United States Patent 7,250,496 (BIOINFORMATICALLY DETECTABLE GROUP OF NOVEL REGULATORY GENES AND USES THEREOF) - sequence listing, part 9

SEQ ID NO: 331829 - RNA, 21 nt, Human
cauuuuccucucaauuggaag

SEQ ID NO: 331830 - RNA, 22 nt, Human
ccaaaaauccacagaugcccag

SEQ ID NO: 331831 - RNA, 23 nt, Human
ccaaaaauccacagaugcccaga

SEQ ID NO: 331832 - RNA, 21 nt, Human
ccaaagugcugggauuacagg

SEQ ID NO: 331833 - RNA, 21 nt, Human
ccaaagugcugggauuacagg

SEQ ID NO: 331834 - RNA, 24 nt, Human
ccaaagugcugggauuacaggugu

SEQ ID NO: 331835 - RNA, 19 nt, Human
ccaagacaagagaaacuua

SEQ ID NO: 331836 - RNA, 26 nt, Human
ccaagacagaaagaaucugaaacaac

SEQ ID NO: 331837 - RNA, 21 nt, Human
ccaaguagcugggauuacagg

SEQ ID NO: 331838 - RNA, 18 nt, Human
ccaagugcugggauuaca

SEQ ID NO: 331839 - RNA, 22 nt, Human
ccaagugcugggauuacaggca

SEQ ID NO: 331840 - RNA, 23 nt, Human
ccaagugcugggauuacaggcau

SEQ ID NO: 331841 - RNA, 26 nt, Human
ccaccugccucagccucccaaagugc

SEQ ID NO: 331842 - RNA, 19 nt, Human
ccagaguagcugggauuac

SEQ ID NO: 331843 - RNA, 20 nt, Human
ccagaguagcugggauuaca

SEQ ID NO: 331844 - RNA, 19 nt, Human
ccaugcugaccagguuggu

SEQ ID NO: 331845 - RNA, 23 nt, Human
ccaugcugaccagguuggucucg

SEQ ID NO: 331846 - RNA, 23 nt, Human
cccaaguagcugggauuacaggu

SEQ ID NO: 331847 - RNA, 24 nt, Human
cccaaguagcugggauuacaggug

SEQ ID NO: 331848 - RNA, 22 nt, Human
cccaagugcugggauuacaggc

SEQ ID NO: 331849 - RNA, 23 nt, Human
cccaagugcugggauuacaggca

SEQ ID NO: 331850 - RNA, 24 nt, Human
cccaagugcugggauuacaggcau

SEQ ID NO: 331851 - RNA, 20 nt, Human
cccaggcugaagcgcaaugg

SEQ ID NO: 331852 - RNA, 23 nt, Human
cccagguucaagugauucuccuc

SEQ ID NO: 331853 - RNA, 23 nt, Human
cccagguucaagugauucuccug

SEQ ID NO: 331854 - RNA, 23 nt, Human
ccccaagugcugggauuacaggc

SEQ ID NO: 331855 - RNA, 21 nt, Human
cccgccaccacgcccagcuaa

SEQ ID NO: 331856 - RNA, 24 nt, Human
ccucccagucucaagcgauucucc

SEQ ID NO: 331857 - RNA, 21 nt, Human
ccugaccucaggcgauccacc

SEQ ID NO: 331858 - RNA, 23 nt, Human
ccugaccucaggcgauccaccug

SEQ ID NO: 331859 - RNA, 23 nt, Human
ccugaccucaggcgauccaccug

SEQ ID NO: 331860 - RNA, 23 nt, Human
ccugccucagccucccaaguagc

SEQ ID NO: 331861 - RNA, 19 nt, Human
ccuucucacaaaauuccgg

SEQ ID NO: 331862 - RNA, 23 nt, Human
ccuucucugucacccaggcugaa

SEQ ID NO: 331863 - RNA, 21 nt, Human
cgaagcaucacagccagcuga

SEQ ID NO: 331864 - RNA, 24 nt, Human
cgggguuucaguauguuggccagg

SEQ ID NO: 331865 - RNA, 24 nt, Human
cgggguuuugccaugcugaccagg

SEQ ID NO: 331866 - RNA, 25 nt, Human
cucaagcgauucucccaccucaguc

SEQ ID NO: 331867 - RNA, 20 nt, Human
cucacaaaauuccggaucac

SEQ ID NO: 331868 - RNA, 24 nt, Human
cucacugcaaccucuaacucccag

SEQ ID NO: 331869 - RNA, 24 nt, Human
cucagccucccaaguagcugggau

SEQ ID NO: 331870 - RNA, 24 nt, Human
cucagucuccagaguagcugggau

SEQ ID NO: 331871 - RNA, 23 nt, Human
cucaugugauccgccugccuugg

SEQ ID NO: 331872 - RNA, 24 nt, Human
cucaugugauccgccugccuuggc

SEQ ID NO: 331873 - RNA, 22 nt, Human
cucccagaacugggauggaaaa

SEQ ID NO: 331874 - RNA, 19 nt, Human
cucccagguucaagugauu

SEQ ID NO: 331875 - RNA, 21 nt, Human
cuccuuacuggacaguaguca

SEQ ID NO: 331876 - RNA, 23 nt, Human
cucugucacccaggcugaagugc

SEQ ID NO: 331877 - RNA, 23 nt, Human
cugcaaccucuaacucccagguu

SEQ ID NO: 331878 - RNA, 24 nt, Human
cugcaaccucuaacucccagguuc

SEQ ID NO: 331879 - RNA, 20 nt, Human
cugcaaccucugccucccag

SEQ ID NO: 331880 - RNA, 22 nt, Human
cugcaaccucugccucccaguc

SEQ ID NO: 331881 - RNA, 23 nt, Human
cugccucagccucccaaagugcu

SEQ ID NO: 331882 - RNA, 24 nt, Human
cugccucagccucccaaagugcug

SEQ ID NO: 331883 - RNA, 23 nt, Human
cugccucagccucccaaguagcu

SEQ ID NO: 331884 - RNA, 23 nt, Human
cugccuuggccuccccaagugcu

SEQ ID NO: 331885 - RNA, 21 nt, Human
cuuuuaguagagacgggguuu

SEQ ID NO: 331886 - RNA, 19 nt, Human
gaauaucaaauggaaaaau

SEQ ID NO: 331887 - RNA, 22 nt, Human
gacaucaacccagaaaccugca

SEQ ID NO: 331888 - RNA, 18 nt, Human
gacaucaacccagaaacu

SEQ ID NO: 331889 - RNA, 24 nt, Human
gaccucaggcgauccaccugccuc

SEQ ID NO: 331890 - RNA, 20 nt, Human
gagacgggguuuugccaugc

SEQ ID NO: 331891 - RNA, 25 nt, Human
gaguagcugggauuacagacacgug

SEQ ID NO: 331892 - RNA, 21 nt, Human
gauccaccugccucagccucc

SEQ ID NO: 331893 - RNA, 20 nt, Human
gaucuugaacuccugaccuc

SEQ ID NO: 331894 - RNA, 18 nt, Human
gauuacagacacgugcca

SEQ ID NO: 331895 - RNA, 18 nt, Human
gauuacaggcaugagcca

SEQ ID NO: 331896 - RNA, 21 nt, Human
gauuacaggcaugagccacca

SEQ ID NO: 331897 - RNA, 24 nt, Human
gauuacaggcaugagccaccaugc

SEQ ID NO: 331898 - RNA, 18 nt, Human
gauuacaggugcccgcca

SEQ ID NO: 331899 - RNA, 18 nt, Human
gauuacaggugugagcca

SEQ ID NO: 331900 - RNA, 21 nt, Human
gauuacaggugugagccacca

SEQ ID NO: 331901 - RNA, 22 nt, Human
gauuacaggugugagccaccac

SEQ ID NO: 331902 - RNA, 21 nt, Human
gauucucccaccucagucucc

SEQ ID NO: 331903 - RNA, 21 nt, Human
gauucuccugccucagccucc

SEQ ID NO: 331904 - RNA, 18 nt, Human
gcgauccaccugccucag

SEQ ID NO: 331905 - RNA, 24 nt, Human
gcgauccaccugccucagccuccc

SEQ ID NO: 331906 - RNA, 24 nt, Human
ggauuacaggcaugagccaccaug

SEQ ID NO: 331907 - RNA, 23 nt, Human
gggguuucaguauguuggccagg

SEQ ID NO: 331908 - RNA, 23 nt, Human
gggguuuugccaugcugaccagg

SEQ ID NO: 331909 - RNA, 23 nt, Human
guagagacgggguuucaguaugu

SEQ ID NO: 331910 - RNA, 21 nt, Human
guagagacgggguuuugccau

SEQ ID NO: 331911 - RNA, 22 nt, Human
guagcugggauuacagacacgu

SEQ ID NO: 331912 - RNA, 18 nt, Human
guagcugggauuacaggu

SEQ ID NO: 331913 - RNA, 23 nt, Human
guagguuauaaaucaccauccua

SEQ ID NO: 331914 - RNA, 24 nt, Human
gugauucuccugccucagccuccc

SEQ ID NO: 331915 - RNA, 23 nt, Human
guggcaugaucucgguucacugc

SEQ ID NO: 331916 - RNA, 24 nt, Human
uaaaauggucaggugggcaaccaa

SEQ ID NO: 331917 - RNA, 28 nt, Human
uaacucccagguucaagugauucuccuu

SEQ ID NO: 331918 - RNA, 20 nt, Human
uaagugccuacauguucaca

SEQ ID NO: 331919 - RNA, 24 nt, Human
uaauuuuucuuauuuuuaguagag

SEQ ID NO: 331920 - RNA, 25 nt, Human
uaauuuuucuuauuuuuaguagaga

SEQ ID NO: 331921 - RNA, 24 nt, Human
uaauuuuuguacuuuuaguagaga

SEQ ID NO: 331922 - RNA, 22 nt, Human
uacagacacgugccaucacgcc

SEQ ID NO: 331923 - RNA, 23 nt, Human
uacaggcaugagccaccaugccc

SEQ ID NO: 331924 - RNA, 24 nt, Human
uacaggugcccgccaccacgccca

SEQ ID NO: 331925 - RNA, 22 nt, Human
uacaggugugagccaccacgcc

SEQ ID NO: 331926 - RNA, 22 nt, Human
uacaggugugagccaccacgcc

SEQ ID NO: 331927 - RNA, 23 nt, Human
uacaggugugagccaccacgccu

SEQ ID NO: 331928 - RNA, 20 nt, Human
uagagacgggguuuugccau

SEQ ID NO: 331929 - RNA, 22 nt, Human
uagccaaaaauccacagaugcc

SEQ ID NO: 331930 - RNA, 19 nt, Human
uaguagagacgggguuuca

SEQ ID NO: 331931 - RNA, 23 nt, Human
uaguagagacgggguuucaguau

SEQ ID NO: 331932 - RNA, 24 nt, Human
uaguagagacgggguuucaguaug

SEQ ID NO: 331933 - RNA, 24 nt, Human
uaguagagacgggguuuugccaug

SEQ ID NO: 331934 - RNA, 20 nt, Human
uaugacuaagugccuacaug

SEQ ID NO: 331935 - RNA, 23 nt, Human
uaugacuaagugccuacauguuc

SEQ ID NO: 331936 - RNA, 19 nt, Human
ucaagugauucuccugccu

SEQ ID NO: 331937 - RNA, 22 nt, Human
ucacaaaauuccggaucacaaa

SEQ ID NO: 331938 - RNA, 23 nt, Human
ucacucuuguugcccaggcugaa

SEQ ID NO: 331939 - RNA, 19 nt, Human
ucacugcaaccucuaacuc

SEQ ID NO: 331940 - RNA, 24 nt, Human
ucacugcaaccucuaacucccagg

SEQ ID NO: 331941 - RNA, 19 nt, Human
ucacugcaaccucugccuc

SEQ ID NO: 331942 - RNA, 23 nt, Human
ucacugcaaccucugccucccag

SEQ ID NO: 331943 - RNA, 24 nt, Human
ucacugcaaccucugccucccagu

SEQ ID NO: 331944 - RNA, 27 nt, Human
ucacugcaaccucugccucccagucuc

SEQ ID NO: 331945 - RNA, 20 nt, Human
ucagaaguaggugagaauua

SEQ ID NO: 331946 - RNA, 20 nt, Human
ucagccucccaaguagcugg

SEQ ID NO: 331947 - RNA, 26 nt, Human
uccaagacagaaagaaucugaaacaa

SEQ ID NO: 331948 - RNA, 20 nt, Human
uccacagaugcccagacccc

SEQ ID NO: 331949 - RNA, 23 nt, Human
ucccaaagugcugggauuacagg

SEQ ID NO: 331950 - RNA, 23 nt, Human
ucccaaguagcugggauuacagg

SEQ ID NO: 331951 - RNA, 24 nt, Human
ucccaaguagcugggauuacaggu

SEQ ID NO: 331952 - RNA, 21 nt, Human
ucccagguucaagugauucuc

SEQ ID NO: 331953 - RNA, 24 nt, Human
ucccagguucaagugauucuccug

SEQ ID NO: 331954 - RNA, 21 nt, Human
ucccagucucaagcgauucuc

SEQ ID NO: 331955 - RNA, 24 nt, Human
uccccaagugcugggauuacaggc

SEQ ID NO: 331956 - RNA, 24 nt, Human
uccuucucugucacccaggcugaa

SEQ ID NO: 331957 - RNA, 26 nt, Human
ucuccugccucagccucccaaguagc

SEQ ID NO: 331958 - RNA, 18 nt, Human
ucucucuuuucuucuucc

SEQ ID NO: 331959 - RNA, 23 nt, Human
ucuugaacuccugaccucaggcg

SEQ ID NO: 331960 - RNA, 19 nt, Human
ugaagcgcaauggugugau

SEQ ID NO: 331961 - RNA, 23 nt, Human
ugaagcgcaauggugugaucuca

SEQ ID NO: 331962 - RNA, 19 nt, Human
ugaagugcgguggcaugau

SEQ ID NO: 331963 - RNA, 23 nt, Human
ugaagugcgguggcaugaucucg

SEQ ID NO: 331964 - RNA, 24 nt, Human
ugaagugcgguggcaugaucucgg

SEQ ID NO: 331965 - RNA, 24 nt, Human
ugaccagguuggucucgaauuccu

SEQ ID NO: 331966 - RNA, 21 nt, Human
ugaccucaggcgauccaccug

SEQ ID NO: 331967 - RNA, 24 nt, Human
ugaccucaggcgauccaccugccu

SEQ ID NO: 331968 - RNA, 22 nt, Human
ugagaagaucuuacaccgaagg

SEQ ID NO: 331969 - RNA, 22 nt, Human
ugagacggaguccuucucuguc

SEQ ID NO: 331970 - RNA, 20 nt, Human
ugauucuccugccucagccu

SEQ ID NO: 331971 - RNA, 18 nt, Human
ugauuucuaauccuucuc

SEQ ID NO: 331972 - RNA, 22 nt, Human
ugccaugcugaccagguugguc

SEQ ID NO: 331973 - RNA, 24 nt, Human
ugccaugcugaccagguuggucuc

SEQ ID NO: 331974 - RNA, 21 nt, Human
ugcccaggcugaagcgcaaug

SEQ ID NO: 331975 - RNA, 24 nt, Human
ugccucagccucccaaagugcugg

SEQ ID NO: 331976 - RNA, 24 nt, Human
ugccucagccucccaaguagcugg

SEQ ID NO: 331977 - RNA, 24 nt, Human
ugcugauuucuaauccuucucaca

SEQ ID NO: 331978 - RNA, 24 nt, Human
ugcugggauuacaggugugagcca

SEQ ID NO: 331979 - RNA, 24 nt, Human
uggccagguugaucuugaacuccu

SEQ ID NO: 331980 - RNA, 18 nt, Human
uggccucaugugauccgc

SEQ ID NO: 331981 - RNA, 21 nt, Human
ugggauggaaaauaagccaaa

SEQ ID NO: 331982 - RNA, 19 nt, Human
ugggauuacagacacgugc

SEQ ID NO: 331983 - RNA, 21 nt, Human
ugggauuacagacacgugcca

SEQ ID NO: 331984 - RNA, 22 nt, Human
ugggauuacagacacgugccau

SEQ ID NO: 331985 - RNA, 24 nt, Human
ugggauuacagacacgugccauca

SEQ ID NO: 331986 - RNA, 24 nt, Human
ugggauuacagacacgugccauca

SEQ ID NO: 331987 - RNA, 18 nt, Human
ugggauuacaggcaugag

SEQ ID NO: 331988 - RNA, 22 nt, Human
ugggauuacaggcaugagccac

SEQ ID NO: 331989 - RNA, 23 nt, Human
ugggauuacaggcaugagccacc

SEQ ID NO: 331990 - RNA, 24 nt, Human
ugggauuacaggcaugagccacca

SEQ ID NO: 331991 - RNA, 25 nt, Human
ugggauuacaggcaugagccaccau

SEQ ID NO: 331992 - RNA, 21 nt, Human
ugggauuacaggugcccgcca

SEQ ID NO: 331993 - RNA, 22 nt, Human
ugggauuacaggugcccgccac

SEQ ID NO: 331994 - RNA, 24 nt, Human
ugggauuacaggugcccgccacca

SEQ ID NO: 331995 - RNA, 18 nt, Human
ugggauuacaggugugag

SEQ ID NO: 331996 - RNA, 19 nt, Human
ugggauuacaggugugagc

SEQ ID NO: 331997 - RNA, 22 nt, Human
ugggauuacaggugugagccac

SEQ ID NO: 331998 - RNA, 23 nt, Human
ugggauuacaggugugagccacc

SEQ ID NO: 331999 - RNA, 24 nt, Human
ugggauuacaggugugagccacca

SEQ ID NO: 332000 - RNA, 24 nt, Human
uggugugaucucagcucacugcaa

SEQ ID NO: 332001 - RNA, 20 nt, Human
ugucacccaggcugaagugc

SEQ ID NO: 332002 - RNA, 20 nt, Human
ugugaaaggcuaauccagga

SEQ ID NO: 332003 - RNA, 22 nt, Human
uuaaaagaccucccagaacugg

SEQ ID NO: 332004 - RNA, 18 nt, Human
uuaguagagacgggguuu

SEQ ID NO: 332005 - RNA, 18 nt, Human
uuaguagagacgggguuu

SEQ ID NO: 332006 - RNA, 20 nt, Human
uuaguagagacgggguuuca

SEQ ID NO: 332007 - RNA, 24 nt, Human
uuaguagagacgggguuucaguau

SEQ ID NO: 332008 - RNA, 22 nt, Human
uuaguagagacgggguuuugcc

SEQ ID NO: 332009 - RNA, 24 nt, Human
uuaguagagacgggguuuugccau

SEQ ID NO: 332010 - RNA, 21 nt, Human
uucaagugauucuccugccuc

SEQ ID NO: 332011 - RNA, 23 nt, Human
uucaagugauucuccugccucag

SEQ ID NO: 332012 - RNA, 24 nt, Human
uucaagugauucuccugccucagc

SEQ ID NO: 332013 - RNA, 24 nt, Human
uucacucuuguugcccaggcugaa

SEQ ID NO: 332014 - RNA, 18 nt, Human
uuccuaccccaggcuagg

SEQ ID NO: 332015 - RNA, 21 nt, Human
uucgaagcaucacagccagcu

SEQ ID NO: 332016 - RNA, 23 nt, Human
uucgaagcaucacagccagcuga

SEQ ID NO: 332017 - RNA, 23 nt, Human
uuguugcccaggcugaagcgcaa

SEQ ID NO: 332018 - RNA, 27 nt, Human
uuuaacaaacuucccagguauucccuu

SEQ ID NO: 332019 - RNA, 24 nt, Human
uuucacucuuguugcccaggcuga

SEQ ID NO: 332020 - RNA, 19 nt, Human
uuucaguauguuggccagg

SEQ ID NO: 332021 - RNA, 20 nt, Human
uuucaguauguuggccaggu

SEQ ID NO: 332022 - RNA, 20 nt, Human
uuuuaguagagacgggguuu

SEQ ID NO: 332023 - RNA, 21 nt, Human
uuuuguacuuuuaguagagac

SEQ ID NO: 332024 - RNA, 22 nt, Human
uuuuuaguagagacgggguuuc

SEQ ID NO: 332025 - RNA, 24 nt, Human
uuuuucuuauuuuuaguagagacg

SEQ ID NO: 332026 - RNA, 20 nt, Human
uuuuuguacuuuuaguagag

SEQ ID NO: 332027 - RNA, 18 nt, Human
uuuuuucuuuuuuuuuug

SEQ ID NO: 332028 - RNA, 18 nt, Human
aaggguagggggcagggc

SEQ ID NO: 332029 - RNA, 22 nt, Human
cuccauucuuuauucaguccca

SEQ ID NO: 332030 - RNA, 20 nt, Human
ggcaaggguagggggcaggg

SEQ ID NO: 332031 - RNA, 23 nt, Human
ugagaggggccucuccauucuuu

SEQ ID NO: 332032 - RNA, 21 nt, Human
aaauguuaaaauggcaaaacu

SEQ ID NO: 332033 - RNA, 19 nt, Human
aagcacuucaaauacagaa

SEQ ID NO: 332034 - RNA, 21 nt, Human
aagcagaaaauaaaauaccgg

SEQ ID NO: 332035 - RNA, 19 nt, Human
acagggaaaggagagagca

SEQ ID NO: 332036 - RNA, 20 nt, Human
agaauaacaggacuucagaa

SEQ ID NO: 332037 - RNA, 22 nt, Human
auacacaaagaacuguagucag

SEQ ID NO: 332038 - RNA, 21 nt, Human
caaguagaaaccuagaguuau

SEQ ID NO: 332039 - RNA, 26 nt, Human
cagaauaaaaagcagaaaauaaaaua

SEQ ID NO: 332040 - RNA, 24 nt, Human
caggacuucagaauaaaaagcaga

SEQ ID NO: 332041 - RNA, 21 nt, Human
cuguagucagaauaacaggac

SEQ ID NO: 332042 - RNA, 22 nt, Human
gauaagcacuucaaauacagaa

SEQ ID NO: 332043 - RNA, 24 nt, Human
ggaaaaaucaaguagaaaccuaga

SEQ ID NO: 332044 - RNA, 28 nt, Human
uaacagacacagaaguauacacaaagaa

SEQ ID NO: 332045 - RNA, 18 nt, Human
uaacagggaaaggagaga

SEQ ID NO: 332046 - RNA, 23 nt, Human
uaagcacuucaaauacagaaaug

SEQ ID NO: 332047 - RNA, 21 nt, Human
uagaacagaugaaagguagug

SEQ ID NO: 332048 - RNA, 22 nt, Human
uagucagaauaacaggacuuca

SEQ ID NO: 332049 - RNA, 22 nt, Human
uaugcaacuuucaauucaauga

SEQ ID NO: 332050 - RNA, 19 nt, Human
ucagaauaacaggacuuca

SEQ ID NO: 332051 - RNA, 22 nt, Human
ugaaagguauacaugggggaaa

SEQ ID NO: 332052 - RNA, 22 nt, Human
ugugcaucauuuaauucaugua

SEQ ID NO: 332053 - RNA, 21 nt, Human
uuaaaauggcaaaacuauacu

SEQ ID NO: 332054 - RNA, 19 nt, Human
uucagaauaaaaagcagaa

SEQ ID NO: 332055 - RNA, 20 nt, Human
uuuaacacaauauacaaaau

SEQ ID NO: 332056 - RNA, 20 nt, Human
uuucaucaguuaacauucuu

SEQ ID NO: 332057 - RNA, 26 nt, Human
aaaaaggaaauagaaaugagggaccc

SEQ ID NO: 332058 - RNA, 24 nt, Human
aaaaggcagaauagcaaccugaua

SEQ ID NO: 332059 - RNA, 20 nt, Human
aaacuccaugaggaccaugc

SEQ ID NO: 332060 - RNA, 22 nt, Human
aagcacagugucccaaaacugg

SEQ ID NO: 332061 - RNA, 25 nt, Human
aagugauccucccaccugagccucc

SEQ ID NO: 332062 - RNA, 25 nt, Human
aagugauccucccaccugagccucc

SEQ ID NO: 332063 - RNA, 22 nt, Human
aaucugcuucucaccuucuagg

SEQ ID NO: 332064 - RNA, 20 nt, Human
aaugaggaagcaacuagaaa

SEQ ID NO: 332065 - RNA, 20 nt, Human
acaauggaagggacuucaga

SEQ ID NO: 332066 - RNA, 18 nt, Human
acagacaagaaggcagcg

SEQ ID NO: 332067 - RNA, 21 nt, Human
acagagccuagggagaaugcc

SEQ ID NO: 332068 - RNA, 24 nt, Human
acccucauauccuacacccuccac

SEQ ID NO: 332069 - RNA, 25 nt, Human
acuauguugcccaggcuagucucaa

SEQ ID NO: 332070 - RNA, 26 nt, Human
acucuguugcccaggcuggagugcca

SEQ ID NO: 332071 - RNA, 22 nt, Human
acucuguuuuucugcacaugcc

SEQ ID NO: 332072 - RNA, 22 nt, Human
agaaaaaggcagauuucaacua

SEQ ID NO: 332073 - RNA, 22 nt, Human
agaaggcagcggaacaguuaua

SEQ ID NO: 332074 - RNA, 21 nt, Human
agagagccugaguaaacagcc

SEQ ID NO: 332075 - RNA, 21 nt, Human
agagcagccccggagcuaugg

SEQ ID NO: 332076 - RNA, 20 nt, Human
agaugggguuaaaaucugcu

SEQ ID NO: 332077 - RNA, 25 nt, Human
agcaacuagaaaacaauggaaggga

SEQ ID NO: 332078 - RNA, 20 nt, Human
agccagggcuggguuuuccu

SEQ ID NO: 332079 - RNA, 18 nt, Human
aggcagaauagcaaccug

SEQ ID NO: 332080 - RNA, 25 nt, Human
agugauccucccaccugagccuccc

SEQ ID NO: 332081 - RNA, 18 nt, Human
agugguuuaaauacugag

SEQ ID NO: 332082 - RNA, 20 nt, Human
auauauuuuuuuguuguuaa

SEQ ID NO: 332083 - RNA, 24 nt, Human
aucacaaggguagccauacaacaa

SEQ ID NO: 332084 - RNA, 18 nt, Human
auccucccaccugagccu

SEQ ID NO: 332085 - RNA, 21 nt, Human
auccuggguuggcacagagau

SEQ ID NO: 332086 - RNA, 22 nt, Human
augcuuagcuuagguucuggcu

SEQ ID NO: 332087 - RNA, 18 nt, Human
auggggucucacuauguu

SEQ ID NO: 332088 - RNA, 19 nt, Human
auggggucucacuauguug

SEQ ID NO: 332089 - RNA, 24 nt, Human
auggggucucacuauguugcccag

SEQ ID NO: 332090 - RNA, 23 nt, Human
caaaggccuaacccucauauccu

SEQ ID NO: 332091 - RNA, 27 nt, Human
caauugcuuacuaaagcucauucaggc

SEQ ID NO: 332092 - RNA, 23 nt, Human
cacagacaagaaggcagcggaac

SEQ ID NO: 332093 - RNA, 24 nt, Human
cacagagauuccaguugaaccaaa

SEQ ID NO: 332094 - RNA, 20 nt, Human
caccugagccucccaaguag

SEQ ID NO: 332095 - RNA, 20 nt, Human
cacuauguugcccaggcuag

SEQ ID NO: 332096 - RNA, 24 nt, Human
cacuauguugcccaggcuagucuc

SEQ ID NO: 332097 - RNA, 27 nt, Human
cacuauguugcccaggcuagucucaaa

SEQ ID NO: 332098 - RNA, 20 nt, Human
cacucucauucuaagagagg

SEQ ID NO: 332099 - RNA, 24 nt, Human
cacucuguugcccaggcuggagug

SEQ ID NO: 332100 - RNA, 18 nt, Human
cagcggaacaguuauacc

SEQ ID NO: 332101 - RNA, 24 nt, Human
cagggucucacucuguugcccagg

SEQ ID NO: 332102 - RNA, 23 nt, Human
ccaaaacuccaugaggaccaugc

SEQ ID NO: 332103 - RNA, 21 nt, Human
ccaaaacugggggaaaaggga

SEQ ID NO: 332104 - RNA, 18 nt, Human
ccagguaauuuuguucau

SEQ ID NO: 332105 - RNA, 22 nt, Human
cccaaguagcagggacuacagg

SEQ ID NO: 332106 - RNA, 20 nt, Human
cccaggcuggagugccagug

SEQ ID NO: 332107 - RNA, 22 nt, Human
ccccugggcaaaacagagccua

SEQ ID NO: 332108 - RNA, 24 nt, Human
ccuacacccuccacucucauucua

SEQ ID NO: 332109 - RNA, 26 nt, Human
ccucccaccugagccucccaaguagc

SEQ ID NO: 332110 - RNA, 23 nt, Human
cuagucucaaacucaauuuaaaa

SEQ ID NO: 332111 - RNA, 24 nt, Human
cucaagugauccucccaccugagc

SEQ ID NO: 332112 - RNA, 24 nt, Human
cucacucuguugcccaggcuggag

SEQ ID NO: 332113 - RNA, 19 nt, Human
cucauauccuacacccucc

SEQ ID NO: 332114 - RNA, 19 nt, Human
cucauauccuacacccucc

SEQ ID NO: 332115 - RNA, 23 nt, Human
cucccaccugagccucccaagua

SEQ ID NO: 332116 - RNA, 24 nt, Human
cuggguuggcacagagauuccagu

SEQ ID NO: 332117 - RNA, 18 nt, Human
cuucuaggcuguagcagu

SEQ ID NO: 332118 - RNA, 20 nt, Human
cuugccuaugaacaaaagaa

SEQ ID NO: 332119 - RNA, 21 nt, Human
cuugugaugugaggggccaug

SEQ ID NO: 332120 - RNA, 21 nt, Human
gacuacagguauacaccacua

SEQ ID NO: 332121 - RNA, 20 nt, Human
gagaaaaaggcagauuucaa

SEQ ID NO: 332122 - RNA, 22 nt, Human
gaggcauguacuugaggcuuua

SEQ ID NO: 332123 - RNA, 25 nt, Human
gcccaggcuggagugccaguggugu

SEQ ID NO: 332124 - RNA, 20 nt, Human
gcuuacugcagccaccaucu

SEQ ID NO: 332125 - RNA, 20 nt, Human
ggaaaaacacaguucucuca

SEQ ID NO: 332126 - RNA, 24 nt, Human
ggacuacagguauacaccacuaug

SEQ ID NO: 332127 - RNA, 20 nt, Human
ggagaaugccagggaagaga

SEQ ID NO: 332128 - RNA, 23 nt, Human
ggcuggagugccaguggugugau

SEQ ID NO: 332129 - RNA, 21 nt, Human
gggcucaagugauccucccac

SEQ ID NO: 332130 - RNA, 22 nt, Human
gggucucacuauguugcccagg

SEQ ID NO: 332131 - RNA, 23 nt, Human
gguaagcacagugucccaaaacu

SEQ ID NO: 332132 - RNA, 24 nt, Human
gugccaguggugugaucuuggcuu

SEQ ID NO: 332133 - RNA, 23 nt, Human
uaaaaagaaacuacaagauuuca

SEQ ID NO: 332134 - RNA, 25 nt, Human
uaaauagagauggggucucacuaug

SEQ ID NO: 332135 - RNA, 22 nt, Human
uaagcacagugucccaaaacug

SEQ ID NO: 332136 - RNA, 22 nt, Human
uacaacaaagucacucucagau

SEQ ID NO: 332137 - RNA, 24 nt, Human
uacagguauacaccacuaugccca

SEQ ID NO: 332138 - RNA, 20 nt, Human
uacuaaagcucauucaggcu

SEQ ID NO: 332139 - RNA, 19 nt, Human
uacuagggcaacauuuggc

SEQ ID NO: 332140 - RNA, 22 nt, Human
uagagauggggucucacuaugu

SEQ ID NO: 332141 - RNA, 20 nt, Human
uagaggcaucuacuuggguu

SEQ ID NO: 332142 - RNA, 21 nt, Human
uaguagagguggugacaggag

SEQ ID NO: 332143 - RNA, 24 nt, Human
uauaaaaagaaacuacaagauuuc

SEQ ID NO: 332144 - RNA, 23 nt, Human
uauccuacacccuccacucucau

SEQ ID NO: 332145 - RNA, 23 nt, Human
uauguugcccaggcuagucucaa

SEQ ID NO: 332146 - RNA, 24 nt, Human
uauguugcccaggcuagucucaaa

SEQ ID NO: 332147 - RNA, 23 nt, Human
ucaaaaaaggaaauagaaaugac

SEQ ID NO: 332148 - RNA, 25 nt, Human
ucaauugcuuacuaaagcucauuca

SEQ ID NO: 332149 - RNA, 23 nt, Human
ucaccuucuaggcuguagcagug

SEQ ID NO: 332150 - RNA, 24 nt, Human
ucacucuguugcccaggcuggagu

SEQ ID NO: 332151 - RNA, 24 nt, Human
uccaaaguaauguuucugguuagu

SEQ ID NO: 332152 - RNA, 20 nt, Human
uccacucucauucuaagaga

SEQ ID NO: 332153 - RNA, 23 nt, Human
ucccaaguagcagggacuacagg

SEQ ID NO: 332154 - RNA, 24 nt, Human
uccuacacccuccacucucauucu

SEQ ID NO: 332155 - RNA, 19 nt, Human
ucucacuauguugcccagg

SEQ ID NO: 332156 - RNA, 26 nt, Human
ucucacuauguugcccaggcuagucu

SEQ ID NO: 332157 - RNA, 27 nt, Human
ucucacuauguugcccaggcuagucuc

SEQ ID NO: 332158 - RNA, 23 nt, Human
ucucacucuguugcccaggcugg

SEQ ID NO: 332159 - RNA, 24 nt, Human
ucucacucuguugcccaggcugga

SEQ ID NO: 332160 - RNA, 18 nt, Human
ugaaaaggcagaauagca

SEQ ID NO: 332161 - RNA, 22 nt, Human
ugaaccaaaacuccaugaggac

SEQ ID NO: 332162 - RNA, 23 nt, Human
ugaaccaaaacuccaugaggacc

SEQ ID NO: 332163 - RNA, 21 nt, Human
ugaccguuugucggaaaaaca

SEQ ID NO: 332164 - RNA, 20 nt, Human
ugagacagggucucacucug

SEQ ID NO: 332165 - RNA, 22 nt, Human
ugagacagggucucacucuguu

SEQ ID NO: 332166 - RNA, 21 nt, Human
ugaugugaggggccaugugcc

SEQ ID NO: 332167 - RNA, 22 nt, Human
ugcaaaacugugcccaaggcca

SEQ ID NO: 332168 - RNA, 22 nt, Human
ugcccaggcuggagugccagug

SEQ ID NO: 332169 - RNA, 25 nt, Human
ugcccaggcuggagugccaguggug

SEQ ID NO: 332170 - RNA, 21 nt, Human
ugcucaaacaugguauuagag

SEQ ID NO: 332171 - RNA, 20 nt, Human
uggaagggacuucagauggu

SEQ ID NO: 332172 - RNA, 20 nt, Human
uggagauggagcugaguacc

SEQ ID NO: 332173 - RNA, 19 nt, Human
uggagugccagugguguga

SEQ ID NO: 332174 - RNA, 25 nt, Human
uggagugccaguggugugaucuugg

SEQ ID NO: 332175 - RNA, 19 nt, Human
uggcaaaggccuaacccuc

SEQ ID NO: 332176 - RNA, 18 nt, Human
uggcacagacaagaaggc

SEQ ID NO: 332177 - RNA, 23 nt, Human
uggcacagacaagaaggcagcgg

SEQ ID NO: 332178 - RNA, 22 nt, Human
uggcuuacugcagccaccaucu

SEQ ID NO: 332179 - RNA, 24 nt, Human
uggggcucaagugauccucccacc

SEQ ID NO: 332180 - RNA, 24 nt, Human
uggggucucacuauguugcccagg

SEQ ID NO: 332181 - RNA, 24 nt, Human
ugguauuagagaugcauccaaagu

SEQ ID NO: 332182 - RNA, 24 nt, Human
ugucccaaaacugggggaaaaggg

SEQ ID NO: 332183 - RNA, 22 nt, Human
uuaaagaagucuugccuaugaa

SEQ ID NO: 332184 - RNA, 23 nt, Human
uuacugcagccaccaucuuuggg

SEQ ID NO: 332185 - RNA, 18 nt, Human
uuacuguagaucacaagg

SEQ ID NO: 332186 - RNA, 18 nt, Human
uucaagggaagagggacc

SEQ ID NO: 332187 - RNA, 22 nt, Human
uugagacagggucucacucugu

SEQ ID NO: 332188 - RNA, 18 nt, Human
uugcccaggcuggagugc

SEQ ID NO: 332189 - RNA, 20 nt, Human
uuggggcucaagugauccuc

SEQ ID NO: 332190 - RNA, 22 nt, Human
uuguucauuuuuuaaauagaga

SEQ ID NO: 332191 - RNA, 23 nt, Human
uuugcuccugacuuguguggaua

SEQ ID NO: 332192 - RNA, 21 nt, Human
uuuuguauaauguggcaaagg

SEQ ID NO: 332193 - RNA, 22 nt, Human
uuuuguuaugugucaucauagc

SEQ ID NO: 332194 - RNA, 25 nt, Human
aaaaaaaaggacagccucuuuaugc

SEQ ID NO: 332195 - RNA, 26 nt, Human
aaaaacaaaaacaaaaacaccaaaag

SEQ ID NO: 332196 - RNA, 18 nt, Human
aaaaacaaaaacaccaaa

SEQ ID NO: 332197 - RNA, 23 nt, Human
aaaaacaaaacccuauuaauaaa

SEQ ID NO: 332198 - RNA, 20 nt, Human
aaaaacaccaaaaaacaccu

SEQ ID NO: 332199 - RNA, 22 nt, Human
aaaaacauacuagcaagccaca

SEQ ID NO: 332200 - RNA, 22 nt, Human
aaaaacauacuagcaagccaca

SEQ ID NO: 332201 - RNA, 24 nt, Human
aaaaaggaaacaauaaaaacaaaa

SEQ ID NO: 332202 - RNA, 24 nt, Human
aaaaaggaaacaauaaaaacaaaa

SEQ ID NO: 332203 - RNA, 19 nt, Human
aaaacaaaaacaaaaacaa

SEQ ID NO: 332204 - RNA, 22 nt, Human
aaaacaaaaacaaaaacaaaaa

SEQ ID NO: 332205 - RNA, 27 nt, Human
aaaacaaaaacaaaaacaaaaacacca

SEQ ID NO: 332206 - RNA, 21 nt, Human
aaaagggcuccacccaccccu

SEQ ID NO: 332207 - RNA, 18 nt, Human
aaaauuagcugggcgugg

SEQ ID NO: 332208 - RNA, 22 nt, Human
aaacaaaaacaaaaacaccaaa

SEQ ID NO: 332209 - RNA, 23 nt, Human
aaacaaaaacaaaaacaccaaaa

SEQ ID NO: 332210 - RNA, 19 nt, Human
aaacaaacaaaccagauga

SEQ ID NO: 332211 - RNA, 23 nt, Human
aaacaauaaaaacaaaacccuau

SEQ ID NO: 332212 - RNA, 23 nt, Human
aaacaauaaaaacaaaacccuau

SEQ ID NO: 332213 - RNA, 25 nt, Human
aaagaaaacaaaaacaaaaacaaaa

SEQ ID NO: 332214 - RNA, 21 nt, Human
aacaaaacccuauuaauaaac

SEQ ID NO: 332215 - RNA, 21 nt, Human
aacaaaacccuauuaauaaac

SEQ ID NO: 332216 - RNA, 19 nt, Human
aacauggugaaaccccguc

SEQ ID NO: 332217 - RNA, 20 nt, Human
aacauggugaaaccccgucu

SEQ ID NO: 332218 - RNA, 21 nt, Human
aacauggugaaaccccgucuc

SEQ ID NO: 332219 - RNA, 18 nt, Human
aacguagggaaaggaugg

SEQ ID NO: 332220 - RNA, 22 nt, Human
aagaaaacaaaaacaaaaacaa

SEQ ID NO: 332221 - RNA, 21 nt, Human
aagaggaaaaaagaugggaga

SEQ ID NO: 332222 - RNA, 26 nt, Human
acaaaaacaaaaacaccaaaaaacac

SEQ ID NO: 332223 - RNA, 22 nt, Human
acaaaaacaccaaaaaacaccu

SEQ ID NO: 332224 - RNA, 20 nt, Human
acagagcgagacuccgucuc

SEQ ID NO: 332225 - RNA, 21 nt, Human
acagagcgagacuccgucuca

SEQ ID NO: 332226 - RNA, 24 nt, Human
accccgucucuacuaaaaauacaa

SEQ ID NO: 332227 - RNA, 22 nt, Human
acucagcugugggugggggggu

SEQ ID NO: 332228 - RNA, 23 nt, Human
acugcacuccagccuggcgacag

SEQ ID NO: 332229 - RNA, 25 nt, Human
acugcacuccagccuggcgacagag

SEQ ID NO: 332230 - RNA, 24 nt, Human
acugcgccacugcacuccagccug

SEQ ID NO: 332231 - RNA, 18 nt, Human
agaagcccaaggaauugu

SEQ ID NO: 332232 - RNA, 21 nt, Human
agaaucguuugaaccagggag

SEQ ID NO: 332233 - RNA, 23 nt, Human
agaguuugcuggugcugaccuca

SEQ ID NO: 332234 - RNA, 20 nt, Human
agaugauuggggccgggcgc

SEQ ID NO: 332235 - RNA, 24 nt, Human
agcacuuugggaggccgaggcggg

SEQ ID NO: 332236 - RNA, 22 nt, Human
agccacaaguaccagagagggg

SEQ ID NO: 332237 - RNA, 23 nt, Human
agccacaaguaccagagaggggu

SEQ ID NO: 332238 - RNA, 21 nt, Human
agccuggcgacagagcgagac

SEQ ID NO: 332239 - RNA, 23 nt, Human
agccuggcgacagagcgagacuc

SEQ ID NO: 332240 - RNA, 21 nt, Human
agcuaggccugucaccugcug

SEQ ID NO: 332241 - RNA, 24 nt, Human
aggaaaaaagaugggagaaaacgu

SEQ ID NO: 332242 - RNA, 22 nt, Human
aggaaacaauaaaaacaaaacc

SEQ ID NO: 332243 - RNA, 22 nt, Human
aggaaacaauaaaaacaaaacc

SEQ ID NO: 332244 - RNA, 22 nt, Human
aggcaggagaaucguuugaacc

SEQ ID NO: 332245 - RNA, 24 nt, Human
aggcaggagaaucguuugaaccag

SEQ ID NO: 332246 - RNA, 21 nt, Human
aggccgaggcgggcggaucac

SEQ ID NO: 332247 - RNA, 23 nt, Human
aggccgaggcgggcggaucacga

SEQ ID NO: 332248 - RNA, 24 nt, Human
aggcgggcggaucacgaggugagg

SEQ ID NO: 332249 - RNA, 20 nt, Human
aggcugaggcaggagaaucg

SEQ ID NO: 332250 - RNA, 24 nt, Human
aggcugaggcaggagaaucguuug

SEQ ID NO: 332251 - RNA, 19 nt, Human
agguagaagaggggauggc

SEQ ID NO: 332252 - RNA, 24 nt, Human
agucagagguugcagcgagccgag

SEQ ID NO: 332253 - RNA, 18 nt, Human
aguuguugaagggaaggg

SEQ ID NO: 332254 - RNA, 19 nt, Human
augccuguaaucccagcac

SEQ ID NO: 332255 - RNA, 25 nt, Human
caaaaacaaaaacaaaaacaccaaa

SEQ ID NO: 332256 - RNA, 27 nt, Human
caaaaacaaaaacaaaaacaccaaaaa

SEQ ID NO: 332257 - RNA, 24 nt, Human
caaaaacaaaaacaccaaaaaaca

SEQ ID NO: 332258 - RNA, 20 nt, Human
caaaaacaccaaaaaacacc

SEQ ID NO: 332259 - RNA, 21 nt, Human
caaaaacaccaaaaaacaccu

SEQ ID NO: 332260 - RNA, 20 nt, Human
caaagaaacaaacaaaccag

SEQ ID NO: 332261 - RNA, 22 nt, Human
caacauggugaaaccccgucuc

SEQ ID NO: 332262 - RNA, 24 nt, Human
caacauggugaaaccccgucucua

SEQ ID NO: 332263 - RNA, 19 nt, Human
caagccacaaguaccagag

SEQ ID NO: 332264 - RNA, 19 nt, Human
caagccacaaguaccagag

SEQ ID NO: 332265 - RNA, 22 nt, Human
cacuccagccuggcgacagagc

SEQ ID NO: 332266 - RNA, 23 nt, Human
cacuccagccuggcgacagagcg

SEQ ID NO: 332267 - RNA, 18 nt, Human
cacugcacuccagccugg

SEQ ID NO: 332268 - RNA, 18 nt, Human
cacugcacuccagccugg

SEQ ID NO: 332269 - RNA, 22 nt, Human
cacugcacuccagccuggcgac

SEQ ID NO: 332270 - RNA, 23 nt, Human
cacugcacuccagccuggcgaca

SEQ ID NO: 332271 - RNA, 23 nt, Human
cacugcacuccagccuggcgaca

SEQ ID NO: 332272 - RNA, 20 nt, Human
cagaguuugcuggugcugac

SEQ ID NO: 332273 - RNA, 24 nt, Human
cagcacuuugggaggccgaggcgg

SEQ ID NO: 332274 - RNA, 24 nt, Human
cagccacucgggaggcugaggcag

SEQ ID NO: 332275 - RNA, 18 nt, Human
cagcccaagggaggggag

SEQ ID NO: 332276 - RNA, 19 nt, Human
cagcuuuaccuagaagagc

SEQ ID NO: 332277 - RNA, 23 nt, Human
caggagaagcccaaggaauuguc

SEQ ID NO: 332278 - RNA, 18 nt, Human
caguccucagccucccac

SEQ ID NO: 332279 - RNA, 18 nt, Human
caguccucagccucccac

SEQ ID NO: 332280 - RNA, 21 nt, Human
cauaucugcuagcucuccucu

SEQ ID NO: 332281 - RNA, 21 nt, Human
cauaucugcuagcucuccucu

SEQ ID NO: 332282 - RNA, 20 nt, Human
caugccuguaaucccagcac

SEQ ID NO: 332283 - RNA, 24 nt, Human
caugccuguaaucccagcacuuug

SEQ ID NO: 332284 - RNA, 19 nt, Human
cauucagagcuggagaguu

SEQ ID NO: 332285 - RNA, 19 nt, Human
ccacugcacuccagccugg

SEQ ID NO: 332286 - RNA, 19 nt, Human
ccacugcacuccagccugg

SEQ ID NO: 332287 - RNA, 23 nt, Human
ccacugcacuccagccuggcgac

SEQ ID NO: 332288 - RNA, 21 nt, Human
cccacaggaggcacaaggucc

SEQ ID NO: 332289 - RNA, 21 nt, Human
cccacaggaggcacaaggucc

SEQ ID NO: 332290 - RNA, 20 nt, Human
cccaccccuagccccagccc

SEQ ID NO: 332291 - RNA, 21 nt, Human
cccaccccuagccccagcccc

SEQ ID NO: 332292 - RNA, 21 nt, Human
ccuagaagagcuccugaaaca

SEQ ID NO: 332293 - RNA, 24 nt, Human
ccucacagacucagcugugggugg

SEQ ID NO: 332294 - RNA, 22 nt, Human
ccucccacaggaggcacaaggu

SEQ ID NO: 332295 - RNA, 22 nt, Human
ccucccacaggaggcacaaggu

SEQ ID NO: 332296 - RNA, 23 nt, Human
ccucuuuaugcugaaauaggaac

SEQ ID NO: 332297 - RNA, 21 nt, Human
ccuggcgacagagcgagacuc

SEQ ID NO: 332298 - RNA, 20 nt, Human
ccugggcaacauggugaaac

SEQ ID NO: 332299 - RNA, 22 nt, Human
ccugggcaacauggugaaaccc

SEQ ID NO: 332300 - RNA, 23 nt, Human
ccugggcaacauggugaaacccc

SEQ ID NO: 332301 - RNA, 24 nt, Human
ccugggcaacauggugaaaccccg

SEQ ID NO: 332302 - RNA, 23 nt, Human
ccuggggggaggggguggggaag

SEQ ID NO: 332303 - RNA, 22 nt, Human
ccuguaaucccagcacuuuggg

SEQ ID NO: 332304 - RNA, 24 nt, Human
cgagaccauccugggcaacauggu

SEQ ID NO: 332305 - RNA, 24 nt, Human
cgagacugcgccacugcacuccag

SEQ ID NO: 332306 - RNA, 22 nt, Human
cgaggugaggagaucgagacca

SEQ ID NO: 332307 - RNA, 25 nt, Human
cgccacugcacuccagccuggcgac

SEQ ID NO: 332308 - RNA, 22 nt, Human
cgccagucuggacucugcgcgc

SEQ ID NO: 332309 - RNA, 27 nt, Human
cucacagacucagcugugggugggggg

SEQ ID NO: 332310 - RNA, 19 nt, Human
cucagccucccacaggagg

SEQ ID NO: 332311 - RNA, 19 nt, Human
cucagccucccacaggagg

SEQ ID NO: 332312 - RNA, 18 nt, Human
cucaggacgaacaaagaa

SEQ ID NO: 332313 - RNA, 24 nt, Human
cucaugccuguaaucccagcacuu

SEQ ID NO: 332314 - RNA, 23 nt, Human
cuccacccaccccuagccccagc

SEQ ID NO: 332315 - RNA, 24 nt, Human
cuccagccuggcgacagagcgaga

SEQ ID NO: 332316 - RNA, 23 nt, Human
cucuccucuugcaguccucagcc

SEQ ID NO: 332317 - RNA, 23 nt, Human
cucuccucuugcaguccucagcc

SEQ ID NO: 332318 - RNA, 25 nt, Human
cuggggggagggggugggaggcucc

SEQ ID NO: 332319 - RNA, 20 nt, Human
cuguuccugugaucucagcu

SEQ ID NO: 332320 - RNA, 18 nt, Human
cuucaaggagaucuggug

SEQ ID NO: 332321 - RNA, 24 nt, Human
gaaaacaaaaacaaaaacaaaaac

SEQ ID NO: 332322 - RNA, 21 nt, Human
gaaauaggaacuuuaaaggaa

SEQ ID NO: 332323 - RNA, 22 nt, Human
gacacauaaucauguuuucuga

SEQ ID NO: 332324 - RNA, 24 nt, Human
gacagagcgagacuccgucucagg

SEQ ID NO: 332325 - RNA, 23 nt, Human
gagaguuucuccauucagggcac

SEQ ID NO: 332326 - RNA, 22 nt, Human
gaggcgggcggaucacgaggug

SEQ ID NO: 332327 - RNA, 18 nt, Human
gaucugguggggaauucu

SEQ ID NO: 332328 - RNA, 24 nt, Human
gaugacugggagacugaagaggaa

SEQ ID NO: 332329 - RNA, 20 nt, Human
gauuggggccgggcgcggug

SEQ ID NO: 332330 - RNA, 23 nt, Human
gcacuccagccuggcgacagagc

SEQ ID NO: 332331 - RNA, 19 nt, Human
gccacaaguaccagagagg

SEQ ID NO: 332332 - RNA, 19 nt, Human
gccacaaguaccagagagg

SEQ ID NO: 332333 - RNA, 21 nt, Human
gccagucuggacucugcgcgc

SEQ ID NO: 332334 - RNA, 19 nt, Human
gcuccacccaccccuagcc

SEQ ID NO: 332335 - RNA, 22 nt, Human
gcuccacccaccccuagcccca

SEQ ID NO: 332336 - RNA, 20 nt, Human
ggccccucgggcccugccgc

SEQ ID NO: 332337 - RNA, 21 nt, Human
ggccgggcgcgguggcucaug

SEQ ID NO: 332338 - RNA, 23 nt, Human
ggccgggcgcgguggcucaugcc

SEQ ID NO: 332339 - RNA, 23 nt, Human
ggcgcgguggcucaugccuguaa

SEQ ID NO: 332340 - RNA, 18 nt, Human
gggaggggguggggaagg

SEQ ID NO: 332341 - RNA, 20 nt, Human
gggcguggugaugccagccc

SEQ ID NO: 332342 - RNA, 26 nt, Human
ggggggaggggguggggaagguguuc

SEQ ID NO: 332343 - RNA, 23 nt, Human
gguggcucaugccuguaauccca

SEQ ID NO: 332344 - RNA, 24 nt, Human
gguggcucaugccuguaaucccag

SEQ ID NO: 332345 - RNA, 21 nt, Human
gguggguugcaggagguagaa

SEQ ID NO: 332346 - RNA, 26 nt, Human
guaguccaaauggacguaccuugugg

SEQ ID NO: 332347 - RNA, 21 nt, Human
guugcagcgagccgagacugc

SEQ ID NO: 332348 - RNA, 18 nt, Human
uaaaaacaaaacccuauu

SEQ ID NO: 332349 - RNA, 21 nt, Human
uaaaaacaaaacccuauuaau

SEQ ID NO: 332350 - RNA, 21 nt, Human
uaaaaacaaaacccuauuaau

SEQ ID NO: 332351 - RNA, 19 nt, Human
uaccucaggagaagcccaa

SEQ ID NO: 332352 - RNA, 21 nt, Human
uagaagagcuccugaaacaga

SEQ ID NO: 332353 - RNA, 26 nt, Human
ucacagacucagcugugggugggggg

SEQ ID NO: 332354 - RNA, 24 nt, Human
ucacgaggugaggagaucgagacc

SEQ ID NO: 332355 - RNA, 24 nt, Human
ucaggacgaacaaagaaacaaaca

SEQ ID NO: 332356 - RNA, 19 nt, Human
ucagugcgguuccgaguga

SEQ ID NO: 332357 - RNA, 22 nt, Human
ucaugccuguaaucccagcacu

SEQ ID NO: 332358 - RNA, 26 nt, Human
uccaaacuauuccuaaaaaaaaaagg

SEQ ID NO: 332359 - RNA, 22 nt, Human
uccagccuggcgacagagcgag

SEQ ID NO: 332360 - RNA, 25 nt, Human
uccugggcaacauggugaaaccccg

SEQ ID NO: 332361 - RNA, 24 nt, Human
ucgggaggcugaggcaggagaauc

SEQ ID NO: 332362 - RNA, 23 nt, Human
ucucuacuaaaaauacaaaaauu

SEQ ID NO: 332363 - RNA, 18 nt, Human
ugaccucaucccuguauc

SEQ ID NO: 332364 - RNA, 20 nt, Human
ugaggcaggagaaucguuug

SEQ ID NO: 332365 - RNA, 24 nt, Human
ugaggcaggagaaucguuugaacc

SEQ ID NO: 332366 - RNA, 23 nt, Human
ugccuguaaucccagcacuuugg

SEQ ID NO: 332367 - RNA, 23 nt, Human
ugccuguaaucccagcacuuugg

SEQ ID NO: 332368 - RNA, 23 nt, Human
ugcugaccucaucccuguaucac

SEQ ID NO: 332369 - RNA, 24 nt, Human
uggaaagaaaacaaaaacaaaaac

SEQ ID NO: 332370 - RNA, 21 nt, Human
uggaaugaauagcuaucugcu

SEQ ID NO: 332371 - RNA, 24 nt, Human
uggcucaugccuguaaucccagca

SEQ ID NO: 332372 - RNA, 19 nt, Human
ugggaggccgaggcgggcg

SEQ ID NO: 332373 - RNA, 24 nt, Human
ugggaggccgaggcgggcggauca

SEQ ID NO: 332374 - RNA, 27 nt, Human
ugggaggcuaauaggauggguggguug

SEQ ID NO: 332375 - RNA, 19 nt, Human
ugggcguggugaugccagc

SEQ ID NO: 332376 - RNA, 21 nt, Human
ugggcguggugaugccagcca

SEQ ID NO: 332377 - RNA, 20 nt, Human
uggggaagguguuaaugaug

SEQ ID NO: 332378 - RNA, 24 nt, Human
uggggccucacagacucagcugug

SEQ ID NO: 332379 - RNA, 20 nt, Human
ugguauggcuguaaggacuc

SEQ ID NO: 332380 - RNA, 18 nt, Human
uguaucacgggccuugaa

SEQ ID NO: 332381 - RNA, 24 nt, Human
ugugggaggcuaauaggaugggug

SEQ ID NO: 332382 - RNA, 20 nt, Human
uuagcugggcguggugaugc

SEQ ID NO: 332383 - RNA, 19 nt, Human
uuccccuagccccagcccc

SEQ ID NO: 332384 - RNA, 22 nt, Human
uugcagcgagccgagacugcgc

SEQ ID NO: 332385 - RNA, 25 nt, Human
uugggaggccgaggcgggcggauca

SEQ ID NO: 332386 - RNA, 20 nt, Human
uuguugaagggaaggguauu

SEQ ID NO: 332387 - RNA, 18 nt, Human
uuugcuggugcugaccuc

SEQ ID NO: 332388 - RNA, 25 nt, Human
aaaaaaaaggacagccucuuuaugc

SEQ ID NO: 332389 - RNA, 18 nt, Human
aaaaacaaaaacaccaaa

SEQ ID NO: 332390 - RNA, 23 nt, Human
aaaaacaaaacccuauuaauaaa

SEQ ID NO: 332391 - RNA, 20 nt, Human
aaaaacaccaaaaaacaccu

SEQ ID NO: 332392 - RNA, 22 nt, Human
aaaaacauacuagcaagccaca

SEQ ID NO: 332393 - RNA, 22 nt, Human
aaaacaaaaacaaaaacaaaaa

SEQ ID NO: 332394 - RNA, 27 nt, Human
aaaacaaaaacaaaaacaaaaacacca

SEQ ID NO: 332395 - RNA, 23 nt, Human
aaaaggaaacaauaaaaacaaaa

SEQ ID NO: 332396 - RNA, 21 nt, Human
aaaagggcuccacccaccccu

SEQ ID NO: 332397 - RNA, 18 nt, Human
aaaauuagcugggcgugg

SEQ ID NO: 332398 - RNA, 25 nt, Human
aaacaaaaacaaaaacaaaaacaaa

SEQ ID NO: 332399 - RNA, 30 nt, Human
aaacaaaaacaaaaacaaaaacaccaaaag

SEQ ID NO: 332400 - RNA, 22 nt, Human
aaacaaaaacaaaaacaccaaa

SEQ ID NO: 332401 - RNA, 23 nt, Human
aaacaaaaacaaaaacaccaaaa

SEQ ID NO: 332402 - RNA, 19 nt, Human
aaacaaacaaaccagauga

SEQ ID NO: 332403 - RNA, 23 nt, Human
aaacaauaaaaacaaaacccuau

SEQ ID NO: 332404 - RNA, 25 nt, Human
aaagaaaacaaaaacaaaaacaaaa

SEQ ID NO: 332405 - RNA, 21 nt, Human
aacaaaacccuauuaauaaac

SEQ ID NO: 332406 - RNA, 19 nt, Human
aacauggugaaaccccguc

SEQ ID NO: 332407 - RNA, 20 nt, Human
aacauggugaaaccccgucu

SEQ ID NO: 332408 - RNA, 21 nt, Human
aacauggugaaaccccgucuc

SEQ ID NO: 332409 - RNA, 18 nt, Human
aacguagggaaaggaugg

SEQ ID NO: 332410 - RNA, 22 nt, Human
aagaaaacaaaaacaaaaacaa

SEQ ID NO: 332411 - RNA, 21 nt, Human
aagagcuccugaaacagaaug

SEQ ID NO: 332412 - RNA, 21 nt, Human
aagaggaaaaaagaugggaga

SEQ ID NO: 332413 - RNA, 25 nt, Human
acaaaaacaaaaacaaaaacaaaaa

SEQ ID NO: 332414 - RNA, 26 nt, Human
acaaaaacaaaaacaccaaaaaacac

SEQ ID NO: 332415 - RNA, 22 nt, Human
acaaaaacaccaaaaaacaccu

SEQ ID NO: 332416 - RNA, 20 nt, Human
acagagcgagacuccgucuc

SEQ ID NO: 332417 - RNA, 21 nt, Human
acagagcgagacuccgucuca

SEQ ID NO: 332418 - RNA, 24 nt, Human
acagagcgagacuccgucucagaa

SEQ ID NO: 332419 - RNA, 24 nt, Human
accccgucucuacuaaaaauacaa

SEQ ID NO: 332420 - RNA, 22 nt, Human
acucagcugugggugggggggu

SEQ ID NO: 332421 - RNA, 23 nt, Human
acugcacuccagccuggcgacag

SEQ ID NO: 332422 - RNA, 25 nt, Human
acugcacuccagccuggcgacagag

SEQ ID NO: 332423 - RNA, 24 nt, Human
acugcgccacugcacuccagccug

SEQ ID NO: 332424 - RNA, 18 nt, Human
agaagcccaaggaauugu

SEQ ID NO: 332425 - RNA, 23 nt, Human
agaguuugcuggugcugaccuca

SEQ ID NO: 332426 - RNA, 20 nt, Human
agaugauuggggccgggcgc

SEQ ID NO: 332427 - RNA, 24 nt, Human
agcacuuugggaggccgaggcggg

SEQ ID NO: 332428 - RNA, 23 nt, Human
agccacaaguaccagagaggggu

SEQ ID NO: 332429 - RNA, 21 nt, Human
agccuggcgacagagcgagac

SEQ ID NO: 332430 - RNA, 23 nt, Human
agccuggcgacagagcgagacuc

SEQ ID NO: 332431 - RNA, 21 nt, Human
agcuaggccugucaccugcug

SEQ ID NO: 332432 - RNA, 24 nt, Human
aggaaaaaagaugggagaaaacgu

SEQ ID NO: 332433 - RNA, 22 nt, Human
aggaaacaauaaaaacaaaacc

SEQ ID NO: 332434 - RNA, 22 nt, Human
aggagaagcccaaggaauuguc

SEQ ID NO: 332435 - RNA, 22 nt, Human
aggcaggagaaucguuugaacc

SEQ ID NO: 332436 - RNA, 24 nt, Human
aggcaggagaaucguuugaaccag

SEQ ID NO: 332437 - RNA, 21 nt, Human
aggccgaggcgggcggaucac

SEQ ID NO: 332438 - RNA, 23 nt, Human
aggccgaggcgggcggaucacga

SEQ ID NO: 332439 - RNA, 24 nt, Human
aggcgggcggaucacgaggugagg

SEQ ID NO: 332440 - RNA, 20 nt, Human
aggcugaggcaggagaaucg

SEQ ID NO: 332441 - RNA, 24 nt, Human
aggcugaggcaggagaaucguuug

SEQ ID NO: 332442 - RNA, 19 nt, Human
agguagaagaggggauggc

SEQ ID NO: 332443 - RNA, 24 nt, Human
agucagagguugcagcgagccgag

SEQ ID NO: 332444 - RNA, 24 nt, Human
aguccaaauggacguaccuugugg

SEQ ID NO: 332445 - RNA, 18 nt, Human
aguuguugaagggaaggg

SEQ ID NO: 332446 - RNA, 19 nt, Human
augccuguaaucccagcac

SEQ ID NO: 332447 - RNA, 25 nt, Human
caaaaacaaaaacaaaaacaaaaac

SEQ ID NO: 332448 - RNA, 25 nt, Human
caaaaacaaaaacaaaaacaccaaa

SEQ ID NO: 332449 - RNA, 21 nt, Human
caaaaacaaaaacaccaaaaa

SEQ ID NO: 332450 - RNA, 24 nt, Human
caaaaacaaaaacaccaaaaaaca

SEQ ID NO: 332451 - RNA, 20 nt, Human
caaaaacaccaaaaaacacc

SEQ ID NO: 332452 - RNA, 21 nt, Human
caaaaacaccaaaaaacaccu

SEQ ID NO: 332453 - RNA, 20 nt, Human
caaagaaacaaacaaaccag

SEQ ID NO: 332454 - RNA, 22 nt, Human
caacauggugaaaccccgucuc

SEQ ID NO: 332455 - RNA, 24 nt, Human
caacauggugaaaccccgucucua

SEQ ID NO: 332456 - RNA, 19 nt, Human
caagccacaaguaccagag

SEQ ID NO: 332457 - RNA, 22 nt, Human
cacuccagccuggcgacagagc

SEQ ID NO: 332458 - RNA, 23 nt, Human
cacuccagccuggcgacagagcg

SEQ ID NO: 332459 - RNA, 18 nt, Human
cacugcacuccagccugg

SEQ ID NO: 332460 - RNA, 20 nt, Human
cacugcacuccagccuggcg

SEQ ID NO: 332461 - RNA, 22 nt, Human
cacugcacuccagccuggcgac

SEQ ID NO: 332462 - RNA, 23 nt, Human
cacugcacuccagccuggcgaca

SEQ ID NO: 332463 - RNA, 24 nt, Human
cacugcacuccagccuggcgacag

SEQ ID NO: 332464 - RNA, 24 nt, Human
cagcacuuugggaggccgaggcgg

SEQ ID NO: 332465 - RNA, 24 nt, Human
cagccacucgggaggcugaggcag

SEQ ID NO: 332466 - RNA, 18 nt, Human
cagcccaagggaggggag

SEQ ID NO: 332467 - RNA, 18 nt, Human
cagcuuuaccuagaagag

SEQ ID NO: 332468 - RNA, 18 nt, Human
caguccucagccucccac

SEQ ID NO: 332469 - RNA, 21 nt, Human
cauaucugcuagcucuccucu

SEQ ID NO: 332470 - RNA, 20 nt, Human
caugccuguaaucccagcac

SEQ ID NO: 332471 - RNA, 24 nt, Human
caugccuguaaucccagcacuuug

SEQ ID NO: 332472 - RNA, 19 nt, Human
cauucagagcuggagaguu

SEQ ID NO: 332473 - RNA, 19 nt, Human
ccacugcacuccagccugg

SEQ ID NO: 332474 - RNA, 19 nt, Human
ccacugcacuccagccugg

SEQ ID NO: 332475 - RNA, 19 nt, Human
ccacugcacuccagccugg

SEQ ID NO: 332476 - RNA, 20 nt, Human
ccacugcacuccagccuggc

SEQ ID NO: 332477 - RNA, 22 nt, Human
ccacugcacuccagccuggcga

SEQ ID NO: 332478 - RNA, 23 nt, Human
ccacugcacuccagccuggcgac

SEQ ID NO: 332479 - RNA, 21 nt, Human
ccagaguuugcuggugcugac

SEQ ID NO: 332480 - RNA, 21 nt, Human
cccacaggaggcacaaggucc

SEQ ID NO: 332481 - RNA, 20 nt, Human
cccaccccuagccccagccc

SEQ ID NO: 332482 - RNA, 21 nt, Human
cccaccccuagccccagcccc

SEQ ID NO: 332483 - RNA, 21 nt, Human
ccuagaagagcuccugaaaca

SEQ ID NO: 332484 - RNA, 24 nt, Human
ccucacagacucagcugugggugg

SEQ ID NO: 332485 - RNA, 22 nt, Human
ccucccacaggaggcacaaggu

SEQ ID NO: 332486 - RNA, 23 nt, Human
ccucuuuaugcugaaauaggaac

SEQ ID NO: 332487 - RNA, 21 nt, Human
ccuggcgacagagcgagacuc

SEQ ID NO: 332488 - RNA, 20 nt, Human
ccugggcaacauggugaaac

SEQ ID NO: 332489 - RNA, 22 nt, Human
ccugggcaacauggugaaaccc

SEQ ID NO: 332490 - RNA, 23 nt, Human
ccugggcaacauggugaaacccc

SEQ ID NO: 332491 - RNA, 24 nt, Human
ccugggcaacauggugaaaccccg

SEQ ID NO: 332492 - RNA, 22 nt, Human
ccuguaaucccagcacuuuggg

SEQ ID NO: 332493 - RNA, 24 nt, Human
cgagaccauccugggcaacauggu

SEQ ID NO: 332494 - RNA, 24 nt, Human
cgaggcgggcggaucacgagguga

SEQ ID NO: 332495 - RNA, 22 nt, Human
cgaggugaggagaucgagacca

SEQ ID NO: 332496 - RNA, 22 nt, Human
cgccagucuggacucugcgcgc

SEQ ID NO: 332497 - RNA, 24 nt, Human
cgggccuagaaugugggaggcuaa

SEQ ID NO: 332498 - RNA, 27 nt, Human
cucacagacucagcugugggugggggg

SEQ ID NO: 332499 - RNA, 19 nt, Human
cucagccucccacaggagg

SEQ ID NO: 332500 - RNA, 24 nt, Human
cucaugccuguaaucccagcacuu

SEQ ID NO: 332501 - RNA, 18 nt, Human
cuccacccaccccuagcc

SEQ ID NO: 332502 - RNA, 23 nt, Human
cuccacccaccccuagccccagc

SEQ ID NO: 332503 - RNA, 24 nt, Human
cuccagccuggcgacagagcgaga

SEQ ID NO: 332504 - RNA, 23 nt, Human
cucuccucuugcaguccucagcc

SEQ ID NO: 332505 - RNA, 20 nt, Human
cuguuccugugaucucagcu

SEQ ID NO: 332506 - RNA, 18 nt, Human
cuucaaggagaucuggug

SEQ ID NO: 332507 - RNA, 24 nt, Human
gaaaacaaaaacaaaaacaaaaac

SEQ ID NO: 332508 - RNA, 21 nt, Human
gaaauaggaacuuuaaaggaa

SEQ ID NO: 332509 - RNA, 22 nt, Human
gagaaucguuugaaccagggag

SEQ ID NO: 332510 - RNA, 23 nt, Human
gagacugcgccacugcacuccag

SEQ ID NO: 332511 - RNA, 23 nt, Human
gagaguuucuccauucagggcac

SEQ ID NO: 332512 - RNA, 18 nt, Human
gaucugguggggaauucu

SEQ ID NO: 332513 - RNA, 24 nt, Human
gaugacugggagacugaagaggaa

SEQ ID NO: 332514 - RNA, 20 nt, Human
gauuggggccgggcgcggug

SEQ ID NO: 332515 - RNA, 23 nt, Human
gcacuccagccuggcgacagagc

SEQ ID NO: 332516 - RNA, 19 nt, Human
gccacaaguaccagagagg

SEQ ID NO: 332517 - RNA, 22 nt, Human
gcuccacccaccccuagcccca

SEQ ID NO: 332518 - RNA, 21 nt, Human
gcugaucccuacuucugcuuc

SEQ ID NO: 332519 - RNA, 23 nt, Human
ggccgggcgcgguggcucaugcc

SEQ ID NO: 332520 - RNA, 23 nt, Human
ggcgcgguggcucaugccuguaa

SEQ ID NO: 332521 - RNA, 21 nt, Human
ggcucaugccuguaaucccag

SEQ ID NO: 332522 - RNA, 18 nt, Human
gggaggggguggggaagg

SEQ ID NO: 332523 - RNA, 20 nt, Human
gggcguggugaugccagccc

SEQ ID NO: 332524 - RNA, 23 nt, Human
gguggcucaugccuguaauccca

SEQ ID NO: 332525 - RNA, 21 nt, Human
gguggguugcaggagguagaa

SEQ ID NO: 332526 - RNA, 24 nt, Human
gugacacauaaucauguuuucuga

SEQ ID NO: 332527 - RNA, 23 nt, Human
guggcucaugccuguaaucccag

SEQ ID NO: 332528 - RNA, 21 nt, Human
guugcagcgagccgagacugc

SEQ ID NO: 332529 - RNA, 18 nt, Human
uaaaaacaaaacccuauu

SEQ ID NO: 332530 - RNA, 19 nt, Human
uaccucaggagaagcccaa

SEQ ID NO: 332531 - RNA, 21 nt, Human
uagaagagcuccugaaacaga

SEQ ID NO: 332532 - RNA, 22 nt, Human
uagcuaggccugucaccugcug

SEQ ID NO: 332533 - RNA, 26 nt, Human
ucacagacucagcugugggugggggg

SEQ ID NO: 332534 - RNA, 24 nt, Human
ucacgaggugaggagaucgagacc

SEQ ID NO: 332535 - RNA, 20 nt, Human
ucagaacgaacaaagaaaca

SEQ ID NO: 332536 - RNA, 24 nt, Human
ucagaacgaacaaagaaacaaaca

SEQ ID NO: 332537 - RNA, 19 nt, Human
ucagugcgguuccgaguga

SEQ ID NO: 332538 - RNA, 22 nt, Human
ucaugccuguaaucccagcacu

SEQ ID NO: 332539 - RNA, 22 nt, Human
uccagccuggcgacagagcgag

SEQ ID NO: 332540 - RNA, 25 nt, Human
uccugggcaacauggugaaaccccg

SEQ ID NO: 332541 - RNA, 22 nt, Human
ucggccccucgggcccugccgc

SEQ ID NO: 332542 - RNA, 24 nt, Human
ucgggaggcugaggcaggagaauc

SEQ ID NO: 332543 - RNA, 22 nt, Human
ucucagaacgaacaaagaaaca

SEQ ID NO: 332544 - RNA, 23 nt, Human
ucucuacuaaaaauacaaaaauu

SEQ ID NO: 332545 - RNA, 18 nt, Human
ucugccugcggggagggg

SEQ ID NO: 332546 - RNA, 18 nt, Human
ugaccucaucccuguauc

SEQ ID NO: 332547 - RNA, 20 nt, Human
ugaggcaggagaaucguuug

SEQ ID NO: 332548 - RNA, 24 nt, Human
ugaggcaggagaaucguuugaacc

SEQ ID NO: 332549 - RNA, 23 nt, Human
ugccuguaaucccagcacuuugg

SEQ ID NO: 332550 - RNA, 23 nt, Human
ugccuguaaucccagcacuuugg

SEQ ID NO: 332551 - RNA, 23 nt, Human
ugcugaccucaucccuguaucac

SEQ ID NO: 332552 - RNA, 23 nt, Human
uggaaagaaaacaaaaacaaaaa

SEQ ID NO: 332553 - RNA, 21 nt, Human
uggaaugaauagcuaucugcu

SEQ ID NO: 332554 - RNA, 22 nt, Human
uggcucaugccuguaaucccag

SEQ ID NO: 332555 - RNA, 24 nt, Human
uggcucaugccuguaaucccagca

SEQ ID NO: 332556 - RNA, 19 nt, Human
ugggaggccgaggcgggcg

SEQ ID NO: 332557 - RNA, 24 nt, Human
ugggaggccgaggcgggcggauca

SEQ ID NO: 332558 - RNA, 27 nt, Human
ugggaggcuaauaggauggguggguug

SEQ ID NO: 332559 - RNA, 19 nt, Human
ugggcguggugaugccagc

SEQ ID NO: 332560 - RNA, 21 nt, Human
ugggcguggugaugccagcca

SEQ ID NO: 332561 - RNA, 20 nt, Human
uggggaagguguuaaugaug

SEQ ID NO: 332562 - RNA, 24 nt, Human
uggggccgggcgcgguggcucaug

SEQ ID NO: 332563 - RNA, 24 nt, Human
uggggccucacagacucagcugug

SEQ ID NO: 332564 - RNA, 20 nt, Human
ugguauggcuguaaggacuc

SEQ ID NO: 332565 - RNA, 24 nt, Human
ugugggaggcuaauaggaugggug

SEQ ID NO: 332566 - RNA, 20 nt, Human
uuagcugggcguggugaugc

SEQ ID NO: 332567 - RNA, 22 nt, Human
uugcagcgagccgagacugcgc

SEQ ID NO: 332568 - RNA, 25 nt, Human
uugggaggccgaggcgggcggauca

SEQ ID NO: 332569 - RNA, 20 nt, Human
uuguugaagggaaggguauu

SEQ ID NO: 332570 - RNA, 18 nt, Human
uuugcuggugcugaccuc

SEQ ID NO: 332571 - RNA, 23 nt, Human
cagcaaauucuuucccagaaucu

SEQ ID NO: 332572 - RNA, 26 nt, Human
cagcaaauucuuucccagaaucuauc

SEQ ID NO: 332573 - RNA, 20 nt, Human
cagcccgcgggccuggggcg

SEQ ID NO: 332574 - RNA, 20 nt, Human
ccagcucccggcccggcaca

SEQ ID NO: 332575 - RNA, 22 nt, Human
cucccggcccggcacaggcugu

SEQ ID NO: 332576 - RNA, 18 nt, Human
cuggggcggcggcggauc

SEQ ID NO: 332577 - RNA, 23 nt, Human
ucaccacugcuaauuucccccug

SEQ ID NO: 332578 - RNA, 20 nt, Human
uccgugcgcaccacggcgcg

SEQ ID NO: 332579 - RNA, 22 nt, Human
uccgugcgcaccacggcgcgua

SEQ ID NO: 332580 - RNA, 23 nt, Human
ugucagcagcccgcgggccuggg

SEQ ID NO: 332581 - RNA, 18 nt, Human
uucccccugcccagcucc

SEQ ID NO: 332582 - RNA, 24 nt, Human
uuucucaccacugcuaauuucccc

SEQ ID NO: 332583 - RNA, 20 nt, Human
cgagcugcggagaaaugccc

SEQ ID NO: 332584 - RNA, 18 nt, Human
gcgcggccgcgagccgag

SEQ ID NO: 332585 - RNA, 19 nt, Human
ggccgcgagccgagcugcg

SEQ ID NO: 332586 - RNA, 18 nt, Human
aaacacguggcauguucu

SEQ ID NO: 332587 - RNA, 23 nt, Human
aaagucccugaagaggagcgagg

SEQ ID NO: 332588 - RNA, 23 nt, Human
aaagucccugaagaggagcgagg

SEQ ID NO: 332589 - RNA, 18 nt, Human
aaagugcugggauuaaaa

SEQ ID NO: 332590 - RNA, 21 nt, Human
aagccaccacacccggccacc

SEQ ID NO: 332591 - RNA, 24 nt, Human
aaggggcaucguccacugcgcauu

SEQ ID NO: 332592 - RNA, 18 nt, Human
aagugcugggauuaaagc

SEQ ID NO: 332593 - RNA, 25 nt, Human
acaaaacauaguaacuauuagggua

SEQ ID NO: 332594 - RNA, 23 nt, Human
accucggguucccaaagugcugg

SEQ ID NO: 332595 - RNA, 23 nt, Human
accuggaggacgaccgcggagcu

SEQ ID NO: 332596 - RNA, 22 nt, Human
acucccaucuuugagcccagga

SEQ ID NO: 332597 - RNA, 22 nt, Human
agccugggcaacauagggagac

SEQ ID NO: 332598 - RNA, 24 nt, Human
agccugggcaacauagggagacuc

SEQ ID NO: 332599 - RNA, 21 nt, Human
aggcggcacagaccuggagga

SEQ ID NO: 332600 - RNA, 19 nt, Human
agggaggcggcacagaccu

SEQ ID NO: 332601 - RNA, 23 nt, Human
agguguuggagaccagccugggc

SEQ ID NO: 332602 - RNA, 23 nt, Human
aguagcuggcauuacaggcaugu

SEQ ID NO: 332603 - RNA, 22 nt, Human
aucccagcgcuuugggaggcca

SEQ ID NO: 332604 - RNA, 20 nt, Human
augggguuucuccacguugg

SEQ ID NO: 332605 - RNA, 21 nt, Human
augggguuucuccacguuggu

SEQ ID NO: 332606 - RNA, 24 nt, Human
augggguuucuccacguuggucag

SEQ ID NO: 332607 - RNA, 21 nt, Human
auuuuccugccucagccuccc

SEQ ID NO: 332608 - RNA, 23 nt, Human
caaaagacagaacuaaaggacag

SEQ ID NO: 332609 - RNA, 24 nt, Human
caaagucccugaagaggagcgagg

SEQ ID NO: 332610 - RNA, 27 nt, Human
caaagugcugggauuaaagccaccaca

SEQ ID NO: 332611 - RNA, 22 nt, Human
caagcaauuuuccugccucagc

SEQ ID NO: 332612 - RNA, 21 nt, Human
caccacaaccuccgccucccg

SEQ ID NO: 332613 - RNA, 25 nt, Human
caccacguccggcuaauuuuuugua

SEQ ID NO: 332614 - RNA, 23 nt, Human
caccgucaccacagagcugaagg

SEQ ID NO: 332615 - RNA, 23 nt, Human
caccgucaccacagagcugaagg

SEQ ID NO: 332616 - RNA, 23 nt, Human
caccgucaccacagagcugaagg

SEQ ID NO: 332617 - RNA, 18 nt, Human
cacucuucagaccggccc

SEQ ID NO: 332618 - RNA, 18 nt, Human
cacucuucagaccggccc

SEQ ID NO: 332619 - RNA, 18 nt, Human
cacucuucagaccggccc

SEQ ID NO: 332620 - RNA, 19 nt, Human
cagaacuaaaggacagucc

SEQ ID NO: 332621 - RNA, 24 nt, Human
cagaccuauaaucccagcgcuuug

SEQ ID NO: 332622 - RNA, 24 nt, Human
cagaccuggaggacgaccgcggag

SEQ ID NO: 332623 - RNA, 20 nt, Human
cagcgcuuugggaggccaag

SEQ ID NO: 332624 - RNA, 24 nt, Human
cauaaauguacacauaaauaucag

SEQ ID NO: 332625 - RNA, 19 nt, Human
cauuacaggcaugugccac

SEQ ID NO: 332626 - RNA, 18 nt, Human
ccacaaccuccgccuccc

SEQ ID NO: 332627 - RNA, 23 nt, Human
ccacaaccuccgccucccggguu

SEQ ID NO: 332628 - RNA, 24 nt, Human
ccacaaccuccgccucccggguuc

SEQ ID NO: 332629 - RNA, 20 nt, Human
ccaccacguccggcuaauuu

SEQ ID NO: 332630 - RNA, 19 nt, Human
ccacguuggucaggcuggu

SEQ ID NO: 332631 - RNA, 19 nt, Human
ccacguuggucaggcuggu

SEQ ID NO: 332632 - RNA, 23 nt, Human
ccacguuggucaggcugguuucg

SEQ ID NO: 332633 - RNA, 19 nt, Human
ccacuguuacuuugauacc

SEQ ID NO: 332634 - RNA, 22 nt, Human
cccaggaacuugaaacugcagu

SEQ ID NO: 332635 - RNA, 21 nt, Human
cccaugaguucaaaagacaga

SEQ ID NO: 332636 - RNA, 21 nt, Human
ccccgagggaugcuccugggg

SEQ ID NO: 332637 - RNA, 21 nt, Human
ccccgagggaugcuccugggg

SEQ ID NO: 332638 - RNA, 21 nt, Human
ccccgagggaugcuccugggg

SEQ ID NO: 332639 - RNA, 23 nt, Human
cccgaguagcuggcauuacaggc

SEQ ID NO: 332640 - RNA, 23 nt, Human
cccggguucaagcaauuuuccug

SEQ ID NO: 332641 - RNA, 27 nt, Human
ccgccucccggguucaagcaauuuuuu

SEQ ID NO: 332642 - RNA, 19 nt, Human
ccggcccuccaccucggcc

SEQ ID NO: 332643 - RNA, 19 nt, Human
ccggcccuccaccucggcc

SEQ ID NO: 332644 - RNA, 19 nt, Human
ccggcccuccaccucggcc

SEQ ID NO: 332645 - RNA, 22 nt, Human
ccuaggcuggagugcaauggcg

SEQ ID NO: 332646 - RNA, 24 nt, Human
ccugaccucaggugauccgcccac

SEQ ID NO: 332647 - RNA, 23 nt, Human
ccugccucagccucccgaguagc

SEQ ID NO: 332648 - RNA, 24 nt, Human
ccugccucagccucccgaguagcu

SEQ ID NO: 332649 - RNA, 25 nt, Human
cgagagcccuucucagcaaaguccc

SEQ ID NO: 332650 - RNA, 25 nt, Human
cgagagcccuucucagcaaaguccc

SEQ ID NO: 332651 - RNA, 25 nt, Human
cgagagcccuucucagcaaaguccc

SEQ ID NO: 332652 - RNA, 24 nt, Human
cgcauucggccccgagggaugcuc

SEQ ID NO: 332653 - RNA, 24 nt, Human
cgcauucggccccgagggaugcuc

SEQ ID NO: 332654 - RNA, 24 nt, Human
cgcauucggccccgagggaugcuc

SEQ ID NO: 332655 - RNA, 26 nt, Human
cgccaaacaccuuugcgguggggucu

SEQ ID NO: 332656 - RNA, 18 nt, Human
cggaaaugaauagcuuuc

SEQ ID NO: 332657 - RNA, 24 nt, Human
cucaccacaaccuccgccucccgg

SEQ ID NO: 332658 - RNA, 24 nt, Human
cuccacguuggucaggcugguuuc

SEQ ID NO: 332659 - RNA, 21 nt, Human
cuccgaggaaccgcggaggaa

SEQ ID NO: 332660 - RNA, 21 nt, Human
cuccgaggaaccgcggaggaa

SEQ ID NO: 332661 - RNA, 21 nt, Human
cuccgaggaaccgcggaggaa

SEQ ID NO: 332662 - RNA, 19 nt, Human
cuccuaucuuccccauugu

SEQ ID NO: 332663 - RNA, 21 nt, Human
cucggcggaucgccaaacacc

SEQ ID NO: 332664 - RNA, 21 nt, Human
cucggcggaucgccaaacacc

SEQ ID NO: 332665 - RNA, 21 nt, Human
cucggcggaucgccaaacacc

SEQ ID NO: 332666 - RNA, 20 nt, Human
cucuuauugccuaggcugga

SEQ ID NO: 332667 - RNA, 22 nt, Human
cucuuauugccuaggcuggagu

SEQ ID NO: 332668 - RNA, 23 nt, Human
cugccucagccucccgaguagcu

SEQ ID NO: 332669 - RNA, 24 nt, Human
cuguacucagaauaagaacuucau

SEQ ID NO: 332670 - RNA, 22 nt, Human
cuuauugccuaggcuggagugc

SEQ ID NO: 332671 - RNA, 24 nt, Human
cuuauugccuaggcuggagugcaa

SEQ ID NO: 332672 - RNA, 20 nt, Human
cuucucagcaaagucccuga

SEQ ID NO: 332673 - RNA, 20 nt, Human
cuucucagcaaagucccuga

SEQ ID NO: 332674 - RNA, 20 nt, Human
cuucucagcaaagucccuga

SEQ ID NO: 332675 - RNA, 26 nt, Human
cuucucggcggaucgccaaacaccuu

SEQ ID NO: 332676 - RNA, 26 nt, Human
cuucucggcggaucgccaaacaccuu

SEQ ID NO: 332677 - RNA, 26 nt, Human
cuucucggcggaucgccaaacaccuu

SEQ ID NO: 332678 - RNA, 24 nt, Human
gaaaacauuuauuuacaugcccuc

SEQ ID NO: 332679 - RNA, 18 nt, Human
gaacuugaaacugcagug

SEQ ID NO: 332680 - RNA, 24 nt, Human
gaccucaggugauccgcccaccuc

SEQ ID NO: 332681 - RNA, 20 nt, Human
gagaugggguuucuccacgu

SEQ ID NO: 332682 - RNA, 24 nt, Human
gagaugggguuucuccacguuggu

SEQ ID NO: 332683 - RNA, 18 nt, Human
gagcccaggaacuugaaa

SEQ ID NO: 332684 - RNA, 25 nt, Human
gccaaacaccuuugcgguggggucu

SEQ ID NO: 332685 - RNA, 25 nt, Human
gccaaacaccuuugcgguggggucu

SEQ ID NO: 332686 - RNA, 28 nt, Human
gcccgagagcccuucucagcaaaguccc

SEQ ID NO: 332687 - RNA, 28 nt, Human
gcccgagagcccuucucagcaaaguccc

SEQ ID NO: 332688 - RNA, 28 nt, Human
gcccgagagcccuucucagcaaaguccc

SEQ ID NO: 332689 - RNA, 24 nt, Human
gccuaggcuggagugcaauggcgu

SEQ ID NO: 332690 - RNA, 23 nt, Human
gcggcacagaccuauaaucccag

SEQ ID NO: 332691 - RNA, 21 nt, Human
gcucuuauugccuaggcugga

SEQ ID NO: 332692 - RNA, 20 nt, Human
gcuggagugcaauggcguca

SEQ ID NO: 332693 - RNA, 23 nt, Human
gcugguuucgaacuccugaccuc

SEQ ID NO: 332694 - RNA, 21 nt, Human
ggaagugaagccagucccgcc

SEQ ID NO: 332695 - RNA, 21 nt, Human
ggaagugaagccagucccgcc

SEQ ID NO: 332696 - RNA, 21 nt, Human
ggaagugaagccagucccgcc

SEQ ID NO: 332697 - RNA, 24 nt, Human
ggaggccaagccacuugagcccag

SEQ ID NO: 332698 - RNA, 20 nt, Human
ggauuaaagccaccacaccc

SEQ ID NO: 332699 - RNA, 24 nt, Human
ggcugguuucgaacuccugaccuc

SEQ ID NO: 332700 - RNA, 18 nt, Human
gggguuucuccacguugg

SEQ ID NO: 332701 - RNA, 22 nt, Human
gggguuucuccacguuggucag

SEQ ID NO: 332702 - RNA, 22 nt, Human
ggguuucuccacguuggucagg

SEQ ID NO: 332703 - RNA, 19 nt, Human
gguuucgaacuccugaccu

SEQ ID NO: 332704 - RNA, 24 nt, Human
gugauccgcccaccucggguuccc

SEQ ID NO: 332705 - RNA, 24 nt, Human
uaauuuuuuguauuuuuaguagag

SEQ ID NO: 332706 - RNA, 25 nt, Human
uaauuuuuuguauuuuuaguagaga

SEQ ID NO: 332707 - RNA, 23 nt, Human
uacaggcaugugccaccacgucc

SEQ ID NO: 332708 - RNA, 21 nt, Human
uagaaaauccaauaugaaaug

SEQ ID NO: 332709 - RNA, 22 nt, Human
uagacucuugaaauguuacgcu

SEQ ID NO: 332710 - RNA, 18 nt, Human
uagcuggcauuacaggca

SEQ ID NO: 332711 - RNA, 18 nt, Human
uaguagagaugggguuuc

SEQ ID NO: 332712 - RNA, 19 nt, Human
uaguagagaugggguuucu

SEQ ID NO: 332713 - RNA, 24 nt, Human
uaguagagaugggguuucuccacg

SEQ ID NO: 332714 - RNA, 19 nt, Human
uauugccuaggcuggagug

SEQ ID NO: 332715 - RNA, 20 nt, Human
uauugccuaggcuggagugc

SEQ ID NO: 332716 - RNA, 23 nt, Human
ucaccacaaccuccgccucccgg

SEQ ID NO: 332717 - RNA, 24 nt, Human
ucaccacaaccuccgccucccggg

SEQ ID NO: 332718 - RNA, 25 nt, Human
ucaccacaaccuccgccucccgggu

SEQ ID NO: 332719 - RNA, 27 nt, Human
ucaccacaaccuccgccucccggguuc

SEQ ID NO: 332720 - RNA, 20 nt, Human
ucagccucccgaguagcugg

SEQ ID NO: 332721 - RNA, 18 nt, Human
ucccaaagugcugggauu

SEQ ID NO: 332722 - RNA, 23 nt, Human
ucccaaagugcugggauuaaagc

SEQ ID NO: 332723 - RNA, 24 nt, Human
ucccgaguagcuggcauuacaggc

SEQ ID NO: 332724 - RNA, 18 nt, Human
ucccggguucaagcaauu

SEQ ID NO: 332725 - RNA, 24 nt, Human
ucccggguucaagcaauuuuccug

SEQ ID NO: 332726 - RNA, 20 nt, Human
ucccugaagaggagcgaggc

SEQ ID NO: 332727 - RNA, 20 nt, Human
ucccugaagaggagcgaggc

SEQ ID NO: 332728 - RNA, 20 nt, Human
ucccugaagaggagcgaggc

SEQ ID NO: 332729 - RNA, 24 nt, Human
uccgccucccggguucaagcaauu

SEQ ID NO: 332730 - RNA, 19 nt, Human
ucuggacgcccgagagccc

SEQ ID NO: 332731 - RNA, 19 nt, Human
ucuggacgcccgagagccc

SEQ ID NO: 332732 - RNA, 19 nt, Human
ucuggacgcccgagagccc

SEQ ID NO: 332733 - RNA, 21 nt, Human
ugaaacugcagugagccguga

SEQ ID NO: 332734 - RNA, 23 nt, Human
ugaaaugacaaagaguacuguac

SEQ ID NO: 332735 - RNA, 21 nt, Human
ugaagaggagcgaggcggcuc

SEQ ID NO: 332736 - RNA, 21 nt, Human
ugaagaggagcgaggcggcuc

SEQ ID NO: 332737 - RNA, 21 nt, Human
ugaagaggagcgaggcggcuc

SEQ ID NO: 332738 - RNA, 23 nt, Human
ugaagccagucccgccacucuuc

SEQ ID NO: 332739 - RNA, 23 nt, Human
ugaagccagucccgccacucuuc

SEQ ID NO: 332740 - RNA, 23 nt, Human
ugaagccagucccgccacucuuc

SEQ ID NO: 332741 - RNA, 18 nt, Human
ugaccucaggugauccgc

SEQ ID NO: 332742 - RNA, 21 nt, Human
ugaccucaggugauccgccca

SEQ ID NO: 332743 - RNA, 24 nt, Human
ugaccucaggugauccgcccaccu

SEQ ID NO: 332744 - RNA, 24 nt, Human
ugacuacaggaaaacauuuauuua

SEQ ID NO: 332745 - RNA, 25 nt, Human
ugagcccaggaacuugaaacugcag

SEQ ID NO: 332746 - RNA, 19 nt, Human
ugagcccagguguuggaga

SEQ ID NO: 332747 - RNA, 23 nt, Human
ugagcccagguguuggagaccag

SEQ ID NO: 332748 - RNA, 25 nt, Human
ugauccgcccaccucggguucccaa

SEQ ID NO: 332749 - RNA, 20 nt, Human
ugccuaggcuggagugcaau

SEQ ID NO: 332750 - RNA, 21 nt, Human
ugccuaggcuggagugcaaug

SEQ ID NO: 332751 - RNA, 24 nt, Human
ugccuaggcuggagugcaauggcg

SEQ ID NO: 332752 - RNA, 24 nt, Human
ugccucagccucccgaguagcugg

SEQ ID NO: 332753 - RNA, 24 nt, Human
ugcucuuauugccuaggcuggagu

SEQ ID NO: 332754 - RNA, 22 nt, Human
ugcugggauuaaagccaccaca

SEQ ID NO: 332755 - RNA, 23 nt, Human
uggacgcccgagagcccuucuca

SEQ ID NO: 332756 - RNA, 23 nt, Human
uggacgcccgagagcccuucuca

SEQ ID NO: 332757 - RNA, 23 nt, Human
uggacgcccgagagcccuucuca

SEQ ID NO: 332758 - RNA, 24 nt, Human
uggauuuacaaaacauaguaacua

SEQ ID NO: 332759 - RNA, 18 nt, Human
uggcauuacaggcaugug

SEQ ID NO: 332760 - RNA, 22 nt, Human
uggcauuacaggcaugugccac

SEQ ID NO: 332761 - RNA, 24 nt, Human
uggcauuacaggcaugugccacca

SEQ ID NO: 332762 - RNA, 24 nt, Human
uggcgucauuucagcucaccacaa

SEQ ID NO: 332763 - RNA, 20 nt, Human
uggggccaacaacuucucgg

SEQ ID NO: 332764 - RNA, 20 nt, Human
uggggccaacaacuucucgg

SEQ ID NO: 332765 - RNA, 20 nt, Human
uggggccaacaacuucucgg

SEQ ID NO: 332766 - RNA, 24 nt, Human
ugggguuucuccacguuggucagg

SEQ ID NO: 332767 - RNA, 24 nt, Human
uggucaggcugguuucgaacuccu

SEQ ID NO: 332768 - RNA, 21 nt, Human
uguauuuuuaguagagauggg

SEQ ID NO: 332769 - RNA, 18 nt, Human
uuagacucuugaaauguu

SEQ ID NO: 332770 - RNA, 18 nt, Human
uuaguagagaugggguuu

SEQ ID NO: 332771 - RNA, 22 nt, Human
uuaguagagaugggguuucucc

SEQ ID NO: 332772 - RNA, 21 nt, Human
uucaagcaauuuuccugccuc

SEQ ID NO: 332773 - RNA, 24 nt, Human
uucaagcaauuuuccugccucagc

SEQ ID NO: 332774 - RNA, 21 nt, Human
uucagaccggcccuccaccuc

SEQ ID NO: 332775 - RNA, 23 nt, Human
uucagaccggcccuccaccuccu

SEQ ID NO: 332776 - RNA, 23 nt, Human
uucagaccggcccuccaccuccu

SEQ ID NO: 332777 - RNA, 18 nt, Human
uucccaugaguucaaaaa

SEQ ID NO: 332778 - RNA, 20 nt, Human
uugaggcagaguuuugcucu

SEQ ID NO: 332779 - RNA, 18 nt, Human
uugccuaggcuggagugc

SEQ ID NO: 332780 - RNA, 22 nt, Human
uugcucuuauugccuaggcugg

SEQ ID NO: 332781 - RNA, 23 nt, Human
uugcucuuauugccuaggcugga

SEQ ID NO: 332782 - RNA, 23 nt, Human
uuguauuuuuaguagagaugggg

SEQ ID NO: 332783 - RNA, 23 nt, Human
uuucgaacuccugaccucaggug

SEQ ID NO: 332784 - RNA, 24 nt, Human
uuugcucuuauugccuaggcugga

SEQ ID NO: 332785 - RNA, 24 nt, Human
uuuugcucuuauugccuaggcugg

SEQ ID NO: 332786 - RNA, 20 nt, Human
uuuuguauuuuuaguagaga

SEQ ID NO: 332787 - RNA, 22 nt, Human
uuuuuaguagagaugggguuuc

SEQ ID NO: 332788 - RNA, 21 nt, Human
uuuuuguauuuuuaguagaga

SEQ ID NO: 332789 - RNA, 24 nt, Human
uuuuuuguauuuuuaguagagaug

SEQ ID NO: 332790 - RNA, 20 nt, Human
uuuuuuuuuuugaggcagag

SEQ ID NO: 332791 - RNA, 18 nt, Human
uuuuuuuuuuuuuuuuug

SEQ ID NO: 332792 - RNA, 21 nt, Human
uuuuuuuuuuuuuuuuugagg

SEQ ID NO: 332793 - RNA, 27 nt, Human
uuuuuuuuuuuuuuuuuuuuuuugggg

SEQ ID NO: 332794 - RNA, 25 nt, Human
aaaauaucuuucauuauaguaaaac

SEQ ID NO: 332795 - RNA, 25 nt, Human
aaaauaucuuucauuauaguaaaac

SEQ ID NO: 332796 - RNA, 25 nt, Human
aaaauaucuuucauuauaguaaaac

SEQ ID NO: 332797 - RNA, 25 nt, Human
aaaauaucuuucauuauaguaaaac

SEQ ID NO: 332798 - RNA, 25 nt, Human
aaaauaucuuucauuauaguaaaac

SEQ ID NO: 332799 - RNA, 18 nt, Human
aaacaaaaaugaagcugu

SEQ ID NO: 332800 - RNA, 24 nt, Human
aaacaccucgacacacuagaaaac

SEQ ID NO: 332801 - RNA, 24 nt, Human
aaacaccucgacacacuagaaaac

SEQ ID NO: 332802 - RNA, 23 nt, Human
aaauaucuuucauuauaguaaaa

SEQ ID NO: 332803 - RNA, 19 nt, Human
aacacauuguucagcccuc

SEQ ID NO: 332804 - RNA, 19 nt, Human
aacacuguuuuucaaccgu

SEQ ID NO: 332805 - RNA, 19 nt, Human
aaguaccacugaaugaaac

SEQ ID NO: 332806 - RNA, 21 nt, Human
acacauagccuauaaacaccu

SEQ ID NO: 332807 - RNA, 20 nt, Human
acagauuuaauaaauaccga

SEQ ID NO: 332808 - RNA, 23 nt, Human
acagauuuaauaaauaccgaaaa

SEQ ID NO: 332809 - RNA, 28 nt, Human
acauagccuauaaacaccucgacacacu

SEQ ID NO: 332810 - RNA, 26 nt, Human
accucgacacacuagaaaacacauug

SEQ ID NO: 332811 - RNA, 24 nt, Human
accuuuggucuaagaaaaguuuuu

SEQ ID NO: 332812 - RNA, 24 nt, Human
acucuagaaaaucaucaaaugaug

SEQ ID NO: 332813 - RNA, 20 nt, Human
acuuucgacagcaauucuga

SEQ ID NO: 332814 - RNA, 20 nt, Human
acuuucgacagcaauucuga

SEQ ID NO: 332815 - RNA, 23 nt, Human
agaaaacacauuguucagcccuc

SEQ ID NO: 332816 - RNA, 21 nt, Human
agcugugaaguagcaaucuga

SEQ ID NO: 332817 - RNA, 27 nt, Human
agggacugggcuggggcaggcuggggg

SEQ ID NO: 332818 - RNA, 23 nt, Human
aguauuuuuaaggucguugucuu

SEQ ID NO: 332819 - RNA, 19 nt, Human
aucaaaugaugggucaacc

SEQ ID NO: 332820 - RNA, 23 nt, Human
aucaaaugaugggucaacccagu

SEQ ID NO: 332821 - RNA, 22 nt, Human
auuaaaguuuuccuuauuucaa

SEQ ID NO: 332822 - RNA, 23 nt, Human
caaccguguuuucaaauucuuaa

SEQ ID NO: 332823 - RNA, 20 nt, Human
cacacauagccuauaaacac

SEQ ID NO: 332824 - RNA, 24 nt, Human
cacagauuuaauaaauaccgaaaa

SEQ ID NO: 332825 - RNA, 19 nt, Human
cacauagccuauaaacacc

SEQ ID NO: 332826 - RNA, 21 nt, Human
cacuguacaacacaucaaaac

SEQ ID NO: 332827 - RNA, 21 nt, Human
caggaggaccuguuauuaaua

SEQ ID NO: 332828 - RNA, 22 nt, Human
cauccccuuuugggcgaagagc

SEQ ID NO: 332829 - RNA, 18 nt, Human
caugaauucacuugcugu

SEQ ID NO: 332830 - RNA, 22 nt, Human
ccaaaaaaguaaaauaccauga

SEQ ID NO: 332831 - RNA, 22 nt, Human
ccaaaaaaguaaaauaccauga

SEQ ID NO: 332832 - RNA, 22 nt, Human
ccaaaaaaguaaaauaccauga

SEQ ID NO: 332833 - RNA, 22 nt, Human
ccaaaaaaguaaaauaccauga

SEQ ID NO: 332834 - RNA, 19 nt, Human
ccaccuggcccuacccggg

SEQ ID NO: 332835 - RNA, 21 nt, Human
cccaaaaaaguaaaauaccau

SEQ ID NO: 332836 - RNA, 21 nt, Human
cccaaaaaaguaaaauaccau

SEQ ID NO: 332837 - RNA, 21 nt, Human
cccaaaaaaguaaaauaccau

SEQ ID NO: 332838 - RNA, 21 nt, Human
cccaaaaaaguaaaauaccau

SEQ ID NO: 332839 - RNA, 25 nt, Human
ccccuuuugggcgaagagcggaggc

SEQ ID NO: 332840 - RNA, 20 nt, Human
cccgggcucaacgccgagcc

SEQ ID NO: 332841 - RNA, 23 nt, Human
cccgggcucaacgccgagccucu

SEQ ID NO: 332842 - RNA, 24 nt, Human
ccuauaaacaccucgacacacuag

SEQ ID NO: 332843 - RNA, 25 nt, Human
ccuauaaacaccucgacacacuaga

SEQ ID NO: 332844 - RNA, 22 nt, Human
ccucgacacacuagaaaacaca

SEQ ID NO: 332845 - RNA, 22 nt, Human
ccuggcccuacccgggcucaac

SEQ ID NO: 332846 - RNA, 23 nt, Human
cgaaaaaauuaagagauuugaag

SEQ ID NO: 332847 - RNA, 22 nt, Human
cgggagggacugggcuggggca

SEQ ID NO: 332848 - RNA, 21 nt, Human
cucaacgccgagccucucgga

SEQ ID NO: 332849 - RNA, 23 nt, Human
cucacagauuuaauaaauaccga

SEQ ID NO: 332850 - RNA, 26 nt, Human
cugguacuauaaucuuggccccuuuc

SEQ ID NO: 332851 - RNA, 26 nt, Human
cugguacuauaaucuuggccccuuuc

SEQ ID NO: 332852 - RNA, 26 nt, Human
cugguacuauaaucuuggccccuuuc

SEQ ID NO: 332853 - RNA, 26 nt, Human
cugguacuauaaucuuggccccuuuc

SEQ ID NO: 332854 - RNA, 26 nt, Human
cugguacuauaaucuuggccccuuuc

SEQ ID NO: 332855 - RNA, 18 nt, Human
cuuaaaccacucacagau

SEQ ID NO: 332856 - RNA, 19 nt, Human
cuuucgacagcaauucuga

SEQ ID NO: 332857 - RNA, 19 nt, Human
cuuucgacagcaauucuga

SEQ ID NO: 332858 - RNA, 19 nt, Human
cuuucgacagcaauucuga

SEQ ID NO: 332859 - RNA, 19 nt, Human
cuuucgacagcaauucuga

SEQ ID NO: 332860 - RNA, 22 nt, Human
gaaaaaauuaagagauuugaag

SEQ ID NO: 332861 - RNA, 20 nt, Human
gacacacuagaaaacacauu

SEQ ID NO: 332862 - RNA, 19 nt, Human
ggacugggcuggggcaggc

SEQ ID NO: 332863 - RNA, 19 nt, Human
ggaggcgaccagggacuac

SEQ ID NO: 332864 - RNA, 20 nt, Human
ggcuggggcaggcugggggc

SEQ ID NO: 332865 - RNA, 19 nt, Human
gggcgcgcggccgggaggg

SEQ ID NO: 332866 - RNA, 18 nt, Human
gguugccuuucuaaaacu

SEQ ID NO: 332867 - RNA, 20 nt, Human
guuuauauuuauccacccau

SEQ ID NO: 332868 - RNA, 26 nt, Human
uaaaauaccaugaauucacuugcggg

SEQ ID NO: 332869 - RNA, 19 nt, Human
uaaaauagauccacccugu

SEQ ID NO: 332870 - RNA, 21 nt, Human
uaaaguuuuccuuauuucaaa

SEQ ID NO: 332871 - RNA, 21 nt, Human
uaaaguuuuccuuauuucaaa

SEQ ID NO: 332872 - RNA, 21 nt, Human
uaaaguuuuccuuauuucaaa

SEQ ID NO: 332873 - RNA, 21 nt, Human
uaaauguggacucccauauac

SEQ ID NO: 332874 - RNA, 21 nt, Human
uaaauguggacucccauauac

SEQ ID NO: 332875 - RNA, 21 nt, Human
uaaauguggacucccauauac

SEQ ID NO: 332876 - RNA, 21 nt, Human
uaaauguggacucccauauac

SEQ ID NO: 332877 - RNA, 21 nt, Human
uaaauguggacucccauauac

SEQ ID NO: 332878 - RNA, 22 nt, Human
uaaauguggacucccauauauu

SEQ ID NO: 332879 - RNA, 19 nt, Human
uaacuuauguaaauacuuu

SEQ ID NO: 332880 - RNA, 22 nt, Human
uaagucuuaaacuguaaaauuu

SEQ ID NO: 332881 - RNA, 20 nt, Human
uaaucuuggccccuuuccuc

SEQ ID NO: 332882 - RNA, 20 nt, Human
uaaucuuggccccuuuccuc

SEQ ID NO: 332883 - RNA, 20 nt, Human
uaaucuuggccccuuuccuc

SEQ ID NO: 332884 - RNA, 20 nt, Human
uaaucuuggccccuuuccuc

SEQ ID NO: 332885 - RNA, 20 nt, Human
uaaucuuggccccuuuccuc

SEQ ID NO: 332886 - RNA, 20 nt, Human
uaaucuuggccccuuuccuc

SEQ ID NO: 332887 - RNA, 26 nt, Human
uaccaugcuccuuugauaguauuuuu

SEQ ID NO: 332888 - RNA, 23 nt, Human
uaccuuuggucuaagaaaaguuu

SEQ ID NO: 332889 - RNA, 21 nt, Human
uacuuuguggaagauaccuuu

SEQ ID NO: 332890 - RNA, 19 nt, Human
uauacuggacuacuuuaca

SEQ ID NO: 332891 - RNA, 20 nt, Human
ucacugcccucuucagaggc

SEQ ID NO: 332892 - RNA, 20 nt, Human
ucaggcaauucuauuugagc

SEQ ID NO: 332893 - RNA, 20 nt, Human
ucaggcaauucuauuugagc

SEQ ID NO: 332894 - RNA, 20 nt, Human
ucaggcaauucuauuugagc

SEQ ID NO: 332895 - RNA, 20 nt, Human
ucaggcaauucuauuugagc

SEQ ID NO: 332896 - RNA, 18 nt, Human
uccacauccaggaggacc

SEQ ID NO: 332897 - RNA, 21 nt, Human
uccaguauuucccaaaaaagu

SEQ ID NO: 332898 - RNA, 21 nt, Human
uccaguauuucccaaaaaagu

SEQ ID NO: 332899 - RNA, 21 nt, Human
uccaguauuucccaaaaaagu

SEQ ID NO: 332900 - RNA, 21 nt, Human
uccaguauuucccaaaaaagu

SEQ ID NO: 332901 - RNA, 23 nt, Human
ucccaaaaaaguaaaauaccaug

SEQ ID NO: 332902 - RNA, 23 nt, Human
ucccaaaaaaguaaaauaccaug

SEQ ID NO: 332903 - RNA, 23 nt, Human
ucccaaaaaaguaaaauaccaug

SEQ ID NO: 332904 - RNA, 23 nt, Human
ucccaaaaaaguaaaauaccaug

SEQ ID NO: 332905 - RNA, 19 nt, Human
ugaaauacuacaagaauga

SEQ ID NO: 332906 - RNA, 21 nt, Human
ugaaguaccacugaaugaaac

SEQ ID NO: 332907 - RNA, 27 nt, Human
ugacauuauaaacuguaauaguuccca

SEQ ID NO: 332908 - RNA, 22 nt, Human
ugacuugaguuauucacaccua

SEQ ID NO: 332909 - RNA, 22 nt, Human
ugcaaacuagugaauucaacga

SEQ ID NO: 332910 - RNA, 24 nt, Human
ugcucugggcaucgggcgcccagg

SEQ ID NO: 332911 - RNA, 20 nt, Human
uggaaaucugcugcuuucua

SEQ ID NO: 332912 - RNA, 19 nt, Human
uggaagucugguaaaacug

SEQ ID NO: 332913 - RNA, 24 nt, Human
uggcauaauguucaaacacacuuu

SEQ ID NO: 332914 - RNA, 22 nt, Human
ugggcuggggcaggcugggggc

SEQ ID NO: 332915 - RNA, 22 nt, Human
uggggcaggcugggggcgcaga

SEQ ID NO: 332916 - RNA, 23 nt, Human
ugugauauaacuuauguaaauac

SEQ ID NO: 332917 - RNA, 21 nt, Human
uguuucccggagcugcauccc

SEQ ID NO: 332918 - RNA, 18 nt, Human
uguuuugguugccuuucu

SEQ ID NO: 332919 - RNA, 22 nt, Human
uuaaaguuuuccuuauuucaaa

SEQ ID NO: 332920 - RNA, 22 nt, Human
uuaaaguuuuccuuauuucaaa

SEQ ID NO: 332921 - RNA, 24 nt, Human
uucaacauuuuaauugugauauaa

SEQ ID NO: 332922 - RNA, 21 nt, Human
uucagcccuccgccccaaauc

SEQ ID NO: 332923 - RNA, 23 nt, Human
uuccacuguacaacacaucaaaa

SEQ ID NO: 332924 - RNA, 19 nt, Human
uucccaaaaaaguaaaaua

SEQ ID NO: 332925 - RNA, 19 nt, Human
uucccaaaaaaguaaaaua

SEQ ID NO: 332926 - RNA, 19 nt, Human
uucccaaaaaaguaaaaua

SEQ ID NO: 332927 - RNA, 19 nt, Human
uucccaaaaaaguaaaaua

SEQ ID NO: 332928 - RNA, 18 nt, Human
uucccggagcugcauccc

SEQ ID NO: 332929 - RNA, 19 nt, Human
uugcauccugaauuagucc

SEQ ID NO: 332930 - RNA, 20 nt, Human
uuucuugguaacacuguuuu

SEQ ID NO: 332931 - RNA, 24 nt, Human
aaaaagacaaggucaacggagaca

SEQ ID NO: 332932 - RNA, 23 nt, Human
aaaccaaaccaaaccaaaccaaa

SEQ ID NO: 332933 - RNA, 24 nt, Human
aaacugauacucucuauucauuua

SEQ ID NO: 332934 - RNA, 21 nt, Human
aagacacaggucuaacaaaca

SEQ ID NO: 332935 - RNA, 18 nt, Human
aagugcuauuucagaaga

SEQ ID NO: 332936 - RNA, 23 nt, Human
acacauuaucagaaaccccaagg

SEQ ID NO: 332937 - RNA, 18 nt, Human
agaggcaggaggcaacug

SEQ ID NO: 332938 - RNA, 23 nt, Human
augauuucuaacccauacucaac

SEQ ID NO: 332939 - RNA, 23 nt, Human
caaaaacaaacauuuaacucaac

SEQ ID NO: 332940 - RNA, 22 nt, Human
caaaccaaaccaaaccaaaucc

SEQ ID NO: 332941 - RNA, 26 nt, Human
caaagagucuaccuccucugcaaagc

SEQ ID NO: 332942 - RNA, 19 nt, Human
cacacauuaucagaaaccc

SEQ ID NO: 332943 - RNA, 23 nt, Human
caccaaggaugugaacugacauc

SEQ ID NO: 332944 - RNA, 22 nt, Human
caccccucaggauuucaugcaa

SEQ ID NO: 332945 - RNA, 18 nt, Human
cacuucacugugaaaaca

SEQ ID NO: 332946 - RNA, 21 nt, Human
cacuucacugugaaaacacua

SEQ ID NO: 332947 - RNA, 26 nt, Human
cagccacccacuagccuccggcgcuc

SEQ ID NO: 332948 - RNA, 23 nt, Human
caucccgccuuuccaaaaacaaa

SEQ ID NO: 332949 - RNA, 20 nt, Human
caugcucacuuaccucacaa

SEQ ID NO: 332950 - RNA, 21 nt, Human
cauugccgcauuuacuaucau

SEQ ID NO: 332951 - RNA, 26 nt, Human
ccaaaaagacaaggucaacggagaca

SEQ ID NO: 332952 - RNA, 19 nt, Human
ccauaaugagacuccacac

SEQ ID NO: 332953 - RNA, 22 nt, Human
cccauacucaacuauccagagg

SEQ ID NO: 332954 - RNA, 21 nt, Human
ccccaaggcauaccaaaaaga

SEQ ID NO: 332955 - RNA, 21 nt, Human
ccuccggcgcuccaacaccac

SEQ ID NO: 332956 - RNA, 20 nt, Human
ccucugcaaagcugguaccu

SEQ ID NO: 332957 - RNA, 21 nt, Human
ccugugccaaagugccaaaga

SEQ ID NO: 332958 - RNA, 22 nt, Human
cuacugguagacauuuuacaca

SEQ ID NO: 332959 - RNA, 24 nt, Human
cucaacuauccagaggauacuguu

SEQ ID NO: 332960 - RNA, 18 nt, Human
cuccggcgcuccaacacc

SEQ ID NO: 332961 - RNA, 18 nt, Human
cucgggcaacaaccauca

SEQ ID NO: 332962 - RNA, 21 nt, Human
cucugagaaauguguaagaca

SEQ ID NO: 332963 - RNA, 24 nt, Human
cuuuuaguuuccuuaaugcacccc

SEQ ID NO: 332964 - RNA, 23 nt, Human
gaaaccccaaggcauaccaaaaa

SEQ ID NO: 332965 - RNA, 25 nt, Human
gaacucauaaagaaaucaaaugucu

SEQ ID NO: 332966 - RNA, 21 nt, Human
gcaauaaagaaguugaaagaa

SEQ ID NO: 332967 - RNA, 24 nt, Human
gcugggugauggcagagggguggg

SEQ ID NO: 332968 - RNA, 24 nt, Human
ggagcugcuguaacacaggcaugg

SEQ ID NO: 332969 - RNA, 21 nt, Human
ggcucugaaaugccagagagg

SEQ ID NO: 332970 - RNA, 19 nt, Human
ggggucagccacccacuag

SEQ ID NO: 332971 - RNA, 18 nt, Human
ggggugggaguuggggga

SEQ ID NO: 332972 - RNA, 24 nt, Human
ggucaacggagacagucuuuggaa

SEQ ID NO: 332973 - RNA, 18 nt, Human
guaacauuuuuccccucu

SEQ ID NO: 332974 - RNA, 23 nt, Human
uaacaaacaacuacauuaaccuc

SEQ ID NO: 332975 - RNA, 22 nt, Human
uaagacacaggucuaacaaaca

SEQ ID NO: 332976 - RNA, 23 nt, Human
uaauuucugacaacucagugaca

SEQ ID NO: 332977 - RNA, 22 nt, Human
uagccuccggcgcuccaacacc

SEQ ID NO: 332978 - RNA, 25 nt, Human
uaucagaaaccccaaggcauaccaa

SEQ ID NO: 332979 - RNA, 22 nt, Human
uauucauuuacaaaauucauuc

SEQ ID NO: 332980 - RNA, 19 nt, Human
ucauucauugcauacuuuu

SEQ ID NO: 332981 - RNA, 21 nt, Human
uccaacaccacucgaaauucc

SEQ ID NO: 332982 - RNA, 23 nt, Human
ugaaaacacuaaacucucagcca

SEQ ID NO: 332983 - RNA, 25 nt, Human
ugaaaacacuaaacucucagccaua

SEQ ID NO: 332984 - RNA, 21 nt, Human
ugaaaagucagcaaaagccca

SEQ ID NO: 332985 - RNA, 21 nt, Human
ugagaaauguguaagacacag

SEQ ID NO: 332986 - RNA, 20 nt, Human
ugaggcuggauucuccaugg

SEQ ID NO: 332987 - RNA, 21 nt, Human
ugauggcagaggggugggagu

SEQ ID NO: 332988 - RNA, 19 nt, Human
ugauuucuaacccauacuc

SEQ ID NO: 332989 - RNA, 18 nt, Human
uggaaaagcagaaaagaa

SEQ ID NO: 332990 - RNA, 18 nt, Human
uggcagaggggugggagu

SEQ ID NO: 332991 - RNA, 22 nt, Human
uggcagaggggugggaguuggg

SEQ ID NO: 332992 - RNA, 20 nt, Human
uguuugggcugggugauggc

SEQ ID NO: 332993 - RNA, 18 nt, Human
uucaugcaaaugaaauua

SEQ ID NO: 332994 - RNA, 20 nt, Human
uuccuuaaugcaccccucag

SEQ ID NO: 332995 - RNA, 21 nt, Human
uuccuugggcauuuauaaaua

SEQ ID NO: 332996 - RNA, 19 nt, Human
uuuagaggcaggaggcaac

SEQ ID NO: 332997 - RNA, 21 nt, Human
uuuccuuaaugcaccccucag

SEQ ID NO: 332998 - RNA, 18 nt, Human
uuuguaacauuuuucccc

SEQ ID NO: 332999 - RNA, 21 nt, Human
uuugugaggcuggauucucca

SEQ ID NO: 333000 - RNA, 21 nt, Human
uuugugaggcuggauucucca

SEQ ID NO: 333001 - RNA, 18 nt, Human
uuuugacauaauuucuga

SEQ ID NO: 333002 - RNA, 24 nt, Human
uuuuguaacauuuuuccccucugg

SEQ ID NO: 333003 - RNA, 21 nt, Human
uuuuuagagagagauguuuua

SEQ ID NO: 333004 - RNA, 23 nt, Human
aaacugaaucauuaaaacaguaa

SEQ ID NO: 333005 - RNA, 20 nt, Human
aacccgauaagcaacaaaaa

SEQ ID NO: 333006 - RNA, 28 nt, Human
aacccgauaagcaacaaaaaccagacua

SEQ ID NO: 333007 - RNA, 21 nt, Human
aacgaaucucaagagggugac

SEQ ID NO: 333008 - RNA, 18 nt, Human
aagaaggaaaaaggcaaa

SEQ ID NO: 333009 - RNA, 24 nt, Human
aagcaacaaaaaccagacuaacaa

SEQ ID NO: 333010 - RNA, 26 nt, Human
aagcaacaaaaaccagacuaacaaaa

SEQ ID NO: 333011 - RNA, 23 nt, Human
aaggagagugguuaacaggaaga

SEQ ID NO: 333012 - RNA, 19 nt, Human
aauaauaaagucuuuauuu

SEQ ID NO: 333013 - RNA, 23 nt, Human
acaaaaaccagacuaacaaaaug

SEQ ID NO: 333014 - RNA, 18 nt, Human
acaagaaacuaaugaccu

SEQ ID NO: 333015 - RNA, 19 nt, Human
agaacacaaacacaaccca

SEQ ID NO: 333016 - RNA, 23 nt, Human
agacaaaaaucuaaguuuucuca

SEQ ID NO: 333017 - RNA, 19 nt, Human
agcccuugcgagguguagc

SEQ ID NO: 333018 - RNA, 25 nt, Human
aggcaaagacuuuguacagacaaaa

SEQ ID NO: 333019 - RNA, 26 nt, Human
aggggguggggaaaggggggagcccu

SEQ ID NO: 333020 - RNA, 19 nt, Human
auagcuccuagaaaguuau

SEQ ID NO: 333021 - RNA, 22 nt, Human
aucagaacacaaacacaaccca

SEQ ID NO: 333022 - RNA, 24 nt, Human
auuuauagcuccuagaaaguuaug

SEQ ID NO: 333023 - RNA, 18 nt, Human
caaagacuuacaccauag

SEQ ID NO: 333024 - RNA, 22 nt, Human
caacaaaaaccagacuaacaaa

SEQ ID NO: 333025 - RNA, 28 nt, Human
caagaaacuaaugaccuuucuaaaauca

SEQ ID NO: 333026 - RNA, 18 nt, Human
caagaacaauauuaaacc

SEQ ID NO: 333027 - RNA, 20 nt, Human
cagcacuggaaaaggagauc

SEQ ID NO: 333028 - RNA, 23 nt, Human
caguaaugaagaacuaagauaaa

SEQ ID NO: 333029 - RNA, 26 nt, Human
caguccuaucuuuuuguagcugaagg

SEQ ID NO: 333030 - RNA, 18 nt, Human
cauaacacaauuucgcgu

SEQ ID NO: 333031 - RNA, 19 nt, Human
cauaacacaauuucgcgua

SEQ ID NO: 333032 - RNA, 20 nt, Human
caucagaacacaaacacaac

SEQ ID NO: 333033 - RNA, 19 nt, Human
cauuauggaauuacacuua

SEQ ID NO: 333034 - RNA, 19 nt, Human
ccacucugaagaaacugaa

SEQ ID NO: 333035 - RNA, 22 nt, Human
cccgauaagcaacaaaaaccaa

SEQ ID NO: 333036 - RNA, 19 nt, Human
cccgccgccgccacagccg

SEQ ID NO: 333037 - RNA, 22 nt, Human
cgagcagcucccgccgccgcca

SEQ ID NO: 333038 - RNA, 19 nt, Human
cggaauacucaaauauauc

SEQ ID NO: 333039 - RNA, 22 nt, Human
cggggaggggaaaagggucggg

SEQ ID NO: 333040 - RNA, 24 nt, Human
cuaaugaccuuucuaaaaucaaac

SEQ ID NO: 333041 - RNA, 20 nt, Human
cuaugaaaacagaagaaaac

SEQ ID NO: 333042 - RNA, 20 nt, Human
cucccgccgccgccacagcc

SEQ ID NO: 333043 - RNA, 22 nt, Human
cugaagaaacugaauccugugg

SEQ ID NO: 333044 - RNA, 23 nt, Human
cuggcuaugaaaacagaagaaaa

SEQ ID NO: 333045 - RNA, 20 nt, Human
cuguuuucuccaucagaaca

SEQ ID NO: 333046 - RNA, 21 nt, Human
gaaaacagaagaaaaccuugc

SEQ ID NO: 333047 - RNA, 22 nt, Human
ggcccggggaggggaaaagggu

SEQ ID NO: 333048 - RNA, 23 nt, Human
ggcccggggaggggaaaaggguc

SEQ ID NO: 333049 - RNA, 20 nt, Human
ggcuaugaaaacagaagaaa

SEQ ID NO: 333050 - RNA, 18 nt, Human
gggaggggguggggaaag

SEQ ID NO: 333051 - RNA, 23 nt, Human
ggggaaaggggggagcccuugcg

SEQ ID NO: 333052 - RNA, 21 nt, Human
ggggaggggguggggaaaggg

SEQ ID NO: 333053 - RNA, 23 nt, Human
gggggaggggguggggaaagggg

SEQ ID NO: 333054 - RNA, 18 nt, Human
ggguggcccggggagggg

SEQ ID NO: 333055 - RNA, 22 nt, Human
guccuuggggugcuguuuucuc

SEQ ID NO: 333056 - RNA, 24 nt, Human
guguaacaagaaacuaaugaccuu

SEQ ID NO: 333057 - RNA, 20 nt, Human
guguuuguuuguuuuuuuuu

SEQ ID NO: 333058 - RNA, 23 nt, Human
guguuuguuuguuuuuuuuucuu

SEQ ID NO: 333059 - RNA, 19 nt, Human
uaaacccgauaagcaacaa

SEQ ID NO: 333060 - RNA, 22 nt, Human
uaaacccgauaagcaacaaaaa

SEQ ID NO: 333061 - RNA, 26 nt, Human
uaaacccgauaagcaacaaaaaccag

SEQ ID NO: 333062 - RNA, 23 nt, Human
uaacacaauuucgcguacaccuc

SEQ ID NO: 333063 - RNA, 23 nt, Human
uaagauaaaaaucaugacuuuug

SEQ ID NO: 333064 - RNA, 22 nt, Human
uaagcaacaaaaaccagacuaa

SEQ ID NO: 333065 - RNA, 22 nt, Human
uaaguugaccaggugcauaauu

SEQ ID NO: 333066 - RNA, 23 nt, Human
uaauaauaaagucuuuauuugga

SEQ ID NO: 333067 - RNA, 18 nt, Human
uacaaaauagaacacuuu

SEQ ID NO: 333068 - RNA, 21 nt, Human
uacagcaucgucugcuuaaaa

SEQ ID NO: 333069 - RNA, 21 nt, Human
uaccacucugaagaaacugaa

SEQ ID NO: 333070 - RNA, 19 nt, Human
uagcuuccgagcagcuccc

SEQ ID NO: 333071 - RNA, 22 nt, Human
uaugaaaacagaagaaaaccuu

SEQ ID NO: 333072 - RNA, 25 nt, Human
uauuacaugcaccaauauugcacac

SEQ ID NO: 333073 - RNA, 21 nt, Human
ucaaacacuagcuauaaugcu

SEQ ID NO: 333074 - RNA, 20 nt, Human
ucagaacacaaacacaaccc

SEQ ID NO: 333075 - RNA, 23 nt, Human
ucagauaccaucccuaaggagag

SEQ ID NO: 333076 - RNA, 23 nt, Human
ucaguacuaaaacuuacaauaaa

SEQ ID NO: 333077 - RNA, 22 nt, Human
uccaaaccaggagugugcagca

SEQ ID NO: 333078 - RNA, 20 nt, Human
ucccgccgccgccacagccg

SEQ ID NO: 333079 - RNA, 19 nt, Human
ucuaaaaucaaacauucaa

SEQ ID NO: 333080 - RNA, 19 nt, Human
ucuacaaugucuuuuuaca

SEQ ID NO: 333081 - RNA, 22 nt, Human
ugaagaacuaagauaaaaauca

SEQ ID NO: 333082 - RNA, 18 nt, Human
ugaagaaggaaaaaggca

SEQ ID NO: 333083 - RNA, 22 nt, Human
ugcagcacuggaaaaggagauc

SEQ ID NO: 333084 - RNA, 22 nt, Human
ugcaguaaugaagaacuaagau

SEQ ID NO: 333085 - RNA, 22 nt, Human
uggaaaaaaaugaagaaggaaa

SEQ ID NO: 333086 - RNA, 25 nt, Human
uggaaagaaguguuuguuuguuuuu

SEQ ID NO: 333087 - RNA, 20 nt, Human
ugggaguugggcgggcuggg

SEQ ID NO: 333088 - RNA, 22 nt, Human
ugguuaacaggaagauugccag

SEQ ID NO: 333089 - RNA, 19 nt, Human
uuauuggguauacacugaa

SEQ ID NO: 333090 - RNA, 19 nt, Human
uucaguguuaacuuugccc

SEQ ID NO: 333091 - RNA, 23 nt, Human
uugcccuaaaaaguuaagacaua

SEQ ID NO: 333092 - RNA, 20 nt, Human
uugcucauuuuggagccuca

SEQ ID NO: 333093 - RNA, 19 nt, Human
uuuuccuuuucaaugcagu

SEQ ID NO: 333094 - RNA, 23 nt, Human
aacuuuauucacuucaaaaccuu

SEQ ID NO: 333095 - RNA, 21 nt, Human
aagcagccgccuuuccgucug

SEQ ID NO: 333096 - RNA, 19 nt, Human
agacuggggagggggccuu

SEQ ID NO: 333097 - RNA, 23 nt, Human
agacuggggagggggccuugggc

SEQ ID NO: 333098 - RNA, 18 nt, Human
agagcugggacagaggcc

SEQ ID NO: 333099 - RNA, 27 nt, Human
agaggauggggggggguccucaggggu

SEQ ID NO: 333100 - RNA, 18 nt, Human
aggaggacggggggacag

SEQ ID NO: 333101 - RNA, 20 nt, Human
aggcaagcagccgccuuucc

SEQ ID NO: 333102 - RNA, 21 nt, Human
aggccaaggccagacugggga

SEQ ID NO: 333103 - RNA, 30 nt, Human
cacgguucuguucugggguggggguggccc

SEQ ID NO: 333104 - RNA, 19 nt, Human
cagccgccuuuccgucugg

SEQ ID NO: 333105 - RNA, 18 nt, Human
cagcuuccccucauccua

SEQ ID NO: 333106 - RNA, 18 nt, Human
ccaguccugccagcuucu

SEQ ID NO: 333107 - RNA, 18 nt, Human
ccgcgcgccgaccacuuc

SEQ ID NO: 333108 - RNA, 19 nt, Human
ccucccaguccugccagcu

SEQ ID NO: 333109 - RNA, 21 nt, Human
cgccgcgccgcgcgccgacca

SEQ ID NO: 333110 - RNA, 21 nt, Human
cgguucuguucuggggugggg

SEQ ID NO: 333111 - RNA, 27 nt, Human
cugggacagaggccaagaggggcccau

SEQ ID NO: 333112 - RNA, 21 nt, Human
cuggggagggggccuugggcc

SEQ ID NO: 333113 - RNA, 25 nt, Human
cuucucugagcaggcugggcugggg

SEQ ID NO: 333114 - RNA, 18 nt, Human
cuuucaggacuugcccua

SEQ ID NO: 333115 - RNA, 23 nt, Human
gaacaggggccacuuuaggagga

SEQ ID NO: 333116 - RNA, 23 nt, Human
gagcugggacagaggccaagagg

SEQ ID NO: 333117 - RNA, 21 nt, Human
gaggauggggggggguccuca

SEQ ID NO: 333118 - RNA, 20 nt, Human
gauggggggggguccucaac

SEQ ID NO: 333119 - RNA, 22 nt, Human
gauggggggggguccucagggg

SEQ ID NO: 333120 - RNA, 22 nt, Human
ggauggggggggguccucaggg

SEQ ID NO: 333121 - RNA, 23 nt, Human
ggcuggggaggaggacgggggga

SEQ ID NO: 333122 - RNA, 25 nt, Human
gggauccucacacaacaugcaacuc

SEQ ID NO: 333123 - RNA, 20 nt, Human
gggcccgagcgacgcggcgg

SEQ ID NO: 333124 - RNA, 18 nt, Human
gggcuggggaggaggacg

SEQ ID NO: 333125 - RNA, 25 nt, Human
ggggguccucagggguuuuucggag

SEQ ID NO: 333126 - RNA, 22 nt, Human
ggggguggccuugacaaugagc

SEQ ID NO: 333127 - RNA, 21 nt, Human
guucuguucuggggugggggu

SEQ ID NO: 333128 - RNA, 20 nt, Human
uagggugggggcuucggugg

SEQ ID NO: 333129 - RNA, 19 nt, Human
ucugagcaggcugggcugg

SEQ ID NO: 333130 - RNA, 22 nt, Human
uggcccgggagaugggaacagg

SEQ ID NO: 333131 - RNA, 18 nt, Human
uggcugcagagagcuggg

SEQ ID NO: 333132 - RNA, 27 nt, Human
ugggacagaggccaagaggggcccauc

SEQ ID NO: 333133 - RNA, 24 nt, Human
ugggcuggggaggaggacgggggg

SEQ ID NO: 333134 - RNA, 20 nt, Human
uggggagggggccuugggcc

SEQ ID NO: 333135 - RNA, 20 nt, Human
uggggggggguccucagggg

SEQ ID NO: 333136 - RNA, 18 nt, Human
uucgguggccuggcuucc

SEQ ID NO: 333137 - RNA, 30 nt, Human
uugacaaugagcugauguuagcccuucucu

SEQ ID NO: 333138 - RNA, 19 nt, Human
uuggggcuccagcuucccc

SEQ ID NO: 333139 - RNA, 21 nt, Human
aaaaaaaaaauguaaacagga

SEQ ID NO: 333140 - RNA, 19 nt, Human
aaaaauccaaauaaaagcc

SEQ ID NO: 333141 - RNA, 20 nt, Human
aaaguacuuuccagccacau

SEQ ID NO: 333142 - RNA, 21 nt, Human
aaggcggugggggugggggcc

SEQ ID NO: 333143 - RNA, 20 nt, Human
aagucaucccagacaauccg

SEQ ID NO: 333144 - RNA, 21 nt, Human
aauaucagaaacccaguuuug

SEQ ID NO: 333145 - RNA, 25 nt, Human
aaugaaggagauuccacagaaaaaa

SEQ ID NO: 333146 - RNA, 23 nt, Human
aauuuuaaaauagcaguaauuau

SEQ ID NO: 333147 - RNA, 28 nt, Human
acagaaaaaacugagaugaaaaaauccc

SEQ ID NO: 333148 - RNA, 21 nt, Human
accaucaauuuggcauuucug

SEQ ID NO: 333149 - RNA, 20 nt, Human
acuugcugauaaacacguuu

SEQ ID NO: 333150 - RNA, 24 nt, Human
agaaaagguucccuuucuccccuc

SEQ ID NO: 333151 - RNA, 22 nt, Human
agaagaaauaaagaccugcaaa

SEQ ID NO: 333152 - RNA, 19 nt, Human
agauuugaaaaacugaaca

SEQ ID NO: 333153 - RNA, 18 nt, Human
aggcagcaguuugacuca

SEQ ID NO: 333154 - RNA, 18 nt, Human
aggcgguggggguggggg

SEQ ID NO: 333155 - RNA, 19 nt, Human
aggcggugggggugggggc

SEQ ID NO: 333156 - RNA, 19 nt, Human
agggggucggcgagacaag

SEQ ID NO: 333157 - RNA, 24 nt, Human
agguucccuuucuccccucccacc

SEQ ID NO: 333158 - RNA, 22 nt, Human
auaaacacguuucugcugaggg

SEQ ID NO: 333159 - RNA, 22 nt, Human
aucccucccuccccacccccaa

SEQ ID NO: 333160 - RNA, 20 nt, Human
auuuucauuuuaagaaaagg

SEQ ID NO: 333161 - RNA, 24 nt, Human
caaaacaaaaaaaaaauguaaaca

SEQ ID NO: 333162 - RNA, 19 nt, Human
caaugaucaagaaauuuua

SEQ ID NO: 333163 - RNA, 25 nt, Human
cacagaaaaaacugagaugaaaaaa

SEQ ID NO: 333164 - RNA, 19 nt, Human
caccccaaguauuuaacau

SEQ ID NO: 333165 - RNA, 22 nt, Human
cagaaaaaacugagaugaaaaa

SEQ ID NO: 333166 - RNA, 21 nt, Human
cagcggagcggccucuccccc

SEQ ID NO: 333167 - RNA, 20 nt, Human
caucaaaagcaaacaugcaa

SEQ ID NO: 333168 - RNA, 24 nt, Human
cauguuagaagggucucacauuca

SEQ ID NO: 333169 - RNA, 23 nt, Human
ccaaaacaaaaaaaaaauguaaa

SEQ ID NO: 333170 - RNA, 22 nt, Human
ccacagaaaaaacugagaugaa

SEQ ID NO: 333171 - RNA, 21 nt, Human
ccacaggaugguggccgccau

SEQ ID NO: 333172 - RNA, 18 nt, Human
ccacccccaacaaucuac

SEQ ID NO: 333173 - RNA, 24 nt, Human
ccagccacaucucccaacccaucc

SEQ ID NO: 333174 - RNA, 27 nt, Human
cccaaaacaaaaaaaaaauguaaacag

SEQ ID NO: 333175 - RNA, 23 nt, Human
cccaaaagugcuaauuucacaaa

SEQ ID NO: 333176 - RNA, 21 nt, Human
cccagcggagcggccucuccc

SEQ ID NO: 333177 - RNA, 25 nt, Human
ccccaacaaucuacuaccuuauacc

SEQ ID NO: 333178 - RNA, 19 nt, Human
ccccacccccaacaaucua

SEQ ID NO: 333179 - RNA, 25 nt, Human
ccccagcccgugccccggaccgcgc

SEQ ID NO: 333180 - RNA, 18 nt, Human
cccccagcccgugccccg

SEQ ID NO: 333181 - RNA, 22 nt, Human
cccccagcccgugccccggacc

SEQ ID NO: 333182 - RNA, 23 nt, Human
ccccggggucgcccgcgcuccuc

SEQ ID NO: 333183 - RNA, 22 nt, Human
ccccucccaccccaaguauuua

SEQ ID NO: 333184 - RNA, 21 nt, Human
cccggaccgcgccgcugccuc

SEQ ID NO: 333185 - RNA, 19 nt, Human
cccucccuccccaccccca

SEQ ID NO: 333186 - RNA, 19 nt, Human
ccgcugccuccgcgacugc

SEQ ID NO: 333187 - RNA, 24 nt, Human
ccuagaucccucccuccccacccc

SEQ ID NO: 333188 - RNA, 21 nt, Human
ccuccccacccccaacaaucu

SEQ ID NO: 333189 - RNA, 18 nt, Human
ccuccgcgacugcggccu

SEQ ID NO: 333190 - RNA, 20 nt, Human
cgccgcugccuccgcgacug

SEQ ID NO: 333191 - RNA, 20 nt, Human
cggggucuguggccuggcgg

SEQ ID NO: 333192 - RNA, 21 nt, Human
cuacuaccuuauaccaaguau

SEQ ID NO: 333193 - RNA, 19 nt, Human
cucccccagcccgugcccc

SEQ ID NO: 333194 - RNA, 24 nt, Human
cuuuccagccacaucucccaaccc

SEQ ID NO: 333195 - RNA, 25 nt, Human
gaaaaaauccaaauaaaagccaaca

SEQ ID NO: 333196 - RNA, 21 nt, Human
gagaugaaaaaauccaaauaa

SEQ ID NO: 333197 - RNA, 23 nt, Human
gaucccucccuccccacccccaa

SEQ ID NO: 333198 - RNA, 21 nt, Human
gccauuauccaguguugccau

SEQ ID NO: 333199 - RNA, 18 nt, Human
gccccggaccgcgccgcu

SEQ ID NO: 333200 - RNA, 23 nt, Human
gcgagacaagcagggaauccgcu

SEQ ID NO: 333201 - RNA, 24 nt, Human
gcggccucucccccagcccgugcc

SEQ ID NO: 333202 - RNA, 21 nt, Human
gcuugucacauucgcccagcg

SEQ ID NO: 333203 - RNA, 20 nt, Human
ggcggggucuguggccuggc

SEQ ID NO: 333204 - RNA, 22 nt, Human
ggcggugggggugggggcuugu

SEQ ID NO: 333205 - RNA, 18 nt, Human
ggucgcccgcgcuccucg

SEQ ID NO: 333206 - RNA, 18 nt, Human
ggucggcgagacaagcag

SEQ ID NO: 333207 - RNA, 21 nt, Human
ggucuguggccuggcggggcc

SEQ ID NO: 333208 - RNA, 19 nt, Human
gucugcagaaggcgcgagg

SEQ ID NO: 333209 - RNA, 22 nt, Human
gugcuggccgcugggcgggguc

SEQ ID NO: 333210 - RNA, 19 nt, Human
uaaaaagagugaaaccuag

SEQ ID NO: 333211 - RNA, 20 nt, Human
uaaacaguaauuagacaccu

SEQ ID NO: 333212 - RNA, 18 nt, Human
uaaagaaacacauuuaca

SEQ ID NO: 333213 - RNA, 21 nt, Human
uaaguuucuggaucuaguaca

SEQ ID NO: 333214 - RNA, 21 nt, Human
uacacacuguguggaguugcg

SEQ ID NO: 333215 - RNA, 19 nt, Human
uacacuaaaaagagugaaa

SEQ ID NO: 333216 - RNA, 22 nt, Human
uacugcaauauaacaaugaagu

SEQ ID NO: 333217 - RNA, 23 nt, Human
uagaucccucccuccccaccccc

SEQ ID NO: 333218 - RNA, 21 nt, Human
uaucagaaacccaguuuugaa

SEQ ID NO: 333219 - RNA, 20 nt, Human
uaucccugcccuguauccua

SEQ ID NO: 333220 - RNA, 21 nt, Human
uauuuuacacacuguguggag

SEQ ID NO: 333221 - RNA, 22 nt, Human
uauuuuacacacuguguggagu

SEQ ID NO: 333222 - RNA, 20 nt, Human
ucacauucgcccagcggagc

SEQ ID NO: 333223 - RNA, 19 nt, Human
ucaucccagacaauccagu

SEQ ID NO: 333224 - RNA, 20 nt, Human
uccccaaaacaaaaaaaaaa

SEQ ID NO: 333225 - RNA, 18 nt, Human
ucccccagcccgugcccc

SEQ ID NO: 333226 - RNA, 18 nt, Human
ucccucccuccccacccc

SEQ ID NO: 333227 - RNA, 21 nt, Human
ucccucccuccccacccccaa

SEQ ID NO: 333228 - RNA, 22 nt, Human
ucccugcccuguauccuagauc

SEQ ID NO: 333229 - RNA, 21 nt, Human
uccgcgacugcggccuucccc

SEQ ID NO: 333230 - RNA, 24 nt, Human
uccucacgcgccgagcgccagcca

SEQ ID NO: 333231 - RNA, 26 nt, Human
uccucacgcgccgagcgccagccacg

SEQ ID NO: 333232 - RNA, 28 nt, Human
ucuggggaggaaggcggugggggugggg

SEQ ID NO: 333233 - RNA, 24 nt, Human
ugaaaaaauccaaauaaaagccaa

SEQ ID NO: 333234 - RNA, 19 nt, Human
ugaacaaguagacaucugc

SEQ ID NO: 333235 - RNA, 28 nt, Human
ugagaugaaaaaauccaaauaaaagcca

SEQ ID NO: 333236 - RNA, 22 nt, Human
ugcacuggugugaagugugaga

SEQ ID NO: 333237 - RNA, 20 nt, Human
ugcggccuuccccgcgaacu

SEQ ID NO: 333238 - RNA, 19 nt, Human
uggggaggaaggcgguggg

SEQ ID NO: 333239 - RNA, 21 nt, Human
ugggggugggggcuugucaca

SEQ ID NO: 333240 - RNA, 25 nt, Human
uggguuuuuuaaaaggcagcaguuu

SEQ ID NO: 333241 - RNA, 19 nt, Human
uguaaacaggaaaauaacu

SEQ ID NO: 333242 - RNA, 18 nt, Human
uguauauauuuuacacac

SEQ ID NO: 333243 - RNA, 19 nt, Human
uguauauauuuuacacacu

SEQ ID NO: 333244 - RNA, 26 nt, Human
uguugccaugaaacagagacuguaaa

SEQ ID NO: 333245 - RNA, 23 nt, Human
uuacugcaauauaacaaugaagu

SEQ ID NO: 333246 - RNA, 23 nt, Human
uucacaaagggauacaucaaaag

SEQ ID NO: 333247 - RNA, 24 nt, Human
uuggccccaaaagugcuaauuuca

SEQ ID NO: 333248 - RNA, 23 nt, Human
uuguggguuuuuuaaaaggcagc

SEQ ID NO: 333249 - RNA, 21 nt, Human
uuuacagaagaaauaaagacc

SEQ ID NO: 333250 - RNA, 25 nt, Human
uuuuugguuguauauauuuuacaca

SEQ ID NO: 333251 - RNA, 21 nt, Human
aaacauacaucucaccauuuc

SEQ ID NO: 333252 - RNA, 18 nt, Human
aacaugcucauuauagcu

SEQ ID NO: 333253 - RNA, 23 nt, Human
aacaugcucauuauagcuacaga

SEQ ID NO: 333254 - RNA, 20 nt, Human
aagggggcugaagaaaguga

SEQ ID NO: 333255 - RNA, 21 nt, Human
aaguggcaucugaagagcaaa

SEQ ID NO: 333256 - RNA, 19 nt, Human
aaguuaaaagcagagccaa

SEQ ID NO: 333257 - RNA, 21 nt, Human
acacuuucugaggaccuacau

SEQ ID NO: 333258 - RNA, 23 nt, Human
acacuuucugaggaccuacauuu

SEQ ID NO: 333259 - RNA, 19 nt, Human
acagauggcacaaaaccau

SEQ ID NO: 333260 - RNA, 21 nt, Human
accaugccauagaucuuugca

SEQ ID NO: 333261 - RNA, 18 nt, Human
accccaccaccaccccca

SEQ ID NO: 333262 - RNA, 21 nt, Human
acccccccccaccccaccacc

SEQ ID NO: 333263 - RNA, 20 nt, Human
acccugaaggccugacagag

SEQ ID NO: 333264 - RNA, 20 nt, Human
accuggaguccacaaaggcu

SEQ ID NO: 333265 - RNA, 18 nt, Human
acgaugggcagaucaggc

SEQ ID NO: 333266 - RNA, 24 nt, Human
acuagaauugauuugcucuuaauc

SEQ ID NO: 333267 - RNA, 21 nt, Human
agaaggugguggguacugacu

SEQ ID NO: 333268 - RNA, 21 nt, Human
agagggggcgggggauggagc

SEQ ID NO: 333269 - RNA, 23 nt, Human
agccacaaugcgaccccgcaacc

SEQ ID NO: 333270 - RNA, 20 nt, Human
aggcccgcacgcguccacgc

SEQ ID NO: 333271 - RNA, 25 nt, Human
aggccgaagcaaggcgugcacggga

SEQ ID NO: 333272 - RNA, 25 nt, Human
aggccucaaguggucaggacccguc

SEQ ID NO: 333273 - RNA, 21 nt, Human
aucuggaagggauauguagga

SEQ ID NO: 333274 - RNA, 21 nt, Human
aucuguuucuugagcaaccuu

SEQ ID NO: 333275 - RNA, 18 nt, Human
augcuacacaggauagac

SEQ ID NO: 333276 - RNA, 20 nt, Human
auugauuugcucuuaaucuu

SEQ ID NO: 333277 - RNA, 22 nt, Human
caaaucagaaacaggcaaucug

SEQ ID NO: 333278 - RNA, 19 nt, Human
caaauggagaggccuguuc

SEQ ID NO: 333279 - RNA, 20 nt, Human
caacagugcuuugagaagaa

SEQ ID NO: 333280 - RNA, 25 nt, Human
caaccaaaauuguaagggggcugaa

SEQ ID NO: 333281 - RNA, 19 nt, Human
caaugcgaccccgcaaccg

SEQ ID NO: 333282 - RNA, 19 nt, Human
cacaaugcgaccccgcaac

SEQ ID NO: 333283 - RNA, 21 nt, Human
cacgaugggcagaucaggccu

SEQ ID NO: 333284 - RNA, 24 nt, Human
cagccuggggcugcccgccgggga

SEQ ID NO: 333285 - RNA, 18 nt, Human
cagcuuccugccucggcc

SEQ ID NO: 333286 - RNA, 18 nt, Human
cauccaaaauccuagaca

SEQ ID NO: 333287 - RNA, 22 nt, Human
cauuuaggacccccccccaccc

SEQ ID NO: 333288 - RNA, 18 nt, Human
ccacauggcaaugcccac

SEQ ID NO: 333289 - RNA, 22 nt, Human
cccacaccagcugcuuuccccg

SEQ ID NO: 333290 - RNA, 21 nt, Human
cccaccccaccaccaccccca

SEQ ID NO: 333291 - RNA, 26 nt, Human
ccccaccccaccaccacccccaggaa

SEQ ID NO: 333292 - RNA, 27 nt, Human
ccccaccccaccaccacccccaggaag

SEQ ID NO: 333293 - RNA, 20 nt, Human
cccccaccccaccaccaccc

SEQ ID NO: 333294 - RNA, 22 nt, Human
ccccccaccccaccaccacccc

SEQ ID NO: 333295 - RNA, 22 nt, Human
cccccccaccccaccaccaccc

SEQ ID NO: 333296 - RNA, 18 nt, Human
ccccccccaccccaccac

SEQ ID NO: 333297 - RNA, 20 nt, Human
ccccccccaccccaccacca

SEQ ID NO: 333298 - RNA, 22 nt, Human
ccccccccaccccaccaccacc

SEQ ID NO: 333299 - RNA, 18 nt, Human
cccccccccaccccacca

SEQ ID NO: 333300 - RNA, 19 nt, Human
cccgcacgcguccacgccg

SEQ ID NO: 333301 - RNA, 23 nt, Human
cccugcggaucacgugggccucu

SEQ ID NO: 333302 - RNA, 22 nt, Human
ccgcgcacucacagcuuccugc

SEQ ID NO: 333303 - RNA, 23 nt, Human
ccucagauauuaauacucaguuu

SEQ ID NO: 333304 - RNA, 19 nt, Human
ccucuaggcccgcacgcgu

SEQ ID NO: 333305 - RNA, 22 nt, Human
ccucuaggcccgcacgcgucca

SEQ ID NO: 333306 - RNA, 23 nt, Human
ccucucaacauccaaaauccuag

SEQ ID NO: 333307 - RNA, 26 nt, Human
cgugagacccgcgaaucucagggucu

SEQ ID NO: 333308 - RNA, 27 nt, Human
cgugagacccgcgaaucucagggucuu

SEQ ID NO: 333309 - RNA, 23 nt, Human
cuagaauugauuugcucuuaauc

SEQ ID NO: 333310 - RNA, 18 nt, Human
cucaacauccaaaauccu

SEQ ID NO: 333311 - RNA, 22 nt, Human
cucaccagggaccuggagucca

SEQ ID NO: 333312 - RNA, 22 nt, Human
cucuaggcccgcacgcguccac

SEQ ID NO: 333313 - RNA, 21 nt, Human
cucuaggcccgcacgcguccc

SEQ ID NO: 333314 - RNA, 22 nt, Human
cucucaacauccaaaauccuag

SEQ ID NO: 333315 - RNA, 20 nt, Human
cugccuggaaugggaugaag

SEQ ID NO: 333316 - RNA, 21 nt, Human
cuugacucugugagugagccu

SEQ ID NO: 333317 - RNA, 24 nt, Human
cuuugcacagcuauaaguucucca

SEQ ID NO: 333318 - RNA, 18 nt, Human
gaagagcagcaaaucaga

SEQ ID NO: 333319 - RNA, 20 nt, Human
gaccccgcaaccgcgcacuc

SEQ ID NO: 333320 - RNA, 20 nt, Human
gaccuggaguccacaaaggc

SEQ ID NO: 333321 - RNA, 23 nt, Human
gauuuaucaacagauuuuucauu

SEQ ID NO: 333322 - RNA, 25 nt, Human
gcaaaguuuccuuugcuguauaaag

SEQ ID NO: 333323 - RNA, 22 nt, Human
gcacacuuagagcucagacuga

SEQ ID NO: 333324 - RNA, 25 nt, Human
gccccauuggguccaaccaaaauug

SEQ ID NO: 333325 - RNA, 18 nt, Human
gccucaaguggucagagc

SEQ ID NO: 333326 - RNA, 20 nt, Human
gggagagagggggcggggga

SEQ ID NO: 333327 - RNA, 21 nt, Human
ggggagagcggaggcggggac

SEQ ID NO: 333328 - RNA, 19 nt, Human
ggggagcgaggccacagga

SEQ ID NO: 333329 - RNA, 20 nt, Human
uaaaaaaauaccaaaaccau

SEQ ID NO: 333330 - RNA, 22 nt, Human
uaaaagcagagccaaacauaca

SEQ ID NO: 333331 - RNA, 23 nt, Human
uaaaagcagagccaaacauacau

SEQ ID NO: 333332 - RNA, 22 nt, Human
uaaaguuaaaagcagagccaaa

SEQ ID NO: 333333 - RNA, 23 nt, Human
uaagggggcugaagaaagugaua

SEQ ID NO: 333334 - RNA, 23 nt, Human
uacaucucaccauuucuggucau

SEQ ID NO: 333335 - RNA, 26 nt, Human
uagaaccucucaacauccaaaauccu

SEQ ID NO: 333336 - RNA, 22 nt, Human
uagacacaauguuccuuugaaa

SEQ ID NO: 333337 - RNA, 22 nt, Human
uagacgcagaggaguguuacag

SEQ ID NO: 333338 - RNA, 25 nt, Human
uagaucuuugcacagcuauaaguuc

SEQ ID NO: 333339 - RNA, 21 nt, Human
uagaugauuacuuaagguucc

SEQ ID NO: 333340 - RNA, 19 nt, Human
uagcacagauagaugccuu

SEQ ID NO: 333341 - RNA, 18 nt, Human
uagccacaaugcgacccc

SEQ ID NO: 333342 - RNA, 20 nt, Human
uaggagaagaaggugguggg

SEQ ID NO: 333343 - RNA, 21 nt, Human
uaggagaagaagguggugggu

SEQ ID NO: 333344 - RNA, 21 nt, Human
uaucaacagauuuuucauuuu

SEQ ID NO: 333345 - RNA, 23 nt, Human
uaucuuuguccucuauuccaaaa

SEQ ID NO: 333346 - RNA, 22 nt, Human
ucaacauccaaaauccuagaca

SEQ ID NO: 333347 - RNA, 19 nt, Human
ucagcuggcaauuccagga

SEQ ID NO: 333348 - RNA, 22 nt, Human
uccaaccaaaauuguaaggggg

SEQ ID NO: 333349 - RNA, 23 nt, Human
uccacaaaggcuuaacugaggcc

SEQ ID NO: 333350 - RNA, 21 nt, Human
uccacauggcaaugcccacuu

SEQ ID NO: 333351 - RNA, 23 nt, Human
uccaggaaaaacugugauuaggc

SEQ ID NO: 333352 - RNA, 25 nt, Human
ucccgccccauuggguccaaccaaa

SEQ ID NO: 333353 - RNA, 22 nt, Human
uccuuagcuuuaaucacaucuu

SEQ ID NO: 333354 - RNA, 21 nt, Human
ucggucaauuucugcacacuu

SEQ ID NO: 333355 - RNA, 22 nt, Human
ucgucuuucccgccccauuggg

SEQ ID NO: 333356 - RNA, 18 nt, Human
ucgugauuacauuuagga

SEQ ID NO: 333357 - RNA, 20 nt, Human
ucucagggucaggaggaucc

SEQ ID NO: 333358 - RNA, 21 nt, Human
ucuguccaauuuucagugaaa

SEQ ID NO: 333359 - RNA, 21 nt, Human
ucuguguggaauggaaggauu

SEQ ID NO: 333360 - RNA, 22 nt, Human
ucuguguggaauggaaggauuc

SEQ ID NO: 333361 - RNA, 21 nt, Human
ugaagagcagcaaaucagaaa

SEQ ID NO: 333362 - RNA, 23 nt, Human
ugaagagcagcaaaucagaaaca

SEQ ID NO: 333363 - RNA, 19 nt, Human
ugacaaaacucuacaaagc

SEQ ID NO: 333364 - RNA, 21 nt, Human
ugacagaggcugccuggaaug

SEQ ID NO: 333365 - RNA, 19 nt, Human
ugacuaaguugauaugaga

SEQ ID NO: 333366 - RNA, 20 nt, Human
ugacucugugagugagccug

SEQ ID NO: 333367 - RNA, 23 nt, Human
ugacuugguugcauucugugugg

SEQ ID NO: 333368 - RNA, 20 nt, Human
ugagaaaagcugucuaggca

SEQ ID NO: 333369 - RNA, 25 nt, Human
ugagaaaagcugucuaggcaaacau

SEQ ID NO: 333370 - RNA, 25 nt, Human
ugauuaggcuuuucuuagaaguggc

SEQ ID NO: 333371 - RNA, 21 nt, Human
ugcaaacguuucuaaucucac

SEQ ID NO: 333372 - RNA, 20 nt, Human
ugccuggaaugggaugaaga

SEQ ID NO: 333373 - RNA, 23 nt, Human
uggcugacucugaaugacaaaac

SEQ ID NO: 333374 - RNA, 21 nt, Human
uggggaaaccaagucccagag

SEQ ID NO: 333375 - RNA, 19 nt, Human
uggggagggaggcacagag

SEQ ID NO: 333376 - RNA, 20 nt, Human
ugguugcauucuguguggaa

SEQ ID NO: 333377 - RNA, 23 nt, Human
ugucuuaagguccuuagcuuuaa

SEQ ID NO: 333378 - RNA, 21 nt, Human
ugugagugagccuggcuugcc

SEQ ID NO: 333379 - RNA, 23 nt, Human
ugugcacaguggagaauuuccuc

SEQ ID NO: 333380 - RNA, 18 nt, Human
uguguggaauggaaggau

SEQ ID NO: 333381 - RNA, 18 nt, Human
uguguggaauggaaggau

SEQ ID NO: 333382 - RNA, 19 nt, Human
uguguggaauggaaggauu

SEQ ID NO: 333383 - RNA, 20 nt, Human
uguguggaauggaaggauuc

SEQ ID NO: 333384 - RNA, 24 nt, Human
uuaauacucaguuuuucaaaccac

SEQ ID NO: 333385 - RNA, 23 nt, Human
uucaugauuuuagaaccucucaa

SEQ ID NO: 333386 - RNA, 19 nt, Human
uucuguguggaauggaagg

SEQ ID NO: 333387 - RNA, 21 nt, Human
uuuaggacccccccccacccc

SEQ ID NO: 333388 - RNA, 26 nt, Human
uuucaccaugccauagaucuuugcac

SEQ ID NO: 333389 - RNA, 18 nt, Human
uuucagugaaacaaguuu

SEQ ID NO: 333390 - RNA, 21 nt, Human
uuugcacuggggagggaggca

SEQ ID NO: 333391 - RNA, 25 nt, Human
uuuuagaaccucucaacauccaaaa

SEQ ID NO: 333392 - RNA, 22 nt, Human
uuuuuuuuuuuuuuuuuuucag

SEQ ID NO: 333393 - RNA, 21 nt, Human
aagcaauaccauccacuauca

SEQ ID NO: 333394 - RNA, 21 nt, Human
aaucccugagguuugauuuga

SEQ ID NO: 333395 - RNA, 24 nt, Human
aaucugugauuauuugcaaggcug

SEQ ID NO: 333396 - RNA, 24 nt, Human
auacacacuuaaaauuaagagcac

SEQ ID NO: 333397 - RNA, 18 nt, Human
aucuuuguugucaucuga

SEQ ID NO: 333398 - RNA, 23 nt, Human
caacaguaucucuaaaucccuga

SEQ ID NO: 333399 - RNA, 28 nt, Human
caacaguaucucuaaaucccugagguuu

SEQ ID NO: 333400 - RNA, 24 nt, Human
caagagugaaauccuccaaagcuu

SEQ ID NO: 333401 - RNA, 21 nt, Human
cacacuuaaaauuaagagcac

SEQ ID NO: 333402 - RNA, 22 nt, Human
ccaaccuuugcuuucgguccca

SEQ ID NO: 333403 - RNA, 26 nt, Human
ccaacuuuccccuaaugcaggaacaa

SEQ ID NO: 333404 - RNA, 19 nt, Human
ccacuuguacacauugauu

SEQ ID NO: 333405 - RNA, 21 nt, Human
ccacuuguacacauugauuuc

SEQ ID NO: 333406 - RNA, 19 nt, Human
ccccggagcagccaaacuc

SEQ ID NO: 333407 - RNA, 21 nt, Human
cgacagcgaaaauaauaaaua

SEQ ID NO: 333408 - RNA, 18 nt, Human
cucuaaaucccugagguu

SEQ ID NO: 333409 - RNA, 21 nt, Human
gaaaggaaaucuggaagaaga

SEQ ID NO: 333410 - RNA, 20 nt, Human
gacagcgaaaauaauaaaua

SEQ ID NO: 333411 - RNA, 20 nt, Human
gcaggaacaagcaaggccug

SEQ ID NO: 333412 - RNA, 21 nt, Human
uaaaucccugagguuugauuu

SEQ ID NO: 333413 - RNA, 18 nt, Human
uccccaacuuuccccuaa

SEQ ID NO: 333414 - RNA, 19 nt, Human
uccgggugcucaaggaacc

SEQ ID NO: 333415 - RNA, 22 nt, Human
uccgggugcucaaggaaccuuc

SEQ ID NO: 333416 - RNA, 21 nt, Human
uccuucuggcugggugacuug

SEQ ID NO: 333417 - RNA, 22 nt, Human
ugaaaggaaaucuggaagaaga

SEQ ID NO: 333418 - RNA, 18 nt, Human
ugacgaaauggaaaagca

SEQ ID NO: 333419 - RNA, 22 nt, Human
uggaagaagauaaacuugugcc

SEQ ID NO: 333420 - RNA, 23 nt, Human
uuccccuaaugcaggaacaagca

SEQ ID NO: 333421 - RNA, 25 nt, Human
aaaaaaccuauguguuccacgaaca

SEQ ID NO: 333422 - RNA, 19 nt, Human
aaagcgcugggauuacagg

SEQ ID NO: 333423 - RNA, 24 nt, Human
aaagcgcugggauuacaggcguga

SEQ ID NO: 333424 - RNA, 20 nt, Human
aaauuucaccuccaucaaaa

SEQ ID NO: 333425 - RNA, 21 nt, Human
aaccaaauguuuuagcagaga

SEQ ID NO: 333426 - RNA, 19 nt, Human
aagcgcugggauuacaggc

SEQ ID NO: 333427 - RNA, 18 nt, Human
accauggaggagacuuga

SEQ ID NO: 333428 - RNA, 24 nt, Human
acccaacccuugcucucauucccc

SEQ ID NO: 333429 - RNA, 22 nt, Human
agaaagagaaaguuaaaaaaaa

SEQ ID NO: 333430 - RNA, 21 nt, Human
agacaucuagagaccugaaca

SEQ ID NO: 333431 - RNA, 22 nt, Human
agacaucuagagaccugaacaa

SEQ ID NO: 333432 - RNA, 21 nt, Human
agacuugaaaacauacuagug

SEQ ID NO: 333433 - RNA, 21 nt, Human
agcccucagcccuagacaucu

SEQ ID NO: 333434 - RNA, 18 nt, Human
agcgcugggauuacaggc

SEQ ID NO: 333435 - RNA, 24 nt, Human
auacuagugaaagaagacagacac

SEQ ID NO: 333436 - RNA, 18 nt, Human
aucuucaccuucccugcu

SEQ ID NO: 333437 - RNA, 24 nt, Human
caaagcgcugggauuacaggcgug

SEQ ID NO: 333438 - RNA, 27 nt, Human
caacagcaaucaacuaauuaaucccca

SEQ ID NO: 333439 - RNA, 22 nt, Human
caaccaaauguuuuagcagaga

SEQ ID NO: 333440 - RNA, 25 nt, Human
caaugcaauauuauucagccauaaa

SEQ ID NO: 333441 - RNA, 20 nt, Human
cacaacccaacccuugcucu

SEQ ID NO: 333442 - RNA, 19 nt, Human
cacgcuacaccauggagga

SEQ ID NO: 333443 - RNA, 26 nt, Human
caucaugauaucuaguugccacggaa

SEQ ID NO: 333444 - RNA, 23 nt, Human
cauuaugucagcuuccguuuccu

SEQ ID NO: 333445 - RNA, 20 nt, Human
ccaaagcgcugggauuacag

SEQ ID NO: 333446 - RNA, 22 nt, Human
ccaaagcgcugggauuacaggc

SEQ ID NO: 333447 - RNA, 23 nt, Human
ccaaagcgcugggauuacaggcg

SEQ ID NO: 333448 - RNA, 24 nt, Human
ccaaagcgcugggauuacaggcgu

SEQ ID NO: 333449 - RNA, 20 nt, Human
cccauggcggcaaagcccuc

SEQ ID NO: 333450 - RNA, 22 nt, Human
ccucuagaauuccaugacuuaa

SEQ ID NO: 333451 - RNA, 23 nt, Human
ccucuagaauuccaugacuuaag

SEQ ID NO: 333452 - RNA, 20 nt, Human
ccugcuaggucugaaaucgc

SEQ ID NO: 333453 - RNA, 21 nt, Human
ccuguaauuacaaaucuuguu

SEQ ID NO: 333454 - RNA, 24 nt, Human
cgcugggauuacaggcgugaucca

SEQ ID NO: 333455 - RNA, 19 nt, Human
cuagacaucuagagaccug

SEQ ID NO: 333456 - RNA, 24 nt, Human
cugaugcacgcuacaccauggagg

SEQ ID NO: 333457 - RNA, 23 nt, Human
cugggaggagggggaaauaggaa

SEQ ID NO: 333458 - RNA, 21 nt, Human
cuucuucaucuucaccuuccc

SEQ ID NO: 333459 - RNA, 30 nt, Human
cuuguuagucauccuccuccucuccccagg

SEQ ID NO: 333460 - RNA, 23 nt, Human
gaacacaacccaacccuugcucu

SEQ ID NO: 333461 - RNA, 22 nt, Human
gaccucgugauccgcccgcuuc

SEQ ID NO: 333462 - RNA, 22 nt, Human
gaccucgugauccgcccgcuuc

SEQ ID NO: 333463 - RNA, 24 nt, Human
gaccucgugauccgcccgcuucgg

SEQ ID NO: 333464 - RNA, 19 nt, Human
gauuacaggcgugauccac

SEQ ID NO: 333465 - RNA, 21 nt, Human
gauuacaggcgugauccaccg

SEQ ID NO: 333466 - RNA, 22 nt, Human
gccguguuagccaggauggucu

SEQ ID NO: 333467 - RNA, 23 nt, Human
gccguguuagccaggauggucuc

SEQ ID NO: 333468 - RNA, 20 nt, Human
ggaaauaggaacacuugcau

SEQ ID NO: 333469 - RNA, 26 nt, Human
ggagcaaaucuguuaccaucucaacc

SEQ ID NO: 333470 - RNA, 24 nt, Human
ggauggucucgauuuccugaccuc

SEQ ID NO: 333471 - RNA, 19 nt, Human
gggaggagggggaaauagg

SEQ ID NO: 333472 - RNA, 21 nt, Human
gggggaaauaggaacacuugc

SEQ ID NO: 333473 - RNA, 23 nt, Human
uagaaagagaaaguuaaaaaaaa

SEQ ID NO: 333474 - RNA, 26 nt, Human
uagacaucuagagaccugaacaaagg

SEQ ID NO: 333475 - RNA, 30 nt, Human
uagcagagaacgauggguguuucaccacag

SEQ ID NO: 333476 - RNA, 18 nt, Human
uagucauccuccuccucu

SEQ ID NO: 333477 - RNA, 19 nt, Human
uauccagaauagguaaagc

SEQ ID NO: 333478 - RNA, 19 nt, Human
uauuauucagccauaaaaa

SEQ ID NO: 333479 - RNA, 21 nt, Human
ucagccauaaaaagaaugaaa

SEQ ID NO: 333480 - RNA, 22 nt, Human
ucagcuuccguuuccuucuucc

SEQ ID NO: 333481 - RNA, 19 nt, Human
ucaucuucaccuucccugc

SEQ ID NO: 333482 - RNA, 21 nt, Human
ucaugauaucuaguugccacg

SEQ ID NO: 333483 - RNA, 23 nt, Human
uccaacuuucaaguuuccccacc

SEQ ID NO: 333484 - RNA, 22 nt, Human
uccacgaacacaacccaacccu

SEQ ID NO: 333485 - RNA, 24 nt, Human
ucccaaagcgcugggauuacaggc

SEQ ID NO: 333486 - RNA, 18 nt, Human
ucccauggcggcaaagcc

SEQ ID NO: 333487 - RNA, 23 nt, Human
uccugaccucgugauccgcccgc

SEQ ID NO: 333488 - RNA, 22 nt, Human
ugauaucuaguugccacggaau

SEQ ID NO: 333489 - RNA, 18 nt, Human
ugggauuacaggcgugau

SEQ ID NO: 333490 - RNA, 21 nt, Human
ugggauuacaggcgugaucca

SEQ ID NO: 333491 - RNA, 22 nt, Human
ugggauuacaggcgugauccac

SEQ ID NO: 333492 - RNA, 23 nt, Human
ugggauuacaggcgugauccacc

SEQ ID NO: 333493 - RNA, 24 nt, Human
ugggauuacaggcgugauccaccg

SEQ ID NO: 333494 - RNA, 21 nt, Human
uuagucauccuccuccucucc

SEQ ID NO: 333495 - RNA, 22 nt, Human
uuagucauccuccuccucuccc

SEQ ID NO: 333496 - RNA, 20 nt, Human
uucacaaaucacacccccau

SEQ ID NO: 333497 - RNA, 28 nt, Human
uucaccuccaucaaaaugaaccccuagg

SEQ ID NO: 333498 - RNA, 20 nt, Human
uugcucucauucccauuucc

SEQ ID NO: 333499 - RNA, 18 nt, Human
uuucuuggcaagaugaac

SEQ ID NO: 333500 - RNA, 18 nt, Human
uuuuuuuuuuuuuuccug

SEQ ID NO: 333501 - RNA, 18 nt, Human
uuuuuuuuuuuuuuucug

SEQ ID NO: 333502 - RNA, 18 nt, Human
uuuuuuuuuuuuuuucug

SEQ ID NO: 333503 - RNA, 20 nt, Human
aaacagagaugaagaagagg

SEQ ID NO: 333504 - RNA, 20 nt, Human
aaacagagaugaagaagagg

SEQ ID NO: 333505 - RNA, 23 nt, Human
aaacagagaugaagaagagggac

SEQ ID NO: 333506 - RNA, 20 nt, Human
aaagaaaaaaaaggcagcag

SEQ ID NO: 333507 - RNA, 20 nt, Human
aaagaaaaaaaaggcagcag

SEQ ID NO: 333508 - RNA, 20 nt, Human
aaagaaaaaaaaggcagcag

SEQ ID NO: 333509 - RNA, 18 nt, Human
aagaaaaaaaaggcagca

SEQ ID NO: 333510 - RNA, 18 nt, Human
aagaaaaaaaaggcagca

SEQ ID NO: 333511 - RNA, 18 nt, Human
aagaaaaaaaaggcagca

SEQ ID NO: 333512 - RNA, 20 nt, Human
aagaaaaaaaaggcagcagc

SEQ ID NO: 333513 - RNA, 20 nt, Human
aagaaaaaaaaggcagcagc

SEQ ID NO: 333514 - RNA, 20 nt, Human
aagaaaaaaaaggcagcagc

SEQ ID NO: 333515 - RNA, 21 nt, Human
aagcagcuggaggaggcggga

SEQ ID NO: 333516 - RNA, 25 nt, Human
acaaagcuccaggagcguccgaggg

SEQ ID NO: 333517 - RNA, 25 nt, Human
acaaagcuccaggagcguccgaggg

SEQ ID NO: 333518 - RNA, 21 nt, Human
acacaauggugaugcacagga

SEQ ID NO: 333519 - RNA, 21 nt, Human
acacaauggugaugcacagga

SEQ ID NO: 333520 - RNA, 21 nt, Human
acacaauggugaugcacagga

SEQ ID NO: 333521 - RNA, 25 nt, Human
acccaguaacucagagacagagcua

SEQ ID NO: 333522 - RNA, 25 nt, Human
acccaguaacucagagacagagcua

SEQ ID NO: 333523 - RNA, 25 nt, Human
acccaguaacucagagacagagcua

SEQ ID NO: 333524 - RNA, 24 nt, Human
accgcagugaccgaguccacaacc

SEQ ID NO: 333525 - RNA, 24 nt, Human
agaaauaagggaaggaaacguggc

SEQ ID NO: 333526 - RNA, 24 nt, Human
agaaauaagggaaggaaacguggc

SEQ ID NO: 333527 - RNA, 24 nt, Human
agaaauaagggaaggaaacguggc

SEQ ID NO: 333528 - RNA, 19 nt, Human
agacaaaagaaaaaaaagg

SEQ ID NO: 333529 - RNA, 19 nt, Human
agacaaaagaaaaaaaagg

SEQ ID NO: 333530 - RNA, 19 nt, Human
agacaaaagaaaaaaaagg

SEQ ID NO: 333531 - RNA, 22 nt, Human
agagacauaccugaguuuugcc

SEQ ID NO: 333532 - RNA, 18 nt, Human
agagaggaggaggcggca

SEQ ID NO: 333533 - RNA, 20 nt, Human
agaggcuuucccggcuuggc

SEQ ID NO: 333534 - RNA, 20 nt, Human
agaggcuuucccggcuuggc

SEQ ID NO: 333535 - RNA, 20 nt, Human
agaggcuuucccggcuuggc

SEQ ID NO: 333536 - RNA, 22 nt, Human
agcaaaacagagaugaagaaga

SEQ ID NO: 333537 - RNA, 22 nt, Human
agcaaaacagagaugaagaaga

SEQ ID NO: 333538 - RNA, 22 nt, Human
agcaaaacagagaugaagaaga

SEQ ID NO: 333539 - RNA, 20 nt, Human
aggagaaaggagagaggagg

SEQ ID NO: 333540 - RNA, 19 nt, Human
aggaggaggcggcaccaag

SEQ ID NO: 333541 - RNA, 22 nt, Human
aggcagcagcagcaaaggcaag

SEQ ID NO: 333542 - RNA, 22 nt, Human
aggcagcagcagcaaaggcaag

SEQ ID NO: 333543 - RNA, 22 nt, Human
aggcagcagcagcaaaggcaag

SEQ ID NO: 333544 - RNA, 19 nt, Human
aggccggaacagccccagg

SEQ ID NO: 333545 - RNA, 22 nt, Human
aggccggaacagccccaggggg

SEQ ID NO: 333546 - RNA, 20 nt, Human
aggguagggcugggggucau

SEQ ID NO: 333547 - RNA, 19 nt, Human
agugaccgaguccacaacc

SEQ ID NO: 333548 - RNA, 19 nt, Human
agugaccgaguccacaacc

SEQ ID NO: 333549 - RNA, 18 nt, Human
caaggucccgggccaggg

SEQ ID NO: 333550 - RNA, 18 nt, Human
caaggucccgggccaggg

SEQ ID NO: 333551 - RNA, 22 nt, Human
caaggucccgggccagggucuu

SEQ ID NO: 333552 - RNA, 22 nt, Human
caaggucccgggccagggucuu

SEQ ID NO: 333553 - RNA, 22 nt, Human
caccaaggguagggcugggggu

SEQ ID NO: 333554 - RNA, 21 nt, Human
caccgcagugaccgaguccaa

SEQ ID NO: 333555 - RNA, 21 nt, Human
caccgcagugaccgaguccaa

SEQ ID NO: 333556 - RNA, 25 nt, Human
caccgcagugaccgaguccacaacc

SEQ ID NO: 333557 - RNA, 22 nt, Human
cagagcccgcccgccgggucgc

SEQ ID NO: 333558 - RNA, 18 nt, Human
cagagcuaaggaagagug

SEQ ID NO: 333559 - RNA, 18 nt, Human
cagagcuaaggaagagug

SEQ ID NO: 333560 - RNA, 18 nt, Human
cagagcuaaggaagagug

SEQ ID NO: 333561 - RNA, 20 nt, Human
cagcagcaaaggcaaguuag

SEQ ID NO: 333562 - RNA, 20 nt, Human
cagcagcaaaggcaaguuag

SEQ ID NO: 333563 - RNA, 20 nt, Human
cagcagcaaaggcaaguuag

SEQ ID NO: 333564 - RNA, 22 nt, Human
cagcagcaaaggcaaguuagag

SEQ ID NO: 333565 - RNA, 22 nt, Human
cagcagcaaaggcaaguuagag

SEQ ID NO: 333566 - RNA, 22 nt, Human
cagcagcaaaggcaaguuagag

SEQ ID NO: 333567 - RNA, 19 nt, Human
cagcagcagcaaaggcaag

SEQ ID NO: 333568 - RNA, 18 nt, Human
caggacacaauggugaug

SEQ ID NO: 333569 - RNA, 18 nt, Human
caggacacaauggugaug

SEQ ID NO: 333570 - RNA, 25 nt, Human
caggacacaauggugaugcacagga

SEQ ID NO: 333571 - RNA, 25 nt, Human
caggacacaauggugaugcacagga

SEQ ID NO: 333572 - RNA, 20 nt, Human
caggacacaauggugauggu

SEQ ID NO: 333573 - RNA, 20 nt, Human
caggacacaauggugauggu

SEQ ID NO: 333574 - RNA, 23 nt, Human
caggagaauccgagugcugggca

SEQ ID NO: 333575 - RNA, 23 nt, Human
caggagaauccgagugcugggca

SEQ ID NO: 333576 - RNA, 19 nt, Human
caggagcguccgagggcag

SEQ ID NO: 333577 - RNA, 19 nt, Human
caggagcguccgagggcag

SEQ ID NO: 333578 - RNA, 19 nt, Human
caggccggaacagccccag

SEQ ID NO: 333579 - RNA, 27 nt, Human
caguaugaauuucuggggugcuguagc

SEQ ID NO: 333580 - RNA, 27 nt, Human
caguaugaauuucuggggugcuguagc

SEQ ID NO: 333581 - RNA, 27 nt, Human
caguaugaauuucuggggugcuguagc

SEQ ID NO: 333582 - RNA, 18 nt, Human
caugggccacauuugcug

SEQ ID NO: 333583 - RNA, 22 nt, Human
caugggccacauuugcugccau

SEQ ID NO: 333584 - RNA, 20 nt, Human
ccaaggguagggcugggggu

SEQ ID NO: 333585 - RNA, 23 nt, Human
cccaaacaacagcacaggucaug

SEQ ID NO: 333586 - RNA, 23 nt, Human
cccaaacaacagcacaggucaug

SEQ ID NO: 333587 - RNA, 19 nt, Human
cccccaggucccaaugucu

SEQ ID NO: 333588 - RNA, 20 nt, Human
cccccaggucccaaugucua

SEQ ID NO: 333589 - RNA, 25 nt, Human
cccccaggucccaaugucuaccauc

SEQ ID NO: 333590 - RNA, 25 nt, Human
cccccaggucccaaugucuaccauc

SEQ ID NO: 333591 - RNA, 18 nt, Human
ccccuaccccuuccuaga

SEQ ID NO: 333592 - RNA, 19 nt, Human
ccccuccccuaccccuucc

SEQ ID NO: 333593 - RNA, 18 nt, Human
cccgcaggccggaacagc

SEQ ID NO: 333594 - RNA, 20 nt, Human
cccucugcugaccucccaga

SEQ ID NO: 333595 - RNA, 18 nt, Human
ccgccgggucgcgccgcg

SEQ ID NO: 333596 - RNA, 19 nt, Human
ccgcgcccagagcccgccc

SEQ ID NO: 333597 - RNA, 19 nt, Human
ccuggguuuuagccugaag

SEQ ID NO: 333598 - RNA, 22 nt, Human
cgagugcugggcacaaagcucc

SEQ ID NO: 333599 - RNA, 22 nt, Human
cgagugcugggcacaaagcucc

SEQ ID NO: 333600 - RNA, 22 nt, Human
cgcccgggauccgccgggauuc

SEQ ID NO: 333601 - RNA, 19 nt, Human
cggagcuccugcagcacau

SEQ ID NO: 333602 - RNA, 19 nt, Human
cggagcuccugcagcacau

SEQ ID NO: 333603 - RNA, 22 nt, Human
cggccgccugaugcuccugcuc

SEQ ID NO: 333604 - RNA, 22 nt, Human
cggccgccugaugcuccugcuc

SEQ ID NO: 333605 - RNA, 23 nt, Human
cuccugcucccucgauggugucc

SEQ ID NO: 333606 - RNA, 23 nt, Human
cuccugcucccucgauggugucc

SEQ ID NO: 333607 - RNA, 19 nt, Human
cugaccucccagaaguggg

SEQ ID NO: 333608 - RNA, 20 nt, Human
cugggcacaaagcuccagga

SEQ ID NO: 333609 - RNA, 20 nt, Human
gaaaggcagagacaaaagaa

SEQ ID NO: 333610 - RNA, 20 nt, Human
gaaaggcagagacaaaagaa

SEQ ID NO: 333611 - RNA, 20 nt, Human
gaaaggcagagacaaaagaa

SEQ ID NO: 333612 - RNA, 22 nt, Human
gaagaaccagucaccugcuggg

SEQ ID NO: 333613 - RNA, 22 nt, Human
gaagaaccagucaccugcuggg

SEQ ID NO: 333614 - RNA, 18 nt, Human
gaagcagcuggaggaggc

SEQ ID NO: 333615 - RNA, 22 nt, Human
gacacaauggugaugcacagga

SEQ ID NO: 333616 - RNA, 23 nt, Human
gagcaaaacagagaugaagaaga

SEQ ID NO: 333617 - RNA, 19 nt, Human
gaggucccccaggucccaa

SEQ ID NO: 333618 - RNA, 19 nt, Human
gaggucccccaggucccaa

SEQ ID NO: 333619 - RNA, 21 nt, Human
gcagcagcagcaaaggcaagu

SEQ ID NO: 333620 - RNA, 21 nt, Human
gcagcagcagcaaaggcaagu

SEQ ID NO: 333621 - RNA, 21 nt, Human
gcagcagcagcaaaggcaagu

SEQ ID NO: 333622 - RNA, 22 nt, Human
gcaugcaccaccuggauccucc

SEQ ID NO: 333623 - RNA, 22 nt, Human
gcaugcaccaccuggauccucc

SEQ ID NO: 333624 - RNA, 22 nt, Human
gcuaaggaagagugggcccccc

SEQ ID NO: 333625 - RNA, 22 nt, Human
gcuaaggaagagugggcccccc

SEQ ID NO: 333626 - RNA, 22 nt, Human
gcuaaggaagagugggcccccc

SEQ ID NO: 333627 - RNA, 20 nt, Human
gcugaccucccagaaguggg

SEQ ID NO: 333628 - RNA, 20 nt, Human
gcugggggucauccgcccgc

SEQ ID NO: 333629 - RNA, 18 nt, Human
ggaagaaaaguugggagg

SEQ ID NO: 333630 - RNA, 18 nt, Human
ggaagaaaaguugggagg

SEQ ID NO: 333631 - RNA, 20 nt, Human
ggagaaaggagagaggagga

SEQ ID NO: 333632 - RNA, 23 nt, Human
ggagcuccugcagcacauccagc

SEQ ID NO: 333633 - RNA, 23 nt, Human
ggagcuccugcagcacauccagc

SEQ ID NO: 333634 - RNA, 20 nt, Human
ggaggagaaaggagagagga

SEQ ID NO: 333635 - RNA, 19 nt, Human
gggaagaaaaguugggagg

SEQ ID NO: 333636 - RNA, 21 nt, Human
uacacguuagaaauaagggaa

SEQ ID NO: 333637 - RNA, 21 nt, Human
uacacguuagaaauaagggaa

SEQ ID NO: 333638 - RNA, 21 nt, Human
uacacguuagaaauaagggaa

SEQ ID NO: 333639 - RNA, 18 nt, Human
uacagagagugaggccaa

SEQ ID NO: 333640 - RNA, 18 nt, Human
uacagagagugaggccaa

SEQ ID NO: 333641 - RNA, 18 nt, Human
uagccugaagcagcugga

SEQ ID NO: 333642 - RNA, 24 nt, Human
uaggagggagcacaggacacaaug

SEQ ID NO: 333643 - RNA, 24 nt, Human
uaggagggagcacaggacacaaug

SEQ ID NO: 333644 - RNA, 24 nt, Human
uaggagggagcacaggacacaaug

SEQ ID NO: 333645 - RNA, 19 nt, Human
uauauuuuuaagagcaaaa

SEQ ID NO: 333646 - RNA, 19 nt, Human
uauauuuuuaagagcaaaa

SEQ ID NO: 333647 - RNA, 19 nt, Human
uauauuuuuaagagcaaaa

SEQ ID NO: 333648 - RNA, 21 nt, Human
ucaccaccacugccaugccaa

SEQ ID NO: 333649 - RNA, 21 nt, Human
ucaccaccacugccaugccaa

SEQ ID NO: 333650 - RNA, 21 nt, Human
ucauuuauaagcuuauuucca

SEQ ID NO: 333651 - RNA, 21 nt, Human
ucauuuauaagcuuauuucca

SEQ ID NO: 333652 - RNA, 19 nt, Human
uccacaaccaccaccuuca

SEQ ID NO: 333653 - RNA, 19 nt, Human
uccacaaccaccaccuuca

SEQ ID NO: 333654 - RNA, 23 nt, Human
uccagacgccccuccccuacccc

SEQ ID NO: 333655 - RNA, 18 nt, Human
uccccgcaggccggaaca

SEQ ID NO: 333656 - RNA, 22 nt, Human
uccgccgggauucccgcgccca

SEQ ID NO: 333657 - RNA, 20 nt, Human
uccggagagcuucugccuga

SEQ ID NO: 333658 - RNA, 18 nt, Human
uccuccucauccuggguu

SEQ ID NO: 333659 - RNA, 23 nt, Human
ucuccuggaaaccuguuggcugu

SEQ ID NO: 333660 - RNA, 23 nt, Human
ucuccuggaaaccuguuggcugu

SEQ ID NO: 333661 - RNA, 19 nt, Human
ucugaggucccccaggucc

SEQ ID NO: 333662 - RNA, 19 nt, Human
ucugaggucccccaggucc

SEQ ID NO: 333663 - RNA, 21 nt, Human
ucuguagucaccagugccagg

SEQ ID NO: 333664 - RNA, 21 nt, Human
ucuguagucaccagugccagg

SEQ ID NO: 333665 - RNA, 21 nt, Human
ucuguagucaccagugccagg

SEQ ID NO: 333666 - RNA, 18 nt, Human
ugaagaagaguauuucau

SEQ ID NO: 333667 - RNA, 18 nt, Human
ugaagaagaguauuucau

SEQ ID NO: 333668 - RNA, 18 nt, Human
ugaagaagaguauuucau

SEQ ID NO: 333669 - RNA, 20 nt, Human
ugaagcagcuggaggaggcg

SEQ ID NO: 333670 - RNA, 19 nt, Human
ugccucggagcuccugcag

SEQ ID NO: 333671 - RNA, 19 nt, Human
ugccucggagcuccugcag

SEQ ID NO: 333672 - RNA, 20 nt, Human
ugccucggagcuccugcagc

SEQ ID NO: 333673 - RNA, 20 nt, Human
ugccucggagcuccugcagc

SEQ ID NO: 333674 - RNA, 22 nt, Human
ugccucggagcuccugcagcac

SEQ ID NO: 333675 - RNA, 22 nt, Human
ugccucggagcuccugcagcac

SEQ ID NO: 333676 - RNA, 22 nt, Human
ugccugaguuuugccgcuaccu

SEQ ID NO: 333677 - RNA, 22 nt, Human
ugccuguuccuccucauccugg

SEQ ID NO: 333678 - RNA, 19 nt, Human
ugcugcaggccaugggcca

SEQ ID NO: 333679 - RNA, 23 nt, Human
ugcugggcacaaagcuccaggag

SEQ ID NO: 333680 - RNA, 26 nt, Human
uggaaaggcagagacaaaagaaaaaa

SEQ ID NO: 333681 - RNA, 26 nt, Human
uggaaaggcagagacaaaagaaaaaa

SEQ ID NO: 333682 - RNA, 26 nt, Human
uggaaaggcagagacaaaagaaaaaa

SEQ ID NO: 333683 - RNA, 22 nt, Human
ugggaagaaaaguugggagggg

SEQ ID NO: 333684 - RNA, 22 nt, Human
ugggaagaaaaguugggagggg

SEQ ID NO: 333685 - RNA, 22 nt, Human
ugggaagaaaaguugggagggg

SEQ ID NO: 333686 - RNA, 18 nt, Human
ugggagggguccccaaug

SEQ ID NO: 333687 - RNA, 18 nt, Human
ugggagggguccccaaug

SEQ ID NO: 333688 - RNA, 19 nt, Human
ugggagggguccccaaugg

SEQ ID NO: 333689 - RNA, 22 nt, Human
uucccgcgcccagagcccgccc

SEQ ID NO: 333690 - RNA, 20 nt, Human
uucgcgggggguccucucca

SEQ ID NO: 333691 - RNA, 23 nt, Human
uuuaagagcaaaacagagaugaa

SEQ ID NO: 333692 - RNA, 23 nt, Human
uuuaagagcaaaacagagaugaa

SEQ ID NO: 333693 - RNA, 23 nt, Human
uuuaagagcaaaacagagaugaa

SEQ ID NO: 333694 - RNA, 28 nt, Human
uuuuuuuuuuuuuuuuuucggggaauug

SEQ ID NO: 333695 - RNA, 24 nt, Human
uuuuuuuuuuuuuuuuuuuucggg

SEQ ID NO: 333696 - RNA, 30 nt, Human
aaaaaaaaaaaaaaaaaaaaaaacaaaaaa

SEQ ID NO: 333697 - RNA, 31 nt, Human
aaaaaaaaaaaaaaaaaaaaaaacaaaaaag

SEQ ID NO: 333698 - RNA, 25 nt, Human
aaaaaaaaaaaaaaaaacaaaaaag

SEQ ID NO: 333699 - RNA, 25 nt, Human
aaaaaaaaaaaaaaaaacaaaaaag

SEQ ID NO: 333700 - RNA, 25 nt, Human
aaaaaaaaaaaaaaaaacaaaaaag

SEQ ID NO: 333701 - RNA, 23 nt, Human
aaaaaaaaaaaaaaaacaaaaaa

SEQ ID NO: 333702 - RNA, 23 nt, Human
aaaaaaaaaaaaaaaacaaaaaa

SEQ ID NO: 333703 - RNA, 23 nt, Human
aaaaaaaaaaaaaaaacaaaaaa

SEQ ID NO: 333704 - RNA, 23 nt, Human
aaaaaaaaaaaaaaaacaaaaaa

SEQ ID NO: 333705 - RNA, 24 nt, Human
aaaaaaaaaaaaaacaaaaaacag

SEQ ID NO: 333706 - RNA, 24 nt, Human
aaaaaaaaaaaaaacaaaaaacag

SEQ ID NO: 333707 - RNA, 24 nt, Human
aaaaaaaaaaaaaacaaaaaacag

SEQ ID NO: 333708 - RNA, 24 nt, Human
aaaaaaaaaaaaaacaaaaaacag

SEQ ID NO: 333709 - RNA, 20 nt, Human
aaaaaaaacaaaaaacagcc

SEQ ID NO: 333710 - RNA, 20 nt, Human
aaaaaaaacaaaaaacagcc

SEQ ID NO: 333711 - RNA, 18 nt, Human
aaaaaaacaaaaaacagc

SEQ ID NO: 333712 - RNA, 18 nt, Human
aaaaaaacaaaaaacagc

SEQ ID NO: 333713 - RNA, 22 nt, Human
aaaaacccagcccucuucagcu

SEQ ID NO: 333714 - RNA, 22 nt, Human
aaaaacccagcccucuucagcu

SEQ ID NO: 333715 - RNA, 22 nt, Human
aaaaacccagcccucuucagcu

SEQ ID NO: 333716 - RNA, 22 nt, Human
aaaaacccagcccucuucagcu

SEQ ID NO: 333717 - RNA, 19 nt, Human
aaaacaaaaaacagccuuu

SEQ ID NO: 333718 - RNA, 19 nt, Human
aaaacaaaaaacagccuuu

SEQ ID NO: 333719 - RNA, 19 nt, Human
aaaacaaaaaacagccuuu

SEQ ID NO: 333720 - RNA, 19 nt, Human
aaaacaaaaaacagccuuu

SEQ ID NO: 333721 - RNA, 18 nt, Human
aaaaugucagucuugaaa

SEQ ID NO: 333722 - RNA, 18 nt, Human
aaaaugucagucuugaaa

SEQ ID NO: 333723 - RNA, 18 nt, Human
aaaaugucagucuugaaa

SEQ ID NO: 333724 - RNA, 18 nt, Human
aaaaugucagucuugaaa

SEQ ID NO: 333725 - RNA, 18 nt, Human
aaacuccugagggcucgc

SEQ ID NO: 333726 - RNA, 22 nt, Human
aaagguauucaucuguccagag

SEQ ID NO: 333727 - RNA, 22 nt, Human
aaagguauucaucuguccagag

SEQ ID NO: 333728 - RNA, 22 nt, Human
aaagguauucaucuguccagag

SEQ ID NO: 333729 - RNA, 22 nt, Human
aaagguauucaucuguccagag

SEQ ID NO: 333730 - RNA, 21 nt, Human
aaaugccuuuucuggccagac

SEQ ID NO: 333731 - RNA, 21 nt, Human
aaaugccuuuucuggccagac

SEQ ID NO: 333732 - RNA, 21 nt, Human
aaaugccuuuucuggccagac

SEQ ID NO: 333733 - RNA, 21 nt, Human
aaaugccuuuucuggccagac

SEQ ID NO: 333734 - RNA, 20 nt, Human
aacacagccagaccccgucu

SEQ ID NO: 333735 - RNA, 20 nt, Human
aacacagccagaccccgucu

SEQ ID NO: 333736 - RNA, 20 nt, Human
aacacagccagaccccgucu

SEQ ID NO: 333737 - RNA, 20 nt, Human
aacacagccagaccccgucu

SEQ ID NO: 333738 - RNA, 21 nt, Human
aacacagccagaccccgucuc

SEQ ID NO: 333739 - RNA, 21 nt, Human
aacacagccagaccccgucuc

SEQ ID NO: 333740 - RNA, 21 nt, Human
aacacagccagaccccgucuc

SEQ ID NO: 333741 - RNA, 21 nt, Human
aacacagccagaccccgucuc

SEQ ID NO: 333742 - RNA, 22 nt, Human
aacaucuucaugauaugaacca

SEQ ID NO: 333743 - RNA, 24 nt, Human
aaccauccuucuccuaccacccac

SEQ ID NO: 333744 - RNA, 25 nt, Human
aaccugcugcuucuccauccgcucc

SEQ ID NO: 333745 - RNA, 25 nt, Human
aaccugcugcuucuccauccgcucc

SEQ ID NO: 333746 - RNA, 24 nt, Human
aacuccagucagggcaacacagcc

SEQ ID NO: 333747 - RNA, 24 nt, Human
aacuccagucagggcaacacagcc

SEQ ID NO: 333748 - RNA, 24 nt, Human
aacuccagucagggcaacacagcc

SEQ ID NO: 333749 - RNA, 24 nt, Human
aacuccagucagggcaacacagcc

SEQ ID NO: 333750 - RNA, 19 nt, Human
aagcaagauaaaucgcaau

SEQ ID NO: 333751 - RNA, 23 nt, Human
aagcaccaggcauacaacaguuu

SEQ ID NO: 333752 - RNA, 18 nt, Human
aagcauuucagauaagca

SEQ ID NO: 333753 - RNA, 18 nt, Human
aagcauuucagauaagca

SEQ ID NO: 333754 - RNA, 18 nt, Human
aagcauuucagauaagca

SEQ ID NO: 333755 - RNA, 18 nt, Human
aagcauuucagauaagca

SEQ ID NO: 333756 - RNA, 26 nt, Human
aaggagccauuggugauuccuaaaaa

SEQ ID NO: 333757 - RNA, 26 nt, Human
aaggagccauuggugauuccuaaaaa

SEQ ID NO: 333758 - RNA, 26 nt, Human
aaggagccauuggugauuccuaaaaa

SEQ ID NO: 333759 - RNA, 26 nt, Human
aaggagccauuggugauuccuaaaaa

SEQ ID NO: 333760 - RNA, 19 nt, Human
aagggaagccugaaacaga

SEQ ID NO: 333761 - RNA, 24 nt, Human
aauaaauagugggaagccucacaa

SEQ ID NO: 333762 - RNA, 24 nt, Human
aauaaauagugggaagccucacaa

SEQ ID NO: 333763 - RNA, 24 nt, Human
aauaaauagugggaagccucacaa

SEQ ID NO: 333764 - RNA, 24 nt, Human
aauaaauagugggaagccucacaa

SEQ ID NO: 333765 - RNA, 18 nt, Human
aaugcaaaacaauucugg

SEQ ID NO: 333766 - RNA, 18 nt, Human
aaugcaaaacaauucugg

SEQ ID NO: 333767 - RNA, 18 nt, Human
aaugcaaaacaauucugg

SEQ ID NO: 333768 - RNA, 18 nt, Human
aaugcaaaacaauucugg

SEQ ID NO: 333769 - RNA, 19 nt, Human
aauuauguggccugagccu

SEQ ID NO: 333770 - RNA, 19 nt, Human
aauuauguggccugagccu

SEQ ID NO: 333771 - RNA, 19 nt, Human
aauuauguggccugagccu

SEQ ID NO: 333772 - RNA, 18 nt, Human
accccgucucaaaaaaaa

SEQ ID NO: 333773 - RNA, 18 nt, Human
accccgucucaaaaaaaa

SEQ ID NO: 333774 - RNA, 18 nt, Human
accccgucucaaaaaaaa

SEQ ID NO: 333775 - RNA, 18 nt, Human
accccgucucaaaaaaaa

SEQ ID NO: 333776 - RNA, 28 nt, Human
accccgucucaaaaaaaaaaaaaaaaaa

SEQ ID NO: 333777 - RNA, 28 nt, Human
accccgucucaaaaaaaaaaaaaaaaaa

SEQ ID NO: 333778 - RNA, 28 nt, Human
accccgucucaaaaaaaaaaaaaaaaaa

SEQ ID NO: 333779 - RNA, 21 nt, Human
acccuaagagaaaaaaaaacc

SEQ ID NO: 333780 - RNA, 21 nt, Human
acccuaagagaaaaaaaaacc

SEQ ID NO: 333781 - RNA, 21 nt, Human
acccuaagagaaaaaaaaacc

SEQ ID NO: 333782 - RNA, 19 nt, Human
agacacaguggcucacacc

SEQ ID NO: 333783 - RNA, 21 nt, Human
agacacaguggcucacaccag

SEQ ID NO: 333784 - RNA, 21 nt, Human
agacacaguggcucacaccag

SEQ ID NO: 333785 - RNA, 21 nt, Human
agacacaguggcucacaccag

SEQ ID NO: 333786 - RNA, 19 nt, Human
agagagcuguguuugcacc

SEQ ID NO: 333787 - RNA, 19 nt, Human
agagagcuguguuugcacc

SEQ ID NO: 333788 - RNA, 19 nt, Human
agagagcuguguuugcacc

SEQ ID NO: 333789 - RNA, 19 nt, Human
agagagcuguguuugcacc

SEQ ID NO: 333790 - RNA, 21 nt, Human
agauaaagccuuggacuugag

SEQ ID NO: 333791 - RNA, 21 nt, Human
agauaaagccuuggacuugag

SEQ ID NO: 333792 - RNA, 19 nt, Human
aggagcacggagaggaggg

SEQ ID NO: 333793 - RNA, 24 nt, Human
aggcagaggugggaguaucacuug

SEQ ID NO: 333794 - RNA, 24 nt, Human
aggcagaggugggaguaucacuug

SEQ ID NO: 333795 - RNA, 24 nt, Human
aggcagaggugggaguaucacuug

SEQ ID NO: 333796 - RNA, 24 nt, Human
aggcagaggugggaguaucacuug

SEQ ID NO: 333797 - RNA, 21 nt, Human
aggcauauacacgaaacacag

SEQ ID NO: 333798 - RNA, 21 nt, Human
aggcauauacacgaaacacag

SEQ ID NO: 333799 - RNA, 21 nt, Human
aggcauauacacgaaacacag

SEQ ID NO: 333800 - RNA, 21 nt, Human
aggcauauacacgaaacacag

SEQ ID NO: 333801 - RNA, 21 nt, Human
agguauucaucuguccagagc

SEQ ID NO: 333802 - RNA, 21 nt, Human
agguauucaucuguccagagc

SEQ ID NO: 333803 - RNA, 21 nt, Human
agguauucaucuguccagagc

SEQ ID NO: 333804 - RNA, 21 nt, Human
agguauucaucuguccagagc

SEQ ID NO: 333805 - RNA, 18 nt, Human
aggugggaguaucacuug

SEQ ID NO: 333806 - RNA, 18 nt, Human
aggugggaguaucacuug

SEQ ID NO: 333807 - RNA, 18 nt, Human
aggugggaguaucacuug

SEQ ID NO: 333808 - RNA, 18 nt, Human
aggugggaguaucacuug

SEQ ID NO: 333809 - RNA, 23 nt, Human
aguaauaaauagugggaagccuc

SEQ ID NO: 333810 - RNA, 23 nt, Human
aguaauaaauagugggaagccuc

SEQ ID NO: 333811 - RNA, 20 nt, Human
agucacuccugcaaggaagu

SEQ ID NO: 333812 - RNA, 20 nt, Human
agucacuccugcaaggaagu

SEQ ID NO: 333813 - RNA, 20 nt, Human
agucacuccugcaaggaagu

SEQ ID NO: 333814 - RNA, 18 nt, Human
agugaucucagguagucu

SEQ ID NO: 333815 - RNA, 18 nt, Human
agugaucucagguagucu

SEQ ID NO: 333816 - RNA, 24 nt, Human
aguggcucacaccaguaaucccug

SEQ ID NO: 333817 - RNA, 24 nt, Human
aguggcucacaccaguaaucccug

SEQ ID NO: 333818 - RNA, 21 nt, Human
aguuuccuguugugcguuggu

SEQ ID NO: 333819 - RNA, 21 nt, Human
aguuuccuguugugcguuggu

SEQ ID NO: 333820 - RNA, 21 nt, Human
aguuuccuguugugcguuggu

SEQ ID NO: 333821 - RNA, 21 nt, Human
augagcucaggcuucugcaug

SEQ ID NO: 333822 - RNA, 19 nt, Human
augcacagacucccacgua

SEQ ID NO: 333823 - RNA, 23 nt, Human
auuuccuuuucuucauguccugg

SEQ ID NO: 333824 - RNA, 23 nt, Human
auuuccuuuucuucauguccugg

SEQ ID NO: 333825 - RNA, 19 nt, Human
caaagauaaagccuuggac

SEQ ID NO: 333826 - RNA, 19 nt, Human
caaagauaaagccuuggac

SEQ ID NO: 333827 - RNA, 18 nt, Human
caacagccgcggcgggag

SEQ ID NO: 333828 - RNA, 23 nt, Human
cacaagccgaagaaaagguauuc

SEQ ID NO: 333829 - RNA, 23 nt, Human
cacaagccgaagaaaagguauuc

SEQ ID NO: 333830 - RNA, 23 nt, Human
cacaagccgaagaaaagguauuc

SEQ ID NO: 333831 - RNA, 23 nt, Human
cacaagccgaagaaaagguauuc

SEQ ID NO: 333832 - RNA, 25 nt, Human
cacagcccacuuuucagaguugucu

SEQ ID NO: 333833 - RNA, 25 nt, Human
cacagcccacuuuucagaguugucu

SEQ ID NO: 333834 - RNA, 18 nt, Human
caccaggcauacaacagu

SEQ ID NO: 333835 - RNA, 18 nt, Human
caccaggcauacaacagu

SEQ ID NO: 333836 - RNA, 18 nt, Human
caccaggcauacaacagu

SEQ ID NO: 333837 - RNA, 18 nt, Human
caccaggcauacaacagu

SEQ ID NO: 333838 - RNA, 18 nt, Human
caccaggcauacaacagu

SEQ ID NO: 333839 - RNA, 18 nt, Human
caccaggcauacaacagu

SEQ ID NO: 333840 - RNA, 18 nt, Human
caccaggcauacaacagu

SEQ ID NO: 333841 - RNA, 18 nt, Human
caccaggcauacaacagu

SEQ ID NO: 333842 - RNA, 20 nt, Human
cacccacugauccuuccggg

SEQ ID NO: 333843 - RNA, 26 nt, Human
caccgccuccuuccuugccuucucca

SEQ ID NO: 333844 - RNA, 26 nt, Human
caccgccuccuuccuugccuucucca

SEQ ID NO: 333845 - RNA, 21 nt, Human
caccugaaauggggaaguaga

SEQ ID NO: 333846 - RNA, 25 nt, Human
cacuaacaccauaaccaacaucuuc

SEQ ID NO: 333847 - RNA, 24 nt, Human
cacugaacuccagucagggcaaca

SEQ ID NO: 333848 - RNA, 24 nt, Human
cacugaacuccagucagggcaaca

SEQ ID NO: 333849 - RNA, 24 nt, Human
cacugaacuccagucagggcaaca

SEQ ID NO: 333850 - RNA, 24 nt, Human
cacugaacuccagucagggcaaca

SEQ ID NO: 333851 - RNA, 19 nt, Human
cagacaggaaccagggcag

SEQ ID NO: 333852 - RNA, 23 nt, Human
cagaggugggaguaucacuuggg

SEQ ID NO: 333853 - RNA, 23 nt, Human
cagaggugggaguaucacuuggg

SEQ ID NO: 333854 - RNA, 23 nt, Human
cagaggugggaguaucacuuggg

SEQ ID NO: 333855 - RNA, 23 nt, Human
cagaggugggaguaucacuuggg

SEQ ID NO: 333856 - RNA, 18 nt, Human
cagccagaccccgucuca

SEQ ID NO: 333857 - RNA, 18 nt, Human
cagccagaccccgucuca

SEQ ID NO: 333858 - RNA, 18 nt, Human
cagccagaccccgucuca

SEQ ID NO: 333859 - RNA, 18 nt, Human
cagccagaccccgucuca

SEQ ID NO: 333860 - RNA, 22 nt, Human
cagcgacccuaagagaaaaaaa

SEQ ID NO: 333861 - RNA, 22 nt, Human
cagcgacccuaagagaaaaaaa

SEQ ID NO: 333862 - RNA, 22 nt, Human
cagcgacccuaagagaaaaaaa

SEQ ID NO: 333863 - RNA, 22 nt, Human
cagcgacccuaagagaaaaaaa

SEQ ID NO: 333864 - RNA, 19 nt, Human
caggcuucugcaugagagg

SEQ ID NO: 333865 - RNA, 24 nt, Human
caguaauaaauagugggaagccuc

SEQ ID NO: 333866 - RNA, 24 nt, Human
caguaauaaauagugggaagccuc

SEQ ID NO: 333867 - RNA, 19 nt, Human
cauccccaaggucucauua

SEQ ID NO: 333868 - RNA, 19 nt, Human
cauccccaaggucucauua

SEQ ID NO: 333869 - RNA, 22 nt, Human
caugcacaaaauuauguguaug

SEQ ID NO: 333870 - RNA, 22 nt, Human
cauucccaaaacuccugugcgu

SEQ ID NO: 333871 - RNA, 22 nt, Human
ccaaaaaguaguuuuccaaagu

SEQ ID NO: 333872 - RNA, 22 nt, Human
ccaaaaaguaguuuuccaaagu

SEQ ID NO: 333873 - RNA, 22 nt, Human
ccaaaaaguaguuuuccaaagu

SEQ ID NO: 333874 - RNA, 22 nt, Human
ccaaaaaguaguuuuccaaagu

SEQ ID NO: 333875 - RNA, 20 nt, Human
ccacaccauccccugcaucg

SEQ ID NO: 333876 - RNA, 23 nt, Human
ccacagugcuuaaugugggcaac

SEQ ID NO: 333877 - RNA, 23 nt, Human
ccacagugcuuaaugugggcaac

SEQ ID NO: 333878 - RNA, 23 nt, Human
ccacagugcuuaaugugggcaac

SEQ ID NO: 333879 - RNA, 23 nt, Human
ccacagugcuuaaugugggcaac

SEQ ID NO: 333880 - RNA, 21 nt, Human
ccagaaguggaaaauuccaca

SEQ ID NO: 333881 - RNA, 21 nt, Human
ccagaaguggaaaauuccaca

SEQ ID NO: 333882 - RNA, 21 nt, Human
ccagaaguggaaaauuccaca

SEQ ID NO: 333883 - RNA, 21 nt, Human
ccagagccucucccuacuaga

SEQ ID NO: 333884 - RNA, 21 nt, Human
ccagagccucucccuacuaga

SEQ ID NO: 333885 - RNA, 21 nt, Human
ccagagccucucccuacuaga

SEQ ID NO: 333886 - RNA, 21 nt, Human
ccagagccucucccuacuaga

SEQ ID NO: 333887 - RNA, 26 nt, Human
ccauccccucaccuucagcuggaccc

SEQ ID NO: 333888 - RNA, 19 nt, Human
ccccgucucaaaaaaaaaa

SEQ ID NO: 333889 - RNA, 19 nt, Human
ccccgucucaaaaaaaaaa

SEQ ID NO: 333890 - RNA, 19 nt, Human
ccccgucucaaaaaaaaaa

SEQ ID NO: 333891 - RNA, 19 nt, Human
ccccgucucaaaaaaaaaa

SEQ ID NO: 333892 - RNA, 24 nt, Human
cccgucucaaaaaaaaaaaaaaag

SEQ ID NO: 333893 - RNA, 24 nt, Human
cccgucucaaaaaaaaaaaaaaag

SEQ ID NO: 333894 - RNA, 21 nt, Human
cccuaagagaaaaaaaaaccc

SEQ ID NO: 333895 - RNA, 21 nt, Human
cccuaagagaaaaaaaaaccc

SEQ ID NO: 333896 - RNA, 21 nt, Human
cccuaagagaaaaaaaaaccc

SEQ ID NO: 333897 - RNA, 21 nt, Human
cccuaagagaaaaaaaaaccc

SEQ ID NO: 333898 - RNA, 19 nt, Human
ccuaagagaaaaaaaaacc

SEQ ID NO: 333899 - RNA, 19 nt, Human
ccuaagagaaaaaaaaacc

SEQ ID NO: 333900 - RNA, 21 nt, Human
ccuccugcuggcagcugaguc

SEQ ID NO: 333901 - RNA, 23 nt, Human
ccuucuccuaccacccacugauc

SEQ ID NO: 333902 - RNA, 22 nt, Human
ccuugcuccaaccuuuuuccug

SEQ ID NO: 333903 - RNA, 22 nt, Human
ccuugcuccaaccuuuuuccug

SEQ ID NO: 333904 - RNA, 21 nt, Human
cgcaaagcaccaggcauacaa

SEQ ID NO: 333905 - RNA, 21 nt, Human
cgcaaagcaccaggcauacaa

SEQ ID NO: 333906 - RNA, 21 nt, Human
cgcaaagcaccaggcauacaa

SEQ ID NO: 333907 - RNA, 23 nt, Human
cggcguggagacucgaaccugcu

SEQ ID NO: 333908 - RNA, 23 nt, Human
cggcguggagacucgaaccugcu

SEQ ID NO: 333909 - RNA, 23 nt, Human
cggcguggagacucgaaccugcu

SEQ ID NO: 333910 - RNA, 18 nt, Human
cgggagcugcaguccugg

SEQ ID NO: 333911 - RNA, 18 nt, Human
cgggagcugcaguccugg

SEQ ID NO: 333912 - RNA, 24 nt, Human
cuaaaauguccaucuucauuaaca

SEQ ID NO: 333913 - RNA, 24 nt, Human
cuaaaauguccaucuucauuaaca

SEQ ID NO: 333914 - RNA, 24 nt, Human
cuaaaauguccaucuucauuaaca

SEQ ID NO: 333915 - RNA, 24 nt, Human
cuaaaauguccaucuucauuaaca

SEQ ID NO: 333916 - RNA, 20 nt, Human
cuaacaccauaaccaacauc

SEQ ID NO: 333917 - RNA, 23 nt, Human
cuaacaccauaaccaacaucuuc

SEQ ID NO: 333918 - RNA, 18 nt, Human
cucaaaaaaaaaaaaaaa

SEQ ID NO: 333919 - RNA, 18 nt, Human
cucaaaaaaaaaaaaaaa

SEQ ID NO: 333920 - RNA, 23 nt, Human
cucaaaaaaaaaaaaaaaaaaaa

SEQ ID NO: 333921 - RNA, 23 nt, Human
cucacaaaugcacagacucccac

SEQ ID NO: 333922 - RNA, 19 nt, Human
cucacaagccgaagaaaag

SEQ ID NO: 333923 - RNA, 19 nt, Human
cucacaagccgaagaaaag

SEQ ID NO: 333924 - RNA, 19 nt, Human
cucacaagccgaagaaaag

SEQ ID NO: 333925 - RNA, 20 nt, Human
cucacuaacaccauaaccaa

SEQ ID NO: 333926 - RNA, 20 nt, Human
cucacuaacaccauaaccaa

SEQ ID NO: 333927 - RNA, 21 nt, Human
cucccggaacugcugcugcag

SEQ ID NO: 333928 - RNA, 21 nt, Human
cucccggaacugcugcugcag

SEQ ID NO: 333929 - RNA, 21 nt, Human
cucccggaacugcugcugcag

SEQ ID NO: 333930 - RNA, 20 nt, Human
cucgcucuccacggcggaug

SEQ ID NO: 333931 - RNA, 20 nt, Human
cucgcucuccacggcggaug

SEQ ID NO: 333932 - RNA, 20 nt, Human
cucgcucuccacggcggaug

SEQ ID NO: 333933 - RNA, 19 nt, Human
cugauccuuccgggcagca

SEQ ID NO: 333934 - RNA, 25 nt, Human
cugcagugggcucucagucagaucc

SEQ ID NO: 333935 - RNA, 25 nt, Human
cugcagugggcucucagucagaucc

SEQ ID NO: 333936 - RNA, 25 nt, Human
cugcagugggcucucagucagaucc

SEQ ID NO: 333937 - RNA, 25 nt, Human
cugcagugggcucucagucagaucc

SEQ ID NO: 333938 - RNA, 20 nt, Human
cugccucacucuucucagcu

SEQ ID NO: 333939 - RNA, 20 nt, Human
cugccucacucuucucagcu

SEQ ID NO: 333940 - RNA, 20 nt, Human
cugccucacucuucucagcu

SEQ ID NO: 333941 - RNA, 24 nt, Human
cugccucacucuucucagcugacg

SEQ ID NO: 333942 - RNA, 23 nt, Human
cugcuuggauuuuugaaccaugu

SEQ ID NO: 333943 - RNA, 25 nt, Human
cugguuguucaaggcuaauguguca

SEQ ID NO: 333944 - RNA, 25 nt, Human
cugguuguucaaggcuaauguguca

SEQ ID NO: 333945 - RNA, 25 nt, Human
cugguuguucaaggcuaauguguca

SEQ ID NO: 333946 - RNA, 19 nt, Human
cugguuucaagcauuucag

SEQ ID NO: 333947 - RNA, 19 nt, Human
cugguuucaagcauuucag

SEQ ID NO: 333948 - RNA, 19 nt, Human
cugguuucaagcauuucag

SEQ ID NO: 333949 - RNA, 19 nt, Human
cugguuucaagcauuucag

SEQ ID NO: 333950 - RNA, 20 nt, Human
gaaacagaaacauugaaaaa

SEQ ID NO: 333951 - RNA, 21 nt, Human
gaaccagggcaggggugagaa

SEQ ID NO: 333952 - RNA, 19 nt, Human
gacagaguccaauuaugug

SEQ ID NO: 333953 - RNA, 19 nt, Human
gacagaguccaauuaugug

SEQ ID NO: 333954 - RNA, 19 nt, Human
gagaaaaaaaaacccagcc

SEQ ID NO: 333955 - RNA, 19 nt, Human
gagaaaaaaaaacccagcc

SEQ ID NO: 333956 - RNA, 19 nt, Human
gagaaaaaaaaacccagcc

SEQ ID NO: 333957 - RNA, 19 nt, Human
gagaaaaaaaaacccagcc

SEQ ID NO: 333958 - RNA, 21 nt, Human
gagagcaaguugaagaggaca

SEQ ID NO: 333959 - RNA, 20 nt, Human
gagcaacagccgcggcggga

SEQ ID NO: 333960 - RNA, 23 nt, Human
gagugguucugagacaguuacag

SEQ ID NO: 333961 - RNA, 23 nt, Human
gagugguucugagacaguuacag

SEQ ID NO: 333962 - RNA, 23 nt, Human
gagugguucugagacaguuacag

SEQ ID NO: 333963 - RNA, 23 nt, Human
gcaaaacaacugaauguagacaa

SEQ ID NO: 333964 - RNA, 23 nt, Human
gcaaaacaacugaauguagacaa

SEQ ID NO: 333965 - RNA, 20 nt, Human
gcaaagcaccaggcauacaa

SEQ ID NO: 333966 - RNA, 20 nt, Human
gcacaaaauuauguguauga

SEQ ID NO: 333967 - RNA, 20 nt, Human
gcacaaaauuauguguauga

SEQ ID NO: 333968 - RNA, 20 nt, Human
gcacaaaauuauguguauga

SEQ ID NO: 333969 - RNA, 20 nt, Human
gcacaaaauuauguguauga

SEQ ID NO: 333970 - RNA, 23 nt, Human
gcacugcuccaaccuuuuuccug

SEQ ID NO: 333971 - RNA, 23 nt, Human
gcacugcuccaaccuuuuuccug

SEQ ID NO: 333972 - RNA, 23 nt, Human
gcgacccuaagagaaaaaaaaac

SEQ ID NO: 333973 - RNA, 23 nt, Human
gcgacccuaagagaaaaaaaaac

SEQ ID NO: 333974 - RNA, 19 nt, Human
gcgcggugcacacagggag

SEQ ID NO: 333975 - RNA, 18 nt, Human
gcggcggcgaggacgggc

SEQ ID NO: 333976 - RNA, 21 nt, Human
gcugcaguccugguccgccgg

SEQ ID NO: 333977 - RNA, 21 nt, Human
gcugcaguccugguccgccgg

SEQ ID NO: 333978 - RNA, 21 nt, Human
gcugcaguccugguccgccgg

SEQ ID NO: 333979 - RNA, 24 nt, Human
ggaaagagagcaaguugaagagga

SEQ ID NO: 333980 - RNA, 21 nt, Human
ggaccaagucuggccuauauu

SEQ ID NO: 333981 - RNA, 21 nt, Human
ggaccaagucuggccuauauu

SEQ ID NO: 333982 - RNA, 21 nt, Human
ggaccaagucuggccuauauu

SEQ ID NO: 333983 - RNA, 21 nt, Human
ggaccaagucuggccuauauu

SEQ ID NO: 333984 - RNA, 18 nt, Human
ggaguccuguucuggguc

SEQ ID NO: 333985 - RNA, 18 nt, Human
ggagugguucugagacag

SEQ ID NO: 333986 - RNA, 22 nt, Human
ggcacacaugacugagugcacg

SEQ ID NO: 333987 - RNA, 21 nt, Human
ggccagacacaguggcucaca

SEQ ID NO: 333988 - RNA, 21 nt, Human
ggccagacacaguggcucaca

SEQ ID NO: 333989 - RNA, 21 nt, Human
ggcuaaugugucagaggucug

SEQ ID NO: 333990 - RNA, 21 nt, Human
ggcuaaugugucagaggucug

SEQ ID NO: 333991 - RNA, 21 nt, Human
ggcuaaugugucagaggucug

SEQ ID NO: 333992 - RNA, 22 nt, Human
ggcugggucuggaaggggaggu

SEQ ID NO: 333993 - RNA, 22 nt, Human
ggcugggucuggaaggggaggu

SEQ ID NO: 333994 - RNA, 22 nt, Human
ggcugggucuggaaggggaggu

SEQ ID NO: 333995 - RNA, 26 nt, Human
gggaaagagagcaaguugaagaggac

SEQ ID NO: 333996 - RNA, 19 nt, Human
gggaagagaucuuagaugg

SEQ ID NO: 333997 - RNA, 18 nt, Human
gggaagccucacaagccg

SEQ ID NO: 333998 - RNA, 18 nt, Human
gggaagccucacaagccg

SEQ ID NO: 333999 - RNA, 18 nt, Human
gggaagccucacaagccg

SEQ ID NO: 334000 - RNA, 18 nt, Human
gggaagccucacaagccg

SEQ ID NO: 334001 - RNA, 19 nt, Human
gggaaguagaaacaguugc

SEQ ID NO: 334002 - RNA, 19 nt, Human
gggaaguagaaacaguugc

SEQ ID NO: 334003 - RNA, 19 nt, Human
gggaaguagaaacaguugc

SEQ ID NO: 334004 - RNA, 19 nt, Human
gggaaguagaaacaguugc

SEQ ID NO: 334005 - RNA, 19 nt, Human
gggcaggggugagaauuac

SEQ ID NO: 334006 - RNA, 24 nt, Human
gggugagaauuaccuuccacgcug

SEQ ID NO: 334007 - RNA, 24 nt, Human
ggugcugucugugcacucgcagua

SEQ ID NO: 334008 - RNA, 22 nt, Human
uaaauagugggaagccucacaa

SEQ ID NO: 334009 - RNA, 22 nt, Human
uaaauagugggaagccucacaa

SEQ ID NO: 334010 - RNA, 22 nt, Human
uaaauagugggaagccucacaa

SEQ ID NO: 334011 - RNA, 22 nt, Human
uaaauagugggaagccucacaa

SEQ ID NO: 334012 - RNA, 19 nt, Human
uaaaugaagauuguagccu

SEQ ID NO: 334013 - RNA, 19 nt, Human
uaaaugaagauuguagccu

SEQ ID NO: 334014 - RNA, 19 nt, Human
uaaaugaagauuguagccu

SEQ ID NO: 334015 - RNA, 19 nt, Human
uaaaugaagauuguagccu

SEQ ID NO: 334016 - RNA, 21 nt, Human
uacuagagugauggacaagcu

SEQ ID NO: 334017 - RNA, 21 nt, Human
uacuagagugauggacaagcu

SEQ ID NO: 334018 - RNA, 21 nt, Human
uacuagagugauggacaagcu

SEQ ID NO: 334019 - RNA, 21 nt, Human
uacuagagugauggacaagcu

SEQ ID NO: 334020 - RNA, 21 nt, Human
uaggaaaaaaugucagucuug

SEQ ID NO: 334021 - RNA, 21 nt, Human
uauguguaugaggcauauaca

SEQ ID NO: 334022 - RNA, 21 nt, Human
uauguguaugaggcauauaca

SEQ ID NO: 334023 - RNA, 21 nt, Human
uauguguaugaggcauauaca

SEQ ID NO: 334024 - RNA, 21 nt, Human
uauguguaugaggcauauaca

SEQ ID NO: 334025 - RNA, 23 nt, Human
uauguguaugaggcauauacacg

SEQ ID NO: 334026 - RNA, 23 nt, Human
uauguguaugaggcauauacacg

SEQ ID NO: 334027 - RNA, 23 nt, Human
uauguguaugaggcauauacacg

SEQ ID NO: 334028 - RNA, 23 nt, Human
uauguguaugaggcauauacacg

SEQ ID NO: 334029 - RNA, 20 nt, Human
ucaaaaaaaaaaaaaaaaaa

SEQ ID NO: 334030 - RNA, 22 nt, Human
ucaaaaaaaaaaaaaaaaaaaa

SEQ ID NO: 334031 - RNA, 22 nt, Human
ucaaaaaaaaaaaaaaaaaaaa

SEQ ID NO: 334032 - RNA, 22 nt, Human
ucaaaaaaaaaaaaaaaaaaaa

SEQ ID NO: 334033 - RNA, 23 nt, Human
ucaaaaaaaaaaaaaaaaaaaaa

SEQ ID NO: 334034 - RNA, 23 nt, Human
ucaaaaaaaaaaaaaaaaaaaaa

SEQ ID NO: 334035 - RNA, 23 nt, Human
ucaaaaaaaaaaaaaaaaaaaaa

SEQ ID NO: 334036 - RNA, 23 nt, Human
ucaaaaaaaaaaaaaaaaaaaaa

SEQ ID NO: 334037 - RNA, 18 nt, Human
ucaagagucuaagcauuu

SEQ ID NO: 334038 - RNA, 18 nt, Human
ucaagagucuaagcauuu

SEQ ID NO: 334039 - RNA, 20 nt, Human
ucagcccgucugucaccgcc

SEQ ID NO: 334040 - RNA, 20 nt, Human
ucagcccgucugucaccgcc

SEQ ID NO: 334041 - RNA, 18 nt, Human
ucagucuugaaacaaugc

SEQ ID NO: 334042 - RNA, 18 nt, Human
ucagucuugaaacaaugc

SEQ ID NO: 334043 - RNA, 18 nt, Human
ucagucuugaaacaaugc

SEQ ID NO: 334044 - RNA, 18 nt, Human
ucagucuugaaacaaugc

SEQ ID NO: 334045 - RNA, 19 nt, Human
ucagucuugaaacaaugca

SEQ ID NO: 334046 - RNA, 19 nt, Human
ucagucuugaaacaaugca

SEQ ID NO: 334047 - RNA, 19 nt, Human
ucagucuugaaacaaugca

SEQ ID NO: 334048 - RNA, 19 nt, Human
ucagucuugaaacaaugca

SEQ ID NO: 334049 - RNA, 20 nt, Human
uccacagugcuuaauguggg

SEQ ID NO: 334050 - RNA, 20 nt, Human
uccacagugcuuaauguggg

SEQ ID NO: 334051 - RNA, 20 nt, Human
uccacagugcuuaauguggg

SEQ ID NO: 334052 - RNA, 20 nt, Human
uccacagugcuuaauguggg

SEQ ID NO: 334053 - RNA, 22 nt, Human
uccacguucagacuuggguccc

SEQ ID NO: 334054 - RNA, 22 nt, Human
uccacguucagacuuggguccc

SEQ ID NO: 334055 - RNA, 22 nt, Human
uccacguucagacuuggguccc

SEQ ID NO: 334056 - RNA, 22 nt, Human
uccacguucagacuuggguccc

SEQ ID NO: 334057 - RNA, 21 nt, Human
ucccaaaacuccugagggcuc

SEQ ID NO: 334058 - RNA, 18 nt, Human
ucccggaacugcugcugc

SEQ ID NO: 334059 - RNA, 18 nt, Human
ucccggaacugcugcugc

SEQ ID NO: 334060 - RNA, 18 nt, Human
ucccggaacugcugcugc

SEQ ID NO: 334061 - RNA, 19 nt, Human
uccuuccgggcagcagguc

SEQ ID NO: 334062 - RNA, 22 nt, Human
ucuagacgagggcuugaccaca

SEQ ID NO: 334063 - RNA, 22 nt, Human
ucuagacgagggcuugaccaca

SEQ ID NO: 334064 - RNA, 22 nt, Human
ucuagacgagggcuugaccaca

SEQ ID NO: 334065 - RNA, 18 nt, Human
ucucaaaaaaaaaaaaaa

SEQ ID NO: 334066 - RNA, 18 nt, Human
ucucaaaaaaaaaaaaaa

SEQ ID NO: 334067 - RNA, 18 nt, Human
ucucaaaaaaaaaaaaaa

SEQ ID NO: 334068 - RNA, 18 nt, Human
ucucaaaaaaaaaaaaaa

SEQ ID NO: 334069 - RNA, 19 nt, Human
ucucaaaaaugccuuuucu

SEQ ID NO: 334070 - RNA, 19 nt, Human
ucucaaaaaugccuuuucu

SEQ ID NO: 334071 - RNA, 19 nt, Human
ucucaaaaaugccuuuucu

SEQ ID NO: 334072 - RNA, 19 nt, Human
ucucaaaaaugccuuuucu

SEQ ID NO: 334073 - RNA, 24 nt, Human
ucuggccagacacaguggcucaca

SEQ ID NO: 334074 - RNA, 24 nt, Human
ucuggccagacacaguggcucaca

SEQ ID NO: 334075 - RNA, 23 nt, Human
ugaaacagaaacauugaaaaaau

SEQ ID NO: 334076 - RNA, 21 nt, Human
ugaaaugcucugagaucagaa

SEQ ID NO: 334077 - RNA, 21 nt, Human
ugaaaugcucugagaucagaa

SEQ ID NO: 334078 - RNA, 21 nt, Human
ugaaaugcucugagaucagaa

SEQ ID NO: 334079 - RNA, 21 nt, Human
ugaaaugcucugagaucagaa

SEQ ID NO: 334080 - RNA, 22 nt, Human
ugacaagucgcaaagcaccagg

SEQ ID NO: 334081 - RNA, 22 nt, Human
ugacaagucgcaaagcaccagg

SEQ ID NO: 334082 - RNA, 22 nt, Human
ugacaagucgcaaagcaccagg

SEQ ID NO: 334083 - RNA, 22 nt, Human
ugacaagucgcaaagcaccagg

SEQ ID NO: 334084 - RNA, 20 nt, Human
ugacagaguccaauuaugug

SEQ ID NO: 334085 - RNA, 20 nt, Human
ugacagaguccaauuaugug

SEQ ID NO: 334086 - RNA, 23 nt, Human
ugaccaaaaaguaguuuuccaaa

SEQ ID NO: 334087 - RNA, 23 nt, Human
ugaccaaaaaguaguuuuccaaa

SEQ ID NO: 334088 - RNA, 23 nt, Human
ugaccaaaaaguaguuuuccaaa

SEQ ID NO: 334089 - RNA, 23 nt, Human
ugaccaaaaaguaguuuuccaaa

SEQ ID NO: 334090 - RNA, 19 nt, Human
ugacgugaugccagaagug

SEQ ID NO: 334091 - RNA, 19 nt, Human
ugacgugaugccagaagug

SEQ ID NO: 334092 - RNA, 19 nt, Human
ugacgugaugccagaagug

SEQ ID NO: 334093 - RNA, 19 nt, Human
ugacgugaugccagaagug

SEQ ID NO: 334094 - RNA, 23 nt, Human
ugagcacuaugaaaagccaauuu

SEQ ID NO: 334095 - RNA, 23 nt, Human
ugagcacuaugaaaagccaauuu

SEQ ID NO: 334096 - RNA, 23 nt, Human
ugagcacuaugaaaagccaauuu

SEQ ID NO: 334097 - RNA, 23 nt, Human
ugagcacuaugaaaagccaauuu

SEQ ID NO: 334098 - RNA, 24 nt, Human
ugauacaaaguagugaaaagccuu

SEQ ID NO: 334099 - RNA, 24 nt, Human
ugauacaaaguagugaaaagccuu

SEQ ID NO: 334100 - RNA, 24 nt, Human
ugcaaaacaacugaauguagacaa

SEQ ID NO: 334101 - RNA, 24 nt, Human
ugcaaaacaacugaauguagacaa

SEQ ID NO: 334102 - RNA, 25 nt, Human
ugcaaaacaauucugguuucaagca

SEQ ID NO: 334103 - RNA, 25 nt, Human
ugcaaaacaauucugguuucaagca

SEQ ID NO: 334104 - RNA, 25 nt, Human
ugcaaaacaauucugguuucaagca

SEQ ID NO: 334105 - RNA, 25 nt, Human
ugcaaaacaauucugguuucaagca

SEQ ID NO: 334106 - RNA, 19 nt, Human
ugcacagacucccacguag

SEQ ID NO: 334107 - RNA, 23 nt, Human
ugcuuggauuuuugaaccaugug

SEQ ID NO: 334108 - RNA, 20 nt, Human
uggaggccgccggacgcgug

SEQ ID NO: 334109 - RNA, 24 nt, Human
uggccagacacaguggcucacacc

SEQ ID NO: 334110 - RNA, 24 nt, Human
uggccagacacaguggcucacacc

SEQ ID NO: 334111 - RNA, 24 nt, Human
uggccagacacaguggcucacacc

SEQ ID NO: 334112 - RNA, 24 nt, Human
uggccagacacaguggcucacacc

SEQ ID NO: 334113 - RNA, 20 nt, Human
uggcucacaccaguaauccc

SEQ ID NO: 334114 - RNA, 20 nt, Human
uggcucacaccaguaauccc

SEQ ID NO: 334115 - RNA, 22 nt, Human
ugggcccaagagguuguggaga

SEQ ID NO: 334116 - RNA, 22 nt, Human
ugggcccaagagguuguggaga

SEQ ID NO: 334117 - RNA, 26 nt, Human
ugguugaccugcgccucgggcagcgc

SEQ ID NO: 334118 - RNA, 18 nt, Human
uguagccuggauugauac

SEQ ID NO: 334119 - RNA, 18 nt, Human
uguagccuggauugauac

SEQ ID NO: 334120 - RNA, 25 nt, Human
ugucagaggucugggcugggucugc

SEQ ID NO: 334121 - RNA, 25 nt, Human
ugucagaggucugggcugggucugc

SEQ ID NO: 334122 - RNA, 25 nt, Human
ugucagaggucugggcugggucugc

SEQ ID NO: 334123 - RNA, 18 nt, Human
uguccagaauacaguuuc

SEQ ID NO: 334124 - RNA, 18 nt, Human
uguccagaauacaguuuc

SEQ ID NO: 334125 - RNA, 21 nt, Human
uguuguaucuugccuccucca

SEQ ID NO: 334126 - RNA, 21 nt, Human
uguuguaucuugccuccucca

SEQ ID NO: 334127 - RNA, 21 nt, Human
uguuguaucuugccuccucca

SEQ ID NO: 334128 - RNA, 23 nt, Human
uuacugauuaauucuugagucac

SEQ ID NO: 334129 - RNA, 23 nt, Human
uuacugauuaauucuugagucac

SEQ ID NO: 334130 - RNA, 21 nt, Human
uuagacucccagccccgcgcu

SEQ ID NO: 334131 - RNA, 20 nt, Human
uucaaaaaaugcaaaacaau

SEQ ID NO: 334132 - RNA, 20 nt, Human
uucaaaaaaugcaaaacaau

SEQ ID NO: 334133 - RNA, 20 nt, Human
uucaaaaaaugcaaaacaau

SEQ ID NO: 334134 - RNA, 20 nt, Human
uucaaaaaaugcaaaacaau

SEQ ID NO: 334135 - RNA, 21 nt, Human
uucaaaaaaugcaaaacaauu

SEQ ID NO: 334136 - RNA, 21 nt, Human
uucaaaaaaugcaaaacaauu

SEQ ID NO: 334137 - RNA, 21 nt, Human
uucaaaaaaugcaaaacaauu

SEQ ID NO: 334138 - RNA, 21 nt, Human
uucaaaaaaugcaaaacaauu

SEQ ID NO: 334139 - RNA, 24 nt, Human
uucagcccgucugucaccgccucc

SEQ ID NO: 334140 - RNA, 24 nt, Human
uucagcccgucugucaccgccucc

SEQ ID NO: 334141 - RNA, 24 nt, Human
uucaugcacaaaauuauguguaug

SEQ ID NO: 334142 - RNA, 24 nt, Human
uucaugcacaaaauuauguguaug

SEQ ID NO: 334143 - RNA, 24 nt, Human
uucaugcacaaaauuauguguaug

SEQ ID NO: 334144 - RNA, 18 nt, Human
uucccaguuuccuguugu

SEQ ID NO: 334145 - RNA, 18 nt, Human
uucccaguuuccuguugu

SEQ ID NO: 334146 - RNA, 18 nt, Human
uucccaguuuccuguugu

SEQ ID NO: 334147 - RNA, 18 nt, Human
uucuccuaccacccacug

SEQ ID NO: 334148 - RNA, 23 nt, Human
uugggcccaagagguuguggaga

SEQ ID NO: 334149 - RNA, 23 nt, Human
uugggcccaagagguuguggaga

SEQ ID NO: 334150 - RNA, 21 nt, Human
uuguaaggcagaggugggagu

SEQ ID NO: 334151 - RNA, 21 nt, Human
uuguaaggcagaggugggagu

SEQ ID NO: 334152 - RNA, 21 nt, Human
uuguaaggcagaggugggagu

SEQ ID NO: 334153 - RNA, 21 nt, Human
uuguaaggcagaggugggagu

SEQ ID NO: 334154 - RNA, 23 nt, Human
uuucucaaaaaugccuuuucugg

SEQ ID NO: 334155 - RNA, 23 nt, Human
uuucucaaaaaugccuuuucugg

SEQ ID NO: 334156 - RNA, 23 nt, Human
uuucucaaaaaugccuuuucugg

SEQ ID NO: 334157 - RNA, 23 nt, Human
uuucucaaaaaugccuuuucugg

SEQ ID NO: 334158 - RNA, 23 nt, Human
uuuuguaaggcagaggugggagu

SEQ ID NO: 334159 - RNA, 20 nt, Human
aaaacaccugccacugcuga

SEQ ID NO: 334160 - RNA, 23 nt, Human
aaacaccugccacugcugaaguc

SEQ ID NO: 334161 - RNA, 18 nt, Human
aagcagaagguucucucg

SEQ ID NO: 334162 - RNA, 18 nt, Human
aagcagaucaugaguaac

SEQ ID NO: 334163 - RNA, 19 nt, Human
aagcagaucaugaguaacc

SEQ ID NO: 334164 - RNA, 25 nt, Human
aagcauauccaugacgcuuacauac

SEQ ID NO: 334165 - RNA, 19 nt, Human
aagcuuccaggugugacaa

SEQ ID NO: 334166 - RNA, 21 nt, Human
aauacauugcaaugucuuccc

SEQ ID NO: 334167 - RNA, 18 nt, Human
aaugacacauuuucuguu

SEQ ID NO: 334168 - RNA, 22 nt, Human
aauucuauuaauuuucaaaaag

SEQ ID NO: 334169 - RNA, 22 nt, Human
aauucuauuaauuuucaaaaag

SEQ ID NO: 334170 - RNA, 18 nt, Human
acuguuaaagccaucaac

SEQ ID NO: 334171 - RNA, 24 nt, Human
agcaagaauagcuccacaucugcc

SEQ ID NO: 334172 - RNA, 21 nt, Human
aggaaacacacuuagcaagcc

SEQ ID NO: 334173 - RNA, 19 nt, Human
aggagaggguuguagucag

SEQ ID NO: 334174 - RNA, 21 nt, Human
aggcagaaccugacaaccuga

SEQ ID NO: 334175 - RNA, 21 nt, Human
aggcaggggugauugcacagu

SEQ ID NO: 334176 - RNA, 19 nt, Human
aggcuaaugagggcuguag

SEQ ID NO: 334177 - RNA, 18 nt, Human
augauauaagcacaucuu

SEQ ID NO: 334178 - RNA, 18 nt, Human
augauauaagcacaucuu

SEQ ID NO: 334179 - RNA, 19 nt, Human
augggucauggcgugguuu

SEQ ID NO: 334180 - RNA, 19 nt, Human
auucugucuauuuuccuuu

SEQ ID NO: 334181 - RNA, 23 nt, Human
caauaagaacagcaucaccuucc

SEQ ID NO: 334182 - RNA, 21 nt, Human
cacaaguugagcuacauuccu

SEQ ID NO: 334183 - RNA, 18 nt, Human
cacugcugaagucaucug

SEQ ID NO: 334184 - RNA, 20 nt, Human
cacugcugaagucaucugga

SEQ ID NO: 334185 - RNA, 24 nt, Human
cagaaccugacaaccugagaauuu

SEQ ID NO: 334186 - RNA, 18 nt, Human
cagauuucucuucuuguu

SEQ ID NO: 334187 - RNA, 22 nt, Human
caggguccagaugagcgaaaua

SEQ ID NO: 334188 - RNA, 22 nt, Human
caguaaauaucuugauccuuuc

SEQ ID NO: 334189 - RNA, 21 nt, Human
cauauccaugacgcuuacaua

SEQ ID NO: 334190 - RNA, 18 nt, Human
caucaacaaucugcugcc

SEQ ID NO: 334191 - RNA, 21 nt, Human
cauuucauaacugaucaacag

SEQ ID NO: 334192 - RNA, 23 nt, Human
cccacaaagaccuugcuuacuga

SEQ ID NO: 334193 - RNA, 22 nt, Human
ccugacacugcaggguccagau

SEQ ID NO: 334194 - RNA, 21 nt, Human
ccugacuccuuuucaguaaac

SEQ ID NO: 334195 - RNA, 24 nt, Human
cgacaacugccccacaaagaccuu

SEQ ID NO: 334196 - RNA, 22 nt, Human
cugccacugcugaagucaucug

SEQ ID NO: 334197 - RNA, 21 nt, Human
cuggcccugcaaagaaguccu

SEQ ID NO: 334198 - RNA, 19 nt, Human
cuguagugcuccuggucgg

SEQ ID NO: 334199 - RNA, 25 nt, Human
cuucuacugaaaacugaauauguuc

SEQ ID NO: 334200 - RNA, 24 nt, Human
gaaacaguucuuauugaauaccca

SEQ ID NO: 334201 - RNA, 19 nt, Human
gaccuugcuuacugaucug

SEQ ID NO: 334202 - RNA, 23 nt, Human
gagauagcaguacuuccuccucc

SEQ ID NO: 334203 - RNA, 21 nt, Human
gauuacacccaugacuucuau

SEQ ID NO: 334204 - RNA, 20 nt, Human
gcaaaagacaacauucucua

SEQ ID NO: 334205 - RNA, 25 nt, Human
gcaaugucuucccuaaacccauuuc

SEQ ID NO: 334206 - RNA, 25 nt, Human
gccuuuguauagacucuuuucuuca

SEQ ID NO: 334207 - RNA, 24 nt, Human
ggauaaccgcuaagagcuuggaca

SEQ ID NO: 334208 - RNA, 19 nt, Human
gguuauauucugaaaaaug

SEQ ID NO: 334209 - RNA, 21 nt, Human
uaaacccauuucaucagcaag

SEQ ID NO: 334210 - RNA, 20 nt, Human
uaaagcucaaucuguagugc

SEQ ID NO: 334211 - RNA, 20 nt, Human
uaacaaaaaaauaaaaaaag

SEQ ID NO: 334212 - RNA, 20 nt, Human
uaagaacagcaucaccuucc

SEQ ID NO: 334213 - RNA, 19 nt, Human
uaaguucuucuacugaaaa

SEQ ID NO: 334214 - RNA, 21 nt, Human
uauaaccaaugccucuuccaa

SEQ ID NO: 334215 - RNA, 23 nt, Human
uauagaguugaacaaaaggcagg

SEQ ID NO: 334216 - RNA, 21 nt, Human
uaucagauuucucuucuuguu

SEQ ID NO: 334217 - RNA, 19 nt, Human
ucagaagcagaagguucuc

SEQ ID NO: 334218 - RNA, 22 nt, Human
ucaguggcuggauuccaaucaa

SEQ ID NO: 334219 - RNA, 21 nt, Human
ucauagagaauuaagugagau

SEQ ID NO: 334220 - RNA, 23 nt, Human
ucccuaaacccauuucaucagca

SEQ ID NO: 334221 - RNA, 21 nt, Human
uccuggauuuacaaaaucaau

SEQ ID NO: 334222 - RNA, 23 nt, Human
ucgacaacugccccacaaagacc

SEQ ID NO: 334223 - RNA, 24 nt, Human
ucucucgauaaaaugauggguucu

SEQ ID NO: 334224 - RNA, 24 nt, Human
ucugaccaucucuccauacucuag

SEQ ID NO: 334225 - RNA, 19 nt, Human
ucuucuacugaaaacugaa

SEQ ID NO: 334226 - RNA, 28 nt, Human
ucuucuuucuccuaacuccuuuucuucc

SEQ ID NO: 334227 - RNA, 22 nt, Human
ucuuggguucuucuaaggauaa

SEQ ID NO: 334228 - RNA, 20 nt, Human
ucuuuucuucauuuuuauca

SEQ ID NO: 334229 - RNA, 21 nt, Human
ugaaaggguuagagaaacauu

SEQ ID NO: 334230 - RNA, 23 nt, Human
ugagguuaaguccuacaccacca

SEQ ID NO: 334231 - RNA, 20 nt, Human
ugcaaagaaguccuucuggu

SEQ ID NO: 334232 - RNA, 25 nt, Human
ugcuucagcugggacauagaaagag

SEQ ID NO: 334233 - RNA, 18 nt, Human
uggcacuguucuucaaac

SEQ ID NO: 334234 - RNA, 26 nt, Human
uguuauucuuucaagaaaaggaucug

SEQ ID NO: 334235 - RNA, 22 nt, Human
uguuuuuucuuugaaggcuuac

SEQ ID NO: 334236 - RNA, 19 nt, Human
uuaaacacuuaauauuuac

SEQ ID NO: 334237 - RNA, 19 nt, Human
uuaaacacuuaauauuuac

SEQ ID NO: 334238 - RNA, 19 nt, Human
uuauguuuuuucuuugaag

SEQ ID NO: 334239 - RNA, 21 nt, Human
uucauuuuuaucacaaguuga

SEQ ID NO: 334240 - RNA, 22 nt, Human
uuccuuugaacuugguuuacaa

SEQ ID NO: 334241 - RNA, 19 nt, Human
uucuaaggauaaagagucc

SEQ ID NO: 334242 - RNA, 23 nt, Human
uugaacuuaacaaaaaaauaaaa

SEQ ID NO: 334243 - RNA, 23 nt, Human
uuggacaacaccuguaguuuucc

SEQ ID NO: 334244 - RNA, 22 nt, Human
uuguagucagcaggaaacacac

SEQ ID NO: 334245 - RNA, 22 nt, Human
uuuacaauaagaacagcaucac

SEQ ID NO: 334246 - RNA, 18 nt, Human
uuuccugacuccuuuuca

SEQ ID NO: 334247 - RNA, 21 nt, Human
uuuuuuuuuuuuuuuuuacaa

SEQ ID NO: 334248 - RNA, 23 nt, Human
uuuuuuuuuuuuuuuuuacaaug

SEQ ID NO: 334249 - RNA, 22 nt, Human
aaaccaggaucagacucaggga

SEQ ID NO: 334250 - RNA, 27 nt, Human
aacugguguuuggaaccaaacugugag

SEQ ID NO: 334251 - RNA, 23 nt, Human
aacugugagaguggccgucccca

SEQ ID NO: 334252 - RNA, 18 nt, Human
aagagaccaagcagagau

SEQ ID NO: 334253 - RNA, 23 nt, Human
aagagaccaagcagagauuagug

SEQ ID NO: 334254 - RNA, 18 nt, Human
aauuaaagagggggcaug

SEQ ID NO: 334255 - RNA, 23 nt, Human
acagggcccuguggagcaaggag

SEQ ID NO: 334256 - RNA, 25 nt, Human
accccagcaccucucucucaaccuu

SEQ ID NO: 334257 - RNA, 19 nt, Human
agaggaagagaccaagcag

SEQ ID NO: 334258 - RNA, 22 nt, Human
aggccaaagaggaagagaccaa

SEQ ID NO: 334259 - RNA, 18 nt, Human
agggcuggagguggaaac

SEQ ID NO: 334260 - RNA, 23 nt, Human
caaggagccccuuuucccuaucu

SEQ ID NO: 334261 - RNA, 21 nt, Human
caaguacccaugagccaaagg

SEQ ID NO: 334262 - RNA, 19 nt, Human
cacccagaccagcugguua

SEQ ID NO: 334263 - RNA, 20 nt, Human
caccucucucucaaccuucc

SEQ ID NO: 334264 - RNA, 23 nt, Human
caggaggggcugaaaagagcgac

SEQ ID NO: 334265 - RNA, 23 nt, Human
caggaggggcugaaaagagcugg

SEQ ID NO: 334266 - RNA, 19 nt, Human
caggaucagacucagggag

SEQ ID NO: 334267 - RNA, 25 nt, Human
cagguuaggaggggaauaccaggag

SEQ ID NO: 334268 - RNA, 22 nt, Human
ccaggaggggcugaaaagagcg

SEQ ID NO: 334269 - RNA, 18 nt, Human
ccccaauaagccgagacg

SEQ ID NO: 334270 - RNA, 22 nt, Human
ccccagcaccucucucucaacc

SEQ ID NO: 334271 - RNA, 19 nt, Human
cccuguggagcaaggagcc

SEQ ID NO: 334272 - RNA, 24 nt, Human
cccuuuucccuaucuccuuccucu

SEQ ID NO: 334273 - RNA, 19 nt, Human
cgagacgagagauuaggcc

SEQ ID NO: 334274 - RNA, 19 nt, Human
cgcagaccccagcaccucu

SEQ ID NO: 334275 - RNA, 20 nt, Human
cgcggcggggcgggguggga

SEQ ID NO: 334276 - RNA, 23 nt, Human
cggggcggggugggauugggggu

SEQ ID NO: 334277 - RNA, 21 nt, Human
cugguguuuggaaccaaacug

SEQ ID NO: 334278 - RNA, 25 nt, Human
gcccggguggggagggcgagucugg

SEQ ID NO: 334279 - RNA, 24 nt, Human
ggaggggaauaccaggaggggcug

SEQ ID NO: 334280 - RNA, 23 nt, Human
ggcccggguggggagggcgaguc

SEQ ID NO: 334281 - RNA, 20 nt, Human
ggcuggagguggaaaccagg

SEQ ID NO: 334282 - RNA, 19 nt, Human
gggaauaccaggaggggcc

SEQ ID NO: 334283 - RNA, 24 nt, Human
gggaggaggcagguggagucccag

SEQ ID NO: 334284 - RNA, 20 nt, Human
gggcggggugggauuggggg

SEQ ID NO: 334285 - RNA, 19 nt, Human
gggcugaaaagagcgacag

SEQ ID NO: 334286 - RNA, 20 nt, Human
ggggagggcgagucuggaga

SEQ ID NO: 334287 - RNA, 22 nt, Human
gggugggauuggggguggguaa

SEQ ID NO: 334288 - RNA, 22 nt, Human
gguaaucacuggccaggagaga

SEQ ID NO: 334289 - RNA, 21 nt, Human
ggugaaaguccgaggcccggg

SEQ ID NO: 334290 - RNA, 19 nt, Human
guggagcaaggagccccuu

SEQ ID NO: 334291 - RNA, 22 nt, Human
uaaaaaacccagguuaggaggg

SEQ ID NO: 334292 - RNA, 18 nt, Human
uaaagagggggcauggau

SEQ ID NO: 334293 - RNA, 21 nt, Human
uaagagcuacacccagaccag

SEQ ID NO: 334294 - RNA, 22 nt, Human
uaagccgagacgagagauuagg

SEQ ID NO: 334295 - RNA, 24 nt, Human
uaagccgagacgagagauuaggcc

SEQ ID NO: 334296 - RNA, 26 nt, Human
uaagccgagacgagagauuaggccaa

SEQ ID NO: 334297 - RNA, 23 nt, Human
uaguugcgcggcggggcggggug

SEQ ID NO: 334298 - RNA, 22 nt, Human
uaucuccuuccucuaagagcua

SEQ ID NO: 334299 - RNA, 30 nt, Human
ucaugcagcccuucuugaugauuuucuccu

SEQ ID NO: 334300 - RNA, 21 nt, Human
uccccaauaagccgagacgag

SEQ ID NO: 334301 - RNA, 21 nt, Human
ucucaaccuuccuguucccaa

SEQ ID NO: 334302 - RNA, 21 nt, Human
ucuggagaaaggaaauuuccc

SEQ ID NO: 334303 - RNA, 19 nt, Human
ugaaaagagcgacagagau

SEQ ID NO: 334304 - RNA, 19 nt, Human
ugaaaguccgaggcccggg

SEQ ID NO: 334305 - RNA, 19 nt, Human
ugauuuucucccagagaac

SEQ ID NO: 334306 - RNA, 18 nt, Human
uggagguggaaaccagga

SEQ ID NO: 334307 - RNA, 21 nt, Human
uggccaggagagagaagcugg

SEQ ID NO: 334308 - RNA, 22 nt, Human
ugggauuggggaggaggcaggu

SEQ ID NO: 334309 - RNA, 24 nt, Human
uggggaggaggcagguggaguccc

SEQ ID NO: 334310 - RNA, 24 nt, Human
uguggagcaaggagccccuuuucc

SEQ ID NO: 334311 - RNA, 18 nt, Human
uugcgcggcggggcgggg

SEQ ID NO: 334312 - RNA, 22 nt, Human
aaacagcucagcuccagcaagc

SEQ ID NO: 334313 - RNA, 23 nt, Human
aaacagcucagcuccagcaagcc

SEQ ID NO: 334314 - RNA, 18 nt, Human
agcagcaccuacuaugac

SEQ ID NO: 334315 - RNA, 22 nt, Human
agcccaccuuucugauccccag

SEQ ID NO: 334316 - RNA, 23 nt, Human
cagcaagcccaccuuucugaucc

SEQ ID NO: 334317 - RNA, 22 nt, Human
cagcagcaccuacuaugacauu

SEQ ID NO: 334318 - RNA, 21 nt, Human
cagccagggcaacccuagcca

SEQ ID NO: 334319 - RNA, 23 nt, Human
cagcgccaaagaguaucaggaaa

SEQ ID NO: 334320 - RNA, 18 nt, Human
cagcgcuccgccagcggc

SEQ ID NO: 334321 - RNA, 19 nt, Human
cagugaaacagcucagcuc

SEQ ID NO: 334322 - RNA, 20 nt, Human
ccagccuuggccagcuggag

SEQ ID NO: 334323 - RNA, 21 nt, Human
ccagcggccaacacugcccag

SEQ ID NO: 334324 - RNA, 18 nt, Human
cccaccuuucugaucccc

SEQ ID NO: 334325 - RNA, 22 nt, Human
ccccagccagggcaacccuagc

SEQ ID NO: 334326 - RNA, 27 nt, Human
ccccagccagggcaacccuagccacac

SEQ ID NO: 334327 - RNA, 18 nt, Human
ccccagggcugagagacc

SEQ ID NO: 334328 - RNA, 23 nt, Human
ccgcgcaccgccccugccggccc

SEQ ID NO: 334329 - RNA, 27 nt, Human
ccgggccccagccagggcaacccuagc

SEQ ID NO: 334330 - RNA, 20 nt, Human
cgaggcugcagcucagggca

SEQ ID NO: 334331 - RNA, 18 nt, Human
cggcaccgggccccagcc

SEQ ID NO: 334332 - RNA, 25 nt, Human
cggccaacacugcccagcucuccgc

SEQ ID NO: 334333 - RNA, 20 nt, Human
cucggcaccgggccccagcc

SEQ ID NO: 334334 - RNA, 20 nt, Human
cucggcaccgggccccagcc

SEQ ID NO: 334335 - RNA, 21 nt, Human
cugcaccugcggugacugucg

SEQ ID NO: 334336 - RNA, 25 nt, Human
cuuggccucagggcuggcagccgga

SEQ ID NO: 334337 - RNA, 21 nt, Human
gaccuccggguccgggguccc

SEQ ID NO: 334338 - RNA, 19 nt, Human
gagacccaguucugccacu

SEQ ID NO: 334339 - RNA, 20 nt, Human
gagggagacagguuuccagc

SEQ ID NO: 334340 - RNA, 20 nt, Human
ggggccugcgagaggcagug

SEQ ID NO: 334341 - RNA, 19 nt, Human
gucuccagccgugcuuggc

SEQ ID NO: 334342 - RNA, 20 nt, Human
uacuaugacauuuuccuuag

SEQ ID NO: 334343 - RNA, 21 nt, Human
uagaauuccaagucagcgcca

SEQ ID NO: 334344 - RNA, 21 nt, Human
ucaaagcuggauucucgccau

SEQ ID NO: 334345 - RNA, 21 nt, Human
ucccgcgcaccgccccugccg

SEQ ID NO: 334346 - RNA, 22 nt, Human
ucccgcgcaccgccccugccgg

SEQ ID NO: 334347 - RNA, 23 nt, Human
ucuaagacacugccuggcagcuc

SEQ ID NO: 334348 - RNA, 19 nt, Human
ucuccagccgugcuuggcc

SEQ ID NO: 334349 - RNA, 24 nt, Human
ucugccacuggcuggggccggggc

SEQ ID NO: 334350 - RNA, 19 nt, Human
ugaaacagcucagcuccag

SEQ ID NO: 334351 - RNA, 23 nt, Human
ugagggagacagguuuccagccu

SEQ ID NO: 334352 - RNA, 20 nt, Human
ugccccagcgcuccgccagc

SEQ ID NO: 334353 - RNA, 22 nt, Human
uggcagagaagcuggaucacca

SEQ ID NO: 334354 - RNA, 21 nt, Human
uggcagccggauccuggggca

SEQ ID NO: 334355 - RNA, 23 nt, Human
uggccucagggcuggcagccgga

SEQ ID NO: 334356 - RNA, 25 nt, Human
uggcuggggguuguggggggagcac

SEQ ID NO: 334357 - RNA, 23 nt, Human
ugggagucucggcaccgggcccc

SEQ ID NO: 334358 - RNA, 22 nt, Human
uggggcaacccaucuggucucc

SEQ ID NO: 334359 - RNA, 21 nt, Human
uggguacaggcuucagguucu

SEQ ID NO: 334360 - RNA, 24 nt, Human
uuccaagucagcgccaaagaguau

SEQ ID NO: 334361 - RNA, 19 nt, Human
uugggagucucggcaccgg

SEQ ID NO: 334362 - RNA, 27 nt, Human
uuuguauuuuucuuuucuuuuuuuaau

SEQ ID NO: 334363 - RNA, 24 nt, Human
aaaccaucccaaugcacuggacac

SEQ ID NO: 334364 - RNA, 18 nt, Human
acaugaaguuaaggcccu

SEQ ID NO: 334365 - RNA, 22 nt, Human
accuuagaagcugugaaaggag

SEQ ID NO: 334366 - RNA, 23 nt, Human
agcauggggaauguggggaggga

SEQ ID NO: 334367 - RNA, 20 nt, Human
agcuggggcugggccccugc

SEQ ID NO: 334368 - RNA, 20 nt, Human
caacagcuggggcugggccc

SEQ ID NO: 334369 - RNA, 23 nt, Human
caacagcuggggcugggccccug

SEQ ID NO: 334370 - RNA, 22 nt, Human
caccagcacugcaaauggcuuc

SEQ ID NO: 334371 - RNA, 21 nt, Human
cacucucugaagaaagucccg

SEQ ID NO: 334372 - RNA, 18 nt, Human
ccaacagcuggggcuggg

SEQ ID NO: 334373 - RNA, 23 nt, Human
cccaaagggauagaaaagaaggc

SEQ ID NO: 334374 - RNA, 20 nt, Human
ccccuaagaaaaguuccaua

SEQ ID NO: 334375 - RNA, 22 nt, Human
ccccuggcagccugaagacagg

SEQ ID NO: 334376 - RNA, 21 nt, Human
ccucuggagaaagggagcaga

SEQ ID NO: 334377 - RNA, 18 nt, Human
ccuggaagacaaaauuca

SEQ ID NO: 334378 - RNA, 20 nt, Human
cgcccgcuccuccuccccgc

SEQ ID NO: 334379 - RNA, 19 nt, Human
cuccuccccgcggcgggug

SEQ ID NO: 334380 - RNA, 20 nt, Human
cucgcccgcuccuccucccc

SEQ ID NO: 334381 - RNA, 18 nt, Human
cugcaaauggcuuccuuc

SEQ ID NO: 334382 - RNA, 18 nt, Human
cuggggcugggccccugc

SEQ ID NO: 334383 - RNA, 20 nt, Human
gaaaacauguguucugccuc

SEQ ID NO: 334384 - RNA, 24 nt, Human
gagcauggggaauguggggaggga

SEQ ID NO: 334385 - RNA, 20 nt, Human
gcagcuucucgcccgcuccu

SEQ ID NO: 334386 - RNA, 19 nt, Human
gcccugcggccccgcccca

SEQ ID NO: 334387 - RNA, 19 nt, Human
gcuggggcugggccccugc

SEQ ID NO: 334388 - RNA, 21 nt, Human
ggaauguggggagggagcagg

SEQ ID NO: 334389 - RNA, 20 nt, Human
gggagcagaaaaguggugcc

SEQ ID NO: 334390 - RNA, 21 nt, Human
uaaaacccaaaucaucaagaa

SEQ ID NO: 334391 - RNA, 24 nt, Human
uaaaacccaaaucaucaagaaaac

SEQ ID NO: 334392 - RNA, 22 nt, Human
uaaaauaacauaauugagggac

SEQ ID NO: 334393 - RNA, 20 nt, Human
uaaacaauucuuaaaccuga

SEQ ID NO: 334394 - RNA, 24 nt, Human
uagaagguccuuagcagcagcuuc

SEQ ID NO: 334395 - RNA, 24 nt, Human
uagagaaacaaggcuggcccugcg

SEQ ID NO: 334396 - RNA, 21 nt, Human
ucccugagagggcugagaugc

SEQ ID NO: 334397 - RNA, 20 nt, Human
uccugggcuguuuggugccu

SEQ ID NO: 334398 - RNA, 22 nt, Human
ucgcccgcuccuccuccccgcg

SEQ ID NO: 334399 - RNA, 25 nt, Human
ucuccacaucagggcuggacugccu

SEQ ID NO: 334400 - RNA, 20 nt, Human
ugaaaggaggacgugucccc

SEQ ID NO: 334401 - RNA, 20 nt, Human
ugacaugcauuccuccagaa

SEQ ID NO: 334402 - RNA, 21 nt, Human
ugacuagagaaacaaggcugu

SEQ ID NO: 334403 - RNA, 23 nt, Human
ugagggagccaggccgccccaac

SEQ ID NO: 334404 - RNA, 20 nt, Human
ugagggagcgggaggcgguc

SEQ ID NO: 334405 - RNA, 23 nt, Human
ugagggagcgggaggcggucaca

SEQ ID NO: 334406 - RNA, 21 nt, Human
ugcacuggacaccuuagaagc

SEQ ID NO: 334407 - RNA, 18 nt, Human
uggaagacaaaauucagc

SEQ ID NO: 334408 - RNA, 19 nt, Human
uguuuguuuguuuguuaga

SEQ ID NO: 334409 - RNA, 21 nt, Human
uuaaggcccugugagcagucu

SEQ ID NO: 334410 - RNA, 24 nt, Human
uuccuccagaagcugauuuccaaa

SEQ ID NO: 334411 - RNA, 19 nt, Human
uugagcauggggaaugugg

SEQ ID NO: 334412 - RNA, 18 nt, Human
uuggccgagugccuugcc

SEQ ID NO: 334413 - RNA, 25 nt, Human
uuuguuagagaaacaaggcuggccc

SEQ ID NO: 334414 - RNA, 23 nt, Human
aaaaaaugaaaaccacaagacca

SEQ ID NO: 334415 - RNA, 24 nt, Human
aaaaauccaugacagcagaugacc

SEQ ID NO: 334416 - RNA, 23 nt, Human
aaaagagccagagcacacaaaug

SEQ ID NO: 334417 - RNA, 21 nt, Human
aaaauggcggacaauaaccau

SEQ ID NO: 334418 - RNA, 19 nt, Human
aaagccgcuuaccccugcc

SEQ ID NO: 334419 - RNA, 24 nt, Human
aaccacaagaccaauuucuggccu

SEQ ID NO: 334420 - RNA, 23 nt, Human
aagaggguuagggggcccuuugg

SEQ ID NO: 334421 - RNA, 22 nt, Human
aaucaaaaaccaccugcaucca

SEQ ID NO: 334422 - RNA, 21 nt, Human
aauccuaaaaaaauucugaua

SEQ ID NO: 334423 - RNA, 20 nt, Human
aaucugaggcaaaacuaaau

SEQ ID NO: 334424 - RNA, 22 nt, Human
acaaucacugaagacacacaca

SEQ ID NO: 334425 - RNA, 19 nt, Human
acucaauaccaaagagaag

SEQ ID NO: 334426 - RNA, 19 nt, Human
acuggucccugcaaugcac

SEQ ID NO: 334427 - RNA, 22 nt, Human
acuucacacauacacacacaaa

SEQ ID NO: 334428 - RNA, 23 nt, Human
agaaauggguaaaaaaucuauaa

SEQ ID NO: 334429 - RNA, 19 nt, Human
agacccacacucucaacca

SEQ ID NO: 334430 - RNA, 19 nt, Human
agauaacugauuuuuccug

SEQ ID NO: 334431 - RNA, 22 nt, Human
aggaagaaaaacuaauuaacac

SEQ ID NO: 334432 - RNA, 18 nt, Human
agggugcuaggagaagcc

SEQ ID NO: 334433 - RNA, 21 nt, Human
aguaaaaauaaagaaucauac

SEQ ID NO: 334434 - RNA, 21 nt, Human
aguaaagggugcuaggagaag

SEQ ID NO: 334435 - RNA, 23 nt, Human
aguaagggcaaaaaaccauaggc

SEQ ID NO: 334436 - RNA, 23 nt, Human
aguauuuauuaccccuaaaugac

SEQ ID NO: 334437 - RNA, 19 nt, Human
agugcaauucuacaaaaca

SEQ ID NO: 334438 - RNA, 19 nt, Human
agugugaaaacauuccaca

SEQ ID NO: 334439 - RNA, 21 nt, Human
auaguuccuacaguguuagaa

SEQ ID NO: 334440 - RNA, 19 nt, Human
aucaaaaugugaucugauu

SEQ ID NO: 334441 - RNA, 19 nt, Human
aucagcucaucaguuucua

SEQ ID NO: 334442 - RNA, 19 nt, Human
augcaacccagagggaaac

SEQ ID NO: 334443 - RNA, 20 nt, Human
augcagaagcucuaaauuug

SEQ ID NO: 334444 - RNA, 20 nt, Human
auuaagcaggaugaagggaa

SEQ ID NO: 334445 - RNA, 23 nt, Human
auugagagcacuuuguaaagguc

SEQ ID NO: 334446 - RNA, 19 nt, Human
auuggaaagguugugcuau

SEQ ID NO: 334447 - RNA, 25 nt, Human
auuuacaugacagcuccccaacaca

SEQ ID NO: 334448 - RNA, 19 nt, Human
caaaacaaaaaauaaucac

SEQ ID NO: 334449 - RNA, 23 nt, Human
caaaacaaaaaauaaucaccaaa

SEQ ID NO: 334450 - RNA, 19 nt, Human
caaaagagccagagcacac

SEQ ID NO: 334451 - RNA, 21 nt, Human
caaaucccagauuccuaagga

SEQ ID NO: 334452 - RNA, 23 nt, Human
caacaaaauggcggacaauaacc

SEQ ID NO: 334453 - RNA, 20 nt, Human
caacccagagggaaacucaa

SEQ ID NO: 334454 - RNA, 19 nt, Human
caagccaaguauuuauuac

SEQ ID NO: 334455 - RNA, 18 nt, Human
caaggaaaacugcugugu

SEQ ID NO: 334456 - RNA, 19 nt, Human
caaggaaaacugcuguguu

SEQ ID NO: 334457 - RNA, 19 nt, Human
caauugcaaaaaccaacuc

SEQ ID NO: 334458 - RNA, 25 nt, Human
cacauauuugcaaucaaaaaccacc

SEQ ID NO: 334459 - RNA, 19 nt, Human
cacuggucccugcaaugca

SEQ ID NO: 334460 - RNA, 21 nt, Human
cagcaacuggcaaaucccaga

SEQ ID NO: 334461 - RNA, 24 nt, Human
caguaaauaggaugauuaugugaa

SEQ ID NO: 334462 - RNA, 21 nt, Human
caucucugguccccugcaguu

SEQ ID NO: 334463 - RNA, 20 nt, Human
cauugcacuucugaaguccc

SEQ ID NO: 334464 - RNA, 18 nt, Human
ccaaauaacuggagccac

SEQ ID NO: 334465 - RNA, 18 nt, Human
ccagauguucccaggguu

SEQ ID NO: 334466 - RNA, 24 nt, Human
ccuaaacucugaagguuacaauag

SEQ ID NO: 334467 - RNA, 19 nt, Human
ccugcaaugcaccugagug

SEQ ID NO: 334468 - RNA, 20 nt, Human
cucuacauugccagcaacug

SEQ ID NO: 334469 - RNA, 21 nt, Human
cugauacuaccuuauaaacau

SEQ ID NO: 334470 - RNA, 18 nt, Human
cugcauauaaaaagcaag

SEQ ID NO: 334471 - RNA, 22 nt, Human
cuguagcaucuuacuccaaccu

SEQ ID NO: 334472 - RNA, 21 nt, Human
gagaagcccucaaugcaaccc

SEQ ID NO: 334473 - RNA, 22 nt, Human
gagcaaaucauuaaacccccau

SEQ ID NO: 334474 - RNA, 22 nt, Human
gcacuucugaagucccagauau

SEQ ID NO: 334475 - RNA, 20 nt, Human
gggauuauuggaaagguugu

SEQ ID NO: 334476 - RNA, 22 nt, Human
guaaaugcauugagagcacuuu

SEQ ID NO: 334477 - RNA, 18 nt, Human
uaaaaagcaaggaaaacu

SEQ ID NO: 334478 - RNA, 21 nt, Human
uaaaaagcaaggaaaacugcu

SEQ ID NO: 334479 - RNA, 26 nt, Human
uaaaauaagaaaauguaaaaugggua

SEQ ID NO: 334480 - RNA, 22 nt, Human
uaaauccauugcauccugguac

SEQ ID NO: 334481 - RNA, 19 nt, Human
uaagcaggaugaagggaaa

SEQ ID NO: 334482 - RNA, 23 nt, Human
uaaguaaacauauauuaucagaa

SEQ ID NO: 334483 - RNA, 19 nt, Human
uaaugcaagacccacacuc

SEQ ID NO: 334484 - RNA, 18 nt, Human
uacaagccucuguggcuu

SEQ ID NO: 334485 - RNA, 19 nt, Human
uacacaauucugaauccac

SEQ ID NO: 334486 - RNA, 22 nt, Human
uacagugccaccaauagagaaa

SEQ ID NO: 334487 - RNA, 19 nt, Human
uaccaaagagaaggcaaag

SEQ ID NO: 334488 - RNA, 22 nt, Human
ucaaaagagccagagcacacaa

SEQ ID NO: 334489 - RNA, 23 nt, Human
ucaaaagagccagagcacacaaa

SEQ ID NO: 334490 - RNA, 24 nt, Human
ucaaaagagccagagcacacaaau

SEQ ID NO: 334491 - RNA, 20 nt, Human
ucaaaggaagaaaaacuaau

SEQ ID NO: 334492 - RNA, 19 nt, Human
ucacugaagacacacacau

SEQ ID NO: 334493 - RNA, 23 nt, Human
ucacuggucccugcaaugcaccu

SEQ ID NO: 334494 - RNA, 18 nt, Human
uccacagugguaaaaagc

SEQ ID NO: 334495 - RNA, 26 nt, Human
uccaugacagcagaugaccuccuaaa

SEQ ID NO: 334496 - RNA, 20 nt, Human
ucccaggguuuaucaaaaug

SEQ ID NO: 334497 - RNA, 22 nt, Human
ucuaaacuuagcggauggaaaa

SEQ ID NO: 334498 - RNA, 23 nt, Human
ucucugaaauacaaaaaaaaaaa

SEQ ID NO: 334499 - RNA, 22 nt, Human
ucuguaucuugugggaaaaaaa

SEQ ID NO: 334500 - RNA, 24 nt, Human
ucuuuaucuucuucuguaucuugu

SEQ ID NO: 334501 - RNA, 18 nt, Human
ucuuugauauacugugua

SEQ ID NO: 334502 - RNA, 23 nt, Human
ugaaaacauuugacauggaaaua

SEQ ID NO: 334503 - RNA, 27 nt, Human
ugaaaaccacaagaccaauuucuggcc

SEQ ID NO: 334504 - RNA, 18 nt, Human
ugaaagauacugaguuca

SEQ ID NO: 334505 - RNA, 21 nt, Human
ugaaaugaaaaaguaaaaaua

SEQ ID NO: 334506 - RNA, 23 nt, Human
ugaagaauuauucaaaaaugaaa

SEQ ID NO: 334507 - RNA, 24 nt, Human
ugaagugcaauucuacaaaacaaa

SEQ ID NO: 334508 - RNA, 23 nt, Human
ugaauccuaaaaaaauucugaua

SEQ ID NO: 334509 - RNA, 22 nt, Human
ugagcaaaucauuaaaccccca

SEQ ID NO: 334510 - RNA, 18 nt, Human
ugagugugaaaacauucc

SEQ ID NO: 334511 - RNA, 24 nt, Human
ugaucauuauagaaagaauaacac

SEQ ID NO: 334512 - RNA, 21 nt, Human
ugauuuacaugacagcucccc

SEQ ID NO: 334513 - RNA, 19 nt, Human
ugcaauaggcauugcuaaa

SEQ ID NO: 334514 - RNA, 20 nt, Human
ugcagccagauguucccagg

SEQ ID NO: 334515 - RNA, 19 nt, Human
ugcagucucaacaguaagg

SEQ ID NO: 334516 - RNA, 21 nt, Human
ugccagcaacuggcaaauccc

SEQ ID NO: 334517 - RNA, 20 nt, Human
ugcuguacaaauguaagaua

SEQ ID NO: 334518 - RNA, 22 nt, Human
uggaaagaagaagggcuuugga

SEQ ID NO: 334519 - RNA, 21 nt, Human
uggaagaaaaagacaucuuuu

SEQ ID NO: 334520 - RNA, 22 nt, Human
uggagcuuuuguguugcuuucu

SEQ ID NO: 334521 - RNA, 25 nt, Human
uggcaaaauguuucaguaagacaug

SEQ ID NO: 334522 - RNA, 23 nt, Human
uggcugagguaccuugcucagca

SEQ ID NO: 334523 - RNA, 20 nt, Human
ugguugauauuacucaauac

SEQ ID NO: 334524 - RNA, 20 nt, Human
uguaaaggucaucaugcugu

SEQ ID NO: 334525 - RNA, 22 nt, Human
ugucauacaaucacugaagaca

SEQ ID NO: 334526 - RNA, 21 nt, Human
uguggaauuugaacucuguuu

SEQ ID NO: 334527 - RNA, 18 nt, Human
ugugguggaaagaagaag

SEQ ID NO: 334528 - RNA, 19 nt, Human
ugugguggaaagaagaagg

SEQ ID NO: 334529 - RNA, 22 nt, Human
ugugguggaaagaagaagggcu

SEQ ID NO: 334530 - RNA, 23 nt, Human
uuaagcaggaugaagggaaagug

SEQ ID NO: 334531 - RNA, 20 nt, Human
uuaguggcccacucauuucc

SEQ ID NO: 334532 - RNA, 18 nt, Human
uuaucuucuucuguaucu

SEQ ID NO: 334533 - RNA, 19 nt, Human
uucaccuggaagaaaaaga

SEQ ID NO: 334534 - RNA, 20 nt, Human
uuccaaauaacuggagccac

SEQ ID NO: 334535 - RNA, 23 nt, Human
uugauguaaugcaagacccacac

SEQ ID NO: 334536 - RNA, 22 nt, Human
uugcaaucaaaaaccaccugca

SEQ ID NO: 334537 - RNA, 21 nt, Human
uugcuucucagugcauguuua

SEQ ID NO: 334538 - RNA, 26 nt, Human
uuuucaucagccauuaucacuggucc

SEQ ID NO: 334539 - RNA, 27 nt, Human
aaacaaaaauguauuuuuaaaaucaau

SEQ ID NO: 334540 - RNA, 23 nt, Human
aaaucagaucagaaauccucagu

SEQ ID NO: 334541 - RNA, 23 nt, Human
acugccgaauuguuauguugcac

SEQ ID NO: 334542 - RNA, 18 nt, Human
agaaggcugacuguaaag

SEQ ID NO: 334543 - RNA, 22 nt, Human
agaaggcugacuguaaagagag

SEQ ID NO: 334544 - RNA, 18 nt, Human
ccauacaccugaaucuga

SEQ ID NO: 334545 - RNA, 20 nt, Human
cugaugguacguagauuuuu

SEQ ID NO: 334546 - RNA, 22 nt, Human
cuguggcaagcagaaggcugac

SEQ ID NO: 334547 - RNA, 21 nt, Human
cuuuauagguuauuuguuacc

SEQ ID NO: 334548 - RNA, 19 nt, Human
gaaucugaaaggcuuuugc

SEQ ID NO: 334549 - RNA, 23 nt, Human
uaggcauuuuaaauaaacaaaaa

SEQ ID NO: 334550 - RNA, 23 nt, Human
uaguagaucuugcuuuuaaguuu

SEQ ID NO: 334551 - RNA, 23 nt, Human
uauaauaaauauaaacauaccuc

SEQ ID NO: 334552 - RNA, 20 nt, Human
uauagguuauuuguuaccaa

SEQ ID NO: 334553 - RNA, 25 nt, Human
ucaaaaauuccauacaccugaaucu

SEQ ID NO: 334554 - RNA, 26 nt, Human
ugaauaaaaaaucagaucagaaaucc

SEQ ID NO: 334555 - RNA, 24 nt, Human
uggccaacugccgaauuguuaugu

SEQ ID NO: 334556 - RNA, 19 nt, Human
uguauacauauauuuauau

SEQ ID NO: 334557 - RNA, 24 nt, Human
uucuuuauuggcuaaauuugucau

SEQ ID NO: 334558 - RNA, 22 nt, Human
aaagaaggaagcaggaagguug

SEQ ID NO: 334559 - RNA, 19 nt, Human
aaugaaagaaaacccuaga

SEQ ID NO: 334560 - RNA, 21 nt, Human
acaaguauauuagcccagaac

SEQ ID NO: 334561 - RNA, 19 nt, Human
acgcagaacccaccuucca

SEQ ID NO: 334562 - RNA, 18 nt, Human
agcagaucacccaggccu

SEQ ID NO: 334563 - RNA, 24 nt, Human
aggcagcugcgcgggccgcgggug

SEQ ID NO: 334564 - RNA, 20 nt, Human
caacacaucacagaaaugcc

SEQ ID NO: 334565 - RNA, 19 nt, Human
caccuuccaaccacgccca

SEQ ID NO: 334566 - RNA, 20 nt, Human
cacgacugaccagcagcgcu

SEQ ID NO: 334567 - RNA, 21 nt, Human
cacgcccaacacaucacagaa

SEQ ID NO: 334568 - RNA, 21 nt, Human
cagaucacccaggccuggccc

SEQ ID NO: 334569 - RNA, 18 nt, Human
cagcagcagaucacccag

SEQ ID NO: 334570 - RNA, 24 nt, Human
ccacgcccaacacaucacagaaau

SEQ ID NO: 334571 - RNA, 19 nt, Human
ccacgcccaacacaucacg

SEQ ID NO: 334572 - RNA, 20 nt, Human
ccaugagcugucgccugcgc

SEQ ID NO: 334573 - RNA, 23 nt, Human
ccauguugugucccugucacccu

SEQ ID NO: 334574 - RNA, 21 nt, Human
cccagaacauccuaggcagcu

SEQ ID NO: 334575 - RNA, 19 nt, Human
cccagagccccggccagcg

SEQ ID NO: 334576 - RNA, 23 nt, Human
cccccugcuuuccacuucccuga

SEQ ID NO: 334577 - RNA, 21 nt, Human
cccugaggcggggucccgcac

SEQ ID NO: 334578 - RNA, 19 nt, Human
cccugcuuuccacuucccu

SEQ ID NO: 334579 - RNA, 26 nt, Human
ccugccccaaauucuuaacgaaaaug

SEQ ID NO: 334580 - RNA, 18 nt, Human
cgagacgacggugcugcu

SEQ ID NO: 334581 - RNA, 20 nt, Human
cggcagggcgcagggcagca

SEQ ID NO: 334582 - RNA, 21 nt, Human
cguuagagaucccgccgccau

SEQ ID NO: 334583 - RNA, 19 nt, Human
cuggacggaaaagaaggaa

SEQ ID NO: 334584 - RNA, 22 nt, Human
gacacgcagaacccaccuucca

SEQ ID NO: 334585 - RNA, 22 nt, Human
gcagcgcugggaagggacacgc

SEQ ID NO: 334586 - RNA, 20 nt, Human
gcaggaagguugucccccug

SEQ ID NO: 334587 - RNA, 25 nt, Human
gcccaacacaucacagaaaugccug

SEQ ID NO: 334588 - RNA, 21 nt, Human
gccuccgaagucgagacgacg

SEQ ID NO: 334589 - RNA, 23 nt, Human
ggaaaagaaggaagcaggaaggu

SEQ ID NO: 334590 - RNA, 21 nt, Human
ggcagcacccagagccccggc

SEQ ID NO: 334591 - RNA, 19 nt, Human
gggcagcacccagagcccc

SEQ ID NO: 334592 - RNA, 21 nt, Human
uagaaugcggugguuuuacaa

SEQ ID NO: 334593 - RNA, 23 nt, Human
uauucuuuaauaaaagucagggg

SEQ ID NO: 334594 - RNA, 20 nt, Human
uccccagcccuccguggcgu

SEQ ID NO: 334595 - RNA, 25 nt, Human
ugaaagaaaacccuagaaugcggug

SEQ ID NO: 334596 - RNA, 22 nt, Human
ugacaaccccuugccgacacug

SEQ ID NO: 334597 - RNA, 19 nt, Human
ugacaaccccuugccgacu

SEQ ID NO: 334598 - RNA, 18 nt, Human
ugagcugucgccugcgca

SEQ ID NO: 334599 - RNA, 22 nt, Human
ugccccaaauucuuaacgaaaa

SEQ ID NO: 334600 - RNA, 22 nt, Human
uggaugcggaagccggugacaa

SEQ ID NO: 334601 - RNA, 24 nt, Human
uuuuuuuuuuuuuuuuuuuuaacg

SEQ ID NO: 334602 - RNA, 24 nt, Human
aaaaaaagaacuuuuaaggacaac

SEQ ID NO: 334603 - RNA, 20 nt, Human
aaacaucuuuaugagccaau

SEQ ID NO: 334604 - RNA, 21 nt, Human
aaaggcuacaccucgucaggc

SEQ ID NO: 334605 - RNA, 24 nt, Human
aaaguugagguuaagaacuaugag

SEQ ID NO: 334606 - RNA, 19 nt, Human
aacaauggcagcggcugcc

SEQ ID NO: 334607 - RNA, 22 nt, Human
aacauaucauccagcacagcca

SEQ ID NO: 334608 - RNA, 26 nt, Human
aagccaaaggcaaaaagaggggaccc

SEQ ID NO: 334609 - RNA, 22 nt, Human
aaggagcauucacugcaggagg

SEQ ID NO: 334610 - RNA, 22 nt, Human
aaggguuuuaagcagauacuuc

SEQ ID NO: 334611 - RNA, 23 nt, Human
acagagaaaaaaauacuucuaca

SEQ ID NO: 334612 - RNA, 23 nt, Human
acagccaagcacccacugaggcc

SEQ ID NO: 334613 - RNA, 22 nt, Human
accuuuugcuauagcugaaaac

SEQ ID NO: 334614 - RNA, 20 nt, Human
agacagaugacaaggggcag

SEQ ID NO: 334615 - RNA, 24 nt, Human
agcaggaggcaaguuugcauagaa

SEQ ID NO: 334616 - RNA, 21 nt, Human
agcauuucugugcgggggcag

SEQ ID NO: 334617 - RNA, 25 nt, Human
agccaaaggcaaaaagagcucuccu

SEQ ID NO: 334618 - RNA, 23 nt, Human
agccagucagggauggaggaggg

SEQ ID NO: 334619 - RNA, 18 nt, Human
agguccuuucacauuucu

SEQ ID NO: 334620 - RNA, 22 nt, Human
augggcccugucagagcaggcc

SEQ ID NO: 334621 - RNA, 19 nt, Human
augggcgcugguagaguca

SEQ ID NO: 334622 - RNA, 24 nt, Human
caaaauacuaaaaacuacagcaua

SEQ ID NO: 334623 - RNA, 24 nt, Human
cacagccaagcacccacugaggcc

SEQ ID NO: 334624 - RNA, 19 nt, Human
cacagugcauaccacgaau

SEQ ID NO: 334625 - RNA, 26 nt, Human
cagccaagcacccacugaggccaagc

SEQ ID NO: 334626 - RNA, 21 nt, Human
caugggcccugucagagcagg

SEQ ID NO: 334627 - RNA, 19 nt, Human
ccaagcagccuugugggac

SEQ ID NO: 334628 - RNA, 24 nt, Human
ccacucagccagucagggauggag

SEQ ID NO: 334629 - RNA, 21 nt, Human
cccccugccagcaucaggacc

SEQ ID NO: 334630 - RNA, 20 nt, Human
ccccggacccagcuggcugc

SEQ ID NO: 334631 - RNA, 26 nt, Human
ccucugggcauggcugaucccagcuc

SEQ ID NO: 334632 - RNA, 22 nt, Human
cgcuaggccacagugcauacca

SEQ ID NO: 334633 - RNA, 20 nt, Human
cuccaccccgcccgccgcuu

SEQ ID NO: 334634 - RNA, 25 nt, Human
cuccccggacccagcuggcugcucc

SEQ ID NO: 334635 - RNA, 23 nt, Human
gagaaaaaaauacuucuacaaaa

SEQ ID NO: 334636 - RNA, 19 nt, Human
gagaacaauggcagcggcc

SEQ ID NO: 334637 - RNA, 18 nt, Human
gaggagggggccccccug

SEQ ID NO: 334638 - RNA, 18 nt, Human
gaggcgggcagucuucuc

SEQ ID NO: 334639 - RNA, 24 nt, Human
gauauauaaggcagaugggaagaa

SEQ ID NO: 334640 - RNA, 19 nt, Human
ggaaacaagauaaaaggcu

SEQ ID NO: 334641 - RNA, 21 nt, Human
ggaagaaaacauggaauuaga

SEQ ID NO: 334642 - RNA, 20 nt, Human
ggacaugggcccugucagag

SEQ ID NO: 334643 - RNA, 21 nt, Human
ggagcauucacugcaggaggc

SEQ ID NO: 334644 - RNA, 18 nt, Human
ggcggcggcgcuccccgg

SEQ ID NO: 334645 - RNA, 20 nt, Human
gggcagaaggggcuguugug

SEQ ID NO: 334646 - RNA, 19 nt, Human
gguuaagaacuaugaggca

SEQ ID NO: 334647 - RNA, 24 nt, Human
guuuggauuuccugagcuucacag

SEQ ID NO: 334648 - RNA, 24 nt, Human
uaaauuacaaagacaaaauacuaa

SEQ ID NO: 334649 - RNA, 19 nt, Human
uaacacaaagacagaugac

SEQ ID NO: 334650 - RNA, 21 nt, Human
uaaggacaacuugcuuuuguu

SEQ ID NO: 334651 - RNA, 22 nt, Human
uaauagugcucaucaaacugaa

SEQ ID NO: 334652 - RNA, 21 nt, Human
uacaaagacaaaauacuaaaa

SEQ ID NO: 334653 - RNA, 22 nt, Human
uacaaagacaaaauacuaaaaa

SEQ ID NO: 334654 - RNA, 19 nt, Human
ucacuuauuuaggaguuca

SEQ ID NO: 334655 - RNA, 18 nt, Human
ucagccuuccaaagcucu

SEQ ID NO: 334656 - RNA, 19 nt, Human
ucaggaccagaccucuggg

SEQ ID NO: 334657 - RNA, 21 nt, Human
ucauccagcacagccaagcac

SEQ ID NO: 334658 - RNA, 23 nt, Human
ucgaggcggcggcggcgcucccc

SEQ ID NO: 334659 - RNA, 22 nt, Human
ucugaagugcugugacaaaagg

SEQ ID NO: 334660 - RNA, 22 nt, Human
ucugaagugcugugacaaaagg

SEQ ID NO: 334661 - RNA, 21 nt, Human
ugaaaaacagauugguacuaa

SEQ ID NO: 334662 - RNA, 24 nt, Human
ugaaacaaguuuauuuucuccaau

SEQ ID NO: 334663 - RNA, 18 nt, Human
ugaagacaccauggcuga

SEQ ID NO: 334664 - RNA, 18 nt, Human
ugacaaggggcagugucc

SEQ ID NO: 334665 - RNA, 19 nt, Human
ugaggcgggcagucuucuc

SEQ ID NO: 334666 - RNA, 21 nt, Human
ugaggcgggcagucuucuccc

SEQ ID NO: 334667 - RNA, 21 nt, Human
ugcauagaaaauuugcaguau

SEQ ID NO: 334668 - RNA, 18 nt, Human
uggcauacauaacuaccu

SEQ ID NO: 334669 - RNA, 26 nt, Human
ugggaagaaaacauggaauuagaguu

SEQ ID NO: 334670 - RNA, 20 nt, Human
ugggagaaguccucagaaac

SEQ ID NO: 334671 - RNA, 24 nt, Human
ugggagaaguccucagaaaccuuu

SEQ ID NO: 334672 - RNA, 24 nt, Human
uguuguguauuuucugaagugcug

SEQ ID NO: 334673 - RNA, 21 nt, Human
uuagaaauuaaaucauguuuu

SEQ ID NO: 334674 - RNA, 21 nt, Human
uucacauuucuuuggagcauu

SEQ ID NO: 334675 - RNA, 19 nt, Human
uucugugcgggggcagaag

SEQ ID NO: 334676 - RNA, 18 nt, Human
uucuuuggagcauuuuug

SEQ ID NO: 334677 - RNA, 21 nt, Human
uugaaauugcuuaacuauaau

SEQ ID NO: 334678 - RNA, 21 nt, Human
uuggaauugaaagccaaaggc

SEQ ID NO: 334679 - RNA, 20 nt, Human
uuuacugucccuuguugaaa

SEQ ID NO: 334680 - RNA, 19 nt, Human
uuuccgagaccucugcuau

SEQ ID NO: 334681 - RNA, 18 nt, Human
uuuggcuguaaacacaca

SEQ ID NO: 334682 - RNA, 22 nt, Human
uuuuuuuuuuuuuugcaaaaug

SEQ ID NO: 334683 - RNA, 18 nt, Human
uuuuuuuuuuuuuuuuug

SEQ ID NO: 334684 - RNA, 21 nt, Human
uuuuuuuuuuuuuuuuugcaa

SEQ ID NO: 334685 - RNA, 26 nt, Human
aaacacaaccacaugauccugugugc

SEQ ID NO: 334686 - RNA, 22 nt, Human
aaauagccaagugagguuaaac

SEQ ID NO: 334687 - RNA, 20 nt, Human
acuagcauacagggccucua

SEQ ID NO: 334688 - RNA, 21 nt, Human
acucauuugugaaaagucaaa

SEQ ID NO: 334689 - RNA, 22 nt, Human
agccaagugagguuaaaccagg

SEQ ID NO: 334690 - RNA, 19 nt, Human
auaacccaucucucuaugu

SEQ ID NO: 334691 - RNA, 24 nt, Human
caacaaaaacgaaguuucagucca

SEQ ID NO: 334692 - RNA, 23 nt, Human
cacuuggccugcaacaacagaac

SEQ ID NO: 334693 - RNA, 24 nt, Human
cauuuuuuaagccuaauucucagc

SEQ ID NO: 334694 - RNA, 22 nt, Human
ccaauucaccuuuccauuuccc

SEQ ID NO: 334695 - RNA, 24 nt, Human
ccauuucccaacuacuccccaaaa

SEQ ID NO: 334696 - RNA, 23 nt, Human
cuagagccaauucaccuuuccau

SEQ ID NO: 334697 - RNA, 20 nt, Human
cugugugcguggagaacccc

SEQ ID NO: 334698 - RNA, 19 nt, Human
gauccugugugcguggaga

SEQ ID NO: 334699 - RNA, 23 nt, Human
uaacagaugauuaagcuauaaau

SEQ ID NO: 334700 - RNA, 20 nt, Human
uaagagcucucucacaucuu

SEQ ID NO: 334701 - RNA, 20 nt, Human
uaagagcucucucacaucuu

SEQ ID NO: 334702 - RNA, 26 nt, Human
uagccaagugagguuaaaccaggcau

SEQ ID NO: 334703 - RNA, 22 nt, Human
uauacaaacacaaccacaugau

SEQ ID NO: 334704 - RNA, 22 nt, Human
uauauacaaacacaaccacaug

SEQ ID NO: 334705 - RNA, 20 nt, Human
uccccaaaauaauuaacaaa

SEQ ID NO: 334706 - RNA, 21 nt, Human
uccugugugcguggagaaccc

SEQ ID NO: 334707 - RNA, 19 nt, Human
ugaaauauucauccuaccc

SEQ ID NO: 334708 - RNA, 22 nt, Human
uggagaaccccaauuuaacaga

SEQ ID NO: 334709 - RNA, 21 nt, Human
uuaaagcugcaaaaaaugugc

SEQ ID NO: 334710 - RNA, 27 nt, Human
uucaacaaaaacgaaguuucaguccaa

SEQ ID NO: 334711 - RNA, 18 nt, Human
uucaccuuuccauuuccc

SEQ ID NO: 334712 - RNA, 27 nt, Human
uuuguggcaaugaaaauagcuuuuuuu

SEQ ID NO: 334713 - RNA, 20 nt, Human
aaaaaacaaacaaaaagagu

SEQ ID NO: 334714 - RNA, 25 nt, Human
aaacaaaaagaguaagggucuaagg

SEQ ID NO: 334715 - RNA, 18 nt, Human
aaacaaacaaaaagagua

SEQ ID NO: 334716 - RNA, 21 nt, Human
aaauucuccugacaaggagca

SEQ ID NO: 334717 - RNA, 24 nt, Human
aacaaacaaaaagaguaagggucu

SEQ ID NO: 334718 - RNA, 24 nt, Human
aagaguggccaccacaucuuuauu

SEQ ID NO: 334719 - RNA, 24 nt, Human
acagagcaagauccuguuucaaaa

SEQ ID NO: 334720 - RNA, 22 nt, Human
acagagccucacaaaacccacu

SEQ ID NO: 334721 - RNA, 21 nt, Human
acaucuuuauugcauacucag

SEQ ID NO: 334722 - RNA, 21 nt, Human
accugugaauuggugcugggg

SEQ ID NO: 334723 - RNA, 22 nt, Human
acuagcccacaucagccccagc

SEQ ID NO: 334724 - RNA, 18 nt, Human
acugcacucaagccuggg

SEQ ID NO: 334725 - RNA, 24 nt, Human
acugcacucaagccugggugacag

SEQ ID NO: 334726 - RNA, 22 nt, Human
agagaggggugaccugugaauu

SEQ ID NO: 334727 - RNA, 21 nt, Human
agagcugugugagccagcgac

SEQ ID NO: 334728 - RNA, 23 nt, Human
agagggacaaggagggggagggu

SEQ ID NO: 334729 - RNA, 19 nt, Human
agcagagggacaaggaggg

SEQ ID NO: 334730 - RNA, 19 nt, Human
agccguaaaugcgguaaau

SEQ ID NO: 334731 - RNA, 19 nt, Human
aggcugggagggaggcaaa

SEQ ID NO: 334732 - RNA, 24 nt, Human
aggggugagcagagggacaaggag

SEQ ID NO: 334733 - RNA, 24 nt, Human
aucgcaccacugcacucaagccug

SEQ ID NO: 334734 - RNA, 27 nt, Human
augagacaaaaaaaaaaaaauacuaca

SEQ ID NO: 334735 - RNA, 22 nt, Human
augcccacuuacagaaugcagc

SEQ ID NO: 334736 - RNA, 21 nt, Human
caccaugaaagaguggccaac

SEQ ID NO: 334737 - RNA, 24 nt, Human
cacgccugucaucccagcacuuug

SEQ ID NO: 334738 - RNA, 23 nt, Human
cacucaagccugggugacagagc

SEQ ID NO: 334739 - RNA, 23 nt, Human
cacugcacucaagccugggugac

SEQ ID NO: 334740 - RNA, 24 nt, Human
cacugcacucaagccugggugaca

SEQ ID NO: 334741 - RNA, 24 nt, Human
cagaaugcagccguaaaugcggua

SEQ ID NO: 334742 - RNA, 24 nt, Human
cagugcugggggagaccuuggaca

SEQ ID NO: 334743 - RNA, 20 nt, Human
ccacugcacucaagccuggg

SEQ ID NO: 334744 - RNA, 20 nt, Human
ccacugcacucaagccuggg

SEQ ID NO: 334745 - RNA, 21 nt, Human
ccacugcacucaagccugggu

SEQ ID NO: 334746 - RNA, 24 nt, Human
ccacugcacucaagccugggugac

SEQ ID NO: 334747 - RNA, 19 nt, Human
cccacaucagccccagcau

SEQ ID NO: 334748 - RNA, 21 nt, Human
cccguagugucuuguacaguu

SEQ ID NO: 334749 - RNA, 21 nt, Human
ccgcuagaucugccgcccggc

SEQ ID NO: 334750 - RNA, 19 nt, Human
ccugggugacagagcaaga

SEQ ID NO: 334751 - RNA, 22 nt, Human
ccuuggacagcuaucccgcccu

SEQ ID NO: 334752 - RNA, 21 nt, Human
cgccggagggagggaacgagc

SEQ ID NO: 334753 - RNA, 23 nt, Human
cgccugucaucccagcacuuugg

SEQ ID NO: 334754 - RNA, 24 nt, Human
cgccugucaucccagcacuuuggg

SEQ ID NO: 334755 - RNA, 20 nt, Human
cuaucccgcccucgcacucu

SEQ ID NO: 334756 - RNA, 22 nt, Human
cuauuuacagagguuggggugc

SEQ ID NO: 334757 - RNA, 24 nt, Human
cucacgccugucaucccagcacuu

SEQ ID NO: 334758 - RNA, 21 nt, Human
cuccuacccaggcaagaaggg

SEQ ID NO: 334759 - RNA, 19 nt, Human
cugccgcccggcugcauuu

SEQ ID NO: 334760 - RNA, 20 nt, Human
gagcagagggacaaggaggg

SEQ ID NO: 334761 - RNA, 19 nt, Human
gaggauugcuugagcacag

SEQ ID NO: 334762 - RNA, 19 nt, Human
gagggaacgagcgaggggu

SEQ ID NO: 334763 - RNA, 24 nt, Human
gagggaacgagcgaggggugagca

SEQ ID NO: 334764 - RNA, 23 nt, Human
gaggucugaaagaauuccuggca

SEQ ID NO: 334765 - RNA, 19 nt, Human
gccgugaacuuggugcugc

SEQ ID NO: 334766 - RNA, 22 nt, Human
gccuaggcugggagcuguggcu

SEQ ID NO: 334767 - RNA, 23 nt, Human
gccuaggcugggagcuguggcuc

SEQ ID NO: 334768 - RNA, 18 nt, Human
gcugcacugggcugugau

SEQ ID NO: 334769 - RNA, 20 nt, Human
gcugugaucgcaccacugca

SEQ ID NO: 334770 - RNA, 20 nt, Human
ggagggggagggucgaggga

SEQ ID NO: 334771 - RNA, 20 nt, Human
ggccacagagccucacaaaa

SEQ ID NO: 334772 - RNA, 18 nt, Human
ggccagugggcugagaga

SEQ ID NO: 334773 - RNA, 21 nt, Human
ggcguuggccgugaacuuggu

SEQ ID NO: 334774 - RNA, 22 nt, Human
ggcugggagcuguggcucacgg

SEQ ID NO: 334775 - RNA, 23 nt, Human
gggagcgggggugccagcaaguu

SEQ ID NO: 334776 - RNA, 24 nt, Human
gggaggauugcuugagcacaggug

SEQ ID NO: 334777 - RNA, 20 nt, Human
ggggagggucgagggagagg

SEQ ID NO: 334778 - RNA, 18 nt, Human
gggggagggucgagggag

SEQ ID NO: 334779 - RNA, 20 nt, Human
ggguuggggagcgggggugc

SEQ ID NO: 334780 - RNA, 20 nt, Human
gguggucgaggcugcacugg

SEQ ID NO: 334781 - RNA, 20 nt, Human
gucgagggagaggacacgcc

SEQ ID NO: 334782 - RNA, 18 nt, Human
gugcaagaugagagaagu

SEQ ID NO: 334783 - RNA, 19 nt, Human
guggucgaggcugcacugg

SEQ ID NO: 334784 - RNA, 22 nt, Human
uacaaugaacacuccuccauua

SEQ ID NO: 334785 - RNA, 22 nt, Human
ucacgccugucaucccagcacu

SEQ ID NO: 334786 - RNA, 20 nt, Human
ucagccccagcauggaagaa

SEQ ID NO: 334787 - RNA, 22 nt, Human
uccuguuucaaaaaacaaacaa

SEQ ID NO: 334788 - RNA, 24 nt, Human
ucucagaagacucaagauuucgcc

SEQ ID NO: 334789 - RNA, 22 nt, Human
ucuccugacaaggagcaaccgg

SEQ ID NO: 334790 - RNA, 19 nt, Human
ugagacaaaaaaaaaaaaa

SEQ ID NO: 334791 - RNA, 22 nt, Human
ugagacaaaaaaaaaaaaauac

SEQ ID NO: 334792 - RNA, 19 nt, Human
ugagcacagguggucgagg

SEQ ID NO: 334793 - RNA, 18 nt, Human
ugaggcugggagggaggc

SEQ ID NO: 334794 - RNA, 18 nt, Human
ugcaagaagagaggggug

SEQ ID NO: 334795 - RNA, 18 nt, Human
ugcugaggcccaauguga

SEQ ID NO: 334796 - RNA, 21 nt, Human
uggcucacgccugucauccca

SEQ ID NO: 334797 - RNA, 22 nt, Human
uggcucacgccugucaucccag

SEQ ID NO: 334798 - RNA, 24 nt, Human
uggcucacgccugucaucccagca

SEQ ID NO: 334799 - RNA, 22 nt, Human
uggggagcugcugaggcccaau

SEQ ID NO: 334800 - RNA, 19 nt, Human
uguacaguuuucucagaag

SEQ ID NO: 334801 - RNA, 21 nt, Human
ugugguugaggcugggaggga

SEQ ID NO: 334802 - RNA, 21 nt, Human
uucaaaaaacaaacaaaaaga

SEQ ID NO: 334803 - RNA, 20 nt, Human
uuccaguuccacggcacuuc

SEQ ID NO: 334804 - RNA, 18 nt, Human
uuuagggugaucuuuagc

SEQ ID NO: 334805 - RNA, 21 nt, Human
uuucaaaaaacaaacaaaaag

SEQ ID NO: 334806 - RNA, 18 nt, Human
uuuuugcugccaccacca

SEQ ID NO: 334807 - RNA, 20 nt, Human
aaagaaauuccacaaccucc

SEQ ID NO: 334808 - RNA, 21 nt, Human
aaccuccugacaaagcagccc

SEQ ID NO: 334809 - RNA, 22 nt, Human
aaccuccugacaaagcagcccu

SEQ ID NO: 334810 - RNA, 21 nt, Human
aacgcgccccgggcccucccg

SEQ ID NO: 334811 - RNA, 21 nt, Human
aagaagcuuacccaaaaaauc

SEQ ID NO: 334812 - RNA, 19 nt, Human
aagcagcccuuccacuugc

SEQ ID NO: 334813 - RNA, 22 nt, Human
acgcgccccgggcccucccggg

SEQ ID NO: 334814 - RNA, 23 nt, Human
acugaagagcagggaccaguccc

SEQ ID NO: 334815 - RNA, 19 nt, Human
agaaggggagaagaaagaa

SEQ ID NO: 334816 - RNA, 23 nt, Human
aucuuacuccacucccuccucca

SEQ ID NO: 334817 - RNA, 24 nt, Human
aucuuacuccacucccuccuccaa

SEQ ID NO: 334818 - RNA, 26 nt, Human
caaaacccacuacaacaucuguaguu

SEQ ID NO: 334819 - RNA, 20 nt, Human
caacccagcccuguguccuu

SEQ ID NO: 334820 - RNA, 26 nt, Human
caagaagcuuacccaaaaaaucggug

SEQ ID NO: 334821 - RNA, 20 nt, Human
cacaaauauuuuuccccauu

SEQ ID NO: 334822 - RNA, 25 nt, Human
cacaagcaagaagucaaccauagcc

SEQ ID NO: 334823 - RNA, 21 nt, Human
cacucccuccuccaaaaccca

SEQ ID NO: 334824 - RNA, 19 nt, Human
cacuuuauacauagcuaag

SEQ ID NO: 334825 - RNA, 19 nt, Human
cagcucuuaaacgcgcccc

SEQ ID NO: 334826 - RNA, 24 nt, Human
caucuuacuccacucccuccucca

SEQ ID NO: 334827 - RNA, 19 nt, Human
ccacucccuccuccaaaac

SEQ ID NO: 334828 - RNA, 21 nt, Human
ccacuugcaugggcuuauuuc

SEQ ID NO: 334829 - RNA, 19 nt, Human
ccagucccgccgccuccgg

SEQ ID NO: 334830 - RNA, 20 nt, Human
cccuccuccaaaacccacua

SEQ ID NO: 334831 - RNA, 18 nt, Human
ccgccgccuccgccgucc

SEQ ID NO: 334832 - RNA, 18 nt, Human
ccgccgccuccgccgucc

SEQ ID NO: 334833 - RNA, 26 nt, Human
ccgccgccuccgccguccgcacccgg

SEQ ID NO: 334834 - RNA, 23 nt, Human
ccuccaaaacccacuacaacauc

SEQ ID NO: 334835 - RNA, 23 nt, Human
ccucccggggccggaccccagcc

SEQ ID NO: 334836 - RNA, 21 nt, Human
cgccccgggcccucccggggc

SEQ ID NO: 334837 - RNA, 19 nt, Human
cgcuggucuucugaggcug

SEQ ID NO: 334838 - RNA, 23 nt, Human
cuccaaaacccacuacaacaucu

SEQ ID NO: 334839 - RNA, 19 nt, Human
cuccacucccuccuccaaa

SEQ ID NO: 334840 - RNA, 19 nt, Human
cucccuccuccaaaaccca

SEQ ID NO: 334841 - RNA, 19 nt, Human
cucuuuaccaacccagccc

SEQ ID NO: 334842 - RNA, 18 nt, Human
gacaaagcagcccuucca

SEQ ID NO: 334843 - RNA, 21 nt, Human
gaugacccacugaagagcagg

SEQ ID NO: 334844 - RNA, 21 nt, Human
gccccgggcccucccggggcc

SEQ ID NO: 334845 - RNA, 18 nt, Human
ggagcagcuggcuucauc

SEQ ID NO: 334846 - RNA, 22 nt, Human
gggaagaaggggagaagaaaga

SEQ ID NO: 334847 - RNA, 24 nt, Human
ggggagaagaaagaaauuccacaa

SEQ ID NO: 334848 - RNA, 24 nt, Human
uaagaugcuaugacaauucuuucu

SEQ ID NO: 334849 - RNA, 18 nt, Human
uaauuaacagcuguuucc

SEQ ID NO: 334850 - RNA, 20 nt, Human
uaccaacccagcccuguguc

SEQ ID NO: 334851 - RNA, 27 nt, Human
ucccgccgccuccgccguccgcacccg

SEQ ID NO: 334852 - RNA, 22 nt, Human
ucccggggccggaccccagccg

SEQ ID NO: 334853 - RNA, 18 nt, Human
uccgcacccggcccgcag

SEQ ID NO: 334854 - RNA, 23 nt, Human
ucggggagagugggaagcacaaa

SEQ ID NO: 334855 - RNA, 22 nt, Human
ucuuaaacgcgccccgggcccu

SEQ ID NO: 334856 - RNA, 21 nt, Human
uguucuuagagcugaagggau

SEQ ID NO: 334857 - RNA, 24 nt, Human
uuucaguguucuuagagcugaagg

SEQ ID NO: 334858 - RNA, 21 nt, Human
aaacaaaaaaggaaccuucga

SEQ ID NO: 334859 - RNA, 22 nt, Human
aaacaaaacacuguguuccccc

SEQ ID NO: 334860 - RNA, 23 nt, Human
aacaaaacacuguguucccccuu

SEQ ID NO: 334861 - RNA, 23 nt, Human
aaccaacuccucgccagcugcag

SEQ ID NO: 334862 - RNA, 26 nt, Human
aacccagugagaaggccuuugcuggu

SEQ ID NO: 334863 - RNA, 22 nt, Human
aagcaaacaaagcaauggaaac

SEQ ID NO: 334864 - RNA, 26 nt, Human
aagcaaacaaagcaauggaaacuuca

SEQ ID NO: 334865 - RNA, 23 nt, Human
aagcaagagugacgguaccagag

SEQ ID NO: 334866 - RNA, 19 nt, Human
aagcccacaaugcguccac

SEQ ID NO: 334867 - RNA, 18 nt, Human
aagcuuuucuuuuuccca

SEQ ID NO: 334868 - RNA, 22 nt, Human
acaaacaaaaaaggaaccuucg

SEQ ID NO: 334869 - RNA, 24 nt, Human
acacccgaccauacuuucagucac

SEQ ID NO: 334870 - RNA, 20 nt, Human
accggagccaggagcugcuc

SEQ ID NO: 334871 - RNA, 24 nt, Human
acuaggaagggacgaggucuucuc

SEQ ID NO: 334872 - RNA, 22 nt, Human
acugcacugccgggggccggug

SEQ ID NO: 334873 - RNA, 22 nt, Human
acugcacugccgggggccggug

SEQ ID NO: 334874 - RNA, 25 nt, Human
acugcuucguccucccauggaaccu

SEQ ID NO: 334875 - RNA, 18 nt, Human
agaaagacgauuuuuggu

SEQ ID NO: 334876 - RNA, 23 nt, Human
agaaggagagaggagagugggcc

SEQ ID NO: 334877 - RNA, 19 nt, Human
agagagccggccuggcccc

SEQ ID NO: 334878 - RNA, 23 nt, Human
agagagccggccuggcccccggg

SEQ ID NO: 334879 - RNA, 20 nt, Human
agcacguugccuccagggcc

SEQ ID NO: 334880 - RNA, 23 nt, Human
aggagagaggagagugggccagg

SEQ ID NO: 334881 - RNA, 21 nt, Human
aggcacaagcaagagugacgg

SEQ ID NO: 334882 - RNA, 21 nt, Human
agggacgaggucuucucuguu

SEQ ID NO: 334883 - RNA, 24 nt, Human
agggcccagccucccagaagccuc

SEQ ID NO: 334884 - RNA, 20 nt, Human
aggugcugaaaauaaauacu

SEQ ID NO: 334885 - RNA, 19 nt, Human
augcaccaggccaagguga

SEQ ID NO: 334886 - RNA, 18 nt, Human
augcaugccagggguccg

SEQ ID NO: 334887 - RNA, 21 nt, Human
augggguggggugaaucacag

SEQ ID NO: 334888 - RNA, 23 nt, Human
caaauaagcugacacuaucugga

SEQ ID NO: 334889 - RNA, 18 nt, Human
caacgagucacaacagug

SEQ ID NO: 334890 - RNA, 18 nt, Human
cacaaacaaaaaaggaac

SEQ ID NO: 334891 - RNA, 19 nt, Human
caccugugccugccgccgc

SEQ ID NO: 334892 - RNA, 21 nt, Human
cagacgugugacagaggaaga

SEQ ID NO: 334893 - RNA, 18 nt, Human
cagcacguugccuccagg

SEQ ID NO: 334894 - RNA, 19 nt, Human
cagcagcuauaaagugaac

SEQ ID NO: 334895 - RNA, 19 nt, Human
caggcgcagcgcugaccug

SEQ ID NO: 334896 - RNA, 22 nt, Human
caguucccaccggagccaggag

SEQ ID NO: 334897 - RNA, 18 nt, Human
cauuacaccugugccugc

SEQ ID NO: 334898 - RNA, 18 nt, Human
ccaagcaagcaaucggag

SEQ ID NO: 334899 - RNA, 22 nt, Human
ccaagccaggccaguggacuug

SEQ ID NO: 334900 - RNA, 19 nt, Human
ccagccucccagaagccuc

SEQ ID NO: 334901 - RNA, 22 nt, Human
cccgaccauacuuucagucacc

SEQ ID NO: 334902 - RNA, 23 nt, Human
ccgacaggacagcaagaaggcau

SEQ ID NO: 334903 - RNA, 19 nt, Human
ccggagccaggagcugcuc

SEQ ID NO: 334904 - RNA, 19 nt, Human
ccucugcagcagcaugggc

SEQ ID NO: 334905 - RNA, 21 nt, Human
ccucugcagcagcaugggcuu

SEQ ID NO: 334906 - RNA, 21 nt, Human
cgcugaccuggugugguuccc

SEQ ID NO: 334907 - RNA, 19 nt, Human
cgcuggacugcacugccgg

SEQ ID NO: 334908 - RNA, 23 nt, Human
cgcuggacugcacugccgggggc

SEQ ID NO: 334909 - RNA, 26 nt, Human
cggcggccacagcaggcgcagcgcug

SEQ ID NO: 334910 - RNA, 23 nt, Human
cuaggagaaggaggugagagccc

SEQ ID NO: 334911 - RNA, 24 nt, Human
cucaaccaacuccucgccagcugc

SEQ ID NO: 334912 - RNA, 22 nt, Human
cucacagaaagaauguguacaa

SEQ ID NO: 334913 - RNA, 21 nt, Human
cuccagacggccacgcaggcu

SEQ ID NO: 334914 - RNA, 27 nt, Human
cugaccagucagagaacgugaggcagc

SEQ ID NO: 334915 - RNA, 19 nt, Human
cugcagcacguugccuccc

SEQ ID NO: 334916 - RNA, 19 nt, Human
cugcagcagcaugggcuug

SEQ ID NO: 334917 - RNA, 22 nt, Human
cuuccgagccacgagccuggcc

SEQ ID NO: 334918 - RNA, 21 nt, Human
cuucgauauugccagcagcua

SEQ ID NO: 334919 - RNA, 25 nt, Human
cuuggccuugaagaagugccucaac

SEQ ID NO: 334920 - RNA, 24 nt, Human
cuuucagucucacggacucccuuu

SEQ ID NO: 334921 - RNA, 22 nt, Human
gaaacaaaacacuguguucccc

SEQ ID NO: 334922 - RNA, 20 nt, Human
gaacuggcaggaacgggcag

SEQ ID NO: 334923 - RNA, 20 nt, Human
gacagcaagaaggcauuugc

SEQ ID NO: 334924 - RNA, 23 nt, Human
gacagcagacccagcccagucca

SEQ ID NO: 334925 - RNA, 22 nt, Human
gauuaaaaacugcaucaaacag

SEQ ID NO: 334926 - RNA, 24 nt, Human
gcagaggugagggguacaaaguga

SEQ ID NO: 334927 - RNA, 24 nt, Human
gcuccacaggcagccccugucugu

SEQ ID NO: 334928 - RNA, 22 nt, Human
ggaauuuuuaaagcaaacaaag

SEQ ID NO: 334929 - RNA, 18 nt, Human
ggagccaggagcugcuca

SEQ ID NO: 334930 - RNA, 21 nt, Human
ggcaggcuccacaggcagccc

SEQ ID NO: 334931 - RNA, 19 nt, Human
ggccaguggacuugugugc

SEQ ID NO: 334932 - RNA, 19 nt, Human
ggcccagccucccagaagc

SEQ ID NO: 334933 - RNA, 21 nt, Human
ggguuuguuuucgaccccuug

SEQ ID NO: 334934 - RNA, 18 nt, Human
gguggggugaaucacagc

SEQ ID NO: 334935 - RNA, 25 nt, Human
uaaaaaagcaaagaaagagggaggc

SEQ ID NO: 334936 - RNA, 23 nt, Human
uaaguuaacaaagaaaauuaauc

SEQ ID NO: 334937 - RNA, 21 nt, Human
uaaucuucaaauaagcugaca

SEQ ID NO: 334938 - RNA, 20 nt, Human
uaauggccaacgagucacaa

SEQ ID NO: 334939 - RNA, 18 nt, Human
uacaaagugagcuggaaa

SEQ ID NO: 334940 - RNA, 20 nt, Human
uacacaaacaaaaaaggaac

SEQ ID NO: 334941 - RNA, 18 nt, Human
uacaccugugccugccgc

SEQ ID NO: 334942 - RNA, 20 nt, Human
uaccuaggagaaggagguga

SEQ ID NO: 334943 - RNA, 18 nt, Human
uaggaagggacgaggucu

SEQ ID NO: 334944 - RNA, 19 nt, Human
ucaauugcaaugccugggg

SEQ ID NO: 334945 - RNA, 22 nt, Human
ucaccagaauaucuucucucca

SEQ ID NO: 334946 - RNA, 24 nt, Human
ucauucuguuuuuaaggaagguca

SEQ ID NO: 334947 - RNA, 19 nt, Human
uccacaggcagccccuguc

SEQ ID NO: 334948 - RNA, 23 nt, Human
ucccaaauggcuguugaauuuau

SEQ ID NO: 334949 - RNA, 18 nt, Human
ucccauggaaccugagcc

SEQ ID NO: 334950 - RNA, 24 nt, Human
ucugucaauugcaaugccuggggc

SEQ ID NO: 334951 - RNA, 23 nt, Human
ucuguggccagacaggccggggc

SEQ ID NO: 334952 - RNA, 19 nt, Human
ugaacguacugagaccgac

SEQ ID NO: 334953 - RNA, 19 nt, Human
ugacagaggaagagucuga

SEQ ID NO: 334954 - RNA, 21 nt, Human
ugaccuggugugguucccccc

SEQ ID NO: 334955 - RNA, 21 nt, Human
ugacgugaaggagucagacgu

SEQ ID NO: 334956 - RNA, 22 nt, Human
ugagaagagaagacaccuuuac

SEQ ID NO: 334957 - RNA, 24 nt, Human
ugagagcccucgugugggguuugu

SEQ ID NO: 334958 - RNA, 21 nt, Human
ugccagggguccgggguucuc

SEQ ID NO: 334959 - RNA, 23 nt, Human
ugccagggguccgggguucuccc

SEQ ID NO: 334960 - RNA, 26 nt, Human
ugccucaaccaacuccucgccagcug

SEQ ID NO: 334961 - RNA, 18 nt, Human
ugccuggggccaagccag

SEQ ID NO: 334962 - RNA, 20 nt, Human
ugccuggggccaagccaggc

SEQ ID NO: 334963 - RNA, 19 nt, Human
uggaaggcacaagcaagag

SEQ ID NO: 334964 - RNA, 19 nt, Human
uggaauuuuuaaagcaaac

SEQ ID NO: 334965 - RNA, 18 nt, Human
uggcccccggguuacagu

SEQ ID NO: 334966 - RNA, 24 nt, Human
uguacaaaaaaacuagaagcuuuu

SEQ ID NO: 334967 - RNA, 19 nt, Human
ugucugcagaggugagggg

SEQ ID NO: 334968 - RNA, 21 nt, Human
ugucuuccgagccacgagccu

SEQ ID NO: 334969 - RNA, 23 nt, Human
ugugauaaaaaagcaaagaaaga

SEQ ID NO: 334970 - RNA, 20 nt, Human
uuaacaaagaaaauuaaucu

SEQ ID NO: 334971 - RNA, 23 nt, Human
uucuagaccagucuaucccagac

SEQ ID NO: 334972 - RNA, 20 nt, Human
uugaagaagugccucaacca

SEQ ID NO: 334973 - RNA, 24 nt, Human
uugcucaaucuugucaauugggag

SEQ ID NO: 334974 - RNA, 18 nt, Human
uugugugcaguucccacc

SEQ ID NO: 334975 - RNA, 20 nt, Human
uuucugguuugaacaacauc

SEQ ID NO: 334976 - RNA, 24 nt, Human
aagaacaucccuuuuaaucacaaa

SEQ ID NO: 334977 - RNA, 19 nt, Human
aagcugccccuacccaggc

SEQ ID NO: 334978 - RNA, 24 nt, Human
aagcugccccuacccaggccugcc

SEQ ID NO: 334979 - RNA, 23 nt, Human
aggcuccagaagcugccccuacc

SEQ ID NO: 334980 - RNA, 24 nt, Human
cacaaaccacucauccacaaaugu

SEQ ID NO: 334981 - RNA, 20 nt, Human
cccccuuccuaggguggcgg

SEQ ID NO: 334982 - RNA, 26 nt, Human
ccuggccucacccugcagccgguucc

SEQ ID NO: 334983 - RNA, 23 nt, Human
cuaggguggcgguggccuccagc

SEQ ID NO: 334984 - RNA, 21 nt, Human
cuccagaagcugccccuaccc

SEQ ID NO: 334985 - RNA, 23 nt, Human
cugcagccugggugcacccgcgg

SEQ ID NO: 334986 - RNA, 23 nt, Human
cuuuuaaucacaaaccacucauc

SEQ ID NO: 334987 - RNA, 20 nt, Human
gaagaaggggggcauugugg

SEQ ID NO: 334988 - RNA, 21 nt, Human
ggcuggaagaaggggggcauu

SEQ ID NO: 334989 - RNA, 18 nt, Human
ucacccugcagccugggu

SEQ ID NO: 334990 - RNA, 19 nt, Human
ucacgucccugcccccuuc

SEQ ID NO: 334991 - RNA, 18 nt, Human
uccagguuaauaccagag

SEQ ID NO: 334992 - RNA, 23 nt, Human
uccuaggguggcgguggccuccc

SEQ ID NO: 334993 - RNA, 20 nt, Human
ucugucccaaggcuccagaa

SEQ ID NO: 334994 - RNA, 20 nt, Human
ugccuggccucacccugcag

SEQ ID NO: 334995 - RNA, 20 nt, Human
ugucccaaggcuccagaagc

SEQ ID NO: 334996 - RNA, 22 nt, Human
uguggcuaugggguaagcaguc

SEQ ID NO: 334997 - RNA, 20 nt, Human
uuccuaggguggcgguggcc

SEQ ID NO: 334998 - RNA, 21 nt, Human
uucuuggcuggaagaaggggg

SEQ ID NO: 334999 - RNA, 24 nt, Human
uucuuggcuggaagaaggggggca

SEQ ID NO: 335000 - RNA, 25 nt, Human
uucuuggcuggaagaaggggggcau

SEQ ID NO: 335001 - RNA, 19 nt, Human
uuggcuggaagaagggggg

SEQ ID NO: 335002 - RNA, 20 nt, Human
aacagcauagaaaccugcag

SEQ ID NO: 335003 - RNA, 18 nt, Human
aaccugcaggcagaggcu

SEQ ID NO: 335004 - RNA, 19 nt, Human
aagcagggccuagacugcg

SEQ ID NO: 335005 - RNA, 24 nt, Human
acaguagcuggagauuggcagcac

SEQ ID NO: 335006 - RNA, 22 nt, Human
acccacccgaucucccaucccc

SEQ ID NO: 335007 - RNA, 24 nt, Human
acccacuccaucucaccgggaccc

SEQ ID NO: 335008 - RNA, 23 nt, Human
acccccacuccagccucugguca

SEQ ID NO: 335009 - RNA, 25 nt, Human
agaaacagcauagaaaccugcaggc

SEQ ID NO: 335010 - RNA, 25 nt, Human
agagccccugccuauauuucugccu

SEQ ID NO: 335011 - RNA, 19 nt, Human
agagggccccucacccaca

SEQ ID NO: 335012 - RNA, 24 nt, Human
agauuggcagcacccacccgaucu

SEQ ID NO: 335013 - RNA, 21 nt, Human
agcagauagaggccacaagcu

SEQ ID NO: 335014 - RNA, 18 nt, Human
agccccucccuucuccuc

SEQ ID NO: 335015 - RNA, 26 nt, Human
agccccucccuucuccucccagccuu

SEQ ID NO: 335016 - RNA, 19 nt, Human
aggaggcccaggccccauc

SEQ ID NO: 335017 - RNA, 20 nt, Human
caagcucuggccuuaucaca

SEQ ID NO: 335018 - RNA, 22 nt, Human
cacagcaucaugauggaaugga

SEQ ID NO: 335019 - RNA, 18 nt, Human
cagcaggugauuucuugc

SEQ ID NO: 335020 - RNA, 21 nt, Human
cagcauagaaaccugcaggca

SEQ ID NO: 335021 - RNA, 22 nt, Human
cagccccucccuucuccuccca

SEQ ID NO: 335022 - RNA, 24 nt, Human
caggagccagggcaggaaccagag

SEQ ID NO: 335023 - RNA, 19 nt, Human
caggccacgcauggcuccu

SEQ ID NO: 335024 - RNA, 20 nt, Human
caggugggguguggccacag

SEQ ID NO: 335025 - RNA, 21 nt, Human
cauggcuccugggaaccccca

SEQ ID NO: 335026 - RNA, 24 nt, Human
ccacgcauggcuccugggaacccc

SEQ ID NO: 335027 - RNA, 21 nt, Human
ccccauccgcacagcaagucc

SEQ ID NO: 335028 - RNA, 19 nt, Human
ccccucccuucuccuccca

SEQ ID NO: 335029 - RNA, 21 nt, Human
ccuccacuggcccuagaauga

SEQ ID NO: 335030 - RNA, 21 nt, Human
ccugagccucagccagggagc

SEQ ID NO: 335031 - RNA, 22 nt, Human
ccugggaacccccagccccucc

SEQ ID NO: 335032 - RNA, 27 nt, Human
ccugggaacccccagccccucccuucu

SEQ ID NO: 335033 - RNA, 26 nt, Human
ccuucuccucccagccuuuccagcug

SEQ ID NO: 335034 - RNA, 21 nt, Human
gagcaggucagcccaggaagg

SEQ ID NO: 335035 - RNA, 22 nt, Human
gagccagggcaggaaccagaga

SEQ ID NO: 335036 - RNA, 23 nt, Human
gagcuggggcuggugcaggagcc

SEQ ID NO: 335037 - RNA, 21 nt, Human
gagcuugggcggauagccuga

SEQ ID NO: 335038 - RNA, 21 nt, Human
gcagcaggugauuucuugccc

SEQ ID NO: 335039 - RNA, 18 nt, Human
gccacgcauggcuccugg

SEQ ID NO: 335040 - RNA, 21 nt, Human
gcccaugaccagguggggugu

SEQ ID NO: 335041 - RNA, 20 nt, Human
gcggcuaaggcuaggcugga

SEQ ID NO: 335042 - RNA, 19 nt, Human
ggaacccccagccccuccc

SEQ ID NO: 335043 - RNA, 21 nt, Human
ggaacgucuuccaagagcccc

SEQ ID NO: 335044 - RNA, 19 nt, Human
ggcaggaaccagagauggg

SEQ ID NO: 335045 - RNA, 23 nt, Human
ggcuccugggaacccccagcccc

SEQ ID NO: 335046 - RNA, 21 nt, Human
ggcuggugcaggagccagggc

SEQ ID NO: 335047 - RNA, 20 nt, Human
uaacacacccccacuccagc

SEQ ID NO: 335048 - RNA, 22 nt, Human
uaagaaacagcauagaaaccug

SEQ ID NO: 335049 - RNA, 24 nt, Human
uagaaugagcaaagagcuugggcg

SEQ ID NO: 335050 - RNA, 20 nt, Human
uaggaaggaggcccaggccc

SEQ ID NO: 335051 - RNA, 21 nt, Human
uccccagggaacuuucuucca

SEQ ID NO: 335052 - RNA, 22 nt, Human
ucuuccaagagccccugccuau

SEQ ID NO: 335053 - RNA, 26 nt, Human
ugcccagcacacaagcucuggccuua

SEQ ID NO: 335054 - RNA, 20 nt, Human
ugccuggauguaggcaggag

SEQ ID NO: 335055 - RNA, 19 nt, Human
ugcggagcacaggaugcag

SEQ ID NO: 335056 - RNA, 22 nt, Human
uggacucugcaggccacgcaug

SEQ ID NO: 335057 - RNA, 21 nt, Human
uggccuuaucacauuuuccuc

SEQ ID NO: 335058 - RNA, 18 nt, Human
uggcuccugggaaccccc

SEQ ID NO: 335059 - RNA, 23 nt, Human
uguaggaaggaggcccaggcccc

SEQ ID NO: 335060 - RNA, 22 nt, Human
ugugcuaagaaacagcauagaa

SEQ ID NO: 335061 - RNA, 23 nt, Human
uugccaggugugacccacuccau

SEQ ID NO: 335062 - RNA, 21 nt, Human
aaaaauacauuccccugggcu

SEQ ID NO: 335063 - RNA, 23 nt, Human
aaaaauacauuccccugggcuag

SEQ ID NO: 335064 - RNA, 20 nt, Human
agacugaauuuacacuggua

SEQ ID NO: 335065 - RNA, 21 nt, Human
ccugagacccagaccuucagg

SEQ ID NO: 335066 - RNA, 27 nt, Human
gagaaaagacugaauuuacacugguag

SEQ ID NO: 335067 - RNA, 21 nt, Human
ugauagaaagacugaaaacac

SEQ ID NO: 335068 - RNA, 24 nt, Human
aaacacaaguacaccugaaaucac

SEQ ID NO: 335069 - RNA, 21 nt, Human
aaauauauuucaaaccuaaaa

SEQ ID NO: 335070 - RNA, 24 nt, Human
aaccagugacgcagcgccguagcc

SEQ ID NO: 335071 - RNA, 18 nt, Human
aaguacaccugaaaucac

SEQ ID NO: 335072 - RNA, 22 nt, Human
acaaguacaccugaaaucacca

SEQ ID NO: 335073 - RNA, 19 nt, Human
accagaaaaagguacugca

SEQ ID NO: 335074 - RNA, 21 nt, Human
acgagucucuaugcauaaaug

SEQ ID NO: 335075 - RNA, 26 nt, Human
aggaaauagucaacuuguuuaaaaug

SEQ ID NO: 335076 - RNA, 18 nt, Human
aggaauugucauuuuauu

SEQ ID NO: 335077 - RNA, 23 nt, Human
caacagcuauaagcugcaauuuu

SEQ ID NO: 335078 - RNA, 23 nt, Human
caagaggaaagcgccugcaaacc

SEQ ID NO: 335079 - RNA, 21 nt, Human
caauaguuaagauuaccaaau

SEQ ID NO: 335080 - RNA, 24 nt, Human
cagaaaaguuugaaacaaaacccc

SEQ ID NO: 335081 - RNA, 20 nt, Human
ccgcagcagucgccacuucc

SEQ ID NO: 335082 - RNA, 19 nt, Human
ccugcaaaccagugacgca

SEQ ID NO: 335083 - RNA, 21 nt, Human
ccugcaaaccagugacgcagc

SEQ ID NO: 335084 - RNA, 23 nt, Human
cgccaaccuggcucccgaggcgc

SEQ ID NO: 335085 - RNA, 21 nt, Human
cgccguagccggcggaggacc

SEQ ID NO: 335086 - RNA, 22 nt, Human
gaaaaguuugaaacaaaacccc

SEQ ID NO: 335087 - RNA, 21 nt, Human
gacgcagcgccguagccggcg

SEQ ID NO: 335088 - RNA, 24 nt, Human
gucaauuauaacacauuaaaaagu

SEQ ID NO: 335089 - RNA, 24 nt, Human
guccauuuucaaaagcugaacaua

SEQ ID NO: 335090 - RNA, 18 nt, Human
gucccuuuauucaaaugg

SEQ ID NO: 335091 - RNA, 21 nt, Human
guggucccuuuauucaaaugg

SEQ ID NO: 335092 - RNA, 23 nt, Human
guuugaggucuauugcuuuuaac

SEQ ID NO: 335093 - RNA, 20 nt, Human
uaaaucggaaacguccauuu

SEQ ID NO: 335094 - RNA, 25 nt, Human
uacaccaauaguuaagauuaccaaa

SEQ ID NO: 335095 - RNA, 20 nt, Human
uacauuuguaaaucggaaac

SEQ ID NO: 335096 - RNA, 20 nt, Human
uaccagaaaaagguacugca

SEQ ID NO: 335097 - RNA, 24 nt, Human
uaguuugaggucuauugcuuuuaa

SEQ ID NO: 335098 - RNA, 27 nt, Human
uaucauauuccuucaauaguuugaggu

SEQ ID NO: 335099 - RNA, 23 nt, Human
ucaauuucuaucaucagaaccaa

SEQ ID NO: 335100 - RNA, 19 nt, Human
ucaggaguacauaaacaca

SEQ ID NO: 335101 - RNA, 23 nt, Human
ucaggcccgcagcagucgccacu

SEQ ID NO: 335102 - RNA, 23 nt, Human
ucccgaggcgcgugagaccagcg

SEQ ID NO: 335103 - RNA, 19 nt, Human
ugcaaaccagugacgcagc

SEQ ID NO: 335104 - RNA, 19 nt, Human
uuucugcuacaaaauuuac

SEQ ID NO: 335105 - RNA, 21 nt, Human
uuucugcuacaaaauuuacca

SEQ ID NO: 335106 - RNA, 23 nt, Human
aaaaauuucucaacaauuuauaa

SEQ ID NO: 335107 - RNA, 18 nt, Human
aaacacugaaagcaccac

SEQ ID NO: 335108 - RNA, 19 nt, Human
aaacacugaaagcaccacu

SEQ ID NO: 335109 - RNA, 20 nt, Human
aaccugauuagguucaagcc

SEQ ID NO: 335110 - RNA, 19 nt, Human
aagagccuggaaagacacc

SEQ ID NO: 335111 - RNA, 24 nt, Human
aagcagcggcguagccggcggaaa

SEQ ID NO: 335112 - RNA, 24 nt, Human
aagcagcggcguagccggcggagg

SEQ ID NO: 335113 - RNA, 25 nt, Human
aagcgauucuccagccucagccucc

SEQ ID NO: 335114 - RNA, 24 nt, Human
accaaagugcaaagucaguucccc

SEQ ID NO: 335115 - RNA, 22 nt, Human
accuggcucccgagacgcgugc

SEQ ID NO: 335116 - RNA, 24 nt, Human
acugugacgaaccugcguucugcc

SEQ ID NO: 335117 - RNA, 21 nt, Human
acuuccucucauugcagaaac

SEQ ID NO: 335118 - RNA, 24 nt, Human
agacaccaugaaaucaccucaacu

SEQ ID NO: 335119 - RNA, 22 nt, Human
agagacaaggucucgcucuguu

SEQ ID NO: 335120 - RNA, 24 nt, Human
agcggcguagccggcggaggccca

SEQ ID NO: 335121 - RNA, 24 nt, Human
aggaaagugccugcaagccacuga

SEQ ID NO: 335122 - RNA, 22 nt, Human
aggaacugugaagauguagccg

SEQ ID NO: 335123 - RNA, 25 nt, Human
aggugucaaaggcaaguaacacuuc

SEQ ID NO: 335124 - RNA, 18 nt, Human
augcacaggugucaaagg

SEQ ID NO: 335125 - RNA, 21 nt, Human
auucugcagucugguuccaaa

SEQ ID NO: 335126 - RNA, 21 nt, Human
caaaaacacugaaagcaccac

SEQ ID NO: 335127 - RNA, 21 nt, Human
caaaaacacugaaagcaccac

SEQ ID NO: 335128 - RNA, 23 nt, Human
caaacucaacauaucagcagcaa

SEQ ID NO: 335129 - RNA, 23 nt, Human
caaccuaucgaaguccaaaccaa

SEQ ID NO: 335130 - RNA, 18 nt, Human
caagagccuggaaagaca

SEQ ID NO: 335131 - RNA, 23 nt, Human
caagaggaaagugccugcaagcc

SEQ ID NO: 335132 - RNA, 25 nt, Human
cacaccuggccuugaaacauuauuu

SEQ ID NO: 335133 - RNA, 22 nt, Human
caccccuccauucugcagucug

SEQ ID NO: 335134 - RNA, 18 nt, Human
cacuuuuaccaacaaagc

SEQ ID NO: 335135 - RNA, 20 nt, Human
cagcaugcaugggagaucac

SEQ ID NO: 335136 - RNA, 22 nt, Human
cagccucagccucccaaaguag

SEQ ID NO: 335137 - RNA, 23 nt, Human
cagcggcguagccggcggaggcc

SEQ ID NO: 335138 - RNA, 23 nt, Human
ccaaaaacacugaaagcaccagu

SEQ ID NO: 335139 - RNA, 21 nt, Human
ccacccaguggccaguugugu

SEQ ID NO: 335140 - RNA, 20 nt, Human
ccccgcagcagucgccacuu

SEQ ID NO: 335141 - RNA, 20 nt, Human
ccccgcagcagucgccacuu

SEQ ID NO: 335142 - RNA, 19 nt, Human
cccgagcuggagugcagug

SEQ ID NO: 335143 - RNA, 20 nt, Human
ccgcagcagucgccacuucc

SEQ ID NO: 335144 - RNA, 20 nt, Human
ccgcagcagucgccacuucc

SEQ ID NO: 335145 - RNA, 19 nt, Human
ccugagguuccagagaagu

SEQ ID NO: 335146 - RNA, 23 nt, Human
cgacgucggcgcuccagcugcac

SEQ ID NO: 335147 - RNA, 23 nt, Human
cgccaaccuggcucccgagacgc

SEQ ID NO: 335148 - RNA, 23 nt, Human
cuccagccucagccucccaaagu

SEQ ID NO: 335149 - RNA, 19 nt, Human
cuccagcugcacucggccg

SEQ ID NO: 335150 - RNA, 26 nt, Human
cucccgagacgcgugcgagcaccgcu

SEQ ID NO: 335151 - RNA, 26 nt, Human
cucccgagacgcgugcgagcaccgcu

SEQ ID NO: 335152 - RNA, 20 nt, Human
cuggcucccgagacgcgugc

SEQ ID NO: 335153 - RNA, 25 nt, Human
cuucauagccccuuaacaugucacu

SEQ ID NO: 335154 - RNA, 18 nt, Human
gaaagaaaauuaagagua

SEQ ID NO: 335155 - RNA, 21 nt, Human
gaacacuaucugccaaaaaca

SEQ ID NO: 335156 - RNA, 24 nt, Human
gagugcagugguacaaucacagcu

SEQ ID NO: 335157 - RNA, 22 nt, Human
gccaaccuggcucccgagacgc

SEQ ID NO: 335158 - RNA, 23 nt, Human
gccucaagcgauucuccagccuc

SEQ ID NO: 335159 - RNA, 24 nt, Human
gcgauucuccagccucagccuccc

SEQ ID NO: 335160 - RNA, 27 nt, Human
gcuccagcugcacucggccgggcucgu

SEQ ID NO: 335161 - RNA, 19 nt, Human
ggaaaauggagaggauucu

SEQ ID NO: 335162 - RNA, 21 nt, Human
ggaaagacgagauauaugaga

SEQ ID NO: 335163 - RNA, 22 nt, Human
ggaacacuaucugccaaaaaca

SEQ ID NO: 335164 - RNA, 21 nt, Human
ggagaggauucucaaaacaga

SEQ ID NO: 335165 - RNA, 21 nt, Human
ggaucuagucauuaaaacaua

SEQ ID NO: 335166 - RNA, 19 nt, Human
ggugauggucucucaguuc

SEQ ID NO: 335167 - RNA, 22 nt, Human
uaaaacauaugcacagguguca

SEQ ID NO: 335168 - RNA, 25 nt, Human
uaaacuguauuuuaacuuagcacaa

SEQ ID NO: 335169 - RNA, 20 nt, Human
uaaaugcaaacauauauaca

SEQ ID NO: 335170 - RNA, 24 nt, Human
uacucauagucaguguuacacuag

SEQ ID NO: 335171 - RNA, 21 nt, Human
uacugccgagaaaugggcggg

SEQ ID NO: 335172 - RNA, 24 nt, Human
uagaaguauuccuuccaucaaccu

SEQ ID NO: 335173 - RNA, 22 nt, Human
uagagacaaggucucgcucugu

SEQ ID NO: 335174 - RNA, 24 nt, Human
uauguaaaugcaaacauauauaca

SEQ ID NO: 335175 - RNA, 26 nt, Human
uauguaaaugcaaacauauauacaca

SEQ ID NO: 335176 - RNA, 18 nt, Human
ucaugucggcucugaaau

SEQ ID NO: 335177 - RNA, 25 nt, Human
ucggaggaacugugaagauguagca

SEQ ID NO: 335178 - RNA, 19 nt, Human
ucggcgacgucggcgcucc

SEQ ID NO: 335179 - RNA, 24 nt, Human
ucucgcucuguuccccgagcugga

SEQ ID NO: 335180 - RNA, 19 nt, Human
ucuguaaaucugaccuugc

SEQ ID NO: 335181 - RNA, 20 nt, Human
ucuguguaaccaaagugcaa

SEQ ID NO: 335182 - RNA, 22 nt, Human
ugaaaucaccucaacucaagug

SEQ ID NO: 335183 - RNA, 25 nt, Human
ugaagcagcggcguagccggcggag

SEQ ID NO: 335184 - RNA, 24 nt, Human
ugagggugucuugacaugaucuua

SEQ ID NO: 335185 - RNA, 21 nt, Human
ugagugauauagucacuguug

SEQ ID NO: 335186 - RNA, 23 nt, Human
uggaacacuaucugccaaaaaca

SEQ ID NO: 335187 - RNA, 24 nt, Human
uggaacacuaucugccaaaaacac

SEQ ID NO: 335188 - RNA, 18 nt, Human
uggagugcagugguacaa

SEQ ID NO: 335189 - RNA, 19 nt, Human
uggagugcagugguacaau

SEQ ID NO: 335190 - RNA, 21 nt, Human
uggagugcagugguacaauca

SEQ ID NO: 335191 - RNA, 23 nt, Human
uggcagcaugcaugggagaucac

SEQ ID NO: 335192 - RNA, 24 nt, Human
ugggauuucaggcaugaaucacca

SEQ ID NO: 335193 - RNA, 20 nt, Human
ugggcggguccugagguucc

SEQ ID NO: 335194 - RNA, 22 nt, Human
ugguacaaucacagcucacuag

SEQ ID NO: 335195 - RNA, 22 nt, Human
uguaaccaaagugcaaagucag

SEQ ID NO: 335196 - RNA, 23 nt, Human
ugucaaaggcaaguaacacuacc

SEQ ID NO: 335197 - RNA, 21 nt, Human
uguuaugacauucguaagugg

SEQ ID NO: 335198 - RNA, 23 nt, Human
uuaaaauaaucauuacacuuccu

SEQ ID NO: 335199 - RNA, 20 nt, Human
uuagauccaaugcugaguga

SEQ ID NO: 335200 - RNA, 23 nt, Human
uucaagccacaaguucccacccc

SEQ ID NO: 335201 - RNA, 18 nt, Human
uucaguguccagagucuu

SEQ ID NO: 335202 - RNA, 18 nt, Human
uucaguguccagagucuu

SEQ ID NO: 335203 - RNA, 18 nt, Human
uucccaccccuccauucu

SEQ ID NO: 335204 - RNA, 18 nt, Human
uuccccgagcuggagugc

SEQ ID NO: 335205 - RNA, 24 nt, Human
uucgcuaguuaggucuguucuucu

SEQ ID NO: 335206 - RNA, 22 nt, Human
uuggaucuagucauuaaaacau

SEQ ID NO: 335207 - RNA, 27 nt, Human
uuuuuuuuuuuuuuuuuuuuuuugggg

SEQ ID NO: 335208 - RNA, 21 nt, Human
aaaauauacacccccaaucag

SEQ ID NO: 335209 - RNA, 24 nt, Human
aaaccaaaacaaagccuucgaaaa

SEQ ID NO: 335210 - RNA, 21 nt, Human
aaaggaggggagggaggaaau

SEQ ID NO: 335211 - RNA, 20 nt, Human
aaauauacacccccaaucag

SEQ ID NO: 335212 - RNA, 21 nt, Human
aacaaguagucccccaaccuc

SEQ ID NO: 335213 - RNA, 19 nt, Human
aagcagcagccuggugugc

SEQ ID NO: 335214 - RNA, 22 nt, Human
aagcagcagccuggugugcagc

SEQ ID NO: 335215 - RNA, 18 nt, Human
aauguaguucccaaauac

SEQ ID NO: 335216 - RNA, 21 nt, Human
acaaguagucccccaaccuca

SEQ ID NO: 335217 - RNA, 19 nt, Human
acacugugguauguggggg

SEQ ID NO: 335218 - RNA, 20 nt, Human
acagggccccaacuccucau

SEQ ID NO: 335219 - RNA, 18 nt, Human
acaguggaggggccuccg

SEQ ID NO: 335220 - RNA, 20 nt, Human
acaugaaggacagacaggcu

SEQ ID NO: 335221 - RNA, 22 nt, Human
accccaugacuuggccuggagg

SEQ ID NO: 335222 - RNA, 18 nt, Human
acccccaaucagagaggg

SEQ ID NO: 335223 - RNA, 22 nt, Human
acguggcggggcgccggcagac

SEQ ID NO: 335224 - RNA, 21 nt, Human
acugccuguucugggaccagc

SEQ ID NO: 335225 - RNA, 25 nt, Human
agacgggagucaggggacccugggg

SEQ ID NO: 335226 - RNA, 22 nt, Human
agccaggggcucuggcuggacc

SEQ ID NO: 335227 - RNA, 24 nt, Human
agcccccggccucucuccacccag

SEQ ID NO: 335228 - RNA, 22 nt, Human
agccccuggcccuggacugucc

SEQ ID NO: 335229 - RNA, 18 nt, Human
aggcacauuuugcaccug

SEQ ID NO: 335230 - RNA, 18 nt, Human
aggcaguucccgagucug

SEQ ID NO: 335231 - RNA, 21 nt, Human
aggcaguucccgagucugcuu

SEQ ID NO: 335232 - RNA, 24 nt, Human
aggcauugcuggacucauuuuucu

SEQ ID NO: 335233 - RNA, 20 nt, Human
aggccagaaccacagguggg

SEQ ID NO: 335234 - RNA, 23 nt, Human
aggccagaaccacagguggggga

SEQ ID NO: 335235 - RNA, 18 nt, Human
aggcggccuucccagugc

SEQ ID NO: 335236 - RNA, 22 nt, Human
aggcggcugccgacucagccag

SEQ ID NO: 335237 - RNA, 21 nt, Human
agggagggggguuuggggggc

SEQ ID NO: 335238 - RNA, 24 nt, Human
aggggacccuggggacccuuccag

SEQ ID NO: 335239 - RNA, 23 nt, Human
aggggcucuggcuggacccagag

SEQ ID NO: 335240 - RNA, 23 nt, Human
agugcauucacaggcagcuaccu

SEQ ID NO: 335241 - RNA, 24 nt, Human
agugucuacacucguacgagcagc

SEQ ID NO: 335242 - RNA, 22 nt, Human
auacaaauuuguugcuggaggc

SEQ ID NO: 335243 - RNA, 23 nt, Human
aucucguuguacucgucacuagc

SEQ ID NO: 335244 - RNA, 19 nt, Human
augcagcagugucagggga

SEQ ID NO: 335245 - RNA, 23 nt, Human
caaaacagccaugcugaggaagu

SEQ ID NO: 335246 - RNA, 18 nt, Human
caacagcgggaagcaguu

SEQ ID NO: 335247 - RNA, 20 nt, Human
caccuggacgcugccggugg

SEQ ID NO: 335248 - RNA, 22 nt, Human
caccuggacgcugccggugggg

SEQ ID NO: 335249 - RNA, 23 nt, Human
cagaaggcggccuucccagugcc

SEQ ID NO: 335250 - RNA, 19 nt, Human
cagagggcuggcugcuccc

SEQ ID NO: 335251 - RNA, 19 nt, Human
cagaugggacaaggacccu

SEQ ID NO: 335252 - RNA, 22 nt, Human
cagcccccgccgucggcagcuc

SEQ ID NO: 335253 - RNA, 21 nt, Human
cagcccccggccucucuccac

SEQ ID NO: 335254 - RNA, 18 nt, Human
cagccccugggcucuucc

SEQ ID NO: 335255 - RNA, 18 nt, Human
cagcuuaacucugucccu

SEQ ID NO: 335256 - RNA, 22 nt, Human
caggcacucuccaggccuagga

SEQ ID NO: 335257 - RNA, 20 nt, Human
cagggguggccuccugggac

SEQ ID NO: 335258 - RNA, 18 nt, Human
cagugugugaggguggug

SEQ ID NO: 335259 - RNA, 20 nt, Human
caugaaggacagacaggcug

SEQ ID NO: 335260 - RNA, 18 nt, Human
ccacaaaggcagggcccc

SEQ ID NO: 335261 - RNA, 19 nt, Human
ccacaaaggcagggcccca

SEQ ID NO: 335262 - RNA, 21 nt, Human
ccaccacugcccacuuuucug

SEQ ID NO: 335263 - RNA, 21 nt, Human
ccacugcuggggacagucugg

SEQ ID NO: 335264 - RNA, 25 nt, Human
ccaggcaaauguauggguacccaug

SEQ ID NO: 335265 - RNA, 25 nt, Human
ccagugugugagggugguguugagg

SEQ ID NO: 335266 - RNA, 20 nt, Human
cccccaagcugggcgggggu

SEQ ID NO: 335267 - RNA, 22 nt, Human
cccccaagcugggcgggggucc

SEQ ID NO: 335268 - RNA, 21 nt, Human
ccccccaagcugggcgggggu

SEQ ID NO: 335269 - RNA, 22 nt, Human
cccccgcuucauucccuuugga

SEQ ID NO: 335270 - RNA, 18 nt, Human
ccccugccugcccccagg

SEQ ID NO: 335271 - RNA, 20 nt, Human
cccgcccgaugcaccccgcc

SEQ ID NO: 335272 - RNA, 19 nt, Human
cccgugccaccacugccca

SEQ ID NO: 335273 - RNA, 26 nt, Human
cccguggaccccugccugcccccagg

SEQ ID NO: 335274 - RNA, 23 nt, Human
cccugugcccaggggaccuccuc

SEQ ID NO: 335275 - RNA, 23 nt, Human
cccuugcaggcuagacuuugcag

SEQ ID NO: 335276 - RNA, 23 nt, Human
ccggugaugacuuccacuuuuuc

SEQ ID NO: 335277 - RNA, 25 nt, Human
ccuauaguuggggagcccugggcag

SEQ ID NO: 335278 - RNA, 23 nt, Human
ccucagaggccagaaccacaggu

SEQ ID NO: 335279 - RNA, 21 nt, Human
ccucguuuaauuuuggggggc

SEQ ID NO: 335280 - RNA, 23 nt, Human
ccucugaagucccaaagaggccc

SEQ ID NO: 335281 - RNA, 19 nt, Human
ccugcuaacuggggcgaac

SEQ ID NO: 335282 - RNA, 23 nt, Human
ccugcucagacagccucucuuua

SEQ ID NO: 335283 - RNA, 23 nt, Human
ccuggcccuggacuguccugggg

SEQ ID NO: 335284 - RNA, 23 nt, Human
ccuguggcuggggaagggauggc

SEQ ID NO: 335285 - RNA, 22 nt, Human
cgaggacucagacccugacucg

SEQ ID NO: 335286 - RNA, 20 nt, Human
cgccuuuggcugcggagcuu

SEQ ID NO: 335287 - RNA, 19 nt, Human
cgcugcugcuccuugggcu

SEQ ID NO: 335288 - RNA, 22 nt, Human
cgggcacugcccccgugcaguc

SEQ ID NO: 335289 - RNA, 24 nt, Human
cguacaggcacauuuugcaccugu

SEQ ID NO: 335290 - RNA, 19 nt, Human
cucaacgcucgagagcauc

SEQ ID NO: 335291 - RNA, 20 nt, Human
cucacagaagccccuggccc

SEQ ID NO: 335292 - RNA, 21 nt, Human
cuccucaagugcacacaccuc

SEQ ID NO: 335293 - RNA, 18 nt, Human
cuccugggacgaggacuc

SEQ ID NO: 335294 - RNA, 23 nt, Human
cuccuugggcuucuggcuuggca

SEQ ID NO: 335295 - RNA, 21 nt, Human
cucuggcuggacccagaggcc

SEQ ID NO: 335296 - RNA, 22 nt, Human
cugcccaaauacaaaggcuugc

SEQ ID NO: 335297 - RNA, 18 nt, Human
cuggaggaaccuggggug

SEQ ID NO: 335298 - RNA, 20 nt, Human
cuguccugggggcagggaca

SEQ ID NO: 335299 - RNA, 22 nt, Human
cugugaauuaauccaguuagca

SEQ ID NO: 335300 - RNA, 23 nt, Human
cugugcagcauccccggcagccu

SEQ ID NO: 335301 - RNA, 24 nt, Human
cuugcacugcaucuguaacacauu

SEQ ID NO: 335302 - RNA, 24 nt, Human
cuuucucagggguggccuccuggg

SEQ ID NO: 335303 - RNA, 18 nt, Human
gacagauggagacgggag

SEQ ID NO: 335304 - RNA, 18 nt, Human
gaccuaggaacagaaggc

SEQ ID NO: 335305 - RNA, 23 nt, Human
gacgugugacugggucucucggg

SEQ ID NO: 335306 - RNA, 25 nt, Human
gagcacacacugacacagagggcac

SEQ ID NO: 335307 - RNA, 20 nt, Human
gcacgcuccgcugcugcucc

SEQ ID NO: 335308 - RNA, 20 nt, Human
gcagcuucggaaggacuucu

SEQ ID NO: 335309 - RNA, 19 nt, Human
gcaguucccgagucugcuu

SEQ ID NO: 335310 - RNA, 23 nt, Human
gcauaguccccagcccuccccau

SEQ ID NO: 335311 - RNA, 22 nt, Human
gcccaaauacaaaggcuugcug

SEQ ID NO: 335312 - RNA, 18 nt, Human
gccccccaagcugggcgg

SEQ ID NO: 335313 - RNA, 18 nt, Human
gcccugggcaggggcaga

SEQ ID NO: 335314 - RNA, 18 nt, Human
gccuggaggaaccugggg

SEQ ID NO: 335315 - RNA, 23 nt, Human
gcgccgcuggaaugcagccaccc

SEQ ID NO: 335316 - RNA, 19 nt, Human
gcuccaggcucgggugggc

SEQ ID NO: 335317 - RNA, 22 nt, Human
gcucgagagcaucuuaaccuaa

SEQ ID NO: 335318 - RNA, 21 nt, Human
gcugcuccccacaaaggcagg

SEQ ID NO: 335319 - RNA, 23 nt, Human
gcugcuccuugggcuucuggcuu

SEQ ID NO: 335320 - RNA, 19 nt, Human
ggaacguggccaggcaaau

SEQ ID NO: 335321 - RNA, 24 nt, Human
ggaauugcauaguccccagcccuc

SEQ ID NO: 335322 - RNA, 18 nt, Human
ggacccagaggcuggcga

SEQ ID NO: 335323 - RNA, 21 nt, Human
ggagccagugugugagggugg

SEQ ID NO: 335324 - RNA, 18 nt, Human
ggaggaaccugggguggg

SEQ ID NO: 335325 - RNA, 21 nt, Human
gggaccuccuccucggccucc

SEQ ID NO: 335326 - RNA, 23 nt, Human
gggcacaguggaggggccuccgc

SEQ ID NO: 335327 - RNA, 21 nt, Human
gggcaggggcagagggcuggc

SEQ ID NO: 335328 - RNA, 22 nt, Human
gggcuucuggcuuggcagaccu

SEQ ID NO: 335329 - RNA, 18 nt, Human
gggugggaaggguguggg

SEQ ID NO: 335330 - RNA, 18 nt, Human
gugcagccgggcucccgg

SEQ ID NO: 335331 - RNA, 19 nt, Human
guggcggagaagccagggg

SEQ ID NO: 335332 - RNA, 18 nt, Human
gugggaagggugugggug

SEQ ID NO: 335333 - RNA, 23 nt, Human
guggggugggggcgggugggcgg

SEQ ID NO: 335334 - RNA, 22 nt, Human
guggggugggggcggguugacg

SEQ ID NO: 335335 - RNA, 24 nt, Human
guggugcaagcuggcucuuggcca

SEQ ID NO: 335336 - RNA, 18 nt, Human
guuguacucgucacuagc

SEQ ID NO: 335337 - RNA, 22 nt, Human
uaaacugaagagaagaugugca

SEQ ID NO: 335338 - RNA, 22 nt, Human
uaacagcacguccaaugggccc

SEQ ID NO: 335339 - RNA, 21 nt, Human
uaaccuaagaaaccaaaacaa

SEQ ID NO: 335340 - RNA, 19 nt, Human
uaagaaaccaaaacaaagc

SEQ ID NO: 335341 - RNA, 22 nt, Human
uagggucaggaucucccccgcu

SEQ ID NO: 335342 - RNA, 19 nt, Human
uaguccccagcccucccca

SEQ ID NO: 335343 - RNA, 19 nt, Human
uaucauaaaccugccacuu

SEQ ID NO: 335344 - RNA, 22 nt, Human
ucaacagucaaguggagacugu

SEQ ID NO: 335345 - RNA, 21 nt, Human
ucacaaggguagggucaggau

SEQ ID NO: 335346 - RNA, 20 nt, Human
ucacagaagccccuggcccc

SEQ ID NO: 335347 - RNA, 26 nt, Human
ucagaaaaucagcuuaaaaacuucca

SEQ ID NO: 335348 - RNA, 22 nt, Human
ucagccagggacucuuucucag

SEQ ID NO: 335349 - RNA, 26 nt, Human
ucaggaucucccccgcuucauucccu

SEQ ID NO: 335350 - RNA, 18 nt, Human
ucccaaagaggcccugug

SEQ ID NO: 335351 - RNA, 19 nt, Human
ucccccucugccucucaca

SEQ ID NO: 335352 - RNA, 19 nt, Human
ucccgugccaccacugccc

SEQ ID NO: 335353 - RNA, 24 nt, Human
ucggaaggacuucuccaugcagca

SEQ ID NO: 335354 - RNA, 22 nt, Human
ucucacagaagccccuggcccu

SEQ ID NO: 335355 - RNA, 20 nt, Human
ucucagggguggccuccugg

SEQ ID NO: 335356 - RNA, 24 nt, Human
ucucucgggagggccucugguucu

SEQ ID NO: 335357 - RNA, 22 nt, Human
ugaacacacgacgcucacaguc

SEQ ID NO: 335358 - RNA, 21 nt, Human
ugacacagagggcacagugga

SEQ ID NO: 335359 - RNA, 18 nt, Human
ugaccccuggcaucccau

SEQ ID NO: 335360 - RNA, 22 nt, Human
ugacugggucucucgggagggc

SEQ ID NO: 335361 - RNA, 19 nt, Human
ugacuuggccuggaggaac

SEQ ID NO: 335362 - RNA, 28 nt, Human
ugagcagcccccggccucucuccaccca

SEQ ID NO: 335363 - RNA, 21 nt, Human
ugagggucccccucugccucu

SEQ ID NO: 335364 - RNA, 20 nt, Human
ugagggugguguugagggcu

SEQ ID NO: 335365 - RNA, 24 nt, Human
ugaggucuuuuuuuaacagcuggc

SEQ ID NO: 335366 - RNA, 19 nt, Human
ugcagccgggcucccggcc

SEQ ID NO: 335367 - RNA, 20 nt, Human
ugcagggagggggguuuggg

SEQ ID NO: 335368 - RNA, 24 nt, Human
ugcagggagggggguuuggggggc

SEQ ID NO: 335369 - RNA, 23 nt, Human
ugccaccacugcccacuuuucug

SEQ ID NO: 335370 - RNA, 23 nt, Human
ugccccuugcaggcuagacuuug

SEQ ID NO: 335371 - RNA, 19 nt, Human
ugcccguggaccccugccu

SEQ ID NO: 335372 - RNA, 21 nt, Human
ugcccguggaccccugccugc

SEQ ID NO: 335373 - RNA, 19 nt, Human
ugccgacucagccagggac

SEQ ID NO: 335374 - RNA, 18 nt, Human
ugccgguggggugggggc

SEQ ID NO: 335375 - RNA, 20 nt, Human
ugccgguggggugggggcga

SEQ ID NO: 335376 - RNA, 21 nt, Human
ugccugcccccaggcgcuuca

SEQ ID NO: 335377 - RNA, 24 nt, Human
ugcuaacuggggcgaacacugugg

SEQ ID NO: 335378 - RNA, 23 nt, Human
ugcugcuccuugggcuucuggcu

SEQ ID NO: 335379 - RNA, 18 nt, Human
ugcugggaggcugacccc

SEQ ID NO: 335380 - RNA, 18 nt, Human
ugcugggaggcugacccc

SEQ ID NO: 335381 - RNA, 23 nt, Human
ugcuggggacagucugggacagc

SEQ ID NO: 335382 - RNA, 19 nt, Human
ugcugggggcugggggcag

SEQ ID NO: 335383 - RNA, 23 nt, Human
ugcugggggcugggggcagggcu

SEQ ID NO: 335384 - RNA, 20 nt, Human
ugcuguguggcggggucuuu

SEQ ID NO: 335385 - RNA, 18 nt, Human
uggaccccugccugcccc

SEQ ID NO: 335386 - RNA, 18 nt, Human
uggacggcacagcugcag

SEQ ID NO: 335387 - RNA, 21 nt, Human
uggccggcccaguggggugug

SEQ ID NO: 335388 - RNA, 21 nt, Human
uggcggagaagccaggggcuc

SEQ ID NO: 335389 - RNA, 23 nt, Human
uggcuaaggcuuaaagcagagac

SEQ ID NO: 335390 - RNA, 24 nt, Human
uggcugcggagcuuguaacacugg

SEQ ID NO: 335391 - RNA, 23 nt, Human
uggcugcuccccacaaaggcagg

SEQ ID NO: 335392 - RNA, 25 nt, Human
uggcuggggaagggauggccaacag

SEQ ID NO: 335393 - RNA, 19 nt, Human
ugggaaacaaguagucccc

SEQ ID NO: 335394 - RNA, 18 nt, Human
ugggaaaugaagauagua

SEQ ID NO: 335395 - RNA, 20 nt, Human
ugggaaggguguggguggcg

SEQ ID NO: 335396 - RNA, 23 nt, Human
ugggaggcugaccccguuggugc

SEQ ID NO: 335397 - RNA, 20 nt, Human
ugggcacaggcguccacucc

SEQ ID NO: 335398 - RNA, 20 nt, Human
ugggcaggggcagagggcug

SEQ ID NO: 335399 - RNA, 21 nt, Human
ugggcaggggcagagggcugg

SEQ ID NO: 335400 - RNA, 21 nt, Human
ugggcuucuggcuuggcagac

SEQ ID NO: 335401 - RNA, 21 nt, Human
ugggggcagggacaccugugg

SEQ ID NO: 335402 - RNA, 18 nt, Human
ugggggcgggugggcggg

SEQ ID NO: 335403 - RNA, 20 nt, Human
uggggugggggcgggugggc

SEQ ID NO: 335404 - RNA, 20 nt, Human
uggggugugugguucccggc

SEQ ID NO: 335405 - RNA, 18 nt, Human
ugggugcagggagggggg

SEQ ID NO: 335406 - RNA, 18 nt, Human
uguccugggggcagggac

SEQ ID NO: 335407 - RNA, 22 nt, Human
ugugggggccagaacaugaagg

SEQ ID NO: 335408 - RNA, 21 nt, Human
uguggguggcggagaagccag

SEQ ID NO: 335409 - RNA, 21 nt, Human
uucaaaggaggggagggagga

SEQ ID NO: 335410 - RNA, 23 nt, Human
uucccagugcccguggaccccug

SEQ ID NO: 335411 - RNA, 23 nt, Human
uucccggccccgcaccuggacgc

SEQ ID NO: 335412 - RNA, 24 nt, Human
uucccuguuggcaucugaacugac

SEQ ID NO: 335413 - RNA, 22 nt, Human
uucugggaccagccccugggcu

SEQ ID NO: 335414 - RNA, 19 nt, Human
uugaacaggacgugcgggu

SEQ ID NO: 335415 - RNA, 28 nt, Human
uugaacaggacgugcgggucggacuucc

SEQ ID NO: 335416 - RNA, 24 nt, Human
uugcaccuguuuuucaaaacagcc

SEQ ID NO: 335417 - RNA, 23 nt, Human
uugcuggacucauuuuucugggg

SEQ ID NO: 335418 - RNA, 19 nt, Human
uugcuggaggcgucggcac

SEQ ID NO: 335419 - RNA, 21 nt, Human
uugcuguguggcggggucuuu

SEQ ID NO: 335420 - RNA, 21 nt, Human
uuuaacagcuggccaggagau

SEQ ID NO: 335421 - RNA, 20 nt, Human
uuucaaaacagccaugcuga

SEQ ID NO: 335422 - RNA, 21 nt, Human
uuuugcaccuguuuuucaaaa

SEQ ID NO: 335423 - RNA, 27 nt, Human
uuuuuuuuuuuuuuuuuuuuuucgggg

SEQ ID NO: 335424 - RNA, 19 nt, Human
aaaaagaaaagcugccuuc

SEQ ID NO: 335425 - RNA, 21 nt, Human
aaaaagaaaagcugccuucau

SEQ ID NO: 335426 - RNA, 23 nt, Human
aaagaaaagcugccuucaugaca

SEQ ID NO: 335427 - RNA, 26 nt, Human
aagguaccucccaucccccccacccc

SEQ ID NO: 335428 - RNA, 20 nt, Human
acagugucacuuugaagcuu

SEQ ID NO: 335429 - RNA, 23 nt, Human
agguaccucccaucccccccacc

SEQ ID NO: 335430 - RNA, 19 nt, Human
auggacccgccgcgcuccg

SEQ ID NO: 335431 - RNA, 22 nt, Human
cacacagcaggaaagaaagaga

SEQ ID NO: 335432 - RNA, 23 nt, Human
cagaaaaagaaaagcugccuuca

SEQ ID NO: 335433 - RNA, 22 nt, Human
cagcaggaaagaaagagauaac

SEQ ID NO: 335434 - RNA, 24 nt, Human
ccacccccaaaaucccgcugauuu

SEQ ID NO: 335435 - RNA, 20 nt, Human
cccacccccaaaaucccgcu

SEQ ID NO: 335436 - RNA, 20 nt, Human
cccaucccccccacccccaa

SEQ ID NO: 335437 - RNA, 20 nt, Human
cccccacccccaaaaucccc

SEQ ID NO: 335438 - RNA, 20 nt, Human
cccccccacccccaaaaucc

SEQ ID NO: 335439 - RNA, 24 nt, Human
cccccccacccccaaaaucccgcu

SEQ ID NO: 335440 - RNA, 20 nt, Human
ccccucguuucagauuucca

SEQ ID NO: 335441 - RNA, 25 nt, Human
cccgccgcgcuccgcagcggcaacc

SEQ ID NO: 335442 - RNA, 18 nt, Human
cccgcugauuucuuuucc

SEQ ID NO: 335443 - RNA, 23 nt, Human
ccucccaucccccccacccccaa

SEQ ID NO: 335444 - RNA, 24 nt, Human
ccucccaucccccccacccccaaa

SEQ ID NO: 335445 - RNA, 28 nt, Human
cuacaagcacacagcaggaaggguuucc

SEQ ID NO: 335446 - RNA, 19 nt, Human
cucccaucccccccacccc

SEQ ID NO: 335447 - RNA, 22 nt, Human
cucccaucccccccacccccaa

SEQ ID NO: 335448 - RNA, 19 nt, Human
cuggaaccacuacuaggag

SEQ ID NO: 335449 - RNA, 19 nt, Human
gguuguuguuucuuuuguc

SEQ ID NO: 335450 - RNA, 18 nt, Human
uaacaugaaccaguucug

SEQ ID NO: 335451 - RNA, 23 nt, Human
uaccucccaucccccccaccccc

SEQ ID NO: 335452 - RNA, 19 nt, Human
ucccaucccccccaccccc

SEQ ID NO: 335453 - RNA, 23 nt, Human
ucccaucccccccacccccaaaa

SEQ ID NO: 335454 - RNA, 21 nt, Human
ucccccccacccccaaaaucc

SEQ ID NO: 335455 - RNA, 18 nt, Human
ugccuucaugacaucccc

SEQ ID NO: 335456 - RNA, 20 nt, Human
aacuuguccuucgggcucca

SEQ ID NO: 335457 - RNA, 18 nt, Human
aacuuguuccauuuccuu

SEQ ID NO: 335458 - RNA, 18 nt, Human
aacuuguuccauuuccuu

SEQ ID NO: 335459 - RNA, 21 nt, Human
aagcgacaaaaaccugucccc

SEQ ID NO: 335460 - RNA, 20 nt, Human
acaaacacaacuuguuccau

SEQ ID NO: 335461 - RNA, 23 nt, Human
acaauauaagugugagcucuuga

SEQ ID NO: 335462 - RNA, 22 nt, Human
acuuguuccauuuccuuccccu

SEQ ID NO: 335463 - RNA, 21 nt, Human
aggcagcggcgucucuuguuc

SEQ ID NO: 335464 - RNA, 18 nt, Human
aggcagggggaggcgggg

SEQ ID NO: 335465 - RNA, 18 nt, Human
aggcagggggaggcgggg

SEQ ID NO: 335466 - RNA, 20 nt, Human
aggcagggggaggcgggggc

SEQ ID NO: 335467 - RNA, 20 nt, Human
aggcagggggaggcgggggc

SEQ ID NO: 335468 - RNA, 21 nt, Human
agggggccgcggcgcugcugc

SEQ ID NO: 335469 - RNA, 18 nt, Human
caacuccuucuccugcuc

SEQ ID NO: 335470 - RNA, 19 nt, Human
cccgccaccagagcugggg

SEQ ID NO: 335471 - RNA, 19 nt, Human
cccgcugcaaggcccgggg

SEQ ID NO: 335472 - RNA, 20 nt, Human
cccuccagccgggccggggc

SEQ ID NO: 335473 - RNA, 21 nt, Human
cccucucuccccccuccccca

SEQ ID NO: 335474 - RNA, 20 nt, Human
ccgaggcagcggcgucucuu

SEQ ID NO: 335475 - RNA, 24 nt, Human
ccgccgcugcaacuccuucuccug

SEQ ID NO: 335476 - RNA, 23 nt, Human
ccgcugaggcagggggaggcggg

SEQ ID NO: 335477 - RNA, 19 nt, Human
cgcuggcgggggcagccgc

SEQ ID NO: 335478 - RNA, 20 nt, Human
cuccagccgggccggggccc

SEQ ID NO: 335479 - RNA, 22 nt, Human
cuccaggaccgaggcagcggcg

SEQ ID NO: 335480 - RNA, 18 nt, Human
cugcugcccgccaccaga

SEQ ID NO: 335481 - RNA, 20 nt, Human
cugcugcccgccaccagagc

SEQ ID NO: 335482 - RNA, 20 nt, Human
gaagggggccgcggcgcugc

SEQ ID NO: 335483 - RNA, 22 nt, Human
gagcuggggucggggccccucc

SEQ ID NO: 335484 - RNA, 19 nt, Human
gcagggggaggcgggggcg

SEQ ID NO: 335485 - RNA, 18 nt, Human
gccgggccggggcccgcu

SEQ ID NO: 335486 - RNA, 19 nt, Human
ggaggcgggggcgacggcg

SEQ ID NO: 335487 - RNA, 21 nt, Human
ggcugcugguauuggaugcgu

SEQ ID NO: 335488 - RNA, 19 nt, Human
guaaagcgacaaaaaccug

SEQ ID NO: 335489 - RNA, 21 nt, Human
guaaagcgacaaaaaccuguc

SEQ ID NO: 335490 - RNA, 22 nt, Human
uaugccacaauauaagugugag

SEQ ID NO: 335491 - RNA, 19 nt, Human
uauuuaacucuuagacaac

SEQ ID NO: 335492 - RNA, 24 nt, Human
ucagccgccgcugcaacuccuucu

SEQ ID NO: 335493 - RNA, 22 nt, Human
ucagggccgaguccccgugagg

SEQ ID NO: 335494 - RNA, 24 nt, Human
uccccccucccccacaaagaaggc

SEQ ID NO: 335495 - RNA, 18 nt, Human
ucggggccccuccagccg

SEQ ID NO: 335496 - RNA, 24 nt, Human
ucuaaauuucaaaucagcagagcu

SEQ ID NO: 335497 - RNA, 20 nt, Human
ucuuagacaacuaagagguu

SEQ ID NO: 335498 - RNA, 20 nt, Human
ugagagaggccgauguagcu

SEQ ID NO: 335499 - RNA, 22 nt, Human
ugcaaggcccgggggagcgggc

SEQ ID NO: 335500 - RNA, 18 nt, Human
ugcguggcucgaacugac

SEQ ID NO: 335501 - RNA, 18 nt, Human
uggcucgaacugacgcgg

SEQ ID NO: 335502 - RNA, 18 nt, Human
ugggguuuugccaugacc

SEQ ID NO: 335503 - RNA, 22 nt, Human
uguuccauuuccuuccccucuc

SEQ ID NO: 335504 - RNA, 21 nt, Human
aaaaaaagaacagccaaagag

SEQ ID NO: 335505 - RNA, 20 nt, Human
aaaaaagaacagccaaagag

SEQ ID NO: 335506 - RNA, 18 nt, Human
aaaaagaacagccaaaga

SEQ ID NO: 335507 - RNA, 22 nt, Human
aaaagaacagccaaagagcagg

SEQ ID NO: 335508 - RNA, 24 nt, Human
aaagaacagccaaagagcagggua

SEQ ID NO: 335509 - RNA, 23 nt, Human
aacaaugaaaacaacacaacaaa

SEQ ID NO: 335510 - RNA, 23 nt, Human
aacacaaugcuuagcacaaacaa

SEQ ID NO: 335511 - RNA, 22 nt, Human
aagaacagccaaagagcagggu

SEQ ID NO: 335512 - RNA, 24 nt, Human
aaggagcuucugccaaaggacagg

SEQ ID NO: 335513 - RNA, 21 nt, Human
aagggcuccaaaaaaagaaca

SEQ ID NO: 335514 - RNA, 21 nt, Human
acaaacaauacucaauaaaua

SEQ ID NO: 335515 - RNA, 27 nt, Human
acagagcaacagcagcgauggucagaa

SEQ ID NO: 335516 - RNA, 22 nt, Human
acagccaaagagcaggguaccc

SEQ ID NO: 335517 - RNA, 25 nt, Human
acagccaaagagcaggguacccaaa

SEQ ID NO: 335518 - RNA, 23 nt, Human
acgccgagcacuacuagaagagc

SEQ ID NO: 335519 - RNA, 25 nt, Human
agcacaaacaauacucaauaaauaa

SEQ ID NO: 335520 - RNA, 23 nt, Human
agccaaagagcaggguacccaaa

SEQ ID NO: 335521 - RNA, 23 nt, Human
aucuucuccuauuucuagauucu

SEQ ID NO: 335522 - RNA, 19 nt, Human
aucuugucgggaccaaaug

SEQ ID NO: 335523 - RNA, 24 nt, Human
caaaaaaagaacagccaaagagca

SEQ ID NO: 335524 - RNA, 21 nt, Human
caacaaaguggagucaaucca

SEQ ID NO: 335525 - RNA, 19 nt, Human
caacaaugaaaacaacaca

SEQ ID NO: 335526 - RNA, 24 nt, Human
caaugcaagaacucucuaaaguuc

SEQ ID NO: 335527 - RNA, 28 nt, Human
caaugcuuagcacaaacaauacucaaua

SEQ ID NO: 335528 - RNA, 18 nt, Human
caccgcagacgccucugc

SEQ ID NO: 335529 - RNA, 21 nt, Human
caccgcagacgccucugccgc

SEQ ID NO: 335530 - RNA, 21 nt, Human
cacugggccugcgcagcagca

SEQ ID NO: 335531 - RNA, 23 nt, Human
cagccaaagagcaggguacccaa

SEQ ID NO: 335532 - RNA, 21 nt, Human
ccaacaauggaucacuacuau

SEQ ID NO: 335533 - RNA, 19 nt, Human
cuccaaaaaaagaacagcc

SEQ ID NO: 335534 - RNA, 21 nt, Human
cuccaaaaaaagaacagccaa

SEQ ID NO: 335535 - RNA, 23 nt, Human
cuggcacacagagcucaacugac

SEQ ID NO: 335536 - RNA, 24 nt, Human
gagcaacagcagcgauggucagaa

SEQ ID NO: 335537 - RNA, 22 nt, Human
gagcgccuggcacacagagcuc

SEQ ID NO: 335538 - RNA, 19 nt, Human
gcagcagcagccgcggcgc

SEQ ID NO: 335539 - RNA, 19 nt, Human
gggaaaugacaaggguuug

SEQ ID NO: 335540 - RNA, 23 nt, Human
gucacaauuuuuuuuaaccaccu

SEQ ID NO: 335541 - RNA, 23 nt, Human
uaaccaaguaacauuauucuuaa

SEQ ID NO: 335542 - RNA, 18 nt, Human
uaacugccgaaugaucuu

SEQ ID NO: 335543 - RNA, 23 nt, Human
uaagaaggcggaaguagccucca

SEQ ID NO: 335544 - RNA, 18 nt, Human
uaaggaaaacugaggggu

SEQ ID NO: 335545 - RNA, 19 nt, Human
uaaggaaaacugaggggua

SEQ ID NO: 335546 - RNA, 18 nt, Human
uacccccucccgagcgcc

SEQ ID NO: 335547 - RNA, 22 nt, Human
uagcacaaacaauacucaauaa

SEQ ID NO: 335548 - RNA, 22 nt, Human
uauagcaaggguuccauuccaa

SEQ ID NO: 335549 - RNA, 19 nt, Human
ucaaagcagucuagaaauc

SEQ ID NO: 335550 - RNA, 25 nt, Human
ucaacaaugaaaacaacacaacaaa

SEQ ID NO: 335551 - RNA, 22 nt, Human
ucauuaucuugccaauuauuuc

SEQ ID NO: 335552 - RNA, 23 nt, Human
ucuaaaguucauuggucacaauu

SEQ ID NO: 335553 - RNA, 18 nt, Human
ugaaaacaacacaacaaa

SEQ ID NO: 335554 - RNA, 19 nt, Human
ugaaauggccuaugccucc

SEQ ID NO: 335555 - RNA, 18 nt, Human
ugacugagaagggcucca

SEQ ID NO: 335556 - RNA, 23 nt, Human
ugagaagggcuccaaaaaaagaa

SEQ ID NO: 335557 - RNA, 22 nt, Human
ugggauauccaucagcucucug

SEQ ID NO: 335558 - RNA, 25 nt, Human
ugggggaaaugacaaggguuugggg

SEQ ID NO: 335559 - RNA, 26 nt, Human
ugguauccucaucaucuuuccacagg

SEQ ID NO: 335560 - RNA, 24 nt, Human
uuagcacaaacaauacucaauaaa

SEQ ID NO: 335561 - RNA, 18 nt, Human
uucuuuauuuggaaucua

SEQ ID NO: 335562 - RNA, 22 nt, Human
uuuuaaggaaaacugaggggua

SEQ ID NO: 335563 - RNA, 18 nt, Human
uuuuucuucuucuucuuc

SEQ ID NO: 335564 - RNA, 23 nt, Human
uuuuuugaccaaugccucucugg

SEQ ID NO: 335565 - RNA, 19 nt, Human
aaacacaagaagcaauauu

SEQ ID NO: 335566 - RNA, 25 nt, Human
aagaagcaauauuagaguugguuua

SEQ ID NO: 335567 - RNA, 18 nt, Human
acacagagcaauuuuuuu

SEQ ID NO: 335568 - RNA, 23 nt, Human
agaaaucaguuaucccaguuuuu

SEQ ID NO: 335569 - RNA, 23 nt, Human
agcugauccugaaauacggccuc

SEQ ID NO: 335570 - RNA, 20 nt, Human
aggggacauuucauaaucag

SEQ ID NO: 335571 - RNA, 22 nt, Human
aguuaucccaguuuuuuuccua

SEQ ID NO: 335572 - RNA, 18 nt, Human
auaaaacaggagaagccu

SEQ ID NO: 335573 - RNA, 22 nt, Human
aucuucugcugacucuuccaaa

SEQ ID NO: 335574 - RNA, 18 nt, Human
caagagauauacacagag

SEQ ID NO: 335575 - RNA, 22 nt, Human
cacguggaaggagccacacaga

SEQ ID NO: 335576 - RNA, 18 nt, Human
cauuacagauauaaagua

SEQ ID NO: 335577 - RNA, 21 nt, Human
ccucucagcuggcacaguccu

SEQ ID NO: 335578 - RNA, 22 nt, Human
ccucucagcuggcacaguccuc

SEQ ID NO: 335579 - RNA, 19 nt, Human
ccuguaaucuggcucagag

SEQ ID NO: 335580 - RNA, 24 nt, Human
ccuguaaucuggcucagagcugcu

SEQ ID NO: 335581 - RNA, 21 nt, Human
cggcagcugauccugaaauac

SEQ ID NO: 335582 - RNA, 20 nt, Human
cguggaaggagccacacaga

SEQ ID NO: 335583 - RNA, 23 nt, Human
cuccuccaacuccuacacggccc

SEQ ID NO: 335584 - RNA, 20 nt, Human
cuggaaugcuggcacuuucc

SEQ ID NO: 335585 - RNA, 20 nt, Human
cuucugcugacucuuccaaa

SEQ ID NO: 335586 - RNA, 18 nt, Human
gaaccggcagcugauccu

SEQ ID NO: 335587 - RNA, 20 nt, Human
gaaccggcagcugauccuga

SEQ ID NO: 335588 - RNA, 23 nt, Human
gaagucaaugacucaaaaaaguu

SEQ ID NO: 335589 - RNA, 18 nt, Human
gagaagccucuucagauu

SEQ ID NO: 335590 - RNA, 18 nt, Human
gcugcugcugacuauggg

SEQ ID NO: 335591 - RNA, 18 nt, Human
uaaaacacaagaagcaau

SEQ ID NO: 335592 - RNA, 20 nt, Human
uaaaaugaagucaaugacuc

SEQ ID NO: 335593 - RNA, 21 nt, Human
uagcaauaucuaacauuugaa

SEQ ID NO: 335594 - RNA, 24 nt, Human
uauaaaaugaagucaaugacucaa

SEQ ID NO: 335595 - RNA, 19 nt, Human
uaucauuacagauauaaag

SEQ ID NO: 335596 - RNA, 20 nt, Human
uccuccaacuccuacacggc

SEQ ID NO: 335597 - RNA, 18 nt, Human
ucugacaguaaaacacaa

SEQ ID NO: 335598 - RNA, 21 nt, Human
ucuggaaugcuggcacuuucc

SEQ ID NO: 335599 - RNA, 19 nt, Human
ugacucuuccaaaauuuca

SEQ ID NO: 335600 - RNA, 18 nt, Human
uggaaggagccacacaga

SEQ ID NO: 335601 - RNA, 21 nt, Human
uggaggucucaggcagcuucc

SEQ ID NO: 335602 - RNA, 18 nt, Human
uggcucagagcugcugcu

SEQ ID NO: 335603 - RNA, 19 nt, Human
uuaagggcggcgguuuuuc

SEQ ID NO: 335604 - RNA, 20 nt, Human
uugaaagccauagaaaucag

SEQ ID NO: 335605 - RNA, 21 nt, Human
uuucauuucucuccuccaacu

SEQ ID NO: 335606 - RNA, 21 nt, Human
uuuccaagagauauacacaga

SEQ ID NO: 335607 - RNA, 19 nt, Human
aaaaaaggaaacauauaau

SEQ ID NO: 335608 - RNA, 22 nt, Human
aaaaaggaaacauauaauaaga

SEQ ID NO: 335609 - RNA, 18 nt, Human
aaaaauacuaaaccugua

SEQ ID NO: 335610 - RNA, 21 nt, Human
aaaccuguauauuugguauug

SEQ ID NO: 335611 - RNA, 21 nt, Human
aacaaucacuaacaggcaaaa

SEQ ID NO: 335612 - RNA, 22 nt, Human
aacaguucuucagaccuggcuc

SEQ ID NO: 335613 - RNA, 18 nt, Human
aagagauuugaaaagucu

SEQ ID NO: 335614 - RNA, 19 nt, Human
aagagauuugaaaagucug

SEQ ID NO: 335615 - RNA, 22 nt, Human
aaggcuuuuaguuuacauuugg

SEQ ID NO: 335616 - RNA, 23 nt, Human
acaacauugguggaugaagaaug

SEQ ID NO: 335617 - RNA, 21 nt, Human
acauccacaguacucguccac

SEQ ID NO: 335618 - RNA, 22 nt, Human
acaugugaaacaaucacuaaca

SEQ ID NO: 335619 - RNA, 20 nt, Human
agauauuaaaggcaacgucu

SEQ ID NO: 335620 - RNA, 20 nt, Human
agauuugaaaagucuggaca

SEQ ID NO: 335621 - RNA, 23 nt, Human
agccugaaaaugauuuacaaaaa

SEQ ID NO: 335622 - RNA, 21 nt, Human
agcugcagaagccugaaaaug

SEQ ID NO: 335623 - RNA, 19 nt, Human
aggagcucuuuggacuuuc

SEQ ID NO: 335624 - RNA, 23 nt, Human
aggagcucuuuggacuuucuuuu

SEQ ID NO: 335625 - RNA, 20 nt, Human
aggcaaaaauacuaaaccug

SEQ ID NO: 335626 - RNA, 19 nt, Human
aggguaccaccacaggaaa

SEQ ID NO: 335627 - RNA, 24 nt, Human
agugagaaucuacagcugcagaag

SEQ ID NO: 335628 - RNA, 22 nt, Human
cacacgacuauaaacauuguuc

SEQ ID NO: 335629 - RNA, 22 nt, Human
cacauccacaguacucguccac

SEQ ID NO: 335630 - RNA, 18 nt, Human
caggcaaaaauacuaaac

SEQ ID NO: 335631 - RNA, 18 nt, Human
cccacauucacauccaca

SEQ ID NO: 335632 - RNA, 19 nt, Human
cccccacuguacacacgac

SEQ ID NO: 335633 - RNA, 19 nt, Human
ccccgcgcuccccccgggu

SEQ ID NO: 335634 - RNA, 23 nt, Human
cuaaaccuguauauuugguauug

SEQ ID NO: 335635 - RNA, 24 nt, Human
cuaguacucugcgaaccucucacg

SEQ ID NO: 335636 - RNA, 31 nt, Human
gaaaauauacacuucuuguuguagacccccc

SEQ ID NO: 335637 - RNA, 24 nt, Human
gaaucuacagcugcagaagccuga

SEQ ID NO: 335638 - RNA, 20 nt, Human
gacuauaaacauuguucccu

SEQ ID NO: 335639 - RNA, 19 nt, Human
gccgcugccgcgccgcucc

SEQ ID NO: 335640 - RNA, 23 nt, Human
gucgcuacucuaggcgccacggc

SEQ ID NO: 335641 - RNA, 21 nt, Human
gugagaaucuacagcugcaga

SEQ ID NO: 335642 - RNA, 18 nt, Human
uaaagacaagaucaccgu

SEQ ID NO: 335643 - RNA, 24 nt, Human
uaaaguauacaguacaccauuuuc

SEQ ID NO: 335644 - RNA, 21 nt, Human
uacaaguaucaaagaagcgaa

SEQ ID NO: 335645 - RNA, 21 nt, Human
uacaguacaccauuuucauac

SEQ ID NO: 335646 - RNA, 24 nt, Human
uacauuauuguacucuccaauaca

SEQ ID NO: 335647 - RNA, 22 nt, Human
uagaaugugcaaacugauauag

SEQ ID NO: 335648 - RNA, 20 nt, Human
uaguacucugcgaaccucuc

SEQ ID NO: 335649 - RNA, 23 nt, Human
uaucuggaguagucuauauagga

SEQ ID NO: 335650 - RNA, 19 nt, Human
uauguaaacaaaaaaagga

SEQ ID NO: 335651 - RNA, 19 nt, Human
uccaauacaaaguaugggg

SEQ ID NO: 335652 - RNA, 18 nt, Human
uccccccgggucgcuacu

SEQ ID NO: 335653 - RNA, 25 nt, Human
ucccuauguaaacaaaaaaaggaaa

SEQ ID NO: 335654 - RNA, 27 nt, Human
ucccuauguaaacaaaaaaaggaaacu

SEQ ID NO: 335655 - RNA, 21 nt, Human
ucccugcagccagcgucgccc

SEQ ID NO: 335656 - RNA, 23 nt, Human
uccugccgcugccgcgccgcucc

SEQ ID NO: 335657 - RNA, 22 nt, Human
ucuccaauacaaaguauggggc

SEQ ID NO: 335658 - RNA, 20 nt, Human
ucucuuagcaguaauacugg

SEQ ID NO: 335659 - RNA, 20 nt, Human
ucucuugugauacuggaaag

SEQ ID NO: 335660 - RNA, 21 nt, Human
ugaaacaaucacuaacaggca

SEQ ID NO: 335661 - RNA, 21 nt, Human
uggacauuuccuucccaacag

SEQ ID NO: 335662 - RNA, 26 nt, Human
uggccaccucaaaguaguuguaacau

SEQ ID NO: 335663 - RNA, 21 nt, Human
uguaaacaaaaaaaggaaaca

SEQ ID NO: 335664 - RNA, 20 nt, Human
uguacacacgacuauaaaca

SEQ ID NO: 335665 - RNA, 26 nt, Human
uguucccuauguaaacaaaaaaagga

SEQ ID NO: 335666 - RNA, 20 nt, Human
uuaaaguauacaguacacca

SEQ ID NO: 335667 - RNA, 20 nt, Human
uucccuauguaaacaaaaaa

SEQ ID NO: 335668 - RNA, 23 nt, Human
uuuaacaaaguuggaaugcuggc

SEQ ID NO: 335669 - RNA, 23 nt, Human
aacccagugcucacucccccaca

SEQ ID NO: 335670 - RNA, 24 nt, Human
aacuaaguucacucgugacagguc

SEQ ID NO: 335671 - RNA, 22 nt, Human
aaucacagucuucagugaccuc

SEQ ID NO: 335672 - RNA, 24 nt, Human
aaucccugccccagcgcagacccc

SEQ ID NO: 335673 - RNA, 26 nt, Human
acacggcaccuuccccuugugcuucu

SEQ ID NO: 335674 - RNA, 21 nt, Human
acagcccagaugggugggcca

SEQ ID NO: 335675 - RNA, 27 nt, Human
accagacacacaagggcucccagcagc

SEQ ID NO: 335676 - RNA, 20 nt, Human
acccccaggcuggggguggg

SEQ ID NO: 335677 - RNA, 19 nt, Human
acccccaguccugcuucca

SEQ ID NO: 335678 - RNA, 18 nt, Human
agaagugaaggacuuguc

SEQ ID NO: 335679 - RNA, 21 nt, Human
agacccccaguccugcuucca

SEQ ID NO: 335680 - RNA, 18 nt, Human
agccggcucccugccccu

SEQ ID NO: 335681 - RNA, 19 nt, Human
aggcuggggguggggacga

SEQ ID NO: 335682 - RNA, 18 nt, Human
agggaccucaagaagcag

SEQ ID NO: 335683 - RNA, 21 nt, Human
agggagagugacuugcccaga

SEQ ID NO: 335684 - RNA, 21 nt, Human
agggcagaggucucgucugcc

SEQ ID NO: 335685 - RNA, 18 nt, Human
aggguggggaggcagggg

SEQ ID NO: 335686 - RNA, 22 nt, Human
aggguggggaggcagggggcag

SEQ ID NO: 335687 - RNA, 21 nt, Human
agugaaggaguauaggaggga

SEQ ID NO: 335688 - RNA, 30 nt, Human
auggggaggguggggaggcagggggcagcc

SEQ ID NO: 335689 - RNA, 23 nt, Human
cacagcagaacccaaauuggaaa

SEQ ID NO: 335690 - RNA, 22 nt, Human
cacagccggcucccugccccuc

SEQ ID NO: 335691 - RNA, 22 nt, Human
caccuuguucccucugagucca

SEQ ID NO: 335692 - RNA, 19 nt, Human
cagacacacaagggcuccc

SEQ ID NO: 335693 - RNA, 23 nt, Human
cagcagaacccaaauuggaaacc

SEQ ID NO: 335694 - RNA, 19 nt, Human
cagcaugggauggcagggg

SEQ ID NO: 335695 - RNA, 19 nt, Human
cagguagguccccaucccc

SEQ ID NO: 335696 - RNA, 23 nt, Human
ccaccuuguucccucugagucca

SEQ ID NO: 335697 - RNA, 18 nt, Human
cccaggcugggggugggg

SEQ ID NO: 335698 - RNA, 23 nt, Human
ccccacauaucacauccuccuug

SEQ ID NO: 335699 - RNA, 18 nt, Human
cccccaggcugggggugg

SEQ ID NO: 335700 - RNA, 20 nt, Human
cccccaggcugggggugggg

SEQ ID NO: 335701 - RNA, 22 nt, Human
cccccaggcuggggguggggac

SEQ ID NO: 335702 - RNA, 22 nt, Human
ccccucagcccaccuggggcuc

SEQ ID NO: 335703 - RNA, 20 nt, Human
ccgacauccacacggccaca

SEQ ID NO: 335704 - RNA, 20 nt, Human
ccggcucccaacccagugcu

SEQ ID NO: 335705 - RNA, 19 nt, Human
ccucaagaagcaggguagg

SEQ ID NO: 335706 - RNA, 24 nt, Human
ccucugaaauaaucuuguccauuu

SEQ ID NO: 335707 - RNA, 20 nt, Human
ccuggggcuccagggaccuc

SEQ ID NO: 335708 - RNA, 19 nt, Human
ccuugugcugccuccaggg

SEQ ID NO: 335709 - RNA, 25 nt, Human
cggcucugcccugcagagacagccc

SEQ ID NO: 335710 - RNA, 20 nt, Human
cucaaacucucucucccacc

SEQ ID NO: 335711 - RNA, 21 nt, Human
cucaaacucucucucccaccu

SEQ ID NO: 335712 - RNA, 19 nt, Human
cucacucccccacauauca

SEQ ID NO: 335713 - RNA, 20 nt, Human
cuccacacacuccggcgaga

SEQ ID NO: 335714 - RNA, 19 nt, Human
cuccacacggagcugucuc

SEQ ID NO: 335715 - RNA, 20 nt, Human
cuccaggggcuaagcucucc

SEQ ID NO: 335716 - RNA, 24 nt, Human
cuccuugugcugccuccaggggcu

SEQ ID NO: 335717 - RNA, 19 nt, Human
cugccccucagcccaccug

SEQ ID NO: 335718 - RNA, 21 nt, Human
cugcuuccacugagcaauccc

SEQ ID NO: 335719 - RNA, 18 nt, Human
cuggagggcccagcaugg

SEQ ID NO: 335720 - RNA, 22 nt, Human
gaccagacacacaagggcuccc

SEQ ID NO: 335721 - RNA, 19 nt, Human
gcagggggcagcccacggg

SEQ ID NO: 335722 - RNA, 19 nt, Human
gcaguggacagggcaucgg

SEQ ID NO: 335723 - RNA, 19 nt, Human
gccaggaggcuggccuuug

SEQ ID NO: 335724 - RNA, 23 nt, Human
gcccaccuggggcuccagggacc

SEQ ID NO: 335725 - RNA, 24 nt, Human
gcccaucgcuccuccacacacucc

SEQ ID NO: 335726 - RNA, 21 nt, Human
gccgggggcguccugggcucg

SEQ ID NO: 335727 - RNA, 19 nt, Human
gccucaucugcucaguuuc

SEQ ID NO: 335728 - RNA, 21 nt, Human
ggccgggggcguccugggcuc

SEQ ID NO: 335729 - RNA, 21 nt, Human
ggccgggggcguccugggcuc

SEQ ID NO: 335730 - RNA, 20 nt, Human
gggccauggggagggugggg

SEQ ID NO: 335731 - RNA, 18 nt, Human
ggucuucagggcagaggu

SEQ ID NO: 335732 - RNA, 25 nt, Human
ggugauaggaggucccugggaagaa

SEQ ID NO: 335733 - RNA, 22 nt, Human
ggugauggaggcccagggaggg

SEQ ID NO: 335734 - RNA, 23 nt, Human
ggugauggaggcccagggagggg

SEQ ID NO: 335735 - RNA, 19 nt, Human
gguuaagcugggugcuggc

SEQ ID NO: 335736 - RNA, 24 nt, Human
gucuagugccugagggaagugcug

SEQ ID NO: 335737 - RNA, 20 nt, Human
gugaccagacacacaagggc

SEQ ID NO: 335738 - RNA, 21 nt, Human
guucugcccaucgcuccucca

SEQ ID NO: 335739 - RNA, 24 nt, Human
uaaaaagugugaccagacacacaa

SEQ ID NO: 335740 - RNA, 24 nt, Human
uaagcucuccacacggagcugucu

SEQ ID NO: 335741 - RNA, 23 nt, Human
uaggagggaacuaaguucacucg

SEQ ID NO: 335742 - RNA, 20 nt, Human
uagugccugagggaagugcu

SEQ ID NO: 335743 - RNA, 20 nt, Human
ucaccuucagaggggguggc

SEQ ID NO: 335744 - RNA, 23 nt, Human
ucagcccaccuggggcuccaggg

SEQ ID NO: 335745 - RNA, 21 nt, Human
ucaguuucaccuucagagggg

SEQ ID NO: 335746 - RNA, 22 nt, Human
uccauggcggucgggggaggca

SEQ ID NO: 335747 - RNA, 19 nt, Human
ucccaacccagugcucacc

SEQ ID NO: 335748 - RNA, 21 nt, Human
ucccaacccagugcucacucc

SEQ ID NO: 335749 - RNA, 18 nt, Human
ucccaccuuguucccucu

SEQ ID NO: 335750 - RNA, 22 nt, Human
ucccccaugaggggguuacuug

SEQ ID NO: 335751 - RNA, 28 nt, Human
ucccugccccagcgcagacccccaggcu

SEQ ID NO: 335752 - RNA, 22 nt, Human
ucccugggaagaaaauccuacc

SEQ ID NO: 335753 - RNA, 19 nt, Human
uccuugugcugccuccagg

SEQ ID NO: 335754 - RNA, 23 nt, Human
ucucaaacucucucucccaccuu

SEQ ID NO: 335755 - RNA, 18 nt, Human
ugacacggcaccuucccc

SEQ ID NO: 335756 - RNA, 25 nt, Human
ugaccagacacacaagggcucccag

SEQ ID NO: 335757 - RNA, 26 nt, Human
ugaccucugaaauaaucuuguccuuu

SEQ ID NO: 335758 - RNA, 23 nt, Human
ugagcaaucccugccccagcgca

SEQ ID NO: 335759 - RNA, 21 nt, Human
ugaggagccagguaggucccc

SEQ ID NO: 335760 - RNA, 21 nt, Human
ugagggaagugcugguucugc

SEQ ID NO: 335761 - RNA, 20 nt, Human
ugcccagagagggagaguga

SEQ ID NO: 335762 - RNA, 19 nt, Human
ugccugagggaagugcugg

SEQ ID NO: 335763 - RNA, 19 nt, Human
ugcuggcugaggagccagg

SEQ ID NO: 335764 - RNA, 18 nt, Human
uggccucaucugcucagu

SEQ ID NO: 335765 - RNA, 24 nt, Human
ugggauggcagggguuaagcuggg

SEQ ID NO: 335766 - RNA, 20 nt, Human
ugggccauggggaggguggg

SEQ ID NO: 335767 - RNA, 23 nt, Human
ugggccauggggaggguggggag

SEQ ID NO: 335768 - RNA, 21 nt, Human
ugggccgggggcguccugggc

SEQ ID NO: 335769 - RNA, 21 nt, Human
ugggcucggcacucuggugcc

SEQ ID NO: 335770 - RNA, 21 nt, Human
uggggaggguggggaggcagg

SEQ ID NO: 335771 - RNA, 22 nt, Human
uggggaggguggggaggcaggg

SEQ ID NO: 335772 - RNA, 29 nt, Human
uggggaggguggggaggcagggggcagcc

SEQ ID NO: 335773 - RNA, 18 nt, Human
uggggccaggaggcuggc

SEQ ID NO: 335774 - RNA, 20 nt, Human
ugggugggccauggggaggg

SEQ ID NO: 335775 - RNA, 21 nt, Human
ugguguuggucuucagggcag

SEQ ID NO: 335776 - RNA, 23 nt, Human
ugguucugcccaucgcuccucca

SEQ ID NO: 335777 - RNA, 21 nt, Human
ugucucaaacucucucuccca

SEQ ID NO: 335778 - RNA, 21 nt, Human
ugugccgggcugcccccucca

SEQ ID NO: 335779 - RNA, 22 nt, Human
uguuggucuucagggcagaggu

SEQ ID NO: 335780 - RNA, 20 nt, Human
uuggccuggagggcccagca

SEQ ID NO: 335781 - RNA, 23 nt, Human
uuuguagcagacaugcccagaga

SEQ ID NO: 335782 - RNA, 22 nt, Human
uuuuauacaacuguuaccgaca

SEQ ID NO: 335783 - RNA, 20 nt, Human
agcaacaggaauacaagaga

SEQ ID NO: 335784 - RNA, 19 nt, Human
agcggaagaagccgcugga

SEQ ID NO: 335785 - RNA, 24 nt, Human
caaaaaauggagcuauuuuuccaa

SEQ ID NO: 335786 - RNA, 26 nt, Human
caucacaugcaugcacaagugguaug

SEQ ID NO: 335787 - RNA, 22 nt, Human
ccuacagcgguucuucaauugg

SEQ ID NO: 335788 - RNA, 19 nt, Human
cggaagaagccgcuggaug

SEQ ID NO: 335789 - RNA, 24 nt, Human
gaggacagaggggaaauuagagau

SEQ ID NO: 335790 - RNA, 23 nt, Human
guggugcgggcggcgcggcucug

SEQ ID NO: 335791 - RNA, 21 nt, Human
uagcucaagcaacaggaauac

SEQ ID NO: 335792 - RNA, 23 nt, Human
uccaauucaguuucaucuuuaau

SEQ ID NO: 335793 - RNA, 23 nt, Human
ucccaagcaccaaaaaauggagc

SEQ ID NO: 335794 - RNA, 24 nt, Human
ucuaccuccgucucucccgcccuc

SEQ ID NO: 335795 - RNA, 21 nt, Human
ugaauaagcagccauacaacu

SEQ ID NO: 335796 - RNA, 22 nt, Human
ugaggaaccggcggggcgaggc

SEQ ID NO: 335797 - RNA, 22 nt, Human
uggagacuugccuuugacaaag

SEQ ID NO: 335798 - RNA, 21 nt, Human
uggagcuauuuuuccaauuca

SEQ ID NO: 335799 - RNA, 21 nt, Human
uggauggaggacagaggggaa

SEQ ID NO: 335800 - RNA, 24 nt, Human
ugguaugguagagaaugaagcgga

SEQ ID NO: 335801 - RNA, 22 nt, Human
uuacaucaucauaggacuacaa

SEQ ID NO: 335802 - RNA, 18 nt, Human
uuuuuuuaaagaguaaga

SEQ ID NO: 335803 - RNA, 21 nt, Human
uuuuuuuuuuuuuaaagagua

SEQ ID NO: 335804 - RNA, 19 nt, Human
uuuuuuuuuuuuuuuuuaa

SEQ ID NO: 335805 - RNA, 22 nt, Human
aaaagcagcgucgggugggagc

SEQ ID NO: 335806 - RNA, 20 nt, Human
aaagcugguucagcccgucu

SEQ ID NO: 335807 - RNA, 18 nt, Human
acccugggaacaaagcug

SEQ ID NO: 335808 - RNA, 23 nt, Human
agagcaaaguacaaagaggcagg

SEQ ID NO: 335809 - RNA, 18 nt, Human
aggcagggaggggagcug

SEQ ID NO: 335810 - RNA, 21 nt, Human
aggcagggaggggagcugggc

SEQ ID NO: 335811 - RNA, 22 nt, Human
agggaggggagcugggcccagg

SEQ ID NO: 335812 - RNA, 21 nt, Human
aggggagcagcccugggcagg

SEQ ID NO: 335813 - RNA, 23 nt, Human
augggccucuggcaugcagugga

SEQ ID NO: 335814 - RNA, 26 nt, Human
caaagaggcagggaggggagcugggg

SEQ ID NO: 335815 - RNA, 20 nt, Human
cacagugccagcugcccccc

SEQ ID NO: 335816 - RNA, 24 nt, Human
caggcgccacccugggaacaaagc

SEQ ID NO: 335817 - RNA, 21 nt, Human
ccccaggaguaaaugggccuc

SEQ ID NO: 335818 - RNA, 23 nt, Human
ccccaggaguaaaugggccucug

SEQ ID NO: 335819 - RNA, 25 nt, Human
ccccccgaaacgugggaacaaaagc

SEQ ID NO: 335820 - RNA, 21 nt, Human
cccccgaaacgugggaacaaa

SEQ ID NO: 335821 - RNA, 18 nt, Human
gaccuggcagcugcccca

SEQ ID NO: 335822 - RNA, 20 nt, Human
gagaaagagcaggaguggcg

SEQ ID NO: 335823 - RNA, 25 nt, Human
gagaaagagcaggaguggcgaggag

SEQ ID NO: 335824 - RNA, 20 nt, Human
gagcaaaguacaaagaggca

SEQ ID NO: 335825 - RNA, 22 nt, Human
gcccaggggagcagcccugggc

SEQ ID NO: 335826 - RNA, 21 nt, Human
gcgccacccugggaacaaagc

SEQ ID NO: 335827 - RNA, 20 nt, Human
ggcagggaggggagcugggc

SEQ ID NO: 335828 - RNA, 22 nt, Human
uacaaagaggcagggaggggag

SEQ ID NO: 335829 - RNA, 21 nt, Human
ucugcagcugucgcugccagu

SEQ ID NO: 335830 - RNA, 20 nt, Human
uggcagcugccccaggagua

SEQ ID NO: 335831 - RNA, 24 nt, Human
uggcaugcaguggagaaagagcag

SEQ ID NO: 335832 - RNA, 22 nt, Human
ugggagccggaauggggccugg

SEQ ID NO: 335833 - RNA, 18 nt, Human
ugggccucuggcaugcag

SEQ ID NO: 335834 - RNA, 19 nt, Human
ugguggcuccgugccucua

SEQ ID NO: 335835 - RNA, 18 nt, Human
uuuccagguacaaacagu

SEQ ID NO: 335836 - RNA, 20 nt, Human
uuuuuuuuuuuuuuuuccag

SEQ ID NO: 335837 - RNA, 23 nt, Human
uuuuuuuuuuuuuuuuuuccagg

SEQ ID NO: 335838 - RNA, 21 nt, Human
aaauaaaaacaaaaccagcga

SEQ ID NO: 335839 - RNA, 19 nt, Human
aacaguaacaggugcaccc

SEQ ID NO: 335840 - RNA, 22 nt, Human
aaccccccgccccugucccacc

SEQ ID NO: 335841 - RNA, 23 nt, Human
aaccccccgccccugucccaccc

SEQ ID NO: 335842 - RNA, 24 nt, Human
aaccccccgccccugucccacccc

SEQ ID NO: 335843 - RNA, 19 nt, Human
aagugccaaggccaggagc

SEQ ID NO: 335844 - RNA, 18 nt, Human
agagaaaacugaggagga

SEQ ID NO: 335845 - RNA, 22 nt, Human
agagaaaagccggggcggaggg

SEQ ID NO: 335846 - RNA, 20 nt, Human
aggcaagugccaaggccagg

SEQ ID NO: 335847 - RNA, 21 nt, Human
aggcaggggggagguugaggu

SEQ ID NO: 335848 - RNA, 21 nt, Human
aggcaggggggagguugaggu

SEQ ID NO: 335849 - RNA, 19 nt, Human
aggcaguccacugagggcc

SEQ ID NO: 335850 - RNA, 25 nt, Human
aggcugaggaggagaacuggggggc

SEQ ID NO: 335851 - RNA, 19 nt, Human
aggcugugggagcaggcag

SEQ ID NO: 335852 - RNA, 21 nt, Human
aggggaaggcaggccuuggaa

SEQ ID NO: 335853 - RNA, 20 nt, Human
agguuggggguggggggcag

SEQ ID NO: 335854 - RNA, 19 nt, Human
augggggagccaaguccug

SEQ ID NO: 335855 - RNA, 27 nt, Human
caaaaaaauuaaaauaaaaacaaaacc

SEQ ID NO: 335856 - RNA, 23 nt, Human
caaaaccagcgagaauuaauacc

SEQ ID NO: 335857 - RNA, 21 nt, Human
caacaguaacaggugcaccca

SEQ ID NO: 335858 - RNA, 33 nt, Human
caauacacagcacaaauuccuucaguauaaaaa

SEQ ID NO: 335859 - RNA, 21 nt, Human
cacccccuccagcucuggauc

SEQ ID NO: 335860 - RNA, 18 nt, Human
cacccccucugucaccaa

SEQ ID NO: 335861 - RNA, 18 nt, Human
cagagaaaagccggggcg

SEQ ID NO: 335862 - RNA, 23 nt, Human
cagaggggugucuugaugaacac

SEQ ID NO: 335863 - RNA, 21 nt, Human
cagcucgggccccuggccagc

SEQ ID NO: 335864 - RNA, 20 nt, Human
cagcucuggauccagcuccc

SEQ ID NO: 335865 - RNA, 24 nt, Human
cagcucuggauccagcucccccca

SEQ ID NO: 335866 - RNA, 25 nt, Human
cagcugggggugcaggggugagggg

SEQ ID NO: 335867 - RNA, 23 nt, Human
caggagccuguccuuucagggcu

SEQ ID NO: 335868 - RNA, 18 nt, Human
caggcagagggagaaagg

SEQ ID NO: 335869 - RNA, 20 nt, Human
cagugggagggaggggaagg

SEQ ID NO: 335870 - RNA, 22 nt, Human
ccaacaguaacaggugcaccca

SEQ ID NO: 335871 - RNA, 19 nt, Human
ccacacccaguggucaggc

SEQ ID NO: 335872 - RNA, 22 nt, Human
ccacccccuccagcucuggauc

SEQ ID NO: 335873 - RNA, 23 nt, Human
ccacccccuccagcucuggaucc

SEQ ID NO: 335874 - RNA, 18 nt, Human
ccagcucuggauccagcu

SEQ ID NO: 335875 - RNA, 19 nt, Human
ccagggaaauggaggaacu

SEQ ID NO: 335876 - RNA, 22 nt, Human
cccaaccccuggugaaggaggu

SEQ ID NO: 335877 - RNA, 19 nt, Human
cccaggccucuguccaagg

SEQ ID NO: 335878 - RNA, 18 nt, Human
ccccacaccguccacacc

SEQ ID NO: 335879 - RNA, 23 nt, Human
cccccaggacccauccugagacc

SEQ ID NO: 335880 - RNA, 24 nt, Human
cccccaggacccauccugagaccc

SEQ ID NO: 335881 - RNA, 26 nt, Human
cccccaggacccauccugagacccag

SEQ ID NO: 335882 - RNA, 21 nt, Human
cccccgccccugucccacccc

SEQ ID NO: 335883 - RNA, 23 nt, Human
cccccggacccacccccuccagc

SEQ ID NO: 335884 - RNA, 19 nt, Human
ccccuccagcucuggaucc

SEQ ID NO: 335885 - RNA, 24 nt, Human
ccccuccagcucuggauccagcuc

SEQ ID NO: 335886 - RNA, 19 nt, Human
cccgggagggcaggugggg

SEQ ID NO: 335887 - RNA, 20 nt, Human
cccggggcccuugcucugcc

SEQ ID NO: 335888 - RNA, 18 nt, Human
cccuggugaaggaggucg

SEQ ID NO: 335889 - RNA, 19 nt, Human
ccgccccugucccaccccc

SEQ ID NO: 335890 - RNA, 20 nt, Human
ccucccccggacccaccccc

SEQ ID NO: 335891 - RNA, 22 nt, Human
ccuccucccuccccguccccca

SEQ ID NO: 335892 - RNA, 19 nt, Human
ccugagacccaggaccagg

SEQ ID NO: 335893 - RNA, 23 nt, Human
ccugagacccaggaccaggggcc

SEQ ID NO: 335894 - RNA, 25 nt, Human
ccuggccucggccucugacgucagc

SEQ ID NO: 335895 - RNA, 19 nt, Human
ccuuucagggcugccccac

SEQ ID NO: 335896 - RNA, 20 nt, Human
cggagggcgagggcuguguu

SEQ ID NO: 335897 - RNA, 20 nt, Human
cgggagggcaggugggggca

SEQ ID NO: 335898 - RNA, 27 nt, Human
cgggagggcaggugggggcagggcugg

SEQ ID NO: 335899 - RNA, 21 nt, Human
cgguagaaaggcagagaaaag

SEQ ID NO: 335900 - RNA, 25 nt, Human
cucccccagcugggggugcaggggu

SEQ ID NO: 335901 - RNA, 24 nt, Human
cucccuccccgucccccagggaag

SEQ ID NO: 335902 - RNA, 21 nt, Human
cugcccgggagggcagguggg

SEQ ID NO: 335903 - RNA, 22 nt, Human
cuucagaccaccccuccucggg

SEQ ID NO: 335904 - RNA, 22 nt, Human
gaacacgaggcccccaggaccc

SEQ ID NO: 335905 - RNA, 20 nt, Human
gaaggaggucggggcagagc

SEQ ID NO: 335906 - RNA, 18 nt, Human
gacagguugggggugggg

SEQ ID NO: 335907 - RNA, 18 nt, Human
gaggaaaaggcugaggag

SEQ ID NO: 335908 - RNA, 24 nt, Human
gaggaugggggagccaaguccugg

SEQ ID NO: 335909 - RNA, 19 nt, Human
gaggcagacagucuggcag

SEQ ID NO: 335910 - RNA, 24 nt, Human
gaggcagcucugccgaggagccag

SEQ ID NO: 335911 - RNA, 19 nt, Human
gaggccgggggugggggca

SEQ ID NO: 335912 - RNA, 18 nt, Human
gaggggaaggcaggccuu

SEQ ID NO: 335913 - RNA, 20 nt, Human
gagucgcugccuccucccuc

SEQ ID NO: 335914 - RNA, 22 nt, Human
gauccagcuccccccaauacac

SEQ ID NO: 335915 - RNA, 21 nt, Human
gaugugggcccugacgggagg

SEQ ID NO: 335916 - RNA, 22 nt, Human
gcacgggggugggacagguugg

SEQ ID NO: 335917 - RNA, 21 nt, Human
gcagagaaaagccggggcgga

SEQ ID NO: 335918 - RNA, 20 nt, Human
gcaggugggggcagggcugg

SEQ ID NO: 335919 - RNA, 18 nt, Human
gccagccccuucacagug

SEQ ID NO: 335920 - RNA, 19 nt, Human
gccccuucacagugggggc

SEQ ID NO: 335921 - RNA, 19 nt, Human
gcucgggccccuggccagc

SEQ ID NO: 335922 - RNA, 19 nt, Human
gcugaggaggagaacuggg

SEQ ID NO: 335923 - RNA, 23 nt, Human
gcugaggccgggggugggggcag

SEQ ID NO: 335924 - RNA, 21 nt, Human
gcuggggagccuagaugaugu

SEQ ID NO: 335925 - RNA, 22 nt, Human
gcuugugaguucugaggauggg

SEQ ID NO: 335926 - RNA, 22 nt, Human
ggaaaacucugucccggggccc

SEQ ID NO: 335927 - RNA, 21 nt, Human
ggacagguugggggugggggg

SEQ ID NO: 335928 - RNA, 24 nt, Human
ggaggagaacuggggggcacaggg

SEQ ID NO: 335929 - RNA, 22 nt, Human
ggagggcaggugggggcagggc

SEQ ID NO: 335930 - RNA, 20 nt, Human
ggcacagggacaugaaagga

SEQ ID NO: 335931 - RNA, 18 nt, Human
ggcagagggagaaagggg

SEQ ID NO: 335932 - RNA, 24 nt, Human
ggcccaggccucuguccaaggagu

SEQ ID NO: 335933 - RNA, 18 nt, Human
ggccccuggccagccccu

SEQ ID NO: 335934 - RNA, 18 nt, Human
ggccucugacgucagccc

SEQ ID NO: 335935 - RNA, 20 nt, Human
ggccucugacgucagcccag

SEQ ID NO: 335936 - RNA, 18 nt, Human
ggccuuggaaaguuagua

SEQ ID NO: 335937 - RNA, 24 nt, Human
ggcggagggcgagggcugugucca

SEQ ID NO: 335938 - RNA, 19 nt, Human
gggaaccccccgccccugu

SEQ ID NO: 335939 - RNA, 25 nt, Human
gggacagguuggggguggggggcag

SEQ ID NO: 335940 - RNA, 24 nt, Human
gggaggcagacagucuggcagggg

SEQ ID NO: 335941 - RNA, 25 nt, Human
gggcacgggggugggacagguuggg

SEQ ID NO: 335942 - RNA, 24 nt, Human
gggcccugacgggaggcagcucug

SEQ ID NO: 335943 - RNA, 24 nt, Human
ggggcccuaugggggugcuggugg

SEQ ID NO: 335944 - RNA, 23 nt, Human
gggggcaggccagggaaauggag

SEQ ID NO: 335945 - RNA, 19 nt, Human
gggggcccuaugggggugc

SEQ ID NO: 335946 - RNA, 20 nt, Human
gggggugggggcagcucggg

SEQ ID NO: 335947 - RNA, 19 nt, Human
ggggugggggcagcucggg

SEQ ID NO: 335948 - RNA, 23 nt, Human
ggguaaggagggggcacgggggu

SEQ ID NO: 335949 - RNA, 24 nt, Human
ggguaaggagggggcacgggggug

SEQ ID NO: 335950 - RNA, 27 nt, Human
gggugggacagguuggggguggggggc

SEQ ID NO: 335951 - RNA, 25 nt, Human
gggugucuugaugaacacgaggccc

SEQ ID NO: 335952 - RNA, 22 nt, Human
gugggggcagggcuggugcggg

SEQ ID NO: 335953 - RNA, 21 nt, Human
guguguguguuugugugugug

SEQ ID NO: 335954 - RNA, 22 nt, Human
uaccugggguugguauggcagg

SEQ ID NO: 335955 - RNA, 25 nt, Human
uagaugaugugggcccugacgggag

SEQ ID NO: 335956 - RNA, 25 nt, Human
uccacacccaguggucaggcagagg

SEQ ID NO: 335957 - RNA, 23 nt, Human
uccacugagggcccaggccucug

SEQ ID NO: 335958 - RNA, 20 nt, Human
ucccccagggaaggucccca

SEQ ID NO: 335959 - RNA, 19 nt, Human
ucccccggacccacccccu

SEQ ID NO: 335960 - RNA, 22 nt, Human
ucccccggacccacccccucca

SEQ ID NO: 335961 - RNA, 21 nt, Human
ucccucccccggacccacccc

SEQ ID NO: 335962 - RNA, 21 nt, Human
ucuggcagggggcucuggugg

SEQ ID NO: 335963 - RNA, 25 nt, Human
ucuggcagggggcucuggugggcuu

SEQ ID NO: 335964 - RNA, 19 nt, Human
ugagacccaggaccagggg

SEQ ID NO: 335965 - RNA, 22 nt, Human
ugaggaugggggagccaagucc

SEQ ID NO: 335966 - RNA, 23 nt, Human
ugaggaugggggagccaaguccu

SEQ ID NO: 335967 - RNA, 21 nt, Human
ugcaggcaagugccaaggcca

SEQ ID NO: 335968 - RNA, 23 nt, Human
ugccuccucccuccccguccccc

SEQ ID NO: 335969 - RNA, 24 nt, Human
ugcucugcccugcuccaugccuca

SEQ ID NO: 335970 - RNA, 20 nt, Human
ugcugguggcugaggccggg

SEQ ID NO: 335971 - RNA, 21 nt, Human
uggaaagcccaacaguaacag

SEQ ID NO: 335972 - RNA, 22 nt, Human
uggcugaggccggggguggggg

SEQ ID NO: 335973 - RNA, 21 nt, Human
ugggcagaggggugucuugau

SEQ ID NO: 335974 - RNA, 23 nt, Human
ugggcccugacgggaggcagcuc

SEQ ID NO: 335975 - RNA, 21 nt, Human
ugggggagccaaguccuggcg

SEQ ID NO: 335976 - RNA, 23 nt, Human
ugggggcagggcuggugcggggu

SEQ ID NO: 335977 - RNA, 21 nt, Human
uggggguggggggcaggccag

SEQ ID NO: 335978 - RNA, 23 nt, Human
uggggguggggggcaggccaggg

SEQ ID NO: 335979 - RNA, 19 nt, Human
uggugcggggucacauggu

SEQ ID NO: 335980 - RNA, 19 nt, Human
ugguggcugaggccggggg

SEQ ID NO: 335981 - RNA, 26 nt, Human
ugucaccaaccgaggcaggggggagg

SEQ ID NO: 335982 - RNA, 24 nt, Human
ugucccacccccucugucaccaac

SEQ ID NO: 335983 - RNA, 19 nt, Human
ugucccggggcccuugcuc

SEQ ID NO: 335984 - RNA, 21 nt, Human
ugucugggggcccuauggggg

SEQ ID NO: 335985 - RNA, 19 nt, Human
uguggugagcugggcagag

SEQ ID NO: 335986 - RNA, 19 nt, Human
uguguguguguuugugugu

SEQ ID NO: 335987 - RNA, 21 nt, Human
uguguguguguuugugugugu

SEQ ID NO: 335988 - RNA, 21 nt, Human
uguguguguguuugugugugu

SEQ ID NO: 335989 - RNA, 18 nt, Human
uguguguguuugugugug

SEQ ID NO: 335990 - RNA, 21 nt, Human
uugcucugcccugcuccaugc

SEQ ID NO: 335991 - RNA, 23 nt, Human
uugcuggugaugaagauguggug

SEQ ID NO: 335992 - RNA, 25 nt, Human
uuuaaagagaaaacugaggaggaaa

SEQ ID NO: 335993 - RNA, 20 nt, Human
aaaagaugcaguuugagagc

SEQ ID NO: 335994 - RNA, 23 nt, Human
aaaagcccuuacaucccucacag

SEQ ID NO: 335995 - RNA, 18 nt, Human
aaacaaguaauaaaccac

SEQ ID NO: 335996 - RNA, 22 nt, Human
aaacauacaguauagaaagaac

SEQ ID NO: 335997 - RNA, 23 nt, Human
aaacauacaguauagaaagaaca

SEQ ID NO: 335998 - RNA, 22 nt, Human
aaagcaccaaacauacaguaua

SEQ ID NO: 335999 - RNA, 23 nt, Human
aaaugaucauuuaccauuuucca

SEQ ID NO: 336000 - RNA, 22 nt, Human
aacaaaaacuuaacacugaaaa

SEQ ID NO: 336001 - RNA, 24 nt, Human
aagaagggcuggaaaaaaauccca

SEQ ID NO: 336002 - RNA, 22 nt, Human
aaguaaaugcuugcaaaaagcc

SEQ ID NO: 336003 - RNA, 21 nt, Human
aaguguuucugccuuggaggc

SEQ ID NO: 336004 - RNA, 19 nt, Human
acaaaaggaaagcaccaaa

SEQ ID NO: 336005 - RNA, 20 nt, Human
acagaauucucuucugcuag

SEQ ID NO: 336006 - RNA, 21 nt, Human
acagacaagccagcuaaaagc

SEQ ID NO: 336007 - RNA, 23 nt, Human
acagacaagccagcuaaaagccu

SEQ ID NO: 336008 - RNA, 18 nt, Human
acuaaaguagaauaucuu

SEQ ID NO: 336009 - RNA, 24 nt, Human
acuccaucaaacucugccccuuuu

SEQ ID NO: 336010 - RNA, 19 nt, Human
acugaagguacuggggaau

SEQ ID NO: 336011 - RNA, 20 nt, Human
agaguuacaugguccagugg

SEQ ID NO: 336012 - RNA, 22 nt, Human
agcaucagaaagagcaaagaca

SEQ ID NO: 336013 - RNA, 24 nt, Human
aguaaacaaaaacuuaacacugaa

SEQ ID NO: 336014 - RNA, 20 nt, Human
aguggagauggggggcuugg

SEQ ID NO: 336015 - RNA, 25 nt, Human
auaaccuuggugucaugguuauuuu

SEQ ID NO: 336016 - RNA, 21 nt, Human
auccagccggggcgggggguu

SEQ ID NO: 336017 - RNA, 25 nt, Human
auuccaguagugcuuaaaugagaac

SEQ ID NO: 336018 - RNA, 19 nt, Human
caaaaagccuuccgaaugc

SEQ ID NO: 336019 - RNA, 22 nt, Human
caaacauacaguauagaaagaa

SEQ ID NO: 336020 - RNA, 19 nt, Human
caaauggcauagaaaaguc

SEQ ID NO: 336021 - RNA, 25 nt, Human
caagaagggcuggaaaaaaauccca

SEQ ID NO: 336022 - RNA, 20 nt, Human
caagacaaaaggaaagcacc

SEQ ID NO: 336023 - RNA, 21 nt, Human
cagacaagccagcuaaaagcc

SEQ ID NO: 336024 - RNA, 23 nt, Human
caggguuuguacacucgaggggg

SEQ ID NO: 336025 - RNA, 22 nt, Human
caguccaaaaacuaagcagcag

SEQ ID NO: 336026 - RNA, 19 nt, Human
caucagaaagagcaaagac

SEQ ID NO: 336027 - RNA, 20 nt, Human
caucagaaagagcaaagaca

SEQ ID NO: 336028 - RNA, 21 nt, Human
ccacccaacuccaucaaacuc

SEQ ID NO: 336029 - RNA, 18 nt, Human
ccaugaaagcaagacagu

SEQ ID NO: 336030 - RNA, 20 nt, Human
ccaugaaagcaagacaguua

SEQ ID NO: 336031 - RNA, 23 nt, Human
ccuaccccgacggugcccagaca

SEQ ID NO: 336032 - RNA, 20 nt, Human
ccucuagguguggaggcaaa

SEQ ID NO: 336033 - RNA, 22 nt, Human
ccuuuggcaaagaauagacccu

SEQ ID NO: 336034 - RNA, 24 nt, Human
ccuuuuuuggcacguaggcuguug

SEQ ID NO: 336035 - RNA, 23 nt, Human
cgagggggaggaaguggagaugg

SEQ ID NO: 336036 - RNA, 22 nt, Human
cgcguucucggcaucccagucc

SEQ ID NO: 336037 - RNA, 22 nt, Human
cgcucgcguucucggcauccca

SEQ ID NO: 336038 - RNA, 21 nt, Human
cuaauauaucaaaaaaaaaaa

SEQ ID NO: 336039 - RNA, 22 nt, Human
cuaccccgacggugcccagaca

SEQ ID NO: 336040 - RNA, 21 nt, Human
cuauuccaugaaagcaagaca

SEQ ID NO: 336041 - RNA, 20 nt, Human
cucacaggcgcugaccccau

SEQ ID NO: 336042 - RNA, 20 nt, Human
cucacuuccuacuacuucug

SEQ ID NO: 336043 - RNA, 22 nt, Human
cucacuuccuacuacuucuguc

SEQ ID NO: 336044 - RNA, 24 nt, Human
cugguccccccuuugguccccugg

SEQ ID NO: 336045 - RNA, 22 nt, Human
cuucuugguccuucuugaguuu

SEQ ID NO: 336046 - RNA, 19 nt, Human
cuugguccuucuugaguuu

SEQ ID NO: 336047 - RNA, 23 nt, Human
gaaagcaccaaacauacaguaua

SEQ ID NO: 336048 - RNA, 21 nt, Human
gagcaaagacaagcuuccaua

SEQ ID NO: 336049 - RNA, 23 nt, Human
gagcaucagaaagagcaaagaca

SEQ ID NO: 336050 - RNA, 22 nt, Human
gcaagacaaaaggaaagcacca

SEQ ID NO: 336051 - RNA, 19 nt, Human
gcauagaaaaguccaccca

SEQ ID NO: 336052 - RNA, 27 nt, Human
gcaucagaaagagcaaagacaagcuuc

SEQ ID NO: 336053 - RNA, 24 nt, Human
gcuggugcucuguguuucaauugc

SEQ ID NO: 336054 - RNA, 21 nt, Human
ggaaaaaaaucccaauaucag

SEQ ID NO: 336055 - RNA, 23 nt, Human
ggaaaaagcccuuacaucccuca

SEQ ID NO: 336056 - RNA, 20 nt, Human
ggaggaaguggagauggggg

SEQ ID NO: 336057 - RNA, 20 nt, Human
ggaggaaguggagauggggg

SEQ ID NO: 336058 - RNA, 19 nt, Human
ggcacguaggcuguugguc

SEQ ID NO: 336059 - RNA, 24 nt, Human
ggcuugggacgaguuccucagagc

SEQ ID NO: 336060 - RNA, 20 nt, Human
gggucuuugccaugcaucuu

SEQ ID NO: 336061 - RNA, 20 nt, Human
guacaaagucuucagaaacu

SEQ ID NO: 336062 - RNA, 21 nt, Human
gucuuuuucccagccccgaau

SEQ ID NO: 336063 - RNA, 18 nt, Human
gugucaugguuauuuuga

SEQ ID NO: 336064 - RNA, 22 nt, Human
uaaaagaugcaguuugagagca

SEQ ID NO: 336065 - RNA, 18 nt, Human
uaaacaaaaacuuaacac

SEQ ID NO: 336066 - RNA, 20 nt, Human
uaaacaaaaacuuaacacug

SEQ ID NO: 336067 - RNA, 22 nt, Human
uaaacaaaaacuuaacacugaa

SEQ ID NO: 336068 - RNA, 24 nt, Human
uaaacaaaaacuuaacacugaaaa

SEQ ID NO: 336069 - RNA, 22 nt, Human
uaaccacucuaccacagcuuuc

SEQ ID NO: 336070 - RNA, 26 nt, Human
uaauaucuuuucaguccaaaaacuaa

SEQ ID NO: 336071 - RNA, 23 nt, Human
uacaaacagagccagugaaagua

SEQ ID NO: 336072 - RNA, 19 nt, Human
uacaucccucacaggcgcu

SEQ ID NO: 336073 - RNA, 18 nt, Human
uauccucuagguguggag

SEQ ID NO: 336074 - RNA, 18 nt, Human
ucaguccaaaaacuaagc

SEQ ID NO: 336075 - RNA, 22 nt, Human
uccaaguaaaugcuugcaaaaa

SEQ ID NO: 336076 - RNA, 25 nt, Human
uccaaguaaaugcuugcaaaaagcc

SEQ ID NO: 336077 - RNA, 21 nt, Human
uccaguagugcuuaaaugaga

SEQ ID NO: 336078 - RNA, 22 nt, Human
ucccagccccgaaucaugaauu

SEQ ID NO: 336079 - RNA, 22 nt, Human
ucccaguccucaaacagcucgc

SEQ ID NO: 336080 - RNA, 26 nt, Human
ucccucacaggcgcugaccccauagu

SEQ ID NO: 336081 - RNA, 20 nt, Human
ucuugguccuucuugaguuu

SEQ ID NO: 336082 - RNA, 23 nt, Human
ugaacaaguaaacaaaaacuuaa

SEQ ID NO: 336083 - RNA, 19 nt, Human
ugacauuaacaauugaaca

SEQ ID NO: 336084 - RNA, 25 nt, Human
ugacugggucuuugccaugcaucuu

SEQ ID NO: 336085 - RNA, 18 nt, Human
ugagagcaucagaaagag

SEQ ID NO: 336086 - RNA, 26 nt, Human
ugagagcaucagaaagagcaaagaca

SEQ ID NO: 336087 - RNA, 20 nt, Human
ugcaagacaaaaggaaagca

SEQ ID NO: 336088 - RNA, 23 nt, Human
ugcccagacaaacccugcucgga

SEQ ID NO: 336089 - RNA, 18 nt, Human
uggugcucuguguuucaa

SEQ ID NO: 336090 - RNA, 20 nt, Human
uguacaaagucuucagaaac

SEQ ID NO: 336091 - RNA, 24 nt, Human
uguaucuguuaaccacucuaccac

SEQ ID NO: 336092 - RNA, 19 nt, Human
ugucaauaguccuguuucc

SEQ ID NO: 336093 - RNA, 23 nt, Human
uucccagccccgaaucaugaauu

SEQ ID NO: 336094 - RNA, 21 nt, Human
uucuugcauuuuaaauccugg

SEQ ID NO: 336095 - RNA, 22 nt, Human
uuuaaaauuggaaaaguuugua

SEQ ID NO: 336096 - RNA, 24 nt, Human
uuuaauaucuuuucaguccaaaaa

SEQ ID NO: 336097 - RNA, 20 nt, Human
uuuccaggcuugcucggcca

SEQ ID NO: 336098 - RNA, 24 nt, Human
uuuggcacguaggcuguuggucuu

SEQ ID NO: 336099 - RNA, 26 nt, Human
uuuguacacucgagggggaggaagug

SEQ ID NO: 336100 - RNA, 19 nt, Human
aagaccccuggaggaaggg

SEQ ID NO: 336101 - RNA, 18 nt, Human
aagccccaacccccacag

SEQ ID NO: 336102 - RNA, 19 nt, Human
aaggggaugaacacagagg

SEQ ID NO: 336103 - RNA, 25 nt, Human
acacacccugcaggugcaucacaca

SEQ ID NO: 336104 - RNA, 23 nt, Human
acagggugaacucugcacccgag

SEQ ID NO: 336105 - RNA, 23 nt, Human
acaugacagggcugggggaggga

SEQ ID NO: 336106 - RNA, 22 nt, Human
acccugaccccccaagagaaca

SEQ ID NO: 336107 - RNA, 19 nt, Human
agaaacuuuggcaaaaaca

SEQ ID NO: 336108 - RNA, 21 nt, Human
agaaaugcagggcccagccug

SEQ ID NO: 336109 - RNA, 21 nt, Human
agagaacacagggagccaaug

SEQ ID NO: 336110 - RNA, 19 nt, Human
agaggggaggggacagcac

SEQ ID NO: 336111 - RNA, 25 nt, Human
agauggucagucugcugccugaagc

SEQ ID NO: 336112 - RNA, 18 nt, Human
agcaagaaggugggcuca

SEQ ID NO: 336113 - RNA, 25 nt, Human
agcaagaaggugggcucagcccuuc

SEQ ID NO: 336114 - RNA, 19 nt, Human
agcacacacccugcaggug

SEQ ID NO: 336115 - RNA, 19 nt, Human
agcagguccucccccaguc

SEQ ID NO: 336116 - RNA, 19 nt, Human
agcccaaggcacaugacag

SEQ ID NO: 336117 - RNA, 22 nt, Human
agcggggaggucaggggcccug

SEQ ID NO: 336118 - RNA, 24 nt, Human
aggcaccccuagaaacuuuggcaa

SEQ ID NO: 336119 - RNA, 20 nt, Human
agggagccaaugggaaucuu

SEQ ID NO: 336120 - RNA, 23 nt, Human
agggcccagccugcccccaccuu

SEQ ID NO: 336121 - RNA, 22 nt, Human
aguaaaggguggaaggcacuag

SEQ ID NO: 336122 - RNA, 21 nt, Human
aucagcuaagcagcauccccc

SEQ ID NO: 336123 - RNA, 18 nt, Human
aucuaucugucccuuuca

SEQ ID NO: 336124 - RNA, 24 nt, Human
auuccacgguguaaacaaaagcua

SEQ ID NO: 336125 - RNA, 20 nt, Human
caaacccaggcucaucccuu

SEQ ID NO: 336126 - RNA, 23 nt, Human
caagagaacacagggagccaaug

SEQ ID NO: 336127 - RNA, 22 nt, Human
cacccugaccccccaagagaac

SEQ ID NO: 336128 - RNA, 21 nt, Human
cagaauggaccugcaucuauc

SEQ ID NO: 336129 - RNA, 21 nt, Human
cagccccugcccaugcccacu

SEQ ID NO: 336130 - RNA, 18 nt, Human
cagccugcccccaccuug

SEQ ID NO: 336131 - RNA, 21 nt, Human
cagcuaagcagcauccccccu

SEQ ID NO: 336132 - RNA, 18 nt, Human
caugcccacugccccagc

SEQ ID NO: 336133 - RNA, 21 nt, Human
ccaauggcugagauggagggc

SEQ ID NO: 336134 - RNA, 20 nt, Human
ccacagccccugcccaugcc

SEQ ID NO: 336135 - RNA, 21 nt, Human
ccacagcggggaggucagggg

SEQ ID NO: 336136 - RNA, 20 nt, Human
ccacugccccagccugggag

SEQ ID NO: 336137 - RNA, 19 nt, Human
cccaacccccacagcgggg

SEQ ID NO: 336138 - RNA, 23 nt, Human
cccacugccccagccugggaggc

SEQ ID NO: 336139 - RNA, 21 nt, Human
cccaggcucaucccuuugccc

SEQ ID NO: 336140 - RNA, 22 nt, Human
cccccaagagaacacagggagc

SEQ ID NO: 336141 - RNA, 25 nt, Human
ccccccaagagaacacagggagccu

SEQ ID NO: 336142 - RNA, 21 nt, Human
cccccgggacuggcgagggag

SEQ ID NO: 336143 - RNA, 18 nt, Human
ccccgggacuggcgaggg

SEQ ID NO: 336144 - RNA, 22 nt, Human
ccccugcccaugcccacugccc

SEQ ID NO: 336145 - RNA, 24 nt, Human
cccgcccugccuggccugcccacu

SEQ ID NO: 336146 - RNA, 21 nt, Human
cccuagaaacuuuggcaaaaa

SEQ ID NO: 336147 - RNA, 24 nt, Human
cccugccuggccugcccacugccu

SEQ ID NO: 336148 - RNA, 19 nt, Human
cccugggaagucuaggacc

SEQ ID NO: 336149 - RNA, 20 nt, Human
cccugggaagucuaggaccc

SEQ ID NO: 336150 - RNA, 25 nt, Human
cccugggcucccccacccaagaccc

SEQ ID NO: 336151 - RNA, 18 nt, Human
ccgcccugccuggccugc

SEQ ID NO: 336152 - RNA, 20 nt, Human
ccuuuguccccuuuuugguc

SEQ ID NO: 336153 - RNA, 24 nt, Human
cuaggacccauggggcagugcuga

SEQ ID NO: 336154 - RNA, 23 nt, Human
cuaucugucccuuucacccucug

SEQ ID NO: 336155 - RNA, 19 nt, Human
cucccccacccaagacccc

SEQ ID NO: 336156 - RNA, 20 nt, Human
cucucagagagccaagcacc

SEQ ID NO: 336157 - RNA, 24 nt, Human
cugaagccccaacccccacagcgg

SEQ ID NO: 336158 - RNA, 18 nt, Human
cugcccccaccuugaccu

SEQ ID NO: 336159 - RNA, 21 nt, Human
cuggcagaggaaggggcugug

SEQ ID NO: 336160 - RNA, 20 nt, Human
cugggucagggcgggaucag

SEQ ID NO: 336161 - RNA, 21 nt, Human
cuguuccugccccagaaaugc

SEQ ID NO: 336162 - RNA, 18 nt, Human
cuuccucuugcccuggga

SEQ ID NO: 336163 - RNA, 22 nt, Human
cuuuguccccuuuuuggucucu

SEQ ID NO: 336164 - RNA, 23 nt, Human
cuuuuuggucucuaguguuccug

SEQ ID NO: 336165 - RNA, 25 nt, Human
gaaacuuuggcaaaaacaaggagcu

SEQ ID NO: 336166 - RNA, 24 nt, Human
gaagaaaggaggggucacaggggc

SEQ ID NO: 336167 - RNA, 22 nt, Human
gagccaagcaccuggcagagga

SEQ ID NO: 336168 - RNA, 19 nt, Human
gcaccccuagaaacuuugg

SEQ ID NO: 336169 - RNA, 19 nt, Human
gcccucucuccugguggga

SEQ ID NO: 336170 - RNA, 21 nt, Human
ggaaggggcuguggaauggca

SEQ ID NO: 336171 - RNA, 21 nt, Human
ggacagcacccugacccccca

SEQ ID NO: 336172 - RNA, 23 nt, Human
ggagcucauuggaaggggugggg

SEQ ID NO: 336173 - RNA, 18 nt, Human
gggaggcuccguacccgc

SEQ ID NO: 336174 - RNA, 20 nt, Human
gggcaggaggagcccaaggc

SEQ ID NO: 336175 - RNA, 21 nt, Human
gggcccugggcucccccaccc

SEQ ID NO: 336176 - RNA, 28 nt, Human
ggggcacagaggcuagcacacacccugc

SEQ ID NO: 336177 - RNA, 20 nt, Human
ggguggggagagggcagagc

SEQ ID NO: 336178 - RNA, 22 nt, Human
uaaauaaauagaggcuuccucu

SEQ ID NO: 336179 - RNA, 20 nt, Human
uaggacccauggggcagugc

SEQ ID NO: 336180 - RNA, 20 nt, Human
uaggagggucccugccccaa

SEQ ID NO: 336181 - RNA, 18 nt, Human
ucagcuaagcagcauccc

SEQ ID NO: 336182 - RNA, 19 nt, Human
ucauuggaaggggugggga

SEQ ID NO: 336183 - RNA, 25 nt, Human
ucuccuuuguccccuuuuuggucuc

SEQ ID NO: 336184 - RNA, 24 nt, Human
ucugucccuuucacccucuguucc

SEQ ID NO: 336185 - RNA, 19 nt, Human
ugaccccccaagagaacac

SEQ ID NO: 336186 - RNA, 22 nt, Human
ugcccaugcccacugccccagc

SEQ ID NO: 336187 - RNA, 23 nt, Human
ugcccucucuccuggugggagca

SEQ ID NO: 336188 - RNA, 22 nt, Human
ugccugaagccccaacccccac

SEQ ID NO: 336189 - RNA, 19 nt, Human
uggaaggcacuagggagag

SEQ ID NO: 336190 - RNA, 20 nt, Human
uggaauggcagggucuuccu

SEQ ID NO: 336191 - RNA, 22 nt, Human
uggaggaagaaaggagggguca

SEQ ID NO: 336192 - RNA, 23 nt, Human
ugggcucccccacccaagacccc

SEQ ID NO: 336193 - RNA, 24 nt, Human
uggggagagggcagagcagguccu

SEQ ID NO: 336194 - RNA, 21 nt, Human
uuagaguccaaacccaggcuc

SEQ ID NO: 336195 - RNA, 22 nt, Human
uugcaaaaauagaaaacucagc

SEQ ID NO: 336196 - RNA, 22 nt, Human
uuugcccucucuccugguggga

SEQ ID NO: 336197 - RNA, 24 nt, Human
uuuuuuuuuuuuuuuuuugaguuu

SEQ ID NO: 336198 - RNA, 27 nt, Human
uuuuuuuuuuuuuuuuuuuuuuugggg

SEQ ID NO: 336199 - RNA, 21 nt, Human
gauaugaaauuagaaguucac

SEQ ID NO: 336200 - RNA, 21 nt, Human
acccccacagcugcuucuaac

SEQ ID NO: 336201 - RNA, 18 nt, Human
agagagggaaacagagga

SEQ ID NO: 336202 - RNA, 26 nt, Human
cagcgagagagggaaacagaggaaag

SEQ ID NO: 336203 - RNA, 19 nt, Human
ccacagcugcuucuaacac

SEQ ID NO: 336204 - RNA, 22 nt, Human
cucaucuccacugggaccccca

SEQ ID NO: 336205 - RNA, 20 nt, Human
cuccacugggacccccacag

SEQ ID NO: 336206 - RNA, 20 nt, Human
gaggcaugggggaggcucau

SEQ ID NO: 336207 - RNA, 23 nt, Human
gagggucaggcugcuggaggcau

SEQ ID NO: 336208 - RNA, 21 nt, Human
uacuuuugccagcgagagagg

SEQ ID NO: 336209 - RNA, 18 nt, Human
aaacacacaguguucaaa

SEQ ID NO: 336210 - RNA, 26 nt, Human
ucuuuacuuaugcuuguguccacaug

SEQ ID NO: 336211 - RNA, 19 nt, Human
uggccacuuugguaaaaac

SEQ ID NO: 336212 - RNA, 19 nt, Human
ugguugacaaauuuucuuu

SEQ ID NO: 336213 - RNA, 18 nt, Human
uuuuuuuuuuuuuuuuug

SEQ ID NO: 336214 - RNA, 18 nt, Human
uuuuuuuuuuuuuuuuug

SEQ ID NO: 336215 - RNA, 21 nt, Human
aaaaauacacauacagaagua

SEQ ID NO: 336216 - RNA, 19 nt, Human
aaggagacauuaaacugaa

SEQ ID NO: 336217 - RNA, 18 nt, Human
aaucauugaacagucaaa

SEQ ID NO: 336218 - RNA, 20 nt, Human
acaaacucuggaaacuguaa

SEQ ID NO: 336219 - RNA, 23 nt, Human
acaugcugaauccaugcagaaca

SEQ ID NO: 336220 - RNA, 22 nt, Human
acuuuuaacaaaagcauucuag

SEQ ID NO: 336221 - RNA, 19 nt, Human
agaauguguuucuugucag

SEQ ID NO: 336222 - RNA, 23 nt, Human
agcuucccaaauuccugaacagc

SEQ ID NO: 336223 - RNA, 18 nt, Human
aggagacauuaaacugaa

SEQ ID NO: 336224 - RNA, 19 nt, Human
aggcagcugaugagguugu

SEQ ID NO: 336225 - RNA, 21 nt, Human
aggcagcugaugagguugucu

SEQ ID NO: 336226 - RNA, 18 nt, Human
auacagaaguaaauaaaa

SEQ ID NO: 336227 - RNA, 19 nt, Human
caaauaacuuuuaacaaaa

SEQ ID NO: 336228 - RNA, 25 nt, Human
caaauaacuuuuaacaaaagcauuc

SEQ ID NO: 336229 - RNA, 21 nt, Human
caaauggucauauuccuaauc

SEQ ID NO: 336230 - RNA, 21 nt, Human
caaauuccugaacagcagucu

SEQ ID NO: 336231 - RNA, 18 nt, Human
caccaaggcucagagguu

SEQ ID NO: 336232 - RNA, 23 nt, Human
caccagcagaaucuuggauuuug

SEQ ID NO: 336233 - RNA, 19 nt, Human
cagcaagagaaauagcaga

SEQ ID NO: 336234 - RNA, 19 nt, Human
caugcugaauccaugcaga

SEQ ID NO: 336235 - RNA, 31 nt, Human
cauucuauauauuuucuuucaacaguuccaa

SEQ ID NO: 336236 - RNA, 21 nt, Human
cauugaacagucaaaugguca

SEQ ID NO: 336237 - RNA, 25 nt, Human
ccagcagauacaacaaguagucaac

SEQ ID NO: 336238 - RNA, 22 nt, Human
cugaauccaugcagaacacugg

SEQ ID NO: 336239 - RNA, 18 nt, Human
gagguuguuaaagauuga

SEQ ID NO: 336240 - RNA, 18 nt, Human
gauuccauguggaaauag

SEQ ID NO: 336241 - RNA, 21 nt, Human
ggcauaguuauucaccagcag

SEQ ID NO: 336242 - RNA, 22 nt, Human
guuugcauagcucacacaucac

SEQ ID NO: 336243 - RNA, 21 nt, Human
uaaauacaaauaaucauugaa

SEQ ID NO: 336244 - RNA, 19 nt, Human
uaaauacagucuuugacaa

SEQ ID NO: 336245 - RNA, 23 nt, Human
uaacuuuuaacaaaagcauucua

SEQ ID NO: 336246 - RNA, 21 nt, Human
uaagagacagcaaaacuuugg

SEQ ID NO: 336247 - RNA, 24 nt, Human
uaauauuuacugaauucaaacuau

SEQ ID NO: 336248 - RNA, 22 nt, Human
uaaucauugaacagucaaauga

SEQ ID NO: 336249 - RNA, 24 nt, Human
uagucuauaaaaugguugaauggg

SEQ ID NO: 336250 - RNA, 23 nt, Human
ucaacgguauggccaccucuucc

SEQ ID NO: 336251 - RNA, 22 nt, Human
ucagaaguucaaagauggauaa

SEQ ID NO: 336252 - RNA, 22 nt, Human
uccugaacagcagucuuaacuu

SEQ ID NO: 336253 - RNA, 19 nt, Human
ugaacagcagucuuaacuu

SEQ ID NO: 336254 - RNA, 24 nt, Human
ugguugaauggguaacaugcauug

SEQ ID NO: 336255 - RNA, 26 nt, Human
ugugaaagguggucuguacaccaagg

SEQ ID NO: 336256 - RNA, 23 nt, Human
ugugaauacuucacaaaaauaca

SEQ ID NO: 336257 - RNA, 18 nt, Human
uuaaaaguauacagcaaa

SEQ ID NO: 336258 - RNA, 25 nt, Human
uucacaaaaauacacauacagaagg

SEQ ID NO: 336259 - RNA, 20 nt, Human
uucaccagcagaaucuugga

SEQ ID NO: 336260 - RNA, 19 nt, Human
uucauaguucuuucucuaa

SEQ ID NO: 336261 - RNA, 18 nt, Human
uugcauagcucacacauc

SEQ ID NO: 336262 - RNA, 24 nt, Human
uugcauagcucacacaucacugga

SEQ ID NO: 336263 - RNA, 18 nt, Human
uuggcaagagcaaaggag

SEQ ID NO: 336264 - RNA, 24 nt, Human
uugguagucuauaaaaugguugaa

SEQ ID NO: 336265 - RNA, 22 nt, Human
aaccacagaaucaaagaggucc

SEQ ID NO: 336266 - RNA, 20 nt, Human
aaggagacaggagacucccg

SEQ ID NO: 336267 - RNA, 21 nt, Human
acaccugccuccucucuccaa

SEQ ID NO: 336268 - RNA, 25 nt, Human
acaccugccuccucucuccaaccuc

SEQ ID NO: 336269 - RNA, 19 nt, Human
agacaggagacucccgggg

SEQ ID NO: 336270 - RNA, 23 nt, Human
aggcacacaggacuaggcacguc

SEQ ID NO: 336271 - RNA, 19 nt, Human
agggaggggcuuugaacag

SEQ ID NO: 336272 - RNA, 18 nt, Human
agguccaaggagacagga

SEQ ID NO: 336273 - RNA, 19 nt, Human
agguccaaggagacaggag

SEQ ID NO: 336274 - RNA, 18 nt, Human
aguuucacucagugcaag

SEQ ID NO: 336275 - RNA, 22 nt, Human
caaggcacacaggacuaggcac

SEQ ID NO: 336276 - RNA, 19 nt, Human
caccugccuccucucucca

SEQ ID NO: 336277 - RNA, 19 nt, Human
caccugcuucaagccuggc

SEQ ID NO: 336278 - RNA, 26 nt, Human
cacuccagucugaaucaagccagagg

SEQ ID NO: 336279 - RNA, 24 nt, Human
cagagggcaaguuucacucagugc

SEQ ID NO: 336280 - RNA, 21 nt, Human
cagcagcucagggccaggcug

SEQ ID NO: 336281 - RNA, 19 nt, Human
cagcucagggccaggcugg

SEQ ID NO: 336282 - RNA, 22 nt, Human
cagggccaggcuggccuccuug

SEQ ID NO: 336283 - RNA, 24 nt, Human
cagguuccgaggcuggaccagggg

SEQ ID NO: 336284 - RNA, 18 nt, Human
cagucugaaucaagccag

SEQ ID NO: 336285 - RNA, 19 nt, Human
ccaaaccacagaaucaaag

SEQ ID NO: 336286 - RNA, 22 nt, Human
ccaaagggcuuccaugcccuga

SEQ ID NO: 336287 - RNA, 22 nt, Human
cccagucucagucaaauaaguc

SEQ ID NO: 336288 - RNA, 22 nt, Human
ccccccgguccaggagcaagua

SEQ ID NO: 336289 - RNA, 23 nt, Human
ccccuggcucuugcuccuccuuc

SEQ ID NO: 336290 - RNA, 19 nt, Human
cccuggcucuugcuccucc

SEQ ID NO: 336291 - RNA, 19 nt, Human
ccgcgccccccgguccagg

SEQ ID NO: 336292 - RNA, 22 nt, Human
ccggggcaggaugcgcugaaga

SEQ ID NO: 336293 - RNA, 23 nt, Human
ccuauccacuccagucugaauca

SEQ ID NO: 336294 - RNA, 19 nt, Human
ccuccucucuccaaccucc

SEQ ID NO: 336295 - RNA, 22 nt, Human
ccuccuuccgggcuagcucugg

SEQ ID NO: 336296 - RNA, 23 nt, Human
ccuccuuccgggcuagcucuggg

SEQ ID NO: 336297 - RNA, 22 nt, Human
ccuccuugguauggauagaggc

SEQ ID NO: 336298 - RNA, 18 nt, Human
ccucguggucccagugcc

SEQ ID NO: 336299 - RNA, 21 nt, Human
ccucguggucccagugccgcc

SEQ ID NO: 336300 - RNA, 23 nt, Human
ccucucuccaaccuccgcgcccc

SEQ ID NO: 336301 - RNA, 24 nt, Human
cuccuugguauggauagaggccag

SEQ ID NO: 336302 - RNA, 25 nt, Human
gcaggaugcgcugaagagggccccc

SEQ ID NO: 336303 - RNA, 19 nt, Human
gccuccucucuccaaccuc

SEQ ID NO: 336304 - RNA, 19 nt, Human
gcucagggccaggcuggcc

SEQ ID NO: 336305 - RNA, 23 nt, Human
ggcaggaugcgcugaagagggcc

SEQ ID NO: 336306 - RNA, 23 nt, Human
gggcaggaugcgcugaagagggc

SEQ ID NO: 336307 - RNA, 18 nt, Human
gggcuagcucuggcauuu

SEQ ID NO: 336308 - RNA, 22 nt, Human
uagagaccccagucucagucaa

SEQ ID NO: 336309 - RNA, 23 nt, Human
uagcaugcagacaccugccuccu

SEQ ID NO: 336310 - RNA, 24 nt, Human
uauccuauccacuccagucugaau

SEQ ID NO: 336311 - RNA, 19 nt, Human
ucaggaauucagguccagc

SEQ ID NO: 336312 - RNA, 21 nt, Human
uccgaggcuggaccaggggac

SEQ ID NO: 336313 - RNA, 22 nt, Human
uccgcgccccccgguccaggag

SEQ ID NO: 336314 - RNA, 23 nt, Human
ucgcauguucccuggggguccgu

SEQ ID NO: 336315 - RNA, 19 nt, Human
ugaagagggcccccuggcu

SEQ ID NO: 336316 - RNA, 22 nt, Human
ugcuucaagccuggcucccugc

SEQ ID NO: 336317 - RNA, 20 nt, Human
ugggagccuccaaaccacag

SEQ ID NO: 336318 - RNA, 22 nt, Human
uggggcaacaacaucacauggg

SEQ ID NO: 336319 - RNA, 20 nt, Human
ugguauggauagaggccagu

SEQ ID NO: 336320 - RNA, 21 nt, Human
ugguauggauagaggccaguu

SEQ ID NO: 336321 - RNA, 25 nt, Human
uggugggugggaggcgucgccagag

SEQ ID NO: 336322 - RNA, 23 nt, Human
uucacucagugcaaggcuggccc

SEQ ID NO: 336323 - RNA, 22 nt, Human
uuccaggcagaagggcgcucag

SEQ ID NO: 336324 - RNA, 21 nt, Human
uuugaacauccccuuccaucu

SEQ ID NO: 336325 - RNA, 24 nt, Human
uuuuuaggagugaggccauuuagu

SEQ ID NO: 336326 - RNA, 18 nt, Human
uuuuuuuuuuuaggagug

SEQ ID NO: 336327 - RNA, 18 nt, Human
uuuuuuuuuuuuaggagu

SEQ ID NO: 336328 - RNA, 23 nt, Human
uuuuuuuuuuuuuuuuuuuuagg

SEQ ID NO: 336329 - RNA, 23 nt, Human
aaaaaaccaaauaaagcaguggg

SEQ ID NO: 336330 - RNA, 25 nt, Human
aaaccaaauaaagcaauaacuuuaa

SEQ ID NO: 336331 - RNA, 20 nt, Human
accaaauaaagcaauaacuu

SEQ ID NO: 336332 - RNA, 21 nt, Human
agcggcugagggucgcugggg

SEQ ID NO: 336333 - RNA, 21 nt, Human
aggcugggcucggcugggguu

SEQ ID NO: 336334 - RNA, 20 nt, Human
caacccggaaucacagacaa

SEQ ID NO: 336335 - RNA, 22 nt, Human
cacacacacacaguauaaacac

SEQ ID NO: 336336 - RNA, 24 nt, Human
cacacacacacaguauaaacaccu

SEQ ID NO: 336337 - RNA, 23 nt, Human
cacaucccucccccaccccgcgc

SEQ ID NO: 336338 - RNA, 18 nt, Human
cacauguaaacaagucac

SEQ ID NO: 336339 - RNA, 29 nt, Human
cagcaacccggaaucacagacaagauaau

SEQ ID NO: 336340 - RNA, 22 nt, Human
cccccccgcuuaguuucgggag

SEQ ID NO: 336341 - RNA, 20 nt, Human
cccccgcuuaguuucgggag

SEQ ID NO: 336342 - RNA, 22 nt, Human
cccucccccaccccgcgcucac

SEQ ID NO: 336343 - RNA, 20 nt, Human
ccgcgagggcgggcgcgggg

SEQ ID NO: 336344 - RNA, 19 nt, Human
ccgggaggggagacgccag

SEQ ID NO: 336345 - RNA, 27 nt, Human
ccucacacacacacaguauaaacaccc

SEQ ID NO: 336346 - RNA, 21 nt, Human
ccucggcugggcccucgcucc

SEQ ID NO: 336347 - RNA, 18 nt, Human
cgcugggguggcacgcgg

SEQ ID NO: 336348 - RNA, 21 nt, Human
cggccuggggcgcaccgggcc

SEQ ID NO: 336349 - RNA, 25 nt, Human
cggcugggcccucgcucccaaaguu

SEQ ID NO: 336350 - RNA, 21 nt, Human
cgggcugggcucgggcuaggc

SEQ ID NO: 336351 - RNA, 18 nt, Human
cuccccagugcugggggc

SEQ ID NO: 336352 - RNA, 21 nt, Human
cuccccagugcugggggcgga

SEQ ID NO: 336353 - RNA, 19 nt, Human
cugacccucaagcgggcau

SEQ ID NO: 336354 - RNA, 20 nt, Human
gagcagaugaccgucccuuc

SEQ ID NO: 336355 - RNA, 19 nt, Human
gccucaaugggggaccggg

SEQ ID NO: 336356 - RNA, 25 nt, Human
ggagcagaugaccgucccuucucgg

SEQ ID NO: 336357 - RNA, 19 nt, Human
ggcagagagcggcugaggg

SEQ ID NO: 336358 - RNA, 22 nt, Human
ggcuaggcugggcucggcuggg

SEQ ID NO: 336359 - RNA, 24 nt, Human
ggcugggcccucgcucccaaaguu

SEQ ID NO: 336360 - RNA, 19 nt, Human
gggcagaggggccgcgagg

SEQ ID NO: 336361 - RNA, 18 nt, Human
gggcuaggcugggcucgg

SEQ ID NO: 336362 - RNA, 21 nt, Human
gucgcugggguggcacgcggg

SEQ ID NO: 336363 - RNA, 18 nt, Human
uaggcugggcucggcugg

SEQ ID NO: 336364 - RNA, 22 nt, Human
ucaagcgggcaugacgguuucu

SEQ ID NO: 336365 - RNA, 22 nt, Human
ucacaucccucccccaccccgc

SEQ ID NO: 336366 - RNA, 23 nt, Human
ucacaucccucccccaccccgcg

SEQ ID NO: 336367 - RNA, 23 nt, Human
ucaguggcgccuccccagugcug

SEQ ID NO: 336368 - RNA, 19 nt, Human
uccgcgcgcgcucccggcc

SEQ ID NO: 336369 - RNA, 20 nt, Human
uccgcgcgcgcucccggccu

SEQ ID NO: 336370 - RNA, 21 nt, Human
uccgcgcgcgcucccggccug

SEQ ID NO: 336371 - RNA, 20 nt, Human
uccggagcagaugaccgucc

SEQ ID NO: 336372 - RNA, 21 nt, Human
ucgcucccaaaguuauggggg

SEQ ID NO: 336373 - RNA, 18 nt, Human
uggcacgcggggugagcg

SEQ ID NO: 336374 - RNA, 22 nt, Human
uggcuaugauuugacccacgcc

SEQ ID NO: 336375 - RNA, 21 nt, Human
ugucacagcaacccggaauca

SEQ ID NO: 336376 - RNA, 23 nt, Human
ugucacagcaacccggaaucaca

SEQ ID NO: 336377 - RNA, 19 nt, Human
uguuccuuugugcaguuuc

SEQ ID NO: 336378 - RNA, 23 nt, Human
uuuuuuuuuuuuuuuuccauuuu

SEQ ID NO: 336379 - RNA, 18 nt, Human
aaaaaggaaaaugaucau

SEQ ID NO: 336380 - RNA, 21 nt, Human
aaagaaaaugagaagugaccc

SEQ ID NO: 336381 - RNA, 23 nt, Human
aaauaguauuaauagugaagaca

SEQ ID NO: 336382 - RNA, 23 nt, Human
aacacaaauacuauuaacuugua

SEQ ID NO: 336383 - RNA, 20 nt, Human
aagaagcaaauccauuuucc

SEQ ID NO: 336384 - RNA, 23 nt, Human
aagaagcaaauccauuuuccaga

SEQ ID NO: 336385 - RNA, 19 nt, Human
aaguacuguuuuaaagcug

SEQ ID NO: 336386 - RNA, 21 nt, Human
aagucgugugagaugcagaaa

SEQ ID NO: 336387 - RNA, 23 nt, Human
acaggguaagaagcaaauccauu

SEQ ID NO: 336388 - RNA, 24 nt, Human
acaugcaugccugauauuguauau

SEQ ID NO: 336389 - RNA, 19 nt, Human
accaucuuuggucuauauc

SEQ ID NO: 336390 - RNA, 20 nt, Human
acuaggcuugauaagccaaa

SEQ ID NO: 336391 - RNA, 22 nt, Human
acuugugauuuugccaaacaau

SEQ ID NO: 336392 - RNA, 21 nt, Human
agaagcaaauccauuuuccag

SEQ ID NO: 336393 - RNA, 27 nt, Human
aguaaaaagguaagucagcaaagaaaa

SEQ ID NO: 336394 - RNA, 20 nt, Human
agucgugugagaugcagaaa

SEQ ID NO: 336395 - RNA, 22 nt, Human
augaacaucagugguaugaaua

SEQ ID NO: 336396 - RNA, 22 nt, Human
caacacaaauacuauuaacuug

SEQ ID NO: 336397 - RNA, 27 nt, Human
cacaaauacuauuaacuuguauacuau

SEQ ID NO: 336398 - RNA, 21 nt, Human
caccaccgccgccgccugccg

SEQ ID NO: 336399 - RNA, 20 nt, Human
cacuaacuacaagcuaguuc

SEQ ID NO: 336400 - RNA, 23 nt, Human
cagaaaacacaggguaagaagca

SEQ ID NO: 336401 - RNA, 18 nt, Human
cagacucuucauagacuu

SEQ ID NO: 336402 - RNA, 24 nt, Human
cagugguaugaauagcaaaaguuu

SEQ ID NO: 336403 - RNA, 26 nt, Human
cauaugauuuuuuuuuuuuuaagaga

SEQ ID NO: 336404 - RNA, 22 nt, Human
cauggaagcuaaguacccccaa

SEQ ID NO: 336405 - RNA, 22 nt, Human
ccaggcaacuaaaugagcccau

SEQ ID NO: 336406 - RNA, 24 nt, Human
cccccgccaccaccgccgccgccu

SEQ ID NO: 336407 - RNA, 24 nt, Human
ccccgccaccaccgccgccgccug

SEQ ID NO: 336408 - RNA, 26 nt, Human
ccgccaccaccgccgccgccugccgg

SEQ ID NO: 336409 - RNA, 24 nt, Human
ccgccgccugccggcucucucccc

SEQ ID NO: 336410 - RNA, 18 nt, Human
cuuaugaagacuuggugc

SEQ ID NO: 336411 - RNA, 20 nt, Human
gaaaugauagucauguuuua

SEQ ID NO: 336412 - RNA, 23 nt, Human
gagaaaacagugcugcacauuag

SEQ ID NO: 336413 - RNA, 24 nt, Human
gcaaagaaaaugagaagugacccu

SEQ ID NO: 336414 - RNA, 18 nt, Human
gccggcucucuccccccc

SEQ ID NO: 336415 - RNA, 20 nt, Human
gcggcccgcgcucccggugc

SEQ ID NO: 336416 - RNA, 22 nt, Human
gcuacaacuauaaguugaccug

SEQ ID NO: 336417 - RNA, 18 nt, Human
gcuggacuguaaaaaccu

SEQ ID NO: 336418 - RNA, 22 nt, Human
gcugggauacagaggaaaucua

SEQ ID NO: 336419 - RNA, 21 nt, Human
ggaggaacucaaaugggaacu

SEQ ID NO: 336420 - RNA, 20 nt, Human
ggccgcggcccgcgcucccg

SEQ ID NO: 336421 - RNA, 19 nt, Human
ggggaucuuuacuucgaau

SEQ ID NO: 336422 - RNA, 21 nt, Human
ggucaguguaaaguuccucag

SEQ ID NO: 336423 - RNA, 19 nt, Human
uaaaaagaggcugacaaau

SEQ ID NO: 336424 - RNA, 19 nt, Human
uaagcaauacuguauguau

SEQ ID NO: 336425 - RNA, 23 nt, Human
uaagccaaagccuuuuuuuuuuu

SEQ ID NO: 336426 - RNA, 20 nt, Human
uaagucagcaaagaaaauga

SEQ ID NO: 336427 - RNA, 24 nt, Human
uaaguuguaaggcuacaacuauaa

SEQ ID NO: 336428 - RNA, 25 nt, Human
uacaagcuaguucuauaucacuaac

SEQ ID NO: 336429 - RNA, 20 nt, Human
uacaguuuaggaaaugagau

SEQ ID NO: 336430 - RNA, 19 nt, Human
uacuauaccucuuuggccc

SEQ ID NO: 336431 - RNA, 22 nt, Human
uagaguacaccaucuuuggucu

SEQ ID NO: 336432 - RNA, 21 nt, Human
uaggcauggaagcuaaguacc

SEQ ID NO: 336433 - RNA, 19 nt, Human
uauaaaugacuaaaacuug

SEQ ID NO: 336434 - RNA, 25 nt, Human
uauacauauuauauacauauguaca

SEQ ID NO: 336435 - RNA, 19 nt, Human
uauauacauauuauauaca

SEQ ID NO: 336436 - RNA, 19 nt, Human
uauauacauauuauauaca

SEQ ID NO: 336437 - RNA, 22 nt, Human
ucagaagagaaagauggaacaa

SEQ ID NO: 336438 - RNA, 20 nt, Human
ucaucuacagauugugcuac

SEQ ID NO: 336439 - RNA, 22 nt, Human
ucgcauacuuuugaugaacauc

SEQ ID NO: 336440 - RNA, 24 nt, Human
ucgcccccgccaccaccgccgccg

SEQ ID NO: 336441 - RNA, 24 nt, Human
ucuacagauugugcuacuuaguuu

SEQ ID NO: 336442 - RNA, 23 nt, Human
ucuuuggcccuugcuggacugua

SEQ ID NO: 336443 - RNA, 18 nt, Human
ugaagaguuaaacagacu

SEQ ID NO: 336444 - RNA, 25 nt, Human
ugagaagugacccugcuguuaauac

SEQ ID NO: 336445 - RNA, 20 nt, Human
ugagaugcagaaauuuacac

SEQ ID NO: 336446 - RNA, 22 nt, Human
ugagguagugaagaaggagcca

SEQ ID NO: 336447 - RNA, 23 nt, Human
ugauauuguauauacauauuaua

SEQ ID NO: 336448 - RNA, 20 nt, Human
ugcagaaaacacaggguaag

SEQ ID NO: 336449 - RNA, 18 nt, Human
uggaagcuaaguaccccc

SEQ ID NO: 336450 - RNA, 20 nt, Human
uggagaggaggaagaaugaa

SEQ ID NO: 336451 - RNA, 18 nt, Human
uggaggaaacaaaauucc

SEQ ID NO: 336452 - RNA, 26 nt, Human
uggaggaaacaaaauuccaagccaca

SEQ ID NO: 336453 - RNA, 23 nt, Human
uggcagauaaauaccuggccaaa

SEQ ID NO: 336454 - RNA, 21 nt, Human
ugggauacagaggaaaucuac

SEQ ID NO: 336455 - RNA, 21 nt, Human
uguauauacauauuauauaca

SEQ ID NO: 336456 - RNA, 29 nt, Human
uguauauacauauuauauacauauguaca

SEQ ID NO: 336457 - RNA, 23 nt, Human
ugugacaccuuuugaaucccuau

SEQ ID NO: 336458 - RNA, 20 nt, Human
ugugacuaaacuauuuccuu

SEQ ID NO: 336459 - RNA, 23 nt, Human
uguuuagccauugcuaauuugac

SEQ ID NO: 336460 - RNA, 22 nt, Human
uuaaaguacuguuuuaaagcug

SEQ ID NO: 336461 - RNA, 19 nt, Human
uucacaaaguaugcuggga

SEQ ID NO: 336462 - RNA, 25 nt, Human
uucacaaaguaugcugggauacaga

SEQ ID NO: 336463 - RNA, 21 nt, Human
uucuagguagauaugcucaug

SEQ ID NO: 336464 - RNA, 20 nt, Human
uucuugcauuucuauauuau

SEQ ID NO: 336465 - RNA, 25 nt, Human
uuguauacuauaccucuuuggcccu

SEQ ID NO: 336466 - RNA, 27 nt, Human
uuucaagucagucugguaccagacuuu

SEQ ID NO: 336467 - RNA, 24 nt, Human
uuuuuuuuuaagccaucaauuccu

SEQ ID NO: 336468 - RNA, 24 nt, Human
uuuuuuuuuuuuuuuuuguagggg

SEQ ID NO: 336469 - RNA, 27 nt, Human
acccccauccccagccuccugccccga

SEQ ID NO: 336470 - RNA, 28 nt, Human
acccccauccccagccuccugccccgac

SEQ ID NO: 336471 - RNA, 21 nt, Human
acccucauaucccacccccau

SEQ ID NO: 336472 - RNA, 18 nt, Human
aggcagcggguggcacag

SEQ ID NO: 336473 - RNA, 23 nt, Human
aggcagcggguggcacaggccua

SEQ ID NO: 336474 - RNA, 25 nt, Human
aggcaggaaugaguccuugauccaa

SEQ ID NO: 336475 - RNA, 18 nt, Human
agggacaccagcccuggc

SEQ ID NO: 336476 - RNA, 18 nt, Human
aucccacccccaucccca

SEQ ID NO: 336477 - RNA, 18 nt, Human
caaauauucacaagaguc

SEQ ID NO: 336478 - RNA, 25 nt, Human
caccagcccuggcccugcccucagc

SEQ ID NO: 336479 - RNA, 21 nt, Human
cacccucauaucccaccccca

SEQ ID NO: 336480 - RNA, 23 nt, Human
caggcagcggguggcacaggccu

SEQ ID NO: 336481 - RNA, 18 nt, Human
cauccccagccuccugcc

SEQ ID NO: 336482 - RNA, 27 nt, Human
caucuggaaaauacaaauauucacaag

SEQ ID NO: 336483 - RNA, 21 nt, Human
ccaaggcaggaaugaguccuu

SEQ ID NO: 336484 - RNA, 21 nt, Human
ccacccucauaucccaccccc

SEQ ID NO: 336485 - RNA, 22 nt, Human
ccacccucauaucccaccccca

SEQ ID NO: 336486 - RNA, 24 nt, Human
ccauccccagccuccugccccgac

SEQ ID NO: 336487 - RNA, 18 nt, Human
ccccagccuccugccccg

SEQ ID NO: 336488 - RNA, 23 nt, Human
ccccagccuccugccccgacacc

SEQ ID NO: 336489 - RNA, 26 nt, Human
ccccauccccagccuccugccccgac

SEQ ID NO: 336490 - RNA, 23 nt, Human
cccccaggcucccugcucugguu

SEQ ID NO: 336491 - RNA, 21 nt, Human
ccuggcccugcccucagcugc

SEQ ID NO: 336492 - RNA, 23 nt, Human
cggcccgggaccgggcgucuucc

SEQ ID NO: 336493 - RNA, 23 nt, Human
cgggaccgggcgucuuccugcag

SEQ ID NO: 336494 - RNA, 24 nt, Human
cgggcgucuuccugcaggcagcgg

SEQ ID NO: 336495 - RNA, 23 nt, Human
cucauaucccacccccaucccca

SEQ ID NO: 336496 - RNA, 24 nt, Human
cuccugccccgacacccccaggcu

SEQ ID NO: 336497 - RNA, 22 nt, Human
cugcaugccacccucauauccc

SEQ ID NO: 336498 - RNA, 24 nt, Human
cuggcccugcccucagcugcaugc

SEQ ID NO: 336499 - RNA, 20 nt, Human
gcaugccacccucauauccc

SEQ ID NO: 336500 - RNA, 20 nt, Human
gccccgacacccccaggcuc

SEQ ID NO: 336501 - RNA, 25 nt, Human
gccuccugccccgacacccccaggc

SEQ ID NO: 336502 - RNA, 22 nt, Human
gggagagggaccuguggggagc

SEQ ID NO: 336503 - RNA, 23 nt, Human
ggggaugggcuaggacaagaugg

SEQ ID NO: 336504 - RNA, 19 nt, Human
uaacccggcccgggaccgg

SEQ ID NO: 336505 - RNA, 18 nt, Human
ucacaagagucuguacaa

SEQ ID NO: 336506 - RNA, 25 nt, Human
uccccagccuccugccccgacaccc

SEQ ID NO: 336507 - RNA, 19 nt, Human
ucuccaaggcaggaaugag

SEQ ID NO: 336508 - RNA, 21 nt, Human
ugccacccucauaucccaccc

SEQ ID NO: 336509 - RNA, 18 nt, Human
ugccccgacacccccagg

SEQ ID NO: 336510 - RNA, 25 nt, Human
uggaaaauacaaauauucacaagag

SEQ ID NO: 336511 - RNA, 18 nt, Human
uggcacaggccuagugga

SEQ ID NO: 336512 - RNA, 23 nt, Human
uggggagagggaccuguggggag

SEQ ID NO: 336513 - RNA, 24 nt, Human
uuccugcaggcagcggguggcaca

SEQ ID NO: 336514 - RNA, 21 nt, Human
uuuuggggagagggaccugug

SEQ ID NO: 336515 - RNA, 19 nt, Human
aaaccaagacucuuccuca

SEQ ID NO: 336516 - RNA, 22 nt, Human
acccacagguggacacagggag

SEQ ID NO: 336517 - RNA, 19 nt, Human
accccaaccccuuucccca

SEQ ID NO: 336518 - RNA, 22 nt, Human
acccuuagcucugauaaggaua

SEQ ID NO: 336519 - RNA, 23 nt, Human
agacuucugucugcaccacuccu

SEQ ID NO: 336520 - RNA, 23 nt, Human
agagaaaccaagacucuuccuca

SEQ ID NO: 336521 - RNA, 18 nt, Human
agcagcuucucagggcag

SEQ ID NO: 336522 - RNA, 19 nt, Human
agccagcacucccugaccu

SEQ ID NO: 336523 - RNA, 19 nt, Human
auaccuggcuacacccaca

SEQ ID NO: 336524 - RNA, 23 nt, Human
cacacagacccuggcccagggac

SEQ ID NO: 336525 - RNA, 23 nt, Human
caccccaaccccuuuccccacag

SEQ ID NO: 336526 - RNA, 23 nt, Human
cacuggcccugucacacucacac

SEQ ID NO: 336527 - RNA, 25 nt, Human
cacuucugagacaaaaauugaggag

SEQ ID NO: 336528 - RNA, 22 nt, Human
cauaaaaaacaccugagggaga

SEQ ID NO: 336529 - RNA, 19 nt, Human
ccacaggccccacuggccc

SEQ ID NO: 336530 - RNA, 19 nt, Human
ccagggacauccuccucau

SEQ ID NO: 336531 - RNA, 20 nt, Human
ccagugcccacauucacaca

SEQ ID NO: 336532 - RNA, 23 nt, Human
cccccagcacaggagggccucca

SEQ ID NO: 336533 - RNA, 18 nt, Human
cccgugcuucgcuggcuu

SEQ ID NO: 336534 - RNA, 19 nt, Human
cccuggcccacuaaggccc

SEQ ID NO: 336535 - RNA, 20 nt, Human
ccuggcccacuaaggcccag

SEQ ID NO: 336536 - RNA, 18 nt, Human
ccuuauucugagcaccca

SEQ ID NO: 336537 - RNA, 24 nt, Human
cgucaccccugcaaacaugacccu

SEQ ID NO: 336538 - RNA, 23 nt, Human
cuccugcugcaggccuggagcag

SEQ ID NO: 336539 - RNA, 22 nt, Human
cugagacaaaaauugaggagac

SEQ ID NO: 336540 - RNA, 24 nt, Human
cugcaccacuccugcugcaggccu

SEQ ID NO: 336541 - RNA, 22 nt, Human
gaccacauucaagauccaaaac

SEQ ID NO: 336542 - RNA, 22 nt, Human
gagccagcacucccugaccuca

SEQ ID NO: 336543 - RNA, 21 nt, Human
gaugacugucaccccaacccc

SEQ ID NO: 336544 - RNA, 22 nt, Human
gcaagcuacuucgcuguucucu

SEQ ID NO: 336545 - RNA, 20 nt, Human
gcgcugccugcugucugccu

SEQ ID NO: 336546 - RNA, 20 nt, Human
ggcccugucacacucacacg

SEQ ID NO: 336547 - RNA, 19 nt, Human
gggcagcccuggcccacua

SEQ ID NO: 336548 - RNA, 23 nt, Human
guaaugagggcagaggggugcag

SEQ ID NO: 336549 - RNA, 26 nt, Human
gucacacucacacggcacgcacuugg

SEQ ID NO: 336550 - RNA, 19 nt, Human
uccaugcacacucauucca

SEQ ID NO: 336551 - RNA, 19 nt, Human
ucucagggcagcccuggcc

SEQ ID NO: 336552 - RNA, 19 nt, Human
ucucagggcagcccuggcc

SEQ ID NO: 336553 - RNA, 18 nt, Human
ugacugucaccccaaccc

SEQ ID NO: 336554 - RNA, 18 nt, Human
ugagacaaaaauugagga

SEQ ID NO: 336555 - RNA, 18 nt, Human
ugagggagagacccuggc

SEQ ID NO: 336556 - RNA, 22 nt, Human
ugauuagcaaauaagguaugaa

SEQ ID NO: 336557 - RNA, 21 nt, Human
ugcuguacugugagccagcac

SEQ ID NO: 336558 - RNA, 21 nt, Human
uggcacuguagagagaaacca

SEQ ID NO: 336559 - RNA, 21 nt, Human
uggcccagggacauccuccuc

SEQ ID NO: 336560 - RNA, 18 nt, Human
uucucagggcagcccugg

SEQ ID NO: 336561 - RNA, 18 nt, Human
uuuuuuuuuuuuggaucu

SEQ ID NO: 336562 - RNA, 21 nt, Human
uuuuuuuuuuuuuuuuuggau

SEQ ID NO: 336563 - RNA, 22 nt, Human
uuuuuuuuuuuuuuuuuuuggg

SEQ ID NO: 336564 - RNA, 19 nt, Human
aaaguuucucaaacucuau

SEQ ID NO: 336565 - RNA, 23 nt, Human
aauucuccucucaaauaguuuga

SEQ ID NO: 336566 - RNA, 24 nt, Human
acucuauuuuuccgccuccccugc

SEQ ID NO: 336567 - RNA, 25 nt, Human
acucuauuuuuccgccuccccugcu

SEQ ID NO: 336568 - RNA, 20 nt, Human
agcgcucagcccgcugccgc

SEQ ID NO: 336569 - RNA, 24 nt, Human
aggcgacagggaaagaggggccga

SEQ ID NO: 336570 - RNA, 18 nt, Human
aggcggccagagggccuc

SEQ ID NO: 336571 - RNA, 22 nt, Human
caacccgacgggucccgacccu

SEQ ID NO: 336572 - RNA, 18 nt, Human
cagcccgcugccgccuua

SEQ ID NO: 336573 - RNA, 20 nt, Human
cagccuguuugggccuggag

SEQ ID NO: 336574 - RNA, 24 nt, Human
ccaagccuccugggaauggccaag

SEQ ID NO: 336575 - RNA, 20 nt, Human
ccccgugcaucgggagcagg

SEQ ID NO: 336576 - RNA, 18 nt, Human
cccggcagccuguugccc

SEQ ID NO: 336577 - RNA, 21 nt, Human
cccggggucggaucccaagac

SEQ ID NO: 336578 - RNA, 20 nt, Human
cccugggagagaggaugcgg

SEQ ID NO: 336579 - RNA, 21 nt, Human
ccuccagcugcagggcugagg

SEQ ID NO: 336580 - RNA, 22 nt, Human
ccuccccugcuucccuguuaug

SEQ ID NO: 336581 - RNA, 21 nt, Human
cgagcuggggagggggguugu

SEQ ID NO: 336582 - RNA, 19 nt, Human
cggcccggggucggauccc

SEQ ID NO: 336583 - RNA, 20 nt, Human
cguggcccugaacuaugcuu

SEQ ID NO: 336584 - RNA, 21 nt, Human
gcgaagugcguugaggcggcc

SEQ ID NO: 336585 - RNA, 18 nt, Human
gcggggcccggcagccug

SEQ ID NO: 336586 - RNA, 21 nt, Human
ggagggggguugucccuggga

SEQ ID NO: 336587 - RNA, 19 nt, Human
ggccgagcuggggaggggg

SEQ ID NO: 336588 - RNA, 18 nt, Human
ggugcggucggcccgggg

SEQ ID NO: 336589 - RNA, 20 nt, Human
gguggccgagcgcucagccc

SEQ ID NO: 336590 - RNA, 18 nt, Human
guggccgagcgcucagcc

SEQ ID NO: 336591 - RNA, 21 nt, Human
guggccgagcgcucagcccgc

SEQ ID NO: 336592 - RNA, 21 nt, Human
guggcugcaggcgacagggaa

SEQ ID NO: 336593 - RNA, 22 nt, Human
ucccugggagagaggaugcggg

SEQ ID NO: 336594 - RNA, 24 nt, Human
ucuccaagccuccugggaauggcc

SEQ ID NO: 336595 - RNA, 21 nt, Human
ugaaagucgcccuucuccccg

SEQ ID NO: 336596 - RNA, 19 nt, Human
ugcccuccagcugcagggc

SEQ ID NO: 336597 - RNA, 23 nt, Human
ugcgcacgcuggggguggccgag

SEQ ID NO: 336598 - RNA, 20 nt, Human
ugcuuggcggguggcugcag

SEQ ID NO: 336599 - RNA, 22 nt, Human
ugggagcggcguggccagcggg

SEQ ID NO: 336600 - RNA, 23 nt, Human
ugggagcggcguggccagcgggg

SEQ ID NO: 336601 - RNA, 23 nt, Human
uuaggagcuucagccuguuuggg

SEQ ID NO: 336602 - RNA, 24 nt, Human
uucccuguuaugguuaucuggggg

SEQ ID NO: 336603 - RNA, 23 nt, Human
uuuaggagcuucagccuguuugg

SEQ ID NO: 336604 - RNA, 27 nt, Human
uuuuuuuuuuuuuuuuuuuuuucgggg

SEQ ID NO: 336605 - RNA, 21 nt, Human
aaaaacaagagcaaacaucac

SEQ ID NO: 336606 - RNA, 21 nt, Human
aaaagacccagaaauaguaag

SEQ ID NO: 336607 - RNA, 22 nt, Human
aaacaagagcaaacaucaccua

SEQ ID NO: 336608 - RNA, 19 nt, Human
aaacacaaaccuucccaaa

SEQ ID NO: 336609 - RNA, 20 nt, Human
aaacauuagaaagugcacuu

SEQ ID NO: 336610 - RNA, 22 nt, Human
aaagauaaauagacaauugcca

SEQ ID NO: 336611 - RNA, 22 nt, Human
aagaaggcaaaguagucagaca

SEQ ID NO: 336612 - RNA, 22 nt, Human
aagaggaaacaaucugcuacaa

SEQ ID NO: 336613 - RNA, 18 nt, Human
aaggagggcagaauaauu

SEQ ID NO: 336614 - RNA, 19 nt, Human
aaugccuaacccauaauga

SEQ ID NO: 336615 - RNA, 21 nt, Human
acagaaccugggaaaguuaua

SEQ ID NO: 336616 - RNA, 20 nt, Human
acccauaaugacccuugauu

SEQ ID NO: 336617 - RNA, 22 nt, Human
acugacuuaaaaaaauaaaaga

SEQ ID NO: 336618 - RNA, 19 nt, Human
agaaaacacaaaccuuccc

SEQ ID NO: 336619 - RNA, 21 nt, Human
agacaaacuauuaauuguaga

SEQ ID NO: 336620 - RNA, 22 nt, Human
agagaaaacacaaaccuuccca

SEQ ID NO: 336621 - RNA, 19 nt, Human
agagcugaagauauuaaau

SEQ ID NO: 336622 - RNA, 22 nt, Human
agcauuauuuaagaaaucucaa

SEQ ID NO: 336623 - RNA, 18 nt, Human
aggaaucacccaaacaau

SEQ ID NO: 336624 - RNA, 24 nt, Human
aggcaaaguagucagacaggccug

SEQ ID NO: 336625 - RNA, 18 nt, Human
aggggagaagcgccucuu

SEQ ID NO: 336626 - RNA, 24 nt, Human
auaaaacaagcacacaguauaucu

SEQ ID NO: 336627 - RNA, 18 nt, Human
auguaccauuccagagaa

SEQ ID NO: 336628 - RNA, 22 nt, Human
caaaagacccagaaauaguaag

SEQ ID NO: 336629 - RNA, 27 nt, Human
caaaauaguaaguuugaaacuuaaaug

SEQ ID NO: 336630 - RNA, 20 nt, Human
caauaguaaaauaaaaucua

SEQ ID NO: 336631 - RNA, 20 nt, Human
cacacaguauaucagauucc

SEQ ID NO: 336632 - RNA, 21 nt, Human
cagaauaauuuugagaugcaa

SEQ ID NO: 336633 - RNA, 20 nt, Human
caguguccaccaagguccug

SEQ ID NO: 336634 - RNA, 24 nt, Human
caguuuuaaccaauacaaaaaagc

SEQ ID NO: 336635 - RNA, 19 nt, Human
cauguaccauuccagagaa

SEQ ID NO: 336636 - RNA, 18 nt, Human
ccccugagaaaaaccgga

SEQ ID NO: 336637 - RNA, 19 nt, Human
cccguccucucccgacucc

SEQ ID NO: 336638 - RNA, 20 nt, Human
ccuaagaucuggcagaacac

SEQ ID NO: 336639 - RNA, 24 nt, Human
ccucauuuaaaaacauaaguugga

SEQ ID NO: 336640 - RNA, 23 nt, Human
cgggagccagcgagcuguggagg

SEQ ID NO: 336641 - RNA, 24 nt, Human
cggggcacgccccguccucucccg

SEQ ID NO: 336642 - RNA, 18 nt, Human
cuaacccauaaugacccu

SEQ ID NO: 336643 - RNA, 25 nt, Human
cuaauucuaaugugaacuuaguagc

SEQ ID NO: 336644 - RNA, 23 nt, Human
cuagcugaagcuaccuuaaauau

SEQ ID NO: 336645 - RNA, 25 nt, Human
cugacuuaaaaaaauaaaagauaaa

SEQ ID NO: 336646 - RNA, 20 nt, Human
gaaaaaaaaauuaaggcucc

SEQ ID NO: 336647 - RNA, 18 nt, Human
gaagacauguaccauucc

SEQ ID NO: 336648 - RNA, 23 nt, Human
gcaauaaagcaauaauaucugaa

SEQ ID NO: 336649 - RNA, 23 nt, Human
gccucuuuuucuaaugcagcugu

SEQ ID NO: 336650 - RNA, 24 nt, Human
ggacccagaaacauuagaaagugg

SEQ ID NO: 336651 - RNA, 22 nt, Human
ggagucaaguuuucuaguguca

SEQ ID NO: 336652 - RNA, 21 nt, Human
gggagccagcgagcuguggag

SEQ ID NO: 336653 - RNA, 18 nt, Human
gggaggggagaagcgccu

SEQ ID NO: 336654 - RNA, 26 nt, Human
uaaaacaagcacacaguauaucagau

SEQ ID NO: 336655 - RNA, 22 nt, Human
uaaauaacaaugacuaacauuu

SEQ ID NO: 336656 - RNA, 23 nt, Human
uaaauguggccauaaacagaacc

SEQ ID NO: 336657 - RNA, 24 nt, Human
uaaauuaaaaaaauauacauauaa

SEQ ID NO: 336658 - RNA, 20 nt, Human
uaacauagcaauuuuaaaug

SEQ ID NO: 336659 - RNA, 23 nt, Human
uaacccauaaugacccuugauua

SEQ ID NO: 336660 - RNA, 23 nt, Human
uaagaaaucucaauacacgaucu

SEQ ID NO: 336661 - RNA, 19 nt, Human
uaaguuacagcaucucuaa

SEQ ID NO: 336662 - RNA, 22 nt, Human
uaaguucuuuuacauucugagg

SEQ ID NO: 336663 - RNA, 25 nt, Human
uacacaguguccaccaagguccuga

SEQ ID NO: 336664 - RNA, 19 nt, Human
uacagcaucucuaaauaag

SEQ ID NO: 336665 - RNA, 22 nt, Human
uacuuguaauuuuggacuagaa

SEQ ID NO: 336666 - RNA, 23 nt, Human
uacuuuggaagaggaaacaaucu

SEQ ID NO: 336667 - RNA, 23 nt, Human
uagaaacauuaaugccuaaccca

SEQ ID NO: 336668 - RNA, 20 nt, Human
uagaccauacugacuuaaaa

SEQ ID NO: 336669 - RNA, 20 nt, Human
uaggacacauuuucuaaggg

SEQ ID NO: 336670 - RNA, 20 nt, Human
uaggggaggggagaagcgcc

SEQ ID NO: 336671 - RNA, 21 nt, Human
uaguaagcccuugaccuaaaa

SEQ ID NO: 336672 - RNA, 24 nt, Human
uaguaagcccuugaccuaaaaacu

SEQ ID NO: 336673 - RNA, 20 nt, Human
ucaaguacuagauggguacu

SEQ ID NO: 336674 - RNA, 21 nt, Human
ucaaucuuguauaaauaacaa

SEQ ID NO: 336675 - RNA, 24 nt, Human
ucagauagaaacauuaaugccuaa

SEQ ID NO: 336676 - RNA, 22 nt, Human
uccgcggcgggagccagcgagc

SEQ ID NO: 336677 - RNA, 20 nt, Human
ucuauaccuaagaucuggca

SEQ ID NO: 336678 - RNA, 18 nt, Human
ucucaauacacgaucucu

SEQ ID NO: 336679 - RNA, 22 nt, Human
ucucccgacucccguuacaaaa

SEQ ID NO: 336680 - RNA, 22 nt, Human
ucuucaggacccagaaacauua

SEQ ID NO: 336681 - RNA, 24 nt, Human
ugaagauauuaaauguggccaguc

SEQ ID NO: 336682 - RNA, 23 nt, Human
ugaaguuccuaaaauucuggcac

SEQ ID NO: 336683 - RNA, 21 nt, Human
ugaaugguauaaaaaccaaga

SEQ ID NO: 336684 - RNA, 21 nt, Human
uggaagaggaaacaaucugcu

SEQ ID NO: 336685 - RNA, 20 nt, Human
uggaggagcgccggggagga

SEQ ID NO: 336686 - RNA, 19 nt, Human
uuacacaagauuuucaauc

SEQ ID NO: 336687 - RNA, 23 nt, Human
uucaacguccccugagaaaaacc

SEQ ID NO: 336688 - RNA, 26 nt, Human
aaaaaaaaaaccaaaaaacaaaaacc

SEQ ID NO: 336689 - RNA, 24 nt, Human
aaaaaaaccaaaaaacaaaaacca

SEQ ID NO: 336690 - RNA, 24 nt, Human
aaaaaaccaaaaaacaaaaaccau

SEQ ID NO: 336691 - RNA, 24 nt, Human
aaaaaguagauuaaaacuggcuua

SEQ ID NO: 336692 - RNA, 21 nt, Human
aaaaccggcaacgccuccucc

SEQ ID NO: 336693 - RNA, 20 nt, Human
aaacgauguacaccagugaa

SEQ ID NO: 336694 - RNA, 19 nt, Human
aaacucagaaaaccggcaa

SEQ ID NO: 336695 - RNA, 21 nt, Human
aacaaaccucaaacaauucuc

SEQ ID NO: 336696 - RNA, 18 nt, Human
aacaucuaaguucaagcu

SEQ ID NO: 336697 - RNA, 25 nt, Human
aaccaaaaaacaaaaaccauuuuaa

SEQ ID NO: 336698 - RNA, 19 nt, Human
acaguuccuuuuuuuuuuu

SEQ ID NO: 336699 - RNA, 20 nt, Human
agaaaaaaaugucauagaau

SEQ ID NO: 336700 - RNA, 26 nt, Human
agauugcugauuacuuauggcugauc

SEQ ID NO: 336701 - RNA, 24 nt, Human
agccaguuaaaaaguaaacgaugu

SEQ ID NO: 336702 - RNA, 20 nt, Human
aggcagggagggguccgggc

SEQ ID NO: 336703 - RNA, 21 nt, Human
aggcagggagggguccgggcg

SEQ ID NO: 336704 - RNA, 21 nt, Human
auacacuaugauguuuauucc

SEQ ID NO: 336705 - RNA, 20 nt, Human
caaaaaacaaaaaccauuuu

SEQ ID NO: 336706 - RNA, 22 nt, Human
caaacaauucucauccaacuca

SEQ ID NO: 336707 - RNA, 23 nt, Human
cagagccagcgacccccggcacc

SEQ ID NO: 336708 - RNA, 20 nt, Human
cagcagagccagcgaccccc

SEQ ID NO: 336709 - RNA, 21 nt, Human
cagcagagccagcgacccccg

SEQ ID NO: 336710 - RNA, 21 nt, Human
caggcaauuaauauggcucau

SEQ ID NO: 336711 - RNA, 19 nt, Human
caggccccucggcucuggg

SEQ ID NO: 336712 - RNA, 19 nt, Human
cauaacacuguuuacccug

SEQ ID NO: 336713 - RNA, 19 nt, Human
cauuuuaauucagccaagg

SEQ ID NO: 336714 - RNA, 18 nt, Human
ccaauccacugaaagugc

SEQ ID NO: 336715 - RNA, 25 nt, Human
ccagcgacccccggcaccaucuucc

SEQ ID NO: 336716 - RNA, 22 nt, Human
ccgacacaaccgccggcguccc

SEQ ID NO: 336717 - RNA, 21 nt, Human
ccgcuaagccgacacaaccgc

SEQ ID NO: 336718 - RNA, 25 nt, Human
ccggcaccaucuuccgccgccgccu

SEQ ID NO: 336719 - RNA, 22 nt, Human
cgcccgcccgccgcggccccga

SEQ ID NO: 336720 - RNA, 22 nt, Human
cgcccgccgcggccccgaacuc

SEQ ID NO: 336721 - RNA, 20 nt, Human
cgccuaguccucggcagcgg

SEQ ID NO: 336722 - RNA, 19 nt, Human
cggccugucagagccgagg

SEQ ID NO: 336723 - RNA, 21 nt, Human
cggcggcagcagcagagccag

SEQ ID NO: 336724 - RNA, 23 nt, Human
cugcaggacaaaucagaaaaaaa

SEQ ID NO: 336725 - RNA, 18 nt, Human
gagcaggccccucggcuc

SEQ ID NO: 336726 - RNA, 22 nt, Human
gagcuuauaccucacccucuga

SEQ ID NO: 336727 - RNA, 20 nt, Human
gcccuuugagaaaaugaagu

SEQ ID NO: 336728 - RNA, 22 nt, Human
ggcauuacugguuaaacucaga

SEQ ID NO: 336729 - RNA, 21 nt, Human
ggcgucccgggcgcccgcccg

SEQ ID NO: 336730 - RNA, 19 nt, Human
gggaagguuugagucugca

SEQ ID NO: 336731 - RNA, 20 nt, Human
gugcaaugaauaucuuuugu

SEQ ID NO: 336732 - RNA, 19 nt, Human
uaaaaagauggccugcugu

SEQ ID NO: 336733 - RNA, 23 nt, Human
uaaaaagauggccugcuguuuuu

SEQ ID NO: 336734 - RNA, 21 nt, Human
uaaaaaguaaacgauguacac

SEQ ID NO: 336735 - RNA, 24 nt, Human
uaaaaaguaaacgauguacaccag

SEQ ID NO: 336736 - RNA, 25 nt, Human
uaaaaaguagauuaaaacuggcuua

SEQ ID NO: 336737 - RNA, 21 nt, Human
uaaacgauguacaccagugaa

SEQ ID NO: 336738 - RNA, 19 nt, Human
uacaguuacgucaggcacu

SEQ ID NO: 336739 - RNA, 22 nt, Human
uaucagcaugcaauaacacucc

SEQ ID NO: 336740 - RNA, 19 nt, Human
ucaggcacugugaaaagga

SEQ ID NO: 336741 - RNA, 24 nt, Human
ucccgggcgcccgccccucgggag

SEQ ID NO: 336742 - RNA, 21 nt, Human
uccgccgccgccuaguccucg

SEQ ID NO: 336743 - RNA, 22 nt, Human
ucuacauaacacuguuuacccu

SEQ ID NO: 336744 - RNA, 21 nt, Human
ucuacugaggcaaacucaaaa

SEQ ID NO: 336745 - RNA, 22 nt, Human
ucuggggccgggggacagaagg

SEQ ID NO: 336746 - RNA, 19 nt, Human
ucuuccgccgccgccuagu

SEQ ID NO: 336747 - RNA, 24 nt, Human
ugaaaaggacuaccacuuuucuua

SEQ ID NO: 336748 - RNA, 20 nt, Human
ugagaaaaugaaguaguuug

SEQ ID NO: 336749 - RNA, 21 nt, Human
ugagaaaaugaaguaguuugg

SEQ ID NO: 336750 - RNA, 20 nt, Human
ugucauagaauguauuaauu

SEQ ID NO: 336751 - RNA, 26 nt, Human
ugugaaaaggacuaccacuuuucuua

SEQ ID NO: 336752 - RNA, 19 nt, Human
uuaaaaggcacacacauuu

SEQ ID NO: 336753 - RNA, 19 nt, Human
uucacaaaaggacaaaugc

SEQ ID NO: 336754 - RNA, 22 nt, Human
uucacaaaaggacaaaugcugg

SEQ ID NO: 336755 - RNA, 23 nt, Human
uuccuaaaaugaagccaguuaaa

SEQ ID NO: 336756 - RNA, 23 nt, Human
uucucuagcaacaaaccucaaac

SEQ ID NO: 336757 - RNA, 21 nt, Human
uugaaacaucaaagggcauuu

SEQ ID NO: 336758 - RNA, 21 nt, Human
uugaaacaucaaagggcauuu

SEQ ID NO: 336759 - RNA, 25 nt, Human
uuuaugaagaaauuaaauauuuucu

SEQ ID NO: 336760 - RNA, 19 nt, Human
uuugaaaugguuaguagca

SEQ ID NO: 336761 - RNA, 19 nt, Human
uuugcuuugcuugagauug

SEQ ID NO: 336762 - RNA, 21 nt, Human
uuuuauuauuguucucuagca

SEQ ID NO: 336763 - RNA, 22 nt, Human
uuuucacacuucccagcaauca

SEQ ID NO: 336764 - RNA, 26 nt, Human
uuuuuuuuuuugaaacaucaaagggg

SEQ ID NO: 336765 - RNA, 20 nt, Human
aaacaagcacaaaucgcuga

SEQ ID NO: 336766 - RNA, 23 nt, Human
aaacaagcacaaaucgcugaggu

SEQ ID NO: 336767 - RNA, 23 nt, Human
aacuucaucacccagagguacua

SEQ ID NO: 336768 - RNA, 18 nt, Human
aagcaucuggccuuaaug

SEQ ID NO: 336769 - RNA, 20 nt, Human
accacacucaaaggagacag

SEQ ID NO: 336770 - RNA, 21 nt, Human
accagccacccuagagcucaa

SEQ ID NO: 336771 - RNA, 22 nt, Human
acuacaaccccacauccucuga

SEQ ID NO: 336772 - RNA, 26 nt, Human
acuucaucacccagagguacuacaag

SEQ ID NO: 336773 - RNA, 22 nt, Human
acuugugaaugaaguuuucccc

SEQ ID NO: 336774 - RNA, 23 nt, Human
agaaaucaccaguguuggaaaca

SEQ ID NO: 336775 - RNA, 19 nt, Human
agagcaauguaacccacag

SEQ ID NO: 336776 - RNA, 24 nt, Human
agauaaggugaccugccccagcuu

SEQ ID NO: 336777 - RNA, 18 nt, Human
aguguuggaaacagcaga

SEQ ID NO: 336778 - RNA, 19 nt, Human
auccauguaccugcucuuc

SEQ ID NO: 336779 - RNA, 22 nt, Human
augaaguuuuccccgaaaagca

SEQ ID NO: 336780 - RNA, 18 nt, Human
caaacaagcacaaaucgc

SEQ ID NO: 336781 - RNA, 19 nt, Human
caaacaagcacaaaucgcu

SEQ ID NO: 336782 - RNA, 22 nt, Human
caacacagaaaccccagaaucg

SEQ ID NO: 336783 - RNA, 19 nt, Human
caagacuuuucaaagccaa

SEQ ID NO: 336784 - RNA, 22 nt, Human
caaguccccugacagaggccga

SEQ ID NO: 336785 - RNA, 25 nt, Human
caauguaacccacagaguccaugca

SEQ ID NO: 336786 - RNA, 18 nt, Human
caaugugguccauguccc

SEQ ID NO: 336787 - RNA, 22 nt, Human
caaugugguccaugucccccca

SEQ ID NO: 336788 - RNA, 20 nt, Human
cacagaaaccccagaaucgc

SEQ ID NO: 336789 - RNA, 24 nt, Human
cacagaaaccccagaaucgcuucc

SEQ ID NO: 336790 - RNA, 21 nt, Human
cauguccccccaugucccaaa

SEQ ID NO: 336791 - RNA, 24 nt, Human
ccaagacagcaagacuuuucaaag

SEQ ID NO: 336792 - RNA, 18 nt, Human
cccacagaguccaugcaa

SEQ ID NO: 336793 - RNA, 24 nt, Human
cccaugucccaaacuaaccaagca

SEQ ID NO: 336794 - RNA, 18 nt, Human
ccccaugucccaaacuaa

SEQ ID NO: 336795 - RNA, 20 nt, Human
ccccaugucccaaacuaacc

SEQ ID NO: 336796 - RNA, 22 nt, Human
ccccaugucccaaacuaaccaa

SEQ ID NO: 336797 - RNA, 25 nt, Human
cccccaugucccaaacuaaccaagc

SEQ ID NO: 336798 - RNA, 21 nt, Human
ccccccaugucccaaacuaac

SEQ ID NO: 336799 - RNA, 21 nt, Human
cccuguuacuccuaguuguau

SEQ ID NO: 336800 - RNA, 24 nt, Human
ccuuguaguagguucuucuccuca

SEQ ID NO: 336801 - RNA, 22 nt, Human
cggcuccuugccuuguaguagg

SEQ ID NO: 336802 - RNA, 20 nt, Human
cuaacagaaauaacuuuggc

SEQ ID NO: 336803 - RNA, 19 nt, Human
cuacaaccccacauccucu

SEQ ID NO: 336804 - RNA, 18 nt, Human
cuagagcucaauuaagca

SEQ ID NO: 336805 - RNA, 20 nt, Human
cucauggccaugccugaagc

SEQ ID NO: 336806 - RNA, 21 nt, Human
cuccuaaguuguaagccucua

SEQ ID NO: 336807 - RNA, 21 nt, Human
cugaagccuggugucuggaau

SEQ ID NO: 336808 - RNA, 19 nt, Human
cuggccuuaaugcaguaaa

SEQ ID NO: 336809 - RNA, 18 nt, Human
cugguaacaguggaagaa

SEQ ID NO: 336810 - RNA, 25 nt, Human
gaaaagcaugcaucacuguggcuca

SEQ ID NO: 336811 - RNA, 19 nt, Human
gaaguuuuccccgaaaagc

SEQ ID NO: 336812 - RNA, 19 nt, Human
gacaugagauauuggcugu

SEQ ID NO: 336813 - RNA, 20 nt, Human
gcucaguaagauaguacgac

SEQ ID NO: 336814 - RNA, 20 nt, Human
ggcccuguuacuccuaguug

SEQ ID NO: 336815 - RNA, 20 nt, Human
gggaaaaagcuguuauuugc

SEQ ID NO: 336816 - RNA, 20 nt, Human
gguucuucuccucagaaucc

SEQ ID NO: 336817 - RNA, 26 nt, Human
guaguagguucuucuccucagaaucc

SEQ ID NO: 336818 - RNA, 19 nt, Human
uaacagaaauaacuuuggc

SEQ ID NO: 336819 - RNA, 21 nt, Human
uaagccucuaacuacuaucag

SEQ ID NO: 336820 - RNA, 22 nt, Human
uaaggucucaaugugguccaug

SEQ ID NO: 336821 - RNA, 21 nt, Human
uaauacuaaccagccacccua

SEQ ID NO: 336822 - RNA, 26 nt, Human
uaaugcaguaaaccacacucaaagga

SEQ ID NO: 336823 - RNA, 22 nt, Human
uacaaagauaaggugaccugcc

SEQ ID NO: 336824 - RNA, 24 nt, Human
uacuacaaccccacauccucugau

SEQ ID NO: 336825 - RNA, 21 nt, Human
uacuugaugacuaaggucuca

SEQ ID NO: 336826 - RNA, 19 nt, Human
uagacccaagacagcaaga

SEQ ID NO: 336827 - RNA, 21 nt, Human
uagcaccuucaguuggugcug

SEQ ID NO: 336828 - RNA, 23 nt, Human
uagcaccuucaguuggugcugcu

SEQ ID NO: 336829 - RNA, 27 nt, Human
uaguagguucuucuccucagaauccaa

SEQ ID NO: 336830 - RNA, 22 nt, Human
ucagauuucugaucuagaugau

SEQ ID NO: 336831 - RNA, 24 nt, Human
ucaucuucuucucuuuuuuuuuuu

SEQ ID NO: 336832 - RNA, 28 nt, Human
uccaacuauccuaaugaaggagauccaa

SEQ ID NO: 336833 - RNA, 25 nt, Human
ucccuaaaauguagacccaagacag

SEQ ID NO: 336834 - RNA, 25 nt, Human
uccucagaauccaaucuagucagau

SEQ ID NO: 336835 - RNA, 19 nt, Human
ucucuuuuuuuuuuuggca

SEQ ID NO: 336836 - RNA, 24 nt, Human
ucuucgcggacaagaaccguucaa

SEQ ID NO: 336837 - RNA, 24 nt, Human
ugaagcccacuaagcccguucaag

SEQ ID NO: 336838 - RNA, 20 nt, Human
ugaaggagauccaagcaauu

SEQ ID NO: 336839 - RNA, 20 nt, Human
ugcaagggaaaaagcuguua

SEQ ID NO: 336840 - RNA, 19 nt, Human
ugccugaagccuggugucu

SEQ ID NO: 336841 - RNA, 18 nt, Human
ugcuaaaacaacuucauc

SEQ ID NO: 336842 - RNA, 20 nt, Human
uggaauacuugugaaugaaa

SEQ ID NO: 336843 - RNA, 19 nt, Human
uggacaaaagccacauccu

SEQ ID NO: 336844 - RNA, 24 nt, Human
uggagaaaagcuggcugaagccca

SEQ ID NO: 336845 - RNA, 22 nt, Human
uggcccuguuacuccuaguugu

SEQ ID NO: 336846 - RNA, 19 nt, Human
uucaucacccagagguacu

SEQ ID NO: 336847 - RNA, 23 nt, Human
uuccccgaaaagcaugcaucacu

SEQ ID NO: 336848 - RNA, 19 nt, Human
uuuuuuggcagaagccugg

SEQ ID NO: 336849 - RNA, 23 nt, Human
uuuuuuuuuuuuuuaaaaaugga

SEQ ID NO: 336850 - RNA, 21 nt, Human
aaaaaaaaaaaaaaagacgau

SEQ ID NO: 336851 - RNA, 22 nt, Human
aaaaaaaaaaagacgauccaga

SEQ ID NO: 336852 - RNA, 20 nt, Human
aaaaaaaaagacgauccagg

SEQ ID NO: 336853 - RNA, 22 nt, Human
aaaaaaagacgauccagauuaa

SEQ ID NO: 336854 - RNA, 21 nt, Human
aaaaguagcuuguugagagac

SEQ ID NO: 336855 - RNA, 24 nt, Human
aaagugcugggauuacaggcguga

SEQ ID NO: 336856 - RNA, 20 nt, Human
aacaacaccuucuccccggc

SEQ ID NO: 336857 - RNA, 24 nt, Human
aaccaugauugaugacaaugaacc

SEQ ID NO: 336858 - RNA, 22 nt, Human
aagucaauuuucaaaugacuga

SEQ ID NO: 336859 - RNA, 19 nt, Human
aagugcugggauuacaggc

SEQ ID NO: 336860 - RNA, 19 nt, Human
aagugcugggauuacaggc

SEQ ID NO: 336861 - RNA, 26 nt, Human
acaacaaaugucaaaaaaaaagcuaa

SEQ ID NO: 336862 - RNA, 24 nt, Human
accacguuggccaggcuggucuug

SEQ ID NO: 336863 - RNA, 25 nt, Human
acccgccuuggccucccaaagugcu

SEQ ID NO: 336864 - RNA, 19 nt, Human
agccagcacagguaaagca

SEQ ID NO: 336865 - RNA, 18 nt, Human
agccuccaguguagcugg

SEQ ID NO: 336866 - RNA, 22 nt, Human
agcuaagcaaccuuucacagaa

SEQ ID NO: 336867 - RNA, 25 nt, Human
aggaaaacaagggaaaaccgguacc

SEQ ID NO: 336868 - RNA, 18 nt, Human
aggagaaguuuaaaauga

SEQ ID NO: 336869 - RNA, 23 nt, Human
aggagguaucuggggagaggaga

SEQ ID NO: 336870 - RNA, 20 nt, Human
aggcauguaccaccacgccc

SEQ ID NO: 336871 - RNA, 19 nt, Human
aggcuuucaccacguuggc

SEQ ID NO: 336872 - RNA, 20 nt, Human
aguaagaaaaaggagcacag

SEQ ID NO: 336873 - RNA, 18 nt, Human
agugcugggauuacaggc

SEQ ID NO: 336874 - RNA, 18 nt, Human
auguaccaccacgcccag

SEQ ID NO: 336875 - RNA, 18 nt, Human
auucuccugacucagccu

SEQ ID NO: 336876 - RNA, 24 nt, Human
caaagugcugggauuacaggcgug

SEQ ID NO: 336877 - RNA, 24 nt, Human
caaaugucaaaaaaaaagcuaagc

SEQ ID NO: 336878 - RNA, 25 nt, Human
caaccuuucacagaaaggaagugac

SEQ ID NO: 336879 - RNA, 21 nt, Human
caacuugcgucuaaguggugg

SEQ ID NO: 336880 - RNA, 22 nt, Human
caagugauucuccugacucagc

SEQ ID NO: 336881 - RNA, 24 nt, Human
caccaaauguacacaucuauccaa

SEQ ID NO: 336882 - RNA, 20 nt, Human
caccacguuggccaggcugg

SEQ ID NO: 336883 - RNA, 21 nt, Human
caccacguuggccaggcuggu

SEQ ID NO: 336884 - RNA, 24 nt, Human
caccacguuggccaggcuggucuu

SEQ ID NO: 336885 - RNA, 27 nt, Human
caccacguuggccaggcuggucuugaa

SEQ ID NO: 336886 - RNA, 23 nt, Human
cacccgccuuggccucccaaagu

SEQ ID NO: 336887 - RNA, 24 nt, Human
cacccgccuuggccucccaaagug

SEQ ID NO: 336888 - RNA, 18 nt, Human
caccuggguuuguuucca

SEQ ID NO: 336889 - RNA, 24 nt, Human
cacguuggccaggcuggucuugaa

SEQ ID NO: 336890 - RNA, 21 nt, Human
cacugcaaccucugccuccca

SEQ ID NO: 336891 - RNA, 21 nt, Human
cacugcaaccucugccuccca

SEQ ID NO: 336892 - RNA, 23 nt, Human
cagaaaggaagugacugaaaaca

SEQ ID NO: 336893 - RNA, 24 nt, Human
caggcuuucaccacguuggccagg

SEQ ID NO: 336894 - RNA, 21 nt, Human
caguaagcacaguauuuaaau

SEQ ID NO: 336895 - RNA, 24 nt, Human
caguguagcugggauuacaggcau

SEQ ID NO: 336896 - RNA, 21 nt, Human
caguguccagaggccacauga

SEQ ID NO: 336897 - RNA, 21 nt, Human
cauguaccaccacgcccagcu

SEQ ID NO: 336898 - RNA, 22 nt, Human
cauucugucaccuaggcuggag

SEQ ID NO: 336899 - RNA, 22 nt, Human
ccaaagugcugggauuacaggc

SEQ ID NO: 336900 - RNA, 22 nt, Human
ccaaagugcugggauuacaggc

SEQ ID NO: 336901 - RNA, 24 nt, Human
ccaaagugcugggauuacaggcgu

SEQ ID NO: 336902 - RNA, 24 nt, Human
ccaguagcaaaauuucagauaaga

SEQ ID NO: 336903 - RNA, 23 nt, Human
ccaguguagcugggauuacaggc

SEQ ID NO: 336904 - RNA, 24 nt, Human
ccaguguagcugggauuacaggca

SEQ ID NO: 336905 - RNA, 19 nt, Human
ccggcaacaacaccuucuc

SEQ ID NO: 336906 - RNA, 24 nt, Human
ccucccacguucaagugauucucc

SEQ ID NO: 336907 - RNA, 22 nt, Human
ccugaccucgggugauccaccc

SEQ ID NO: 336908 - RNA, 23 nt, Human
ccugacucagccuccaguguagc

SEQ ID NO: 336909 - RNA, 19 nt, Human
ccuuucacagaaaggaagu

SEQ ID NO: 336910 - RNA, 21 nt, Human
cgugacccaccacgcccggcu

SEQ ID NO: 336911 - RNA, 22 nt, Human
cguuggccaggcuggucuugaa

SEQ ID NO: 336912 - RNA, 23 nt, Human
cucacugcaaccucugccuccca

SEQ ID NO: 336913 - RNA, 23 nt, Human
cucagccuccaguguagcuggga

SEQ ID NO: 336914 - RNA, 24 nt, Human
cucauucugucaccuaggcuggag

SEQ ID NO: 336915 - RNA, 25 nt, Human
cuccagcaacauaacuaagguaccc

SEQ ID NO: 336916 - RNA, 22 nt, Human
cuccccggccggcuucagcaac

SEQ ID NO: 336917 - RNA, 26 nt, Human
cuccugaccucgggugauccacccgc

SEQ ID NO: 336918 - RNA, 24 nt, Human
cucgggugauccacccgccuuggc

SEQ ID NO: 336919 - RNA, 24 nt, Human
cugcaaccucugccucccacguuc

SEQ ID NO: 336920 - RNA, 24 nt, Human
gaccucgggugauccacccgccuu

SEQ ID NO: 336921 - RNA, 23 nt, Human
gacugaugaggauagauuuccac

SEQ ID NO: 336922 - RNA, 22 nt, Human
gaucuccacucacugcaaccuc

SEQ ID NO: 336923 - RNA, 18 nt, Human
gauggcaaagugagaaag

SEQ ID NO: 336924 - RNA, 21 nt, Human
gauuacaggcgugacccacca

SEQ ID NO: 336925 - RNA, 21 nt, Human
gauucuccugacucagccucc

SEQ ID NO: 336926 - RNA, 22 nt, Human
gcaaccucugccucccacguuc

SEQ ID NO: 336927 - RNA, 22 nt, Human
gccuuggccucccaaagugcug

SEQ ID NO: 336928 - RNA, 23 nt, Human
gcuggucuugaacuccugaccuc

SEQ ID NO: 336929 - RNA, 25 nt, Human
ggaaaacccugaauuguuacagccc

SEQ ID NO: 336930 - RNA, 21 nt, Human
ggaccgaaggcaaaugggaga

SEQ ID NO: 336931 - RNA, 19 nt, Human
ggagaaguuuaaaaugaga

SEQ ID NO: 336932 - RNA, 19 nt, Human
ggcagggaaaaaugcaaug

SEQ ID NO: 336933 - RNA, 24 nt, Human
ggcuggucuugaacuccugaccuc

SEQ ID NO: 336934 - RNA, 19 nt, Human
ggucuugaacuccugaccu

SEQ ID NO: 336935 - RNA, 23 nt, Human
ggugauccacccgccuuggccuc

SEQ ID NO: 336936 - RNA, 18 nt, Human
guagcugggauuacaggc

SEQ ID NO: 336937 - RNA, 20 nt, Human
guagcugggauuacaggcau

SEQ ID NO: 336938 - RNA, 22 nt, Human
guagcugggauuacaggcaugu

SEQ ID NO: 336939 - RNA, 24 nt, Human
gucuugaacuccugaccucgggug

SEQ ID NO: 336940 - RNA, 24 nt, Human
gugauccacccgccuuggccuccc

SEQ ID NO: 336941 - RNA, 21 nt, Human
guggccgcccggucucagcuc

SEQ ID NO: 336942 - RNA, 25 nt, Human
uaaaaacgccacucagagaagcuac

SEQ ID NO: 336943 - RNA, 22 nt, Human
uaaagaacaacaaaugucaaaa

SEQ ID NO: 336944 - RNA, 18 nt, Human
uaaauucuccuuuuaaaa

SEQ ID NO: 336945 - RNA, 19 nt, Human
uaagaagucacucaaagac

SEQ ID NO: 336946 - RNA, 25 nt, Human
uaagcaaccuuucacagaaaggaag

SEQ ID NO: 336947 - RNA, 24 nt, Human
uaauagauacaggcuuucaccacg

SEQ ID NO: 336948 - RNA, 21 nt, Human
uaauuuuugucuuuuaauaga

SEQ ID NO: 336949 - RNA, 23 nt, Human
uacaaugaaguuagaugagcaaa

SEQ ID NO: 336950 - RNA, 24 nt, Human
uacaggcauguaccaccacgccca

SEQ ID NO: 336951 - RNA, 22 nt, Human
uaccaccacgcccagcuaauuu

SEQ ID NO: 336952 - RNA, 18 nt, Human
uaggcuggagggcagugg

SEQ ID NO: 336953 - RNA, 21 nt, Human
uauccaacaaaagcuuuccua

SEQ ID NO: 336954 - RNA, 18 nt, Human
ucacaguaagcacaguau

SEQ ID NO: 336955 - RNA, 18 nt, Human
ucacugcaaccucugccu

SEQ ID NO: 336956 - RNA, 19 nt, Human
ucacugcaaccucugccuc

SEQ ID NO: 336957 - RNA, 22 nt, Human
ucacugcaaccucugccuccca

SEQ ID NO: 336958 - RNA, 24 nt, Human
ucacugcaaccucugccucccacg

SEQ ID NO: 336959 - RNA, 26 nt, Human
ucacugcaaccucugccucccacguu

SEQ ID NO: 336960 - RNA, 21 nt, Human
ucagcaacuugcgucuaagug

SEQ ID NO: 336961 - RNA, 19 nt, Human
ucagcuaaaaacgccacuc

SEQ ID NO: 336962 - RNA, 22 nt, Human
ucauucugucaccuaggcugga

SEQ ID NO: 336963 - RNA, 24 nt, Human
ucccaaagugcugggauuacaggc

SEQ ID NO: 336964 - RNA, 24 nt, Human
ucccacguucaagugauucuccug

SEQ ID NO: 336965 - RNA, 22 nt, Human
uccuggguggagcacaggccuu

SEQ ID NO: 336966 - RNA, 22 nt, Human
ucucauucugucaccuaggcug

SEQ ID NO: 336967 - RNA, 24 nt, Human
ucucauucugucaccuaggcugga

SEQ ID NO: 336968 - RNA, 18 nt, Human
ucugucaccuaggcugga

SEQ ID NO: 336969 - RNA, 23 nt, Human
ucuugaacuccugaccucgggug

SEQ ID NO: 336970 - RNA, 18 nt, Human
ugaacuaugugguugcug

SEQ ID NO: 336971 - RNA, 24 nt, Human
ugaccucgggugauccacccgccu

SEQ ID NO: 336972 - RNA, 24 nt, Human
ugacucagccuccaguguagcugg

SEQ ID NO: 336973 - RNA, 23 nt, Human
ugagaggaaaacaagggaaaacc

SEQ ID NO: 336974 - RNA, 18 nt, Human
ugagauagagucucauuc

SEQ ID NO: 336975 - RNA, 22 nt, Human
ugagauagagucucauucuguc

SEQ ID NO: 336976 - RNA, 18 nt, Human
ugagcaaaacauaaguau

SEQ ID NO: 336977 - RNA, 19 nt, Human
ugauuugaacuaugugguu

SEQ ID NO: 336978 - RNA, 21 nt, Human
ugcccauccuuugcacacaau

SEQ ID NO: 336979 - RNA, 22 nt, Human
ugcugggauuacaggcgugacc

SEQ ID NO: 336980 - RNA, 24 nt, Human
uggccaggcuggucuugaacuccu

SEQ ID NO: 336981 - RNA, 21 nt, Human
ugggauuacaggcauguacca

SEQ ID NO: 336982 - RNA, 24 nt, Human
ugggauuacaggcauguaccacca

SEQ ID NO: 336983 - RNA, 18 nt, Human
ugggauuacaggcgugac

SEQ ID NO: 336984 - RNA, 22 nt, Human
ugggauuacaggcgugacccac

SEQ ID NO: 336985 - RNA, 23 nt, Human
ugggauuacaggcgugacccacc

SEQ ID NO: 336986 - RNA, 24 nt, Human
ugggauuacaggcgugacccacca

SEQ ID NO: 336987 - RNA, 21 nt, Human
uggguggagcacaggccuuug

SEQ ID NO: 336988 - RNA, 19 nt, Human
uggguuuguuuccaucucu

SEQ ID NO: 336989 - RNA, 24 nt, Human
uguagcugggauuacaggcaugua

SEQ ID NO: 336990 - RNA, 22 nt, Human
ugucaaaaugacgcuggguaca

SEQ ID NO: 336991 - RNA, 22 nt, Human
uguccagaggccacaugauggc

SEQ ID NO: 336992 - RNA, 20 nt, Human
uuaaauucuccuuuuaaaau

SEQ ID NO: 336993 - RNA, 21 nt, Human
uucaagcacuuucuuuucugc

SEQ ID NO: 336994 - RNA, 23 nt, Human
uucaagugauucuccugacucag

SEQ ID NO: 336995 - RNA, 24 nt, Human
uucaagugauucuccugacucagc

SEQ ID NO: 336996 - RNA, 18 nt, Human
uugcugcuuugauucugg

SEQ ID NO: 336997 - RNA, 18 nt, Human
uuggccucccaaagugcu

SEQ ID NO: 336998 - RNA, 21 nt, Human
uuucaccacguuggccaggcu

SEQ ID NO: 336999 - RNA, 24 nt, Human
accccaacuaauuaauggugguua

SEQ ID NO: 337000 - RNA, 21 nt, Human
caaauaaucaagcagcaauau

SEQ ID NO: 337001 - RNA, 20 nt, Human
cagaugacuuaguaauuaag

SEQ ID NO: 337002 - RNA, 23 nt, Human
gaaaauuucacauuacaguaaac

SEQ ID NO: 337003 - RNA, 20 nt, Human
uaaugaauucagcaaaucau

SEQ ID NO: 337004 - RNA, 24 nt, Human
ugauguaaaaaucaaauaaucaag

SEQ ID NO: 337005 - RNA, 25 nt, Human
uuacaguaaacuccaccccaacuaa

SEQ ID NO: 337006 - RNA, 21 nt, Human
aaaauacucgcugccacacca

SEQ ID NO: 337007 - RNA, 18 nt, Human
aacuaagaaggaaaaaac

SEQ ID NO: 337008 - RNA, 18 nt, Human
aagcaaaauaucacaaac

SEQ ID NO: 337009 - RNA, 26 nt, Human
aagcgccuuauuguuuuaaagguggc

SEQ ID NO: 337010 - RNA, 24 nt, Human
aauaucacaaacauuuucaauaga

SEQ ID NO: 337011 - RNA, 21 nt, Human
auaccaaaauacucgcugcca

SEQ ID NO: 337012 - RNA, 22 nt, Human
caaaagcaaaauaucacaaaca

SEQ ID NO: 337013 - RNA, 22 nt, Human
cacaccacagguauucucacac

SEQ ID NO: 337014 - RNA, 22 nt, Human
cacuacauaaaguaaaaacucu

SEQ ID NO: 337015 - RNA, 26 nt, Human
cagccaggucccuucuccauccauuu

SEQ ID NO: 337016 - RNA, 24 nt, Human
ccaaaauacucgcugccacaccac

SEQ ID NO: 337017 - RNA, 24 nt, Human
ccucuuaugggcggagcagagcag

SEQ ID NO: 337018 - RNA, 18 nt, Human
cuccacacuucuacuugc

SEQ ID NO: 337019 - RNA, 19 nt, Human
cuccccaggugcccgcgcc

SEQ ID NO: 337020 - RNA, 18 nt, Human
cuuaauauuuucugaccu

SEQ ID NO: 337021 - RNA, 20 nt, Human
gggcggagcagagcagcggg

SEQ ID NO: 337022 - RNA, 25 nt, Human
uaaguuagagugcaaaaugaaagcg

SEQ ID NO: 337023 - RNA, 21 nt, Human
uaccaaaauacucgcugccac

SEQ ID NO: 337024 - RNA, 22 nt, Human
uaccaaaauacucgcugccaca

SEQ ID NO: 337025 - RNA, 18 nt, Human
ucacuacauaaaguaaaa

SEQ ID NO: 337026 - RNA, 19 nt, Human
uccccaggugcccgcgccg

SEQ ID NO: 337027 - RNA, 26 nt, Human
uccuucauccuucuguuucuguuuca

SEQ ID NO: 337028 - RNA, 24 nt, Human
ugcaaaagcaaaauaucacaaaca

SEQ ID NO: 337029 - RNA, 18 nt, Human
uguauuuucaaaauugua

SEQ ID NO: 337030 - RNA, 19 nt, Human
uuagagugcaaaaugaaag

SEQ ID NO: 337031 - RNA, 25 nt, Human
uuucaaaauuguauuagguaucacu

SEQ ID NO: 337032 - RNA, 21 nt, Human
aaaauagcagaaaucauacag

SEQ ID NO: 337033 - RNA, 25 nt, Human
aaacagaaaucagaaaugagggacc

SEQ ID NO: 337034 - RNA, 19 nt, Human
aaacagauuguggggcucu

SEQ ID NO: 337035 - RNA, 23 nt, Human
aaacagccucuuuaacaacauuu

SEQ ID NO: 337036 - RNA, 18 nt, Human
aaaggacuucacagagaa

SEQ ID NO: 337037 - RNA, 24 nt, Human
aacacuuugggcggcugagguggg

SEQ ID NO: 337038 - RNA, 20 nt, Human
aacauggugaaacccugucu

SEQ ID NO: 337039 - RNA, 21 nt, Human
aacauggugaaacccugucuc

SEQ ID NO: 337040 - RNA, 23 nt, Human
aacuccugggcucaagcaauccu

SEQ ID NO: 337041 - RNA, 24 nt, Human
aagcaauccugccucagccuccca

SEQ ID NO: 337042 - RNA, 19 nt, Human
aagcuaacacucuggacuu

SEQ ID NO: 337043 - RNA, 24 nt, Human
aaucacuugaacccgggaggugca

SEQ ID NO: 337044 - RNA, 20 nt, Human
acaaauucaaauaaucagga

SEQ ID NO: 337045 - RNA, 18 nt, Human
acaaggcaaagaauaagu

SEQ ID NO: 337046 - RNA, 24 nt, Human
acagagcaagacacugucucaaaa

SEQ ID NO: 337047 - RNA, 24 nt, Human
acagugcugggauuacaggcauga

SEQ ID NO: 337048 - RNA, 24 nt, Human
acccugucucuacuaaaaauacaa

SEQ ID NO: 337049 - RNA, 20 nt, Human
acuauauuuggcagcaaagu

SEQ ID NO: 337050 - RNA, 28 nt, Human
agaagaaaauggaaugugcuugaaagag

SEQ ID NO: 337051 - RNA, 25 nt, Human
agagaacaaggcaaagaauaaguaa

SEQ ID NO: 337052 - RNA, 23 nt, Human
agagaucuaaagggccauggaag

SEQ ID NO: 337053 - RNA, 23 nt, Human
agcaauacaaccaccucagccuc

SEQ ID NO: 337054 - RNA, 21 nt, Human
agccaccacacccagccaaaa

SEQ ID NO: 337055 - RNA, 23 nt, Human
agccaggcgugguggcacaugcc

SEQ ID NO: 337056 - RNA, 22 nt, Human
agccccuggcuaagugaaugcu

SEQ ID NO: 337057 - RNA, 22 nt, Human
agccuggccaacauggugaaac

SEQ ID NO: 337058 - RNA, 24 nt, Human
agccuggccaacauggugaaaccc

SEQ ID NO: 337059 - RNA, 24 nt, Human
aggggaaaauacaaaauauauguc

SEQ ID NO: 337060 - RNA, 24 nt, Human
aggggccgggcaugguggcucaug

SEQ ID NO: 337061 - RNA, 23 nt, Human
agguggguggaucacuugaggcc

SEQ ID NO: 337062 - RNA, 21 nt, Human
aguacaguggcgcgaucauag

SEQ ID NO: 337063 - RNA, 23 nt, Human
aguacaguggcgcgaucauagcu

SEQ ID NO: 337064 - RNA, 22 nt, Human
agucugaguuuaaugucugggg

SEQ ID NO: 337065 - RNA, 18 nt, Human
agugcugggauuacaggc

SEQ ID NO: 337066 - RNA, 22 nt, Human
agugcugggauuacaggcauga

SEQ ID NO: 337067 - RNA, 22 nt, Human
auacaacagcaaauuuccaaaa

SEQ ID NO: 337068 - RNA, 23 nt, Human
auaccugcaacauacauaaaacc

SEQ ID NO: 337069 - RNA, 25 nt, Human
augaauguauauugcugugcuucuc

SEQ ID NO: 337070 - RNA, 19 nt, Human
augccuguaaucccaacac

SEQ ID NO: 337071 - RNA, 20 nt, Human
auggauuguauguguaugug

SEQ ID NO: 337072 - RNA, 23 nt, Human
auggauuguauguguaugugugu

SEQ ID NO: 337073 - RNA, 24 nt, Human
auguguaugugugugugugugugu

SEQ ID NO: 337074 - RNA, 20 nt, Human
augugugugugugugugugu

SEQ ID NO: 337075 - RNA, 24 nt, Human
caaagaaucaaacagaaaucagaa

SEQ ID NO: 337076 - RNA, 22 nt, Human
caacaaaguuuugugaacuaaa

SEQ ID NO: 337077 - RNA, 24 nt, Human
caacacuuugggcggcugaggugg

SEQ ID NO: 337078 - RNA, 24 nt, Human
caacauggugaaacccugucucua

SEQ ID NO: 337079 - RNA, 23 nt, Human
caagagacaauuuaaaauuacag

SEQ ID NO: 337080 - RNA, 22 nt, Human
caagcaauacaaccaccucagc

SEQ ID NO: 337081 - RNA, 18 nt, Human
caagcaauccugccucag

SEQ ID NO: 337082 - RNA, 21 nt, Human
cacacccagccaaaaaaaggu

SEQ ID NO: 337083 - RNA, 24 nt, Human
cacagugcugggauuacaggcaug

SEQ ID NO: 337084 - RNA, 24 nt, Human
caccucagccucccacagugcugg

SEQ ID NO: 337085 - RNA, 24 nt, Human
cacuacuugggaggcugagaugag

SEQ ID NO: 337086 - RNA, 19 nt, Human
cagacaauuaucuaaaagc

SEQ ID NO: 337087 - RNA, 21 nt, Human
cagacaauuaucuaaaagccc

SEQ ID NO: 337088 - RNA, 21 nt, Human
cagcgaggccagaguucccca

SEQ ID NO: 337089 - RNA, 19 nt, Human
cagcuaagcaaacuagcca

SEQ ID NO: 337090 - RNA, 25 nt, Human
cagugcugggauuacaggcaugagc

SEQ ID NO: 337091 - RNA, 23 nt, Human
ccacagugcugggauuacaggca

SEQ ID NO: 337092 - RNA, 24 nt, Human
ccacagugcugggauuacaggcau

SEQ ID NO: 337093 - RNA, 24 nt, Human
ccacugaccuccagccugggagac

SEQ ID NO: 337094 - RNA, 20 nt, Human
ccaggaguucgagaccagcc

SEQ ID NO: 337095 - RNA, 24 nt, Human
cccaccacucuugucucaaacaaa

SEQ ID NO: 337096 - RNA, 23 nt, Human
ccuaccaaaaugcccauucccca

SEQ ID NO: 337097 - RNA, 22 nt, Human
ccuccagccugggagacagagc

SEQ ID NO: 337098 - RNA, 24 nt, Human
ccugccucagccucccaagaagcu

SEQ ID NO: 337099 - RNA, 22 nt, Human
ccuggccaacauggugaaaccc

SEQ ID NO: 337100 - RNA, 24 nt, Human
ccuggccaacauggugaaacccug

SEQ ID NO: 337101 - RNA, 24 nt, Human
ccuggccucaagcaauacaaccac

SEQ ID NO: 337102 - RNA, 20 nt, Human
ccuguaaucccaacacuuug

SEQ ID NO: 337103 - RNA, 22 nt, Human
ccuguaaucccaacacuuuggg

SEQ ID NO: 337104 - RNA, 25 nt, Human
ccuguaaucccaacacuuugggcgg

SEQ ID NO: 337105 - RNA, 22 nt, Human
ccuuccugccugacuccggaag

SEQ ID NO: 337106 - RNA, 24 nt, Human
cgagaccagccuggccaacauggu

SEQ ID NO: 337107 - RNA, 22 nt, Human
cgaggccagaguuccccagcgc

SEQ ID NO: 337108 - RNA, 19 nt, Human
cguccaccacacuuuaccu

SEQ ID NO: 337109 - RNA, 21 nt, Human
cucaagcaauccugccucagc

SEQ ID NO: 337110 - RNA, 24 nt, Human
cucaugccuguaaucccaacacuu

SEQ ID NO: 337111 - RNA, 21 nt, Human
cugcaacauacauaaaaccua

SEQ ID NO: 337112 - RNA, 24 nt, Human
cuggccaacauggugaaacccugu

SEQ ID NO: 337113 - RNA, 22 nt, Human
cuggccucaagcaauacaacca

SEQ ID NO: 337114 - RNA, 25 nt, Human
cuguaaccaaaacagauuguggggc

SEQ ID NO: 337115 - RNA, 19 nt, Human
cugugcuucuccuuccugc

SEQ ID NO: 337116 - RNA, 24 nt, Human
cuucgcuccaucacccaggaugga

SEQ ID NO: 337117 - RNA, 24 nt, Human
gaaaagugugcaauaccugcaaca

SEQ ID NO: 337118 - RNA, 24 nt, Human
gaaugcuuaugacuguggucacaa

SEQ ID NO: 337119 - RNA, 24 nt, Human
gacuacaggugugcaccaccaugc

SEQ ID NO: 337120 - RNA, 18 nt, Human
gacuccugucucagucuc

SEQ ID NO: 337121 - RNA, 23 nt, Human
gagaaucacuugaacccgggagg

SEQ ID NO: 337122 - RNA, 23 nt, Human
gagaugagaaucacuugaacccg

SEQ ID NO: 337123 - RNA, 19 nt, Human
gagcccagccugcucccgc

SEQ ID NO: 337124 - RNA, 25 nt, Human
gagcccagccugcucccgcagggag

SEQ ID NO: 337125 - RNA, 18 nt, Human
gaucacuugaggccagga

SEQ ID NO: 337126 - RNA, 24 nt, Human
gaucacuugaggccaggaguucga

SEQ ID NO: 337127 - RNA, 18 nt, Human
gauuacaggcaugagcca

SEQ ID NO: 337128 - RNA, 21 nt, Human
gauuacaggcaugagccacca

SEQ ID NO: 337129 - RNA, 22 nt, Human
gauuacaggcaugagccaccac

SEQ ID NO: 337130 - RNA, 20 nt, Human
gauuguauguguaugugugu

SEQ ID NO: 337131 - RNA, 24 nt, Human
gccaacauggugaaacccugucuc

SEQ ID NO: 337132 - RNA, 19 nt, Human
gcccauuccccaaagauga

SEQ ID NO: 337133 - RNA, 22 nt, Human
gccgggcaugguggcucaugcc

SEQ ID NO: 337134 - RNA, 19 nt, Human
gcuccaucacccaggaugg

SEQ ID NO: 337135 - RNA, 22 nt, Human
ggacuacaggugugcaccacca

SEQ ID NO: 337136 - RNA, 24 nt, Human
ggacuacaggugugcaccaccaug

SEQ ID NO: 337137 - RNA, 19 nt, Human
ggaguacaguggcgcgauc

SEQ ID NO: 337138 - RNA, 19 nt, Human
ggauuacaggcaugagcca

SEQ ID NO: 337139 - RNA, 21 nt, Human
ggcaaagaauaaguaauacaa

SEQ ID NO: 337140 - RNA, 23 nt, Human
ggcaugguggcucaugccuguaa

SEQ ID NO: 337141 - RNA, 23 nt, Human
ggccgggcaugguggcucaugcc

SEQ ID NO: 337142 - RNA, 20 nt, Human
ggcucaugccuguaauccca

SEQ ID NO: 337143 - RNA, 19 nt, Human
gggcucaagcaauccugcc

SEQ ID NO: 337144 - RNA, 22 nt, Human
gggucuugcuguguugcccugg

SEQ ID NO: 337145 - RNA, 18 nt, Human
gguccagcggagcugagc

SEQ ID NO: 337146 - RNA, 23 nt, Human
gguggcucaugccuguaauccca

SEQ ID NO: 337147 - RNA, 24 nt, Human
guauguguaugugugugugugugu

SEQ ID NO: 337148 - RNA, 27 nt, Human
guauguguaugugugugugugugugug

SEQ ID NO: 337149 - RNA, 21 nt, Human
gugaaacccugucucuacuaa

SEQ ID NO: 337150 - RNA, 24 nt, Human
gugagcugagauuugugccacuga

SEQ ID NO: 337151 - RNA, 22 nt, Human
guggaucacuugaggccaggag

SEQ ID NO: 337152 - RNA, 25 nt, Human
guguguauauauauauauauuugaa

SEQ ID NO: 337153 - RNA, 24 nt, Human
guuuuuaauucugaaaauuaacug

SEQ ID NO: 337154 - RNA, 21 nt, Human
uaaaaauacaaaaauuagcca

SEQ ID NO: 337155 - RNA, 18 nt, Human
uaaaauuacagcaccucu

SEQ ID NO: 337156 - RNA, 20 nt, Human
uaaccaauagccaccagugg

SEQ ID NO: 337157 - RNA, 23 nt, Human
uacaacagcaaauuuccaaaaaa

SEQ ID NO: 337158 - RNA, 24 nt, Human
uacaaccaccucagccucccacag

SEQ ID NO: 337159 - RNA, 24 nt, Human
uacaggcaugagccaccacaccca

SEQ ID NO: 337160 - RNA, 19 nt, Human
uacaguggcgcgaucauag

SEQ ID NO: 337161 - RNA, 23 nt, Human
uaccugcaacauacauaaaaccu

SEQ ID NO: 337162 - RNA, 24 nt, Human
uaccugcaacauacauaaaaccua

SEQ ID NO: 337163 - RNA, 22 nt, Human
uagacaggccaugagcucucca

SEQ ID NO: 337164 - RNA, 18 nt, Human
uagagaaggguaguuaag

SEQ ID NO: 337165 - RNA, 23 nt, Human
uagccaaacagaaguaauuucaa

SEQ ID NO: 337166 - RNA, 21 nt, Human
uaggacuacaggugugcacca

SEQ ID NO: 337167 - RNA, 24 nt, Human
uaggacuacaggugugcaccacca

SEQ ID NO: 337168 - RNA, 21 nt, Human
uaguucauagcaauuugggga

SEQ ID NO: 337169 - RNA, 18 nt, Human
uauagaacagaacacgaa

SEQ ID NO: 337170 - RNA, 21 nt, Human
uauagaccuaugauguuggug

SEQ ID NO: 337171 - RNA, 21 nt, Human
uauauuugcauuccccaaauu

SEQ ID NO: 337172 - RNA, 20 nt, Human
uauggaaaauggaagugcua

SEQ ID NO: 337173 - RNA, 20 nt, Human
uauguauauggauuguaugu

SEQ ID NO: 337174 - RNA, 19 nt, Human
uauguguaugugugugugu

SEQ ID NO: 337175 - RNA, 23 nt, Human
uauguguaugugugugugugugu

SEQ ID NO: 337176 - RNA, 23 nt, Human
uauguguaugugugugugugugu

SEQ ID NO: 337177 - RNA, 18 nt, Human
uaugugugugugugugug

SEQ ID NO: 337178 - RNA, 25 nt, Human
ucaaacaccuggccucaagcaauac

SEQ ID NO: 337179 - RNA, 24 nt, Human
ucacugaaggcucaaacuccuggg

SEQ ID NO: 337180 - RNA, 20 nt, Human
ucacuugaggccaggaguuc

SEQ ID NO: 337181 - RNA, 23 nt, Human
uccaauagagcuuucuauaauga

SEQ ID NO: 337182 - RNA, 20 nt, Human
uccacacaaaaaaucagaaa

SEQ ID NO: 337183 - RNA, 24 nt, Human
uccaucacccaggauggaguacag

SEQ ID NO: 337184 - RNA, 23 nt, Human
ucccaagaagcuaggacuacagg

SEQ ID NO: 337185 - RNA, 24 nt, Human
ucccacagugcugggauuacaggc

SEQ ID NO: 337186 - RNA, 19 nt, Human
uccccaaauuuaaaaacca

SEQ ID NO: 337187 - RNA, 18 nt, Human
uccccagugaaauagaaa

SEQ ID NO: 337188 - RNA, 24 nt, Human
uccuaauacuuacaguugauuucc

SEQ ID NO: 337189 - RNA, 21 nt, Human
uccugccucagccucccaaga

SEQ ID NO: 337190 - RNA, 18 nt, Human
uccugggcucaagcaauc

SEQ ID NO: 337191 - RNA, 20 nt, Human
uccugggcucaagcaauccu

SEQ ID NO: 337192 - RNA, 21 nt, Human
uccugggcucaagcaauccug

SEQ ID NO: 337193 - RNA, 20 nt, Human
uccugucucagucucucuca

SEQ ID NO: 337194 - RNA, 26 nt, Human
uccuuugacauuauguucaucuuggu

SEQ ID NO: 337195 - RNA, 22 nt, Human
ucgcuccaucacccaggaugga

SEQ ID NO: 337196 - RNA, 21 nt, Human
ucucuacuaaaaauacaaaaa

SEQ ID NO: 337197 - RNA, 19 nt, Human
ucuugcuguguugcccugg

SEQ ID NO: 337198 - RNA, 20 nt, Human
ucuuuuggaacaaaauccaa

SEQ ID NO: 337199 - RNA, 22 nt, Human
ugagaugagaaucacuugaacc

SEQ ID NO: 337200 - RNA, 25 nt, Human
ugagaugagaaucacuugaaccccc

SEQ ID NO: 337201 - RNA, 26 nt, Human
ugagcccagccugcucccgcagggag

SEQ ID NO: 337202 - RNA, 19 nt, Human
ugagcucuaagcuaacacu

SEQ ID NO: 337203 - RNA, 23 nt, Human
ugaggaaguaugaucagaagaaa

SEQ ID NO: 337204 - RNA, 23 nt, Human
ugagguggguggaucacuugagg

SEQ ID NO: 337205 - RNA, 24 nt, Human
ugagguggguggaucacuugaggc

SEQ ID NO: 337206 - RNA, 26 nt, Human
ugagguggguggaucacuugaggcca

SEQ ID NO: 337207 - RNA, 19 nt, Human
ugaugaccacaaagaauca

SEQ ID NO: 337208 - RNA, 20 nt, Human
ugauguugguggugaucagc

SEQ ID NO: 337209 - RNA, 24 nt, Human
ugccucagccucccaagaagcuag

SEQ ID NO: 337210 - RNA, 23 nt, Human
ugccuguaaucccaacacuuugg

SEQ ID NO: 337211 - RNA, 20 nt, Human
ugcugugcuucuccuuccug

SEQ ID NO: 337212 - RNA, 21 nt, Human
uggaaagguucuuuuuaaaaa

SEQ ID NO: 337213 - RNA, 24 nt, Human
uggaaagguucuuuuuaaaaacac

SEQ ID NO: 337214 - RNA, 23 nt, Human
uggaaugugcuugaaagagaucu

SEQ ID NO: 337215 - RNA, 19 nt, Human
uggaguacaguggcgcgau

SEQ ID NO: 337216 - RNA, 24 nt, Human
uggaucacuugaggccaggaguuc

SEQ ID NO: 337217 - RNA, 26 nt, Human
uggaucacuugaggccaggaguucga

SEQ ID NO: 337218 - RNA, 24 nt, Human
uggauuguauguguaugugugugu

SEQ ID NO: 337219 - RNA, 24 nt, Human
uggccaacauggugaaacccuguc

SEQ ID NO: 337220 - RNA, 23 nt, Human
uggccucaagcaauacaaccacc

SEQ ID NO: 337221 - RNA, 22 nt, Human
uggcgcgaucauagcucacuga

SEQ ID NO: 337222 - RNA, 21 nt, Human
uggcucaugccuguaauccca

SEQ ID NO: 337223 - RNA, 24 nt, Human
uggcucaugccuguaaucccaaca

SEQ ID NO: 337224 - RNA, 22 nt, Human
uggcuggccucaaacaccuggc

SEQ ID NO: 337225 - RNA, 22 nt, Human
ugggaggcugagaugagaauca

SEQ ID NO: 337226 - RNA, 18 nt, Human
ugggauuacaggcaugag

SEQ ID NO: 337227 - RNA, 19 nt, Human
ugggauuacaggcaugagc

SEQ ID NO: 337228 - RNA, 22 nt, Human
ugggauuacaggcaugagccac

SEQ ID NO: 337229 - RNA, 23 nt, Human
ugggauuacaggcaugagccacc

SEQ ID NO: 337230 - RNA, 24 nt, Human
ugggauuacaggcaugagccacca

SEQ ID NO: 337231 - RNA, 24 nt, Human
ugggauuacaggcaugagccacca

SEQ ID NO: 337232 - RNA, 19 nt, Human
ugggcggcugaggugggug

SEQ ID NO: 337233 - RNA, 24 nt, Human
ugggcggcugagguggguggauca

SEQ ID NO: 337234 - RNA, 19 nt, Human
uggggcucuagacuccgga

SEQ ID NO: 337235 - RNA, 24 nt, Human
uggggucuugcuguguugcccugg

SEQ ID NO: 337236 - RNA, 24 nt, Human
uggguggaucacuugaggccagga

SEQ ID NO: 337237 - RNA, 24 nt, Human
ugguggcucaugccuguaauccca

SEQ ID NO: 337238 - RNA, 23 nt, Human
uguacguauauuaugaauguaua

SEQ ID NO: 337239 - RNA, 24 nt, Human
uguagagauggggucuugcugugu

SEQ ID NO: 337240 - RNA, 23 nt, Human
uguauauugcugugcuucuccuu

SEQ ID NO: 337241 - RNA, 21 nt, Human
uguauguguaugugugugugu

SEQ ID NO: 337242 - RNA, 21 nt, Human
uguccuagaccaauguugucc

SEQ ID NO: 337243 - RNA, 21 nt, Human
ugucucagucucucucaacau

SEQ ID NO: 337244 - RNA, 22 nt, Human
uguggggcucuagacuccggac

SEQ ID NO: 337245 - RNA, 18 nt, Human
uguguagauuuucccaug

SEQ ID NO: 337246 - RNA, 18 nt, Human
uguguauauauauauaua

SEQ ID NO: 337247 - RNA, 19 nt, Human
uguguauauauauauauau

SEQ ID NO: 337248 - RNA, 20 nt, Human
uguguaugugugugugugug

SEQ ID NO: 337249 - RNA, 24 nt, Human
uguguguauauauauauauauuug

SEQ ID NO: 337250 - RNA, 18 nt, Human
uguguguguauauauaua

SEQ ID NO: 337251 - RNA, 18 nt, Human
uguguguguauauauaua

SEQ ID NO: 337252 - RNA, 24 nt, Human
uguguguguauauauauauauaau

SEQ ID NO: 337253 - RNA, 23 nt, Human
uguguguguguauauauauauau

SEQ ID NO: 337254 - RNA, 23 nt, Human
uguguguguguguauauauauau

SEQ ID NO: 337255 - RNA, 18 nt, Human
uguguguguguguguaua

SEQ ID NO: 337256 - RNA, 20 nt, Human
uguguguguguguguauaua

SEQ ID NO: 337257 - RNA, 18 nt, Human
ugugugugugugugugug

SEQ ID NO: 337258 - RNA, 24 nt, Human
uguguguguguguguguguauaua

SEQ ID NO: 337259 - RNA, 24 nt, Human
uguguugcccuggcuggccucaaa

SEQ ID NO: 337260 - RNA, 18 nt, Human
uguugcccuggcuggccu

SEQ ID NO: 337261 - RNA, 21 nt, Human
uguuuguuuuucaggcacuua

SEQ ID NO: 337262 - RNA, 22 nt, Human
uuaaaagguuuaacucuauaga

SEQ ID NO: 337263 - RNA, 19 nt, Human
uucacagacaauuaucuaa

SEQ ID NO: 337264 - RNA, 21 nt, Human
uucauuucuacagagaaagag

SEQ ID NO: 337265 - RNA, 24 nt, Human
uucgcuccaucacccaggauggag

SEQ ID NO: 337266 - RNA, 22 nt, Human
uucguccuuugacauuauguuc

SEQ ID NO: 337267 - RNA, 18 nt, Human
uucugaggaaguaugauc

SEQ ID NO: 337268 - RNA, 18 nt, Human
uugaaggaacacauagcg

SEQ ID NO: 337269 - RNA, 22 nt, Human
uugaggccaggaguucgagacc

SEQ ID NO: 337270 - RNA, 19 nt, Human
uugcaacaucaagugugga

SEQ ID NO: 337271 - RNA, 23 nt, Human
uugggaggcugagaugagaauca

SEQ ID NO: 337272 - RNA, 25 nt, Human
uugggcggcugagguggguggauca

SEQ ID NO: 337273 - RNA, 24 nt, Human
uuguagagauggggucuugcugug

SEQ ID NO: 337274 - RNA, 23 nt, Human
uugugccacugaccuccagccug

SEQ ID NO: 337275 - RNA, 23 nt, Human
uuuaggaaaggacuucacagaga

SEQ ID NO: 337276 - RNA, 20 nt, Human
uuuguagagauggggucuug

SEQ ID NO: 337277 - RNA, 24 nt, Human
uuuguagagauggggucuugcugu

SEQ ID NO: 337278 - RNA, 24 nt, Human
uuugugccacugaccuccagccug

SEQ ID NO: 337279 - RNA, 24 nt, Human
aaaguccugggauuagaggcguga

SEQ ID NO: 337280 - RNA, 24 nt, Human
aagcaauucugccucagccuccca

SEQ ID NO: 337281 - RNA, 22 nt, Human
aaguagcugggauuauaggcau

SEQ ID NO: 337282 - RNA, 24 nt, Human
aaguagcugggauuauaggcaugc

SEQ ID NO: 337283 - RNA, 24 nt, Human
aauuuuguauuuuuaguagagaug

SEQ ID NO: 337284 - RNA, 20 nt, Human
acucuuguugcccaggcugg

SEQ ID NO: 337285 - RNA, 21 nt, Human
acucuuguugcccaggcugga

SEQ ID NO: 337286 - RNA, 24 nt, Human
acucuuguugcccaggcuggagug

SEQ ID NO: 337287 - RNA, 18 nt, Human
aggcuggagugcaguggc

SEQ ID NO: 337288 - RNA, 18 nt, Human
agggcuaaaagguuugaa

SEQ ID NO: 337289 - RNA, 20 nt, Human
agugcaguggcgcaaccuug

SEQ ID NO: 337290 - RNA, 24 nt, Human
agugcaguggcgcaaccuuggcuc

SEQ ID NO: 337291 - RNA, 20 nt, Human
augggguuucuccauguugg

SEQ ID NO: 337292 - RNA, 24 nt, Human
augggguuucuccauguuggucag

SEQ ID NO: 337293 - RNA, 24 nt, Human
auuaguauuuuuaaaaggcacuua

SEQ ID NO: 337294 - RNA, 24 nt, Human
caaaguccugggauuagaggcgug

SEQ ID NO: 337295 - RNA, 19 nt, Human
caagcaauucugccucagc

SEQ ID NO: 337296 - RNA, 23 nt, Human
cacaccacccggcuaauuuugua

SEQ ID NO: 337297 - RNA, 21 nt, Human
caccacaaccuccgcuuccug

SEQ ID NO: 337298 - RNA, 27 nt, Human
cacggcccccgacuucuuucucccucc

SEQ ID NO: 337299 - RNA, 18 nt, Human
cagaacacagaaggagac

SEQ ID NO: 337300 - RNA, 24 nt, Human
ccaaaguccugggauuagaggcgu

SEQ ID NO: 337301 - RNA, 24 nt, Human
ccaaguagcugggauuauaggcau

SEQ ID NO: 337302 - RNA, 23 nt, Human
ccacaaccuccgcuuccuggguu

SEQ ID NO: 337303 - RNA, 25 nt, Human
ccacaaccuccgcuuccuggguucc

SEQ ID NO: 337304 - RNA, 19 nt, Human
ccauguuggucaggcuggu

SEQ ID NO: 337305 - RNA, 23 nt, Human
ccauguuggucaggcuggucucg

SEQ ID NO: 337306 - RNA, 23 nt, Human
cccaaguagcugggauuauaggc

SEQ ID NO: 337307 - RNA, 24 nt, Human
cccaaguagcugggauuauaggca

SEQ ID NO: 337308 - RNA, 19 nt, Human
ccuggguucaagcaauucu

SEQ ID NO: 337309 - RNA, 22 nt, Human
cggcccccgacuucuuucuccc

SEQ ID NO: 337310 - RNA, 24 nt, Human
cuaauuuuguauuuuuaguagaga

SEQ ID NO: 337311 - RNA, 22 nt, Human
cuauagggcuaaaagguuugaa

SEQ ID NO: 337312 - RNA, 25 nt, Human
cucaaggagcaaacauuaaaaaaaa

SEQ ID NO: 337313 - RNA, 23 nt, Human
cucagccucccaaguagcuggga

SEQ ID NO: 337314 - RNA, 24 nt, Human
cuccauguuggucaggcuggucuc

SEQ ID NO: 337315 - RNA, 25 nt, Human
cuccugacuccggugaucugcccgc

SEQ ID NO: 337316 - RNA, 23 nt, Human
cugccucagccucccaaguagcu

SEQ ID NO: 337317 - RNA, 22 nt, Human
cuuccuggguucaagcaauucu

SEQ ID NO: 337318 - RNA, 24 nt, Human
cuuguugcccaggcuggagugcag

SEQ ID NO: 337319 - RNA, 23 nt, Human
cuuucugcagaacaaucugaaag

SEQ ID NO: 337320 - RNA, 24 nt, Human
gagaugggguuucuccauguuggu

SEQ ID NO: 337321 - RNA, 18 nt, Human
gauuagaggcgugagcca

SEQ ID NO: 337322 - RNA, 18 nt, Human
gauuauaggcaugcgcca

SEQ ID NO: 337323 - RNA, 19 nt, Human
gcccaggcuggagugcagu

SEQ ID NO: 337324 - RNA, 19 nt, Human
gcuggagugcaguggcgca

SEQ ID NO: 337325 - RNA, 22 nt, Human
gggguuucuccauguuggucag

SEQ ID NO: 337326 - RNA, 23 nt, Human
ggugaucugcccgccuuggccuc

SEQ ID NO: 337327 - RNA, 18 nt, Human
guagcugggauuauaggc

SEQ ID NO: 337328 - RNA, 25 nt, Human
uaaaaagcacauaauuuuugugcaa

SEQ ID NO: 337329 - RNA, 23 nt, Human
uaaaagagagcuaaaaaguuaug

SEQ ID NO: 337330 - RNA, 20 nt, Human
uacagaacacagaaggagac

SEQ ID NO: 337331 - RNA, 24 nt, Human
uacucuuguugcccaggcuggagu

SEQ ID NO: 337332 - RNA, 24 nt, Human
uaguagagaugggguuucuccaug

SEQ ID NO: 337333 - RNA, 18 nt, Human
uauuuuuugagauggagu

SEQ ID NO: 337334 - RNA, 24 nt, Human
ucaccacaaccuccgcuuccuggg

SEQ ID NO: 337335 - RNA, 25 nt, Human
ucaccacaaccuccgcuuccugggg

SEQ ID NO: 337336 - RNA, 25 nt, Human
ucaccacaaccuccgcuuccugggu

SEQ ID NO: 337337 - RNA, 27 nt, Human
ucaccacaaccuccgcuuccuggguuc

SEQ ID NO: 337338 - RNA, 20 nt, Human
ucagccucccaaguagcugg

SEQ ID NO: 337339 - RNA, 24 nt, Human
ucccaaaguccugggauuagaggc

SEQ ID NO: 337340 - RNA, 24 nt, Human
ucccaaguagcugggauuauaggc

SEQ ID NO: 337341 - RNA, 25 nt, Human
ucccuauuuauauauauauauauau

SEQ ID NO: 337342 - RNA, 18 nt, Human
uccucauauuacagaaca

SEQ ID NO: 337343 - RNA, 19 nt, Human
uccuggguucaagcaauuc

SEQ ID NO: 337344 - RNA, 20 nt, Human
uccuggguucaagcaauucu

SEQ ID NO: 337345 - RNA, 21 nt, Human
uccuggguucaagcaauucug

SEQ ID NO: 337346 - RNA, 22 nt, Human
ucuuguugcccaggcuggagug

SEQ ID NO: 337347 - RNA, 20 nt, Human
ugcaguggcgcaaccuuggc

SEQ ID NO: 337348 - RNA, 23 nt, Human
ugcaguggcgcaaccuuggcuca

SEQ ID NO: 337349 - RNA, 18 nt, Human
ugcccaggcuggagugca

SEQ ID NO: 337350 - RNA, 21 nt, Human
ugcccaggcuggagugcagug

SEQ ID NO: 337351 - RNA, 22 nt, Human
ugcccaggcuggagugcagugg

SEQ ID NO: 337352 - RNA, 24 nt, Human
ugcccaggcuggagugcaguggcg

SEQ ID NO: 337353 - RNA, 24 nt, Human
ugccucagccucccaaguagcugg

SEQ ID NO: 337354 - RNA, 23 nt, Human
uggagugcaguggcgcaaccuug

SEQ ID NO: 337355 - RNA, 24 nt, Human
uggagugcaguggcgcaaccuugg

SEQ ID NO: 337356 - RNA, 24 nt, Human
uggcgcaaccuuggcucaccacaa

SEQ ID NO: 337357 - RNA, 18 nt, Human
ugggauuagaggcgugag

SEQ ID NO: 337358 - RNA, 19 nt, Human
ugggauuagaggcgugagc

SEQ ID NO: 337359 - RNA, 22 nt, Human
ugggauuagaggcgugagccac

SEQ ID NO: 337360 - RNA, 24 nt, Human
ugggauuagaggcgugagccacag

SEQ ID NO: 337361 - RNA, 18 nt, Human
ugggauuauaggcaugcg

SEQ ID NO: 337362 - RNA, 21 nt, Human
ugggauuauaggcaugcgcca

SEQ ID NO: 337363 - RNA, 22 nt, Human
ugggauuauaggcaugcgccac

SEQ ID NO: 337364 - RNA, 24 nt, Human
ugggauuauaggcaugcgccacac

SEQ ID NO: 337365 - RNA, 24 nt, Human
ugggguuucuccauguuggucagg

SEQ ID NO: 337366 - RNA, 24 nt, Human
uggucaggcuggucucgaacuccu

SEQ ID NO: 337367 - RNA, 22 nt, Human
uuacucuuguugcccaggcugg

SEQ ID NO: 337368 - RNA, 23 nt, Human
uuacucuuguugcccaggcugga

SEQ ID NO: 337369 - RNA, 18 nt, Human
uuaguagagaugggguuu

SEQ ID NO: 337370 - RNA, 24 nt, Human
uuaguagagaugggguuucuccau

SEQ ID NO: 337371 - RNA, 21 nt, Human
uucaagcaauucugccucagc

SEQ ID NO: 337372 - RNA, 19 nt, Human
uugaaggacagagcuccaa

SEQ ID NO: 337373 - RNA, 24 nt, Human
uugcccaggcuggagugcaguggc

SEQ ID NO: 337374 - RNA, 30 nt, Human
uuggcucaccacaaccuccgcuuccugggg

SEQ ID NO: 337375 - RNA, 23 nt, Human
uuguauuuuuaguagagaugggg

SEQ ID NO: 337376 - RNA, 24 nt, Human
uuuacucuuguugcccaggcugga

SEQ ID NO: 337377 - RNA, 19 nt, Human
uuuauauauauauauauau

SEQ ID NO: 337378 - RNA, 21 nt, Human
uuucuccauguuggucaggcu

SEQ ID NO: 337379 - RNA, 24 nt, Human
uuuuacucuuguugcccaggcugg

SEQ ID NO: 337380 - RNA, 19 nt, Human
uuuuguauuuuuaguagag

SEQ ID NO: 337381 - RNA, 20 nt, Human
uuuuguauuuuuaguagaga

SEQ ID NO: 337382 - RNA, 19 nt, Human
uuuugugcaauuuuuucuu

SEQ ID NO: 337383 - RNA, 22 nt, Human
uuuuuaguagagaugggguuuc

SEQ ID NO: 337384 - RNA, 22 nt, Human
aaaacagguaggauugaacuug

SEQ ID NO: 337385 - RNA, 20 nt, Human
aaacacaguucuucuguugg

SEQ ID NO: 337386 - RNA, 21 nt, Human
aacaauagugauuaauaaaga

SEQ ID NO: 337387 - RNA, 22 nt, Human
aaccuaaauucuccaaccaauu

SEQ ID NO: 337388 - RNA, 18 nt, Human
aaccugggugugcucucc

SEQ ID NO: 337389 - RNA, 20 nt, Human
aaccugggugugcucuccuu

SEQ ID NO: 337390 - RNA, 24 nt, Human
aagcuuugccagagccaaaaaccc

SEQ ID NO: 337391 - RNA, 27 nt, Human
acacccaaaaauauuuuuaaauauauc

SEQ ID NO: 337392 - RNA, 21 nt, Human
acugccaggaacacccaaaaa

SEQ ID NO: 337393 - RNA, 24 nt, Human
acugccaggaacacccaaaaauau

SEQ ID NO: 337394 - RNA, 23 nt, Human
agauaacucccuccuaaaggaag

SEQ ID NO: 337395 - RNA, 23 nt, Human
aggaaaaaagcuccauaaucuag

SEQ ID NO: 337396 - RNA, 27 nt, Human
caggaacacccaaaaauauuuuuaaau

SEQ ID NO: 337397 - RNA, 22 nt, Human
cauauuaauccccucaauucaa

SEQ ID NO: 337398 - RNA, 27 nt, Human
cauuaaagaaaauauuggauguuuagc

SEQ ID NO: 337399 - RNA, 26 nt, Human
ccauuucucaccaaaauguccccuca

SEQ ID NO: 337400 - RNA, 18 nt, Human
ccccugggcggccggacc

SEQ ID NO: 337401 - RNA, 19 nt, Human
ccccugggcggccggaccu

SEQ ID NO: 337402 - RNA, 21 nt, Human
cccgcagcaauucaaacggcg

SEQ ID NO: 337403 - RNA, 18 nt, Human
cccuauauaacaaaaaac

SEQ ID NO: 337404 - RNA, 18 nt, Human
cccugggcggccggaccu

SEQ ID NO: 337405 - RNA, 24 nt, Human
ccuaaagugccuccacuuauacag

SEQ ID NO: 337406 - RNA, 21 nt, Human
ccucaggugaggugagggccc

SEQ ID NO: 337407 - RNA, 18 nt, Human
ccucauguuacuaacagg

SEQ ID NO: 337408 - RNA, 25 nt, Human
gauuaauaaagauauguauagauaa

SEQ ID NO: 337409 - RNA, 19 nt, Human
gcagcaauucaaacggcga

SEQ ID NO: 337410 - RNA, 23 nt, Human
gccagagccaaaaacccaaguuu

SEQ ID NO: 337411 - RNA, 21 nt, Human
ggaacgggagacgagggcuaa

SEQ ID NO: 337412 - RNA, 19 nt, Human
gggcccgggcccgcagcaa

SEQ ID NO: 337413 - RNA, 19 nt, Human
gugagggcccgggcccgca

SEQ ID NO: 337414 - RNA, 20 nt, Human
uaaaaaccuaaauucuccaa

SEQ ID NO: 337415 - RNA, 24 nt, Human
uaaaaaccuaaauucuccaaccaa

SEQ ID NO: 337416 - RNA, 21 nt, Human
uaaaagcuuugccagagccaa

SEQ ID NO: 337417 - RNA, 26 nt, Human
uagacauuucuuuuagauaacucccu

SEQ ID NO: 337418 - RNA, 18 nt, Human
uagauaacucccuccuaa

SEQ ID NO: 337419 - RNA, 19 nt, Human
uagcaguaucuugagaagu

SEQ ID NO: 337420 - RNA, 19 nt, Human
uagcaguaucuugagaagu

SEQ ID NO: 337421 - RNA, 23 nt, Human
uagcaguaucuugagaaguuuua

SEQ ID NO: 337422 - RNA, 22 nt, Human
ucaauucaacuugacuuaaaau

SEQ ID NO: 337423 - RNA, 22 nt, Human
ucacacugcaccacaccgaaug

SEQ ID NO: 337424 - RNA, 18 nt, Human
ucauaaguuuucauauua

SEQ ID NO: 337425 - RNA, 24 nt, Human
ucucucagcaauaugaaguuaccu

SEQ ID NO: 337426 - RNA, 21 nt, Human
ucuguuggagacgucaacaga

SEQ ID NO: 337427 - RNA, 20 nt, Human
ugccaggaacacccaaaaau

SEQ ID NO: 337428 - RNA, 19 nt, Human
ugcuaaacagauuuuguga

SEQ ID NO: 337429 - RNA, 21 nt, Human
ugcuaaacagauuuugugaag

SEQ ID NO: 337430 - RNA, 20 nt, Human
uggaaggaguuaagucccau

SEQ ID NO: 337431 - RNA, 18 nt, Human
uggauuaaggaaaaaagc

SEQ ID NO: 337432 - RNA, 19 nt, Human
uggggagagggaagaugug

SEQ ID NO: 337433 - RNA, 24 nt, Human
uggguuacaaaaucaugcauuuua

SEQ ID NO: 337434 - RNA, 22 nt, Human
ugugcucuccuuugucaggaau

SEQ ID NO: 337435 - RNA, 20 nt, Human
uuaauuugacuugaaaacug

SEQ ID NO: 337436 - RNA, 18 nt, Human
uucuaaggacacuggaag

SEQ ID NO: 337437 - RNA, 19 nt, Human
uuucacacugcaccacacc

SEQ ID NO: 337438 - RNA, 23 nt, Human
uuucacacugcaccacaccgaau

SEQ ID NO: 337439 - RNA, 23 nt, Human
uuuguuuugcuuuuuaugaggac

SEQ ID NO: 337440 - RNA, 21 nt, Human
uuuucacacugcaccacaccg

SEQ ID NO: 337441 - RNA, 23 nt, Human
aaacaggacgugaucccagccca

SEQ ID NO: 337442 - RNA, 19 nt, Human
aacucacugccgccuacuc

SEQ ID NO: 337443 - RNA, 24 nt, Human
aagcccucucuggcuggggagugg

SEQ ID NO: 337444 - RNA, 20 nt, Human
acaaaacaggacgugauccc

SEQ ID NO: 337445 - RNA, 21 nt, Human
accucugcccgccgccaccuc

SEQ ID NO: 337446 - RNA, 18 nt, Human
acucuguccuucccugcc

SEQ ID NO: 337447 - RNA, 20 nt, Human
acucuguccuucccugcccc

SEQ ID NO: 337448 - RNA, 19 nt, Human
caacaaccaaguccgagac

SEQ ID NO: 337449 - RNA, 23 nt, Human
caacaaccaaguccgagacugga

SEQ ID NO: 337450 - RNA, 20 nt, Human
caauuuuccaacaaaaguca

SEQ ID NO: 337451 - RNA, 19 nt, Human
cacagucaccagcucaaaa

SEQ ID NO: 337452 - RNA, 24 nt, Human
cacccccgcugcugcuaccaugau

SEQ ID NO: 337453 - RNA, 22 nt, Human
cacucuguccuucccugcccca

SEQ ID NO: 337454 - RNA, 19 nt, Human
cagcucaaaauggcgacga

SEQ ID NO: 337455 - RNA, 22 nt, Human
ccagccggccacagucaccagc

SEQ ID NO: 337456 - RNA, 24 nt, Human
ccaugaucugccagccugggugau

SEQ ID NO: 337457 - RNA, 20 nt, Human
cccagccacccccgcugcug

SEQ ID NO: 337458 - RNA, 21 nt, Human
cccaggauggacacccaacau

SEQ ID NO: 337459 - RNA, 21 nt, Human
cccgccgccaccuccuccaac

SEQ ID NO: 337460 - RNA, 19 nt, Human
cccgcugcugcuaccauga

SEQ ID NO: 337461 - RNA, 18 nt, Human
ccgccgccaccuccucca

SEQ ID NO: 337462 - RNA, 18 nt, Human
ccuacucccagccggcca

SEQ ID NO: 337463 - RNA, 19 nt, Human
ccucagccgcuggcuccgu

SEQ ID NO: 337464 - RNA, 19 nt, Human
ccuccaacucucccagcuc

SEQ ID NO: 337465 - RNA, 19 nt, Human
ccucucuggcuggggagug

SEQ ID NO: 337466 - RNA, 21 nt, Human
ccucucuggcuggggaguggg

SEQ ID NO: 337467 - RNA, 24 nt, Human
ccucugcccgccgccaccuccucc

SEQ ID NO: 337468 - RNA, 22 nt, Human
cucaaaauggcgacgacgagaa

SEQ ID NO: 337469 - RNA, 18 nt, Human
cucccagacaucaccucu

SEQ ID NO: 337470 - RNA, 19 nt, Human
cucuguccuucccugcccc

SEQ ID NO: 337471 - RNA, 18 nt, Human
cugcccgccgccaccucc

SEQ ID NO: 337472 - RNA, 25 nt, Human
cuucgggggcugcuggggccccucc

SEQ ID NO: 337473 - RNA, 20 nt, Human
gccaagcgcgcugcccuccc

SEQ ID NO: 337474 - RNA, 24 nt, Human
gccugggugaugcuuccugcaggg

SEQ ID NO: 337475 - RNA, 20 nt, Human
gccuucgggggcugcugggg

SEQ ID NO: 337476 - RNA, 19 nt, Human
gcucagccggagccggagc

SEQ ID NO: 337477 - RNA, 19 nt, Human
gcuggggccccuccucagc

SEQ ID NO: 337478 - RNA, 20 nt, Human
gggagugggcuggccgacaa

SEQ ID NO: 337479 - RNA, 19 nt, Human
ucaaggaagggcucccaga

SEQ ID NO: 337480 - RNA, 22 nt, Human
ucaaggaagggcucccagacag

SEQ ID NO: 337481 - RNA, 19 nt, Human
ucacuucccagccaccccc

SEQ ID NO: 337482 - RNA, 18 nt, Human
ucugccagccugggugau

SEQ ID NO: 337483 - RNA, 20 nt, Human
ugaucugccagccuggguga

SEQ ID NO: 337484 - RNA, 18 nt, Human
ugcagggacucuucucgg

SEQ ID NO: 337485 - RNA, 22 nt, Human
ugccccaggauggacacccaac

SEQ ID NO: 337486 - RNA, 21 nt, Human
uggaggcagaucggggggagg

SEQ ID NO: 337487 - RNA, 21 nt, Human
uggcgacgacgagaagggagu

SEQ ID NO: 337488 - RNA, 19 nt, Human
uggcuggggagugggcugg

SEQ ID NO: 337489 - RNA, 18 nt, Human
ugucaaggaagggcuccc

SEQ ID NO: 337490 - RNA, 22 nt, Human
uuuuuuuuuuuuuuuuuuucag

SEQ ID NO: 337491 - RNA, 22 nt, Human
aaaaaaaaaagacauuugcaaa

SEQ ID NO: 337492 - RNA, 24 nt, Human
aaaaaaaaagacauuugcaaacau

SEQ ID NO: 337493 - RNA, 21 nt, Human
aaaaaacccggacgaacagcg

SEQ ID NO: 337494 - RNA, 25 nt, Human
aaaaagaaugaaggaagccgguacc

SEQ ID NO: 337495 - RNA, 20 nt, Human
aaaacccggacgaacagcga

SEQ ID NO: 337496 - RNA, 18 nt, Human
aaacccggacgaacagcg

SEQ ID NO: 337497 - RNA, 18 nt, Human
aaccuaagagcucaaacu

SEQ ID NO: 337498 - RNA, 25 nt, Human
aaccuaagagcucaaacuaaaaaac

SEQ ID NO: 337499 - RNA, 21 nt, Human
aacucaggcugaguucuccuc

SEQ ID NO: 337500 - RNA, 20 nt, Human
aagaauuuggaggcgugggu

SEQ ID NO: 337501 - RNA, 18 nt, Human
aagcccaaggcaggucaa

SEQ ID NO: 337502 - RNA, 21 nt, Human
aaucccaaagacgcuuccccu

SEQ ID NO: 337503 - RNA, 22 nt, Human
acaaaaugaccugaaugcacca

SEQ ID NO: 337504 - RNA, 21 nt, Human
acaguggcgcgaucuuagcuc

SEQ ID NO: 337505 - RNA, 20 nt, Human
accauguuggucaggcuggc

SEQ ID NO: 337506 - RNA, 20 nt, Human
acucuacuaccuaagcccaa

SEQ ID NO: 337507 - RNA, 21 nt, Human
acugaacucaggcugaguucu

SEQ ID NO: 337508 - RNA, 22 nt, Human
agaagacucacgagguccucuc

SEQ ID NO: 337509 - RNA, 22 nt, Human
agacauccuaagcacuguauga

SEQ ID NO: 337510 - RNA, 19 nt, Human
agagggagagaagauggag

SEQ ID NO: 337511 - RNA, 18 nt, Human
agauaggaggccccaccu

SEQ ID NO: 337512 - RNA, 18 nt, Human
agcacaaaaaacagggac

SEQ ID NO: 337513 - RNA, 19 nt, Human
agcagaaaugcagagcagu

SEQ ID NO: 337514 - RNA, 24 nt, Human
agcgauucuccugccucagccucc

SEQ ID NO: 337515 - RNA, 23 nt, Human
agcuccaaaaaccuuuauaaaua

SEQ ID NO: 337516 - RNA, 19 nt, Human
aggaagaaaaagaauuugg

SEQ ID NO: 337517 - RNA, 22 nt, Human
aggcaggucaaccauccacagg

SEQ ID NO: 337518 - RNA, 21 nt, Human
aguacaguggcgcgaucuuag

SEQ ID NO: 337519 - RNA, 21 nt, Human
agucgucgccucccaggcggc

SEQ ID NO: 337520 - RNA, 26 nt, Human
agucuggccaaacuugccagaaccaa

SEQ ID NO: 337521 - RNA, 18 nt, Human
agugcagcuccaaaaacc

SEQ ID NO: 337522 - RNA, 21 nt, Human
augcaccauguuccccuugcu

SEQ ID NO: 337523 - RNA, 23 nt, Human
augccaggcuaauuuuuuuaugu

SEQ ID NO: 337524 - RNA, 23 nt, Human
auggggacaaggucccucugcag

SEQ ID NO: 337525 - RNA, 21 nt, Human
augggguuucaccauguuggu

SEQ ID NO: 337526 - RNA, 24 nt, Human
augggguuucaccauguuggucag

SEQ ID NO: 337527 - RNA, 20 nt, Human
caaccuccgccucccggguu

SEQ ID NO: 337528 - RNA, 22 nt, Human
caagcgauucuccugccucagc

SEQ ID NO: 337529 - RNA, 27 nt, Human
caagcgauucuccugccucagccuccc

SEQ ID NO: 337530 - RNA, 23 nt, Human
caccauguuggucaggcuggcuu

SEQ ID NO: 337531 - RNA, 21 nt, Human
cacgcugccccgagcagacac

SEQ ID NO: 337532 - RNA, 23 nt, Human
cacuaaucccaaagacgcuuccc

SEQ ID NO: 337533 - RNA, 21 nt, Human
cacugcaaccuccgccucccg

SEQ ID NO: 337534 - RNA, 23 nt, Human
cacugcaaccuccgccucccggg

SEQ ID NO: 337535 - RNA, 21 nt, Human
cacugggauuacaggcguaca

SEQ ID NO: 337536 - RNA, 23 nt, Human
cacuguaugagacacaacagaau

SEQ ID NO: 337537 - RNA, 23 nt, Human
cagacacagagggaaaaacaaaa

SEQ ID NO: 337538 - RNA, 21 nt, Human
cagaguccaugucagaagacu

SEQ ID NO: 337539 - RNA, 18 nt, Human
cagauaggaggccccacc

SEQ ID NO: 337540 - RNA, 22 nt, Human
cagauaggaggccccaccucuc

SEQ ID NO: 337541 - RNA, 24 nt, Human
cagaugggguuucaccauguuggu

SEQ ID NO: 337542 - RNA, 24 nt, Human
cagcugacaacaugcucaccuccu

SEQ ID NO: 337543 - RNA, 21 nt, Human
caggagcuauagaaucccaca

SEQ ID NO: 337544 - RNA, 18 nt, Human
caggcugaguucuccucc

SEQ ID NO: 337545 - RNA, 21 nt, Human
ccaaaaccccuggaccgcuga

SEQ ID NO: 337546 - RNA, 22 nt, Human
ccaagucacugggauuacaggc

SEQ ID NO: 337547 - RNA, 24 nt, Human
ccaagucacugggauuacaggcgu

SEQ ID NO: 337548 - RNA, 20 nt, Human
ccaggcucugucugccgcug

SEQ ID NO: 337549 - RNA, 20 nt, Human
ccauugugaguauggcccgu

SEQ ID NO: 337550 - RNA, 21 nt, Human
cccaaagacgcuuccccucau

SEQ ID NO: 337551 - RNA, 18 nt, Human
cccacacaagaguagaag

SEQ ID NO: 337552 - RNA, 19 nt, Human
cccacaggucugcagacuc

SEQ ID NO: 337553 - RNA, 18 nt, Human
cccccuagaacaaaaggc

SEQ ID NO: 337554 - RNA, 21 nt, Human
cccccuagaacaaaaggcagu

SEQ ID NO: 337555 - RNA, 22 nt, Human
cccccuagcaaacuugcucuga

SEQ ID NO: 337556 - RNA, 20 nt, Human
cccggguucaagcgauucuc

SEQ ID NO: 337557 - RNA, 23 nt, Human
cccggguucaagcgauucuccug

SEQ ID NO: 337558 - RNA, 18 nt, Human
cccuggaccgcugagucu

SEQ ID NO: 337559 - RNA, 24 nt, Human
ccgccucccggguucaagcgauuc

SEQ ID NO: 337560 - RNA, 18 nt, Human
ccgcugcccuccaccccc

SEQ ID NO: 337561 - RNA, 24 nt, Human
ccgcugcccuccacccccuagaac

SEQ ID NO: 337562 - RNA, 24 nt, Human
ccucccggguucaagcgauucucc

SEQ ID NO: 337563 - RNA, 21 nt, Human
ccuccuagagcugaugaagau

SEQ ID NO: 337564 - RNA, 24 nt, Human
ccugaaugcaccauguuccccuug

SEQ ID NO: 337565 - RNA, 20 nt, Human
ccuucauuuccuccauccca

SEQ ID NO: 337566 - RNA, 22 nt, Human
ccuuuuuuuuugagauggaguc

SEQ ID NO: 337567 - RNA, 23 nt, Human
cgagcagacacagagggaaaaac

SEQ ID NO: 337568 - RNA, 22 nt, Human
cuaaaaaacugguaaaaagaaa

SEQ ID NO: 337569 - RNA, 24 nt, Human
cucacugcaaccuccgccucccgg

SEQ ID NO: 337570 - RNA, 20 nt, Human
cucaggcugaguucuccucc

SEQ ID NO: 337571 - RNA, 26 nt, Human
cucaggcugaguucuccuccccacuc

SEQ ID NO: 337572 - RNA, 19 nt, Human
cucccacuaaucccaaaga

SEQ ID NO: 337573 - RNA, 25 nt, Human
cucccgguccuugacaacgaccacu

SEQ ID NO: 337574 - RNA, 23 nt, Human
cuccugccucagccucccaaguc

SEQ ID NO: 337575 - RNA, 21 nt, Human
cucugucugccgcugcccucc

SEQ ID NO: 337576 - RNA, 24 nt, Human
cugaagcaugcucuggguugguga

SEQ ID NO: 337577 - RNA, 24 nt, Human
cugacaacaugcucaccuccuaga

SEQ ID NO: 337578 - RNA, 18 nt, Human
cugaguucuccuccccac

SEQ ID NO: 337579 - RNA, 24 nt, Human
cugcaaccuccgccucccggguuc

SEQ ID NO: 337580 - RNA, 23 nt, Human
cugucuaaaaggucuucagcuac

SEQ ID NO: 337581 - RNA, 20 nt, Human
cuugacugaacucaggcuga

SEQ ID NO: 337582 - RNA, 25 nt, Human
gaaaccaaaaccccuggaccgcuga

SEQ ID NO: 337583 - RNA, 23 nt, Human
gaacaaaaggcagucaugcuccu

SEQ ID NO: 337584 - RNA, 18 nt, Human
gaaggugaugaaaccaaa

SEQ ID NO: 337585 - RNA, 19 nt, Human
gacucuacuaccuaagccc

SEQ ID NO: 337586 - RNA, 18 nt, Human
gagcaaggaaggccuagc

SEQ ID NO: 337587 - RNA, 21 nt, Human
gagggcagcagaaaugcagag

SEQ ID NO: 337588 - RNA, 21 nt, Human
gaguucuccuccccacuccuc

SEQ ID NO: 337589 - RNA, 24 nt, Human
gauuacaggcguacaccaccaugc

SEQ ID NO: 337590 - RNA, 21 nt, Human
gcaggaccagucgucgccucc

SEQ ID NO: 337591 - RNA, 19 nt, Human
gccccgagcagacacagag

SEQ ID NO: 337592 - RNA, 24 nt, Human
gcgauucuccugccucagccuccc

SEQ ID NO: 337593 - RNA, 21 nt, Human
gcuauagaaucccacacaaaa

SEQ ID NO: 337594 - RNA, 18 nt, Human
gcugaguucuccucccca

SEQ ID NO: 337595 - RNA, 19 nt, Human
gcuggaguacaguggcgcg

SEQ ID NO: 337596 - RNA, 20 nt, Human
ggaagaaaaagaauuuggag

SEQ ID NO: 337597 - RNA, 22 nt, Human
ggagauggguuuucagauccca

SEQ ID NO: 337598 - RNA, 24 nt, Human
ggagcacaaaaaacagggacgggg

SEQ ID NO: 337599 - RNA, 18 nt, Human
ggaggagcacaaaaaaca

SEQ ID NO: 337600 - RNA, 20 nt, Human
ggagucucgcuguugcccag

SEQ ID NO: 337601 - RNA, 21 nt, Human
ggagucucgcuguugcccagg

SEQ ID NO: 337602 - RNA, 24 nt, Human
ggauuacaggcguacaccaccaug

SEQ ID NO: 337603 - RNA, 19 nt, Human
gggaacagcaagaggggga

SEQ ID NO: 337604 - RNA, 22 nt, Human
gggguuucaccauguuggucag

SEQ ID NO: 337605 - RNA, 23 nt, Human
gggguuucaccauguuggucagg

SEQ ID NO: 337606 - RNA, 22 nt, Human
ggguuucaccauguuggucagg

SEQ ID NO: 337607 - RNA, 21 nt, Human
ggguuuucagaucccaccccc

SEQ ID NO: 337608 - RNA, 23 nt, Human
gucucgcuguugcccaggcugga

SEQ ID NO: 337609 - RNA, 19 nt, Human
guggaccagucaguacccc

SEQ ID NO: 337610 - RNA, 24 nt, Human
uaaaaugucccuggauacacauua

SEQ ID NO: 337611 - RNA, 23 nt, Human
uaaccacaauaaacacuguguac

SEQ ID NO: 337612 - RNA, 22 nt, Human
uaccuaagcccaaggcagguca

SEQ ID NO: 337613 - RNA, 23 nt, Human
uacucagguucuacaaacguccc

SEQ ID NO: 337614 - RNA, 24 nt, Human
uaggaagaaaaagaauuuggaggc

SEQ ID NO: 337615 - RNA, 22 nt, Human
uaggcuuaggaagaaaaagaau

SEQ ID NO: 337616 - RNA, 24 nt, Human
uaguacagaugggguuucaccaug

SEQ ID NO: 337617 - RNA, 21 nt, Human
uaucugggaacagcaagaggg

SEQ ID NO: 337618 - RNA, 20 nt, Human
uauuuuuucuuccaguauua

SEQ ID NO: 337619 - RNA, 23 nt, Human
ucacugcaaccuccgccucccgg

SEQ ID NO: 337620 - RNA, 24 nt, Human
ucacugcaaccuccgccucccggg

SEQ ID NO: 337621 - RNA, 25 nt, Human
ucacugcaaccuccgccucccgggu

SEQ ID NO: 337622 - RNA, 27 nt, Human
ucacugcaaccuccgccucccggguuc

SEQ ID NO: 337623 - RNA, 18 nt, Human
ucaggcugaguucuccuc

SEQ ID NO: 337624 - RNA, 18 nt, Human
ucagggcuagacagacac

SEQ ID NO: 337625 - RNA, 21 nt, Human
ucagugcagcuccaaaaaccu

SEQ ID NO: 337626 - RNA, 21 nt, Human
ucauccuuagucuacaccaua

SEQ ID NO: 337627 - RNA, 22 nt, Human
uccacagguggcuucucggccu

SEQ ID NO: 337628 - RNA, 23 nt, Human
uccaguauuaaaaaaaaaaagac

SEQ ID NO: 337629 - RNA, 18 nt, Human
uccagugccugcucgucg

SEQ ID NO: 337630 - RNA, 23 nt, Human
ucccaaagacgcuuccccucauc

SEQ ID NO: 337631 - RNA, 24 nt, Human
ucccaagucacugggauuacaggc

SEQ ID NO: 337632 - RNA, 24 nt, Human
ucccacgaagagcuuuccuucuuc

SEQ ID NO: 337633 - RNA, 18 nt, Human
ucccaggcggccaggcuc

SEQ ID NO: 337634 - RNA, 21 nt, Human
ucccggguucaagcgauucuc

SEQ ID NO: 337635 - RNA, 24 nt, Human
ucccggguucaagcgauucuccug

SEQ ID NO: 337636 - RNA, 18 nt, Human
uccgggccaggcccacag

SEQ ID NO: 337637 - RNA, 21 nt, Human
ucuacuaccuaagcccaaggc

SEQ ID NO: 337638 - RNA, 21 nt, Human
ucuccuccccacuccucuaag

SEQ ID NO: 337639 - RNA, 25 nt, Human
ucuccugccucagccucccaaguca

SEQ ID NO: 337640 - RNA, 20 nt, Human
ucucgcuguugcccaggcug

SEQ ID NO: 337641 - RNA, 21 nt, Human
ucucgcuguugcccaggcugg

SEQ ID NO: 337642 - RNA, 21 nt, Human
ucucgcuguugcccaggcugg

SEQ ID NO: 337643 - RNA, 22 nt, Human
ucucgcuguugcccaggcugga

SEQ ID NO: 337644 - RNA, 24 nt, Human
ucucgcuguugcccaggcuggagu

SEQ ID NO: 337645 - RNA, 22 nt, Human
ucucucaccaacccccauugug

SEQ ID NO: 337646 - RNA, 19 nt, Human
ucugccgcugcccuccacc

SEQ ID NO: 337647 - RNA, 21 nt, Human
ucuuauagguacauugggaaa

SEQ ID NO: 337648 - RNA, 21 nt, Human
ucuugacugaacucaggcuga

SEQ ID NO: 337649 - RNA, 20 nt, Human
ugagagcaaggaaggccuag

SEQ ID NO: 337650 - RNA, 22 nt, Human
ugagcccucccacgaagagcuu

SEQ ID NO: 337651 - RNA, 23 nt, Human
ugagcccucccacgaagagcuuu

SEQ ID NO: 337652 - RNA, 24 nt, Human
ugagcccucccacgaagagcuuuc

SEQ ID NO: 337653 - RNA, 19 nt, Human
ugagugggcacugcggggc

SEQ ID NO: 337654 - RNA, 21 nt, Human
ugaguucuccuccccacuccu

SEQ ID NO: 337655 - RNA, 18 nt, Human
ugauaugcaccugagagc

SEQ ID NO: 337656 - RNA, 21 nt, Human
ugcccaggcuggaguacagug

SEQ ID NO: 337657 - RNA, 21 nt, Human
ugcccaggcuggaguacagug

SEQ ID NO: 337658 - RNA, 24 nt, Human
ugcccaggcuggaguacaguggcg

SEQ ID NO: 337659 - RNA, 19 nt, Human
ugccucagccucccaaguc

SEQ ID NO: 337660 - RNA, 24 nt, Human
ugccucagccucccaagucacugg

SEQ ID NO: 337661 - RNA, 21 nt, Human
uggacaacagggacacaccuu

SEQ ID NO: 337662 - RNA, 19 nt, Human
uggaguacaguggcgcgau

SEQ ID NO: 337663 - RNA, 20 nt, Human
uggccggaaaaggagauggc

SEQ ID NO: 337664 - RNA, 24 nt, Human
uggcgcgaucuuagcucacugcaa

SEQ ID NO: 337665 - RNA, 20 nt, Human
uggcugggugagguaugagg

SEQ ID NO: 337666 - RNA, 21 nt, Human
uggcugggugagguaugaggg

SEQ ID NO: 337667 - RNA, 22 nt, Human
uggcugggugagguaugagggc

SEQ ID NO: 337668 - RNA, 21 nt, Human
ugggauuacaggcguacacca

SEQ ID NO: 337669 - RNA, 22 nt, Human
ugggauuacaggcguacaccac

SEQ ID NO: 337670 - RNA, 24 nt, Human
ugggauuacaggcguacaccacca

SEQ ID NO: 337671 - RNA, 25 nt, Human
ugggauuacaggcguacaccaccau

SEQ ID NO: 337672 - RNA, 24 nt, Human
ugggguuucaccauguuggucagg

SEQ ID NO: 337673 - RNA, 18 nt, Human
uggucaggcuggcuugau

SEQ ID NO: 337674 - RNA, 24 nt, Human
uguuuaguacagaugggguuucac

SEQ ID NO: 337675 - RNA, 19 nt, Human
uuaaaaaaaaagauggaac

SEQ ID NO: 337676 - RNA, 18 nt, Human
uuaguacagaugggguuu

SEQ ID NO: 337677 - RNA, 22 nt, Human
uuaguacagaugggguuucacc

SEQ ID NO: 337678 - RNA, 24 nt, Human
uuaguacagaugggguuucaccau

SEQ ID NO: 337679 - RNA, 21 nt, Human
uucaagcgauucuccugccuc

SEQ ID NO: 337680 - RNA, 23 nt, Human
uucaagcgauucuccugccucag

SEQ ID NO: 337681 - RNA, 24 nt, Human
uucaagcgauucuccugccucagc

SEQ ID NO: 337682 - RNA, 25 nt, Human
uugagcccucccacgaagagcuuuc

SEQ ID NO: 337683 - RNA, 28 nt, Human
uugagcccucccacgaagagcuuuccuu

SEQ ID NO: 337684 - RNA, 24 nt, Human
uugcccaggcuggaguacaguggc

SEQ ID NO: 337685 - RNA, 21 nt, Human
uuucaccauguuggucaggcu

SEQ ID NO: 337686 - RNA, 22 nt, Human
uuugaagucagucuggccaaac

SEQ ID NO: 337687 - RNA, 22 nt, Human
uuuuuugaagucagucuggcca

SEQ ID NO: 337688 - RNA, 25 nt, Human
aaaagaaaaggagagacaaacaaaa

SEQ ID NO: 337689 - RNA, 24 nt, Human
aaaaggagagacaaacaaaacaag

SEQ ID NO: 337690 - RNA, 24 nt, Human
aacaaguaaauccuuuuucuacca

SEQ ID NO: 337691 - RNA, 20 nt, Human
aagaacaguaacaaaagaaa

SEQ ID NO: 337692 - RNA, 18 nt, Human
acaguaacaaaagaaaag

SEQ ID NO: 337693 - RNA, 25 nt, Human
agacaaacaaaacaagagggagguu

SEQ ID NO: 337694 - RNA, 28 nt, Human
agcaagaacaguaacaaaagaaaaggaa

SEQ ID NO: 337695 - RNA, 26 nt, Human
agcagcaagaacaguaacaaaagaaa

SEQ ID NO: 337696 - RNA, 25 nt, Human
aguaaauccuuuuucuaccaaauuc

SEQ ID NO: 337697 - RNA, 19 nt, Human
cagcaagaacaguaacaaa

SEQ ID NO: 337698 - RNA, 23 nt, Human
caguaacaaaagaaaaggagaga

SEQ ID NO: 337699 - RNA, 23 nt, Human
cccaacaaguaaauccuuuuucu

SEQ ID NO: 337700 - RNA, 24 nt, Human
ccccaacaaguaaauccuuuuucu

SEQ ID NO: 337701 - RNA, 22 nt, Human
ccuccgccaccgacccagcgcc

SEQ ID NO: 337702 - RNA, 18 nt, Human
cuccacggcccgcuccuc

SEQ ID NO: 337703 - RNA, 21 nt, Human
cuccucagccuccgccaccga

SEQ ID NO: 337704 - RNA, 19 nt, Human
ggagagacaaacaaaacaa

SEQ ID NO: 337705 - RNA, 22 nt, Human
uaccuaggcggcgaagccucca

SEQ ID NO: 337706 - RNA, 23 nt, Human
uagcagcaagaacaguaacaaaa

SEQ ID NO: 337707 - RNA, 21 nt, Human
ucccauggaacuugucuccuu

SEQ ID NO: 337708 - RNA, 23 nt, Human
uuuuuuuuuuuuuuuuucacauu

SEQ ID NO: 337709 - RNA, 24 nt, Human
uuuuuuuuuuuuuuuuucacauug

SEQ ID NO: 337710 - RNA, 19 nt, Human
aaaaaagaaauacauagag

SEQ ID NO: 337711 - RNA, 21 nt, Human
aaaacgguuugcaacauucuc

SEQ ID NO: 337712 - RNA, 19 nt, Human
aaaauaacagacauaccag

SEQ ID NO: 337713 - RNA, 19 nt, Human
aaaauaacagacauaccag

SEQ ID NO: 337714 - RNA, 24 nt, Human
aaaauaacagacauaccaggaaaa

SEQ ID NO: 337715 - RNA, 19 nt, Human
aacacagcaagaccccauc

SEQ ID NO: 337716 - RNA, 20 nt, Human
aacacagcaagaccccaucu

SEQ ID NO: 337717 - RNA, 21 nt, Human
aacacagcaagaccccaucuc

SEQ ID NO: 337718 - RNA, 20 nt, Human
aacacagcaagacucuaucu

SEQ ID NO: 337719 - RNA, 21 nt, Human
aacacagcaagacucuaucuc

SEQ ID NO: 337720 - RNA, 19 nt, Human
aacacagcaaguuccaccc

SEQ ID NO: 337721 - RNA, 20 nt, Human
aacaucuaucugauccuaac

SEQ ID NO: 337722 - RNA, 21 nt, Human
aacauuaaauguagaaaacaa

SEQ ID NO: 337723 - RNA, 21 nt, Human
aaccauggugagauucuaacc

SEQ ID NO: 337724 - RNA, 21 nt, Human
aagaaaaaaaagaaauacaua

SEQ ID NO: 337725 - RNA, 22 nt, Human
aagaagggcaggagaaacaaaa

SEQ ID NO: 337726 - RNA, 24 nt, Human
aaguaucuucacaaugauccauac

SEQ ID NO: 337727 - RNA, 19 nt, Human
aauccacccuggguaacac

SEQ ID NO: 337728 - RNA, 26 nt, Human
acaaaauaacagacauaccaggaaaa

SEQ ID NO: 337729 - RNA, 24 nt, Human
acacagcaagacucuaucucaaaa

SEQ ID NO: 337730 - RNA, 21 nt, Human
acaucaagaagggcaggagaa

SEQ ID NO: 337731 - RNA, 20 nt, Human
accaugcuaacugaaguccc

SEQ ID NO: 337732 - RNA, 19 nt, Human
acccuauacucagaucaga

SEQ ID NO: 337733 - RNA, 24 nt, Human
acccuauacucagaucagaagcug

SEQ ID NO: 337734 - RNA, 23 nt, Human
acugaagucccucccaaccggag

SEQ ID NO: 337735 - RNA, 23 nt, Human
agaaaaaaaagaaauacauagag

SEQ ID NO: 337736 - RNA, 24 nt, Human
agaaauaucaucccuuauaaagcc

SEQ ID NO: 337737 - RNA, 23 nt, Human
agaagggucugggagaaugcucc

SEQ ID NO: 337738 - RNA, 24 nt, Human
agacaaggaaggggagccauggug

SEQ ID NO: 337739 - RNA, 20 nt, Human
agacagcuggaaguacaaaa

SEQ ID NO: 337740 - RNA, 24 nt, Human
agagaacaccuggacaacagagga

SEQ ID NO: 337741 - RNA, 19 nt, Human
agcaccugaugcuagagau

SEQ ID NO: 337742 - RNA, 23 nt, Human
agcugggcaugguggcaugugcc

SEQ ID NO: 337743 - RNA, 20 nt, Human
aggaugaauugggaggagac

SEQ ID NO: 337744 - RNA, 18 nt, Human
aggcagaaggauggcuug

SEQ ID NO: 337745 - RNA, 24 nt, Human
aggcagaaggauggcuugagccca

SEQ ID NO: 337746 - RNA, 27 nt, Human
aggcagaaggauggcuugagcccaaga

SEQ ID NO: 337747 - RNA, 21 nt, Human
agguugggaaggggaaaacgg

SEQ ID NO: 337748 - RNA, 21 nt, Human
aguauuauuuauucuugaaca

SEQ ID NO: 337749 - RNA, 20 nt, Human
agugagcuaugaucagcugc

SEQ ID NO: 337750 - RNA, 20 nt, Human
agugaggugguagaaauauc

SEQ ID NO: 337751 - RNA, 26 nt, Human
aucucacuucuacuccugcucuccua

SEQ ID NO: 337752 - RNA, 21 nt, Human
auucuccuccuuguaggaggc

SEQ ID NO: 337753 - RNA, 25 nt, Human
caaaaaaaagaaaaaaaagaaauac

SEQ ID NO: 337754 - RNA, 18 nt, Human
caaaggcagcuucaaggc

SEQ ID NO: 337755 - RNA, 18 nt, Human
caacuccacuccagcugu

SEQ ID NO: 337756 - RNA, 27 nt, Human
caagaccccaucucuacaaaaauauua

SEQ ID NO: 337757 - RNA, 23 nt, Human
caagacucuaucucaaaaaaaag

SEQ ID NO: 337758 - RNA, 26 nt, Human
caagagaccaccuauaaccucuucac

SEQ ID NO: 337759 - RNA, 20 nt, Human
caaguuccaccccaguccua

SEQ ID NO: 337760 - RNA, 23 nt, Human
cacagcaaguuccaccccagucc

SEQ ID NO: 337761 - RNA, 21 nt, Human
cagaauaguaagucuuuagug

SEQ ID NO: 337762 - RNA, 24 nt, Human
cagcugcaauccacccuggguaac

SEQ ID NO: 337763 - RNA, 24 nt, Human
caggaaaaucauuucagcuaaaaa

SEQ ID NO: 337764 - RNA, 26 nt, Human
caggagaaacaaaaggcauuucuaua

SEQ ID NO: 337765 - RNA, 18 nt, Human
caggccccagacaaggaa

SEQ ID NO: 337766 - RNA, 19 nt, Human
caggccccagacaaggaag

SEQ ID NO: 337767 - RNA, 22 nt, Human
caggccccagacaaggaagggg

SEQ ID NO: 337768 - RNA, 23 nt, Human
caucaagaagggcaggagaaaca

SEQ ID NO: 337769 - RNA, 20 nt, Human
cauccuuuuccucuugggcc

SEQ ID NO: 337770 - RNA, 18 nt, Human
ccaaaggcagcuucaagg

SEQ ID NO: 337771 - RNA, 18 nt, Human
ccacuccagcuguuccug

SEQ ID NO: 337772 - RNA, 23 nt, Human
ccacugacugccauggccaucug

SEQ ID NO: 337773 - RNA, 19 nt, Human
ccaggccuuaauccuuaac

SEQ ID NO: 337774 - RNA, 23 nt, Human
ccauggugagauucuaaccaugu

SEQ ID NO: 337775 - RNA, 20 nt, Human
cccaaaaaagaaauacugac

SEQ ID NO: 337776 - RNA, 20 nt, Human
cccaagaguuugaagcugca

SEQ ID NO: 337777 - RNA, 19 nt, Human
cccaggccuuaauccuuaa

SEQ ID NO: 337778 - RNA, 20 nt, Human
cccaggccuuaauccuuaac

SEQ ID NO: 337779 - RNA, 18 nt, Human
cccagguugggaagggga

SEQ ID NO: 337780 - RNA, 24 nt, Human
ccccaaaaaagaaauacugaccag

SEQ ID NO: 337781 - RNA, 28 nt, Human
ccccaccaugcuaacugaagucccuccc

SEQ ID NO: 337782 - RNA, 21 nt, Human
ccccaguccuauuuguccaag

SEQ ID NO: 337783 - RNA, 18 nt, Human
ccuauacucagaucagaa

SEQ ID NO: 337784 - RNA, 24 nt, Human
ccucugcuggacaccuuauuaccu

SEQ ID NO: 337785 - RNA, 18 nt, Human
ccucuugggccuccucaa

SEQ ID NO: 337786 - RNA, 20 nt, Human
ccuggguaacacagcaagac

SEQ ID NO: 337787 - RNA, 22 nt, Human
ccuggguaacacagcaagacuc

SEQ ID NO: 337788 - RNA, 18 nt, Human
ccuguaaucccaacuacu

SEQ ID NO: 337789 - RNA, 22 nt, Human
ccuguaaucccaacuacuaggg

SEQ ID NO: 337790 - RNA, 25 nt, Human
ccuucugcugccucuuucugcugcc

SEQ ID NO: 337791 - RNA, 20 nt, Human
ccuuuuccucuugggccucc

SEQ ID NO: 337792 - RNA, 23 nt, Human
cgcaauguuagaauaguacuuga

SEQ ID NO: 337793 - RNA, 23 nt, Human
cuagcaucauuuauuuaucuacc

SEQ ID NO: 337794 - RNA, 27 nt, Human
cuagcccagguaacacagcaagacccc

SEQ ID NO: 337795 - RNA, 18 nt, Human
cucaaugcuccuuuggau

SEQ ID NO: 337796 - RNA, 22 nt, Human
cucccagccugagccacauccu

SEQ ID NO: 337797 - RNA, 18 nt, Human
cucuccucuauggggccu

SEQ ID NO: 337798 - RNA, 18 nt, Human
cugaauuacaguauauuu

SEQ ID NO: 337799 - RNA, 22 nt, Human
cugcaauccacccuggguaaca

SEQ ID NO: 337800 - RNA, 24 nt, Human
cuggaaguacaaaaaacugugaca

SEQ ID NO: 337801 - RNA, 27 nt, Human
cuuaacccuagaccuguugccucuagc

SEQ ID NO: 337802 - RNA, 18 nt, Human
cuuaauccuuaacccuag

SEQ ID NO: 337803 - RNA, 18 nt, Human
cuuguaggaggcgagcuc

SEQ ID NO: 337804 - RNA, 22 nt, Human
cuuucugcugccacugacugcc

SEQ ID NO: 337805 - RNA, 21 nt, Human
gaacaccuggacaacagagga

SEQ ID NO: 337806 - RNA, 26 nt, Human
gaagucccucccagccugagccacau

SEQ ID NO: 337807 - RNA, 19 nt, Human
gaauugggaggagacagua

SEQ ID NO: 337808 - RNA, 24 nt, Human
gagaacaccuggacaacagaggac

SEQ ID NO: 337809 - RNA, 24 nt, Human
gauggcuugagcccaagaguuuga

SEQ ID NO: 337810 - RNA, 22 nt, Human
gccauggccaucugcuauagcc

SEQ ID NO: 337811 - RNA, 25 nt, Human
gcccugcuuaucuugcugaccuuca

SEQ ID NO: 337812 - RNA, 23 nt, Human
gcuaugaucagcugcaauccacc

SEQ ID NO: 337813 - RNA, 24 nt, Human
ggcagcuucaaggcucaauggcaa

SEQ ID NO: 337814 - RNA, 23 nt, Human
ggcaugguggcaugugccuguaa

SEQ ID NO: 337815 - RNA, 20 nt, Human
gggacagugaggcagaagga

SEQ ID NO: 337816 - RNA, 23 nt, Human
guaggaacagaauaguaagucuu

SEQ ID NO: 337817 - RNA, 24 nt, Human
guccucaguguguccaggccccag

SEQ ID NO: 337818 - RNA, 22 nt, Human
uaaacccuaccugaaacuugag

SEQ ID NO: 337819 - RNA, 18 nt, Human
uaacugaagucccuccca

SEQ ID NO: 337820 - RNA, 21 nt, Human
uaccaggaaaaucauuucagc

SEQ ID NO: 337821 - RNA, 22 nt, Human
uagaauaguacuugagaaagca

SEQ ID NO: 337822 - RNA, 20 nt, Human
uagcccagguaacacagcaa

SEQ ID NO: 337823 - RNA, 24 nt, Human
uagcuaugccccuccaucaauuca

SEQ ID NO: 337824 - RNA, 22 nt, Human
uagcugggcaugguggcaugug

SEQ ID NO: 337825 - RNA, 19 nt, Human
uaggaggcgagcucugucu

SEQ ID NO: 337826 - RNA, 21 nt, Human
uagggaggcaaucaguauuau

SEQ ID NO: 337827 - RNA, 19 nt, Human
uauaacaucuaucugaucc

SEQ ID NO: 337828 - RNA, 22 nt, Human
ucaaugcuccuuuggauccucu

SEQ ID NO: 337829 - RNA, 19 nt, Human
ucaauucacccuauacucg

SEQ ID NO: 337830 - RNA, 21 nt, Human
ucaccuucugcugccucuuuc

SEQ ID NO: 337831 - RNA, 20 nt, Human
ucagaagcugagugucugaa

SEQ ID NO: 337832 - RNA, 18 nt, Human
ucaguauuauuuauucuu

SEQ ID NO: 337833 - RNA, 21 nt, Human
uccaacuucuuuaacauggca

SEQ ID NO: 337834 - RNA, 19 nt, Human
uccacaaaauaacagacau

SEQ ID NO: 337835 - RNA, 22 nt, Human
uccacaaaauaacagacauacc

SEQ ID NO: 337836 - RNA, 25 nt, Human
uccacacgguccacugagcuggccc

SEQ ID NO: 337837 - RNA, 24 nt, Human
ucccuagaaguaucuucacaauga

SEQ ID NO: 337838 - RNA, 25 nt, Human
uccucaacuccacuccagcuguucc

SEQ ID NO: 337839 - RNA, 20 nt, Human
uccuguuccacacgguccac

SEQ ID NO: 337840 - RNA, 26 nt, Human
ucuauaacaucuaucugauccuaaca

SEQ ID NO: 337841 - RNA, 23 nt, Human
ucuaucucaaaaaaaagaaaaaa

SEQ ID NO: 337842 - RNA, 23 nt, Human
ucucccccaccaugcuaacugaa

SEQ ID NO: 337843 - RNA, 23 nt, Human
ugaagcugcagugagcuaugauc

SEQ ID NO: 337844 - RNA, 18 nt, Human
ugagaaagcaggauuguu

SEQ ID NO: 337845 - RNA, 20 nt, Human
ugagaaagcaggauuguuuu

SEQ ID NO: 337846 - RNA, 19 nt, Human
ugagcccaagaguuugaag

SEQ ID NO: 337847 - RNA, 25 nt, Human
ugaggcagaaggauggcuugagccc

SEQ ID NO: 337848 - RNA, 22 nt, Human
ugcaauccacccuggguaacac

SEQ ID NO: 337849 - RNA, 21 nt, Human
ugccauaagaucuuaacaucu

SEQ ID NO: 337850 - RNA, 23 nt, Human
ugccauaagaucuuaacaucuca

SEQ ID NO: 337851 - RNA, 23 nt, Human
ugccuguaaucccaacuacuagg

SEQ ID NO: 337852 - RNA, 20 nt, Human
ugcugaccuucauccucugc

SEQ ID NO: 337853 - RNA, 25 nt, Human
ugcuuuagaacuuucaauuuuagga

SEQ ID NO: 337854 - RNA, 20 nt, Human
uggaaucuugaagagaacac

SEQ ID NO: 337855 - RNA, 22 nt, Human
uggaugaacuguuucucagcaa

SEQ ID NO: 337856 - RNA, 19 nt, Human
uggcaccauggaugaacug

SEQ ID NO: 337857 - RNA, 21 nt, Human
uggcaugugccuguaauccca

SEQ ID NO: 337858 - RNA, 23 nt, Human
ugggagaaugcuccaagaggaga

SEQ ID NO: 337859 - RNA, 24 nt, Human
ugguggcaugugccuguaauccca

SEQ ID NO: 337860 - RNA, 23 nt, Human
ugguucucccccaccaugcuaac

SEQ ID NO: 337861 - RNA, 18 nt, Human
uuagcuggacaaggacua

SEQ ID NO: 337862 - RNA, 19 nt, Human
uuagcugggcaugguggca

SEQ ID NO: 337863 - RNA, 24 nt, Human
uuagcugggcaugguggcaugugc

SEQ ID NO: 337864 - RNA, 20 nt, Human
uuccacacgguccacugagc

SEQ ID NO: 337865 - RNA, 19 nt, Human
uucccaggccuuaauccuu

SEQ ID NO: 337866 - RNA, 22 nt, Human
uucugcugccucuuucugcugc

SEQ ID NO: 337867 - RNA, 19 nt, Human
uuggaaaauguuaaauuuu

SEQ ID NO: 337868 - RNA, 21 nt, Human
uuggcugccgaagagggcacc

SEQ ID NO: 337869 - RNA, 24 nt, Human
uuguugaaucccuucaauuauaaa

SEQ ID NO: 337870 - RNA, 24 nt, Human
uuuuccucuugggccuccucaaug

SEQ ID NO: 337871 - RNA, 18 nt, Human
aaaagagcuuagcacagc

SEQ ID NO: 337872 - RNA, 23 nt, Human
aaagagcuuagcacagcccagac

SEQ ID NO: 337873 - RNA, 19 nt, Human
aggcagggaacuggaugac

SEQ ID NO: 337874 - RNA, 19 nt, Human
cuucagagacuccaccacu

SEQ ID NO: 337875 - RNA, 23 nt, Human
ucagagacuccaccacucgcuag

SEQ ID NO: 337876 - RNA, 21 nt, Human
ugaugucaagauggcugaucu

SEQ ID NO: 337877 - RNA, 24 nt, Human
aaaaauuauggaggggaacuuaac

SEQ ID NO: 337878 - RNA, 24 nt, Human
agauaggaaguggccuuuagggga

SEQ ID NO: 337879 - RNA, 26 nt, Human
agccuuuaggaaguuggagauaacuu

SEQ ID NO: 337880 - RNA, 25 nt, Human
agcucagcaccaguggcggcugccg

SEQ ID NO: 337881 - RNA, 24 nt, Human
aggaaaugucagaaaggcaaaaug

SEQ ID NO: 337882 - RNA, 21 nt, Human
agguuuuucguacugagaaca

SEQ ID NO: 337883 - RNA, 22 nt, Human
aucaagcuguuccuuuaaaagu

SEQ ID NO: 337884 - RNA, 19 nt, Human
auggaggggaacuuaacag

SEQ ID NO: 337885 - RNA, 20 nt, Human
auugccugccucauuugcug

SEQ ID NO: 337886 - RNA, 23 nt, Human
auuuucuccuuugcaaucaagcu

SEQ ID NO: 337887 - RNA, 19 nt, Human
caaaauggccagcauuauc

SEQ ID NO: 337888 - RNA, 23 nt, Human
cacccugaaaucuuaugaguagc

SEQ ID NO: 337889 - RNA, 20 nt, Human
cagcucagcaccaguggcgg

SEQ ID NO: 337890 - RNA, 24 nt, Human
ccccaaccacccucuaauagcuag

SEQ ID NO: 337891 - RNA, 21 nt, Human
cgagcucggcgauaggggcuu

SEQ ID NO: 337892 - RNA, 18 nt, Human
cggcugccgggugcgagg

SEQ ID NO: 337893 - RNA, 23 nt, Human
cugggauuuugguccaaaguuuu

SEQ ID NO: 337894 - RNA, 23 nt, Human
gcuuaucuauuuucuccuuugca

SEQ ID NO: 337895 - RNA, 19 nt, Human
ggugagucggaggggugac

SEQ ID NO: 337896 - RNA, 22 nt, Human
uaaaagugagacacuacagagu

SEQ ID NO: 337897 - RNA, 20 nt, Human
uaacagggaauuuaaaaaaa

SEQ ID NO: 337898 - RNA, 26 nt, Human
uaccccaaccacccucuaauagcuag

SEQ ID NO: 337899 - RNA, 22 nt, Human
uacugggugaauagcacuuucc

SEQ ID NO: 337900 - RNA, 24 nt, Human
uacugggugaauagcacuuuccuu

SEQ ID NO: 337901 - RNA, 22 nt, Human
uaggaaguggccuuuaggggau

SEQ ID NO: 337902 - RNA, 19 nt, Human
uaggggcuuccuagcagcu

SEQ ID NO: 337903 - RNA, 22 nt, Human
uagguagaaugauucaucucuc

SEQ ID NO: 337904 - RNA, 20 nt, Human
uauuuaguauucuguaguug

SEQ ID NO: 337905 - RNA, 21 nt, Human
ucagcaccaguggcggcugcc

SEQ ID NO: 337906 - RNA, 21 nt, Human
ucaguuggaagacacccugaa

SEQ ID NO: 337907 - RNA, 23 nt, Human
ucaguuggaagacacccugaaau

SEQ ID NO: 337908 - RNA, 24 nt, Human
ucaguuggaagacacccugaaauc

SEQ ID NO: 337909 - RNA, 27 nt, Human
uccuuugcaaucaagcuguuccuuuuc

SEQ ID NO: 337910 - RNA, 20 nt, Human
ucggaggggugacaaugggu

SEQ ID NO: 337911 - RNA, 19 nt, Human
ucggcgauaggggcuuccu

SEQ ID NO: 337912 - RNA, 22 nt, Human
ugaaaagcaaugcgaaagucaa

SEQ ID NO: 337913 - RNA, 21 nt, Human
ugaaacaguaagagcaagcac

SEQ ID NO: 337914 - RNA, 18 nt, Human
ugaguagcauaccccaac

SEQ ID NO: 337915 - RNA, 20 nt, Human
uggaaaguuacaacacuagu

SEQ ID NO: 337916 - RNA, 24 nt, Human
uggaagaucuuagaauugccugcc

SEQ ID NO: 337917 - RNA, 18 nt, Human
uggaaugcugauagauuc

SEQ ID NO: 337918 - RNA, 23 nt, Human
uggaaugcugauagauucacuuu

SEQ ID NO: 337919 - RNA, 25 nt, Human
uggaaugcugauagauucacuuuuu

SEQ ID NO: 337920 - RNA, 24 nt, Human
uggcuagauguuuuguggaagauc

SEQ ID NO: 337921 - RNA, 20 nt, Human
uggguaguuaugauagaaua

SEQ ID NO: 337922 - RNA, 20 nt, Human
uggguuuacugggugaauag

SEQ ID NO: 337923 - RNA, 19 nt, Human
ugucagaaaggcaaaaugg

SEQ ID NO: 337924 - RNA, 22 nt, Human
ugucagaaaggcaaaauggcca

SEQ ID NO: 337925 - RNA, 26 nt, Human
uguggaaugcugauagauucacuuuu

SEQ ID NO: 337926 - RNA, 24 nt, Human
uuaaacauguuuuacuuuuuuccu

SEQ ID NO: 337927 - RNA, 24 nt, Human
uuccuagcagcucagcaccagugg

SEQ ID NO: 337928 - RNA, 24 nt, Human
uucuguaguuguuuaacacacacu

SEQ ID NO: 337929 - RNA, 22 nt, Human
uugggggaagggaaaggggagg

SEQ ID NO: 337930 - RNA, 19 nt, Human
uuucacaggcauuugaugc

SEQ ID NO: 337931 - RNA, 22 nt, Human
uuugcaaucaagcuguuccuuu

SEQ ID NO: 337932 - RNA, 24 nt, Human
uuuuguggaagaucuuagaauugc

SEQ ID NO: 337933 - RNA, 25 nt, Human
uuuuuuggguuuacugggugaauag

SEQ ID NO: 337934 - RNA, 21 nt, Human
uuuuuuuuuuugggccgguga

SEQ ID NO: 337935 - RNA, 23 nt, Human
accucaaaaaauucauggaggaa

SEQ ID NO: 337936 - RNA, 26 nt, Human
caacaaguaugaaauuacuuugaaaa

SEQ ID NO: 337937 - RNA, 19 nt, Human
cagggccaacugcgggagg

SEQ ID NO: 337938 - RNA, 19 nt, Human
cccucaggccguacguaac

SEQ ID NO: 337939 - RNA, 26 nt, Human
cggaacaccacagggccaacugcggg

SEQ ID NO: 337940 - RNA, 18 nt, Human
cucuccacaaaaccaaca

SEQ ID NO: 337941 - RNA, 19 nt, Human
gacagcuggagcuucccug

SEQ ID NO: 337942 - RNA, 18 nt, Human
uagcaucaacaaguauga

SEQ ID NO: 337943 - RNA, 20 nt, Human
uagcaucaacaaguaugaaa

SEQ ID NO: 337944 - RNA, 21 nt, Human
uaugaaauuacuuugaaaaca

SEQ ID NO: 337945 - RNA, 18 nt, Human
ucaggccguacguaaccg

SEQ ID NO: 337946 - RNA, 21 nt, Human
ucucuccacaaaaccaacaug

SEQ ID NO: 337947 - RNA, 19 nt, Human
uuugauuugcaaacaagga

SEQ ID NO: 337948 - RNA, 18 nt, Human
aaaagugacaaagccaag

SEQ ID NO: 337949 - RNA, 21 nt, Human
aaggaaaagugacaaagccaa

SEQ ID NO: 337950 - RNA, 20 nt, Human
acgcggguggugggcggccc

SEQ ID NO: 337951 - RNA, 22 nt, Human
agggguggcuggacauuuuugc

SEQ ID NO: 337952 - RNA, 18 nt, Human
agugacaaagccaagaga

SEQ ID NO: 337953 - RNA, 19 nt, Human
augagcgcccuccgccccc

SEQ ID NO: 337954 - RNA, 23 nt, Human
cauuuuugccucaugcugugcaa

SEQ ID NO: 337955 - RNA, 25 nt, Human
cggaaaugagcgcccuccgcccccc

SEQ ID NO: 337956 - RNA, 22 nt, Human
cgggacagcggcugccggugcu

SEQ ID NO: 337957 - RNA, 18 nt, Human
cuagggguggcuggacau

SEQ ID NO: 337958 - RNA, 22 nt, Human
cugccgggacagcggcugccgg

SEQ ID NO: 337959 - RNA, 19 nt, Human
gagacugccgggacagcgg

SEQ ID NO: 337960 - RNA, 20 nt, Human
gccgggacagcggcugccgg

SEQ ID NO: 337961 - RNA, 23 nt, Human
gcuaacagaugccuagggguggc

SEQ ID NO: 337962 - RNA, 24 nt, Human
gugacaaagccaagagacagacuu

SEQ ID NO: 337963 - RNA, 19 nt, Human
gugcaaagagggauccugg

SEQ ID NO: 337964 - RNA, 22 nt, Human
uaagaaaaggaaaagugacaaa

SEQ ID NO: 337965 - RNA, 18 nt, Human
ucaugcugugcaaagagg

SEQ ID NO: 337966 - RNA, 20 nt, Human
ucaugcugugcaaagaggga

SEQ ID NO: 337967 - RNA, 19 nt, Human
uccuggcucacacauccug

SEQ ID NO: 337968 - RNA, 24 nt, Human
ugacuggagccaguuuggccacaa

SEQ ID NO: 337969 - RNA, 18 nt, Human
ugcaaagagggauccugg

SEQ ID NO: 337970 - RNA, 19 nt, Human
ugccuagggguggcuggac

SEQ ID NO: 337971 - RNA, 21 nt, Human
uggcuuuguuuuaagaaaagg

SEQ ID NO: 337972 - RNA, 21 nt, Human
aaccagagcucagcaggcccc

SEQ ID NO: 337973 - RNA, 25 nt, Human
auaccaccccaaguucuaccacuua

SEQ ID NO: 337974 - RNA, 19 nt, Human
auauauauauacauauaua

SEQ ID NO: 337975 - RNA, 18 nt, Human
caccccaaguucuaccac

SEQ ID NO: 337976 - RNA, 20 nt, Human
cacuuagaaggaaccuuugu

SEQ ID NO: 337977 - RNA, 21 nt, Human
cagcaggccccuuugcugcuc

SEQ ID NO: 337978 - RNA, 18 nt, Human
cauacacauauauaugug

SEQ ID NO: 337979 - RNA, 24 nt, Human
ccuucucagcugguggacagaagg

SEQ ID NO: 337980 - RNA, 20 nt, Human
cuuggugugugucccagagg

SEQ ID NO: 337981 - RNA, 20 nt, Human
cuuggugugugucccagagg

SEQ ID NO: 337982 - RNA, 21 nt, Human
cuuggugugugucccagaggu

SEQ ID NO: 337983 - RNA, 19 nt, Human
gcagcugccuuccgcccuu

SEQ ID NO: 337984 - RNA, 22 nt, Human
ggccuggcuccugcacaaaagc

SEQ ID NO: 337985 - RNA, 22 nt, Human
guauauacacgugugugugugu

SEQ ID NO: 337986 - RNA, 24 nt, Human
gugcagcugccuuccgcccuuguc

SEQ ID NO: 337987 - RNA, 27 nt, Human
uaaaaauaccaccccaaguucuaccac

SEQ ID NO: 337988 - RNA, 18 nt, Human
uacauacacauauauaug

SEQ ID NO: 337989 - RNA, 20 nt, Human
uacauacacauauauaugug

SEQ ID NO: 337990 - RNA, 25 nt, Human
uauacacguguguguguguauauaa

SEQ ID NO: 337991 - RNA, 22 nt, Human
uauacauacacauauauaugug

SEQ ID NO: 337992 - RNA, 24 nt, Human
uauacauacacauauauaugugua

SEQ ID NO: 337993 - RNA, 19 nt, Human
uauauacacgugugugugu

SEQ ID NO: 337994 - RNA, 24 nt, Human
uauauacauacacauauauaugug

SEQ ID NO: 337995 - RNA, 20 nt, Human
uauauacauauauauacaua

SEQ ID NO: 337996 - RNA, 32 nt, Human
uauauacauauauauacauacacauauauagu

SEQ ID NO: 337997 - RNA, 21 nt, Human
uauauauacacaccuccagcu

SEQ ID NO: 337998 - RNA, 22 nt, Human
uauauauacauacacauauaua

SEQ ID NO: 337999 - RNA, 19 nt, Human
uauauauauacauauauau

SEQ ID NO: 338000 - RNA, 23 nt, Human
uauauauauacauauauauacau

SEQ ID NO: 338001 - RNA, 31 nt, Human
uauauauauacauauauauacauacacauag

SEQ ID NO: 338002 - RNA, 18 nt, Human
uauauauguguauauaca

SEQ ID NO: 338003 - RNA, 28 nt, Human
uauguguauauacacgugugugugugua

SEQ ID NO: 338004 - RNA, 19 nt, Human
ucccagagguucugucugc

SEQ ID NO: 338005 - RNA, 24 nt, Human
ucccagagguucugucugcccugg

SEQ ID NO: 338006 - RNA, 21 nt, Human
ucucagcugguggacagaagg

SEQ ID NO: 338007 - RNA, 18 nt, Human
ucugugcagcugccuucc

SEQ ID NO: 338008 - RNA, 25 nt, Human
ugcccuggggcucugccuauggggc

SEQ ID NO: 338009 - RNA, 25 nt, Human
uggcuccugcacaaaagcucccucc

SEQ ID NO: 338010 - RNA, 19 nt, Human
uguguauauacacgugugu

SEQ ID NO: 338011 - RNA, 19 nt, Human
uguguauauacacgugugu

SEQ ID NO: 338012 - RNA, 22 nt, Human
uguguauauacacgugugugug

SEQ ID NO: 338013 - RNA, 24 nt, Human
uguguauauacacgugugugugug

SEQ ID NO: 338014 - RNA, 19 nt, Human
uuggaauaaugauagcugc

SEQ ID NO: 338015 - RNA, 23 nt, Human
uuggaauaaugauagcugcaucu

SEQ ID NO: 338016 - RNA, 22 nt, Human
uuggugugugucccagagguuc

SEQ ID NO: 338017 - RNA, 21 nt, Human
uuuguuaaaauuuaggugguu

SEQ ID NO: 338018 - RNA, 25 nt, Human
aacuuucaggaaaggcaagcagauu

SEQ ID NO: 338019 - RNA, 22 nt, Human
aagcagauucacugacccccac

SEQ ID NO: 338020 - RNA, 19 nt, Human
agagcugaagacugagagc

SEQ ID NO: 338021 - RNA, 21 nt, Human
agggaagauggggagagaagg

SEQ ID NO: 338022 - RNA, 20 nt, Human
auguguaaugaagguuuuau

SEQ ID NO: 338023 - RNA, 23 nt, Human
cagaaacuuucaggaaaggcaag

SEQ ID NO: 338024 - RNA, 26 nt, Human
ccccagaaacuuucaggaaaggcaag

SEQ ID NO: 338025 - RNA, 19 nt, Human
gaagacugagagcuaauca

SEQ ID NO: 338026 - RNA, 22 nt, Human
gagggaagauggggagagaagg

SEQ ID NO: 338027 - RNA, 19 nt, Human
gcagauucacugaccccca

SEQ ID NO: 338028 - RNA, 22 nt, Human
gcguggagcgagggaggcgagc

SEQ ID NO: 338029 - RNA, 23 nt, Human
uaagccccagaaacuuucaggaa

SEQ ID NO: 338030 - RNA, 24 nt, Human
ucagaaguucucagaugaaacuag

SEQ ID NO: 338031 - RNA, 19 nt, Human
ucuuaagccccagaaacuu

SEQ ID NO: 338032 - RNA, 24 nt, Human
ugagggaagauggggagagaaggg

SEQ ID NO: 338033 - RNA, 19 nt, Human
uucaggaaaggcaagcaga

SEQ ID NO: 338034 - RNA, 19 nt, Human
aacaagagcgucugugagc

SEQ ID NO: 338035 - RNA, 22 nt, Human
aaggaaaagaagaggucaaaug

SEQ ID NO: 338036 - RNA, 21 nt, Human
agaagaggucaaauggacagg

SEQ ID NO: 338037 - RNA, 22 nt, Human
agacagggugaggaaggagggg

SEQ ID NO: 338038 - RNA, 19 nt, Human
agaggucaaauggacagga

SEQ ID NO: 338039 - RNA, 27 nt, Human
agaggucaaauggacaggagagagcgg

SEQ ID NO: 338040 - RNA, 20 nt, Human
agucacaguuuuccagaagu

SEQ ID NO: 338041 - RNA, 19 nt, Human
aguuacagauuaacacggg

SEQ ID NO: 338042 - RNA, 22 nt, Human
caggagaaugcaggagacaggg

SEQ ID NO: 338043 - RNA, 22 nt, Human
caggggcuccuucccuuugccu

SEQ ID NO: 338044 - RNA, 23 nt, Human
cagucacaguuuuccagaagucc

SEQ ID NO: 338045 - RNA, 22 nt, Human
caguuuuccagaaguccaucag

SEQ ID NO: 338046 - RNA, 23 nt, Human
ccaguagccccuguuuaaacucu

SEQ ID NO: 338047 - RNA, 20 nt, Human
ccuugaccuggaagugaggu

SEQ ID NO: 338048 - RNA, 21 nt, Human
cugggcuugaagggggcacaa

SEQ ID NO: 338049 - RNA, 22 nt, Human
cuggugcugucuggagggaucu

SEQ ID NO: 338050 - RNA, 24 nt, Human
cuguuuaaacucuugaaccccagu

SEQ ID NO: 338051 - RNA, 19 nt, Human
gagcgucugugagcuggug

SEQ ID NO: 338052 - RNA, 21 nt, Human
gcaguggagugugagaaagga

SEQ ID NO: 338053 - RNA, 24 nt, Human
gccaaaugcccaaagcuuaguucu

SEQ ID NO: 338054 - RNA, 19 nt, Human
ggagacagggugaggaagg

SEQ ID NO: 338055 - RNA, 21 nt, Human
ggagacagggugaggaaggag

SEQ ID NO: 338056 - RNA, 20 nt, Human
ggcacaacaagagcgucugu

SEQ ID NO: 338057 - RNA, 22 nt, Human
ggcaguggagugugagaaagga

SEQ ID NO: 338058 - RNA, 19 nt, Human
gggaggaaagguggccaga

SEQ ID NO: 338059 - RNA, 22 nt, Human
gggugaggaaggaggggguguu

SEQ ID NO: 338060 - RNA, 23 nt, Human
gggugaggagggacccagaggga

SEQ ID NO: 338061 - RNA, 22 nt, Human
ggugaggagggacccagaggga

SEQ ID NO: 338062 - RNA, 25 nt, Human
gguuucaggagaaugcaggagacag

SEQ ID NO: 338063 - RNA, 19 nt, Human
gucacaguuuuccagaagu

SEQ ID NO: 338064 - RNA, 23 nt, Human
uaaacucuugaaccccagucaca

SEQ ID NO: 338065 - RNA, 26 nt, Human
uaaucgccaaaugcccaaagcuuagu

SEQ ID NO: 338066 - RNA, 19 nt, Human
uacagauuaacacggggag

SEQ ID NO: 338067 - RNA, 24 nt, Human
uauugggcaguggagugugagaaa

SEQ ID NO: 338068 - RNA, 21 nt, Human
ucaaauggacaggagagagcg

SEQ ID NO: 338069 - RNA, 19 nt, Human
ucacuauugggcaguggag

SEQ ID NO: 338070 - RNA, 19 nt, Human
ucucaggggcuccuucccu

SEQ ID NO: 338071 - RNA, 21 nt, Human
ugaagguuucaggagaaugca

SEQ ID NO: 338072 - RNA, 19 nt, Human
ugagcuggugcugucugga

SEQ ID NO: 338073 - RNA, 22 nt, Human
ugaggucacuauugggcagugg

SEQ ID NO: 338074 - RNA, 22 nt, Human
uggccagaggaagggacagcug

SEQ ID NO: 338075 - RNA, 23 nt, Human
ugggacgccagaccuugaccugg

SEQ ID NO: 338076 - RNA, 18 nt, Human
uguggaugaagguuucag

SEQ ID NO: 338077 - RNA, 21 nt, Human
uuucuuagaaggaaaagaaga

SEQ ID NO: 338078 - RNA, 24 nt, Human
uuuuuuuuuucugccaguagcccc

SEQ ID NO: 338079 - RNA, 21 nt, Human
uuuuuuuuuuuuucugccagu

SEQ ID NO: 338080 - RNA, 23 nt, Human
uuuuuuuuuuuuuuucugccagu

SEQ ID NO: 338081 - RNA, 27 nt, Human
uuuuuuuuuuuuuuuuuuuuucugggg

SEQ ID NO: 338082 - RNA, 22 nt, Human
aaaaaaccccgagcagcuuuuc

SEQ ID NO: 338083 - RNA, 21 nt, Human
aaaaaccccgagcagcuuuuc

SEQ ID NO: 338084 - RNA, 24 nt, Human
aacuagcucuggcuucaaucccua

SEQ ID NO: 338085 - RNA, 19 nt, Human
aagacaaugagaaaaccca

SEQ ID NO: 338086 - RNA, 22 nt, Human
agaggagcuaagagaagcagca

SEQ ID NO: 338087 - RNA, 21 nt, Human
aggaaguuggggggugggggg

SEQ ID NO: 338088 - RNA, 23 nt, Human
caaaggcccaagccauguuaccc

SEQ ID NO: 338089 - RNA, 22 nt, Human
cacagcugcucguaaacacccc

SEQ ID NO: 338090 - RNA, 20 nt, Human
cacccuuuggauaucugcuu

SEQ ID NO: 338091 - RNA, 22 nt, Human
cagcaguccaaagugaggaagg

SEQ ID NO: 338092 - RNA, 25 nt, Human
cagccagcccuuccccugcaguacc

SEQ ID NO: 338093 - RNA, 22 nt, Human
ccccagccagcccuuccccugc

SEQ ID NO: 338094 - RNA, 23 nt, Human
ccccuuguccccucacucacagc

SEQ ID NO: 338095 - RNA, 23 nt, Human
ccuuucaaaaggggcugcacccu

SEQ ID NO: 338096 - RNA, 18 nt, Human
cgcccugacccgcggcgc

SEQ ID NO: 338097 - RNA, 18 nt, Human
cuccugggaccugccccu

SEQ ID NO: 338098 - RNA, 22 nt, Human
cuccugggaccugccccuuguc

SEQ ID NO: 338099 - RNA, 21 nt, Human
gacaaugagaaaacccaggaa

SEQ ID NO: 338100 - RNA, 21 nt, Human
gaggagcuaagagaagcagca

SEQ ID NO: 338101 - RNA, 19 nt, Human
gccccuuguccccucacuc

SEQ ID NO: 338102 - RNA, 22 nt, Human
gccccuuguccccucacucaca

SEQ ID NO: 338103 - RNA, 20 nt, Human
gggagggcuuggggagccgg

SEQ ID NO: 338104 - RNA, 22 nt, Human
ggggaccccagccagcccuucc

SEQ ID NO: 338105 - RNA, 18 nt, Human
gggggguggggggugggg

SEQ ID NO: 338106 - RNA, 25 nt, Human
gucccugggacgcaacuagcucugg

SEQ ID NO: 338107 - RNA, 20 nt, Human
guggcuccugggaccugccc

SEQ ID NO: 338108 - RNA, 23 nt, Human
uaaacaccccuuucaaaaggggc

SEQ ID NO: 338109 - RNA, 22 nt, Human
ucacagcugcucguaaacaccc

SEQ ID NO: 338110 - RNA, 21 nt, Human
ucccuacaaaaauuccugaga

SEQ ID NO: 338111 - RNA, 22 nt, Human
ucugcuucuuucucuugguccc

SEQ ID NO: 338112 - RNA, 18 nt, Human
ugacccgcggcgcgcacc

SEQ ID NO: 338113 - RNA, 23 nt, Human
ugacccgcggcgcgcaccaguga

SEQ ID NO: 338114 - RNA, 23 nt, Human
ugaggaagggaguguguggcucc

SEQ ID NO: 338115 - RNA, 21 nt, Human
uggcuccugggaccugccccu

SEQ ID NO: 338116 - RNA, 18 nt, Human
uggggagggcuuggggag

SEQ ID NO: 338117 - RNA, 21 nt, Human
uggggggugggggguggggag

SEQ ID NO: 338118 - RNA, 23 nt, Human
uuaaaucucuuuaauaucccaua

SEQ ID NO: 338119 - RNA, 19 nt, Human
uuccugagaucuucgggga

SEQ ID NO: 338120 - RNA, 24 nt, Human
uuccugagaucuucggggacccca

SEQ ID NO: 338121 - RNA, 19 nt, Human
aacccgcggcgccagcacc

SEQ ID NO: 338122 - RNA, 20 nt, Human
aacuccacuccguuuggcuu

SEQ ID NO: 338123 - RNA, 19 nt, Human
aaucaugaaacucugcggg

SEQ ID NO: 338124 - RNA, 26 nt, Human
acaaacaaagacauggauuuacugug

SEQ ID NO: 338125 - RNA, 26 nt, Human
acaaacaaagacauggauuuacugug

SEQ ID NO: 338126 - RNA, 22 nt, Human
accagcgccagcagcagcccca

SEQ ID NO: 338127 - RNA, 23 nt, Human
acccgcggcgccagcaccagcgc

SEQ ID NO: 338128 - RNA, 18 nt, Human
acuccacuccguuuggcu

SEQ ID NO: 338129 - RNA, 19 nt, Human
agaaaaacaaacaaagaca

SEQ ID NO: 338130 - RNA, 19 nt, Human
agaaaaacaaacaaagaca

SEQ ID NO: 338131 - RNA, 23 nt, Human
agaaaaacaaacaaagacaugga

SEQ ID NO: 338132 - RNA, 23 nt, Human
agaaaaacaaacaaagacaugga

SEQ ID NO: 338133 - RNA, 18 nt, Human
agaaaaacaaacaaagag

SEQ ID NO: 338134 - RNA, 18 nt, Human
agaaaaacaaacaaagag

SEQ ID NO: 338135 - RNA, 20 nt, Human
agacauggauuuacugugca

SEQ ID NO: 338136 - RNA, 20 nt, Human
agacauggauuuacugugca

SEQ ID NO: 338137 - RNA, 20 nt, Human
agacgcugagcgagcgacaa

SEQ ID NO: 338138 - RNA, 19 nt, Human
agaguaucaccuuguccuc

SEQ ID NO: 338139 - RNA, 23 nt, Human
agcuccgagucgggccgcaccac

SEQ ID NO: 338140 - RNA, 22 nt, Human
aggagagggcggccgggaggga

SEQ ID NO: 338141 - RNA, 21 nt, Human
aguggcaaauauaaaaaaucu

SEQ ID NO: 338142 - RNA, 24 nt, Human
aguuuuguuccccuuuaaguuuua

SEQ ID NO: 338143 - RNA, 24 nt, Human
aguuuuguuccccuuuaaguuuua

SEQ ID NO: 338144 - RNA, 20 nt, Human
auaaagucgaaaagaaagaa

SEQ ID NO: 338145 - RNA, 18 nt, Human
cacagcagucacuucaua

SEQ ID NO: 338146 - RNA, 18 nt, Human
cacagcagucacuucaua

SEQ ID NO: 338147 - RNA, 20 nt, Human
cacagcucagaguaucaccu

SEQ ID NO: 338148 - RNA, 18 nt, Human
caccagcgccagcagcag

SEQ ID NO: 338149 - RNA, 20 nt, Human
cagaguaucaccuuguccuc

SEQ ID NO: 338150 - RNA, 21 nt, Human
cagcaccagcgccagcagcag

SEQ ID NO: 338151 - RNA, 21 nt, Human
cagcagcagccccagggcuaa

SEQ ID NO: 338152 - RNA, 22 nt, Human
caggcggccaccgcgcgccauc

SEQ ID NO: 338153 - RNA, 21 nt, Human
ccacagcucagaguaucaccu

SEQ ID NO: 338154 - RNA, 19 nt, Human
ccagcgccagcagcagccc

SEQ ID NO: 338155 - RNA, 22 nt, Human
ccagcgccagcagcagccccag

SEQ ID NO: 338156 - RNA, 23 nt, Human
cccagaaagaauugcaauuuacc

SEQ ID NO: 338157 - RNA, 19 nt, Human
ccccaggcggccaccgcgc

SEQ ID NO: 338158 - RNA, 22 nt, Human
ccccaggcggccaccgcgcgcc

SEQ ID NO: 338159 - RNA, 20 nt, Human
cccgcagaacccgcggcgcc

SEQ ID NO: 338160 - RNA, 29 nt, Human
cccgcagaacccgcggcgccagcaccagc

SEQ ID NO: 338161 - RNA, 21 nt, Human
cccgcagaacccgcggcgccg

SEQ ID NO: 338162 - RNA, 20 nt, Human
ccucccucaacccacucacc

SEQ ID NO: 338163 - RNA, 22 nt, Human
cgcaccacgcgcucuuugcgca

SEQ ID NO: 338164 - RNA, 21 nt, Human
cgcggcgccagcaccagcgcc

SEQ ID NO: 338165 - RNA, 22 nt, Human
cgcucuuugcgcaccgugggcu

SEQ ID NO: 338166 - RNA, 18 nt, Human
cuaaccccaggcggccac

SEQ ID NO: 338167 - RNA, 21 nt, Human
cucagaguauaaagucgaaaa

SEQ ID NO: 338168 - RNA, 21 nt, Human
cucagaguauaaagucgaaaa

SEQ ID NO: 338169 - RNA, 20 nt, Human
cuccucaguagugacaaagc

SEQ ID NO: 338170 - RNA, 26 nt, Human
cucuaaauuccuuucuuuuucacauu

SEQ ID NO: 338171 - RNA, 18 nt, Human
cugcacccguuugaucca

SEQ ID NO: 338172 - RNA, 25 nt, Human
gaagaaucaugaaacucugcggggu

SEQ ID NO: 338173 - RNA, 19 nt, Human
gaagcucugguuguccuca

SEQ ID NO: 338174 - RNA, 23 nt, Human
gaggagagggcggccgggaggga

SEQ ID NO: 338175 - RNA, 22 nt, Human
gauugcuucuuaauagaaaaac

SEQ ID NO: 338176 - RNA, 22 nt, Human
gauugcuuuuuaauagaaaaac

SEQ ID NO: 338177 - RNA, 24 nt, Human
gcagaacccgcggcgccagcacca

SEQ ID NO: 338178 - RNA, 22 nt, Human
gccaccgcgcgccaucgucccg

SEQ ID NO: 338179 - RNA, 19 nt, Human
gccaucgucccgaggagag

SEQ ID NO: 338180 - RNA, 18 nt, Human
gcccgcagaacccgcggc

SEQ ID NO: 338181 - RNA, 20 nt, Human
gcggcgccagcaccagcgcc

SEQ ID NO: 338182 - RNA, 19 nt, Human
gcggggggggcaggucugc

SEQ ID NO: 338183 - RNA, 19 nt, Human
gcucuuugcgcaccguggg

SEQ ID NO: 338184 - RNA, 19 nt, Human
ggaaauguuaucauccuug

SEQ ID NO: 338185 - RNA, 19 nt, Human
ggacaugauccagaacccc

SEQ ID NO: 338186 - RNA, 20 nt, Human
ggcggccgggagggagacgc

SEQ ID NO: 338187 - RNA, 20 nt, Human
ggggggcaggucugcggguc

SEQ ID NO: 338188 - RNA, 19 nt, Human
gucgaaaagaaagaaucug

SEQ ID NO: 338189 - RNA, 19 nt, Human
gucgaaaagaaagaaucug

SEQ ID NO: 338190 - RNA, 21 nt, Human
guggcaaauauaaaaaucugg

SEQ ID NO: 338191 - RNA, 24 nt, Human
uaacucagaguauaaagucgaaaa

SEQ ID NO: 338192 - RNA, 24 nt, Human
uaacucagaguauaaagucgaaaa

SEQ ID NO: 338193 - RNA, 21 nt, Human
uacauuccuuucuuuuucaca

SEQ ID NO: 338194 - RNA, 22 nt, Human
uacauuccuuucuuuuucacau

SEQ ID NO: 338195 - RNA, 19 nt, Human
uauaguaaccauagguggc

SEQ ID NO: 338196 - RNA, 23 nt, Human
uauauuagacuuguucugaaaua

SEQ ID NO: 338197 - RNA, 18 nt, Human
uaucauaauccuuccaga

SEQ ID NO: 338198 - RNA, 24 nt, Human
uauuucauucacuuccuccuuaca

SEQ ID NO: 338199 - RNA, 22 nt, Human
ucaaagauguaucuuuucugca

SEQ ID NO: 338200 - RNA, 24 nt, Human
ucaacaaucuucccuagccucucc

SEQ ID NO: 338201 - RNA, 24 nt, Human
ucagaguauaaagucgaaaagaaa

SEQ ID NO: 338202 - RNA, 24 nt, Human
ucagaguauaaagucgaaaagaaa

SEQ ID NO: 338203 - RNA, 21 nt, Human
ucagcuccucaguagugacaa

SEQ ID NO: 338204 - RNA, 18 nt, Human
ucaguccacagcucagag

SEQ ID NO: 338205 - RNA, 21 nt, Human
ucaugaaacucugcgggguuu

SEQ ID NO: 338206 - RNA, 18 nt, Human
ucccaaggaucccaccaa

SEQ ID NO: 338207 - RNA, 18 nt, Human
ucccucaacccacucaac

SEQ ID NO: 338208 - RNA, 20 nt, Human
uccucagggggccgcucgcc

SEQ ID NO: 338209 - RNA, 22 nt, Human
ucguacuggaagcucugguugu

SEQ ID NO: 338210 - RNA, 21 nt, Human
ucugacauucaucuuuucccu

SEQ ID NO: 338211 - RNA, 24 nt, Human
ucugguaguuaaaauacacagcag

SEQ ID NO: 338212 - RNA, 24 nt, Human
ugaaacucugcgggguuuccuagg

SEQ ID NO: 338213 - RNA, 21 nt, Human
ugagagaaaucuuacugaaag

SEQ ID NO: 338214 - RNA, 21 nt, Human
ugagagaaaucuuacugaaag

SEQ ID NO: 338215 - RNA, 26 nt, Human
ugagcgaaaaacaauuuuuauacccc

SEQ ID NO: 338216 - RNA, 26 nt, Human
ugagcgaaaaacaauuuuuauacccc

SEQ ID NO: 338217 - RNA, 19 nt, Human
ugaugaucugaagaaucau

SEQ ID NO: 338218 - RNA, 20 nt, Human
ugcccaggaaggccucgugg

SEQ ID NO: 338219 - RNA, 20 nt, Human
uggaaaaugcauggagguuu

SEQ ID NO: 338220 - RNA, 20 nt, Human
uggaaaaugcauggagguuu

SEQ ID NO: 338221 - RNA, 20 nt, Human
uggcuucccaaggaucccuc

SEQ ID NO: 338222 - RNA, 20 nt, Human
uggcuucccaaggaucccuc

SEQ ID NO: 338223 - RNA, 19 nt, Human
uggcuuguuuguauucuuc

SEQ ID NO: 338224 - RNA, 27 nt, Human
ugggacaugauccagaaccccgcuccg

SEQ ID NO: 338225 - RNA, 27 nt, Human
ugggacaugauccagaacuccacuccg

SEQ ID NO: 338226 - RNA, 20 nt, Human
ugggaucacaacugcuguaa

SEQ ID NO: 338227 - RNA, 20 nt, Human
ugggaucacaacugcuguaa

SEQ ID NO: 338228 - RNA, 24 nt, Human
uguuguggggggacaggucugagg

SEQ ID NO: 338229 - RNA, 24 nt, Human
uuacugccucccucaacccacuca

SEQ ID NO: 338230 - RNA, 24 nt, Human
uuacugccucccucaacccacuca

SEQ ID NO: 338231 - RNA, 22 nt, Human
uucauccuuucccuaccucuac

SEQ ID NO: 338232 - RNA, 19 nt, Human
uucaucuuuucccuaccuc

SEQ ID NO: 338233 - RNA, 19 nt, Human
uugauugcuucuuaauaga

SEQ ID NO: 338234 - RNA, 19 nt, Human
uugauugcuuuuuaauaga

SEQ ID NO: 338235 - RNA, 18 nt, Human
uuggcauuuuaagguagg

SEQ ID NO: 338236 - RNA, 21 nt, Human
uuguggggggacaggucugag

SEQ ID NO: 338237 - RNA, 24 nt, Human
aacagauggaguauuuaggaaaga

SEQ ID NO: 338238 - RNA, 19 nt, Human
acaccgagggacgcgagga

SEQ ID NO: 338239 - RNA, 18 nt, Human
aggagggaggcuggcggg

SEQ ID NO: 338240 - RNA, 24 nt, Human
agggaggcuggcgggggcccgggc

SEQ ID NO: 338241 - RNA, 25 nt, Human
auuuauagcucggucacauacuacu

SEQ ID NO: 338242 - RNA, 21 nt, Human
caaauuaaaucuacuuagaac

SEQ ID NO: 338243 - RNA, 20 nt, Human
caguacucuacugagacagg

SEQ ID NO: 338244 - RNA, 23 nt, Human
cugguaacaaauuauaaaaggag

SEQ ID NO: 338245 - RNA, 20 nt, Human
gaggagggaggcuggcgggg

SEQ ID NO: 338246 - RNA, 21 nt, Human
uaaaacccuuuauagaaacca

SEQ ID NO: 338247 - RNA, 21 nt, Human
uaaagguuucuuuaaagguuu

SEQ ID NO: 338248 - RNA, 22 nt, Human
uaagauaauucugacugugguu

SEQ ID NO: 338249 - RNA, 21 nt, Human
uaaucacucaaaaaugaaaaa

SEQ ID NO: 338250 - RNA, 21 nt, Human
uacauuaagauaauucugacu

SEQ ID NO: 338251 - RNA, 26 nt, Human
uacauuaagauaauucugacuguggu

SEQ ID NO: 338252 - RNA, 19 nt, Human
uauagcucggucacauacu

SEQ ID NO: 338253 - RNA, 19 nt, Human
ucaguucccaaauuaaauc

SEQ ID NO: 338254 - RNA, 20 nt, Human
ucccaaauuaaaucuacuua

SEQ ID NO: 338255 - RNA, 22 nt, Human
uccuucuaaagguuucuuuaaa

SEQ ID NO: 338256 - RNA, 18 nt, Human
uggaaauagaacucaaau

SEQ ID NO: 338257 - RNA, 22 nt, Human
uguugucauauggcacaauauu

SEQ ID NO: 338258 - RNA, 21 nt, Human
uucauacaauaaaacccuuua

SEQ ID NO: 338259 - RNA, 18 nt, Human
uuccacaauacaguacua

SEQ ID NO: 338260 - RNA, 18 nt, Human
uuccuaaaagagccaaaa

SEQ ID NO: 338261 - RNA, 21 nt, Human
uuguccugucaguucccaaau

SEQ ID NO: 338262 - RNA, 19 nt, Human
agggagauggugauucgga

SEQ ID NO: 338263 - RNA, 23 nt, Human
ccccuggagcaggugaaagugaa

SEQ ID NO: 338264 - RNA, 18 nt, Human
cucgguguuuuuuuucug

SEQ ID NO: 338265 - RNA, 20 nt, Human
uaucaggcaaggcaaguccu

SEQ ID NO: 338266 - RNA, 19 nt, Human
ugccggauaacaugugagg

SEQ ID NO: 338267 - RNA, 23 nt, Human
uggagcaggugaaagugaaguca

SEQ ID NO: 338268 - RNA, 23 nt, Human
uggugauucggagccugcuggcu

SEQ ID NO: 338269 - RNA, 20 nt, Human
aaacugcuuacccagcacuc

SEQ ID NO: 338270 - RNA, 23 nt, Human
aagacccaggaagaaggaaccag

SEQ ID NO: 338271 - RNA, 24 nt, Human
aagacccaggaagaaggaaccagg

SEQ ID NO: 338272 - RNA, 20 nt, Human
acugcuuacccagcacucca

SEQ ID NO: 338273 - RNA, 23 nt, Human
agagggaggggugggaccgggcc

SEQ ID NO: 338274 - RNA, 20 nt, Human
agcacagggacaugggcugg

SEQ ID NO: 338275 - RNA, 20 nt, Human
agggagcugugcugugggcu

SEQ ID NO: 338276 - RNA, 18 nt, Human
augugugugugugugugu

SEQ ID NO: 338277 - RNA, 19 nt, Human
augugugugugugugugug

SEQ ID NO: 338278 - RNA, 21 nt, Human
cagcggcuggggagucgcugg

SEQ ID NO: 338279 - RNA, 23 nt, Human
ccuuucucuuggcccuggggugg

SEQ ID NO: 338280 - RNA, 24 nt, Human
cggcuggggagucgcugggugggu

SEQ ID NO: 338281 - RNA, 21 nt, Human
cugggugggugggacgugcgu

SEQ ID NO: 338282 - RNA, 23 nt, Human
gaagggaggaggggcccaggagc

SEQ ID NO: 338283 - RNA, 23 nt, Human
gcaauccuugaagggaggagggg

SEQ ID NO: 338284 - RNA, 25 nt, Human
gcgcgcgugugugugcaugugugug

SEQ ID NO: 338285 - RNA, 22 nt, Human
gcggcuggggagucgcugggug

SEQ ID NO: 338286 - RNA, 22 nt, Human
ggaaacugcuuacccagcacuc

SEQ ID NO: 338287 - RNA, 27 nt, Human
ggacaugggcugguggacagagggagg

SEQ ID NO: 338288 - RNA, 20 nt, Human
gggaggaggggcccaggagc

SEQ ID NO: 338289 - RNA, 20 nt, Human
gggcugguggacagagggag

SEQ ID NO: 338290 - RNA, 21 nt, Human
gugcugugggcuugugugcag

SEQ ID NO: 338291 - RNA, 18 nt, Human
guggacagagggaggggu

SEQ ID NO: 338292 - RNA, 21 nt, Human
gugucaugugagugguaggug

SEQ ID NO: 338293 - RNA, 21 nt, Human
gugugugcaugugugugugug

SEQ ID NO: 338294 - RNA, 24 nt, Human
uacccagcacuccacaaaggagcu

SEQ ID NO: 338295 - RNA, 18 nt, Human
uccccuggccgcaggcug

SEQ ID NO: 338296 - RNA, 19 nt, Human
uccuauggccuaauccugg

SEQ ID NO: 338297 - RNA, 25 nt, Human
ugaagacccaggaagaaggaaccag

SEQ ID NO: 338298 - RNA, 19 nt, Human
ugaagggaggaggggccca

SEQ ID NO: 338299 - RNA, 19 nt, Human
ugaggaagagugggcagcg

SEQ ID NO: 338300 - RNA, 21 nt, Human
ugcaggccuuucucuuggccc

SEQ ID NO: 338301 - RNA, 19 nt, Human
ugcgcgcgcgugugugugc

SEQ ID NO: 338302 - RNA, 20 nt, Human
ugcuucaguuuggcagggag

SEQ ID NO: 338303 - RNA, 20 nt, Human
uggaugugugugugugugug

SEQ ID NO: 338304 - RNA, 21 nt, Human
ugggauuagcacagggacaug

SEQ ID NO: 338305 - RNA, 22 nt, Human
ugggguggaugugugugugugu

SEQ ID NO: 338306 - RNA, 21 nt, Human
ugugagcugaagaccgagaug

SEQ ID NO: 338307 - RNA, 20 nt, Human
ugugcaggccuuucucuugg

SEQ ID NO: 338308 - RNA, 18 nt, Human
ugugcgcgcgcgugugug

SEQ ID NO: 338309 - RNA, 24 nt, Human
ugugcgcgcgcgugugugugcaug

SEQ ID NO: 338310 - RNA, 29 nt, Human
ugugugcaggccuuucucuuggccccggc

SEQ ID NO: 338311 - RNA, 19 nt, Human
ugugugcaugugugugugu

SEQ ID NO: 338312 - RNA, 21 nt, Human
ugugugcaugugugugugugu

SEQ ID NO: 338313 - RNA, 21 nt, Human
ugugugcgcgcgcgugugugu

SEQ ID NO: 338314 - RNA, 22 nt, Human
ugugugcgcgcgcgugugugug

SEQ ID NO: 338315 - RNA, 21 nt, Human
ugugugugcaugugugugugu

SEQ ID NO: 338316 - RNA, 22 nt, Human
ugugugugcaugugugugugug

SEQ ID NO: 338317 - RNA, 21 nt, Human
ugugugugcgcgcgcgugugu

SEQ ID NO: 338318 - RNA, 21 nt, Human
ugugugugugcgcgcgcgugu

SEQ ID NO: 338319 - RNA, 22 nt, Human
ugugugugugugcgcgcgcgug

SEQ ID NO: 338320 - RNA, 26 nt, Human
ugugugugugugcgcgcgcgugauuu

SEQ ID NO: 338321 - RNA, 18 nt, Human
ugugugugugugugcaca

SEQ ID NO: 338322 - RNA, 21 nt, Human
ugugugugugugugcgcgcgc

SEQ ID NO: 338323 - RNA, 23 nt, Human
ugugugugugugugugcgcgcgc

SEQ ID NO: 338324 - RNA, 18 nt, Human
uuacccagcacuccacaa

SEQ ID NO: 338325 - RNA, 24 nt, Human
uugaagggaggaggggcccaggag

SEQ ID NO: 338326 - RNA, 20 nt, Human
uuuuuuuuuuuuuuuuccag

SEQ ID NO: 338327 - RNA, 23 nt, Human
aaccccaaucccaagugcugaaa

SEQ ID NO: 338328 - RNA, 22 nt, Human
aagugcugaaaaaccagaggcu

SEQ ID NO: 338329 - RNA, 26 nt, Human
aaucccaagugcugaaaaaccagagg

SEQ ID NO: 338330 - RNA, 21 nt, Human
agggagauguguaagcuucca

SEQ ID NO: 338331 - RNA, 25 nt, Human
caagugcugaaaaaccagaggcuga

SEQ ID NO: 338332 - RNA, 19 nt, Human
cccaagugcugaaaaacca

SEQ ID NO: 338333 - RNA, 24 nt, Human
ccccacggucuccggccgcgcccg

SEQ ID NO: 338334 - RNA, 20 nt, Human
ccgcgcuggccgcugauagc

SEQ ID NO: 338335 - RNA, 20 nt, Human
ccuuuuggggcaagggagug

SEQ ID NO: 338336 - RNA, 25 nt, Human
cucccgagggggcggcaaccggggg

SEQ ID NO: 338337 - RNA, 20 nt, Human
cugagaucaaaccugacagc

SEQ ID NO: 338338 - RNA, 22 nt, Human
cuuaaccccaaucccaagugcc

SEQ ID NO: 338339 - RNA, 20 nt, Human
ucuccggccgcgcccgcgcu

SEQ ID NO: 338340 - RNA, 18 nt, Human
uguuuuacugagaccagc

SEQ ID NO: 338341 - RNA, 23 nt, Human
uuaaccccaaucccaagugcuga

SEQ ID NO: 338342 - RNA, 20 nt, Human
aaaaaaaaaaaaaaagacaa

SEQ ID NO: 338343 - RNA, 22 nt, Human
aaaaaaaaaaaaaaagacaaca

SEQ ID NO: 338344 - RNA, 21 nt, Human
aaaaaaaaaaaaagacaacau

SEQ ID NO: 338345 - RNA, 27 nt, Human
aaaaagacaacauggccauuuuucaga

SEQ ID NO: 338346 - RNA, 21 nt, Human
aaagaacccaaacucagucca

SEQ ID NO: 338347 - RNA, 24 nt, Human
aaagcaggccuuucacuguguuuu

SEQ ID NO: 338348 - RNA, 23 nt, Human
aaaguaaccuauucccaaacacc

SEQ ID NO: 338349 - RNA, 30 nt, Human
aacugugugucaaaugcuuuuagggacccc

SEQ ID NO: 338350 - RNA, 19 nt, Human
aagaaacggaagaagcucc

SEQ ID NO: 338351 - RNA, 19 nt, Human
aagaaagugaaaacuccug

SEQ ID NO: 338352 - RNA, 27 nt, Human
aagcaaacggccaaccugucaaucuug

SEQ ID NO: 338353 - RNA, 21 nt, Human
aagcagagguaaguuauggac

SEQ ID NO: 338354 - RNA, 19 nt, Human
aaucauucucuccuucccc

SEQ ID NO: 338355 - RNA, 20 nt, Human
acacuaaaguucuuaggaca

SEQ ID NO: 338356 - RNA, 20 nt, Human
accaagugacacuuuggaua

SEQ ID NO: 338357 - RNA, 20 nt, Human
acccaaacucaguccaaagu

SEQ ID NO: 338358 - RNA, 23 nt, Human
acccgugguucacuccagacuca

SEQ ID NO: 338359 - RNA, 18 nt, Human
acgagcucucuugaaugu

SEQ ID NO: 338360 - RNA, 23 nt, Human
agaacauaccccagcagcaccag

SEQ ID NO: 338361 - RNA, 18 nt, Human
agagauagcaagagcucg

SEQ ID NO: 338362 - RNA, 18 nt, Human
agauggcccaagcuguag

SEQ ID NO: 338363 - RNA, 23 nt, Human
agcaaagaacccaaacucagucc

SEQ ID NO: 338364 - RNA, 22 nt, Human
agcccagaacauaccccagcag

SEQ ID NO: 338365 - RNA, 19 nt, Human
agggagcugcccugggggc

SEQ ID NO: 338366 - RNA, 24 nt, Human
auagagugaagcaacauggagcuc

SEQ ID NO: 338367 - RNA, 30 nt, Human
aucuuggcauuaaaaaaaaaaaaaaaaaaa

SEQ ID NO: 338368 - RNA, 19 nt, Human
caaaaucauucucuccuuc

SEQ ID NO: 338369 - RNA, 22 nt, Human
caccccaaaccuuaacgagccc

SEQ ID NO: 338370 - RNA, 28 nt, Human
cacgccaacagccugacuuccucaaccc

SEQ ID NO: 338371 - RNA, 19 nt, Human
cagcaaagaacccaaacuc

SEQ ID NO: 338372 - RNA, 21 nt, Human
cagcaaagaacccaaacucag

SEQ ID NO: 338373 - RNA, 20 nt, Human
cagcacagcucccaccccaa

SEQ ID NO: 338374 - RNA, 21 nt, Human
cagcccccgagucaccaggag

SEQ ID NO: 338375 - RNA, 24 nt, Human
cagcccccgagucaccaggagggc

SEQ ID NO: 338376 - RNA, 24 nt, Human
caguccaaaguaaccuauucccaa

SEQ ID NO: 338377 - RNA, 23 nt, Human
ccaaaguaaccuauucccaaaca

SEQ ID NO: 338378 - RNA, 18 nt, Human
ccagccagguaggaacga

SEQ ID NO: 338379 - RNA, 25 nt, Human
cccaaaccuuaacgagcccagaggc

SEQ ID NO: 338380 - RNA, 18 nt, Human
ccccaaaccuuaacgagc

SEQ ID NO: 338381 - RNA, 24 nt, Human
ccccgagucaccaggagggcauau

SEQ ID NO: 338382 - RNA, 19 nt, Human
cccucaaugccuuaagagu

SEQ ID NO: 338383 - RNA, 19 nt, Human
cggaguuggaugaggggga

SEQ ID NO: 338384 - RNA, 19 nt, Human
cgggaggggaggggcccca

SEQ ID NO: 338385 - RNA, 21 nt, Human
cgggaggggaggggccccagg

SEQ ID NO: 338386 - RNA, 21 nt, Human
cgugguucacuccagacucag

SEQ ID NO: 338387 - RNA, 23 nt, Human
cuaaagaaagugaaaacuccugu

SEQ ID NO: 338388 - RNA, 26 nt, Human
cuauucccaaacaccaucggucagaa

SEQ ID NO: 338389 - RNA, 21 nt, Human
cucagauacggccaguggcca

SEQ ID NO: 338390 - RNA, 20 nt, Human
cuggcacuuuagggauggug

SEQ ID NO: 338391 - RNA, 22 nt, Human
cuggcauuaagcaaacggccaa

SEQ ID NO: 338392 - RNA, 19 nt, Human
cugggcccaccaagagcug

SEQ ID NO: 338393 - RNA, 22 nt, Human
cugugugggugucccugggccc

SEQ ID NO: 338394 - RNA, 20 nt, Human
cuuccaccgaugagccacag

SEQ ID NO: 338395 - RNA, 20 nt, Human
cuucccacagcacagcuccc

SEQ ID NO: 338396 - RNA, 18 nt, Human
gaacauaccccagcagca

SEQ ID NO: 338397 - RNA, 19 nt, Human
gaagaugggcuaucucaaa

SEQ ID NO: 338398 - RNA, 18 nt, Human
gacuuccucaacccgugg

SEQ ID NO: 338399 - RNA, 21 nt, Human
gaugcagaagcauuccagaaa

SEQ ID NO: 338400 - RNA, 21 nt, Human
gcucccaccccaaaccuuaac

SEQ ID NO: 338401 - RNA, 20 nt, Human
ggagaucaccuggcacuuua

SEQ ID NO: 338402 - RNA, 20 nt, Human
ggaggggaggggccccaggg

SEQ ID NO: 338403 - RNA, 18 nt, Human
gggaagucagcaaaauca

SEQ ID NO: 338404 - RNA, 19 nt, Human
gggaggggaggggccccag

SEQ ID NO: 338405 - RNA, 21 nt, Human
gggaggggaggggccccaggg

SEQ ID NO: 338406 - RNA, 21 nt, Human
gggggaagaaacggaagaagc

SEQ ID NO: 338407 - RNA, 18 nt, Human
ggugcccuccuugggaga

SEQ ID NO: 338408 - RNA, 26 nt, Human
gugaagcaacauggagcucauaagag

SEQ ID NO: 338409 - RNA, 18 nt, Human
gugguucacuccagacuc

SEQ ID NO: 338410 - RNA, 18 nt, Human
guguuuuucaagaugggu

SEQ ID NO: 338411 - RNA, 20 nt, Human
uaaaaggggagcagcccuca

SEQ ID NO: 338412 - RNA, 21 nt, Human
uaaagaaagugaaaacuccug

SEQ ID NO: 338413 - RNA, 21 nt, Human
uaaguuauggacuguucccuu

SEQ ID NO: 338414 - RNA, 21 nt, Human
uacacuaaaguucuuaggaca

SEQ ID NO: 338415 - RNA, 18 nt, Human
uagcuucauucacauuuu

SEQ ID NO: 338416 - RNA, 21 nt, Human
uaggacagcaaagaacccaaa

SEQ ID NO: 338417 - RNA, 19 nt, Human
uagggcagcgggccugaag

SEQ ID NO: 338418 - RNA, 19 nt, Human
uagugguggcaggggucuc

SEQ ID NO: 338419 - RNA, 20 nt, Human
uagugguggcaggggucucg

SEQ ID NO: 338420 - RNA, 21 nt, Human
uauugacagcuguuaacagca

SEQ ID NO: 338421 - RNA, 21 nt, Human
ucagauuucugugcuuaugca

SEQ ID NO: 338422 - RNA, 19 nt, Human
ucaguauggaucauuccuu

SEQ ID NO: 338423 - RNA, 21 nt, Human
ucccaaacaccaucggucaga

SEQ ID NO: 338424 - RNA, 21 nt, Human
uccccgugaaugcaguagugg

SEQ ID NO: 338425 - RNA, 22 nt, Human
uccccugaaagcuucucuuucc

SEQ ID NO: 338426 - RNA, 21 nt, Human
uccuaaagaaagugaaaacuc

SEQ ID NO: 338427 - RNA, 20 nt, Human
ucuuaggacagcaaagaacc

SEQ ID NO: 338428 - RNA, 18 nt, Human
ucuuuccuaaagaaagug

SEQ ID NO: 338429 - RNA, 21 nt, Human
ugauuaaagaauccuguuuag

SEQ ID NO: 338430 - RNA, 21 nt, Human
ugccaaagauggcuggcucag

SEQ ID NO: 338431 - RNA, 18 nt, Human
ugccuucuggccucgguc

SEQ ID NO: 338432 - RNA, 18 nt, Human
ugcuucccacagcacagc

SEQ ID NO: 338433 - RNA, 18 nt, Human
ugggaaaagugcagaugg

SEQ ID NO: 338434 - RNA, 22 nt, Human
ugggaccaacgucugacagggu

SEQ ID NO: 338435 - RNA, 18 nt, Human
ugggcccaccaagagcug

SEQ ID NO: 338436 - RNA, 21 nt, Human
ugggcccugccuuggucuggu

SEQ ID NO: 338437 - RNA, 22 nt, Human
ugggggaagaaacggaagaagc

SEQ ID NO: 338438 - RNA, 20 nt, Human
ugguguggugcugggacacg

SEQ ID NO: 338439 - RNA, 22 nt, Human
ugguguggugcugggacacgcc

SEQ ID NO: 338440 - RNA, 22 nt, Human
uguaagauggugcccuccuugg

SEQ ID NO: 338441 - RNA, 24 nt, Human
ugucugauuguugcuccucuucca

SEQ ID NO: 338442 - RNA, 24 nt, Human
uguuuagagcccucaaugccuuaa

SEQ ID NO: 338443 - RNA, 18 nt, Human
uucacauuuugggucagu

SEQ ID NO: 338444 - RNA, 25 nt, Human
uuccaccgaugagccacaggguacc

SEQ ID NO: 338445 - RNA, 19 nt, Human
uuggcauuaaaaaaaaaaa

SEQ ID NO: 338446 - RNA, 21 nt, Human
uuggcauuaaaaaaaaaaaaa

SEQ ID NO: 338447 - RNA, 22 nt, Human
uuggccucaacgagauucagaa

SEQ ID NO: 338448 - RNA, 18 nt, Human
uuuuucagauuucugugc

SEQ ID NO: 338449 - RNA, 21 nt, Human
aaaaauccaaugaaaguucag

SEQ ID NO: 338450 - RNA, 29 nt, Human
aaaagaaaaagaaaaaaaaugugaaaagg

SEQ ID NO: 338451 - RNA, 25 nt, Human
aaacaaaauaagcacagugaucuag

SEQ ID NO: 338452 - RNA, 22 nt, Human
aaacaaaguauuagaacaugug

SEQ ID NO: 338453 - RNA, 22 nt, Human
aaacuuuuaaaaucuugcagag

SEQ ID NO: 338454 - RNA, 19 nt, Human
aaaugguaggcaaaaaaag

SEQ ID NO: 338455 - RNA, 20 nt, Human
aacuaaucauuuguuuuucu

SEQ ID NO: 338456 - RNA, 21 nt, Human
aagaaaaaaaaugugaaaaga

SEQ ID NO: 338457 - RNA, 24 nt, Human
aagcacagugaucuagaaaccaaa

SEQ ID NO: 338458 - RNA, 25 nt, Human
aagguccagguuuuaaaaaauaaca

SEQ ID NO: 338459 - RNA, 31 nt, Human
acacacagaguacacacacacacacacacag

SEQ ID NO: 338460 - RNA, 31 nt, Human
acacagaguacacacacacacacacacacag

SEQ ID NO: 338461 - RNA, 28 nt, Human
acacagccuuaaaaauggagggaacgcc

SEQ ID NO: 338462 - RNA, 30 nt, Human
acagaguacacacacacacacacacacaca

SEQ ID NO: 338463 - RNA, 20 nt, Human
agaaaaaaaaaagaaaaaga

SEQ ID NO: 338464 - RNA, 21 nt, Human
agaaaaaaaaaagaaaaagaa

SEQ ID NO: 338465 - RNA, 27 nt, Human
agaaaaagaaaaaaaaugugaaaagag

SEQ ID NO: 338466 - RNA, 18 nt, Human
agaaaaccaagcaugaua

SEQ ID NO: 338467 - RNA, 19 nt, Human
agaauuaacaaaccaaauu

SEQ ID NO: 338468 - RNA, 23 nt, Human
agauaagagaagggcacacugag

SEQ ID NO: 338469 - RNA, 23 nt, Human
agcaaaaucaaaaaagcacaaga

SEQ ID NO: 338470 - RNA, 20 nt, Human
aggaaaauuaacaaaaaucc

SEQ ID NO: 338471 - RNA, 23 nt, Human
agguuuuuaucuauuaugcaauu

SEQ ID NO: 338472 - RNA, 23 nt, Human
aguaggguccaccauccauuccu

SEQ ID NO: 338473 - RNA, 24 nt, Human
agugagguaguauuguuguccccu

SEQ ID NO: 338474 - RNA, 22 nt, Human
aucaaauauccaauaagguaau

SEQ ID NO: 338475 - RNA, 21 nt, Human
auggaaaguagcugaaccaca

SEQ ID NO: 338476 - RNA, 19 nt, Human
auuaugcuaaugguaaaag

SEQ ID NO: 338477 - RNA, 21 nt, Human
caaaagaaaaaagaaaaccaa

SEQ ID NO: 338478 - RNA, 21 nt, Human
caaaauaagcacagugaucua

SEQ ID NO: 338479 - RNA, 27 nt, Human
caaaauaagcacagugaucuagaaacc

SEQ ID NO: 338480 - RNA, 26 nt, Human
caaaaucaaaaaagcacaagagauau

SEQ ID NO: 338481 - RNA, 23 nt, Human
caaagacuguccacugugcuacc

SEQ ID NO: 338482 - RNA, 24 nt, Human
caaauagaucauaaacagcaaaau

SEQ ID NO: 338483 - RNA, 18 nt, Human
caacagaaaaaaaaaaga

SEQ ID NO: 338484 - RNA, 21 nt, Human
caaggugggaugcauuccauc

SEQ ID NO: 338485 - RNA, 20 nt, Human
cacacacacacacacacaca

SEQ ID NO: 338486 - RNA, 20 nt, Human
cacacacacacacacacaca

SEQ ID NO: 338487 - RNA, 20 nt, Human
cacacacacacacacacaca

SEQ ID NO: 338488 - RNA, 22 nt, Human
cacacacacacacacacacaca

SEQ ID NO: 338489 - RNA, 22 nt, Human
cacacacacacacacacacaca

SEQ ID NO: 338490 - RNA, 23 nt, Human
cacacacacacacacacacacag

SEQ ID NO: 338491 - RNA, 23 nt, Human
cacacacacacacacacacaguc

SEQ ID NO: 338492 - RNA, 21 nt, Human
cacacacagaguacacacaca

SEQ ID NO: 338493 - RNA, 24 nt, Human
cacacagccuuaaaaauggauuaa

SEQ ID NO: 338494 - RNA, 19 nt, Human
cacuucaagguuaaccagc

SEQ ID NO: 338495 - RNA, 21 nt, Human
cagaacugaaaccacacauac

SEQ ID NO: 338496 - RNA, 21 nt, Human
cagaaucccacaguuugacuc

SEQ ID NO: 338497 - RNA, 24 nt, Human
cagagauugaaacaaaauaagcac

SEQ ID NO: 338498 - RNA, 18 nt, Human
cagcaaaauauaacugau

SEQ ID NO: 338499 - RNA, 21 nt, Human
caggagauaaaacaccaauca

SEQ ID NO: 338500 - RNA, 24 nt, Human
caugugaauauuagaaccuccuuc

SEQ ID NO: 338501 - RNA, 20 nt, Human
ccacacagagaaaacaaggc

SEQ ID NO: 338502 - RNA, 21 nt, Human
ccauacaacaccccuccagga

SEQ ID NO: 338503 - RNA, 27 nt, Human
cccuuccagaaagguccagguuuuaaa

SEQ ID NO: 338504 - RNA, 18 nt, Human
ccuaaucuacaaauagau

SEQ ID NO: 338505 - RNA, 19 nt, Human
cugaaaccacacauacacc

SEQ ID NO: 338506 - RNA, 19 nt, Human
gaacauuuaugucucaaaa

SEQ ID NO: 338507 - RNA, 18 nt, Human
gagagaauguggaaauag

SEQ ID NO: 338508 - RNA, 20 nt, Human
guacacagaacugaaaccac

SEQ ID NO: 338509 - RNA, 19 nt, Human
guuguccccuccucgggac

SEQ ID NO: 338510 - RNA, 18 nt, Human
uaaaaaaaaacuaagcac

SEQ ID NO: 338511 - RNA, 23 nt, Human
uaaaaaaaaacuaagcaccagcu

SEQ ID NO: 338512 - RNA, 20 nt, Human
uaaaacaccaaucaguguaa

SEQ ID NO: 338513 - RNA, 19 nt, Human
uaaaauguucaccauuauc

SEQ ID NO: 338514 - RNA, 20 nt, Human
uaaccaaauaucaaauaucc

SEQ ID NO: 338515 - RNA, 24 nt, Human
uaaccgaaauuaauauaaacuaaa

SEQ ID NO: 338516 - RNA, 21 nt, Human
uaauguugaagagcuccccuu

SEQ ID NO: 338517 - RNA, 20 nt, Human
uacacacacacacacacaca

SEQ ID NO: 338518 - RNA, 25 nt, Human
uacacacacacacacacacacacac

SEQ ID NO: 338519 - RNA, 25 nt, Human
uacacacacagaguacacacacaca

SEQ ID NO: 338520 - RNA, 22 nt, Human
uagaucauaaacagcaaaauau

SEQ ID NO: 338521 - RNA, 18 nt, Human
uagauuaaaaaaaaacua

SEQ ID NO: 338522 - RNA, 21 nt, Human
uagauuaaaaaaaaacuaagc

SEQ ID NO: 338523 - RNA, 25 nt, Human
uagugagguaguauuguuguccccu

SEQ ID NO: 338524 - RNA, 18 nt, Human
uaguguauuuuuacauug

SEQ ID NO: 338525 - RNA, 22 nt, Human
ucaaaaugaggaaaauuaacaa

SEQ ID NO: 338526 - RNA, 20 nt, Human
ucagaaucccacaguuugac

SEQ ID NO: 338527 - RNA, 19 nt, Human
ucagcaaaaucaaaaaagc

SEQ ID NO: 338528 - RNA, 19 nt, Human
uccaggaugauaguauacc

SEQ ID NO: 338529 - RNA, 21 nt, Human
ucccuggaccaaaagaaaaaa

SEQ ID NO: 338530 - RNA, 21 nt, Human
uccuagggagcuacuacugcu

SEQ ID NO: 338531 - RNA, 23 nt, Human
ucguaucaagguacagacauucu

SEQ ID NO: 338532 - RNA, 27 nt, Human
ucucucucucucucauacacacacaga

SEQ ID NO: 338533 - RNA, 25 nt, Human
ugaaggaaaaugaaauuucgaaagu

SEQ ID NO: 338534 - RNA, 19 nt, Human
ugacucgacaaaaaggcag

SEQ ID NO: 338535 - RNA, 20 nt, Human
ugcacaaccaugguacaaca

SEQ ID NO: 338536 - RNA, 22 nt, Human
ugugcacaaccaugguacaaca

SEQ ID NO: 338537 - RNA, 22 nt, Human
uguggaaauagguuaaauaugg

SEQ ID NO: 338538 - RNA, 19 nt, Human
uguugaagagcuccccuua

SEQ ID NO: 338539 - RNA, 24 nt, Human
uuaaaaaauaacauuaguuaccaa

SEQ ID NO: 338540 - RNA, 22 nt, Human
uuaaagucagcaaaaucaaaaa

SEQ ID NO: 338541 - RNA, 21 nt, Human
uuaaauaaccaaauaucaaau

SEQ ID NO: 338542 - RNA, 22 nt, Human
uuagaaaaauucacacagccuu

SEQ ID NO: 338543 - RNA, 20 nt, Human
uuagaacaugugaauauuag

SEQ ID NO: 338544 - RNA, 27 nt, Human
uucaacagaaaaaaaaaagaaaaagaa

SEQ ID NO: 338545 - RNA, 20 nt, Human
uucaauacuguaucaaacuu

SEQ ID NO: 338546 - RNA, 20 nt, Human
uucuaaucucuuuccugauu

SEQ ID NO: 338547 - RNA, 23 nt, Human
uuuaaagugaacauuuaugucuc

SEQ ID NO: 338548 - RNA, 21 nt, Human
uuugaacaaccagucaucaca

SEQ ID NO: 338549 - RNA, 20 nt, Human
uuuuauaugcugcccuucca

SEQ ID NO: 338550 - RNA, 19 nt, Human
uuuugucucgugccgaauu

SEQ ID NO: 338551 - RNA, 18 nt, Human
uuuuuuuuuuuuuuuuug

SEQ ID NO: 338552 - RNA, 18 nt, Human
aaaaaagaaagucagaca

SEQ ID NO: 338553 - RNA, 18 nt, Human
aaaaaagaaagucagaca

SEQ ID NO: 338554 - RNA, 22 nt, Human
aaacucuacauuuaacuuggau

SEQ ID NO: 338555 - RNA, 20 nt, Human
aacuuggaugaauaccgaug

SEQ ID NO: 338556 - RNA, 19 nt, Human
aagugcccauuuuucagca

SEQ ID NO: 338557 - RNA, 25 nt, Human
acaaaacaaaugcaacgggaaccuu

SEQ ID NO: 338558 - RNA, 20 nt, Human
acacaagaaguauuacauca

SEQ ID NO: 338559 - RNA, 22 nt, Human
aguauucaauuucuuagacaac

SEQ ID NO: 338560 - RNA, 18 nt, Human
agugcccauuuuucagca

SEQ ID NO: 338561 - RNA, 19 nt, Human
augugcauacacacaagaa

SEQ ID NO: 338562 - RNA, 24 nt, Human
auuaguauuuggaacaacacauuu

SEQ ID NO: 338563 - RNA, 23 nt, Human
auuugcuuuagagugggggaccc

SEQ ID NO: 338564 - RNA, 22 nt, Human
caaaaaagaaagucagacagaa

SEQ ID NO: 338565 - RNA, 23 nt, Human
caaggcaggagagugagguggag

SEQ ID NO: 338566 - RNA, 19 nt, Human
cacacaagaaguauuacau

SEQ ID NO: 338567 - RNA, 27 nt, Human
caugugcauacacacaagaaguauuac

SEQ ID NO: 338568 - RNA, 22 nt, Human
cauuucccagcgauaaauuugc

SEQ ID NO: 338569 - RNA, 19 nt, Human
ccaggaagagacauucugu

SEQ ID NO: 338570 - RNA, 21 nt, Human
cccagcgauaaauuugcuuua

SEQ ID NO: 338571 - RNA, 19 nt, Human
cccagcuuggccgcagccg

SEQ ID NO: 338572 - RNA, 19 nt, Human
ccgccgccgccggacgcgu

SEQ ID NO: 338573 - RNA, 21 nt, Human
ccgccgcuaccgccgccgccg

SEQ ID NO: 338574 - RNA, 21 nt, Human
ccgccgcuaccgccgccgccg

SEQ ID NO: 338575 - RNA, 22 nt, Human
ccgccgcuaccgccgccgccgg

SEQ ID NO: 338576 - RNA, 23 nt, Human
ccgccgcuaccgccgccgccgga

SEQ ID NO: 338577 - RNA, 19 nt, Human
ccgcugccgccgcuaccgc

SEQ ID NO: 338578 - RNA, 24 nt, Human
cuccagagccgcgggaugcucgga

SEQ ID NO: 338579 - RNA, 24 nt, Human
cuucauguaaaaucuaaguuucau

SEQ ID NO: 338580 - RNA, 24 nt, Human
cuucauguaaaaucuaaguuucau

SEQ ID NO: 338581 - RNA, 18 nt, Human
gacaugugccuuuccuug

SEQ ID NO: 338582 - RNA, 19 nt, Human
gacccagcuuggccgcagc

SEQ ID NO: 338583 - RNA, 20 nt, Human
gacccuuauggugaggaaau

SEQ ID NO: 338584 - RNA, 22 nt, Human
gauuaaaaaaaaaaauacugug

SEQ ID NO: 338585 - RNA, 19 nt, Human
gccgcagccgcugccgccg

SEQ ID NO: 338586 - RNA, 18 nt, Human
ggaggagcauucugcacu

SEQ ID NO: 338587 - RNA, 22 nt, Human
ggccgggcggcuccagagccgc

SEQ ID NO: 338588 - RNA, 24 nt, Human
ggcgaauagaggugacaugugccu

SEQ ID NO: 338589 - RNA, 18 nt, Human
guggaggagcauucugca

SEQ ID NO: 338590 - RNA, 22 nt, Human
guuucaugugcauacacacaag

SEQ ID NO: 338591 - RNA, 22 nt, Human
uaaaauagaaauauaauguauu

SEQ ID NO: 338592 - RNA, 23 nt, Human
uaaagacauuuauacagaaaaaa

SEQ ID NO: 338593 - RNA, 18 nt, Human
uaccaggaagagacauuc

SEQ ID NO: 338594 - RNA, 25 nt, Human
uaccaggaagagacauucuguuuuc

SEQ ID NO: 338595 - RNA, 21 nt, Human
uacuguguggcgaauagaggu

SEQ ID NO: 338596 - RNA, 21 nt, Human
uacuucaaaaagaacucugaa

SEQ ID NO: 338597 - RNA, 20 nt, Human
uagcagcaauugguuuaaag

SEQ ID NO: 338598 - RNA, 21 nt, Human
uagcagcaauugguuuaaaga

SEQ ID NO: 338599 - RNA, 20 nt, Human
uauacagaaaaaaggcaauu

SEQ ID NO: 338600 - RNA, 20 nt, Human
uauacagaaaaaaggcaauu

SEQ ID NO: 338601 - RNA, 23 nt, Human
uaucaaaaaagaaagucagacag

SEQ ID NO: 338602 - RNA, 22 nt, Human
uaucaaaaaagaaagucagacu

SEQ ID NO: 338603 - RNA, 18 nt, Human
uaucugguuaauauaaaa

SEQ ID NO: 338604 - RNA, 19 nt, Human
uauguauuucagaggguac

SEQ ID NO: 338605 - RNA, 23 nt, Human
uauuucacuuuuuggcaauuaua

SEQ ID NO: 338606 - RNA, 23 nt, Human
uauuuggaacaacacauuuuaac

SEQ ID NO: 338607 - RNA, 24 nt, Human
ucaugugcauacacacaagaagua

SEQ ID NO: 338608 - RNA, 21 nt, Human
ucuaaaaaguggucaucucau

SEQ ID NO: 338609 - RNA, 22 nt, Human
ucuaccaggaagagacauucug

SEQ ID NO: 338610 - RNA, 23 nt, Human
ucuguaaacaaaacaaaugcaac

SEQ ID NO: 338611 - RNA, 18 nt, Human
ugacaugugccuuuccuu

SEQ ID NO: 338612 - RNA, 21 nt, Human
ugagguggaggagcauucugc

SEQ ID NO: 338613 - RNA, 19 nt, Human
ugauugucauuuuacaaau

SEQ ID NO: 338614 - RNA, 19 nt, Human
ugcuacaucagcacugaca

SEQ ID NO: 338615 - RNA, 21 nt, Human
uggaacaacacauuuuaacau

SEQ ID NO: 338616 - RNA, 20 nt, Human
uggcaguggcucuucacugg

SEQ ID NO: 338617 - RNA, 18 nt, Human
uggccaauauucaacuac

SEQ ID NO: 338618 - RNA, 20 nt, Human
uggcggauuaaaaaaaaaaa

SEQ ID NO: 338619 - RNA, 18 nt, Human
uguaaacaaaacaaaugc

SEQ ID NO: 338620 - RNA, 19 nt, Human
uucaaggcaggagagugag

SEQ ID NO: 338621 - RNA, 18 nt, Human
uucacgaauggaaagcac

SEQ ID NO: 338622 - RNA, 20 nt, Human
uucaugugcauacacacagu

SEQ ID NO: 338623 - RNA, 19 nt, Human
uugcauaacacaguaguug

SEQ ID NO: 338624 - RNA, 19 nt, Human
uuggccaauauucaacuac

SEQ ID NO: 338625 - RNA, 19 nt, Human
aaaaagcgcacacccuuga

SEQ ID NO: 338626 - RNA, 25 nt, Human
aaaaagcgcacacccuugacccuuc

SEQ ID NO: 338627 - RNA, 21 nt, Human
aaagcacccaggccucgagca

SEQ ID NO: 338628 - RNA, 18 nt, Human
aggccucgagcagaucuu

SEQ ID NO: 338629 - RNA, 19 nt, Human
aggccucgagcagaucuuu

SEQ ID NO: 338630 - RNA, 24 nt, Human
aguuaugucaaaagaaaaaauaua

SEQ ID NO: 338631 - RNA, 21 nt, Human
aucccagagccucuccccacc

SEQ ID NO: 338632 - RNA, 25 nt, Human
auccucccuugacccuucaaagcug

SEQ ID NO: 338633 - RNA, 21 nt, Human
caaaaagcgcacacccuugaa

SEQ ID NO: 338634 - RNA, 25 nt, Human
cacaauucgcuggcucagggaagcc

SEQ ID NO: 338635 - RNA, 18 nt, Human
cagaccggccucgcccug

SEQ ID NO: 338636 - RNA, 23 nt, Human
cagcaggcgaacgugccccuucu

SEQ ID NO: 338637 - RNA, 23 nt, Human
ccagagccucuccccaccgagaa

SEQ ID NO: 338638 - RNA, 18 nt, Human
cccagagccucuccccac

SEQ ID NO: 338639 - RNA, 18 nt, Human
ccccuaaaggcccgaguu

SEQ ID NO: 338640 - RNA, 19 nt, Human
cgacaccaaagcacccagg

SEQ ID NO: 338641 - RNA, 24 nt, Human
cgauuguaugaacuuauucucaaa

SEQ ID NO: 338642 - RNA, 18 nt, Human
cuccgacaccaaagcacc

SEQ ID NO: 338643 - RNA, 21 nt, Human
cugcagcaggaaagggaagga

SEQ ID NO: 338644 - RNA, 20 nt, Human
cugcuaauaaacaggcuuug

SEQ ID NO: 338645 - RNA, 20 nt, Human
cugcuaauaaacaggcuuug

SEQ ID NO: 338646 - RNA, 19 nt, Human
cuguccuguguccgacucu

SEQ ID NO: 338647 - RNA, 21 nt, Human
cuguccuguguccgacucucc

SEQ ID NO: 338648 - RNA, 23 nt, Human
cuucaaagcuguaacaguaguua

SEQ ID NO: 338649 - RNA, 23 nt, Human
gaaaggaagugauccgcuacaga

SEQ ID NO: 338650 - RNA, 20 nt, Human
gacaccaaagcacccaggcc

SEQ ID NO: 338651 - RNA, 27 nt, Human
gaugaaacaaaaagcgcacacccuuga

SEQ ID NO: 338652 - RNA, 23 nt, Human
ggaucuccgacaccaaagcaccc

SEQ ID NO: 338653 - RNA, 21 nt, Human
uaagacgauuguaugaacuua

SEQ ID NO: 338654 - RNA, 22 nt, Human
uaguuaugucaaaagaaaaaau

SEQ ID NO: 338655 - RNA, 19 nt, Human
uccgacucucggaucuccg

SEQ ID NO: 338656 - RNA, 23 nt, Human
ucuaacuacaaaaauaauggcau

SEQ ID NO: 338657 - RNA, 21 nt, Human
ucuccgacucucggaucuccg

SEQ ID NO: 338658 - RNA, 28 nt, Human
ugaaacaaaaagcgcacacccuugaccc

SEQ ID NO: 338659 - RNA, 21 nt, Human
ugcagcaggaaagggaagggg

SEQ ID NO: 338660 - RNA, 18 nt, Human
ugcauggaaaagaauggg

SEQ ID NO: 338661 - RNA, 21 nt, Human
ugccccuaaaggcccgaguuc

SEQ ID NO: 338662 - RNA, 19 nt, Human
uggggagaucagaagaccg

SEQ ID NO: 338663 - RNA, 23 nt, Human
uucaaaaagauaguuaugucaaa

SEQ ID NO: 338664 - RNA, 25 nt, Human
uucccuuguuuuauacuggaaaauu

SEQ ID NO: 338665 - RNA, 24 nt, Human
uugacuguccgguguccgacuguc

SEQ ID NO: 338666 - RNA, 21 nt, Human
uugcauaaaccaucuuuaauu

SEQ ID NO: 338667 - RNA, 18 nt, Human
uuuuuuuuuuuuuuuuug

SEQ ID NO: 338668 - RNA, 21 nt, Human
uuuuuuuuuuuuuuuuugcau

SEQ ID NO: 338669 - RNA, 24 nt, Human
uuuuuuuuuuuuuuuuuugcauaa

SEQ ID NO: 338670 - RNA, 21 nt, Human
aaacaggacucacaaugaaca

SEQ ID NO: 338671 - RNA, 24 nt, Human
aaagugcugguauaacagguauga

SEQ ID NO: 338672 - RNA, 18 nt, Human
aaauaaaaacacacagcc

SEQ ID NO: 338673 - RNA, 21 nt, Human
aacaaacugacaagaaaccua

SEQ ID NO: 338674 - RNA, 22 nt, Human
aaccaggccacugaugcacuaa

SEQ ID NO: 338675 - RNA, 19 nt, Human
aaccgcuggcugccacagc

SEQ ID NO: 338676 - RNA, 24 nt, Human
aaccugacuacaccaagcagcccu

SEQ ID NO: 338677 - RNA, 24 nt, Human
aacuccuccugggugucucuccug

SEQ ID NO: 338678 - RNA, 26 nt, Human
aagaaaccuacagcuuccuuugcaga

SEQ ID NO: 338679 - RNA, 20 nt, Human
aagaucccaggaaacaacag

SEQ ID NO: 338680 - RNA, 23 nt, Human
aagcagcccucagacucuucccg

SEQ ID NO: 338681 - RNA, 25 nt, Human
aagcgauccucccacuucagccucc

SEQ ID NO: 338682 - RNA, 19 nt, Human
aaggacaccacucagaaua

SEQ ID NO: 338683 - RNA, 26 nt, Human
aaggagacaggcacgaggcugcucaa

SEQ ID NO: 338684 - RNA, 20 nt, Human
acaaccugacuacaccaagc

SEQ ID NO: 338685 - RNA, 24 nt, Human
acacaaccccaacucagagaagcc

SEQ ID NO: 338686 - RNA, 22 nt, Human
acagguaugagccaccauggcc

SEQ ID NO: 338687 - RNA, 24 nt, Human
accaaaauguaaaaacuccuccug

SEQ ID NO: 338688 - RNA, 20 nt, Human
accccagccccuggcaaccg

SEQ ID NO: 338689 - RNA, 23 nt, Human
acuccuccugggugucucuccug

SEQ ID NO: 338690 - RNA, 23 nt, Human
acuucagccucccaaagugcugg

SEQ ID NO: 338691 - RNA, 18 nt, Human
agacagggucuugccaug

SEQ ID NO: 338692 - RNA, 23 nt, Human
agacagggucuugccauguugcc

SEQ ID NO: 338693 - RNA, 24 nt, Human
agacucuucccguggccccugccc

SEQ ID NO: 338694 - RNA, 23 nt, Human
agagacagcaguuuggagaagaa

SEQ ID NO: 338695 - RNA, 18 nt, Human
agaggcccuugggaggac

SEQ ID NO: 338696 - RNA, 19 nt, Human
agaugccgaggccucaagc

SEQ ID NO: 338697 - RNA, 23 nt, Human
agcauuccagagccucagacagc

SEQ ID NO: 338698 - RNA, 21 nt, Human
agccaagaacacagaaccggc

SEQ ID NO: 338699 - RNA, 22 nt, Human
agcccaccccacuagcucuguc

SEQ ID NO: 338700 - RNA, 19 nt, Human
aggaccuguucccuugccu

SEQ ID NO: 338701 - RNA, 24 nt, Human
aggccaaauuagagacagcaguuu

SEQ ID NO: 338702 - RNA, 19 nt, Human
agguaaguuggggccacag

SEQ ID NO: 338703 - RNA, 22 nt, Human
augaacaggaacacuuggcccu

SEQ ID NO: 338704 - RNA, 23 nt, Human
auggccuuugcaggcaggugucc

SEQ ID NO: 338705 - RNA, 24 nt, Human
auuccagccugcugccuggauuuc

SEQ ID NO: 338706 - RNA, 24 nt, Human
caaagugcugguauaacagguaug

SEQ ID NO: 338707 - RNA, 25 nt, Human
caaccccaacucagagaagccaaag

SEQ ID NO: 338708 - RNA, 27 nt, Human
caagcgauccucccacuucagccuccc

SEQ ID NO: 338709 - RNA, 18 nt, Human
cacagaaccggccguggu

SEQ ID NO: 338710 - RNA, 18 nt, Human
cacauguagcaaaggaga

SEQ ID NO: 338711 - RNA, 25 nt, Human
caccccacuagcucugucccucacu

SEQ ID NO: 338712 - RNA, 19 nt, Human
cacccccagccccaagauc

SEQ ID NO: 338713 - RNA, 22 nt, Human
cacugcagccgaccacuuuugc

SEQ ID NO: 338714 - RNA, 26 nt, Human
cagaccccacaacaaacugacaagaa

SEQ ID NO: 338715 - RNA, 19 nt, Human
cagcagcguuuauuccagc

SEQ ID NO: 338716 - RNA, 20 nt, Human
cagcagcguuuauuccagcc

SEQ ID NO: 338717 - RNA, 24 nt, Human
cagccccuggcaaccaggccacug

SEQ ID NO: 338718 - RNA, 24 nt, Human
cagggucuugccauguugcccagg

SEQ ID NO: 338719 - RNA, 21 nt, Human
caguagccaauacagacauac

SEQ ID NO: 338720 - RNA, 19 nt, Human
cauguugcccaggcugguc

SEQ ID NO: 338721 - RNA, 20 nt, Human
cauguugcccaggcuggucu

SEQ ID NO: 338722 - RNA, 24 nt, Human
cauguugcccaggcuggucuugaa

SEQ ID NO: 338723 - RNA, 20 nt, Human
ccaaagugcugguauaacag

SEQ ID NO: 338724 - RNA, 21 nt, Human
ccaaagugcugguauaacagg

SEQ ID NO: 338725 - RNA, 24 nt, Human
ccaaagugcugguauaacagguau

SEQ ID NO: 338726 - RNA, 22 nt, Human
ccaagaacacagaaccggccgu

SEQ ID NO: 338727 - RNA, 21 nt, Human
ccacaaagccgauggcucaga

SEQ ID NO: 338728 - RNA, 26 nt, Human
ccacaacaaacugacaagaaaccuac

SEQ ID NO: 338729 - RNA, 22 nt, Human
ccacagaggccaaauuagagac

SEQ ID NO: 338730 - RNA, 20 nt, Human
ccacucagaauacugagcaa

SEQ ID NO: 338731 - RNA, 21 nt, Human
ccagccccaagaucccaggaa

SEQ ID NO: 338732 - RNA, 18 nt, Human
ccagccccuggcaaccag

SEQ ID NO: 338733 - RNA, 18 nt, Human
ccauggccggcucuggga

SEQ ID NO: 338734 - RNA, 19 nt, Human
ccauguugcccaggcuggu

SEQ ID NO: 338735 - RNA, 21 nt, Human
ccauguugcccaggcuggucu

SEQ ID NO: 338736 - RNA, 21 nt, Human
ccauguugcccaggcuggucu

SEQ ID NO: 338737 - RNA, 22 nt, Human
cccacaacaaacugacaagaaa

SEQ ID NO: 338738 - RNA, 21 nt, Human
cccagagaaaguagcuacaga

SEQ ID NO: 338739 - RNA, 24 nt, Human
cccagccccuggcaaccaggccac

SEQ ID NO: 338740 - RNA, 20 nt, Human
cccaggcucaagcgauccuc

SEQ ID NO: 338741 - RNA, 23 nt, Human
cccaggcucaagcgauccuccca

SEQ ID NO: 338742 - RNA, 19 nt, Human
cccaugugccucagacccc

SEQ ID NO: 338743 - RNA, 19 nt, Human
ccccaagaucccaggaaac

SEQ ID NO: 338744 - RNA, 22 nt, Human
ccccacuagcucugucccucac

SEQ ID NO: 338745 - RNA, 23 nt, Human
ccccagccccuggcaaccaggcc

SEQ ID NO: 338746 - RNA, 19 nt, Human
ccccauguccaaugugucu

SEQ ID NO: 338747 - RNA, 24 nt, Human
cccuauacacaaccccaacucaga

SEQ ID NO: 338748 - RNA, 21 nt, Human
cccucagacucuucccguggc

SEQ ID NO: 338749 - RNA, 22 nt, Human
cccugccccaucgccugcagaa

SEQ ID NO: 338750 - RNA, 19 nt, Human
cccuuggaacugaguggcu

SEQ ID NO: 338751 - RNA, 22 nt, Human
ccgcccaagaauuaaaggcugc

SEQ ID NO: 338752 - RNA, 21 nt, Human
ccucagaccccacaacaaacu

SEQ ID NO: 338753 - RNA, 23 nt, Human
ccucagacucuucccguggcccc

SEQ ID NO: 338754 - RNA, 26 nt, Human
ccucccacuucagccucccaaagugc

SEQ ID NO: 338755 - RNA, 18 nt, Human
ccugcaggcacucacagc

SEQ ID NO: 338756 - RNA, 21 nt, Human
ccuggaccccagccccuggcc

SEQ ID NO: 338757 - RNA, 23 nt, Human
ccuggcacugcagccgaccacuu

SEQ ID NO: 338758 - RNA, 23 nt, Human
cgaagaccccuauacacaacccc

SEQ ID NO: 338759 - RNA, 23 nt, Human
cgaagaccccuauacacaacccc

SEQ ID NO: 338760 - RNA, 21 nt, Human
cgcaacaccgucaccuggacu

SEQ ID NO: 338761 - RNA, 25 nt, Human
cuaagucugaagcaaucacgucagc

SEQ ID NO: 338762 - RNA, 24 nt, Human
cucaagcgauccucccacuucagc

SEQ ID NO: 338763 - RNA, 20 nt, Human
cucacugacacuuugcucca

SEQ ID NO: 338764 - RNA, 22 nt, Human
cucauuaguuaacugaccugag

SEQ ID NO: 338765 - RNA, 23 nt, Human
cucccaugugccucagaccccac

SEQ ID NO: 338766 - RNA, 18 nt, Human
cugcugagcccaccccac

SEQ ID NO: 338767 - RNA, 24 nt, Human
cugcugagcccaccccacuagcuc

SEQ ID NO: 338768 - RNA, 18 nt, Human
cugucccucacugccagg

SEQ ID NO: 338769 - RNA, 18 nt, Human
cuucccguggccccugcc

SEQ ID NO: 338770 - RNA, 24 nt, Human
cuucugcugagcccaccccacuag

SEQ ID NO: 338771 - RNA, 20 nt, Human
cuuuugcugggcguggucuu

SEQ ID NO: 338772 - RNA, 23 nt, Human
gaaaauagcuucaguccagaagc

SEQ ID NO: 338773 - RNA, 21 nt, Human
gaagaccccuauacacaaccc

SEQ ID NO: 338774 - RNA, 21 nt, Human
gaaggcagaggcccuugggag

SEQ ID NO: 338775 - RNA, 20 nt, Human
gagaugaauccaagagcuuu

SEQ ID NO: 338776 - RNA, 18 nt, Human
gaugccagaagucccagc

SEQ ID NO: 338777 - RNA, 22 nt, Human
gcaaaaaccaagauggcccagg

SEQ ID NO: 338778 - RNA, 21 nt, Human
gcagaguuaacccuccagaga

SEQ ID NO: 338779 - RNA, 24 nt, Human
gccccaagaucccaggaaacaaca

SEQ ID NO: 338780 - RNA, 23 nt, Human
gccucaagcuggagguugcuuca

SEQ ID NO: 338781 - RNA, 19 nt, Human
gccuggacacaaccugacu

SEQ ID NO: 338782 - RNA, 25 nt, Human
ggaaaaccgcuggcugccacagccc

SEQ ID NO: 338783 - RNA, 23 nt, Human
ggacaggcagaguuaacccucca

SEQ ID NO: 338784 - RNA, 24 nt, Human
ggccucaagcuggagguugcuuca

SEQ ID NO: 338785 - RNA, 24 nt, Human
ggcuggucuugaacucccaggcuc

SEQ ID NO: 338786 - RNA, 22 nt, Human
gguggaacaugaugaccacaaa

SEQ ID NO: 338787 - RNA, 23 nt, Human
guagagacagggucuugccaugu

SEQ ID NO: 338788 - RNA, 21 nt, Human
uaaaaacacacagcccaaaga

SEQ ID NO: 338789 - RNA, 24 nt, Human
uaaacacacagagaaacaagaaga

SEQ ID NO: 338790 - RNA, 23 nt, Human
uaaaugaucucacugacacuuug

SEQ ID NO: 338791 - RNA, 20 nt, Human
uaacagguaugagccaccau

SEQ ID NO: 338792 - RNA, 22 nt, Human
uaagucugaagcaaucacguca

SEQ ID NO: 338793 - RNA, 23 nt, Human
uaaguuggggccacaggcuucug

SEQ ID NO: 338794 - RNA, 21 nt, Human
uacagacauaccagcagcguu

SEQ ID NO: 338795 - RNA, 22 nt, Human
uagagacagggucuugccaugu

SEQ ID NO: 338796 - RNA, 20 nt, Human
uagccaagaacacagaaccg

SEQ ID NO: 338797 - RNA, 24 nt, Human
uaguagagacagggucuugccaug

SEQ ID NO: 338798 - RNA, 21 nt, Human
ucaaagcacaugacuccccga

SEQ ID NO: 338799 - RNA, 18 nt, Human
ucacugacacuuugcucc

SEQ ID NO: 338800 - RNA, 20 nt, Human
ucacuggucaacaggaggag

SEQ ID NO: 338801 - RNA, 19 nt, Human
ucauccgacaggaucauuc

SEQ ID NO: 338802 - RNA, 20 nt, Human
uccacagaugccuggacccc

SEQ ID NO: 338803 - RNA, 21 nt, Human
uccacagaugccuggacccca

SEQ ID NO: 338804 - RNA, 18 nt, Human
uccacauauaaaauaagu

SEQ ID NO: 338805 - RNA, 20 nt, Human
uccacauauaaaauaaguca

SEQ ID NO: 338806 - RNA, 23 nt, Human
ucccaaagugcugguauaacagg

SEQ ID NO: 338807 - RNA, 21 nt, Human
ucccaggcucaagcgauccuc

SEQ ID NO: 338808 - RNA, 25 nt, Human
ucccguggccccugccccaucgccu

SEQ ID NO: 338809 - RNA, 24 nt, Human
ucccugugacacuaaaagacacuc

SEQ ID NO: 338810 - RNA, 18 nt, Human
ucgcuggugggaggcugc

SEQ ID NO: 338811 - RNA, 19 nt, Human
ucucaagaugccgaggccu

SEQ ID NO: 338812 - RNA, 22 nt, Human
ucucuccugcaggcacucacag

SEQ ID NO: 338813 - RNA, 18 nt, Human
ucugcugagcccacccca

SEQ ID NO: 338814 - RNA, 21 nt, Human
ucugcuggucccacucccaug

SEQ ID NO: 338815 - RNA, 18 nt, Human
ucuggucgcaaaggcugc

SEQ ID NO: 338816 - RNA, 23 nt, Human
ucuugccauguugcccaggcugg

SEQ ID NO: 338817 - RNA, 24 nt, Human
ucuugccauguugcccaggcuggu

SEQ ID NO: 338818 - RNA, 25 nt, Human
ugaacucccaggcucaagcgauccu

SEQ ID NO: 338819 - RNA, 18 nt, Human
ugaaggcagaggcccuug

SEQ ID NO: 338820 - RNA, 24 nt, Human
ugaaugaaugaguaaacacacaga

SEQ ID NO: 338821 - RNA, 23 nt, Human
ugacaagaaaccuacagcuuccu

SEQ ID NO: 338822 - RNA, 21 nt, Human
ugacuacaccaagcagcccuc

SEQ ID NO: 338823 - RNA, 20 nt, Human
ugagaacuauucuuaggaag

SEQ ID NO: 338824 - RNA, 19 nt, Human
ugagaugaauccaagagcu

SEQ ID NO: 338825 - RNA, 22 nt, Human
ugaggacgccacugaaaaucag

SEQ ID NO: 338826 - RNA, 19 nt, Human
ugcacccacuucugcugag

SEQ ID NO: 338827 - RNA, 19 nt, Human
ugcaggcaggugucccuug

SEQ ID NO: 338828 - RNA, 22 nt, Human
ugccacagaggccaaauuagag

SEQ ID NO: 338829 - RNA, 27 nt, Human
ugccauguugcccaggcuggucuugaa

SEQ ID NO: 338830 - RNA, 21 nt, Human
ugcccaggcuggucuugaacu

SEQ ID NO: 338831 - RNA, 22 nt, Human
ugcugccuggauuucagaauca

SEQ ID NO: 338832 - RNA, 22 nt, Human
uggaaauaaaaacacacagccc

SEQ ID NO: 338833 - RNA, 23 nt, Human
uggaaauaaaaacacacagccca

SEQ ID NO: 338834 - RNA, 24 nt, Human
uggaccccagccccuggcaaccag

SEQ ID NO: 338835 - RNA, 20 nt, Human
uggcacagagcuggcaucag

SEQ ID NO: 338836 - RNA, 24 nt, Human
uggcaggcggagcagacccugggg

SEQ ID NO: 338837 - RNA, 22 nt, Human
uggcuuguggggccagccaucc

SEQ ID NO: 338838 - RNA, 21 nt, Human
ugggcguggucuugccacaga

SEQ ID NO: 338839 - RNA, 24 nt, Human
ugguauaacagguaugagccacca

SEQ ID NO: 338840 - RNA, 21 nt, Human
uguaaaaacuccuccugggug

SEQ ID NO: 338841 - RNA, 23 nt, Human
uguaaaaacuccuccuggguguc

SEQ ID NO: 338842 - RNA, 24 nt, Human
uuaguagagacagggucuugccau

SEQ ID NO: 338843 - RNA, 19 nt, Human
uucagccucccaaagugcu

SEQ ID NO: 338844 - RNA, 25 nt, Human
uuccagagccucagacagccccaga

SEQ ID NO: 338845 - RNA, 21 nt, Human
uuccagccugcugccuggauu

SEQ ID NO: 338846 - RNA, 21 nt, Human
uuccucaccagaaauaagagc

SEQ ID NO: 338847 - RNA, 19 nt, Human
uucuuaggaagcaaauauc

SEQ ID NO: 338848 - RNA, 25 nt, Human
aacuauugaagauuaacaaggcaaa

SEQ ID NO: 338849 - RNA, 22 nt, Human
aaucucuugcuuaagaggcaaa

SEQ ID NO: 338850 - RNA, 21 nt, Human
acaaggcaaacucagcagaga

SEQ ID NO: 338851 - RNA, 23 nt, Human
accuuccuuaaaaccuccucuca

SEQ ID NO: 338852 - RNA, 19 nt, Human
auuaccuuccuuaaaaccu

SEQ ID NO: 338853 - RNA, 21 nt, Human
caacuuuggaucccacugagg

SEQ ID NO: 338854 - RNA, 19 nt, Human
ccagguugaguugaguugg

SEQ ID NO: 338855 - RNA, 19 nt, Human
ccuuaaaaccuccucucag

SEQ ID NO: 338856 - RNA, 24 nt, Human
ccuuccuuaaaaccuccucucaga

SEQ ID NO: 338857 - RNA, 26 nt, Human
uaacugaaaaacaacuuuggauccca

SEQ ID NO: 338858 - RNA, 22 nt, Human
ucugagacacccacaccuucaa

SEQ ID NO: 338859 - RNA, 22 nt, Human
ugaaaaacaacuuuggauccca

SEQ ID NO: 338860 - RNA, 20 nt, Human
ugagaguggggauuauacag

SEQ ID NO: 338861 - RNA, 24 nt, Human
uugagaguggggauuauacagacu

SEQ ID NO: 338862 - RNA, 24 nt, Human
uugcuggaucaguucuagacaugu

SEQ ID NO: 338863 - RNA, 23 nt, Human
uuuaggguuccaaagacuggggu

SEQ ID NO: 338864 - RNA, 22 nt, Human
aagacaaugagaagauucagac

SEQ ID NO: 338865 - RNA, 19 nt, Human
aagggccagaacaggggca

SEQ ID NO: 338866 - RNA, 18 nt, Human
aaguaguagcagugggag

SEQ ID NO: 338867 - RNA, 19 nt, Human
aaucugagguggcuuuuca

SEQ ID NO: 338868 - RNA, 23 nt, Human
acaaaggagaacuucuccuuaca

SEQ ID NO: 338869 - RNA, 19 nt, Human
acccuagaaguacagagaa

SEQ ID NO: 338870 - RNA, 21 nt, Human
accuugauauccuuuacauua

SEQ ID NO: 338871 - RNA, 21 nt, Human
agaaagagacagaaacaccug

SEQ ID NO: 338872 - RNA, 22 nt, Human
agaaagagacagaaacaccugg

SEQ ID NO: 338873 - RNA, 21 nt, Human
agacaucagacccucuggaac

SEQ ID NO: 338874 - RNA, 20 nt, Human
agacgugacucagaaagaga

SEQ ID NO: 338875 - RNA, 22 nt, Human
agccacaaaggcacccucagcc

SEQ ID NO: 338876 - RNA, 21 nt, Human
aggagaccagggacccacuac

SEQ ID NO: 338877 - RNA, 19 nt, Human
aggugccagacaucagacc

SEQ ID NO: 338878 - RNA, 21 nt, Human
agucaggcuagcacaguaggc

SEQ ID NO: 338879 - RNA, 25 nt, Human
auaagacaagaauaaaccuuccuuu

SEQ ID NO: 338880 - RNA, 21 nt, Human
aucagcaaucuuuguuggcug

SEQ ID NO: 338881 - RNA, 24 nt, Human
aucauccuuccauuucuugaaucc

SEQ ID NO: 338882 - RNA, 25 nt, Human
augcagcagacugauccgguggggg

SEQ ID NO: 338883 - RNA, 24 nt, Human
caagacauaagacaagaauaaacc

SEQ ID NO: 338884 - RNA, 20 nt, Human
caauccagacauugcuaucc

SEQ ID NO: 338885 - RNA, 21 nt, Human
caccagguuaccugaauucau

SEQ ID NO: 338886 - RNA, 19 nt, Human
cacccuuccucuaucccag

SEQ ID NO: 338887 - RNA, 19 nt, Human
cagaaagagacagaaacac

SEQ ID NO: 338888 - RNA, 18 nt, Human
cagagauaaauaggagag

SEQ ID NO: 338889 - RNA, 22 nt, Human
cagagauaaauaggagaggaug

SEQ ID NO: 338890 - RNA, 19 nt, Human
cagcaguagauucuccucc

SEQ ID NO: 338891 - RNA, 18 nt, Human
cagcauagcauuagaugg

SEQ ID NO: 338892 - RNA, 18 nt, Human
cagcuuuaagcuuaucuc

SEQ ID NO: 338893 - RNA, 21 nt, Human
caggagguagaagaugcagca

SEQ ID NO: 338894 - RNA, 20 nt, Human
caggucaagacauaagacaa

SEQ ID NO: 338895 - RNA, 23 nt, Human
ccacagggaaccaugacaccuca

SEQ ID NO: 338896 - RNA, 25 nt, Human
ccuccuggcugcaggacucagcaaa

SEQ ID NO: 338897 - RNA, 22 nt, Human
ccugguuuuucuuuccugaggc

SEQ ID NO: 338898 - RNA, 26 nt, Human
cuacuccacugauaauggcaguucua

SEQ ID NO: 338899 - RNA, 22 nt, Human
cugguagaccaauucuagacgu

SEQ ID NO: 338900 - RNA, 24 nt, Human
cuuacaagaaucauccuuccauuu

SEQ ID NO: 338901 - RNA, 21 nt, Human
cuuccauuucuugaauccuau

SEQ ID NO: 338902 - RNA, 20 nt, Human
cuucugggcagcugaucugg

SEQ ID NO: 338903 - RNA, 19 nt, Human
gaaacuaguuccugguuuu

SEQ ID NO: 338904 - RNA, 22 nt, Human
gacucagaaagagacagaaaca

SEQ ID NO: 338905 - RNA, 25 nt, Human
gauggggaagggccagaacaggggc

SEQ ID NO: 338906 - RNA, 20 nt, Human
gcacuggugccuucugggca

SEQ ID NO: 338907 - RNA, 21 nt, Human
gcagaggagagaugguccaga

SEQ ID NO: 338908 - RNA, 23 nt, Human
ggacucagcaaaaauaaagagga

SEQ ID NO: 338909 - RNA, 21 nt, Human
gguagaagaugcagcagacug

SEQ ID NO: 338910 - RNA, 19 nt, Human
uaacagagaugauaacaca

SEQ ID NO: 338911 - RNA, 18 nt, Human
uaggagaggauggcaaua

SEQ ID NO: 338912 - RNA, 18 nt, Human
uaucccaguccccggucg

SEQ ID NO: 338913 - RNA, 22 nt, Human
uauggucuacagaaggcucuuc

SEQ ID NO: 338914 - RNA, 19 nt, Human
ucagaaagagacagaaaca

SEQ ID NO: 338915 - RNA, 21 nt, Human
ucagcaaaaauaaagaggaaa

SEQ ID NO: 338916 - RNA, 21 nt, Human
ucccaggauuuguaggagacc

SEQ ID NO: 338917 - RNA, 18 nt, Human
uccugaggccccaaaagu

SEQ ID NO: 338918 - RNA, 22 nt, Human
ucuggaaccugauaaucaggag

SEQ ID NO: 338919 - RNA, 29 nt, Human
ugaaacacacaggaaauucaggggagucc

SEQ ID NO: 338920 - RNA, 25 nt, Human
ugaagucaggcuagcacaguaggca

SEQ ID NO: 338921 - RNA, 18 nt, Human
ugacucagaaagagacag

SEQ ID NO: 338922 - RNA, 26 nt, Human
ugacucagaaagagacagaaacaccu

SEQ ID NO: 338923 - RNA, 21 nt, Human
ugccaaacgauaaguguucua

SEQ ID NO: 338924 - RNA, 18 nt, Human
ugccacagggaaccauga

SEQ ID NO: 338925 - RNA, 18 nt, Human
ugccagacaucagacccu

SEQ ID NO: 338926 - RNA, 22 nt, Human
ugccuucugggcagcugaucug

SEQ ID NO: 338927 - RNA, 20 nt, Human
ugcuuaaggagcaaaucagc

SEQ ID NO: 338928 - RNA, 19 nt, Human
uggaauguucaccuaccuc

SEQ ID NO: 338929 - RNA, 20 nt, Human
uggagagagaugguccaguu

SEQ ID NO: 338930 - RNA, 24 nt, Human
uggcugcaggacucagcaaaaaua

SEQ ID NO: 338931 - RNA, 23 nt, Human
uggggaagggccagaacaggggc

SEQ ID NO: 338932 - RNA, 21 nt, Human
uguauuacccuccuggcugca

SEQ ID NO: 338933 - RNA, 23 nt, Human
uuacccuccuggcugcaggacuc

SEQ ID NO: 338934 - RNA, 19 nt, Human
uuaguauaccuugcgguuc

SEQ ID NO: 338935 - RNA, 18 nt, Human
uuccuggaauguucaccu

SEQ ID NO: 338936 - RNA, 20 nt, Human
aacacaccccaccagaaucc

SEQ ID NO: 338937 - RNA, 22 nt, Human
aaccccuucuggauccuggaga

SEQ ID NO: 338938 - RNA, 26 nt, Human
aagaauaaaauauggcuccccccucc

SEQ ID NO: 338939 - RNA, 20 nt, Human
acaaugccagugccauacag

SEQ ID NO: 338940 - RNA, 22 nt, Human
aggaagacauccacaaaguugg

SEQ ID NO: 338941 - RNA, 21 nt, Human
agugccauacaggggcuggua

SEQ ID NO: 338942 - RNA, 22 nt, Human
auaaggcuuugugggcucaaag

SEQ ID NO: 338943 - RNA, 19 nt, Human
auuguucacuaaaaacuau

SEQ ID NO: 338944 - RNA, 22 nt, Human
caaggaaguccagaccaaaccc

SEQ ID NO: 338945 - RNA, 22 nt, Human
caaugccagugccauacagggg

SEQ ID NO: 338946 - RNA, 30 nt, Human
caucaggacaggggaaaaguuugaguuucc

SEQ ID NO: 338947 - RNA, 22 nt, Human
ccaaaaagagagagagauacaa

SEQ ID NO: 338948 - RNA, 18 nt, Human
ccacaaaguugggggcag

SEQ ID NO: 338949 - RNA, 20 nt, Human
cccagcugcgacccggcccc

SEQ ID NO: 338950 - RNA, 18 nt, Human
ccccagcuccccccuuuc

SEQ ID NO: 338951 - RNA, 18 nt, Human
ccccugcaaccagugcuc

SEQ ID NO: 338952 - RNA, 20 nt, Human
cccggccccgccucgugccg

SEQ ID NO: 338953 - RNA, 18 nt, Human
cugacaauaaaagaauaa

SEQ ID NO: 338954 - RNA, 21 nt, Human
cuggauccuggagagagccag

SEQ ID NO: 338955 - RNA, 18 nt, Human
gaacacaccccaccagaa

SEQ ID NO: 338956 - RNA, 18 nt, Human
gaguagaaagagcaagag

SEQ ID NO: 338957 - RNA, 18 nt, Human
gauccuggagagagccag

SEQ ID NO: 338958 - RNA, 18 nt, Human
gcacuguuuccuucagcc

SEQ ID NO: 338959 - RNA, 19 nt, Human
ggaggauggggauggggga

SEQ ID NO: 338960 - RNA, 22 nt, Human
ggauccuggagagagccagugc

SEQ ID NO: 338961 - RNA, 24 nt, Human
ggcacagggacaaugccagugcca

SEQ ID NO: 338962 - RNA, 21 nt, Human
ggcuuugugggcucaaaggcc

SEQ ID NO: 338963 - RNA, 19 nt, Human
gugcucuggggagggcagg

SEQ ID NO: 338964 - RNA, 25 nt, Human
gugcuuugauuguucacuaaaaacu

SEQ ID NO: 338965 - RNA, 19 nt, Human
guugggggcaguuggaaca

SEQ ID NO: 338966 - RNA, 23 nt, Human
uaagcaccuccaaaaagagagag

SEQ ID NO: 338967 - RNA, 18 nt, Human
uacagagaagggagcuga

SEQ ID NO: 338968 - RNA, 21 nt, Human
uaccagaagcuggaggauggg

SEQ ID NO: 338969 - RNA, 18 nt, Human
uaggagaguaccagaagc

SEQ ID NO: 338970 - RNA, 26 nt, Human
uaggcacagggacaaugccagugcca

SEQ ID NO: 338971 - RNA, 21 nt, Human
uauggcuccccccuccaagga

SEQ ID NO: 338972 - RNA, 22 nt, Human
ucaggacaggggaaaaguuuga

SEQ ID NO: 338973 - RNA, 24 nt, Human
uccaaaaagagagagagauacaga

SEQ ID NO: 338974 - RNA, 27 nt, Human
uccaaggaagacauccacaaaguuggg

SEQ ID NO: 338975 - RNA, 20 nt, Human
uccccagcuccccccuuucc

SEQ ID NO: 338976 - RNA, 20 nt, Human
uccccugcaaccagugcucu

SEQ ID NO: 338977 - RNA, 23 nt, Human
ucuggauccuggagagagccagu

SEQ ID NO: 338978 - RNA, 20 nt, Human
ugacuggagagcugccagcc

SEQ ID NO: 338979 - RNA, 21 nt, Human
ugccagccugcucucccccac

SEQ ID NO: 338980 - RNA, 24 nt, Human
ugccguccagcuuggcaacagcuu

SEQ ID NO: 338981 - RNA, 20 nt, Human
ugcuucugucucuaggagag

SEQ ID NO: 338982 - RNA, 23 nt, Human
uggaggauggggaugggggaccc

SEQ ID NO: 338983 - RNA, 24 nt, Human
ugugggcucaaaggccuuaccucc

SEQ ID NO: 338984 - RNA, 21 nt, Human
uucagaguagaaagagcaaga

SEQ ID NO: 338985 - RNA, 20 nt, Human
uuccccagcuccccccuuuc

SEQ ID NO: 338986 - RNA, 23 nt, Human
uugcacuguuuccuucagccaug

SEQ ID NO: 338987 - RNA, 23 nt, Human
aaaaaacaauccacgaagaaaac

SEQ ID NO: 338988 - RNA, 18 nt, Human
aaaaauggcaguuacugu

SEQ ID NO: 338989 - RNA, 20 nt, Human
aaaacacaaugaaaaaacaa

SEQ ID NO: 338990 - RNA, 21 nt, Human
aaauagcuuugugaccaagaa

SEQ ID NO: 338991 - RNA, 25 nt, Human
aagaauguuaaauacugugcuaaau

SEQ ID NO: 338992 - RNA, 19 nt, Human
acaaugaaaaaacaaccac

SEQ ID NO: 338993 - RNA, 22 nt, Human
acagugugggaaagugguguac

SEQ ID NO: 338994 - RNA, 23 nt, Human
accaaguccuucacagauauuuc

SEQ ID NO: 338995 - RNA, 21 nt, Human
accacuguuuuacaaaucacu

SEQ ID NO: 338996 - RNA, 23 nt, Human
acccuagagugcaaccuuucagu

SEQ ID NO: 338997 - RNA, 25 nt, Human
acgaagaaaacacaaugaaaaaaca

SEQ ID NO: 338998 - RNA, 18 nt, Human
agaaaaaacaauccacga

SEQ ID NO: 338999 - RNA, 21 nt, Human
agaaaaaacaauccacgaaga

SEQ ID NO: 339000 - RNA, 22 nt, Human
agagcuacagggccauuauaau

SEQ ID NO: 339001 - RNA, 21 nt, Human
aggcgagaagaaggcggacgg

SEQ ID NO: 339002 - RNA, 21 nt, Human
aucacagacaaaaaauggcag

SEQ ID NO: 339003 - RNA, 20 nt, Human
auggagagcaacacaucaca

SEQ ID NO: 339004 - RNA, 22 nt, Human
caacuucaucagaagguaugaa

SEQ ID NO: 339005 - RNA, 18 nt, Human
cacagacaaaaaauggca

SEQ ID NO: 339006 - RNA, 19 nt, Human
cacagacaaaaaauggcag

SEQ ID NO: 339007 - RNA, 23 nt, Human
cacaucaacaugaagacauuuac

SEQ ID NO: 339008 - RNA, 24 nt, Human
cagaaaaaacaauccacgaagaaa

SEQ ID NO: 339009 - RNA, 19 nt, Human
cagugugggaaaguggugu

SEQ ID NO: 339010 - RNA, 22 nt, Human
ccacagaacacuuaaaaaaaga

SEQ ID NO: 339011 - RNA, 22 nt, Human
ccacagaacacuuaaaaaaaga

SEQ ID NO: 339012 - RNA, 22 nt, Human
ccacuuaaauagcuuugugacc

SEQ ID NO: 339013 - RNA, 18 nt, Human
cccgcagaaaaaacaauc

SEQ ID NO: 339014 - RNA, 21 nt, Human
cccgcagaaaaaacaauccac

SEQ ID NO: 339015 - RNA, 18 nt, Human
ccgccgccgccgccgccg

SEQ ID NO: 339016 - RNA, 18 nt, Human
ccgccgccgccgccgccg

SEQ ID NO: 339017 - RNA, 18 nt, Human
ccgccgccgccgccgccg

SEQ ID NO: 339018 - RNA, 24 nt, Human
ccgccgccgccgccgccgccgccg

SEQ ID NO: 339019 - RNA, 18 nt, Human
ccgccgccgccgccgcgc

SEQ ID NO: 339020 - RNA, 18 nt, Human
ccgccgccgccgccgcgc

SEQ ID NO: 339021 - RNA, 19 nt, Human
ccgccgccgccgccgcgcg

SEQ ID NO: 339022 - RNA, 23 nt, Human
ccgccgcgcgcccuacgcgccgc

SEQ ID NO: 339023 - RNA, 25 nt, Human
ccgccgcgcgcccuacgcgccgcuc

SEQ ID NO: 339024 - RNA, 25 nt, Human
gaaaaaacaaccacuguuuuacaaa

SEQ ID NO: 339025 - RNA, 21 nt, Human
gaacgggcucgggagcgggcc

SEQ ID NO: 339026 - RNA, 22 nt, Human
gaagaaaacacaaugaaaaaac

SEQ ID NO: 339027 - RNA, 21 nt, Human
gaauacauaaaggacaaacaa

SEQ ID NO: 339028 - RNA, 18 nt, Human
gacccgcagaaaaaacaa

SEQ ID NO: 339029 - RNA, 19 nt, Human
gcagaauauaaguagcccc

SEQ ID NO: 339030 - RNA, 22 nt, Human
gccgccgccgccgccgccgccg

SEQ ID NO: 339031 - RNA, 18 nt, Human
ggccugggagcgggcccc

SEQ ID NO: 339032 - RNA, 19 nt, Human
uacagggccauuauaaugu

SEQ ID NO: 339033 - RNA, 23 nt, Human
uagaaaauauuucagggucaagc

SEQ ID NO: 339034 - RNA, 22 nt, Human
uaucacagacaaaaaauggcag

SEQ ID NO: 339035 - RNA, 19 nt, Human
uaucagauguagugcgaga

SEQ ID NO: 339036 - RNA, 22 nt, Human
uauccacaaaacaacgcuaaac

SEQ ID NO: 339037 - RNA, 22 nt, Human
ucacuugucauuaguucacagu

SEQ ID NO: 339038 - RNA, 23 nt, Human
uccacaaaacaacgcuaaaccaa

SEQ ID NO: 339039 - RNA, 23 nt, Human
uccugauaucagauguagugcga

SEQ ID NO: 339040 - RNA, 19 nt, Human
ucucuuaaauuuuuugugc

SEQ ID NO: 339041 - RNA, 20 nt, Human
ugaccaagaauguuaaauac

SEQ ID NO: 339042 - RNA, 22 nt, Human
ugacccgcagaaaaaacaaucc

SEQ ID NO: 339043 - RNA, 19 nt, Human
ugagaagggcuuucaggua

SEQ ID NO: 339044 - RNA, 20 nt, Human
uggaagaaaaaaaauaaacu

SEQ ID NO: 339045 - RNA, 22 nt, Human
ugggagauagggucuucaucca

SEQ ID NO: 339046 - RNA, 22 nt, Human
ugggcuuuuauagcuugguuca

SEQ ID NO: 339047 - RNA, 24 nt, Human
ugguguuguacaacuucaucagaa

SEQ ID NO: 339048 - RNA, 22 nt, Human
uguugcugguguuguacaacuu

SEQ ID NO: 339049 - RNA, 19 nt, Human
uucacagugugggaaagug

SEQ ID NO: 339050 - RNA, 20 nt, Human
uucacagugugggaaagugg

SEQ ID NO: 339051 - RNA, 19 nt, Human
uucacggacacaucaacau

SEQ ID NO: 339052 - RNA, 24 nt, Human
uugaauagguauuucaauuaauuu

SEQ ID NO: 339053 - RNA, 18 nt, Human
uuuaaaagaauggagagc

SEQ ID NO: 339054 - RNA, 24 nt, Human
uuucacggacacaucaacaugaag

SEQ ID NO: 339055 - RNA, 22 nt, Human
uuuuaaacauaaaaucucuuaa

SEQ ID NO: 339056 - RNA, 26 nt, Human
uuuuaaggaguauauuaaaggagaua

SEQ ID NO: 339057 - RNA, 18 nt, Human
cagagaguguuccagcuc

SEQ ID NO: 339058 - RNA, 23 nt, Human
ccagggcugaaggcagggccugc

SEQ ID NO: 339059 - RNA, 19 nt, Human
cucucugagauccacugag

SEQ ID NO: 339060 - RNA, 21 nt, Human
cuggggcucucucugagaucc

SEQ ID NO: 339061 - RNA, 21 nt, Human
gggcuggugcaggggucaggg

SEQ ID NO: 339062 - RNA, 22 nt, Human
gggcuggugcaggggucagggc

SEQ ID NO: 339063 - RNA, 21 nt, Human
ucaaagcagggaagggcuggu

SEQ ID NO: 339064 - RNA, 24 nt, Human
ucagagaguguuccagcucugggc

SEQ ID NO: 339065 - RNA, 19 nt, Human
ucugggccagggcugaagg

SEQ ID NO: 339066 - RNA, 24 nt, Human
uguuccagcucugggccagggcug

SEQ ID NO: 339067 - RNA, 20 nt, Human
caggguuccgcugggccugg

SEQ ID NO: 339068 - RNA, 23 nt, Human
caggguuccgcugggccuggggg

SEQ ID NO: 339069 - RNA, 23 nt, Human
cccccgcacuuguuccugccgcg

SEQ ID NO: 339070 - RNA, 21 nt, Human
cccccuccucuucaggguucc

SEQ ID NO: 339071 - RNA, 24 nt, Human
ccccgcacuuguuccugccgcgac

SEQ ID NO: 339072 - RNA, 24 nt, Human
cccgcccuccugcuccucuaggaa

SEQ ID NO: 339073 - RNA, 20 nt, Human
ccgcugggccugggggcggg

SEQ ID NO: 339074 - RNA, 23 nt, Human
ccuccugcuccucuaggaagcca

SEQ ID NO: 339075 - RNA, 23 nt, Human
ccuugccccgcccuccugcuccu

SEQ ID NO: 339076 - RNA, 24 nt, Human
ccuugccccgcccuccugcuccuc

SEQ ID NO: 339077 - RNA, 18 nt, Human
cgcacuuguuccugccgc

SEQ ID NO: 339078 - RNA, 20 nt, Human
cgcgcccggcucacccuccc

SEQ ID NO: 339079 - RNA, 19 nt, Human
cggcucacccucccccucc

SEQ ID NO: 339080 - RNA, 24 nt, Human
cgugacugucacucagcugacaca

SEQ ID NO: 339081 - RNA, 25 nt, Human
gcccggcucacccucccccuccucu

SEQ ID NO: 339082 - RNA, 20 nt, Human
gccugggggcggggcuuuga

SEQ ID NO: 339083 - RNA, 18 nt, Human
gggagacccuugccccgc

SEQ ID NO: 339084 - RNA, 22 nt, Human
gggcggggcuuugaggccccgc

SEQ ID NO: 339085 - RNA, 23 nt, Human
ucacucagcugacacagccgcgc

SEQ ID NO: 339086 - RNA, 20 nt, Human
uccucuucaggguuccgcug

SEQ ID NO: 339087 - RNA, 21 nt, Human
ucgcggucccgugacugucac

SEQ ID NO: 339088 - RNA, 24 nt, Human
ugggagacccuugccccgcccucc

SEQ ID NO: 339089 - RNA, 24 nt, Human
uugccccgcccuccugcuccucua

SEQ ID NO: 339090 - RNA, 22 nt, Human
aaaaaaacaaagagaaaaaccc

SEQ ID NO: 339091 - RNA, 19 nt, Human
aaaaagaaauaaaagaaca

SEQ ID NO: 339092 - RNA, 22 nt, Human
aaaacuccuccggccgcggcac

SEQ ID NO: 339093 - RNA, 24 nt, Human
aaaagcaccuuccucaccggugcg

SEQ ID NO: 339094 - RNA, 22 nt, Human
aaagagaaaaagaaauaaaaga

SEQ ID NO: 339095 - RNA, 21 nt, Human
aacaaagagaaaaacccaaaa

SEQ ID NO: 339096 - RNA, 24 nt, Human
aacaaagagaaaaacccaaaacac

SEQ ID NO: 339097 - RNA, 21 nt, Human
aacuuguuuccuuacccccca

SEQ ID NO: 339098 - RNA, 21 nt, Human
aagaagccacuggaagcuaaa

SEQ ID NO: 339099 - RNA, 18 nt, Human
aagcggcccagcccaaca

SEQ ID NO: 339100 - RNA, 21 nt, Human
aaggaccaaaccgcccgcccc

SEQ ID NO: 339101 - RNA, 24 nt, Human
aauaagagucccugccagaaggaa

SEQ ID NO: 339102 - RNA, 19 nt, Human
acaccacacccucaguccc

SEQ ID NO: 339103 - RNA, 20 nt, Human
acagaggaaagggcuacucu

SEQ ID NO: 339104 - RNA, 21 nt, Human
agaggaaagggcuacucugag

SEQ ID NO: 339105 - RNA, 19 nt, Human
agaugcugauggacuaagc

SEQ ID NO: 339106 - RNA, 18 nt, Human
agauuuuagagacaaacu

SEQ ID NO: 339107 - RNA, 21 nt, Human
agcaaucaccccaucagcaaa

SEQ ID NO: 339108 - RNA, 20 nt, Human
agccugaugccccgcagaaa

SEQ ID NO: 339109 - RNA, 21 nt, Human
agcuuggcuucugaguccagc

SEQ ID NO: 339110 - RNA, 21 nt, Human
aggcagcgcgaccucggcgcg

SEQ ID NO: 339111 - RNA, 22 nt, Human
agggucuuccucccuccgcccu

SEQ ID NO: 339112 - RNA, 21 nt, Human
auggggccaaaagcaccuucc

SEQ ID NO: 339113 - RNA, 19 nt, Human
caaagagaaaaacccaaaa

SEQ ID NO: 339114 - RNA, 18 nt, Human
caacaaaacuccuccggc

SEQ ID NO: 339115 - RNA, 18 nt, Human
caacagccgggauggggc

SEQ ID NO: 339116 - RNA, 24 nt, Human
caagccaggcguucgaggggcugg

SEQ ID NO: 339117 - RNA, 21 nt, Human
cacagcacagggcgaagcaga

SEQ ID NO: 339118 - RNA, 21 nt, Human
cacagggcgaagcagaggcaa

SEQ ID NO: 339119 - RNA, 24 nt, Human
cagaaagaagccacuggaagcuaa

SEQ ID NO: 339120 - RNA, 25 nt, Human
cagaacgcgguaauuucuguaacuu

SEQ ID NO: 339121 - RNA, 28 nt, Human
cagaaugacaccccaagccaggcguucg

SEQ ID NO: 339122 - RNA, 26 nt, Human
cagcacagggacugucgguaccuccu

SEQ ID NO: 339123 - RNA, 23 nt, Human
cagcacagggcgaagcagaggca

SEQ ID NO: 339124 - RNA, 21 nt, Human
cagccugaugccccgcagaaa

SEQ ID NO: 339125 - RNA, 24 nt, Human
caggcguucgaggggcuggggcag

SEQ ID NO: 339126 - RNA, 19 nt, Human
cagugacagccccaggccc

SEQ ID NO: 339127 - RNA, 20 nt, Human
ccaucagcaaaguugccggc

SEQ ID NO: 339128 - RNA, 23 nt, Human
cccagaagcagcaaucaccccau

SEQ ID NO: 339129 - RNA, 19 nt, Human
ccccagaagcagcaaucac

SEQ ID NO: 339130 - RNA, 30 nt, Human
ccccagaagcagcaaucaccccaucagcaa

SEQ ID NO: 339131 - RNA, 25 nt, Human
ccccccagaagcagcaaucaccccc

SEQ ID NO: 339132 - RNA, 19 nt, Human
cccccgggaaaaagccguc

SEQ ID NO: 339133 - RNA, 20 nt, Human
cccccgggaaaaagccguca

SEQ ID NO: 339134 - RNA, 23 nt, Human
ccccgcacgcugcugucuuugca

SEQ ID NO: 339135 - RNA, 24 nt, Human
ccccgcgcgcccggaaaggaccaa

SEQ ID NO: 339136 - RNA, 20 nt, Human
cccgccgccgcgcugaggcc

SEQ ID NO: 339137 - RNA, 22 nt, Human
cccgcgcgcccggaaaggacca

SEQ ID NO: 339138 - RNA, 22 nt, Human
cccggggcucugccccgcacgc

SEQ ID NO: 339139 - RNA, 24 nt, Human
cccuccgcgccucagcuccccucg

SEQ ID NO: 339140 - RNA, 19 nt, Human
cccugcgccgagucuaggc

SEQ ID NO: 339141 - RNA, 18 nt, Human
ccgagccgccgccgcugc

SEQ ID NO: 339142 - RNA, 18 nt, Human
ccgcccuggccgcagccc

SEQ ID NO: 339143 - RNA, 22 nt, Human
ccgccgccgcgcugaggccuag

SEQ ID NO: 339144 - RNA, 19 nt, Human
ccgccgccgcugccgccga

SEQ ID NO: 339145 - RNA, 20 nt, Human
ccgcgggccggccccuccuc

SEQ ID NO: 339146 - RNA, 20 nt, Human
ccggaagaaggggaaaccga

SEQ ID NO: 339147 - RNA, 24 nt, Human
ccuccgcccuggccgcagccccga

SEQ ID NO: 339148 - RNA, 20 nt, Human
ccuccgcgccucagcucccc

SEQ ID NO: 339149 - RNA, 27 nt, Human
ccucuuguccuuccaccaaaucuucca

SEQ ID NO: 339150 - RNA, 21 nt, Human
ccuuaccccccagaagcagca

SEQ ID NO: 339151 - RNA, 21 nt, Human
ccuuccaccaaaucuuccaaa

SEQ ID NO: 339152 - RNA, 20 nt, Human
ccuugguacagugcgccugg

SEQ ID NO: 339153 - RNA, 27 nt, Human
cgcagaaagaagccacuggaagcuaaa

SEQ ID NO: 339154 - RNA, 21 nt, Human
cgccucagcuccccucgaagc

SEQ ID NO: 339155 - RNA, 21 nt, Human
cgcgcgcccggaaaggaccaa

SEQ ID NO: 339156 - RNA, 21 nt, Human
cgcgggccggccccuccuccg

SEQ ID NO: 339157 - RNA, 21 nt, Human
cggaaaggaccaaaccgcccg

SEQ ID NO: 339158 - RNA, 24 nt, Human
cggaaaggaccaaaccgcccgguu

SEQ ID NO: 339159 - RNA, 18 nt, Human
cggccccuccuccgcucc

SEQ ID NO: 339160 - RNA, 23 nt, Human
cggugcaugccucuacgcggccu

SEQ ID NO: 339161 - RNA, 22 nt, Human
cguucgaggggcuggggcagcu

SEQ ID NO: 339162 - RNA, 23 nt, Human
cuaaaaccaacaacaaaacuccc

SEQ ID NO: 339163 - RNA, 18 nt, Human
cucccgcgggccggcccc

SEQ ID NO: 339164 - RNA, 20 nt, Human
cuccgcucccucugcuccuc

SEQ ID NO: 339165 - RNA, 23 nt, Human
cugccaaugacaccacacccuca

SEQ ID NO: 339166 - RNA, 18 nt, Human
cugcuccucgccgccgcg

SEQ ID NO: 339167 - RNA, 19 nt, Human
cugcugcuacaaagcugga

SEQ ID NO: 339168 - RNA, 27 nt, Human
gaaaaaaacaaagagaaaaacccaaaa

SEQ ID NO: 339169 - RNA, 22 nt, Human
gaagcuucucaaaucucccagg

SEQ ID NO: 339170 - RNA, 23 nt, Human
gacaccccaagccaggcguucga

SEQ ID NO: 339171 - RNA, 18 nt, Human
gcaauggggccaaaagca

SEQ ID NO: 339172 - RNA, 21 nt, Human
gcagaaagaagccacuggaag

SEQ ID NO: 339173 - RNA, 20 nt, Human
gccaaggccccucgcaaugg

SEQ ID NO: 339174 - RNA, 24 nt, Human
gccaggcguucgaggggcuggggc

SEQ ID NO: 339175 - RNA, 24 nt, Human
gccgagccgccgccgcugccgccg

SEQ ID NO: 339176 - RNA, 19 nt, Human
gccgcugucgcccccgcgc

SEQ ID NO: 339177 - RNA, 24 nt, Human
gccggccccuccuccgcucccucu

SEQ ID NO: 339178 - RNA, 20 nt, Human
gcggcuaccccagcagccug

SEQ ID NO: 339179 - RNA, 23 nt, Human
gcucccaauuugggcuuucggug

SEQ ID NO: 339180 - RNA, 20 nt, Human
ggaaaggaccaaaccgcccg

SEQ ID NO: 339181 - RNA, 20 nt, Human
ggccagugacagccccaggc

SEQ ID NO: 339182 - RNA, 21 nt, Human
ggccagugacagccccaggcc

SEQ ID NO: 339183 - RNA, 18 nt, Human
ggcccggggcaggggaag

SEQ ID NO: 339184 - RNA, 23 nt, Human
ggcgggaagcagcuuggcuucug

SEQ ID NO: 339185 - RNA, 19 nt, Human
gggacggggacagggacag

SEQ ID NO: 339186 - RNA, 21 nt, Human
gggccagugacagccccaggc

SEQ ID NO: 339187 - RNA, 19 nt, Human
gggcggcuaccccagcagc

SEQ ID NO: 339188 - RNA, 23 nt, Human
ggggcaggggaagcuggaggccu

SEQ ID NO: 339189 - RNA, 18 nt, Human
gguagggcccucgggccg

SEQ ID NO: 339190 - RNA, 18 nt, Human
uaacuuguuuccuuaccc

SEQ ID NO: 339191 - RNA, 19 nt, Human
uacaaagcuggagaacaca

SEQ ID NO: 339192 - RNA, 22 nt, Human
uacccagaauaagaugcugauu

SEQ ID NO: 339193 - RNA, 23 nt, Human
uagagcaaugggaauaaauaaga

SEQ ID NO: 339194 - RNA, 20 nt, Human
ucaaucaaagagaaaaagaa

SEQ ID NO: 339195 - RNA, 21 nt, Human
ucagcaaaguugccggcaggc

SEQ ID NO: 339196 - RNA, 20 nt, Human
uccgcccuggccgcagcccc

SEQ ID NO: 339197 - RNA, 27 nt, Human
uccuccggccgcggcacagguguugcu

SEQ ID NO: 339198 - RNA, 21 nt, Human
ucgaggggcuggggcagcucu

SEQ ID NO: 339199 - RNA, 23 nt, Human
ucgcaauggggccaaaagcaccu

SEQ ID NO: 339200 - RNA, 20 nt, Human
ucgccgccgcgggccagcag

SEQ ID NO: 339201 - RNA, 21 nt, Human
ucucaaaucucccagguccac

SEQ ID NO: 339202 - RNA, 22 nt, Human
ucugccaaugacaccacacccu

SEQ ID NO: 339203 - RNA, 20 nt, Human
ugaccgaaaaucaaaaguua

SEQ ID NO: 339204 - RNA, 24 nt, Human
ugagaugagggucuuccucccucc

SEQ ID NO: 339205 - RNA, 23 nt, Human
ugcgccuggguuugucaaggcug

SEQ ID NO: 339206 - RNA, 23 nt, Human
ugcucgggcacagaaaugcgaag

SEQ ID NO: 339207 - RNA, 18 nt, Human
uggaaaacagguauccgu

SEQ ID NO: 339208 - RNA, 22 nt, Human
uggaaaacagguauccguuuau

SEQ ID NO: 339209 - RNA, 20 nt, Human
uggagaacacagcacagggc

SEQ ID NO: 339210 - RNA, 22 nt, Human
uggccgccaggcagaaugacac

SEQ ID NO: 339211 - RNA, 20 nt, Human
uggccugugcguccccgucu

SEQ ID NO: 339212 - RNA, 19 nt, Human
uggggacggggacagggac

SEQ ID NO: 339213 - RNA, 20 nt, Human
uggggacggggacagggaca

SEQ ID NO: 339214 - RNA, 18 nt, Human
ugucuaaccagcacaggg

SEQ ID NO: 339215 - RNA, 18 nt, Human
uguucggaucagggccag

SEQ ID NO: 339216 - RNA, 19 nt, Human
uucuucaguacuccuuuaa

SEQ ID NO: 339217 - RNA, 28 nt, Human
uugaaaaaaacaaagagaaaaacccaaa

SEQ ID NO: 339218 - RNA, 21 nt, Human
uuuagagacaaacuuaggaaa

SEQ ID NO: 339219 - RNA, 23 nt, Human
uuucuguaacuuguuuccuuacc

SEQ ID NO: 339220 - RNA, 19 nt, Human
acuguguuggaccaaaaua

SEQ ID NO: 339221 - RNA, 18 nt, Human
agcagcagcggcggcggc

SEQ ID NO: 339222 - RNA, 30 nt, Human
agcagcggcggcggcccggagccacagccc

SEQ ID NO: 339223 - RNA, 24 nt, Human
caaaacauucaaaagaaagaucuu

SEQ ID NO: 339224 - RNA, 24 nt, Human
caaaagaaagaucuuggcagacaa

SEQ ID NO: 339225 - RNA, 19 nt, Human
caccaccgccgccgccacc

SEQ ID NO: 339226 - RNA, 26 nt, Human
caccaccgccgccgccaccaccaccc

SEQ ID NO: 339227 - RNA, 18 nt, Human
cagcagcggcggcggccc

SEQ ID NO: 339228 - RNA, 25 nt, Human
cagcggcggcggcccggagccacag

SEQ ID NO: 339229 - RNA, 21 nt, Human
ccaacccgcuuugcaccacac

SEQ ID NO: 339230 - RNA, 21 nt, Human
ccaccaccacccccacgcccc

SEQ ID NO: 339231 - RNA, 22 nt, Human
ccaccaccacccccacgccccg

SEQ ID NO: 339232 - RNA, 21 nt, Human
cccgcagcugccgcgcggccg

SEQ ID NO: 339233 - RNA, 21 nt, Human
cccgcccgccgcugccgcugc

SEQ ID NO: 339234 - RNA, 21 nt, Human
ccgccaccaccgccgccgcca

SEQ ID NO: 339235 - RNA, 18 nt, Human
ccgccgccaccaccaccc

SEQ ID NO: 339236 - RNA, 24 nt, Human
ccgccgccaccaccacccccacgc

SEQ ID NO: 339237 - RNA, 20 nt, Human
ccgccgccaccaccgccgcc

SEQ ID NO: 339238 - RNA, 23 nt, Human
ccgccgccaccaccgccgccgcc

SEQ ID NO: 339239 - RNA, 23 nt, Human
ccgccgccgccaccaccgccgcc

SEQ ID NO: 339240 - RNA, 24 nt, Human
ccgccgccgccgccaccaccgccg

SEQ ID NO: 339241 - RNA, 18 nt, Human
ccgccgccgccgccgccg

SEQ ID NO: 339242 - RNA, 24 nt, Human
ccgccgccgccgccgccgcugccg

SEQ ID NO: 339243 - RNA, 26 nt, Human
ccgccgccgccgccgccgcugccgcc

SEQ ID NO: 339244 - RNA, 27 nt, Human
ccgccgccgccgccgccgcugccgccu

SEQ ID NO: 339245 - RNA, 18 nt, Human
ccgccgccgccgcugccg

SEQ ID NO: 339246 - RNA, 21 nt, Human
ccgccgccgcugccgccucca

SEQ ID NO: 339247 - RNA, 18 nt, Human
ccgccgcugccgcugccg

SEQ ID NO: 339248 - RNA, 18 nt, Human
ccgcugccgccgccgccg

SEQ ID NO: 339249 - RNA, 24 nt, Human
ccgcugccgccgccgccgccgccg

SEQ ID NO: 339250 - RNA, 18 nt, Human
ccgcugccgcugccgccg

SEQ ID NO: 339251 - RNA, 21 nt, Human
ccgcugccgcugccgccgccg

SEQ ID NO: 339252 - RNA, 24 nt, Human
ccgcugccgcugccgccgccgccg

SEQ ID NO: 339253 - RNA, 20 nt, Human
ccgcugccgcugccgcugcc

SEQ ID NO: 339254 - RNA, 24 nt, Human
cgaggcagaggcaauucacauuua

SEQ ID NO: 339255 - RNA, 20 nt, Human
cgccacagccaccgccuccu

SEQ ID NO: 339256 - RNA, 21 nt, Human
cgcgaagagcucggaguagca

SEQ ID NO: 339257 - RNA, 25 nt, Human
cucagcagcagcggcggcggcccuu

SEQ ID NO: 339258 - RNA, 21 nt, Human
cugccgccgccgccgccgccg

SEQ ID NO: 339259 - RNA, 19 nt, Human
cugccgcugccgccgccgc

SEQ ID NO: 339260 - RNA, 21 nt, Human
gcagcaauuaauuucagggca

SEQ ID NO: 339261 - RNA, 22 nt, Human
gcagcagcggcggcggcccgga

SEQ ID NO: 339262 - RNA, 25 nt, Human
gcagcagcggcggcggcccggagcc

SEQ ID NO: 339263 - RNA, 20 nt, Human
gccgccgccgccgccgccgc

SEQ ID NO: 339264 - RNA, 22 nt, Human
gccgcugccgccgccgccgccg

SEQ ID NO: 339265 - RNA, 22 nt, Human
gccgcugccgcugccgccgccg

SEQ ID NO: 339266 - RNA, 22 nt, Human
gcugccgccgccgccgccgccg

SEQ ID NO: 339267 - RNA, 18 nt, Human
ggcccagacccggggccc

SEQ ID NO: 339268 - RNA, 21 nt, Human
ggccggcggccgcaguggccg

SEQ ID NO: 339269 - RNA, 23 nt, Human
ggccggcggccgcaguggccgug

SEQ ID NO: 339270 - RNA, 24 nt, Human
ggccggcggccgcaguggccgugc

SEQ ID NO: 339271 - RNA, 22 nt, Human
gugcagcgucucggcgggcagc

SEQ ID NO: 339272 - RNA, 23 nt, Human
gugcagcgucucggcgggcagcu

SEQ ID NO: 339273 - RNA, 19 nt, Human
ucaaaagaaagaucuuggc

SEQ ID NO: 339274 - RNA, 23 nt, Human
ucaaaagaaagaucuuggcagac

SEQ ID NO: 339275 - RNA, 26 nt, Human
ucagcagcagcggcggcggcccggag

SEQ ID NO: 339276 - RNA, 19 nt, Human
ucccuagcuggggugcugc

SEQ ID NO: 339277 - RNA, 18 nt, Human
uccgccacagccaccgcc

SEQ ID NO: 339278 - RNA, 25 nt, Human
ucggccucagcugccgccgccgccg

SEQ ID NO: 339279 - RNA, 29 nt, Human
ucggccucagcugccgccgccgccgccgg

SEQ ID NO: 339280 - RNA, 20 nt, Human
ucuggugcagcgucucggcg

SEQ ID NO: 339281 - RNA, 20 nt, Human
ucuuggcagacaaggucacc

SEQ ID NO: 339282 - RNA, 26 nt, Human
ugcccgaaacaggucagccacggggg

SEQ ID NO: 339283 - RNA, 21 nt, Human
ugcucacagcuuuugacacag

SEQ ID NO: 339284 - RNA, 23 nt, Human
uggaccaaaauaaccaacccgcu

SEQ ID NO: 339285 - RNA, 22 nt, Human
uuuaauacucucuauccguacc

SEQ ID NO: 339286 - RNA, 23 nt, Human
uuuugcugcucacagcuuuugac

SEQ ID NO: 339287 - RNA, 21 nt, Human
aaaaaacaggcacauuaucca

SEQ ID NO: 339288 - RNA, 21 nt, Human
aaagacaccucaacuccaaag

SEQ ID NO: 339289 - RNA, 21 nt, Human
aauacaggaacuaaagaaaga

SEQ ID NO: 339290 - RNA, 24 nt, Human
accguaagagugagccaggagagc

SEQ ID NO: 339291 - RNA, 20 nt, Human
acuccaggguguccuggcau

SEQ ID NO: 339292 - RNA, 20 nt, Human
agaaaaagaaaagacaccuc

SEQ ID NO: 339293 - RNA, 21 nt, Human
agaaaacuugaggaaucaggg

SEQ ID NO: 339294 - RNA, 22 nt, Human
agaacauccugacuccagaaaa

SEQ ID NO: 339295 - RNA, 19 nt, Human
agagguggucagagcugcc

SEQ ID NO: 339296 - RNA, 23 nt, Human
agaugagaaauuccaaggguggg

SEQ ID NO: 339297 - RNA, 22 nt, Human
agcaggaacacagggccgcaga

SEQ ID NO: 339298 - RNA, 19 nt, Human
aggaagaacaaaaagggga

SEQ ID NO: 339299 - RNA, 23 nt, Human
aggaagaacaaaaaggggauuuu

SEQ ID NO: 339300 - RNA, 23 nt, Human
aggaagggaggcagaagaugaga

SEQ ID NO: 339301 - RNA, 24 nt, Human
aggaggaagaagggaaagaugggu

SEQ ID NO: 339302 - RNA, 18 nt, Human
aggcagaacacagagaaa

SEQ ID NO: 339303 - RNA, 25 nt, Human
aggcagaagaugagaaauuccaagg

SEQ ID NO: 339304 - RNA, 18 nt, Human
aggcaggcuggcacaacc

SEQ ID NO: 339305 - RNA, 20 nt, Human
aggcaggcuggcacaaccac

SEQ ID NO: 339306 - RNA, 26 nt, Human
aucuccuuguggcccccgagcugcug

SEQ ID NO: 339307 - RNA, 23 nt, Human
cacagggccgcagagagccacuc

SEQ ID NO: 339308 - RNA, 25 nt, Human
caccucagcuugcagcugccaaagg

SEQ ID NO: 339309 - RNA, 19 nt, Human
cacucuguagcaggaacac

SEQ ID NO: 339310 - RNA, 22 nt, Human
cagaaaagaacacucuguagca

SEQ ID NO: 339311 - RNA, 20 nt, Human
cagaacacagagaagugagc

SEQ ID NO: 339312 - RNA, 18 nt, Human
cagcucccuggccuggcu

SEQ ID NO: 339313 - RNA, 27 nt, Human
caggaacacagggccgcagagagccac

SEQ ID NO: 339314 - RNA, 19 nt, Human
caggaagaacaaaaagggg

SEQ ID NO: 339315 - RNA, 23 nt, Human
caggcacauuauccaucuccuug

SEQ ID NO: 339316 - RNA, 31 nt, Human
ccagaaaagaacacucuguagcaggaacaac

SEQ ID NO: 339317 - RNA, 30 nt, Human
cccacaaaaccaaaaggaguaggaagggag

SEQ ID NO: 339318 - RNA, 23 nt, Human
cccccgagcugcuggccuggccc

SEQ ID NO: 339319 - RNA, 25 nt, Human
cccccugauccuuccccucucccca

SEQ ID NO: 339320 - RNA, 23 nt, Human
ccccgagcugcuggccuggcccc

SEQ ID NO: 339321 - RNA, 22 nt, Human
ccccucuccccacaaaaccaaa

SEQ ID NO: 339322 - RNA, 21 nt, Human
ccugauccuuccccucucccc

SEQ ID NO: 339323 - RNA, 19 nt, Human
ccugcccacggccaagggg

SEQ ID NO: 339324 - RNA, 23 nt, Human
cgccuaggggcaguguguugcuc

SEQ ID NO: 339325 - RNA, 22 nt, Human
cgcucccagcucccuggccugg

SEQ ID NO: 339326 - RNA, 20 nt, Human
cuaaagaaagaaaaagaaaa

SEQ ID NO: 339327 - RNA, 22 nt, Human
cuccuuucucccugagggccug

SEQ ID NO: 339328 - RNA, 21 nt, Human
cucuagaggacaggaaaacuc

SEQ ID NO: 339329 - RNA, 19 nt, Human
cucuccccacaaaaccaaa

SEQ ID NO: 339330 - RNA, 18 nt, Human
cugccaaaggcaggcugg

SEQ ID NO: 339331 - RNA, 20 nt, Human
cuggcccccugauccuuccc

SEQ ID NO: 339332 - RNA, 24 nt, Human
gaaacagccuuagauaugucgggg

SEQ ID NO: 339333 - RNA, 21 nt, Human
gaacauccugacuccagaaaa

SEQ ID NO: 339334 - RNA, 20 nt, Human
gaaguggaggagagaaacag

SEQ ID NO: 339335 - RNA, 18 nt, Human
gacacuguuugaacccug

SEQ ID NO: 339336 - RNA, 24 nt, Human
gaggagagaaacagccuuagauau

SEQ ID NO: 339337 - RNA, 18 nt, Human
gaguaggaagggaggcag

SEQ ID NO: 339338 - RNA, 20 nt, Human
gauccuuccccucuccccac

SEQ ID NO: 339339 - RNA, 21 nt, Human
gcagaacacagagaagugagc

SEQ ID NO: 339340 - RNA, 21 nt, Human
gcagagagaaacugggccaca

SEQ ID NO: 339341 - RNA, 22 nt, Human
gcucccuggccuggcuugccuc

SEQ ID NO: 339342 - RNA, 22 nt, Human
ggccagagguggucagagcugc

SEQ ID NO: 339343 - RNA, 27 nt, Human
gggaauaacaaggugaagccgguaccc

SEQ ID NO: 339344 - RNA, 19 nt, Human
gggcccaaggcaagcagag

SEQ ID NO: 339345 - RNA, 21 nt, Human
guggccucagcuugcucgcuc

SEQ ID NO: 339346 - RNA, 18 nt, Human
uaaaaaacaggcacauua

SEQ ID NO: 339347 - RNA, 24 nt, Human
uaauggagagcagagagaaacugg

SEQ ID NO: 339348 - RNA, 25 nt, Human
uacaggaacuaaagaaagaaaaaga

SEQ ID NO: 339349 - RNA, 21 nt, Human
uagcaggaacacagggccgca

SEQ ID NO: 339350 - RNA, 22 nt, Human
uaggaagggaggcagaagauga

SEQ ID NO: 339351 - RNA, 21 nt, Human
ucaccaggggcugggcccaag

SEQ ID NO: 339352 - RNA, 18 nt, Human
ucagagcugccaccucag

SEQ ID NO: 339353 - RNA, 22 nt, Human
ucagagcugccaccucagcuug

SEQ ID NO: 339354 - RNA, 18 nt, Human
ucaguuaagagcaggagg

SEQ ID NO: 339355 - RNA, 21 nt, Human
ucccugagggccuggggccag

SEQ ID NO: 339356 - RNA, 21 nt, Human
ucccuggccuggcuugccucu

SEQ ID NO: 339357 - RNA, 20 nt, Human
ucgcucccagcucccuggcc

SEQ ID NO: 339358 - RNA, 22 nt, Human
ucucccugagggccuggggcca

SEQ ID NO: 339359 - RNA, 24 nt, Human
ugaaggagaggaggaagaagggaa

SEQ ID NO: 339360 - RNA, 19 nt, Human
ugacuccagaaaagaacac

SEQ ID NO: 339361 - RNA, 19 nt, Human
ugaggaaucagggugugaa

SEQ ID NO: 339362 - RNA, 23 nt, Human
ugaggcuaugcggcacaggggca

SEQ ID NO: 339363 - RNA, 24 nt, Human
ugagggccuggggccagagguggu

SEQ ID NO: 339364 - RNA, 19 nt, Human
ugcuagcgagcgugcaagg

SEQ ID NO: 339365 - RNA, 20 nt, Human
uggaggaaagaggugaggcu

SEQ ID NO: 339366 - RNA, 18 nt, Human
uggagguaggcuuuuuug

SEQ ID NO: 339367 - RNA, 21 nt, Human
uggagguaggcuuuuuuguug

SEQ ID NO: 339368 - RNA, 21 nt, Human
uggcacaaccaccccaagguu

SEQ ID NO: 339369 - RNA, 21 nt, Human
uggcccccgagcugcuggccu

SEQ ID NO: 339370 - RNA, 21 nt, Human
uggcccccugauccuuccccu

SEQ ID NO: 339371 - RNA, 19 nt, Human
ugggguggaaugggacagg

SEQ ID NO: 339372 - RNA, 19 nt, Human
ugucggggagcaggugggu

SEQ ID NO: 339373 - RNA, 18 nt, Human
ugucuauguggcuucccc

SEQ ID NO: 339374 - RNA, 21 nt, Human
uuacuaauguuuagaauacag

SEQ ID NO: 339375 - RNA, 20 nt, Human
uucuaggaggacacuguuug

SEQ ID NO: 339376 - RNA, 20 nt, Human
uugcagcugccaaaggcagg

SEQ ID NO: 339377 - RNA, 22 nt, Human
aaaaaaauuacaaaauacucaa

SEQ ID NO: 339378 - RNA, 21 nt, Human
aaaacuaaagccaaaccccaa

SEQ ID NO: 339379 - RNA, 21 nt, Human
aaaacuagaaacauuuucaac

SEQ ID NO: 339380 - RNA, 20 nt, Human
aaaauacaggcugcccccaa

SEQ ID NO: 339381 - RNA, 24 nt, Human
aaacagaacagugacacuggagaa

SEQ ID NO: 339382 - RNA, 21 nt, Human
aaacaggcugaagcucuccac

SEQ ID NO: 339383 - RNA, 20 nt, Human
aaaccaaaccccgaacaaag

SEQ ID NO: 339384 - RNA, 22 nt, Human
aaacuaaagccaaaccccaaga

SEQ ID NO: 339385 - RNA, 23 nt, Human
aaagguucaugucagcuuugccu

SEQ ID NO: 339386 - RNA, 21 nt, Human
aaccaaaccccgaacaaaggg

SEQ ID NO: 339387 - RNA, 24 nt, Human
aagaaaaaaaggcuguucuaaaaa

SEQ ID NO: 339388 - RNA, 21 nt, Human
aagcaaagcuaacaagaaugc

SEQ ID NO: 339389 - RNA, 21 nt, Human
aagcuaacaagaaugccuucg

SEQ ID NO: 339390 - RNA, 21 nt, Human
aagcucuccacaaaucuucuc

SEQ ID NO: 339391 - RNA, 25 nt, Human
aauccaaccacuccaacaaccccaa

SEQ ID NO: 339392 - RNA, 21 nt, Human
acaaagggaggaaaauccgaa

SEQ ID NO: 339393 - RNA, 18 nt, Human
acaagccugccaugaggg

SEQ ID NO: 339394 - RNA, 21 nt, Human
acacagaggagccaaaccaaa

SEQ ID NO: 339395 - RNA, 21 nt, Human
acaccaugaaggucagggccu

SEQ ID NO: 339396 - RNA, 22 nt, Human
acagugaagggugugaacugga

SEQ ID NO: 339397 - RNA, 24 nt, Human
accaaaaagaaagaaaaaccagaa

SEQ ID NO: 339398 - RNA, 19 nt, Human
accacaagauccaagugac

SEQ ID NO: 339399 - RNA, 28 nt, Human
accauaaacaggcugaagcucuccacaa

SEQ ID NO: 339400 - RNA, 21 nt, Human
accccaagauugcagggaagc

SEQ ID NO: 339401 - RNA, 24 nt, Human
accccagaacacccgcccucagcc

SEQ ID NO: 339402 - RNA, 23 nt, Human
accgagugguugggcuucaaaga

SEQ ID NO: 339403 - RNA, 21 nt, Human
acgcggaggggcugagggggc

SEQ ID NO: 339404 - RNA, 22 nt, Human
acuuccaggaugaagaguggga

SEQ ID NO: 339405 - RNA, 19 nt, Human
agaaaagcaaagcuaacaa

SEQ ID NO: 339406 - RNA, 26 nt, Human
agaaagauggggccguccucaccaca

SEQ ID NO: 339407 - RNA, 22 nt, Human
agaaagugaacauucaccuccu

SEQ ID NO: 339408 - RNA, 25 nt, Human
agaacaaucaaguguguguacacag

SEQ ID NO: 339409 - RNA, 20 nt, Human
agaaggaaaucuacaaugga

SEQ ID NO: 339410 - RNA, 22 nt, Human
agacaaaacaagccuaucccaa

SEQ ID NO: 339411 - RNA, 21 nt, Human
agacguaaaaagccaugcugc

SEQ ID NO: 339412 - RNA, 18 nt, Human
agaggacucgacucuucu

SEQ ID NO: 339413 - RNA, 19 nt, Human
agaggggcggcccgcgggg

SEQ ID NO: 339414 - RNA, 18 nt, Human
agcacagaccucagagga

SEQ ID NO: 339415 - RNA, 22 nt, Human
agccaaaccaaaccccgaacaa

SEQ ID NO: 339416 - RNA, 21 nt, Human
agccugggcuucagucuucug

SEQ ID NO: 339417 - RNA, 23 nt, Human
agcucuccacaaaucuucucugu

SEQ ID NO: 339418 - RNA, 19 nt, Human
aggaaaauccgaaggaaac

SEQ ID NO: 339419 - RNA, 19 nt, Human
aggacaccgaacaagauac

SEQ ID NO: 339420 - RNA, 19 nt, Human
aggcagaaaacagagucug

SEQ ID NO: 339421 - RNA, 25 nt, Human
aggcagaaaacagagucuguaacau

SEQ ID NO: 339422 - RNA, 21 nt, Human
aggcugcccccaacaccuguc

SEQ ID NO: 339423 - RNA, 23 nt, Human
agggcgagggggcucccugagga

SEQ ID NO: 339424 - RNA, 21 nt, Human
agggggcucccugaggaugau

SEQ ID NO: 339425 - RNA, 23 nt, Human
aguggcggggauggggcgggagg

SEQ ID NO: 339426 - RNA, 21 nt, Human
auaaacaggcugaagcucucc

SEQ ID NO: 339427 - RNA, 19 nt, Human
auacaguuacuccuagaca

SEQ ID NO: 339428 - RNA, 22 nt, Human
aucccaacugaaaccaaacacg

SEQ ID NO: 339429 - RNA, 21 nt, Human
aucuucucuguaaguggaucc

SEQ ID NO: 339430 - RNA, 23 nt, Human
caaaacaagccuaucccaacuga

SEQ ID NO: 339431 - RNA, 19 nt, Human
caaaauacucaaauggaga

SEQ ID NO: 339432 - RNA, 22 nt, Human
caaaauacucaaauggagagaa

SEQ ID NO: 339433 - RNA, 21 nt, Human
caaaauggaagaggucugaug

SEQ ID NO: 339434 - RNA, 19 nt, Human
caaaccaaaccccgaacaa

SEQ ID NO: 339435 - RNA, 19 nt, Human
caaaccccgaacaaaggga

SEQ ID NO: 339436 - RNA, 21 nt, Human
caaaccccgaacaaagggagg

SEQ ID NO: 339437 - RNA, 27 nt, Human
caaauggagagaacacagaagucacga

SEQ ID NO: 339438 - RNA, 18 nt, Human
caagaaagauggggccgu

SEQ ID NO: 339439 - RNA, 25 nt, Human
caagugacaaugcgcaugagaaggc

SEQ ID NO: 339440 - RNA, 19 nt, Human
cacagcaugcuuucugaau

SEQ ID NO: 339441 - RNA, 19 nt, Human
cacaggcuaggagcagaca

SEQ ID NO: 339442 - RNA, 20 nt, Human
cacaggcuaggagcagacac

SEQ ID NO: 339443 - RNA, 22 nt, Human
cacaggcuaggagcagacacaa

SEQ ID NO: 339444 - RNA, 20 nt, Human
cacuccaacaaccccaacgu

SEQ ID NO: 339445 - RNA, 19 nt, Human
cacugugggugggacucca

SEQ ID NO: 339446 - RNA, 27 nt, Human
cagaacagugacacuggagaacagaag

SEQ ID NO: 339447 - RNA, 24 nt, Human
cagcacaauggcagaagagaccuc

SEQ ID NO: 339448 - RNA, 19 nt, Human
cagggaaaauccaaccacu

SEQ ID NO: 339449 - RNA, 25 nt, Human
caucaauagugagguguucgcggcc

SEQ ID NO: 339450 - RNA, 25 nt, Human
cauggcaaacuacucauauauacau

SEQ ID NO: 339451 - RNA, 20 nt, Human
ccaaaaagaaagaaaaacca

SEQ ID NO: 339452 - RNA, 21 nt, Human
ccaaaccaaaccccgaacaaa

SEQ ID NO: 339453 - RNA, 22 nt, Human
ccaaaccccaagauugcaggga

SEQ ID NO: 339454 - RNA, 18 nt, Human
ccacaauuccuuucucag

SEQ ID NO: 339455 - RNA, 27 nt, Human
ccauccagaauuauaucaaauggccac

SEQ ID NO: 339456 - RNA, 23 nt, Human
cccacggugguugugacccgugc

SEQ ID NO: 339457 - RNA, 19 nt, Human
cccagaaggaaacgaaugc

SEQ ID NO: 339458 - RNA, 22 nt, Human
cccccaagaacugggguuucca

SEQ ID NO: 339459 - RNA, 21 nt, Human
ccccuaaagcgcuacaccauc

SEQ ID NO: 339460 - RNA, 25 nt, Human
cccgcggggaggcgacgcggagggg

SEQ ID NO: 339461 - RNA, 22 nt, Human
cccgugcugagcgcacauacag

SEQ ID NO: 339462 - RNA, 20 nt, Human
cccugccgugaccuuuccug

SEQ ID NO: 339463 - RNA, 19 nt, Human
ccuccuccucggucgggca

SEQ ID NO: 339464 - RNA, 22 nt, Human
ccuccugcacucccugugcaaa

SEQ ID NO: 339465 - RNA, 22 nt, Human
ccucugccgcaguggagugaag

SEQ ID NO: 339466 - RNA, 19 nt, Human
ccugcgacuugaaccuagg

SEQ ID NO: 339467 - RNA, 18 nt, Human
cgacagagggcagacacc

SEQ ID NO: 339468 - RNA, 28 nt, Human
cgaggacaccgaacaagauuggagaccc

SEQ ID NO: 339469 - RNA, 19 nt, Human
cgcggaggcugcggggccg

SEQ ID NO: 339470 - RNA, 20 nt, Human
cgcggggcgcagggccgaga

SEQ ID NO: 339471 - RNA, 21 nt, Human
cgggaggccgcgcggaggcug

SEQ ID NO: 339472 - RNA, 22 nt, Human
cuaaagcgcuacaccaucaaua

SEQ ID NO: 339473 - RNA, 24 nt, Human
cuaucccaacugaaaccaaacacg

SEQ ID NO: 339474 - RNA, 19 nt, Human
cucgugggcucuggagcac

SEQ ID NO: 339475 - RNA, 18 nt, Human
cucuccacaaaucuucuc

SEQ ID NO: 339476 - RNA, 24 nt, Human
cucuccacaaaucuucucuguaag

SEQ ID NO: 339477 - RNA, 23 nt, Human
cugcccccaacaccugucuuaac

SEQ ID NO: 339478 - RNA, 26 nt, Human
cugcggggccgcggggcgcagggccg

SEQ ID NO: 339479 - RNA, 21 nt, Human
cuuucagaagcaggagcccag

SEQ ID NO: 339480 - RNA, 25 nt, Human
cuuuguguccgccgacccagugugg

SEQ ID NO: 339481 - RNA, 25 nt, Human
gaaaacuaaagccaaaccccaagau

SEQ ID NO: 339482 - RNA, 21 nt, Human
gaaacgccaggcagaaaacag

SEQ ID NO: 339483 - RNA, 21 nt, Human
gaaccugaauuugagccagua

SEQ ID NO: 339484 - RNA, 18 nt, Human
gaaugcacuguggguggg

SEQ ID NO: 339485 - RNA, 20 nt, Human
gagccaaaccaaaccccgaa

SEQ ID NO: 339486 - RNA, 21 nt, Human
gauugcagggaagcuuucugg

SEQ ID NO: 339487 - RNA, 22 nt, Human
gcagaaaacagagucuguaaca

SEQ ID NO: 339488 - RNA, 19 nt, Human
gcagacaccccagaacacc

SEQ ID NO: 339489 - RNA, 22 nt, Human
gcaggaagaggccucgcucaga

SEQ ID NO: 339490 - RNA, 18 nt, Human
gcagggaagcuuucugga

SEQ ID NO: 339491 - RNA, 20 nt, Human
gccgugaccuuuccugcgac

SEQ ID NO: 339492 - RNA, 26 nt, Human
gccugaagucccacgacaaaagguuc

SEQ ID NO: 339493 - RNA, 18 nt, Human
gccuggaaacgagggcag

SEQ ID NO: 339494 - RNA, 19 nt, Human
gcugcuggcagagcacagg

SEQ ID NO: 339495 - RNA, 18 nt, Human
gcuuugccucccugugaa

SEQ ID NO: 339496 - RNA, 22 nt, Human
ggaaaagaaaacuaaagccaaa

SEQ ID NO: 339497 - RNA, 22 nt, Human
ggaccagcacaauggcagaaga

SEQ ID NO: 339498 - RNA, 18 nt, Human
ggagugugucaguguguc

SEQ ID NO: 339499 - RNA, 21 nt, Human
ggaugaagagugggacucaaa

SEQ ID NO: 339500 - RNA, 22 nt, Human
ggaugcucgcugcugugaccag

SEQ ID NO: 339501 - RNA, 22 nt, Human
ggcggggauggggcgggaggcc

SEQ ID NO: 339502 - RNA, 27 nt, Human
gggaaaauccaaccacuccaacaaccc

SEQ ID NO: 339503 - RNA, 24 nt, Human
gggaccagcacaauggcagaagag

SEQ ID NO: 339504 - RNA, 21 nt, Human
gggaggcgacgcggaggggcu

SEQ ID NO: 339505 - RNA, 19 nt, Human
guaaaauacaggcugcccc

SEQ ID NO: 339506 - RNA, 19 nt, Human
gucacuugugugcugaguu

SEQ ID NO: 339507 - RNA, 23 nt, Human
gugaaacgccaggcagaaaacag

SEQ ID NO: 339508 - RNA, 21 nt, Human
gugaaacgccccuuugcuccc

SEQ ID NO: 339509 - RNA, 22 nt, Human
uaaaaaagacauucauccagaa

SEQ ID NO: 339510 - RNA, 21 nt, Human
uaaaaagccaugcugcagaac

SEQ ID NO: 339511 - RNA, 22 nt, Human
uaacaccauaaacaggcugaaa

SEQ ID NO: 339512 - RNA, 24 nt, Human
uaacaucgucccugcaaacccugg

SEQ ID NO: 339513 - RNA, 19 nt, Human
uaacuccaggaucucccuu

SEQ ID NO: 339514 - RNA, 24 nt, Human
uagaaggaaaucuacaauggacac

SEQ ID NO: 339515 - RNA, 23 nt, Human
uagcucuuggauuccaaauuccu

SEQ ID NO: 339516 - RNA, 21 nt, Human
uaggguaaaauacaggcugcc

SEQ ID NO: 339517 - RNA, 20 nt, Human
uauggaagaaaaaaaggcug

SEQ ID NO: 339518 - RNA, 20 nt, Human
uauggaagaaaaaaaggcuu

SEQ ID NO: 339519 - RNA, 24 nt, Human
ucaaagacaccaugaaggucaggg

SEQ ID NO: 339520 - RNA, 18 nt, Human
ucaacagacaaaacaagc

SEQ ID NO: 339521 - RNA, 19 nt, Human
ucaacagacaaaacaagcc

SEQ ID NO: 339522 - RNA, 18 nt, Human
ucaagccaauguggccug

SEQ ID NO: 339523 - RNA, 21 nt, Human
ucacgauuucugggugucuac

SEQ ID NO: 339524 - RNA, 22 nt, Human
ucagcaacucuuccugcucccu

SEQ ID NO: 339525 - RNA, 22 nt, Human
uccaaauuccuaugcccccgau

SEQ ID NO: 339526 - RNA, 23 nt, Human
uccaaccacuccaacaaccccaa

SEQ ID NO: 339527 - RNA, 19 nt, Human
uccaggaucucccuugcuc

SEQ ID NO: 339528 - RNA, 18 nt, Human
uccuggauggacuuugug

SEQ ID NO: 339529 - RNA, 19 nt, Human
uccugggucacuugugugc

SEQ ID NO: 339530 - RNA, 20 nt, Human
ucgccacgugccuucuucug

SEQ ID NO: 339531 - RNA, 19 nt, Human
ucuacaauggacacaggcc

SEQ ID NO: 339532 - RNA, 23 nt, Human
ucuagaaggaaaucuacaaugga

SEQ ID NO: 339533 - RNA, 19 nt, Human
ucucauggcaaacuacucu

SEQ ID NO: 339534 - RNA, 22 nt, Human
ucugauggagcagaugucugug

SEQ ID NO: 339535 - RNA, 18 nt, Human
ucugcaagccucgugggc

SEQ ID NO: 339536 - RNA, 24 nt, Human
ucugcaagccucgugggcucugga

SEQ ID NO: 339537 - RNA, 20 nt, Human
ucugcacgcacagugaaggg

SEQ ID NO: 339538 - RNA, 24 nt, Human
ucuggauguucaguccaguccagg

SEQ ID NO: 339539 - RNA, 18 nt, Human
ucugguuuuguuuuccga

SEQ ID NO: 339540 - RNA, 22 nt, Human
ucuguggcaagaaagauggggc

SEQ ID NO: 339541 - RNA, 24 nt, Human
ucuucugaauuucucacucaauuc

SEQ ID NO: 339542 - RNA, 22 nt, Human
ucuucuguccucucacggcuaa

SEQ ID NO: 339543 - RNA, 26 nt, Human
ugaaagaaaaaaaacuagaaacauuu

SEQ ID NO: 339544 - RNA, 21 nt, Human
ugacacuggagaacagaaagu

SEQ ID NO: 339545 - RNA, 21 nt, Human
ugagaaaucaaggaaaagaaa

SEQ ID NO: 339546 - RNA, 23 nt, Human
ugagaagcagcccccacacagca

SEQ ID NO: 339547 - RNA, 19 nt, Human
ugagagaaaaggaucggaa

SEQ ID NO: 339548 - RNA, 23 nt, Human
ugagagaaaaggaucggaagagg

SEQ ID NO: 339549 - RNA, 19 nt, Human
ugaggguuucgggucgagg

SEQ ID NO: 339550 - RNA, 23 nt, Human
ugccaugagggccuguccccacc

SEQ ID NO: 339551 - RNA, 25 nt, Human
ugccaugagggccuguccccacccc

SEQ ID NO: 339552 - RNA, 21 nt, Human
ugcggggccgcggggcgcagg

SEQ ID NO: 339553 - RNA, 21 nt, Human
uggaaaaauggaugccaaagg

SEQ ID NO: 339554 - RNA, 20 nt, Human
uggaaacagaacagugacac

SEQ ID NO: 339555 - RNA, 22 nt, Human
uggaaucauuuucuuagaugau

SEQ ID NO: 339556 - RNA, 20 nt, Human
uggacacaggcccaugcgcu

SEQ ID NO: 339557 - RNA, 24 nt, Human
uggauuccaaauuccuaugccccc

SEQ ID NO: 339558 - RNA, 22 nt, Human
uggcaggaagcagggccgacag

SEQ ID NO: 339559 - RNA, 21 nt, Human
uggccacaauuccuuucucag

SEQ ID NO: 339560 - RNA, 23 nt, Human
uggccuccugagaagcagccccc

SEQ ID NO: 339561 - RNA, 23 nt, Human
uggcuggaaaaaauagaucacaa

SEQ ID NO: 339562 - RNA, 18 nt, Human
ugggaccagcacaauggc

SEQ ID NO: 339563 - RNA, 21 nt, Human
ugggagaaagugcguuacggc

SEQ ID NO: 339564 - RNA, 23 nt, Human
uggguccuggauggacuuugugu

SEQ ID NO: 339565 - RNA, 20 nt, Human
ugguagauguuguguucuac

SEQ ID NO: 339566 - RNA, 18 nt, Human
ugguuucuagaucaaacu

SEQ ID NO: 339567 - RNA, 23 nt, Human
ugucugguuuuguuuuccgaggg

SEQ ID NO: 339568 - RNA, 21 nt, Human
ugugacccgugcugagcgcac

SEQ ID NO: 339569 - RNA, 23 nt, Human
uuacuccuagacaaucaccuccu

SEQ ID NO: 339570 - RNA, 22 nt, Human
uucaaaaaugcucuaauucaau

SEQ ID NO: 339571 - RNA, 20 nt, Human
uucaacagacaaaacaagcc

SEQ ID NO: 339572 - RNA, 18 nt, Human
uuccugcucccucugcgg

SEQ ID NO: 339573 - RNA, 21 nt, Human
uucucuguaaguggaucccac

SEQ ID NO: 339574 - RNA, 19 nt, Human
uugcagggaagcuuucugg

SEQ ID NO: 339575 - RNA, 20 nt, Human
uuucaagcacagaccucaga

SEQ ID NO: 339576 - RNA, 22 nt, Human
uuucuuagaugaugaaauuuuc

SEQ ID NO: 339577 - RNA, 21 nt, Human
uuuuaagagaaacuggaaaug

SEQ ID NO: 339578 - RNA, 24 nt, Human
aggaguggggcugcagagggugcu

SEQ ID NO: 339579 - RNA, 20 nt, Human
aggccuccgggccucgcccu

SEQ ID NO: 339580 - RNA, 20 nt, Human
cagagggugcucaggccucc

SEQ ID NO: 339581 - RNA, 18 nt, Human
cagccgcacauuccaaca

SEQ ID NO: 339582 - RNA, 19 nt, Human
cagccgccgccagggucug

SEQ ID NO: 339583 - RNA, 19 nt, Human
caggaguggggcugcagag

SEQ ID NO: 339584 - RNA, 21 nt, Human
ccaagaaggcccaggaguggg

SEQ ID NO: 339585 - RNA, 23 nt, Human
ccaggaguggggcugcagagggu

SEQ ID NO: 339586 - RNA, 21 nt, Human
ccccgggccucggcggcgcuc

SEQ ID NO: 339587 - RNA, 24 nt, Human
cccugagucgccgcuccucgggag

SEQ ID NO: 339588 - RNA, 23 nt, Human
ccgccagggucuggggccccggg

SEQ ID NO: 339589 - RNA, 21 nt, Human
ccgucucggcugccgcagccg

SEQ ID NO: 339590 - RNA, 23 nt, Human
ccuccgggccucgcccugccguc

SEQ ID NO: 339591 - RNA, 21 nt, Human
cgacccugagucgccgcuccu

SEQ ID NO: 339592 - RNA, 23 nt, Human
cgcacauuccaacacaggacgcu

SEQ ID NO: 339593 - RNA, 19 nt, Human
cgggggagaggugggggag

SEQ ID NO: 339594 - RNA, 20 nt, Human
cugccgcagccgccgccagg

SEQ ID NO: 339595 - RNA, 24 nt, Human
cuggggccgucguggaccaagaag

SEQ ID NO: 339596 - RNA, 20 nt, Human
gaggggcgggcgacccugag

SEQ ID NO: 339597 - RNA, 19 nt, Human
gagucgccgcuccuucucc

SEQ ID NO: 339598 - RNA, 18 nt, Human
gccagggucuggggcccc

SEQ ID NO: 339599 - RNA, 20 nt, Human
gcgagcucgcggcagccgca

SEQ ID NO: 339600 - RNA, 20 nt, Human
gcggcgcucgcuccgcugcu

SEQ ID NO: 339601 - RNA, 20 nt, Human
gcucaggccuccgggccucg

SEQ ID NO: 339602 - RNA, 18 nt, Human
gcugcagagggugcucag

SEQ ID NO: 339603 - RNA, 22 nt, Human
ggaccaagaaggcccaggagug

SEQ ID NO: 339604 - RNA, 18 nt, Human
ggaguuucgggggagagg

SEQ ID NO: 339605 - RNA, 20 nt, Human
gggagggugguaaaguuggg

SEQ ID NO: 339606 - RNA, 21 nt, Human
gggccucggcggcgcucgcuc

SEQ ID NO: 339607 - RNA, 20 nt, Human
ggggagaggugggggagggu

SEQ ID NO: 339608 - RNA, 21 nt, Human
ggggagggugguaaaguuggg

SEQ ID NO: 339609 - RNA, 22 nt, Human
ggggagggugguaaaguugggu

SEQ ID NO: 339610 - RNA, 20 nt, Human
ggggcgggcgacccugaguc

SEQ ID NO: 339611 - RNA, 18 nt, Human
uccgggccucgcccugcc

SEQ ID NO: 339612 - RNA, 21 nt, Human
ucgcccugccgucucggcugc

SEQ ID NO: 339613 - RNA, 19 nt, Human
ucguggaccaagaaggccc

SEQ ID NO: 339614 - RNA, 24 nt, Human
ugcgccgcgcacccaguccgcgcc

SEQ ID NO: 339615 - RNA, 22 nt, Human
uuccaacacaggacgcugcgcc

SEQ ID NO: 339616 - RNA, 24 nt, Human
aaaaaaaggaacaugaucugguuu

SEQ ID NO: 339617 - RNA, 25 nt, Human
aaaaaaaggaacaugaucugguuua

SEQ ID NO: 339618 - RNA, 25 nt, Human
aaaaaaaggaacaugaucugguuua

SEQ ID NO: 339619 - RNA, 25 nt, Human
aaaaaaaggaacaugaucugguuua

SEQ ID NO: 339620 - RNA, 25 nt, Human
aaaaagcaucacagagaggaaggau

SEQ ID NO: 339621 - RNA, 18 nt, Human
aaaacuucaagugcagac

SEQ ID NO: 339622 - RNA, 18 nt, Human
aaaagaacuuaucacagu

SEQ ID NO: 339623 - RNA, 18 nt, Human
aaaagaacuuaucacagu

SEQ ID NO: 339624 - RNA, 18 nt, Human
aaaagaacuuaucacagu

SEQ ID NO: 339625 - RNA, 18 nt, Human
aaaagaacuuaucacagu

SEQ ID NO: 339626 - RNA, 19 nt, Human
aaacauaguugcaauaaug

SEQ ID NO: 339627 - RNA, 23 nt, Human
aaaccuguugcagcaauucacac

SEQ ID NO: 339628 - RNA, 23 nt, Human
aaaccuguugcagcaauucacac

SEQ ID NO: 339629 - RNA, 23 nt, Human
aaaccuguugcagcaauucacac

SEQ ID NO: 339630 - RNA, 23 nt, Human
aaaccuguugcagcaauucacac

SEQ ID NO: 339631 - RNA, 20 nt, Human
aaagaaagggccgguagacu

SEQ ID NO: 339632 - RNA, 20 nt, Human
aaagaaagggccgguagacu

SEQ ID NO: 339633 - RNA, 21 nt, Human
aaccaaaaguuuaccaugucu

SEQ ID NO: 339634 - RNA, 21 nt, Human
aaccaaaaguuuaccaugucu

SEQ ID NO: 339635 - RNA, 21 nt, Human
aaccuguucuuggucuccccu

SEQ ID NO: 339636 - RNA, 24 nt, Human
aacuagaaaaauccaacaguucag

SEQ ID NO: 339637 - RNA, 23 nt, Human
aagaaacagaaacaucuuguagc

SEQ ID NO: 339638 - RNA, 23 nt, Human
aagaaacagaaacaucuuguagc

SEQ ID NO: 339639 - RNA, 24 nt, Human
aagaaacagaaacaucuuguagcc

SEQ ID NO: 339640 - RNA, 24 nt, Human
aagaaacagaaacaucuuguagcc

SEQ ID NO: 339641 - RNA, 18 nt, Human
aagaaccaaaacuucaag

SEQ ID NO: 339642 - RNA, 19 nt, Human
aauuuuuuugccuuguuug

SEQ ID NO: 339643 - RNA, 19 nt, Human
aauuuuuuugccuuguuug

SEQ ID NO: 339644 - RNA, 19 nt, Human
acacugcugcacucaaugg

SEQ ID NO: 339645 - RNA, 23 nt, Human
acagaaacaucuuguagcagcau

SEQ ID NO: 339646 - RNA, 23 nt, Human
acagaaacaucuuguagcagcau

SEQ ID NO: 339647 - RNA, 24 nt, Human
acagaauguugguggucacugaug

SEQ ID NO: 339648 - RNA, 24 nt, Human
acagaauguugguggucacugaug

SEQ ID NO: 339649 - RNA, 23 nt, Human
acagauuacuacuuaauacucag

SEQ ID NO: 339650 - RNA, 23 nt, Human
acagauuacuacuuaauacucag

SEQ ID NO: 339651 - RNA, 23 nt, Human
acagauuacuacuuaauacucag

SEQ ID NO: 339652 - RNA, 23 nt, Human
acagauuacuacuuaauacucag

SEQ ID NO: 339653 - RNA, 18 nt, Human
acagccagaagagcugcu

SEQ ID NO: 339654 - RNA, 18 nt, Human
acagccagaagagcugcu

SEQ ID NO: 339655 - RNA, 18 nt, Human
acagccagaagagcugcu

SEQ ID NO: 339656 - RNA, 22 nt, Human
acagcuagcuagccugucccuu

SEQ ID NO: 339657 - RNA, 22 nt, Human
acagcuagcuagccugucccuu

SEQ ID NO: 339658 - RNA, 21 nt, Human
acaggacucucuccaggccag

SEQ ID NO: 339659 - RNA, 20 nt, Human
acagugcugacaacacagcc

SEQ ID NO: 339660 - RNA, 20 nt, Human
acagugcugacaacacagcc

SEQ ID NO: 339661 - RNA, 20 nt, Human
acagugcugacaacacagcc

SEQ ID NO: 339662 - RNA, 20 nt, Human
accaaaaguuuaccaugucu

SEQ ID NO: 339663 - RNA, 20 nt, Human
accaaaaguuuaccaugucu

SEQ ID NO: 339664 - RNA, 22 nt, Human
accacaaggcucuauuacacac

SEQ ID NO: 339665 - RNA, 22 nt, Human
accacaaggcucuauuacacac

SEQ ID NO: 339666 - RNA, 22 nt, Human
accacaaggcucuauuacacac

SEQ ID NO: 339667 - RNA, 22 nt, Human
accacaaggcucuauuacacac

SEQ ID NO: 339668 - RNA, 24 nt, Human
accccagaagcgccuuauucaacc

SEQ ID NO: 339669 - RNA, 24 nt, Human
acccuccugagaacaaaccuguug

SEQ ID NO: 339670 - RNA, 24 nt, Human
acccuccugagaacaaaccuguug

SEQ ID NO: 339671 - RNA, 20 nt, Human
accuugauuacaaaaaaagg

SEQ ID NO: 339672 - RNA, 20 nt, Human
accuugauuacaaaaaaagg

SEQ ID NO: 339673 - RNA, 21 nt, Human
acuacccccaggccccccccg

SEQ ID NO: 339674 - RNA, 24 nt, Human
agaaacauuuuuaaaaagcaucac

SEQ ID NO: 339675 - RNA, 19 nt, Human
agagcuaauaaggaugggg

SEQ ID NO: 339676 - RNA, 19 nt, Human
agagcuaauaaggaugggg

SEQ ID NO: 339677 - RNA, 19 nt, Human
agagcuaauaaggaugggg

SEQ ID NO: 339678 - RNA, 19 nt, Human
agagcuaauaaggaugggg

SEQ ID NO: 339679 - RNA, 21 nt, Human
agcaaugaagaaugacaagaa

SEQ ID NO: 339680 - RNA, 19 nt, Human
agcaauucugggacuccac

SEQ ID NO: 339681 - RNA, 21 nt, Human
agccaaacaccaucuuuuuca

SEQ ID NO: 339682 - RNA, 21 nt, Human
agccaaacaccaucuuuuuca

SEQ ID NO: 339683 - RNA, 23 nt, Human
agcugcugagacuucccaaaagc

SEQ ID NO: 339684 - RNA, 23 nt, Human
agcugcugagacuucccaaaagc

SEQ ID NO: 339685 - RNA, 23 nt, Human
agcugcugagacuucccaaaagc

SEQ ID NO: 339686 - RNA, 23 nt, Human
aggaaggauagugcaaaggggac

SEQ ID NO: 339687 - RNA, 19 nt, Human
aggaaugcuuaaccacuaa

SEQ ID NO: 339688 - RNA, 19 nt, Human
aggaaugcuuaaccacuaa

SEQ ID NO: 339689 - RNA, 27 nt, Human
aggaggggucugggggaaccuggcugu

SEQ ID NO: 339690 - RNA, 19 nt, Human
aggcaguguuuugguaauc

SEQ ID NO: 339691 - RNA, 19 nt, Human
aggcaguguuuugguaauc

SEQ ID NO: 339692 - RNA, 19 nt, Human
aggcaguguuuugguaauc

SEQ ID NO: 339693 - RNA, 19 nt, Human
agucugccaccugggaacu

SEQ ID NO: 339694 - RNA, 19 nt, Human
agucugccaccugggaacu

SEQ ID NO: 339695 - RNA, 27 nt, Human
caaaaagcaacugcuccagcuuuagca

SEQ ID NO: 339696 - RNA, 18 nt, Human
caaacacaggaagagcug

SEQ ID NO: 339697 - RNA, 18 nt, Human
caaacacaggaagagcug

SEQ ID NO: 339698 - RNA, 19 nt, Human
caaacaccaucuuuuucac

SEQ ID NO: 339699 - RNA, 19 nt, Human
caaacaccaucuuuuucac

SEQ ID NO: 339700 - RNA, 18 nt, Human
caaagacaaaagaaggag

SEQ ID NO: 339701 - RNA, 24 nt, Human
caacagcacacugcugcacucaau

SEQ ID NO: 339702 - RNA, 22 nt, Human
caacuagaaaaauccaacaguu

SEQ ID NO: 339703 - RNA, 22 nt, Human
caacuagaaaaauccaacaguu

SEQ ID NO: 339704 - RNA, 25 nt, Human
caacuagaaaaauccaacaguucag

SEQ ID NO: 339705 - RNA, 21 nt, Human
caagcaaugaagaaugacaac

SEQ ID NO: 339706 - RNA, 21 nt, Human
caagcaaugaagaaugacaac

SEQ ID NO: 339707 - RNA, 19 nt, Human
caaggauaaauuggucaag

SEQ ID NO: 339708 - RNA, 19 nt, Human
caaggauaaauuggucaag

SEQ ID NO: 339709 - RNA, 19 nt, Human
caaggauaaauuggucaag

SEQ ID NO: 339710 - RNA, 19 nt, Human
caaggauaaauuggucaag

SEQ ID NO: 339711 - RNA, 24 nt, Human
cacacaugugaacacagaauguug

SEQ ID NO: 339712 - RNA, 24 nt, Human
cacacaugugaacacagaauguug

SEQ ID NO: 339713 - RNA, 26 nt, Human
cacagcaccacagaccauguucuuuc

SEQ ID NO: 339714 - RNA, 30 nt, Human
cacaggcucuauaagagccaaacaccaucc

SEQ ID NO: 339715 - RNA, 30 nt, Human; identical to SEQ ID NO: 339714

SEQ ID NO: 339716 - RNA, 19 nt, Human
cacaguguaucugaaaaac

SEQ ID NO: 339717 - RNA, 19 nt, Human
cacaguguaucugaaaaac

SEQ ID NO: 339718 - RNA, 19 nt, Human
cacaguguaucugaaaaac

SEQ ID NO: 339719 - RNA, 19 nt, Human
cacaguguaucugaaaaac

SEQ ID NO: 339720 - RNA, 20 nt, Human
cacaucagaauuguaaucag

SEQ ID NO: 339721 - RNA, 22 nt, Human
caccaucuuuuucacaucagaa

SEQ ID NO: 339722 - RNA, 22 nt, Human
caccaucuuuuucacaucagaa

SEQ ID NO: 339723 - RNA, 23 nt, Human
cacggcucggccaaugugacguu

SEQ ID NO: 339724 - RNA, 23 nt, Human
cacggcucggccaaugugacguu

SEQ ID NO: 339725 - RNA, 22 nt, Human
cacuacccccaggccccccccg

SEQ ID NO: 339726 - RNA, 25 nt, Human
cacuacccccaggccccccccgcag

SEQ ID NO: 339727 - RNA, 25 nt, Human
cacuacccccaggccccccccgcag

SEQ ID NO: 339728 - RNA, 18 nt, Human
cacugcuuucgccucuac

SEQ ID NO: 339729 - RNA, 18 nt, Human
cacugcuuucgccucuac

SEQ ID NO: 339730 - RNA, 18 nt, Human
cagcaauucugggacucc

SEQ ID NO: 339731 - RNA, 21 nt, Human
cagcaauucugggacuccaac

SEQ ID NO: 339732 - RNA, 19 nt, Human
cagcccaaauuagagccag

SEQ ID NO: 339733 - RNA, 19 nt, Human
cagcccaaauuagagccag

SEQ ID NO: 339734 - RNA, 19 nt, Human
cagcccaaauuagagccag

SEQ ID NO: 339735 - RNA, 21 nt, Human
cagcccccuuucuucauacug

SEQ ID NO: 339736 - RNA, 21 nt, Human
cagcccccuuucuucauacug

SEQ ID NO: 339737 - RNA, 24 nt, Human
cagcccccuuucuucauacuguuc

SEQ ID NO: 339738 - RNA, 24 nt, Human
cagcccccuuucuucauacuguuc

SEQ ID NO: 339739 - RNA, 21 nt, Human
cagcuagcuagccugucccuu

SEQ ID NO: 339740 - RNA, 21 nt, Human
cagcuagcuagccugucccuu

SEQ ID NO: 339741 - RNA, 25 nt, Human
cagcuccugcaaccucgcuaccccu

SEQ ID NO: 339742 - RNA, 18 nt, Human
caggacucucuccaggcc

SEQ ID NO: 339743 - RNA, 23 nt, Human
cagggguaguggcugcucaguac

SEQ ID NO: 339744 - RNA, 23 nt, Human
cagggguaguggcugcucaguac

SEQ ID NO: 339745 - RNA, 22 nt, Human
cagugcugacaacacagccaga

SEQ ID NO: 339746 - RNA, 22 nt, Human
cagugcugacaacacagccaga

SEQ ID NO: 339747 - RNA, 20 nt, Human
cauagcaucgucagcacaaa

SEQ ID NO: 339748 - RNA, 22 nt, Human
cauagcaucgucagcacaaaug

SEQ ID NO: 339749 - RNA, 19 nt, Human
caucugugaccacaaacaa

SEQ ID NO: 339750 - RNA, 19 nt, Human
caucugugaccacaaacaa

SEQ ID NO: 339751 - RNA, 18 nt, Human
cauucugaauaaggacag

SEQ ID NO: 339752 - RNA, 23 nt, Human
cauuguaagaccacagcaccaca

SEQ ID NO: 339753 - RNA, 25 nt, Human
ccaaaacuucaagugcagacaguaa

SEQ ID NO: 339754 - RNA, 22 nt, Human
ccaaaagcugcccccacaagac

SEQ ID NO: 339755 - RNA, 22 nt, Human
ccaaaagcugcccccacaagac

SEQ ID NO: 339756 - RNA, 22 nt, Human
ccaaaagcugcccccacaagac

SEQ ID NO: 339757 - RNA, 23 nt, Human
ccaaaaguuuaccaugucuauag

SEQ ID NO: 339758 - RNA, 23 nt, Human
ccaaaaguuuaccaugucuauag

SEQ ID NO: 339759 - RNA, 23 nt, Human
ccaaaaguuuaccaugucuauag

SEQ ID NO: 339760 - RNA, 21 nt, Human
ccacacaugugaacacagaau

SEQ ID NO: 339761 - RNA, 21 nt, Human
ccacacaugugaacacagaau

SEQ ID NO: 339762 - RNA, 19 nt, Human
ccagugcaggcugaguggu

SEQ ID NO: 339763 - RNA, 22 nt, Human
ccaguggcugcucgccagugcc

SEQ ID NO: 339764 - RNA, 21 nt, Human
ccaguucgggucugacaugcc

SEQ ID NO: 339765 - RNA, 21 nt, Human
cccaaaagcugcccccacaag

SEQ ID NO: 339766 - RNA, 21 nt, Human
cccaaaagcugcccccacaag

SEQ ID NO: 339767 - RNA, 21 nt, Human
cccaaaagcugcccccacaag

SEQ ID NO: 339768 - RNA, 18 nt, Human
cccacaagacuggaggag

SEQ ID NO: 339769 - RNA, 19 nt, Human
ccccucuuccccuccagcc

SEQ ID NO: 339770 - RNA, 19 nt, Human
ccccucuuccccuccagcc

SEQ ID NO: 339771 - RNA, 20 nt, Human
ccccucuuccccuccagccc

SEQ ID NO: 339772 - RNA, 24 nt, Human
ccccugagaguuccgcccugaucu

SEQ ID NO: 339773 - RNA, 19 nt, Human
cccgugcgcgcuggggcca

SEQ ID NO: 339774 - RNA, 21 nt, Human
cccgugcgcgcuggggccacg

SEQ ID NO: 339775 - RNA, 19 nt, Human
ccugaagguggguaaggga

SEQ ID NO: 339776 - RNA, 19 nt, Human
cgccccauccccgcccggg

SEQ ID NO: 339777 - RNA, 20 nt, Human
cgcgacggacacugggggcg

SEQ ID NO: 339778 - RNA, 19 nt, Human
cggggcacucagcgcugcu

SEQ ID NO: 339779 - RNA, 19 nt, Human
cuacccccaggcccccccc

SEQ ID NO: 339780 - RNA, 19 nt, Human
cuacccccaggcccccccc

SEQ ID NO: 339781 - RNA, 20 nt, Human
cucaacugaauaccucccca

SEQ ID NO: 339782 - RNA, 18 nt, Human
cucccagugcaggcugag

SEQ ID NO: 339783 - RNA, 20 nt, Human
cucgugagugguacaggacu

SEQ ID NO: 339784 - RNA, 21 nt, Human
cucuaaucugauguauauuug

SEQ ID NO: 339785 - RNA, 20 nt, Human
cugaguggugcugguggcuc

SEQ ID NO: 339786 - RNA, 18 nt, Human
cugauaccaccauccaca

SEQ ID NO: 339787 - RNA, 18 nt, Human
cugauaccaccauccaca

SEQ ID NO: 339788 - RNA, 20 nt, Human
cugcgcgcccugcuucgguc

SEQ ID NO: 339789 - RNA, 18 nt, Human
cugcugcgcgcccugcuu

SEQ ID NO: 339790 - RNA, 18 nt, Human
gacacuaccaauuuugac

SEQ ID NO: 339791 - RNA, 19 nt, Human
gacucucuccaggccaguu

SEQ ID NO: 339792 - RNA, 20 nt, Human
gaggacauguggcugggacu

SEQ ID NO: 339793 - RNA, 19 nt, Human
gaguacaagcccuaccugc

SEQ ID NO: 339794 - RNA, 19 nt, Human
gaguacaagcccuaccugc

SEQ ID NO: 339795 - RNA, 27 nt, Human
gauuacaaaaaaaggaacaugaucugg

SEQ ID NO: 339796 - RNA, 27 nt, Human
gauuacaaaaaaaggaacaugaucugg

SEQ ID NO: 339797 - RNA, 27 nt, Human
gauuacaaaaaaaggaacaugaucugg

SEQ ID NO: 339798 - RNA, 23 nt, Human
gcaaagucagacauuuacaaaua

SEQ ID NO: 339799 - RNA, 24 nt, Human
gcagcggaaacguucuauaaaaca

SEQ ID NO: 339800 - RNA, 22 nt, Human
gcauuuuuaauaauuugagaaa

SEQ ID NO: 339801 - RNA, 22 nt, Human
gcauuuuuaauaauuugagaaa

SEQ ID NO: 339802 - RNA, 22 nt, Human
gcauuuuuaauaauuugagaaa

SEQ ID NO: 339803 - RNA, 22 nt, Human
gcauuuuuaauaauuugagaaa

SEQ ID NO: 339804 - RNA, 20 nt, Human
gcccccacaagacuggagga

SEQ ID NO: 339805 - RNA, 23 nt, Human
gccccccccgcagucucucauuc

SEQ ID NO: 339806 - RNA, 23 nt, Human
gccccccccgcagucucucauuc

SEQ ID NO: 339807 - RNA, 21 nt, Human
gccugcccaggaggggucugg

SEQ ID NO: 339808 - RNA, 23 nt, Human
gcugcccccacaagacuggagga

SEQ ID NO: 339809 - RNA, 23 nt, Human
gcugcccccacaagacuggagga

SEQ ID NO: 339810 - RNA, 22 nt, Human
gcugcgcgcccugcuucggucg

SEQ ID NO: 339811 - RNA, 20 nt, Human
ggaaccgucucagcuugaaa

SEQ ID NO: 339812 - RNA, 22 nt, Human
ggaggggucugggggaaccugg

SEQ ID NO: 339813 - RNA, 24 nt, Human
ggcauggaaucucuccauugugcu

SEQ ID NO: 339814 - RNA, 24 nt, Human
ggcauggaaucucuccauugugcu

SEQ ID NO: 339815 - RNA, 23 nt, Human
ggccccucuuccccuccagcccu

SEQ ID NO: 339816 - RNA, 20 nt, Human
ggcggcaacuagaaaaaucc

SEQ ID NO: 339817 - RNA, 20 nt, Human
ggcggcaacuagaaaaaucc

SEQ ID NO: 339818 - RNA, 19 nt, Human
ggcugggacuggggcugag

SEQ ID NO: 339819 - RNA, 18 nt, Human
gggcacucagcgcugcug

SEQ ID NO: 339820 - RNA, 21 nt, Human
gggggugcguccucccagggc

SEQ ID NO: 339821 - RNA, 18 nt, Human
gggucugggggaaccugg

SEQ ID NO: 339822 - RNA, 21 nt, Human
uaaaacaaacuaccaaaaacc

SEQ ID NO: 339823 - RNA, 21 nt, Human
uaaaacaaacuaccaaaaacc

SEQ ID NO: 339824 - RNA, 26 nt, Human
uaaaacaaacuaccaaaaacgagucu

SEQ ID NO: 339825 - RNA, 26 nt, Human
uaaaacaaacuaccaaaaacgagucu

SEQ ID NO: 339826 - RNA, 27 nt, Human
uaaacuggaugcaaagucagacauuua

SEQ ID NO: 339827 - RNA, 21 nt, Human
uaaauguaacuuaacagacac

SEQ ID NO: 339828 - RNA, 26 nt, Human
uaaauuacaaacacaggaagagcuga

SEQ ID NO: 339829 - RNA, 26 nt, Human
uaaauuacaaacacaggaagagcuga

SEQ ID NO: 339830 - RNA, 24 nt, Human
uaacacagcuagcuagccuguccc

SEQ ID NO: 339831 - RNA, 24 nt, Human
uaacacagcuagcuagccuguccc

SEQ ID NO: 339832 - RNA, 18 nt, Human
uaaccacuaagacucaga

SEQ ID NO: 339833 - RNA, 18 nt, Human
uaacucaggaauagacaa

SEQ ID NO: 339834 - RNA, 18 nt, Human
uaacucaggaauagacaa

SEQ ID NO: 339835 - RNA, 18 nt, Human
uaacucaggaauagacaa

SEQ ID NO: 339836 - RNA, 18 nt, Human
uaacucaggaauagacaa

SEQ ID NO: 339837 - RNA, 23 nt, Human
uaagaccacagcaccacagacca

SEQ ID NO: 339838 - RNA, 20 nt, Human
uaaggaaagguugcaugauu

SEQ ID NO: 339839 - RNA, 20 nt, Human
uaaggaaagguugcaugauu

SEQ ID NO: 339840 - RNA, 24 nt, Human
uaaggauggggacuuuuauaacuc

SEQ ID NO: 339841 - RNA, 24 nt, Human
uaaggauggggacuuuuauaacuc

SEQ ID NO: 339842 - RNA, 24 nt, Human
uaaggauggggacuuuuauaacuc

SEQ ID NO: 339843 - RNA, 24 nt, Human
uaaggauggggacuuuuauaacuc

SEQ ID NO: 339844 - RNA, 21 nt, Human
uacaaauaaaaagguucagag

SEQ ID NO: 339845 - RNA, 27 nt, Human
uacacuuauuuucacauccuuuuagaa

SEQ ID NO: 339846 - RNA, 25 nt, Human
uaccaaaaacgagucugccaccugg

SEQ ID NO: 339847 - RNA, 23 nt, Human
uacuaugacuugauucccacccc

SEQ ID NO: 339848 - RNA, 25 nt, Human
uagcauauacacuaucauuuggaua

SEQ ID NO: 339849 - RNA, 18 nt, Human
uagcaucgucagcacaaa

SEQ ID NO: 339850 - RNA, 18 nt, Human
uaggaaacagaaaaaauu

SEQ ID NO: 339851 - RNA, 21 nt, Human
uagugccaucagcucucguga

SEQ ID NO: 339852 - RNA, 22 nt, Human
uaucugaaaaacagcccaaauu

SEQ ID NO: 339853 - RNA, 22 nt, Human
uaucugaaaaacagcccaaauu

SEQ ID NO: 339854 - RNA, 22 nt, Human
uaucugaaaaacagcccaaauu

SEQ ID NO: 339855 - RNA, 22 nt, Human
uaucugaaaaacagcccaaauu

SEQ ID NO: 339856 - RNA, 18 nt, Human
uaucugaaaaccaaaagu

SEQ ID NO: 339857 - RNA, 18 nt, Human
uaucugaaaaccaaaagu

SEQ ID NO: 339858 - RNA, 18 nt, Human
uaucugaaaaccaaaagu

SEQ ID NO: 339859 - RNA, 18 nt, Human
uaucugaaaaccaaaagu

SEQ ID NO: 339860 - RNA, 19 nt, Human
ucacaaagaaagggccggu

SEQ ID NO: 339861 - RNA, 19 nt, Human
ucacaaagaaagggccggu

SEQ ID NO: 339862 - RNA, 18 nt, Human
ucagaaguaaaaccaccu

SEQ ID NO: 339863 - RNA, 18 nt, Human
ucagaaguaaaaccaccu

SEQ ID NO: 339864 - RNA, 18 nt, Human
ucagaaucuaagaaacag

SEQ ID NO: 339865 - RNA, 18 nt, Human
ucagaaucuaagaaacag

SEQ ID NO: 339866 - RNA, 25 nt, Human
ucagcaauucugggacuccaacagc

SEQ ID NO: 339867 - RNA, 25 nt, Human
ucagcaauucugggacuccaacagc

SEQ ID NO: 339868 - RNA, 19 nt, Human
ucauacuguucucaucagg

SEQ ID NO: 339869 - RNA, 19 nt, Human
ucauucugaauaaggacag

SEQ ID NO: 339870 - RNA, 24 nt, Human
uccacauaguaaagauggcaugga

SEQ ID NO: 339871 - RNA, 24 nt, Human
uccacauaguaaagauggcaugga

SEQ ID NO: 339872 - RNA, 19 nt, Human
ucccaaaagcugcccccac

SEQ ID NO: 339873 - RNA, 19 nt, Human
ucccaaaagcugcccccac

SEQ ID NO: 339874 - RNA, 19 nt, Human
ucccaaaagcugcccccac

SEQ ID NO: 339875 - RNA, 20 nt, Human
ucccaaaagcugcccccaca

SEQ ID NO: 339876 - RNA, 20 nt, Human
ucccaaaagcugcccccaca

SEQ ID NO: 339877 - RNA, 20 nt, Human
ucccaaaagcugcccccaca

SEQ ID NO: 339878 - RNA, 20 nt, Human
ucucagcauguuucuucccc

SEQ ID NO: 339879 - RNA, 20 nt, Human
ucucagcauguuucuucccc

SEQ ID NO: 339880 - RNA, 22 nt, Human
ucucuaaucugauguauauuug

SEQ ID NO: 339881 - RNA, 21 nt, Human
ucugccaccugggaacugaac

SEQ ID NO: 339882 - RNA, 21 nt, Human
ucugccaccugggaacugaac

SEQ ID NO: 339883 - RNA, 27 nt, Human
ucugugaccacaaacaagccggggucc

SEQ ID NO: 339884 - RNA, 27 nt, Human
ucugugaccacaaacaagccggggucc

SEQ ID NO: 339885 - RNA, 23 nt, Human
ugaaaaacagcccaaauuagagc

SEQ ID NO: 339886 - RNA, 23 nt, Human
ugaaaaacagcccaaauuagagc

SEQ ID NO: 339887 - RNA, 23 nt, Human
ugaaaaacagcccaaauuagagc

SEQ ID NO: 339888 - RNA, 23 nt, Human
ugaaaaacagcccaaauuagagc

SEQ ID NO: 339889 - RNA, 24 nt, Human
ugaguccauuaccuuucacaaaga

SEQ ID NO: 339890 - RNA, 24 nt, Human
ugaguccauuaccuuucacaaaga

SEQ ID NO: 339891 - RNA, 22 nt, Human
ugcaggcugaguggugcuggug

SEQ ID NO: 339892 - RNA, 18 nt, Human
ugcaggcugguggcaggu

SEQ ID NO: 339893 - RNA, 19 nt, Human
ugcugcacucaauggcuua

SEQ ID NO: 339894 - RNA, 24 nt, Human
ugcugcaggcugguggcagguggg

SEQ ID NO: 339895 - RNA, 24 nt, Human
ugcugcaggcugguggcagguggg

SEQ ID NO: 339896 - RNA, 23 nt, Human
ugcugggcacugaagagaaagga

SEQ ID NO: 339897 - RNA, 23 nt, Human
ugcugggcacugaagagaaagga

SEQ ID NO: 339898 - RNA, 22 nt, Human
uggaaacccaguguuagugcca

SEQ ID NO: 339899 - RNA, 22 nt, Human
uggaggacauguggcugggacu

SEQ ID NO: 339900 - RNA, 21 nt, Human
uggcuguggggugugcugcag

SEQ ID NO: 339901 - RNA, 21 nt, Human
uggcuguggggugugcugcag

SEQ ID NO: 339902 - RNA, 20 nt, Human
ugggacuccaacagcccccc

SEQ ID NO: 339903 - RNA, 20 nt, Human
ugggacuccaacagcccccc

SEQ ID NO: 339904 - RNA, 18 nt, Human
ugggacuggggcugaggc

SEQ ID NO: 339905 - RNA, 22 nt, Human
ugggauucacagcagcaaagcc

SEQ ID NO: 339906 - RNA, 22 nt, Human
ugggauucacagcagcaaagcc

SEQ ID NO: 339907 - RNA, 18 nt, Human
uguagcaguccuugguca

SEQ ID NO: 339908 - RNA, 18 nt, Human
uguagcaguccuugguca

SEQ ID NO: 339909 - RNA, 19 nt, Human
ugugcuaaaucuaggaauc

SEQ ID NO: 339910 - RNA, 19 nt, Human
ugugcuaaaucuaggaauc

SEQ ID NO: 339911 - RNA, 18 nt, Human
uguggcugggacuggggc

SEQ ID NO: 339912 - RNA, 23 nt, Human
ugugugcuucauguuuaaauuuu

SEQ ID NO: 339913 - RNA, 23 nt, Human
ugugugcuucauguuuaaauuuu

SEQ ID NO: 339914 - RNA, 22 nt, Human
uguucugcacugaagaaccaaa

SEQ ID NO: 339915 - RNA, 23 nt, Human
uuaaagugaguacaagcccuacc

SEQ ID NO: 339916 - RNA, 23 nt, Human
uuaaagugaguacaagcccuacc

SEQ ID NO: 339917 - RNA, 19 nt, Human
uuaaauuacaaacacagga

SEQ ID NO: 339918 - RNA, 22 nt, Human
uuaauacucaguaauacuuaau

SEQ ID NO: 339919 - RNA, 22 nt, Human
uuaauacucaguaauacuuaau

SEQ ID NO: 339920 - RNA, 22 nt, Human
uuaauacucaguaauacuuaau

SEQ ID NO: 339921 - RNA, 22 nt, Human
uuaauacucaguaauacuuaau

SEQ ID NO: 339922 - RNA, 22 nt, Human
uuacaaaaaaaggaacaugauc

SEQ ID NO: 339923 - RNA, 22 nt, Human
uuacaaaaaaaggaacaugauc

SEQ ID NO: 339924 - RNA, 22 nt, Human
uuacaaaaaaaggaacaugauc

SEQ ID NO: 339925 - RNA, 22 nt, Human
uuacaaaaaaaggaacaugauc

SEQ ID NO: 339926 - RNA, 24 nt, Human
uuaccuuucacaaagaaauguuaa

SEQ ID NO: 339927 - RNA, 18 nt, Human
uuagugccaucagcucuc

SEQ ID NO: 339928 - RNA, 22 nt, Human
uucacauccuuuuagaaaaaca

SEQ ID NO: 339929 - RNA, 19 nt, Human
uucccaaaagcugccccca

SEQ ID NO: 339930 - RNA, 19 nt, Human
uucccaaaagcugccccca

SEQ ID NO: 339931 - RNA, 19 nt, Human
uucccaaaagcugccccca

SEQ ID NO: 339932 - RNA, 25 nt, Human
uugcugggcaaugugguaauuacac

SEQ ID NO: 339933 - RNA, 30 nt, Human
uuggcaagaaccauauuuacuguccauugg

SEQ ID NO: 339934 - RNA, 23 nt, Human
uugugcaucugugaccacaaaca

SEQ ID NO: 339935 - RNA, 23 nt, Human
uugugcaucugugaccacaaaca

SEQ ID NO: 339936 - RNA, 20 nt, Human
uuuaaguccuaucagugcuu

SEQ ID NO: 339937 - RNA, 20 nt, Human
uuuaaguccuaucagugcuu

SEQ ID NO: 339938 - RNA, 20 nt, Human
uuuaaguccuaucagugcuu

SEQ ID NO: 339939 - RNA, 20 nt, Human
uuuuccucuaccauccuaag

SEQ ID NO: 339940 - RNA, 23 nt, Human
aaaaaacaaugcacugaccacau

SEQ ID NO: 339941 - RNA, 18 nt, Human
aaaaagcaccaugcacaa

SEQ ID NO: 339942 - RNA, 19 nt, Human
aacaaaaaugucuuugcac

SEQ ID NO: 339943 - RNA, 19 nt, Human
aacggcgggcggggcggug

SEQ ID NO: 339944 - RNA, 21 nt, Human
acacauacuggagcaaaucca

SEQ ID NO: 339945 - RNA, 19 nt, Human
acagacaguucaaggaaaa

SEQ ID NO: 339946 - RNA, 23 nt, Human
accucgaggaacggcgggcgggg

SEQ ID NO: 339947 - RNA, 24 nt, Human
acuuugagucaagcaaaaccuaga

SEQ ID NO: 339948 - RNA, 25 nt, Human
agaagcaauagaaaugucuauacaa

SEQ ID NO: 339949 - RNA, 19 nt, Human
agacagugaacauccuuga

SEQ ID NO: 339950 - RNA, 18 nt, Human
agcagcagcggcggcggc

SEQ ID NO: 339951 - RNA, 21 nt, Human
agucacuauccuuacugaaaa

SEQ ID NO: 339952 - RNA, 20 nt, Human
auagagguaaggaaagaugc

SEQ ID NO: 339953 - RNA, 19 nt, Human
aucuacucaaaugaauuua

SEQ ID NO: 339954 - RNA, 20 nt, Human
augaaaguuaaaaagcacca

SEQ ID NO: 339955 - RNA, 21 nt, Human
augaaaguuaaaaagcaccau

SEQ ID NO: 339956 - RNA, 18 nt, Human
augaucuacucaaaugaa

SEQ ID NO: 339957 - RNA, 18 nt, Human
augucuucugacuugaaa

SEQ ID NO: 339958 - RNA, 18 nt, Human
auuggcagguauccagcc

SEQ ID NO: 339959 - RNA, 19 nt, Human
caaaaugcuacacguggua

SEQ ID NO: 339960 - RNA, 24 nt, Human
caaauauucuaaauacacauuuug

SEQ ID NO: 339961 - RNA, 23 nt, Human
caacaggcccacagguuuguaac

SEQ ID NO: 339962 - RNA, 20 nt, Human
caaggcaagaaaaucccgcc

SEQ ID NO: 339963 - RNA, 22 nt, Human
cacaguuccucacaaugcccca

SEQ ID NO: 339964 - RNA, 22 nt, Human
caccuguaauacugugauauug

SEQ ID NO: 339965 - RNA, 24 nt, Human
cacggcccccuccccucacacaga

SEQ ID NO: 339966 - RNA, 18 nt, Human
cagcagcggcggcggcuc

SEQ ID NO: 339967 - RNA, 23 nt, Human
cagcggcagcagcagcggcggcg

SEQ ID NO: 339968 - RNA, 24 nt, Human
cagcggcggcggcucccuccgcag

SEQ ID NO: 339969 - RNA, 22 nt, Human
caguuugaucaaaauaacgauc

SEQ ID NO: 339970 - RNA, 18 nt, Human
cauagagguaaggaaaga

SEQ ID NO: 339971 - RNA, 21 nt, Human
caucguauggcacauagaggu

SEQ ID NO: 339972 - RNA, 18 nt, Human
cauugcacauuauuuuac

SEQ ID NO: 339973 - RNA, 22 nt, Human
ccccuccccucacacagaggca

SEQ ID NO: 339974 - RNA, 23 nt, Human
ccccuccccuucucggcacggcc

SEQ ID NO: 339975 - RNA, 21 nt, Human
cccggcagcggcagcagcagc

SEQ ID NO: 339976 - RNA, 23 nt, Human
ccuccgcagcggcggcggcgccc

SEQ ID NO: 339977 - RNA, 22 nt, Human
cgacccggcagcggcagcagca

SEQ ID NO: 339978 - RNA, 23 nt, Human
cggcagcagcagcggcggcggcu

SEQ ID NO: 339979 - RNA, 25 nt, Human
cucacaaugccccauuaauagcuaa

SEQ ID NO: 339980 - RNA, 20 nt, Human
cuccgaagacucgcaccacc

SEQ ID NO: 339981 - RNA, 20 nt, Human
cugaccacauaauuccuuuu

SEQ ID NO: 339982 - RNA, 21 nt, Human
cugcagcucuuguugccauga

SEQ ID NO: 339983 - RNA, 20 nt, Human
cuuuaagagguuuucagugc

SEQ ID NO: 339984 - RNA, 22 nt, Human
cuuucuggcugcuguccauaac

SEQ ID NO: 339985 - RNA, 18 nt, Human
gacaugucuucugacuug

SEQ ID NO: 339986 - RNA, 19 nt, Human
gauuggcagguauccagcc

SEQ ID NO: 339987 - RNA, 23 nt, Human
gcaaggagagaagcccucgaagc

SEQ ID NO: 339988 - RNA, 23 nt, Human
gcacccggcaaggggccgcaagg

SEQ ID NO: 339989 - RNA, 20 nt, Human
gcacugaaaaaaauagcacc

SEQ ID NO: 339990 - RNA, 19 nt, Human
gcagcagcagcggcggcgg

SEQ ID NO: 339991 - RNA, 21 nt, Human
gccgccacugcgccaccgccg

SEQ ID NO: 339992 - RNA, 21 nt, Human
gccucccuucacuggcgaccc

SEQ ID NO: 339993 - RNA, 21 nt, Human
gcuccuuccacugggaaguaa

SEQ ID NO: 339994 - RNA, 21 nt, Human
ggagcaaauccaacaccugac

SEQ ID NO: 339995 - RNA, 22 nt, Human
ggcacauagagguaaggaaaga

SEQ ID NO: 339996 - RNA, 21 nt, Human
gucuuugcacaguuccucaca

SEQ ID NO: 339997 - RNA, 22 nt, Human
uaaaaaacaaugcacugaccac

SEQ ID NO: 339998 - RNA, 21 nt, Human
uaaaaagcaccaugcacaaca

SEQ ID NO: 339999 - RNA, 21 nt, Human
uacaaaauauuuugcagucaa

SEQ ID NO: 340000 - RNA, 21 nt, Human
uacacaguuauacaaauauuc

SEQ ID NO: 340001 - RNA, 22 nt, Human
uacacaguuauacaaauauucu

SEQ ID NO: 340002 - RNA, 25 nt, Human
uauacaaaacaagcaaauggaauaa

SEQ ID NO: 340003 - RNA, 20 nt, Human
uauucagagaucaacaagua

SEQ ID NO: 340004 - RNA, 18 nt, Human
ucaggagcacccggcaag

SEQ ID NO: 340005 - RNA, 21 nt, Human
uccagccccugcagcgggcug

SEQ ID NO: 340006 - RNA, 22 nt, Human
ucccuccgcagcggcggcggcg

SEQ ID NO: 340007 - RNA, 26 nt, Human
uccucacaaugccccauuaauagcua

SEQ ID NO: 340008 - RNA, 23 nt, Human
uccucggucccaggcugcagcuc

SEQ ID NO: 340009 - RNA, 22 nt, Human
ucucgaaguaacacgucuugau

SEQ ID NO: 340010 - RNA, 18 nt, Human
ucugcagucacuauccuu

SEQ ID NO: 340011 - RNA, 26 nt, Human
ugaaaaguaaaaaaguguauuuacaa

SEQ ID NO: 340012 - RNA, 21 nt, Human
ugacagaaugaggaauuugua

SEQ ID NO: 340013 - RNA, 22 nt, Human
ugagaaaaacaauuuugagaga

SEQ ID NO: 340014 - RNA, 22 nt, Human
ugagaaagauagcuuucuggcu

SEQ ID NO: 340015 - RNA, 18 nt, Human
ugagagaaaucuuccuca

SEQ ID NO: 340016 - RNA, 19 nt, Human
ugagagaaaucuuccucag

SEQ ID NO: 340017 - RNA, 25 nt, Human
ugaggagggaggcgagcgcagucuc

SEQ ID NO: 340018 - RNA, 18 nt, Human
uggagcaaauccaacacc

SEQ ID NO: 340019 - RNA, 18 nt, Human
uggcugcuguccauaacc

SEQ ID NO: 340020 - RNA, 22 nt, Human
ugggugaggggggauuggcagg

SEQ ID NO: 340021 - RNA, 18 nt, Human
uggugcugccgccacugc

SEQ ID NO: 340022 - RNA, 21 nt, Human
uguaacaaaaaugucuuugca

SEQ ID NO: 340023 - RNA, 21 nt, Human
uuaagagguuuucagugcucc

SEQ ID NO: 340024 - RNA, 19 nt, Human
uucacaaggcaagaaaauc

SEQ ID NO: 340025 - RNA, 19 nt, Human
uucgccgccgccgccacug

SEQ ID NO: 340026 - RNA, 19 nt, Human
uugacaggggccuggguga

SEQ ID NO: 340027 - RNA, 23 nt, Human
uugauacagacaguucaaggaaa

SEQ ID NO: 340028 - RNA, 18 nt, Human
uuucgucggugcuggugc

SEQ ID NO: 340029 - RNA, 21 nt, Human
uuucgucggugcuggugcugc

SEQ ID NO: 340030 - RNA, 20 nt, Human
uuugagagaaaucuuccuca

SEQ ID NO: 340031 - RNA, 23 nt, Human
uuugaucaaaauaacgaucuacu

SEQ ID NO: 340032 - RNA, 22 nt, Human
uuuugagagaaaucuuccucag

SEQ ID NO: 340033 - RNA, 24 nt, Human
aaacaugguugcucugggaaaaaa

SEQ ID NO: 340034 - RNA, 20 nt, Human
aaagugaacaaaagccagug

SEQ ID NO: 340035 - RNA, 23 nt, Human
aaauagcuagacaucuaaauucc

SEQ ID NO: 340036 - RNA, 19 nt, Human
aagcaguccuaucaaccuc

SEQ ID NO: 340037 - RNA, 21 nt, Human
aagcauuuucaguuagaaaca

SEQ ID NO: 340038 - RNA, 19 nt, Human
aagccaucacaggacagga

SEQ ID NO: 340039 - RNA, 23 nt, Human
aaggcgcuggcuggcuggcgggu

SEQ ID NO: 340040 - RNA, 24 nt, Human
acgcugcaaagccccauaacagac

SEQ ID NO: 340041 - RNA, 20 nt, Human
acugguaaauacaguuuaaa

SEQ ID NO: 340042 - RNA, 21 nt, Human
agaccucugagcauuuaccaa

SEQ ID NO: 340043 - RNA, 24 nt, Human
agaggacaguggaggacccaagca

SEQ ID NO: 340044 - RNA, 21 nt, Human
auacaguuauaggaauaaccc

SEQ ID NO: 340045 - RNA, 19 nt, Human
auucagaagcacgucuaac

SEQ ID NO: 340046 - RNA, 21 nt, Human
auucgcgccaacaacuucucc

SEQ ID NO: 340047 - RNA, 22 nt, Human
auuuauuuacaaaauuucacca

SEQ ID NO: 340048 - RNA, 21 nt, Human
caaaagacgccuuaguacuac

SEQ ID NO: 340049 - RNA, 18 nt, Human
caaggcuuucucuagacc

SEQ ID NO: 340050 - RNA, 23 nt, Human
cacauaauaggaacugccuuuaa

SEQ ID NO: 340051 - RNA, 20 nt, Human
cacccaaacaagacuaccag

SEQ ID NO: 340052 - RNA, 22 nt, Human
cagaccacugcaugaaauccuu

SEQ ID NO: 340053 - RNA, 21 nt, Human
cagcagagacguggucaacac

SEQ ID NO: 340054 - RNA, 21 nt, Human
cauacccuucuagccauacca

SEQ ID NO: 340055 - RNA, 26 nt, Human
caucacaggacaggacuagaucucuc

SEQ ID NO: 340056 - RNA, 20 nt, Human
cauucagaagcacgucuaac

SEQ ID NO: 340057 - RNA, 23 nt, Human
cccaaacaagacuaccaguuccu

SEQ ID NO: 340058 - RNA, 19 nt, Human
cucaggauccauucgcgcc

SEQ ID NO: 340059 - RNA, 23 nt, Human
cucaucacccaaacaagacuacc

SEQ ID NO: 340060 - RNA, 22 nt, Human
cugcagccccccacgcugcaaa

SEQ ID NO: 340061 - RNA, 24 nt, Human
cuucuagccauaccacccuuuauu

SEQ ID NO: 340062 - RNA, 19 nt, Human
gacaucuaaauuccaggcu

SEQ ID NO: 340063 - RNA, 22 nt, Human
gcccuuuuuuaaaaaaugaaaa

SEQ ID NO: 340064 - RNA, 19 nt, Human
gcuccgauaagagaaugaa

SEQ ID NO: 340065 - RNA, 18 nt, Human
gcucugggaaaaaacaag

SEQ ID NO: 340066 - RNA, 18 nt, Human
ggacaccaggucauccca

SEQ ID NO: 340067 - RNA, 18 nt, Human
ggacuggucaggagggag

SEQ ID NO: 340068 - RNA, 20 nt, Human
gggagaguaaaaaguggcug

SEQ ID NO: 340069 - RNA, 22 nt, Human
uaaaaaguggcugucgcuagug

SEQ ID NO: 340070 - RNA, 19 nt, Human
uaaagcagggaauacgauc

SEQ ID NO: 340071 - RNA, 19 nt, Human
uaaaggccauuaggauaaa

SEQ ID NO: 340072 - RNA, 22 nt, Human
uaaauuccaggcuagguccaua

SEQ ID NO: 340073 - RNA, 21 nt, Human
uaacagaccacugcaugaaau

SEQ ID NO: 340074 - RNA, 20 nt, Human
uaagaaugucugagaaucuu

SEQ ID NO: 340075 - RNA, 18 nt, Human
uaagagccugacccagcc

SEQ ID NO: 340076 - RNA, 24 nt, Human
uaaguuaaaaaaauuuacaucaau

SEQ ID NO: 340077 - RNA, 26 nt, Human
uaaguuaaaaaaauuuacaucaauga

SEQ ID NO: 340078 - RNA, 19 nt, Human
uacacauaucauguggaac

SEQ ID NO: 340079 - RNA, 21 nt, Human
uacacauaucauguggaacau

SEQ ID NO: 340080 - RNA, 21 nt, Human
uaggaauaacccaaacuucca

SEQ ID NO: 340081 - RNA, 19 nt, Human
uaucugacaauguacaaag

SEQ ID NO: 340082 - RNA, 21 nt, Human
uaugcuaaaacaugguugcuc

SEQ ID NO: 340083 - RNA, 19 nt, Human
ucaaugaaaaaagaagcaa

SEQ ID NO: 340084 - RNA, 23 nt, Human
ucacagagguagcacagaccucu

SEQ ID NO: 340085 - RNA, 20 nt, Human
ucagaagcacgucuaacuag

SEQ ID NO: 340086 - RNA, 19 nt, Human
ucaguuagaaacagcuuua

SEQ ID NO: 340087 - RNA, 21 nt, Human
uccauaaaugacauuuuucac

SEQ ID NO: 340088 - RNA, 29 nt, Human
ucucccgcgaagugcaagaaggcgaagac

SEQ ID NO: 340089 - RNA, 22 nt, Human
ucucucaggggcaaagugaaca

SEQ ID NO: 340090 - RNA, 27 nt, Human
ucucucaggggcaaagugaacaaaagc

SEQ ID NO: 340091 - RNA, 22 nt, Human
ucuuaagccuacaaaagacgcc

SEQ ID NO: 340092 - RNA, 25 nt, Human
ucuucugcagccccccacgcugcaa

SEQ ID NO: 340093 - RNA, 18 nt, Human
ugacagaggacaguggag

SEQ ID NO: 340094 - RNA, 20 nt, Human
ugacuccaaagcccaggugu

SEQ ID NO: 340095 - RNA, 23 nt, Human
ugacuccaaagcccagguguagu

SEQ ID NO: 340096 - RNA, 20 nt, Human
ugcaagaaggcgaagacagu

SEQ ID NO: 340097 - RNA, 26 nt, Human
ugcaagaaggcgaagacagucuggga

SEQ ID NO: 340098 - RNA, 21 nt, Human
uggcgggugggccgguugagg

SEQ ID NO: 340099 - RNA, 18 nt, Human
uggcuggcuggcgggugg

SEQ ID NO: 340100 - RNA, 18 nt, Human
uggcuggcuggcgggugg

SEQ ID NO: 340101 - RNA, 20 nt, Human
ugggaauuccgcccuuuuuu

SEQ ID NO: 340102 - RNA, 22 nt, Human
ugggccgguugaggaaucuguu

SEQ ID NO: 340103 - RNA, 20 nt, Human
ugucugagaaucuucugcag

SEQ ID NO: 340104 - RNA, 21 nt, Human
ugucugagaaucuucugcagc

SEQ ID NO: 340105 - RNA, 19 nt, Human
uguuauguuucacacaaca

SEQ ID NO: 340106 - RNA, 20 nt, Human
uuaacuaaaaucugacucca

SEQ ID NO: 340107 - RNA, 22 nt, Human
uuauuuacaaaauuucaccaca

SEQ ID NO: 340108 - RNA, 20 nt, Human
uucacagcagagacgugguc

SEQ ID NO: 340109 - RNA, 22 nt, Human
uucacagcagagacguggucaa

SEQ ID NO: 340110 - RNA, 24 nt, Human
uucucuagaccagcuggacugguc

SEQ ID NO: 340111 - RNA, 20 nt, Human
uugucucaucacccaaacaa

SEQ ID NO: 340112 - RNA, 18 nt, Human
uuuaaaugucucaagaac

SEQ ID NO: 340113 - RNA, 24 nt, Human
aaagccgcggcuccuguaccucag

SEQ ID NO: 340114 - RNA, 24 nt, Human
aaaguguugggauuacaggcguga

SEQ ID NO: 340115 - RNA, 21 nt, Human
aaguguugggauuacaggcgu

SEQ ID NO: 340116 - RNA, 21 nt, Human
aaguguugggauuacaggcgu

SEQ ID NO: 340117 - RNA, 24 nt, Human
acaggguuuccccauguuggccag

SEQ ID NO: 340118 - RNA, 19 nt, Human
accgcgccuggccagccac

SEQ ID NO: 340119 - RNA, 24 nt, Human
aggugauccaccugccucggccuc

SEQ ID NO: 340120 - RNA, 18 nt, Human
aguagcugggauuacagg

SEQ ID NO: 340121 - RNA, 24 nt, Human
agucucugucgcccaggcuggagu

SEQ ID NO: 340122 - RNA, 23 nt, Human
agugcaauggugugaucuuggcu

SEQ ID NO: 340123 - RNA, 24 nt, Human
agugcaauggugugaucuuggcuc

SEQ ID NO: 340124 - RNA, 24 nt, Human
caaaguguugggauuacaggcgug

SEQ ID NO: 340125 - RNA, 20 nt, Human
caccuccuccuccuggguuc

SEQ ID NO: 340126 - RNA, 21 nt, Human
caccuccuccuccuggguuca

SEQ ID NO: 340127 - RNA, 23 nt, Human
caccugccucggccucccaaagu

SEQ ID NO: 340128 - RNA, 24 nt, Human
caggguuuccccauguuggccagg

SEQ ID NO: 340129 - RNA, 22 nt, Human
caggugauccaccugccucggc

SEQ ID NO: 340130 - RNA, 21 nt, Human
caggugcccgccaccacaccc

SEQ ID NO: 340131 - RNA, 24 nt, Human
cauguuggccaggcuggucuugaa

SEQ ID NO: 340132 - RNA, 22 nt, Human
ccaaaguguugggauuacaggc

SEQ ID NO: 340133 - RNA, 22 nt, Human
ccaaaguguugggauuacaggc

SEQ ID NO: 340134 - RNA, 24 nt, Human
ccaaaguguugggauuacaggcgu

SEQ ID NO: 340135 - RNA, 18 nt, Human
ccagcagugagggucucu

SEQ ID NO: 340136 - RNA, 19 nt, Human
ccauguuggccaggcuggu

SEQ ID NO: 340137 - RNA, 21 nt, Human
ccauguuggccaggcuggucu

SEQ ID NO: 340138 - RNA, 21 nt, Human
ccauguuggccaggcuggucu

SEQ ID NO: 340139 - RNA, 22 nt, Human
cccagcagugagggucucucuc

SEQ ID NO: 340140 - RNA, 24 nt, Human
ccccauguuggccaggcuggucuu

SEQ ID NO: 340141 - RNA, 23 nt, Human
cccgaguagcugggauuacaggu

SEQ ID NO: 340142 - RNA, 24 nt, Human
cccgaguagcugggauuacaggug

SEQ ID NO: 340143 - RNA, 21 nt, Human
cccgccaccacacccagcuaa

SEQ ID NO: 340144 - RNA, 21 nt, Human
ccgaguagcugggauuacagg

SEQ ID NO: 340145 - RNA, 24 nt, Human
ccuccucuucccucucggaauucc

SEQ ID NO: 340146 - RNA, 18 nt, Human
ccuggccagccacuggag

SEQ ID NO: 340147 - RNA, 22 nt, Human
ccuggguucaagcgauuucgcc

SEQ ID NO: 340148 - RNA, 24 nt, Human
ccuggguucaagcgauuucgccug

SEQ ID NO: 340149 - RNA, 18 nt, Human
cucaaguaugaggagaug

SEQ ID NO: 340150 - RNA, 22 nt, Human
cucacugcaaccuccaccuccu

SEQ ID NO: 340151 - RNA, 23 nt, Human
cucacugcaaccuccaccuccuc

SEQ ID NO: 340152 - RNA, 22 nt, Human
cuccaccuccuccuccuggguu

SEQ ID NO: 340153 - RNA, 18 nt, Human
cucugucgcccaggcugg

SEQ ID NO: 340154 - RNA, 19 nt, Human
cucugucgcccaggcugga

SEQ ID NO: 340155 - RNA, 25 nt, Human
cucugucgcccaggcuggagugcaa

SEQ ID NO: 340156 - RNA, 20 nt, Human
cugaccucaggugauccacc

SEQ ID NO: 340157 - RNA, 23 nt, Human
cugccacagccucccgaguagcu

SEQ ID NO: 340158 - RNA, 18 nt, Human
cugccucggccucccaaa

SEQ ID NO: 340159 - RNA, 20 nt, Human
cuugaacuucugaccucagg

SEQ ID NO: 340160 - RNA, 24 nt, Human
gaccucaggugauccaccugccuc

SEQ ID NO: 340161 - RNA, 27 nt, Human
gaguuuauuuauuuaauuuuuuucccc

SEQ ID NO: 340162 - RNA, 21 nt, Human
gauuacaggcgugacuaccgc

SEQ ID NO: 340163 - RNA, 18 nt, Human
gauuacaggugcccgcca

SEQ ID NO: 340164 - RNA, 29 nt, Human
gcaaccuccaccuccuccuccuggguucc

SEQ ID NO: 340165 - RNA, 20 nt, Human
gcccaggcuggagugcaaug

SEQ ID NO: 340166 - RNA, 24 nt, Human
gcccaggcuggagugcaauggugu

SEQ ID NO: 340167 - RNA, 30 nt, Human
gcuggagugcaauggugugaucuuggcucc

SEQ ID NO: 340168 - RNA, 22 nt, Human
ggagauguuuucuccaaauauu

SEQ ID NO: 340169 - RNA, 24 nt, Human
ggagucucugucgcccaggcugga

SEQ ID NO: 340170 - RNA, 22 nt, Human
ggcuggagugcaauggugugau

SEQ ID NO: 340171 - RNA, 24 nt, Human
ggcuggucuugaacuucugaccuc

SEQ ID NO: 340172 - RNA, 19 nt, Human
ggucuugaacuucugaccu

SEQ ID NO: 340173 - RNA, 21 nt, Human
gucucugucgcccaggcugga

SEQ ID NO: 340174 - RNA, 24 nt, Human
gucucugucgcccaggcuggagug

SEQ ID NO: 340175 - RNA, 24 nt, Human
gugauccaccugccucggccuccc

SEQ ID NO: 340176 - RNA, 22 nt, Human
uaaagacaggguuuccccaugu

SEQ ID NO: 340177 - RNA, 19 nt, Human
uaagucagucagugaaguc

SEQ ID NO: 340178 - RNA, 24 nt, Human
uaauuuuuauauuuuuaguaaaga

SEQ ID NO: 340179 - RNA, 24 nt, Human
uacaggugcccgccaccacaccca

SEQ ID NO: 340180 - RNA, 24 nt, Human
uaguaaagacaggguuuccccaug

SEQ ID NO: 340181 - RNA, 20 nt, Human
ucacugcaaccuccaccucc

SEQ ID NO: 340182 - RNA, 21 nt, Human
ucacugcaaccuccaccuccu

SEQ ID NO: 340183 - RNA, 22 nt, Human
ucacugcaaccuccaccuccuc

SEQ ID NO: 340184 - RNA, 31 nt, Human
ucacugcaaccuccaccuccuccuccugggg

SEQ ID NO: 340185 - RNA, 21 nt, Human
ucagccuaaggcgcauuuucc

SEQ ID NO: 340186 - RNA, 21 nt, Human
ucaggugauccaccugccucg

SEQ ID NO: 340187 - RNA, 24 nt, Human
ucccaaaguguugggauuacaggc

SEQ ID NO: 340188 - RNA, 25 nt, Human
ucccaaauccgagaaauggaaacuc

SEQ ID NO: 340189 - RNA, 23 nt, Human
ucccgaguagcugggauuacagg

SEQ ID NO: 340190 - RNA, 24 nt, Human
ucccgaguagcugggauuacaggu

SEQ ID NO: 340191 - RNA, 18 nt, Human
uccuggguucaagcgauu

SEQ ID NO: 340192 - RNA, 20 nt, Human
uccuggguucaagcgauuuc

SEQ ID NO: 340193 - RNA, 25 nt, Human
uccuggguucaagcgauuucgccug

SEQ ID NO: 340194 - RNA, 18 nt, Human
ucgcccaggcuggagugc

SEQ ID NO: 340195 - RNA, 19 nt, Human
ucucaaguaugaggagaug

SEQ ID NO: 340196 - RNA, 19 nt, Human
ucucugucgcccaggcugg

SEQ ID NO: 340197 - RNA, 23 nt, Human
ucugaccucaggugauccaccug

SEQ ID NO: 340198 - RNA, 24 nt, Human
ugaccucaggugauccaccugccu

SEQ ID NO: 340199 - RNA, 24 nt, Human
ugccacagccucccgaguagcugg

SEQ ID NO: 340200 - RNA, 18 nt, Human
ugcccgccaccacaccca

SEQ ID NO: 340201 - RNA, 24 nt, Human
ugccucggccucccaaaguguugg

SEQ ID NO: 340202 - RNA, 19 nt, Human
uggagugcaauggugugau

SEQ ID NO: 340203 - RNA, 23 nt, Human
uggagugcaauggugugaucuug

SEQ ID NO: 340204 - RNA, 24 nt, Human
uggagugcaauggugugaucuugg

SEQ ID NO: 340205 - RNA, 18 nt, Human
uggccagccacuggaguu

SEQ ID NO: 340206 - RNA, 24 nt, Human
uggccaggcuggucuugaacuucu

SEQ ID NO: 340207 - RNA, 20 nt, Human
ugggauuacaggcgugacua

SEQ ID NO: 340208 - RNA, 21 nt, Human
ugggauuacaggcgugacuac

SEQ ID NO: 340209 - RNA, 22 nt, Human
ugggauuacaggcgugacuacc

SEQ ID NO: 340210 - RNA, 23 nt, Human
ugggauuacaggcgugacuaccg

SEQ ID NO: 340211 - RNA, 21 nt, Human
ugggauuacaggugcccgcca

SEQ ID NO: 340212 - RNA, 22 nt, Human
ugggauuacaggugcccgccac

SEQ ID NO: 340213 - RNA, 24 nt, Human
ugggauuacaggugcccgccacca

SEQ ID NO: 340214 - RNA, 24 nt, Human
uggucuugaacuucugaccucagg

SEQ ID NO: 340215 - RNA, 20 nt, Human
ugucgcccaggcuggagugc

SEQ ID NO: 340216 - RNA, 22 nt, Human
ugucgcccaggcuggagugcaa

SEQ ID NO: 340217 - RNA, 19 nt, Human
ugugcucucaaguaugagg

SEQ ID NO: 340218 - RNA, 22 nt, Human
uuaguaaagacaggguuucccc

SEQ ID NO: 340219 - RNA, 24 nt, Human
uuaguaaagacaggguuuccccau

SEQ ID NO: 340220 - RNA, 22 nt, Human
uucaagcgauuucgccugccac

SEQ ID NO: 340221 - RNA, 20 nt, Human
uuccccagauggagucucug

SEQ ID NO: 340222 - RNA, 23 nt, Human
uuuauauuuuuaguaaagacagg

SEQ ID NO: 340223 - RNA, 24 nt, Human
uuuauauuuuuaguaaagacaggg

SEQ ID NO: 340224 - RNA, 21 nt, Human
uuuccccauguuggccaggcu

SEQ ID NO: 340225 - RNA, 18 nt, Human
aaaaaaacccaaauacga

SEQ ID NO: 340226 - RNA, 23 nt, Human
acucagaggaugauuaauaguuc

SEQ ID NO: 340227 - RNA, 21 nt, Human
agaaaauggucaucuggauaa

SEQ ID NO: 340228 - RNA, 26 nt, Human
aggaucaacaaugaauacuugaauaa

SEQ ID NO: 340229 - RNA, 18 nt, Human
augauuaauaguucacag

SEQ ID NO: 340230 - RNA, 23 nt, Human
caucuggauaaaugaaaauaauc

SEQ ID NO: 340231 - RNA, 22 nt, Human
cuguggcagaaaauggucaucu

SEQ ID NO: 340232 - RNA, 18 nt, Human
gcaagaauaacugacaga

SEQ ID NO: 340233 - RNA, 20 nt, Human
gcagaaaauggucaucugga

SEQ ID NO: 340234 - RNA, 23 nt, Human
ggucaucuggauaaaugaaaaua

SEQ ID NO: 340235 - RNA, 23 nt, Human
ggugagagauuagacggaagaga

SEQ ID NO: 340236 - RNA, 21 nt, Human
uguggcagaaaauggucaucu

SEQ ID NO: 340237 - RNA, 22 nt, Human
uguggcagaaaauggucaucug

SEQ ID NO: 340238 - RNA, 18 nt, Human
uuaaaguaaauuaagauc

SEQ ID NO: 340239 - RNA, 23 nt, Human
uuaauuuacccacagcucuuuua

SEQ ID NO: 340240 - RNA, 26 nt, Human
uuaccaaaaaaacccaaauacgacau

SEQ ID NO: 340241 - RNA, 23 nt, Human
aaaaccccccauccagauauauc

SEQ ID NO: 340242 - RNA, 23 nt, Human
aaaaggacgagauggucucgaag

SEQ ID NO: 340243 - RNA, 20 nt, Human
aagauugugauucuggauga

SEQ ID NO: 340244 - RNA, 22 nt, Human
aucaucuccuauacacgaaccc

SEQ ID NO: 340245 - RNA, 19 nt, Human
caaaccaucaucauccagc

SEQ ID NO: 340246 - RNA, 22 nt, Human
gcgauacaaaaaggacgagaug

SEQ ID NO: 340247 - RNA, 21 nt, Human
ucacccaguuagccuggcuuc

SEQ ID NO: 340248 - RNA, 22 nt, Human
ucacccaguuagccuggcuucu

SEQ ID NO: 340249 - RNA, 22 nt, Human
uccagcuuguccuaaauggcag

SEQ ID NO: 340250 - RNA, 18 nt, Human
uccgcgauacaaaaagga

SEQ ID NO: 340251 - RNA, 21 nt, Human
ucuccuauacacgaaccccug

SEQ ID NO: 340252 - RNA, 20 nt, Human
uggcuucucgugcaggucac

SEQ ID NO: 340253 - RNA, 20 nt, Human
uuccucagguuuccgcgaua

SEQ ID NO: 340254 - RNA, 19 nt, Human
uuuacaaaaccccccaucc

SEQ ID NO: 340255 - RNA, 20 nt, Human
uuuacaaaaccccccaucca

SEQ ID NO: 340256 - RNA, 24 nt, Human
uuuuaagauugugauucuggauga

SEQ ID NO: 340257 - RNA, 18 nt, Human
aagccuguucccguggga

SEQ ID NO: 340258 - RNA, 18 nt, Human
aagugcugggguggaagc

SEQ ID NO: 340259 - RNA, 24 nt, Human
acaaagccugccaggcugagcccu

SEQ ID NO: 340260 - RNA, 20 nt, Human
accuuggccuggagccugcu

SEQ ID NO: 340261 - RNA, 18 nt, Human
agaacaaaagcuuuacuc

SEQ ID NO: 340262 - RNA, 23 nt, Human
agcaaagcaggaggcagagggga

SEQ ID NO: 340263 - RNA, 19 nt, Human
agccagccuagcacccgcc

SEQ ID NO: 340264 - RNA, 22 nt, Human
aggcagcccugggucggggugg

SEQ ID NO: 340265 - RNA, 19 nt, Human
augggcccaggcacagugg

SEQ ID NO: 340266 - RNA, 19 nt, Human
caagaggccuccgaaugag

SEQ ID NO: 340267 - RNA, 23 nt, Human
caauggccguggcugggccagga

SEQ ID NO: 340268 - RNA, 19 nt, Human
cacccgccuucagcaacag

SEQ ID NO: 340269 - RNA, 21 nt, Human
caccgcagcccaccaggggcu

SEQ ID NO: 340270 - RNA, 20 nt, Human
cagcaaagcaggaggcagag

SEQ ID NO: 340271 - RNA, 24 nt, Human
caucucuguggucccagucaagag

SEQ ID NO: 340272 - RNA, 18 nt, Human
ccaaaacacccaucaccg

SEQ ID NO: 340273 - RNA, 19 nt, Human
ccagaaaguaguccugagc

SEQ ID NO: 340274 - RNA, 23 nt, Human
cccacugagcccauagggggcuc

SEQ ID NO: 340275 - RNA, 18 nt, Human
cccacuguggugcccggc

SEQ ID NO: 340276 - RNA, 22 nt, Human
cccaggugcgcaagugcugggg

SEQ ID NO: 340277 - RNA, 22 nt, Human
ccccacaaagccugccaggcug

SEQ ID NO: 340278 - RNA, 24 nt, Human
cccgcgccugggacagagccaggc

SEQ ID NO: 340279 - RNA, 18 nt, Human
ccgcgccugggacagagc

SEQ ID NO: 340280 - RNA, 23 nt, Human
ccugcggcagagagggccggggc

SEQ ID NO: 340281 - RNA, 22 nt, Human
ccugcuccuugacacccagcca

SEQ ID NO: 340282 - RNA, 22 nt, Human
cgacccagaaaguaguccugag

SEQ ID NO: 340283 - RNA, 19 nt, Human
cgccuggacugggagcaaa

SEQ ID NO: 340284 - RNA, 26 nt, Human
cggcaacagcaaagcaggaggcagag

SEQ ID NO: 340285 - RNA, 23 nt, Human
cggccccugucccauuucccucc

SEQ ID NO: 340286 - RNA, 23 nt, Human
cggggaggugggucugcugggau

SEQ ID NO: 340287 - RNA, 18 nt, Human
cugcaucucacuggugug

SEQ ID NO: 340288 - RNA, 19 nt, Human
cugccaggcugagcccuug

SEQ ID NO: 340289 - RNA, 20 nt, Human
cugccaggcugagcccuugc

SEQ ID NO: 340290 - RNA, 25 nt, Human
cugcggcccuggccaucagccuggc

SEQ ID NO: 340291 - RNA, 24 nt, Human
cuggagccugcuccuugacaccca

SEQ ID NO: 340292 - RNA, 22 nt, Human
cugggacagagccaggcagccc

SEQ ID NO: 340293 - RNA, 22 nt, Human
cugggagagggggggcugcagg

SEQ ID NO: 340294 - RNA, 21 nt, Human
gaaggcaccaggcggggaggu

SEQ ID NO: 340295 - RNA, 23 nt, Human
gcaaagcaggaggcagaggggag

SEQ ID NO: 340296 - RNA, 19 nt, Human
gccuggacugggagcaaag

SEQ ID NO: 340297 - RNA, 19 nt, Human
gccugggacagagccaggc

SEQ ID NO: 340298 - RNA, 21 nt, Human
ggacugggagcaaagcucugg

SEQ ID NO: 340299 - RNA, 20 nt, Human
ggagcccacugagcccauag

SEQ ID NO: 340300 - RNA, 22 nt, Human
ggaucaaccuuggggcuggguc

SEQ ID NO: 340301 - RNA, 18 nt, Human
ggcacaguggggcaggag

SEQ ID NO: 340302 - RNA, 20 nt, Human
ggccaggaccuuggccugga

SEQ ID NO: 340303 - RNA, 20 nt, Human
ggccguggcaccugagggag

SEQ ID NO: 340304 - RNA, 20 nt, Human
ggcugcaggcuagccagagg

SEQ ID NO: 340305 - RNA, 22 nt, Human
ggcugggccaggaccuuggccu

SEQ ID NO: 340306 - RNA, 19 nt, Human
gggacagagccaggcagcc

SEQ ID NO: 340307 - RNA, 21 nt, Human
gggacagagccaggcagcccu

SEQ ID NO: 340308 - RNA, 20 nt, Human
ggggcugggagagggggggc

SEQ ID NO: 340309 - RNA, 20 nt, Human
gggggcugcaggcuagccag

SEQ ID NO: 340310 - RNA, 20 nt, Human
uaagaacaaaagcuuuacuc

SEQ ID NO: 340311 - RNA, 20 nt, Human
uaugggcccaggcacagugg

SEQ ID NO: 340312 - RNA, 18 nt, Human
ucagcaacagguaaugga

SEQ ID NO: 340313 - RNA, 24 nt, Human
ucccgggccugagucccacugugg

SEQ ID NO: 340314 - RNA, 20 nt, Human
uccuguuguuuaugggccca

SEQ ID NO: 340315 - RNA, 22 nt, Human
ucgagaacaugaccuucccggg

SEQ ID NO: 340316 - RNA, 22 nt, Human
ugacacccagccagccuagcac

SEQ ID NO: 340317 - RNA, 21 nt, Human
ugcaauggccguggcugggcc

SEQ ID NO: 340318 - RNA, 18 nt, Human
ugccaggcugagcccuug

SEQ ID NO: 340319 - RNA, 21 nt, Human
uggcagcucccucccaggugc

SEQ ID NO: 340320 - RNA, 18 nt, Human
uggccguggcaccugagg

SEQ ID NO: 340321 - RNA, 20 nt, Human
ugggacagagccaggcagcc

SEQ ID NO: 340322 - RNA, 23 nt, Human
ugggacagagccaggcagcccug

SEQ ID NO: 340323 - RNA, 22 nt, Human
ugggaucaaccuuggggcuggg

SEQ ID NO: 340324 - RNA, 24 nt, Human
uggggcugggucggggggaggggc

SEQ ID NO: 340325 - RNA, 27 nt, Human
uuacucgugcucggcaaccagggaccc

SEQ ID NO: 340326 - RNA, 24 nt, Human
aacagacaaagcccucagaaaaga

SEQ ID NO: 340327 - RNA, 24 nt, Human
aaggagcccuagcccagaaaugac

SEQ ID NO: 340328 - RNA, 23 nt, Human
aaugaagagaacagacaaagccc

SEQ ID NO: 340329 - RNA, 23 nt, Human
acacuggagguggacaucugguu

SEQ ID NO: 340330 - RNA, 22 nt, Human
acaggacguggcaaggcaacaa

SEQ ID NO: 340331 - RNA, 22 nt, Human
agagguggggccauuacccacc

SEQ ID NO: 340332 - RNA, 20 nt, Human
agccauaaucauuauguggg

SEQ ID NO: 340333 - RNA, 19 nt, Human
agcccagaaaugacagcaa

SEQ ID NO: 340334 - RNA, 27 nt, Human
agguggacaucugguuuuccuuaauag

SEQ ID NO: 340335 - RNA, 20 nt, Human
agugaucugccccagccuuc

SEQ ID NO: 340336 - RNA, 20 nt, Human
augaaucccuggaauauugu

SEQ ID NO: 340337 - RNA, 22 nt, Human
auggagaaaaggagccaagaag

SEQ ID NO: 340338 - RNA, 21 nt, Human
auggcacauugggaaucaggg

SEQ ID NO: 340339 - RNA, 21 nt, Human
caaagcgcgcaagacaacgug

SEQ ID NO: 340340 - RNA, 18 nt, Human
caacaagaugccuugugc

SEQ ID NO: 340341 - RNA, 20 nt, Human
caagggcguggaacauggua

SEQ ID NO: 340342 - RNA, 22 nt, Human
cacguacccacagagaagcagg

SEQ ID NO: 340343 - RNA, 18 nt, Human
cagacaaagcccucagaa

SEQ ID NO: 340344 - RNA, 19 nt, Human
cagacggaaaacugggaua

SEQ ID NO: 340345 - RNA, 19 nt, Human
cagaggaagccaggcugag

SEQ ID NO: 340346 - RNA, 19 nt, Human
cagcgauguguaaaaccag

SEQ ID NO: 340347 - RNA, 23 nt, Human
cagggccaggcgggcaaagcgcg

SEQ ID NO: 340348 - RNA, 18 nt, Human
cauggacauccugucucc

SEQ ID NO: 340349 - RNA, 25 nt, Human
cauggucaauucccccuucccccaa

SEQ ID NO: 340350 - RNA, 23 nt, Human
cauuacauuucacaaucugcaug

SEQ ID NO: 340351 - RNA, 24 nt, Human
ccagaaaguaugaaacacuggagg

SEQ ID NO: 340352 - RNA, 21 nt, Human
ccagggccaggcgggcaaagc

SEQ ID NO: 340353 - RNA, 19 nt, Human
ccagucuagguuguuagaa

SEQ ID NO: 340354 - RNA, 18 nt, Human
cccaaaggaaauggagaa

SEQ ID NO: 340355 - RNA, 22 nt, Human
cccccaaaggaaauggagaaaa

SEQ ID NO: 340356 - RNA, 21 nt, Human
ccccuaagcgagagcgggaau

SEQ ID NO: 340357 - RNA, 20 nt, Human
ccucagaaaagauacaaagg

SEQ ID NO: 340358 - RNA, 21 nt, Human
cgacuggccaccaguccacaa

SEQ ID NO: 340359 - RNA, 23 nt, Human
cgagcggaugccggcggcagcgu

SEQ ID NO: 340360 - RNA, 21 nt, Human
cgccucccgggcccguauccc

SEQ ID NO: 340361 - RNA, 18 nt, Human
cuaaccaaaacacauaca

SEQ ID NO: 340362 - RNA, 23 nt, Human
cuccgcacugagcccaacucucc

SEQ ID NO: 340363 - RNA, 20 nt, Human
cucuccggcgcucucuccgg

SEQ ID NO: 340364 - RNA, 21 nt, Human
gaaauggagaaaaggagccaa

SEQ ID NO: 340365 - RNA, 22 nt, Human
gaacauggacauccugucuccc

SEQ ID NO: 340366 - RNA, 19 nt, Human
gaauauugucccagaaucc

SEQ ID NO: 340367 - RNA, 19 nt, Human
gacugagaaccaucauggg

SEQ ID NO: 340368 - RNA, 23 nt, Human
gagaaaaggagccaagaagucaa

SEQ ID NO: 340369 - RNA, 21 nt, Human
gagccaagaagcuggaaguau

SEQ ID NO: 340370 - RNA, 18 nt, Human
gagcccuagcccagaaau

SEQ ID NO: 340371 - RNA, 21 nt, Human
gcaaggcaacaagaugccuug

SEQ ID NO: 340372 - RNA, 26 nt, Human
ggccauuacccaccauuauuguaaaa

SEQ ID NO: 340373 - RNA, 23 nt, Human
ggcgccgagcuccgcacugagcc

SEQ ID NO: 340374 - RNA, 20 nt, Human
gggccaggcgggcaaagcgc

SEQ ID NO: 340375 - RNA, 21 nt, Human
gggcugaaccagaggaagcca

SEQ ID NO: 340376 - RNA, 20 nt, Human
gggucagagucccagggcca

SEQ ID NO: 340377 - RNA, 19 nt, Human
guagagaacauggacaucc

SEQ ID NO: 340378 - RNA, 20 nt, Human
guagagaacauggacauccu

SEQ ID NO: 340379 - RNA, 22 nt, Human
guuagaaaggagcccuagccca

SEQ ID NO: 340380 - RNA, 21 nt, Human
uaaaaccagaaaguaugaaac

SEQ ID NO: 340381 - RNA, 23 nt, Human
uaaaaccagaaaguaugaaacac

SEQ ID NO: 340382 - RNA, 24 nt, Human
uaaaauaacuguaacuaaccaaaa

SEQ ID NO: 340383 - RNA, 19 nt, Human
uaaagggagccaugcugac

SEQ ID NO: 340384 - RNA, 22 nt, Human
uaacagaggauggaguugggca

SEQ ID NO: 340385 - RNA, 19 nt, Human
uagaaaggagcccuagccc

SEQ ID NO: 340386 - RNA, 18 nt, Human
uagaauacaccuuucauu

SEQ ID NO: 340387 - RNA, 23 nt, Human
uaucccuccagcgauguguaaaa

SEQ ID NO: 340388 - RNA, 23 nt, Human
uauggcacauugggaaucagggg

SEQ ID NO: 340389 - RNA, 20 nt, Human
ucagaaaagauacaaaggca

SEQ ID NO: 340390 - RNA, 26 nt, Human
ucagaaaagauacaaaggcagagaca

SEQ ID NO: 340391 - RNA, 18 nt, Human
uccaaagauuauccauac

SEQ ID NO: 340392 - RNA, 21 nt, Human
ucccagacgcgcccgcgcacc

SEQ ID NO: 340393 - RNA, 22 nt, Human
ucccccuucccccaaaggaaau

SEQ ID NO: 340394 - RNA, 22 nt, Human
ugaaccagaggaagccaggcug

SEQ ID NO: 340395 - RNA, 19 nt, Human
ugaacggcucuccaaaucc

SEQ ID NO: 340396 - RNA, 21 nt, Human
ugacagcaaauagccauaauc

SEQ ID NO: 340397 - RNA, 23 nt, Human
ugagaaccaucaugggggcuugc

SEQ ID NO: 340398 - RNA, 22 nt, Human
ugccccagccuucugacuucga

SEQ ID NO: 340399 - RNA, 19 nt, Human
ugccggcggcagcguaaaa

SEQ ID NO: 340400 - RNA, 22 nt, Human
ugccugcgccugugcccccuaa

SEQ ID NO: 340401 - RNA, 23 nt, Human
ugcgggggcgcacgggcaugggc

SEQ ID NO: 340402 - RNA, 21 nt, Human
uggaauauugucccagaaucc

SEQ ID NO: 340403 - RNA, 21 nt, Human
uggccgggccgaugccugcgc

SEQ ID NO: 340404 - RNA, 20 nt, Human
ugggaaggaaaaggauggua

SEQ ID NO: 340405 - RNA, 22 nt, Human
ugggauaaagggagccaugcug

SEQ ID NO: 340406 - RNA, 21 nt, Human
uggggcaggaaaggguagccg

SEQ ID NO: 340407 - RNA, 23 nt, Human
uguaaaaccagaaaguaugaaac

SEQ ID NO: 340408 - RNA, 21 nt, Human
ugucccagaauccuuccaggg

SEQ ID NO: 340409 - RNA, 21 nt, Human
uuccugagaggcaccgggcgg

SEQ ID NO: 340410 - RNA, 20 nt, Human
uugaacggcucuccaaaucc

SEQ ID NO: 340411 - RNA, 21 nt, Human
uugaacggcucuccaaaucca

SEQ ID NO: 340412 - RNA, 19 nt, Human
uugauuagaacauuaucuc

SEQ ID NO: 340413 - RNA, 24 nt, Human
aagcaggucuuuuuuuucacguuu

SEQ ID NO: 340414 - RNA, 24 nt, Human
aagcaggucuuuuuuuucacguuu

SEQ ID NO: 340415 - RNA, 21 nt, Human
accaccccgcuuucccgagag

SEQ ID NO: 340416 - RNA, 22 nt, Human
accccgcuuucccgagaggagc

SEQ ID NO: 340417 - RNA, 25 nt, Human
acgguacgcgccaagcacagccccc

SEQ ID NO: 340418 - RNA, 24 nt, Human
agcaggucuuuuuuuucacguuuu

SEQ ID NO: 340419 - RNA, 24 nt, Human
agcaggucuuuuuuuucacguuuu

SEQ ID NO: 340420 - RNA, 23 nt, Human
ccagggcaaagcaggucuuuuuu

SEQ ID NO: 340421 - RNA, 23 nt, Human
ccagggcaaagcaggucuuuuuu

SEQ ID NO: 340422 - RNA, 18 nt, Human
cccucgcugaagguucga

SEQ ID NO: 340423 - RNA, 23 nt, Human
ccgcacgguacgcgccaagcaca

SEQ ID NO: 340424 - RNA, 19 nt, Human
cgagaggagccgggcggcg

SEQ ID NO: 340425 - RNA, 21 nt, Human
cgcgccaagcacagccccaaa

SEQ ID NO: 340426 - RNA, 19 nt, Human
cuacugggcaacuccccac

SEQ ID NO: 340427 - RNA, 18 nt, Human
cuagaggcuacuccggcu

SEQ ID NO: 340428 - RNA, 19 nt, Human
cugauguauuuggcagggu

SEQ ID NO: 340429 - RNA, 19 nt, Human
cugauguauuuggcagggu

SEQ ID NO: 340430 - RNA, 19 nt, Human
gcuacugggcaacucccca

SEQ ID NO: 340431 - RNA, 22 nt, Human
ggcuacugggcaacuccccacc

SEQ ID NO: 340432 - RNA, 21 nt, Human
ucccgagaggagccgggcggc

SEQ ID NO: 340433 - RNA, 23 nt, Human
uucgaggaccaccccgcuuuccc

SEQ ID NO: 340434 - RNA, 18 nt, Human
uuuuuuuuuuuuuuuuug

SEQ ID NO: 340435 - RNA, 22 nt, Human
aaacaagaugugaaccauaaga

SEQ ID NO: 340436 - RNA, 23 nt, Human
aaacacucaagcacaucccccca

SEQ ID NO: 340437 - RNA, 20 nt, Human
aacugagccugagccaguga

SEQ ID NO: 340438 - RNA, 20 nt, Human
aagcacauccccccaccccc

SEQ ID NO: 340439 - RNA, 26 nt, Human
accuguuuuuuguuuuuuugcagugg

SEQ ID NO: 340440 - RNA, 18 nt, Human
acucaagcacaucccccc

SEQ ID NO: 340441 - RNA, 19 nt, Human
aggggaaaagugcacaagg

SEQ ID NO: 340442 - RNA, 19 nt, Human
caagcacauccccccaccc

SEQ ID NO: 340443 - RNA, 22 nt, Human
caagcacauccccccacccccc

SEQ ID NO: 340444 - RNA, 24 nt, Human
cacugugcucugaacugaggugga

SEQ ID NO: 340445 - RNA, 21 nt, Human
caugaguacaaacacucaagc

SEQ ID NO: 340446 - RNA, 21 nt, Human
ccagaauacagaauauuucua

SEQ ID NO: 340447 - RNA, 20 nt, Human
ccccaccccccgucuucaga

SEQ ID NO: 340448 - RNA, 27 nt, Human
cucaagcacauccccccaccccccguc

SEQ ID NO: 340449 - RNA, 22 nt, Human
cugagguggaggaaggguccau

SEQ ID NO: 340450 - RNA, 18 nt, Human
cugccaggggaaaagugc

SEQ ID NO: 340451 - RNA, 22 nt, Human
gcccacccaaguaauuuucuua

SEQ ID NO: 340452 - RNA, 26 nt, Human
uacaaacacucaagcacaucccccca

SEQ ID NO: 340453 - RNA, 21 nt, Human
uagaacaagaccaugaguaca

SEQ ID NO: 340454 - RNA, 25 nt, Human
uagaacaagaccaugaguacaaaca

SEQ ID NO: 340455 - RNA, 21 nt, Human
uaggaaacaagaugugaacca

SEQ ID NO: 340456 - RNA, 23 nt, Human
uccacugccaggggaaaagugca

SEQ ID NO: 340457 - RNA, 21 nt, Human
uccccccaccccccgucuuca

SEQ ID NO: 340458 - RNA, 28 nt, Human
uccuaugacuuuguauaacgcuuuuacc

SEQ ID NO: 340459 - RNA, 22 nt, Human
ucuagaacaagaccaugaguac

SEQ ID NO: 340460 - RNA, 20 nt, Human
ugagguggaggaagggucca

SEQ ID NO: 340461 - RNA, 22 nt, Human
ugugaaccauaagacucaauga

SEQ ID NO: 340462 - RNA, 22 nt, Human
uucuauugggaaagaaagucac

SEQ ID NO: 340463 - RNA, 26 nt, Human
uuggaugguggcaauaauuaauacuu

SEQ ID NO: 340464 - RNA, 23 nt, Human
uuugucacuucuagaacaagacc

SEQ ID NO: 340465 - RNA, 19 nt, Human
uuuguuuuuuugcaguggg

SEQ ID NO: 340466 - RNA, 22 nt, Human
aaacaagaugugaaccauagga

SEQ ID NO: 340467 - RNA, 23 nt, Human
aaacacucaagcacaucccccca

SEQ ID NO: 340468 - RNA, 21 nt, Human
aagcguccauucuccugguga

SEQ ID NO: 340469 - RNA, 20 nt, Human
agguaaaaaaauuuccauga

SEQ ID NO: 340470 - RNA, 20 nt, Human
auacaggacauuucuauagg

SEQ ID NO: 340471 - RNA, 23 nt, Human
auaggacucaaugaguuugaugg

SEQ ID NO: 340472 - RNA, 19 nt, Human
caagcacauccccccaccc

SEQ ID NO: 340473 - RNA, 21 nt, Human
caagcacauccccccaccccc

SEQ ID NO: 340474 - RNA, 22 nt, Human
caagcacauccccccacccccc

SEQ ID NO: 340475 - RNA, 19 nt, Human
cacucaagcacaucccccc

SEQ ID NO: 340476 - RNA, 24 nt, Human
cacugugcucugagcugaggugga

SEQ ID NO: 340477 - RNA, 21 nt, Human
caugaguacaaacacucaagc

SEQ ID NO: 340478 - RNA, 19 nt, Human
ccaaguaauuuucuuaccc

SEQ ID NO: 340479 - RNA, 22 nt, Human
cccagaauacaggacauuucua

SEQ ID NO: 340480 - RNA, 20 nt, Human
ccccaccccccgucuucaga

SEQ ID NO: 340481 - RNA, 22 nt, Human
cguccauucuccuggugaccca

SEQ ID NO: 340482 - RNA, 27 nt, Human
cucaagcacauccccccaccccccguc

SEQ ID NO: 340483 - RNA, 21 nt, Human
cuuugucacuccgagaauaag

SEQ ID NO: 340484 - RNA, 24 nt, Human
uaauuaauacuuaggacucuauaa

SEQ ID NO: 340485 - RNA, 26 nt, Human
uacaaacacucaagcacaucccccca

SEQ ID NO: 340486 - RNA, 18 nt, Human
uagagguauuguguucca

SEQ ID NO: 340487 - RNA, 21 nt, Human
uaggaaacaagaugugaacca

SEQ ID NO: 340488 - RNA, 21 nt, Human
ucacugugcucugagcugagg

SEQ ID NO: 340489 - RNA, 23 nt, Human
uccacugccaggggaaaaguaca

SEQ ID NO: 340490 - RNA, 21 nt, Human
uccccccaccccccgucuuca

SEQ ID NO: 340491 - RNA, 21 nt, Human
uccuaagucuacccacccaag

SEQ ID NO: 340492 - RNA, 19 nt, Human
ugagcugagguggaggaag

SEQ ID NO: 340493 - RNA, 20 nt, Human
ugagguggaggaagcgucca

SEQ ID NO: 340494 - RNA, 22 nt, Human
ugugaaccauaggacucaauga

SEQ ID NO: 340495 - RNA, 19 nt, Human
uguuuuuuguuuuuuugga

SEQ ID NO: 340496 - RNA, 24 nt, Human
uucaugcauagagguauuguguuc

SEQ ID NO: 340497 - RNA, 23 nt, Human
uucuccuggugacccagcagcug

SEQ ID NO: 340498 - RNA, 24 nt, Human
uuugaaguucuauugggaaaguca

SEQ ID NO: 340499 - RNA, 26 nt, Human
uuugaugguggcaauaauuaauacuu

SEQ ID NO: 340500 - RNA, 23 nt, Human
uuugucacuccgagaauaagacc

SEQ ID NO: 340501 - RNA, 22 nt, Human
aaacaagaugugaaccauaaga

SEQ ID NO: 340502 - RNA, 23 nt, Human
aaacacucaagcacaucccccca

SEQ ID NO: 340503 - RNA, 20 nt, Human
aagcacauccccccaccccc

SEQ ID NO: 340504 - RNA, 21 nt, Human
aauacagaacauuucuauagg

SEQ ID NO: 340505 - RNA, 23 nt, Human
aaugaaaaaguaaagcauuugga

SEQ ID NO: 340506 - RNA, 18 nt, Human
acucaagcacaucccccc

SEQ ID NO: 340507 - RNA, 19 nt, Human
aggggaaaaguacacaagg

SEQ ID NO: 340508 - RNA, 25 nt, Human
caaauuagaauauagauuauagaaa

SEQ ID NO: 340509 - RNA, 19 nt, Human
caagcacauccccccaccc

SEQ ID NO: 340510 - RNA, 22 nt, Human
caagcacauccccccacccccc

SEQ ID NO: 340511 - RNA, 24 nt, Human
cacugugcucugagcugaggugga

SEQ ID NO: 340512 - RNA, 21 nt, Human
caugaguacaaacacucaagc

SEQ ID NO: 340513 - RNA, 18 nt, Human
cccaaguaauuuucugac

SEQ ID NO: 340514 - RNA, 20 nt, Human
ccccaccccccguccucaga

SEQ ID NO: 340515 - RNA, 22 nt, Human
ccgagaacaagaccaugaguac

SEQ ID NO: 340516 - RNA, 27 nt, Human
cucaagcacauccccccaccccccguc

SEQ ID NO: 340517 - RNA, 22 nt, Human
cugagguggaggaaggguccau

SEQ ID NO: 340518 - RNA, 22 nt, Human
gcuuugucacuccgagaacaag

SEQ ID NO: 340519 - RNA, 26 nt, Human
uacaaacacucaagcacaucccccca

SEQ ID NO: 340520 - RNA, 18 nt, Human
uagagguauuguguucca

SEQ ID NO: 340521 - RNA, 21 nt, Human
uaggaaacaagaugugaacca

SEQ ID NO: 340522 - RNA, 21 nt, Human
ucacugugcucugagcugagg

SEQ ID NO: 340523 - RNA, 23 nt, Human
uccacugccaggggaaaaguaca

SEQ ID NO: 340524 - RNA, 21 nt, Human
uccccccaccccccguccuca

SEQ ID NO: 340525 - RNA, 21 nt, Human
uccuaagucuacccacccaag

SEQ ID NO: 340526 - RNA, 26 nt, Human
uccuaugacuguauaaugcuuuuacc

SEQ ID NO: 340527 - RNA, 19 nt, Human
ucuccuggugacccagcag

SEQ ID NO: 340528 - RNA, 20 nt, Human
ugagguggaggaagggucca

SEQ ID NO: 340529 - RNA, 22 nt, Human
ugugaaccauaagacucaauga

SEQ ID NO: 340530 - RNA, 24 nt, Human
uucaugcauagagguauuguguuc

SEQ ID NO: 340531 - RNA, 26 nt, Human
uuggaugguggcaauaauuaauacuu

SEQ ID NO: 340532 - RNA, 24 nt, Human
uuugaaguucuauugggaaaguca

SEQ ID NO: 340533 - RNA, 23 nt, Human
uuugucacuccgagaacaagacc

SEQ ID NO: 340534 - RNA, 27 nt, Human
aaacaucuaucucacaggcugaaaaca

SEQ ID NO: 340535 - RNA, 19 nt, Human
aaacccaacaaguuaccaa

SEQ ID NO: 340536 - RNA, 21 nt, Human
aacaucuaucucacaggcuga

SEQ ID NO: 340537 - RNA, 24 nt, Human
aagaaggggaagcagugggguugc

SEQ ID NO: 340538 - RNA, 18 nt, Human
aagaugcgacacccacgg

SEQ ID NO: 340539 - RNA, 21 nt, Human
acacugagaaaacuggaacag

SEQ ID NO: 340540 - RNA, 19 nt, Human
accaagaaggggaagcagu

SEQ ID NO: 340541 - RNA, 21 nt, Human
accaagaaggggaagcagugg

SEQ ID NO: 340542 - RNA, 20 nt, Human
accagcgggcagugcccccu

SEQ ID NO: 340543 - RNA, 19 nt, Human
acccuggcguggaggggug

SEQ ID NO: 340544 - RNA, 19 nt, Human
acccuggcguggaggggug

SEQ ID NO: 340545 - RNA, 22 nt, Human
acgaagccacagaagcuuugag

SEQ ID NO: 340546 - RNA, 22 nt, Human
acuggaacagauaaggccauga

SEQ ID NO: 340547 - RNA, 22 nt, Human
agaaaacagcucggcacacuag

SEQ ID NO: 340548 - RNA, 19 nt, Human
agaaaagguuccauuacaa

SEQ ID NO: 340549 - RNA, 21 nt, Human
agccacagaagcuuugaggga

SEQ ID NO: 340550 - RNA, 21 nt, Human
aggacaggcugugcaaagcca

SEQ ID NO: 340551 - RNA, 21 nt, Human
aggcugaaaacacugagaaaa

SEQ ID NO: 340552 - RNA, 24 nt, Human
agggagggcccagcgcuggagaag

SEQ ID NO: 340553 - RNA, 24 nt, Human
augauaauaaauaaggcuuuuuuu

SEQ ID NO: 340554 - RNA, 18 nt, Human
caacgguggggaaaauga

SEQ ID NO: 340555 - RNA, 18 nt, Human
caagaaggggaagcagug

SEQ ID NO: 340556 - RNA, 25 nt, Human
cagaaaagguuccauuacaaaccag

SEQ ID NO: 340557 - RNA, 19 nt, Human
cagaguuugcagcugcggc

SEQ ID NO: 340558 - RNA, 23 nt, Human
caggacaggcugugcaaagccag

SEQ ID NO: 340559 - RNA, 23 nt, Human
cagggcugggcccaggacaggcu

SEQ ID NO: 340560 - RNA, 20 nt, Human
caguggggaguccccaggug

SEQ ID NO: 340561 - RNA, 19 nt, Human
ccagcccacugauugugcc

SEQ ID NO: 340562 - RNA, 22 nt, Human
ccaggugacgcccaccugcgcc

SEQ ID NO: 340563 - RNA, 21 nt, Human
ccaugaugguuggaaaaaaac

SEQ ID NO: 340564 - RNA, 18 nt, Human
cccccuggggugguggga

SEQ ID NO: 340565 - RNA, 26 nt, Human
cccccugggguggugggaggacgggg

SEQ ID NO: 340566 - RNA, 23 nt, Human
ccccugggguggugggaggacgg

SEQ ID NO: 340567 - RNA, 21 nt, Human
cccugcccuggcugaggcugg

SEQ ID NO: 340568 - RNA, 20 nt, Human
cccuggcguggagggguggc

SEQ ID NO: 340569 - RNA, 20 nt, Human
cccuggcguggagggguggc

SEQ ID NO: 340570 - RNA, 22 nt, Human
ccugcccccuggggugguggga

SEQ ID NO: 340571 - RNA, 19 nt, Human
ccugccugccugcccccug

SEQ ID NO: 340572 - RNA, 20 nt, Human
ccuuaaggcacgucuuuugu

SEQ ID NO: 340573 - RNA, 23 nt, Human
cggcccggggcucagggcugggc

SEQ ID NO: 340574 - RNA, 24 nt, Human
cggcccggggcucagggcugggcc

SEQ ID NO: 340575 - RNA, 22 nt, Human
cgggaagauaggggcacagaaa

SEQ ID NO: 340576 - RNA, 20 nt, Human
cgggggcggguggggcgggg

SEQ ID NO: 340577 - RNA, 20 nt, Human
cgggggcggguggggcgggg

SEQ ID NO: 340578 - RNA, 18 nt, Human
cugccugcccccuggggu

SEQ ID NO: 340579 - RNA, 23 nt, Human
cuggggguagggugucccggggc

SEQ ID NO: 340580 - RNA, 21 nt, Human
gaaaacacugagaaaacugga

SEQ ID NO: 340581 - RNA, 21 nt, Human
gaagauaggggcacagaaaag

SEQ ID NO: 340582 - RNA, 19 nt, Human
gacgcuggggccugggagg

SEQ ID NO: 340583 - RNA, 20 nt, Human
gaggagggccccggucuucc

SEQ ID NO: 340584 - RNA, 19 nt, Human
gcacggaggagaagcgugg

SEQ ID NO: 340585 - RNA, 20 nt, Human
gcuggggagaagacgcuggg

SEQ ID NO: 340586 - RNA, 21 nt, Human
gcuggggagaagacgcugggg

SEQ ID NO: 340587 - RNA, 23 nt, Human
ggaggggggcggccaaggggccg

SEQ ID NO: 340588 - RNA, 21 nt, Human
ggcagugcccccuucuugagc

SEQ ID NO: 340589 - RNA, 20 nt, Human
ggccugccugccugcccccu

SEQ ID NO: 340590 - RNA, 21 nt, Human
ggccugggaggggggcggcca

SEQ ID NO: 340591 - RNA, 23 nt, Human
gggagaagacgcuggggccuggg

SEQ ID NO: 340592 - RNA, 20 nt, Human
gggcaccugggcacgcggcg

SEQ ID NO: 340593 - RNA, 26 nt, Human
gggccugccugccugcccccuggggu

SEQ ID NO: 340594 - RNA, 19 nt, Human
gggcugggcccaggacagg

SEQ ID NO: 340595 - RNA, 18 nt, Human
ggggaaaaugauaauaaa

SEQ ID NO: 340596 - RNA, 18 nt, Human
ggggcggguggggcgggg

SEQ ID NO: 340597 - RNA, 19 nt, Human
ggggcggguggggcggggg

SEQ ID NO: 340598 - RNA, 21 nt, Human
ggggguagggugucccggggc

SEQ ID NO: 340599 - RNA, 22 nt, Human
ggguggcgggggcggguggggc

SEQ ID NO: 340600 - RNA, 21 nt, Human
gguggcgggggcggguggggc

SEQ ID NO: 340601 - RNA, 21 nt, Human
guggcgggggcggguggggcg

SEQ ID NO: 340602 - RNA, 25 nt, Human
guggcgggggcggguggggcgggga

SEQ ID NO: 340603 - RNA, 19 nt, Human
uaagaaagacuacaaaaag

SEQ ID NO: 340604 - RNA, 22 nt, Human
uaagaaagacuacaaaaaggua

SEQ ID NO: 340605 - RNA, 23 nt, Human
uaagaaagacuacaaaaagguag

SEQ ID NO: 340606 - RNA, 22 nt, Human
uaaggcuuuuuuuuuuuuuuaa

SEQ ID NO: 340607 - RNA, 19 nt, Human
uaccaagaaggggaagcag

SEQ ID NO: 340608 - RNA, 28 nt, Human
uaccaagaaggggaagcagugggguugc

SEQ ID NO: 340609 - RNA, 22 nt, Human
uagaaaacagcucggcacacua

SEQ ID NO: 340610 - RNA, 21 nt, Human
uccccaggugacgcccaccug

SEQ ID NO: 340611 - RNA, 23 nt, Human
ucccugcccuggcugaggcugga

SEQ ID NO: 340612 - RNA, 22 nt, Human
ucucacaggcugaaaacacuga

SEQ ID NO: 340613 - RNA, 21 nt, Human
ugcccuggcugaggcuggagc

SEQ ID NO: 340614 - RNA, 25 nt, Human
ugcuggggguagggugucccggggc

SEQ ID NO: 340615 - RNA, 22 nt, Human
uggaaaaaaacccaacaaguua

SEQ ID NO: 340616 - RNA, 25 nt, Human
uggaaaaaaacccaacaaguuacca

SEQ ID NO: 340617 - RNA, 20 nt, Human
uggaacagauaaggccauga

SEQ ID NO: 340618 - RNA, 22 nt, Human
uggaacagauaaggccaugaug

SEQ ID NO: 340619 - RNA, 19 nt, Human
uggagcagugaccacgaag

SEQ ID NO: 340620 - RNA, 22 nt, Human
ugggaggacggggcuggggaga

SEQ ID NO: 340621 - RNA, 19 nt, Human
ugggaggggggcggccaag

SEQ ID NO: 340622 - RNA, 20 nt, Human
ugggaggggggcggccaagg

SEQ ID NO: 340623 - RNA, 23 nt, Human
ugggaggggggcggccaaggggc

SEQ ID NO: 340624 - RNA, 25 nt, Human
ugggaggggggcggccaaggggccg

SEQ ID NO: 340625 - RNA, 23 nt, Human
ugggcccaggacaggcugugcaa

SEQ ID NO: 340626 - RNA, 21 nt, Human
uggggagaagacgcuggggcc

SEQ ID NO: 340627 - RNA, 21 nt, Human
uggggagaagacgcuggggcc

SEQ ID NO: 340628 - RNA, 19 nt, Human
uggggccugggaggggggc

SEQ ID NO: 340629 - RNA, 18 nt, Human
uggggcggggaggccaag

SEQ ID NO: 340630 - RNA, 19 nt, Human
uggggcggggaggccaagg

SEQ ID NO: 340631 - RNA, 22 nt, Human
uggggguagggugucccggggc

SEQ ID NO: 340632 - RNA, 22 nt, Human
ugggggucgcacggcacggagg

SEQ ID NO: 340633 - RNA, 22 nt, Human
ugggguggugggaggacggggc

SEQ ID NO: 340634 - RNA, 24 nt, Human
ugggguggugggaggacggggcug

SEQ ID NO: 340635 - RNA, 21 nt, Human
ugggguugcuggggguagggu

SEQ ID NO: 340636 - RNA, 20 nt, Human
uggugggaggacggggcugg

SEQ ID NO: 340637 - RNA, 18 nt, Human
ugucucggagucccccuc

SEQ ID NO: 340638 - RNA, 21 nt, Human
uguuuuaagaaagacuacaaa

SEQ ID NO: 340639 - RNA, 20 nt, Human
uuaauuccuccgcuucuccc

SEQ ID NO: 340640 - RNA, 18 nt, Human
uuccuccgcuucucccca

SEQ ID NO: 340641 - RNA, 20 nt, Human
uuccuccgcuucuccccacu

SEQ ID NO: 340642 - RNA, 24 nt, Human
uuccuccgcuucuccccacuucug

SEQ ID NO: 340643 - RNA, 23 nt, Human
uucuugccauaaacaucuaucuc

SEQ ID NO: 340644 - RNA, 18 nt, Human
uugcacuuaauaccaaga

SEQ ID NO: 340645 - RNA, 22 nt, Human
uuugugucagaguuugcagcug

SEQ ID NO: 340646 - RNA, 23 nt, Human
aacacugaccccgggagcccccc

SEQ ID NO: 340647 - RNA, 26 nt, Human
aacauuuuuccaaaaagagaaaacua

SEQ ID NO: 340648 - RNA, 24 nt, Human
aaggaacccauggucugguggggc

SEQ ID NO: 340649 - RNA, 24 nt, Human
acacugcuguguccuggcacgagc

SEQ ID NO: 340650 - RNA, 20 nt, Human
acauggugcuaccagacaag

SEQ ID NO: 340651 - RNA, 23 nt, Human
agaacuccagcacgcagcugucc

SEQ ID NO: 340652 - RNA, 22 nt, Human
agacaaacagugugauuauucc

SEQ ID NO: 340653 - RNA, 18 nt, Human
agagguccaggugggacu

SEQ ID NO: 340654 - RNA, 22 nt, Human
agcacgcgucuuugucuuccug

SEQ ID NO: 340655 - RNA, 23 nt, Human
aggaaaagccgggcauuacaauc

SEQ ID NO: 340656 - RNA, 18 nt, Human
aggaggcgccggccgggg

SEQ ID NO: 340657 - RNA, 18 nt, Human
aggcucgucuuucuucuc

SEQ ID NO: 340658 - RNA, 21 nt, Human
agggaccuggggacccagagc

SEQ ID NO: 340659 - RNA, 21 nt, Human
agggcgcugcgcccagcuggg

SEQ ID NO: 340660 - RNA, 19 nt, Human
aggucuggaucuaaaaggc

SEQ ID NO: 340661 - RNA, 23 nt, Human
agugggagcccuggccugggcuu

SEQ ID NO: 340662 - RNA, 18 nt, Human
aucacaucaucuaagagg

SEQ ID NO: 340663 - RNA, 25 nt, Human
auggcggcggcgguggcggcggcgc

SEQ ID NO: 340664 - RNA, 21 nt, Human
auuacaauccguuaacuguga

SEQ ID NO: 340665 - RNA, 19 nt, Human
cagagucccacauccuucc

SEQ ID NO: 340666 - RNA, 20 nt, Human
cagcugccccucaaguccuu

SEQ ID NO: 340667 - RNA, 26 nt, Human
ccacauccuuccugcugcugauaaaa

SEQ ID NO: 340668 - RNA, 22 nt, Human
ccagguucccagagugaccagg

SEQ ID NO: 340669 - RNA, 21 nt, Human
cccagagcacagcuacagcca

SEQ ID NO: 340670 - RNA, 18 nt, Human
ccccucaaguccuuuggc

SEQ ID NO: 340671 - RNA, 20 nt, Human
cccgccucggggcauccggc

SEQ ID NO: 340672 - RNA, 23 nt, Human
ccugcaccccucacucuggcgca

SEQ ID NO: 340673 - RNA, 21 nt, Human
ccugcagcacagccggccucc

SEQ ID NO: 340674 - RNA, 20 nt, Human
ccuucuugaacacugacccc

SEQ ID NO: 340675 - RNA, 23 nt, Human
cgcccagcugggucccucccaca

SEQ ID NO: 340676 - RNA, 20 nt, Human
cgccucggggcauccggcag

SEQ ID NO: 340677 - RNA, 24 nt, Human
cgucuuugucuuccugcaccccuc

SEQ ID NO: 340678 - RNA, 23 nt, Human
cuccagggacgcuggcgagcucu

SEQ ID NO: 340679 - RNA, 22 nt, Human
cucgcuggggguggggugcucc

SEQ ID NO: 340680 - RNA, 20 nt, Human
cugcagcacagccggccucc

SEQ ID NO: 340681 - RNA, 19 nt, Human
cugcugauaaaacuucugg

SEQ ID NO: 340682 - RNA, 21 nt, Human
cuggccugggcuucuguagcu

SEQ ID NO: 340683 - RNA, 20 nt, Human
cuguagcuucaacaacugcu

SEQ ID NO: 340684 - RNA, 21 nt, Human
cuucuugaacacugaccccgg

SEQ ID NO: 340685 - RNA, 18 nt, Human
cuuugaagagguccaggu

SEQ ID NO: 340686 - RNA, 19 nt, Human
cuuugucuuccugcacccc

SEQ ID NO: 340687 - RNA, 19 nt, Human
gaccccgggagcccccgcu

SEQ ID NO: 340688 - RNA, 19 nt, Human
gacgacacgcgggauggcu

SEQ ID NO: 340689 - RNA, 18 nt, Human
gagcacagcuacagccag

SEQ ID NO: 340690 - RNA, 18 nt, Human
gcccuggccugggcuucu

SEQ ID NO: 340691 - RNA, 24 nt, Human
gcggcggcgguggcggcggcggcc

SEQ ID NO: 340692 - RNA, 30 nt, Human
gcggcgguggcggcggcggccgcuccuccu

SEQ ID NO: 340693 - RNA, 24 nt, Human
gcggcucccgcggcggcggcagcg

SEQ ID NO: 340694 - RNA, 19 nt, Human
gcucugugccuccccagcg

SEQ ID NO: 340695 - RNA, 19 nt, Human
ggacacagcgauugucagc

SEQ ID NO: 340696 - RNA, 19 nt, Human
ggacagagucccacauccu

SEQ ID NO: 340697 - RNA, 21 nt, Human
ggacccagagcacagcuacag

SEQ ID NO: 340698 - RNA, 22 nt, Human
ggacugaauauacugcaaugua

SEQ ID NO: 340699 - RNA, 22 nt, Human
ggaucuaaaaggccacagggcg

SEQ ID NO: 340700 - RNA, 20 nt, Human
ggcggcggcgguggcggcgg

SEQ ID NO: 340701 - RNA, 23 nt, Human
ggcggcggcgguggcggcggcgg

SEQ ID NO: 340702 - RNA, 22 nt, Human
gggcauccggcagggaggucug

SEQ ID NO: 340703 - RNA, 30 nt, Human
gggccaaaguccaggguuccagcagaggaa

SEQ ID NO: 340704 - RNA, 20 nt, Human
gguuccaguugagugcagag

SEQ ID NO: 340705 - RNA, 22 nt, Human
gugaaauccagguucccagagu

SEQ ID NO: 340706 - RNA, 23 nt, Human
guggcugcgcagggaccuggggg

SEQ ID NO: 340707 - RNA, 21 nt, Human
gugucucaaguucagggcuuc

SEQ ID NO: 340708 - RNA, 22 nt, Human
guuucuguggcuuguucuuuuu

SEQ ID NO: 340709 - RNA, 21 nt, Human
guuuguccagaauaaggaacc

SEQ ID NO: 340710 - RNA, 22 nt, Human
uacacauucauaagaaacguuc

SEQ ID NO: 340711 - RNA, 26 nt, Human
uaccagacaagggcacuccacuuucc

SEQ ID NO: 340712 - RNA, 24 nt, Human
uaguucagagggagguguucugga

SEQ ID NO: 340713 - RNA, 21 nt, Human
uauggcggcggcgguggcggc

SEQ ID NO: 340714 - RNA, 19 nt, Human
ucagcugccccucaagucc

SEQ ID NO: 340715 - RNA, 23 nt, Human
ucccacauggugcuaccagacaa

SEQ ID NO: 340716 - RNA, 20 nt, Human
ucuagucgggcucugccagg

SEQ ID NO: 340717 - RNA, 22 nt, Human
ucuauggcggcggcgguggcuu

SEQ ID NO: 340718 - RNA, 23 nt, Human
ucuggaagacuccguggagcggg

SEQ ID NO: 340719 - RNA, 18 nt, Human
ugaaagacacugcugugu

SEQ ID NO: 340720 - RNA, 18 nt, Human
ugaacacugaccccggga

SEQ ID NO: 340721 - RNA, 21 nt, Human
ugaagagguccaggugggacu

SEQ ID NO: 340722 - RNA, 22 nt, Human
ugaaugagaacaaaacauuugg

SEQ ID NO: 340723 - RNA, 23 nt, Human
ugcugcguguugguccccguugg

SEQ ID NO: 340724 - RNA, 23 nt, Human
uggagcgggacgcaggcacugcu

SEQ ID NO: 340725 - RNA, 18 nt, Human
uggcagguaggaggggag

SEQ ID NO: 340726 - RNA, 19 nt, Human
uggcaucuggagauggguu

SEQ ID NO: 340727 - RNA, 21 nt, Human
uggcgcaggcccagcgaugcu

SEQ ID NO: 340728 - RNA, 18 nt, Human
uggcggcggcgguggcgg

SEQ ID NO: 340729 - RNA, 20 nt, Human
uggggguggggugcuccggg

SEQ ID NO: 340730 - RNA, 18 nt, Human
ugggucccucccacaugg

SEQ ID NO: 340731 - RNA, 21 nt, Human
uggugcuaccagacaagggca

SEQ ID NO: 340732 - RNA, 22 nt, Human
ugguggcugcgcagggaccugg

SEQ ID NO: 340733 - RNA, 21 nt, Human
ugguuccaguugagugcagag

SEQ ID NO: 340734 - RNA, 18 nt, Human
uguugguccccguuggua

SEQ ID NO: 340735 - RNA, 19 nt, Human
uucagugucuccaaggaga

SEQ ID NO: 340736 - RNA, 28 nt, Human
uuccaaaaagagaaaacuauugcauuuc

SEQ ID NO: 340737 - RNA, 24 nt, Human
uucugugugaaugagaacaaaaca

SEQ ID NO: 340738 - RNA, 22 nt, Human
uucuugaacacugaccccggga

SEQ ID NO: 340739 - RNA, 19 nt, Human
uugguaaguaacagucucc

SEQ ID NO: 340740 - RNA, 24 nt, Human
aaaaaagucaguccgguauuuaga

SEQ ID NO: 340741 - RNA, 24 nt, Human
aaaaauuaagaaacaggaaaagga

SEQ ID NO: 340742 - RNA, 20 nt, Human
aaacaggaaaaggaaggagg

SEQ ID NO: 340743 - RNA, 19 nt, Human
aacaggaaaaggaaggagc

SEQ ID NO: 340744 - RNA, 23 nt, Human
aacuacugggucaagucuucacc

SEQ ID NO: 340745 - RNA, 21 nt, Human
aagcaagugcaaagaagggcc

SEQ ID NO: 340746 - RNA, 20 nt, Human
aagcuacccuauguagagga

SEQ ID NO: 340747 - RNA, 24 nt, Human
aaugagaagacaaaaauuaagaaa

SEQ ID NO: 340748 - RNA, 24 nt, Human
aaugagacugaagagucccuagag

SEQ ID NO: 340749 - RNA, 25 nt, Human
acauucaucauacuuagcccauucc

SEQ ID NO: 340750 - RNA, 20 nt, Human
acccccacccuuuuccccaa

SEQ ID NO: 340751 - RNA, 21 nt, Human
acccccacccuuuuccccaaa

SEQ ID NO: 340752 - RNA, 21 nt, Human
acugaggagaaaagaaagcag

SEQ ID NO: 340753 - RNA, 24 nt, Human
agaaaaaaagggacuaucaucuaa

SEQ ID NO: 340754 - RNA, 20 nt, Human
agaaagcaggucuagcugau

SEQ ID NO: 340755 - RNA, 20 nt, Human
agaagaugcaacagugagaa

SEQ ID NO: 340756 - RNA, 24 nt, Human
agaagcaagugcaaagaagggccu

SEQ ID NO: 340757 - RNA, 22 nt, Human
agagacauacugaacuacuggg

SEQ ID NO: 340758 - RNA, 18 nt, Human
agcaggaaugagaagaca

SEQ ID NO: 340759 - RNA, 19 nt, Human
agccagcacuaccuaugac

SEQ ID NO: 340760 - RNA, 23 nt, Human
aggagaaaagaaagcaggucuag

SEQ ID NO: 340761 - RNA, 23 nt, Human
agguacuaguagacugggugacu

SEQ ID NO: 340762 - RNA, 22 nt, Human
aguuugaauuagguuuucugug

SEQ ID NO: 340763 - RNA, 20 nt, Human
caagucuucaccuggagcca

SEQ ID NO: 340764 - RNA, 24 nt, Human
cacccaagcaacucccugcuccua

SEQ ID NO: 340765 - RNA, 18 nt, Human
cagaagaugcaacaguga

SEQ ID NO: 340766 - RNA, 19 nt, Human
cagaagaugcaacagugag

SEQ ID NO: 340767 - RNA, 20 nt, Human
caugaaccaauaaauccuuu

SEQ ID NO: 340768 - RNA, 18 nt, Human
cauucuaucugccccacc

SEQ ID NO: 340769 - RNA, 23 nt, Human
ccacccaagcaacucccugcucc

SEQ ID NO: 340770 - RNA, 18 nt, Human
ccacccuuuuccccaaag

SEQ ID NO: 340771 - RNA, 23 nt, Human
ccaguuugaauuagguuuucugu

SEQ ID NO: 340772 - RNA, 20 nt, Human
cccaccuuucugaagucucc

SEQ ID NO: 340773 - RNA, 23 nt, Human
cccgcaguccuaaguccugacac

SEQ ID NO: 340774 - RNA, 18 nt, Human
cuauguagaggacaaagu

SEQ ID NO: 340775 - RNA, 20 nt, Human
cuccuaaaucuggaaaacuc

SEQ ID NO: 340776 - RNA, 22 nt, Human
cugacccccacccuuuucccca

SEQ ID NO: 340777 - RNA, 22 nt, Human
cugccccaccuuucugaagucu

SEQ ID NO: 340778 - RNA, 21 nt, Human
cugguacaaagaugccuucuu

SEQ ID NO: 340779 - RNA, 22 nt, Human
cuuagcccauuccuaccuuccc

SEQ ID NO: 340780 - RNA, 23 nt, Human
gaaaagaaagcaggucuagcuga

SEQ ID NO: 340781 - RNA, 18 nt, Human
gaaacaggaaaaggaagg

SEQ ID NO: 340782 - RNA, 18 nt, Human
gaagucuccuaaaucugg

SEQ ID NO: 340783 - RNA, 19 nt, Human
gagacuagaaacgaggaaa

SEQ ID NO: 340784 - RNA, 23 nt, Human
gaggagaauggcuucccucuccu

SEQ ID NO: 340785 - RNA, 20 nt, Human
gcaauagggugagagggaag

SEQ ID NO: 340786 - RNA, 20 nt, Human
gcagcuuguauugagggaaa

SEQ ID NO: 340787 - RNA, 18 nt, Human
gcccauauaugcccaaag

SEQ ID NO: 340788 - RNA, 20 nt, Human
gcuaaaauaagaguagccug

SEQ ID NO: 340789 - RNA, 24 nt, Human
ggagaauggcuucccucuccuucc

SEQ ID NO: 340790 - RNA, 21 nt, Human
ggaggcugacccccacccuuu

SEQ ID NO: 340791 - RNA, 23 nt, Human
ggaggcugacccccacccuuuuc

SEQ ID NO: 340792 - RNA, 18 nt, Human
ggcaauagggugagaggg

SEQ ID NO: 340793 - RNA, 21 nt, Human
gugacccaggccuaaucagug

SEQ ID NO: 340794 - RNA, 24 nt, Human
uaaccuaaaccccgcaguccuaag

SEQ ID NO: 340795 - RNA, 18 nt, Human
uaagaaacaggaaaagga

SEQ ID NO: 340796 - RNA, 18 nt, Human
uacugcuuuucccaagga

SEQ ID NO: 340797 - RNA, 24 nt, Human
uagcaagcuaaaauaagaguagcc

SEQ ID NO: 340798 - RNA, 20 nt, Human
uaggaaaagaauagccaaau

SEQ ID NO: 340799 - RNA, 21 nt, Human
uauaauuucuuaaaaucugcu

SEQ ID NO: 340800 - RNA, 18 nt, Human
uauagaauaagcaaauua

SEQ ID NO: 340801 - RNA, 18 nt, Human
ucccuagaggagaauggc

SEQ ID NO: 340802 - RNA, 21 nt, Human
uccugacacguaugacaagau

SEQ ID NO: 340803 - RNA, 25 nt, Human
uccuuuuuauuuuaagccaguuuga

SEQ ID NO: 340804 - RNA, 21 nt, Human
ucugaagucuccuaaaucugg

SEQ ID NO: 340805 - RNA, 24 nt, Human
ucugguacaaagaugccuucuuuu

SEQ ID NO: 340806 - RNA, 21 nt, Human
ugaaaaggucagaggcagcaa

SEQ ID NO: 340807 - RNA, 18 nt, Human
ugaacuacugggucaagu

SEQ ID NO: 340808 - RNA, 23 nt, Human
ugacacguaugacaagaugcugc

SEQ ID NO: 340809 - RNA, 19 nt, Human
ugacagaagcuacccuaug

SEQ ID NO: 340810 - RNA, 19 nt, Human
ugacccaggccuaaucagu

SEQ ID NO: 340811 - RNA, 19 nt, Human
ugacccccacccuuuuccc

SEQ ID NO: 340812 - RNA, 20 nt, Human
ugagaagcaagugcaaagaa

SEQ ID NO: 340813 - RNA, 21 nt, Human
ugagaagcaagugcaaagaag

SEQ ID NO: 340814 - RNA, 22 nt, Human
ugcaacagugagaaaaaaguca

SEQ ID NO: 340815 - RNA, 24 nt, Human
ugccccaccuuucugaagucuccu

SEQ ID NO: 340816 - RNA, 19 nt, Human
uggagguagaaaaaaaggg

SEQ ID NO: 340817 - RNA, 22 nt, Human
ugggaagaaccaagauucccug

SEQ ID NO: 340818 - RNA, 18 nt, Human
ugugguggaaauaaauga

SEQ ID NO: 340819 - RNA, 21 nt, Human
uuagcccauuccuaccuuccc

SEQ ID NO: 340820 - RNA, 22 nt, Human
uuagcccauuccuaccuuccca

SEQ ID NO: 340821 - RNA, 24 nt, Human
uuagcggccacccaagcaacuccc

SEQ ID NO: 340822 - RNA, 22 nt, Human
uucaucauacuuagcccauucc

SEQ ID NO: 340823 - RNA, 23 nt, Human
uucugguacaaagaugccuucuu

SEQ ID NO: 340824 - RNA, 20 nt, Human
uuugcugagauuucugguac

SEQ ID NO: 340825 - RNA, 22 nt, Human
uuuuugguauuuaaaauguuuu

SEQ ID NO: 340826 - RNA, 19 nt, Human
uuuuuuuuuuuuuuuuugg

SEQ ID NO: 340827 - RNA, 23 nt, Human
uuuuuuuuuuuuuuuuugguauu

SEQ ID NO: 340828 - RNA, 23 nt, Human
aaacuggagaccggacccucagc

SEQ ID NO: 340829 - RNA, 18 nt, Human
aaagcuccccacgagccu

SEQ ID NO: 340830 - RNA, 21 nt, Human
aaagcuccccacgagccuccu

SEQ ID NO: 340831 - RNA, 24 nt, Human
agaagguuuauugguuccucuugg

SEQ ID NO: 340832 - RNA, 23 nt, Human
agaguucuucccccucuccugcc

SEQ ID NO: 340833 - RNA, 24 nt, Human
agaguucuucccccucuccugccu

SEQ ID NO: 340834 - RNA, 18 nt, Human
aggaaaaggggguucaga

SEQ ID NO: 340835 - RNA, 20 nt, Human
aggaaaaggggguucagaaa

SEQ ID NO: 340836 - RNA, 21 nt, Human
aggcuuauaagcaagggcggg

SEQ ID NO: 340837 - RNA, 18 nt, Human
aguucuggguuuccccag

SEQ ID NO: 340838 - RNA, 19 nt, Human
aguucuggguuuccccagc

SEQ ID NO: 340839 - RNA, 23 nt, Human
caacaaggucccuucugcggucu

SEQ ID NO: 340840 - RNA, 18 nt, Human
caaggaaaaggggguuca

SEQ ID NO: 340841 - RNA, 21 nt, Human
cacagccccuuucuuguccgc

SEQ ID NO: 340842 - RNA, 22 nt, Human
caccggaacaggagccgugcgg

SEQ ID NO: 340843 - RNA, 21 nt, Human
cacgagccuccucuguccccc

SEQ ID NO: 340844 - RNA, 18 nt, Human
cacugcgccacccccggg

SEQ ID NO: 340845 - RNA, 19 nt, Human
cacugcgccacccccgggu

SEQ ID NO: 340846 - RNA, 24 nt, Human
cagccuccuggccgucgcgccccc

SEQ ID NO: 340847 - RNA, 20 nt, Human
caguucuggguuuccccagc

SEQ ID NO: 340848 - RNA, 21 nt, Human
ccacccccgggugugccuccu

SEQ ID NO: 340849 - RNA, 25 nt, Human
ccccacgagccuccucugucccccc

SEQ ID NO: 340850 - RNA, 18 nt, Human
ccccagcucuggcugacc

SEQ ID NO: 340851 - RNA, 24 nt, Human
ccccucccaccaccuguccagaag

SEQ ID NO: 340852 - RNA, 21 nt, Human
ccgucgcgcccccuccucacu

SEQ ID NO: 340853 - RNA, 19 nt, Human
ccucugacaccggaacagg

SEQ ID NO: 340854 - RNA, 22 nt, Human
ccucugacaccggaacaggagc

SEQ ID NO: 340855 - RNA, 19 nt, Human
cgagccuccucuguccccc

SEQ ID NO: 340856 - RNA, 23 nt, Human
cgaucuggcuuccucuuggccgu

SEQ ID NO: 340857 - RNA, 23 nt, Human
cgccgaaagcccaguucucucaa

SEQ ID NO: 340858 - RNA, 23 nt, Human
cggacccucagcgaucuggcuuc

SEQ ID NO: 340859 - RNA, 21 nt, Human
cucagcgaucuggcuuccucu

SEQ ID NO: 340860 - RNA, 19 nt, Human
cuccaccagccuccuggcc

SEQ ID NO: 340861 - RNA, 23 nt, Human
cuccucacugcgccacccccggg

SEQ ID NO: 340862 - RNA, 25 nt, Human
cuccucuguccccccgcgccgaaag

SEQ ID NO: 340863 - RNA, 22 nt, Human
cucucaaaacuugggggcccaa

SEQ ID NO: 340864 - RNA, 24 nt, Human
cugacaccggaacaggagccgugc

SEQ ID NO: 340865 - RNA, 19 nt, Human
cugcggucucaaaggcuua

SEQ ID NO: 340866 - RNA, 22 nt, Human
gccgaaagcccaguucucucaa

SEQ ID NO: 340867 - RNA, 21 nt, Human
gcugaccauuuuguucccuga

SEQ ID NO: 340868 - RNA, 22 nt, Human
ggagagaguucuucccccucuc

SEQ ID NO: 340869 - RNA, 28 nt, Human
ggauauagcaggaggcaaaccgguaccc

SEQ ID NO: 340870 - RNA, 19 nt, Human
gggcagagggcuaaagaag

SEQ ID NO: 340871 - RNA, 22 nt, Human
guuuauugguuccucuugggaa

SEQ ID NO: 340872 - RNA, 22 nt, Human
uauagcaggaggcaaacuggag

SEQ ID NO: 340873 - RNA, 25 nt, Human
ucacacagccccuuucuuguccgca

SEQ ID NO: 340874 - RNA, 19 nt, Human
uccagaagcugccuuugaa

SEQ ID NO: 340875 - RNA, 19 nt, Human
ucccccucuccugccuggg

SEQ ID NO: 340876 - RNA, 19 nt, Human
uccgcaaagacugaggagc

SEQ ID NO: 340877 - RNA, 31 nt, Human
ucucaaaggcuuauaagcaagggcgggggcu

SEQ ID NO: 340878 - RNA, 19 nt, Human
ugaguccccggcaggcggc

SEQ ID NO: 340879 - RNA, 22 nt, Human
ugccugggugucgcuccaccag

SEQ ID NO: 340880 - RNA, 19 nt, Human
uggaggacucccccaacuc

SEQ ID NO: 340881 - RNA, 23 nt, Human
uggcugaccauuuuguucccuga

SEQ ID NO: 340882 - RNA, 23 nt, Human
uguccagaagcugccuuugaagu

SEQ ID NO: 340883 - RNA, 23 nt, Human
uucccugagugucugaguccccg

SEQ ID NO: 340884 - RNA, 24 nt, Human
uucuuguccgcaaagacugaggag

SEQ ID NO: 340885 - RNA, 20 nt, Human
aaaagccagugguuuucaag

SEQ ID NO: 340886 - RNA, 21 nt, Human
aaaauagccaucaacauuucu

SEQ ID NO: 340887 - RNA, 23 nt, Human
aaacucucaacaucguaaguaug

SEQ ID NO: 340888 - RNA, 21 nt, Human
aaagaaaucagcuaacucaaa

SEQ ID NO: 340889 - RNA, 20 nt, Human
aaagaacagaauaaagaaau

SEQ ID NO: 340890 - RNA, 18 nt, Human
aacaguuaauaacagaca

SEQ ID NO: 340891 - RNA, 26 nt, Human
aagaagcauaagcuaauguuuuccac

SEQ ID NO: 340892 - RNA, 22 nt, Human
aagaauaaacuaaagaacagaa

SEQ ID NO: 340893 - RNA, 25 nt, Human
aauacuuacuuauccccaaaugcac

SEQ ID NO: 340894 - RNA, 21 nt, Human
aauaucuauuaacuuuaugac

SEQ ID NO: 340895 - RNA, 20 nt, Human
acaaugacaaaauacuggag

SEQ ID NO: 340896 - RNA, 19 nt, Human
acucaaaggucaacaacug

SEQ ID NO: 340897 - RNA, 18 nt, Human
agagaagccaacuguagg

SEQ ID NO: 340898 - RNA, 23 nt, Human
agauuaauaucuauuaacuuuau

SEQ ID NO: 340899 - RNA, 19 nt, Human
agguuuuacuaacacaccu

SEQ ID NO: 340900 - RNA, 22 nt, Human
aguaacaaugacugaagaggaa

SEQ ID NO: 340901 - RNA, 18 nt, Human
auaaaaugugcuuaccuc

SEQ ID NO: 340902 - RNA, 26 nt, Human
auaccgggaaggcgccccgacugcgc

SEQ ID NO: 340903 - RNA, 19 nt, Human
auguuauuuggaaagauaa

SEQ ID NO: 340904 - RNA, 24 nt, Human
cacacacauuaagaaaugaacaaa

SEQ ID NO: 340905 - RNA, 21 nt, Human
cacauuaagaaaugaacaaaa

SEQ ID NO: 340906 - RNA, 18 nt, Human
cagaauaaagaaaucagc

SEQ ID NO: 340907 - RNA, 19 nt, Human
caguaacaaugacugaaga

SEQ ID NO: 340908 - RNA, 18 nt, Human
caucaucacaaaguucuu

SEQ ID NO: 340909 - RNA, 21 nt, Human
ccccgggcuuuuagcaccugc

SEQ ID NO: 340910 - RNA, 20 nt, Human
cccuccuuucccauuauucc

SEQ ID NO: 340911 - RNA, 18 nt, Human
cccuccuuucccauuucc

SEQ ID NO: 340912 - RNA, 22 nt, Human
cccuccuuucccauuuccaucc

SEQ ID NO: 340913 - RNA, 20 nt, Human
ccuaaaaaauauccuuggua

SEQ ID NO: 340914 - RNA, 23 nt, Human
ccugacacugcagaacauuuagc

SEQ ID NO: 340915 - RNA, 24 nt, Human
ccuuacgucuauauaaaaugugcu

SEQ ID NO: 340916 - RNA, 19 nt, Human
cucaaaggucaacaacugg

SEQ ID NO: 340917 - RNA, 21 nt, Human
cucacaguaaucugaaagauu

SEQ ID NO: 340918 - RNA, 23 nt, Human
cucuccauaaguacuucuuagaa

SEQ ID NO: 340919 - RNA, 19 nt, Human
cugggguaaaaggcgccua

SEQ ID NO: 340920 - RNA, 25 nt, Human
cuguucacaaauucaacaaacaaga

SEQ ID NO: 340921 - RNA, 19 nt, Human
gaacauuuagcauuuccug

SEQ ID NO: 340922 - RNA, 18 nt, Human
gagagaagccaacuguag

SEQ ID NO: 340923 - RNA, 23 nt, Human
uaaaaaaauaugcucaucuauua

SEQ ID NO: 340924 - RNA, 24 nt, Human
uaaaaaacaaguaacaaauuuuug

SEQ ID NO: 340925 - RNA, 20 nt, Human
uaaaaguguuuugaacagau

SEQ ID NO: 340926 - RNA, 18 nt, Human
uaacaguuaauaacagac

SEQ ID NO: 340927 - RNA, 18 nt, Human
uaacucaaaggucaacaa

SEQ ID NO: 340928 - RNA, 25 nt, Human
uaacuuuaugacuuccacagaaagu

SEQ ID NO: 340929 - RNA, 22 nt, Human
uaccccugacacugcagaacau

SEQ ID NO: 340930 - RNA, 25 nt, Human
uagcucaauugcgaaaaacaaugac

SEQ ID NO: 340931 - RNA, 24 nt, Human
uaugcaaguaaaaacacacacauu

SEQ ID NO: 340932 - RNA, 21 nt, Human
ucacaaauucaacaaacaaga

SEQ ID NO: 340933 - RNA, 23 nt, Human
ucaguaacaaugacugaagagga

SEQ ID NO: 340934 - RNA, 24 nt, Human
ucagucccuuuucauucagcucuc

SEQ ID NO: 340935 - RNA, 21 nt, Human
ucucuugacauuuaauuuguu

SEQ ID NO: 340936 - RNA, 20 nt, Human
ugaacaggcagcuaccuuau

SEQ ID NO: 340937 - RNA, 18 nt, Human
ugacuucuucaaacucac

SEQ ID NO: 340938 - RNA, 20 nt, Human
ugccccaacuacauguuagc

SEQ ID NO: 340939 - RNA, 21 nt, Human
ugcuucauuaccuucaguaac

SEQ ID NO: 340940 - RNA, 20 nt, Human
uggccacucacuaaaagcca

SEQ ID NO: 340941 - RNA, 18 nt, Human
uggccgggguccacgacc

SEQ ID NO: 340942 - RNA, 22 nt, Human
uggccgggguccacgaccccgg

SEQ ID NO: 340943 - RNA, 21 nt, Human
uuaauaacagacaguagauga

SEQ ID NO: 340944 - RNA, 20 nt, Human
uucauucagcucucacuggg

SEQ ID NO: 340945 - RNA, 27 nt, Human
uucccauuuccauccauuucccauuuc

SEQ ID NO: 340946 - RNA, 24 nt, Human
uucccauuucccuccuuucccauu

SEQ ID NO: 340947 - RNA, 22 nt, Human
uuccuggccacucacuaaaagc

SEQ ID NO: 340948 - RNA, 21 nt, Human
uuggugggcugagaucuauac

SEQ ID NO: 340949 - RNA, 19 nt, Human
uuucaggaucaccuuuuug

SEQ ID NO: 340950 - RNA, 18 nt, Human
uuuccuggccacucacua

SEQ ID NO: 340951 - RNA, 19 nt, Human
aaacagaagaaagugcuuu

SEQ ID NO: 340952 - RNA, 23 nt, Human
aaacagaugauggagaugcagaa

SEQ ID NO: 340953 - RNA, 23 nt, Human
aaacggaaauacacgggguugcc

SEQ ID NO: 340954 - RNA, 20 nt, Human
aaauugcacauaauaaagag

SEQ ID NO: 340955 - RNA, 23 nt, Human
aaccugcaugagggcugccaccc

SEQ ID NO: 340956 - RNA, 22 nt, Human
aagacuccagacacauaguuuu

SEQ ID NO: 340957 - RNA, 18 nt, Human
acaauguguaguccaauc

SEQ ID NO: 340958 - RNA, 28 nt, Human
acacaugcauaccaaauacaugugcaua

SEQ ID NO: 340959 - RNA, 21 nt, Human
acaccugaggaauaaauugca

SEQ ID NO: 340960 - RNA, 19 nt, Human
acagucugaggcaaugucu

SEQ ID NO: 340961 - RNA, 19 nt, Human
acaugcaaaaggcaaucag

SEQ ID NO: 340962 - RNA, 19 nt, Human
accaagaauaucaggcuga

SEQ ID NO: 340963 - RNA, 21 nt, Human
accacaggaacucaauaaaua

SEQ ID NO: 340964 - RNA, 20 nt, Human
accugcaugagggcugccac

SEQ ID NO: 340965 - RNA, 27 nt, Human
acucaauaaauaucugcugacuucacc

SEQ ID NO: 340966 - RNA, 18 nt, Human
agaaagacaagcaugcga

SEQ ID NO: 340967 - RNA, 20 nt, Human
agaaagacaagcaugcgagc

SEQ ID NO: 340968 - RNA, 22 nt, Human
agcaaaagccaaggccaccugc

SEQ ID NO: 340969 - RNA, 21 nt, Human
agcacgggaaccuggaaaaaa

SEQ ID NO: 340970 - RNA, 20 nt, Human
agccccaucucuuuccccag

SEQ ID NO: 340971 - RNA, 22 nt, Human
agccucuagcagcgcacagucu

SEQ ID NO: 340972 - RNA, 22 nt, Human
agccuguggcaguuccagccuc

SEQ ID NO: 340973 - RNA, 19 nt, Human
agcuaaaagcauuacccgg

SEQ ID NO: 340974 - RNA, 25 nt, Human
aggcaaucagagaaggcaaugaagc

SEQ ID NO: 340975 - RNA, 22 nt, Human
aggcaggcaggaggcauuacgg

SEQ ID NO: 340976 - RNA, 18 nt, Human
agugaccucaacuuccca

SEQ ID NO: 340977 - RNA, 25 nt, Human
augucaaauucauuuccaguuuccc

SEQ ID NO: 340978 - RNA, 26 nt, Human
caaaggacacucucuauucccaggac

SEQ ID NO: 340979 - RNA, 20 nt, Human
caagcacagaagcacaaauc

SEQ ID NO: 340980 - RNA, 19 nt, Human
caaucacuguucagaaauc

SEQ ID NO: 340981 - RNA, 19 nt, Human
cacagcacugacagauaag

SEQ ID NO: 340982 - RNA, 19 nt, Human
caccaaugauccucgaaca

SEQ ID NO: 340983 - RNA, 20 nt, Human
cacgggaaccuggaaaaaaa

SEQ ID NO: 340984 - RNA, 22 nt, Human
cagaaagacaagcaugcgagca

SEQ ID NO: 340985 - RNA, 22 nt, Human
cagccggaccuuacgcaggacc

SEQ ID NO: 340986 - RNA, 22 nt, Human
cagcucauccaaacccuuucca

SEQ ID NO: 340987 - RNA, 18 nt, Human
caggaccccgaugauagg

SEQ ID NO: 340988 - RNA, 21 nt, Human
caguccaucccacccacagcc

SEQ ID NO: 340989 - RNA, 21 nt, Human
cauacagccuguggcaguucc

SEQ ID NO: 340990 - RNA, 21 nt, Human
cauccaaacccuuuccaaagu

SEQ ID NO: 340991 - RNA, 25 nt, Human
caugucaaauucauuuccaguuucc

SEQ ID NO: 340992 - RNA, 22 nt, Human
cauugccgcaaaucucuaaacu

SEQ ID NO: 340993 - RNA, 22 nt, Human
ccaaucccaggaaacgggcuuc

SEQ ID NO: 340994 - RNA, 21 nt, Human
ccaccugccgcugcugcccau

SEQ ID NO: 340995 - RNA, 24 nt, Human
cccaggccauugugcaaauuuguu

SEQ ID NO: 340996 - RNA, 24 nt, Human
cccgccaaucugagacccccuaga

SEQ ID NO: 340997 - RNA, 19 nt, Human
ccgcagccuguuucucagc

SEQ ID NO: 340998 - RNA, 20 nt, Human
ccugccgcugcugcccaucc

SEQ ID NO: 340999 - RNA, 25 nt, Human
cgaagcuccuccuggccucccuagg

SEQ ID NO: 341000 - RNA, 19 nt, Human
cgcaggaccccgaugauag

SEQ ID NO: 341001 - RNA, 22 nt, Human
cgggaaccuggaaaaaaaaaag

SEQ ID NO: 341002 - RNA, 19 nt, Human
cuacauauacuucaaccug

SEQ ID NO: 341003 - RNA, 19 nt, Human
cuccuccuggccucccuag

SEQ ID NO: 341004 - RNA, 24 nt, Human
cuccuggaaagaccaaaggaaauu

SEQ ID NO: 341005 - RNA, 22 nt, Human
cugcagcaaaagccaaggccac

SEQ ID NO: 341006 - RNA, 20 nt, Human
cugcaugagggcugccaccc

SEQ ID NO: 341007 - RNA, 18 nt, Human
cugggcgcccgggugugc

SEQ ID NO: 341008 - RNA, 20 nt, Human
gagcagcuaaaagcauuacc

SEQ ID NO: 341009 - RNA, 27 nt, Human
gauacacaugcauaccaaauacaugug

SEQ ID NO: 341010 - RNA, 21 nt, Human
gaugauggagaugcagaaaga

SEQ ID NO: 341011 - RNA, 18 nt, Human
gccccaucucuuucccca

SEQ ID NO: 341012 - RNA, 19 nt, Human
gccccaucucuuuccccac

SEQ ID NO: 341013 - RNA, 19 nt, Human
ggauugaaaacagaagaaa

SEQ ID NO: 341014 - RNA, 18 nt, Human
ggccaaugguuuuauuua

SEQ ID NO: 341015 - RNA, 18 nt, Human
ggccaccagcucauccaa

SEQ ID NO: 341016 - RNA, 21 nt, Human
gggauugaaaacagaagaaag

SEQ ID NO: 341017 - RNA, 20 nt, Human
gguugccagaaacugaaauu

SEQ ID NO: 341018 - RNA, 19 nt, Human
uaaaagcauuacccggcug

SEQ ID NO: 341019 - RNA, 25 nt, Human
uacagccccaucucuuuccccacga

SEQ ID NO: 341020 - RNA, 23 nt, Human
uacuccuaccaacugcagggcac

SEQ ID NO: 341021 - RNA, 27 nt, Human
uaucauaaugcuuugcacaccacagga

SEQ ID NO: 341022 - RNA, 19 nt, Human
uaugagagacaaaaguguc

SEQ ID NO: 341023 - RNA, 24 nt, Human
uaugagagacaaaagugucacuua

SEQ ID NO: 341024 - RNA, 26 nt, Human
uaugagagacaaaagugucacuuaac

SEQ ID NO: 341025 - RNA, 23 nt, Human
uccaccaggaaacaaauuuaaga

SEQ ID NO: 341026 - RNA, 19 nt, Human
uccagaggugucaugaugg

SEQ ID NO: 341027 - RNA, 19 nt, Human
uccaucccacccacagcca

SEQ ID NO: 341028 - RNA, 21 nt, Human
ucccagccagccggaccuuac

SEQ ID NO: 341029 - RNA, 25 nt, Human
ucccagccagccggaccuuacgcag

SEQ ID NO: 341030 - RNA, 23 nt, Human
uccccgccaaucugagacccccu

SEQ ID NO: 341031 - RNA, 22 nt, Human
ucccuggugcuucuuguggaau

SEQ ID NO: 341032 - RNA, 20 nt, Human
ucccuuuauaaaaauaaagu

SEQ ID NO: 341033 - RNA, 23 nt, Human
ucuacauauacaguauaaauaca

SEQ ID NO: 341034 - RNA, 25 nt, Human
ucuccuggaaagaccaaaggaaauu

SEQ ID NO: 341035 - RNA, 21 nt, Human
ucugcaguuguuuuuaucugg

SEQ ID NO: 341036 - RNA, 18 nt, Human
ugaaagaggcaggcagga

SEQ ID NO: 341037 - RNA, 21 nt, Human
ugaaagaggcaggcaggaggc

SEQ ID NO: 341038 - RNA, 20 nt, Human
ugaaggccaccagcucaucc

SEQ ID NO: 341039 - RNA, 23 nt, Human
ugacggcugcagcaaaagccaag

SEQ ID NO: 341040 - RNA, 18 nt, Human
ugagaaagucauccucuc

SEQ ID NO: 341041 - RNA, 19 nt, Human
ugaggaauaaauugcacau

SEQ ID NO: 341042 - RNA, 19 nt, Human
ugaggggcuauuaacggga

SEQ ID NO: 341043 - RNA, 18 nt, Human
ugagucaccauucuuuug

SEQ ID NO: 341044 - RNA, 19 nt, Human
ugccagaaacugaaaugag

SEQ ID NO: 341045 - RNA, 18 nt, Human
ugccagccaagucccaaa

SEQ ID NO: 341046 - RNA, 23 nt, Human
ugcgagcagcuaaaagcauuacc

SEQ ID NO: 341047 - RNA, 18 nt, Human
uggaggacuuccuggccc

SEQ ID NO: 341048 - RNA, 19 nt, Human
uggcaaaagacuccagaca

SEQ ID NO: 341049 - RNA, 24 nt, Human
uggcaguuccagccucugcaguug

SEQ ID NO: 341050 - RNA, 19 nt, Human
ugggauuaggaaaaaaaaa

SEQ ID NO: 341051 - RNA, 23 nt, Human
uggucacgcccucaaccaggccc

SEQ ID NO: 341052 - RNA, 24 nt, Human
ugucaugauggcuagaccaguggg

SEQ ID NO: 341053 - RNA, 19 nt, Human
ugugauagcaagcacggga

SEQ ID NO: 341054 - RNA, 22 nt, Human
uuccaaucccaggaaacgggcu

SEQ ID NO: 341055 - RNA, 19 nt, Human
uuccaucuggaagaaugua

SEQ ID NO: 341056 - RNA, 23 nt, Human
uuccauugucuuuaaaaaaggua

SEQ ID NO: 341057 - RNA, 24 nt, Human
uuccggguuuguucucuaaauuuu

SEQ ID NO: 341058 - RNA, 22 nt, Human
uuccuggcccguucuucggucc

SEQ ID NO: 341059 - RNA, 19 nt, Human
uucucaguuucuucuauuu

SEQ ID NO: 341060 - RNA, 18 nt, Human
uugaaacccagucagucu

SEQ ID NO: 341061 - RNA, 23 nt, Human
uugggucuggcagcacaugccag

SEQ ID NO: 341062 - RNA, 22 nt, Human
uuuccaguuuccccacggugcc

SEQ ID NO: 341063 - RNA, 22 nt, Human
agagauauguacccacccaccc

SEQ ID NO: 341064 - RNA, 18 nt, Human
auaaaaucauugccucau

SEQ ID NO: 341065 - RNA, 18 nt, Human
cacccacccuggcaauuu

SEQ ID NO: 341066 - RNA, 21 nt, Human
cagaauucucuaguugucuuc

SEQ ID NO: 341067 - RNA, 21 nt, Human
cgcugggaccucgggcgacgg

SEQ ID NO: 341068 - RNA, 23 nt, Human
cggcgacggcgacagcgacagag

SEQ ID NO: 341069 - RNA, 22 nt, Human
gaagguuaagccugccuccucc

SEQ ID NO: 341070 - RNA, 27 nt, Human
gcgacagagaggcccugggaaucugaa

SEQ ID NO: 341071 - RNA, 31 nt, Human
ggcccagaauucucuaguugucuucagagcc

SEQ ID NO: 341072 - RNA, 23 nt, Human
ggcgacggcgacagcgacagaga

SEQ ID NO: 341073 - RNA, 20 nt, Human
uacaaagaaucaagaggcug

SEQ ID NO: 341074 - RNA, 26 nt, Human
uacccacccacccuggcaauuuacaa

SEQ ID NO: 341075 - RNA, 25 nt, Human
uauaguaccuuuuacagaaagccuu

SEQ ID NO: 341076 - RNA, 19 nt, Human
ucccucuggcaggaaagaa

SEQ ID NO: 341077 - RNA, 22 nt, Human
ugaacgauucuucgcccuucua

SEQ ID NO: 341078 - RNA, 23 nt, Human
ugaagguuaagccugccuccucc

SEQ ID NO: 341079 - RNA, 18 nt, Human
ugccucauuuuucuuucu

SEQ ID NO: 341080 - RNA, 19 nt, Human
uggcaauuuacaaagaauc

SEQ ID NO: 341081 - RNA, 18 nt, Human
uuuuuuuuuuuuuuuuug

SEQ ID NO: 341082 - RNA, 18 nt, Human
uuuuuuuuuuuuuuuuug

SEQ ID NO: 341083 - RNA, 22 nt, Human
uuuuuuuuuuuuuuuuuuuggc

SEQ ID NO: 341084 - RNA, 19 nt, Human
aaaauaaaccaucaacaga

SEQ ID NO: 341085 - RNA, 22 nt, Human
aaacagaaagucaaauaccaca

SEQ ID NO: 341086 - RNA, 23 nt, Human
aacauggaugaaacuggagguca

SEQ ID NO: 341087 - RNA, 21 nt, Human
aaccaucaacagaaugaacaa

SEQ ID NO: 341088 - RNA, 23 nt, Human
aacucaaauaacucaacaaaaaa

SEQ ID NO: 341089 - RNA, 20 nt, Human
aagaagcauaugaaaaaaug

SEQ ID NO: 341090 - RNA, 23 nt, Human
acagaaugaacaacgugcagaac

SEQ ID NO: 341091 - RNA, 24 nt, Human
acagcaaaauaaaccaucaacaga

SEQ ID NO: 341092 - RNA, 20 nt, Human
agacaugaauaaacauuuuu

SEQ ID NO: 341093 - RNA, 23 nt, Human
agcaaaauaaaccaucaacagaa

SEQ ID NO: 341094 - RNA, 21 nt, Human
agucaaauaccacauguucuc

SEQ ID NO: 341095 - RNA, 24 nt, Human
auccaaauaaugccauuaaaaagu

SEQ ID NO: 341096 - RNA, 25 nt, Human
aucucacacaaaugagaauggcuau

SEQ ID NO: 341097 - RNA, 18 nt, Human
augcuuaucacagcucug

SEQ ID NO: 341098 - RNA, 19 nt, Human
caaaacugcacuguacccc

SEQ ID NO: 341099 - RNA, 24 nt, Human
caaauaacucaacaaaaaaaaucc

SEQ ID NO: 341100 - RNA, 18 nt, Human
caaauaccacauguucuc

SEQ ID NO: 341101 - RNA, 19 nt, Human
cacaaugagaccuuaucuc

SEQ ID NO: 341102 - RNA, 24 nt, Human
cacagcaaaauaaaccaucaacag

SEQ ID NO: 341103 - RNA, 23 nt, Human
cacugccauaaaaaagaacgaga

SEQ ID NO: 341104 - RNA, 24 nt, Human
cagaauauauaagaaacucaaaua

SEQ ID NO: 341105 - RNA, 23 nt, Human
cagaaugaacaacgugcagaacc

SEQ ID NO: 341106 - RNA, 25 nt, Human
cagagaaauggaaauuaaaaccaca

SEQ ID NO: 341107 - RNA, 24 nt, Human
cagcaaaauaaaccaucaacagaa

SEQ ID NO: 341108 - RNA, 23 nt, Human
cagcaacauggaugaaacuggag

SEQ ID NO: 341109 - RNA, 22 nt, Human
caggacuccuggaacagccucc

SEQ ID NO: 341110 - RNA, 24 nt, Human
caguagcaaagauauggaauccua

SEQ ID NO: 341111 - RNA, 22 nt, Human
ccacuaggcaaucuauccaugu

SEQ ID NO: 341112 - RNA, 23 nt, Human
ccuaggaccaggauccacggggc

SEQ ID NO: 341113 - RNA, 21 nt, Human
ccucucagccuugaguguagg

SEQ ID NO: 341114 - RNA, 18 nt, Human
ccuguguccagccuagga

SEQ ID NO: 341115 - RNA, 19 nt, Human
ccuugaguguagggggcug

SEQ ID NO: 341116 - RNA, 22 nt, Human
cgaggcugcugggcaggacucc

SEQ ID NO: 341117 - RNA, 21 nt, Human
cucaaaaacagaaagucaaau

SEQ ID NO: 341118 - RNA, 22 nt, Human
cucaaaaacagaaagucaaaua

SEQ ID NO: 341119 - RNA, 19 nt, Human
cucaacaaaaaaaauccaa

SEQ ID NO: 341120 - RNA, 18 nt, Human
cucuuucugugcagccug

SEQ ID NO: 341121 - RNA, 20 nt, Human
cucuuucugugcagccuggu

SEQ ID NO: 341122 - RNA, 23 nt, Human
cugcacuguacccccuuacauuu

SEQ ID NO: 341123 - RNA, 24 nt, Human
cugcacuguacccccuuacauuua

SEQ ID NO: 341124 - RNA, 20 nt, Human
cugugaccgacacucagguc

SEQ ID NO: 341125 - RNA, 22 nt, Human
gaaaaaaugcuuaacaucaaaa

SEQ ID NO: 341126 - RNA, 20 nt, Human
gaacaccuauacacuguugg

SEQ ID NO: 341127 - RNA, 20 nt, Human
gacaaggugggaggggguga

SEQ ID NO: 341128 - RNA, 23 nt, Human
gagaaaagggaacaccuauacac

SEQ ID NO: 341129 - RNA, 18 nt, Human
gagcuaccauuugaucca

SEQ ID NO: 341130 - RNA, 21 nt, Human
ggacuccuggaacagccuccu

SEQ ID NO: 341131 - RNA, 20 nt, Human
ggcugugaccgacacucagg

SEQ ID NO: 341132 - RNA, 21 nt, Human
uaaaaaggaaugacuuuccug

SEQ ID NO: 341133 - RNA, 24 nt, Human
uaaaaagugggcaaaagacaugaa

SEQ ID NO: 341134 - RNA, 22 nt, Human
uaaaaauagagcuaccauuuga

SEQ ID NO: 341135 - RNA, 18 nt, Human
uaaauuaguacaaccccu

SEQ ID NO: 341136 - RNA, 23 nt, Human
uaacaucaaaagucaucagagaa

SEQ ID NO: 341137 - RNA, 26 nt, Human
uaacucaaaaacagaaagucaaauac

SEQ ID NO: 341138 - RNA, 20 nt, Human
uaacucaacaaaaaaaaucc

SEQ ID NO: 341139 - RNA, 19 nt, Human
uaagaagcauaugaaaaaa

SEQ ID NO: 341140 - RNA, 23 nt, Human
uaccacauguucucacuuguaag

SEQ ID NO: 341141 - RNA, 21 nt, Human
uauccagaauauauccagaau

SEQ ID NO: 341142 - RNA, 19 nt, Human
uaucucacacaaaugagaa

SEQ ID NO: 341143 - RNA, 20 nt, Human
uaucucacacaaaugagaau

SEQ ID NO: 341144 - RNA, 24 nt, Human
uccagaauauauaagaaacucaaa

SEQ ID NO: 341145 - RNA, 23 nt, Human
uccaucaacagaugauuggauaa

SEQ ID NO: 341146 - RNA, 20 nt, Human
ugaaaaaaugcuuaacauca

SEQ ID NO: 341147 - RNA, 20 nt, Human
ugaaaaaaugcuuaacauca

SEQ ID NO: 341148 - RNA, 23 nt, Human
ugacaaggugggagggggugagg

SEQ ID NO: 341149 - RNA, 20 nt, Human
ugaggccucucagccuugag

SEQ ID NO: 341150 - RNA, 18 nt, Human
uggaauacuacacugcca

SEQ ID NO: 341151 - RNA, 18 nt, Human
uggaauacuacacugcca

SEQ ID NO: 341152 - RNA, 18 nt, Human
uggacauggaguguggaa

SEQ ID NO: 341153 - RNA, 20 nt, Human
ugggacuuaauuaaacuaaa

SEQ ID NO: 341154 - RNA, 19 nt, Human
ugggagggggugagggaug

SEQ ID NO: 341155 - RNA, 20 nt, Human
ugggagggggugagggauga

SEQ ID NO: 341156 - RNA, 21 nt, Human
ugggagggggugagggaugag

SEQ ID NO: 341157 - RNA, 18 nt, Human
uggugggacuguaaauua

SEQ ID NO: 341158 - RNA, 21 nt, Human
uguggaauaauagacauugga

SEQ ID NO: 341159 - RNA, 21 nt, Human
uuucugugcagccuggugucu

SEQ ID NO: 341160 - RNA, 19 nt, Human
acaaaaggccaagcuguuc

SEQ ID NO: 341161 - RNA, 28 nt, Human
caaagucaaaaacaauaaaauaaaauaa

SEQ ID NO: 341162 - RNA, 21 nt, Human
caaauauauucugacucccug

SEQ ID NO: 341163 - RNA, 22 nt, Human
caagacacccacaaaaggccaa

SEQ ID NO: 341164 - RNA, 23 nt, Human
caagacacccacaaaaggccaag

SEQ ID NO: 341165 - RNA, 24 nt, Human
ccacaaaaggccaagcuguucacc

SEQ ID NO: 341166 - RNA, 21 nt, Human
cucuuccaaagucaaaaacaa

SEQ ID NO: 341167 - RNA, 18 nt, Human
gacacccacaaaaggcca

SEQ ID NO: 341168 - RNA, 18 nt, Human
gacuucaauagcucagua

SEQ ID NO: 341169 - RNA, 23 nt, Human
ucacccagggagccauacuggca

SEQ ID NO: 341170 - RNA, 21 nt, Human
uccuucugcggucucucuguu

SEQ ID NO: 341171 - RNA, 26 nt, Human
ucugagucauuuguucuucuugggcu

SEQ ID NO: 341172 - RNA, 23 nt, Human
ucuuccuccuucugcggucucuc

SEQ ID NO: 341173 - RNA, 21 nt, Human
ucuugggcugucaagacaccc

SEQ ID NO: 341174 - RNA, 20 nt, Human
ugucuugcuuaugcuucuuc

SEQ ID NO: 341175 - RNA, 19 nt, Human
uuaagagcaauagcuuaag

SEQ ID NO: 341176 - RNA, 26 nt, Human
uuaauacaaaauccacauuuauuauu

SEQ ID NO: 341177 - RNA, 19 nt, Human
uugcuuaugcuucuucaac

SEQ ID NO: 341178 - RNA, 23 nt, Human
uuuuuuuuuuuuuuuuuuaaaug

SEQ ID NO: 341179 - RNA, 21 nt, Human
acagacagggcaugcagagcg

SEQ ID NO: 341180 - RNA, 19 nt, Human
agacagggcaugcagagcg

SEQ ID NO: 341181 - RNA, 18 nt, Human
agggauugggggugagcu

SEQ ID NO: 341182 - RNA, 27 nt, Human
agggcugccugccugcacccucaaggc

SEQ ID NO: 341183 - RNA, 20 nt, Human
aguccccuuuccaccccuac

SEQ ID NO: 341184 - RNA, 22 nt, Human
aguccccuuuccaccccuaccg

SEQ ID NO: 341185 - RNA, 24 nt, Human
caagccuacugcaaaaucuguaug

SEQ ID NO: 341186 - RNA, 22 nt, Human
caagccuguuccaaggggcugg

SEQ ID NO: 341187 - RNA, 21 nt, Human
cacagacagggcaugcagagc

SEQ ID NO: 341188 - RNA, 23 nt, Human
cagcgccggccagagcuugcacg

SEQ ID NO: 341189 - RNA, 18 nt, Human
cagcuuccugaggagggg

SEQ ID NO: 341190 - RNA, 22 nt, Human
caucugaguccccuuuccaccc

SEQ ID NO: 341191 - RNA, 19 nt, Human
caugcagcuguccuggacu

SEQ ID NO: 341192 - RNA, 21 nt, Human
ccagagcuugcacgguggcgg

SEQ ID NO: 341193 - RNA, 23 nt, Human
ccagcugccccaagccuacugca

SEQ ID NO: 341194 - RNA, 18 nt, Human
ccccaagccuacugcaaa

SEQ ID NO: 341195 - RNA, 23 nt, Human
cccccauuguggccuggcugcaa

SEQ ID NO: 341196 - RNA, 20 nt, Human
cccuccucuugccccuguug

SEQ ID NO: 341197 - RNA, 19 nt, Human
ccucacauccugaaacacc

SEQ ID NO: 341198 - RNA, 19 nt, Human
ccucccccauuguggccug

SEQ ID NO: 341199 - RNA, 23 nt, Human
ccugcgggcccucacauccugaa

SEQ ID NO: 341200 - RNA, 18 nt, Human
cucauaccagcuuccuga

SEQ ID NO: 341201 - RNA, 22 nt, Human
gaggaggggccggccccuccuc

SEQ ID NO: 341202 - RNA, 20 nt, Human
gcacgguggcgggcaggcag

SEQ ID NO: 341203 - RNA, 20 nt, Human
gcccauggcaggaaggggcc

SEQ ID NO: 341204 - RNA, 19 nt, Human
gccggccccuccucuugcc

SEQ ID NO: 341205 - RNA, 22 nt, Human
ggcacaggcuggggaggcuggc

SEQ ID NO: 341206 - RNA, 22 nt, Human
ggcaggaaggggccagggacac

SEQ ID NO: 341207 - RNA, 21 nt, Human
gggcagcgccggccagagcuu

SEQ ID NO: 341208 - RNA, 22 nt, Human
gggcagcgccggccagagcuuc

SEQ ID NO: 341209 - RNA, 21 nt, Human
gggcuggacucaccuccccca

SEQ ID NO: 341210 - RNA, 19 nt, Human
ggguccccgccgcgggggc

SEQ ID NO: 341211 - RNA, 23 nt, Human
guauguacaguauagucuaugug

SEQ ID NO: 341212 - RNA, 19 nt, Human
gugggugggguacagggcu

SEQ ID NO: 341213 - RNA, 20 nt, Human
uccaaggggcuggacucacc

SEQ ID NO: 341214 - RNA, 21 nt, Human
uccuggacuguuggguagcug

SEQ ID NO: 341215 - RNA, 22 nt, Human
ugaaacaccgcucacuacccuc

SEQ ID NO: 341216 - RNA, 20 nt, Human
ugaguccccuuuccaccccu

SEQ ID NO: 341217 - RNA, 22 nt, Human
ugccugccugcacccucaaggc

SEQ ID NO: 341218 - RNA, 18 nt, Human
uggcaggaaggggccaga

SEQ ID NO: 341219 - RNA, 21 nt, Human
uuccaaggggcuggacucacc

SEQ ID NO: 341220 - RNA, 19 nt, Human
uuccugaggaggggccggc

SEQ ID NO: 341221 - RNA, 21 nt, Human
uuccugcgggccugcccaugg

SEQ ID NO: 341222 - RNA, 23 nt, Human
uuuuuuuuuuuuuuuuugcagaa

SEQ ID NO: 341223 - RNA, 21 nt, Human
uuuuuuuuuuuuuuuuuuugg

SEQ ID NO: 341224 - RNA, 21 nt, Human
aaacaauguuaugacaaucac

SEQ ID NO: 341225 - RNA, 20 nt, Human
aacagcaccaacaauaacaa

SEQ ID NO: 341226 - RNA, 18 nt, Human
acagcacagaacucagag

SEQ ID NO: 341227 - RNA, 20 nt, Human
acagcaccaacaauaacaaa

SEQ ID NO: 341228 - RNA, 25 nt, Human
acagucaggcugaaaccccugcuga

SEQ ID NO: 341229 - RNA, 23 nt, Human
acuuuguucuccugggcccugcc

SEQ ID NO: 341230 - RNA, 18 nt, Human
agacagcacagaacucag

SEQ ID NO: 341231 - RNA, 21 nt, Human
agagacagcacagaacucaga

SEQ ID NO: 341232 - RNA, 23 nt, Human
agcgcauuuuuuuuuuuuuuuuu

SEQ ID NO: 341233 - RNA, 19 nt, Human
aggcaaaacagcugaucug

SEQ ID NO: 341234 - RNA, 18 nt, Human
aggccaguguuugaggua

SEQ ID NO: 341235 - RNA, 22 nt, Human
augcaaucagagucaacugagc

SEQ ID NO: 341236 - RNA, 20 nt, Human
caaaggggcugcccugggua

SEQ ID NO: 341237 - RNA, 19 nt, Human
caacagcaccaacaauaac

SEQ ID NO: 341238 - RNA, 25 nt, Human
caacagcaccaacaauaacaaaaac

SEQ ID NO: 341239 - RNA, 20 nt, Human
caacugagcaacaggcaaaa

SEQ ID NO: 341240 - RNA, 22 nt, Human
caaucacagaaaaccaaugaua

SEQ ID NO: 341241 - RNA, 23 nt, Human
caggccaguguuugagguauaaa

SEQ ID NO: 341242 - RNA, 19 nt, Human
cagggggccacccagagca

SEQ ID NO: 341243 - RNA, 23 nt, Human
cauccagggucccuuccgugccc

SEQ ID NO: 341244 - RNA, 21 nt, Human
cauucagagguagagucuggu

SEQ ID NO: 341245 - RNA, 18 nt, Human
ccacccagagcacugagc

SEQ ID NO: 341246 - RNA, 23 nt, Human
cccacagagagccccaccaaccc

SEQ ID NO: 341247 - RNA, 24 nt, Human
cccacagagagccccaccaacccu

SEQ ID NO: 341248 - RNA, 21 nt, Human
cccacuccaguguucaucuca

SEQ ID NO: 341249 - RNA, 25 nt, Human
cccugcugcaacgcagggucagggg

SEQ ID NO: 341250 - RNA, 21 nt, Human
ccugccucccacacaggggca

SEQ ID NO: 341251 - RNA, 19 nt, Human
ccugggcccugccuccaag

SEQ ID NO: 341252 - RNA, 18 nt, Human
ccuuucagggcucuccac

SEQ ID NO: 341253 - RNA, 21 nt, Human
cgccaggaagcaaaggcgcgg

SEQ ID NO: 341254 - RNA, 20 nt, Human
cuccagcaugagucccacag

SEQ ID NO: 341255 - RNA, 19 nt, Human
cuccucuccagcaugaguc

SEQ ID NO: 341256 - RNA, 18 nt, Human
cuccuggaggagcucaug

SEQ ID NO: 341257 - RNA, 20 nt, Human
cuccuuucagggcucuccac

SEQ ID NO: 341258 - RNA, 20 nt, Human
cuggcuuccucacugccgug

SEQ ID NO: 341259 - RNA, 22 nt, Human
gaagcaaaggcgcgguagcccc

SEQ ID NO: 341260 - RNA, 18 nt, Human
gacucugggcuagcccag

SEQ ID NO: 341261 - RNA, 19 nt, Human
gaggugacaggcagguauc

SEQ ID NO: 341262 - RNA, 20 nt, Human
gagucugguagagaaaggga

SEQ ID NO: 341263 - RNA, 23 nt, Human
gcaggaaagaaacacaaggcucc

SEQ ID NO: 341264 - RNA, 19 nt, Human
gccccagggcgggccugcu

SEQ ID NO: 341265 - RNA, 24 nt, Human
gcccugccuccaagagacagcaca

SEQ ID NO: 341266 - RNA, 21 nt, Human
ggaaaagccacuccccgaggg

SEQ ID NO: 341267 - RNA, 20 nt, Human
ggcaggcuccaggaggcucc

SEQ ID NO: 341268 - RNA, 22 nt, Human
ggcaucucuuuuugccuguucu

SEQ ID NO: 341269 - RNA, 19 nt, Human
gggcaagagucacaucagc

SEQ ID NO: 341270 - RNA, 20 nt, Human
gggccacaaaggggcugccc

SEQ ID NO: 341271 - RNA, 19 nt, Human
gguagagaaagggagacag

SEQ ID NO: 341272 - RNA, 20 nt, Human
gucacaucagcuugcuggcc

SEQ ID NO: 341273 - RNA, 26 nt, Human
uaacaacagcaccaacaauaacaaaa

SEQ ID NO: 341274 - RNA, 22 nt, Human
uaagggacucugggcuagccca

SEQ ID NO: 341275 - RNA, 22 nt, Human
uacacuuaaauaaucuccugga

SEQ ID NO: 341276 - RNA, 20 nt, Human
uacagagagaacaguguuga

SEQ ID NO: 341277 - RNA, 20 nt, Human
uaccacaaaaaacacuggcu

SEQ ID NO: 341278 - RNA, 19 nt, Human
uaguucacuuccccagccu

SEQ ID NO: 341279 - RNA, 21 nt, Human
uaucuaggaaaccagcuccau

SEQ ID NO: 341280 - RNA, 22 nt, Human
uaucugaaggagagacugcugc

SEQ ID NO: 341281 - RNA, 23 nt, Human
ucacaggccaguguuugagguau

SEQ ID NO: 341282 - RNA, 18 nt, Human
ucaggggccaccugcagg

SEQ ID NO: 341283 - RNA, 18 nt, Human
ucaggggccaccugcagg

SEQ ID NO: 341284 - RNA, 20 nt, Human
ucauucauaucuaggaaacc

SEQ ID NO: 341285 - RNA, 21 nt, Human
uccacacugcggggcaugaga

SEQ ID NO: 341286 - RNA, 19 nt, Human
ucccaaacaggcugcugga

SEQ ID NO: 341287 - RNA, 21 nt, Human
ucccacacaggggcagccacc

SEQ ID NO: 341288 - RNA, 23 nt, Human
uccugggccacaaaggggcugcc

SEQ ID NO: 341289 - RNA, 23 nt, Human
uccugggccacaaaggggcugcc

SEQ ID NO: 341290 - RNA, 19 nt, Human
ucggggcaucucuuuuugc

SEQ ID NO: 341291 - RNA, 19 nt, Human
ucucauaccacaaaaaaca

SEQ ID NO: 341292 - RNA, 20 nt, Human
ucugcccacuccaguguuca

SEQ ID NO: 341293 - RNA, 21 nt, Human
ugacaggcagguauccccagu

SEQ ID NO: 341294 - RNA, 18 nt, Human
ugacaugacugcaaggcu

SEQ ID NO: 341295 - RNA, 22 nt, Human
ugacugcaaggcuggacagaca

SEQ ID NO: 341296 - RNA, 20 nt, Human
ugaggagggccaaaggggaa

SEQ ID NO: 341297 - RNA, 18 nt, Human
ugaggaguuccugacagg

SEQ ID NO: 341298 - RNA, 20 nt, Human
ugaucuggaugucuuuccuc

SEQ ID NO: 341299 - RNA, 24 nt, Human
ugcagaaccugccucccacacagg

SEQ ID NO: 341300 - RNA, 24 nt, Human
ugcaggaaagaaacacaaggcucc

SEQ ID NO: 341301 - RNA, 20 nt, Human
uggaaagggcucacaggcca

SEQ ID NO: 341302 - RNA, 26 nt, Human
uggagcgcauuuuuuuuuuuuuuuuu

SEQ ID NO: 341303 - RNA, 25 nt, Human
uggaugucuuuccuccucucauuuu

SEQ ID NO: 341304 - RNA, 21 nt, Human
uggcuggauuucagcaggacu

SEQ ID NO: 341305 - RNA, 22 nt, Human
uggcuuccucacugccguggag

SEQ ID NO: 341306 - RNA, 22 nt, Human
uuauccacauguuuccuaaacc

SEQ ID NO: 341307 - RNA, 18 nt, Human
uucagcaggacucucagg

SEQ ID NO: 341308 - RNA, 27 nt, Human
uucucauaccacaaaaaacacuggcug

SEQ ID NO: 341309 - RNA, 19 nt, Human
uugcacuugcuuugcagaa

SEQ ID NO: 341310 - RNA, 20 nt, Human
uuugcagaaccugccuccca

SEQ ID NO: 341311 - RNA, 22 nt, Human
uuuguucagugaugcccugagg

SEQ ID NO: 341312 - RNA, 27 nt, Human
uuuuuuuuuuuuuuuuuuuuuuugggg

SEQ ID NO: 341313 - RNA, 21 nt, Human
aacccaccgccaucgucccuc

SEQ ID NO: 341314 - RNA, 24 nt, Human
aagacagcaaauucagauacaaaa

SEQ ID NO: 341315 - RNA, 18 nt, Human
aaggccccagggagacag

SEQ ID NO: 341316 - RNA, 20 nt, Human
agacagcaaauucagauaca

SEQ ID NO: 341317 - RNA, 18 nt, Human
agcugagguaggugggga

SEQ ID NO: 341318 - RNA, 23 nt, Human
aggaaacuaggaaggucaugacc

SEQ ID NO: 341319 - RNA, 25 nt, Human
caaaaacccaccgccaucgucccuc

SEQ ID NO: 341320 - RNA, 21 nt, Human
caaacagaacccaaggcccca

SEQ ID NO: 341321 - RNA, 21 nt, Human
cagaacccaaggccccaggga

SEQ ID NO: 341322 - RNA, 19 nt, Human
cagagggaccaguuuggca

SEQ ID NO: 341323 - RNA, 25 nt, Human
cagggggccuggccccaccuccccu

SEQ ID NO: 341324 - RNA, 22 nt, Human
caugacccccaaacagaaccca

SEQ ID NO: 341325 - RNA, 23 nt, Human
ccacagggagggggcuccucuca

SEQ ID NO: 341326 - RNA, 23 nt, Human
cccaauuuggcugaucccucccc

SEQ ID NO: 341327 - RNA, 23 nt, Human
cccccaaacagaacccaaggccc

SEQ ID NO: 341328 - RNA, 18 nt, Human
cccgugcgcacccggccg

SEQ ID NO: 341329 - RNA, 19 nt, Human
cccgugcgcacccggcucg

SEQ ID NO: 341330 - RNA, 22 nt, Human
cccuccugcucugggccaggga

SEQ ID NO: 341331 - RNA, 25 nt, Human
cccuccugcucugggccagggaugg

SEQ ID NO: 341332 - RNA, 18 nt, Human
cccugugccugacccagc

SEQ ID NO: 341333 - RNA, 18 nt, Human
ccgccaucgucccucccu

SEQ ID NO: 341334 - RNA, 18 nt, Human
ccgccgccgccgccgccg

SEQ ID NO: 341335 - RNA, 18 nt, Human
ccgccgccgccgccgccg

SEQ ID NO: 341336 - RNA, 18 nt, Human
ccgccgccgccgccgccg

SEQ ID NO: 341337 - RNA, 18 nt, Human
ccgccgccgccgccgccg

SEQ ID NO: 341338 - RNA, 21 nt, Human
ccgccgccgccgccgccgccg

SEQ ID NO: 341339 - RNA, 22 nt, Human
ccgccgccgccgccgccgccgc

SEQ ID NO: 341340 - RNA, 22 nt, Human
ccgccgccgccgccgccgccgc

SEQ ID NO: 341341 - RNA, 24 nt, Human
ccgccgccgccgccgccgccgccg

SEQ ID NO: 341342 - RNA, 24 nt, Human
ccgccgccgccgccgccgccgccg

SEQ ID NO: 341343 - RNA, 24 nt, Human
ccgccgccgccgccgccgccgccg

SEQ ID NO: 341344 - RNA, 24 nt, Human
ccgccgccgccgccgccgccgccg

SEQ ID NO: 341345 - RNA, 23 nt, Human
ccgccgccgccgccgccgccgcu

SEQ ID NO: 341346 - RNA, 26 nt, Human
ccgccgccgccgccgccgccgcugcc

SEQ ID NO: 341347 - RNA, 18 nt, Human
ccgccgccgcugccuccg

SEQ ID NO: 341348 - RNA, 19 nt, Human
ccgccgcugccuccgccuc

SEQ ID NO: 341349 - RNA, 23 nt, Human
ccgccgcugccuccgccuccccg

SEQ ID NO: 341350 - RNA, 25 nt, Human
ccuccccucaccaucguccuugggc

SEQ ID NO: 341351 - RNA, 20 nt, Human
ccugugccugacccagcuga

SEQ ID NO: 341352 - RNA, 23 nt, Human
cgccgccgccgccgcugccuccg

SEQ ID NO: 341353 - RNA, 21 nt, Human
cuccgccgccgccgccgccgc

SEQ ID NO: 341354 - RNA, 21 nt, Human
cugcuccgccgccgccgccgc

SEQ ID NO: 341355 - RNA, 24 nt, Human
cuggggggaaggacaacccucucc

SEQ ID NO: 341356 - RNA, 27 nt, Human
gacagcaaauucagauacaaaaaccca

SEQ ID NO: 341357 - RNA, 23 nt, Human
gccccagggagacagagggaccc

SEQ ID NO: 341358 - RNA, 19 nt, Human
gcgcccgggucaucaucgc

SEQ ID NO: 341359 - RNA, 22 nt, Human
ggagguggggaggagguugcgg

SEQ ID NO: 341360 - RNA, 24 nt, Human
ggagguggggaggagguugcgggg

SEQ ID NO: 341361 - RNA, 19 nt, Human
ggggaacagggcacagggg

SEQ ID NO: 341362 - RNA, 22 nt, Human
gguggggaggagguugcggggu

SEQ ID NO: 341363 - RNA, 22 nt, Human
guggaaagugguggaggcgggg

SEQ ID NO: 341364 - RNA, 18 nt, Human
uagguggggaacagggca

SEQ ID NO: 341365 - RNA, 21 nt, Human
uagguggggaacagggcacag

SEQ ID NO: 341366 - RNA, 19 nt, Human
uccccgugcgcacccggcu

SEQ ID NO: 341367 - RNA, 19 nt, Human
ucccucccuccugcucugg

SEQ ID NO: 341368 - RNA, 21 nt, Human
ucccugcugggggcccccacc

SEQ ID NO: 341369 - RNA, 23 nt, Human
ugagcuaggcucaggcuggaggc

SEQ ID NO: 341370 - RNA, 23 nt, Human
ugcugggggcccccaccagguug

SEQ ID NO: 341371 - RNA, 23 nt, Human
ugcuggggggaaggacaacccuc

SEQ ID NO: 341372 - RNA, 19 nt, Human
uggaaagugguggaggcgg

SEQ ID NO: 341373 - RNA, 23 nt, Human
ugggagguggggaggagguugcg

SEQ ID NO: 341374 - RNA, 18 nt, Human
ugggcugcugagcuaggc

SEQ ID NO: 341375 - RNA, 18 nt, Human
ugucccugcugggggccc

SEQ ID NO: 341376 - RNA, 21 nt, Human
uucaagacagcaaauucagau

SEQ ID NO: 341377 - RNA, 22 nt, Human
uuggagcggggcagggggccug

SEQ ID NO: 341378 - RNA, 23 nt, Human
aaacuaaaacuacuaugugguaa

SEQ ID NO: 341379 - RNA, 19 nt, Human
aaaugcuuuuggaccaaca

SEQ ID NO: 341380 - RNA, 22 nt, Human
aagaacuucaauacccuugcac

SEQ ID NO: 341381 - RNA, 20 nt, Human
accagcuaccuaaggccaca

SEQ ID NO: 341382 - RNA, 18 nt, Human
aggaaaaagaaugaaaug

SEQ ID NO: 341383 - RNA, 23 nt, Human
ccagcuaccuaaggccacauaau

SEQ ID NO: 341384 - RNA, 21 nt, Human
ccccucaggaaaaagaaugaa

SEQ ID NO: 341385 - RNA, 19 nt, Human
ccuccauuucugggcuccc

SEQ ID NO: 341386 - RNA, 18 nt, Human
ccugaacacccaggcuga

SEQ ID NO: 341387 - RNA, 18 nt, Human
cucaggaaaaagaaugaa

SEQ ID NO: 341388 - RNA, 25 nt, Human
gaaauguccuccauuucugggcucc

SEQ ID NO: 341389 - RNA, 23 nt, Human
ggucacaguccuuccccucagga

SEQ ID NO: 341390 - RNA, 24 nt, Human
uaaaaguauucaaagaccacuuca

SEQ ID NO: 341391 - RNA, 21 nt, Human
uaacaaugcaaacacggacca

SEQ ID NO: 341392 - RNA, 25 nt, Human
uaacggacacugcaguuuucaacac

SEQ ID NO: 341393 - RNA, 19 nt, Human
uaccuaaggccacauaauc

SEQ ID NO: 341394 - RNA, 20 nt, Human
uaguaaacacuucacuguua

SEQ ID NO: 341395 - RNA, 21 nt, Human
uaguucugagugauguuuccu

SEQ ID NO: 341396 - RNA, 25 nt, Human
ucaauaguucugagugauguuuccu

SEQ ID NO: 341397 - RNA, 19 nt, Human
uccugaacacccaggcuga

SEQ ID NO: 341398 - RNA, 20 nt, Human
uccugaacacccaggcugaa

SEQ ID NO: 341399 - RNA, 19 nt, Human
uccugcuuuucagagugag

SEQ ID NO: 341400 - RNA, 22 nt, Human
ugaaauguccuccauuucuggg

SEQ ID NO: 341401 - RNA, 19 nt, Human
uggcaggucacaguccuuc

SEQ ID NO: 341402 - RNA, 21 nt, Human
uggcuuccugauucacuaccc

SEQ ID NO: 341403 - RNA, 22 nt, Human
uguacaaccagcuaccuaaggc

SEQ ID NO: 341404 - RNA, 23 nt, Human
uucaagacagauuuuuggcacuc

SEQ ID NO: 341405 - RNA, 18 nt, Human
uucugagugauguuuccu

SEQ ID NO: 341406 - RNA, 24 nt, Human
aaaaccagaaaugcaagucagccu

SEQ ID NO: 341407 - RNA, 19 nt, Human
aacagaaaacucugugguu

SEQ ID NO: 341408 - RNA, 20 nt, Human
aacccagcucucccccagca

SEQ ID NO: 341409 - RNA, 20 nt, Human
aacuuggucaacgcgaagcc

SEQ ID NO: 341410 - RNA, 21 nt, Human
aagaauggcaggaaaucaccu

SEQ ID NO: 341411 - RNA, 24 nt, Human
aagcauccaacuacuauuuaaaua

SEQ ID NO: 341412 - RNA, 18 nt, Human
aagccaugcucgaagcug

SEQ ID NO: 341413 - RNA, 22 nt, Human
aagcccccgagggacacuccac

SEQ ID NO: 341414 - RNA, 19 nt, Human
aagcuccaauggcccucua

SEQ ID NO: 341415 - RNA, 24 nt, Human
aaggaacuuggucaacgcgaagcc

SEQ ID NO: 341416 - RNA, 25 nt, Human
aaggaacuuggucaacgcgaagccg

SEQ ID NO: 341417 - RNA, 20 nt, Human
acaaagccaggaggggaagu

SEQ ID NO: 341418 - RNA, 19 nt, Human
acccagcucucccccagca

SEQ ID NO: 341419 - RNA, 21 nt, Human
acggaaggaagcagcaaccgg

SEQ ID NO: 341420 - RNA, 18 nt, Human
acgugucaggggucacgc

SEQ ID NO: 341421 - RNA, 18 nt, Human
agaaaugcaagucagccu

SEQ ID NO: 341422 - RNA, 19 nt, Human
agacggaaggaagcagcaa

SEQ ID NO: 341423 - RNA, 23 nt, Human
agacggaaggaagcagcaaccgg

SEQ ID NO: 341424 - RNA, 21 nt, Human
agccugccucugccaacccug

SEQ ID NO: 341425 - RNA, 18 nt, Human
aggaaaacugaugaggca

SEQ ID NO: 341426 - RNA, 21 nt, Human
aggaggggaagugccacucag

SEQ ID NO: 341427 - RNA, 23 nt, Human
aggcagggguacugcccccagag

SEQ ID NO: 341428 - RNA, 23 nt, Human
aggccaaaccaaacaaagccagg

SEQ ID NO: 341429 - RNA, 24 nt, Human
aggccaaaccaaacaaagccagga

SEQ ID NO: 341430 - RNA, 20 nt, Human
agggaggcaggugggcaggg

SEQ ID NO: 341431 - RNA, 22 nt, Human
aggggcccagcuggcucccggg

SEQ ID NO: 341432 - RNA, 20 nt, Human
agucuguaauggugaagccc

SEQ ID NO: 341433 - RNA, 22 nt, Human
agugcagcaacaaacccaaaac

SEQ ID NO: 341434 - RNA, 19 nt, Human
caaaccaaacaaagccagg

SEQ ID NO: 341435 - RNA, 24 nt, Human
caacaaacccaaaaccagaaaugc

SEQ ID NO: 341436 - RNA, 22 nt, Human
caagucagccugccucugccaa

SEQ ID NO: 341437 - RNA, 19 nt, Human
cacucuggagagaggcugg

SEQ ID NO: 341438 - RNA, 19 nt, Human
cacuggacccgucagccug

SEQ ID NO: 341439 - RNA, 21 nt, Human
cacuggacccgucagccuggc

SEQ ID NO: 341440 - RNA, 19 nt, Human
cagagcccgcccaccccuu

SEQ ID NO: 341441 - RNA, 22 nt, Human
cagcaacaaacccaaaaccaga

SEQ ID NO: 341442 - RNA, 19 nt, Human
cagccaguucuuuaaggaa

SEQ ID NO: 341443 - RNA, 19 nt, Human
cagccucuggggccgcccc

SEQ ID NO: 341444 - RNA, 24 nt, Human
cagcugccugccaccggugcccgg

SEQ ID NO: 341445 - RNA, 19 nt, Human
caggaaaacugaugaggca

SEQ ID NO: 341446 - RNA, 19 nt, Human
caggaggggaagugccacu

SEQ ID NO: 341447 - RNA, 24 nt, Human
caggaggggaagugccacucaggc

SEQ ID NO: 341448 - RNA, 21 nt, Human
cagggccccugaccugccagg

SEQ ID NO: 341449 - RNA, 23 nt, Human
caugaaaacccagccgucagaga

SEQ ID NO: 341450 - RNA, 21 nt, Human
caugagcacccugggaagccc

SEQ ID NO: 341451 - RNA, 23 nt, Human
ccaaaagccaugcucgaagcuga

SEQ ID NO: 341452 - RNA, 24 nt, Human
ccaaagcccccgagggacacuccc

SEQ ID NO: 341453 - RNA, 21 nt, Human
ccacucuggagagaggcugga

SEQ ID NO: 341454 - RNA, 21 nt, Human
ccaguagccugggccucucuu

SEQ ID NO: 341455 - RNA, 18 nt, Human
ccaguggugacugucagu

SEQ ID NO: 341456 - RNA, 22 nt, Human
ccaugcucgaagcugagaaguc

SEQ ID NO: 341457 - RNA, 26 nt, Human
cccaaagcccccgagggacacucccu

SEQ ID NO: 341458 - RNA, 22 nt, Human
cccaccccuuggggaaagugca

SEQ ID NO: 341459 - RNA, 23 nt, Human
cccaggcugccuuaguccagaag

SEQ ID NO: 341460 - RNA, 24 nt, Human
cccaugaaaacccagcucuccccc

SEQ ID NO: 341461 - RNA, 18 nt, Human
ccccagagggcaccuacc

SEQ ID NO: 341462 - RNA, 18 nt, Human
ccccagggcccaagcugg

SEQ ID NO: 341463 - RNA, 21 nt, Human
cccccagcagcgggagcccgc

SEQ ID NO: 341464 - RNA, 19 nt, Human
cccccaggcugccuuaguc

SEQ ID NO: 341465 - RNA, 18 nt, Human
ccccccaggcugccuuag

SEQ ID NO: 341466 - RNA, 25 nt, Human
ccccgagggacacuccacccagggg

SEQ ID NO: 341467 - RNA, 19 nt, Human
ccccugaagcuggagaaug

SEQ ID NO: 341468 - RNA, 24 nt, Human
ccgccacucuggagagaggcugga

SEQ ID NO: 341469 - RNA, 19 nt, Human
ccggccaccgccacucugg

SEQ ID NO: 341470 - RNA, 21 nt, Human
ccugccaccggugcccgggac

SEQ ID NO: 341471 - RNA, 21 nt, Human
ccuguggcucauccccagggc

SEQ ID NO: 341472 - RNA, 20 nt, Human
ccuucuacuccuccaguagc

SEQ ID NO: 341473 - RNA, 24 nt, Human
ccuucuacuccuccaguagccugg

SEQ ID NO: 341474 - RNA, 21 nt, Human
cgagauggaguccgggauguc

SEQ ID NO: 341475 - RNA, 19 nt, Human
cgaggccaaaccaaacaaa

SEQ ID NO: 341476 - RNA, 23 nt, Human
cgaggccaaaccaaacaaagcca

SEQ ID NO: 341477 - RNA, 27 nt, Human
cgaggccaaaccaaacaaagccaggag

SEQ ID NO: 341478 - RNA, 19 nt, Human
cgucacagggggcagggag

SEQ ID NO: 341479 - RNA, 21 nt, Human
cuaaaucgaggccaaaccaaa

SEQ ID NO: 341480 - RNA, 22 nt, Human
cuccaguagccugggccucucu

SEQ ID NO: 341481 - RNA, 21 nt, Human
cucccggguuacaugcucaca

SEQ ID NO: 341482 - RNA, 20 nt, Human
cuccgggggagaggcgucca

SEQ ID NO: 341483 - RNA, 19 nt, Human
cucguaccggggcaguggg

SEQ ID NO: 341484 - RNA, 22 nt, Human
cugcccugacagccaaaagcca

SEQ ID NO: 341485 - RNA, 23 nt, Human
cuggagaaugguguccaccuuug

SEQ ID NO: 341486 - RNA, 25 nt, Human
cuggccccaaagugcugcuccgggg

SEQ ID NO: 341487 - RNA, 26 nt, Human
cuggccccaaagugcugcuccggggg

SEQ ID NO: 341488 - RNA, 19 nt, Human
cugggccagcccguccuuc

SEQ ID NO: 341489 - RNA, 21 nt, Human
cuuugaagcccuggggagucu

SEQ ID NO: 341490 - RNA, 22 nt, Human
gaagaauggcaggaaaucaccu

SEQ ID NO: 341491 - RNA, 18 nt, Human
gacagccaaaagccaugc

SEQ ID NO: 341492 - RNA, 18 nt, Human
gagcccgcccaccccuug

SEQ ID NO: 341493 - RNA, 22 nt, Human
gaggcaggugggcaggggaccc

SEQ ID NO: 341494 - RNA, 20 nt, Human
gcaacaaacccaaaaccaga

SEQ ID NO: 341495 - RNA, 23 nt, Human
gcaagcuccaauggcccucuagg

SEQ ID NO: 341496 - RNA, 22 nt, Human
gcaagggacagccucuggggcc

SEQ ID NO: 341497 - RNA, 20 nt, Human
gcagcaacaaacccaaaacc

SEQ ID NO: 341498 - RNA, 23 nt, Human
gcagggaggcaggugggcagggg

SEQ ID NO: 341499 - RNA, 18 nt, Human
gcccaagcuggccccaaa

SEQ ID NO: 341500 - RNA, 21 nt, Human
gcccgccccacagaagaaugg

SEQ ID NO: 341501 - RNA, 19 nt, Human
gcucccggguuacaugcuc

SEQ ID NO: 341502 - RNA, 23 nt, Human
ggaggcaggugggcaggggaccc

SEQ ID NO: 341503 - RNA, 23 nt, Human
ggccaaaccaaacaaagccagga

SEQ ID NO: 341504 - RNA, 23 nt, Human
gggcagggaggcaggugggcagg

SEQ ID NO: 341505 - RNA, 25 nt, Human
gggcagggaggcaggugggcagggg

SEQ ID NO: 341506 - RNA, 21 nt, Human
gggcaguggggaccccacggg

SEQ ID NO: 341507 - RNA, 24 nt, Human
ggggcagggaggcaggugggcagg

SEQ ID NO: 341508 - RNA, 24 nt, Human
ggguccugggccagcccguccuuc

SEQ ID NO: 341509 - RNA, 20 nt, Human
gugcagcaacaaacccaaaa

SEQ ID NO: 341510 - RNA, 22 nt, Human
gugcagcaacaaacccaaaacc

SEQ ID NO: 341511 - RNA, 18 nt, Human
uaaaacucaaaguggggg

SEQ ID NO: 341512 - RNA, 18 nt, Human
uaaaucaggaaaacugau

SEQ ID NO: 341513 - RNA, 25 nt, Human
uacaugcucacacgcauaggcugug

SEQ ID NO: 341514 - RNA, 19 nt, Human
uacuguguggucugagggu

SEQ ID NO: 341515 - RNA, 21 nt, Human
uauuguacagcugcccugaca

SEQ ID NO: 341516 - RNA, 20 nt, Human
ucaaagugggggucugagcu

SEQ ID NO: 341517 - RNA, 19 nt, Human
uccccagggcccaagcugg

SEQ ID NO: 341518 - RNA, 19 nt, Human
ucccccagcagcgggagcc

SEQ ID NO: 341519 - RNA, 21 nt, Human
uccugggccagcccguccuuc

SEQ ID NO: 341520 - RNA, 24 nt, Human
uccugggccagcccguccuucugc

SEQ ID NO: 341521 - RNA, 23 nt, Human
uccuggguggugaggguggggcc

SEQ ID NO: 341522 - RNA, 21 nt, Human
uccuucuacuccuccaguagc

SEQ ID NO: 341523 - RNA, 20 nt, Human
uccuuggggaaagacggaag

SEQ ID NO: 341524 - RNA, 25 nt, Human
ucuaaaucgaggccaaaccgggguc

SEQ ID NO: 341525 - RNA, 19 nt, Human
ucuauccgucuguccagag

SEQ ID NO: 341526 - RNA, 19 nt, Human
ucucccccagcagcgggag

SEQ ID NO: 341527 - RNA, 18 nt, Human
ugaaaacccagcucuccc

SEQ ID NO: 341528 - RNA, 24 nt, Human
ugcaagcuccaauggcccucuagg

SEQ ID NO: 341529 - RNA, 22 nt, Human
ugcagcaacaaacccaaaacca

SEQ ID NO: 341530 - RNA, 22 nt, Human
ugcaggcugcugcacacacgug

SEQ ID NO: 341531 - RNA, 22 nt, Human
ugccagaucucuguguguagcc

SEQ ID NO: 341532 - RNA, 20 nt, Human
ugccagggucuugggccccc

SEQ ID NO: 341533 - RNA, 19 nt, Human
ugccaugcuuucccaaagc

SEQ ID NO: 341534 - RNA, 19 nt, Human
ugcccugacagccaaaagc

SEQ ID NO: 341535 - RNA, 21 nt, Human
ugcuccgggggagaggcgucc

SEQ ID NO: 341536 - RNA, 24 nt, Human
uggaccuccugccccaucagccag

SEQ ID NO: 341537 - RNA, 20 nt, Human
uggcacagaguggcacugag

SEQ ID NO: 341538 - RNA, 19 nt, Human
uggcacggaguggcacaga

SEQ ID NO: 341539 - RNA, 20 nt, Human
uggcacggaguggcacagag

SEQ ID NO: 341540 - RNA, 21 nt, Human
uggcaggaaaucaccucucac

SEQ ID NO: 341541 - RNA, 20 nt, Human
uggcucccggguuacaugcu

SEQ ID NO: 341542 - RNA, 18 nt, Human
uggcuuggccagggcccc

SEQ ID NO: 341543 - RNA, 19 nt, Human
ugggcccccucguaccggg

SEQ ID NO: 341544 - RNA, 22 nt, Human
uggguccccuguggcucauccc

SEQ ID NO: 341545 - RNA, 18 nt, Human
uggugaagcccacagcug

SEQ ID NO: 341546 - RNA, 19 nt, Human
uggugaggguggggcccag

SEQ ID NO: 341547 - RNA, 18 nt, Human
ugguguccaccuuugcau

SEQ ID NO: 341548 - RNA, 25 nt, Human
ugucugcaagggacagccucugggg

SEQ ID NO: 341549 - RNA, 21 nt, Human
uucuacuccuccaguagccug

SEQ ID NO: 341550 - RNA, 18 nt, Human
uugcauggcagcuucucc

SEQ ID NO: 341551 - RNA, 18 nt, Human
uugcuugcccccuccguc

SEQ ID NO: 341552 - RNA, 20 nt, Human
uugcuugcccccuccgucac

SEQ ID NO: 341553 - RNA, 20 nt, Human
uugggcccccucguaccggg

SEQ ID NO: 341554 - RNA, 23 nt, Human
aaagauuagaaaaaauucuagca

SEQ ID NO: 341555 - RNA, 26 nt, Human
aauaauuugaaaauggaaacauuuga

SEQ ID NO: 341556 - RNA, 24 nt, Human
aaucuauuacuuaacccacauuca

SEQ ID NO: 341557 - RNA, 20 nt, Human
acaguagauaaguauccaaa

SEQ ID NO: 341558 - RNA, 19 nt, Human
acaugauuggauuuagaaa

SEQ ID NO: 341559 - RNA, 20 nt, Human
acuaugggcagguggagggg

SEQ ID NO: 341560 - RNA, 22 nt, Human
agugaggaagguauaaaagaga

SEQ ID NO: 341561 - RNA, 24 nt, Human
augcaggaagcgaaauagugaagg

SEQ ID NO: 341562 - RNA, 19 nt, Human
caggauuuuucugugauuc

SEQ ID NO: 341563 - RNA, 23 nt, Human
caggauuuuucugugauucugau

SEQ ID NO: 341564 - RNA, 24 nt, Human
ccaaagcagugugggcaaaaagag

SEQ ID NO: 341565 - RNA, 19 nt, Human
cccacauucauugauauca

SEQ ID NO: 341566 - RNA, 26 nt, Human
ccuccgcuuuaaguacaagacaucgg

SEQ ID NO: 341567 - RNA, 27 nt, Human
cuaaaacaagugagaucaauuaagcuc

SEQ ID NO: 341568 - RNA, 25 nt, Human
cugacuacaagcugaagauaucuua

SEQ ID NO: 341569 - RNA, 18 nt, Human
gaaauaggucuguccaca

SEQ ID NO: 341570 - RNA, 18 nt, Human
gauuacccucauacaugg

SEQ ID NO: 341571 - RNA, 22 nt, Human
gauuacuuuuuuuuuuuuuuuu

SEQ ID NO: 341572 - RNA, 20 nt, Human
gauucuguuacuaaauucug

SEQ ID NO: 341573 - RNA, 28 nt, Human
gcgaaauagugaaggaauaccgguaccc

SEQ ID NO: 341574 - RNA, 19 nt, Human
gggauuuuucccauguggg

SEQ ID NO: 341575 - RNA, 18 nt, Human
gggggccagugaggaagg

SEQ ID NO: 341576 - RNA, 23 nt, Human
gugacuaugggcagguggagggg

SEQ ID NO: 341577 - RNA, 24 nt, Human
uagcagcauaaauacauuuauaaa

SEQ ID NO: 341578 - RNA, 23 nt, Human
uagcaucauaggacaauuagcca

SEQ ID NO: 341579 - RNA, 23 nt, Human
uagcugugaaugagacacgucag

SEQ ID NO: 341580 - RNA, 25 nt, Human
ucaaaucuacuaaagauuagaaaaa

SEQ ID NO: 341581 - RNA, 19 nt, Human
ucaccuagaaggccucuac

SEQ ID NO: 341582 - RNA, 19 nt, Human
uccccugggauuuuuccca

SEQ ID NO: 341583 - RNA, 25 nt, Human
uccccugggauuuuucccauguggg

SEQ ID NO: 341584 - RNA, 19 nt, Human
ucuaugauaauagcaucau

SEQ ID NO: 341585 - RNA, 23 nt, Human
ugaaauaggucuguccacacuua

SEQ ID NO: 341586 - RNA, 21 nt, Human
ugacccacagucuagcagcau

SEQ ID NO: 341587 - RNA, 19 nt, Human
ugaggaagguauaaaagag

SEQ ID NO: 341588 - RNA, 24 nt, Human
ugaguggggaaagaaggccuucgg

SEQ ID NO: 341589 - RNA, 22 nt, Human
ugcaaaaugcaguguaccuuaa

SEQ ID NO: 341590 - RNA, 22 nt, Human
ugccuuaggcaggauuuuucug

SEQ ID NO: 341591 - RNA, 19 nt, Human
uggcagguggcuuagcucc

SEQ ID NO: 341592 - RNA, 22 nt, Human
ugggaagauauguagauuaaug

SEQ ID NO: 341593 - RNA, 24 nt, Human
ugggaagauauguagauuaauggg

SEQ ID NO: 341594 - RNA, 23 nt, Human
uguaaguaaaauuugcuaaugca

SEQ ID NO: 341595 - RNA, 23 nt, Human
uuggcagguggcuuagcuccucc

SEQ ID NO: 341596 - RNA, 23 nt, Human
uuuaaaacagaauuuggugacua

SEQ ID NO: 341597 - RNA, 22 nt, Human
uuugacccacagucuagcagca

SEQ ID NO: 341598 - RNA, 23 nt, Human
uuugacccacagucuagcagcau

SEQ ID NO: 341599 - RNA, 19 nt, Human
uuuuagaccaauuuagcug

SEQ ID NO: 341600 - RNA, 18 nt, Human
uuuuuuuuuuuuuuucug

SEQ ID NO: 341601 - RNA, 19 nt, Human
uuuuuuuuuuuuuuucugc

SEQ ID NO: 341602 - RNA, 24 nt, Human
aaacaggagccuccaccgggccca

SEQ ID NO: 341603 - RNA, 19 nt, Human
acacaaguccacacgccag

SEQ ID NO: 341604 - RNA, 22 nt, Human
acccaccgagucuccccaccau

SEQ ID NO: 341605 - RNA, 24 nt, Human
acccaucccacacaaguccacacg

SEQ ID NO: 341606 - RNA, 18 nt, Human
accugcacccaucccaca

SEQ ID NO: 341607 - RNA, 20 nt, Human
cacacaaguccacacgccag

SEQ ID NO: 341608 - RNA, 18 nt, Human
caccgggcccagcccagg

SEQ ID NO: 341609 - RNA, 21 nt, Human
caggagccuccaccgggccca

SEQ ID NO: 341610 - RNA, 23 nt, Human
caggagccuccaccgggcccagc

SEQ ID NO: 341611 - RNA, 23 nt, Human
caucgcccuucauugcccucacc

SEQ ID NO: 341612 - RNA, 21 nt, Human
ccagaaacccaggaacaugau

SEQ ID NO: 341613 - RNA, 21 nt, Human
cccacacaaguccacacgcca

SEQ ID NO: 341614 - RNA, 20 nt, Human
cccaccgagucuccccacca

SEQ ID NO: 341615 - RNA, 19 nt, Human
cccuggacugcggugagga

SEQ ID NO: 341616 - RNA, 23 nt, Human
cccuucauugcccucacucuuuc

SEQ ID NO: 341617 - RNA, 19 nt, Human
ccgggcccagcccaggcuc

SEQ ID NO: 341618 - RNA, 19 nt, Human
cucacacugcgaucacaac

SEQ ID NO: 341619 - RNA, 18 nt, Human
cuccaccgggcccagccc

SEQ ID NO: 341620 - RNA, 19 nt, Human
gagccuccaccgggcccag

SEQ ID NO: 341621 - RNA, 24 nt, Human
gcagaccugcacccaucccacaca

SEQ ID NO: 341622 - RNA, 24 nt, Human
gcgggcccaggcccuggacugcgg

SEQ ID NO: 341623 - RNA, 20 nt, Human
ggaagacuggaaguaucuaa

SEQ ID NO: 341624 - RNA, 20 nt, Human
ggcccagcccaggcucugug

SEQ ID NO: 341625 - RNA, 22 nt, Human
gggcccagcccaggcucugugg

SEQ ID NO: 341626 - RNA, 26 nt, Human
guccacacgccagcuugccuaaccac

SEQ ID NO: 341627 - RNA, 24 nt, Human
ucacacccagaaacccaggaacau

SEQ ID NO: 341628 - RNA, 21 nt, Human
ucccacacaaguccacacgcc

SEQ ID NO: 341629 - RNA, 21 nt, Human
uccgcgggcccaggcccugga

SEQ ID NO: 341630 - RNA, 23 nt, Human
uccgcgggcccaggcccuggacu

SEQ ID NO: 341631 - RNA, 20 nt, Human
ucggugugcgcuucacaccc

SEQ ID NO: 341632 - RNA, 26 nt, Human
ugaccaagucuccucguaaggaaacu

SEQ ID NO: 341633 - RNA, 20 nt, Human
ugagugucuucacucacacu

SEQ ID NO: 341634 - RNA, 22 nt, Human
ugcccucacucuuucuccuuca

SEQ ID NO: 341635 - RNA, 21 nt, Human
ugcgcuucacacccagaaacc

SEQ ID NO: 341636 - RNA, 21 nt, Human
uggaauacaacuguacaaaga

SEQ ID NO: 341637 - RNA, 22 nt, Human
uggaauacaacuguacaaagaa

SEQ ID NO: 341638 - RNA, 21 nt, Human
ugugcgcuucacacccagaaa

SEQ ID NO: 341639 - RNA, 21 nt, Human
uuucuggucugcccauucacc

SEQ ID NO: 341640 - RNA, 21 nt, Human
aaaaauccuuccccaugagaa

SEQ ID NO: 341641 - RNA, 18 nt, Human
aaagaaacaaaaccguua

SEQ ID NO: 341642 - RNA, 20 nt, Human
aacaugacaaaaccccgucu

SEQ ID NO: 341643 - RNA, 21 nt, Human
aacaugacaaaaccccgucuu

SEQ ID NO: 341644 - RNA, 21 nt, Human
aaccagccagagcauucuuug

SEQ ID NO: 341645 - RNA, 23 nt, Human
aauaaaaauccuuccccaugaga

SEQ ID NO: 341646 - RNA, 18 nt, Human
aauuagccaggcauggua

SEQ ID NO: 341647 - RNA, 22 nt, Human
acccaaaugcacuuugguucuc

SEQ ID NO: 341648 - RNA, 20 nt, Human
accccaucuugucuccccaa

SEQ ID NO: 341649 - RNA, 24 nt, Human
accccaucuugucuccccaaucuu

SEQ ID NO: 341650 - RNA, 24 nt, Human
accccgucuuuacuaaaaguacaa

SEQ ID NO: 341651 - RNA, 21 nt, Human
agaaaaauggggaaggccagg

SEQ ID NO: 341652 - RNA, 18 nt, Human
agaaggaguuggccccug

SEQ ID NO: 341653 - RNA, 24 nt, Human
agcacuuugggaggccgaggaggg

SEQ ID NO: 341654 - RNA, 18 nt, Human
aggagggaggaucgcuug

SEQ ID NO: 341655 - RNA, 24 nt, Human
aggaucgcuugagcccaggaguuu

SEQ ID NO: 341656 - RNA, 24 nt, Human
aggcaugguagcgugcaccuguag

SEQ ID NO: 341657 - RNA, 19 nt, Human
aggccaagaucaauuaagg

SEQ ID NO: 341658 - RNA, 20 nt, Human
aggccgaggagggaggaucg

SEQ ID NO: 341659 - RNA, 24 nt, Human
aggccgaggagggaggaucgcuug

SEQ ID NO: 341660 - RNA, 20 nt, Human
agggucaggaagaggagaag

SEQ ID NO: 341661 - RNA, 24 nt, Human
aggugcgguggcucaagccuguaa

SEQ ID NO: 341662 - RNA, 24 nt, Human
aucgcuugagcccaggaguuugag

SEQ ID NO: 341663 - RNA, 20 nt, Human
aucuugucuccccaaucuuc

SEQ ID NO: 341664 - RNA, 24 nt, Human
caacaugacaaaaccccgucuuua

SEQ ID NO: 341665 - RNA, 24 nt, Human
caagccuguaaucccagcacuuug

SEQ ID NO: 341666 - RNA, 23 nt, Human
caccuguagucccagcuacuugg

SEQ ID NO: 341667 - RNA, 24 nt, Human
caccuguagucccagcuacuuggg

SEQ ID NO: 341668 - RNA, 19 nt, Human
cagagcccccaacucagcc

SEQ ID NO: 341669 - RNA, 23 nt, Human
cagcacuuugggaggccgaggag

SEQ ID NO: 341670 - RNA, 24 nt, Human
cagcacuuugggaggccgaggagg

SEQ ID NO: 341671 - RNA, 22 nt, Human
cauuuuuuucuuucuuaaaaga

SEQ ID NO: 341672 - RNA, 20 nt, Human
ccacaaucuaccccaucuug

SEQ ID NO: 341673 - RNA, 20 nt, Human
ccagagcccccaacucagcc

SEQ ID NO: 341674 - RNA, 21 nt, Human
ccaggggagggagggucagga

SEQ ID NO: 341675 - RNA, 19 nt, Human
ccauggcaucugucagaac

SEQ ID NO: 341676 - RNA, 24 nt, Human
cccauaccauggcaucugucagaa

SEQ ID NO: 341677 - RNA, 21 nt, Human
cccaucuugucuccccaaucu

SEQ ID NO: 341678 - RNA, 26 nt, Human
cccgagcaacaugacaaaaggaguuc

SEQ ID NO: 341679 - RNA, 22 nt, Human
ccuguaaucccagcacuuuggg

SEQ ID NO: 341680 - RNA, 21 nt, Human
ccuguagucccagcuacuugg

SEQ ID NO: 341681 - RNA, 24 nt, Human
cucaagccuguaaucccagcacuu

SEQ ID NO: 341682 - RNA, 22 nt, Human
cugccuccacucuauucuaugu

SEQ ID NO: 341683 - RNA, 21 nt, Human
cuugucuccccaaucuucaaa

SEQ ID NO: 341684 - RNA, 19 nt, Human
gagaaaaauggggaaggcc

SEQ ID NO: 341685 - RNA, 20 nt, Human
gagcaacaugacaaaacccc

SEQ ID NO: 341686 - RNA, 18 nt, Human
gagcccaggaguuugagg

SEQ ID NO: 341687 - RNA, 24 nt, Human
gaucgcuugagcccaggaguuuga

SEQ ID NO: 341688 - RNA, 20 nt, Human
gcagcagggaaagucuucug

SEQ ID NO: 341689 - RNA, 23 nt, Human
ggaaggccaggugcgguggcuca

SEQ ID NO: 341690 - RNA, 20 nt, Human
ggaggcugaggugagagggu

SEQ ID NO: 341691 - RNA, 23 nt, Human
ggaggcugaggugagaggguugc

SEQ ID NO: 341692 - RNA, 22 nt, Human
ggagggagggucaggaagagga

SEQ ID NO: 341693 - RNA, 22 nt, Human
ggaucgcuugagcccaggaguu

SEQ ID NO: 341694 - RNA, 18 nt, Human
gggagggucaggaagagg

SEQ ID NO: 341695 - RNA, 24 nt, Human
ggggagggagggucaggaagagga

SEQ ID NO: 341696 - RNA, 24 nt, Human
gguagcgugcaccuguagucccag

SEQ ID NO: 341697 - RNA, 23 nt, Human
gguggcucaagccuguaauccca

SEQ ID NO: 341698 - RNA, 24 nt, Human
gguggcucaagccuguaaucccag

SEQ ID NO: 341699 - RNA, 19 nt, Human
guaagacaaagaaacaaaa

SEQ ID NO: 341700 - RNA, 21 nt, Human
guaagacaaagaaacaaaacc

SEQ ID NO: 341701 - RNA, 24 nt, Human
uaaaagauaggauuucuccauguc

SEQ ID NO: 341702 - RNA, 19 nt, Human
uaagacaaagaaacaaaac

SEQ ID NO: 341703 - RNA, 19 nt, Human
uaagagaaaaauggggaag

SEQ ID NO: 341704 - RNA, 22 nt, Human
uaccacuguaacuuugcucacc

SEQ ID NO: 341705 - RNA, 20 nt, Human
uagcccgagcaacaugacaa

SEQ ID NO: 341706 - RNA, 25 nt, Human
uccagagcccccaacucagccugcc

SEQ ID NO: 341707 - RNA, 24 nt, Human
ucgcuugagcccaggaguuugagg

SEQ ID NO: 341708 - RNA, 19 nt, Human
ucuccaugucuacugccuc

SEQ ID NO: 341709 - RNA, 25 nt, Human
ucuuuacuaaaaguacaaaaaaauu

SEQ ID NO: 341710 - RNA, 21 nt, Human
ugaaaaauaaaaauccuuccc

SEQ ID NO: 341711 - RNA, 23 nt, Human
ugagcccaggaguuugaggcuag

SEQ ID NO: 341712 - RNA, 18 nt, Human
ugaggugagaggguugcc

SEQ ID NO: 341713 - RNA, 24 nt, Human
ugcaccuguagucccagcuacuug

SEQ ID NO: 341714 - RNA, 22 nt, Human
uggcucaagccuguaaucccag

SEQ ID NO: 341715 - RNA, 24 nt, Human
uggcucaagccuguaaucccagca

SEQ ID NO: 341716 - RNA, 18 nt, Human
ugggaggccgaggaggga

SEQ ID NO: 341717 - RNA, 23 nt, Human
ugggaggccgaggagggaggauc

SEQ ID NO: 341718 - RNA, 19 nt, Human
ugggaggcugaggugagag

SEQ ID NO: 341719 - RNA, 20 nt, Human
ugggaggcugaggugagagg

SEQ ID NO: 341720 - RNA, 24 nt, Human
ugggaggcugaggugagaggguug

SEQ ID NO: 341721 - RNA, 21 nt, Human
uggggaaggccaggugcggug

SEQ ID NO: 341722 - RNA, 24 nt, Human
ugguagcgugcaccuguaguccca

SEQ ID NO: 341723 - RNA, 24 nt, Human
uugggaggccgaggagggaggauc

SEQ ID NO: 341724 - RNA, 18 nt, Human
uugggaggcugaggugag

SEQ ID NO: 341725 - RNA, 19 nt, Human
uugggaggcugaggugaga

SEQ ID NO: 341726 - RNA, 19 nt, Human
uugguuuuaaggcagcagg

SEQ ID NO: 341727 - RNA, 23 nt, Human
uuucuucugcccaggggagggag

SEQ ID NO: 341728 - RNA, 20 nt, Human
uuuuauugguuuuaaggcag

SEQ ID NO: 341729 - RNA, 22 nt, Human
uuuuucuuucuuaaaagauagg

SEQ ID NO: 341730 - RNA, 24 nt, Human
aaaagcacuaccuaaaaucauccc

SEQ ID NO: 341731 - RNA, 24 nt, Human
aaagcuuuuugggaauccuggaga

SEQ ID NO: 341732 - RNA, 20 nt, Human
aagcacuaccuaaaaucauc

SEQ ID NO: 341733 - RNA, 21 nt, Human
aauuaagaauaauauucaugc

SEQ ID NO: 341734 - RNA, 19 nt, Human
acuacuuuacacacaugca

SEQ ID NO: 341735 - RNA, 18 nt, Human
auuaagaauaauauucau

SEQ ID NO: 341736 - RNA, 19 nt, Human
cacaucuauucuugcuuca

SEQ ID NO: 341737 - RNA, 21 nt, Human
cagcaucagacauaaggacau

SEQ ID NO: 341738 - RNA, 24 nt, Human
ccaaaagcuuuuugggaauccugg

SEQ ID NO: 341739 - RNA, 23 nt, Human
cuuuuuguuuauuuggacuugau

SEQ ID NO: 341740 - RNA, 18 nt, Human
gaagacauagugucuaca

SEQ ID NO: 341741 - RNA, 20 nt, Human
gacuugauucuggauaaugg

SEQ ID NO: 341742 - RNA, 22 nt, Human
uaacauccccucaauuaaucau

SEQ ID NO: 341743 - RNA, 19 nt, Human
uacacuggccauuugggac

SEQ ID NO: 341744 - RNA, 22 nt, Human
ucacaucuauucuugcuucaug

SEQ ID NO: 341745 - RNA, 20 nt, Human
ugauucuggauaaugggaaa

SEQ ID NO: 341746 - RNA, 22 nt, Human
ugauucuggauaaugggaaagg

SEQ ID NO: 341747 - RNA, 19 nt, Human
ugggaauccuggagaagau

SEQ ID NO: 341748 - RNA, 21 nt, Human
uguggcaaaggacagaggcac

SEQ ID NO: 341749 - RNA, 18 nt, Human
uucaugcaaggauacaac

SEQ ID NO: 341750 - RNA, 21 nt, Human
uuugaucagauagcauuugag

SEQ ID NO: 341751 - RNA, 19 nt, Human
uuugggaauccuggagaag

SEQ ID NO: 341752 - RNA, 24 nt, Human
uuuuuuuuuuuuuuuuuuuauuuu

SEQ ID NO: 341753 - RNA, 21 nt, Human
agugggggguggguggcuggg

SEQ ID NO: 341754 - RNA, 21 nt, Human
cacagcagcccugagacgucc

SEQ ID NO: 341755 - RNA, 21 nt, Human
caccacaugcccgagcccugg

SEQ ID NO: 341756 - RNA, 22 nt, Human
caccacaugcccgagcccuggc

SEQ ID NO: 341757 - RNA, 19 nt, Human
cccgagcccuggccugugc

SEQ ID NO: 341758 - RNA, 18 nt, Human
cccuggugggcggccacc

SEQ ID NO: 341759 - RNA, 20 nt, Human
ccgcaaguccugggaguggg

SEQ ID NO: 341760 - RNA, 20 nt, Human
cuggccugugcagccucagg

SEQ ID NO: 341761 - RNA, 18 nt, Human
cugggacagggccuccuu

SEQ ID NO: 341762 - RNA, 18 nt, Human
gagcccuggccugugcag

SEQ ID NO: 341763 - RNA, 21 nt, Human
gagcccuggccugugcagccu

SEQ ID NO: 341764 - RNA, 22 nt, Human
uccaaaaaggcucagaccgcaa

SEQ ID NO: 341765 - RNA, 22 nt, Human
ugaggccacccacacccaaggg

SEQ ID NO: 341766 - RNA, 24 nt, Human
aaaagaacuuccuaguagcagcca

SEQ ID NO: 341767 - RNA, 18 nt, Human
accauuucccagccuccu

SEQ ID NO: 341768 - RNA, 18 nt, Human
acccucaaccaggccugg

SEQ ID NO: 341769 - RNA, 22 nt, Human
caaaaagaacuuccuaguagca

SEQ ID NO: 341770 - RNA, 25 nt, Human
ccacuccccaccauuucccagccuc

SEQ ID NO: 341771 - RNA, 21 nt, Human
ccccacuccccaccauuuccc

SEQ ID NO: 341772 - RNA, 22 nt, Human
ccccacuccccaccauuuccca

SEQ ID NO: 341773 - RNA, 18 nt, Human
ccuccuguugccccucuc

SEQ ID NO: 341774 - RNA, 18 nt, Human
ccuggcuugggcuucacu

SEQ ID NO: 341775 - RNA, 25 nt, Human
cuaguagcagccagucagcaucuuc

SEQ ID NO: 341776 - RNA, 21 nt, Human
cucaauuuggccucuucuacc

SEQ ID NO: 341777 - RNA, 20 nt, Human
cuggcucauggcucccuucu

SEQ ID NO: 341778 - RNA, 26 nt, Human
cuucuugcagcuggaggaaugggagc

SEQ ID NO: 341779 - RNA, 21 nt, Human
gaaaaggagcguguccucuca

SEQ ID NO: 341780 - RNA, 22 nt, Human
gagcguguccucucaggggcca

SEQ ID NO: 341781 - RNA, 19 nt, Human
gccccacuccccaccauuu

SEQ ID NO: 341782 - RNA, 21 nt, Human
ggaaugggagcucaaaaagaa

SEQ ID NO: 341783 - RNA, 22 nt, Human
ggcuugggcuucacuguaacug

SEQ ID NO: 341784 - RNA, 18 nt, Human
guucccccuauuguaccc

SEQ ID NO: 341785 - RNA, 21 nt, Human
uccccaccauuucccagccuc

SEQ ID NO: 341786 - RNA, 21 nt, Human
ucccuguggagacgcugccug

SEQ ID NO: 341787 - RNA, 24 nt, Human
uccuucuggcucauggcucccuuc

SEQ ID NO: 341788 - RNA, 18 nt, Human
ucucggcuggcgcucgca

SEQ ID NO: 341789 - RNA, 19 nt, Human
ugccuguggaaaggggccu

SEQ ID NO: 341790 - RNA, 20 nt, Human
uggaggaaugggagcucaaa

SEQ ID NO: 341791 - RNA, 20 nt, Human
uggcucccuucuugcagcug

SEQ ID NO: 341792 - RNA, 23 nt, Human
uggcucccuucuugcagcuggag

SEQ ID NO: 341793 - RNA, 18 nt, Human
uggcuugggcuucacugu

SEQ ID NO: 341794 - RNA, 19 nt, Human
uggcuugggcuucacugua

SEQ ID NO: 341795 - RNA, 21 nt, Human
uguugccccucucccugugga

SEQ ID NO: 341796 - RNA, 21 nt, Human
uuuuuuuuuuuagagacagug

SEQ ID NO: 341797 - RNA, 27 nt, Human
uuuuuuuuuuuuagagacaguggcguu

SEQ ID NO: 341798 - RNA, 24 nt, Human
aggaaacuuccagaaaacuugguc

SEQ ID NO: 341799 - RNA, 18 nt, Human
aucaaaucugucucugac

SEQ ID NO: 341800 - RNA, 18 nt, Human
aucaaaucugucucugac

SEQ ID NO: 341801 - RNA, 18 nt, Human
aucaaaucugucucugac

SEQ ID NO: 341802 - RNA, 20 nt, Human
caucaccccucucuccaaca

SEQ ID NO: 341803 - RNA, 23 nt, Human
ccagcaccaggcaucaccccucu

SEQ ID NO: 341804 - RNA, 18 nt, Human
cucugugcagggguucca

SEQ ID NO: 341805 - RNA, 22 nt, Human
uaauaucaaaucugucucugac

SEQ ID NO: 341806 - RNA, 24 nt, Human
uauacauaaggagcuuugcuguca

SEQ ID NO: 341807 - RNA, 21 nt, Human
uccaacagccaaaugaggaaa

SEQ ID NO: 341808 - RNA, 23 nt, Human
ucucuccaacaccuacuugaggg

SEQ ID NO: 341809 - RNA, 25 nt, Human
ugagaggaaguugucuuguuuuuga

SEQ ID NO: 341810 - RNA, 25 nt, Human
ugagaggaaguugucuuguuuuuga

SEQ ID NO: 341811 - RNA, 20 nt, Human
uuccaccagcaccaggcauc

SEQ ID NO: 341812 - RNA, 21 nt, Human
uuccaccagcaccaggcauca

SEQ ID NO: 341813 - RNA, 18 nt, Human
uuccagaaaacuugguca

SEQ ID NO: 341814 - RNA, 19 nt, Human
uucuuggaugcuuuugcuu

SEQ ID NO: 341815 - RNA, 24 nt, Human
uuuaauaucaaaucugucucugac

SEQ ID NO: 341816 - RNA, 24 nt, Human
uuuaauaucaaaucugucucugac

SEQ ID NO: 341817 - RNA, 19 nt, Human
aagaccccaggcagaggca

SEQ ID NO: 341818 - RNA, 20 nt, Human
aagaccccaggcagaggcag

SEQ ID NO: 341819 - RNA, 25 nt, Human
accccaggcagaggcagaacuucug

SEQ ID NO: 341820 - RNA, 20 nt, Human
agagcucagguucacccacc

SEQ ID NO: 341821 - RNA, 18 nt, Human
agggcagggguggaggca

SEQ ID NO: 341822 - RNA, 23 nt, Human
agggcagggguggaggcaccuug

SEQ ID NO: 341823 - RNA, 18 nt, Human
cacccaccaggucccagc

SEQ ID NO: 341824 - RNA, 20 nt, Human
caccuugaggccaagccagc

SEQ ID NO: 341825 - RNA, 21 nt, Human
cagaacccggcuuggaugccc

SEQ ID NO: 341826 - RNA, 20 nt, Human
ccaccaggucccagccccac

SEQ ID NO: 341827 - RNA, 23 nt, Human
ccccugggaugaaggggagggca

SEQ ID NO: 341828 - RNA, 20 nt, Human
cucugggccccaggagaguc

SEQ ID NO: 341829 - RNA, 20 nt, Human
gaaggggagggcaggggugg

SEQ ID NO: 341830 - RNA, 18 nt, Human
gccugcuccucaccugcc

SEQ ID NO: 341831 - RNA, 21 nt, Human
gcucagguucacccaccaggu

SEQ ID NO: 341832 - RNA, 20 nt, Human
gggcagggguggaggcaccu

SEQ ID NO: 341833 - RNA, 21 nt, Human
gggcagggguggaggcaccuu

SEQ ID NO: 341834 - RNA, 21 nt, Human
ggguggaggcaccuugaggcc

SEQ ID NO: 341835 - RNA, 20 nt, Human
gguggaggcaccuugaggcc

SEQ ID NO: 341836 - RNA, 20 nt, Human
gucuguggagccugcuccuc

SEQ ID NO: 341837 - RNA, 22 nt, Human
uagaagagccucauagguggug

SEQ ID NO: 341838 - RNA, 19 nt, Human
ucccagccccacuuugagc

SEQ ID NO: 341839 - RNA, 20 nt, Human
ucucaggcagacccccuggg

SEQ ID NO: 341840 - RNA, 19 nt, Human
ugaaggggagggcaggggu

SEQ ID NO: 341841 - RNA, 20 nt, Human
ugagccuguuuuucuccaau

SEQ ID NO: 341842 - RNA, 26 nt, Human
ugcagccagaacccggcuuggaugcc

SEQ ID NO: 341843 - RNA, 21 nt, Human
ugccacgcacacaacacagag

SEQ ID NO: 341844 - RNA, 18 nt, Human
ugcccacuuuguagcuuc

SEQ ID NO: 341845 - RNA, 25 nt, Human
uuuuuuuuuuuuuuuuuuacaaagg

SEQ ID NO: 341846 - RNA, 22 nt, Human
aaaaaaaaaaaaaaaaaacaag

SEQ ID NO: 341847 - RNA, 20 nt, Human
aaaaaaaaaaaaaaaaacaa

SEQ ID NO: 341848 - RNA, 24 nt, Human
aaaaaaaaaaaaaaaaacaaggaa

SEQ ID NO: 341849 - RNA, 24 nt, Human
aaaaaaaaaaaaaaaaacaaggaa

SEQ ID NO: 341850 - RNA, 25 nt, Human
aaaaaaaaaaaguauaaaaaucuga

SEQ ID NO: 341851 - RNA, 23 nt, Human
aaaaaaaaaguauaaaaaucuga

SEQ ID NO: 341852 - RNA, 22 nt, Human
aaacaaaaagaaccuuggucug

SEQ ID NO: 341853 - RNA, 22 nt, Human
aaacaaaaagaaccuuggucug

SEQ ID NO: 341854 - RNA, 18 nt, Human
aaagcaguuucuaugagc

SEQ ID NO: 341855 - RNA, 18 nt, Human
aaagcaguuucuaugagc

SEQ ID NO: 341856 - RNA, 19 nt, Human
aacauggugaaaccccauc

SEQ ID NO: 341857 - RNA, 19 nt, Human
aacauggugaaaccccauc

SEQ ID NO: 341858 - RNA, 20 nt, Human
aacauggugaaaccccaucu

SEQ ID NO: 341859 - RNA, 20 nt, Human
aacauggugaaaccccaucu

SEQ ID NO: 341860 - RNA, 21 nt, Human
aacauggugaaaccccaucuu

SEQ ID NO: 341861 - RNA, 21 nt, Human
aacauggugaaaccccaucuu

SEQ ID NO: 341862 - RNA, 22 nt, Human
aacauggugaaaccccaucuuu

SEQ ID NO: 341863 - RNA, 23 nt, Human
aacauggugaaaccccaucuuua

SEQ ID NO: 341864 - RNA, 18 nt, Human
aacauggugaaacccugu

SEQ ID NO: 341865 - RNA, 18 nt, Human
aacauggugaaacccugu

SEQ ID NO: 341866 - RNA, 19 nt, Human
aacauggugaaacccuguc

SEQ ID NO: 341867 - RNA, 19 nt, Human
aacauggugaaacccuguc

SEQ ID NO: 341868 - RNA, 24 nt, Human
aauugcuugaaccugggaggcgga

SEQ ID NO: 341869 - RNA, 24 nt, Human
aauugcuugaaccugggaggcgga

SEQ ID NO: 341870 - RNA, 23 nt, Human
acaaaaagaaccuuggucugcca

SEQ ID NO: 341871 - RNA, 23 nt, Human
acaaaaagaaccuuggucugcca

SEQ ID NO: 341872 - RNA, 24 nt, Human
acagaguaagacuacaucucaaaa

SEQ ID NO: 341873 - RNA, 24 nt, Human
acagaguaagacuacaucucaaaa

SEQ ID NO: 341874 - RNA, 24 nt, Human
acagagugagacuccguuucaaaa

SEQ ID NO: 341875 - RNA, 24 nt, Human
acagagugagacuccguuucaaaa

SEQ ID NO: 341876 - RNA, 24 nt, Human
acccaggagguagagguugcagug

SEQ ID NO: 341877 - RNA, 24 nt, Human
accccaucuuuacuaaaaauacaa

SEQ ID NO: 341878 - RNA, 24 nt, Human
accccaucuuuacuaaaaauacaa

SEQ ID NO: 341879 - RNA, 28 nt, Human
acuacaucucaaaaaaaaaaaaaaaaaa

SEQ ID NO: 341880 - RNA, 23 nt, Human
acuccagccuggugacagaguga

SEQ ID NO: 341881 - RNA, 23 nt, Human
acuccagccuggugacagaguga

SEQ ID NO: 341882 - RNA, 23 nt, Human
acugcacuccagccuggugacag

SEQ ID NO: 341883 - RNA, 23 nt, Human
acugcacuccagccuggugacag

SEQ ID NO: 341884 - RNA, 25 nt, Human
acugcacuccagccuggugacagag

SEQ ID NO: 341885 - RNA, 25 nt, Human
acugcacuccagccuggugacagag

SEQ ID NO: 341886 - RNA, 24 nt, Human
acuugaggucaggaguuugagauc

SEQ ID NO: 341887 - RNA, 24 nt, Human
acuugaggucaggaguuugagauc

SEQ ID NO: 341888 - RNA, 18 nt, Human
acuuuggaggcugaggca

SEQ ID NO: 341889 - RNA, 18 nt, Human
acuuuggaggcugaggca

SEQ ID NO: 341890 - RNA, 26 nt, Human
acuuuggaggcugaggcaggagauuu

SEQ ID NO: 341891 - RNA, 26 nt, Human
acuuuggaggcugaggcaggagauuu

SEQ ID NO: 341892 - RNA, 25 nt, Human
agaaaaccgcuuauucauuuuccac

SEQ ID NO: 341893 - RNA, 25 nt, Human
agaaaaccgcuuauucauuuuccac

SEQ ID NO: 341894 - RNA, 19 nt, Human
agaaccuuggucugccaga

SEQ ID NO: 341895 - RNA, 19 nt, Human
agaaccuuggucugccaga

SEQ ID NO: 341896 - RNA, 18 nt, Human
agagguugcagugagcca

SEQ ID NO: 341897 - RNA, 18 nt, Human
agagguugcagugagcca

SEQ ID NO: 341898 - RNA, 20 nt, Human
agagguugcagugagccaag

SEQ ID NO: 341899 - RNA, 20 nt, Human
agagguugcagugagccaag

SEQ ID NO: 341900 - RNA, 22 nt, Human
agagguugcagugagccaagau

SEQ ID NO: 341901 - RNA, 22 nt, Human
agagguugcagugagccaagau

SEQ ID NO: 341902 - RNA, 24 nt, Human
agagguugcagugagccaagaugg

SEQ ID NO: 341903 - RNA, 24 nt, Human
agagguugcagugagccaagaugg

SEQ ID NO: 341904 - RNA, 22 nt, Human
agaucacuugaggucaggaguu

SEQ ID NO: 341905 - RNA, 22 nt, Human
agaucacuugaggucaggaguu

SEQ ID NO: 341906 - RNA, 25 nt, Human
agaucacuugaggucaggaguuuga

SEQ ID NO: 341907 - RNA, 24 nt, Human
agcacuuugggaggccgaggcagg

SEQ ID NO: 341908 - RNA, 24 nt, Human
agcacuuugggaggccgaggcagg

SEQ ID NO: 341909 - RNA, 24 nt, Human
agcacuuugggaggccgaggcggg

SEQ ID NO: 341910 - RNA, 24 nt, Human
agcacuuugggaggccgaggcggg

SEQ ID NO: 341911 - RNA, 22 nt, Human
agccuggccaacauggugaaac

SEQ ID NO: 341912 - RNA, 22 nt, Human
agccuggccaacauggugaaac

SEQ ID NO: 341913 - RNA, 24 nt, Human
agccuggccaacauggugaaaccc

SEQ ID NO: 341914 - RNA, 24 nt, Human
agccuggccaacauggugaaaccc

SEQ ID NO: 341915 - RNA, 22 nt, Human
agccugggugacagaguaagac

SEQ ID NO: 341916 - RNA, 22 nt, Human
agccugggugacagaguaagac

SEQ ID NO: 341917 - RNA, 21 nt, Human
agccuggugacagagugagac

SEQ ID NO: 341918 - RNA, 21 nt, Human
agccuggugacagagugagac

SEQ ID NO: 341919 - RNA, 23 nt, Human
agccuggugacagagugagacuc

SEQ ID NO: 341920 - RNA, 23 nt, Human
agccuggugacagagugagacuc

SEQ ID NO: 341921 - RNA, 18 nt, Human
agcugggugugguagugc

SEQ ID NO: 341922 - RNA, 18 nt, Human
agcugggugugguagugc

SEQ ID NO: 341923 - RNA, 24 nt, Human
aggaaacuuccagaaaacuugguc

SEQ ID NO: 341924 - RNA, 22 nt, Human
aggcaggagaauugcuugaacc

SEQ ID NO: 341925 - RNA, 22 nt, Human
aggcaggagaauugcuugaacc

SEQ ID NO: 341926 - RNA, 24 nt, Human
aggcaggagaauugcuugaaccug

SEQ ID NO: 341927 - RNA, 24 nt, Human
aggcaggagaauugcuugaaccug

SEQ ID NO: 341928 - RNA, 18 nt, Human
aggcaggagauuugcuug

SEQ ID NO: 341929 - RNA, 18 nt, Human
aggcaggagauuugcuug

SEQ ID NO: 341930 - RNA, 24 nt, Human
aggcaggagauuugcuugaaccca

SEQ ID NO: 341931 - RNA, 24 nt, Human
aggcaggagauuugcuugaaccca

SEQ ID NO: 341932 - RNA, 19 nt, Human
aggcaggcugaucaugagg

SEQ ID NO: 341933 - RNA, 19 nt, Human
aggcaggcugaucaugagg

SEQ ID NO: 341934 - RNA, 24 nt, Human
aggcaggcugaucaugaggccaag

SEQ ID NO: 341935 - RNA, 24 nt, Human
aggcaggcugaucaugaggccaag

SEQ ID NO: 341936 - RNA, 20 nt, Human
aggccgaggcaggcugauca

SEQ ID NO: 341937 - RNA, 20 nt, Human
aggccgaggcaggcugauca

SEQ ID NO: 341938 - RNA, 21 nt, Human
aggcggagguugcagugagcc

SEQ ID NO: 341939 - RNA, 24 nt, Human
aggcggagguugcagugagccgag

SEQ ID NO: 341940 - RNA, 24 nt, Human
aggcggagguugcagugagccgag

SEQ ID NO: 341941 - RNA, 21 nt, Human
aggcgggcagaucacuugagg

SEQ ID NO: 341942 - RNA, 22 nt, Human
aggcgggcagaucacuugaggu

SEQ ID NO: 341943 - RNA, 22 nt, Human
aggcgggcagaucacuugaggu

SEQ ID NO: 341944 - RNA, 23 nt, Human
aggcgggcagaucacuugagguc

SEQ ID NO: 341945 - RNA, 23 nt, Human
aggcgggcagaucacuugagguc

SEQ ID NO: 341946 - RNA, 26 nt, Human
aggcgggcagaucacuugaggucagg

SEQ ID NO: 341947 - RNA, 26 nt, Human
aggcgggcagaucacuugaggucagg

SEQ ID NO: 341948 - RNA, 21 nt, Human
aggcugaggcaggagaauugc

SEQ ID NO: 341949 - RNA, 21 nt, Human
aggcugaggcaggagaauugc

SEQ ID NO: 341950 - RNA, 24 nt, Human
aggcugaggcaggagaauugcuug

SEQ ID NO: 341951 - RNA, 24 nt, Human
aggcugaggcaggagaauugcuug

SEQ ID NO: 341952 - RNA, 24 nt, Human
aggcugaggcaggagauuugcuug

SEQ ID NO: 341953 - RNA, 24 nt, Human
aggcugaggcaggagauuugcuug

SEQ ID NO: 341954 - RNA, 24 nt, Human
agguagagguugcagugagccaag

SEQ ID NO: 341955 - RNA, 24 nt, Human
agguagagguugcagugagccaag

SEQ ID NO: 341956 - RNA, 22 nt, Human
aguggcucaggccugugguucc

SEQ ID NO: 341957 - RNA, 22 nt, Human
aguggcucaggccugugguucc

SEQ ID NO: 341958 - RNA, 24 nt, Human
aguggcucaggccugugguuccag

SEQ ID NO: 341959 - RNA, 24 nt, Human
aguggcucaggccugugguuccag

SEQ ID NO: 341960 - RNA, 20 nt, Human
aucacuugaggucaggaguu

SEQ ID NO: 341961 - RNA, 24 nt, Human
aucacuugaggucaggaguuugag

SEQ ID NO: 341962 - RNA, 18 nt, Human
auugcacucuagccuggg

SEQ ID NO: 341963 - RNA, 21 nt, Human
auugcacucuagccuggguga

SEQ ID NO: 341964 - RNA, 24 nt, Human
auugcacucuagccugggugacag

SEQ ID NO: 341965 - RNA, 24 nt, Human
auugcacucuagccugggugacag

SEQ ID NO: 341966 - RNA, 24 nt, Human
auugcggcacugcacuccagccug

SEQ ID NO: 341967 - RNA, 24 nt, Human
auugcggcacugcacuccagccug

SEQ ID NO: 341968 - RNA, 26 nt, Human
caaaacaccaaaugguauucaaaaag

SEQ ID NO: 341969 - RNA, 26 nt, Human
caaaacaccaaaugguauucaaaaag

SEQ ID NO: 341970 - RNA, 21 nt, Human
caacauggugaaaccccaucu

SEQ ID NO: 341971 - RNA, 21 nt, Human
caacauggugaaaccccaucu

SEQ ID NO: 341972 - RNA, 24 nt, Human
caacauggugaaaccccaucuuua

SEQ ID NO: 341973 - RNA, 18 nt, Human
caacauggugaaacccug

SEQ ID NO: 341974 - RNA, 24 nt, Human
cacaccuguaaucccagcacuuug

SEQ ID NO: 341975 - RNA, 24 nt, Human
cacaccuguaaucccagcacuuug

SEQ ID NO: 341976 - RNA, 19 nt, Human
caccuguaaucccagcacu

SEQ ID NO: 341977 - RNA, 23 nt, Human
caccuguaaucccagcacuuugg

SEQ ID NO: 341978 - RNA, 24 nt, Human
caccuguaaucccagcacuuuggg

SEQ ID NO: 341979 - RNA, 24 nt, Human
caccuguaaucccagcacuuuggg

SEQ ID NO: 341980 - RNA, 21 nt, Human
cacuccagccuggugacagag

SEQ ID NO: 341981 - RNA, 21 nt, Human
cacuccagccuggugacagag

SEQ ID NO: 341982 - RNA, 23 nt, Human
cacuccagccuggugacagagug

SEQ ID NO: 341983 - RNA, 23 nt, Human
cacuccagccuggugacagagug

SEQ ID NO: 341984 - RNA, 22 nt, Human
cacucuagccugggugacagag

SEQ ID NO: 341985 - RNA, 22 nt, Human
cacucuagccugggugacagag

SEQ ID NO: 341986 - RNA, 22 nt, Human
cacucuagccugggugacagag

SEQ ID NO: 341987 - RNA, 22 nt, Human
cacucuagccugggugacagag

SEQ ID NO: 341988 - RNA, 18 nt, Human
cacugcacuccagccugg

SEQ ID NO: 341989 - RNA, 18 nt, Human
cacugcacuccagccugg

SEQ ID NO: 341990 - RNA, 18 nt, Human
cacugcacuccagccugg

SEQ ID NO: 341991 - RNA, 18 nt, Human
cacugcacuccagccugg

SEQ ID NO: 341992 - RNA, 18 nt, Human
cacugcacuccagccugg

SEQ ID NO: 341993 - RNA, 18 nt, Human
cacugcacuccagccugg

SEQ ID NO: 341994 - RNA, 20 nt, Human
cacugcacuccagccuggug

SEQ ID NO: 341995 - RNA, 22 nt, Human
cacugcacuccagccuggugac

SEQ ID NO: 341996 - RNA, 22 nt, Human
cacugcacuccagccuggugac

SEQ ID NO: 341997 - RNA, 23 nt, Human
cacugcacuccagccuggugaca

SEQ ID NO: 341998 - RNA, 23 nt, Human
cacugcacuccagccuggugaca

SEQ ID NO: 341999 - RNA, 23 nt, Human
cacugcacuccagccuggugaca

SEQ ID NO: 342000 - RNA, 24 nt, Human
cacugcacuccagccuggugacag

SEQ ID NO: 342001 - RNA, 23 nt, Human
cacuugaggucaggaguuugaga

SEQ ID NO: 342002 - RNA, 23 nt, Human
cacuugaggucaggaguuugaga

SEQ ID NO: 342003 - RNA, 23 nt, Human
cacuuguaaucccagcuacucgg

SEQ ID NO: 342004 - RNA, 23 nt, Human
cacuuguaaucccagcuacucgg

SEQ ID NO: 342005 - RNA, 24 nt, Human
cacuuguaaucccagcuacucggg

SEQ ID NO: 342006 - RNA, 24 nt, Human
cacuuguaaucccagcuacucggg

SEQ ID NO: 342007 - RNA, 24 nt, Human
cagaucacuugaggucaggaguuu

SEQ ID NO: 342008 - RNA, 24 nt, Human
cagaucacuugaggucaggaguuu

SEQ ID NO: 342009 - RNA, 27 nt, Human
cagaucacuugaggucaggaguuugag

SEQ ID NO: 342010 - RNA, 22 nt, Human
cagcacuuugggaggccgaggc

SEQ ID NO: 342011 - RNA, 24 nt, Human
cagcacuuugggaggccgaggcag

SEQ ID NO: 342012 - RNA, 24 nt, Human
cagcacuuugggaggccgaggcag

SEQ ID NO: 342013 - RNA, 25 nt, Human
cagcacuuugggaggccgaggcagg

SEQ ID NO: 342014 - RNA, 25 nt, Human
cagcacuuugggaggccgaggcagg

SEQ ID NO: 342015 - RNA, 24 nt, Human
cagcacuuugggaggccgaggcgg

SEQ ID NO: 342016 - RNA, 24 nt, Human
cagcacuuugggaggccgaggcgg

SEQ ID NO: 342017 - RNA, 24 nt, Human
cagcuacucgggaggcugaggcag

SEQ ID NO: 342018 - RNA, 24 nt, Human
cagcuacucgggaggcugaggcag

SEQ ID NO: 342019 - RNA, 24 nt, Human
caggccugugguuccagcacuuug

SEQ ID NO: 342020 - RNA, 24 nt, Human
caucucaaaaaaaaaaaaaaaaaa

SEQ ID NO: 342021 - RNA, 19 nt, Human
cauugcacucuagccuggg

SEQ ID NO: 342022 - RNA, 19 nt, Human
cauugcacucuagccuggg

SEQ ID NO: 342023 - RNA, 21 nt, Human
cauugcacucuagccugggug

SEQ ID NO: 342024 - RNA, 21 nt, Human
cauugcacucuagccugggug

SEQ ID NO: 342025 - RNA, 22 nt, Human
cauugcacucuagccuggguga

SEQ ID NO: 342026 - RNA, 22 nt, Human
cauugcacucuagccuggguga

SEQ ID NO: 342027 - RNA, 24 nt, Human
cauugcacucuagccugggugaca

SEQ ID NO: 342028 - RNA, 24 nt, Human
cauugcacucuagccugggugaca

SEQ ID NO: 342029 - RNA, 24 nt, Human
cauugcacucuagccugggugaca

SEQ ID NO: 342030 - RNA, 24 nt, Human
cauugcacucuagccugggugaca

SEQ ID NO: 342031 - RNA, 21 nt, Human
ccaacauggugaaacccuguc

SEQ ID NO: 342032 - RNA, 21 nt, Human
ccaacauggugaaacccuguc

SEQ ID NO: 342033 - RNA, 22 nt, Human
ccaggagguagagguugcagug

SEQ ID NO: 342034 - RNA, 20 nt, Human
ccauugcacucuagccuggg

SEQ ID NO: 342035 - RNA, 20 nt, Human
ccauugcacucuagccuggg

SEQ ID NO: 342036 - RNA, 21 nt, Human
ccauugcacucuagccugggu

SEQ ID NO: 342037 - RNA, 21 nt, Human
ccauugcacucuagccugggu

SEQ ID NO: 342038 - RNA, 21 nt, Human
ccauugcacucuagccugggu

SEQ ID NO: 342039 - RNA, 21 nt, Human
ccauugcacucuagccugggu

SEQ ID NO: 342040 - RNA, 22 nt, Human
ccauugcacucuagccugggug

SEQ ID NO: 342041 - RNA, 22 nt, Human
ccauugcacucuagccugggug

SEQ ID NO: 342042 - RNA, 23 nt, Human
ccauugcacucuagccuggguga

SEQ ID NO: 342043 - RNA, 23 nt, Human
ccauugcacucuagccuggguga

SEQ ID NO: 342044 - RNA, 24 nt, Human
ccauugcacucuagccugggugac

SEQ ID NO: 342045 - RNA, 24 nt, Human
ccauugcacucuagccugggugac

SEQ ID NO: 342046 - RNA, 22 nt, Human
ccuagccaacauggugaaaccc

SEQ ID NO: 342047 - RNA, 22 nt, Human
ccuagccaacauggugaaaccc

SEQ ID NO: 342048 - RNA, 22 nt, Human
ccuagccaacauggugaaaccc

SEQ ID NO: 342049 - RNA, 22 nt, Human
ccuagccaacauggugaaaccc

SEQ ID NO: 342050 - RNA, 24 nt, Human
ccuagccaacauggugaaacccug

SEQ ID NO: 342051 - RNA, 24 nt, Human
ccuagccaacauggugaaacccug

SEQ ID NO: 342052 - RNA, 23 nt, Human
ccuggccaacauggugaaacccc

SEQ ID NO: 342053 - RNA, 23 nt, Human
ccuggccaacauggugaaacccc

SEQ ID NO: 342054 - RNA, 24 nt, Human
ccuggccaacauggugaaacccca

SEQ ID NO: 342055 - RNA, 24 nt, Human
ccuggccaacauggugaaacccca

SEQ ID NO: 342056 - RNA, 19 nt, Human
ccugggaggcggagguugc

SEQ ID NO: 342057 - RNA, 20 nt, Human
ccugggugacagaguaagac

SEQ ID NO: 342058 - RNA, 20 nt, Human
ccugggugacagaguaagac

SEQ ID NO: 342059 - RNA, 21 nt, Human
ccuggugacagagugagacuc

SEQ ID NO: 342060 - RNA, 21 nt, Human
ccuggugacagagugagacuc

SEQ ID NO: 342061 - RNA, 18 nt, Human
ccuguaaucccagcuacu

SEQ ID NO: 342062 - RNA, 21 nt, Human
ccuguaaucccagcuacuuug

SEQ ID NO: 342063 - RNA, 22 nt, Human
ccuguaaucccagcuacuuugg

SEQ ID NO: 342064 - RNA, 22 nt, Human
ccuguaaucccagcuacuuugg

SEQ ID NO: 342065 - RNA, 20 nt, Human
ccugugguuccagcacuuug

SEQ ID NO: 342066 - RNA, 24 nt, Human
cgagauugcggcacugcacuccag

SEQ ID NO: 342067 - RNA, 24 nt, Human
cgagauugcggcacugcacuccag

SEQ ID NO: 342068 - RNA, 24 nt, Human
cgaggcaggcugaucaugaggcca

SEQ ID NO: 342069 - RNA, 24 nt, Human
cgaggcaggcugaucaugaggcca

SEQ ID NO: 342070 - RNA, 24 nt, Human
cgaggcgggcagaucacuugaggu

SEQ ID NO: 342071 - RNA, 24 nt, Human
cgaggcgggcagaucacuugaggu

SEQ ID NO: 342072 - RNA, 26 nt, Human
cgaggcgggcagaucacuugagguca

SEQ ID NO: 342073 - RNA, 26 nt, Human
cgaggcgggcagaucacuugagguca

SEQ ID NO: 342074 - RNA, 19 nt, Human
cgcacuuguaaucccagcu

SEQ ID NO: 342075 - RNA, 24 nt, Human
cgggcagaucacuugaggucagga

SEQ ID NO: 342076 - RNA, 24 nt, Human
cgggcagaucacuugaggucagga

SEQ ID NO: 342077 - RNA, 24 nt, Human
cuacaucucaaaaaaaaaaaaaaa

SEQ ID NO: 342078 - RNA, 24 nt, Human
cuacaucucaaaaaaaaaaaaaaa

SEQ ID NO: 342079 - RNA, 18 nt, Human
cucaaaaaaaaaaaaaaa

SEQ ID NO: 342080 - RNA, 18 nt, Human
cucaaaaaaaaaaaaaaa

SEQ ID NO: 342081 - RNA, 23 nt, Human
cucaaaaaaaaaaaaaaaaaaaa

SEQ ID NO: 342082 - RNA, 22 nt, Human
cucacaccuguaaucccagcac

SEQ ID NO: 342083 - RNA, 22 nt, Human
cucacaccuguaaucccagcac

SEQ ID NO: 342084 - RNA, 24 nt, Human
cucacaccuguaaucccagcacuu

SEQ ID NO: 342085 - RNA, 24 nt, Human
cucacaccuguaaucccagcacuu

SEQ ID NO: 342086 - RNA, 22 nt, Human
cucaggccugugguuccagcac

SEQ ID NO: 342087 - RNA, 22 nt, Human
cucaggccugugguuccagcac

SEQ ID NO: 342088 - RNA, 24 nt, Human
cucaggccugugguuccagcacuu

SEQ ID NO: 342089 - RNA, 24 nt, Human
cucaggccugugguuccagcacuu

SEQ ID NO: 342090 - RNA, 18 nt, Human
cucugugcagggguucca

SEQ ID NO: 342091 - RNA, 23 nt, Human
cuggccaacauggugaaacccca

SEQ ID NO: 342092 - RNA, 23 nt, Human
cuggccaacauggugaaacccca

SEQ ID NO: 342093 - RNA, 19 nt, Human
cuugaaccugggaggcgga

SEQ ID NO: 342094 - RNA, 21 nt, Human
cuuguaaucccagcuacucgg

SEQ ID NO: 342095 - RNA, 21 nt, Human
cuuguaaucccagcuacucgg

SEQ ID NO: 342096 - RNA, 18 nt, Human
gaaucacaagcacugcca

SEQ ID NO: 342097 - RNA, 18 nt, Human
gaaucacaagcacugcca

SEQ ID NO: 342098 - RNA, 24 nt, Human
gacagagugagacuccguuucaaa

SEQ ID NO: 342099 - RNA, 24 nt, Human
gacagagugagacuccguuucaaa

SEQ ID NO: 342100 - RNA, 23 nt, Human
gagaauugcuugaaccugggagg

SEQ ID NO: 342101 - RNA, 23 nt, Human
gagaauugcuugaaccugggagg

SEQ ID NO: 342102 - RNA, 23 nt, Human
gagaucagccuggccaacauggu

SEQ ID NO: 342103 - RNA, 23 nt, Human
gagcauuuaaacacugccacacg

SEQ ID NO: 342104 - RNA, 23 nt, Human
gagcauuuaaacacugccacacg

SEQ ID NO: 342105 - RNA, 18 nt, Human
gagguugcagugagccaa

SEQ ID NO: 342106 - RNA, 21 nt, Human
gagguugcagugagccgagau

SEQ ID NO: 342107 - RNA, 21 nt, Human
gagguugcagugagccgagau

SEQ ID NO: 342108 - RNA, 23 nt, Human
gagguugcagugagccgagauug

SEQ ID NO: 342109 - RNA, 23 nt, Human
gagguugcagugagccgagauug

SEQ ID NO: 342110 - RNA, 24 nt, Human
gaucacuugaggucaggaguuuga

SEQ ID NO: 342111 - RNA, 24 nt, Human
gaucacuugaggucaggaguuuga

SEQ ID NO: 342112 - RNA, 22 nt, Human
gcacuccagccuggugacagag

SEQ ID NO: 342113 - RNA, 23 nt, Human
gcacuccagccuggugacagagu

SEQ ID NO: 342114 - RNA, 23 nt, Human
gcacuccagccuggugacagagu

SEQ ID NO: 342115 - RNA, 23 nt, Human
gcacucuagccugggugacagag

SEQ ID NO: 342116 - RNA, 24 nt, Human
gcacucuagccugggugacagagu

SEQ ID NO: 342117 - RNA, 20 nt, Human
gcacugcacuccagccuggu

SEQ ID NO: 342118 - RNA, 20 nt, Human
gcacugcacuccagccuggu

SEQ ID NO: 342119 - RNA, 23 nt, Human
gcacugcacuccagccuggugac

SEQ ID NO: 342120 - RNA, 22 nt, Human
gcaggagauuugcuugaaccca

SEQ ID NO: 342121 - RNA, 22 nt, Human
gcaggagauuugcuugaaccca

SEQ ID NO: 342122 - RNA, 20 nt, Human
gcagucaugucaaagcaguu

SEQ ID NO: 342123 - RNA, 20 nt, Human
gcagucaugucaaagcaguu

SEQ ID NO: 342124 - RNA, 23 nt, Human
gccaacauggugaaaccccaucu

SEQ ID NO: 342125 - RNA, 23 nt, Human
gccaacauggugaaaccccaucu

SEQ ID NO: 342126 - RNA, 22 nt, Human
gccaacauggugaaacccuguc

SEQ ID NO: 342127 - RNA, 22 nt, Human
gccaacauggugaaacccuguc

SEQ ID NO: 342128 - RNA, 24 nt, Human
gccauugcacucuagccuggguga

SEQ ID NO: 342129 - RNA, 24 nt, Human
gccauugcacucuagccuggguga

SEQ ID NO: 342130 - RNA, 24 nt, Human
gccugugguuccagcacuuuggga

SEQ ID NO: 342131 - RNA, 24 nt, Human
gccugugguuccagcacuuuggga

SEQ ID NO: 342132 - RNA, 18 nt, Human
gcgcacuuguaaucccag

SEQ ID NO: 342133 - RNA, 18 nt, Human
gcgcacuuguaaucccag

SEQ ID NO: 342134 - RNA, 21 nt, Human
gcggcacugcacuccagccug

SEQ ID NO: 342135 - RNA, 21 nt, Human
gcggcacugcacuccagccug

SEQ ID NO: 342136 - RNA, 22 nt, Human
ggagguagagguugcagugagc

SEQ ID NO: 342137 - RNA, 22 nt, Human
ggagguagagguugcagugagc

SEQ ID NO: 342138 - RNA, 22 nt, Human
ggagguugcagugagccgagau

SEQ ID NO: 342139 - RNA, 22 nt, Human
ggagguugcagugagccgagau

SEQ ID NO: 342140 - RNA, 24 nt, Human
ggagguugcagugagccgagauug

SEQ ID NO: 342141 - RNA, 24 nt, Human
ggagguugcagugagccgagauug

SEQ ID NO: 342142 - RNA, 23 nt, Human
ggcacgguggcucacaccuguaa

SEQ ID NO: 342143 - RNA, 25 nt, Human
ggcagaucacuugaggucaggaguu

SEQ ID NO: 342144 - RNA, 25 nt, Human
ggcagaucacuugaggucaggaguu

SEQ ID NO: 342145 - RNA, 24 nt, Human
gggcacaguggcucaggccugugg

SEQ ID NO: 342146 - RNA, 24 nt, Human
gggcacaguggcucaggccugugg

SEQ ID NO: 342147 - RNA, 24 nt, Human
gggcacgguggcucacaccuguaa

SEQ ID NO: 342148 - RNA, 24 nt, Human
gguagugcgcacuuguaaucccag

SEQ ID NO: 342149 - RNA, 24 nt, Human
gguagugcgcacuuguaaucccag

SEQ ID NO: 342150 - RNA, 19 nt, Human
ggucaggaguuugagauca

SEQ ID NO: 342151 - RNA, 19 nt, Human
ggucaggaguuugagauca

SEQ ID NO: 342152 - RNA, 25 nt, Human
ggugccuguaaucccagcuacuuug

SEQ ID NO: 342153 - RNA, 23 nt, Human
gguggcucacaccuguaauccca

SEQ ID NO: 342154 - RNA, 23 nt, Human
gguggcucacaccuguaauccca

SEQ ID NO: 342155 - RNA, 24 nt, Human
gguggcucacaccuguaaucccag

SEQ ID NO: 342156 - RNA, 24 nt, Human
gguggcucacaccuguaaucccag

SEQ ID NO: 342157 - RNA, 19 nt, Human
gguuccagcacuuugggag

SEQ ID NO: 342158 - RNA, 23 nt, Human
guggugggugccuguaaucccag

SEQ ID NO: 342159 - RNA, 21 nt, Human
gugguuccagcacuuugggag

SEQ ID NO: 342160 - RNA, 19 nt, Human
guugcagugagccgagauu

SEQ ID NO: 342161 - RNA, 19 nt, Human
guugcagugagccgagauu

SEQ ID NO: 342162 - RNA, 21 nt, Human
guugcagugagccgagauugc

SEQ ID NO: 342163 - RNA, 18 nt, Human
uacuaaaaauacaaaaaa

SEQ ID NO: 342164 - RNA, 18 nt, Human
uacuaaaaauacaaaaaa

SEQ ID NO: 342165 - RNA, 23 nt, Human
uagccaacauggugaaacccugu

SEQ ID NO: 342166 - RNA, 23 nt, Human
uagccaacauggugaaacccugu

SEQ ID NO: 342167 - RNA, 21 nt, Human
uagccagauguggugggugcc

SEQ ID NO: 342168 - RNA, 23 nt, Human
uaggcugggcacgguggcucaca

SEQ ID NO: 342169 - RNA, 23 nt, Human
uaggcugggcacgguggcucaca

SEQ ID NO: 342170 - RNA, 19 nt, Human
uauguaaacaaaaagaacc

SEQ ID NO: 342171 - RNA, 21 nt, Human
uauguaaacaaaaagaaccuu

SEQ ID NO: 342172 - RNA, 22 nt, Human
uauguguuucuuaagcaaugga

SEQ ID NO: 342173 - RNA, 22 nt, Human
uauguguuucuuaagcaaugga

SEQ ID NO: 342174 - RNA, 22 nt, Human
ucaaaaaaaaaaaaaaaaaaaa

SEQ ID NO: 342175 - RNA, 23 nt, Human
ucaaaaaaaaaaaaaaaaaaaaa

SEQ ID NO: 342176 - RNA, 23 nt, Human
ucaaaaaaaaaaaaaaaaaaaaa

SEQ ID NO: 342177 - RNA, 22 nt, Human
ucaaaacaccaaaugguauuca

SEQ ID NO: 342178 - RNA, 22 nt, Human
ucaaaacaccaaaugguauuca

SEQ ID NO: 342179 - RNA, 19 nt, Human
ucacuugaggucaggaguu

SEQ ID NO: 342180 - RNA, 22 nt, Human
ucaggccugugguuccagcacu

SEQ ID NO: 342181 - RNA, 22 nt, Human
ucaggccugugguuccagcacu

SEQ ID NO: 342182 - RNA, 21 nt, Human
uccaacagccaaaugaggaaa

SEQ ID NO: 342183 - RNA, 22 nt, Human
uccagccuggugacagagugag

SEQ ID NO: 342184 - RNA, 22 nt, Human
uccagccuggugacagagugag

SEQ ID NO: 342185 - RNA, 23 nt, Human
uccagccuggugacagagugaga

SEQ ID NO: 342186 - RNA, 23 nt, Human
uccagccuggugacagagugaga

SEQ ID NO: 342187 - RNA, 22 nt, Human
uccccuuggucucaauggaagc

SEQ ID NO: 342188 - RNA, 22 nt, Human
uccccuuggucucaauggaagc

SEQ ID NO: 342189 - RNA, 23 nt, Human
ucgggaggcugaggcaggagaau

SEQ ID NO: 342190 - RNA, 23 nt, Human
ucgggaggcugaggcaggagaau

SEQ ID NO: 342191 - RNA, 24 nt, Human
ucuagccugggugacagaguaaga

SEQ ID NO: 342192 - RNA, 24 nt, Human
ucuagccugggugacagaguaaga

SEQ ID NO: 342193 - RNA, 19 nt, Human
ucucaaaaaaaaaaaaaaa

SEQ ID NO: 342194 - RNA, 19 nt, Human
ucucaaaaaaaaaaaaaaa

SEQ ID NO: 342195 - RNA, 19 nt, Human
ugaaaccccaucuuuacua

SEQ ID NO: 342196 - RNA, 19 nt, Human
ugaaaccccaucuuuacua

SEQ ID NO: 342197 - RNA, 24 nt, Human
ugaaacuauccuagccaacauggu

SEQ ID NO: 342198 - RNA, 24 nt, Human
ugaaacuauccuagccaacauggu

SEQ ID NO: 342199 - RNA, 24 nt, Human
ugaaccugggaggcggagguugca

SEQ ID NO: 342200 - RNA, 24 nt, Human
ugaaccugggaggcggagguugca

SEQ ID NO: 342201 - RNA, 19 nt, Human
ugaagcacaugauugcagu

SEQ ID NO: 342202 - RNA, 19 nt, Human
ugaagcacaugauugcagu

SEQ ID NO: 342203 - RNA, 24 nt, Human
ugaccaccaucauauaugcagucu

SEQ ID NO: 342204 - RNA, 24 nt, Human
ugaccaccaucauauaugcagucu

SEQ ID NO: 342205 - RNA, 22 nt, Human
ugacuaaaugguguuuaugugu

SEQ ID NO: 342206 - RNA, 22 nt, Human
ugacuaaaugguguuuaugugu

SEQ ID NO: 342207 - RNA, 25 nt, Human
ugagaggaaguugucuuguuuuuga

SEQ ID NO: 342208 - RNA, 25 nt, Human
ugagaggaaguugucuuguuuuuga

SEQ ID NO: 342209 - RNA, 23 nt, Human
ugagaucagccuggccaacaugg

SEQ ID NO: 342210 - RNA, 23 nt, Human
ugagaucagccuggccaacaugg

SEQ ID NO: 342211 - RNA, 24 nt, Human
ugagaucagccuggccaacauggu

SEQ ID NO: 342212 - RNA, 18 nt, Human
ugagcacacuguuaucug

SEQ ID NO: 342213 - RNA, 18 nt, Human
ugagcacacuguuaucug

SEQ ID NO: 342214 - RNA, 22 nt, Human
ugagccgagauugcggcacugc

SEQ ID NO: 342215 - RNA, 22 nt, Human
ugagccgagauugcggcacugc

SEQ ID NO: 342216 - RNA, 24 nt, Human
ugaggcaggagaauugcuugaacc

SEQ ID NO: 342217 - RNA, 24 nt, Human
ugaggcaggagaauugcuugaacc

SEQ ID NO: 342218 - RNA, 24 nt, Human
ugaggcaggagaauugcuugaacc

SEQ ID NO: 342219 - RNA, 25 nt, Human
ugaggcaggagaauugcuugaaccu

SEQ ID NO: 342220 - RNA, 24 nt, Human
ugaggcaggagauuugcuugaacc

SEQ ID NO: 342221 - RNA, 24 nt, Human
ugaggcaggagauuugcuugaacc

SEQ ID NO: 342222 - RNA, 25 nt, Human
ugaggcaggagauuugcuugaaccc

SEQ ID NO: 342223 - RNA, 25 nt, Human
ugaggcaggagauuugcuugaaccc

SEQ ID NO: 342224 - RNA, 18 nt, Human
ugaggucaggaguuugag

SEQ ID NO: 342225 - RNA, 18 nt, Human
ugaggucaggaguuugag

SEQ ID NO: 342226 - RNA, 24 nt, Human
ugcacucuagccugggugacagag

SEQ ID NO: 342227 - RNA, 24 nt, Human
ugcacucuagccugggugacagag

SEQ ID NO: 342228 - RNA, 20 nt, Human
ugccagaauuuucaaagaaa

SEQ ID NO: 342229 - RNA, 20 nt, Human
ugccagaauuuucaaagaaa

SEQ ID NO: 342230 - RNA, 19 nt, Human
ugccuguaaucccagcuac

SEQ ID NO: 342231 - RNA, 19 nt, Human
ugccuguaaucccagcuac

SEQ ID NO: 342232 - RNA, 24 nt, Human
ugccuguaaucccagcuacuuugg

SEQ ID NO: 342233 - RNA, 21 nt, Human
ugcuugaaccugggaggcgga

SEQ ID NO: 342234 - RNA, 19 nt, Human
uggcaaagugugacacaua

SEQ ID NO: 342235 - RNA, 19 nt, Human
uggcaaagugugacacaua

SEQ ID NO: 342236 - RNA, 24 nt, Human
uggccaacauggugaaaccccauc

SEQ ID NO: 342237 - RNA, 24 nt, Human
uggccaacauggugaaaccccauc

SEQ ID NO: 342238 - RNA, 21 nt, Human
uggcucacaccuguaauccca

SEQ ID NO: 342239 - RNA, 21 nt, Human
uggcucacaccuguaauccca

SEQ ID NO: 342240 - RNA, 22 nt, Human
uggcucacaccuguaaucccag

SEQ ID NO: 342241 - RNA, 22 nt, Human
uggcucacaccuguaaucccag

SEQ ID NO: 342242 - RNA, 24 nt, Human
uggcucacaccuguaaucccagca

SEQ ID NO: 342243 - RNA, 24 nt, Human
uggcucacaccuguaaucccagca

SEQ ID NO: 342244 - RNA, 20 nt, Human
ugggaggccgaggcaggcug

SEQ ID NO: 342245 - RNA, 20 nt, Human
ugggaggccgaggcaggcug

SEQ ID NO: 342246 - RNA, 24 nt, Human
ugggaggccgaggcaggcugauca

SEQ ID NO: 342247 - RNA, 24 nt, Human
ugggaggccgaggcaggcugauca

SEQ ID NO: 342248 - RNA, 19 nt, Human
ugggaggccgaggcgggca

SEQ ID NO: 342249 - RNA, 20 nt, Human
ugggaggccgaggcgggcag

SEQ ID NO: 342250 - RNA, 20 nt, Human
ugggaggccgaggcgggcag

SEQ ID NO: 342251 - RNA, 24 nt, Human
ugggaggccgaggcgggcagauca

SEQ ID NO: 342252 - RNA, 24 nt, Human
ugggaggccgaggcgggcagauca

SEQ ID NO: 342253 - RNA, 29 nt, Human
ugggaggcggagguugcagugacaacggu

SEQ ID NO: 342254 - RNA, 29 nt, Human
ugggaggcggagguugcagugacaacggu

SEQ ID NO: 342255 - RNA, 24 nt, Human
ugggaggcggagguugcagugagc

SEQ ID NO: 342256 - RNA, 24 nt, Human
ugggaggcggagguugcagugagc

SEQ ID NO: 342257 - RNA, 24 nt, Human
ugguagugcgcacuuguaauccca

SEQ ID NO: 342258 - RNA, 24 nt, Human
ugguagugcgcacuuguaauccca

SEQ ID NO: 342259 - RNA, 21 nt, Human
uggugggugccuguaauccca

SEQ ID NO: 342260 - RNA, 21 nt, Human
uggugggugccuguaauccca

SEQ ID NO: 342261 - RNA, 22 nt, Human
uggugggugccuguaaucccag

SEQ ID NO: 342262 - RNA, 24 nt, Human
uggugggugccuguaaucccagcu

SEQ ID NO: 342263 - RNA, 24 nt, Human
uggugggugccuguaaucccagcu

SEQ ID NO: 342264 - RNA, 23 nt, Human
ugguguuuauguguuucuuaagc

SEQ ID NO: 342265 - RNA, 23 nt, Human
ugguguuuauguguuucuuaagc

SEQ ID NO: 342266 - RNA, 20 nt, Human
uguaaucccagcuacucggg

SEQ ID NO: 342267 - RNA, 24 nt, Human
uguggugggugccuguaaucccag

SEQ ID NO: 342268 - RNA, 24 nt, Human
uguggugggugccuguaaucccag

SEQ ID NO: 342269 - RNA, 21 nt, Human
uguuucuuaagcaauggaguu

SEQ ID NO: 342270 - RNA, 21 nt, Human
uguuucuuaagcaauggaguu

SEQ ID NO: 342271 - RNA, 23 nt, Human
uuacuggaugaccaccaucauau

SEQ ID NO: 342272 - RNA, 23 nt, Human
uuacuggaugaccaccaucauau

SEQ ID NO: 342273 - RNA, 21 nt, Human
uuagccagauguggugggugc

SEQ ID NO: 342274 - RNA, 21 nt, Human
uuagccagauguggugggugc

SEQ ID NO: 342275 - RNA, 22 nt, Human
uuagccagauguggugggugcc

SEQ ID NO: 342276 - RNA, 22 nt, Human
uuagccagauguggugggugcc

SEQ ID NO: 342277 - RNA, 20 nt, Human
uuagcugggugugguagugc

SEQ ID NO: 342278 - RNA, 20 nt, Human
uuagcugggugugguagugc

SEQ ID NO: 342279 - RNA, 20 nt, Human
uuagcugggugugguagugc

SEQ ID NO: 342280 - RNA, 20 nt, Human
uuagcugggugugguagugc

SEQ ID NO: 342281 - RNA, 18 nt, Human
uuccagaaaacuugguca

SEQ ID NO: 342282 - RNA, 19 nt, Human
uucuuggaugcuuuugcuu

SEQ ID NO: 342283 - RNA, 24 nt, Human
uugaaccugggaggcggagguugc

SEQ ID NO: 342284 - RNA, 24 nt, Human
uugaaccugggaggcggagguugc

SEQ ID NO: 342285 - RNA, 22 nt, Human
uugcagugagccaagauggugc

SEQ ID NO: 342286 - RNA, 22 nt, Human
uugcagugagccaagauggugc

SEQ ID NO: 342287 - RNA, 18 nt, Human
uugcagugagccgagauu

SEQ ID NO: 342288 - RNA, 19 nt, Human
uugcagugagccgagauug

SEQ ID NO: 342289 - RNA, 19 nt, Human
uugcagugagccgagauug

SEQ ID NO: 342290 - RNA, 20 nt, Human
uugcagugagccgagauugc

SEQ ID NO: 342291 - RNA, 20 nt, Human
uugcagugagccgagauugc

SEQ ID NO: 342292 - RNA, 24 nt, Human
uugcuugaacccaggagguagagg

SEQ ID NO: 342293 - RNA, 24 nt, Human
uugcuugaacccaggagguagagg

SEQ ID NO: 342294 - RNA, 24 nt, Human
uugcuugaaccugggaggcggagg

SEQ ID NO: 342295 - RNA, 24 nt, Human
uugcuugaaccugggaggcggagg

SEQ ID NO: 342296 - RNA, 25 nt, Human
uugggaggccgaggcaggcugauca

SEQ ID NO: 342297 - RNA, 25 nt, Human
uugggaggccgaggcaggcugauca

SEQ ID NO: 342298 - RNA, 25 nt, Human
uugggaggccgaggcgggcagauca

SEQ ID NO: 342299 - RNA, 25 nt, Human
uugggaggccgaggcgggcagauca

SEQ ID NO: 342300 - RNA, 21 nt, Human
uuguaaucccagcuacucggg

SEQ ID NO: 342301 - RNA, 22 nt, Human
aaaaaaaggggacgccgcgaug

SEQ ID NO: 342302 - RNA, 25 nt, Human
aaaaagaagcauaguuuaucuucaa

SEQ ID NO: 342303 - RNA, 18 nt, Human
aaaggcaaaaaaaagggg

SEQ ID NO: 342304 - RNA, 24 nt, Human
aacacgcccacgugaccggccggc

SEQ ID NO: 342305 - RNA, 21 nt, Human
aacucgcugcgucaugacccu

SEQ ID NO: 342306 - RNA, 18 nt, Human
aagaaaaaagaagcauag

SEQ ID NO: 342307 - RNA, 21 nt, Human
aauaaacacugauauacugaa

SEQ ID NO: 342308 - RNA, 18 nt, Human
acauuuaacacaaugaaa

SEQ ID NO: 342309 - RNA, 18 nt, Human
accgcccggaaccgaccg

SEQ ID NO: 342310 - RNA, 20 nt, Human
acuuuaaaggcaaaaaaaag

SEQ ID NO: 342311 - RNA, 21 nt, Human
acuuuaaaggcaaaaaaaagg

SEQ ID NO: 342312 - RNA, 18 nt, Human
agcaggggcggcggcggg

SEQ ID NO: 342313 - RNA, 19 nt, Human
aguauacauuuaacacaau

SEQ ID NO: 342314 - RNA, 21 nt, Human
caccgccccucuucgcgccgu

SEQ ID NO: 342315 - RNA, 20 nt, Human
cccacaacacgcccacguga

SEQ ID NO: 342316 - RNA, 20 nt, Human
cccccccacaacacgcccac

SEQ ID NO: 342317 - RNA, 21 nt, Human
ccccgaaauacgcggggggug

SEQ ID NO: 342318 - RNA, 23 nt, Human
ccccucccccccacaacacgccc

SEQ ID NO: 342319 - RNA, 22 nt, Human
cccgccgccuccgccccccgaa

SEQ ID NO: 342320 - RNA, 19 nt, Human
ccgccgccuuuuaauuacg

SEQ ID NO: 342321 - RNA, 24 nt, Human
ccgccuccgccccccgaaauacgc

SEQ ID NO: 342322 - RNA, 21 nt, Human
ccgcgcggcggcgccccuccc

SEQ ID NO: 342323 - RNA, 23 nt, Human
ccggcgucagcaccgccccucuu

SEQ ID NO: 342324 - RNA, 24 nt, Human
ccguggcccgccgccuccgccccc

SEQ ID NO: 342325 - RNA, 27 nt, Human
cgaugcccccagaaaagucacgacuga

SEQ ID NO: 342326 - RNA, 25 nt, Human
cgccuccgccccccgaaauacgcgg

SEQ ID NO: 342327 - RNA, 19 nt, Human
cgcgccguggcccgccgcc

SEQ ID NO: 342328 - RNA, 22 nt, Human
cgcgccguggcccgccgccucc

SEQ ID NO: 342329 - RNA, 19 nt, Human
cggcgggcgcggcugccuc

SEQ ID NO: 342330 - RNA, 24 nt, Human
cguggcccgccgccuccgcccccc

SEQ ID NO: 342331 - RNA, 23 nt, Human
cuacacugaaaaauuaaugccga

SEQ ID NO: 342332 - RNA, 26 nt, Human
cucagccccggcccaaccacaucaac

SEQ ID NO: 342333 - RNA, 23 nt, Human
cuucgcgccguggcccgccgccu

SEQ ID NO: 342334 - RNA, 25 nt, Human
cuucgcgccguggcccgccgccucc

SEQ ID NO: 342335 - RNA, 24 nt, Human
cuuggcggccuccucagccccggc

SEQ ID NO: 342336 - RNA, 20 nt, Human
gaaaaaagaagcauaguuua

SEQ ID NO: 342337 - RNA, 21 nt, Human
gagcaggggcggcggcgggcg

SEQ ID NO: 342338 - RNA, 23 nt, Human
gcaccgccccucuucgcgccgug

SEQ ID NO: 342339 - RNA, 23 nt, Human
gccggcgucagcaccgccccucu

SEQ ID NO: 342340 - RNA, 24 nt, Human
gcgccccucccccccacaacacgc

SEQ ID NO: 342341 - RNA, 21 nt, Human
gcggcggcgguggcuccugcu

SEQ ID NO: 342342 - RNA, 23 nt, Human
ggcggcggccgcgccgggagaga

SEQ ID NO: 342343 - RNA, 21 nt, Human
ggcggcgggcgcggcugccuc

SEQ ID NO: 342344 - RNA, 22 nt, Human
gggacgccgcgaugcccccaga

SEQ ID NO: 342345 - RNA, 19 nt, Human
gggcggcggcgggcgcggc

SEQ ID NO: 342346 - RNA, 22 nt, Human
uaaacaacaaacuacacugaaa

SEQ ID NO: 342347 - RNA, 19 nt, Human
uaacagaagaaaaaagaag

SEQ ID NO: 342348 - RNA, 23 nt, Human
uagaauauauucccaguguccuc

SEQ ID NO: 342349 - RNA, 24 nt, Human
uagcucgcgcgcucccaaccgccc

SEQ ID NO: 342350 - RNA, 24 nt, Human
ucaaccgcggcggcgguggcuccu

SEQ ID NO: 342351 - RNA, 20 nt, Human
ucagguuaacagaagaaaaa

SEQ ID NO: 342352 - RNA, 20 nt, Human
ucccaccuucuuccgccgcc

SEQ ID NO: 342353 - RNA, 22 nt, Human
ucggcggcggccgcgccgggag

SEQ ID NO: 342354 - RNA, 24 nt, Human
ucuucgcgccguggcccgccgccu

SEQ ID NO: 342355 - RNA, 24 nt, Human
ugaaauaaacacugauauacugaa

SEQ ID NO: 342356 - RNA, 23 nt, Human
uggcggccuccucagccccggcc

SEQ ID NO: 342357 - RNA, 21 nt, Human
uggcuccugcugcugugaucg

SEQ ID NO: 342358 - RNA, 24 nt, Human
uucgcgccguggcccgccgccucc

SEQ ID NO: 342359 - RNA, 21 nt, Human
uuuuuuuuuuuuuuuuugagg

SEQ ID NO: 342360 - RNA, 22 nt, Human
aacacacacauagacacacaca

SEQ ID NO: 342361 - RNA, 22 nt, Human
aauccagccaucccagggucag

SEQ ID NO: 342362 - RNA, 23 nt, Human
acccaccaccguuaauaccaaca

SEQ ID NO: 342363 - RNA, 19 nt, Human
accucuagccccaggggac

SEQ ID NO: 342364 - RNA, 19 nt, Human
agaagaaagugaggcccag

SEQ ID NO: 342365 - RNA, 21 nt, Human
agaagaaagugaggcccaggg

SEQ ID NO: 342366 - RNA, 19 nt, Human
agaagggggagcaguuacu

SEQ ID NO: 342367 - RNA, 18 nt, Human
agacacuuaucccuaagc

SEQ ID NO: 342368 - RNA, 18 nt, Human
agagcaaaagagcaggug

SEQ ID NO: 342369 - RNA, 18 nt, Human
agcccaacccccagcccu

SEQ ID NO: 342370 - RNA, 18 nt, Human
agcuuuuuggagcagauu

SEQ ID NO: 342371 - RNA, 19 nt, Human
agggaucugggauuuccau

SEQ ID NO: 342372 - RNA, 24 nt, Human
aguguuguuuuuucaggucugaug

SEQ ID NO: 342373 - RNA, 24 nt, Human
aucccgcuggccuuggggaacgug

SEQ ID NO: 342374 - RNA, 18 nt, Human
augucccuucucaggcug

SEQ ID NO: 342375 - RNA, 24 nt, Human
caaaacccaccaccguuaauacca

SEQ ID NO: 342376 - RNA, 23 nt, Human
caacauaggagcugagcuuuuaa

SEQ ID NO: 342377 - RNA, 24 nt, Human
caacccccagcccuggucuggccu

SEQ ID NO: 342378 - RNA, 22 nt, Human
cacacacauagacacacacaca

SEQ ID NO: 342379 - RNA, 23 nt, Human
cacacauagacacacacacaccu

SEQ ID NO: 342380 - RNA, 20 nt, Human
caccucuagccccaggggac

SEQ ID NO: 342381 - RNA, 18 nt, Human
caggaccagggaucuggg

SEQ ID NO: 342382 - RNA, 20 nt, Human
caggaccagggaucugggau

SEQ ID NO: 342383 - RNA, 22 nt, Human
cauagacacacacacaccucuu

SEQ ID NO: 342384 - RNA, 20 nt, Human
cauaggccacauugggaagg

SEQ ID NO: 342385 - RNA, 21 nt, Human
cauccagcauuuauuaagcac

SEQ ID NO: 342386 - RNA, 24 nt, Human
cccaacccccagcccuggucuggc

SEQ ID NO: 342387 - RNA, 18 nt, Human
cccaugaacauccccaag

SEQ ID NO: 342388 - RNA, 21 nt, Human
cccauucauuccuccauuccu

SEQ ID NO: 342389 - RNA, 18 nt, Human
ccccaaggaagguaggcc

SEQ ID NO: 342390 - RNA, 20 nt, Human
ccccaagguugggugaaacc

SEQ ID NO: 342391 - RNA, 19 nt, Human
ccccaucaucugaaugccc

SEQ ID NO: 342392 - RNA, 21 nt, Human
cccccagcccuggucuggccu

SEQ ID NO: 342393 - RNA, 19 nt, Human
cccccucccccaguguugu

SEQ ID NO: 342394 - RNA, 24 nt, Human
cccguggcugcucccacccaagaa

SEQ ID NO: 342395 - RNA, 21 nt, Human
cgggugagcauggcuucuaga

SEQ ID NO: 342396 - RNA, 18 nt, Human
cuacagcccaacccccag

SEQ ID NO: 342397 - RNA, 24 nt, Human
cuaggggugagaccccaggcccaa

SEQ ID NO: 342398 - RNA, 22 nt, Human
cucauugcucaauccagccauc

SEQ ID NO: 342399 - RNA, 21 nt, Human
cuccuccaccucuagccccag

SEQ ID NO: 342400 - RNA, 24 nt, Human
cuccuccaccucuagccccagggg

SEQ ID NO: 342401 - RNA, 19 nt, Human
cugcgagggucugagagga

SEQ ID NO: 342402 - RNA, 18 nt, Human
cuuaaaaaaaaaaaaaaa

SEQ ID NO: 342403 - RNA, 18 nt, Human
cuuaucccuaagcuggga

SEQ ID NO: 342404 - RNA, 21 nt, Human
gagcagauucuccagaaugga

SEQ ID NO: 342405 - RNA, 22 nt, Human
gccagcuuuuuggagcagauuc

SEQ ID NO: 342406 - RNA, 18 nt, Human
gcccaugaacauccccaa

SEQ ID NO: 342407 - RNA, 21 nt, Human
gcuagagcaaaagagcaggug

SEQ ID NO: 342408 - RNA, 21 nt, Human
gcuauuuacaaagugcugaaa

SEQ ID NO: 342409 - RNA, 18 nt, Human
gcugcucccacccaagaa

SEQ ID NO: 342410 - RNA, 20 nt, Human
gcuuuuuggagcagauucuc

SEQ ID NO: 342411 - RNA, 22 nt, Human
ggaaacuggaaacuggggccca

SEQ ID NO: 342412 - RNA, 22 nt, Human
ggagaagaaagugaggcccagg

SEQ ID NO: 342413 - RNA, 20 nt, Human
ggcuguggcccuuguggcug

SEQ ID NO: 342414 - RNA, 24 nt, Human
uacagcccaacccccagcccuggu

SEQ ID NO: 342415 - RNA, 27 nt, Human
uagagugugaaagcaacaaaacccacc

SEQ ID NO: 342416 - RNA, 18 nt, Human
uaggagaagaaagugagg

SEQ ID NO: 342417 - RNA, 21 nt, Human
uaucauuagccaaguaugagu

SEQ ID NO: 342418 - RNA, 24 nt, Human
uccagaauggagaauggacuagca

SEQ ID NO: 342419 - RNA, 21 nt, Human
ucccauucauuccuccauucc

SEQ ID NO: 342420 - RNA, 26 nt, Human
ucccauucauuccuccauuccuuccu

SEQ ID NO: 342421 - RNA, 24 nt, Human
ucccauucccaggacugccuccuc

SEQ ID NO: 342422 - RNA, 18 nt, Human
ugaaaccccaucaucuga

SEQ ID NO: 342423 - RNA, 21 nt, Human
ugaaagaugaguugggaggag

SEQ ID NO: 342424 - RNA, 22 nt, Human
ugaaagaugaguugggaggagg

SEQ ID NO: 342425 - RNA, 19 nt, Human
ugaaagcaacaaaacccac

SEQ ID NO: 342426 - RNA, 24 nt, Human
ugaaagcaacaaaacccaccaccg

SEQ ID NO: 342427 - RNA, 20 nt, Human
ugaguugggaggaggagggg

SEQ ID NO: 342428 - RNA, 21 nt, Human
ugaguugggaggaggaggggc

SEQ ID NO: 342429 - RNA, 24 nt, Human
ugaguugggaggaggaggggcaac

SEQ ID NO: 342430 - RNA, 22 nt, Human
ugccuagcuaauuuuuaaaaac

SEQ ID NO: 342431 - RNA, 23 nt, Human
ugccuccuccaccucuagcccca

SEQ ID NO: 342432 - RNA, 22 nt, Human
ugcugaaacacacacauagaca

SEQ ID NO: 342433 - RNA, 20 nt, Human
ugcugcugcgagggucugag

SEQ ID NO: 342434 - RNA, 22 nt, Human
uggcaagggaaacuggaaacug

SEQ ID NO: 342435 - RNA, 22 nt, Human
ugggaacuuggccuucaccguc

SEQ ID NO: 342436 - RNA, 23 nt, Human
ugggaaggggaggcacgggaccu

SEQ ID NO: 342437 - RNA, 24 nt, Human
ugggaggaggaggggcacacaucc

SEQ ID NO: 342438 - RNA, 24 nt, Human
uguacagcuucuugcuauuuacaa

SEQ ID NO: 342439 - RNA, 21 nt, Human
ugugacugucccugccuacag

SEQ ID NO: 342440 - RNA, 23 nt, Human
ugugcugcuuggcucugcucauu

SEQ ID NO: 342441 - RNA, 20 nt, Human
uuaagcaccuacugugugcc

SEQ ID NO: 342442 - RNA, 20 nt, Human
uuuaauggcccaauuugccu

SEQ ID NO: 342443 - RNA, 20 nt, Human
aaguugauugucugucuccg

SEQ ID NO: 342444 - RNA, 19 nt, Human
agcgaagcucggggccgcc

SEQ ID NO: 342445 - RNA, 23 nt, Human
aggaggagcagcggcggcggcgg

SEQ ID NO: 342446 - RNA, 23 nt, Human
aggaggaggagcagcggcggcgg

SEQ ID NO: 342447 - RNA, 21 nt, Human
aggcggaggcgcggcgggaga

SEQ ID NO: 342448 - RNA, 20 nt, Human
aguagaagugcaccaaugcu

SEQ ID NO: 342449 - RNA, 24 nt, Human
aucuaguagaagugcaccaaugcu

SEQ ID NO: 342450 - RNA, 21 nt, Human
caacaaugcuuucgaucauga

SEQ ID NO: 342451 - RNA, 19 nt, Human
cagcagcagagccggggag

SEQ ID NO: 342452 - RNA, 21 nt, Human
cagcagcagcagagccgggga

SEQ ID NO: 342453 - RNA, 28 nt, Human
cagcagcagcagcagcagagccggggag

SEQ ID NO: 342454 - RNA, 18 nt, Human
cagccccggaugcugccu

SEQ ID NO: 342455 - RNA, 19 nt, Human
cagccucggccggcgggga

SEQ ID NO: 342456 - RNA, 20 nt, Human
cauccacccagccccggaug

SEQ ID NO: 342457 - RNA, 26 nt, Human
ccagcagcugcgccccugcuuccccc

SEQ ID NO: 342458 - RNA, 22 nt, Human
ccagccccggaugcugccuuug

SEQ ID NO: 342459 - RNA, 21 nt, Human
ccagccucggccggcgggggc

SEQ ID NO: 342460 - RNA, 19 nt, Human
ccccugcuucccccucaca

SEQ ID NO: 342461 - RNA, 20 nt, Human
cccgcagcccagccucggcc

SEQ ID NO: 342462 - RNA, 22 nt, Human
ccuccuacucagcauggugagc

SEQ ID NO: 342463 - RNA, 18 nt, Human
cgcagcccagccucggcc

SEQ ID NO: 342464 - RNA, 19 nt, Human
cgcucucuggcucucaccu

SEQ ID NO: 342465 - RNA, 19 nt, Human
cggccgccucccgcagccc

SEQ ID NO: 342466 - RNA, 30 nt, Human
cggcggcggcagcagcagcagcagcagagg

SEQ ID NO: 342467 - RNA, 18 nt, Human
cggcggcggcaggaggag

SEQ ID NO: 342468 - RNA, 23 nt, Human
gagccggggagagcgagaaccca

SEQ ID NO: 342469 - RNA, 25 nt, Human
gagccggggagagcgagaacccagu

SEQ ID NO: 342470 - RNA, 20 nt, Human
gcagcggcggcggcggcagc

SEQ ID NO: 342471 - RNA, 19 nt, Human
gcaggaggaggagcagcgg

SEQ ID NO: 342472 - RNA, 19 nt, Human
gcaguggucaaucugugcc

SEQ ID NO: 342473 - RNA, 24 nt, Human
ggagcagcggcggcggcggcagca

SEQ ID NO: 342474 - RNA, 18 nt, Human
gggcgggcaggcggaggc

SEQ ID NO: 342475 - RNA, 18 nt, Human
ggucgcccuagcgaagcu

SEQ ID NO: 342476 - RNA, 22 nt, Human
guuguuugcauccacccagccc

SEQ ID NO: 342477 - RNA, 18 nt, Human
uagcggcggcggcaggag

SEQ ID NO: 342478 - RNA, 23 nt, Human
ucacuuggugcaggcaguauguc

SEQ ID NO: 342479 - RNA, 24 nt, Human
ucacuuggugcaggcaguaugucc

SEQ ID NO: 342480 - RNA, 19 nt, Human
ucaguuccuccuacucagc

SEQ ID NO: 342481 - RNA, 19 nt, Human
ucaguugauuguuggccac

SEQ ID NO: 342482 - RNA, 23 nt, Human
ucccccucacagcggagcccuag

SEQ ID NO: 342483 - RNA, 18 nt, Human
ucggggccgcccggccgc

SEQ ID NO: 342484 - RNA, 23 nt, Human
ucuccaacaaugcuuucgaucau

SEQ ID NO: 342485 - RNA, 22 nt, Human
ugagcaguggucaaucugugcc

SEQ ID NO: 342486 - RNA, 20 nt, Human
ugcucgcucucuggcucuca

SEQ ID NO: 342487 - RNA, 21 nt, Human
uggugagcaguggucaaucug

SEQ ID NO: 342488 - RNA, 22 nt, Human
ugguucagauuauuauccugaa

SEQ ID NO: 342489 - RNA, 22 nt, Human
uuucaugguuguuugcauccac

SEQ ID NO: 342490 - RNA, 21 nt, Human
aaucaucuauuugcugacacc

SEQ ID NO: 342491 - RNA, 23 nt, Human
ccgugcagcuuucggcuuucucc

SEQ ID NO: 342492 - RNA, 19 nt, Human
gcagcuuucggcuuucucc

SEQ ID NO: 342493 - RNA, 18 nt, Human
guaacgcugguugcugug

SEQ ID NO: 342494 - RNA, 24 nt, Human
uaaaaacacgccaaucaaguucca

SEQ ID NO: 342495 - RNA, 24 nt, Human
uaaaaucaucuauuugcugacacc

SEQ ID NO: 342496 - RNA, 23 nt, Human
ucuccugacuguagcaagaauug

SEQ ID NO: 342497 - RNA, 21 nt, Human
ucuccugagcucuguaaaaac

SEQ ID NO: 342498 - RNA, 26 nt, Human
ucuuucuuuuuuuuuccccuucccuc

SEQ ID NO: 342499 - RNA, 24 nt, Human
uuauuuuucccuaccaccugucuu

SEQ ID NO: 342500 - RNA, 23 nt, Human
uuucuuucuuuuuuuuuccccuu

SEQ ID NO: 342501 - RNA, 22 nt, Human
aaagaggaaaaaagcacguuug

SEQ ID NO: 342502 - RNA, 23 nt, Human
augggaggguucuucaccuucuc

SEQ ID NO: 342503 - RNA, 23 nt, Human
augguccccuuccucuggcuguc

SEQ ID NO: 342504 - RNA, 19 nt, Human
caaagaagcuggggugaua

SEQ ID NO: 342505 - RNA, 20 nt, Human
ccccuuccucuggcuguccc

SEQ ID NO: 342506 - RNA, 18 nt, Human
gcaauagaaaaggcagca

SEQ ID NO: 342507 - RNA, 22 nt, Human
gcgggcgugaaugggaggguuc

SEQ ID NO: 342508 - RNA, 23 nt, Human
ggcgggcgugaaugggaggguuc

SEQ ID NO: 342509 - RNA, 18 nt, Human
ggcuggcugggcuggggg

SEQ ID NO: 342510 - RNA, 19 nt, Human
uaccccaugguccccuucc

SEQ ID NO: 342511 - RNA, 20 nt, Human
uacugggggacaaagaagcu

SEQ ID NO: 342512 - RNA, 21 nt, Human
uagaaaggugguguggguuag

SEQ ID NO: 342513 - RNA, 24 nt, Human
uauggcuuccugaaggcaucagug

SEQ ID NO: 342514 - RNA, 19 nt, Human
uccucuggcuguccccugg

SEQ ID NO: 342515 - RNA, 21 nt, Human
uccucuggcuguccccuggug

SEQ ID NO: 342516 - RNA, 18 nt, Human
uggcuggcugggcugggg

SEQ ID NO: 342517 - RNA, 23 nt, Human
uggcuggcugggcuggggguacu

SEQ ID NO: 342518 - RNA, 21 nt, Human
uggcugggcuggggguacugg

SEQ ID NO: 342519 - RNA, 24 nt, Human
uggcugggcuggggguacuggggg

SEQ ID NO: 342520 - RNA, 27 nt, Human
uggcugggcuggggguacugggggaca

SEQ ID NO: 342521 - RNA, 23 nt, Human
ugggaggguucuucaccuucucc

SEQ ID NO: 342522 - RNA, 18 nt, Human
ugggggacaaagaagcug

SEQ ID NO: 342523 - RNA, 18 nt, Human
ugggggcguguuuugccc

SEQ ID NO: 342524 - RNA, 21 nt, Human
uggggugauagaccaggacac

SEQ ID NO: 342525 - RNA, 19 nt, Human
uggguuagagggaaagggg

SEQ ID NO: 342526 - RNA, 21 nt, Human
uggguuagagggaaagggguu

SEQ ID NO: 342527 - RNA, 19 nt, Human
uugcagggcaauagaaaaa

SEQ ID NO: 342528 - RNA, 19 nt, Human
accacagucaucucaagca

SEQ ID NO: 342529 - RNA, 19 nt, Human
aggaaaugauugagaaaau

SEQ ID NO: 342530 - RNA, 18 nt, Human
aggcccagagauucuaac

SEQ ID NO: 342531 - RNA, 22 nt, Human
caacuugagaacagggugacac

SEQ ID NO: 342532 - RNA, 22 nt, Human
caagaggcagccugcuguggcg

SEQ ID NO: 342533 - RNA, 22 nt, Human
cacagaguccuuggaaaaagaa

SEQ ID NO: 342534 - RNA, 22 nt, Human
cagccggccccuucccuaggau

SEQ ID NO: 342535 - RNA, 19 nt, Human
cccccaacuugagaacagg

SEQ ID NO: 342536 - RNA, 19 nt, Human
ccuccuuggggcuaccugg

SEQ ID NO: 342537 - RNA, 20 nt, Human
ccugcuguggcgcaaaaguu

SEQ ID NO: 342538 - RNA, 20 nt, Human
ccuggguucaaguucuucuc

SEQ ID NO: 342539 - RNA, 18 nt, Human
cuccuuggggcuaccugg

SEQ ID NO: 342540 - RNA, 22 nt, Human
cuuccacuugcaggcugugagg

SEQ ID NO: 342541 - RNA, 22 nt, Human
gacaccugagcucacucgggcu

SEQ ID NO: 342542 - RNA, 23 nt, Human
gaccacagucaucucaagcagcc

SEQ ID NO: 342543 - RNA, 18 nt, Human
gagucuuugaaauacaac

SEQ ID NO: 342544 - RNA, 21 nt, Human
gccaggucggcagcuccuccu

SEQ ID NO: 342545 - RNA, 22 nt, Human
uaggauaggaagucagggccaa

SEQ ID NO: 342546 - RNA, 21 nt, Human
uauaacuauccccaguucuuc

SEQ ID NO: 342547 - RNA, 21 nt, Human
ucuaaggggggaccacaguca

SEQ ID NO: 342548 - RNA, 24 nt, Human
ucucaagcagcccuuuccuagccu

SEQ ID NO: 342549 - RNA, 23 nt, Human
ucucucuuuuaucuucuuuuauu

SEQ ID NO: 342550 - RNA, 20 nt, Human
ugaaauacaaccuuacacaa

SEQ ID NO: 342551 - RNA, 23 nt, Human
ugaaauacaaccuuacacaaaaa

SEQ ID NO: 342552 - RNA, 24 nt, Human
ugagaaaaugaauucgagucuuug

SEQ ID NO: 342553 - RNA, 19 nt, Human
ugagaacagggugacaccu

SEQ ID NO: 342554 - RNA, 20 nt, Human
ugagaacagggugacaccug

SEQ ID NO: 342555 - RNA, 24 nt, Human
ugagcucacucgggcuuagggagu

SEQ ID NO: 342556 - RNA, 18 nt, Human
ugaggagaggcccagaga

SEQ ID NO: 342557 - RNA, 20 nt, Human
ugaggagaggcccagagauu

SEQ ID NO: 342558 - RNA, 18 nt, Human
ugccaggucggcagcucc

SEQ ID NO: 342559 - RNA, 19 nt, Human
ugccuauggaagacacaga

SEQ ID NO: 342560 - RNA, 18 nt, Human
uggggcuaccugguaccu

SEQ ID NO: 342561 - RNA, 20 nt, Human
uguuacaaaggaaaugauug

SEQ ID NO: 342562 - RNA, 24 nt, Human
uuggguccaggacaguugaggaga

SEQ ID NO: 342563 - RNA, 24 nt, Human
uuuuuccucucucuuuuaucuucu

SEQ ID NO: 342564 - RNA, 27 nt, Human
uuuuuccucucucuuuuaucuucuuuu

SEQ ID NO: 342565 - RNA, 21 nt, Human
aaacaaacaaaaauaaaccca

SEQ ID NO: 342566 - RNA, 18 nt, Human
aaacaaguguacaguucc

SEQ ID NO: 342567 - RNA, 27 nt, Human
acaaaaauaaacccaaucauuaaacca

SEQ ID NO: 342568 - RNA, 22 nt, Human
acaaacaaacaaaaauaaaccc

SEQ ID NO: 342569 - RNA, 18 nt, Human
acaaagcacccucaggug

SEQ ID NO: 342570 - RNA, 20 nt, Human
acaauauauuacacaaagca

SEQ ID NO: 342571 - RNA, 23 nt, Human
acacuuaauuugaaaaaggaagc

SEQ ID NO: 342572 - RNA, 25 nt, Human
acuccauaucccuuucccuagcccu

SEQ ID NO: 342573 - RNA, 21 nt, Human
cacccucaggugcacauucaa

SEQ ID NO: 342574 - RNA, 19 nt, Human
cccauguugcaguguugga

SEQ ID NO: 342575 - RNA, 20 nt, Human
cccuuucccuagcccuccca

SEQ ID NO: 342576 - RNA, 18 nt, Human
ccuagcccucccacccug

SEQ ID NO: 342577 - RNA, 20 nt, Human
gcaccaaacaaguguacagu

SEQ ID NO: 342578 - RNA, 23 nt, Human
gcuucucagccuuuguucgaguu

SEQ ID NO: 342579 - RNA, 19 nt, Human
uaaaccaacuggagagcua

SEQ ID NO: 342580 - RNA, 19 nt, Human
ucaugcacacuuaauuuga

SEQ ID NO: 342581 - RNA, 18 nt, Human
ucccuagcccucccaccc

SEQ ID NO: 342582 - RNA, 23 nt, Human
ucccuagcccucccacccuggga

SEQ ID NO: 342583 - RNA, 22 nt, Human
ugauguauuaauuagcaccaaa

SEQ ID NO: 342584 - RNA, 19 nt, Human
ugcaguguuggagccaguc

SEQ ID NO: 342585 - RNA, 22 nt, Human
uggcugcuucucagccuuuguu

SEQ ID NO: 342586 - RNA, 22 nt, Human
uucccuagcccucccacccugg

SEQ ID NO: 342587 - RNA, 19 nt, Human
uuucccuagcccucccacc

SEQ ID NO: 342588 - RNA, 20 nt, Human
aaaaagacaaaaagacuuca

SEQ ID NO: 342589 - RNA, 22 nt, Human
aaacauuaauaaagauuucuua

SEQ ID NO: 342590 - RNA, 19 nt, Human
aaagugucauuuacagaaa

SEQ ID NO: 342591 - RNA, 20 nt, Human
aucaagacuaugugugaaaa

SEQ ID NO: 342592 - RNA, 19 nt, Human
caagaugugcacaauuagc

SEQ ID NO: 342593 - RNA, 28 nt, Human
cagaaacuacaaucauacaaccuucagg

SEQ ID NO: 342594 - RNA, 20 nt, Human
cagcauuaaaaagaaucaac

SEQ ID NO: 342595 - RNA, 22 nt, Human
cagcauuaaaaagaaucaacac

SEQ ID NO: 342596 - RNA, 23 nt, Human
cugggccuggucucuccuggagg

SEQ ID NO: 342597 - RNA, 22 nt, Human
cugggccugugugccugucccg

SEQ ID NO: 342598 - RNA, 22 nt, Human
gaccugacagaagcaucaguga

SEQ ID NO: 342599 - RNA, 23 nt, Human
gcaucagugaaaugucaucaaga

SEQ ID NO: 342600 - RNA, 20 nt, Human
gcugcuguggccuacacacc

SEQ ID NO: 342601 - RNA, 21 nt, Human
gggccuggucucuccuggagg

SEQ ID NO: 342602 - RNA, 23 nt, Human
uacagaaacuacaaucauacaaa

SEQ ID NO: 342603 - RNA, 23 nt, Human
uccuggaggucuggguguugcag

SEQ ID NO: 342604 - RNA, 20 nt, Human
ucucuccuggaggucugggu

SEQ ID NO: 342605 - RNA, 18 nt, Human
ugaaaaaucuaaacauua

SEQ ID NO: 342606 - RNA, 25 nt, Human
ugaaaaaucuaaacauuaauaaaga

SEQ ID NO: 342607 - RNA, 24 nt, Human
ugaaaauuagacaagaugugcaca

SEQ ID NO: 342608 - RNA, 19 nt, Human
ugcuuucccuacccggcuc

SEQ ID NO: 342609 - RNA, 21 nt, Human
ugggaccugacagaagcauca

SEQ ID NO: 342610 - RNA, 18 nt, Human
ugugugaaaauuagacaa

SEQ ID NO: 342611 - RNA, 18 nt, Human
ugugugccugucccgggc

SEQ ID NO: 342612 - RNA, 21 nt, Human
uguugcagccuuucaggacug

SEQ ID NO: 342613 - RNA, 27 nt, Human
aaaaaaaucuaaacaucaacaaagaug

SEQ ID NO: 342614 - RNA, 27 nt, Human
aaaaaaaucuaaacaucaacaaagaug

SEQ ID NO: 342615 - RNA, 22 nt, Human
aaagaacauuuucuuacacauc

SEQ ID NO: 342616 - RNA, 21 nt, Human
agacuggaaucuuuuaauaca

SEQ ID NO: 342617 - RNA, 18 nt, Human
agagaagacuggaaucuu

SEQ ID NO: 342618 - RNA, 24 nt, Human
caaagaacauuuucuuacacauca

SEQ ID NO: 342619 - RNA, 24 nt, Human
caaagaacauuuucuuacacauca

SEQ ID NO: 342620 - RNA, 21 nt, Human
caaauuagcaacaaauucuga

SEQ ID NO: 342621 - RNA, 19 nt, Human
cgagaugugcacaauuagc

SEQ ID NO: 342622 - RNA, 19 nt, Human
cgagaugugcacaauuagc

SEQ ID NO: 342623 - RNA, 20 nt, Human
gaccuaauaucuaacaaaga

SEQ ID NO: 342624 - RNA, 20 nt, Human
gaccuaauaucuaacaaaga

SEQ ID NO: 342625 - RNA, 22 nt, Human
gaccugauagaagcaucaguga

SEQ ID NO: 342626 - RNA, 22 nt, Human
gaccugauagaagcaucaguga

SEQ ID NO: 342627 - RNA, 21 nt, Human
ggaccuaauaucuaacaaaga

SEQ ID NO: 342628 - RNA, 21 nt, Human
ggaccuaauaucuaacaaaga

SEQ ID NO: 342629 - RNA, 21 nt, Human
uaaaaaaaucuaaacaucaac

SEQ ID NO: 342630 - RNA, 21 nt, Human
uaaaaaaaucuaaacaucaac

SEQ ID NO: 342631 - RNA, 24 nt, Human
ucacacaaagaacauuuucuuaca

SEQ ID NO: 342632 - RNA, 24 nt, Human
ucacacaaagaacauuuucuuaca

SEQ ID NO: 342633 - RNA, 20 nt, Human
ucugcggcuucacuuugucu

SEQ ID NO: 342634 - RNA, 22 nt, Human
ugaugggaccuaauaucuaaca

SEQ ID NO: 342635 - RNA, 22 nt, Human
ugaugggaccuaauaucuaaca

SEQ ID NO: 342636 - RNA, 21 nt, Human
ugggaccugauagaagcauca

SEQ ID NO: 342637 - RNA, 21 nt, Human
ugggaccugauagaagcauca

SEQ ID NO: 342638 - RNA, 23 nt, Human
ugugcacaauuagcuucaucuca

SEQ ID NO: 342639 - RNA, 21 nt, Human
uucugaaggacugcugucugc

SEQ ID NO: 342640 - RNA, 20 nt, Human
aaaagcguguacccuuuucc

SEQ ID NO: 342641 - RNA, 19 nt, Human
aaagcguguacccuuuucc

SEQ ID NO: 342642 - RNA, 19 nt, Human
aacccacucuucaccccca

SEQ ID NO: 342643 - RNA, 19 nt, Human
aacccacucuucaccccca

SEQ ID NO: 342644 - RNA, 22 nt, Human
aagacugccuccacccuuucag

SEQ ID NO: 342645 - RNA, 21 nt, Human
aagcgaggucuuccuccccuc

SEQ ID NO: 342646 - RNA, 21 nt, Human
aaggaagagggaagaggcagc

SEQ ID NO: 342647 - RNA, 20 nt, Human
aaguugggguucccacgacc

SEQ ID NO: 342648 - RNA, 20 nt, Human
acaccacgugggguaagagc

SEQ ID NO: 342649 - RNA, 19 nt, Human
accuagacagaaccgcuuc

SEQ ID NO: 342650 - RNA, 21 nt, Human
agaaacaguaccuagacagaa

SEQ ID NO: 342651 - RNA, 22 nt, Human
agaaacaguaccuagacagaac

SEQ ID NO: 342652 - RNA, 21 nt, Human
agaaagaguggagggguuaac

SEQ ID NO: 342653 - RNA, 20 nt, Human
agacaccagucugaagucug

SEQ ID NO: 342654 - RNA, 26 nt, Human
agaggaaauaggguaagguauggggg

SEQ ID NO: 342655 - RNA, 19 nt, Human
agcugaaugaugcagugga

SEQ ID NO: 342656 - RNA, 25 nt, Human
agggaagaggcagcuguggagagga

SEQ ID NO: 342657 - RNA, 26 nt, Human
agggaagaggcagcuguggagaggau

SEQ ID NO: 342658 - RNA, 18 nt, Human
agggaugggacucaggaa

SEQ ID NO: 342659 - RNA, 23 nt, Human
caaagcgaggucuuccuccccuc

SEQ ID NO: 342660 - RNA, 31 nt, Human
caacacagaagaagacuucugugaccaaugg

SEQ ID NO: 342661 - RNA, 22 nt, Human
caacccacucuucacccccaaa

SEQ ID NO: 342662 - RNA, 23 nt, Human
caagucagaagggaaggcauuua

SEQ ID NO: 342663 - RNA, 19 nt, Human
caaugccagaaacaguacc

SEQ ID NO: 342664 - RNA, 21 nt, Human
cacaacuacagggcaccaccc

SEQ ID NO: 342665 - RNA, 25 nt, Human
cacaacuacagggcaccacccucuc

SEQ ID NO: 342666 - RNA, 24 nt, Human
caccucacaacccacucuucaccc

SEQ ID NO: 342667 - RNA, 25 nt, Human
caccucacaacccacucuucacccc

SEQ ID NO: 342668 - RNA, 23 nt, Human
cacgacccccucuuuagguucaa

SEQ ID NO: 342669 - RNA, 23 nt, Human
cacuacaacuaucaacacagaag

SEQ ID NO: 342670 - RNA, 19 nt, Human
cagaaaccauguaugaaaa

SEQ ID NO: 342671 - RNA, 19 nt, Human
cagaggaaauaggguaagg

SEQ ID NO: 342672 - RNA, 19 nt, Human
cagaucccauagauugggg

SEQ ID NO: 342673 - RNA, 18 nt, Human
caguaccuagacagaacc

SEQ ID NO: 342674 - RNA, 18 nt, Human
ccaagucagaagggaagg

SEQ ID NO: 342675 - RNA, 20 nt, Human
ccaagucagaagggaaggca

SEQ ID NO: 342676 - RNA, 18 nt, Human
ccacucuccaaagcgagg

SEQ ID NO: 342677 - RNA, 20 nt, Human
cccacucuccaaagcgaggu

SEQ ID NO: 342678 - RNA, 20 nt, Human
cccacucuccaaagcgaggu

SEQ ID NO: 342679 - RNA, 21 nt, Human
cccacucuccaaagcgagguc

SEQ ID NO: 342680 - RNA, 20 nt, Human
ccccaagacugccuccaccc

SEQ ID NO: 342681 - RNA, 24 nt, Human
cccccaaaaucacgcagggauggg

SEQ ID NO: 342682 - RNA, 21 nt, Human
cccugggcuccacccuccagg

SEQ ID NO: 342683 - RNA, 24 nt, Human
cucacaacccacucuucaccccca

SEQ ID NO: 342684 - RNA, 23 nt, Human
cucacaacccacucuucacccuu

SEQ ID NO: 342685 - RNA, 21 nt, Human
cucacacacuaaccaguggac

SEQ ID NO: 342686 - RNA, 18 nt, Human
cucaggaaagggaagcau

SEQ ID NO: 342687 - RNA, 21 nt, Human
cuccaggaccuccaugugucc

SEQ ID NO: 342688 - RNA, 18 nt, Human
cuccauucaccguucucc

SEQ ID NO: 342689 - RNA, 18 nt, Human
cucugcugucacacuaca

SEQ ID NO: 342690 - RNA, 19 nt, Human
cuggaaggcaaugccagaa

SEQ ID NO: 342691 - RNA, 19 nt, Human
cuggaaggcaaugccagaa

SEQ ID NO: 342692 - RNA, 19 nt, Human
cuggaguggccacagaccu

SEQ ID NO: 342693 - RNA, 19 nt, Human
cugugaccaaugguaggga

SEQ ID NO: 342694 - RNA, 24 nt, Human
cuucccacaacuacagggcaccac

SEQ ID NO: 342695 - RNA, 19 nt, Human
gaaaggugagggaagagua

SEQ ID NO: 342696 - RNA, 19 nt, Human
gaaggaagagggaagaggc

SEQ ID NO: 342697 - RNA, 22 nt, Human
gacucaauuccaacacuacugg

SEQ ID NO: 342698 - RNA, 22 nt, Human
gacuucugugaccaaugguagg

SEQ ID NO: 342699 - RNA, 25 nt, Human
gcaaugccagaaacaguaccuagac

SEQ ID NO: 342700 - RNA, 20 nt, Human
ggagaggaugagguugaggg

SEQ ID NO: 342701 - RNA, 22 nt, Human
gggaugggacucaggaaaggga

SEQ ID NO: 342702 - RNA, 19 nt, Human
ggggaaggucuuaagaugc

SEQ ID NO: 342703 - RNA, 18 nt, Human
ggguguguucgggaaaac

SEQ ID NO: 342704 - RNA, 19 nt, Human
uaaaauggagaaauugggu

SEQ ID NO: 342705 - RNA, 28 nt, Human
uaacauggggcccaccucacaacccacu

SEQ ID NO: 342706 - RNA, 21 nt, Human
uaaggaacuuaugagccagaa

SEQ ID NO: 342707 - RNA, 22 nt, Human
uaccuagacagaaccgcuucag

SEQ ID NO: 342708 - RNA, 18 nt, Human
uauagcaagggcuaagga

SEQ ID NO: 342709 - RNA, 27 nt, Human
ucacaacccacucuucacccccaaaag

SEQ ID NO: 342710 - RNA, 20 nt, Human
uccagaagcucguuucucgg

SEQ ID NO: 342711 - RNA, 22 nt, Human
uccagcuauccagaagcucguu

SEQ ID NO: 342712 - RNA, 24 nt, Human
uccauguguccagcuauccagaag

SEQ ID NO: 342713 - RNA, 24 nt, Human
ucccauagauugggggcucggucc

SEQ ID NO: 342714 - RNA, 18 nt, Human
ucccugggcuccacccuc

SEQ ID NO: 342715 - RNA, 29 nt, Human
ucucuggggaaggucuuaagaugcaacgu

SEQ ID NO: 342716 - RNA, 25 nt, Human
ugaccuacaaagugaccuaaaaucc

SEQ ID NO: 342717 - RNA, 24 nt, Human
ugaccuacaaagugaccuggaucu

SEQ ID NO: 342718 - RNA, 19 nt, Human
ugagagagauggaaagcug

SEQ ID NO: 342719 - RNA, 20 nt, Human
ugagggaagaguacaguccu

SEQ ID NO: 342720 - RNA, 19 nt, Human
uggaaggcaaugccagaaa

SEQ ID NO: 342721 - RNA, 21 nt, Human
uggagauagugucagauccca

SEQ ID NO: 342722 - RNA, 19 nt, Human
uggagggguuaacaugggg

SEQ ID NO: 342723 - RNA, 23 nt, Human
ugggguaagagcccugcucccau

SEQ ID NO: 342724 - RNA, 18 nt, Human
uggugucugagagagaug

SEQ ID NO: 342725 - RNA, 19 nt, Human
uguccagcuauccagaagc

SEQ ID NO: 342726 - RNA, 23 nt, Human
uguggaaauggauaguaaaaugg

SEQ ID NO: 342727 - RNA, 25 nt, Human
uucuucccuagaacuccuuuucaaa

SEQ ID NO: 342728 - RNA, 23 nt, Human
uugcuggaguggccacagaccuu

SEQ ID NO: 342729 - RNA, 22 nt, Human
uuuauggaagcuucaugaugcc

SEQ ID NO: 342730 - RNA, 23 nt, Human
uuucccagaaaagcguguacccu

SEQ ID NO: 342731 - RNA, 23 nt, Human
uuucccagaaaagcguguacccu

SEQ ID NO: 342732 - RNA, 18 nt, Human
aggaaagcugaaggggua

SEQ ID NO: 342733 - RNA, 19 nt, Human
cuguagcuccugugagaac

SEQ ID NO: 342734 - RNA, 19 nt, Human
gagagaugggaucuuggcu

SEQ ID NO: 342735 - RNA, 24 nt, Human
gguuguucugggguucaggggcag

SEQ ID NO: 342736 - RNA, 23 nt, Human
gugaugaugaggagugcugauac

SEQ ID NO: 342737 - RNA, 18 nt, Human
ugagaacugauccagcug

SEQ ID NO: 342738 - RNA, 20 nt, Human
uggagagaugggaucuuggc

SEQ ID NO: 342739 - RNA, 19 nt, Human
acauggagggaugggaucu

SEQ ID NO: 342740 - RNA, 19 nt, Human
cagcugguuguucuggggc

SEQ ID NO: 342741 - RNA, 19 nt, Human
caggaaagcugaaggggua

SEQ ID NO: 342742 - RNA, 22 nt, Human
cagucucugagcuguggcuccu

SEQ ID NO: 342743 - RNA, 20 nt, Human
gagugaugaugaggacugcu

SEQ ID NO: 342744 - RNA, 21 nt, Human
gaugaugaggacugcugauac

SEQ ID NO: 342745 - RNA, 23 nt, Human
gugaugaugaggacugcugauac

SEQ ID NO: 342746 - RNA, 24 nt, Human
ucacaaggacuucagcucaggaaa

SEQ ID NO: 342747 - RNA, 20 nt, Human
ucucugagcuguggcuccug

SEQ ID NO: 342748 - RNA, 18 nt, Human
ugaauuugcaaagcaguu

SEQ ID NO: 342749 - RNA, 18 nt, Human
ugagaacugauccagcug

SEQ ID NO: 342750 - RNA, 23 nt, Human
uuucccagucucugagcuguggc

SEQ ID NO: 342751 - RNA, 20 nt, Human
aaaaaaagcagacacuuuca

SEQ ID NO: 342752 - RNA, 26 nt, Human
aaaaaaagcagacacuuucaaaacau

SEQ ID NO: 342753 - RNA, 23 nt, Human
aaguggccagcuacacuggauuu

SEQ ID NO: 342754 - RNA, 26 nt, Human
acaaggaaaacauaaaaaaucuuuca

SEQ ID NO: 342755 - RNA, 18 nt, Human
acccgcuucuuccucccu

SEQ ID NO: 342756 - RNA, 21 nt, Human
acccgcuucuuccucccuagu

SEQ ID NO: 342757 - RNA, 21 nt, Human
agaaaacgcaaagauguucuu

SEQ ID NO: 342758 - RNA, 19 nt, Human
agacagagccuggggcagc

SEQ ID NO: 342759 - RNA, 18 nt, Human
agagcuaagcugaccagu

SEQ ID NO: 342760 - RNA, 21 nt, Human
agagcucacauuuugcuggca

SEQ ID NO: 342761 - RNA, 21 nt, Human
aggauaaaaaaagcagacacc

SEQ ID NO: 342762 - RNA, 18 nt, Human
aguagaaaaagcccugga

SEQ ID NO: 342763 - RNA, 20 nt, Human
auaaaaggaagcuuauuaca

SEQ ID NO: 342764 - RNA, 24 nt, Human
auacauuuccaaauuuuuaaugcc

SEQ ID NO: 342765 - RNA, 21 nt, Human
aucauuuucuuaaucuuauua

SEQ ID NO: 342766 - RNA, 21 nt, Human
caaacauaagaaugccaaaaa

SEQ ID NO: 342767 - RNA, 21 nt, Human
cagagccuggggcagcucaaa

SEQ ID NO: 342768 - RNA, 22 nt, Human
cagagccuggggcagcucaaau

SEQ ID NO: 342769 - RNA, 18 nt, Human
cagcucaaaugcauuacu

SEQ ID NO: 342770 - RNA, 26 nt, Human
cauaagaaugccaaaaaauacagagc

SEQ ID NO: 342771 - RNA, 19 nt, Human
gaggagacagagccugggg

SEQ ID NO: 342772 - RNA, 25 nt, Human
gcuacacuggauuuuugucucaauu

SEQ ID NO: 342773 - RNA, 19 nt, Human
ggcaggacaauggaaagaa

SEQ ID NO: 342774 - RNA, 23 nt, Human
uaaaaaaagcagacacuuucaaa

SEQ ID NO: 342775 - RNA, 21 nt, Human
uaaaaggaagcuuauuacaga

SEQ ID NO: 342776 - RNA, 19 nt, Human
uacagaaaagcccagccuc

SEQ ID NO: 342777 - RNA, 22 nt, Human
uacagaaaagcccagccucauu

SEQ ID NO: 342778 - RNA, 22 nt, Human
uacuagggugauucaaaguuuc

SEQ ID NO: 342779 - RNA, 23 nt, Human
uauguagugacaucauuauaagu

SEQ ID NO: 342780 - RNA, 21 nt, Human
uccaaauuuuuaaugccuccc

SEQ ID NO: 342781 - RNA, 21 nt, Human
ucccuuaacuuugagcuucua

SEQ ID NO: 342782 - RNA, 25 nt, Human
ucggccucagaacaaguccgcagaa

SEQ ID NO: 342783 - RNA, 19 nt, Human
ucuucagcaaaucccuuaa

SEQ ID NO: 342784 - RNA, 24 nt, Human
ugagagagcuaagcugaccaguag

SEQ ID NO: 342785 - RNA, 25 nt, Human
ugagcugaggagacagagccugggg

SEQ ID NO: 342786 - RNA, 18 nt, Human
ugaggagacagagccugg

SEQ ID NO: 342787 - RNA, 22 nt, Human
ugauucaaaguuucaggaaaaa

SEQ ID NO: 342788 - RNA, 20 nt, Human
ugccaaaaaauacagagcuc

SEQ ID NO: 342789 - RNA, 25 nt, Human
ugccaaaaaauacagagcucacauu

SEQ ID NO: 342790 - RNA, 23 nt, Human
ugccucggccucagaacaagucc

SEQ ID NO: 342791 - RNA, 18 nt, Human
uggauuuuugucucaauu

SEQ ID NO: 342792 - RNA, 22 nt, Human
uuaauagaaugaguuauauaga

SEQ ID NO: 342793 - RNA, 18 nt, Human
uucaggaaaaagaaaauu

SEQ ID NO: 342794 - RNA, 22 nt, Human
uuucucacccgcuucuuccucc

SEQ ID NO: 342795 - RNA, 21 nt, Human
uuuuuuuuuuuucagguaccu

SEQ ID NO: 342796 - RNA, 19 nt, Human
uuuuuuuuuuuuuuucagg

SEQ ID NO: 342797 - RNA, 18 nt, Human
aaaguacagaacuacaaa

SEQ ID NO: 342798 - RNA, 20 nt, Human
aagaaaaucaacaaaagaaa

SEQ ID NO: 342799 - RNA, 22 nt, Human
aagaaacaacaugacugaaaac

SEQ ID NO: 342800 - RNA, 23 nt, Human
aaggggaagaaauauucugagaa

SEQ ID NO: 342801 - RNA, 25 nt, Human
agaaaaucaacaaaagaaaagaaaa

SEQ ID NO: 342802 - RNA, 22 nt, Human
agcaggaagugguuuuauugcc

SEQ ID NO: 342803 - RNA, 20 nt, Human
aggcacucgaauucuccaaa

SEQ ID NO: 342804 - RNA, 19 nt, Human
aguacagaacuacaaagca

SEQ ID NO: 342805 - RNA, 22 nt, Human
caaagcucagaagcuguugucu

SEQ ID NO: 342806 - RNA, 18 nt, Human
caacaaaagaaaagaaaa

SEQ ID NO: 342807 - RNA, 25 nt, Human
caccuuucuucuuucuucuacggga

SEQ ID NO: 342808 - RNA, 25 nt, Human
cagaacuacaaagcagaaaauaauc

SEQ ID NO: 342809 - RNA, 19 nt, Human
cagcaggaagugguuuuau

SEQ ID NO: 342810 - RNA, 23 nt, Human
cagggcaauaaagcuuggcaaaa

SEQ ID NO: 342811 - RNA, 26 nt, Human
cugugauuaguccaaagccggggucc

SEQ ID NO: 342812 - RNA, 21 nt, Human
gaaaagaaaacguggaugcaa

SEQ ID NO: 342813 - RNA, 23 nt, Human
gaaaaguacagaacuacaaagca

SEQ ID NO: 342814 - RNA, 28 nt, Human
gaacaagaaaaucaacaaaagaaaagaa

SEQ ID NO: 342815 - RNA, 22 nt, Human
gaaggggaagaaauauucugag

SEQ ID NO: 342816 - RNA, 20 nt, Human
gaauucuccaaacaccuuuc

SEQ ID NO: 342817 - RNA, 23 nt, Human
gcuccugcugagaacagaggcug

SEQ ID NO: 342818 - RNA, 23 nt, Human
ggaacaagaaaaucaacaaaaga

SEQ ID NO: 342819 - RNA, 19 nt, Human
ggaaggcuaaaccaacuua

SEQ ID NO: 342820 - RNA, 23 nt, Human
ggaaggggaagaaauauucugag

SEQ ID NO: 342821 - RNA, 26 nt, Human
gggaacaagaaaaucaacaaaagaaa

SEQ ID NO: 342822 - RNA, 26 nt, Human
gugguuuuauugcugugaacacaggg

SEQ ID NO: 342823 - RNA, 21 nt, Human
uaaaacaguaucauuaucaca

SEQ ID NO: 342824 - RNA, 22 nt, Human
uauucccuucucucgaaaagua

SEQ ID NO: 342825 - RNA, 20 nt, Human
uccaaacaccuuucuucuuu

SEQ ID NO: 342826 - RNA, 18 nt, Human
ucuuucuuugcugucuuc

SEQ ID NO: 342827 - RNA, 23 nt, Human
uggcaaaaguugcaggggacguc

SEQ ID NO: 342828 - RNA, 24 nt, Human
uggcagauuaacuucuugugcaga

SEQ ID NO: 342829 - RNA, 22 nt, Human
uggggcuccugcugagaacaga

SEQ ID NO: 342830 - RNA, 22 nt, Human
uucagaaugcagcaggaagugg

SEQ ID NO: 342831 - RNA, 22 nt, Human
uucuucuuucuucuacgggaac

SEQ ID NO: 342832 - RNA, 22 nt, Human
uuggcagauuaacuucuugugc

SEQ ID NO: 342833 - RNA, 22 nt, Human
uuuuucagaaugcagcaggaag

SEQ ID NO: 342834 - RNA, 22 nt, Human
uuuuuuuuuuuuuuuuuuucag

SEQ ID NO: 342835 - RNA, 28 nt, Human
aggcuauuuuccacaccaguaaguacag

SEQ ID NO: 342836 - RNA, 20 nt, Human
caagacagccgcuggcucaa

SEQ ID NO: 342837 - RNA, 21 nt, Human
cagcaagacagccgcuggcuc

SEQ ID NO: 342838 - RNA, 20 nt, Human
ccggcgcuuaacaccgcacu

SEQ ID NO: 342839 - RNA, 19 nt, Human
uaaguacaggcagcaagac

SEQ ID NO: 342840 - RNA, 19 nt, Human
ucacagaaggccacugugc

SEQ ID NO: 342841 - RNA, 23 nt, Human
ucccggcaccgggaagcauuucg

SEQ ID NO: 342842 - RNA, 18 nt, Human
uuuauaaacacaugucac

SEQ ID NO: 342843 - RNA, 25 nt, Human
uuuuuuuuuuuuuaaaagauguuca

SEQ ID NO: 342844 - RNA, 23 nt, Human
uuuuuuuuuuuuuuuuuuaaaag

SEQ ID NO: 342845 - RNA, 22 nt, Human
cgccucagccgccgccaccagc

SEQ ID NO: 342846 - RNA, 18 nt, Human
cuggguuggggaagcagg

SEQ ID NO: 342847 - RNA, 21 nt, Human
gccucagccgccgccaccagc

SEQ ID NO: 342848 - RNA, 19 nt, Human
gccucagccgccgccaccg

SEQ ID NO: 342849 - RNA, 19 nt, Human
aaaaacuggagaaaggaca

SEQ ID NO: 342850 - RNA, 20 nt, Human
aagugauuccuguuugccca

SEQ ID NO: 342851 - RNA, 20 nt, Human
cagucuauuauagagucacc

SEQ ID NO: 342852 - RNA, 19 nt, Human
caucugaguuuugcggugg

SEQ ID NO: 342853 - RNA, 22 nt, Human
ccgccgccgccgaggcugcucc

SEQ ID NO: 342854 - RNA, 18 nt, Human
ccucuuugcccacuucuu

SEQ ID NO: 342855 - RNA, 28 nt, Human
ccuuuuauucuggaacaaaaacuggaga

SEQ ID NO: 342856 - RNA, 18 nt, Human
cuccgcaccucccuggcc

SEQ ID NO: 342857 - RNA, 22 nt, Human
cugacuucugcgcugugcugca

SEQ ID NO: 342858 - RNA, 25 nt, Human
cuggaacaaaaacuggagaaaggac

SEQ ID NO: 342859 - RNA, 25 nt, Human
gaacaaaaacuggagaaaggacaau

SEQ ID NO: 342860 - RNA, 24 nt, Human
gacucacugcucuccaagauuggu

SEQ ID NO: 342861 - RNA, 22 nt, Human
ggaacaaaaacuggagaaagga

SEQ ID NO: 342862 - RNA, 22 nt, Human
uaaguaccacucaaaaagugga

SEQ ID NO: 342863 - RNA, 21 nt, Human
uagaaagcuucuucucgaucc

SEQ ID NO: 342864 - RNA, 21 nt, Human
uauuauagagucaccauuaga

SEQ ID NO: 342865 - RNA, 24 nt, Human
uauuuccaguuugucugacagagu

SEQ ID NO: 342866 - RNA, 23 nt, Human
uccucuuugcccacuucuuguug

SEQ ID NO: 342867 - RNA, 20 nt, Human
ugaguuuugcgguggugggc

SEQ ID NO: 342868 - RNA, 19 nt, Human
ugaugaacaaguggaaaau

SEQ ID NO: 342869 - RNA, 20 nt, Human
uggcuuuuaaaauauuuccu

SEQ ID NO: 342870 - RNA, 18 nt, Human
uuugcuguagucgucuca

SEQ ID NO: 342871 - RNA, 19 nt, Human
aaaaagccaacaaaaccca

SEQ ID NO: 342872 - RNA, 21 nt, Human
aaaaagccaacaaaacccaga

SEQ ID NO: 342873 - RNA, 28 nt, Human
aaacagaagguagggcaaaggggacccc

SEQ ID NO: 342874 - RNA, 19 nt, Human
aaccucguucuuccauauc

SEQ ID NO: 342875 - RNA, 23 nt, Human
aagacaauuuuucaaaaagccaa

SEQ ID NO: 342876 - RNA, 21 nt, Human
aagcauccucuuugacaaucc

SEQ ID NO: 342877 - RNA, 18 nt, Human
aagccaacaaaacccaga

SEQ ID NO: 342878 - RNA, 22 nt, Human
accgcagucuguauuucagcuc

SEQ ID NO: 342879 - RNA, 21 nt, Human
agaucaaaaugacacuggacc

SEQ ID NO: 342880 - RNA, 23 nt, Human
aggaaaaaaagaauacguucuca

SEQ ID NO: 342881 - RNA, 21 nt, Human
aggaaagacaauuuuucaaaa

SEQ ID NO: 342882 - RNA, 21 nt, Human
aggaagagugaaugaauagua

SEQ ID NO: 342883 - RNA, 23 nt, Human
aucuagguucuaacacccaggaa

SEQ ID NO: 342884 - RNA, 19 nt, Human
caaagaaagaguaugaagc

SEQ ID NO: 342885 - RNA, 20 nt, Human
caaagagaacugacuuggca

SEQ ID NO: 342886 - RNA, 19 nt, Human
cacucuggacacacacacc

SEQ ID NO: 342887 - RNA, 19 nt, Human
cagaaaguuaggacuggaa

SEQ ID NO: 342888 - RNA, 19 nt, Human
caguggaccauauacacca

SEQ ID NO: 342889 - RNA, 21 nt, Human
ccaaagagaacugacuuggca

SEQ ID NO: 342890 - RNA, 23 nt, Human
ccaacaaaacccagaaaaaggaa

SEQ ID NO: 342891 - RNA, 18 nt, Human
ccagaacacugcuguugc

SEQ ID NO: 342892 - RNA, 19 nt, Human
ccagucaguuauggaguaa

SEQ ID NO: 342893 - RNA, 20 nt, Human
ccccucuucuccuuaccuaa

SEQ ID NO: 342894 - RNA, 24 nt, Human
ccuagaaacgcccugcucaaccgg

SEQ ID NO: 342895 - RNA, 20 nt, Human
ccugccaucgccgccagccg

SEQ ID NO: 342896 - RNA, 21 nt, Human
cuaauaaauaucaagugcccc

SEQ ID NO: 342897 - RNA, 23 nt, Human
cuagaaacgcccugcucaaccgg

SEQ ID NO: 342898 - RNA, 20 nt, Human
cucacucuggacacacacac

SEQ ID NO: 342899 - RNA, 21 nt, Human
cucuugaccccucuucuccuu

SEQ ID NO: 342900 - RNA, 28 nt, Human
cugaaaccaguggaccauauacaccccu

SEQ ID NO: 342901 - RNA, 24 nt, Human
cugcugaagcuggguaagaggccc

SEQ ID NO: 342902 - RNA, 24 nt, Human
cuuccauaucuugagcaguaguua

SEQ ID NO: 342903 - RNA, 18 nt, Human
gaacauucagcuugggaa

SEQ ID NO: 342904 - RNA, 21 nt, Human
gaaugaauaguacccuaaaua

SEQ ID NO: 342905 - RNA, 18 nt, Human
gaccaggccuagaaacgc

SEQ ID NO: 342906 - RNA, 18 nt, Human
gagaauguggaacaaaag

SEQ ID NO: 342907 - RNA, 22 nt, Human
ggaaagcugaauagaacuuaaa

SEQ ID NO: 342908 - RNA, 23 nt, Human
guucaauuuuucuguccucuuuu

SEQ ID NO: 342909 - RNA, 23 nt, Human
uaaaugcagauauaauucaagaa

SEQ ID NO: 342910 - RNA, 22 nt, Human
uaacaaaguaggaaaaaaagaa

SEQ ID NO: 342911 - RNA, 20 nt, Human
uaacugguggagcugagacu

SEQ ID NO: 342912 - RNA, 19 nt, Human
uaccacaugaaaauauaaa

SEQ ID NO: 342913 - RNA, 19 nt, Human
uaucaagugccccacagga

SEQ ID NO: 342914 - RNA, 21 nt, Human
ucaguauaauuuucauaaggc

SEQ ID NO: 342915 - RNA, 24 nt, Human
ucaguauaauuuucauaaggcuuc

SEQ ID NO: 342916 - RNA, 18 nt, Human
ucccaccaaugauaagga

SEQ ID NO: 342917 - RNA, 23 nt, Human
uccugccaucgccgccagccgac

SEQ ID NO: 342918 - RNA, 27 nt, Human
uccuuacaaacagaagguagggcaaag

SEQ ID NO: 342919 - RNA, 21 nt, Human
ucuguccucuuuuccaaaaaa

SEQ ID NO: 342920 - RNA, 21 nt, Human
ucuuugacaauccaaaaacau

SEQ ID NO: 342921 - RNA, 20 nt, Human
ugaaaagcagaucaaaauga

SEQ ID NO: 342922 - RNA, 24 nt, Human
ugaaaagcagaucaaaaugacacu

SEQ ID NO: 342923 - RNA, 24 nt, Human
ugaaaauauaaaccucguucuucc

SEQ ID NO: 342924 - RNA, 22 nt, Human
ugaaccuuuggcuuauaaauuu

SEQ ID NO: 342925 - RNA, 21 nt, Human
ugaagcuggguaagaggccaa

SEQ ID NO: 342926 - RNA, 21 nt, Human
ugcaauaacaaaguaggaaaa

SEQ ID NO: 342927 - RNA, 19 nt, Human
uggaccauauacaccacua

SEQ ID NO: 342928 - RNA, 22 nt, Human
uggcagaaauuuagguugguag

SEQ ID NO: 342929 - RNA, 20 nt, Human
ugggcuuccuccaaagagaa

SEQ ID NO: 342930 - RNA, 22 nt, Human
uguacuugacggaagauuaggg

SEQ ID NO: 342931 - RNA, 24 nt, Human
uucaaaaagccaacaaaacccaga

SEQ ID NO: 342932 - RNA, 21 nt, Human
uuccuggaauuaauauuaaaa

SEQ ID NO: 342933 - RNA, 24 nt, Human
uuucaaaaagccaacaaaacccag

SEQ ID NO: 342934 - RNA, 18 nt, Human
aacuccacuacaucaagc

SEQ ID NO: 342935 - RNA, 25 nt, Human
acuagcucugcagaacuacacauac

SEQ ID NO: 342936 - RNA, 20 nt, Human
agaaacauugaaaaaaugag

SEQ ID NO: 342937 - RNA, 18 nt, Human
agaaauggcaaggaucua

SEQ ID NO: 342938 - RNA, 19 nt, Human
cagcagaggaaugacgcca

SEQ ID NO: 342939 - RNA, 19 nt, Human
uaagccagagugaacauuu

SEQ ID NO: 342940 - RNA, 24 nt, Human
uacagaaacauugaaaaaaugaga

SEQ ID NO: 342941 - RNA, 22 nt, Human
uggcuuacaaaaacuagcucug

SEQ ID NO: 342942 - RNA, 21 nt, Human
uugaaaaaaugagaaaguguc

SEQ ID NO: 342943 - RNA, 23 nt, Human
aaaaaagagaauauacuguaugc

SEQ ID NO: 342944 - RNA, 20 nt, Human
aaaagaucccgacugucuuc

SEQ ID NO: 342945 - RNA, 22 nt, Human
aacccaauugugggagcugcuu

SEQ ID NO: 342946 - RNA, 21 nt, Human
aaugguucccacaacgauuuu

SEQ ID NO: 342947 - RNA, 22 nt, Human
agaacccaauugugggagcugc

SEQ ID NO: 342948 - RNA, 19 nt, Human
agagaauauacuguaugcc

SEQ ID NO: 342949 - RNA, 20 nt, Human
aguuagauaaagaggaagaa

SEQ ID NO: 342950 - RNA, 24 nt, Human
aguucaccucaaggucagaagcuc

SEQ ID NO: 342951 - RNA, 20 nt, Human
caccaaaaugcaguucuaag

SEQ ID NO: 342952 - RNA, 21 nt, Human
caguccaucaggaaaagaaau

SEQ ID NO: 342953 - RNA, 19 nt, Human
caguucuaagugcaguccu

SEQ ID NO: 342954 - RNA, 19 nt, Human
cauucagacaugucuguca

SEQ ID NO: 342955 - RNA, 20 nt, Human
ccuggaguucuuuuaauggu

SEQ ID NO: 342956 - RNA, 18 nt, Human
cuucauucagacaugucu

SEQ ID NO: 342957 - RNA, 25 nt, Human
gaaaagaaaucccccgcuggcugga

SEQ ID NO: 342958 - RNA, 21 nt, Human
uaaaauagagccuauuugucc

SEQ ID NO: 342959 - RNA, 26 nt, Human
uaacauuagaaggcaauucaagacau

SEQ ID NO: 342960 - RNA, 18 nt, Human
uacaguccaucaggaaaa

SEQ ID NO: 342961 - RNA, 24 nt, Human
uacguauacuuuuagcguuuucag

SEQ ID NO: 342962 - RNA, 21 nt, Human
uaguuagauaaagaggaagaa

SEQ ID NO: 342963 - RNA, 21 nt, Human
ucagaggucaccaaaaugcag

SEQ ID NO: 342964 - RNA, 26 nt, Human
uccaaaaauaauuuuguuaaguucac

SEQ ID NO: 342965 - RNA, 22 nt, Human
uccaaguuuuuugcaugaagca

SEQ ID NO: 342966 - RNA, 21 nt, Human
ucuccuucagagaaaacugag

SEQ ID NO: 342967 - RNA, 24 nt, Human
ucucuucuguguccuuuuauaaga

SEQ ID NO: 342968 - RNA, 22 nt, Human
ugacagucauaaauaaagaaaa

SEQ ID NO: 342969 - RNA, 19 nt, Human
ugcuuaagcaaaugugaga

SEQ ID NO: 342970 - RNA, 22 nt, Human
ugguuuaaagucaauagggggc

SEQ ID NO: 342971 - RNA, 23 nt, Human
uguaauauaguuagauaaagagg

SEQ ID NO: 342972 - RNA, 22 nt, Human
ugucucuucuguguccuuuuau

SEQ ID NO: 342973 - RNA, 18 nt, Human
aaaccagaagcagacagg

SEQ ID NO: 342974 - RNA, 20 nt, Human
aagaaucugaggaagaagug

SEQ ID NO: 342975 - RNA, 20 nt, Human
aagcagacagggguaacccc

SEQ ID NO: 342976 - RNA, 24 nt, Human
aagcagacagggguaaccccagag

SEQ ID NO: 342977 - RNA, 21 nt, Human
aagcagacagggguaaccccg

SEQ ID NO: 342978 - RNA, 24 nt, Human
aagcgaaggcgagcccaggccgua

SEQ ID NO: 342979 - RNA, 24 nt, Human
accagggcacaggggcucuggcug

SEQ ID NO: 342980 - RNA, 25 nt, Human
acccuagugaaaugugcacagucuu

SEQ ID NO: 342981 - RNA, 25 nt, Human
acgaagcugcaagccccugggcccu

SEQ ID NO: 342982 - RNA, 22 nt, Human
agagaacuuuauucauuggaaa

SEQ ID NO: 342983 - RNA, 21 nt, Human
agaggcaucugggugggcccu

SEQ ID NO: 342984 - RNA, 19 nt, Human
aggaaaugugaaggaggca

SEQ ID NO: 342985 - RNA, 19 nt, Human
aggcagagguggcucugag

SEQ ID NO: 342986 - RNA, 23 nt, Human
aggcagagguggcucugagggca

SEQ ID NO: 342987 - RNA, 29 nt, Human
aggcaggaaaaggaccuauagaucuccaa

SEQ ID NO: 342988 - RNA, 25 nt, Human
agguuuugaagaugggcuguuuggg

SEQ ID NO: 342989 - RNA, 23 nt, Human
agugacaggggaaagagcagaaa

SEQ ID NO: 342990 - RNA, 21 nt, Human
auguauggcaggauggccaca

SEQ ID NO: 342991 - RNA, 26 nt, Human
caaaacacccaaaugacacugaugug

SEQ ID NO: 342992 - RNA, 22 nt, Human
caacagaaaaaccagaagcaga

SEQ ID NO: 342993 - RNA, 23 nt, Human
caagccccugggcccugggcccu

SEQ ID NO: 342994 - RNA, 22 nt, Human
cacccgagagauacuaaccuug

SEQ ID NO: 342995 - RNA, 18 nt, Human
cagaagcagacaggggua

SEQ ID NO: 342996 - RNA, 22 nt, Human
cagaccgggaggagacgaggaa

SEQ ID NO: 342997 - RNA, 20 nt, Human
cagcaucgaagggacccacu

SEQ ID NO: 342998 - RNA, 22 nt, Human
cagcaucgaagggacccacugg

SEQ ID NO: 342999 - RNA, 19 nt, Human
cagggagagacagagagga

SEQ ID NO: 343000 - RNA, 22 nt, Human
caucccccaucccagggguaaa

SEQ ID NO: 343001 - RNA, 20 nt, Human
ccaaaacaaagucuggcucc

SEQ ID NO: 343002 - RNA, 19 nt, Human
ccaaaacacccaaaugaca

SEQ ID NO: 343003 - RNA, 22 nt, Human
ccaacgccuaccagggcacagg

SEQ ID NO: 343004 - RNA, 18 nt, Human
ccccugaguugccaaaac

SEQ ID NO: 343005 - RNA, 18 nt, Human
ccccugggcccugggccc

SEQ ID NO: 343006 - RNA, 18 nt, Human
cccgagagauacuaaccc

SEQ ID NO: 343007 - RNA, 23 nt, Human
cccucagcaucgaagggacccac

SEQ ID NO: 343008 - RNA, 20 nt, Human
cccugggcccugggcccuuc

SEQ ID NO: 343009 - RNA, 21 nt, Human
ccucacgaagcugcaagcccc

SEQ ID NO: 343010 - RNA, 22 nt, Human
ccucacgaagcugcaagccccu

SEQ ID NO: 343011 - RNA, 21 nt, Human
ccuccugagacucccagugag

SEQ ID NO: 343012 - RNA, 19 nt, Human
ccugagacucccagugagc

SEQ ID NO: 343013 - RNA, 21 nt, Human
ccugcguggagcauggagggg

SEQ ID NO: 343014 - RNA, 21 nt, Human
ccugggcccugggcccuucug

SEQ ID NO: 343015 - RNA, 21 nt, Human
ccuucuguauuugaacccuag

SEQ ID NO: 343016 - RNA, 21 nt, Human
cgaagcugcaagccccugggc

SEQ ID NO: 343017 - RNA, 18 nt, Human
cucuaaagcgaaggcgag

SEQ ID NO: 343018 - RNA, 20 nt, Human
cugggcccugggcccuucug

SEQ ID NO: 343019 - RNA, 25 nt, Human
gaaccacggccgggcaacgggucag

SEQ ID NO: 343020 - RNA, 21 nt, Human
gaagcagacagggguaacccc

SEQ ID NO: 343021 - RNA, 21 nt, Human
gaccgggaggagacgaggaac

SEQ ID NO: 343022 - RNA, 23 nt, Human
gaggcaggaaaaggaccuauagg

SEQ ID NO: 343023 - RNA, 20 nt, Human
gaucauagucuuccaacuca

SEQ ID NO: 343024 - RNA, 19 nt, Human
gaucauccgaaggccccug

SEQ ID NO: 343025 - RNA, 24 nt, Human
gaugugggagugacaggggaaaga

SEQ ID NO: 343026 - RNA, 22 nt, Human
gccccugaguugccaaaacacc

SEQ ID NO: 343027 - RNA, 20 nt, Human
gcccugggcccuucuguauu

SEQ ID NO: 343028 - RNA, 22 nt, Human
gcgagcccaggccguaggagcg

SEQ ID NO: 343029 - RNA, 18 nt, Human
ggaaaugugaaggaggcc

SEQ ID NO: 343030 - RNA, 18 nt, Human
ggacccggagaugaggug

SEQ ID NO: 343031 - RNA, 22 nt, Human
gggaaagguggccaggugccag

SEQ ID NO: 343032 - RNA, 19 nt, Human
gggaggaaaugugaaggag

SEQ ID NO: 343033 - RNA, 26 nt, Human
gggcaggcuggaggagagcccacagc

SEQ ID NO: 343034 - RNA, 23 nt, Human
gguaccaagaaucugaggaagaa

SEQ ID NO: 343035 - RNA, 20 nt, Human
gguuaucccuccugagacuc

SEQ ID NO: 343036 - RNA, 24 nt, Human
guaaacuccugagacuggcuuuug

SEQ ID NO: 343037 - RNA, 21 nt, Human
gugaaggaggcaggaaaagga

SEQ ID NO: 343038 - RNA, 18 nt, Human
guggcucugagggcaccc

SEQ ID NO: 343039 - RNA, 23 nt, Human
gugggcccugggcaggcuggagg

SEQ ID NO: 343040 - RNA, 23 nt, Human
uaaagagaagccauguuauccug

SEQ ID NO: 343041 - RNA, 21 nt, Human
uaagacggaaguggagucuug

SEQ ID NO: 343042 - RNA, 24 nt, Human
ucacaggcagagguggcucugagg

SEQ ID NO: 343043 - RNA, 18 nt, Human
ucagguugggagggagcc

SEQ ID NO: 343044 - RNA, 18 nt, Human
ucccagggguaaacuccu

SEQ ID NO: 343045 - RNA, 23 nt, Human
ugaaaugugcacagucugcccuc

SEQ ID NO: 343046 - RNA, 23 nt, Human
ugacauacucaccacccucagca

SEQ ID NO: 343047 - RNA, 24 nt, Human
ugacauacucaccacccucagcau

SEQ ID NO: 343048 - RNA, 21 nt, Human
ugagcuggggugccacagggc

SEQ ID NO: 343049 - RNA, 18 nt, Human
ugccugcguggagcaugg

SEQ ID NO: 343050 - RNA, 20 nt, Human
ugccugcguggagcauggag

SEQ ID NO: 343051 - RNA, 19 nt, Human
uggaggggugggcaggcag

SEQ ID NO: 343052 - RNA, 24 nt, Human
uggcuccucgguugggggguuguc

SEQ ID NO: 343053 - RNA, 20 nt, Human
ugggagugacaggggaaaga

SEQ ID NO: 343054 - RNA, 21 nt, Human
ugucaagagaacuuuauucau

SEQ ID NO: 343055 - RNA, 19 nt, Human
ugugaugugggagugacag

SEQ ID NO: 343056 - RNA, 23 nt, Human
uuuaagaucauccgaaggcccuu

SEQ ID NO: 343057 - RNA, 18 nt, Human
uuuuuuuuuuuuuuuuug

SEQ ID NO: 343058 - RNA, 21 nt, Human
aaacaacauauaacacaaacu

SEQ ID NO: 343059 - RNA, 22 nt, Human
aacacaaacucaguuaccaccc

SEQ ID NO: 343060 - RNA, 22 nt, Human
aagaacaggaagagagcauugu

SEQ ID NO: 343061 - RNA, 24 nt, Human
aagaacaggaagagagcauugugc

SEQ ID NO: 343062 - RNA, 26 nt, Human
acaucaccuccccauugccccuccag

SEQ ID NO: 343063 - RNA, 18 nt, Human
accccauccuccugcuca

SEQ ID NO: 343064 - RNA, 19 nt, Human
accccauccuccugcucag

SEQ ID NO: 343065 - RNA, 21 nt, Human
accccucccacccugggccug

SEQ ID NO: 343066 - RNA, 24 nt, Human
acccuagucccugcucucugagcc

SEQ ID NO: 343067 - RNA, 18 nt, Human
agaacaggaagagagcau

SEQ ID NO: 343068 - RNA, 24 nt, Human
aggggccccgaccccucccacccu

SEQ ID NO: 343069 - RNA, 22 nt, Human
aucaccuccccauugccccucc

SEQ ID NO: 343070 - RNA, 22 nt, Human
caaaacaccgggucggauccug

SEQ ID NO: 343071 - RNA, 20 nt, Human
caacauauaacacaaacuca

SEQ ID NO: 343072 - RNA, 21 nt, Human
cagucucucugcaucuggggg

SEQ ID NO: 343073 - RNA, 20 nt, Human
caucugggggccucucauuc

SEQ ID NO: 343074 - RNA, 22 nt, Human
ccaaggccgcugggccccuccc

SEQ ID NO: 343075 - RNA, 19 nt, Human
ccacgccuagcugccuccu

SEQ ID NO: 343076 - RNA, 19 nt, Human
ccccucccacccugggccu

SEQ ID NO: 343077 - RNA, 20 nt, Human
cccgaccccucccacccugg

SEQ ID NO: 343078 - RNA, 20 nt, Human
cccuccaggggccccgaccc

SEQ ID NO: 343079 - RNA, 21 nt, Human
cccuccaggggccccgacccc

SEQ ID NO: 343080 - RNA, 24 nt, Human
ccuggcuuccuuccccucuuucug

SEQ ID NO: 343081 - RNA, 25 nt, Human
ccuguuggcuuccuucuccuggugc

SEQ ID NO: 343082 - RNA, 20 nt, Human
ccuucuccuggugcccgaau

SEQ ID NO: 343083 - RNA, 19 nt, Human
cuccccauugccccuccag

SEQ ID NO: 343084 - RNA, 23 nt, Human
cuccucuacuaacuuugcucuaa

SEQ ID NO: 343085 - RNA, 24 nt, Human
cugaaauacagcacaucgucccug

SEQ ID NO: 343086 - RNA, 19 nt, Human
gcuuccuuccccucuuucu

SEQ ID NO: 343087 - RNA, 19 nt, Human
ggccccuccccacccucuc

SEQ ID NO: 343088 - RNA, 25 nt, Human
uaacacaaacucaguuaccaccccc

SEQ ID NO: 343089 - RNA, 18 nt, Human
uacagcacaucgucccug

SEQ ID NO: 343090 - RNA, 25 nt, Human
uauaacacaaacucaguuaccaccc

SEQ ID NO: 343091 - RNA, 24 nt, Human
ucaagcacguuuccaauucugguu

SEQ ID NO: 343092 - RNA, 22 nt, Human
ucccugcucucugagcagagag

SEQ ID NO: 343093 - RNA, 23 nt, Human
ucccugugagugcuaccccaucc

SEQ ID NO: 343094 - RNA, 19 nt, Human
uccuacccuagucccugcu

SEQ ID NO: 343095 - RNA, 22 nt, Human
uccuccugcucaggaaaggaag

SEQ ID NO: 343096 - RNA, 22 nt, Human
ucuccagucucucugcaucugg

SEQ ID NO: 343097 - RNA, 24 nt, Human
ugagugcuaccccauccuccugcu

SEQ ID NO: 343098 - RNA, 20 nt, Human
ugcuggacgcagcggugagg

SEQ ID NO: 343099 - RNA, 23 nt, Human
uggcauacauauacaaguauaua

SEQ ID NO: 343100 - RNA, 27 nt, Human
ugggauagacacugaaauacagcacau

SEQ ID NO: 343101 - RNA, 26 nt, Human
ugggggccucucauucauccagcucc

SEQ ID NO: 343102 - RNA, 23 nt, Human
acugcuggucauauauccaaagg

SEQ ID NO: 343103 - RNA, 21 nt, Human
agucugguccacaugacaccc

SEQ ID NO: 343104 - RNA, 18 nt, Human
auucucuauucagaaguc

SEQ ID NO: 343105 - RNA, 20 nt, Human
ccaaaggaaaaaaaaaaaaa

SEQ ID NO: 343106 - RNA, 24 nt, Human
ccagaggcaauguucuuaagcgcg

SEQ ID NO: 343107 - RNA, 22 nt, Human
ccagcaaucccacugcugguca

SEQ ID NO: 343108 - RNA, 23 nt, Human
cccaaaaaaaucuccgcuccccu

SEQ ID NO: 343109 - RNA, 18 nt, Human
cccccguuuuuugggccc

SEQ ID NO: 343110 - RNA, 18 nt, Human
ccccuuuuuaucaccccc

SEQ ID NO: 343111 - RNA, 22 nt, Human
uaagcgcggcggccgggagcac

SEQ ID NO: 343112 - RNA, 23 nt, Human
ucccacugcuggucauauaucca

SEQ ID NO: 343113 - RNA, 25 nt, Human
uuucccaaaaaaaucuccgcucccc

SEQ ID NO: 343114 - RNA, 24 nt, Human
aaaaggaagggguuggaaacaaaa

SEQ ID NO: 343115 - RNA, 24 nt, Human
aaaaggaagugaucuauaccaagg

SEQ ID NO: 343116 - RNA, 18 nt, Human
aaccugggauccucgagc

SEQ ID NO: 343117 - RNA, 21 nt, Human
aaugauaaggugcaggcagaa

SEQ ID NO: 343118 - RNA, 18 nt, Human
aaugaugagagcugcgga

SEQ ID NO: 343119 - RNA, 19 nt, Human
aaugguuuuauuuccaucu

SEQ ID NO: 343120 - RNA, 23 nt, Human
aauguaacaaagaaagaguugaa

SEQ ID NO: 343121 - RNA, 21 nt, Human
acacaucacaaugaugagagc

SEQ ID NO: 343122 - RNA, 26 nt, Human
acaggugggccagguucuccgaacau

SEQ ID NO: 343123 - RNA, 22 nt, Human
acauugaaaaaaggaaagacau

SEQ ID NO: 343124 - RNA, 24 nt, Human
acuuuuauaauuaaccacugaagu

SEQ ID NO: 343125 - RNA, 21 nt, Human
agacacuugggacaaaaggug

SEQ ID NO: 343126 - RNA, 22 nt, Human
agacaggugggccagguucucc

SEQ ID NO: 343127 - RNA, 18 nt, Human
agaggaacagagauggcc

SEQ ID NO: 343128 - RNA, 20 nt, Human
agaggaacagagauggccug

SEQ ID NO: 343129 - RNA, 19 nt, Human
agcagucagaagcccgaag

SEQ ID NO: 343130 - RNA, 20 nt, Human
agcagucagaagcccgaagc

SEQ ID NO: 343131 - RNA, 23 nt, Human
agccaaacaguuaaaaagucaga

SEQ ID NO: 343132 - RNA, 20 nt, Human
aggaagcuucugaaauaaaa

SEQ ID NO: 343133 - RNA, 24 nt, Human
aggaaggacgacaguggaagagga

SEQ ID NO: 343134 - RNA, 20 nt, Human
aggagagguugucaucuggg

SEQ ID NO: 343135 - RNA, 19 nt, Human
aggcagaaucacgggugac

SEQ ID NO: 343136 - RNA, 22 nt, Human
aggccucucucguuagccaccc

SEQ ID NO: 343137 - RNA, 24 nt, Human
aggggagugcccugcagaguuucu

SEQ ID NO: 343138 - RNA, 22 nt, Human
aucacaaugaugagagcugcgg

SEQ ID NO: 343139 - RNA, 20 nt, Human
aucuggcuugcaaaauaauu

SEQ ID NO: 343140 - RNA, 24 nt, Human
auggggcaacagugaccugggcaa

SEQ ID NO: 343141 - RNA, 24 nt, Human
caaaacuuaaauuuuaaaaugggu

SEQ ID NO: 343142 - RNA, 23 nt, Human
cagucagaagcccgaagcaucca

SEQ ID NO: 343143 - RNA, 21 nt, Human
caguggccaggaagcuucuga

SEQ ID NO: 343144 - RNA, 19 nt, Human
cagugggaacugaggacug

SEQ ID NO: 343145 - RNA, 20 nt, Human
cauuaagccucugaggggga

SEQ ID NO: 343146 - RNA, 23 nt, Human
ccacaauuacugccaccaccucu

SEQ ID NO: 343147 - RNA, 19 nt, Human
ccaccgccuucgcacuccg

SEQ ID NO: 343148 - RNA, 18 nt, Human
ccacucuagaacuggacc

SEQ ID NO: 343149 - RNA, 19 nt, Human
ccacuggagaaccuggcug

SEQ ID NO: 343150 - RNA, 19 nt, Human
ccagacuggaaccacgauu

SEQ ID NO: 343151 - RNA, 22 nt, Human
ccccugagagaaccugaggcuc

SEQ ID NO: 343152 - RNA, 25 nt, Human
ccccugagagaaccugaggcucccg

SEQ ID NO: 343153 - RNA, 20 nt, Human
ccgaagcauccaagcccagu

SEQ ID NO: 343154 - RNA, 22 nt, Human
ccgaagcauccaagcccagugg

SEQ ID NO: 343155 - RNA, 27 nt, Human
cgccuucgcacuccggagaagaagcuc

SEQ ID NO: 343156 - RNA, 21 nt, Human
cucccacucuagaacuggacc

SEQ ID NO: 343157 - RNA, 22 nt, Human
cugcaaccagacuggaaccacg

SEQ ID NO: 343158 - RNA, 25 nt, Human
cugcaaccagacuggaaccacgauu

SEQ ID NO: 343159 - RNA, 21 nt, Human
cugcccucuucaacuccaagu

SEQ ID NO: 343160 - RNA, 18 nt, Human
cuggagauaacaaaagga

SEQ ID NO: 343161 - RNA, 22 nt, Human
cuggagcauggguaagguuccu

SEQ ID NO: 343162 - RNA, 23 nt, Human
cuggagcauggguaagguuccug

SEQ ID NO: 343163 - RNA, 23 nt, Human
cugucaggggcagcuugggccac

SEQ ID NO: 343164 - RNA, 26 nt, Human
cugugcugucaggggcagcuugggcc

SEQ ID NO: 343165 - RNA, 25 nt, Human
gaaaagagaggacacccaaacacgu

SEQ ID NO: 343166 - RNA, 22 nt, Human
gaagcuccuucuucagccgccc

SEQ ID NO: 343167 - RNA, 19 nt, Human
gaauaguagaaacaaaaca

SEQ ID NO: 343168 - RNA, 19 nt, Human
gaccggcagacacuuggga

SEQ ID NO: 343169 - RNA, 23 nt, Human
gcaaacuuuccaaacagggaaaa

SEQ ID NO: 343170 - RNA, 18 nt, Human
gcaacauuaagccucuga

SEQ ID NO: 343171 - RNA, 19 nt, Human
gccaagacaggugggccag

SEQ ID NO: 343172 - RNA, 19 nt, Human
gccauagcaucaaacugga

SEQ ID NO: 343173 - RNA, 23 nt, Human
gccgugaugcccagaagaaaguu

SEQ ID NO: 343174 - RNA, 21 nt, Human
gcgccaccgccuucgcacucc

SEQ ID NO: 343175 - RNA, 21 nt, Human
gcugagucccugcuccuucag

SEQ ID NO: 343176 - RNA, 22 nt, Human
ggaaaauggaggcagauaccac

SEQ ID NO: 343177 - RNA, 18 nt, Human
ggaacugagcggcugaua

SEQ ID NO: 343178 - RNA, 22 nt, Human
ggacaaaagguggugugcccgg

SEQ ID NO: 343179 - RNA, 20 nt, Human
ggagugcccugcagaguuuc

SEQ ID NO: 343180 - RNA, 25 nt, Human
ggauuuuaucagaaaagagaggaca

SEQ ID NO: 343181 - RNA, 23 nt, Human
gggcaacagugaccugggcaaaa

SEQ ID NO: 343182 - RNA, 19 nt, Human
gggcagaaacgggcuggga

SEQ ID NO: 343183 - RNA, 24 nt, Human
gggcaucgugacacugccgugaug

SEQ ID NO: 343184 - RNA, 26 nt, Human
ggugggccagguucuccgaacauggg

SEQ ID NO: 343185 - RNA, 25 nt, Human
guccugugccaggugaaggacgcug

SEQ ID NO: 343186 - RNA, 20 nt, Human
gugauuggucuuuccagggc

SEQ ID NO: 343187 - RNA, 23 nt, Human
uacauugaaaaaaggaaagacau

SEQ ID NO: 343188 - RNA, 24 nt, Human
uacauugaaaaaaggaaagacauu

SEQ ID NO: 343189 - RNA, 23 nt, Human
uaccacuggagaaccuggcuguc

SEQ ID NO: 343190 - RNA, 23 nt, Human
uagaacuggaccaccccagagga

SEQ ID NO: 343191 - RNA, 19 nt, Human
uagccacccccaggcccug

SEQ ID NO: 343192 - RNA, 24 nt, Human
uaggcagugggaacugaggacugg

SEQ ID NO: 343193 - RNA, 18 nt, Human
uaguagaaacaaaacaca

SEQ ID NO: 343194 - RNA, 22 nt, Human
uaucagaaaagagaggacaccc

SEQ ID NO: 343195 - RNA, 23 nt, Human
uccacaggcaacauuaagccucu

SEQ ID NO: 343196 - RNA, 24 nt, Human
uccacaggcaacauuaagccucug

SEQ ID NO: 343197 - RNA, 18 nt, Human
uccagggccucaaggggc

SEQ ID NO: 343198 - RNA, 24 nt, Human
uccgcaggcgccaccgccuucgca

SEQ ID NO: 343199 - RNA, 20 nt, Human
uccggagaagaagcuccuuc

SEQ ID NO: 343200 - RNA, 22 nt, Human
ucuaaagugaauucugugcuga

SEQ ID NO: 343201 - RNA, 22 nt, Human
ucuagaacuggaccaccccaga

SEQ ID NO: 343202 - RNA, 22 nt, Human
ucuauaccaagguuugcaggga

SEQ ID NO: 343203 - RNA, 22 nt, Human
ucucaggaaaauggaggcagau

SEQ ID NO: 343204 - RNA, 20 nt, Human
ucugucuguccauccgucuu

SEQ ID NO: 343205 - RNA, 24 nt, Human
ucugugcugagucccugcuccuuc

SEQ ID NO: 343206 - RNA, 22 nt, Human
ucuugcauguccugugccaggu

SEQ ID NO: 343207 - RNA, 24 nt, Human
ugaaaaaaggaaagacauuuuuuc

SEQ ID NO: 343208 - RNA, 18 nt, Human
ugaaaaguagguaacgaa

SEQ ID NO: 343209 - RNA, 23 nt, Human
ugaccugggcaaaagccuggaac

SEQ ID NO: 343210 - RNA, 21 nt, Human
ugagagaaccugaggcucccg

SEQ ID NO: 343211 - RNA, 18 nt, Human
ugaggacuggagggcgug

SEQ ID NO: 343212 - RNA, 21 nt, Human
ugccaggugaaggacgcugga

SEQ ID NO: 343213 - RNA, 24 nt, Human
ugcccagaagaaaguuaauggcaa

SEQ ID NO: 343214 - RNA, 19 nt, Human
ugccuugcuccaagucugg

SEQ ID NO: 343215 - RNA, 21 nt, Human
uggcgugaggcccucugagga

SEQ ID NO: 343216 - RNA, 18 nt, Human
ugggagggcccugggucc

SEQ ID NO: 343217 - RNA, 23 nt, Human
ugguuucgaaacagucuuuuuga

SEQ ID NO: 343218 - RNA, 25 nt, Human
uguaacacuagcagaggaguccaaa

SEQ ID NO: 343219 - RNA, 25 nt, Human
uguccugugccaggugaaggacgcu

SEQ ID NO: 343220 - RNA, 24 nt, Human
ugugcagauucugcaaccagacug

SEQ ID NO: 343221 - RNA, 20 nt, Human
ugugcugucaggggcagcuu

SEQ ID NO: 343222 - RNA, 24 nt, Human
ugugcugucaggggcagcuugggc

SEQ ID NO: 343223 - RNA, 23 nt, Human
uucaccagucaaaaccuauggag

SEQ ID NO: 343224 - RNA, 21 nt, Human
uucagccgcccaggagagcuc

SEQ ID NO: 343225 - RNA, 23 nt, Human
uugcagggaagucaaauguucuc

SEQ ID NO: 343226 - RNA, 23 nt, Human
uuggauccggacagauuuccagu

SEQ ID NO: 343227 - RNA, 23 nt, Human
uugggccacuuugcugccccuga

SEQ ID NO: 343228 - RNA, 20 nt, Human
uuggucgaccggcagacacu

SEQ ID NO: 343229 - RNA, 19 nt, Human
uuugcagaaaucacugcag

SEQ ID NO: 343230 - RNA, 21 nt, Human
uuugcagaaaucacugcagau

SEQ ID NO: 343231 - RNA, 22 nt, Human
uuuggcgugaggcccucugagg

SEQ ID NO: 343232 - RNA, 28 nt, Human
uuuuuuuuuuuuuuuuuuuuuuuggggg

SEQ ID NO: 343233 - RNA, 27 nt, Human
aaaaagcacacgaaaaauaguucaaac

SEQ ID NO: 343234 - RNA, 19 nt, Human
aaacauuuuagagguuauu

SEQ ID NO: 343235 - RNA, 19 nt, Human
aaaguuacaaaaaggcuga

SEQ ID NO: 343236 - RNA, 22 nt, Human
acggcaggccccagcccuucuu

SEQ ID NO: 343237 - RNA, 22 nt, Human
agaacggcaggccccagcccuu

SEQ ID NO: 343238 - RNA, 21 nt, Human
agcaauauuaacuauucugua

SEQ ID NO: 343239 - RNA, 21 nt, Human
agccaaauacucuuucaugaa

SEQ ID NO: 343240 - RNA, 22 nt, Human
agcguggggucguccagcugga

SEQ ID NO: 343241 - RNA, 20 nt, Human
agcuaaucacaaauaacuca

SEQ ID NO: 343242 - RNA, 19 nt, Human
aggagagaagccggaagcc

SEQ ID NO: 343243 - RNA, 21 nt, Human
auauaccuauauauacaccua

SEQ ID NO: 343244 - RNA, 21 nt, Human
auuuuuagccuccaagugaac

SEQ ID NO: 343245 - RNA, 20 nt, Human
caaaugucuagauauaagua

SEQ ID NO: 343246 - RNA, 18 nt, Human
cacaaguuaaauaaccua

SEQ ID NO: 343247 - RNA, 23 nt, Human
cacgcuuuuaacauaugccaugg

SEQ ID NO: 343248 - RNA, 18 nt, Human
ccacugaggagagaagcc

SEQ ID NO: 343249 - RNA, 18 nt, Human
ccccagcccuucuuuccc

SEQ ID NO: 343250 - RNA, 18 nt, Human
ccgacagccacgccgccc

SEQ ID NO: 343251 - RNA, 19 nt, Human
ccgccgcgccuccggagcc

SEQ ID NO: 343252 - RNA, 20 nt, Human
ccuaugguaugcugcauauu

SEQ ID NO: 343253 - RNA, 21 nt, Human
ccuccggagcccgcugugccc

SEQ ID NO: 343254 - RNA, 22 nt, Human
cuaaaaaacaguauuugaguag

SEQ ID NO: 343255 - RNA, 21 nt, Human
gaaccaaacuuguagacugaa

SEQ ID NO: 343256 - RNA, 19 nt, Human
gccgcucauuuuuuuuuuu

SEQ ID NO: 343257 - RNA, 24 nt, Human
gcugaacacaaguuaaauaaccua

SEQ ID NO: 343258 - RNA, 21 nt, Human
ggaggcugugguugggaggcg

SEQ ID NO: 343259 - RNA, 18 nt, Human
ggauaggcuugccgccgc

SEQ ID NO: 343260 - RNA, 20 nt, Human
guggggucguccagcuggag

SEQ ID NO: 343261 - RNA, 22 nt, Human
uaaaaaguuaaugaaaagcuua

SEQ ID NO: 343262 - RNA, 27 nt, Human
uaacaaguuuaaaaaagcacacgaaaa

SEQ ID NO: 343263 - RNA, 23 nt, Human
uaaugaaaagcuuauuuagacac

SEQ ID NO: 343264 - RNA, 26 nt, Human
uacaaaaaggcugaacacaaguuaaa

SEQ ID NO: 343265 - RNA, 22 nt, Human
uacucgggaggaagaacggcag

SEQ ID NO: 343266 - RNA, 22 nt, Human
uagauugucagagacgcuucag

SEQ ID NO: 343267 - RNA, 23 nt, Human
uagcaugacaaaauuaccaaaau

SEQ ID NO: 343268 - RNA, 25 nt, Human
uaugauguaaauuuuccauuucuga

SEQ ID NO: 343269 - RNA, 24 nt, Human
uauuaagaaaaagaagauugauuc

SEQ ID NO: 343270 - RNA, 19 nt, Human
ucccgacagccacgccgcc

SEQ ID NO: 343271 - RNA, 19 nt, Human
ucguccagcuggaggggau

SEQ ID NO: 343272 - RNA, 20 nt, Human
ucuccaggucuugggccuuc

SEQ ID NO: 343273 - RNA, 23 nt, Human
ucucugagaugaacuugccaaua

SEQ ID NO: 343274 - RNA, 23 nt, Human
ucugauucuuuauagacuuuuag

SEQ ID NO: 343275 - RNA, 20 nt, Human
ugaagcuaaagucugcugua

SEQ ID NO: 343276 - RNA, 20 nt, Human
ugaauugugcagauacaaaa

SEQ ID NO: 343277 - RNA, 21 nt, Human
ugagaaaccaugcauacugua

SEQ ID NO: 343278 - RNA, 18 nt, Human
ugcagauacaaaagugcu

SEQ ID NO: 343279 - RNA, 18 nt, Human
ugcaguauuagcccaaaa

SEQ ID NO: 343280 - RNA, 21 nt, Human
uuaaaauuauaucugaauccc

SEQ ID NO: 343281 - RNA, 19 nt, Human
uuacaaaaaggcugaacac

SEQ ID NO: 343282 - RNA, 20 nt, Human
uucguuuuguuuucacugga

SEQ ID NO: 343283 - RNA, 24 nt, Human
uucuacuaaaaaacaguauuugag

SEQ ID NO: 343284 - RNA, 22 nt, Human
uuuuucaguauuauauauugcu

SEQ ID NO: 343285 - RNA, 24 nt, Human
uuuuuuuuuuuuuuuacagucuuu

SEQ ID NO: 343286 - RNA, 19 nt, Human
aaaguucucugaaacugcu

SEQ ID NO: 343287 - RNA, 22 nt, Human
aaccaaggcuuugaugaguccc

SEQ ID NO: 343288 - RNA, 19 nt, Human
aauuuggagcucuuuccuu

SEQ ID NO: 343289 - RNA, 19 nt, Human
agccgacggcggcgccgcg

SEQ ID NO: 343290 - RNA, 19 nt, Human
caaaaugcuaaaccaaggc

SEQ ID NO: 343291 - RNA, 25 nt, Human
caugcaaaaaguucucugaaacugc

SEQ ID NO: 343292 - RNA, 19 nt, Human
ccaccagggcucugaacaa

SEQ ID NO: 343293 - RNA, 25 nt, Human
ccaccagggcucugaacaacugcgc

SEQ ID NO: 343294 - RNA, 21 nt, Human
ccccuguaguguucuagccuu

SEQ ID NO: 343295 - RNA, 24 nt, Human
ccgcggagccgacggcgcucgugc

SEQ ID NO: 343296 - RNA, 23 nt, Human
cuuuccuuuuuuauagcacuucu

SEQ ID NO: 343297 - RNA, 21 nt, Human
uaggaaggaccaccuuuaaua

SEQ ID NO: 343298 - RNA, 19 nt, Human
uaguguucuagccuuugua

SEQ ID NO: 343299 - RNA, 24 nt, Human
ucucugaaacugcuuccacugccu

SEQ ID NO: 343300 - RNA, 21 nt, Human
ugcgcgacacacaccacagag

SEQ ID NO: 343301 - RNA, 18 nt, Human
uggauuacaagauccacc

SEQ ID NO: 343302 - RNA, 22 nt, Human
ugugcgcgacacacaccacaga

SEQ ID NO: 343303 - RNA, 18 nt, Human
uuuuuuuuuuuuuugggu

SEQ ID NO: 343304 - RNA, 20 nt, Human
uuuuuuuuuuuuuuuugggu

SEQ ID NO: 343305 - RNA, 21 nt, Human
uuuuuuuuuuuuuuuuuuggg

SEQ ID NO: 343306 - RNA, 25 nt, Human
uuuuuuuuuuuuuuuuuuggguuuu

SEQ ID NO: 343307 - RNA, 22 nt, Human
aaaaauaaauacacuagccucc

SEQ ID NO: 343308 - RNA, 22 nt, Human
aaacagaugaaaauacucaaaa

SEQ ID NO: 343309 - RNA, 22 nt, Human
aacacaacuucuaaaaaauacu

SEQ ID NO: 343310 - RNA, 18 nt, Human
aacacucuaguaaaaaaa

SEQ ID NO: 343311 - RNA, 20 nt, Human
aacagaaauaacauccgcag

SEQ ID NO: 343312 - RNA, 19 nt, Human
aagcaaauguaaccaucca

SEQ ID NO: 343313 - RNA, 20 nt, Human
aagcaaauguaaccauccac

SEQ ID NO: 343314 - RNA, 19 nt, Human
aaguauuuacaggcuggcu

SEQ ID NO: 343315 - RNA, 20 nt, Human
acaauguccaaaauccugcc

SEQ ID NO: 343316 - RNA, 19 nt, Human
acaccgggguccgagacac

SEQ ID NO: 343317 - RNA, 19 nt, Human
acaugugauaacugaagaa

SEQ ID NO: 343318 - RNA, 23 nt, Human
accuggugguguauguccaaguu

SEQ ID NO: 343319 - RNA, 19 nt, Human
acugcagaugguauuaugu

SEQ ID NO: 343320 - RNA, 21 nt, Human
agaaggagcacauuuccuuca

SEQ ID NO: 343321 - RNA, 19 nt, Human
agacaaucaauuagccgcc

SEQ ID NO: 343322 - RNA, 18 nt, Human
agcacugcaggagaaaac

SEQ ID NO: 343323 - RNA, 19 nt, Human
aggcucggagggaaagcag

SEQ ID NO: 343324 - RNA, 21 nt, Human
aguaacucaaaaccacugccc

SEQ ID NO: 343325 - RNA, 25 nt, Human
agucauccacaccuuuuccuaacaa

SEQ ID NO: 343326 - RNA, 18 nt, Human
auagaauucucgcuuuga

SEQ ID NO: 343327 - RNA, 23 nt, Human
auauuuaguuccuacagaugucu

SEQ ID NO: 343328 - RNA, 21 nt, Human
auuuacauauacaauucagac

SEQ ID NO: 343329 - RNA, 19 nt, Human
caaaaagcaaaagcuuuca

SEQ ID NO: 343330 - RNA, 18 nt, Human
caaaagggcucugccuuu

SEQ ID NO: 343331 - RNA, 24 nt, Human
caaaggaaugcaguuggcaaacac

SEQ ID NO: 343332 - RNA, 19 nt, Human
caauucacaaaaauggagc

SEQ ID NO: 343333 - RNA, 21 nt, Human
caccgcgccuuuggagccgcc

SEQ ID NO: 343334 - RNA, 19 nt, Human
cagaauggacacacuggau

SEQ ID NO: 343335 - RNA, 22 nt, Human
cauauacuuacacagauaugca

SEQ ID NO: 343336 - RNA, 21 nt, Human
ccacaccuuuuccuaacaaaa

SEQ ID NO: 343337 - RNA, 23 nt, Human
ccauagaucacagugaguugugu

SEQ ID NO: 343338 - RNA, 18 nt, Human
cccauauauaaacaaggc

SEQ ID NO: 343339 - RNA, 20 nt, Human
ccggugcacaccgggguccg

SEQ ID NO: 343340 - RNA, 23 nt, Human
ccucuagauuaucccccugaccu

SEQ ID NO: 343341 - RNA, 18 nt, Human
cgacaaaaaugggcaaca

SEQ ID NO: 343342 - RNA, 21 nt, Human
cgagacacccgaaucgcagcc

SEQ ID NO: 343343 - RNA, 22 nt, Human
cggugcacaccgggguccgaga

SEQ ID NO: 343344 - RNA, 24 nt, Human
cguaauuaacaaugugcugauacc

SEQ ID NO: 343345 - RNA, 23 nt, Human
cugagcauuucacggaaagcaaa

SEQ ID NO: 343346 - RNA, 20 nt, Human
cugccucuagauuauccccc

SEQ ID NO: 343347 - RNA, 19 nt, Human
cuggguguauuaaaaguga

SEQ ID NO: 343348 - RNA, 25 nt, Human
cuugcuuucguaucugcaaaagggc

SEQ ID NO: 343349 - RNA, 21 nt, Human
gaaacgaaugcaucaaguauu

SEQ ID NO: 343350 - RNA, 21 nt, Human
gaaugcaucaaguauuuacag

SEQ ID NO: 343351 - RNA, 18 nt, Human
gacaaaaaugggcaacag

SEQ ID NO: 343352 - RNA, 20 nt, Human
gauaugcauuuacauauaca

SEQ ID NO: 343353 - RNA, 25 nt, Human
gcaaaguuuucuuauucuugucuaa

SEQ ID NO: 343354 - RNA, 18 nt, Human
gccaacuacucuauguca

SEQ ID NO: 343355 - RNA, 22 nt, Human
ggcgcagagcugcccucccuca

SEQ ID NO: 343356 - RNA, 19 nt, Human
guaaagauacuauggaacc

SEQ ID NO: 343357 - RNA, 23 nt, Human
gugaagcuacccauauauaaaca

SEQ ID NO: 343358 - RNA, 20 nt, Human
uaaaaaugcgcaaagacuug

SEQ ID NO: 343359 - RNA, 24 nt, Human
uaaaaggaaaauuugcuacaguug

SEQ ID NO: 343360 - RNA, 18 nt, Human
uaaagaucauuggcaaaa

SEQ ID NO: 343361 - RNA, 21 nt, Human
uaacaaaaagcaaaagcuuuc

SEQ ID NO: 343362 - RNA, 22 nt, Human
uaacaaaaagcaaaagcuuuca

SEQ ID NO: 343363 - RNA, 23 nt, Human
uaacaaugugcugauaccacuga

SEQ ID NO: 343364 - RNA, 23 nt, Human
uaacacaacuucuaaaaaauaau

SEQ ID NO: 343365 - RNA, 19 nt, Human
uaacagaaauaacauccgc

SEQ ID NO: 343366 - RNA, 23 nt, Human
uaacagaaauaacauccgcagaa

SEQ ID NO: 343367 - RNA, 19 nt, Human
uacaacuuaacaacccuuu

SEQ ID NO: 343368 - RNA, 21 nt, Human
uacaguuguaacacaacuucu

SEQ ID NO: 343369 - RNA, 19 nt, Human
uagaaaagcacugcaggag

SEQ ID NO: 343370 - RNA, 21 nt, Human
uagagucauccacaccuuuuc

SEQ ID NO: 343371 - RNA, 23 nt, Human
uauaacagaaauaacauccgcag

SEQ ID NO: 343372 - RNA, 18 nt, Human
uauaauugaaaggaaaga

SEQ ID NO: 343373 - RNA, 21 nt, Human
uauaguacaacuuaacaaccc

SEQ ID NO: 343374 - RNA, 23 nt, Human
ucaccgcgccuuuggagccgccu

SEQ ID NO: 343375 - RNA, 18 nt, Human
ucauccacaccuuuuccu

SEQ ID NO: 343376 - RNA, 19 nt, Human
ucauugauuuccaucuugu

SEQ ID NO: 343377 - RNA, 22 nt, Human
uccauauagaaaucccgucaga

SEQ ID NO: 343378 - RNA, 23 nt, Human
uccaugaaguaacucaaaaccac

SEQ ID NO: 343379 - RNA, 23 nt, Human
ucucagaaauguaggaaauccau

SEQ ID NO: 343380 - RNA, 21 nt, Human
ucucagaguucuuucacaaac

SEQ ID NO: 343381 - RNA, 20 nt, Human
ucucggcgacaaaaaugggc

SEQ ID NO: 343382 - RNA, 21 nt, Human
ucuuuuuuuuuaaaaaaaauu

SEQ ID NO: 343383 - RNA, 22 nt, Human
ugaaaauaaaugucuugauuuc

SEQ ID NO: 343384 - RNA, 18 nt, Human
ugaaaauacucaaaauag

SEQ ID NO: 343385 - RNA, 22 nt, Human
ugaagugagcugagaaggagca

SEQ ID NO: 343386 - RNA, 19 nt, Human
ugacacacaauuggaaaag

SEQ ID NO: 343387 - RNA, 25 nt, Human
ugacagcauucuauuccaugacugg

SEQ ID NO: 343388 - RNA, 22 nt, Human
ugaggaaacgaaugcaucaacu

SEQ ID NO: 343389 - RNA, 25 nt, Human
ugcaaaaacacucuaguaaaaaacg

SEQ ID NO: 343390 - RNA, 19 nt, Human
ugcauauacuuacacagau

SEQ ID NO: 343391 - RNA, 20 nt, Human
ugcaucaaguauuuacaggc

SEQ ID NO: 343392 - RNA, 21 nt, Human
uggaagagucacucguccugg

SEQ ID NO: 343393 - RNA, 25 nt, Human
uggcaucaguuguuuuaaucccuuc

SEQ ID NO: 343394 - RNA, 23 nt, Human
uggugguguauguccaaguucca

SEQ ID NO: 343395 - RNA, 20 nt, Human
ugguguauguccaaguucca

SEQ ID NO: 343396 - RNA, 24 nt, Human
uucacggaaagcaaauguaaccau

SEQ ID NO: 343397 - RNA, 22 nt, Human
uugaaguugcauaggcauuuuu

SEQ ID NO: 343398 - RNA, 20 nt, Human
uugagaauuuucccuccuuc

SEQ ID NO: 343399 - RNA, 21 nt, Human
uuuaaugccauugccuggauu

SEQ ID NO: 343400 - RNA, 21 nt, Human
uuucauugauuuccaucuugu

SEQ ID NO: 343401 - RNA, 20 nt, Human
uuucucggcgacaaaaaugg

SEQ ID NO: 343402 - RNA, 19 nt, Human
uuucuuuuacauuuccaaa

SEQ ID NO: 343403 - RNA, 20 nt, Human
aaccacuugauggccacaaa

SEQ ID NO: 343404 - RNA, 24 nt, Human
aagaggcuccccuggaaagcaagc

SEQ ID NO: 343405 - RNA, 19 nt, Human
acaaagccagagaccuccc

SEQ ID NO: 343406 - RNA, 19 nt, Human
acaaagccagagaccuccc

SEQ ID NO: 343407 - RNA, 19 nt, Human
acaaagccagagaccuccc

SEQ ID NO: 343408 - RNA, 21 nt, Human
acaaagccagagaccucccag

SEQ ID NO: 343409 - RNA, 21 nt, Human
acaaggccccugguaccaacu

SEQ ID NO: 343410 - RNA, 22 nt, Human
acccacccccagaaaggccacc

SEQ ID NO: 343411 - RNA, 22 nt, Human
acccacccccagaaaggccacc

SEQ ID NO: 343412 - RNA, 21 nt, Human
acccccagaaaggccaccaug

SEQ ID NO: 343413 - RNA, 21 nt, Human
acccccagaaaggccaccaug

SEQ ID NO: 343414 - RNA, 20 nt, Human
acccugaagccuccccaggc

SEQ ID NO: 343415 - RNA, 20 nt, Human
acccugaagccuccccaggc

SEQ ID NO: 343416 - RNA, 22 nt, Human
acccugaagccuccccaggcac

SEQ ID NO: 343417 - RNA, 22 nt, Human
acccugaagccuccccaggcac

SEQ ID NO: 343418 - RNA, 20 nt, Human
acuagcccagaggcugggcu

SEQ ID NO: 343419 - RNA, 20 nt, Human
acuagcccagaggcugggcu

SEQ ID NO: 343420 - RNA, 18 nt, Human
agaaauaagcggaucuga

SEQ ID NO: 343421 - RNA, 19 nt, Human
agagaacagcccaccccag

SEQ ID NO: 343422 - RNA, 22 nt, Human
agaggccccugguaccaacugg

SEQ ID NO: 343423 - RNA, 23 nt, Human
agaggggaggcuugugaugggaa

SEQ ID NO: 343424 - RNA, 22 nt, Human
agcuuccugagucugugugccu

SEQ ID NO: 343425 - RNA, 21 nt, Human
agcuuggguaaugcagaugcc

SEQ ID NO: 343426 - RNA, 21 nt, Human
agcuuggguaaugcagaugcc

SEQ ID NO: 343427 - RNA, 21 nt, Human
aggaggcuuggauggccagga

SEQ ID NO: 343428 - RNA, 25 nt, Human
aggcagagaacagcccaccccaaaa

SEQ ID NO: 343429 - RNA, 18 nt, Human
aggcagagacagccaccc

SEQ ID NO: 343430 - RNA, 18 nt, Human
aggcagagggaagaggac

SEQ ID NO: 343431 - RNA, 18 nt, Human
aggcagagggaagaggac

SEQ ID NO: 343432 - RNA, 24 nt, Human
aggcaggcugcccacaaagccaga

SEQ ID NO: 343433 - RNA, 24 nt, Human
aggcaggcugcccacaaagccaga

SEQ ID NO: 343434 - RNA, 20 nt, Human
aggcucccuggaagcagcag

SEQ ID NO: 343435 - RNA, 18 nt, Human
agggaccagcacccaccc

SEQ ID NO: 343436 - RNA, 18 nt, Human
agggaccagcacccaccc

SEQ ID NO: 343437 - RNA, 19 nt, Human
agggguggguggggugggg

SEQ ID NO: 343438 - RNA, 23 nt, Human
auaacaagcagggcaaggaaccc

SEQ ID NO: 343439 - RNA, 21 nt, Human
aucagggguggggcagggggc

SEQ ID NO: 343440 - RNA, 21 nt, Human
aucagggguggggcagggggc

SEQ ID NO: 343441 - RNA, 20 nt, Human
augcaaccccagcugcccuu

SEQ ID NO: 343442 - RNA, 19 nt, Human
augcggggagggguggguc

SEQ ID NO: 343443 - RNA, 19 nt, Human
caaaauauacuggcagaaa

SEQ ID NO: 343444 - RNA, 21 nt, Human
caaagccagagaccucccagg

SEQ ID NO: 343445 - RNA, 23 nt, Human
caacaggaccgcuugagaggcuc

SEQ ID NO: 343446 - RNA, 19 nt, Human
caaccgacccgaagcacgu

SEQ ID NO: 343447 - RNA, 20 nt, Human
caagaggccccugguaccaa

SEQ ID NO: 343448 - RNA, 22 nt, Human
cacaaagccagagaccucccag

SEQ ID NO: 343449 - RNA, 22 nt, Human
cacaaagccagagaccucccag

SEQ ID NO: 343450 - RNA, 20 nt, Human
cacaguguccgaagcaagac

SEQ ID NO: 343451 - RNA, 20 nt, Human
cacaguguccgaagcaagac

SEQ ID NO: 343452 - RNA, 20 nt, Human
cacaguuucacaggccggag

SEQ ID NO: 343453 - RNA, 20 nt, Human
cacaguuucacaggccggag

SEQ ID NO: 343454 - RNA, 28 nt, Human
caccacccagccucugugggcaccuccu

SEQ ID NO: 343455 - RNA, 28 nt, Human
caccacccagccucugugggcaccuccu

SEQ ID NO: 343456 - RNA, 23 nt, Human
cacccagccucugugggcaccuc

SEQ ID NO: 343457 - RNA, 23 nt, Human
cacccagccucugugggcaccuc

SEQ ID NO: 343458 - RNA, 21 nt, Human
cacccugaagccuccccaggc

SEQ ID NO: 343459 - RNA, 21 nt, Human
cacccugaagccuccccaggc

SEQ ID NO: 343460 - RNA, 18 nt, Human
caccugccaagcacuggc

SEQ ID NO: 343461 - RNA, 22 nt, Human
caccugccaagcacuggccugg

SEQ ID NO: 343462 - RNA, 18 nt, Human
caccuuugucucuggagc

SEQ ID NO: 343463 - RNA, 26 nt, Human
cagagaacagcccaccccaaaaccuu

SEQ ID NO: 343464 - RNA, 22 nt, Human
cagcacccuccccaccuuuguc

SEQ ID NO: 343465 - RNA, 22 nt, Human
cagcacccuccccaccuuuguc

SEQ ID NO: 343466 - RNA, 25 nt, Human
cagcagggcaggaaccuggagagga

SEQ ID NO: 343467 - RNA, 24 nt, Human
cagcccgggaagccccugccucuc

SEQ ID NO: 343468 - RNA, 24 nt, Human
cagcccgggaagccccugccucuc

SEQ ID NO: 343469 - RNA, 21 nt, Human
cagccucugugggcaccuccu

SEQ ID NO: 343470 - RNA, 21 nt, Human
cagccucugugggcaccuccu

SEQ ID NO: 343471 - RNA, 24 nt, Human
cagccucugugggcaccuccuccu

SEQ ID NO: 343472 - RNA, 24 nt, Human
cagccucugugggcaccuccuccu

SEQ ID NO: 343473 - RNA, 22 nt, Human
cagccugggaugggcacagcug

SEQ ID NO: 343474 - RNA, 22 nt, Human
cagccugggaugggcacagcug

SEQ ID NO: 343475 - RNA, 23 nt, Human
cagcuuccugagucugugugccu

SEQ ID NO: 343476 - RNA, 25 nt, Human
caggacaggcagacugugcgggcca

SEQ ID NO: 343477 - RNA, 25 nt, Human
caggacaggcagacugugcgggcca

SEQ ID NO: 343478 - RNA, 24 nt, Human
caggccggagauucugcaaacagg

SEQ ID NO: 343479 - RNA, 24 nt, Human
caggccggagauucugcaaacagg

SEQ ID NO: 343480 - RNA, 21 nt, Human
caggcugcccacaaagccaga

SEQ ID NO: 343481 - RNA, 21 nt, Human
caggcugcccacaaagccaga

SEQ ID NO: 343482 - RNA, 18 nt, Human
cagggcaggaaccuggag

SEQ ID NO: 343483 - RNA, 21 nt, Human
caggggcuggugggccccagg

SEQ ID NO: 343484 - RNA, 22 nt, Human
caguggcaaaggguggugacau

SEQ ID NO: 343485 - RNA, 21 nt, Human
cauccagaagccccagaaagu

SEQ ID NO: 343486 - RNA, 19 nt, Human
caugggcagcagagcuugg

SEQ ID NO: 343487 - RNA, 19 nt, Human
caugggcagcagagcuugg

SEQ ID NO: 343488 - RNA, 23 nt, Human
ccagaaaggccaccaugggcagc

SEQ ID NO: 343489 - RNA, 23 nt, Human
ccagaaaggccaccaugggcagc

SEQ ID NO: 343490 - RNA, 24 nt, Human
ccaggcaggcugcccacaaagcca

SEQ ID NO: 343491 - RNA, 24 nt, Human
ccaggcaggcugcccacaaagcca

SEQ ID NO: 343492 - RNA, 23 nt, Human
cccacggcacacuagcccagagg

SEQ ID NO: 343493 - RNA, 23 nt, Human
cccacggcacacuagcccagagg

SEQ ID NO: 343494 - RNA, 18 nt, Human
cccacggcacacuagccu

SEQ ID NO: 343495 - RNA, 19 nt, Human
ccccaaaaccuuggguggg

SEQ ID NO: 343496 - RNA, 22 nt, Human
ccccacggcacacuagcccaga

SEQ ID NO: 343497 - RNA, 22 nt, Human
ccccacggcacacuagcccaga

SEQ ID NO: 343498 - RNA, 18 nt, Human
ccccagaaaggccaccau

SEQ ID NO: 343499 - RNA, 18 nt, Human
ccccagaaaggccaccau

SEQ ID NO: 343500 - RNA, 19 nt, Human
ccccagaaaggccaccaug

SEQ ID NO: 343501 - RNA, 19 nt, Human
ccccagaaaggccaccaug

SEQ ID NO: 343502 - RNA, 21 nt, Human
cccccagcuuccugagucugu

SEQ ID NO: 343503 - RNA, 25 nt, Human
cccccagcuuccugagucugugugc

SEQ ID NO: 343504 - RNA, 20 nt, Human
cccggccacaguguccgaag

SEQ ID NO: 343505 - RNA, 20 nt, Human
cccggccacaguguccgaag

SEQ ID NO: 343506 - RNA, 20 nt, Human
cccugagagcacagcucagg

SEQ ID NO: 343507 - RNA, 24 nt, Human
cccuucagaaagacggccaacagg

SEQ ID NO: 343508 - RNA, 20 nt, Human
ccgaagcaagacagagcagg

SEQ ID NO: 343509 - RNA, 20 nt, Human
ccgaagcaagacagagcagg

SEQ ID NO: 343510 - RNA, 21 nt, Human
ccgaagcaagacagagcaggg

SEQ ID NO: 343511 - RNA, 21 nt, Human
ccgaagcaagacagagcaggg

SEQ ID NO: 343512 - RNA, 19 nt, Human
ccuccccaggcacaggccc

SEQ ID NO: 343513 - RNA, 19 nt, Human
ccuccugccccacagaggg

SEQ ID NO: 343514 - RNA, 19 nt, Human
ccuccugccccacagaggg

SEQ ID NO: 343515 - RNA, 21 nt, Human
ccugccaagcacuggccuggg

SEQ ID NO: 343516 - RNA, 28 nt, Human
ccugccccacggcacacuagcccagagg

SEQ ID NO: 343517 - RNA, 28 nt, Human
ccugccccacggcacacuagcccagagg

SEQ ID NO: 343518 - RNA, 22 nt, Human
cgaagcacgugagcaaaaccga

SEQ ID NO: 343519 - RNA, 22 nt, Human
cgggacagcagcagcccgggaa

SEQ ID NO: 343520 - RNA, 22 nt, Human
cgggacagcagcagcccgggaa

SEQ ID NO: 343521 - RNA, 24 nt, Human
cuccccaggcacaggcccugaaua

SEQ ID NO: 343522 - RNA, 24 nt, Human
cuccccaggcacaggcccugaaua

SEQ ID NO: 343523 - RNA, 18 nt, Human
cuccuggcuaucaccacc

SEQ ID NO: 343524 - RNA, 18 nt, Human
cuccuggcuaucaccacc

SEQ ID NO: 343525 - RNA, 28 nt, Human
cucugcaccaggcuacagcacauccccc

SEQ ID NO: 343526 - RNA, 28 nt, Human
cucugcaccaggcuacagcacauccccc

SEQ ID NO: 343527 - RNA, 18 nt, Human
cuggagcaccugucaagg

SEQ ID NO: 343528 - RNA, 19 nt, Human
cuggagcagacaucagggg

SEQ ID NO: 343529 - RNA, 19 nt, Human
cuggagcagacaucagggg

SEQ ID NO: 343530 - RNA, 20 nt, Human
cugugugccuggcacuccuc

SEQ ID NO: 343531 - RNA, 19 nt, Human
cuucagaggcggcuggucc

SEQ ID NO: 343532 - RNA, 21 nt, Human
gaagcacgugagcaaaaccga

SEQ ID NO: 343533 - RNA, 24 nt, Human
gacaggcagacugugcgggccagg

SEQ ID NO: 343534 - RNA, 24 nt, Human
gacaggcagacugugcgggccagg

SEQ ID NO: 343535 - RNA, 20 nt, Human
gacaggguaggguggggugg

SEQ ID NO: 343536 - RNA, 20 nt, Human
gacaggguaggguggggugg

SEQ ID NO: 343537 - RNA, 20 nt, Human
gacccgaagcacgugagcaa

SEQ ID NO: 343538 - RNA, 19 nt, Human
gagcaccugucaaggaacu

SEQ ID NO: 343539 - RNA, 21 nt, Human
gagcaccugucaaggaacugg

SEQ ID NO: 343540 - RNA, 18 nt, Human
gagccgcagccucucccu

SEQ ID NO: 343541 - RNA, 20 nt, Human
gagccgcagccucucccugg

SEQ ID NO: 343542 - RNA, 24 nt, Human
gagccuggaggccccagcagggga

SEQ ID NO: 343543 - RNA, 24 nt, Human
gagccuggaggccccagcagggga

SEQ ID NO: 343544 - RNA, 19 nt, Human
gcaaacaggacccacaggg

SEQ ID NO: 343545 - RNA, 19 nt, Human
gcaaacaggacccacaggg

SEQ ID NO: 343546 - RNA, 19 nt, Human
gcaaccccagcugcccuuc

SEQ ID NO: 343547 - RNA, 22 nt, Human
gcaaggaagaggcuccccugga

SEQ ID NO: 343548 - RNA, 23 nt, Human
gcacccacccccagaaaggccac

SEQ ID NO: 343549 - RNA, 23 nt, Human
gcacccacccccagaaaggccac

SEQ ID NO: 343550 - RNA, 24 nt, Human
gcaggcugcccacaaagccagaga

SEQ ID NO: 343551 - RNA, 24 nt, Human
gcaggcugcccacaaagccagaga

SEQ ID NO: 343552 - RNA, 23 nt, Human
gccccacagagggcgggacagca

SEQ ID NO: 343553 - RNA, 23 nt, Human
gccccacagagggcgggacagca

SEQ ID NO: 343554 - RNA, 19 nt, Human
gcccugaauauggaaggag

SEQ ID NO: 343555 - RNA, 19 nt, Human
gcccugaauauggaaggag

SEQ ID NO: 343556 - RNA, 19 nt, Human
gcccugacacccccagcuu

SEQ ID NO: 343557 - RNA, 22 nt, Human
gcccugagagcacagcucaggu

SEQ ID NO: 343558 - RNA, 20 nt, Human
gccuccccaggcacaggccc

SEQ ID NO: 343559 - RNA, 23 nt, Human
gcgggacagcagcagcccgggaa

SEQ ID NO: 343560 - RNA, 23 nt, Human
gcgggacagcagcagcccgggaa

SEQ ID NO: 343561 - RNA, 18 nt, Human
gcuacagcacauccccug

SEQ ID NO: 343562 - RNA, 18 nt, Human
gcuacagcacauccccug

SEQ ID NO: 343563 - RNA, 20 nt, Human
gcugggugggucagccuggg

SEQ ID NO: 343564 - RNA, 18 nt, Human
ggaccagcacccaccccc

SEQ ID NO: 343565 - RNA, 18 nt, Human
ggaccagcacccaccccc

SEQ ID NO: 343566 - RNA, 24 nt, Human
ggagagggcucucauccagaagcc

SEQ ID NO: 343567 - RNA, 18 nt, Human
ggaggcagagggaagagg

SEQ ID NO: 343568 - RNA, 18 nt, Human
ggaggcagagggaagagg

SEQ ID NO: 343569 - RNA, 20 nt, Human
ggaggcagagggaagaggac

SEQ ID NO: 343570 - RNA, 24 nt, Human
ggagguuccugaggcccugagagc

SEQ ID NO: 343571 - RNA, 24 nt, Human
ggagguuccugaggcccugagagc

SEQ ID NO: 343572 - RNA, 20 nt, Human
ggcagaaauaagcggaucug

SEQ ID NO: 343573 - RNA, 24 nt, Human
ggcaggggcuggugggccccaggg

SEQ ID NO: 343574 - RNA, 19 nt, Human
ggcccuggggaaagugguc

SEQ ID NO: 343575 - RNA, 22 nt, Human
ggcuacagcacauccccugccc

SEQ ID NO: 343576 - RNA, 22 nt, Human
ggcuacagcacauccccugccc

SEQ ID NO: 343577 - RNA, 20 nt, Human
gggaaaguggucaaggcaga

SEQ ID NO: 343578 - RNA, 20 nt, Human
gggaaaguggucaggcagag

SEQ ID NO: 343579 - RNA, 19 nt, Human
gggaggcagagggaagagg

SEQ ID NO: 343580 - RNA, 19 nt, Human
gggaggcagagggaagagg

SEQ ID NO: 343581 - RNA, 21 nt, Human
gggaggcagagggaagaggac

SEQ ID NO: 343582 - RNA, 19 nt, Human
gggcaaggaagaggcuccc

SEQ ID NO: 343583 - RNA, 28 nt, Human
gggcaggaaccuggagaggaggcuugga

SEQ ID NO: 343584 - RNA, 18 nt, Human
gggcuggugggccccagg

SEQ ID NO: 343585 - RNA, 22 nt, Human
ggggaggggugggugggguggg

SEQ ID NO: 343586 - RNA, 21 nt, Human
ggggcagggggcagggaccag

SEQ ID NO: 343587 - RNA, 21 nt, Human
ggggcagggggcagggaccag

SEQ ID NO: 343588 - RNA, 18 nt, Human
gggguggggcagggggca

SEQ ID NO: 343589 - RNA, 18 nt, Human
gggguggggcagggggca

SEQ ID NO: 343590 - RNA, 19 nt, Human
gggguggguggggugggga

SEQ ID NO: 343591 - RNA, 18 nt, Human
ggguggguggggugggga

SEQ ID NO: 343592 - RNA, 18 nt, Human
ggugggaggcagagggaa

SEQ ID NO: 343593 - RNA, 18 nt, Human
ggugggaggcagagggaa

SEQ ID NO: 343594 - RNA, 20 nt, Human
ggugggguggucugugagcc

SEQ ID NO: 343595 - RNA, 20 nt, Human
ggugggguggucugugagcc

SEQ ID NO: 343596 - RNA, 21 nt, Human
gugggguggggagagggcucu

SEQ ID NO: 343597 - RNA, 21 nt, Human
ucaaggcagagaacagcccac

SEQ ID NO: 343598 - RNA, 20 nt, Human
uccacacgccugggcgcccg

SEQ ID NO: 343599 - RNA, 25 nt, Human
ucccacggccccacauggaggaacu

SEQ ID NO: 343600 - RNA, 19 nt, Human
uccccaggcacaggcccug

SEQ ID NO: 343601 - RNA, 19 nt, Human
uccccaggcacaggcccug

SEQ ID NO: 343602 - RNA, 21 nt, Human
uccccaggcacaggcccugaa

SEQ ID NO: 343603 - RNA, 21 nt, Human
uccccaggcacaggcccugaa

SEQ ID NO: 343604 - RNA, 18 nt, Human
ucccugagcaccugccaa

SEQ ID NO: 343605 - RNA, 18 nt, Human
ucugcaaacaggacccac

SEQ ID NO: 343606 - RNA, 18 nt, Human
ucugcaaacaggacccac

SEQ ID NO: 343607 - RNA, 23 nt, Human
ucugcaaacaggacccacagggc

SEQ ID NO: 343608 - RNA, 23 nt, Human
ucugcaaacaggacccacagggc

SEQ ID NO: 343609 - RNA, 21 nt, Human
ugagcaaaaccgaccagggug

SEQ ID NO: 343610 - RNA, 22 nt, Human
ugaggcccugagagcacagcuc

SEQ ID NO: 343611 - RNA, 22 nt, Human
ugaggcccugagagcacagcuc

SEQ ID NO: 343612 - RNA, 18 nt, Human
ugaguggaggcaagaggc

SEQ ID NO: 343613 - RNA, 18 nt, Human
ugaguggaggcacaaggc

SEQ ID NO: 343614 - RNA, 21 nt, Human
ugcaaacaggacccacagggc

SEQ ID NO: 343615 - RNA, 21 nt, Human
ugcaaacaggacccacagggc

SEQ ID NO: 343616 - RNA, 22 nt, Human
ugcagaugccagcccaucuccu

SEQ ID NO: 343617 - RNA, 22 nt, Human
ugcagaugccagcccaucuccu

SEQ ID NO: 343618 - RNA, 18 nt, Human
ugccaagcacuggccugg

SEQ ID NO: 343619 - RNA, 25 nt, Human
ugccagcccaucuccuggcuaucac

SEQ ID NO: 343620 - RNA, 25 nt, Human
ugccagcccaucuccuggcuaucac

SEQ ID NO: 343621 - RNA, 18 nt, Human
ugccccacagagggcggg

SEQ ID NO: 343622 - RNA, 18 nt, Human
ugccccacagagggcggg

SEQ ID NO: 343623 - RNA, 18 nt, Human
ugcccugacacccccagc

SEQ ID NO: 343624 - RNA, 24 nt, Human
ugcccugacacccccagcuuccug

SEQ ID NO: 343625 - RNA, 21 nt, Human
uggaaagcaagcaaccacuug

SEQ ID NO: 343626 - RNA, 20 nt, Human
uggaagcagcagcacugaug

SEQ ID NO: 343627 - RNA, 21 nt, Human
uggaauaacaagcagggcaag

SEQ ID NO: 343628 - RNA, 23 nt, Human
uggaauaacaagcagggcaagga

SEQ ID NO: 343629 - RNA, 22 nt, Human
uggaggccccagcaggggagca

SEQ ID NO: 343630 - RNA, 22 nt, Human
uggaggccccagcaggggagca

SEQ ID NO: 343631 - RNA, 18 nt, Human
uggauggccaggaaggcu

SEQ ID NO: 343632 - RNA, 23 nt, Human
ugggaggaaagacgcaaggcugg

SEQ ID NO: 343633 - RNA, 21 nt, Human
ugggcaaggacaggguagggu

SEQ ID NO: 343634 - RNA, 21 nt, Human
ugggcaaggacaggguagggu

SEQ ID NO: 343635 - RNA, 19 nt, Human
ugggcaccuccuccugccc

SEQ ID NO: 343636 - RNA, 19 nt, Human
ugggcaccuccuccugccc

SEQ ID NO: 343637 - RNA, 22 nt, Human
ugggcucggguccacacgccug

SEQ ID NO: 343638 - RNA, 24 nt, Human
uggggaaaguggucaggcagagac

SEQ ID NO: 343639 - RNA, 19 nt, Human
uggggcagggggcagggac

SEQ ID NO: 343640 - RNA, 19 nt, Human
uggggcagggggcagggac

SEQ ID NO: 343641 - RNA, 19 nt, Human
ugggugggguggggagagg

SEQ ID NO: 343642 - RNA, 20 nt, Human
uggguggguggauacauuua

SEQ ID NO: 343643 - RNA, 18 nt, Human
ugguagaggggaggcuug

SEQ ID NO: 343644 - RNA, 19 nt, Human
ugguagaggggaggcuugu

SEQ ID NO: 343645 - RNA, 19 nt, Human
uggucaaggcagagaacag

SEQ ID NO: 343646 - RNA, 21 nt, Human
uuaaugauuauaaagugucca

SEQ ID NO: 343647 - RNA, 27 nt, Human
uuccauggcccccuucugggguugggg

SEQ ID NO: 343648 - RNA, 27 nt, Human
uuccauggcccccuucugggguugggg

SEQ ID NO: 343649 - RNA, 26 nt, Human
uugggcaaggacaggguagggugggg

SEQ ID NO: 343650 - RNA, 26 nt, Human
uugggcaaggacaggguagggugggg

SEQ ID NO: 343651 - RNA, 24 nt, Human
aaaaaugcuauauaacaaaaccau

SEQ ID NO: 343652 - RNA, 19 nt, Human
aaacauuagcugucagcuc

SEQ ID NO: 343653 - RNA, 22 nt, Human
aaacugcauggcaggucuggga

SEQ ID NO: 343654 - RNA, 18 nt, Human
aaagccccaaaauuccaa

SEQ ID NO: 343655 - RNA, 22 nt, Human
aaagugcugagguuguaacaga

SEQ ID NO: 343656 - RNA, 23 nt, Human
aaagugcugagguuguaacagaa

SEQ ID NO: 343657 - RNA, 18 nt, Human
aacaggccaucaaguacc

SEQ ID NO: 343658 - RNA, 20 nt, Human
aacagugggcucaguccccc

SEQ ID NO: 343659 - RNA, 23 nt, Human
aacaguucuuaagucaauaucca

SEQ ID NO: 343660 - RNA, 18 nt, Human
aacccaggagaaguccag

SEQ ID NO: 343661 - RNA, 20 nt, Human
aaggagacacaggggcuugg

SEQ ID NO: 343662 - RNA, 25 nt, Human
aaggaguggggugacuuuaggccua

SEQ ID NO: 343663 - RNA, 20 nt, Human
aaguccagggagcaggggac

SEQ ID NO: 343664 - RNA, 20 nt, Human
aaucauggcuuaauaauuua

SEQ ID NO: 343665 - RNA, 20 nt, Human
aauggugagggugggaagga

SEQ ID NO: 343666 - RNA, 22 nt, Human
aauuucuuuggagagucacccu

SEQ ID NO: 343667 - RNA, 25 nt, Human
acaaaaccauagaaaugagcacacu

SEQ ID NO: 343668 - RNA, 23 nt, Human
acaaugaaauauuauacaaccau

SEQ ID NO: 343669 - RNA, 21 nt, Human
acacacaggacaaaucugaac

SEQ ID NO: 343670 - RNA, 18 nt, Human
acagaacacggccccucu

SEQ ID NO: 343671 - RNA, 21 nt, Human
accauagaaaugagcacacua

SEQ ID NO: 343672 - RNA, 25 nt, Human
acccuggacccagagaaccuggcug

SEQ ID NO: 343673 - RNA, 19 nt, Human
acugaaaugaggaaaucca

SEQ ID NO: 343674 - RNA, 19 nt, Human
acuggagaguacccuugga

SEQ ID NO: 343675 - RNA, 23 nt, Human
acuuccuauuugaccaacaggcc

SEQ ID NO: 343676 - RNA, 24 nt, Human
acuuccuuuccccaccucacugac

SEQ ID NO: 343677 - RNA, 18 nt, Human
agaaagccccaaaauucc

SEQ ID NO: 343678 - RNA, 20 nt, Human
agagcggucaugcucccuca

SEQ ID NO: 343679 - RNA, 23 nt, Human
agaggcaaauggaauucuuagaa

SEQ ID NO: 343680 - RNA, 20 nt, Human
aggacaaaucugaacacugg

SEQ ID NO: 343681 - RNA, 24 nt, Human
agggaaucugacggggggcuucug

SEQ ID NO: 343682 - RNA, 18 nt, Human
aggugcaggcacuaagga

SEQ ID NO: 343683 - RNA, 20 nt, Human
aguagccaaaccuucauuac

SEQ ID NO: 343684 - RNA, 18 nt, Human
aguccucuuccuaacagu

SEQ ID NO: 343685 - RNA, 20 nt, Human
auauuauacaaccaugagaa

SEQ ID NO: 343686 - RNA, 22 nt, Human
aucaucgcaauccccaguuccg

SEQ ID NO: 343687 - RNA, 19 nt, Human
aucguggugaggugcaggc

SEQ ID NO: 343688 - RNA, 18 nt, Human
augcgcuuagaacucagg

SEQ ID NO: 343689 - RNA, 20 nt, Human
caaaaugcaauaaauugcua

SEQ ID NO: 343690 - RNA, 18 nt, Human
caaaccagacagaacuaa

SEQ ID NO: 343691 - RNA, 19 nt, Human
caaagagaguuaacaaaac

SEQ ID NO: 343692 - RNA, 25 nt, Human
caacaggccaucaaguaccacaggc

SEQ ID NO: 343693 - RNA, 25 nt, Human
caauccagccauguucccagaucaa

SEQ ID NO: 343694 - RNA, 23 nt, Human
cacaaugaaauauuauacaacca

SEQ ID NO: 343695 - RNA, 20 nt, Human
cacacacaggacaaaucuga

SEQ ID NO: 343696 - RNA, 24 nt, Human
cacacauccagcacagccaaacgc

SEQ ID NO: 343697 - RNA, 20 nt, Human
cacagguuagaacacggcuc

SEQ ID NO: 343698 - RNA, 19 nt, Human
cacccuggacccagagaac

SEQ ID NO: 343699 - RNA, 24 nt, Human
cacuaagcuaaaaaacaggcugaa

SEQ ID NO: 343700 - RNA, 18 nt, Human
cacugagcuugcagcaac

SEQ ID NO: 343701 - RNA, 23 nt, Human
cacugugcuggcaaucuaccuuu

SEQ ID NO: 343702 - RNA, 22 nt, Human
cacuuacauucaacuguacaga

SEQ ID NO: 343703 - RNA, 24 nt, Human
cagaaggaacugaaaugaggaaau

SEQ ID NO: 343704 - RNA, 22 nt, Human
cagacagcaaauguugaauuuc

SEQ ID NO: 343705 - RNA, 22 nt, Human
cagaggucccaacucauucuua

SEQ ID NO: 343706 - RNA, 24 nt, Human
cagccaaacuggagaguacccuug

SEQ ID NO: 343707 - RNA, 18 nt, Human
cagcgccugcaggugugg

SEQ ID NO: 343708 - RNA, 19 nt, Human
cagcgccugcagguguggc

SEQ ID NO: 343709 - RNA, 21 nt, Human
caggacagaacacggccccuc

SEQ ID NO: 343710 - RNA, 20 nt, Human
caggcugcagaaggaacuga

SEQ ID NO: 343711 - RNA, 21 nt, Human
cauaauggcacuaagcuaaaa

SEQ ID NO: 343712 - RNA, 20 nt, Human
cauccugcacauuuagaauu

SEQ ID NO: 343713 - RNA, 22 nt, Human
caugaaccaacacuuucaauga

SEQ ID NO: 343714 - RNA, 20 nt, Human
cauggcugagcaagcuuugu

SEQ ID NO: 343715 - RNA, 22 nt, Human
cauuuagaauuaaaaucaacag

SEQ ID NO: 343716 - RNA, 22 nt, Human
ccaaaaugacuuaaggcaaaaa

SEQ ID NO: 343717 - RNA, 24 nt, Human
cccaaagaauucaacaucagcauu

SEQ ID NO: 343718 - RNA, 21 nt, Human
ccccaaaauuccaaaauucua

SEQ ID NO: 343719 - RNA, 19 nt, Human
ccccagagcaucuucucag

SEQ ID NO: 343720 - RNA, 20 nt, Human
ccccucugggacuacugccu

SEQ ID NO: 343721 - RNA, 24 nt, Human
ccucucccugccaugcaggcuaaa

SEQ ID NO: 343722 - RNA, 23 nt, Human
ccugacaccaacaacagugggcu

SEQ ID NO: 343723 - RNA, 19 nt, Human
ccugaccaauauacuccca

SEQ ID NO: 343724 - RNA, 21 nt, Human
ccugaccaauauacucccaac

SEQ ID NO: 343725 - RNA, 21 nt, Human
cguggaagagguuucaggcua

SEQ ID NO: 343726 - RNA, 19 nt, Human
cucaauugcucugcuucau

SEQ ID NO: 343727 - RNA, 25 nt, Human
cucacagaauugcaauacuuuccac

SEQ ID NO: 343728 - RNA, 21 nt, Human
cucacugugcuggcaaucuac

SEQ ID NO: 343729 - RNA, 22 nt, Human
cugaacacaagccacuagugcu

SEQ ID NO: 343730 - RNA, 24 nt, Human
cugacagugcccugggauccaguc

SEQ ID NO: 343731 - RNA, 21 nt, Human
cugacggggggcuucuggggu

SEQ ID NO: 343732 - RNA, 20 nt, Human
cuggauacucgacucaaaac

SEQ ID NO: 343733 - RNA, 20 nt, Human
cugguaacacuuuguggaga

SEQ ID NO: 343734 - RNA, 23 nt, Human
cuugaaguuguacaguacccaau

SEQ ID NO: 343735 - RNA, 22 nt, Human
cuugcucucugcuccuuucugu

SEQ ID NO: 343736 - RNA, 21 nt, Human
gaaaaagaaauucccaaagag

SEQ ID NO: 343737 - RNA, 18 nt, Human
gaaauauuauacaaccau

SEQ ID NO: 343738 - RNA, 20 nt, Human
gaaugaaaacgaaccugcau

SEQ ID NO: 343739 - RNA, 22 nt, Human
gaccaauauacucccaacucug

SEQ ID NO: 343740 - RNA, 20 nt, Human
gagucaucugggcugacacc

SEQ ID NO: 343741 - RNA, 24 nt, Human
gcacaacccaggagaaggggaacc

SEQ ID NO: 343742 - RNA, 22 nt, Human
gcaggacagaacacggccccuc

SEQ ID NO: 343743 - RNA, 22 nt, Human
gcagggccaagccugauggugc

SEQ ID NO: 343744 - RNA, 18 nt, Human
gcaguauuacuuauuucc

SEQ ID NO: 343745 - RNA, 24 nt, Human
gccucuauuuugcagacccuagag

SEQ ID NO: 343746 - RNA, 18 nt, Human
gcucaaggaggaaggugg

SEQ ID NO: 343747 - RNA, 23 nt, Human
ggagagucacccuggacccagag

SEQ ID NO: 343748 - RNA, 19 nt, Human
ggaugggggagcaggcugg

SEQ ID NO: 343749 - RNA, 19 nt, Human
gggccuggucccuggauuu

SEQ ID NO: 343750 - RNA, 18 nt, Human
ggggagggggguguaggg

SEQ ID NO: 343751 - RNA, 21 nt, Human
ggggagggggguguagggugg

SEQ ID NO: 343752 - RNA, 19 nt, Human
guauuacuuauuuccaaaa

SEQ ID NO: 343753 - RNA, 18 nt, Human
guccaagguauguugccc

SEQ ID NO: 343754 - RNA, 20 nt, Human
gucccuggauuuggccuccu

SEQ ID NO: 343755 - RNA, 20 nt, Human
gugaagaauuuagcaaagug

SEQ ID NO: 343756 - RNA, 22 nt, Human
gugacucugcagagucacuccc

SEQ ID NO: 343757 - RNA, 23 nt, Human
uaaauugcuaaaauuuuagcuaa

SEQ ID NO: 343758 - RNA, 25 nt, Human
uaacuucagcaauacauauugaaca

SEQ ID NO: 343759 - RNA, 18 nt, Human
uaagaucauagaggcaaa

SEQ ID NO: 343760 - RNA, 22 nt, Human
uaagucaauauccagaaacuua

SEQ ID NO: 343761 - RNA, 19 nt, Human
uacacaagugacaacuuua

SEQ ID NO: 343762 - RNA, 20 nt, Human
uacacaaguguaguagccuu

SEQ ID NO: 343763 - RNA, 23 nt, Human
uacagaccauuaaauguugaaaa

SEQ ID NO: 343764 - RNA, 27 nt, Human
uacauggcaucagauggugagaauauu

SEQ ID NO: 343765 - RNA, 18 nt, Human
uacccaauagguucacac

SEQ ID NO: 343766 - RNA, 20 nt, Human
uaccuggccaucucauggcu

SEQ ID NO: 343767 - RNA, 23 nt, Human
uacgaagaaugcauaauuccauu

SEQ ID NO: 343768 - RNA, 23 nt, Human
uacuugaauacaaaucaaaauga

SEQ ID NO: 343769 - RNA, 23 nt, Human
uagaauaccgaacauuuagacua

SEQ ID NO: 343770 - RNA, 23 nt, Human
uagaauauucacacuggcauuuu

SEQ ID NO: 343771 - RNA, 20 nt, Human
uagaauuaaaaucaacagac

SEQ ID NO: 343772 - RNA, 19 nt, Human
uaggccuacaugggagcag

SEQ ID NO: 343773 - RNA, 20 nt, Human
uaguagccuuugcacugguu

SEQ ID NO: 343774 - RNA, 22 nt, Human
uauggcaccauuuguucaauga

SEQ ID NO: 343775 - RNA, 20 nt, Human
uauugcuuauuucugaagug

SEQ ID NO: 343776 - RNA, 25 nt, Human
uccaaaaugacuuaaggcaaaaaga

SEQ ID NO: 343777 - RNA, 22 nt, Human
uccaccuuggugaucggagagg

SEQ ID NO: 343778 - RNA, 28 nt, Human
ucccacagaagugguuaaaaacugccag

SEQ ID NO: 343779 - RNA, 20 nt, Human
ucccagaucaaucaucgcaa

SEQ ID NO: 343780 - RNA, 19 nt, Human
uccccaaaccagacagaac

SEQ ID NO: 343781 - RNA, 18 nt, Human
uccccagagcaucuucuc

SEQ ID NO: 343782 - RNA, 24 nt, Human
ucucuaacccccucuuucaacaaa

SEQ ID NO: 343783 - RNA, 20 nt, Human
ucuuuggagagucacccugg

SEQ ID NO: 343784 - RNA, 18 nt, Human
ugaaaagaaaccagauac

SEQ ID NO: 343785 - RNA, 20 nt, Human
ugaagaaagguaaauguguc

SEQ ID NO: 343786 - RNA, 22 nt, Human
ugaaggcacagcagggccaagc

SEQ ID NO: 343787 - RNA, 24 nt, Human
ugacaccauuuacaaaccuuuccu

SEQ ID NO: 343788 - RNA, 19 nt, Human
ugacggggggcuucugggg

SEQ ID NO: 343789 - RNA, 22 nt, Human
ugagauuuugguaucacagaaa

SEQ ID NO: 343790 - RNA, 19 nt, Human
ugagcaagcuuugucuucu

SEQ ID NO: 343791 - RNA, 20 nt, Human
ugagcaagcuuugucuucuu

SEQ ID NO: 343792 - RNA, 23 nt, Human
ugaggagggggugugaaaauccu

SEQ ID NO: 343793 - RNA, 21 nt, Human
ugagggugggaagagaauccc

SEQ ID NO: 343794 - RNA, 21 nt, Human
ugcaacucuaacaccaugaac

SEQ ID NO: 343795 - RNA, 19 nt, Human
ugcagaaggaacugaaaug

SEQ ID NO: 343796 - RNA, 26 nt, Human
ugcaggugguggaugggucgggcgcu

SEQ ID NO: 343797 - RNA, 24 nt, Human
ugccaugcaggcuaaacuagauuu

SEQ ID NO: 343798 - RNA, 21 nt, Human
ugcccugggauccaguccugu

SEQ ID NO: 343799 - RNA, 22 nt, Human
ugcuaaaaaguuugcaacucua

SEQ ID NO: 343800 - RNA, 19 nt, Human
uggaaaagcagucaguuac

SEQ ID NO: 343801 - RNA, 20 nt, Human
uggaauucuuagaacauuac

SEQ ID NO: 343802 - RNA, 21 nt, Human
uggaggaagaacugauaaggc

SEQ ID NO: 343803 - RNA, 24 nt, Human
uggagggcaggcccagcuugagga

SEQ ID NO: 343804 - RNA, 20 nt, Human
uggauguccugugcuuccuu

SEQ ID NO: 343805 - RNA, 23 nt, Human
uggcagcauccugcacauuuaga

SEQ ID NO: 343806 - RNA, 25 nt, Human
uggcuccaguaagccucccugacac

SEQ ID NO: 343807 - RNA, 21 nt, Human
uggcuggguacugaaggcaca

SEQ ID NO: 343808 - RNA, 20 nt, Human
ugggaaacucacugugcugg

SEQ ID NO: 343809 - RNA, 18 nt, Human
ugggaagaguuuaguugc

SEQ ID NO: 343810 - RNA, 21 nt, Human
uggugaaaagaaaccagauac

SEQ ID NO: 343811 - RNA, 19 nt, Human
uguaugcacgugcuccacu

SEQ ID NO: 343812 - RNA, 23 nt, Human
ugucaaggaagaguccuacuagc

SEQ ID NO: 343813 - RNA, 20 nt, Human
ugucagagggcggggaauga

SEQ ID NO: 343814 - RNA, 23 nt, Human
ugugcaacaugucuacaugggag

SEQ ID NO: 343815 - RNA, 19 nt, Human
uguggagauucacaggcug

SEQ ID NO: 343816 - RNA, 21 nt, Human
uguggaugggggagcaggcug

SEQ ID NO: 343817 - RNA, 22 nt, Human
uuaaaaacugccagcuccucuc

SEQ ID NO: 343818 - RNA, 24 nt, Human
uuagaacacggcucccacagaagu

SEQ ID NO: 343819 - RNA, 24 nt, Human
uuauuaccuguuaauuaagaccag

SEQ ID NO: 343820 - RNA, 19 nt, Human
uucuaaccagcuccugaau

SEQ ID NO: 343821 - RNA, 23 nt, Human
uugaagaguacuugaauacaaau

SEQ ID NO: 343822 - RNA, 25 nt, Human
uugcagcaacaggugcucuuccccu

SEQ ID NO: 343823 - RNA, 18 nt, Human
uugcucugcuucauucuu

SEQ ID NO: 343824 - RNA, 21 nt, Human
uugguggugccuaucugauuu

SEQ ID NO: 343825 - RNA, 21 nt, Human
uuugugcaggacagaacacgg

SEQ ID NO: 343826 - RNA, 22 nt, Human
aagaaaaaggacagaaagagaa

SEQ ID NO: 343827 - RNA, 21 nt, Human
aagaacaaucagaaugccagc

SEQ ID NO: 343828 - RNA, 19 nt, Human
accagagcagaggcccaag

SEQ ID NO: 343829 - RNA, 18 nt, Human
agaaaaaagaagagcauc

SEQ ID NO: 343830 - RNA, 18 nt, Human
agaaagagaaaaaagaag

SEQ ID NO: 343831 - RNA, 24 nt, Human
agcaagaaaaaggacagaaagaga

SEQ ID NO: 343832 - RNA, 20 nt, Human
aggcaggggccaugcacacg

SEQ ID NO: 343833 - RNA, 22 nt, Human
auuugggaacaaacaauuauuc

SEQ ID NO: 343834 - RNA, 21 nt, Human
cagagcagaggcccaagaguc

SEQ ID NO: 343835 - RNA, 24 nt, Human
cccaccagagcagaggcccaagag

SEQ ID NO: 343836 - RNA, 22 nt, Human
ccugaaaaaagaacaaucagaa

SEQ ID NO: 343837 - RNA, 21 nt, Human
ccugcagccuguagcggggag

SEQ ID NO: 343838 - RNA, 20 nt, Human
ccuguagcggggagagcugu

SEQ ID NO: 343839 - RNA, 20 nt, Human
gagaaaaaagaagagcauca

SEQ ID NO: 343840 - RNA, 19 nt, Human
gagcaucaguccucuccac

SEQ ID NO: 343841 - RNA, 22 nt, Human
gcaagaaaaaggacagaaagag

SEQ ID NO: 343842 - RNA, 23 nt, Human
ggacagaaagagaaaaaagaaga

SEQ ID NO: 343843 - RNA, 22 nt, Human
uaaaccugaaaaaagaacaauc

SEQ ID NO: 343844 - RNA, 20 nt, Human
uaagcuagagaauagauuau

SEQ ID NO: 343845 - RNA, 23 nt, Human
ucaguccucuccacuucuuccca

SEQ ID NO: 343846 - RNA, 23 nt, Human
ugaggggauauaaacuccaggaa

SEQ ID NO: 343847 - RNA, 19 nt, Human
uggagagccugaagaggca

SEQ ID NO: 343848 - RNA, 19 nt, Human
uggggaggagaauacccgc

SEQ ID NO: 343849 - RNA, 20 nt, Human
aacugaggcugccaacccca

SEQ ID NO: 343850 - RNA, 25 nt, Human
acaaccauccucucccugugucccc

SEQ ID NO: 343851 - RNA, 20 nt, Human
accugcacccccgauggcgc

SEQ ID NO: 343852 - RNA, 20 nt, Human
agagcccaggggaggggcuu

SEQ ID NO: 343853 - RNA, 19 nt, Human
agcaggcgggcucggagcc

SEQ ID NO: 343854 - RNA, 20 nt, Human
agcgggggcggcggcgcggg

SEQ ID NO: 343855 - RNA, 21 nt, Human
aggaagcuacaagagacaggc

SEQ ID NO: 343856 - RNA, 19 nt, Human
aggcgaaggcgcagggcgu

SEQ ID NO: 343857 - RNA, 21 nt, Human
aggcgggcagcgggggcggcg

SEQ ID NO: 343858 - RNA, 23 nt, Human
aggcgggcagcgggggcggcggc

SEQ ID NO: 343859 - RNA, 23 nt, Human
aggugcacuucacggcaggugug

SEQ ID NO: 343860 - RNA, 24 nt, Human
caaccauccucucccugugucccc

SEQ ID NO: 343861 - RNA, 21 nt, Human
caacugaggcugccaacccca

SEQ ID NO: 343862 - RNA, 26 nt, Human
caacugaggcugccaaccccaggggc

SEQ ID NO: 343863 - RNA, 19 nt, Human
caggcucuggccgccucuc

SEQ ID NO: 343864 - RNA, 24 nt, Human
caucacagcagucccaggcuggag

SEQ ID NO: 343865 - RNA, 18 nt, Human
ccacacucucccuggguc

SEQ ID NO: 343866 - RNA, 18 nt, Human
ccaggggccaacugaggc

SEQ ID NO: 343867 - RNA, 19 nt, Human
ccaggggcggggugcaggg

SEQ ID NO: 343868 - RNA, 19 nt, Human
ccagguccacaggucucug

SEQ ID NO: 343869 - RNA, 21 nt, Human
ccagguccacaggucucugcc

SEQ ID NO: 343870 - RNA, 21 nt, Human
ccauagggcugcuggggcccu

SEQ ID NO: 343871 - RNA, 22 nt, Human
ccccagggacaaccauccucuc

SEQ ID NO: 343872 - RNA, 23 nt, Human
ccccagggacaaccauccucucc

SEQ ID NO: 343873 - RNA, 24 nt, Human
ccccaggggcggggugcagggcug

SEQ ID NO: 343874 - RNA, 18 nt, Human
ccccggcccgggggcgga

SEQ ID NO: 343875 - RNA, 18 nt, Human
cccuggguccugggacuc

SEQ ID NO: 343876 - RNA, 20 nt, Human
cccuguguccccugcccccc

SEQ ID NO: 343877 - RNA, 27 nt, Human
ccucggggaaggcgggcagcgggggcg

SEQ ID NO: 343878 - RNA, 21 nt, Human
ccucugccaggggccaacuga

SEQ ID NO: 343879 - RNA, 22 nt, Human
ccugcagcucgggcggcagcgu

SEQ ID NO: 343880 - RNA, 23 nt, Human
ccuguccccacacucucccuggg

SEQ ID NO: 343881 - RNA, 20 nt, Human
ccugugccucccaccccagg

SEQ ID NO: 343882 - RNA, 22 nt, Human
ccugugccucccaccccaggaa

SEQ ID NO: 343883 - RNA, 18 nt, Human
cgcaggaugaccuggaag

SEQ ID NO: 343884 - RNA, 20 nt, Human
cgggcagcgggggcggcggc

SEQ ID NO: 343885 - RNA, 25 nt, Human
cgggggcggcggcgcgggccccggc

SEQ ID NO: 343886 - RNA, 22 nt, Human
cucccaccccaggaagcuacaa

SEQ ID NO: 343887 - RNA, 24 nt, Human
cuccccauucucccugccugggag

SEQ ID NO: 343888 - RNA, 20 nt, Human
cucuggccgccucucccagc

SEQ ID NO: 343889 - RNA, 21 nt, Human
cugccaggggccaacugaggc

SEQ ID NO: 343890 - RNA, 23 nt, Human
cuggaagggcuggugcgccugca

SEQ ID NO: 343891 - RNA, 22 nt, Human
cuguccccacacucucccuggg

SEQ ID NO: 343892 - RNA, 20 nt, Human
cuguccuguccccacacucu

SEQ ID NO: 343893 - RNA, 19 nt, Human
cugugccucccaccccagg

SEQ ID NO: 343894 - RNA, 18 nt, Human
gaccuggaagggcuggug

SEQ ID NO: 343895 - RNA, 27 nt, Human
gagagcccaggggaggggcuugugggc

SEQ ID NO: 343896 - RNA, 25 nt, Human
gagcccaggggaggggcuugugggc

SEQ ID NO: 343897 - RNA, 19 nt, Human
gagccgggcgccucgggga

SEQ ID NO: 343898 - RNA, 23 nt, Human
gcacccccgauggcgccuugacg

SEQ ID NO: 343899 - RNA, 18 nt, Human
gcacuucacggcaggugu

SEQ ID NO: 343900 - RNA, 20 nt, Human
gcagggacagcacagccugg

SEQ ID NO: 343901 - RNA, 19 nt, Human
gccauaggucagcucuggg

SEQ ID NO: 343902 - RNA, 20 nt, Human
gccugggcccccggcagaca

SEQ ID NO: 343903 - RNA, 19 nt, Human
gcgcagccauaggucagcu

SEQ ID NO: 343904 - RNA, 20 nt, Human
gcgcagccauaggucagcuc

SEQ ID NO: 343905 - RNA, 18 nt, Human
gcgccugcagcucgggcg

SEQ ID NO: 343906 - RNA, 20 nt, Human
gcgggcagcgggggcggcgg

SEQ ID NO: 343907 - RNA, 21 nt, Human
gcugccaaccccaggggcggg

SEQ ID NO: 343908 - RNA, 24 nt, Human
ggaagggcuggugcgccugcagcu

SEQ ID NO: 343909 - RNA, 20 nt, Human
ggagagcccaggggaggggc

SEQ ID NO: 343910 - RNA, 22 nt, Human
ggcaggugcuggcauccggggc

SEQ ID NO: 343911 - RNA, 22 nt, Human
ggcccgggggcggagaaggcga

SEQ ID NO: 343912 - RNA, 24 nt, Human
ggcggcggcgcgggccccggcccg

SEQ ID NO: 343913 - RNA, 19 nt, Human
gggaaugucuguguccuug

SEQ ID NO: 343914 - RNA, 18 nt, Human
gggaggggcuugugggcc

SEQ ID NO: 343915 - RNA, 20 nt, Human
gggcagagcucauggccaga

SEQ ID NO: 343916 - RNA, 21 nt, Human
gggccagagggcccuccccag

SEQ ID NO: 343917 - RNA, 23 nt, Human
gggccagagggcccuccccaggg

SEQ ID NO: 343918 - RNA, 23 nt, Human
gggcggcggcgcgggccccggcc

SEQ ID NO: 343919 - RNA, 23 nt, Human
ggggcggcggcgcgggccccggc

SEQ ID NO: 343920 - RNA, 23 nt, Human
ggucgagggucagcccgccaaca

SEQ ID NO: 343921 - RNA, 21 nt, Human
guccuuguuccucugccagga

SEQ ID NO: 343922 - RNA, 18 nt, Human
gugcgggcuggccccagg

SEQ ID NO: 343923 - RNA, 23 nt, Human
guggugucugggaggucgagggu

SEQ ID NO: 343924 - RNA, 20 nt, Human
uaccgcaggaugaccuggaa

SEQ ID NO: 343925 - RNA, 21 nt, Human
uccacaggucucugccagaca

SEQ ID NO: 343926 - RNA, 23 nt, Human
ucccaggcuggaggccccaggcu

SEQ ID NO: 343927 - RNA, 25 nt, Human
uccccugccccccacacugagggaa

SEQ ID NO: 343928 - RNA, 19 nt, Human
ucccugccugggagagccc

SEQ ID NO: 343929 - RNA, 22 nt, Human
ucccuggguccugggacucccu

SEQ ID NO: 343930 - RNA, 18 nt, Human
ucccuguguccccugccc

SEQ ID NO: 343931 - RNA, 22 nt, Human
uccuuguuccucugccaggggc

SEQ ID NO: 343932 - RNA, 23 nt, Human
ucggugaacggguccacccugaa

SEQ ID NO: 343933 - RNA, 18 nt, Human
ucuggccgccucucccag

SEQ ID NO: 343934 - RNA, 18 nt, Human
ugaccuggaagggcuggu

SEQ ID NO: 343935 - RNA, 26 nt, Human
ugaggggcuaagguugccuggggcca

SEQ ID NO: 343936 - RNA, 21 nt, Human
ugcagggacagcacagccugg

SEQ ID NO: 343937 - RNA, 20 nt, Human
ugcagugcaagagagcuggg

SEQ ID NO: 343938 - RNA, 23 nt, Human
ugccccggggcggcaccuggcag

SEQ ID NO: 343939 - RNA, 18 nt, Human
ugccuggggccagagggc

SEQ ID NO: 343940 - RNA, 20 nt, Human
ugccuggggccagagggccc

SEQ ID NO: 343941 - RNA, 18 nt, Human
ugcgccugcagcucgggc

SEQ ID NO: 343942 - RNA, 19 nt, Human
ugcuuugccccugugccuc

SEQ ID NO: 343943 - RNA, 21 nt, Human
ugcuuugccccugugccuccc

SEQ ID NO: 343944 - RNA, 24 nt, Human
uggcaggccuggcccacagaaggc

SEQ ID NO: 343945 - RNA, 22 nt, Human
uggcaggugcuggcauccgggg

SEQ ID NO: 343946 - RNA, 23 nt, Human
uggcaggugcuggcauccggggc

SEQ ID NO: 343947 - RNA, 22 nt, Human
uggcauccggggcuaggcacag

SEQ ID NO: 343948 - RNA, 23 nt, Human
uggcauccggggcuaggcacagc

SEQ ID NO: 343949 - RNA, 19 nt, Human
ugggagagcccaggggagg

SEQ ID NO: 343950 - RNA, 19 nt, Human
ugggaggucgagggucagc

SEQ ID NO: 343951 - RNA, 18 nt, Human
uguggcggucaccauagg

SEQ ID NO: 343952 - RNA, 22 nt, Human
uguguccuuguuccucugccag

SEQ ID NO: 343953 - RNA, 26 nt, Human
uucccugggguauugcuuugccccug

SEQ ID NO: 343954 - RNA, 24 nt, Human
aaaaagaaaaacuggacuaaaaga

SEQ ID NO: 343955 - RNA, 23 nt, Human
aaagccccaccuugcaacaggaa

SEQ ID NO: 343956 - RNA, 24 nt, Human
aaaguuuaaagccccaccuugcaa

SEQ ID NO: 343957 - RNA, 18 nt, Human
aagaaaauggcaacagcu

SEQ ID NO: 343958 - RNA, 22 nt, Human
aagccgagcccgggaaccagga

SEQ ID NO: 343959 - RNA, 23 nt, Human
aagccgagcccgggaaccaggaa

SEQ ID NO: 343960 - RNA, 22 nt, Human
aaugcaguuaguguggcugccc

SEQ ID NO: 343961 - RNA, 20 nt, Human
acaaauauaugagagggaaa

SEQ ID NO: 343962 - RNA, 21 nt, Human
acauacacuacauauagccuu

SEQ ID NO: 343963 - RNA, 24 nt, Human
accacacugcuaaugcaguuagug

SEQ ID NO: 343964 - RNA, 21 nt, Human
acgaagucauacucucuugga

SEQ ID NO: 343965 - RNA, 22 nt, Human
agaaaaacauaaccggaacuga

SEQ ID NO: 343966 - RNA, 23 nt, Human
agcuggcggucccgggcggccga

SEQ ID NO: 343967 - RNA, 23 nt, Human
agggaucaguaagcugcaacuuc

SEQ ID NO: 343968 - RNA, 23 nt, Human
agguuuuggagaaaaacauaacc

SEQ ID NO: 343969 - RNA, 19 nt, Human
auauauauauauauauaua

SEQ ID NO: 343970 - RNA, 27 nt, Human
auuuuuugcauauauauauauauauau

SEQ ID NO: 343971 - RNA, 20 nt, Human
caacagaguaaaaauguuca

SEQ ID NO: 343972 - RNA, 18 nt, Human
caauguagguuucacgug

SEQ ID NO: 343973 - RNA, 20 nt, Human
cacacugcuaaugcaguuag

SEQ ID NO: 343974 - RNA, 25 nt, Human
cacugcugcaccuuuggccguaaac

SEQ ID NO: 343975 - RNA, 20 nt, Human
cagaagaaagaaguaaccac

SEQ ID NO: 343976 - RNA, 21 nt, Human
cagaccagaacaaagggcaca

SEQ ID NO: 343977 - RNA, 21 nt, Human
caggaagaaacaucaaugucg

SEQ ID NO: 343978 - RNA, 22 nt, Human
caggaagaaacaucaaugucgg

SEQ ID NO: 343979 - RNA, 24 nt, Human
caguaagcugcaacuucuccugcu

SEQ ID NO: 343980 - RNA, 18 nt, Human
ccauuguuucccuuccaa

SEQ ID NO: 343981 - RNA, 20 nt, Human
cccagguuacaaauauauga

SEQ ID NO: 343982 - RNA, 22 nt, Human
cgaagccgagcccgggaaccag

SEQ ID NO: 343983 - RNA, 22 nt, Human
cgacuacauuccauaaagagga

SEQ ID NO: 343984 - RNA, 21 nt, Human
cguuucaauguaguguuuagc

SEQ ID NO: 343985 - RNA, 20 nt, Human
cucaucuuaagcagcaucua

SEQ ID NO: 343986 - RNA, 24 nt, Human
cuccgccccauuguuucccuucca

SEQ ID NO: 343987 - RNA, 19 nt, Human
cuuguguguauauauauau

SEQ ID NO: 343988 - RNA, 18 nt, Human
gaacagaugccuauaucu

SEQ ID NO: 343989 - RNA, 18 nt, Human
gaagaaagaaguaaccac

SEQ ID NO: 343990 - RNA, 18 nt, Human
gacacauacacuacauau

SEQ ID NO: 343991 - RNA, 21 nt, Human
gagcuggcggucccgggcggc

SEQ ID NO: 343992 - RNA, 18 nt, Human
gcaauguugaaaacaagc

SEQ ID NO: 343993 - RNA, 18 nt, Human
gcagcggacagagcuggc

SEQ ID NO: 343994 - RNA, 19 nt, Human
gcggcgcggcggcggcggc

SEQ ID NO: 343995 - RNA, 24 nt, Human
gcggcggcggcggcggcuaccgca

SEQ ID NO: 343996 - RNA, 21 nt, Human
gcuaaugcaguuaguguggcu

SEQ ID NO: 343997 - RNA, 20 nt, Human
ggagcagcucagauacugcu

SEQ ID NO: 343998 - RNA, 18 nt, Human
ggcagcggacagagcugg

SEQ ID NO: 343999 - RNA, 19 nt, Human
ggcgaagccgagcccgggg

SEQ ID NO: 344000 - RNA, 24 nt, Human
ggcgcggcgcggcggcggcggcgg

SEQ ID NO: 344001 - RNA, 21 nt, Human
ggcggccgagcagauccggcg

SEQ ID NO: 344002 - RNA, 21 nt, Human
gggcacaaacgcacuaagacc

SEQ ID NO: 344003 - RNA, 19 nt, Human
guguggcugccccacauga

SEQ ID NO: 344004 - RNA, 21 nt, Human
uaaaagacaaggaaaacaaga

SEQ ID NO: 344005 - RNA, 23 nt, Human
uaaaccaaaaucugcuguccaag

SEQ ID NO: 344006 - RNA, 21 nt, Human
uaaacuaaauuguacagcuug

SEQ ID NO: 344007 - RNA, 19 nt, Human
uaaaugcuauugcgauguu

SEQ ID NO: 344008 - RNA, 22 nt, Human
uaacauggacaauguaauggcc

SEQ ID NO: 344009 - RNA, 18 nt, Human
uaauuuuaacauggacaa

SEQ ID NO: 344010 - RNA, 19 nt, Human
uauauauauauauauauau

SEQ ID NO: 344011 - RNA, 25 nt, Human
uauauauauuuuuugcauauauaua

SEQ ID NO: 344012 - RNA, 18 nt, Human
uaugaacauagcaaugua

SEQ ID NO: 344013 - RNA, 21 nt, Human
ucaaaauagaaugagccaaca

SEQ ID NO: 344014 - RNA, 24 nt, Human
ucacuaauuuuuuuuuaagccaag

SEQ ID NO: 344015 - RNA, 22 nt, Human
ucagaccagaacaaagggcaca

SEQ ID NO: 344016 - RNA, 18 nt, Human
ucaguuuaggacccaggu

SEQ ID NO: 344017 - RNA, 18 nt, Human
ucgaggcagaagaaagaa

SEQ ID NO: 344018 - RNA, 27 nt, Human
ucgaggcagaagaaagaaguaaccaca

SEQ ID NO: 344019 - RNA, 23 nt, Human
ucgcaagagucagaccagaacaa

SEQ ID NO: 344020 - RNA, 18 nt, Human
ucuacaguuuuuucagua

SEQ ID NO: 344021 - RNA, 21 nt, Human
ugaaacgcucaucuuaagcag

SEQ ID NO: 344022 - RNA, 24 nt, Human
ugaacagaugccuauauuguaaua

SEQ ID NO: 344023 - RNA, 18 nt, Human
ugaaggagaaugaugagc

SEQ ID NO: 344024 - RNA, 20 nt, Human
ugaaggagaaugaugagcau

SEQ ID NO: 344025 - RNA, 23 nt, Human
ugagagggaaaaagaaaaacugg

SEQ ID NO: 344026 - RNA, 21 nt, Human
ugaggugcagcaauauccguc

SEQ ID NO: 344027 - RNA, 19 nt, Human
ugauaagcacugcugcacc

SEQ ID NO: 344028 - RNA, 19 nt, Human
ugcauauauauauauauau

SEQ ID NO: 344029 - RNA, 20 nt, Human
ugcauauauauauauauaua

SEQ ID NO: 344030 - RNA, 20 nt, Human
ugcauauauauauauauaua

SEQ ID NO: 344031 - RNA, 23 nt, Human
ugcccuccgccccauuguuuccc

SEQ ID NO: 344032 - RNA, 21 nt, Human
uggaaaugggucugaauguug

SEQ ID NO: 344033 - RNA, 21 nt, Human
uggagaaaaacauaaccggaa

SEQ ID NO: 344034 - RNA, 19 nt, Human
ugugggcagcggacagagc

SEQ ID NO: 344035 - RNA, 18 nt, Human
uguguguauauauauauu

SEQ ID NO: 344036 - RNA, 24 nt, Human
uuaccaaguugaucaaaauuacau

SEQ ID NO: 344037 - RNA, 21 nt, Human
uucaaauguggaugaacagau

SEQ ID NO: 344038 - RNA, 19 nt, Human
uucagguuuuggagaaaaa

SEQ ID NO: 344039 - RNA, 22 nt, Human
uuguuucaaugaaaaaaaaaaa

SEQ ID NO: 344040 - RNA, 20 nt, Human
uuuaaaagaucaaaauccua

SEQ ID NO: 344041 - RNA, 22 nt, Human
uuuaaagccccaccuugcaaca

SEQ ID NO: 344042 - RNA, 19 nt, Human
uuugcauauauauauauau

SEQ ID NO: 344043 - RNA, 20 nt, Human
uuuuaagcaccauuaagugg

SEQ ID NO: 344044 - RNA, 20 nt, Human
aaaaccaaaaaaaaaaaaaa

SEQ ID NO: 344045 - RNA, 23 nt, Human
aaacaacaacaauaaaaacccaa

SEQ ID NO: 344046 - RNA, 22 nt, Human
aaaugaacaaguuugguuuugg

SEQ ID NO: 344047 - RNA, 22 nt, Human
aacaacaaagagccgaggcaga

SEQ ID NO: 344048 - RNA, 22 nt, Human
aacaacaacaauaaaaacccaa

SEQ ID NO: 344049 - RNA, 18 nt, Human
aacauuuuaucuggcguc

SEQ ID NO: 344050 - RNA, 18 nt, Human
aaccauccaaagcgaaca

SEQ ID NO: 344051 - RNA, 19 nt, Human
aagaggaauaaaaacgaca

SEQ ID NO: 344052 - RNA, 19 nt, Human
aagcgaacaacaaagagcc

SEQ ID NO: 344053 - RNA, 24 nt, Human
aaugaagccaaaauaaaauaccac

SEQ ID NO: 344054 - RNA, 18 nt, Human
acaacaacaauaaaaacc

SEQ ID NO: 344055 - RNA, 23 nt, Human
accacacacaaaggcuuaauaua

SEQ ID NO: 344056 - RNA, 19 nt, Human
accccagcuccucccggau

SEQ ID NO: 344057 - RNA, 19 nt, Human
acucgcacgucuucugggc

SEQ ID NO: 344058 - RNA, 18 nt, Human
agaaccauuugguucaug

SEQ ID NO: 344059 - RNA, 23 nt, Human
agaggagggaguggaaauagggu

SEQ ID NO: 344060 - RNA, 19 nt, Human
agcccaaacuuccuggggg

SEQ ID NO: 344061 - RNA, 21 nt, Human
agcgaacaacaaagagccgag

SEQ ID NO: 344062 - RNA, 18 nt, Human
agcuccucccggaucagc

SEQ ID NO: 344063 - RNA, 19 nt, Human
aggagggaguggaaauagg

SEQ ID NO: 344064 - RNA, 21 nt, Human
aggcagaagcgcaguagugcc

SEQ ID NO: 344065 - RNA, 23 nt, Human
agggcaucauuugucaauugaaa

SEQ ID NO: 344066 - RNA, 23 nt, Human
agggggcggugcggcgacagcgg

SEQ ID NO: 344067 - RNA, 18 nt, Human
auacaaacauagagcauu

SEQ ID NO: 344068 - RNA, 23 nt, Human
auaucccaauaagaggaauaaaa

SEQ ID NO: 344069 - RNA, 18 nt, Human
aucauuugucaauugaaa

SEQ ID NO: 344070 - RNA, 25 nt, Human
caaaaaaggaucauagaaaucuacu

SEQ ID NO: 344071 - RNA, 18 nt, Human
caagaggagggaguggaa

SEQ ID NO: 344072 - RNA, 21 nt, Human
caccccuggcucguggaagcu

SEQ ID NO: 344073 - RNA, 22 nt, Human
cagaggaagaauuccaagguuu

SEQ ID NO: 344074 - RNA, 18 nt, Human
cagcgggccacccgcggc

SEQ ID NO: 344075 - RNA, 19 nt, Human
cagcucccggcucuccccg

SEQ ID NO: 344076 - RNA, 21 nt, Human
cauccaaagcgaacaacaaag

SEQ ID NO: 344077 - RNA, 22 nt, Human
ccaaaauaaaauaccaccaggg

SEQ ID NO: 344078 - RNA, 20 nt, Human
ccauccaaagcgaacaacaa

SEQ ID NO: 344079 - RNA, 25 nt, Human
ccaucugucauuauucaaauauucc

SEQ ID NO: 344080 - RNA, 24 nt, Human
cccaaauguaugaagccacacacc

SEQ ID NO: 344081 - RNA, 23 nt, Human
cccagccccgcgcggcgcccaac

SEQ ID NO: 344082 - RNA, 27 nt, Human
ccccacaaugugcggccgagcgccgcu

SEQ ID NO: 344083 - RNA, 19 nt, Human
cccccacaaugugcggccg

SEQ ID NO: 344084 - RNA, 19 nt, Human
ccccuaaacuacgcagaag

SEQ ID NO: 344085 - RNA, 23 nt, Human
ccccuaaacuacgcagaagccca

SEQ ID NO: 344086 - RNA, 21 nt, Human
ccgcugcgagggcaggcgcgg

SEQ ID NO: 344087 - RNA, 20 nt, Human
cgaggggaauaggaaggcuc

SEQ ID NO: 344088 - RNA, 22 nt, Human
cgcccccagccccgcgcggcgc

SEQ ID NO: 344089 - RNA, 21 nt, Human
cggcaaaaugcaaaagaacag

SEQ ID NO: 344090 - RNA, 20 nt, Human
cgggguggcagagaagggcc

SEQ ID NO: 344091 - RNA, 21 nt, Human
cuagacaaccagagauccaac

SEQ ID NO: 344092 - RNA, 21 nt, Human
cucaccccagcuccucccgga

SEQ ID NO: 344093 - RNA, 19 nt, Human
cucggccccucgcccucuc

SEQ ID NO: 344094 - RNA, 19 nt, Human
gaacugacacuaccagaag

SEQ ID NO: 344095 - RNA, 23 nt, Human
gaauaaauguacauuuuuuucuu

SEQ ID NO: 344096 - RNA, 20 nt, Human
gacaauuuguacacucugau

SEQ ID NO: 344097 - RNA, 18 nt, Human
gagagcgagcgagggggc

SEQ ID NO: 344098 - RNA, 18 nt, Human
gaggaagggcucggggug

SEQ ID NO: 344099 - RNA, 19 nt, Human
gaggaggcucagacacuuu

SEQ ID NO: 344100 - RNA, 21 nt, Human
gaggaggcucagacacuuuca

SEQ ID NO: 344101 - RNA, 19 nt, Human
gaggggaauaggaaggcuc

SEQ ID NO: 344102 - RNA, 18 nt, Human
gccaaaguagaagcagcg

SEQ ID NO: 344103 - RNA, 20 nt, Human
gcccucggccccucgcccuc

SEQ ID NO: 344104 - RNA, 21 nt, Human
gcccucggccccucgcccucu

SEQ ID NO: 344105 - RNA, 18 nt, Human
gccgcggcucaccccagc

SEQ ID NO: 344106 - RNA, 23 nt, Human
gcggcgacagcggcugccugggc

SEQ ID NO: 344107 - RNA, 21 nt, Human
gcucguggaagcuguaaagag

SEQ ID NO: 344108 - RNA, 18 nt, Human
gcugccugggcgggcccu

SEQ ID NO: 344109 - RNA, 23 nt, Human
ggcagagaggaugcugcugcggg

SEQ ID NO: 344110 - RNA, 18 nt, Human
ggcgcggcggcggcggca

SEQ ID NO: 344111 - RNA, 18 nt, Human
ggcggcggcgauagcagc

SEQ ID NO: 344112 - RNA, 18 nt, Human
ggcucggggugccgggag

SEQ ID NO: 344113 - RNA, 20 nt, Human
ggggaugcggaggguacugg

SEQ ID NO: 344114 - RNA, 22 nt, Human
gguacuggagacagcagcagga

SEQ ID NO: 344115 - RNA, 18 nt, Human
gucauuaaaaacauccac

SEQ ID NO: 344116 - RNA, 21 nt, Human
guuaaaaacgcuucucaacaa

SEQ ID NO: 344117 - RNA, 23 nt, Human
uaaaauaccaccaggguuugcaa

SEQ ID NO: 344118 - RNA, 25 nt, Human
uaaagaggcagcucccggcucuccc

SEQ ID NO: 344119 - RNA, 22 nt, Human
uacuuugagagcccuugugagg

SEQ ID NO: 344120 - RNA, 22 nt, Human
uagaagcagcagcuccggagga

SEQ ID NO: 344121 - RNA, 19 nt, Human
uagagcauuaacaaaacag

SEQ ID NO: 344122 - RNA, 19 nt, Human
uauaagcagugcaaugcca

SEQ ID NO: 344123 - RNA, 23 nt, Human
uaucuaugaauaaauguacauuu

SEQ ID NO: 344124 - RNA, 20 nt, Human
uauggcuaaaaauaaggggc

SEQ ID NO: 344125 - RNA, 18 nt, Human
ucaaugauugaaaugaag

SEQ ID NO: 344126 - RNA, 18 nt, Human
uccccgggguggcagaga

SEQ ID NO: 344127 - RNA, 20 nt, Human
ucccggcgugcgcccccaca

SEQ ID NO: 344128 - RNA, 20 nt, Human
uccgaggaggcucagacacu

SEQ ID NO: 344129 - RNA, 22 nt, Human
ucuucugggcgcccccagcccu

SEQ ID NO: 344130 - RNA, 22 nt, Human
ucuugcuggcugaugacugaag

SEQ ID NO: 344131 - RNA, 22 nt, Human
ugaaaaacugauuuugaaauca

SEQ ID NO: 344132 - RNA, 23 nt, Human
ugaaaguugaacugacacuacca

SEQ ID NO: 344133 - RNA, 22 nt, Human
ugaagccacacaccacacacaa

SEQ ID NO: 344134 - RNA, 18 nt, Human
ugacugaagcaagaaguc

SEQ ID NO: 344135 - RNA, 21 nt, Human
ugauacuuaucuaucuaugaa

SEQ ID NO: 344136 - RNA, 19 nt, Human
ugauugaaaugaagccaaa

SEQ ID NO: 344137 - RNA, 23 nt, Human
ugcaaagaguaaauauuuacaau

SEQ ID NO: 344138 - RNA, 23 nt, Human
ugcauguuacuucaccaucuguc

SEQ ID NO: 344139 - RNA, 25 nt, Human
ugccaagaggagggaguggaaauag

SEQ ID NO: 344140 - RNA, 18 nt, Human
ugccugggcgggcccuug

SEQ ID NO: 344141 - RNA, 19 nt, Human
ugcggccgagcgccgcugc

SEQ ID NO: 344142 - RNA, 23 nt, Human
ugcugagggagggccaaaaagug

SEQ ID NO: 344143 - RNA, 18 nt, Human
uggauuuucaguaugcaa

SEQ ID NO: 344144 - RNA, 19 nt, Human
uggcagagaagggcagaga

SEQ ID NO: 344145 - RNA, 20 nt, Human
ugggagagacggccgccgcg

SEQ ID NO: 344146 - RNA, 21 nt, Human
ugggggaugcggaggguacug

SEQ ID NO: 344147 - RNA, 22 nt, Human
ugggucaauuagccaagaguuu

SEQ ID NO: 344148 - RNA, 23 nt, Human
ugugguucaguuuuguuuggcuu

SEQ ID NO: 344149 - RNA, 19 nt, Human
uguuuuaauuugcauuagc

SEQ ID NO: 344150 - RNA, 24 nt, Human
uuagcccuacuuauccaaaaguac

SEQ ID NO: 344151 - RNA, 23 nt, Human
uucauaaaaugacaaaaaaggau

SEQ ID NO: 344152 - RNA, 22 nt, Human
uuuacuagguuuacuuaugaca

SEQ ID NO: 344153 - RNA, 18 nt, Human
uuugcauuagcaguuggc

SEQ ID NO: 344154 - RNA, 18 nt, Human
uuuguaggguuagggauc

SEQ ID NO: 344155 - RNA, 24 nt, Human
uuugugguucugcauuugcuauau

SEQ ID NO: 344156 - RNA, 24 nt, Human
uuuuucaaauuaucuaaaugaaca

SEQ ID NO: 344157 - RNA, 23 nt, Human
aaaaaaaaacaaaaacaaaaaaa

SEQ ID NO: 344158 - RNA, 21 nt, Human
aaaaaacaaaaacaaaaaaaa

SEQ ID NO: 344159 - RNA, 23 nt, Human
aaacaaaaacaaaaaaaaaacuu

SEQ ID NO: 344160 - RNA, 22 nt, Human
aaacuccaacauuauggcuuua

SEQ ID NO: 344161 - RNA, 19 nt, Human
aaagugcuaggauuacagg

SEQ ID NO: 344162 - RNA, 25 nt, Human
aaccuguugcuucaaaggagcccag

SEQ ID NO: 344163 - RNA, 19 nt, Human
aaguagcugggauuacagg

SEQ ID NO: 344164 - RNA, 23 nt, Human
aaguagcugggauuacaggccac

SEQ ID NO: 344165 - RNA, 26 nt, Human
aagugcuaggauuacaggcguaagcc

SEQ ID NO: 344166 - RNA, 21 nt, Human
aaucauuguugguucaaccug

SEQ ID NO: 344167 - RNA, 20 nt, Human
aauccauucccagauucuuc

SEQ ID NO: 344168 - RNA, 20 nt, Human
acaggccaccaccaucaugc

SEQ ID NO: 344169 - RNA, 22 nt, Human
acaggccaccaccaucaugccc

SEQ ID NO: 344170 - RNA, 18 nt, Human
acaggcguaagccaccau

SEQ ID NO: 344171 - RNA, 23 nt, Human
acauauauguaugaguguaugua

SEQ ID NO: 344172 - RNA, 25 nt, Human
accauccauuauuguuucuauaacc

SEQ ID NO: 344173 - RNA, 24 nt, Human
accauugcugcauauuguugcagu

SEQ ID NO: 344174 - RNA, 19 nt, Human
acccgcacucaggcuccuc

SEQ ID NO: 344175 - RNA, 23 nt, Human
accgccccgcccucuggggcccc

SEQ ID NO: 344176 - RNA, 22 nt, Human
accucaggugauccgcccgucu

SEQ ID NO: 344177 - RNA, 22 nt, Human
accucaggugauccgcccgucu

SEQ ID NO: 344178 - RNA, 18 nt, Human
acggaguuucacuauguu

SEQ ID NO: 344179 - RNA, 24 nt, Human
acggaguuucacuauguugggcag

SEQ ID NO: 344180 - RNA, 24 nt, Human
acuauguugggcaggcuggucuug

SEQ ID NO: 344181 - RNA, 19 nt, Human
acugcaaccaccgucuccu

SEQ ID NO: 344182 - RNA, 24 nt, Human
acuucauaauauaaaaaaaaacaa

SEQ ID NO: 344183 - RNA, 19 nt, Human
agcaccgcccccgaaccac

SEQ ID NO: 344184 - RNA, 24 nt, Human
agcgauucuccugucucagccucc

SEQ ID NO: 344185 - RNA, 18 nt, Human
aggcugaagcccaggccu

SEQ ID NO: 344186 - RNA, 25 nt, Human
aggcuggagugcaguggcucgaucu

SEQ ID NO: 344187 - RNA, 22 nt, Human
aggugauccgcccgucuuggcc

SEQ ID NO: 344188 - RNA, 24 nt, Human
aggugauccgcccgucuuggccuc

SEQ ID NO: 344189 - RNA, 21 nt, Human
agugcaguggcucgaucuucg

SEQ ID NO: 344190 - RNA, 18 nt, Human
auauauauauauauaugu

SEQ ID NO: 344191 - RNA, 24 nt, Human
caaaauggguaaaguugccuauca

SEQ ID NO: 344192 - RNA, 24 nt, Human
caaagugcuaggauuacaggcgua

SEQ ID NO: 344193 - RNA, 22 nt, Human
caagcgauucuccugucucagc

SEQ ID NO: 344194 - RNA, 26 nt, Human
caauaauacuuuaaaaacauuuguua

SEQ ID NO: 344195 - RNA, 20 nt, Human
caccucaggugauccgcccg

SEQ ID NO: 344196 - RNA, 24 nt, Human
cacuauguugggcaggcuggucuu

SEQ ID NO: 344197 - RNA, 23 nt, Human
cacugcaaccaccgucuccuggg

SEQ ID NO: 344198 - RNA, 21 nt, Human
cagaugauguauuuaaauauc

SEQ ID NO: 344199 - RNA, 18 nt, Human
cagcugcccaggcuggag

SEQ ID NO: 344200 - RNA, 21 nt, Human
caggggcccgcccggcccagc

SEQ ID NO: 344201 - RNA, 24 nt, Human
cagguacacaggaaugagugauau

SEQ ID NO: 344202 - RNA, 21 nt, Human
cauauauccuuagucuaucaa

SEQ ID NO: 344203 - RNA, 24 nt, Human
caucaaggauauauuaguuccaac

SEQ ID NO: 344204 - RNA, 21 nt, Human
caugcccggcuaauuuuugua

SEQ ID NO: 344205 - RNA, 20 nt, Human
ccaaagugcuaggauuacag

SEQ ID NO: 344206 - RNA, 22 nt, Human
ccaaagugcuaggauuacaggc

SEQ ID NO: 344207 - RNA, 24 nt, Human
ccaaagugcuaggauuacaggcgu

SEQ ID NO: 344208 - RNA, 21 nt, Human
ccagcccggcccggcccugcc

SEQ ID NO: 344209 - RNA, 21 nt, Human
ccauggucgccgccggccgcc

SEQ ID NO: 344210 - RNA, 23 nt, Human
cccaaguagcugggauuacaggc

SEQ ID NO: 344211 - RNA, 19 nt, Human
cccaggcuggagugcagug

SEQ ID NO: 344212 - RNA, 18 nt, Human
cccccgaaccaccagcuc

SEQ ID NO: 344213 - RNA, 20 nt, Human
cccccgaaccaccagcuccg

SEQ ID NO: 344214 - RNA, 20 nt, Human
ccccgccugggggcugcucc

SEQ ID NO: 344215 - RNA, 21 nt, Human
ccccgggaggcugaagcccag

SEQ ID NO: 344216 - RNA, 24 nt, Human
ccccucagucagauucgcgccgcc

SEQ ID NO: 344217 - RNA, 23 nt, Human
cccgcccucuggggccccgggag

SEQ ID NO: 344218 - RNA, 23 nt, Human
cccggcccggcccugccgggagc

SEQ ID NO: 344219 - RNA, 22 nt, Human
cccgucuuggccucccaaagug

SEQ ID NO: 344220 - RNA, 20 nt, Human
cccucagucagauucgcgcc

SEQ ID NO: 344221 - RNA, 19 nt, Human
ccgcacucaggcuccucgc

SEQ ID NO: 344222 - RNA, 21 nt, Human
ccgccgcggcccggaccgccc

SEQ ID NO: 344223 - RNA, 21 nt, Human
ccgcugccauggucgccgccg

SEQ ID NO: 344224 - RNA, 24 nt, Human
ccggcccggcccugccgggagcgg

SEQ ID NO: 344225 - RNA, 18 nt, Human
ccgggacuccacccgggc

SEQ ID NO: 344226 - RNA, 24 nt, Human
ccucaccucaggugauccgcccgu

SEQ ID NO: 344227 - RNA, 21 nt, Human
ccucucuguugaagcuagaaa

SEQ ID NO: 344228 - RNA, 18 nt, Human
ccugggccacuacggccg

SEQ ID NO: 344229 - RNA, 23 nt, Human
ccuggguucaagcgauucuccug

SEQ ID NO: 344230 - RNA, 23 nt, Human
cgagugcccgcaggaguccucgg

SEQ ID NO: 344231 - RNA, 19 nt, Human
cgccgccaccgccgcggcc

SEQ ID NO: 344232 - RNA, 20 nt, Human
cgccgccaccgccgcggccc

SEQ ID NO: 344233 - RNA, 22 nt, Human
cgcuggacccgcacucaggcuc

SEQ ID NO: 344234 - RNA, 24 nt, Human
cggagucuuguucagcugcccagg

SEQ ID NO: 344235 - RNA, 21 nt, Human
cggcccugccgggagcggcgg

SEQ ID NO: 344236 - RNA, 22 nt, Human
cgggcccaccgccugccucuag

SEQ ID NO: 344237 - RNA, 25 nt, Human
cuaaaauacugccacacacagcugc

SEQ ID NO: 344238 - RNA, 18 nt, Human
cuauauauauauauauau

SEQ ID NO: 344239 - RNA, 19 nt, Human
cuauauauauauauauaua

SEQ ID NO: 344240 - RNA, 24 nt, Human
cucacugcaaccaccgucuccugg

SEQ ID NO: 344241 - RNA, 24 nt, Human
cucagccucccaaguagcugggau

SEQ ID NO: 344242 - RNA, 18 nt, Human
cucaggucccgcagccuc

SEQ ID NO: 344243 - RNA, 21 nt, Human
cuccacccgggcccaccgccu

SEQ ID NO: 344244 - RNA, 24 nt, Human
cuccacccgggcccaccgccugcc

SEQ ID NO: 344245 - RNA, 21 nt, Human
cuccuggguucaagcgauucu

SEQ ID NO: 344246 - RNA, 20 nt, Human
cucggggccuagcaccgccc

SEQ ID NO: 344247 - RNA, 23 nt, Human
cugcaaccaccgucuccuggguu

SEQ ID NO: 344248 - RNA, 24 nt, Human
cugcccaggcuggagugcaguggc

SEQ ID NO: 344249 - RNA, 22 nt, Human
cugcguaaacuguaacuuugac

SEQ ID NO: 344250 - RNA, 23 nt, Human
cugucucagccucccaaguagcu

SEQ ID NO: 344251 - RNA, 23 nt, Human
gaggcugaagcccaggccugggc

SEQ ID NO: 344252 - RNA, 19 nt, Human
gauuacaggccaccaccau

SEQ ID NO: 344253 - RNA, 18 nt, Human
gauuacaggcguaagcca

SEQ ID NO: 344254 - RNA, 21 nt, Human
gauuacaggcguaagccacca

SEQ ID NO: 344255 - RNA, 24 nt, Human
gauuacaggcguaagccaccaugc

SEQ ID NO: 344256 - RNA, 19 nt, Human
gcaaccaccgucuccuggg

SEQ ID NO: 344257 - RNA, 24 nt, Human
gcgauucuccugucucagccuccc

SEQ ID NO: 344258 - RNA, 20 nt, Human
gcugcccaggcuggagugca

SEQ ID NO: 344259 - RNA, 19 nt, Human
gcuggagugcaguggcucg

SEQ ID NO: 344260 - RNA, 23 nt, Human
ggagucuuguucagcugcccagg

SEQ ID NO: 344261 - RNA, 23 nt, Human
ggaguuucacuauguugggcagg

SEQ ID NO: 344262 - RNA, 24 nt, Human
ggauuacaggccaccaccaucaug

SEQ ID NO: 344263 - RNA, 22 nt, Human
ggauuacaggcguaagccacca

SEQ ID NO: 344264 - RNA, 24 nt, Human
ggauuacaggcguaagccaccaug

SEQ ID NO: 344265 - RNA, 19 nt, Human
ggcuggagugcaguggcuc

SEQ ID NO: 344266 - RNA, 24 nt, Human
ggcuggucuugaacuccucaccuc

SEQ ID NO: 344267 - RNA, 19 nt, Human
gggaacagacggcgucccc

SEQ ID NO: 344268 - RNA, 21 nt, Human
gguagccagcaaauuuaaagc

SEQ ID NO: 344269 - RNA, 23 nt, Human
ggugauccgcccgucuuggccuc

SEQ ID NO: 344270 - RNA, 26 nt, Human
guacuauauauauauauauauaugug

SEQ ID NO: 344271 - RNA, 18 nt, Human
guagagacggaguuucac

SEQ ID NO: 344272 - RNA, 22 nt, Human
guagagacggaguuucacuaug

SEQ ID NO: 344273 - RNA, 18 nt, Human
guagcugggauuacaggc

SEQ ID NO: 344274 - RNA, 24 nt, Human
gucuuguucagcugcccaggcugg

SEQ ID NO: 344275 - RNA, 25 nt, Human
guguguuuauauauauauacacaga

SEQ ID NO: 344276 - RNA, 25 nt, Human
uaaaaaaaaacaaaaacaaaaaaaa

SEQ ID NO: 344277 - RNA, 22 nt, Human
uaaaaagaguugaaugaauaau

SEQ ID NO: 344278 - RNA, 19 nt, Human
uaagugccuuugaggccac

SEQ ID NO: 344279 - RNA, 21 nt, Human
uaagugccuuugaggccacuu

SEQ ID NO: 344280 - RNA, 22 nt, Human
uaauacuuuaaaaacauuuguu

SEQ ID NO: 344281 - RNA, 23 nt, Human
uaauuuuuguauauugguagaga

SEQ ID NO: 344282 - RNA, 22 nt, Human
uacacaguauaauggucacuuc

SEQ ID NO: 344283 - RNA, 23 nt, Human
uacagacagggcugagacuuuga

SEQ ID NO: 344284 - RNA, 23 nt, Human
uacaggccaccaccaucaugccc

SEQ ID NO: 344285 - RNA, 22 nt, Human
uacaggcguaagccaccaugcc

SEQ ID NO: 344286 - RNA, 21 nt, Human
uacuaaaauacugccacacac

SEQ ID NO: 344287 - RNA, 24 nt, Human
uacugaggucuguaaaaagaguug

SEQ ID NO: 344288 - RNA, 22 nt, Human
uagagacggaguuucacuaugu

SEQ ID NO: 344289 - RNA, 22 nt, Human
uagcaccgcccccgaaccacca

SEQ ID NO: 344290 - RNA, 23 nt, Human
uagccuuuaacucuucucaaucc

SEQ ID NO: 344291 - RNA, 22 nt, Human
uaggauuacaggcguaagccac

SEQ ID NO: 344292 - RNA, 24 nt, Human
uaggauuacaggcguaagccacca

SEQ ID NO: 344293 - RNA, 25 nt, Human
uaggauuacaggcguaagccaccau

SEQ ID NO: 344294 - RNA, 21 nt, Human
uaguggaauccauucccagau

SEQ ID NO: 344295 - RNA, 19 nt, Human
uauauauauauauauauau

SEQ ID NO: 344296 - RNA, 19 nt, Human
uauauauauaugugugugu

SEQ ID NO: 344297 - RNA, 24 nt, Human
uauauauauguguguguguuuaua

SEQ ID NO: 344298 - RNA, 20 nt, Human
uauauguaugaguguaugua

SEQ ID NO: 344299 - RNA, 23 nt, Human
uaucagucucucaggaaaauaua

SEQ ID NO: 344300 - RNA, 23 nt, Human
uaucaugaagcauuaggaaacug

SEQ ID NO: 344301 - RNA, 24 nt, Human
uauguugggcaggcuggucuugaa

SEQ ID NO: 344302 - RNA, 19 nt, Human
uauuacagggaaaagggga

SEQ ID NO: 344303 - RNA, 26 nt, Human
ucaaauuaagugccuuugaggcccug

SEQ ID NO: 344304 - RNA, 24 nt, Human
ucaauaucacuguaguggaaucca

SEQ ID NO: 344305 - RNA, 20 nt, Human
ucacagacuaauacugaggu

SEQ ID NO: 344306 - RNA, 18 nt, Human
ucaccucaggugauccgc

SEQ ID NO: 344307 - RNA, 24 nt, Human
ucaccucaggugauccgcccgucu

SEQ ID NO: 344308 - RNA, 22 nt, Human
ucacuauguugggcaggcuggu

SEQ ID NO: 344309 - RNA, 24 nt, Human
ucacugcaaccaccgucuccuggg

SEQ ID NO: 344310 - RNA, 18 nt, Human
ucagccucccaaguagcu

SEQ ID NO: 344311 - RNA, 19 nt, Human
ucagcugcccaggcuggag

SEQ ID NO: 344312 - RNA, 21 nt, Human
uccacaaagcuaguuuacauc

SEQ ID NO: 344313 - RNA, 24 nt, Human
ucccaaagugcuaggauuacaggc

SEQ ID NO: 344314 - RNA, 24 nt, Human
ucccaaguagcugggauuacaggc

SEQ ID NO: 344315 - RNA, 21 nt, Human
uccuggguucaagcgauucuc

SEQ ID NO: 344316 - RNA, 24 nt, Human
uccuggguucaagcgauucuccug

SEQ ID NO: 344317 - RNA, 24 nt, Human
ucuccuggguucaagcgauucucc

SEQ ID NO: 344318 - RNA, 26 nt, Human
ucuccugucucagccucccaaguagc

SEQ ID NO: 344319 - RNA, 23 nt, Human
ucuuguucagcugcccaggcugg

SEQ ID NO: 344320 - RNA, 24 nt, Human
ucuuguucagcugcccaggcugga

SEQ ID NO: 344321 - RNA, 22 nt, Human
ugcccaggcuggagugcagugg

SEQ ID NO: 344322 - RNA, 25 nt, Human
ugcccaggcuggagugcaguggcuc

SEQ ID NO: 344323 - RNA, 22 nt, Human
ugcccgcaggaguccucgggcg

SEQ ID NO: 344324 - RNA, 18 nt, Human
ugcccggcuaauuuuugu

SEQ ID NO: 344325 - RNA, 19 nt, Human
ugccucuagcuccggcuuc

SEQ ID NO: 344326 - RNA, 25 nt, Human
ugccucuagcuccggcuucgggucu

SEQ ID NO: 344327 - RNA, 24 nt, Human
ugcuaggauuacaggcguaagcca

SEQ ID NO: 344328 - RNA, 19 nt, Human
uggagugcaguggcucgau

SEQ ID NO: 344329 - RNA, 19 nt, Human
uggagugcaguggcucgau

SEQ ID NO: 344330 - RNA, 18 nt, Human
uggccucccaaagugcua

SEQ ID NO: 344331 - RNA, 19 nt, Human
ugggaaaaauuuugaaucu

SEQ ID NO: 344332 - RNA, 21 nt, Human
ugggaucaugagaauacggca

SEQ ID NO: 344333 - RNA, 18 nt, Human
ugggauuacaggccacca

SEQ ID NO: 344334 - RNA, 21 nt, Human
ugggauuacaggccaccacca

SEQ ID NO: 344335 - RNA, 22 nt, Human
ugggauuacaggccaccaccau

SEQ ID NO: 344336 - RNA, 24 nt, Human
ugggcaggcuggucuugaacuccu

SEQ ID NO: 344337 - RNA, 23 nt, Human
uggguucaagcgauucuccuguc

SEQ ID NO: 344338 - RNA, 24 nt, Human
uggguucaagcgauucuccugucu

SEQ ID NO: 344339 - RNA, 24 nt, Human
ugguagagacggaguuucacuaug

SEQ ID NO: 344340 - RNA, 23 nt, Human
uguaaucacaaaugucuuuacca

SEQ ID NO: 344341 - RNA, 24 nt, Human
ugucucagccucccaaguagcugg

SEQ ID NO: 344342 - RNA, 24 nt, Human
ugucugaggaucauauuuaaauau

SEQ ID NO: 344343 - RNA, 20 nt, Human
uguguaaaaauagugcacca

SEQ ID NO: 344344 - RNA, 26 nt, Human
uguguguguguuuauauauauaaugu

SEQ ID NO: 344345 - RNA, 18 nt, Human
uguguuuauauauauaua

SEQ ID NO: 344346 - RNA, 20 nt, Human
uguguuuauauauauauaca

SEQ ID NO: 344347 - RNA, 19 nt, Human
uguugcuucaaaggagccc

SEQ ID NO: 344348 - RNA, 20 nt, Human
uguugggcaggcuggucuug

SEQ ID NO: 344349 - RNA, 23 nt, Human
uguuuauauauauauacacagua

SEQ ID NO: 344350 - RNA, 23 nt, Human
uguuuuuuaauacagacagggcu

SEQ ID NO: 344351 - RNA, 20 nt, Human
uuagccuuuaacucuucuca

SEQ ID NO: 344352 - RNA, 21 nt, Human
uuaguuccaacaccauccauu

SEQ ID NO: 344353 - RNA, 23 nt, Human
uucaagcgauucuccugucucag

SEQ ID NO: 344354 - RNA, 24 nt, Human
uugguagagacggaguuucacuau

SEQ ID NO: 344355 - RNA, 24 nt, Human
uuguucagcugcccaggcuggagu

SEQ ID NO: 344356 - RNA, 19 nt, Human
uuuuuguauauugguagag

SEQ ID NO: 344357 - RNA, 21 nt, Human
uuuuuguauauugguagagac

SEQ ID NO: 344358 - RNA, 27 nt, Human
uuuuuuuguuuuuuaauacagacaggg

SEQ ID NO: 344359 - RNA, 22 nt, Human
aaccuggagccuugguaaggag

SEQ ID NO: 344360 - RNA, 18 nt, Human
accccaauacccugagca

SEQ ID NO: 344361 - RNA, 20 nt, Human
acucuguucuuugcuguucc

SEQ ID NO: 344362 - RNA, 21 nt, Human
acucuguucuuugcuguuccc

SEQ ID NO: 344363 - RNA, 26 nt, Human
agcugggcuaaugccacccugacccc

SEQ ID NO: 344364 - RNA, 19 nt, Human
aggugucagggauggaagc

SEQ ID NO: 344365 - RNA, 24 nt, Human
aucccucccucuuccucaccccaa

SEQ ID NO: 344366 - RNA, 21 nt, Human
auccuuagccccucuaauccu

SEQ ID NO: 344367 - RNA, 28 nt, Human
cauccaaaaacuuuauugagucuauauc

SEQ ID NO: 344368 - RNA, 25 nt, Human
caucccucccucuuccucaccccaa

SEQ ID NO: 344369 - RNA, 26 nt, Human
caucucugcccaagggagugcagagg

SEQ ID NO: 344370 - RNA, 18 nt, Human
caugucacuuucccauca

SEQ ID NO: 344371 - RNA, 20 nt, Human
ccaucccucccucuuccuca

SEQ ID NO: 344372 - RNA, 20 nt, Human
cccaauacccugagcauccu

SEQ ID NO: 344373 - RNA, 20 nt, Human
ccccaauacccugagcaucc

SEQ ID NO: 344374 - RNA, 21 nt, Human
cccucuuccucaccccaagcu

SEQ ID NO: 344375 - RNA, 24 nt, Human
ccuacgauccccccaaccuggagc

SEQ ID NO: 344376 - RNA, 20 nt, Human
ccuccaggccuucucauguc

SEQ ID NO: 344377 - RNA, 23 nt, Human
ccucccucuuccucaccccaagc

SEQ ID NO: 344378 - RNA, 22 nt, Human
cuaauccuacgauccccccaac

SEQ ID NO: 344379 - RNA, 20 nt, Human
cucccucuuccucaccccaa

SEQ ID NO: 344380 - RNA, 21 nt, Human
cucccucuuccucaccccaag

SEQ ID NO: 344381 - RNA, 23 nt, Human
cucuuccucaccccaagcuccag

SEQ ID NO: 344382 - RNA, 23 nt, Human
cuuguccaucccucccucuuccu

SEQ ID NO: 344383 - RNA, 19 nt, Human
gacuuguccaucccucccu

SEQ ID NO: 344384 - RNA, 21 nt, Human
gggagugcagaggugucaggg

SEQ ID NO: 344385 - RNA, 21 nt, Human
guccaucccucccucuuccuc

SEQ ID NO: 344386 - RNA, 19 nt, Human
gugcagaggugucagggau

SEQ ID NO: 344387 - RNA, 21 nt, Human
uccaaaaacuuuauugagucu

SEQ ID NO: 344388 - RNA, 18 nt, Human
uccaucccucccucuucc

SEQ ID NO: 344389 - RNA, 18 nt, Human
ucccuggugguucugacu

SEQ ID NO: 344390 - RNA, 23 nt, Human
uccuacgauccccccaaccugga

SEQ ID NO: 344391 - RNA, 23 nt, Human
ugagcugggcuaaugccacccug

SEQ ID NO: 344392 - RNA, 21 nt, Human
ugagguuuucagacuugucca

SEQ ID NO: 344393 - RNA, 18 nt, Human
ugcuguucccuggugguu

SEQ ID NO: 344394 - RNA, 21 nt, Human
uggcuggggcaggaugcugag

SEQ ID NO: 344395 - RNA, 21 nt, Human
ugggcuaaugccacccugacc

SEQ ID NO: 344396 - RNA, 23 nt, Human
ugggcuaaugccacccugacccc

SEQ ID NO: 344397 - RNA, 21 nt, Human
uucugacuacaagggcuaggc

SEQ ID NO: 344398 - RNA, 28 nt, Human
uucuuugcuguucccuggugguucugac

SEQ ID NO: 344399 - RNA, 25 nt, Human
ccaggccgcgcgcagaacauccacg

SEQ ID NO: 344400 - RNA, 21 nt, Human
cccucuggcugcagccucgcc

SEQ ID NO: 344401 - RNA, 21 nt, Human
ccucuggaugccgcgagcgcg

SEQ ID NO: 344402 - RNA, 19 nt, Human
cggcggcggcgguggcggc

SEQ ID NO: 344403 - RNA, 27 nt, Human
cucggcggcggcgguggcggcugcucc

SEQ ID NO: 344404 - RNA, 27 nt, Human
cugaggcggcggcggcggcggcucccu

SEQ ID NO: 344405 - RNA, 21 nt, Human
cugccgucccggggcucccuc

SEQ ID NO: 344406 - RNA, 25 nt, Human
cugcgcccaggggcugccgucccgg

SEQ ID NO: 344407 - RNA, 18 nt, Human
cugcucccucgccuccgc

SEQ ID NO: 344408 - RNA, 18 nt, Human
cuggccgagugucugucc

SEQ ID NO: 344409 - RNA, 19 nt, Human
gaggcggcggcggcggcgg

SEQ ID NO: 344410 - RNA, 18 nt, Human
gaucccuucccagcccuc

SEQ ID NO: 344411 - RNA, 18 nt, Human
gcccucuggcugcagccu

SEQ ID NO: 344412 - RNA, 25 nt, Human
gcggcggcggcggcggcucccaggc

SEQ ID NO: 344413 - RNA, 22 nt, Human
gcggcggcggcggcucccaggc

SEQ ID NO: 344414 - RNA, 19 nt, Human
gcggcggcgguggcggcug

SEQ ID NO: 344415 - RNA, 22 nt, Human
gcucccucgccuccgccuggcc

SEQ ID NO: 344416 - RNA, 23 nt, Human
gcugaggcggcggcggcggcgac

SEQ ID NO: 344417 - RNA, 20 nt, Human
ggccggcgggucagucccag

SEQ ID NO: 344418 - RNA, 18 nt, Human
gggacgucugcaaagcuc

SEQ ID NO: 344419 - RNA, 20 nt, Human
gggacgucugcaaagcucuu

SEQ ID NO: 344420 - RNA, 21 nt, Human
gggcucccggccgccucgucc

SEQ ID NO: 344421 - RNA, 29 nt, Human
ggggcucccucggcggcggcgguggcggg

SEQ ID NO: 344422 - RNA, 22 nt, Human
ggucggacuccgagaacagcgc

SEQ ID NO: 344423 - RNA, 23 nt, Human
uaaaugagaaccuuacuuuaaua

SEQ ID NO: 344424 - RNA, 21 nt, Human
uaaccugcucccucgccuccg

SEQ ID NO: 344425 - RNA, 25 nt, Human
uaagacacagugaaacuucacagaa

SEQ ID NO: 344426 - RNA, 25 nt, Human
uccacgggcucuucccgggcucccg

SEQ ID NO: 344427 - RNA, 19 nt, Human
ucccgggcucccggccgcc

SEQ ID NO: 344428 - RNA, 22 nt, Human
ucccucggcggcggcgguggcg

SEQ ID NO: 344429 - RNA, 25 nt, Human
uccucucgcugaggcggcggcggcg

SEQ ID NO: 344430 - RNA, 24 nt, Human
ucgccugggccggcgggucagucc

SEQ ID NO: 344431 - RNA, 23 nt, Human
ucgcugaggcggcggcggcggcg

SEQ ID NO: 344432 - RNA, 19 nt, Human
ucggcggcggcgguggcgg

SEQ ID NO: 344433 - RNA, 23 nt, Human
uggcgcucgcaggacgccgggga

SEQ ID NO: 344434 - RNA, 22 nt, Human
uggcugcagccucgccugggcc

SEQ ID NO: 344435 - RNA, 23 nt, Human
ugucugcuaaaugagaaccuuac

SEQ ID NO: 344436 - RNA, 18 nt, Human
aaaccaagaccaacugga

SEQ ID NO: 344437 - RNA, 19 nt, Human
aagaccaacuggaucccaa

SEQ ID NO: 344438 - RNA, 24 nt, Human
aauggagccccuucauccucaaac

SEQ ID NO: 344439 - RNA, 22 nt, Human
accucacccagucugcaaacaa

SEQ ID NO: 344440 - RNA, 18 nt, Human
acuucaaugaaaauggca

SEQ ID NO: 344441 - RNA, 18 nt, Human
agaagcaaaccaagacca

SEQ ID NO: 344442 - RNA, 22 nt, Human
agaggacagagaggagcagggc

SEQ ID NO: 344443 - RNA, 20 nt, Human
agcagggcuccaccucaccc

SEQ ID NO: 344444 - RNA, 18 nt, Human
aggacagagaggagcagg

SEQ ID NO: 344445 - RNA, 22 nt, Human
aggacagagaggagcagggcuc

SEQ ID NO: 344446 - RNA, 18 nt, Human
aggcagcagaaauggagc

SEQ ID NO: 344447 - RNA, 19 nt, Human
aggcagggcagcucucugu

SEQ ID NO: 344448 - RNA, 26 nt, Human
auuuuguuguaucucaggaacuccca

SEQ ID NO: 344449 - RNA, 19 nt, Human
caaauaggaccaacaaugu

SEQ ID NO: 344450 - RNA, 18 nt, Human
cacccagucugcaaacaa

SEQ ID NO: 344451 - RNA, 22 nt, Human
cagaaucaauguauacagcccu

SEQ ID NO: 344452 - RNA, 19 nt, Human
cagagaggagcagggcucc

SEQ ID NO: 344453 - RNA, 22 nt, Human
cagcagaaauggagccccuuca

SEQ ID NO: 344454 - RNA, 19 nt, Human
caguuaaauuacuaaaguc

SEQ ID NO: 344455 - RNA, 28 nt, Human
cauauuaaaaacauauaaauuacauuua

SEQ ID NO: 344456 - RNA, 21 nt, Human
ccccuugucuuccgaccccaa

SEQ ID NO: 344457 - RNA, 24 nt, Human
ccguuccagcgaaucuuuggcugc

SEQ ID NO: 344458 - RNA, 23 nt, Human
ccucugaacauuccaaacccaag

SEQ ID NO: 344459 - RNA, 22 nt, Human
cgaaccccgggcccuggugcca

SEQ ID NO: 344460 - RNA, 18 nt, Human
cgaccccaacaggcagca

SEQ ID NO: 344461 - RNA, 18 nt, Human
cgccgugcugccagaccc

SEQ ID NO: 344462 - RNA, 19 nt, Human
cgccgugcugccagacccc

SEQ ID NO: 344463 - RNA, 21 nt, Human
cggcccggaugcgccgcucgg

SEQ ID NO: 344464 - RNA, 18 nt, Human
cggcuccggccacggcaa

SEQ ID NO: 344465 - RNA, 19 nt, Human
cggggucgggcgccaccac

SEQ ID NO: 344466 - RNA, 20 nt, Human
cucacuaccagucuaccacc

SEQ ID NO: 344467 - RNA, 22 nt, Human
cugaacauuccaaacccaagaa

SEQ ID NO: 344468 - RNA, 25 nt, Human
cugaguauggugucuucucaaaggu

SEQ ID NO: 344469 - RNA, 21 nt, Human
cuuaacaaaaauaacaauacc

SEQ ID NO: 344470 - RNA, 18 nt, Human
gaagcaaaccaagaccag

SEQ ID NO: 344471 - RNA, 22 nt, Human
gagaggagcagggcuccaccuc

SEQ ID NO: 344472 - RNA, 19 nt, Human
gaugcguccgcuccuccuu

SEQ ID NO: 344473 - RNA, 22 nt, Human
gcagagggcagccuccguucca

SEQ ID NO: 344474 - RNA, 21 nt, Human
gcagcagaaauggagccccuu

SEQ ID NO: 344475 - RNA, 19 nt, Human
gcccggaugcgccgcucgg

SEQ ID NO: 344476 - RNA, 21 nt, Human
gcuucuauccccgaaccccgg

SEQ ID NO: 344477 - RNA, 18 nt, Human
ggcaaaauacacauggag

SEQ ID NO: 344478 - RNA, 20 nt, Human
ggccgggaagcccucagagc

SEQ ID NO: 344479 - RNA, 19 nt, Human
gggaggcagcagaaaugga

SEQ ID NO: 344480 - RNA, 19 nt, Human
gggcacagacggcugccug

SEQ ID NO: 344481 - RNA, 25 nt, Human
gucccuguggggucucggcggggcu

SEQ ID NO: 344482 - RNA, 19 nt, Human
gugaagcugccaccuauuu

SEQ ID NO: 344483 - RNA, 18 nt, Human
gugguacagagagaagca

SEQ ID NO: 344484 - RNA, 18 nt, Human
uaaaaugaauggaccuca

SEQ ID NO: 344485 - RNA, 24 nt, Human
uaaaaugaauggaccucaugugca

SEQ ID NO: 344486 - RNA, 19 nt, Human
uaacaggggcuguaaaaug

SEQ ID NO: 344487 - RNA, 22 nt, Human
ucagaagccccuugucuuccga

SEQ ID NO: 344488 - RNA, 24 nt, Human
ucagagcuucgggccggggcgcgg

SEQ ID NO: 344489 - RNA, 23 nt, Human
uccccaggacgccgugcugccag

SEQ ID NO: 344490 - RNA, 19 nt, Human
uccccgaaccccgggcccu

SEQ ID NO: 344491 - RNA, 23 nt, Human
ucggcggggcuucuauccccgaa

SEQ ID NO: 344492 - RNA, 23 nt, Human
ucgggccggggcgcggggucggg

SEQ ID NO: 344493 - RNA, 19 nt, Human
ugacugaggucccuguggg

SEQ ID NO: 344494 - RNA, 18 nt, Human
ugaggucccugugggguc

SEQ ID NO: 344495 - RNA, 18 nt, Human
ugcugccagacccccugc

SEQ ID NO: 344496 - RNA, 24 nt, Human
ugcuuccucugaacauuccaaacc

SEQ ID NO: 344497 - RNA, 20 nt, Human
uggagccccuucauccucaa

SEQ ID NO: 344498 - RNA, 22 nt, Human
uggagugaagcugccaccuauu

SEQ ID NO: 344499 - RNA, 24 nt, Human
ugucaggaaccucaagacccgagg

SEQ ID NO: 344500 - RNA, 25 nt, Human
ugucaguuucuuugaaggcacacau

SEQ ID NO: 344501 - RNA, 20 nt, Human
uguggggucucggcggggcu

SEQ ID NO: 344502 - RNA, 23 nt, Human
uucuccggcccggaugcgccgcu

SEQ ID NO: 344503 - RNA, 18 nt, Human
agaaugauggggaggagu

SEQ ID NO: 344504 - RNA, 20 nt, Human
cagacagauggcuccaacag

SEQ ID NO: 344505 - RNA, 21 nt, Human
cccccucugccgccgccgcua

SEQ ID NO: 344506 - RNA, 18 nt, Human
ccccggagcccccucugc

SEQ ID NO: 344507 - RNA, 20 nt, Human
ccccucugccgccgccgcgc

SEQ ID NO: 344508 - RNA, 19 nt, Human
ccgccgcgccgccgccgcc

SEQ ID NO: 344509 - RNA, 20 nt, Human
ccuccagaaacuggggcugu

SEQ ID NO: 344510 - RNA, 18 nt, Human
ccucugccgccgccgcgc

SEQ ID NO: 344511 - RNA, 24 nt, Human
cgaucaccaaaagaugugcagugu

SEQ ID NO: 344512 - RNA, 22 nt, Human
cuccagaaacuggggcugugcu

SEQ ID NO: 344513 - RNA, 18 nt, Human
cugaccccgaucaccaaa

SEQ ID NO: 344514 - RNA, 22 nt, Human
gaccccggagcccccucugccg

SEQ ID NO: 344515 - RNA, 21 nt, Human
gccgccgccgcgccgccgccg

SEQ ID NO: 344516 - RNA, 18 nt, Human
ggcugugcuuugccccag

SEQ ID NO: 344517 - RNA, 18 nt, Human
ggggaggaguauggggga

SEQ ID NO: 344518 - RNA, 21 nt, Human
gguggagaaugauggggagga

SEQ ID NO: 344519 - RNA, 21 nt, Human
gugcagggccauauaaagugu

SEQ ID NO: 344520 - RNA, 19 nt, Human
uacccaucugccuccagaa

SEQ ID NO: 344521 - RNA, 22 nt, Human
uacccaucugccuccagaaacu

SEQ ID NO: 344522 - RNA, 18 nt, Human
uacuauggaguccaaggu

SEQ ID NO: 344523 - RNA, 21 nt, Human
ugcagggccauauaaaguguc

SEQ ID NO: 344524 - RNA, 21 nt, Human
uggggcugugcuuugccccag

SEQ ID NO: 344525 - RNA, 18 nt, Human
uguuuuucauguuuguac

SEQ ID NO: 344526 - RNA, 22 nt, Human
aaaaaaggaaacagaaagaaaa

SEQ ID NO: 344527 - RNA, 19 nt, Human
aaaaaaugccaccgccucc

SEQ ID NO: 344528 - RNA, 21 nt, Human
aaaaaggaaacagaaagaaaa

SEQ ID NO: 344529 - RNA, 24 nt, Human
aaaaaggaaacagaaagaaaagaa

SEQ ID NO: 344530 - RNA, 29 nt, Human
aaaaaggaaacagaaagaaaagggacccc

SEQ ID NO: 344531 - RNA, 27 nt, Human
aaaacaaacaaacaaauaaaagagccc

SEQ ID NO: 344532 - RNA, 19 nt, Human
aaacaaauaaaagagcccc

SEQ ID NO: 344533 - RNA, 21 nt, Human
aaacaaauaaaagagccccac

SEQ ID NO: 344534 - RNA, 22 nt, Human
aaacagaaagaaaagaaagaaa

SEQ ID NO: 344535 - RNA, 21 nt, Human
aaagaaaagaaagaaaggcgg

SEQ ID NO: 344536 - RNA, 19 nt, Human
aaagaagagggagaaggaa

SEQ ID NO: 344537 - RNA, 22 nt, Human
aaagaagagggagaaggaacaa

SEQ ID NO: 344538 - RNA, 22 nt, Human
aaagaagagggagaaggaacaa

SEQ ID NO: 344539 - RNA, 26 nt, Human
aaagaagagggagaaggaacaagggg

SEQ ID NO: 344540 - RNA, 20 nt, Human
aaagagccccacucaggugc

SEQ ID NO: 344541 - RNA, 19 nt, Human
aaauaaaagagccccacuc

SEQ ID NO: 344542 - RNA, 18 nt, Human
aacaagggggaaaaaagg

SEQ ID NO: 344543 - RNA, 23 nt, Human
aaccaucccuuuaggcggacgcc

SEQ ID NO: 344544 - RNA, 20 nt, Human
aacuaccuaaaaacauagaa

SEQ ID NO: 344545 - RNA, 20 nt, Human
aagaaaagaaagaaaggcgg

SEQ ID NO: 344546 - RNA, 24 nt, Human
aagcacugaaaucaagcuuguuuc

SEQ ID NO: 344547 - RNA, 22 nt, Human
aauguuaucuguggccuaauuc

SEQ ID NO: 344548 - RNA, 19 nt, Human
acagaaagaaaagaaagaa

SEQ ID NO: 344549 - RNA, 19 nt, Human
acucugggucuucucuuuc

SEQ ID NO: 344550 - RNA, 23 nt, Human
acuguuuggucaaaaaagucuug

SEQ ID NO: 344551 - RNA, 23 nt, Human
agagagaaaauguuuacaugaaa

SEQ ID NO: 344552 - RNA, 22 nt, Human
agcccgaaccccggagagccca

SEQ ID NO: 344553 - RNA, 21 nt, Human
aggaggaggaagggcagcagc

SEQ ID NO: 344554 - RNA, 18 nt, Human
aggaggaggaggaagggc

SEQ ID NO: 344555 - RNA, 21 nt, Human
aggaggaggaguugguggugg

SEQ ID NO: 344556 - RNA, 21 nt, Human
aggcgguguggauggcagagc

SEQ ID NO: 344557 - RNA, 24 nt, Human
agguggucggcgaagagcugcucu

SEQ ID NO: 344558 - RNA, 22 nt, Human
aguuacaaagaagagggagaag

SEQ ID NO: 344559 - RNA, 19 nt, Human
aucccuuuaggcggacgcc

SEQ ID NO: 344560 - RNA, 21 nt, Human
augucauugacagaaauagag

SEQ ID NO: 344561 - RNA, 22 nt, Human
auuuauucuuuuaacuuuccua

SEQ ID NO: 344562 - RNA, 25 nt, Human
caaacaaacaaauaaaagagcccca

SEQ ID NO: 344563 - RNA, 21 nt, Human
caauaagcacugaaaucaagc

SEQ ID NO: 344564 - RNA, 22 nt, Human
cagaaagaaaagaaagaaaggc

SEQ ID NO: 344565 - RNA, 27 nt, Human
caggaggaggaguugguggugguuuug

SEQ ID NO: 344566 - RNA, 21 nt, Human
cccaaaaaucccgcucagcac

SEQ ID NO: 344567 - RNA, 22 nt, Human
cccagcccgaaccccggagagc

SEQ ID NO: 344568 - RNA, 23 nt, Human
cccgaaccccggagagcccaaaa

SEQ ID NO: 344569 - RNA, 25 nt, Human
ccgaaccccggagagcccaaaaauc

SEQ ID NO: 344570 - RNA, 26 nt, Human
ccgaauaaaauuaaaaaaaggauaac

SEQ ID NO: 344571 - RNA, 21 nt, Human
cgccuccggcucagaagauuu

SEQ ID NO: 344572 - RNA, 21 nt, Human
cugugccuguuagcggaucca

SEQ ID NO: 344573 - RNA, 22 nt, Human
gaacaagggggaaaaaaggaaa

SEQ ID NO: 344574 - RNA, 18 nt, Human
gaaccccggagagcccaa

SEQ ID NO: 344575 - RNA, 18 nt, Human
gaggaagggcagcagcag

SEQ ID NO: 344576 - RNA, 20 nt, Human
gaguugguaccguccugcca

SEQ ID NO: 344577 - RNA, 21 nt, Human
gccacacauuauguuuauucc

SEQ ID NO: 344578 - RNA, 20 nt, Human
gcccgaaccccggagagccc

SEQ ID NO: 344579 - RNA, 18 nt, Human
gcgaagagcugcucugcc

SEQ ID NO: 344580 - RNA, 28 nt, Human
gcucccagcccgaaccccggagagccca

SEQ ID NO: 344581 - RNA, 24 nt, Human
ggacugaggaggaggaggaagggc

SEQ ID NO: 344582 - RNA, 24 nt, Human
ggagagcccaaaaaucccgcucag

SEQ ID NO: 344583 - RNA, 19 nt, Human
ggaggaggaguugguggug

SEQ ID NO: 344584 - RNA, 23 nt, Human
ggcagcagcaggaggaggaguug

SEQ ID NO: 344585 - RNA, 21 nt, Human
gggaaaaaaggaaacagaaag

SEQ ID NO: 344586 - RNA, 23 nt, Human
gggcagcagcaggaggaggaguu

SEQ ID NO: 344587 - RNA, 23 nt, Human
gggucuucucuuucuaccuuuuc

SEQ ID NO: 344588 - RNA, 22 nt, Human
gguuuuguuuuucuuuuucuuu

SEQ ID NO: 344589 - RNA, 18 nt, Human
gucaaguuuuugcuacau

SEQ ID NO: 344590 - RNA, 24 nt, Human
guguggccgcucucccgcuccgcg

SEQ ID NO: 344591 - RNA, 19 nt, Human
uaaaaaaugccaccgccuc

SEQ ID NO: 344592 - RNA, 24 nt, Human
uaacaaauacauuaaagaaaggaa

SEQ ID NO: 344593 - RNA, 26 nt, Human
uaacaaauacauuaaagaaggguuuc

SEQ ID NO: 344594 - RNA, 19 nt, Human
uaagccuauuaaguggaau

SEQ ID NO: 344595 - RNA, 22 nt, Human
uaauggugaugcauuccaugac

SEQ ID NO: 344596 - RNA, 23 nt, Human
uauauacuuauuacauacaugca

SEQ ID NO: 344597 - RNA, 24 nt, Human
ucaaaaaagucuuggaccuugcaa

SEQ ID NO: 344598 - RNA, 26 nt, Human
ucagaagauuucuuuugugaucacuu

SEQ ID NO: 344599 - RNA, 20 nt, Human
ucauagaagagagccugacu

SEQ ID NO: 344600 - RNA, 18 nt, Human
uccaaaagaaaaaaagug

SEQ ID NO: 344601 - RNA, 18 nt, Human
uccaugacuaugagacag

SEQ ID NO: 344602 - RNA, 18 nt, Human
ucccaaaacauacccgaa

SEQ ID NO: 344603 - RNA, 24 nt, Human
ucccagcccgaaccccggagagcc

SEQ ID NO: 344604 - RNA, 25 nt, Human
ucuauaaacaguugucucccaaaac

SEQ ID NO: 344605 - RNA, 21 nt, Human
ucucuccaaugugcuugcuuu

SEQ ID NO: 344606 - RNA, 21 nt, Human
ucugccgagaaaaccaucccu

SEQ ID NO: 344607 - RNA, 23 nt, Human
ucuggcugucuggugccuggguu

SEQ ID NO: 344608 - RNA, 23 nt, Human
ugaaaaauaauucuauuaagugc

SEQ ID NO: 344609 - RNA, 18 nt, Human
ugaaaacucuggcuggga

SEQ ID NO: 344610 - RNA, 19 nt, Human
ugaaacaggaaaauggcuu

SEQ ID NO: 344611 - RNA, 24 nt, Human
ugaaacaggaaaauggcuuaaaau

SEQ ID NO: 344612 - RNA, 19 nt, Human
ugagacaguucucuugucc

SEQ ID NO: 344613 - RNA, 19 nt, Human
ugaggaggaggaggaaggg

SEQ ID NO: 344614 - RNA, 21 nt, Human
ugcucccagcccgaaccccgg

SEQ ID NO: 344615 - RNA, 22 nt, Human
uggcauuguugcccuggguucu

SEQ ID NO: 344616 - RNA, 23 nt, Human
uggcugucuggugccuggguuuu

SEQ ID NO: 344617 - RNA, 21 nt, Human
ugucauugacagaaauagagu

SEQ ID NO: 344618 - RNA, 22 nt, Human
uguuuauuccuuuguagacuua

SEQ ID NO: 344619 - RNA, 22 nt, Human
uuaaaauacugucuccuuccca

SEQ ID NO: 344620 - RNA, 21 nt, Human
uuaguuacaaagaagagggag

SEQ ID NO: 344621 - RNA, 20 nt, Human
uucuuuuucuuucucuccaa

SEQ ID NO: 344622 - RNA, 23 nt, Human
uugauguugguggugacuguuuu

SEQ ID NO: 344623 - RNA, 22 nt, Human
uuugccgccgccgccgcuaugu

SEQ ID NO: 344624 - RNA, 30 nt, Human
uuuguuaguuacaaagaagagggagaagga

SEQ ID NO: 344625 - RNA, 31 nt, Human
uuuuguuuugguuuuguuuuucuuuuucuuu

SEQ ID NO: 344626 - RNA, 27 nt, Human
agggugaggguggaacgggguccaggg

SEQ ID NO: 344627 - RNA, 19 nt, Human
caaggagucccucuuccag

SEQ ID NO: 344628 - RNA, 22 nt, Human
cagcaucugcucacuuccaaag

SEQ ID NO: 344629 - RNA, 20 nt, Human
ccagggaggugggccagcag

SEQ ID NO: 344630 - RNA, 19 nt, Human
ccguccuggcugcccuggc

SEQ ID NO: 344631 - RNA, 22 nt, Human
ccguccuggcugcccuggcugc

SEQ ID NO: 344632 - RNA, 21 nt, Human
cugacagaaagccagccgcag

SEQ ID NO: 344633 - RNA, 24 nt, Human
gccauagggagaggcaaggagucc

SEQ ID NO: 344634 - RNA, 21 nt, Human
ggcagggagcagggcccaggg

SEQ ID NO: 344635 - RNA, 19 nt, Human
ucacuuccaaagagcuggu

SEQ ID NO: 344636 - RNA, 19 nt, Human
uccagggaggugggccagc

SEQ ID NO: 344637 - RNA, 19 nt, Human
ugcccuggcugcccaggag

SEQ ID NO: 344638 - RNA, 23 nt, Human
ugguggggaccacccuccagggu

SEQ ID NO: 344639 - RNA, 20 nt, Human
auggauuuugcuuuguuugu

SEQ ID NO: 344640 - RNA, 20 nt, Human
gcagaguuuucuuucaguaa

SEQ ID NO: 344641 - RNA, 20 nt, Human
uagccuuuuucauuuagacc

SEQ ID NO: 344642 - RNA, 23 nt, Human
uaggauauacuugccuuuugaaa

SEQ ID NO: 344643 - RNA, 22 nt, Human
ucauuuagaccuuugaaugcuu

SEQ ID NO: 344644 - RNA, 25 nt, Human
uuagauggccggucuaauuuucucc

SEQ ID NO: 344645 - RNA, 18 nt, Human
uuuugcuuuguuuguuuu

SEQ ID NO: 344646 - RNA, 27 nt, Human
aaaaaaaaaaaaaauguaaguucagaa

SEQ ID NO: 344647 - RNA, 23 nt, Human
aaaaaacagagacauuaugaaag

SEQ ID NO: 344648 - RNA, 21 nt, Human
aaaaaaugaauugacaaagaa

SEQ ID NO: 344649 - RNA, 22 nt, Human
aauauacauuuuacaccaagcu

SEQ ID NO: 344650 - RNA, 23 nt, Human
agaaacuuccaaaauaagagaac

SEQ ID NO: 344651 - RNA, 23 nt, Human
agaaccugagucuguaauuguug

SEQ ID NO: 344652 - RNA, 23 nt, Human
auucgucacaugugcuucaucuc

SEQ ID NO: 344653 - RNA, 25 nt, Human
caaaaaaaaucauagauaccaaaaa

SEQ ID NO: 344654 - RNA, 20 nt, Human
cacaacuugaaacgucccuu

SEQ ID NO: 344655 - RNA, 19 nt, Human
cacuggauauguaaccuca

SEQ ID NO: 344656 - RNA, 22 nt, Human
cagaacaaaaccagauagaaac

SEQ ID NO: 344657 - RNA, 18 nt, Human
cuaguccguauucgucac

SEQ ID NO: 344658 - RNA, 18 nt, Human
gucuuuggauuuauucuc

SEQ ID NO: 344659 - RNA, 20 nt, Human
uaagagaaccugagucugua

SEQ ID NO: 344660 - RNA, 20 nt, Human
uccaaaauaagagaaccuga

SEQ ID NO: 344661 - RNA, 18 nt, Human
ugagcaaaaaaaaucaua

SEQ ID NO: 344662 - RNA, 20 nt, Human
uggaaaaacaaaaaacagag

SEQ ID NO: 344663 - RNA, 21 nt, Human
uggaaaaacaaaaaacagaga

SEQ ID NO: 344664 - RNA, 20 nt, Human
ugggaaaaaaugaauugaca

SEQ ID NO: 344665 - RNA, 22 nt, Human
uugaugcccugagcaaaaaaaa

SEQ ID NO: 344666 - RNA, 23 nt, Human
uuggcugagaccacaacuugaaa

SEQ ID NO: 344667 - RNA, 23 nt, Human
uuguuggaaaaacaaaaaacaga

SEQ ID NO: 344668 - RNA, 21 nt, Human
uuuuuaucaaaucaguaguua

SEQ ID NO: 344669 - RNA, 23 nt, Human
aaaagcuagacauaaauauaaag

SEQ ID NO: 344670 - RNA, 23 nt, Human
aaacauuuuaaacaugaaaauac

SEQ ID NO: 344671 - RNA, 19 nt, Human
aaagaacuuaguuuauagc

SEQ ID NO: 344672 - RNA, 21 nt, Human
aaauuaaauggguaaaagguc

SEQ ID NO: 344673 - RNA, 24 nt, Human
aaccgcccaacgguccgcagccuu

SEQ ID NO: 344674 - RNA, 20 nt, Human
aaccuauugacaccuccuga

SEQ ID NO: 344675 - RNA, 20 nt, Human
aacguggaaaaaccccaucu

SEQ ID NO: 344676 - RNA, 23 nt, Human
aagagcuaauaaaaguuaucacc

SEQ ID NO: 344677 - RNA, 19 nt, Human
aagcaaaacaaaaacagca

SEQ ID NO: 344678 - RNA, 18 nt, Human
aagcugguuaucaaaugc

SEQ ID NO: 344679 - RNA, 22 nt, Human
aaguagcucuccucugcuuccu

SEQ ID NO: 344680 - RNA, 21 nt, Human
aauacacaaaaguguauuauc

SEQ ID NO: 344681 - RNA, 24 nt, Human
aaucgcuugaacccaggaggcgga

SEQ ID NO: 344682 - RNA, 20 nt, Human
acaagagugaaacuccaccu

SEQ ID NO: 344683 - RNA, 24 nt, Human
acagaguuuccccugaagacugaa

SEQ ID NO: 344684 - RNA, 22 nt, Human
acagugcuuuaaagcaaccaaa

SEQ ID NO: 344685 - RNA, 24 nt, Human
accugaggucaggaguucgagacc

SEQ ID NO: 344686 - RNA, 23 nt, Human
accuuuuuaaaaacugcugguga

SEQ ID NO: 344687 - RNA, 19 nt, Human
agagaaacaaaacugcaag

SEQ ID NO: 344688 - RNA, 22 nt, Human
agccagguguaguggcgcaugc

SEQ ID NO: 344689 - RNA, 21 nt, Human
agcucacaccuguaaucccag

SEQ ID NO: 344690 - RNA, 23 nt, Human
agcucuuugggaggcugaggugg

SEQ ID NO: 344691 - RNA, 23 nt, Human
aggcaggagaaucgcuugaaccc

SEQ ID NO: 344692 - RNA, 24 nt, Human
aggcaggagaaucgcuugaaccca

SEQ ID NO: 344693 - RNA, 24 nt, Human
aggcgcgguagcucacaccuguaa

SEQ ID NO: 344694 - RNA, 21 nt, Human
aggcggauguuguggugagcc

SEQ ID NO: 344695 - RNA, 24 nt, Human
aggcggauguuguggugagccgag

SEQ ID NO: 344696 - RNA, 20 nt, Human
aggcugaggcaggagaaucg

SEQ ID NO: 344697 - RNA, 24 nt, Human
aggcugaggcaggagaaucgcuug

SEQ ID NO: 344698 - RNA, 22 nt, Human
agguggacggaucaccugaggu

SEQ ID NO: 344699 - RNA, 22 nt, Human
auaagaauaucauaugcagaga

SEQ ID NO: 344700 - RNA, 18 nt, Human
auagaaacaaccauagca

SEQ ID NO: 344701 - RNA, 24 nt, Human
aucaccugaggucaggaguucgag

SEQ ID NO: 344702 - RNA, 24 nt, Human
aucgcgccauugcacuccagcuug

SEQ ID NO: 344703 - RNA, 22 nt, Human
auggagcacugaggaaaguuua

SEQ ID NO: 344704 - RNA, 18 nt, Human
auugcacuccagcuuggg

SEQ ID NO: 344705 - RNA, 23 nt, Human
caaaagcuauucagaaaugaaau

SEQ ID NO: 344706 - RNA, 22 nt, Human
caacguggaaaaaccccaucuc

SEQ ID NO: 344707 - RNA, 24 nt, Human
cacaccuguaaucccagcucuuug

SEQ ID NO: 344708 - RNA, 20 nt, Human
caccaacuuuuauuugcacc

SEQ ID NO: 344709 - RNA, 23 nt, Human
caccugaggucaggaguucgaga

SEQ ID NO: 344710 - RNA, 23 nt, Human
caccuguaaucccagcucuuugg

SEQ ID NO: 344711 - RNA, 24 nt, Human
caccuguaaucccagcucuuuggg

SEQ ID NO: 344712 - RNA, 23 nt, Human
cacuccagcuugggcaacaagag

SEQ ID NO: 344713 - RNA, 24 nt, Human
cacuccagcuugggcaacaagagu

SEQ ID NO: 344714 - RNA, 25 nt, Human
cacuccagcuugggcaacaagagug

SEQ ID NO: 344715 - RNA, 19 nt, Human
cagcacccccggacgcgug

SEQ ID NO: 344716 - RNA, 24 nt, Human
cagcuacucaggaggcugaggcag

SEQ ID NO: 344717 - RNA, 24 nt, Human
cagcucuuugggaggcugaggugg

SEQ ID NO: 344718 - RNA, 20 nt, Human
caguacuauuaaugcaagag

SEQ ID NO: 344719 - RNA, 24 nt, Human
cauggccaggcgcgguagcucaca

SEQ ID NO: 344720 - RNA, 24 nt, Human
cauucagaagccaaaugacugucc

SEQ ID NO: 344721 - RNA, 19 nt, Human
cauugcacuccagcuuggg

SEQ ID NO: 344722 - RNA, 21 nt, Human
cauugcacuccagcuugggca

SEQ ID NO: 344723 - RNA, 22 nt, Human
cauugcacuccagcuugggcaa

SEQ ID NO: 344724 - RNA, 23 nt, Human
cauugcacuccagcuugggcaac

SEQ ID NO: 344725 - RNA, 24 nt, Human
cauugcacuccagcuugggcaaca

SEQ ID NO: 344726 - RNA, 18 nt, Human
cauugcuaauacacaaaa

SEQ ID NO: 344727 - RNA, 20 nt, Human
ccaacaucuguuaguagagu

SEQ ID NO: 344728 - RNA, 22 nt, Human
ccauauaaugcaacuaggaagc

SEQ ID NO: 344729 - RNA, 20 nt, Human
ccauugcacuccagcuuggg

SEQ ID NO: 344730 - RNA, 21 nt, Human
ccauugcacuccagcuugggc

SEQ ID NO: 344731 - RNA, 23 nt, Human
ccauugcacuccagcuugggcaa

SEQ ID NO: 344732 - RNA, 24 nt, Human
ccauugcacuccagcuugggcaac

SEQ ID NO: 344733 - RNA, 25 nt, Human
cccaaaaauauccaaaaacauuuua

SEQ ID NO: 344734 - RNA, 19 nt, Human
ccgcagccuuaguuugccc

SEQ ID NO: 344735 - RNA, 24 nt, Human
ccugaccaacguggaaaaacccca

SEQ ID NO: 344736 - RNA, 22 nt, Human
ccugaggucaggaguucgagac

SEQ ID NO: 344737 - RNA, 21 nt, Human
ccuguaaucccagcucuuugg

SEQ ID NO: 344738 - RNA, 23 nt, Human
cgacuaguaacaaaucccucuua

SEQ ID NO: 344739 - RNA, 24 nt, Human
cgccauugcacuccagcuugggca

SEQ ID NO: 344740 - RNA, 19 nt, Human
cggacaacgccccgcggaa

SEQ ID NO: 344741 - RNA, 24 nt, Human
cggaucaccugaggucaggaguuc

SEQ ID NO: 344742 - RNA, 27 nt, Human
cggaucaccugaggucaggaguucgag

SEQ ID NO: 344743 - RNA, 19 nt, Human
cguggaaaaaccccaucuc

SEQ ID NO: 344744 - RNA, 20 nt, Human
cucacaccuguaaucccagc

SEQ ID NO: 344745 - RNA, 24 nt, Human
cucacaccuguaaucccagcucuu

SEQ ID NO: 344746 - RNA, 22 nt, Human
cuccagcuugggcaacaagagu

SEQ ID NO: 344747 - RNA, 27 nt, Human
cugagguggacggaucaccugagguca

SEQ ID NO: 344748 - RNA, 21 nt, Human
gaaaaaccccaucucaacuaa

SEQ ID NO: 344749 - RNA, 18 nt, Human
gaaaugugaauaauggug

SEQ ID NO: 344750 - RNA, 23 nt, Human
gagaaucgcuugaacccaggagg

SEQ ID NO: 344751 - RNA, 23 nt, Human
gagaccagccugaccaacgugga

SEQ ID NO: 344752 - RNA, 23 nt, Human
gagaucgcgccauugcacuccag

SEQ ID NO: 344753 - RNA, 23 nt, Human
gagguggacggaucaccugaggu

SEQ ID NO: 344754 - RNA, 19 nt, Human
gagucccuuuaauuuagcu

SEQ ID NO: 344755 - RNA, 21 nt, Human
gaucaccugaggucaggaguu

SEQ ID NO: 344756 - RNA, 24 nt, Human
gaucaccugaggucaggaguucga

SEQ ID NO: 344757 - RNA, 19 nt, Human
gauguggauggcagauuca

SEQ ID NO: 344758 - RNA, 19 nt, Human
gcagccuuaguuugcccgc

SEQ ID NO: 344759 - RNA, 22 nt, Human
gcaggagaaucgcuugaaccca

SEQ ID NO: 344760 - RNA, 22 nt, Human
gccauugcacuccagcuugggc

SEQ ID NO: 344761 - RNA, 24 nt, Human
gccauugcacuccagcuugggcaa

SEQ ID NO: 344762 - RNA, 23 nt, Human
ggaucaccugaggucaggaguuc

SEQ ID NO: 344763 - RNA, 24 nt, Human
ggauguuguggugagccgagaucg

SEQ ID NO: 344764 - RNA, 18 nt, Human
guggaaaaaccccaucuc

SEQ ID NO: 344765 - RNA, 20 nt, Human
guggcgcaugcuguauuccc

SEQ ID NO: 344766 - RNA, 21 nt, Human
uaaaaauacaaaaauuagcca

SEQ ID NO: 344767 - RNA, 18 nt, Human
uaaaaucguuucaaacau

SEQ ID NO: 344768 - RNA, 21 nt, Human
uaaagaagcaaaacaaaaaca

SEQ ID NO: 344769 - RNA, 21 nt, Human
uaacaggauggagucccuuua

SEQ ID NO: 344770 - RNA, 23 nt, Human
uaaugguguuuaauaauaucauc

SEQ ID NO: 344771 - RNA, 22 nt, Human
uaccaaguccugguuccacauu

SEQ ID NO: 344772 - RNA, 22 nt, Human
uagcucacaccuguaaucccag

SEQ ID NO: 344773 - RNA, 22 nt, Human
uaguagaguuacuugccaagcu

SEQ ID NO: 344774 - RNA, 19 nt, Human
uauaaaagaauugaaauga

SEQ ID NO: 344775 - RNA, 20 nt, Human
uaucaggaagcagaagaguc

SEQ ID NO: 344776 - RNA, 18 nt, Human
uaugcagagaaacaaaac

SEQ ID NO: 344777 - RNA, 19 nt, Human
uccagcuugggcaacaaga

SEQ ID NO: 344778 - RNA, 18 nt, Human
ucccagcccgcggagcuc

SEQ ID NO: 344779 - RNA, 21 nt, Human
uccggacaacgccccgcggaa

SEQ ID NO: 344780 - RNA, 23 nt, Human
uccuagaguguggcgugaacccu

SEQ ID NO: 344781 - RNA, 25 nt, Human
ugaaagcugauuucauaauagcugc

SEQ ID NO: 344782 - RNA, 24 nt, Human
ugaaccaauuacuuuagauuacaa

SEQ ID NO: 344783 - RNA, 22 nt, Human
ugagccgagaucgcgccauugc

SEQ ID NO: 344784 - RNA, 19 nt, Human
ugaggauuggguccaagaa

SEQ ID NO: 344785 - RNA, 19 nt, Human
ugaggauuggguccaagaa

SEQ ID NO: 344786 - RNA, 21 nt, Human
ugaggauuggguccaagaaug

SEQ ID NO: 344787 - RNA, 20 nt, Human
ugaggcaggagaaucgcuug

SEQ ID NO: 344788 - RNA, 24 nt, Human
ugaggcaggagaaucgcuugaacc

SEQ ID NO: 344789 - RNA, 25 nt, Human
ugaggcaggagaaucgcuugaaccc

SEQ ID NO: 344790 - RNA, 20 nt, Human
ugagguggacggaucaccug

SEQ ID NO: 344791 - RNA, 24 nt, Human
ugagguggacggaucaccugaggu

SEQ ID NO: 344792 - RNA, 18 nt, Human
ugauauggagucucaaaa

SEQ ID NO: 344793 - RNA, 19 nt, Human
ugcacuccagcuugggcaa

SEQ ID NO: 344794 - RNA, 22 nt, Human
ugcacuccagcuugggcaacaa

SEQ ID NO: 344795 - RNA, 23 nt, Human
ugcccuuauaaaagaauugaaau

SEQ ID NO: 344796 - RNA, 23 nt, Human
ugccuauuucuuaccuaaaaguc

SEQ ID NO: 344797 - RNA, 23 nt, Human
ugcuguauucccagcuacucagg

SEQ ID NO: 344798 - RNA, 24 nt, Human
uggacggaucaccugaggucagga

SEQ ID NO: 344799 - RNA, 18 nt, Human
ugggaggcugagguggac

SEQ ID NO: 344800 - RNA, 19 nt, Human
ugggaggcugagguggacg

SEQ ID NO: 344801 - RNA, 24 nt, Human
ugggaggcugagguggacggauca

SEQ ID NO: 344802 - RNA, 18 nt, Human
uguacaaaaucucauuug

SEQ ID NO: 344803 - RNA, 21 nt, Human
uguacaaaaucucauuugcca

SEQ ID NO: 344804 - RNA, 18 nt, Human
ugugauguggauggcaga

SEQ ID NO: 344805 - RNA, 24 nt, Human
ugugauguggauggcagauucagu

SEQ ID NO: 344806 - RNA, 22 nt, Human
uguguacauaaaaaugugcaua

SEQ ID NO: 344807 - RNA, 18 nt, Human
uuaaaaaauucaauuuac

SEQ ID NO: 344808 - RNA, 22 nt, Human
uuaaaacuacuuaauuuaaaau

SEQ ID NO: 344809 - RNA, 18 nt, Human
uuaaauagcuauaccaac

SEQ ID NO: 344810 - RNA, 24 nt, Human
uuaaauagcuuuuaagcugauuaa

SEQ ID NO: 344811 - RNA, 20 nt, Human
uuaacccaaaaauauccaaa

SEQ ID NO: 344812 - RNA, 18 nt, Human
uuacuugauaugaauggc

SEQ ID NO: 344813 - RNA, 21 nt, Human
uuagcacaaggccacgcacag

SEQ ID NO: 344814 - RNA, 23 nt, Human
uugauaugaauggcauaucuaau

SEQ ID NO: 344815 - RNA, 23 nt, Human
uugccaagcugguuaucaaaugc

SEQ ID NO: 344816 - RNA, 25 nt, Human
uugggaggcugagguggacggauca

SEQ ID NO: 344817 - RNA, 18 nt, Human
uuguggugagccgagauc

SEQ ID NO: 344818 - RNA, 22 nt, Human
uuguggugagccgagaucgcgc

SEQ ID NO: 344819 - RNA, 20 nt, Human
uuuagcuacuucuguuuucu

SEQ ID NO: 344820 - RNA, 19 nt, Human
uuuuaagcuuugguuaaua

SEQ ID NO: 344821 - RNA, 24 nt, Human
uuuugaaccucaaguaaaugaugu

SEQ ID NO: 344822 - RNA, 26 nt, Human
aaaaaaaguaaaaauaaaacaaaaaa

SEQ ID NO: 344823 - RNA, 24 nt, Human
aaaaaaauuccccccaaaccaaaa

SEQ ID NO: 344824 - RNA, 23 nt, Human
aaaaaauuccccccaaaccaaaa

SEQ ID NO: 344825 - RNA, 28 nt, Human
aaaaaauuccccccaaaccaaaacacca

SEQ ID NO: 344826 - RNA, 19 nt, Human
aaaaauuccccccaaacca

SEQ ID NO: 344827 - RNA, 22 nt, Human
aaaaauuccccccaaaccaaaa

SEQ ID NO: 344828 - RNA, 18 nt, Human
aaaacaaaaaaacccuca

SEQ ID NO: 344829 - RNA, 26 nt, Human
aaaacaaaaaaacccucaugccuaaa

SEQ ID NO: 344830 - RNA, 18 nt, Human
aaacacacacagccauau

SEQ ID NO: 344831 - RNA, 21 nt, Human
aaaccaccauuagaagaauga

SEQ ID NO: 344832 - RNA, 19 nt, Human
aaauaaaacaaaaaaaccc

SEQ ID NO: 344833 - RNA, 23 nt, Human
aaauacugaaagcagcaagauuc

SEQ ID NO: 344834 - RNA, 26 nt, Human
aaaucuucaagacaggaaacaaaaca

SEQ ID NO: 344835 - RNA, 25 nt, Human
aaaugaccauuuucagcauaaaagc

SEQ ID NO: 344836 - RNA, 22 nt, Human
aacccucaugccuaaauuuaga

SEQ ID NO: 344837 - RNA, 24 nt, Human
aaccuuuugaaaucaagagucuaa

SEQ ID NO: 344838 - RNA, 21 nt, Human
aagugaacagggaaaugacca

SEQ ID NO: 344839 - RNA, 20 nt, Human
aaugacaaaaaaaaaguaaa

SEQ ID NO: 344840 - RNA, 20 nt, Human
acaaaacaguacauauauau

SEQ ID NO: 344841 - RNA, 23 nt, Human
acacacacacacacacacacaca

SEQ ID NO: 344842 - RNA, 23 nt, Human
acacacacacacacacacacaca

SEQ ID NO: 344843 - RNA, 23 nt, Human
acacacacacacacacacacaca

SEQ ID NO: 344844 - RNA, 23 nt, Human
acacacacacacacacacacaca

SEQ ID NO: 344845 - RNA, 23 nt, Human
acacacauacacacacacacaca

SEQ ID NO: 344846 - RNA, 25 nt, Human
acacagacucaaacacacacagcca

SEQ ID NO: 344847 - RNA, 23 nt, Human
accauaacucaaaaucuucaaga

SEQ ID NO: 344848 - RNA, 21 nt, Human
agaaacccuucuucacauguc

SEQ ID NO: 344849 - RNA, 22 nt, Human
agaagacaagcccaaaccacca

SEQ ID NO: 344850 - RNA, 18 nt, Human
agacaggaaacaaaacag

SEQ ID NO: 344851 - RNA, 20 nt, Human
agauguauccuuaaaguuuu

SEQ ID NO: 344852 - RNA, 24 nt, Human
aguaaaaauaaaacaaaaaaaccc

SEQ ID NO: 344853 - RNA, 23 nt, Human
auaaaacaaaaaaacccucaugc

SEQ ID NO: 344854 - RNA, 22 nt, Human
auaagaugaaauccacaauguu

SEQ ID NO: 344855 - RNA, 24 nt, Human
auaaucaucaaacauuugaaguau

SEQ ID NO: 344856 - RNA, 19 nt, Human
auauauauauauauauaua

SEQ ID NO: 344857 - RNA, 19 nt, Human
auauauauauauauauaua

SEQ ID NO: 344858 - RNA, 19 nt, Human
auauauauauauauauaua

SEQ ID NO: 344859 - RNA, 19 nt, Human
auauauauauauauauaua

SEQ ID NO: 344860 - RNA, 19 nt, Human
auauauauauauauauaua

SEQ ID NO: 344861 - RNA, 19 nt, Human
auauauauauauauauaua

SEQ ID NO: 344862 - RNA, 19 nt, Human
auauauauauauauauaua

SEQ ID NO: 344863 - RNA, 19 nt, Human
auauauauauauauauaua

SEQ ID NO: 344864 - RNA, 19 nt, Human
auauauauauauauauaua

SEQ ID NO: 344865 - RNA, 19 nt, Human
auauauauauauauauaua

SEQ ID NO: 344866 - RNA, 19 nt, Human
auauauauauauauauaua

SEQ ID NO: 344867 - RNA, 22 nt, Human
augguccacagauauaagauga

SEQ ID NO: 344868 - RNA, 19 nt, Human
augugauuugccaggaaaa

SEQ ID NO: 344869 - RNA, 25 nt, Human
caaaaaaaucaggaaauacugaaag

SEQ ID NO: 344870 - RNA, 24 nt, Human
caaaacaguaaauagacuagaagc

SEQ ID NO: 344871 - RNA, 23 nt, Human
caacaaaauaagaagucauuaaa

SEQ ID NO: 344872 - RNA, 18 nt, Human
caagacaggaaacaaaac

SEQ ID NO: 344873 - RNA, 22 nt, Human
caagagucuaaaacacaauaca

SEQ ID NO: 344874 - RNA, 22 nt, Human
cacaauacauuuuucagguagg

SEQ ID NO: 344875 - RNA, 18 nt, Human
cacacacacacacacaca

SEQ ID NO: 344876 - RNA, 20 nt, Human
cacacacacacacacacaca

SEQ ID NO: 344877 - RNA, 20 nt, Human
cacacacacacacacacaca

SEQ ID NO: 344878 - RNA, 20 nt, Human
cacacacacacacacacaca

SEQ ID NO: 344879 - RNA, 20 nt, Human
cacacacacacacacacaca

SEQ ID NO: 344880 - RNA, 20 nt, Human
cacacacacacacacacaca

SEQ ID NO: 344881 - RNA, 20 nt, Human
cacacacacacacacacaca

SEQ ID NO: 344882 - RNA, 20 nt, Human
cacacacacacacacacaca

SEQ ID NO: 344883 - RNA, 22 nt, Human
cacacacacacacacacacaca

SEQ ID NO: 344884 - RNA, 22 nt, Human
cacacacacacacacacacaca

SEQ ID NO: 344885 - RNA, 18 nt, Human
cacacauacacacacaca

SEQ ID NO: 344886 - RNA, 21 nt, Human
cacagacucaaacacacacag

SEQ ID NO: 344887 - RNA, 28 nt, Human
caccauaaagcuucuaagacuuauggga

SEQ ID NO: 344888 - RNA, 23 nt, Human
cacgcaagauagcauucugcuuu

SEQ ID NO: 344889 - RNA, 21 nt, Human
cacuaaagauaaucuucaucu

SEQ ID NO: 344890 - RNA, 22 nt, Human
cacuaaagauaaucuucaucuc

SEQ ID NO: 344891 - RNA, 25 nt, Human
caggaaaaaaaaaaaauucccccca

SEQ ID NO: 344892 - RNA, 19 nt, Human
ccaaaccaccauuagaaga

SEQ ID NO: 344893 - RNA, 21 nt, Human
cccaagcagaaucuauuccua

SEQ ID NO: 344894 - RNA, 19 nt, Human
cccagacuagaagacaagc

SEQ ID NO: 344895 - RNA, 19 nt, Human
ccccaaaccaaaacaccau

SEQ ID NO: 344896 - RNA, 18 nt, Human
cccccaaaccaaaacacc

SEQ ID NO: 344897 - RNA, 22 nt, Human
ccccccaaaccaaaacaccauu

SEQ ID NO: 344898 - RNA, 18 nt, Human
cccucagucugaauugug

SEQ ID NO: 344899 - RNA, 28 nt, Human
ccuaugguucaguuuaaaaccggggucc

SEQ ID NO: 344900 - RNA, 20 nt, Human
cggcccagacuagaagacaa

SEQ ID NO: 344901 - RNA, 22 nt, Human
gaaacacuuaggaguuaaagca

SEQ ID NO: 344902 - RNA, 24 nt, Human
gaauaaacuaggaugguccacaga

SEQ ID NO: 344903 - RNA, 23 nt, Human
gaccauaaucaucaaacauuuga

SEQ ID NO: 344904 - RNA, 18 nt, Human
gcauaauguagacaggag

SEQ ID NO: 344905 - RNA, 21 nt, Human
gccaucauagugaacaaccuu

SEQ ID NO: 344906 - RNA, 20 nt, Human
gcgugugugugucucucccu

SEQ ID NO: 344907 - RNA, 24 nt, Human
ggaaccuuuugaaaucaagagucu

SEQ ID NO: 344908 - RNA, 27 nt, Human
ggcuuuuguaauuuaaaaaaaaaaaaa

SEQ ID NO: 344909 - RNA, 21 nt, Human
gggaguuuaccggaaugagga

SEQ ID NO: 344910 - RNA, 20 nt, Human
guaaauagacuagaagccag

SEQ ID NO: 344911 - RNA, 19 nt, Human
uaaaaagcaguuuugauau

SEQ ID NO: 344912 - RNA, 22 nt, Human
uaaaacaaaaaaacccucaugc

SEQ ID NO: 344913 - RNA, 23 nt, Human
uaaaacaaaaaaacccucaugcc

SEQ ID NO: 344914 - RNA, 23 nt, Human
uaaccauaacucaaaaucuucaa

SEQ ID NO: 344915 - RNA, 22 nt, Human
uaacucaaaaucuucaagacag

SEQ ID NO: 344916 - RNA, 24 nt, Human
uaagaaguuuuuauaaauuguuuu

SEQ ID NO: 344917 - RNA, 20 nt, Human
uaagaugccaucauagugaa

SEQ ID NO: 344918 - RNA, 18 nt, Human
uagaagaaugaaauacga

SEQ ID NO: 344919 - RNA, 19 nt, Human
uagaagacaagcccaaacc

SEQ ID NO: 344920 - RNA, 20 nt, Human
uaguaccaaccugaugacaa

SEQ ID NO: 344921 - RNA, 20 nt, Human
uauauagauauauagauaua

SEQ ID NO: 344922 - RNA, 19 nt, Human
uauauauacacacauacac

SEQ ID NO: 344923 - RNA, 19 nt, Human
uauauauauauauauauau

SEQ ID NO: 344924 - RNA, 19 nt, Human
uauauauauauauauauau

SEQ ID NO: 344925 - RNA, 19 nt, Human
uauauauauauauauauau

SEQ ID NO: 344926 - RNA, 19 nt, Human
uauauauauauauauauau

SEQ ID NO: 344927 - RNA, 23 nt, Human
uauauauauauauauauauauac

SEQ ID NO: 344928 - RNA, 18 nt, Human
uaugcagaugauauucac

SEQ ID NO: 344929 - RNA, 22 nt, Human
uaugugacaggcagauaagcau

SEQ ID NO: 344930 - RNA, 27 nt, Human
uauugccucuguugguaauaugacagg

SEQ ID NO: 344931 - RNA, 20 nt, Human
uauuguacagacuauguaca

SEQ ID NO: 344932 - RNA, 25 nt, Human
ucaagacaggaaacaaaacaguaca

SEQ ID NO: 344933 - RNA, 18 nt, Human
ucacagacacagacucaa

SEQ ID NO: 344934 - RNA, 21 nt, Human
ucacugcagcuuuuauugccu

SEQ ID NO: 344935 - RNA, 20 nt, Human
uccagccagcagaaauugac

SEQ ID NO: 344936 - RNA, 21 nt, Human
ucugcuuugaugagaaaacug

SEQ ID NO: 344937 - RNA, 18 nt, Human
ugacaggcagauaagcau

SEQ ID NO: 344938 - RNA, 23 nt, Human
ugagaaaacugagcuaaucugag

SEQ ID NO: 344939 - RNA, 23 nt, Human
ugauaugucauuguuucuuaaaa

SEQ ID NO: 344940 - RNA, 21 nt, Human
ugauuugccaggaaaaaaaaa

SEQ ID NO: 344941 - RNA, 21 nt, Human
ugcaauuuucuguuguauuua

SEQ ID NO: 344942 - RNA, 21 nt, Human
uggcaaaaaggaaacuguacc

SEQ ID NO: 344943 - RNA, 22 nt, Human
uggcaaaaaggaaacuguaccu

SEQ ID NO: 344944 - RNA, 18 nt, Human
ugggagaauaaacuagga

SEQ ID NO: 344945 - RNA, 20 nt, Human
ugggagaauaaacuaggaug

SEQ ID NO: 344946 - RNA, 19 nt, Human
uguagccagacauuuaucu

SEQ ID NO: 344947 - RNA, 21 nt, Human
uguagccagacauuuaucuuc

SEQ ID NO: 344948 - RNA, 19 nt, Human
uguccuccaggccucuccc

SEQ ID NO: 344949 - RNA, 23 nt, Human
ugugaggauugaucuucaguuca

SEQ ID NO: 344950 - RNA, 19 nt, Human
uguggaaccuuuugaaauc

SEQ ID NO: 344951 - RNA, 20 nt, Human
uuaaaaaaaaaaaaaaaaaa

SEQ ID NO: 344952 - RNA, 20 nt, Human
uuaaaaaaaaaaaaaaaaaa

SEQ ID NO: 344953 - RNA, 24 nt, Human
uuaaaaaaaaaaaaaaaaaaaaau

SEQ ID NO: 344954 - RNA, 27 nt, Human
uucccuguagccagacauuuaucuuca

SEQ ID NO: 344955 - RNA, 20 nt, Human
uugcauaaaauguacugcua

SEQ ID NO: 344956 - RNA, 23 nt, Human
uugguguccuccaggccucuccc

SEQ ID NO: 344957 - RNA, 21 nt, Human
uuguaccuguuuugacauuug

SEQ ID NO: 344958 - RNA, 24 nt, Human
uuugacauuuggcaaaaaggaaac

SEQ ID NO: 344959 - RNA, 20 nt, Human
uuuggcaaaaaggaaacugu

SEQ ID NO: 344960 - RNA, 26 nt, Human
aaaaaaacaaaauacaugaaugcagg

SEQ ID NO: 344961 - RNA, 23 nt, Human
aaaacaaagcaagggaaacaaaa

SEQ ID NO: 344962 - RNA, 18 nt, Human
aaaaguacgcacucacca

SEQ ID NO: 344963 - RNA, 26 nt, Human
aaaauccuuuccauguaacauagcuu

SEQ ID NO: 344964 - RNA, 21 nt, Human
aaagcaagggaaacaaaaggc

SEQ ID NO: 344965 - RNA, 23 nt, Human
aaagcaagggaaacaaaaggcuu

SEQ ID NO: 344966 - RNA, 19 nt, Human
aaaguacgcacucaccaag

SEQ ID NO: 344967 - RNA, 23 nt, Human
aagggaaacaaaaggcuucaaaa

SEQ ID NO: 344968 - RNA, 18 nt, Human
aaugcaggaauguguaca

SEQ ID NO: 344969 - RNA, 20 nt, Human
acaaagcaagggaaacaaaa

SEQ ID NO: 344970 - RNA, 20 nt, Human
acaaagcaagggaaacaaaa

SEQ ID NO: 344971 - RNA, 20 nt, Human
acaaagcaagggaaacaaaa

SEQ ID NO: 344972 - RNA, 23 nt, Human
acacagucuacaccacaaccacc

SEQ ID NO: 344973 - RNA, 20 nt, Human
acaccacaaccaccugagcg

SEQ ID NO: 344974 - RNA, 22 nt, Human
acagcaagucaaugcuuaucag

SEQ ID NO: 344975 - RNA, 18 nt, Human
acucagucuauuaaaccc

SEQ ID NO: 344976 - RNA, 20 nt, Human
acuggagaagcaaaaaccua

SEQ ID NO: 344977 - RNA, 20 nt, Human
agaaagagagagccuucgaa

SEQ ID NO: 344978 - RNA, 18 nt, Human
aggaagacacacuuacua

SEQ ID NO: 344979 - RNA, 21 nt, Human
aggaauguguacagguagaaa

SEQ ID NO: 344980 - RNA, 18 nt, Human
aguuagggucagugacuu

SEQ ID NO: 344981 - RNA, 19 nt, Human
aucagacccaucugacuca

SEQ ID NO: 344982 - RNA, 21 nt, Human
caagcauuaccaacuauguag

SEQ ID NO: 344983 - RNA, 23 nt, Human
cacagucuacaccacaaccaccu

SEQ ID NO: 344984 - RNA, 24 nt, Human
caccgccaagacuuccccgcggac

SEQ ID NO: 344985 - RNA, 22 nt, Human
cacuguguagcuaacaugggau

SEQ ID NO: 344986 - RNA, 19 nt, Human
cagaagccugaaggcagag

SEQ ID NO: 344987 - RNA, 28 nt, Human
cagcgguccucagaagagacaauuuuga

SEQ ID NO: 344988 - RNA, 23 nt, Human
caucaagagccucugcacugugu

SEQ ID NO: 344989 - RNA, 22 nt, Human
ccaagacuuccccgcggacccc

SEQ ID NO: 344990 - RNA, 21 nt, Human
ccgcggaccccgcaacagcuc

SEQ ID NO: 344991 - RNA, 21 nt, Human
cgccccgcugagaagaaccca

SEQ ID NO: 344992 - RNA, 18 nt, Human
cuucauggucugcaguua

SEQ ID NO: 344993 - RNA, 20 nt, Human
gacacacuuacuaaaauccc

SEQ ID NO: 344994 - RNA, 22 nt, Human
gacacacuuacuaaaaucccca

SEQ ID NO: 344995 - RNA, 22 nt, Human
gaccgcuucucagcucgccccg

SEQ ID NO: 344996 - RNA, 19 nt, Human
gagcggggauggggggggg

SEQ ID NO: 344997 - RNA, 24 nt, Human
gccaagacuuccccgcggacccuu

SEQ ID NO: 344998 - RNA, 19 nt, Human
gccugaaggcagagggagu

SEQ ID NO: 344999 - RNA, 19 nt, Human
ggggauggggggggggugg

SEQ ID NO: 345000 - RNA, 22 nt, Human
uacaugaaugcaggaaugugua

SEQ ID NO: 345001 - RNA, 20 nt, Human
uagaaaaaguacgcacucac

SEQ ID NO: 345002 - RNA, 21 nt, Human
ucaaaauccuuuccauguaac

SEQ ID NO: 345003 - RNA, 21 nt, Human
uccaccaucaagagccucugc

SEQ ID NO: 345004 - RNA, 19 nt, Human
uccccaggugcucaugacc

SEQ ID NO: 345005 - RNA, 23 nt, Human
uccguaggccugacacagucuac

SEQ ID NO: 345006 - RNA, 19 nt, Human
ugaaauugacagaagccug

SEQ ID NO: 345007 - RNA, 25 nt, Human
ugacuggucuugcgcuagccacugg

SEQ ID NO: 345008 - RNA, 20 nt, Human
ugacuuacgacauaauuccu

SEQ ID NO: 345009 - RNA, 24 nt, Human
ugagaagaacccaaguugugagcg

SEQ ID NO: 345010 - RNA, 24 nt, Human
uggcugacuccguaggccugacac

SEQ ID NO: 345011 - RNA, 20 nt, Human
ugggaucgucacacggaggu

SEQ ID NO: 345012 - RNA, 21 nt, Human
uuaguccaccaucaagagccu

SEQ ID NO: 345013 - RNA, 21 nt, Human
uuccauguaacauagcuuuag

SEQ ID NO: 345014 - RNA, 23 nt, Human
uuugcaaacuucugcccgauugg

SEQ ID NO: 345015 - RNA, 23 nt, Human
uuuuuuuuuuuuuuuuuuuuagg

SEQ ID NO: 345016 - RNA, 23 nt, Human
aaaacaaaauaaaacagaagagc

SEQ ID NO: 345017 - RNA, 19 nt, Human
aaaacgcaguaacacuucu

SEQ ID NO: 345018 - RNA, 22 nt, Human
aaaagccuccgcggccaucuuu

SEQ ID NO: 345019 - RNA, 20 nt, Human
aaacaggcagaggccagcag

SEQ ID NO: 345020 - RNA, 23 nt, Human
aaacauuuuaagaagagaaacuc

SEQ ID NO: 345021 - RNA, 23 nt, Human
aacagauugugaaacuaggucca

SEQ ID NO: 345022 - RNA, 24 nt, Human
aaccuacuuccuagaagcccccug

SEQ ID NO: 345023 - RNA, 22 nt, Human
aagcaggaaagugcaauucuga

SEQ ID NO: 345024 - RNA, 19 nt, Human
aaggaagucagaggagaca

SEQ ID NO: 345025 - RNA, 21 nt, Human
acaaaacaaaauaaaacagaa

SEQ ID NO: 345026 - RNA, 19 nt, Human
acacuucuucuuuuccucu

SEQ ID NO: 345027 - RNA, 21 nt, Human
accacaaacgccuucccgcga

SEQ ID NO: 345028 - RNA, 18 nt, Human
agaacgcggccgccacug

SEQ ID NO: 345029 - RNA, 18 nt, Human
agagcaguaaguuucaaa

SEQ ID NO: 345030 - RNA, 18 nt, Human
aggaagucagaggagaca

SEQ ID NO: 345031 - RNA, 24 nt, Human
aggcagaggccagcagguuucucg

SEQ ID NO: 345032 - RNA, 21 nt, Human
auaaaacagaagagcaguaag

SEQ ID NO: 345033 - RNA, 19 nt, Human
caaagaggccgagaaggug

SEQ ID NO: 345034 - RNA, 25 nt, Human
cacuucuucuuuuccucugccccug

SEQ ID NO: 345035 - RNA, 27 nt, Human
cagaagagcaguaaguuucaaaaggaa

SEQ ID NO: 345036 - RNA, 23 nt, Human
cagcuguaaaauaucucagguac

SEQ ID NO: 345037 - RNA, 18 nt, Human
caggcagaggccagcagg

SEQ ID NO: 345038 - RNA, 23 nt, Human
caucccugucaauugcccaucuc

SEQ ID NO: 345039 - RNA, 18 nt, Human
caugacaagcaggaaagu

SEQ ID NO: 345040 - RNA, 25 nt, Human
ccacacaaccaaagugggaaaugaa

SEQ ID NO: 345041 - RNA, 19 nt, Human
cccaguuggcuccaaaagc

SEQ ID NO: 345042 - RNA, 24 nt, Human
cccucugagcuucaaacaaaacaa

SEQ ID NO: 345043 - RNA, 22 nt, Human
ccuauaacgcccugguccugcu

SEQ ID NO: 345044 - RNA, 19 nt, Human
ccucaagaaaucccacccu

SEQ ID NO: 345045 - RNA, 20 nt, Human
ccugcucaucuuucagcagu

SEQ ID NO: 345046 - RNA, 24 nt, Human
cgcucccaguuggcuccaaaagcc

SEQ ID NO: 345047 - RNA, 24 nt, Human
cuccaaaagccuccgcggccaucu

SEQ ID NO: 345048 - RNA, 18 nt, Human
cuccucugcccaugcucc

SEQ ID NO: 345049 - RNA, 18 nt, Human
cugcucaucuuucagcag

SEQ ID NO: 345050 - RNA, 22 nt, Human
cuggcaccacaaacgccuuccc

SEQ ID NO: 345051 - RNA, 21 nt, Human
cugucuccucugcccaugcuc

SEQ ID NO: 345052 - RNA, 22 nt, Human
cugucuccucugcccaugcucc

SEQ ID NO: 345053 - RNA, 23 nt, Human
cuuccuagaagcccccuggccag

SEQ ID NO: 345054 - RNA, 20 nt, Human
gaaaacaggcagaggccagc

SEQ ID NO: 345055 - RNA, 19 nt, Human
gaaaacgcguacugcgcuc

SEQ ID NO: 345056 - RNA, 19 nt, Human
gcccugguccugcucaucu

SEQ ID NO: 345057 - RNA, 20 nt, Human
ggagccagucagcucccggg

SEQ ID NO: 345058 - RNA, 22 nt, Human
gggaauagcggaaaaccacaga

SEQ ID NO: 345059 - RNA, 20 nt, Human
guaaaauaucucagguaccc

SEQ ID NO: 345060 - RNA, 20 nt, Human
uaaacauuuuaagaagagaa

SEQ ID NO: 345061 - RNA, 18 nt, Human
uacaaaacgcaguaacac

SEQ ID NO: 345062 - RNA, 22 nt, Human
uaccgcagaacuucauguucac

SEQ ID NO: 345063 - RNA, 19 nt, Human
uagaagcccccuggccaga

SEQ ID NO: 345064 - RNA, 21 nt, Human
uagcauccuuccaauuccauc

SEQ ID NO: 345065 - RNA, 19 nt, Human
uaucucagguacccaguua

SEQ ID NO: 345066 - RNA, 19 nt, Human
ucagccaaucggugcucac

SEQ ID NO: 345067 - RNA, 21 nt, Human
ucagcucccggggugcucgcu

SEQ ID NO: 345068 - RNA, 18 nt, Human
uccugucuccucugccca

SEQ ID NO: 345069 - RNA, 21 nt, Human
ucuccugguagcauccuucca

SEQ ID NO: 345070 - RNA, 25 nt, Human
ucuggcaccacaaacgccuucccgc

SEQ ID NO: 345071 - RNA, 22 nt, Human
ugauagaugaaaccuacuuccu

SEQ ID NO: 345072 - RNA, 24 nt, Human
ugccacacaaccaaagugggaaau

SEQ ID NO: 345073 - RNA, 26 nt, Human
uggcaccacaaacgccuucccgcgaa

SEQ ID NO: 345074 - RNA, 24 nt, Human
ugggggaauagcggaaaaccacag

SEQ ID NO: 345075 - RNA, 18 nt, Human
uguaacaagcuuauuugu

SEQ ID NO: 345076 - RNA, 24 nt, Human
ugugucaaaaagucaugacaagca

SEQ ID NO: 345077 - RNA, 20 nt, Human
uuccuagaagcccccuggcc

SEQ ID NO: 345078 - RNA, 21 nt, Human
uuccucaagaaaucccacccu

SEQ ID NO: 345079 - RNA, 19 nt, Human
uucuucuuuuccucugccc

SEQ ID NO: 345080 - RNA, 22 nt, Human
uuuguacaaaacgcaguaacac

SEQ ID NO: 345081 - RNA, 20 nt, Human
aaauguccucuuggagccuc

SEQ ID NO: 345082 - RNA, 22 nt, Human
aauaaguaagaagaauguggua

SEQ ID NO: 345083 - RNA, 19 nt, Human
acuugaccccggaaguggg

SEQ ID NO: 345084 - RNA, 19 nt, Human
acuuucuccacuuucucca

SEQ ID NO: 345085 - RNA, 20 nt, Human
agaggcaguggaggcgggac

SEQ ID NO: 345086 - RNA, 20 nt, Human
agagucaaaagagcuaggcg

SEQ ID NO: 345087 - RNA, 26 nt, Human
aucgcaaucgcgcugucucugaaagg

SEQ ID NO: 345088 - RNA, 27 nt, Human
cauucuucccgcgaacagagucaaaag

SEQ ID NO: 345089 - RNA, 27 nt, Human
ccaagacugcggcuggcgggaaaccca

SEQ ID NO: 345090 - RNA, 24 nt, Human
ccacaccauuucagccucauuuuc

SEQ ID NO: 345091 - RNA, 27 nt, Human
cccaggugcucugcugcuugguuaggg

SEQ ID NO: 345092 - RNA, 21 nt, Human
cccccuuggagaugggccgcg

SEQ ID NO: 345093 - RNA, 19 nt, Human
cccgcccccuuggagaugg

SEQ ID NO: 345094 - RNA, 21 nt, Human
cccgcccccuuggagaugggc

SEQ ID NO: 345095 - RNA, 21 nt, Human
ccgcggugcugugggugcugc

SEQ ID NO: 345096 - RNA, 19 nt, Human
cgagaggcaguggaggcgg

SEQ ID NO: 345097 - RNA, 21 nt, Human
cguaccagcuguucacugcug

SEQ ID NO: 345098 - RNA, 23 nt, Human
cuacuuucuccacuuucuccacc

SEQ ID NO: 345099 - RNA, 22 nt, Human
cucauaaaauaaguaagaagaa

SEQ ID NO: 345100 - RNA, 18 nt, Human
cucgccuucccucuugcc

SEQ ID NO: 345101 - RNA, 21 nt, Human
cucuugccaguucugcguggg

SEQ ID NO: 345102 - RNA, 21 nt, Human
cugaaacuauuguauucccug

SEQ ID NO: 345103 - RNA, 22 nt, Human
cugugcauugucuucacauccu

SEQ ID NO: 345104 - RNA, 21 nt, Human
cuuacuguuuccccauucuuc

SEQ ID NO: 345105 - RNA, 18 nt, Human
cuuucuccacuuucucca

SEQ ID NO: 345106 - RNA, 19 nt, Human
gaaagggguggagaagggg

SEQ ID NO: 345107 - RNA, 24 nt, Human
gaugaagcaaaaggaaacuguaca

SEQ ID NO: 345108 - RNA, 18 nt, Human
gcgugggaggcgcgggag

SEQ ID NO: 345109 - RNA, 19 nt, Human
gcuggcgggaaacccacgg

SEQ ID NO: 345110 - RNA, 19 nt, Human
gcugucucugaaaggggug

SEQ ID NO: 345111 - RNA, 19 nt, Human
gcuucgccaauuaaaugcg

SEQ ID NO: 345112 - RNA, 22 nt, Human
ggagaugggccgcggggucauc

SEQ ID NO: 345113 - RNA, 21 nt, Human
ggugcggcgggggacugcggg

SEQ ID NO: 345114 - RNA, 23 nt, Human
guucacugcugucucgccuuccc

SEQ ID NO: 345115 - RNA, 20 nt, Human
uaaguaagaagaauguggua

SEQ ID NO: 345116 - RNA, 18 nt, Human
uacauuguugcaggagau

SEQ ID NO: 345117 - RNA, 22 nt, Human
ucagugaucuugaucacuuucu

SEQ ID NO: 345118 - RNA, 23 nt, Human
ucauuacauuguugcaggagaug

SEQ ID NO: 345119 - RNA, 20 nt, Human
uccaaaaauguccucuugga

SEQ ID NO: 345120 - RNA, 18 nt, Human
ucccuuagcugcgucacu

SEQ ID NO: 345121 - RNA, 23 nt, Human
ucccuuagcugcgucacucuacu

SEQ ID NO: 345122 - RNA, 19 nt, Human
ucgcgggaggcgccgcaac

SEQ ID NO: 345123 - RNA, 20 nt, Human
ucuacuuucuccacuuucuc

SEQ ID NO: 345124 - RNA, 27 nt, Human
ucuucccgcgaacagagucaaaagagc

SEQ ID NO: 345125 - RNA, 21 nt, Human
ugaaagggguggagaaggggc

SEQ ID NO: 345126 - RNA, 24 nt, Human
ugaaagggguggagaaggggcugg

SEQ ID NO: 345127 - RNA, 21 nt, Human
ugaccccggaaguggggugug

SEQ ID NO: 345128 - RNA, 20 nt, Human
ugacuugaccccggaagugg

SEQ ID NO: 345129 - RNA, 18 nt, Human
ugcauugucuucacaucc

SEQ ID NO: 345130 - RNA, 18 nt, Human
ugcgugggaggcgcggga

SEQ ID NO: 345131 - RNA, 19 nt, Human
uggaagaauaguaucucau

SEQ ID NO: 345132 - RNA, 30 nt, Human
uuaauauagcucauuuacaaucguaugaaa

SEQ ID NO: 345133 - RNA, 22 nt, Human
uuuuuuuuuuuuuuuuuccuuu

SEQ ID NO: 345134 - RNA, 26 nt, Human
uuuuuuuuuuuuuuuuuuuccuuuaa

SEQ ID NO: 345135 - RNA, 25 nt, Human
uuuuuuuuuuuuuuuuuuuuccuuu

SEQ ID NO: 345136 - RNA, 25 nt, Human
uuuuuuuuuuuuuuuuuuuuuccuu

SEQ ID NO: 345137 - RNA, 25 nt, Human
aaaaaaccauaaagacuuccuuugc

SEQ ID NO: 345138 - RNA, 23 nt, Human
aaacaaaagccagacaaacccaa

SEQ ID NO: 345139 - RNA, 25 nt, Human
aaacaaaagccagacaaaccgacgc

SEQ ID NO: 345140 - RNA, 24 nt, Human
aaacaaaucacaauaacaugaaau

SEQ ID NO: 345141 - RNA, 26 nt, Human
aaacagcugagaaacaacaaaauucu

SEQ ID NO: 345142 - RNA, 19 nt, Human
aaagaaaaagaaaacaaaa

SEQ ID NO: 345143 - RNA, 20 nt, Human
aaagcuuucccaagcugaau

SEQ ID NO: 345144 - RNA, 21 nt, Human
aacaaaagccagacaaaccca

SEQ ID NO: 345145 - RNA, 23 nt, Human
aacaaaagccagacaaacccaag

SEQ ID NO: 345146 - RNA, 19 nt, Human
aacacccugauaaaaucua

SEQ ID NO: 345147 - RNA, 21 nt, Human
aacaguaucuuacucacuaau

SEQ ID NO: 345148 - RNA, 28 nt, Human
aacaugaaauagaaaaaaaccauaaagg

SEQ ID NO: 345149 - RNA, 22 nt, Human
aacccaccucccaagggcucca

SEQ ID NO: 345150 - RNA, 23 nt, Human
aagaaaaagaaaacaaaagccag

SEQ ID NO: 345151 - RNA, 22 nt, Human
aagaaugguggggaggaaucac

SEQ ID NO: 345152 - RNA, 24 nt, Human
aagccagacaaacccaaguugucc

SEQ ID NO: 345153 - RNA, 18 nt, Human
aaucaguuuuaaucacug

SEQ ID NO: 345154 - RNA, 18 nt, Human
acaaacccaaguugucca

SEQ ID NO: 345155 - RNA, 24 nt, Human
acaaagcuuucccaagcugaauaa

SEQ ID NO: 345156 - RNA, 20 nt, Human
acagacaaaauuuguuuuug

SEQ ID NO: 345157 - RNA, 21 nt, Human
acagagguuuuacuuuuuccu

SEQ ID NO: 345158 - RNA, 18 nt, Human
acaggaacacugggcucc

SEQ ID NO: 345159 - RNA, 22 nt, Human
acccaccucccaagggcuccau

SEQ ID NO: 345160 - RNA, 26 nt, Human
auccuuuccaggguaccacccuauua

SEQ ID NO: 345161 - RNA, 22 nt, Human
caaagcuuucccaagcugaaua

SEQ ID NO: 345162 - RNA, 22 nt, Human
caagcaagcucuagucugugcu

SEQ ID NO: 345163 - RNA, 22 nt, Human
cacacaucaaguguaaggugaa

SEQ ID NO: 345164 - RNA, 19 nt, Human
cacgaguccccggcaaggc

SEQ ID NO: 345165 - RNA, 22 nt, Human
caggaagaaacccaagcaagcu

SEQ ID NO: 345166 - RNA, 21 nt, Human
ccauaccgcuggcucccaaaa

SEQ ID NO: 345167 - RNA, 21 nt, Human
cccuggguuucacacauuguu

SEQ ID NO: 345168 - RNA, 18 nt, Human
ccggagcacucggccccu

SEQ ID NO: 345169 - RNA, 24 nt, Human
ccggcaaggcuagagcgucacccc

SEQ ID NO: 345170 - RNA, 24 nt, Human
cguucuuaagaaugguggggagga

SEQ ID NO: 345171 - RNA, 22 nt, Human
cuacucagagcuaacacaacag

SEQ ID NO: 345172 - RNA, 23 nt, Human
cucaagaagucuauugauauugg

SEQ ID NO: 345173 - RNA, 22 nt, Human
cucagagcuaacacaacagcau

SEQ ID NO: 345174 - RNA, 19 nt, Human
cuggaaugaauaacugcuc

SEQ ID NO: 345175 - RNA, 20 nt, Human
gacucuguauccugucaucu

SEQ ID NO: 345176 - RNA, 18 nt, Human
gaguccccggcaaggcua

SEQ ID NO: 345177 - RNA, 18 nt, Human
ggccccuaaauuggccag

SEQ ID NO: 345178 - RNA, 23 nt, Human
gguaccacccuauuaagcauuaa

SEQ ID NO: 345179 - RNA, 19 nt, Human
uaaaaacaguaucuuacuc

SEQ ID NO: 345180 - RNA, 20 nt, Human
uaaacaaaucacaauaacau

SEQ ID NO: 345181 - RNA, 20 nt, Human
uaaauugcaucacuaaaaau

SEQ ID NO: 345182 - RNA, 18 nt, Human
uaaguaaaaagcuucuuu

SEQ ID NO: 345183 - RNA, 24 nt, Human
uaauaugcccuccuuagacauuaa

SEQ ID NO: 345184 - RNA, 22 nt, Human
uacagaccagaaauucuaccac

SEQ ID NO: 345185 - RNA, 22 nt, Human
uaccgcuggcucccaaaagcaa

SEQ ID NO: 345186 - RNA, 23 nt, Human
uaccuaacccaccucccaagggc

SEQ ID NO: 345187 - RNA, 24 nt, Human
uacuuuauaacucacaaaaauaua

SEQ ID NO: 345188 - RNA, 21 nt, Human
uagaaaaaaaccauaaagacu

SEQ ID NO: 345189 - RNA, 23 nt, Human
uagaaccccuggguuucacacau

SEQ ID NO: 345190 - RNA, 22 nt, Human
uagcugacacauauuuuuagac

SEQ ID NO: 345191 - RNA, 24 nt, Human
ucaacccaauauuaccuccaaaca

SEQ ID NO: 345192 - RNA, 21 nt, Human
ucagagcuaacacaacagcau

SEQ ID NO: 345193 - RNA, 21 nt, Human
ucuuaagaaugguggggagga

SEQ ID NO: 345194 - RNA, 23 nt, Human
ucuuaagaaugguggggaggaau

SEQ ID NO: 345195 - RNA, 18 nt, Human
ucuuauuuuuugaaccuu

SEQ ID NO: 345196 - RNA, 21 nt, Human
ugauagauuuuaagaaccaag

SEQ ID NO: 345197 - RNA, 18 nt, Human
ugcaggaagaaacccaag

SEQ ID NO: 345198 - RNA, 21 nt, Human
ugcuuugacaaaacacccuga

SEQ ID NO: 345199 - RNA, 21 nt, Human
uggccaggucgcuguugagga

SEQ ID NO: 345200 - RNA, 20 nt, Human
uguuaaagguccagcuagaa

SEQ ID NO: 345201 - RNA, 21 nt, Human
uguuaaagguccagcuagaaa

SEQ ID NO: 345202 - RNA, 21 nt, Human
uuaagaaccaagaauauggua

SEQ ID NO: 345203 - RNA, 23 nt, Human
uuaauucucaacagaaccccaca

SEQ ID NO: 345204 - RNA, 20 nt, Human
uucuaaauucugggacuagu

SEQ ID NO: 345205 - RNA, 25 nt, Human
uuuaaagaaaaagaaaacaaaagcc

SEQ ID NO: 345206 - RNA, 19 nt, Human
uuucaugaacaggaacacu

SEQ ID NO: 345207 - RNA, 18 nt, Human
aaaccaugacauauagca

SEQ ID NO: 345208 - RNA, 20 nt, Human
agcugauuuucucaguuuug

SEQ ID NO: 345209 - RNA, 24 nt, Human
auacuagaauuaagauauaaaaca

SEQ ID NO: 345210 - RNA, 23 nt, Human
auguuaaaaauauaauuggagca

SEQ ID NO: 345211 - RNA, 25 nt, Human
caacauuaucccauaaucugauuuu

SEQ ID NO: 345212 - RNA, 21 nt, Human
cauuuuaugcucuguuuuuuu

SEQ ID NO: 345213 - RNA, 19 nt, Human
cccugguuugagaaaaagu

SEQ ID NO: 345214 - RNA, 23 nt, Human
ccuuauugcaugauacuuccuug

SEQ ID NO: 345215 - RNA, 19 nt, Human
cuuaaucucugagauguua

SEQ ID NO: 345216 - RNA, 23 nt, Human
gcaucugcaaguuaaaaccauga

SEQ ID NO: 345217 - RNA, 24 nt, Human
gcgcaucugcaaguuaaaaccaug

SEQ ID NO: 345218 - RNA, 18 nt, Human
ggaauuaaaagccauuua

SEQ ID NO: 345219 - RNA, 20 nt, Human
uaaaacagauacuagaauua

SEQ ID NO: 345220 - RNA, 24 nt, Human
uaagcuuuuaauauauaacuuaau

SEQ ID NO: 345221 - RNA, 20 nt, Human
uagaauuaagauauaaaaca

SEQ ID NO: 345222 - RNA, 21 nt, Human
uauaauaggaauuaaaagcca

SEQ ID NO: 345223 - RNA, 23 nt, Human
ucccugguuugagaaaaaguuug

SEQ ID NO: 345224 - RNA, 23 nt, Human
uccuugacucagcaaagccacau

SEQ ID NO: 345225 - RNA, 21 nt, Human
ucucaguuuugcuaccaaaaa

SEQ ID NO: 345226 - RNA, 23 nt, Human
ucuuagaugauagucccugguuu

SEQ ID NO: 345227 - RNA, 23 nt, Human
ugaagcugauuuucucaguuuug

SEQ ID NO: 345228 - RNA, 22 nt, Human
ugagcaguuacguauacgcaaa

SEQ ID NO: 345229 - RNA, 24 nt, Human
ugcacaaugcuuaaauacaauuaa

SEQ ID NO: 345230 - RNA, 25 nt, Human
ugcucuguuuuuuuaaauauaguca

SEQ ID NO: 345231 - RNA, 19 nt, Human
ugcuuucaagcauaaaaca

SEQ ID NO: 345232 - RNA, 23 nt, Human
uggaacaaaagaaauuuaaaaac

SEQ ID NO: 345233 - RNA, 23 nt, Human
uggagcagauagguaccuaaaau

SEQ ID NO: 345234 - RNA, 22 nt, Human
ugguugagaggccucaguugau

SEQ ID NO: 345235 - RNA, 18 nt, Human
uguaauaaacggaaaggu

SEQ ID NO: 345236 - RNA, 18 nt, Human
uuagaugauagucccugg

SEQ ID NO: 345237 - RNA, 23 nt, Human
uugagaggccucaguugauuaaa

SEQ ID NO: 345238 - RNA, 22 nt, Human
uugauugcagaccugaagcuga

SEQ ID NO: 345239 - RNA, 22 nt, Human
uuugguuugacauuuaguaauu

SEQ ID NO: 345240 - RNA, 24 nt, Human
caauacugaacaguuaaggccaca

SEQ ID NO: 345241 - RNA, 25 nt, Human
ccacaacacuuuagggagaauuuga

SEQ ID NO: 345242 - RNA, 21 nt, Human
ccugcgccggggccaggaggc

SEQ ID NO: 345243 - RNA, 25 nt, Human
ggcaguacgggcagccugcgccggg

SEQ ID NO: 345244 - RNA, 22 nt, Human
uaaauaaauaucaaaacugguc

SEQ ID NO: 345245 - RNA, 23 nt, Human
uagcauaaauaaauaucaaaacu

SEQ ID NO: 345246 - RNA, 18 nt, Human
uauacauuacaauacacu

SEQ ID NO: 345247 - RNA, 19 nt, Human
ugacugugaaaacauaaau

SEQ ID NO: 345248 - RNA, 21 nt, Human
uuaagucuuauaucuuuuaaa

SEQ ID NO: 345249 - RNA, 22 nt, Human
aaagaaacuaaacagacccagg

SEQ ID NO: 345250 - RNA, 19 nt, Human
aacauggagaaaccccauc

SEQ ID NO: 345251 - RNA, 20 nt, Human
aacauggagaaaccccaucu

SEQ ID NO: 345252 - RNA, 21 nt, Human
aacauggagaaaccccaucuc

SEQ ID NO: 345253 - RNA, 19 nt, Human
aaccaaagaaacuaaacag

SEQ ID NO: 345254 - RNA, 24 nt, Human
aaggaccggucagggaggagccgg

SEQ ID NO: 345255 - RNA, 25 nt, Human
aaggcccuuccagacccaggaaccc

SEQ ID NO: 345256 - RNA, 24 nt, Human
aaucgcuugagcccgggaggugga

SEQ ID NO: 345257 - RNA, 21 nt, Human
acaaaaaccaaagaaacuaaa

SEQ ID NO: 345258 - RNA, 19 nt, Human
acacugcaugugggaaacc

SEQ ID NO: 345259 - RNA, 19 nt, Human
accagagcuucccagcucc

SEQ ID NO: 345260 - RNA, 27 nt, Human
acgcagcuucggaggccgugcccuagg

SEQ ID NO: 345261 - RNA, 18 nt, Human
acugcaccccagccuggg

SEQ ID NO: 345262 - RNA, 23 nt, Human
acugcaccccagccugggcaaca

SEQ ID NO: 345263 - RNA, 23 nt, Human
agacaggcugagcaaaaaccagg

SEQ ID NO: 345264 - RNA, 24 nt, Human
agacaggcugagcaaaaaccaggc

SEQ ID NO: 345265 - RNA, 24 nt, Human
agcacuuugggaggccgaggcggg

SEQ ID NO: 345266 - RNA, 24 nt, Human
agccuggccaacauggagaaaccc

SEQ ID NO: 345267 - RNA, 21 nt, Human
aggacaaaaagugaauggugg

SEQ ID NO: 345268 - RNA, 19 nt, Human
aggaggcaggaaggauggg

SEQ ID NO: 345269 - RNA, 21 nt, Human
aggauugggugcgguggcuca

SEQ ID NO: 345270 - RNA, 23 nt, Human
aggcaggaaggaugggagggugu

SEQ ID NO: 345271 - RNA, 18 nt, Human
aggcaggccaugagggga

SEQ ID NO: 345272 - RNA, 21 nt, Human
aggccgaggcgggcggaucac

SEQ ID NO: 345273 - RNA, 24 nt, Human
aggccgugcccuagguuucauuua

SEQ ID NO: 345274 - RNA, 26 nt, Human
aggcgggcggaucacuugagaccagg

SEQ ID NO: 345275 - RNA, 24 nt, Human
aggcugaggugagagaaucgcuug

SEQ ID NO: 345276 - RNA, 20 nt, Human
agggagagggagaggguggg

SEQ ID NO: 345277 - RNA, 22 nt, Human
agggaggagccgggcagggucu

SEQ ID NO: 345278 - RNA, 18 nt, Human
aggugagagaaucgcuug

SEQ ID NO: 345279 - RNA, 24 nt, Human
aggugagagaaucgcuugagcccg

SEQ ID NO: 345280 - RNA, 21 nt, Human
agguggagguugcagugagcc

SEQ ID NO: 345281 - RNA, 22 nt, Human
agguggagguugcagugagccg

SEQ ID NO: 345282 - RNA, 23 nt, Human
agugaauggugggggcccaggag

SEQ ID NO: 345283 - RNA, 23 nt, Human
auagcaacggagauagccccacc

SEQ ID NO: 345284 - RNA, 24 nt, Human
aucacuugagaccaggaguucaag

SEQ ID NO: 345285 - RNA, 24 nt, Human
aucgugccacugcaccccagccug

SEQ ID NO: 345286 - RNA, 25 nt, Human
caaaaacaaacaaacauacaaaaac

SEQ ID NO: 345287 - RNA, 26 nt, Human
caaaaacaaacaaacauacaaaaacc

SEQ ID NO: 345288 - RNA, 21 nt, Human
caaaaaccaaagaaacuaaac

SEQ ID NO: 345289 - RNA, 24 nt, Human
caaacauacaaaaaccaaagaaac

SEQ ID NO: 345290 - RNA, 21 nt, Human
caaagcugucagcugcaggcc

SEQ ID NO: 345291 - RNA, 24 nt, Human
caacauggagaaaccccaucucuu

SEQ ID NO: 345292 - RNA, 24 nt, Human
cacaccuguaaucccagcacuuug

SEQ ID NO: 345293 - RNA, 18 nt, Human
cacccgcgguccugggcc

SEQ ID NO: 345294 - RNA, 19 nt, Human
caccugaacgcugcucuuc

SEQ ID NO: 345295 - RNA, 23 nt, Human
caccuguaaucccagcacuuugg

SEQ ID NO: 345296 - RNA, 24 nt, Human
caccuguaaucccagcacuuuggg

SEQ ID NO: 345297 - RNA, 23 nt, Human
cacugcaccccagccugggcaac

SEQ ID NO: 345298 - RNA, 24 nt, Human
cacugcaccccagccugggcaaca

SEQ ID NO: 345299 - RNA, 21 nt, Human
cagacccaggaacccgggguu

SEQ ID NO: 345300 - RNA, 24 nt, Human
cagcacuuugggaggccgaggcgg

SEQ ID NO: 345301 - RNA, 24 nt, Human
cagccuggccaacauggagaaacc

SEQ ID NO: 345302 - RNA, 20 nt, Human
caucuguaaucccaccuacu

SEQ ID NO: 345303 - RNA, 24 nt, Human
caucuguaaucccaccuacucagg

SEQ ID NO: 345304 - RNA, 19 nt, Human
ccaaagaaacuaaacagac

SEQ ID NO: 345305 - RNA, 20 nt, Human
ccaacccaagacacgcgcaa

SEQ ID NO: 345306 - RNA, 23 nt, Human
ccaacccaagacacgcgcaaacu

SEQ ID NO: 345307 - RNA, 22 nt, Human
ccaagccaaaccuccugaagag

SEQ ID NO: 345308 - RNA, 21 nt, Human
ccacugcaccccagccugggc

SEQ ID NO: 345309 - RNA, 23 nt, Human
ccacugcaccccagccugggcaa

SEQ ID NO: 345310 - RNA, 24 nt, Human
ccacugcaccccagccugggcaac

SEQ ID NO: 345311 - RNA, 26 nt, Human
ccagaagcauuugcccauacucugaa

SEQ ID NO: 345312 - RNA, 18 nt, Human
ccagcccaugggaggggg

SEQ ID NO: 345313 - RNA, 24 nt, Human
cccaagacacgcgcaaacuuaaaa

SEQ ID NO: 345314 - RNA, 19 nt, Human
cccccagcccaacccaaga

SEQ ID NO: 345315 - RNA, 19 nt, Human
ccccccagcccaacccaag

SEQ ID NO: 345316 - RNA, 21 nt, Human
cccgggagguggagguugcag

SEQ ID NO: 345317 - RNA, 19 nt, Human
ccgacacacacacacacgg

SEQ ID NO: 345318 - RNA, 19 nt, Human
ccucaugcuugcugucucc

SEQ ID NO: 345319 - RNA, 19 nt, Human
ccuccugaagagaagugaa

SEQ ID NO: 345320 - RNA, 24 nt, Human
ccucuaaggggccacacgcagcuu

SEQ ID NO: 345321 - RNA, 24 nt, Human
ccuggccaacauggagaaacccca

SEQ ID NO: 345322 - RNA, 19 nt, Human
ccugggccagcccauggga

SEQ ID NO: 345323 - RNA, 19 nt, Human
cgacacacacacacacguu

SEQ ID NO: 345324 - RNA, 23 nt, Human
cgaggcgggcggaucacuugaga

SEQ ID NO: 345325 - RNA, 22 nt, Human
cgcgaucgugccacugcacccc

SEQ ID NO: 345326 - RNA, 24 nt, Human
cggaucacuugagaccaggaguuc

SEQ ID NO: 345327 - RNA, 27 nt, Human
cggaucacuugagaccaggaguucaag

SEQ ID NO: 345328 - RNA, 29 nt, Human
cgggagguggagguugcagugacaacggu

SEQ ID NO: 345329 - RNA, 24 nt, Human
cgggagguggagguugcagugagc

SEQ ID NO: 345330 - RNA, 24 nt, Human
cgggcggaucacuugagaccagga

SEQ ID NO: 345331 - RNA, 23 nt, Human
cguacaaguguccacuacacaaa

SEQ ID NO: 345332 - RNA, 22 nt, Human
cucacaccuguaaucccagcac

SEQ ID NO: 345333 - RNA, 24 nt, Human
cucacaccuguaaucccagcacuu

SEQ ID NO: 345334 - RNA, 22 nt, Human
cuccacagggaagucuguucca

SEQ ID NO: 345335 - RNA, 19 nt, Human
cuggcucugaugcucaccu

SEQ ID NO: 345336 - RNA, 25 nt, Human
cugggccagcccaugggaggggggc

SEQ ID NO: 345337 - RNA, 21 nt, Human
cuguaaucccaccuacucagg

SEQ ID NO: 345338 - RNA, 22 nt, Human
cuucagggaaggguuuuccaga

SEQ ID NO: 345339 - RNA, 21 nt, Human
gacaaaaagugaauggugggg

SEQ ID NO: 345340 - RNA, 21 nt, Human
gagauagccccaccgggcggc

SEQ ID NO: 345341 - RNA, 30 nt, Human
gagcaaaaaccaggcaggccaugaggggaa

SEQ ID NO: 345342 - RNA, 25 nt, Human
gaggcgggcggaucacuugagacca

SEQ ID NO: 345343 - RNA, 24 nt, Human
gagggcagugguuggagggggugg

SEQ ID NO: 345344 - RNA, 23 nt, Human
gagucacaucugagaugaaguca

SEQ ID NO: 345345 - RNA, 24 nt, Human
gaucacuugagaccaggaguucaa

SEQ ID NO: 345346 - RNA, 24 nt, Human
gccaacauggagaaaccccaucuc

SEQ ID NO: 345347 - RNA, 24 nt, Human
gccacugcaccccagccugggcaa

SEQ ID NO: 345348 - RNA, 20 nt, Human
gcgagacugugucaaaaaca

SEQ ID NO: 345349 - RNA, 20 nt, Human
gcgguggcucacaccuguaa

SEQ ID NO: 345350 - RNA, 21 nt, Human
gcucuggcucugaugcucacc

SEQ ID NO: 345351 - RNA, 18 nt, Human
ggagcacccggcuggggg

SEQ ID NO: 345352 - RNA, 24 nt, Human
ggagguugcagugagccgcgaucg

SEQ ID NO: 345353 - RNA, 23 nt, Human
ggaucacuugagaccaggaguuc

SEQ ID NO: 345354 - RNA, 26 nt, Human
ggcaggaggcaggaaggaugggaggg

SEQ ID NO: 345355 - RNA, 19 nt, Human
gggcccaggagcucccagc

SEQ ID NO: 345356 - RNA, 19 nt, Human
ggguuuggggcaggaggca

SEQ ID NO: 345357 - RNA, 23 nt, Human
gguggcucacaccuguaauccca

SEQ ID NO: 345358 - RNA, 24 nt, Human
gguggcucacaccuguaaucccag

SEQ ID NO: 345359 - RNA, 18 nt, Human
gucagguucacagccacu

SEQ ID NO: 345360 - RNA, 24 nt, Human
guugcagugagccgcgaucgugcc

SEQ ID NO: 345361 - RNA, 24 nt, Human
uaaacagacccagguuucacccgc

SEQ ID NO: 345362 - RNA, 18 nt, Human
uaacgugccacagggaaa

SEQ ID NO: 345363 - RNA, 23 nt, Human
uacaaaaaccaaagaaacuaaac

SEQ ID NO: 345364 - RNA, 25 nt, Human
uacaaaaaccaaagaaacuaaacag

SEQ ID NO: 345365 - RNA, 20 nt, Human
uacaaguguccacuacacaa

SEQ ID NO: 345366 - RNA, 20 nt, Human
uagaugguuucaauaaggca

SEQ ID NO: 345367 - RNA, 24 nt, Human
uaggauugggugcgguggcucaca

SEQ ID NO: 345368 - RNA, 22 nt, Human
ucaauaaggcagacgauccucc

SEQ ID NO: 345369 - RNA, 19 nt, Human
ucacccgcgguccugggcc

SEQ ID NO: 345370 - RNA, 19 nt, Human
ucagggaggagccgggcag

SEQ ID NO: 345371 - RNA, 20 nt, Human
uccacuacacaaauucugcu

SEQ ID NO: 345372 - RNA, 19 nt, Human
ucccagcuccucaagcuga

SEQ ID NO: 345373 - RNA, 24 nt, Human
ucgcuugagcccgggagguggagg

SEQ ID NO: 345374 - RNA, 20 nt, Human
ucggaggccgugcccuaggu

SEQ ID NO: 345375 - RNA, 23 nt, Human
ucgugccacugcaccccagccug

SEQ ID NO: 345376 - RNA, 22 nt, Human
ucuccaaagugcacguacaagu

SEQ ID NO: 345377 - RNA, 20 nt, Human
ugaagggagagggagagggu

SEQ ID NO: 345378 - RNA, 18 nt, Human
ugaauggugggggcccag

SEQ ID NO: 345379 - RNA, 21 nt, Human
ugaauggugggggcccaggag

SEQ ID NO: 345380 - RNA, 24 nt, Human
ugagcccgggagguggagguugca

SEQ ID NO: 345381 - RNA, 22 nt, Human
ugagccgcgaucgugccacugc

SEQ ID NO: 345382 - RNA, 21 nt, Human
ugagcuggggaggcagacggc

SEQ ID NO: 345383 - RNA, 23 nt, Human
ugcagaaaggcacugagcugggg

SEQ ID NO: 345384 - RNA, 22 nt, Human
ugcagugagccgcgaucgugcc

SEQ ID NO: 345385 - RNA, 24 nt, Human
ugccacugcaccccagccugggca

SEQ ID NO: 345386 - RNA, 22 nt, Human
uggccaacagggugucugguga

SEQ ID NO: 345387 - RNA, 21 nt, Human
uggcucacaccuguaauccca

SEQ ID NO: 345388 - RNA, 22 nt, Human
uggcucacaccuguaaucccag

SEQ ID NO: 345389 - RNA, 24 nt, Human
uggcucacaccuguaaucccagca

SEQ ID NO: 345390 - RNA, 18 nt, Human
uggcuggggaugcaccug

SEQ ID NO: 345391 - RNA, 19 nt, Human
ugggaaaccccccagccca

SEQ ID NO: 345392 - RNA, 21 nt, Human
ugggaaaccccccagcccaac

SEQ ID NO: 345393 - RNA, 19 nt, Human
ugggaggccgaggcgggcg

SEQ ID NO: 345394 - RNA, 24 nt, Human
ugggaggccgaggcgggcggauca

SEQ ID NO: 345395 - RNA, 18 nt, Human
ugggaggggaggguaaua

SEQ ID NO: 345396 - RNA, 19 nt, Human
ugggaggggggcacugcgc

SEQ ID NO: 345397 - RNA, 23 nt, Human
uggggcaggaggcaggaaggaug

SEQ ID NO: 345398 - RNA, 19 nt, Human
ugggggugugggaggggag

SEQ ID NO: 345399 - RNA, 24 nt, Human
ugguggcgggcaucuguaauccca

SEQ ID NO: 345400 - RNA, 26 nt, Human
ugugaucaccgacacacacacacacg

SEQ ID NO: 345401 - RNA, 19 nt, Human
ugugucaaaaacaaacaaa

SEQ ID NO: 345402 - RNA, 24 nt, Human
ugugucaaaaacaaacaaacauac

SEQ ID NO: 345403 - RNA, 18 nt, Human
uuaacugggugugguggc

SEQ ID NO: 345404 - RNA, 21 nt, Human
uuaauucugaagcauaacgug

SEQ ID NO: 345405 - RNA, 22 nt, Human
uucacagccacucaaagcuguc

SEQ ID NO: 345406 - RNA, 21 nt, Human
uucacccgcgguccugggccc

SEQ ID NO: 345407 - RNA, 21 nt, Human
uucaugccaagccaaaccucc

SEQ ID NO: 345408 - RNA, 22 nt, Human
uugagaccaggaguucaagacc

SEQ ID NO: 345409 - RNA, 24 nt, Human
uugagcccgggagguggagguugc

SEQ ID NO: 345410 - RNA, 22 nt, Human
uugcagugagccgcgaucgugc

SEQ ID NO: 345411 - RNA, 25 nt, Human
uugggaggccgaggcgggcggauca

SEQ ID NO: 345412 - RNA, 26 nt, Human
uuugcccauacucugaaugaaguauu

SEQ ID NO: 345413 - RNA, 25 nt, Human
aaaaaccaaggugaagccagggaug

SEQ ID NO: 345414 - RNA, 23 nt, Human
agacacacagacaaucacaaaca

SEQ ID NO: 345415 - RNA, 19 nt, Human
agacacggucccugcccuc

SEQ ID NO: 345416 - RNA, 22 nt, Human
agacagacacacagacaaucac

SEQ ID NO: 345417 - RNA, 22 nt, Human
caaagaagaucuagggucaucc

SEQ ID NO: 345418 - RNA, 22 nt, Human
cacacagacaaucacaaacaca

SEQ ID NO: 345419 - RNA, 24 nt, Human
cacacagacaaucacaaacacagu

SEQ ID NO: 345420 - RNA, 18 nt, Human
cacagccugccuugucuc

SEQ ID NO: 345421 - RNA, 24 nt, Human
cacagugagcacucgcucuguucc

SEQ ID NO: 345422 - RNA, 23 nt, Human
ccaaggugaagccagggaugagg

SEQ ID NO: 345423 - RNA, 23 nt, Human
ccaccccucccggagccccaaac

SEQ ID NO: 345424 - RNA, 23 nt, Human
ccccaccccucccggagccccaa

SEQ ID NO: 345425 - RNA, 19 nt, Human
cccccugccuuugcgcccg

SEQ ID NO: 345426 - RNA, 19 nt, Human
cccgcugcccccccacccc

SEQ ID NO: 345427 - RNA, 24 nt, Human
cccgcugcccccccaccccucccg

SEQ ID NO: 345428 - RNA, 26 nt, Human
cccgcugcccccccaccccucccgga

SEQ ID NO: 345429 - RNA, 24 nt, Human
cccggagccccaaacccgucgcug

SEQ ID NO: 345430 - RNA, 21 nt, Human
cccggcccccucgcucccucc

SEQ ID NO: 345431 - RNA, 22 nt, Human
cccucuguccgacggggccccu

SEQ ID NO: 345432 - RNA, 21 nt, Human
cccugcccucauggagcucac

SEQ ID NO: 345433 - RNA, 20 nt, Human
ccgccgcccgcugccccccc

SEQ ID NO: 345434 - RNA, 24 nt, Human
ccgccgcccgcugcccccccaccc

SEQ ID NO: 345435 - RNA, 20 nt, Human
ccggcggcgaugccagagca

SEQ ID NO: 345436 - RNA, 23 nt, Human
ccuuccauggccaucccccugcc

SEQ ID NO: 345437 - RNA, 20 nt, Human
cguugaaguccugggcauuc

SEQ ID NO: 345438 - RNA, 19 nt, Human
cucaacccuuccauggcca

SEQ ID NO: 345439 - RNA, 21 nt, Human
cucuguccgacggggccccuc

SEQ ID NO: 345440 - RNA, 22 nt, Human
cugcugccgccgcccgcugccc

SEQ ID NO: 345441 - RNA, 19 nt, Human
gaaaagacaggauauucag

SEQ ID NO: 345442 - RNA, 21 nt, Human
gagacagacacacagacaauc

SEQ ID NO: 345443 - RNA, 20 nt, Human
gcugccgccgcccgcugccc

SEQ ID NO: 345444 - RNA, 22 nt, Human
ggaaaaaccaaggugaagccag

SEQ ID NO: 345445 - RNA, 18 nt, Human
uaaaaaagaaaagacagg

SEQ ID NO: 345446 - RNA, 19 nt, Human
uccaagcacuggggauaca

SEQ ID NO: 345447 - RNA, 18 nt, Human
ucccccugccuuugcgcc

SEQ ID NO: 345448 - RNA, 23 nt, Human
ucccggagccccaaacccgucgc

SEQ ID NO: 345449 - RNA, 21 nt, Human
ucccugcccucauggagcuca

SEQ ID NO: 345450 - RNA, 21 nt, Human
ugcccccccaccccucccgga

SEQ ID NO: 345451 - RNA, 27 nt, Human
ugcccggcccccucgcucccucccccg

SEQ ID NO: 345452 - RNA, 27 nt, Human
ugggaaaaaccaaggugaagccaggga

SEQ ID NO: 345453 - RNA, 24 nt, Human
uggggauacagagaacggacaaga

SEQ ID NO: 345454 - RNA, 21 nt, Human
uuccauggccaucccccugcc

SEQ ID NO: 345455 - RNA, 23 nt, Human
uuuugagggucauccucucucuu

SEQ ID NO: 345456 - RNA, 20 nt, Human
uuuuuuuuuuuuugaggguc

SEQ ID NO: 345457 - RNA, 22 nt, Human
uuuuuuuuuuuuuuuuugaggg

SEQ ID NO: 345458 - RNA, 21 nt, Human
aaaaugccagcagcaugccgg

SEQ ID NO: 345459 - RNA, 21 nt, Human
aaagggcaaugacccaaaggu

SEQ ID NO: 345460 - RNA, 22 nt, Human
aagaggggggcagcacauugga

SEQ ID NO: 345461 - RNA, 20 nt, Human
aaggcccugggaaugcaggu

SEQ ID NO: 345462 - RNA, 22 nt, Human
aaggcuuugcugcagcugugcu

SEQ ID NO: 345463 - RNA, 18 nt, Human
acaaaaaaccagaggccu

SEQ ID NO: 345464 - RNA, 19 nt, Human
acagaugcucaggccaccc

SEQ ID NO: 345465 - RNA, 24 nt, Human
acagcaaaaugccagcagcaugcc

SEQ ID NO: 345466 - RNA, 19 nt, Human
accaaggaggaauggccaa

SEQ ID NO: 345467 - RNA, 20 nt, Human
accaggaaaccauuaagccc

SEQ ID NO: 345468 - RNA, 24 nt, Human
accaucaccccaagguaaaaaaaa

SEQ ID NO: 345469 - RNA, 18 nt, Human
accccaagguaaaaaaaa

SEQ ID NO: 345470 - RNA, 21 nt, Human
accccaagguaaaaaaaaaau

SEQ ID NO: 345471 - RNA, 24 nt, Human
agcuaaaaagcugugugaacccag

SEQ ID NO: 345472 - RNA, 19 nt, Human
aggggugggggcauggggc

SEQ ID NO: 345473 - RNA, 18 nt, Human
agguauguuuggcaaaau

SEQ ID NO: 345474 - RNA, 20 nt, Human
aggucagacaucuaagaucc

SEQ ID NO: 345475 - RNA, 23 nt, Human
agucuguguugguacaggcuucu

SEQ ID NO: 345476 - RNA, 22 nt, Human
agugaaagggcaaugacccaaa

SEQ ID NO: 345477 - RNA, 18 nt, Human
caagaauguagauacaaa

SEQ ID NO: 345478 - RNA, 20 nt, Human
caauagcuacaaggagggug

SEQ ID NO: 345479 - RNA, 20 nt, Human
caccccaagguaaaaaaaaa

SEQ ID NO: 345480 - RNA, 23 nt, Human
cagccucuagcccacaagccccu

SEQ ID NO: 345481 - RNA, 26 nt, Human
caggaaaaacacuggcugggacgcua

SEQ ID NO: 345482 - RNA, 26 nt, Human
caggacacagcaaaaugccagcagca

SEQ ID NO: 345483 - RNA, 21 nt, Human
caggucagacaucuaagaucc

SEQ ID NO: 345484 - RNA, 19 nt, Human
cauaaggccaccaguccca

SEQ ID NO: 345485 - RNA, 21 nt, Human
cauaaggccaccagucccagc

SEQ ID NO: 345486 - RNA, 23 nt, Human
caucaccccaagguaaaaaaaaa

SEQ ID NO: 345487 - RNA, 22 nt, Human
ccaaaccagaugggugagaaca

SEQ ID NO: 345488 - RNA, 18 nt, Human
ccaaaccaugccacacac

SEQ ID NO: 345489 - RNA, 22 nt, Human
ccaccaaggaggaauggccaaa

SEQ ID NO: 345490 - RNA, 21 nt, Human
ccagcccuuugcaggguuugc

SEQ ID NO: 345491 - RNA, 21 nt, Human
ccaggccaaaccaugccacac

SEQ ID NO: 345492 - RNA, 23 nt, Human
cccaaaagccagcgcuguucuac

SEQ ID NO: 345493 - RNA, 22 nt, Human
ccccaaaagccagcgcuguucu

SEQ ID NO: 345494 - RNA, 26 nt, Human
ccccagccugggauugcaaggcuuug

SEQ ID NO: 345495 - RNA, 22 nt, Human
cccccaaaagccagcgcuguuc

SEQ ID NO: 345496 - RNA, 24 nt, Human
ccccucccuuccauccuccucucc

SEQ ID NO: 345497 - RNA, 25 nt, Human
ccgcugagcagccacacucgcaccu

SEQ ID NO: 345498 - RNA, 23 nt, Human
ccuaggaccuggggagguccaag

SEQ ID NO: 345499 - RNA, 20 nt, Human
ccucccuuccauccuccucu

SEQ ID NO: 345500 - RNA, 21 nt, Human
ccucccuuccauccuccucuc

SEQ ID NO: 345501 - RNA, 23 nt, Human
ccucccuuccauccuccucucca

SEQ ID NO: 345502 - RNA, 24 nt, Human
ccucccuuccauccuccucuccaa

SEQ ID NO: 345503 - RNA, 21 nt, Human
ccucuagcccacaagccccuc

SEQ ID NO: 345504 - RNA, 21 nt, Human
ccugaaaccagcaaacaccgg

SEQ ID NO: 345505 - RNA, 23 nt, Human
ccugaaaccagcaaacaccggga

SEQ ID NO: 345506 - RNA, 22 nt, Human
ccuuuggucagguggugaaggc

SEQ ID NO: 345507 - RNA, 25 nt, Human
cggaaaggggcugcaggacacagca

SEQ ID NO: 345508 - RNA, 18 nt, Human
cuagaaggggugggggca

SEQ ID NO: 345509 - RNA, 24 nt, Human
cuagcccacaagccccucuugguc

SEQ ID NO: 345510 - RNA, 22 nt, Human
cuccacacagaaaaucugcacc

SEQ ID NO: 345511 - RNA, 23 nt, Human
cugaaaccagcaaacaccgggaa

SEQ ID NO: 345512 - RNA, 24 nt, Human
cugaaaccagcaaacaccgggaaa

SEQ ID NO: 345513 - RNA, 23 nt, Human
cugggugcuguagucuguguugg

SEQ ID NO: 345514 - RNA, 25 nt, Human
cuguaggcugaccccagccugggau

SEQ ID NO: 345515 - RNA, 20 nt, Human
cuuugcaggguuugcugccu

SEQ ID NO: 345516 - RNA, 24 nt, Human
gaccuggggagguccaagucaagc

SEQ ID NO: 345517 - RNA, 19 nt, Human
gccaacauaccccagcucu

SEQ ID NO: 345518 - RNA, 19 nt, Human
gccuuuggaguccuguccc

SEQ ID NO: 345519 - RNA, 19 nt, Human
gcgacaccaggaucuucag

SEQ ID NO: 345520 - RNA, 18 nt, Human
gggcauggggcccaggag

SEQ ID NO: 345521 - RNA, 20 nt, Human
gguaauuaaaaaccuaagaa

SEQ ID NO: 345522 - RNA, 19 nt, Human
ggucagacaucuaagaucc

SEQ ID NO: 345523 - RNA, 19 nt, Human
uaagcaacacaacuguagg

SEQ ID NO: 345524 - RNA, 22 nt, Human
uaagccccaauagcuacaagga

SEQ ID NO: 345525 - RNA, 21 nt, Human
uaagcuaaaaagcugugugaa

SEQ ID NO: 345526 - RNA, 21 nt, Human
uaauaagcaacacaacuguag

SEQ ID NO: 345527 - RNA, 23 nt, Human
uaucaaacuccuucccugaaacc

SEQ ID NO: 345528 - RNA, 18 nt, Human
ucaccccaagguaaaaaa

SEQ ID NO: 345529 - RNA, 20 nt, Human
ucccagaggaaguuccuucc

SEQ ID NO: 345530 - RNA, 21 nt, Human
ucccggaaaggggcugcagga

SEQ ID NO: 345531 - RNA, 18 nt, Human
ucccugaaaccagcaaac

SEQ ID NO: 345532 - RNA, 21 nt, Human
uccugggugcuguagucugug

SEQ ID NO: 345533 - RNA, 19 nt, Human
ucuacaauaguucagguca

SEQ ID NO: 345534 - RNA, 23 nt, Human
ucucauuuuugcugcucccccaa

SEQ ID NO: 345535 - RNA, 20 nt, Human
ucuccacacagaaaaucugc

SEQ ID NO: 345536 - RNA, 20 nt, Human
ugaaggcccugggaaugcag

SEQ ID NO: 345537 - RNA, 22 nt, Human
ugaaggcccugggaaugcaggu

SEQ ID NO: 345538 - RNA, 19 nt, Human
ugcagguucuagaaggggu

SEQ ID NO: 345539 - RNA, 20 nt, Human
ugccggaccccucccuucca

SEQ ID NO: 345540 - RNA, 18 nt, Human
ugccuaggaccuggggag

SEQ ID NO: 345541 - RNA, 22 nt, Human
ugccucaugagcagggcugagu

SEQ ID NO: 345542 - RNA, 25 nt, Human
ugcuucaugaaaagcacuucagugu

SEQ ID NO: 345543 - RNA, 21 nt, Human
ugggaaugcagguucuagaag

SEQ ID NO: 345544 - RNA, 20 nt, Human
ugggauugcaaggcuuugcu

SEQ ID NO: 345545 - RNA, 21 nt, Human
ugggugagaacaagcccaaug

SEQ ID NO: 345546 - RNA, 23 nt, Human
ugggugagaacaagcccaaugug

SEQ ID NO: 345547 - RNA, 23 nt, Human
uguaaacugagauuacaaaaaac

SEQ ID NO: 345548 - RNA, 18 nt, Human
uucaggucagacaucuaa

SEQ ID NO: 345549 - RNA, 18 nt, Human
uuugggagccacaggcug

SEQ ID NO: 345550 - RNA, 18 nt, Human
uuuuuuuuuuuuuuuuug

SEQ ID NO: 345551 - RNA, 21 nt, Human
uuuuuuuuuuuuuuuuugcag

SEQ ID NO: 345552 - RNA, 23 nt, Human
uuuuuuuuuuuuuuuuugcagau

SEQ ID NO: 345553 - RNA, 22 nt, Human
uauugcucuuuuggauagaaac

SEQ ID NO: 345554 - RNA, 22 nt, Human
ucuuuuggauagaaacgggaau

SEQ ID NO: 345555 - RNA, 21 nt, Human
ugcacauuucacugaaaacuu

SEQ ID NO: 345556 - RNA, 18 nt, Human
aaaaagucuacaccugcc

SEQ ID NO: 345557 - RNA, 22 nt, Human
aaauaaaccagcagagcauugc

SEQ ID NO: 345558 - RNA, 18 nt, Human
aacaguagucuagucucc

SEQ ID NO: 345559 - RNA, 22 nt, Human
aagccauggcacugaaccagga

SEQ ID NO: 345560 - RNA, 21 nt, Human
acccuggacaacaguagucua

SEQ ID NO: 345561 - RNA, 21 nt, Human
acuaaaaaaaacgcagccacu

SEQ ID NO: 345562 - RNA, 20 nt, Human
agaaacaagauacaccacca

SEQ ID NO: 345563 - RNA, 26 nt, Human
agaacaagagaaauaacugcagaaaa

SEQ ID NO: 345564 - RNA, 21 nt, Human
agacaaauaacaccuguaagc

SEQ ID NO: 345565 - RNA, 20 nt, Human
auuuaaaaugguacugugga

SEQ ID NO: 345566 - RNA, 22 nt, Human
caaacagaaaugcaauguggug

SEQ ID NO: 345567 - RNA, 26 nt, Human
caagauacaccaccacuuauugucuu

SEQ ID NO: 345568 - RNA, 23 nt, Human
caccaguguuuaccauuaccacu

SEQ ID NO: 345569 - RNA, 20 nt, Human
cacuccgauaaagcugcagg

SEQ ID NO: 345570 - RNA, 24 nt, Human
cacuugaaaauaaaccagcagagc

SEQ ID NO: 345571 - RNA, 19 nt, Human
cagcaaagucagaauuuaa

SEQ ID NO: 345572 - RNA, 22 nt, Human
cauggcacugaaccaggagcuu

SEQ ID NO: 345573 - RNA, 23 nt, Human
ccagaacaagagaaauaacugca

SEQ ID NO: 345574 - RNA, 21 nt, Human
ccaugaagccauggcacugaa

SEQ ID NO: 345575 - RNA, 21 nt, Human
ccccuagagaagauaggagaa

SEQ ID NO: 345576 - RNA, 21 nt, Human
cccuaauaagauaaagcaaag

SEQ ID NO: 345577 - RNA, 21 nt, Human
ccuggaaaucaauuaacugag

SEQ ID NO: 345578 - RNA, 18 nt, Human
cuagagaagauaggagaa

SEQ ID NO: 345579 - RNA, 20 nt, Human
cucaaauugacccuggacaa

SEQ ID NO: 345580 - RNA, 27 nt, Human
cuucaaaacacaccaguguuuaccauu

SEQ ID NO: 345581 - RNA, 19 nt, Human
gaaacaagauacaccacca

SEQ ID NO: 345582 - RNA, 24 nt, Human
gaacaagagaaauaacugcagaaa

SEQ ID NO: 345583 - RNA, 20 nt, Human
gagaaauaacugcagaaaac

SEQ ID NO: 345584 - RNA, 23 nt, Human
gaguggacagaguggguaaccca

SEQ ID NO: 345585 - RNA, 20 nt, Human
ggcuaguuucaguucucucc

SEQ ID NO: 345586 - RNA, 20 nt, Human
guacuuccuggaaaucaauu

SEQ ID NO: 345587 - RNA, 22 nt, Human
uaaagcccaacuuaaaaagucu

SEQ ID NO: 345588 - RNA, 24 nt, Human
uaaauuaagucagcaaagucagaa

SEQ ID NO: 345589 - RNA, 19 nt, Human
uaacugagucuuuugaaac

SEQ ID NO: 345590 - RNA, 20 nt, Human
uaagaucuuuucuuuuuuug

SEQ ID NO: 345591 - RNA, 21 nt, Human
uagaaacaagauacaccacca

SEQ ID NO: 345592 - RNA, 21 nt, Human
uaggguuguuuggccagaaca

SEQ ID NO: 345593 - RNA, 24 nt, Human
uauagccaacuacuuucccccuaa

SEQ ID NO: 345594 - RNA, 24 nt, Human
uaugacuuaagaucuuuucuuuuu

SEQ ID NO: 345595 - RNA, 23 nt, Human
ucaaaacacaccaguguuuacca

SEQ ID NO: 345596 - RNA, 22 nt, Human
ucacaauuagcauuacgguuaa

SEQ ID NO: 345597 - RNA, 24 nt, Human
ucagaacgagcauuuaaauuaagu

SEQ ID NO: 345598 - RNA, 24 nt, Human
ucccuaauaagauaaagcaaagac

SEQ ID NO: 345599 - RNA, 20 nt, Human
ucuguagccuaugggagugg

SEQ ID NO: 345600 - RNA, 20 nt, Human
ugaaugccaugaagccaugg

SEQ ID NO: 345601 - RNA, 19 nt, Human
ugacaaagcauucaagaaa

SEQ ID NO: 345602 - RNA, 23 nt, Human
ugacccuggacaacaguagucua

SEQ ID NO: 345603 - RNA, 19 nt, Human
ugacgucuaagcucacacu

SEQ ID NO: 345604 - RNA, 21 nt, Human
ugacuggacuaagaaugacgu

SEQ ID NO: 345605 - RNA, 23 nt, Human
ugcagaaaacacauaugguugga

SEQ ID NO: 345606 - RNA, 20 nt, Human
ugcagguuucaucacaugca

SEQ ID NO: 345607 - RNA, 21 nt, Human
ugccaugaagccauggcacug

SEQ ID NO: 345608 - RNA, 19 nt, Human
uggaagacauggugcaaac

SEQ ID NO: 345609 - RNA, 21 nt, Human
uuaaaauugggcaauuccuug

SEQ ID NO: 345610 - RNA, 22 nt, Human
uuaacagacaaauaacaccugu

SEQ ID NO: 345611 - RNA, 18 nt, Human
uuggcuuaccugauggcu

SEQ ID NO: 345612 - RNA, 19 nt, Human
uuuaacuuucuuaauuuga

SEQ ID NO: 345613 - RNA, 22 nt, Human
uuuaacuuucuuaauuugacaa

SEQ ID NO: 345614 - RNA, 22 nt, Human
uuugugaagaaauuuaggucuc

SEQ ID NO: 345615 - RNA, 21 nt, Human
aaguagccacacgggccucac

SEQ ID NO: 345616 - RNA, 20 nt, Human
caccaagggcuugcuuuccc

SEQ ID NO: 345617 - RNA, 19 nt, Human
ccaaagguguccuaagaaa

SEQ ID NO: 345618 - RNA, 21 nt, Human
ccaccaagggcuugcuuuccc

SEQ ID NO: 345619 - RNA, 20 nt, Human
cgcagccauacuuuccccca

SEQ ID NO: 345620 - RNA, 25 nt, Human
uaagaaaugccaucaucgcagccau

SEQ ID NO: 345621 - RNA, 21 nt, Human
uacuuacaguaacucauucaa

SEQ ID NO: 345622 - RNA, 19 nt, Human
ucgaacagcugcucagaga

SEQ ID NO: 345623 - RNA, 22 nt, Human
ucugucaauacguacuuacagu

SEQ ID NO: 345624 - RNA, 22 nt, Human
ugcucagagaguaguuguuuuc

SEQ ID NO: 345625 - RNA, 23 nt, Human
uguuuucauuauuaauccaaagg

SEQ ID NO: 345626 - RNA, 18 nt, Human
uucacagaucaccuagag

SEQ ID NO: 345627 - RNA, 23 nt, Human
uuuuuuuuuuuuuuuuuuccuuu

SEQ ID NO: 345628 - RNA, 24 nt, Human
uuuuuuuuuuuuuuuuuuccuuuu

SEQ ID NO: 345629 - RNA, 25 nt, Human
uuuuuuuuuuuuuuuuuuuuccuuu

SEQ ID NO: 345630 - RNA, 25 nt, Human
uuuuuuuuuuuuuuuuuuuuuccuu

SEQ ID NO: 345631 - RNA, 30 nt, Human
uuuuuuuuuuuuuuuuuuuuuccuuuuaaa

SEQ ID NO: 345632 - RNA, 23 nt, Human
uaauaagagaguaggauccaggg

SEQ ID NO: 345633 - RNA, 22 nt, Human
uggcgccuccugcucggccagg

SEQ ID NO: 345634 - RNA, 21 nt, Human
gcucuccgcguucgccgccac

SEQ ID NO: 345635 - RNA, 21 nt, Human
ucuccgcguucgccgccaccc

SEQ ID NO: 345636 - RNA, 24 nt, Human
aguauguacagacaaagugggagg

SEQ ID NO: 345637 - RNA, 19 nt, Human
uuuuuuuuuuuuuuuuugu

SEQ ID NO: 345638 - RNA, 20 nt, Human
uuuuuuuuuuuuuuuuuugg

SEQ ID NO: 345639 - RNA, 20 nt, Human
aaaauuuuccagauaaauga

SEQ ID NO: 345640 - RNA, 24 nt, Human
accaccauuuugguucccaaguuu

SEQ ID NO: 345641 - RNA, 23 nt, Human
agagauacaaggauaaaccacca

SEQ ID NO: 345642 - RNA, 19 nt, Human
cacugcagagauacaagga

SEQ ID NO: 345643 - RNA, 22 nt, Human
cagagauacaaggauaaaccac

SEQ ID NO: 345644 - RNA, 24 nt, Human
ccacacugcagagauacaaggaua

SEQ ID NO: 345645 - RNA, 21 nt, Human
cccuuugacuaugauuuccaa

SEQ ID NO: 345646 - RNA, 22 nt, Human
gguucccaaguuuuauucaaga

SEQ ID NO: 345647 - RNA, 19 nt, Human
ucaaguuacaaauaaauga

SEQ ID NO: 345648 - RNA, 23 nt, Human
uccacacugcagagauacaagga

SEQ ID NO: 345649 - RNA, 18 nt, Human
ucccaaguuuuauucaag

SEQ ID NO: 345650 - RNA, 21 nt, Human
ugacuaugauuuccaauuuuc

SEQ ID NO: 345651 - RNA, 20 nt, Human
gguuuaguuuuuuuuuauuu

SEQ ID NO: 345652 - RNA, 24 nt, Human
ugaacgccggaaaaaagaaaaaag

SEQ ID NO: 345653 - RNA, 19 nt, Human
uugaacgccggaaaaaaga

SEQ ID NO: 345654 - RNA, 24 nt, Human
gaaagacaaaagauggcgaaaaga

SEQ ID NO: 345655 - RNA, 23 nt, Human
cucccgcuucggugauggccgca

SEQ ID NO: 345656 - RNA, 19 nt, Human
ggugauggccgcaaaaggg

SEQ ID NO: 345657 - RNA, 19 nt, Human
uuuaaugaaacucccucca

SEQ ID NO: 345658 - RNA, 19 nt, Human
aaauagggucaacaacgcc

SEQ ID NO: 345659 - RNA, 18 nt, Human
agagaaaggggcugcggu

SEQ ID NO: 345660 - RNA, 21 nt, Human
aggaggaccccagccccaugc

SEQ ID NO: 345661 - RNA, 18 nt, Human
aggggcgggggugggggg

SEQ ID NO: 345662 - RNA, 19 nt, Human
aggggcggggguggggggu

SEQ ID NO: 345663 - RNA, 21 nt, Human
caccauaagccgcggcucccg

SEQ ID NO: 345664 - RNA, 20 nt, Human
ccaggggcgggggugggggg

SEQ ID NO: 345665 - RNA, 19 nt, Human
cccgaagcgccuagaaccg

SEQ ID NO: 345666 - RNA, 18 nt, Human
ccucauguuggcagagau

SEQ ID NO: 345667 - RNA, 18 nt, Human
ggcggggguggggggucg

SEQ ID NO: 345668 - RNA, 18 nt, Human
ggggcggggguggggggu

SEQ ID NO: 345669 - RNA, 19 nt, Human
ucccgaagcgccuagaacc

SEQ ID NO: 345670 - RNA, 25 nt, Human
ucgcaccaguccuucuguccucaug

SEQ ID NO: 345671 - RNA, 20 nt, Human
ugcagcacgggaaauagggu

SEQ ID NO: 345672 - RNA, 27 nt, Human
uuuuuuuuuuuuuuuuuuuuccugggg

SEQ ID NO: 345673 - RNA, 24 nt, Human
uuuuuuuuuuuuuuuuuuuuuccu

SEQ ID NO: 345674 - RNA, 20 nt, Human
ugagaccccaccaacugcaa

SEQ ID NO: 345675 - RNA, 20 nt, Human
uuuuuuuuuuuuucagugga

SEQ ID NO: 345676 - RNA, 22 nt, Human
uuuuuuuuuuuuuuuucagugg

SEQ ID NO: 345677 - RNA, 21 nt, Human
uuuuuuuuuuuuuuuuuucag

SEQ ID NO: 345678 - RNA, 26 nt, Human
aaccaacagcagccgcuaagauggcc

SEQ ID NO: 345679 - RNA, 18 nt, Human
cagcagccgcuaagaugg

SEQ ID NO: 345680 - RNA, 19 nt, Human
cagcagccgcuaagauggc

SEQ ID NO: 345681 - RNA, 24 nt, Human
cagccgcuaagauggccggggaac

SEQ ID NO: 345682 - RNA, 21 nt, Human
ccaacagcagccgcuaagaag

SEQ ID NO: 345683 - RNA, 21 nt, Human
ccaaccaacagcagccgcuaa

SEQ ID NO: 345684 - RNA, 19 nt, Human
cccccaaccaacagcagcc

SEQ ID NO: 345685 - RNA, 24 nt, Human
gguuugcaggugaaauuuuguagg

SEQ ID NO: 345686 - RNA, 24 nt, Human
uaagguuugcaggugaaauuuugu

SEQ ID NO: 345687 - RNA, 26 nt, Human
uuuuuuuuuuuuuuuacaauguuuuu

SEQ ID NO: 345688 - RNA, 22 nt, Human
uuuuuuuuuuuuuuuuuuacaa

SEQ ID NO: 345689 - RNA, 20 nt, Human
cgcggaaagaaagaaaccgc

SEQ ID NO: 345690 - RNA, 20 nt, Human
uuuuuuuuuuuuuuuuuugg

SEQ ID NO: 345691 - RNA, 23 nt, Human
cccgacaccuggcccuucgcagc

SEQ ID NO: 345692 - RNA, 23 nt, Human
ccgacaccuggcccuucgcagcu

SEQ ID NO: 345693 - RNA, 24 nt, Human
ccuggcccuucgcagcucucgcca

SEQ ID NO: 345694 - RNA, 20 nt, Human
cguaagaauaucacuguauu

SEQ ID NO: 345695 - RNA, 18 nt, Human
cuucaaaauugaagaaaa

SEQ ID NO: 345696 - RNA, 20 nt, Human
uauaugaugaaaacgagaaa

SEQ ID NO: 345697 - RNA, 21 nt, Human
ucacuguauuuauuuucccuc

SEQ ID NO: 345698 - RNA, 26 nt, Human
uucaaaauugaagaaaaauaucccaa

SEQ ID NO: 345699 - RNA, 18 nt, Human
uuuuuuuuuuuuuuuuug

SEQ ID NO: 345700 - RNA, 21 nt, Human
uuuuuuuuuuuuuuuuugcgu

SEQ ID NO: 345701 - RNA, 24 nt, Human
uuuuuuuuuuuuuuuuuugcguaa

SEQ ID NO: 345702 - RNA, 20 nt, Human
ccagaacauuuauugcauga

SEQ ID NO: 345703 - RNA, 18 nt, Human
cggccgagaccagaaaga

SEQ ID NO: 345704 - RNA, 21 nt, Human
gcaugacuaaucguugacauu

SEQ ID NO: 345705 - RNA, 19 nt, Human
uuaaaaccagaacauuuau

SEQ ID NO: 345706 - RNA, 22 nt, Human
acucacagcaagcagcaaccgg

SEQ ID NO: 345707 - RNA, 19 nt, Human
agcaagcagcaaccgggga

SEQ ID NO: 345708 - RNA, 19 nt, Human
cacucacagcaagcagcaa

SEQ ID NO: 345709 - RNA, 20 nt, Human
cacucacagcaagcagcaac

SEQ ID NO: 345710 - RNA, 24 nt, Human
cuggcgcggaccaggaccuuucuc

SEQ ID NO: 345711 - RNA, 21 nt, Human
caaaagaagcuguccaaaaug

SEQ ID NO: 345712 - RNA, 26 nt, Human
ucacugccuguauaaucaggucuuua

SEQ ID NO: 345713 - RNA, 25 nt, Human
uccaaaaugauuugaccuuuaugga

SEQ ID NO: 345714 - RNA, 20 nt, Human
ugccuguauaaucaggucuu

SEQ ID NO: 345715 - RNA, 22 nt, Human
uuuuuuuuuuuuuuucauguuu

SEQ ID NO: 345716 - RNA, 22 nt, Human
ccugcaggcccagcggcgcuag

SEQ ID NO: 345717 - RNA, 23 nt, Human
cggaacagagaccggcguccgcu

SEQ ID NO: 345718 - RNA, 22 nt, Human
uaucugaaaaaaucauagaaaa

SEQ ID NO: 345719 - RNA, 18 nt, Human
uuuuuuuuuuuuuuuuug

SEQ ID NO: 345720 - RNA, 19 nt, Human
uuuuuuuuuuuuuuuuugu

SEQ ID NO: 345721 - RNA, 21 nt, Human
aaaaauaaucaugguagacac

SEQ ID NO: 345722 - RNA, 24 nt, Human
uagaaaaauaaucaugguagacac

SEQ ID NO: 345723 - RNA, 24 nt, Human
aggaaaauuuguauuauuucaauu

SEQ ID NO: 345724 - RNA, 19 nt, Human
aggagggccgguccggguc

SEQ ID NO: 345725 - RNA, 25 nt, Human
cgacgggucccucuccgcgggcgcc

SEQ ID NO: 345726 - RNA, 19 nt, Human
cucucaggagggccggucc

SEQ ID NO: 345727 - RNA, 18 nt, Human
gagggccgguccgggucu

SEQ ID NO: 345728 - RNA, 18 nt, Human
ucacggaagaggauggcg

SEQ ID NO: 345729 - RNA, 18 nt, Human
uuuauugaggcccucagc

SEQ ID NO: 345730 - RNA, 19 nt, Human
uuuuuuggcauaaacacaa

SEQ ID NO: 345731 - RNA, 18 nt, Human
uuuuuuuuuuuuuuuuug

SEQ ID NO: 345732 - RNA, 22 nt, Human
uuuuuuuuuuuuuuuuuggcau

SEQ ID NO: 345733 - RNA, 22 nt, Human
uuuuuuuuuuuuuuuuuuuggc

SEQ ID NO: 345734 - RNA, 22 nt, Human
gcaguagacgcagcaaagaaag

SEQ ID NO: 345735 - RNA, 20 nt, Human
gucuuaagugucaucuggcc

SEQ ID NO: 345736 - RNA, 24 nt, Human
ucuuaagugucaucuggcaucuuc

SEQ ID NO: 345737 - RNA, 19 nt, Human
agacagggagcucaggccu

SEQ ID NO: 345738 - RNA, 20 nt, Human
cacugaggagagacagggag

SEQ ID NO: 345739 - RNA, 23 nt, Human
cuaaguugguugcuuuuugguga

SEQ ID NO: 345740 - RNA, 20 nt, Human
gacacccaucccgcgguccc

SEQ ID NO: 345741 - RNA, 22 nt, Human
gagagacagggagcucaggccu

SEQ ID NO: 345742 - RNA, 23 nt, Human
gaggagagacagggagcucaggc

SEQ ID NO: 345743 - RNA, 19 nt, Human
ggagagacagggagcucag

SEQ ID NO: 345744 - RNA, 20 nt, Human
gucacgccgacacccauccc

SEQ ID NO: 345745 - RNA, 23 nt, Human
uaaaacuggcuaaguugguugcu

SEQ ID NO: 345746 - RNA, 21 nt, Human
uaaguugguugcuuuuuggug

SEQ ID NO: 345747 - RNA, 21 nt, Human
ucacgccgacacccaucccgc

SEQ ID NO: 345748 - RNA, 18 nt, Human
ucacugaggagagacagg

SEQ ID NO: 345749 - RNA, 21 nt, Human
ugaggagagacagggagcuca

SEQ ID NO: 345750 - RNA, 24 nt, Human
uuuuuuuuuuaaagaaguaagccu

SEQ ID NO: 345751 - RNA, 25 nt, Human
uuuuuuuuuuuuaaagaaguaagcc

SEQ ID NO: 345752 - RNA, 22 nt, Human
uuuuuuuuuuuuuaaagaagua

SEQ ID NO: 345753 - RNA, 19 nt, Human
uuuuuuuuuuuuuuuuuaa

SEQ ID NO: 345754 - RNA, 22 nt, Human
uuuuuuuuuuuuuuuuuuaaag

SEQ ID NO: 345755 - RNA, 21 nt, Human
aacgcagccuuagcuuccucg

SEQ ID NO: 345756 - RNA, 18 nt, Human
accccaacgcagccuuag

SEQ ID NO: 345757 - RNA, 19 nt, Human
aguucagcuuuuuauugaa

SEQ ID NO: 345758 - RNA, 21 nt, Human
augaagugagggccucacccc

SEQ ID NO: 345759 - RNA, 23 nt, Human
ccucaccccaacgcagccuuagc

SEQ ID NO: 345760 - RNA, 18 nt, Human
gcgcgggcgaguguaggg

SEQ ID NO: 345761 - RNA, 23 nt, Human
ggccucaccccaacgcagccuua

SEQ ID NO: 345762 - RNA, 24 nt, Human
ucggaaggaccgagcaccuuggcg

SEQ ID NO: 345763 - RNA, 20 nt, Human
uggcggcagcugaggaaagg

SEQ ID NO: 345764 - RNA, 25 nt, Human
uuccucggaaggaccgagcaccuug

SEQ ID NO: 345765 - RNA, 19 nt, Human
aaacacaugcacucacaca

SEQ ID NO: 345766 - RNA, 21 nt, Human
aaucugccugccacagcaaag

SEQ ID NO: 345767 - RNA, 19 nt, Human
acacaugcacucacacaau

SEQ ID NO: 345768 - RNA, 23 nt, Human
acggcaaacucacacugccugac

SEQ ID NO: 345769 - RNA, 22 nt, Human
acucacacaauacccaaacauc

SEQ ID NO: 345770 - RNA, 23 nt, Human
aguagcugggauuacaggcaugu

SEQ ID NO: 345771 - RNA, 24 nt, Human
aguuuuuuuaaaguuuucuuuuuu

SEQ ID NO: 345772 - RNA, 21 nt, Human
auucuccugccucagccuccc

SEQ ID NO: 345773 - RNA, 19 nt, Human
auugaaaauuccuuuguuc

SEQ ID NO: 345774 - RNA, 18 nt, Human
caaccucccacuaccacc

SEQ ID NO: 345775 - RNA, 19 nt, Human
caaccucccacuaccaccc

SEQ ID NO: 345776 - RNA, 20 nt, Human
caaccucugccucccggguu

SEQ ID NO: 345777 - RNA, 22 nt, Human
caagcaauucuccugccucagc

SEQ ID NO: 345778 - RNA, 24 nt, Human
caggcacccugggcccccuggagg

SEQ ID NO: 345779 - RNA, 25 nt, Human
cccaaacaucagaauuagaagggca

SEQ ID NO: 345780 - RNA, 20 nt, Human
cccccuggaggaugcgggca

SEQ ID NO: 345781 - RNA, 23 nt, Human
cccgaguagcugggauuacaggc

SEQ ID NO: 345782 - RNA, 24 nt, Human
cccgaguagcugggauuacaggca

SEQ ID NO: 345783 - RNA, 23 nt, Human
cccggguucaagcaauucuccug

SEQ ID NO: 345784 - RNA, 23 nt, Human
ccgaguagcugggauuacaggca

SEQ ID NO: 345785 - RNA, 24 nt, Human
ccgaguagcugggauuacaggcau

SEQ ID NO: 345786 - RNA, 28 nt, Human
ccuccaugcacaaccucccacuaccacc

SEQ ID NO: 345787 - RNA, 24 nt, Human
ccucccacuaccacccaaucugcc

SEQ ID NO: 345788 - RNA, 24 nt, Human
ccucccggguucaagcaauucucc

SEQ ID NO: 345789 - RNA, 19 nt, Human
ccugccacagcaaagugca

SEQ ID NO: 345790 - RNA, 23 nt, Human
ccugccucagccucccgaguagc

SEQ ID NO: 345791 - RNA, 24 nt, Human
ccugccucagccucccgaguagcu

SEQ ID NO: 345792 - RNA, 24 nt, Human
cggcugcaaccucugccucccggg

SEQ ID NO: 345793 - RNA, 20 nt, Human
cucacacaauacccaaacau

SEQ ID NO: 345794 - RNA, 24 nt, Human
cucagccucccgaguagcugggau

SEQ ID NO: 345795 - RNA, 22 nt, Human
cugaaaaauauccuagacuuca

SEQ ID NO: 345796 - RNA, 24 nt, Human
cugacgcagggccugguuucucuu

SEQ ID NO: 345797 - RNA, 19 nt, Human
cugcaaccucugccucccg

SEQ ID NO: 345798 - RNA, 20 nt, Human
cugcaaccucugccucccgg

SEQ ID NO: 345799 - RNA, 21 nt, Human
cugcaaccucugccucccggg

SEQ ID NO: 345800 - RNA, 24 nt, Human
cugcaaccucugccucccggguuc

SEQ ID NO: 345801 - RNA, 18 nt, Human
cugccugccacagcaaag

SEQ ID NO: 345802 - RNA, 25 nt, Human
gaguagcugggauuacaggcaugug

SEQ ID NO: 345803 - RNA, 18 nt, Human
gauuacaggcaugugcca

SEQ ID NO: 345804 - RNA, 24 nt, Human
gauuacaggcaugugccaccaugc

SEQ ID NO: 345805 - RNA, 25 nt, Human
gcacaaccucccacuaccacccaau

SEQ ID NO: 345806 - RNA, 24 nt, Human
ggauuacaggcaugugccaccaug

SEQ ID NO: 345807 - RNA, 18 nt, Human
ggccugguuucucuuccu

SEQ ID NO: 345808 - RNA, 20 nt, Human
guagcugggauuacaggcau

SEQ ID NO: 345809 - RNA, 23 nt, Human
uaaaaaaaaaaaaaaaaaaacac

SEQ ID NO: 345810 - RNA, 22 nt, Human
uacaggcaugugccaccaugcc

SEQ ID NO: 345811 - RNA, 19 nt, Human
uaggcugaaaaauauccua

SEQ ID NO: 345812 - RNA, 33 nt, Human
ucacacacgcuuuaaaaaaaaaaaaaaaaaaaa

SEQ ID NO: 345813 - RNA, 20 nt, Human
ucagccucccgaguagcugg

SEQ ID NO: 345814 - RNA, 24 nt, Human
ucccgaguagcugggauuacaggc

SEQ ID NO: 345815 - RNA, 21 nt, Human
ucccggguucaagcaauucuc

SEQ ID NO: 345816 - RNA, 24 nt, Human
ucccggguucaagcaauucuccug

SEQ ID NO: 345817 - RNA, 24 nt, Human
ucuccugccucagccucccgagua

SEQ ID NO: 345818 - RNA, 18 nt, Human
ugcacaaccucccacuac

SEQ ID NO: 345819 - RNA, 24 nt, Human
ugccucagccucccgaguagcugg

SEQ ID NO: 345820 - RNA, 22 nt, Human
ugccucccggguucaagcaauu

SEQ ID NO: 345821 - RNA, 19 nt, Human
ugccugacgcagggccugg

SEQ ID NO: 345822 - RNA, 22 nt, Human
uggccuccaugcacaaccuccc

SEQ ID NO: 345823 - RNA, 24 nt, Human
uggcgccaucucagccggcugcaa

SEQ ID NO: 345824 - RNA, 21 nt, Human
ugggaguuuuuuuaaaguuuu

SEQ ID NO: 345825 - RNA, 18 nt, Human
ugggauuacaggcaugug

SEQ ID NO: 345826 - RNA, 21 nt, Human
ugggauuacaggcaugugcca

SEQ ID NO: 345827 - RNA, 22 nt, Human
ugggauuacaggcaugugccac

SEQ ID NO: 345828 - RNA, 24 nt, Human
ugggauuacaggcaugugccacca

SEQ ID NO: 345829 - RNA, 21 nt, Human
uucaagcaauucuccugccuc

SEQ ID NO: 345830 - RNA, 24 nt, Human
uucaagcaauucuccugccucagc

SEQ ID NO: 345831 - RNA, 20 nt, Human
uuccauuuguucacacacgc

SEQ ID NO: 345832 - RNA, 24 nt, Human
uuuaaaaaaaaaaaaaaagaaagu

SEQ ID NO: 345833 - RNA, 25 nt, Human
uuuaaaaaaaaaaaaaaagaaaguu

SEQ ID NO: 345834 - RNA, 23 nt, Human
uuuccauuuguucacacacgcuu

SEQ ID NO: 345835 - RNA, 28 nt, Human
uuucuuuuuuaaaaaaaaaaaaaaagaa

SEQ ID NO: 345836 - RNA, 20 nt, Human
aaacugaaaaacaagcaaaa

SEQ ID NO: 345837 - RNA, 24 nt, Human
aaacugaaaaacaagcaaaaguau

SEQ ID NO: 345838 - RNA, 22 nt, Human
aagcaaaaguauaacuacaauc

SEQ ID NO: 345839 - RNA, 24 nt, Human
aagcaaaaguauaacuacaaucug

SEQ ID NO: 345840 - RNA, 26 nt, Human
aagcaaaaguauaacuacaaucuggg

SEQ ID NO: 345841 - RNA, 20 nt, Human
acccgccucucccccgcgcc

SEQ ID NO: 345842 - RNA, 19 nt, Human
acucgcggcaggcucugcg

SEQ ID NO: 345843 - RNA, 18 nt, Human
aggaauauucacagcuuc

SEQ ID NO: 345844 - RNA, 19 nt, Human
cacagggccuugcaguucc

SEQ ID NO: 345845 - RNA, 26 nt, Human
cacagugucagagaaagagacuaucu

SEQ ID NO: 345846 - RNA, 27 nt, Human
cagcagccgcggccgggaaggaccuuc

SEQ ID NO: 345847 - RNA, 21 nt, Human
cagcaggucccgccggagucc

SEQ ID NO: 345848 - RNA, 23 nt, Human
ccagcagccgcggccgggauccc

SEQ ID NO: 345849 - RNA, 18 nt, Human
cccgaggacagacccgcc

SEQ ID NO: 345850 - RNA, 22 nt, Human
cccgaggacagacccgccucuc

SEQ ID NO: 345851 - RNA, 22 nt, Human
ccuugcaguucccgaggacaga

SEQ ID NO: 345852 - RNA, 20 nt, Human
cgaggacagacccgccucuc

SEQ ID NO: 345853 - RNA, 20 nt, Human
cgccacaggggacgccaggg

SEQ ID NO: 345854 - RNA, 26 nt, Human
cggccgggaucccaguccucccgcuc

SEQ ID NO: 345855 - RNA, 20 nt, Human
cucacagggccuugcaguuc

SEQ ID NO: 345856 - RNA, 24 nt, Human
cuccaagagcccgccacaggggac

SEQ ID NO: 345857 - RNA, 25 nt, Human
cugaaaaacaagcaaaaguauaaag

SEQ ID NO: 345858 - RNA, 23 nt, Human
cugagcuucgacgcuuccagcag

SEQ ID NO: 345859 - RNA, 22 nt, Human
cuuacacagugucagagaaaga

SEQ ID NO: 345860 - RNA, 27 nt, Human
cuucucauacugugaauuguucuugac

SEQ ID NO: 345861 - RNA, 22 nt, Human
gacccgccucucccccgcgccc

SEQ ID NO: 345862 - RNA, 25 nt, Human
gaguuccgcuggggaaaguggcucc

SEQ ID NO: 345863 - RNA, 21 nt, Human
gaucccaguccucccgcucac

SEQ ID NO: 345864 - RNA, 22 nt, Human
ggacagacccgccucucccccg

SEQ ID NO: 345865 - RNA, 22 nt, Human
gugaauuguucuugacuccuuu

SEQ ID NO: 345866 - RNA, 24 nt, Human
uaaguuaggaauauucacagcuuc

SEQ ID NO: 345867 - RNA, 18 nt, Human
ucagagaaagagacuauc

SEQ ID NO: 345868 - RNA, 24 nt, Human
ucauacugugaauuguucuugacu

SEQ ID NO: 345869 - RNA, 22 nt, Human
uccaagagcccgccacagggga

SEQ ID NO: 345870 - RNA, 18 nt, Human
ucccccgcgcccaggccc

SEQ ID NO: 345871 - RNA, 19 nt, Human
ucccccgcgcccaggccca

SEQ ID NO: 345872 - RNA, 22 nt, Human
ucccgcucacagggccuugcag

SEQ ID NO: 345873 - RNA, 23 nt, Human
uccgcuggggaaaguggcuccaa

SEQ ID NO: 345874 - RNA, 18 nt, Human
ugaaaaacaagcaaaagu

SEQ ID NO: 345875 - RNA, 25 nt, Human
ugaaaaacaagcaaaaguauaacua

SEQ ID NO: 345876 - RNA, 28 nt, Human
ugaaaaacaagcaaaaguauaacuacaa

SEQ ID NO: 345877 - RNA, 21 nt, Human
uggcuccaagagcccgccaca

SEQ ID NO: 345878 - RNA, 18 nt, Human
uuuccaucuuucuucugg

SEQ ID NO: 345879 - RNA, 23 nt, Human
uuuccuauuguuacccucuuuau

SEQ ID NO: 345880 - RNA, 27 nt, Human
uuuuuuuuuuuuuuccuauuguuaccc

SEQ ID NO: 345881 - RNA, 22 nt, Human
uuuuuuuuuuuuuuuuccuauu

SEQ ID NO: 345882 - RNA, 19 nt, Human
acaauuacccccacccuca

SEQ ID NO: 345883 - RNA, 21 nt, Human
accccaggucccagagaaaga

SEQ ID NO: 345884 - RNA, 21 nt, Human
agagaaagaaggaugugggug

SEQ ID NO: 345885 - RNA, 20 nt, Human
caauaguuacagaccgcaua

SEQ ID NO: 345886 - RNA, 21 nt, Human
cagaguccuuugggcuuccag

SEQ ID NO: 345887 - RNA, 24 nt, Human
cagcccaaguaaccgcgaccccag

SEQ ID NO: 345888 - RNA, 19 nt, Human
cauggcucugguccgaggu

SEQ ID NO: 345889 - RNA, 23 nt, Human
ccagcccaaguaaccgcgacccc

SEQ ID NO: 345890 - RNA, 20 nt, Human
ccccaggucccagagaaaga

SEQ ID NO: 345891 - RNA, 19 nt, Human
cgcgcgaggcccgcucccc

SEQ ID NO: 345892 - RNA, 20 nt, Human
cuagugcaacaggauuuuuu

SEQ ID NO: 345893 - RNA, 18 nt, Human
cuccaggcgcgcgaggcc

SEQ ID NO: 345894 - RNA, 18 nt, Human
cuccccgccaggccacuc

SEQ ID NO: 345895 - RNA, 25 nt, Human
gaacaggccuuuucuuacauggcuc

SEQ ID NO: 345896 - RNA, 19 nt, Human
uacagaccgcauacacaca

SEQ ID NO: 345897 - RNA, 25 nt, Human
uacccccacccucaaugcagagucc

SEQ ID NO: 345898 - RNA, 20 nt, Human
ucacggaggggauaagugga

SEQ ID NO: 345899 - RNA, 22 nt, Human
uccuuugggcuuccagggaaca

SEQ ID NO: 345900 - RNA, 21 nt, Human
ugggugcaagcagccagccag

SEQ ID NO: 345901 - RNA, 24 nt, Human
uuacauggcucugguccgaggucc

SEQ ID NO: 345902 - RNA, 21 nt, Human
uuuuuuuuuuuggcaggacac

SEQ ID NO: 345903 - RNA, 18 nt, Human
uuuuuuuuuuuuuuuuug

SEQ ID NO: 345904 - RNA, 23 nt, Human
uuuuuuuuuuuuuuuuuggcagg

SEQ ID NO: 345905 - RNA, 22 nt, Human
uuuuuuuuuuuuuuuuuuuggc

SEQ ID NO: 345906 - RNA, 22 nt, Human
aaaaaaaaaaaaaaauagccag

SEQ ID NO: 345907 - RNA, 20 nt, Human
aaaacaaaaugaaacaaaaa

SEQ ID NO: 345908 - RNA, 24 nt, Human
aaaacaaaaugaaacaaaaauacc

SEQ ID NO: 345909 - RNA, 19 nt, Human
aaacaguaaaucacacaaa

SEQ ID NO: 345910 - RNA, 20 nt, Human
aacaaagacccuaucucaaa

SEQ ID NO: 345911 - RNA, 19 nt, Human
aacacggugaaaccccguc

SEQ ID NO: 345912 - RNA, 20 nt, Human
aacacggugaaaccccgucu

SEQ ID NO: 345913 - RNA, 21 nt, Human
aacacggugaaaccccgucuc

SEQ ID NO: 345914 - RNA, 24 nt, Human
aacaugaucccauuauaaaaauaa

SEQ ID NO: 345915 - RNA, 24 nt, Human
aacgccuguaaucccagcacuuug

SEQ ID NO: 345916 - RNA, 23 nt, Human
aacuaaaaguaaggaauccuauu

SEQ ID NO: 345917 - RNA, 26 nt, Human
aagaagcuuaaaacaagaggaacuaa

SEQ ID NO: 345918 - RNA, 23 nt, Human
aagagaccagauguaauuuuaca

SEQ ID NO: 345919 - RNA, 22 nt, Human
aagcagugaaggaagagaccag

SEQ ID NO: 345920 - RNA, 23 nt, Human
aagcagugaaggaagagaccaga

SEQ ID NO: 345921 - RNA, 18 nt, Human
aagcgggaggaucacuug

SEQ ID NO: 345922 - RNA, 20 nt, Human
aaucucucuuugucuucuuc

SEQ ID NO: 345923 - RNA, 19 nt, Human
acaagaggaacuaaaguca

SEQ ID NO: 345924 - RNA, 22 nt, Human
acagagcgagacugucucaaaa

SEQ ID NO: 345925 - RNA, 20 nt, Human
acauggcgagcgccuguagu

SEQ ID NO: 345926 - RNA, 21 nt, Human
accccgucucugcuaaauaca

SEQ ID NO: 345927 - RNA, 24 nt, Human
acuccagccugggggacagagcga

SEQ ID NO: 345928 - RNA, 18 nt, Human
acugcacuccagccuggg

SEQ ID NO: 345929 - RNA, 24 nt, Human
acugcacuccagccugggggacag

SEQ ID NO: 345930 - RNA, 18 nt, Human
acuguacuccagccugag

SEQ ID NO: 345931 - RNA, 24 nt, Human
agagaucgagccacugcacuccag

SEQ ID NO: 345932 - RNA, 24 nt, Human
agcacuuugggaggccgaggcggg

SEQ ID NO: 345933 - RNA, 18 nt, Human
agccaggugugguagugc

SEQ ID NO: 345934 - RNA, 22 nt, Human
agcuguaguuaaccugcgcagu

SEQ ID NO: 345935 - RNA, 22 nt, Human
aggaggccaaagcgggaggaug

SEQ ID NO: 345936 - RNA, 21 nt, Human
aggauugagguugcagugagc

SEQ ID NO: 345937 - RNA, 24 nt, Human
aggcaggagaauggcaugaaccca

SEQ ID NO: 345938 - RNA, 27 nt, Human
aggcaggagaauggcaugaacccagga

SEQ ID NO: 345939 - RNA, 18 nt, Human
aggccgaggcggguggaa

SEQ ID NO: 345940 - RNA, 21 nt, Human
aggccgaggcggguggaauau

SEQ ID NO: 345941 - RNA, 24 nt, Human
aggcggagcuugcagugagcagag

SEQ ID NO: 345942 - RNA, 24 nt, Human
aggcggguggaauaugaggucagg

SEQ ID NO: 345943 - RNA, 24 nt, Human
aggcugaagcgggaggaucacuug

SEQ ID NO: 345944 - RNA, 19 nt, Human
aggcugaggcaggagaaug

SEQ ID NO: 345945 - RNA, 20 nt, Human
agggaagaagggagugcuga

SEQ ID NO: 345946 - RNA, 19 nt, Human
aggucaggagauugagacc

SEQ ID NO: 345947 - RNA, 24 nt, Human
aggugugguagugcacaccuguag

SEQ ID NO: 345948 - RNA, 24 nt, Human
aguggcuaacgccuguaaucccag

SEQ ID NO: 345949 - RNA, 19 nt, Human
auaaaaagcuacuucuacu

SEQ ID NO: 345950 - RNA, 24 nt, Human
auaugaggucaggagauugagacc

SEQ ID NO: 345951 - RNA, 22 nt, Human
aucccagcacuuuaggaggcca

SEQ ID NO: 345952 - RNA, 23 nt, Human
auccucucuccuuccacaaauuc

SEQ ID NO: 345953 - RNA, 24 nt, Human
aucgagccacugcacuccagccug

SEQ ID NO: 345954 - RNA, 25 nt, Human
augaaacaaaaauaccugaaacauu

SEQ ID NO: 345955 - RNA, 19 nt, Human
augaaagaagcuuaaaaca

SEQ ID NO: 345956 - RNA, 24 nt, Human
augccacuguacuccagccugagc

SEQ ID NO: 345957 - RNA, 23 nt, Human
auggcgagcgccuguagucccag

SEQ ID NO: 345958 - RNA, 24 nt, Human
auuaugccacuguacuccagccug

SEQ ID NO: 345959 - RNA, 25 nt, Human
caaaaacaaaaugaaacaaaaauac

SEQ ID NO: 345960 - RNA, 21 nt, Human
caacauagugagaccaugucu

SEQ ID NO: 345961 - RNA, 21 nt, Human
caacccgcagaacaguugucu

SEQ ID NO: 345962 - RNA, 21 nt, Human
caagggaaaaaaaaaaaaaaa

SEQ ID NO: 345963 - RNA, 24 nt, Human
cacaccuguaguucccgcugcuug

SEQ ID NO: 345964 - RNA, 18 nt, Human
caccuguaguucccgcug

SEQ ID NO: 345965 - RNA, 23 nt, Human
caccuguaguucccgcugcuuga

SEQ ID NO: 345966 - RNA, 23 nt, Human
cacuccagccugggggacagagc

SEQ ID NO: 345967 - RNA, 24 nt, Human
cacuccagccugggggacagagcg

SEQ ID NO: 345968 - RNA, 18 nt, Human
cacugcacuccagccugg

SEQ ID NO: 345969 - RNA, 19 nt, Human
cacugcacuccagccuggg

SEQ ID NO: 345970 - RNA, 20 nt, Human
cacugcacuccagccugggg

SEQ ID NO: 345971 - RNA, 22 nt, Human
cacugcacuccagccuggggga

SEQ ID NO: 345972 - RNA, 24 nt, Human
cacugcacuccagccugggggaca

SEQ ID NO: 345973 - RNA, 24 nt, Human
cacugcacuccagccugggggaca

SEQ ID NO: 345974 - RNA, 19 nt, Human
cacuguacuccagccugag

SEQ ID NO: 345975 - RNA, 21 nt, Human
cacuguacuccagccugagca

SEQ ID NO: 345976 - RNA, 22 nt, Human
cacuguacuccagccugagcaa

SEQ ID NO: 345977 - RNA, 24 nt, Human
cacuguacuccagccugagcaaca

SEQ ID NO: 345978 - RNA, 22 nt, Human
cagcacuuuaggaggccaaagc

SEQ ID NO: 345979 - RNA, 24 nt, Human
cagcacuuuaggaggccaaagcgg

SEQ ID NO: 345980 - RNA, 22 nt, Human
cagcacuuugggaggccgaggc

SEQ ID NO: 345981 - RNA, 24 nt, Human
cagcacuuugggaggccgaggcgg

SEQ ID NO: 345982 - RNA, 20 nt, Human
cagccgcugagcccgccccu

SEQ ID NO: 345983 - RNA, 24 nt, Human
cagcuacucaggaggcugaggcag

SEQ ID NO: 345984 - RNA, 20 nt, Human
cauaaaugcauguauuugca

SEQ ID NO: 345985 - RNA, 23 nt, Human
caucuaccaccagaauuugugug

SEQ ID NO: 345986 - RNA, 21 nt, Human
caugaacccaggaggcggagc

SEQ ID NO: 345987 - RNA, 19 nt, Human
ccacugcacuccagccugg

SEQ ID NO: 345988 - RNA, 20 nt, Human
ccacugcacuccagccuggg

SEQ ID NO: 345989 - RNA, 22 nt, Human
ccacugcacuccagccuggggg

SEQ ID NO: 345990 - RNA, 24 nt, Human
ccacugcacuccagccugggggac

SEQ ID NO: 345991 - RNA, 20 nt, Human
ccacuguacuccagccugag

SEQ ID NO: 345992 - RNA, 21 nt, Human
ccacuguacuccagccugagc

SEQ ID NO: 345993 - RNA, 22 nt, Human
ccacuguacuccagccugagca

SEQ ID NO: 345994 - RNA, 24 nt, Human
ccacuguacuccagccugagcaac

SEQ ID NO: 345995 - RNA, 18 nt, Human
ccgcugagcccgccccuc

SEQ ID NO: 345996 - RNA, 24 nt, Human
ccgcugagcccgccccucaggcau

SEQ ID NO: 345997 - RNA, 18 nt, Human
ccucucuccuuccacaaa

SEQ ID NO: 345998 - RNA, 19 nt, Human
ccucuggcucuacuccauu

SEQ ID NO: 345999 - RNA, 22 nt, Human
ccugaaacauuuuauucaagua

SEQ ID NO: 346000 - RNA, 23 nt, Human
ccuggcuaacacggugaaacccc

SEQ ID NO: 346001 - RNA, 24 nt, Human
ccuggcuaacacggugaaaccccg

SEQ ID NO: 346002 - RNA, 19 nt, Human
ccuguagucccagcuacuc

SEQ ID NO: 346003 - RNA, 21 nt, Human
ccuguagucccagcuacucag

SEQ ID NO: 346004 - RNA, 19 nt, Human
ccuguaguucccgcugcuu

SEQ ID NO: 346005 - RNA, 22 nt, Human
cgaggcggguggaauaugaggu

SEQ ID NO: 346006 - RNA, 23 nt, Human
cgcagccgcugagcccgccccuc

SEQ ID NO: 346007 - RNA, 23 nt, Human
cgccuguaaucccagcacuuugg

SEQ ID NO: 346008 - RNA, 24 nt, Human
cgccuguaaucccagcacuuuggg

SEQ ID NO: 346009 - RNA, 24 nt, Human
cgccuguagucccagcuacucagg

SEQ ID NO: 346010 - RNA, 18 nt, Human
cgcugagcccgccccucc

SEQ ID NO: 346011 - RNA, 25 nt, Human
cgggccgggcgcaguggcuaacgcc

SEQ ID NO: 346012 - RNA, 22 nt, Human
cggguggaauaugaggucagga

SEQ ID NO: 346013 - RNA, 24 nt, Human
cuaacgccuguaaucccagcacuu

SEQ ID NO: 346014 - RNA, 18 nt, Human
cucaaaaaaaaaaaaaaa

SEQ ID NO: 346015 - RNA, 26 nt, Human
cugaacgacaauguuugguucccccu

SEQ ID NO: 346016 - RNA, 20 nt, Human
cugaagucccaugaccgucc

SEQ ID NO: 346017 - RNA, 20 nt, Human
cugagcccgccccucaggca

SEQ ID NO: 346018 - RNA, 18 nt, Human
cuggcuaacacggugaaa

SEQ ID NO: 346019 - RNA, 22 nt, Human
cugucucaaaaaaaaaaaaaaa

SEQ ID NO: 346020 - RNA, 23 nt, Human
cuuucucuugcuuaaaaaaauuu

SEQ ID NO: 346021 - RNA, 25 nt, Human
gaaauaaccagucuuucucucuuaa

SEQ ID NO: 346022 - RNA, 23 nt, Human
gaggcggguggaauaugagguca

SEQ ID NO: 346023 - RNA, 19 nt, Human
gagguugcagugagcuggc

SEQ ID NO: 346024 - RNA, 21 nt, Human
gagguugcagugagcugugau

SEQ ID NO: 346025 - RNA, 22 nt, Human
gagugcugacagagacuggggc

SEQ ID NO: 346026 - RNA, 22 nt, Human
gaucacuugagcccaggauuga

SEQ ID NO: 346027 - RNA, 24 nt, Human
gcacuccagccugggggacagagc

SEQ ID NO: 346028 - RNA, 22 nt, Human
gcaggagaauggcaugaaccca

SEQ ID NO: 346029 - RNA, 18 nt, Human
gcagugaaggaagagacc

SEQ ID NO: 346030 - RNA, 19 nt, Human
gcagugaaggaagagacca

SEQ ID NO: 346031 - RNA, 20 nt, Human
gccacuguacuccagccuga

SEQ ID NO: 346032 - RNA, 22 nt, Human
gccacuguacuccagccugagc

SEQ ID NO: 346033 - RNA, 24 nt, Human
gccacuguacuccagccugagcaa

SEQ ID NO: 346034 - RNA, 19 nt, Human
gccugagcaacaaagaccc

SEQ ID NO: 346035 - RNA, 20 nt, Human
gcgcaguggcuaacgccugu

SEQ ID NO: 346036 - RNA, 24 nt, Human
gcuaacacggugaaaccccgucuc

SEQ ID NO: 346037 - RNA, 18 nt, Human
ggagcuugcagugagcag

SEQ ID NO: 346038 - RNA, 24 nt, Human
ggagcuugcagugagcagagaucg

SEQ ID NO: 346039 - RNA, 20 nt, Human
ggagugcugacagagacugg

SEQ ID NO: 346040 - RNA, 23 nt, Human
ggcgcaguggcuaacgccuguaa

SEQ ID NO: 346041 - RNA, 23 nt, Human
ggcggguggaauaugaggucagg

SEQ ID NO: 346042 - RNA, 21 nt, Human
ggcugcaugugguggcucaug

SEQ ID NO: 346043 - RNA, 21 nt, Human
gugaaaccccgucucugcuaa

SEQ ID NO: 346044 - RNA, 19 nt, Human
guggcucauguaaucccag

SEQ ID NO: 346045 - RNA, 21 nt, Human
uaaaacaagaggaacuaaagu

SEQ ID NO: 346046 - RNA, 23 nt, Human
uaaaacaagaggaacuaaaguca

SEQ ID NO: 346047 - RNA, 23 nt, Human
uaaaaguaaggaauccuauuuca

SEQ ID NO: 346048 - RNA, 20 nt, Human
uaaaauauucaaacaucugg

SEQ ID NO: 346049 - RNA, 22 nt, Human
uaacacggugaaaccccgucuc

SEQ ID NO: 346050 - RNA, 23 nt, Human
uaacacggugaaaccccgucucu

SEQ ID NO: 346051 - RNA, 18 nt, Human
uaaccugcgcaguccguc

SEQ ID NO: 346052 - RNA, 23 nt, Human
uaaguuugaauaucuucaaaaua

SEQ ID NO: 346053 - RNA, 20 nt, Human
uaauacagcuaucaggaaaa

SEQ ID NO: 346054 - RNA, 21 nt, Human
uacauggcgagcgccuguagu

SEQ ID NO: 346055 - RNA, 23 nt, Human
uagaaaaaaaugcugauuugaau

SEQ ID NO: 346056 - RNA, 22 nt, Human
uagagcccuuacauuaauauug

SEQ ID NO: 346057 - RNA, 19 nt, Human
uauugcauaaaugcaugua

SEQ ID NO: 346058 - RNA, 22 nt, Human
ucaaaaaaaaaaaaaaaaaaaa

SEQ ID NO: 346059 - RNA, 24 nt, Human
ucaaacaucuggcugcauguggug

SEQ ID NO: 346060 - RNA, 23 nt, Human
uccagccugggggacagagcgag

SEQ ID NO: 346061 - RNA, 24 nt, Human
uccagccugggggacagagcgaga

SEQ ID NO: 346062 - RNA, 23 nt, Human
ucccaugaccguccgcgcgcgcc

SEQ ID NO: 346063 - RNA, 20 nt, Human
uccgcgcgcgccagucugcg

SEQ ID NO: 346064 - RNA, 22 nt, Human
uccgcgcgcgccagucugcgca

SEQ ID NO: 346065 - RNA, 18 nt, Human
uccuaggaguuugagacc

SEQ ID NO: 346066 - RNA, 24 nt, Human
ucgggccgggcgcaguggcuaacg

SEQ ID NO: 346067 - RNA, 22 nt, Human
ucucuacaagggaaaaaaaaaa

SEQ ID NO: 346068 - RNA, 23 nt, Human
ucucuaccuccaguugacuaggg

SEQ ID NO: 346069 - RNA, 22 nt, Human
ucugaacgacaauguuugguuc

SEQ ID NO: 346070 - RNA, 23 nt, Human
ugaaaacaguaaaucacacaaag

SEQ ID NO: 346071 - RNA, 18 nt, Human
ugaaggaagagaccagau

SEQ ID NO: 346072 - RNA, 22 nt, Human
ugaaggaagagaccagauguaa

SEQ ID NO: 346073 - RNA, 18 nt, Human
ugagaccagccucagcaa

SEQ ID NO: 346074 - RNA, 24 nt, Human
ugagaccagccucagcaacauagu

SEQ ID NO: 346075 - RNA, 24 nt, Human
ugagaccauccuggcuaacacggu

SEQ ID NO: 346076 - RNA, 24 nt, Human
ugagaggcugaagcgggaggauca

SEQ ID NO: 346077 - RNA, 23 nt, Human
ugaggcaggagaauggcaugaac

SEQ ID NO: 346078 - RNA, 24 nt, Human
ugaggcaggagaauggcaugaacc

SEQ ID NO: 346079 - RNA, 25 nt, Human
ugaggcaggagaauggcaugaaccc

SEQ ID NO: 346080 - RNA, 23 nt, Human
ugagguugcagugagcugugauu

SEQ ID NO: 346081 - RNA, 22 nt, Human
ugauccuaggaguuugagacca

SEQ ID NO: 346082 - RNA, 23 nt, Human
ugcagugagcagagaucgagcca

SEQ ID NO: 346083 - RNA, 20 nt, Human
ugcauaaaugcauguauuug

SEQ ID NO: 346084 - RNA, 24 nt, Human
ugcauaaaugcauguauuugcaua

SEQ ID NO: 346085 - RNA, 21 nt, Human
ugcaugugguggcucauguaa

SEQ ID NO: 346086 - RNA, 23 nt, Human
uggaauaugaggucaggagauug

SEQ ID NO: 346087 - RNA, 21 nt, Human
uggcgagcgccuguaguccca

SEQ ID NO: 346088 - RNA, 24 nt, Human
uggcuaacgccuguaaucccagca

SEQ ID NO: 346089 - RNA, 19 nt, Human
ugggaggccgaggcgggug

SEQ ID NO: 346090 - RNA, 22 nt, Human
uuacauguguauccucucuccu

SEQ ID NO: 346091 - RNA, 23 nt, Human
uuaugccacuguacuccagccug

SEQ ID NO: 346092 - RNA, 19 nt, Human
uucaucuaccaccagaauu

SEQ ID NO: 346093 - RNA, 23 nt, Human
uucggagaaacuuacuugcuuug

SEQ ID NO: 346094 - RNA, 25 nt, Human
uugagaggcugaagcgggaggauca

SEQ ID NO: 346095 - RNA, 19 nt, Human
uugcagugagcagagaucg

SEQ ID NO: 346096 - RNA, 25 nt, Human
uugcagugagcagagaucgagccac

SEQ ID NO: 346097 - RNA, 21 nt, Human
uugcagugagcugugauuaug

SEQ ID NO: 346098 - RNA, 18 nt, Human
uugguucccccuggaggg

SEQ ID NO: 346099 - RNA, 22 nt, Human
uuugagaccagccucagcaaca

SEQ ID NO: 346100 - RNA, 24 nt, Human
uuuuuuuuuuuuuuuuucgcuuuu

SEQ ID NO: 346101 - RNA, 31 nt, Human
uuuuuuuuuuuuuuuuuuucgcuuuuaaugg

SEQ ID NO: 346102 - RNA, 31 nt, Human
uuuuuuuuuuuuuuuuuuuuucgcuuuuaaa

SEQ ID NO: 346103 - RNA, 27 nt, Human
uuuuuuuuuuuuuuuuuuuuuucgggg

SEQ ID NO: 346104 - RNA, 18 nt, Human
aaacuguaugacaugaca

SEQ ID NO: 346105 - RNA, 18 nt, Human
uacaagguguccuuucac

SEQ ID NO: 346106 - RNA, 19 nt, Human
ugaaaauccuggaacucac

SEQ ID NO: 346107 - RNA, 22 nt, Human
cgguaccggggcuggaaaagaa

SEQ ID NO: 346108 - RNA, 23 nt, Human
gcaggguccgguaccggggcugg

SEQ ID NO: 346109 - RNA, 19 nt, Human
gguaccggggcuggaaaag

SEQ ID NO: 346110 - RNA, 18 nt, Human
gguccgguaccggggcug

SEQ ID NO: 346111 - RNA, 19 nt, Human
auuucauuguggggagcgg

SEQ ID NO: 346112 - RNA, 24 nt, Human
ccgccugaaaaaaagaaaggggca

SEQ ID NO: 346113 - RNA, 21 nt, Human
cggccgccugaaaaaaagaaa

SEQ ID NO: 346114 - RNA, 22 nt, Human
uuuuuuuuuuuuuuuuuggaau

SEQ ID NO: 346115 - RNA, 28 nt, Human
uuuuuuuuuuuuuuuuuuuuuuuggggg

SEQ ID NO: 346116 - RNA, 23 nt, Human
cgggugaagcugaaucuugaacg

SEQ ID NO: 346117 - RNA, 21 nt, Human
ucuugaacgcacccaagccuc

SEQ ID NO: 346118 - RNA, 18 nt, Human
uuuuuuuuuuuuuuuuug

SEQ ID NO: 346119 - RNA, 19 nt, Human
uuuuuuuuuuuuuuuuugu

SEQ ID NO: 346120 - RNA, 20 nt, Human
ucaggcaacgaaaggagagc

SEQ ID NO: 346121 - RNA, 19 nt, Human
uggcggcgaucaggcaacg

SEQ ID NO: 346122 - RNA, 22 nt, Human
uggcggcgaucaggcaacgaaa

SEQ ID NO: 346123 - RNA, 18 nt, Human
acagaaaauauuuugagg

SEQ ID NO: 346124 - RNA, 18 nt, Human
acuccacaccggaaagag

SEQ ID NO: 346125 - RNA, 20 nt, Human
ugcacgucgucuccagacuc

SEQ ID NO: 346126 - RNA, 21 nt, Human
uuuuuuuuuuuuuuuuuuaca

SEQ ID NO: 346127 - RNA, 18 nt, Human
ucagaagagaucgcuuug

SEQ ID NO: 346128 - RNA, 21 nt, Human
uagauugcaggauggcgccga

SEQ ID NO: 346129 - RNA, 20 nt, Human
ucucagagagugcuacucac

SEQ ID NO: 346130 - RNA, 22 nt, Human
ugcaggauggcgccgauggcag

SEQ ID NO: 346131 - RNA, 23 nt, Human
acuuuaaaaucccucaaaaacug

SEQ ID NO: 346132 - RNA, 19 nt, Human
caccgcgcggcgccgcaac

SEQ ID NO: 346133 - RNA, 22 nt, Human
ccucaccgcgcggcgccgcaac

SEQ ID NO: 346134 - RNA, 20 nt, Human
uugaaacuuuaaaaucccuc

SEQ ID NO: 346135 - RNA, 24 nt, Human
aauaauacagcacuacagaaaaaa

SEQ ID NO: 346136 - RNA, 19 nt, Human
uuuuuugcuguugucccag

SEQ ID NO: 346137 - RNA, 24 nt, Human
uuuuuuuuugcuguugucccagau

SEQ ID NO: 346138 - RNA, 21 nt, Human
uuuuuuuuuugcuguuguccc

SEQ ID NO: 346139 - RNA, 21 nt, Human
uuuuuuuuuuuuuuuugcugu

SEQ ID NO: 346140 - RNA, 20 nt, Human
uuuuuuuuuuuuuuuuugcu

SEQ ID NO: 346141 - RNA, 27 nt, Human
uuuuuuuuuuuuuuuuuuuuuuugggg

SEQ ID NO: 346142 - RNA, 20 nt, Human
ggcugcagcacaagcggcgg

SEQ ID NO: 346143 - RNA, 21 nt, Human
ugcagcacaagcggcggcgug

SEQ ID NO: 346144 - RNA, 18 nt, Human
aggggaaagggaacgacg

SEQ ID NO: 346145 - RNA, 22 nt, Human
cagccaggggaaagggaacgac

SEQ ID NO: 346146 - RNA, 22 nt, Human
gccaggggaaagggaacgacgg

SEQ ID NO: 346147 - RNA, 19 nt, Human
gggaaagggaacgacgggg

SEQ ID NO: 346148 - RNA, 19 nt, Human
uccgcgcugccagccaggg

SEQ ID NO: 346149 - RNA, 22 nt, Human
uuuuuuuuuuuuucacgcuuaa

SEQ ID NO: 346150 - RNA, 22 nt, Human
uuuuuuuuuuuuuuucacgcuu

SEQ ID NO: 346151 - RNA, 20 nt, Human
uuuuuuuuuuuuuuuuucac

SEQ ID NO: 346152 - RNA, 23 nt, Human
ccaaaaauccucagcccuuacga

SEQ ID NO: 346153 - RNA, 21 nt, Human
cuggucaucaauuuauuaaaa

SEQ ID NO: 346154 - RNA, 18 nt, Human
uccugaccgacuuguucc

SEQ ID NO: 346155 - RNA, 20 nt, Human
ucggcgagagcgaacagcgg

SEQ ID NO: 346156 - RNA, 23 nt, Human
ugagucaggagcaggagcgugcc

SEQ ID NO: 346157 - RNA, 19 nt, Human
uuccucggcgagagcgaac

SEQ ID NO: 346158 - RNA, 21 nt, Human
uugcgcgcgggcuuccugacc

SEQ ID NO: 346159 - RNA, 23 nt, Human
uuuuuuuuuuuuaacaacugguc

SEQ ID NO: 346160 - RNA, 20 nt, Human
cugcugccaccacaccgcgc

SEQ ID NO: 346161 - RNA, 23 nt, Human
ggcugggcugcgccugcugccac

SEQ ID NO: 346162 - RNA, 23 nt, Human
uacuacaguguuuucaccauuaa

SEQ ID NO: 346163 - RNA, 20 nt, Human
agcuaacaucauugcagcac

SEQ ID NO: 346164 - RNA, 21 nt, Human
cagcuaacaucauugcagcac

SEQ ID NO: 346165 - RNA, 24 nt, Human
ccuuuacuccuucggcugugaucc

SEQ ID NO: 346166 - RNA, 19 nt, Human
cgaaaaauccacaguggcc

SEQ ID NO: 346167 - RNA, 19 nt, Human
cgaaaaauccacaguggcc

SEQ ID NO: 346168 - RNA, 22 nt, Human
cuuuacuccuucggcugugauc

SEQ ID NO: 346169 - RNA, 20 nt, Human
uccacaguggccacagcuaa

SEQ ID NO: 346170 - RNA, 20 nt, Human
uccacaguggccacagcuaa

SEQ ID NO: 346171 - RNA, 22 nt, Human
ugcgaaaaauccacaguggcca

SEQ ID NO: 346172 - RNA, 22 nt, Human
ugcgaaaaauccacaguggcca

SEQ ID NO: 346173 - RNA, 24 nt, Human
uugcagcaccuuuacuccuucggc

SEQ ID NO: 346174 - RNA, 21 nt, Human
aagcucggagaauagcagcag

SEQ ID NO: 346175 - RNA, 21 nt, Human
gagaauagcagcagacaccgc

SEQ ID NO: 346176 - RNA, 22 nt, Human
uagcagcagacaccgcagccuc

SEQ ID NO: 346177 - RNA, 18 nt, Human
ucggagaauagcagcaga

SEQ ID NO: 346178 - RNA, 22 nt, Human
ugauuuaauaaaguuuuauuuu

SEQ ID NO: 346179 - RNA, 20 nt, Human
ugcgaagcucggagaauagc

SEQ ID NO: 346180 - RNA, 18 nt, Human
uuuuuuuuuuuuuuuuug

SEQ ID NO: 346181 - RNA, 23 nt, Human
uuuuuuuuuuuuuuuuuugauuu

SEQ ID NO: 346182 - RNA, 22 nt, Human
uuuuuuuuuuuuuuuuuuuaag

SEQ ID NO: 346183 - RNA, 21 nt, Human
cacucaucuugacucagagug

SEQ ID NO: 346184 - RNA, 20 nt, Human
uaggucgucaccgccggaaa

SEQ ID NO: 346185 - RNA, 20 nt, Human
aaaaggagcagauugugaca

SEQ ID NO: 346186 - RNA, 23 nt, Human
aguggucgaacccgacauccaag

SEQ ID NO: 346187 - RNA, 23 nt, Human
ccaagacccagcgagcagccaag

SEQ ID NO: 346188 - RNA, 25 nt, Human
ccgacauccaagacccagcgagcag

SEQ ID NO: 346189 - RNA, 26 nt, Human
ccgacauccaagacccagcgagcagc

SEQ ID NO: 346190 - RNA, 22 nt, Human
gcgcggcggcggucuggcggag

SEQ ID NO: 346191 - RNA, 22 nt, Human
ggcggcgcggcggcggucuggc

SEQ ID NO: 346192 - RNA, 22 nt, Human
ucggccaaguggucgaacccga

SEQ ID NO: 346193 - RNA, 18 nt, Human
uggcggcgcggcggcggu

SEQ ID NO: 346194 - RNA, 20 nt, Human
uguggcggacaaaaaaaagg

SEQ ID NO: 346195 - RNA, 24 nt, Human
uuuuuuuuuuuuuuuuuuaacuug

SEQ ID NO: 346196 - RNA, 18 nt, Human
cccggauaauccucugaa

SEQ ID NO: 346197 - RNA, 23 nt, Human
ucagcagugcaacgagguaaaag

SEQ ID NO: 346198 - RNA, 22 nt, Human
aauacagcugccaaggagaccc

SEQ ID NO: 346199 - RNA, 19 nt, Human
agagcaacauccagacucc

SEQ ID NO: 346200 - RNA, 21 nt, Human
caacauccagacuccagaaua

SEQ ID NO: 346201 - RNA, 22 nt, Human
uccagaauacagcugccaagga

SEQ ID NO: 346202 - RNA, 22 nt, Human
ucuuuagagagcaacauccaga

SEQ ID NO: 346203 - RNA, 21 nt, Human
uuuuuuuuuuuuuuugucuuu

SEQ ID NO: 346204 - RNA, 21 nt, Human
ggucagagagccaaaagggcg

SEQ ID NO: 346205 - RNA, 22 nt, Human
ucagaagcaaaccaucacaaau

SEQ ID NO: 346206 - RNA, 18 nt, Human
uuuucagaagcaaaccau

SEQ ID NO: 346207 - RNA, 23 nt, Human
uuuuuuuuucagaagcaaaccau

SEQ ID NO: 346208 - RNA, 22 nt, Human
uuuuuuuuuuuuuuuuuuucag

SEQ ID NO: 346209 - RNA, 18 nt, Human
caaggaaagaggaccucc

SEQ ID NO: 346210 - RNA, 18 nt, Human
ucugacaugucacccagg

SEQ ID NO: 346211 - RNA, 21 nt, Human
uuuuuuuuuuuuuuuugcuau

SEQ ID NO: 346212 - RNA, 18 nt, Human
uuuuuuuuuuuuuuuuug

SEQ ID NO: 346213 - RNA, 20 nt, Human
uuuuuuuuuuuuuuuuugcu

SEQ ID NO: 346214 - RNA, 26 nt, Human
uuuuuuuuuuuuuuuuuugcuauuaa

SEQ ID NO: 346215 - RNA, 18 nt, Human
uugugcaaagaaaaaaag

SEQ ID NO: 346216 - RNA, 25 nt, Human
uuuuuuuuuuuuaaacgagaauuca

SEQ ID NO: 346217 - RNA, 18 nt, Human
uuuuuuuuuuuuuuaaac

SEQ ID NO: 346218 - RNA, 23 nt, Human
uuuuuuuuuuuuuuuuuuaaacg

SEQ ID NO: 346219 - RNA, 18 nt, Human
acacagccugagcgucuc

SEQ ID NO: 346220 - RNA, 23 nt, Human
cuccgaggcgccacggaaaagag

SEQ ID NO: 346221 - RNA, 19 nt, Human
aagaggccuccccugggga

SEQ ID NO: 346222 - RNA, 21 nt, Human
aagccaugcccacccaccuca

SEQ ID NO: 346223 - RNA, 21 nt, Human
acacuagauuagcaaaaaaag

SEQ ID NO: 346224 - RNA, 21 nt, Human
accccacucacccaucccuca

SEQ ID NO: 346225 - RNA, 19 nt, Human
acccgaaccgccgcgcccc

SEQ ID NO: 346226 - RNA, 22 nt, Human
accgccgcgcccccccgagccc

SEQ ID NO: 346227 - RNA, 19 nt, Human
accuggcccuugguaaugg

SEQ ID NO: 346228 - RNA, 23 nt, Human
agacaggauuugaauacagggcu

SEQ ID NO: 346229 - RNA, 23 nt, Human
augcccacccaccucaggauggc

SEQ ID NO: 346230 - RNA, 20 nt, Human
caaaguaccuggcccuuggu

SEQ ID NO: 346231 - RNA, 23 nt, Human
cacacuagauuagcaaaaaaaga

SEQ ID NO: 346232 - RNA, 18 nt, Human
caccccacucacccaucc

SEQ ID NO: 346233 - RNA, 19 nt, Human
caccccacucacccauccc

SEQ ID NO: 346234 - RNA, 19 nt, Human
caccccacucacccauccc

SEQ ID NO: 346235 - RNA, 21 nt, Human
cagcuggcacuaccacccacc

SEQ ID NO: 346236 - RNA, 22 nt, Human
cccacucacccaucccucagau

SEQ ID NO: 346237 - RNA, 20 nt, Human
cccccgagccccucgcgcuc

SEQ ID NO: 346238 - RNA, 21 nt, Human
cccccgagccccucgcgcucc

SEQ ID NO: 346239 - RNA, 18 nt, Human
ccccuggcuccuuaguua

SEQ ID NO: 346240 - RNA, 20 nt, Human
ccccuggggaggcuggggug

SEQ ID NO: 346241 - RNA, 21 nt, Human
ccccuggggaggcuggggugg

SEQ ID NO: 346242 - RNA, 22 nt, Human
ccccuggggaggcugggguggg

SEQ ID NO: 346243 - RNA, 24 nt, Human
cccgaaccgccgcgcccccccgag

SEQ ID NO: 346244 - RNA, 24 nt, Human
ccgccgccgccgccgcggcacuag

SEQ ID NO: 346245 - RNA, 21 nt, Human
ccgccgcgcccccccgagccc

SEQ ID NO: 346246 - RNA, 22 nt, Human
ccgccgcgcccccccgagcccc

SEQ ID NO: 346247 - RNA, 18 nt, Human
ccgcgcccccccgagccc

SEQ ID NO: 346248 - RNA, 18 nt, Human
ccggcugcgccgccuccc

SEQ ID NO: 346249 - RNA, 18 nt, Human
ccguccgccgccgccgcc

SEQ ID NO: 346250 - RNA, 20 nt, Human
ccugccccuggcuccuuagu

SEQ ID NO: 346251 - RNA, 21 nt, Human
cgccgccgccgccgcggcacu

SEQ ID NO: 346252 - RNA, 23 nt, Human
cgccucccggguccugggguccc

SEQ ID NO: 346253 - RNA, 22 nt, Human
cuaccacccaccccacucaccc

SEQ ID NO: 346254 - RNA, 23 nt, Human
cuaccacccaccccacucaccca

SEQ ID NO: 346255 - RNA, 20 nt, Human
cuccggcggccccggcugcg

SEQ ID NO: 346256 - RNA, 18 nt, Human
cugggguggggcuggagg

SEQ ID NO: 346257 - RNA, 18 nt, Human
gaaccgccgcgccccccc

SEQ ID NO: 346258 - RNA, 21 nt, Human
gaccucuaaagguggcaucuc

SEQ ID NO: 346259 - RNA, 26 nt, Human
gccuccccuggggaggcugggguggg

SEQ ID NO: 346260 - RNA, 24 nt, Human
gccucccggguccuggggucccug

SEQ ID NO: 346261 - RNA, 20 nt, Human
gcuccggcugggccguccgc

SEQ ID NO: 346262 - RNA, 18 nt, Human
gggcagcuggcacuacca

SEQ ID NO: 346263 - RNA, 19 nt, Human
ggggaggcugggguggggc

SEQ ID NO: 346264 - RNA, 24 nt, Human
uaaagccagaucuuauuccaacuc

SEQ ID NO: 346265 - RNA, 22 nt, Human
uaaguagcucuacagucauuga

SEQ ID NO: 346266 - RNA, 24 nt, Human
uagaagaggccuccccuggggagg

SEQ ID NO: 346267 - RNA, 21 nt, Human
uagcaaaaaaagacgggcaac

SEQ ID NO: 346268 - RNA, 23 nt, Human
uagcaaaaaaagacgggcaacau

SEQ ID NO: 346269 - RNA, 24 nt, Human
uagcaaaaaaagacgggcaacauu

SEQ ID NO: 346270 - RNA, 20 nt, Human
uagcaguaccacgcaggggu

SEQ ID NO: 346271 - RNA, 21 nt, Human
uccccuggggaggcuggggug

SEQ ID NO: 346272 - RNA, 25 nt, Human
ucccggguccuggggucccuggcuc

SEQ ID NO: 346273 - RNA, 18 nt, Human
ucccucagauugcccaag

SEQ ID NO: 346274 - RNA, 19 nt, Human
uccggcggccccggcugcg

SEQ ID NO: 346275 - RNA, 21 nt, Human
uccuccggcggccccggcugc

SEQ ID NO: 346276 - RNA, 18 nt, Human
uccuggggucccuggcuc

SEQ ID NO: 346277 - RNA, 19 nt, Human
ucgccgccgccaggucacc

SEQ ID NO: 346278 - RNA, 21 nt, Human
ucuacagucauugagcuagua

SEQ ID NO: 346279 - RNA, 19 nt, Human
ugaagcaacugugugaggc

SEQ ID NO: 346280 - RNA, 21 nt, Human
ugacugggcggguguugcagg

SEQ ID NO: 346281 - RNA, 21 nt, Human
ugggaaaacuaaggcucaggg

SEQ ID NO: 346282 - RNA, 20 nt, Human
uggggaggcugggguggggc

SEQ ID NO: 346283 - RNA, 18 nt, Human
ugggguggggcuggaggc

SEQ ID NO: 346284 - RNA, 19 nt, Human
ugggguggggcuggaggcu

SEQ ID NO: 346285 - RNA, 21 nt, Human
uuauuccaacucaccaccugc

SEQ ID NO: 346286 - RNA, 21 nt, Human
aaaaagaaaacacggacacgg

SEQ ID NO: 346287 - RNA, 23 nt, Human
aaaaagaaaacacggacacggcg

SEQ ID NO: 346288 - RNA, 25 nt, Human
aaaaagaaaacacggacacggggac

SEQ ID NO: 346289 - RNA, 18 nt, Human
aaaacgcaacacaaagcc

SEQ ID NO: 346290 - RNA, 22 nt, Human
aaaacgcaacacaaagccacag

SEQ ID NO: 346291 - RNA, 27 nt, Human
aaacacggacacggcgagggcgggcgc

SEQ ID NO: 346292 - RNA, 18 nt, Human
aaagaagcccccggccuc

SEQ ID NO: 346293 - RNA, 22 nt, Human
aaagagagcgggcggggaggcu

SEQ ID NO: 346294 - RNA, 20 nt, Human
aacacagcaaaaccacagcu

SEQ ID NO: 346295 - RNA, 18 nt, Human
aaccccgucauccagccc

SEQ ID NO: 346296 - RNA, 24 nt, Human
aagccacagcaucuacaaagugca

SEQ ID NO: 346297 - RNA, 21 nt, Human
aagcccccaggucaggacccu

SEQ ID NO: 346298 - RNA, 23 nt, Human
acaaaacgcaacacaaagccaca

SEQ ID NO: 346299 - RNA, 25 nt, Human
acacaaaacgcaacacaaagccaca

SEQ ID NO: 346300 - RNA, 25 nt, Human
acacagcaaaaccacagcuuuaggu

SEQ ID NO: 346301 - RNA, 22 nt, Human
acagcaaaaccacagcuuuagg

SEQ ID NO: 346302 - RNA, 24 nt, Human
acccagcaccucaggcaaaaacug

SEQ ID NO: 346303 - RNA, 21 nt, Human
acccuuacaggacaaugaagg

SEQ ID NO: 346304 - RNA, 21 nt, Human
agacuggagguggacacaggc

SEQ ID NO: 346305 - RNA, 20 nt, Human
agaucugugcaacagagaca

SEQ ID NO: 346306 - RNA, 18 nt, Human
agcccggagcagccgcag

SEQ ID NO: 346307 - RNA, 19 nt, Human
agcccggcacggcggccau

SEQ ID NO: 346308 - RNA, 20 nt, Human
agccgcagggccgggggacg

SEQ ID NO: 346309 - RNA, 21 nt, Human
agccuccagauagcugugugg

SEQ ID NO: 346310 - RNA, 18 nt, Human
aggcaaaaacugaagggc

SEQ ID NO: 346311 - RNA, 19 nt, Human
aggcuccuccgagaggcac

SEQ ID NO: 346312 - RNA, 18 nt, Human
aggcuggcgcagugaggc

SEQ ID NO: 346313 - RNA, 18 nt, Human
aggcuuggagaagccccc

SEQ ID NO: 346314 - RNA, 19 nt, Human
agggcaggccgcgccggcc

SEQ ID NO: 346315 - RNA, 25 nt, Human
caaaacgcaacacaaagccacagcc

SEQ ID NO: 346316 - RNA, 20 nt, Human
caaagauccagccugccuuc

SEQ ID NO: 346317 - RNA, 22 nt, Human
cacagaccagaaaaaucgaagu

SEQ ID NO: 346318 - RNA, 22 nt, Human
cacagaccagaaaaaucgaagu

SEQ ID NO: 346319 - RNA, 26 nt, Human
cacagaccagaaaaaucgaagugaac

SEQ ID NO: 346320 - RNA, 20 nt, Human
caccuccugaagcccugcuu

SEQ ID NO: 346321 - RNA, 21 nt, Human
cagaaaaaucgaagugaacac

SEQ ID NO: 346322 - RNA, 18 nt, Human
cagaagccauguaugaga

SEQ ID NO: 346323 - RNA, 20 nt, Human
cagagacacaaaacgcaaca

SEQ ID NO: 346324 - RNA, 30 nt, Human
cagagacacaaaacgcaacacaaagccacc

SEQ ID NO: 346325 - RNA, 19 nt, Human
cagcccguggggagccccg

SEQ ID NO: 346326 - RNA, 19 nt, Human
cagcccguggggagccccg

SEQ ID NO: 346327 - RNA, 19 nt, Human
caggaagccgacacagggc

SEQ ID NO: 346328 - RNA, 22 nt, Human
cagugccaaccccgucauccag

SEQ ID NO: 346329 - RNA, 18 nt, Human
caucuccuccuggacgcc

SEQ ID NO: 346330 - RNA, 20 nt, Human
ccacaaucgcucccuccgcc

SEQ ID NO: 346331 - RNA, 23 nt, Human
ccaccggguaccugggacguggg

SEQ ID NO: 346332 - RNA, 19 nt, Human
ccagaaaaaucgaagugaa

SEQ ID NO: 346333 - RNA, 22 nt, Human
ccagcaccucaggcaaaaacug

SEQ ID NO: 346334 - RNA, 22 nt, Human
ccaggcaucuccuccuggacgc

SEQ ID NO: 346335 - RNA, 22 nt, Human
cccaccugugccucugccccuc

SEQ ID NO: 346336 - RNA, 25 nt, Human
cccaggucaggacccucuccggggc

SEQ ID NO: 346337 - RNA, 28 nt, Human
ccccacacccgcccugugugcacaccca

SEQ ID NO: 346338 - RNA, 24 nt, Human
ccccagcccucuggggcccugcaa

SEQ ID NO: 346339 - RNA, 19 nt, Human
ccccgcgcccagcccggag

SEQ ID NO: 346340 - RNA, 23 nt, Human
ccccgcgcccagcccggagcagc

SEQ ID NO: 346341 - RNA, 25 nt, Human
cccgcccugugugcacacccagggg

SEQ ID NO: 346342 - RNA, 18 nt, Human
cccgcgcccagcccggag

SEQ ID NO: 346343 - RNA, 19 nt, Human
cccggaaccucucacucga

SEQ ID NO: 346344 - RNA, 20 nt, Human
cccuccgccuccuucuccgc

SEQ ID NO: 346345 - RNA, 21 nt, Human
ccgcgccggccaccgcggccg

SEQ ID NO: 346346 - RNA, 21 nt, Human
ccgcugcccucccaccugugc

SEQ ID NO: 346347 - RNA, 18 nt, Human
ccggaaccucucacucga

SEQ ID NO: 346348 - RNA, 18 nt, Human
ccuccgccuccuucuccg

SEQ ID NO: 346349 - RNA, 21 nt, Human
ccucgcacgggcacgcgaggu

SEQ ID NO: 346350 - RNA, 22 nt, Human
ccucuggggcccugcaaccacc

SEQ ID NO: 346351 - RNA, 20 nt, Human
ccugcaaagccuccagauag

SEQ ID NO: 346352 - RNA, 22 nt, Human
ccugcaaccaccaauggcugcg

SEQ ID NO: 346353 - RNA, 18 nt, Human
ccugugccucugccccuc

SEQ ID NO: 346354 - RNA, 22 nt, Human
cgaagugaacacagcaaaacca

SEQ ID NO: 346355 - RNA, 18 nt, Human
cgagaacccacgacuccc

SEQ ID NO: 346356 - RNA, 22 nt, Human
cgcuccuguccacgcugaucuc

SEQ ID NO: 346357 - RNA, 19 nt, Human
cggcagaaacagaagccau

SEQ ID NO: 346358 - RNA, 23 nt, Human
cggcaucccaggcgcggggcuca

SEQ ID NO: 346359 - RNA, 21 nt, Human
cggccggggccacaaucgcuc

SEQ ID NO: 346360 - RNA, 21 nt, Human
cggcuggacugggcgucgauc

SEQ ID NO: 346361 - RNA, 22 nt, Human
cggggaaagccgagacuggagg

SEQ ID NO: 346362 - RNA, 22 nt, Human
cuaaaugccccacacccgcccu

SEQ ID NO: 346363 - RNA, 18 nt, Human
cuccagccuccagcugga

SEQ ID NO: 346364 - RNA, 23 nt, Human
cucccugcaaagccuccagauag

SEQ ID NO: 346365 - RNA, 18 nt, Human
cuccgcugcccucccacc

SEQ ID NO: 346366 - RNA, 20 nt, Human
cuccgcugcccucccaccug

SEQ ID NO: 346367 - RNA, 20 nt, Human
cuccuguccacgcugaucuc

SEQ ID NO: 346368 - RNA, 22 nt, Human
cugaaagaagcccccggccucg

SEQ ID NO: 346369 - RNA, 18 nt, Human
cugaagcccugcuugcug

SEQ ID NO: 346370 - RNA, 18 nt, Human
cugagcggcgccuccucc

SEQ ID NO: 346371 - RNA, 20 nt, Human
cugcaaagccuccagauagc

SEQ ID NO: 346372 - RNA, 19 nt, Human
cugcccucccaccugugcc

SEQ ID NO: 346373 - RNA, 19 nt, Human
cugcccucccaccugugcc

SEQ ID NO: 346374 - RNA, 20 nt, Human
cuuggagaagcccccagguc

SEQ ID NO: 346375 - RNA, 22 nt, Human
gaaaaccuggcuguggccagcg

SEQ ID NO: 346376 - RNA, 18 nt, Human
gaaggacccguguguucc

SEQ ID NO: 346377 - RNA, 23 nt, Human
gaagugaacacagcaaaaccaca

SEQ ID NO: 346378 - RNA, 19 nt, Human
gacucccugcaaagccucc

SEQ ID NO: 346379 - RNA, 18 nt, Human
gagaggcacccccuucca

SEQ ID NO: 346380 - RNA, 22 nt, Human
gagcacagcauggccuaaaugc

SEQ ID NO: 346381 - RNA, 18 nt, Human
gagcaggugcgagaaccc

SEQ ID NO: 346382 - RNA, 23 nt, Human
gagcaggugcgagaacccacgac

SEQ ID NO: 346383 - RNA, 18 nt, Human
gagcggcgccuccuccca

SEQ ID NO: 346384 - RNA, 19 nt, Human
gauccagccugccuuccuc

SEQ ID NO: 346385 - RNA, 23 nt, Human
gcacagcauggccuaaaugcccc

SEQ ID NO: 346386 - RNA, 23 nt, Human
gcacggcggccaugggcgcgggg

SEQ ID NO: 346387 - RNA, 18 nt, Human
gcccggaaccucucacuc

SEQ ID NO: 346388 - RNA, 20 nt, Human
gcccugugugcacacccagg

SEQ ID NO: 346389 - RNA, 23 nt, Human
gcgggcggggaggcuggcgcagu

SEQ ID NO: 346390 - RNA, 19 nt, Human
gcggggcguggggcgcgag

SEQ ID NO: 346391 - RNA, 24 nt, Human
gcuggguggggccugugucucccu

SEQ ID NO: 346392 - RNA, 19 nt, Human
ggaaaaccuggcuguggcc

SEQ ID NO: 346393 - RNA, 22 nt, Human
ggacacaggcuccuccgagagg

SEQ ID NO: 346394 - RNA, 18 nt, Human
ggacgugggugucgggag

SEQ ID NO: 346395 - RNA, 18 nt, Human
ggacugggcgucgauccg

SEQ ID NO: 346396 - RNA, 22 nt, Human
ggaugcuggcaggggacgcugg

SEQ ID NO: 346397 - RNA, 24 nt, Human
ggcagaaacagaagccauguauga

SEQ ID NO: 346398 - RNA, 18 nt, Human
ggccaugggcgcggggcg

SEQ ID NO: 346399 - RNA, 21 nt, Human
ggccugugucucccuccagcc

SEQ ID NO: 346400 - RNA, 23 nt, Human
ggccugugucucccuccagccuc

SEQ ID NO: 346401 - RNA, 18 nt, Human
ggcgaggaggaaacggcu

SEQ ID NO: 346402 - RNA, 18 nt, Human
ggcucugaaagaagcccc

SEQ ID NO: 346403 - RNA, 22 nt, Human
gggacgcgcauccccggcaucc

SEQ ID NO: 346404 - RNA, 18 nt, Human
ggggaggcuggcgcagug

SEQ ID NO: 346405 - RNA, 22 nt, Human
ggggaggcuggcgcagugaggc

SEQ ID NO: 346406 - RNA, 21 nt, Human
gugagcccacgaggaugcugg

SEQ ID NO: 346407 - RNA, 22 nt, Human
guggccacgggagcuggggaca

SEQ ID NO: 346408 - RNA, 23 nt, Human
uagggaaaaccuggcuguggcca

SEQ ID NO: 346409 - RNA, 18 nt, Human
ucaaugaaguagagcaca

SEQ ID NO: 346410 - RNA, 21 nt, Human
uccacagaccagaaaaaucga

SEQ ID NO: 346411 - RNA, 23 nt, Human
uccacagaccagaaaaaucgaag

SEQ ID NO: 346412 - RNA, 25 nt, Human
uccacgcugaucuccgcugcccucc

SEQ ID NO: 346413 - RNA, 21 nt, Human
ucccaccugugccucugcccc

SEQ ID NO: 346414 - RNA, 19 nt, Human
ucccuccgccuccuucucc

SEQ ID NO: 346415 - RNA, 21 nt, Human
ucccugcaaagccuccagaua

SEQ ID NO: 346416 - RNA, 24 nt, Human
uccgagaggcacccccuuccaucc

SEQ ID NO: 346417 - RNA, 20 nt, Human
uccgccuccuucuccgccuc

SEQ ID NO: 346418 - RNA, 19 nt, Human
uccgcugcccucccaccug

SEQ ID NO: 346419 - RNA, 24 nt, Human
ucgcacugccacuuucccaccggg

SEQ ID NO: 346420 - RNA, 27 nt, Human
ucuccaauucacaguuucuccacagac

SEQ ID NO: 346421 - RNA, 21 nt, Human
ucucucggcagaaacagaagc

SEQ ID NO: 346422 - RNA, 20 nt, Human
ugaaaaaacagaucugugca

SEQ ID NO: 346423 - RNA, 22 nt, Human
ugaaaaagaaaacacggacacg

SEQ ID NO: 346424 - RNA, 21 nt, Human
ugaacacagcaaaaccacagc

SEQ ID NO: 346425 - RNA, 22 nt, Human
ugaacacagcaaaaccacagcu

SEQ ID NO: 346426 - RNA, 24 nt, Human
ugacacggagcucucaaggcaaag

SEQ ID NO: 346427 - RNA, 23 nt, Human
ugaggcuuggagaagcccccagg

SEQ ID NO: 346428 - RNA, 18 nt, Human
ugcaucgcuccuguccac

SEQ ID NO: 346429 - RNA, 19 nt, Human
ugccaggucaccccagccc

SEQ ID NO: 346430 - RNA, 23 nt, Human
ugccccacacccgcccugugugc

SEQ ID NO: 346431 - RNA, 18 nt, Human
ugccucugccccucaguc

SEQ ID NO: 346432 - RNA, 18 nt, Human
uggacgccacagugccaa

SEQ ID NO: 346433 - RNA, 19 nt, Human
uggcaggggacgcuggggc

SEQ ID NO: 346434 - RNA, 25 nt, Human
uggccacgggagcuggggacagacg

SEQ ID NO: 346435 - RNA, 19 nt, Human
uggccagggagcccggcac

SEQ ID NO: 346436 - RNA, 19 nt, Human
uggguacgagaaucgagau

SEQ ID NO: 346437 - RNA, 23 nt, Human
ugggugggaagccacagagcucc

SEQ ID NO: 346438 - RNA, 20 nt, Human
uguggucacucugggugcca

SEQ ID NO: 346439 - RNA, 24 nt, Human
uuugggugggaagccacagagcuc

SEQ ID NO: 346440 - RNA, 20 nt, Human
uuuuuuuuuuuuuuaguugg

SEQ ID NO: 346441 - RNA, 24 nt, Human
uuuuuuuuuuuuuuuuuaguuggg

SEQ ID NO: 346442 - RNA, 21 nt, Human
aaaaacauacacauagcuuag

SEQ ID NO: 346443 - RNA, 18 nt, Human
aagcauaaaagaucgacu

SEQ ID NO: 346444 - RNA, 27 nt, Human
aaguagaaaaugaaaauaaagggaccc

SEQ ID NO: 346445 - RNA, 21 nt, Human
aauaaauggcaaaaauacagu

SEQ ID NO: 346446 - RNA, 19 nt, Human
aauugccaggaaagagcag

SEQ ID NO: 346447 - RNA, 23 nt, Human
acauacacauagcuuagcaugca

SEQ ID NO: 346448 - RNA, 22 nt, Human
accccuuucucugauaaaucau

SEQ ID NO: 346449 - RNA, 22 nt, Human
agagacauguaccuuaauauuc

SEQ ID NO: 346450 - RNA, 20 nt, Human
aguggcugacuacaugacac

SEQ ID NO: 346451 - RNA, 25 nt, Human
caaauugccaggaaagagcagugca

SEQ ID NO: 346452 - RNA, 22 nt, Human
caacacaguguacaaauaugaa

SEQ ID NO: 346453 - RNA, 18 nt, Human
cagcggacgcccgucccc

SEQ ID NO: 346454 - RNA, 24 nt, Human
caggaaagagcagugcaaaauuaa

SEQ ID NO: 346455 - RNA, 22 nt, Human
cauacacauagcuuagcaugca

SEQ ID NO: 346456 - RNA, 26 nt, Human
caucuggaaaaccugugacuuacaag

SEQ ID NO: 346457 - RNA, 22 nt, Human
caugcuagguucguaaaaagag

SEQ ID NO: 346458 - RNA, 23 nt, Human
ccacaaggcaaagcaaaagguau

SEQ ID NO: 346459 - RNA, 20 nt, Human
ccccucgcagccgcugccgc

SEQ ID NO: 346460 - RNA, 20 nt, Human
cccgaauacagaguauggga

SEQ ID NO: 346461 - RNA, 18 nt, Human
ccucgcagccgcugccgc

SEQ ID NO: 346462 - RNA, 19 nt, Human
cuccuuuuuuuccgauccc

SEQ ID NO: 346463 - RNA, 20 nt, Human
gacagcggacgcccgucccc

SEQ ID NO: 346464 - RNA, 23 nt, Human
gaccccuuucucugauaaaucau

SEQ ID NO: 346465 - RNA, 21 nt, Human
gacuacaugacacaacaaggc

SEQ ID NO: 346466 - RNA, 21 nt, Human
ggaaauuccucacuguaguac

SEQ ID NO: 346467 - RNA, 19 nt, Human
gggaaacauuuuuaaaagc

SEQ ID NO: 346468 - RNA, 20 nt, Human
guaaccauaaaauaaaaaca

SEQ ID NO: 346469 - RNA, 18 nt, Human
gucucuuucccgcucugg

SEQ ID NO: 346470 - RNA, 22 nt, Human
uaaagugcaauauuacuuaaaa

SEQ ID NO: 346471 - RNA, 21 nt, Human
uaaaugccgcaaucuuucaau

SEQ ID NO: 346472 - RNA, 21 nt, Human
uaaguggcugacuacaugaca

SEQ ID NO: 346473 - RNA, 26 nt, Human
uaauaauagcagguuaucaucauaug

SEQ ID NO: 346474 - RNA, 18 nt, Human
uacaacacaguguacaaa

SEQ ID NO: 346475 - RNA, 20 nt, Human
uacaggaggaaauuccucac

SEQ ID NO: 346476 - RNA, 22 nt, Human
uaccuuaauauucugcaauaac

SEQ ID NO: 346477 - RNA, 22 nt, Human
uagaaaaugaaaauaaauggca

SEQ ID NO: 346478 - RNA, 18 nt, Human
uagaagaggcaugugagg

SEQ ID NO: 346479 - RNA, 18 nt, Human
uagcuuagcaugcaucuc

SEQ ID NO: 346480 - RNA, 18 nt, Human
uaugauucuaaaauauua

SEQ ID NO: 346481 - RNA, 21 nt, Human
ucaacagaaaaauuuccaaac

SEQ ID NO: 346482 - RNA, 21 nt, Human
ucacuguaguacaacacagug

SEQ ID NO: 346483 - RNA, 22 nt, Human
uccccucgcagccgcugccgcg

SEQ ID NO: 346484 - RNA, 26 nt, Human
uccucacauuggugcauaaguggcug

SEQ ID NO: 346485 - RNA, 24 nt, Human
ucgcagccgcugccgcggccccag

SEQ ID NO: 346486 - RNA, 24 nt, Human
ucggggugcggcggcuccagaacu

SEQ ID NO: 346487 - RNA, 24 nt, Human
ucuuauaucuuuuuuauuuuuuuu

SEQ ID NO: 346488 - RNA, 20 nt, Human
ugaaaacagaccccuuucuc

SEQ ID NO: 346489 - RNA, 21 nt, Human
ugaaaacagaccccuuucucu

SEQ ID NO: 346490 - RNA, 23 nt, Human
ugaaaacagaccccuuucucuga

SEQ ID NO: 346491 - RNA, 25 nt, Human
ugacuacaugacacaacaaggcccc

SEQ ID NO: 346492 - RNA, 19 nt, Human
ugagaccaacgggaaacau

SEQ ID NO: 346493 - RNA, 23 nt, Human
ugagggaauaaaggugcaaugga

SEQ ID NO: 346494 - RNA, 23 nt, Human
uggcaucaugcuagguucguaaa

SEQ ID NO: 346495 - RNA, 20 nt, Human
uguaaccauaaaauaaaaac

SEQ ID NO: 346496 - RNA, 23 nt, Human
uguauuuuuaaaugccgcaaucu

SEQ ID NO: 346497 - RNA, 19 nt, Human
uuaaaguagaaaaugaaaa

SEQ ID NO: 346498 - RNA, 25 nt, Human
uuagcaugcaucucagauggauccc

SEQ ID NO: 346499 - RNA, 22 nt, Human
uuguccacaaggcaaagcaaaa

SEQ ID NO: 346500 - RNA, 26 nt, Human
uuuuauuuuuuuucacuuuuuagaaa

SEQ ID NO: 346501 - RNA, 21 nt, Human
uuuuuuuuuuuuugcauaggg

SEQ ID NO: 346502 - RNA, 25 nt, Human
aaacacuugaacacuacugcaaaca

SEQ ID NO: 346503 - RNA, 20 nt, Human
aagaauaggaaaaaagccac

SEQ ID NO: 346504 - RNA, 19 nt, Human
agacaacgaugccuuugau

SEQ ID NO: 346505 - RNA, 19 nt, Human
cugguggacaccaauuaua

SEQ ID NO: 346506 - RNA, 20 nt, Human
gccuaggaacaccacaaauc

SEQ ID NO: 346507 - RNA, 20 nt, Human
uaacuuuauuugaaaggaau

SEQ ID NO: 346508 - RNA, 22 nt, Human
ucucacuuccccuaaaaauggg

SEQ ID NO: 346509 - RNA, 22 nt, Human
ugugcagagaaguugugaggac

SEQ ID NO: 346510 - RNA, 21 nt, Human
uuagcagacaacgaugccuuu

SEQ ID NO: 346511 - RNA, 27 nt, Human
uuuuuuuuuuaaauauuaaaguaacuu

SEQ ID NO: 346512 - RNA, 18 nt, Human
cgagagcacgucaaaauc

SEQ ID NO: 346513 - RNA, 18 nt, Human
uaggaagagacccaaauc

SEQ ID NO: 346514 - RNA, 21 nt, Human
ugggagaacuugccgagcgcc

SEQ ID NO: 346515 - RNA, 22 nt, Human
uuaggaagagacccaaaucucg

SEQ ID NO: 346516 - RNA, 24 nt, Human
uuuuuuuuuuuuuuuuuacuguga

SEQ ID NO: 346517 - RNA, 25 nt, Human
acaaaacaauaaacaccuuuauuac

SEQ ID NO: 346518 - RNA, 22 nt, Human
caaaacaauaaacaccuuuauu

SEQ ID NO: 346519 - RNA, 19 nt, Human
ugggaacaaaacaauaaac

SEQ ID NO: 346520 - RNA, 19 nt, Human
ugggaacaaaacaauaaac

SEQ ID NO: 346521 - RNA, 23 nt, Human
ugugggaacaaaacaauaaacac

SEQ ID NO: 346522 - RNA, 21 nt, Human
cagcagcccaggagggacagg

SEQ ID NO: 346523 - RNA, 21 nt, Human
cuccgcuuccccgucugcgcc

SEQ ID NO: 346524 - RNA, 18 nt, Human
gcagcccaggagggacag

SEQ ID NO: 346525 - RNA, 23 nt, Human
ggcaggaaaacgagacaauccag

SEQ ID NO: 346526 - RNA, 18 nt, Human
acccagagucugagccug

SEQ ID NO: 346527 - RNA, 24 nt, Human
acucguaguccggacucggacuuu

SEQ ID NO: 346528 - RNA, 23 nt, Human
aggaggccacgcacucguagucc

SEQ ID NO: 346529 - RNA, 22 nt, Human
agggcagcacugucuaucuguc

SEQ ID NO: 346530 - RNA, 21 nt, Human
caaaaaucugcauguaaacaa

SEQ ID NO: 346531 - RNA, 22 nt, Human
cacccgggcugugaaaaaaggc

SEQ ID NO: 346532 - RNA, 24 nt, Human
cacccggggcaguuggcugggcca

SEQ ID NO: 346533 - RNA, 18 nt, Human
cagcuccgagggacccag

SEQ ID NO: 346534 - RNA, 23 nt, Human
ccaacccuuccguucgucuccca

SEQ ID NO: 346535 - RNA, 20 nt, Human
cccaccauagugggagcggg

SEQ ID NO: 346536 - RNA, 21 nt, Human
ccuccagggcaggcacacccg

SEQ ID NO: 346537 - RNA, 21 nt, Human
cgagggacccagagucugagc

SEQ ID NO: 346538 - RNA, 24 nt, Human
cugcgcaugcaucucugugggccc

SEQ ID NO: 346539 - RNA, 22 nt, Human
gaaaaaaggcagaguccucucc

SEQ ID NO: 346540 - RNA, 21 nt, Human
gcacccggggcaguuggcugg

SEQ ID NO: 346541 - RNA, 23 nt, Human
gcagaguccucucccggcacgca

SEQ ID NO: 346542 - RNA, 24 nt, Human
gcagaguccucucccggcacgcag

SEQ ID NO: 346543 - RNA, 23 nt, Human
gcaggccugcccggcggcugcgc

SEQ ID NO: 346544 - RNA, 19 nt, Human
gcaugcaucucugugggcc

SEQ ID NO: 346545 - RNA, 21 nt, Human
gcgcaugcaucucugugggcc

SEQ ID NO: 346546 - RNA, 21 nt, Human
gcugggccagcccaccaaccc

SEQ ID NO: 346547 - RNA, 19 nt, Human
gugcccggcuggcagcucc

SEQ ID NO: 346548 - RNA, 23 nt, Human
guuuccgccgccgcugcugcugc

SEQ ID NO: 346549 - RNA, 18 nt, Human
uaaacaaguagcuaccgc

SEQ ID NO: 346550 - RNA, 18 nt, Human
uacaaaaaucugcaugua

SEQ ID NO: 346551 - RNA, 19 nt, Human
uccaugaccaugagguugg

SEQ ID NO: 346552 - RNA, 25 nt, Human
uccgccgccgcugcugcugcagcca

SEQ ID NO: 346553 - RNA, 19 nt, Human
ucucccaccauagugggag

SEQ ID NO: 346554 - RNA, 24 nt, Human
ugaaaaaaggcagaguccucuccc

SEQ ID NO: 346555 - RNA, 22 nt, Human
uggcagcuccgagggacccaga

SEQ ID NO: 346556 - RNA, 21 nt, Human
uguaaacaaguagcuaccgca

SEQ ID NO: 346557 - RNA, 21 nt, Human
uuccgccgccgcugcugcugc

SEQ ID NO: 346558 - RNA, 24 nt, Human
uuccgccgccgcugcugcugcagc

SEQ ID NO: 346559 - RNA, 22 nt, Human
aagaggccaggaaguaagggug

SEQ ID NO: 346560 - RNA, 23 nt, Human
acccggagccccucacccccacc

SEQ ID NO: 346561 - RNA, 24 nt, Human
acccggagccccucacccccacca

SEQ ID NO: 346562 - RNA, 24 nt, Human
agagcuuguggugguugcuucucu

SEQ ID NO: 346563 - RNA, 22 nt, Human
agcccagaagaggccaggaagu

SEQ ID NO: 346564 - RNA, 20 nt, Human
aggcuuagguggggacagga

SEQ ID NO: 346565 - RNA, 19 nt, Human
cagaagaggccaggaagua

SEQ ID NO: 346566 - RNA, 18 nt, Human
caguggcaguagcccaga

SEQ ID NO: 346567 - RNA, 23 nt, Human
cccgagagcuuguggugguugcu

SEQ ID NO: 346568 - RNA, 19 nt, Human
cgccaccgcugcugcugcc

SEQ ID NO: 346569 - RNA, 23 nt, Human
cugcugccuucgcuaccgccugc

SEQ ID NO: 346570 - RNA, 21 nt, Human
cuuguggugguugcuucucuc

SEQ ID NO: 346571 - RNA, 20 nt, Human
gacccggagccccucacccc

SEQ ID NO: 346572 - RNA, 19 nt, Human
ggccaggaaguaagggugg

SEQ ID NO: 346573 - RNA, 23 nt, Human
ggggaggggaguuauauacagca

SEQ ID NO: 346574 - RNA, 19 nt, Human
uagguggggacaggaggcg

SEQ ID NO: 346575 - RNA, 18 nt, Human
ugacccggagccccucac

SEQ ID NO: 346576 - RNA, 21 nt, Human
ugacccggagccccucacccc

SEQ ID NO: 346577 - RNA, 19 nt, Human
ugaggaaauugaggcucag

SEQ ID NO: 346578 - RNA, 24 nt, Human
ugaggaaauugaggcucagugagg

SEQ ID NO: 346579 - RNA, 19 nt, Human
uggcagaaggcacacagug

SEQ ID NO: 346580 - RNA, 20 nt, Human
uggcagaaggcacacagugg

SEQ ID NO: 346581 - RNA, 22 nt, Human
uggcagaaggcacacaguggca

SEQ ID NO: 346582 - RNA, 19 nt, Human
uguggugguugcuucucuc

SEQ ID NO: 346583 - RNA, 23 nt, Human
uuggcagugacauuuauuuuucu

SEQ ID NO: 346584 - RNA, 18 nt, Human
uuuuuuuuuuuuuuuucg

SEQ ID NO: 346585 - RNA, 22 nt, Human
uuuuuuuuuuuuuuuucguugg

SEQ ID NO: 346586 - RNA, 21 nt, Human
uuuuuuuuuuuuuuuuucguu

SEQ ID NO: 346587 - RNA, 20 nt, Human
aaagagcaugucuguguaua

SEQ ID NO: 346588 - RNA, 24 nt, Human
aaagauaggcaaaaauucacauua

SEQ ID NO: 346589 - RNA, 23 nt, Human
agaaaggacuagccagcuucuug

SEQ ID NO: 346590 - RNA, 21 nt, Human
cagcuuagauuccaaaacuga

SEQ ID NO: 346591 - RNA, 23 nt, Human
cgccgagccgccgcugccgcccc

SEQ ID NO: 346592 - RNA, 25 nt, Human
cggccgggcugggguccccgggacc

SEQ ID NO: 346593 - RNA, 30 nt, Human
cugacugcgccgagccgccgcugccgcccc

SEQ ID NO: 346594 - RNA, 18 nt, Human
cugcgggcgagcggccgg

SEQ ID NO: 346595 - RNA, 19 nt, Human
gacauauauuuuaaaggaa

SEQ ID NO: 346596 - RNA, 22 nt, Human
gagcggccgggcuggggucccg

SEQ ID NO: 346597 - RNA, 21 nt, Human
gcgagcggccgggcugggguc

SEQ ID NO: 346598 - RNA, 20 nt, Human
gcgccgagccgccgcugccg

SEQ ID NO: 346599 - RNA, 19 nt, Human
gcgcggcgcuggggacugg

SEQ ID NO: 346600 - RNA, 25 nt, Human
gcggcgcuggggacuggcuggguac

SEQ ID NO: 346601 - RNA, 22 nt, Human
ggcaaaaauucacauuaaaaaa

SEQ ID NO: 346602 - RNA, 22 nt, Human
uaacaaaggcugacauugaaau

SEQ ID NO: 346603 - RNA, 21 nt, Human
uaacauggugaucauuugucu

SEQ ID NO: 346604 - RNA, 23 nt, Human
uaauccauaaauacaacaggcau

SEQ ID NO: 346605 - RNA, 21 nt, Human
uagaaagguaccaacaagaug

SEQ ID NO: 346606 - RNA, 24 nt, Human
uagcuucagcuuggcaaacagcuu

SEQ ID NO: 346607 - RNA, 21 nt, Human
uauauuuuaaaggaaucagau

SEQ ID NO: 346608 - RNA, 21 nt, Human
ucccggguaccgggaggcguc

SEQ ID NO: 346609 - RNA, 22 nt, Human
uggaaaugaccauuguauuagc

SEQ ID NO: 346610 - RNA, 22 nt, Human
uguaguaucaguaaaggucuga

SEQ ID NO: 346611 - RNA, 20 nt, Human
uguuuccuuuaaauuugucu

SEQ ID NO: 346612 - RNA, 24 nt, Human
uuaaaaaaaacccuauauuucuau

SEQ ID NO: 346613 - RNA, 22 nt, Human
uuaaagauaggcaaaaauucac

SEQ ID NO: 346614 - RNA, 18 nt, Human
uucacagaaaggacuagc

SEQ ID NO: 346615 - RNA, 25 nt, Human
uugaagcagccuuaguguuuccuuu

SEQ ID NO: 346616 - RNA, 21 nt, Human
uuuuuuuuuuuuauaagcagu

SEQ ID NO: 346617 - RNA, 28 nt, Human
caguaacuucuuuuuccaaagaggaaac

SEQ ID NO: 346618 - RNA, 20 nt, Human
ccagagacgcgagagggaaa

SEQ ID NO: 346619 - RNA, 19 nt, Human
gaauguguaaggcauuuug

SEQ ID NO: 346620 - RNA, 18 nt, Human
gggaaagcgagagggcag

SEQ ID NO: 346621 - RNA, 22 nt, Human
gggaaagcgagagggcaggagc

SEQ ID NO: 346622 - RNA, 23 nt, Human
uaaguugaacaguaacuucuuuu

SEQ ID NO: 346623 - RNA, 18 nt, Human
uuuuuuuuuuuuuuuuug

SEQ ID NO: 346624 - RNA, 19 nt, Human
uuuuuuuuuuuuuuuuugu

SEQ ID NO: 346625 - RNA, 22 nt, Human
uuuuuuuuuuuuuuuuuguagg

SEQ ID NO: 346626 - RNA, 21 nt, Human
acacacucggagcaacccuga

SEQ ID NO: 346627 - RNA, 22 nt, Human
acccugauaaguagacacauca

SEQ ID NO: 346628 - RNA, 26 nt, Human
agcggccggcggcggcggcggcggcg

SEQ ID NO: 346629 - RNA, 23 nt, Human
aggcugcgguaaggcuauggcac

SEQ ID NO: 346630 - RNA, 18 nt, Human
agucuguguugacuucuu

SEQ ID NO: 346631 - RNA, 18 nt, Human
cacuggaaucggcacggg

SEQ ID NO: 346632 - RNA, 21 nt, Human
cagagccaccacuccuggaac

SEQ ID NO: 346633 - RNA, 23 nt, Human
cauccccuacgacgagcugggag

SEQ ID NO: 346634 - RNA, 20 nt, Human
ccaagccagcgggacgaacu

SEQ ID NO: 346635 - RNA, 21 nt, Human
cggacuggggggggugagggg

SEQ ID NO: 346636 - RNA, 22 nt, Human
cggcggcggcggcggcggcggc

SEQ ID NO: 346637 - RNA, 18 nt, Human
cucccgcgcaggcugcgg

SEQ ID NO: 346638 - RNA, 21 nt, Human
cuccugcgagucuccugggga

SEQ ID NO: 346639 - RNA, 26 nt, Human
cucucucacuccucaacagccaaagg

SEQ ID NO: 346640 - RNA, 27 nt, Human
cucucucucucucacuccucaacagcc

SEQ ID NO: 346641 - RNA, 18 nt, Human
cucucucucucucucucu

SEQ ID NO: 346642 - RNA, 18 nt, Human
cucucucucucucucucu

SEQ ID NO: 346643 - RNA, 18 nt, Human
cucucucucucucucucu

SEQ ID NO: 346644 - RNA, 18 nt, Human
cucucucucucucucucu

SEQ ID NO: 346645 - RNA, 18 nt, Human
cucucucucucucucucu

SEQ ID NO: 346646 - RNA, 18 nt, Human
cucucucucucucucucu

SEQ ID NO: 346647 - RNA, 24 nt, Human
cucucucucucucucucucucaag

SEQ ID NO: 346648 - RNA, 24 nt, Human
cucugcuggcuuuugucugugcug

SEQ ID NO: 346649 - RNA, 27 nt, Human
cugcuauaaaacuccauuuucugaccc

SEQ ID NO: 346650 - RNA, 19 nt, Human
cuguggccucccgcgcagg

SEQ ID NO: 346651 - RNA, 18 nt, Human
gacacuguuuucuuugug

SEQ ID NO: 346652 - RNA, 25 nt, Human
gcaacccugauaaguagacacauca

SEQ ID NO: 346653 - RNA, 21 nt, Human
gcacugagcgagcagccacgc

SEQ ID NO: 346654 - RNA, 21 nt, Human
gccggcggcggcggcggcggc

SEQ ID NO: 346655 - RNA, 24 nt, Human
gcgagcagccacgcuccugcuugu

SEQ ID NO: 346656 - RNA, 20 nt, Human
gcggcggcggcggcggcggc

SEQ ID NO: 346657 - RNA, 24 nt, Human
gcggcggcggcggcggcggcgcuc

SEQ ID NO: 346658 - RNA, 23 nt, Human
gcggcggcggcggcggcggcggc

SEQ ID NO: 346659 - RNA, 23 nt, Human
gcggcggcggcggcggcggcggc

SEQ ID NO: 346660 - RNA, 18 nt, Human
gcugaggcugucacucca

SEQ ID NO: 346661 - RNA, 24 nt, Human
ggccggcggcggcggcggcggcgg

SEQ ID NO: 346662 - RNA, 25 nt, Human
ggcggcggcggcggcgcucggacug

SEQ ID NO: 346663 - RNA, 23 nt, Human
ggcggcggcggcggcggcggcgg

SEQ ID NO: 346664 - RNA, 23 nt, Human
ggcggcggcggcggcggcggcgg

SEQ ID NO: 346665 - RNA, 22 nt, Human
gggucacaccucagagccacca

SEQ ID NO: 346666 - RNA, 23 nt, Human
uacaacacccaugauaauaugga

SEQ ID NO: 346667 - RNA, 21 nt, Human
uagacgcuuugcucugcuggc

SEQ ID NO: 346668 - RNA, 20 nt, Human
uccccugcuguagcuaucau

SEQ ID NO: 346669 - RNA, 21 nt, Human
ucucacuccucaacagccaaa

SEQ ID NO: 346670 - RNA, 19 nt, Human
ucuccuggggacguguuac

SEQ ID NO: 346671 - RNA, 22 nt, Human
ucucucacuccucaacagccaa

SEQ ID NO: 346672 - RNA, 21 nt, Human
ucucucucucucucucucuca

SEQ ID NO: 346673 - RNA, 18 nt, Human
ugacuucuugucuucuuc

SEQ ID NO: 346674 - RNA, 20 nt, Human
ugacuucuugucuucuucuc

SEQ ID NO: 346675 - RNA, 21 nt, Human
ugcugagggggcugaggcugu

SEQ ID NO: 346676 - RNA, 20 nt, Human
uggcacugagcgagcagcca

SEQ ID NO: 346677 - RNA, 20 nt, Human
uggcugggcccaaacguggg

SEQ ID NO: 346678 - RNA, 19 nt, Human
uggggggggugagggggag

SEQ ID NO: 346679 - RNA, 21 nt, Human
ugucuucuucucuugguagua

SEQ ID NO: 346680 - RNA, 22 nt, Human
uguugacuucuugucuucuucu

SEQ ID NO: 346681 - RNA, 22 nt, Human
uuccaagccagcgggacgaacu

SEQ ID NO: 346682 - RNA, 21 nt, Human
uuucuuuguguuaucaagcug

SEQ ID NO: 346683 - RNA, 19 nt, Human
aaagaacuggaguuggagc

SEQ ID NO: 346684 - RNA, 19 nt, Human
aagcgccggcgggaucgag

SEQ ID NO: 346685 - RNA, 21 nt, Human
acagcacuuucuucagagcag

SEQ ID NO: 346686 - RNA, 22 nt, Human
accaccucaagcaaacccacua

SEQ ID NO: 346687 - RNA, 19 nt, Human
aguuggagccagacagcac

SEQ ID NO: 346688 - RNA, 22 nt, Human
caaagcaguaaaacuaaaucuc

SEQ ID NO: 346689 - RNA, 19 nt, Human
caccucaagcaaacccacu

SEQ ID NO: 346690 - RNA, 18 nt, Human
cagcacuuucuucagagc

SEQ ID NO: 346691 - RNA, 25 nt, Human
caucauuaacaguacuuuaaaucaa

SEQ ID NO: 346692 - RNA, 23 nt, Human
cauuccuaaaacuucuacuuuga

SEQ ID NO: 346693 - RNA, 22 nt, Human
ccaccagucaaagcaguaaaac

SEQ ID NO: 346694 - RNA, 24 nt, Human
ccaccagucaaagcaguaaaacua

SEQ ID NO: 346695 - RNA, 23 nt, Human
ccugcaacaggguccagcaaagc

SEQ ID NO: 346696 - RNA, 23 nt, Human
cugaagacaugcuggucucuucc

SEQ ID NO: 346697 - RNA, 24 nt, Human
cuuaacaaaacugaagucuucaga

SEQ ID NO: 346698 - RNA, 20 nt, Human
cuucuagagacccaccaguc

SEQ ID NO: 346699 - RNA, 19 nt, Human
gaaguaguuuggcuacuga

SEQ ID NO: 346700 - RNA, 20 nt, Human
ggugacagagugggaagggu

SEQ ID NO: 346701 - RNA, 26 nt, Human
uaacaaaacugaagucuucagaaaag

SEQ ID NO: 346702 - RNA, 24 nt, Human
uaggaccauauccagauaaagguc

SEQ ID NO: 346703 - RNA, 24 nt, Human
ucaaagcaguaaaacuaaaucucc

SEQ ID NO: 346704 - RNA, 18 nt, Human
ucaagaaguaguuuggcu

SEQ ID NO: 346705 - RNA, 23 nt, Human
ucaagcaaacccacuauaccuau

SEQ ID NO: 346706 - RNA, 21 nt, Human
uccaagacuggacugcggcuc

SEQ ID NO: 346707 - RNA, 23 nt, Human
uccccuucccgcgcccgccaccc

SEQ ID NO: 346708 - RNA, 23 nt, Human
ucucaugaguuaucacucaguuu

SEQ ID NO: 346709 - RNA, 24 nt, Human
ugaaaaucccaauauaugaguuua

SEQ ID NO: 346710 - RNA, 20 nt, Human
ugcuucuagagacccaccag

SEQ ID NO: 346711 - RNA, 22 nt, Human
ugggaaggguuagguuccaggc

SEQ ID NO: 346712 - RNA, 18 nt, Human
uuuuuuuuuuuuucacuu

SEQ ID NO: 346713 - RNA, 25 nt, Human
uuuuuuuuuuuuucacuuagaaaug

SEQ ID NO: 346714 - RNA, 24 nt, Human
uuuuuuuuuuuuuuuucacuuaau

SEQ ID NO: 346715 - RNA, 23 nt, Human
aaacagacaggacugguugugag

SEQ ID NO: 346716 - RNA, 18 nt, Human
aaaccaaauaaaucaagc

SEQ ID NO: 346717 - RNA, 27 nt, Human
aacacaaccugucuucuaucuggcacc

SEQ ID NO: 346718 - RNA, 25 nt, Human
aagggucaccccucacuuuaaagcc

SEQ ID NO: 346719 - RNA, 18 nt, Human
acaggauaaaaacacaac

SEQ ID NO: 346720 - RNA, 24 nt, Human
accuacuuacaccaaacaaaacua

SEQ ID NO: 346721 - RNA, 20 nt, Human
acuaccuuagcucccacaua

SEQ ID NO: 346722 - RNA, 22 nt, Human
acucacacaaccuacuuacacc

SEQ ID NO: 346723 - RNA, 20 nt, Human
agaaaccaaauaaaucaagc

SEQ ID NO: 346724 - RNA, 22 nt, Human
agcagccaggacaggacggcug

SEQ ID NO: 346725 - RNA, 23 nt, Human
agccacaggauaaaaacacaacc

SEQ ID NO: 346726 - RNA, 20 nt, Human
aggacacuacacaagccaca

SEQ ID NO: 346727 - RNA, 19 nt, Human
aggcugcaucuuuuaacug

SEQ ID NO: 346728 - RNA, 18 nt, Human
aguugauuucaccacuua

SEQ ID NO: 346729 - RNA, 18 nt, Human
auguauuugguguagaaa

SEQ ID NO: 346730 - RNA, 21 nt, Human
caaaaggugauacuaccagca

SEQ ID NO: 346731 - RNA, 23 nt, Human
caagccacaggauaaaaacacaa

SEQ ID NO: 346732 - RNA, 20 nt, Human
cacaagccacaggauaaaaa

SEQ ID NO: 346733 - RNA, 23 nt, Human
cacacaaccuacuuacaccaaac

SEQ ID NO: 346734 - RNA, 21 nt, Human
cacacauaugaaggcccagau

SEQ ID NO: 346735 - RNA, 23 nt, Human
caccccuaaauuucuagugauuu

SEQ ID NO: 346736 - RNA, 19 nt, Human
caccccucacuuuaaagcc

SEQ ID NO: 346737 - RNA, 22 nt, Human
caccccucacuuuaaagccaag

SEQ ID NO: 346738 - RNA, 23 nt, Human
caccccucacuuuaaagccaaga

SEQ ID NO: 346739 - RNA, 20 nt, Human
cacuacacaagccacaggau

SEQ ID NO: 346740 - RNA, 18 nt, Human
cacuauaaacagacagga

SEQ ID NO: 346741 - RNA, 19 nt, Human
cagcagccuuuaaaucucc

SEQ ID NO: 346742 - RNA, 19 nt, Human
cagccagccaggccuucug

SEQ ID NO: 346743 - RNA, 22 nt, Human
caggauaaaaacacaaccuguc

SEQ ID NO: 346744 - RNA, 24 nt, Human
cauaguaaauauaaaugaauuaac

SEQ ID NO: 346745 - RNA, 23 nt, Human
cauuggcugugccaugccuccga

SEQ ID NO: 346746 - RNA, 22 nt, Human
ccaaacaaaacuagaaugaaca

SEQ ID NO: 346747 - RNA, 21 nt, Human
cccacauaugaaaacucuuca

SEQ ID NO: 346748 - RNA, 19 nt, Human
ccuccgacccuucccauug

SEQ ID NO: 346749 - RNA, 19 nt, Human
cgcgcgcucccggcccuuc

SEQ ID NO: 346750 - RNA, 25 nt, Human
cgcucccggcccuucccauuggcuu

SEQ ID NO: 346751 - RNA, 21 nt, Human
cggcugggacagggugcacgg

SEQ ID NO: 346752 - RNA, 21 nt, Human
cugugccaugccuccgacccu

SEQ ID NO: 346753 - RNA, 30 nt, Human
cuucccauuggcugugccaugccuccgacu

SEQ ID NO: 346754 - RNA, 19 nt, Human
gaaaauacagugagaaaua

SEQ ID NO: 346755 - RNA, 19 nt, Human
gacacuacacaagccacag

SEQ ID NO: 346756 - RNA, 18 nt, Human
gaccccucacuccagcag

SEQ ID NO: 346757 - RNA, 21 nt, Human
gaccccucacuccagcagccu

SEQ ID NO: 346758 - RNA, 21 nt, Human
gagauggaaaaaaaaaaucag

SEQ ID NO: 346759 - RNA, 20 nt, Human
gagggggcagagaaucccag

SEQ ID NO: 346760 - RNA, 18 nt, Human
ggcagagaaucccaggac

SEQ ID NO: 346761 - RNA, 20 nt, Human
uaaaaacacaaccugucuuc

SEQ ID NO: 346762 - RNA, 19 nt, Human
uaaaucucccgcgccgcgc

SEQ ID NO: 346763 - RNA, 18 nt, Human
uaagaagcuccuugcccu

SEQ ID NO: 346764 - RNA, 21 nt, Human
uaagggcacaucuucaguuca

SEQ ID NO: 346765 - RNA, 23 nt, Human
uacaccaaacaaaacuagaauga

SEQ ID NO: 346766 - RNA, 23 nt, Human
uacaccaaacaaaacuagaauga

SEQ ID NO: 346767 - RNA, 18 nt, Human
uaucccacaacacucuac

SEQ ID NO: 346768 - RNA, 18 nt, Human
ucaccacuuaacaggggc

SEQ ID NO: 346769 - RNA, 22 nt, Human
uccagcagccuuuaaaucuccc

SEQ ID NO: 346770 - RNA, 21 nt, Human
ucccacaacacucuacucaga

SEQ ID NO: 346771 - RNA, 20 nt, Human
ucccgcgccgcgcgcucccg

SEQ ID NO: 346772 - RNA, 21 nt, Human
ugacuugaaauuuuacaauac

SEQ ID NO: 346773 - RNA, 18 nt, Human
ugagauggaaaaaaaaaa

SEQ ID NO: 346774 - RNA, 21 nt, Human
ugagauggaaaaaaaaaauca

SEQ ID NO: 346775 - RNA, 18 nt, Human
ugccccggcccuucccau

SEQ ID NO: 346776 - RNA, 25 nt, Human
uggcugugccaugccuccgacccuu

SEQ ID NO: 346777 - RNA, 23 nt, Human
uuaugagauggaaaaaaaaaauc

SEQ ID NO: 346778 - RNA, 26 nt, Human
uucucacacauaugaaggcccagauc

SEQ ID NO: 346779 - RNA, 19 nt, Human
uuggugccccggcccuucc

SEQ ID NO: 346780 - RNA, 24 nt, Human
uuuggugccccggcccuucccauu

SEQ ID NO: 346781 - RNA, 19 nt, Human
aaaaaaauacuguacagac

SEQ ID NO: 346782 - RNA, 21 nt, Human
aaaaaaauuuagauacaccac

SEQ ID NO: 346783 - RNA, 22 nt, Human
aaaaacacuuggcaaacugaag

SEQ ID NO: 346784 - RNA, 26 nt, Human
aaaagcaaucauucucuccagccuuc

SEQ ID NO: 346785 - RNA, 22 nt, Human
aaacaguuguaaacacacucuu

SEQ ID NO: 346786 - RNA, 22 nt, Human
aaagaaacacagccuaagucaa

SEQ ID NO: 346787 - RNA, 18 nt, Human
aacacacucuuaauuuuu

SEQ ID NO: 346788 - RNA, 18 nt, Human
aaccacauaaugccaucu

SEQ ID NO: 346789 - RNA, 19 nt, Human
aaccauaaagaaacacagc

SEQ ID NO: 346790 - RNA, 20 nt, Human
aagaaccaaaguauugaaca

SEQ ID NO: 346791 - RNA, 23 nt, Human
aagacuucuucauccaaagacag

SEQ ID NO: 346792 - RNA, 26 nt, Human
aagacuucuucauccaaagacagguc

SEQ ID NO: 346793 - RNA, 20 nt, Human
aagacuucuucauccaaauc

SEQ ID NO: 346794 - RNA, 23 nt, Human
aagacuucuucauccaaauccag

SEQ ID NO: 346795 - RNA, 20 nt, Human
aagccaaaaaaauaagaaaa

SEQ ID NO: 346796 - RNA, 21 nt, Human
aauccuuucuuccuaaugccu

SEQ ID NO: 346797 - RNA, 23 nt, Human
aauuggacagcaaaacccagucc

SEQ ID NO: 346798 - RNA, 18 nt, Human
acacuagcugggugagau

SEQ ID NO: 346799 - RNA, 25 nt, Human
acagaauccccuuuuucccccaaaa

SEQ ID NO: 346800 - RNA, 19 nt, Human
acuacgacagcacccaggu

SEQ ID NO: 346801 - RNA, 21 nt, Human
agacaaaagcaaaucaacaua

SEQ ID NO: 346802 - RNA, 23 nt, Human
agcuuucuauguacacaguaaau

SEQ ID NO: 346803 - RNA, 18 nt, Human
aggaaauguacaaaauga

SEQ ID NO: 346804 - RNA, 20 nt, Human
aggcuggggccagcuuaguu

SEQ ID NO: 346805 - RNA, 19 nt, Human
aggggcagacuucucaaaa

SEQ ID NO: 346806 - RNA, 24 nt, Human
aggugguccgcugguccgcugggu

SEQ ID NO: 346807 - RNA, 25 nt, Human
aguaaauaguaaauaacuuugcuaa

SEQ ID NO: 346808 - RNA, 19 nt, Human
aguuuguugggaaugggaa

SEQ ID NO: 346809 - RNA, 20 nt, Human
aguuuuaaaacaagagguuu

SEQ ID NO: 346810 - RNA, 21 nt, Human
auaaugccaucuuuuauuuca

SEQ ID NO: 346811 - RNA, 19 nt, Human
auccagaauuguauaaagu

SEQ ID NO: 346812 - RNA, 24 nt, Human
caaaaaaauaucuagaggagcuaa

SEQ ID NO: 346813 - RNA, 22 nt, Human
caaagaacuuauucuugcguga

SEQ ID NO: 346814 - RNA, 19 nt, Human
caacuaacaacuaaauuuu

SEQ ID NO: 346815 - RNA, 19 nt, Human
cacacacuggaguaagggc

SEQ ID NO: 346816 - RNA, 24 nt, Human
caccacacauaauaaagcuuucua

SEQ ID NO: 346817 - RNA, 19 nt, Human
cacccaggugguccgcugg

SEQ ID NO: 346818 - RNA, 22 nt, Human
cacuccauaaguaggcuuccca

SEQ ID NO: 346819 - RNA, 20 nt, Human
cacuggaguaagggcagaac

SEQ ID NO: 346820 - RNA, 18 nt, Human
cagaaccuuagacucaug

SEQ ID NO: 346821 - RNA, 24 nt, Human
cagaauccccuuuuucccccaaaa

SEQ ID NO: 346822 - RNA, 18 nt, Human
cagacagugacgaugagc

SEQ ID NO: 346823 - RNA, 21 nt, Human
cagcacccaggugguccgcug

SEQ ID NO: 346824 - RNA, 20 nt, Human
cagcucuagggacucggccg

SEQ ID NO: 346825 - RNA, 24 nt, Human
cagggcgagauaaauuuauguacc

SEQ ID NO: 346826 - RNA, 19 nt, Human
caggugguccgcugguccg

SEQ ID NO: 346827 - RNA, 18 nt, Human
caguccauaagcccuucc

SEQ ID NO: 346828 - RNA, 18 nt, Human
cauaaguaggcuucccaa

SEQ ID NO: 346829 - RNA, 23 nt, Human
ccaaaaaaauaagaaaacaacua

SEQ ID NO: 346830 - RNA, 22 nt, Human
ccaaaagaucucaaguuucuga

SEQ ID NO: 346831 - RNA, 23 nt, Human
cccaaguccacuaccaauucacu

SEQ ID NO: 346832 - RNA, 18 nt, Human
cccgccccgccgcgccgg

SEQ ID NO: 346833 - RNA, 18 nt, Human
cccggccccgccuccccc

SEQ ID NO: 346834 - RNA, 24 nt, Human
cccugcgccggcccggccccgccu

SEQ ID NO: 346835 - RNA, 18 nt, Human
ccgaagcuacgggcgcug

SEQ ID NO: 346836 - RNA, 23 nt, Human
ccgccccgccgcgccgguccugc

SEQ ID NO: 346837 - RNA, 24 nt, Human
ccgccgaagcuacgggcgcugagg

SEQ ID NO: 346838 - RNA, 20 nt, Human
ccucggggcuccgccuaacu

SEQ ID NO: 346839 - RNA, 21 nt, Human
ccucuaaaaaaaaauacugua

SEQ ID NO: 346840 - RNA, 25 nt, Human
ccucuaaaaaaaaauacuguacaga

SEQ ID NO: 346841 - RNA, 29 nt, Human
cgcccccagcucuagggacucggccggcc

SEQ ID NO: 346842 - RNA, 20 nt, Human
cucccccgccucggggcucc

SEQ ID NO: 346843 - RNA, 23 nt, Human
cuccucaggccaccuccaacuac

SEQ ID NO: 346844 - RNA, 19 nt, Human
cucggccagcuuuuuccaa

SEQ ID NO: 346845 - RNA, 19 nt, Human
cucggccggccccgccccg

SEQ ID NO: 346846 - RNA, 20 nt, Human
cucggggcuccgccuaacuu

SEQ ID NO: 346847 - RNA, 23 nt, Human
cugagccucauucuuuccaucug

SEQ ID NO: 346848 - RNA, 18 nt, Human
cugcuccuuuugcauuca

SEQ ID NO: 346849 - RNA, 22 nt, Human
cugguccgcuggguccgccccg

SEQ ID NO: 346850 - RNA, 19 nt, Human
gaauauugugaccuuauuu

SEQ ID NO: 346851 - RNA, 18 nt, Human
gcauuaaaaauacaaaga

SEQ ID NO: 346852 - RNA, 20 nt, Human
gcgcugagggaacugagcuc

SEQ ID NO: 346853 - RNA, 23 nt, Human
gcuauuauaaauaagcuucacau

SEQ ID NO: 346854 - RNA, 22 nt, Human
ggaaauagacaaaagcaaauca

SEQ ID NO: 346855 - RNA, 22 nt, Human
gggaauucuaugacagugaugu

SEQ ID NO: 346856 - RNA, 23 nt, Human
gggaauucuaugacagugauguu

SEQ ID NO: 346857 - RNA, 25 nt, Human
gguaaaaaacaucuguguuaaguau

SEQ ID NO: 346858 - RNA, 21 nt, Human
uaaaaccauaaagaaacacag

SEQ ID NO: 346859 - RNA, 28 nt, Human
uaaaaccauaaagaaacacagccuaagu

SEQ ID NO: 346860 - RNA, 21 nt, Human
uaaacaagauuaagccccaaa

SEQ ID NO: 346861 - RNA, 22 nt, Human
uaaacacacucuuaauuuuuuu

SEQ ID NO: 346862 - RNA, 19 nt, Human
uaaagggaaauggugggaa

SEQ ID NO: 346863 - RNA, 24 nt, Human
uaaauacauguacuguaaaaaaga

SEQ ID NO: 346864 - RNA, 18 nt, Human
uaaauaucuuuaaacaua

SEQ ID NO: 346865 - RNA, 21 nt, Human
uaaaugguucucggccagcuu

SEQ ID NO: 346866 - RNA, 23 nt, Human
uaaaugguucucggccagcuuuu

SEQ ID NO: 346867 - RNA, 26 nt, Human
uaacagguaaaaaacaucuguguuaa

SEQ ID NO: 346868 - RNA, 18 nt, Human
uaacaguaguaguguugg

SEQ ID NO: 346869 - RNA, 24 nt, Human
uaacugacuugccaagggucacac

SEQ ID NO: 346870 - RNA, 18 nt, Human
uaacuucccugagccuca

SEQ ID NO: 346871 - RNA, 24 nt, Human
uaagccaaaaaaauaagaaaacaa

SEQ ID NO: 346872 - RNA, 20 nt, Human
uaagccccaaauugaaggga

SEQ ID NO: 346873 - RNA, 23 nt, Human
uaaguacaccgagguuuaccagu

SEQ ID NO: 346874 - RNA, 21 nt, Human
uacaaaaugaugaagauacca

SEQ ID NO: 346875 - RNA, 22 nt, Human
uacaaaaugaugaagauaccau

SEQ ID NO: 346876 - RNA, 23 nt, Human
uacaccgagguuuaccaagauua

SEQ ID NO: 346877 - RNA, 22 nt, Human
uaccauguucucccuuucucag

SEQ ID NO: 346878 - RNA, 20 nt, Human
uacuguaaaaaagagaaaac

SEQ ID NO: 346879 - RNA, 23 nt, Human
uagagaaaccuccuuuucccuca

SEQ ID NO: 346880 - RNA, 25 nt, Human
uauaaauaagcuucacauuaaggca

SEQ ID NO: 346881 - RNA, 23 nt, Human
uauaaauaucuuuaaacauauua

SEQ ID NO: 346882 - RNA, 23 nt, Human
uauaacagcucaagaguuuuaaa

SEQ ID NO: 346883 - RNA, 21 nt, Human
uauaauuggacagcaaaaccc

SEQ ID NO: 346884 - RNA, 18 nt, Human
uaucauguugcauaguca

SEQ ID NO: 346885 - RNA, 21 nt, Human
uaucuagaggagcuaauagcu

SEQ ID NO: 346886 - RNA, 23 nt, Human
uaugaaaaagauuuggauucaaa

SEQ ID NO: 346887 - RNA, 20 nt, Human
uauguacacaguaaauagua

SEQ ID NO: 346888 - RNA, 23 nt, Human
uauugcuauuauaaauaagcuuc

SEQ ID NO: 346889 - RNA, 19 nt, Human
ucaaagaacuuauucuugc

SEQ ID NO: 346890 - RNA, 20 nt, Human
ucaggcuaccucuugauacu

SEQ ID NO: 346891 - RNA, 18 nt, Human
ucaugucugaccccucgc

SEQ ID NO: 346892 - RNA, 21 nt, Human
uccauaaguaggcuucccaaa

SEQ ID NO: 346893 - RNA, 23 nt, Human
uccauaaguaggcuucccaaagc

SEQ ID NO: 346894 - RNA, 23 nt, Human
ucccaaguccacuaccaauucac

SEQ ID NO: 346895 - RNA, 22 nt, Human
uccccuuuuucccccaaaaaaa

SEQ ID NO: 346896 - RNA, 20 nt, Human
ucccugcgccggcccggccc

SEQ ID NO: 346897 - RNA, 23 nt, Human
ucccugcgccggcccggccccgc

SEQ ID NO: 346898 - RNA, 22 nt, Human
uccgcuggguccgccccgcccc

SEQ ID NO: 346899 - RNA, 18 nt, Human
uccucaggccaccuccaa

SEQ ID NO: 346900 - RNA, 23 nt, Human
ucggccagcuuuuuccaaucuuu

SEQ ID NO: 346901 - RNA, 19 nt, Human
ucgggaauaugagauucuc

SEQ ID NO: 346902 - RNA, 20 nt, Human
ucuaaacauuccagagcuaa

SEQ ID NO: 346903 - RNA, 22 nt, Human
ucuagagaaaccuccuuuuccc

SEQ ID NO: 346904 - RNA, 24 nt, Human
ucucgccuguccauugagugacuc

SEQ ID NO: 346905 - RNA, 18 nt, Human
ucucuccagccuuccauc

SEQ ID NO: 346906 - RNA, 20 nt, Human
ucugacaguguaucuaacaa

SEQ ID NO: 346907 - RNA, 20 nt, Human
ucuguacaugcaggcuuggc

SEQ ID NO: 346908 - RNA, 24 nt, Human
ucuucuagagaaaccuccuuuucc

SEQ ID NO: 346909 - RNA, 19 nt, Human
ucuucucaaguccuuccug

SEQ ID NO: 346910 - RNA, 21 nt, Human
ugaaaacacaguuguaaaaca

SEQ ID NO: 346911 - RNA, 20 nt, Human
ugaccccucgccccaugcuc

SEQ ID NO: 346912 - RNA, 25 nt, Human
ugacgaugagcagaucuuggccaag

SEQ ID NO: 346913 - RNA, 23 nt, Human
ugagaauuauguucuuuuuaagg

SEQ ID NO: 346914 - RNA, 24 nt, Human
ugagcaaacccccaguccuuuaaa

SEQ ID NO: 346915 - RNA, 25 nt, Human
ugaggaaauagacaaaagcaaauca

SEQ ID NO: 346916 - RNA, 26 nt, Human
ugaggaaauagacaaaagcaaaucaa

SEQ ID NO: 346917 - RNA, 21 nt, Human
ugcaaagagaaaaucucuaag

SEQ ID NO: 346918 - RNA, 23 nt, Human
ugcaaucuaucauagaacugcaa

SEQ ID NO: 346919 - RNA, 22 nt, Human
ugccaagggucacacacuggag

SEQ ID NO: 346920 - RNA, 19 nt, Human
uggaaagaauggagccaaa

SEQ ID NO: 346921 - RNA, 18 nt, Human
uggcaaacugaagcaaug

SEQ ID NO: 346922 - RNA, 18 nt, Human
ugggaaugggaaacaacu

SEQ ID NO: 346923 - RNA, 24 nt, Human
ugggaaugggaaacaacugcuuga

SEQ ID NO: 346924 - RNA, 18 nt, Human
ugguccgcugguccgcug

SEQ ID NO: 346925 - RNA, 20 nt, Human
uguaaaaaagagaaaacagu

SEQ ID NO: 346926 - RNA, 24 nt, Human
uguacaaaaugaugaagauaccau

SEQ ID NO: 346927 - RNA, 25 nt, Human
uguauuaauaucaagacaaggcugg

SEQ ID NO: 346928 - RNA, 22 nt, Human
ugucuaaaagcaauggaucaaa

SEQ ID NO: 346929 - RNA, 20 nt, Human
uguuauggaaagaauggagc

SEQ ID NO: 346930 - RNA, 27 nt, Human
uuaaaaccauaaagaaacacagccuaa

SEQ ID NO: 346931 - RNA, 19 nt, Human
uuaauaucaagacaaggcu

SEQ ID NO: 346932 - RNA, 21 nt, Human
uucaacauacuaagccaaaaa

SEQ ID NO: 346933 - RNA, 22 nt, Human
uucauucugaugucauuacaga

SEQ ID NO: 346934 - RNA, 24 nt, Human
uuccccuaagcauuaaaaauacaa

SEQ ID NO: 346935 - RNA, 21 nt, Human
uuccuuuugagcaaaccccca

SEQ ID NO: 346936 - RNA, 19 nt, Human
uuuuaaggaaaugagagua

SEQ ID NO: 346937 - RNA, 26 nt, Human
aaagggggccagucgcuuaggagacu

SEQ ID NO: 346938 - RNA, 18 nt, Human
aagcucgagagagagcag

SEQ ID NO: 346939 - RNA, 20 nt, Human
aagguggggcccauggaugg

SEQ ID NO: 346940 - RNA, 20 nt, Human
agagggcaggcccgaggcaa

SEQ ID NO: 346941 - RNA, 19 nt, Human
aggucccugauugucccag

SEQ ID NO: 346942 - RNA, 24 nt, Human
agguggcgggcgcgcgagcggcuc

SEQ ID NO: 346943 - RNA, 20 nt, Human
agguucaaaagggggccagu

SEQ ID NO: 346944 - RNA, 20 nt, Human
auggagcuugggaccugguu

SEQ ID NO: 346945 - RNA, 28 nt, Human
caagguggggcccauggauggcacuguc

SEQ ID NO: 346946 - RNA, 18 nt, Human
caauccaggucccugauu

SEQ ID NO: 346947 - RNA, 22 nt, Human
caauccaggucccugauugucc

SEQ ID NO: 346948 - RNA, 20 nt, Human
cagacaccgccuccgccccg

SEQ ID NO: 346949 - RNA, 18 nt, Human
caggcccgaggcaggagg

SEQ ID NO: 346950 - RNA, 21 nt, Human
cagggcggagacuucccuguc

SEQ ID NO: 346951 - RNA, 23 nt, Human
ccaggccgugcgccccgcgcgcc

SEQ ID NO: 346952 - RNA, 19 nt, Human
ccagugaagcuccaggagc

SEQ ID NO: 346953 - RNA, 21 nt, Human
cccagugaaguugggcgaucc

SEQ ID NO: 346954 - RNA, 18 nt, Human
ccccgcgcgcccugcccg

SEQ ID NO: 346955 - RNA, 18 nt, Human
ccccgcgcuggaaagccu

SEQ ID NO: 346956 - RNA, 25 nt, Human
cccgcgcgcccugcccggugcgcca

SEQ ID NO: 346957 - RNA, 25 nt, Human
cccgcgcgcccugcccggugcgcca

SEQ ID NO: 346958 - RNA, 26 nt, Human
cccgcgcgcccugcccggugcgccac

SEQ ID NO: 346959 - RNA, 25 nt, Human
ccguccaauccaggucccugauugu

SEQ ID NO: 346960 - RNA, 23 nt, Human
cgccuccgccccgcagcgccaac

SEQ ID NO: 346961 - RNA, 21 nt, Human
cggagcaccgagaccggagag

SEQ ID NO: 346962 - RNA, 20 nt, Human
cggccccgucgcgcuucucg

SEQ ID NO: 346963 - RNA, 21 nt, Human
cggccggcgcugccgcucccc

SEQ ID NO: 346964 - RNA, 19 nt, Human
cugguuggguccaaugagg

SEQ ID NO: 346965 - RNA, 21 nt, Human
gaagcuccaggagcaggcugc

SEQ ID NO: 346966 - RNA, 20 nt, Human
gagcaggcugcguguuucca

SEQ ID NO: 346967 - RNA, 21 nt, Human
gagcuggcggcgggagggcag

SEQ ID NO: 346968 - RNA, 22 nt, Human
gcaggagcuggcggcgggaggg

SEQ ID NO: 346969 - RNA, 21 nt, Human
gccaaguccuuuccauccaau

SEQ ID NO: 346970 - RNA, 26 nt, Human
gcgcccccaggccgugcgccccgcgc

SEQ ID NO: 346971 - RNA, 21 nt, Human
gcgcucagacaccgccuccgc

SEQ ID NO: 346972 - RNA, 19 nt, Human
gcgcugccgcuccccgcgc

SEQ ID NO: 346973 - RNA, 21 nt, Human
ggugccgaagcucgagagaga

SEQ ID NO: 346974 - RNA, 18 nt, Human
gugaagcuccaggagcag

SEQ ID NO: 346975 - RNA, 18 nt, Human
uccaauccaggucccuga

SEQ ID NO: 346976 - RNA, 22 nt, Human
uccccgcgcuggaaagccucau

SEQ ID NO: 346977 - RNA, 21 nt, Human
uccucauccaaucagggcgga

SEQ ID NO: 346978 - RNA, 23 nt, Human
ugaagcuccaggagcaggcugcg

SEQ ID NO: 346979 - RNA, 18 nt, Human
uggcauaaagaauauguc

SEQ ID NO: 346980 - RNA, 24 nt, Human
uggcggcgggagggcagacagaca

SEQ ID NO: 346981 - RNA, 18 nt, Human
uucaaaagggggccaguc

SEQ ID NO: 346982 - RNA, 28 nt, Human
uucccuuuuauuaucccgugguaggugg

SEQ ID NO: 346983 - RNA, 19 nt, Human
uucucgucgccccucggag

SEQ ID NO: 346984 - RNA, 18 nt, Human
aaaaacaguaaaaaaacc

SEQ ID NO: 346985 - RNA, 18 nt, Human
aaaaauuggagaaaauuc

SEQ ID NO: 346986 - RNA, 20 nt, Human
aaacaaaacaccacaguaga

SEQ ID NO: 346987 - RNA, 18 nt, Human
aaagagcucagauauuuc

SEQ ID NO: 346988 - RNA, 23 nt, Human
aaaggcauauauacaauuauaga

SEQ ID NO: 346989 - RNA, 19 nt, Human
aaaucuccucggacgccgc

SEQ ID NO: 346990 - RNA, 23 nt, Human
agaaggaaaaaaaaauuggagaa

SEQ ID NO: 346991 - RNA, 20 nt, Human
agaugaaaaugcaaaauggc

SEQ ID NO: 346992 - RNA, 22 nt, Human
aggaaaaaaaaauuggagaaaa

SEQ ID NO: 346993 - RNA, 22 nt, Human
agguauugugaggguagggguu

SEQ ID NO: 346994 - RNA, 20 nt, Human
aguaaaaaaacuugugaagg

SEQ ID NO: 346995 - RNA, 22 nt, Human
aguaaaaaaacuugugaaggga

SEQ ID NO: 346996 - RNA, 19 nt, Human
aucuccucggacgccgccg

SEQ ID NO: 346997 - RNA, 26 nt, Human
caaaacaccacaguagauuaaguggg

SEQ ID NO: 346998 - RNA, 21 nt, Human
caaaacuaauaaacaaaacac

SEQ ID NO: 346999 - RNA, 21 nt, Human
cacacacaaugcugguguuac

SEQ ID NO: 347000 - RNA, 18 nt, Human
cagcaguuuggggcuugc

SEQ ID NO: 347001 - RNA, 22 nt, Human
cagcaguuuggggcuugccccu

SEQ ID NO: 347002 - RNA, 22 nt, Human
cagucucuggauuaaaucuccu

SEQ ID NO: 347003 - RNA, 21 nt, Human
cagugucaaagcuuaaccaaa

SEQ ID NO: 347004 - RNA, 23 nt, Human
ccuguugccacuaucuuucccca

SEQ ID NO: 347005 - RNA, 18 nt, Human
cggggagacuaaagggca

SEQ ID NO: 347006 - RNA, 25 nt, Human
cuaaugaucauuuuaaguguuuucu

SEQ ID NO: 347007 - RNA, 20 nt, Human
cuccuuugccuguugccacu

SEQ ID NO: 347008 - RNA, 20 nt, Human
gagaaggaaaaaaaaauugg

SEQ ID NO: 347009 - RNA, 23 nt, Human
gcauggaagauacauuuuaugac

SEQ ID NO: 347010 - RNA, 21 nt, Human
gccuggaaauaucuuaggugc

SEQ ID NO: 347011 - RNA, 21 nt, Human
ggggggccaauaaauguaaug

SEQ ID NO: 347012 - RNA, 18 nt, Human
ggugaagaaauaaaagga

SEQ ID NO: 347013 - RNA, 20 nt, Human
uaaaaggaaaacaaacaaau

SEQ ID NO: 347014 - RNA, 28 nt, Human
uaaaauguccccacagcaguuuggggcu

SEQ ID NO: 347015 - RNA, 23 nt, Human
uaaauagauucaaacuggucgau

SEQ ID NO: 347016 - RNA, 24 nt, Human
uaaccaaaaaaucuaaauauacaa

SEQ ID NO: 347017 - RNA, 20 nt, Human
uacaauauauagaagcugaa

SEQ ID NO: 347018 - RNA, 23 nt, Human
uaccugccagagaaggaaaaaaa

SEQ ID NO: 347019 - RNA, 25 nt, Human
uaccugccagagaaggaaaaaaaaa

SEQ ID NO: 347020 - RNA, 23 nt, Human
uagaugaaaaugcaaaauggcac

SEQ ID NO: 347021 - RNA, 19 nt, Human
uagauuauaaaaugucccc

SEQ ID NO: 347022 - RNA, 26 nt, Human
uauaaccaaaaauuucaacugguacc

SEQ ID NO: 347023 - RNA, 18 nt, Human
uauguuuuuuucccaaaa

SEQ ID NO: 347024 - RNA, 18 nt, Human
ucaggugcuuugaggucc

SEQ ID NO: 347025 - RNA, 23 nt, Human
ucauacggggagacuaaagggca

SEQ ID NO: 347026 - RNA, 26 nt, Human
uccccacagcaguuuggggcuugccc

SEQ ID NO: 347027 - RNA, 21 nt, Human
uccuuugccuguugccacuau

SEQ ID NO: 347028 - RNA, 23 nt, Human
ucgaggugaaaacucaccuacua

SEQ ID NO: 347029 - RNA, 22 nt, Human
ucuaaaaacaguaaaaaaacuu

SEQ ID NO: 347030 - RNA, 21 nt, Human
ucuccucggacgccgccgccu

SEQ ID NO: 347031 - RNA, 18 nt, Human
ucugcacacacaaugcug

SEQ ID NO: 347032 - RNA, 22 nt, Human
ucuuuuucaaaaagguaaaugu

SEQ ID NO: 347033 - RNA, 22 nt, Human
ugaagaaauaaaaggaaaacaa

SEQ ID NO: 347034 - RNA, 23 nt, Human
ugaagaaauaaaaggaaaacaaa

SEQ ID NO: 347035 - RNA, 19 nt, Human
ugagguccuucauuuucuu

SEQ ID NO: 347036 - RNA, 23 nt, Human
ugcaaaauggcacauuuuuucaa

SEQ ID NO: 347037 - RNA, 20 nt, Human
ugcacacacaaugcuggugu

SEQ ID NO: 347038 - RNA, 22 nt, Human
ugcacacacaaugcugguguua

SEQ ID NO: 347039 - RNA, 24 nt, Human
ugccacuaucuuuccccaaccauu

SEQ ID NO: 347040 - RNA, 20 nt, Human
uggauuaaaucuccucggag

SEQ ID NO: 347041 - RNA, 22 nt, Human
uguuauguccuaaugaucauuu

SEQ ID NO: 347042 - RNA, 22 nt, Human
uuaagugggugcagcauauaga

SEQ ID NO: 347043 - RNA, 19 nt, Human
uuagguguuuuauacuggc

SEQ ID NO: 347044 - RNA, 22 nt, Human
uucaaaaagguaaauguccaaa

SEQ ID NO: 347045 - RNA, 19 nt, Human
uuguguauguuuuuuuccc

SEQ ID NO: 347046 - RNA, 20 nt, Human
uuuacauaucuagaagacau

SEQ ID NO: 347047 - RNA, 25 nt, Human
uuuauaaucacaccuaaguauuauc

SEQ ID NO: 347048 - RNA, 23 nt, Human
uuuauuuaaaucuggugaagaaa

SEQ ID NO: 347049 - RNA, 20 nt, Human
aaagaaacaaauggaaaugg

SEQ ID NO: 347050 - RNA, 20 nt, Human
aaagagagugaaaagaaaaa

SEQ ID NO: 347051 - RNA, 22 nt, Human
aagcauuagaaagagagugaaa

SEQ ID NO: 347052 - RNA, 21 nt, Human
acagggcaagagagaaugaag

SEQ ID NO: 347053 - RNA, 22 nt, Human
acagggcaagagagaaugaagu

SEQ ID NO: 347054 - RNA, 18 nt, Human
acuguucuuuuauucuga

SEQ ID NO: 347055 - RNA, 23 nt, Human
agaaagagagugaaaagaaaaau

SEQ ID NO: 347056 - RNA, 18 nt, Human
agagacagggcaagagag

SEQ ID NO: 347057 - RNA, 18 nt, Human
agagagaaggugcuggaa

SEQ ID NO: 347058 - RNA, 18 nt, Human
agagagaaggugcuggaa

SEQ ID NO: 347059 - RNA, 20 nt, Human
agagagaaugaaguguugga

SEQ ID NO: 347060 - RNA, 19 nt, Human
agagugaaaaguguuaaca

SEQ ID NO: 347061 - RNA, 21 nt, Human
aggugcuggaaggccagccuc

SEQ ID NO: 347062 - RNA, 26 nt, Human
agugaaaagaaaaauaaaaaaggccu

SEQ ID NO: 347063 - RNA, 24 nt, Human
auaaaaaaggccucacacgcagca

SEQ ID NO: 347064 - RNA, 18 nt, Human
auaaagcaaaauaaugag

SEQ ID NO: 347065 - RNA, 19 nt, Human
auaauaagcaaccuuguga

SEQ ID NO: 347066 - RNA, 24 nt, Human
caaacucaagauuuuauuaaaauc

SEQ ID NO: 347067 - RNA, 27 nt, Human
cacuauggaauucgcaguugaauaaga

SEQ ID NO: 347068 - RNA, 19 nt, Human
cagggcaagagagaaugaa

SEQ ID NO: 347069 - RNA, 23 nt, Human
gagaaugaaguguuggagagaga

SEQ ID NO: 347070 - RNA, 19 nt, Human
gagagaaugaaguguugga

SEQ ID NO: 347071 - RNA, 18 nt, Human
gugaaucaacagaaagag

SEQ ID NO: 347072 - RNA, 21 nt, Human
uaaaaaaggccucacacgcag

SEQ ID NO: 347073 - RNA, 22 nt, Human
uauggaauucgcaguugaauaa

SEQ ID NO: 347074 - RNA, 23 nt, Human
uauucuuuugauaauaagcaacc

SEQ ID NO: 347075 - RNA, 21 nt, Human
ucaagaaaagccagagcccac

SEQ ID NO: 347076 - RNA, 22 nt, Human
ucgguggugaaggaagacuuuu

SEQ ID NO: 347077 - RNA, 28 nt, Human
ugaaaagaaaaauaaaaaaggccucacu

SEQ ID NO: 347078 - RNA, 21 nt, Human
ugaaucaacagaaagagugaa

SEQ ID NO: 347079 - RNA, 24 nt, Human
ugaaucaacagaaagagugaaaag

SEQ ID NO: 347080 - RNA, 19 nt, Human
ugagagacagggcaagaga

SEQ ID NO: 347081 - RNA, 20 nt, Human
ugaguuaggugaaucaacaa

SEQ ID NO: 347082 - RNA, 20 nt, Human
uggaaaugguuuaaagaccu

SEQ ID NO: 347083 - RNA, 22 nt, Human
uggagagagaaggugcuggaag

SEQ ID NO: 347084 - RNA, 21 nt, Human
uguuggagagagaaggugcug

SEQ ID NO: 347085 - RNA, 23 nt, Human
uuugagagacagggcaagagaga

SEQ ID NO: 347086 - RNA, 21 nt, Human
aaaugaagcucugcagaaacc

SEQ ID NO: 347087 - RNA, 23 nt, Human
aacuacagaggccuuuccaaaug

SEQ ID NO: 347088 - RNA, 21 nt, Human
augaagcucugcagaaaccac

SEQ ID NO: 347089 - RNA, 21 nt, Human
caacuacagaggccuuuccaa

SEQ ID NO: 347090 - RNA, 18 nt, Human
cacauuuauucacucaca

SEQ ID NO: 347091 - RNA, 24 nt, Human
cagaggccuuuccaaaugaagcuc

SEQ ID NO: 347092 - RNA, 23 nt, Human
ccuuuccaaaugaagcucugcag

SEQ ID NO: 347093 - RNA, 24 nt, Human
cucugcagaaaccacucacugccu

SEQ ID NO: 347094 - RNA, 24 nt, Human
cugcagaaaccacucacugccucc

SEQ ID NO: 347095 - RNA, 21 nt, Human
cugccuccgcagcccuuucug

SEQ ID NO: 347096 - RNA, 19 nt, Human
gccuccgcagcccuuucug

SEQ ID NO: 347097 - RNA, 22 nt, Human
ggccaaccuauucaguugccag

SEQ ID NO: 347098 - RNA, 22 nt, Human
uccaaaugaagcucugcagaaa

SEQ ID NO: 347099 - RNA, 18 nt, Human
uccagcagcguccgcggc

SEQ ID NO: 347100 - RNA, 24 nt, Human
uccaguagcccgcgccacuggcca

SEQ ID NO: 347101 - RNA, 18 nt, Human
uccccaacuacagaggcc

SEQ ID NO: 347102 - RNA, 22 nt, Human
ucugcagaaaccacucacugcc

SEQ ID NO: 347103 - RNA, 23 nt, Human
uugccaggcgacuccagcagcgu

SEQ ID NO: 347104 - RNA, 24 nt, Human
uuuuuuuuuuuuuaaagagacuua

SEQ ID NO: 347105 - RNA, 19 nt, Human
uuuuuuuuuuuuuuuuuaa

SEQ ID NO: 347106 - RNA, 20 nt, Human
aagcugcccuuaucccucug

SEQ ID NO: 347107 - RNA, 20 nt, Human
accauggcaaccacaauuua

SEQ ID NO: 347108 - RNA, 24 nt, Human
agacagcgccguauccagagccca

SEQ ID NO: 347109 - RNA, 25 nt, Human
agacuggccaacuugcuauagacag

SEQ ID NO: 347110 - RNA, 18 nt, Human
agaggaacaggaggccag

SEQ ID NO: 347111 - RNA, 19 nt, Human
aggggcuucugcccacccc

SEQ ID NO: 347112 - RNA, 24 nt, Human
agguggccagcucuugggcagagg

SEQ ID NO: 347113 - RNA, 26 nt, Human
agucuuuaaagagguggccagcucuu

SEQ ID NO: 347114 - RNA, 23 nt, Human
auagacagcgccguauccagagc

SEQ ID NO: 347115 - RNA, 19 nt, Human
cagcgagccccaggaauga

SEQ ID NO: 347116 - RNA, 25 nt, Human
cauuuucucuucugggcagauccua

SEQ ID NO: 347117 - RNA, 21 nt, Human
ccaguuuucuuccaggaaggg

SEQ ID NO: 347118 - RNA, 20 nt, Human
cccccggugcccuuucccuu

SEQ ID NO: 347119 - RNA, 18 nt, Human
ccuccagaggggggacag

SEQ ID NO: 347120 - RNA, 19 nt, Human
ccuccagaggggggacaga

SEQ ID NO: 347121 - RNA, 25 nt, Human
cgccguauccagagcccaacugcgc

SEQ ID NO: 347122 - RNA, 23 nt, Human
gguuccaguuuucuuccaggaag

SEQ ID NO: 347123 - RNA, 18 nt, Human
guaccauggcaaccacaa

SEQ ID NO: 347124 - RNA, 18 nt, Human
gucccagcgagccccagg

SEQ ID NO: 347125 - RNA, 18 nt, Human
uaccacacugucccacag

SEQ ID NO: 347126 - RNA, 21 nt, Human
uaccauggcaaccacaauuua

SEQ ID NO: 347127 - RNA, 21 nt, Human
uagguaccacacugucccaca

SEQ ID NO: 347128 - RNA, 20 nt, Human
ucgguaccauggcaaccaca

SEQ ID NO: 347129 - RNA, 24 nt, Human
uggccaacuugcuauagacagcgc

SEQ ID NO: 347130 - RNA, 25 nt, Human
uuuuuugcuguuaaauaacuuuaau

SEQ ID NO: 347131 - RNA, 20 nt, Human
uuuuuuuuuuuuuuugcugu

SEQ ID NO: 347132 - RNA, 23 nt, Human
uuuuuuuuuuuuuuugcuguuaa

SEQ ID NO: 347133 - RNA, 18 nt, Human
aacacaaaauuaaaaacc

SEQ ID NO: 347134 - RNA, 26 nt, Human
aagaacaccgaagagggaaagauaac

SEQ ID NO: 347135 - RNA, 23 nt, Human
aagagaagaagaacaccgaagag

SEQ ID NO: 347136 - RNA, 21 nt, Human
aaucagcccaccaaucccaua

SEQ ID NO: 347137 - RNA, 19 nt, Human
acauuccuguuugugucca

SEQ ID NO: 347138 - RNA, 22 nt, Human
agagaagaagaacaccgaagag

SEQ ID NO: 347139 - RNA, 24 nt, Human
agagaagaagaacaccgaagaggg

SEQ ID NO: 347140 - RNA, 26 nt, Human
agagaagagaagaagaacaccgaaga

SEQ ID NO: 347141 - RNA, 27 nt, Human
agcuacagaagcauugcagagaagaga

SEQ ID NO: 347142 - RNA, 18 nt, Human
aggaaaggccuagccacg

SEQ ID NO: 347143 - RNA, 18 nt, Human
aguaaugaguaagaagag

SEQ ID NO: 347144 - RNA, 22 nt, Human
caacccaaggacauauaagcga

SEQ ID NO: 347145 - RNA, 19 nt, Human
caagugacucaaauauccu

SEQ ID NO: 347146 - RNA, 22 nt, Human
cacuccagacauuccuguuugu

SEQ ID NO: 347147 - RNA, 23 nt, Human
ccauacauguaaaucagcccacc

SEQ ID NO: 347148 - RNA, 23 nt, Human
cggcgcggcgacggcggcuuggc

SEQ ID NO: 347149 - RNA, 20 nt, Human
cggcuuggcugggcagaggc

SEQ ID NO: 347150 - RNA, 22 nt, Human
cucccugcugcuguccccggag

SEQ ID NO: 347151 - RNA, 19 nt, Human
gaagaacaccgaagaggga

SEQ ID NO: 347152 - RNA, 23 nt, Human
gaagagaagaagaacaccgaaga

SEQ ID NO: 347153 - RNA, 22 nt, Human
gaagcuacagaagcauugcaga

SEQ ID NO: 347154 - RNA, 22 nt, Human
gcaaauauccagaguccguaau

SEQ ID NO: 347155 - RNA, 18 nt, Human
gcagagaagagaagaaga

SEQ ID NO: 347156 - RNA, 22 nt, Human
gcagaggcucgguggcugcgcg

SEQ ID NO: 347157 - RNA, 20 nt, Human
ggggaacauuagaagcuaca

SEQ ID NO: 347158 - RNA, 24 nt, Human
gguacuggagggaggggggaaaga

SEQ ID NO: 347159 - RNA, 23 nt, Human
guggcugcgcgggcgcucccugc

SEQ ID NO: 347160 - RNA, 22 nt, Human
guguguuggaaaaaugcuaaaa

SEQ ID NO: 347161 - RNA, 21 nt, Human
uaagaagagagcuguuaccac

SEQ ID NO: 347162 - RNA, 18 nt, Human
uacaacaaaaguacugca

SEQ ID NO: 347163 - RNA, 24 nt, Human
uacaaggaacagccuaaaaacagc

SEQ ID NO: 347164 - RNA, 23 nt, Human
uaucaaguacauaagugcaaaua

SEQ ID NO: 347165 - RNA, 18 nt, Human
uauccuaagaguacaagg

SEQ ID NO: 347166 - RNA, 24 nt, Human
uccguaauugaauccauuaggaac

SEQ ID NO: 347167 - RNA, 20 nt, Human
ucucuauacuuuagugguug

SEQ ID NO: 347168 - RNA, 18 nt, Human
ugacacaagugacucaaa

SEQ ID NO: 347169 - RNA, 21 nt, Human
uggagggaggggggaaagaca

SEQ ID NO: 347170 - RNA, 22 nt, Human
ugggcagaggcucgguggcugc

SEQ ID NO: 347171 - RNA, 23 nt, Human
ugggcucucaccaucaugcacuu

SEQ ID NO: 347172 - RNA, 21 nt, Human
uuaaaaaccacaucuaauaca

SEQ ID NO: 347173 - RNA, 19 nt, Human
uuagaagcuacagaagcau

SEQ ID NO: 347174 - RNA, 21 nt, Human
uugcagagaagagaagaagaa

SEQ ID NO: 347175 - RNA, 22 nt, Human
uuuagugguugacacaagugac

SEQ ID NO: 347176 - RNA, 22 nt, Human
aaggugccucgucuuuccugga

SEQ ID NO: 347177 - RNA, 22 nt, Human
accaacgccucacggcgccucc

SEQ ID NO: 347178 - RNA, 21 nt, Human
aggccccgcggccaagacccu

SEQ ID NO: 347179 - RNA, 26 nt, Human
aggggggugggugggaacggacaaga

SEQ ID NO: 347180 - RNA, 19 nt, Human
caagagauggagggggcca

SEQ ID NO: 347181 - RNA, 18 nt, Human
cccaccgggaaaaggcuc

SEQ ID NO: 347182 - RNA, 20 nt, Human
cccagcaggccccgcggcca

SEQ ID NO: 347183 - RNA, 19 nt, Human
cccaugcaaagccccggcg

SEQ ID NO: 347184 - RNA, 22 nt, Human
cccugggccccaugcaaagccc

SEQ ID NO: 347185 - RNA, 23 nt, Human
cccugggccccaugcaaagcccc

SEQ ID NO: 347186 - RNA, 20 nt, Human
cccugucuaggcaacuacaa

SEQ ID NO: 347187 - RNA, 20 nt, Human
ccgcgcccacgacgccgcug

SEQ ID NO: 347188 - RNA, 19 nt, Human
ccggcugugccgcccuggg

SEQ ID NO: 347189 - RNA, 21 nt, Human
ccggcugugccgcccugggcc

SEQ ID NO: 347190 - RNA, 23 nt, Human
ccucgggccugcaucgggacccc

SEQ ID NO: 347191 - RNA, 23 nt, Human
ccucuugggaaauguaguccugg

SEQ ID NO: 347192 - RNA, 21 nt, Human
cgcccacgacgccgcugccau

SEQ ID NO: 347193 - RNA, 19 nt, Human
cgggacccccgcccacucc

SEQ ID NO: 347194 - RNA, 22 nt, Human
cgggccugcaucgggacccccg

SEQ ID NO: 347195 - RNA, 23 nt, Human
cguccugcgggcagagacaccgu

SEQ ID NO: 347196 - RNA, 20 nt, Human
cucgccgccuccuccucccg

SEQ ID NO: 347197 - RNA, 20 nt, Human
cugcaucgggacccccgccc

SEQ ID NO: 347198 - RNA, 23 nt, Human
cuggagcagagccucuugggaaa

SEQ ID NO: 347199 - RNA, 24 nt, Human
cugggccccaugcaaagccccggc

SEQ ID NO: 347200 - RNA, 20 nt, Human
gaacggacaagagauggagg

SEQ ID NO: 347201 - RNA, 24 nt, Human
gacaagagauggagggggccagag

SEQ ID NO: 347202 - RNA, 22 nt, Human
gagggggccagagggcugcggg

SEQ ID NO: 347203 - RNA, 19 nt, Human
gaggggggugggugggaac

SEQ ID NO: 347204 - RNA, 20 nt, Human
gcugcgggggcugggggcag

SEQ ID NO: 347205 - RNA, 18 nt, Human
ggagggggguggguggga

SEQ ID NO: 347206 - RNA, 21 nt, Human
ggccccaugcaaagccccggc

SEQ ID NO: 347207 - RNA, 22 nt, Human
ggccugcaucgggacccccgcc

SEQ ID NO: 347208 - RNA, 21 nt, Human
ggcugggggcaggcguccugc

SEQ ID NO: 347209 - RNA, 18 nt, Human
ggcugugccgcccugggc

SEQ ID NO: 347210 - RNA, 24 nt, Human
gggaacggacaagagauggagggg

SEQ ID NO: 347211 - RNA, 25 nt, Human
gggcugggggcaggcguccugcggg

SEQ ID NO: 347212 - RNA, 18 nt, Human
gugccgcccugggcccgg

SEQ ID NO: 347213 - RNA, 18 nt, Human
ucuugggaaauguagucc

SEQ ID NO: 347214 - RNA, 21 nt, Human
ugcaucgggacccccgcccac

SEQ ID NO: 347215 - RNA, 18 nt, Human
ugcgggggcugggggcag

SEQ ID NO: 347216 - RNA, 21 nt, Human
uggacuccuggagcagagccu

SEQ ID NO: 347217 - RNA, 27 nt, Human
uggagggggccagagggcugcgggggg

SEQ ID NO: 347218 - RNA, 19 nt, Human
ugggccccaugcaaagccc

SEQ ID NO: 347219 - RNA, 21 nt, Human
uggugcccugucuaggcaacu

SEQ ID NO: 347220 - RNA, 18 nt, Human
uuggggcuaguagcaucc

SEQ ID NO: 347221 - RNA, 18 nt, Human
aaaaaaaaagcuuggaau

SEQ ID NO: 347222 - RNA, 21 nt, Human
aaaagaaaagaacuggaugug

SEQ ID NO: 347223 - RNA, 23 nt, Human
aaagaaaagaacuggauguggca

SEQ ID NO: 347224 - RNA, 19 nt, Human
aacuguugcauuucugguu

SEQ ID NO: 347225 - RNA, 18 nt, Human
aaggacccagagguguuc

SEQ ID NO: 347226 - RNA, 19 nt, Human
aaggaugggagaaaacacc

SEQ ID NO: 347227 - RNA, 18 nt, Human
aagguccuuuggagggga

SEQ ID NO: 347228 - RNA, 18 nt, Human
acaaaagaaaagaacugg

SEQ ID NO: 347229 - RNA, 23 nt, Human
acagcagcaacaaaagaaaagaa

SEQ ID NO: 347230 - RNA, 24 nt, Human
acagcagcaacaaaagaaaagaac

SEQ ID NO: 347231 - RNA, 20 nt, Human
acgaguucucaaacuaaugc

SEQ ID NO: 347232 - RNA, 25 nt, Human
agcuacagguaaaggcucuaccacc

SEQ ID NO: 347233 - RNA, 18 nt, Human
agcugaguaagacuagug

SEQ ID NO: 347234 - RNA, 21 nt, Human
agggaggaaagcacauucggg

SEQ ID NO: 347235 - RNA, 22 nt, Human
aggugggcaggggagagggagg

SEQ ID NO: 347236 - RNA, 20 nt, Human
aguggcagagggagugaccg

SEQ ID NO: 347237 - RNA, 18 nt, Human
auaacugaggagcccaca

SEQ ID NO: 347238 - RNA, 20 nt, Human
aucaagaaaaaaaggcuuuc

SEQ ID NO: 347239 - RNA, 21 nt, Human
augcaggcucaagcugacacu

SEQ ID NO: 347240 - RNA, 21 nt, Human
augguguuuuaguaacuguug

SEQ ID NO: 347241 - RNA, 19 nt, Human
caagucccuuuacuccgcc

SEQ ID NO: 347242 - RNA, 23 nt, Human
caauaacugaggagcccacaugc

SEQ ID NO: 347243 - RNA, 19 nt, Human
cacacaguuucauuaguaa

SEQ ID NO: 347244 - RNA, 23 nt, Human
cacagcagcaacaaaagaaaaga

SEQ ID NO: 347245 - RNA, 19 nt, Human
caccgcagcaugccugcug

SEQ ID NO: 347246 - RNA, 22 nt, Human
cagauggcauucuuggaaucag

SEQ ID NO: 347247 - RNA, 18 nt, Human
cagcagcaacaaaagaaa

SEQ ID NO: 347248 - RNA, 23 nt, Human
caggaauuaucacuaucaccuau

SEQ ID NO: 347249 - RNA, 19 nt, Human
ccgccaccgcagcaugccu

SEQ ID NO: 347250 - RNA, 19 nt, Human
ccuccaaucuuuccccuuu

SEQ ID NO: 347251 - RNA, 22 nt, Human
ccuuccacuacuuuuugcagcu

SEQ ID NO: 347252 - RNA, 21 nt, Human
ccuuuggaggggaagcccaaa

SEQ ID NO: 347253 - RNA, 21 nt, Human
cgccagugcauauucccucug

SEQ ID NO: 347254 - RNA, 24 nt, Human
cucucagucccacuuuccauuucc

SEQ ID NO: 347255 - RNA, 19 nt, Human
cugaaggaacucacagaug

SEQ ID NO: 347256 - RNA, 23 nt, Human
cuggauguggcacuuccacugca

SEQ ID NO: 347257 - RNA, 23 nt, Human
cuuaaaaaaaaaaaaaauccugu

SEQ ID NO: 347258 - RNA, 23 nt, Human
gaaggugaagaaaaaaacuugcc

SEQ ID NO: 347259 - RNA, 19 nt, Human
gaauguucccccccagacu

SEQ ID NO: 347260 - RNA, 19 nt, Human
gagggcagaggaugaggau

SEQ ID NO: 347261 - RNA, 22 nt, Human
gcaacaaaagaaaagaacugga

SEQ ID NO: 347262 - RNA, 18 nt, Human
gcauucuuggaaucagga

SEQ ID NO: 347263 - RNA, 18 nt, Human
ggaagguaucacacuccu

SEQ ID NO: 347264 - RNA, 24 nt, Human
ggcacaaagaucucuucaauuauc

SEQ ID NO: 347265 - RNA, 18 nt, Human
gggaaaagaucaagaaaa

SEQ ID NO: 347266 - RNA, 26 nt, Human
gggaagcccaaaaagacaaucacuga

SEQ ID NO: 347267 - RNA, 19 nt, Human
gggcaggggagagggagga

SEQ ID NO: 347268 - RNA, 18 nt, Human
ggggcaggaagauaggau

SEQ ID NO: 347269 - RNA, 19 nt, Human
guugcauuucugguuucca

SEQ ID NO: 347270 - RNA, 22 nt, Human
uaagacuagugcugaaaacugg

SEQ ID NO: 347271 - RNA, 23 nt, Human
uacagguaaaggcucuaccacca

SEQ ID NO: 347272 - RNA, 18 nt, Human
uacuguauuuuuauguug

SEQ ID NO: 347273 - RNA, 25 nt, Human
uagguuuuucuuaaaaaaaaaaaaa

SEQ ID NO: 347274 - RNA, 19 nt, Human
uaguacaaguaacgacguu

SEQ ID NO: 347275 - RNA, 30 nt, Human
uauguugcacgcacagacacguacacacag

SEQ ID NO: 347276 - RNA, 19 nt, Human
uauuucaccucuugagaau

SEQ ID NO: 347277 - RNA, 18 nt, Human
ucacugacuuccugggag

SEQ ID NO: 347278 - RNA, 21 nt, Human
ucagauggcauucuuggaauc

SEQ ID NO: 347279 - RNA, 19 nt, Human
ucaguccaucaauuuuugu

SEQ ID NO: 347280 - RNA, 21 nt, Human
ucccuggggauaguggcagag

SEQ ID NO: 347281 - RNA, 21 nt, Human
ucccuggggauaguggcagag

SEQ ID NO: 347282 - RNA, 19 nt, Human
uccuuuggaggggaagccc

SEQ ID NO: 347283 - RNA, 21 nt, Human
ucugaaggaucaugacuauga

SEQ ID NO: 347284 - RNA, 24 nt, Human
ucuuucaaguucgcugaauucuca

SEQ ID NO: 347285 - RNA, 18 nt, Human
ugaaggugaagaaaaaaa

SEQ ID NO: 347286 - RNA, 22 nt, Human
ugaauucucauauugaagguga

SEQ ID NO: 347287 - RNA, 24 nt, Human
ugacuaugagugagaaccugaagg

SEQ ID NO: 347288 - RNA, 28 nt, Human
ugagauaggaucacaaaaacucaauaac

SEQ ID NO: 347289 - RNA, 20 nt, Human
ugaggguuaaagggaaagga

SEQ ID NO: 347290 - RNA, 22 nt, Human
ugcaaaaaaaaaccaaggaagg

SEQ ID NO: 347291 - RNA, 23 nt, Human
ugcaaaaaaaaaccaaggaaggu

SEQ ID NO: 347292 - RNA, 19 nt, Human
ugccugcugacucccucuc

SEQ ID NO: 347293 - RNA, 18 nt, Human
uggaaugcaggcucaagc

SEQ ID NO: 347294 - RNA, 23 nt, Human
uggaaugcaggcucaagcugaca

SEQ ID NO: 347295 - RNA, 26 nt, Human
uggacagaaggacccagagguguucu

SEQ ID NO: 347296 - RNA, 23 nt, Human
ugggagaaaacaccaaauuaaaa

SEQ ID NO: 347297 - RNA, 24 nt, Human
ugggagaaaacaccaaauuaaaaa

SEQ ID NO: 347298 - RNA, 21 nt, Human
ugggagaagggugaaaagaga

SEQ ID NO: 347299 - RNA, 20 nt, Human
uggggcaggaagauaggauu

SEQ ID NO: 347300 - RNA, 19 nt, Human
uuaaaaaaaaagcuuggaa

SEQ ID NO: 347301 - RNA, 23 nt, Human
uuaaagggaaaggaugggagaaa

SEQ ID NO: 347302 - RNA, 23 nt, Human
uuaccuccaaucuuuccccuuuc

SEQ ID NO: 347303 - RNA, 20 nt, Human
uucucauauugaaggugaag

SEQ ID NO: 347304 - RNA, 19 nt, Human
uuuccccuuucaagcuaca

SEQ ID NO: 347305 - RNA, 18 nt, Human
uuugauucuuucuucuuc

SEQ ID NO: 347306 - RNA, 18 nt, Human
aauccauacauagcagcu

SEQ ID NO: 347307 - RNA, 20 nt, Human
acugcacugcaacgucaagg

SEQ ID NO: 347308 - RNA, 20 nt, Human
agaggggcugggccgacuga

SEQ ID NO: 347309 - RNA, 25 nt, Human
agauaggaaaaagauaugauuacgg

SEQ ID NO: 347310 - RNA, 20 nt, Human
aggacugagaggggcugggc

SEQ ID NO: 347311 - RNA, 21 nt, Human
cagauagauaggaaaaagaua

SEQ ID NO: 347312 - RNA, 20 nt, Human
ccucacaacagugcauggcu

SEQ ID NO: 347313 - RNA, 20 nt, Human
cgucucagagccgcgggcgg

SEQ ID NO: 347314 - RNA, 24 nt, Human
cuagcuccaccaucucugcaacuu

SEQ ID NO: 347315 - RNA, 19 nt, Human
gagccgcgggcgguugugg

SEQ ID NO: 347316 - RNA, 21 nt, Human
gcaacaaaguaaaauauacag

SEQ ID NO: 347317 - RNA, 22 nt, Human
gcagcugcugccgccgccgccg

SEQ ID NO: 347318 - RNA, 22 nt, Human
gcugccgccgccgccggggccg

SEQ ID NO: 347319 - RNA, 20 nt, Human
ggacugagaggggcugggcc

SEQ ID NO: 347320 - RNA, 21 nt, Human
ggguuggggaggacugagagg

SEQ ID NO: 347321 - RNA, 19 nt, Human
guucuucccugacccuccc

SEQ ID NO: 347322 - RNA, 21 nt, Human
uaaauccauacauagcagcuu

SEQ ID NO: 347323 - RNA, 18 nt, Human
uaagaugaugaacacaug

SEQ ID NO: 347324 - RNA, 22 nt, Human
uacagguuuuuuauuccaccag

SEQ ID NO: 347325 - RNA, 22 nt, Human
uagauaggaaaaagauaugauu

SEQ ID NO: 347326 - RNA, 24 nt, Human
ucccugacccucccccguauaauc

SEQ ID NO: 347327 - RNA, 25 nt, Human
ucucagagccgcgggcgguuguggg

SEQ ID NO: 347328 - RNA, 23 nt, Human
uggaggguggagaugaugcugca

SEQ ID NO: 347329 - RNA, 24 nt, Human
uguggggguuggggaggacugaga

SEQ ID NO: 347330 - RNA, 21 nt, Human
aagagcucuuuauuccacguc

SEQ ID NO: 347331 - RNA, 23 nt, Human
acacacaccuggcugcugagcac

SEQ ID NO: 347332 - RNA, 18 nt, Human
acccuguaaacaugaugg

SEQ ID NO: 347333 - RNA, 24 nt, Human
acgcugccgccgaacccuguaaac

SEQ ID NO: 347334 - RNA, 20 nt, Human
aucugggugggaggcggcgu

SEQ ID NO: 347335 - RNA, 21 nt, Human
caaguaaaauaaaaugcauau

SEQ ID NO: 347336 - RNA, 21 nt, Human
ccccguauguacacacaccug

SEQ ID NO: 347337 - RNA, 19 nt, Human
ccgcccggcuggcuuggcg

SEQ ID NO: 347338 - RNA, 21 nt, Human
cggcguucuggaacaaacgcu

SEQ ID NO: 347339 - RNA, 19 nt, Human
gcguucuggaacaaacgcu

SEQ ID NO: 347340 - RNA, 22 nt, Human
gcuggcuuggcggcguggagag

SEQ ID NO: 347341 - RNA, 18 nt, Human
ggagauggggguggcggg

SEQ ID NO: 347342 - RNA, 18 nt, Human
guaaaauaaaaugcauau

SEQ ID NO: 347343 - RNA, 24 nt, Human
guugggcggggcgcgucggggacu

SEQ ID NO: 347344 - RNA, 21 nt, Human
uggccuggccugccccacggg

SEQ ID NO: 347345 - RNA, 22 nt, Human
uggccuggccugccccacgggu

SEQ ID NO: 347346 - RNA, 18 nt, Human
ugggaggcggcguucugg

SEQ ID NO: 347347 - RNA, 18 nt, Human
uuacacaaguaaaauaaa

SEQ ID NO: 347348 - RNA, 24 nt, Human
uuuuuuuuuuuuaagaaaagagcu

SEQ ID NO: 347349 - RNA, 19 nt, Human
uuuuuuuuuuuuuuuuuaa

SEQ ID NO: 347350 - RNA, 18 nt, Human
agccaaucaggacccgca

SEQ ID NO: 347351 - RNA, 21 nt, Human
agcuugcaggacucggaguag

SEQ ID NO: 347352 - RNA, 24 nt, Human
agugucacauuauauucagcaaua

SEQ ID NO: 347353 - RNA, 24 nt, Human
caauugucuuccagugcaaauucu

SEQ ID NO: 347354 - RNA, 18 nt, Human
cacaugcaauaaaaguaa

SEQ ID NO: 347355 - RNA, 19 nt, Human
caccacaccagguucaccu

SEQ ID NO: 347356 - RNA, 19 nt, Human
caccugcuacgggcagaau

SEQ ID NO: 347357 - RNA, 21 nt, Human
ccgcacccagggcgcgggauc

SEQ ID NO: 347358 - RNA, 20 nt, Human
ccgccgccucagcucgcugc

SEQ ID NO: 347359 - RNA, 22 nt, Human
ccgccgccucagcucgcugcuu

SEQ ID NO: 347360 - RNA, 22 nt, Human
ccgccucagcucgcugcuucgg

SEQ ID NO: 347361 - RNA, 23 nt, Human
ccugcuacgggcagaaucaaggu

SEQ ID NO: 347362 - RNA, 22 nt, Human
cgaacgagaaacugacgaaucc

SEQ ID NO: 347363 - RNA, 20 nt, Human
cuccugaaacgaacgagaaa

SEQ ID NO: 347364 - RNA, 19 nt, Human
cugacgaauccacagguga

SEQ ID NO: 347365 - RNA, 24 nt, Human
cuggccgccgccucagcucgcugc

SEQ ID NO: 347366 - RNA, 20 nt, Human
cuuuacaaguggcaauuguc

SEQ ID NO: 347367 - RNA, 22 nt, Human
gcaauaaaaguaaguaauuauc

SEQ ID NO: 347368 - RNA, 24 nt, Human
uaggcuucuaauguuauaauucgu

SEQ ID NO: 347369 - RNA, 21 nt, Human
uauuuaauauuucuauaugac

SEQ ID NO: 347370 - RNA, 19 nt, Human
ucaccgcacccagggcgcg

SEQ ID NO: 347371 - RNA, 18 nt, Human
ucaccugcuacgggcaga

SEQ ID NO: 347372 - RNA, 27 nt, Human
ucagcaauaacuaugugcuuaucuuuc

SEQ ID NO: 347373 - RNA, 25 nt, Human
uccacaggugaaagagaaguaacgg

SEQ ID NO: 347374 - RNA, 22 nt, Human
ucccagcggccucaccgcaccc

SEQ ID NO: 347375 - RNA, 18 nt, Human
uccccgcuggccgccgcc

SEQ ID NO: 347376 - RNA, 18 nt, Human
ucgcugcuucgcgucggg

SEQ ID NO: 347377 - RNA, 21 nt, Human
ugaaacgaacgagaaacugac

SEQ ID NO: 347378 - RNA, 22 nt, Human
uuaaaacacaugcaauaaaagu

SEQ ID NO: 347379 - RNA, 24 nt, Human
uuccccgcuggccgccgccucagc

SEQ ID NO: 347380 - RNA, 24 nt, Human
aaaaaaaaagccagcgccgccuug

SEQ ID NO: 347381 - RNA, 21 nt, Human
aaaaaacaacuacccaaaagu

SEQ ID NO: 347382 - RNA, 22 nt, Human
aaaacaaaacaaaaaaaaacaa

SEQ ID NO: 347383 - RNA, 25 nt, Human
aaaacaaaacaaaacaaaaaaaaac

SEQ ID NO: 347384 - RNA, 23 nt, Human
aaaauaagaauuagaugccaaac

SEQ ID NO: 347385 - RNA, 20 nt, Human
aaaaugacccaaagcuguag

SEQ ID NO: 347386 - RNA, 26 nt, Human
aaacaaaaaaaaacaacuacccaaaa

SEQ ID NO: 347387 - RNA, 19 nt, Human
aaacaaaacaaaacaaaaa

SEQ ID NO: 347388 - RNA, 25 nt, Human
aaacaaaacaaaacaaaaaaaaaca

SEQ ID NO: 347389 - RNA, 21 nt, Human
aaacaacuacccaaaagucca

SEQ ID NO: 347390 - RNA, 22 nt, Human
aaacacacaaaaaucccaaaac

SEQ ID NO: 347391 - RNA, 18 nt, Human
aaacagggcgaguugcau

SEQ ID NO: 347392 - RNA, 23 nt, Human
aaauacucuucagaguugaccug

SEQ ID NO: 347393 - RNA, 21 nt, Human
aacaaaaauaaaaaucaucag

SEQ ID NO: 347394 - RNA, 20 nt, Human
aacaaacacacaaaaauccc

SEQ ID NO: 347395 - RNA, 22 nt, Human
aacaacuacccaaaaguccaaa

SEQ ID NO: 347396 - RNA, 19 nt, Human
aacccaaggcagcagaaag

SEQ ID NO: 347397 - RNA, 27 nt, Human
aagagaacacaggaaaaggaggaggga

SEQ ID NO: 347398 - RNA, 23 nt, Human
aaggaggagggagaaagugggga

SEQ ID NO: 347399 - RNA, 25 nt, Human
aaggaggagggagaaagugggguuu

SEQ ID NO: 347400 - RNA, 23 nt, Human
aauacaguaguuaaaaaugaccc

SEQ ID NO: 347401 - RNA, 22 nt, Human
acaaaaauaaaaaucaucagga

SEQ ID NO: 347402 - RNA, 25 nt, Human
acaaaacaaaaaaaaacaacuaccc

SEQ ID NO: 347403 - RNA, 20 nt, Human
acacaaaaaucccaaaacaa

SEQ ID NO: 347404 - RNA, 23 nt, Human
acacacacacacgcacacacaca

SEQ ID NO: 347405 - RNA, 23 nt, Human
acacacacgcacacacacacaca

SEQ ID NO: 347406 - RNA, 20 nt, Human
acaggagaaaggcugacaaa

SEQ ID NO: 347407 - RNA, 25 nt, Human
accccucuagcccuacaucucucuu

SEQ ID NO: 347408 - RNA, 21 nt, Human
acgcacacacacacacauaca

SEQ ID NO: 347409 - RNA, 20 nt, Human
acuacaguuugauuuuuuuu

SEQ ID NO: 347410 - RNA, 20 nt, Human
agaaaaagaaagaacugaag

SEQ ID NO: 347411 - RNA, 22 nt, Human
agacaccagcuugacaguuccc

SEQ ID NO: 347412 - RNA, 21 nt, Human
agacccuuguugagccuggca

SEQ ID NO: 347413 - RNA, 19 nt, Human
agacggcggcggcgugggc

SEQ ID NO: 347414 - RNA, 23 nt, Human
agacuucugacacugccaggcua

SEQ ID NO: 347415 - RNA, 23 nt, Human
agaggaagagagaaaaaaaggga

SEQ ID NO: 347416 - RNA, 21 nt, Human
agcaaaccuaagaaaaagucc

SEQ ID NO: 347417 - RNA, 21 nt, Human
agccgggccaggccuggcgcc

SEQ ID NO: 347418 - RNA, 20 nt, Human
aggcagaaaucugcaauccg

SEQ ID NO: 347419 - RNA, 22 nt, Human
aggcggcggcccgcguggccca

SEQ ID NO: 347420 - RNA, 19 nt, Human
agucugugaaacucuaaau

SEQ ID NO: 347421 - RNA, 19 nt, Human
auaaaacuuaaagaaaagg

SEQ ID NO: 347422 - RNA, 22 nt, Human
auaaacaaaguuagaaagaagc

SEQ ID NO: 347423 - RNA, 20 nt, Human
auagugagaaaaagaaagaa

SEQ ID NO: 347424 - RNA, 18 nt, Human
auccagaauaacacaaau

SEQ ID NO: 347425 - RNA, 22 nt, Human
caaaaaaaaacaacuacccaaa

SEQ ID NO: 347426 - RNA, 23 nt, Human
caaaaaaaaacaacuacccaaaa

SEQ ID NO: 347427 - RNA, 18 nt, Human
caaaaaucccaaaacaaa

SEQ ID NO: 347428 - RNA, 24 nt, Human
caaaacaaaaaaaaacaacuaccc

SEQ ID NO: 347429 - RNA, 20 nt, Human
caaaauuccacacucuuugg

SEQ ID NO: 347430 - RNA, 21 nt, Human
caaaauucccaacaaacacac

SEQ ID NO: 347431 - RNA, 23 nt, Human
caaacccaauaacugccacacaa

SEQ ID NO: 347432 - RNA, 22 nt, Human
caaauaaccaacaguucuuuuu

SEQ ID NO: 347433 - RNA, 21 nt, Human
caacaaacacacaaaaauccc

SEQ ID NO: 347434 - RNA, 26 nt, Human
caacaacugcauucugaccaaauccu

SEQ ID NO: 347435 - RNA, 23 nt, Human
caacccaaauuacaaauuuaacu

SEQ ID NO: 347436 - RNA, 18 nt, Human
caacuacccaaaagucca

SEQ ID NO: 347437 - RNA, 19 nt, Human
caagauacauaaauaucug

SEQ ID NO: 347438 - RNA, 21 nt, Human
caaggcagaaaucugcaaucc

SEQ ID NO: 347439 - RNA, 24 nt, Human
caauagugacaagcccccuccaca

SEQ ID NO: 347440 - RNA, 22 nt, Human
cacaaaaaucccaaaacaaaug

SEQ ID NO: 347441 - RNA, 24 nt, Human
cacacacacacacgcacacacaca

SEQ ID NO: 347442 - RNA, 18 nt, Human
caccacgcugcgaaaccc

SEQ ID NO: 347443 - RNA, 23 nt, Human
caccuuggagagaggguucuggg

SEQ ID NO: 347444 - RNA, 22 nt, Human
cacucuuuggaauaaacaacuu

SEQ ID NO: 347445 - RNA, 18 nt, Human
cagaaaucaaauccucuc

SEQ ID NO: 347446 - RNA, 23 nt, Human
cagaauaacacaaauaaccaaca

SEQ ID NO: 347447 - RNA, 19 nt, Human
cagacaugguaacaugugc

SEQ ID NO: 347448 - RNA, 18 nt, Human
cagcagacggcggcggcg

SEQ ID NO: 347449 - RNA, 24 nt, Human
cagcagcaguccagcugcccugcu

SEQ ID NO: 347450 - RNA, 20 nt, Human
cagccgggccaggccuggcg

SEQ ID NO: 347451 - RNA, 21 nt, Human
caucccuccucuccccccacc

SEQ ID NO: 347452 - RNA, 23 nt, Human
caucccuccucuccccccacccc

SEQ ID NO: 347453 - RNA, 18 nt, Human
caucucucuuucuucucc

SEQ ID NO: 347454 - RNA, 22 nt, Human
cauuaacaauauuuuauaauga

SEQ ID NO: 347455 - RNA, 19 nt, Human
ccaaauccuccaauaaaaa

SEQ ID NO: 347456 - RNA, 24 nt, Human
ccaacaaacacacaaaaaucccaa

SEQ ID NO: 347457 - RNA, 20 nt, Human
ccagaucauuuggagcacac

SEQ ID NO: 347458 - RNA, 19 nt, Human
ccagcgccgccuuggcugu

SEQ ID NO: 347459 - RNA, 22 nt, Human
cccaacaaacacacaaaaaucc

SEQ ID NO: 347460 - RNA, 20 nt, Human
ccccaaaaauaaaaaccaac

SEQ ID NO: 347461 - RNA, 23 nt, Human
cccccaaaaauaaaaaccaacaa

SEQ ID NO: 347462 - RNA, 21 nt, Human
ccccccaaaaauaaaaaccaa

SEQ ID NO: 347463 - RNA, 23 nt, Human
cccgcguggcccagccgggccag

SEQ ID NO: 347464 - RNA, 18 nt, Human
cccuacaucucucuuucu

SEQ ID NO: 347465 - RNA, 20 nt, Human
cccuaggugggggcuggcuu

SEQ ID NO: 347466 - RNA, 20 nt, Human
cccugggugcuggggccggc

SEQ ID NO: 347467 - RNA, 18 nt, Human
ccggcggacacccucgag

SEQ ID NO: 347468 - RNA, 22 nt, Human
ccuacaguauuuagcaaaccua

SEQ ID NO: 347469 - RNA, 26 nt, Human
ccuccucuccccccaccccaaccaaa

SEQ ID NO: 347470 - RNA, 18 nt, Human
ccucugggacuccccaag

SEQ ID NO: 347471 - RNA, 23 nt, Human
ccugaaaaugcacccucuucuga

SEQ ID NO: 347472 - RNA, 21 nt, Human
ccugcagccaaagauuugccu

SEQ ID NO: 347473 - RNA, 22 nt, Human
ccuuggagagaggguucuggga

SEQ ID NO: 347474 - RNA, 19 nt, Human
ccuuguugagccuggcaga

SEQ ID NO: 347475 - RNA, 22 nt, Human
cgcccggaggcgaaggcggcgg

SEQ ID NO: 347476 - RNA, 24 nt, Human
cggagcgaaaaccaagacagguca

SEQ ID NO: 347477 - RNA, 21 nt, Human
cggcggcgugggcuucugggc

SEQ ID NO: 347478 - RNA, 21 nt, Human
cgggcccagggcccgggaucc

SEQ ID NO: 347479 - RNA, 19 nt, Human
cgguaaacaaaaaggcauu

SEQ ID NO: 347480 - RNA, 20 nt, Human
cucaaugauuucuuuuaccu

SEQ ID NO: 347481 - RNA, 23 nt, Human
cuccaauaaaaauagugccauaa

SEQ ID NO: 347482 - RNA, 22 nt, Human
cugaaauuugguacuggguggg

SEQ ID NO: 347483 - RNA, 24 nt, Human
cugaacaucaagauacauaaauau

SEQ ID NO: 347484 - RNA, 24 nt, Human
cugcacagaaacccaaggcagcag

SEQ ID NO: 347485 - RNA, 22 nt, Human
cuggaacuagauugaccuucuc

SEQ ID NO: 347486 - RNA, 20 nt, Human
cuggcuaaaaacaaaauucc

SEQ ID NO: 347487 - RNA, 24 nt, Human
cuuauucaauacuucuccuggacc

SEQ ID NO: 347488 - RNA, 18 nt, Human
cuuuaugugaagggggaa

SEQ ID NO: 347489 - RNA, 19 nt, Human
gaacaggaggcccgcgcgc

SEQ ID NO: 347490 - RNA, 18 nt, Human
gacggcggcggcgugggc

SEQ ID NO: 347491 - RNA, 18 nt, Human
gagcagcacaggacaggg

SEQ ID NO: 347492 - RNA, 21 nt, Human
gaggaaggcucugguggcucc

SEQ ID NO: 347493 - RNA, 20 nt, Human
gaggcccgcgcgcccggagg

SEQ ID NO: 347494 - RNA, 22 nt, Human
gcagaaaauuccauacuucuga

SEQ ID NO: 347495 - RNA, 18 nt, Human
gccaggcuacccaacuug

SEQ ID NO: 347496 - RNA, 22 nt, Human
gcccaaagaaguuuucacacaa

SEQ ID NO: 347497 - RNA, 19 nt, Human
gcccggaggcgaaggcggc

SEQ ID NO: 347498 - RNA, 19 nt, Human
gccgccuuggcuguggguu

SEQ ID NO: 347499 - RNA, 21 nt, Human
gccucaacccucuggaacuag

SEQ ID NO: 347500 - RNA, 18 nt, Human
gcgaaggcggcggcccgc

SEQ ID NO: 347501 - RNA, 22 nt, Human
gcggcggcgugggcuucugggc

SEQ ID NO: 347502 - RNA, 18 nt, Human
gcuucugggcgcaggagg

SEQ ID NO: 347503 - RNA, 18 nt, Human
ggaagagagggagggaaa

SEQ ID NO: 347504 - RNA, 20 nt, Human
ggcccagccgggccaggccu

SEQ ID NO: 347505 - RNA, 22 nt, Human
ggcuguguucuguuacacagca

SEQ ID NO: 347506 - RNA, 19 nt, Human
gggcccgggaucccggcgg

SEQ ID NO: 347507 - RNA, 25 nt, Human
ggggaggcggcccacccgacugugu

SEQ ID NO: 347508 - RNA, 23 nt, Human
gggggcuggcuuaaauaggacca

SEQ ID NO: 347509 - RNA, 25 nt, Human
ggguagggucucagccuggugaaag

SEQ ID NO: 347510 - RNA, 18 nt, Human
gguucagacuucugacac

SEQ ID NO: 347511 - RNA, 18 nt, Human
gucuccacugaggcacac

SEQ ID NO: 347512 - RNA, 19 nt, Human
gucucgcacaggugggacc

SEQ ID NO: 347513 - RNA, 28 nt, Human
gugaaacucuaaaugaccaauccaguga

SEQ ID NO: 347514 - RNA, 18 nt, Human
guggcuccugaacagcag

SEQ ID NO: 347515 - RNA, 22 nt, Human
uaaaaacaaaauucccaacaaa

SEQ ID NO: 347516 - RNA, 21 nt, Human
uaaaaacaaauauucaaauug

SEQ ID NO: 347517 - RNA, 20 nt, Human
uaaaagacccaaacauguca

SEQ ID NO: 347518 - RNA, 18 nt, Human
uaaaagcccauauacccc

SEQ ID NO: 347519 - RNA, 20 nt, Human
uaagaaaacucaaaaacaag

SEQ ID NO: 347520 - RNA, 18 nt, Human
uaauuugggggaaauggg

SEQ ID NO: 347521 - RNA, 21 nt, Human
uacccaaaaguccaaaagaaa

SEQ ID NO: 347522 - RNA, 22 nt, Human
uauacgcuacgguaaacaaaaa

SEQ ID NO: 347523 - RNA, 21 nt, Human
uauaugaaacugaguugugga

SEQ ID NO: 347524 - RNA, 27 nt, Human
uaucuagaaacaccuuggagagagggu

SEQ ID NO: 347525 - RNA, 21 nt, Human
uaugugaagggggaagaacug

SEQ ID NO: 347526 - RNA, 20 nt, Human
uauuucaaggcagaaaucug

SEQ ID NO: 347527 - RNA, 23 nt, Human
ucaaaaaaacaaaacaaaacaaa

SEQ ID NO: 347528 - RNA, 21 nt, Human
ucaaauccucuccaaagaugu

SEQ ID NO: 347529 - RNA, 19 nt, Human
ucaguagauguguuauacc

SEQ ID NO: 347530 - RNA, 19 nt, Human
ucaucuggcugaagacacc

SEQ ID NO: 347531 - RNA, 24 nt, Human
ucauuccccccaaaaauaaaaacc

SEQ ID NO: 347532 - RNA, 20 nt, Human
ucauuuggagcacacaugug

SEQ ID NO: 347533 - RNA, 20 nt, Human
ucauuuggagcacacaugug

SEQ ID NO: 347534 - RNA, 22 nt, Human
uccagcuguuuuugcugccugc

SEQ ID NO: 347535 - RNA, 23 nt, Human
uccagcuguuuuugcugccugca

SEQ ID NO: 347536 - RNA, 18 nt, Human
uccauggucaaagcaaga

SEQ ID NO: 347537 - RNA, 18 nt, Human
ucccaaagaaacagguag

SEQ ID NO: 347538 - RNA, 18 nt, Human
uccccccaaaaauaaaaa

SEQ ID NO: 347539 - RNA, 23 nt, Human
uccucgaggccugcuucuggugg

SEQ ID NO: 347540 - RNA, 18 nt, Human
uccugaacagcagcaguc

SEQ ID NO: 347541 - RNA, 24 nt, Human
ucgaggccugcuucugguggcccu

SEQ ID NO: 347542 - RNA, 28 nt, Human
ucucaaaaaaacaaaacaaaacaaaaaa

SEQ ID NO: 347543 - RNA, 25 nt, Human
ucugaaauuugguacuggguggggg

SEQ ID NO: 347544 - RNA, 28 nt, Human
ucugcuggauaccucugggacuccccaa

SEQ ID NO: 347545 - RNA, 20 nt, Human
ucugggcgcaggaggcugcg

SEQ ID NO: 347546 - RNA, 21 nt, Human
ugaaaucauaaauagggacau

SEQ ID NO: 347547 - RNA, 18 nt, Human
ugaagucaaugaaugcaa

SEQ ID NO: 347548 - RNA, 24 nt, Human
ugacaaaccauguuccuuuaugug

SEQ ID NO: 347549 - RNA, 18 nt, Human
ugacaguuccccuuuaag

SEQ ID NO: 347550 - RNA, 24 nt, Human
ugaccuggcuaaaaacaaaauucc

SEQ ID NO: 347551 - RNA, 18 nt, Human
ugagaaaaagaaagaacu

SEQ ID NO: 347552 - RNA, 19 nt, Human
ugagcaaaucccugggcag

SEQ ID NO: 347553 - RNA, 23 nt, Human
ugaguaagcaguagaaauggcuu

SEQ ID NO: 347554 - RNA, 22 nt, Human
ugaguuggaauaucuucaguua

SEQ ID NO: 347555 - RNA, 18 nt, Human
ugauucguccugccugcu

SEQ ID NO: 347556 - RNA, 19 nt, Human
ugauucguccugccugcug

SEQ ID NO: 347557 - RNA, 23 nt, Human
ugauuugguuccuauguaaaugu

SEQ ID NO: 347558 - RNA, 20 nt, Human
ugcaacucuucuggaaggaa

SEQ ID NO: 347559 - RNA, 18 nt, Human
ugcagccaaagauuugcc

SEQ ID NO: 347560 - RNA, 22 nt, Human
ugcagugccugcucuccugugc

SEQ ID NO: 347561 - RNA, 27 nt, Human
ugcaucccuccucuccccccaccccaa

SEQ ID NO: 347562 - RNA, 19 nt, Human
ugcccaggaaguuugcugg

SEQ ID NO: 347563 - RNA, 24 nt, Human
ugcuggggccggcggacacccucg

SEQ ID NO: 347564 - RNA, 18 nt, Human
uggaauaucuucaguuaa

SEQ ID NO: 347565 - RNA, 19 nt, Human
uggccgucgggcgcccucg

SEQ ID NO: 347566 - RNA, 21 nt, Human
uggcuaaaaacaaaauuccca

SEQ ID NO: 347567 - RNA, 22 nt, Human
uggcuaaaaacaaaauucccaa

SEQ ID NO: 347568 - RNA, 21 nt, Human
uggcuguggguuggugaugcu

SEQ ID NO: 347569 - RNA, 21 nt, Human
ugggauauucucucaugucau

SEQ ID NO: 347570 - RNA, 19 nt, Human
ugggguuuggaagauagag

SEQ ID NO: 347571 - RNA, 24 nt, Human
uggucaaagcaagaaagaagcaag

SEQ ID NO: 347572 - RNA, 18 nt, Human
ugguggcuccugaacagc

SEQ ID NO: 347573 - RNA, 21 nt, Human
ugucaaacaaauuuucaugua

SEQ ID NO: 347574 - RNA, 19 nt, Human
ugugguacaaagagaggaa

SEQ ID NO: 347575 - RNA, 18 nt, Human
uguucugaaguccugcuu

SEQ ID NO: 347576 - RNA, 26 nt, Human
uuaagagaacacaggaaaaggaggag

SEQ ID NO: 347577 - RNA, 20 nt, Human
uucaaggcagaaaucugcaa

SEQ ID NO: 347578 - RNA, 19 nt, Human
uucaauacuucuccuggac

SEQ ID NO: 347579 - RNA, 20 nt, Human
uucacacacacacacacaca

SEQ ID NO: 347580 - RNA, 21 nt, Human
uucacacacacacacacacac

SEQ ID NO: 347581 - RNA, 19 nt, Human
uuccauggucaaagcaaga

SEQ ID NO: 347582 - RNA, 18 nt, Human
uuccugucacacuggugc

SEQ ID NO: 347583 - RNA, 21 nt, Human
uucucucaugucaucuggcug

SEQ ID NO: 347584 - RNA, 18 nt, Human
uugcaucccuccucuccc

SEQ ID NO: 347585 - RNA, 19 nt, Human
uuggcacccgccucaaccc

SEQ ID NO: 347586 - RNA, 20 nt, Human
uugguuccuauguaaaugug

SEQ ID NO: 347587 - RNA, 24 nt, Human
uuucucaaaaaaacaaaacaaaac

SEQ ID NO: 347588 - RNA, 19 nt, Human
uuuuucuuuuuuugcacca

SEQ ID NO: 347589 - RNA, 23 nt, Human
aaaaacaaacaccaagcaaacga

SEQ ID NO: 347590 - RNA, 19 nt, Human
aaacagguuacagacaggu

SEQ ID NO: 347591 - RNA, 23 nt, Human
aaacgauagugcaaagcaguuuc

SEQ ID NO: 347592 - RNA, 19 nt, Human
aaagugcugggcacuggga

SEQ ID NO: 347593 - RNA, 22 nt, Human
aagagaccuuguguuugaaaac

SEQ ID NO: 347594 - RNA, 24 nt, Human
aaggugccucccacgcugaccugg

SEQ ID NO: 347595 - RNA, 18 nt, Human
acaaacaccaagcaaacg

SEQ ID NO: 347596 - RNA, 22 nt, Human
acagaagacaguuuacuguaca

SEQ ID NO: 347597 - RNA, 19 nt, Human
acagcuuggcuggacccag

SEQ ID NO: 347598 - RNA, 24 nt, Human
acagugcucucacagagacaacca

SEQ ID NO: 347599 - RNA, 20 nt, Human
acagugcuucuguccugcca

SEQ ID NO: 347600 - RNA, 20 nt, Human
accaccuaggggaaagggga

SEQ ID NO: 347601 - RNA, 20 nt, Human
accagaaggacugccuaacc

SEQ ID NO: 347602 - RNA, 18 nt, Human
accagcuauaaccagaga

SEQ ID NO: 347603 - RNA, 21 nt, Human
acccagcuccauccucucgcc

SEQ ID NO: 347604 - RNA, 22 nt, Human
acccuaauaaccccacacccuc

SEQ ID NO: 347605 - RNA, 24 nt, Human
agaugcagccagaggcucccacca

SEQ ID NO: 347606 - RNA, 18 nt, Human
agcauuuuguagggcaga

SEQ ID NO: 347607 - RNA, 24 nt, Human
agccuguggugcaggcugguggga

SEQ ID NO: 347608 - RNA, 21 nt, Human
agcgcccacuuucccauuuug

SEQ ID NO: 347609 - RNA, 19 nt, Human
agcuggggguccgcggggg

SEQ ID NO: 347610 - RNA, 22 nt, Human
aggggaugggggaugggguagg

SEQ ID NO: 347611 - RNA, 18 nt, Human
aggugcaggggucgggag

SEQ ID NO: 347612 - RNA, 19 nt, Human
aguaacacuauaucaaaac

SEQ ID NO: 347613 - RNA, 22 nt, Human
agugaggacaggccaagagaaa

SEQ ID NO: 347614 - RNA, 19 nt, Human
auccugcccaccuccgccc

SEQ ID NO: 347615 - RNA, 18 nt, Human
caaaacgucuuccuuucc

SEQ ID NO: 347616 - RNA, 21 nt, Human
caaaaugaucccucaccucaa

SEQ ID NO: 347617 - RNA, 18 nt, Human
caagagaaaccgcagcag

SEQ ID NO: 347618 - RNA, 18 nt, Human
caagauuuggcuggaucc

SEQ ID NO: 347619 - RNA, 25 nt, Human
caccagcugggaccacccugggacc

SEQ ID NO: 347620 - RNA, 18 nt, Human
cagcagcgugcugggucc

SEQ ID NO: 347621 - RNA, 19 nt, Human
cagccagaggcucccacca

SEQ ID NO: 347622 - RNA, 22 nt, Human
cagccaguacuccccaccucuc

SEQ ID NO: 347623 - RNA, 19 nt, Human
caggagacaugggucccau

SEQ ID NO: 347624 - RNA, 18 nt, Human
cauccugcccaccuccgc

SEQ ID NO: 347625 - RNA, 19 nt, Human
cauccugcccaccuccgcc

SEQ ID NO: 347626 - RNA, 23 nt, Human
ccaagcaaacgauagugcaaagc

SEQ ID NO: 347627 - RNA, 23 nt, Human
ccagcagcgugcuggguccugcc

SEQ ID NO: 347628 - RNA, 23 nt, Human
ccaggagucgcaagauuuggcug

SEQ ID NO: 347629 - RNA, 24 nt, Human
ccaggagucgcaagauuuggcugg

SEQ ID NO: 347630 - RNA, 20 nt, Human
ccaggcugucuguacccacu

SEQ ID NO: 347631 - RNA, 22 nt, Human
ccaguacuccccaccucucaca

SEQ ID NO: 347632 - RNA, 23 nt, Human
cccaaaggugccucccacgcuga

SEQ ID NO: 347633 - RNA, 24 nt, Human
cccaccuccgcccagccuccugga

SEQ ID NO: 347634 - RNA, 18 nt, Human
cccacgcugaccugggac

SEQ ID NO: 347635 - RNA, 21 nt, Human
ccccaccucucacauccugcc

SEQ ID NO: 347636 - RNA, 23 nt, Human
ccccccucccccgcccugccaag

SEQ ID NO: 347637 - RNA, 24 nt, Human
cccugggaccgagaccacccugga

SEQ ID NO: 347638 - RNA, 23 nt, Human
ccuaauaaccccacacccucagg

SEQ ID NO: 347639 - RNA, 24 nt, Human
ccuauccccccucccccgcccugc

SEQ ID NO: 347640 - RNA, 19 nt, Human
ccuaucuaucuggcccucc

SEQ ID NO: 347641 - RNA, 19 nt, Human
ccucccaggaggcuugggg

SEQ ID NO: 347642 - RNA, 19 nt, Human
ccuccuauccccccucccc

SEQ ID NO: 347643 - RNA, 20 nt, Human
ccuccuguucucuccacaaa

SEQ ID NO: 347644 - RNA, 20 nt, Human
ccugcccaccuccgcccagc

SEQ ID NO: 347645 - RNA, 23 nt, Human
ccuggcccuuggcaagcgcccac

SEQ ID NO: 347646 - RNA, 19 nt, Human
ccugggaccgagaccaccc

SEQ ID NO: 347647 - RNA, 25 nt, Human
ccugggaccgagaccacccuggagc

SEQ ID NO: 347648 - RNA, 20 nt, Human
ccugugggccaaugcugccu

SEQ ID NO: 347649 - RNA, 19 nt, Human
cgcccagccuccuggacag

SEQ ID NO: 347650 - RNA, 22 nt, Human
cggagccggcccaucacugguc

SEQ ID NO: 347651 - RNA, 21 nt, Human
cuacaaggacaauggauucau

SEQ ID NO: 347652 - RNA, 21 nt, Human
cucaaaccaucucugccagca

SEQ ID NO: 347653 - RNA, 18 nt, Human
cucaucagcguuucccuc

SEQ ID NO: 347654 - RNA, 25 nt, Human
cugacccaaaaugaucccucaccuc

SEQ ID NO: 347655 - RNA, 23 nt, Human
cugaggcuuauccugugacgucc

SEQ ID NO: 347656 - RNA, 24 nt, Human
cugcauccacagaggccgaggcag

SEQ ID NO: 347657 - RNA, 23 nt, Human
cugggaccagcuauaaccagaga

SEQ ID NO: 347658 - RNA, 22 nt, Human
cugggcacugggaacccaaagg

SEQ ID NO: 347659 - RNA, 25 nt, Human
cugggccgggggcaguaucccgggc

SEQ ID NO: 347660 - RNA, 21 nt, Human
cuggucuugaagguuguuagg

SEQ ID NO: 347661 - RNA, 21 nt, Human
gaccugggaccagcuauaacc

SEQ ID NO: 347662 - RNA, 24 nt, Human
gaggcagcuggggguccgcggggg

SEQ ID NO: 347663 - RNA, 23 nt, Human
gcagcaggagggaauggaauagg

SEQ ID NO: 347664 - RNA, 19 nt, Human
gcagccuuguaaauaagga

SEQ ID NO: 347665 - RNA, 22 nt, Human
gcagcuggggguccgcgggggg

SEQ ID NO: 347666 - RNA, 22 nt, Human
gcaggaggcugauuccccacag

SEQ ID NO: 347667 - RNA, 22 nt, Human
gcaggggucgggagguuuccca

SEQ ID NO: 347668 - RNA, 19 nt, Human
gccacgcacagccaguacu

SEQ ID NO: 347669 - RNA, 20 nt, Human
gcccuuggcaagcgcccacu

SEQ ID NO: 347670 - RNA, 18 nt, Human
gccucucucuggaagaga

SEQ ID NO: 347671 - RNA, 20 nt, Human
gcuggggggacuggcuugga

SEQ ID NO: 347672 - RNA, 24 nt, Human
ggaggggaagcugggcugggggga

SEQ ID NO: 347673 - RNA, 21 nt, Human
ggagguuucccagggccugag

SEQ ID NO: 347674 - RNA, 18 nt, Human
ggagucagcaacuauuuu

SEQ ID NO: 347675 - RNA, 19 nt, Human
ggaugcugccugaugggga

SEQ ID NO: 347676 - RNA, 19 nt, Human
ggcaagcgcccacuuuccc

SEQ ID NO: 347677 - RNA, 22 nt, Human
ggcagcuggggguccgcggggg

SEQ ID NO: 347678 - RNA, 19 nt, Human
ggccguugugacagguugg

SEQ ID NO: 347679 - RNA, 21 nt, Human
ggcuggggggacuggcuugga

SEQ ID NO: 347680 - RNA, 24 nt, Human
ggcuugggggauggggcacagcuu

SEQ ID NO: 347681 - RNA, 20 nt, Human
gggaagcugggcugggggga

SEQ ID NO: 347682 - RNA, 22 nt, Human
gggaugcugccugauggggagu

SEQ ID NO: 347683 - RNA, 24 nt, Human
ggggagccuguggugcaggcuggu

SEQ ID NO: 347684 - RNA, 23 nt, Human
ggggguccgcgggggggagaggg

SEQ ID NO: 347685 - RNA, 22 nt, Human
ggggucgggagguuucccaggg

SEQ ID NO: 347686 - RNA, 19 nt, Human
ggucccaugcagcacuggg

SEQ ID NO: 347687 - RNA, 22 nt, Human
gguggugggggugggggacacu

SEQ ID NO: 347688 - RNA, 18 nt, Human
guggugcaggcugguggg

SEQ ID NO: 347689 - RNA, 19 nt, Human
guggugggggugggggaca

SEQ ID NO: 347690 - RNA, 19 nt, Human
guguagccccuugagaaag

SEQ ID NO: 347691 - RNA, 20 nt, Human
uaaaauaccgcaugcugcua

SEQ ID NO: 347692 - RNA, 21 nt, Human
uaaauaaggaccuacuuuuac

SEQ ID NO: 347693 - RNA, 19 nt, Human
uaaaugcagagggggcugg

SEQ ID NO: 347694 - RNA, 24 nt, Human
uacaagcaaguugugcguuaaaaa

SEQ ID NO: 347695 - RNA, 21 nt, Human
uacccacuuugggccuuacag

SEQ ID NO: 347696 - RNA, 18 nt, Human
uaccgcaugcugcuagcc

SEQ ID NO: 347697 - RNA, 19 nt, Human
uaggguccccgccuccagg

SEQ ID NO: 347698 - RNA, 23 nt, Human
ucagcaugacaauaugucacaaa

SEQ ID NO: 347699 - RNA, 22 nt, Human
uccacaaauggaauuaugagac

SEQ ID NO: 347700 - RNA, 23 nt, Human
uccacaaauggaauuaugagacc

SEQ ID NO: 347701 - RNA, 18 nt, Human
ucccagggccugaggcuu

SEQ ID NO: 347702 - RNA, 21 nt, Human
ucccauuuugcaaaauucagg

SEQ ID NO: 347703 - RNA, 20 nt, Human
uccugccacgcacagccagg

SEQ ID NO: 347704 - RNA, 21 nt, Human
ucucugggccugggaccgugc

SEQ ID NO: 347705 - RNA, 18 nt, Human
ucugcuaggaccuaucua

SEQ ID NO: 347706 - RNA, 22 nt, Human
ucuguaggugcuuuccugguuu

SEQ ID NO: 347707 - RNA, 25 nt, Human
ugacaauaugucacaaaagauuggu

SEQ ID NO: 347708 - RNA, 18 nt, Human
ugacagguugggugggga

SEQ ID NO: 347709 - RNA, 22 nt, Human
ugagcugcgcuggagagcccuu

SEQ ID NO: 347710 - RNA, 23 nt, Human
ugagcugcgcuggagagcccuuu

SEQ ID NO: 347711 - RNA, 24 nt, Human
ugagugcagcaggugucacaccuc

SEQ ID NO: 347712 - RNA, 20 nt, Human
ugccauagacucaucuucuc

SEQ ID NO: 347713 - RNA, 20 nt, Human
ugccgucacuuuuugucagg

SEQ ID NO: 347714 - RNA, 19 nt, Human
ugcguuaaaaacaaacacc

SEQ ID NO: 347715 - RNA, 19 nt, Human
ugcugccucucucuggaag

SEQ ID NO: 347716 - RNA, 18 nt, Human
uggaagagagauggccuc

SEQ ID NO: 347717 - RNA, 21 nt, Human
uggaauaggaucaccagaagg

SEQ ID NO: 347718 - RNA, 24 nt, Human
uggcaggaggcugauuccccacag

SEQ ID NO: 347719 - RNA, 21 nt, Human
ugggaugcugccugaugggga

SEQ ID NO: 347720 - RNA, 20 nt, Human
ugggcuggggggacuggcuu

SEQ ID NO: 347721 - RNA, 19 nt, Human
ugggggauggggcacagcu

SEQ ID NO: 347722 - RNA, 22 nt, Human
ugggggauggggcacagcuugg

SEQ ID NO: 347723 - RNA, 24 nt, Human
uggggggacuggcuuggauguguu

SEQ ID NO: 347724 - RNA, 23 nt, Human
uguuaggguccccgccccggggg

SEQ ID NO: 347725 - RNA, 22 nt, Human
uuacuguacaagcaaguugugc

SEQ ID NO: 347726 - RNA, 22 nt, Human
uucuagggccagagaacucuga

SEQ ID NO: 347727 - RNA, 18 nt, Human
uuggcuggacccaggggg

SEQ ID NO: 347728 - RNA, 19 nt, Human
uuggcuggacccagggggg

SEQ ID NO: 347729 - RNA, 21 nt, Human
uuuccaguucugacucaaauc

SEQ ID NO: 347730 - RNA, 25 nt, Human
uuucccauuuugcaaaauucagggg

SEQ ID NO: 347731 - RNA, 23 nt, Human
uuuuuguuuuuuuguuuuuuuuu

SEQ ID NO: 347732 - RNA, 27 nt, Human
uuuuuuuuguuuuuuuguuuuuuuuuu

SEQ ID NO: 347733 - RNA, 23 nt, Human
uuuuuuuuuuuuuuuugcucagg

SEQ ID NO: 347734 - RNA, 18 nt, Human
uuuuuuuuuuuuuuuuug

SEQ ID NO: 347735 - RNA, 23 nt, Human
aacaggguggggucgggggauga

SEQ ID NO: 347736 - RNA, 21 nt, Human
acagagucacagugucagaac

SEQ ID NO: 347737 - RNA, 20 nt, Human
acucugguggaaaacagggu

SEQ ID NO: 347738 - RNA, 31 nt, Human
cugguggaaaacaggguggggucgggggaga

SEQ ID NO: 347739 - RNA, 23 nt, Human
ggaaaacaggguggggucggggg

SEQ ID NO: 347740 - RNA, 24 nt, Human
uggaaaacaggguggggucggggg

SEQ ID NO: 347741 - RNA, 18 nt, Human
uggggucgggggaugaca

SEQ ID NO: 347742 - RNA, 23 nt, Human
uggggucgggggaugacauccaa

SEQ ID NO: 347743 - RNA, 18 nt, Human
aaaauaaacacaaaacac

SEQ ID NO: 347744 - RNA, 23 nt, Human
aaacagucccagcccuccccccg

SEQ ID NO: 347745 - RNA, 19 nt, Human
aaaccaacagcacuguaca

SEQ ID NO: 347746 - RNA, 22 nt, Human
aaacgaaacagucccagcccuc

SEQ ID NO: 347747 - RNA, 22 nt, Human
aaaggggcuaccuucccccuca

SEQ ID NO: 347748 - RNA, 25 nt, Human
aaccaacagcacuguacaacuacaa

SEQ ID NO: 347749 - RNA, 21 nt, Human
aaccuguaggcagcuccccuc

SEQ ID NO: 347750 - RNA, 23 nt, Human
aacgaaacagucccagcccuccc

SEQ ID NO: 347751 - RNA, 23 nt, Human
aacggaaacaaaagccccguucc

SEQ ID NO: 347752 - RNA, 21 nt, Human
aacgggugggcacaaaggaug

SEQ ID NO: 347753 - RNA, 23 nt, Human
aagaagcagccgaccccccgcaa

SEQ ID NO: 347754 - RNA, 22 nt, Human
aagcagaaacgaaacaguccca

SEQ ID NO: 347755 - RNA, 23 nt, Human
acacaacagagcaaggcuuuaaa

SEQ ID NO: 347756 - RNA, 18 nt, Human
acaccacacaccugcgug

SEQ ID NO: 347757 - RNA, 21 nt, Human
acaccacacaccugcguggac

SEQ ID NO: 347758 - RNA, 23 nt, Human
acaccagccgacuacccacaggc

SEQ ID NO: 347759 - RNA, 23 nt, Human
acagagggcagcucauguucuca

SEQ ID NO: 347760 - RNA, 25 nt, Human
acagcaacggaaacaaaagccccgu

SEQ ID NO: 347761 - RNA, 20 nt, Human
acagggacaccagccgacuu

SEQ ID NO: 347762 - RNA, 21 nt, Human
acagggcagcuugcuugcccc

SEQ ID NO: 347763 - RNA, 22 nt, Human
acauacauguuuacaccacaca

SEQ ID NO: 347764 - RNA, 24 nt, Human
accagaucacgcaccccagcucca

SEQ ID NO: 347765 - RNA, 19 nt, Human
accagcaucgauaaacagc

SEQ ID NO: 347766 - RNA, 23 nt, Human
acccccuccgguaucccccccau

SEQ ID NO: 347767 - RNA, 23 nt, Human
accccgcagagcaaggagaagac

SEQ ID NO: 347768 - RNA, 24 nt, Human
agaaacgaaacagucccagcccuc

SEQ ID NO: 347769 - RNA, 22 nt, Human
agaagccacuucacagucaguc

SEQ ID NO: 347770 - RNA, 18 nt, Human
agagcacagggcagcuug

SEQ ID NO: 347771 - RNA, 25 nt, Human
agcacugccaccaggccgccagccc

SEQ ID NO: 347772 - RNA, 20 nt, Human
agcaggcguucagugaggcu

SEQ ID NO: 347773 - RNA, 20 nt, Human
agccagcgccggaaacgaca

SEQ ID NO: 347774 - RNA, 18 nt, Human
agccccgcccccacccca

SEQ ID NO: 347775 - RNA, 28 nt, Human
agccucgccgccgucacaggagcccucu

SEQ ID NO: 347776 - RNA, 18 nt, Human
aggaagccccugcuccag

SEQ ID NO: 347777 - RNA, 22 nt, Human
aggcaccagguguuggcguugg

SEQ ID NO: 347778 - RNA, 21 nt, Human
aggcagagaagggcagggaca

SEQ ID NO: 347779 - RNA, 27 nt, Human
aggcagagaagggcagggacagggcuc

SEQ ID NO: 347780 - RNA, 19 nt, Human
aggcagagagaaaacaggg

SEQ ID NO: 347781 - RNA, 22 nt, Human
aggcagagagaaaacagggggg

SEQ ID NO: 347782 - RNA, 27 nt, Human
aggcagcuccccucaccacugaggaag

SEQ ID NO: 347783 - RNA, 23 nt, Human
aggcagggguggagggcggcggg

SEQ ID NO: 347784 - RNA, 22 nt, Human
aggcaggguggccagaacgggu

SEQ ID NO: 347785 - RNA, 23 nt, Human
aggccgaugagaaagggacggga

SEQ ID NO: 347786 - RNA, 21 nt, Human
aggcugcugccucaggaaagc

SEQ ID NO: 347787 - RNA, 21 nt, Human
aggcuggggaggggccggggc

SEQ ID NO: 347788 - RNA, 21 nt, Human
agggaaaccaacaggccaccc

SEQ ID NO: 347789 - RNA, 24 nt, Human
agggaagaaaacccuugaaagccu

SEQ ID NO: 347790 - RNA, 18 nt, Human
agggguggagggcggcgg

SEQ ID NO: 347791 - RNA, 18 nt, Human
agggguuggcggccgggg

SEQ ID NO: 347792 - RNA, 22 nt, Human
agugagguggugaugccccacc

SEQ ID NO: 347793 - RNA, 20 nt, Human
auaaggagggugacaacaca

SEQ ID NO: 347794 - RNA, 23 nt, Human
caacacaucucuuaggcagagca

SEQ ID NO: 347795 - RNA, 23 nt, Human
caacagcacuguacaacuacaag

SEQ ID NO: 347796 - RNA, 21 nt, Human
caacaggacacaacagagcaa

SEQ ID NO: 347797 - RNA, 19 nt, Human
caacggaaacaaaagcccc

SEQ ID NO: 347798 - RNA, 22 nt, Human
caacuccugcagcuccagggcu

SEQ ID NO: 347799 - RNA, 19 nt, Human
caaggcagagagaaaacag

SEQ ID NO: 347800 - RNA, 25 nt, Human
caaggcagagagaaaacaggggggu

SEQ ID NO: 347801 - RNA, 19 nt, Human
caauaccaggcuggguggu

SEQ ID NO: 347802 - RNA, 26 nt, Human
cacauacauguuuacaccacacaccu

SEQ ID NO: 347803 - RNA, 20 nt, Human
caccaaggcagagagaaaac

SEQ ID NO: 347804 - RNA, 19 nt, Human
caccccagcuccacgacag

SEQ ID NO: 347805 - RNA, 19 nt, Human
cacccccccgcaucauucc

SEQ ID NO: 347806 - RNA, 23 nt, Human
cacccuccugccauuuccaccac

SEQ ID NO: 347807 - RNA, 22 nt, Human
cacccuccugccccgagggaag

SEQ ID NO: 347808 - RNA, 23 nt, Human
cacccucuguucaggcaccugcc

SEQ ID NO: 347809 - RNA, 22 nt, Human
cacgcaccccagcuccacgaca

SEQ ID NO: 347810 - RNA, 19 nt, Human
cagaacaccaaggcagaga

SEQ ID NO: 347811 - RNA, 19 nt, Human
cagaauucuugggaaacac

SEQ ID NO: 347812 - RNA, 21 nt, Human
cagagggcagcucauguucuc

SEQ ID NO: 347813 - RNA, 19 nt, Human
cagcaaggccagugagguc

SEQ ID NO: 347814 - RNA, 19 nt, Human
cagcaucgauaaacagcaa

SEQ ID NO: 347815 - RNA, 22 nt, Human
cagcccuccccccgccauaucc

SEQ ID NO: 347816 - RNA, 18 nt, Human
cagcgccggaaacgacaa

SEQ ID NO: 347817 - RNA, 19 nt, Human
cagcgccggaaacgacaaa

SEQ ID NO: 347818 - RNA, 20 nt, Human
cagcgggcggcgggcgcggc

SEQ ID NO: 347819 - RNA, 24 nt, Human
cagcuggccggggaccugguacag

SEQ ID NO: 347820 - RNA, 22 nt, Human
caggccaaagggagggccuucc

SEQ ID NO: 347821 - RNA, 22 nt, Human
caggccccaggguggaaggucc

SEQ ID NO: 347822 - RNA, 20 nt, Human
caggcccgagggcgcugcga

SEQ ID NO: 347823 - RNA, 24 nt, Human
cagggccagcccugcaggaaacaa

SEQ ID NO: 347824 - RNA, 23 nt, Human
cagggggccaccucuagggaucc

SEQ ID NO: 347825 - RNA, 19 nt, Human
cagggguggagggcggcgg

SEQ ID NO: 347826 - RNA, 20 nt, Human
cagggguuggcggccggggg

SEQ ID NO: 347827 - RNA, 21 nt, Human
cagugaugagccgcacucccc

SEQ ID NO: 347828 - RNA, 18 nt, Human
ccaagaguaccugcaccc

SEQ ID NO: 347829 - RNA, 19 nt, Human
ccagcaucgauaaacagca

SEQ ID NO: 347830 - RNA, 20 nt, Human
ccagccagcgccggaaacga

SEQ ID NO: 347831 - RNA, 18 nt, Human
ccagggaggccagguucu

SEQ ID NO: 347832 - RNA, 21 nt, Human
ccagggccagcccugcaggaa

SEQ ID NO: 347833 - RNA, 19 nt, Human
ccauccccgcgggccucac

SEQ ID NO: 347834 - RNA, 22 nt, Human
cccaagaagcagccgacccccc

SEQ ID NO: 347835 - RNA, 20 nt, Human
cccacgaguccccucucauc

SEQ ID NO: 347836 - RNA, 26 nt, Human
cccagcccuccccccgccauauccaa

SEQ ID NO: 347837 - RNA, 22 nt, Human
ccccaaaguccaaacaggccag

SEQ ID NO: 347838 - RNA, 18 nt, Human
ccccaagccccgccccca

SEQ ID NO: 347839 - RNA, 22 nt, Human
ccccaccccaccuucaaccaga

SEQ ID NO: 347840 - RNA, 20 nt, Human
cccccaccccaccuucaacc

SEQ ID NO: 347841 - RNA, 23 nt, Human
cccccaccccaccuucaaccaga

SEQ ID NO: 347842 - RNA, 21 nt, Human
cccccauccacccucuguuca

SEQ ID NO: 347843 - RNA, 19 nt, Human
cccccccauccacccucug

SEQ ID NO: 347844 - RNA, 21 nt, Human
ccccccgcaucauuccuagac

SEQ ID NO: 347845 - RNA, 22 nt, Human
ccccuccugauuagggggaagc

SEQ ID NO: 347846 - RNA, 20 nt, Human
ccccucucucuccaggccac

SEQ ID NO: 347847 - RNA, 23 nt, Human
cccgcaccaccggagcccggggg

SEQ ID NO: 347848 - RNA, 22 nt, Human
cccgcccccaccccaccuucaa

SEQ ID NO: 347849 - RNA, 19 nt, Human
cccgccccugcagccugga

SEQ ID NO: 347850 - RNA, 19 nt, Human
cccugcccgagccagggcc

SEQ ID NO: 347851 - RNA, 22 nt, Human
cccuggguccccaggaagcagc

SEQ ID NO: 347852 - RNA, 18 nt, Human
cccugugccuccagcaag

SEQ ID NO: 347853 - RNA, 20 nt, Human
cccuugaaagccucaggccc

SEQ ID NO: 347854 - RNA, 19 nt, Human
ccgaaaccuugcacagagg

SEQ ID NO: 347855 - RNA, 18 nt, Human
ccgcuccgccuuuccugg

SEQ ID NO: 347856 - RNA, 21 nt, Human
ccgcuccgccuuuccugggug

SEQ ID NO: 347857 - RNA, 23 nt, Human
ccggaaacgacaaaguucccaag

SEQ ID NO: 347858 - RNA, 21 nt, Human
ccgggacacguagagcggugg

SEQ ID NO: 347859 - RNA, 19 nt, Human
ccucacagauggcugcagg

SEQ ID NO: 347860 - RNA, 23 nt, Human
ccucagcccaccccgcagagcaa

SEQ ID NO: 347861 - RNA, 18 nt, Human
ccuccugccauuuccacc

SEQ ID NO: 347862 - RNA, 22 nt, Human
ccuccugccauuuccaccacac

SEQ ID NO: 347863 - RNA, 21 nt, Human
ccucucacacuucucccuuug

SEQ ID NO: 347864 - RNA, 21 nt, Human
ccucugagggaaaccaacagg

SEQ ID NO: 347865 - RNA, 20 nt, Human
ccugaaggugccggggugcc

SEQ ID NO: 347866 - RNA, 24 nt, Human
ccugccauuuccaccacacccgcc

SEQ ID NO: 347867 - RNA, 21 nt, Human
cgacaaaguucccaagaagca

SEQ ID NO: 347868 - RNA, 24 nt, Human
cgacagggacaccagccgacuacc

SEQ ID NO: 347869 - RNA, 21 nt, Human
cgacgcagccuaggggagccc

SEQ ID NO: 347870 - RNA, 22 nt, Human
cgcgggcauucccaaggguccg

SEQ ID NO: 347871 - RNA, 21 nt, Human
cggaaacaaaagccccguucc

SEQ ID NO: 347872 - RNA, 20 nt, Human
cggcgguuuccucccaagcc

SEQ ID NO: 347873 - RNA, 19 nt, Human
cggggacaggcacaggugg

SEQ ID NO: 347874 - RNA, 21 nt, Human
cguggacaauaccaggcuggg

SEQ ID NO: 347875 - RNA, 18 nt, Human
cucagagcacagggcagc

SEQ ID NO: 347876 - RNA, 23 nt, Human
cuccagcaaggccagugaggugg

SEQ ID NO: 347877 - RNA, 24 nt, Human
cuccagcacugccaccaggccgcc

SEQ ID NO: 347878 - RNA, 20 nt, Human
cuccaggccaccugcccccu

SEQ ID NO: 347879 - RNA, 20 nt, Human
cuccaggccaccugcccccu

SEQ ID NO: 347880 - RNA, 21 nt, Human
cucccaagccucgccgccguc

SEQ ID NO: 347881 - RNA, 18 nt, Human
cucccaaguaaggcucug

SEQ ID NO: 347882 - RNA, 22 nt, Human
cuccccacacaucaccuuuuca

SEQ ID NO: 347883 - RNA, 24 nt, Human
cuccccucaccacugaggaagccc

SEQ ID NO: 347884 - RNA, 18 nt, Human
cuccggguucucagauuc

SEQ ID NO: 347885 - RNA, 19 nt, Human
cuccugagccucaggagcc

SEQ ID NO: 347886 - RNA, 20 nt, Human
cuggcagccagagagaaggc

SEQ ID NO: 347887 - RNA, 21 nt, Human
cuguacaacuacaaggccgau

SEQ ID NO: 347888 - RNA, 19 nt, Human
cuguccccuccugauuagg

SEQ ID NO: 347889 - RNA, 23 nt, Human
cugugaguuaucuuuggaaaaag

SEQ ID NO: 347890 - RNA, 18 nt, Human
gaaaaaggggcuaccuuc

SEQ ID NO: 347891 - RNA, 21 nt, Human
gaagguccuggcaggccagcu

SEQ ID NO: 347892 - RNA, 18 nt, Human
gagccggcaacaggacac

SEQ ID NO: 347893 - RNA, 23 nt, Human
gagccugcgggaggagcgccagg

SEQ ID NO: 347894 - RNA, 19 nt, Human
gaggccccgucccugggcu

SEQ ID NO: 347895 - RNA, 21 nt, Human
gcaccagaucacgcaccccag

SEQ ID NO: 347896 - RNA, 24 nt, Human
gcacugccaccaggccgccagccc

SEQ ID NO: 347897 - RNA, 18 nt, Human
gcagagagaaaacagggg

SEQ ID NO: 347898 - RNA, 26 nt, Human
gcagagcagugacaggcugugccccc

SEQ ID NO: 347899 - RNA, 21 nt, Human
gcagccagagagaaggccuga

SEQ ID NO: 347900 - RNA, 21 nt, Human
gccacagacaaguaguaacag

SEQ ID NO: 347901 - RNA, 21 nt, Human
gccacgaaggcugcugccuca

SEQ ID NO: 347902 - RNA, 21 nt, Human
gccccaagccccgcccccacc

SEQ ID NO: 347903 - RNA, 26 nt, Human
gccccaagccccgcccccaccccacc

SEQ ID NO: 347904 - RNA, 23 nt, Human
gccccaucugaacggcaaagccg

SEQ ID NO: 347905 - RNA, 19 nt, Human
gcccugcggggaagccgcu

SEQ ID NO: 347906 - RNA, 21 nt, Human
gcggcgcaggcagcgggcggc

SEQ ID NO: 347907 - RNA, 21 nt, Human
gcggcugacacaggccccagg

SEQ ID NO: 347908 - RNA, 20 nt, Human
gcugacacaggccccagggu

SEQ ID NO: 347909 - RNA, 19 nt, Human
gcugcugccucaggaaagc

SEQ ID NO: 347910 - RNA, 20 nt, Human
gcuggggcccgaagacccug

SEQ ID NO: 347911 - RNA, 20 nt, Human
gcuguggccagggaggccag

SEQ ID NO: 347912 - RNA, 21 nt, Human
ggaaagcugccucuccaagcc

SEQ ID NO: 347913 - RNA, 19 nt, Human
ggaagacaagacccccucc

SEQ ID NO: 347914 - RNA, 19 nt, Human
ggaagguccuggcaggcca

SEQ ID NO: 347915 - RNA, 25 nt, Human
ggaagugggggcccugcggggaagc

SEQ ID NO: 347916 - RNA, 22 nt, Human
ggagcaucugccccacccacga

SEQ ID NO: 347917 - RNA, 19 nt, Human
ggccucacagauggcugca

SEQ ID NO: 347918 - RNA, 18 nt, Human
ggcggcgggcgcggcggc

SEQ ID NO: 347919 - RNA, 19 nt, Human
ggcggcggggaggagaggc

SEQ ID NO: 347920 - RNA, 23 nt, Human
ggcguucagugaggcucccaagu

SEQ ID NO: 347921 - RNA, 21 nt, Human
ggcucugggugaacaacgcug

SEQ ID NO: 347922 - RNA, 20 nt, Human
ggcuggggaggggccggggc

SEQ ID NO: 347923 - RNA, 21 nt, Human
gggaagacaagacccccuccg

SEQ ID NO: 347924 - RNA, 18 nt, Human
gggaagugggggcccugc

SEQ ID NO: 347925 - RNA, 21 nt, Human
gggaggccccaagccccgccc

SEQ ID NO: 347926 - RNA, 23 nt, Human
gggagucgggagucugaaaccag

SEQ ID NO: 347927 - RNA, 18 nt, Human
gggccccaagaguaccug

SEQ ID NO: 347928 - RNA, 18 nt, Human
gggcgcugcgacuccggg

SEQ ID NO: 347929 - RNA, 20 nt, Human
gggcggcggggaggagaggc

SEQ ID NO: 347930 - RNA, 22 nt, Human
ggggaaagacuauggagaaggc

SEQ ID NO: 347931 - RNA, 21 nt, Human
gggguguggcaggguguccug

SEQ ID NO: 347932 - RNA, 19 nt, Human
gggguuggcggccgggggg

SEQ ID NO: 347933 - RNA, 21 nt, Human
gggucaucuccagcacugcca

SEQ ID NO: 347934 - RNA, 22 nt, Human
ggguggccagaacgggugggca

SEQ ID NO: 347935 - RNA, 22 nt, Human
ggguguggcaggguguccugag

SEQ ID NO: 347936 - RNA, 19 nt, Human
gguccuggcaggccagcuu

SEQ ID NO: 347937 - RNA, 20 nt, Human
ggugagugacccgccccugc

SEQ ID NO: 347938 - RNA, 21 nt, Human
gguguggcaggguguccugag

SEQ ID NO: 347939 - RNA, 18 nt, Human
gguuggcggccggggggc

SEQ ID NO: 347940 - RNA, 18 nt, Human
guggccagggaggccagg

SEQ ID NO: 347941 - RNA, 26 nt, Human
gugggcgcuggcugcaaaaggcacca

SEQ ID NO: 347942 - RNA, 21 nt, Human
uaaacagcaacggaaacaaaa

SEQ ID NO: 347943 - RNA, 21 nt, Human
uaacagaaauaaggaggguga

SEQ ID NO: 347944 - RNA, 22 nt, Human
uacaaaaaaucaccuuaauuga

SEQ ID NO: 347945 - RNA, 25 nt, Human
uacagccagccagccagccagcgcc

SEQ ID NO: 347946 - RNA, 21 nt, Human
uacagguaugaggcucaacac

SEQ ID NO: 347947 - RNA, 22 nt, Human
uaccuucccccucacucagagc

SEQ ID NO: 347948 - RNA, 19 nt, Human
uacucagugaugagccgca

SEQ ID NO: 347949 - RNA, 18 nt, Human
uagagcgguggguaaggc

SEQ ID NO: 347950 - RNA, 20 nt, Human
ucacucagagcacagggcag

SEQ ID NO: 347951 - RNA, 20 nt, Human
ucccaguuccugagccccuc

SEQ ID NO: 347952 - RNA, 23 nt, Human
ucccauccccgcgggccucacag

SEQ ID NO: 347953 - RNA, 26 nt, Human
uccccacacaucaccuuuucaaacca

SEQ ID NO: 347954 - RNA, 19 nt, Human
uccccgcgggccucacaga

SEQ ID NO: 347955 - RNA, 20 nt, Human
uccugagccccucucucucc

SEQ ID NO: 347956 - RNA, 20 nt, Human
uccugagccucaggagcccc

SEQ ID NO: 347957 - RNA, 18 nt, Human
uccugggugccccacggg

SEQ ID NO: 347958 - RNA, 21 nt, Human
uccuggguggcgcuggugugc

SEQ ID NO: 347959 - RNA, 24 nt, Human
ucggaaaaccgaaggucagggcug

SEQ ID NO: 347960 - RNA, 25 nt, Human
ucuccaagccacugccucccggucc

SEQ ID NO: 347961 - RNA, 19 nt, Human
ucuccucucacacuucucc

SEQ ID NO: 347962 - RNA, 19 nt, Human
ucucuccacacgcgucucu

SEQ ID NO: 347963 - RNA, 18 nt, Human
ucuguccuggcguuucuc

SEQ ID NO: 347964 - RNA, 21 nt, Human
ugaaaccagaacaccaaggcu

SEQ ID NO: 347965 - RNA, 23 nt, Human
ugaaaggcagggguggagggcgg

SEQ ID NO: 347966 - RNA, 20 nt, Human
ugagccccucucucuccagg

SEQ ID NO: 347967 - RNA, 23 nt, Human
ugauuaaaaauaaacacaaaaca

SEQ ID NO: 347968 - RNA, 21 nt, Human
ugauuagggggaagcugucac

SEQ ID NO: 347969 - RNA, 22 nt, Human
ugcacucccaccgcuggggccc

SEQ ID NO: 347970 - RNA, 30 nt, Human
ugccccacccugcccgagccagggccagcc

SEQ ID NO: 347971 - RNA, 24 nt, Human
ugcccuggguccccaggaagcagc

SEQ ID NO: 347972 - RNA, 19 nt, Human
ugccucaggaaagccacug

SEQ ID NO: 347973 - RNA, 21 nt, Human
ugcuugccccacgaguccccu

SEQ ID NO: 347974 - RNA, 21 nt, Human
ugggaagacaagacccccucc

SEQ ID NO: 347975 - RNA, 19 nt, Human
ugggaagugggggcccugc

SEQ ID NO: 347976 - RNA, 20 nt, Human
ugggaagugggggcccugcg

SEQ ID NO: 347977 - RNA, 18 nt, Human
ugggaggggcccagcugg

SEQ ID NO: 347978 - RNA, 24 nt, Human
ugggcaccaguauucagagcagau

SEQ ID NO: 347979 - RNA, 18 nt, Human
ugggugaacaacgcuguc

SEQ ID NO: 347980 - RNA, 24 nt, Human
ugugaguuaucuuuggaaaaaggg

SEQ ID NO: 347981 - RNA, 18 nt, Human
uguggcccaggcccgagg

SEQ ID NO: 347982 - RNA, 23 nt, Human
uucacagucagucacaggaaggc

SEQ ID NO: 347983 - RNA, 18 nt, Human
uucccagaggccgugugc

SEQ ID NO: 347984 - RNA, 22 nt, Human
uuccugagccccucucucucca

SEQ ID NO: 347985 - RNA, 19 nt, Human
uugcguguuccuuuuccac

SEQ ID NO: 347986 - RNA, 29 nt, Human
uuggcggccggggggcuucaggguagucc

SEQ ID NO: 347987 - RNA, 25 nt, Human
uuggcggccggggggcuucagugcu

SEQ ID NO: 347988 - RNA, 20 nt, Human
uuguuucuccucucacacuu

SEQ ID NO: 347989 - RNA, 23 nt, Human
uuucucggacgaagcuuucaccu

SEQ ID NO: 347990 - RNA, 24 nt, Human
uuucucggacgaagcuuucaccuc

SEQ ID NO: 347991 - RNA, 24 nt, Human
uuuuaccuuuccagaugcuuuaga

SEQ ID NO: 347992 - RNA, 20 nt, Human
uuuuccacaauucuaaugcu

SEQ ID NO: 347993 - RNA, 24 nt, Human
uuuuccacaauucuaaugcuacug

SEQ ID NO: 347994 - RNA, 22 nt, Human
uuuuuuuuaccuuuccagaugc

SEQ ID NO: 347995 - RNA, 20 nt, Human
aaaaagagacucuggacagu

SEQ ID NO: 347996 - RNA, 24 nt, Human
aagcgauuuuauguaugagagggg

SEQ ID NO: 347997 - RNA, 24 nt, Human
aaggagccccaaagagaagggacg

SEQ ID NO: 347998 - RNA, 22 nt, Human
aaucaugcagccccagcacccc

SEQ ID NO: 347999 - RNA, 19 nt, Human
acucgugaaaccauccccu

SEQ ID NO: 348000 - RNA, 18 nt, Human
agacaggaagagaugggg

SEQ ID NO: 348001 - RNA, 19 nt, Human
agaguagggauaccgaaga

SEQ ID NO: 348002 - RNA, 24 nt, Human
aggaagcaagguccuggaggcaag

SEQ ID NO: 348003 - RNA, 21 nt, Human
aggcaagaugagaaggaagca

SEQ ID NO: 348004 - RNA, 19 nt, Human
aggggaaaggagccccaaa

SEQ ID NO: 348005 - RNA, 22 nt, Human
aucuccaccagccccuucacca

SEQ ID NO: 348006 - RNA, 19 nt, Human
augcuaugugcccagggcu

SEQ ID NO: 348007 - RNA, 21 nt, Human
caaaaugacagcgccaaugug

SEQ ID NO: 348008 - RNA, 23 nt, Human
caaggccaccgaagagagacaac

SEQ ID NO: 348009 - RNA, 21 nt, Human
cacagcccaggccccuucccc

SEQ ID NO: 348010 - RNA, 22 nt, Human
cacagcccaggccccuucccca

SEQ ID NO: 348011 - RNA, 19 nt, Human
caccacuggcauuucuuag

SEQ ID NO: 348012 - RNA, 21 nt, Human
caccccaaaucaugggagacu

SEQ ID NO: 348013 - RNA, 22 nt, Human
caccgaagagagacaaccaguc

SEQ ID NO: 348014 - RNA, 23 nt, Human
caccuccccucaauucucaggcc

SEQ ID NO: 348015 - RNA, 23 nt, Human
cagcaccccaccucugcggggaa

SEQ ID NO: 348016 - RNA, 19 nt, Human
cagcccaggccccuucccc

SEQ ID NO: 348017 - RNA, 19 nt, Human
cagccccuucaccaccacc

SEQ ID NO: 348018 - RNA, 22 nt, Human
cagcuugggaggccugcccccc

SEQ ID NO: 348019 - RNA, 22 nt, Human
caggauccuguguccccagccu

SEQ ID NO: 348020 - RNA, 20 nt, Human
cagggccccucccucuucca

SEQ ID NO: 348021 - RNA, 21 nt, Human
caguauccaccucugggggag

SEQ ID NO: 348022 - RNA, 21 nt, Human
caugcagccccagcaccccac

SEQ ID NO: 348023 - RNA, 22 nt, Human
caugcagccccagcaccccacc

SEQ ID NO: 348024 - RNA, 18 nt, Human
ccaaaaugacagcgccaa

SEQ ID NO: 348025 - RNA, 20 nt, Human
ccaauguggcagccaucuuu

SEQ ID NO: 348026 - RNA, 19 nt, Human
cccaccuccaccacuggca

SEQ ID NO: 348027 - RNA, 18 nt, Human
cccagcaccccaccucug

SEQ ID NO: 348028 - RNA, 20 nt, Human
cccaguauccaccucugggg

SEQ ID NO: 348029 - RNA, 21 nt, Human
cccaucugccagguuugagag

SEQ ID NO: 348030 - RNA, 19 nt, Human
ccccaucaagguucuggga

SEQ ID NO: 348031 - RNA, 21 nt, Human
ccccccacccugccccagggc

SEQ ID NO: 348032 - RNA, 24 nt, Human
ccccugagagaaagacucuggccu

SEQ ID NO: 348033 - RNA, 19 nt, Human
cccugccccagggcuugga

SEQ ID NO: 348034 - RNA, 23 nt, Human
ccgucgcucugcucaguaccaaa

SEQ ID NO: 348035 - RNA, 21 nt, Human
ccuaugcuaugugcccagggc

SEQ ID NO: 348036 - RNA, 19 nt, Human
ccucacagcccaggccccu

SEQ ID NO: 348037 - RNA, 19 nt, Human
ccuguccucacagcccagg

SEQ ID NO: 348038 - RNA, 18 nt, Human
cuucaccaccaccaccac

SEQ ID NO: 348039 - RNA, 19 nt, Human
cuuggagagcccuagggac

SEQ ID NO: 348040 - RNA, 20 nt, Human
gaaaggagccccaaagagaa

SEQ ID NO: 348041 - RNA, 20 nt, Human
gagaaggaagcaagguccug

SEQ ID NO: 348042 - RNA, 22 nt, Human
gagaaggaagcaagguccugga

SEQ ID NO: 348043 - RNA, 18 nt, Human
gaucgguuccuacaucuc

SEQ ID NO: 348044 - RNA, 20 nt, Human
gcagccccagcaccccaccu

SEQ ID NO: 348045 - RNA, 24 nt, Human
gcagggcaaaaaucaugcagcccc

SEQ ID NO: 348046 - RNA, 19 nt, Human
gcccaggccccuuccccaa

SEQ ID NO: 348047 - RNA, 21 nt, Human
gccccagcaccccaccucugc

SEQ ID NO: 348048 - RNA, 21 nt, Human
gccugccccccaguauccacc

SEQ ID NO: 348049 - RNA, 19 nt, Human
gcgggcuggccaccucccc

SEQ ID NO: 348050 - RNA, 20 nt, Human
gcgggcuggccaccuccccu

SEQ ID NO: 348051 - RNA, 22 nt, Human
gcucugcucaguaccaaaauga

SEQ ID NO: 348052 - RNA, 21 nt, Human
ggaaaggagccccaaagagaa

SEQ ID NO: 348053 - RNA, 19 nt, Human
ggaagcaaaaugaggcaag

SEQ ID NO: 348054 - RNA, 20 nt, Human
ggaguuccccauuuccacuc

SEQ ID NO: 348055 - RNA, 25 nt, Human
ggcccugccuuucccaaacacccac

SEQ ID NO: 348056 - RNA, 19 nt, Human
gggcccuguccucacagcc

SEQ ID NO: 348057 - RNA, 19 nt, Human
gggcuggccaccuccccuc

SEQ ID NO: 348058 - RNA, 22 nt, Human
gggggcccuguccucacagccc

SEQ ID NO: 348059 - RNA, 21 nt, Human
ggggggcggcgggaagcuggg

SEQ ID NO: 348060 - RNA, 21 nt, Human
gggggggcggcgggaagcugg

SEQ ID NO: 348061 - RNA, 19 nt, Human
gguuccuacaucuccacca

SEQ ID NO: 348062 - RNA, 23 nt, Human
uaaaaauagcagaucgguuccua

SEQ ID NO: 348063 - RNA, 19 nt, Human
uaauuugaaagcgauuuua

SEQ ID NO: 348064 - RNA, 25 nt, Human
uacaucuccaccagccccuucacca

SEQ ID NO: 348065 - RNA, 24 nt, Human
uagacaggaagagauggggggggc

SEQ ID NO: 348066 - RNA, 19 nt, Human
uagcugagcacgaggaagc

SEQ ID NO: 348067 - RNA, 20 nt, Human
ucagucugacugcagaagga

SEQ ID NO: 348068 - RNA, 18 nt, Human
uccacucuucagauggga

SEQ ID NO: 348069 - RNA, 22 nt, Human
uccagagaggcccccaucugcc

SEQ ID NO: 348070 - RNA, 20 nt, Human
uccccagccuaugcuaugug

SEQ ID NO: 348071 - RNA, 21 nt, Human
ucccuggcugagaguagggau

SEQ ID NO: 348072 - RNA, 27 nt, Human
ucccuuggaggguuuauguucuugacc

SEQ ID NO: 348073 - RNA, 20 nt, Human
ucgcucugcucaguaccaaa

SEQ ID NO: 348074 - RNA, 21 nt, Human
ucgcucugcucaguaccaaaa

SEQ ID NO: 348075 - RNA, 24 nt, Human
ucuuccagagaggcccccaucugc

SEQ ID NO: 348076 - RNA, 22 nt, Human
ugacagggccccucccucuucc

SEQ ID NO: 348077 - RNA, 21 nt, Human
ugagaaggaagcaagguccug

SEQ ID NO: 348078 - RNA, 18 nt, Human
ugagaggggaaaggagcc

SEQ ID NO: 348079 - RNA, 21 nt, Human
ugagaggggaaaggagcccca

SEQ ID NO: 348080 - RNA, 18 nt, Human
ugagaguagggauaccga

SEQ ID NO: 348081 - RNA, 25 nt, Human
uggcauuucuuagucaaccugggaa

SEQ ID NO: 348082 - RNA, 22 nt, Human
uggggggggcggcgggaagcug

SEQ ID NO: 348083 - RNA, 23 nt, Human
uggggggggcggcgggaagcugg

SEQ ID NO: 348084 - RNA, 24 nt, Human
uggggggggcggcgggaagcuggg

SEQ ID NO: 348085 - RNA, 18 nt, Human
uguaaagggaaggccucc

SEQ ID NO: 348086 - RNA, 19 nt, Human
ugucagggcccuacucuca

SEQ ID NO: 348087 - RNA, 24 nt, Human
ugugcugggggaaggacagagggu

SEQ ID NO: 348088 - RNA, 21 nt, Human
ugugggggcccuguccucaca

SEQ ID NO: 348089 - RNA, 23 nt, Human
ugugggggcccuguccucacagg

SEQ ID NO: 348090 - RNA, 23 nt, Human
uucugcccuguacuucucacccc

SEQ ID NO: 348091 - RNA, 21 nt, Human
uuggaugugugcuccuccagu

SEQ ID NO: 348092 - RNA, 22 nt, Human
uuucagggcccugccuuuccca

SEQ ID NO: 348093 - RNA, 23 nt, Human
uuucccaaacacccaccuccacc

SEQ ID NO: 348094 - RNA, 24 nt, Human
uuuuuuuuuuuuuuuuuuaauuug

SEQ ID NO: 348095 - RNA, 20 nt, Human
accgccucucucggcuccca

SEQ ID NO: 348096 - RNA, 19 nt, Human
aggaaagugcagggugggg

SEQ ID NO: 348097 - RNA, 19 nt, Human
caacuugggcuaacaagag

SEQ ID NO: 348098 - RNA, 22 nt, Human
cagcuucuaaauauuaccgccu

SEQ ID NO: 348099 - RNA, 27 nt, Human
caggguggggguccacacacaccugcc

SEQ ID NO: 348100 - RNA, 18 nt, Human
caguucauguuccucucc

SEQ ID NO: 348101 - RNA, 19 nt, Human
caguucauguuccucuccu

SEQ ID NO: 348102 - RNA, 23 nt, Human
caguucauguuccucuccugugc

SEQ ID NO: 348103 - RNA, 19 nt, Human
ccacacacaccugcccagg

SEQ ID NO: 348104 - RNA, 21 nt, Human
ccuggguggggaggcuguggc

SEQ ID NO: 348105 - RNA, 18 nt, Human
cggggagcacaggcuggg

SEQ ID NO: 348106 - RNA, 21 nt, Human
cucccaggcacagcccggcuu

SEQ ID NO: 348107 - RNA, 21 nt, Human
gacaggaagggggucagggug

SEQ ID NO: 348108 - RNA, 22 nt, Human
gacaggaagggggucagggugg

SEQ ID NO: 348109 - RNA, 19 nt, Human
gagcacaggcugggccagc

SEQ ID NO: 348110 - RNA, 21 nt, Human
gcagcccggggagcacaggcu

SEQ ID NO: 348111 - RNA, 24 nt, Human
gcccggggagcacaggcugggcca

SEQ ID NO: 348112 - RNA, 18 nt, Human
ggacaggaagggggucag

SEQ ID NO: 348113 - RNA, 20 nt, Human
ggagguggaggaaagugcag

SEQ ID NO: 348114 - RNA, 24 nt, Human
ggagguggaggaaagugcagggug

SEQ ID NO: 348115 - RNA, 21 nt, Human
ggggucagggugggaggugga

SEQ ID NO: 348116 - RNA, 27 nt, Human
gggugggagguggaggaaagugcaggg

SEQ ID NO: 348117 - RNA, 26 nt, Human
ggugggagguggaggaaagugcaggg

SEQ ID NO: 348118 - RNA, 19 nt, Human
gucauccuggguggggagg

SEQ ID NO: 348119 - RNA, 20 nt, Human
ucagggugggagguggagga

SEQ ID NO: 348120 - RNA, 20 nt, Human
ucauccuggguggggaggcu

SEQ ID NO: 348121 - RNA, 22 nt, Human
uccacacacaccugcccagggg

SEQ ID NO: 348122 - RNA, 23 nt, Human
ugcccaggggucauccugggugg

SEQ ID NO: 348123 - RNA, 20 nt, Human
ugggagguggaggaaagugc

SEQ ID NO: 348124 - RNA, 22 nt, Human
ugggauuagucaggaaucugcc

SEQ ID NO: 348125 - RNA, 21 nt, Human
uggggguccacacacaccugc

SEQ ID NO: 348126 - RNA, 19 nt, Human
uuuggggacaggaaggggg

SEQ ID NO: 348127 - RNA, 19 nt, Human
uuuuuuuuuuuuuuuuugu

SEQ ID NO: 348128 - RNA, 20 nt, Human
uuuuuuuuuuuuuuuuuugg

SEQ ID NO: 348129 - RNA, 19 nt, Human
agaccucuggagacaccag

SEQ ID NO: 348130 - RNA, 21 nt, Human
agggagggggcugcgggcugg

SEQ ID NO: 348131 - RNA, 21 nt, Human
agggagggggcugcgggcugg

SEQ ID NO: 348132 - RNA, 21 nt, Human
agguggggguggagggccagc

SEQ ID NO: 348133 - RNA, 22 nt, Human
cacuugagguggggguggaggg

SEQ ID NO: 348134 - RNA, 22 nt, Human
ccagggucugaggucggggaac

SEQ ID NO: 348135 - RNA, 19 nt, Human
cgaggucggaagcccaggg

SEQ ID NO: 348136 - RNA, 25 nt, Human
cggaagcccagggucugaggucggg

SEQ ID NO: 348137 - RNA, 23 nt, Human
cgggcugggcgggagggcugggg

SEQ ID NO: 348138 - RNA, 21 nt, Human
gaagcccagggucugaggucg

SEQ ID NO: 348139 - RNA, 24 nt, Human
gaggggcuuggggacuaaggggcu

SEQ ID NO: 348140 - RNA, 22 nt, Human
ggaacagagggagggggcugcg

SEQ ID NO: 348141 - RNA, 19 nt, Human
ggcacuugaggugggggug

SEQ ID NO: 348142 - RNA, 23 nt, Human
gggaggggcuuggggacuaaggg

SEQ ID NO: 348143 - RNA, 19 nt, Human
gggagggggcugcgggcug

SEQ ID NO: 348144 - RNA, 22 nt, Human
gggagggggcugcgggcugggc

SEQ ID NO: 348145 - RNA, 18 nt, Human
gggcgggagggcuggggg

SEQ ID NO: 348146 - RNA, 21 nt, Human
gggcugggcgggagggcuggg

SEQ ID NO: 348147 - RNA, 23 nt, Human
gggcugggcgggagggcuggggg

SEQ ID NO: 348148 - RNA, 18 nt, Human
ggggcugcgggcugggcg

SEQ ID NO: 348149 - RNA, 21 nt, Human
gggggcugcgggcugggcgac

SEQ ID NO: 348150 - RNA, 25 nt, Human
gucggggaacagagggagggggcug

SEQ ID NO: 348151 - RNA, 27 nt, Human
guggggguggagggccagcugggggug

SEQ ID NO: 348152 - RNA, 24 nt, Human
ugagguggggguggagggccagcu

SEQ ID NO: 348153 - RNA, 19 nt, Human
ugccuuagggggaggggcu

SEQ ID NO: 348154 - RNA, 18 nt, Human
ugggggcgggcugggguc

SEQ ID NO: 348155 - RNA, 19 nt, Human
uggggguggagggccagcu

SEQ ID NO: 348156 - RNA, 21 nt, Human
aaacagagcuucgaugcuccc

SEQ ID NO: 348157 - RNA, 23 nt, Human
aagaaaggucgacauaaagaaaa

SEQ ID NO: 348158 - RNA, 18 nt, Human
acuccgggagucucagaa

SEQ ID NO: 348159 - RNA, 25 nt, Human
agaaaagaaaggucgacauaaagaa

SEQ ID NO: 348160 - RNA, 21 nt, Human
agaaaagacuaaaggaaaaaa

SEQ ID NO: 348161 - RNA, 22 nt, Human
agaaaggucgacauaaagaaaa

SEQ ID NO: 348162 - RNA, 21 nt, Human
agccgggggcuggagggggcc

SEQ ID NO: 348163 - RNA, 24 nt, Human
aggaaaaaaaaaaaaccucacaaa

SEQ ID NO: 348164 - RNA, 25 nt, Human
aggaaaaaaaaaaaaccucacaaaa

SEQ ID NO: 348165 - RNA, 22 nt, Human
agguggggggaggaaacagcuc

SEQ ID NO: 348166 - RNA, 25 nt, Human
agguggggggaggaaacaggggacc

SEQ ID NO: 348167 - RNA, 21 nt, Human
caugcacguaucuucugcaua

SEQ ID NO: 348168 - RNA, 20 nt, Human
ccacuaaagaaaagacuaaa

SEQ ID NO: 348169 - RNA, 26 nt, Human
ccucccccacuaaagaaaagacuaaa

SEQ ID NO: 348170 - RNA, 23 nt, Human
ccuucugcuucugcugccgggag

SEQ ID NO: 348171 - RNA, 24 nt, Human
ccuucugcuucugcugccgggagc

SEQ ID NO: 348172 - RNA, 21 nt, Human
cggcggcggcggcggccccug

SEQ ID NO: 348173 - RNA, 19 nt, Human
cuaaagaaaagacuaaagg

SEQ ID NO: 348174 - RNA, 25 nt, Human
cuaaaggaaaaaaaaaaaaccucac

SEQ ID NO: 348175 - RNA, 27 nt, Human
cucggcggcggcggcggccccuggcgc

SEQ ID NO: 348176 - RNA, 22 nt, Human
gaaaacacacaucgcuggcaau

SEQ ID NO: 348177 - RNA, 24 nt, Human
gacacaccacccguuuuuuuuuuu

SEQ ID NO: 348178 - RNA, 18 nt, Human
gaggaaacagcucuuccg

SEQ ID NO: 348179 - RNA, 22 nt, Human
gcggcggcggcggccccuggcg

SEQ ID NO: 348180 - RNA, 20 nt, Human
gcugggugaguguggcugcc

SEQ ID NO: 348181 - RNA, 26 nt, Human
ggagccgggggcuggagggggccgcg

SEQ ID NO: 348182 - RNA, 19 nt, Human
ggagcucggcggcggcggc

SEQ ID NO: 348183 - RNA, 21 nt, Human
ggagcucggcggcggcggcgg

SEQ ID NO: 348184 - RNA, 21 nt, Human
ggugaaauaaagaggcugggu

SEQ ID NO: 348185 - RNA, 18 nt, Human
guccugagacacaccacc

SEQ ID NO: 348186 - RNA, 19 nt, Human
uaagugcuacagugcucug

SEQ ID NO: 348187 - RNA, 19 nt, Human
uagcucgagaagacuccgg

SEQ ID NO: 348188 - RNA, 21 nt, Human
uagcucgagaagacuccggga

SEQ ID NO: 348189 - RNA, 18 nt, Human
uagcugaaugagaagagc

SEQ ID NO: 348190 - RNA, 22 nt, Human
uccagaauuccuuuuuuugucu

SEQ ID NO: 348191 - RNA, 21 nt, Human
uccaggauggugaaauaaaga

SEQ ID NO: 348192 - RNA, 20 nt, Human
ucccgagccccgcggagcuc

SEQ ID NO: 348193 - RNA, 20 nt, Human
ucuaagaaaagaaaggucga

SEQ ID NO: 348194 - RNA, 19 nt, Human
ugaaauaaagaggcugggu

SEQ ID NO: 348195 - RNA, 18 nt, Human
ugacaguguccagaaugg

SEQ ID NO: 348196 - RNA, 20 nt, Human
ugagagagggagagagaggg

SEQ ID NO: 348197 - RNA, 18 nt, Human
ugcaaacugcuuuucuua

SEQ ID NO: 348198 - RNA, 20 nt, Human
ugcuuuucuuacccuccccc

SEQ ID NO: 348199 - RNA, 23 nt, Human
uggggggaggaaacagcucuucc

SEQ ID NO: 348200 - RNA, 19 nt, Human
uucacaaaaucagcaaaau

SEQ ID NO: 348201 - RNA, 25 nt, Human
uuccgcgccuccucgccggggccgg

SEQ ID NO: 348202 - RNA, 22 nt, Human
uuuuucuuuuuaagugcaaacu

SEQ ID NO: 348203 - RNA, 21 nt, Human
uuuuuuuuuuuucuuuuuaag

SEQ ID NO: 348204 - RNA, 23 nt, Human
aaaaacuuguaugaauaaccuuc

SEQ ID NO: 348205 - RNA, 23 nt, Human
aaaucaauuucaaaauagcacag

SEQ ID NO: 348206 - RNA, 23 nt, Human
aacacaaacauaaaaaacuugca

SEQ ID NO: 348207 - RNA, 20 nt, Human
aagggaggcauuuagaaaau

SEQ ID NO: 348208 - RNA, 20 nt, Human
acugcaguuauuaucuuuug

SEQ ID NO: 348209 - RNA, 24 nt, Human
cagccuccggcgccucugcuuccc

SEQ ID NO: 348210 - RNA, 21 nt, Human
cauaaaaaacuugcauagcua

SEQ ID NO: 348211 - RNA, 21 nt, Human
cauuuagaaaaugucacauuu

SEQ ID NO: 348212 - RNA, 19 nt, Human
ccuagagauuacuugauuc

SEQ ID NO: 348213 - RNA, 21 nt, Human
cucagaacuggaaaacuugaa

SEQ ID NO: 348214 - RNA, 18 nt, Human
cuucgccuuccuucuucg

SEQ ID NO: 348215 - RNA, 23 nt, Human
cuucgccuuccuucuucgacauu

SEQ ID NO: 348216 - RNA, 22 nt, Human
gaacuaguuaccucagaacugg

SEQ ID NO: 348217 - RNA, 21 nt, Human
gaacuggaaaacuugaaggca

SEQ ID NO: 348218 - RNA, 25 nt, Human
gagcagcuccacuacuuacaaggga

SEQ ID NO: 348219 - RNA, 18 nt, Human
gcagugggcacuucauug

SEQ ID NO: 348220 - RNA, 23 nt, Human
gugucgguuuuuuucuguuucuu

SEQ ID NO: 348221 - RNA, 19 nt, Human
uaacagcaguugacugaca

SEQ ID NO: 348222 - RNA, 21 nt, Human
uaagacggaagaucacaacua

SEQ ID NO: 348223 - RNA, 19 nt, Human
uacaagggaccauaaagca

SEQ ID NO: 348224 - RNA, 25 nt, Human
uaccaugggaaaaauuagacugcag

SEQ ID NO: 348225 - RNA, 24 nt, Human
uaugaauaaccuucaagugcaguu

SEQ ID NO: 348226 - RNA, 20 nt, Human
ucuuuuggagugaguucaga

SEQ ID NO: 348227 - RNA, 23 nt, Human
ugaaggcauuugccuagagauua

SEQ ID NO: 348228 - RNA, 22 nt, Human
ugaggagauucaccuaaacaga

SEQ ID NO: 348229 - RNA, 18 nt, Human
ugauucuucgccuuccuu

SEQ ID NO: 348230 - RNA, 18 nt, Human
ugccuagagauuacuuga

SEQ ID NO: 348231 - RNA, 21 nt, Human
uggaacacaaacauaaaaaac

SEQ ID NO: 348232 - RNA, 22 nt, Human
uggaacacaaacauaaaaaacu

SEQ ID NO: 348233 - RNA, 18 nt, Human
uggagugaguucagaccc

SEQ ID NO: 348234 - RNA, 19 nt, Human
ugggaaaaauuagacugca

SEQ ID NO: 348235 - RNA, 22 nt, Human
uguaaaaaggggacuuuauuuc

SEQ ID NO: 348236 - RNA, 19 nt, Human
ugucacauuucagauaugu

SEQ ID NO: 348237 - RNA, 19 nt, Human
uguugcagaacuguaaaaa

SEQ ID NO: 348238 - RNA, 22 nt, Human
uguugcagaacuguaaaaaggg

SEQ ID NO: 348239 - RNA, 19 nt, Human
uuagaaaaugucacauuuc

SEQ ID NO: 348240 - RNA, 23 nt, Human
uugacagguucucucccacagug

SEQ ID NO: 348241 - RNA, 22 nt, Human
uugcagaacuguaaaaagggga

SEQ ID NO: 348242 - RNA, 20 nt, Human
uuucaugggaaguugacugu

SEQ ID NO: 348243 - RNA, 21 nt, Human
uuuuuauugguacguauuacu

SEQ ID NO: 348244 - RNA, 23 nt, Human
aagaggcaggucugggagggugg

SEQ ID NO: 348245 - RNA, 21 nt, Human
aagcagggggaagaggcaggu

SEQ ID NO: 348246 - RNA, 22 nt, Human
agaggcaggucugggagggugg

SEQ ID NO: 348247 - RNA, 18 nt, Human
auggagagggauaagugg

SEQ ID NO: 348248 - RNA, 22 nt, Human
cagugcacgguuggccugggcc

SEQ ID NO: 348249 - RNA, 20 nt, Human
cccuuggugggggugggggu

SEQ ID NO: 348250 - RNA, 22 nt, Human
cgcccuuggugggggugggggu

SEQ ID NO: 348251 - RNA, 19 nt, Human
cugggaggguggagaggaa

SEQ ID NO: 348252 - RNA, 19 nt, Human
gccugaggugggagcaggu

SEQ ID NO: 348253 - RNA, 20 nt, Human
gcuggagcuguguguggaga

SEQ ID NO: 348254 - RNA, 23 nt, Human
ggcaagggugggguuauggagag

SEQ ID NO: 348255 - RNA, 18 nt, Human
gggaagaggcaggucugg

SEQ ID NO: 348256 - RNA, 20 nt, Human
gggaagaggcaggucuggga

SEQ ID NO: 348257 - RNA, 21 nt, Human
gggaagaggcaggucugggag

SEQ ID NO: 348258 - RNA, 18 nt, Human
gggagcagguucuggaca

SEQ ID NO: 348259 - RNA, 28 nt, Human
gggcaagggugggguuauggggacugcc

SEQ ID NO: 348260 - RNA, 24 nt, Human
ggggaagaggcaggucugggaggg

SEQ ID NO: 348261 - RNA, 23 nt, Human
ggggguggggugggcaagggugg

SEQ ID NO: 348262 - RNA, 26 nt, Human
ggggguggggugggcaaggguggggu

SEQ ID NO: 348263 - RNA, 20 nt, Human
gggguggggguggggugggc

SEQ ID NO: 348264 - RNA, 18 nt, Human
gggguggggugggcaagg

SEQ ID NO: 348265 - RNA, 19 nt, Human
gggguggggugggcaaggg

SEQ ID NO: 348266 - RNA, 19 nt, Human
gggguggggugggcaaggg

SEQ ID NO: 348267 - RNA, 18 nt, Human
ggguggggugggcaaggg

SEQ ID NO: 348268 - RNA, 18 nt, Human
gggugggguuauggagag

SEQ ID NO: 348269 - RNA, 24 nt, Human
ggugagguggaagcagggggaaga

SEQ ID NO: 348270 - RNA, 24 nt, Human
uacucuugcgcccuuggugggggu

SEQ ID NO: 348271 - RNA, 21 nt, Human
ucugggaggguggagaggaag

SEQ ID NO: 348272 - RNA, 24 nt, Human
ugaggugggagcagguucuggaca

SEQ ID NO: 348273 - RNA, 21 nt, Human
ugcagcagugcacgguuggcc

SEQ ID NO: 348274 - RNA, 21 nt, Human
ugggagcagguucuggacaga

SEQ ID NO: 348275 - RNA, 18 nt, Human
uggggguggggguggggu

SEQ ID NO: 348276 - RNA, 19 nt, Human
uggggguggggugggcaag

SEQ ID NO: 348277 - RNA, 22 nt, Human
uggggugagguggaagcagggg

SEQ ID NO: 348278 - RNA, 23 nt, Human
ugguggggguggggguggggucg

SEQ ID NO: 348279 - RNA, 24 nt, Human
uggugggggugggggugggguggg

SEQ ID NO: 348280 - RNA, 26 nt, Human
uuggaccgcuacucuugcgcccuugg

SEQ ID NO: 348281 - RNA, 19 nt, Human
uuggugggggugggggugg

SEQ ID NO: 348282 - RNA, 21 nt, Human
aauacaaaaaucaaaagcuua

SEQ ID NO: 348283 - RNA, 23 nt, Human
aauacaaaaaucaaaagcuuauu

SEQ ID NO: 348284 - RNA, 19 nt, Human
acccugcagggaguggcac

SEQ ID NO: 348285 - RNA, 20 nt, Human
accucagaggcacuaucaga

SEQ ID NO: 348286 - RNA, 18 nt, Human
acgcggggcggagaggcg

SEQ ID NO: 348287 - RNA, 19 nt, Human
agaggcgagcgcggcgggc

SEQ ID NO: 348288 - RNA, 25 nt, Human
caaacaauacaaaaaucaaaagcuu

SEQ ID NO: 348289 - RNA, 25 nt, Human
caacucuuaucagggaggagcgaac

SEQ ID NO: 348290 - RNA, 19 nt, Human
cagggcauccccacccuga

SEQ ID NO: 348291 - RNA, 22 nt, Human
ccccacccugagccugcccuuc

SEQ ID NO: 348292 - RNA, 24 nt, Human
ccccagaagccgggcuucccgccu

SEQ ID NO: 348293 - RNA, 24 nt, Human
cccccgaccccgggcgcgcggccc

SEQ ID NO: 348294 - RNA, 20 nt, Human
cccccgacucccccgacccc

SEQ ID NO: 348295 - RNA, 23 nt, Human
cccccucuuccugcccccgacuc

SEQ ID NO: 348296 - RNA, 24 nt, Human
cccgaccccgggcgcgcggcccac

SEQ ID NO: 348297 - RNA, 24 nt, Human
ccucccccucuuccugcccccgac

SEQ ID NO: 348298 - RNA, 23 nt, Human
ccugcccccgacucccccgaccc

SEQ ID NO: 348299 - RNA, 21 nt, Human
ccugucuccucccccucuucc

SEQ ID NO: 348300 - RNA, 22 nt, Human
ccuuggccgaggcgcggcggac

SEQ ID NO: 348301 - RNA, 21 nt, Human
cgaauauuucagggcaucccc

SEQ ID NO: 348302 - RNA, 22 nt, Human
cgcccugcccucgcucccggac

SEQ ID NO: 348303 - RNA, 23 nt, Human
cgcggcccacgcccugcccucgc

SEQ ID NO: 348304 - RNA, 18 nt, Human
cgcggcggacgcugggcg

SEQ ID NO: 348305 - RNA, 19 nt, Human
cggagaggcgagcgcggcg

SEQ ID NO: 348306 - RNA, 21 nt, Human
cggcgggcugugcgccuuccu

SEQ ID NO: 348307 - RNA, 21 nt, Human
cgggcgcgcggcccacgcccu

SEQ ID NO: 348308 - RNA, 22 nt, Human
cucaugaaauccuucuaugggg

SEQ ID NO: 348309 - RNA, 20 nt, Human
cuccccagaagccgggcuuc

SEQ ID NO: 348310 - RNA, 26 nt, Human
cucccccgaccccgggcgcgcggccc

SEQ ID NO: 348311 - RNA, 22 nt, Human
cucgaauauuucagggcauccc

SEQ ID NO: 348312 - RNA, 23 nt, Human
cucgcagaggccucgcccgcccc

SEQ ID NO: 348313 - RNA, 20 nt, Human
cuuccugcccccgacucccc

SEQ ID NO: 348314 - RNA, 24 nt, Human
cuuccugcccccgacucccccgac

SEQ ID NO: 348315 - RNA, 19 nt, Human
gaaacgguccugcucucga

SEQ ID NO: 348316 - RNA, 20 nt, Human
gagaggcgagcgcggcgggc

SEQ ID NO: 348317 - RNA, 21 nt, Human
gagcgcggcgggcugugcgcc

SEQ ID NO: 348318 - RNA, 22 nt, Human
gcaccuccccagaagccgggcu

SEQ ID NO: 348319 - RNA, 19 nt, Human
ggcggcgcgggagcgggag

SEQ ID NO: 348320 - RNA, 22 nt, Human
ggggcggagaggcgagcgcggc

SEQ ID NO: 348321 - RNA, 22 nt, Human
guaaacuucucuucaguagaaa

SEQ ID NO: 348322 - RNA, 21 nt, Human
guccugcucucgaauauuuca

SEQ ID NO: 348323 - RNA, 19 nt, Human
uaacuuuucuuucucugcu

SEQ ID NO: 348324 - RNA, 20 nt, Human
uacaaaucaaagaacccggc

SEQ ID NO: 348325 - RNA, 18 nt, Human
ucagauuagcccuaggag

SEQ ID NO: 348326 - RNA, 19 nt, Human
ucccccagcccugucuccu

SEQ ID NO: 348327 - RNA, 22 nt, Human
ucccccagcccugucuccuccc

SEQ ID NO: 348328 - RNA, 22 nt, Human
uccugcggguggggcacgcugg

SEQ ID NO: 348329 - RNA, 21 nt, Human
ucucggguuugguuuuagaaa

SEQ ID NO: 348330 - RNA, 22 nt, Human
ucucugcuugucaaaugagagu

SEQ ID NO: 348331 - RNA, 21 nt, Human
ugcccccgacucccccgaccc

SEQ ID NO: 348332 - RNA, 19 nt, Human
ugcccucgcucccggaccc

SEQ ID NO: 348333 - RNA, 26 nt, Human
ugcccuuccucucggguuugguuuua

SEQ ID NO: 348334 - RNA, 18 nt, Human
uguacaaaucaaagaacc

SEQ ID NO: 348335 - RNA, 22 nt, Human
uuuuacauuugcuaaguguccu

SEQ ID NO: 348336 - RNA, 21 nt, Human
agcucugugcgcgcggcgucg

SEQ ID NO: 348337 - RNA, 23 nt, Human
caggggaugggugggcuguggag

SEQ ID NO: 348338 - RNA, 21 nt, Human
ccucaacccacgcccuucccg

SEQ ID NO: 348339 - RNA, 24 nt, Human
cgggaggcuguggcugggagcggc

SEQ ID NO: 348340 - RNA, 21 nt, Human
cuggagccucuccucaaccca

SEQ ID NO: 348341 - RNA, 23 nt, Human
gaugacagaaaggcuggaaggaa

SEQ ID NO: 348342 - RNA, 21 nt, Human
gcccuucccggcccagccuug

SEQ ID NO: 348343 - RNA, 22 nt, Human
gcgcgcggcgugcgggucugga

SEQ ID NO: 348344 - RNA, 19 nt, Human
gcgcggcgugcgggucugg

SEQ ID NO: 348345 - RNA, 21 nt, Human
gcgcggcgugcgggucuggag

SEQ ID NO: 348346 - RNA, 20 nt, Human
ggcugggagcggcgcugaga

SEQ ID NO: 348347 - RNA, 23 nt, Human
gggaggcuguggcugggagcggc

SEQ ID NO: 348348 - RNA, 18 nt, Human
ggggaugggugggcugug

SEQ ID NO: 348349 - RNA, 25 nt, Human
uagugugcucaggggaugggugggc

SEQ ID NO: 348350 - RNA, 22 nt, Human
ugacagaaaggcuggaaggaaa

SEQ ID NO: 348351 - RNA, 25 nt, Human
ugcucaggggaugggugggcugugg

SEQ ID NO: 348352 - RNA, 18 nt, Human
ugggcuguggagaugaug

SEQ ID NO: 348353 - RNA, 18 nt, Human
ugugcgcgcggcgugcgg

SEQ ID NO: 348354 - RNA, 21 nt, Human
agaaaagacccucauugagga

SEQ ID NO: 348355 - RNA, 19 nt, Human
aggcuggguuuuggugagg

SEQ ID NO: 348356 - RNA, 20 nt, Human
ggcaaggcuggguuuuggug

SEQ ID NO: 348357 - RNA, 20 nt, Human
gggaaagaaaagacccucau

SEQ ID NO: 348358 - RNA, 20 nt, Human
uccccacgggcaaggcuggg

SEQ ID NO: 348359 - RNA, 20 nt, Human
uguggagcuacagcaaaaag

SEQ ID NO: 348360 - RNA, 26 nt, Human
uguguuuauuaacucuuacuccccac

SEQ ID NO: 348361 - RNA, 20 nt, Human
aaacucaaaggcaucaacag

SEQ ID NO: 348362 - RNA, 19 nt, Human
aacucaaaggcaucaacag

SEQ ID NO: 348363 - RNA, 19 nt, Human
caacaguccugggcccaag

SEQ ID NO: 348364 - RNA, 19 nt, Human
ccauggcaggaagucaaga

SEQ ID NO: 348365 - RNA, 18 nt, Human
cccaagagauccauggca

SEQ ID NO: 348366 - RNA, 18 nt, Human
uccugggcccaagagauc

SEQ ID NO: 348367 - RNA, 19 nt, Human
uggcaggaagucaagaguu

SEQ ID NO: 348368 - RNA, 22 nt, Human
ugggcccaagagauccauggca

SEQ ID NO: 348369 - RNA, 20 nt, Human
aacugaucgcagaagaccug

SEQ ID NO: 348370 - RNA, 23 nt, Human
acagccagcgcacccccuggagc

SEQ ID NO: 348371 - RNA, 18 nt, Human
agagaggguaggaggggg

SEQ ID NO: 348372 - RNA, 23 nt, Human
agaucccgccuccucccauccac

SEQ ID NO: 348373 - RNA, 25 nt, Human
aggcaggcugggccccagaguggcu

SEQ ID NO: 348374 - RNA, 18 nt, Human
auccugaggaaggagccc

SEQ ID NO: 348375 - RNA, 21 nt, Human
caagggaggccacaggggugc

SEQ ID NO: 348376 - RNA, 19 nt, Human
cagagcagaucccgccucc

SEQ ID NO: 348377 - RNA, 21 nt, Human
cagcgcacccccuggagcaga

SEQ ID NO: 348378 - RNA, 20 nt, Human
cagucaggaaccugaaccag

SEQ ID NO: 348379 - RNA, 23 nt, Human
cccagaguggcucuaccccucau

SEQ ID NO: 348380 - RNA, 22 nt, Human
ccccgacagccagcgcaccccc

SEQ ID NO: 348381 - RNA, 22 nt, Human
cccucacaucucugggccuccu

SEQ ID NO: 348382 - RNA, 22 nt, Human
cgcucugcugagccucgagggc

SEQ ID NO: 348383 - RNA, 24 nt, Human
gacagccagcgcacccccuggagc

SEQ ID NO: 348384 - RNA, 19 nt, Human
gagagaggguaggaggggg

SEQ ID NO: 348385 - RNA, 20 nt, Human
gcacgcucugcugagccucg

SEQ ID NO: 348386 - RNA, 18 nt, Human
ggagacaugcccagcccc

SEQ ID NO: 348387 - RNA, 22 nt, Human
ggugcggcaggcaggcugggcc

SEQ ID NO: 348388 - RNA, 27 nt, Human
uaaauaggcccuuucccaucguggucu

SEQ ID NO: 348389 - RNA, 19 nt, Human
uaacugaucgcagaagacc

SEQ ID NO: 348390 - RNA, 22 nt, Human
uauuaggaguuaaauaggcccu

SEQ ID NO: 348391 - RNA, 21 nt, Human
ugcccagcccccgacagccag

SEQ ID NO: 348392 - RNA, 18 nt, Human
ugcugagccucgagggcc

SEQ ID NO: 348393 - RNA, 24 nt, Human
ugugggagacaugcccagcccccg

SEQ ID NO: 348394 - RNA, 19 nt, Human
aagaaagaagaagcgcuga

SEQ ID NO: 348395 - RNA, 22 nt, Human
aagaaucuuuauugaacuugcu

SEQ ID NO: 348396 - RNA, 21 nt, Human
aagcccacaucucagaagcac

SEQ ID NO: 348397 - RNA, 23 nt, Human
acuuccaagaaucuuuauugaac

SEQ ID NO: 348398 - RNA, 18 nt, Human
aggaucaaaccaagaaag

SEQ ID NO: 348399 - RNA, 19 nt, Human
cacuggcgacagggagggc

SEQ ID NO: 348400 - RNA, 18 nt, Human
cagcagucaggaucaaac

SEQ ID NO: 348401 - RNA, 22 nt, Human
cagcagucaggaucacacguac

SEQ ID NO: 348402 - RNA, 21 nt, Human
cagggagggccccagcuggca

SEQ ID NO: 348403 - RNA, 24 nt, Human
cgacagggagggccccagcuggca

SEQ ID NO: 348404 - RNA, 22 nt, Human
gaggagagaggguuguagagag

SEQ ID NO: 348405 - RNA, 23 nt, Human
gcgacagggagggccccagcugg

SEQ ID NO: 348406 - RNA, 24 nt, Human
uagcaacagcgugugcaagcccac

SEQ ID NO: 348407 - RNA, 21 nt, Human
ucaaaccaagaaagaagaagc

SEQ ID NO: 348408 - RNA, 21 nt, Human
ugaggagagaggguuguagag

SEQ ID NO: 348409 - RNA, 21 nt, Human
uggaaaaaaaaaagugcccac

SEQ ID NO: 348410 - RNA, 24 nt, Human
uggaaaaaaaaaagugcccacugg

SEQ ID NO: 348411 - RNA, 25 nt, Human
uggcgacagggagggccccagcugg

SEQ ID NO: 348412 - RNA, 18 nt, Human
ugucugaaggagccaggg

SEQ ID NO: 348413 - RNA, 21 nt, Human
aaaccaggcuguccuggaaag

SEQ ID NO: 348414 - RNA, 21 nt, Human
aacaauaagccgaagaaggga

SEQ ID NO: 348415 - RNA, 19 nt, Human
aagaagggaaaccaggcug

SEQ ID NO: 348416 - RNA, 21 nt, Human
aaggguggagggugagggugg

SEQ ID NO: 348417 - RNA, 22 nt, Human
acaaacaagggcuggggacaca

SEQ ID NO: 348418 - RNA, 18 nt, Human
aggagcagccgaggucag

SEQ ID NO: 348419 - RNA, 20 nt, Human
aggagggcagggggccaaag

SEQ ID NO: 348420 - RNA, 18 nt, Human
agggagaggagggcaggg

SEQ ID NO: 348421 - RNA, 21 nt, Human
agggagaggagggcagggggc

SEQ ID NO: 348422 - RNA, 22 nt, Human
agggagaggagggcagggggcc

SEQ ID NO: 348423 - RNA, 24 nt, Human
caauaagccgaagaagggaaacca

SEQ ID NO: 348424 - RNA, 24 nt, Human
cagaacucaaaaucugaaaucuga

SEQ ID NO: 348425 - RNA, 24 nt, Human
cagcagcaaaggguggagggugag

SEQ ID NO: 348426 - RNA, 19 nt, Human
cagccgaggucagcagcaa

SEQ ID NO: 348427 - RNA, 22 nt, Human
ccaaaaaucagaacucaaaauc

SEQ ID NO: 348428 - RNA, 23 nt, Human
ccuucugccuuuauuucccugau

SEQ ID NO: 348429 - RNA, 18 nt, Human
cugggagggagaggaggg

SEQ ID NO: 348430 - RNA, 21 nt, Human
gagggugaggguggagggcag

SEQ ID NO: 348431 - RNA, 18 nt, Human
gaggguggagggcagccc

SEQ ID NO: 348432 - RNA, 20 nt, Human
gcacacacguccccaauccc

SEQ ID NO: 348433 - RNA, 20 nt, Human
ggagaggagggcagggggcc

SEQ ID NO: 348434 - RNA, 18 nt, Human
ggagggagaggagggcag

SEQ ID NO: 348435 - RNA, 19 nt, Human
ggagggugaggguggaggg

SEQ ID NO: 348436 - RNA, 24 nt, Human
gguccaucugggagggagaggagg

SEQ ID NO: 348437 - RNA, 24 nt, Human
guggagggugaggguggagggcag

SEQ ID NO: 348438 - RNA, 23 nt, Human
ucacugccuucugccuuuauucu

SEQ ID NO: 348439 - RNA, 18 nt, Human
ucagcagcaaagggugga

SEQ ID NO: 348440 - RNA, 24 nt, Human
ucccauagcacacacguccccaau

SEQ ID NO: 348441 - RNA, 20 nt, Human
uccccaaucccagaaacuuu

SEQ ID NO: 348442 - RNA, 24 nt, Human
uccccaaucccagaaacuuuacuc

SEQ ID NO: 348443 - RNA, 21 nt, Human
ucccugaucucugucccuucc

SEQ ID NO: 348444 - RNA, 21 nt, Human
uccuuguuuacaaacaagggc

SEQ ID NO: 348445 - RNA, 18 nt, Human
ucugauggaacaauaagc

SEQ ID NO: 348446 - RNA, 21 nt, Human
ucugugagaggagcagccgag

SEQ ID NO: 348447 - RNA, 22 nt, Human
ugaccaaaaaucagaacucaaa

SEQ ID NO: 348448 - RNA, 22 nt, Human
ugaggguggagggcagcccugg

SEQ ID NO: 348449 - RNA, 19 nt, Human
ugaucucugucccuuccuu

SEQ ID NO: 348450 - RNA, 19 nt, Human
uggaacaauaagccgaaga

SEQ ID NO: 348451 - RNA, 23 nt, Human
ugggagggagaggagggcagggg

SEQ ID NO: 348452 - RNA, 21 nt, Human
ugugagaggagcagccgaggu

SEQ ID NO: 348453 - RNA, 19 nt, Human
gagcgguagggaggcggcc

SEQ ID NO: 348454 - RNA, 21 nt, Human
gggaggcggccaaaugcgacg

SEQ ID NO: 348455 - RNA, 18 nt, Human
uggagcgguagggaggcg

SEQ ID NO: 348456 - RNA, 18 nt, Human
ugucgcaguccgacuggc

SEQ ID NO: 348457 - RNA, 22 nt, Human
ugucuccaucuucccuauuuau

SEQ ID NO: 348458 - RNA, 22 nt, Human
aaaaagccagagcugggaagcg

SEQ ID NO: 348459 - RNA, 19 nt, Human
cugggucucuggaggccca

SEQ ID NO: 348460 - RNA, 18 nt, Human
gggucucuggaggcccau

SEQ ID NO: 348461 - RNA, 24 nt, Human
gucucuggaggcccauuggugggg

SEQ ID NO: 348462 - RNA, 20 nt, Human
uccugggucucuggaggccc

SEQ ID NO: 348463 - RNA, 20 nt, Human
uccugggucucuggaggccc

SEQ ID NO: 348464 - RNA, 22 nt, Human
uccugggucucuggaggcccau

SEQ ID NO: 348465 - RNA, 21 nt, Human
ucucuggaggcccauuggugg

SEQ ID NO: 348466 - RNA, 19 nt, Human
uggaggcccauuggugggg

SEQ ID NO: 348467 - RNA, 21 nt, Human
uggaggcccauugguggggcu

SEQ ID NO: 348468 - RNA, 22 nt, Human
uuccugggucucuggaggccca

SEQ ID NO: 348469 - RNA, 18 nt, Human
uuguuccugggucucugg

SEQ ID NO: 348470 - RNA, 20 nt, Human
uuguuccugggucucuggag

SEQ ID NO: 348471 - RNA, 24 nt, Human
uuucaaaaagccagagcugggaag

SEQ ID NO: 348472 - RNA, 22 nt, Human
cagguacauguccaggggccca

SEQ ID NO: 348473 - RNA, 23 nt, Human
ccaggucuucugaaagacagcug

SEQ ID NO: 348474 - RNA, 18 nt, Human
gacuugccccaccagguc

SEQ ID NO: 348475 - RNA, 18 nt, Human
ggcccagccucugggccc

SEQ ID NO: 348476 - RNA, 19 nt, Human
ggggcccagccucugggcc

SEQ ID NO: 348477 - RNA, 20 nt, Human
ggggcccagccucugggccc

SEQ ID NO: 348478 - RNA, 23 nt, Human
uucugcagguacauguccagggg

SEQ ID NO: 348479 - RNA, 23 nt, Human
uugaugacuuuauuauucugcag

SEQ ID NO: 348480 - RNA, 18 nt, Human
uuuuuuuuuuuuuuuuug

SEQ ID NO: 348481 - RNA, 21 nt, Human
uuuuuuuuuuuuuuuuugagg

SEQ ID NO: 348482 - RNA, 19 nt, Human
agccccuagccccacagcc

SEQ ID NO: 348483 - RNA, 21 nt, Human
agccccuagccccacagccaa

SEQ ID NO: 348484 - RNA, 19 nt, Human
aggaagagacuuuauuugg

SEQ ID NO: 348485 - RNA, 22 nt, Human
caaagccgaggagccacacaga

SEQ ID NO: 348486 - RNA, 31 nt, Human
cagccccuagccccacagccaagacaguuuu

SEQ ID NO: 348487 - RNA, 24 nt, Human
ccagccccuagccccacagccaag

SEQ ID NO: 348488 - RNA, 22 nt, Human
cccacagccaagacaguuugac

SEQ ID NO: 348489 - RNA, 18 nt, Human
cccagccccuagccccac

SEQ ID NO: 348490 - RNA, 23 nt, Human
cccagccccuagccccacagccg

SEQ ID NO: 348491 - RNA, 21 nt, Human
ccccagccccuagccccacag

SEQ ID NO: 348492 - RNA, 23 nt, Human
ccccagccccuagccccacagcc

SEQ ID NO: 348493 - RNA, 20 nt, Human
ccccggggcccugguugggg

SEQ ID NO: 348494 - RNA, 20 nt, Human
ccccggggcccugguugggu

SEQ ID NO: 348495 - RNA, 20 nt, Human
gacuguggccauggccgugg

SEQ ID NO: 348496 - RNA, 20 nt, Human
gccacugugaucuuggccac

SEQ ID NO: 348497 - RNA, 18 nt, Human
gugaucuuggccacugug

SEQ ID NO: 348498 - RNA, 19 nt, Human
uagaggcaggguggccugg

SEQ ID NO: 348499 - RNA, 18 nt, Human
ucccaaagccgaggagcc

SEQ ID NO: 348500 - RNA, 20 nt, Human
ugacuguggccauggccgug

SEQ ID NO: 348501 - RNA, 21 nt, Human
uggccuccugauuaguggccu

SEQ ID NO: 348502 - RNA, 18 nt, Human
uuggccccagccccuagc

SEQ ID NO: 348503 - RNA, 19 nt, Human
aaaacagccuuuggaaaga

SEQ ID NO: 348504 - RNA, 20 nt, Human
aacacggcuggaaagcuccu

SEQ ID NO: 348505 - RNA, 22 nt, Human
aagccgcaugugcuggaggcac

SEQ ID NO: 348506 - RNA, 19 nt, Human
acaggaaagguuuggcugc

SEQ ID NO: 348507 - RNA, 23 nt, Human
accccuuccuggucuccuugcug

SEQ ID NO: 348508 - RNA, 21 nt, Human
agcaguguuuucaaauaaugc

SEQ ID NO: 348509 - RNA, 18 nt, Human
aggcaaggauccugcagc

SEQ ID NO: 348510 - RNA, 20 nt, Human
aggcacguuggaggcaagga

SEQ ID NO: 348511 - RNA, 18 nt, Human
cacacaggccuaauauag

SEQ ID NO: 348512 - RNA, 19 nt, Human
caccacgcccuugcagggc

SEQ ID NO: 348513 - RNA, 23 nt, Human
cacggaggccacgcuggagcccc

SEQ ID NO: 348514 - RNA, 22 nt, Human
cagagcccccgguagugcccuc

SEQ ID NO: 348515 - RNA, 19 nt, Human
cagagcuggcucggauugc

SEQ ID NO: 348516 - RNA, 22 nt, Human
cagcaguguuuucaaauaaugc

SEQ ID NO: 348517 - RNA, 20 nt, Human
cagccgcgacuugaaucgca

SEQ ID NO: 348518 - RNA, 19 nt, Human
caggccuaauauagcagaa

SEQ ID NO: 348519 - RNA, 22 nt, Human
ccacgcccuugcagggccacac

SEQ ID NO: 348520 - RNA, 19 nt, Human
cgcgguggcucagagcccc

SEQ ID NO: 348521 - RNA, 19 nt, Human
cgcugagcguucaccuggu

SEQ ID NO: 348522 - RNA, 21 nt, Human
cgcuggagcccccagagcugg

SEQ ID NO: 348523 - RNA, 20 nt, Human
cuacaacacggcuggaaagc

SEQ ID NO: 348524 - RNA, 21 nt, Human
gaacagcaguguuuucaaaaa

SEQ ID NO: 348525 - RNA, 19 nt, Human
gagcccccagagcuggcuc

SEQ ID NO: 348526 - RNA, 21 nt, Human
gauccugcagccgcgacuuga

SEQ ID NO: 348527 - RNA, 19 nt, Human
gcaggccgaagccaccacg

SEQ ID NO: 348528 - RNA, 24 nt, Human
gcccucggaagccgcaugugcugg

SEQ ID NO: 348529 - RNA, 21 nt, Human
gcuggaaagcucagcuccuac

SEQ ID NO: 348530 - RNA, 24 nt, Human
ucaccuggugaucaggcgcauccc

SEQ ID NO: 348531 - RNA, 23 nt, Human
ucagagcccccgguagugcccuc

SEQ ID NO: 348532 - RNA, 20 nt, Human
uccuugucucaccccuuccu

SEQ ID NO: 348533 - RNA, 21 nt, Human
ucuacacggccauggcgggcu

SEQ ID NO: 348534 - RNA, 23 nt, Human
ucucaccccuuccuggucuccuu

SEQ ID NO: 348535 - RNA, 19 nt, Human
ucucuguuacaggaaaggu

SEQ ID NO: 348536 - RNA, 21 nt, Human
ucuguuacaggaaagguuugg

SEQ ID NO: 348537 - RNA, 20 nt, Human
ugcugucugcuuucuugcau

SEQ ID NO: 348538 - RNA, 20 nt, Human
uggaaagcucagcuccuacu

SEQ ID NO: 348539 - RNA, 22 nt, Human
uggagcccccagagcuggcucg

SEQ ID NO: 348540 - RNA, 23 nt, Human
uggagcccccagagcuggcucgg

SEQ ID NO: 348541 - RNA, 22 nt, Human
uggaguugcuuuuuccaggacg

SEQ ID NO: 348542 - RNA, 18 nt, Human
ugugcuggaggcacguug

SEQ ID NO: 348543 - RNA, 22 nt, Human
uuaaaacagccuuuggaaagag

SEQ ID NO: 348544 - RNA, 26 nt, Human
uuaaagaacagcaguguuuucaaaua

SEQ ID NO: 348545 - RNA, 20 nt, Human
uuacaggaaagguuuggcug

SEQ ID NO: 348546 - RNA, 18 nt, Human
uugcuuuuuccaggacgc

SEQ ID NO: 348547 - RNA, 24 nt, Human
aggaaucugugacaucuccagggc

SEQ ID NO: 348548 - RNA, 22 nt, Human
auuuauuaaucagagguacaug

SEQ ID NO: 348549 - RNA, 18 nt, Human
cacuuuugggaagccugg

SEQ ID NO: 348550 - RNA, 19 nt, Human
cagagguacaugagcaggc

SEQ ID NO: 348551 - RNA, 18 nt, Human
uaauugccaacaaacacu

SEQ ID NO: 348552 - RNA, 18 nt, Human
agcucagugacccugugu

SEQ ID NO: 348553 - RNA, 21 nt, Human
aggugcccuauaccaguuccu

SEQ ID NO: 348554 - RNA, 24 nt, Human
ccucuaggugcccuauaccaguuc

SEQ ID NO: 348555 - RNA, 23 nt, Human
cuggggggagaaguguguggcuc

SEQ ID NO: 348556 - RNA, 27 nt, Human
cuguggaccuuucuccagcugaaauuu

SEQ ID NO: 348557 - RNA, 19 nt, Human
guggaccuuucuccagcug

SEQ ID NO: 348558 - RNA, 18 nt, Human
ucagugacccuguguccc

SEQ ID NO: 348559 - RNA, 22 nt, Human
ucccugagagcagaggagcagg

SEQ ID NO: 348560 - RNA, 18 nt, Human
ugacccugugucccuguc

SEQ ID NO: 348561 - RNA, 19 nt, Human
ugagagcagaggagcagga

SEQ ID NO: 348562 - RNA, 20 nt, Human
ugcuguggaccuuucuccag

SEQ ID NO: 348563 - RNA, 24 nt, Human
uguggaccuuucuccagcugaaau

SEQ ID NO: 348564 - RNA, 21 nt, Human
uguguggcucacagcccaguu

SEQ ID NO: 348565 - RNA, 22 nt, Human
uuucaguaaaggcagagcugcu

SEQ ID NO: 348566 - RNA, 21 nt, Human
aagcagucuccaaauaggucu

SEQ ID NO: 348567 - RNA, 21 nt, Human
agacaggagaggaggccgggu

SEQ ID NO: 348568 - RNA, 21 nt, Human
caaauaggucuucuccacuuu

SEQ ID NO: 348569 - RNA, 22 nt, Human
caggagaggaggccgggugaca

SEQ ID NO: 348570 - RNA, 27 nt, Human
cuucuccacuucauccagggcugagga

SEQ ID NO: 348571 - RNA, 20 nt, Human
gcuuauuaaaaucuuuuuuc

SEQ ID NO: 348572 - RNA, 23 nt, Human
ggaaaagccagaccucaguuagg

SEQ ID NO: 348573 - RNA, 19 nt, Human
ggcugaggaaaagccagac

SEQ ID NO: 348574 - RNA, 19 nt, Human
uauggugacaggaagcagu

SEQ ID NO: 348575 - RNA, 23 nt, Human
uccagggcugaggaaaagccaga

SEQ ID NO: 348576 - RNA, 21 nt, Human
uccagggcugaggaaaagccg

SEQ ID NO: 348577 - RNA, 21 nt, Human
ugaagacagcugaagcgccag

SEQ ID NO: 348578 - RNA, 21 nt, Human
ugacaggaagcagucuccaaa

SEQ ID NO: 348579 - RNA, 20 nt, Human
aaaacagaggcagcuuugga

SEQ ID NO: 348580 - RNA, 21 nt, Human
aaaggagcuagguuuuuaaaa

SEQ ID NO: 348581 - RNA, 23 nt, Human
aacaagacccucucagaggccug

SEQ ID NO: 348582 - RNA, 25 nt, Human
aacuacagaggguuuuccagcuauu

SEQ ID NO: 348583 - RNA, 27 nt, Human
aagaaaccaaaauguauagugggcacc

SEQ ID NO: 348584 - RNA, 20 nt, Human
aagcauauuuuucagguuug

SEQ ID NO: 348585 - RNA, 22 nt, Human
aauauuggaaaaaaacuguaca

SEQ ID NO: 348586 - RNA, 19 nt, Human
aaugaaacugagcuacaaa

SEQ ID NO: 348587 - RNA, 20 nt, Human
acaauggaaucuuccaagcc

SEQ ID NO: 348588 - RNA, 21 nt, Human
acaauggaaucuuccaagcca

SEQ ID NO: 348589 - RNA, 23 nt, Human
accucauccuccucuuuccuauc

SEQ ID NO: 348590 - RNA, 19 nt, Human
accuuaagaucuaacacac

SEQ ID NO: 348591 - RNA, 19 nt, Human
acugauuuuaaacuacaga

SEQ ID NO: 348592 - RNA, 24 nt, Human
agacacauucauugauagccaaca

SEQ ID NO: 348593 - RNA, 18 nt, Human
agaguaccaugcgugaaa

SEQ ID NO: 348594 - RNA, 21 nt, Human
aggcagcuuuggaccucuagc

SEQ ID NO: 348595 - RNA, 22 nt, Human
aguaacaucagaucaauucugu

SEQ ID NO: 348596 - RNA, 22 nt, Human
agugcaauaugaaaucuagaac

SEQ ID NO: 348597 - RNA, 27 nt, Human
auuacaauuugaauauacaaucugacu

SEQ ID NO: 348598 - RNA, 21 nt, Human
caauaguaaagagaccauccu

SEQ ID NO: 348599 - RNA, 20 nt, Human
caccuccuuccuucucucuc

SEQ ID NO: 348600 - RNA, 21 nt, Human
caccuccuuccuucucucucc

SEQ ID NO: 348601 - RNA, 21 nt, Human
cagcuuuggaccucuagcgua

SEQ ID NO: 348602 - RNA, 19 nt, Human
cauugauagccaacaaaau

SEQ ID NO: 348603 - RNA, 24 nt, Human
cauuuuauuuucacuuauggacau

SEQ ID NO: 348604 - RNA, 19 nt, Human
ccaccuccuuccuucucuc

SEQ ID NO: 348605 - RNA, 20 nt, Human
ccccagaccucauccuccuc

SEQ ID NO: 348606 - RNA, 20 nt, Human
ccccgcgccgccaccucggc

SEQ ID NO: 348607 - RNA, 18 nt, Human
ccuccuuccuucucucuc

SEQ ID NO: 348608 - RNA, 24 nt, Human
ccugcacaaccaccuccuuccuuc

SEQ ID NO: 348609 - RNA, 19 nt, Human
ccugcauggagcacaagau

SEQ ID NO: 348610 - RNA, 21 nt, Human
ccugcuaauagugaccgcuuc

SEQ ID NO: 348611 - RNA, 19 nt, Human
ccuuccuucucucuccgcc

SEQ ID NO: 348612 - RNA, 20 nt, Human
ccuuccuucucucuccgccc

SEQ ID NO: 348613 - RNA, 21 nt, Human
gaaaaacaucaagaguaccau

SEQ ID NO: 348614 - RNA, 18 nt, Human
gaacagauucagcuucca

SEQ ID NO: 348615 - RNA, 21 nt, Human
gaccgcuucuacaaugacaau

SEQ ID NO: 348616 - RNA, 20 nt, Human
uaacacacugauauuagucc

SEQ ID NO: 348617 - RNA, 19 nt, Human
uaacuaccuggaagcacua

SEQ ID NO: 348618 - RNA, 22 nt, Human
uaagagacuuacauuuuauaaa

SEQ ID NO: 348619 - RNA, 25 nt, Human
uacaguacaugaauuuagaaauaaa

SEQ ID NO: 348620 - RNA, 20 nt, Human
uaccuuaagaucuaacacac

SEQ ID NO: 348621 - RNA, 23 nt, Human
uaccuuaagaucuaacacacuga

SEQ ID NO: 348622 - RNA, 21 nt, Human
uacuauaacuaccuggaagca

SEQ ID NO: 348623 - RNA, 23 nt, Human
uagaacaagacccucucagaggc

SEQ ID NO: 348624 - RNA, 22 nt, Human
uagccaacaaaauccuugacag

SEQ ID NO: 348625 - RNA, 18 nt, Human
uagugguaauuauacuac

SEQ ID NO: 348626 - RNA, 23 nt, Human
ucaagcacaacacugaaauauug

SEQ ID NO: 348627 - RNA, 22 nt, Human
ucuagaacaagacccucucaga

SEQ ID NO: 348628 - RNA, 26 nt, Human
ucuguaagagacuuacauuuuauaaa

SEQ ID NO: 348629 - RNA, 18 nt, Human
ugaaaugcccagcagcau

SEQ ID NO: 348630 - RNA, 21 nt, Human
ugaauucucucaucacaccuu

SEQ ID NO: 348631 - RNA, 22 nt, Human
ugacagagugaaaaacaucaag

SEQ ID NO: 348632 - RNA, 22 nt, Human
ugagugacccucaaagaaacca

SEQ ID NO: 348633 - RNA, 20 nt, Human
ugcacuggcaguucaagcug

SEQ ID NO: 348634 - RNA, 20 nt, Human
uggaaaaguaugccugcuaa

SEQ ID NO: 348635 - RNA, 24 nt, Human
uggaacaaauuaugcuuauuuaca

SEQ ID NO: 348636 - RNA, 22 nt, Human
uggaagcacuaaguuuuagaca

SEQ ID NO: 348637 - RNA, 20 nt, Human
ugggcaucuuccacauuggg

SEQ ID NO: 348638 - RNA, 23 nt, Human
uguuguagcuguugacauuaagu

SEQ ID NO: 348639 - RNA, 21 nt, Human
uuaaagaaccccagaccucau

SEQ ID NO: 348640 - RNA, 18 nt, Human
uucaagcacaacacugaa

SEQ ID NO: 348641 - RNA, 23 nt, Human
uuccaagccaagccgcuuuccac

SEQ ID NO: 348642 - RNA, 22 nt, Human
uuuaaaaagauaaaguauaucu

SEQ ID NO: 348643 - RNA, 22 nt, Human
uuuuaaaaagauaaaguauauc

SEQ ID NO: 348644 - RNA, 21 nt, Human
uuuucagguuuguuuuugcac

SEQ ID NO: 348645 - RNA, 21 nt, Human
aaacuggaagggguaccccag

SEQ ID NO: 348646 - RNA, 26 nt, Human
aaaugauaaaggccauuuuggaagcc

SEQ ID NO: 348647 - RNA, 21 nt, Human
aaggccauuuuggaagcccac

SEQ ID NO: 348648 - RNA, 22 nt, Human
aaugauaaaggccauuuuggaa

SEQ ID NO: 348649 - RNA, 18 nt, Human
accugaagacacugggau

SEQ ID NO: 348650 - RNA, 24 nt, Human
acuuccggcaacugucagucccgg

SEQ ID NO: 348651 - RNA, 27 nt, Human
acuuugaaaaacacaaugacucagagg

SEQ ID NO: 348652 - RNA, 22 nt, Human
agaaaagaaaucacuuugaaaa

SEQ ID NO: 348653 - RNA, 19 nt, Human
agccccggaaccuucgcug

SEQ ID NO: 348654 - RNA, 21 nt, Human
aggcagguaagccaugucaag

SEQ ID NO: 348655 - RNA, 22 nt, Human
aggggaagaaacaagccuuggg

SEQ ID NO: 348656 - RNA, 20 nt, Human
aguuguuugacuccagcugu

SEQ ID NO: 348657 - RNA, 24 nt, Human
caaaaagcuacagaaaagaaauca

SEQ ID NO: 348658 - RNA, 18 nt, Human
caaagggucuuccucagc

SEQ ID NO: 348659 - RNA, 23 nt, Human
cacaaacuagccccggaaccuuc

SEQ ID NO: 348660 - RNA, 22 nt, Human
cacugggauauucagaaggcca

SEQ ID NO: 348661 - RNA, 26 nt, Human
cacuuugaaaaacacaaugacucaga

SEQ ID NO: 348662 - RNA, 20 nt, Human
caggaaaggagggugacaga

SEQ ID NO: 348663 - RNA, 23 nt, Human
ccagcaauuccaagagcugagga

SEQ ID NO: 348664 - RNA, 24 nt, Human
ccccuugccagcaauuccaagagc

SEQ ID NO: 348665 - RNA, 25 nt, Human
cccgcagccucacuuccggcaacuu

SEQ ID NO: 348666 - RNA, 24 nt, Human
ccuuucagcucuaaccacuucacc

SEQ ID NO: 348667 - RNA, 23 nt, Human
cuaaccacuucacccaacugcaa

SEQ ID NO: 348668 - RNA, 23 nt, Human
cuagccccggaaccuucgcuguu

SEQ ID NO: 348669 - RNA, 22 nt, Human
cucuuaccuaugaaccuuacga

SEQ ID NO: 348670 - RNA, 20 nt, Human
cugaaacacaaacuagcccc

SEQ ID NO: 348671 - RNA, 23 nt, Human
cuuccggcaacugucagucccgg

SEQ ID NO: 348672 - RNA, 23 nt, Human
cuuucagcucuaaccacuucacc

SEQ ID NO: 348673 - RNA, 19 nt, Human
gaagaaacaagccuugggg

SEQ ID NO: 348674 - RNA, 22 nt, Human
gacacugggauauucagaaggc

SEQ ID NO: 348675 - RNA, 23 nt, Human
gccccggaaccuucgcuguucuc

SEQ ID NO: 348676 - RNA, 21 nt, Human
gucuuccucagcgcgaaaucg

SEQ ID NO: 348677 - RNA, 27 nt, Human
guucaaauugcugagaucuuaggucaa

SEQ ID NO: 348678 - RNA, 19 nt, Human
uaggucaaaaagcuacaga

SEQ ID NO: 348679 - RNA, 24 nt, Human
ucugaaacacaaacuagccccgga

SEQ ID NO: 348680 - RNA, 25 nt, Human
ugaaaaacacaaugacucagaggca

SEQ ID NO: 348681 - RNA, 24 nt, Human
ugaaacacaaacuagccccggaac

SEQ ID NO: 348682 - RNA, 18 nt, Human
ugcugggagugaaggcag

SEQ ID NO: 348683 - RNA, 24 nt, Human
ugcugggagugaaggcagguaagc

SEQ ID NO: 348684 - RNA, 20 nt, Human
uggaagggguaccccaggug

SEQ ID NO: 348685 - RNA, 19 nt, Human
uggaagucugaaacacaaa

SEQ ID NO: 348686 - RNA, 22 nt, Human
uggaagucugaaacacaaacua

SEQ ID NO: 348687 - RNA, 18 nt, Human
uggaauggggugcagaag

SEQ ID NO: 348688 - RNA, 20 nt, Human
uggaauggggugcagaaguc

SEQ ID NO: 348689 - RNA, 22 nt, Human
ugggaagcaaggggaaaacugg

SEQ ID NO: 348690 - RNA, 28 nt, Human
uuacaggggaagaaacaagccuugggug

SEQ ID NO: 348691 - RNA, 20 nt, Human
uugaaaaacacaaugacuca

SEQ ID NO: 348692 - RNA, 22 nt, Human
uugaaaaacacaaugacucaga

SEQ ID NO: 348693 - RNA, 24 nt, Human
uuugacuccagcuguccccccagg

SEQ ID NO: 348694 - RNA, 21 nt, Human
aaaaaaacuccacuacaugcc

SEQ ID NO: 348695 - RNA, 21 nt, Human
aaacaauacuaacaacuggua

SEQ ID NO: 348696 - RNA, 19 nt, Human
aaacaggaagccuguaaac

SEQ ID NO: 348697 - RNA, 23 nt, Human
aacugccaccauuuugaguuuuc

SEQ ID NO: 348698 - RNA, 21 nt, Human
aagaagcauggcgagacaaac

SEQ ID NO: 348699 - RNA, 18 nt, Human
accauuuugaguuuuccg

SEQ ID NO: 348700 - RNA, 20 nt, Human
acugccaccauuuugaguuu

SEQ ID NO: 348701 - RNA, 21 nt, Human
agagccagcugaugagaaaau

SEQ ID NO: 348702 - RNA, 22 nt, Human
aggauccacuuaaaaaaaugac

SEQ ID NO: 348703 - RNA, 23 nt, Human
auaagauguuaaaaaaaaauuua

SEQ ID NO: 348704 - RNA, 25 nt, Human
auccagaagcaauaaaauguggagg

SEQ ID NO: 348705 - RNA, 24 nt, Human
cacucuaaaaaguacuaccuucac

SEQ ID NO: 348706 - RNA, 21 nt, Human
cagcugaugagaaaauaacgc

SEQ ID NO: 348707 - RNA, 26 nt, Human
caucccaaucauucaaauccauccag

SEQ ID NO: 348708 - RNA, 22 nt, Human
ccagcugaugagaaaauaacgc

SEQ ID NO: 348709 - RNA, 21 nt, Human
ccauccagcuauuuugcagcu

SEQ ID NO: 348710 - RNA, 21 nt, Human
ccuuauucccaauaaaaguaa

SEQ ID NO: 348711 - RNA, 27 nt, Human
cgugcuacaacacauucaagaucuacc

SEQ ID NO: 348712 - RNA, 22 nt, Human
cuacaacacauucaagaucuac

SEQ ID NO: 348713 - RNA, 22 nt, Human
gcuacaacacauucaagaucua

SEQ ID NO: 348714 - RNA, 20 nt, Human
gguaauaagaacugccacca

SEQ ID NO: 348715 - RNA, 19 nt, Human
guacacacaaacauaaagc

SEQ ID NO: 348716 - RNA, 19 nt, Human
uaaagaagcauggcgagac

SEQ ID NO: 348717 - RNA, 22 nt, Human
uaaagcaaguguucuaacaguu

SEQ ID NO: 348718 - RNA, 18 nt, Human
uaagauguuaaaaaaaaa

SEQ ID NO: 348719 - RNA, 26 nt, Human
uaauuacaugauuucacauccagaag

SEQ ID NO: 348720 - RNA, 24 nt, Human
uacaacaaauucaugaucagagcc

SEQ ID NO: 348721 - RNA, 23 nt, Human
uaccuucacacucuuagucaagu

SEQ ID NO: 348722 - RNA, 26 nt, Human
uauauaacagcagaaauaauuacaug

SEQ ID NO: 348723 - RNA, 23 nt, Human
uauguacacacaaacauaaagca

SEQ ID NO: 348724 - RNA, 22 nt, Human
ucaguuaagguuuuccguuggu

SEQ ID NO: 348725 - RNA, 21 nt, Human
ucauucaaauccauccagcua

SEQ ID NO: 348726 - RNA, 19 nt, Human
ucuguaagcccuuaauugc

SEQ ID NO: 348727 - RNA, 18 nt, Human
ugagaaaauaacgcaucc

SEQ ID NO: 348728 - RNA, 19 nt, Human
ugagaaaauaacgcaucca

SEQ ID NO: 348729 - RNA, 25 nt, Human
ugcacucagugcacucuaaaaagua

SEQ ID NO: 348730 - RNA, 22 nt, Human
uggcaagcaguuuccagaaaca

SEQ ID NO: 348731 - RNA, 21 nt, Human
uucccaauaaaaguaaaaaaa

SEQ ID NO: 348732 - RNA, 23 nt, Human
uucgugcuacaacacauucaaga

SEQ ID NO: 348733 - RNA, 24 nt, Human
uuucuuaaaugcacugaguacaac

SEQ ID NO: 348734 - RNA, 19 nt, Human
aaaaaaaaaaaaccccaaa

SEQ ID NO: 348735 - RNA, 19 nt, Human
aaaaaaaaaaaaccccaaa

SEQ ID NO: 348736 - RNA, 26 nt, Human
aaaaaaaccccaaaacgaaaaacaaa

SEQ ID NO: 348737 - RNA, 24 nt, Human
aaaaaccccaaaacgaaaaacaaa

SEQ ID NO: 348738 - RNA, 21 nt, Human
aaaaccccaaaacgaaaaaca

SEQ ID NO: 348739 - RNA, 19 nt, Human
accccaaaacgaaaaacaa

SEQ ID NO: 348740 - RNA, 20 nt, Human
accccaaaacgaaaaacaaa

SEQ ID NO: 348741 - RNA, 21 nt, Human
acccuggcuccgccgcccacu

SEQ ID NO: 348742 - RNA, 23 nt, Human
auagccuuguugccacgagacag

SEQ ID NO: 348743 - RNA, 19 nt, Human
cacgagacaggacacagga

SEQ ID NO: 348744 - RNA, 23 nt, Human
ccaaaacgaaaaacaaauucaca

SEQ ID NO: 348745 - RNA, 19 nt, Human
uccagggacccuggcuccg

SEQ ID NO: 348746 - RNA, 22 nt, Human
ugccacgagacaggacacagga

SEQ ID NO: 348747 - RNA, 21 nt, Human
uuuuuuuuuuuuuaaagggua

SEQ ID NO: 348748 - RNA, 23 nt, Human
uuuuuuuuuuuuuuuuuaaaggg

SEQ ID NO: 348749 - RNA, 23 nt, Human
acaccuugugauugucaccaacc

SEQ ID NO: 348750 - RNA, 22 nt, Human
agccagccccuguucugagcaa

SEQ ID NO: 348751 - RNA, 18 nt, Human
agccugaaggggcagcgc

SEQ ID NO: 348752 - RNA, 19 nt, Human
agccugaaggggcagcgcu

SEQ ID NO: 348753 - RNA, 18 nt, Human
aggugggaagggccgggu

SEQ ID NO: 348754 - RNA, 21 nt, Human
caaccaggugggaagggccgg

SEQ ID NO: 348755 - RNA, 21 nt, Human
cagcauaacuccaaaggacua

SEQ ID NO: 348756 - RNA, 18 nt, Human
cagcgcugaggcuccugg

SEQ ID NO: 348757 - RNA, 21 nt, Human
ccaggugggaagggccgggug

SEQ ID NO: 348758 - RNA, 19 nt, Human
cggguggcaaggagagggu

SEQ ID NO: 348759 - RNA, 21 nt, Human
cuccaaaggacuaaacugugg

SEQ ID NO: 348760 - RNA, 22 nt, Human
cuccaaaggacuaaacuguggg

SEQ ID NO: 348761 - RNA, 18 nt, Human
cugagcaagcugguaccg

SEQ ID NO: 348762 - RNA, 23 nt, Human
cugguaacuacaggucauuuucc

SEQ ID NO: 348763 - RNA, 19 nt, Human
uacgugauguggggaauuu

SEQ ID NO: 348764 - RNA, 23 nt, Human
ucugagcaagcugguaccgucuu

SEQ ID NO: 348765 - RNA, 18 nt, Human
ugggaagggccggguggc

SEQ ID NO: 348766 - RNA, 19 nt, Human
ugggaagggccggguggca

SEQ ID NO: 348767 - RNA, 22 nt, Human
ugucccuggcaacuucuacacu

SEQ ID NO: 348768 - RNA, 22 nt, Human
aguaucauggaaguaaaaugga

SEQ ID NO: 348769 - RNA, 19 nt, Human
aucagucuuguuggaagcu

SEQ ID NO: 348770 - RNA, 23 nt, Human
caggauuugcacagagaccaguu

SEQ ID NO: 348771 - RNA, 23 nt, Human
uagaagagcagcccugaaccuug

SEQ ID NO: 348772 - RNA, 21 nt, Human
uaucauggaaguaaaauggaa

SEQ ID NO: 348773 - RNA, 18 nt, Human
ucacauauuuauaaaaau

SEQ ID NO: 348774 - RNA, 22 nt, Human
aaaaagcacaauacaaauagca

SEQ ID NO: 348775 - RNA, 22 nt, Human
aaggaguaggaggccaccauag

SEQ ID NO: 348776 - RNA, 18 nt, Human
agaaggaaggggcggggc

SEQ ID NO: 348777 - RNA, 21 nt, Human
agaaggaaggggcggggcggg

SEQ ID NO: 348778 - RNA, 20 nt, Human
aggaaggggcggggcggggu

SEQ ID NO: 348779 - RNA, 26 nt, Human
aggaaggggcggggcggggugggggg

SEQ ID NO: 348780 - RNA, 22 nt, Human
aggggcggggcggggugggggg

SEQ ID NO: 348781 - RNA, 19 nt, Human
auagaucuggggaacagaa

SEQ ID NO: 348782 - RNA, 18 nt, Human
auagcaguucaaaaugga

SEQ ID NO: 348783 - RNA, 23 nt, Human
augccagauuacaacugccuagc

SEQ ID NO: 348784 - RNA, 19 nt, Human
caaguaaaaagcacaauac

SEQ ID NO: 348785 - RNA, 23 nt, Human
ccaaaccuuucaaagaaccacac

SEQ ID NO: 348786 - RNA, 21 nt, Human
cuuauuaacauugaagacgac

SEQ ID NO: 348787 - RNA, 19 nt, Human
gcggggcgggguggggggc

SEQ ID NO: 348788 - RNA, 19 nt, Human
ggaguaggaggccaccaua

SEQ ID NO: 348789 - RNA, 18 nt, Human
gggaacagaaggaagggg

SEQ ID NO: 348790 - RNA, 21 nt, Human
gggaacagaaggaaggggccg

SEQ ID NO: 348791 - RNA, 27 nt, Human
uaaaaaaccaaaccuuucaaagaacca

SEQ ID NO: 348792 - RNA, 20 nt, Human
uaaaaagcacaauacaaaua

SEQ ID NO: 348793 - RNA, 24 nt, Human
uaaaucgacaaaaaaaagguugaa

SEQ ID NO: 348794 - RNA, 21 nt, Human
uaggaggccaccauaggucgc

SEQ ID NO: 348795 - RNA, 23 nt, Human
uaguccaaaauacagaagaccaa

SEQ ID NO: 348796 - RNA, 19 nt, Human
uaguucauagaucugggga

SEQ ID NO: 348797 - RNA, 21 nt, Human
uccaaaauacagaagaccaaa

SEQ ID NO: 348798 - RNA, 22 nt, Human
uguacagaaacuuauuaacauu

SEQ ID NO: 348799 - RNA, 21 nt, Human
uuaaaucuguuuugaaagauu

SEQ ID NO: 348800 - RNA, 18 nt, Human
uuagaacucuaaaguuga

SEQ ID NO: 348801 - RNA, 20 nt, Human
aaacuagaagcauacuagug

SEQ ID NO: 348802 - RNA, 19 nt, Human
aaagagcagcagguacaga

SEQ ID NO: 348803 - RNA, 19 nt, Human
aaggaaaauacaaggggcc

SEQ ID NO: 348804 - RNA, 21 nt, Human
acacagacucucucucucucu

SEQ ID NO: 348805 - RNA, 20 nt, Human
acuacaacucauuacaagac

SEQ ID NO: 348806 - RNA, 20 nt, Human
acuacagaaaagccacuagg

SEQ ID NO: 348807 - RNA, 22 nt, Human
acuacagaaaagccacuaggga

SEQ ID NO: 348808 - RNA, 27 nt, Human
agaaaaagacaaaaucagggcucaaag

SEQ ID NO: 348809 - RNA, 21 nt, Human
agagaaaaagacaaaaucagg

SEQ ID NO: 348810 - RNA, 20 nt, Human
agagaggagggggaagaagg

SEQ ID NO: 348811 - RNA, 20 nt, Human
agaguugggagagggagggg

SEQ ID NO: 348812 - RNA, 22 nt, Human
agaguugggagagggaggggca

SEQ ID NO: 348813 - RNA, 20 nt, Human
agcagaaaggucaccccaga

SEQ ID NO: 348814 - RNA, 23 nt, Human
aggagagaggagggggaagaagg

SEQ ID NO: 348815 - RNA, 24 nt, Human
aggaggggggcugucuucuccuug

SEQ ID NO: 348816 - RNA, 21 nt, Human
agggaggacgccaccuggagc

SEQ ID NO: 348817 - RNA, 21 nt, Human
agguacaaagaaugaggaggg

SEQ ID NO: 348818 - RNA, 22 nt, Human
agguggagcuggaauuccaggg

SEQ ID NO: 348819 - RNA, 19 nt, Human
augaaugagaagcuggaga

SEQ ID NO: 348820 - RNA, 20 nt, Human
augucacuauuagcccaaaa

SEQ ID NO: 348821 - RNA, 19 nt, Human
caaagacacaagccccagc

SEQ ID NO: 348822 - RNA, 21 nt, Human
caaagacacaagccccagccu

SEQ ID NO: 348823 - RNA, 23 nt, Human
caauagcaaaacccucacucucu

SEQ ID NO: 348824 - RNA, 18 nt, Human
cacuauuagcccaaaaga

SEQ ID NO: 348825 - RNA, 25 nt, Human
cacucucuccuccucagaacuccug

SEQ ID NO: 348826 - RNA, 20 nt, Human
cacugccuugggugcaggag

SEQ ID NO: 348827 - RNA, 21 nt, Human
cagccacaguuccuaggccaa

SEQ ID NO: 348828 - RNA, 23 nt, Human
caggaaugccacauacugguucu

SEQ ID NO: 348829 - RNA, 21 nt, Human
cagguacaaagaaugaggagg

SEQ ID NO: 348830 - RNA, 19 nt, Human
ccagacaaugacaaagaca

SEQ ID NO: 348831 - RNA, 25 nt, Human
ccagacaaugacaaagacacaagcc

SEQ ID NO: 348832 - RNA, 21 nt, Human
ccagagacagcugccagcccu

SEQ ID NO: 348833 - RNA, 20 nt, Human
cccaccagcugagcagaaag

SEQ ID NO: 348834 - RNA, 20 nt, Human
cccuggaucccauuguugga

SEQ ID NO: 348835 - RNA, 23 nt, Human
ccuacagcuugaggagaagccau

SEQ ID NO: 348836 - RNA, 23 nt, Human
ccuccagagacagcugccagccc

SEQ ID NO: 348837 - RNA, 19 nt, Human
ccucuuggcaagaaaucag

SEQ ID NO: 348838 - RNA, 19 nt, Human
ccuugggugcaggaggcug

SEQ ID NO: 348839 - RNA, 21 nt, Human
cgcccccuuuuuuucuucagc

SEQ ID NO: 348840 - RNA, 23 nt, Human
cuccagagacagcugccagcccu

SEQ ID NO: 348841 - RNA, 20 nt, Human
cucucucucuuucucucuca

SEQ ID NO: 348842 - RNA, 23 nt, Human
cucucucucuuucucucucaauc

SEQ ID NO: 348843 - RNA, 18 nt, Human
cuucccagccacaguucc

SEQ ID NO: 348844 - RNA, 21 nt, Human
cuuccuucauuucucccuacu

SEQ ID NO: 348845 - RNA, 24 nt, Human
cuuggagugguaguggagguggag

SEQ ID NO: 348846 - RNA, 18 nt, Human
gaccagccaaaaccuuua

SEQ ID NO: 348847 - RNA, 20 nt, Human
gagagggaggggcaacgcuc

SEQ ID NO: 348848 - RNA, 22 nt, Human
gagcagaaaggucaccccagag

SEQ ID NO: 348849 - RNA, 19 nt, Human
gagguggagcuggaauucc

SEQ ID NO: 348850 - RNA, 18 nt, Human
gaguugggagagggaggg

SEQ ID NO: 348851 - RNA, 21 nt, Human
gcacaguaauuuccaagcuca

SEQ ID NO: 348852 - RNA, 21 nt, Human
gcacugggcccuccagagaca

SEQ ID NO: 348853 - RNA, 22 nt, Human
ggaaaucccccaugaucccugg

SEQ ID NO: 348854 - RNA, 20 nt, Human
ggaauuccagggcuucaugg

SEQ ID NO: 348855 - RNA, 19 nt, Human
ggagaagccaucguucaag

SEQ ID NO: 348856 - RNA, 21 nt, Human
ggagaggagagaggaggggga

SEQ ID NO: 348857 - RNA, 21 nt, Human
ggaggaagaaggaauguacag

SEQ ID NO: 348858 - RNA, 21 nt, Human
ggagguggagcuggaauucca

SEQ ID NO: 348859 - RNA, 22 nt, Human
gggggcugucuucuccuuggcu

SEQ ID NO: 348860 - RNA, 21 nt, Human
gguacaaagaaugaggaggga

SEQ ID NO: 348861 - RNA, 20 nt, Human
ggugcaccuaccaaagggaa

SEQ ID NO: 348862 - RNA, 20 nt, Human
guaccggcaccuucuggagc

SEQ ID NO: 348863 - RNA, 21 nt, Human
guggggccaggcuuggagugg

SEQ ID NO: 348864 - RNA, 23 nt, Human
guucuugacucucucucuuucuc

SEQ ID NO: 348865 - RNA, 25 nt, Human
uaagaaccagacaaugacaaagaca

SEQ ID NO: 348866 - RNA, 21 nt, Human
uacaaagaaugaggagggaag

SEQ ID NO: 348867 - RNA, 21 nt, Human
uacaacucauuacaagacgga

SEQ ID NO: 348868 - RNA, 20 nt, Human
uacaaggggccagggaauag

SEQ ID NO: 348869 - RNA, 21 nt, Human
uacaguuugcuacuucuuguc

SEQ ID NO: 348870 - RNA, 20 nt, Human
uagaaagauaggggacccau

SEQ ID NO: 348871 - RNA, 21 nt, Human
uagaaagauaggggacccaua

SEQ ID NO: 348872 - RNA, 24 nt, Human
uagaaagauaggggacccauaccc

SEQ ID NO: 348873 - RNA, 20 nt, Human
uagcaaaacccucacucucu

SEQ ID NO: 348874 - RNA, 22 nt, Human
uagcccaaaagaauauuaacga

SEQ ID NO: 348875 - RNA, 20 nt, Human
uaggaggggggcugucuucu

SEQ ID NO: 348876 - RNA, 24 nt, Human
ucagggcucauaacucugggaggu

SEQ ID NO: 348877 - RNA, 22 nt, Human
ucccagccacaguuccuaggcc

SEQ ID NO: 348878 - RNA, 19 nt, Human
ucccuuacaucaugucccu

SEQ ID NO: 348879 - RNA, 18 nt, Human
uccuaggguugggucacc

SEQ ID NO: 348880 - RNA, 19 nt, Human
uccugggagaccucuuggc

SEQ ID NO: 348881 - RNA, 24 nt, Human
uccuuaacucucucaucauuaguu

SEQ ID NO: 348882 - RNA, 22 nt, Human
uccuuagggggccauccccuug

SEQ ID NO: 348883 - RNA, 18 nt, Human
ucgucucccccuuggguc

SEQ ID NO: 348884 - RNA, 22 nt, Human
ucucucucugauucucuguucu

SEQ ID NO: 348885 - RNA, 26 nt, Human
ucucucucugauucucuguucuugac

SEQ ID NO: 348886 - RNA, 20 nt, Human
ucugcacacuaugucacuau

SEQ ID NO: 348887 - RNA, 20 nt, Human
ucuguucuugacucucucuc

SEQ ID NO: 348888 - RNA, 24 nt, Human
ucuucagcuucuucccuacgcuuc

SEQ ID NO: 348889 - RNA, 18 nt, Human
ugaaagaggaagauaagg

SEQ ID NO: 348890 - RNA, 23 nt, Human
ugaaagaggaagauaaggaaaau

SEQ ID NO: 348891 - RNA, 21 nt, Human
ugaccuggucucgucuccccc

SEQ ID NO: 348892 - RNA, 26 nt, Human
ugacucucucucuuucucucucaaag

SEQ ID NO: 348893 - RNA, 25 nt, Human
ugagaagcuggagaggucuuggcac

SEQ ID NO: 348894 - RNA, 18 nt, Human
ugaucccugguacaccuc

SEQ ID NO: 348895 - RNA, 21 nt, Human
ugaugggcuucucaggcacug

SEQ ID NO: 348896 - RNA, 21 nt, Human
uggagcaucuucaguaccggc

SEQ ID NO: 348897 - RNA, 21 nt, Human
uggagguggagcuggaauucc

SEQ ID NO: 348898 - RNA, 20 nt, Human
uggcaagaaaucagcuuguu

SEQ ID NO: 348899 - RNA, 23 nt, Human
uggcacacugaccagccaaaacu

SEQ ID NO: 348900 - RNA, 18 nt, Human
ugggagguccuuuuguga

SEQ ID NO: 348901 - RNA, 22 nt, Human
ugggagguccuuuugugaagcu

SEQ ID NO: 348902 - RNA, 23 nt, Human
ugggugcaggaggcugaaauagg

SEQ ID NO: 348903 - RNA, 19 nt, Human
ugguggggccaggcuugga

SEQ ID NO: 348904 - RNA, 22 nt, Human
uguaagcacaguaauuuccaag

SEQ ID NO: 348905 - RNA, 24 nt, Human
uucaucaaccaugcugaccaaaaa

SEQ ID NO: 348906 - RNA, 24 nt, Human
uucaugggcaggccauuugacagg

SEQ ID NO: 348907 - RNA, 21 nt, Human
uuccuuaacucucucaucauu

SEQ ID NO: 348908 - RNA, 18 nt, Human
uuccuuagggggccaucc

SEQ ID NO: 348909 - RNA, 22 nt, Human
uucucaggcacugccuugggug

SEQ ID NO: 348910 - RNA, 21 nt, Human
uugacauuuuacuagguuagg

SEQ ID NO: 348911 - RNA, 22 nt, Human
uuggcacacugaccagccaaaa

SEQ ID NO: 348912 - RNA, 20 nt, Human
uuuccaagcucagggacuac

SEQ ID NO: 348913 - RNA, 22 nt, Human
aaaaaaaaaaaaccuggaaaag

SEQ ID NO: 348914 - RNA, 21 nt, Human
aaaaaauagaaucacuuuccu

SEQ ID NO: 348915 - RNA, 19 nt, Human
aaacaaaugcuacaauacu

SEQ ID NO: 348916 - RNA, 24 nt, Human
aaacagccugagagaccaaauucu

SEQ ID NO: 348917 - RNA, 19 nt, Human
aaagacuggcuaaaaucug

SEQ ID NO: 348918 - RNA, 18 nt, Human
aaaggaacagcucuacag

SEQ ID NO: 348919 - RNA, 21 nt, Human
aacagcggcuggcucggaccc

SEQ ID NO: 348920 - RNA, 19 nt, Human
aacccacagauuucuagcu

SEQ ID NO: 348921 - RNA, 26 nt, Human
aacccauucuauaauuaacuccucca

SEQ ID NO: 348922 - RNA, 20 nt, Human
aaccuagcuuaccacagugg

SEQ ID NO: 348923 - RNA, 18 nt, Human
aagagcacaugucaccac

SEQ ID NO: 348924 - RNA, 23 nt, Human
aagagcacaugucaccacuccac

SEQ ID NO: 348925 - RNA, 23 nt, Human
aaggagaaaaaauguaaaaaaaa

SEQ ID NO: 348926 - RNA, 19 nt, Human
aaucugcuacacauuccuu

SEQ ID NO: 348927 - RNA, 20 nt, Human
aauguaaaaaaaagagcucc

SEQ ID NO: 348928 - RNA, 22 nt, Human
aaugucccccagaaucugugca

SEQ ID NO: 348929 - RNA, 24 nt, Human
acaauuucauaucaaaaaaaaaaa

SEQ ID NO: 348930 - RNA, 21 nt, Human
acccaaaugagcucuggccuc

SEQ ID NO: 348931 - RNA, 18 nt, Human
acccggcaaauccugcca

SEQ ID NO: 348932 - RNA, 24 nt, Human
acccggcaaauccugccagcuucc

SEQ ID NO: 348933 - RNA, 20 nt, Human
acgaaaugcaugcacuuccc

SEQ ID NO: 348934 - RNA, 18 nt, Human
acuacggccugaggggcu

SEQ ID NO: 348935 - RNA, 18 nt, Human
agaauaaagacauccucc

SEQ ID NO: 348936 - RNA, 22 nt, Human
agagacaggugagcucagggga

SEQ ID NO: 348937 - RNA, 20 nt, Human
agagcccuuaagcuguuaac

SEQ ID NO: 348938 - RNA, 21 nt, Human
agcucaggggagcuucucuca

SEQ ID NO: 348939 - RNA, 23 nt, Human
aggaaugaaccuagcuuaccaca

SEQ ID NO: 348940 - RNA, 24 nt, Human
aggcagucagagagacaggugagc

SEQ ID NO: 348941 - RNA, 26 nt, Human
agugacaagggacaaauaggggaaaa

SEQ ID NO: 348942 - RNA, 19 nt, Human
auacugagucuuuacugcc

SEQ ID NO: 348943 - RNA, 21 nt, Human
auccagcuauguuugcuaaua

SEQ ID NO: 348944 - RNA, 21 nt, Human
auccugccagcuuccaagucc

SEQ ID NO: 348945 - RNA, 24 nt, Human
augcaugcacuucccacauauaua

SEQ ID NO: 348946 - RNA, 20 nt, Human
auuaguuuaaaaaaaaaaaa

SEQ ID NO: 348947 - RNA, 23 nt, Human
caaaaguauaaaagcaaagacug

SEQ ID NO: 348948 - RNA, 23 nt, Human
caaagagcugcccuauguauaac

SEQ ID NO: 348949 - RNA, 21 nt, Human
caaauccugccagcuuccaag

SEQ ID NO: 348950 - RNA, 25 nt, Human
caaauccugccagcuuccaaguccc

SEQ ID NO: 348951 - RNA, 22 nt, Human
caacaaagugacaagggacaaa

SEQ ID NO: 348952 - RNA, 22 nt, Human
caacaauaacccauucuauaau

SEQ ID NO: 348953 - RNA, 24 nt, Human
caacuaaagaacaaugccuccuuc

SEQ ID NO: 348954 - RNA, 23 nt, Human
caauuucauaucaaaaaaaaaaa

SEQ ID NO: 348955 - RNA, 19 nt, Human
cacauguggcacuaggaaa

SEQ ID NO: 348956 - RNA, 22 nt, Human
cacucugauaaaacagaaugag

SEQ ID NO: 348957 - RNA, 23 nt, Human
cagcagcacccgggaccgccagc

SEQ ID NO: 348958 - RNA, 23 nt, Human
cagcaggaguaaguuuacccaaa

SEQ ID NO: 348959 - RNA, 26 nt, Human
cagccugagagaccaaauucugcaaa

SEQ ID NO: 348960 - RNA, 20 nt, Human
caguaugugacacgagagau

SEQ ID NO: 348961 - RNA, 21 nt, Human
caguaugugacacgagagaug

SEQ ID NO: 348962 - RNA, 21 nt, Human
cagucagagagacaggugagc

SEQ ID NO: 348963 - RNA, 22 nt, Human
cauccucccaacuuuucaucuc

SEQ ID NO: 348964 - RNA, 20 nt, Human
ccaggauacugaccugcacc

SEQ ID NO: 348965 - RNA, 27 nt, Human
cccaacuuuucaucuccuaucuccaau

SEQ ID NO: 348966 - RNA, 20 nt, Human
cccagaaucugugcaaaagu

SEQ ID NO: 348967 - RNA, 19 nt, Human
cccaucacccaaguaggga

SEQ ID NO: 348968 - RNA, 24 nt, Human
cccaugauggcauacagcuuuacc

SEQ ID NO: 348969 - RNA, 18 nt, Human
cccuauguauaacccaca

SEQ ID NO: 348970 - RNA, 23 nt, Human
ccggcaaaacagcggcuggcucu

SEQ ID NO: 348971 - RNA, 22 nt, Human
ccugcaccagcacguggggcag

SEQ ID NO: 348972 - RNA, 20 nt, Human
cgggguucugccccuuuucu

SEQ ID NO: 348973 - RNA, 27 nt, Human
cuaaccagcagcacccgggaccgccag

SEQ ID NO: 348974 - RNA, 22 nt, Human
cucaacucuuuuaugaggucaa

SEQ ID NO: 348975 - RNA, 19 nt, Human
cuccacagugaacaaucug

SEQ ID NO: 348976 - RNA, 18 nt, Human
cugccacaacugcaaggc

SEQ ID NO: 348977 - RNA, 22 nt, Human
cuggcuaaaaucuguaacuuca

SEQ ID NO: 348978 - RNA, 23 nt, Human
cuucccacauauauacuucacug

SEQ ID NO: 348979 - RNA, 18 nt, Human
gaaaacgaaaaaggaagg

SEQ ID NO: 348980 - RNA, 22 nt, Human
gaacaaucugcuacacauuccu

SEQ ID NO: 348981 - RNA, 21 nt, Human
gacaugguuggagagcuuucc

SEQ ID NO: 348982 - RNA, 24 nt, Human
gaccugcaccagcacguggggcag

SEQ ID NO: 348983 - RNA, 24 nt, Human
gagaaagacaauuucauaucaaaa

SEQ ID NO: 348984 - RNA, 22 nt, Human
gauaacugaaaacgaaaaagga

SEQ ID NO: 348985 - RNA, 23 nt, Human
gccccuuuucuaguucucugugc

SEQ ID NO: 348986 - RNA, 20 nt, Human
gcuccucacagcagcuucuu

SEQ ID NO: 348987 - RNA, 19 nt, Human
ggaagcugugaauaggauc

SEQ ID NO: 348988 - RNA, 21 nt, Human
ggcaaaacagcggcuggcucg

SEQ ID NO: 348989 - RNA, 22 nt, Human
ggcucggacccucccucagagc

SEQ ID NO: 348990 - RNA, 18 nt, Human
guauaaaagcaaagacug

SEQ ID NO: 348991 - RNA, 19 nt, Human
uaaaugacuguuuuacuuu

SEQ ID NO: 348992 - RNA, 27 nt, Human
uaacaacaauaacccauucuauaauua

SEQ ID NO: 348993 - RNA, 21 nt, Human
uaagaauaacaacaauaaccc

SEQ ID NO: 348994 - RNA, 18 nt, Human
uacaaggugcugauccug

SEQ ID NO: 348995 - RNA, 22 nt, Human
uacagcuuuacccggcaaaucc

SEQ ID NO: 348996 - RNA, 21 nt, Human
uaggggaaaaaaaaaauuaag

SEQ ID NO: 348997 - RNA, 24 nt, Human
uaguucauucacuguuagcuagau

SEQ ID NO: 348998 - RNA, 20 nt, Human
uauauacuucacugagccuu

SEQ ID NO: 348999 - RNA, 25 nt, Human
uaucaaaaaaaaaaaaaaaaaaacc

SEQ ID NO: 349000 - RNA, 25 nt, Human
uaugcacucugauaaaacagaauga

SEQ ID NO: 349001 - RNA, 19 nt, Human
uaugggggaccuuuaacca

SEQ ID NO: 349002 - RNA, 21 nt, Human
ucaaaaaaaaaaaaaaaaaaa

SEQ ID NO: 349003 - RNA, 23 nt, Human
ucaacucacagaauuaagagccc

SEQ ID NO: 349004 - RNA, 19 nt, Human
ucauaggagauauaucuuu

SEQ ID NO: 349005 - RNA, 26 nt, Human
ucauaucaaaaaaaaaaaaaaaaaaa

SEQ ID NO: 349006 - RNA, 26 nt, Human
ucauuaguuuaaaaaaaaaaaagaaa

SEQ ID NO: 349007 - RNA, 25 nt, Human
ucccaaacagccugagagaccaaau

SEQ ID NO: 349008 - RNA, 21 nt, Human
uccgaacagagaaguaugggg

SEQ ID NO: 349009 - RNA, 23 nt, Human
uccuccggcaaaacagcggcugg

SEQ ID NO: 349010 - RNA, 20 nt, Human
uccuucaccccaguaauguu

SEQ ID NO: 349011 - RNA, 20 nt, Human
ucucaacgccagacaugguu

SEQ ID NO: 349012 - RNA, 19 nt, Human
ucuccgaacagagaaguau

SEQ ID NO: 349013 - RNA, 22 nt, Human
ucucugugcacaagguuaugcc

SEQ ID NO: 349014 - RNA, 26 nt, Human
ucucugugcacaagguuaugccaccu

SEQ ID NO: 349015 - RNA, 21 nt, Human
ucugccccuuuucuaguucuc

SEQ ID NO: 349016 - RNA, 18 nt, Human
ugaaguaucuaaauguca

SEQ ID NO: 349017 - RNA, 19 nt, Human
ugaauacauuuuucaugga

SEQ ID NO: 349018 - RNA, 19 nt, Human
ugaggucaaagucacuuuu

SEQ ID NO: 349019 - RNA, 20 nt, Human
ugaugaggaaugaaccuagc

SEQ ID NO: 349020 - RNA, 24 nt, Human
ugcaacaaagugacaagggacaaa

SEQ ID NO: 349021 - RNA, 18 nt, Human
ugccuccuucaccccagu

SEQ ID NO: 349022 - RNA, 20 nt, Human
ugcuuaggauacagauugac

SEQ ID NO: 349023 - RNA, 24 nt, Human
uggaaugcuauaaaauuaaucccc

SEQ ID NO: 349024 - RNA, 20 nt, Human
uggagaagagcacaugucac

SEQ ID NO: 349025 - RNA, 21 nt, Human
uggcuaaaaucuguaacuuca

SEQ ID NO: 349026 - RNA, 22 nt, Human
uggcuaaaaucuguaacuucau

SEQ ID NO: 349027 - RNA, 23 nt, Human
uggcucggacccucccucagagc

SEQ ID NO: 349028 - RNA, 18 nt, Human
uguccugucuuccuauuc

SEQ ID NO: 349029 - RNA, 18 nt, Human
ugugcaaaaguaacugau

SEQ ID NO: 349030 - RNA, 23 nt, Human
uuagaauaaagacauccucccaa

SEQ ID NO: 349031 - RNA, 21 nt, Human
uuauauuaccuaguucauuca

SEQ ID NO: 349032 - RNA, 21 nt, Human
uucagaaaaaugucccccaga

SEQ ID NO: 349033 - RNA, 23 nt, Human
uucaugaggaagcugugaauagg

SEQ ID NO: 349034 - RNA, 23 nt, Human
uugauaacugaaaacgaaaaagg

SEQ ID NO: 349035 - RNA, 26 nt, Human
uuucuuuucaggugccccaugauggc

SEQ ID NO: 349036 - RNA, 24 nt, Human
uuuuuuuuuuuuguuuuaacuuuu

SEQ ID NO: 349037 - RNA, 18 nt, Human
uuuuuuuuuuuuuuuuug

SEQ ID NO: 349038 - RNA, 18 nt, Human
aaaacgcagcagucacca

SEQ ID NO: 349039 - RNA, 21 nt, Human
agaaaaacgcagcagucacca

SEQ ID NO: 349040 - RNA, 20 nt, Human
agaauggauggacagcaugg

SEQ ID NO: 349041 - RNA, 22 nt, Human
agagggcaaggaaggagugugg

SEQ ID NO: 349042 - RNA, 18 nt, Human
aggaaggaguguggccca

SEQ ID NO: 349043 - RNA, 23 nt, Human
agggagcuggggugguguggggg

SEQ ID NO: 349044 - RNA, 20 nt, Human
caacagggugacgaaugagc

SEQ ID NO: 349045 - RNA, 19 nt, Human
caagccauggucccugagc

SEQ ID NO: 349046 - RNA, 22 nt, Human
cacccaacagggugacgaauga

SEQ ID NO: 349047 - RNA, 22 nt, Human
ccauggucccugagcccaagac

SEQ ID NO: 349048 - RNA, 20 nt, Human
ccuaggcuaaggacagggag

SEQ ID NO: 349049 - RNA, 18 nt, Human
ccucagcaaaacagggag

SEQ ID NO: 349050 - RNA, 23 nt, Human
ccugggacccagggccauuuggg

SEQ ID NO: 349051 - RNA, 20 nt, Human
cuccagggcaguggccgggu

SEQ ID NO: 349052 - RNA, 23 nt, Human
cuggcuggguccaggguccuggg

SEQ ID NO: 349053 - RNA, 21 nt, Human
cuggggcagaggaccuccucu

SEQ ID NO: 349054 - RNA, 20 nt, Human
gaaagggcuacaagccaugg

SEQ ID NO: 349055 - RNA, 19 nt, Human
gagcccaagacacuuacag

SEQ ID NO: 349056 - RNA, 21 nt, Human
ggaugguguggcuugcccagu

SEQ ID NO: 349057 - RNA, 25 nt, Human
ggccuaggcuaaggacagggagggc

SEQ ID NO: 349058 - RNA, 20 nt, Human
gggcagaggaccuccucuuu

SEQ ID NO: 349059 - RNA, 23 nt, Human
ggggugguguggggguccugggg

SEQ ID NO: 349060 - RNA, 20 nt, Human
ggugguguggggguccuggg

SEQ ID NO: 349061 - RNA, 23 nt, Human
guccugggacccagggccauuuu

SEQ ID NO: 349062 - RNA, 19 nt, Human
ucacguggggcuuaucaag

SEQ ID NO: 349063 - RNA, 18 nt, Human
ugcccaguggccugagcu

SEQ ID NO: 349064 - RNA, 21 nt, Human
uggaaagggcuacaagccaug

SEQ ID NO: 349065 - RNA, 19 nt, Human
uggacagcaugggaugggg

SEQ ID NO: 349066 - RNA, 22 nt, Human
uggggugguguggggguccugg

SEQ ID NO: 349067 - RNA, 24 nt, Human
ugugagaauggauggacagcaugg

SEQ ID NO: 349068 - RNA, 23 nt, Human
uucuggcuggguccaggguccug

SEQ ID NO: 349069 - RNA, 25 nt, Human
uuuuuuuuuuuucacguggggcuua

SEQ ID NO: 349070 - RNA, 24 nt, Human
uuuuuuuuuuuuuuuucacgugau

SEQ ID NO: 349071 - RNA, 22 nt, Human
uuuuuuuuuuuuuuuuucacgu

SEQ ID NO: 349072 - RNA, 25 nt, Human
uuuuuuuuuuuuuuuuucacguggg

SEQ ID NO: 349073 - RNA, 22 nt, Human
aggcagggccggggcgggaggg

SEQ ID NO: 349074 - RNA, 23 nt, Human
aggcagggccggggcgggagggc

SEQ ID NO: 349075 - RNA, 21 nt, Human
gaaaaaauaaggagggagccg

SEQ ID NO: 349076 - RNA, 21 nt, Human
ggcacguccacuccgagcccg

SEQ ID NO: 349077 - RNA, 18 nt, Human
ggccggggcgggagggcg

SEQ ID NO: 349078 - RNA, 20 nt, Human
ggccggggcgggagggcgcu

SEQ ID NO: 349079 - RNA, 20 nt, Human
uuugaaaaaauaaggaggga

SEQ ID NO: 349080 - RNA, 27 nt, Human
uuuuuuuuuuuuuuuuuuuuuuugggg

SEQ ID NO: 349081 - RNA, 21 nt, Human
aaaaacaccauaggaccacca

SEQ ID NO: 349082 - RNA, 22 nt, Human
aaaaacaccauaggaccaccaa

SEQ ID NO: 349083 - RNA, 23 nt, Human
aaacaccauaggaccaccaagcu

SEQ ID NO: 349084 - RNA, 27 nt, Human
aaggaaaauacaguauuaucuguaauc

SEQ ID NO: 349085 - RNA, 19 nt, Human
accaagcuauuucuauugc

SEQ ID NO: 349086 - RNA, 26 nt, Human
aguacuuccccaaggaagcucacacu

SEQ ID NO: 349087 - RNA, 20 nt, Human
auacuuccaaaaacaccaua

SEQ ID NO: 349088 - RNA, 22 nt, Human
augaaaaucaacauucauaaua

SEQ ID NO: 349089 - RNA, 19 nt, Human
caaaaacaccauaggacca

SEQ ID NO: 349090 - RNA, 22 nt, Human
caaaaacaccauaggaccacca

SEQ ID NO: 349091 - RNA, 22 nt, Human
caaaaugaccagguaauuuaua

SEQ ID NO: 349092 - RNA, 22 nt, Human
cagagccagcucccgguccucc

SEQ ID NO: 349093 - RNA, 21 nt, Human
cagccuccagagccagcuccc

SEQ ID NO: 349094 - RNA, 22 nt, Human
caucaaggaaauauucauucau

SEQ ID NO: 349095 - RNA, 23 nt, Human
caucaaggaaauauucauucaua

SEQ ID NO: 349096 - RNA, 21 nt, Human
ccaaauacuuccaaaaacacc

SEQ ID NO: 349097 - RNA, 21 nt, Human
ccaaaucuccaaggcagccaa

SEQ ID NO: 349098 - RNA, 22 nt, Human
ccaaaucuccaaggcagccaaa

SEQ ID NO: 349099 - RNA, 21 nt, Human
ccaccaagcuauuucuauugc

SEQ ID NO: 349100 - RNA, 18 nt, Human
cggcgucgccuccgcagc

SEQ ID NO: 349101 - RNA, 24 nt, Human
cucaagaaguacuuccccaaggaa

SEQ ID NO: 349102 - RNA, 23 nt, Human
cuuccccaaggaagcucacacca

SEQ ID NO: 349103 - RNA, 22 nt, Human
gaagcucacaccaucauaccag

SEQ ID NO: 349104 - RNA, 22 nt, Human
ggaaaaaaaucugauaaucugg

SEQ ID NO: 349105 - RNA, 27 nt, Human
uaaaaaaacauaagaaucauauccaaa

SEQ ID NO: 349106 - RNA, 25 nt, Human
uaaaacauccuguuaguuacauaac

SEQ ID NO: 349107 - RNA, 27 nt, Human
uaaccaagcauaugugugcagagacca

SEQ ID NO: 349108 - RNA, 24 nt, Human
uaagaaaaaacauuacuuuaaaaa

SEQ ID NO: 349109 - RNA, 19 nt, Human
uaauuuguuaaaaugaauc

SEQ ID NO: 349110 - RNA, 20 nt, Human
uaauuuguuaaaaugaaucu

SEQ ID NO: 349111 - RNA, 20 nt, Human
uccugcuccaauuucuccac

SEQ ID NO: 349112 - RNA, 20 nt, Human
ucguucucuccggcgucgcc

SEQ ID NO: 349113 - RNA, 20 nt, Human
ucucagaauuguauucuuca

SEQ ID NO: 349114 - RNA, 22 nt, Human
ucuccaaaucuccaaggcagcc

SEQ ID NO: 349115 - RNA, 23 nt, Human
ucuccaaaucuccaaggcagcca

SEQ ID NO: 349116 - RNA, 21 nt, Human
ucugaauagccauccagaucu

SEQ ID NO: 349117 - RNA, 22 nt, Human
ucuucugcuaucauuuuuugcc

SEQ ID NO: 349118 - RNA, 20 nt, Human
ugaagaagguuuucuauuaa

SEQ ID NO: 349119 - RNA, 22 nt, Human
ugaaugcaugcaaguaaccaag

SEQ ID NO: 349120 - RNA, 19 nt, Human
ugagggaaaaaaaucugau

SEQ ID NO: 349121 - RNA, 20 nt, Human
ugccaaauacuuccaaaaac

SEQ ID NO: 349122 - RNA, 23 nt, Human
ugccaaauacuuccaaaaacacc

SEQ ID NO: 349123 - RNA, 23 nt, Human
uguauucuucagucuuuuccaca

SEQ ID NO: 349124 - RNA, 18 nt, Human
uuccugcuccaauuucuc

SEQ ID NO: 349125 - RNA, 18 nt, Human
uuucacaauuaugauguu

SEQ ID NO: 349126 - RNA, 21 nt, Human
uuucucagaauuguauucuuc

SEQ ID NO: 349127 - RNA, 23 nt, Human
uuugauaauuucuuuuccugcuc

SEQ ID NO: 349128 - RNA, 24 nt, Human
uuuucuauuaaaaaaacauaagaa

SEQ ID NO: 349129 - RNA, 20 nt, Human
uuuuuugccauguuaucuga

SEQ ID NO: 349130 - RNA, 24 nt, Human
uuuuuuuuuuuuuuuuucacaauu

SEQ ID NO: 349131 - RNA, 22 nt, Human
aaaaaccacuuggaagaaggga

SEQ ID NO: 349132 - RNA, 23 nt, Human
aaaacgguuacagacccuagaua

SEQ ID NO: 349133 - RNA, 20 nt, Human
aaacagcuaagaaugacucc

SEQ ID NO: 349134 - RNA, 23 nt, Human
aaacagcuaagaaugacuccagc

SEQ ID NO: 349135 - RNA, 20 nt, Human
aacauggugaaacccugucu

SEQ ID NO: 349136 - RNA, 21 nt, Human
aacauggugaaacccugucuc

SEQ ID NO: 349137 - RNA, 25 nt, Human
aacgcggguggaucaccugagguca

SEQ ID NO: 349138 - RNA, 18 nt, Human
aagaaugacuccagcccc

SEQ ID NO: 349139 - RNA, 24 nt, Human
acagagcaagacucugugucaaaa

SEQ ID NO: 349140 - RNA, 20 nt, Human
accaggguauguugagguga

SEQ ID NO: 349141 - RNA, 23 nt, Human
acccaauacucugcgccugcacc

SEQ ID NO: 349142 - RNA, 24 nt, Human
acccugucucuacuaaaaauacaa

SEQ ID NO: 349143 - RNA, 24 nt, Human
acuaacauggugaaacccugucuc

SEQ ID NO: 349144 - RNA, 23 nt, Human
agaaaagucagaaggauccaaag

SEQ ID NO: 349145 - RNA, 24 nt, Human
agacugaggcaggaggaucgcuug

SEQ ID NO: 349146 - RNA, 21 nt, Human
agagcagaagaaaagucagaa

SEQ ID NO: 349147 - RNA, 18 nt, Human
agagguugcggugagccg

SEQ ID NO: 349148 - RNA, 23 nt, Human
agagguugcggugagccgagauc

SEQ ID NO: 349149 - RNA, 24 nt, Human
agagguugcggugagccgagauca

SEQ ID NO: 349150 - RNA, 24 nt, Human
agccugacuaacauggugaaaccc

SEQ ID NO: 349151 - RNA, 24 nt, Human
agccugggcaacagagcaagacuc

SEQ ID NO: 349152 - RNA, 20 nt, Human
agcggcucgggguccaaagc

SEQ ID NO: 349153 - RNA, 25 nt, Human
aggaagagaaagcuuagagagagca

SEQ ID NO: 349154 - RNA, 21 nt, Human
aggcagagguugcggugagcc

SEQ ID NO: 349155 - RNA, 24 nt, Human
aggcagagguugcggugagccgag

SEQ ID NO: 349156 - RNA, 24 nt, Human
aggcaggaggaucgcuugaacccg

SEQ ID NO: 349157 - RNA, 22 nt, Human
aggcggggcgugguggcucacg

SEQ ID NO: 349158 - RNA, 24 nt, Human
aggcgugguggugcacaccuguaa

SEQ ID NO: 349159 - RNA, 19 nt, Human
aggucaggaguucgagacc

SEQ ID NO: 349160 - RNA, 28 nt, Human
aguggucccaaggacuuggggggagggu

SEQ ID NO: 349161 - RNA, 21 nt, Human
aucaccugaggucaggaguuc

SEQ ID NO: 349162 - RNA, 24 nt, Human
aucaugccauugcacuccagccug

SEQ ID NO: 349163 - RNA, 22 nt, Human
aucgaggccagccaaacccaau

SEQ ID NO: 349164 - RNA, 23 nt, Human
aucgcuugaacccgggaggcaga

SEQ ID NO: 349165 - RNA, 24 nt, Human
auugcacuccagccugggcaacag

SEQ ID NO: 349166 - RNA, 24 nt, Human
caacgcggguggaucaccugaggu

SEQ ID NO: 349167 - RNA, 24 nt, Human
cacaccuguaaucccagcuacuug

SEQ ID NO: 349168 - RNA, 23 nt, Human
caccugaggucaggaguucgaga

SEQ ID NO: 349169 - RNA, 20 nt, Human
caccuguaaucccagcuacu

SEQ ID NO: 349170 - RNA, 24 nt, Human
caccuguaaucccagcuacuuggg

SEQ ID NO: 349171 - RNA, 24 nt, Human
cacgccuauaaucccagcacguug

SEQ ID NO: 349172 - RNA, 23 nt, Human
cacuccagccugggcaacagagc

SEQ ID NO: 349173 - RNA, 20 nt, Human
cagaagcuucccauauccuc

SEQ ID NO: 349174 - RNA, 24 nt, Human
cagcacguugggaggccaacgcgg

SEQ ID NO: 349175 - RNA, 23 nt, Human
cagcggcucgggguccaaagccu

SEQ ID NO: 349176 - RNA, 22 nt, Human
cauccuaugcacucacagaagc

SEQ ID NO: 349177 - RNA, 18 nt, Human
cauugcacuccagccugg

SEQ ID NO: 349178 - RNA, 19 nt, Human
cauugcacuccagccuggg

SEQ ID NO: 349179 - RNA, 21 nt, Human
cauugcacuccagccugggca

SEQ ID NO: 349180 - RNA, 24 nt, Human
cauugcacuccagccugggcaaca

SEQ ID NO: 349181 - RNA, 27 nt, Human
cauugcacuccagccugggcaacagag

SEQ ID NO: 349182 - RNA, 21 nt, Human
ccagccaaacccaauacucug

SEQ ID NO: 349183 - RNA, 20 nt, Human
ccauugcacuccagccuggg

SEQ ID NO: 349184 - RNA, 21 nt, Human
ccauugcacuccagccugggc

SEQ ID NO: 349185 - RNA, 23 nt, Human
ccauugcacuccagccugggcaa

SEQ ID NO: 349186 - RNA, 24 nt, Human
ccauugcacuccagccugggcaac

SEQ ID NO: 349187 - RNA, 20 nt, Human
cccagcacguugggaggcca

SEQ ID NO: 349188 - RNA, 19 nt, Human
ccggccgccgccgccgccg

SEQ ID NO: 349189 - RNA, 22 nt, Human
ccggccgccgccgccgccgccu

SEQ ID NO: 349190 - RNA, 25 nt, Human
ccucuguuuggcuuugccauugugc

SEQ ID NO: 349191 - RNA, 22 nt, Human
ccugacuaacauggugaaaccc

SEQ ID NO: 349192 - RNA, 24 nt, Human
ccugacuaacauggugaaacccug

SEQ ID NO: 349193 - RNA, 22 nt, Human
ccugaggucaggaguucgagac

SEQ ID NO: 349194 - RNA, 22 nt, Human
ccugcuuauuacaggaaagagu

SEQ ID NO: 349195 - RNA, 22 nt, Human
ccugggcaacagagcaagacuc

SEQ ID NO: 349196 - RNA, 21 nt, Human
ccuguaaucccagcuacuugg

SEQ ID NO: 349197 - RNA, 24 nt, Human
cgagaccagccugacuaacauggu

SEQ ID NO: 349198 - RNA, 24 nt, Human
cgagaucaugccauugcacuccag

SEQ ID NO: 349199 - RNA, 19 nt, Human
cgaggccagccaaacccaa

SEQ ID NO: 349200 - RNA, 23 nt, Human
cgccuauaaucccagcacguugg

SEQ ID NO: 349201 - RNA, 24 nt, Human
cgccuauaaucccagcacguuggg

SEQ ID NO: 349202 - RNA, 24 nt, Human
cgggaggcagagguugcggugagc

SEQ ID NO: 349203 - RNA, 24 nt, Human
cggguggaucaccugaggucagga

SEQ ID NO: 349204 - RNA, 22 nt, Human
cucacgccuauaaucccagcac

SEQ ID NO: 349205 - RNA, 22 nt, Human
cucacgccuauaaucccagcac

SEQ ID NO: 349206 - RNA, 27 nt, Human
cucacuaccagucuggguccggccgcc

SEQ ID NO: 349207 - RNA, 23 nt, Human
cuccagcccccauccuaugcacu

SEQ ID NO: 349208 - RNA, 20 nt, Human
cuccuuggcccuaucccuga

SEQ ID NO: 349209 - RNA, 20 nt, Human
cucugugucaaaaaaaaaaa

SEQ ID NO: 349210 - RNA, 21 nt, Human
cugacaaagcuuagaaaggaa

SEQ ID NO: 349211 - RNA, 24 nt, Human
cugacuaacauggugaaacccugu

SEQ ID NO: 349212 - RNA, 21 nt, Human
cuguaaucccagcuacuuggg

SEQ ID NO: 349213 - RNA, 19 nt, Human
cuuagagagagcagaagaa

SEQ ID NO: 349214 - RNA, 24 nt, Human
cuuagagccacaccaggguauguu

SEQ ID NO: 349215 - RNA, 19 nt, Human
gaaacccugucucuacuaa

SEQ ID NO: 349216 - RNA, 20 nt, Human
gaagcuucccauauccucuu

SEQ ID NO: 349217 - RNA, 21 nt, Human
gacccaaguggucccaaggac

SEQ ID NO: 349218 - RNA, 22 nt, Human
gacugacaaagcuuagaaagga

SEQ ID NO: 349219 - RNA, 18 nt, Human
gacuuuccugcaaaaccu

SEQ ID NO: 349220 - RNA, 20 nt, Human
gaggaagagaaagcuuagag

SEQ ID NO: 349221 - RNA, 23 nt, Human
gaggaucgcuugaacccgggagg

SEQ ID NO: 349222 - RNA, 21 nt, Human
gaucaccugaggucaggaguu

SEQ ID NO: 349223 - RNA, 24 nt, Human
gaucaccugaggucaggaguucga

SEQ ID NO: 349224 - RNA, 24 nt, Human
gcacuccagccugggcaacagagc

SEQ ID NO: 349225 - RNA, 22 nt, Human
gccauugcacuccagccugggc

SEQ ID NO: 349226 - RNA, 24 nt, Human
gccauugcacuccagccugggcaa

SEQ ID NO: 349227 - RNA, 24 nt, Human
gccuuuccuuuuucucaaaccaaa

SEQ ID NO: 349228 - RNA, 19 nt, Human
gcggguggaucaccugagg

SEQ ID NO: 349229 - RNA, 27 nt, Human
ggaaacagcuaagaaugaccgguaccc

SEQ ID NO: 349230 - RNA, 23 nt, Human
ggaagaagggacuuuccugcaaa

SEQ ID NO: 349231 - RNA, 18 nt, Human
ggacuuggggggagggua

SEQ ID NO: 349232 - RNA, 19 nt, Human
ggagagagaggaagaaagu

SEQ ID NO: 349233 - RNA, 18 nt, Human
ggcggggcgugguggcuc

SEQ ID NO: 349234 - RNA, 21 nt, Human
ggcucacgccuauaaucccag

SEQ ID NO: 349235 - RNA, 18 nt, Human
gggacccaagugguccca

SEQ ID NO: 349236 - RNA, 24 nt, Human
gggcgugguggcucacgccuauaa

SEQ ID NO: 349237 - RNA, 21 nt, Human
ggugcacaccuguaaucccag

SEQ ID NO: 349238 - RNA, 24 nt, Human
gguggcucacgccuauaaucccag

SEQ ID NO: 349239 - RNA, 23 nt, Human
guggcucacgccuauaaucccag

SEQ ID NO: 349240 - RNA, 23 nt, Human
guggugcacaccuguaaucccag

SEQ ID NO: 349241 - RNA, 24 nt, Human
guugcggugagccgagaucaugcc

SEQ ID NO: 349242 - RNA, 22 nt, Human
uaaaaauacaaaauuagucagg

SEQ ID NO: 349243 - RNA, 23 nt, Human
uaaaaauacaaaauuagucaggc

SEQ ID NO: 349244 - RNA, 19 nt, Human
uaaaauaugucaaggcaua

SEQ ID NO: 349245 - RNA, 22 nt, Human
uaaaucgaggccagccaaaccc

SEQ ID NO: 349246 - RNA, 22 nt, Human
uaacauggugaaacccugucuc

SEQ ID NO: 349247 - RNA, 24 nt, Human
uaacauggugaaacccugucucua

SEQ ID NO: 349248 - RNA, 19 nt, Human
uaagaaugacuccagcccc

SEQ ID NO: 349249 - RNA, 18 nt, Human
uacaggaaagaguucuug

SEQ ID NO: 349250 - RNA, 21 nt, Human
uaccagucuggguccggccgc

SEQ ID NO: 349251 - RNA, 21 nt, Human
uaggcggggcgugguggcuca

SEQ ID NO: 349252 - RNA, 22 nt, Human
uaggcggggcgugguggcucac

SEQ ID NO: 349253 - RNA, 18 nt, Human
ucaaaccaaaacgguuac

SEQ ID NO: 349254 - RNA, 24 nt, Human
ucaaaccaaaacgguuacagaccc

SEQ ID NO: 349255 - RNA, 22 nt, Human
ucaaggcauaaagucuugcuau

SEQ ID NO: 349256 - RNA, 20 nt, Human
ucaccugaggucaggaguuc

SEQ ID NO: 349257 - RNA, 23 nt, Human
ucaugccauugcacuccagccug

SEQ ID NO: 349258 - RNA, 22 nt, Human
uccaaagccucacuaccagucu

SEQ ID NO: 349259 - RNA, 18 nt, Human
ucgcuugaacccgggagg

SEQ ID NO: 349260 - RNA, 20 nt, Human
ucucuacuaaaaauacaaaa

SEQ ID NO: 349261 - RNA, 21 nt, Human
ucuugguuguuuucuccuugg

SEQ ID NO: 349262 - RNA, 23 nt, Human
ucuuuuuuuuuuuuuuaauguuu

SEQ ID NO: 349263 - RNA, 24 nt, Human
ugacaaagcuuagaaaggaacuga

SEQ ID NO: 349264 - RNA, 24 nt, Human
ugacuaacauggugaaacccuguc

SEQ ID NO: 349265 - RNA, 22 nt, Human
ugagccgagaucaugccauugc

SEQ ID NO: 349266 - RNA, 24 nt, Human
ugaggcaggaggaucgcuugaacc

SEQ ID NO: 349267 - RNA, 25 nt, Human
ugaggcaggaggaucgcuugaaccc

SEQ ID NO: 349268 - RNA, 22 nt, Human
ugcacuccagccugggcaacag

SEQ ID NO: 349269 - RNA, 22 nt, Human
ugcacuccagccugggcaacag

SEQ ID NO: 349270 - RNA, 24 nt, Human
ugccauugcacuccagccugggca

SEQ ID NO: 349271 - RNA, 18 nt, Human
uggaaaaaccacuuggaa

SEQ ID NO: 349272 - RNA, 24 nt, Human
uggaucaccugaggucaggaguuc

SEQ ID NO: 349273 - RNA, 27 nt, Human
uggaucaccugaggucaggaguucgag

SEQ ID NO: 349274 - RNA, 21 nt, Human
uggcucacgccuauaauccca

SEQ ID NO: 349275 - RNA, 24 nt, Human
uggcucacgccuauaaucccagca

SEQ ID NO: 349276 - RNA, 23 nt, Human
ugggagacugaggcaggaggauc

SEQ ID NO: 349277 - RNA, 24 nt, Human
ugggaggccaacgcggguggauca

SEQ ID NO: 349278 - RNA, 24 nt, Human
uggggacccaaguggucccaagga

SEQ ID NO: 349279 - RNA, 19 nt, Human
uggucuuuuuuuuuuuuuu

SEQ ID NO: 349280 - RNA, 22 nt, Human
uggugcacaccuguaaucccag

SEQ ID NO: 349281 - RNA, 24 nt, Human
ugguggcucacgccuauaauccca

SEQ ID NO: 349282 - RNA, 24 nt, Human
ugguggugcacaccuguaauccca

SEQ ID NO: 349283 - RNA, 19 nt, Human
ugucaaaaaaaaaaagaau

SEQ ID NO: 349284 - RNA, 21 nt, Human
uuccugcaaaaccuuaaagac

SEQ ID NO: 349285 - RNA, 19 nt, Human
uucuugguuguuuucuccu

SEQ ID NO: 349286 - RNA, 18 nt, Human
uugcggugagccgagauc

SEQ ID NO: 349287 - RNA, 19 nt, Human
uugcggugagccgagauca

SEQ ID NO: 349288 - RNA, 20 nt, Human
uugcggugagccgagaucau

SEQ ID NO: 349289 - RNA, 24 nt, Human
uugggagacugaggcaggaggauc

SEQ ID NO: 349290 - RNA, 21 nt, Human
uuuaauguuucuuccucuguu

SEQ ID NO: 349291 - RNA, 20 nt, Human
uuuccugcaaaaccuuaaag

SEQ ID NO: 349292 - RNA, 24 nt, Human
uuucuccuuggcccuaucccugau

SEQ ID NO: 349293 - RNA, 25 nt, Human
uuuuuuuuuuuuuuuuuuuuaaugg

SEQ ID NO: 349294 - RNA, 20 nt, Human
aaacagaaacucuaaguacc

SEQ ID NO: 349295 - RNA, 23 nt, Human
aaacagaaacucuaaguaccagu

SEQ ID NO: 349296 - RNA, 20 nt, Human
aagagaaguugggaauuuau

SEQ ID NO: 349297 - RNA, 23 nt, Human
agaaguugggaauuuauucuaaa

SEQ ID NO: 349298 - RNA, 23 nt, Human
aggagaaagaucugacucuccaa

SEQ ID NO: 349299 - RNA, 19 nt, Human
aggaggugguuccucauuc

SEQ ID NO: 349300 - RNA, 24 nt, Human
auagaaagcaagagaaguugggaa

SEQ ID NO: 349301 - RNA, 19 nt, Human
caaacagaaacucuaagua

SEQ ID NO: 349302 - RNA, 27 nt, Human
caacaacgccacugguaauaaagcuuu

SEQ ID NO: 349303 - RNA, 24 nt, Human
cagaccucauuucaaacaugcaac

SEQ ID NO: 349304 - RNA, 18 nt, Human
ccacuuuaaacagaccuc

SEQ ID NO: 349305 - RNA, 21 nt, Human
cgaaagauauucaaggagaaa

SEQ ID NO: 349306 - RNA, 20 nt, Human
cuuuugcuuuucuucccuuu

SEQ ID NO: 349307 - RNA, 20 nt, Human
gacccaaggaaccucggcga

SEQ ID NO: 349308 - RNA, 21 nt, Human
ggauaaacaccagucggcccg

SEQ ID NO: 349309 - RNA, 24 nt, Human
uaaacagaccucauuucaaacaug

SEQ ID NO: 349310 - RNA, 19 nt, Human
uagaaagcaagagaaguug

SEQ ID NO: 349311 - RNA, 26 nt, Human
ucagucaggcuggcaccaugacccaa

SEQ ID NO: 349312 - RNA, 21 nt, Human
uccucuucucagucaggcugg

SEQ ID NO: 349313 - RNA, 20 nt, Human
ugaacaguaggaggaggugg

SEQ ID NO: 349314 - RNA, 21 nt, Human
uugaacaguaggaggaggugg

SEQ ID NO: 349315 - RNA, 19 nt, Human
accgucccuccauccagau

SEQ ID NO: 349316 - RNA, 21 nt, Human
caaaauaaguuagggccggcc

SEQ ID NO: 349317 - RNA, 24 nt, Human
cacacucaggaauggugaccgucc

SEQ ID NO: 349318 - RNA, 22 nt, Human
cacucaggaauggugaccgucc

SEQ ID NO: 349319 - RNA, 19 nt, Human
cagagcagccgggcagggc

SEQ ID NO: 349320 - RNA, 26 nt, Human
cagcaacaaucacaucgagcagcucc

SEQ ID NO: 349321 - RNA, 22 nt, Human
cagccgggcagggcugggaggc

SEQ ID NO: 349322 - RNA, 20 nt, Human
cagcuccugggucucugccu

SEQ ID NO: 349323 - RNA, 18 nt, Human
cagcugagccggcaggau

SEQ ID NO: 349324 - RNA, 18 nt, Human
caggcccauugcgggcug

SEQ ID NO: 349325 - RNA, 20 nt, Human
ccagcacacgcugacggggc

SEQ ID NO: 349326 - RNA, 21 nt, Human
ccagcacacgcugacggggcc

SEQ ID NO: 349327 - RNA, 22 nt, Human
ccagcacacgcugacggggccg

SEQ ID NO: 349328 - RNA, 19 nt, Human
ccauugcgggcuguaccuu

SEQ ID NO: 349329 - RNA, 23 nt, Human
cccugcccaccccuaguggucgg

SEQ ID NO: 349330 - RNA, 20 nt, Human
ccuccagcagcugagccggc

SEQ ID NO: 349331 - RNA, 23 nt, Human
ccugcagccgcuggcuggaccag

SEQ ID NO: 349332 - RNA, 23 nt, Human
cgccugcagccgcuggcuggacc

SEQ ID NO: 349333 - RNA, 25 nt, Human
cuagaaacucgccugcagccgcugg

SEQ ID NO: 349334 - RNA, 18 nt, Human
cucccggcacggugcuca

SEQ ID NO: 349335 - RNA, 18 nt, Human
cucugcaguggcucuggc

SEQ ID NO: 349336 - RNA, 19 nt, Human
cuggaaggccgcguugacc

SEQ ID NO: 349337 - RNA, 26 nt, Human
gcggggacgggggcuguugcuggagc

SEQ ID NO: 349338 - RNA, 21 nt, Human
gcggggcggggacgggggcug

SEQ ID NO: 349339 - RNA, 19 nt, Human
gcggggcggggcggggacg

SEQ ID NO: 349340 - RNA, 18 nt, Human
gcuguaucugagaggaaa

SEQ ID NO: 349341 - RNA, 19 nt, Human
ggcggggcggggacggggg

SEQ ID NO: 349342 - RNA, 20 nt, Human
ggggcggggcggggacgggg

SEQ ID NO: 349343 - RNA, 18 nt, Human
gugggugugcugaggacc

SEQ ID NO: 349344 - RNA, 19 nt, Human
uacaggcccauugcgggcu

SEQ ID NO: 349345 - RNA, 23 nt, Human
ucaggaauggugaccgucccucc

SEQ ID NO: 349346 - RNA, 22 nt, Human
ucgguaacgaccggaagcagag

SEQ ID NO: 349347 - RNA, 21 nt, Human
ucugcaguggcucuggcaagg

SEQ ID NO: 349348 - RNA, 22 nt, Human
ucuggcaaggguggaaugugca

SEQ ID NO: 349349 - RNA, 21 nt, Human
ugccuggaaggccgcguugac

SEQ ID NO: 349350 - RNA, 23 nt, Human
ugcgucugacucugcaguggcuc

SEQ ID NO: 349351 - RNA, 21 nt, Human
ugcugaggaccuccagcagcu

SEQ ID NO: 349352 - RNA, 21 nt, Human
uugaccccaaugaugaagggc

SEQ ID NO: 349353 - RNA, 24 nt, Human
uugaccccaaugaugaagggcgug

SEQ ID NO: 349354 - RNA, 18 nt, Human
aaaaaagaaauacgauga

SEQ ID NO: 349355 - RNA, 20 nt, Human
aaaaaagaaauacgaugaua

SEQ ID NO: 349356 - RNA, 21 nt, Human
aagugaggggagaagaggagg

SEQ ID NO: 349357 - RNA, 21 nt, Human
agaggaaguagggaaaaguga

SEQ ID NO: 349358 - RNA, 22 nt, Human
agugaggggagaagaggaggaa

SEQ ID NO: 349359 - RNA, 20 nt, Human
aucaaauuucuuuuuuuaaa

SEQ ID NO: 349360 - RNA, 23 nt, Human
aucuggcauuuuaagcauaagag

SEQ ID NO: 349361 - RNA, 22 nt, Human
aucuucuucugaccuaccacua

SEQ ID NO: 349362 - RNA, 18 nt, Human
auuucuugguuauggugc

SEQ ID NO: 349363 - RNA, 25 nt, Human
caauuuaacuaaaaaaucaguagug

SEQ ID NO: 349364 - RNA, 20 nt, Human
cagaggaaguagggaaaagu

SEQ ID NO: 349365 - RNA, 23 nt, Human
cagugcccacgaugcugauuucc

SEQ ID NO: 349366 - RNA, 23 nt, Human
cauaccaacguugaagaauuaac

SEQ ID NO: 349367 - RNA, 20 nt, Human
cccccgaacaacaucuggca

SEQ ID NO: 349368 - RNA, 19 nt, Human
ccugaaacaagaaacaauc

SEQ ID NO: 349369 - RNA, 18 nt, Human
gugaggggagaagaggag

SEQ ID NO: 349370 - RNA, 21 nt, Human
uaaaaaaaagaaauacgauga

SEQ ID NO: 349371 - RNA, 18 nt, Human
uaaccauuccugaaacaa

SEQ ID NO: 349372 - RNA, 19 nt, Human
uagaaugccuuuacaaacu

SEQ ID NO: 349373 - RNA, 19 nt, Human
uagaaugccuuuacaaacu

SEQ ID NO: 349374 - RNA, 21 nt, Human
uauguuuuugcaauauauuug

SEQ ID NO: 349375 - RNA, 18 nt, Human
ucaaauuucuuuuuuuaa

SEQ ID NO: 349376 - RNA, 24 nt, Human
uccaauuuauuuguuaaucaguaa

SEQ ID NO: 349377 - RNA, 20 nt, Human
ugaaacaagaaacaaucuuu

SEQ ID NO: 349378 - RNA, 20 nt, Human
ugcugcuagaaagauacaag

SEQ ID NO: 349379 - RNA, 19 nt, Human
uggcauuuuaagcauaaga

SEQ ID NO: 349380 - RNA, 25 nt, Human
uguuuuugcaauauauuuguuacaa

SEQ ID NO: 349381 - RNA, 19 nt, Human
uuccugaaacaagaaacaa

SEQ ID NO: 349382 - RNA, 19 nt, Human
aaaaaaaaaaaaaguguaa

SEQ ID NO: 349383 - RNA, 18 nt, Human
aaaaaaaaaaaguguaau

SEQ ID NO: 349384 - RNA, 20 nt, Human
aaaaaaaaauucccacaagg

SEQ ID NO: 349385 - RNA, 22 nt, Human
aaaaaagccauucugaaaauaa

SEQ ID NO: 349386 - RNA, 18 nt, Human
aaaaaaguauauucucug

SEQ ID NO: 349387 - RNA, 19 nt, Human
aaaaaaguauauucucugu

SEQ ID NO: 349388 - RNA, 24 nt, Human
aaaaagaaaaacacuggacaaaaa

SEQ ID NO: 349389 - RNA, 20 nt, Human
aaaaagcaagagaaugaaaa

SEQ ID NO: 349390 - RNA, 22 nt, Human
aaaaagccaaaagggaaugagc

SEQ ID NO: 349391 - RNA, 22 nt, Human
aaaaagccauucugaaaauaac

SEQ ID NO: 349392 - RNA, 22 nt, Human
aaaaaugaguauucucuucucc

SEQ ID NO: 349393 - RNA, 24 nt, Human
aaaacaaauguggaagcaaaggcc

SEQ ID NO: 349394 - RNA, 20 nt, Human
aaaacugcaggaauaucaca

SEQ ID NO: 349395 - RNA, 24 nt, Human
aaaaggagacaggcucauuggcca

SEQ ID NO: 349396 - RNA, 22 nt, Human
aaaaugaguauucucuucucca

SEQ ID NO: 349397 - RNA, 25 nt, Human
aaacaaaaagaaaaacaaaaccuaa

SEQ ID NO: 349398 - RNA, 18 nt, Human
aaacaaaacaaaacaaaa

SEQ ID NO: 349399 - RNA, 21 nt, Human
aaacaaaacaaaauccagagc

SEQ ID NO: 349400 - RNA, 25 nt, Human
aaacaaaauccagagcuacaacaac

SEQ ID NO: 349401 - RNA, 21 nt, Human
aaacaggaaagaaagaacaaa

SEQ ID NO: 349402 - RNA, 26 nt, Human
aaacccaacacacucaccuaacagaa

SEQ ID NO: 349403 - RNA, 22 nt, Human
aaacccacaaaugauauuucgg

SEQ ID NO: 349404 - RNA, 27 nt, Human
aaaggaacauaaccuuauaaaauggcc

SEQ ID NO: 349405 - RNA, 18 nt, Human
aaaguggacauaguacag

SEQ ID NO: 349406 - RNA, 24 nt, Human
aaauacccuuucuggguuuguacc

SEQ ID NO: 349407 - RNA, 23 nt, Human
aaauguggaagcaaaggccucca

SEQ ID NO: 349408 - RNA, 23 nt, Human
aacaaaauccagagcuacaacaa

SEQ ID NO: 349409 - RNA, 20 nt, Human
aacacacucaccuaacagaa

SEQ ID NO: 349410 - RNA, 19 nt, Human
aacacagcucaagaagccc

SEQ ID NO: 349411 - RNA, 23 nt, Human
aacacgcucagaacgcacacaca

SEQ ID NO: 349412 - RNA, 21 nt, Human
aaccaaacaaggaaaaagcca

SEQ ID NO: 349413 - RNA, 22 nt, Human
aaccaaacaaggaaaaagccaa

SEQ ID NO: 349414 - RNA, 27 nt, Human
aacccaacacacucaccuaacagaaaa

SEQ ID NO: 349415 - RNA, 22 nt, Human
aaccugcaagcaccaucaaaga

SEQ ID NO: 349416 - RNA, 23 nt, Human
aacggcaccgaagaauuucuacc

SEQ ID NO: 349417 - RNA, 25 nt, Human
aagaaagaacaaaagacggcugucg

SEQ ID NO: 349418 - RNA, 19 nt, Human
aagcaagagaaugaaaugg

SEQ ID NO: 349419 - RNA, 19 nt, Human
aagcaccaucaaagaaagg

SEQ ID NO: 349420 - RNA, 23 nt, Human
aagcagaaaugaaaucccgcaug

SEQ ID NO: 349421 - RNA, 23 nt, Human
aagcagaaaugaaaucccgcaug

SEQ ID NO: 349422 - RNA, 24 nt, Human
aagcagaaaugaaaucccgcaugu

SEQ ID NO: 349423 - RNA, 27 nt, Human
aagcagaaaugaaaucccgcauguggu

SEQ ID NO: 349424 - RNA, 22 nt, Human
aagcauuggagauuuuucucuc

SEQ ID NO: 349425 - RNA, 18 nt, Human
aaggagacaggcucauug

SEQ ID NO: 349426 - RNA, 21 nt, Human
aaggucaccacaaauacugac

SEQ ID NO: 349427 - RNA, 19 nt, Human
acaaaacaaaacaaaaucc

SEQ ID NO: 349428 - RNA, 22 nt, Human
acaaaacaaaacaaaauccaga

SEQ ID NO: 349429 - RNA, 25 nt, Human
acaaauagacacaccacgauuagaa

SEQ ID NO: 349430 - RNA, 25 nt, Human
acaaccaacacagcucaagaagccc

SEQ ID NO: 349431 - RNA, 20 nt, Human
acacagcucaagaagcccgg

SEQ ID NO: 349432 - RNA, 24 nt, Human
accaucaaaggcuaaaaaacaaaa

SEQ ID NO: 349433 - RNA, 18 nt, Human
acccaacacacucaccua

SEQ ID NO: 349434 - RNA, 25 nt, Human
accccagaaaacgguuuauaaaaau

SEQ ID NO: 349435 - RNA, 19 nt, Human
accccgaggaggggccugc

SEQ ID NO: 349436 - RNA, 22 nt, Human
acccuaugaaaacagcacgucg

SEQ ID NO: 349437 - RNA, 23 nt, Human
acccuggugacaucgcugcacua

SEQ ID NO: 349438 - RNA, 21 nt, Human
accgaauugggccauggaguc

SEQ ID NO: 349439 - RNA, 21 nt, Human
acucagcauccgcagcagggg

SEQ ID NO: 349440 - RNA, 19 nt, Human
acuccacuggcuggaaaug

SEQ ID NO: 349441 - RNA, 26 nt, Human
acucuucccacgggacuuuucuccug

SEQ ID NO: 349442 - RNA, 19 nt, Human
acuugguauucuggaggac

SEQ ID NO: 349443 - RNA, 22 nt, Human
agaaaaagagacccucacucgc

SEQ ID NO: 349444 - RNA, 22 nt, Human
agaaggcaggcacugugaagcc

SEQ ID NO: 349445 - RNA, 20 nt, Human
agacagcaaacaaacuaaag

SEQ ID NO: 349446 - RNA, 24 nt, Human
agacagccaaaauguggguugaua

SEQ ID NO: 349447 - RNA, 18 nt, Human
agacucuuucacuaugcu

SEQ ID NO: 349448 - RNA, 20 nt, Human
agagaccaagaugcuuggua

SEQ ID NO: 349449 - RNA, 27 nt, Human
agagagugaggcagagggaggcagaga

SEQ ID NO: 349450 - RNA, 23 nt, Human
agaggcugcucugggagccucgg

SEQ ID NO: 349451 - RNA, 19 nt, Human
agaugaggaaaccccgcca

SEQ ID NO: 349452 - RNA, 19 nt, Human
agcacgguauuagugucuu

SEQ ID NO: 349453 - RNA, 20 nt, Human
agcagaucuuuucacgaaga

SEQ ID NO: 349454 - RNA, 20 nt, Human
agcaggggaaaggugggagg

SEQ ID NO: 349455 - RNA, 19 nt, Human
agccaaaagguggugugug

SEQ ID NO: 349456 - RNA, 24 nt, Human
agcccugaccgcuccugcugugcc

SEQ ID NO: 349457 - RNA, 22 nt, Human
agcccugcucuggccagaaugg

SEQ ID NO: 349458 - RNA, 21 nt, Human
agccucagccuauacuucacc

SEQ ID NO: 349459 - RNA, 21 nt, Human
agcuacaacaacaaaaauaaa

SEQ ID NO: 349460 - RNA, 18 nt, Human
aggaaagaaagaacaaaa

SEQ ID NO: 349461 - RNA, 20 nt, Human
aggaaagaaagaacaaaaga

SEQ ID NO: 349462 - RNA, 28 nt, Human
aggacacagaccccgaggaggggccugc

SEQ ID NO: 349463 - RNA, 20 nt, Human
aggacuccacuggcuggaaa

SEQ ID NO: 349464 - RNA, 21 nt, Human
aggccauaaccauacaaaucu

SEQ ID NO: 349465 - RNA, 19 nt, Human
agggaggggacgagauucu

SEQ ID NO: 349466 - RNA, 22 nt, Human
aggugguccccuccacagccac

SEQ ID NO: 349467 - RNA, 22 nt, Human
agguuuccuuaguagucacaga

SEQ ID NO: 349468 - RNA, 21 nt, Human
agugcaaaggguuucagaagg

SEQ ID NO: 349469 - RNA, 29 nt, Human
agugcuucaaaauuuuguuuucuucagcu

SEQ ID NO: 349470 - RNA, 18 nt, Human
aguggugaccgugggugg

SEQ ID NO: 349471 - RNA, 24 nt, Human
aguuugcaucuaccucuugggagu

SEQ ID NO: 349472 - RNA, 21 nt, Human
auacccuaugaaaacagcacg

SEQ ID NO: 349473 - RNA, 22 nt, Human
aucaaaucaucccaaacuaaac

SEQ ID NO: 349474 - RNA, 22 nt, Human
aucaccaccgaagaaaccgaau

SEQ ID NO: 349475 - RNA, 28 nt, Human
auccaucucuguaucccucccucccccc

SEQ ID NO: 349476 - RNA, 26 nt, Human
aucccucccuccccccucugccccag

SEQ ID NO: 349477 - RNA, 21 nt, Human
augaaacaguagccaugacaa

SEQ ID NO: 349478 - RNA, 25 nt, Human
augaaacaguagccaugacaaccaa

SEQ ID NO: 349479 - RNA, 18 nt, Human
augcugccacuuccuggu

SEQ ID NO: 349480 - RNA, 24 nt, Human
auggaaaacaggaaagaaagaaca

SEQ ID NO: 349481 - RNA, 18 nt, Human
auugcuguacaaggauga

SEQ ID NO: 349482 - RNA, 25 nt, Human
auuggcacagaaaguauugcacaug

SEQ ID NO: 349483 - RNA, 23 nt, Human
caaaaagauuucgcaaacucaac

SEQ ID NO: 349484 - RNA, 22 nt, Human
caaaacaaaacaaaauccagag

SEQ ID NO: 349485 - RNA, 25 nt, Human
caaacaaaucugcagcuugaaugga

SEQ ID NO: 349486 - RNA, 21 nt, Human
caaacucaacgugaagagcuu

SEQ ID NO: 349487 - RNA, 22 nt, Human
caaagacaaaaagauuucgcaa

SEQ ID NO: 349488 - RNA, 20 nt, Human
caaagugaaaagugccuccc

SEQ ID NO: 349489 - RNA, 20 nt, Human
caaagugaaaagugccuccc

SEQ ID NO: 349490 - RNA, 26 nt, Human
caacaacagaaaucaaaucaucccaa

SEQ ID NO: 349491 - RNA, 25 nt, Human
caacacaauagcagaugcaugugcu

SEQ ID NO: 349492 - RNA, 21 nt, Human
caacacacucaccuaacagaa

SEQ ID NO: 349493 - RNA, 21 nt, Human
caacacagcucaagaagcccg

SEQ ID NO: 349494 - RNA, 22 nt, Human
caacagaaaucaaaucauccca

SEQ ID NO: 349495 - RNA, 23 nt, Human
caacagaaaucaaaucaucccaa

SEQ ID NO: 349496 - RNA, 20 nt, Human
caacauagaaaauuauccug

SEQ ID NO: 349497 - RNA, 19 nt, Human
caacccaacacaauagcag

SEQ ID NO: 349498 - RNA, 18 nt, Human
caagagagugaggcagag

SEQ ID NO: 349499 - RNA, 25 nt, Human
caauaaacagacucgaguguauccu

SEQ ID NO: 349500 - RNA, 25 nt, Human
caauucaauacucgaaguaagccaa

SEQ ID NO: 349501 - RNA, 18 nt, Human
cacacaccugccccgucc

SEQ ID NO: 349502 - RNA, 19 nt, Human
cacagaacugaaugcacag

SEQ ID NO: 349503 - RNA, 19 nt, Human
cacagcgccugugcacccc

SEQ ID NO: 349504 - RNA, 22 nt, Human
caccauggagacuucccacagg

SEQ ID NO: 349505 - RNA, 21 nt, Human
cacccgaguuguccauaguca

SEQ ID NO: 349506 - RNA, 28 nt, Human
cacgucaguguaccacacacacagugug

SEQ ID NO: 349507 - RNA, 22 nt, Human
cacuaaguuugaagcuucaaaa

SEQ ID NO: 349508 - RNA, 23 nt, Human
cagaggcugcucugggagccucg

SEQ ID NO: 349509 - RNA, 24 nt, Human
cagcagaucuuuucacgaagauuu

SEQ ID NO: 349510 - RNA, 21 nt, Human
cagcgcccccggcugcuucug

SEQ ID NO: 349511 - RNA, 18 nt, Human
caguaugacugcaagaau

SEQ ID NO: 349512 - RNA, 22 nt, Human
caguauucucaaaucgcagaau

SEQ ID NO: 349513 - RNA, 20 nt, Human
caucaaagaaagggaccaua

SEQ ID NO: 349514 - RNA, 21 nt, Human
caucuccccguggguacaauc

SEQ ID NO: 349515 - RNA, 18 nt, Human
caucuucaaaaucuaauu

SEQ ID NO: 349516 - RNA, 24 nt, Human
caugacaaccaacacagcucaaga

SEQ ID NO: 349517 - RNA, 18 nt, Human
cauguguguuuucccauc

SEQ ID NO: 349518 - RNA, 19 nt, Human
ccaaacaaggaaaaagcca

SEQ ID NO: 349519 - RNA, 23 nt, Human
ccaacacacucaccuaacagaaa

SEQ ID NO: 349520 - RNA, 21 nt, Human
ccaaccccccuuaccccaugu

SEQ ID NO: 349521 - RNA, 19 nt, Human
ccacaacacccuggugacu

SEQ ID NO: 349522 - RNA, 20 nt, Human
ccacagaaaaggagacaggc

SEQ ID NO: 349523 - RNA, 22 nt, Human
ccacagcuguccaguuuccacu

SEQ ID NO: 349524 - RNA, 20 nt, Human
ccacgauuagaaaauagaau

SEQ ID NO: 349525 - RNA, 21 nt, Human
ccacucuuucucucuuguucc

SEQ ID NO: 349526 - RNA, 20 nt, Human
ccacuuaaaaaaaaaaaaaa

SEQ ID NO: 349527 - RNA, 25 nt, Human
ccacuuaaaaaaaaaaaaaguguaa

SEQ ID NO: 349528 - RNA, 21 nt, Human
ccagaaaacgguuuauaaaaa

SEQ ID NO: 349529 - RNA, 25 nt, Human
ccagacaaacugaaauaauucuuaa

SEQ ID NO: 349530 - RNA, 19 nt, Human
ccagcccugcucuggccag

SEQ ID NO: 349531 - RNA, 21 nt, Human
ccaggcucagaggcagggcuc

SEQ ID NO: 349532 - RNA, 18 nt, Human
ccaggcucuucaugagga

SEQ ID NO: 349533 - RNA, 19 nt, Human
cccaaccccccuuacccca

SEQ ID NO: 349534 - RNA, 21 nt, Human
cccacaggcucuggagggcuc

SEQ ID NO: 349535 - RNA, 21 nt, Human
cccacccccaaccccccuuac

SEQ ID NO: 349536 - RNA, 22 nt, Human
cccaugccgauagcaagagagu

SEQ ID NO: 349537 - RNA, 19 nt, Human
ccccaaccccccuuacccc

SEQ ID NO: 349538 - RNA, 21 nt, Human
ccccaaccccccuuaccccau

SEQ ID NO: 349539 - RNA, 23 nt, Human
ccccacccccaaccccccuuacc

SEQ ID NO: 349540 - RNA, 23 nt, Human
ccccaggaggacacugcucugaa

SEQ ID NO: 349541 - RNA, 20 nt, Human
cccccaaaccuuucccacaa

SEQ ID NO: 349542 - RNA, 20 nt, Human
cccccaaccccccuuacccc

SEQ ID NO: 349543 - RNA, 20 nt, Human
cccccaaccccccuuacccu

SEQ ID NO: 349544 - RNA, 20 nt, Human
cccccacccccaaccccccu

SEQ ID NO: 349545 - RNA, 18 nt, Human
cccccauuuaaaugaggu

SEQ ID NO: 349546 - RNA, 19 nt, Human
ccccgaggaggggccugcc

SEQ ID NO: 349547 - RNA, 22 nt, Human
ccccuccacagccacuggccaa

SEQ ID NO: 349548 - RNA, 19 nt, Human
cccuccagcccugcucugg

SEQ ID NO: 349549 - RNA, 22 nt, Human
cccuccuggcuccuucccucca

SEQ ID NO: 349550 - RNA, 20 nt, Human
cccugcaccccugcaggacc

SEQ ID NO: 349551 - RNA, 22 nt, Human
cccuuccucccgcccgcucacu

SEQ ID NO: 349552 - RNA, 21 nt, Human
ccgccaacgucugcaaacagg

SEQ ID NO: 349553 - RNA, 19 nt, Human
ccuagaaaaccugcaagca

SEQ ID NO: 349554 - RNA, 18 nt, Human
ccuagaccaaaaaccauu

SEQ ID NO: 349555 - RNA, 24 nt, Human
ccucacccauaucugaaauagcac

SEQ ID NO: 349556 - RNA, 21 nt, Human
ccuccuuccucuccacacucc

SEQ ID NO: 349557 - RNA, 24 nt, Human
ccucugccccaguguggcccagac

SEQ ID NO: 349558 - RNA, 19 nt, Human
ccugaaauagaaccacaaa

SEQ ID NO: 349559 - RNA, 21 nt, Human
ccugaaauagaaccacaaaaa

SEQ ID NO: 349560 - RNA, 19 nt, Human
ccugcgacacaccugcugu

SEQ ID NO: 349561 - RNA, 21 nt, Human
ccugguggggggaaaaaaccc

SEQ ID NO: 349562 - RNA, 22 nt, Human
cgccacagcgccugugcacccc

SEQ ID NO: 349563 - RNA, 18 nt, Human
cgcucagaacgcacacac

SEQ ID NO: 349564 - RNA, 21 nt, Human
cgguuccucccccgggucucc

SEQ ID NO: 349565 - RNA, 23 nt, Human
cguacuguucacagguagccuca

SEQ ID NO: 349566 - RNA, 22 nt, Human
cuaaaaaacaaaaagaaaaaca

SEQ ID NO: 349567 - RNA, 20 nt, Human
cuacaaauagacacaccacg

SEQ ID NO: 349568 - RNA, 19 nt, Human
cuagaaaaccugcaagcac

SEQ ID NO: 349569 - RNA, 18 nt, Human
cuauaccugaaauagaac

SEQ ID NO: 349570 - RNA, 21 nt, Human
cucacccauaucugaaauagc

SEQ ID NO: 349571 - RNA, 20 nt, Human
cucacugacagacacucgug

SEQ ID NO: 349572 - RNA, 22 nt, Human
cucacugacagacacucgugga

SEQ ID NO: 349573 - RNA, 19 nt, Human
cucaugucacacuggaauc

SEQ ID NO: 349574 - RNA, 19 nt, Human
cucccucucccccaccccc

SEQ ID NO: 349575 - RNA, 21 nt, Human
cuccugucacaauaaaagcuc

SEQ ID NO: 349576 - RNA, 19 nt, Human
cucucccccacccccaacc

SEQ ID NO: 349577 - RNA, 18 nt, Human
cucucucccucuccccca

SEQ ID NO: 349578 - RNA, 22 nt, Human
cucucugcaagcaugcugagag

SEQ ID NO: 349579 - RNA, 18 nt, Human
cucuguacuggccauguc

SEQ ID NO: 349580 - RNA, 19 nt, Human
cucuucuccaucccuuuuc

SEQ ID NO: 349581 - RNA, 22 nt, Human
cucuugggcucaggcguguucu

SEQ ID NO: 349582 - RNA, 21 nt, Human
cugaagcuggguuccugaugu

SEQ ID NO: 349583 - RNA, 21 nt, Human
cugaagggcaguuugcaucua

SEQ ID NO: 349584 - RNA, 20 nt, Human
cugcaacguggcggcagacg

SEQ ID NO: 349585 - RNA, 21 nt, Human
cugcacagaaaccagcguggg

SEQ ID NO: 349586 - RNA, 23 nt, Human
cugcagugaaacagguccuguac

SEQ ID NO: 349587 - RNA, 18 nt, Human
cugcugugcccuuccucc

SEQ ID NO: 349588 - RNA, 20 nt, Human
cugcuuccucacccauaucu

SEQ ID NO: 349589 - RNA, 23 nt, Human
cuggaaucugaaaaaaaaaaaag

SEQ ID NO: 349590 - RNA, 26 nt, Human
cuggcuccuucccuccagcccugcuc

SEQ ID NO: 349591 - RNA, 20 nt, Human
cuuccucacccauaucugaa

SEQ ID NO: 349592 - RNA, 20 nt, Human
cuuuucacgaagauuuugcu

SEQ ID NO: 349593 - RNA, 22 nt, Human
gaaaaaaaaaaaaguggcaccc

SEQ ID NO: 349594 - RNA, 19 nt, Human
gaaaaggagacaggcucau

SEQ ID NO: 349595 - RNA, 19 nt, Human
gaaaugaaucugccuccuu

SEQ ID NO: 349596 - RNA, 20 nt, Human
gaaauucgaggaaagucaag

SEQ ID NO: 349597 - RNA, 22 nt, Human
gaacgcacacacacaacaggcc

SEQ ID NO: 349598 - RNA, 21 nt, Human
gaauuuaagaauuguaagugg

SEQ ID NO: 349599 - RNA, 23 nt, Human
gacacaccugcuguaacucuaau

SEQ ID NO: 349600 - RNA, 19 nt, Human
gagaaaaagagacccucac

SEQ ID NO: 349601 - RNA, 21 nt, Human
gagcaguucaggcuggggaga

SEQ ID NO: 349602 - RNA, 24 nt, Human
gaugugguaaaaagaccaaaauga

SEQ ID NO: 349603 - RNA, 20 nt, Human
gcacgugggaaccccaggag

SEQ ID NO: 349604 - RNA, 19 nt, Human
gcucagagaaguacuuuca

SEQ ID NO: 349605 - RNA, 19 nt, Human
gcucucucccucuccccca

SEQ ID NO: 349606 - RNA, 21 nt, Human
ggaaagaaaacgugggugaag

SEQ ID NO: 349607 - RNA, 19 nt, Human
ggaagauuaagcaaguucu

SEQ ID NO: 349608 - RNA, 22 nt, Human
ggacacugcgguuccucccccg

SEQ ID NO: 349609 - RNA, 20 nt, Human
ggacaugaaaaacugaagcc

SEQ ID NO: 349610 - RNA, 20 nt, Human
ggagaaggagggaugcugcc

SEQ ID NO: 349611 - RNA, 26 nt, Human
ggagcccugaccgcuccugcugugcc

SEQ ID NO: 349612 - RNA, 21 nt, Human
ggaguagaggugugcaaguug

SEQ ID NO: 349613 - RNA, 20 nt, Human
ggcuaaaaaacaaaaagaaa

SEQ ID NO: 349614 - RNA, 21 nt, Human
gggagccucggggcccgccaa

SEQ ID NO: 349615 - RNA, 18 nt, Human
gggcagagggagagaaac

SEQ ID NO: 349616 - RNA, 20 nt, Human
guaaagaucaaacugugcag

SEQ ID NO: 349617 - RNA, 19 nt, Human
gucaaggaacuauucuagc

SEQ ID NO: 349618 - RNA, 21 nt, Human
gucaaucguuuccuuaaaaaa

SEQ ID NO: 349619 - RNA, 21 nt, Human
guccccccuccacggugacug

SEQ ID NO: 349620 - RNA, 22 nt, Human
gugaacaacacuuccaacgaag

SEQ ID NO: 349621 - RNA, 21 nt, Human
gugaggcagagggaggcagag

SEQ ID NO: 349622 - RNA, 18 nt, Human
gugguuccuguaagaacc

SEQ ID NO: 349623 - RNA, 18 nt, Human
guguguuuuucugagucc

SEQ ID NO: 349624 - RNA, 20 nt, Human
guuacuaguuuaaaaaugga

SEQ ID NO: 349625 - RNA, 22 nt, Human
guuucccuaugccagaaacaca

SEQ ID NO: 349626 - RNA, 24 nt, Human
guuucucugccaacucugcauaug

SEQ ID NO: 349627 - RNA, 24 nt, Human
uaaaaagaaaaacacuggacaaaa

SEQ ID NO: 349628 - RNA, 26 nt, Human
uaaaaguucaucuuaaaaagaaaaac

SEQ ID NO: 349629 - RNA, 24 nt, Human
uaaaugaauacuagacagccaaaa

SEQ ID NO: 349630 - RNA, 18 nt, Human
uaagcaaguucucugaac

SEQ ID NO: 349631 - RNA, 24 nt, Human
uaagcaaguucucugaacagaaac

SEQ ID NO: 349632 - RNA, 18 nt, Human
uaagcugaacggcaccga

SEQ ID NO: 349633 - RNA, 19 nt, Human
uacaaggaugacaaacaaa

SEQ ID NO: 349634 - RNA, 23 nt, Human
uacacaggagaaaguuagcuacc

SEQ ID NO: 349635 - RNA, 21 nt, Human
uaccaaguucaaaugcacuaa

SEQ ID NO: 349636 - RNA, 19 nt, Human
uaccuagaaaaccugcaag

SEQ ID NO: 349637 - RNA, 19 nt, Human
uaccugaaauagaaccaca

SEQ ID NO: 349638 - RNA, 23 nt, Human
uaccugaaauagaaccacaaaaa

SEQ ID NO: 349639 - RNA, 21 nt, Human
uacuugguauucuggaggaca

SEQ ID NO: 349640 - RNA, 21 nt, Human
uagaaaaccugcaagcaccau

SEQ ID NO: 349641 - RNA, 18 nt, Human
uagaaagaaccaauuauu

SEQ ID NO: 349642 - RNA, 20 nt, Human
uagaaaggguggcaguggag

SEQ ID NO: 349643 - RNA, 22 nt, Human
uaggaacaggaagugcugaaaa

SEQ ID NO: 349644 - RNA, 21 nt, Human
uaguggcaguggaggaggaga

SEQ ID NO: 349645 - RNA, 23 nt, Human
uauacagacaauuuauuuaaaac

SEQ ID NO: 349646 - RNA, 23 nt, Human
uauauagcacacuggucagacuc

SEQ ID NO: 349647 - RNA, 21 nt, Human
uaucacacaaguuauaaacuc

SEQ ID NO: 349648 - RNA, 21 nt, Human
uauggaaauucuuagagauug

SEQ ID NO: 349649 - RNA, 21 nt, Human
uauguuggagagaaaaauguu

SEQ ID NO: 349650 - RNA, 24 nt, Human
uauuuguucaguuuaguugcagcc

SEQ ID NO: 349651 - RNA, 19 nt, Human
ucaaacugugcaaagagug

SEQ ID NO: 349652 - RNA, 18 nt, Human
ucaaaucaucccaaacua

SEQ ID NO: 349653 - RNA, 30 nt, Human
ucaacaacaacagaaaucaaaucaucccaa

SEQ ID NO: 349654 - RNA, 22 nt, Human
ucaauacucgaaguaagccaaa

SEQ ID NO: 349655 - RNA, 22 nt, Human
ucagucccccaaaccuuuccca

SEQ ID NO: 349656 - RNA, 24 nt, Human
ucaguuuaguugcagccauccaag

SEQ ID NO: 349657 - RNA, 19 nt, Human
ucauuuauugucacauacu

SEQ ID NO: 349658 - RNA, 19 nt, Human
uccaaguuagaaaugggau

SEQ ID NO: 349659 - RNA, 21 nt, Human
uccacacuccacauucacuau

SEQ ID NO: 349660 - RNA, 22 nt, Human
uccacucuuucucucuuguucc

SEQ ID NO: 349661 - RNA, 23 nt, Human
uccagacagcaaacaaacuaaag

SEQ ID NO: 349662 - RNA, 21 nt, Human
uccagcccugcucuggccaga

SEQ ID NO: 349663 - RNA, 22 nt, Human
uccaggcucagaggcagggcuc

SEQ ID NO: 349664 - RNA, 30 nt, Human
ucccccacccccaaccccccuuaccccauu

SEQ ID NO: 349665 - RNA, 20 nt, Human
ucccgccauuacacaggaga

SEQ ID NO: 349666 - RNA, 24 nt, Human
ucccucccuccccccucugccccc

SEQ ID NO: 349667 - RNA, 21 nt, Human
ucccuguaguggcaguggagg

SEQ ID NO: 349668 - RNA, 21 nt, Human
uccgccaacagcagcucugga

SEQ ID NO: 349669 - RNA, 20 nt, Human
uccgugcaggcugaaaucca

SEQ ID NO: 349670 - RNA, 18 nt, Human
uccuuucagauaagaaaa

SEQ ID NO: 349671 - RNA, 20 nt, Human
ucuaaaccuauucaaauguu

SEQ ID NO: 349672 - RNA, 18 nt, Human
ucucagagauggcucugg

SEQ ID NO: 349673 - RNA, 23 nt, Human
ucucaguuucucugccaacucug

SEQ ID NO: 349674 - RNA, 20 nt, Human
ucuccacacuccacauucaa

SEQ ID NO: 349675 - RNA, 19 nt, Human
ucucccccacccccaaccc

SEQ ID NO: 349676 - RNA, 20 nt, Human
ucugaaaaaaaaaaaagugg

SEQ ID NO: 349677 - RNA, 21 nt, Human
ucugcagcuugaauggaccac

SEQ ID NO: 349678 - RNA, 18 nt, Human
ucugcauaugccuugaac

SEQ ID NO: 349679 - RNA, 23 nt, Human
ucugccccaguguggcccagaca

SEQ ID NO: 349680 - RNA, 19 nt, Human
ucugccuccuuccucucca

SEQ ID NO: 349681 - RNA, 24 nt, Human
ucugccuccuuccucuccacacuc

SEQ ID NO: 349682 - RNA, 21 nt, Human
ucuguaggggauccaggcucu

SEQ ID NO: 349683 - RNA, 18 nt, Human
ucuugguaacugcucuga

SEQ ID NO: 349684 - RNA, 22 nt, Human
ucuuuaaaaguucaucuuaaaa

SEQ ID NO: 349685 - RNA, 18 nt, Human
ugaaaaacugaagccggu

SEQ ID NO: 349686 - RNA, 26 nt, Human
ugaaacaguagccaugacaaccaaca

SEQ ID NO: 349687 - RNA, 21 nt, Human
ugaaauagaaccacaaaaauu

SEQ ID NO: 349688 - RNA, 21 nt, Human
ugaacccccccggcccaugcc

SEQ ID NO: 349689 - RNA, 18 nt, Human
ugaagaaaauucucagag

SEQ ID NO: 349690 - RNA, 22 nt, Human
ugacaaacaaaucugcagcuug

SEQ ID NO: 349691 - RNA, 21 nt, Human
ugagaaauacccuaugaaaac

SEQ ID NO: 349692 - RNA, 25 nt, Human
ugagaacaaagucuauguggcagcc

SEQ ID NO: 349693 - RNA, 20 nt, Human
ugagguaaguggcauccauc

SEQ ID NO: 349694 - RNA, 18 nt, Human
ugaguagaaaggguggca

SEQ ID NO: 349695 - RNA, 27 nt, Human
ugaguauucucuucuccaucccuuuuc

SEQ ID NO: 349696 - RNA, 19 nt, Human
ugauauuucggaucucugg

SEQ ID NO: 349697 - RNA, 23 nt, Human
ugaucugauauuaaaacauccag

SEQ ID NO: 349698 - RNA, 18 nt, Human
ugcacgcauauggaaaaa

SEQ ID NO: 349699 - RNA, 19 nt, Human
ugcagaaaagaccguggaa

SEQ ID NO: 349700 - RNA, 20 nt, Human
ugccacaagggaguggugac

SEQ ID NO: 349701 - RNA, 26 nt, Human
ugcucaucuucaaaaucuaauuccuc

SEQ ID NO: 349702 - RNA, 19 nt, Human
ugcucugaacccccccggc

SEQ ID NO: 349703 - RNA, 22 nt, Human
uggaaaacaggaaagaaagaac

SEQ ID NO: 349704 - RNA, 23 nt, Human
uggaaaacaggaaagaaagaaca

SEQ ID NO: 349705 - RNA, 24 nt, Human
uggaaaagagaggaaaccaaccca

SEQ ID NO: 349706 - RNA, 25 nt, Human
uggagccaggacuccacuggcugga

SEQ ID NO: 349707 - RNA, 18 nt, Human
uggagcccugaccgcucc

SEQ ID NO: 349708 - RNA, 24 nt, Human
uggauaaaaacugcaggaauauca

SEQ ID NO: 349709 - RNA, 22 nt, Human
uggcagcccguauuccucuuac

SEQ ID NO: 349710 - RNA, 24 nt, Human
uggcaggugguccccuccacagcc

SEQ ID NO: 349711 - RNA, 18 nt, Human
uggcaguggaggaggaga

SEQ ID NO: 349712 - RNA, 18 nt, Human
uggcaguugcucuuuaaa

SEQ ID NO: 349713 - RNA, 21 nt, Human
uggccaacacgcucagaacgc

SEQ ID NO: 349714 - RNA, 20 nt, Human
uggcuggcucuuucugcaac

SEQ ID NO: 349715 - RNA, 23 nt, Human
uggcuguugcuccacggggcuug

SEQ ID NO: 349716 - RNA, 22 nt, Human
ugggaaugaaagguuuaaaaac

SEQ ID NO: 349717 - RNA, 22 nt, Human
ugggccagaaaacugaaagagu

SEQ ID NO: 349718 - RNA, 21 nt, Human
uggggaagggggggcagaggg

SEQ ID NO: 349719 - RNA, 18 nt, Human
uggguggcaggugguccc

SEQ ID NO: 349720 - RNA, 23 nt, Human
uggguugacuccaggcuacaugg

SEQ ID NO: 349721 - RNA, 18 nt, Human
uggguuuagaguugagca

SEQ ID NO: 349722 - RNA, 19 nt, Human
uguaaauggaucugggguu

SEQ ID NO: 349723 - RNA, 21 nt, Human
uguaacaaaaauaacaauaag

SEQ ID NO: 349724 - RNA, 20 nt, Human
uguaagaaccagagaaaacc

SEQ ID NO: 349725 - RNA, 19 nt, Human
uguaccacacacacaccug

SEQ ID NO: 349726 - RNA, 27 nt, Human
ugucuggauggcucugauuuuagucug

SEQ ID NO: 349727 - RNA, 19 nt, Human
ugugaaagguuccgcagag

SEQ ID NO: 349728 - RNA, 22 nt, Human
ugugaugcacuucccuguagug

SEQ ID NO: 349729 - RNA, 22 nt, Human
ugugcacccccacaugcgugca

SEQ ID NO: 349730 - RNA, 19 nt, Human
uguggaagcaaaggccucc

SEQ ID NO: 349731 - RNA, 21 nt, Human
uguuccuggucugcagcagca

SEQ ID NO: 349732 - RNA, 24 nt, Human
uguucgcucucucccucuccccca

SEQ ID NO: 349733 - RNA, 22 nt, Human
uguuuggaguuucccuaugcca

SEQ ID NO: 349734 - RNA, 21 nt, Human
uuagaaaauagaauaugaauu

SEQ ID NO: 349735 - RNA, 19 nt, Human
uuagaaagaaauuuugcua

SEQ ID NO: 349736 - RNA, 22 nt, Human
uuagaaaugaaucugccuccuu

SEQ ID NO: 349737 - RNA, 23 nt, Human
uuauugucacauacuaguucaua

SEQ ID NO: 349738 - RNA, 21 nt, Human
uucaucuuaaaaagaaaaaca

SEQ ID NO: 349739 - RNA, 19 nt, Human
uucgcccugacuaauuucu

SEQ ID NO: 349740 - RNA, 21 nt, Human
uucuuggugauuguguuccau

SEQ ID NO: 349741 - RNA, 24 nt, Human
uugcagcugcuguugcucuggcug

SEQ ID NO: 349742 - RNA, 23 nt, Human
uuggcacagaaaguauugcacau

SEQ ID NO: 349743 - RNA, 23 nt, Human
uugggccauggagucugcuggcc

SEQ ID NO: 349744 - RNA, 21 nt, Human
uuggguuuagaguugagcagu

SEQ ID NO: 349745 - RNA, 22 nt, Human
uuuagucugauaaacggaaagu

SEQ ID NO: 349746 - RNA, 19 nt, Human
uuucccaucuuaguguugg

SEQ ID NO: 349747 - RNA, 22 nt, Human
uuuuuuuuugcaauuggcacug

SEQ ID NO: 349748 - RNA, 19 nt, Human
aacuuccaguuucggcaag

SEQ ID NO: 349749 - RNA, 21 nt, Human
acucugaaacagcauauggaa

SEQ ID NO: 349750 - RNA, 18 nt, Human
agaacgugagguggcccc

SEQ ID NO: 349751 - RNA, 22 nt, Human
agaagggaggagggaauuuggc

SEQ ID NO: 349752 - RNA, 18 nt, Human
aguagaagggaggaggga

SEQ ID NO: 349753 - RNA, 25 nt, Human
caaguaucuuccacugcaagugaac

SEQ ID NO: 349754 - RNA, 23 nt, Human
caaguuccuaaaugccucuacuc

SEQ ID NO: 349755 - RNA, 21 nt, Human
cggaagucggaggggucagac

SEQ ID NO: 349756 - RNA, 19 nt, Human
cgggagggacacgugagga

SEQ ID NO: 349757 - RNA, 19 nt, Human
cgguuccuccagggcagcc

SEQ ID NO: 349758 - RNA, 21 nt, Human
cucuuuaccggaagucggagg

SEQ ID NO: 349759 - RNA, 23 nt, Human
cuuccacugcaagugaacuguua

SEQ ID NO: 349760 - RNA, 23 nt, Human
gaagcagaacgugagguggcccc

SEQ ID NO: 349761 - RNA, 22 nt, Human
gaagcaguagaagggaggaggg

SEQ ID NO: 349762 - RNA, 21 nt, Human
gaauagcccccaaguuccuaa

SEQ ID NO: 349763 - RNA, 21 nt, Human
gcagaacgugagguggccccg

SEQ ID NO: 349764 - RNA, 26 nt, Human
gcggcgcgcuggguugcuuucucggg

SEQ ID NO: 349765 - RNA, 19 nt, Human
gcgggcgcgccgaggcgcc

SEQ ID NO: 349766 - RNA, 19 nt, Human
ggaauagcccccaaguucc

SEQ ID NO: 349767 - RNA, 21 nt, Human
gggaggagggaauuuggccuu

SEQ ID NO: 349768 - RNA, 20 nt, Human
uagaagcaguagaagggagg

SEQ ID NO: 349769 - RNA, 25 nt, Human
uagcagcaagaaucacucuuguuac

SEQ ID NO: 349770 - RNA, 19 nt, Human
uagcaguaauagcagcaag

SEQ ID NO: 349771 - RNA, 24 nt, Human
uauggaauuauggaauagccccca

SEQ ID NO: 349772 - RNA, 18 nt, Human
uccaaguaucuuccacug

SEQ ID NO: 349773 - RNA, 23 nt, Human
uccuaaaugccucuacucggucc

SEQ ID NO: 349774 - RNA, 18 nt, Human
uggauguuacaagaaauc

SEQ ID NO: 349775 - RNA, 21 nt, Human
uuggauguuacaagaaaucaa

SEQ ID NO: 349776 - RNA, 24 nt, Human
uuuuaaaaacaaaauaaaugaaau

SEQ ID NO: 349777 - RNA, 23 nt, Human
aaaaacaaaacaaaaacaaaaac

SEQ ID NO: 349778 - RNA, 21 nt, Human
aaaacaaaacaaaaacaaaaa

SEQ ID NO: 349779 - RNA, 24 nt, Human
aaaagcaauucgguggcugaacuu

SEQ ID NO: 349780 - RNA, 20 nt, Human
aaaaggaaggagggagaaag

SEQ ID NO: 349781 - RNA, 20 nt, Human
aaacaaaaacuucucacaga

SEQ ID NO: 349782 - RNA, 24 nt, Human
aaacaaaacaaaaacaaaaacuuc

SEQ ID NO: 349783 - RNA, 20 nt, Human
aaacaacuacacacaaggca

SEQ ID NO: 349784 - RNA, 24 nt, Human
aaauaaaagcaccccaucacgauc

SEQ ID NO: 349785 - RNA, 19 nt, Human
acaaaacaaaaacaaaaac

SEQ ID NO: 349786 - RNA, 24 nt, Human
acaaaacaaaaacaaaaacuucuc

SEQ ID NO: 349787 - RNA, 18 nt, Human
acccuugaggcccacagg

SEQ ID NO: 349788 - RNA, 27 nt, Human
agagaaaaauaaaagcaccccaucacg

SEQ ID NO: 349789 - RNA, 19 nt, Human
agagugcugaguggaggug

SEQ ID NO: 349790 - RNA, 21 nt, Human
agccuaauucccuucuucaga

SEQ ID NO: 349791 - RNA, 18 nt, Human
aggcccacaggagguugg

SEQ ID NO: 349792 - RNA, 18 nt, Human
aguuuguaaguuagaaac

SEQ ID NO: 349793 - RNA, 19 nt, Human
auccugaucaauuuaccaa

SEQ ID NO: 349794 - RNA, 23 nt, Human
augcagcccuguguucucuggaa

SEQ ID NO: 349795 - RNA, 20 nt, Human
caaaucagcugcacuggugc

SEQ ID NO: 349796 - RNA, 21 nt, Human
caaaucagcugcacuggugcc

SEQ ID NO: 349797 - RNA, 18 nt, Human
caagcaguucagaccacu

SEQ ID NO: 349798 - RNA, 20 nt, Human
cacaaggcaacguuucucau

SEQ ID NO: 349799 - RNA, 18 nt, Human
cagaggguugcucgggau

SEQ ID NO: 349800 - RNA, 22 nt, Human
cagagugcugaguggaggugua

SEQ ID NO: 349801 - RNA, 25 nt, Human
caguguccuuuaugaguacucacug

SEQ ID NO: 349802 - RNA, 20 nt, Human
cauugagcacccccgccccc

SEQ ID NO: 349803 - RNA, 21 nt, Human
ccaaacaacuacacacaaggc

SEQ ID NO: 349804 - RNA, 19 nt, Human
ccagagugcugaguggagg

SEQ ID NO: 349805 - RNA, 20 nt, Human
ccagagugcugaguggaggu

SEQ ID NO: 349806 - RNA, 21 nt, Human
ccagagugcugaguggaggug

SEQ ID NO: 349807 - RNA, 22 nt, Human
ccagagugcugaguggaggugu

SEQ ID NO: 349808 - RNA, 21 nt, Human
ccccacuuucaacuuccccuu

SEQ ID NO: 349809 - RNA, 24 nt, Human
cccccgcccccacuuucaacuucc

SEQ ID NO: 349810 - RNA, 18 nt, Human
ccgcccccacuuucaacu

SEQ ID NO: 349811 - RNA, 18 nt, Human
ccucauccaccucucacc

SEQ ID NO: 349812 - RNA, 22 nt, Human
cuacagaugacaguguuaaaaa

SEQ ID NO: 349813 - RNA, 21 nt, Human
cuaucaaaaucuaaagccuaa

SEQ ID NO: 349814 - RNA, 24 nt, Human
cucacagauugguagcaagcaguu

SEQ ID NO: 349815 - RNA, 22 nt, Human
cugacagcuucuuuucccaaau

SEQ ID NO: 349816 - RNA, 20 nt, Human
cugcaaguuaaaaaacaaaa

SEQ ID NO: 349817 - RNA, 19 nt, Human
cugcugcaauugugaaagc

SEQ ID NO: 349818 - RNA, 19 nt, Human
cuggaagguuucuggucuc

SEQ ID NO: 349819 - RNA, 22 nt, Human
cuggugccuguuuccucaucca

SEQ ID NO: 349820 - RNA, 25 nt, Human
cuugaggcccacaggagguugggaa

SEQ ID NO: 349821 - RNA, 24 nt, Human
cuugccaaaacauucuuuugccca

SEQ ID NO: 349822 - RNA, 24 nt, Human
cuuuccgcuccuuuucuuuggagg

SEQ ID NO: 349823 - RNA, 23 nt, Human
gcucgggaugcagcccuguguuc

SEQ ID NO: 349824 - RNA, 21 nt, Human
ggacgauggcaacacgcuccu

SEQ ID NO: 349825 - RNA, 20 nt, Human
ggcaucaaaaauuucaaacc

SEQ ID NO: 349826 - RNA, 23 nt, Human
guugcugucgauacuugcugucu

SEQ ID NO: 349827 - RNA, 19 nt, Human
uaaaagcaccccaucacga

SEQ ID NO: 349828 - RNA, 22 nt, Human
uaaaagcaccccaucacgauca

SEQ ID NO: 349829 - RNA, 19 nt, Human
uaaaaggaaggagggagaa

SEQ ID NO: 349830 - RNA, 23 nt, Human
uaagauagggacagucacauaga

SEQ ID NO: 349831 - RNA, 18 nt, Human
uaaguuagaaacuucuga

SEQ ID NO: 349832 - RNA, 22 nt, Human
uacucacugcuagagacauagc

SEQ ID NO: 349833 - RNA, 21 nt, Human
uagcaagcaguucagaccacu

SEQ ID NO: 349834 - RNA, 22 nt, Human
uauacugcaaguuaaaaaacaa

SEQ ID NO: 349835 - RNA, 24 nt, Human
uauacugcaaguuaaaaaacaaaa

SEQ ID NO: 349836 - RNA, 22 nt, Human
ucaaagagaaaaauaaaagcac

SEQ ID NO: 349837 - RNA, 23 nt, Human
ucagaggguugcucgggaugcag

SEQ ID NO: 349838 - RNA, 21 nt, Human
ucucuggaagguuucuggucu

SEQ ID NO: 349839 - RNA, 19 nt, Human
ugaaucaaagugacuuuug

SEQ ID NO: 349840 - RNA, 18 nt, Human
ugacaguguuaaaaaaaa

SEQ ID NO: 349841 - RNA, 18 nt, Human
ugagcacccccgccccca

SEQ ID NO: 349842 - RNA, 21 nt, Human
ugauaaaagcaauucgguggc

SEQ ID NO: 349843 - RNA, 22 nt, Human
ugcaaguuaaaaaacaaaacaa

SEQ ID NO: 349844 - RNA, 18 nt, Human
ugcuagagacauagcuuc

SEQ ID NO: 349845 - RNA, 19 nt, Human
ugcugaguggagguguaac

SEQ ID NO: 349846 - RNA, 23 nt, Human
uggaagguuucuggucuccaguu

SEQ ID NO: 349847 - RNA, 19 nt, Human
uggcaacacgcuccugguc

SEQ ID NO: 349848 - RNA, 20 nt, Human
ugguaguaaaaggaaggagg

SEQ ID NO: 349849 - RNA, 19 nt, Human
ugugguggaauugggugcc

SEQ ID NO: 349850 - RNA, 20 nt, Human
uucagaggguugcucgggau

SEQ ID NO: 349851 - RNA, 22 nt, Human
uucccuucuucagaggguugcu

SEQ ID NO: 349852 - RNA, 18 nt, Human
uucgucuuaauucuguuc

SEQ ID NO: 349853 - RNA, 24 nt, Human
uugauccaguguccuuuaugagua

SEQ ID NO: 349854 - RNA, 27 nt, Human
uuucccaaauuacucucaaaaggcugg

SEQ ID NO: 349855 - RNA, 21 nt, Human
aaaaaaaagaaaagaaaaaga

SEQ ID NO: 349856 - RNA, 19 nt, Human
aaacagcuaaaaagcaagc

SEQ ID NO: 349857 - RNA, 23 nt, Human
aaagguaacaguguauuguuuga

SEQ ID NO: 349858 - RNA, 23 nt, Human
aaagguaacaguguauuguuuga

SEQ ID NO: 349859 - RNA, 22 nt, Human
aaauaauucacugaaugucauc

SEQ ID NO: 349860 - RNA, 22 nt, Human
aaauaauucacugaaugucauc

SEQ ID NO: 349861 - RNA, 20 nt, Human
aacuucuuauauugcacccc

SEQ ID NO: 349862 - RNA, 25 nt, Human
aagcaagccaauuuaaaaucccuaa

SEQ ID NO: 349863 - RNA, 18 nt, Human
aagcaguacagaagccaa

SEQ ID NO: 349864 - RNA, 20 nt, Human
aagugaacaggaaauaucca

SEQ ID NO: 349865 - RNA, 20 nt, Human
aagugaacaggaaauaucca

SEQ ID NO: 349866 - RNA, 21 nt, Human
agaaaagaaaaagaugacaaa

SEQ ID NO: 349867 - RNA, 22 nt, Human
agacgaagaagaauacaaagaa

SEQ ID NO: 349868 - RNA, 25 nt, Human
agccaauuuaaaaucccuaagucuc

SEQ ID NO: 349869 - RNA, 20 nt, Human
agcugcacuagaugcugcag

SEQ ID NO: 349870 - RNA, 23 nt, Human
aucagcuauucuaaaaaaaagaa

SEQ ID NO: 349871 - RNA, 19 nt, Human
augcugugaaaagugcugc

SEQ ID NO: 349872 - RNA, 23 nt, Human
augugcaauccuuaucucuaaag

SEQ ID NO: 349873 - RNA, 21 nt, Human
cacugaaugucaucccccaaa

SEQ ID NO: 349874 - RNA, 21 nt, Human
cacugaaugucaucccccaaa

SEQ ID NO: 349875 - RNA, 20 nt, Human
cagcuaaaaagcaagccaau

SEQ ID NO: 349876 - RNA, 21 nt, Human
ccaaccacaauugccccaguu

SEQ ID NO: 349877 - RNA, 24 nt, Human
ccacugaaauaauucacugaaugu

SEQ ID NO: 349878 - RNA, 24 nt, Human
ccacugaaauaauucacugaaugu

SEQ ID NO: 349879 - RNA, 18 nt, Human
cccaaaaauauggagaau

SEQ ID NO: 349880 - RNA, 18 nt, Human
cccaaaaauauggagaau

SEQ ID NO: 349881 - RNA, 23 nt, Human
ccccugaauccuacaaccauaag

SEQ ID NO: 349882 - RNA, 22 nt, Human
ccccugcgcgcucacgucgccc

SEQ ID NO: 349883 - RNA, 25 nt, Human
cccuaagucucugcuggccuauuuc

SEQ ID NO: 349884 - RNA, 19 nt, Human
ccgccgccccccugcgcgc

SEQ ID NO: 349885 - RNA, 21 nt, Human
ccgccgccccccugcgcgcuc

SEQ ID NO: 349886 - RNA, 22 nt, Human
ccuacaaccauaagcaguacag

SEQ ID NO: 349887 - RNA, 26 nt, Human
ccuacaaccauaagcaguacagaagc

SEQ ID NO: 349888 - RNA, 21 nt, Human
cgacccaggcgcagagagaga

SEQ ID NO: 349889 - RNA, 19 nt, Human
cuaaaaagcaagccaauuu

SEQ ID NO: 349890 - RNA, 18 nt, Human
cuauucuaaaaaaaagaa

SEQ ID NO: 349891 - RNA, 21 nt, Human
cuccuguugggccuucucaaa

SEQ ID NO: 349892 - RNA, 22 nt, Human
cucucuggcucucggcgucacc

SEQ ID NO: 349893 - RNA, 21 nt, Human
cugguuacccuugaaagcauu

SEQ ID NO: 349894 - RNA, 25 nt, Human
cuguugggccuucucaaaacuagca

SEQ ID NO: 349895 - RNA, 18 nt, Human
gaacaggaaauauccaug

SEQ ID NO: 349896 - RNA, 18 nt, Human
gaacaggaaauauccaug

SEQ ID NO: 349897 - RNA, 18 nt, Human
gaaugucaucccccaaaa

SEQ ID NO: 349898 - RNA, 18 nt, Human
gaaugucaucccccaaaa

SEQ ID NO: 349899 - RNA, 21 nt, Human
gcacauaggcucuucacuggg

SEQ ID NO: 349900 - RNA, 18 nt, Human
ggagaauauuuauuuagc

SEQ ID NO: 349901 - RNA, 18 nt, Human
ggagaauauuuauuuagc

SEQ ID NO: 349902 - RNA, 21 nt, Human
ggugacugaaacagcuaaaaa

SEQ ID NO: 349903 - RNA, 21 nt, Human
guauuguuugaagauucuuaa

SEQ ID NO: 349904 - RNA, 21 nt, Human
uaaccccugaauccuacaacc

SEQ ID NO: 349905 - RNA, 19 nt, Human
uaagaaauguggugcccau

SEQ ID NO: 349906 - RNA, 21 nt, Human
uaagacaaggaaguuuuccug

SEQ ID NO: 349907 - RNA, 21 nt, Human
uaagacaaggaaguuuuccug

SEQ ID NO: 349908 - RNA, 21 nt, Human
uaagcaguacagaagccaaaa

SEQ ID NO: 349909 - RNA, 24 nt, Human
uaaguaccauuauuaauuuucagu

SEQ ID NO: 349910 - RNA, 24 nt, Human
uaaguaccauuauuaauuuucagu

SEQ ID NO: 349911 - RNA, 19 nt, Human
uauaaacuucuuauauugc

SEQ ID NO: 349912 - RNA, 21 nt, Human
uauggagaauauuuauuuagc

SEQ ID NO: 349913 - RNA, 21 nt, Human
uauggagaauauuuauuuagc

SEQ ID NO: 349914 - RNA, 19 nt, Human
uauugcacccccaaacuuu

SEQ ID NO: 349915 - RNA, 18 nt, Human
uauuuugguugagaccag

SEQ ID NO: 349916 - RNA, 20 nt, Human
ucaaaacuagcaccuguugu

SEQ ID NO: 349917 - RNA, 25 nt, Human
ucaaaagguaacaguguauuguuug

SEQ ID NO: 349918 - RNA, 25 nt, Human
ucaaaagguaacaguguauuguuug

SEQ ID NO: 349919 - RNA, 22 nt, Human
uccauuaaccccugaauccuac

SEQ ID NO: 349920 - RNA, 20 nt, Human
ucccccaaaaauauggagaa

SEQ ID NO: 349921 - RNA, 20 nt, Human
ucccccaaaaauauggagaa

SEQ ID NO: 349922 - RNA, 19 nt, Human
uccuguugggccuucucaa

SEQ ID NO: 349923 - RNA, 25 nt, Human
ucucuggcucucggcgucacccacc

SEQ ID NO: 349924 - RNA, 23 nt, Human
ugaaacagcuaaaaagcaagcca

SEQ ID NO: 349925 - RNA, 19 nt, Human
ugaacaggaaauauccaug

SEQ ID NO: 349926 - RNA, 19 nt, Human
ugaacaggaaauauccaug

SEQ ID NO: 349927 - RNA, 23 nt, Human
ugaacaggaaauauccaugcugu

SEQ ID NO: 349928 - RNA, 23 nt, Human
ugaacaggaaauauccaugcugu

SEQ ID NO: 349929 - RNA, 21 nt, Human
ugacaaauauagacgaagaag

SEQ ID NO: 349930 - RNA, 22 nt, Human
ugacaaauauagacgaagaaga

SEQ ID NO: 349931 - RNA, 18 nt, Human
ugagaccaguaagggaug

SEQ ID NO: 349932 - RNA, 22 nt, Human
uggacaucacaccuguugcaaa

SEQ ID NO: 349933 - RNA, 22 nt, Human
uguacugcauauuauauaaacu

SEQ ID NO: 349934 - RNA, 19 nt, Human
uuauauugcacccccaaac

SEQ ID NO: 349935 - RNA, 21 nt, Human
uucacugaaugucauccccca

SEQ ID NO: 349936 - RNA, 21 nt, Human
uucacugaaugucauccccca

SEQ ID NO: 349937 - RNA, 25 nt, Human
uugagaccaguaagggaugaaaucc

SEQ ID NO: 349938 - RNA, 20 nt, Human
uuuuuuuuuuuuuuuuuggu

SEQ ID NO: 349939 - RNA, 28 nt, Human
uuuuuuuuuuuuuuuuuuuuuuuggggg

SEQ ID NO: 349940 - RNA, 24 nt, Human
acaaccaccaccacauaaggcacc

SEQ ID NO: 349941 - RNA, 20 nt, Human
acuccgcgaacgcugcugcc

SEQ ID NO: 349942 - RNA, 23 nt, Human
aggcgagagaaaggcugaggggg

SEQ ID NO: 349943 - RNA, 24 nt, Human
cagaaggcaggcgagagaaaggcc

SEQ ID NO: 349944 - RNA, 23 nt, Human
caggucugugcugggcacaacca

SEQ ID NO: 349945 - RNA, 23 nt, Human
ccaccacauaaggcacccacgga

SEQ ID NO: 349946 - RNA, 21 nt, Human
ccacggaaagugcagcucaga

SEQ ID NO: 349947 - RNA, 23 nt, Human
ccacggcaagaacccugccaggu

SEQ ID NO: 349948 - RNA, 22 nt, Human
ccagacccagcggcgcuucgug

SEQ ID NO: 349949 - RNA, 19 nt, Human
ccuccgggcacccagaccc

SEQ ID NO: 349950 - RNA, 21 nt, Human
ccuccgggcacccagacccag

SEQ ID NO: 349951 - RNA, 22 nt, Human
cucagaaggcaggcgagagaaa

SEQ ID NO: 349952 - RNA, 20 nt, Human
cuccgcgaacgcugcugccu

SEQ ID NO: 349953 - RNA, 21 nt, Human
cugccaggucugugcugggga

SEQ ID NO: 349954 - RNA, 19 nt, Human
gagagaagagaggaggaag

SEQ ID NO: 349955 - RNA, 22 nt, Human
ggagagcuggucgcugagggag

SEQ ID NO: 349956 - RNA, 22 nt, Human
ggcaagaacccugccaggucug

SEQ ID NO: 349957 - RNA, 23 nt, Human
uaaggcacccacggaaagugcag

SEQ ID NO: 349958 - RNA, 22 nt, Human
uccgcgaacgcugcugccuccg

SEQ ID NO: 349959 - RNA, 24 nt, Human
uccgcgaacgcugcugccuccggg

SEQ ID NO: 349960 - RNA, 25 nt, Human
uccgcgaacgcugcugccuccgggc

SEQ ID NO: 349961 - RNA, 21 nt, Human
ugagggaggaggaagagccac

SEQ ID NO: 349962 - RNA, 21 nt, Human
ugagggggagagaagagagga

SEQ ID NO: 349963 - RNA, 24 nt, Human
ugagggggagagaagagaggagga

SEQ ID NO: 349964 - RNA, 21 nt, Human
uuccagggagagcuggucgcu

SEQ ID NO: 349965 - RNA, 24 nt, Human
uucccugucccucccguuccaggg

SEQ ID NO: 349966 - RNA, 22 nt, Human
uuuuuuuuuuuuuuuuaccaga

SEQ ID NO: 349967 - RNA, 22 nt, Human
uuuuuuuuuuuuuuuuuaccag

SEQ ID NO: 349968 - RNA, 22 nt, Human
aaagugcccccacgugauaccu

SEQ ID NO: 349969 - RNA, 21 nt, Human
acacgccugucagguucagca

SEQ ID NO: 349970 - RNA, 18 nt, Human
acagcagagggaagcugg

SEQ ID NO: 349971 - RNA, 22 nt, Human
acccagugcccacaaccaacua

SEQ ID NO: 349972 - RNA, 22 nt, Human
agcaguggcgguagcgguagcc

SEQ ID NO: 349973 - RNA, 24 nt, Human
agcuaagacgaaagugcccccacg

SEQ ID NO: 349974 - RNA, 22 nt, Human
auggccauaggauugggagcac

SEQ ID NO: 349975 - RNA, 20 nt, Human
caaggauccccgcagcagcc

SEQ ID NO: 349976 - RNA, 22 nt, Human
caagucccagagaccuuaggga

SEQ ID NO: 349977 - RNA, 19 nt, Human
cagcaguggcgguagcggu

SEQ ID NO: 349978 - RNA, 23 nt, Human
cagcucccucaaguagcagggcc

SEQ ID NO: 349979 - RNA, 19 nt, Human
cagggccagggcaucccag

SEQ ID NO: 349980 - RNA, 23 nt, Human
ccacacgccugucagguucagca

SEQ ID NO: 349981 - RNA, 20 nt, Human
ccacgugauaccucuaaccc

SEQ ID NO: 349982 - RNA, 21 nt, Human
ccagugcccacaaccaacuac

SEQ ID NO: 349983 - RNA, 23 nt, Human
cccagugcccacaaccaacuacc

SEQ ID NO: 349984 - RNA, 20 nt, Human
cccucagaguccacuucacu

SEQ ID NO: 349985 - RNA, 21 nt, Human
cccucagaguccacuucacuc

SEQ ID NO: 349986 - RNA, 22 nt, Human
ccuccgcggcccucugcccucc

SEQ ID NO: 349987 - RNA, 18 nt, Human
cgaagcaacagccguggc

SEQ ID NO: 349988 - RNA, 30 nt, Human
cgcagcaguggcgguagcgguagcccucuu

SEQ ID NO: 349989 - RNA, 23 nt, Human
cggccuccgcggcccucugcccu

SEQ ID NO: 349990 - RNA, 21 nt, Human
cuccgcggcccucugcccucc

SEQ ID NO: 349991 - RNA, 21 nt, Human
cugcggccuccgcggcccucu

SEQ ID NO: 349992 - RNA, 19 nt, Human
gaccggaagggccacaagg

SEQ ID NO: 349993 - RNA, 24 nt, Human
gcagcaguguggccugaugggggg

SEQ ID NO: 349994 - RNA, 25 nt, Human
ggcagcaguguggccugaugggggg

SEQ ID NO: 349995 - RNA, 26 nt, Human
guggcgguagcgguagcccucagagu

SEQ ID NO: 349996 - RNA, 23 nt, Human
uaacccagugcccacaaccaacu

SEQ ID NO: 349997 - RNA, 24 nt, Human
uaaccgaagcaacagccguggcac

SEQ ID NO: 349998 - RNA, 21 nt, Human
uagcgguagcccucagagucc

SEQ ID NO: 349999 - RNA, 26 nt, Human
uccaccgaccggaagggccacaagga

SEQ ID NO: 350000 - RNA, 18 nt, Human
ugaugucucuccaagucc

SEQ ID NO: 350001 - RNA, 18 nt, Human
ugcaacugcggccuccgc

SEQ ID NO: 350002 - RNA, 19 nt, Human
uggcacagcagagggaagc

SEQ ID NO: 350003 - RNA, 22 nt, Human
uggcagcaguguggccugaugg

SEQ ID NO: 350004 - RNA, 19 nt, Human
uggccugauggggggacua

SEQ ID NO: 350005 - RNA, 21 nt, Human
uggcgguagcgguagcccucu

SEQ ID NO: 350006 - RNA, 21 nt, Human
uuuuauuuaaauaaccgaagc

SEQ ID NO: 350007 - RNA, 20 nt, Human
uuuuuuuuuuuuuuugucag

SEQ ID NO: 350008 - RNA, 18 nt, Human
uuuuuuuuuuuuuuuuug

SEQ ID NO: 350009 - RNA, 23 nt, Human
uuuuuuuuuuuuuuuuugucagu

SEQ ID NO: 350010 - RNA, 19 nt, Human
aaccaguaauguccuccuc

SEQ ID NO: 350011 - RNA, 20 nt, Human
aagaauauauuuccuggguu

SEQ ID NO: 350012 - RNA, 19 nt, Human
acucugaggugucaagaga

SEQ ID NO: 350013 - RNA, 21 nt, Human
agaacaaccaguaauguccuc

SEQ ID NO: 350014 - RNA, 27 nt, Human
agccagaacaaccaguaauguccuccu

SEQ ID NO: 350015 - RNA, 21 nt, Human
aggaguccaaggcguuggugg

SEQ ID NO: 350016 - RNA, 19 nt, Human
aggcaggagagagggaaga

SEQ ID NO: 350017 - RNA, 19 nt, Human
caaaccagccagaacaacu

SEQ ID NO: 350018 - RNA, 25 nt, Human
caguaauguccuccucccaagguuu

SEQ ID NO: 350019 - RNA, 22 nt, Human
ccaguaauguccuccucccaag

SEQ ID NO: 350020 - RNA, 20 nt, Human
ccucccaagguuuccuucuc

SEQ ID NO: 350021 - RNA, 19 nt, Human
cgggaggcggacgggcugg

SEQ ID NO: 350022 - RNA, 22 nt, Human
cuuacagucacucugagguguc

SEQ ID NO: 350023 - RNA, 19 nt, Human
cuucccacuugucuuacug

SEQ ID NO: 350024 - RNA, 20 nt, Human
gacacauuuacacaugggga

SEQ ID NO: 350025 - RNA, 18 nt, Human
ggagagaggcgggacggg

SEQ ID NO: 350026 - RNA, 21 nt, Human
ggcagaaguagggagugggaa

SEQ ID NO: 350027 - RNA, 22 nt, Human
gggacggggcgcgggcccuggu

SEQ ID NO: 350028 - RNA, 20 nt, Human
gggcgcgggcccuggucggg

SEQ ID NO: 350029 - RNA, 23 nt, Human
gugggaacuuuugaugaucaguu

SEQ ID NO: 350030 - RNA, 18 nt, Human
uaaaggcaggagagaggg

SEQ ID NO: 350031 - RNA, 18 nt, Human
uggacacauuuacacaug

SEQ ID NO: 350032 - RNA, 18 nt, Human
uggcugggcgggagagag

SEQ ID NO: 350033 - RNA, 18 nt, Human
ugggguggcagaaguagg

SEQ ID NO: 350034 - RNA, 19 nt, Human
ugucaagagacuugggucu

SEQ ID NO: 350035 - RNA, 20 nt, Human
uguggaaaaggcagaugugg

SEQ ID NO: 350036 - RNA, 22 nt, Human
uguguggacacauuuacacaug

SEQ ID NO: 350037 - RNA, 20 nt, Human
uugaugaacgugccucuucc

SEQ ID NO: 350038 - RNA, 23 nt, Human
uugggucucuucagcaaagagag

SEQ ID NO: 350039 - RNA, 25 nt, Human
uuguguggacacauuuacacauggg

SEQ ID NO: 350040 - RNA, 22 nt, Human
aaaaaacucgcaugauacacua

SEQ ID NO: 350041 - RNA, 25 nt, Human
aaacauuacaaaucacaccagaagu

SEQ ID NO: 350042 - RNA, 24 nt, Human
aagcaauucucgugccuuggccuc

SEQ ID NO: 350043 - RNA, 19 nt, Human
aaguagcugggacugcagg

SEQ ID NO: 350044 - RNA, 20 nt, Human
aaguagcugggacugcaggu

SEQ ID NO: 350045 - RNA, 24 nt, Human
aauagugaugaauucuucacacaa

SEQ ID NO: 350046 - RNA, 18 nt, Human
acaggguuucaccauguu

SEQ ID NO: 350047 - RNA, 21 nt, Human
acaggguuucaccauguuggc

SEQ ID NO: 350048 - RNA, 22 nt, Human
acaggguuucaccauguuggcc

SEQ ID NO: 350049 - RNA, 25 nt, Human
acaggguuucaccauguuggccugg

SEQ ID NO: 350050 - RNA, 25 nt, Human
acucugucgcccaggcuggagugca

SEQ ID NO: 350051 - RNA, 20 nt, Human
acuuggcuaauuuuuaguag

SEQ ID NO: 350052 - RNA, 24 nt, Human
agcaauucucgugccuuggccucc

SEQ ID NO: 350053 - RNA, 25 nt, Human
aggcuggagugcaguggcgcgaucu

SEQ ID NO: 350054 - RNA, 21 nt, Human
aggugaccgacgggguggggc

SEQ ID NO: 350055 - RNA, 23 nt, Human
agugcaguggcgcgaucuuggcu

SEQ ID NO: 350056 - RNA, 24 nt, Human
agugcaguggcgcgaucuuggcuc

SEQ ID NO: 350057 - RNA, 19 nt, Human
auucuuuagcauucuuugu

SEQ ID NO: 350058 - RNA, 27 nt, Human
caagcaauucucgugccuuggccuccc

SEQ ID NO: 350059 - RNA, 21 nt, Human
caauaguagcauacuaugcua

SEQ ID NO: 350060 - RNA, 20 nt, Human
cacauucuucagcaucuacc

SEQ ID NO: 350061 - RNA, 18 nt, Human
caccauguuggccuggcu

SEQ ID NO: 350062 - RNA, 24 nt, Human
cacucugucgcccaggcuggagug

SEQ ID NO: 350063 - RNA, 22 nt, Human
cagcaucuaccaaaaaaaacuc

SEQ ID NO: 350064 - RNA, 27 nt, Human
cagcaucuaccaaaaaaaacucgcaug

SEQ ID NO: 350065 - RNA, 24 nt, Human
caggguuucaccauguuggccugg

SEQ ID NO: 350066 - RNA, 19 nt, Human
caguggcgcgaucuuggcu

SEQ ID NO: 350067 - RNA, 23 nt, Human
ccaaaaaaaacucgcaugauaca

SEQ ID NO: 350068 - RNA, 25 nt, Human
ccacauucuucagcaucuaccaaaa

SEQ ID NO: 350069 - RNA, 22 nt, Human
cccaaguagcugggacugcagg

SEQ ID NO: 350070 - RNA, 23 nt, Human
cccaaguagcugggacugcaggu

SEQ ID NO: 350071 - RNA, 22 nt, Human
cccggauuaagaacagcggggc

SEQ ID NO: 350072 - RNA, 18 nt, Human
cgaccuagacucaggcua

SEQ ID NO: 350073 - RNA, 24 nt, Human
cgcccaggcuggagugcaguggcg

SEQ ID NO: 350074 - RNA, 24 nt, Human
cgggccggggcucacaacaaggaa

SEQ ID NO: 350075 - RNA, 23 nt, Human
cuaccaaaaaaaacucgcaugau

SEQ ID NO: 350076 - RNA, 24 nt, Human
cuaccaaaaaaaacucgcaugaua

SEQ ID NO: 350077 - RNA, 24 nt, Human
cucacucugucgcccaggcuggag

SEQ ID NO: 350078 - RNA, 19 nt, Human
cucacugcaaccucugccu

SEQ ID NO: 350079 - RNA, 22 nt, Human
cucacugcaaccucugccuacc

SEQ ID NO: 350080 - RNA, 25 nt, Human
cucgugccuuggccucccaaguagc

SEQ ID NO: 350081 - RNA, 19 nt, Human
cucgugcuuucaugacgcu

SEQ ID NO: 350082 - RNA, 24 nt, Human
cugcaaccucugccuaccuuguuc

SEQ ID NO: 350083 - RNA, 19 nt, Human
cugucgcccaggcuggagu

SEQ ID NO: 350084 - RNA, 24 nt, Human
cuuggccucccaaguagcugggac

SEQ ID NO: 350085 - RNA, 20 nt, Human
gaccuagacucaggcuagcg

SEQ ID NO: 350086 - RNA, 21 nt, Human
gaccuagacucaggcuagcgg

SEQ ID NO: 350087 - RNA, 21 nt, Human
gagcgcagggcgugcggggaa

SEQ ID NO: 350088 - RNA, 19 nt, Human
gcccaggcuggagugcagu

SEQ ID NO: 350089 - RNA, 20 nt, Human
gcccaggcuggagugcagug

SEQ ID NO: 350090 - RNA, 23 nt, Human
gcggcccggauuaagaacagcgg

SEQ ID NO: 350091 - RNA, 19 nt, Human
gcuggagugcaguggcgcg

SEQ ID NO: 350092 - RNA, 18 nt, Human
ggccggggcucacaacaa

SEQ ID NO: 350093 - RNA, 20 nt, Human
gguagggugguauuucuuag

SEQ ID NO: 350094 - RNA, 22 nt, Human
gugccuuggccucccaaguagc

SEQ ID NO: 350095 - RNA, 23 nt, Human
gugccuuggccucccaaguagcu

SEQ ID NO: 350096 - RNA, 18 nt, Human
uaaauccaaagcauuugc

SEQ ID NO: 350097 - RNA, 18 nt, Human
uacuaugcuauaguagac

SEQ ID NO: 350098 - RNA, 22 nt, Human
uagacucaggcuagcggcccgg

SEQ ID NO: 350099 - RNA, 22 nt, Human
uagagacaggguuucaccaugu

SEQ ID NO: 350100 - RNA, 24 nt, Human
uaguagagacaggguuucaccaug

SEQ ID NO: 350101 - RNA, 26 nt, Human
uaguagagacaggguuucaccauguu

SEQ ID NO: 350102 - RNA, 24 nt, Human
uauccuucauuuaauuucacauca

SEQ ID NO: 350103 - RNA, 18 nt, Human
ucacugcaaccucugccu

SEQ ID NO: 350104 - RNA, 19 nt, Human
ucacugcaaccucugccua

SEQ ID NO: 350105 - RNA, 24 nt, Human
ucacugcaaccucugccuaccuug

SEQ ID NO: 350106 - RNA, 24 nt, Human
ucccaaguagcugggacugcaggu

SEQ ID NO: 350107 - RNA, 24 nt, Human
ucgcccaggcuggagugcaguggc

SEQ ID NO: 350108 - RNA, 23 nt, Human
ucucacucugucgcccaggcugg

SEQ ID NO: 350109 - RNA, 24 nt, Human
ucucacucugucgcccaggcugga

SEQ ID NO: 350110 - RNA, 26 nt, Human
ucucacucugucgcccaggcuggagu

SEQ ID NO: 350111 - RNA, 27 nt, Human
ucucacucugucgcccaggcuggagug

SEQ ID NO: 350112 - RNA, 24 nt, Human
ucugucgcccaggcuggagugcag

SEQ ID NO: 350113 - RNA, 22 nt, Human
ugagauggagucucacucuguc

SEQ ID NO: 350114 - RNA, 19 nt, Human
ugccauuugcaacuucauc

SEQ ID NO: 350115 - RNA, 24 nt, Human
uggagucucacucugucgcccagg

SEQ ID NO: 350116 - RNA, 23 nt, Human
uggagugcaguggcgcgaucuug

SEQ ID NO: 350117 - RNA, 24 nt, Human
uggagugcaguggcgcgaucuugg

SEQ ID NO: 350118 - RNA, 24 nt, Human
uggcucacugcaaccucugccuac

SEQ ID NO: 350119 - RNA, 18 nt, Human
ugguagggugguauuucu

SEQ ID NO: 350120 - RNA, 19 nt, Human
uguccaaugauuaagaaac

SEQ ID NO: 350121 - RNA, 22 nt, Human
uuaauauccuucauuuaauuuc

SEQ ID NO: 350122 - RNA, 24 nt, Human
uuaguagagacaggguuucaccau

SEQ ID NO: 350123 - RNA, 21 nt, Human
uugccaggcccaucaucgcac

SEQ ID NO: 350124 - RNA, 23 nt, Human
uuggcuaauuuuuaguagagaca

SEQ ID NO: 350125 - RNA, 19 nt, Human
uuguacgguaaaaugcuuu

SEQ ID NO: 350126 - RNA, 21 nt, Human
uuucaccauguuggccuggcu

SEQ ID NO: 350127 - RNA, 24 nt, Human
uuuuuaguagagacaggguuucac

SEQ ID NO: 350128 - RNA, 26 nt, Human
uuuuuuuuuucugagauggagucuca

SEQ ID NO: 350129 - RNA, 24 nt, Human
aaaagaaaacccuuccccagcaga

SEQ ID NO: 350130 - RNA, 23 nt, Human
aaaaucccacccaaucacagaaa

SEQ ID NO: 350131 - RNA, 22 nt, Human
aaacacaaucucagauuaguac

SEQ ID NO: 350132 - RNA, 21 nt, Human
aaacaucccucuuuggaaggg

SEQ ID NO: 350133 - RNA, 19 nt, Human
aaagaccauucguuuuagg

SEQ ID NO: 350134 - RNA, 24 nt, Human
aaagcauuagucaugccucaaaac

SEQ ID NO: 350135 - RNA, 18 nt, Human
aacacugugauuagaaaa

SEQ ID NO: 350136 - RNA, 20 nt, Human
aaccaccagcauaacauggc

SEQ ID NO: 350137 - RNA, 21 nt, Human
aacuucaagacuucuugauau

SEQ ID NO: 350138 - RNA, 24 nt, Human
aagagauuccuaacccugcccccu

SEQ ID NO: 350139 - RNA, 19 nt, Human
aagguucucaaauucuguu

SEQ ID NO: 350140 - RNA, 22 nt, Human
aaguugucagcacaccccccaa

SEQ ID NO: 350141 - RNA, 18 nt, Human
acacacucccacccacac

SEQ ID NO: 350142 - RNA, 20 nt, Human
acacacucccacccacaccc

SEQ ID NO: 350143 - RNA, 19 nt, Human
acacuguguucagcagggu

SEQ ID NO: 350144 - RNA, 21 nt, Human
acagaaaaggcauccucugua

SEQ ID NO: 350145 - RNA, 22 nt, Human
acagacaggguagagccaggaa

SEQ ID NO: 350146 - RNA, 23 nt, Human
acagagacccccuucuccucaaa

SEQ ID NO: 350147 - RNA, 21 nt, Human
acauucaaauuauuuccaccc

SEQ ID NO: 350148 - RNA, 21 nt, Human
accacuuuuacuacaaacuua

SEQ ID NO: 350149 - RNA, 23 nt, Human
acccccuucuccucaaaaaaaaa

SEQ ID NO: 350150 - RNA, 18 nt, Human
acccugccccccaggcag

SEQ ID NO: 350151 - RNA, 23 nt, Human
accguguccgguauuuccucagc

SEQ ID NO: 350152 - RNA, 22 nt, Human
accuauuugagcuacacuuaca

SEQ ID NO: 350153 - RNA, 19 nt, Human
acuaaacuacagugaucuu

SEQ ID NO: 350154 - RNA, 20 nt, Human
acuucuacaagcauugcacu

SEQ ID NO: 350155 - RNA, 20 nt, Human
agaaaagcagcccuaacaaa

SEQ ID NO: 350156 - RNA, 19 nt, Human
agacacacucccacccaca

SEQ ID NO: 350157 - RNA, 21 nt, Human
agacacacucccacccacacc

SEQ ID NO: 350158 - RNA, 18 nt, Human
agagaauacacccaagau

SEQ ID NO: 350159 - RNA, 22 nt, Human
agaggcuuucugggccagagau

SEQ ID NO: 350160 - RNA, 20 nt, Human
agagggagggagagagaggc

SEQ ID NO: 350161 - RNA, 20 nt, Human
agagggagggagagagaggc

SEQ ID NO: 350162 - RNA, 22 nt, Human
agagggagggagagagaggcuu

SEQ ID NO: 350163 - RNA, 19 nt, Human
agcagaaagaggaaagaac

SEQ ID NO: 350164 - RNA, 25 nt, Human
agccuugucuugagccaucagugug

SEQ ID NO: 350165 - RNA, 18 nt, Human
aggaaaccugagggaccc

SEQ ID NO: 350166 - RNA, 20 nt, Human
aggaaucaagaaucagggua

SEQ ID NO: 350167 - RNA, 26 nt, Human
agggguaggugcacagguccccaagg

SEQ ID NO: 350168 - RNA, 23 nt, Human
aguccaggcuaaccccuguagcc

SEQ ID NO: 350169 - RNA, 23 nt, Human
agugguuggagaggcccuggccu

SEQ ID NO: 350170 - RNA, 23 nt, Human
aguguggcaggggagcacagggg

SEQ ID NO: 350171 - RNA, 19 nt, Human
auaaaaagggaaaaaaucc

SEQ ID NO: 350172 - RNA, 22 nt, Human
aucuagcaaaagccugggcuga

SEQ ID NO: 350173 - RNA, 20 nt, Human
auguauauauguauauauau

SEQ ID NO: 350174 - RNA, 20 nt, Human
caacaugagcgcuuggcuug

SEQ ID NO: 350175 - RNA, 21 nt, Human
caaguaacuacuauaucccac

SEQ ID NO: 350176 - RNA, 23 nt, Human
cacaccccccaaagcagggacug

SEQ ID NO: 350177 - RNA, 23 nt, Human
cacccaagauacuagcaaaccaa

SEQ ID NO: 350178 - RNA, 21 nt, Human
cacccuccaucaaaugugggc

SEQ ID NO: 350179 - RNA, 19 nt, Human
cacucaguaaccuucucaa

SEQ ID NO: 350180 - RNA, 18 nt, Human
cacuguguucagcagggu

SEQ ID NO: 350181 - RNA, 20 nt, Human
cagaagaaaggccuuccucc

SEQ ID NO: 350182 - RNA, 22 nt, Human
cagaaggaaaacugaggcaccu

SEQ ID NO: 350183 - RNA, 22 nt, Human
cagacacacucccacccacacc

SEQ ID NO: 350184 - RNA, 21 nt, Human
cagagcagaaagaggaaagaa

SEQ ID NO: 350185 - RNA, 21 nt, Human
cagcacaccccccaaagcagg

SEQ ID NO: 350186 - RNA, 21 nt, Human
cagcaguggagaggaaauugg

SEQ ID NO: 350187 - RNA, 21 nt, Human
caggagugguccaagguucuc

SEQ ID NO: 350188 - RNA, 21 nt, Human
caguauuauuauccccauuuu

SEQ ID NO: 350189 - RNA, 18 nt, Human
cagugguuggagaggccc

SEQ ID NO: 350190 - RNA, 18 nt, Human
caugguggacauuccuau

SEQ ID NO: 350191 - RNA, 19 nt, Human
cauugcacugccagcugag

SEQ ID NO: 350192 - RNA, 23 nt, Human
cauugcacugccagcugagagca

SEQ ID NO: 350193 - RNA, 23 nt, Human
ccaacuucaagacuucuugauau

SEQ ID NO: 350194 - RNA, 18 nt, Human
ccacacccacagccacac

SEQ ID NO: 350195 - RNA, 19 nt, Human
ccacagccacacauacauu

SEQ ID NO: 350196 - RNA, 20 nt, Human
ccagcugcuugccugggagg

SEQ ID NO: 350197 - RNA, 23 nt, Human
ccauccagccuuauguaggguca

SEQ ID NO: 350198 - RNA, 18 nt, Human
cccaacuaauuccuccuc

SEQ ID NO: 350199 - RNA, 18 nt, Human
cccacacccacagccaca

SEQ ID NO: 350200 - RNA, 26 nt, Human
cccacagccacacauacauuggggcc

SEQ ID NO: 350201 - RNA, 19 nt, Human
cccacccacacccacagcc

SEQ ID NO: 350202 - RNA, 20 nt, Human
cccacccacacccacagcca

SEQ ID NO: 350203 - RNA, 21 nt, Human
cccacccacacccacagccac

SEQ ID NO: 350204 - RNA, 22 nt, Human
cccgagccgggaauuuaaaggc

SEQ ID NO: 350205 - RNA, 19 nt, Human
cccucagccucuccaucuc

SEQ ID NO: 350206 - RNA, 19 nt, Human
cccucagccugaggugcca

SEQ ID NO: 350207 - RNA, 19 nt, Human
cccuggccuuaaccaccag

SEQ ID NO: 350208 - RNA, 18 nt, Human
ccggagcggaguucgggg

SEQ ID NO: 350209 - RNA, 19 nt, Human
ccuaacccugccccccagg

SEQ ID NO: 350210 - RNA, 18 nt, Human
ccucagccugaggugcca

SEQ ID NO: 350211 - RNA, 24 nt, Human
ccugaagauggcagagcagaaaga

SEQ ID NO: 350212 - RNA, 19 nt, Human
ccugcaaaucgugauacug

SEQ ID NO: 350213 - RNA, 24 nt, Human
ccuggccuuaaccaccagcauaac

SEQ ID NO: 350214 - RNA, 19 nt, Human
ccuuccagcacuggggcuc

SEQ ID NO: 350215 - RNA, 23 nt, Human
cgagccgggaauuuaaaggcuag

SEQ ID NO: 350216 - RNA, 23 nt, Human
cgauagcaauaaagugaaaagga

SEQ ID NO: 350217 - RNA, 24 nt, Human
cuaacccugccccccaggcaguug

SEQ ID NO: 350218 - RNA, 21 nt, Human
cuagcucaagccaccuacuuc

SEQ ID NO: 350219 - RNA, 19 nt, Human
cucaaaagacaaggaugcc

SEQ ID NO: 350220 - RNA, 21 nt, Human
cucaaauucuguuuuuguuuu

SEQ ID NO: 350221 - RNA, 20 nt, Human
cucaaggaaagagaguuauc

SEQ ID NO: 350222 - RNA, 18 nt, Human
cucauggaauacucaaaa

SEQ ID NO: 350223 - RNA, 23 nt, Human
cuccuacuucuacaagcauugca

SEQ ID NO: 350224 - RNA, 18 nt, Human
cuccucuccuucagaguu

SEQ ID NO: 350225 - RNA, 22 nt, Human
cugacuccagggaacagggccu

SEQ ID NO: 350226 - RNA, 24 nt, Human
cuucccagugagaacuguuuccuc

SEQ ID NO: 350227 - RNA, 26 nt, Human
cuucugcuuugaugacugagcuacag

SEQ ID NO: 350228 - RNA, 20 nt, Human
cuuggcucucggaugccggg

SEQ ID NO: 350229 - RNA, 22 nt, Human
cuuggguucuugcccuugcuuc

SEQ ID NO: 350230 - RNA, 21 nt, Human
cuuucaauacuuuugaauuuu

SEQ ID NO: 350231 - RNA, 23 nt, Human
gaaaacccuuccccagcagagac

SEQ ID NO: 350232 - RNA, 21 nt, Human
gaaaagaaaacccuuccccag

SEQ ID NO: 350233 - RNA, 19 nt, Human
gaaaagcagcccuaacaaa

SEQ ID NO: 350234 - RNA, 21 nt, Human
gaaauaccagcagacauuucc

SEQ ID NO: 350235 - RNA, 18 nt, Human
gaaggaucccaaaaugcu

SEQ ID NO: 350236 - RNA, 21 nt, Human
gagcagcucauggaauacuca

SEQ ID NO: 350237 - RNA, 18 nt, Human
gagguccccgagccggga

SEQ ID NO: 350238 - RNA, 18 nt, Human
gcaauaagggaaaggagg

SEQ ID NO: 350239 - RNA, 21 nt, Human
gcagagaccacuuuuacuaca

SEQ ID NO: 350240 - RNA, 18 nt, Human
gcagagggagugagggca

SEQ ID NO: 350241 - RNA, 19 nt, Human
gccacacauacauuggggc

SEQ ID NO: 350242 - RNA, 22 nt, Human
gcuacaaccaucuuuuaaccca

SEQ ID NO: 350243 - RNA, 22 nt, Human
gcuaguuauccaccgcuucucc

SEQ ID NO: 350244 - RNA, 24 nt, Human
gcuaguuauccaccgcuucuccaa

SEQ ID NO: 350245 - RNA, 25 nt, Human
ggaaaaaaucccacccaaucacaga

SEQ ID NO: 350246 - RNA, 20 nt, Human
ggaacagggccuccuuucga

SEQ ID NO: 350247 - RNA, 21 nt, Human
ggagagagaggcuuucugggc

SEQ ID NO: 350248 - RNA, 23 nt, Human
ggcugugccucaugagagaggga

SEQ ID NO: 350249 - RNA, 20 nt, Human
gggggcugaggcuccggagc

SEQ ID NO: 350250 - RNA, 22 nt, Human
guauauauguauauauauuuua

SEQ ID NO: 350251 - RNA, 20 nt, Human
gucuugagccaucagugugg

SEQ ID NO: 350252 - RNA, 22 nt, Human
gugaauagcucaaaagacaagg

SEQ ID NO: 350253 - RNA, 23 nt, Human
guuggagaggcccuggccuuaac

SEQ ID NO: 350254 - RNA, 21 nt, Human
uaaaaagggaaaaaaucccac

SEQ ID NO: 350255 - RNA, 22 nt, Human
uaaaggcuagagcuggcaacgg

SEQ ID NO: 350256 - RNA, 19 nt, Human
uaacacagaagaaaggccu

SEQ ID NO: 350257 - RNA, 19 nt, Human
uaacagaaggaaaacugag

SEQ ID NO: 350258 - RNA, 18 nt, Human
uaacauggccaccucgcu

SEQ ID NO: 350259 - RNA, 23 nt, Human
uaaccaccagcauaacauggcca

SEQ ID NO: 350260 - RNA, 22 nt, Human
uaaccccuguagccucuacgca

SEQ ID NO: 350261 - RNA, 24 nt, Human
uaagugacuugcccagggucacac

SEQ ID NO: 350262 - RNA, 20 nt, Human
uacuuucaaaagagaagcag

SEQ ID NO: 350263 - RNA, 19 nt, Human
uagaagcugccuauagauc

SEQ ID NO: 350264 - RNA, 20 nt, Human
uagcauccugguagcauuau

SEQ ID NO: 350265 - RNA, 24 nt, Human
uagcauugccaaacaccgcagcca

SEQ ID NO: 350266 - RNA, 24 nt, Human
uaggaagaagugaaaguuguuuuu

SEQ ID NO: 350267 - RNA, 21 nt, Human
uagggucucaggugcaaaggg

SEQ ID NO: 350268 - RNA, 25 nt, Human
uaugugguggggcuugaaguccuca

SEQ ID NO: 350269 - RNA, 25 nt, Human
ucaaaaaaaaaugagugaaggggca

SEQ ID NO: 350270 - RNA, 21 nt, Human
ucaaaauuccaugagcugcug

SEQ ID NO: 350271 - RNA, 22 nt, Human
ucaagaaucaggguagugaaga

SEQ ID NO: 350272 - RNA, 18 nt, Human
ucagccaaagcuuugcag

SEQ ID NO: 350273 - RNA, 23 nt, Human
ucaggccccuuuuucuaccagcc

SEQ ID NO: 350274 - RNA, 18 nt, Human
ucaguagggucucaggug

SEQ ID NO: 350275 - RNA, 21 nt, Human
ucaguggcacagugguuggag

SEQ ID NO: 350276 - RNA, 21 nt, Human
ucccaacuaauuccuccucuc

SEQ ID NO: 350277 - RNA, 20 nt, Human
ucccacauaaaaagggaaaa

SEQ ID NO: 350278 - RNA, 20 nt, Human
ucccaggucucagccaaaga

SEQ ID NO: 350279 - RNA, 19 nt, Human
ucccucagccucuccaucu

SEQ ID NO: 350280 - RNA, 20 nt, Human
uccuccacucaggccccuuu

SEQ ID NO: 350281 - RNA, 21 nt, Human
ucggggucgccggaggacugc

SEQ ID NO: 350282 - RNA, 24 nt, Human
ucuaagcaauguauauauguauau

SEQ ID NO: 350283 - RNA, 19 nt, Human
ucucagccaaagcuuugca

SEQ ID NO: 350284 - RNA, 27 nt, Human
ugaauacacacaaaggaggcugccugu

SEQ ID NO: 350285 - RNA, 22 nt, Human
ugacccagagagaggggacuga

SEQ ID NO: 350286 - RNA, 24 nt, Human
ugacugagcuacagggacaggagu

SEQ ID NO: 350287 - RNA, 25 nt, Human
ugagagagggagggagagagaggcu

SEQ ID NO: 350288 - RNA, 23 nt, Human
ugagagcacugacucaggcgggg

SEQ ID NO: 350289 - RNA, 20 nt, Human
ugagccaucaguguggcagg

SEQ ID NO: 350290 - RNA, 18 nt, Human
ugagcuacagggacagga

SEQ ID NO: 350291 - RNA, 24 nt, Human
ugagguaggucaguauuauuaucc

SEQ ID NO: 350292 - RNA, 19 nt, Human
ugaggugaauagcucaaaa

SEQ ID NO: 350293 - RNA, 20 nt, Human
ugaggugccauccagccuua

SEQ ID NO: 350294 - RNA, 21 nt, Human
ugaguuuaucauuaauguguc

SEQ ID NO: 350295 - RNA, 22 nt, Human
ugcaaagggauucugcagaggg

SEQ ID NO: 350296 - RNA, 20 nt, Human
ugcagagggagugagggcag

SEQ ID NO: 350297 - RNA, 24 nt, Human
ugcaguucacccugacuccaggga

SEQ ID NO: 350298 - RNA, 22 nt, Human
ugccgggaucacuuuccagggg

SEQ ID NO: 350299 - RNA, 21 nt, Human
ugcucuguggcuggcccacug

SEQ ID NO: 350300 - RNA, 20 nt, Human
uggaauggguuaacaucauc

SEQ ID NO: 350301 - RNA, 18 nt, Human
uggcagagcagaaagagg

SEQ ID NO: 350302 - RNA, 24 nt, Human
uggcuaguuauccaccgcuucucc

SEQ ID NO: 350303 - RNA, 23 nt, Human
ugggaggcaauaagggaaaggag

SEQ ID NO: 350304 - RNA, 24 nt, Human
uggggcccucagccugaggugcca

SEQ ID NO: 350305 - RNA, 25 nt, Human
uggggcucaacaguggacugagugu

SEQ ID NO: 350306 - RNA, 19 nt, Human
ugguggggcuugaaguccu

SEQ ID NO: 350307 - RNA, 20 nt, Human
ugguuggagaggcccuggcc

SEQ ID NO: 350308 - RNA, 18 nt, Human
uguauauauguauauaua

SEQ ID NO: 350309 - RNA, 18 nt, Human
ugucacuugaauugagcu

SEQ ID NO: 350310 - RNA, 21 nt, Human
uguccgguauuuccucagccc

SEQ ID NO: 350311 - RNA, 18 nt, Human
ugucuaggcuuuggaagc

SEQ ID NO: 350312 - RNA, 18 nt, Human
ugucugcccuaggcugua

SEQ ID NO: 350313 - RNA, 21 nt, Human
uguggcuggcccacuggcuca

SEQ ID NO: 350314 - RNA, 19 nt, Human
uguucagcaggguuugugg

SEQ ID NO: 350315 - RNA, 19 nt, Human
uuaaccaccagcauaacau

SEQ ID NO: 350316 - RNA, 23 nt, Human
uucaaauuauuuccacccuccau

SEQ ID NO: 350317 - RNA, 23 nt, Human
uucacuuuuauuaugaacaaaca

SEQ ID NO: 350318 - RNA, 23 nt, Human
uuccucccuuccagcacuggggc

SEQ ID NO: 350319 - RNA, 24 nt, Human
uucucaaauucuguuuuuguuuuu

SEQ ID NO: 350320 - RNA, 19 nt, Human
uugcugaacagacacugug

SEQ ID NO: 350321 - RNA, 23 nt, Human
uuucugggaggguuugccagccu

SEQ ID NO: 350322 - RNA, 20 nt, Human
uuugcaguucacccugacuc

SEQ ID NO: 350323 - RNA, 18 nt, Human
uuuuaaaugcuacaacca

SEQ ID NO: 350324 - RNA, 22 nt, Human
uuuugcucuguggcuggcccac

SEQ ID NO: 350325 - RNA, 23 nt, Human
ccagagaccagauggcucuuuuu

SEQ ID NO: 350326 - RNA, 23 nt, Human
cugccuuccaguaaggaccucua

SEQ ID NO: 350327 - RNA, 19 nt, Human
gcucuuuuuauguguguga

SEQ ID NO: 350328 - RNA, 25 nt, Human
gcugccuuccaguaaggaccucuau

SEQ ID NO: 350329 - RNA, 22 nt, Human
uaacucuagccagagaccagau

SEQ ID NO: 350330 - RNA, 25 nt, Human
uaaugagugcuuuucaucuugauuu

SEQ ID NO: 350331 - RNA, 18 nt, Human
uagauuacauauuauuaa

SEQ ID NO: 350332 - RNA, 21 nt, Human
uaugcaauaacagaauuguua

SEQ ID NO: 350333 - RNA, 19 nt, Human
uuuaauuccuuaaugagug

SEQ ID NO: 350334 - RNA, 22 nt, Human
aaagauauuacaguguuaacag

SEQ ID NO: 350335 - RNA, 22 nt, Human
aacauuuacacauauccauaca

SEQ ID NO: 350336 - RNA, 24 nt, Human
acaaaacgcuacagacaguaacaa

SEQ ID NO: 350337 - RNA, 19 nt, Human
acacuuuuuuaucauaugu

SEQ ID NO: 350338 - RNA, 18 nt, Human
acauauccauacacaaga

SEQ ID NO: 350339 - RNA, 21 nt, Human
acuccacaaaacgcuacagac

SEQ ID NO: 350340 - RNA, 25 nt, Human
agaaauguugggauuugcuuggggu

SEQ ID NO: 350341 - RNA, 20 nt, Human
caacacacugaagagaaaug

SEQ ID NO: 350342 - RNA, 22 nt, Human
cagcucagaggaaaugaagcag

SEQ ID NO: 350343 - RNA, 19 nt, Human
ccacagcauauuccucccc

SEQ ID NO: 350344 - RNA, 22 nt, Human
cccagugaccugguuucaucug

SEQ ID NO: 350345 - RNA, 19 nt, Human
uacuccacaaaacgcuaca

SEQ ID NO: 350346 - RNA, 21 nt, Human
uagauauacuauuaaacacag

SEQ ID NO: 350347 - RNA, 19 nt, Human
uccacaaaacgcuacagac

SEQ ID NO: 350348 - RNA, 21 nt, Human
uccccagugaccugguuucau

SEQ ID NO: 350349 - RNA, 24 nt, Human
uccccagugaccugguuucaucug

SEQ ID NO: 350350 - RNA, 25 nt, Human
uccccagugaccugguuucaucugc

SEQ ID NO: 350351 - RNA, 21 nt, Human
ugcuuggggugggaggaauga

SEQ ID NO: 350352 - RNA, 26 nt, Human
ugcuuuauuuuuuugguccaguacuc

SEQ ID NO: 350353 - RNA, 22 nt, Human
ugggauuugcuuggggugggag

SEQ ID NO: 350354 - RNA, 22 nt, Human
uggggugggaggaaugaaagua

SEQ ID NO: 350355 - RNA, 26 nt, Human
uggggugggaggaaugaaaguagggu

SEQ ID NO: 350356 - RNA, 21 nt, Human
ugguccaguacuccacaaaac

SEQ ID NO: 350357 - RNA, 18 nt, Human
uuaaacacagucauagau

SEQ ID NO: 350358 - RNA, 20 nt, Human
uuccucuuuuuguuuauaug

SEQ ID NO: 350359 - RNA, 24 nt, Human
uugaaagauuuccucuuuuuguuu

SEQ ID NO: 350360 - RNA, 18 nt, Human
uugguccaguacuccaca

SEQ ID NO: 350361 - RNA, 21 nt, Human
aaaaaagcagauggcuccucc

SEQ ID NO: 350362 - RNA, 23 nt, Human
aaaaguucuccaaggccccacuc

SEQ ID NO: 350363 - RNA, 28 nt, Human
aaacagaacccccuuaauucuucgggga

SEQ ID NO: 350364 - RNA, 23 nt, Human
aaagagcagccaaaaaagcagau

SEQ ID NO: 350365 - RNA, 19 nt, Human
aagcagauggcuccuccaa

SEQ ID NO: 350366 - RNA, 18 nt, Human
aagcaggguuggggcgcg

SEQ ID NO: 350367 - RNA, 21 nt, Human
aaggaggaguaaaaacaggaa

SEQ ID NO: 350368 - RNA, 18 nt, Human
acaacuuuacuuucagau

SEQ ID NO: 350369 - RNA, 22 nt, Human
acaauccucuuguaagacagaa

SEQ ID NO: 350370 - RNA, 21 nt, Human
accugaacagguugcugcugc

SEQ ID NO: 350371 - RNA, 22 nt, Human
acuccaaucccccgggaaugga

SEQ ID NO: 350372 - RNA, 21 nt, Human
acucucgcucccuccuggaga

SEQ ID NO: 350373 - RNA, 21 nt, Human
acugcugguggaaaugacauc

SEQ ID NO: 350374 - RNA, 22 nt, Human
agaauuagaaguguuuuaagcu

SEQ ID NO: 350375 - RNA, 23 nt, Human
agaauuagaaguguuuuaagcua

SEQ ID NO: 350376 - RNA, 23 nt, Human
agccaaaaaagcagauggcuccu

SEQ ID NO: 350377 - RNA, 21 nt, Human
agcccggcgcugggcuccugg

SEQ ID NO: 350378 - RNA, 20 nt, Human
agcggcaggcgaccugaaca

SEQ ID NO: 350379 - RNA, 22 nt, Human
aggaaguguuaagaacaggggg

SEQ ID NO: 350380 - RNA, 18 nt, Human
aggccccacucgacccag

SEQ ID NO: 350381 - RNA, 22 nt, Human
agggcuguguuugugguggggg

SEQ ID NO: 350382 - RNA, 20 nt, Human
aggguuggggcgcgcgggag

SEQ ID NO: 350383 - RNA, 19 nt, Human
agguagaggggagcgcugu

SEQ ID NO: 350384 - RNA, 19 nt, Human
aguguuaagaacaggggga

SEQ ID NO: 350385 - RNA, 19 nt, Human
auccagcaaauccuauacc

SEQ ID NO: 350386 - RNA, 22 nt, Human
aucucucuuuauaaguaaacuc

SEQ ID NO: 350387 - RNA, 20 nt, Human
augaagagcaaaaggacaaa

SEQ ID NO: 350388 - RNA, 21 nt, Human
augaagagcaaaaggacaaag

SEQ ID NO: 350389 - RNA, 21 nt, Human
caaagcuuccacagcggcagg

SEQ ID NO: 350390 - RNA, 19 nt, Human
cacuguauguuuccagggc

SEQ ID NO: 350391 - RNA, 24 nt, Human
ccaaaaaagcagauggcuccucca

SEQ ID NO: 350392 - RNA, 22 nt, Human
ccagcuaaaaagagcagccaaa

SEQ ID NO: 350393 - RNA, 25 nt, Human
ccagcuaaaaagagcagccaaaaaa

SEQ ID NO: 350394 - RNA, 22 nt, Human
ccaggaggguggguguggggcg

SEQ ID NO: 350395 - RNA, 21 nt, Human
cccuuugcucucuguugagaa

SEQ ID NO: 350396 - RNA, 21 nt, Human
ccucuuguaagacagaaaagu

SEQ ID NO: 350397 - RNA, 22 nt, Human
cgggacugggcggcugcaggau

SEQ ID NO: 350398 - RNA, 18 nt, Human
cgggagaggggccgggac

SEQ ID NO: 350399 - RNA, 19 nt, Human
cgggagaggggccgggacu

SEQ ID NO: 350400 - RNA, 21 nt, Human
cgggaggggauggcgucggug

SEQ ID NO: 350401 - RNA, 24 nt, Human
cucacuaauacacaaauuacauau

SEQ ID NO: 350402 - RNA, 22 nt, Human
cuccaacgcuacuccaaucccc

SEQ ID NO: 350403 - RNA, 22 nt, Human
cuccugcuacgccagaggcggg

SEQ ID NO: 350404 - RNA, 25 nt, Human
cucugcaaggugcuuuaguacuugg

SEQ ID NO: 350405 - RNA, 21 nt, Human
cugagccuaauaaaaagccag

SEQ ID NO: 350406 - RNA, 23 nt, Human
cuucaccucucacuaauacacaa

SEQ ID NO: 350407 - RNA, 22 nt, Human
cuuggcaugccuugaaaacaga

SEQ ID NO: 350408 - RNA, 23 nt, Human
cuuuacucucgcucccuccugga

SEQ ID NO: 350409 - RNA, 22 nt, Human
gaguaaaaacaggaagagccag

SEQ ID NO: 350410 - RNA, 22 nt, Human
gcccuuuuuuucaauccucccu

SEQ ID NO: 350411 - RNA, 22 nt, Human
gcgggagaggggccgggacugg

SEQ ID NO: 350412 - RNA, 18 nt, Human
gcuggcugggguggccag

SEQ ID NO: 350413 - RNA, 20 nt, Human
gcugggguggccagauuuua

SEQ ID NO: 350414 - RNA, 22 nt, Human
ggagaggggccgggacugggcg

SEQ ID NO: 350415 - RNA, 20 nt, Human
ggagcgcuguccgcccuguc

SEQ ID NO: 350416 - RNA, 22 nt, Human
ggaugagacaguggaagaagga

SEQ ID NO: 350417 - RNA, 24 nt, Human
gggaacugcugguggaaaugacau

SEQ ID NO: 350418 - RNA, 25 nt, Human
gggccgggacugggcggcugcagga

SEQ ID NO: 350419 - RNA, 23 nt, Human
gggcguagcuuuacucucgcucc

SEQ ID NO: 350420 - RNA, 20 nt, Human
gggcuccuggagcuguagcu

SEQ ID NO: 350421 - RNA, 24 nt, Human
gggcuguguuuguggugggggcug

SEQ ID NO: 350422 - RNA, 19 nt, Human
gugcuuuaguacuuggcau

SEQ ID NO: 350423 - RNA, 18 nt, Human
uaaaaagagcagccaaaa

SEQ ID NO: 350424 - RNA, 19 nt, Human
uaaaaagagcagccaaaaa

SEQ ID NO: 350425 - RNA, 22 nt, Human
uaaaaagccagcuaaaaagagc

SEQ ID NO: 350426 - RNA, 23 nt, Human
uaaaaagccagcuaaaaagagca

SEQ ID NO: 350427 - RNA, 18 nt, Human
uaaccacuuguaaaaggu

SEQ ID NO: 350428 - RNA, 18 nt, Human
uaacuacuguaaauucag

SEQ ID NO: 350429 - RNA, 21 nt, Human
uaagggaacugcugguggaaa

SEQ ID NO: 350430 - RNA, 18 nt, Human
uaaguaaacucaaugucu

SEQ ID NO: 350431 - RNA, 21 nt, Human
uaaguaaacucaaugucugaa

SEQ ID NO: 350432 - RNA, 24 nt, Human
uacagagcgcugauugguguguuu

SEQ ID NO: 350433 - RNA, 21 nt, Human
uacuuggcaugccuugaaaac

SEQ ID NO: 350434 - RNA, 20 nt, Human
uagauaacugagauguggca

SEQ ID NO: 350435 - RNA, 21 nt, Human
uauguggaugagacaguggaa

SEQ ID NO: 350436 - RNA, 24 nt, Human
uauucccuuauuuguccccuccca

SEQ ID NO: 350437 - RNA, 19 nt, Human
ucauuaaccuuuuccucca

SEQ ID NO: 350438 - RNA, 18 nt, Human
uccaacgcuacuccaauc

SEQ ID NO: 350439 - RNA, 19 nt, Human
uccaaggccccacucgacc

SEQ ID NO: 350440 - RNA, 20 nt, Human
uccaaggccccacucgaccc

SEQ ID NO: 350441 - RNA, 20 nt, Human
uccaggaaagcugcucgacc

SEQ ID NO: 350442 - RNA, 21 nt, Human
uccauuagaggcuuuuucaaa

SEQ ID NO: 350443 - RNA, 24 nt, Human
ucccauguuccguuuuugcccuau

SEQ ID NO: 350444 - RNA, 25 nt, Human
ucgcucccuccuggagaggaaguga

SEQ ID NO: 350445 - RNA, 21 nt, Human
ucuaugaggaaauaaggauuc

SEQ ID NO: 350446 - RNA, 21 nt, Human
ucuccaaggccccacucgacc

SEQ ID NO: 350447 - RNA, 22 nt, Human
ucuccaaggccccacucgaccc

SEQ ID NO: 350448 - RNA, 20 nt, Human
ugaaaacagaacccccuuaa

SEQ ID NO: 350449 - RNA, 23 nt, Human
ugaaaacagaacccccuuaauuc

SEQ ID NO: 350450 - RNA, 18 nt, Human
ugaaagacuccuggaucu

SEQ ID NO: 350451 - RNA, 24 nt, Human
ugaaagacuccuggaucuuuugcc

SEQ ID NO: 350452 - RNA, 24 nt, Human
ugacuccaacgcuacuccaauccc

SEQ ID NO: 350453 - RNA, 23 nt, Human
ugagaaaacuuggcuuggaucua

SEQ ID NO: 350454 - RNA, 26 nt, Human
ugccuggcccuuugcucucuguuggu

SEQ ID NO: 350455 - RNA, 21 nt, Human
ugccuugaaaacagaaccccc

SEQ ID NO: 350456 - RNA, 22 nt, Human
uggagaggaagugaggaaggaa

SEQ ID NO: 350457 - RNA, 24 nt, Human
uggaugagacaguggaagaaggau

SEQ ID NO: 350458 - RNA, 18 nt, Human
uggcugggguggccagau

SEQ ID NO: 350459 - RNA, 20 nt, Human
uggggcgcgcgggagucaag

SEQ ID NO: 350460 - RNA, 20 nt, Human
ugggggcugaguugcaggga

SEQ ID NO: 350461 - RNA, 20 nt, Human
uggugggggcugaguugcag

SEQ ID NO: 350462 - RNA, 24 nt, Human
uggugggggcugaguugcagggac

SEQ ID NO: 350463 - RNA, 25 nt, Human
uguauacaaaaucucagcuuacaua

SEQ ID NO: 350464 - RNA, 23 nt, Human
ugucugaaaagucacuaauagga

SEQ ID NO: 350465 - RNA, 18 nt, Human
uguuaguaaauccagcaa

SEQ ID NO: 350466 - RNA, 22 nt, Human
uuaaucacagaauuagaagugu

SEQ ID NO: 350467 - RNA, 18 nt, Human
uuuuuuuuuuuuuuuuug

SEQ ID NO: 350468 - RNA, 22 nt, Human
agaggcuggagcaguuggggau

SEQ ID NO: 350469 - RNA, 20 nt, Human
augcucuggccugucucugg

SEQ ID NO: 350470 - RNA, 18 nt, Human
cagcggcagaggcuggag

SEQ ID NO: 350471 - RNA, 21 nt, Human
cagcggcagaggcuggagcag

SEQ ID NO: 350472 - RNA, 19 nt, Human
cuggagcaguuggggaucu

SEQ ID NO: 350473 - RNA, 24 nt, Human
ggacucaaagcauggcagcggcag

SEQ ID NO: 350474 - RNA, 24 nt, Human
ggcuggagcaguuggggaucuuca

SEQ ID NO: 350475 - RNA, 23 nt, Human
ucucugguuccgucucugccucg

SEQ ID NO: 350476 - RNA, 22 nt, Human
ugcucuggccugucucugguuc

SEQ ID NO: 350477 - RNA, 22 nt, Human
uggaggagggggaugcucuggc

SEQ ID NO: 350478 - RNA, 23 nt, Human
uggcagcggcagaggcuggagca

SEQ ID NO: 350479 - RNA, 18 nt, Human
uugaagagagcaaggcug

SEQ ID NO: 350480 - RNA, 27 nt, Human
uuuuuuuuuuuuuuuuuuuuuuugggg

SEQ ID NO: 350481 - RNA, 18 nt, Human
aaaaagacaacacaagaa

SEQ ID NO: 350482 - RNA, 24 nt, Human
aaaaagacaacacaagaaagaaaa

SEQ ID NO: 350483 - RNA, 20 nt, Human
caagaaagaaaagugguuuc

SEQ ID NO: 350484 - RNA, 20 nt, Human
cagggaucaaggaaguugcu

SEQ ID NO: 350485 - RNA, 20 nt, Human
cauaaaaagacaacacaaga

SEQ ID NO: 350486 - RNA, 23 nt, Human
cuggccauagucuguagcccucu

SEQ ID NO: 350487 - RNA, 24 nt, Human
guuuccacauaaaaagacaacaca

SEQ ID NO: 350488 - RNA, 25 nt, Human
uaaaaagacaacacaagaaagaaaa

SEQ ID NO: 350489 - RNA, 22 nt, Human
ucuguagcccucugagccaaac

SEQ ID NO: 350490 - RNA, 28 nt, Human
ugagguuucaacaguugucuagcaguuu

SEQ ID NO: 350491 - RNA, 23 nt, Human
uugucuagcaguuuccacauaaa

SEQ ID NO: 350492 - RNA, 21 nt, Human
aguaaaaagacauaagaaaga

SEQ ID NO: 350493 - RNA, 24 nt, Human
aguaaaaagacauaagaaagagaa

SEQ ID NO: 350494 - RNA, 24 nt, Human
gugaggcugcugcugucgguguuc

SEQ ID NO: 350495 - RNA, 18 nt, Human
uacccugcaguucuguga

SEQ ID NO: 350496 - RNA, 20 nt, Human
uugucuuguaguuuguagua

SEQ ID NO: 350497 - RNA, 19 nt, Human
aaaaaucagaaaaaucuag

SEQ ID NO: 350498 - RNA, 24 nt, Human
aguauucauugcuuuauuuguccu

SEQ ID NO: 350499 - RNA, 19 nt, Human
cauuugaucuauaauuggu

SEQ ID NO: 350500 - RNA, 20 nt, Human
cuuccauccccauccaccuc

SEQ ID NO: 350501 - RNA, 20 nt, Human
cuugccauacaaaguguccc

SEQ ID NO: 350502 - RNA, 18 nt, Human
ucacuacauuuuagggca

SEQ ID NO: 350503 - RNA, 20 nt, Human
ucacuacauuuuagggcauu

SEQ ID NO: 350504 - RNA, 22 nt, Human
ucagaaaaaucuagcaaaaucc

SEQ ID NO: 350505 - RNA, 21 nt, Human
ucaggcagggaggauaggagc

SEQ ID NO: 350506 - RNA, 23 nt, Human
ucuauaauugguagaaccggggc

SEQ ID NO: 350507 - RNA, 19 nt, Human
ugcuuuauuuguccuuuuc

SEQ ID NO: 350508 - RNA, 28 nt, Human
uuaaaaaucagaaaaaucuagcaaaauc

SEQ ID NO: 350509 - RNA, 22 nt, Human
uuauuuguccuuuucacggguc

SEQ ID NO: 350510 - RNA, 23 nt, Human
uuugaucuauaauugguagaaca

SEQ ID NO: 350511 - RNA, 22 nt, Human
uuuuagggcauuugaucuauaa

SEQ ID NO: 350512 - RNA, 19 nt, Human
aagcuuuuuaacaagccgg

SEQ ID NO: 350513 - RNA, 20 nt, Human
aaggguuuuuuuuuuuuucu

SEQ ID NO: 350514 - RNA, 21 nt, Human
aaggguuuuuuuuuuuuucug

SEQ ID NO: 350515 - RNA, 21 nt, Human
aggaguugucaacccugauaa

SEQ ID NO: 350516 - RNA, 26 nt, Human
auacuccagaaagagauauauauggg

SEQ ID NO: 350517 - RNA, 18 nt, Human
auucaaucauaggaguug

SEQ ID NO: 350518 - RNA, 18 nt, Human
caaaauaaagcccccaaa

SEQ ID NO: 350519 - RNA, 19 nt, Human
cacaauguaauaacaaagu

SEQ ID NO: 350520 - RNA, 22 nt, Human
cagaaagagauauauaugggua

SEQ ID NO: 350521 - RNA, 26 nt, Human
cagauacaauauucgguuccuaguuc

SEQ ID NO: 350522 - RNA, 25 nt, Human
cauaaaauacaguuaugccuuuuaa

SEQ ID NO: 350523 - RNA, 22 nt, Human
cauccaaaccacccuugcggua

SEQ ID NO: 350524 - RNA, 21 nt, Human
ccacagggaucucgcauggaa

SEQ ID NO: 350525 - RNA, 18 nt, Human
ccagguuuugcagagcau

SEQ ID NO: 350526 - RNA, 19 nt, Human
cccugauaauaccucucuu

SEQ ID NO: 350527 - RNA, 26 nt, Human
cgcuucggaaagguccuggcaccgga

SEQ ID NO: 350528 - RNA, 24 nt, Human
gacagagccugucacgccggccuc

SEQ ID NO: 350529 - RNA, 19 nt, Human
gcaaacaaugaaaguguag

SEQ ID NO: 350530 - RNA, 22 nt, Human
gcacauaauaaaaguuuauaug

SEQ ID NO: 350531 - RNA, 22 nt, Human
gcagaaaaaugauuccacacua

SEQ ID NO: 350532 - RNA, 24 nt, Human
gccauuucaaauuuuuuuuaaaaa

SEQ ID NO: 350533 - RNA, 19 nt, Human
ggaaaccgggccuggucac

SEQ ID NO: 350534 - RNA, 22 nt, Human
ggagaacuucccuguauggaaa

SEQ ID NO: 350535 - RNA, 25 nt, Human
uaaaaaguaaguugagagguacuaa

SEQ ID NO: 350536 - RNA, 19 nt, Human
uaaacaccugaggacuguu

SEQ ID NO: 350537 - RNA, 18 nt, Human
uaaagaaugaauuuucua

SEQ ID NO: 350538 - RNA, 23 nt, Human
uaaguaagaaucuuaugacaugu

SEQ ID NO: 350539 - RNA, 27 nt, Human
uacaaaacaaaaacgacuaaagggcag

SEQ ID NO: 350540 - RNA, 19 nt, Human
ucacgcgcacgcgagacca

SEQ ID NO: 350541 - RNA, 22 nt, Human
ucagacuucauccaaaccaccc

SEQ ID NO: 350542 - RNA, 21 nt, Human
ucgcauggaaacguuggauuu

SEQ ID NO: 350543 - RNA, 20 nt, Human
ucggaaagguccuggcaccg

SEQ ID NO: 350544 - RNA, 21 nt, Human
ucuagaaguuggcccaaucua

SEQ ID NO: 350545 - RNA, 18 nt, Human
ucuucaguauuacaggau

SEQ ID NO: 350546 - RNA, 22 nt, Human
uggaaacuuguagaauacugca

SEQ ID NO: 350547 - RNA, 18 nt, Human
uggcucagaauuaagcaa

SEQ ID NO: 350548 - RNA, 22 nt, Human
ugggcgacagcugugaccguua

SEQ ID NO: 350549 - RNA, 24 nt, Human
uuaaaugguuuuuaaagaaguaga

SEQ ID NO: 350550 - RNA, 23 nt, Human
uuaagagcacauaauaaaaguuu

SEQ ID NO: 350551 - RNA, 25 nt, Human
uuuaagcuuuuuaacaagccgguaa

SEQ ID NO: 350552 - RNA, 19 nt, Human
uuuguaaacaauauaauaa

SEQ ID NO: 350553 - RNA, 19 nt, Human
uuuugguucucuguaucga

SEQ ID NO: 350554 - RNA, 19 nt, Human
uuuuuuuuuuuuucuguuu

SEQ ID NO: 350555 - RNA, 19 nt, Human
aaaacaaaguugacugaac

SEQ ID NO: 350556 - RNA, 21 nt, Human
aaacaccugaggacuguucaa

SEQ ID NO: 350557 - RNA, 19 nt, Human
aaagaaguagacuggggga

SEQ ID NO: 350558 - RNA, 18 nt, Human
aaagacauaaagaacugc

SEQ ID NO: 350559 - RNA, 24 nt, Human
aaagccccaaacauggcugggcag

SEQ ID NO: 350560 - RNA, 21 nt, Human
aaagguuaaccaaaaucaaag

SEQ ID NO: 350561 - RNA, 21 nt, Human
aacaaaaacugcuaagagaaa

SEQ ID NO: 350562 - RNA, 18 nt, Human
aacaauaagucagaacua

SEQ ID NO: 350563 - RNA, 23 nt, Human
aacagaacaccacagaguaucac

SEQ ID NO: 350564 - RNA, 19 nt, Human
aacauggagaaaccccauc

SEQ ID NO: 350565 - RNA, 20 nt, Human
aacauggagaaaccccaucu

SEQ ID NO: 350566 - RNA, 21 nt, Human
aacauggagaaaccccaucuc

SEQ ID NO: 350567 - RNA, 24 nt, Human
aaguacauuugguuuucuaaaaag

SEQ ID NO: 350568 - RNA, 19 nt, Human
aauaugccaauacuaaccu

SEQ ID NO: 350569 - RNA, 19 nt, Human
aaucccugauauuuucccc

SEQ ID NO: 350570 - RNA, 23 nt, Human
aauugcuugaaccagggaggcga

SEQ ID NO: 350571 - RNA, 23 nt, Human
acaaaacaaaaacugcuaagaga

SEQ ID NO: 350572 - RNA, 19 nt, Human
acaagagugaaacuccauc

SEQ ID NO: 350573 - RNA, 20 nt, Human
acaagagugaaacuccaucu

SEQ ID NO: 350574 - RNA, 21 nt, Human
acaagagugaaacuccaucuc

SEQ ID NO: 350575 - RNA, 24 nt, Human
accugaggucaggaguuugagacc

SEQ ID NO: 350576 - RNA, 24 nt, Human
acuccagccugggcacaagaguga

SEQ ID NO: 350577 - RNA, 21 nt, Human
acugaacuguuacuacaguuc

SEQ ID NO: 350578 - RNA, 23 nt, Human
acuucaugaaagcuuauaagcuu

SEQ ID NO: 350579 - RNA, 22 nt, Human
agaaaauguacauucuugcccc

SEQ ID NO: 350580 - RNA, 23 nt, Human
agaaaauguacauucuugccccu

SEQ ID NO: 350581 - RNA, 20 nt, Human
agaaacuuggcauuaggacg

SEQ ID NO: 350582 - RNA, 18 nt, Human
agaacacuucaugaaagc

SEQ ID NO: 350583 - RNA, 18 nt, Human
agauuguuucauaucccc

SEQ ID NO: 350584 - RNA, 22 nt, Human
agccugggcacaagagugaaac

SEQ ID NO: 350585 - RNA, 24 nt, Human
agcuauugcacuccagccugggca

SEQ ID NO: 350586 - RNA, 20 nt, Human
agcugggcgugguggugcau

SEQ ID NO: 350587 - RNA, 24 nt, Human
aggaaaaaaacaaaguugacugaa

SEQ ID NO: 350588 - RNA, 31 nt, Human
aggaaaaauucucauggauuuaauuauagaa

SEQ ID NO: 350589 - RNA, 20 nt, Human
aggaguuugagaccagccug

SEQ ID NO: 350590 - RNA, 22 nt, Human
aggcaggagaauugcuugaacc

SEQ ID NO: 350591 - RNA, 24 nt, Human
aggcaggagaauugcuugaaccag

SEQ ID NO: 350592 - RNA, 21 nt, Human
aggccgaggugggcggaucac

SEQ ID NO: 350593 - RNA, 20 nt, Human
aggcgagguugcagugagcc

SEQ ID NO: 350594 - RNA, 23 nt, Human
agggaggcgagguugcagugagc

SEQ ID NO: 350595 - RNA, 22 nt, Human
aggugggcggaucaccugaggu

SEQ ID NO: 350596 - RNA, 22 nt, Human
aguauauuuguaaacuguacaa

SEQ ID NO: 350597 - RNA, 22 nt, Human
auagaacaugaacagaacacca

SEQ ID NO: 350598 - RNA, 24 nt, Human
aucgagcuauugcacuccagccug

SEQ ID NO: 350599 - RNA, 18 nt, Human
auugcacuccagccuggg

SEQ ID NO: 350600 - RNA, 20 nt, Human
auugcacuccagccugggca

SEQ ID NO: 350601 - RNA, 23 nt, Human
auugcacuccagccugggcacaa

SEQ ID NO: 350602 - RNA, 18 nt, Human
caaaacaaaaacugcuaa

SEQ ID NO: 350603 - RNA, 19 nt, Human
caaaauuagcugggcgugg

SEQ ID NO: 350604 - RNA, 22 nt, Human
caaagugcccagauuaaauuca

SEQ ID NO: 350605 - RNA, 26 nt, Human
caacauacagagaaauaauaaaagga

SEQ ID NO: 350606 - RNA, 18 nt, Human
caacgaaauucuguccca

SEQ ID NO: 350607 - RNA, 23 nt, Human
caccugaggucaggaguuugaga

SEQ ID NO: 350608 - RNA, 22 nt, Human
cacuccagccugggcacaagag

SEQ ID NO: 350609 - RNA, 22 nt, Human
cacuccagccugggcacaagag

SEQ ID NO: 350610 - RNA, 24 nt, Human
cacuccagccugggcacaagagug

SEQ ID NO: 350611 - RNA, 21 nt, Human
cagcauuuugcaaggccgagg

SEQ ID NO: 350612 - RNA, 24 nt, Human
cagccugaccaacauggagaaacc

SEQ ID NO: 350613 - RNA, 20 nt, Human
caggaaaaaaacaaaguuga

SEQ ID NO: 350614 - RNA, 22 nt, Human
cauaaaugaagcuauucuuuaa

SEQ ID NO: 350615 - RNA, 18 nt, Human
cauggcugggcagguggc

SEQ ID NO: 350616 - RNA, 20 nt, Human
ccacagaguaucacacaaaa

SEQ ID NO: 350617 - RNA, 20 nt, Human
ccagggaggcgagguugcag

SEQ ID NO: 350618 - RNA, 21 nt, Human
ccauccaaacaacccucguag

SEQ ID NO: 350619 - RNA, 25 nt, Human
ccccaacaauaagucagaacuaaua

SEQ ID NO: 350620 - RNA, 21 nt, Human
ccccugaagaguaagcugaga

SEQ ID NO: 350621 - RNA, 24 nt, Human
ccccuguggcagugcaaagugccc

SEQ ID NO: 350622 - RNA, 24 nt, Human
ccugaccaacauggagaaacccca

SEQ ID NO: 350623 - RNA, 22 nt, Human
ccugaggucaggaguuugagac

SEQ ID NO: 350624 - RNA, 24 nt, Human
ccugggcacaagagugaaacucca

SEQ ID NO: 350625 - RNA, 20 nt, Human
ccuguaaucccagcauuuug

SEQ ID NO: 350626 - RNA, 24 nt, Human
cgaggugggcggaucaccugaggu

SEQ ID NO: 350627 - RNA, 26 nt, Human
cgaggugggcggaucaccugagguca

SEQ ID NO: 350628 - RNA, 24 nt, Human
cgagguugcagugagccgagaucg

SEQ ID NO: 350629 - RNA, 24 nt, Human
cggaucaccugaggucaggaguuu

SEQ ID NO: 350630 - RNA, 18 nt, Human
cuaauacuuuuauaacug

SEQ ID NO: 350631 - RNA, 18 nt, Human
cuacaaaacaaaaacugc

SEQ ID NO: 350632 - RNA, 27 nt, Human
cuauauacauaguuccaucgucacccc

SEQ ID NO: 350633 - RNA, 21 nt, Human
cuauugcacuccagccugggc

SEQ ID NO: 350634 - RNA, 24 nt, Human
cucaugccuguaaucccagcauuu

SEQ ID NO: 350635 - RNA, 25 nt, Human
cuccugcauaaaaugacaauucuau

SEQ ID NO: 350636 - RNA, 22 nt, Human
cugacuccauccaaacaacccu

SEQ ID NO: 350637 - RNA, 22 nt, Human
cugggcagguggcucaugccug

SEQ ID NO: 350638 - RNA, 27 nt, Human
cugucuacaaaacaaaaacugcuaaga

SEQ ID NO: 350639 - RNA, 18 nt, Human
cuuugggauuuagcuguu

SEQ ID NO: 350640 - RNA, 19 nt, Human
gaaaagaugauaucuacag

SEQ ID NO: 350641 - RNA, 25 nt, Human
gagaaaagaugauaucuacaggugc

SEQ ID NO: 350642 - RNA, 22 nt, Human
gagaauugcuugaaccagggag

SEQ ID NO: 350643 - RNA, 23 nt, Human
gagaucgagcuauugcacuccag

SEQ ID NO: 350644 - RNA, 24 nt, Human
gaggcgagguugcagugagccgag

SEQ ID NO: 350645 - RNA, 23 nt, Human
gagguugcagugagccgagaucg

SEQ ID NO: 350646 - RNA, 24 nt, Human
gaucaccugaggucaggaguuuga

SEQ ID NO: 350647 - RNA, 22 nt, Human
gcuauugcacuccagccugggc

SEQ ID NO: 350648 - RNA, 21 nt, Human
gcugggcagguggcucaugcc

SEQ ID NO: 350649 - RNA, 23 nt, Human
gcugguuggugacuccaggaaaa

SEQ ID NO: 350650 - RNA, 22 nt, Human
ggaucaccugaggucaggaguu

SEQ ID NO: 350651 - RNA, 22 nt, Human
ggaucaccugaggucaggaguu

SEQ ID NO: 350652 - RNA, 25 nt, Human
ggaucaccugaggucaggaguuuga

SEQ ID NO: 350653 - RNA, 22 nt, Human
ggcagguggcucaugccuguaa

SEQ ID NO: 350654 - RNA, 21 nt, Human
ggcggaucaccugaggucagg

SEQ ID NO: 350655 - RNA, 21 nt, Human
ggcugugucucccaaagcugg

SEQ ID NO: 350656 - RNA, 19 nt, Human
ggucaggaguuugagacca

SEQ ID NO: 350657 - RNA, 23 nt, Human
gguggcucaugccuguaauccca

SEQ ID NO: 350658 - RNA, 24 nt, Human
gguggcucaugccuguaaucccag

SEQ ID NO: 350659 - RNA, 23 nt, Human
gugacuccaggaaaaaaacaaag

SEQ ID NO: 350660 - RNA, 23 nt, Human
guggcucaugccuguaaucccag

SEQ ID NO: 350661 - RNA, 19 nt, Human
guugcagugagccgagauc

SEQ ID NO: 350662 - RNA, 20 nt, Human
uaaaauaaagccccaaacau

SEQ ID NO: 350663 - RNA, 22 nt, Human
uaaaauaaagccccaaacaugg

SEQ ID NO: 350664 - RNA, 20 nt, Human
uaaaauguuaacaguacacc

SEQ ID NO: 350665 - RNA, 19 nt, Human
uaaacaccugaggacuguu

SEQ ID NO: 350666 - RNA, 21 nt, Human
uaaaccuacagguauaaaaca

SEQ ID NO: 350667 - RNA, 19 nt, Human
uaaacuguacaaugaaaau

SEQ ID NO: 350668 - RNA, 18 nt, Human
uaaagccccaaacauggc

SEQ ID NO: 350669 - RNA, 20 nt, Human
uaacuuauaaaauaaagccc

SEQ ID NO: 350670 - RNA, 23 nt, Human
uaacuuauaaaauaaagccccaa

SEQ ID NO: 350671 - RNA, 19 nt, Human
uaagaaaagaaugccuagu

SEQ ID NO: 350672 - RNA, 23 nt, Human
uaaguaagaaucuuaugacaugu

SEQ ID NO: 350673 - RNA, 18 nt, Human
uaaucugacuccauccaa

SEQ ID NO: 350674 - RNA, 24 nt, Human
uacacaaaguaauaacaauaaaca

SEQ ID NO: 350675 - RNA, 21 nt, Human
uagcagaauaaauggcucaga

SEQ ID NO: 350676 - RNA, 19 nt, Human
uauaaauaucuccugcaua

SEQ ID NO: 350677 - RNA, 23 nt, Human
uauagaaguugucaaucccugau

SEQ ID NO: 350678 - RNA, 27 nt, Human
uauauuuguaaacuguaccacccaagg

SEQ ID NO: 350679 - RNA, 20 nt, Human
uauugcacuccagccugggc

SEQ ID NO: 350680 - RNA, 21 nt, Human
uauugcacuccagccugggca

SEQ ID NO: 350681 - RNA, 19 nt, Human
ucaccugaggucaggaguu

SEQ ID NO: 350682 - RNA, 20 nt, Human
ucaugccuguaaucccagca

SEQ ID NO: 350683 - RNA, 25 nt, Human
uccaggaaaaaaacaaaguugacug

SEQ ID NO: 350684 - RNA, 24 nt, Human
ucuucaaaaauuuuggacacaggu

SEQ ID NO: 350685 - RNA, 23 nt, Human
ugaaaacaacgaaauucuguccc

SEQ ID NO: 350686 - RNA, 24 nt, Human
ugaacagaacaccacagaguauca

SEQ ID NO: 350687 - RNA, 19 nt, Human
ugaagaauaaacacauaca

SEQ ID NO: 350688 - RNA, 22 nt, Human
ugacugaacuguuacuacaguu

SEQ ID NO: 350689 - RNA, 24 nt, Human
ugagaccagccugaccaacaugga

SEQ ID NO: 350690 - RNA, 22 nt, Human
ugagccgagaucgagcuauugc

SEQ ID NO: 350691 - RNA, 24 nt, Human
ugaggcaggagaauugcuugaacc

SEQ ID NO: 350692 - RNA, 18 nt, Human
ugaggucaggaguuugag

SEQ ID NO: 350693 - RNA, 18 nt, Human
ugcacuccagccugggca

SEQ ID NO: 350694 - RNA, 18 nt, Human
ugcacuccagccugggca

SEQ ID NO: 350695 - RNA, 18 nt, Human
ugcacuccagccugggca

SEQ ID NO: 350696 - RNA, 24 nt, Human
ugcacuccagccugggcacaagag

SEQ ID NO: 350697 - RNA, 21 nt, Human
uggcagugcaaagugcccaga

SEQ ID NO: 350698 - RNA, 22 nt, Human
uggcucagaacuaagcaaauua

SEQ ID NO: 350699 - RNA, 22 nt, Human
uggcucaugccuguaaucccag

SEQ ID NO: 350700 - RNA, 24 nt, Human
uggcucaugccuguaaucccagca

SEQ ID NO: 350701 - RNA, 19 nt, Human
uggcugggcagguggcuca

SEQ ID NO: 350702 - RNA, 22 nt, Human
uggcugggcagguggcucaugc

SEQ ID NO: 350703 - RNA, 23 nt, Human
uggcugggcagguggcucaugcc

SEQ ID NO: 350704 - RNA, 24 nt, Human
ugggcggaucaccugaggucagga

SEQ ID NO: 350705 - RNA, 22 nt, Human
ugguaagaacacuucaugaaag

SEQ ID NO: 350706 - RNA, 25 nt, Human
uguuuugguucuagauauaaagguu

SEQ ID NO: 350707 - RNA, 20 nt, Human
uuagcugggcgugguggugc

SEQ ID NO: 350708 - RNA, 21 nt, Human
uuagcugggcgugguggugca

SEQ ID NO: 350709 - RNA, 22 nt, Human
uuagcugggcgugguggugcau

SEQ ID NO: 350710 - RNA, 19 nt, Human
uuccccuuugggauuuagc

SEQ ID NO: 350711 - RNA, 20 nt, Human
uuccuguaaucgcugaggca

SEQ ID NO: 350712 - RNA, 18 nt, Human
uugcagugagccgagauc

SEQ ID NO: 350713 - RNA, 19 nt, Human
uugcagugagccgagaucg

SEQ ID NO: 350714 - RNA, 25 nt, Human
uugcagugagccgagaucgagcuau

SEQ ID NO: 350715 - RNA, 18 nt, Human
uugcuugaaccagggagg

SEQ ID NO: 350716 - RNA, 23 nt, Human
uuuguaaacuguacaaugaaaau

SEQ ID NO: 350717 - RNA, 27 nt, Human
uuuuauuggcauuuacaacaaauggcu

SEQ ID NO: 350718 - RNA, 23 nt, Human
uuuugguucuagauauaaagguu

SEQ ID NO: 350719 - RNA, 22 nt, Human
aaacaaccccaaaaucacaggu

SEQ ID NO: 350720 - RNA, 27 nt, Human
aaagcaccuccacuuaucacccaauua

SEQ ID NO: 350721 - RNA, 23 nt, Human
aaagcaccuccacuuaucacccu

SEQ ID NO: 350722 - RNA, 19 nt, Human
aaagcagaaaucuacaacu

SEQ ID NO: 350723 - RNA, 20 nt, Human
aaaguauauauuccugugaa

SEQ ID NO: 350724 - RNA, 24 nt, Human
aaaucacagguuugcaccccuuga

SEQ ID NO: 350725 - RNA, 24 nt, Human
aacaaagcaccuccacuuaucacc

SEQ ID NO: 350726 - RNA, 21 nt, Human
aacagaauccccuugcaauaa

SEQ ID NO: 350727 - RNA, 20 nt, Human
aagcagaaaucuacaacuac

SEQ ID NO: 350728 - RNA, 22 nt, Human
aagugcugcaaacuauugcuuc

SEQ ID NO: 350729 - RNA, 25 nt, Human
aaugacuauuuacauaauaaauagc

SEQ ID NO: 350730 - RNA, 19 nt, Human
acaaaaauagucacauaua

SEQ ID NO: 350731 - RNA, 19 nt, Human
acaaagugcaggaaaaagc

SEQ ID NO: 350732 - RNA, 24 nt, Human
acaaagugcaggaaaaagcagaaa

SEQ ID NO: 350733 - RNA, 24 nt, Human
acgcaaauguaaugacagugaaau

SEQ ID NO: 350734 - RNA, 20 nt, Human
acuccaaagaaaugaaaaca

SEQ ID NO: 350735 - RNA, 21 nt, Human
agacagaacacagucaggauc

SEQ ID NO: 350736 - RNA, 21 nt, Human
agucaguuuggcauugaccuc

SEQ ID NO: 350737 - RNA, 24 nt, Human
aguggauacaauuacuacacuaaa

SEQ ID NO: 350738 - RNA, 18 nt, Human
auaagugauucaaaagua

SEQ ID NO: 350739 - RNA, 22 nt, Human
caaaaagaugaauccacuaaca

SEQ ID NO: 350740 - RNA, 22 nt, Human
caaaaagcuguuaaagugcugc

SEQ ID NO: 350741 - RNA, 20 nt, Human
caaaacaagaucaacaaagc

SEQ ID NO: 350742 - RNA, 18 nt, Human
caacaaagcaccuccacu

SEQ ID NO: 350743 - RNA, 20 nt, Human
caauagccgcaagagauucu

SEQ ID NO: 350744 - RNA, 19 nt, Human
cacauggauuaacaaaaag

SEQ ID NO: 350745 - RNA, 22 nt, Human
cacugaaccggaagauggccuu

SEQ ID NO: 350746 - RNA, 19 nt, Human
cagaaaguaagaaaaguga

SEQ ID NO: 350747 - RNA, 20 nt, Human
cagagucacaguuugcugac

SEQ ID NO: 350748 - RNA, 22 nt, Human
cagcauuacuccaaagaaauga

SEQ ID NO: 350749 - RNA, 26 nt, Human
cagcauuacuccaaagaaaugaaaac

SEQ ID NO: 350750 - RNA, 23 nt, Human
caguaaccuccugucaaggucau

SEQ ID NO: 350751 - RNA, 25 nt, Human
cagugucaaccuugcugagagccga

SEQ ID NO: 350752 - RNA, 20 nt, Human
caucuaaaaaacccuccagg

SEQ ID NO: 350753 - RNA, 22 nt, Human
caucuccccuuuacacagaguc

SEQ ID NO: 350754 - RNA, 25 nt, Human
caugcaaaccacgacuuuguguagc

SEQ ID NO: 350755 - RNA, 19 nt, Human
caugugguugccauacccc

SEQ ID NO: 350756 - RNA, 23 nt, Human
caugugguugccauaccccccag

SEQ ID NO: 350757 - RNA, 21 nt, Human
cauucuuuguccaaucaggag

SEQ ID NO: 350758 - RNA, 23 nt, Human
cauuuaugacuccaaacauuuga

SEQ ID NO: 350759 - RNA, 21 nt, Human
ccacauaguagugcaucuaaa

SEQ ID NO: 350760 - RNA, 23 nt, Human
ccagauacagcagcaugguaaua

SEQ ID NO: 350761 - RNA, 19 nt, Human
cccaauuaccccucccaga

SEQ ID NO: 350762 - RNA, 21 nt, Human
cccaauuaccccucccagaaa

SEQ ID NO: 350763 - RNA, 23 nt, Human
cccacaaauaaucuacuuggucu

SEQ ID NO: 350764 - RNA, 20 nt, Human
ccccaaaaucacagguuugc

SEQ ID NO: 350765 - RNA, 21 nt, Human
cccccagguggcauaccuguu

SEQ ID NO: 350766 - RNA, 19 nt, Human
ccuacagucugacuagcca

SEQ ID NO: 350767 - RNA, 20 nt, Human
ccucaugcaaaccacgacuu

SEQ ID NO: 350768 - RNA, 21 nt, Human
cggaagauggccuucccuuua

SEQ ID NO: 350769 - RNA, 24 nt, Human
cuacaacuacccagucuuguuuuc

SEQ ID NO: 350770 - RNA, 19 nt, Human
cuacucuguuuuuguggaa

SEQ ID NO: 350771 - RNA, 25 nt, Human
cuccaggggcucugacaccaucucu

SEQ ID NO: 350772 - RNA, 24 nt, Human
cuucauauuuauguacauaaugcu

SEQ ID NO: 350773 - RNA, 23 nt, Human
gaaaacauaaaccgaagucagaa

SEQ ID NO: 350774 - RNA, 21 nt, Human
gaacacagucaggaucauuac

SEQ ID NO: 350775 - RNA, 20 nt, Human
gagcagcauuacuccaaaga

SEQ ID NO: 350776 - RNA, 19 nt, Human
gcaaaacaagaucaacaaa

SEQ ID NO: 350777 - RNA, 19 nt, Human
gcagguacuaccagaaaua

SEQ ID NO: 350778 - RNA, 19 nt, Human
gcccaugaacagcugcagc

SEQ ID NO: 350779 - RNA, 25 nt, Human
gccgaagauggcuaaacaaagugca

SEQ ID NO: 350780 - RNA, 18 nt, Human
gcucugacaccaucucug

SEQ ID NO: 350781 - RNA, 24 nt, Human
ggaaaaagcagaaauuuauaaaga

SEQ ID NO: 350782 - RNA, 19 nt, Human
guaaaaucuucuaaacaga

SEQ ID NO: 350783 - RNA, 21 nt, Human
gucaaccuugcugagagccga

SEQ ID NO: 350784 - RNA, 23 nt, Human
gucuuauuuagcaaauuucuuuc

SEQ ID NO: 350785 - RNA, 19 nt, Human
uaaaaagcagaaaucuaca

SEQ ID NO: 350786 - RNA, 18 nt, Human
uaaaauuagcaaauguaa

SEQ ID NO: 350787 - RNA, 22 nt, Human
uaaacaaccccaaaaucacagg

SEQ ID NO: 350788 - RNA, 21 nt, Human
uaaaugguacagaauacauuu

SEQ ID NO: 350789 - RNA, 23 nt, Human
uaacaaaaagaugaauccacuaa

SEQ ID NO: 350790 - RNA, 24 nt, Human
uaaccaaaaagcuguuaaagugcu

SEQ ID NO: 350791 - RNA, 23 nt, Human
uacuuggucuaggggcuggauuu

SEQ ID NO: 350792 - RNA, 23 nt, Human
uagagcagcauuacuccaaagaa

SEQ ID NO: 350793 - RNA, 19 nt, Human
uagagguccuuagccuauu

SEQ ID NO: 350794 - RNA, 21 nt, Human
uagccuauuucucaacagaaa

SEQ ID NO: 350795 - RNA, 22 nt, Human
uauacuauguuccuccaaggaa

SEQ ID NO: 350796 - RNA, 23 nt, Human
ucaauacuauaaaaguuuucuua

SEQ ID NO: 350797 - RNA, 21 nt, Human
ucagcagugucagcugguagu

SEQ ID NO: 350798 - RNA, 23 nt, Human
ucauguuaaacaaccccaaaauc

SEQ ID NO: 350799 - RNA, 24 nt, Human
uccacuaacagauuccauaaaaau

SEQ ID NO: 350800 - RNA, 25 nt, Human
uccacuaacagauuccauaaaaaug

SEQ ID NO: 350801 - RNA, 23 nt, Human
uccacuuaucacccaauuacccc

SEQ ID NO: 350802 - RNA, 19 nt, Human
ucccucuggacauuggcug

SEQ ID NO: 350803 - RNA, 22 nt, Human
ucuagagcagcauuacuccaaa

SEQ ID NO: 350804 - RNA, 23 nt, Human
ucuauacuauguuccuccaagga

SEQ ID NO: 350805 - RNA, 23 nt, Human
ucuggugaagaaguugaagcugu

SEQ ID NO: 350806 - RNA, 19 nt, Human
ugaaaaaguacuauggaca

SEQ ID NO: 350807 - RNA, 20 nt, Human
ugaagaaguugaagcuguca

SEQ ID NO: 350808 - RNA, 19 nt, Human
ugaagcugucagguccugg

SEQ ID NO: 350809 - RNA, 22 nt, Human
ugaagcugucagguccuggugg

SEQ ID NO: 350810 - RNA, 21 nt, Human
ugaccuccuaaaggaguccug

SEQ ID NO: 350811 - RNA, 23 nt, Human
ugacuauuuacauaauaaauagc

SEQ ID NO: 350812 - RNA, 24 nt, Human
ugacugaaaucgucuucaaugcuc

SEQ ID NO: 350813 - RNA, 24 nt, Human
ugagaacaguaaccuccucccugg

SEQ ID NO: 350814 - RNA, 21 nt, Human
ugagaacaguaaccuccuguc

SEQ ID NO: 350815 - RNA, 22 nt, Human
ugagcagugagagaaaccagau

SEQ ID NO: 350816 - RNA, 24 nt, Human
ugcaauaaauacugugcuuagguu

SEQ ID NO: 350817 - RNA, 19 nt, Human
uggauaugaaucgugaacc

SEQ ID NO: 350818 - RNA, 20 nt, Human
uggcgguggagggugagggg

SEQ ID NO: 350819 - RNA, 20 nt, Human
uggcuaaacaaagugcagga

SEQ ID NO: 350820 - RNA, 19 nt, Human
ugggagggccaugugguug

SEQ ID NO: 350821 - RNA, 18 nt, Human
ugggauucuuugccuuuu

SEQ ID NO: 350822 - RNA, 21 nt, Human
ugguuugcuucuguaagaaac

SEQ ID NO: 350823 - RNA, 22 nt, Human
ugguuugggauucuuugccuuu

SEQ ID NO: 350824 - RNA, 21 nt, Human
ugguuuucaggccuggaauga

SEQ ID NO: 350825 - RNA, 25 nt, Human
ugucuuauuuagcaaauuucuuuca

SEQ ID NO: 350826 - RNA, 21 nt, Human
uguguagcugggagggccaug

SEQ ID NO: 350827 - RNA, 20 nt, Human
uuaaacaaccccaaaaucac

SEQ ID NO: 350828 - RNA, 19 nt, Human
uuccaauugcaaagcauaa

SEQ ID NO: 350829 - RNA, 22 nt, Human
uuccucagguugcccaugaaca

SEQ ID NO: 350830 - RNA, 22 nt, Human
uugaaugaaguuugcaccugcu

SEQ ID NO: 350831 - RNA, 23 nt, Human
uuguuugcucaaacgugcaccac

SEQ ID NO: 350832 - RNA, 22 nt, Human
uuuacaaaaauagucacauaua

SEQ ID NO: 350833 - RNA, 20 nt, Human
uuucaugaaaaaguacuaug

SEQ ID NO: 350834 - RNA, 20 nt, Human
uuuugucugguuugggauuc

SEQ ID NO: 350835 - RNA, 22 nt, Human
aggcggcgggaccuggcggcgg

SEQ ID NO: 350836 - RNA, 22 nt, Human
ccgguauuaauagcggggcgag

SEQ ID NO: 350837 - RNA, 18 nt, Human
cggcgggaccuggcggcg

SEQ ID NO: 350838 - RNA, 18 nt, Human
cugcgccccccucccggg

SEQ ID NO: 350839 - RNA, 19 nt, Human
gcggcgcgugcugcgcccc

SEQ ID NO: 350840 - RNA, 19 nt, Human
ggcggcgggaccuggcggc

SEQ ID NO: 350841 - RNA, 18 nt, Human
acacaaacacaucaccau

SEQ ID NO: 350842 - RNA, 23 nt, Human
cccagaguuugggauugauaagc

SEQ ID NO: 350843 - RNA, 19 nt, Human
ccuguugacacaaacacau

SEQ ID NO: 350844 - RNA, 21 nt, Human
ccuugcauaagaaagugcccu

SEQ ID NO: 350845 - RNA, 20 nt, Human
cugaguuccaguuugcugac

SEQ ID NO: 350846 - RNA, 21 nt, Human
uaagaaagugcccuguagaau

SEQ ID NO: 350847 - RNA, 27 nt, Human
ucauccugcuccuuuaaucacuguuua

SEQ ID NO: 350848 - RNA, 20 nt, Human
uggcauagaccuccuguggg

SEQ ID NO: 350849 - RNA, 24 nt, Human
uguuauaggcacugaccuuaagua

SEQ ID NO: 350850 - RNA, 23 nt, Human
uuucuccaguuuacugaguucca

SEQ ID NO: 350851 - RNA, 19 nt, Human
agagggugauuugaggggg

SEQ ID NO: 350852 - RNA, 23 nt, Human
augcuaaaaaaaaagccucgugc

SEQ ID NO: 350853 - RNA, 22 nt, Human
gaacuacaagggaggaaugguu

SEQ ID NO: 350854 - RNA, 21 nt, Human
ggugggcuacgggagagggug

SEQ ID NO: 350855 - RNA, 24 nt, Human
uaaaaaaaaagccucgugccaagc

SEQ ID NO: 350856 - RNA, 27 nt, Human
aaaaaaaaacaucuaugaauaaaaggg

SEQ ID NO: 350857 - RNA, 20 nt, Human
aaaaaucaaaagcaaaagca

SEQ ID NO: 350858 - RNA, 25 nt, Human
aaaacaaaaacaaaaaaccccagag

SEQ ID NO: 350859 - RNA, 22 nt, Human
aaacaaaaaaccccagagccca

SEQ ID NO: 350860 - RNA, 21 nt, Human
aaacaaaaacaaaaaacccca

SEQ ID NO: 350861 - RNA, 23 nt, Human
aaacaaaaacaaaaaaccccaga

SEQ ID NO: 350862 - RNA, 24 nt, Human
aaacaaaaacaaaaaaccccagaa

SEQ ID NO: 350863 - RNA, 23 nt, Human
aaacaaacauaacagacuaaaau

SEQ ID NO: 350864 - RNA, 23 nt, Human
aaacugccaacagcaaaaaacaa

SEQ ID NO: 350865 - RNA, 21 nt, Human
aaauuauucugcuugacauaa

SEQ ID NO: 350866 - RNA, 18 nt, Human
aacaaaaaaccccagagc

SEQ ID NO: 350867 - RNA, 20 nt, Human
aacaaaaaaccccagagccc

SEQ ID NO: 350868 - RNA, 22 nt, Human
aacaaagaaauccauaaaaccc

SEQ ID NO: 350869 - RNA, 20 nt, Human
aacaaagcccagcauccaag

SEQ ID NO: 350870 - RNA, 21 nt, Human
aagaaaacaaagagaccuuuc

SEQ ID NO: 350871 - RNA, 18 nt, Human
aagacuagucugcauacg

SEQ ID NO: 350872 - RNA, 25 nt, Human
aagcauaaaguaaaauaaagggacc

SEQ ID NO: 350873 - RNA, 23 nt, Human
aagcauuugaccuaaauuaaaua

SEQ ID NO: 350874 - RNA, 18 nt, Human
aagcuccaggucccuucu

SEQ ID NO: 350875 - RNA, 20 nt, Human
acaacuuugccacuuuguuc

SEQ ID NO: 350876 - RNA, 29 nt, Human
acagcaaaaaacaaaaacaaaagggaccc

SEQ ID NO: 350877 - RNA, 18 nt, Human
accacaggauaaaauaac

SEQ ID NO: 350878 - RNA, 20 nt, Human
acccauuaucuaacuuuuau

SEQ ID NO: 350879 - RNA, 28 nt, Human
agaauccucucugcuuaugccuccgcuu

SEQ ID NO: 350880 - RNA, 27 nt, Human
agcaaaaaacaaaaacaaaaaacccca

SEQ ID NO: 350881 - RNA, 21 nt, Human
agcaaccucuugucaacguug

SEQ ID NO: 350882 - RNA, 22 nt, Human
agcaaccucuugucaacguuga

SEQ ID NO: 350883 - RNA, 19 nt, Human
agcagaagauggcaaaggg

SEQ ID NO: 350884 - RNA, 23 nt, Human
auaaaaaaaaacaucuaugaaua

SEQ ID NO: 350885 - RNA, 21 nt, Human
auaaucucugauaaaacagag

SEQ ID NO: 350886 - RNA, 25 nt, Human
auaugaagaauagguuuugucagua

SEQ ID NO: 350887 - RNA, 18 nt, Human
auccagagagauaccaua

SEQ ID NO: 350888 - RNA, 19 nt, Human
auuauccauugaaaaaucu

SEQ ID NO: 350889 - RNA, 23 nt, Human
caaaaaacaaaaacaaaaaaccc

SEQ ID NO: 350890 - RNA, 22 nt, Human
caaaaaaccccagagcccaaua

SEQ ID NO: 350891 - RNA, 19 nt, Human
caacagcaaaaaacaaaaa

SEQ ID NO: 350892 - RNA, 20 nt, Human
caacagcaaaaaacaaaaac

SEQ ID NO: 350893 - RNA, 22 nt, Human
caacagcaaaaaacaaaaacaa

SEQ ID NO: 350894 - RNA, 19 nt, Human
caaggacuguacuaaaggu

SEQ ID NO: 350895 - RNA, 18 nt, Human
caccaaguaauuaggaga

SEQ ID NO: 350896 - RNA, 21 nt, Human
caccuuuuuccggaaaagcuc

SEQ ID NO: 350897 - RNA, 22 nt, Human
cacuaguuuguuguaaaauuca

SEQ ID NO: 350898 - RNA, 20 nt, Human
cagcaaaaaacaaaaacaaa

SEQ ID NO: 350899 - RNA, 25 nt, Human
cagcaaaaaacaaaaacaaaaaacc

SEQ ID NO: 350900 - RNA, 22 nt, Human
cagcaaccucuugucaacguug

SEQ ID NO: 350901 - RNA, 24 nt, Human
cagcaaccucuugucaacguugau

SEQ ID NO: 350902 - RNA, 21 nt, Human
cagcagaaaguggaacaacua

SEQ ID NO: 350903 - RNA, 20 nt, Human
cauaaaaguucacaaagcug

SEQ ID NO: 350904 - RNA, 20 nt, Human
cauaaauccaaggguucuuu

SEQ ID NO: 350905 - RNA, 19 nt, Human
caucaaccugaaaauaauu

SEQ ID NO: 350906 - RNA, 21 nt, Human
cccuauagucuagguagccau

SEQ ID NO: 350907 - RNA, 22 nt, Human
cuaaaauacuuucaaaauuaaa

SEQ ID NO: 350908 - RNA, 20 nt, Human
cuauauauauauuugcccaa

SEQ ID NO: 350909 - RNA, 22 nt, Human
cugccaacagcaaaaaacaaaa

SEQ ID NO: 350910 - RNA, 24 nt, Human
cugccaacagcaaaaaacaaaaac

SEQ ID NO: 350911 - RNA, 20 nt, Human
cuugcugaaacagaauacuu

SEQ ID NO: 350912 - RNA, 18 nt, Human
gauaagaaaacaaagaga

SEQ ID NO: 350913 - RNA, 18 nt, Human
gaugucaucaaccugaaa

SEQ ID NO: 350914 - RNA, 21 nt, Human
gcaaaaaacaaaaacaaaaaa

SEQ ID NO: 350915 - RNA, 23 nt, Human
gguagaaaaugaucuagguuuga

SEQ ID NO: 350916 - RNA, 24 nt, Human
gguuucuccucagcagugucagcu

SEQ ID NO: 350917 - RNA, 19 nt, Human
guucagcuuuuuuuuuuuu

SEQ ID NO: 350918 - RNA, 23 nt, Human
uaaaaacagcaaccucuugucaa

SEQ ID NO: 350919 - RNA, 20 nt, Human
uaaaaaucaaaagcaaaagc

SEQ ID NO: 350920 - RNA, 21 nt, Human
uaaaauagagcagcauaggca

SEQ ID NO: 350921 - RNA, 21 nt, Human
uaaacaaguuuuagacauauu

SEQ ID NO: 350922 - RNA, 21 nt, Human
uaaacaauugaucacaaagau

SEQ ID NO: 350923 - RNA, 19 nt, Human
uaaacugccaacagcaaaa

SEQ ID NO: 350924 - RNA, 24 nt, Human
uaagaaaacaaagagaccuuucca

SEQ ID NO: 350925 - RNA, 19 nt, Human
uacaauaucccuagaagag

SEQ ID NO: 350926 - RNA, 19 nt, Human
uacuauuauuaucaaaccu

SEQ ID NO: 350927 - RNA, 21 nt, Human
uagaaaauggaaguaacugaa

SEQ ID NO: 350928 - RNA, 20 nt, Human
uagaagagauucuuugcucc

SEQ ID NO: 350929 - RNA, 19 nt, Human
uagcaauucccugcaugca

SEQ ID NO: 350930 - RNA, 18 nt, Human
uagguaauugcacaacuu

SEQ ID NO: 350931 - RNA, 19 nt, Human
uagugcagcaggaauuaaa

SEQ ID NO: 350932 - RNA, 18 nt, Human
uaguuuguuguaaaauuc

SEQ ID NO: 350933 - RNA, 21 nt, Human
uauuaucaaaccugaaaguug

SEQ ID NO: 350934 - RNA, 23 nt, Human
uauugaggcaaccauaguuggua

SEQ ID NO: 350935 - RNA, 18 nt, Human
ucaguaggcaguauccag

SEQ ID NO: 350936 - RNA, 22 nt, Human
uccaaggguucuugaaaaaaaa

SEQ ID NO: 350937 - RNA, 23 nt, Human
uccagagagauaccauaugauac

SEQ ID NO: 350938 - RNA, 19 nt, Human
ucuaaagcaauacuuuaga

SEQ ID NO: 350939 - RNA, 19 nt, Human
ucucucuggcaaaacaccu

SEQ ID NO: 350940 - RNA, 24 nt, Human
ucuggcagcuguucagcuuuuuuu

SEQ ID NO: 350941 - RNA, 26 nt, Human
ugaaacagaauacuuugcauaaaaau

SEQ ID NO: 350942 - RNA, 22 nt, Human
ugaaaugcaauaaaaaaugaaa

SEQ ID NO: 350943 - RNA, 25 nt, Human
ugaauccuugacagguaucucaucc

SEQ ID NO: 350944 - RNA, 19 nt, Human
ugacguagcucaccauucu

SEQ ID NO: 350945 - RNA, 18 nt, Human
ugagaauaagaguuuggu

SEQ ID NO: 350946 - RNA, 20 nt, Human
ugcacacauaaaaguucaca

SEQ ID NO: 350947 - RNA, 21 nt, Human
ugccaacagcaaaaaacaaaa

SEQ ID NO: 350948 - RNA, 24 nt, Human
ugccaacagcaaaaaacaaaaaca

SEQ ID NO: 350949 - RNA, 21 nt, Human
uggaacaacuauucuaaagca

SEQ ID NO: 350950 - RNA, 24 nt, Human
uggcaaagcaauacugcagcagaa

SEQ ID NO: 350951 - RNA, 20 nt, Human
uggcuaaaaagaacaaaguc

SEQ ID NO: 350952 - RNA, 18 nt, Human
ugguaauaaaaacagcaa

SEQ ID NO: 350953 - RNA, 24 nt, Human
ugguagaaaaugaucuagguuuga

SEQ ID NO: 350954 - RNA, 24 nt, Human
uguaaaaauauggcagauauggaa

SEQ ID NO: 350955 - RNA, 21 nt, Human
uguacaaaaugcugacaaaua

SEQ ID NO: 350956 - RNA, 22 nt, Human
uguauacaaaugucagaucaag

SEQ ID NO: 350957 - RNA, 25 nt, Human
ugugcaaaaaacaaaaauuuauauc

SEQ ID NO: 350958 - RNA, 18 nt, Human
uguuuaaugaaugauaca

SEQ ID NO: 350959 - RNA, 21 nt, Human
uuaaaacagucaguuuggcau

SEQ ID NO: 350960 - RNA, 21 nt, Human
uuagauagucacagcaccuuu

SEQ ID NO: 350961 - RNA, 21 nt, Human
uucacuuugcacaacuauccc

SEQ ID NO: 350962 - RNA, 24 nt, Human
uucccaguaagccacucuacuaug

SEQ ID NO: 350963 - RNA, 19 nt, Human
uucuuucuuucucugugga

SEQ ID NO: 350964 - RNA, 23 nt, Human
uugacauagacuaucagcuuugc

SEQ ID NO: 350965 - RNA, 21 nt, Human
uugagcaaaaauuuuaucucu

SEQ ID NO: 350966 - RNA, 21 nt, Human
uugcagugacagagaggucac

SEQ ID NO: 350967 - RNA, 22 nt, Human
uuggggaccauggaaaugcacu

SEQ ID NO: 350968 - RNA, 23 nt, Human
uuucuugcuccauaaucucugau

SEQ ID NO: 350969 - RNA, 20 nt, Human
uuucuuucuuucucugugga

SEQ ID NO: 350970 - RNA, 24 nt, Human
uuuuucuuucuuucucuguggaua

SEQ ID NO: 350971 - RNA, 18 nt, Human
uuuuuuuuuuuuuuuuug

SEQ ID NO: 350972 - RNA, 18 nt, Human
aaacaggaaggggaggag

SEQ ID NO: 350973 - RNA, 27 nt, Human
aaacaggaaggggaggagaggggaccc

SEQ ID NO: 350974 - RNA, 18 nt, Human
aaagacaacucuggccca

SEQ ID NO: 350975 - RNA, 21 nt, Human
aacaagaagaaaaagaagagg

SEQ ID NO: 350976 - RNA, 19 nt, Human
aagaaaaagaagaggcacu

SEQ ID NO: 350977 - RNA, 21 nt, Human
aagaaaaagaagaggcacuua

SEQ ID NO: 350978 - RNA, 18 nt, Human
aagaagaaaaagaagagg

SEQ ID NO: 350979 - RNA, 19 nt, Human
aagacaucuuugucugggc

SEQ ID NO: 350980 - RNA, 21 nt, Human
aagcagacacacagccacagg

SEQ ID NO: 350981 - RNA, 23 nt, Human
aagcagacacacagccacaggua

SEQ ID NO: 350982 - RNA, 21 nt, Human
aagcagcaggauccaguggcc

SEQ ID NO: 350983 - RNA, 23 nt, Human
acacacacacacguguucacaca

SEQ ID NO: 350984 - RNA, 23 nt, Human
acacacacacagcuauacacaca

SEQ ID NO: 350985 - RNA, 22 nt, Human
acacacacacauacagucacgc

SEQ ID NO: 350986 - RNA, 19 nt, Human
acacagccacagguacacc

SEQ ID NO: 350987 - RNA, 22 nt, Human
acaggaaguuggaagguugagc

SEQ ID NO: 350988 - RNA, 22 nt, Human
acccagccugucucacuccccc

SEQ ID NO: 350989 - RNA, 23 nt, Human
acgggggagcucuggggacuaug

SEQ ID NO: 350990 - RNA, 23 nt, Human
acucuggugauggggggcaacug

SEQ ID NO: 350991 - RNA, 24 nt, Human
agaagaaaaagaagaggcacuuag

SEQ ID NO: 350992 - RNA, 19 nt, Human
agaaucuucuuacugagca

SEQ ID NO: 350993 - RNA, 24 nt, Human
agagauucgaauguucugaccucc

SEQ ID NO: 350994 - RNA, 18 nt, Human
agagggcuguucaggcag

SEQ ID NO: 350995 - RNA, 20 nt, Human
agcacagguccacucuccca

SEQ ID NO: 350996 - RNA, 18 nt, Human
agcauggagccccugagc

SEQ ID NO: 350997 - RNA, 19 nt, Human
aggaagagauggaaggagg

SEQ ID NO: 350998 - RNA, 19 nt, Human
aggaagagguuucaggagu

SEQ ID NO: 350999 - RNA, 20 nt, Human
aggagacauaggcaggaggc

SEQ ID NO: 351000 - RNA, 21 nt, Human
aggcaccacgggggagcucug

SEQ ID NO: 351001 - RNA, 23 nt, Human
aggcagaggggcaaugugccagg

SEQ ID NO: 351002 - RNA, 22 nt, Human
aggcagggagaggccggacccg

SEQ ID NO: 351003 - RNA, 22 nt, Human
aggggcugugccagcccagggc

SEQ ID NO: 351004 - RNA, 22 nt, Human
aggugucugcacucccugaggu

SEQ ID NO: 351005 - RNA, 23 nt, Human
aguugggccuucccugcugcacg

SEQ ID NO: 351006 - RNA, 21 nt, Human
augcaggcuccaguacacagu

SEQ ID NO: 351007 - RNA, 18 nt, Human
caagugaauaaauccagc

SEQ ID NO: 351008 - RNA, 22 nt, Human
cacacagugguucacacacaca

SEQ ID NO: 351009 - RNA, 27 nt, Human
cacacauacagucacgcacuugaacac

SEQ ID NO: 351010 - RNA, 22 nt, Human
cacacauauauacacauauaua

SEQ ID NO: 351011 - RNA, 22 nt, Human
cacagcacagguccacucuccc

SEQ ID NO: 351012 - RNA, 22 nt, Human
cacagcuauacacacaggccua

SEQ ID NO: 351013 - RNA, 23 nt, Human
cacaggccuauaaaagcauacaa

SEQ ID NO: 351014 - RNA, 26 nt, Human
cacaguccgaggagaauauccaauca

SEQ ID NO: 351015 - RNA, 21 nt, Human
caccagccguacuccauggac

SEQ ID NO: 351016 - RNA, 18 nt, Human
cacuuaggccaacagaau

SEQ ID NO: 351017 - RNA, 21 nt, Human
cacuuuggggagagagguggg

SEQ ID NO: 351018 - RNA, 21 nt, Human
cagaacagcgaugcagcagaa

SEQ ID NO: 351019 - RNA, 19 nt, Human
cagaagggugguggguggc

SEQ ID NO: 351020 - RNA, 24 nt, Human
cagaggccuggcccugccaugccc

SEQ ID NO: 351021 - RNA, 23 nt, Human
cagccguacuccauggaccuuga

SEQ ID NO: 351022 - RNA, 18 nt, Human
caggagggcaaggcagag

SEQ ID NO: 351023 - RNA, 19 nt, Human
caggagucaccaucccagc

SEQ ID NO: 351024 - RNA, 24 nt, Human
cagucccagauucaaagcccuccu

SEQ ID NO: 351025 - RNA, 25 nt, Human
ccacacacucacagcacagguccac

SEQ ID NO: 351026 - RNA, 19 nt, Human
ccacagguacacacacaag

SEQ ID NO: 351027 - RNA, 23 nt, Human
ccacaugcguucacacgcaucca

SEQ ID NO: 351028 - RNA, 20 nt, Human
ccagaggaggucagagcaac

SEQ ID NO: 351029 - RNA, 18 nt, Human
ccagcagaggccuggccc

SEQ ID NO: 351030 - RNA, 18 nt, Human
cccccaggccaaaaggag

SEQ ID NO: 351031 - RNA, 18 nt, Human
cccuaggagccagccagg

SEQ ID NO: 351032 - RNA, 20 nt, Human
cccugccaugcccagaacag

SEQ ID NO: 351033 - RNA, 24 nt, Human
ccuaggaagagguuucaggaguca

SEQ ID NO: 351034 - RNA, 23 nt, Human
ccuauaaaagcauacaagcagac

SEQ ID NO: 351035 - RNA, 21 nt, Human
ccucagacccagcauggagcc

SEQ ID NO: 351036 - RNA, 26 nt, Human
ccuccugagccagcagaggccuggcc

SEQ ID NO: 351037 - RNA, 18 nt, Human
ccuggacguggccuagga

SEQ ID NO: 351038 - RNA, 21 nt, Human
ccuggagcccugguggugcuc

SEQ ID NO: 351039 - RNA, 22 nt, Human
ccuggcccugccaugcccagaa

SEQ ID NO: 351040 - RNA, 20 nt, Human
ccuucugcucuuccccuagg

SEQ ID NO: 351041 - RNA, 18 nt, Human
cgagaaacaggaagggga

SEQ ID NO: 351042 - RNA, 18 nt, Human
cgagaaacaggaagggga

SEQ ID NO: 351043 - RNA, 19 nt, Human
cgcaggcgcucgggccugg

SEQ ID NO: 351044 - RNA, 21 nt, Human
cuccaggggcugugccagccc

SEQ ID NO: 351045 - RNA, 19 nt, Human
cugaggcuccaggggcugu

SEQ ID NO: 351046 - RNA, 21 nt, Human
cuggagcccugguggugcuca

SEQ ID NO: 351047 - RNA, 21 nt, Human
cuggggacuaugccgagacuc

SEQ ID NO: 351048 - RNA, 19 nt, Human
cugggugucagccccagug

SEQ ID NO: 351049 - RNA, 23 nt, Human
gaaacaggaaggggaggagaggg

SEQ ID NO: 351050 - RNA, 21 nt, Human
gaagguuuugcugcuuccuga

SEQ ID NO: 351051 - RNA, 19 nt, Human
gaccucccccaggccaaaa

SEQ ID NO: 351052 - RNA, 19 nt, Human
gacggggcguggggagaug

SEQ ID NO: 351053 - RNA, 24 nt, Human
gacggggcguggggagaugagaag

SEQ ID NO: 351054 - RNA, 21 nt, Human
gagacugcccccauuagacga

SEQ ID NO: 351055 - RNA, 22 nt, Human
gagaggggagugagagagaggg

SEQ ID NO: 351056 - RNA, 21 nt, Human
gagccccugagcgcaauuccc

SEQ ID NO: 351057 - RNA, 23 nt, Human
gaggagaggggagugagagagag

SEQ ID NO: 351058 - RNA, 22 nt, Human
gaggccuggcccugccaugccc

SEQ ID NO: 351059 - RNA, 19 nt, Human
gaggcuccuggagcccugg

SEQ ID NO: 351060 - RNA, 27 nt, Human
gaugugcacacacacacacguguucac

SEQ ID NO: 351061 - RNA, 18 nt, Human
gcaccccagagucaaagg

SEQ ID NO: 351062 - RNA, 25 nt, Human
gcaggggaggggccacaggcaggga

SEQ ID NO: 351063 - RNA, 23 nt, Human
gcccagaacagcgaugcagcagg

SEQ ID NO: 351064 - RNA, 19 nt, Human
gccugaaccaguugggccu

SEQ ID NO: 351065 - RNA, 21 nt, Human
gcucacggaggagugaggcag

SEQ ID NO: 351066 - RNA, 26 nt, Human
gcucagagaccagaaggguggugggu

SEQ ID NO: 351067 - RNA, 19 nt, Human
gcuggcagugcccuggggu

SEQ ID NO: 351068 - RNA, 18 nt, Human
gcuggccuggugggugaa

SEQ ID NO: 351069 - RNA, 21 nt, Human
ggaaggggaggagaggggagu

SEQ ID NO: 351070 - RNA, 18 nt, Human
ggaagguugagccugaac

SEQ ID NO: 351071 - RNA, 24 nt, Human
ggcacacauauauacacauauaua

SEQ ID NO: 351072 - RNA, 22 nt, Human
ggcacgggaacacucccaggga

SEQ ID NO: 351073 - RNA, 18 nt, Human
ggcauccuuccuucugcu

SEQ ID NO: 351074 - RNA, 21 nt, Human
ggccacaggcagggagaggcc

SEQ ID NO: 351075 - RNA, 18 nt, Human
ggccuggcgugggaccug

SEQ ID NO: 351076 - RNA, 19 nt, Human
ggccuggugggugaagcug

SEQ ID NO: 351077 - RNA, 18 nt, Human
ggcgacagggcccagagg

SEQ ID NO: 351078 - RNA, 22 nt, Human
ggcguggggagaugagaaggga

SEQ ID NO: 351079 - RNA, 24 nt, Human
ggcugugccagcccagggcccagg

SEQ ID NO: 351080 - RNA, 21 nt, Human
gggcagagauucgaauguucu

SEQ ID NO: 351081 - RNA, 21 nt, Human
ggggaggggccacaggcaggg

SEQ ID NO: 351082 - RNA, 19 nt, Human
gggugaagcugcaccccag

SEQ ID NO: 351083 - RNA, 23 nt, Human
gggugguggguggccuggggagc

SEQ ID NO: 351084 - RNA, 19 nt, Human
gguggguggccuggggagc

SEQ ID NO: 351085 - RNA, 19 nt, Human
gucagccccaguguggcca

SEQ ID NO: 351086 - RNA, 21 nt, Human
guccagggcacacauauauac

SEQ ID NO: 351087 - RNA, 19 nt, Human
gucucucaccccuccuccu

SEQ ID NO: 351088 - RNA, 23 nt, Human
gugggcuggcagugcccuggggu

SEQ ID NO: 351089 - RNA, 19 nt, Human
gugggugaagcugcacccc

SEQ ID NO: 351090 - RNA, 20 nt, Human
gugguggguggccuggggag

SEQ ID NO: 351091 - RNA, 19 nt, Human
guucacacgcauccacaca

SEQ ID NO: 351092 - RNA, 20 nt, Human
uaaaucuuggaggcaggggc

SEQ ID NO: 351093 - RNA, 23 nt, Human
uacacagugguucacacaguggu

SEQ ID NO: 351094 - RNA, 21 nt, Human
uaccacaugcguucacacgca

SEQ ID NO: 351095 - RNA, 19 nt, Human
uacccagacacgugcauaa

SEQ ID NO: 351096 - RNA, 23 nt, Human
uaggcaggaggcagggagcaggg

SEQ ID NO: 351097 - RNA, 19 nt, Human
uaggccaacagaaugcccu

SEQ ID NO: 351098 - RNA, 24 nt, Human
uauaaaagcauacaagcagacaca

SEQ ID NO: 351099 - RNA, 20 nt, Human
uaugacacaccagccguacu

SEQ ID NO: 351100 - RNA, 23 nt, Human
ucaaagcccuccucccucacucu

SEQ ID NO: 351101 - RNA, 22 nt, Human
ucacacacacacauacagucaa

SEQ ID NO: 351102 - RNA, 19 nt, Human
ucagccccaguguggccaa

SEQ ID NO: 351103 - RNA, 22 nt, Human
ucaggccaugugcagcgaucca

SEQ ID NO: 351104 - RNA, 18 nt, Human
ucagggagccaggcacag

SEQ ID NO: 351105 - RNA, 19 nt, Human
ucccagauucaaagcccuc

SEQ ID NO: 351106 - RNA, 20 nt, Human
ucccccgugcuuccuagaaa

SEQ ID NO: 351107 - RNA, 19 nt, Human
ucccugacucccgcucagg

SEQ ID NO: 351108 - RNA, 23 nt, Human
uccuggagcccugguggugcuca

SEQ ID NO: 351109 - RNA, 21 nt, Human
ucugaccucccccaggccaaa

SEQ ID NO: 351110 - RNA, 22 nt, Human
ucuuaggaucacuuuggggaga

SEQ ID NO: 351111 - RNA, 25 nt, Human
ugaacacacacacagcuauacacac

SEQ ID NO: 351112 - RNA, 22 nt, Human
ugaaggaagagauggaaggagu

SEQ ID NO: 351113 - RNA, 25 nt, Human
ugaguacacaccuuaccacaugcgg

SEQ ID NO: 351114 - RNA, 21 nt, Human
ugcagugcgcagccccggggu

SEQ ID NO: 351115 - RNA, 19 nt, Human
ugccaggaaggggagacug

SEQ ID NO: 351116 - RNA, 23 nt, Human
ugccaggaaggggagacugcccc

SEQ ID NO: 351117 - RNA, 18 nt, Human
ugcuggccuggcguggga

SEQ ID NO: 351118 - RNA, 21 nt, Human
uggaaggaguggaggccuccu

SEQ ID NO: 351119 - RNA, 22 nt, Human
uggaagguugagccugaaccag

SEQ ID NO: 351120 - RNA, 23 nt, Human
uggacaauaaagacaacucuggc

SEQ ID NO: 351121 - RNA, 18 nt, Human
ugggaagcaggugagaga

SEQ ID NO: 351122 - RNA, 20 nt, Human
ugggcuggggcugagggggg

SEQ ID NO: 351123 - RNA, 20 nt, Human
ugggcuggggcugagggggg

SEQ ID NO: 351124 - RNA, 22 nt, Human
uggggcugaggggggucugagc

SEQ ID NO: 351125 - RNA, 23 nt, Human
ugggguuaggugucugcacuccc

SEQ ID NO: 351126 - RNA, 25 nt, Human
ugucugggcuggggcugaggggggu

SEQ ID NO: 351127 - RNA, 23 nt, Human
ugugcacacacacacacguguuc

SEQ ID NO: 351128 - RNA, 18 nt, Human
uguggccaaauccugucc

SEQ ID NO: 351129 - RNA, 20 nt, Human
uguggccaaauccugucccc

SEQ ID NO: 351130 - RNA, 24 nt, Human
uucacacacucaagcacacauaca

SEQ ID NO: 351131 - RNA, 22 nt, Human
uucccauggucugggaacgcag

SEQ ID NO: 351132 - RNA, 19 nt, Human
uuggaagguugagccugaa

SEQ ID NO: 351133 - RNA, 24 nt, Human
aaaaagugaauuuggcaugaaguc

SEQ ID NO: 351134 - RNA, 19 nt, Human
aacaacagcacuucuccag

SEQ ID NO: 351135 - RNA, 22 nt, Human
cagaagauccacacucuuuuca

SEQ ID NO: 351136 - RNA, 22 nt, Human
cuggcuuaggcuuucaacauuu

SEQ ID NO: 351137 - RNA, 24 nt, Human
gaacaacagcacuucuccagaaga

SEQ ID NO: 351138 - RNA, 20 nt, Human
ggcuuaggcuuucaacauuu

SEQ ID NO: 351139 - RNA, 18 nt, Human
ucgguuguaaagaacuga

SEQ ID NO: 351140 - RNA, 21 nt, Human
ucgguuguaaagaacugauua

SEQ ID NO: 351141 - RNA, 18 nt, Human
ucuccagaagauccacac

SEQ ID NO: 351142 - RNA, 22 nt, Human
ugaaaagaggugguaaguggua

SEQ ID NO: 351143 - RNA, 20 nt, Human
aacugacaauuaaaugacau

SEQ ID NO: 351144 - RNA, 21 nt, Human
aagugaugcuuucugcuucug

SEQ ID NO: 351145 - RNA, 19 nt, Human
augugagugugugugugug

SEQ ID NO: 351146 - RNA, 18 nt, Human
caaaggcugacccagugc

SEQ ID NO: 351147 - RNA, 19 nt, Human
cacgugaagcccaugugga

SEQ ID NO: 351148 - RNA, 20 nt, Human
cagugcaagggacuagauua

SEQ ID NO: 351149 - RNA, 21 nt, Human
ccaaaccacgugaagcccaug

SEQ ID NO: 351150 - RNA, 19 nt, Human
cccggcagccucucuucug

SEQ ID NO: 351151 - RNA, 23 nt, Human
ccggcagccucucuucuguuucu

SEQ ID NO: 351152 - RNA, 23 nt, Human
cgcggccggacugcaaaggcgcc

SEQ ID NO: 351153 - RNA, 19 nt, Human
cggacugcaaaggcgccga

SEQ ID NO: 351154 - RNA, 21 nt, Human
cggcggcgagggaggcagcgg

SEQ ID NO: 351155 - RNA, 18 nt, Human
cuggucccggcagccucu

SEQ ID NO: 351156 - RNA, 21 nt, Human
cuuuuugcugcuuagcuuaac

SEQ ID NO: 351157 - RNA, 22 nt, Human
gacccagugcaagggacuagau

SEQ ID NO: 351158 - RNA, 22 nt, Human
gcaaguccuccucagccugaag

SEQ ID NO: 351159 - RNA, 20 nt, Human
gcagccucucuucuguuucu

SEQ ID NO: 351160 - RNA, 21 nt, Human
gcagcggcggcggcgagggag

SEQ ID NO: 351161 - RNA, 20 nt, Human
gccggacugcaaaggcgccg

SEQ ID NO: 351162 - RNA, 20 nt, Human
gccugaagaaaccugauugu

SEQ ID NO: 351163 - RNA, 22 nt, Human
gcggccggacugcaaaggcgcc

SEQ ID NO: 351164 - RNA, 19 nt, Human
ggucagcuggcagcggcgg

SEQ ID NO: 351165 - RNA, 21 nt, Human
gucccggcagccucucuucug

SEQ ID NO: 351166 - RNA, 21 nt, Human
guguguguguguuuucuuuuu

SEQ ID NO: 351167 - RNA, 22 nt, Human
guuuucuuuuugcugcuuagcu

SEQ ID NO: 351168 - RNA, 20 nt, Human
uaaaugugagugugugugug

SEQ ID NO: 351169 - RNA, 21 nt, Human
uaacuaauguaagaaugcaaa

SEQ ID NO: 351170 - RNA, 23 nt, Human
uaagaacucaaagaauuguagcc

SEQ ID NO: 351171 - RNA, 21 nt, Human
uauggaucucaugcaugacuu

SEQ ID NO: 351172 - RNA, 22 nt, Human
uauucaggaaguuuguaaacaa

SEQ ID NO: 351173 - RNA, 21 nt, Human
ucaaagaaacugacaauuaaa

SEQ ID NO: 351174 - RNA, 20 nt, Human
ucagguuagagucuccacag

SEQ ID NO: 351175 - RNA, 20 nt, Human
ucccggcagccucucuucug

SEQ ID NO: 351176 - RNA, 24 nt, Human
ucccggcagccucucuucuguuuc

SEQ ID NO: 351177 - RNA, 21 nt, Human
ucuccaaaccacgugaagccc

SEQ ID NO: 351178 - RNA, 18 nt, Human
ugaaaaaauaaaauccau

SEQ ID NO: 351179 - RNA, 26 nt, Human
ugaagaaaccugauuguuuuccccca

SEQ ID NO: 351180 - RNA, 24 nt, Human
ugacaugggcuaaaugugagugug

SEQ ID NO: 351181 - RNA, 21 nt, Human
ugacccagugcaagggacuag

SEQ ID NO: 351182 - RNA, 23 nt, Human
ugcaagggacuagauuaguagug

SEQ ID NO: 351183 - RNA, 21 nt, Human
ugcggugggcgccaucuugga

SEQ ID NO: 351184 - RNA, 19 nt, Human
uggaacaugcaguaaccac

SEQ ID NO: 351185 - RNA, 18 nt, Human
uggcagcggcggcggcga

SEQ ID NO: 351186 - RNA, 21 nt, Human
uggcagcggcggcggcgaggg

SEQ ID NO: 351187 - RNA, 21 nt, Human
ugguaagcagacgacguuugg

SEQ ID NO: 351188 - RNA, 23 nt, Human
uguauggaucucaugcaugacuu

SEQ ID NO: 351189 - RNA, 19 nt, Human
uguccugugguguauggau

SEQ ID NO: 351190 - RNA, 22 nt, Human
uguguguguguguuuucuuuuc

SEQ ID NO: 351191 - RNA, 21 nt, Human
uucagguuagagucuccacag

SEQ ID NO: 351192 - RNA, 27 nt, Human
uugcaugaacaaacgaacuuuuaaagu

SEQ ID NO: 351193 - RNA, 20 nt, Human
uuucuuuuugcugcuuagcu

SEQ ID NO: 351194 - RNA, 22 nt, Human
acccaucuugcuuccccuccac

SEQ ID NO: 351195 - RNA, 19 nt, Human
agcccucgggagucaggga

SEQ ID NO: 351196 - RNA, 19 nt, Human
agcuccugccuacuugcuc

SEQ ID NO: 351197 - RNA, 19 nt, Human
agggcuggagccaaggcac

SEQ ID NO: 351198 - RNA, 24 nt, Human
aggggaauugccuaaguaacaaag

SEQ ID NO: 351199 - RNA, 24 nt, Human
aucuugcuuccccuccacacauca

SEQ ID NO: 351200 - RNA, 23 nt, Human
auguuauagugugcuacgggagc

SEQ ID NO: 351201 - RNA, 23 nt, Human
auuuuggggaagacaagaugugg

SEQ ID NO: 351202 - RNA, 21 nt, Human
caacuuccugagcccuuaccc

SEQ ID NO: 351203 - RNA, 18 nt, Human
cacggguaugaggcuaga

SEQ ID NO: 351204 - RNA, 23 nt, Human
cagcaacacuccagcagauguua

SEQ ID NO: 351205 - RNA, 22 nt, Human
cagcgguuucuuaggaaaguuc

SEQ ID NO: 351206 - RNA, 25 nt, Human
caguaccaagggguacagggcugga

SEQ ID NO: 351207 - RNA, 21 nt, Human
caguguggccaggccagucgg

SEQ ID NO: 351208 - RNA, 19 nt, Human
caucuugcuuccccuccac

SEQ ID NO: 351209 - RNA, 25 nt, Human
ccaaggcacuucugggcagcuucau

SEQ ID NO: 351210 - RNA, 20 nt, Human
cccgugcaugccugcgugua

SEQ ID NO: 351211 - RNA, 21 nt, Human
cccuccacacaucaacggcag

SEQ ID NO: 351212 - RNA, 25 nt, Human
ccuuacccaucuugcuuccccucca

SEQ ID NO: 351213 - RNA, 23 nt, Human
cggcaguuugggcggcucugaga

SEQ ID NO: 351214 - RNA, 19 nt, Human
cggggcauggcucugugag

SEQ ID NO: 351215 - RNA, 18 nt, Human
cucuggcagaugguuggg

SEQ ID NO: 351216 - RNA, 18 nt, Human
cugccuacuugcuccaag

SEQ ID NO: 351217 - RNA, 23 nt, Human
gaggagcaucugccuugguguga

SEQ ID NO: 351218 - RNA, 21 nt, Human
gaugguuggggaaacuuucag

SEQ ID NO: 351219 - RNA, 20 nt, Human
gcaggaaacccgugcaugcc

SEQ ID NO: 351220 - RNA, 19 nt, Human
gcuggagccaaggcacuuc

SEQ ID NO: 351221 - RNA, 21 nt, Human
gcuggagccaaggcacuucug

SEQ ID NO: 351222 - RNA, 18 nt, Human
gcuuuugggugggguuuc

SEQ ID NO: 351223 - RNA, 18 nt, Human
ggagcccaggagaaggcg

SEQ ID NO: 351224 - RNA, 23 nt, Human
ggcacuuacagucuaguugggaa

SEQ ID NO: 351225 - RNA, 20 nt, Human
ggcagaugguuggggaaacu

SEQ ID NO: 351226 - RNA, 25 nt, Human
ggccaggccagucgggggcuggcuu

SEQ ID NO: 351227 - RNA, 23 nt, Human
ggcggagugaucaauuuugggga

SEQ ID NO: 351228 - RNA, 19 nt, Human
ggcugauccaagggaaaaa

SEQ ID NO: 351229 - RNA, 19 nt, Human
gggaaaccagaguguucag

SEQ ID NO: 351230 - RNA, 19 nt, Human
gggaagacaagauguggca

SEQ ID NO: 351231 - RNA, 22 nt, Human
gggcaagauucagucccugacc

SEQ ID NO: 351232 - RNA, 20 nt, Human
gggcauggcucugugagggc

SEQ ID NO: 351233 - RNA, 27 nt, Human
gguuguguuuuguccugguuaucagcg

SEQ ID NO: 351234 - RNA, 20 nt, Human
gucagggaaggggaauugcc

SEQ ID NO: 351235 - RNA, 24 nt, Human
uacaagaaaguauggugcaacagc

SEQ ID NO: 351236 - RNA, 21 nt, Human
uaggguccugcuccuccagga

SEQ ID NO: 351237 - RNA, 18 nt, Human
uccaagggaaaaagagac

SEQ ID NO: 351238 - RNA, 18 nt, Human
uccccuccacacaucaac

SEQ ID NO: 351239 - RNA, 18 nt, Human
ucuaagggaugcauagga

SEQ ID NO: 351240 - RNA, 21 nt, Human
ugagaaaccucuccuucccuc

SEQ ID NO: 351241 - RNA, 18 nt, Human
ugaggaaauaucucaagc

SEQ ID NO: 351242 - RNA, 24 nt, Human
ugcaacaaacauuuauugagcucc

SEQ ID NO: 351243 - RNA, 21 nt, Human
ugccuaaguaacaaagggggc

SEQ ID NO: 351244 - RNA, 18 nt, Human
ugccugcguguacccuug

SEQ ID NO: 351245 - RNA, 23 nt, Human
ugccugcguguacccuugguugu

SEQ ID NO: 351246 - RNA, 19 nt, Human
ugcuacgggagcccaggag

SEQ ID NO: 351247 - RNA, 19 nt, Human
uggccaggccagucggggg

SEQ ID NO: 351248 - RNA, 21 nt, Human
uggggaagacaagauguggca

SEQ ID NO: 351249 - RNA, 21 nt, Human
ugguaugggcugcagaggucu

SEQ ID NO: 351250 - RNA, 21 nt, Human
ugugcuacgggagcccaggag

SEQ ID NO: 351251 - RNA, 23 nt, Human
uucaagaggaggagcagacaucu

SEQ ID NO: 351252 - RNA, 23 nt, Human
uuccccuccacacaucaacggca

SEQ ID NO: 351253 - RNA, 22 nt, Human
aaggacacaagcucuggccugg

SEQ ID NO: 351254 - RNA, 24 nt, Human
aaguggccugccaccaggagaggg

SEQ ID NO: 351255 - RNA, 19 nt, Human
accaggagaggguguuccg

SEQ ID NO: 351256 - RNA, 22 nt, Human
acugggagggaaguggccugcc

SEQ ID NO: 351257 - RNA, 20 nt, Human
aggaaggagaaaaccacaug

SEQ ID NO: 351258 - RNA, 18 nt, Human
aggccagccaaggccagg

SEQ ID NO: 351259 - RNA, 21 nt, Human
aggccagccaaggccaggaag

SEQ ID NO: 351260 - RNA, 20 nt, Human
agugaguuucacccacccgg

SEQ ID NO: 351261 - RNA, 21 nt, Human
aucaggugccacuuggcaggg

SEQ ID NO: 351262 - RNA, 22 nt, Human
caagcucuggccuggagagcua

SEQ ID NO: 351263 - RNA, 21 nt, Human
caccccugccccagaggccag

SEQ ID NO: 351264 - RNA, 19 nt, Human
cacccgggguggacagggg

SEQ ID NO: 351265 - RNA, 21 nt, Human
cagccaaggccaggaaggaga

SEQ ID NO: 351266 - RNA, 22 nt, Human
caggacagguagggacgagggu

SEQ ID NO: 351267 - RNA, 22 nt, Human
caggaccaggaucaggacaggu

SEQ ID NO: 351268 - RNA, 19 nt, Human
caggugccacuuggcaggg

SEQ ID NO: 351269 - RNA, 23 nt, Human
ccccagaggccagccaaggccag

SEQ ID NO: 351270 - RNA, 20 nt, Human
cccuacaccugaugcccuuc

SEQ ID NO: 351271 - RNA, 21 nt, Human
ccucucugggguggauggaga

SEQ ID NO: 351272 - RNA, 24 nt, Human
ccuguauccuguaccagcaccguu

SEQ ID NO: 351273 - RNA, 19 nt, Human
cggcgguggcggaggcggc

SEQ ID NO: 351274 - RNA, 21 nt, Human
cgggcggcggagcggggacac

SEQ ID NO: 351275 - RNA, 18 nt, Human
cgguggcggaggcggcgg

SEQ ID NO: 351276 - RNA, 25 nt, Human
cuccaccaccccugccccagaggcc

SEQ ID NO: 351277 - RNA, 25 nt, Human
cucuccaccaccccugccccagagg

SEQ ID NO: 351278 - RNA, 19 nt, Human
gagaggguguuccgagggg

SEQ ID NO: 351279 - RNA, 19 nt, Human
gcggagcggggacacggag

SEQ ID NO: 351280 - RNA, 21 nt, Human
gcgguggcggaggcggcggug

SEQ ID NO: 351281 - RNA, 20 nt, Human
ggagacuggcacugggaggg

SEQ ID NO: 351282 - RNA, 24 nt, Human
ggauggagacuggcacugggaggg

SEQ ID NO: 351283 - RNA, 20 nt, Human
ggcggagcggggacacggag

SEQ ID NO: 351284 - RNA, 20 nt, Human
gggaaguggccugccaccag

SEQ ID NO: 351285 - RNA, 19 nt, Human
gggguggauggagacuggc

SEQ ID NO: 351286 - RNA, 20 nt, Human
ucaggacagguagggacgag

SEQ ID NO: 351287 - RNA, 22 nt, Human
ucaggacagguagggacgaggg

SEQ ID NO: 351288 - RNA, 20 nt, Human
ucggcgguggcggaggcggc

SEQ ID NO: 351289 - RNA, 21 nt, Human
ucuccaccaccccugccccag

SEQ ID NO: 351290 - RNA, 24 nt, Human
ugaaggacacaagcucuggccugg

SEQ ID NO: 351291 - RNA, 19 nt, Human
ugcccuuccaucucuccac

SEQ ID NO: 351292 - RNA, 19 nt, Human
uggcggcggcggccgagug

SEQ ID NO: 351293 - RNA, 25 nt, Human
uguaccagcaccguugauucuucag

SEQ ID NO: 351294 - RNA, 20 nt, Human
uucuucagagcccuuggcca

SEQ ID NO: 351295 - RNA, 21 nt, Human
uuuuuuuuuuuuuuuucucag

SEQ ID NO: 351296 - RNA, 24 nt, Human
aaaauucuuaguucauggacaaaa

SEQ ID NO: 351297 - RNA, 26 nt, Human
aaagcaaaaauaaaaauucuuggcug

SEQ ID NO: 351298 - RNA, 24 nt, Human
aagaucauuugaggccaggaguuc

SEQ ID NO: 351299 - RNA, 22 nt, Human
acagacacgaauuggaugccac

SEQ ID NO: 351300 - RNA, 20 nt, Human
acugccucggcucccagucu

SEQ ID NO: 351301 - RNA, 23 nt, Human
agccugggcaacauagugagauc

SEQ ID NO: 351302 - RNA, 24 nt, Human
agccugggcaacauagugagaucc

SEQ ID NO: 351303 - RNA, 25 nt, Human
agccugggcaacauagugagauccu

SEQ ID NO: 351304 - RNA, 20 nt, Human
aggggucagcucugucuugg

SEQ ID NO: 351305 - RNA, 18 nt, Human
aguaucugaaaagcccag

SEQ ID NO: 351306 - RNA, 23 nt, Human
aguccuucccucucaagacccgu

SEQ ID NO: 351307 - RNA, 21 nt, Human
augaagaacaguuuauucaca

SEQ ID NO: 351308 - RNA, 20 nt, Human
auggaggacaccuuucucca

SEQ ID NO: 351309 - RNA, 19 nt, Human
auggcuccuccugcgcaug

SEQ ID NO: 351310 - RNA, 21 nt, Human
caccaacacuccaagggcucu

SEQ ID NO: 351311 - RNA, 18 nt, Human
cacugugucaccuugggc

SEQ ID NO: 351312 - RNA, 18 nt, Human
cagcaccacugccucggc

SEQ ID NO: 351313 - RNA, 22 nt, Human
cagguugcuaagacagagcuaa

SEQ ID NO: 351314 - RNA, 24 nt, Human
ccacccaugccccaaagugaggac

SEQ ID NO: 351315 - RNA, 18 nt, Human
ccagcuucagggcuggca

SEQ ID NO: 351316 - RNA, 18 nt, Human
ccccaacccaggcuggca

SEQ ID NO: 351317 - RNA, 20 nt, Human
cccgauccauguccuuagac

SEQ ID NO: 351318 - RNA, 20 nt, Human
ccuagcucugccaccuccuc

SEQ ID NO: 351319 - RNA, 19 nt, Human
ccuccccaagcaaagugac

SEQ ID NO: 351320 - RNA, 20 nt, Human
ccucggcuuuggggcuuugg

SEQ ID NO: 351321 - RNA, 22 nt, Human
ccugggcaacauagugagaucc

SEQ ID NO: 351322 - RNA, 24 nt, Human
ccugggcaacauagugagauccua

SEQ ID NO: 351323 - RNA, 23 nt, Human
ccuucacuugggccagcaccacu

SEQ ID NO: 351324 - RNA, 19 nt, Human
ccuugggccccaacccagg

SEQ ID NO: 351325 - RNA, 22 nt, Human
ccuugggccgguaacuuaaucu

SEQ ID NO: 351326 - RNA, 24 nt, Human
cuccugcgcaugcccaggccccau

SEQ ID NO: 351327 - RNA, 22 nt, Human
cuccuggagccacccaugcccc

SEQ ID NO: 351328 - RNA, 19 nt, Human
cucugaucuccaccaacac

SEQ ID NO: 351329 - RNA, 24 nt, Human
cugcacuuugggaggcugaagugg

SEQ ID NO: 351330 - RNA, 21 nt, Human
cugcugccugagggcauggag

SEQ ID NO: 351331 - RNA, 19 nt, Human
cuggagccacccaugcccc

SEQ ID NO: 351332 - RNA, 18 nt, Human
cugucuucucaacccugc

SEQ ID NO: 351333 - RNA, 18 nt, Human
cuucccucucaagacccg

SEQ ID NO: 351334 - RNA, 23 nt, Human
cuugggccccaacccaggcuggc

SEQ ID NO: 351335 - RNA, 24 nt, Human
gaagaucauuugaggccaggaguu

SEQ ID NO: 351336 - RNA, 20 nt, Human
gacacucaaggucacauccu

SEQ ID NO: 351337 - RNA, 18 nt, Human
gagcaguuggcuuguugg

SEQ ID NO: 351338 - RNA, 18 nt, Human
gaggcugaagugggaaga

SEQ ID NO: 351339 - RNA, 18 nt, Human
gaucauuugaggccagga

SEQ ID NO: 351340 - RNA, 24 nt, Human
gaucauuugaggccaggaguucaa

SEQ ID NO: 351341 - RNA, 23 nt, Human
gcacuuugggaggcugaaguggg

SEQ ID NO: 351342 - RNA, 25 nt, Human
gccacaaucaugaagucagauuguc

SEQ ID NO: 351343 - RNA, 19 nt, Human
gccccaaagugaggacacu

SEQ ID NO: 351344 - RNA, 19 nt, Human
gccuguaaucccugcacuu

SEQ ID NO: 351345 - RNA, 18 nt, Human
gccuuuggugguggaggg

SEQ ID NO: 351346 - RNA, 22 nt, Human
gccuuuggugguggagggguca

SEQ ID NO: 351347 - RNA, 24 nt, Human
gccuuuggugguggaggggucagc

SEQ ID NO: 351348 - RNA, 22 nt, Human
gcggaacaacauuugcagcccc

SEQ ID NO: 351349 - RNA, 22 nt, Human
gcugggcacgguggcuugugcc

SEQ ID NO: 351350 - RNA, 20 nt, Human
gcuuaucgcugcccgggacu

SEQ ID NO: 351351 - RNA, 22 nt, Human
ggacaaaaacagggauuuggug

SEQ ID NO: 351352 - RNA, 18 nt, Human
ggagccacccaugcccca

SEQ ID NO: 351353 - RNA, 23 nt, Human
ggcacgguggcuugugccuguaa

SEQ ID NO: 351354 - RNA, 23 nt, Human
ggccagcaccacugccucggcuc

SEQ ID NO: 351355 - RNA, 20 nt, Human
ggcugggcacgguggcuugu

SEQ ID NO: 351356 - RNA, 24 nt, Human
gguggcuugugccuguaaucccug

SEQ ID NO: 351357 - RNA, 19 nt, Human
gugcacacgucugggggca

SEQ ID NO: 351358 - RNA, 21 nt, Human
guggcuugugccuguaauccc

SEQ ID NO: 351359 - RNA, 23 nt, Human
gugggucaucugugagcaguugg

SEQ ID NO: 351360 - RNA, 20 nt, Human
uagaucugucuucucaaccc

SEQ ID NO: 351361 - RNA, 25 nt, Human
uaguucauggacaaaaacagggauu

SEQ ID NO: 351362 - RNA, 18 nt, Human
uaucugaaaagcccagag

SEQ ID NO: 351363 - RNA, 20 nt, Human
ucauggacaaaaacagggau

SEQ ID NO: 351364 - RNA, 23 nt, Human
ucauuugaggccaggaguucaag

SEQ ID NO: 351365 - RNA, 24 nt, Human
uccaagggcucugggccaguucuc

SEQ ID NO: 351366 - RNA, 21 nt, Human
uccaccaacacuccaagggcu

SEQ ID NO: 351367 - RNA, 19 nt, Human
uccaccacggcacucugau

SEQ ID NO: 351368 - RNA, 21 nt, Human
uccagccuugacacucaaggu

SEQ ID NO: 351369 - RNA, 24 nt, Human
uccccugugcacacgucugggggc

SEQ ID NO: 351370 - RNA, 21 nt, Human
ucccugcacuuugggaggcug

SEQ ID NO: 351371 - RNA, 23 nt, Human
uccugcgcaugcccaggccccuc

SEQ ID NO: 351372 - RNA, 23 nt, Human
ucuccuggagccacccaugcccc

SEQ ID NO: 351373 - RNA, 19 nt, Human
ucugaaaagcccagagugg

SEQ ID NO: 351374 - RNA, 22 nt, Human
ucuugcgguuuaaagcaggcuu

SEQ ID NO: 351375 - RNA, 25 nt, Human
ucuugcgguuuaaagcaggcuuuuu

SEQ ID NO: 351376 - RNA, 26 nt, Human
ugaaaagcccagaguggggcagaggg

SEQ ID NO: 351377 - RNA, 18 nt, Human
ugaaacccucggcuuugg

SEQ ID NO: 351378 - RNA, 26 nt, Human
ugaagugggaagaucauuugaggcca

SEQ ID NO: 351379 - RNA, 20 nt, Human
ugagggcauggaggacaccu

SEQ ID NO: 351380 - RNA, 18 nt, Human
ugaucuccaccaacacuc

SEQ ID NO: 351381 - RNA, 23 nt, Human
ugccuguaaucccugcacuuugg

SEQ ID NO: 351382 - RNA, 23 nt, Human
ugccuguaaucccugcacuuugg

SEQ ID NO: 351383 - RNA, 24 nt, Human
ugccuguaaucccugcacuuuggg

SEQ ID NO: 351384 - RNA, 18 nt, Human
uggaugccacaaucauga

SEQ ID NO: 351385 - RNA, 18 nt, Human
uggcugggcacgguggcu

SEQ ID NO: 351386 - RNA, 24 nt, Human
uggcuugugccuguaaucccugca

SEQ ID NO: 351387 - RNA, 20 nt, Human
ugggaggcugaagugggaag

SEQ ID NO: 351388 - RNA, 24 nt, Human
ugggaggcugaagugggaagauca

SEQ ID NO: 351389 - RNA, 24 nt, Human
ugggccaguucucugcugccugag

SEQ ID NO: 351390 - RNA, 19 nt, Human
uggggcagaggguccccug

SEQ ID NO: 351391 - RNA, 19 nt, Human
uggugguggaggggucagc

SEQ ID NO: 351392 - RNA, 20 nt, Human
ugugagcaguuggcuuguug

SEQ ID NO: 351393 - RNA, 24 nt, Human
ugugccuguaaucccugcacuuug

SEQ ID NO: 351394 - RNA, 21 nt, Human
uuaguucauggacaaaaacag

SEQ ID NO: 351395 - RNA, 20 nt, Human
uucauggacaaaaacaggga

SEQ ID NO: 351396 - RNA, 24 nt, Human
uuggcugggcacgguggcuugugc

SEQ ID NO: 351397 - RNA, 23 nt, Human
uuggcuuguuggugagagacagg

SEQ ID NO: 351398 - RNA, 25 nt, Human
uugggaggcugaagugggaagauca

SEQ ID NO: 351399 - RNA, 21 nt, Human
uuggugagagacaggccuuug

SEQ ID NO: 351400 - RNA, 22 nt, Human
uugugccuguaaucccugcacu

SEQ ID NO: 351401 - RNA, 23 nt, Human
uugugccuguaaucccugcacuu

SEQ ID NO: 351402 - RNA, 23 nt, Human
uuuuuuuuuuuuuuuuuggggcu

SEQ ID NO: 351403 - RNA, 25 nt, Human
uuuuuuuuuuuuuuuuuuuuugggg

SEQ ID NO: 351404 - RNA, 19 nt, Human
acacaaaguacaauccagu

SEQ ID NO: 351405 - RNA, 18 nt, Human
agaagagcaaagaacuca

SEQ ID NO: 351406 - RNA, 24 nt, Human
agaagagcaaagaacucaagaaga

SEQ ID NO: 351407 - RNA, 27 nt, Human
agagcaaagaacucaagaagaggcaag

SEQ ID NO: 351408 - RNA, 21 nt, Human
agcuauuugagcaagggccca

SEQ ID NO: 351409 - RNA, 20 nt, Human
aggaaugcacuggcugugcc

SEQ ID NO: 351410 - RNA, 18 nt, Human
caaaguacaauccaguau

SEQ ID NO: 351411 - RNA, 26 nt, Human
caaaguacaauccaguauaugcagaa

SEQ ID NO: 351412 - RNA, 27 nt, Human
caauagauuuccucuucauuagucaaa

SEQ ID NO: 351413 - RNA, 21 nt, Human
cagcuuccugggagacuuugg

SEQ ID NO: 351414 - RNA, 22 nt, Human
caggugggcucuucacuggcuu

SEQ ID NO: 351415 - RNA, 22 nt, Human
caguauaugcagaaagguacuc

SEQ ID NO: 351416 - RNA, 21 nt, Human
caguuccaagaaucaauuuug

SEQ ID NO: 351417 - RNA, 22 nt, Human
cauaaaagaaccccuagagaaa

SEQ ID NO: 351418 - RNA, 21 nt, Human
cccacagcuuccugggagacu

SEQ ID NO: 351419 - RNA, 18 nt, Human
ccccgccauguccuucca

SEQ ID NO: 351420 - RNA, 24 nt, Human
cuaaaaaucacauaaaagaacccc

SEQ ID NO: 351421 - RNA, 21 nt, Human
cucaagaagaggcaagcaaga

SEQ ID NO: 351422 - RNA, 25 nt, Human
cucugaauggcagagacccuaaucu

SEQ ID NO: 351423 - RNA, 23 nt, Human
cuguucgcaggcaggaaugcacu

SEQ ID NO: 351424 - RNA, 18 nt, Human
gaacucaagaagaggcaa

SEQ ID NO: 351425 - RNA, 27 nt, Human
gaagagcaaagaacucaagaagaggcc

SEQ ID NO: 351426 - RNA, 26 nt, Human
gagcaaagaacucaagaagaggcaag

SEQ ID NO: 351427 - RNA, 18 nt, Human
gccccgccauguccuucc

SEQ ID NO: 351428 - RNA, 18 nt, Human
ggaaauuauauucuuuuc

SEQ ID NO: 351429 - RNA, 22 nt, Human
ggagggccuguucgcaggcagg

SEQ ID NO: 351430 - RNA, 19 nt, Human
guaugaaggccauucugua

SEQ ID NO: 351431 - RNA, 24 nt, Human
gucacugaaaaccuggcacaccac

SEQ ID NO: 351432 - RNA, 19 nt, Human
gugggcucuucacuggcuu

SEQ ID NO: 351433 - RNA, 21 nt, Human
gugggcucuucacuggcuuca

SEQ ID NO: 351434 - RNA, 21 nt, Human
guuuucaagcaucaacucuga

SEQ ID NO: 351435 - RNA, 24 nt, Human
uaaaagaaccccuagagaaaucaa

SEQ ID NO: 351436 - RNA, 23 nt, Human
uaaucugacuguuauuagccacc

SEQ ID NO: 351437 - RNA, 23 nt, Human
uaggcuccuaugcgagacaguuu

SEQ ID NO: 351438 - RNA, 23 nt, Human
ucaagaagaggcaagcaagagca

SEQ ID NO: 351439 - RNA, 23 nt, Human
ucacuggcuucacuucagcuuga

SEQ ID NO: 351440 - RNA, 25 nt, Human
ucagcuugauccucuggucucccca

SEQ ID NO: 351441 - RNA, 22 nt, Human
ugaacgcaaggguaacaucccc

SEQ ID NO: 351442 - RNA, 25 nt, Human
ugccucgccccgccauguccuucca

SEQ ID NO: 351443 - RNA, 18 nt, Human
uggagaggcggcaaagcu

SEQ ID NO: 351444 - RNA, 21 nt, Human
uggcacaccacuuagcuaaaa

SEQ ID NO: 351445 - RNA, 22 nt, Human
ugggagggccuguucgcaggca

SEQ ID NO: 351446 - RNA, 19 nt, Human
uguagagugcacguauaua

SEQ ID NO: 351447 - RNA, 18 nt, Human
ugugaaauucagucccac

SEQ ID NO: 351448 - RNA, 24 nt, Human
uuccacaggugggcucuucacugg

SEQ ID NO: 351449 - RNA, 18 nt, Human
uuuuuuuuuuuuuuuuug

SEQ ID NO: 351450 - RNA, 20 nt, Human
accuccagcucccugggcuc

SEQ ID NO: 351451 - RNA, 20 nt, Human
agaggaagcgccgaccucca

SEQ ID NO: 351452 - RNA, 25 nt, Human
ccgaccuccagcucccugggcucug

SEQ ID NO: 351453 - RNA, 19 nt, Human
cgcgucaguggaccaagca

SEQ ID NO: 351454 - RNA, 24 nt, Human
aaaaaggaaaauuauaacaaagga

SEQ ID NO: 351455 - RNA, 23 nt, Human
aaacugaaucuucagcagaauaa

SEQ ID NO: 351456 - RNA, 23 nt, Human
aauugauuaaugacaugaagugc

SEQ ID NO: 351457 - RNA, 19 nt, Human
acccagagcauaggaaaaa

SEQ ID NO: 351458 - RNA, 20 nt, Human
agagcauaggaaaaacagga

SEQ ID NO: 351459 - RNA, 23 nt, Human
aguauuagaaaaacuaggaaaaa

SEQ ID NO: 351460 - RNA, 23 nt, Human
aguuauuuuaauuuucuauuaaa

SEQ ID NO: 351461 - RNA, 19 nt, Human
cagcuguuggcauuguguu

SEQ ID NO: 351462 - RNA, 22 nt, Human
ccagagcauaggaaaaacagga

SEQ ID NO: 351463 - RNA, 20 nt, Human
ccaucaggcucuauucaccc

SEQ ID NO: 351464 - RNA, 23 nt, Human
cugcaucugaaagcaaacuuuau

SEQ ID NO: 351465 - RNA, 24 nt, Human
cuuuauuguucaauuauucuuaau

SEQ ID NO: 351466 - RNA, 19 nt, Human
gaaaacugcaucugaaagc

SEQ ID NO: 351467 - RNA, 25 nt, Human
gaccauaauuaccauauuaacuuug

SEQ ID NO: 351468 - RNA, 18 nt, Human
gcaaagcaguaguauacc

SEQ ID NO: 351469 - RNA, 19 nt, Human
gccagcuguuggcauugug

SEQ ID NO: 351470 - RNA, 22 nt, Human
uaccccagaccauaauuaccau

SEQ ID NO: 351471 - RNA, 20 nt, Human
uacuuuguaagcaaaacaaa

SEQ ID NO: 351472 - RNA, 23 nt, Human
uaggaaaaacaggauuggucaca

SEQ ID NO: 351473 - RNA, 19 nt, Human
uauccuauaucucacugaa

SEQ ID NO: 351474 - RNA, 21 nt, Human
uauuuuuauuuuaaaaauaag

SEQ ID NO: 351475 - RNA, 23 nt, Human
ucagucuaaauucugacaauaaa

SEQ ID NO: 351476 - RNA, 18 nt, Human
ucuauuaaacauucuucu

SEQ ID NO: 351477 - RNA, 20 nt, Human
ucuuaaacugaaucuucagc

SEQ ID NO: 351478 - RNA, 18 nt, Human
ugaagugcacaacacuaa

SEQ ID NO: 351479 - RNA, 21 nt, Human
uguaaugcacaguuguaugca

SEQ ID NO: 351480 - RNA, 25 nt, Human
uuagaaaaacuaggaaaaaagauaa

SEQ ID NO: 351481 - RNA, 22 nt, Human
uucugacaauaaaauguaugga

SEQ ID NO: 351482 - RNA, 23 nt, Human
uuggauuuuacuguuccuaauuu

SEQ ID NO: 351483 - RNA, 21 nt, Human
uuguaagcaaaacaaaagcuu

SEQ ID NO: 351484 - RNA, 20 nt, Human
uuuagauuuuuaaucucacu

SEQ ID NO: 351485 - RNA, 26 nt, Human
uuuggauuuuacuguuccuaauuuua

SEQ ID NO: 351486 - RNA, 20 nt, Human
acccggacgccagcgaagac

SEQ ID NO: 351487 - RNA, 20 nt, Human
agccggggcuugggggggcu

SEQ ID NO: 351488 - RNA, 21 nt, Human
agcggcggaggcagcgcggga

SEQ ID NO: 351489 - RNA, 19 nt, Human
agguucgguucuaggucuc

SEQ ID NO: 351490 - RNA, 20 nt, Human
auuccugcggggcuccggcg

SEQ ID NO: 351491 - RNA, 25 nt, Human
cacccccgucuucagagacccaacu

SEQ ID NO: 351492 - RNA, 23 nt, Human
cccacaacgcgucuaacacugcc

SEQ ID NO: 351493 - RNA, 21 nt, Human
ccccuggcgggcggggcgggg

SEQ ID NO: 351494 - RNA, 24 nt, Human
cccgacccacaacgcgucuaacac

SEQ ID NO: 351495 - RNA, 24 nt, Human
ccgcaggcccugcgcuagaaggcu

SEQ ID NO: 351496 - RNA, 18 nt, Human
ccgggccccccucccccu

SEQ ID NO: 351497 - RNA, 21 nt, Human
ccuccggccccuccacccgga

SEQ ID NO: 351498 - RNA, 19 nt, Human
ccugcgacgcgauccaggg

SEQ ID NO: 351499 - RNA, 24 nt, Human
ccuggcgggcggggcgggguggga

SEQ ID NO: 351500 - RNA, 23 nt, Human
cgcuagaaggcuugggaaggggu

SEQ ID NO: 351501 - RNA, 22 nt, Human
cugcuaggcaggggcgucccug

SEQ ID NO: 351502 - RNA, 22 nt, Human
cugcuccgccccggccugcugc

SEQ ID NO: 351503 - RNA, 26 nt, Human
cuggaggggaggggagggggcucggg

SEQ ID NO: 351504 - RNA, 21 nt, Human
gaggguaggagggcggcuccg

SEQ ID NO: 351505 - RNA, 18 nt, Human
gccccccucccccuauug

SEQ ID NO: 351506 - RNA, 19 nt, Human
gcccgcccuccggccccuc

SEQ ID NO: 351507 - RNA, 22 nt, Human
gcccgcccuccggccccuccac

SEQ ID NO: 351508 - RNA, 23 nt, Human
gcgggagaggaagggcgcucccu

SEQ ID NO: 351509 - RNA, 26 nt, Human
ggagaaagccgggggcacccuggagg

SEQ ID NO: 351510 - RNA, 23 nt, Human
ggaggacagagcccgggaagcug

SEQ ID NO: 351511 - RNA, 19 nt, Human
ggaggggaggggagggggc

SEQ ID NO: 351512 - RNA, 21 nt, Human
ggagggggcucgggguggguc

SEQ ID NO: 351513 - RNA, 18 nt, Human
ggcgcagaggcgggagag

SEQ ID NO: 351514 - RNA, 24 nt, Human
ggcuccgacugaggccccagaagc

SEQ ID NO: 351515 - RNA, 20 nt, Human
gggaagcugggcuggaagaa

SEQ ID NO: 351516 - RNA, 23 nt, Human
gggaggggagggggcucggggug

SEQ ID NO: 351517 - RNA, 18 nt, Human
gggcggggugggaccggg

SEQ ID NO: 351518 - RNA, 21 nt, Human
ggggaggggagggggcucggg

SEQ ID NO: 351519 - RNA, 23 nt, Human
ggggaggggagggggcucggggu

SEQ ID NO: 351520 - RNA, 25 nt, Human
ggggaggggagggggcucggggugg

SEQ ID NO: 351521 - RNA, 19 nt, Human
ggggugggucuccccucgg

SEQ ID NO: 351522 - RNA, 25 nt, Human
gugggaccgggccccccucccccua

SEQ ID NO: 351523 - RNA, 22 nt, Human
uccccucgggacccuauugcuu

SEQ ID NO: 351524 - RNA, 18 nt, Human
ucccuaccucaccucacc

SEQ ID NO: 351525 - RNA, 21 nt, Human
ucccuaccucaccucaccccc

SEQ ID NO: 351526 - RNA, 22 nt, Human
ugcggggcuccggcgcuguggg

SEQ ID NO: 351527 - RNA, 23 nt, Human
ugcuugaaggggccggcaaggcc

SEQ ID NO: 351528 - RNA, 18 nt, Human
ugggaagggguggggaag

SEQ ID NO: 351529 - RNA, 19 nt, Human
ugggagaaagccgggggca

SEQ ID NO: 351530 - RNA, 20 nt, Human
uugaaggggccggcaaggcc

SEQ ID NO: 351531 - RNA, 22 nt, Human
aaguaccaccccucccccucuc

SEQ ID NO: 351532 - RNA, 20 nt, Human
accaccccucccccucuccc

SEQ ID NO: 351533 - RNA, 20 nt, Human
auuggugccaaguaccaccc

SEQ ID NO: 351534 - RNA, 20 nt, Human
caccccucccccucuccccc

SEQ ID NO: 351535 - RNA, 21 nt, Human
caccccucccccucuccccca

SEQ ID NO: 351536 - RNA, 23 nt, Human
cagguggugaggggguuccuucc

SEQ ID NO: 351537 - RNA, 21 nt, Human
cauccugccccccaccccaaa

SEQ ID NO: 351538 - RNA, 21 nt, Human
ccaaguaccaccccucccccu

SEQ ID NO: 351539 - RNA, 21 nt, Human
ccccauccugccccccacccc

SEQ ID NO: 351540 - RNA, 19 nt, Human
cccccucucccccauccug

SEQ ID NO: 351541 - RNA, 20 nt, Human
ccugccccccaccccaaaug

SEQ ID NO: 351542 - RNA, 23 nt, Human
cugggccgggcagguggugaggg

SEQ ID NO: 351543 - RNA, 19 nt, Human
gcagcugcgcuccugggcc

SEQ ID NO: 351544 - RNA, 18 nt, Human
gggucggggcgcaggagc

SEQ ID NO: 351545 - RNA, 19 nt, Human
ucccccauccugcccccca

SEQ ID NO: 351546 - RNA, 24 nt, Human
uuggugccaaguaccaccccuccc

SEQ ID NO: 351547 - RNA, 23 nt, Human
acgaaccaaaucccaggcccuug

SEQ ID NO: 351548 - RNA, 22 nt, Human
agcaaacgaaccaaaucccagg

SEQ ID NO: 351549 - RNA, 18 nt, Human
cagcgccccgcgcagggu

SEQ ID NO: 351550 - RNA, 21 nt, Human
cagcgccccgcgcaggguccc

SEQ ID NO: 351551 - RNA, 22 nt, Human
cagcgccccgcgcagggucccg

SEQ ID NO: 351552 - RNA, 26 nt, Human
cagggucccgggcuccggccggccuc

SEQ ID NO: 351553 - RNA, 24 nt, Human
ccacagcagugcccagccuucgca

SEQ ID NO: 351554 - RNA, 18 nt, Human
ccaggcccuuguccugcc

SEQ ID NO: 351555 - RNA, 20 nt, Human
cccacagcagugcccagccu

SEQ ID NO: 351556 - RNA, 18 nt, Human
cccagaagagcaaacgaa

SEQ ID NO: 351557 - RNA, 18 nt, Human
cccaggcccuuguccugc

SEQ ID NO: 351558 - RNA, 24 nt, Human
ccccgacguccgccugcccgugcc

SEQ ID NO: 351559 - RNA, 19 nt, Human
cgccugcccgugcccucug

SEQ ID NO: 351560 - RNA, 24 nt, Human
cgccugcccgugcccucugcccgc

SEQ ID NO: 351561 - RNA, 21 nt, Human
cggaagaguccaaggccuggg

SEQ ID NO: 351562 - RNA, 18 nt, Human
gccucacaucccuucgga

SEQ ID NO: 351563 - RNA, 22 nt, Human
ggaccccugaacuucucuuccc

SEQ ID NO: 351564 - RNA, 21 nt, Human
ggccuggggaggggcaucuuc

SEQ ID NO: 351565 - RNA, 21 nt, Human
uauuucccugucccuuucugg

SEQ ID NO: 351566 - RNA, 21 nt, Human
ucccagaagagcaaacgaacc

SEQ ID NO: 351567 - RNA, 24 nt, Human
uccgccugcccgugcccucugccc

SEQ ID NO: 351568 - RNA, 25 nt, Human
uccgugggugacccugcuccagccu

SEQ ID NO: 351569 - RNA, 22 nt, Human
ugcccgcacguuccccgagggc

SEQ ID NO: 351570 - RNA, 20 nt, Human
ugcccgugcccucugcccgc

SEQ ID NO: 351571 - RNA, 19 nt, Human
ugcugggaagacuggcugu

SEQ ID NO: 351572 - RNA, 22 nt, Human
ugggaagacuggcugucccaca

SEQ ID NO: 351573 - RNA, 23 nt, Human
ugggaagacuggcugucccacag

SEQ ID NO: 351574 - RNA, 21 nt, Human
ugggugacccugcuccagccu

SEQ ID NO: 351575 - RNA, 22 nt, Human
uguccugccccacagugccuca

SEQ ID NO: 351576 - RNA, 18 nt, Human
uuguccugccccacagug

SEQ ID NO: 351577 - RNA, 21 nt, Human
aaaaaaaaaaaaaaaaagucu

SEQ ID NO: 351578 - RNA, 19 nt, Human
aacagaccaccagaaacgg

SEQ ID NO: 351579 - RNA, 20 nt, Human
aacccacaggcccuuccucg

SEQ ID NO: 351580 - RNA, 20 nt, Human
aagagacaacacacaaacua

SEQ ID NO: 351581 - RNA, 22 nt, Human
aagauggggggauaccgaauca

SEQ ID NO: 351582 - RNA, 22 nt, Human
aagcaagauggggggauaccga

SEQ ID NO: 351583 - RNA, 22 nt, Human
aagugcuacaggugugugagcc

SEQ ID NO: 351584 - RNA, 22 nt, Human
aauaaacccacaggcccuuccu

SEQ ID NO: 351585 - RNA, 22 nt, Human
aauuuccaggaggaagcagccc

SEQ ID NO: 351586 - RNA, 18 nt, Human
acacaggcacgacugcuu

SEQ ID NO: 351587 - RNA, 20 nt, Human
acagggaaaaacccauugga

SEQ ID NO: 351588 - RNA, 23 nt, Human
accccuggugcccuaagucucca

SEQ ID NO: 351589 - RNA, 21 nt, Human
agacaacacacaaacuaagcc

SEQ ID NO: 351590 - RNA, 22 nt, Human
agacaacacacaaacuaagccu

SEQ ID NO: 351591 - RNA, 23 nt, Human
agacaacacacaaacuaagccua

SEQ ID NO: 351592 - RNA, 18 nt, Human
agagaagcagaguggagc

SEQ ID NO: 351593 - RNA, 23 nt, Human
agagacaacacacaaacuaagcc

SEQ ID NO: 351594 - RNA, 19 nt, Human
agaggcugcuucaguuugg

SEQ ID NO: 351595 - RNA, 21 nt, Human
agcacaccccacgacuccgug

SEQ ID NO: 351596 - RNA, 18 nt, Human
agcggcaggcugcgcggg

SEQ ID NO: 351597 - RNA, 18 nt, Human
aggcacgacugcuugaaa

SEQ ID NO: 351598 - RNA, 23 nt, Human
aggcagaagucagagaagcagag

SEQ ID NO: 351599 - RNA, 24 nt, Human
aggugcuggcugugguggaaaggu

SEQ ID NO: 351600 - RNA, 18 nt, Human
agguggccugguggcagg

SEQ ID NO: 351601 - RNA, 21 nt, Human
agucagagaagcagaguggag

SEQ ID NO: 351602 - RNA, 21 nt, Human
aguggagcucccagcacaccc

SEQ ID NO: 351603 - RNA, 23 nt, Human
aguuuaaaaaaaaaaaaaaaaaa

SEQ ID NO: 351604 - RNA, 21 nt, Human
auauuccugauuccagcccag

SEQ ID NO: 351605 - RNA, 20 nt, Human
caaaagcaaaagacuaucac

SEQ ID NO: 351606 - RNA, 22 nt, Human
caaagcagucggaucccccucc

SEQ ID NO: 351607 - RNA, 21 nt, Human
caaaguggacuccuguccccu

SEQ ID NO: 351608 - RNA, 24 nt, Human
caaaguggacuccuguccccugcc

SEQ ID NO: 351609 - RNA, 23 nt, Human
caacguggcagcggcccaggccu

SEQ ID NO: 351610 - RNA, 19 nt, Human
cacacgggcuucuccaacg

SEQ ID NO: 351611 - RNA, 21 nt, Human
caccagaaacggggccaccag

SEQ ID NO: 351612 - RNA, 22 nt, Human
caccagaaacggggccaccaga

SEQ ID NO: 351613 - RNA, 23 nt, Human
caccagacagauaguccauaccc

SEQ ID NO: 351614 - RNA, 22 nt, Human
caccucucccgccgagcuccga

SEQ ID NO: 351615 - RNA, 19 nt, Human
cagaaacggggccaccaga

SEQ ID NO: 351616 - RNA, 20 nt, Human
cagaagucagagaagcagag

SEQ ID NO: 351617 - RNA, 26 nt, Human
cagaccaccagaaacggggccaccag

SEQ ID NO: 351618 - RNA, 23 nt, Human
cagagccagcucugcccaagaca

SEQ ID NO: 351619 - RNA, 25 nt, Human
cagaguggagcucccagcacacccc

SEQ ID NO: 351620 - RNA, 20 nt, Human
cagcacaccccacgacuccg

SEQ ID NO: 351621 - RNA, 22 nt, Human
cagccugccaacagaccaccag

SEQ ID NO: 351622 - RNA, 21 nt, Human
caggguggggccacaggagcu

SEQ ID NO: 351623 - RNA, 24 nt, Human
cauuuggaaaaucuacuguacagg

SEQ ID NO: 351624 - RNA, 26 nt, Human
cauuuggaaaaucuacuguacaggga

SEQ ID NO: 351625 - RNA, 18 nt, Human
ccacaggcaggacgggcg

SEQ ID NO: 351626 - RNA, 21 nt, Human
ccacucagcggccaccccccc

SEQ ID NO: 351627 - RNA, 18 nt, Human
ccagcccagggcccaggg

SEQ ID NO: 351628 - RNA, 19 nt, Human
ccaggccccugccgcccuc

SEQ ID NO: 351629 - RNA, 18 nt, Human
ccaguaagugcuacaggu

SEQ ID NO: 351630 - RNA, 20 nt, Human
cccagcgcgccgcuguccca

SEQ ID NO: 351631 - RNA, 24 nt, Human
cccagcgcgccgcugucccaggcg

SEQ ID NO: 351632 - RNA, 18 nt, Human
ccccaagccccacccgca

SEQ ID NO: 351633 - RNA, 18 nt, Human
cccccaagaugcuugguc

SEQ ID NO: 351634 - RNA, 24 nt, Human
ccccugccacucagcggccacccc

SEQ ID NO: 351635 - RNA, 21 nt, Human
ccccugccgcccucccuacag

SEQ ID NO: 351636 - RNA, 20 nt, Human
cccgcaggaucuuccagcca

SEQ ID NO: 351637 - RNA, 22 nt, Human
ccgcaggaucuuccagccacau

SEQ ID NO: 351638 - RNA, 22 nt, Human
ccgcugcucgaugcucucuugg

SEQ ID NO: 351639 - RNA, 26 nt, Human
ccuuauaauaaacccacaggcccuuc

SEQ ID NO: 351640 - RNA, 22 nt, Human
cgacaaacucaagagacaacac

SEQ ID NO: 351641 - RNA, 23 nt, Human
cgcaccucucccgccgagcuccg

SEQ ID NO: 351642 - RNA, 21 nt, Human
cgcucagagccagcucugccc

SEQ ID NO: 351643 - RNA, 25 nt, Human
cggcccgcaccucucccgccgagcu

SEQ ID NO: 351644 - RNA, 22 nt, Human
cggcucggauucggcccgcacc

SEQ ID NO: 351645 - RNA, 25 nt, Human
cgggccggcuucgcggguuccgcug

SEQ ID NO: 351646 - RNA, 19 nt, Human
cuacaguccucucugucug

SEQ ID NO: 351647 - RNA, 18 nt, Human
cucuacugccggauuccu

SEQ ID NO: 351648 - RNA, 20 nt, Human
cucugcccaagacaccccuc

SEQ ID NO: 351649 - RNA, 26 nt, Human
cucugucugaaggcugaggagcucau

SEQ ID NO: 351650 - RNA, 21 nt, Human
cugccaacagaccaccagaaa

SEQ ID NO: 351651 - RNA, 18 nt, Human
cugccgcccucccuacag

SEQ ID NO: 351652 - RNA, 20 nt, Human
gaacaaagaacuagaggaaa

SEQ ID NO: 351653 - RNA, 21 nt, Human
gacuccuguccccugccacuc

SEQ ID NO: 351654 - RNA, 20 nt, Human
gagcggcaggcugcgcgggu

SEQ ID NO: 351655 - RNA, 19 nt, Human
gagcuggaccuggggagag

SEQ ID NO: 351656 - RNA, 21 nt, Human
gagucccagcauucacuucuc

SEQ ID NO: 351657 - RNA, 18 nt, Human
gaguccgcucucuacugc

SEQ ID NO: 351658 - RNA, 21 nt, Human
gaugccaggugcuggcugugg

SEQ ID NO: 351659 - RNA, 23 nt, Human
gaugccaggugcuggcuguggug

SEQ ID NO: 351660 - RNA, 21 nt, Human
gcacaccccacgacuccgugg

SEQ ID NO: 351661 - RNA, 21 nt, Human
gcagaagucagagaagcagag

SEQ ID NO: 351662 - RNA, 18 nt, Human
gcaggggaggccagggcc

SEQ ID NO: 351663 - RNA, 24 nt, Human
gccagcucugcccaagacaccccu

SEQ ID NO: 351664 - RNA, 20 nt, Human
gccugccaacagaccaccag

SEQ ID NO: 351665 - RNA, 25 nt, Human
gcuggaaugcuggggagguggccug

SEQ ID NO: 351666 - RNA, 19 nt, Human
ggagguggccugguggcag

SEQ ID NO: 351667 - RNA, 24 nt, Human
ggcaggacgggcguggucugcagg

SEQ ID NO: 351668 - RNA, 21 nt, Human
ggccagggccugcaguucuuc

SEQ ID NO: 351669 - RNA, 27 nt, Human
ggccuuggauggaggcgcucagagcca

SEQ ID NO: 351670 - RNA, 20 nt, Human
ggcggagggggcgcauggcu

SEQ ID NO: 351671 - RNA, 23 nt, Human
gggccacaggagcuaacggagaa

SEQ ID NO: 351672 - RNA, 20 nt, Human
gggcggagggggcgcauggc

SEQ ID NO: 351673 - RNA, 18 nt, Human
gggcguggucugcaggag

SEQ ID NO: 351674 - RNA, 20 nt, Human
ggggcuggaaugcuggggag

SEQ ID NO: 351675 - RNA, 18 nt, Human
gguccgccggcuggaguc

SEQ ID NO: 351676 - RNA, 28 nt, Human
gguucuccuaguuuaaaaaaaaaaaaaa

SEQ ID NO: 351677 - RNA, 24 nt, Human
guggggccacaggagcuaacggag

SEQ ID NO: 351678 - RNA, 20 nt, Human
uaacuuaccucagaaguaac

SEQ ID NO: 351679 - RNA, 18 nt, Human
uaagccuacauuuuggcu

SEQ ID NO: 351680 - RNA, 21 nt, Human
uaaguagaguuuugccaaaag

SEQ ID NO: 351681 - RNA, 25 nt, Human
uaagucuccaggcagaagucagaga

SEQ ID NO: 351682 - RNA, 18 nt, Human
uacuguacagggaaaaac

SEQ ID NO: 351683 - RNA, 19 nt, Human
ucagcggccacccccccaa

SEQ ID NO: 351684 - RNA, 21 nt, Human
uccaacguggcagcggcccag

SEQ ID NO: 351685 - RNA, 23 nt, Human
uccgcugcucgaugcucucuugg

SEQ ID NO: 351686 - RNA, 19 nt, Human
uccugauuccagcccaggg

SEQ ID NO: 351687 - RNA, 21 nt, Human
ucgaugcucucuugggcgccu

SEQ ID NO: 351688 - RNA, 18 nt, Human
ucuccaggccccugccgc

SEQ ID NO: 351689 - RNA, 19 nt, Human
ucuccaggccccugccgcc

SEQ ID NO: 351690 - RNA, 26 nt, Human
ucuccuaguuuaaaaaaaaaaaaaaa

SEQ ID NO: 351691 - RNA, 24 nt, Human
ucuugggcgccugcccagcgcgcc

SEQ ID NO: 351692 - RNA, 21 nt, Human
ugagccccaagccccacccgc

SEQ ID NO: 351693 - RNA, 24 nt, Human
ugagccccaagccccacccgcagg

SEQ ID NO: 351694 - RNA, 22 nt, Human
ugauuccagcccagggcccagg

SEQ ID NO: 351695 - RNA, 20 nt, Human
ugcccggaccggcggcggga

SEQ ID NO: 351696 - RNA, 24 nt, Human
ugcccggaccggcggcgggagagc

SEQ ID NO: 351697 - RNA, 18 nt, Human
ugcccuaagucuccaggc

SEQ ID NO: 351698 - RNA, 23 nt, Human
ugcgcgggucgcggcugcgggcc

SEQ ID NO: 351699 - RNA, 22 nt, Human
ugcuggggagguggccuggugg

SEQ ID NO: 351700 - RNA, 21 nt, Human
uggaaagguccuaugcgagaa

SEQ ID NO: 351701 - RNA, 24 nt, Human
uggaaugcuggggagguggccugg

SEQ ID NO: 351702 - RNA, 24 nt, Human
uggauggaggcgcucagagccagc

SEQ ID NO: 351703 - RNA, 20 nt, Human
uggcccugagcgcauggaca

SEQ ID NO: 351704 - RNA, 23 nt, Human
uggcuuccagauuugguucuccu

SEQ ID NO: 351705 - RNA, 22 nt, Human
ugggggccuagugaguggcagg

SEQ ID NO: 351706 - RNA, 18 nt, Human
ugguggcaggggaggcca

SEQ ID NO: 351707 - RNA, 22 nt, Human
ugugcaaaaacaagucgauauc

SEQ ID NO: 351708 - RNA, 25 nt, Human
uuggagaaaccgagucagaauggug

SEQ ID NO: 351709 - RNA, 21 nt, Human
uuggauggaggcgcucagagc

SEQ ID NO: 351710 - RNA, 18 nt, Human
uuuuuuuuuacuuuauaa

SEQ ID NO: 351711 - RNA, 22 nt, Human
aaaacaaaaaacaaagaucuuc

SEQ ID NO: 351712 - RNA, 26 nt, Human
aaacccacgucauccuugagagcaga

SEQ ID NO: 351713 - RNA, 25 nt, Human
aaacugauuuuucuuuaaaccucua

SEQ ID NO: 351714 - RNA, 21 nt, Human
aacacuuagaaaucaaaccca

SEQ ID NO: 351715 - RNA, 19 nt, Human
aacaucuuuggguuugcug

SEQ ID NO: 351716 - RNA, 25 nt, Human
aagcaaguguaaaauggauagucug

SEQ ID NO: 351717 - RNA, 22 nt, Human
aaguguaaaauggauagucuga

SEQ ID NO: 351718 - RNA, 20 nt, Human
aauggcucuuuaaugaaaac

SEQ ID NO: 351719 - RNA, 22 nt, Human
aauguucucaaaaugaaauauu

SEQ ID NO: 351720 - RNA, 22 nt, Human
acaaguuacauagaaucagagg

SEQ ID NO: 351721 - RNA, 22 nt, Human
acacuaaauuaccauuaucuga

SEQ ID NO: 351722 - RNA, 22 nt, Human
accaacaucaggaaagccccau

SEQ ID NO: 351723 - RNA, 22 nt, Human
agaaaaaggaaauguuuaguac

SEQ ID NO: 351724 - RNA, 21 nt, Human
agggagggcagaggagaggaa

SEQ ID NO: 351725 - RNA, 26 nt, Human
aggggacaacagauaaauuaacaaag

SEQ ID NO: 351726 - RNA, 22 nt, Human
augcauuuuuaagaacaaaaac

SEQ ID NO: 351727 - RNA, 18 nt, Human
caaaacgaagccuccugc

SEQ ID NO: 351728 - RNA, 19 nt, Human
caaaacgaagccuccugcc

SEQ ID NO: 351729 - RNA, 18 nt, Human
cacaguacccucauaacu

SEQ ID NO: 351730 - RNA, 22 nt, Human
cacuuguugguuucugcacucc

SEQ ID NO: 351731 - RNA, 19 nt, Human
cagaacacugcagauguua

SEQ ID NO: 351732 - RNA, 18 nt, Human
cagugagacccucauuuu

SEQ ID NO: 351733 - RNA, 22 nt, Human
cauagaaucagaggcacuucaa

SEQ ID NO: 351734 - RNA, 22 nt, Human
ccaaagcuacagguaaugaaaa

SEQ ID NO: 351735 - RNA, 18 nt, Human
ccaugaacaucgaggguu

SEQ ID NO: 351736 - RNA, 20 nt, Human
ccccagggaccggcugcucc

SEQ ID NO: 351737 - RNA, 23 nt, Human
ccccagggaccggcugcucccag

SEQ ID NO: 351738 - RNA, 18 nt, Human
cccgccgcccgcagcugc

SEQ ID NO: 351739 - RNA, 21 nt, Human
cccucauaacuccaucuccuu

SEQ ID NO: 351740 - RNA, 18 nt, Human
cccuccuccucccgcgcc

SEQ ID NO: 351741 - RNA, 22 nt, Human
ccgcgccgcgccucccuccccg

SEQ ID NO: 351742 - RNA, 19 nt, Human
ccgcgccucccuccccggg

SEQ ID NO: 351743 - RNA, 19 nt, Human
ccggguccuccuccuucuc

SEQ ID NO: 351744 - RNA, 21 nt, Human
ccucccgcgccgcgccucccu

SEQ ID NO: 351745 - RNA, 24 nt, Human
ccuccgcggacuccuuucccgugc

SEQ ID NO: 351746 - RNA, 19 nt, Human
ccuccucccgcgccgcgcc

SEQ ID NO: 351747 - RNA, 18 nt, Human
ccuccuucuccuccucuu

SEQ ID NO: 351748 - RNA, 20 nt, Human
ccuccuucuccuccucuucu

SEQ ID NO: 351749 - RNA, 19 nt, Human
ccugcucccgccgcccgca

SEQ ID NO: 351750 - RNA, 24 nt, Human
cgcccgcagcugcgccccgggaac

SEQ ID NO: 351751 - RNA, 19 nt, Human
cggccguuagcaaagggga

SEQ ID NO: 351752 - RNA, 20 nt, Human
cggcgcagcccgcgcacacg

SEQ ID NO: 351753 - RNA, 20 nt, Human
cggcugcgccccuccuccuc

SEQ ID NO: 351754 - RNA, 23 nt, Human
cggcugcucccagccgcugcuug

SEQ ID NO: 351755 - RNA, 21 nt, Human
cgggggcgcucgcuuccuccu

SEQ ID NO: 351756 - RNA, 18 nt, Human
cuaaagaaauacaugaaa

SEQ ID NO: 351757 - RNA, 24 nt, Human
cucauuaacaccagucugcaacaa

SEQ ID NO: 351758 - RNA, 19 nt, Human
cuccgcggcugcgccccuc

SEQ ID NO: 351759 - RNA, 22 nt, Human
cuccucuucuuuuccucuggcu

SEQ ID NO: 351760 - RNA, 24 nt, Human
cuccucuucuuuuccucuggcucc

SEQ ID NO: 351761 - RNA, 19 nt, Human
cugcgccugcucccgccgc

SEQ ID NO: 351762 - RNA, 22 nt, Human
cuggcagccuuccaauaucucu

SEQ ID NO: 351763 - RNA, 21 nt, Human
cuguugcaaaucugcccaaag

SEQ ID NO: 351764 - RNA, 21 nt, Human
cuuacaucaaauccucccaaa

SEQ ID NO: 351765 - RNA, 22 nt, Human
cuuacaucaaauccucccaaaa

SEQ ID NO: 351766 - RNA, 19 nt, Human
cuucuugcucugcuguggu

SEQ ID NO: 351767 - RNA, 21 nt, Human
gaaaaagacaaucauuuugua

SEQ ID NO: 351768 - RNA, 21 nt, Human
gaaauccccuggcagccuucc

SEQ ID NO: 351769 - RNA, 18 nt, Human
gaccggcugcucccagcc

SEQ ID NO: 351770 - RNA, 28 nt, Human
gcacaauuccaaagguaaagggaacgcc

SEQ ID NO: 351771 - RNA, 28 nt, Human
gcggacuccuuucccgugccgagguucu

SEQ ID NO: 351772 - RNA, 20 nt, Human
gcuuucaucuuugagucaua

SEQ ID NO: 351773 - RNA, 21 nt, Human
gggagggcagaggagaggaag

SEQ ID NO: 351774 - RNA, 26 nt, Human
gggcagagcggcgggagcgcgcgauu

SEQ ID NO: 351775 - RNA, 18 nt, Human
gguaaaauagaaaaagga

SEQ ID NO: 351776 - RNA, 19 nt, Human
gguaucuggagagcagcgc

SEQ ID NO: 351777 - RNA, 19 nt, Human
guggcaauuccagggaaug

SEQ ID NO: 351778 - RNA, 21 nt, Human
uaaaauacuguuaacaucuuu

SEQ ID NO: 351779 - RNA, 24 nt, Human
uaaaauggauagucugacacuuaa

SEQ ID NO: 351780 - RNA, 25 nt, Human
uaaagcaaguguaaaauggauaguc

SEQ ID NO: 351781 - RNA, 18 nt, Human
uaaaguaaacacuguucc

SEQ ID NO: 351782 - RNA, 23 nt, Human
uaacuuacaucaaauccucccaa

SEQ ID NO: 351783 - RNA, 20 nt, Human
uaagacuacaaaaguuacca

SEQ ID NO: 351784 - RNA, 18 nt, Human
uaagggcacaagaaggga

SEQ ID NO: 351785 - RNA, 18 nt, Human
uacagcagugacaaaaua

SEQ ID NO: 351786 - RNA, 22 nt, Human
uacauagaaucagaggcacuuc

SEQ ID NO: 351787 - RNA, 20 nt, Human
uacccucauaacuccaucuc

SEQ ID NO: 351788 - RNA, 18 nt, Human
uagauaccaacaucagga

SEQ ID NO: 351789 - RNA, 24 nt, Human
uagauaccaacaucaggaaagccc

SEQ ID NO: 351790 - RNA, 23 nt, Human
ucaaauccucccaaaagaagauc

SEQ ID NO: 351791 - RNA, 24 nt, Human
ucacucuuuccagccacuucaauc

SEQ ID NO: 351792 - RNA, 18 nt, Human
ucagaggcacuucaaagg

SEQ ID NO: 351793 - RNA, 20 nt, Human
ucaguaguuuuuauguuccc

SEQ ID NO: 351794 - RNA, 22 nt, Human
ucauaggaaaaagacaaucauu

SEQ ID NO: 351795 - RNA, 23 nt, Human
uccaaagacaaauugcaccauga

SEQ ID NO: 351796 - RNA, 21 nt, Human
uccaauaucucuaccuagaca

SEQ ID NO: 351797 - RNA, 21 nt, Human
uccccaggcaucacucuuucc

SEQ ID NO: 351798 - RNA, 22 nt, Human
uccccaggcaucacucuuucca

SEQ ID NO: 351799 - RNA, 18 nt, Human
uccccagggaccggcugc

SEQ ID NO: 351800 - RNA, 23 nt, Human
uccccagggaccggcugcuccca

SEQ ID NO: 351801 - RNA, 18 nt, Human
uccccggguccuccuccu

SEQ ID NO: 351802 - RNA, 19 nt, Human
ucccgccgcccgcagcugc

SEQ ID NO: 351803 - RNA, 20 nt, Human
ucccugccuacccuccuucc

SEQ ID NO: 351804 - RNA, 20 nt, Human
uccgcgcggcuggagcuccg

SEQ ID NO: 351805 - RNA, 18 nt, Human
uccuaaagcagugagacc

SEQ ID NO: 351806 - RNA, 18 nt, Human
uccuccuucuccuccucu

SEQ ID NO: 351807 - RNA, 22 nt, Human
uccucuggcucccucccuccug

SEQ ID NO: 351808 - RNA, 23 nt, Human
uccugcgccugcucccgccgccc

SEQ ID NO: 351809 - RNA, 21 nt, Human
ucgggggcgcucgcuuccucc

SEQ ID NO: 351810 - RNA, 21 nt, Human
ucucuaccuagacacacacag

SEQ ID NO: 351811 - RNA, 21 nt, Human
ucuguaauugagggacacagc

SEQ ID NO: 351812 - RNA, 21 nt, Human
ugaaaaguucagugaucucau

SEQ ID NO: 351813 - RNA, 24 nt, Human
ugaaauguuuuaaauacaauggga

SEQ ID NO: 351814 - RNA, 22 nt, Human
ugcaaccagggcaaaacgaagc

SEQ ID NO: 351815 - RNA, 19 nt, Human
uggguuugcugaggcuugu

SEQ ID NO: 351816 - RNA, 20 nt, Human
ugucuauucauaagacuaca

SEQ ID NO: 351817 - RNA, 22 nt, Human
uuaaaccaauuccaugaacauc

SEQ ID NO: 351818 - RNA, 23 nt, Human
uuccaaagacaaauugcaccaug

SEQ ID NO: 351819 - RNA, 18 nt, Human
uuccccaggcaucacucu

SEQ ID NO: 351820 - RNA, 24 nt, Human
uugcaaaucugcccaaagcuacag

SEQ ID NO: 351821 - RNA, 20 nt, Human
uugcuuuacagcagugacaa

SEQ ID NO: 351822 - RNA, 20 nt, Human
uuguucuaaagaaauacaug

SEQ ID NO: 351823 - RNA, 18 nt, Human
uuuaaaccaauuccauga

SEQ ID NO: 351824 - RNA, 23 nt, Human
uuuccuggcacggauauucccag

SEQ ID NO: 351825 - RNA, 27 nt, Human
uuuugcuccuccgcggacuccuuuccc

SEQ ID NO: 351826 - RNA, 21 nt, Human
aaaaaaaacuauguuucggca

SEQ ID NO: 351827 - RNA, 20 nt, Human
aaaaaaacgaacaaacacua

SEQ ID NO: 351828 - RNA, 24 nt, Human
aaaacaaaaacaaaaaccauuaaa

SEQ ID NO: 351829 - RNA, 27 nt, Human
aaaauagauuuacaaauauucuauaaa

SEQ ID NO: 351830 - RNA, 21 nt, Human
aaacaaaaacaaaaacaaaaa

SEQ ID NO: 351831 - RNA, 23 nt, Human
aaacaaaaacaaaaaccauuaaa

SEQ ID NO: 351832 - RNA, 26 nt, Human
aaacaaaaacaaaaaccauuaaauac

SEQ ID NO: 351833 - RNA, 19 nt, Human
aaacaaacaaaaacaaaaa

SEQ ID NO: 351834 - RNA, 21 nt, Human
aaacaaacaaaaacaaaaaca

SEQ ID NO: 351835 - RNA, 19 nt, Human
aaacagaaggcagaaaggg

SEQ ID NO: 351836 - RNA, 19 nt, Human
aaacuggaaacaccacacu

SEQ ID NO: 351837 - RNA, 21 nt, Human
aaauucacucacucaaccacc

SEQ ID NO: 351838 - RNA, 27 nt, Human
aacaaaaacaaaaacaaaaaccauuaa

SEQ ID NO: 351839 - RNA, 25 nt, Human
aaccaaagaacaccagcuggguccc

SEQ ID NO: 351840 - RNA, 23 nt, Human
aagaaacaaacaaaaacaaaaac

SEQ ID NO: 351841 - RNA, 19 nt, Human
aagaacacagacacaaaua

SEQ ID NO: 351842 - RNA, 24 nt, Human
aagagaacaaagaaagaagagggg

SEQ ID NO: 351843 - RNA, 19 nt, Human
aagaggaagcagcuucaga

SEQ ID NO: 351844 - RNA, 24 nt, Human
aagaggacccagccagcugggacc

SEQ ID NO: 351845 - RNA, 19 nt, Human
aagcaaaccaaagaacacc

SEQ ID NO: 351846 - RNA, 22 nt, Human
aagcagcuucagaaagggccaa

SEQ ID NO: 351847 - RNA, 19 nt, Human
aaggguagaaccauccacc

SEQ ID NO: 351848 - RNA, 23 nt, Human
acaaacaaaaacaaaaacaaaaa

SEQ ID NO: 351849 - RNA, 24 nt, Human
acaaacaaaaacaaaaacaaaaac

SEQ ID NO: 351850 - RNA, 24 nt, Human
acaaaggaaugaacaguuaaaaaa

SEQ ID NO: 351851 - RNA, 21 nt, Human
acacaacauccguuagccccc

SEQ ID NO: 351852 - RNA, 23 nt, Human
acacagacacaaauaucccacca

SEQ ID NO: 351853 - RNA, 20 nt, Human
acagggcaagagaaaaaggc

SEQ ID NO: 351854 - RNA, 20 nt, Human
acaugaaaauucacucacuc

SEQ ID NO: 351855 - RNA, 20 nt, Human
accaaggaagaauaauaaua

SEQ ID NO: 351856 - RNA, 23 nt, Human
acccagcaacaucaaacuggaaa

SEQ ID NO: 351857 - RNA, 21 nt, Human
acuauguuucggcaaaagcua

SEQ ID NO: 351858 - RNA, 21 nt, Human
acucaaccacccagcaacauc

SEQ ID NO: 351859 - RNA, 21 nt, Human
acucucagcucuuuuccccau

SEQ ID NO: 351860 - RNA, 24 nt, Human
agaaaaaggcaaaaacccacccag

SEQ ID NO: 351861 - RNA, 22 nt, Human
agaaacaaacaaaaacaaaaac

SEQ ID NO: 351862 - RNA, 24 nt, Human
agaaacaaacaaaaacaaaaacaa

SEQ ID NO: 351863 - RNA, 19 nt, Human
agaagaggggaagggaggc

SEQ ID NO: 351864 - RNA, 18 nt, Human
agaauggccccagguaua

SEQ ID NO: 351865 - RNA, 18 nt, Human
agacaaugucucuucuga

SEQ ID NO: 351866 - RNA, 19 nt, Human
agagauauacacucugcac

SEQ ID NO: 351867 - RNA, 18 nt, Human
agauauacacucugcaca

SEQ ID NO: 351868 - RNA, 22 nt, Human
agccuagaauggccccagguau

SEQ ID NO: 351869 - RNA, 19 nt, Human
agcuucagaaagggccaag

SEQ ID NO: 351870 - RNA, 23 nt, Human
aggaaggccacugggggaggacc

SEQ ID NO: 351871 - RNA, 22 nt, Human
aggaggagacacgaccugccca

SEQ ID NO: 351872 - RNA, 21 nt, Human
aggaggugcucacuccaacac

SEQ ID NO: 351873 - RNA, 19 nt, Human
aggcaaaaacccacccagc

SEQ ID NO: 351874 - RNA, 19 nt, Human
aggccaugaggagcggggu

SEQ ID NO: 351875 - RNA, 25 nt, Human
agggaggaaggccacugggggagga

SEQ ID NO: 351876 - RNA, 26 nt, Human
agggaggaaggccacugggggaggac

SEQ ID NO: 351877 - RNA, 21 nt, Human
agggcaacugaggcccaaagc

SEQ ID NO: 351878 - RNA, 22 nt, Human
agguauauaccacagagauucc

SEQ ID NO: 351879 - RNA, 22 nt, Human
aguaacagacaacagugugaga

SEQ ID NO: 351880 - RNA, 20 nt, Human
aguuccuucccccauuuccu

SEQ ID NO: 351881 - RNA, 24 nt, Human
aucagcccucccccauuccccccc

SEQ ID NO: 351882 - RNA, 21 nt, Human
caaaaacaaaaacaaaaacca

SEQ ID NO: 351883 - RNA, 18 nt, Human
caaaauccccuggcuucc

SEQ ID NO: 351884 - RNA, 23 nt, Human
caaacaaaaacaaaaacaaaaac

SEQ ID NO: 351885 - RNA, 24 nt, Human
caaacaaaaacaaaaacaaaaacc

SEQ ID NO: 351886 - RNA, 28 nt, Human
caaacaaaaacaaaaacaaaaaccauua

SEQ ID NO: 351887 - RNA, 19 nt, Human
caacaucaaacuggaaaca

SEQ ID NO: 351888 - RNA, 20 nt, Human
caacaucaaacuggaaacac

SEQ ID NO: 351889 - RNA, 22 nt, Human
caacugaggcccaaagcucaag

SEQ ID NO: 351890 - RNA, 26 nt, Human
caagaaacaaacaaaaacaaaaacaa

SEQ ID NO: 351891 - RNA, 23 nt, Human
caagaagaaccuggcagaacagu

SEQ ID NO: 351892 - RNA, 21 nt, Human
caagagaaaaaggcaaaaacc

SEQ ID NO: 351893 - RNA, 25 nt, Human
caagagaaaaaggcaaaaacccacc

SEQ ID NO: 351894 - RNA, 24 nt, Human
caaguacccauuuacagaaacauc

SEQ ID NO: 351895 - RNA, 21 nt, Human
cacaaauaucccaccaucccc

SEQ ID NO: 351896 - RNA, 28 nt, Human
cacagcccuagagccugaagaaagcaaa

SEQ ID NO: 351897 - RNA, 19 nt, Human
caccacacuauuuccugaa

SEQ ID NO: 351898 - RNA, 27 nt, Human
cacccagcaacaucaaacuggaaacac

SEQ ID NO: 351899 - RNA, 22 nt, Human
caccucggcaccuccacacucu

SEQ ID NO: 351900 - RNA, 21 nt, Human
cagaaacaucucaaggugcag

SEQ ID NO: 351901 - RNA, 24 nt, Human
cagaaggcagaaaggguagaacca

SEQ ID NO: 351902 - RNA, 20 nt, Human
cagacacaaauaucccacca

SEQ ID NO: 351903 - RNA, 21 nt, Human
cagcucuuuuccccauccucc

SEQ ID NO: 351904 - RNA, 22 nt, Human
cagcucuuuuccccauccuccc

SEQ ID NO: 351905 - RNA, 21 nt, Human
cagcuucagaaagggccaagg

SEQ ID NO: 351906 - RNA, 21 nt, Human
caguagccaugaacuacauac

SEQ ID NO: 351907 - RNA, 18 nt, Human
cagugugagaggugccua

SEQ ID NO: 351908 - RNA, 21 nt, Human
caucaaacuggaaacaccaca

SEQ ID NO: 351909 - RNA, 23 nt, Human
ccaagccagugcccacaagcaag

SEQ ID NO: 351910 - RNA, 18 nt, Human
ccaccaggccuccccucu

SEQ ID NO: 351911 - RNA, 20 nt, Human
ccacugggggaggaccucca

SEQ ID NO: 351912 - RNA, 19 nt, Human
ccacuggggucaggaggag

SEQ ID NO: 351913 - RNA, 18 nt, Human
ccagggagacaagggucg

SEQ ID NO: 351914 - RNA, 20 nt, Human
cccaaagcucaagaagaacc

SEQ ID NO: 351915 - RNA, 23 nt, Human
cccaaggggaagggcacuggggg

SEQ ID NO: 351916 - RNA, 22 nt, Human
cccagccagcugggacccuggg

SEQ ID NO: 351917 - RNA, 21 nt, Human
cccagguauauaccacagaga

SEQ ID NO: 351918 - RNA, 21 nt, Human
ccccauuccccccccccuacc

SEQ ID NO: 351919 - RNA, 21 nt, Human
cccccaaauaaaaaagguuga

SEQ ID NO: 351920 - RNA, 25 nt, Human
cccccauuccccccccccuacccag

SEQ ID NO: 351921 - RNA, 19 nt, Human
ccccccccuacccagggag

SEQ ID NO: 351922 - RNA, 22 nt, Human
cccccuggcuucagaggagcuc

SEQ ID NO: 351923 - RNA, 20 nt, Human
ccccuggcuucccuccccgc

SEQ ID NO: 351924 - RNA, 19 nt, Human
cccuacccuaauguccacc

SEQ ID NO: 351925 - RNA, 23 nt, Human
cccuacccuaauguccacccuuc

SEQ ID NO: 351926 - RNA, 27 nt, Human
cccuacccuaauguccacccuucaaaa

SEQ ID NO: 351927 - RNA, 19 nt, Human
ccgcuaaaguccaagccag

SEQ ID NO: 351928 - RNA, 25 nt, Human
ccggcugugaaaggaagggaggaag

SEQ ID NO: 351929 - RNA, 25 nt, Human
cgaacaaacacuaaaaauagauuua

SEQ ID NO: 351930 - RNA, 18 nt, Human
cuaaagcuauaaauagua

SEQ ID NO: 351931 - RNA, 24 nt, Human
cuaauguccacccuucaaaauccc

SEQ ID NO: 351932 - RNA, 22 nt, Human
cuaguuccuucccccauuuccu

SEQ ID NO: 351933 - RNA, 22 nt, Human
cuccacacaacauccguuagcc

SEQ ID NO: 351934 - RNA, 19 nt, Human
cuccacacucuugcccagg

SEQ ID NO: 351935 - RNA, 19 nt, Human
cucucauuuucaagaaaca

SEQ ID NO: 351936 - RNA, 23 nt, Human
cugccagggcaacugaggcccaa

SEQ ID NO: 351937 - RNA, 20 nt, Human
cugggggcagaagaggaccc

SEQ ID NO: 351938 - RNA, 26 nt, Human
cuucaaaauccccuggcuucccuccc

SEQ ID NO: 351939 - RNA, 21 nt, Human
cuucaaagguaaucagagcug

SEQ ID NO: 351940 - RNA, 20 nt, Human
gaacacagacacaaauaucc

SEQ ID NO: 351941 - RNA, 18 nt, Human
gaaccuggcagaacagua

SEQ ID NO: 351942 - RNA, 19 nt, Human
gaagaaagcaaaccaaaga

SEQ ID NO: 351943 - RNA, 25 nt, Human
gaccucacccuacccuaauguccac

SEQ ID NO: 351944 - RNA, 22 nt, Human
gagaaugaagacaccucggcac

SEQ ID NO: 351945 - RNA, 21 nt, Human
gaggagacacgaccugcccag

SEQ ID NO: 351946 - RNA, 23 nt, Human
gcacagcccuagagccugaagaa

SEQ ID NO: 351947 - RNA, 18 nt, Human
gccagcugggacccuggg

SEQ ID NO: 351948 - RNA, 21 nt, Human
gcccaaagcucaagaagaacc

SEQ ID NO: 351949 - RNA, 22 nt, Human
gcccaaggggaagggcacuggg

SEQ ID NO: 351950 - RNA, 18 nt, Human
gccucaucagcccucccc

SEQ ID NO: 351951 - RNA, 19 nt, Human
gccucaucagcccuccccc

SEQ ID NO: 351952 - RNA, 22 nt, Human
gccuucagaaaggccaaguuga

SEQ ID NO: 351953 - RNA, 18 nt, Human
ggagacaagggucguccc

SEQ ID NO: 351954 - RNA, 25 nt, Human
ggcaccaggaacagggcaagagaaa

SEQ ID NO: 351955 - RNA, 18 nt, Human
ggccacuggugcagcaag

SEQ ID NO: 351956 - RNA, 22 nt, Human
gggaagggcacugggggcagaa

SEQ ID NO: 351957 - RNA, 24 nt, Human
ggggaagggcacugggggcagaag

SEQ ID NO: 351958 - RNA, 21 nt, Human
gucccagacaacaggccccag

SEQ ID NO: 351959 - RNA, 21 nt, Human
uaaaaaaaaaacuggggaagg

SEQ ID NO: 351960 - RNA, 26 nt, Human
uaaauaguaaaaaaaaaaaaaaaaaa

SEQ ID NO: 351961 - RNA, 28 nt, Human
uaagaacacagacacaaauaucccacca

SEQ ID NO: 351962 - RNA, 28 nt, Human
uaagaacacagacacaaauuggagaccc

SEQ ID NO: 351963 - RNA, 22 nt, Human
uaauauauuauaagaacacaga

SEQ ID NO: 351964 - RNA, 20 nt, Human
uaccagguuuuauuaucuuu

SEQ ID NO: 351965 - RNA, 28 nt, Human
uauaaaaaaaaaacuggggaagggguuu

SEQ ID NO: 351966 - RNA, 18 nt, Human
uauaaauaguaaaaaaaa

SEQ ID NO: 351967 - RNA, 28 nt, Human
uaucaaaaaaaaucaguaacagacaaca

SEQ ID NO: 351968 - RNA, 23 nt, Human
ucaaaaaaaaucaguaacagaca

SEQ ID NO: 351969 - RNA, 18 nt, Human
ucaaacuggaaacaccac

SEQ ID NO: 351970 - RNA, 23 nt, Human
ucaaccacccagcaacaucaaac

SEQ ID NO: 351971 - RNA, 19 nt, Human
ucagaaggcaccaggaaca

SEQ ID NO: 351972 - RNA, 22 nt, Human
ucagcccucccccauucccccc

SEQ ID NO: 351973 - RNA, 18 nt, Human
ucaguacaguagccauga

SEQ ID NO: 351974 - RNA, 22 nt, Human
uccaaaagucacuugaaagagc

SEQ ID NO: 351975 - RNA, 24 nt, Human
uccaccucaacuauuccagcccca

SEQ ID NO: 351976 - RNA, 18 nt, Human
uccagccccaucagaagg

SEQ ID NO: 351977 - RNA, 21 nt, Human
uccccucucaggagagggagg

SEQ ID NO: 351978 - RNA, 21 nt, Human
uccccuggcuucccuccccga

SEQ ID NO: 351979 - RNA, 22 nt, Human
ugagaggugccuacagaggagg

SEQ ID NO: 351980 - RNA, 26 nt, Human
ugcaacugaggaaggaauuuuuaauc

SEQ ID NO: 351981 - RNA, 22 nt, Human
ugcccaggcuaagccaccaggc

SEQ ID NO: 351982 - RNA, 19 nt, Human
uggauagcacagcccuaga

SEQ ID NO: 351983 - RNA, 21 nt, Human
uggcagaacaguagaagacaa

SEQ ID NO: 351984 - RNA, 22 nt, Human
uggcagagagaccggcugugaa

SEQ ID NO: 351985 - RNA, 20 nt, Human
uggggucaggaggagacacg

SEQ ID NO: 351986 - RNA, 23 nt, Human
uggggucaggaggagacacgacc

SEQ ID NO: 351987 - RNA, 23 nt, Human
ugggucccaaacagaaggcagaa

SEQ ID NO: 351988 - RNA, 19 nt, Human
uggguugcaguggugacgg

SEQ ID NO: 351989 - RNA, 23 nt, Human
uguccacccuucaaaauccccug

SEQ ID NO: 351990 - RNA, 18 nt, Human
uuccccauccuccccccc

SEQ ID NO: 351991 - RNA, 21 nt, Human
uuccccauccucccccccaaa

SEQ ID NO: 351992 - RNA, 23 nt, Human
uuccuggcagagagaccggcugu

SEQ ID NO: 351993 - RNA, 23 nt, Human
uugaccucacccuacccuaaugu

SEQ ID NO: 351994 - RNA, 24 nt, Human
uuuccccauccucccccccaaaua

SEQ ID NO: 351995 - RNA, 20 nt, Human
uuuuccccauccuccccccc

SEQ ID NO: 351996 - RNA, 18 nt, Human
aacauugugcguuaacag

SEQ ID NO: 351997 - RNA, 20 nt, Human
acacagccacuauuuucugu

SEQ ID NO: 351998 - RNA, 18 nt, Human
agagagaaaauaggggga

SEQ ID NO: 351999 - RNA, 20 nt, Human
agcuaagagggauguuuccc

SEQ ID NO: 352000 - RNA, 19 nt, Human
auaaaaagcaucugccccu

SEQ ID NO: 352001 - RNA, 18 nt, Human
aucccaaggugaggcagc

SEQ ID NO: 352002 - RNA, 22 nt, Human
cauugugcguuaacaguggcuc

SEQ ID NO: 352003 - RNA, 18 nt, Human
ccaaggaacuuguggcag

SEQ ID NO: 352004 - RNA, 21 nt, Human
ccaaggugaggcagcaacaga

SEQ ID NO: 352005 - RNA, 25 nt, Human
cggagccccaaaucuucgaagaaaa

SEQ ID NO: 352006 - RNA, 19 nt, Human
cugaagcuuccaaacacag

SEQ ID NO: 352007 - RNA, 19 nt, Human
cugcccaaggaacuugugg

SEQ ID NO: 352008 - RNA, 21 nt, Human
gaaagaacugacccacgcaag

SEQ ID NO: 352009 - RNA, 22 nt, Human
gugaggcagcaacagaugucug

SEQ ID NO: 352010 - RNA, 22 nt, Human
uaacuguaucgcggagccccaa

SEQ ID NO: 352011 - RNA, 19 nt, Human
ucaauggugacauggccac

SEQ ID NO: 352012 - RNA, 22 nt, Human
ucagaaagaacugacccacgca

SEQ ID NO: 352013 - RNA, 20 nt, Human
uccaugaugccaagcuccug

SEQ ID NO: 352014 - RNA, 21 nt, Human
ucccucaguuuguuuuaucag

SEQ ID NO: 352015 - RNA, 21 nt, Human
uccugaagaguaaaaguuucc

SEQ ID NO: 352016 - RNA, 20 nt, Human
ugacauggccacugcccaag

SEQ ID NO: 352017 - RNA, 26 nt, Human
ugccaagcuccugaagaguaaaaguu

SEQ ID NO: 352018 - RNA, 18 nt, Human
ugcccaaggaacuugugg

SEQ ID NO: 352019 - RNA, 18 nt, Human
uggagagagaaaauaggg

SEQ ID NO: 352020 - RNA, 25 nt, Human
uggagagagaaaauagggggaaaau

SEQ ID NO: 352021 - RNA, 27 nt, Human
uuuucuguuguauaucuucaucucaau

SEQ ID NO: 352022 - RNA, 23 nt, Human
acacaugcaugagcuauuauaca

SEQ ID NO: 352023 - RNA, 21 nt, Human
agagcugugcccaguuuuauc

SEQ ID NO: 352024 - RNA, 22 nt, Human
agccacuaggugccaaucuccc

SEQ ID NO: 352025 - RNA, 21 nt, Human
caauguacuccuucuucccca

SEQ ID NO: 352026 - RNA, 24 nt, Human
cacaagaaugaagcaagggacaaa

SEQ ID NO: 352027 - RNA, 19 nt, Human
cacuaggugccaaucuccc

SEQ ID NO: 352028 - RNA, 21 nt, Human
cacuggguuccuggcaagcuc

SEQ ID NO: 352029 - RNA, 25 nt, Human
ccacuggguuccuggcaagcuccca

SEQ ID NO: 352030 - RNA, 24 nt, Human
ccagagugcagaagcguaugaaga

SEQ ID NO: 352031 - RNA, 22 nt, Human
cucccuggccacuggguuccug

SEQ ID NO: 352032 - RNA, 23 nt, Human
cucccuggccacuggguuccugg

SEQ ID NO: 352033 - RNA, 21 nt, Human
cugcuguugccgccgcgcagu

SEQ ID NO: 352034 - RNA, 27 nt, Human
gaagacaguuaugacauggacacaugc

SEQ ID NO: 352035 - RNA, 18 nt, Human
ggguuccuggcaagcucc

SEQ ID NO: 352036 - RNA, 21 nt, Human
uaugacauggacacaugcaug

SEQ ID NO: 352037 - RNA, 26 nt, Human
ucucacaagaaugaagcaagggacaa

SEQ ID NO: 352038 - RNA, 19 nt, Human
ucugcuguugccgccgcgc

SEQ ID NO: 352039 - RNA, 22 nt, Human
ucugcuguugccgccgcgcagu

SEQ ID NO: 352040 - RNA, 24 nt, Human
ugauucugucaucaccacaucuug

SEQ ID NO: 352041 - RNA, 26 nt, Human
uggacacaugcaugagcuauuauaca

SEQ ID NO: 352042 - RNA, 21 nt, Human
cccuuaaccccgaggucgcuc

SEQ ID NO: 352043 - RNA, 25 nt, Human
ccugacgucagccccaccccuuaac

SEQ ID NO: 352044 - RNA, 18 nt, Human
cgaggucgcucuccgccg

SEQ ID NO: 352045 - RNA, 18 nt, Human
cgcucuccgccggugucc

SEQ ID NO: 352046 - RNA, 19 nt, Human
cgcucuccgccgguguccc

SEQ ID NO: 352047 - RNA, 19 nt, Human
ucgcucuccgccggugucc

SEQ ID NO: 352048 - RNA, 21 nt, Human
uggaaaaccaagaucuuuaaa

SEQ ID NO: 352049 - RNA, 22 nt, Human
uggaaaaccaagaucuuuaaag

SEQ ID NO: 352050 - RNA, 27 nt, Human
uggcuccugacgucagccccaccccuu

SEQ ID NO: 352051 - RNA, 21 nt, Human
aaaagcagcugcuccaagaac

SEQ ID NO: 352052 - RNA, 23 nt, Human
aaaauacaaaaggaucuaaacaa

SEQ ID NO: 352053 - RNA, 23 nt, Human
aaacaaggggaaaacuagacccu

SEQ ID NO: 352054 - RNA, 23 nt, Human
aaagccucaccaacccacccccc

SEQ ID NO: 352055 - RNA, 18 nt, Human
aacaaauaaggagaacuu

SEQ ID NO: 352056 - RNA, 21 nt, Human
aacccggcccauccccagggc

SEQ ID NO: 352057 - RNA, 23 nt, Human
aacccggcccauccccagggcag

SEQ ID NO: 352058 - RNA, 19 nt, Human
aacugcuucuaggccgaga

SEQ ID NO: 352059 - RNA, 22 nt, Human
aagaaaaagaaauaaccauuaa

SEQ ID NO: 352060 - RNA, 20 nt, Human
aagccagcaacccacaggca

SEQ ID NO: 352061 - RNA, 25 nt, Human
aagcccaauauggagagagaauaac

SEQ ID NO: 352062 - RNA, 21 nt, Human
aagccucaccaacccaccccc

SEQ ID NO: 352063 - RNA, 24 nt, Human
aagccucaccaacccaccccccaa

SEQ ID NO: 352064 - RNA, 21 nt, Human
acaggcaguggcacccaaagc

SEQ ID NO: 352065 - RNA, 24 nt, Human
acaggcaguggcacccaaagccuc

SEQ ID NO: 352066 - RNA, 27 nt, Human
acccaaagccucaccaacccacccccc

SEQ ID NO: 352067 - RNA, 19 nt, Human
acccaccccccaacccggc

SEQ ID NO: 352068 - RNA, 22 nt, Human
agaaacaaggggaaaacuagac

SEQ ID NO: 352069 - RNA, 23 nt, Human
agauaagaaugacaaacagaaag

SEQ ID NO: 352070 - RNA, 18 nt, Human
aggagccaaaagcugacc

SEQ ID NO: 352071 - RNA, 20 nt, Human
auuuucuccucaaaagcagc

SEQ ID NO: 352072 - RNA, 20 nt, Human
caagaaaaagaaauaaccau

SEQ ID NO: 352073 - RNA, 27 nt, Human
caccaacccaccccccaacccggccca

SEQ ID NO: 352074 - RNA, 18 nt, Human
caccccccaacccggccc

SEQ ID NO: 352075 - RNA, 23 nt, Human
cagaaagaugggugaauguaaua

SEQ ID NO: 352076 - RNA, 23 nt, Human
cagaagccacagagcuggcauug

SEQ ID NO: 352077 - RNA, 24 nt, Human
cagcaacccacaggcaguggcacc

SEQ ID NO: 352078 - RNA, 18 nt, Human
caguuucagaaaaaaagg

SEQ ID NO: 352079 - RNA, 25 nt, Human
ccaaaagcugacccucagcacaaau

SEQ ID NO: 352080 - RNA, 18 nt, Human
ccaaagccucaccaaccc

SEQ ID NO: 352081 - RNA, 24 nt, Human
ccaacccaccccccaacccggccc

SEQ ID NO: 352082 - RNA, 24 nt, Human
ccaggcuggagauaagaaugacaa

SEQ ID NO: 352083 - RNA, 24 nt, Human
cccaaagccucaccaacccacccc

SEQ ID NO: 352084 - RNA, 25 nt, Human
cccaaagccucaccaacccaccccc

SEQ ID NO: 352085 - RNA, 24 nt, Human
cccacaggcaguggcacccaaagc

SEQ ID NO: 352086 - RNA, 24 nt, Human
ccccccaacccggcccaguccgag

SEQ ID NO: 352087 - RNA, 22 nt, Human
cccucagcacaaaucaaagccc

SEQ ID NO: 352088 - RNA, 24 nt, Human
cccucagcacaaaucaaagcccaa

SEQ ID NO: 352089 - RNA, 19 nt, Human
ccucaaaagcagcugcucc

SEQ ID NO: 352090 - RNA, 19 nt, Human
ccucaccaacccacccccc

SEQ ID NO: 352091 - RNA, 23 nt, Human
ccucaucuuuagaaacaagggga

SEQ ID NO: 352092 - RNA, 25 nt, Human
ccucuagcugggacagaccgggguc

SEQ ID NO: 352093 - RNA, 25 nt, Human
cgagaguaggcaagcugugggcaaa

SEQ ID NO: 352094 - RNA, 21 nt, Human
cuaauuccccuccacccccac

SEQ ID NO: 352095 - RNA, 19 nt, Human
cuacugcuccaaggagauc

SEQ ID NO: 352096 - RNA, 23 nt, Human
cucaccaacccaccccccaaccc

SEQ ID NO: 352097 - RNA, 19 nt, Human
cuucuaggccgagaguagg

SEQ ID NO: 352098 - RNA, 23 nt, Human
gcaagcugugggcaaaaaagggg

SEQ ID NO: 352099 - RNA, 21 nt, Human
gcacccaaagccucaccaacc

SEQ ID NO: 352100 - RNA, 23 nt, Human
uaauuccccuccacccccaccuc

SEQ ID NO: 352101 - RNA, 24 nt, Human
uacaaaaggaucuaaacaaauaag

SEQ ID NO: 352102 - RNA, 21 nt, Human
uaccagguacucuacugcucc

SEQ ID NO: 352103 - RNA, 23 nt, Human
uacucuacugcuccaaggagauc

SEQ ID NO: 352104 - RNA, 24 nt, Human
uagcugggacagacuaauuccccu

SEQ ID NO: 352105 - RNA, 20 nt, Human
ucagaaaaaaaggguacauu

SEQ ID NO: 352106 - RNA, 21 nt, Human
ucagcacaaaucaaagcccaa

SEQ ID NO: 352107 - RNA, 20 nt, Human
uccaagaaaaagaaauaacc

SEQ ID NO: 352108 - RNA, 21 nt, Human
uccaaggagaucugaaaauac

SEQ ID NO: 352109 - RNA, 18 nt, Human
ugaugcugggagccuccu

SEQ ID NO: 352110 - RNA, 23 nt, Human
ugugggcaaaaaaggggaguuuu

SEQ ID NO: 352111 - RNA, 21 nt, Human
uguguaggaagaugaugcugg

SEQ ID NO: 352112 - RNA, 21 nt, Human
uguuaauggccugggcucuca

SEQ ID NO: 352113 - RNA, 21 nt, Human
uuaagccagcaacccacaggc

SEQ ID NO: 352114 - RNA, 24 nt, Human
uuucccaggcuggagauaagaaug

SEQ ID NO: 352115 - RNA, 24 nt, Human
uuugcagccaccucaucuuuagaa

SEQ ID NO: 352116 - RNA, 22 nt, Human
aaagaggcauacaucaauucuu

SEQ ID NO: 352117 - RNA, 21 nt, Human
acaaagcagaggcaaagaggc

SEQ ID NO: 352118 - RNA, 24 nt, Human
caaggcaaauauggaaguuugauc

SEQ ID NO: 352119 - RNA, 20 nt, Human
caccagaauauagaacucag

SEQ ID NO: 352120 - RNA, 21 nt, Human
uaagagaagaaggcuguccac

SEQ ID NO: 352121 - RNA, 20 nt, Human
uagaacucagucucacaacu

SEQ ID NO: 352122 - RNA, 20 nt, Human
uauucagaagcacuccaagc

SEQ ID NO: 352123 - RNA, 20 nt, Human
uauuuugauacaucuacggg

SEQ ID NO: 352124 - RNA, 21 nt, Human
ucaaaguaugaagucaaaaag

SEQ ID NO: 352125 - RNA, 20 nt, Human
ugacaaagcagaggcaaaga

SEQ ID NO: 352126 - RNA, 21 nt, Human
ugacaaagcagaggcaaagga

SEQ ID NO: 352127 - RNA, 20 nt, Human
ugugauuaagagaagaaggc

SEQ ID NO: 352128 - RNA, 21 nt, Human
uucaaaguaugaagucaaaaa

SEQ ID NO: 352129 - RNA, 24 nt, Human
uuccucucaaaccuuuuccucaaa

SEQ ID NO: 352130 - RNA, 22 nt, Human
uuuaagagauugauaaauugaa

SEQ ID NO: 352131 - RNA, 19 nt, Human
uuuucgaaaauuaaacacu

SEQ ID NO: 352132 - RNA, 22 nt, Human
aagaguuuguucuucagcccug

SEQ ID NO: 352133 - RNA, 22 nt, Human
acgcaggagugggugagucgug

SEQ ID NO: 352134 - RNA, 28 nt, Human
caaguaaacaaccaacugaucaucucuu

SEQ ID NO: 352135 - RNA, 21 nt, Human
cagaguacgguggaaauacaa

SEQ ID NO: 352136 - RNA, 18 nt, Human
ccaggauauacgaacuuc

SEQ ID NO: 352137 - RNA, 21 nt, Human
cugggagcugcuucuugcucg

SEQ ID NO: 352138 - RNA, 19 nt, Human
gagcacagcacaggauggc

SEQ ID NO: 352139 - RNA, 18 nt, Human
gaguccgugacaggucgc

SEQ ID NO: 352140 - RNA, 22 nt, Human
gaguuuguucuucagcccuggc

SEQ ID NO: 352141 - RNA, 23 nt, Human
guauauuauauaucaacacuuaa

SEQ ID NO: 352142 - RNA, 23 nt, Human
guuggagcucagggcaccagucu

SEQ ID NO: 352143 - RNA, 19 nt, Human
uaaaacaaugguuucuagc

SEQ ID NO: 352144 - RNA, 23 nt, Human
uaaacaaccaacugaucaucucu

SEQ ID NO: 352145 - RNA, 25 nt, Human
uaaacaaccaacugaucaucucuuu

SEQ ID NO: 352146 - RNA, 23 nt, Human
uaauaauuagauucacagaguac

SEQ ID NO: 352147 - RNA, 26 nt, Human
uaauuagauucacagaguacggugga

SEQ ID NO: 352148 - RNA, 21 nt, Human
uaggaugaggcccgcugguuu

SEQ ID NO: 352149 - RNA, 24 nt, Human
uauuaagaaaaauacagcuuuaac

SEQ ID NO: 352150 - RNA, 20 nt, Human
uauuuguaauguccuuuauu

SEQ ID NO: 352151 - RNA, 20 nt, Human
uccaaauuuucuuucuuacu

SEQ ID NO: 352152 - RNA, 21 nt, Human
ucucucugggagcugcuucuu

SEQ ID NO: 352153 - RNA, 20 nt, Human
ugacaaaaaagaaugaauca

SEQ ID NO: 352154 - RNA, 20 nt, Human
ugagaaguugcgguggugag

SEQ ID NO: 352155 - RNA, 21 nt, Human
ugccuggacaggaacgcagga

SEQ ID NO: 352156 - RNA, 18 nt, Human
uggagcucagggcaccag

SEQ ID NO: 352157 - RNA, 21 nt, Human
uugcgguggugaggguguagg

SEQ ID NO: 352158 - RNA, 21 nt, Human
uuggagcucagggcaccaguc

SEQ ID NO: 352159 - RNA, 22 nt, Human
uuuauaaucucuucauuuuucc

SEQ ID NO: 352160 - RNA, 19 nt, Human
aaaggugaugggucugagc

SEQ ID NO: 352161 - RNA, 24 nt, Human
accaaaaagguccaauucauagcc

SEQ ID NO: 352162 - RNA, 22 nt, Human
aggagucagagccaagccagcg

SEQ ID NO: 352163 - RNA, 25 nt, Human
caagaaguuaaccugcacccagggc

SEQ ID NO: 352164 - RNA, 21 nt, Human
cacccagggccacaggugcuc

SEQ ID NO: 352165 - RNA, 25 nt, Human
cacccagggccacaggugcucagcc

SEQ ID NO: 352166 - RNA, 20 nt, Human
ccagccccuccaggggucuc

SEQ ID NO: 352167 - RNA, 21 nt, Human
ccucugcauagugggcuccug

SEQ ID NO: 352168 - RNA, 20 nt, Human
cgaccuuuggccucugcaua

SEQ ID NO: 352169 - RNA, 21 nt, Human
gagcaggagucagagccaagc

SEQ ID NO: 352170 - RNA, 25 nt, Human
gagucagagccaagccagcgaggga

SEQ ID NO: 352171 - RNA, 22 nt, Human
gcgcuggauaaacuccagcccc

SEQ ID NO: 352172 - RNA, 19 nt, Human
uaaacuccagccccuccag

SEQ ID NO: 352173 - RNA, 20 nt, Human
uaggagagcacagaucggua

SEQ ID NO: 352174 - RNA, 20 nt, Human
ucagagccaagccagcgagg

SEQ ID NO: 352175 - RNA, 19 nt, Human
ucgcuggcugccgaccuuu

SEQ ID NO: 352176 - RNA, 26 nt, Human
uggccucugcauagugggcuccuucc

SEQ ID NO: 352177 - RNA, 20 nt, Human
uuggccucugcauagugggc

SEQ ID NO: 352178 - RNA, 20 nt, Human
aaaaaugacccaaaauagau

SEQ ID NO: 352179 - RNA, 20 nt, Human
aaaaccccccaaauaaugcc

SEQ ID NO: 352180 - RNA, 27 nt, Human
aaccccccaaauaaugccugaacccaa

SEQ ID NO: 352181 - RNA, 18 nt, Human
acuuguaguuucuuccuc

SEQ ID NO: 352182 - RNA, 21 nt, Human
caaaaccccccaaauaaugcc

SEQ ID NO: 352183 - RNA, 20 nt, Human
cagcacaagcccaugauugc

SEQ ID NO: 352184 - RNA, 18 nt, Human
cccaggaaggggcagucc

SEQ ID NO: 352185 - RNA, 21 nt, Human
ccuggagcuggcgggugggga

SEQ ID NO: 352186 - RNA, 20 nt, Human
ccuuuggaaacaaaaccccc

SEQ ID NO: 352187 - RNA, 23 nt, Human
cugggaaaauaauccuguuggag

SEQ ID NO: 352188 - RNA, 19 nt, Human
cuguuggaguugggggcuc

SEQ ID NO: 352189 - RNA, 25 nt, Human
gcccaugauugcggcgguggcugcc

SEQ ID NO: 352190 - RNA, 20 nt, Human
ggcucuucccaguugucugg

SEQ ID NO: 352191 - RNA, 19 nt, Human
guuaguuggcccaggaagg

SEQ ID NO: 352192 - RNA, 25 nt, Human
uaaaaaugacccaaaauagauuuga

SEQ ID NO: 352193 - RNA, 22 nt, Human
uaacuccuccugggaaaauaau

SEQ ID NO: 352194 - RNA, 21 nt, Human
uauuuaguuccuuuggaaaca

SEQ ID NO: 352195 - RNA, 19 nt, Human
uggaaacaaaaccccccaa

SEQ ID NO: 352196 - RNA, 21 nt, Human
uggacaguagauuacaaggca

SEQ ID NO: 352197 - RNA, 21 nt, Human
uggagcuggcggguggggagc

SEQ ID NO: 352198 - RNA, 24 nt, Human
uggcccaggaaggggcaguccugg

SEQ ID NO: 352199 - RNA, 20 nt, Human
uggcggguggggagccaggc

SEQ ID NO: 352200 - RNA, 18 nt, Human
ugggggcucuucccaguu

SEQ ID NO: 352201 - RNA, 19 nt, Human
uuggcccaggaaggggcag

SEQ ID NO: 352202 - RNA, 26 nt, Human
uuuuuuuuuuauaagcaauaugacuu

SEQ ID NO: 352203 - RNA, 26 nt, Human
aaaaaaaaaaaaaaaacaccuuccca

SEQ ID NO: 352204 - RNA, 28 nt, Human
aaaaaaaaaaaacaccuucccaaaggag

SEQ ID NO: 352205 - RNA, 25 nt, Human
aaaaaaaaaacaccuucccaaagga

SEQ ID NO: 352206 - RNA, 23 nt, Human
aaaaaaaaacaccuucccaaagg

SEQ ID NO: 352207 - RNA, 24 nt, Human
aaaaaaacaccuucccaaaggacu

SEQ ID NO: 352208 - RNA, 19 nt, Human
aaaaucacaaaugucacca

SEQ ID NO: 352209 - RNA, 19 nt, Human
acccuaugucucaguuacc

SEQ ID NO: 352210 - RNA, 19 nt, Human
agagaaagccucugccccc

SEQ ID NO: 352211 - RNA, 26 nt, Human
auacuggagucuuguuuaaaaggcca

SEQ ID NO: 352212 - RNA, 19 nt, Human
cagggcaucucuuuucuug

SEQ ID NO: 352213 - RNA, 23 nt, Human
cauuuuagcuucuuaaucaagga

SEQ ID NO: 352214 - RNA, 19 nt, Human
cccagagaaagccucugcc

SEQ ID NO: 352215 - RNA, 20 nt, Human
cccccgaaagagacuuucua

SEQ ID NO: 352216 - RNA, 20 nt, Human
ccgccgcgacaacaguuaua

SEQ ID NO: 352217 - RNA, 23 nt, Human
ccgccgcgacaacaguuauaccc

SEQ ID NO: 352218 - RNA, 22 nt, Human
ccuacuggguucuagguucucc

SEQ ID NO: 352219 - RNA, 18 nt, Human
gagaaugccccagccagu

SEQ ID NO: 352220 - RNA, 21 nt, Human
gcaaggucuuuagagggcaga

SEQ ID NO: 352221 - RNA, 21 nt, Human
ggagcacagcaauuaaccuuc

SEQ ID NO: 352222 - RNA, 20 nt, Human
ggcccggaaggcccuuggcg

SEQ ID NO: 352223 - RNA, 21 nt, Human
gucaaaaaaaaaaaaaaaaaa

SEQ ID NO: 352224 - RNA, 21 nt, Human
guggagcacagcaauuaaccu

SEQ ID NO: 352225 - RNA, 21 nt, Human
uaaaaggccaucaaaaacuca

SEQ ID NO: 352226 - RNA, 21 nt, Human
uaaagcaauugugcaauaagc

SEQ ID NO: 352227 - RNA, 19 nt, Human
uaaggaguaaaugagagaa

SEQ ID NO: 352228 - RNA, 27 nt, Human
uacugaaaaucacaaaugucaccaaca

SEQ ID NO: 352229 - RNA, 23 nt, Human
ucaaaaaaaaaaaaaaaaaaaaa

SEQ ID NO: 352230 - RNA, 21 nt, Human
ucagggcaucucuuuucuugc

SEQ ID NO: 352231 - RNA, 19 nt, Human
ucaguuaccggagauccag

SEQ ID NO: 352232 - RNA, 19 nt, Human
ucauuaaaugaggugcaac

SEQ ID NO: 352233 - RNA, 19 nt, Human
ucccaaaggacugccuucu

SEQ ID NO: 352234 - RNA, 18 nt, Human
uccucacuuccuccgccg

SEQ ID NO: 352235 - RNA, 19 nt, Human
uccucacuuccuccgccgc

SEQ ID NO: 352236 - RNA, 24 nt, Human
ugagaaugccccagccagugcugu

SEQ ID NO: 352237 - RNA, 21 nt, Human
ugugagcucaguuuccugaaa

SEQ ID NO: 352238 - RNA, 22 nt, Human
uuagagucaaaaaaaaaaaaaa

SEQ ID NO: 352239 - RNA, 31 nt, Human
uugauuagagucaaaaaaaaaaaaaaaaaaa

SEQ ID NO: 352240 - RNA, 23 nt, Human
uuuaaaaugcacugggagggaaa

SEQ ID NO: 352241 - RNA, 21 nt, Human
uuuaaggaguaaaugagagaa

SEQ ID NO: 352242 - RNA, 22 nt, Human
uuuaaggaguaaaugagagaaa

SEQ ID NO: 352243 - RNA, 24 nt, Human
uuuuuuuuuuuuuuuuuugucuuu

SEQ ID NO: 352244 - RNA, 27 nt, Human
uuuuuuuuuuuuuuuuuuuuuuugggg

SEQ ID NO: 352245 - RNA, 19 nt, Human
aagaccugggggguggagg

SEQ ID NO: 352246 - RNA, 23 nt, Human
aagcagagcuuggaagaccuggg

SEQ ID NO: 352247 - RNA, 23 nt, Human
aagcaugaacagaucugggucca

SEQ ID NO: 352248 - RNA, 19 nt, Human
aagggcccccaaagccugc

SEQ ID NO: 352249 - RNA, 21 nt, Human
acgaagacaaaagcaugaaca

SEQ ID NO: 352250 - RNA, 23 nt, Human
agacaaaagcaugaacagaucug

SEQ ID NO: 352251 - RNA, 21 nt, Human
agccugggguggcagaaaggg

SEQ ID NO: 352252 - RNA, 22 nt, Human
agcguccaccugaccccccagc

SEQ ID NO: 352253 - RNA, 24 nt, Human
aggagccaucccagccucuaagcc

SEQ ID NO: 352254 - RNA, 18 nt, Human
agggacguuuuggggcuu

SEQ ID NO: 352255 - RNA, 18 nt, Human
agggggauucccggugau

SEQ ID NO: 352256 - RNA, 22 nt, Human
aggugcggugggcacgagggag

SEQ ID NO: 352257 - RNA, 22 nt, Human
agucauggaacuuuuucaaagg

SEQ ID NO: 352258 - RNA, 21 nt, Human
augaacagaucuggguccaaa

SEQ ID NO: 352259 - RNA, 21 nt, Human
caaagccugcucauagccaag

SEQ ID NO: 352260 - RNA, 19 nt, Human
cacucccggguccgcuccu

SEQ ID NO: 352261 - RNA, 20 nt, Human
cagagcuuggaagaccuggg

SEQ ID NO: 352262 - RNA, 23 nt, Human
cagccucuaagcccccagacccu

SEQ ID NO: 352263 - RNA, 19 nt, Human
cagccugccaagcaagccg

SEQ ID NO: 352264 - RNA, 21 nt, Human
cagggcggccggcugugcgag

SEQ ID NO: 352265 - RNA, 22 nt, Human
ccaaagccugcucauagccaag

SEQ ID NO: 352266 - RNA, 24 nt, Human
ccagccucuaagcccccagacccu

SEQ ID NO: 352267 - RNA, 19 nt, Human
cccaggccccgccacccaa

SEQ ID NO: 352268 - RNA, 24 nt, Human
cccauacagaugaagacaucaaag

SEQ ID NO: 352269 - RNA, 23 nt, Human
ccccacaccuggggccggaccag

SEQ ID NO: 352270 - RNA, 22 nt, Human
ccccagacccuaccucggcccc

SEQ ID NO: 352271 - RNA, 19 nt, Human
cccccagacccuaccucgg

SEQ ID NO: 352272 - RNA, 19 nt, Human
ccccccagcccugaacucc

SEQ ID NO: 352273 - RNA, 19 nt, Human
ccccgccacccaaggucgg

SEQ ID NO: 352274 - RNA, 18 nt, Human
ccccgccgcagugacgaa

SEQ ID NO: 352275 - RNA, 27 nt, Human
ccccgccgcagugacgaagacaaaagc

SEQ ID NO: 352276 - RNA, 20 nt, Human
ccccggagccccaggaaaau

SEQ ID NO: 352277 - RNA, 27 nt, Human
ccccggggcugccgcggaagggccccc

SEQ ID NO: 352278 - RNA, 20 nt, Human
ccccuggcgguggggccagg

SEQ ID NO: 352279 - RNA, 18 nt, Human
ccgccgccgccucccagc

SEQ ID NO: 352280 - RNA, 20 nt, Human
ccgcgccccggagccccagg

SEQ ID NO: 352281 - RNA, 21 nt, Human
ccucuaagcccccagacccua

SEQ ID NO: 352282 - RNA, 19 nt, Human
ccuuagggacguuuugggg

SEQ ID NO: 352283 - RNA, 21 nt, Human
cgaagacaaaagcaugaacag

SEQ ID NO: 352284 - RNA, 22 nt, Human
cgcacccaggagugggugacac

SEQ ID NO: 352285 - RNA, 22 nt, Human
cgcggacggaaccuuauuuuaa

SEQ ID NO: 352286 - RNA, 22 nt, Human
cucagggcuggcucuccugugu

SEQ ID NO: 352287 - RNA, 24 nt, Human
cucuaagcccccagacccuaccuc

SEQ ID NO: 352288 - RNA, 18 nt, Human
cuuggaagaccugggggg

SEQ ID NO: 352289 - RNA, 19 nt, Human
gaaacugaggaagcagagc

SEQ ID NO: 352290 - RNA, 19 nt, Human
gaccugggggguggagggg

SEQ ID NO: 352291 - RNA, 25 nt, Human
gaccugggggguggaggggaagggu

SEQ ID NO: 352292 - RNA, 23 nt, Human
gagagacccaggccccgccaccc

SEQ ID NO: 352293 - RNA, 24 nt, Human
gagcuuggaagaccuggggggugg

SEQ ID NO: 352294 - RNA, 19 nt, Human
gaggcccagccugccaagc

SEQ ID NO: 352295 - RNA, 21 nt, Human
gaggcccagccugccaagcaa

SEQ ID NO: 352296 - RNA, 20 nt, Human
gagggaggggcaugcguccu

SEQ ID NO: 352297 - RNA, 23 nt, Human
gaggugguuccauuuuggaaacu

SEQ ID NO: 352298 - RNA, 19 nt, Human
gcaagccggugucugugcc

SEQ ID NO: 352299 - RNA, 20 nt, Human
gcagugacgaagacaaaagc

SEQ ID NO: 352300 - RNA, 22 nt, Human
gcaugcguccugguaagucggg

SEQ ID NO: 352301 - RNA, 21 nt, Human
gcccccaaagccugcucauag

SEQ ID NO: 352302 - RNA, 18 nt, Human
gccccgccacccaagguc

SEQ ID NO: 352303 - RNA, 20 nt, Human
gccccgccacccaaggucgg

SEQ ID NO: 352304 - RNA, 22 nt, Human
gcccgacccucagggcggccgg

SEQ ID NO: 352305 - RNA, 20 nt, Human
gccgcggaagggcccccaaa

SEQ ID NO: 352306 - RNA, 23 nt, Human
gcuuggaagaccuggggggugga

SEQ ID NO: 352307 - RNA, 18 nt, Human
ggccggaccagccugggg

SEQ ID NO: 352308 - RNA, 18 nt, Human
ggcuccggcaggggcccc

SEQ ID NO: 352309 - RNA, 18 nt, Human
gggaagggucugcacgca

SEQ ID NO: 352310 - RNA, 20 nt, Human
gggggguggaggggaagggu

SEQ ID NO: 352311 - RNA, 23 nt, Human
gguccaaagaggcucggcaggug

SEQ ID NO: 352312 - RNA, 21 nt, Human
guggagagagcggaccccaca

SEQ ID NO: 352313 - RNA, 19 nt, Human
uaagcccccagacccuacc

SEQ ID NO: 352314 - RNA, 22 nt, Human
uaagcccccagacccuaccucg

SEQ ID NO: 352315 - RNA, 18 nt, Human
uccaccugaccccccagc

SEQ ID NO: 352316 - RNA, 20 nt, Human
ucccagccucuaagccccca

SEQ ID NO: 352317 - RNA, 24 nt, Human
ucccagccucuaagcccccagacc

SEQ ID NO: 352318 - RNA, 23 nt, Human
uccgcgccccggagccccaggaa

SEQ ID NO: 352319 - RNA, 20 nt, Human
ucuguggguuugaugagggc

SEQ ID NO: 352320 - RNA, 23 nt, Human
ugaaacacucccggguccgcucc

SEQ ID NO: 352321 - RNA, 19 nt, Human
ugacccagcacgcggacgg

SEQ ID NO: 352322 - RNA, 19 nt, Human
ugaccccccagcccgagcc

SEQ ID NO: 352323 - RNA, 21 nt, Human
ugacgaagacaaaagcaugaa

SEQ ID NO: 352324 - RNA, 24 nt, Human
ugaggaagcagagcuuggaagacc

SEQ ID NO: 352325 - RNA, 19 nt, Human
ugagggcagagggaggggc

SEQ ID NO: 352326 - RNA, 21 nt, Human
ugagucgguuuguuuucuuca

SEQ ID NO: 352327 - RNA, 20 nt, Human
ugccaaggcccccccagccc

SEQ ID NO: 352328 - RNA, 21 nt, Human
ugcgcgaccagccccggaggc

SEQ ID NO: 352329 - RNA, 24 nt, Human
ugcgcuugcccccuggcggugggg

SEQ ID NO: 352330 - RNA, 18 nt, Human
uggaacuuuuucaaagaa

SEQ ID NO: 352331 - RNA, 22 nt, Human
uggaagaccugggggguggagg

SEQ ID NO: 352332 - RNA, 19 nt, Human
uggagagagcggaccccac

SEQ ID NO: 352333 - RNA, 20 nt, Human
uggcagaaagggaguccggg

SEQ ID NO: 352334 - RNA, 24 nt, Human
uggcagaaagggaguccgggucug

SEQ ID NO: 352335 - RNA, 27 nt, Human
ugggggguggaggggaagggucugcaa

SEQ ID NO: 352336 - RNA, 21 nt, Human
ugggguggcagaaagggaguc

SEQ ID NO: 352337 - RNA, 24 nt, Human
uggguccaaagaggcucggcaggu

SEQ ID NO: 352338 - RNA, 18 nt, Human
ugucugaggcuccggcag

SEQ ID NO: 352339 - RNA, 22 nt, Human
uuagggacguuuuggggcuuaa

SEQ ID NO: 352340 - RNA, 21 nt, Human
uuuccaccccauacagaugaa

SEQ ID NO: 352341 - RNA, 24 nt, Human
aaaaaaaaaaaaaaaaccccaaag

SEQ ID NO: 352342 - RNA, 22 nt, Human
aaaaaaaaaaaaaaccccaaag

SEQ ID NO: 352343 - RNA, 25 nt, Human
aaaaaaaaagcgagcuuauucccaa

SEQ ID NO: 352344 - RNA, 26 nt, Human
aaaaaacaaaaaacaaaaaacaaaaa

SEQ ID NO: 352345 - RNA, 25 nt, Human
aaaaaacaaaaaacaaaaacaaaaa

SEQ ID NO: 352346 - RNA, 22 nt, Human
aaaaacccacaaaaaaccaaaa

SEQ ID NO: 352347 - RNA, 18 nt, Human
aaaaaccccaaagaucaa

SEQ ID NO: 352348 - RNA, 20 nt, Human
aaaaaccccaaagaucaacc

SEQ ID NO: 352349 - RNA, 24 nt, Human
aaaacaaaaaacaaaaaacaaaaa

SEQ ID NO: 352350 - RNA, 23 nt, Human
aaaacaaaaaacaaaaacaaaaa

SEQ ID NO: 352351 - RNA, 26 nt, Human
aaaacaaaaacccacaaaaaaccaaa

SEQ ID NO: 352352 - RNA, 20 nt, Human
aaaauagcgaaaccccgucu

SEQ ID NO: 352353 - RNA, 21 nt, Human
aaaauagcgaaaccccgucuc

SEQ ID NO: 352354 - RNA, 26 nt, Human
aaacaaaaaacaaaaaacaaaaacaa

SEQ ID NO: 352355 - RNA, 28 nt, Human
aaacaaaaaacaaaaacaaaaacccaca

SEQ ID NO: 352356 - RNA, 18 nt, Human
aaacaaaaacaaaaaccc

SEQ ID NO: 352357 - RNA, 24 nt, Human
aaacaaaaacaaaaacccacaaaa

SEQ ID NO: 352358 - RNA, 22 nt, Human
aaacaaaaacccacaaaaaacc

SEQ ID NO: 352359 - RNA, 23 nt, Human
aaacaugauuauugauaaugaac

SEQ ID NO: 352360 - RNA, 23 nt, Human
aaaccaaaaagcuuauucccaau

SEQ ID NO: 352361 - RNA, 22 nt, Human
aaauagcgaaaccccgucucua

SEQ ID NO: 352362 - RNA, 22 nt, Human
aaauguuaauguaauccaagcu

SEQ ID NO: 352363 - RNA, 19 nt, Human
aacaaaaacaaaaacccac

SEQ ID NO: 352364 - RNA, 24 nt, Human
aacaaaaacccacaaaaaaccaaa

SEQ ID NO: 352365 - RNA, 19 nt, Human
aacagagcgaaacuccauc

SEQ ID NO: 352366 - RNA, 20 nt, Human
aacagagcgaaacuccaucu

SEQ ID NO: 352367 - RNA, 21 nt, Human
aacagagcgaaacuccaucuc

SEQ ID NO: 352368 - RNA, 21 nt, Human
aacccacaaaaaaccaaaaag

SEQ ID NO: 352369 - RNA, 24 nt, Human
aagaaggagaauugcuugaaccca

SEQ ID NO: 352370 - RNA, 24 nt, Human
aagaaggagaauugcuugaacccg

SEQ ID NO: 352371 - RNA, 23 nt, Human
aagauugcgccacugcacuccag

SEQ ID NO: 352372 - RNA, 23 nt, Human
aagcagacaugugacacuuagca

SEQ ID NO: 352373 - RNA, 21 nt, Human
aauauggugaaacccugucuc

SEQ ID NO: 352374 - RNA, 21 nt, Human
aauauggugaaacccugucuc

SEQ ID NO: 352375 - RNA, 24 nt, Human
aaucgccugaaccugggaggcgga

SEQ ID NO: 352376 - RNA, 24 nt, Human
aauugcuugaacccaggaggugga

SEQ ID NO: 352377 - RNA, 24 nt, Human
aauugcuugaacccgggaggugga

SEQ ID NO: 352378 - RNA, 22 nt, Human
acaaaaaacaaaaaacaaaaac

SEQ ID NO: 352379 - RNA, 24 nt, Human
acaaaaacccacaaaaaaccaaaa

SEQ ID NO: 352380 - RNA, 24 nt, Human
acagagcgaaacuccaucucaaaa

SEQ ID NO: 352381 - RNA, 21 nt, Human
acagagugagacucuguauca

SEQ ID NO: 352382 - RNA, 24 nt, Human
acagagugagacucuguaucagaa

SEQ ID NO: 352383 - RNA, 22 nt, Human
accaaaaagcuuauucccaauu

SEQ ID NO: 352384 - RNA, 24 nt, Human
accaauauggugaaacccugucuc

SEQ ID NO: 352385 - RNA, 24 nt, Human
accaauauggugaaacccugucuc

SEQ ID NO: 352386 - RNA, 21 nt, Human
acccacaaaaaaccaaaaagc

SEQ ID NO: 352387 - RNA, 24 nt, Human
accccgucucuacuaaaaacacaa

SEQ ID NO: 352388 - RNA, 24 nt, Human
acccugucucuacuaaaaauacaa

SEQ ID NO: 352389 - RNA, 24 nt, Human
acccugucucuacuaaaaauacaa

SEQ ID NO: 352390 - RNA, 23 nt, Human
acuccagccuggcaacagaguga

SEQ ID NO: 352391 - RNA, 23 nt, Human
acugcacuacagccugcacaaca

SEQ ID NO: 352392 - RNA, 24 nt, Human
acugcacuacagccugcacaacag

SEQ ID NO: 352393 - RNA, 24 nt, Human
acugcacuacagccugcacaacag

SEQ ID NO: 352394 - RNA, 24 nt, Human
acugcacuccagccugcacaacag

SEQ ID NO: 352395 - RNA, 24 nt, Human
acugcacuccagccugcacaacag

SEQ ID NO: 352396 - RNA, 23 nt, Human
acugcacuccagccuggcaacag

SEQ ID NO: 352397 - RNA, 23 nt, Human
acugcacuccagccuggcaacag

SEQ ID NO: 352398 - RNA, 21 nt, Human
acugucugagggaaaggaaau

SEQ ID NO: 352399 - RNA, 24 nt, Human
acugugccacugcacuccagccug

SEQ ID NO: 352400 - RNA, 27 nt, Human
acuugcuuuucaauggacauuuacuau

SEQ ID NO: 352401 - RNA, 25 nt, Human
agaauggaacaaaauuguucaagug

SEQ ID NO: 352402 - RNA, 22 nt, Human
agaauugcuugaagucaggagg

SEQ ID NO: 352403 - RNA, 22 nt, Human
agacugugccacugcacuccag

SEQ ID NO: 352404 - RNA, 20 nt, Human
agagacaauucccagccccc

SEQ ID NO: 352405 - RNA, 21 nt, Human
agcacuuugggaggcugaggc

SEQ ID NO: 352406 - RNA, 24 nt, Human
agcacuuugggaggcugaggcagg

SEQ ID NO: 352407 - RNA, 24 nt, Human
agcacuuugggaggcugaggcggg

SEQ ID NO: 352408 - RNA, 18 nt, Human
agccaggugugguggugc

SEQ ID NO: 352409 - RNA, 23 nt, Human
agccaggugugguggugcacgcc

SEQ ID NO: 352410 - RNA, 23 nt, Human
agccaggugugguggugcaugcc

SEQ ID NO: 352411 - RNA, 23 nt, Human
agccgggcgugguggcacgcgcc

SEQ ID NO: 352412 - RNA, 24 nt, Human
agccugaccaauauggugaaaccc

SEQ ID NO: 352413 - RNA, 24 nt, Human
agccugaccaauauggugaaaccc

SEQ ID NO: 352414 - RNA, 22 nt, Human
agccuggacaacagagcgaaac

SEQ ID NO: 352415 - RNA, 21 nt, Human
agccuggcaacagagugagac

SEQ ID NO: 352416 - RNA, 23 nt, Human
agccuggcaacagagugagacuc

SEQ ID NO: 352417 - RNA, 23 nt, Human
aggagcaagacuccaucucaaaa

SEQ ID NO: 352418 - RNA, 18 nt, Human
aggaggcagagguuacgg

SEQ ID NO: 352419 - RNA, 19 nt, Human
aggcagagguuacggugaa

SEQ ID NO: 352420 - RNA, 22 nt, Human
aggcaggagaaucgccugaacc

SEQ ID NO: 352421 - RNA, 24 nt, Human
aggcaggagaaucgccugaaccug

SEQ ID NO: 352422 - RNA, 18 nt, Human
aggcaggagaauugcuug

SEQ ID NO: 352423 - RNA, 23 nt, Human
aggccaaggcgggcagaucacga

SEQ ID NO: 352424 - RNA, 24 nt, Human
aggcggagguugcagugagccaag

SEQ ID NO: 352425 - RNA, 18 nt, Human
aggcgggcagaucacgag

SEQ ID NO: 352426 - RNA, 24 nt, Human
aggcgggcagaucacgaggucagg

SEQ ID NO: 352427 - RNA, 26 nt, Human
aggcggguggaucaacugaggucagg

SEQ ID NO: 352428 - RNA, 20 nt, Human
aggcugaggcaggagaaucg

SEQ ID NO: 352429 - RNA, 20 nt, Human
aggcugaggcaggagaaucg

SEQ ID NO: 352430 - RNA, 21 nt, Human
aggcugaggcaggagaauugc

SEQ ID NO: 352431 - RNA, 24 nt, Human
aggcugaggcaggagaauugcuug

SEQ ID NO: 352432 - RNA, 18 nt, Human
aggcugaggcggguggau

SEQ ID NO: 352433 - RNA, 24 nt, Human
aggcugaggcggguggaucaacug

SEQ ID NO: 352434 - RNA, 24 nt, Human
agguggagguugcagugagccaag

SEQ ID NO: 352435 - RNA, 24 nt, Human
agguggagguugcagugagccaag

SEQ ID NO: 352436 - RNA, 20 nt, Human
agguggguggaucacgaggu

SEQ ID NO: 352437 - RNA, 24 nt, Human
agguggguggaucacgaggucagg

SEQ ID NO: 352438 - RNA, 24 nt, Human
aggugugguggugcacgccuauaa

SEQ ID NO: 352439 - RNA, 24 nt, Human
aggugugguggugcaugccuguaa

SEQ ID NO: 352440 - RNA, 23 nt, Human
agugacagaagcaacacacuuca

SEQ ID NO: 352441 - RNA, 21 nt, Human
auacauuuuuauaacaucucu

SEQ ID NO: 352442 - RNA, 21 nt, Human
aucacgaggucaggaguucaa

SEQ ID NO: 352443 - RNA, 22 nt, Human
aucacgaggucaggaguucaag

SEQ ID NO: 352444 - RNA, 20 nt, Human
aucacgaggucaggaguucc

SEQ ID NO: 352445 - RNA, 24 nt, Human
aucagaaaaaaaaaaaaaaaaaaa

SEQ ID NO: 352446 - RNA, 22 nt, Human
aucccaguacuuugggaggcca

SEQ ID NO: 352447 - RNA, 24 nt, Human
aucgugccacugcacuacagccug

SEQ ID NO: 352448 - RNA, 19 nt, Human
aucucaaaaaaaaaaaaag

SEQ ID NO: 352449 - RNA, 22 nt, Human
aucuggagacaucuuugguugu

SEQ ID NO: 352450 - RNA, 19 nt, Human
augccuguaauccuagcac

SEQ ID NO: 352451 - RNA, 20 nt, Human
auggugaaacccugucucua

SEQ ID NO: 352452 - RNA, 20 nt, Human
auggugaaacccugucucua

SEQ ID NO: 352453 - RNA, 18 nt, Human
augugcuaucacauuuca

SEQ ID NO: 352454 - RNA, 18 nt, Human
auugcacuccagccugga

SEQ ID NO: 352455 - RNA, 24 nt, Human
auugcacuccagccuggacaacag

SEQ ID NO: 352456 - RNA, 24 nt, Human
auugcgccacugcacuccagccug

SEQ ID NO: 352457 - RNA, 26 nt, Human
caacaauacuaaaaauugccuuacaa

SEQ ID NO: 352458 - RNA, 21 nt, Human
caacaggagcaagacuccauc

SEQ ID NO: 352459 - RNA, 21 nt, Human
caacaggagcaagacuccauc

SEQ ID NO: 352460 - RNA, 24 nt, Human
caacugccauugcacuccagccug

SEQ ID NO: 352461 - RNA, 21 nt, Human
caagacuccaucucaaaaaaa

SEQ ID NO: 352462 - RNA, 21 nt, Human
caagacuccaucucaaaaaaa

SEQ ID NO: 352463 - RNA, 21 nt, Human
caaggaaauaccaauugaucu

SEQ ID NO: 352464 - RNA, 24 nt, Human
caaggcgggcagaucacgagguca

SEQ ID NO: 352465 - RNA, 24 nt, Human
caauauggugaaacccugucucua

SEQ ID NO: 352466 - RNA, 24 nt, Human
caauauggugaaacccugucucua

SEQ ID NO: 352467 - RNA, 18 nt, Human
caauugaucuauugauac

SEQ ID NO: 352468 - RNA, 21 nt, Human
cacaaaaaaccaaaaagcuua

SEQ ID NO: 352469 - RNA, 24 nt, Human
cacaaugguugguacucuaaaacu

SEQ ID NO: 352470 - RNA, 24 nt, Human
cacaccuguaaucccagcacuuug

SEQ ID NO: 352471 - RNA, 22 nt, Human
cacacuugggggagaaggugau

SEQ ID NO: 352472 - RNA, 19 nt, Human
caccuguaaucccagcacu

SEQ ID NO: 352473 - RNA, 24 nt, Human
caccuguaaucccagcacuuuggg

SEQ ID NO: 352474 - RNA, 19 nt, Human
cacgccuauaaucucagcu

SEQ ID NO: 352475 - RNA, 22 nt, Human
cacgccuguaaucccagcacuu

SEQ ID NO: 352476 - RNA, 23 nt, Human
cacgccuguaaucccagcacuuc

SEQ ID NO: 352477 - RNA, 24 nt, Human
cacgccuguaaucccaguacuuug

SEQ ID NO: 352478 - RNA, 19 nt, Human
cacuacagccugcacaaca

SEQ ID NO: 352479 - RNA, 24 nt, Human
cacuccagccuggacaacagagcg

SEQ ID NO: 352480 - RNA, 21 nt, Human
cacuccagccuggcaacagag

SEQ ID NO: 352481 - RNA, 22 nt, Human
cacuccagccuggcaacagagu

SEQ ID NO: 352482 - RNA, 23 nt, Human
cacuccagccuggcaacagagug

SEQ ID NO: 352483 - RNA, 18 nt, Human
cacugcacuacagccugc

SEQ ID NO: 352484 - RNA, 24 nt, Human
cacugcacuacagccugcacaaca

SEQ ID NO: 352485 - RNA, 18 nt, Human
cacugcacuccagccugc

SEQ ID NO: 352486 - RNA, 22 nt, Human
cacugcacuccagccugcacaa

SEQ ID NO: 352487 - RNA, 24 nt, Human
cacugcacuccagccugcacaaca

SEQ ID NO: 352488 - RNA, 18 nt, Human
cacugcacuccagccugg

SEQ ID NO: 352489 - RNA, 20 nt, Human
cacugcacuccagccuggca

SEQ ID NO: 352490 - RNA, 23 nt, Human
cacugcacuccagccuggcaaca

SEQ ID NO: 352491 - RNA, 23 nt, Human
cacugcacuccagccuggcaaca

SEQ ID NO: 352492 - RNA, 24 nt, Human
cacugcacuccagccuggcaacag

SEQ ID NO: 352493 - RNA, 24 nt, Human
cagcacuuugggaggcugaggcag

SEQ ID NO: 352494 - RNA, 25 nt, Human
cagcacuuugggaggcugaggcagg

SEQ ID NO: 352495 - RNA, 23 nt, Human
cagccugcacaacaggagcaaga

SEQ ID NO: 352496 - RNA, 29 nt, Human
caggagguggagguugcagugacaacggu

SEQ ID NO: 352497 - RNA, 24 nt, Human
caguacuuugggaggccaaggcgg

SEQ ID NO: 352498 - RNA, 23 nt, Human
caucucaaaaaaaaaaaaaaaac

SEQ ID NO: 352499 - RNA, 24 nt, Human
caugccuguaauccuagcacuuug

SEQ ID NO: 352500 - RNA, 24 nt, Human
cauggccgggcgugguggcucaca

SEQ ID NO: 352501 - RNA, 24 nt, Human
caugguugggcacgguggcucacg

SEQ ID NO: 352502 - RNA, 18 nt, Human
cauuagguuuagauaagc

SEQ ID NO: 352503 - RNA, 18 nt, Human
cauugcacuccagccugg

SEQ ID NO: 352504 - RNA, 19 nt, Human
cauugcacuccagccugga

SEQ ID NO: 352505 - RNA, 20 nt, Human
cauugcacuccagccuggac

SEQ ID NO: 352506 - RNA, 21 nt, Human
cauugcacuccagccuggaca

SEQ ID NO: 352507 - RNA, 24 nt, Human
cauugcacuccagccuggacaaca

SEQ ID NO: 352508 - RNA, 18 nt, Human
ccaaaaagcuuauuccca

SEQ ID NO: 352509 - RNA, 18 nt, Human
ccacugcacuacagccug

SEQ ID NO: 352510 - RNA, 18 nt, Human
ccacugcacuacagccug

SEQ ID NO: 352511 - RNA, 18 nt, Human
ccacugcacuccagccug

SEQ ID NO: 352512 - RNA, 18 nt, Human
ccacugcacuccagccug

SEQ ID NO: 352513 - RNA, 19 nt, Human
ccacugcacuccagccugc

SEQ ID NO: 352514 - RNA, 24 nt, Human
ccacugcacuccagccugcacaac

SEQ ID NO: 352515 - RNA, 19 nt, Human
ccacugcacuccagccugg

SEQ ID NO: 352516 - RNA, 19 nt, Human
ccacugcacuccagccugg

SEQ ID NO: 352517 - RNA, 20 nt, Human
ccacugcacuccagccuggc

SEQ ID NO: 352518 - RNA, 23 nt, Human
ccacugcacuccagccuggcaac

SEQ ID NO: 352519 - RNA, 18 nt, Human
ccagcccggccaaaauag

SEQ ID NO: 352520 - RNA, 22 nt, Human
ccaggagguggagguugcagug

SEQ ID NO: 352521 - RNA, 23 nt, Human
ccaucucaaaaaaaaaaaaaaaa

SEQ ID NO: 352522 - RNA, 30 nt, Human
ccaucucaaaaaaacaaaaaacaaaaaacc

SEQ ID NO: 352523 - RNA, 19 nt, Human
ccauugcacuccagccugg

SEQ ID NO: 352524 - RNA, 20 nt, Human
ccauugcacuccagccugga

SEQ ID NO: 352525 - RNA, 21 nt, Human
ccauugcacuccagccuggac

SEQ ID NO: 352526 - RNA, 22 nt, Human
ccauugcacuccagccuggaca

SEQ ID NO: 352527 - RNA, 21 nt, Human
cccagcacuuccugagguggg

SEQ ID NO: 352528 - RNA, 21 nt, Human
cccaggagguggagguugcag

SEQ ID NO: 352529 - RNA, 21 nt, Human
cccgggagguggagguugcag

SEQ ID NO: 352530 - RNA, 19 nt, Human
ccuagccucugguggaagc

SEQ ID NO: 352531 - RNA, 19 nt, Human
ccuauaaucucagcuacuc

SEQ ID NO: 352532 - RNA, 21 nt, Human
ccuauaaucucagcuacucgg

SEQ ID NO: 352533 - RNA, 21 nt, Human
ccucacagcacacaaugguug

SEQ ID NO: 352534 - RNA, 18 nt, Human
ccugaaccugggaggcgg

SEQ ID NO: 352535 - RNA, 22 nt, Human
ccugaccaauauggugaaaccc

SEQ ID NO: 352536 - RNA, 22 nt, Human
ccugaccaauauggugaaaccc

SEQ ID NO: 352537 - RNA, 24 nt, Human
ccugaccaauauggugaaacccug

SEQ ID NO: 352538 - RNA, 22 nt, Human
ccugcaacugcucccagcgucc

SEQ ID NO: 352539 - RNA, 24 nt, Human
ccuggacaacagagcgaaacucca

SEQ ID NO: 352540 - RNA, 21 nt, Human
ccuggcaacagagugagacuc

SEQ ID NO: 352541 - RNA, 24 nt, Human
ccuggccgggcacggugguucaug

SEQ ID NO: 352542 - RNA, 19 nt, Human
ccugggaggcggagguugc

SEQ ID NO: 352543 - RNA, 21 nt, Human
ccuguaaucccagcuacucgg

SEQ ID NO: 352544 - RNA, 22 nt, Human
ccuguaaucccaguacuuuggg

SEQ ID NO: 352545 - RNA, 22 nt, Human
ccuguaauccuagcacuuuggg

SEQ ID NO: 352546 - RNA, 21 nt, Human
ccuguagucccagcuacuugg

SEQ ID NO: 352547 - RNA, 23 nt, Human
cgaaacuccaucucaaaaaaaaa

SEQ ID NO: 352548 - RNA, 25 nt, Human
cgccacugcacuccagccuggcaac

SEQ ID NO: 352549 - RNA, 24 nt, Human
cgccuauaaucucagcuacucggg

SEQ ID NO: 352550 - RNA, 18 nt, Human
cgccuguaaucccagcac

SEQ ID NO: 352551 - RNA, 25 nt, Human
cgccuguaaucccagcacuuccuga

SEQ ID NO: 352552 - RNA, 23 nt, Human
cgccuguaaucccaguacuuugg

SEQ ID NO: 352553 - RNA, 21 nt, Human
cgccuguagucccagcuacuu

SEQ ID NO: 352554 - RNA, 23 nt, Human
cgccuguagucccagcuacuugg

SEQ ID NO: 352555 - RNA, 29 nt, Human
cgggagguggagguugcagugacaacggu

SEQ ID NO: 352556 - RNA, 24 nt, Human
cgggagguggagguugcagugagc

SEQ ID NO: 352557 - RNA, 22 nt, Human
cgggcagaucacgaggucagga

SEQ ID NO: 352558 - RNA, 24 nt, Human
cggguggaucaacugaggucagga

SEQ ID NO: 352559 - RNA, 23 nt, Human
cucaaaaaaaaaaaaaaaacccc

SEQ ID NO: 352560 - RNA, 25 nt, Human
cucaaaaaaaaaaaaagcgagcuua

SEQ ID NO: 352561 - RNA, 22 nt, Human
cucacaccuguaaucccagcac

SEQ ID NO: 352562 - RNA, 24 nt, Human
cucacaccuguaaucccagcacuu

SEQ ID NO: 352563 - RNA, 22 nt, Human
cucacgccuguaaucccaguac

SEQ ID NO: 352564 - RNA, 24 nt, Human
cucacgccuguaaucccaguacuu

SEQ ID NO: 352565 - RNA, 26 nt, Human
cuccaucucaaaaaaaaaaaaaaaac

SEQ ID NO: 352566 - RNA, 24 nt, Human
cuccaucucaaaaaaaaaaaaagc

SEQ ID NO: 352567 - RNA, 24 nt, Human
cucuguaucagaaaaaaaaaaaaa

SEQ ID NO: 352568 - RNA, 24 nt, Human
cugaaccugggaggcggagguugc

SEQ ID NO: 352569 - RNA, 24 nt, Human
cugaccaauauggugaaacccugu

SEQ ID NO: 352570 - RNA, 24 nt, Human
cugaccaauauggugaaacccugu

SEQ ID NO: 352571 - RNA, 23 nt, Human
cugagguggguggaucacgaggu

SEQ ID NO: 352572 - RNA, 24 nt, Human
gaaaaaaaaaaaaaaaaaaaacau

SEQ ID NO: 352573 - RNA, 24 nt, Human
gaaacaacugccauugcacuccag

SEQ ID NO: 352574 - RNA, 19 nt, Human
gaaacccugucucuacuaa

SEQ ID NO: 352575 - RNA, 19 nt, Human
gaaacccugucucuacuaa

SEQ ID NO: 352576 - RNA, 20 nt, Human
gaacaaaauuguucaagugc

SEQ ID NO: 352577 - RNA, 24 nt, Human
gaagaaggagaauugcuugaaccc

SEQ ID NO: 352578 - RNA, 21 nt, Human
gaaggagaauugcuugaaccc

SEQ ID NO: 352579 - RNA, 21 nt, Human
gagcaagacuccaucucaaaa

SEQ ID NO: 352580 - RNA, 23 nt, Human
gaggcggguggaucaacugaggu

SEQ ID NO: 352581 - RNA, 21 nt, Human
gagguggagguugcagugagc

SEQ ID NO: 352582 - RNA, 18 nt, Human
gagguugcagugagccaa

SEQ ID NO: 352583 - RNA, 18 nt, Human
gagguugcagugagccaa

SEQ ID NO: 352584 - RNA, 23 nt, Human
gagguugcagugagccaagacug

SEQ ID NO: 352585 - RNA, 21 nt, Human
gagguugcagugagccaagau

SEQ ID NO: 352586 - RNA, 23 nt, Human
gagguugcagugagccaagaucg

SEQ ID NO: 352587 - RNA, 23 nt, Human
gagguugcagugagccaagauug

SEQ ID NO: 352588 - RNA, 21 nt, Human
gaucaacugaggucaggaguu

SEQ ID NO: 352589 - RNA, 24 nt, Human
gaucaacugaggucaggaguuuga

SEQ ID NO: 352590 - RNA, 22 nt, Human
gaucacgaggucaggaguucaa

SEQ ID NO: 352591 - RNA, 24 nt, Human
gaucacgaggucaggaguucaaga

SEQ ID NO: 352592 - RNA, 24 nt, Human
gaucacgaggucaggaguucaaga

SEQ ID NO: 352593 - RNA, 24 nt, Human
gcacuccagccuggacaacagagc

SEQ ID NO: 352594 - RNA, 23 nt, Human
gcacuccagccuggcaacagagu

SEQ ID NO: 352595 - RNA, 20 nt, Human
gccaagaucgugccacugca

SEQ ID NO: 352596 - RNA, 22 nt, Human
gccgggcacggugguucaugcc

SEQ ID NO: 352597 - RNA, 23 nt, Human
gccuauaaucucagcuacucggg

SEQ ID NO: 352598 - RNA, 21 nt, Human
gccugcacaacaggagcaaga

SEQ ID NO: 352599 - RNA, 21 nt, Human
gcgaaaccccgucucuacuaa

SEQ ID NO: 352600 - RNA, 25 nt, Human
ggacaucuggcaauaucuggagaca

SEQ ID NO: 352601 - RNA, 18 nt, Human
ggagguugcagugagcca

SEQ ID NO: 352602 - RNA, 20 nt, Human
ggagguugcagugagccaag

SEQ ID NO: 352603 - RNA, 20 nt, Human
ggagguugcagugagccaag

SEQ ID NO: 352604 - RNA, 22 nt, Human
ggagguugcagugagccaagau

SEQ ID NO: 352605 - RNA, 24 nt, Human
ggagguugcagugagccaagaucg

SEQ ID NO: 352606 - RNA, 24 nt, Human
ggagguugcagugagccaagauug

SEQ ID NO: 352607 - RNA, 19 nt, Human
ggcaacagagugagacucu

SEQ ID NO: 352608 - RNA, 23 nt, Human
ggcacgguggcucacaccuguaa

SEQ ID NO: 352609 - RNA, 23 nt, Human
ggcacgguggcucacgccuguaa

SEQ ID NO: 352610 - RNA, 23 nt, Human
ggcacggugguucaugccuguaa

SEQ ID NO: 352611 - RNA, 23 nt, Human
ggcagaucacgaggucaggaguu

SEQ ID NO: 352612 - RNA, 20 nt, Human
ggccaaaauagcgaaacccc

SEQ ID NO: 352613 - RNA, 21 nt, Human
ggccgggcacgguggcucaca

SEQ ID NO: 352614 - RNA, 22 nt, Human
ggcgugguggcacgcgccugua

SEQ ID NO: 352615 - RNA, 23 nt, Human
ggcucacacgccuguaaucccag

SEQ ID NO: 352616 - RNA, 21 nt, Human
ggcucacgccuguaaucccag

SEQ ID NO: 352617 - RNA, 26 nt, Human
gggcgugguggcucacacgccuguaa

SEQ ID NO: 352618 - RNA, 24 nt, Human
ggguggaucacgaggucaggaguu

SEQ ID NO: 352619 - RNA, 21 nt, Human
gguggaucaacugaggucagg

SEQ ID NO: 352620 - RNA, 24 nt, Human
gguggcacgcgccuguagucccag

SEQ ID NO: 352621 - RNA, 23 nt, Human
gguggcucacaccuguaauccca

SEQ ID NO: 352622 - RNA, 24 nt, Human
gguggcucacaccuguaaucccag

SEQ ID NO: 352623 - RNA, 26 nt, Human
gguggcucacacgccuguaaucccag

SEQ ID NO: 352624 - RNA, 23 nt, Human
gguggcucacgccuguaauccca

SEQ ID NO: 352625 - RNA, 24 nt, Human
gguggcucacgccuguaaucccag

SEQ ID NO: 352626 - RNA, 24 nt, Human
gguggugcacgccuauaaucucag

SEQ ID NO: 352627 - RNA, 24 nt, Human
gguggugcaugccuguaaucccag

SEQ ID NO: 352628 - RNA, 21 nt, Human
ggugguucaugccuguaaucc

SEQ ID NO: 352629 - RNA, 24 nt, Human
ggugguucaugccuguaauccuag

SEQ ID NO: 352630 - RNA, 22 nt, Human
guggaucaacugaggucaggag

SEQ ID NO: 352631 - RNA, 23 nt, Human
guggaucacgaggucaggaguuc

SEQ ID NO: 352632 - RNA, 23 nt, Human
guggcucacaccuguaaucccag

SEQ ID NO: 352633 - RNA, 21 nt, Human
uaaaaacacaaaaauuagcca

SEQ ID NO: 352634 - RNA, 21 nt, Human
uaaaaauacaaaaauuagcca

SEQ ID NO: 352635 - RNA, 18 nt, Human
uaagcugagaauacacaa

SEQ ID NO: 352636 - RNA, 21 nt, Human
uaaucaaguaacuuacaaugu

SEQ ID NO: 352637 - RNA, 22 nt, Human
uaaugaacucuuuauaaauaac

SEQ ID NO: 352638 - RNA, 21 nt, Human
uacacauuccugaguauacac

SEQ ID NO: 352639 - RNA, 24 nt, Human
uagcacuuugggaggcugaggcgg

SEQ ID NO: 352640 - RNA, 20 nt, Human
uagccgggcgugguggcacg

SEQ ID NO: 352641 - RNA, 22 nt, Human
uaucagaaaaaaaaaaaaaaaa

SEQ ID NO: 352642 - RNA, 26 nt, Human
uaucagaaaaaaaaaaaaaaaaaaaa

SEQ ID NO: 352643 - RNA, 20 nt, Human
uauuuuggaauuuucugcau

SEQ ID NO: 352644 - RNA, 25 nt, Human
ucaaaaaaaaaaaaaaaaccccaaa

SEQ ID NO: 352645 - RNA, 19 nt, Human
ucaaaagcuuauuccuggc

SEQ ID NO: 352646 - RNA, 22 nt, Human
ucacacgccuguaaucccagca

SEQ ID NO: 352647 - RNA, 21 nt, Human
ucacgaggucaggaguucaag

SEQ ID NO: 352648 - RNA, 24 nt, Human
ucacgaggucaggaguucaagacc

SEQ ID NO: 352649 - RNA, 24 nt, Human
ucacgaggucaggaguucaagacc

SEQ ID NO: 352650 - RNA, 22 nt, Human
ucacgccuguaaucccaguacu

SEQ ID NO: 352651 - RNA, 22 nt, Human
ucagaaaaaaaaaaaaaaaaaa

SEQ ID NO: 352652 - RNA, 23 nt, Human
ucaugccuguaauccuagcacuu

SEQ ID NO: 352653 - RNA, 23 nt, Human
uccaagaggacaucuggcaauau

SEQ ID NO: 352654 - RNA, 22 nt, Human
uccagccuggcaacagagugag

SEQ ID NO: 352655 - RNA, 23 nt, Human
uccagccuggcaacagagugaga

SEQ ID NO: 352656 - RNA, 20 nt, Human
uccaggcuauuuaaucaagu

SEQ ID NO: 352657 - RNA, 23 nt, Human
uccaucucaaaaaaaaaaaaaaa

SEQ ID NO: 352658 - RNA, 19 nt, Human
uccuggccgggcacggugg

SEQ ID NO: 352659 - RNA, 24 nt, Human
ucgccugaaccugggaggcggagg

SEQ ID NO: 352660 - RNA, 25 nt, Human
ucgccugaaccugggaggcggaggu

SEQ ID NO: 352661 - RNA, 23 nt, Human
ucgggaggcugaagaaggagaau

SEQ ID NO: 352662 - RNA, 23 nt, Human
ucgggaggcugaagaaggagaau

SEQ ID NO: 352663 - RNA, 21 nt, Human
ucucaaaaaaaaaaaaagcga

SEQ ID NO: 352664 - RNA, 21 nt, Human
ucucuacuaaaaacacaaaaa

SEQ ID NO: 352665 - RNA, 21 nt, Human
ucucuacuaaaaauacaaaaa

SEQ ID NO: 352666 - RNA, 21 nt, Human
ucucuacuaaaaauacaaaaa

SEQ ID NO: 352667 - RNA, 19 nt, Human
ucuggcaauaucuggagac

SEQ ID NO: 352668 - RNA, 21 nt, Human
ucugguguaucaccuaaaaga

SEQ ID NO: 352669 - RNA, 22 nt, Human
ucuguggaucucaacccggagc

SEQ ID NO: 352670 - RNA, 22 nt, Human
ucuuugguugucacacuugggg

SEQ ID NO: 352671 - RNA, 24 nt, Human
ugaaccugggaggcggagguugca

SEQ ID NO: 352672 - RNA, 24 nt, Human
ugaagaaggagaauugcuugaacc

SEQ ID NO: 352673 - RNA, 24 nt, Human
ugaagaaggagaauugcuugaacc

SEQ ID NO: 352674 - RNA, 23 nt, Human
ugaauuggguaagucaaaagcuu

SEQ ID NO: 352675 - RNA, 24 nt, Human
ugaccaauauggugaaacccuguc

SEQ ID NO: 352676 - RNA, 24 nt, Human
ugaccaauauggugaaacccuguc

SEQ ID NO: 352677 - RNA, 22 nt, Human
ugagccaagaucgugccacugc

SEQ ID NO: 352678 - RNA, 22 nt, Human
ugagccaagauugcgccacugc

SEQ ID NO: 352679 - RNA, 20 nt, Human
ugaggcaggagaaucgccug

SEQ ID NO: 352680 - RNA, 24 nt, Human
ugaggcaggagaaucgccugaacc

SEQ ID NO: 352681 - RNA, 25 nt, Human
ugaggcaggagaaucgccugaaccu

SEQ ID NO: 352682 - RNA, 22 nt, Human
ugaggcaggagaauugcuugaa

SEQ ID NO: 352683 - RNA, 25 nt, Human
ugaggcaggagaauugcuugaaguc

SEQ ID NO: 352684 - RNA, 26 nt, Human
ugaggcaggagaauugcuugaaguca

SEQ ID NO: 352685 - RNA, 27 nt, Human
ugaggcaggagaauugcuugaagucag

SEQ ID NO: 352686 - RNA, 22 nt, Human
ugaggcggguggaucaacugag

SEQ ID NO: 352687 - RNA, 24 nt, Human
ugaggcggguggaucaacugaggu

SEQ ID NO: 352688 - RNA, 26 nt, Human
ugaggcggguggaucaacugagguca

SEQ ID NO: 352689 - RNA, 18 nt, Human
ugaggucaggaguuugaa

SEQ ID NO: 352690 - RNA, 23 nt, Human
ugaggucaggaguuugaaaccag

SEQ ID NO: 352691 - RNA, 20 nt, Human
ugagguggguggaucacgag

SEQ ID NO: 352692 - RNA, 21 nt, Human
ugagguggguggaucacgagg

SEQ ID NO: 352693 - RNA, 24 nt, Human
ugagguggguggaucacgagguca

SEQ ID NO: 352694 - RNA, 23 nt, Human
ugagguggguggaucacgagguu

SEQ ID NO: 352695 - RNA, 22 nt, Human
ugcacuccagccuggacaacag

SEQ ID NO: 352696 - RNA, 22 nt, Human
ugcacuccagccuggacaacag

SEQ ID NO: 352697 - RNA, 21 nt, Human
ugcauaaugucaacguaugug

SEQ ID NO: 352698 - RNA, 23 nt, Human
ugccuguaaucccagcuacucgg

SEQ ID NO: 352699 - RNA, 24 nt, Human
ugccuguaaucccagcuacucggg

SEQ ID NO: 352700 - RNA, 23 nt, Human
ugccuguaauccuagcacuuugg

SEQ ID NO: 352701 - RNA, 23 nt, Human
ugccuguaauccuagcacuuugg

SEQ ID NO: 352702 - RNA, 18 nt, Human
ugccuuacaauuuuuuac

SEQ ID NO: 352703 - RNA, 23 nt, Human
uggaucaacugaggucaggaguu

SEQ ID NO: 352704 - RNA, 24 nt, Human
uggaucaacugaggucaggaguuu

SEQ ID NO: 352705 - RNA, 22 nt, Human
uggaucacgaggucaggaguuc

SEQ ID NO: 352706 - RNA, 26 nt, Human
uggcaauaucuggagacaucuuuggu

SEQ ID NO: 352707 - RNA, 21 nt, Human
uggcacgcgccuguaguccca

SEQ ID NO: 352708 - RNA, 24 nt, Human
uggccgggcacggugguucaugcc

SEQ ID NO: 352709 - RNA, 21 nt, Human
uggcucacaccuguaauccca

SEQ ID NO: 352710 - RNA, 22 nt, Human
uggcucacaccuguaaucccag

SEQ ID NO: 352711 - RNA, 24 nt, Human
uggcucacaccuguaaucccagca

SEQ ID NO: 352712 - RNA, 24 nt, Human
uggcucacacgccuguaaucccag

SEQ ID NO: 352713 - RNA, 26 nt, Human
uggcucacacgccuguaaucccagca

SEQ ID NO: 352714 - RNA, 22 nt, Human
uggcucacgccuguaaucccag

SEQ ID NO: 352715 - RNA, 24 nt, Human
ugggaggccaaggcgggcagauca

SEQ ID NO: 352716 - RNA, 29 nt, Human
ugggaggcggagguugcagugacaacggu

SEQ ID NO: 352717 - RNA, 24 nt, Human
ugggaggcggagguugcagugagc

SEQ ID NO: 352718 - RNA, 19 nt, Human
ugggaggcugaggcaggag

SEQ ID NO: 352719 - RNA, 22 nt, Human
ugggaggcugaggcaggagaau

SEQ ID NO: 352720 - RNA, 20 nt, Human
ugggaggcugaggcgggugg

SEQ ID NO: 352721 - RNA, 23 nt, Human
ugggaggcugaggcggguggauc

SEQ ID NO: 352722 - RNA, 24 nt, Human
ugggaggcugaggcggguggauca

SEQ ID NO: 352723 - RNA, 26 nt, Human
uggguggaucacgaggucaggaguuc

SEQ ID NO: 352724 - RNA, 21 nt, Human
uggugcaugccuguaauccca

SEQ ID NO: 352725 - RNA, 22 nt, Human
uggugcaugccuguaaucccag

SEQ ID NO: 352726 - RNA, 24 nt, Human
ugguggcacgcgccuguaguccca

SEQ ID NO: 352727 - RNA, 26 nt, Human
ugguggcucacacgccuguaauccca

SEQ ID NO: 352728 - RNA, 24 nt, Human
ugguggugcaugccuguaauccca

SEQ ID NO: 352729 - RNA, 24 nt, Human
ugguucaugccuguaauccuagca

SEQ ID NO: 352730 - RNA, 23 nt, Human
uguguauacugccuauacauuuu

SEQ ID NO: 352731 - RNA, 24 nt, Human
uuagccaggugugguggugcacgc

SEQ ID NO: 352732 - RNA, 24 nt, Human
uuagccaggugugguggugcaugc

SEQ ID NO: 352733 - RNA, 18 nt, Human
uuagccgggcgugguggc

SEQ ID NO: 352734 - RNA, 20 nt, Human
uuagccgggcgugguggcac

SEQ ID NO: 352735 - RNA, 25 nt, Human
uuccugagguggguggaucacgagg

SEQ ID NO: 352736 - RNA, 21 nt, Human
uuccugaguauacaccauugu

SEQ ID NO: 352737 - RNA, 20 nt, Human
uucuuugacaacaauacuaa

SEQ ID NO: 352738 - RNA, 24 nt, Human
uugaacccaggagguggagguugc

SEQ ID NO: 352739 - RNA, 24 nt, Human
uugaacccgggagguggagguugc

SEQ ID NO: 352740 - RNA, 22 nt, Human
uugcagugagccaagacugugc

SEQ ID NO: 352741 - RNA, 22 nt, Human
uugcagugagccaagaucgugc

SEQ ID NO: 352742 - RNA, 22 nt, Human
uugcagugagccaagauugcgc

SEQ ID NO: 352743 - RNA, 23 nt, Human
uugcgccacugcacuccagccug

SEQ ID NO: 352744 - RNA, 24 nt, Human
uugcuugaacccaggagguggagg

SEQ ID NO: 352745 - RNA, 24 nt, Human
uugcuugaacccgggagguggagg

SEQ ID NO: 352746 - RNA, 23 nt, Human
uuggaggcugaggcaggagaauc

SEQ ID NO: 352747 - RNA, 23 nt, Human
uugggaggcugaggcaggagaau

SEQ ID NO: 352748 - RNA, 25 nt, Human
uugggaggcugaggcggguggauca

SEQ ID NO: 352749 - RNA, 19 nt, Human
uuuagcucuguggaucuca

SEQ ID NO: 352750 - RNA, 23 nt, Human
uuucaugguugggcacgguggcu

SEQ ID NO: 352751 - RNA, 24 nt, Human
uuuuacaaguacgaguaucaacag

SEQ ID NO: 352752 - RNA, 18 nt, Human
aaaaaagaagaagagagc

SEQ ID NO: 352753 - RNA, 22 nt, Human
aaaaaaguaacaaauccuuagu

SEQ ID NO: 352754 - RNA, 19 nt, Human
aaaaaccaaacccaacucc

SEQ ID NO: 352755 - RNA, 18 nt, Human
aaaaacccaccaaugcua

SEQ ID NO: 352756 - RNA, 20 nt, Human
aaaaacccaccaaugcuacc

SEQ ID NO: 352757 - RNA, 22 nt, Human
aaaaacccaccaaugcuaccuc

SEQ ID NO: 352758 - RNA, 27 nt, Human
aaaaagaaaugcaaaguaaaauaaauc

SEQ ID NO: 352759 - RNA, 18 nt, Human
aaaaagaagaagagagca

SEQ ID NO: 352760 - RNA, 23 nt, Human
aaaaauuccugggacaaggcaau

SEQ ID NO: 352761 - RNA, 23 nt, Human
aaaacaaacaagcaaauuacaga

SEQ ID NO: 352762 - RNA, 24 nt, Human
aaaagaaaaaaaaaagccacugaa

SEQ ID NO: 352763 - RNA, 20 nt, Human
aaaagaagaagagagcaaag

SEQ ID NO: 352764 - RNA, 23 nt, Human
aaacaagcaaauuacagaguagg

SEQ ID NO: 352765 - RNA, 29 nt, Human
aaacacagagacagaaaaaaagggacccc

SEQ ID NO: 352766 - RNA, 22 nt, Human
aaacagaaacugaaacuucaaa

SEQ ID NO: 352767 - RNA, 22 nt, Human
aaagaaaaaaaaaagccacuga

SEQ ID NO: 352768 - RNA, 23 nt, Human
aaagaaguaaagcucacaaaaaa

SEQ ID NO: 352769 - RNA, 22 nt, Human
aaagacaaagcaaaauaaaaaa

SEQ ID NO: 352770 - RNA, 18 nt, Human
aaagggugcuugguugug

SEQ ID NO: 352771 - RNA, 21 nt, Human
aaauauccagcugucacugaa

SEQ ID NO: 352772 - RNA, 20 nt, Human
aaaucucuacauguaagaga

SEQ ID NO: 352773 - RNA, 22 nt, Human
aacaaaauauccagcugucacu

SEQ ID NO: 352774 - RNA, 20 nt, Human
aacaaaccaaaugcacaaga

SEQ ID NO: 352775 - RNA, 21 nt, Human
aacacagagacagaaaaaaaa

SEQ ID NO: 352776 - RNA, 21 nt, Human
aacacugguuugaagaaugaa

SEQ ID NO: 352777 - RNA, 22 nt, Human
aaccaaacccaacuccuauuug

SEQ ID NO: 352778 - RNA, 21 nt, Human
aaccuuuauacugcauuucau

SEQ ID NO: 352779 - RNA, 22 nt, Human
aacuugcaacuggguuuuccuu

SEQ ID NO: 352780 - RNA, 25 nt, Human
aagaaaaggaaauucagaacauuaa

SEQ ID NO: 352781 - RNA, 18 nt, Human
aagaaguaaagcucacaa

SEQ ID NO: 352782 - RNA, 21 nt, Human
aagagaccaaacaagucucac

SEQ ID NO: 352783 - RNA, 19 nt, Human
aagauuaauaauuuauaaa

SEQ ID NO: 352784 - RNA, 25 nt, Human
aagccaagaaaaggaaauucagaac

SEQ ID NO: 352785 - RNA, 20 nt, Human
aaguagaaacaagccaagaa

SEQ ID NO: 352786 - RNA, 19 nt, Human
aaguauauuccauuccaaa

SEQ ID NO: 352787 - RNA, 21 nt, Human
aaugugcaugugaaauguuag

SEQ ID NO: 352788 - RNA, 20 nt, Human
acaaaauaccauuaccaaaa

SEQ ID NO: 352789 - RNA, 18 nt, Human
acaaagcaaaauaaaaaa

SEQ ID NO: 352790 - RNA, 21 nt, Human
acaacuucauauauaaaagcc

SEQ ID NO: 352791 - RNA, 22 nt, Human
acaaggcaaugcauaaacaaac

SEQ ID NO: 352792 - RNA, 23 nt, Human
acagaaacugaaacuucaaacac

SEQ ID NO: 352793 - RNA, 18 nt, Human
acagcauacaggauaacc

SEQ ID NO: 352794 - RNA, 20 nt, Human
acaggcuggugaacaccacc

SEQ ID NO: 352795 - RNA, 22 nt, Human
acaggguuuuacugucaucaag

SEQ ID NO: 352796 - RNA, 21 nt, Human
acaguacagagacagaauggc

SEQ ID NO: 352797 - RNA, 21 nt, Human
accaacaaaccaaaugcacaa

SEQ ID NO: 352798 - RNA, 23 nt, Human
accucaguuaccucuuugaguug

SEQ ID NO: 352799 - RNA, 22 nt, Human
acuccauauggcacugaaacaa

SEQ ID NO: 352800 - RNA, 18 nt, Human
acuuaguccauccucugg

SEQ ID NO: 352801 - RNA, 25 nt, Human
agaaaaaaaaaaaaaaacccaccaa

SEQ ID NO: 352802 - RNA, 18 nt, Human
agaaagacaaagcaaaau

SEQ ID NO: 352803 - RNA, 22 nt, Human
agacaaagcaaaauaaaaaaaa

SEQ ID NO: 352804 - RNA, 23 nt, Human
agacagaaaaaaaaaaaaaaacc

SEQ ID NO: 352805 - RNA, 25 nt, Human
agacagaaaaaaaaaaaaagggacc

SEQ ID NO: 352806 - RNA, 24 nt, Human
agcaguaccuccuuuugaacugau

SEQ ID NO: 352807 - RNA, 19 nt, Human
agccaagaaaaggaaauuc

SEQ ID NO: 352808 - RNA, 29 nt, Human
aggcaggaagacagacuagaagggacccc

SEQ ID NO: 352809 - RNA, 19 nt, Human
aggcaggcauugccccagg

SEQ ID NO: 352810 - RNA, 19 nt, Human
agggugcuugguugugguc

SEQ ID NO: 352811 - RNA, 19 nt, Human
aggguggauggcagaagaa

SEQ ID NO: 352812 - RNA, 20 nt, Human
agugagaaaauggugacuau

SEQ ID NO: 352813 - RNA, 20 nt, Human
aguggaaucuuuauuucaca

SEQ ID NO: 352814 - RNA, 21 nt, Human
aguuagacauuaauacacaug

SEQ ID NO: 352815 - RNA, 20 nt, Human
aucagaguucuacucaaaag

SEQ ID NO: 352816 - RNA, 21 nt, Human
auccaaagaaagauagcugga

SEQ ID NO: 352817 - RNA, 24 nt, Human
auccaaagaaagauagcuggauac

SEQ ID NO: 352818 - RNA, 20 nt, Human
auccuuuucaugcacacaac

SEQ ID NO: 352819 - RNA, 23 nt, Human
aucguaguaccccaaccagaguu

SEQ ID NO: 352820 - RNA, 25 nt, Human
augaacaaaaaagaagaagagagca

SEQ ID NO: 352821 - RNA, 18 nt, Human
auguguaauacauauaua

SEQ ID NO: 352822 - RNA, 21 nt, Human
caaacacagagacagaaaaaa

SEQ ID NO: 352823 - RNA, 21 nt, Human
caaaccaaaugcacaagagaa

SEQ ID NO: 352824 - RNA, 20 nt, Human
caaaguacuguaccaacugc

SEQ ID NO: 352825 - RNA, 23 nt, Human
caaccagaguucguuuuguuuuc

SEQ ID NO: 352826 - RNA, 28 nt, Human
caacuucaaaaaucaaagcaguacaacu

SEQ ID NO: 352827 - RNA, 19 nt, Human
caagacagucggcuaacca

SEQ ID NO: 352828 - RNA, 23 nt, Human
caagacagucggcuaaccaacaa

SEQ ID NO: 352829 - RNA, 20 nt, Human
caauccugaagcauaguagc

SEQ ID NO: 352830 - RNA, 20 nt, Human
cacaauaccuuaaagauggu

SEQ ID NO: 352831 - RNA, 26 nt, Human
cacagagacagaaaaaaaaaaaaaaa

SEQ ID NO: 352832 - RNA, 19 nt, Human
caccaauaagaaaccuccc

SEQ ID NO: 352833 - RNA, 21 nt, Human
caccaauaagaaaccucccaa

SEQ ID NO: 352834 - RNA, 18 nt, Human
cacugacugugcucccac

SEQ ID NO: 352835 - RNA, 18 nt, Human
cagcagauaacuuccuuc

SEQ ID NO: 352836 - RNA, 21 nt, Human
cagccuguuucucaaaccaaa

SEQ ID NO: 352837 - RNA, 24 nt, Human
cagccuuagguggcacacacuguu

SEQ ID NO: 352838 - RNA, 18 nt, Human
cagucucagacaagauac

SEQ ID NO: 352839 - RNA, 19 nt, Human
cauaguagccuugauuuuc

SEQ ID NO: 352840 - RNA, 21 nt, Human
caucagaucaucaccagauca

SEQ ID NO: 352841 - RNA, 22 nt, Human
caucuggggucacugacugugc

SEQ ID NO: 352842 - RNA, 23 nt, Human
caugagaaaaaauugugugguuu

SEQ ID NO: 352843 - RNA, 25 nt, Human
cauuaaaaaauuggauucauucagc

SEQ ID NO: 352844 - RNA, 20 nt, Human
cauuucuuagcaaauucaug

SEQ ID NO: 352845 - RNA, 23 nt, Human
ccaaagaaguaaagcucacaaaa

SEQ ID NO: 352846 - RNA, 24 nt, Human
ccaaccagaguucguuuuguuuuc

SEQ ID NO: 352847 - RNA, 25 nt, Human
ccaacccucccuuuuaaaauaacaa

SEQ ID NO: 352848 - RNA, 21 nt, Human
ccaaccuaaacuagcaucaua

SEQ ID NO: 352849 - RNA, 18 nt, Human
ccacaaguacaauuugag

SEQ ID NO: 352850 - RNA, 19 nt, Human
ccacaagugaauguuuuca

SEQ ID NO: 352851 - RNA, 20 nt, Human
ccacacauuuaaaauccaga

SEQ ID NO: 352852 - RNA, 23 nt, Human
ccagaaaagaaaaaaaaaagcca

SEQ ID NO: 352853 - RNA, 24 nt, Human
cccauacuauuuaaccagacaauc

SEQ ID NO: 352854 - RNA, 18 nt, Human
cccaugaacaaaaaagaa

SEQ ID NO: 352855 - RNA, 21 nt, Human
cccugcacauaaccaaggaau

SEQ ID NO: 352856 - RNA, 22 nt, Human
ccucccaacccucccuuuuaaa

SEQ ID NO: 352857 - RNA, 21 nt, Human
ccugcaugcauacuuccaaaa

SEQ ID NO: 352858 - RNA, 19 nt, Human
ccuugugccgugccucuuc

SEQ ID NO: 352859 - RNA, 22 nt, Human
ccuugugccgugccucuucugg

SEQ ID NO: 352860 - RNA, 21 nt, Human
cuaaccaacaaaccaaaugca

SEQ ID NO: 352861 - RNA, 25 nt, Human
cucaaaccaaauaggaaaaacagcc

SEQ ID NO: 352862 - RNA, 21 nt, Human
cugaaacuucaaacacagaga

SEQ ID NO: 352863 - RNA, 22 nt, Human
cugcuguaacuuaaucuaagca

SEQ ID NO: 352864 - RNA, 20 nt, Human
cuuaccagguuucccauaau

SEQ ID NO: 352865 - RNA, 23 nt, Human
cuucuacauauuuauagugguua

SEQ ID NO: 352866 - RNA, 19 nt, Human
cuuugauucucugaguuuu

SEQ ID NO: 352867 - RNA, 20 nt, Human
gaaauucugauuuuuuuuac

SEQ ID NO: 352868 - RNA, 23 nt, Human
gagaaagacaaagcaaaauaaaa

SEQ ID NO: 352869 - RNA, 26 nt, Human
gcaauaaaagggccauacauuuugaa

SEQ ID NO: 352870 - RNA, 30 nt, Human
gcacucaaaucucuacauguaagagaccaa

SEQ ID NO: 352871 - RNA, 22 nt, Human
gcagcaagugacccaggguuaa

SEQ ID NO: 352872 - RNA, 23 nt, Human
gcuggaacauuuuaccucaguua

SEQ ID NO: 352873 - RNA, 21 nt, Human
ggaaagggugcuugguugugg

SEQ ID NO: 352874 - RNA, 19 nt, Human
ggauucauucagcuuaaaa

SEQ ID NO: 352875 - RNA, 19 nt, Human
guaaaauaaaacuagaagc

SEQ ID NO: 352876 - RNA, 18 nt, Human
guacucaauggagggaag

SEQ ID NO: 352877 - RNA, 18 nt, Human
guagucacuguaagccau

SEQ ID NO: 352878 - RNA, 24 nt, Human
gucaaggucaucuggggucacuga

SEQ ID NO: 352879 - RNA, 23 nt, Human
gucaucuuugauuuacuuuuucu

SEQ ID NO: 352880 - RNA, 23 nt, Human
gucucugcaaguccucuuaaaaa

SEQ ID NO: 352881 - RNA, 20 nt, Human
guugccacaguuugcaucau

SEQ ID NO: 352882 - RNA, 23 nt, Human
guuuuguuuucuaauuucuccca

SEQ ID NO: 352883 - RNA, 20 nt, Human
uaaaacuagaagcaaaauga

SEQ ID NO: 352884 - RNA, 19 nt, Human
uaaaauccagaucgugccu

SEQ ID NO: 352885 - RNA, 23 nt, Human
uaaaaugaaguagaaacaagcca

SEQ ID NO: 352886 - RNA, 21 nt, Human
uaaaucaucagaucaucacca

SEQ ID NO: 352887 - RNA, 21 nt, Human
uaacagugagaaaauggugac

SEQ ID NO: 352888 - RNA, 21 nt, Human
uaagagaccaaacaagucuca

SEQ ID NO: 352889 - RNA, 24 nt, Human
uaaguauauuccauuccaaagaag

SEQ ID NO: 352890 - RNA, 22 nt, Human
uaauacacaugcuauacacaua

SEQ ID NO: 352891 - RNA, 23 nt, Human
uacaaauucaguuuaagcuguaa

SEQ ID NO: 352892 - RNA, 21 nt, Human
uacaagaguugccuaaagcaa

SEQ ID NO: 352893 - RNA, 18 nt, Human
uacagagacagaauggcu

SEQ ID NO: 352894 - RNA, 21 nt, Human
uacaggauaaccaaaagugga

SEQ ID NO: 352895 - RNA, 22 nt, Human
uacaggcuggugaacaccacca

SEQ ID NO: 352896 - RNA, 18 nt, Human
uacauguaagagaccaaa

SEQ ID NO: 352897 - RNA, 18 nt, Human
uaccuagaaaacagaaac

SEQ ID NO: 352898 - RNA, 19 nt, Human
uacgugucucugcaagucc

SEQ ID NO: 352899 - RNA, 23 nt, Human
uacgugucucugcaaguccucuu

SEQ ID NO: 352900 - RNA, 20 nt, Human
uagaaaacagaaacugaagg

SEQ ID NO: 352901 - RNA, 21 nt, Human
uaggaaaaacagcaugugaga

SEQ ID NO: 352902 - RNA, 21 nt, Human
uaggagagaugggcuaccaug

SEQ ID NO: 352903 - RNA, 18 nt, Human
uagguaccaugucccaug

SEQ ID NO: 352904 - RNA, 18 nt, Human
uaugaacaacaagacugc

SEQ ID NO: 352905 - RNA, 24 nt, Human
uauggcacugaaacaaacauucag

SEQ ID NO: 352906 - RNA, 28 nt, Human
ucaaaacaaacaagcaaauuacagagua

SEQ ID NO: 352907 - RNA, 18 nt, Human
ucaaaauauaauacuacc

SEQ ID NO: 352908 - RNA, 24 nt, Human
ucaaaauauaauacuaccaauaaa

SEQ ID NO: 352909 - RNA, 21 nt, Human
ucaaaccaaauaggaaaaaca

SEQ ID NO: 352910 - RNA, 19 nt, Human
ucaaagcacguacucaaug

SEQ ID NO: 352911 - RNA, 24 nt, Human
ucacuauuuacaagaguugccuaa

SEQ ID NO: 352912 - RNA, 20 nt, Human
ucagaaacaaaauauccagc

SEQ ID NO: 352913 - RNA, 22 nt, Human
ucauaaaggaaguuaggaaaga

SEQ ID NO: 352914 - RNA, 20 nt, Human
uccaaagaaagauagcugga

SEQ ID NO: 352915 - RNA, 23 nt, Human
ucccauacuauuuaaccagacaa

SEQ ID NO: 352916 - RNA, 21 nt, Human
uccucuggcuucuggaucaag

SEQ ID NO: 352917 - RNA, 22 nt, Human
uccucuuaaaaaauuccuggga

SEQ ID NO: 352918 - RNA, 21 nt, Human
ucgaauuuggaagcaauuauc

SEQ ID NO: 352919 - RNA, 18 nt, Human
ucuaccaugguguuccuu

SEQ ID NO: 352920 - RNA, 18 nt, Human
ucugggaaaaaagcauga

SEQ ID NO: 352921 - RNA, 23 nt, Human
ucuguuauauucaaaacaaacaa

SEQ ID NO: 352922 - RNA, 26 nt, Human
ucuucaguuuuuuucccauacuauuu

SEQ ID NO: 352923 - RNA, 22 nt, Human
ucuuugaaggagaggaguaugg

SEQ ID NO: 352924 - RNA, 18 nt, Human
ucuuugauuuacuuuuuc

SEQ ID NO: 352925 - RNA, 19 nt, Human
ucuuugauuuacuuuuucu

SEQ ID NO: 352926 - RNA, 27 nt, Human
ugaaacaaacauucagcucaguuuagg

SEQ ID NO: 352927 - RNA, 21 nt, Human
ugaaacuucaaacacagagac

SEQ ID NO: 352928 - RNA, 22 nt, Human
ugaaacuucaaacacagagaca

SEQ ID NO: 352929 - RNA, 24 nt, Human
ugaacaggcaggcauugccccagg

SEQ ID NO: 352930 - RNA, 21 nt, Human
ugaagaaugaacaugaggaua

SEQ ID NO: 352931 - RNA, 21 nt, Human
ugaauaguauagaacaguaca

SEQ ID NO: 352932 - RNA, 18 nt, Human
ugacacaucuuguuuuga

SEQ ID NO: 352933 - RNA, 19 nt, Human
ugacuaugauagcuaagca

SEQ ID NO: 352934 - RNA, 26 nt, Human
ugagaugauucccugcacauaaccaa

SEQ ID NO: 352935 - RNA, 21 nt, Human
ugagugucucacauauguuuc

SEQ ID NO: 352936 - RNA, 22 nt, Human
ugaguugccugcugggaagcug

SEQ ID NO: 352937 - RNA, 19 nt, Human
ugcaaaaagaaaugcaaag

SEQ ID NO: 352938 - RNA, 22 nt, Human
ugcacaagagaauacuaaacag

SEQ ID NO: 352939 - RNA, 22 nt, Human
ugccauugacugcuaaucaaaa

SEQ ID NO: 352940 - RNA, 22 nt, Human
ugcuaaagggaaaaugaggguu

SEQ ID NO: 352941 - RNA, 21 nt, Human
ugcuaaucaaaaauaagccuu

SEQ ID NO: 352942 - RNA, 23 nt, Human
uggagggaaggaaaguuagauau

SEQ ID NO: 352943 - RNA, 23 nt, Human
uggcagaagaaaaaaagugaaaa

SEQ ID NO: 352944 - RNA, 23 nt, Human
uggugaacaggcaggcauugccc

SEQ ID NO: 352945 - RNA, 22 nt, Human
uguaaaauaaaacuagaagcaa

SEQ ID NO: 352946 - RNA, 22 nt, Human
uguaagagaccaaacaagucuc

SEQ ID NO: 352947 - RNA, 19 nt, Human
uguaauuauguugaaacuc

SEQ ID NO: 352948 - RNA, 25 nt, Human
uguaccaacugcacucaaaucucua

SEQ ID NO: 352949 - RNA, 22 nt, Human
uguagcccacuuccaauugcac

SEQ ID NO: 352950 - RNA, 23 nt, Human
ugucacugaucaaggcuggaccc

SEQ ID NO: 352951 - RNA, 20 nt, Human
ugucuggaaagggugcuugg

SEQ ID NO: 352952 - RNA, 21 nt, Human
ugugcaaaaagaaaugcaaag

SEQ ID NO: 352953 - RNA, 18 nt, Human
uguguaauacauauauau

SEQ ID NO: 352954 - RNA, 22 nt, Human
uguuuaaaagaaauuaacccag

SEQ ID NO: 352955 - RNA, 24 nt, Human
uuaaaagauaacauuucuuagcaa

SEQ ID NO: 352956 - RNA, 21 nt, Human
uuaacccagauaaaaagaauu

SEQ ID NO: 352957 - RNA, 28 nt, Human
uuaacccagauaaaaagaauuuggccuc

SEQ ID NO: 352958 - RNA, 21 nt, Human
uuaggagagaugggcuaccau

SEQ ID NO: 352959 - RNA, 25 nt, Human
uuaucugggaggaaaguuuugcuua

SEQ ID NO: 352960 - RNA, 20 nt, Human
uucagaagcuucugaauuuc

SEQ ID NO: 352961 - RNA, 24 nt, Human
uuccaaagaaguaaagcucacaaa

SEQ ID NO: 352962 - RNA, 23 nt, Human
uucgcugucacugaucaaggcug

SEQ ID NO: 352963 - RNA, 20 nt, Human
uugaaagacaccauucacaa

SEQ ID NO: 352964 - RNA, 18 nt, Human
uugagacagucuuuaagu

SEQ ID NO: 352965 - RNA, 21 nt, Human
uugcacuuuguguacauguuc

SEQ ID NO: 352966 - RNA, 25 nt, Human
uugccacaguuugcaucauguaggc

SEQ ID NO: 352967 - RNA, 21 nt, Human
uugcuaaagggaaaaugaggg

SEQ ID NO: 352968 - RNA, 23 nt, Human
uugcuuagguaccaugucccaug

SEQ ID NO: 352969 - RNA, 18 nt, Human
uuggacuuguaaaaaucu

SEQ ID NO: 352970 - RNA, 20 nt, Human
uuggacuuguaaaaaucuga

SEQ ID NO: 352971 - RNA, 19 nt, Human
uugguugugguauauuaca

SEQ ID NO: 352972 - RNA, 21 nt, Human
uuuaggaaaaguaugucugug

SEQ ID NO: 352973 - RNA, 22 nt, Human
uuucagaaacaaaauauccagc

SEQ ID NO: 352974 - RNA, 21 nt, Human
uuucuggcagaugagggauuc

SEQ ID NO: 352975 - RNA, 22 nt, Human
uuuguagcccacuuccaauugc

SEQ ID NO: 352976 - RNA, 21 nt, Human
uuuuauuuuucguaguuucua

SEQ ID NO: 352977 - RNA, 25 nt, Human
uuuuccuuuuuaacacugaucaguu

SEQ ID NO: 352978 - RNA, 25 nt, Human
uuuucuggcagaugagggauucugg

SEQ ID NO: 352979 - RNA, 24 nt, Human
uuuuucuuauucguaaaaaaauac

SEQ ID NO: 352980 - RNA, 23 nt, Human
aaaaacaacuguaguaaaaacac

SEQ ID NO: 352981 - RNA, 20 nt, Human
aaaacucaaacacaaaccac

SEQ ID NO: 352982 - RNA, 21 nt, Human
aaaacucaaacacaaaccaca

SEQ ID NO: 352983 - RNA, 21 nt, Human
aaaagaaagaaagccacaaaa

SEQ ID NO: 352984 - RNA, 24 nt, Human
aaacaaauagggaauaacuauuag

SEQ ID NO: 352985 - RNA, 20 nt, Human
aaacagauguaacauaauua

SEQ ID NO: 352986 - RNA, 22 nt, Human
aaccacacugguauuucacaca

SEQ ID NO: 352987 - RNA, 20 nt, Human
aacccuccaugcauuugccu

SEQ ID NO: 352988 - RNA, 21 nt, Human
aagaguucuuuucacccaaag

SEQ ID NO: 352989 - RNA, 27 nt, Human
aauaaaacucaaacacaaaccacacug

SEQ ID NO: 352990 - RNA, 23 nt, Human
acauaucacaucugacaaacauc

SEQ ID NO: 352991 - RNA, 24 nt, Human
agaaaauauccuuucccuucauua

SEQ ID NO: 352992 - RNA, 19 nt, Human
agaagaaaacaaauaggga

SEQ ID NO: 352993 - RNA, 20 nt, Human
agaguucuuuucacccaaag

SEQ ID NO: 352994 - RNA, 23 nt, Human
agcaagggagaguuagaaaagga

SEQ ID NO: 352995 - RNA, 24 nt, Human
agcacccuaacauacagaagaaaa

SEQ ID NO: 352996 - RNA, 22 nt, Human
agccaacacuuucuugauccug

SEQ ID NO: 352997 - RNA, 19 nt, Human
aggaaagggaacacugagu

SEQ ID NO: 352998 - RNA, 24 nt, Human
aggcaagaagggccagagacccga

SEQ ID NO: 352999 - RNA, 19 nt, Human
aggcaucuggcauaguagg

SEQ ID NO: 353000 - RNA, 25 nt, Human
aguuagaaaaggaauucugagauuu

SEQ ID NO: 353001 - RNA, 23 nt, Human
auccugagaguaggaaagggaac

SEQ ID NO: 353002 - RNA, 22 nt, Human
aucugacaaacaucuuuguagg

SEQ ID NO: 353003 - RNA, 18 nt, Human
auugugcauaguaacccu

SEQ ID NO: 353004 - RNA, 25 nt, Human
caaaaaacaacuguaguaaaaacac

SEQ ID NO: 353005 - RNA, 18 nt, Human
caaaagaaagaaagccac

SEQ ID NO: 353006 - RNA, 22 nt, Human
caaaauauuguguuucugugcc

SEQ ID NO: 353007 - RNA, 19 nt, Human
caaagaaaauaacacugua

SEQ ID NO: 353008 - RNA, 20 nt, Human
caaagcacauccaucuuucu

SEQ ID NO: 353009 - RNA, 20 nt, Human
caagaagggccagagacccg

SEQ ID NO: 353010 - RNA, 19 nt, Human
cauaucacaucugacaaac

SEQ ID NO: 353011 - RNA, 21 nt, Human
cauaucacaucugacaaacau

SEQ ID NO: 353012 - RNA, 22 nt, Human
cauaucacaucugacaaacauc

SEQ ID NO: 353013 - RNA, 21 nt, Human
cauccaucuuucuguauucuu

SEQ ID NO: 353014 - RNA, 23 nt, Human
ccagaguuuuucugccccuuuaa

SEQ ID NO: 353015 - RNA, 21 nt, Human
cccuaacauacagaagaaaac

SEQ ID NO: 353016 - RNA, 18 nt, Human
cucucuuauuucccagag

SEQ ID NO: 353017 - RNA, 19 nt, Human
gaaggccguccuugccugc

SEQ ID NO: 353018 - RNA, 19 nt, Human
gaaguuuuucaucguggaa

SEQ ID NO: 353019 - RNA, 22 nt, Human
gagcacccuaacauacagaaga

SEQ ID NO: 353020 - RNA, 27 nt, Human
gagcacccuaacauacagaagaaaaca

SEQ ID NO: 353021 - RNA, 23 nt, Human
gaguucuuuucacccaaagguuu

SEQ ID NO: 353022 - RNA, 26 nt, Human
gggcauucaacaucugucauuuuuuu

SEQ ID NO: 353023 - RNA, 19 nt, Human
ggugauggguguugcgguu

SEQ ID NO: 353024 - RNA, 18 nt, Human
gugaucaacugaaaacug

SEQ ID NO: 353025 - RNA, 20 nt, Human
uaaaacucaaacacaaacca

SEQ ID NO: 353026 - RNA, 21 nt, Human
uaaaacucaaacacaaaccac

SEQ ID NO: 353027 - RNA, 23 nt, Human
uaaaacucaaacacaaaccacac

SEQ ID NO: 353028 - RNA, 21 nt, Human
uaaaauucucaauaaaacuca

SEQ ID NO: 353029 - RNA, 23 nt, Human
uaaauaaacauaaaugcuugcuc

SEQ ID NO: 353030 - RNA, 22 nt, Human
uaguucaaaacguuuggccuca

SEQ ID NO: 353031 - RNA, 25 nt, Human
ucaaaaaacaacuguaguaaaaaca

SEQ ID NO: 353032 - RNA, 20 nt, Human
ucaguaggauuugcaccauu

SEQ ID NO: 353033 - RNA, 21 nt, Human
ucccagaguuuuucugccccu

SEQ ID NO: 353034 - RNA, 22 nt, Human
uccccagaugcaccuguuucug

SEQ ID NO: 353035 - RNA, 26 nt, Human
uccccagaugcaccuguuucugauuc

SEQ ID NO: 353036 - RNA, 19 nt, Human
uccuuaucacaucucuguu

SEQ ID NO: 353037 - RNA, 22 nt, Human
ucuccaauucuaccauguuuuc

SEQ ID NO: 353038 - RNA, 19 nt, Human
ucucuucaccuuugcuugg

SEQ ID NO: 353039 - RNA, 24 nt, Human
ugaaaacuggagauuccuuuggaa

SEQ ID NO: 353040 - RNA, 24 nt, Human
ugaaauaaauuuaaaacagaugua

SEQ ID NO: 353041 - RNA, 18 nt, Human
ugaagggcaaaagaaaga

SEQ ID NO: 353042 - RNA, 21 nt, Human
ugaagggcaaaagaaagaaag

SEQ ID NO: 353043 - RNA, 20 nt, Human
ugaaguggugauggguguug

SEQ ID NO: 353044 - RNA, 19 nt, Human
ugaucaacugaaaacugga

SEQ ID NO: 353045 - RNA, 18 nt, Human
ugauccuuaucacaucuc

SEQ ID NO: 353046 - RNA, 19 nt, Human
ugccagugaucaacugaaa

SEQ ID NO: 353047 - RNA, 21 nt, Human
uggagauuccuuuggaauugu

SEQ ID NO: 353048 - RNA, 23 nt, Human
uucaaaacguuuggccucaugga

SEQ ID NO: 353049 - RNA, 21 nt, Human
uucaguaggauuugcaccauu

SEQ ID NO: 353050 - RNA, 23 nt, Human
uucauuagccaacacuuucuuga

SEQ ID NO: 353051 - RNA, 24 nt, Human
uucucucuuauuucccagaguuuu

SEQ ID NO: 353052 - RNA, 21 nt, Human
uugcauuuaugcuuuuauuag

SEQ ID NO: 353053 - RNA, 22 nt, Human
uuuaccauaucauaguugacag

SEQ ID NO: 353054 - RNA, 19 nt, Human
uuuugggaagcaguuguuc

SEQ ID NO: 353055 - RNA, 21 nt, Human
uuuuuuuccucuaaacucugg

SEQ ID NO: 353056 - RNA, 18 nt, Human
aagccagguccccaagga

SEQ ID NO: 353057 - RNA, 18 nt, Human
agaaugaagccagguccc

SEQ ID NO: 353058 - RNA, 24 nt, Human
agcagaaugaagccagguccccaa

SEQ ID NO: 353059 - RNA, 22 nt, Human
agggcccaaaauagggagugug

SEQ ID NO: 353060 - RNA, 26 nt, Human
cagcacagugagcaacaagcaacagg

SEQ ID NO: 353061 - RNA, 18 nt, Human
gagggcccaaaauaggga

SEQ ID NO: 353062 - RNA, 20 nt, Human
gccacagucucagcuuggcu

SEQ ID NO: 353063 - RNA, 20 nt, Human
ggcggguuugcugugcuggu

SEQ ID NO: 353064 - RNA, 24 nt, Human
gggagugugggugaugagggugga

SEQ ID NO: 353065 - RNA, 19 nt, Human
uagggagugugggugauga

SEQ ID NO: 353066 - RNA, 21 nt, Human
uaugacucaacacauugccac

SEQ ID NO: 353067 - RNA, 24 nt, Human
uauuucuuggugccuccaagagcu

SEQ ID NO: 353068 - RNA, 18 nt, Human
uccccaaggaagugaggg

SEQ ID NO: 353069 - RNA, 19 nt, Human
ugaaggacaggguuacgag

SEQ ID NO: 353070 - RNA, 21 nt, Human
ugacucaacacauugccacag

SEQ ID NO: 353071 - RNA, 19 nt, Human
ugccaagggucgggugcca

SEQ ID NO: 353072 - RNA, 23 nt, Human
ugccaagggucgggugccaagag

SEQ ID NO: 353073 - RNA, 20 nt, Human
ugguacacuuugaucccggc

SEQ ID NO: 353074 - RNA, 18 nt, Human
uuucuuggugccuccaag

SEQ ID NO: 353075 - RNA, 21 nt, Human
uuuuuuuuuugaaggacaggg

SEQ ID NO: 353076 - RNA, 25 nt, Human
uuuuuuuuuuuugaaggacaggguu

SEQ ID NO: 353077 - RNA, 28 nt, Human
uuuuuuuuuuuuuuuuugaaggacaggg

SEQ ID NO: 353078 - RNA, 22 nt, Human
aaaacaagagucaagaaagagc

SEQ ID NO: 353079 - RNA, 20 nt, Human
aaacguuucauggaaggauu

SEQ ID NO: 353080 - RNA, 24 nt, Human
aaagacaaaaagcugagcuguaua

SEQ ID NO: 353081 - RNA, 28 nt, Human
aaauaggacucuuucaacuugagcagga

SEQ ID NO: 353082 - RNA, 22 nt, Human
aacagcgcaggcuauuucucuc

SEQ ID NO: 353083 - RNA, 21 nt, Human
aacuguuggucagguagaaau

SEQ ID NO: 353084 - RNA, 22 nt, Human
acccccaaacuaaaaaacagcg

SEQ ID NO: 353085 - RNA, 23 nt, Human
acuaauaauaucgugauaaaaga

SEQ ID NO: 353086 - RNA, 20 nt, Human
agaagguggggaggcugaag

SEQ ID NO: 353087 - RNA, 20 nt, Human
agaaguggugggguugaggg

SEQ ID NO: 353088 - RNA, 22 nt, Human
agaaucuagguaaguggauaaa

SEQ ID NO: 353089 - RNA, 19 nt, Human
aggcuauuucucucuucuc

SEQ ID NO: 353090 - RNA, 18 nt, Human
aggucugggggcagggga

SEQ ID NO: 353091 - RNA, 26 nt, Human
agguggcugaagaagguggggaggcu

SEQ ID NO: 353092 - RNA, 20 nt, Human
aguuauaaaagaaguggugg

SEQ ID NO: 353093 - RNA, 24 nt, Human
auuuagaagugucugucaucaagu

SEQ ID NO: 353094 - RNA, 23 nt, Human
caaaacccccaaacuaaaaaaca

SEQ ID NO: 353095 - RNA, 27 nt, Human
cacaugaauccuuucccuuuauggucu

SEQ ID NO: 353096 - RNA, 19 nt, Human
caccuguuuuaacucuucc

SEQ ID NO: 353097 - RNA, 19 nt, Human
cacuugcagcuagcauuuc

SEQ ID NO: 353098 - RNA, 22 nt, Human
cagcaaaacccccaaacuaaaa

SEQ ID NO: 353099 - RNA, 20 nt, Human
cagcgcaggcuauuucucuc

SEQ ID NO: 353100 - RNA, 27 nt, Human
caggcuauuucucucuucucuccuuuu

SEQ ID NO: 353101 - RNA, 23 nt, Human
ccaagaauuuucuuucaccaagg

SEQ ID NO: 353102 - RNA, 20 nt, Human
ccaguuaaauaggauggucc

SEQ ID NO: 353103 - RNA, 19 nt, Human
cccccaaacuaaaaaacag

SEQ ID NO: 353104 - RNA, 22 nt, Human
cccccaaacuaaaaaacagcgc

SEQ ID NO: 353105 - RNA, 19 nt, Human
cucuuccauaugacaucaa

SEQ ID NO: 353106 - RNA, 22 nt, Human
cugaguccauauucacauaugu

SEQ ID NO: 353107 - RNA, 24 nt, Human
cuucccagaugcacugaaggaaac

SEQ ID NO: 353108 - RNA, 21 nt, Human
gaaaacaagagucaagaaaga

SEQ ID NO: 353109 - RNA, 19 nt, Human
gaaaucuucccagaugcac

SEQ ID NO: 353110 - RNA, 20 nt, Human
gagguggcugaagaaggugg

SEQ ID NO: 353111 - RNA, 26 nt, Human
gcaaaacccccaaacuaaaaaacagg

SEQ ID NO: 353112 - RNA, 22 nt, Human
gcaggcuauuucucucuucucu

SEQ ID NO: 353113 - RNA, 19 nt, Human
ggaaaggagagcauuucau

SEQ ID NO: 353114 - RNA, 18 nt, Human
ggaguuagaaagaaagga

SEQ ID NO: 353115 - RNA, 21 nt, Human
guccaauucacagacggcgag

SEQ ID NO: 353116 - RNA, 29 nt, Human
uaaguggauaaaaggucugggggcagggg

SEQ ID NO: 353117 - RNA, 22 nt, Human
uauaagaaauaggaaugggucu

SEQ ID NO: 353118 - RNA, 22 nt, Human
ucccagaugcacugaaggaaac

SEQ ID NO: 353119 - RNA, 19 nt, Human
ucucagguccuugcccaaa

SEQ ID NO: 353120 - RNA, 21 nt, Human
ucuccucagaaaagacaaaaa

SEQ ID NO: 353121 - RNA, 18 nt, Human
ucucuaguucuucugcag

SEQ ID NO: 353122 - RNA, 18 nt, Human
ucucucuucucuccuuuu

SEQ ID NO: 353123 - RNA, 26 nt, Human
ucugcagcccauugagccuugcgugc

SEQ ID NO: 353124 - RNA, 21 nt, Human
ucugggggcaggggaaaggag

SEQ ID NO: 353125 - RNA, 21 nt, Human
ugaagaagguggggaggcuga

SEQ ID NO: 353126 - RNA, 20 nt, Human
ugauaaaagaaacauugacu

SEQ ID NO: 353127 - RNA, 20 nt, Human
ugcaaaauugcauguuacag

SEQ ID NO: 353128 - RNA, 18 nt, Human
ugcaaauaggacucuuuc

SEQ ID NO: 353129 - RNA, 21 nt, Human
ugcuuggcacucaugagaugc

SEQ ID NO: 353130 - RNA, 20 nt, Human
uggaagucagccaacugaaa

SEQ ID NO: 353131 - RNA, 23 nt, Human
uggucuuauuuguuucuccucag

SEQ ID NO: 353132 - RNA, 20 nt, Human
uguuacaggguaaccuuuca

SEQ ID NO: 353133 - RNA, 26 nt, Human
uuagaaagaaaggagagcguagacuu

SEQ ID NO: 353134 - RNA, 18 nt, Human
uucauuuagaagugucug

SEQ ID NO: 353135 - RNA, 21 nt, Human
uucuccucagaaaagacaaaa

SEQ ID NO: 353136 - RNA, 22 nt, Human
uucuucugcagcccauugagcc

SEQ ID NO: 353137 - RNA, 24 nt, Human
uuuaacucuuccauaugacaucaa

SEQ ID NO: 353138 - RNA, 27 nt, Human
uuugcuugguccuucucuaguucuucu

SEQ ID NO: 353139 - RNA, 21 nt, Human
aacaggcugguccagagcuaa

SEQ ID NO: 353140 - RNA, 21 nt, Human
acaggguugguccagagcggg

SEQ ID NO: 353141 - RNA, 18 nt, Human
acuccagaagaugcuaca

SEQ ID NO: 353142 - RNA, 22 nt, Human
acuccagaagaugcuacaggaa

SEQ ID NO: 353143 - RNA, 19 nt, Human
agagaagaggugggacagg

SEQ ID NO: 353144 - RNA, 20 nt, Human
agaggugggacaggaagggg

SEQ ID NO: 353145 - RNA, 24 nt, Human
agcacagagacuacugcagaaaca

SEQ ID NO: 353146 - RNA, 18 nt, Human
aggaaacaggguuggucc

SEQ ID NO: 353147 - RNA, 18 nt, Human
aggaauuucuuccaauua

SEQ ID NO: 353148 - RNA, 19 nt, Human
agguauuuuuauuucucca

SEQ ID NO: 353149 - RNA, 21 nt, Human
caagaggccucaucaacagca

SEQ ID NO: 353150 - RNA, 19 nt, Human
caaguaacaggugagucaa

SEQ ID NO: 353151 - RNA, 19 nt, Human
cagaagaugcuacaggaau

SEQ ID NO: 353152 - RNA, 27 nt, Human
cagagcagagguccaagaggccucauc

SEQ ID NO: 353153 - RNA, 21 nt, Human
cagaggacucucuggaagccu

SEQ ID NO: 353154 - RNA, 18 nt, Human
cagccucuggugccaucc

SEQ ID NO: 353155 - RNA, 21 nt, Human
ccacaaucccaaacucaggaa

SEQ ID NO: 353156 - RNA, 19 nt, Human
ccacuggagacuccagaag

SEQ ID NO: 353157 - RNA, 24 nt, Human
cuagcuugauucuuggccuucugc

SEQ ID NO: 353158 - RNA, 22 nt, Human
cucaucaacagcaaccacugga

SEQ ID NO: 353159 - RNA, 21 nt, Human
cugguauuucaaguaacaggu

SEQ ID NO: 353160 - RNA, 20 nt, Human
gagucaaagcacagagacua

SEQ ID NO: 353161 - RNA, 21 nt, Human
ggaaggggugguagguugaga

SEQ ID NO: 353162 - RNA, 21 nt, Human
gguccagagcuaaucuaaggu

SEQ ID NO: 353163 - RNA, 22 nt, Human
ucaaucaaaaaauaaagaggua

SEQ ID NO: 353164 - RNA, 21 nt, Human
ucagagcagagguccaagagg

SEQ ID NO: 353165 - RNA, 23 nt, Human
ucagaugcuccagucucuuuggu

SEQ ID NO: 353166 - RNA, 26 nt, Human
ucagaugcuccagucucuuugguuga

SEQ ID NO: 353167 - RNA, 19 nt, Human
uccaagaggccucaucaac

SEQ ID NO: 353168 - RNA, 23 nt, Human
uccacggugacauguggccuucu

SEQ ID NO: 353169 - RNA, 23 nt, Human
ucugcugguuuucugccuucugc

SEQ ID NO: 353170 - RNA, 21 nt, Human
ugcuccuggcuucuguggcuu

SEQ ID NO: 353171 - RNA, 20 nt, Human
uggccuucugcagccucugg

SEQ ID NO: 353172 - RNA, 22 nt, Human
ugguccagagcggguccaacag

SEQ ID NO: 353173 - RNA, 19 nt, Human
ugugagucagaugcuccag

SEQ ID NO: 353174 - RNA, 21 nt, Human
uguguuacaggaagagaagag

SEQ ID NO: 353175 - RNA, 22 nt, Human
uguguuacaggaagagaagagg

SEQ ID NO: 353176 - RNA, 23 nt, Human
uucacugguauuucaaguaacag

SEQ ID NO: 353177 - RNA, 18 nt, Human
uuugcuccuggcuucugu

SEQ ID NO: 353178 - RNA, 22 nt, Human
aaaaggagagaaucugucucaa

SEQ ID NO: 353179 - RNA, 18 nt, Human
aaagaaaggucugcccuu

SEQ ID NO: 353180 - RNA, 22 nt, Human
aagacagaguccacccuggaaa

SEQ ID NO: 353181 - RNA, 27 nt, Human
aaguaaauggccuccugcuguaaugac

SEQ ID NO: 353182 - RNA, 22 nt, Human
aagucagaggagcagcaggaaa

SEQ ID NO: 353183 - RNA, 24 nt, Human
aauguccacuuccuguuuggugac

SEQ ID NO: 353184 - RNA, 28 nt, Human
acacagucccaaagaaagggggaacgcc

SEQ ID NO: 353185 - RNA, 20 nt, Human
agagaagaugggggacagga

SEQ ID NO: 353186 - RNA, 22 nt, Human
agaguccacccuggaaaguggc

SEQ ID NO: 353187 - RNA, 19 nt, Human
agcuccuugguccacacag

SEQ ID NO: 353188 - RNA, 22 nt, Human
agcugccucgugggcccagaag

SEQ ID NO: 353189 - RNA, 27 nt, Human
aggagcagcaggaaacagccgguaccc

SEQ ID NO: 353190 - RNA, 21 nt, Human
aggcaagaggcgauagcuggg

SEQ ID NO: 353191 - RNA, 20 nt, Human
augggggacaggaaaaagga

SEQ ID NO: 353192 - RNA, 18 nt, Human
caccgugcucagcagagc

SEQ ID NO: 353193 - RNA, 19 nt, Human
cagaaguccgucacucuuc

SEQ ID NO: 353194 - RNA, 21 nt, Human
cagcaggaaacagccucagaa

SEQ ID NO: 353195 - RNA, 24 nt, Human
cagcugccucgugggcccagaaga

SEQ ID NO: 353196 - RNA, 23 nt, Human
caggaaaaaggagagaaucuguc

SEQ ID NO: 353197 - RNA, 18 nt, Human
cagugaccaggagaagcg

SEQ ID NO: 353198 - RNA, 22 nt, Human
ccaagucagaggagcagcagga

SEQ ID NO: 353199 - RNA, 18 nt, Human
ccaggagaagcggggaga

SEQ ID NO: 353200 - RNA, 19 nt, Human
cccaaagaaaggucugccc

SEQ ID NO: 353201 - RNA, 23 nt, Human
cccacgaaacccaucccagcccu

SEQ ID NO: 353202 - RNA, 19 nt, Human
ccuuggguacauggggagg

SEQ ID NO: 353203 - RNA, 19 nt, Human
cucccuuagaauguccacu

SEQ ID NO: 353204 - RNA, 21 nt, Human
cuguggaauggggucugggca

SEQ ID NO: 353205 - RNA, 23 nt, Human
gaaacccaucccagcccucacag

SEQ ID NO: 353206 - RNA, 18 nt, Human
gagcagcaggaaacagcc

SEQ ID NO: 353207 - RNA, 19 nt, Human
gagcuccaucuuccuuggg

SEQ ID NO: 353208 - RNA, 22 nt, Human
gauccccauccccaggggucuc

SEQ ID NO: 353209 - RNA, 18 nt, Human
gaugggggacaggaaaaa

SEQ ID NO: 353210 - RNA, 18 nt, Human
gcaagaggcgauagcugg

SEQ ID NO: 353211 - RNA, 24 nt, Human
gcccacgaaacccaucccagcccu

SEQ ID NO: 353212 - RNA, 18 nt, Human
gcccaggagagcccgugg

SEQ ID NO: 353213 - RNA, 22 nt, Human
gccccaagucagaggagcagca

SEQ ID NO: 353214 - RNA, 21 nt, Human
gcuccacuugcccgucugcuu

SEQ ID NO: 353215 - RNA, 21 nt, Human
gcugggcuucauccgcggagg

SEQ ID NO: 353216 - RNA, 18 nt, Human
ggaaaguggccacagggg

SEQ ID NO: 353217 - RNA, 19 nt, Human
ggagaagcggggagagcca

SEQ ID NO: 353218 - RNA, 22 nt, Human
ucacuugucacuagauggaagc

SEQ ID NO: 353219 - RNA, 21 nt, Human
uccacuuccuguuuggugacc

SEQ ID NO: 353220 - RNA, 21 nt, Human
ucccaaagaaaggucugcccu

SEQ ID NO: 353221 - RNA, 19 nt, Human
ucccagagaggugcccaag

SEQ ID NO: 353222 - RNA, 25 nt, Human
ucccagagaggugcccaagaagacc

SEQ ID NO: 353223 - RNA, 18 nt, Human
ucccagcccucacaggcu

SEQ ID NO: 353224 - RNA, 21 nt, Human
ucccagcccucacaggcugaa

SEQ ID NO: 353225 - RNA, 19 nt, Human
ugaacaagacagaguccac

SEQ ID NO: 353226 - RNA, 18 nt, Human
ugaagauccccaucccca

SEQ ID NO: 353227 - RNA, 22 nt, Human
ugcccaagaagacccaagcugc

SEQ ID NO: 353228 - RNA, 22 nt, Human
ugccccaagucagaggagcagc

SEQ ID NO: 353229 - RNA, 22 nt, Human
ugcccuugggcccacgaaaccc

SEQ ID NO: 353230 - RNA, 19 nt, Human
ugcucagcagagcauggga

SEQ ID NO: 353231 - RNA, 18 nt, Human
ugcucuuguccuguuugg

SEQ ID NO: 353232 - RNA, 18 nt, Human
uggcccaggagagcccgu

SEQ ID NO: 353233 - RNA, 22 nt, Human
ugggacagcugccucgugggcc

SEQ ID NO: 353234 - RNA, 22 nt, Human
uggggaggagacuccagugacc

SEQ ID NO: 353235 - RNA, 23 nt, Human
ugggggacaggaaaaaggagaga

SEQ ID NO: 353236 - RNA, 28 nt, Human
uucccagagaggugcccaagaagacccc

SEQ ID NO: 353237 - RNA, 21 nt, Human
uuccuucccugaagaucccca

SEQ ID NO: 353238 - RNA, 24 nt, Human
uugggcccacgaaacccaucccag

SEQ ID NO: 353239 - RNA, 22 nt, Human
uuguccuguuuggguggccaga

SEQ ID NO: 353240 - RNA, 19 nt, Human
accucccucccuuccaauc

SEQ ID NO: 353241 - RNA, 25 nt, Human
aggggccuagggcccaggaagcagg

SEQ ID NO: 353242 - RNA, 19 nt, Human
auauauauauauauauaua

SEQ ID NO: 353243 - RNA, 19 nt, Human
auauauauauauauauaua

SEQ ID NO: 353244 - RNA, 19 nt, Human
auauauauauauauauaua

SEQ ID NO: 353245 - RNA, 19 nt, Human
auauauauauauauauaua

SEQ ID NO: 353246 - RNA, 19 nt, Human
auauauauauauauauaua

SEQ ID NO: 353247 - RNA, 19 nt, Human
auauauauauauauauaua

SEQ ID NO: 353248 - RNA, 19 nt, Human
auauauauauauauauaua

SEQ ID NO: 353249 - RNA, 19 nt, Human
caauaaccccgaauaacgc

SEQ ID NO: 353250 - RNA, 19 nt, Human
caccucccucccuuccaau

SEQ ID NO: 353251 - RNA, 22 nt, Human
caggaagcaggcuccacucucu

SEQ ID NO: 353252 - RNA, 21 nt, Human
ccaaaaaggaaaaaaggucuc

SEQ ID NO: 353253 - RNA, 21 nt, Human
ccaaaaaggaaaaaaggucuc

SEQ ID NO: 353254 - RNA, 23 nt, Human
cccauggcaggcacaggcagcug

SEQ ID NO: 353255 - RNA, 18 nt, Human
ccuagccuggcccauggc

SEQ ID NO: 353256 - RNA, 23 nt, Human
ccucccucccuuccaaucacccc

SEQ ID NO: 353257 - RNA, 21 nt, Human
ccuuccaaucaccccccaccc

SEQ ID NO: 353258 - RNA, 24 nt, Human
cggacaaggucuccaaaaaggaaa

SEQ ID NO: 353259 - RNA, 23 nt, Human
cuagccuggcccauggcaggcac

SEQ ID NO: 353260 - RNA, 23 nt, Human
cuuccaaucaccccccaccccga

SEQ ID NO: 353261 - RNA, 18 nt, Human
ggacaaggucuccaaaaa

SEQ ID NO: 353262 - RNA, 20 nt, Human
ggaggggccuagggcccagg

SEQ ID NO: 353263 - RNA, 18 nt, Human
ggcccaggaagcaggcuc

SEQ ID NO: 353264 - RNA, 19 nt, Human
gugaggacagaaagucuac

SEQ ID NO: 353265 - RNA, 19 nt, Human
uauauauauauauauauau

SEQ ID NO: 353266 - RNA, 19 nt, Human
uauauauauauauauauau

SEQ ID NO: 353267 - RNA, 25 nt, Human
uauuuuaauauauauauauauauau

SEQ ID NO: 353268 - RNA, 20 nt, Human
uccaaucaccccccaccccg

SEQ ID NO: 353269 - RNA, 22 nt, Human
ugugggaggggccuagggccca

SEQ ID NO: 353270 - RNA, 19 nt, Human
accaagaaucugaaacuac

SEQ ID NO: 353271 - RNA, 19 nt, Human
aggaagcaugggcaggugg

SEQ ID NO: 353272 - RNA, 26 nt, Human
cagaauucacugaggucaacugacac

SEQ ID NO: 353273 - RNA, 21 nt, Human
cauggaccaagaaucugaaac

SEQ ID NO: 353274 - RNA, 21 nt, Human
cuugauauugguccauccuuu

SEQ ID NO: 353275 - RNA, 19 nt, Human
ggaaagccuaauucaagga

SEQ ID NO: 353276 - RNA, 22 nt, Human
uccauccuuucacaugguuacc

SEQ ID NO: 353277 - RNA, 24 nt, Human
ucucagaaacaucacagaauucac

SEQ ID NO: 353278 - RNA, 28 nt, Human
uucagguuaggaaagccuaauucaagga

SEQ ID NO: 353279 - RNA, 24 nt, Human
aaacaucaaagacuucacugaggu

SEQ ID NO: 353280 - RNA, 21 nt, Human
aggaagcaugggaagguggug

SEQ ID NO: 353281 - RNA, 21 nt, Human
ccacaugggagucugccucuc

SEQ ID NO: 353282 - RNA, 21 nt, Human
gaaaaugaucccuuuauugga

SEQ ID NO: 353283 - RNA, 19 nt, Human
gccucucagaaacaucaaa

SEQ ID NO: 353284 - RNA, 20 nt, Human
uagaaagccuaaugcaagga

SEQ ID NO: 353285 - RNA, 19 nt, Human
ucugccucucagaaacauc

SEQ ID NO: 353286 - RNA, 20 nt, Human
uugguccagcuuuucaagug

SEQ ID NO: 353287 - RNA, 21 nt, Human
aaaaaaauaccuacaaaccau

SEQ ID NO: 353288 - RNA, 18 nt, Human
aaaaaacacccccaaauc

SEQ ID NO: 353289 - RNA, 20 nt, Human
aaaauaccuacaaaccauga

SEQ ID NO: 353290 - RNA, 18 nt, Human
aaacaaaacaaaacaaaa

SEQ ID NO: 353291 - RNA, 22 nt, Human
aacaaaacaaaauugagaacaa

SEQ ID NO: 353292 - RNA, 21 nt, Human
aagacuggcuccuguugagac

SEQ ID NO: 353293 - RNA, 21 nt, Human
aagcugcagggggucccgucu

SEQ ID NO: 353294 - RNA, 20 nt, Human
aauauggugaaaccccaucu

SEQ ID NO: 353295 - RNA, 21 nt, Human
aauauggugaaaccccaucuc

SEQ ID NO: 353296 - RNA, 18 nt, Human
aauuagccagccauggug

SEQ ID NO: 353297 - RNA, 24 nt, Human
aauugcuugaaccugggaggugga

SEQ ID NO: 353298 - RNA, 22 nt, Human
acaaaacaaaacaaaauugaga

SEQ ID NO: 353299 - RNA, 24 nt, Human
acaaaacaaaacaaaauugagaac

SEQ ID NO: 353300 - RNA, 20 nt, Human
acagagcaagacuccgucuc

SEQ ID NO: 353301 - RNA, 24 nt, Human
acagagcaagacuccgucucaaaa

SEQ ID NO: 353302 - RNA, 24 nt, Human
accaauauggugaaaccccaucuc

SEQ ID NO: 353303 - RNA, 24 nt, Human
accccaucucuacuaaaaauacaa

SEQ ID NO: 353304 - RNA, 22 nt, Human
acccugagccucgaggccuggu

SEQ ID NO: 353305 - RNA, 24 nt, Human
accugagugacccugggcaaguca

SEQ ID NO: 353306 - RNA, 19 nt, Human
acgaaggcucuagauaaac

SEQ ID NO: 353307 - RNA, 20 nt, Human
agaguacaggcaugccugug

SEQ ID NO: 353308 - RNA, 24 nt, Human
agcacuuugggaggcugaggcagg

SEQ ID NO: 353309 - RNA, 18 nt, Human
agcagcaggagaagggcu

SEQ ID NO: 353310 - RNA, 21 nt, Human
agcagcuuccagagccaaaug

SEQ ID NO: 353311 - RNA, 24 nt, Human
agccaugguggcaugcaccuguaa

SEQ ID NO: 353312 - RNA, 23 nt, Human
agccgccuuggcagccuggcccc

SEQ ID NO: 353313 - RNA, 24 nt, Human
agccugaccaauauggugaaaccc

SEQ ID NO: 353314 - RNA, 18 nt, Human
agccugacuucaagaccu

SEQ ID NO: 353315 - RNA, 19 nt, Human
agccuggcugagcuggcug

SEQ ID NO: 353316 - RNA, 24 nt, Human
agccugggugacagagcaagacuc

SEQ ID NO: 353317 - RNA, 22 nt, Human
aggcaagagaauugcuugaacc

SEQ ID NO: 353318 - RNA, 23 nt, Human
aggcaagagaauugcuugaaccu

SEQ ID NO: 353319 - RNA, 24 nt, Human
aggcaagagaauugcuugaaccug

SEQ ID NO: 353320 - RNA, 23 nt, Human
aggcacaggagggcaguccgggg

SEQ ID NO: 353321 - RNA, 19 nt, Human
aggcagggagagaggugag

SEQ ID NO: 353322 - RNA, 21 nt, Human
aggcagggagagaggugaggg

SEQ ID NO: 353323 - RNA, 18 nt, Human
aggcagguggaucaccug

SEQ ID NO: 353324 - RNA, 22 nt, Human
aggcagguggaucaccugaggu

SEQ ID NO: 353325 - RNA, 26 nt, Human
aggcagguggaucaccugaggucaga

SEQ ID NO: 353326 - RNA, 19 nt, Human
aggcaugccugugggccuu

SEQ ID NO: 353327 - RNA, 24 nt, Human
aggcugaggcaagagaauugcuug

SEQ ID NO: 353328 - RNA, 21 nt, Human
aggcugaggcagguggaucac

SEQ ID NO: 353329 - RNA, 24 nt, Human
aggcugaggcagguggaucaccug

SEQ ID NO: 353330 - RNA, 20 nt, Human
agggagccuggcugagcugg

SEQ ID NO: 353331 - RNA, 18 nt, Human
aggggguggggagagaac

SEQ ID NO: 353332 - RNA, 20 nt, Human
aggggguggggagagaacug

SEQ ID NO: 353333 - RNA, 24 nt, Human
agguggagguugcagugagccaag

SEQ ID NO: 353334 - RNA, 24 nt, Human
agugagacacucugguuugaaagg

SEQ ID NO: 353335 - RNA, 21 nt, Human
aguguuagaggagugacaggg

SEQ ID NO: 353336 - RNA, 19 nt, Human
auaaaaagagagacuggcc

SEQ ID NO: 353337 - RNA, 24 nt, Human
auagcacuccagccugggugacag

SEQ ID NO: 353338 - RNA, 24 nt, Human
aucgagccauagcacuccagccug

SEQ ID NO: 353339 - RNA, 20 nt, Human
auggggcugcugccggggaa

SEQ ID NO: 353340 - RNA, 20 nt, Human
auggugaaaccccaucucua

SEQ ID NO: 353341 - RNA, 24 nt, Human
caaaaaacacccccaaauccagau

SEQ ID NO: 353342 - RNA, 24 nt, Human
caaaacaaaauugagaacaagacu

SEQ ID NO: 353343 - RNA, 24 nt, Human
caaagucccaagaguggccaaggg

SEQ ID NO: 353344 - RNA, 24 nt, Human
caauauggugaaaccccaucucua

SEQ ID NO: 353345 - RNA, 19 nt, Human
cacagggagccuggcugag

SEQ ID NO: 353346 - RNA, 23 nt, Human
caccuguaaucccagcuacucgg

SEQ ID NO: 353347 - RNA, 24 nt, Human
caccuguaaucccagcuacucggg

SEQ ID NO: 353348 - RNA, 19 nt, Human
caccugugccugacaggau

SEQ ID NO: 353349 - RNA, 24 nt, Human
caccugugccugacaggauggggg

SEQ ID NO: 353350 - RNA, 24 nt, Human
cacgccuguaaucccagcacuuug

SEQ ID NO: 353351 - RNA, 22 nt, Human
cacuccagccugggugacagag

SEQ ID NO: 353352 - RNA, 23 nt, Human
cacuccagccugggugacagagc

SEQ ID NO: 353353 - RNA, 22 nt, Human
cagauaaggccucagaaagccc

SEQ ID NO: 353354 - RNA, 24 nt, Human
cagcacuuugggaggcugaggcag

SEQ ID NO: 353355 - RNA, 24 nt, Human
cagcacuuugggaggcugaggcag

SEQ ID NO: 353356 - RNA, 19 nt, Human
cagcuggggacaucaggca

SEQ ID NO: 353357 - RNA, 18 nt, Human
caggacacagggagccug

SEQ ID NO: 353358 - RNA, 21 nt, Human
caggacguggaccaaaguccc

SEQ ID NO: 353359 - RNA, 19 nt, Human
caggauggggggggaggca

SEQ ID NO: 353360 - RNA, 24 nt, Human
cagguggaucaccugaggucagaa

SEQ ID NO: 353361 - RNA, 19 nt, Human
cagugcuggggaucaugga

SEQ ID NO: 353362 - RNA, 25 nt, Human
cagugcuggggaucauggauccucu

SEQ ID NO: 353363 - RNA, 19 nt, Human
cauagcacuccagccuggg

SEQ ID NO: 353364 - RNA, 19 nt, Human
cauagcacuccagccuggg

SEQ ID NO: 353365 - RNA, 23 nt, Human
cauagcacuccagccugggugac

SEQ ID NO: 353366 - RNA, 24 nt, Human
cauagcacuccagccugggugaca

SEQ ID NO: 353367 - RNA, 25 nt, Human
cauagcacuccagccugggugacag

SEQ ID NO: 353368 - RNA, 22 nt, Human
caugccaaaaaacacccccaaa

SEQ ID NO: 353369 - RNA, 23 nt, Human
caugccccaucuggucuggaggu

SEQ ID NO: 353370 - RNA, 21 nt, Human
ccaaggcagccuaggaguggg

SEQ ID NO: 353371 - RNA, 20 nt, Human
ccauagcacuccagccuggg

SEQ ID NO: 353372 - RNA, 21 nt, Human
ccauagcacuccagccugggu

SEQ ID NO: 353373 - RNA, 24 nt, Human
ccauagcacuccagccugggugac

SEQ ID NO: 353374 - RNA, 22 nt, Human
ccaucuggucuggaggucagag

SEQ ID NO: 353375 - RNA, 19 nt, Human
ccaugccaaaaaacacccc

SEQ ID NO: 353376 - RNA, 24 nt, Human
cccagagcagcaggagaagggcuc

SEQ ID NO: 353377 - RNA, 20 nt, Human
cccagagguagaagagcuag

SEQ ID NO: 353378 - RNA, 21 nt, Human
ccccagagguagaagagcuag

SEQ ID NO: 353379 - RNA, 21 nt, Human
ccccagagguagaagagcuuc

SEQ ID NO: 353380 - RNA, 21 nt, Human
cccccaaauccagaugcagac

SEQ ID NO: 353381 - RNA, 20 nt, Human
ccccggguggggugaggggg

SEQ ID NO: 353382 - RNA, 20 nt, Human
cccuccuggcuggggcuucu

SEQ ID NO: 353383 - RNA, 20 nt, Human
cccucucccacccugagccu

SEQ ID NO: 353384 - RNA, 19 nt, Human
cccugggccucgggaaccc

SEQ ID NO: 353385 - RNA, 21 nt, Human
ccgccuuggcagccuggcccc

SEQ ID NO: 353386 - RNA, 21 nt, Human
ccgucucaaaacaaaacaaaa

SEQ ID NO: 353387 - RNA, 19 nt, Human
ccucacaggcuugucguga

SEQ ID NO: 353388 - RNA, 27 nt, Human
ccucucccacccugagccucgaggccu

SEQ ID NO: 353389 - RNA, 24 nt, Human
ccugaccaauauggugaaacccca

SEQ ID NO: 353390 - RNA, 21 nt, Human
ccugcagagacccugugcuaa

SEQ ID NO: 353391 - RNA, 21 nt, Human
ccugggagguggagguugcag

SEQ ID NO: 353392 - RNA, 22 nt, Human
ccugggugacagagcaagacuc

SEQ ID NO: 353393 - RNA, 22 nt, Human
ccuguaaucccagcacuuuggg

SEQ ID NO: 353394 - RNA, 21 nt, Human
ccuguaaucccagcuacucgg

SEQ ID NO: 353395 - RNA, 19 nt, Human
ccugugggccuuuguggag

SEQ ID NO: 353396 - RNA, 19 nt, Human
ccuuccuucuuccucugcc

SEQ ID NO: 353397 - RNA, 23 nt, Human
ccuuggcagccuggccccuccug

SEQ ID NO: 353398 - RNA, 20 nt, Human
cgagugacagucagagcuag

SEQ ID NO: 353399 - RNA, 18 nt, Human
cgcuggcucccgcagucc

SEQ ID NO: 353400 - RNA, 25 nt, Human
cggagaugucugccuuccuucuucc

SEQ ID NO: 353401 - RNA, 22 nt, Human
cucacgccuguaaucccagcac

SEQ ID NO: 353402 - RNA, 24 nt, Human
cucacgccuguaaucccagcacuu

SEQ ID NO: 353403 - RNA, 19 nt, Human
cucccagagcagcaggaga

SEQ ID NO: 353404 - RNA, 22 nt, Human
cuccucccuccauucuucaccc

SEQ ID NO: 353405 - RNA, 22 nt, Human
cugcagucugaaaugggcugag

SEQ ID NO: 353406 - RNA, 20 nt, Human
cugcccccgucaccugugcc

SEQ ID NO: 353407 - RNA, 21 nt, Human
cugcccccgucaccugugccu

SEQ ID NO: 353408 - RNA, 18 nt, Human
cuggccccuccuggcugg

SEQ ID NO: 353409 - RNA, 19 nt, Human
cuggccccuccuggcuggg

SEQ ID NO: 353410 - RNA, 21 nt, Human
cuguaaucccagcuacucggg

SEQ ID NO: 353411 - RNA, 18 nt, Human
cuucacaguaaacuuccc

SEQ ID NO: 353412 - RNA, 20 nt, Human
cuuccuagccugcuccuccc

SEQ ID NO: 353413 - RNA, 18 nt, Human
cuuggcccugggccucgg

SEQ ID NO: 353414 - RNA, 19 nt, Human
cuuggcccugggccucggg

SEQ ID NO: 353415 - RNA, 24 nt, Human
gacagagcaagacuccgucucaaa

SEQ ID NO: 353416 - RNA, 23 nt, Human
gagaauugcuugaaccugggagg

SEQ ID NO: 353417 - RNA, 21 nt, Human
gagagaacugggggcugggga

SEQ ID NO: 353418 - RNA, 20 nt, Human
gagcaucagacgcccucccu

SEQ ID NO: 353419 - RNA, 21 nt, Human
gagccgagugacagucagagc

SEQ ID NO: 353420 - RNA, 25 nt, Human
gagccgagugacagucagagcuaga

SEQ ID NO: 353421 - RNA, 18 nt, Human
gagguugcagugagccaa

SEQ ID NO: 353422 - RNA, 23 nt, Human
gagguugcagugagccaagaucg

SEQ ID NO: 353423 - RNA, 22 nt, Human
gaucaccugaggucagaaguuc

SEQ ID NO: 353424 - RNA, 25 nt, Human
gaucaccugaggucagaaguuccag

SEQ ID NO: 353425 - RNA, 21 nt, Human
gaugcagacuuuggagccaca

SEQ ID NO: 353426 - RNA, 24 nt, Human
gauugcucacgccuguaaucccag

SEQ ID NO: 353427 - RNA, 21 nt, Human
gcacuccagccugggugacag

SEQ ID NO: 353428 - RNA, 23 nt, Human
gcacuccagccugggugacagag

SEQ ID NO: 353429 - RNA, 24 nt, Human
gcacuccagccugggugacagagc

SEQ ID NO: 353430 - RNA, 24 nt, Human
gcagcaggagaagggcucgcaugg

SEQ ID NO: 353431 - RNA, 21 nt, Human
gccaccauggagccaaggcug

SEQ ID NO: 353432 - RNA, 19 nt, Human
gccauagcacuccagccug

SEQ ID NO: 353433 - RNA, 24 nt, Human
gccauagcacuccagccuggguga

SEQ ID NO: 353434 - RNA, 24 nt, Human
gcccagaggcuccagaagacuggc

SEQ ID NO: 353435 - RNA, 19 nt, Human
gccccagagguagaagagc

SEQ ID NO: 353436 - RNA, 21 nt, Human
gcccggggcccucucccaccc

SEQ ID NO: 353437 - RNA, 19 nt, Human
gcccugggccucgggaacc

SEQ ID NO: 353438 - RNA, 26 nt, Human
gccugacaggauggggggggaggcag

SEQ ID NO: 353439 - RNA, 19 nt, Human
gcgcuggcucccgcagucc

SEQ ID NO: 353440 - RNA, 18 nt, Human
gcggcggcugccggcggc

SEQ ID NO: 353441 - RNA, 22 nt, Human
gcuaaaggcagaaaccccuuca

SEQ ID NO: 353442 - RNA, 22 nt, Human
gcucacgccuguaaucccagca

SEQ ID NO: 353443 - RNA, 21 nt, Human
gcuucuugauguuuccugugg

SEQ ID NO: 353444 - RNA, 19 nt, Human
ggagagggugguggccccg

SEQ ID NO: 353445 - RNA, 18 nt, Human
ggaggcagagagagagca

SEQ ID NO: 353446 - RNA, 24 nt, Human
ggaggucagaggggagugagacac

SEQ ID NO: 353447 - RNA, 20 nt, Human
ggagguugcagugagccaag

SEQ ID NO: 353448 - RNA, 24 nt, Human
ggagguugcagugagccaagaucg

SEQ ID NO: 353449 - RNA, 23 nt, Human
ggauuucggauucagccaucaug

SEQ ID NO: 353450 - RNA, 23 nt, Human
ggcacgauugcucacgccuguaa

SEQ ID NO: 353451 - RNA, 21 nt, Human
ggcaugcaccuguaaucccag

SEQ ID NO: 353452 - RNA, 23 nt, Human
ggcccucccagagcagcaggaga

SEQ ID NO: 353453 - RNA, 23 nt, Human
ggcugaaagcaaggagagggugg

SEQ ID NO: 353454 - RNA, 19 nt, Human
ggcuggggagggggcagcc

SEQ ID NO: 353455 - RNA, 23 nt, Human
gggagccgccuuggcagccuggc

SEQ ID NO: 353456 - RNA, 19 nt, Human
gggaggcugaggcaagaga

SEQ ID NO: 353457 - RNA, 24 nt, Human
gggcaguccgggguauggccagga

SEQ ID NO: 353458 - RNA, 23 nt, Human
gggccaagcagcuuccagagcca

SEQ ID NO: 353459 - RNA, 23 nt, Human
gggcugcccccgucaccugugcc

SEQ ID NO: 353460 - RNA, 24 nt, Human
ggggagccgccuuggcagccuggc

SEQ ID NO: 353461 - RNA, 18 nt, Human
ggggcugcugccggggaa

SEQ ID NO: 353462 - RNA, 27 nt, Human
ggggguggggagagaacugggggcugg

SEQ ID NO: 353463 - RNA, 22 nt, Human
ggguggggagagaacugggggc

SEQ ID NO: 353464 - RNA, 19 nt, Human
ggguggggugagggggugg

SEQ ID NO: 353465 - RNA, 19 nt, Human
ggugaggggguggggagag

SEQ ID NO: 353466 - RNA, 19 nt, Human
ggugaggggguggggagag

SEQ ID NO: 353467 - RNA, 21 nt, Human
gguggggagagaacugggggc

SEQ ID NO: 353468 - RNA, 21 nt, Human
gucucaaaacaaaacaaaaca

SEQ ID NO: 353469 - RNA, 23 nt, Human
gugggggacaugaacugcagagg

SEQ ID NO: 353470 - RNA, 19 nt, Human
uaaaaacacuuuucugcac

SEQ ID NO: 353471 - RNA, 21 nt, Human
uaaaaauacaaaaauuagcca

SEQ ID NO: 353472 - RNA, 20 nt, Human
uagccuggggcaccccugga

SEQ ID NO: 353473 - RNA, 23 nt, Human
uagccuggggcaccccugguugc

SEQ ID NO: 353474 - RNA, 18 nt, Human
uagcuggucaguggcgug

SEQ ID NO: 353475 - RNA, 20 nt, Human
uaggcggugggagugccuug

SEQ ID NO: 353476 - RNA, 19 nt, Human
ucagccugaccaauauggu

SEQ ID NO: 353477 - RNA, 22 nt, Human
ucaggacguggaccaaaguccc

SEQ ID NO: 353478 - RNA, 23 nt, Human
ucaggcacaggagggcaguccgg

SEQ ID NO: 353479 - RNA, 21 nt, Human
ucaguggaucuuguacccucc

SEQ ID NO: 353480 - RNA, 24 nt, Human
uccagccugggugacagagcaaga

SEQ ID NO: 353481 - RNA, 19 nt, Human
ucccaggacacagggagcc

SEQ ID NO: 353482 - RNA, 23 nt, Human
ucgggaggcugaggcaagagaau

SEQ ID NO: 353483 - RNA, 19 nt, Human
ucuacccgccaccauggag

SEQ ID NO: 353484 - RNA, 22 nt, Human
ucuacccgccaccauggagcca

SEQ ID NO: 353485 - RNA, 21 nt, Human
ucucuacuaaaaauacaaaaa

SEQ ID NO: 353486 - RNA, 19 nt, Human
ucugcagucugaaaugggc

SEQ ID NO: 353487 - RNA, 18 nt, Human
ucugggggggccaagcag

SEQ ID NO: 353488 - RNA, 19 nt, Human
ugaaaccccaucucuacua

SEQ ID NO: 353489 - RNA, 19 nt, Human
ugaaagcaaggagagggug

SEQ ID NO: 353490 - RNA, 20 nt, Human
ugaaagcaaggagagggugg

SEQ ID NO: 353491 - RNA, 22 nt, Human
ugaaaugggcugaggaccaacu

SEQ ID NO: 353492 - RNA, 24 nt, Human
ugaaccugggagguggagguugca

SEQ ID NO: 353493 - RNA, 24 nt, Human
ugaccaauauggugaaaccccauc

SEQ ID NO: 353494 - RNA, 23 nt, Human
ugagaacaagacuggcuggggaa

SEQ ID NO: 353495 - RNA, 20 nt, Human
ugagacacucugguuugaaa

SEQ ID NO: 353496 - RNA, 24 nt, Human
ugaggcaagagaauugcuugaacc

SEQ ID NO: 353497 - RNA, 25 nt, Human
ugaggcaagagaauugcuugaaccu

SEQ ID NO: 353498 - RNA, 20 nt, Human
ugaggcagguggaucaccug

SEQ ID NO: 353499 - RNA, 24 nt, Human
ugaggcagguggaucaccugaggu

SEQ ID NO: 353500 - RNA, 26 nt, Human
ugaggcagguggaucaccugagguca

SEQ ID NO: 353501 - RNA, 18 nt, Human
ugcaaagacaucaagcug

SEQ ID NO: 353502 - RNA, 24 nt, Human
ugcaaagacaucaagcuggaccca

SEQ ID NO: 353503 - RNA, 22 nt, Human
ugcaaggucugaggggcaagag

SEQ ID NO: 353504 - RNA, 21 nt, Human
ugcacauauaaaaagagagac

SEQ ID NO: 353505 - RNA, 19 nt, Human
ugcaccuguaaucccagcu

SEQ ID NO: 353506 - RNA, 23 nt, Human
ugccaaaaaacacccccaaaucc

SEQ ID NO: 353507 - RNA, 20 nt, Human
ugccaggcugagugagcccc

SEQ ID NO: 353508 - RNA, 23 nt, Human
ugccccaucuggucuggagguca

SEQ ID NO: 353509 - RNA, 24 nt, Human
ugccggggaagccacugccccucc

SEQ ID NO: 353510 - RNA, 21 nt, Human
ugccugugggccuuuguggag

SEQ ID NO: 353511 - RNA, 25 nt, Human
ugccuuggcccugggccucgggaac

SEQ ID NO: 353512 - RNA, 20 nt, Human
ugcggcuggcggcggcugcc

SEQ ID NO: 353513 - RNA, 19 nt, Human
ugcuaaaggcagaaacccc

SEQ ID NO: 353514 - RNA, 22 nt, Human
ugcuaagguaggcggugggagu

SEQ ID NO: 353515 - RNA, 21 nt, Human
ugcuugaaccugggaggugga

SEQ ID NO: 353516 - RNA, 18 nt, Human
uggaacuggcccucccag

SEQ ID NO: 353517 - RNA, 24 nt, Human
uggagccaaggcugugguggccac

SEQ ID NO: 353518 - RNA, 24 nt, Human
uggaucaccugaggucagaaguuc

SEQ ID NO: 353519 - RNA, 27 nt, Human
uggaucaccugaggucagaaguuccag

SEQ ID NO: 353520 - RNA, 30 nt, Human
uggcagccuggccccuccuggcuggggcuu

SEQ ID NO: 353521 - RNA, 22 nt, Human
uggcaugcaccuguaaucccag

SEQ ID NO: 353522 - RNA, 20 nt, Human
uggcccucccagagcagcag

SEQ ID NO: 353523 - RNA, 24 nt, Human
uggcccugggccucgggaaccccc

SEQ ID NO: 353524 - RNA, 19 nt, Human
uggcucaggacguggacca

SEQ ID NO: 353525 - RNA, 24 nt, Human
uggcugagcuggcuggcucaugcc

SEQ ID NO: 353526 - RNA, 24 nt, Human
uggcuggguugugcuucuguggau

SEQ ID NO: 353527 - RNA, 18 nt, Human
ugggaggcugaggcaggu

SEQ ID NO: 353528 - RNA, 24 nt, Human
ugggaggcugaggcagguggauca

SEQ ID NO: 353529 - RNA, 18 nt, Human
ugggagguggagguugca

SEQ ID NO: 353530 - RNA, 29 nt, Human
ugggagguggagguugcagugacaacggu

SEQ ID NO: 353531 - RNA, 24 nt, Human
ugggagguggagguugcagugagc

SEQ ID NO: 353532 - RNA, 22 nt, Human
ugggagugccuuggcccugggc

SEQ ID NO: 353533 - RNA, 27 nt, Human
uggggaaaacaggcagggagagaggug

SEQ ID NO: 353534 - RNA, 24 nt, Human
uggggagagaacugggggcugggg

SEQ ID NO: 353535 - RNA, 25 nt, Human
uggggagagaacugggggcugggga

SEQ ID NO: 353536 - RNA, 23 nt, Human
ugggggcuggggagggggcagcc

SEQ ID NO: 353537 - RNA, 18 nt, Human
uggggugggagugggcgg

SEQ ID NO: 353538 - RNA, 20 nt, Human
uggggugggagugggcggca

SEQ ID NO: 353539 - RNA, 23 nt, Human
uggggugggagugggcggcaucu

SEQ ID NO: 353540 - RNA, 24 nt, Human
ugguggcaugcaccuguaauccca

SEQ ID NO: 353541 - RNA, 22 nt, Human
ugguggccccgucuuccuagcc

SEQ ID NO: 353542 - RNA, 19 nt, Human
ugucgugaggauuaaguga

SEQ ID NO: 353543 - RNA, 18 nt, Human
uuccagaucagccugacc

SEQ ID NO: 353544 - RNA, 24 nt, Human
uugaaccugggagguggagguugc

SEQ ID NO: 353545 - RNA, 22 nt, Human
uugcagugagccaagaucgagc

SEQ ID NO: 353546 - RNA, 24 nt, Human
uugcucacgccuguaaucccagca

SEQ ID NO: 353547 - RNA, 24 nt, Human
uugcuugaaccugggagguggagg

SEQ ID NO: 353548 - RNA, 25 nt, Human
uugggaggcugaggcagguggauca

SEQ ID NO: 353549 - RNA, 20 nt, Human
uuugaaaggccuuccuuucc

SEQ ID NO: 353550 - RNA, 22 nt, Human
aaaaaagacauauuaaccaaaa

SEQ ID NO: 353551 - RNA, 24 nt, Human
aaaaagacauauuaaccaaaagcu

SEQ ID NO: 353552 - RNA, 23 nt, Human
aaaagaaaaaaaaagacauauua

SEQ ID NO: 353553 - RNA, 20 nt, Human
aaaugaaauugugucuagac

SEQ ID NO: 353554 - RNA, 21 nt, Human
aaauggaaagcaugucuuugu

SEQ ID NO: 353555 - RNA, 21 nt, Human
aaauggaaagcaugucuuugu

SEQ ID NO: 353556 - RNA, 18 nt, Human
aagcaaauagaacacugg

SEQ ID NO: 353557 - RNA, 21 nt, Human
aagcaaauagaacacuggaaa

SEQ ID NO: 353558 - RNA, 21 nt, Human
aaguaaaggaaaaaauggaaa

SEQ ID NO: 353559 - RNA, 21 nt, Human
acuaagcaauauagagacaga

SEQ ID NO: 353560 - RNA, 21 nt, Human
acuaagcaauauagagacaga

SEQ ID NO: 353561 - RNA, 20 nt, Human
acugcauucuugcuuaauag

SEQ ID NO: 353562 - RNA, 20 nt, Human
acugcauucuugcuuaauag

SEQ ID NO: 353563 - RNA, 28 nt, Human
agaaaaaaaaagacauauuaaccaaaag

SEQ ID NO: 353564 - RNA, 23 nt, Human
agcaaauagaacacuggaaaaag

SEQ ID NO: 353565 - RNA, 19 nt, Human
auagaacacuggaaaaaga

SEQ ID NO: 353566 - RNA, 23 nt, Human
caacauuagagaaagaaagauac

SEQ ID NO: 353567 - RNA, 23 nt, Human
caacauuagagaaagaaagauac

SEQ ID NO: 353568 - RNA, 20 nt, Human
caguagauuucuccauguuu

SEQ ID NO: 353569 - RNA, 19 nt, Human
cauugacuauggaaauacu

SEQ ID NO: 353570 - RNA, 22 nt, Human
cugcaaucaccuuucaguugcu

SEQ ID NO: 353571 - RNA, 20 nt, Human
cuggaaaaagaaaaaaaaag

SEQ ID NO: 353572 - RNA, 23 nt, Human
gcugcaaucaccuuucaguugcu

SEQ ID NO: 353573 - RNA, 23 nt, Human
uaaaccaucauugacuauggaaa

SEQ ID NO: 353574 - RNA, 23 nt, Human
uaaaccaucauugacuauggaaa

SEQ ID NO: 353575 - RNA, 20 nt, Human
uaaagcaaauagaacacugg

SEQ ID NO: 353576 - RNA, 21 nt, Human
uaaagcaaauagaacacugga

SEQ ID NO: 353577 - RNA, 22 nt, Human
uaagcaauauagagacagacaa

SEQ ID NO: 353578 - RNA, 22 nt, Human
uaagcaauauagagacagacaa

SEQ ID NO: 353579 - RNA, 25 nt, Human
uaagcaauauagagacagacaauau

SEQ ID NO: 353580 - RNA, 25 nt, Human
uaagcaauauagagacagacaauau

SEQ ID NO: 353581 - RNA, 25 nt, Human
uacaacauuagagaaagaaagauac

SEQ ID NO: 353582 - RNA, 25 nt, Human
uacaacauuagagaaagaaagauac

SEQ ID NO: 353583 - RNA, 25 nt, Human
uagagacagacaauauuaucuuucc

SEQ ID NO: 353584 - RNA, 25 nt, Human
uagagacagacaauauuaucuuucc

SEQ ID NO: 353585 - RNA, 24 nt, Human
uauuaaccaaaagcugcaaucacc

SEQ ID NO: 353586 - RNA, 25 nt, Human
uauuaaccaaaagcugcaaucaccu

SEQ ID NO: 353587 - RNA, 22 nt, Human
ucauugacuauggaaauacuaa

SEQ ID NO: 353588 - RNA, 21 nt, Human
uccuccauucuaaacugcuaa

SEQ ID NO: 353589 - RNA, 21 nt, Human
uccuccauucuaaacugcuaa

SEQ ID NO: 353590 - RNA, 18 nt, Human
ucuuccuccauucuaaac

SEQ ID NO: 353591 - RNA, 18 nt, Human
ucuuccuccauucuaaac

SEQ ID NO: 353592 - RNA, 22 nt, Human
ucuuuguuguucuuccuccauu

SEQ ID NO: 353593 - RNA, 22 nt, Human
ucuuuguuguucuuccuccauu

SEQ ID NO: 353594 - RNA, 21 nt, Human
ugacuauggaaauacuaagca

SEQ ID NO: 353595 - RNA, 19 nt, Human
ugagagauaaguaaaggaa

SEQ ID NO: 353596 - RNA, 19 nt, Human
uggaaaaagaaaaaaaaag

SEQ ID NO: 353597 - RNA, 19 nt, Human
uuaaaaguagaagauugaa

SEQ ID NO: 353598 - RNA, 19 nt, Human
uuaaaaguagaagauugaa

SEQ ID NO: 353599 - RNA, 18 nt, Human
uuaaagcaaauagaacac

SEQ ID NO: 353600 - RNA, 18 nt, Human
uuuaagacagccacucaa

SEQ ID NO: 353601 - RNA, 19 nt, Human
uuuaagacagccacucaag

SEQ ID NO: 353602 - RNA, 22 nt, Human
uuuguuguucuuccuccauucu

SEQ ID NO: 353603 - RNA, 22 nt, Human
uuuguuguucuuccuccauucu

SEQ ID NO: 353604 - RNA, 25 nt, Human
uuuuuuuuuuuuuuuuaagguuuuu

SEQ ID NO: 353605 - RNA, 23 nt, Human
uuuuuuuuuuuuuuuuuuuaagg

SEQ ID NO: 353606 - RNA, 18 nt, Human
aaccacugcgcccugccu

SEQ ID NO: 353607 - RNA, 19 nt, Human
acccgcguccaccuccccu

SEQ ID NO: 353608 - RNA, 20 nt, Human
acccgcguccaccuccccuc

SEQ ID NO: 353609 - RNA, 21 nt, Human
agagacagggccaggaaaaga

SEQ ID NO: 353610 - RNA, 22 nt, Human
agauggggggugauuucagcau

SEQ ID NO: 353611 - RNA, 20 nt, Human
agcaaaugagucucuuuucc

SEQ ID NO: 353612 - RNA, 25 nt, Human
agcaucacccacccuccuauauggc

SEQ ID NO: 353613 - RNA, 18 nt, Human
agccggggccuugggagu

SEQ ID NO: 353614 - RNA, 19 nt, Human
agccugggagaugugggcc

SEQ ID NO: 353615 - RNA, 20 nt, Human
aggccuccgagcauguacag

SEQ ID NO: 353616 - RNA, 20 nt, Human
auugggccucacaggggaga

SEQ ID NO: 353617 - RNA, 25 nt, Human
caaaugagucucuuuuccaagaaac

SEQ ID NO: 353618 - RNA, 24 nt, Human
caacguguggccucaguguggugg

SEQ ID NO: 353619 - RNA, 18 nt, Human
cacagcccaggccugucc

SEQ ID NO: 353620 - RNA, 19 nt, Human
cacagcccaggccuguccc

SEQ ID NO: 353621 - RNA, 25 nt, Human
cacccagggcucaccuccuggaggc

SEQ ID NO: 353622 - RNA, 21 nt, Human
caccuagagugagcagggggc

SEQ ID NO: 353623 - RNA, 25 nt, Human
caggggagaguccagagacagggcc

SEQ ID NO: 353624 - RNA, 18 nt, Human
ccauccccacucuggcug

SEQ ID NO: 353625 - RNA, 21 nt, Human
ccccacucuggcuggccugga

SEQ ID NO: 353626 - RNA, 22 nt, Human
ccccacucuggcuggccuggaa

SEQ ID NO: 353627 - RNA, 19 nt, Human
ccccucguggacgagaggc

SEQ ID NO: 353628 - RNA, 26 nt, Human
ccccucguggacgagaggccaagggu

SEQ ID NO: 353629 - RNA, 23 nt, Human
ccuauauggccaggccuccgagc

SEQ ID NO: 353630 - RNA, 21 nt, Human
ccuccgagcauguacaguaag

SEQ ID NO: 353631 - RNA, 18 nt, Human
cgacccgacgaccgccgg

SEQ ID NO: 353632 - RNA, 22 nt, Human
cgacgcccaggguuccaacucc

SEQ ID NO: 353633 - RNA, 20 nt, Human
cuaagcagaagugaggcaag

SEQ ID NO: 353634 - RNA, 22 nt, Human
cugucuccuaagcagccuggga

SEQ ID NO: 353635 - RNA, 18 nt, Human
cuugccgcugccaacuga

SEQ ID NO: 353636 - RNA, 23 nt, Human
cuugccgcugccaacugaccaaa

SEQ ID NO: 353637 - RNA, 22 nt, Human
cuugggaagggccucccugcag

SEQ ID NO: 353638 - RNA, 20 nt, Human
gaccaaaggcugccgacccg

SEQ ID NO: 353639 - RNA, 19 nt, Human
gaccauccccacucuggcu

SEQ ID NO: 353640 - RNA, 18 nt, Human
gagcagggggcuaaguca

SEQ ID NO: 353641 - RNA, 19 nt, Human
gaguccagagacagggcca

SEQ ID NO: 353642 - RNA, 21 nt, Human
gcaagcuacuuccgcacagau

SEQ ID NO: 353643 - RNA, 20 nt, Human
gcagugaccagggccagggc

SEQ ID NO: 353644 - RNA, 20 nt, Human
gccaggaaaagaaggugagg

SEQ ID NO: 353645 - RNA, 23 nt, Human
ggccucacaggggagaguccaga

SEQ ID NO: 353646 - RNA, 21 nt, Human
gggccucacaggggagagucc

SEQ ID NO: 353647 - RNA, 20 nt, Human
uaagauggggggugauuuca

SEQ ID NO: 353648 - RNA, 21 nt, Human
ucagagccggggccuugggag

SEQ ID NO: 353649 - RNA, 18 nt, Human
ucagcaaaugagucucuu

SEQ ID NO: 353650 - RNA, 18 nt, Human
ucagcaucacccacccuc

SEQ ID NO: 353651 - RNA, 19 nt, Human
ucauuugucuauggauuuc

SEQ ID NO: 353652 - RNA, 23 nt, Human
uccaagaaacgaaaaggucuugu

SEQ ID NO: 353653 - RNA, 24 nt, Human
uccaagaaacgaaaaggucuuguu

SEQ ID NO: 353654 - RNA, 21 nt, Human
ucccugcaggugugcacugca

SEQ ID NO: 353655 - RNA, 22 nt, Human
ucccugcaggugugcacugcag

SEQ ID NO: 353656 - RNA, 27 nt, Human
ucucuuuuccaagaaacgaaaaggucu

SEQ ID NO: 353657 - RNA, 23 nt, Human
ucugucuccuaagcagccuggga

SEQ ID NO: 353658 - RNA, 20 nt, Human
ugaccagggccagggcggcu

SEQ ID NO: 353659 - RNA, 24 nt, Human
ugccuuccugucucgacgcccagg

SEQ ID NO: 353660 - RNA, 21 nt, Human
ugggaagggccucccugcagg

SEQ ID NO: 353661 - RNA, 21 nt, Human
uggggggugauuucagcauca

SEQ ID NO: 353662 - RNA, 20 nt, Human
uguaacgucauucagagacc

SEQ ID NO: 353663 - RNA, 19 nt, Human
uguggccucaguguggugg

SEQ ID NO: 353664 - RNA, 21 nt, Human
uguggccucagugugguggcc

SEQ ID NO: 353665 - RNA, 20 nt, Human
ugugguggccgucuggggug

SEQ ID NO: 353666 - RNA, 24 nt, Human
ugugguggccgucuggggugggug

SEQ ID NO: 353667 - RNA, 22 nt, Human
uguuucaaccacugcgcccugc

SEQ ID NO: 353668 - RNA, 20 nt, Human
uugccgcugccaacugacca

SEQ ID NO: 353669 - RNA, 22 nt, Human
uuuuuuuuuuuuuuuuucauuu

SEQ ID NO: 353670 - RNA, 20 nt, Human
agacagggccacacaugcca

SEQ ID NO: 353671 - RNA, 21 nt, Human
aggggccaggcugugcccaga

SEQ ID NO: 353672 - RNA, 18 nt, Human
caggacccuccagacuga

SEQ ID NO: 353673 - RNA, 21 nt, Human
ccagagacccaggcauccagc

SEQ ID NO: 353674 - RNA, 22 nt, Human
cccagagacccaggcauccagc

SEQ ID NO: 353675 - RNA, 23 nt, Human
cccagagacccaggcauccagcu

SEQ ID NO: 353676 - RNA, 25 nt, Human
cccuccagacugaagaguccauggg

SEQ ID NO: 353677 - RNA, 19 nt, Human
ggaggcccaggacccucca

SEQ ID NO: 353678 - RNA, 18 nt, Human
uugcugucaggaggccca

SEQ ID NO: 353679 - RNA, 22 nt, Human
acucacucccagcccuccccug

SEQ ID NO: 353680 - RNA, 23 nt, Human
agaggcugcacagcaccagggug

SEQ ID NO: 353681 - RNA, 18 nt, Human
cacagcaccagggugugg

SEQ ID NO: 353682 - RNA, 18 nt, Human
caccugcuguccuggacu

SEQ ID NO: 353683 - RNA, 24 nt, Human
cagcccuccccugccacauccucc

SEQ ID NO: 353684 - RNA, 19 nt, Human
ccccaacucuaaacacaga

SEQ ID NO: 353685 - RNA, 20 nt, Human
ccccuggguggcugucucag

SEQ ID NO: 353686 - RNA, 23 nt, Human
ccccuggguggcugucucagcuc

SEQ ID NO: 353687 - RNA, 21 nt, Human
ccccuuuccagaggcagaaac

SEQ ID NO: 353688 - RNA, 21 nt, Human
cccgcccccuuuccagaggca

SEQ ID NO: 353689 - RNA, 23 nt, Human
cccugcccaucucagugccccuc

SEQ ID NO: 353690 - RNA, 21 nt, Human
ccuccccugccacauccuccu

SEQ ID NO: 353691 - RNA, 20 nt, Human
ccucugcacucucaggcggc

SEQ ID NO: 353692 - RNA, 23 nt, Human
ccugcuguccuggacuccuggac

SEQ ID NO: 353693 - RNA, 23 nt, Human
cucagugccccuccccgcucccc

SEQ ID NO: 353694 - RNA, 22 nt, Human
cucccagcccuccccugccaca

SEQ ID NO: 353695 - RNA, 19 nt, Human
cuccccugccacauccucc

SEQ ID NO: 353696 - RNA, 18 nt, Human
cucuaaacacagagcuac

SEQ ID NO: 353697 - RNA, 20 nt, Human
gccagcaccugcuguccugg

SEQ ID NO: 353698 - RNA, 23 nt, Human
gcccccuuuccagaggcagaaac

SEQ ID NO: 353699 - RNA, 22 nt, Human
ggcugcacagcaccagggugug

SEQ ID NO: 353700 - RNA, 21 nt, Human
uacucacucccagcccucccc

SEQ ID NO: 353701 - RNA, 22 nt, Human
uacucacucccagcccuccccu

SEQ ID NO: 353702 - RNA, 22 nt, Human
ucagugccccuccccgcucccc

SEQ ID NO: 353703 - RNA, 19 nt, Human
uccaagaggucggaugcuu

SEQ ID NO: 353704 - RNA, 18 nt, Human
uccuggacuccuggaccu

SEQ ID NO: 353705 - RNA, 22 nt, Human
uccuuguccccaacucuaaaca

SEQ ID NO: 353706 - RNA, 23 nt, Human
ugcacucucaggcggcacagucu

SEQ ID NO: 353707 - RNA, 19 nt, Human
uggaguggacccccugggu

SEQ ID NO: 353708 - RNA, 21 nt, Human
ugugaaaagggcccgcccccu

SEQ ID NO: 353709 - RNA, 24 nt, Human
uuuuuuuuuuuuuuuuuuucaugg

SEQ ID NO: 353710 - RNA, 18 nt, Human
aagugugggaccagccuu

SEQ ID NO: 353711 - RNA, 22 nt, Human
acacagcacguuaggacugaaa

SEQ ID NO: 353712 - RNA, 21 nt, Human
agcaagaaucugauccuugua

SEQ ID NO: 353713 - RNA, 20 nt, Human
auuugcaaaaggcuucccuu

SEQ ID NO: 353714 - RNA, 24 nt, Human
caaaaggcuucccuucuuccacuc

SEQ ID NO: 353715 - RNA, 22 nt, Human
cacagcaagaaucugauccuug

SEQ ID NO: 353716 - RNA, 24 nt, Human
caccccagccuuucuauaugauuu

SEQ ID NO: 353717 - RNA, 22 nt, Human
cacugagcugggcaucaagggc

SEQ ID NO: 353718 - RNA, 22 nt, Human
ccugcaacugacacucuacuau

SEQ ID NO: 353719 - RNA, 20 nt, Human
cugagguccagagagggaaa

SEQ ID NO: 353720 - RNA, 23 nt, Human
cugcugauaagugugggaccagc

SEQ ID NO: 353721 - RNA, 22 nt, Human
cuguagauuucaggagaagccc

SEQ ID NO: 353722 - RNA, 21 nt, Human
cuuccugguggcccucaucca

SEQ ID NO: 353723 - RNA, 21 nt, Human
gacccacucaccucugcugcc

SEQ ID NO: 353724 - RNA, 19 nt, Human
gaugggccauagcauagcc

SEQ ID NO: 353725 - RNA, 22 nt, Human
gcugccuuggauaccugaaaug

SEQ ID NO: 353726 - RNA, 21 nt, Human
ggcuucccuucuuccacuccc

SEQ ID NO: 353727 - RNA, 25 nt, Human
gggaaacugagguccagagagggaa

SEQ ID NO: 353728 - RNA, 20 nt, Human
uaccugaaaugugucccgua

SEQ ID NO: 353729 - RNA, 23 nt, Human
uagcauagcccccuucaucuccc

SEQ ID NO: 353730 - RNA, 24 nt, Human
uauaugauuucaggaguucuuggg

SEQ ID NO: 353731 - RNA, 28 nt, Human
ucagacucccauuccaacauuuuuccca

SEQ ID NO: 353732 - RNA, 23 nt, Human
ucauuagucaacuaaaccugugu

SEQ ID NO: 353733 - RNA, 19 nt, Human
uccacauuuccccaaggca

SEQ ID NO: 353734 - RNA, 20 nt, Human
uccacuggaacaucccuccu

SEQ ID NO: 353735 - RNA, 22 nt, Human
ucuuaaaggaugaauggcacuu

SEQ ID NO: 353736 - RNA, 23 nt, Human
ugaacugacaguuguugcugcug

SEQ ID NO: 353737 - RNA, 21 nt, Human
ugagcugggcaucaagggccg

SEQ ID NO: 353738 - RNA, 18 nt, Human
ugagguccagagagggaa

SEQ ID NO: 353739 - RNA, 23 nt, Human
ugagguccagagagggaaagugu

SEQ ID NO: 353740 - RNA, 19 nt, Human
ugauaagugugggaccagc

SEQ ID NO: 353741 - RNA, 26 nt, Human
ugcaacugacacucuacuauuugcaa

SEQ ID NO: 353742 - RNA, 22 nt, Human
uggcuguucuuuguucuaugag

SEQ ID NO: 353743 - RNA, 20 nt, Human
uuccaccuugauauccagau

SEQ ID NO: 353744 - RNA, 22 nt, Human
uucccuucuuccacucccagcc

SEQ ID NO: 353745 - RNA, 22 nt, Human
uuccugguggcccucauccacu

SEQ ID NO: 353746 - RNA, 19 nt, Human
uucuaugaggaaacggagg

SEQ ID NO: 353747 - RNA, 20 nt, Human
uuggauaccugaaauguguc

SEQ ID NO: 353748 - RNA, 18 nt, Human
uuguggcacugagcuggg

SEQ ID NO: 353749 - RNA, 18 nt, Human
uuuuuuuuuuuuuuuuug

SEQ ID NO: 353750 - RNA, 22 nt, Human
uuuuuuuuuuuuuuuuuuguuu

SEQ ID NO: 353751 - RNA, 22 nt, Human
aaaaaagcucaaccuaauuaga

SEQ ID NO: 353752 - RNA, 24 nt, Human
aaacaaauggccaauaagcacaua

SEQ ID NO: 353753 - RNA, 19 nt, Human
aaacauaugugaacacaaa

SEQ ID NO: 353754 - RNA, 18 nt, Human
aaagcagcaaugccaugg

SEQ ID NO: 353755 - RNA, 21 nt, Human
aaaggaaaccaaaggggagau

SEQ ID NO: 353756 - RNA, 25 nt, Human
aaauggccaauaagcacauaaaaaa

SEQ ID NO: 353757 - RNA, 21 nt, Human
aaauggcuauaaucauaaaga

SEQ ID NO: 353758 - RNA, 18 nt, Human
aacacugguaguuguuuu

SEQ ID NO: 353759 - RNA, 24 nt, Human
aacagaaaaugaaaaacauaugug

SEQ ID NO: 353760 - RNA, 19 nt, Human
aagacaagacagacaaccc

SEQ ID NO: 353761 - RNA, 19 nt, Human
aagacgccagacacaaaau

SEQ ID NO: 353762 - RNA, 24 nt, Human
aagacgccagacacaaaauacuac

SEQ ID NO: 353763 - RNA, 24 nt, Human
aauguuagaauggaagaugaaaau

SEQ ID NO: 353764 - RNA, 18 nt, Human
acaaaacuacaagauacc

SEQ ID NO: 353765 - RNA, 24 nt, Human
agaaaaaaagggaaacuuuucuaa

SEQ ID NO: 353766 - RNA, 22 nt, Human
agaaaaugaaaaacauauguga

SEQ ID NO: 353767 - RNA, 21 nt, Human
agaaagaaaaacuuauaaaga

SEQ ID NO: 353768 - RNA, 18 nt, Human
agacuggaaaugcaagug

SEQ ID NO: 353769 - RNA, 24 nt, Human
agagauuauuaagaacucauuuaa

SEQ ID NO: 353770 - RNA, 22 nt, Human
agaugaaccucaagaacaccau

SEQ ID NO: 353771 - RNA, 19 nt, Human
augaggaaauguccacgua

SEQ ID NO: 353772 - RNA, 25 nt, Human
auggcccagcaauuucuagccuagg

SEQ ID NO: 353773 - RNA, 24 nt, Human
caaaaaaaaaaaaaaaaaccagaa

SEQ ID NO: 353774 - RNA, 27 nt, Human
caaaaaaaaaaaaaaaaaccagaaaaa

SEQ ID NO: 353775 - RNA, 20 nt, Human
caaaaaaaaggacauuucac

SEQ ID NO: 353776 - RNA, 23 nt, Human
caaaaaaaaggacauuucacuuu

SEQ ID NO: 353777 - RNA, 26 nt, Human
caaaaagcaucuucagaaaauaucau

SEQ ID NO: 353778 - RNA, 22 nt, Human
caaacaaauggccaauaagcac

SEQ ID NO: 353779 - RNA, 19 nt, Human
caacuacaucauuuaucuu

SEQ ID NO: 353780 - RNA, 18 nt, Human
caagacagacaacccaaa

SEQ ID NO: 353781 - RNA, 19 nt, Human
caagacgccagacacaaaa

SEQ ID NO: 353782 - RNA, 21 nt, Human
caagacuggaaaugcaaguga

SEQ ID NO: 353783 - RNA, 23 nt, Human
caagauaccaauuuacuuucaaa

SEQ ID NO: 353784 - RNA, 21 nt, Human
cauaaagacacaauccuggau

SEQ ID NO: 353785 - RNA, 20 nt, Human
cauggaaauauucuaaaacu

SEQ ID NO: 353786 - RNA, 22 nt, Human
ccaaaggggagauuaucaauga

SEQ ID NO: 353787 - RNA, 18 nt, Human
ccaaaugucccucaacug

SEQ ID NO: 353788 - RNA, 23 nt, Human
ccucacucaaaaaaaaaaaaaaa

SEQ ID NO: 353789 - RNA, 24 nt, Human
ccucacucaaaaaaaaaaaaaaag

SEQ ID NO: 353790 - RNA, 20 nt, Human
cuaaaagcagcaaugccaug

SEQ ID NO: 353791 - RNA, 20 nt, Human
cuagaaauaaaauaggucuu

SEQ ID NO: 353792 - RNA, 26 nt, Human
cucaaauaccacauuuauuacacaau

SEQ ID NO: 353793 - RNA, 19 nt, Human
cucaaccuaauuagauauu

SEQ ID NO: 353794 - RNA, 24 nt, Human
cucggguuuuuggagagacggugg

SEQ ID NO: 353795 - RNA, 23 nt, Human
gagcauuagguauagauucagag

SEQ ID NO: 353796 - RNA, 21 nt, Human
gaucuuguuaaaaacuggagg

SEQ ID NO: 353797 - RNA, 19 nt, Human
gauguuggugaggauuuga

SEQ ID NO: 353798 - RNA, 24 nt, Human
ggaaacuucuuagggucauggaaa

SEQ ID NO: 353799 - RNA, 22 nt, Human
ggaacaauccaaaugucccuca

SEQ ID NO: 353800 - RNA, 21 nt, Human
uaaaaccaccaugagaugcca

SEQ ID NO: 353801 - RNA, 22 nt, Human
uaaaaccaccaugagaugccac

SEQ ID NO: 353802 - RNA, 19 nt, Human
uaaaagcagcaaugccaug

SEQ ID NO: 353803 - RNA, 24 nt, Human
uaacgcuagaaaauuuacuaaaag

SEQ ID NO: 353804 - RNA, 18 nt, Human
uaaguaucaauacauacu

SEQ ID NO: 353805 - RNA, 19 nt, Human
uaagugcaagacgccagac

SEQ ID NO: 353806 - RNA, 19 nt, Human
uacaaagucuaaaaaggug

SEQ ID NO: 353807 - RNA, 22 nt, Human
uagaaagaaaaacuuauaaaga

SEQ ID NO: 353808 - RNA, 23 nt, Human
uauuaagaacucauuuaacucaa

SEQ ID NO: 353809 - RNA, 23 nt, Human
ucacucaaaaaaaaaaaaaaaaa

SEQ ID NO: 353810 - RNA, 27 nt, Human
ucacucaaaaaaaaaaaaaaaaaccag

SEQ ID NO: 353811 - RNA, 22 nt, Human
ugaaaaacauaugugaacacaa

SEQ ID NO: 353812 - RNA, 19 nt, Human
ugagaugccacuuuguacc

SEQ ID NO: 353813 - RNA, 21 nt, Human
ugaggaaacuucuuaggguca

SEQ ID NO: 353814 - RNA, 23 nt, Human
ugaggauuugaagacacuaguuu

SEQ ID NO: 353815 - RNA, 22 nt, Human
ugauggccaagacuggaaaugc

SEQ ID NO: 353816 - RNA, 20 nt, Human
ugauuuguauacauuucacc

SEQ ID NO: 353817 - RNA, 21 nt, Human
ugauuuuagcgagaccucggg

SEQ ID NO: 353818 - RNA, 24 nt, Human
uggaaaugcaaauuaaaaccacca

SEQ ID NO: 353819 - RNA, 20 nt, Human
uggcuauaaucauaaagaca

SEQ ID NO: 353820 - RNA, 22 nt, Human
uggcugggcaacgaacuaggaa

SEQ ID NO: 353821 - RNA, 21 nt, Human
ugggaaaacaguuugacuguu

SEQ ID NO: 353822 - RNA, 24 nt, Human
uguauacauuucaccaaacaaagu

SEQ ID NO: 353823 - RNA, 22 nt, Human
uucaccaaacaaagucaaacaa

SEQ ID NO: 353824 - RNA, 18 nt, Human
uugacucaccuuacgcau

SEQ ID NO: 353825 - RNA, 24 nt, Human
uuucaaaggaaaccaaaggggaga

SEQ ID NO: 353826 - RNA, 24 nt, Human
uuucauaaucauaugaguaacacu

SEQ ID NO: 353827 - RNA, 22 nt, Human
uuugcuacuguauucccaaauc

SEQ ID NO: 353828 - RNA, 19 nt, Human
uuuuguccugggcauuuga

SEQ ID NO: 353829 - RNA, 23 nt, Human
uuuuuuuuuuuuuuuuuaugagg

SEQ ID NO: 353830 - RNA, 18 nt, Human
aaaguaaaaguuaauguu

SEQ ID NO: 353831 - RNA, 24 nt, Human
agaagagcagaaauauguagaaaa

SEQ ID NO: 353832 - RNA, 20 nt, Human
cugacgggcaaugcuccucu

SEQ ID NO: 353833 - RNA, 24 nt, Human
cugacgggcaaugcuccucugaga

SEQ ID NO: 353834 - RNA, 24 nt, Human
gcaugaucccauuuuagaagacca

SEQ ID NO: 353835 - RNA, 24 nt, Human
guuguucucugguuauucucugag

SEQ ID NO: 353836 - RNA, 31 nt, Human
uaaauuuuuggcaauuugaaauagcaauucu

SEQ ID NO: 353837 - RNA, 24 nt, Human
uaacagaucaucugcuucuauaac

SEQ ID NO: 353838 - RNA, 18 nt, Human
uacagacauauauaugug

SEQ ID NO: 353839 - RNA, 21 nt, Human
uacuuauucuucauuaugaga

SEQ ID NO: 353840 - RNA, 25 nt, Human
uauaagauacagacauauauaugug

SEQ ID NO: 353841 - RNA, 24 nt, Human
ucaaucugguuguucucugguuau

SEQ ID NO: 353842 - RNA, 19 nt, Human
ugauaguaaggaaaaucua

SEQ ID NO: 353843 - RNA, 21 nt, Human
aaacaggucacaaacagaauu

SEQ ID NO: 353844 - RNA, 23 nt, Human
aaagaaauguguguuucuaggga

SEQ ID NO: 353845 - RNA, 26 nt, Human
aagaaaagaaauaugagccaagagaa

SEQ ID NO: 353846 - RNA, 23 nt, Human
aagaaggauuuagguaucaccua

SEQ ID NO: 353847 - RNA, 25 nt, Human
aaucacaaaauuuagaaacauaaga

SEQ ID NO: 353848 - RNA, 25 nt, Human
agaaaagaaauaugagccaagagaa

SEQ ID NO: 353849 - RNA, 21 nt, Human
agaaacauaagaaggauuuag

SEQ ID NO: 353850 - RNA, 24 nt, Human
agaaagaaaagaaauaugagccaa

SEQ ID NO: 353851 - RNA, 27 nt, Human
agaaagaaaagaaauaugagccaagag

SEQ ID NO: 353852 - RNA, 18 nt, Human
agagaaagagagaaaggc

SEQ ID NO: 353853 - RNA, 19 nt, Human
agagaaagagagaaaggca

SEQ ID NO: 353854 - RNA, 25 nt, Human
agaggaagcagaggugggcagagag

SEQ ID NO: 353855 - RNA, 23 nt, Human
cacaaaauuuagaaacagcggac

SEQ ID NO: 353856 - RNA, 19 nt, Human
caguuuaccagaacaucug

SEQ ID NO: 353857 - RNA, 23 nt, Human
caucaagaugagaaagaaaagaa

SEQ ID NO: 353858 - RNA, 19 nt, Human
ccagaacaucugcagguga

SEQ ID NO: 353859 - RNA, 25 nt, Human
uauagaaucacaaaauuuagaaaca

SEQ ID NO: 353860 - RNA, 22 nt, Human
uauuuuauugaugauguguuuu

SEQ ID NO: 353861 - RNA, 21 nt, Human
ucaagaugagaaagaaaagaa

SEQ ID NO: 353862 - RNA, 22 nt, Human
uccucaaggagaauuuuucugg

SEQ ID NO: 353863 - RNA, 18 nt, Human
ugagccaagagaaucugu

SEQ ID NO: 353864 - RNA, 21 nt, Human
uggaagaaaaaguacauuuau

SEQ ID NO: 353865 - RNA, 23 nt, Human
ugggcuuauuaagagaaagagag

SEQ ID NO: 353866 - RNA, 19 nt, Human
uuccuagaggaagcagagg

SEQ ID NO: 353867 - RNA, 21 nt, Human
uugaugaugacgaucaucauc

SEQ ID NO: 353868 - RNA, 23 nt, Human
aaagaaauguguguuucuaggga

SEQ ID NO: 353869 - RNA, 23 nt, Human
aacaccucuaggugaacauuuuc

SEQ ID NO: 353870 - RNA, 23 nt, Human
aagaaggauuuagguaucaccua

SEQ ID NO: 353871 - RNA, 25 nt, Human
aaucacaaaauuuagaaacauaaga

SEQ ID NO: 353872 - RNA, 21 nt, Human
aaugaagggugagauccuaaa

SEQ ID NO: 353873 - RNA, 25 nt, Human
agaaaagaaauaugagccaagagaa

SEQ ID NO: 353874 - RNA, 21 nt, Human
agaaacauaagaaggauuuag

SEQ ID NO: 353875 - RNA, 19 nt, Human
agagaaagagagaaaggca

SEQ ID NO: 353876 - RNA, 25 nt, Human
agaggaagcagaggugggcagagag

SEQ ID NO: 353877 - RNA, 27 nt, Human
agaggaagcagaggugggcagagaggc

SEQ ID NO: 353878 - RNA, 24 nt, Human
agauagaaaagaaauaugagccaa

SEQ ID NO: 353879 - RNA, 23 nt, Human
aggaagcagaggugggcagagag

SEQ ID NO: 353880 - RNA, 23 nt, Human
cacaaaauuuagaaacagcggac

SEQ ID NO: 353881 - RNA, 18 nt, Human
cauuauuuuauugaugau

SEQ ID NO: 353882 - RNA, 23 nt, Human
ccagaacaccucuaggugaacau

SEQ ID NO: 353883 - RNA, 21 nt, Human
uaaaugauucaucuuaucuug

SEQ ID NO: 353884 - RNA, 26 nt, Human
uagaaaagaaauaugagccaagagaa

SEQ ID NO: 353885 - RNA, 20 nt, Human
uagaagacacgguauuaaau

SEQ ID NO: 353886 - RNA, 25 nt, Human
uauagaaucacaaaauuuagaaaca

SEQ ID NO: 353887 - RNA, 22 nt, Human
uauuuuauugaugauguguuuu

SEQ ID NO: 353888 - RNA, 21 nt, Human
ugaagagaaaguaugauuugg

SEQ ID NO: 353889 - RNA, 19 nt, Human
ugacuaucaucaucaagau

SEQ ID NO: 353890 - RNA, 18 nt, Human
ugagccaagagaaucugu

SEQ ID NO: 353891 - RNA, 25 nt, Human
ugggcagagaggcugugugugucug

SEQ ID NO: 353892 - RNA, 23 nt, Human
ugggcuuauuaagagaaagagag

SEQ ID NO: 353893 - RNA, 19 nt, Human
uuccuagaggaagcagagg

SEQ ID NO: 353894 - RNA, 21 nt, Human
aaaaaggaaacaaaagauaga

SEQ ID NO: 353895 - RNA, 24 nt, Human
aaaaggaaacaaaagauagaauug

SEQ ID NO: 353896 - RNA, 21 nt, Human
aaaaggaacaggcaagcgagg

SEQ ID NO: 353897 - RNA, 22 nt, Human
aaaaggucuaucugugugaagg

SEQ ID NO: 353898 - RNA, 19 nt, Human
aaacaaaagauagaauugg

SEQ ID NO: 353899 - RNA, 24 nt, Human
aaagaaggaaagcauagugcuggg

SEQ ID NO: 353900 - RNA, 25 nt, Human
aagaaccuauuuacaaugcauguca

SEQ ID NO: 353901 - RNA, 18 nt, Human
aagaaggaaagcauagug

SEQ ID NO: 353902 - RNA, 31 nt, Human
aagaaggaaagcauagugcugggaagaagaa

SEQ ID NO: 353903 - RNA, 25 nt, Human
acaagaagaaccuauuuacaaugca

SEQ ID NO: 353904 - RNA, 21 nt, Human
agaaggaaagcauagugcugg

SEQ ID NO: 353905 - RNA, 18 nt, Human
agacugaaaaacuaugug

SEQ ID NO: 353906 - RNA, 19 nt, Human
agcauagugcugggaagaa

SEQ ID NO: 353907 - RNA, 28 nt, Human
agucagggaggacuuaacaugggcuaug

SEQ ID NO: 353908 - RNA, 19 nt, Human
auagacugaaaaacuaugu

SEQ ID NO: 353909 - RNA, 21 nt, Human
aucccaaagaaggaaagcaua

SEQ ID NO: 353910 - RNA, 19 nt, Human
augaaucucuggaugcaga

SEQ ID NO: 353911 - RNA, 18 nt, Human
caacagggauagcuuauc

SEQ ID NO: 353912 - RNA, 26 nt, Human
caacagggauagcuuauccacccaac

SEQ ID NO: 353913 - RNA, 22 nt, Human
caagaagaaccuauuuacaaug

SEQ ID NO: 353914 - RNA, 23 nt, Human
cagaacaagaagaaccuauuuac

SEQ ID NO: 353915 - RNA, 19 nt, Human
cagcuagaagccccugcca

SEQ ID NO: 353916 - RNA, 23 nt, Human
cagggaggacuuaacaugggcua

SEQ ID NO: 353917 - RNA, 23 nt, Human
cagggauagcuuauccacccaac

SEQ ID NO: 353918 - RNA, 23 nt, Human
cauacgcauuuggcagcaaauuu

SEQ ID NO: 353919 - RNA, 21 nt, Human
cccaaagaaggaaagcauagu

SEQ ID NO: 353920 - RNA, 19 nt, Human
cuagaagccccugccacca

SEQ ID NO: 353921 - RNA, 19 nt, Human
cuggcggcuuccugaucca

SEQ ID NO: 353922 - RNA, 19 nt, Human
gaaaucggcauccacagaa

SEQ ID NO: 353923 - RNA, 22 nt, Human
gaacaagaagaaccuauuuaca

SEQ ID NO: 353924 - RNA, 20 nt, Human
gccuggagucacaguuaucc

SEQ ID NO: 353925 - RNA, 19 nt, Human
gggaaaaaaggaaacaaaa

SEQ ID NO: 353926 - RNA, 19 nt, Human
gggaaaaaaggaaacaaaa

SEQ ID NO: 353927 - RNA, 22 nt, Human
guaacuaaacccauagacugaa

SEQ ID NO: 353928 - RNA, 23 nt, Human
uaaacccauagacugaaaaacua

SEQ ID NO: 353929 - RNA, 22 nt, Human
uaaaguaacuaaacccauagac

SEQ ID NO: 353930 - RNA, 26 nt, Human
uaacuaaacccauagacugaaaaacu

SEQ ID NO: 353931 - RNA, 23 nt, Human
uagacugaaaaacuaugugucaa

SEQ ID NO: 353932 - RNA, 23 nt, Human
uagcauaggagaaauucaauauu

SEQ ID NO: 353933 - RNA, 21 nt, Human
uaggaauuuucuuuguggaag

SEQ ID NO: 353934 - RNA, 19 nt, Human
uauaguagccugagcaugu

SEQ ID NO: 353935 - RNA, 19 nt, Human
ucaacacaaauucugauau

SEQ ID NO: 353936 - RNA, 18 nt, Human
ucacuggagccagggcag

SEQ ID NO: 353937 - RNA, 21 nt, Human
ucagaacaagaagaaccuauu

SEQ ID NO: 353938 - RNA, 20 nt, Human
ucagggaggacuuaacaugg

SEQ ID NO: 353939 - RNA, 18 nt, Human
ucccaaagaaggaaagca

SEQ ID NO: 353940 - RNA, 19 nt, Human
ucuacauuuuguugcagca

SEQ ID NO: 353941 - RNA, 22 nt, Human
ucuagaaaaugaaucucuggau

SEQ ID NO: 353942 - RNA, 24 nt, Human
ucuaucccaaagaaggaaagcaua

SEQ ID NO: 353943 - RNA, 25 nt, Human
ucugauccaugaaguucuauaacau

SEQ ID NO: 353944 - RNA, 20 nt, Human
ugaagagacaaguuccuuca

SEQ ID NO: 353945 - RNA, 21 nt, Human
ugagaaucccugugcgaguca

SEQ ID NO: 353946 - RNA, 19 nt, Human
ugauaucggcuauugugag

SEQ ID NO: 353947 - RNA, 23 nt, Human
ugccaucuaaaguaacuaaaccc

SEQ ID NO: 353948 - RNA, 18 nt, Human
uggaacauucucuauccc

SEQ ID NO: 353949 - RNA, 22 nt, Human
uggagccagggcaguuucgugg

SEQ ID NO: 353950 - RNA, 24 nt, Human
ugucauugucuuaugggaaaaaag

SEQ ID NO: 353951 - RNA, 24 nt, Human
uuauccaacauuccacaaucugaa

SEQ ID NO: 353952 - RNA, 21 nt, Human
uuccuucaacacaaauucuga

SEQ ID NO: 353953 - RNA, 21 nt, Human
uuuauagguugcugccccaga

SEQ ID NO: 353954 - RNA, 24 nt, Human
uuuauuguaucuagaaaaugaauc

SEQ ID NO: 353955 - RNA, 18 nt, Human
uuugucugaauauucuac

SEQ ID NO: 353956 - RNA, 23 nt, Human
uuuguugcagcauauuaaggucg

SEQ ID NO: 353957 - RNA, 19 nt, Human
aacccugauuauuaccauc

SEQ ID NO: 353958 - RNA, 21 nt, Human
aggggacagagaggagagggg

SEQ ID NO: 353959 - RNA, 23 nt, Human
aggggacagagaggagaggggcu

SEQ ID NO: 353960 - RNA, 25 nt, Human
augggcccuuuauuucugaacugcc

SEQ ID NO: 353961 - RNA, 24 nt, Human
ccaacccugauuauuaccaucucc

SEQ ID NO: 353962 - RNA, 23 nt, Human
ccacaaaugggcccuuuauuucu

SEQ ID NO: 353963 - RNA, 18 nt, Human
cuagauaaaucuaaaucc

SEQ ID NO: 353964 - RNA, 29 nt, Human
cucccuugguacuuccugcuccucaccgg

SEQ ID NO: 353965 - RNA, 19 nt, Human
cucuucaaggcccaaauca

SEQ ID NO: 353966 - RNA, 20 nt, Human
gggacagagaggagaggggc

SEQ ID NO: 353967 - RNA, 24 nt, Human
uaaauccagucaauuacucuucaa

SEQ ID NO: 353968 - RNA, 24 nt, Human
ucagauauucuccacccaacccug

SEQ ID NO: 353969 - RNA, 18 nt, Human
ucuaaauccagucaauua

SEQ ID NO: 353970 - RNA, 21 nt, Human
ucugcugggaacgaccuuucu

SEQ ID NO: 353971 - RNA, 21 nt, Human
ugauuauuaccaucuccaucc

SEQ ID NO: 353972 - RNA, 22 nt, Human
ugcacggauaaggccacuuggg

SEQ ID NO: 353973 - RNA, 18 nt, Human
ugcggcaucccacaaaug

SEQ ID NO: 353974 - RNA, 21 nt, Human
uggguugcaggcacacugugg

SEQ ID NO: 353975 - RNA, 24 nt, Human
uguuguucuuguugcuucugcugg

SEQ ID NO: 353976 - RNA, 26 nt, Human
uuggguugcaggcacacuguggagug

SEQ ID NO: 353977 - RNA, 18 nt, Human
uuguugcuucugcuggga

SEQ ID NO: 353978 - RNA, 28 nt, Human
aaggucuccugcugcugcugcugcugcc

SEQ ID NO: 353979 - RNA, 24 nt, Human
agaaggucuccugcugcugcugcu

SEQ ID NO: 353980 - RNA, 22 nt, Human
ccgccgccgccgccgccgcugc

SEQ ID NO: 353981 - RNA, 22 nt, Human
ccgccgccgccgccgccgcugc

SEQ ID NO: 353982 - RNA, 22 nt, Human
ccgccgccgccgccgccgcugc

SEQ ID NO: 353983 - RNA, 25 nt, Human
ccgccgccgccgccgccgcugcugc

SEQ ID NO: 353984 - RNA, 26 nt, Human
ccgccgccgccgccgccgcugcugcu

SEQ ID NO: 353985 - RNA, 18 nt, Human
cgccgccgccgcugcugc

SEQ ID NO: 353986 - RNA, 21 nt, Human
cugccgccgccgccgccgccg

SEQ ID NO: 353987 - RNA, 20 nt, Human
gccgccgccgccgccgccgc

SEQ ID NO: 353988 - RNA, 22 nt, Human
gcugccgccgccgccgccgccg

SEQ ID NO: 353989 - RNA, 22 nt, Human
gcugcugccgccgccgccgccg

SEQ ID NO: 353990 - RNA, 22 nt, Human
gcugcugcugccgccgccgccg

SEQ ID NO: 353991 - RNA, 22 nt, Human
gcugcugcugcugccgccgccg

SEQ ID NO: 353992 - RNA, 21 nt, Human
gucuccugcugcugcugcugc

SEQ ID NO: 353993 - RNA, 19 nt, Human
uagguagaaggaaaggagg

SEQ ID NO: 353994 - RNA, 21 nt, Human
uagguagaaggaaaggagggu

SEQ ID NO: 353995 - RNA, 23 nt, Human
ucuccugcugcugcugcugcugc

SEQ ID NO: 353996 - RNA, 24 nt, Human
aaaaaaaaaacucagugauaucca

SEQ ID NO: 353997 - RNA, 22 nt, Human
aaaagauacugaacuagggcug

SEQ ID NO: 353998 - RNA, 23 nt, Human
aaacaaauacagguacacaaaca

SEQ ID NO: 353999 - RNA, 21 nt, Human
aaacaacccaaaguccaucaa

SEQ ID NO: 354000 - RNA, 25 nt, Human
aacaaaauuuaaaaggcaauacaag

SEQ ID NO: 354001 - RNA, 19 nt, Human
aacacggugaaaccccguc

SEQ ID NO: 354002 - RNA, 20 nt, Human
aacacggugaaaccccgucu

SEQ ID NO: 354003 - RNA, 21 nt, Human
aacacggugaaaccccgucuc

SEQ ID NO: 354004 - RNA, 18 nt, Human
aacacuguuuauuaauga

SEQ ID NO: 354005 - RNA, 20 nt, Human
aacccaaaguccaucaauga

SEQ ID NO: 354006 - RNA, 19 nt, Human
aagaagccagacacaaaag

SEQ ID NO: 354007 - RNA, 23 nt, Human
aagagccaauaaaugcauagaac

SEQ ID NO: 354008 - RNA, 22 nt, Human
aagcagaaaaguagguguguga

SEQ ID NO: 354009 - RNA, 24 nt, Human
aagucagaaacaacccaaagucca

SEQ ID NO: 354010 - RNA, 21 nt, Human
aauacagguacacaaacauuc

SEQ ID NO: 354011 - RNA, 20 nt, Human
aauugcuugaauccaggagg

SEQ ID NO: 354012 - RNA, 24 nt, Human
acacuccagccugggugacagagu

SEQ ID NO: 354013 - RNA, 23 nt, Human
acagagugaggcacugucucaaa

SEQ ID NO: 354014 - RNA, 24 nt, Human
acagagugaggcacugucucaaaa

SEQ ID NO: 354015 - RNA, 18 nt, Human
accacuaauaaaagaaau

SEQ ID NO: 354016 - RNA, 24 nt, Human
accccgucucuacuaaaaauacaa

SEQ ID NO: 354017 - RNA, 25 nt, Human
accccgucucuacugaaaaauacaa

SEQ ID NO: 354018 - RNA, 18 nt, Human
acuacacuccagccuggg

SEQ ID NO: 354019 - RNA, 24 nt, Human
acuacacuccagccugggugacag

SEQ ID NO: 354020 - RNA, 21 nt, Human
acuaugaggggcacccagaua

SEQ ID NO: 354021 - RNA, 24 nt, Human
acuccagccugggugacagaguga

SEQ ID NO: 354022 - RNA, 24 nt, Human
acugaaaaauacaaaauuagccgg

SEQ ID NO: 354023 - RNA, 24 nt, Human
acugcacuccagccugggcgacag

SEQ ID NO: 354024 - RNA, 26 nt, Human
acugcacuccagccugggcgacagag

SEQ ID NO: 354025 - RNA, 26 nt, Human
agaaaggaaaaacuucucaaagaaga

SEQ ID NO: 354026 - RNA, 24 nt, Human
agaacauuuuuuuuggaacuuuaa

SEQ ID NO: 354027 - RNA, 22 nt, Human
agagaaaauauaaaacagaggg

SEQ ID NO: 354028 - RNA, 24 nt, Human
agagaucgagccacugcacuccag

SEQ ID NO: 354029 - RNA, 24 nt, Human
agcacuuugggaggccgaggcggg

SEQ ID NO: 354030 - RNA, 24 nt, Human
agcacuuugggaggcugagguagg

SEQ ID NO: 354031 - RNA, 22 nt, Human
agccgggugugguggugggugc

SEQ ID NO: 354032 - RNA, 23 nt, Human
agccgggugugguggugggugcu

SEQ ID NO: 354033 - RNA, 20 nt, Human
agccugggugacagagugag

SEQ ID NO: 354034 - RNA, 21 nt, Human
aggaagagggaaauggccgag

SEQ ID NO: 354035 - RNA, 19 nt, Human
aggaggagguugcagugag

SEQ ID NO: 354036 - RNA, 23 nt, Human
aggaguucaagaccaacacggcc

SEQ ID NO: 354037 - RNA, 23 nt, Human
aggcaaagacauauguaaaaacg

SEQ ID NO: 354038 - RNA, 20 nt, Human
aggcagcggguuaaggaaug

SEQ ID NO: 354039 - RNA, 21 nt, Human
aggcagcggguuaaggaaugu

SEQ ID NO: 354040 - RNA, 21 nt, Human
aggcaggagaauggcgugaac

SEQ ID NO: 354041 - RNA, 24 nt, Human
aggcaggagaauggcgugaacccg

SEQ ID NO: 354042 - RNA, 21 nt, Human
aggccgaggcggguggaucac

SEQ ID NO: 354043 - RNA, 24 nt, Human
aggcggagcuugcagugagcagag

SEQ ID NO: 354044 - RNA, 24 nt, Human
aggcggguggaucacgaggucagg

SEQ ID NO: 354045 - RNA, 19 nt, Human
aggcugaggcaggagaaug

SEQ ID NO: 354046 - RNA, 24 nt, Human
aggcugagguaggcggauugcuug

SEQ ID NO: 354047 - RNA, 23 nt, Human
agguaggcggauugcuugaggcc

SEQ ID NO: 354048 - RNA, 26 nt, Human
agguaggcggauugcuugaggccagg

SEQ ID NO: 354049 - RNA, 23 nt, Human
aguaggugugugaaugacaauuc

SEQ ID NO: 354050 - RNA, 21 nt, Human
aguggcuuaugccuguaaucc

SEQ ID NO: 354051 - RNA, 24 nt, Human
aguggcuuaugccuguaauccuag

SEQ ID NO: 354052 - RNA, 24 nt, Human
aucaugccacuacacuccagccug

SEQ ID NO: 354053 - RNA, 24 nt, Human
aucgagccacugcacuccagccug

SEQ ID NO: 354054 - RNA, 22 nt, Human
augccacuacacuccagccugg

SEQ ID NO: 354055 - RNA, 21 nt, Human
caacuuacuuauuacugcacu

SEQ ID NO: 354056 - RNA, 24 nt, Human
caagaaugagagaaaauauaaaac

SEQ ID NO: 354057 - RNA, 18 nt, Human
caauagccaaaagucaga

SEQ ID NO: 354058 - RNA, 19 nt, Human
cacgaaagaagugcccucc

SEQ ID NO: 354059 - RNA, 24 nt, Human
cacuacacuccagccugggugaca

SEQ ID NO: 354060 - RNA, 24 nt, Human
cacuccagccugggcgacagagag

SEQ ID NO: 354061 - RNA, 22 nt, Human
cacuccagccugggugacagag

SEQ ID NO: 354062 - RNA, 24 nt, Human
cacuccagccugggugacagagug

SEQ ID NO: 354063 - RNA, 19 nt, Human
cacugcacuccagccuggg

SEQ ID NO: 354064 - RNA, 20 nt, Human
cacugcacuccagccugggc

SEQ ID NO: 354065 - RNA, 22 nt, Human
cacugcacuccagccugggcga

SEQ ID NO: 354066 - RNA, 23 nt, Human
cacugcacuccagccugggcgac

SEQ ID NO: 354067 - RNA, 24 nt, Human
cacugcacuccagccugggcgaca

SEQ ID NO: 354068 - RNA, 20 nt, Human
cacugcacuccagccugggg

SEQ ID NO: 354069 - RNA, 21 nt, Human
cagaaauuggaauucucauac

SEQ ID NO: 354070 - RNA, 24 nt, Human
cagcacuuugggaggccgaggcgg

SEQ ID NO: 354071 - RNA, 24 nt, Human
cagcuacucgggaggcugaggcag

SEQ ID NO: 354072 - RNA, 20 nt, Human
ccacuacacuccagccuggg

SEQ ID NO: 354073 - RNA, 21 nt, Human
ccacuacacuccagccugggu

SEQ ID NO: 354074 - RNA, 21 nt, Human
ccacuacacuccagccugggu

SEQ ID NO: 354075 - RNA, 24 nt, Human
ccacuacacuccagccugggugac

SEQ ID NO: 354076 - RNA, 20 nt, Human
ccacugcacuccagccuggg

SEQ ID NO: 354077 - RNA, 21 nt, Human
ccacugcacuccagccugggc

SEQ ID NO: 354078 - RNA, 21 nt, Human
ccacugcacuccagccugggc

SEQ ID NO: 354079 - RNA, 23 nt, Human
ccacugcacuccagccugggcga

SEQ ID NO: 354080 - RNA, 24 nt, Human
ccacugcacuccagccugggcgac

SEQ ID NO: 354081 - RNA, 22 nt, Human
ccaggaggaggagguugcagug

SEQ ID NO: 354082 - RNA, 20 nt, Human
cccagaucaugccacuacac

SEQ ID NO: 354083 - RNA, 20 nt, Human
ccgugccgcgcuccgagccu

SEQ ID NO: 354084 - RNA, 19 nt, Human
ccuagauauauacccaaga

SEQ ID NO: 354085 - RNA, 23 nt, Human
ccuggcuaacacggugaaacccc

SEQ ID NO: 354086 - RNA, 24 nt, Human
ccuggcuaacacggugaaaccccg

SEQ ID NO: 354087 - RNA, 18 nt, Human
ccugggugacagagugag

SEQ ID NO: 354088 - RNA, 20 nt, Human
ccuguaaucccagcacuuug

SEQ ID NO: 354089 - RNA, 22 nt, Human
ccuguaaucccagcacuuuggg

SEQ ID NO: 354090 - RNA, 19 nt, Human
ccuguagucccagcuacuc

SEQ ID NO: 354091 - RNA, 21 nt, Human
ccuguagucccagcuacucgg

SEQ ID NO: 354092 - RNA, 22 nt, Human
ccuguagucccagcuacucggg

SEQ ID NO: 354093 - RNA, 24 nt, Human
cgacaccauccuggcuaacacggu

SEQ ID NO: 354094 - RNA, 20 nt, Human
cgacccccgaggcgcagccu

SEQ ID NO: 354095 - RNA, 24 nt, Human
cgaggcggguggaucacgagguca

SEQ ID NO: 354096 - RNA, 24 nt, Human
cgccuguagucccagcuacucggg

SEQ ID NO: 354097 - RNA, 24 nt, Human
cggauugcuugaggccaggaguuc

SEQ ID NO: 354098 - RNA, 18 nt, Human
cggccaauguggcgaaac

SEQ ID NO: 354099 - RNA, 19 nt, Human
cucaaaaagcuaaacauag

SEQ ID NO: 354100 - RNA, 24 nt, Human
cucaagccuguaaucccagcacuu

SEQ ID NO: 354101 - RNA, 19 nt, Human
cucaucuuugcacuuggcu

SEQ ID NO: 354102 - RNA, 18 nt, Human
cuggcuaacacggugaaa

SEQ ID NO: 354103 - RNA, 22 nt, Human
cugucucaaaaaaaaaaaaaaa

SEQ ID NO: 354104 - RNA, 19 nt, Human
cuugaggccaggaguucaa

SEQ ID NO: 354105 - RNA, 20 nt, Human
gaaagaagccagacacaaaa

SEQ ID NO: 354106 - RNA, 20 nt, Human
gaaagcacagggucgccaga

SEQ ID NO: 354107 - RNA, 21 nt, Human
gaaggaaggaauggagaguaa

SEQ ID NO: 354108 - RNA, 20 nt, Human
gacauauguaaaaacgaagc

SEQ ID NO: 354109 - RNA, 23 nt, Human
gagaauugcuugaauccaggagg

SEQ ID NO: 354110 - RNA, 24 nt, Human
gagauaccacuucacacccacuaa

SEQ ID NO: 354111 - RNA, 18 nt, Human
gagcccagaucaugccac

SEQ ID NO: 354112 - RNA, 21 nt, Human
gaggaaauucaagagccaaua

SEQ ID NO: 354113 - RNA, 26 nt, Human
gagggcagacagguaaggaaucugcc

SEQ ID NO: 354114 - RNA, 19 nt, Human
gagguugcagugagcccag

SEQ ID NO: 354115 - RNA, 28 nt, Human
gcacugucucaaaaaaaaaaaaaaaaaa

SEQ ID NO: 354116 - RNA, 24 nt, Human
gccaauguggcgaaaccccgucuc

SEQ ID NO: 354117 - RNA, 19 nt, Human
gccacuacacuccagccug

SEQ ID NO: 354118 - RNA, 24 nt, Human
gccacuacacuccagccuggguga

SEQ ID NO: 354119 - RNA, 22 nt, Human
gccacugcacuccagccugggc

SEQ ID NO: 354120 - RNA, 24 nt, Human
gccacugcacuccagccugggcga

SEQ ID NO: 354121 - RNA, 20 nt, Human
gcccagaucaugccacuaca

SEQ ID NO: 354122 - RNA, 19 nt, Human
gccuguaauccuagcacuu

SEQ ID NO: 354123 - RNA, 21 nt, Human
gcgaaaccccgucucuacuga

SEQ ID NO: 354124 - RNA, 24 nt, Human
gcuaacacggugaaaccccgucuc

SEQ ID NO: 354125 - RNA, 22 nt, Human
gcugaggcaggagaauggcgug

SEQ ID NO: 354126 - RNA, 22 nt, Human
ggaaucauuauggucuauuuuc

SEQ ID NO: 354127 - RNA, 18 nt, Human
ggagcuugcagugagcag

SEQ ID NO: 354128 - RNA, 24 nt, Human
ggagcuugcagugagcagagaucg

SEQ ID NO: 354129 - RNA, 22 nt, Human
ggaggaggagguugcagugagc

SEQ ID NO: 354130 - RNA, 20 nt, Human
ggagguugcagugagcccag

SEQ ID NO: 354131 - RNA, 24 nt, Human
ggagguugcagugagcccagauca

SEQ ID NO: 354132 - RNA, 23 nt, Human
ggauugcuugaggccaggaguuc

SEQ ID NO: 354133 - RNA, 18 nt, Human
ggcgugguggcgggcgcc

SEQ ID NO: 354134 - RNA, 24 nt, Human
gggcgcgguggcucaagccuguaa

SEQ ID NO: 354135 - RNA, 24 nt, Human
gggcgugguggcgggcgccuguag

SEQ ID NO: 354136 - RNA, 24 nt, Human
gggcucaguggcuuaugccuguaa

SEQ ID NO: 354137 - RNA, 21 nt, Human
gguggaucacgaggucaggag

SEQ ID NO: 354138 - RNA, 24 nt, Human
gguggcgggcgccuguagucccag

SEQ ID NO: 354139 - RNA, 23 nt, Human
gguggcucaagccuguaauccca

SEQ ID NO: 354140 - RNA, 24 nt, Human
gguggcucaagccuguaaucccag

SEQ ID NO: 354141 - RNA, 23 nt, Human
gguggugguuaugcaacauuguu

SEQ ID NO: 354142 - RNA, 19 nt, Human
guacuaagugaaagaagcc

SEQ ID NO: 354143 - RNA, 19 nt, Human
gugaaagaagccagacaca

SEQ ID NO: 354144 - RNA, 22 nt, Human
guggaaaacaguuugucuguuc

SEQ ID NO: 354145 - RNA, 20 nt, Human
guggggaucuggggacacag

SEQ ID NO: 354146 - RNA, 20 nt, Human
guguacuucacuuuguuuuc

SEQ ID NO: 354147 - RNA, 20 nt, Human
gugugugaaugacaauucau

SEQ ID NO: 354148 - RNA, 24 nt, Human
uaaaaauaaaagaacuaccacgaa

SEQ ID NO: 354149 - RNA, 20 nt, Human
uaaacaguccaaccugguca

SEQ ID NO: 354150 - RNA, 21 nt, Human
uaaauaaaucucaaaaacuug

SEQ ID NO: 354151 - RNA, 22 nt, Human
uaacacggugaaaccccgucuc

SEQ ID NO: 354152 - RNA, 24 nt, Human
uaacacggugaaaccccgucucua

SEQ ID NO: 354153 - RNA, 18 nt, Human
uaagacagagucccaacc

SEQ ID NO: 354154 - RNA, 22 nt, Human
uaaguguacuucacuuuguuuu

SEQ ID NO: 354155 - RNA, 18 nt, Human
uaaguugaaagacauuaa

SEQ ID NO: 354156 - RNA, 23 nt, Human
uacacaaacauucauagcagcac

SEQ ID NO: 354157 - RNA, 22 nt, Human
uacuaagugaaagaagccagac

SEQ ID NO: 354158 - RNA, 24 nt, Human
uagcaagaauagauaaaaccauag

SEQ ID NO: 354159 - RNA, 19 nt, Human
uagcaauaucuagcaccau

SEQ ID NO: 354160 - RNA, 24 nt, Human
uagcacuuugggaggcugagguag

SEQ ID NO: 354161 - RNA, 28 nt, Human
uagcacuuugggaggcugagguaggcgg

SEQ ID NO: 354162 - RNA, 24 nt, Human
uaggcggauugcuugaggccagga

SEQ ID NO: 354163 - RNA, 20 nt, Human
uaugccuguaauccuagcac

SEQ ID NO: 354164 - RNA, 24 nt, Human
uaugccuguaauccuagcacuuug

SEQ ID NO: 354165 - RNA, 20 nt, Human
uauggucuauuuucucaaga

SEQ ID NO: 354166 - RNA, 19 nt, Human
uauuacugcacuaugaggg

SEQ ID NO: 354167 - RNA, 22 nt, Human
ucaaaaaaaaaaaaaaaaaaaa

SEQ ID NO: 354168 - RNA, 23 nt, Human
ucaaaaaaaaaaaaaaaaaaaaa

SEQ ID NO: 354169 - RNA, 19 nt, Human
ucacacccacuaagauggc

SEQ ID NO: 354170 - RNA, 18 nt, Human
ucacgaggucaggagauc

SEQ ID NO: 354171 - RNA, 24 nt, Human
ucacgaggucaggagaucgacacc

SEQ ID NO: 354172 - RNA, 22 nt, Human
ucagaaaaaaaaaaaaaaaaaa

SEQ ID NO: 354173 - RNA, 25 nt, Human
ucagcauuaucuaucaaagggaccu

SEQ ID NO: 354174 - RNA, 20 nt, Human
uccaagauguccacuuggcc

SEQ ID NO: 354175 - RNA, 21 nt, Human
uccaagauguccacuuggccc

SEQ ID NO: 354176 - RNA, 22 nt, Human
uccaagauguccacuuggcccu

SEQ ID NO: 354177 - RNA, 20 nt, Human
uccagccugggcgacagaga

SEQ ID NO: 354178 - RNA, 23 nt, Human
uccagccugggugacagagugag

SEQ ID NO: 354179 - RNA, 24 nt, Human
uccagccugggugacagagugagg

SEQ ID NO: 354180 - RNA, 22 nt, Human
ucucuacuaaaaauacaaaaaa

SEQ ID NO: 354181 - RNA, 21 nt, Human
ucucuacugaaaaauacaaaa

SEQ ID NO: 354182 - RNA, 22 nt, Human
ucuggggacacaggaagaggga

SEQ ID NO: 354183 - RNA, 21 nt, Human
ugaaagacauuaaacagucca

SEQ ID NO: 354184 - RNA, 25 nt, Human
ugaagcaagagaauugcuugaaucc

SEQ ID NO: 354185 - RNA, 21 nt, Human
ugacccagcaguuccacuccu

SEQ ID NO: 354186 - RNA, 18 nt, Human
ugaggcacugucucaaaa

SEQ ID NO: 354187 - RNA, 24 nt, Human
ugaggcaggagaauggcgugaacc

SEQ ID NO: 354188 - RNA, 25 nt, Human
ugaggcaggagaauggcgugaaccc

SEQ ID NO: 354189 - RNA, 24 nt, Human
ugagguaggcggauugcuugaggc

SEQ ID NO: 354190 - RNA, 26 nt, Human
ugagguaggcggauugcuugaggcca

SEQ ID NO: 354191 - RNA, 23 nt, Human
ugcagugagcagagaucgagcca

SEQ ID NO: 354192 - RNA, 23 nt, Human
ugccuguaauccuagcacuuugg

SEQ ID NO: 354193 - RNA, 24 nt, Human
ugccuguaauccuagcacuuuggg

SEQ ID NO: 354194 - RNA, 21 nt, Human
ugcuuaaugggaugggguuuc

SEQ ID NO: 354195 - RNA, 24 nt, Human
ugcuuguagucucagcuacuuggg

SEQ ID NO: 354196 - RNA, 21 nt, Human
uggcacugaacuucucacuuu

SEQ ID NO: 354197 - RNA, 19 nt, Human
uggcgaaaccccgucucua

SEQ ID NO: 354198 - RNA, 24 nt, Human
uggcucaagccuguaaucccagca

SEQ ID NO: 354199 - RNA, 19 nt, Human
uggcuuaugccuguaaucc

SEQ ID NO: 354200 - RNA, 24 nt, Human
uggcuuaugccuguaauccuagca

SEQ ID NO: 354201 - RNA, 23 nt, Human
ugggaggccgaggcggguggauc

SEQ ID NO: 354202 - RNA, 24 nt, Human
ugggaggccgaggcggguggauca

SEQ ID NO: 354203 - RNA, 18 nt, Human
ugggaggcugagguaggc

SEQ ID NO: 354204 - RNA, 22 nt, Human
ugggaggcugagguaggcggau

SEQ ID NO: 354205 - RNA, 24 nt, Human
ugggaggcugagguaggcggauug

SEQ ID NO: 354206 - RNA, 23 nt, Human
ugggcacagaacugaagaccagg

SEQ ID NO: 354207 - RNA, 24 nt, Human
ugguggcgggcgccuguaguccca

SEQ ID NO: 354208 - RNA, 18 nt, Human
uggugggugcuuguaguc

SEQ ID NO: 354209 - RNA, 24 nt, Human
ugguggugggugcuuguagucuca

SEQ ID NO: 354210 - RNA, 23 nt, Human
uggugguugcugggggcuggagg

SEQ ID NO: 354211 - RNA, 24 nt, Human
uguaaaaacgaagcagaaaaguag

SEQ ID NO: 354212 - RNA, 22 nt, Human
uguacuaagugaaagaagccag

SEQ ID NO: 354213 - RNA, 22 nt, Human
uguggaaaacaguuugucuguu

SEQ ID NO: 354214 - RNA, 21 nt, Human
uguucuaaaaacaaacaaaug

SEQ ID NO: 354215 - RNA, 19 nt, Human
uguugcagauguuuauaau

SEQ ID NO: 354216 - RNA, 19 nt, Human
uguuuauuaaugaaacauc

SEQ ID NO: 354217 - RNA, 21 nt, Human
uguuuucauuccuccucuaaa

SEQ ID NO: 354218 - RNA, 26 nt, Human
uuaauaaaaauaaaagaacuaccacg

SEQ ID NO: 354219 - RNA, 18 nt, Human
uuagccgggcgugguggc

SEQ ID NO: 354220 - RNA, 22 nt, Human
uuagccgggcgugguggcgggc

SEQ ID NO: 354221 - RNA, 24 nt, Human
uuagccgggcgugguggcgggcgc

SEQ ID NO: 354222 - RNA, 24 nt, Human
uuagccgggugugguggugggugc

SEQ ID NO: 354223 - RNA, 24 nt, Human
uucaagagccaauaaaugcauaga

SEQ ID NO: 354224 - RNA, 22 nt, Human
uugaggccaggaguucaagacc

SEQ ID NO: 354225 - RNA, 19 nt, Human
uugcagugagcagagaucg

SEQ ID NO: 354226 - RNA, 25 nt, Human
uugcagugagcagagaucgagccac

SEQ ID NO: 354227 - RNA, 20 nt, Human
uugcagugagcccagaucau

SEQ ID NO: 354228 - RNA, 20 nt, Human
uugcauguggaauucuagaa

SEQ ID NO: 354229 - RNA, 27 nt, Human
uugcauguggaauucuagaagaacuuu

SEQ ID NO: 354230 - RNA, 18 nt, Human
uugcuugaauccaggagg

SEQ ID NO: 354231 - RNA, 21 nt, Human
uugcuugaauccaggaggagg

SEQ ID NO: 354232 - RNA, 23 nt, Human
uugcuugaggccaggaguucaag

SEQ ID NO: 354233 - RNA, 25 nt, Human
uugggaggccgaggcggguggauca

SEQ ID NO: 354234 - RNA, 23 nt, Human
uugggaggcugaagcaagagaau

SEQ ID NO: 354235 - RNA, 20 nt, Human
uuggugguugcugggggcug

SEQ ID NO: 354236 - RNA, 23 nt, Human
aaacaaaaugagggugcccccaa

SEQ ID NO: 354237 - RNA, 23 nt, Human
aagcuccucucauaugggccucg

SEQ ID NO: 354238 - RNA, 22 nt, Human
aaguggcgcuucagaugaaagc

SEQ ID NO: 354239 - RNA, 23 nt, Human
aauggaaacaaaaugagggugcc

SEQ ID NO: 354240 - RNA, 18 nt, Human
accggagcgggaggugcu

SEQ ID NO: 354241 - RNA, 18 nt, Human
agaaguggcgcuucagau

SEQ ID NO: 354242 - RNA, 19 nt, Human
aggcaacagcaggagggac

SEQ ID NO: 354243 - RNA, 21 nt, Human
aggcuuugagaaaauuaagcc

SEQ ID NO: 354244 - RNA, 21 nt, Human
agggcaccccucauaugucuu

SEQ ID NO: 354245 - RNA, 24 nt, Human
caacaagccucucuucuuggucgu

SEQ ID NO: 354246 - RNA, 24 nt, Human
caagccucucuucuuggucguuuc

SEQ ID NO: 354247 - RNA, 18 nt, Human
caccggagcgggaggugc

SEQ ID NO: 354248 - RNA, 18 nt, Human
cacuacaguuacagugac

SEQ ID NO: 354249 - RNA, 21 nt, Human
gaaacaaaaugagggugcccc

SEQ ID NO: 354250 - RNA, 19 nt, Human
gagggugcccccaaggcac

SEQ ID NO: 354251 - RNA, 23 nt, Human
gcauucaucauggauuugaaagg

SEQ ID NO: 354252 - RNA, 20 nt, Human
ggagggacugauggcauuca

SEQ ID NO: 354253 - RNA, 25 nt, Human
ggcaacagcaggagggacugauggc

SEQ ID NO: 354254 - RNA, 23 nt, Human
gggcaccccucauaugucuugag

SEQ ID NO: 354255 - RNA, 18 nt, Human
gggucaccggagcgggag

SEQ ID NO: 354256 - RNA, 24 nt, Human
gucacagggaggcaacagcaggag

SEQ ID NO: 354257 - RNA, 23 nt, Human
uaagcuccucucauaugggccuc

SEQ ID NO: 354258 - RNA, 21 nt, Human
ucagacaccuagaccuccacc

SEQ ID NO: 354259 - RNA, 20 nt, Human
uccaggucacagggaggcaa

SEQ ID NO: 354260 - RNA, 20 nt, Human
ucucguuguuggaauggaac

SEQ ID NO: 354261 - RNA, 19 nt, Human
ucuguguguuucugagaag

SEQ ID NO: 354262 - RNA, 25 nt, Human
ugagaaaauuaagcccuaacauuag

SEQ ID NO: 354263 - RNA, 23 nt, Human
ugagguggcuucuucccuggaca

SEQ ID NO: 354264 - RNA, 26 nt, Human
uggaaacaaaaugagggugcccccaa

SEQ ID NO: 354265 - RNA, 20 nt, Human
uggaauggaaacaaaaugag

SEQ ID NO: 354266 - RNA, 20 nt, Human
uggaauggaaacaaaaugag

SEQ ID NO: 354267 - RNA, 23 nt, Human
uggacaucaagaauggugcuagu

SEQ ID NO: 354268 - RNA, 21 nt, Human
uggagaaaggcuugagugaca

SEQ ID NO: 354269 - RNA, 23 nt, Human
uuggucguuucuaagcuccucuc

SEQ ID NO: 354270 - RNA, 18 nt, Human
aaaaagaggggcgcgggg

SEQ ID NO: 354271 - RNA, 22 nt, Human
aaagagucauuaacacuaaaau

SEQ ID NO: 354272 - RNA, 23 nt, Human
aacccaugcacacuguuucuggg

SEQ ID NO: 354273 - RNA, 24 nt, Human
aagcaauccucccgccuuggccuc

SEQ ID NO: 354274 - RNA, 25 nt, Human
aagcaauccucccgccuuggccucc

SEQ ID NO: 354275 - RNA, 25 nt, Human
aagcaggugccccagauggucccgc

SEQ ID NO: 354276 - RNA, 20 nt, Human
aagguggcagugugggcucc

SEQ ID NO: 354277 - RNA, 19 nt, Human
acaaaagcuccuguaagcc

SEQ ID NO: 354278 - RNA, 22 nt, Human
acacaaaagcuccuguaagccc

SEQ ID NO: 354279 - RNA, 22 nt, Human
acaccccuccccaccaagagau

SEQ ID NO: 354280 - RNA, 28 nt, Human
agagauuggggggugaagagcugggcac

SEQ ID NO: 354281 - RNA, 22 nt, Human
agaggccaaggucuuggagaca

SEQ ID NO: 354282 - RNA, 21 nt, Human
agcaauccucccgccuuggcc

SEQ ID NO: 354283 - RNA, 18 nt, Human
aggaagcagaaaucugcu

SEQ ID NO: 354284 - RNA, 24 nt, Human
aggagaggccaaggucuuggagac

SEQ ID NO: 354285 - RNA, 27 nt, Human
caagcaauccucccgccuuggccuccc

SEQ ID NO: 354286 - RNA, 27 nt, Human
caagcaauccucccgccuuggccuccc

SEQ ID NO: 354287 - RNA, 20 nt, Human
cacaaagaaacacuaggagc

SEQ ID NO: 354288 - RNA, 24 nt, Human
cacacaaaagcuccuguaagcccc

SEQ ID NO: 354289 - RNA, 19 nt, Human
cacagaccacaaagaaaca

SEQ ID NO: 354290 - RNA, 27 nt, Human
cacagaccacaaagaaacacuaggagc

SEQ ID NO: 354291 - RNA, 19 nt, Human
caccaaugcggcugugagu

SEQ ID NO: 354292 - RNA, 19 nt, Human
caccccccccucacguguc

SEQ ID NO: 354293 - RNA, 23 nt, Human
caccccccccucacguguccacu

SEQ ID NO: 354294 - RNA, 20 nt, Human
cacuccguccuuuugauccc

SEQ ID NO: 354295 - RNA, 23 nt, Human
cacucugccaccugcagcacccc

SEQ ID NO: 354296 - RNA, 24 nt, Human
cagaaagagucauuaacacuaaaa

SEQ ID NO: 354297 - RNA, 19 nt, Human
cagcagccggaaaugacac

SEQ ID NO: 354298 - RNA, 19 nt, Human
cagugccacaguggacucu

SEQ ID NO: 354299 - RNA, 22 nt, Human
caucugagucucugucccccca

SEQ ID NO: 354300 - RNA, 22 nt, Human
ccacugcucacacacagcagcc

SEQ ID NO: 354301 - RNA, 24 nt, Human
ccaggccaggagaguugggccaca

SEQ ID NO: 354302 - RNA, 24 nt, Human
ccaggcuggucuugaacuccuggg

SEQ ID NO: 354303 - RNA, 19 nt, Human
cccaugcacacuguuucug

SEQ ID NO: 354304 - RNA, 25 nt, Human
ccccacuccguccuuuugauccccu

SEQ ID NO: 354305 - RNA, 22 nt, Human
ccuacacuccaaaauaacccau

SEQ ID NO: 354306 - RNA, 26 nt, Human
ccucccgccuuggccucccaaagugc

SEQ ID NO: 354307 - RNA, 26 nt, Human
ccugcaaagggccucagugggaaccc

SEQ ID NO: 354308 - RNA, 21 nt, Human
ccugcagcaccccuguacugg

SEQ ID NO: 354309 - RNA, 20 nt, Human
cggcggcugcugagcugcag

SEQ ID NO: 354310 - RNA, 24 nt, Human
cucaagcaauccucccgccuuggc

SEQ ID NO: 354311 - RNA, 21 nt, Human
cuccaaaauaacccaugcaca

SEQ ID NO: 354312 - RNA, 22 nt, Human
cuccuccgcgguggcaggcagu

SEQ ID NO: 354313 - RNA, 25 nt, Human
cuccugggcucaagcaauccucccg

SEQ ID NO: 354314 - RNA, 23 nt, Human
cugacauuucuuccucuauuccu

SEQ ID NO: 354315 - RNA, 18 nt, Human
cuggccuuuggccuguca

SEQ ID NO: 354316 - RNA, 19 nt, Human
cuggucuugaacuccuggg

SEQ ID NO: 354317 - RNA, 23 nt, Human
cuucaaacuucucucccaggguc

SEQ ID NO: 354318 - RNA, 18 nt, Human
gaggaugaaauuguaugg

SEQ ID NO: 354319 - RNA, 23 nt, Human
gagucucuguccccccacuccgu

SEQ ID NO: 354320 - RNA, 19 nt, Human
gcagacccgagugggcaga

SEQ ID NO: 354321 - RNA, 20 nt, Human
gcgcggggggcgcggggggc

SEQ ID NO: 354322 - RNA, 20 nt, Human
ggccaggagaguugggccac

SEQ ID NO: 354323 - RNA, 18 nt, Human
ggcuggucuugaacuccu

SEQ ID NO: 354324 - RNA, 22 nt, Human
gggcgcggggggcgcggggggc

SEQ ID NO: 354325 - RNA, 21 nt, Human
gggggcgcgagggucucaggc

SEQ ID NO: 354326 - RNA, 24 nt, Human
gggggucuugguauguugcccagg

SEQ ID NO: 354327 - RNA, 24 nt, Human
ggggugugugccagucaaguggcu

SEQ ID NO: 354328 - RNA, 24 nt, Human
gggucucaggcggccacaaggugg

SEQ ID NO: 354329 - RNA, 22 nt, Human
gggucuugguauguugcccagg

SEQ ID NO: 354330 - RNA, 24 nt, Human
gguauguugcccaggcuggucuug

SEQ ID NO: 354331 - RNA, 18 nt, Human
uaaacaagucaccuacac

SEQ ID NO: 354332 - RNA, 25 nt, Human
uaaacaagucaccuacacuccaaaa

SEQ ID NO: 354333 - RNA, 19 nt, Human
uacaccccuccccaccaag

SEQ ID NO: 354334 - RNA, 23 nt, Human
uagguacaccccuccccaccaag

SEQ ID NO: 354335 - RNA, 21 nt, Human
uagguuuucagaaauauuauc

SEQ ID NO: 354336 - RNA, 21 nt, Human
uaugauaaauauuuagguaca

SEQ ID NO: 354337 - RNA, 23 nt, Human
uauguugcccaggcuggucuuga

SEQ ID NO: 354338 - RNA, 24 nt, Human
uauguugcccaggcuggucuugaa

SEQ ID NO: 354339 - RNA, 25 nt, Human
ucacccaccccccccucacgugucc

SEQ ID NO: 354340 - RNA, 23 nt, Human
ucacgcuggauguccggaggggu

SEQ ID NO: 354341 - RNA, 20 nt, Human
uccaaggagaggccaagguc

SEQ ID NO: 354342 - RNA, 19 nt, Human
uccggaggggugugugcca

SEQ ID NO: 354343 - RNA, 18 nt, Human
uccugggcucaagcaauc

SEQ ID NO: 354344 - RNA, 21 nt, Human
uccugggcucaagcaauccuc

SEQ ID NO: 354345 - RNA, 22 nt, Human
uccugggcucaagcaauccucc

SEQ ID NO: 354346 - RNA, 21 nt, Human
uccuuaguaguucucuuucuc

SEQ ID NO: 354347 - RNA, 22 nt, Human
uccuuuugauccccugaaggag

SEQ ID NO: 354348 - RNA, 24 nt, Human
ucucacccaccccccccucacgug

SEQ ID NO: 354349 - RNA, 24 nt, Human
ucucccagggucucagguggagac

SEQ ID NO: 354350 - RNA, 18 nt, Human
ucucuguccccccacucc

SEQ ID NO: 354351 - RNA, 24 nt, Human
ucugagucucuguccccccacucc

SEQ ID NO: 354352 - RNA, 23 nt, Human
ucuugaacuccugggcucaagca

SEQ ID NO: 354353 - RNA, 23 nt, Human
ucuugguauguugcccaggcugg

SEQ ID NO: 354354 - RNA, 24 nt, Human
ucuugguauguugcccaggcuggu

SEQ ID NO: 354355 - RNA, 24 nt, Human
ugaacuccugggcucaagcaaucc

SEQ ID NO: 354356 - RNA, 25 nt, Human
ugaacuccugggcucaagcaauccu

SEQ ID NO: 354357 - RNA, 23 nt, Human
ugacacagaccacaaagaaacac

SEQ ID NO: 354358 - RNA, 23 nt, Human
ugagucucuguccccccacuccg

SEQ ID NO: 354359 - RNA, 24 nt, Human
ugcaaagggccucagugggaacca

SEQ ID NO: 354360 - RNA, 24 nt, Human
ugcccaggcuggucuugaacuccu

SEQ ID NO: 354361 - RNA, 28 nt, Human
ugcccaggcuggucuugaacuccugggc

SEQ ID NO: 354362 - RNA, 18 nt, Human
ugcucuggcggcggcugc

SEQ ID NO: 354363 - RNA, 19 nt, Human
ugcucuggcggcggcugcu

SEQ ID NO: 354364 - RNA, 20 nt, Human
ugcuucaaacuucucuccca

SEQ ID NO: 354365 - RNA, 25 nt, Human
uggacuuccugagauacggugacac

SEQ ID NO: 354366 - RNA, 20 nt, Human
uggagaccuuaagggaguug

SEQ ID NO: 354367 - RNA, 22 nt, Human
ugggaaccaggucugcagaccc

SEQ ID NO: 354368 - RNA, 24 nt, Human
ugggcucaagcaauccucccgccu

SEQ ID NO: 354369 - RNA, 18 nt, Human
uggggggugaagagcugg

SEQ ID NO: 354370 - RNA, 24 nt, Human
ugguauguugcccaggcuggucuu

SEQ ID NO: 354371 - RNA, 20 nt, Human
ugucucucucacccaccccc

SEQ ID NO: 354372 - RNA, 24 nt, Human
ugucucucucacccaccccccccu

SEQ ID NO: 354373 - RNA, 19 nt, Human
uucuguccugguaggucau

SEQ ID NO: 354374 - RNA, 20 nt, Human
uugaauccgagcugccuguc

SEQ ID NO: 354375 - RNA, 26 nt, Human
uuggaaaccacucuguccucaucuga

SEQ ID NO: 354376 - RNA, 23 nt, Human
uuucuaccaggcacacaaaagcu

SEQ ID NO: 354377 - RNA, 22 nt, Human
aaacaacaacaacaacaacaac

SEQ ID NO: 354378 - RNA, 19 nt, Human
aacaacaaaaacacaaaga

SEQ ID NO: 354379 - RNA, 20 nt, Human
aacaacaaaaacacaaagag

SEQ ID NO: 354380 - RNA, 25 nt, Human
aacaacaacaacaaaaacacaaaga

SEQ ID NO: 354381 - RNA, 25 nt, Human
aacagaaacacuugcaucgagucug

SEQ ID NO: 354382 - RNA, 24 nt, Human
aacuaguuuugaaaaagaagcgau

SEQ ID NO: 354383 - RNA, 24 nt, Human
aacuaugaaagaugcaggaaagga

SEQ ID NO: 354384 - RNA, 22 nt, Human
aagaggcuagagauuucaccgu

SEQ ID NO: 354385 - RNA, 19 nt, Human
aagcggcggcggcgaggag

SEQ ID NO: 354386 - RNA, 21 nt, Human
aagcggcggcggcgaggaggg

SEQ ID NO: 354387 - RNA, 21 nt, Human
aagcggcggcggcgaggaggg

SEQ ID NO: 354388 - RNA, 24 nt, Human
aauacaaaaaugcaaauccaagga

SEQ ID NO: 354389 - RNA, 24 nt, Human
acaaaacaaaacaaaaauuccuga

SEQ ID NO: 354390 - RNA, 21 nt, Human
acaacaaaaacacaaagaggc

SEQ ID NO: 354391 - RNA, 22 nt, Human
acaacaaaaacacaaagaggcu

SEQ ID NO: 354392 - RNA, 19 nt, Human
acaacaacaaaaacacaaa

SEQ ID NO: 354393 - RNA, 21 nt, Human
acaacaacaaaaacacaaaga

SEQ ID NO: 354394 - RNA, 19 nt, Human
acaacaacaacaacaacaa

SEQ ID NO: 354395 - RNA, 27 nt, Human
acaacaacaacaacaacaaaaacacaa

SEQ ID NO: 354396 - RNA, 22 nt, Human
acaacaacaacaacaacaacaa

SEQ ID NO: 354397 - RNA, 21 nt, Human
acacugcacaacagcaaccuu

SEQ ID NO: 354398 - RNA, 21 nt, Human
acaggcacacugcacaacagc

SEQ ID NO: 354399 - RNA, 21 nt, Human
accauaaaacauuuuuuuuuc

SEQ ID NO: 354400 - RNA, 19 nt, Human
acuaugaaagaugcaggaa

SEQ ID NO: 354401 - RNA, 24 nt, Human
acuaugaaagaugcaggaaaggag

SEQ ID NO: 354402 - RNA, 22 nt, Human
agcaaccuugucuagcaagaca

SEQ ID NO: 354403 - RNA, 18 nt, Human
aggagggucacagccgga

SEQ ID NO: 354404 - RNA, 22 nt, Human
aggcacacugcacaacagcaac

SEQ ID NO: 354405 - RNA, 19 nt, Human
agggggaugggggaaaagg

SEQ ID NO: 354406 - RNA, 22 nt, Human
agggggcggccgcggagggcgg

SEQ ID NO: 354407 - RNA, 24 nt, Human
aguagugacaggcacacugcacaa

SEQ ID NO: 354408 - RNA, 19 nt, Human
auaaaacaacaacaacaac

SEQ ID NO: 354409 - RNA, 26 nt, Human
auaaaacaacaacaacaacaacaaca

SEQ ID NO: 354410 - RNA, 21 nt, Human
caaaacaaaaauuccugaacc

SEQ ID NO: 354411 - RNA, 23 nt, Human
caaaauacaaaaaugcaaaucca

SEQ ID NO: 354412 - RNA, 24 nt, Human
caacaaaaacacaaagaggcuaga

SEQ ID NO: 354413 - RNA, 28 nt, Human
caacaacaacaacaacaaaaacacaaag

SEQ ID NO: 354414 - RNA, 22 nt, Human
caagcggcggcggcgaggaggg

SEQ ID NO: 354415 - RNA, 18 nt, Human
caaggaguacagaccagu

SEQ ID NO: 354416 - RNA, 21 nt, Human
cagaacagaaacacuugcauc

SEQ ID NO: 354417 - RNA, 18 nt, Human
cagcccgggcagccccac

SEQ ID NO: 354418 - RNA, 21 nt, Human
cagcgguggcgccugcagacg

SEQ ID NO: 354419 - RNA, 18 nt, Human
caguacaguguuccagcc

SEQ ID NO: 354420 - RNA, 22 nt, Human
cauauagacaaaacaaaacaaa

SEQ ID NO: 354421 - RNA, 25 nt, Human
ccaguagugacaggcacacugcaca

SEQ ID NO: 354422 - RNA, 18 nt, Human
ccgcaaccggagcgggag

SEQ ID NO: 354423 - RNA, 24 nt, Human
ccguuucuaccaccaaaauaacgc

SEQ ID NO: 354424 - RNA, 23 nt, Human
ccucccagaacagaaacacuugc

SEQ ID NO: 354425 - RNA, 19 nt, Human
ccugaacuggacaaacagc

SEQ ID NO: 354426 - RNA, 20 nt, Human
ccuuucuauucauuccucag

SEQ ID NO: 354427 - RNA, 22 nt, Human
cgcuugcuaucaagacuuugga

SEQ ID NO: 354428 - RNA, 23 nt, Human
cucaguacaguguuccagccauc

SEQ ID NO: 354429 - RNA, 22 nt, Human
cuucugaaaagccgcacauaua

SEQ ID NO: 354430 - RNA, 22 nt, Human
gaaaaagaagcgauguacaaaa

SEQ ID NO: 354431 - RNA, 21 nt, Human
gagucuguuccuaagaacuag

SEQ ID NO: 354432 - RNA, 23 nt, Human
gcaaauccaaggaguacagacca

SEQ ID NO: 354433 - RNA, 22 nt, Human
gccgcgcagcccgggcagcccc

SEQ ID NO: 354434 - RNA, 24 nt, Human
ggaaaggagucuuucuucguagca

SEQ ID NO: 354435 - RNA, 18 nt, Human
ggagcgggagccuggucu

SEQ ID NO: 354436 - RNA, 23 nt, Human
ggcggugcggccgcaaccggagc

SEQ ID NO: 354437 - RNA, 20 nt, Human
guagugacaggcacacugcc

SEQ ID NO: 354438 - RNA, 24 nt, Human
uaaaaaguaaaagcuaccauaaaa

SEQ ID NO: 354439 - RNA, 28 nt, Human
uaaaacaacaacaacaacaacaacaaaa

SEQ ID NO: 354440 - RNA, 27 nt, Human
uaacagaacuaugaaagaugcaggaaa

SEQ ID NO: 354441 - RNA, 23 nt, Human
uaaccuagguaacaguucaguag

SEQ ID NO: 354442 - RNA, 19 nt, Human
uacagaccaguagugacag

SEQ ID NO: 354443 - RNA, 19 nt, Human
uaccucccagaacagaaac

SEQ ID NO: 354444 - RNA, 22 nt, Human
uauauaaaacaacaacaacaac

SEQ ID NO: 354445 - RNA, 21 nt, Human
uccccagggggcggccgcgga

SEQ ID NO: 354446 - RNA, 26 nt, Human
ucuucguagcaaaguagucguugcuu

SEQ ID NO: 354447 - RNA, 19 nt, Human
ugaacuggacaaacagcaa

SEQ ID NO: 354448 - RNA, 19 nt, Human
ugaauacaugcauuauaua

SEQ ID NO: 354449 - RNA, 25 nt, Human
ugaauacaugcauuauauaaaacaa

SEQ ID NO: 354450 - RNA, 24 nt, Human
uggaagccuuucuauucauuccuc

SEQ ID NO: 354451 - RNA, 25 nt, Human
uguacaaaauacaaaaaugcaaauc

SEQ ID NO: 354452 - RNA, 19 nt, Human
ugucuagcaagacaggagu

SEQ ID NO: 354453 - RNA, 21 nt, Human
uguuccagccauccugcuugu

SEQ ID NO: 354454 - RNA, 24 nt, Human
uguuuuuucccuccaauaccuccc

SEQ ID NO: 354455 - RNA, 25 nt, Human
uguuuuuucccuccaauaccuccca

SEQ ID NO: 354456 - RNA, 24 nt, Human
uucauaaaaaguaaaagcuaccau

SEQ ID NO: 354457 - RNA, 18 nt, Human
uuccugaacuggacaaac

SEQ ID NO: 354458 - RNA, 20 nt, Human
uucguagcaaaguagucguu

SEQ ID NO: 354459 - RNA, 26 nt, Human
uuuuuuaaauuuuauuuuagugaaua

SEQ ID NO: 354460 - RNA, 24 nt, Human
cacccgguacaggucauagccgaa

SEQ ID NO: 354461 - RNA, 27 nt, Human
ucuaggguauuggaauauuaaacuggg

SEQ ID NO: 354462 - RNA, 25 nt, Human
ucugcugucccucggguuuucuucu

SEQ ID NO: 354463 - RNA, 23 nt, Human
uguggaaucugcugucccucggg

SEQ ID NO: 354464 - RNA, 21 nt, Human
aaagcagguuggaaagaguca

SEQ ID NO: 354465 - RNA, 20 nt, Human
agacaggagaggaaggaagg

SEQ ID NO: 354466 - RNA, 21 nt, Human
aggaagggaaaugcuggcagu

SEQ ID NO: 354467 - RNA, 20 nt, Human
aggagccgugggaagucugg

SEQ ID NO: 354468 - RNA, 21 nt, Human
aggagggagacaggagaggaa

SEQ ID NO: 354469 - RNA, 21 nt, Human
aggcacaggggguaggaugga

SEQ ID NO: 354470 - RNA, 21 nt, Human
auggaggcugauggacucucg

SEQ ID NO: 354471 - RNA, 22 nt, Human
cacuacaaaaaccuuacaaaag

SEQ ID NO: 354472 - RNA, 21 nt, Human
cagccgcgcccccccccaccc

SEQ ID NO: 354473 - RNA, 22 nt, Human
cagccgcgcccccccccacccu

SEQ ID NO: 354474 - RNA, 25 nt, Human
cagccgcgcccccccccacccuaaa

SEQ ID NO: 354475 - RNA, 19 nt, Human
ccaccagggcccgucucuc

SEQ ID NO: 354476 - RNA, 19 nt, Human
ccagcugacguggggagca

SEQ ID NO: 354477 - RNA, 21 nt, Human
cccacccuaaacuccccaaga

SEQ ID NO: 354478 - RNA, 18 nt, Human
cccagccgcgcccccccc

SEQ ID NO: 354479 - RNA, 20 nt, Human
ccccacccuaaacuccccaa

SEQ ID NO: 354480 - RNA, 18 nt, Human
ccccccacccuaaacucc

SEQ ID NO: 354481 - RNA, 19 nt, Human
ccccccacccuaaacuccc

SEQ ID NO: 354482 - RNA, 24 nt, Human
ccccccacccuaaacuccccaaga

SEQ ID NO: 354483 - RNA, 24 nt, Human
ccccccccacccuaaacuccccaa

SEQ ID NO: 354484 - RNA, 21 nt, Human
cccccccccacccuaaacucc

SEQ ID NO: 354485 - RNA, 19 nt, Human
ccccugccccagugccaca

SEQ ID NO: 354486 - RNA, 19 nt, Human
ccggccccugccccagugc

SEQ ID NO: 354487 - RNA, 22 nt, Human
ccuagccuaggugucccgggac

SEQ ID NO: 354488 - RNA, 21 nt, Human
cgcggggcugaggacaacgcu

SEQ ID NO: 354489 - RNA, 19 nt, Human
cgcuucgccucccgagcca

SEQ ID NO: 354490 - RNA, 18 nt, Human
cgggcagaggagggagac

SEQ ID NO: 354491 - RNA, 18 nt, Human
cucccagccgcgcccccc

SEQ ID NO: 354492 - RNA, 20 nt, Human
cuccccgaugccugcccucc

SEQ ID NO: 354493 - RNA, 24 nt, Human
gaauuccuuuuuuuuuuuuuuuuu

SEQ ID NO: 354494 - RNA, 20 nt, Human
gagaggcugguccaggcagg

SEQ ID NO: 354495 - RNA, 20 nt, Human
gaggacaacgcuucgccucc

SEQ ID NO: 354496 - RNA, 24 nt, Human
gcagaacuagaagcaccucccucc

SEQ ID NO: 354497 - RNA, 18 nt, Human
gcagaggagggagacagg

SEQ ID NO: 354498 - RNA, 21 nt, Human
gccacaaagcagguuggaaag

SEQ ID NO: 354499 - RNA, 24 nt, Human
gcccuccucccagccgcgcccccc

SEQ ID NO: 354500 - RNA, 25 nt, Human
ggaaaugcuggcaguguugggaucu

SEQ ID NO: 354501 - RNA, 18 nt, Human
ggacaaguccaaaggcaa

SEQ ID NO: 354502 - RNA, 18 nt, Human
ggagacaggagaggaagg

SEQ ID NO: 354503 - RNA, 18 nt, Human
gggagacaggagaggaag

SEQ ID NO: 354504 - RNA, 19 nt, Human
gggcugaggacaacgcuuc

SEQ ID NO: 354505 - RNA, 20 nt, Human
gguguugggaaagaauggcc

SEQ ID NO: 354506 - RNA, 22 nt, Human
ucccagccgcgcccccccccac

SEQ ID NO: 354507 - RNA, 22 nt, Human
ucccgagccaccaccagggccc

SEQ ID NO: 354508 - RNA, 25 nt, Human
ucccgggcagaggagggagacagga

SEQ ID NO: 354509 - RNA, 19 nt, Human
ucccuuuuucucugguaaa

SEQ ID NO: 354510 - RNA, 18 nt, Human
uccuuuuuuuuuuuuuuu

SEQ ID NO: 354511 - RNA, 18 nt, Human
uccuuuuuuuuuuuuuuu

SEQ ID NO: 354512 - RNA, 21 nt, Human
ucucagacugcccccggcccc

SEQ ID NO: 354513 - RNA, 20 nt, Human
ucucccccucccuuuuucuc

SEQ ID NO: 354514 - RNA, 24 nt, Human
ucucugguaaacaaaagucggggu

SEQ ID NO: 354515 - RNA, 22 nt, Human
ucugagccuguuuggaagaaag

SEQ ID NO: 354516 - RNA, 24 nt, Human
ugacguggggagcagcuaaccugu

SEQ ID NO: 354517 - RNA, 22 nt, Human
ugaguggagaggcugguccagg

SEQ ID NO: 354518 - RNA, 19 nt, Human
ugccccagugccacaaagc

SEQ ID NO: 354519 - RNA, 24 nt, Human
ugccugcccuccucccagccgcgc

SEQ ID NO: 354520 - RNA, 20 nt, Human
uggaaagagucacaugagug

SEQ ID NO: 354521 - RNA, 24 nt, Human
uggaaagagucacaugaguggaga

SEQ ID NO: 354522 - RNA, 22 nt, Human
uggacucucggcagguuaggcc

SEQ ID NO: 354523 - RNA, 18 nt, Human
uggaugccacagccacgg

SEQ ID NO: 354524 - RNA, 21 nt, Human
uggcagaacuagaagcaccuc

SEQ ID NO: 354525 - RNA, 22 nt, Human
ugggaaagaauggccucucuca

SEQ ID NO: 354526 - RNA, 19 nt, Human
uuuuuuuuuuuuuugccca

SEQ ID NO: 354527 - RNA, 21 nt, Human
uuuuuuuuuuuuuuuugccca

SEQ ID NO: 354528 - RNA, 18 nt, Human
uuuuuuuuuuuuuuuuug

SEQ ID NO: 354529 - RNA, 21 nt, Human
uuuuuuuuuuuuuuuuugccc

SEQ ID NO: 354530 - RNA, 24 nt, Human
aaaaaaauguacaaauaaguucuu

SEQ ID NO: 354531 - RNA, 26 nt, Human
aaaaaaggaagaaacaaaacaaaaag

SEQ ID NO: 354532 - RNA, 20 nt, Human
aaaggaagaaacaaaacaaa

SEQ ID NO: 354533 - RNA, 20 nt, Human
aacaaaaaguucauccccac

SEQ ID NO: 354534 - RNA, 21 nt, Human
aacuaaaaaaggaagaaacaa

SEQ ID NO: 354535 - RNA, 19 nt, Human
aagccccuccugggagcuc

SEQ ID NO: 354536 - RNA, 22 nt, Human
acaaaacaaaaaguucaucccc

SEQ ID NO: 354537 - RNA, 22 nt, Human
accacggugggccugggucggg

SEQ ID NO: 354538 - RNA, 20 nt, Human
accccauggaguauccaagg

SEQ ID NO: 354539 - RNA, 22 nt, Human
accucaccucccccccaacccc

SEQ ID NO: 354540 - RNA, 24 nt, Human
accucaccucccccccaaccccaa

SEQ ID NO: 354541 - RNA, 24 nt, Human
accucccccccaaccccaauagca

SEQ ID NO: 354542 - RNA, 18 nt, Human
acuuucagggcaggcaga

SEQ ID NO: 354543 - RNA, 24 nt, Human
agagcuggggaggcagcugaggug

SEQ ID NO: 354544 - RNA, 18 nt, Human
aggaagaaacaaaacaaa

SEQ ID NO: 354545 - RNA, 21 nt, Human
aggcagaaugacuauggccca

SEQ ID NO: 354546 - RNA, 19 nt, Human
aggcaggcuugaucuggga

SEQ ID NO: 354547 - RNA, 22 nt, Human
augguaucuggggcccaugucc

SEQ ID NO: 354548 - RNA, 22 nt, Human
auguucccccuucccucccuau

SEQ ID NO: 354549 - RNA, 22 nt, Human
caauccgccucacugcggccag

SEQ ID NO: 354550 - RNA, 21 nt, Human
cacccccaccccauggaguau

SEQ ID NO: 354551 - RNA, 23 nt, Human
cagaagccccuccugggagcucc

SEQ ID NO: 354552 - RNA, 19 nt, Human
cccccaaccccaauagcac

SEQ ID NO: 354553 - RNA, 21 nt, Human
cccccaaccccaauagcaccc

SEQ ID NO: 354554 - RNA, 23 nt, Human
ccccccaaccccaauagcaccca

SEQ ID NO: 354555 - RNA, 21 nt, Human
cccccccaaccccaauagcac

SEQ ID NO: 354556 - RNA, 22 nt, Human
cccccccaaccccaauagcacc

SEQ ID NO: 354557 - RNA, 23 nt, Human
cccccccaaccccaauagcaccc

SEQ ID NO: 354558 - RNA, 20 nt, Human
ccccuucccucccuaucuuu

SEQ ID NO: 354559 - RNA, 22 nt, Human
ccucccccccaaccccaauagc

SEQ ID NO: 354560 - RNA, 20 nt, Human
cggucugcuuuuccaccccc

SEQ ID NO: 354561 - RNA, 22 nt, Human
cucaggagccuuuggaugccuc

SEQ ID NO: 354562 - RNA, 25 nt, Human
cugcccagaagccccuccugggagc

SEQ ID NO: 354563 - RNA, 22 nt, Human
cugguaccucaccuccccccca

SEQ ID NO: 354564 - RNA, 21 nt, Human
cuugaccagagucugcccaga

SEQ ID NO: 354565 - RNA, 21 nt, Human
cuuugaagaacuaaaaaagga

SEQ ID NO: 354566 - RNA, 19 nt, Human
gaagccccuccugggagcu

SEQ ID NO: 354567 - RNA, 18 nt, Human
gcagaaugacuauggccc

SEQ ID NO: 354568 - RNA, 19 nt, Human
ggagagguugggauagagc

SEQ ID NO: 354569 - RNA, 22 nt, Human
ggagcuccuucucaauccgccu

SEQ ID NO: 354570 - RNA, 20 nt, Human
ggcugguaccucaccucccc

SEQ ID NO: 354571 - RNA, 23 nt, Human
gggaggcagcugagguguuuuag

SEQ ID NO: 354572 - RNA, 21 nt, Human
ggggcccauguccaaguggag

SEQ ID NO: 354573 - RNA, 24 nt, Human
ggucccacaggauguggaguuucc

SEQ ID NO: 354574 - RNA, 18 nt, Human
gguugggauagagcuggg

SEQ ID NO: 354575 - RNA, 23 nt, Human
gucucaggagccuuuggaugccu

SEQ ID NO: 354576 - RNA, 19 nt, Human
uaaaaaaggaagaaacaaa

SEQ ID NO: 354577 - RNA, 23 nt, Human
uaaguucuuggauugauagcaac

SEQ ID NO: 354578 - RNA, 19 nt, Human
uaccucaccucccccccaa

SEQ ID NO: 354579 - RNA, 22 nt, Human
uaccucaccucccccccaaccc

SEQ ID NO: 354580 - RNA, 23 nt, Human
uagagcuggggaggcagcugagg

SEQ ID NO: 354581 - RNA, 22 nt, Human
ucaauccgccucacugcggcca

SEQ ID NO: 354582 - RNA, 23 nt, Human
ucaggagccuuuggaugccuccu

SEQ ID NO: 354583 - RNA, 20 nt, Human
uccacccccaccccauggag

SEQ ID NO: 354584 - RNA, 26 nt, Human
uccacccccaccccauggaguaucca

SEQ ID NO: 354585 - RNA, 23 nt, Human
ucccacaggauguggaguuuccg

SEQ ID NO: 354586 - RNA, 24 nt, Human
ucuuggauugauagcaacaaaggc

SEQ ID NO: 354587 - RNA, 23 nt, Human
ugaccagagucugcccagaagcc

SEQ ID NO: 354588 - RNA, 22 nt, Human
ugaggcaggcuugaucugggac

SEQ ID NO: 354589 - RNA, 19 nt, Human
ugccauccugugugcaccc

SEQ ID NO: 354590 - RNA, 26 nt, Human
ugcggccaggucauucugggggugcc

SEQ ID NO: 354591 - RNA, 20 nt, Human
ugggaagguccgcucaggca

SEQ ID NO: 354592 - RNA, 18 nt, Human
ugggagagguugggauag

SEQ ID NO: 354593 - RNA, 21 nt, Human
ugggauagagcuggggaggca

SEQ ID NO: 354594 - RNA, 22 nt, Human
ugggauagagcuggggaggcag

SEQ ID NO: 354595 - RNA, 25 nt, Human
ugggauagagcuggggaggcagcug

SEQ ID NO: 354596 - RNA, 22 nt, Human
ugggucgggcugggcuagcgcc

SEQ ID NO: 354597 - RNA, 25 nt, Human
aaauauauaccaguugcaaacauaa

SEQ ID NO: 354598 - RNA, 24 nt, Human
aagccucccacacaccugcaaccc

SEQ ID NO: 354599 - RNA, 23 nt, Human
acagcacacaaacacaaugacau

SEQ ID NO: 354600 - RNA, 20 nt, Human
agauauacuguaaaacacaa

SEQ ID NO: 354601 - RNA, 22 nt, Human
caaacacaaugacauaacagga

SEQ ID NO: 354602 - RNA, 22 nt, Human
ccugcaaccccugacgggaugc

SEQ ID NO: 354603 - RNA, 24 nt, Human
uaacaggaccauuagcuuaauacu

SEQ ID NO: 354604 - RNA, 18 nt, Human
uaagauauacuguaaaac

SEQ ID NO: 354605 - RNA, 19 nt, Human
uaccaguugcaaacauaau

SEQ ID NO: 354606 - RNA, 25 nt, Human
aaaaaaaaaaaaaaaagacugcaag

SEQ ID NO: 354607 - RNA, 19 nt, Human
aaaaaaaggaagguuggaa

SEQ ID NO: 354608 - RNA, 26 nt, Human
aaaaagaaacccaaaaauaaacagga

SEQ ID NO: 354609 - RNA, 21 nt, Human
aaaaaugaacuucgaacagaa

SEQ ID NO: 354610 - RNA, 23 nt, Human
aaaaaugaacuucgaacagaaag

SEQ ID NO: 354611 - RNA, 20 nt, Human
aaacaagagaaaguagacag

SEQ ID NO: 354612 - RNA, 20 nt, Human
aaacuuggaaggucauagua

SEQ ID NO: 354613 - RNA, 19 nt, Human
aacaucucaaaccccaccc

SEQ ID NO: 354614 - RNA, 21 nt, Human
aacaucucaaaccccaccccu

SEQ ID NO: 354615 - RNA, 21 nt, Human
aaccauggaguagagaaaaga

SEQ ID NO: 354616 - RNA, 22 nt, Human
aacccaaaaauaaacaggaaca

SEQ ID NO: 354617 - RNA, 26 nt, Human
aaccccaccccuuugcugaccuucua

SEQ ID NO: 354618 - RNA, 18 nt, Human
aagagaaaguagacagau

SEQ ID NO: 354619 - RNA, 19 nt, Human
aaucccauuacucaaucca

SEQ ID NO: 354620 - RNA, 24 nt, Human
acaauagagaaugucaauuccaaa

SEQ ID NO: 354621 - RNA, 22 nt, Human
acagagaaaggaggaaaaaagc

SEQ ID NO: 354622 - RNA, 20 nt, Human
acagguucugcugauucucc

SEQ ID NO: 354623 - RNA, 23 nt, Human
acaugccaaaggagaagccaugu

SEQ ID NO: 354624 - RNA, 20 nt, Human
accagaaagcagggacaguu

SEQ ID NO: 354625 - RNA, 24 nt, Human
accagaaagcagggacaguuacug

SEQ ID NO: 354626 - RNA, 22 nt, Human
acccaaacaucucaaaccccac

SEQ ID NO: 354627 - RNA, 20 nt, Human
accugugcagaaauuacaua

SEQ ID NO: 354628 - RNA, 22 nt, Human
agaaaauuuaaaaaaaggaagg

SEQ ID NO: 354629 - RNA, 22 nt, Human
agacaggaagggauaaaaauga

SEQ ID NO: 354630 - RNA, 23 nt, Human
agacaggaagggauaaaagggac

SEQ ID NO: 354631 - RNA, 22 nt, Human
agagagccaaugaagacaugcc

SEQ ID NO: 354632 - RNA, 25 nt, Human
agagagccaaugaagacaugccagc

SEQ ID NO: 354633 - RNA, 20 nt, Human
agaguauugagcuaucuggu

SEQ ID NO: 354634 - RNA, 25 nt, Human
agcaccaggucuguuggaugguggu

SEQ ID NO: 354635 - RNA, 21 nt, Human
aggagagaauuuauuuuaaaa

SEQ ID NO: 354636 - RNA, 18 nt, Human
aggaggaaaaaagcuaga

SEQ ID NO: 354637 - RNA, 18 nt, Human
agggugacaaaguuugac

SEQ ID NO: 354638 - RNA, 18 nt, Human
auauacagagaaaggagg

SEQ ID NO: 354639 - RNA, 24 nt, Human
aucaaguuuuauacaucaaaaagc

SEQ ID NO: 354640 - RNA, 21 nt, Human
caaaccccaccccuuugcuga

SEQ ID NO: 354641 - RNA, 20 nt, Human
caagaacagggcgacugagc

SEQ ID NO: 354642 - RNA, 23 nt, Human
cacuuggagauaaaaaucaaggg

SEQ ID NO: 354643 - RNA, 24 nt, Human
cagagaaaggaggaaaaaagcuag

SEQ ID NO: 354644 - RNA, 23 nt, Human
cagagcugaguccauuaucccac

SEQ ID NO: 354645 - RNA, 23 nt, Human
caggaacaaaauuacaauagaga

SEQ ID NO: 354646 - RNA, 20 nt, Human
caggucuguuggaugguggu

SEQ ID NO: 354647 - RNA, 23 nt, Human
cagugauguuauacaagucaaac

SEQ ID NO: 354648 - RNA, 25 nt, Human
cauagcccugaggucauccugcaaa

SEQ ID NO: 354649 - RNA, 23 nt, Human
caucucaaaccccaccccuuugc

SEQ ID NO: 354650 - RNA, 24 nt, Human
cauuaucccacccagauucacaug

SEQ ID NO: 354651 - RNA, 19 nt, Human
ccaaaaauaaacaggaaca

SEQ ID NO: 354652 - RNA, 22 nt, Human
ccaaacaucucaaaccccaccc

SEQ ID NO: 354653 - RNA, 27 nt, Human
ccacccaaacaucucaaaccccacccc

SEQ ID NO: 354654 - RNA, 18 nt, Human
cccaaaaauaaacaggaa

SEQ ID NO: 354655 - RNA, 24 nt, Human
cccaaacaucucaaaccccacccc

SEQ ID NO: 354656 - RNA, 23 nt, Human
cccacccaaacaucucaaacccc

SEQ ID NO: 354657 - RNA, 25 nt, Human
cccacccaaacaucucaaaccccac

SEQ ID NO: 354658 - RNA, 18 nt, Human
cccacuaacccacccaaa

SEQ ID NO: 354659 - RNA, 20 nt, Human
cccagauucacauggucaca

SEQ ID NO: 354660 - RNA, 21 nt, Human
cccuccagcuuccagcagagc

SEQ ID NO: 354661 - RNA, 20 nt, Human
ccuuuauuggagcaagauuc

SEQ ID NO: 354662 - RNA, 23 nt, Human
cuagauagguuguuacacuuuug

SEQ ID NO: 354663 - RNA, 19 nt, Human
cuccagcuuccagcagagc

SEQ ID NO: 354664 - RNA, 22 nt, Human
cugagcacaagagggaaaaaaa

SEQ ID NO: 354665 - RNA, 22 nt, Human
cuuccagcagagcaaagggagc

SEQ ID NO: 354666 - RNA, 21 nt, Human
gaccugugcagaaauuacaua

SEQ ID NO: 354667 - RNA, 22 nt, Human
gagaguauugagcuaucuggua

SEQ ID NO: 354668 - RNA, 22 nt, Human
gagcagacagagcugaguccau

SEQ ID NO: 354669 - RNA, 21 nt, Human
ggcgacugagcacaagaggga

SEQ ID NO: 354670 - RNA, 24 nt, Human
gugaaacaaaaagaaacccaaaaa

SEQ ID NO: 354671 - RNA, 23 nt, Human
uaaacagagaccugugcagaaau

SEQ ID NO: 354672 - RNA, 21 nt, Human
uaaacaggaacaaaauuacaa

SEQ ID NO: 354673 - RNA, 20 nt, Human
uaaacaggaacaaaauuacu

SEQ ID NO: 354674 - RNA, 23 nt, Human
uaacaaagcaacuuguacacuuu

SEQ ID NO: 354675 - RNA, 22 nt, Human
uaacuuggcauuagagcaccag

SEQ ID NO: 354676 - RNA, 23 nt, Human
uacaauagagaaugucaauucca

SEQ ID NO: 354677 - RNA, 23 nt, Human
uacagagaaaggaggaaaaaagc

SEQ ID NO: 354678 - RNA, 18 nt, Human
uagcacccuccagcuucc

SEQ ID NO: 354679 - RNA, 20 nt, Human
ucaaaaugcccacuaaccca

SEQ ID NO: 354680 - RNA, 22 nt, Human
ucauaguaagcauaccuaugcu

SEQ ID NO: 354681 - RNA, 18 nt, Human
ucaucuuaaacugcaagg

SEQ ID NO: 354682 - RNA, 18 nt, Human
uccacauagcccugaggu

SEQ ID NO: 354683 - RNA, 24 nt, Human
uccauacaguuuuuguucagaaaa

SEQ ID NO: 354684 - RNA, 23 nt, Human
ucccagggacuggagaaaauuua

SEQ ID NO: 354685 - RNA, 19 nt, Human
ucucaaaccccaccccuuu

SEQ ID NO: 354686 - RNA, 21 nt, Human
ucucugagcccaauauacaga

SEQ ID NO: 354687 - RNA, 23 nt, Human
ugagcacaagagggaaaaaaaaa

SEQ ID NO: 354688 - RNA, 21 nt, Human
ugaguccauuaucccacccag

SEQ ID NO: 354689 - RNA, 21 nt, Human
ugauuccauacaguuuuuguu

SEQ ID NO: 354690 - RNA, 23 nt, Human
uggagaaaauuuaaaaaaaggaa

SEQ ID NO: 354691 - RNA, 23 nt, Human
uggcaaauugaacccacguuucc

SEQ ID NO: 354692 - RNA, 24 nt, Human
uggcaggcacaauuaauuuauauc

SEQ ID NO: 354693 - RNA, 20 nt, Human
uguuacacuuuugccuauug

SEQ ID NO: 354694 - RNA, 20 nt, Human
uguucagacaggaagggaua

SEQ ID NO: 354695 - RNA, 21 nt, Human
uuaaaaagcuuaugcauuagg

SEQ ID NO: 354696 - RNA, 22 nt, Human
uucaaaucccauuacucaaucc

SEQ ID NO: 354697 - RNA, 20 nt, Human
uuccugaucgguauacagug

SEQ ID NO: 354698 - RNA, 23 nt, Human
uuggcauuagagcaccaggucug

SEQ ID NO: 354699 - RNA, 24 nt, Human
aaaaaaccaaagccauucuauugc

SEQ ID NO: 354700 - RNA, 24 nt, Human
aaugaugauauagaaagaaccaga

SEQ ID NO: 354701 - RNA, 20 nt, Human
acagcccuuucaauuccuug

SEQ ID NO: 354702 - RNA, 20 nt, Human
accacugacuaaaaaugacu

SEQ ID NO: 354703 - RNA, 24 nt, Human
acuauggaaaaaccacugacuaaa

SEQ ID NO: 354704 - RNA, 18 nt, Human
agaaaaaaaccaaagcca

SEQ ID NO: 354705 - RNA, 18 nt, Human
aggagcagucggggcugg

SEQ ID NO: 354706 - RNA, 19 nt, Human
aggaggaggaggaagagga

SEQ ID NO: 354707 - RNA, 25 nt, Human
auagaaagaaccagagagaccuaca

SEQ ID NO: 354708 - RNA, 22 nt, Human
auuuagagaauaaagauguagu

SEQ ID NO: 354709 - RNA, 19 nt, Human
caauuugcacuggccauag

SEQ ID NO: 354710 - RNA, 19 nt, Human
cacaucuuaaagcaaagau

SEQ ID NO: 354711 - RNA, 21 nt, Human
cacugccucccccuacagccc

SEQ ID NO: 354712 - RNA, 20 nt, Human
cacugcuauugaugcaaaaa

SEQ ID NO: 354713 - RNA, 25 nt, Human
cagcccuuucaauuccuuggccuuc

SEQ ID NO: 354714 - RNA, 18 nt, Human
cagcucggggcugcgcgg

SEQ ID NO: 354715 - RNA, 20 nt, Human
cagcugcugcggcagcagcc

SEQ ID NO: 354716 - RNA, 21 nt, Human
cccuucgcccacuugccccuc

SEQ ID NO: 354717 - RNA, 25 nt, Human
ccggcggcugagcgagcucuggggc

SEQ ID NO: 354718 - RNA, 18 nt, Human
ccuaguuaguaugcgaga

SEQ ID NO: 354719 - RNA, 19 nt, Human
cgcacugccucccccuaca

SEQ ID NO: 354720 - RNA, 18 nt, Human
cgcggcugccucccgucc

SEQ ID NO: 354721 - RNA, 19 nt, Human
cgcggcugccucccguccc

SEQ ID NO: 354722 - RNA, 19 nt, Human
cuagcacuacugaaaauag

SEQ ID NO: 354723 - RNA, 19 nt, Human
cucaaggaggaaaaaauua

SEQ ID NO: 354724 - RNA, 24 nt, Human
cucggggcugcgcggcugccuccc

SEQ ID NO: 354725 - RNA, 21 nt, Human
cucuuccauaacuuaaugcaa

SEQ ID NO: 354726 - RNA, 20 nt, Human
cugaaccccaaagccaggcc

SEQ ID NO: 354727 - RNA, 24 nt, Human
cugacuaaaaaugacugaaaaacc

SEQ ID NO: 354728 - RNA, 21 nt, Human
gaaaaaaaccaaagccauucu

SEQ ID NO: 354729 - RNA, 20 nt, Human
gaggaagaggaggagcaguc

SEQ ID NO: 354730 - RNA, 25 nt, Human
gaggaagaggaggagcagucggggc

SEQ ID NO: 354731 - RNA, 22 nt, Human
gaugauauagaaagaaccagag

SEQ ID NO: 354732 - RNA, 19 nt, Human
gcaagugugcuaacacaau

SEQ ID NO: 354733 - RNA, 21 nt, Human
gcagcagccgucguccccccu

SEQ ID NO: 354734 - RNA, 22 nt, Human
gcgcggcugccucccgucccuc

SEQ ID NO: 354735 - RNA, 20 nt, Human
ggaggaagaggaggagcagu

SEQ ID NO: 354736 - RNA, 18 nt, Human
ggaggaggaagaggagga

SEQ ID NO: 354737 - RNA, 18 nt, Human
ggaggaggaggaagagga

SEQ ID NO: 354738 - RNA, 22 nt, Human
ggcagcagccgucguccccccu

SEQ ID NO: 354739 - RNA, 20 nt, Human
ggcugagcgagcucuggggc

SEQ ID NO: 354740 - RNA, 21 nt, Human
gugugccgccuuggccgcugc

SEQ ID NO: 354741 - RNA, 23 nt, Human
guugucccauugucagauaaacg

SEQ ID NO: 354742 - RNA, 18 nt, Human
uaagaaaaaaaccaaagc

SEQ ID NO: 354743 - RNA, 20 nt, Human
uaccgcuuagagauacuagu

SEQ ID NO: 354744 - RNA, 19 nt, Human
uaccucucaguaggacguu

SEQ ID NO: 354745 - RNA, 24 nt, Human
uacuaagaaaaaaaccaaagccau

SEQ ID NO: 354746 - RNA, 19 nt, Human
uagaaagaaccagagagac

SEQ ID NO: 354747 - RNA, 24 nt, Human
uauggaaaaaccacugacuaaaaa

SEQ ID NO: 354748 - RNA, 31 nt, Human
uauggaaaaaccacugacuaaaaaugacugg

SEQ ID NO: 354749 - RNA, 23 nt, Human
uaugucaaaugcucgacaauacc

SEQ ID NO: 354750 - RNA, 19 nt, Human
ucccggcggcugagcgagc

SEQ ID NO: 354751 - RNA, 20 nt, Human
ucgcacugccucccccuaca

SEQ ID NO: 354752 - RNA, 22 nt, Human
ugaaccccaaagccaggacccu

SEQ ID NO: 354753 - RNA, 22 nt, Human
ugagcagucccugguuguccca

SEQ ID NO: 354754 - RNA, 22 nt, Human
ugcacuggccauaggaaaaaag

SEQ ID NO: 354755 - RNA, 22 nt, Human
uggaaguuuucucuuguaaagg

SEQ ID NO: 354756 - RNA, 23 nt, Human
uggaggaggaggaggaagaggag

SEQ ID NO: 354757 - RNA, 19 nt, Human
uggggacacugcccagcuc

SEQ ID NO: 354758 - RNA, 18 nt, Human
uggugagaggaugugacg

SEQ ID NO: 354759 - RNA, 25 nt, Human
uuaaagcaaagauaucuuuguuuac

SEQ ID NO: 354760 - RNA, 23 nt, Human
uuauacuacauuuagagaauaaa

SEQ ID NO: 354761 - RNA, 20 nt, Human
uucuucucuucuuucuuaaa

SEQ ID NO: 354762 - RNA, 25 nt, Human
uugaugcaaaaauccauuuggaagu

SEQ ID NO: 354763 - RNA, 24 nt, Human
uuggaggaggaggaggaagaggag

SEQ ID NO: 354764 - RNA, 21 nt, Human
agggaucaucugguccagaac

SEQ ID NO: 354765 - RNA, 25 nt, Human
caaccagaccccagacucacaacuc

SEQ ID NO: 354766 - RNA, 22 nt, Human
caccaaccagaccccagacuca

SEQ ID NO: 354767 - RNA, 22 nt, Human
ccaaccagaccccagacucaca

SEQ ID NO: 354768 - RNA, 27 nt, Human
ccauuucuaucaacuaggagcuggggg

SEQ ID NO: 354769 - RNA, 18 nt, Human
cuccauucuaagaacaaa

SEQ ID NO: 354770 - RNA, 22 nt, Human
cucucccgucuuccagcuucaa

SEQ ID NO: 354771 - RNA, 21 nt, Human
cuuuuguccucucccgucuuc

SEQ ID NO: 354772 - RNA, 18 nt, Human
ggguugggaagaaggcug

SEQ ID NO: 354773 - RNA, 21 nt, Human
guuagaguggugaucucuccc

SEQ ID NO: 354774 - RNA, 19 nt, Human
uagaguggugaucucuccc

SEQ ID NO: 354775 - RNA, 18 nt, Human
ucaagaaauaauacaaac

SEQ ID NO: 354776 - RNA, 24 nt, Human
ucaccaaccagaccccagacucac

SEQ ID NO: 354777 - RNA, 20 nt, Human
uuagaguggugaucucuccc

SEQ ID NO: 354778 - RNA, 22 nt, Human
uucaccaaccagaccccagacu

SEQ ID NO: 354779 - RNA, 21 nt, Human
uuccagcuucaagggcucuuu

SEQ ID NO: 354780 - RNA, 25 nt, Human
uuggacaaauaugggaugggaggga

SEQ ID NO: 354781 - RNA, 18 nt, Human
uuuggagguggagaaggg

SEQ ID NO: 354782 - RNA, 18 nt, Human
uuuggagguggagaaggg

SEQ ID NO: 354783 - RNA, 23 nt, Human
aagcagcggugacagggcuggga

SEQ ID NO: 354784 - RNA, 18 nt, Human
aggcccaggcuccccggg

SEQ ID NO: 354785 - RNA, 19 nt, Human
aggcccugggacgcuggcu

SEQ ID NO: 354786 - RNA, 18 nt, Human
agggcuagcaucucccuc

SEQ ID NO: 354787 - RNA, 21 nt, Human
auccagcaccagcucgcccag

SEQ ID NO: 354788 - RNA, 22 nt, Human
caaagcucguccggcuggccuc

SEQ ID NO: 354789 - RNA, 26 nt, Human
caaagcucguccggcuggccucuaaa

SEQ ID NO: 354790 - RNA, 22 nt, Human
caaggcccccagggccuuuggg

SEQ ID NO: 354791 - RNA, 22 nt, Human
ccaacuucuccuuucucccucc

SEQ ID NO: 354792 - RNA, 23 nt, Human
ccaggcuucuccguggaggagga

SEQ ID NO: 354793 - RNA, 22 nt, Human
cccaaagggcuagcaucucccu

SEQ ID NO: 354794 - RNA, 23 nt, Human
cccauccagcaccagcucgccca

SEQ ID NO: 354795 - RNA, 24 nt, Human
cccccagggccuuuggauaaaugu

SEQ ID NO: 354796 - RNA, 21 nt, Human
ccgggucccccggugggccag

SEQ ID NO: 354797 - RNA, 18 nt, Human
ccuugggccucagcugcu

SEQ ID NO: 354798 - RNA, 20 nt, Human
cgcccagcacuuccgccgac

SEQ ID NO: 354799 - RNA, 20 nt, Human
cggggaaauugggguugagu

SEQ ID NO: 354800 - RNA, 18 nt, Human
cuaggcccugggacgcug

SEQ ID NO: 354801 - RNA, 19 nt, Human
cuccccggguucuggccuc

SEQ ID NO: 354802 - RNA, 24 nt, Human
cucuccggggcuccugagggcagg

SEQ ID NO: 354803 - RNA, 24 nt, Human
cuugggccucagcugcuuccuggc

SEQ ID NO: 354804 - RNA, 19 nt, Human
cuuucgguccagccaaagg

SEQ ID NO: 354805 - RNA, 19 nt, Human
gcagaguucaccugcuuga

SEQ ID NO: 354806 - RNA, 21 nt, Human
gccuugggccucagcugcuuc

SEQ ID NO: 354807 - RNA, 24 nt, Human
ggacaguggcugcggagguggccu

SEQ ID NO: 354808 - RNA, 18 nt, Human
ggacccaaagggcuagca

SEQ ID NO: 354809 - RNA, 18 nt, Human
gggaagagcaucuuggaa

SEQ ID NO: 354810 - RNA, 23 nt, Human
gggcaggagguaaggacccaaag

SEQ ID NO: 354811 - RNA, 20 nt, Human
gggccucagcugcuuccugg

SEQ ID NO: 354812 - RNA, 20 nt, Human
ggggcacuucugaugccucc

SEQ ID NO: 354813 - RNA, 18 nt, Human
gugcagagggugcggucc

SEQ ID NO: 354814 - RNA, 21 nt, Human
uaaaaaguuuaaccaaaaaac

SEQ ID NO: 354815 - RNA, 18 nt, Human
uaaggacccaaagggcua

SEQ ID NO: 354816 - RNA, 19 nt, Human
ucaccugcuugagcgaagg

SEQ ID NO: 354817 - RNA, 21 nt, Human
uccagcaccagcucgcccagc

SEQ ID NO: 354818 - RNA, 21 nt, Human
uccccggguucuggccucugg

SEQ ID NO: 354819 - RNA, 19 nt, Human
ucccucgggaagagcaucu

SEQ ID NO: 354820 - RNA, 18 nt, Human
uccucggaggccacgaug

SEQ ID NO: 354821 - RNA, 19 nt, Human
uccucggaggccacgaugg

SEQ ID NO: 354822 - RNA, 20 nt, Human
ucuccggggcuccugagggc

SEQ ID NO: 354823 - RNA, 19 nt, Human
ucuccguggaggaggagag

SEQ ID NO: 354824 - RNA, 24 nt, Human
ugaggguggcccuccuaagggcgg

SEQ ID NO: 354825 - RNA, 22 nt, Human
ugcggagguggccuugggccuc

SEQ ID NO: 354826 - RNA, 19 nt, Human
uggaagcagcggugacagg

SEQ ID NO: 354827 - RNA, 25 nt, Human
uggacaguggcugcggagguggccu

SEQ ID NO: 354828 - RNA, 23 nt, Human
uggccucuaaaccaacuucuccu

SEQ ID NO: 354829 - RNA, 19 nt, Human
uggcugcggagguggccuu

SEQ ID NO: 354830 - RNA, 18 nt, Human
ugugugggccacauaggg

SEQ ID NO: 354831 - RNA, 24 nt, Human
uguuaaaaaguuuaaccaaaaaac

SEQ ID NO: 354832 - RNA, 26 nt, Human
uuggacaguggcugcggagguggccu

SEQ ID NO: 354833 - RNA, 23 nt, Human
aaaaauuaauaaaaauuucacga

SEQ ID NO: 354834 - RNA, 20 nt, Human
aaaacaaaacauaaaaggaa

SEQ ID NO: 354835 - RNA, 23 nt, Human
aaacauaaaaggaagccuuccag

SEQ ID NO: 354836 - RNA, 23 nt, Human
aaagauaaagaaguaacaaagga

SEQ ID NO: 354837 - RNA, 24 nt, Human
aaaggaaggagaaugaacaagggg

SEQ ID NO: 354838 - RNA, 20 nt, Human
aaauggaaucugaggcagcu

SEQ ID NO: 354839 - RNA, 21 nt, Human
aaauggaaucugaggcagcuu

SEQ ID NO: 354840 - RNA, 25 nt, Human
aaauggcggcggaguucggugggcu

SEQ ID NO: 354841 - RNA, 20 nt, Human
aaauuucacgauauggagcc

SEQ ID NO: 354842 - RNA, 20 nt, Human
aacaccgaaaaaagcccaga

SEQ ID NO: 354843 - RNA, 18 nt, Human
aacuuuacaagacucccu

SEQ ID NO: 354844 - RNA, 24 nt, Human
aagaaaaaaauuaauaaaaauuuc

SEQ ID NO: 354845 - RNA, 25 nt, Human
aagaaaaaaauuaauaaaaauuuca

SEQ ID NO: 354846 - RNA, 19 nt, Human
aagcgggaggaaaaaggaa

SEQ ID NO: 354847 - RNA, 19 nt, Human
acaaaacauaaaaggaagc

SEQ ID NO: 354848 - RNA, 20 nt, Human
acaaaacauaaaaggaagcc

SEQ ID NO: 354849 - RNA, 19 nt, Human
acaccgaaaaaagcccaga

SEQ ID NO: 354850 - RNA, 20 nt, Human
acacugcaaaacauucagac

SEQ ID NO: 354851 - RNA, 20 nt, Human
agaaaggaaaagauaaagaa

SEQ ID NO: 354852 - RNA, 21 nt, Human
agacauuugggauuaaaacaa

SEQ ID NO: 354853 - RNA, 19 nt, Human
agagggaggagagagggca

SEQ ID NO: 354854 - RNA, 21 nt, Human
agagggcaccgcgggggcggg

SEQ ID NO: 354855 - RNA, 20 nt, Human
aggaaggagaaugaacaagg

SEQ ID NO: 354856 - RNA, 22 nt, Human
aggagaaugaacaaggggcuca

SEQ ID NO: 354857 - RNA, 24 nt, Human
aggccaagcgaggaaauggcggcg

SEQ ID NO: 354858 - RNA, 22 nt, Human
aguaacaaaggaaaaagaaaaa

SEQ ID NO: 354859 - RNA, 21 nt, Human
auggcaccuugaaaaacccac

SEQ ID NO: 354860 - RNA, 22 nt, Human
caaaacauaaaaggaagccuuc

SEQ ID NO: 354861 - RNA, 24 nt, Human
caaaccccuacacacugcaaaaca

SEQ ID NO: 354862 - RNA, 23 nt, Human
cacacugcaaaacauucagacau

SEQ ID NO: 354863 - RNA, 26 nt, Human
cacgauauggagccagcguguuccga

SEQ ID NO: 354864 - RNA, 22 nt, Human
caggaagaacuccaggcuggca

SEQ ID NO: 354865 - RNA, 24 nt, Human
cauuauugucaacagaaucacuuc

SEQ ID NO: 354866 - RNA, 21 nt, Human
ccaaaaccauuugcuccccuc

SEQ ID NO: 354867 - RNA, 22 nt, Human
ccaaagcccuugcccaaaacca

SEQ ID NO: 354868 - RNA, 23 nt, Human
ccacacugcucuuuuauucaaug

SEQ ID NO: 354869 - RNA, 22 nt, Human
cccuugcccaaaaccauuugcu

SEQ ID NO: 354870 - RNA, 18 nt, Human
ccgaaccguuaggccaag

SEQ ID NO: 354871 - RNA, 27 nt, Human
ccgauuggcggagccucaguccuucuu

SEQ ID NO: 354872 - RNA, 23 nt, Human
ccuggauugggccgggccgaggc

SEQ ID NO: 354873 - RNA, 23 nt, Human
cgcuuuaaacaaacauauuuggg

SEQ ID NO: 354874 - RNA, 21 nt, Human
cgggccgaggcgaagggucga

SEQ ID NO: 354875 - RNA, 28 nt, Human
cugcagauaaaccagugaagagaacgcg

SEQ ID NO: 354876 - RNA, 23 nt, Human
gaaaaacccacaaccagcuugac

SEQ ID NO: 354877 - RNA, 22 nt, Human
gccgggggcggcggggccgggg

SEQ ID NO: 354878 - RNA, 19 nt, Human
gcggcgggcggcggcggcg

SEQ ID NO: 354879 - RNA, 22 nt, Human
gcguugcugaggcugucugccu

SEQ ID NO: 354880 - RNA, 24 nt, Human
ggaaaagauaaagaaguaacaaag

SEQ ID NO: 354881 - RNA, 26 nt, Human
ggaagccuuccaggaaggagaggacc

SEQ ID NO: 354882 - RNA, 25 nt, Human
ggagaacuggagagaagggaaagga

SEQ ID NO: 354883 - RNA, 19 nt, Human
ggagagggaagcgggagga

SEQ ID NO: 354884 - RNA, 19 nt, Human
ggaggagagagggcaccgc

SEQ ID NO: 354885 - RNA, 21 nt, Human
ggccgggccgaggcgaagggu

SEQ ID NO: 354886 - RNA, 20 nt, Human
ggcggcggaguucggugggc

SEQ ID NO: 354887 - RNA, 21 nt, Human
ggcggcggaguucggugggcu

SEQ ID NO: 354888 - RNA, 19 nt, Human
ggcgggcggcggcggcgcg

SEQ ID NO: 354889 - RNA, 22 nt, Human
gggccgaggcgaagggucgaaa

SEQ ID NO: 354890 - RNA, 24 nt, Human
ggugaucaaggagcacaggaagaa

SEQ ID NO: 354891 - RNA, 23 nt, Human
gucgaaaucggcggccuccgauu

SEQ ID NO: 354892 - RNA, 25 nt, Human
uaaaaaaccccacgcuuuaaacaaa

SEQ ID NO: 354893 - RNA, 23 nt, Human
uaaaccagugaagagaacgcgca

SEQ ID NO: 354894 - RNA, 22 nt, Human
uaacaaaggaaaaagaaaaaaa

SEQ ID NO: 354895 - RNA, 19 nt, Human
uacccucggcaacuuuaca

SEQ ID NO: 354896 - RNA, 23 nt, Human
ucacgcggcgggcggcggcggcg

SEQ ID NO: 354897 - RNA, 18 nt, Human
ucauggagagggaagcgg

SEQ ID NO: 354898 - RNA, 21 nt, Human
uccaggaaggagaggaccaaa

SEQ ID NO: 354899 - RNA, 18 nt, Human
ucccuugacaaggguggc

SEQ ID NO: 354900 - RNA, 21 nt, Human
ucccuugacaaggguggcaga

SEQ ID NO: 354901 - RNA, 18 nt, Human
ucucacgcggcgggcggc

SEQ ID NO: 354902 - RNA, 22 nt, Human
ugaaaaacccacaaccagcuug

SEQ ID NO: 354903 - RNA, 22 nt, Human
uggcaccuugaaaaacccacaa

SEQ ID NO: 354904 - RNA, 23 nt, Human
uggcaggaucgccaggacggaug

SEQ ID NO: 354905 - RNA, 18 nt, Human
uggcaggcgagcccgagg

SEQ ID NO: 354906 - RNA, 21 nt, Human
uugccgaaccauccuguccac

SEQ ID NO: 354907 - RNA, 20 nt, Human
aaugggcugcugaagaaaug

SEQ ID NO: 354908 - RNA, 24 nt, Human
agaaaacccagcuacucuuaccaa

SEQ ID NO: 354909 - RNA, 22 nt, Human
agacaggagaggcaaaagggac

SEQ ID NO: 354910 - RNA, 18 nt, Human
aggagaggcaaaauggca

SEQ ID NO: 354911 - RNA, 18 nt, Human
aggagaggcaaaauggca

SEQ ID NO: 354912 - RNA, 21 nt, Human
aggcaaggcaaagccucaggg

SEQ ID NO: 354913 - RNA, 22 nt, Human
auucuauuagccaagugccacc

SEQ ID NO: 354914 - RNA, 19 nt, Human
caagacagccuccccgcuc

SEQ ID NO: 354915 - RNA, 19 nt, Human
caguugcuaaugggcugcu

SEQ ID NO: 354916 - RNA, 24 nt, Human
ccaccugucacuaugaaacuaucc

SEQ ID NO: 354917 - RNA, 22 nt, Human
ccucaggggggcuccugggucu

SEQ ID NO: 354918 - RNA, 20 nt, Human
ccugucacuaugaaacuauc

SEQ ID NO: 354919 - RNA, 24 nt, Human
cgaaacaaauaugcaggcaaggca

SEQ ID NO: 354920 - RNA, 21 nt, Human
cgagacccuaacacaaagaga

SEQ ID NO: 354921 - RNA, 19 nt, Human
cuguaggacaucccugggc

SEQ ID NO: 354922 - RNA, 24 nt, Human
cuuagaaaacccagcuacucuuac

SEQ ID NO: 354923 - RNA, 23 nt, Human
gaaacaaauaugcaggcaaggca

SEQ ID NO: 354924 - RNA, 19 nt, Human
gcaggacaauuugaauucc

SEQ ID NO: 354925 - RNA, 21 nt, Human
ggagacaggagaggcaaaaug

SEQ ID NO: 354926 - RNA, 19 nt, Human
ggcagggggugggagacag

SEQ ID NO: 354927 - RNA, 19 nt, Human
ggucuggggcagggggugg

SEQ ID NO: 354928 - RNA, 19 nt, Human
uaggacaucccugggcucu

SEQ ID NO: 354929 - RNA, 21 nt, Human
uaggacaucccugggcucuca

SEQ ID NO: 354930 - RNA, 18 nt, Human
ucccugggcucucaguug

SEQ ID NO: 354931 - RNA, 21 nt, Human
uccugggucuggggcaggggg

SEQ ID NO: 354932 - RNA, 24 nt, Human
uccugggucuggggcagggggugg

SEQ ID NO: 354933 - RNA, 20 nt, Human
uccuguaggacaucccuggg

SEQ ID NO: 354934 - RNA, 22 nt, Human
ucucaguugcuaaugggcugcu

SEQ ID NO: 354935 - RNA, 28 nt, Human
ugcaggcaaggcaaagccucaggggggc

SEQ ID NO: 354936 - RNA, 20 nt, Human
uggggcagggggugggagac

SEQ ID NO: 354937 - RNA, 21 nt, Human
uggggcagggggugggagaca

SEQ ID NO: 354938 - RNA, 24 nt, Human
uuuuuuuuuuuuuuuuuucacaag

SEQ ID NO: 354939 - RNA, 25 nt, Human
uuuuuuuuuuuuuuuuuucacaaga

SEQ ID NO: 354940 - RNA, 20 nt, Human
agagcaccuggcgcugggcu

SEQ ID NO: 354941 - RNA, 21 nt, Human
caaaagagcagccuucucuca

SEQ ID NO: 354942 - RNA, 25 nt, Human
caagagcaccuggcgcugggcuugc

SEQ ID NO: 354943 - RNA, 26 nt, Human
cagagcccaaggccgcguuccgaggg

SEQ ID NO: 354944 - RNA, 25 nt, Human
cuccucguuucgccaccuccacgac

SEQ ID NO: 354945 - RNA, 22 nt, Human
gcaguacaaaagagcagccuuc

SEQ ID NO: 354946 - RNA, 20 nt, Human
gccaccuccacgacuucguu

SEQ ID NO: 354947 - RNA, 20 nt, Human
gcugggcuugcugggggagg

SEQ ID NO: 354948 - RNA, 22 nt, Human
ggcgcugggcuugcugggggag

SEQ ID NO: 354949 - RNA, 20 nt, Human
guuucgccaccuccacgacu

SEQ ID NO: 354950 - RNA, 18 nt, Human
ucguuuggcgaacggcgg

SEQ ID NO: 354951 - RNA, 25 nt, Human
ucucucagugggaaaaggcaagagc

SEQ ID NO: 354952 - RNA, 21 nt, Human
uggcgcugggcuugcuggggg

SEQ ID NO: 354953 - RNA, 24 nt, Human
uggcgcugggcuugcugggggagg

SEQ ID NO: 354954 - RNA, 22 nt, Human
ugggggaggcuguuuaaugagc

SEQ ID NO: 354955 - RNA, 24 nt, Human
uuggcgaacggcgggcaaagaaag

SEQ ID NO: 354956 - RNA, 18 nt, Human
uuuuuuuuuuuuuggggg

SEQ ID NO: 354957 - RNA, 20 nt, Human
uuuuuuuuuuuuuuggggga

SEQ ID NO: 354958 - RNA, 20 nt, Human
uuuuuuuuuuuuuuuggggg

SEQ ID NO: 354959 - RNA, 22 nt, Human
uuuuuuuuuuuuuuuuuggggg

SEQ ID NO: 354960 - RNA, 21 nt, Human
aucacuguguucuuggucacu

SEQ ID NO: 354961 - RNA, 23 nt, Human
aucaugcuacuggauuucuagcu

SEQ ID NO: 354962 - RNA, 21 nt, Human
cacuguguucuuggucacuac

SEQ ID NO: 354963 - RNA, 21 nt, Human
ccuuuaaacacaaggaaugag

SEQ ID NO: 354964 - RNA, 20 nt, Human
cuagcucuuccucuaugacc

SEQ ID NO: 354965 - RNA, 18 nt, Human
uaaaaaugaaaucccucc

SEQ ID NO: 354966 - RNA, 19 nt, Human
uccucuaugaccaguucua

SEQ ID NO: 354967 - RNA, 22 nt, Human
ucucaauuaaacauucccuuua

SEQ ID NO: 354968 - RNA, 19 nt, Human
ucuuggucacuacuggcau

SEQ ID NO: 354969 - RNA, 21 nt, Human
ugaaguagcugugcauuaaac

SEQ ID NO: 354970 - RNA, 21 nt, Human
cuggagguggcggcggcggca

SEQ ID NO: 354971 - RNA, 24 nt, Human
cuggagguggcggcggcggcagcu

SEQ ID NO: 354972 - RNA, 19 nt, Human
gccaaaaaaagggcuagug

SEQ ID NO: 354973 - RNA, 22 nt, Human
ggagguggcggcggcggcagcu

SEQ ID NO: 354974 - RNA, 21 nt, Human
guggcggcggcggcagcugca

SEQ ID NO: 354975 - RNA, 25 nt, Human
guggcggcggcggcagcugcaauuc

SEQ ID NO: 354976 - RNA, 28 nt, Human
uaaaauaagaacaugaaaugacaagucc

SEQ ID NO: 354977 - RNA, 22 nt, Human
uacaaaacaggucuaaaauaag

SEQ ID NO: 354978 - RNA, 24 nt, Human
uggagguggcggcggcggcagcug

SEQ ID NO: 354979 - RNA, 18 nt, Human
uggcggcggcggcagcug

SEQ ID NO: 354980 - RNA, 22 nt, Human
uucaucucuuuccuugggaaac

SEQ ID NO: 354981 - RNA, 24 nt, Human
uuuuuuuuuuuuuuuucaucucuu

SEQ ID NO: 354982 - RNA, 23 nt, Human
aaacacacagucucuggcaagcc

SEQ ID NO: 354983 - RNA, 20 nt, Human
aacuguauuuacaagaaaac

SEQ ID NO: 354984 - RNA, 19 nt, Human
accugagccacccagaccu

SEQ ID NO: 354985 - RNA, 19 nt, Human
acuguauuuacaagaaaac

SEQ ID NO: 354986 - RNA, 20 nt, Human
agccagguggcagugauggu

SEQ ID NO: 354987 - RNA, 24 nt, Human
agcuguugacuuucauaaugcagu

SEQ ID NO: 354988 - RNA, 18 nt, Human
aggccuugguuacaccaa

SEQ ID NO: 354989 - RNA, 18 nt, Human
agggauggcuuuggggaa

SEQ ID NO: 354990 - RNA, 24 nt, Human
agguggcagugauggugguggggg

SEQ ID NO: 354991 - RNA, 20 nt, Human
auccagucacccuccugcca

SEQ ID NO: 354992 - RNA, 24 nt, Human
caaaaguagacaggagagucaaga

SEQ ID NO: 354993 - RNA, 20 nt, Human
caacggaugcuaccucccuu

SEQ ID NO: 354994 - RNA, 24 nt, Human
caagccccaccgggaaaggagggc

SEQ ID NO: 354995 - RNA, 21 nt, Human
cacagccugccuccuuccucc

SEQ ID NO: 354996 - RNA, 22 nt, Human
caccaacuccaacauacuggcg

SEQ ID NO: 354997 - RNA, 22 nt, Human
cacccagaccuccaggccuugg

SEQ ID NO: 354998 - RNA, 22 nt, Human
caguacggaguccaagaaagcc

SEQ ID NO: 354999 - RNA, 23 nt, Human
cauuccaggagaagagcugaggg

SEQ ID NO: 355000 - RNA, 24 nt, Human
ccaccaccaacuccaacauacugg

SEQ ID NO: 355001 - RNA, 19 nt, Human
ccacccagaccuccaggcc

SEQ ID NO: 355002 - RNA, 18 nt, Human
cccaccgggaaaggaggg

SEQ ID NO: 355003 - RNA, 26 nt, Human
cccuucaaaacuuaagccaccaccaa

SEQ ID NO: 355004 - RNA, 19 nt, Human
ccucccuucaaaacuuaag

SEQ ID NO: 355005 - RNA, 22 nt, Human
ccucccuucaaaacuuaagcca

SEQ ID NO: 355006 - RNA, 22 nt, Human
ccuccugccacauggcagaagc

SEQ ID NO: 355007 - RNA, 22 nt, Human
ccuucaaaacuuaagccaccac

SEQ ID NO: 355008 - RNA, 19 nt, Human
cuucaaaacuuaagccacc

SEQ ID NO: 355009 - RNA, 20 nt, Human
gaaacaaaacacacagucuc

SEQ ID NO: 355010 - RNA, 18 nt, Human
gagcugaggggaaagagc

SEQ ID NO: 355011 - RNA, 20 nt, Human
gauggcuuuggggaaugggg

SEQ ID NO: 355012 - RNA, 20 nt, Human
ggaguccaagaaagccugca

SEQ ID NO: 355013 - RNA, 20 nt, Human
gggaagccagucauuccagg

SEQ ID NO: 355014 - RNA, 24 nt, Human
ggggaaugggggacucagguucua

SEQ ID NO: 355015 - RNA, 23 nt, Human
uaccucccuucaaaacuuaagcc

SEQ ID NO: 355016 - RNA, 19 nt, Human
ucaaugcagggauggcuuu

SEQ ID NO: 355017 - RNA, 24 nt, Human
uccaggagaagagcugaggggaaa

SEQ ID NO: 355018 - RNA, 19 nt, Human
ugaggggaagccagucauu

SEQ ID NO: 355019 - RNA, 20 nt, Human
ugauacuauacccuacccag

SEQ ID NO: 355020 - RNA, 21 nt, Human
ugcaggaaaccugagccaccc

SEQ ID NO: 355021 - RNA, 19 nt, Human
ugccacauggcagaagcca

SEQ ID NO: 355022 - RNA, 19 nt, Human
uggcagaagccagguggca

SEQ ID NO: 355023 - RNA, 18 nt, Human
uggcagugaugguggugg

SEQ ID NO: 355024 - RNA, 25 nt, Human
uggcagugaugguggugggggaaac

SEQ ID NO: 355025 - RNA, 24 nt, Human
uggggagaaguguagcaaaucuca

SEQ ID NO: 355026 - RNA, 19 nt, Human
uggggucauguaucaugua

SEQ ID NO: 355027 - RNA, 18 nt, Human
uguagcaaaucucagugc

SEQ ID NO: 355028 - RNA, 18 nt, Human
uucaaaacuuaagccacc

SEQ ID NO: 355029 - RNA, 19 nt, Human
uucaaaacuuaagccacca

SEQ ID NO: 355030 - RNA, 19 nt, Human
uuccaggagaagagcugag

SEQ ID NO: 355031 - RNA, 19 nt, Human
aaaauacucaggaccaaca

SEQ ID NO: 355032 - RNA, 19 nt, Human
aaaguuacauuaaaaaggg

SEQ ID NO: 355033 - RNA, 19 nt, Human
aggaauagaaaagauauug

SEQ ID NO: 355034 - RNA, 22 nt, Human
caaaauacucaggaccaacaua

SEQ ID NO: 355035 - RNA, 24 nt, Human
caacauaaaaaagaaauaccuccu

SEQ ID NO: 355036 - RNA, 23 nt, Human
ccccaaggagcuacagcaucucu

SEQ ID NO: 355037 - RNA, 20 nt, Human
gggaauggagugggggugcu

SEQ ID NO: 355038 - RNA, 24 nt, Human
uaaaaaagaaauaccuccugugga

SEQ ID NO: 355039 - RNA, 20 nt, Human
uggagugggggugcugaaag

SEQ ID NO: 355040 - RNA, 20 nt, Human
uggagugggggugcugaaag

SEQ ID NO: 355041 - RNA, 22 nt, Human
uuuuuuuuuuuuuuaacaagga

SEQ ID NO: 355042 - RNA, 25 nt, Human
uuuuuuuuuuuuuuuuuuaacaagg

SEQ ID NO: 355043 - RNA, 19 nt, Human
aaguagccugguccugggg

SEQ ID NO: 355044 - RNA, 23 nt, Human
acacacacacacacacacacaca

SEQ ID NO: 355045 - RNA, 23 nt, Human
acacacacacacacacacacaca

SEQ ID NO: 355046 - RNA, 24 nt, Human
acacacacacacacacacccaucu

SEQ ID NO: 355047 - RNA, 24 nt, Human
acacccaucuccagccccugccac

SEQ ID NO: 355048 - RNA, 19 nt, Human
agaagagugggauccccag

SEQ ID NO: 355049 - RNA, 19 nt, Human
agccccagguggccucagc

SEQ ID NO: 355050 - RNA, 19 nt, Human
aggaaacauggucacaccc

SEQ ID NO: 355051 - RNA, 23 nt, Human
aggcagcaggggcaggagggagg

SEQ ID NO: 355052 - RNA, 20 nt, Human
agggaggcaagaggagggga

SEQ ID NO: 355053 - RNA, 18 nt, Human
aggggagaaggguggggc

SEQ ID NO: 355054 - RNA, 25 nt, Human
agggggcagggcggggcgguggcgg

SEQ ID NO: 355055 - RNA, 23 nt, Human
aguucucagccacaaggcgggac

SEQ ID NO: 355056 - RNA, 20 nt, Human
caacagcugcaagaagagug

SEQ ID NO: 355057 - RNA, 20 nt, Human
cacacacacacacacacaca

SEQ ID NO: 355058 - RNA, 20 nt, Human
cacacacacacacacacaca

SEQ ID NO: 355059 - RNA, 20 nt, Human
cacacacacacacacacaca

SEQ ID NO: 355060 - RNA, 20 nt, Human
cacacacacacacacacaca

SEQ ID NO: 355061 - RNA, 20 nt, Human
cacacacacacacacacaca

SEQ ID NO: 355062 - RNA, 20 nt, Human
cacacacacacacacacaca

SEQ ID NO: 355063 - RNA, 20 nt, Human
cacacacacacacacacaca

SEQ ID NO: 355064 - RNA, 20 nt, Human
cacacacacacacacacaca

SEQ ID NO: 355065 - RNA, 22 nt, Human
cacacacacacacacacacaca

SEQ ID NO: 355066 - RNA, 22 nt, Human
cacacacacacacacacacaca

SEQ ID NO: 355067 - RNA, 22 nt, Human
cacacacacacacacacacaca

SEQ ID NO: 355068 - RNA, 22 nt, Human
cacacacacacacacacacaca

SEQ ID NO: 355069 - RNA, 26 nt, Human
cacacacacacacacacacacacaca

SEQ ID NO: 355070 - RNA, 26 nt, Human
cacacacacacacacacacacacaca

SEQ ID NO: 355071 - RNA, 26 nt, Human
cacacacacacacacacacacacaca

SEQ ID NO: 355072 - RNA, 26 nt, Human
cacacacacacacacacacacacaca

SEQ ID NO: 355073 - RNA, 30 nt, Human; identical to SEQ ID NO: 326474

SEQ ID NO: 355074 - RNA, 28 nt, Human
cacacacacacacacacacacacaccca

SEQ ID NO: 355075 - RNA, 24 nt, Human
cacacacacacacacacccaucuc

SEQ ID NO: 355076 - RNA, 20 nt, Human
cacacacacacccaucucca

SEQ ID NO: 355077 - RNA, 21 nt, Human
cacacacccaucuccagcccc

SEQ ID NO: 355078 - RNA, 28 nt, Human
caggggcaggagggaggcaagaggaggg

SEQ ID NO: 355079 - RNA, 19 nt, Human
caggggugggggcaugacc

SEQ ID NO: 355080 - RNA, 23 nt, Human
ccagcagacaugcuuucccucaa

SEQ ID NO: 355081 - RNA, 20 nt, Human
ccauacuaguccucucggca

SEQ ID NO: 355082 - RNA, 22 nt, Human
cccagccccagguggccucagc

SEQ ID NO: 355083 - RNA, 23 nt, Human
ccccagguggccucagcucugcc

SEQ ID NO: 355084 - RNA, 18 nt, Human
ccccauacuaguccucuc

SEQ ID NO: 355085 - RNA, 24 nt, Human
ccuacgaucagaggcagcaggggc

SEQ ID NO: 355086 - RNA, 21 nt, Human
ccuggggucgggaggaagccg

SEQ ID NO: 355087 - RNA, 20 nt, Human
ccuggggucgggaggaagcg

SEQ ID NO: 355088 - RNA, 20 nt, Human
cgaucagaggcagcaggggc

SEQ ID NO: 355089 - RNA, 20 nt, Human
cgcacacacacacacacaca

SEQ ID NO: 355090 - RNA, 25 nt, Human
cgcacacacacacacacacacacac

SEQ ID NO: 355091 - RNA, 24 nt, Human
cgccuaggggagaaggguggggcc

SEQ ID NO: 355092 - RNA, 25 nt, Human
cgcgcgcacacacacacacacacac

SEQ ID NO: 355093 - RNA, 19 nt, Human
cggcgggcuaacugcugcc

SEQ ID NO: 355094 - RNA, 20 nt, Human
cgggcuaacugcugccuggg

SEQ ID NO: 355095 - RNA, 19 nt, Human
cuccacggagcccuuugga

SEQ ID NO: 355096 - RNA, 23 nt, Human
cugccacuguccaguucucagcc

SEQ ID NO: 355097 - RNA, 20 nt, Human
gagaaguagccugguccugg

SEQ ID NO: 355098 - RNA, 18 nt, Human
gagcaggggugggggcau

SEQ ID NO: 355099 - RNA, 22 nt, Human
gagcaggggugggggcaugacc

SEQ ID NO: 355100 - RNA, 20 nt, Human
gcaggagggaggcaagagga

SEQ ID NO: 355101 - RNA, 23 nt, Human
gcgcacacacacacacacacaca

SEQ ID NO: 355102 - RNA, 24 nt, Human
gcgcgcacacacacacacacacag

SEQ ID NO: 355103 - RNA, 21 nt, Human
ggacacacaggcgggcggcgg

SEQ ID NO: 355104 - RNA, 19 nt, Human
ggacuggagggggcagggc

SEQ ID NO: 355105 - RNA, 25 nt, Human
ggacuggagggggcagggcggggcg

SEQ ID NO: 355106 - RNA, 20 nt, Human
ggagagcaggggugggggca

SEQ ID NO: 355107 - RNA, 18 nt, Human
ggagggggcagggcgggg

SEQ ID NO: 355108 - RNA, 18 nt, Human
ggagggggcagggcgggg

SEQ ID NO: 355109 - RNA, 21 nt, Human
ggcaggagggaggcaagagga

SEQ ID NO: 355110 - RNA, 21 nt, Human
ggcgggcggcgggcuaacugc

SEQ ID NO: 355111 - RNA, 25 nt, Human
gggcagggcggggcgguggcgggca

SEQ ID NO: 355112 - RNA, 18 nt, Human
gggcggggcgguggcggg

SEQ ID NO: 355113 - RNA, 19 nt, Human
gggucgggaggaagcgggu

SEQ ID NO: 355114 - RNA, 19 nt, Human
gggucgggaggaagcgggu

SEQ ID NO: 355115 - RNA, 18 nt, Human
ggucgggaggaagcgggu

SEQ ID NO: 355116 - RNA, 20 nt, Human
gucgggaggaagcgggugcg

SEQ ID NO: 355117 - RNA, 21 nt, Human
gugcggagagcaggggugggg

SEQ ID NO: 355118 - RNA, 19 nt, Human
uacuaguccucucggcagg

SEQ ID NO: 355119 - RNA, 18 nt, Human
ucagaggcagcaggggca

SEQ ID NO: 355120 - RNA, 22 nt, Human
ucagcucugccagucccucucc

SEQ ID NO: 355121 - RNA, 21 nt, Human
uccccagccccagguggccuc

SEQ ID NO: 355122 - RNA, 26 nt, Human
uccccagccccagguggccucagcuc

SEQ ID NO: 355123 - RNA, 21 nt, Human
uccuggggucgggaggaagcg

SEQ ID NO: 355124 - RNA, 18 nt, Human
ucugccagucccucucca

SEQ ID NO: 355125 - RNA, 21 nt, Human
ucugccagucccucuccacgg

SEQ ID NO: 355126 - RNA, 18 nt, Human
ugcaagaagagugggauc

SEQ ID NO: 355127 - RNA, 18 nt, Human
ugcggagagcaggggugg

SEQ ID NO: 355128 - RNA, 22 nt, Human
ugcggagagcaggggugggggc

SEQ ID NO: 355129 - RNA, 18 nt, Human
uggccucagcucugccag

SEQ ID NO: 355130 - RNA, 21 nt, Human
uggccucagcucugccagucc

SEQ ID NO: 355131 - RNA, 23 nt, Human
ugggauccccagccccagguggc

SEQ ID NO: 355132 - RNA, 23 nt, Human
uggggacacacaggcgggcggcg

SEQ ID NO: 355133 - RNA, 27 nt, Human
uggggccucccaccccauacuaguccu

SEQ ID NO: 355134 - RNA, 20 nt, Human
ugggggacuggagggggcag

SEQ ID NO: 355135 - RNA, 20 nt, Human
aaaaaaacaaaacaaacugg

SEQ ID NO: 355136 - RNA, 20 nt, Human
aaaaaagaaaaaauaaagaa

SEQ ID NO: 355137 - RNA, 19 nt, Human
aaaaaauucuccuguucca

SEQ ID NO: 355138 - RNA, 30 nt, Human
aaaaagaaaaaauaaagaaauaaaaaggaa

SEQ ID NO: 355139 - RNA, 23 nt, Human
aaaagauugguaucuaaacaaaa

SEQ ID NO: 355140 - RNA, 21 nt, Human
aaaauacuuagcaccagcgug

SEQ ID NO: 355141 - RNA, 21 nt, Human
aaacguggaggccaccuugcu

SEQ ID NO: 355142 - RNA, 21 nt, Human
aaacugcuaacauccauaaaa

SEQ ID NO: 355143 - RNA, 20 nt, Human
aaaugaccuuuccacuuuuc

SEQ ID NO: 355144 - RNA, 20 nt, Human
aacguggaggccaccuugcu

SEQ ID NO: 355145 - RNA, 23 nt, Human
acaaaacaaacuggaaugaaagc

SEQ ID NO: 355146 - RNA, 18 nt, Human
acaguaaaaaaaaaaaaa

SEQ ID NO: 355147 - RNA, 25 nt, Human
acaguaaaaaaaaaaaaauugguac

SEQ ID NO: 355148 - RNA, 20 nt, Human
acccacuuucacccccuacc

SEQ ID NO: 355149 - RNA, 21 nt, Human
acccacuuucacccccuacca

SEQ ID NO: 355150 - RNA, 19 nt, Human
acuaaaaugcaagaauuua

SEQ ID NO: 355151 - RNA, 19 nt, Human
acuuucacccccuaccaau

SEQ ID NO: 355152 - RNA, 21 nt, Human
agaaagcaauacuuagccucc

SEQ ID NO: 355153 - RNA, 18 nt, Human
agaagcaugaauggcaaa

SEQ ID NO: 355154 - RNA, 20 nt, Human
aggcaaaagcgaagaagacg

SEQ ID NO: 355155 - RNA, 23 nt, Human
aggcaaaagcgaagaagacgcuc

SEQ ID NO: 355156 - RNA, 23 nt, Human
aggcaaaagcgaagaagagggac

SEQ ID NO: 355157 - RNA, 24 nt, Human
agggacauuauacaguaaaaaaga

SEQ ID NO: 355158 - RNA, 20 nt, Human
auauuccugaagauuuacag

SEQ ID NO: 355159 - RNA, 24 nt, Human
caaacaaaucaucaaacuacuucu

SEQ ID NO: 355160 - RNA, 25 nt, Human
caacaaaaugaccuuuccacuuuuc

SEQ ID NO: 355161 - RNA, 21 nt, Human
cacugccauaaacuugaggga

SEQ ID NO: 355162 - RNA, 23 nt, Human
cauaaaagauccauuuaaucaaa

SEQ ID NO: 355163 - RNA, 23 nt, Human
cauccauaaaaagauagcuuucu

SEQ ID NO: 355164 - RNA, 20 nt, Human
caugcuuucaauguggaaua

SEQ ID NO: 355165 - RNA, 19 nt, Human
ccaaacagaccauuuacaa

SEQ ID NO: 355166 - RNA, 20 nt, Human
ccaaacagaccauuuacaaa

SEQ ID NO: 355167 - RNA, 27 nt, Human
cccaaacagaccauuuacaaauauuag

SEQ ID NO: 355168 - RNA, 20 nt, Human
cugcccaaacagaccauuua

SEQ ID NO: 355169 - RNA, 29 nt, Human
cuugagggacauuauacaguaaaaaagag

SEQ ID NO: 355170 - RNA, 23 nt, Human
gaaauggcauaugccauucaaag

SEQ ID NO: 355171 - RNA, 18 nt, Human
gaauuuaaaagauuggua

SEQ ID NO: 355172 - RNA, 24 nt, Human
gccauuuauagggcuugagauuug

SEQ ID NO: 355173 - RNA, 22 nt, Human
ggacauuauacaguaaaaaaga

SEQ ID NO: 355174 - RNA, 22 nt, Human
gggcaauuauuuguagaaagca

SEQ ID NO: 355175 - RNA, 19 nt, Human
guggaggccaccuugcuuc

SEQ ID NO: 355176 - RNA, 24 nt, Human
uaaaaaagaaaaaauaaagaaaua

SEQ ID NO: 355177 - RNA, 24 nt, Human
uaaaaacaagaaauggggaaaugc

SEQ ID NO: 355178 - RNA, 24 nt, Human
uaucuaaacaaaaaaacaaaacaa

SEQ ID NO: 355179 - RNA, 18 nt, Human
ucaauaaacugcuaacau

SEQ ID NO: 355180 - RNA, 23 nt, Human
ucaguggcacaagguacacugcc

SEQ ID NO: 355181 - RNA, 22 nt, Human
uccagaugcauuucccagaaau

SEQ ID NO: 355182 - RNA, 19 nt, Human
ucccagaaauggcauaugc

SEQ ID NO: 355183 - RNA, 18 nt, Human
ucgaggcaaaagcgaaga

SEQ ID NO: 355184 - RNA, 21 nt, Human
ucgaggcaaaagcgaagaaga

SEQ ID NO: 355185 - RNA, 22 nt, Human
ucuaaacaaaaaaacaaaacaa

SEQ ID NO: 355186 - RNA, 24 nt, Human
ucuaaacaaaaaaacaaaacaaac

SEQ ID NO: 355187 - RNA, 22 nt, Human
ucucaugcuuucaauguggaau

SEQ ID NO: 355188 - RNA, 25 nt, Human
ucuguggucaaggggcggucgaggc

SEQ ID NO: 355189 - RNA, 25 nt, Human
uguagaaagcaauacuuagccucca

SEQ ID NO: 355190 - RNA, 21 nt, Human
ugucuuacacccauuccacaa

SEQ ID NO: 355191 - RNA, 24 nt, Human
uuaccugcccaaacagaccauuua

SEQ ID NO: 355192 - RNA, 24 nt, Human
uugaagcacaguaaaaaaaaaaaa

SEQ ID NO: 355193 - RNA, 21 nt, Human
uuguagaaagcaauacuuagc

SEQ ID NO: 355194 - RNA, 21 nt, Human
aaaaaacaacacaaaugaaau

SEQ ID NO: 355195 - RNA, 18 nt, Human
aaaccccuccacuaagga

SEQ ID NO: 355196 - RNA, 23 nt, Human
aaagaaacuacucuggaccugaa

SEQ ID NO: 355197 - RNA, 18 nt, Human
aagaaaaaaacggaaagc

SEQ ID NO: 355198 - RNA, 26 nt, Human
aagggcuuugggaaguaucucagggu

SEQ ID NO: 355199 - RNA, 21 nt, Human
aaucauccaaaauuacaggca

SEQ ID NO: 355200 - RNA, 22 nt, Human
acccugggguuuggagcguggc

SEQ ID NO: 355201 - RNA, 21 nt, Human
acuggguauaagcauuggccc

SEQ ID NO: 355202 - RNA, 21 nt, Human
agaaagaaacuacucuggacc

SEQ ID NO: 355203 - RNA, 18 nt, Human
agagagggcccgguugca

SEQ ID NO: 355204 - RNA, 21 nt, Human
agagccaaguguuacacagga

SEQ ID NO: 355205 - RNA, 21 nt, Human
aggcaggcacaggcugccccu

SEQ ID NO: 355206 - RNA, 21 nt, Human
aggcggcgcgggcggggaggc

SEQ ID NO: 355207 - RNA, 22 nt, Human
aggugcggcgagcaggaaggcg

SEQ ID NO: 355208 - RNA, 18 nt, Human
aguaacuaaugacacuca

SEQ ID NO: 355209 - RNA, 21 nt, Human
aguuaugacacagcaaccagu

SEQ ID NO: 355210 - RNA, 23 nt, Human
auacuggagucuucaagaguuaa

SEQ ID NO: 355211 - RNA, 22 nt, Human
augaaacaaauauauguaaaaa

SEQ ID NO: 355212 - RNA, 21 nt, Human
caaaaugagcagauacguaug

SEQ ID NO: 355213 - RNA, 25 nt, Human
caaaaugagcagauacguaugagca

SEQ ID NO: 355214 - RNA, 24 nt, Human
caaacagaucaccugagccuccug

SEQ ID NO: 355215 - RNA, 21 nt, Human
caaaccuccucucucggagac

SEQ ID NO: 355216 - RNA, 25 nt, Human
caaaucacuuaagguccccagcacu

SEQ ID NO: 355217 - RNA, 21 nt, Human
cacaggcaaaccuccucucuc

SEQ ID NO: 355218 - RNA, 18 nt, Human
cacccaugucaacuuucc

SEQ ID NO: 355219 - RNA, 27 nt, Human
caccccacccgaggcucccuccccacc

SEQ ID NO: 355220 - RNA, 24 nt, Human
cagaacuaagacccagauccacgc

SEQ ID NO: 355221 - RNA, 25 nt, Human
cagaucaccugagccuccugcaucu

SEQ ID NO: 355222 - RNA, 21 nt, Human
cagccaauagauccacaccaa

SEQ ID NO: 355223 - RNA, 23 nt, Human
cagcccgaaaaucgccgucucuc

SEQ ID NO: 355224 - RNA, 25 nt, Human
cagcuacacuaccagggaaauccgc

SEQ ID NO: 355225 - RNA, 18 nt, Human
caggccaaucagucugca

SEQ ID NO: 355226 - RNA, 19 nt, Human
caggcuagggccgcagggg

SEQ ID NO: 355227 - RNA, 20 nt, Human
cagggaaauccgccucccuu

SEQ ID NO: 355228 - RNA, 18 nt, Human
cauaagcgauaacaucaa

SEQ ID NO: 355229 - RNA, 24 nt, Human
cauccaaaauuacaggcaaaucac

SEQ ID NO: 355230 - RNA, 25 nt, Human
ccaaaauuacaggcaaaucacuuaa

SEQ ID NO: 355231 - RNA, 19 nt, Human
ccaccccacccgaggcucc

SEQ ID NO: 355232 - RNA, 20 nt, Human
ccagggaaauccgccucccu

SEQ ID NO: 355233 - RNA, 21 nt, Human
ccagggaccuccggggacaaa

SEQ ID NO: 355234 - RNA, 22 nt, Human
cccacccgaggcucccucccca

SEQ ID NO: 355235 - RNA, 20 nt, Human
ccccacccgaggcucccucc

SEQ ID NO: 355236 - RNA, 22 nt, Human
ccccacccgaggcucccucccc

SEQ ID NO: 355237 - RNA, 24 nt, Human
ccccacccgaggcucccuccccac

SEQ ID NO: 355238 - RNA, 18 nt, Human
ccccacccugcccccggg

SEQ ID NO: 355239 - RNA, 19 nt, Human
ccccacccugcccccggga

SEQ ID NO: 355240 - RNA, 21 nt, Human
cccccccgcucccaccccacc

SEQ ID NO: 355241 - RNA, 18 nt, Human
ccccccgcucccacccca

SEQ ID NO: 355242 - RNA, 28 nt, Human
cccccgcucccaccccacccgaggcucc

SEQ ID NO: 355243 - RNA, 19 nt, Human
cccgcgcgcguccugccgc

SEQ ID NO: 355244 - RNA, 23 nt, Human
ccgccgccuccccgcgcgcgucc

SEQ ID NO: 355245 - RNA, 24 nt, Human
ccgccgccuccccgcgcgcguccu

SEQ ID NO: 355246 - RNA, 18 nt, Human
ccgguagguaacuaggcg

SEQ ID NO: 355247 - RNA, 23 nt, Human
ccuccacuaaggacucugccgca

SEQ ID NO: 355248 - RNA, 20 nt, Human
ccuccccgcgcgcguccugc

SEQ ID NO: 355249 - RNA, 24 nt, Human
ccuccccgcgcgcguccugccgca

SEQ ID NO: 355250 - RNA, 23 nt, Human
ccucccuuggcaaaugccuggga

SEQ ID NO: 355251 - RNA, 20 nt, Human
ccugcucuuccguauucugu

SEQ ID NO: 355252 - RNA, 18 nt, Human
ccuucucagcccgaaaau

SEQ ID NO: 355253 - RNA, 23 nt, Human
cgaaacuuuggggcaucugagac

SEQ ID NO: 355254 - RNA, 18 nt, Human
cggccaguggcggcccuc

SEQ ID NO: 355255 - RNA, 18 nt, Human
cucacugcagcauccuca

SEQ ID NO: 355256 - RNA, 24 nt, Human
cucccggaggugcggcgagcagga

SEQ ID NO: 355257 - RNA, 23 nt, Human
cuccgcggccgcaagcugcugcc

SEQ ID NO: 355258 - RNA, 18 nt, Human
cugaagcuguugcuuccu

SEQ ID NO: 355259 - RNA, 20 nt, Human
cugcagaaaugaaacaaaua

SEQ ID NO: 355260 - RNA, 19 nt, Human
cugccuucucagcccgaaa

SEQ ID NO: 355261 - RNA, 21 nt, Human
cugcuggcucucacuuuccgc

SEQ ID NO: 355262 - RNA, 20 nt, Human
cugggcuugaccuuaauugu

SEQ ID NO: 355263 - RNA, 23 nt, Human
cuuuggggcaucugagacuggcu

SEQ ID NO: 355264 - RNA, 22 nt, Human
cuuuugguucugaaauugcuga

SEQ ID NO: 355265 - RNA, 20 nt, Human
gaaguuaugacacagcaacc

SEQ ID NO: 355266 - RNA, 21 nt, Human
gagaauucccauuuagagagc

SEQ ID NO: 355267 - RNA, 23 nt, Human
gaggcucccuccccacccugccc

SEQ ID NO: 355268 - RNA, 19 nt, Human
gccacacagcuacacuacc

SEQ ID NO: 355269 - RNA, 18 nt, Human
gccauggcuacccugggg

SEQ ID NO: 355270 - RNA, 20 nt, Human
gccccgggcucauaggaacc

SEQ ID NO: 355271 - RNA, 20 nt, Human
gcguggcuauggagggaaag

SEQ ID NO: 355272 - RNA, 18 nt, Human
gcugccuccgccgccucc

SEQ ID NO: 355273 - RNA, 21 nt, Human
gcugcugcccgguccccccgg

SEQ ID NO: 355274 - RNA, 24 nt, Human
ggaacaggcaggcuguucugaauu

SEQ ID NO: 355275 - RNA, 19 nt, Human
ggacaaucauaaauguccu

SEQ ID NO: 355276 - RNA, 25 nt, Human
ggacaaucauaaauguccucaaagu

SEQ ID NO: 355277 - RNA, 21 nt, Human
ggagagcugcuccucugggaa

SEQ ID NO: 355278 - RNA, 20 nt, Human
ggcaggcacaggcugccccu

SEQ ID NO: 355279 - RNA, 21 nt, Human
ggccaguggcggcccucggcc

SEQ ID NO: 355280 - RNA, 22 nt, Human
ggcgcaguccccagcguugccc

SEQ ID NO: 355281 - RNA, 25 nt, Human
ggcggcgggcgcgcggcacugacuc

SEQ ID NO: 355282 - RNA, 22 nt, Human
ggcugaaaaagcaugaaaauaa

SEQ ID NO: 355283 - RNA, 21 nt, Human
gucaggcuagggccgcagggg

SEQ ID NO: 355284 - RNA, 21 nt, Human
guccccagcacuuuacgauga

SEQ ID NO: 355285 - RNA, 18 nt, Human
uaaaaaaacaacacaaau

SEQ ID NO: 355286 - RNA, 21 nt, Human
uaaaaugcaguuaaaaaaaca

SEQ ID NO: 355287 - RNA, 21 nt, Human
uaaaauguuuuuggaauccuc

SEQ ID NO: 355288 - RNA, 23 nt, Human
uaacccacagguaccaagagcca

SEQ ID NO: 355289 - RNA, 24 nt, Human
uaagcucuucacccaauuucacaa

SEQ ID NO: 355290 - RNA, 21 nt, Human
uagaauccuaagcucuucacc

SEQ ID NO: 355291 - RNA, 22 nt, Human
uagaauccuaagcucuucaccc

SEQ ID NO: 355292 - RNA, 20 nt, Human
uaggaucuaaaagaggagua

SEQ ID NO: 355293 - RNA, 19 nt, Human
uaggggguguuagguucua

SEQ ID NO: 355294 - RNA, 20 nt, Human
uagggugcucuccucaaaca

SEQ ID NO: 355295 - RNA, 23 nt, Human
uagguaacuaggcgggcaugcug

SEQ ID NO: 355296 - RNA, 21 nt, Human
uaugacacagcaaccaguuac

SEQ ID NO: 355297 - RNA, 24 nt, Human
uauucuucaaagauuuaacugagu

SEQ ID NO: 355298 - RNA, 21 nt, Human
uauuuugagcucuuucugaag

SEQ ID NO: 355299 - RNA, 23 nt, Human
ucacccaauuucacaauucaccc

SEQ ID NO: 355300 - RNA, 22 nt, Human
ucacugcagcauccucacuggg

SEQ ID NO: 355301 - RNA, 22 nt, Human
ucagaucaugccccgggcucau

SEQ ID NO: 355302 - RNA, 21 nt, Human
uccaaaauuacaggcaaauca

SEQ ID NO: 355303 - RNA, 25 nt, Human
uccacuaaggacucugccgcagaga

SEQ ID NO: 355304 - RNA, 18 nt, Human
ucccaggacucuauccag

SEQ ID NO: 355305 - RNA, 19 nt, Human
uccccagcguugcccggcu

SEQ ID NO: 355306 - RNA, 19 nt, Human
uccccgcgcgcguccugcc

SEQ ID NO: 355307 - RNA, 19 nt, Human
ucccuuggcaaaugccugg

SEQ ID NO: 355308 - RNA, 18 nt, Human
uccugccgcaaacuucca

SEQ ID NO: 355309 - RNA, 22 nt, Human
uccugccgcaaacuuccaggga

SEQ ID NO: 355310 - RNA, 20 nt, Human
uccugugcaguggcugcugc

SEQ ID NO: 355311 - RNA, 23 nt, Human
ucuccgcgacgucggggcugccu

SEQ ID NO: 355312 - RNA, 18 nt, Human
ucugccaaggaccuccca

SEQ ID NO: 355313 - RNA, 24 nt, Human
ugaaacaaauauauguaaaaagug

SEQ ID NO: 355314 - RNA, 23 nt, Human
ugaccacggguucccgggcacuu

SEQ ID NO: 355315 - RNA, 19 nt, Human
ugagaaaaacagauuuuag

SEQ ID NO: 355316 - RNA, 23 nt, Human
ugagacagacggugguaaaaccc

SEQ ID NO: 355317 - RNA, 19 nt, Human
ugauuuucauacuggaguc

SEQ ID NO: 355318 - RNA, 22 nt, Human
ugcagagauguuuugcuuuuga

SEQ ID NO: 355319 - RNA, 23 nt, Human
ugcaguggcugcugcuccacauu

SEQ ID NO: 355320 - RNA, 19 nt, Human
ugcccgguccccccggcca

SEQ ID NO: 355321 - RNA, 21 nt, Human
ugccuacagagagccucccuu

SEQ ID NO: 355322 - RNA, 20 nt, Human
ugccuccgccgccuccccgc

SEQ ID NO: 355323 - RNA, 21 nt, Human
ugcgggggaacaggcaggcug

SEQ ID NO: 355324 - RNA, 22 nt, Human
uggaaaugguuugucaccuccu

SEQ ID NO: 355325 - RNA, 19 nt, Human
uggauggggacaccccacc

SEQ ID NO: 355326 - RNA, 18 nt, Human
uggcuauggagggaaagg

SEQ ID NO: 355327 - RNA, 18 nt, Human
ugggaaaaacugcagaga

SEQ ID NO: 355328 - RNA, 21 nt, Human
ugggaagcagccucggacgga

SEQ ID NO: 355329 - RNA, 20 nt, Human
ugggcuugaccuuaauugua

SEQ ID NO: 355330 - RNA, 18 nt, Human
uggguauaagcauuggcc

SEQ ID NO: 355331 - RNA, 18 nt, Human
ugguaugagucuguuucc

SEQ ID NO: 355332 - RNA, 22 nt, Human
uguccuguguaucugcuggcaa

SEQ ID NO: 355333 - RNA, 22 nt, Human
ugucuuggggaucagaucaugc

SEQ ID NO: 355334 - RNA, 21 nt, Human
ugugaaaaggaaaaaacauga

SEQ ID NO: 355335 - RNA, 21 nt, Human
ugugguaugagucuguuucca

SEQ ID NO: 355336 - RNA, 24 nt, Human
ugugugugaccacggguucccggg

SEQ ID NO: 355337 - RNA, 28 nt, Human
uguuggaaaugguuugucaaccgugagg

SEQ ID NO: 355338 - RNA, 26 nt, Human
uguuuugaaaacuacugccuucucag

SEQ ID NO: 355339 - RNA, 22 nt, Human
uucacaguauucaaagcuuuug

SEQ ID NO: 355340 - RNA, 19 nt, Human
uugcacuuuuccucccugc

SEQ ID NO: 355341 - RNA, 19 nt, Human
uuggagcguggcuauggag

SEQ ID NO: 355342 - RNA, 21 nt, Human
uuucugaagcuguugcuuccu

SEQ ID NO: 355343 - RNA, 18 nt, Human
uuugucaccuccuccugu

SEQ ID NO: 355344 - RNA, 24 nt, Human
aaauggucagccgugcucuggagc

SEQ ID NO: 355345 - RNA, 18 nt, Human
agacuggagcagcuagga

SEQ ID NO: 355346 - RNA, 18 nt, Human
caccgggaggacagcgcg

SEQ ID NO: 355347 - RNA, 18 nt, Human
cagcgcgggcgaggcgcu

SEQ ID NO: 355348 - RNA, 21 nt, Human
cagcuccggggggcuccgacc

SEQ ID NO: 355349 - RNA, 19 nt, Human
ccccgaaaagcuggcagcc

SEQ ID NO: 355350 - RNA, 22 nt, Human
ccccgagggggcagagggagcg

SEQ ID NO: 355351 - RNA, 24 nt, Human
ccggcggcuggggcgcggagaagc

SEQ ID NO: 355352 - RNA, 18 nt, Human
cuggagcaggccugucgg

SEQ ID NO: 355353 - RNA, 20 nt, Human
cuugucccgggcccgcucuc

SEQ ID NO: 355354 - RNA, 22 nt, Human
gcagagggagcggagccgggga

SEQ ID NO: 355355 - RNA, 24 nt, Human
gcagcuccggggggcuccgacccg

SEQ ID NO: 355356 - RNA, 21 nt, Human
gccggcggcuggggcgcggag

SEQ ID NO: 355357 - RNA, 22 nt, Human
gcgaccccgagggggcagaggg

SEQ ID NO: 355358 - RNA, 20 nt, Human
gcgcgaccccgagggggcag

SEQ ID NO: 355359 - RNA, 24 nt, Human
gcgcgaccccgagggggccggcgc

SEQ ID NO: 355360 - RNA, 23 nt, Human
gggaacgggagcugagaucccgg

SEQ ID NO: 355361 - RNA, 24 nt, Human
gggcgcgcgaccccgagggggcag

SEQ ID NO: 355362 - RNA, 21 nt, Human
ucgcugggugcgacucggggc

SEQ ID NO: 355363 - RNA, 19 nt, Human
ugcaaaaggcagggggaag

SEQ ID NO: 355364 - RNA, 21 nt, Human
uggagcaggccugucggagcc

SEQ ID NO: 355365 - RNA, 19 nt, Human
uugucccgggcccgcucuc

SEQ ID NO: 355366 - RNA, 22 nt, Human
uugucccgggcccgcucucuuc

SEQ ID NO: 355367 - RNA, 18 nt, Human
aaaaaauccccuuucauc

SEQ ID NO: 355368 - RNA, 23 nt, Human
aaaauccccuuucaucacaaaaa

SEQ ID NO: 355369 - RNA, 19 nt, Human
aaaggaggcagguuaugaa

SEQ ID NO: 355370 - RNA, 20 nt, Human
aacaacagauaucaaaaggu

SEQ ID NO: 355371 - RNA, 24 nt, Human
aagaaaauauuuaaaugaagaaaa

SEQ ID NO: 355372 - RNA, 18 nt, Human
acaaagaaaaacugaagc

SEQ ID NO: 355373 - RNA, 20 nt, Human
acuauggaauauaacacagc

SEQ ID NO: 355374 - RNA, 20 nt, Human
agggcaaggggcacauggcc

SEQ ID NO: 355375 - RNA, 21 nt, Human
aguaagaugagugacauaccu

SEQ ID NO: 355376 - RNA, 23 nt, Human
auccccuuucaucacaaaaaucc

SEQ ID NO: 355377 - RNA, 19 nt, Human
augguacagacaaacucac

SEQ ID NO: 355378 - RNA, 26 nt, Human
caaagaaaaacugaagcauagccuua

SEQ ID NO: 355379 - RNA, 25 nt, Human
caacagauaucaaaagguaauaaaa

SEQ ID NO: 355380 - RNA, 22 nt, Human
caacaguuuguugaguaaugca

SEQ ID NO: 355381 - RNA, 19 nt, Human
cacagcuguuagaaaugag

SEQ ID NO: 355382 - RNA, 19 nt, Human
caccuaaguauccaauagc

SEQ ID NO: 355383 - RNA, 24 nt, Human
caccuucuguaccaaagggcaaac

SEQ ID NO: 355384 - RNA, 18 nt, Human
cacuaacauugcaacaac

SEQ ID NO: 355385 - RNA, 18 nt, Human
cagcaaagcggggccgcg

SEQ ID NO: 355386 - RNA, 23 nt, Human
cagugaagaaaccaccuaaguau

SEQ ID NO: 355387 - RNA, 22 nt, Human
cauccuguaaggaagucggaag

SEQ ID NO: 355388 - RNA, 24 nt, Human
cauuauaauuuuccauaugcuacu

SEQ ID NO: 355389 - RNA, 22 nt, Human
cccccaaacuccagucggcagc

SEQ ID NO: 355390 - RNA, 23 nt, Human
ccggcagacagaaagcgccuucu

SEQ ID NO: 355391 - RNA, 22 nt, Human
cgcgggguccggccgcggagcu

SEQ ID NO: 355392 - RNA, 18 nt, Human
cggcagacagaaagcgcc

SEQ ID NO: 355393 - RNA, 21 nt, Human
cuagcuaaaaacagaaacuga

SEQ ID NO: 355394 - RNA, 24 nt, Human
cucaucuuucgcugucccuucgcc

SEQ ID NO: 355395 - RNA, 18 nt, Human
cucuguguaguggagagu

SEQ ID NO: 355396 - RNA, 24 nt, Human
cuuccugccacccucaucuuucgc

SEQ ID NO: 355397 - RNA, 18 nt, Human
gcaaggggcacauggccu

SEQ ID NO: 355398 - RNA, 18 nt, Human
gcugucccuucgccgagg

SEQ ID NO: 355399 - RNA, 20 nt, Human
ggcaaagaaaauauuuaaau

SEQ ID NO: 355400 - RNA, 19 nt, Human
ggccgcgggguccggccgc

SEQ ID NO: 355401 - RNA, 25 nt, Human
ggccgcgggguccggccgcggagcu

SEQ ID NO: 355402 - RNA, 22 nt, Human
uaaaacaucacuaacauugcaa

SEQ ID NO: 355403 - RNA, 21 nt, Human
uaacaagcauuauuuucccua

SEQ ID NO: 355404 - RNA, 23 nt, Human
uaaccaaaaaacaggaauccaga

SEQ ID NO: 355405 - RNA, 26 nt, Human
uaaccaaaaaacaggaauccagacau

SEQ ID NO: 355406 - RNA, 21 nt, Human
uaagaggguguugacaagaag

SEQ ID NO: 355407 - RNA, 24 nt, Human
uaagaugagugacauaccucucuu

SEQ ID NO: 355408 - RNA, 18 nt, Human
uaagcaaacaccuggaga

SEQ ID NO: 355409 - RNA, 19 nt, Human
uaagcaaacaccuggagaa

SEQ ID NO: 355410 - RNA, 25 nt, Human
uaagcaaacaccuggagaauaauau

SEQ ID NO: 355411 - RNA, 21 nt, Human
uacaaagaaaaacugaagcau

SEQ ID NO: 355412 - RNA, 18 nt, Human
uagcuaaaaacagaaacu

SEQ ID NO: 355413 - RNA, 24 nt, Human
uaggcaaagaaaauauuuaaauga

SEQ ID NO: 355414 - RNA, 21 nt, Human
uccacaauuaugaaauuuguu

SEQ ID NO: 355415 - RNA, 19 nt, Human
uccccuuucaucacaaaaa

SEQ ID NO: 355416 - RNA, 26 nt, Human
ucggaagucuccgcuuuggaaacuag

SEQ ID NO: 355417 - RNA, 20 nt, Human
ucggcagcaaagcggggccu

SEQ ID NO: 355418 - RNA, 24 nt, Human
ugaagaaaccaccuaaguauccaa

SEQ ID NO: 355419 - RNA, 24 nt, Human
ugaagagcacugcagugaguuguu

SEQ ID NO: 355420 - RNA, 22 nt, Human
ugcaacaacagauaucaaaagg

SEQ ID NO: 355421 - RNA, 21 nt, Human
ugcaagaugugucuaugaaga

SEQ ID NO: 355422 - RNA, 21 nt, Human
ugguacagacaaacucacugu

SEQ ID NO: 355423 - RNA, 23 nt, Human
uguaacaagcauuauuuucccua

SEQ ID NO: 355424 - RNA, 21 nt, Human
uucaguauugucagugaagaa

SEQ ID NO: 355425 - RNA, 18 nt, Human
uucauuccacuacuguuc

SEQ ID NO: 355426 - RNA, 22 nt, Human
uucccccaaacuccagucggca

SEQ ID NO: 355427 - RNA, 21 nt, Human
uucgcugucccuucgccgagg

SEQ ID NO: 355428 - RNA, 20 nt, Human
uucuagcuaaaaacagaaac

SEQ ID NO: 355429 - RNA, 23 nt, Human
aacauucgugaaaacacccucca

SEQ ID NO: 355430 - RNA, 24 nt, Human
acccagccgccgccgccgccgccg

SEQ ID NO: 355431 - RNA, 19 nt, Human
acucugaaaccuccgccuc

SEQ ID NO: 355432 - RNA, 22 nt, Human
agaaaacccaacccugcaugua

SEQ ID NO: 355433 - RNA, 19 nt, Human
agagggcaagcaaggcaca

SEQ ID NO: 355434 - RNA, 20 nt, Human
agccuggaaguuggggcggg

SEQ ID NO: 355435 - RNA, 19 nt, Human
agccugggcuccgugccca

SEQ ID NO: 355436 - RNA, 20 nt, Human
aggcaggggguguggcugga

SEQ ID NO: 355437 - RNA, 24 nt, Human
aggcaggggguguggcuggaggca

SEQ ID NO: 355438 - RNA, 22 nt, Human
agggaccccaggaccccugggu

SEQ ID NO: 355439 - RNA, 20 nt, Human
aucccagggaccccaggacc

SEQ ID NO: 355440 - RNA, 20 nt, Human
caaggugaggccccaccacc

SEQ ID NO: 355441 - RNA, 25 nt, Human
caccuucuacucugaaaccuccgcc

SEQ ID NO: 355442 - RNA, 27 nt, Human
caccuuucccuuacccucuccuccccu

SEQ ID NO: 355443 - RNA, 21 nt, Human
ccaccuuucccuuacccucuc

SEQ ID NO: 355444 - RNA, 22 nt, Human
ccaguagggccgggucagccug

SEQ ID NO: 355445 - RNA, 19 nt, Human
ccccaggaccccuggguca

SEQ ID NO: 355446 - RNA, 20 nt, Human
cccccggcccugacucuacc

SEQ ID NO: 355447 - RNA, 18 nt, Human
ccgccgccgccgccgccg

SEQ ID NO: 355448 - RNA, 21 nt, Human
ccgccgccgccgccgccgcgg

SEQ ID NO: 355449 - RNA, 21 nt, Human
ccggcgugcgcccccggcccu

SEQ ID NO: 355450 - RNA, 21 nt, Human
ccucagggugcccugagcccc

SEQ ID NO: 355451 - RNA, 24 nt, Human
ccucagggugcccugagccccucc

SEQ ID NO: 355452 - RNA, 24 nt, Human
ccuccgccucagggugcccugagc

SEQ ID NO: 355453 - RNA, 18 nt, Human
ccugcgcugcgggugccc

SEQ ID NO: 355454 - RNA, 21 nt, Human
ccugcgcugcgggugccccga

SEQ ID NO: 355455 - RNA, 22 nt, Human
ccuuaggccuugugccaguaac

SEQ ID NO: 355456 - RNA, 18 nt, Human
cgacagaggggagcugga

SEQ ID NO: 355457 - RNA, 23 nt, Human
cggaccagaagggggucuaugcc

SEQ ID NO: 355458 - RNA, 19 nt, Human
cuaugccgaggcugggcug

SEQ ID NO: 355459 - RNA, 18 nt, Human
cucacagcaguagcaaua

SEQ ID NO: 355460 - RNA, 24 nt, Human
cuccgccucagggugcccugagcc

SEQ ID NO: 355461 - RNA, 21 nt, Human
cuccugagagaggaagcccaa

SEQ ID NO: 355462 - RNA, 19 nt, Human
cugcgcccucuccaggguc

SEQ ID NO: 355463 - RNA, 19 nt, Human
gacucuacccagccgccgc

SEQ ID NO: 355464 - RNA, 19 nt, Human
gagaagcagaggcugagga

SEQ ID NO: 355465 - RNA, 20 nt, Human
gauaaaagggagaagcagag

SEQ ID NO: 355466 - RNA, 20 nt, Human
gauaaaagggagaagcagag

SEQ ID NO: 355467 - RNA, 21 nt, Human
gcaagcuggggaaggcagggg

SEQ ID NO: 355468 - RNA, 23 nt, Human
ggagcucugggccuuggggcagg

SEQ ID NO: 355469 - RNA, 20 nt, Human
ggauaaaagggagaagcaga

SEQ ID NO: 355470 - RNA, 21 nt, Human
ggccuuggggcagggaaaugg

SEQ ID NO: 355471 - RNA, 25 nt, Human
ggggagcucugggccuuggggcagg

SEQ ID NO: 355472 - RNA, 25 nt, Human
ggucaaaaaggacagccugggcucc

SEQ ID NO: 355473 - RNA, 22 nt, Human
ggugcccugagccccuccaccu

SEQ ID NO: 355474 - RNA, 22 nt, Human
guacaggggcgguggggagaac

SEQ ID NO: 355475 - RNA, 19 nt, Human
gugcccugagccccuccac

SEQ ID NO: 355476 - RNA, 18 nt, Human
uacccagccgccgccgcc

SEQ ID NO: 355477 - RNA, 18 nt, Human
ucacagcaguagcaauaa

SEQ ID NO: 355478 - RNA, 24 nt, Human
uccccugccuacuuucugagaccc

SEQ ID NO: 355479 - RNA, 23 nt, Human
ucccucuucaaggugaggcccca

SEQ ID NO: 355480 - RNA, 28 nt, Human
ucccucuucaaggugaggccccaccagu

SEQ ID NO: 355481 - RNA, 18 nt, Human
ucccuuacccucuccucc

SEQ ID NO: 355482 - RNA, 19 nt, Human
ucccuuacccucuccuccc

SEQ ID NO: 355483 - RNA, 21 nt, Human
ucuaugccgaggcugggcugg

SEQ ID NO: 355484 - RNA, 26 nt, Human
ucuaugccgaggcugggcugggcuug

SEQ ID NO: 355485 - RNA, 19 nt, Human
ugagccccuccaccuuucc

SEQ ID NO: 355486 - RNA, 18 nt, Human
ugaggccccaccaccgac

SEQ ID NO: 355487 - RNA, 18 nt, Human
ugcccugagccccuccac

SEQ ID NO: 355488 - RNA, 28 nt, Human
ugcgcccccggcccugacucuacccagg

SEQ ID NO: 355489 - RNA, 19 nt, Human
uggaaguuggggcggggcc

SEQ ID NO: 355490 - RNA, 19 nt, Human
uggaggcacugagacccua

SEQ ID NO: 355491 - RNA, 24 nt, Human
uggcagccugcgcugcgggugccc

SEQ ID NO: 355492 - RNA, 18 nt, Human
uguggcuggaggcacuga

SEQ ID NO: 355493 - RNA, 22 nt, Human
uguuccggcgugcgcccccggc

SEQ ID NO: 355494 - RNA, 22 nt, Human
uucacccagaugaagaagcccu

SEQ ID NO: 355495 - RNA, 20 nt, Human
aaaaaauccacacgaaugcg

SEQ ID NO: 355496 - RNA, 22 nt, Human
aaaauacaauuuaucaaagaca

SEQ ID NO: 355497 - RNA, 23 nt, Human
aaaauacaauuuaucaaagacac

SEQ ID NO: 355498 - RNA, 20 nt, Human
aaacccccccuuuccccuuu

SEQ ID NO: 355499 - RNA, 20 nt, Human
aaaccuuuauaaccagcaaa

SEQ ID NO: 355500 - RNA, 24 nt, Human
aacaguuugaauuaaaaaaugaaa

SEQ ID NO: 355501 - RNA, 19 nt, Human
aaccagcaaaaccaaaaaa

SEQ ID NO: 355502 - RNA, 23 nt, Human
aaccuacuuauucuucaacucca

SEQ ID NO: 355503 - RNA, 19 nt, Human
aagaagcauuuuguauuua

SEQ ID NO: 355504 - RNA, 21 nt, Human
aagggaauguagauguuagga

SEQ ID NO: 355505 - RNA, 22 nt, Human
aagucuaaaacuaaaucuaaug

SEQ ID NO: 355506 - RNA, 19 nt, Human
aaucuaaugcucccauuug

SEQ ID NO: 355507 - RNA, 25 nt, Human
aauucauccucccuauccuauccac

SEQ ID NO: 355508 - RNA, 29 nt, Human
acaaaaugggcaauauaauuuugccccug

SEQ ID NO: 355509 - RNA, 18 nt, Human
acaauuccaucgugcauc

SEQ ID NO: 355510 - RNA, 25 nt, Human
accacaaacacccccaacaucccag

SEQ ID NO: 355511 - RNA, 20 nt, Human
accuuuauaaccagcaaaac

SEQ ID NO: 355512 - RNA, 22 nt, Human
accuuuauaaccagcaaaacca

SEQ ID NO: 355513 - RNA, 22 nt, Human
agcaaaaccaaaaaagaggagg

SEQ ID NO: 355514 - RNA, 21 nt, Human
agcaggucacacauuaacagu

SEQ ID NO: 355515 - RNA, 21 nt, Human
agcauucuuaauccaucucuu

SEQ ID NO: 355516 - RNA, 22 nt, Human
aggaaaaaaaaaaucuuuggaa

SEQ ID NO: 355517 - RNA, 25 nt, Human
aggcaaaauguuagauacuguaauc

SEQ ID NO: 355518 - RNA, 24 nt, Human
aguuguaacuaagcacugugacaa

SEQ ID NO: 355519 - RNA, 20 nt, Human
auaaaggaaaacuguauaca

SEQ ID NO: 355520 - RNA, 24 nt, Human
caaaaaacgcaaaacacaauucca

SEQ ID NO: 355521 - RNA, 22 nt, Human
caaaaaagaggaggcaaaaugu

SEQ ID NO: 355522 - RNA, 22 nt, Human
caaaacacaauuccaucgugca

SEQ ID NO: 355523 - RNA, 22 nt, Human
caaagcaauuguagcuaaagac

SEQ ID NO: 355524 - RNA, 24 nt, Human
caaucgucaaaaauaggaaaaaaa

SEQ ID NO: 355525 - RNA, 22 nt, Human
caauugccaagguuuaaaaagc

SEQ ID NO: 355526 - RNA, 28 nt, Human
cacaauaucacagucugaagaguaugga

SEQ ID NO: 355527 - RNA, 19 nt, Human
cacaauccuuaauccaaag

SEQ ID NO: 355528 - RNA, 19 nt, Human
cacauguacaccaacagca

SEQ ID NO: 355529 - RNA, 20 nt, Human
cagcaggucacacauuaacc

SEQ ID NO: 355530 - RNA, 23 nt, Human
cagcguauuacagguuucguggu

SEQ ID NO: 355531 - RNA, 21 nt, Human
cagguaagauaaccacaaaca

SEQ ID NO: 355532 - RNA, 24 nt, Human
cagugagcccucuccaauccaaac

SEQ ID NO: 355533 - RNA, 21 nt, Human
caguucaacugauaaugccaa

SEQ ID NO: 355534 - RNA, 26 nt, Human
cauguacaccaacagcaggucacaca

SEQ ID NO: 355535 - RNA, 23 nt, Human
cauuuugucuuaaaaaaaugaaa

SEQ ID NO: 355536 - RNA, 24 nt, Human
ccaacaucccaguucacacaaacc

SEQ ID NO: 355537 - RNA, 22 nt, Human
ccagcaaaaccaaaaaagagga

SEQ ID NO: 355538 - RNA, 28 nt, Human
ccagguccucgcuuugcuccuuuuacca

SEQ ID NO: 355539 - RNA, 25 nt, Human
cccccccuuuccccuuuaaauguuu

SEQ ID NO: 355540 - RNA, 22 nt, Human
ccccccuuuccccuuuaaaugu

SEQ ID NO: 355541 - RNA, 18 nt, Human
ccuguacccacauguaca

SEQ ID NO: 355542 - RNA, 25 nt, Human
cgucaaaaauaggaaaaaaaaaauc

SEQ ID NO: 355543 - RNA, 19 nt, Human
cuccagguccucgcuuugc

SEQ ID NO: 355544 - RNA, 20 nt, Human
cucccauuugcaauuuaauu

SEQ ID NO: 355545 - RNA, 19 nt, Human
cuggggaaugaugaguuau

SEQ ID NO: 355546 - RNA, 23 nt, Human
cuucagauaugucuacagaaaga

SEQ ID NO: 355547 - RNA, 22 nt, Human
gaagggaauguagauguuagga

SEQ ID NO: 355548 - RNA, 19 nt, Human
gagcaaaauaaguugcuac

SEQ ID NO: 355549 - RNA, 25 nt, Human
gagcaaggggauauuacaagaaugc

SEQ ID NO: 355550 - RNA, 19 nt, Human
gauguuaggagcaagggga

SEQ ID NO: 355551 - RNA, 19 nt, Human
gcuacaaaaugggcaauau

SEQ ID NO: 355552 - RNA, 19 nt, Human
ggcaggaauccacuccuau

SEQ ID NO: 355553 - RNA, 21 nt, Human
gggcuccaaucgucaaaaaua

SEQ ID NO: 355554 - RNA, 22 nt, Human
gucaaaaauaggaaaaaaaaaa

SEQ ID NO: 355555 - RNA, 19 nt, Human
gugacuuacugauuuacua

SEQ ID NO: 355556 - RNA, 21 nt, Human
gugagcccucuccaauccaaa

SEQ ID NO: 355557 - RNA, 19 nt, Human
uaaaaacacccuguaccca

SEQ ID NO: 355558 - RNA, 25 nt, Human
uaaacaaacccccccuuuccccuuu

SEQ ID NO: 355559 - RNA, 20 nt, Human
uaacaguuguaacuaagcac

SEQ ID NO: 355560 - RNA, 23 nt, Human
uaaccacaaacacccccaacauc

SEQ ID NO: 355561 - RNA, 18 nt, Human
uaagauaaccacaaacac

SEQ ID NO: 355562 - RNA, 19 nt, Human
uaagauaaccacaaacacc

SEQ ID NO: 355563 - RNA, 20 nt, Human
uaauucauccucccuauccu

SEQ ID NO: 355564 - RNA, 21 nt, Human
uacagguuucgugguugcaag

SEQ ID NO: 355565 - RNA, 22 nt, Human
uaccaaaaaacgcaaaacacaa

SEQ ID NO: 355566 - RNA, 23 nt, Human
uaccaaaaaacgcaaaacacaau

SEQ ID NO: 355567 - RNA, 20 nt, Human
uacccacauguacaccaaca

SEQ ID NO: 355568 - RNA, 19 nt, Human
uagcuaaagacaacugaau

SEQ ID NO: 355569 - RNA, 25 nt, Human
uaucaaauuccccaaaacaaguuuc

SEQ ID NO: 355570 - RNA, 22 nt, Human
ucagauaaauuuuagaaacuua

SEQ ID NO: 355571 - RNA, 24 nt, Human
uccaaagcauucuuaauccaucuc

SEQ ID NO: 355572 - RNA, 20 nt, Human
ucccgcuccaugaauccugg

SEQ ID NO: 355573 - RNA, 22 nt, Human
uccucgcuuugcuccuuuuacc

SEQ ID NO: 355574 - RNA, 25 nt, Human
ucgcuuugcuccuuuuaccaaaaaa

SEQ ID NO: 355575 - RNA, 23 nt, Human
ugaaaagcaagauaaacauaaga

SEQ ID NO: 355576 - RNA, 23 nt, Human
ugacaaauuagccaguucuuccc

SEQ ID NO: 355577 - RNA, 25 nt, Human
ugccaagguuuaaaaagcaaagcaa

SEQ ID NO: 355578 - RNA, 23 nt, Human
uggaacucuauauuuugcuuuca

SEQ ID NO: 355579 - RNA, 18 nt, Human
uggauuuaaaaacacccu

SEQ ID NO: 355580 - RNA, 23 nt, Human
uuaaaaacacccuguacccacau

SEQ ID NO: 355581 - RNA, 20 nt, Human
uuaaaaguauucccaacuag

SEQ ID NO: 355582 - RNA, 23 nt, Human
uuaaggaaaauguauauaaucau

SEQ ID NO: 355583 - RNA, 24 nt, Human
uuacuguacagcguauuacagguu

SEQ ID NO: 355584 - RNA, 20 nt, Human
uuccccaaaacaaguuucug

SEQ ID NO: 355585 - RNA, 31 nt, Human
uuccccagguaagauaaccacaaacaccccu

SEQ ID NO: 355586 - RNA, 23 nt, Human
uugccaagguuuaaaaagcaaag

SEQ ID NO: 355587 - RNA, 23 nt, Human
uuggagucauaccauugccucca

SEQ ID NO: 355588 - RNA, 18 nt, Human
uugguuggggcaggaauc

SEQ ID NO: 355589 - RNA, 20 nt, Human
uuuuaccaaaaaacgcaaaa

SEQ ID NO: 355590 - RNA, 25 nt, Human
uuuuuuguuuuuuaaaaaauguuua

SEQ ID NO: 355591 - RNA, 18 nt, Human
aaaggccuugccgcagaa

SEQ ID NO: 355592 - RNA, 26 nt, Human
aagucagcacuauauaacaacagggg

SEQ ID NO: 355593 - RNA, 18 nt, Human
aagugcaguugucaggca

SEQ ID NO: 355594 - RNA, 22 nt, Human
accucaaauauccaaauccaau

SEQ ID NO: 355595 - RNA, 22 nt, Human
agaaaacaggaaacagccaagc

SEQ ID NO: 355596 - RNA, 24 nt, Human
agacaaauguuacaaaauaaccuu

SEQ ID NO: 355597 - RNA, 19 nt, Human
agcacuauauaacaaaaug

SEQ ID NO: 355598 - RNA, 22 nt, Human
agucaaucucuugacagcuuua

SEQ ID NO: 355599 - RNA, 23 nt, Human
caccugaaaagucuuuauacaaa

SEQ ID NO: 355600 - RNA, 24 nt, Human
cacguuuuccuuaaaagucaggag

SEQ ID NO: 355601 - RNA, 25 nt, Human
cacuauauaacaaaaugaaauuuua

SEQ ID NO: 355602 - RNA, 18 nt, Human
cagaauauucauaagcaa

SEQ ID NO: 355603 - RNA, 22 nt, Human
cagcacuauauaacaaaaugaa

SEQ ID NO: 355604 - RNA, 20 nt, Human
caggaggccacaaauuaggu

SEQ ID NO: 355605 - RNA, 26 nt, Human
caucuuuacacaggagcaaucgggag

SEQ ID NO: 355606 - RNA, 22 nt, Human
ccgcagaacagcacggacgggc

SEQ ID NO: 355607 - RNA, 19 nt, Human
cgccucucaggcaguugcc

SEQ ID NO: 355608 - RNA, 21 nt, Human
cggagccccgcgaacuggcgc

SEQ ID NO: 355609 - RNA, 23 nt, Human
cggagccccgcgaacuggcgccg

SEQ ID NO: 355610 - RNA, 22 nt, Human
cuguuuaauuucaaacaaaaaa

SEQ ID NO: 355611 - RNA, 28 nt, Human
gacuggaagugcaguugucccgccgacg

SEQ ID NO: 355612 - RNA, 24 nt, Human
gauaugaucagauuuaccauuuuu

SEQ ID NO: 355613 - RNA, 19 nt, Human
gcaacaaaauggcacauaa

SEQ ID NO: 355614 - RNA, 18 nt, Human
gcuuccuuaacauuuucc

SEQ ID NO: 355615 - RNA, 18 nt, Human
ggcgccggcuuccucagc

SEQ ID NO: 355616 - RNA, 24 nt, Human
ggggacacugggaaaggccuugcc

SEQ ID NO: 355617 - RNA, 20 nt, Human
guccuuuuuccccaaguccu

SEQ ID NO: 355618 - RNA, 21 nt, Human
uaaccagcauuacucaacugc

SEQ ID NO: 355619 - RNA, 18 nt, Human
uaagagaagagauuagaa

SEQ ID NO: 355620 - RNA, 26 nt, Human
uaagagaagagauuagaauuguguuu

SEQ ID NO: 355621 - RNA, 25 nt, Human
uacaaaauaaccuuuucaauagcca

SEQ ID NO: 355622 - RNA, 21 nt, Human
uacaaccauuugcuuccuuaa

SEQ ID NO: 355623 - RNA, 24 nt, Human
uauaugcaaggcccgggugacugg

SEQ ID NO: 355624 - RNA, 24 nt, Human
ucugcacugcaacacgccaccuua

SEQ ID NO: 355625 - RNA, 24 nt, Human
ugaauaacagcaacaaaauggcac

SEQ ID NO: 355626 - RNA, 18 nt, Human
ugacuggaagugcaguug

SEQ ID NO: 355627 - RNA, 20 nt, Human
ugaucagauuuaccauuuuu

SEQ ID NO: 355628 - RNA, 23 nt, Human
ugcacaaaaauacauaagagaag

SEQ ID NO: 355629 - RNA, 24 nt, Human
ugcuacacaacugcgccuagugca

SEQ ID NO: 355630 - RNA, 22 nt, Human
ugggaaaggccuugccgcagaa

SEQ ID NO: 355631 - RNA, 22 nt, Human
uguguaauggcugcacacggug

SEQ ID NO: 355632 - RNA, 24 nt, Human
uucaaaaaaucaagucuuuucacc

SEQ ID NO: 355633 - RNA, 21 nt, Human
uucaauagccaguugcuuguu

SEQ ID NO: 355634 - RNA, 22 nt, Human
uuguagguuuuuaauuuuaagg

SEQ ID NO: 355635 - RNA, 20 nt, Human
uuuagaucugaagguaaaua

SEQ ID NO: 355636 - RNA, 18 nt, Human
uuuagggggaagagggaa

SEQ ID NO: 355637 - RNA, 18 nt, Human
uuuguagguuuuuaauuu

SEQ ID NO: 355638 - RNA, 18 nt, Human
uuuuccccaaguccuccg

SEQ ID NO: 355639 - RNA, 18 nt, Human
aaaaccagugcacuuaga

SEQ ID NO: 355640 - RNA, 21 nt, Human
aaacagaaaggagacuucuaa

SEQ ID NO: 355641 - RNA, 24 nt, Human
aaacugcugggaauacaggcguga

SEQ ID NO: 355642 - RNA, 24 nt, Human
aaagaugcacauuccuuuaaaccc

SEQ ID NO: 355643 - RNA, 20 nt, Human
aacaucugaguaauaugacu

SEQ ID NO: 355644 - RNA, 23 nt, Human
aacuuucuuaaugacacugaaau

SEQ ID NO: 355645 - RNA, 23 nt, Human
aagcaaaaggagagagaagggac

SEQ ID NO: 355646 - RNA, 25 nt, Human
aagcgauccucccaccucagccucc

SEQ ID NO: 355647 - RNA, 24 nt, Human
aagugaucugccugccucggccuc

SEQ ID NO: 355648 - RNA, 23 nt, Human
aaucacaguuauguaugauuuuc

SEQ ID NO: 355649 - RNA, 19 nt, Human
acacagggauuaggagcac

SEQ ID NO: 355650 - RNA, 18 nt, Human
acaggguuuugccauguu

SEQ ID NO: 355651 - RNA, 19 nt, Human
acaggguuuugccauguug

SEQ ID NO: 355652 - RNA, 23 nt, Human
accaugcccagcuaauuuuugua

SEQ ID NO: 355653 - RNA, 24 nt, Human
acccaggcuggagugcaauggcgu

SEQ ID NO: 355654 - RNA, 18 nt, Human
acucugucacccaggcug

SEQ ID NO: 355655 - RNA, 27 nt, Human
acucugucacccaggcuggagugcaau

SEQ ID NO: 355656 - RNA, 21 nt, Human
acuuucccuugaauuuugugg

SEQ ID NO: 355657 - RNA, 18 nt, Human
agacaggguuuugccaug

SEQ ID NO: 355658 - RNA, 23 nt, Human
agacaggguuuugccauguugcc

SEQ ID NO: 355659 - RNA, 21 nt, Human
agagagaaaauggucaaguua

SEQ ID NO: 355660 - RNA, 20 nt, Human
agccucaaccucccaggcuc

SEQ ID NO: 355661 - RNA, 23 nt, Human
agccucaaccucccaggcucaag

SEQ ID NO: 355662 - RNA, 23 nt, Human
agcuggucucaaacuccugaguu

SEQ ID NO: 355663 - RNA, 24 nt, Human
agguagcugggacuacaggcaugc

SEQ ID NO: 355664 - RNA, 19 nt, Human
agugcaauggcgugaucac

SEQ ID NO: 355665 - RNA, 21 nt, Human
agugcaauggcgugaucacug

SEQ ID NO: 355666 - RNA, 24 nt, Human
aucaacuuucuuaaugacacugaa

SEQ ID NO: 355667 - RNA, 18 nt, Human
auuccuuuaaacccuuua

SEQ ID NO: 355668 - RNA, 21 nt, Human
auugcacuuugcagauauccu

SEQ ID NO: 355669 - RNA, 24 nt, Human
caaaaagcuauacauuuuccagua

SEQ ID NO: 355670 - RNA, 24 nt, Human
caaacugcugggaauacaggcgug

SEQ ID NO: 355671 - RNA, 23 nt, Human
caaagccuccaaguuguaauuuc

SEQ ID NO: 355672 - RNA, 19 nt, Human
caacacagggauuaggagc

SEQ ID NO: 355673 - RNA, 22 nt, Human
caacccccaacacagucaaaaa

SEQ ID NO: 355674 - RNA, 27 nt, Human
caagcgauccucccaccucagccuccc

SEQ ID NO: 355675 - RNA, 27 nt, Human
caagcgauccucccaccucagccuccc

SEQ ID NO: 355676 - RNA, 22 nt, Human
caagugaucugccugccucggc

SEQ ID NO: 355677 - RNA, 22 nt, Human
cacagaagccucaaccucccag

SEQ ID NO: 355678 - RNA, 21 nt, Human
caccaacccccaacacaguca

SEQ ID NO: 355679 - RNA, 24 nt, Human
caccucagccucccagguagcugg

SEQ ID NO: 355680 - RNA, 23 nt, Human
cacucugucacccaggcuggagu

SEQ ID NO: 355681 - RNA, 24 nt, Human
cacucugucacccaggcuggagug

SEQ ID NO: 355682 - RNA, 21 nt, Human
cagaagccucaaccucccagg

SEQ ID NO: 355683 - RNA, 24 nt, Human
caggcgugagcuacugugcccggc

SEQ ID NO: 355684 - RNA, 18 nt, Human
caggguuuugccauguug

SEQ ID NO: 355685 - RNA, 21 nt, Human
caugaauuaauaaagacucaa

SEQ ID NO: 355686 - RNA, 24 nt, Human
cauguugcccaagcuggucucaaa

SEQ ID NO: 355687 - RNA, 24 nt, Human
ccaaacugcugggaauacaggcgu

SEQ ID NO: 355688 - RNA, 24 nt, Human
ccacacuauaacacaguccuagua

SEQ ID NO: 355689 - RNA, 22 nt, Human
ccauguugcccaagcuggucuc

SEQ ID NO: 355690 - RNA, 18 nt, Human
cccaggcucaagcgaucc

SEQ ID NO: 355691 - RNA, 23 nt, Human
cccagguagcugggacuacaggc

SEQ ID NO: 355692 - RNA, 24 nt, Human
cccagguagcugggacuacaggca

SEQ ID NO: 355693 - RNA, 25 nt, Human
ccucccaccucagccucccagguag

SEQ ID NO: 355694 - RNA, 24 nt, Human
ccucccagguagcugggacuacag

SEQ ID NO: 355695 - RNA, 21 nt, Human
ccugaguucaagugaucugcc

SEQ ID NO: 355696 - RNA, 22 nt, Human
ccugaguucaagugaucugccu

SEQ ID NO: 355697 - RNA, 23 nt, Human
ccugaguucaagugaucugccug

SEQ ID NO: 355698 - RNA, 24 nt, Human
cgcacagaagccucaaccucccag

SEQ ID NO: 355699 - RNA, 18 nt, Human
cgucuugauccucuggua

SEQ ID NO: 355700 - RNA, 21 nt, Human
cuacuuaauauaugcacuacc

SEQ ID NO: 355701 - RNA, 24 nt, Human
cuagcuacuuaauauaugcacuac

SEQ ID NO: 355702 - RNA, 25 nt, Human
cucaaagccuccaaguuguaauuuc

SEQ ID NO: 355703 - RNA, 24 nt, Human
cucaagcgauccucccaccucagc

SEQ ID NO: 355704 - RNA, 24 nt, Human
cucacucugucacccaggcuggag

SEQ ID NO: 355705 - RNA, 24 nt, Human
cucagccucccagguagcugggac

SEQ ID NO: 355706 - RNA, 25 nt, Human
cucccaggcucaagcgauccuccca

SEQ ID NO: 355707 - RNA, 18 nt, Human
gaagccucaaccucccag

SEQ ID NO: 355708 - RNA, 24 nt, Human
gacuacaggcaugcacuaccaugc

SEQ ID NO: 355709 - RNA, 20 nt, Human
gagacagggucucacucugu

SEQ ID NO: 355710 - RNA, 20 nt, Human
gaggggaaggaaggauacag

SEQ ID NO: 355711 - RNA, 26 nt, Human
gauaugaaagccugaaacagaaagga

SEQ ID NO: 355712 - RNA, 20 nt, Human
gccauguugcccaagcuggu

SEQ ID NO: 355713 - RNA, 22 nt, Human
gcccagcuaauuuuuguauuuu

SEQ ID NO: 355714 - RNA, 22 nt, Human
gcguaacaagcagcauaaccuu

SEQ ID NO: 355715 - RNA, 22 nt, Human
gcucaagcgauccucccaccuc

SEQ ID NO: 355716 - RNA, 19 nt, Human
gcuggagugcaauggcgug

SEQ ID NO: 355717 - RNA, 24 nt, Human
ggacuacaggcaugcacuaccaug

SEQ ID NO: 355718 - RNA, 18 nt, Human
ggauaugaaagccugaaa

SEQ ID NO: 355719 - RNA, 22 nt, Human
ggcuggagugcaauggcgugau

SEQ ID NO: 355720 - RNA, 18 nt, Human
guacauauacauugugga

SEQ ID NO: 355721 - RNA, 20 nt, Human
guagcugggacuacaggcau

SEQ ID NO: 355722 - RNA, 24 nt, Human
uaauagagacaggguuuugccaug

SEQ ID NO: 355723 - RNA, 22 nt, Human
uaauuaauuaacagauguuacu

SEQ ID NO: 355724 - RNA, 24 nt, Human
uaauuuuuguauuuuuaauagaga

SEQ ID NO: 355725 - RNA, 24 nt, Human
uacaggcaugcacuaccaugccca

SEQ ID NO: 355726 - RNA, 19 nt, Human
uagaaacauuuuucauggu

SEQ ID NO: 355727 - RNA, 18 nt, Human
uagagaaaaaaaaaaagg

SEQ ID NO: 355728 - RNA, 21 nt, Human
uagagaaaaaaaaaaaggaaa

SEQ ID NO: 355729 - RNA, 21 nt, Human
uagagacaggguuuugccaug

SEQ ID NO: 355730 - RNA, 22 nt, Human
uagagacaggguuuugccaugu

SEQ ID NO: 355731 - RNA, 21 nt, Human
uagcauaaaauagucugcaac

SEQ ID NO: 355732 - RNA, 24 nt, Human
uagcuacuaacaucugaguaauau

SEQ ID NO: 355733 - RNA, 19 nt, Human
uagcuacuuaauauaugca

SEQ ID NO: 355734 - RNA, 20 nt, Human
uaucuaagcaaaaggagaga

SEQ ID NO: 355735 - RNA, 20 nt, Human
ucaagugaucugccugccuc

SEQ ID NO: 355736 - RNA, 18 nt, Human
ucacccaggcuggagugc

SEQ ID NO: 355737 - RNA, 24 nt, Human
ucacucugucacccaggcuggagu

SEQ ID NO: 355738 - RNA, 21 nt, Human
ucacuggagcaaucaucgcgc

SEQ ID NO: 355739 - RNA, 24 nt, Human
ucaguuccucaaagccuccaaguu

SEQ ID NO: 355740 - RNA, 23 nt, Human
uccacacuauaacacaguccuag

SEQ ID NO: 355741 - RNA, 21 nt, Human
uccaugaauuaauaaagacuc

SEQ ID NO: 355742 - RNA, 24 nt, Human
ucccaaacugcugggaauacaggc

SEQ ID NO: 355743 - RNA, 21 nt, Human
ucccaggcucaagcgauccuc

SEQ ID NO: 355744 - RNA, 24 nt, Human
ucccagguagcugggacuacaggc

SEQ ID NO: 355745 - RNA, 18 nt, Human
uccugaguucaagugauc

SEQ ID NO: 355746 - RNA, 23 nt, Human
ucuaauuuaugcacuccauugcc

SEQ ID NO: 355747 - RNA, 30 nt, Human
ucuaugguuuggauaugaaagccugaaacc

SEQ ID NO: 355748 - RNA, 23 nt, Human
ucucaaacuccugaguucaagug

SEQ ID NO: 355749 - RNA, 22 nt, Human
ucucacucugucacccaggcug

SEQ ID NO: 355750 - RNA, 23 nt, Human
ucucacucugucacccaggcugg

SEQ ID NO: 355751 - RNA, 24 nt, Human
ucucacucugucacccaggcugga

SEQ ID NO: 355752 - RNA, 26 nt, Human
ucucacucugucacccaggcuggagu

SEQ ID NO: 355753 - RNA, 27 nt, Human
ucucacucugucacccaggcuggagug

SEQ ID NO: 355754 - RNA, 24 nt, Human
ucugucacccaggcuggagugcaa

SEQ ID NO: 355755 - RNA, 22 nt, Human
ugaaagccugaaacagaaagga

SEQ ID NO: 355756 - RNA, 24 nt, Human
ugaagaguguuucaauguuuugaa

SEQ ID NO: 355757 - RNA, 20 nt, Human
ugagaacacuuuacguccac

SEQ ID NO: 355758 - RNA, 18 nt, Human
ugaguucaagugaucugc

SEQ ID NO: 355759 - RNA, 20 nt, Human
ugaguucaagugaucugccu

SEQ ID NO: 355760 - RNA, 19 nt, Human
ugcauagcuacuaacaucu

SEQ ID NO: 355761 - RNA, 27 nt, Human
ugccauguugcccaagcuggucucaaa

SEQ ID NO: 355762 - RNA, 20 nt, Human
ugcccggccaugaucuggga

SEQ ID NO: 355763 - RNA, 19 nt, Human
ugcccuaaucaaaaagcua

SEQ ID NO: 355764 - RNA, 21 nt, Human
ugccucggccucccaaacugc

SEQ ID NO: 355765 - RNA, 24 nt, Human
ugccucggccucccaaacugcugg

SEQ ID NO: 355766 - RNA, 19 nt, Human
uggagugcaauggcgugau

SEQ ID NO: 355767 - RNA, 21 nt, Human
uggagugcaauggcgugauca

SEQ ID NO: 355768 - RNA, 25 nt, Human
uggagugcaauggcgugaucacugg

SEQ ID NO: 355769 - RNA, 20 nt, Human
uggauaugaaagccugaaac

SEQ ID NO: 355770 - RNA, 19 nt, Human
ugggaauacaggcgugagc

SEQ ID NO: 355771 - RNA, 19 nt, Human
ugggaauacaggcgugagc

SEQ ID NO: 355772 - RNA, 22 nt, Human
ugggaauacaggcgugagcuac

SEQ ID NO: 355773 - RNA, 24 nt, Human
ugggaauacaggcgugagcuacug

SEQ ID NO: 355774 - RNA, 19 nt, Human
ugggacuacaggcaugcac

SEQ ID NO: 355775 - RNA, 24 nt, Human
ugggacuacaggcaugcacuacca

SEQ ID NO: 355776 - RNA, 23 nt, Human
ugguacauguugaaauugcacuu

SEQ ID NO: 355777 - RNA, 20 nt, Human
ugucacccaggcuggagugc

SEQ ID NO: 355778 - RNA, 24 nt, Human
uuaauagagacaggguuuugccau

SEQ ID NO: 355779 - RNA, 22 nt, Human
uuaugcacuccauugcccuaau

SEQ ID NO: 355780 - RNA, 18 nt, Human
uucaagugaucugccugc

SEQ ID NO: 355781 - RNA, 21 nt, Human
uucaagugaucugccugccuc

SEQ ID NO: 355782 - RNA, 21 nt, Human
uucaagugaucugccugccuc

SEQ ID NO: 355783 - RNA, 20 nt, Human
uuuaaaaaaaaaaaaaaagu

SEQ ID NO: 355784 - RNA, 22 nt, Human
uuuacucgugauaauuuuuuuu

SEQ ID NO: 355785 - RNA, 21 nt, Human
uuuuuaauagagacaggguuu

SEQ ID NO: 355786 - RNA, 21 nt, Human
uuuuuaauagagacaggguuu

SEQ ID NO: 355787 - RNA, 20 nt, Human
uuuuuguauuuuuaauagag

SEQ ID NO: 355788 - RNA, 23 nt, Human
uuuuuguauuuuuaauagagaca

SEQ ID NO: 355789 - RNA, 27 nt, Human
uuuuuuuuuuuuggagacagggucuca

SEQ ID NO: 355790 - RNA, 24 nt, Human
uuuuuuuuuuuuuuggagacaggg

SEQ ID NO: 355791 - RNA, 20 nt, Human
aaacuugaugcagaccagua

SEQ ID NO: 355792 - RNA, 21 nt, Human
aaaugugccaaauaaaaaccc

SEQ ID NO: 355793 - RNA, 22 nt, Human
aacaauccaaauaacuuccaac

SEQ ID NO: 355794 - RNA, 23 nt, Human
aacauacuagcggucaaacuacc

SEQ ID NO: 355795 - RNA, 24 nt, Human
aacuaccgaauaaacuugaugcag

SEQ ID NO: 355796 - RNA, 29 nt, Human
aacuaccgaauaaacuugaugcagacccc

SEQ ID NO: 355797 - RNA, 22 nt, Human
aagauacuuaaaauuugaauaa

SEQ ID NO: 355798 - RNA, 19 nt, Human
aagguguuuugucccaauu

SEQ ID NO: 355799 - RNA, 22 nt, Human
aauaaaaacccacauuuucaga

SEQ ID NO: 355800 - RNA, 21 nt, Human
aaucuaacgacgaucaaacug

SEQ ID NO: 355801 - RNA, 19 nt, Human
aauucagccagucaaaauu

SEQ ID NO: 355802 - RNA, 23 nt, Human
acacaccuucacccgccaagagu

SEQ ID NO: 355803 - RNA, 21 nt, Human
accaacuucaaacggauuagc

SEQ ID NO: 355804 - RNA, 20 nt, Human
agacuuaaccaacaccuuuc

SEQ ID NO: 355805 - RNA, 25 nt, Human
agaugacucgaggggaucuggccuc

SEQ ID NO: 355806 - RNA, 24 nt, Human
agcaagcagcgcccagggcucgag

SEQ ID NO: 355807 - RNA, 21 nt, Human
agcgcccagggcucgagugac

SEQ ID NO: 355808 - RNA, 20 nt, Human
aggaagagcccggguucgcg

SEQ ID NO: 355809 - RNA, 21 nt, Human
augcucauuuagacacaucag

SEQ ID NO: 355810 - RNA, 19 nt, Human
auguagguauguaugaaua

SEQ ID NO: 355811 - RNA, 22 nt, Human
auucaacaaaauuuauauuauc

SEQ ID NO: 355812 - RNA, 24 nt, Human
caagaccauugagaguagaacucc

SEQ ID NO: 355813 - RNA, 22 nt, Human
caaguugcaauaguauccaaug

SEQ ID NO: 355814 - RNA, 24 nt, Human
cacacaccuucacccgccaagagu

SEQ ID NO: 355815 - RNA, 22 nt, Human
cagaacaauuaaagcuaaccaa

SEQ ID NO: 355816 - RNA, 25 nt, Human
cagccagucaaaauuccaaaaacaa

SEQ ID NO: 355817 - RNA, 23 nt, Human
cauacuagcggucaaacuaccga

SEQ ID NO: 355818 - RNA, 18 nt, Human
caucacaaaucccuuaua

SEQ ID NO: 355819 - RNA, 18 nt, Human
ccccaauuguaagccaaa

SEQ ID NO: 355820 - RNA, 20 nt, Human
ccuacuaacaccaacuucaa

SEQ ID NO: 355821 - RNA, 21 nt, Human
cuaccaaaaaauauuagcuac

SEQ ID NO: 355822 - RNA, 24 nt, Human
cuaguagccugaaagcugcaauua

SEQ ID NO: 355823 - RNA, 21 nt, Human
cuggaaaauuuugcaaagcug

SEQ ID NO: 355824 - RNA, 21 nt, Human
gaaagcaaagaaacaagacca

SEQ ID NO: 355825 - RNA, 22 nt, Human
gaaccagaccuagaucuucuga

SEQ ID NO: 355826 - RNA, 23 nt, Human
gaccucgacggggauuggaaaua

SEQ ID NO: 355827 - RNA, 22 nt, Human
gaggaagagcccggguucgcgu

SEQ ID NO: 355828 - RNA, 24 nt, Human
gaucauacaauaccuacuaacacc

SEQ ID NO: 355829 - RNA, 24 nt, Human
gcugcaauuaguauaaagaucauc

SEQ ID NO: 355830 - RNA, 22 nt, Human
ggagaugcugaccuugaccuuc

SEQ ID NO: 355831 - RNA, 22 nt, Human
gugaaauagaccuggaucuuga

SEQ ID NO: 355832 - RNA, 21 nt, Human
uaaaaacccacauuuucagac

SEQ ID NO: 355833 - RNA, 24 nt, Human
uaaaauuugaauaaagaaccuacu

SEQ ID NO: 355834 - RNA, 18 nt, Human
uaaagcuaaccaagugca

SEQ ID NO: 355835 - RNA, 22 nt, Human
uaaaugugccaaauaaaaaccc

SEQ ID NO: 355836 - RNA, 18 nt, Human
uaacaccaacuucaaacg

SEQ ID NO: 355837 - RNA, 19 nt, Human
uacagaacaauuaaagcua

SEQ ID NO: 355838 - RNA, 18 nt, Human
uaccaaccauaauucagc

SEQ ID NO: 355839 - RNA, 20 nt, Human
uagaaagcaaagaaacaaga

SEQ ID NO: 355840 - RNA, 22 nt, Human
uagaaagcaaagaaacaagacc

SEQ ID NO: 355841 - RNA, 21 nt, Human
uagaccgugaccuugcaaguu

SEQ ID NO: 355842 - RNA, 19 nt, Human
uagaugacucgaggggauc

SEQ ID NO: 355843 - RNA, 22 nt, Human
uagcaagcagcgcccagggccg

SEQ ID NO: 355844 - RNA, 25 nt, Human
uagcuacauggaguguugcuaaaua

SEQ ID NO: 355845 - RNA, 18 nt, Human
uagguguagaugacucga

SEQ ID NO: 355846 - RNA, 26 nt, Human
uauagaaccagaccuagaucuucuga

SEQ ID NO: 355847 - RNA, 21 nt, Human
uaugccaccuaguagccugaa

SEQ ID NO: 355848 - RNA, 18 nt, Human
uauuagcuacauggagug

SEQ ID NO: 355849 - RNA, 18 nt, Human
ucagaauaagacaaucca

SEQ ID NO: 355850 - RNA, 18 nt, Human
ucagccagucaaaauucc

SEQ ID NO: 355851 - RNA, 25 nt, Human
ucauccagaaauguuucuauuucuc

SEQ ID NO: 355852 - RNA, 21 nt, Human
uccccugcuccugcugcguga

SEQ ID NO: 355853 - RNA, 20 nt, Human
ucccuuaagauccuggccaa

SEQ ID NO: 355854 - RNA, 24 nt, Human
ucuaaaccggaggggggccggggc

SEQ ID NO: 355855 - RNA, 21 nt, Human
ucuagauguuuucuucaaucu

SEQ ID NO: 355856 - RNA, 21 nt, Human
ucugauugacaucuuuaauua

SEQ ID NO: 355857 - RNA, 19 nt, Human
ugaagaguaucugggcugg

SEQ ID NO: 355858 - RNA, 25 nt, Human
ugaauaaagaaccuacuggcuaugu

SEQ ID NO: 355859 - RNA, 18 nt, Human
ugaccagaaaacucucaa

SEQ ID NO: 355860 - RNA, 25 nt, Human
ugacgcaaaagcugacacacaccuu

SEQ ID NO: 355861 - RNA, 19 nt, Human
ugagccaggugaggcuuga

SEQ ID NO: 355862 - RNA, 23 nt, Human
ugagugaagcugaucuugaucua

SEQ ID NO: 355863 - RNA, 18 nt, Human
ugcaacagauaaauaagc

SEQ ID NO: 355864 - RNA, 21 nt, Human
ugcaacagauaaauaagccug

SEQ ID NO: 355865 - RNA, 20 nt, Human
ugcccuacuauucuuaagau

SEQ ID NO: 355866 - RNA, 18 nt, Human
ugcucggcucuuuagcaa

SEQ ID NO: 355867 - RNA, 21 nt, Human
uggaaaauuuugcaaagcugg

SEQ ID NO: 355868 - RNA, 19 nt, Human
uggccucuuaugcugauca

SEQ ID NO: 355869 - RNA, 21 nt, Human
ugguaaaagcuugaccagaaa

SEQ ID NO: 355870 - RNA, 19 nt, Human
uguaagccaaauuuacugu

SEQ ID NO: 355871 - RNA, 20 nt, Human
uuaaccaacaccuuucaauu

SEQ ID NO: 355872 - RNA, 21 nt, Human
uuaacuaauguagaaagcaaa

SEQ ID NO: 355873 - RNA, 18 nt, Human
uuagaugguugaauuauc

SEQ ID NO: 355874 - RNA, 19 nt, Human
uuaguuccugucaugcuca

SEQ ID NO: 355875 - RNA, 24 nt, Human
uuccucaaacaugcauuuuuuggu

SEQ ID NO: 355876 - RNA, 20 nt, Human
uucugagugaagcugaucuu

SEQ ID NO: 355877 - RNA, 22 nt, Human
uucuuggucgugaaauagaccu

SEQ ID NO: 355878 - RNA, 21 nt, Human
uugaccagaaaacucucaaaa

SEQ ID NO: 355879 - RNA, 24 nt, Human
uuuacagacaucacaaaucccuuu

SEQ ID NO: 355880 - RNA, 20 nt, Human
uuucaggacuugcacuucug

SEQ ID NO: 355881 - RNA, 21 nt, Human
agccuuuguguguaguaacgg

SEQ ID NO: 355882 - RNA, 21 nt, Human
aggaagccuccaucucaugcc

SEQ ID NO: 355883 - RNA, 22 nt, Human
aggcagagcugaggggaccagg

SEQ ID NO: 355884 - RNA, 25 nt, Human
aggcagugggcugcagaggcagagc

SEQ ID NO: 355885 - RNA, 21 nt, Human
aggggugggguggcugggagc

SEQ ID NO: 355886 - RNA, 21 nt, Human
caaaggccaaggcuaggagug

SEQ ID NO: 355887 - RNA, 21 nt, Human
caagacacauccuaagaccug

SEQ ID NO: 355888 - RNA, 24 nt, Human
cacagucagggcuucccugaaauc

SEQ ID NO: 355889 - RNA, 19 nt, Human
caccuggagagccugacca

SEQ ID NO: 355890 - RNA, 19 nt, Human
cacucaaaacauuucacuc

SEQ ID NO: 355891 - RNA, 20 nt, Human
cagagccuccagcugcuugg

SEQ ID NO: 355892 - RNA, 23 nt, Human
caucucacagaccaaguggaucc

SEQ ID NO: 355893 - RNA, 26 nt, Human
ccaagacacauccuaagaccuggcac

SEQ ID NO: 355894 - RNA, 22 nt, Human
ccaaguggauccuggggaugga

SEQ ID NO: 355895 - RNA, 24 nt, Human
ccacagagaccucagagugccaga

SEQ ID NO: 355896 - RNA, 19 nt, Human
ccacugggcccucugacca

SEQ ID NO: 355897 - RNA, 21 nt, Human
ccagacaggauccucccuguc

SEQ ID NO: 355898 - RNA, 18 nt, Human
cccuagaggccuuggccg

SEQ ID NO: 355899 - RNA, 18 nt, Human
ccuccaggucagggggcu

SEQ ID NO: 355900 - RNA, 19 nt, Human
ccuggggugcagugcuggg

SEQ ID NO: 355901 - RNA, 20 nt, Human
ccuucuuuucaggcuccaag

SEQ ID NO: 355902 - RNA, 21 nt, Human
cuaggaguggcugccuggggu

SEQ ID NO: 355903 - RNA, 18 nt, Human
cucaaaacauuucacucc

SEQ ID NO: 355904 - RNA, 21 nt, Human
cucugugugacuuuggaggau

SEQ ID NO: 355905 - RNA, 18 nt, Human
cuggucagugauuauggg

SEQ ID NO: 355906 - RNA, 20 nt, Human
gaccaaguggauccugggga

SEQ ID NO: 355907 - RNA, 21 nt, Human
gcagagcugaggggaccagga

SEQ ID NO: 355908 - RNA, 20 nt, Human
gcugggagcaugaacuucag

SEQ ID NO: 355909 - RNA, 21 nt, Human
ggcauccaaagacucaaagga

SEQ ID NO: 355910 - RNA, 23 nt, Human
ggcugcagaggcagagcugaggg

SEQ ID NO: 355911 - RNA, 21 nt, Human
guacaugucagucacaggguu

SEQ ID NO: 355912 - RNA, 23 nt, Human
uaaauauccccaagagucaccgg

SEQ ID NO: 355913 - RNA, 22 nt, Human
uaacacucaaaacauuucacuc

SEQ ID NO: 355914 - RNA, 19 nt, Human
uaccccaaggccucacugc

SEQ ID NO: 355915 - RNA, 21 nt, Human
uaggaguggcugccuggggug

SEQ ID NO: 355916 - RNA, 21 nt, Human
uauuaauaaaaggggaaagug

SEQ ID NO: 355917 - RNA, 19 nt, Human
ucaccggguacugugccca

SEQ ID NO: 355918 - RNA, 18 nt, Human
ucccauggccuaaaugcc

SEQ ID NO: 355919 - RNA, 22 nt, Human
uccccauuucacagaugaagau

SEQ ID NO: 355920 - RNA, 24 nt, Human
ucugcaguggggggcucuucccua

SEQ ID NO: 355921 - RNA, 20 nt, Human
ugaaggaacuggaccagaug

SEQ ID NO: 355922 - RNA, 22 nt, Human
ugaaguggggugcagauuuguu

SEQ ID NO: 355923 - RNA, 19 nt, Human
ugaccaccuggagagccug

SEQ ID NO: 355924 - RNA, 24 nt, Human
ugaccaggccugccacagagaccu

SEQ ID NO: 355925 - RNA, 18 nt, Human
ugccaaaggccaaggcua

SEQ ID NO: 355926 - RNA, 27 nt, Human
ugccacagagaccucagagugccagag

SEQ ID NO: 355927 - RNA, 20 nt, Human
ugccuccagcucuaauagcc

SEQ ID NO: 355928 - RNA, 22 nt, Human
uggcugccuggggugcagugcu

SEQ ID NO: 355929 - RNA, 21 nt, Human
uggcugggagcaugaacuuca

SEQ ID NO: 355930 - RNA, 21 nt, Human
ugggaugguuugcaaggggag

SEQ ID NO: 355931 - RNA, 20 nt, Human
ugggcugcagaggcagagcu

SEQ ID NO: 355932 - RNA, 22 nt, Human
ugggcugcagaggcagagcuga

SEQ ID NO: 355933 - RNA, 22 nt, Human
uggggcaccacugggcccucug

SEQ ID NO: 355934 - RNA, 23 nt, Human
ugggggguggugugaaugcccac

SEQ ID NO: 355935 - RNA, 19 nt, Human
uggguaaacaauacugguc

SEQ ID NO: 355936 - RNA, 23 nt, Human
ugguaugugcucggucaauagcc

SEQ ID NO: 355937 - RNA, 18 nt, Human
ugucaaggcuggucagug

SEQ ID NO: 355938 - RNA, 18 nt, Human
ugugaaugcccaccgagg

SEQ ID NO: 355939 - RNA, 19 nt, Human
uucacagaugaagauauag

SEQ ID NO: 355940 - RNA, 21 nt, Human
aaaagacccuuugcccggggc

SEQ ID NO: 355941 - RNA, 18 nt, Human
aagcagcuucuugcccgu

SEQ ID NO: 355942 - RNA, 22 nt, Human
cacucccauccucuccccaagc

SEQ ID NO: 355943 - RNA, 21 nt, Human
cccacucccauccucucccca

SEQ ID NO: 355944 - RNA, 19 nt, Human
cccauccucuccccaagcu

SEQ ID NO: 355945 - RNA, 20 nt, Human
cccauccucuccccaagcuc

SEQ ID NO: 355946 - RNA, 23 nt, Human
cccauccucuccccaagcuccca

SEQ ID NO: 355947 - RNA, 23 nt, Human
cccauuucuccagggcuuguccc

SEQ ID NO: 355948 - RNA, 22 nt, Human
ccccugggcgccaccucugccc

SEQ ID NO: 355949 - RNA, 21 nt, Human
cccugggcgccaccucugccc

SEQ ID NO: 355950 - RNA, 26 nt, Human
ccucugcccacucccauccucucccc

SEQ ID NO: 355951 - RNA, 23 nt, Human
cugacccugcucaccggaggcgu

SEQ ID NO: 355952 - RNA, 27 nt, Human
cugcccacucccauccucuccccaagc

SEQ ID NO: 355953 - RNA, 21 nt, Human
gcccacucccauccucucccc

SEQ ID NO: 355954 - RNA, 22 nt, Human
gcccacucccauccucucccca

SEQ ID NO: 355955 - RNA, 20 nt, Human
gccccugggcgccaccucug

SEQ ID NO: 355956 - RNA, 21 nt, Human
ggcagaagcagcuucuugccc

SEQ ID NO: 355957 - RNA, 19 nt, Human
ucccauccucuccccaagc

SEQ ID NO: 355958 - RNA, 18 nt, Human
ucccauuucuccagggcu

SEQ ID NO: 355959 - RNA, 24 nt, Human
ucccauuucuccagggcuuguccc

SEQ ID NO: 355960 - RNA, 25 nt, Human
uccccaagcucccauuucuccaggg

SEQ ID NO: 355961 - RNA, 21 nt, Human
ucccgggccccugggcgccac

SEQ ID NO: 355962 - RNA, 19 nt, Human
ucccugcggugugggcaga

SEQ ID NO: 355963 - RNA, 22 nt, Human
ucccugcggugugggcagaagc

SEQ ID NO: 355964 - RNA, 23 nt, Human
ucugcaaaagcugcaaaagaccc

SEQ ID NO: 355965 - RNA, 21 nt, Human
ugcaaaagcugcaaaagaccc

SEQ ID NO: 355966 - RNA, 18 nt, Human
ugcccgucugcaaaagcu

SEQ ID NO: 355967 - RNA, 19 nt, Human
uaggccccaggagcuccaa

SEQ ID NO: 355968 - RNA, 19 nt, Human
ucuuuuuguuaggccccag

SEQ ID NO: 355969 - RNA, 18 nt, Human
ugacuucuggccaaacuc

SEQ ID NO: 355970 - RNA, 19 nt, Human
ugccccacccaccccaguu

SEQ ID NO: 355971 - RNA, 21 nt, Human
ugggccaagcacugccccacc

SEQ ID NO: 355972 - RNA, 21 nt, Human
uugacuucuggccaaacuccu

SEQ ID NO: 355973 - RNA, 23 nt, Human
uuuuuuuuuuuuuuuuuuuaugg

SEQ ID NO: 355974 - RNA, 23 nt, Human
acacacucucaccccaccccacc

SEQ ID NO: 355975 - RNA, 23 nt, Human
accccaccccacccccucucccu

SEQ ID NO: 355976 - RNA, 18 nt, Human
acucucaccccaccccac

SEQ ID NO: 355977 - RNA, 23 nt, Human
agaagggaggaugaagucagggc

SEQ ID NO: 355978 - RNA, 20 nt, Human
agagaagggaggaugaaguc

SEQ ID NO: 355979 - RNA, 19 nt, Human
agggaggaugaagucaggg

SEQ ID NO: 355980 - RNA, 20 nt, Human
agggaggaugaagucagggc

SEQ ID NO: 355981 - RNA, 23 nt, Human
agggaggaugaagucagggcugg

SEQ ID NO: 355982 - RNA, 23 nt, Human
agggccaggagcuggaaucagca

SEQ ID NO: 355983 - RNA, 25 nt, Human
caccccacccccucucccugcuugu

SEQ ID NO: 355984 - RNA, 18 nt, Human
cacccccucucccugcuu

SEQ ID NO: 355985 - RNA, 23 nt, Human
cccaccccacccccucucccugc

SEQ ID NO: 355986 - RNA, 19 nt, Human
ccccaccccacccccucuc

SEQ ID NO: 355987 - RNA, 21 nt, Human
ccccaccccacccccucuccc

SEQ ID NO: 355988 - RNA, 23 nt, Human
ccccaccccacccccucucccug

SEQ ID NO: 355989 - RNA, 20 nt, Human
cucaccccaccccacccccu

SEQ ID NO: 355990 - RNA, 21 nt, Human
cucaccccaccccacccccuc

SEQ ID NO: 355991 - RNA, 19 nt, Human
cucucccugcuuguuuaga

SEQ ID NO: 355992 - RNA, 19 nt, Human
gagaggcugccagcagcaa

SEQ ID NO: 355993 - RNA, 20 nt, Human
gggagaggcugccagcagca

SEQ ID NO: 355994 - RNA, 22 nt, Human
uacuccacacacucucacccca

SEQ ID NO: 355995 - RNA, 23 nt, Human
uccacacacucucaccccacccc

SEQ ID NO: 355996 - RNA, 23 nt, Human
ucccugcuuguuuagagccuggg

SEQ ID NO: 355997 - RNA, 18 nt, Human
ucucaccccaccccaccc

SEQ ID NO: 355998 - RNA, 24 nt, Human
ucucaccccaccccacccccucuc

SEQ ID NO: 355999 - RNA, 25 nt, Human
ugccagcagcaauuggugagcagag

SEQ ID NO: 356000 - RNA, 19 nt, Human
ugguguggacagagaaggg

SEQ ID NO: 356001 - RNA, 22 nt, Human
uuagagccuggguuccaggagg

SEQ ID NO: 356002 - RNA, 21 nt, Human
aaacaaaacagauaugcuuac

SEQ ID NO: 356003 - RNA, 20 nt, Human
aaacagcugcuucagaccuu

SEQ ID NO: 356004 - RNA, 24 nt, Human
aaacagcugcuucagaccuuuaac

SEQ ID NO: 356005 - RNA, 23 nt, Human
aaaguucuuuaaugacuucacuu

SEQ ID NO: 356006 - RNA, 19 nt, Human
aacauucuuuuacaaaaua

SEQ ID NO: 356007 - RNA, 23 nt, Human
aagaagaugagaaucaaacaaaa

SEQ ID NO: 356008 - RNA, 21 nt, Human
aaggaaccauuguuucuaucu

SEQ ID NO: 356009 - RNA, 18 nt, Human
agaagcuaaaaggcagag

SEQ ID NO: 356010 - RNA, 22 nt, Human
agauauaaacauguuggugacc

SEQ ID NO: 356011 - RNA, 23 nt, Human
agaugaacaaagguuaauuuaaa

SEQ ID NO: 356012 - RNA, 23 nt, Human
cagagcaugaaacgcugaugcca

SEQ ID NO: 356013 - RNA, 21 nt, Human
caggguuguggugagaauugg

SEQ ID NO: 356014 - RNA, 22 nt, Human
ccaacucugcuacuuacuauau

SEQ ID NO: 356015 - RNA, 19 nt, Human
cccgcgcccgccgccgccg

SEQ ID NO: 356016 - RNA, 19 nt, Human
ccgccgagcuccccgcccc

SEQ ID NO: 356017 - RNA, 20 nt, Human
ccgccgagcuccccgcccga

SEQ ID NO: 356018 - RNA, 22 nt, Human
ccgccgagcuccccgcccgacu

SEQ ID NO: 356019 - RNA, 19 nt, Human
ccgccgccgagcuccccgc

SEQ ID NO: 356020 - RNA, 25 nt, Human
ccgcgcccgccgccgccgagcuccc

SEQ ID NO: 356021 - RNA, 19 nt, Human
cuaaacagcugcuucagac

SEQ ID NO: 356022 - RNA, 18 nt, Human
cuagaaaucugcaucuuu

SEQ ID NO: 356023 - RNA, 22 nt, Human
cucugagaagauuuuaacuaug

SEQ ID NO: 356024 - RNA, 21 nt, Human
cuuaacuucucugaucuucag

SEQ ID NO: 356025 - RNA, 23 nt, Human
guuaaaaaaaaaaaaaaaggaau

SEQ ID NO: 356026 - RNA, 23 nt, Human
uaaaaaagucaagucaagauaua

SEQ ID NO: 356027 - RNA, 19 nt, Human
uacaaaauauuuucuuccc

SEQ ID NO: 356028 - RNA, 21 nt, Human
uagaagaugcucaauaaagau

SEQ ID NO: 356029 - RNA, 22 nt, Human
uagaagcuaaaaggcagagcau

SEQ ID NO: 356030 - RNA, 22 nt, Human
uagagaacaguaaauaugaaga

SEQ ID NO: 356031 - RNA, 26 nt, Human
uaucauuauuauuuaaaaguuaaagc

SEQ ID NO: 356032 - RNA, 18 nt, Human
ucaagucaagauauaaac

SEQ ID NO: 356033 - RNA, 22 nt, Human
uccaaaugccauguuguuuuca

SEQ ID NO: 356034 - RNA, 20 nt, Human
ucccgcgcccgccgccgccg

SEQ ID NO: 356035 - RNA, 21 nt, Human
ucccgcgcccgccgccgccga

SEQ ID NO: 356036 - RNA, 26 nt, Human
ucuaguuaaaaaaaaaaaaaaaggaa

SEQ ID NO: 356037 - RNA, 23 nt, Human
ugagaagauuuuaacuauguaga

SEQ ID NO: 356038 - RNA, 19 nt, Human
ugauguugagcaaguuucu

SEQ ID NO: 356039 - RNA, 20 nt, Human
ugcaaaacuaaggaaccauu

SEQ ID NO: 356040 - RNA, 24 nt, Human
uuaaagcugagaugguguuuuaau

SEQ ID NO: 356041 - RNA, 21 nt, Human
uuguuucuaucucacauaugu

SEQ ID NO: 356042 - RNA, 20 nt, Human
aaccggccgaugaaaaccgc

SEQ ID NO: 356043 - RNA, 23 nt, Human
aagccaaaaaaggccuuuaugcu

SEQ ID NO: 356044 - RNA, 23 nt, Human
acacacacguacacauacacaca

SEQ ID NO: 356045 - RNA, 23 nt, Human
acgcacacacacguacacauaca

SEQ ID NO: 356046 - RNA, 18 nt, Human
agccagugucuaaagcca

SEQ ID NO: 356047 - RNA, 23 nt, Human
agcuggcagccagugucuaaagc

SEQ ID NO: 356048 - RNA, 22 nt, Human
caacaauguccacuauggauag

SEQ ID NO: 356049 - RNA, 19 nt, Human
cacucaacacucccggcag

SEQ ID NO: 356050 - RNA, 25 nt, Human
cguacacauacacacaaggucuuug

SEQ ID NO: 356051 - RNA, 20 nt, Human
cuaaagccaaaaaaggccuu

SEQ ID NO: 356052 - RNA, 25 nt, Human
gcacgcacacacacguacacauaca

SEQ ID NO: 356053 - RNA, 25 nt, Human
gcacgcacacacacguacacauagu

SEQ ID NO: 356054 - RNA, 29 nt, Human
gcgaacacacucaagcacgcacacacagg

SEQ ID NO: 356055 - RNA, 20 nt, Human
uauauccacccacacacgcg

SEQ ID NO: 356056 - RNA, 22 nt, Human
ucccggcaguaaugucucucuc

SEQ ID NO: 356057 - RNA, 24 nt, Human
ucccggcaguaaugucucucucuu

SEQ ID NO: 356058 - RNA, 20 nt, Human
ucucucuuguccguuucaca

SEQ ID NO: 356059 - RNA, 20 nt, Human
ucucuuguccguuucacaaa

SEQ ID NO: 356060 - RNA, 22 nt, Human
ugucucucucuuguccguuuca

SEQ ID NO: 356061 - RNA, 23 nt, Human
uugauaggcuuucuguguucuag

SEQ ID NO: 356062 - RNA, 19 nt, Human
uuuauauccacccacacac

SEQ ID NO: 356063 - RNA, 18 nt, Human
uuuuuuuuuuuuuuuuug

SEQ ID NO: 356064 - RNA, 24 nt, Human
uuuuuuuuuuuuuuuuugauacag

SEQ ID NO: 356065 - RNA, 18 nt, Human
aagagaaaagaaauguga

SEQ ID NO: 356066 - RNA, 18 nt, Human
caaaaaugcuuuaaguac

SEQ ID NO: 356067 - RNA, 20 nt, Human
ccccucccuuucuucuuccc

SEQ ID NO: 356068 - RNA, 18 nt, Human
cccucccuuucuucuucc

SEQ ID NO: 356069 - RNA, 19 nt, Human
ccuccccucccuuucuucu

SEQ ID NO: 356070 - RNA, 19 nt, Human
ggccuggcuaggccguccg

SEQ ID NO: 356071 - RNA, 21 nt, Human
ucauugcuucagucaguuuuc

SEQ ID NO: 356072 - RNA, 24 nt, Human
ucuccccuccccucccuuucuucu

SEQ ID NO: 356073 - RNA, 18 nt, Human
ugcauaacauaugccaga

SEQ ID NO: 356074 - RNA, 23 nt, Human
uggaagagaaaagaaaugugaug

SEQ ID NO: 356075 - RNA, 22 nt, Human
uguaacugcuauauugucugau

SEQ ID NO: 356076 - RNA, 19 nt, Human
ugucugauuauaaauucau

SEQ ID NO: 356077 - RNA, 19 nt, Human
aagcguuuacuucccaucc

SEQ ID NO: 356078 - RNA, 19 nt, Human
aggaaaugcuguauagaac

SEQ ID NO: 356079 - RNA, 19 nt, Human
cacacggcaacucaacacu

SEQ ID NO: 356080 - RNA, 21 nt, Human
cauccacgcugccucagucuu

SEQ ID NO: 356081 - RNA, 18 nt, Human
cauuuuaguacugagcaa

SEQ ID NO: 356082 - RNA, 23 nt, Human
ccacacggacaagauagggggag

SEQ ID NO: 356083 - RNA, 18 nt, Human
cccauccacgcugccuca

SEQ ID NO: 356084 - RNA, 18 nt, Human
cccuucaaaacuugaaaa

SEQ ID NO: 356085 - RNA, 23 nt, Human
ccuuuaacuacaucuugaaaacc

SEQ ID NO: 356086 - RNA, 20 nt, Human
cucaacacucagugugugcc

SEQ ID NO: 356087 - RNA, 23 nt, Human
cuccacacggcaacucaacacuc

SEQ ID NO: 356088 - RNA, 20 nt, Human
cuuucacgaugugcagcugc

SEQ ID NO: 356089 - RNA, 22 nt, Human
cuuuugugucucacauccacgu

SEQ ID NO: 356090 - RNA, 18 nt, Human
gaacuacagcuggcccga

SEQ ID NO: 356091 - RNA, 21 nt, Human
gacuauauacagaaaguuuaa

SEQ ID NO: 356092 - RNA, 19 nt, Human
gcagcugcucccugggugu

SEQ ID NO: 356093 - RNA, 22 nt, Human
gcugccucagucuuucacgauu

SEQ ID NO: 356094 - RNA, 26 nt, Human
gugauuuauuccuuuaacuacaucuu

SEQ ID NO: 356095 - RNA, 23 nt, Human
guuuacuucccauccacgcugcc

SEQ ID NO: 356096 - RNA, 19 nt, Human
uaagaaaagcacacuggcg

SEQ ID NO: 356097 - RNA, 21 nt, Human
uaccacagacagaauguuuca

SEQ ID NO: 356098 - RNA, 23 nt, Human
uagaacuuuggggcauuuuagua

SEQ ID NO: 356099 - RNA, 21 nt, Human
ucccugggugugaggaucugg

SEQ ID NO: 356100 - RNA, 22 nt, Human
ucccugggugugaggaucuggg

SEQ ID NO: 356101 - RNA, 19 nt, Human
ucuaccacagacagaaugu

SEQ ID NO: 356102 - RNA, 26 nt, Human
ucuaccacagacagaauguuucaaac

SEQ ID NO: 356103 - RNA, 24 nt, Human
ugaaaauuaauccaguggaaaaac

SEQ ID NO: 356104 - RNA, 23 nt, Human
ugagagcaaaggaugaagcuuca

SEQ ID NO: 356105 - RNA, 19 nt, Human
ugaggaucuggggccggca

SEQ ID NO: 356106 - RNA, 20 nt, Human
uggcccgagcucuaccacag

SEQ ID NO: 356107 - RNA, 23 nt, Human
uggcccgagcucuaccacagaca

SEQ ID NO: 356108 - RNA, 19 nt, Human
uucccauccacgcugccuc

SEQ ID NO: 356109 - RNA, 25 nt, Human
uugaaaauuuucuugugaaaccuga

SEQ ID NO: 356110 - RNA, 20 nt, Human
uuuuauugcuuauugacuau

SEQ ID NO: 356111 - RNA, 24 nt, Human
uuuuuaacucugaaaaaugagguu

SEQ ID NO: 356112 - RNA, 18 nt, Human
aaaauccuuuaaaaccaa

SEQ ID NO: 356113 - RNA, 21 nt, Human
aaaauccuuuaaaaccaagcc

SEQ ID NO: 356114 - RNA, 23 nt, Human
aauccuuuaaaaccaagcccuaa

SEQ ID NO: 356115 - RNA, 19 nt, Human
aaugcaaaaaaaaaaacau

SEQ ID NO: 356116 - RNA, 21 nt, Human
aaugcccauuuuacaggugac

SEQ ID NO: 356117 - RNA, 19 nt, Human
acacagcauauccacaagg

SEQ ID NO: 356118 - RNA, 29 nt, Human
acucacacgacgguucacacagcauaucc

SEQ ID NO: 356119 - RNA, 18 nt, Human
aggcauaccacacucaca

SEQ ID NO: 356120 - RNA, 21 nt, Human
aucacagcccagacagaucug

SEQ ID NO: 356121 - RNA, 21 nt, Human
augagcucacugaggagaaug

SEQ ID NO: 356122 - RNA, 23 nt, Human
caauaagauugcuaagcuuccag

SEQ ID NO: 356123 - RNA, 25 nt, Human
caaugaaaaacaccaacggcucuga

SEQ ID NO: 356124 - RNA, 23 nt, Human
cacacaaaaaaaguugugugaug

SEQ ID NO: 356125 - RNA, 18 nt, Human
cacacucacacgacgguu

SEQ ID NO: 356126 - RNA, 25 nt, Human
cacauaaaauccuuuaaaaccaagc

SEQ ID NO: 356127 - RNA, 20 nt, Human
caggaaugcaaaaaaaaaaa

SEQ ID NO: 356128 - RNA, 26 nt, Human
ccacacucacacgacgguucacacag

SEQ ID NO: 356129 - RNA, 19 nt, Human
ccuuuaaaaccaagcccua

SEQ ID NO: 356130 - RNA, 22 nt, Human
gaaaaacaccaacggcucugac

SEQ ID NO: 356131 - RNA, 22 nt, Human
gaaaaccucaugagcucacuga

SEQ ID NO: 356132 - RNA, 18 nt, Human
gaagaaacaaacaauguc

SEQ ID NO: 356133 - RNA, 25 nt, Human
gcaaugcuuucuuuaggcaucugaa

SEQ ID NO: 356134 - RNA, 18 nt, Human
ggaaaagcuuuggagcua

SEQ ID NO: 356135 - RNA, 22 nt, Human
gggcauugguccauaaaaaccc

SEQ ID NO: 356136 - RNA, 19 nt, Human
gucagcuggcggcuccacc

SEQ ID NO: 356137 - RNA, 19 nt, Human
guccgcuuucuaacgaaac

SEQ ID NO: 356138 - RNA, 20 nt, Human
gugaugggaugagggaagga

SEQ ID NO: 356139 - RNA, 19 nt, Human
uaaaaccaagcccuaacag

SEQ ID NO: 356140 - RNA, 19 nt, Human
uaaacaaugaaaaacacca

SEQ ID NO: 356141 - RNA, 18 nt, Human
uaacaaaauccaucugug

SEQ ID NO: 356142 - RNA, 22 nt, Human
uaaccguaucuuacaaaaaagu

SEQ ID NO: 356143 - RNA, 27 nt, Human
uaccacacucacacgacgguucacaca

SEQ ID NO: 356144 - RNA, 20 nt, Human
uaggaaaagcuuuggagcua

SEQ ID NO: 356145 - RNA, 21 nt, Human
uaggaaaagcuuuggagcuaa

SEQ ID NO: 356146 - RNA, 21 nt, Human
uauacaauacauacaauuauc

SEQ ID NO: 356147 - RNA, 18 nt, Human
uaucuuccaaauauggaa

SEQ ID NO: 356148 - RNA, 23 nt, Human
ucauaauauucgucaucacagcc

SEQ ID NO: 356149 - RNA, 23 nt, Human
ugaaaaacaccaacggcucugac

SEQ ID NO: 356150 - RNA, 20 nt, Human
ugaggagaaugugcucuuca

SEQ ID NO: 356151 - RNA, 19 nt, Human
ugagggaaggauuguacgu

SEQ ID NO: 356152 - RNA, 21 nt, Human
ugaugggaugagggaaggauu

SEQ ID NO: 356153 - RNA, 20 nt, Human
uggaagaaacaaacaauguc

SEQ ID NO: 356154 - RNA, 24 nt, Human
uggaagaaacaaacaaugucccac

SEQ ID NO: 356155 - RNA, 21 nt, Human
uggggcauugguccauaaaaa

SEQ ID NO: 356156 - RNA, 22 nt, Human
uggggcauugguccauaaaaac

SEQ ID NO: 356157 - RNA, 20 nt, Human
ugugaucaggcauaccacac

SEQ ID NO: 356158 - RNA, 23 nt, Human
ugugaugggaugagggaaggauu

SEQ ID NO: 356159 - RNA, 19 nt, Human
uuaaacaaugaaaaacacc

SEQ ID NO: 356160 - RNA, 19 nt, Human
uucuuuaggcaucugaaua

SEQ ID NO: 356161 - RNA, 21 nt, Human
uuuguagcagcaaugcuuucu

SEQ ID NO: 356162 - RNA, 25 nt, Human
uuuuuuuuuuuuuuauuuuucaagg

SEQ ID NO: 356163 - RNA, 25 nt, Human
uuuuuuuuuuuuuuuuuuuauuuuu

SEQ ID NO: 356164 - RNA, 21 nt, Human
aaaauaguacaaccucagaca

SEQ ID NO: 356165 - RNA, 18 nt, Human
aacccaagaaacaaaaaa

SEQ ID NO: 356166 - RNA, 20 nt, Human
acauaagccaugcugaggcc

SEQ ID NO: 356167 - RNA, 21 nt, Human
acccaagaaacaaaaaagcuc

SEQ ID NO: 356168 - RNA, 21 nt, Human
agacaccauuuuaaacugcaa

SEQ ID NO: 356169 - RNA, 23 nt, Human
caaaaagcagaaucaucggugug

SEQ ID NO: 356170 - RNA, 25 nt, Human
caagugaaaugugucagcuccuccu

SEQ ID NO: 356171 - RNA, 18 nt, Human
cacgugcacauaagccau

SEQ ID NO: 356172 - RNA, 24 nt, Human
cauuuuaaaaacccaagaaacaaa

SEQ ID NO: 356173 - RNA, 21 nt, Human
cgaggggcagcccgaggagcg

SEQ ID NO: 356174 - RNA, 21 nt, Human
cuccuccucuugaguacagcc

SEQ ID NO: 356175 - RNA, 27 nt, Human
cuuuuuauuguugacauucacauuuua

SEQ ID NO: 356176 - RNA, 21 nt, Human
gaagacaauacacuaucuaca

SEQ ID NO: 356177 - RNA, 20 nt, Human
gaggggcagcccgaggagcg

SEQ ID NO: 356178 - RNA, 27 nt, Human
guacaaccucagacaccauuuuaaacu

SEQ ID NO: 356179 - RNA, 18 nt, Human
gugaaaugugucagcucc

SEQ ID NO: 356180 - RNA, 19 nt, Human
guuuucgucuagcaucuuc

SEQ ID NO: 356181 - RNA, 22 nt, Human
uaaaaacccaagaaacaaaaaa

SEQ ID NO: 356182 - RNA, 18 nt, Human
uaacagguaauguggguu

SEQ ID NO: 356183 - RNA, 22 nt, Human
uagcaaaaagcagaaucaucgg

SEQ ID NO: 356184 - RNA, 19 nt, Human
uauaacaaugcccaagggc

SEQ ID NO: 356185 - RNA, 19 nt, Human
ugaaaugugucagcuccuc

SEQ ID NO: 356186 - RNA, 27 nt, Human
uggccaaaauaguacaaccucagacac

SEQ ID NO: 356187 - RNA, 25 nt, Human
uuauucuaauuuagcaaaaagcaga

SEQ ID NO: 356188 - RNA, 23 nt, Human
uuggccaaaauaguacaaccuca

SEQ ID NO: 356189 - RNA, 18 nt, Human
uuuagcaaaaagcagaau

SEQ ID NO: 356190 - RNA, 21 nt, Human
aaaaaccacaaaaggaagaua

SEQ ID NO: 356191 - RNA, 24 nt, Human
accacaaaaggaagauaagaggaa

SEQ ID NO: 356192 - RNA, 24 nt, Human
agaacaagaauccugaggcucaag

SEQ ID NO: 356193 - RNA, 19 nt, Human
aggaagaacaagaauccug

SEQ ID NO: 356194 - RNA, 24 nt, Human
auggagcaagaccagaugucaaag

SEQ ID NO: 356195 - RNA, 19 nt, Human
cagccuccucuccgcgcuc

SEQ ID NO: 356196 - RNA, 23 nt, Human
uccauaucccaagaaccuucuga

SEQ ID NO: 356197 - RNA, 22 nt, Human
uccugaggcucaagcugucuca

SEQ ID NO: 356198 - RNA, 25 nt, Human
ucuccgcgcuccccuuuuucagacu

SEQ ID NO: 356199 - RNA, 19 nt, Human
uggagcaagaccagauguc

SEQ ID NO: 356200 - RNA, 21 nt, Human
aaacacucaagugaccgagcu

SEQ ID NO: 356201 - RNA, 18 nt, Human
aaacauccaggacagaag

SEQ ID NO: 356202 - RNA, 18 nt, Human
aaaccugccacuucucug

SEQ ID NO: 356203 - RNA, 21 nt, Human
aagcuucccuggggggccccg

SEQ ID NO: 356204 - RNA, 22 nt, Human
aagcuucccuggggggccccgg

SEQ ID NO: 356205 - RNA, 24 nt, Human
acaacgccuauuuauuccccacac

SEQ ID NO: 356206 - RNA, 18 nt, Human
acaccgggagcaggcagc

SEQ ID NO: 356207 - RNA, 18 nt, Human
acauggcccgcggugccc

SEQ ID NO: 356208 - RNA, 22 nt, Human
accccaggauucuagaaaacac

SEQ ID NO: 356209 - RNA, 22 nt, Human
acgcccugcaccccgggugggc

SEQ ID NO: 356210 - RNA, 21 nt, Human
acugcgccuaccucacagacg

SEQ ID NO: 356211 - RNA, 18 nt, Human
agaaaaugagggugggag

SEQ ID NO: 356212 - RNA, 22 nt, Human
agacggccaggagccagggagc

SEQ ID NO: 356213 - RNA, 21 nt, Human
agagauaaaaggggaaaaucc

SEQ ID NO: 356214 - RNA, 22 nt, Human
aggaaguggcagacaaccagaa

SEQ ID NO: 356215 - RNA, 22 nt, Human
aggaugcuccgacugacaaccc

SEQ ID NO: 356216 - RNA, 20 nt, Human
aggcugccugcuguccggcc

SEQ ID NO: 356217 - RNA, 26 nt, Human
aggcuuuggaagccacacgauccgcc

SEQ ID NO: 356218 - RNA, 19 nt, Human
agggaguuacaaaaaggga

SEQ ID NO: 356219 - RNA, 21 nt, Human
caaacacacauggcccgcggu

SEQ ID NO: 356220 - RNA, 22 nt, Human
caacaugcccaacuggagaaaa

SEQ ID NO: 356221 - RNA, 22 nt, Human
caagguggguggcaccugaggu

SEQ ID NO: 356222 - RNA, 21 nt, Human
caagugaccgagcuuucuggg

SEQ ID NO: 356223 - RNA, 20 nt, Human
cacacauggcccgcggugcc

SEQ ID NO: 356224 - RNA, 19 nt, Human
cacacggcugaacgugaaa

SEQ ID NO: 356225 - RNA, 24 nt, Human
cagaagaggugauaccucucaggc

SEQ ID NO: 356226 - RNA, 19 nt, Human
cagcaggaugggacacaga

SEQ ID NO: 356227 - RNA, 23 nt, Human
caggacggcuccugagccgcgga

SEQ ID NO: 356228 - RNA, 23 nt, Human
ccacacgucacgcccugcacccc

SEQ ID NO: 356229 - RNA, 20 nt, Human
ccacccagcacaggaggggu

SEQ ID NO: 356230 - RNA, 18 nt, Human
cccagaagaggugauacc

SEQ ID NO: 356231 - RNA, 23 nt, Human
cccagcugccuucccugugcccg

SEQ ID NO: 356232 - RNA, 19 nt, Human
ccccaggccucaggaaccc

SEQ ID NO: 356233 - RNA, 22 nt, Human
cccccaggccucaggaacccag

SEQ ID NO: 356234 - RNA, 20 nt, Human
cccggccccggccccagggc

SEQ ID NO: 356235 - RNA, 23 nt, Human
cccggggcuaaggcggccgggac

SEQ ID NO: 356236 - RNA, 21 nt, Human
ccgcagccgucucuuaggugu

SEQ ID NO: 356237 - RNA, 21 nt, Human
ccgggcccaugaaacauccag

SEQ ID NO: 356238 - RNA, 23 nt, Human
ccgugggcucgucugccaccccc

SEQ ID NO: 356239 - RNA, 24 nt, Human
ccucacagacggccaggagccagg

SEQ ID NO: 356240 - RNA, 23 nt, Human
cggccaggagccagggagcccca

SEQ ID NO: 356241 - RNA, 21 nt, Human
cgggucggccagggaaggacg

SEQ ID NO: 356242 - RNA, 25 nt, Human
cgucacgcccugcaccccggguggg

SEQ ID NO: 356243 - RNA, 20 nt, Human
cucuccggcugcuuuccugg

SEQ ID NO: 356244 - RNA, 18 nt, Human
cugggggcuguaagggag

SEQ ID NO: 356245 - RNA, 26 nt, Human
gagcaccccaggauucuagaaaacac

SEQ ID NO: 356246 - RNA, 21 nt, Human
gagcccagaagaggugauacc

SEQ ID NO: 356247 - RNA, 19 nt, Human
gaggggaaacaugucuguc

SEQ ID NO: 356248 - RNA, 20 nt, Human
gcgccuaccucacagacggc

SEQ ID NO: 356249 - RNA, 23 nt, Human
gcuguuuuagggccaaggugggu

SEQ ID NO: 356250 - RNA, 20 nt, Human
ggcacagggccgggguggcc

SEQ ID NO: 356251 - RNA, 19 nt, Human
ggccgggguggccgggagg

SEQ ID NO: 356252 - RNA, 20 nt, Human
ggcugcuuuccugguggcug

SEQ ID NO: 356253 - RNA, 19 nt, Human
gggccaagguggguggcac

SEQ ID NO: 356254 - RNA, 19 nt, Human
gggccgggguggccgggag

SEQ ID NO: 356255 - RNA, 23 nt, Human
gggcucgucugccacccccaggc

SEQ ID NO: 356256 - RNA, 18 nt, Human
gggcuguaaaaggcuuug

SEQ ID NO: 356257 - RNA, 22 nt, Human
gggugggaggaggggaaacaug

SEQ ID NO: 356258 - RNA, 21 nt, Human
ggugggaggaggggaaacaug

SEQ ID NO: 356259 - RNA, 24 nt, Human
uaaggcggccgggacagaagguca

SEQ ID NO: 356260 - RNA, 22 nt, Human
uacacgguacugcgccuaccuc

SEQ ID NO: 356261 - RNA, 22 nt, Human
uaccucacagacggccaggagc

SEQ ID NO: 356262 - RNA, 26 nt, Human
uacgauacacgguacugcgccuaccu

SEQ ID NO: 356263 - RNA, 19 nt, Human
uagaaaacacucaagugac

SEQ ID NO: 356264 - RNA, 24 nt, Human
uagaaaacacucaagugaccgagc

SEQ ID NO: 356265 - RNA, 25 nt, Human
uaggugucugccacuaaagaguucc

SEQ ID NO: 356266 - RNA, 18 nt, Human
ucaggcaguccaacagga

SEQ ID NO: 356267 - RNA, 21 nt, Human
ucccuggggggccccgggccc

SEQ ID NO: 356268 - RNA, 21 nt, Human
ucccuggggggccccgggccc

SEQ ID NO: 356269 - RNA, 22 nt, Human
ucccugugcccggggcuaaggc

SEQ ID NO: 356270 - RNA, 22 nt, Human
uccucaugcaaacacacauggc

SEQ ID NO: 356271 - RNA, 24 nt, Human
ucucaggcgaccgauccccgaccc

SEQ ID NO: 356272 - RNA, 20 nt, Human
ucucucucuuccccucucuc

SEQ ID NO: 356273 - RNA, 18 nt, Human
ucucuuccccucucucag

SEQ ID NO: 356274 - RNA, 20 nt, Human
ugaaacauccaggacagaag

SEQ ID NO: 356275 - RNA, 22 nt, Human
ugagcccagaagaggugauacc

SEQ ID NO: 356276 - RNA, 19 nt, Human
ugagcucuuccgagcaggc

SEQ ID NO: 356277 - RNA, 22 nt, Human
ugagcucuuccgagcaggcacu

SEQ ID NO: 356278 - RNA, 22 nt, Human
ugagggugggaggaggggaaac

SEQ ID NO: 356279 - RNA, 24 nt, Human
ugaggugucccguggccuccaccc

SEQ ID NO: 356280 - RNA, 21 nt, Human
ugaugucgccccuggcucuca

SEQ ID NO: 356281 - RNA, 21 nt, Human
ugcaaacacacauggcccgcg

SEQ ID NO: 356282 - RNA, 23 nt, Human
ugccacccccaggccucaggaac

SEQ ID NO: 356283 - RNA, 24 nt, Human
ugccacccccaggccucaggaacc

SEQ ID NO: 356284 - RNA, 25 nt, Human
ugccacccccaggccucaggaaccc

SEQ ID NO: 356285 - RNA, 18 nt, Human
ugccacuucucugagagc

SEQ ID NO: 356286 - RNA, 19 nt, Human
ugcccaggccgcagcuggc

SEQ ID NO: 356287 - RNA, 25 nt, Human
ugcccggggcuaaggcggccgggac

SEQ ID NO: 356288 - RNA, 22 nt, Human
ugcuggucugugcucagcuugc

SEQ ID NO: 356289 - RNA, 25 nt, Human
ugcuggucugugcucagcuugcugg

SEQ ID NO: 356290 - RNA, 24 nt, Human
uggcagacaaccagaaggcuuccu

SEQ ID NO: 356291 - RNA, 23 nt, Human
uggcuguuuuagggccaaggugg

SEQ ID NO: 356292 - RNA, 18 nt, Human
ugggacacagacagaaac

SEQ ID NO: 356293 - RNA, 18 nt, Human
ugggggcuggaagggagg

SEQ ID NO: 356294 - RNA, 21 nt, Human
uguuuuagggccaaggugggu

SEQ ID NO: 356295 - RNA, 23 nt, Human
uuccugcagacagaccacgggau

SEQ ID NO: 356296 - RNA, 18 nt, Human
uugagcccagaagaggug

SEQ ID NO: 356297 - RNA, 20 nt, Human
uuuagggccaaggugggugg

SEQ ID NO: 356298 - RNA, 19 nt, Human
uuuuuuuuuuuuagagguc

SEQ ID NO: 356299 - RNA, 22 nt, Human
uuuuuuuuuuuuuuuuuagagg

SEQ ID NO: 356300 - RNA, 19 nt, Human
aaaaucccaaaagagccua

SEQ ID NO: 356301 - RNA, 30 nt, Human
aaagugacauauaaucaaucacaaaaucaa

SEQ ID NO: 356302 - RNA, 22 nt, Human
aaaucccaaaagagccuaugac

SEQ ID NO: 356303 - RNA, 23 nt, Human
aaccaaguucaccaacacccaua

SEQ ID NO: 356304 - RNA, 19 nt, Human
aaccacccauaaugcauua

SEQ ID NO: 356305 - RNA, 19 nt, Human
aagacaagggacaccagcc

SEQ ID NO: 356306 - RNA, 20 nt, Human
aagcuuuuuuucaaaaaaag

SEQ ID NO: 356307 - RNA, 20 nt, Human
aaguucaccaacacccauac

SEQ ID NO: 356308 - RNA, 19 nt, Human
aauuccuuuacaaguucau

SEQ ID NO: 356309 - RNA, 21 nt, Human
accaaguucaccaacacccau

SEQ ID NO: 356310 - RNA, 20 nt, Human
accagccaacuucccaccau

SEQ ID NO: 356311 - RNA, 21 nt, Human
accagccaacuucccaccaua

SEQ ID NO: 356312 - RNA, 18 nt, Human
acuccagguuggucugug

SEQ ID NO: 356313 - RNA, 19 nt, Human
agaaaauaaaguacaaggu

SEQ ID NO: 356314 - RNA, 22 nt, Human
agccagaugugcaaaaaagaga

SEQ ID NO: 356315 - RNA, 20 nt, Human
agggaccagguguuuuuacu

SEQ ID NO: 356316 - RNA, 19 nt, Human
agggagaugccgcugcuac

SEQ ID NO: 356317 - RNA, 21 nt, Human
aggguucauacagagagggga

SEQ ID NO: 356318 - RNA, 24 nt, Human
auacagcuucaaaaaucccaaaag

SEQ ID NO: 356319 - RNA, 25 nt, Human
aucacaaaaauauaaaugugagaag

SEQ ID NO: 356320 - RNA, 18 nt, Human
aucaggucuugccaguac

SEQ ID NO: 356321 - RNA, 18 nt, Human
augccgcugcuacugcag

SEQ ID NO: 356322 - RNA, 22 nt, Human
auggagaauagcucugucucuc

SEQ ID NO: 356323 - RNA, 22 nt, Human
auuauccuuuuguuucccauuu

SEQ ID NO: 356324 - RNA, 23 nt, Human
auuauuccagaaugaacacauua

SEQ ID NO: 356325 - RNA, 23 nt, Human
auuguuucuuuucucguccaaca

SEQ ID NO: 356326 - RNA, 18 nt, Human
caaaaaaaggcucuugga

SEQ ID NO: 356327 - RNA, 26 nt, Human
caaaaaagagagaagcaccccaacaa

SEQ ID NO: 356328 - RNA, 18 nt, Human
caaaagagccuaugacac

SEQ ID NO: 356329 - RNA, 21 nt, Human
caacaagacagugaacugaga

SEQ ID NO: 356330 - RNA, 18 nt, Human
caaccaccugacucccag

SEQ ID NO: 356331 - RNA, 20 nt, Human
caagacagugaacugagagc

SEQ ID NO: 356332 - RNA, 21 nt, Human
caagucaaccaccugacuccc

SEQ ID NO: 356333 - RNA, 23 nt, Human
caagucaaccaccugacucccag

SEQ ID NO: 356334 - RNA, 24 nt, Human
caaucacaaaaucacaaaaauaua

SEQ ID NO: 356335 - RNA, 21 nt, Human
caauccagaauucccaguuau

SEQ ID NO: 356336 - RNA, 21 nt, Human
cacacaguauacagcuucaaa

SEQ ID NO: 356337 - RNA, 19 nt, Human
cacaguauacagcuucaaa

SEQ ID NO: 356338 - RNA, 21 nt, Human
caccauacaaucaagcaagac

SEQ ID NO: 356339 - RNA, 20 nt, Human
cacccauaaugcauuacuca

SEQ ID NO: 356340 - RNA, 26 nt, Human
cacccauaaugcauuacucaggccac

SEQ ID NO: 356341 - RNA, 21 nt, Human
cacccauacacaauccagaau

SEQ ID NO: 356342 - RNA, 23 nt, Human
cacuaaaaauggagcuuuucaca

SEQ ID NO: 356343 - RNA, 22 nt, Human
cacuccacuuuuguacucccac

SEQ ID NO: 356344 - RNA, 26 nt, Human
cagaaugaacacauuauagaguuaaa

SEQ ID NO: 356345 - RNA, 21 nt, Human
cagaguauuugcacugaccua

SEQ ID NO: 356346 - RNA, 21 nt, Human
cagccaggcacaagucaacca

SEQ ID NO: 356347 - RNA, 22 nt, Human
ccaacacccauacacaauccag

SEQ ID NO: 356348 - RNA, 21 nt, Human
ccaccauacaaucaagcaaga

SEQ ID NO: 356349 - RNA, 18 nt, Human
ccagaugugcaaaaaaga

SEQ ID NO: 356350 - RNA, 21 nt, Human
cucaagaaaugguaaaccacc

SEQ ID NO: 356351 - RNA, 22 nt, Human
cucaagaaaugguaaaccaccc

SEQ ID NO: 356352 - RNA, 18 nt, Human
cucaggccacacuccacu

SEQ ID NO: 356353 - RNA, 22 nt, Human
cugcagccaggcacaagucaac

SEQ ID NO: 356354 - RNA, 21 nt, Human
cuucaaaaaucccaaaagagc

SEQ ID NO: 356355 - RNA, 21 nt, Human
cuugccuuaaaccuccuucuc

SEQ ID NO: 356356 - RNA, 18 nt, Human
cuuggcaaagacaaggga

SEQ ID NO: 356357 - RNA, 23 nt, Human
gaaugaacacauuauagaguuaa

SEQ ID NO: 356358 - RNA, 26 nt, Human
gcaagaagguugcuuuccuccccugg

SEQ ID NO: 356359 - RNA, 23 nt, Human
gcagccaggcacaagucaaccac

SEQ ID NO: 356360 - RNA, 19 nt, Human
gccgcugcuacugcagcca

SEQ ID NO: 356361 - RNA, 21 nt, Human
ggacaccagccaacuucccac

SEQ ID NO: 356362 - RNA, 19 nt, Human
ggaggaacauuggaagaag

SEQ ID NO: 356363 - RNA, 20 nt, Human
ggaggaacauuggaagaaga

SEQ ID NO: 356364 - RNA, 19 nt, Human
guggauuuuacuguccaau

SEQ ID NO: 356365 - RNA, 21 nt, Human
uaaagaccagaucuaccuaca

SEQ ID NO: 356366 - RNA, 22 nt, Human
uaaaguauucauuauccuuuug

SEQ ID NO: 356367 - RNA, 18 nt, Human
uaaugcauuacucaggcc

SEQ ID NO: 356368 - RNA, 24 nt, Human
uacagagaggggaggaacauugga

SEQ ID NO: 356369 - RNA, 19 nt, Human
uacucaggccacacuccac

SEQ ID NO: 356370 - RNA, 21 nt, Human
uacuuuaaaaggaggcuuguu

SEQ ID NO: 356371 - RNA, 21 nt, Human
uagcuaguggagaacuuggca

SEQ ID NO: 356372 - RNA, 25 nt, Human
ucaaaaaaagcuuuuuuucaaaaaa

SEQ ID NO: 356373 - RNA, 22 nt, Human
ucacuaaaaauggagcuuuuca

SEQ ID NO: 356374 - RNA, 22 nt, Human
uccaauaucagaacacuaggca

SEQ ID NO: 356375 - RNA, 19 nt, Human
ucuaucugccucuaaagac

SEQ ID NO: 356376 - RNA, 24 nt, Human
ucucguccaacaagacagugaacu

SEQ ID NO: 356377 - RNA, 20 nt, Human
ucugugagcccuguagcaaa

SEQ ID NO: 356378 - RNA, 22 nt, Human
ucuugggcaggccgaggaggag

SEQ ID NO: 356379 - RNA, 22 nt, Human
ugaaaagaaaaacucauuucau

SEQ ID NO: 356380 - RNA, 24 nt, Human
ugaaagacuugaugauucaaaaaa

SEQ ID NO: 356381 - RNA, 19 nt, Human
ugaacugagagcagggacc

SEQ ID NO: 356382 - RNA, 21 nt, Human
ugaacugagagcagggaccag

SEQ ID NO: 356383 - RNA, 19 nt, Human
ugacauauaaucaaucaca

SEQ ID NO: 356384 - RNA, 22 nt, Human
ugagaagaaaaugccgcauaaa

SEQ ID NO: 356385 - RNA, 21 nt, Human
ugcauuuguagcucaccgaac

SEQ ID NO: 356386 - RNA, 21 nt, Human
uguagguuucaaucacuugga

SEQ ID NO: 356387 - RNA, 25 nt, Human
uuaaaaccaaguucaccaacaccca

SEQ ID NO: 356388 - RNA, 21 nt, Human
uuaaaauuaguagcuauaaaa

SEQ ID NO: 356389 - RNA, 18 nt, Human
uucacugucuuuuaucgu

SEQ ID NO: 356390 - RNA, 18 nt, Human
uucacugucuuuuaucgu

SEQ ID NO: 356391 - RNA, 29 nt, Human
uuuaaacucaagccauauaauuaaaaauu

SEQ ID NO: 356392 - RNA, 21 nt, Human
uuucaaaaaaaggcucuugga

SEQ ID NO: 356393 - RNA, 19 nt, Human
uuucacaaaaacugaggau

SEQ ID NO: 356394 - RNA, 20 nt, Human
acagugggagcuaacagggc

SEQ ID NO: 356395 - RNA, 26 nt, Human
accaaaccauuccucagacaacagcc

SEQ ID NO: 356396 - RNA, 20 nt, Human
agacaagaaucaacaaaccg

SEQ ID NO: 356397 - RNA, 24 nt, Human
agacucaaaaggcucagagggcca

SEQ ID NO: 356398 - RNA, 21 nt, Human
agcaggguguguguauguguu

SEQ ID NO: 356399 - RNA, 18 nt, Human
agccauuggauucuuggg

SEQ ID NO: 356400 - RNA, 25 nt, Human
aggacagugggagcuaaccgguacc

SEQ ID NO: 356401 - RNA, 19 nt, Human
aggagaaaccaggacagug

SEQ ID NO: 356402 - RNA, 26 nt, Human
aggagaaggcaguuggugaugauuua

SEQ ID NO: 356403 - RNA, 20 nt, Human
aggcuccgcauuugcuucuc

SEQ ID NO: 356404 - RNA, 22 nt, Human
caccaaaccauuccucagacaa

SEQ ID NO: 356405 - RNA, 18 nt, Human
cacuucuuugcugucuua

SEQ ID NO: 356406 - RNA, 22 nt, Human
cagcagcauuggaccagggccc

SEQ ID NO: 356407 - RNA, 20 nt, Human
caggcuucuuuguugggggu

SEQ ID NO: 356408 - RNA, 24 nt, Human
ccagggcccagacucaaaaggcuc

SEQ ID NO: 356409 - RNA, 23 nt, Human
ccucagacaacagcagcauugga

SEQ ID NO: 356410 - RNA, 22 nt, Human
gagggagcaggcuccgcauuug

SEQ ID NO: 356411 - RNA, 19 nt, Human
gcccagacucaaaaggcuc

SEQ ID NO: 356412 - RNA, 20 nt, Human
gcuucuuuguugggggucag

SEQ ID NO: 356413 - RNA, 22 nt, Human
ggaccagggcccagacucaaaa

SEQ ID NO: 356414 - RNA, 18 nt, Human
ggccaaggaaauuagacu

SEQ ID NO: 356415 - RNA, 21 nt, Human
uagccagacaagaaucaacaa

SEQ ID NO: 356416 - RNA, 22 nt, Human
uaggagaaggcaguuggugaug

SEQ ID NO: 356417 - RNA, 22 nt, Human
ucagagggccaaggaaauuaga

SEQ ID NO: 356418 - RNA, 19 nt, Human
uccaggaggagaaaccagg

SEQ ID NO: 356419 - RNA, 20 nt, Human
ucccuguaggagaaggcagu

SEQ ID NO: 356420 - RNA, 18 nt, Human
uggaccagggcccagacu

SEQ ID NO: 356421 - RNA, 18 nt, Human
uggauucuugggaucuuc

SEQ ID NO: 356422 - RNA, 20 nt, Human
uguaggagaaggcaguuggu

SEQ ID NO: 356423 - RNA, 24 nt, Human
aaaagaaaaaaaaaucuucaaaag

SEQ ID NO: 356424 - RNA, 21 nt, Human
aaaagccaagacugucaggca

SEQ ID NO: 356425 - RNA, 22 nt, Human
agcaaaaaagaaaaaaaaaucu

SEQ ID NO: 356426 - RNA, 24 nt, Human
aggcagcauaaguccucaguaacc

SEQ ID NO: 356427 - RNA, 18 nt, Human
augaagguaugcauaaac

SEQ ID NO: 356428 - RNA, 18 nt, Human
caaaagccaagacuguca

SEQ ID NO: 356429 - RNA, 24 nt, Human
caaaagccaagacugucaggcaca

SEQ ID NO: 356430 - RNA, 20 nt, Human
cagagcaaaaaagaaaaaaa

SEQ ID NO: 356431 - RNA, 19 nt, Human
caugccuugaaaucauuuu

SEQ ID NO: 356432 - RNA, 21 nt, Human
ccuccauguacaucuaaccag

SEQ ID NO: 356433 - RNA, 18 nt, Human
cuccucccuccauuggcc

SEQ ID NO: 356434 - RNA, 20 nt, Human
cuucauuuuaaaaccuguuu

SEQ ID NO: 356435 - RNA, 18 nt, Human
cuugggcuccucccucca

SEQ ID NO: 356436 - RNA, 19 nt, Human
gaaaauauuugauuggucg

SEQ ID NO: 356437 - RNA, 18 nt, Human
uaaguccucaguaacccu

SEQ ID NO: 356438 - RNA, 20 nt, Human
ucacagagaacuuccaugcc

SEQ ID NO: 356439 - RNA, 20 nt, Human
ugaaaucauuuuuuucagag

SEQ ID NO: 356440 - RNA, 24 nt, Human
ugaaaucauuuuuuucagaguauu

SEQ ID NO: 356441 - RNA, 23 nt, Human
ugcagagcaaaaaagaaaaaaaa

SEQ ID NO: 356442 - RNA, 26 nt, Human
ugcagagcaaaaaagaaaaaaaaauc

SEQ ID NO: 356443 - RNA, 27 nt, Human
ugcagagcaaaaaagaaaaaaaaaucc

SEQ ID NO: 356444 - RNA, 19 nt, Human
ugcauaaacggucuucaca

SEQ ID NO: 356445 - RNA, 23 nt, Human
uuaauaagauggucuagcuaugc

SEQ ID NO: 356446 - RNA, 25 nt, Human
uucagaguauuauuaauaagauggu

SEQ ID NO: 356447 - RNA, 21 nt, Human
uuuauuuauaugaugguucuc

SEQ ID NO: 356448 - RNA, 22 nt, Human
aaaaaaaaaagaaaagaaaaag

SEQ ID NO: 356449 - RNA, 21 nt, Human
aaaaaaagaaaagaaaaagaa

SEQ ID NO: 356450 - RNA, 18 nt, Human
aaaaacaaaaaacuaaaa

SEQ ID NO: 356451 - RNA, 23 nt, Human
aaaaacaaaauaaauaaaaagaa

SEQ ID NO: 356452 - RNA, 20 nt, Human
aaaaacaagaacacaagacu

SEQ ID NO: 356453 - RNA, 22 nt, Human
aaaaacaagaacacaagacuca

SEQ ID NO: 356454 - RNA, 25 nt, Human
aaaagaaaaagaaaaagacaacaag

SEQ ID NO: 356455 - RNA, 20 nt, Human
aaaagcuucuucccugcuga

SEQ ID NO: 356456 - RNA, 24 nt, Human
aaacaagaacacaagacucacaua

SEQ ID NO: 356457 - RNA, 24 nt, Human
aaagcaccuccagagcccuaaccc

SEQ ID NO: 356458 - RNA, 18 nt, Human
aacaaaagugcaagagga

SEQ ID NO: 356459 - RNA, 21 nt, Human
aacacacgugcaucagagaca

SEQ ID NO: 356460 - RNA, 20 nt, Human
aacaugauaaaaucccgucu

SEQ ID NO: 356461 - RNA, 20 nt, Human
aacauggugaaaccccgguu

SEQ ID NO: 356462 - RNA, 21 nt, Human
aacauggugaaaccccgguuc

SEQ ID NO: 356463 - RNA, 21 nt, Human
aacauggugaaaccccgguuc

SEQ ID NO: 356464 - RNA, 22 nt, Human
aaccacagguccccagaacaca

SEQ ID NO: 356465 - RNA, 25 nt, Human
aaccacaucucgcacccaauucucc

SEQ ID NO: 356466 - RNA, 20 nt, Human
aagaaaaaucacaaggauuc

SEQ ID NO: 356467 - RNA, 19 nt, Human
aagagaaacuauggccaca

SEQ ID NO: 356468 - RNA, 19 nt, Human
aagcacccagcucggcacc

SEQ ID NO: 356469 - RNA, 23 nt, Human
aagcacccagcucggcaccucac

SEQ ID NO: 356470 - RNA, 23 nt, Human
aagcaccuccagagcccuaaccc

SEQ ID NO: 356471 - RNA, 19 nt, Human
aagcagacggcaacgccag

SEQ ID NO: 356472 - RNA, 21 nt, Human
aagcagacggcaacgccaggg

SEQ ID NO: 356473 - RNA, 18 nt, Human
aagccagggcagagaggc

SEQ ID NO: 356474 - RNA, 18 nt, Human
aagcuggaccaaggcccc

SEQ ID NO: 356475 - RNA, 25 nt, Human
aagggaauucuguuuuacugcuggu

SEQ ID NO: 356476 - RNA, 24 nt, Human
aauccacucuagccugggcgacag

SEQ ID NO: 356477 - RNA, 22 nt, Human
acaaaaauuuggcaggcagcug

SEQ ID NO: 356478 - RNA, 19 nt, Human
acaaaagugcaagaggaag

SEQ ID NO: 356479 - RNA, 24 nt, Human
acacccaggggaagggggcugcag

SEQ ID NO: 356480 - RNA, 24 nt, Human
acagagugagacugugucccaaaa

SEQ ID NO: 356481 - RNA, 23 nt, Human
acagggugagacuacaucucaaa

SEQ ID NO: 356482 - RNA, 24 nt, Human
acagggugagacuacaucucaaaa

SEQ ID NO: 356483 - RNA, 23 nt, Human
acccaggggaagggggcugcagg

SEQ ID NO: 356484 - RNA, 24 nt, Human
accccaaacuagaaacaaaccaac

SEQ ID NO: 356485 - RNA, 24 nt, Human
accccaacacacucuugaaacuga

SEQ ID NO: 356486 - RNA, 24 nt, Human
accugaggucaggaguucgagacc

SEQ ID NO: 356487 - RNA, 24 nt, Human
acuccagccugggcgacaggguga

SEQ ID NO: 356488 - RNA, 24 nt, Human
acucuagccugggcgacagaguga

SEQ ID NO: 356489 - RNA, 20 nt, Human
acugcucgcuaaugcaggga

SEQ ID NO: 356490 - RNA, 18 nt, Human
acugcucuccagucuggg

SEQ ID NO: 356491 - RNA, 21 nt, Human
acuuccuaacaguguguuagg

SEQ ID NO: 356492 - RNA, 27 nt, Human
agaaaaagaaaaagacaacaaguuaaa

SEQ ID NO: 356493 - RNA, 18 nt, Human
agacagguaggggucugc

SEQ ID NO: 356494 - RNA, 19 nt, Human
agaggaaaccccugcagag

SEQ ID NO: 356495 - RNA, 21 nt, Human
agagucccuucguccucugga

SEQ ID NO: 356496 - RNA, 23 nt, Human
agaucaccugaggucaggaguuc

SEQ ID NO: 356497 - RNA, 18 nt, Human
agcaaaccagcacccucc

SEQ ID NO: 356498 - RNA, 23 nt, Human
agcacuugggaggccaagguggg

SEQ ID NO: 356499 - RNA, 24 nt, Human
agcacuuugggaggccaagguggg

SEQ ID NO: 356500 - RNA, 19 nt, Human
agccccggcccccacccag

SEQ ID NO: 356501 - RNA, 24 nt, Human
agccuggccaacaugauaaaaucc

SEQ ID NO: 356502 - RNA, 22 nt, Human
agccuggccaacauggugaaac

SEQ ID NO: 356503 - RNA, 24 nt, Human
agccuggccaacauggugaaaccc

SEQ ID NO: 356504 - RNA, 22 nt, Human
agccuggcgccugguucagccc

SEQ ID NO: 356505 - RNA, 22 nt, Human
agccugggcgacagagugagac

SEQ ID NO: 356506 - RNA, 22 nt, Human
agccugggcgacagggugagac

SEQ ID NO: 356507 - RNA, 20 nt, Human
agcucggcaccucacagaug

SEQ ID NO: 356508 - RNA, 22 nt, Human
aggcaagcacagccuugcuccu

SEQ ID NO: 356509 - RNA, 20 nt, Human
aggcacagcuugguccuggg

SEQ ID NO: 356510 - RNA, 24 nt, Human
aggcacaguggcucaugccuguaa

SEQ ID NO: 356511 - RNA, 25 nt, Human
aggcagcagaacuggugaguggggu

SEQ ID NO: 356512 - RNA, 21 nt, Human
aggcaggaaaaucgcuugaac

SEQ ID NO: 356513 - RNA, 24 nt, Human
aggcaggaaaaucgcuugaacuag

SEQ ID NO: 356514 - RNA, 23 nt, Human
aggcaggagaaucgauugaaccc

SEQ ID NO: 356515 - RNA, 25 nt, Human
aggcaggagaaucgauugaacccug

SEQ ID NO: 356516 - RNA, 21 nt, Human
aggcaggggccagggucuagg

SEQ ID NO: 356517 - RNA, 20 nt, Human
aggcagggggugugugcgag

SEQ ID NO: 356518 - RNA, 21 nt, Human
aggcagggggugugugcgagg

SEQ ID NO: 356519 - RNA, 21 nt, Human
aggccaaggugggcagaucac

SEQ ID NO: 356520 - RNA, 18 nt, Human
aggccaaggugggcggau

SEQ ID NO: 356521 - RNA, 24 nt, Human
aggcggagguggcagugagcggag

SEQ ID NO: 356522 - RNA, 21 nt, Human
aggcugaggcaggaaaaucgc

SEQ ID NO: 356523 - RNA, 24 nt, Human
aggcugaggcaggaaaaucgcuug

SEQ ID NO: 356524 - RNA, 21 nt, Human
agggcacuugggugcuggcaa

SEQ ID NO: 356525 - RNA, 19 nt, Human
aggggugagugugaugggg

SEQ ID NO: 356526 - RNA, 21 nt, Human
aggggugagugugaugggggg

SEQ ID NO: 356527 - RNA, 26 nt, Human
aggugggcagaucaccugaggucagg

SEQ ID NO: 356528 - RNA, 25 nt, Human
aggugguggggguugucugucaagc

SEQ ID NO: 356529 - RNA, 18 nt, Human
aguggcagaggugggacu

SEQ ID NO: 356530 - RNA, 23 nt, Human
aguggcucaugccuguaauccca

SEQ ID NO: 356531 - RNA, 24 nt, Human
aguggcucaugccuguaaucccag

SEQ ID NO: 356532 - RNA, 24 nt, Human
aguugaggucaggaguucaagacc

SEQ ID NO: 356533 - RNA, 19 nt, Human
auaaagcacagaaacagga

SEQ ID NO: 356534 - RNA, 21 nt, Human
auaacuauacaccccaccaga

SEQ ID NO: 356535 - RNA, 24 nt, Human
aucacgccaauccacucuagccug

SEQ ID NO: 356536 - RNA, 24 nt, Human
aucacggcauugcacuccagccug

SEQ ID NO: 356537 - RNA, 23 nt, Human
aucagaacaacagaagcucccug

SEQ ID NO: 356538 - RNA, 19 nt, Human
augccuguaaucccagcac

SEQ ID NO: 356539 - RNA, 24 nt, Human
auggcccccuggggucacagccuc

SEQ ID NO: 356540 - RNA, 21 nt, Human
auugcacuccagccugggcga

SEQ ID NO: 356541 - RNA, 23 nt, Human
auugcacuccagccugggcgaca

SEQ ID NO: 356542 - RNA, 22 nt, Human
caaaaaacacacgugcaucaga

SEQ ID NO: 356543 - RNA, 22 nt, Human
caaacaauggaaguuuuuagca

SEQ ID NO: 356544 - RNA, 24 nt, Human
caacaugauaaaaucccgucucua

SEQ ID NO: 356545 - RNA, 18 nt, Human
caacauggugaaaccccg

SEQ ID NO: 356546 - RNA, 22 nt, Human
caacauggugaaaccccgguuc

SEQ ID NO: 356547 - RNA, 18 nt, Human
caagaacacaagacucac

SEQ ID NO: 356548 - RNA, 26 nt, Human
caagaacacaagacucacauaagcca

SEQ ID NO: 356549 - RNA, 24 nt, Human
caagaccagccuggccaacauggu

SEQ ID NO: 356550 - RNA, 19 nt, Human
caagacucacauaagccag

SEQ ID NO: 356551 - RNA, 23 nt, Human
caagagacccccacaacgaccau

SEQ ID NO: 356552 - RNA, 18 nt, Human
caagaggaagucuucaag

SEQ ID NO: 356553 - RNA, 24 nt, Human
caaggccuaggccuccugccagcc

SEQ ID NO: 356554 - RNA, 24 nt, Human
caaggugggcagaucaccugaggu

SEQ ID NO: 356555 - RNA, 24 nt, Human
caaggugggcggaucaguugaggu

SEQ ID NO: 356556 - RNA, 18 nt, Human
caccauuugcaaaaaaca

SEQ ID NO: 356557 - RNA, 20 nt, Human
caccccaacacacucuugaa

SEQ ID NO: 356558 - RNA, 25 nt, Human
caccccaacacacucuugaaacuga

SEQ ID NO: 356559 - RNA, 25 nt, Human
caccccaggcaccaggcuggaaacc

SEQ ID NO: 356560 - RNA, 19 nt, Human
cacccuccaacaaaagugc

SEQ ID NO: 356561 - RNA, 23 nt, Human
caccugaggucaggaguucgaga

SEQ ID NO: 356562 - RNA, 20 nt, Human
cacuccagccugggcgacag

SEQ ID NO: 356563 - RNA, 20 nt, Human
cacuccagccugggcgacag

SEQ ID NO: 356564 - RNA, 20 nt, Human
cacuccagccugggcgacag

SEQ ID NO: 356565 - RNA, 24 nt, Human
cacuccagccugggcgacagggug

SEQ ID NO: 356566 - RNA, 18 nt, Human
cacucuagccugggcgac

SEQ ID NO: 356567 - RNA, 22 nt, Human
cacucuagccugggcgacagag

SEQ ID NO: 356568 - RNA, 22 nt, Human
cacucuagccugggcgacagag

SEQ ID NO: 356569 - RNA, 24 nt, Human
cacucuagccugggcgacagagug

SEQ ID NO: 356570 - RNA, 24 nt, Human
cagaucaccugaggucaggaguuc

SEQ ID NO: 356571 - RNA, 27 nt, Human
cagaucaccugaggucaggaguucgag

SEQ ID NO: 356572 - RNA, 20 nt, Human
cagcacuugggaggccaagg

SEQ ID NO: 356573 - RNA, 24 nt, Human
cagcacuuugggaggccaaggugg

SEQ ID NO: 356574 - RNA, 24 nt, Human
cagcuacucgggaggcugaggcag

SEQ ID NO: 356575 - RNA, 19 nt, Human
cagcugcccuggcccugcc

SEQ ID NO: 356576 - RNA, 19 nt, Human
cagcugcccuggcccugcc

SEQ ID NO: 356577 - RNA, 23 nt, Human
cagcuguaaucccagcuacaugg

SEQ ID NO: 356578 - RNA, 24 nt, Human
cagcuguaaucccagcuacauggg

SEQ ID NO: 356579 - RNA, 20 nt, Human
caggacugccccuagggcaa

SEQ ID NO: 356580 - RNA, 18 nt, Human
cagggcgugcaggcagag

SEQ ID NO: 356581 - RNA, 23 nt, Human
cagggcuucuagcucuguagccc

SEQ ID NO: 356582 - RNA, 24 nt, Human
cagggucacugccccucuucccca

SEQ ID NO: 356583 - RNA, 20 nt, Human
caggucccaggucccccucu

SEQ ID NO: 356584 - RNA, 19 nt, Human
caggugaccguguaaguga

SEQ ID NO: 356585 - RNA, 22 nt, Human
caggugaccguguaagugacau

SEQ ID NO: 356586 - RNA, 22 nt, Human
caguggggaguggcaugacucc

SEQ ID NO: 356587 - RNA, 24 nt, Human
caguguuccuguccuuggagccca

SEQ ID NO: 356588 - RNA, 23 nt, Human
caguugaggucaggaguucaaga

SEQ ID NO: 356589 - RNA, 20 nt, Human
caucucaaaaacaaaaaacu

SEQ ID NO: 356590 - RNA, 20 nt, Human
caugccuguaaucccagcac

SEQ ID NO: 356591 - RNA, 24 nt, Human
caugccuguaaucccagcacuuug

SEQ ID NO: 356592 - RNA, 19 nt, Human
cauugcacuccagccuggg

SEQ ID NO: 356593 - RNA, 19 nt, Human
cauugcacuccagccuggg

SEQ ID NO: 356594 - RNA, 20 nt, Human
cauugcacuccagccugggc

SEQ ID NO: 356595 - RNA, 20 nt, Human
cauugcacuccagccugggc

SEQ ID NO: 356596 - RNA, 20 nt, Human
cauugcacuccagccugggc

SEQ ID NO: 356597 - RNA, 21 nt, Human
cauugcacuccagccugggcg

SEQ ID NO: 356598 - RNA, 22 nt, Human
cauugcacuccagccugggcga

SEQ ID NO: 356599 - RNA, 24 nt, Human
cauugcacuccagccugggcgaca

SEQ ID NO: 356600 - RNA, 22 nt, Human
cauuguguguaguuaccccaaa

SEQ ID NO: 356601 - RNA, 21 nt, Human
ccaaacuagaaacaaaccaac

SEQ ID NO: 356602 - RNA, 22 nt, Human
ccaaagaagccagcugccagaa

SEQ ID NO: 356603 - RNA, 24 nt, Human
ccaaagccacuggggcccuuuucc

SEQ ID NO: 356604 - RNA, 20 nt, Human
ccaacaaaagugcaagagga

SEQ ID NO: 356605 - RNA, 21 nt, Human
ccaacacacucuugaaacuga

SEQ ID NO: 356606 - RNA, 20 nt, Human
ccaagcaaaugaugucaagc

SEQ ID NO: 356607 - RNA, 18 nt, Human
ccacugcucuccagucug

SEQ ID NO: 356608 - RNA, 21 nt, Human
ccacugcucuccagucugggc

SEQ ID NO: 356609 - RNA, 23 nt, Human
ccacugcucuccagucugggcaa

SEQ ID NO: 356610 - RNA, 24 nt, Human
ccacugcucuccagucugggcaac

SEQ ID NO: 356611 - RNA, 19 nt, Human
ccagacugcccaaguuugg

SEQ ID NO: 356612 - RNA, 18 nt, Human
ccagcaaaccacaggucc

SEQ ID NO: 356613 - RNA, 24 nt, Human
ccagcacuugggaggccaaggugg

SEQ ID NO: 356614 - RNA, 21 nt, Human
ccagcccacccucacagaccc

SEQ ID NO: 356615 - RNA, 26 nt, Human
ccagcgaggggcuugaugcugcuggg

SEQ ID NO: 356616 - RNA, 21 nt, Human
ccaggcaagagacccccacaa

SEQ ID NO: 356617 - RNA, 20 nt, Human
ccaggcaugcaggagguacc

SEQ ID NO: 356618 - RNA, 21 nt, Human
cccaacccuacccuuauaugu

SEQ ID NO: 356619 - RNA, 20 nt, Human
cccaucccaccccaacacac

SEQ ID NO: 356620 - RNA, 20 nt, Human
ccccaaggacaggcaaccuc

SEQ ID NO: 356621 - RNA, 19 nt, Human
ccccaauaagcccugccug

SEQ ID NO: 356622 - RNA, 20 nt, Human
ccccaauaagcccugccugc

SEQ ID NO: 356623 - RNA, 19 nt, Human
ccccaaugcccacccucgc

SEQ ID NO: 356624 - RNA, 18 nt, Human
ccccagaacacacccagg

SEQ ID NO: 356625 - RNA, 18 nt, Human
ccccagugcuguggcccc

SEQ ID NO: 356626 - RNA, 19 nt, Human
ccccaucccaccccaacac

SEQ ID NO: 356627 - RNA, 20 nt, Human
ccccaucccaccccaacaca

SEQ ID NO: 356628 - RNA, 22 nt, Human
cccccacccagcugcccuggcc

SEQ ID NO: 356629 - RNA, 23 nt, Human
cccccacccagcugcccuggccc

SEQ ID NO: 356630 - RNA, 20 nt, Human
ccccuagggcaaggccuagg

SEQ ID NO: 356631 - RNA, 19 nt, Human
ccccuccuucccaaucaag

SEQ ID NO: 356632 - RNA, 19 nt, Human
ccccucuuccccaaggaca

SEQ ID NO: 356633 - RNA, 20 nt, Human
ccccucuuccccaaggacag

SEQ ID NO: 356634 - RNA, 22 nt, Human
cccgucucuacuaaaaauacaa

SEQ ID NO: 356635 - RNA, 19 nt, Human
cccuaccucccugagucug

SEQ ID NO: 356636 - RNA, 24 nt, Human
cccuagaacccaggagucagacuc

SEQ ID NO: 356637 - RNA, 22 nt, Human
cccucggccuagaacagcucac

SEQ ID NO: 356638 - RNA, 19 nt, Human
cccuggggcugcgcugagc

SEQ ID NO: 356639 - RNA, 19 nt, Human
cccugugcuccagccucgg

SEQ ID NO: 356640 - RNA, 19 nt, Human
cccugugcuccagccucgg

SEQ ID NO: 356641 - RNA, 20 nt, Human
cccugugcuccagccucggc

SEQ ID NO: 356642 - RNA, 18 nt, Human
ccuaacccuagcccuggg

SEQ ID NO: 356643 - RNA, 22 nt, Human
ccuaacccuagcccugggagcc

SEQ ID NO: 356644 - RNA, 20 nt, Human
ccucauacccagcugucccc

SEQ ID NO: 356645 - RNA, 22 nt, Human
ccucgcccauccugaggugcag

SEQ ID NO: 356646 - RNA, 24 nt, Human
ccucuggagccuggcgccugguuc

SEQ ID NO: 356647 - RNA, 18 nt, Human
ccugaacucaucuugaag

SEQ ID NO: 356648 - RNA, 20 nt, Human
ccugcacacccagcugcccu

SEQ ID NO: 356649 - RNA, 23 nt, Human
ccugcacacccagcugcccugga

SEQ ID NO: 356650 - RNA, 25 nt, Human
ccugcucacccucccaugugggccc

SEQ ID NO: 356651 - RNA, 20 nt, Human
ccuggaaggccugcgaagcu

SEQ ID NO: 356652 - RNA, 19 nt, Human
ccuggaaucccagcuacuc

SEQ ID NO: 356653 - RNA, 22 nt, Human
ccuggaaucccagcuacucggg

SEQ ID NO: 356654 - RNA, 23 nt, Human
ccuggccaacaugauaaaauccc

SEQ ID NO: 356655 - RNA, 24 nt, Human
ccuggccaacaugauaaaaucccg

SEQ ID NO: 356656 - RNA, 23 nt, Human
ccuggccaacauggugaaacccc

SEQ ID NO: 356657 - RNA, 24 nt, Human
ccuggccaacauggugaaaccccg

SEQ ID NO: 356658 - RNA, 18 nt, Human
ccuggccugaccugaggc

SEQ ID NO: 356659 - RNA, 23 nt, Human
ccuggcucugggccccaggaugc

SEQ ID NO: 356660 - RNA, 20 nt, Human
ccuggguuucugggauuggg

SEQ ID NO: 356661 - RNA, 22 nt, Human
ccuguaaucccagcacuuuggg

SEQ ID NO: 356662 - RNA, 24 nt, Human
ccugugcuccagccucggcugugg

SEQ ID NO: 356663 - RNA, 21 nt, Human
ccuugcuccugcucacccucc

SEQ ID NO: 356664 - RNA, 22 nt, Human
ccuuggacaccugguuccugga

SEQ ID NO: 356665 - RNA, 21 nt, Human
cgagaccagccuggccaacau

SEQ ID NO: 356666 - RNA, 24 nt, Human
cgccuggaaucccagcuacucggg

SEQ ID NO: 356667 - RNA, 22 nt, Human
cgccuguaaucccagcacuugg

SEQ ID NO: 356668 - RNA, 20 nt, Human
cgcgccuguaaucccagcac

SEQ ID NO: 356669 - RNA, 23 nt, Human
cgcgccuguaaucccagcacuug

SEQ ID NO: 356670 - RNA, 24 nt, Human
cggaucaguugaggucaggaguuc

SEQ ID NO: 356671 - RNA, 18 nt, Human
cuacgcacccuuggccug

SEQ ID NO: 356672 - RNA, 22 nt, Human
cuaggccaucccuccagcgccu

SEQ ID NO: 356673 - RNA, 20 nt, Human
cucaaaagcuucuucccugc

SEQ ID NO: 356674 - RNA, 22 nt, Human
cucacccucccaugugggccca

SEQ ID NO: 356675 - RNA, 24 nt, Human
cucacuagcucagcaccccaggca

SEQ ID NO: 356676 - RNA, 24 nt, Human
cucaugccuguaaucccagcacuu

SEQ ID NO: 356677 - RNA, 21 nt, Human
cuccagagcccuaacccuagc

SEQ ID NO: 356678 - RNA, 18 nt, Human
cuccccagugcuguggcc

SEQ ID NO: 356679 - RNA, 24 nt, Human
cucgcgccuguaaucccagcacuu

SEQ ID NO: 356680 - RNA, 18 nt, Human
cucugggccccaggaugc

SEQ ID NO: 356681 - RNA, 23 nt, Human
cugagcuucaaucugccuuucua

SEQ ID NO: 356682 - RNA, 25 nt, Human
cugcacacccagcugcccuggacac

SEQ ID NO: 356683 - RNA, 26 nt, Human
cugcagggccuucuagcucugcagca

SEQ ID NO: 356684 - RNA, 20 nt, Human
cugcagggcuucuagcucgu

SEQ ID NO: 356685 - RNA, 19 nt, Human
cugcggucaccacuuagac

SEQ ID NO: 356686 - RNA, 18 nt, Human
cugcugcggucaccacuu

SEQ ID NO: 356687 - RNA, 19 nt, Human
cuggaaggccugcgaagcu

SEQ ID NO: 356688 - RNA, 19 nt, Human
cuggagccugugucuuagc

SEQ ID NO: 356689 - RNA, 23 nt, Human
cuguacccaucaaaucucccucc

SEQ ID NO: 356690 - RNA, 24 nt, Human
cugucuucugccggccucggccug

SEQ ID NO: 356691 - RNA, 22 nt, Human
cuucacagggucacugccccuc

SEQ ID NO: 356692 - RNA, 27 nt, Human
cuucccaaagccacuggggcccuuuuc

SEQ ID NO: 356693 - RNA, 21 nt, Human
gaaggugugccagggagagug

SEQ ID NO: 356694 - RNA, 23 nt, Human
gaaucugugaacuacgauacagc

SEQ ID NO: 356695 - RNA, 22 nt, Human
gaccugaggcagcagaacuggu

SEQ ID NO: 356696 - RNA, 21 nt, Human
gacugcagggaggaggaaugg

SEQ ID NO: 356697 - RNA, 22 nt, Human
gagacaagcacggcccucccau

SEQ ID NO: 356698 - RNA, 21 nt, Human
gagaggccggaagugacacug

SEQ ID NO: 356699 - RNA, 20 nt, Human
gagaucacgccaauccacuc

SEQ ID NO: 356700 - RNA, 26 nt, Human
gagcccccagucccugcacacccagg

SEQ ID NO: 356701 - RNA, 21 nt, Human
gaggaggaauggcugguuuuc

SEQ ID NO: 356702 - RNA, 24 nt, Human
gaucaccugaggucaggaguucga

SEQ ID NO: 356703 - RNA, 23 nt, Human
gaucaguugaggucaggaguuca

SEQ ID NO: 356704 - RNA, 24 nt, Human
gaucaguugaggucaggaguucaa

SEQ ID NO: 356705 - RNA, 20 nt, Human
gauuggggcugggccugagc

SEQ ID NO: 356706 - RNA, 24 nt, Human
gcaaaccagcacccuccaacaaaa

SEQ ID NO: 356707 - RNA, 21 nt, Human
gcaagcacagccuugcuccug

SEQ ID NO: 356708 - RNA, 18 nt, Human
gcacagcuugguccuggg

SEQ ID NO: 356709 - RNA, 20 nt, Human
gcacccuggggaagucacuc

SEQ ID NO: 356710 - RNA, 24 nt, Human
gcacuccagccugggcgacagggu

SEQ ID NO: 356711 - RNA, 22 nt, Human
gcagcagcacugcccuggccug

SEQ ID NO: 356712 - RNA, 20 nt, Human
gcaggcagcuguaaucccag

SEQ ID NO: 356713 - RNA, 21 nt, Human
gcaguuucacuccccagugcu

SEQ ID NO: 356714 - RNA, 21 nt, Human
gcauugcacuccagccugggc

SEQ ID NO: 356715 - RNA, 24 nt, Human
gcauugcacuccagccugggcgac

SEQ ID NO: 356716 - RNA, 24 nt, Human
gccaacauggugaaaccccgguuc

SEQ ID NO: 356717 - RNA, 24 nt, Human
gccaauccacucuagccugggcga

SEQ ID NO: 356718 - RNA, 22 nt, Human
gccacauucaaaggcauccugg

SEQ ID NO: 356719 - RNA, 19 nt, Human
gccacugcucuccagucug

SEQ ID NO: 356720 - RNA, 24 nt, Human
gccacugcucuccagucugggcaa

SEQ ID NO: 356721 - RNA, 23 nt, Human
gccaggccagaggccccugucug

SEQ ID NO: 356722 - RNA, 20 nt, Human
gccagggucuaggcucagag

SEQ ID NO: 356723 - RNA, 19 nt, Human
gcccccuggggucacagcc

SEQ ID NO: 356724 - RNA, 19 nt, Human
gcccuuuucccaagcccca

SEQ ID NO: 356725 - RNA, 26 nt, Human
gccggccucggccugggucacccggc

SEQ ID NO: 356726 - RNA, 23 nt, Human
gccuuggacaccugguuccugga

SEQ ID NO: 356727 - RNA, 19 nt, Human
gcgccuguaaucccagcac

SEQ ID NO: 356728 - RNA, 24 nt, Human
gcgccuguaaucccagcacuuggg

SEQ ID NO: 356729 - RNA, 24 nt, Human
gcugcuucuccaagcaaaugaugu

SEQ ID NO: 356730 - RNA, 19 nt, Human
gcuggaccaaggccccagc

SEQ ID NO: 356731 - RNA, 21 nt, Human
ggacaccugguuccuggaagc

SEQ ID NO: 356732 - RNA, 24 nt, Human
ggagaucacggcauugcacuccag

SEQ ID NO: 356733 - RNA, 19 nt, Human
ggagcuccgcacaacgugg

SEQ ID NO: 356734 - RNA, 24 nt, Human
ggagguggcagugagcggagauca

SEQ ID NO: 356735 - RNA, 22 nt, Human
ggaucaguugaggucaggaguu

SEQ ID NO: 356736 - RNA, 23 nt, Human
ggaucaguugaggucaggaguuc

SEQ ID NO: 356737 - RNA, 25 nt, Human
ggcagaucaccugaggucaggaguu

SEQ ID NO: 356738 - RNA, 21 nt, Human
ggcagcugucuggcagccugg

SEQ ID NO: 356739 - RNA, 18 nt, Human
ggccagggucuaggcuca

SEQ ID NO: 356740 - RNA, 20 nt, Human
ggccuucuagcucugcagca

SEQ ID NO: 356741 - RNA, 21 nt, Human
ggcggaucaguugaggucagg

SEQ ID NO: 356742 - RNA, 21 nt, Human
ggcucgcgccuguaaucccag

SEQ ID NO: 356743 - RNA, 21 nt, Human
gggacuugaacccaggccucu

SEQ ID NO: 356744 - RNA, 19 nt, Human
gggagggcacuugggugcu

SEQ ID NO: 356745 - RNA, 19 nt, Human
gggcaacgcagggugaggc

SEQ ID NO: 356746 - RNA, 20 nt, Human
gggcagcugucuggcagccu

SEQ ID NO: 356747 - RNA, 20 nt, Human
gggcccaagugcugaccuca

SEQ ID NO: 356748 - RNA, 24 nt, Human
gggcgccguggcucgcgccuguaa

SEQ ID NO: 356749 - RNA, 19 nt, Human
ggggcucaccacaauccuu

SEQ ID NO: 356750 - RNA, 19 nt, Human
ggggcugggccugagccag

SEQ ID NO: 356751 - RNA, 18 nt, Human
gggguccgaaggagggua

SEQ ID NO: 356752 - RNA, 22 nt, Human
ggugaguggggugugggcuccc

SEQ ID NO: 356753 - RNA, 20 nt, Human
gguuccuggaagcagcuggc

SEQ ID NO: 356754 - RNA, 18 nt, Human
guaagcaccucauaccca

SEQ ID NO: 356755 - RNA, 23 nt, Human
guggcucgcgccuguaaucccag

SEQ ID NO: 356756 - RNA, 22 nt, Human
guggggccagggaagaagcaga

SEQ ID NO: 356757 - RNA, 24 nt, Human
uaaggcagggggugugugcgaggu

SEQ ID NO: 356758 - RNA, 22 nt, Human
uacaugggagggugaggcagga

SEQ ID NO: 356759 - RNA, 21 nt, Human
uacccaguaaccaggcacuaa

SEQ ID NO: 356760 - RNA, 18 nt, Human
uaccccaaacuagaaaca

SEQ ID NO: 356761 - RNA, 24 nt, Human
uacuggagccugugucuuagcguu

SEQ ID NO: 356762 - RNA, 20 nt, Human
uagaacagcucacacagacg

SEQ ID NO: 356763 - RNA, 18 nt, Human
uagaacccaggagucaga

SEQ ID NO: 356764 - RNA, 19 nt, Human
uagacagguaggggucugc

SEQ ID NO: 356765 - RNA, 21 nt, Human
uagcaggugcagaaucuggga

SEQ ID NO: 356766 - RNA, 19 nt, Human
uagcucagcaccccaggca

SEQ ID NO: 356767 - RNA, 18 nt, Human
uaggccaucccuccagcg

SEQ ID NO: 356768 - RNA, 23 nt, Human
uagggucacaugccaguuagugg

SEQ ID NO: 356769 - RNA, 19 nt, Human
uagguugugcauuuauguu

SEQ ID NO: 356770 - RNA, 21 nt, Human
uaugcaaguucuggaacgggg

SEQ ID NO: 356771 - RNA, 21 nt, Human
ucaagcacccagcucggcacc

SEQ ID NO: 356772 - RNA, 20 nt, Human
ucaccugaggucaggaguuc

SEQ ID NO: 356773 - RNA, 20 nt, Human
ucagaacaacagaagcuccc

SEQ ID NO: 356774 - RNA, 19 nt, Human
ucagcaggcagucuaggug

SEQ ID NO: 356775 - RNA, 24 nt, Human
ucagucacugucagugggcccaag

SEQ ID NO: 356776 - RNA, 23 nt, Human
ucaguugaggucaggaguucaag

SEQ ID NO: 356777 - RNA, 22 nt, Human
ucaugccuguaaucccagcacu

SEQ ID NO: 356778 - RNA, 23 nt, Human
uccagccugggcgacagggugag

SEQ ID NO: 356779 - RNA, 24 nt, Human
uccagccugggcgacagggugaga

SEQ ID NO: 356780 - RNA, 21 nt, Human
ucccaaaaaaaaaagaaaaaa

SEQ ID NO: 356781 - RNA, 21 nt, Human
ucccaaagccacuggggcccu

SEQ ID NO: 356782 - RNA, 22 nt, Human
ucccaagccccagaacugagcc

SEQ ID NO: 356783 - RNA, 23 nt, Human
ucccaagccccagaacugagccc

SEQ ID NO: 356784 - RNA, 22 nt, Human
ucccaaucaagccccagccacc

SEQ ID NO: 356785 - RNA, 19 nt, Human
ucccaccccaacacacucu

SEQ ID NO: 356786 - RNA, 20 nt, Human
ucccaccccaacacacucuu

SEQ ID NO: 356787 - RNA, 23 nt, Human
ucccagcccagacugcccaaguu

SEQ ID NO: 356788 - RNA, 19 nt, Human
ucccugcacacccagcugc

SEQ ID NO: 356789 - RNA, 23 nt, Human
ucccugcugagcuucaaucugcc

SEQ ID NO: 356790 - RNA, 20 nt, Human
ucccuggggcugcgcugagc

SEQ ID NO: 356791 - RNA, 20 nt, Human
ucccugugcuccagccucgg

SEQ ID NO: 356792 - RNA, 21 nt, Human
ucccugugcuccagccucggc

SEQ ID NO: 356793 - RNA, 22 nt, Human
uccuagggguccgaaggagggu

SEQ ID NO: 356794 - RNA, 18 nt, Human
uccuggcacugcccccuc

SEQ ID NO: 356795 - RNA, 21 nt, Human
uccuucccaaucaagccccag

SEQ ID NO: 356796 - RNA, 24 nt, Human
ucgcuugaacuagagaggcggagg

SEQ ID NO: 356797 - RNA, 24 nt, Human
ucgggaggcugaggcaggaaaauc

SEQ ID NO: 356798 - RNA, 24 nt, Human
ucuagccugggcgacagagugaga

SEQ ID NO: 356799 - RNA, 21 nt, Human
ucucaccccaggcaggcugaa

SEQ ID NO: 356800 - RNA, 22 nt, Human
ucucuacuaaaaauacaaaaaa

SEQ ID NO: 356801 - RNA, 24 nt, Human
ucugcagcagcacugcccuggccu

SEQ ID NO: 356802 - RNA, 21 nt, Human
ucuguuucauuaaaaauccag

SEQ ID NO: 356803 - RNA, 19 nt, Human
ugaaagcaccuccagagcc

SEQ ID NO: 356804 - RNA, 24 nt, Human
ugaaagcaccuccagagcccuaac

SEQ ID NO: 356805 - RNA, 19 nt, Human
ugaacucaucuugaaggua

SEQ ID NO: 356806 - RNA, 23 nt, Human
ugaagcagcuguagcugcagggc

SEQ ID NO: 356807 - RNA, 23 nt, Human
ugaagcagcuguagcugcagggc

SEQ ID NO: 356808 - RNA, 21 nt, Human
ugaccugaggcagcagaacug

SEQ ID NO: 356809 - RNA, 20 nt, Human
ugacugcagggaggaggaau

SEQ ID NO: 356810 - RNA, 22 nt, Human
ugacugcagggaggaggaaugg

SEQ ID NO: 356811 - RNA, 22 nt, Human
ugagaauggcuggaagauggcu

SEQ ID NO: 356812 - RNA, 18 nt, Human
ugagccgagaucacgcca

SEQ ID NO: 356813 - RNA, 19 nt, Human
ugagcuaaaaaaaaaaauc

SEQ ID NO: 356814 - RNA, 20 nt, Human
ugaggcaggaaaaucgcuug

SEQ ID NO: 356815 - RNA, 23 nt, Human
ugaggcaggaaaaucgcuugaac

SEQ ID NO: 356816 - RNA, 20 nt, Human
ugaggcaggagaaucgauug

SEQ ID NO: 356817 - RNA, 24 nt, Human
ugaggcaggagaaucgauugaacc

SEQ ID NO: 356818 - RNA, 25 nt, Human
ugaggcaggagaaucgauugaaccc

SEQ ID NO: 356819 - RNA, 22 nt, Human
ugagggguggcagggagccugg

SEQ ID NO: 356820 - RNA, 21 nt, Human
ugagugaaagcaccuccagag

SEQ ID NO: 356821 - RNA, 21 nt, Human
ugauuggccacugcucuccag

SEQ ID NO: 356822 - RNA, 22 nt, Human
ugcacuccagccugggcgacag

SEQ ID NO: 356823 - RNA, 19 nt, Human
ugcaggcagagauaaggca

SEQ ID NO: 356824 - RNA, 22 nt, Human
ugcccagcgaggggcuugaugc

SEQ ID NO: 356825 - RNA, 19 nt, Human
ugccccaucccaccccaac

SEQ ID NO: 356826 - RNA, 18 nt, Human
ugcccuggccugaccuga

SEQ ID NO: 356827 - RNA, 19 nt, Human
ugcccuggccugaccugag

SEQ ID NO: 356828 - RNA, 21 nt, Human
ugcccuggccugaccugaggc

SEQ ID NO: 356829 - RNA, 19 nt, Human
ugccucagcucugagcccc

SEQ ID NO: 356830 - RNA, 18 nt, Human
ugccucagggaacuaagc

SEQ ID NO: 356831 - RNA, 19 nt, Human
ugccucagggaacuaagcc

SEQ ID NO: 356832 - RNA, 23 nt, Human
ugccuguaaucccagcacuuugg

SEQ ID NO: 356833 - RNA, 23 nt, Human
ugccuguaaucccagcacuuugg

SEQ ID NO: 356834 - RNA, 23 nt, Human
ugcgaggugcccagcgaggggcu

SEQ ID NO: 356835 - RNA, 20 nt, Human
ugcgcugagccccaaccagc

SEQ ID NO: 356836 - RNA, 18 nt, Human
ugcuggaggaccacggcc

SEQ ID NO: 356837 - RNA, 24 nt, Human
uggaaaccacaucucgcacccaau

SEQ ID NO: 356838 - RNA, 20 nt, Human
uggaagacuugggcaucugg

SEQ ID NO: 356839 - RNA, 19 nt, Human
uggagccuggcgccugguu

SEQ ID NO: 356840 - RNA, 21 nt, Human
uggaggcaacagccccuacug

SEQ ID NO: 356841 - RNA, 19 nt, Human
uggauuggggcugggccug

SEQ ID NO: 356842 - RNA, 23 nt, Human
uggcaaaagugaaaugucugcca

SEQ ID NO: 356843 - RNA, 19 nt, Human
uggcagccacauggacugc

SEQ ID NO: 356844 - RNA, 22 nt, Human
uggcagugagcggagaucacgg

SEQ ID NO: 356845 - RNA, 25 nt, Human
uggccaacauggugaaaccccgguu

SEQ ID NO: 356846 - RNA, 27 nt, Human
uggcccccuggggucacagccuccccu

SEQ ID NO: 356847 - RNA, 20 nt, Human
uggcccuucccccauucccc

SEQ ID NO: 356848 - RNA, 22 nt, Human
uggcucaugccuguaaucccag

SEQ ID NO: 356849 - RNA, 24 nt, Human
uggcucaugccuguaaucccagca

SEQ ID NO: 356850 - RNA, 22 nt, Human
uggcucgcgccuguaaucccag

SEQ ID NO: 356851 - RNA, 24 nt, Human
uggcucgcgccuguaaucccagca

SEQ ID NO: 356852 - RNA, 19 nt, Human
ugggaacuccucauggcug

SEQ ID NO: 356853 - RNA, 18 nt, Human
ugggagccaggcaagaga

SEQ ID NO: 356854 - RNA, 20 nt, Human
ugggaggccaaggugggcag

SEQ ID NO: 356855 - RNA, 24 nt, Human
ugggaggccaaggugggcagauca

SEQ ID NO: 356856 - RNA, 19 nt, Human
ugggaggccaaggugggcg

SEQ ID NO: 356857 - RNA, 24 nt, Human
ugggaggccaaggugggcggauca

SEQ ID NO: 356858 - RNA, 18 nt, Human
ugggcagaucaccugagg

SEQ ID NO: 356859 - RNA, 25 nt, Human
ugggcucccagcccagacugcccaa

SEQ ID NO: 356860 - RNA, 19 nt, Human
uggggucagggccccugug

SEQ ID NO: 356861 - RNA, 19 nt, Human
uggugaguggggugugggc

SEQ ID NO: 356862 - RNA, 21 nt, Human
uguaagugacauaaagcaaag

SEQ ID NO: 356863 - RNA, 24 nt, Human
uguccuaggccaucccuccagcgc

SEQ ID NO: 356864 - RNA, 23 nt, Human
ugugaacucagccaggccagagg

SEQ ID NO: 356865 - RNA, 19 nt, Human
ugugacugccuuggccugg

SEQ ID NO: 356866 - RNA, 22 nt, Human
ugugcaccauuugcaaaaaacu

SEQ ID NO: 356867 - RNA, 21 nt, Human
uguuuuaagaaaguuuacaaa

SEQ ID NO: 356868 - RNA, 24 nt, Human
uuacaggaagagaaacuauggcca

SEQ ID NO: 356869 - RNA, 23 nt, Human
uuccccucgucuagagacaagca

SEQ ID NO: 356870 - RNA, 20 nt, Human
uucugguucuaaaaacaucu

SEQ ID NO: 356871 - RNA, 21 nt, Human
uucuucccugcugagcuucaa

SEQ ID NO: 356872 - RNA, 20 nt, Human
uugcauugagccgagaucac

SEQ ID NO: 356873 - RNA, 19 nt, Human
uuuggcuuccauggaccau

SEQ ID NO: 356874 - RNA, 21 nt, Human
uuuuacugcuggugggcacgu

SEQ ID NO: 356875 - RNA, 24 nt, Human
uuuuccagagauagaucagaacaa

SEQ ID NO: 356876 - RNA, 23 nt, Human
aaaaggugauagauggucucugg

SEQ ID NO: 356877 - RNA, 20 nt, Human
aaacacacacacacuuaaca

SEQ ID NO: 356878 - RNA, 20 nt, Human
aaauaccuauauacaucucu

SEQ ID NO: 356879 - RNA, 19 nt, Human
aacaaauagaaagcuaugu

SEQ ID NO: 356880 - RNA, 23 nt, Human
aaccgaacgagcaucuuuccggg

SEQ ID NO: 356881 - RNA, 25 nt, Human
aagaggcagcaaacucuaugggaaa

SEQ ID NO: 356882 - RNA, 24 nt, Human
aagcacggaagacaaucaaauccg

SEQ ID NO: 356883 - RNA, 20 nt, Human
aaugacuaauugcacacugg

SEQ ID NO: 356884 - RNA, 18 nt, Human
acacuuaacagguuaaaa

SEQ ID NO: 356885 - RNA, 22 nt, Human
acagaaaacacacacacacuua

SEQ ID NO: 356886 - RNA, 19 nt, Human
acuacgagugaggcaaagc

SEQ ID NO: 356887 - RNA, 20 nt, Human
acugaagcucaccaaagauu

SEQ ID NO: 356888 - RNA, 22 nt, Human
agaaaacacacacacacuuaac

SEQ ID NO: 356889 - RNA, 26 nt, Human
agacaaucaaauccgaggagggagca

SEQ ID NO: 356890 - RNA, 20 nt, Human
agauaccaccuuucucauag

SEQ ID NO: 356891 - RNA, 18 nt, Human
agcagcaggaggggaggg

SEQ ID NO: 356892 - RNA, 20 nt, Human
agccgggggcgcgcgcggcu

SEQ ID NO: 356893 - RNA, 20 nt, Human
aggcagucccuucaggccuc

SEQ ID NO: 356894 - RNA, 18 nt, Human
aggugcaacugguuuugu

SEQ ID NO: 356895 - RNA, 23 nt, Human
agugaaagagguccaacaaccga

SEQ ID NO: 356896 - RNA, 18 nt, Human
auggugggaugauuggcg

SEQ ID NO: 356897 - RNA, 21 nt, Human
auucgggaucccaaauggucc

SEQ ID NO: 356898 - RNA, 22 nt, Human
caaauggucccugacaacugca

SEQ ID NO: 356899 - RNA, 21 nt, Human
caagaaagcaguuuuagagaa

SEQ ID NO: 356900 - RNA, 20 nt, Human
caaggaaaaaacaguacaau

SEQ ID NO: 356901 - RNA, 21 nt, Human
cacacuggcaggggcccuaaa

SEQ ID NO: 356902 - RNA, 24 nt, Human
cacacuggcaggggcccuaaagac

SEQ ID NO: 356903 - RNA, 18 nt, Human
cacagcaucugcaauaag

SEQ ID NO: 356904 - RNA, 19 nt, Human
cacagcaugucugcacccu

SEQ ID NO: 356905 - RNA, 21 nt, Human
caccuaaaugcuaaugcggga

SEQ ID NO: 356906 - RNA, 21 nt, Human
cacggcggcggcggcggcggu

SEQ ID NO: 356907 - RNA, 23 nt, Human
cacucugcccacugaagcucacc

SEQ ID NO: 356908 - RNA, 22 nt, Human
cagaaaacacacacacacuuaa

SEQ ID NO: 356909 - RNA, 20 nt, Human
cagaaacgcucccagugacc

SEQ ID NO: 356910 - RNA, 24 nt, Human
cagcagggcacgcagggcagaaga

SEQ ID NO: 356911 - RNA, 18 nt, Human
cagcauaaaauagcuaau

SEQ ID NO: 356912 - RNA, 20 nt, Human
cagcauaaaauagcuaaugu

SEQ ID NO: 356913 - RNA, 21 nt, Human
cagcuggcaccucugcacauc

SEQ ID NO: 356914 - RNA, 23 nt, Human
cagggaccaccucacucucaaau

SEQ ID NO: 356915 - RNA, 21 nt, Human
cagggcacgcagggcagaaga

SEQ ID NO: 356916 - RNA, 18 nt, Human
ccaaccacagcaucugca

SEQ ID NO: 356917 - RNA, 19 nt, Human
ccaccuuucucauagaucc

SEQ ID NO: 356918 - RNA, 19 nt, Human
ccagagcagcaggagggga

SEQ ID NO: 356919 - RNA, 20 nt, Human
ccagagcagcaggaggggag

SEQ ID NO: 356920 - RNA, 19 nt, Human
ccaggacacggccuucugu

SEQ ID NO: 356921 - RNA, 23 nt, Human
cccaaauggucccugacaacugc

SEQ ID NO: 356922 - RNA, 21 nt, Human
cccucgauggaggagggcggc

SEQ ID NO: 356923 - RNA, 19 nt, Human
cccuuccucccucuucagc

SEQ ID NO: 356924 - RNA, 21 nt, Human
cccuuccucccucuucagcuc

SEQ ID NO: 356925 - RNA, 22 nt, Human
ccucaagcaaacacgcugcgcg

SEQ ID NO: 356926 - RNA, 23 nt, Human
ccucguagcagcagggaccaccu

SEQ ID NO: 356927 - RNA, 21 nt, Human
ccuuccucccucuucagcucc

SEQ ID NO: 356928 - RNA, 23 nt, Human
cgagagucaguggccaccaaggc

SEQ ID NO: 356929 - RNA, 19 nt, Human
cgccccuuccucccucuuc

SEQ ID NO: 356930 - RNA, 24 nt, Human
cuaaaguuauuaaugcaacacugu

SEQ ID NO: 356931 - RNA, 22 nt, Human
cucaaggaaaaaacaguacaau

SEQ ID NO: 356932 - RNA, 19 nt, Human
cucaccaaagauucacaua

SEQ ID NO: 356933 - RNA, 20 nt, Human
cuccgcggugacagcagggc

SEQ ID NO: 356934 - RNA, 19 nt, Human
cucgaaacucgcuucccgg

SEQ ID NO: 356935 - RNA, 23 nt, Human
cugggagaaauuaugggguggag

SEQ ID NO: 356936 - RNA, 20 nt, Human
cugugucaaguuccugauuu

SEQ ID NO: 356937 - RNA, 23 nt, Human
cuuaacagguuaaaauauccaaa

SEQ ID NO: 356938 - RNA, 18 nt, Human
cuugcacuccagagcagc

SEQ ID NO: 356939 - RNA, 22 nt, Human
gacacagguacaccaggaagga

SEQ ID NO: 356940 - RNA, 22 nt, Human
gaccaccucacucucaaauggc

SEQ ID NO: 356941 - RNA, 18 nt, Human
gagaagggagacgcuggc

SEQ ID NO: 356942 - RNA, 20 nt, Human
gaggagacacagguacaccg

SEQ ID NO: 356943 - RNA, 20 nt, Human
gaguuuggcaaauggcagcu

SEQ ID NO: 356944 - RNA, 21 nt, Human
gcacggaagacaaucaaaucc

SEQ ID NO: 356945 - RNA, 20 nt, Human
gcggcggcggcggcgguagu

SEQ ID NO: 356946 - RNA, 20 nt, Human
gcggcggcggcgguaguggc

SEQ ID NO: 356947 - RNA, 25 nt, Human
gcggcggcgguaguggcgaggggcc

SEQ ID NO: 356948 - RNA, 28 nt, Human
ggaagacaaucaaauccgaggagggagc

SEQ ID NO: 356949 - RNA, 19 nt, Human
ggaaggaagagggguuaag

SEQ ID NO: 356950 - RNA, 20 nt, Human
ggagggcggcgcaugauggg

SEQ ID NO: 356951 - RNA, 21 nt, Human
ggcaauauguuucuuccuggu

SEQ ID NO: 356952 - RNA, 19 nt, Human
ggccagcggcucggcccag

SEQ ID NO: 356953 - RNA, 19 nt, Human
ggcggcggcggcgguagug

SEQ ID NO: 356954 - RNA, 18 nt, Human
ggcuccugaggcuccgcu

SEQ ID NO: 356955 - RNA, 24 nt, Human
gggacucacggcggcggcggcggc

SEQ ID NO: 356956 - RNA, 26 nt, Human
gggacucacggcggcggcggcggcgg

SEQ ID NO: 356957 - RNA, 20 nt, Human
ggggaaaaggugauagaugg

SEQ ID NO: 356958 - RNA, 23 nt, Human
ggguguagccuagcuggcgggcc

SEQ ID NO: 356959 - RNA, 24 nt, Human
ggucccugacaacugcaggcacac

SEQ ID NO: 356960 - RNA, 25 nt, Human
ggugauagauggucucugggagaaa

SEQ ID NO: 356961 - RNA, 22 nt, Human
gguguagccuagcuggcgggcc

SEQ ID NO: 356962 - RNA, 22 nt, Human
guacccguuuacugaaaagcca

SEQ ID NO: 356963 - RNA, 23 nt, Human
guuauauggugggaugauuggcg

SEQ ID NO: 356964 - RNA, 23 nt, Human
guuucuucuuuggggaaaaggug

SEQ ID NO: 356965 - RNA, 23 nt, Human
uacaaaaugcucaucuugcucag

SEQ ID NO: 356966 - RNA, 22 nt, Human
uacugaaaagccacuuuuuccc

SEQ ID NO: 356967 - RNA, 21 nt, Human
uagcagcagggaccaccucac

SEQ ID NO: 356968 - RNA, 23 nt, Human
uauuucuuccuccaguuauccca

SEQ ID NO: 356969 - RNA, 25 nt, Human
ucaacagccugugccccuauuuucu

SEQ ID NO: 356970 - RNA, 22 nt, Human
ucacacagcaugucugcacccu

SEQ ID NO: 356971 - RNA, 26 nt, Human
ucacggcggcggcggcggcgguagug

SEQ ID NO: 356972 - RNA, 18 nt, Human
ucagggcaccuaaaugcu

SEQ ID NO: 356973 - RNA, 21 nt, Human
ucauggcugcuuucuaaucua

SEQ ID NO: 356974 - RNA, 21 nt, Human
ucccacgugauucaccuucuu

SEQ ID NO: 356975 - RNA, 24 nt, Human
uccccgccggcuccugaggcuccc

SEQ ID NO: 356976 - RNA, 18 nt, Human
uccucccucuucagcucc

SEQ ID NO: 356977 - RNA, 22 nt, Human
ucgcauggcguccccgccggcu

SEQ ID NO: 356978 - RNA, 25 nt, Human
ucgcauggcguccccgccggcuccu

SEQ ID NO: 356979 - RNA, 19 nt, Human
ugaaagagguccaacaacc

SEQ ID NO: 356980 - RNA, 22 nt, Human
ugaauaaguagcuauacaacgu

SEQ ID NO: 356981 - RNA, 25 nt, Human
ugacagcagggcacgcagggcagaa

SEQ ID NO: 356982 - RNA, 23 nt, Human
ugaccucaaggaaaaaacaguac

SEQ ID NO: 356983 - RNA, 22 nt, Human
ugacuaauugcacacuggcagg

SEQ ID NO: 356984 - RNA, 24 nt, Human
ugagcagccgccccuuccucccuc

SEQ ID NO: 356985 - RNA, 21 nt, Human
ugcacuccagagcagcaggag

SEQ ID NO: 356986 - RNA, 23 nt, Human
ugcgggacuucacucugcccacu

SEQ ID NO: 356987 - RNA, 22 nt, Human
uggaggagggcggcgcaugaug

SEQ ID NO: 356988 - RNA, 18 nt, Human
uggcaaauggcagcuggc

SEQ ID NO: 356989 - RNA, 23 nt, Human
uggcaaauggcagcuggcaccuc

SEQ ID NO: 356990 - RNA, 18 nt, Human
ugguuuaaggugcaacug

SEQ ID NO: 356991 - RNA, 22 nt, Human
ugugagucacauuuucauuuuu

SEQ ID NO: 356992 - RNA, 20 nt, Human
ugugucaaguuccugauuuu

SEQ ID NO: 356993 - RNA, 24 nt, Human
uguuucuucuuuggggaaaaggug

SEQ ID NO: 356994 - RNA, 21 nt, Human
uucacacagcaugucugcacc

SEQ ID NO: 356995 - RNA, 24 nt, Human
uucccacgugauucaccuucuuac

SEQ ID NO: 356996 - RNA, 19 nt, Human
uugaccucaaggaaaaaac

SEQ ID NO: 356997 - RNA, 22 nt, Human
uugaccucaaggaaaaaacagu

SEQ ID NO: 356998 - RNA, 23 nt, Human
uugcauaggaaacuauuuaaagc

SEQ ID NO: 356999 - RNA, 18 nt, Human
uuggucuucaguaucuga

SEQ ID NO: 357000 - RNA, 23 nt, Human
uuuauacuuaacaaauagaaagc

SEQ ID NO: 357001 - RNA, 24 nt, Human
uuuuuuuuuuuuuuuuagguuuca

SEQ ID NO: 357002 - RNA, 23 nt, Human
uuuuuuuuuuuuuuuuuuuuagg

SEQ ID NO: 357003 - RNA, 21 nt, Human
aaaaaagaagucacuauugua

SEQ ID NO: 357004 - RNA, 20 nt, Human
aaauaaccuuguaauuaaga

SEQ ID NO: 357005 - RNA, 24 nt, Human
aaccuagucacagucuacccacaa

SEQ ID NO: 357006 - RNA, 21 nt, Human
aaccuucucccccacagccac

SEQ ID NO: 357007 - RNA, 24 nt, Human
aagacaaaaauacagugcucuaaa

SEQ ID NO: 357008 - RNA, 20 nt, Human
aagacaaguacaaaauaacc

SEQ ID NO: 357009 - RNA, 22 nt, Human
aagauuuggcauauauuaaaug

SEQ ID NO: 357010 - RNA, 23 nt, Human
aagccuccacugggucaaaaaua

SEQ ID NO: 357011 - RNA, 24 nt, Human
aauaacaguggcaaccauucuuca

SEQ ID NO: 357012 - RNA, 24 nt, Human
accaugaaaacguuaaagaaaagc

SEQ ID NO: 357013 - RNA, 22 nt, Human
acccucauccccccgcaucccc

SEQ ID NO: 357014 - RNA, 24 nt, Human
acccucauccccccgcauccccac

SEQ ID NO: 357015 - RNA, 19 nt, Human
accuuguaauuaagauacu

SEQ ID NO: 357016 - RNA, 23 nt, Human
agaaccuucucccccacagccac

SEQ ID NO: 357017 - RNA, 18 nt, Human
agacaaaaauacagugcu

SEQ ID NO: 357018 - RNA, 21 nt, Human
agacaaguacaaaauaaccuu

SEQ ID NO: 357019 - RNA, 24 nt, Human
aggaauacuagugcagcauaaccc

SEQ ID NO: 357020 - RNA, 20 nt, Human
auccccccgcauccccacug

SEQ ID NO: 357021 - RNA, 22 nt, Human
auucaccuuucccaccccaaaa

SEQ ID NO: 357022 - RNA, 24 nt, Human
auuuucuuaacaagacaaaaauac

SEQ ID NO: 357023 - RNA, 24 nt, Human
caaccuacagagaaauuaacaucu

SEQ ID NO: 357024 - RNA, 26 nt, Human
cacaacaagaacucugcucugaaaaa

SEQ ID NO: 357025 - RNA, 22 nt, Human
caccccaaaaagugcagcucau

SEQ ID NO: 357026 - RNA, 18 nt, Human
caccuuucccaccccaaa

SEQ ID NO: 357027 - RNA, 24 nt, Human
cagaagaacaaucuuuagcccuca

SEQ ID NO: 357028 - RNA, 22 nt, Human
caucuccauuuucccauacaaa

SEQ ID NO: 357029 - RNA, 30 nt, Human
caucuccauuuucccauacaaacugagggg

SEQ ID NO: 357030 - RNA, 24 nt, Human
cauuaccaugaaaacguuaaagaa

SEQ ID NO: 357031 - RNA, 20 nt, Human
ccacaaauccccuucuauaa

SEQ ID NO: 357032 - RNA, 20 nt, Human
ccagcccaagagcucuuacc

SEQ ID NO: 357033 - RNA, 21 nt, Human
cccauacaaacugagggugag

SEQ ID NO: 357034 - RNA, 19 nt, Human
ccccacagccacaaauccc

SEQ ID NO: 357035 - RNA, 24 nt, Human
ccccacuggcauucaccuuuccca

SEQ ID NO: 357036 - RNA, 21 nt, Human
ccccccgcauccccacuggca

SEQ ID NO: 357037 - RNA, 22 nt, Human
ccccccgcauccccacuggcau

SEQ ID NO: 357038 - RNA, 19 nt, Human
ccccucuuccuccuccucc

SEQ ID NO: 357039 - RNA, 21 nt, Human
cccuucuauaagucccuccua

SEQ ID NO: 357040 - RNA, 22 nt, Human
cccuuggcuggcaggauaaggc

SEQ ID NO: 357041 - RNA, 19 nt, Human
ccucauccccccgcauccc

SEQ ID NO: 357042 - RNA, 21 nt, Human
ccuccuccuccuccucguccc

SEQ ID NO: 357043 - RNA, 22 nt, Human
ccuccuccuccucgucccgggc

SEQ ID NO: 357044 - RNA, 25 nt, Human
ccuucuauaagucccuccuacccuc

SEQ ID NO: 357045 - RNA, 24 nt, Human
ccuuucccaccccaaaaagugcag

SEQ ID NO: 357046 - RNA, 21 nt, Human
cuagucacagucuacccacaa

SEQ ID NO: 357047 - RNA, 24 nt, Human
cucccccacagccacaaauccccu

SEQ ID NO: 357048 - RNA, 23 nt, Human
cugcucugaaaaaccagcccaag

SEQ ID NO: 357049 - RNA, 18 nt, Human
cuucccagccaucuuccc

SEQ ID NO: 357050 - RNA, 22 nt, Human
gaacaccagagguggugaaaau

SEQ ID NO: 357051 - RNA, 21 nt, Human
gaacucugcucugaaaaacca

SEQ ID NO: 357052 - RNA, 21 nt, Human
gaagaacaaucuuuagcccuc

SEQ ID NO: 357053 - RNA, 23 nt, Human
gggcaggcggcaggauuucggcu

SEQ ID NO: 357054 - RNA, 19 nt, Human
gucccuccuacccucaucc

SEQ ID NO: 357055 - RNA, 21 nt, Human
uaagacaaguacaaaauaacc

SEQ ID NO: 357056 - RNA, 24 nt, Human
uaagacaaguacaaaauaaccuug

SEQ ID NO: 357057 - RNA, 21 nt, Human
uagccuucuagaaaaugguuu

SEQ ID NO: 357058 - RNA, 23 nt, Human
uagccuucuagaaaaugguuuua

SEQ ID NO: 357059 - RNA, 19 nt, Human
uagugcagcauaacccuua

SEQ ID NO: 357060 - RNA, 21 nt, Human
uauacggaauguuccacaaag

SEQ ID NO: 357061 - RNA, 24 nt, Human
uaugcuguagaaccuucuccccca

SEQ ID NO: 357062 - RNA, 19 nt, Human
uauuaagacaaguacaaaa

SEQ ID NO: 357063 - RNA, 18 nt, Human
uccacaaaggcugugaac

SEQ ID NO: 357064 - RNA, 20 nt, Human
ucccccacagccacaaaucc

SEQ ID NO: 357065 - RNA, 21 nt, Human
ucucuuagaauaaauccccuu

SEQ ID NO: 357066 - RNA, 22 nt, Human
ucuuccuccuccuccuccucgu

SEQ ID NO: 357067 - RNA, 20 nt, Human
ugaaaaaccagcccaagagc

SEQ ID NO: 357068 - RNA, 24 nt, Human
ugaaaacguuaaagaaaagcaguc

SEQ ID NO: 357069 - RNA, 19 nt, Human
ugaaagaggguugcuuuuu

SEQ ID NO: 357070 - RNA, 24 nt, Human
ugaagagauuuacaaaugacuaaa

SEQ ID NO: 357071 - RNA, 22 nt, Human
ugagaagagaaagagaagcaag

SEQ ID NO: 357072 - RNA, 24 nt, Human
ugcagcucaugguagccuucuaga

SEQ ID NO: 357073 - RNA, 21 nt, Human
ugcccccacuuuggccuggcu

SEQ ID NO: 357074 - RNA, 22 nt, Human
ugcccccacuuuggccuggcuu

SEQ ID NO: 357075 - RNA, 24 nt, Human
ugcuguagaaccuucucccccaca

SEQ ID NO: 357076 - RNA, 19 nt, Human
uggcaggauaaggcuuaug

SEQ ID NO: 357077 - RNA, 21 nt, Human
uggcuucccagccaucuuccc

SEQ ID NO: 357078 - RNA, 18 nt, Human
ugggauaaaguggagagg

SEQ ID NO: 357079 - RNA, 23 nt, Human
uggguuuucuuucuuuuucauuu

SEQ ID NO: 357080 - RNA, 22 nt, Human
uuaaaagcccccucugaacacc

SEQ ID NO: 357081 - RNA, 24 nt, Human
uuagaaaugcuaaauuuucuuaac

SEQ ID NO: 357082 - RNA, 20 nt, Human
uucccauacaaacugagggu

SEQ ID NO: 357083 - RNA, 19 nt, Human
uuuuuuuuuuuuaagccuc

SEQ ID NO: 357084 - RNA, 23 nt, Human
aagcccccccacccaaguguggg

SEQ ID NO: 357085 - RNA, 18 nt, Human
agaugucggggcugccug

SEQ ID NO: 357086 - RNA, 19 nt, Human
agcaggcccgggaggcggu

SEQ ID NO: 357087 - RNA, 18 nt, Human
agccugggguccggagcu

SEQ ID NO: 357088 - RNA, 21 nt, Human
aggcauccccacccacccaga

SEQ ID NO: 357089 - RNA, 21 nt, Human
aggcgggggugcauuggcccu

SEQ ID NO: 357090 - RNA, 20 nt, Human
agggcagggcagagcagagc

SEQ ID NO: 357091 - RNA, 22 nt, Human
aggggcggggcggggacacggg

SEQ ID NO: 357092 - RNA, 21 nt, Human
aggugugcuggggugggugug

SEQ ID NO: 357093 - RNA, 24 nt, Human
cacccacccagauaagccccccca

SEQ ID NO: 357094 - RNA, 27 nt, Human
cacccacccagauaagcccccccaccc

SEQ ID NO: 357095 - RNA, 23 nt, Human
cagagccugggguccggagcuuc

SEQ ID NO: 357096 - RNA, 27 nt, Human
cagcgcuaguguaaacaggcaucccca

SEQ ID NO: 357097 - RNA, 22 nt, Human
cagcggcucagcaaggggagcc

SEQ ID NO: 357098 - RNA, 20 nt, Human
caggagacccagcagggggu

SEQ ID NO: 357099 - RNA, 19 nt, Human
caggcauccccacccaccc

SEQ ID NO: 357100 - RNA, 23 nt, Human
caguuaaaaagcugaaaagguac

SEQ ID NO: 357101 - RNA, 21 nt, Human
cauccuguuaaggcugcggga

SEQ ID NO: 357102 - RNA, 18 nt, Human
caucgauuuugcauuggg

SEQ ID NO: 357103 - RNA, 23 nt, Human
ccacccacccagauaagcccccc

SEQ ID NO: 357104 - RNA, 24 nt, Human
ccacccagauaagcccccccaccc

SEQ ID NO: 357105 - RNA, 24 nt, Human
ccaccccauggggacccucgaucc

SEQ ID NO: 357106 - RNA, 21 nt, Human
cccacccacccagauaagccc

SEQ ID NO: 357107 - RNA, 18 nt, Human
cccagauaagccccccca

SEQ ID NO: 357108 - RNA, 19 nt, Human
cccagauaagcccccccac

SEQ ID NO: 357109 - RNA, 19 nt, Human
cccccacccaagugugggg

SEQ ID NO: 357110 - RNA, 21 nt, Human
ccccccacccaaguguggggu

SEQ ID NO: 357111 - RNA, 23 nt, Human
ccucccuggguugggaugggggc

SEQ ID NO: 357112 - RNA, 18 nt, Human
ccuggguugggauggggg

SEQ ID NO: 357113 - RNA, 19 nt, Human
cggccagcugggcgagaag

SEQ ID NO: 357114 - RNA, 19 nt, Human
cggccaguguggacggagg

SEQ ID NO: 357115 - RNA, 19 nt, Human
cucacuggaaccuuugugc

SEQ ID NO: 357116 - RNA, 18 nt, Human
cucccuggguugggaugg

SEQ ID NO: 357117 - RNA, 25 nt, Human
cucugagccaccccauggggacccu

SEQ ID NO: 357118 - RNA, 20 nt, Human
cugcaagcugacagcaggcc

SEQ ID NO: 357119 - RNA, 18 nt, Human
cuggcccagagaacuccc

SEQ ID NO: 357120 - RNA, 23 nt, Human
cugugugcucaucucugcgcccc

SEQ ID NO: 357121 - RNA, 19 nt, Human
gacggaggugggggcugcc

SEQ ID NO: 357122 - RNA, 21 nt, Human
gagcagagccugggguccgga

SEQ ID NO: 357123 - RNA, 19 nt, Human
gagcgggggaggaggcugg

SEQ ID NO: 357124 - RNA, 22 nt, Human
gaggagaaggagugcgugugug

SEQ ID NO: 357125 - RNA, 21 nt, Human
gaggcagggcccugcaggaga

SEQ ID NO: 357126 - RNA, 19 nt, Human
gcagcuugugccagaguga

SEQ ID NO: 357127 - RNA, 18 nt, Human
gccuugaggagaaggagu

SEQ ID NO: 357128 - RNA, 19 nt, Human
gccuuggucuagaggagau

SEQ ID NO: 357129 - RNA, 21 nt, Human
gcugcaagcugacagcaggcc

SEQ ID NO: 357130 - RNA, 20 nt, Human
ggagaaggagugcgugugug

SEQ ID NO: 357131 - RNA, 18 nt, Human
ggcgauagaggaagcaga

SEQ ID NO: 357132 - RNA, 18 nt, Human
gggagcgggggaggaggc

SEQ ID NO: 357133 - RNA, 18 nt, Human
gggaguaccucaagggcc

SEQ ID NO: 357134 - RNA, 21 nt, Human
gggcccagguggcgccggcag

SEQ ID NO: 357135 - RNA, 18 nt, Human
gggcgagaaguuggggag

SEQ ID NO: 357136 - RNA, 19 nt, Human
gggcggggcggggacacgg

SEQ ID NO: 357137 - RNA, 21 nt, Human
gggcggggcggggacacgggu

SEQ ID NO: 357138 - RNA, 22 nt, Human
gggcggggcuugggaggcaggg

SEQ ID NO: 357139 - RNA, 22 nt, Human
ggggagccuggccaccagggcu

SEQ ID NO: 357140 - RNA, 18 nt, Human
gggggcugccccagagga

SEQ ID NO: 357141 - RNA, 22 nt, Human
ggggggugcagggcagggcaga

SEQ ID NO: 357142 - RNA, 20 nt, Human
ggguccugcucagggaguac

SEQ ID NO: 357143 - RNA, 21 nt, Human
gguccggagcuucacuggacc

SEQ ID NO: 357144 - RNA, 18 nt, Human
gugcauuggcccuggagu

SEQ ID NO: 357145 - RNA, 28 nt, Human
gugcugggguggguguggguggcuggga

SEQ ID NO: 357146 - RNA, 20 nt, Human
uaaacaggcauccccacccc

SEQ ID NO: 357147 - RNA, 22 nt, Human
uaagagcaccuuaguguugccc

SEQ ID NO: 357148 - RNA, 19 nt, Human
uaagcccccccacccaagu

SEQ ID NO: 357149 - RNA, 20 nt, Human
uagggccagggcccaucacc

SEQ ID NO: 357150 - RNA, 20 nt, Human
ucaagggccggggcccaggu

SEQ ID NO: 357151 - RNA, 21 nt, Human
ucacuggaccacagagggagg

SEQ ID NO: 357152 - RNA, 23 nt, Human
uccccacccacccagauaagccc

SEQ ID NO: 357153 - RNA, 23 nt, Human
ucccuggguugggaugggggcag

SEQ ID NO: 357154 - RNA, 20 nt, Human
ugacacaggccucccugggu

SEQ ID NO: 357155 - RNA, 22 nt, Human
ugagccaccccauggggacccu

SEQ ID NO: 357156 - RNA, 22 nt, Human
ugaggugugcuggggugggugu

SEQ ID NO: 357157 - RNA, 26 nt, Human
ugcaggagacccagcagggggugccg

SEQ ID NO: 357158 - RNA, 22 nt, Human
ugcgcucacuggaaccuuugug

SEQ ID NO: 357159 - RNA, 23 nt, Human
ugcucagggaguaccucaagggc

SEQ ID NO: 357160 - RNA, 21 nt, Human
ugcuggggugggugugggugg

SEQ ID NO: 357161 - RNA, 22 nt, Human
ugcugggguggguguggguggg

SEQ ID NO: 357162 - RNA, 18 nt, Human
uggaaugcaggagaccca

SEQ ID NO: 357163 - RNA, 22 nt, Human
uggaguagggccagggcccauc

SEQ ID NO: 357164 - RNA, 24 nt, Human
uggcagcuugugccagagugacac

SEQ ID NO: 357165 - RNA, 21 nt, Human
uggcuggggccacuucccaca

SEQ ID NO: 357166 - RNA, 18 nt, Human
uggcuuucugagggcggg

SEQ ID NO: 357167 - RNA, 19 nt, Human
uggggccacuucccacagg

SEQ ID NO: 357168 - RNA, 24 nt, Human
uggguguggguggcuggugguggc

SEQ ID NO: 357169 - RNA, 28 nt, Human
uggguguggguggcuggugguggcagcu

SEQ ID NO: 357170 - RNA, 20 nt, Human
uggguugggaugggggcagu

SEQ ID NO: 357171 - RNA, 22 nt, Human
uuaaggcugcgggacucgaggg

SEQ ID NO: 357172 - RNA, 19 nt, Human
uucuguuuacaaaauucag

SEQ ID NO: 357173 - RNA, 21 nt, Human
aaagcaaaagcuuucuccucu

SEQ ID NO: 357174 - RNA, 18 nt, Human
aaauaaaaaaacacacug

SEQ ID NO: 357175 - RNA, 23 nt, Human
aaauagccauaagugugaggagc

SEQ ID NO: 357176 - RNA, 23 nt, Human
aaccucugaaagagucuguacag

SEQ ID NO: 357177 - RNA, 20 nt, Human
aagaggaggcgagccagcca

SEQ ID NO: 357178 - RNA, 20 nt, Human
acaugccacgcccaccaggc

SEQ ID NO: 357179 - RNA, 19 nt, Human
agaaaugcaaagagaccuu

SEQ ID NO: 357180 - RNA, 27 nt, Human
agaaaugcaaagagaccuucagauggc

SEQ ID NO: 357181 - RNA, 22 nt, Human
agacaaauucauucagaucagg

SEQ ID NO: 357182 - RNA, 20 nt, Human
agcaaggagggaagaaaacu

SEQ ID NO: 357183 - RNA, 18 nt, Human
agcaguaagauuugccuu

SEQ ID NO: 357184 - RNA, 19 nt, Human
agcgacugaauugggaaag

SEQ ID NO: 357185 - RNA, 19 nt, Human
aggagcugagaugccuauu

SEQ ID NO: 357186 - RNA, 19 nt, Human
auaagcagcauugccaaag

SEQ ID NO: 357187 - RNA, 21 nt, Human
auacauacauaguucuguaua

SEQ ID NO: 357188 - RNA, 18 nt, Human
auagcaaggagggaagaa

SEQ ID NO: 357189 - RNA, 24 nt, Human
aucaucuuuauuugguccucauug

SEQ ID NO: 357190 - RNA, 21 nt, Human
cacaaauaaaacugaagugaa

SEQ ID NO: 357191 - RNA, 20 nt, Human
cacagcacuguacacacaaa

SEQ ID NO: 357192 - RNA, 22 nt, Human
cacaugccacgcccaccaggcu

SEQ ID NO: 357193 - RNA, 23 nt, Human
cacuguacacacaaaaugaagac

SEQ ID NO: 357194 - RNA, 21 nt, Human
cagagaaugcuuugaacccac

SEQ ID NO: 357195 - RNA, 20 nt, Human
caggaggccgcgcuggcggc

SEQ ID NO: 357196 - RNA, 21 nt, Human
cauguaauucacaaauaaaac

SEQ ID NO: 357197 - RNA, 28 nt, Human
ccuuaaacugcuaagcacaaaaaucauc

SEQ ID NO: 357198 - RNA, 22 nt, Human
cggaagcagcacguuaaaccuc

SEQ ID NO: 357199 - RNA, 25 nt, Human
cucacaauaaugcugauuaacuguc

SEQ ID NO: 357200 - RNA, 24 nt, Human
cugauacaaauaaaaaaacacacu

SEQ ID NO: 357201 - RNA, 23 nt, Human
cugcugugcgggagggaggcggc

SEQ ID NO: 357202 - RNA, 19 nt, Human
cugugcccuucagaauagc

SEQ ID NO: 357203 - RNA, 18 nt, Human
gauuugccuuucacucca

SEQ ID NO: 357204 - RNA, 18 nt, Human
gcagcauugccaaagcag

SEQ ID NO: 357205 - RNA, 18 nt, Human
gccaaauggauucaugaa

SEQ ID NO: 357206 - RNA, 24 nt, Human
uaaauacauacauaguucuguaua

SEQ ID NO: 357207 - RNA, 21 nt, Human
uaagauuugccuuucacucca

SEQ ID NO: 357208 - RNA, 22 nt, Human
uacaaauaaaaaaacacacuga

SEQ ID NO: 357209 - RNA, 20 nt, Human
uacacacagcacuguacaca

SEQ ID NO: 357210 - RNA, 27 nt, Human
uagaaagggcagaaguaaaaguagcgg

SEQ ID NO: 357211 - RNA, 22 nt, Human
uagauaaauagaacucuggaua

SEQ ID NO: 357212 - RNA, 19 nt, Human
uagcaagaaauuuaagcuu

SEQ ID NO: 357213 - RNA, 23 nt, Human
uagcaaggagggaagaaaacugg

SEQ ID NO: 357214 - RNA, 24 nt, Human
uagcaaggagggaagaaaacuggc

SEQ ID NO: 357215 - RNA, 21 nt, Human
ucacuccacaugauccacuac

SEQ ID NO: 357216 - RNA, 20 nt, Human
ucagauggccccugggguga

SEQ ID NO: 357217 - RNA, 20 nt, Human
ucauccaucaccaugacucc

SEQ ID NO: 357218 - RNA, 23 nt, Human
uccucuuugcauggagaaaugca

SEQ ID NO: 357219 - RNA, 22 nt, Human
uccuugugucucugugccaaaa

SEQ ID NO: 357220 - RNA, 20 nt, Human
ucucugugccaaauggauuc

SEQ ID NO: 357221 - RNA, 23 nt, Human
ugaaacauguaauucacaaauaa

SEQ ID NO: 357222 - RNA, 24 nt, Human
ugaacuaguggaaaguugguuacu

SEQ ID NO: 357223 - RNA, 24 nt, Human
ugagaacuguguaaacagcaguuc

SEQ ID NO: 357224 - RNA, 24 nt, Human
ugcaggaggccgcgcuggcggcug

SEQ ID NO: 357225 - RNA, 27 nt, Human
uggcggcugcugugcgggagggaggcg

SEQ ID NO: 357226 - RNA, 22 nt, Human
uggggcuggaugacguggacca

SEQ ID NO: 357227 - RNA, 24 nt, Human
uggugagaguuuauacauuaagca

SEQ ID NO: 357228 - RNA, 22 nt, Human
uggugagggaaggcuuacuuug

SEQ ID NO: 357229 - RNA, 21 nt, Human
ugguggggcuggaugacgugg

SEQ ID NO: 357230 - RNA, 24 nt, Human
uuaaacugcuaagcacaaaaauca

SEQ ID NO: 357231 - RNA, 22 nt, Human
uucagaucaggagacaauuugc

SEQ ID NO: 357232 - RNA, 20 nt, Human
uugccuuucacuccacauga

SEQ ID NO: 357233 - RNA, 20 nt, Human
uuggaauuacgacucuggcu

SEQ ID NO: 357234 - RNA, 20 nt, Human
uuucacuccacaugauccac

SEQ ID NO: 357235 - RNA, 23 nt, Human
uuucucaguauaugaacuagugg

SEQ ID NO: 357236 - RNA, 18 nt, Human
uuuuuuuuuuuuuuucug

SEQ ID NO: 357237 - RNA, 22 nt, Human
uuuuuuuuuuuuuuucugucuu

SEQ ID NO: 357238 - RNA, 26 nt, Human
aaacaaaauauuuagcauuucuuagu

SEQ ID NO: 357239 - RNA, 20 nt, Human
aaacccaagaaccagccuca

SEQ ID NO: 357240 - RNA, 25 nt, Human
aaauacaaugaaaagaaaagaccag

SEQ ID NO: 357241 - RNA, 18 nt, Human
aacauggugaaacccauc

SEQ ID NO: 357242 - RNA, 19 nt, Human
aacauggugaaacccaucu

SEQ ID NO: 357243 - RNA, 20 nt, Human
aacauggugaaacccaucuc

SEQ ID NO: 357244 - RNA, 23 nt, Human
aaccagccucauaaccugggagc

SEQ ID NO: 357245 - RNA, 18 nt, Human
aacugcuucuucagcccg

SEQ ID NO: 357246 - RNA, 22 nt, Human
aagcaaaaaagaaaacaaggga

SEQ ID NO: 357247 - RNA, 19 nt, Human
aagcaaaaaagaaaacaau

SEQ ID NO: 357248 - RNA, 21 nt, Human
aagcagaucaaugagcaugau

SEQ ID NO: 357249 - RNA, 24 nt, Human
aagcuuaaaauacaaugaaaagaa

SEQ ID NO: 357250 - RNA, 22 nt, Human
acaaugaaaagaaaagaccaga

SEQ ID NO: 357251 - RNA, 24 nt, Human
accauuucauugcagcugaggaau

SEQ ID NO: 357252 - RNA, 20 nt, Human
agaagaggcugggcacagug

SEQ ID NO: 357253 - RNA, 19 nt, Human
aggacaggaagcaaaaaag

SEQ ID NO: 357254 - RNA, 20 nt, Human
aggacaggaagcaaaaaaga

SEQ ID NO: 357255 - RNA, 20 nt, Human
aggcaggcggaucacgaggu

SEQ ID NO: 357256 - RNA, 24 nt, Human
aggcaggcggaucacgaggucagg

SEQ ID NO: 357257 - RNA, 26 nt, Human
aggcaggcggaucacgaggucaggag

SEQ ID NO: 357258 - RNA, 21 nt, Human
aggccgaggcaggcggaucac

SEQ ID NO: 357259 - RNA, 23 nt, Human
aggccgaggcaggcggaucacga

SEQ ID NO: 357260 - RNA, 22 nt, Human
aggcggaucacgaggucaggag

SEQ ID NO: 357261 - RNA, 24 nt, Human
aguggcucacaccuguaaucccag

SEQ ID NO: 357262 - RNA, 20 nt, Human
aucaggaaugucgagaaaca

SEQ ID NO: 357263 - RNA, 22 nt, Human
augacacugcucauugggaaaa

SEQ ID NO: 357264 - RNA, 20 nt, Human
augauucccagagucaaacc

SEQ ID NO: 357265 - RNA, 23 nt, Human
caacauggugaaacccaucucua

SEQ ID NO: 357266 - RNA, 21 nt, Human
caagaaccagccucauaaccu

SEQ ID NO: 357267 - RNA, 24 nt, Human
cacaccuguaaucccagcacucug

SEQ ID NO: 357268 - RNA, 23 nt, Human
caccuguaaucccagcacucugg

SEQ ID NO: 357269 - RNA, 24 nt, Human
caccuguaaucccagcacucuggg

SEQ ID NO: 357270 - RNA, 18 nt, Human
cagaacaccgcacugaga

SEQ ID NO: 357271 - RNA, 24 nt, Human
cagagucaaacccaagaaccagcc

SEQ ID NO: 357272 - RNA, 24 nt, Human
cagcacucugggaggccgaggcag

SEQ ID NO: 357273 - RNA, 26 nt, Human
cagcacucugggaggccgaggcaggc

SEQ ID NO: 357274 - RNA, 20 nt, Human
cagcccggccaccgacaucu

SEQ ID NO: 357275 - RNA, 22 nt, Human
cccagagucaaacccaagaacc

SEQ ID NO: 357276 - RNA, 24 nt, Human
cgagaccauauuggccaacauggu

SEQ ID NO: 357277 - RNA, 24 nt, Human
cgaggcaggcggaucacgagguca

SEQ ID NO: 357278 - RNA, 23 nt, Human
cucacaccuguaaucccagcacu

SEQ ID NO: 357279 - RNA, 24 nt, Human
cucacaccuguaaucccagcacuc

SEQ ID NO: 357280 - RNA, 22 nt, Human
cuuaaaagcuccuucuuccuuu

SEQ ID NO: 357281 - RNA, 22 nt, Human
gaaaagaccagacgucaucagg

SEQ ID NO: 357282 - RNA, 25 nt, Human
gacaggaagcaaaaaagaagggacc

SEQ ID NO: 357283 - RNA, 21 nt, Human
gagaaacaaaauauuuagcau

SEQ ID NO: 357284 - RNA, 22 nt, Human
gagcacacuggugugaauucau

SEQ ID NO: 357285 - RNA, 19 nt, Human
gagcagcgccugcaggcag

SEQ ID NO: 357286 - RNA, 19 nt, Human
gcugggcacaguggcucac

SEQ ID NO: 357287 - RNA, 20 nt, Human
gcugggcacaguggcucaca

SEQ ID NO: 357288 - RNA, 22 nt, Human
ggacaggaagcaaaaaagaaaa

SEQ ID NO: 357289 - RNA, 23 nt, Human
ggcacaguggcucacaccuguaa

SEQ ID NO: 357290 - RNA, 24 nt, Human
ggccaacauggugaaacccaucuc

SEQ ID NO: 357291 - RNA, 19 nt, Human
uaaaauacauuauaaagag

SEQ ID NO: 357292 - RNA, 22 nt, Human
uacaaugaaaagaaaagaccag

SEQ ID NO: 357293 - RNA, 21 nt, Human
uagcauuucuuaguuucaaau

SEQ ID NO: 357294 - RNA, 19 nt, Human
uaggaaaagcagaucaaug

SEQ ID NO: 357295 - RNA, 23 nt, Human
uagguauucacugacaugauuag

SEQ ID NO: 357296 - RNA, 20 nt, Human
uagugagagaagaggcuggg

SEQ ID NO: 357297 - RNA, 18 nt, Human
uauugggcuauucacagg

SEQ ID NO: 357298 - RNA, 18 nt, Human
ucacgaggucaggagauc

SEQ ID NO: 357299 - RNA, 24 nt, Human
ucacgaggucaggagaucgagacc

SEQ ID NO: 357300 - RNA, 24 nt, Human
ucaggagaucgagaccauauuggc

SEQ ID NO: 357301 - RNA, 19 nt, Human
ucugcaggacccacaucca

SEQ ID NO: 357302 - RNA, 19 nt, Human
ugaaagacugguuagagcu

SEQ ID NO: 357303 - RNA, 18 nt, Human
ugagagaagaggcugggc

SEQ ID NO: 357304 - RNA, 20 nt, Human
uggccaacauggugaaaccc

SEQ ID NO: 357305 - RNA, 20 nt, Human
uggccaacauggugaaaccc

SEQ ID NO: 357306 - RNA, 21 nt, Human
uggccaacauggugaaaccca

SEQ ID NO: 357307 - RNA, 23 nt, Human
uggccaacauggugaaacccauc

SEQ ID NO: 357308 - RNA, 21 nt, Human
uggcucacaccuguaauccca

SEQ ID NO: 357309 - RNA, 22 nt, Human
uggcucacaccuguaaucccag

SEQ ID NO: 357310 - RNA, 24 nt, Human
uggcucacaccuguaaucccagca

SEQ ID NO: 357311 - RNA, 24 nt, Human
ugggagcagcgccugcaggcaggu

SEQ ID NO: 357312 - RNA, 20 nt, Human
ugggaggccgaggcaggcgg

SEQ ID NO: 357313 - RNA, 24 nt, Human
ugggaggccgaggcaggcggauca

SEQ ID NO: 357314 - RNA, 23 nt, Human
ugucacagaacaccgcacugaga

SEQ ID NO: 357315 - RNA, 23 nt, Human
uuagagcuggccucagguucugc

SEQ ID NO: 357316 - RNA, 22 nt, Human
uuaggacaggaagcaaaaaaga

SEQ ID NO: 357317 - RNA, 21 nt, Human
uuccuuuagcuuuauggugca

SEQ ID NO: 357318 - RNA, 21 nt, Human
aaaaaaaaaaacaaaaccaug

SEQ ID NO: 357319 - RNA, 22 nt, Human
aaaaagaauucugagaggcaga

SEQ ID NO: 357320 - RNA, 23 nt, Human
aaaacacccaaggcacacacuuu

SEQ ID NO: 357321 - RNA, 23 nt, Human
aaaagcacaaaaguaacagcaac

SEQ ID NO: 357322 - RNA, 22 nt, Human
aaagagguagcaaaauaaauua

SEQ ID NO: 357323 - RNA, 21 nt, Human
aaagcacacggaaguaaagcg

SEQ ID NO: 357324 - RNA, 19 nt, Human
aaagcagaggacggagguc

SEQ ID NO: 357325 - RNA, 22 nt, Human
aaagcgccuuaauauucaauug

SEQ ID NO: 357326 - RNA, 24 nt, Human
aaauggaaccaaggcagauuagcu

SEQ ID NO: 357327 - RNA, 21 nt, Human
aacaucuggcccucaccaacu

SEQ ID NO: 357328 - RNA, 22 nt, Human
aagaaacuuuaggaacuaaaga

SEQ ID NO: 357329 - RNA, 21 nt, Human
aagcacaaaaguaacagcaac

SEQ ID NO: 357330 - RNA, 24 nt, Human
aagcagaggacggaggucucagga

SEQ ID NO: 357331 - RNA, 18 nt, Human
aagccuuagcaugugguu

SEQ ID NO: 357332 - RNA, 22 nt, Human
acacaguaaaggcaaugcugaa

SEQ ID NO: 357333 - RNA, 18 nt, Human
acaccaccuccacggcca

SEQ ID NO: 357334 - RNA, 20 nt, Human
acaggacagugccccugggg

SEQ ID NO: 357335 - RNA, 20 nt, Human
acaguaaaggcaaugcugaa

SEQ ID NO: 357336 - RNA, 21 nt, Human
accaccccgcccacccucccg

SEQ ID NO: 357337 - RNA, 20 nt, Human
accacuuugaagaaauuguc

SEQ ID NO: 357338 - RNA, 23 nt, Human
accccgcccacccucccgcuuua

SEQ ID NO: 357339 - RNA, 20 nt, Human
accuccacggccacuuacug

SEQ ID NO: 357340 - RNA, 20 nt, Human
acuaaagacaacaaguuuuc

SEQ ID NO: 357341 - RNA, 20 nt, Human
acucucacagggcaagggcu

SEQ ID NO: 357342 - RNA, 18 nt, Human
acugaaguggcacaaagg

SEQ ID NO: 357343 - RNA, 23 nt, Human
agaaacacauuccaguucgccag

SEQ ID NO: 357344 - RNA, 21 nt, Human
agacaaauacgcagcuuuccc

SEQ ID NO: 357345 - RNA, 18 nt, Human
agacaaauuaauggccaa

SEQ ID NO: 357346 - RNA, 18 nt, Human
agagcaaaaggacugucu

SEQ ID NO: 357347 - RNA, 21 nt, Human
agagcuugagggugaacuaca

SEQ ID NO: 357348 - RNA, 22 nt, Human
agaggagacgcugucucacugg

SEQ ID NO: 357349 - RNA, 26 nt, Human
agaggcccagggcucagaauuccuga

SEQ ID NO: 357350 - RNA, 20 nt, Human
agaggcugcugcucaacugg

SEQ ID NO: 357351 - RNA, 18 nt, Human
agaugacagaagccaccc

SEQ ID NO: 357352 - RNA, 20 nt, Human
agcaaagauagaaaauauaa

SEQ ID NO: 357353 - RNA, 21 nt, Human
agccagcuugcuugugguuag

SEQ ID NO: 357354 - RNA, 18 nt, Human
agcugcccggaaagcaga

SEQ ID NO: 357355 - RNA, 20 nt, Human
aggaaaaaaaaaaaacaaaa

SEQ ID NO: 357356 - RNA, 22 nt, Human
aggaaauggaaccaaggcagau

SEQ ID NO: 357357 - RNA, 21 nt, Human
agggacuccggggaaagaaag

SEQ ID NO: 357358 - RNA, 26 nt, Human
agggacuccggggaaagaaaggggcg

SEQ ID NO: 357359 - RNA, 18 nt, Human
aggggaaaagccucuaag

SEQ ID NO: 357360 - RNA, 18 nt, Human
aguggaaucaauggacag

SEQ ID NO: 357361 - RNA, 22 nt, Human
aguuccagaguggaaucaaugg

SEQ ID NO: 357362 - RNA, 18 nt, Human
aguugaucuuaaaaccug

SEQ ID NO: 357363 - RNA, 18 nt, Human
auaaaaccaaaaaccuga

SEQ ID NO: 357364 - RNA, 22 nt, Human
auacuuuuauaauuauuccaca

SEQ ID NO: 357365 - RNA, 24 nt, Human
aucaauauuguggcccacacacaa

SEQ ID NO: 357366 - RNA, 21 nt, Human
auuacaggagcuuuuuuuuuu

SEQ ID NO: 357367 - RNA, 21 nt, Human
auuuccagaacacacaggaca

SEQ ID NO: 357368 - RNA, 19 nt, Human
auuuguuggucagugcagg

SEQ ID NO: 357369 - RNA, 21 nt, Human
caaaacacccaaggcacacac

SEQ ID NO: 357370 - RNA, 22 nt, Human
caaaacacccaaggcacacacu

SEQ ID NO: 357371 - RNA, 21 nt, Human
caaaauaagcagauagagaua

SEQ ID NO: 357372 - RNA, 25 nt, Human
caagacaaauacgcagcuuucccug

SEQ ID NO: 357373 - RNA, 19 nt, Human
caagaugacagaagccacc

SEQ ID NO: 357374 - RNA, 20 nt, Human
caagaugacagaagccaccc

SEQ ID NO: 357375 - RNA, 22 nt, Human
caaucagaaccacaaccuuagu

SEQ ID NO: 357376 - RNA, 22 nt, Human
caccaauacagcauggauuaga

SEQ ID NO: 357377 - RNA, 20 nt, Human
caccaccccgcccacccucc

SEQ ID NO: 357378 - RNA, 26 nt, Human
caccccgcccacccucccgcuuuacc

SEQ ID NO: 357379 - RNA, 22 nt, Human
cacccucccgcuuuacccugcu

SEQ ID NO: 357380 - RNA, 21 nt, Human
cacuggcagccgcaugugccc

SEQ ID NO: 357381 - RNA, 19 nt, Human
cagaagguccaaaaacuug

SEQ ID NO: 357382 - RNA, 18 nt, Human
cagagucccaggguugcc

SEQ ID NO: 357383 - RNA, 21 nt, Human
cagcaacauagauaaugcgaa

SEQ ID NO: 357384 - RNA, 24 nt, Human
cagcagcccagaggcauuuccaga

SEQ ID NO: 357385 - RNA, 21 nt, Human
caggaacgauaaacaaaauca

SEQ ID NO: 357386 - RNA, 24 nt, Human
cagggaacccacuuacccuuccca

SEQ ID NO: 357387 - RNA, 23 nt, Human
caguccugucugcaugcagcugc

SEQ ID NO: 357388 - RNA, 23 nt, Human
cagugcagguucugauaggucua

SEQ ID NO: 357389 - RNA, 20 nt, Human
caugccggggccuggggugg

SEQ ID NO: 357390 - RNA, 23 nt, Human
cauggaauagggccucguccuaa

SEQ ID NO: 357391 - RNA, 22 nt, Human
cauguuguggacacaacucagu

SEQ ID NO: 357392 - RNA, 20 nt, Human
ccaaacucccagcacugcca

SEQ ID NO: 357393 - RNA, 25 nt, Human
ccagaacacacaggacagugccccc

SEQ ID NO: 357394 - RNA, 21 nt, Human
ccaggguugccuccacaacuc

SEQ ID NO: 357395 - RNA, 26 nt, Human
cccaaccacccuuggaaguacaucug

SEQ ID NO: 357396 - RNA, 19 nt, Human
cccacaaagcacgggcagu

SEQ ID NO: 357397 - RNA, 19 nt, Human
cccacccucuggugggugg

SEQ ID NO: 357398 - RNA, 23 nt, Human
cccauccaaacucccagcacugc

SEQ ID NO: 357399 - RNA, 20 nt, Human
cccgcccagcucccagagga

SEQ ID NO: 357400 - RNA, 24 nt, Human
cccuucccacccugagcagggcag

SEQ ID NO: 357401 - RNA, 20 nt, Human
ccggggaaagaaaggggcgg

SEQ ID NO: 357402 - RNA, 22 nt, Human
ccuacaguuauccaccugagac

SEQ ID NO: 357403 - RNA, 20 nt, Human
ccuaguagaccagccacuuu

SEQ ID NO: 357404 - RNA, 18 nt, Human
ccucauggccaaagagcc

SEQ ID NO: 357405 - RNA, 22 nt, Human
ccuccacggccacuuacugccu

SEQ ID NO: 357406 - RNA, 21 nt, Human
ccuucuguucucaacccuggg

SEQ ID NO: 357407 - RNA, 24 nt, Human
cgagagcaaaaggacugucucagc

SEQ ID NO: 357408 - RNA, 23 nt, Human
cgcaccaccccgcccacccuccc

SEQ ID NO: 357409 - RNA, 23 nt, Human
cgccaaggcaacugugagaggcc

SEQ ID NO: 357410 - RNA, 21 nt, Human
cgcuuuacccugcuggaauua

SEQ ID NO: 357411 - RNA, 19 nt, Human
cuccacggccacuuacugc

SEQ ID NO: 357412 - RNA, 18 nt, Human
cuccccuccauuguggaa

SEQ ID NO: 357413 - RNA, 20 nt, Human
cucgcaccaccccgcccacc

SEQ ID NO: 357414 - RNA, 24 nt, Human
cugagacucacaagcacgcugcgc

SEQ ID NO: 357415 - RNA, 19 nt, Human
cugcaugcagcugcugugg

SEQ ID NO: 357416 - RNA, 24 nt, Human
cuggcagggccuugcugggguggg

SEQ ID NO: 357417 - RNA, 20 nt, Human
cuggugguggcuggggaaug

SEQ ID NO: 357418 - RNA, 21 nt, Human
cuuggccaggucuccccucca

SEQ ID NO: 357419 - RNA, 18 nt, Human
gaaagaaaggggcggggc

SEQ ID NO: 357420 - RNA, 20 nt, Human
gaaaggaaggcaguuuucug

SEQ ID NO: 357421 - RNA, 22 nt, Human
gaaauucucugauuccccacaa

SEQ ID NO: 357422 - RNA, 19 nt, Human
gaaccacaaccuuagugca

SEQ ID NO: 357423 - RNA, 22 nt, Human
gaacccacuuacccuucccacc

SEQ ID NO: 357424 - RNA, 20 nt, Human
gacacccacauggugagcca

SEQ ID NO: 357425 - RNA, 22 nt, Human
gacuguguauuuuccacagucu

SEQ ID NO: 357426 - RNA, 18 nt, Human
gagcaaaaggacugucuc

SEQ ID NO: 357427 - RNA, 18 nt, Human
gagcagucugcgaggugg

SEQ ID NO: 357428 - RNA, 21 nt, Human
gagcagucugcgagguggaga

SEQ ID NO: 357429 - RNA, 20 nt, Human
gagcuggccacaaugccuga

SEQ ID NO: 357430 - RNA, 19 nt, Human
gaggacggaggucucagga

SEQ ID NO: 357431 - RNA, 23 nt, Human
gaguggaaucaauggacagggau

SEQ ID NO: 357432 - RNA, 18 nt, Human
gauccugccgcccaccuu

SEQ ID NO: 357433 - RNA, 21 nt, Human
gaugacagaagccacccuaga

SEQ ID NO: 357434 - RNA, 25 nt, Human
gcaucagguguccucugagaggcca

SEQ ID NO: 357435 - RNA, 21 nt, Human
gcauggauuagaaaucaaagu

SEQ ID NO: 357436 - RNA, 18 nt, Human
gccaagugcaggagaaag

SEQ ID NO: 357437 - RNA, 21 nt, Human
gcccacccucccgcuuuaccc

SEQ ID NO: 357438 - RNA, 18 nt, Human
gcguguguguggugugug

SEQ ID NO: 357439 - RNA, 25 nt, Human
gcucgcaccaccccgcccacccucc

SEQ ID NO: 357440 - RNA, 21 nt, Human
gcuggggaaugcagggaaccc

SEQ ID NO: 357441 - RNA, 18 nt, Human
gcuguuguacuguuaaga

SEQ ID NO: 357442 - RNA, 26 nt, Human
ggaauuuuuccugaacguggaagcau

SEQ ID NO: 357443 - RNA, 26 nt, Human
gggagcuuuaagcacagcagacacca

SEQ ID NO: 357444 - RNA, 22 nt, Human
gggcagggugggggaggggggu

SEQ ID NO: 357445 - RNA, 18 nt, Human
ggggugggacgccaaggc

SEQ ID NO: 357446 - RNA, 18 nt, Human
gggugggggagggggguu

SEQ ID NO: 357447 - RNA, 20 nt, Human
gggugggggagggggguugg

SEQ ID NO: 357448 - RNA, 26 nt, Human
ggucaguuuuagagaggcagagcugg

SEQ ID NO: 357449 - RNA, 24 nt, Human
guaucuuggcagguauacauaauu

SEQ ID NO: 357450 - RNA, 23 nt, Human
guauuccaaauuuaacauacucc

SEQ ID NO: 357451 - RNA, 23 nt, Human
guuuuguuuuuguuuuuggagaa

SEQ ID NO: 357452 - RNA, 22 nt, Human
uaaaaauaaacuauguuaucag

SEQ ID NO: 357453 - RNA, 19 nt, Human
uaaaagcacaaaaguaaca

SEQ ID NO: 357454 - RNA, 21 nt, Human
uaaacaaaaucaccaauacag

SEQ ID NO: 357455 - RNA, 27 nt, Human
uaaauuacuugaaaugaaaaaaagucc

SEQ ID NO: 357456 - RNA, 23 nt, Human
uaacaagagcagucugcgaggug

SEQ ID NO: 357457 - RNA, 23 nt, Human
uaacauuuguuccaccauuaaag

SEQ ID NO: 357458 - RNA, 27 nt, Human
uaacugggcuucaagaugacagaagcc

SEQ ID NO: 357459 - RNA, 26 nt, Human
uaagggaaggguccggaucuggcugg

SEQ ID NO: 357460 - RNA, 21 nt, Human
uaagguucacuaaccugauag

SEQ ID NO: 357461 - RNA, 22 nt, Human
uaauaauaaaaccaaaaaccug

SEQ ID NO: 357462 - RNA, 24 nt, Human
uacucgaugagagagauuuuucug

SEQ ID NO: 357463 - RNA, 18 nt, Human
uauaacaagagcagucug

SEQ ID NO: 357464 - RNA, 22 nt, Human
ucaaagggucaagugugaccuu

SEQ ID NO: 357465 - RNA, 22 nt, Human
uccaaauaagguugauuuaaaa

SEQ ID NO: 357466 - RNA, 22 nt, Human
uccaaauuuaacauacuccuug

SEQ ID NO: 357467 - RNA, 19 nt, Human
uccacggccacuuacugcc

SEQ ID NO: 357468 - RNA, 19 nt, Human
uccaugugacaucugcuug

SEQ ID NO: 357469 - RNA, 19 nt, Human
ucccgcuuuacccugcugg

SEQ ID NO: 357470 - RNA, 21 nt, Human
ucccuagugggcaaggccagg

SEQ ID NO: 357471 - RNA, 24 nt, Human
ucccuagugggcaaggccagguuc

SEQ ID NO: 357472 - RNA, 22 nt, Human
ucccugcuuuccucuccucacg

SEQ ID NO: 357473 - RNA, 21 nt, Human
ucccuggccuccgagagcaaa

SEQ ID NO: 357474 - RNA, 21 nt, Human
uccgcggcaccgcugcuucca

SEQ ID NO: 357475 - RNA, 20 nt, Human
uccugaacguggaagcauag

SEQ ID NO: 357476 - RNA, 23 nt, Human
uccuugugggaggacauuuuggc

SEQ ID NO: 357477 - RNA, 27 nt, Human
uccuuuuuuuuuuucuuuucuguguuu

SEQ ID NO: 357478 - RNA, 25 nt, Human
ucgcaccaccccgcccacccucccg

SEQ ID NO: 357479 - RNA, 19 nt, Human
ucucacagggcaagggccu

SEQ ID NO: 357480 - RNA, 18 nt, Human
ucucuauaauaagacagu

SEQ ID NO: 357481 - RNA, 19 nt, Human
ucugagaggccacaggacu

SEQ ID NO: 357482 - RNA, 20 nt, Human
ucugcugagcucauacucca

SEQ ID NO: 357483 - RNA, 25 nt, Human
ugacaggagccuguuuacucgauga

SEQ ID NO: 357484 - RNA, 18 nt, Human
ugacauucgaguauccuc

SEQ ID NO: 357485 - RNA, 20 nt, Human
ugacuaacuccaugugacau

SEQ ID NO: 357486 - RNA, 18 nt, Human
ugagaaaaaaauuuacca

SEQ ID NO: 357487 - RNA, 21 nt, Human
ugagcucauacuccaggccug

SEQ ID NO: 357488 - RNA, 19 nt, Human
ugaggaacuauugcuuuca

SEQ ID NO: 357489 - RNA, 27 nt, Human
ugaggccaaagaagaaguucaacguuu

SEQ ID NO: 357490 - RNA, 24 nt, Human
ugaguaauuuuuauauuaugugaa

SEQ ID NO: 357491 - RNA, 21 nt, Human
ugauaugggcuucucaguuca

SEQ ID NO: 357492 - RNA, 21 nt, Human
ugcagaucagguucaaaacac

SEQ ID NO: 357493 - RNA, 21 nt, Human
ugccuacaguuauccaccuga

SEQ ID NO: 357494 - RNA, 24 nt, Human
ugcucuuguccuggagaccuggag

SEQ ID NO: 357495 - RNA, 18 nt, Human
ugcugguucagaugcauc

SEQ ID NO: 357496 - RNA, 20 nt, Human
uggaaccaaggcagauuagc

SEQ ID NO: 357497 - RNA, 18 nt, Human
uggaagcaaagucuaggg

SEQ ID NO: 357498 - RNA, 22 nt, Human
uggagggacuccggggaaagaa

SEQ ID NO: 357499 - RNA, 21 nt, Human
uggauuagaaaucaaagugau

SEQ ID NO: 357500 - RNA, 20 nt, Human
uggcagccgcaugugcccgc

SEQ ID NO: 357501 - RNA, 19 nt, Human
uggcauguggcuuggagua

SEQ ID NO: 357502 - RNA, 21 nt, Human
uggcauguggcuuggaguauc

SEQ ID NO: 357503 - RNA, 19 nt, Human
uggccaaagagccauggau

SEQ ID NO: 357504 - RNA, 22 nt, Human
uggcucgcaccaccccgcccac

SEQ ID NO: 357505 - RNA, 22 nt, Human
uggcuggggaaugcaggggagc

SEQ ID NO: 357506 - RNA, 18 nt, Human
ugggaaaaucaauauugu

SEQ ID NO: 357507 - RNA, 20 nt, Human
ugggaaaaucaauauugugg

SEQ ID NO: 357508 - RNA, 20 nt, Human
ugggcacagaacugaggaug

SEQ ID NO: 357509 - RNA, 22 nt, Human
ugggcaguugcacgcuggcugg

SEQ ID NO: 357510 - RNA, 23 nt, Human
uggggugggacgccaaggcaacu

SEQ ID NO: 357511 - RNA, 22 nt, Human
uggguccucaaagaagcuguug

SEQ ID NO: 357512 - RNA, 20 nt, Human
uggguggugauuugaaugag

SEQ ID NO: 357513 - RNA, 19 nt, Human
uggugaggccaaagaagaa

SEQ ID NO: 357514 - RNA, 20 nt, Human
ugguguguguuuuguuuuug

SEQ ID NO: 357515 - RNA, 25 nt, Human
ugguuugcuugucaaccagagaggc

SEQ ID NO: 357516 - RNA, 20 nt, Human
uguaaaguucagcaaaucaa

SEQ ID NO: 357517 - RNA, 24 nt, Human
ugugacauuaagaagaaaggaagg

SEQ ID NO: 357518 - RNA, 18 nt, Human
ugugcuuauaaacuaucu

SEQ ID NO: 357519 - RNA, 20 nt, Human
ugugguuaguggcauguggc

SEQ ID NO: 357520 - RNA, 22 nt, Human
uguguaggaaaaaguuucucug

SEQ ID NO: 357521 - RNA, 26 nt, Human
uguuacacaaacuauagugugaaaca

SEQ ID NO: 357522 - RNA, 20 nt, Human
uuacccuucccacccugagc

SEQ ID NO: 357523 - RNA, 20 nt, Human
uucaagaugacagaagccac

SEQ ID NO: 357524 - RNA, 18 nt, Human
uucauucuagagcuguuc

SEQ ID NO: 357525 - RNA, 21 nt, Human
uucccugaguuugcuggugca

SEQ ID NO: 357526 - RNA, 22 nt, Human
uugcagaaauaaagaaagcuaa

SEQ ID NO: 357527 - RNA, 19 nt, Human
uuggagaaacugcugcauu

SEQ ID NO: 357528 - RNA, 21 nt, Human
uuggcugggcacagaacugag

SEQ ID NO: 357529 - RNA, 24 nt, Human
uuuaaacuugcaguaaagaaagau

SEQ ID NO: 357530 - RNA, 21 nt, Human
uuuauaauuauuccacagaaa

SEQ ID NO: 357531 - RNA, 18 nt, Human
uuucgagaccugacccaa

SEQ ID NO: 357532 - RNA, 21 nt, Human
uuuggagaaacugcugcauua

SEQ ID NO: 357533 - RNA, 22 nt, Human
uuugugcuuugacuaacuccau

SEQ ID NO: 357534 - RNA, 24 nt, Human
uuuuccacagucuuaugaugagaa

SEQ ID NO: 357535 - RNA, 24 nt, Human
uuuuucuggucaguuuuagagagg

SEQ ID NO: 357536 - RNA, 21 nt, Human
acaacacaaacgacacagcca

SEQ ID NO: 357537 - RNA, 18 nt, Human
acacaacacaaacgacac

SEQ ID NO: 357538 - RNA, 22 nt, Human
acacaacacaaacgacacagcc

SEQ ID NO: 357539 - RNA, 21 nt, Human
acacacaacacaaacgacaca

SEQ ID NO: 357540 - RNA, 23 nt, Human
aggcagccggcgcccgccggagc

SEQ ID NO: 357541 - RNA, 22 nt, Human
caagucuccaggcucugucaca

SEQ ID NO: 357542 - RNA, 27 nt, Human
cacaacacaaacgacacagccagcaac

SEQ ID NO: 357543 - RNA, 23 nt, Human
cacacaacacaaacgacacagcc

SEQ ID NO: 357544 - RNA, 25 nt, Human
cacacaacacaaacgacacagccag

SEQ ID NO: 357545 - RNA, 18 nt, Human
cagcaacaguggcugggg

SEQ ID NO: 357546 - RNA, 21 nt, Human
cagcauucuagagacaugcag

SEQ ID NO: 357547 - RNA, 24 nt, Human
ccacgccgcggacccuuuggccgu

SEQ ID NO: 357548 - RNA, 19 nt, Human
ccgcagccuccgccuuggc

SEQ ID NO: 357549 - RNA, 21 nt, Human
ccggagcccgcgcgcccgugc

SEQ ID NO: 357550 - RNA, 23 nt, Human
ccucuggcaccuccaagucucca

SEQ ID NO: 357551 - RNA, 18 nt, Human
cgacacagccagcaacag

SEQ ID NO: 357552 - RNA, 22 nt, Human
cgcagcggaggagaaugcggcc

SEQ ID NO: 357553 - RNA, 18 nt, Human
cgccggagcccgcgcgcc

SEQ ID NO: 357554 - RNA, 22 nt, Human
cgccggagcccgcgcgcccgug

SEQ ID NO: 357555 - RNA, 24 nt, Human
cgggagagacagcgagcgacggag

SEQ ID NO: 357556 - RNA, 23 nt, Human
cugucacagagcagggcaggucu

SEQ ID NO: 357557 - RNA, 23 nt, Human
cuuuauccaggccuccagccccc

SEQ ID NO: 357558 - RNA, 19 nt, Human
cuuuggccguacgccccuc

SEQ ID NO: 357559 - RNA, 19 nt, Human
gagaaugcggccgggagag

SEQ ID NO: 357560 - RNA, 21 nt, Human
gagacagcgagcgacggagga

SEQ ID NO: 357561 - RNA, 21 nt, Human
gagccgcagccuccgccuugg

SEQ ID NO: 357562 - RNA, 23 nt, Human
gagcucggccccgcagcggagga

SEQ ID NO: 357563 - RNA, 19 nt, Human
gaggaaggcagccggcgcc

SEQ ID NO: 357564 - RNA, 23 nt, Human
gaggagaaugcggccgggagaga

SEQ ID NO: 357565 - RNA, 22 nt, Human
gccgggauccgcggcugccgcg

SEQ ID NO: 357566 - RNA, 23 nt, Human
gcggccgggagagacagcgagcg

SEQ ID NO: 357567 - RNA, 23 nt, Human
gcugggggcugguuggugggggg

SEQ ID NO: 357568 - RNA, 26 nt, Human
ggcugggggcugguugguggggggcc

SEQ ID NO: 357569 - RNA, 19 nt, Human
gggccucuggcaccuccaa

SEQ ID NO: 357570 - RNA, 23 nt, Human
gggccucuggcaccuccaagucu

SEQ ID NO: 357571 - RNA, 18 nt, Human
ggggcugguugguggggg

SEQ ID NO: 357572 - RNA, 22 nt, Human
uccacgccgcggacccuuuggc

SEQ ID NO: 357573 - RNA, 21 nt, Human
ucggcguccucggcucccuuc

SEQ ID NO: 357574 - RNA, 20 nt, Human
uggcaccuccaagucuccag

SEQ ID NO: 357575 - RNA, 20 nt, Human
uggcugggggcugguuggug

SEQ ID NO: 357576 - RNA, 21 nt, Human
ugggggcugguuggugggggg

SEQ ID NO: 357577 - RNA, 22 nt, Human
ugguugguggggggccucuggc

SEQ ID NO: 357578 - RNA, 22 nt, Human
ugucacagagcagggcaggucu

SEQ ID NO: 357579 - RNA, 20 nt, Human
uuccuuccugcgagcgcugg

SEQ ID NO: 357580 - RNA, 19 nt, Human
aaaaugccaagagcuguaa

SEQ ID NO: 357581 - RNA, 19 nt, Human
aaaaugccaagagcuguaa

SEQ ID NO: 357582 - RNA, 21 nt, Human
aaacagcaaaaggaggccagg

SEQ ID NO: 357583 - RNA, 22 nt, Human
aaacauccaaacagcaaaagga

SEQ ID NO: 357584 - RNA, 18 nt, Human
aaaguuuaaacauggggg

SEQ ID NO: 357585 - RNA, 21 nt, Human
aagaacacaggucccagaagc

SEQ ID NO: 357586 - RNA, 24 nt, Human
aagagacccaaguuuuucuagucc

SEQ ID NO: 357587 - RNA, 24 nt, Human
aagagacccaaguuuuucuagucc

SEQ ID NO: 357588 - RNA, 18 nt, Human
aagcacucaccuucuugg

SEQ ID NO: 357589 - RNA, 18 nt, Human
aaggguugcauaucccca

SEQ ID NO: 357590 - RNA, 25 nt, Human
aaguuuuucuaguccuagauggaaa

SEQ ID NO: 357591 - RNA, 25 nt, Human
aaguuuuucuaguccuagauggaaa

SEQ ID NO: 357592 - RNA, 21 nt, Human
acaaggccaagcccacagaac

SEQ ID NO: 357593 - RNA, 20 nt, Human
acagaacacucccaaacgag

SEQ ID NO: 357594 - RNA, 21 nt, Human
acccagaguccaugcuacucc

SEQ ID NO: 357595 - RNA, 20 nt, Human
acuccugccucuguuauccc

SEQ ID NO: 357596 - RNA, 22 nt, Human
agaacacucccaaacgaggucc

SEQ ID NO: 357597 - RNA, 18 nt, Human
agacccguggaaacaucc

SEQ ID NO: 357598 - RNA, 21 nt, Human
agcaagaacacaggucccaga

SEQ ID NO: 357599 - RNA, 18 nt, Human
agcugccacuccugccuc

SEQ ID NO: 357600 - RNA, 21 nt, Human
aggaaaggcccaggugagggg

SEQ ID NO: 357601 - RNA, 20 nt, Human
aggaagggcugcacuuuggc

SEQ ID NO: 357602 - RNA, 22 nt, Human
aggccaaaagagggggggccgg

SEQ ID NO: 357603 - RNA, 21 nt, Human
agggagagggacaaguggcuu

SEQ ID NO: 357604 - RNA, 23 nt, Human
agguacucaggaacugcagguuu

SEQ ID NO: 357605 - RNA, 24 nt, Human
agucacagaaguccuggggaggga

SEQ ID NO: 357606 - RNA, 21 nt, Human
augaaacccagaguccaugcu

SEQ ID NO: 357607 - RNA, 22 nt, Human
augaaauguauauacagacccc

SEQ ID NO: 357608 - RNA, 22 nt, Human
caagaacacaggucccagaagc

SEQ ID NO: 357609 - RNA, 23 nt, Human
caagaacacaggucccagaagcc

SEQ ID NO: 357610 - RNA, 22 nt, Human
caaggccaagcccacagaacac

SEQ ID NO: 357611 - RNA, 26 nt, Human
caaggccaagcccacagaacacuccu

SEQ ID NO: 357612 - RNA, 22 nt, Human
cacaaggccaagcccacagaac

SEQ ID NO: 357613 - RNA, 25 nt, Human
cacagaacacucccaaacgaggucc

SEQ ID NO: 357614 - RNA, 19 nt, Human
caccacaggacauuuucca

SEQ ID NO: 357615 - RNA, 23 nt, Human
caccccgggccuaggcugggccg

SEQ ID NO: 357616 - RNA, 28 nt, Human
cagaacacucccaaacgaggucccgaag

SEQ ID NO: 357617 - RNA, 20 nt, Human
cagaguacauaggcaugcaa

SEQ ID NO: 357618 - RNA, 24 nt, Human
cagcaagaacacaggucccagaag

SEQ ID NO: 357619 - RNA, 18 nt, Human
caggucucugguauaaaa

SEQ ID NO: 357620 - RNA, 18 nt, Human
caggucucugguauaaaa

SEQ ID NO: 357621 - RNA, 24 nt, Human
cauccaaacagcaaaaggaggcca

SEQ ID NO: 357622 - RNA, 18 nt, Human
cccacagaacacucccaa

SEQ ID NO: 357623 - RNA, 19 nt, Human
cccacagaacacucccaaa

SEQ ID NO: 357624 - RNA, 20 nt, Human
cccacagaacacucccaaac

SEQ ID NO: 357625 - RNA, 21 nt, Human
cccacagaacacucccaaacg

SEQ ID NO: 357626 - RNA, 21 nt, Human
cccaccccgcccucccagaaa

SEQ ID NO: 357627 - RNA, 20 nt, Human
ccccaccccgcccucccaga

SEQ ID NO: 357628 - RNA, 20 nt, Human
ccccugccaguuugggcaag

SEQ ID NO: 357629 - RNA, 25 nt, Human
ccccuugcccagaagggugacuguu

SEQ ID NO: 357630 - RNA, 22 nt, Human
cccguggaaacauccaaacagc

SEQ ID NO: 357631 - RNA, 21 nt, Human
ccgggaguggggcucuggggc

SEQ ID NO: 357632 - RNA, 19 nt, Human
cgcuccccagcucagaccc

SEQ ID NO: 357633 - RNA, 18 nt, Human
cuaggcgaggaaaaugcc

SEQ ID NO: 357634 - RNA, 18 nt, Human
cuaggcgaggaaaaugcc

SEQ ID NO: 357635 - RNA, 21 nt, Human
cucaccuccacaaaauccacc

SEQ ID NO: 357636 - RNA, 24 nt, Human
cucagcaagaacacaggucccaga

SEQ ID NO: 357637 - RNA, 18 nt, Human
cucccgccuggccgggag

SEQ ID NO: 357638 - RNA, 21 nt, Human
cuguuccacugggccugucac

SEQ ID NO: 357639 - RNA, 23 nt, Human
cuucuuggggaaggggcaucagg

SEQ ID NO: 357640 - RNA, 20 nt, Human
gaaaggcccaggugaggggc

SEQ ID NO: 357641 - RNA, 23 nt, Human
gaagaauucagggguccaagaac

SEQ ID NO: 357642 - RNA, 20 nt, Human
gacaggcauucgggcugacu

SEQ ID NO: 357643 - RNA, 21 nt, Human
gacccaaguuuuucuaguccu

SEQ ID NO: 357644 - RNA, 21 nt, Human
gacccaaguuuuucuaguccu

SEQ ID NO: 357645 - RNA, 19 nt, Human
gacccagacaguuucaggc

SEQ ID NO: 357646 - RNA, 22 nt, Human
gacccagacaguuucaggcccc

SEQ ID NO: 357647 - RNA, 22 nt, Human
gaggaagggcugcacuuuggcg

SEQ ID NO: 357648 - RNA, 18 nt, Human
gaggccaggaugaaaacg

SEQ ID NO: 357649 - RNA, 24 nt, Human
gagggagagggacaaguggcuucc

SEQ ID NO: 357650 - RNA, 18 nt, Human
gagggggggccggcuugc

SEQ ID NO: 357651 - RNA, 20 nt, Human
gaguacauaggcaugcaaca

SEQ ID NO: 357652 - RNA, 24 nt, Human
gcacucaccuucuuggggaagggg

SEQ ID NO: 357653 - RNA, 21 nt, Human
gccuaggcugggccgggccug

SEQ ID NO: 357654 - RNA, 22 nt, Human
gcggguguugagaggggucugg

SEQ ID NO: 357655 - RNA, 18 nt, Human
gcugcugcccagccuggc

SEQ ID NO: 357656 - RNA, 23 nt, Human
gcuggauaugaaacccagagucc

SEQ ID NO: 357657 - RNA, 22 nt, Human
ggacaaguggcuuccgcucccc

SEQ ID NO: 357658 - RNA, 18 nt, Human
ggccaggcaggggguauc

SEQ ID NO: 357659 - RNA, 18 nt, Human
gggaauaggguggaaagg

SEQ ID NO: 357660 - RNA, 18 nt, Human
gggagggcaggccuuaug

SEQ ID NO: 357661 - RNA, 19 nt, Human
gggauacccugaagcccag

SEQ ID NO: 357662 - RNA, 20 nt, Human
gggcggguguugagaggggu

SEQ ID NO: 357663 - RNA, 20 nt, Human
gggcugcugcccagccuggc

SEQ ID NO: 357664 - RNA, 26 nt, Human
gggcugcugcccagccuggccccccu

SEQ ID NO: 357665 - RNA, 18 nt, Human
ggggaaggggcaucaggu

SEQ ID NO: 357666 - RNA, 21 nt, Human
gguauccccaggcccuuaccc

SEQ ID NO: 357667 - RNA, 19 nt, Human
gucacagaaguccugggga

SEQ ID NO: 357668 - RNA, 21 nt, Human
guuggcacaggaaaggcccag

SEQ ID NO: 357669 - RNA, 18 nt, Human
guuuugcguuuccccucc

SEQ ID NO: 357670 - RNA, 25 nt, Human
uaaaagggcuuggaaaagucaaaaa

SEQ ID NO: 357671 - RNA, 25 nt, Human
uaaaagggcuuggaaaagucaaaaa

SEQ ID NO: 357672 - RNA, 23 nt, Human
uaaaauauaugcauauaaaacuu

SEQ ID NO: 357673 - RNA, 22 nt, Human
uaaaauaucauuagaccuaaga

SEQ ID NO: 357674 - RNA, 19 nt, Human
uaagcaauggaaaagaaaa

SEQ ID NO: 357675 - RNA, 19 nt, Human
uacauaggcaugcaacaug

SEQ ID NO: 357676 - RNA, 20 nt, Human
uacccugguuggaccucugu

SEQ ID NO: 357677 - RNA, 23 nt, Human
ucaaugccccuuuucucaccucc

SEQ ID NO: 357678 - RNA, 23 nt, Human
ucagacccagacaguuucaggcc

SEQ ID NO: 357679 - RNA, 19 nt, Human
ucaggaacugcagguuuug

SEQ ID NO: 357680 - RNA, 24 nt, Human
ucagucacccccaccccgcccucc

SEQ ID NO: 357681 - RNA, 20 nt, Human
ucauuagaccuaagagaugg

SEQ ID NO: 357682 - RNA, 19 nt, Human
ucauugaagaauucagggg

SEQ ID NO: 357683 - RNA, 19 nt, Human
uccacugggccugucacca

SEQ ID NO: 357684 - RNA, 21 nt, Human
uccccaggcccuuacccuggu

SEQ ID NO: 357685 - RNA, 19 nt, Human
ucccccuugcccagaaggg

SEQ ID NO: 357686 - RNA, 20 nt, Human
ucugccucucagucucgcgg

SEQ ID NO: 357687 - RNA, 23 nt, Human
ucuguacauuaauacuuugguga

SEQ ID NO: 357688 - RNA, 21 nt, Human
ucuguuaucccaacccaaacc

SEQ ID NO: 357689 - RNA, 18 nt, Human
ugaagaguuuucccuuug

SEQ ID NO: 357690 - RNA, 18 nt, Human
ugacacaaggccaagccc

SEQ ID NO: 357691 - RNA, 20 nt, Human
ugacucaaacccucucacuc

SEQ ID NO: 357692 - RNA, 21 nt, Human
ugacuucugccucucagucuc

SEQ ID NO: 357693 - RNA, 21 nt, Human
ugacuucugccucucagucuc

SEQ ID NO: 357694 - RNA, 23 nt, Human
ugagacccguggaaacauccaaa

SEQ ID NO: 357695 - RNA, 21 nt, Human
ugaggugaaagaggggcugcu

SEQ ID NO: 357696 - RNA, 22 nt, Human
ugaggugaaagaggggcugcug

SEQ ID NO: 357697 - RNA, 21 nt, Human
ugauuaauguuuggggagagg

SEQ ID NO: 357698 - RNA, 19 nt, Human
ugcaacaugggagggcagg

SEQ ID NO: 357699 - RNA, 18 nt, Human
ugccucaggucucuggua

SEQ ID NO: 357700 - RNA, 18 nt, Human
ugccucaggucucuggua

SEQ ID NO: 357701 - RNA, 22 nt, Human
uggaaacauccaaacagcaaaa

SEQ ID NO: 357702 - RNA, 20 nt, Human
uggaagagagcgcuagggca

SEQ ID NO: 357703 - RNA, 18 nt, Human
uggaccucuguggcccag

SEQ ID NO: 357704 - RNA, 25 nt, Human
uggauaugaaacccagaguccaugc

SEQ ID NO: 357705 - RNA, 23 nt, Human
uggggaaggggcaucagguuggc

SEQ ID NO: 357706 - RNA, 19 nt, Human
uggggagaggcaggauucu

SEQ ID NO: 357707 - RNA, 21 nt, Human
uggggagggagagggacaagu

SEQ ID NO: 357708 - RNA, 23 nt, Human
uggggagggagagggacaagugg

SEQ ID NO: 357709 - RNA, 21 nt, Human
uggggcucuggggcaaucucu

SEQ ID NO: 357710 - RNA, 22 nt, Human
uggggggggcggguguugagag

SEQ ID NO: 357711 - RNA, 19 nt, Human
uggucaaaggcacaaaguu

SEQ ID NO: 357712 - RNA, 19 nt, Human
uuaauguuuggggagaggc

SEQ ID NO: 357713 - RNA, 24 nt, Human
uuagaccuaagagauggucaaagg

SEQ ID NO: 357714 - RNA, 18 nt, Human
uuaucauuuugugcucaa

SEQ ID NO: 357715 - RNA, 18 nt, Human
uucaggaggaagggcugc

SEQ ID NO: 357716 - RNA, 19 nt, Human
uugaggugaaagaggggcu

SEQ ID NO: 357717 - RNA, 24 nt, Human
uuuuuuuuuuuagaagaaauacgg

SEQ ID NO: 357718 - RNA, 21 nt, Human
cauggaacugaugacuuccga

SEQ ID NO: 357719 - RNA, 21 nt, Human
cccucccgcgccccucccccg

SEQ ID NO: 357720 - RNA, 20 nt, Human
ccgcgccccucccccggccc

SEQ ID NO: 357721 - RNA, 22 nt, Human
cgcgccccucccccggcccccc

SEQ ID NO: 357722 - RNA, 20 nt, Human
cuccggcucgcccgcucgcu

SEQ ID NO: 357723 - RNA, 22 nt, Human
cucgcccgcucgcucucucccu

SEQ ID NO: 357724 - RNA, 20 nt, Human
gcccgcucgcucucucccuc

SEQ ID NO: 357725 - RNA, 25 nt, Human
gcggcgggugugugcgugugcgcuc

SEQ ID NO: 357726 - RNA, 18 nt, Human
ugacuuccgagcuguccc

SEQ ID NO: 357727 - RNA, 20 nt, Human
uucccuuccucgcuccggcu

SEQ ID NO: 357728 - RNA, 24 nt, Human
aacaugaaaaaaguccaaaagaaa

SEQ ID NO: 357729 - RNA, 21 nt, Human
aacccccucaaagggcccgag

SEQ ID NO: 357730 - RNA, 21 nt, Human
aagcugccuagcgacgccucc

SEQ ID NO: 357731 - RNA, 20 nt, Human
acagcaaaacccucccacca

SEQ ID NO: 357732 - RNA, 22 nt, Human
acagcaaaacccucccaccaua

SEQ ID NO: 357733 - RNA, 19 nt, Human
accauacuuugagcuacug

SEQ ID NO: 357734 - RNA, 22 nt, Human
agacuuaaacaaauuuugauuu

SEQ ID NO: 357735 - RNA, 22 nt, Human
agcaaaacccucccaccauacu

SEQ ID NO: 357736 - RNA, 23 nt, Human
caccaggaugggacugggacuuc

SEQ ID NO: 357737 - RNA, 22 nt, Human
cacuucugauuuacagcagaag

SEQ ID NO: 357738 - RNA, 23 nt, Human
ccagggagaguaaaacgcuacaa

SEQ ID NO: 357739 - RNA, 22 nt, Human
cccaggauggagggaggaggcc

SEQ ID NO: 357740 - RNA, 24 nt, Human
ccucagaagcuaauucaguucucc

SEQ ID NO: 357741 - RNA, 19 nt, Human
cgccggugccugccucgug

SEQ ID NO: 357742 - RNA, 26 nt, Human
cuacaaucuuucuaacagcuuugccc

SEQ ID NO: 357743 - RNA, 24 nt, Human
cugggugcaucuuguuuacucuug

SEQ ID NO: 357744 - RNA, 23 nt, Human
cuguggacaugggcauuuccucu

SEQ ID NO: 357745 - RNA, 19 nt, Human
gcaucuuguuuacucuuga

SEQ ID NO: 357746 - RNA, 23 nt, Human
gccgccgccggugccugccucgg

SEQ ID NO: 357747 - RNA, 24 nt, Human
gcuauaauucuuguagacauucug

SEQ ID NO: 357748 - RNA, 18 nt, Human
guccagagugggcccgcu

SEQ ID NO: 357749 - RNA, 24 nt, Human
gugaagaaaacaugaaaaaagucc

SEQ ID NO: 357750 - RNA, 18 nt, Human
gugacauuuggcuuccug

SEQ ID NO: 357751 - RNA, 18 nt, Human
guggguccagagugggcc

SEQ ID NO: 357752 - RNA, 22 nt, Human
uaaaauuucuuugggaagguga

SEQ ID NO: 357753 - RNA, 22 nt, Human
uaacagcuuugcccuacaccac

SEQ ID NO: 357754 - RNA, 23 nt, Human
uaacagcuuugcccuacaccacc

SEQ ID NO: 357755 - RNA, 24 nt, Human
uaagaaauuaauuuauuugaguuc

SEQ ID NO: 357756 - RNA, 23 nt, Human
uacaagcuguggacaugggcauu

SEQ ID NO: 357757 - RNA, 19 nt, Human
uagcgacgccuccguccua

SEQ ID NO: 357758 - RNA, 19 nt, Human
uagugagggggcagugugu

SEQ ID NO: 357759 - RNA, 20 nt, Human
ucaaagggcccgagugucaa

SEQ ID NO: 357760 - RNA, 21 nt, Human
uccaaaagaaacccccucaaa

SEQ ID NO: 357761 - RNA, 22 nt, Human
uccaaaagaaacccccucaaag

SEQ ID NO: 357762 - RNA, 19 nt, Human
uccuuuggcaugccacugg

SEQ ID NO: 357763 - RNA, 21 nt, Human
ucgaagcugccuagcgacgcc

SEQ ID NO: 357764 - RNA, 20 nt, Human
ugaaaaaaguccaaaagaaa

SEQ ID NO: 357765 - RNA, 22 nt, Human
ugaaaaaaguccaaaagaaacc

SEQ ID NO: 357766 - RNA, 18 nt, Human
ugacagcaaaacccuccc

SEQ ID NO: 357767 - RNA, 18 nt, Human
ugauuugugaagaaaaca

SEQ ID NO: 357768 - RNA, 19 nt, Human
ugauuugugaagaaaacau

SEQ ID NO: 357769 - RNA, 21 nt, Human
ugcccuacaccaccaucuaaa

SEQ ID NO: 357770 - RNA, 20 nt, Human
uggagcagcucauccaucuc

SEQ ID NO: 357771 - RNA, 22 nt, Human
uggcaugccacuggauaacaag

SEQ ID NO: 357772 - RNA, 23 nt, Human
uggcaugccacuggauaacaaga

SEQ ID NO: 357773 - RNA, 24 nt, Human
ugugcuuauuaaaaauggucaucu

SEQ ID NO: 357774 - RNA, 19 nt, Human
uucaguucuccuuuggcau

SEQ ID NO: 357775 - RNA, 19 nt, Human
uugcccuacaccaccaucu

SEQ ID NO: 357776 - RNA, 24 nt, Human
uuguauuuuuuaaagcuauaauuc

SEQ ID NO: 357777 - RNA, 20 nt, Human
uugugcuuauuaaaaauggu

SEQ ID NO: 357778 - RNA, 24 nt, Human
uuuuuuuuuuuuuuuuuuacuuuu

SEQ ID NO: 357779 - RNA, 29 nt, Human
uuuuuuuuuuuuuuuuuuuuacuuuuuaa

SEQ ID NO: 357780 - RNA, 19 nt, Human
aaaaaugucauucuugucc

SEQ ID NO: 357781 - RNA, 19 nt, Human
aacacauacugaaaaauga

SEQ ID NO: 357782 - RNA, 25 nt, Human
aacuggcugccugagagaggagagg

SEQ ID NO: 357783 - RNA, 22 nt, Human
aagaagacagaacagagaucag

SEQ ID NO: 357784 - RNA, 24 nt, Human
aagaagacagaacagagaucagua

SEQ ID NO: 357785 - RNA, 18 nt, Human
aagagaaaaccagcagaa

SEQ ID NO: 357786 - RNA, 19 nt, Human
aagcaccagaugccuucug

SEQ ID NO: 357787 - RNA, 23 nt, Human
aaucugcauguuccugcagguuu

SEQ ID NO: 357788 - RNA, 20 nt, Human
acacugugaucaugacaggg

SEQ ID NO: 357789 - RNA, 20 nt, Human
acuccacugcccugagcugg

SEQ ID NO: 357790 - RNA, 24 nt, Human
agaaaagaucuucucaguuacaaa

SEQ ID NO: 357791 - RNA, 23 nt, Human
agaaggaagucuuauuguccagc

SEQ ID NO: 357792 - RNA, 23 nt, Human
agagaggagagggguccccagag

SEQ ID NO: 357793 - RNA, 25 nt, Human
agaggagagggguccccagaguggg

SEQ ID NO: 357794 - RNA, 21 nt, Human
agcaggaagcaacuggcugcc

SEQ ID NO: 357795 - RNA, 20 nt, Human
aggaagacacugugugucca

SEQ ID NO: 357796 - RNA, 19 nt, Human
aggagagggguccccagag

SEQ ID NO: 357797 - RNA, 20 nt, Human
aggaggccaccaggcucagc

SEQ ID NO: 357798 - RNA, 25 nt, Human
aggcaacagaucucaaucuucggga

SEQ ID NO: 357799 - RNA, 30 nt, Human
aggcagaguccaccuagucugauuuuuuuu

SEQ ID NO: 357800 - RNA, 22 nt, Human
aggggauaagagaaaaccagca

SEQ ID NO: 357801 - RNA, 20 nt, Human
agggguugcagguauagcgc

SEQ ID NO: 357802 - RNA, 18 nt, Human
agucgcugagcucuuggg

SEQ ID NO: 357803 - RNA, 24 nt, Human
aucaucuucuuaaaaugcagauuc

SEQ ID NO: 357804 - RNA, 21 nt, Human
augauuacacugugagcucca

SEQ ID NO: 357805 - RNA, 19 nt, Human
caacaugauaagugugaca

SEQ ID NO: 357806 - RNA, 28 nt, Human
caagccccaaguaaucguccaucaggga

SEQ ID NO: 357807 - RNA, 21 nt, Human
caagccccaaguaaucguccu

SEQ ID NO: 357808 - RNA, 19 nt, Human
caccaaaaaauagaaaggc

SEQ ID NO: 357809 - RNA, 23 nt, Human
caccaaaaaauagaaaggcuuuc

SEQ ID NO: 357810 - RNA, 18 nt, Human
cacuguguguccaagagc

SEQ ID NO: 357811 - RNA, 24 nt, Human
cacuuccuagaguaggaccaaggg

SEQ ID NO: 357812 - RNA, 22 nt, Human
cagaagauauauagaggcccau

SEQ ID NO: 357813 - RNA, 23 nt, Human
cagcagccagacuggaccucugg

SEQ ID NO: 357814 - RNA, 19 nt, Human
cagguaggcaggcagaguc

SEQ ID NO: 357815 - RNA, 24 nt, Human
caguaguuaagcuacaagaagcac

SEQ ID NO: 357816 - RNA, 18 nt, Human
caguauguguaagaccaa

SEQ ID NO: 357817 - RNA, 18 nt, Human
ccaaguacuccacugccc

SEQ ID NO: 357818 - RNA, 25 nt, Human
ccaccaggcucagcuuacaagcccc

SEQ ID NO: 357819 - RNA, 19 nt, Human
ccagaccagguaggcaggc

SEQ ID NO: 357820 - RNA, 19 nt, Human
cccagagagcuuaaugacc

SEQ ID NO: 357821 - RNA, 19 nt, Human
ccccaagaaagaggacgcg

SEQ ID NO: 357822 - RNA, 18 nt, Human
cccugugcagguccccuc

SEQ ID NO: 357823 - RNA, 18 nt, Human
ccuaagugagaggucuuc

SEQ ID NO: 357824 - RNA, 24 nt, Human
ccuccacaacagcagccagacugg

SEQ ID NO: 357825 - RNA, 18 nt, Human
ccucuggacaacaugaua

SEQ ID NO: 357826 - RNA, 22 nt, Human
ccugcagguuuuucugaugcug

SEQ ID NO: 357827 - RNA, 21 nt, Human
ccuugccuccacaacagcagc

SEQ ID NO: 357828 - RNA, 18 nt, Human
ccuuguucugagcccaac

SEQ ID NO: 357829 - RNA, 20 nt, Human
cgaguaggaguuggggaggg

SEQ ID NO: 357830 - RNA, 22 nt, Human
cugccccagacagucuugauuc

SEQ ID NO: 357831 - RNA, 21 nt, Human
cugugaucaugacagggguuc

SEQ ID NO: 357832 - RNA, 21 nt, Human
cuucucaguuacaaauucugg

SEQ ID NO: 357833 - RNA, 21 nt, Human
cuuucuauuucacuggcccag

SEQ ID NO: 357834 - RNA, 20 nt, Human
gaacccaaagcaggaagcaa

SEQ ID NO: 357835 - RNA, 21 nt, Human
gaagaguccaaccugcaagga

SEQ ID NO: 357836 - RNA, 19 nt, Human
gagaaucaucuucuuaaaa

SEQ ID NO: 357837 - RNA, 19 nt, Human
gagaggagaggggucccca

SEQ ID NO: 357838 - RNA, 21 nt, Human
gaggaugagaaacaggaagac

SEQ ID NO: 357839 - RNA, 22 nt, Human
gaguaacuuugagucugugggc

SEQ ID NO: 357840 - RNA, 20 nt, Human
gaguccaaccugcaaggagg

SEQ ID NO: 357841 - RNA, 21 nt, Human
gauucuguagggaauaaggag

SEQ ID NO: 357842 - RNA, 23 nt, Human
gcaccagaugccuucugggauga

SEQ ID NO: 357843 - RNA, 22 nt, Human
gcagagggcgcccugggaaccc

SEQ ID NO: 357844 - RNA, 18 nt, Human
ggaaggagaguaacuuug

SEQ ID NO: 357845 - RNA, 23 nt, Human
ggagagcagacacaggaacaaug

SEQ ID NO: 357846 - RNA, 18 nt, Human
ggcacaggggauaagaga

SEQ ID NO: 357847 - RNA, 23 nt, Human
ggccccucugugcaaagcccaga

SEQ ID NO: 357848 - RNA, 19 nt, Human
ggggauaagagaaaaccag

SEQ ID NO: 357849 - RNA, 18 nt, Human
ggggguagggucggggag

SEQ ID NO: 357850 - RNA, 24 nt, Human
gucugugggccucauuucccaggu

SEQ ID NO: 357851 - RNA, 22 nt, Human
gugccuacccaccccugccugc

SEQ ID NO: 357852 - RNA, 21 nt, Human
guggucccugggcacagggga

SEQ ID NO: 357853 - RNA, 22 nt, Human
uaagagaaaaccagcagaauga

SEQ ID NO: 357854 - RNA, 20 nt, Human
uacaagaagcaccagaugcc

SEQ ID NO: 357855 - RNA, 26 nt, Human
uaccaaaaaaaggaaaaagaaaagau

SEQ ID NO: 357856 - RNA, 27 nt, Human
uaccaaaaaaaggaaaaagaaaagauc

SEQ ID NO: 357857 - RNA, 20 nt, Human
uagaggcccauggugugugg

SEQ ID NO: 357858 - RNA, 25 nt, Human
uagaggcccaugguguguggucccu

SEQ ID NO: 357859 - RNA, 24 nt, Human
uaggaucaaacuccaucucugaag

SEQ ID NO: 357860 - RNA, 23 nt, Human
uagggucggggagagcaaaagga

SEQ ID NO: 357861 - RNA, 24 nt, Human
uaguuaagcuacaagaagcaccag

SEQ ID NO: 357862 - RNA, 23 nt, Human
uauagaggcccaugguguguggu

SEQ ID NO: 357863 - RNA, 24 nt, Human
uauuucacuggcccagguaggggg

SEQ ID NO: 357864 - RNA, 18 nt, Human
ucagcugagagaaggaag

SEQ ID NO: 357865 - RNA, 23 nt, Human
ucauucuuguccacacggguccc

SEQ ID NO: 357866 - RNA, 18 nt, Human
uccaaccugcaaggagga

SEQ ID NO: 357867 - RNA, 21 nt, Human
uccaagaaggcuggaguccuu

SEQ ID NO: 357868 - RNA, 19 nt, Human
uccacugcccugagcuggg

SEQ ID NO: 357869 - RNA, 23 nt, Human
ucccaggcuacuuccuuccuccc

SEQ ID NO: 357870 - RNA, 20 nt, Human
uccccaagaaagaggacgcg

SEQ ID NO: 357871 - RNA, 18 nt, Human
ucccucccgcaccaaaaa

SEQ ID NO: 357872 - RNA, 18 nt, Human
ucccugugcagguccccu

SEQ ID NO: 357873 - RNA, 22 nt, Human
ucgaucugcuuuuucuggucau

SEQ ID NO: 357874 - RNA, 24 nt, Human
ucuggucauucauucagaagauau

SEQ ID NO: 357875 - RNA, 18 nt, Human
ucugugcaaagcccagag

SEQ ID NO: 357876 - RNA, 19 nt, Human
ucugugggccucauuuccc

SEQ ID NO: 357877 - RNA, 19 nt, Human
ucuucgggaugccugagaa

SEQ ID NO: 357878 - RNA, 21 nt, Human
ucuucgggaugccugagaauc

SEQ ID NO: 357879 - RNA, 21 nt, Human
ugagaaacaggaagacacugu

SEQ ID NO: 357880 - RNA, 24 nt, Human
ugagcccaacacggguccuggcac

SEQ ID NO: 357881 - RNA, 26 nt, Human
ugauaagugugacaaucacacuuccu

SEQ ID NO: 357882 - RNA, 22 nt, Human
ugcaaggaggaugagaaacagg

SEQ ID NO: 357883 - RNA, 20 nt, Human
ugccuccacaacagcagcca

SEQ ID NO: 357884 - RNA, 22 nt, Human
ugcuacuggcucugaagggcac

SEQ ID NO: 357885 - RNA, 29 nt, Human
ugggaacccaaagcaggaagcaacuggcu

SEQ ID NO: 357886 - RNA, 22 nt, Human
uggggguagggucggggagagc

SEQ ID NO: 357887 - RNA, 22 nt, Human
ugugaagaguccaaccugcaag

SEQ ID NO: 357888 - RNA, 25 nt, Human
ugugcaaagcccagagauggucaaa

SEQ ID NO: 357889 - RNA, 23 nt, Human
uguuaccaaaaaaaggaaaaaga

SEQ ID NO: 357890 - RNA, 21 nt, Human
uuagauaaaaacaggaaggag

SEQ ID NO: 357891 - RNA, 20 nt, Human
uuaggaucaaacuccaucuc

SEQ ID NO: 357892 - RNA, 23 nt, Human
uuggaguuaggaucaaacuccau

SEQ ID NO: 357893 - RNA, 22 nt, Human
uuuuuuuuuugagaaccaaggg

SEQ ID NO: 357894 - RNA, 18 nt, Human
uuuuuuuuuuuuuuuuug

SEQ ID NO: 357895 - RNA, 18 nt, Human
uuuuuuuuuuuuuuuuug

SEQ ID NO: 357896 - RNA, 22 nt, Human
uuuuuuuuuuuuuuuuugcagg

SEQ ID NO: 357897 - RNA, 20 nt, Human
aaaacaaacaaaagaaaucc

SEQ ID NO: 357898 - RNA, 19 nt, Human
aaaacagagcaaaucaaaa

SEQ ID NO: 357899 - RNA, 19 nt, Human
aaacaaacaaaagaaaucc

SEQ ID NO: 357900 - RNA, 20 nt, Human
aaacaaacaaaagaaaucca

SEQ ID NO: 357901 - RNA, 21 nt, Human
aaacagagcaaaucaaaacaa

SEQ ID NO: 357902 - RNA, 18 nt, Human
aaacauacauacauugca

SEQ ID NO: 357903 - RNA, 19 nt, Human
aaagcacuaugcccauuuc

SEQ ID NO: 357904 - RNA, 21 nt, Human
aaagcagaacaacaguccaaa

SEQ ID NO: 357905 - RNA, 21 nt, Human
aacagaaaaacauccaucaaa

SEQ ID NO: 357906 - RNA, 21 nt, Human
aaccauaguacacuguuaaau

SEQ ID NO: 357907 - RNA, 20 nt, Human
aacuaccaagaaaggaaaga

SEQ ID NO: 357908 - RNA, 21 nt, Human
aacuauacuaccucugucccu

SEQ ID NO: 357909 - RNA, 21 nt, Human
aagcaaacuggcauaucagau

SEQ ID NO: 357910 - RNA, 26 nt, Human
aagcagugaagcaaagaaaagggacc

SEQ ID NO: 357911 - RNA, 23 nt, Human
aauagugcuggucaaucaaugau

SEQ ID NO: 357912 - RNA, 21 nt, Human
acaacagaaaaacauccauca

SEQ ID NO: 357913 - RNA, 23 nt, Human
acaacagaaaaacauccaucaaa

SEQ ID NO: 357914 - RNA, 24 nt, Human
acgcccaacuaaauggaaaaaaaa

SEQ ID NO: 357915 - RNA, 21 nt, Human
acugcaaguuucucuuccccc

SEQ ID NO: 357916 - RNA, 22 nt, Human
agaaaaacauccaucaaauuca

SEQ ID NO: 357917 - RNA, 23 nt, Human
agaauugaaagauguacaaggca

SEQ ID NO: 357918 - RNA, 18 nt, Human
agcaaaucaaaacaaaca

SEQ ID NO: 357919 - RNA, 21 nt, Human
agcagaggauucaaacucuag

SEQ ID NO: 357920 - RNA, 22 nt, Human
agccccgacuccgccauccucc

SEQ ID NO: 357921 - RNA, 22 nt, Human
aguauuaaaagcagugaagcaa

SEQ ID NO: 357922 - RNA, 27 nt, Human
aguauuaaaagcagugaagcaaagaaa

SEQ ID NO: 357923 - RNA, 21 nt, Human
auaauguguuggcaaauguuu

SEQ ID NO: 357924 - RNA, 30 nt, Human
auauaccaauaucuacauaaauagauacaa

SEQ ID NO: 357925 - RNA, 26 nt, Human
aucagauuacacaacagaaaaacauc

SEQ ID NO: 357926 - RNA, 18 nt, Human
aucuucaccugccuucca

SEQ ID NO: 357927 - RNA, 22 nt, Human
augaagagacaaagauccuaca

SEQ ID NO: 357928 - RNA, 20 nt, Human
auggcagucuauuuuugaac

SEQ ID NO: 357929 - RNA, 18 nt, Human
auucauacuagaaaaggu

SEQ ID NO: 357930 - RNA, 23 nt, Human
caaaucucaaaauaaguuaaaga

SEQ ID NO: 357931 - RNA, 23 nt, Human
caaauuucuaucuuaauaucaua

SEQ ID NO: 357932 - RNA, 22 nt, Human
caacaauacugcuaaguauuaa

SEQ ID NO: 357933 - RNA, 23 nt, Human
caacucgucagagaagcaaaauu

SEQ ID NO: 357934 - RNA, 20 nt, Human
caagccuggacaaaaacuac

SEQ ID NO: 357935 - RNA, 21 nt, Human
caagccuggacaaaaacuaca

SEQ ID NO: 357936 - RNA, 23 nt, Human
caaggcaagucaagauauaaaac

SEQ ID NO: 357937 - RNA, 25 nt, Human
caaggcaagucaagauauaaaacca

SEQ ID NO: 357938 - RNA, 22 nt, Human
caaugugccucuuuuccauaac

SEQ ID NO: 357939 - RNA, 21 nt, Human
cacaacgcccaacuaaaugga

SEQ ID NO: 357940 - RNA, 22 nt, Human
cacaacucgucagagaagcaaa

SEQ ID NO: 357941 - RNA, 27 nt, Human
cacaagcagcaauauguaauuauacaa

SEQ ID NO: 357942 - RNA, 22 nt, Human
cacacaagcagcaauauguaau

SEQ ID NO: 357943 - RNA, 25 nt, Human
cagaacaacaguccaaauuucuauc

SEQ ID NO: 357944 - RNA, 21 nt, Human
cagagcaaaucaaaacaaaca

SEQ ID NO: 357945 - RNA, 26 nt, Human
cagcagauggggggaaaaaaaaaaga

SEQ ID NO: 357946 - RNA, 21 nt, Human
caucuagaacgcaccuugcuc

SEQ ID NO: 357947 - RNA, 19 nt, Human
cgacuccgccauccuccuc

SEQ ID NO: 357948 - RNA, 18 nt, Human
cgucaggagccccgacuc

SEQ ID NO: 357949 - RNA, 23 nt, Human
cuacacaaucaaaaaaguacugg

SEQ ID NO: 357950 - RNA, 22 nt, Human
cuccccaauggcuucuaugcaa

SEQ ID NO: 357951 - RNA, 19 nt, Human
cuuccacugaacuccccaa

SEQ ID NO: 357952 - RNA, 21 nt, Human
cuuucagggccuacaauacua

SEQ ID NO: 357953 - RNA, 21 nt, Human
gaaaaaaaaaaaaacacacaa

SEQ ID NO: 357954 - RNA, 20 nt, Human
gaaaagcagaacaacagucc

SEQ ID NO: 357955 - RNA, 20 nt, Human
gaaaaggucucaauacccuu

SEQ ID NO: 357956 - RNA, 19 nt, Human
gauuguguguguuuauaug

SEQ ID NO: 357957 - RNA, 20 nt, Human
gauuguguguguuuauaugu

SEQ ID NO: 357958 - RNA, 28 nt, Human
gcaaguuucucuucccccaaacuuaaaa

SEQ ID NO: 357959 - RNA, 22 nt, Human
gccaggaaaagcagaacaacag

SEQ ID NO: 357960 - RNA, 23 nt, Human
ggaaaaaaaaaaaaacacacaag

SEQ ID NO: 357961 - RNA, 23 nt, Human
ggggggaaaaaaaaaagaaagga

SEQ ID NO: 357962 - RNA, 21 nt, Human
gugacucaagccuggacaaaa

SEQ ID NO: 357963 - RNA, 20 nt, Human
gugccaggaaaagcagaaca

SEQ ID NO: 357964 - RNA, 24 nt, Human
guuucucuucccccaaacuuaaaa

SEQ ID NO: 357965 - RNA, 22 nt, Human
uaaaaaauauucauacuagaaa

SEQ ID NO: 357966 - RNA, 21 nt, Human
uaacuauacuaccucuguccc

SEQ ID NO: 357967 - RNA, 25 nt, Human
uacacaacagaaaaacauccaucaa

SEQ ID NO: 357968 - RNA, 23 nt, Human
uacacuguuaaauaaccuugaaa

SEQ ID NO: 357969 - RNA, 21 nt, Human
uaccaagaaaggaaagaugag

SEQ ID NO: 357970 - RNA, 21 nt, Human
uaccaagaaaggaaagaugag

SEQ ID NO: 357971 - RNA, 24 nt, Human
uacccaaagacucacuucagguau

SEQ ID NO: 357972 - RNA, 20 nt, Human
uaccucugucccuuaaauuu

SEQ ID NO: 357973 - RNA, 23 nt, Human
uagccuuaauucaaaaaugguuu

SEQ ID NO: 357974 - RNA, 23 nt, Human
uauaaacaaaauuuuaacugaaa

SEQ ID NO: 357975 - RNA, 19 nt, Human
uauacuaccucugucccuu

SEQ ID NO: 357976 - RNA, 25 nt, Human
uauauacauauauagauugugugug

SEQ ID NO: 357977 - RNA, 21 nt, Human
uauauagcauuguauauacau

SEQ ID NO: 357978 - RNA, 22 nt, Human
uauauagcauuguauauacaua

SEQ ID NO: 357979 - RNA, 18 nt, Human
uaucuaacuauacuaccu

SEQ ID NO: 357980 - RNA, 19 nt, Human
uaucuuaauaucauagccu

SEQ ID NO: 357981 - RNA, 22 nt, Human
uaugauauaauaaauacauauc

SEQ ID NO: 357982 - RNA, 19 nt, Human
uauucauacuagaaaaggu

SEQ ID NO: 357983 - RNA, 21 nt, Human
ucaaagaugaagagacaaaga

SEQ ID NO: 357984 - RNA, 19 nt, Human
ucaaauugacuuagaccaa

SEQ ID NO: 357985 - RNA, 18 nt, Human
ucacuuugccaguuuuuu

SEQ ID NO: 357986 - RNA, 22 nt, Human
uccaaauuucuaucuuaauauc

SEQ ID NO: 357987 - RNA, 26 nt, Human
ucuacuuucagggccuacaauacuau

SEQ ID NO: 357988 - RNA, 18 nt, Human
ucucaauacccuuccccu

SEQ ID NO: 357989 - RNA, 19 nt, Human
ugacucaagccuggacaaa

SEQ ID NO: 357990 - RNA, 24 nt, Human
ugacuguaaacaauacauaaaauu

SEQ ID NO: 357991 - RNA, 21 nt, Human
ugagugccaggaaaagcagaa

SEQ ID NO: 357992 - RNA, 21 nt, Human
ugccaggaaaagcagaacaac

SEQ ID NO: 357993 - RNA, 19 nt, Human
ugcuucacaacucgucaga

SEQ ID NO: 357994 - RNA, 23 nt, Human
ugcuucacaacucgucagagaag

SEQ ID NO: 357995 - RNA, 23 nt, Human
uggaaaaaaaaaaaaacacacaa

SEQ ID NO: 357996 - RNA, 20 nt, Human
uggacaaaaacuacaugaac

SEQ ID NO: 357997 - RNA, 20 nt, Human
uggcuucuaugcaaugugcc

SEQ ID NO: 357998 - RNA, 22 nt, Human
ugguaaggggaaaauauauaug

SEQ ID NO: 357999 - RNA, 18 nt, Human
uguacagaauuuaaaaaa

SEQ ID NO: 358000 - RNA, 23 nt, Human
uguacagaauuuaaaaaaaauuc

SEQ ID NO: 358001 - RNA, 19 nt, Human
ugugggaccagcagauuua

SEQ ID NO: 358002 - RNA, 22 nt, Human
uuagaguuccgucaggagcccc

SEQ ID NO: 358003 - RNA, 20 nt, Human
uucaggaaugaaaaaacucc

SEQ ID NO: 358004 - RNA, 28 nt, Human
uucuuuagcagaggauucaaacucuagg

SEQ ID NO: 358005 - RNA, 21 nt, Human
uugaauucaaagaugaagaga

SEQ ID NO: 358006 - RNA, 24 nt, Human
uugauccuuauaaaaucucucauu

SEQ ID NO: 358007 - RNA, 21 nt, Human
uuucaaagaaagacauucaug

SEQ ID NO: 358008 - RNA, 22 nt, Human
uuuugcuucacaacucgucaga

SEQ ID NO: 358009 - RNA, 20 nt, Human
aaaaaaaaaaaaaauaccaa

SEQ ID NO: 358010 - RNA, 26 nt, Human
aaaaaaaaaaaaaauaccaauccaaa

SEQ ID NO: 358011 - RNA, 23 nt, Human
aaaaaaaaaaacaaagugugggg

SEQ ID NO: 358012 - RNA, 26 nt, Human
aaaaaaaaaaauaaauaacaaaucca

SEQ ID NO: 358013 - RNA, 22 nt, Human
aaaaaaaaaacaaagugugggg

SEQ ID NO: 358014 - RNA, 23 nt, Human
aaaaaaaaaacaaagugugggga

SEQ ID NO: 358015 - RNA, 26 nt, Human
aaaaauaccaauccaaaacaaaacca

SEQ ID NO: 358016 - RNA, 23 nt, Human
aaaacaaaaccaaaaaaaaaaaa

SEQ ID NO: 358017 - RNA, 22 nt, Human
aaaacaaagaaauaaaagaacu

SEQ ID NO: 358018 - RNA, 26 nt, Human
aaaagaaaaagcaacaguuuucagaa

SEQ ID NO: 358019 - RNA, 19 nt, Human
aaacaaaaccaaaaaaaaa

SEQ ID NO: 358020 - RNA, 25 nt, Human
aaacaaaaccaaaaaaaaaaaacaa

SEQ ID NO: 358021 - RNA, 22 nt, Human
aaacaaaguguggggagccccc

SEQ ID NO: 358022 - RNA, 18 nt, Human
aaacacaaccacacuccc

SEQ ID NO: 358023 - RNA, 25 nt, Human
aaacacaaccacacucccagcgcgc

SEQ ID NO: 358024 - RNA, 23 nt, Human
aaaccaccaagcuugaauccaga

SEQ ID NO: 358025 - RNA, 21 nt, Human
aaaccagacccaauuugggaa

SEQ ID NO: 358026 - RNA, 24 nt, Human
aaacgaaauaaaacaaaaccaaaa

SEQ ID NO: 358027 - RNA, 22 nt, Human
aaagaaaaccaccaagcuugaa

SEQ ID NO: 358028 - RNA, 22 nt, Human
aacaaaaccaaaaaaaaaaaac

SEQ ID NO: 358029 - RNA, 20 nt, Human
aacacggugaaacgccgucu

SEQ ID NO: 358030 - RNA, 21 nt, Human
aacacggugaaacgccgucuc

SEQ ID NO: 358031 - RNA, 19 nt, Human
aacauggucaaaccccauc

SEQ ID NO: 358032 - RNA, 20 nt, Human
aacauggucaaaccccaucu

SEQ ID NO: 358033 - RNA, 21 nt, Human
aacauggucaaaccccaucuc

SEQ ID NO: 358034 - RNA, 21 nt, Human
aaccaaaaaaaaaaaacaaag

SEQ ID NO: 358035 - RNA, 22 nt, Human
aaccacacucccagcgcgccca

SEQ ID NO: 358036 - RNA, 23 nt, Human
aacucgugaagccacauccccuu

SEQ ID NO: 358037 - RNA, 21 nt, Human
aacuugaaaacucucuggauc

SEQ ID NO: 358038 - RNA, 24 nt, Human
aagaaaaagcaacaguuuucagaa

SEQ ID NO: 358039 - RNA, 22 nt, Human
aagaaacuccaguuuuccaagc

SEQ ID NO: 358040 - RNA, 22 nt, Human
aagauggaguaggggagaaaga

SEQ ID NO: 358041 - RNA, 18 nt, Human
aagcaacuguccagccca

SEQ ID NO: 358042 - RNA, 22 nt, Human
aagcaacuguccagcccaugcc

SEQ ID NO: 358043 - RNA, 22 nt, Human
aagcaagucucugucucaaaaa

SEQ ID NO: 358044 - RNA, 23 nt, Human
aagcccgcgguucacguccucag

SEQ ID NO: 358045 - RNA, 18 nt, Human
aagccucucuccucuuuu

SEQ ID NO: 358046 - RNA, 24 nt, Human
aagcuggaaccaccuacaucugca

SEQ ID NO: 358047 - RNA, 23 nt, Human
aaguccacauucaaauccacacc

SEQ ID NO: 358048 - RNA, 24 nt, Human
aaucgcuugaacucgggaggcgga

SEQ ID NO: 358049 - RNA, 24 nt, Human
acaaaaccaaaaaaaaaaaacaaa

SEQ ID NO: 358050 - RNA, 24 nt, Human
acaaagcaagucucugucucaaaa

SEQ ID NO: 358051 - RNA, 26 nt, Human
acagagcaagacucugucuuucuuaa

SEQ ID NO: 358052 - RNA, 21 nt, Human
accacacucccagcgcgccca

SEQ ID NO: 358053 - RNA, 22 nt, Human
accacacucccagcgcgcccag

SEQ ID NO: 358054 - RNA, 19 nt, Human
accagugugcuccagccug

SEQ ID NO: 358055 - RNA, 24 nt, Human
accccaucucuacugaaaauacaa

SEQ ID NO: 358056 - RNA, 19 nt, Human
accucccgcaaacccugug

SEQ ID NO: 358057 - RNA, 24 nt, Human
accugaggucaggaguucgagacc

SEQ ID NO: 358058 - RNA, 19 nt, Human
acgcagaagauggaguagg

SEQ ID NO: 358059 - RNA, 19 nt, Human
acgcagccaggcggggguu

SEQ ID NO: 358060 - RNA, 21 nt, Human
acgcgcggugcaggcggggug

SEQ ID NO: 358061 - RNA, 25 nt, Human
acugaaaauacaaacauuaucuuga

SEQ ID NO: 358062 - RNA, 18 nt, Human
acugcgcuccagccuggg

SEQ ID NO: 358063 - RNA, 21 nt, Human
acugcgcuccagccugggcga

SEQ ID NO: 358064 - RNA, 23 nt, Human
acugcgcuccagccugggcgaca

SEQ ID NO: 358065 - RNA, 19 nt, Human
agaaacacaaccacacucc

SEQ ID NO: 358066 - RNA, 21 nt, Human
agaaagaaaagcuggaaccac

SEQ ID NO: 358067 - RNA, 20 nt, Human
agacgcgcggaaacgaaaua

SEQ ID NO: 358068 - RNA, 23 nt, Human
agaggaucuuuggagcucaggag

SEQ ID NO: 358069 - RNA, 23 nt, Human
agaucaccugaggucaggaguuc

SEQ ID NO: 358070 - RNA, 20 nt, Human
agcacuuugggaggcuaagg

SEQ ID NO: 358071 - RNA, 21 nt, Human
agcccgggaguccgggcgcgc

SEQ ID NO: 358072 - RNA, 22 nt, Human
agccggggcugguggaugcgcg

SEQ ID NO: 358073 - RNA, 24 nt, Human
agccuggccaacauggucaaaccc

SEQ ID NO: 358074 - RNA, 20 nt, Human
agccugggcgacaaagcaag

SEQ ID NO: 358075 - RNA, 24 nt, Human
agccugggugacagagcaagacuc

SEQ ID NO: 358076 - RNA, 24 nt, Human
agcuacucaggaggcugagguggg

SEQ ID NO: 358077 - RNA, 23 nt, Human
agcugggugugguggugggugcc

SEQ ID NO: 358078 - RNA, 26 nt, Human
aggaaaaaaaaaaauaaauaacaaag

SEQ ID NO: 358079 - RNA, 26 nt, Human
aggaaggagcaugguaguaaagaaaa

SEQ ID NO: 358080 - RNA, 23 nt, Human
aggagcucaagaccagccucagc

SEQ ID NO: 358081 - RNA, 24 nt, Human
aggauugcuugagcccaggaguuu

SEQ ID NO: 358082 - RNA, 24 nt, Human
aggcaggagaaucgcuugaacucg

SEQ ID NO: 358083 - RNA, 18 nt, Human
aggcaggagcaucgcuug

SEQ ID NO: 358084 - RNA, 24 nt, Human
aggcaggagcaucgcuugaacccg

SEQ ID NO: 358085 - RNA, 22 nt, Human
aggccggcaauuggcuuucuuc

SEQ ID NO: 358086 - RNA, 19 nt, Human
aggcggagguugcagugag

SEQ ID NO: 358087 - RNA, 24 nt, Human
aggcggagguugcagugagucgag

SEQ ID NO: 358088 - RNA, 22 nt, Human
aggcgggcagaucaccugaggu

SEQ ID NO: 358089 - RNA, 26 nt, Human
aggcgggcagaucaccugaggucagg

SEQ ID NO: 358090 - RNA, 26 nt, Human
aggcggguggaucaccugaggucagg

SEQ ID NO: 358091 - RNA, 21 nt, Human
aggcuaaggcggguggaucac

SEQ ID NO: 358092 - RNA, 20 nt, Human
aggcugaggcaggagaaucg

SEQ ID NO: 358093 - RNA, 24 nt, Human
aggcugaggcaggagaaucgcuug

SEQ ID NO: 358094 - RNA, 20 nt, Human
aggcugaggcaggagcaucg

SEQ ID NO: 358095 - RNA, 24 nt, Human
aggcugaggcaggagcaucgcuug

SEQ ID NO: 358096 - RNA, 24 nt, Human
aggcugaggugggaggauugcuug

SEQ ID NO: 358097 - RNA, 18 nt, Human
agggcgucaccagagaaa

SEQ ID NO: 358098 - RNA, 19 nt, Human
agguccccggaacguggga

SEQ ID NO: 358099 - RNA, 23 nt, Human
agugguucaugcuuguaauucua

SEQ ID NO: 358100 - RNA, 24 nt, Human
agugugcuccagccugggugacag

SEQ ID NO: 358101 - RNA, 26 nt, Human
auaaaacaaaaccaaaaaaaaaaaac

SEQ ID NO: 358102 - RNA, 24 nt, Human
aucgcaccagugugcuccagccug

SEQ ID NO: 358103 - RNA, 20 nt, Human
auggaacguggaucucccga

SEQ ID NO: 358104 - RNA, 24 nt, Human
auugcgggacugcgcuccagccug

SEQ ID NO: 358105 - RNA, 24 nt, Human
auugcuugagcccaggaguuugag

SEQ ID NO: 358106 - RNA, 18 nt, Human
auuuaugaacguccgacc

SEQ ID NO: 358107 - RNA, 18 nt, Human
caaaaauaaaaaacaaag

SEQ ID NO: 358108 - RNA, 23 nt, Human
caaaccccuugcuguguucccag

SEQ ID NO: 358109 - RNA, 21 nt, Human
caaagcaagaucccgucucua

SEQ ID NO: 358110 - RNA, 19 nt, Human
caaaguaagaagcaggggc

SEQ ID NO: 358111 - RNA, 19 nt, Human
caaauggaucuacaguuca

SEQ ID NO: 358112 - RNA, 19 nt, Human
caaccagaaacagcucagg

SEQ ID NO: 358113 - RNA, 18 nt, Human
cacacucccagcgcgccc

SEQ ID NO: 358114 - RNA, 27 nt, Human
cacauacaucacaaaguaagaagcagg

SEQ ID NO: 358115 - RNA, 23 nt, Human
caccaaaccccuugcuguguucc

SEQ ID NO: 358116 - RNA, 18 nt, Human
caccaccucccgcaaacc

SEQ ID NO: 358117 - RNA, 22 nt, Human
caccagcgcuguuauuuacgcc

SEQ ID NO: 358118 - RNA, 18 nt, Human
caccagugugcuccagcc

SEQ ID NO: 358119 - RNA, 18 nt, Human
cacccgugauuuuugcaa

SEQ ID NO: 358120 - RNA, 23 nt, Human
caccugaggucaggaguucgaga

SEQ ID NO: 358121 - RNA, 23 nt, Human
caccuguaaucccagcuacucgg

SEQ ID NO: 358122 - RNA, 24 nt, Human
caccuguaaucccagcuacucggg

SEQ ID NO: 358123 - RNA, 20 nt, Human
caccuugcaaccacgcgucc

SEQ ID NO: 358124 - RNA, 24 nt, Human
cacgccugucaucccagcacuuug

SEQ ID NO: 358125 - RNA, 19 nt, Human
cacguccucagccucagcc

SEQ ID NO: 358126 - RNA, 22 nt, Human
cacguugggaggccgaggcggg

SEQ ID NO: 358127 - RNA, 24 nt, Human
cagaucaccugaggucaggaguuc

SEQ ID NO: 358128 - RNA, 22 nt, Human
cagcaaaaaaaaaaaaaaaaaa

SEQ ID NO: 358129 - RNA, 23 nt, Human
cagcaaagcaagaucccgucucu

SEQ ID NO: 358130 - RNA, 24 nt, Human
cagcacuuugggaggcuaaggcgg

SEQ ID NO: 358131 - RNA, 19 nt, Human
cagccccccaugcgcugcc

SEQ ID NO: 358132 - RNA, 19 nt, Human
cagccccccaugcgcugcc

SEQ ID NO: 358133 - RNA, 19 nt, Human
cagccccccaugcgcugcc

SEQ ID NO: 358134 - RNA, 20 nt, Human
cagccccccaugcgcugccu

SEQ ID NO: 358135 - RNA, 21 nt, Human
cagcuacucaggaggcugagg

SEQ ID NO: 358136 - RNA, 24 nt, Human
cagcuacucaggaggcugaggugg

SEQ ID NO: 358137 - RNA, 24 nt, Human
cagcuacucgggaggcugaggcag

SEQ ID NO: 358138 - RNA, 24 nt, Human
cagcuacucgggaggcugaggcag

SEQ ID NO: 358139 - RNA, 24 nt, Human
caggccccgagcgugccccggagg

SEQ ID NO: 358140 - RNA, 21 nt, Human
cagggccaucucuacacccgu

SEQ ID NO: 358141 - RNA, 22 nt, Human
cagugugcuccagccuggguga

SEQ ID NO: 358142 - RNA, 23 nt, Human
cagugugcuccagccugggugac

SEQ ID NO: 358143 - RNA, 24 nt, Human
cagugugcuccagccugggugaca

SEQ ID NO: 358144 - RNA, 25 nt, Human
cagugugcuccagccugggugacag

SEQ ID NO: 358145 - RNA, 21 nt, Human
caucacaaaguaagaagcagg

SEQ ID NO: 358146 - RNA, 24 nt, Human
caucgcuugaacccggggggcgga

SEQ ID NO: 358147 - RNA, 20 nt, Human
caucggagaccagcuccggg

SEQ ID NO: 358148 - RNA, 25 nt, Human
caugccagcugugacgacaaguuuu

SEQ ID NO: 358149 - RNA, 24 nt, Human
caugcuuguaauucuaacacuuug

SEQ ID NO: 358150 - RNA, 18 nt, Human
cauggucaaaccccaucu

SEQ ID NO: 358151 - RNA, 24 nt, Human
ccaauccaaaacaaaaccagaccc

SEQ ID NO: 358152 - RNA, 20 nt, Human
ccacacucccagcgcgccca

SEQ ID NO: 358153 - RNA, 21 nt, Human
ccacgggcagugguucaugcu

SEQ ID NO: 358154 - RNA, 21 nt, Human
ccagaaaaccaaucagaaaag

SEQ ID NO: 358155 - RNA, 24 nt, Human
ccagaaaaccaaucagaacaugga

SEQ ID NO: 358156 - RNA, 20 nt, Human
ccagcgcuguuauuuacgcc

SEQ ID NO: 358157 - RNA, 22 nt, Human
ccaggaguuugaggcugcagug

SEQ ID NO: 358158 - RNA, 18 nt, Human
ccaggccggcaauuggcu

SEQ ID NO: 358159 - RNA, 21 nt, Human
ccagugugcuccagccugggu

SEQ ID NO: 358160 - RNA, 21 nt, Human
ccagugugcuccagccugggu

SEQ ID NO: 358161 - RNA, 22 nt, Human
ccagugugcuccagccugggug

SEQ ID NO: 358162 - RNA, 23 nt, Human
ccagugugcuccagccuggguga

SEQ ID NO: 358163 - RNA, 24 nt, Human
ccagugugcuccagccugggugac

SEQ ID NO: 358164 - RNA, 20 nt, Human
cccacacagguuacccgcgg

SEQ ID NO: 358165 - RNA, 22 nt, Human
cccccaggccggcaauuggcuu

SEQ ID NO: 358166 - RNA, 28 nt, Human
ccccccaggccggcaauuggcuuucuuc

SEQ ID NO: 358167 - RNA, 20 nt, Human
ccccucccuuuccaaagccc

SEQ ID NO: 358168 - RNA, 21 nt, Human
cccgcaaacccugugcggacu

SEQ ID NO: 358169 - RNA, 18 nt, Human
cccggagguucauucgcg

SEQ ID NO: 358170 - RNA, 25 nt, Human
cccggccccugccuccugggauucc

SEQ ID NO: 358171 - RNA, 22 nt, Human
cccgggagccucccuccucagg

SEQ ID NO: 358172 - RNA, 24 nt, Human
ccgaaagccucucuccucuuuuuu

SEQ ID NO: 358173 - RNA, 25 nt, Human
ccgaaguccacauucaaauccacac

SEQ ID NO: 358174 - RNA, 18 nt, Human
ccgagccccccacacagg

SEQ ID NO: 358175 - RNA, 22 nt, Human
ccucaggccucuugcaggagcu

SEQ ID NO: 358176 - RNA, 23 nt, Human
ccugaggucaggaguuccgagac

SEQ ID NO: 358177 - RNA, 22 nt, Human
ccugaggucaggaguucgagac

SEQ ID NO: 358178 - RNA, 18 nt, Human
ccugcacguacaaugggc

SEQ ID NO: 358179 - RNA, 20 nt, Human
ccuggccaacacggugaaac

SEQ ID NO: 358180 - RNA, 21 nt, Human
ccuggccaacacggugaaacg

SEQ ID NO: 358181 - RNA, 24 nt, Human
ccuggccaacauggucaaacccca

SEQ ID NO: 358182 - RNA, 22 nt, Human
ccugggugacagagcaagacuc

SEQ ID NO: 358183 - RNA, 21 nt, Human
ccuguaaucccagcuacucgg

SEQ ID NO: 358184 - RNA, 19 nt, Human
ccuguagucccagcuacuc

SEQ ID NO: 358185 - RNA, 19 nt, Human
ccuguagucccagcuacuc

SEQ ID NO: 358186 - RNA, 21 nt, Human
ccuguagucccagcuacucag

SEQ ID NO: 358187 - RNA, 21 nt, Human
ccuguagucccagcuacucgg

SEQ ID NO: 358188 - RNA, 22 nt, Human
ccuguagucccagcuacucggg

SEQ ID NO: 358189 - RNA, 19 nt, Human
ccuucagaaacacaaccac

SEQ ID NO: 358190 - RNA, 20 nt, Human
ccuuggagaggcccgggcug

SEQ ID NO: 358191 - RNA, 24 nt, Human
cgagaccagccuggccaacauggu

SEQ ID NO: 358192 - RNA, 22 nt, Human
cgagcgugccccggagguucau

SEQ ID NO: 358193 - RNA, 20 nt, Human
cgaggcgggcagaucaccug

SEQ ID NO: 358194 - RNA, 26 nt, Human
cgaggcgggcagaucaccugagguca

SEQ ID NO: 358195 - RNA, 18 nt, Human
cgcaggcgcccgagcccc

SEQ ID NO: 358196 - RNA, 20 nt, Human
cgcccgagccccccacacag

SEQ ID NO: 358197 - RNA, 24 nt, Human
cgccugucaucccagcacuuuggg

SEQ ID NO: 358198 - RNA, 20 nt, Human
cgccuguccacccucccauu

SEQ ID NO: 358199 - RNA, 21 nt, Human
cgcgcaggaggggggcgcagg

SEQ ID NO: 358200 - RNA, 18 nt, Human
cgcgcggugcaggcgggg

SEQ ID NO: 358201 - RNA, 22 nt, Human
cgcugugucucccccacccccc

SEQ ID NO: 358202 - RNA, 23 nt, Human
cggaaacgaaauaaaacaaaacc

SEQ ID NO: 358203 - RNA, 18 nt, Human
cggaggaaaagaaacucc

SEQ ID NO: 358204 - RNA, 24 nt, Human
cgggaggcggagguugcagugagu

SEQ ID NO: 358205 - RNA, 24 nt, Human
cgggcagaucaccugaggucagga

SEQ ID NO: 358206 - RNA, 24 nt, Human
cggguggaucaccugaggucagga

SEQ ID NO: 358207 - RNA, 19 nt, Human
cgucacaaagauacagucu

SEQ ID NO: 358208 - RNA, 22 nt, Human
cuaacacuuugggagguggagg

SEQ ID NO: 358209 - RNA, 19 nt, Human
cuacacccgugauuuuugc

SEQ ID NO: 358210 - RNA, 20 nt, Human
cuaguaaaaaucaaaaaaau

SEQ ID NO: 358211 - RNA, 22 nt, Human
cucaagaccagccucagcagca

SEQ ID NO: 358212 - RNA, 24 nt, Human
cucacgccugucaucccagcacuu

SEQ ID NO: 358213 - RNA, 23 nt, Human
cucaggacccgggcaaaagcagg

SEQ ID NO: 358214 - RNA, 18 nt, Human
cucaggaggcugaggugg

SEQ ID NO: 358215 - RNA, 20 nt, Human
cuccagccugggugacagag

SEQ ID NO: 358216 - RNA, 22 nt, Human
cugcagugagcuaugaucgcac

SEQ ID NO: 358217 - RNA, 20 nt, Human
cuggaaaaguuauaaagucg

SEQ ID NO: 358218 - RNA, 18 nt, Human
cuggccaacacggugaaa

SEQ ID NO: 358219 - RNA, 23 nt, Human
cuggccaacauggucaaacccca

SEQ ID NO: 358220 - RNA, 21 nt, Human
cuguaaucccagcuacucggg

SEQ ID NO: 358221 - RNA, 24 nt, Human
cugucucaaaaauaaaaaacaaag

SEQ ID NO: 358222 - RNA, 20 nt, Human
cugugucucccccacccccc

SEQ ID NO: 358223 - RNA, 23 nt, Human
cugugucucccccaccccccagg

SEQ ID NO: 358224 - RNA, 20 nt, Human
gaaauaaaacaaaaccaaaa

SEQ ID NO: 358225 - RNA, 22 nt, Human
gaacauggaacguggaucuccc

SEQ ID NO: 358226 - RNA, 18 nt, Human
gaagauggaguaggggag

SEQ ID NO: 358227 - RNA, 18 nt, Human
gaagcaaaaaagaaguug

SEQ ID NO: 358228 - RNA, 18 nt, Human
gaagggggaaagauccca

SEQ ID NO: 358229 - RNA, 23 nt, Human
gagaaucgcuugaacucgggagg

SEQ ID NO: 358230 - RNA, 23 nt, Human
gagcagccggggcugguggaugc

SEQ ID NO: 358231 - RNA, 18 nt, Human
gagcccaggaguuugagg

SEQ ID NO: 358232 - RNA, 21 nt, Human
gagcucccggggugcccggag

SEQ ID NO: 358233 - RNA, 21 nt, Human
gaggugggaggauugcuugag

SEQ ID NO: 358234 - RNA, 24 nt, Human
gaggugggaggauugcuugagccc

SEQ ID NO: 358235 - RNA, 22 nt, Human
gaucaccugaggucaggaguuc

SEQ ID NO: 358236 - RNA, 24 nt, Human
gaucaccugaggucaggaguuccg

SEQ ID NO: 358237 - RNA, 25 nt, Human
gaucaccugaggucaggaguuccga

SEQ ID NO: 358238 - RNA, 24 nt, Human
gaucaccugaggucaggaguucga

SEQ ID NO: 358239 - RNA, 22 nt, Human
gauugcuugagcccaggaguuu

SEQ ID NO: 358240 - RNA, 24 nt, Human
gauugcuugagcccaggaguuuga

SEQ ID NO: 358241 - RNA, 23 nt, Human
gcaaaaaaaaaaaaaaaaaaaaa

SEQ ID NO: 358242 - RNA, 20 nt, Human
gcacguugggaggccgaggc

SEQ ID NO: 358243 - RNA, 22 nt, Human
gcagagacgcugugucuccccc

SEQ ID NO: 358244 - RNA, 21 nt, Human
gcagccggggcugguggaugc

SEQ ID NO: 358245 - RNA, 20 nt, Human
gcaggcgcccgagcccccca

SEQ ID NO: 358246 - RNA, 21 nt, Human
gcaggcgcccgagccccccac

SEQ ID NO: 358247 - RNA, 24 nt, Human
gccaacacggugaaacgccgucuc

SEQ ID NO: 358248 - RNA, 24 nt, Human
gccaacauggucaaaccccaucuc

SEQ ID NO: 358249 - RNA, 21 nt, Human
gcccagggccaucucuacacc

SEQ ID NO: 358250 - RNA, 19 nt, Human
gcccgggcuggacgcacgg

SEQ ID NO: 358251 - RNA, 24 nt, Human
gccgggcgcaggggcucacgccug

SEQ ID NO: 358252 - RNA, 20 nt, Human
gcggagguggcggugagcug

SEQ ID NO: 358253 - RNA, 21 nt, Human
gcgggacugcgcuccagccug

SEQ ID NO: 358254 - RNA, 22 nt, Human
ggaaacgaaauaaaacaaaacc

SEQ ID NO: 358255 - RNA, 22 nt, Human
ggacugcgcuccagccugggcg

SEQ ID NO: 358256 - RNA, 18 nt, Human
ggagguggcggugagcug

SEQ ID NO: 358257 - RNA, 24 nt, Human
ggagguggcggugagcugacauug

SEQ ID NO: 358258 - RNA, 18 nt, Human
ggagguugcagugagucg

SEQ ID NO: 358259 - RNA, 20 nt, Human
ggagguugcagugagucgag

SEQ ID NO: 358260 - RNA, 18 nt, Human
ggaguccgggcgcgcggg

SEQ ID NO: 358261 - RNA, 22 nt, Human
ggaucaccugaggucaggaguu

SEQ ID NO: 358262 - RNA, 22 nt, Human
ggauugcuugagcccaggaguu

SEQ ID NO: 358263 - RNA, 19 nt, Human
ggcaccuguaaucccagcu

SEQ ID NO: 358264 - RNA, 27 nt, Human
ggccggggcuggcgagcagccggggcu

SEQ ID NO: 358265 - RNA, 19 nt, Human
ggcgcaggggcucacgccu

SEQ ID NO: 358266 - RNA, 19 nt, Human
ggcuggggccggggcuggc

SEQ ID NO: 358267 - RNA, 20 nt, Human
gggaguccgggcgcgcgggg

SEQ ID NO: 358268 - RNA, 24 nt, Human
gggcacguugggaggccgaggcgg

SEQ ID NO: 358269 - RNA, 26 nt, Human
gggcagaucaccugaggucaggaguu

SEQ ID NO: 358270 - RNA, 18 nt, Human
gggcgcaggggcucacgc

SEQ ID NO: 358271 - RNA, 24 nt, Human
gggcgcaggggcucacgccuguca

SEQ ID NO: 358272 - RNA, 22 nt, Human
gggcgucugauccgcuccuacc

SEQ ID NO: 358273 - RNA, 24 nt, Human
gggcucacgccugucaucccagca

SEQ ID NO: 358274 - RNA, 18 nt, Human
ggggggcggagguggcgg

SEQ ID NO: 358275 - RNA, 24 nt, Human
gguggugggcaccuguaaucccag

SEQ ID NO: 358276 - RNA, 20 nt, Human
guaagaagcaggggcuuuug

SEQ ID NO: 358277 - RNA, 22 nt, Human
guacaccuuggugcgaaggggg

SEQ ID NO: 358278 - RNA, 18 nt, Human
gucacaaagauacagucu

SEQ ID NO: 358279 - RNA, 21 nt, Human
gucaccaccucccgcaaaccc

SEQ ID NO: 358280 - RNA, 18 nt, Human
gugccuguagucccagcu

SEQ ID NO: 358281 - RNA, 18 nt, Human
gugcgaagggggaaagau

SEQ ID NO: 358282 - RNA, 24 nt, Human
gugcuccagccugggugacagagc

SEQ ID NO: 358283 - RNA, 18 nt, Human
guguccaccgaaagccuc

SEQ ID NO: 358284 - RNA, 21 nt, Human
gugugcuccagccugggugac

SEQ ID NO: 358285 - RNA, 23 nt, Human
uaaaacauuuauaaauggcauca

SEQ ID NO: 358286 - RNA, 22 nt, Human
uaagaaaaauggaugaaugagg

SEQ ID NO: 358287 - RNA, 20 nt, Human
uaaggcggguggaucaccug

SEQ ID NO: 358288 - RNA, 24 nt, Human
uaaggcggguggaucaccugaggu

SEQ ID NO: 358289 - RNA, 26 nt, Human
uaaggcggguggaucaccugagguca

SEQ ID NO: 358290 - RNA, 22 nt, Human
uacccgccuguccacccuccca

SEQ ID NO: 358291 - RNA, 23 nt, Human
uacccgcguucucuccguggccg

SEQ ID NO: 358292 - RNA, 19 nt, Human
uacccuucuccaggguccc

SEQ ID NO: 358293 - RNA, 28 nt, Human
uacugaaaauacaaacauuaucuugaca

SEQ ID NO: 358294 - RNA, 19 nt, Human
uagaaagagacgcgcggaa

SEQ ID NO: 358295 - RNA, 21 nt, Human
uauaucucaguuuuacaagau

SEQ ID NO: 358296 - RNA, 22 nt, Human
uaugacaccuugcaaccacgcg

SEQ ID NO: 358297 - RNA, 20 nt, Human
uaugaucgcaccagugugcu

SEQ ID NO: 358298 - RNA, 25 nt, Human
uauugcacuucacuccaugucagua

SEQ ID NO: 358299 - RNA, 19 nt, Human
ucaaaaauaaaaaacaaag

SEQ ID NO: 358300 - RNA, 22 nt, Human
ucaagcaacuguccagcccaug

SEQ ID NO: 358301 - RNA, 23 nt, Human
ucaauagacucuaaggaucuucc

SEQ ID NO: 358302 - RNA, 20 nt, Human
ucaccugaggucaggaguuc

SEQ ID NO: 358303 - RNA, 22 nt, Human
ucacgccugucaucccagcacu

SEQ ID NO: 358304 - RNA, 20 nt, Human
ucaggacccgggcaaaagca

SEQ ID NO: 358305 - RNA, 18 nt, Human
uccacauucaaauccaca

SEQ ID NO: 358306 - RNA, 21 nt, Human
uccaccgaaagccucucuccu

SEQ ID NO: 358307 - RNA, 24 nt, Human
uccagccugggugacagagcaaga

SEQ ID NO: 358308 - RNA, 18 nt, Human
ucccaaccagaaacagcu

SEQ ID NO: 358309 - RNA, 24 nt, Human
uccccagcgcggucaccaccuccc

SEQ ID NO: 358310 - RNA, 18 nt, Human
uccccucccuuuccaaag

SEQ ID NO: 358311 - RNA, 23 nt, Human
uccguggccggaggaaaagaaac

SEQ ID NO: 358312 - RNA, 28 nt, Human
uccucagccucagccagagaacuauuuc

SEQ ID NO: 358313 - RNA, 23 nt, Human
uccucaggccucuugcaggagcu

SEQ ID NO: 358314 - RNA, 23 nt, Human
ucgcaccagugugcuccagccug

SEQ ID NO: 358315 - RNA, 23 nt, Human
ucgcuaagcuaauucucuuuaau

SEQ ID NO: 358316 - RNA, 24 nt, Human
ucgcuugaacccggggggcggagg

SEQ ID NO: 358317 - RNA, 24 nt, Human
ucgcuugaacucgggaggcggagg

SEQ ID NO: 358318 - RNA, 24 nt, Human
ucgggaggcugaggcaggagaauc

SEQ ID NO: 358319 - RNA, 22 nt, Human
ucuaccccucaccgccugccga

SEQ ID NO: 358320 - RNA, 26 nt, Human
ucucaaaaauaaaaaacaaagaaaua

SEQ ID NO: 358321 - RNA, 19 nt, Human
ucucauuucaucacuguuu

SEQ ID NO: 358322 - RNA, 25 nt, Human
ucuccagggucccaggacgcacggg

SEQ ID NO: 358323 - RNA, 18 nt, Human
ucucccccaccccccagg

SEQ ID NO: 358324 - RNA, 23 nt, Human
ucucuacugaaaauacaaacauu

SEQ ID NO: 358325 - RNA, 19 nt, Human
ucucuggaucucucccugg

SEQ ID NO: 358326 - RNA, 23 nt, Human
ucugcuguuuauaaaacuggggg

SEQ ID NO: 358327 - RNA, 22 nt, Human
ucuggugcaauuacuggucucc

SEQ ID NO: 358328 - RNA, 24 nt, Human
ucuggugcaauuacuggucuccgg

SEQ ID NO: 358329 - RNA, 27 nt, Human
ucugucuuucuuaaaaaaaaaaaaaaa

SEQ ID NO: 358330 - RNA, 23 nt, Human
ucuugcaggagcucccggggugc

SEQ ID NO: 358331 - RNA, 19 nt, Human
ucuuucucucucucucccc

SEQ ID NO: 358332 - RNA, 23 nt, Human
ucuuucuuaaaaaaaaaaaaaaa

SEQ ID NO: 358333 - RNA, 19 nt, Human
ugaaacgccgucucuacua

SEQ ID NO: 358334 - RNA, 22 nt, Human
ugaaacgccgucucuacuauaa

SEQ ID NO: 358335 - RNA, 19 nt, Human
ugacaugguggugggcacc

SEQ ID NO: 358336 - RNA, 20 nt, Human
ugaccaguggauguuaguaa

SEQ ID NO: 358337 - RNA, 21 nt, Human
ugagacggguccaaauggauc

SEQ ID NO: 358338 - RNA, 25 nt, Human
ugagaggaucuuuggagcucaggag

SEQ ID NO: 358339 - RNA, 22 nt, Human
ugagcccaggaguuugaggcug

SEQ ID NO: 358340 - RNA, 20 nt, Human
ugaggcaggagaaucgcuug

SEQ ID NO: 358341 - RNA, 23 nt, Human
ugaggcaggagaaucgcuugaac

SEQ ID NO: 358342 - RNA, 23 nt, Human
ugaggcaggagaaucgcuugaac

SEQ ID NO: 358343 - RNA, 25 nt, Human
ugaggcaggagaaucgcuugaacuc

SEQ ID NO: 358344 - RNA, 24 nt, Human
ugaggcaggagcaucgcuugaacc

SEQ ID NO: 358345 - RNA, 25 nt, Human
ugaggcaggagcaucgcuugaaccc

SEQ ID NO: 358346 - RNA, 23 nt, Human
ugaggcugcagugagcuaugauc

SEQ ID NO: 358347 - RNA, 20 nt, Human
ugaggugggaggauugcuug

SEQ ID NO: 358348 - RNA, 23 nt, Human
ugaggugggaggauugcuugagc

SEQ ID NO: 358349 - RNA, 24 nt, Human
ugaggugggaggauugcuugagcc

SEQ ID NO: 358350 - RNA, 23 nt, Human
ugcacguacaaugggcugaacuc

SEQ ID NO: 358351 - RNA, 18 nt, Human
ugcccggagcacgguggc

SEQ ID NO: 358352 - RNA, 21 nt, Human
ugcccucuuuuauccccuuca

SEQ ID NO: 358353 - RNA, 24 nt, Human
ugccuguagucccagcuacucagg

SEQ ID NO: 358354 - RNA, 24 nt, Human
ugccuguagucccagcuacucggg

SEQ ID NO: 358355 - RNA, 21 nt, Human
ugcguggacggucccgggagc

SEQ ID NO: 358356 - RNA, 18 nt, Human
ugcuugagcccaggaguu

SEQ ID NO: 358357 - RNA, 20 nt, Human
uggagaccacgggcaguggu

SEQ ID NO: 358358 - RNA, 21 nt, Human
uggaggugagaggaucuuugg

SEQ ID NO: 358359 - RNA, 24 nt, Human
uggaucaccugaggucaggaguuc

SEQ ID NO: 358360 - RNA, 27 nt, Human
uggaucaccugaggucaggaguucgag

SEQ ID NO: 358361 - RNA, 21 nt, Human
uggcaccaccgugcccucuuu

SEQ ID NO: 358362 - RNA, 19 nt, Human
uggcggggguggugguggc

SEQ ID NO: 358363 - RNA, 21 nt, Human
ugggaaacggugugugauuug

SEQ ID NO: 358364 - RNA, 19 nt, Human
ugggaaucaaacacuggaa

SEQ ID NO: 358365 - RNA, 20 nt, Human
ugggagaagagguaacgccu

SEQ ID NO: 358366 - RNA, 20 nt, Human
ugggaggccgaggcgggcag

SEQ ID NO: 358367 - RNA, 24 nt, Human
ugggaggccgaggcgggcagauca

SEQ ID NO: 358368 - RNA, 20 nt, Human
ugggaggcuaaggcgggugg

SEQ ID NO: 358369 - RNA, 24 nt, Human
ugggaggcuaaggcggguggauca

SEQ ID NO: 358370 - RNA, 24 nt, Human
ugggagguggaggugagaggaucu

SEQ ID NO: 358371 - RNA, 20 nt, Human
ugggggaacgcagaagaugg

SEQ ID NO: 358372 - RNA, 18 nt, Human
ugggggcacguugggagg

SEQ ID NO: 358373 - RNA, 23 nt, Human
ugguaguaaagaaaaucguuggc

SEQ ID NO: 358374 - RNA, 20 nt, Human
uggugcgaagggggaaagau

SEQ ID NO: 358375 - RNA, 24 nt, Human
ugguggcaggugccuguaguccca

SEQ ID NO: 358376 - RNA, 24 nt, Human
ugguggugggcaccuguaauccca

SEQ ID NO: 358377 - RNA, 24 nt, Human
ugguggugggugccuguaguccca

SEQ ID NO: 358378 - RNA, 18 nt, Human
uguauuuguaacccggac

SEQ ID NO: 358379 - RNA, 18 nt, Human
uguuuucaucugaagcaa

SEQ ID NO: 358380 - RNA, 20 nt, Human
uuacuggucuccgggcuccg

SEQ ID NO: 358381 - RNA, 24 nt, Human
uuagcugggugugguggugggugc

SEQ ID NO: 358382 - RNA, 19 nt, Human
uuaggaaagaaaaccacca

SEQ ID NO: 358383 - RNA, 25 nt, Human
uuauccccuucagaaacacaacccu

SEQ ID NO: 358384 - RNA, 19 nt, Human
uuauugcugccugggaggc

SEQ ID NO: 358385 - RNA, 20 nt, Human
uucauagcuuugaaacggga

SEQ ID NO: 358386 - RNA, 24 nt, Human
uugaacucgggaggcggagguugc

SEQ ID NO: 358387 - RNA, 24 nt, Human
uugcuugagcccaggaguuugagg

SEQ ID NO: 358388 - RNA, 20 nt, Human
uuggagaccacgggcagugg

SEQ ID NO: 358389 - RNA, 21 nt, Human
uuggagaccacgggcaguggu

SEQ ID NO: 358390 - RNA, 25 nt, Human
uugggaggccgaggcgggcagauca

SEQ ID NO: 358391 - RNA, 25 nt, Human
uugggaggcuaaggcggguggauca

SEQ ID NO: 358392 - RNA, 19 nt, Human
uugggagguggaggugaga

SEQ ID NO: 358393 - RNA, 23 nt, Human
uuuuuuuuuuuuaauuuccagcu

SEQ ID NO: 358394 - RNA, 19 nt, Human
aaaacacacauuuaaguug

SEQ ID NO: 358395 - RNA, 18 nt, Human
aaaaggaggcccgccucu

SEQ ID NO: 358396 - RNA, 23 nt, Human
aaagaauagagaauccuuccccc

SEQ ID NO: 358397 - RNA, 27 nt, Human
aacccgcuccuacaaaacccaauucua

SEQ ID NO: 358398 - RNA, 24 nt, Human
aagaguccaucguuguagcuuugc

SEQ ID NO: 358399 - RNA, 24 nt, Human
aagauuuuuuuuuucuaugcaaga

SEQ ID NO: 358400 - RNA, 26 nt, Human
acaagauuuuuuuuuucuaugcaaga

SEQ ID NO: 358401 - RNA, 23 nt, Human
acacacacacacgcacacacaca

SEQ ID NO: 358402 - RNA, 27 nt, Human
acacacacacgcacacacacacggacg

SEQ ID NO: 358403 - RNA, 21 nt, Human
acacacacgcacacacacacg

SEQ ID NO: 358404 - RNA, 24 nt, Human
acacacacggacgaaaacagcaca

SEQ ID NO: 358405 - RNA, 19 nt, Human
acccgcuccuacaaaaccc

SEQ ID NO: 358406 - RNA, 23 nt, Human
acgaaaacagcacagcaaauccu

SEQ ID NO: 358407 - RNA, 19 nt, Human
agacucccccaaacccgcu

SEQ ID NO: 358408 - RNA, 20 nt, Human
agacucccccaaacccgcuc

SEQ ID NO: 358409 - RNA, 25 nt, Human
aggcgggaagagggccggcucccga

SEQ ID NO: 358410 - RNA, 23 nt, Human
caaauagcaguuaagaaauaagu

SEQ ID NO: 358411 - RNA, 25 nt, Human
caacguaaaaggaggcccgccucuc

SEQ ID NO: 358412 - RNA, 24 nt, Human
cacacacacacacgcacacacaca

SEQ ID NO: 358413 - RNA, 21 nt, Human
cacagcaaauccuguuaccag

SEQ ID NO: 358414 - RNA, 31 nt, Human
cacgaacacacacacacacgcacacacacag

SEQ ID NO: 358415 - RNA, 22 nt, Human
cagacucccccaaacccgcucc

SEQ ID NO: 358416 - RNA, 20 nt, Human
cagucucucgagaaucgucu

SEQ ID NO: 358417 - RNA, 31 nt, Human
cauccacacgaacacacacacacacgcacag

SEQ ID NO: 358418 - RNA, 24 nt, Human
caugcaaaccggaauuuacuguca

SEQ ID NO: 358419 - RNA, 33 nt, Human
ccacacgaacacacacacacacgcacacacagu

SEQ ID NO: 358420 - RNA, 22 nt, Human
cccagucucucgagaaucgucu

SEQ ID NO: 358421 - RNA, 25 nt, Human
ccccaaacccgcuccuacaaaaccc

SEQ ID NO: 358422 - RNA, 26 nt, Human
ccccagcggggccacacgugcaucca

SEQ ID NO: 358423 - RNA, 28 nt, Human
cccccaaacccgcuccuacaaaacccaa

SEQ ID NO: 358424 - RNA, 20 nt, Human
ccgcgguuccagcacuaccc

SEQ ID NO: 358425 - RNA, 19 nt, Human
ccuacaaaacccaauucua

SEQ ID NO: 358426 - RNA, 23 nt, Human
ccuacaaaacccaauucuaggcc

SEQ ID NO: 358427 - RNA, 19 nt, Human
ccucgaguaggaaaacggg

SEQ ID NO: 358428 - RNA, 19 nt, Human
ccuguccagucucucucca

SEQ ID NO: 358429 - RNA, 18 nt, Human
ccuuccucuuuuucucuc

SEQ ID NO: 358430 - RNA, 20 nt, Human
ccuuccucuuuuucucuccc

SEQ ID NO: 358431 - RNA, 21 nt, Human
cgaaaacagcacagcaaaucc

SEQ ID NO: 358432 - RNA, 24 nt, Human
cgaacacacacacacacgcacaca

SEQ ID NO: 358433 - RNA, 18 nt, Human
cgagaaucgucuggguug

SEQ ID NO: 358434 - RNA, 18 nt, Human
cgugcaggcugagugccg

SEQ ID NO: 358435 - RNA, 21 nt, Human
cucccccaaacccgcuccuac

SEQ ID NO: 358436 - RNA, 23 nt, Human
cucccccaaacccgcuccuacaa

SEQ ID NO: 358437 - RNA, 24 nt, Human
cucuucuuucugcuuugccuucuu

SEQ ID NO: 358438 - RNA, 18 nt, Human
cucuuuucuugcucuucc

SEQ ID NO: 358439 - RNA, 19 nt, Human
cuuccucuuuuucucuccc

SEQ ID NO: 358440 - RNA, 21 nt, Human
cuuccucuuuuucucucccgu

SEQ ID NO: 358441 - RNA, 19 nt, Human
cuuugccuucuuagcgcau

SEQ ID NO: 358442 - RNA, 21 nt, Human
gagaagcagcggggcgcggag

SEQ ID NO: 358443 - RNA, 18 nt, Human
gcagaaaaaggucaguuu

SEQ ID NO: 358444 - RNA, 21 nt, Human
gcaguccagacaguuuugcca

SEQ ID NO: 358445 - RNA, 20 nt, Human
gggccggcucccgaggucuc

SEQ ID NO: 358446 - RNA, 18 nt, Human
gguaacggagaagcagcg

SEQ ID NO: 358447 - RNA, 21 nt, Human
gugcauccacacgaacacaca

SEQ ID NO: 358448 - RNA, 21 nt, Human
guugccuuccucuuuuucucu

SEQ ID NO: 358449 - RNA, 25 nt, Human
guugccuuccucuuuuucucucccg

SEQ ID NO: 358450 - RNA, 27 nt, Human
uaaaacacacauuuaaguugguaacuc

SEQ ID NO: 358451 - RNA, 24 nt, Human
uaaaaggaggcccgccucucucau

SEQ ID NO: 358452 - RNA, 22 nt, Human
uacccuguccagucucucucca

SEQ ID NO: 358453 - RNA, 24 nt, Human
uacugucagcaguccagacaguuu

SEQ ID NO: 358454 - RNA, 28 nt, Human
uagagaauccuucccccucguggaaucc

SEQ ID NO: 358455 - RNA, 20 nt, Human
uccacacgaacacacacaca

SEQ ID NO: 358456 - RNA, 22 nt, Human
uccacacgaacacacacacaca

SEQ ID NO: 358457 - RNA, 21 nt, Human
ucccugguccugcguggaguc

SEQ ID NO: 358458 - RNA, 19 nt, Human
ucgcauccucuuugcgauc

SEQ ID NO: 358459 - RNA, 18 nt, Human
ucucaaagggguaacgga

SEQ ID NO: 358460 - RNA, 22 nt, Human
ucucucuccagacucccccaaa

SEQ ID NO: 358461 - RNA, 18 nt, Human
ucucuuuucuugcucuuc

SEQ ID NO: 358462 - RNA, 21 nt, Human
ucuggcuuuccgaguccaaga

SEQ ID NO: 358463 - RNA, 23 nt, Human
ucuggcuuuccgaguccaagaug

SEQ ID NO: 358464 - RNA, 21 nt, Human
ucuuuuucucucccguuuguc

SEQ ID NO: 358465 - RNA, 23 nt, Human
ugagaucccugguccugcgugga

SEQ ID NO: 358466 - RNA, 22 nt, Human
ugcaaaccggaauuuacuguca

SEQ ID NO: 358467 - RNA, 18 nt, Human
ugccuuccucuuuuucuc

SEQ ID NO: 358468 - RNA, 27 nt, Human
ugcuuugccuucuuagcgcauuuuuua

SEQ ID NO: 358469 - RNA, 21 nt, Human
uuaaauaaguauaccucuucu

SEQ ID NO: 358470 - RNA, 21 nt, Human
uucccccucguggaauccugg

SEQ ID NO: 358471 - RNA, 23 nt, Human
uugcuccuugguucuccaauuuc

SEQ ID NO: 358472 - RNA, 30 nt, Human
uuuaaaacacacauuuaaguugguaacucc

SEQ ID NO: 358473 - RNA, 23 nt, Human
uuuaaaauuuguuuuugcuccuu

SEQ ID NO: 358474 - RNA, 22 nt, Human
uuugcggugagccaaacuccgc

SEQ ID NO: 358475 - RNA, 24 nt, Human
uuugcggugagccaaacuccgcgg

SEQ ID NO: 358476 - RNA, 20 nt, Human
uuuuccaugcaaaccggaau

SEQ ID NO: 358477 - RNA, 25 nt, Human
uuuucucuuuucuugcucuuccccu

SEQ ID NO: 358478 - RNA, 21 nt, Human
uuuuuuuuuuuuuuuuuccau

SEQ ID NO: 358479 - RNA, 24 nt, Human
uuuuuuuuuuuuuuuuuuuccaug

SEQ ID NO: 358480 - RNA, 23 nt, Human
aauagggcuauucaaauuuuguu

SEQ ID NO: 358481 - RNA, 22 nt, Human
caagaaccaagugaagagggaa

SEQ ID NO: 358482 - RNA, 23 nt, Human
cucuuugcuauguuguaccagac

SEQ ID NO: 358483 - RNA, 21 nt, Human
guagaguacaagaaccaagug

SEQ ID NO: 358484 - RNA, 23 nt, Human
uaaaauugaauccaagucacauu

SEQ ID NO: 358485 - RNA, 20 nt, Human
ucauagccuguucucuuugc

SEQ ID NO: 358486 - RNA, 23 nt, Human
ugaaacuuaaauccugguguuuu

SEQ ID NO: 358487 - RNA, 18 nt, Human
ugaagagggaaaauugua

SEQ ID NO: 358488 - RNA, 23 nt, Human
aaaaccaauaaauacaagaacaa

SEQ ID NO: 358489 - RNA, 23 nt, Human
aaaagaccaaaaacauuuuuugc

SEQ ID NO: 358490 - RNA, 24 nt, Human
aaaaucaauuuaucucuaaccuuc

SEQ ID NO: 358491 - RNA, 24 nt, Human
aaacaaauaugcauaucaaaagau

SEQ ID NO: 358492 - RNA, 18 nt, Human
aaacacuggccagaaaau

SEQ ID NO: 358493 - RNA, 21 nt, Human
aaauacacacaaaaaaagcac

SEQ ID NO: 358494 - RNA, 22 nt, Human
aacaauacaaucaaucuacaac

SEQ ID NO: 358495 - RNA, 24 nt, Human
aacauuuuuugcaaacugccuuuu

SEQ ID NO: 358496 - RNA, 21 nt, Human
aagaaaauauugaacacguua

SEQ ID NO: 358497 - RNA, 25 nt, Human
aagacagaaagagagcaccuuauag

SEQ ID NO: 358498 - RNA, 19 nt, Human
aagaugcccaucuugggug

SEQ ID NO: 358499 - RNA, 18 nt, Human
aagcaguggcccaugacc

SEQ ID NO: 358500 - RNA, 22 nt, Human
acaaaaaaaggaaaaaccugaa

SEQ ID NO: 358501 - RNA, 20 nt, Human
acaaaagccugauuugcagu

SEQ ID NO: 358502 - RNA, 20 nt, Human
accuucaagauuaagcucaa

SEQ ID NO: 358503 - RNA, 23 nt, Human
agcgcgccccgcaacggccgccc

SEQ ID NO: 358504 - RNA, 21 nt, Human
aggcacacacucccacggcaa

SEQ ID NO: 358505 - RNA, 22 nt, Human
aggcacacacucccacggcaaa

SEQ ID NO: 358506 - RNA, 18 nt, Human
auacauauauuuuuucag

SEQ ID NO: 358507 - RNA, 21 nt, Human
caacaaacacaaaacucagaa

SEQ ID NO: 358508 - RNA, 25 nt, Human
cacacacucccacggcaaaaacaaa

SEQ ID NO: 358509 - RNA, 21 nt, Human
cacacucccacggcaaaaaca

SEQ ID NO: 358510 - RNA, 24 nt, Human
cacgcaggcacacacucccacggc

SEQ ID NO: 358511 - RNA, 18 nt, Human
cagaaagagagcaccuua

SEQ ID NO: 358512 - RNA, 24 nt, Human
cagcacuauguauugacucacaaa

SEQ ID NO: 358513 - RNA, 23 nt, Human
caucuguagaagacagaaagaga

SEQ ID NO: 358514 - RNA, 21 nt, Human
ccaacccccgccaccgcgggc

SEQ ID NO: 358515 - RNA, 22 nt, Human
ccaccgccucuucccggcgccg

SEQ ID NO: 358516 - RNA, 18 nt, Human
ccacggcaaaaacaaacu

SEQ ID NO: 358517 - RNA, 27 nt, Human
cccgcaacggccgccccggcucccccc

SEQ ID NO: 358518 - RNA, 18 nt, Human
cccggcuccccccuggcc

SEQ ID NO: 358519 - RNA, 24 nt, Human
ccgccccggcuccccccuggccgc

SEQ ID NO: 358520 - RNA, 23 nt, Human
ccgccgccgccucucgagagcgc

SEQ ID NO: 358521 - RNA, 24 nt, Human
ccgccgccucucgagagcgcgccc

SEQ ID NO: 358522 - RNA, 23 nt, Human
gcacacacccacgcaggcacaca

SEQ ID NO: 358523 - RNA, 19 nt, Human
gcaugacgaugccuucuuc

SEQ ID NO: 358524 - RNA, 22 nt, Human
gccccgcaacggccgccccggc

SEQ ID NO: 358525 - RNA, 23 nt, Human
ggaaaagaaaauauugaacacgu

SEQ ID NO: 358526 - RNA, 21 nt, Human
ggaccccgguccuggcaccaa

SEQ ID NO: 358527 - RNA, 18 nt, Human
ggccgccgccgccucucg

SEQ ID NO: 358528 - RNA, 22 nt, Human
gggaaaagcaguggcccaugac

SEQ ID NO: 358529 - RNA, 18 nt, Human
guuuuagguuggcagaca

SEQ ID NO: 358530 - RNA, 23 nt, Human
uacaaucaaucuacaacaaacac

SEQ ID NO: 358531 - RNA, 24 nt, Human
uaucugaaaaaggaaacaaaagcc

SEQ ID NO: 358532 - RNA, 24 nt, Human
uccaagauaucugaaaaaggaaac

SEQ ID NO: 358533 - RNA, 24 nt, Human
ucugcaaaaccaauaaauacaaga

SEQ ID NO: 358534 - RNA, 24 nt, Human
ucugcaaaaccaauaaauacaaga

SEQ ID NO: 358535 - RNA, 23 nt, Human
ugaaaaacuaaaauuaauaaaaa

SEQ ID NO: 358536 - RNA, 22 nt, Human
ugauuugcuuuuaauuacaaau

SEQ ID NO: 358537 - RNA, 25 nt, Human
ugcaaaaccaauaaauacaagaaca

SEQ ID NO: 358538 - RNA, 23 nt, Human
uggcagacagaugggugccuuau

SEQ ID NO: 358539 - RNA, 20 nt, Human
uggccgccgccgccucucga

SEQ ID NO: 358540 - RNA, 20 nt, Human
uguagaagacagaaagagag

SEQ ID NO: 358541 - RNA, 19 nt, Human
ugugacucaucuguagaag

SEQ ID NO: 358542 - RNA, 18 nt, Human
uuagguuggcagacagau

SEQ ID NO: 358543 - RNA, 22 nt, Human
uuuucagugguuuacuguugac

SEQ ID NO: 358544 - RNA, 21 nt, Human
aaacaaaaguaaaggaaucug

SEQ ID NO: 358545 - RNA, 18 nt, Human
aaacaauuccuaccuccc

SEQ ID NO: 358546 - RNA, 18 nt, Human
aaacaauuccuaccuccc

SEQ ID NO: 358547 - RNA, 19 nt, Human
aaacaauuccuaccuccca

SEQ ID NO: 358548 - RNA, 22 nt, Human
aaaucaccaacaggccaacccc

SEQ ID NO: 358549 - RNA, 23 nt, Human
aacagccgcugacgcaagccccc

SEQ ID NO: 358550 - RNA, 24 nt, Human
aauuuaacccaguaauucucaaac

SEQ ID NO: 358551 - RNA, 23 nt, Human
acaaacaguaucggcagagggca

SEQ ID NO: 358552 - RNA, 24 nt, Human
agaaagacaaacaguaucggcaga

SEQ ID NO: 358553 - RNA, 18 nt, Human
agaacagcauccaaauca

SEQ ID NO: 358554 - RNA, 18 nt, Human
agccacccugcgccgggg

SEQ ID NO: 358555 - RNA, 19 nt, Human
agccauccaauuucagaaa

SEQ ID NO: 358556 - RNA, 27 nt, Human
aggcaggcaggaaggggccucccucuu

SEQ ID NO: 358557 - RNA, 21 nt, Human
aggcggugcgcgccccgcggg

SEQ ID NO: 358558 - RNA, 22 nt, Human
aggcucccuaaaucugcaauuu

SEQ ID NO: 358559 - RNA, 22 nt, Human
auccaaaucaccaacaggccaa

SEQ ID NO: 358560 - RNA, 21 nt, Human
augaaacaguagaaagacaaa

SEQ ID NO: 358561 - RNA, 18 nt, Human
caacaggccaaccccauu

SEQ ID NO: 358562 - RNA, 22 nt, Human
caacaggccaaccccauucauc

SEQ ID NO: 358563 - RNA, 24 nt, Human
caacaggccaaccccauucauccc

SEQ ID NO: 358564 - RNA, 18 nt, Human
caaugucaagggaccaau

SEQ ID NO: 358565 - RNA, 25 nt, Human
caaugucaagggaccaauaugggaa

SEQ ID NO: 358566 - RNA, 22 nt, Human
cacaauuuaacccaguaauucu

SEQ ID NO: 358567 - RNA, 18 nt, Human
caccaacaggccaacccc

SEQ ID NO: 358568 - RNA, 19 nt, Human
cacccugcgccggggcgcu

SEQ ID NO: 358569 - RNA, 21 nt, Human
cagaacagcauccaaaucacc

SEQ ID NO: 358570 - RNA, 21 nt, Human
cagagggcaaccuuaaagcac

SEQ ID NO: 358571 - RNA, 20 nt, Human
cagcauccaaaucaccaaca

SEQ ID NO: 358572 - RNA, 21 nt, Human
cagcccagguccgggcggcgg

SEQ ID NO: 358573 - RNA, 21 nt, Human
cauccaauuucagaaacacug

SEQ ID NO: 358574 - RNA, 25 nt, Human
ccaaauaauuuugaagguuuacgga

SEQ ID NO: 358575 - RNA, 18 nt, Human
ccaaaucaccaacaggcc

SEQ ID NO: 358576 - RNA, 22 nt, Human
ccaaccauggaacugcgggcgc

SEQ ID NO: 358577 - RNA, 18 nt, Human
ccagguccgggcggcgga

SEQ ID NO: 358578 - RNA, 23 nt, Human
cccaaauaauuuugaagguuuac

SEQ ID NO: 358579 - RNA, 19 nt, Human
cccgggccccgaaccccag

SEQ ID NO: 358580 - RNA, 20 nt, Human
cccgggccccgaaccccagc

SEQ ID NO: 358581 - RNA, 23 nt, Human
cccugcgccggggcgcuggcucc

SEQ ID NO: 358582 - RNA, 23 nt, Human
ccuaccucccacaaacaaaagua

SEQ ID NO: 358583 - RNA, 25 nt, Human
ccucccacaaacaaaaguaaaggaa

SEQ ID NO: 358584 - RNA, 19 nt, Human
cgcgcgcggacgugacgcc

SEQ ID NO: 358585 - RNA, 20 nt, Human
cgcgcugaugcacuccgcag

SEQ ID NO: 358586 - RNA, 22 nt, Human
cgcuuccugcucgggcugcggg

SEQ ID NO: 358587 - RNA, 24 nt, Human
cgucccgggccccgaaccccagcc

SEQ ID NO: 358588 - RNA, 23 nt, Human
cgugacgccuggacacgugugcg

SEQ ID NO: 358589 - RNA, 24 nt, Human
cugaugcacuccgcagcccccggc

SEQ ID NO: 358590 - RNA, 19 nt, Human
cuuuccacaauuuaaccca

SEQ ID NO: 358591 - RNA, 21 nt, Human
gccccgaaccccagcggugcg

SEQ ID NO: 358592 - RNA, 18 nt, Human
gccuggacacgugugcgg

SEQ ID NO: 358593 - RNA, 24 nt, Human
gcgggcgccugccugccgcggggc

SEQ ID NO: 358594 - RNA, 18 nt, Human
ggcguuccgagcacgccu

SEQ ID NO: 358595 - RNA, 22 nt, Human
gggcgccugccugccgcggggc

SEQ ID NO: 358596 - RNA, 19 nt, Human
gggucgaagccagauggga

SEQ ID NO: 358597 - RNA, 22 nt, Human
uaguuuuaauuugaggguuggg

SEQ ID NO: 358598 - RNA, 21 nt, Human
uauggaauaaaacaucuauaa

SEQ ID NO: 358599 - RNA, 18 nt, Human
ucacagaacagcauccaa

SEQ ID NO: 358600 - RNA, 19 nt, Human
uccgcccggcuccagcugg

SEQ ID NO: 358601 - RNA, 20 nt, Human
uccuaccucccacaaacaaa

SEQ ID NO: 358602 - RNA, 22 nt, Human
ucgaagccagaugggacacugc

SEQ ID NO: 358603 - RNA, 18 nt, Human
ucgcugcagcccgcgggg

SEQ ID NO: 358604 - RNA, 19 nt, Human
ugaaagaucacugaugaga

SEQ ID NO: 358605 - RNA, 18 nt, Human
ugacuugugaagacauau

SEQ ID NO: 358606 - RNA, 20 nt, Human
ugaggguugggggaaguuag

SEQ ID NO: 358607 - RNA, 24 nt, Human
ugaugcacuccgcagcccccggcg

SEQ ID NO: 358608 - RNA, 21 nt, Human
ugcacuccgcagcccccggcg

SEQ ID NO: 358609 - RNA, 24 nt, Human
ugugcggccgcccaggcgcgcggg

SEQ ID NO: 358610 - RNA, 21 nt, Human
uguggguccugacuugugaag

SEQ ID NO: 358611 - RNA, 24 nt, Human
uugaaagaucacugaugagacugu

SEQ ID NO: 358612 - RNA, 18 nt, Human
uuuagaucacagaacagc

SEQ ID NO: 358613 - RNA, 20 nt, Human
aaaucaauauuuagaugcag

SEQ ID NO: 358614 - RNA, 21 nt, Human
aauccuaccugccuguucaga

SEQ ID NO: 358615 - RNA, 24 nt, Human
acagagagagcaagcccaucucuc

SEQ ID NO: 358616 - RNA, 18 nt, Human
accaccuacuugcccccc

SEQ ID NO: 358617 - RNA, 19 nt, Human
acugagcacacugaauccu

SEQ ID NO: 358618 - RNA, 18 nt, Human
agaaaauaaacaugggaa

SEQ ID NO: 358619 - RNA, 18 nt, Human
agaagauuuggggguagg

SEQ ID NO: 358620 - RNA, 25 nt, Human
agcccaucucucuccaaauccccag

SEQ ID NO: 358621 - RNA, 21 nt, Human
aggaugcugucuggaaagaau

SEQ ID NO: 358622 - RNA, 19 nt, Human
aggcggggaggaugcuguc

SEQ ID NO: 358623 - RNA, 22 nt, Human
agguggaaggcggggaggaugc

SEQ ID NO: 358624 - RNA, 20 nt, Human
aguaaaaggagcaggcugga

SEQ ID NO: 358625 - RNA, 21 nt, Human
aguaaaaggagcaggcuggaa

SEQ ID NO: 358626 - RNA, 23 nt, Human
auaaagccuucucugauccacaa

SEQ ID NO: 358627 - RNA, 22 nt, Human
auaagcacccagucuaaggacc

SEQ ID NO: 358628 - RNA, 18 nt, Human
auaggaacacguuccagg

SEQ ID NO: 358629 - RNA, 18 nt, Human
auaugugugcaugugugu

SEQ ID NO: 358630 - RNA, 18 nt, Human
auccaugggagggaaggu

SEQ ID NO: 358631 - RNA, 18 nt, Human
auguguguggcaggaggc

SEQ ID NO: 358632 - RNA, 19 nt, Human
caaggaugcugcagaggau

SEQ ID NO: 358633 - RNA, 21 nt, Human
caccuacuugccccccagagc

SEQ ID NO: 358634 - RNA, 20 nt, Human
cacugagcacacugaauccu

SEQ ID NO: 358635 - RNA, 21 nt, Human
cagaugucugccucucucacu

SEQ ID NO: 358636 - RNA, 22 nt, Human
cagcccaaccagccagagugau

SEQ ID NO: 358637 - RNA, 20 nt, Human
cagggucaggccaggcagag

SEQ ID NO: 358638 - RNA, 28 nt, Human
ccaaccagccagagugauaggaacugac

SEQ ID NO: 358639 - RNA, 20 nt, Human
ccaggggcggcaggcccuuc

SEQ ID NO: 358640 - RNA, 28 nt, Human
ccauguuucuucucuuccucuaagacuc

SEQ ID NO: 358641 - RNA, 22 nt, Human
cccaucucucuccaaaucccca

SEQ ID NO: 358642 - RNA, 22 nt, Human
ccccagugcacugagcacacug

SEQ ID NO: 358643 - RNA, 19 nt, Human
ccccuagaguaaaaggagc

SEQ ID NO: 358644 - RNA, 22 nt, Human
ccccuagaguaaaaggagcagg

SEQ ID NO: 358645 - RNA, 23 nt, Human
cccugaugggagagauagaccuu

SEQ ID NO: 358646 - RNA, 24 nt, Human
cccuguaccaccuacuugcccccc

SEQ ID NO: 358647 - RNA, 21 nt, Human
cccugugcuauaaagccuucc

SEQ ID NO: 358648 - RNA, 26 nt, Human
cccuucagguccucaggaauuagcac

SEQ ID NO: 358649 - RNA, 24 nt, Human
cuaagacucaucugaaugccccug

SEQ ID NO: 358650 - RNA, 25 nt, Human
cuaggguuaggagaagauuuggggg

SEQ ID NO: 358651 - RNA, 18 nt, Human
cucucuccaaauccccag

SEQ ID NO: 358652 - RNA, 22 nt, Human
cucuggauugccugguaucugu

SEQ ID NO: 358653 - RNA, 22 nt, Human
cuugaagcccccauggucuugc

SEQ ID NO: 358654 - RNA, 20 nt, Human
gaaaucaauauuuagaugca

SEQ ID NO: 358655 - RNA, 18 nt, Human
gaagucacuuuguucuga

SEQ ID NO: 358656 - RNA, 19 nt, Human
gauaugugugcaugugugu

SEQ ID NO: 358657 - RNA, 20 nt, Human
gccauguuucuucucuuccu

SEQ ID NO: 358658 - RNA, 23 nt, Human
gccauguuucuucucuuccucua

SEQ ID NO: 358659 - RNA, 22 nt, Human
ggaaggcuggaccugauuuccu

SEQ ID NO: 358660 - RNA, 22 nt, Human
ggaugcagagcuuccacgcccu

SEQ ID NO: 358661 - RNA, 18 nt, Human
gggcauggaccucgggag

SEQ ID NO: 358662 - RNA, 18 nt, Human
gugcguggcccuccuggg

SEQ ID NO: 358663 - RNA, 18 nt, Human
uaagcacccagucuaagg

SEQ ID NO: 358664 - RNA, 20 nt, Human
uaccucagacauggguagga

SEQ ID NO: 358665 - RNA, 19 nt, Human
uaccugccuguucagaugu

SEQ ID NO: 358666 - RNA, 21 nt, Human
uaucugucgugaggcugcacu

SEQ ID NO: 358667 - RNA, 24 nt, Human
ucaauauuuagaugcagacuucaa

SEQ ID NO: 358668 - RNA, 19 nt, Human
uccaggggcauggaccucg

SEQ ID NO: 358669 - RNA, 24 nt, Human
ucuaagacucaucugaaugcccuu

SEQ ID NO: 358670 - RNA, 19 nt, Human
ucugauccacaaacucagu

SEQ ID NO: 358671 - RNA, 20 nt, Human
ucugauccacaaacucaguu

SEQ ID NO: 358672 - RNA, 26 nt, Human
ugaaugccccugugcuauaaagccuu

SEQ ID NO: 358673 - RNA, 20 nt, Human
ugagaauggcaucauucugc

SEQ ID NO: 358674 - RNA, 18 nt, Human
ugagcaggaaaacaagcc

SEQ ID NO: 358675 - RNA, 19 nt, Human
ugagcaggaaaacaagccu

SEQ ID NO: 358676 - RNA, 20 nt, Human
ugaggauagacacuguaucc

SEQ ID NO: 358677 - RNA, 19 nt, Human
ugcacagagagagcaagcc

SEQ ID NO: 358678 - RNA, 25 nt, Human
ugccauguuucuucucuuccucuaa

SEQ ID NO: 358679 - RNA, 20 nt, Human
ugcuucuggcuaauccccca

SEQ ID NO: 358680 - RNA, 20 nt, Human
uggagaagagugaggagccu

SEQ ID NO: 358681 - RNA, 18 nt, Human
uggcaggaggcucugggc

SEQ ID NO: 358682 - RNA, 18 nt, Human
uggcaggaggcucugggc

SEQ ID NO: 358683 - RNA, 18 nt, Human
uguaaacccagcugacag

SEQ ID NO: 358684 - RNA, 23 nt, Human
ugugcauguguguggcaggaggc

SEQ ID NO: 358685 - RNA, 21 nt, Human
uguguagagcaagguauggga

SEQ ID NO: 358686 - RNA, 23 nt, Human
uguguggcaggaggcucugggcu

SEQ ID NO: 358687 - RNA, 23 nt, Human
uguguguggcaggaggcucuggg

SEQ ID NO: 358688 - RNA, 21 nt, Human
uguucuucccaggcuggggug

SEQ ID NO: 358689 - RNA, 22 nt, Human
uguuucuucucuuccucuaaga

SEQ ID NO: 358690 - RNA, 19 nt, Human
uuaaugccugauggagaag

SEQ ID NO: 358691 - RNA, 18 nt, Human
uuagcacuauuauccaug

SEQ ID NO: 358692 - RNA, 26 nt, Human
uuuggggguagguauugaaaaggaag

SEQ ID NO: 358693 - RNA, 30 nt, Human
agcaccuuccuaccccuuaauuaaauagcc

SEQ ID NO: 358694 - RNA, 20 nt, Human
agcgacgagcccccugcccu

SEQ ID NO: 358695 - RNA, 21 nt, Human
aggcaaccgacaggcuacagc

SEQ ID NO: 358696 - RNA, 22 nt, Human
aguaggcaaccgacaggcuaca

SEQ ID NO: 358697 - RNA, 22 nt, Human
caagagggggugaguccaagug

SEQ ID NO: 358698 - RNA, 23 nt, Human
cacacaggcggaccccgcaaagc

SEQ ID NO: 358699 - RNA, 21 nt, Human
cacagcaccuuccuaccccuu

SEQ ID NO: 358700 - RNA, 21 nt, Human
cacaggcggaccccgcaaagc

SEQ ID NO: 358701 - RNA, 21 nt, Human
caccuccagcacagucagcuc

SEQ ID NO: 358702 - RNA, 21 nt, Human
caccuuuggguccugcucagc

SEQ ID NO: 358703 - RNA, 20 nt, Human
cagaauucucuacuggccuc

SEQ ID NO: 358704 - RNA, 18 nt, Human
cagcacagucagcuccca

SEQ ID NO: 358705 - RNA, 21 nt, Human
cagcagaguaggcaaccgaca

SEQ ID NO: 358706 - RNA, 19 nt, Human
cagcccacagcaccuuccu

SEQ ID NO: 358707 - RNA, 23 nt, Human
cagcgacgagcccccugcccugg

SEQ ID NO: 358708 - RNA, 19 nt, Human
caggcggaccccgcaaagc

SEQ ID NO: 358709 - RNA, 24 nt, Human
ccacagcaccuuccuaccccuuaa

SEQ ID NO: 358710 - RNA, 19 nt, Human
ccagccacccccacagcca

SEQ ID NO: 358711 - RNA, 23 nt, Human
ccagcccacagcaccuuccuacc

SEQ ID NO: 358712 - RNA, 21 nt, Human
ccagcgcccccacccugacug

SEQ ID NO: 358713 - RNA, 22 nt, Human
ccagcgcccccacccugacugg

SEQ ID NO: 358714 - RNA, 19 nt, Human
cccaaugccccugcccucc

SEQ ID NO: 358715 - RNA, 25 nt, Human
cccacagccacgcaugggggucacc

SEQ ID NO: 358716 - RNA, 22 nt, Human
ccccacaccagugcucuuccca

SEQ ID NO: 358717 - RNA, 20 nt, Human
cccccacaccagugcucuuc

SEQ ID NO: 358718 - RNA, 28 nt, Human
cccccacaccagugcucuucccaugccu

SEQ ID NO: 358719 - RNA, 18 nt, Human
cccccugcccuggccggg

SEQ ID NO: 358720 - RNA, 20 nt, Human
ccccgcaaagccugucaccu

SEQ ID NO: 358721 - RNA, 22 nt, Human
cccucucuggagggcacccacc

SEQ ID NO: 358722 - RNA, 22 nt, Human
cccugacuggaucucggcuccc

SEQ ID NO: 358723 - RNA, 28 nt, Human
ccuccagcacagucagcucccaagucga

SEQ ID NO: 358724 - RNA, 24 nt, Human
ccugcacacaggcggaccccgcaa

SEQ ID NO: 358725 - RNA, 19 nt, Human
cggcuccauaagagcagcc

SEQ ID NO: 358726 - RNA, 21 nt, Human
cuccagcgcccccacccugac

SEQ ID NO: 358727 - RNA, 19 nt, Human
cuccccaagagggggugag

SEQ ID NO: 358728 - RNA, 21 nt, Human
cucgguggaacccccacacca

SEQ ID NO: 358729 - RNA, 22 nt, Human
cugggagguagcagccccucuc

SEQ ID NO: 358730 - RNA, 23 nt, Human
gaacccccacaccagugcucuuc

SEQ ID NO: 358731 - RNA, 21 nt, Human
gacagcagaguaggcaaccga

SEQ ID NO: 358732 - RNA, 20 nt, Human
gacuccugcacacaggcgga

SEQ ID NO: 358733 - RNA, 20 nt, Human
gcacccacccauucccaaug

SEQ ID NO: 358734 - RNA, 23 nt, Human
gccacccccacagccacgcaugg

SEQ ID NO: 358735 - RNA, 21 nt, Human
gccaggcccagaacucccucc

SEQ ID NO: 358736 - RNA, 21 nt, Human
gcccagaacucccuccccaag

SEQ ID NO: 358737 - RNA, 23 nt, Human
gccccugcccuccugggaggcca

SEQ ID NO: 358738 - RNA, 19 nt, Human
gccucgggccaccuuuggg

SEQ ID NO: 358739 - RNA, 24 nt, Human
gcugggagguagcagccccucucu

SEQ ID NO: 358740 - RNA, 21 nt, Human
ggaacccccacaccagugcuc

SEQ ID NO: 358741 - RNA, 24 nt, Human
ggccgggcucccacggcuccagcg

SEQ ID NO: 358742 - RNA, 20 nt, Human
gggagagcugucaucccggc

SEQ ID NO: 358743 - RNA, 18 nt, Human
guagguuuguaaccucuu

SEQ ID NO: 358744 - RNA, 24 nt, Human
uagcagccccucucuggagggcac

SEQ ID NO: 358745 - RNA, 20 nt, Human
uccaagugggucauacuggc

SEQ ID NO: 358746 - RNA, 18 nt, Human
ucccaaugccccugcccu

SEQ ID NO: 358747 - RNA, 18 nt, Human
ucccacggcuccagcgcc

SEQ ID NO: 358748 - RNA, 23 nt, Human
uccccuucucgguggaaccccca

SEQ ID NO: 358749 - RNA, 18 nt, Human
uccguuuuaggaaaaaua

SEQ ID NO: 358750 - RNA, 21 nt, Human
uccugcucagcgaccuugcga

SEQ ID NO: 358751 - RNA, 24 nt, Human
ucucuggagggcacccacccauuc

SEQ ID NO: 358752 - RNA, 24 nt, Human
ugccccugcccuccugggaggcca

SEQ ID NO: 358753 - RNA, 18 nt, Human
ugcccuggccgggcuccc

SEQ ID NO: 358754 - RNA, 22 nt, Human
ugccucgggccaccuuuggguc

SEQ ID NO: 358755 - RNA, 23 nt, Human
uggccgggcucccacggcuccag

SEQ ID NO: 358756 - RNA, 21 nt, Human
ugggaccagcccacagcaccc

SEQ ID NO: 358757 - RNA, 26 nt, Human
uuaaugguagguuuguaaccucuuuu

SEQ ID NO: 358758 - RNA, 18 nt, Human
uuuuuuuuuuuuuuuccg

SEQ ID NO: 358759 - RNA, 24 nt, Human
uuuuuuuuuuuuuuuuuccguuuu

SEQ ID NO: 358760 - RNA, 19 nt, Human
aaccccaggcucucggcug

SEQ ID NO: 358761 - RNA, 19 nt, Human
aaccuuagguccacccagc

SEQ ID NO: 358762 - RNA, 18 nt, Human
agaccuggagguggggug

SEQ ID NO: 358763 - RNA, 22 nt, Human
agaccuggagguggggugagcc

SEQ ID NO: 358764 - RNA, 21 nt, Human
agggcuggggcugggaagggg

SEQ ID NO: 358765 - RNA, 21 nt, Human
aggggcggcuggggagggagg

SEQ ID NO: 358766 - RNA, 21 nt, Human
auggcccccgggccgggccuc

SEQ ID NO: 358767 - RNA, 23 nt, Human
caacuccaaggccccuucaccaa

SEQ ID NO: 358768 - RNA, 23 nt, Human
cacuugacagaccuggagguggg

SEQ ID NO: 358769 - RNA, 24 nt, Human
cagccugagaaguguggcaccaaa

SEQ ID NO: 358770 - RNA, 22 nt, Human
ccaaccagggcggccagccuga

SEQ ID NO: 358771 - RNA, 24 nt, Human
ccaaccagggcggccagccugaga

SEQ ID NO: 358772 - RNA, 23 nt, Human
ccagggcuggggcugggaagggg

SEQ ID NO: 358773 - RNA, 20 nt, Human
ccaucagccccagggacaaa

SEQ ID NO: 358774 - RNA, 19 nt, Human
ccccagggacaaaggccac

SEQ ID NO: 358775 - RNA, 21 nt, Human
cccuucaccaaugaaccccag

SEQ ID NO: 358776 - RNA, 18 nt, Human
ccgggccgacugggcugg

SEQ ID NO: 358777 - RNA, 24 nt, Human
ccugagaaguguggcaccaaaagg

SEQ ID NO: 358778 - RNA, 18 nt, Human
cugggguucgcaggaggc

SEQ ID NO: 358779 - RNA, 21 nt, Human
gaauggggugggaaggaaccu

SEQ ID NO: 358780 - RNA, 19 nt, Human
gaggaccaggacuggcaca

SEQ ID NO: 358781 - RNA, 19 nt, Human
gauuccacugccgcaucuc

SEQ ID NO: 358782 - RNA, 27 nt, Human
gccccggcagucacaacuccaaggccc

SEQ ID NO: 358783 - RNA, 19 nt, Human
gcucucggcugccccaacc

SEQ ID NO: 358784 - RNA, 25 nt, Human
gcuggggagggaggaccaggacugg

SEQ ID NO: 358785 - RNA, 18 nt, Human
ggcugcugucuccagggc

SEQ ID NO: 358786 - RNA, 25 nt, Human
ggcugggaaggggugggagccgggc

SEQ ID NO: 358787 - RNA, 23 nt, Human
gggcuggggcugggaaggggugg

SEQ ID NO: 358788 - RNA, 24 nt, Human
gggcuggggcugggaagggguggg

SEQ ID NO: 358789 - RNA, 19 nt, Human
ggugguaggggcggcuggg

SEQ ID NO: 358790 - RNA, 20 nt, Human
ggugguaggggcggcugggg

SEQ ID NO: 358791 - RNA, 21 nt, Human
guaggggcggcuggggaggga

SEQ ID NO: 358792 - RNA, 26 nt, Human
gugcaggcugggguucgcaggaggcu

SEQ ID NO: 358793 - RNA, 20 nt, Human
ucuccagggcuggggcuggg

SEQ ID NO: 358794 - RNA, 18 nt, Human
ugaugcuggugaguuggg

SEQ ID NO: 358795 - RNA, 21 nt, Human
uggggagggaggaccaggacu

SEQ ID NO: 358796 - RNA, 24 nt, Human
uggggcugggaaggggugggagcc

SEQ ID NO: 358797 - RNA, 21 nt, Human
uuuuuuuuuuuuuuuuccaga

SEQ ID NO: 358798 - RNA, 22 nt, Human
uuuuuuuuuuuuuuuuuuccag

SEQ ID NO: 358799 - RNA, 18 nt, Human
aacccugccucccuaccc

SEQ ID NO: 358800 - RNA, 25 nt, Human
acaauggagggagagacagccugaa

SEQ ID NO: 358801 - RNA, 21 nt, Human
acagaagaaccugucgggugg

SEQ ID NO: 358802 - RNA, 23 nt, Human
acaggaaccaaaagugugaauaa

SEQ ID NO: 358803 - RNA, 25 nt, Human
accccaggauccaaguacagagcug

SEQ ID NO: 358804 - RNA, 25 nt, Human
acgccaggaccccacgcugcccggu

SEQ ID NO: 358805 - RNA, 22 nt, Human
aggacagggccgguggcaggga

SEQ ID NO: 358806 - RNA, 18 nt, Human
aggagagggggcgccgcu

SEQ ID NO: 358807 - RNA, 19 nt, Human
agggagcucugccgcggcc

SEQ ID NO: 358808 - RNA, 21 nt, Human
agggagcucugccgcggccag

SEQ ID NO: 358809 - RNA, 25 nt, Human
auaaaacacaggaaccaaaagugug

SEQ ID NO: 358810 - RNA, 19 nt, Human
aucuugggguguggcccag

SEQ ID NO: 358811 - RNA, 23 nt, Human
caaaacgccggguuugaaucuug

SEQ ID NO: 358812 - RNA, 22 nt, Human
caagacccgggcuccguccccu

SEQ ID NO: 358813 - RNA, 18 nt, Human
caaguguccugugaagug

SEQ ID NO: 358814 - RNA, 20 nt, Human
cacagaagaaccugucgggu

SEQ ID NO: 358815 - RNA, 22 nt, Human
cagaagaaccugucggguggug

SEQ ID NO: 358816 - RNA, 18 nt, Human
caggaccccacgcugccc

SEQ ID NO: 358817 - RNA, 19 nt, Human
caggugccacgagccggag

SEQ ID NO: 358818 - RNA, 22 nt, Human
ccacgcugcccgguucggggcu

SEQ ID NO: 358819 - RNA, 24 nt, Human
ccaggauccaaguacagagcugaa

SEQ ID NO: 358820 - RNA, 18 nt, Human
ccaggccaggaggcucag

SEQ ID NO: 358821 - RNA, 21 nt, Human
ccaggggccuuccccaccccc

SEQ ID NO: 358822 - RNA, 22 nt, Human
ccccagggccccugaucuuggg

SEQ ID NO: 358823 - RNA, 21 nt, Human
ccccugaucuugggguguggc

SEQ ID NO: 358824 - RNA, 18 nt, Human
ccgagguggcggccaaug

SEQ ID NO: 358825 - RNA, 19 nt, Human
ccggcgccggaucgcgguu

SEQ ID NO: 358826 - RNA, 18 nt, Human
ccgggcagccuggcuggc

SEQ ID NO: 358827 - RNA, 26 nt, Human
ccgguuccuaacccugccucccuacc

SEQ ID NO: 358828 - RNA, 19 nt, Human
ccuccaggcgccggugccg

SEQ ID NO: 358829 - RNA, 18 nt, Human
ccugcaguuugugcucuc

SEQ ID NO: 358830 - RNA, 20 nt, Human
cgccaggaccccacgcugcc

SEQ ID NO: 358831 - RNA, 21 nt, Human
cgccaggaccccacgcugccc

SEQ ID NO: 358832 - RNA, 24 nt, Human
cgcgcugugcccugccgggggcgg

SEQ ID NO: 358833 - RNA, 23 nt, Human
cgcggccaggggccuuccccacc

SEQ ID NO: 358834 - RNA, 21 nt, Human
cggcgccggaucgcgguugcc

SEQ ID NO: 358835 - RNA, 21 nt, Human
cgggcgcgggguacggggcgg

SEQ ID NO: 358836 - RNA, 22 nt, Human
cggugggggccaggccaggagg

SEQ ID NO: 358837 - RNA, 18 nt, Human
cuaacccugccucccuac

SEQ ID NO: 358838 - RNA, 18 nt, Human
cugggggcaccaagaccg

SEQ ID NO: 358839 - RNA, 21 nt, Human
cuuccccacccccggguaccu

SEQ ID NO: 358840 - RNA, 20 nt, Human
gccaggaccccacgcugccc

SEQ ID NO: 358841 - RNA, 22 nt, Human
gcccagcgcgcugugcccugcc

SEQ ID NO: 358842 - RNA, 23 nt, Human
gcgccggaucgcgguugcccagc

SEQ ID NO: 358843 - RNA, 25 nt, Human
gcgcgcugugcccugccgggggcgg

SEQ ID NO: 358844 - RNA, 23 nt, Human
gcggccaauggggagcaagaccc

SEQ ID NO: 358845 - RNA, 22 nt, Human
gcggccaggggccuuccccacc

SEQ ID NO: 358846 - RNA, 18 nt, Human
gcgggcgcgggguacggg

SEQ ID NO: 358847 - RNA, 24 nt, Human
gcgguugcccagcgcgcugugccc

SEQ ID NO: 358848 - RNA, 19 nt, Human
ggagggggaggggcggagc

SEQ ID NO: 358849 - RNA, 19 nt, Human
ggcccagcagcaugcuagc

SEQ ID NO: 358850 - RNA, 21 nt, Human
ggcgcuggggcggcaagcagg

SEQ ID NO: 358851 - RNA, 23 nt, Human
ggcuccguccccugugcgcccca

SEQ ID NO: 358852 - RNA, 20 nt, Human
gggacagcaggagagggggc

SEQ ID NO: 358853 - RNA, 23 nt, Human
gggagcaagacccgggcuccguc

SEQ ID NO: 358854 - RNA, 20 nt, Human
gggccguggggagggggagg

SEQ ID NO: 358855 - RNA, 22 nt, Human
gggcggaugcaccggugggggc

SEQ ID NO: 358856 - RNA, 23 nt, Human
guuggcuucuaagcucugagauu

SEQ ID NO: 358857 - RNA, 19 nt, Human
uaaaacacaggaaccaaaa

SEQ ID NO: 358858 - RNA, 19 nt, Human
uaacccugccucccuaccc

SEQ ID NO: 358859 - RNA, 23 nt, Human
uaagucuucgauauaaaacacag

SEQ ID NO: 358860 - RNA, 21 nt, Human
uaccuuuaccuccaggcgccg

SEQ ID NO: 358861 - RNA, 18 nt, Human
ucacuggaaggucuaguc

SEQ ID NO: 358862 - RNA, 25 nt, Human
ucacuggaaggucuagucacugggu

SEQ ID NO: 358863 - RNA, 22 nt, Human
uccggcgccggaucgcgguugc

SEQ ID NO: 358864 - RNA, 18 nt, Human
uccugucuccacucucaa

SEQ ID NO: 358865 - RNA, 22 nt, Human
ucgaccccuccaguccggcgcc

SEQ ID NO: 358866 - RNA, 25 nt, Human
ucucgacuaagacauaaccgggguc

SEQ ID NO: 358867 - RNA, 20 nt, Human
ugagaucacuuucuucacug

SEQ ID NO: 358868 - RNA, 24 nt, Human
ugccgggcagccuggcuggcagcc

SEQ ID NO: 358869 - RNA, 23 nt, Human
ugcuuuauucacuugccgucccc

SEQ ID NO: 358870 - RNA, 24 nt, Human
ugcuuuauucacuugccgucccca

SEQ ID NO: 358871 - RNA, 20 nt, Human
uggaccucuugagaucacuu

SEQ ID NO: 358872 - RNA, 21 nt, Human
uggcgcggccggagcuggggg

SEQ ID NO: 358873 - RNA, 19 nt, Human
uggcuaaugauaggcgggc

SEQ ID NO: 358874 - RNA, 20 nt, Human
uggcuuggcuguuaaguccc

SEQ ID NO: 358875 - RNA, 19 nt, Human
uggggagggggaggggcgg

SEQ ID NO: 358876 - RNA, 20 nt, Human
ugggggcaccaagaccgcag

SEQ ID NO: 358877 - RNA, 23 nt, Human
uguagggucuuccuucagcugca

SEQ ID NO: 358878 - RNA, 18 nt, Human
uguccugucuccacucuc

SEQ ID NO: 358879 - RNA, 20 nt, Human
uguccugucuccacucucaa

SEQ ID NO: 358880 - RNA, 26 nt, Human
uguccugucuccacucucaauuccaa

SEQ ID NO: 358881 - RNA, 28 nt, Human
uucacuugccguccccagggccccugau

SEQ ID NO: 358882 - RNA, 22 nt, Human
uucagcugcaacaagggccugc

SEQ ID NO: 358883 - RNA, 23 nt, Human
uucugguuggcgcggccggagcu

SEQ ID NO: 358884 - RNA, 18 nt, Human
aaaaauacaacaaugagc

SEQ ID NO: 358885 - RNA, 24 nt, Human
aaacauggcaaaacccugucucua

SEQ ID NO: 358886 - RNA, 24 nt, Human
aaagugcugagaccacaggcguga

SEQ ID NO: 358887 - RNA, 20 nt, Human
aacauggcaaaacccugucu

SEQ ID NO: 358888 - RNA, 21 nt, Human
aacauggcaaaacccugucuc

SEQ ID NO: 358889 - RNA, 21 nt, Human
aacccugucucuaccaaaaau

SEQ ID NO: 358890 - RNA, 19 nt, Human
aagccugguggaggggcag

SEQ ID NO: 358891 - RNA, 26 nt, Human
aagugcugagaccacaggcgugagcc

SEQ ID NO: 358892 - RNA, 24 nt, Human
acagagucagacccugucucaaaa

SEQ ID NO: 358893 - RNA, 24 nt, Human
accaucuugcccaggcuggucucg

SEQ ID NO: 358894 - RNA, 20 nt, Human
acccacuucagccucccaaa

SEQ ID NO: 358895 - RNA, 24 nt, Human
acccugucucuaccaaaaauacaa

SEQ ID NO: 358896 - RNA, 25 nt, Human
acuccugacuugugauccacccacu

SEQ ID NO: 358897 - RNA, 25 nt, Human
acucuguugcccaggcuggagugca

SEQ ID NO: 358898 - RNA, 23 nt, Human
acuucagccucccaaagugcuga

SEQ ID NO: 358899 - RNA, 18 nt, Human
agagaagcuucuguagua

SEQ ID NO: 358900 - RNA, 25 nt, Human
agaggcgggcagauugcuugagccc

SEQ ID NO: 358901 - RNA, 24 nt, Human
agcugugguggcucacgucugcaa

SEQ ID NO: 358902 - RNA, 18 nt, Human
aggaguccgagaccagcc

SEQ ID NO: 358903 - RNA, 21 nt, Human
aggcagaggcgggcagauugc

SEQ ID NO: 358904 - RNA, 24 nt, Human
aggcagaggcgggcagauugcuug

SEQ ID NO: 358905 - RNA, 25 nt, Human
aggcuggagugcagugggacgaucu

SEQ ID NO: 358906 - RNA, 24 nt, Human
agguugaggcuacagugagccgag

SEQ ID NO: 358907 - RNA, 18 nt, Human
aguagcugggauuuuagg

SEQ ID NO: 358908 - RNA, 21 nt, Human
aguccgagaccagccagggaa

SEQ ID NO: 358909 - RNA, 24 nt, Human
agugcagugggacgaucucggcuc

SEQ ID NO: 358910 - RNA, 18 nt, Human
augggguuucaccaucuu

SEQ ID NO: 358911 - RNA, 19 nt, Human
augggguuucaccaucuug

SEQ ID NO: 358912 - RNA, 24 nt, Human
augggguuucaccaucuugcccag

SEQ ID NO: 358913 - RNA, 24 nt, Human
auugcaccacuggacuccggccug

SEQ ID NO: 358914 - RNA, 20 nt, Human
auuuagaaacagagucucac

SEQ ID NO: 358915 - RNA, 24 nt, Human
caaagugcugagaccacaggcgug

SEQ ID NO: 358916 - RNA, 23 nt, Human
caaccuccaccucccggguucaa

SEQ ID NO: 358917 - RNA, 23 nt, Human
caauuguagucccagccacuugg

SEQ ID NO: 358918 - RNA, 24 nt, Human
cacaggcgugagccaccaugccca

SEQ ID NO: 358919 - RNA, 24 nt, Human
caccaucuugcccaggcuggucuc

SEQ ID NO: 358920 - RNA, 27 nt, Human
caccaucuugcccaggcuggucucgaa

SEQ ID NO: 358921 - RNA, 19 nt, Human
cacccugugccuccucugc

SEQ ID NO: 358922 - RNA, 24 nt, Human
cacgucugcaaucccagcaccuug

SEQ ID NO: 358923 - RNA, 24 nt, Human
cacucuguugcccaggcuggagug

SEQ ID NO: 358924 - RNA, 21 nt, Human
cacugcaaccuccaccucccg

SEQ ID NO: 358925 - RNA, 23 nt, Human
cacugcaaccuccaccucccggg

SEQ ID NO: 358926 - RNA, 24 nt, Human
cagagucucacucuguugcccagg

SEQ ID NO: 358927 - RNA, 24 nt, Human
cagcaccuugggaggcagaggcgg

SEQ ID NO: 358928 - RNA, 22 nt, Human
cagccuuuuuuuuuuuuuuaaa

SEQ ID NO: 358929 - RNA, 19 nt, Human
caguagagaugggguuuca

SEQ ID NO: 358930 - RNA, 23 nt, Human
caguagagaugggguuucaccau

SEQ ID NO: 358931 - RNA, 26 nt, Human
caguagagaugggguuucaccaucuu

SEQ ID NO: 358932 - RNA, 24 nt, Human
caucuugcccaggcuggucucgaa

SEQ ID NO: 358933 - RNA, 22 nt, Human
ccaaagugcugagaccacaggc

SEQ ID NO: 358934 - RNA, 24 nt, Human
ccaaagugcugagaccacaggcgu

SEQ ID NO: 358935 - RNA, 19 nt, Human
ccaccaugcccggcuaacc

SEQ ID NO: 358936 - RNA, 24 nt, Human
ccaccucccggguucaaccaauuc

SEQ ID NO: 358937 - RNA, 20 nt, Human
ccaggaguccgagaccagcc

SEQ ID NO: 358938 - RNA, 24 nt, Human
ccaguagagaugggguuucaccau

SEQ ID NO: 358939 - RNA, 22 nt, Human
cccacacacuugcugguguccu

SEQ ID NO: 358940 - RNA, 18 nt, Human
cccgaguagcugggauuu

SEQ ID NO: 358941 - RNA, 20 nt, Human
cccggguucaaccaauucuc

SEQ ID NO: 358942 - RNA, 23 nt, Human
ccuagucucccgaguagcuggga

SEQ ID NO: 358943 - RNA, 23 nt, Human
ccucccggguucaaccaauucuc

SEQ ID NO: 358944 - RNA, 21 nt, Human
ccugacuugugauccacccac

SEQ ID NO: 358945 - RNA, 23 nt, Human
ccugugcuuuacacauccagaga

SEQ ID NO: 358946 - RNA, 20 nt, Human
ccuugggaggcagaggcggg

SEQ ID NO: 358947 - RNA, 22 nt, Human
cgaacuccugacuugugaucca

SEQ ID NO: 358948 - RNA, 23 nt, Human
cgucugcaaucccagcaccuugg

SEQ ID NO: 358949 - RNA, 24 nt, Human
cgucugcaaucccagcaccuuggg

SEQ ID NO: 358950 - RNA, 24 nt, Human
cucacgucugcaaucccagcaccu

SEQ ID NO: 358951 - RNA, 24 nt, Human
cucacucuguugcccaggcuggag

SEQ ID NO: 358952 - RNA, 24 nt, Human
cucacugcaaccuccaccucccgg

SEQ ID NO: 358953 - RNA, 21 nt, Human
cucccaaagugcugagaccac

SEQ ID NO: 358954 - RNA, 24 nt, Human
cucugccuagucucccgaguagcu

SEQ ID NO: 358955 - RNA, 18 nt, Human
cugcaaccuccaccuccc

SEQ ID NO: 358956 - RNA, 23 nt, Human
cugcaaccuccaccucccggguu

SEQ ID NO: 358957 - RNA, 24 nt, Human
cugcaaccuccaccucccggguuc

SEQ ID NO: 358958 - RNA, 21 nt, Human
cuggcuucugggccggccugg

SEQ ID NO: 358959 - RNA, 23 nt, Human
cuugguccucucacucucccucu

SEQ ID NO: 358960 - RNA, 21 nt, Human
cuugugauccacccacuucag

SEQ ID NO: 358961 - RNA, 23 nt, Human
gaaacuccuccagcaggaagccu

SEQ ID NO: 358962 - RNA, 21 nt, Human
gacagagucagacccugucuc

SEQ ID NO: 358963 - RNA, 20 nt, Human
gacccugucucaaaaaaagu

SEQ ID NO: 358964 - RNA, 21 nt, Human
gacuugugauccacccacuuc

SEQ ID NO: 358965 - RNA, 23 nt, Human
gacuugugauccacccacuucag

SEQ ID NO: 358966 - RNA, 18 nt, Human
gagaugggguuucaccau

SEQ ID NO: 358967 - RNA, 23 nt, Human
gagaugggguuucaccaucuugc

SEQ ID NO: 358968 - RNA, 21 nt, Human
gaggcuacagugagccgagau

SEQ ID NO: 358969 - RNA, 23 nt, Human
gaggcuacagugagccgagauug

SEQ ID NO: 358970 - RNA, 24 nt, Human
gauuuuaggcgcccgccaccaugc

SEQ ID NO: 358971 - RNA, 22 nt, Human
gcccaggaguccgagaccagcc

SEQ ID NO: 358972 - RNA, 19 nt, Human
gcccaggcuggagugcagu

SEQ ID NO: 358973 - RNA, 18 nt, Human
ggaaacauggcaaaaccc

SEQ ID NO: 358974 - RNA, 21 nt, Human
ggaggacagagucagacccug

SEQ ID NO: 358975 - RNA, 22 nt, Human
ggcaugguggcucacaauugua

SEQ ID NO: 358976 - RNA, 21 nt, Human
ggcucacgucugcaaucccag

SEQ ID NO: 358977 - RNA, 19 nt, Human
ggggcugggccugucccgg

SEQ ID NO: 358978 - RNA, 22 nt, Human
gggguuucaccaucuugcccag

SEQ ID NO: 358979 - RNA, 22 nt, Human
ggguuucaccaucuugcccagg

SEQ ID NO: 358980 - RNA, 24 nt, Human
gguggcucacaauuguagucccag

SEQ ID NO: 358981 - RNA, 21 nt, Human
guagagaugggguuucaccau

SEQ ID NO: 358982 - RNA, 24 nt, Human
gugagccaccaugcccagccuuuu

SEQ ID NO: 358983 - RNA, 24 nt, Human
gugauccacccacuucagccuccc

SEQ ID NO: 358984 - RNA, 24 nt, Human
guggaggggcagugaccauccaca

SEQ ID NO: 358985 - RNA, 23 nt, Human
guggcucacaauuguagucccag

SEQ ID NO: 358986 - RNA, 24 nt, Human
guggcucacaauuguagucccagc

SEQ ID NO: 358987 - RNA, 23 nt, Human
guggcucacgucugcaaucccag

SEQ ID NO: 358988 - RNA, 18 nt, Human
guguccuguugccaugga

SEQ ID NO: 358989 - RNA, 24 nt, Human
guuucaccaucuugcccaggcugg

SEQ ID NO: 358990 - RNA, 19 nt, Human
uagaaacagagucucacuc

SEQ ID NO: 358991 - RNA, 19 nt, Human
uaggcgcccgccaccaugc

SEQ ID NO: 358992 - RNA, 21 nt, Human
ucaccaucuugcccaggcugg

SEQ ID NO: 358993 - RNA, 24 nt, Human
ucacucuguugcccaggcuggagu

SEQ ID NO: 358994 - RNA, 23 nt, Human
ucacugcaaccuccaccucccgg

SEQ ID NO: 358995 - RNA, 24 nt, Human
ucacugcaaccuccaccucccggg

SEQ ID NO: 358996 - RNA, 25 nt, Human
ucacugcaaccuccaccucccgggu

SEQ ID NO: 358997 - RNA, 26 nt, Human
ucacugcaaccuccaccucccggguu

SEQ ID NO: 358998 - RNA, 23 nt, Human
ucagccagcugugguggcucacg

SEQ ID NO: 358999 - RNA, 25 nt, Human
ucagccagcugugguggcucacguc

SEQ ID NO: 359000 - RNA, 21 nt, Human
uccacccacuucagccuccca

SEQ ID NO: 359001 - RNA, 25 nt, Human
uccagagaagcuucuguaguaauga

SEQ ID NO: 359002 - RNA, 18 nt, Human
ucccaaagugcugagacc

SEQ ID NO: 359003 - RNA, 24 nt, Human
ucccaaagugcugagaccacaggc

SEQ ID NO: 359004 - RNA, 18 nt, Human
ucccagccacuugggagg

SEQ ID NO: 359005 - RNA, 24 nt, Human
ucccgaguagcugggauuuuaggc

SEQ ID NO: 359006 - RNA, 21 nt, Human
ucccggguucaaccaauucuc

SEQ ID NO: 359007 - RNA, 23 nt, Human
ucccggguucaaccaauucucug

SEQ ID NO: 359008 - RNA, 23 nt, Human
ucucacucuguugcccaggcugg

SEQ ID NO: 359009 - RNA, 24 nt, Human
ucucacucuguugcccaggcugga

SEQ ID NO: 359010 - RNA, 26 nt, Human
ucucacucuguugcccaggcuggagu

SEQ ID NO: 359011 - RNA, 27 nt, Human
ucucacucuguugcccaggcuggagug

SEQ ID NO: 359012 - RNA, 24 nt, Human
ucugccuagucucccgaguagcug

SEQ ID NO: 359013 - RNA, 22 nt, Human
ucuggcuucugggccggccugg

SEQ ID NO: 359014 - RNA, 18 nt, Human
ucuguugcccaggcugga

SEQ ID NO: 359015 - RNA, 24 nt, Human
ucuguugcccaggcuggagugcag

SEQ ID NO: 359016 - RNA, 22 nt, Human
ugaaaugggaggcucacuucaa

SEQ ID NO: 359017 - RNA, 21 nt, Human
ugaaccauagacacgaugccu

SEQ ID NO: 359018 - RNA, 19 nt, Human
ugaaggaagagcaugguca

SEQ ID NO: 359019 - RNA, 19 nt, Human
ugacuugugauccacccac

SEQ ID NO: 359020 - RNA, 24 nt, Human
ugagaccacaggcgugagccacca

SEQ ID NO: 359021 - RNA, 23 nt, Human
ugagcccaggaguccgagaccag

SEQ ID NO: 359022 - RNA, 24 nt, Human
ugagccgagauugcaccacuggac

SEQ ID NO: 359023 - RNA, 23 nt, Human
ugagccuggcaugguggcucaca

SEQ ID NO: 359024 - RNA, 22 nt, Human
ugcagugggacgaucucggcuc

SEQ ID NO: 359025 - RNA, 18 nt, Human
ugcccaggcuggagugca

SEQ ID NO: 359026 - RNA, 21 nt, Human
ugcccaggcuggagugcagug

SEQ ID NO: 359027 - RNA, 22 nt, Human
ugcccaggcuggagugcagugg

SEQ ID NO: 359028 - RNA, 25 nt, Human
ugcccaggcuggagugcagugggac

SEQ ID NO: 359029 - RNA, 24 nt, Human
ugcccaggcuggucucgaacuccu

SEQ ID NO: 359030 - RNA, 21 nt, Human
ugccucaaagugucaucuuca

SEQ ID NO: 359031 - RNA, 24 nt, Human
ugcugagaccacaggcgugagcca

SEQ ID NO: 359032 - RNA, 23 nt, Human
uggagugcagugggacgaucucg

SEQ ID NO: 359033 - RNA, 24 nt, Human
uggagugcagugggacgaucucgg

SEQ ID NO: 359034 - RNA, 24 nt, Human
uggcagguugaggcuacagugagc

SEQ ID NO: 359035 - RNA, 22 nt, Human
uggcaguugcagcaaacaacuc

SEQ ID NO: 359036 - RNA, 22 nt, Human
uggcucacgucugcaaucccag

SEQ ID NO: 359037 - RNA, 24 nt, Human
uggcucacgucugcaaucccagca

SEQ ID NO: 359038 - RNA, 22 nt, Human
uggcuucugggccggccuggcu

SEQ ID NO: 359039 - RNA, 19 nt, Human
uggcuucugggccggccuu

SEQ ID NO: 359040 - RNA, 19 nt, Human
ugggaaggaaacuccucca

SEQ ID NO: 359041 - RNA, 21 nt, Human
ugggaaggaaacuccuccagc

SEQ ID NO: 359042 - RNA, 18 nt, Human
ugggaggcagaggcgggc

SEQ ID NO: 359043 - RNA, 22 nt, Human
ugggaggcagaggcgggcagau

SEQ ID NO: 359044 - RNA, 24 nt, Human
ugggaggcagaggcgggcagauug

SEQ ID NO: 359045 - RNA, 18 nt, Human
ugggaggcugaaauggga

SEQ ID NO: 359046 - RNA, 19 nt, Human
ugggaggcugaaaugggag

SEQ ID NO: 359047 - RNA, 21 nt, Human
ugggauuuuaggcgcccgcca

SEQ ID NO: 359048 - RNA, 19 nt, Human
uggggauggggcugaaauc

SEQ ID NO: 359049 - RNA, 24 nt, Human
ugggguuucaccaucuugcccagg

SEQ ID NO: 359050 - RNA, 24 nt, Human
ugguggcucacaauuguaguccca

SEQ ID NO: 359051 - RNA, 24 nt, Human
ugguggcucacgucugcaauccca

SEQ ID NO: 359052 - RNA, 22 nt, Human
uguaguaaugaaccauagacac

SEQ ID NO: 359053 - RNA, 20 nt, Human
uguagucccagccacuuggg

SEQ ID NO: 359054 - RNA, 24 nt, Human
ugugauccacccacuucagccucc

SEQ ID NO: 359055 - RNA, 19 nt, Human
uucagccucccaaagugcu

SEQ ID NO: 359056 - RNA, 23 nt, Human
uugcaccacuggacuccggccug

SEQ ID NO: 359057 - RNA, 23 nt, Human
uugcccaggcuggagugcagugg

SEQ ID NO: 359058 - RNA, 21 nt, Human
uugcuugagcccaggaguccg

SEQ ID NO: 359059 - RNA, 21 nt, Human
uugggaggcagaggcgggcag

SEQ ID NO: 359060 - RNA, 24 nt, Human
uugggaggcagaggcgggcagauu

SEQ ID NO: 359061 - RNA, 24 nt, Human
uuuccaguagagaugggguuucac

SEQ ID NO: 359062 - RNA, 18 nt, Human
uuuuuuuuuuuuuuuucg

SEQ ID NO: 359063 - RNA, 22 nt, Human
uuuuuuuuuuuuuuuuucguuu

SEQ ID NO: 359064 - RNA, 24 nt, Human
aaagccccgacaggaagccggagg

SEQ ID NO: 359065 - RNA, 22 nt, Human
acagaaugggaaacugaggcac

SEQ ID NO: 359066 - RNA, 21 nt, Human
agaaagccccgacaggaagcc

SEQ ID NO: 359067 - RNA, 22 nt, Human
agacaggcuguggcuccuccag

SEQ ID NO: 359068 - RNA, 21 nt, Human
aggcacagagggaugcaguga

SEQ ID NO: 359069 - RNA, 23 nt, Human
ccagggccccagcccagucccag

SEQ ID NO: 359070 - RNA, 21 nt, Human
cccccagacaggcuguggcuc

SEQ ID NO: 359071 - RNA, 21 nt, Human
cccugacuuguccuuuccccc

SEQ ID NO: 359072 - RNA, 22 nt, Human
ccuagauuugagcccaccucuc

SEQ ID NO: 359073 - RNA, 27 nt, Human
ccuccagccaggacugaaccggggucc

SEQ ID NO: 359074 - RNA, 19 nt, Human
cgccagggccccagcccag

SEQ ID NO: 359075 - RNA, 22 nt, Human
cuuggagcacuuaaacaucagu

SEQ ID NO: 359076 - RNA, 19 nt, Human
cuuguccuuucccccagac

SEQ ID NO: 359077 - RNA, 19 nt, Human
gacugaacucugggcaaau

SEQ ID NO: 359078 - RNA, 23 nt, Human
gagcacuuaaacaucaguuaaug

SEQ ID NO: 359079 - RNA, 24 nt, Human
gauuucuuuaauguucacaacaac

SEQ ID NO: 359080 - RNA, 19 nt, Human
gccagggccuagauuugag

SEQ ID NO: 359081 - RNA, 21 nt, Human
gccccagcccagucccagguc

SEQ ID NO: 359082 - RNA, 19 nt, Human
ggagggugagugagagcug

SEQ ID NO: 359083 - RNA, 20 nt, Human
gggccccagcccagucccag

SEQ ID NO: 359084 - RNA, 22 nt, Human
ucagcaaguggucccugacuug

SEQ ID NO: 359085 - RNA, 20 nt, Human
uccgccagggccccagccca

SEQ ID NO: 359086 - RNA, 25 nt, Human
uccuccagccaggacugaacucugg

SEQ ID NO: 359087 - RNA, 19 nt, Human
ucuguuuucuuucugcucu

SEQ ID NO: 359088 - RNA, 20 nt, Human
ugcagugaauugcuugauga

SEQ ID NO: 359089 - RNA, 25 nt, Human
ugggaaacugaggcacagagggaug

SEQ ID NO: 359090 - RNA, 19 nt, Human
uguccaaacgugggguggg

SEQ ID NO: 359091 - RNA, 20 nt, Human
uguccaaacguggggugggg

SEQ ID NO: 359092 - RNA, 22 nt, Human
uucacaacaaccuuugagguag

SEQ ID NO: 359093 - RNA, 23 nt, Human
uucgugcuucagcaagugguccc

SEQ ID NO: 359094 - RNA, 22 nt, Human
uugaugacagugccagggccuu

SEQ ID NO: 359095 - RNA, 23 nt, Human
uuugauuuccauguguugauuuc

SEQ ID NO: 359096 - RNA, 24 nt, Human
aaagaagagcagaggagaagagac

SEQ ID NO: 359097 - RNA, 20 nt, Human
aacaacauuuauuucucuua

SEQ ID NO: 359098 - RNA, 23 nt, Human
aacaagagaggccuuagaaggga

SEQ ID NO: 359099 - RNA, 20 nt, Human
aagaagagcagaggagaaga

SEQ ID NO: 359100 - RNA, 23 nt, Human
aagaagagcagaggagaagagac

SEQ ID NO: 359101 - RNA, 23 nt, Human
acaaaccaucauuuuuacaacaa

SEQ ID NO: 359102 - RNA, 20 nt, Human
accaugugaagacacaagga

SEQ ID NO: 359103 - RNA, 25 nt, Human
acccagagaccugcccaaagaagag

SEQ ID NO: 359104 - RNA, 23 nt, Human
agaaaucuuuucuuuauuaacac

SEQ ID NO: 359105 - RNA, 19 nt, Human
agaaggggaagggagugga

SEQ ID NO: 359106 - RNA, 23 nt, Human
agacacaaggaggagacagccau

SEQ ID NO: 359107 - RNA, 18 nt, Human
agacccagagaccugccc

SEQ ID NO: 359108 - RNA, 23 nt, Human
agacccagagaccugcccaaaga

SEQ ID NO: 359109 - RNA, 20 nt, Human
agaggaacugcgaagccaca

SEQ ID NO: 359110 - RNA, 21 nt, Human
agcccucggagcuccacuccc

SEQ ID NO: 359111 - RNA, 24 nt, Human
caacaaaaacauuaauuuuaaaag

SEQ ID NO: 359112 - RNA, 20 nt, Human
caacaagagaggccuuagaa

SEQ ID NO: 359113 - RNA, 19 nt, Human
cagaaguccuguggucugc

SEQ ID NO: 359114 - RNA, 21 nt, Human
cagagcagacggaaacuuuga

SEQ ID NO: 359115 - RNA, 20 nt, Human
cagaggagaagagacugugu

SEQ ID NO: 359116 - RNA, 24 nt, Human
caucugaaacuauacgaaaauaaa

SEQ ID NO: 359117 - RNA, 22 nt, Human
ccaacccugauaacaccuuguu

SEQ ID NO: 359118 - RNA, 24 nt, Human
ccaucaaagacaucuuucuauugc

SEQ ID NO: 359119 - RNA, 21 nt, Human
ccaucuacaagccaacaagag

SEQ ID NO: 359120 - RNA, 22 nt, Human
ccaucuacaagccaacaagaga

SEQ ID NO: 359121 - RNA, 18 nt, Human
cccagagaccugcccaaa

SEQ ID NO: 359122 - RNA, 18 nt, Human
ccucggagcuccacuccc

SEQ ID NO: 359123 - RNA, 19 nt, Human
ccucggagcuccacucccu

SEQ ID NO: 359124 - RNA, 21 nt, Human
ccucugcacagagcagacgga

SEQ ID NO: 359125 - RNA, 20 nt, Human
gacacaguguuaugggcuaa

SEQ ID NO: 359126 - RNA, 18 nt, Human
gacugcggggaggaacgg

SEQ ID NO: 359127 - RNA, 21 nt, Human
gcccuaguaaccaauacacug

SEQ ID NO: 359128 - RNA, 21 nt, Human
gcccucggagcuccacucccu

SEQ ID NO: 359129 - RNA, 23 nt, Human
gcuaaauuguucccuucuaaaau

SEQ ID NO: 359130 - RNA, 26 nt, Human
gcucuguugcccaggcuggcauagau

SEQ ID NO: 359131 - RNA, 23 nt, Human
ggagucucgcucuguugcccagg

SEQ ID NO: 359132 - RNA, 18 nt, Human
gugguacauugcuguggc

SEQ ID NO: 359133 - RNA, 23 nt, Human
uaaaacaacauuuauuucucuua

SEQ ID NO: 359134 - RNA, 21 nt, Human
uacauugcuguggcagcccua

SEQ ID NO: 359135 - RNA, 20 nt, Human
uagaagggaccaacccugau

SEQ ID NO: 359136 - RNA, 22 nt, Human
uagaagggaccaacccugauaa

SEQ ID NO: 359137 - RNA, 22 nt, Human
ucuauugcauuuagccuuccaa

SEQ ID NO: 359138 - RNA, 18 nt, Human
ucucgcucuguugcccag

SEQ ID NO: 359139 - RNA, 19 nt, Human
ucucgcucuguugcccagg

SEQ ID NO: 359140 - RNA, 23 nt, Human
ucucgcucuguugcccaggcugg

SEQ ID NO: 359141 - RNA, 26 nt, Human
ucucgcucuguugcccaggcuggcau

SEQ ID NO: 359142 - RNA, 22 nt, Human
ucuguguuuaugucacucgguu

SEQ ID NO: 359143 - RNA, 23 nt, Human
ucuguugcccaggcuggcauaga

SEQ ID NO: 359144 - RNA, 21 nt, Human
ugaguaggcuuucuaaaacaa

SEQ ID NO: 359145 - RNA, 21 nt, Human
ugcuuguuuguuuguuuuguu

SEQ ID NO: 359146 - RNA, 24 nt, Human
uggagucucgcucuguugcccagg

SEQ ID NO: 359147 - RNA, 23 nt, Human
uggggaggagcgcgugaucucgg

SEQ ID NO: 359148 - RNA, 19 nt, Human
uguugcccaggcuggcaua

SEQ ID NO: 359149 - RNA, 20 nt, Human
uuacaauaauaaauuaucca

SEQ ID NO: 359150 - RNA, 25 nt, Human
uucacagaagaggaacugcgaagcc

SEQ ID NO: 359151 - RNA, 20 nt, Human
uugugguacauugcuguggc

SEQ ID NO: 359152 - RNA, 20 nt, Human
uuguuuguuuguuuuguuuu

SEQ ID NO: 359153 - RNA, 20 nt, Human
uuugcuacuuuccuagguuu

SEQ ID NO: 359154 - RNA, 18 nt, Human
uuuugcuuguuuguuugu

SEQ ID NO: 359155 - RNA, 20 nt, Human
agaggccagggcggggagug

SEQ ID NO: 359156 - RNA, 22 nt, Human
agaggccagggcggggagugug

SEQ ID NO: 359157 - RNA, 22 nt, Human
agaggccagggcggggagugug

SEQ ID NO: 359158 - RNA, 20 nt, Human
agggagaguuuggucaucag

SEQ ID NO: 359159 - RNA, 20 nt, Human
agggagaguuuggucaucag

SEQ ID NO: 359160 - RNA, 22 nt, Human
auacuggaucucucuuuccucc

SEQ ID NO: 359161 - RNA, 20 nt, Human
aucucucuuuccuccccuga

SEQ ID NO: 359162 - RNA, 18 nt, Human
cacagcauugagggcugc

SEQ ID NO: 359163 - RNA, 18 nt, Human
cacagcauugagggcugc

SEQ ID NO: 359164 - RNA, 21 nt, Human
cagaggccagggcggggagug

SEQ ID NO: 359165 - RNA, 22 nt, Human
cauuguugguggcuucuugucc

SEQ ID NO: 359166 - RNA, 22 nt, Human
ccccuuaugaaagcugaggggu

SEQ ID NO: 359167 - RNA, 24 nt, Human
cccucaaacaagcccgagccucug

SEQ ID NO: 359168 - RNA, 24 nt, Human
cccucaaacaagcccgagccucug

SEQ ID NO: 359169 - RNA, 19 nt, Human
cccuuaugaaagcugaggg

SEQ ID NO: 359170 - RNA, 21 nt, Human
ccucaaacaagcccgagccuc

SEQ ID NO: 359171 - RNA, 21 nt, Human
ccucaaacaagcccgagccuc

SEQ ID NO: 359172 - RNA, 18 nt, Human
ccugauagguccugaggc

SEQ ID NO: 359173 - RNA, 23 nt, Human
cgugaacccucaaacaagcccga

SEQ ID NO: 359174 - RNA, 24 nt, Human
cgugaacccucaaacaagcccuuc

SEQ ID NO: 359175 - RNA, 24 nt, Human
cgugaacccucaaacaagcccuuc

SEQ ID NO: 359176 - RNA, 19 nt, Human
cucauuguugguggcuucu

SEQ ID NO: 359177 - RNA, 26 nt, Human
gaaucagccucagacuccuuugcugg

SEQ ID NO: 359178 - RNA, 26 nt, Human
gaaucagccucagacuccuuugcugg

SEQ ID NO: 359179 - RNA, 18 nt, Human
gccagggccgcgagggaa

SEQ ID NO: 359180 - RNA, 18 nt, Human
gccagggccgcgagggaa

SEQ ID NO: 359181 - RNA, 19 nt, Human
ggaucuugaucucugagua

SEQ ID NO: 359182 - RNA, 22 nt, Human
gugaacccucaaacaagcccga

SEQ ID NO: 359183 - RNA, 18 nt, Human
uaccagaggccagggcgg

SEQ ID NO: 359184 - RNA, 18 nt, Human
uaccagaggccagggcgg

SEQ ID NO: 359185 - RNA, 20 nt, Human
uacucauuguugguggcuuc

SEQ ID NO: 359186 - RNA, 19 nt, Human
uacuggaucucucuuuccu

SEQ ID NO: 359187 - RNA, 20 nt, Human
uauauucggaaucuaaagua

SEQ ID NO: 359188 - RNA, 19 nt, Human
uaucaucugcccaggacuc

SEQ ID NO: 359189 - RNA, 19 nt, Human
ucaaacaagcccgagccuc

SEQ ID NO: 359190 - RNA, 19 nt, Human
ucaaacaagcccgagccuc

SEQ ID NO: 359191 - RNA, 23 nt, Human
ucaaacaagcccgagccucugca

SEQ ID NO: 359192 - RNA, 23 nt, Human
ucaaacaagcccgagccucugca

SEQ ID NO: 359193 - RNA, 24 nt, Human
ucaaacaagcccgagccucugcau

SEQ ID NO: 359194 - RNA, 24 nt, Human
ucaaacaagcccgagccucugcau

SEQ ID NO: 359195 - RNA, 21 nt, Human
ucagccucagacuccuuugcu

SEQ ID NO: 359196 - RNA, 21 nt, Human
ucagccucagacuccuuugcu

SEQ ID NO: 359197 - RNA, 21 nt, Human
ucugcauuuucuuacuugggg

SEQ ID NO: 359198 - RNA, 23 nt, Human
ucugggguuggaggugccagggc

SEQ ID NO: 359199 - RNA, 23 nt, Human
ucugggguuggaggugccagggc

SEQ ID NO: 359200 - RNA, 20 nt, Human
ugagggcugcuaauucuacu

SEQ ID NO: 359201 - RNA, 20 nt, Human
ugagggcugcuaauucuacu

SEQ ID NO: 359202 - RNA, 19 nt, Human
ugaguacucauuguuggug

SEQ ID NO: 359203 - RNA, 22 nt, Human
ugcauuuucaguuagacaagag

SEQ ID NO: 359204 - RNA, 22 nt, Human
ugcauuuucaguuagacaagag

SEQ ID NO: 359205 - RNA, 22 nt, Human
uggguaccagaggccagggcgg

SEQ ID NO: 359206 - RNA, 22 nt, Human
uggguaccagaggccagggcgg

SEQ ID NO: 359207 - RNA, 24 nt, Human
ugucuuguugcacagcauugaggg

SEQ ID NO: 359208 - RNA, 24 nt, Human
ugucuuguugcacagcauugaggg

SEQ ID NO: 359209 - RNA, 19 nt, Human
uguugcacagcauugaggg

SEQ ID NO: 359210 - RNA, 21 nt, Human
uucuacuggaaucagccucag

SEQ ID NO: 359211 - RNA, 21 nt, Human
uucuacuggaaucagccucag

SEQ ID NO: 359212 - RNA, 20 nt, Human
uuuuuuuuuuuuuuuucacg

SEQ ID NO: 359213 - RNA, 19 nt, Human
cgccagggccgccagggaa

SEQ ID NO: 359214 - RNA, 19 nt, Human
gcgccagggccgccaggga

SEQ ID NO: 359215 - RNA, 23 nt, Human
ucuggguuugaaggcgccagggc

SEQ ID NO: 359216 - RNA, 18 nt, Human
aaaaauaaaagggagggc

SEQ ID NO: 359217 - RNA, 18 nt, Human
aguguggauucagguuug

SEQ ID NO: 359218 - RNA, 20 nt, Human
aucauagcucaucacguuga

SEQ ID NO: 359219 - RNA, 18 nt, Human
cagccucugacuucuccc

SEQ ID NO: 359220 - RNA, 23 nt, Human
cccucaaucagggugagucucug

SEQ ID NO: 359221 - RNA, 23 nt, Human
cucaggguucuucucuccuaagg

SEQ ID NO: 359222 - RNA, 19 nt, Human
gcacaguguggauucaggu

SEQ ID NO: 359223 - RNA, 18 nt, Human
gccagggccgcgagggaa

SEQ ID NO: 359224 - RNA, 19 nt, Human
uaaagccugugugcuuuuc

SEQ ID NO: 359225 - RNA, 23 nt, Human
ucugggguuagaggugccagggc

SEQ ID NO: 359226 - RNA, 18 nt, Human
ucuguuccucaggguucu

SEQ ID NO: 359227 - RNA, 23 nt, Human
uuaguuaaaaaaauaaaagggag

SEQ ID NO: 359228 - RNA, 21 nt, Human
uugccuggaggggcugugauc

SEQ ID NO: 359229 - RNA, 18 nt, Human
agagaaguagagaagaga

SEQ ID NO: 359230 - RNA, 19 nt, Human
aggccgggggcggggagug

SEQ ID NO: 359231 - RNA, 20 nt, Human
agggagaguuuggucaucag

SEQ ID NO: 359232 - RNA, 24 nt, Human
cagaggccgggggcggggagugug

SEQ ID NO: 359233 - RNA, 18 nt, Human
cagcauggagggcuguua

SEQ ID NO: 359234 - RNA, 23 nt, Human
cgaccucagagaaguagagaaga

SEQ ID NO: 359235 - RNA, 20 nt, Human
cugcaggggucgugagcccu

SEQ ID NO: 359236 - RNA, 23 nt, Human
ucaaacaggccugagucucugca

SEQ ID NO: 359237 - RNA, 22 nt, Human
ucgugagcccucaaacaggccu

SEQ ID NO: 359238 - RNA, 25 nt, Human
ugagcccucaaacaggccugagucu

SEQ ID NO: 359239 - RNA, 18 nt, Human
uugcacagcauggagggc

SEQ ID NO: 359240 - RNA, 21 nt, Human
uuuuuuuuuuuuacgaucuca

SEQ ID NO: 359241 - RNA, 25 nt, Human
aaaaaaaaaaguacaguauaaaaga

SEQ ID NO: 359242 - RNA, 23 nt, Human
aaaaaaaaguacaguauaaaaga

SEQ ID NO: 359243 - RNA, 19 nt, Human
aaaacacacucauacucaa

SEQ ID NO: 359244 - RNA, 22 nt, Human
aaagagcaguugagacuuagag

SEQ ID NO: 359245 - RNA, 19 nt, Human
aacauggugaaaccccguc

SEQ ID NO: 359246 - RNA, 20 nt, Human
aacauggugaaaccccgucu

SEQ ID NO: 359247 - RNA, 21 nt, Human
aacauggugaaaccccgucuc

SEQ ID NO: 359248 - RNA, 24 nt, Human
aagcaggaaaaucgcuugaaccca

SEQ ID NO: 359249 - RNA, 24 nt, Human
aaucgcuugaacccaggaggcaga

SEQ ID NO: 359250 - RNA, 18 nt, Human
accaaaaccaacccacca

SEQ ID NO: 359251 - RNA, 24 nt, Human
accaacauggugaaaccccgucuc

SEQ ID NO: 359252 - RNA, 24 nt, Human
acccaggaggcagagguugcagug

SEQ ID NO: 359253 - RNA, 20 nt, Human
accccgucucgcaacuuccg

SEQ ID NO: 359254 - RNA, 18 nt, Human
agacuuauggaaaagucc

SEQ ID NO: 359255 - RNA, 24 nt, Human
agagaugcaacaugcuggaccuuc

SEQ ID NO: 359256 - RNA, 21 nt, Human
agcauuuugggaggccgaggc

SEQ ID NO: 359257 - RNA, 24 nt, Human
agcauuuugggaggccgaggcggg

SEQ ID NO: 359258 - RNA, 23 nt, Human
agccaggcguuguggcacaugcc

SEQ ID NO: 359259 - RNA, 24 nt, Human
agcccgaccaacauggugaaaccc

SEQ ID NO: 359260 - RNA, 18 nt, Human
aggcagagguugcaguga

SEQ ID NO: 359261 - RNA, 24 nt, Human
aggcagagguugcagugaucugag

SEQ ID NO: 359262 - RNA, 21 nt, Human
aggccgaggcgggcggaucac

SEQ ID NO: 359263 - RNA, 21 nt, Human
aggccgaggcggguggaucac

SEQ ID NO: 359264 - RNA, 22 nt, Human
aggcgggcggaucaccugaggg

SEQ ID NO: 359265 - RNA, 22 nt, Human
aggcgggcggaucaccugaggu

SEQ ID NO: 359266 - RNA, 26 nt, Human
aggcggguggaucaccugaagucagg

SEQ ID NO: 359267 - RNA, 24 nt, Human
aggcguuguggcacaugccuguaa

SEQ ID NO: 359268 - RNA, 20 nt, Human
aggcuccuguuuucccuaag

SEQ ID NO: 359269 - RNA, 24 nt, Human
aggggcgguggcucacgcuuguaa

SEQ ID NO: 359270 - RNA, 24 nt, Human
aguggcucacgccuguaaucccag

SEQ ID NO: 359271 - RNA, 24 nt, Human
auaaaacacacucauacucaauaa

SEQ ID NO: 359272 - RNA, 20 nt, Human
aucaccugaggucgggaguu

SEQ ID NO: 359273 - RNA, 24 nt, Human
auccugccauugcacuccagccug

SEQ ID NO: 359274 - RNA, 18 nt, Human
auugcacuccagccuggg

SEQ ID NO: 359275 - RNA, 25 nt, Human
auugcacuccagccugggcuacaag

SEQ ID NO: 359276 - RNA, 22 nt, Human
caaaaccaacccaccauacugc

SEQ ID NO: 359277 - RNA, 22 nt, Human
caacauggugaaaccccgucuc

SEQ ID NO: 359278 - RNA, 20 nt, Human
cacagaagucacucuuccca

SEQ ID NO: 359279 - RNA, 22 nt, Human
caccauacugcaaaaagcugua

SEQ ID NO: 359280 - RNA, 23 nt, Human
caccgccgacuccggccccgccu

SEQ ID NO: 359281 - RNA, 23 nt, Human
cacgccuguaaucccagcacuuu

SEQ ID NO: 359282 - RNA, 24 nt, Human
cacgcuuguaaucccagcauuuug

SEQ ID NO: 359283 - RNA, 24 nt, Human
cacuccagccugggcuacaagagc

SEQ ID NO: 359284 - RNA, 22 nt, Human
cagcacuuuaggaggccgaggc

SEQ ID NO: 359285 - RNA, 24 nt, Human
cagcacuuuaggaggccgaggcgg

SEQ ID NO: 359286 - RNA, 24 nt, Human
cagcauuuugggaggccgaggcgg

SEQ ID NO: 359287 - RNA, 24 nt, Human
cagccugaccaacauggagaaacc

SEQ ID NO: 359288 - RNA, 19 nt, Human
caggagccuugugguaggc

SEQ ID NO: 359289 - RNA, 20 nt, Human
cagugaucugagauccugcc

SEQ ID NO: 359290 - RNA, 19 nt, Human
caucugaaaaacucagaaa

SEQ ID NO: 359291 - RNA, 24 nt, Human
caugccuguaaucccagcuaccug

SEQ ID NO: 359292 - RNA, 18 nt, Human
cauugcacuccagccugg

SEQ ID NO: 359293 - RNA, 19 nt, Human
cauugcacuccagccuggg

SEQ ID NO: 359294 - RNA, 20 nt, Human
cauugcacuccagccugggc

SEQ ID NO: 359295 - RNA, 22 nt, Human
cauugcacuccagccugggcua

SEQ ID NO: 359296 - RNA, 24 nt, Human
cauugcacuccagccugggcuaca

SEQ ID NO: 359297 - RNA, 24 nt, Human
ccaccauacugcaaaaagcuguau

SEQ ID NO: 359298 - RNA, 22 nt, Human
ccagccugggcuacaagagcaa

SEQ ID NO: 359299 - RNA, 20 nt, Human
ccauugcacuccagccuggg

SEQ ID NO: 359300 - RNA, 21 nt, Human
ccauugcacuccagccugggc

SEQ ID NO: 359301 - RNA, 24 nt, Human
ccauugcacuccagccugggcuac

SEQ ID NO: 359302 - RNA, 19 nt, Human
cccaccauacugcaaaaag

SEQ ID NO: 359303 - RNA, 23 nt, Human
cccgaccaacauggugaaacccc

SEQ ID NO: 359304 - RNA, 22 nt, Human
ccugaggucgggaguuugagac

SEQ ID NO: 359305 - RNA, 21 nt, Human
ccuguaaucccagcuaccugg

SEQ ID NO: 359306 - RNA, 22 nt, Human
ccuguaaucccagcuaccuggg

SEQ ID NO: 359307 - RNA, 20 nt, Human
cgaggcgggcggaucaccug

SEQ ID NO: 359308 - RNA, 21 nt, Human
cgaggcgggcggaucaccuga

SEQ ID NO: 359309 - RNA, 24 nt, Human
cgaggcgggcggaucaccugaggu

SEQ ID NO: 359310 - RNA, 19 nt, Human
cgaggcggguggaucaccu

SEQ ID NO: 359311 - RNA, 20 nt, Human
cgaggcggguggaucaccug

SEQ ID NO: 359312 - RNA, 18 nt, Human
cgccuguaaucccagcac

SEQ ID NO: 359313 - RNA, 24 nt, Human
cgcuuguaaucccagcauuuuggg

SEQ ID NO: 359314 - RNA, 24 nt, Human
cggaucaccugaggucgggaguuu

SEQ ID NO: 359315 - RNA, 24 nt, Human
cgggcggaucaccugaggucggga

SEQ ID NO: 359316 - RNA, 24 nt, Human
cggguggaucaccugaagucagga

SEQ ID NO: 359317 - RNA, 22 nt, Human
cucacgccuguaaucccagcac

SEQ ID NO: 359318 - RNA, 24 nt, Human
cucacgccuguaaucccagcacuu

SEQ ID NO: 359319 - RNA, 21 nt, Human
cucacgcuuguaaucccagca

SEQ ID NO: 359320 - RNA, 21 nt, Human
cucacgcuuguaaucccagca

SEQ ID NO: 359321 - RNA, 22 nt, Human
cucaugucaggggcgguggcuc

SEQ ID NO: 359322 - RNA, 26 nt, Human
cuccaaggagcgccaccgccgacucc

SEQ ID NO: 359323 - RNA, 23 nt, Human
cuccgucucaaaaaaaaaaguac

SEQ ID NO: 359324 - RNA, 19 nt, Human
cucgcaacuuccgcggagc

SEQ ID NO: 359325 - RNA, 19 nt, Human
cucgcaacuuccgcggagc

SEQ ID NO: 359326 - RNA, 21 nt, Human
cugcuuuaaaagucaauggcu

SEQ ID NO: 359327 - RNA, 22 nt, Human
cuucaggagacacccugucccu

SEQ ID NO: 359328 - RNA, 21 nt, Human
gagaacuuaguccuaucacca

SEQ ID NO: 359329 - RNA, 23 nt, Human
gagcaguugagacuuagagcugg

SEQ ID NO: 359330 - RNA, 22 nt, Human
gagcgggagccggcuccaagga

SEQ ID NO: 359331 - RNA, 25 nt, Human
gaggcggguggaucaccugaaguca

SEQ ID NO: 359332 - RNA, 18 nt, Human
gaucaccugaagucagga

SEQ ID NO: 359333 - RNA, 24 nt, Human
gaucaccugaagucaggauuucca

SEQ ID NO: 359334 - RNA, 24 nt, Human
gaucaccugaggucgggaguuuga

SEQ ID NO: 359335 - RNA, 22 nt, Human
gccauugcacuccagccugggc

SEQ ID NO: 359336 - RNA, 18 nt, Human
gccggcuccaaggagcgc

SEQ ID NO: 359337 - RNA, 23 nt, Human
gcucaugucaggggcgguggcuc

SEQ ID NO: 359338 - RNA, 22 nt, Human
ggagaaaccagucucuacuaaa

SEQ ID NO: 359339 - RNA, 19 nt, Human
ggaguuugagaccagccug

SEQ ID NO: 359340 - RNA, 22 nt, Human
ggaucaccugaggucgggaguu

SEQ ID NO: 359341 - RNA, 21 nt, Human
ggcacaugccuguaaucccag

SEQ ID NO: 359342 - RNA, 22 nt, Human
gggcaguggcucacgccuguaa

SEQ ID NO: 359343 - RNA, 19 nt, Human
ggucgggaguuugagacca

SEQ ID NO: 359344 - RNA, 23 nt, Human
gguggcucacgcuuguaauccca

SEQ ID NO: 359345 - RNA, 24 nt, Human
gguggcucacgcuuguaaucccag

SEQ ID NO: 359346 - RNA, 27 nt, Human
gguugauuucgcuaauuuacccaacac

SEQ ID NO: 359347 - RNA, 22 nt, Human
guggcacaugccuguaauccca

SEQ ID NO: 359348 - RNA, 23 nt, Human
guggcucacgcuuguaaucccag

SEQ ID NO: 359349 - RNA, 20 nt, Human
uaaaaauacaaaauuagcca

SEQ ID NO: 359350 - RNA, 22 nt, Human
uaaaaauacaaaauuagccagg

SEQ ID NO: 359351 - RNA, 23 nt, Human
uaaaaauacaaaauuagccaggc

SEQ ID NO: 359352 - RNA, 21 nt, Human
uaaaagagcaguugagacuua

SEQ ID NO: 359353 - RNA, 24 nt, Human
uaggaggccgaggcgggcggauca

SEQ ID NO: 359354 - RNA, 22 nt, Human
ucaccugaagucaggauuucca

SEQ ID NO: 359355 - RNA, 20 nt, Human
ucacgcuuguaaucccagca

SEQ ID NO: 359356 - RNA, 18 nt, Human
ucaguauccagacuuaug

SEQ ID NO: 359357 - RNA, 18 nt, Human
uccagaaugaucaggagc

SEQ ID NO: 359358 - RNA, 22 nt, Human
ucccaauuggcugcuaccaaga

SEQ ID NO: 359359 - RNA, 23 nt, Human
ucccaauuggcugcuaccaagaa

SEQ ID NO: 359360 - RNA, 23 nt, Human
uccgucucaaaaaaaaaaguaca

SEQ ID NO: 359361 - RNA, 24 nt, Human
ucucgaguuuaaucaacaugcauc

SEQ ID NO: 359362 - RNA, 22 nt, Human
ucucuacuaaaaauacaaaauu

SEQ ID NO: 359363 - RNA, 21 nt, Human
ucuuaaagguuucagugaugu

SEQ ID NO: 359364 - RNA, 20 nt, Human
ugaagcaggaaaaucgcuug

SEQ ID NO: 359365 - RNA, 24 nt, Human
ugaagcaggaaaaucgcuugaacc

SEQ ID NO: 359366 - RNA, 24 nt, Human
ugagaccagccugaccaacaugga

SEQ ID NO: 359367 - RNA, 24 nt, Human
ugagauccugccauugcacuccag

SEQ ID NO: 359368 - RNA, 18 nt, Human
ugaggucgggaguuugag

SEQ ID NO: 359369 - RNA, 23 nt, Human
ugccuguaaucccagcuaccugg

SEQ ID NO: 359370 - RNA, 24 nt, Human
ugccuguaaucccagcuaccuggg

SEQ ID NO: 359371 - RNA, 27 nt, Human
ugcuaccaagaaacagugacuccagaa

SEQ ID NO: 359372 - RNA, 21 nt, Human
uggaaaaguccccauaaugcu

SEQ ID NO: 359373 - RNA, 24 nt, Human
uggauaguaucugucuacuacuua

SEQ ID NO: 359374 - RNA, 20 nt, Human
uggaucaccugaagucagga

SEQ ID NO: 359375 - RNA, 23 nt, Human
uggaucaccugaagucaggauuu

SEQ ID NO: 359376 - RNA, 21 nt, Human
uggcacaugccuguaauccca

SEQ ID NO: 359377 - RNA, 22 nt, Human
uggcacaugccuguaaucccag

SEQ ID NO: 359378 - RNA, 24 nt, Human
uggcucacgccuguaaucccagca

SEQ ID NO: 359379 - RNA, 22 nt, Human
uggcucacgcuuguaaucccag

SEQ ID NO: 359380 - RNA, 24 nt, Human
uggcucacgcuuguaaucccagca

SEQ ID NO: 359381 - RNA, 23 nt, Human
ugggaggccgaggcggguggauc

SEQ ID NO: 359382 - RNA, 24 nt, Human
ugggaggccgaggcggguggauca

SEQ ID NO: 359383 - RNA, 25 nt, Human
uguaaucccagcuaccugggaagau

SEQ ID NO: 359384 - RNA, 24 nt, Human
uguggcacaugccuguaaucccag

SEQ ID NO: 359385 - RNA, 19 nt, Human
uugcagugaucugagaucc

SEQ ID NO: 359386 - RNA, 22 nt, Human
uugcagugaucugagauccugc

SEQ ID NO: 359387 - RNA, 23 nt, Human
uuggcugcuaccaagaaacagug

SEQ ID NO: 359388 - RNA, 25 nt, Human
uugggaggccgaggcggguggauca

SEQ ID NO: 359389 - RNA, 20 nt, Human
uuuccauauaaaucugaucc

SEQ ID NO: 359390 - RNA, 23 nt, Human
uuugauagccagugugacauguu

SEQ ID NO: 359391 - RNA, 23 nt, Human
aaacacuuaacacugcugucaug

SEQ ID NO: 359392 - RNA, 19 nt, Human
aacauuuugccuauuccuu

SEQ ID NO: 359393 - RNA, 24 nt, Human
aagcuccgcagauucauccaaaac

SEQ ID NO: 359394 - RNA, 19 nt, Human
aaggagcccacacaccugc

SEQ ID NO: 359395 - RNA, 23 nt, Human
agaaaaacccucagcgccauguc

SEQ ID NO: 359396 - RNA, 18 nt, Human
agaaaauuacccauuuuu

SEQ ID NO: 359397 - RNA, 18 nt, Human
agcuggcugauuugaaac

SEQ ID NO: 359398 - RNA, 23 nt, Human
aguguucuuacuuagaaaaaccc

SEQ ID NO: 359399 - RNA, 21 nt, Human
aucuaaacuucuguguacaga

SEQ ID NO: 359400 - RNA, 23 nt, Human
caaggugaaaaauuaccucuucc

SEQ ID NO: 359401 - RNA, 22 nt, Human
caauaaggaaaauaaacauuuu

SEQ ID NO: 359402 - RNA, 26 nt, Human
cacuuaacacugcugucauguggcac

SEQ ID NO: 359403 - RNA, 25 nt, Human
ccaaaaauaaacuuucaauuagaga

SEQ ID NO: 359404 - RNA, 21 nt, Human
ccaauugagcacuccagguuu

SEQ ID NO: 359405 - RNA, 18 nt, Human
ccagagaucuagucagcu

SEQ ID NO: 359406 - RNA, 18 nt, Human
cccccuuucuucucacaa

SEQ ID NO: 359407 - RNA, 18 nt, Human
ccugaaccaaaugagcug

SEQ ID NO: 359408 - RNA, 23 nt, Human
ccuugucuaacugaaaagcaagg

SEQ ID NO: 359409 - RNA, 23 nt, Human
cgcagauucauccaaaaccaaaa

SEQ ID NO: 359410 - RNA, 24 nt, Human
cuauaaauauguuucagagauccu

SEQ ID NO: 359411 - RNA, 21 nt, Human
cuuagaaaaacccucagcgcc

SEQ ID NO: 359412 - RNA, 20 nt, Human
cuuagcucuuaacuacuugu

SEQ ID NO: 359413 - RNA, 24 nt, Human
cuucagaguacugcucuuagcucu

SEQ ID NO: 359414 - RNA, 19 nt, Human
gaaaaaacagaaugaucag

SEQ ID NO: 359415 - RNA, 24 nt, Human
gaacacguaucaaauacccaguaa

SEQ ID NO: 359416 - RNA, 23 nt, Human
gaaccauuucucuaauuuaugcc

SEQ ID NO: 359417 - RNA, 23 nt, Human
gaaugguacaacuguggucacaa

SEQ ID NO: 359418 - RNA, 19 nt, Human
guacaacuguggucacaaa

SEQ ID NO: 359419 - RNA, 24 nt, Human
guguacagaaaaaacagaaugauc

SEQ ID NO: 359420 - RNA, 21 nt, Human
uaaaauguauaccgcaguuug

SEQ ID NO: 359421 - RNA, 24 nt, Human
uaaauuguguuaaacuuugagaua

SEQ ID NO: 359422 - RNA, 19 nt, Human
uaagucacaaagcaucuaa

SEQ ID NO: 359423 - RNA, 20 nt, Human
uaaguucaguucugcucuau

SEQ ID NO: 359424 - RNA, 21 nt, Human
uacaagcaaaccccaaauaug

SEQ ID NO: 359425 - RNA, 26 nt, Human
uaccacacagauguaagaccaaguuu

SEQ ID NO: 359426 - RNA, 23 nt, Human
uauaacccugaaugcuagugcua

SEQ ID NO: 359427 - RNA, 23 nt, Human
uauaugcacacuugaucuacaug

SEQ ID NO: 359428 - RNA, 21 nt, Human
uaugcacacuugaucuacaug

SEQ ID NO: 359429 - RNA, 23 nt, Human
uaugcugagcccuuaaauugugu

SEQ ID NO: 359430 - RNA, 19 nt, Human
ucagcgccaugucagugca

SEQ ID NO: 359431 - RNA, 20 nt, Human
ugaaaagcaaggugaaaaaa

SEQ ID NO: 359432 - RNA, 24 nt, Human
ugaaaagcaaggugaaaaauuacc

SEQ ID NO: 359433 - RNA, 21 nt, Human
ugaaguauuugcaccaagaac

SEQ ID NO: 359434 - RNA, 20 nt, Human
ugaauaaagaggcugaaguc

SEQ ID NO: 359435 - RNA, 23 nt, Human
ugagcacuccagguuuuugaugu

SEQ ID NO: 359436 - RNA, 18 nt, Human
ugccuaaaggagcccaca

SEQ ID NO: 359437 - RNA, 19 nt, Human
ugccuauuccuucagagua

SEQ ID NO: 359438 - RNA, 18 nt, Human
ugccugaaccaaaugagc

SEQ ID NO: 359439 - RNA, 20 nt, Human
uggauagucacaaugcaaug

SEQ ID NO: 359440 - RNA, 19 nt, Human
uggcaaaaacauaaaacau

SEQ ID NO: 359441 - RNA, 24 nt, Human
uggcaaaaacauaaaacauacuuu

SEQ ID NO: 359442 - RNA, 20 nt, Human
uggcaguaaaagaccagcgg

SEQ ID NO: 359443 - RNA, 21 nt, Human
ugguacaacuguggucacaaa

SEQ ID NO: 359444 - RNA, 23 nt, Human
ugguacaacuguggucacaaaau

SEQ ID NO: 359445 - RNA, 19 nt, Human
ugguuuuacaagcaaaccc

SEQ ID NO: 359446 - RNA, 25 nt, Human
uguacagaaaaaacagaaugaucag

SEQ ID NO: 359447 - RNA, 23 nt, Human
uguauaacccugaaugcuagugc

SEQ ID NO: 359448 - RNA, 21 nt, Human
ugucacauuggcacauaugug

SEQ ID NO: 359449 - RNA, 24 nt, Human
ugucuuguucccccuuucuucuca

SEQ ID NO: 359450 - RNA, 21 nt, Human
uguguacagaaaaaacagaau

SEQ ID NO: 359451 - RNA, 23 nt, Human
uguguacagaaaaaacagaauga

SEQ ID NO: 359452 - RNA, 21 nt, Human
uguuuucuuugauuuuauagg

SEQ ID NO: 359453 - RNA, 19 nt, Human
uuacauagccuauauuucc

SEQ ID NO: 359454 - RNA, 23 nt, Human
uucucacaacuuaagcuccgcag

SEQ ID NO: 359455 - RNA, 19 nt, Human
uugaaaccacaaagaaguc

SEQ ID NO: 359456 - RNA, 21 nt, Human
uugauggcaguaaaagaccag

SEQ ID NO: 359457 - RNA, 22 nt, Human
aaaacaaaaauaaugagacucu

SEQ ID NO: 359458 - RNA, 26 nt, Human
aaaaccucuuuccauucagggcacuc

SEQ ID NO: 359459 - RNA, 21 nt, Human
aaaggaaucuugcaaaagaaa

SEQ ID NO: 359460 - RNA, 24 nt, Human
aaagugcugggauuacagguguga

SEQ ID NO: 359461 - RNA, 19 nt, Human
aaaguuaauaacaagguag

SEQ ID NO: 359462 - RNA, 26 nt, Human
aaaugcagcugggguguucucagcac

SEQ ID NO: 359463 - RNA, 19 nt, Human
aacugggucgcaccggccc

SEQ ID NO: 359464 - RNA, 18 nt, Human
aagaaacugaggccugga

SEQ ID NO: 359465 - RNA, 22 nt, Human
aagaaacugaggccuggagggu

SEQ ID NO: 359466 - RNA, 19 nt, Human
aaguaagagcuuguuaaug

SEQ ID NO: 359467 - RNA, 18 nt, Human
aagugcugggauuacagg

SEQ ID NO: 359468 - RNA, 19 nt, Human
aagugcugggauuacaggu

SEQ ID NO: 359469 - RNA, 26 nt, Human
aagugcugggauuacaggugugagcc

SEQ ID NO: 359470 - RNA, 22 nt, Human
aauuacagaucugugugggcca

SEQ ID NO: 359471 - RNA, 24 nt, Human
acaaaaauaaugagacucuugaau

SEQ ID NO: 359472 - RNA, 19 nt, Human
acguaauaaugaagcuuga

SEQ ID NO: 359473 - RNA, 18 nt, Human
acucuguuacccaggcug

SEQ ID NO: 359474 - RNA, 25 nt, Human
acucuguuacccaggcuggagugca

SEQ ID NO: 359475 - RNA, 18 nt, Human
agccuccagaguagcugg

SEQ ID NO: 359476 - RNA, 21 nt, Human
aggcaagacgcgugaagcccg

SEQ ID NO: 359477 - RNA, 21 nt, Human
aggcaucugcaccaucucggu

SEQ ID NO: 359478 - RNA, 22 nt, Human
aggccggguccaggcuccuggc

SEQ ID NO: 359479 - RNA, 25 nt, Human
aggcuggagugcagugaugugaucu

SEQ ID NO: 359480 - RNA, 19 nt, Human
agggcaggucccuacugug

SEQ ID NO: 359481 - RNA, 24 nt, Human
aggugauccgcccaccuuggccuc

SEQ ID NO: 359482 - RNA, 18 nt, Human
aggugugagccacugagc

SEQ ID NO: 359483 - RNA, 18 nt, Human
aguagcugggauuacagg

SEQ ID NO: 359484 - RNA, 19 nt, Human
agucuugguuuguuggcuu

SEQ ID NO: 359485 - RNA, 19 nt, Human
agugcagugaugugaucuu

SEQ ID NO: 359486 - RNA, 21 nt, Human
agugcagugaugugaucuuag

SEQ ID NO: 359487 - RNA, 22 nt, Human
agugugaagaaaauugaaggac

SEQ ID NO: 359488 - RNA, 22 nt, Human
auaaagcagcaaaaugcugcag

SEQ ID NO: 359489 - RNA, 21 nt, Human
auggaauugcauggucacccc

SEQ ID NO: 359490 - RNA, 20 nt, Human
augggguuucagcuuguugg

SEQ ID NO: 359491 - RNA, 18 nt, Human
augucaccuucacccaca

SEQ ID NO: 359492 - RNA, 24 nt, Human
auuuuuguauuuuuaguggagaug

SEQ ID NO: 359493 - RNA, 21 nt, Human
caaaaugcugcaguguugaua

SEQ ID NO: 359494 - RNA, 24 nt, Human
caaagugcugggauuacaggugug

SEQ ID NO: 359495 - RNA, 25 nt, Human
caaauuuccaccauaguuuucccca

SEQ ID NO: 359496 - RNA, 23 nt, Human
caaccuccaccucccggguucaa

SEQ ID NO: 359497 - RNA, 21 nt, Human
caagguagacacaaaagcauu

SEQ ID NO: 359498 - RNA, 21 nt, Human
caaggugaggaaaccaagccc

SEQ ID NO: 359499 - RNA, 21 nt, Human
cacccccuuagucuugguuug

SEQ ID NO: 359500 - RNA, 23 nt, Human
cacccuguagggauugugucagg

SEQ ID NO: 359501 - RNA, 24 nt, Human
caccucccggguucaagugauccu

SEQ ID NO: 359502 - RNA, 24 nt, Human
cacuauuuguagcaaacacgagcc

SEQ ID NO: 359503 - RNA, 23 nt, Human
cacucuguuacccaggcuggagu

SEQ ID NO: 359504 - RNA, 24 nt, Human
cacucuguuacccaggcuggagug

SEQ ID NO: 359505 - RNA, 21 nt, Human
cacugcaaccuccaccucccg

SEQ ID NO: 359506 - RNA, 23 nt, Human
cacugcaaccuccaccucccggg

SEQ ID NO: 359507 - RNA, 18 nt, Human
cagcaaaaugcugcagug

SEQ ID NO: 359508 - RNA, 21 nt, Human
cagcuucaccccauuuuacag

SEQ ID NO: 359509 - RNA, 19 nt, Human
caggagaaggugaaaggcc

SEQ ID NO: 359510 - RNA, 19 nt, Human
caggagucagucugcgucc

SEQ ID NO: 359511 - RNA, 19 nt, Human
caggugcucaccaccaugc

SEQ ID NO: 359512 - RNA, 18 nt, Human
cauuacacccccuuaagc

SEQ ID NO: 359513 - RNA, 21 nt, Human
ccaaagugcugggauuacagg

SEQ ID NO: 359514 - RNA, 21 nt, Human
ccaaagugcugggauuacagg

SEQ ID NO: 359515 - RNA, 24 nt, Human
ccaaagugcugggauuacaggugu

SEQ ID NO: 359516 - RNA, 24 nt, Human
ccaccucccggguucaagugaucc

SEQ ID NO: 359517 - RNA, 24 nt, Human
ccacugacagacacccuguaggga

SEQ ID NO: 359518 - RNA, 19 nt, Human
ccagaguagcugggauuac

SEQ ID NO: 359519 - RNA, 22 nt, Human
ccagaguagcugggauuacagg

SEQ ID NO: 359520 - RNA, 23 nt, Human
ccagaguagcugggauuacaggu

SEQ ID NO: 359521 - RNA, 24 nt, Human
ccagaguagcugggauuacaggug

SEQ ID NO: 359522 - RNA, 24 nt, Human
ccauaguuuuccccacuuccaaaa

SEQ ID NO: 359523 - RNA, 25 nt, Human
cccacugacagacacccuguaggga

SEQ ID NO: 359524 - RNA, 23 nt, Human
ccccaagcccacaaauuuccacc

SEQ ID NO: 359525 - RNA, 21 nt, Human
ccccagcaacugggucgcacc

SEQ ID NO: 359526 - RNA, 22 nt, Human
cccggguucaagugauccuccu

SEQ ID NO: 359527 - RNA, 21 nt, Human
ccuaagcaucuaaaagggcuc

SEQ ID NO: 359528 - RNA, 24 nt, Human
ccucccggguucaagugauccucc

SEQ ID NO: 359529 - RNA, 24 nt, Human
ccuccuaucucagccuccagagua

SEQ ID NO: 359530 - RNA, 24 nt, Human
ccugaccucaggugauccgcccac

SEQ ID NO: 359531 - RNA, 21 nt, Human
cggucaccugcccggacccgg

SEQ ID NO: 359532 - RNA, 19 nt, Human
cguuggggacaaggcaaga

SEQ ID NO: 359533 - RNA, 24 nt, Human
cucacucuguuacccaggcuggag

SEQ ID NO: 359534 - RNA, 24 nt, Human
cucacugcaaccuccaccucccgg

SEQ ID NO: 359535 - RNA, 23 nt, Human
cucagccuccagaguagcuggga

SEQ ID NO: 359536 - RNA, 24 nt, Human
cucaggugauccgcccaccuuggc

SEQ ID NO: 359537 - RNA, 18 nt, Human
cugcaaccuccaccuccc

SEQ ID NO: 359538 - RNA, 23 nt, Human
cugcaaccuccaccucccggguu

SEQ ID NO: 359539 - RNA, 19 nt, Human
cuggcaugggaaaauagcc

SEQ ID NO: 359540 - RNA, 21 nt, Human
cuggcaugggaaaauagccaa

SEQ ID NO: 359541 - RNA, 24 nt, Human
cuggguuggugaguggcauuucug

SEQ ID NO: 359542 - RNA, 19 nt, Human
cuuccaaaacuggcauggg

SEQ ID NO: 359543 - RNA, 24 nt, Human
cuugcaaaagaaaugcagcugggg

SEQ ID NO: 359544 - RNA, 20 nt, Human
gaagaaaauugaaggacggc

SEQ ID NO: 359545 - RNA, 24 nt, Human
gaaggugaaaggccauuccuuucu

SEQ ID NO: 359546 - RNA, 24 nt, Human
gaccucaggugauccgcccaccuu

SEQ ID NO: 359547 - RNA, 22 nt, Human
gagacagucucacucuguuacc

SEQ ID NO: 359548 - RNA, 18 nt, Human
gagcccggccuggggcac

SEQ ID NO: 359549 - RNA, 20 nt, Human
gaguucauagggguuagggg

SEQ ID NO: 359550 - RNA, 21 nt, Human
gauuacaggugcucaccacca

SEQ ID NO: 359551 - RNA, 18 nt, Human
gauuacaggugugagcca

SEQ ID NO: 359552 - RNA, 19 nt, Human
gauuacaggugugagccac

SEQ ID NO: 359553 - RNA, 21 nt, Human
gauuacaggugugagccacug

SEQ ID NO: 359554 - RNA, 18 nt, Human
gcaaaacccauaaaaagu

SEQ ID NO: 359555 - RNA, 21 nt, Human
gcaaaacccauaaaaaguaaa

SEQ ID NO: 359556 - RNA, 22 nt, Human
gcaaccuccaccucccggguuc

SEQ ID NO: 359557 - RNA, 19 nt, Human
gcagaggacaucugcuugc

SEQ ID NO: 359558 - RNA, 25 nt, Human
gcuccucggcccucggcaccggcgc

SEQ ID NO: 359559 - RNA, 18 nt, Human
ggaaaggaaucuugcaaa

SEQ ID NO: 359560 - RNA, 19 nt, Human
ggagaggcgggcacauccc

SEQ ID NO: 359561 - RNA, 21 nt, Human
ggaggguuuguguucuuugcc

SEQ ID NO: 359562 - RNA, 18 nt, Human
ggcaaaaaaaaaaaaaaa

SEQ ID NO: 359563 - RNA, 18 nt, Human
ggcaaaaaaaaaaaaaaa

SEQ ID NO: 359564 - RNA, 20 nt, Human
ggguucaagugauccuccua

SEQ ID NO: 359565 - RNA, 21 nt, Human
ggguuggcaaaaaaaaaaaaa

SEQ ID NO: 359566 - RNA, 22 nt, Human
ggguuuguguucuuugcccugg

SEQ ID NO: 359567 - RNA, 21 nt, Human
gguccagcgagcaaacaggag

SEQ ID NO: 359568 - RNA, 22 nt, Human
gguggguuuucccuccugaaag

SEQ ID NO: 359569 - RNA, 19 nt, Human
gguuggugaauguggccag

SEQ ID NO: 359570 - RNA, 21 nt, Human
gugcgcauuugccgggcucgg

SEQ ID NO: 359571 - RNA, 20 nt, Human
guggaacguuggggacaagg

SEQ ID NO: 359572 - RNA, 21 nt, Human
guggguuuucccuccugaaag

SEQ ID NO: 359573 - RNA, 22 nt, Human
guucuuugcccuggguuggugg

SEQ ID NO: 359574 - RNA, 18 nt, Human
guuggugaguggcauuuc

SEQ ID NO: 359575 - RNA, 21 nt, Human
uaaaccucuguucccaccuuc

SEQ ID NO: 359576 - RNA, 24 nt, Human
uaauuuuuguauuuuuaguggaga

SEQ ID NO: 359577 - RNA, 25 nt, Human
uacagccccaaaaguuaauaacaag

SEQ ID NO: 359578 - RNA, 18 nt, Human
uacaggugugagccacug

SEQ ID NO: 359579 - RNA, 19 nt, Human
uacaggugugagccacuga

SEQ ID NO: 359580 - RNA, 23 nt, Human
uacaggugugagccacugagccc

SEQ ID NO: 359581 - RNA, 20 nt, Human
uacaucauuuucauuacacc

SEQ ID NO: 359582 - RNA, 21 nt, Human
uacaucauuuucauuacaccc

SEQ ID NO: 359583 - RNA, 22 nt, Human
uacccaggcuggagugcaguga

SEQ ID NO: 359584 - RNA, 24 nt, Human
uacccaggcuggagugcagugaug

SEQ ID NO: 359585 - RNA, 19 nt, Human
uacccucggcuuauuuccu

SEQ ID NO: 359586 - RNA, 19 nt, Human
uaguggagaugggguuuca

SEQ ID NO: 359587 - RNA, 20 nt, Human
uaguggagaugggguuucag

SEQ ID NO: 359588 - RNA, 21 nt, Human
uaguggagaugggguuucagc

SEQ ID NO: 359589 - RNA, 24 nt, Human
uaguggagaugggguuucagcuug

SEQ ID NO: 359590 - RNA, 24 nt, Human
uaucaagaguucauagggguuagg

SEQ ID NO: 359591 - RNA, 24 nt, Human
uaucucagccuccagaguagcugg

SEQ ID NO: 359592 - RNA, 23 nt, Human
uauugaacugcuccgauagccuu

SEQ ID NO: 359593 - RNA, 20 nt, Human
uauuugcggagugaaaccgc

SEQ ID NO: 359594 - RNA, 22 nt, Human
ucaaggugaggaaaccaagccc

SEQ ID NO: 359595 - RNA, 24 nt, Human
ucacucuguuacccaggcuggagu

SEQ ID NO: 359596 - RNA, 23 nt, Human
ucacugcaaccuccaccucccgg

SEQ ID NO: 359597 - RNA, 24 nt, Human
ucacugcaaccuccaccucccggg

SEQ ID NO: 359598 - RNA, 25 nt, Human
ucacugcaaccuccaccucccgggu

SEQ ID NO: 359599 - RNA, 27 nt, Human
ucacugcaaccuccaccucccggguuc

SEQ ID NO: 359600 - RNA, 27 nt, Human
uccaccauaguuuuccccacuuccaaa

SEQ ID NO: 359601 - RNA, 24 nt, Human
uccagaguagcugggauuacaggu

SEQ ID NO: 359602 - RNA, 24 nt, Human
uccauugacaguguuccguauugc

SEQ ID NO: 359603 - RNA, 25 nt, Human
uccauugacaguguuccguauugca

SEQ ID NO: 359604 - RNA, 23 nt, Human
ucccaaagugcugggauuacagg

SEQ ID NO: 359605 - RNA, 22 nt, Human
uccccaagcccacaaauuucca

SEQ ID NO: 359606 - RNA, 23 nt, Human
uccccaagcccacaaauuuccac

SEQ ID NO: 359607 - RNA, 24 nt, Human
uccccaagcccacaaauuuccacc

SEQ ID NO: 359608 - RNA, 21 nt, Human
ucccggguucaagugauccuc

SEQ ID NO: 359609 - RNA, 19 nt, Human
ucccuccugaaaguggagg

SEQ ID NO: 359610 - RNA, 24 nt, Human
ucucacucuguuacccaggcugga

SEQ ID NO: 359611 - RNA, 26 nt, Human
ucucacucuguuacccaggcuggagu

SEQ ID NO: 359612 - RNA, 27 nt, Human
ucucacucuguuacccaggcuggagug

SEQ ID NO: 359613 - RNA, 24 nt, Human
ucuguuacccaggcuggagugcag

SEQ ID NO: 359614 - RNA, 18 nt, Human
ugaagaaacugaggccug

SEQ ID NO: 359615 - RNA, 22 nt, Human
ugaagaaacugaggccuggagg

SEQ ID NO: 359616 - RNA, 23 nt, Human
ugaagaaacugaggccuggaggg

SEQ ID NO: 359617 - RNA, 20 nt, Human
ugacacaggcguccccuccc

SEQ ID NO: 359618 - RNA, 22 nt, Human
ugacacaggcguccccucccag

SEQ ID NO: 359619 - RNA, 23 nt, Human
ugacacaggguuggcaaaaaaaa

SEQ ID NO: 359620 - RNA, 24 nt, Human
ugacacaggguuggcaaaaaaaaa

SEQ ID NO: 359621 - RNA, 27 nt, Human
ugacacaggguuggcaaaaaaaaaaaa

SEQ ID NO: 359622 - RNA, 18 nt, Human
ugaccucaggugauccgc

SEQ ID NO: 359623 - RNA, 21 nt, Human
ugaccucaggugauccgccca

SEQ ID NO: 359624 - RNA, 24 nt, Human
ugaccucaggugauccgcccaccu

SEQ ID NO: 359625 - RNA, 24 nt, Human
ugagagcaagaaagcacagcaagc

SEQ ID NO: 359626 - RNA, 20 nt, Human
ugaggaaaccaagcccccag

SEQ ID NO: 359627 - RNA, 23 nt, Human
ugauagggucuuuuuucucaaca

SEQ ID NO: 359628 - RNA, 24 nt, Human
ugauccgcccaccuuggccuccca

SEQ ID NO: 359629 - RNA, 21 nt, Human
ugcagcuaaaccucuguuccc

SEQ ID NO: 359630 - RNA, 19 nt, Human
ugcaguacuuuauugaaaa

SEQ ID NO: 359631 - RNA, 18 nt, Human
ugcaguccauugacagug

SEQ ID NO: 359632 - RNA, 22 nt, Human
ugcagugaugugaucuuagcuc

SEQ ID NO: 359633 - RNA, 21 nt, Human
ugcccuggguuggugaguggc

SEQ ID NO: 359634 - RNA, 21 nt, Human
ugccguccacuuggaagagcg

SEQ ID NO: 359635 - RNA, 24 nt, Human
ugcugggauuacaggugugagcca

SEQ ID NO: 359636 - RNA, 19 nt, Human
ugcuuuaugaaaggauuuc

SEQ ID NO: 359637 - RNA, 19 nt, Human
uggagugcagugaugugau

SEQ ID NO: 359638 - RNA, 19 nt, Human
uggagugcagugaugugau

SEQ ID NO: 359639 - RNA, 23 nt, Human
uggagugcagugaugugaucuua

SEQ ID NO: 359640 - RNA, 28 nt, Human
uggagugcagugaugugauggcucuagc

SEQ ID NO: 359641 - RNA, 19 nt, Human
uggcaaaaaaaaaaaaaaa

SEQ ID NO: 359642 - RNA, 23 nt, Human
uggcacugcaggcaucugcacca

SEQ ID NO: 359643 - RNA, 24 nt, Human
ugggagcugguuuugaaaaucacu

SEQ ID NO: 359644 - RNA, 19 nt, Human
ugggauuacaggugcucac

SEQ ID NO: 359645 - RNA, 21 nt, Human
ugggauuacaggugcucacca

SEQ ID NO: 359646 - RNA, 24 nt, Human
ugggauuacaggugcucaccacca

SEQ ID NO: 359647 - RNA, 25 nt, Human
ugggauuacaggugcucaccaccau

SEQ ID NO: 359648 - RNA, 18 nt, Human
ugggauuacaggugugag

SEQ ID NO: 359649 - RNA, 19 nt, Human
ugggauuacaggugugagc

SEQ ID NO: 359650 - RNA, 21 nt, Human
ugggauuacaggugugagcca

SEQ ID NO: 359651 - RNA, 22 nt, Human
ugggauuacaggugugagccac

SEQ ID NO: 359652 - RNA, 22 nt, Human
ugggauuacaggugugagccac

SEQ ID NO: 359653 - RNA, 24 nt, Human
ugggauuacaggugugagccacug

SEQ ID NO: 359654 - RNA, 20 nt, Human
uggggacaaggcaagacgcc

SEQ ID NO: 359655 - RNA, 23 nt, Human
ugggguguucucagcacauggga

SEQ ID NO: 359656 - RNA, 21 nt, Human
uggguuggugaguggcauuuc

SEQ ID NO: 359657 - RNA, 20 nt, Human
ugugagccacugagcccggc

SEQ ID NO: 359658 - RNA, 24 nt, Human
uuacccaggcuggagugcagugau

SEQ ID NO: 359659 - RNA, 20 nt, Human
uuaguggagaugggguuuca

SEQ ID NO: 359660 - RNA, 21 nt, Human
uuaguggagaugggguuucag

SEQ ID NO: 359661 - RNA, 24 nt, Human
uuaguggagaugggguuucagcuu

SEQ ID NO: 359662 - RNA, 25 nt, Human
uuaguggagaugggguuucagcuug

SEQ ID NO: 359663 - RNA, 26 nt, Human
uuaguggagaugggguuucagcuugu

SEQ ID NO: 359664 - RNA, 23 nt, Human
uucaagugauccuccuaucucag

SEQ ID NO: 359665 - RNA, 24 nt, Human
uucaagugauccuccuaucucagc

SEQ ID NO: 359666 - RNA, 19 nt, Human
uucugccugggguuggucc

SEQ ID NO: 359667 - RNA, 26 nt, Human
uugaaaaaugucggugguaucuccua

SEQ ID NO: 359668 - RNA, 20 nt, Human
uugagacagucucacucugu

SEQ ID NO: 359669 - RNA, 22 nt, Human
uugagagcaguugguguaggug

SEQ ID NO: 359670 - RNA, 19 nt, Human
uugauaaagcagcaaaaug

SEQ ID NO: 359671 - RNA, 18 nt, Human
uuggccucccaaagugcu

SEQ ID NO: 359672 - RNA, 23 nt, Human
uuguauuuuuaguggagaugggg

SEQ ID NO: 359673 - RNA, 20 nt, Human
uugugcaguucagagccaug

SEQ ID NO: 359674 - RNA, 18 nt, Human
uuguguucuuugcccugg

SEQ ID NO: 359675 - RNA, 18 nt, Human
uuugguuggugaaugugg

SEQ ID NO: 359676 - RNA, 22 nt, Human
uuuuaauggcacugcaggcauc

SEQ ID NO: 359677 - RNA, 20 nt, Human
uuuuccauguugagaucuuu

SEQ ID NO: 359678 - RNA, 22 nt, Human
uuuuuaguggagaugggguuuc

SEQ ID NO: 359679 - RNA, 20 nt, Human
uuuuuguauuuuuaguggag

SEQ ID NO: 359680 - RNA, 25 nt, Human
uuuuuuuuuuuuugagacagucuca

SEQ ID NO: 359681 - RNA, 21 nt, Human
aaaaacccaucuuuaccccac

SEQ ID NO: 359682 - RNA, 21 nt, Human
aaaacuguucuaaugaagaaa

SEQ ID NO: 359683 - RNA, 21 nt, Human
aaaccaucugauccacggcaa

SEQ ID NO: 359684 - RNA, 19 nt, Human
aaguaauggagaucacagg

SEQ ID NO: 359685 - RNA, 23 nt, Human
aaguaauggagaucacaggcacu

SEQ ID NO: 359686 - RNA, 25 nt, Human
aaucuguuacccaagcugcaguaca

SEQ ID NO: 359687 - RNA, 19 nt, Human
acauauaaugucguuuucc

SEQ ID NO: 359688 - RNA, 22 nt, Human
acaucacaguucccaaaacgac

SEQ ID NO: 359689 - RNA, 26 nt, Human
agacaaauaaaucauaaaacuguucu

SEQ ID NO: 359690 - RNA, 21 nt, Human
aggaauagacgggcuuucaaa

SEQ ID NO: 359691 - RNA, 24 nt, Human
aggcacugguccugacuucagggg

SEQ ID NO: 359692 - RNA, 23 nt, Human
aguacaguggcaucaucauagcu

SEQ ID NO: 359693 - RNA, 18 nt, Human
aguagcugggauuacggg

SEQ ID NO: 359694 - RNA, 22 nt, Human
cacggcaaaacuaacugguacc

SEQ ID NO: 359695 - RNA, 24 nt, Human
cagcaaccuucaagcacaggcacc

SEQ ID NO: 359696 - RNA, 20 nt, Human
cagccuuaaacuccugggcu

SEQ ID NO: 359697 - RNA, 24 nt, Human
cagccuuaaacuccugggcugaag

SEQ ID NO: 359698 - RNA, 23 nt, Human
cagcucaccaauauucccuuacu

SEQ ID NO: 359699 - RNA, 23 nt, Human
caguucccaaaacgacuuuaaag

SEQ ID NO: 359700 - RNA, 23 nt, Human
cauaggaauagacgggcuuucaa

SEQ ID NO: 359701 - RNA, 20 nt, Human
caucugauccacggcaaaac

SEQ ID NO: 359702 - RNA, 23 nt, Human
ccaucugauccacggcaaaacua

SEQ ID NO: 359703 - RNA, 20 nt, Human
cccaagcugcaguacagugg

SEQ ID NO: 359704 - RNA, 23 nt, Human
cccaagcugcaguacaguggcau

SEQ ID NO: 359705 - RNA, 20 nt, Human
ccccgcgccgagcccucaaa

SEQ ID NO: 359706 - RNA, 18 nt, Human
cccgagcugcagccgcgc

SEQ ID NO: 359707 - RNA, 23 nt, Human
cccgagcugcagccgcgcagaag

SEQ ID NO: 359708 - RNA, 21 nt, Human
cccgcgccgagcccucaaacc

SEQ ID NO: 359709 - RNA, 22 nt, Human
ccgagcccucaaaccgagcgca

SEQ ID NO: 359710 - RNA, 23 nt, Human
ccuccagccuuaguagcugggau

SEQ ID NO: 359711 - RNA, 23 nt, Human
ccugacuucagggggaauaggag

SEQ ID NO: 359712 - RNA, 20 nt, Human
ccugggcugaagugauccuc

SEQ ID NO: 359713 - RNA, 24 nt, Human
ccuuaaacuccugggcugaaguga

SEQ ID NO: 359714 - RNA, 23 nt, Human
ccuuaguagcugggauuacgggc

SEQ ID NO: 359715 - RNA, 18 nt, Human
ccuuggguuauggugggg

SEQ ID NO: 359716 - RNA, 21 nt, Human
cgagcccucaaaccgagcgca

SEQ ID NO: 359717 - RNA, 21 nt, Human
cuacagcaaccuucaagcaca

SEQ ID NO: 359718 - RNA, 21 nt, Human
cucacugcagccuuaaacucc

SEQ ID NO: 359719 - RNA, 24 nt, Human
cucacugcagccuuaaacuccugg

SEQ ID NO: 359720 - RNA, 21 nt, Human
cugcagccgcgcagaaggagg

SEQ ID NO: 359721 - RNA, 20 nt, Human
cuguucaugugucaaccccu

SEQ ID NO: 359722 - RNA, 23 nt, Human
cuuaguagcugggauuacgggcg

SEQ ID NO: 359723 - RNA, 18 nt, Human
gaugucaguaacuuaaaa

SEQ ID NO: 359724 - RNA, 23 nt, Human
ggccgaagucccgagcugcagcc

SEQ ID NO: 359725 - RNA, 21 nt, Human
ggcuuuuuuuuuuuuuuuuuu

SEQ ID NO: 359726 - RNA, 19 nt, Human
gggcugggucaggccgaag

SEQ ID NO: 359727 - RNA, 18 nt, Human
guagcugggauuacgggc

SEQ ID NO: 359728 - RNA, 21 nt, Human
uaaaaacccaucuuuacccca

SEQ ID NO: 359729 - RNA, 23 nt, Human
uaaauccuaccacuucuuccaaa

SEQ ID NO: 359730 - RNA, 23 nt, Human
uaacggcuuuuuuuuuuuuuuuu

SEQ ID NO: 359731 - RNA, 23 nt, Human
uaccacuucuuccaaauucccau

SEQ ID NO: 359732 - RNA, 24 nt, Human
uagcucacugcagccuuaaacucc

SEQ ID NO: 359733 - RNA, 22 nt, Human
uaguagcugggauuacgggcgc

SEQ ID NO: 359734 - RNA, 19 nt, Human
uauacauugcuuaaggugg

SEQ ID NO: 359735 - RNA, 24 nt, Human
uauucuguucaugugucaacccca

SEQ ID NO: 359736 - RNA, 24 nt, Human
uauuuuauuuaaauaaauccucca

SEQ ID NO: 359737 - RNA, 20 nt, Human
ucaaaccgagcgcagacgcc

SEQ ID NO: 359738 - RNA, 22 nt, Human
ucacaucacaguucccaaaacg

SEQ ID NO: 359739 - RNA, 24 nt, Human
ucacugcagccuuaaacuccuggg

SEQ ID NO: 359740 - RNA, 22 nt, Human
uccacaucacaucacaguuccc

SEQ ID NO: 359741 - RNA, 23 nt, Human
ucucaaucuguuacccaagcugc

SEQ ID NO: 359742 - RNA, 24 nt, Human
ucucaaucuguuacccaagcugca

SEQ ID NO: 359743 - RNA, 24 nt, Human
ucuguuacccaagcugcaguacag

SEQ ID NO: 359744 - RNA, 19 nt, Human
ugaacaaaaaauacacacc

SEQ ID NO: 359745 - RNA, 20 nt, Human
ugagacagguucucaaucug

SEQ ID NO: 359746 - RNA, 22 nt, Human
ugagacagguucucaaucuguu

SEQ ID NO: 359747 - RNA, 23 nt, Human
uggcaucaucauagcucacugca

SEQ ID NO: 359748 - RNA, 19 nt, Human
uggcuaauaccuccaggaa

SEQ ID NO: 359749 - RNA, 19 nt, Human
ugggauuacgggcgccagc

SEQ ID NO: 359750 - RNA, 20 nt, Human
ugugucaaccccaauuacag

SEQ ID NO: 359751 - RNA, 21 nt, Human
uuauugggcaagacuugcuuu

SEQ ID NO: 359752 - RNA, 27 nt, Human
uuccacaucacaucacaguucccaaaa

SEQ ID NO: 359753 - RNA, 26 nt, Human
uuggcuaauaccuccaggaaaauaaa

SEQ ID NO: 359754 - RNA, 21 nt, Human
uuuaaauccuaccacuucuuc

SEQ ID NO: 359755 - RNA, 23 nt, Human
uuuacccuucuggauuuuuccug

SEQ ID NO: 359756 - RNA, 21 nt, Human
uuuauaaaccaucugauccac

SEQ ID NO: 359757 - RNA, 21 nt, Human
uuuuauuuauuucuucuaggu

SEQ ID NO: 359758 - RNA, 19 nt, Human
uuuucugacauacuccuag

SEQ ID NO: 359759 - RNA, 26 nt, Human
uuuucugacauacuccuagacaaaua

SEQ ID NO: 359760 - RNA, 19 nt, Human
uuuuuuuuuuuuuuuuuaa

SEQ ID NO: 359761 - RNA, 24 nt, Human
aaaaaaagaacaaaacagcaccaa

SEQ ID NO: 359762 - RNA, 26 nt, Human
aaaaaaagaacaaaacagcaccaaga

SEQ ID NO: 359763 - RNA, 22 nt, Human
aaacaaaaaaagaacaaaacag

SEQ ID NO: 359764 - RNA, 25 nt, Human
aaacaaaaaaagaacaaaacagcac

SEQ ID NO: 359765 - RNA, 27 nt, Human
aaacaaaaaaagaacaaaacagcacca

SEQ ID NO: 359766 - RNA, 26 nt, Human
aaacaacaaaaaacaaaaaaagaaca

SEQ ID NO: 359767 - RNA, 25 nt, Human
aaacagcaccaagaacccccaguag

SEQ ID NO: 359768 - RNA, 22 nt, Human
aaacugagugggauuuuccauu

SEQ ID NO: 359769 - RNA, 25 nt, Human
aacaaaaaacaaaaaaagaacaaaa

SEQ ID NO: 359770 - RNA, 26 nt, Human
aacaaaaaacaaaaaaagaacaaaag

SEQ ID NO: 359771 - RNA, 19 nt, Human
aacaaaacagcaccaagaa

SEQ ID NO: 359772 - RNA, 22 nt, Human
aacaaaacagcaccaagaaccu

SEQ ID NO: 359773 - RNA, 24 nt, Human
aauaucuucuaucccugagagauc

SEQ ID NO: 359774 - RNA, 21 nt, Human
acaaaacaacaaaaaacaaaa

SEQ ID NO: 359775 - RNA, 22 nt, Human
acaaaacaacaaaaaacaaaaa

SEQ ID NO: 359776 - RNA, 18 nt, Human
caaaaaaagaacaaaaca

SEQ ID NO: 359777 - RNA, 23 nt, Human
caaaaaaagaacaaaacagcacc

SEQ ID NO: 359778 - RNA, 30 nt, Human
caaaacaacaaaaaacaaaaaaagaacaaa

SEQ ID NO: 359779 - RNA, 18 nt, Human
caaaacagcaccaagaac

SEQ ID NO: 359780 - RNA, 21 nt, Human
caaaacagcaccaagaaccua

SEQ ID NO: 359781 - RNA, 26 nt, Human
caacaaaaaacaaaaaaagaacaaaa

SEQ ID NO: 359782 - RNA, 22 nt, Human
cagcaccaagaaccuauguaaa

SEQ ID NO: 359783 - RNA, 24 nt, Human
cugcuugauuacagaaaacuguuc

SEQ ID NO: 359784 - RNA, 19 nt, Human
cuucuaucccugagagauc

SEQ ID NO: 359785 - RNA, 21 nt, Human
uaacaaaacaacaaaaaacaa

SEQ ID NO: 359786 - RNA, 23 nt, Human
uaacaaaacaacaaaaaacaaaa

SEQ ID NO: 359787 - RNA, 27 nt, Human
uaacaaaacaacaaaaaacaaaaaaag

SEQ ID NO: 359788 - RNA, 27 nt, Human
uaacaaaacaacaaaaaacaaaaaaag

SEQ ID NO: 359789 - RNA, 21 nt, Human
uaaguaaauaacaaaacaaca

SEQ ID NO: 359790 - RNA, 19 nt, Human
ucaaacuguucaucaaaaa

SEQ ID NO: 359791 - RNA, 18 nt, Human
ucuaucccugagagauca

SEQ ID NO: 359792 - RNA, 21 nt, Human
ugaauuggcauuguuuuccuc

SEQ ID NO: 359793 - RNA, 24 nt, Human
ugaauuggcauuguuuuccucaga

SEQ ID NO: 359794 - RNA, 20 nt, Human
ugauuacagaaaacuguuca

SEQ ID NO: 359795 - RNA, 18 nt, Human
ugcaagcugcuugauuac

SEQ ID NO: 359796 - RNA, 22 nt, Human
uucaaacuguucaucaaaaacu

SEQ ID NO: 359797 - RNA, 18 nt, Human
uucagauauucaaaucaa

SEQ ID NO: 359798 - RNA, 18 nt, Human
uugauuacagaaaacugu

SEQ ID NO: 359799 - RNA, 26 nt, Human
uuucuaugcaagcugcuugauuacag

SEQ ID NO: 359800 - RNA, 20 nt, Human
aaaggaccaggaggaugggg

SEQ ID NO: 359801 - RNA, 27 nt, Human
aaggaccaggaggauggggccaggagg

SEQ ID NO: 359802 - RNA, 19 nt, Human
aaggagcaacaggagccug

SEQ ID NO: 359803 - RNA, 19 nt, Human
aagucagugcccagagccc

SEQ ID NO: 359804 - RNA, 23 nt, Human
aagucccagcaguagagucagaa

SEQ ID NO: 359805 - RNA, 20 nt, Human
acaaggcuggggaguuggga

SEQ ID NO: 359806 - RNA, 20 nt, Human
accuggagagcgucuguggu

SEQ ID NO: 359807 - RNA, 25 nt, Human
acuucuguaagucccagcaguagag

SEQ ID NO: 359808 - RNA, 20 nt, Human
agagcgucugugguuuacgg

SEQ ID NO: 359809 - RNA, 25 nt, Human
agagucagaagcaggaaaggaccag

SEQ ID NO: 359810 - RNA, 21 nt, Human
aggcuggggaguugggauagg

SEQ ID NO: 359811 - RNA, 23 nt, Human
aguccugguguguuuagauuugg

SEQ ID NO: 359812 - RNA, 25 nt, Human
cagagcccaaucccauggccccugc

SEQ ID NO: 359813 - RNA, 24 nt, Human
cagcagagaugagggucccacgug

SEQ ID NO: 359814 - RNA, 21 nt, Human
caggaaaggaccaggaggaug

SEQ ID NO: 359815 - RNA, 18 nt, Human
caggaaucuggaaggcag

SEQ ID NO: 359816 - RNA, 18 nt, Human
caggagccugugggcagg

SEQ ID NO: 359817 - RNA, 19 nt, Human
caggagccugugggcaggc

SEQ ID NO: 359818 - RNA, 22 nt, Human
caggagccugugggcaggcaga

SEQ ID NO: 359819 - RNA, 25 nt, Human
caggagccugugggcaggcagaaaa

SEQ ID NO: 359820 - RNA, 20 nt, Human
ccucaacaaggcuggggagu

SEQ ID NO: 359821 - RNA, 20 nt, Human
ccugugggcaggcagauguc

SEQ ID NO: 359822 - RNA, 18 nt, Human
cugguguguuuagauuug

SEQ ID NO: 359823 - RNA, 21 nt, Human
gaaaggaccaggaggaugggg

SEQ ID NO: 359824 - RNA, 19 nt, Human
gaggauggggccaggaggc

SEQ ID NO: 359825 - RNA, 24 nt, Human
gagucagaagcaggaaaggaccag

SEQ ID NO: 359826 - RNA, 20 nt, Human
ggggaguugggauaggcagg

SEQ ID NO: 359827 - RNA, 21 nt, Human
ggggaguugggauaggcagga

SEQ ID NO: 359828 - RNA, 21 nt, Human
ggggaguugggauaggcagga

SEQ ID NO: 359829 - RNA, 20 nt, Human
guggcaggggaggaaggaau

SEQ ID NO: 359830 - RNA, 30 nt, Human
uaagucagugcccagagcccaaucccaugg

SEQ ID NO: 359831 - RNA, 25 nt, Human
uaagucccagcaguagagucagaag

SEQ ID NO: 359832 - RNA, 21 nt, Human
uagagaaccucaacaaggcug

SEQ ID NO: 359833 - RNA, 20 nt, Human
ucccauggccccugcucagg

SEQ ID NO: 359834 - RNA, 19 nt, Human
ucucaaggcgauggauggg

SEQ ID NO: 359835 - RNA, 23 nt, Human
ucuggggcauccaggucugugug

SEQ ID NO: 359836 - RNA, 18 nt, Human
ugagggucccacguggca

SEQ ID NO: 359837 - RNA, 20 nt, Human
ugcucuggggcauccagguc

SEQ ID NO: 359838 - RNA, 18 nt, Human
uggaaggcaggauaacuc

SEQ ID NO: 359839 - RNA, 18 nt, Human
uggcaggggaggaaggaa

SEQ ID NO: 359840 - RNA, 18 nt, Human
uggcaggggaggaaggaa

SEQ ID NO: 359841 - RNA, 19 nt, Human
uggcaggggaggaaggaag

SEQ ID NO: 359842 - RNA, 21 nt, Human
uggcaggggaggaaggaagga

SEQ ID NO: 359843 - RNA, 19 nt, Human
uggcauguuucucgccuuc

SEQ ID NO: 359844 - RNA, 18 nt, Human
uucaagaggcaauagaga

SEQ ID NO: 359845 - RNA, 19 nt, Human
aaaaagagcugaaaacagu

SEQ ID NO: 359846 - RNA, 23 nt, Human
aaaaauguugaaacucacuagac

SEQ ID NO: 359847 - RNA, 23 nt, Human
aaacagcaguccaaaauauuaca

SEQ ID NO: 359848 - RNA, 24 nt, Human
aaacagucuucacuguaaaaauaa

SEQ ID NO: 359849 - RNA, 21 nt, Human
aaagaaaagugaaaauaccau

SEQ ID NO: 359850 - RNA, 26 nt, Human
aaagcaacugaaacauuuccaaagca

SEQ ID NO: 359851 - RNA, 23 nt, Human
aagcuuuugcagcugagaaaguu

SEQ ID NO: 359852 - RNA, 22 nt, Human
acaaagaaaagugaaaauacca

SEQ ID NO: 359853 - RNA, 18 nt, Human
accugcacaauuauuaca

SEQ ID NO: 359854 - RNA, 20 nt, Human
acuagaagcuuuugcagcug

SEQ ID NO: 359855 - RNA, 23 nt, Human
agacaaccgagugcucuccccac

SEQ ID NO: 359856 - RNA, 20 nt, Human
agagcugaaaacagucuuca

SEQ ID NO: 359857 - RNA, 18 nt, Human
agcugccacaguuuugga

SEQ ID NO: 359858 - RNA, 18 nt, Human
agucuugaccaacagcug

SEQ ID NO: 359859 - RNA, 23 nt, Human
aucaucuauagcacacaaacauc

SEQ ID NO: 359860 - RNA, 24 nt, Human
augaacuucuugaaagacuagaag

SEQ ID NO: 359861 - RNA, 22 nt, Human
augagccaauauagacauuacu

SEQ ID NO: 359862 - RNA, 19 nt, Human
auuuauuuguuuuucaggu

SEQ ID NO: 359863 - RNA, 24 nt, Human
caaauaaauucagauugagacauc

SEQ ID NO: 359864 - RNA, 21 nt, Human
caaccgagugcucuccccaca

SEQ ID NO: 359865 - RNA, 22 nt, Human
cauuacuacauguccacaggaa

SEQ ID NO: 359866 - RNA, 21 nt, Human
ccaaaauauuacacucucccc

SEQ ID NO: 359867 - RNA, 20 nt, Human
ccaaccuauaaauauuacac

SEQ ID NO: 359868 - RNA, 18 nt, Human
ccaguagaaguaccauua

SEQ ID NO: 359869 - RNA, 19 nt, Human
ccucucuggcccuccuccc

SEQ ID NO: 359870 - RNA, 23 nt, Human
ccuguugcucuccucauuaaugg

SEQ ID NO: 359871 - RNA, 23 nt, Human
cuaagcuuuuaaauaaagauaaa

SEQ ID NO: 359872 - RNA, 24 nt, Human
cugaaaacagucuucacuguaaaa

SEQ ID NO: 359873 - RNA, 18 nt, Human
gaaaauaccauucuuugg

SEQ ID NO: 359874 - RNA, 21 nt, Human
ggaacaauuccuguaccugca

SEQ ID NO: 359875 - RNA, 20 nt, Human
ggagacauguacuuucuggc

SEQ ID NO: 359876 - RNA, 19 nt, Human
guuacaaagaaaagugaaa

SEQ ID NO: 359877 - RNA, 24 nt, Human
uaaaaauuauccaugaaaaacaau

SEQ ID NO: 359878 - RNA, 22 nt, Human
uaaaauaucaucuauagcacac

SEQ ID NO: 359879 - RNA, 27 nt, Human
uaaacaacaauggcaaauauuucaaaa

SEQ ID NO: 359880 - RNA, 22 nt, Human
uaaagacaaccgagugcucucc

SEQ ID NO: 359881 - RNA, 18 nt, Human
uaauccugaaauucuuag

SEQ ID NO: 359882 - RNA, 19 nt, Human
uacaaguaaaaaacacugg

SEQ ID NO: 359883 - RNA, 21 nt, Human
uacaauauaaaaagagcugaa

SEQ ID NO: 359884 - RNA, 22 nt, Human
uaccaaccuauaaauauuacac

SEQ ID NO: 359885 - RNA, 24 nt, Human
uacuagggcuagcaguuugguauu

SEQ ID NO: 359886 - RNA, 19 nt, Human
uagaagcuuuugcagcuga

SEQ ID NO: 359887 - RNA, 18 nt, Human
uagcacacaaacaucaug

SEQ ID NO: 359888 - RNA, 18 nt, Human
uagcugccacaguuuugg

SEQ ID NO: 359889 - RNA, 18 nt, Human
uauuucaaaaguugaagg

SEQ ID NO: 359890 - RNA, 22 nt, Human
ucacuagacaaaacaaaaaaaa

SEQ ID NO: 359891 - RNA, 19 nt, Human
ucaggggccuguugcucuc

SEQ ID NO: 359892 - RNA, 19 nt, Human
uccacaggaaguacaaaag

SEQ ID NO: 359893 - RNA, 23 nt, Human
uccacaggaaguacaaaagccau

SEQ ID NO: 359894 - RNA, 21 nt, Human
ucucuaguuuuaaggcaggga

SEQ ID NO: 359895 - RNA, 23 nt, Human
ucuggcccuccucccucgccucc

SEQ ID NO: 359896 - RNA, 21 nt, Human
ugacuuccuucuacucacacu

SEQ ID NO: 359897 - RNA, 27 nt, Human
ugcaaauggaaaacuaaauauacugca

SEQ ID NO: 359898 - RNA, 19 nt, Human
ugcaauuucauaaaguaug

SEQ ID NO: 359899 - RNA, 18 nt, Human
ugcucuccucauuaaugg

SEQ ID NO: 359900 - RNA, 21 nt, Human
uggcccuccucccucgccucc

SEQ ID NO: 359901 - RNA, 19 nt, Human
ugggagacauguacuuucu

SEQ ID NO: 359902 - RNA, 19 nt, Human
uguuaaagaaucaaaaguu

SEQ ID NO: 359903 - RNA, 23 nt, Human
uucucuggcaguaaugguccuag

SEQ ID NO: 359904 - RNA, 21 nt, Human
uuuaaaauaucaucuauagca

SEQ ID NO: 359905 - RNA, 23 nt, Human
uuuaaaauaucaucuauagcaca

SEQ ID NO: 359906 - RNA, 22 nt, Human
uuuauuuguuuuucagguuagu

SEQ ID NO: 359907 - RNA, 26 nt, Human
uuuuaugagccaauauagacauuacu

SEQ ID NO: 359908 - RNA, 23 nt, Human
uuuuuuuuuuuuuuuuuuaacag

SEQ ID NO: 359909 - RNA, 23 nt, Human
aaccacugugucccgucaccgac

SEQ ID NO: 359910 - RNA, 23 nt, Human
aaccacugugucccgucaccgac

SEQ ID NO: 359911 - RNA, 22 nt, Human
accaaccacugugucccgucac

SEQ ID NO: 359912 - RNA, 22 nt, Human
acuacaacucucagcagacauu

SEQ ID NO: 359913 - RNA, 22 nt, Human
acuacaacucucagcagacauu

SEQ ID NO: 359914 - RNA, 22 nt, Human
auagggcacagaacuacaacuc

SEQ ID NO: 359915 - RNA, 23 nt, Human
caccaaccacugugucccgucac

SEQ ID NO: 359916 - RNA, 23 nt, Human
cagcggcuccucccucagagucu

SEQ ID NO: 359917 - RNA, 23 nt, Human
cccucagagucugaaucugaguc

SEQ ID NO: 359918 - RNA, 24 nt, Human
cccucccggcucagacucccccua

SEQ ID NO: 359919 - RNA, 25 nt, Human
cccuugaggcugucaccgaccgcuc

SEQ ID NO: 359920 - RNA, 25 nt, Human
cccuugaggcugucaccgaccgcuc

SEQ ID NO: 359921 - RNA, 18 nt, Human
cgggggcaggagacagag

SEQ ID NO: 359922 - RNA, 22 nt, Human
cugcuucuccaccagcggcucc

SEQ ID NO: 359923 - RNA, 22 nt, Human
cuggaagaguuaaaaguucugg

SEQ ID NO: 359924 - RNA, 21 nt, Human
cugucccugaggagcucggca

SEQ ID NO: 359925 - RNA, 21 nt, Human
cuucuccaccagcggcuccuc

SEQ ID NO: 359926 - RNA, 26 nt, Human
gcaggagacagagugggaggucgacc

SEQ ID NO: 359927 - RNA, 20 nt, Human
gcaggagacagagugggggc

SEQ ID NO: 359928 - RNA, 18 nt, Human
gcugaaggcagagacucg

SEQ ID NO: 359929 - RNA, 24 nt, Human
ggaccccaguuuuggggagggagc

SEQ ID NO: 359930 - RNA, 20 nt, Human
ggagcccucccggcucagac

SEQ ID NO: 359931 - RNA, 23 nt, Human
gggaagugggucccacgugaaaa

SEQ ID NO: 359932 - RNA, 19 nt, Human
gggagggagcuguaagaga

SEQ ID NO: 359933 - RNA, 28 nt, Human
gggcaggagacagagugggaggucgacc

SEQ ID NO: 359934 - RNA, 21 nt, Human
ggggagggagcuguaagagau

SEQ ID NO: 359935 - RNA, 24 nt, Human
ggggcccaccacccacuuugggag

SEQ ID NO: 359936 - RNA, 20 nt, Human
gggggccaggcccgguuggg

SEQ ID NO: 359937 - RNA, 24 nt, Human
guugcugggaccccaguuuugggg

SEQ ID NO: 359938 - RNA, 28 nt, Human
uaagcaaugucuucugcccccugaaagg

SEQ ID NO: 359939 - RNA, 21 nt, Human
uagggcacagaacuacaacuc

SEQ ID NO: 359940 - RNA, 21 nt, Human
uaugguuuacuuagccacagg

SEQ ID NO: 359941 - RNA, 24 nt, Human
ucccuguccuggaagaguuaaaag

SEQ ID NO: 359942 - RNA, 21 nt, Human
ucugagcuccccagacaagaa

SEQ ID NO: 359943 - RNA, 18 nt, Human
ucugggguagcccuggcc

SEQ ID NO: 359944 - RNA, 24 nt, Human
ugaaggcagagacucgggagcccu

SEQ ID NO: 359945 - RNA, 22 nt, Human
ugaagggggcccaccacccacu

SEQ ID NO: 359946 - RNA, 24 nt, Human
ugacggcaccagaaaugggagugg

SEQ ID NO: 359947 - RNA, 24 nt, Human
ugacggcaccagaaaugggagugg

SEQ ID NO: 359948 - RNA, 26 nt, Human
ugaggcugucaccgaccgcucugucc

SEQ ID NO: 359949 - RNA, 23 nt, Human
ugccaugggcgcggugcugaagc

SEQ ID NO: 359950 - RNA, 18 nt, Human
ugcccauccagcauggga

SEQ ID NO: 359951 - RNA, 20 nt, Human
uggaagaguuaaaaguucug

SEQ ID NO: 359952 - RNA, 19 nt, Human
ugggaguggccgugauagg

SEQ ID NO: 359953 - RNA, 19 nt, Human
ugggaguggccgugauagg

SEQ ID NO: 359954 - RNA, 20 nt, Human
ugggggccaggguugcuggg

SEQ ID NO: 359955 - RNA, 30 nt, Human
ugucccgugacggcaccagaaaugggaguu

SEQ ID NO: 359956 - RNA, 30 nt, Human; identical to SEQ ID NO: 359955

SEQ ID NO: 359957 - RNA, 20 nt, Human
ugucuccaauaagcaauguc

SEQ ID NO: 359958 - RNA, 23 nt, Human
uuaaaaguucugggguagcccug

SEQ ID NO: 359959 - RNA, 27 nt, Human
uugaggcugucaccgaccgcucugucc

SEQ ID NO: 359960 - RNA, 19 nt, Human
uugcugggaccccaguuuu

SEQ ID NO: 359961 - RNA, 23 nt, Human
uugcugggaccccaguuuugggg

SEQ ID NO: 359962 - RNA, 28 nt, Human
uuuuuuguuaguuguuuuuguuuuuaau

SEQ ID NO: 359963 - RNA, 20 nt, Human
uuuuuuuuuguuaguuguuu

SEQ ID NO: 359964 - RNA, 25 nt, Human
uuuuuuuuuuuuuuuuguuaguugu

SEQ ID NO: 359965 - RNA, 18 nt, Human
uuuuuuuuuuuuuuuuug

SEQ ID NO: 359966 - RNA, 25 nt, Human
uuuuuuuuuuuuuuuuuuguuaguu

SEQ ID NO: 359967 - RNA, 21 nt, Human
aaaaauagccccacuaaagga

SEQ ID NO: 359968 - RNA, 19 nt, Human
aaauagccccacuaaagga

SEQ ID NO: 359969 - RNA, 19 nt, Human
auuaggagcuucagcagag

SEQ ID NO: 359970 - RNA, 18 nt, Human
caacaugcuagaagugcg

SEQ ID NO: 359971 - RNA, 22 nt, Human
caacuaggcacagaaagcagac

SEQ ID NO: 359972 - RNA, 20 nt, Human
cagaagaaagcuuuuuccau

SEQ ID NO: 359973 - RNA, 21 nt, Human
cauuccaguggcagccucggg

SEQ ID NO: 359974 - RNA, 20 nt, Human
cccgcggcgccccggccccg

SEQ ID NO: 359975 - RNA, 22 nt, Human
cccgcggcgccccggccccgcc

SEQ ID NO: 359976 - RNA, 21 nt, Human
cccggccccgccuccgccucc

SEQ ID NO: 359977 - RNA, 21 nt, Human
ccgccuccgccucccaccccc

SEQ ID NO: 359978 - RNA, 22 nt, Human
ccgccuccgccucccacccccg

SEQ ID NO: 359979 - RNA, 21 nt, Human
ccucccacccccgcccccggc

SEQ ID NO: 359980 - RNA, 20 nt, Human
ccuccgccucccacccccgc

SEQ ID NO: 359981 - RNA, 21 nt, Human
ccucggguguccacucaguuc

SEQ ID NO: 359982 - RNA, 18 nt, Human
cgccccgcccccggcgcc

SEQ ID NO: 359983 - RNA, 18 nt, Human
cgcccgcggcgccccggg

SEQ ID NO: 359984 - RNA, 23 nt, Human
cggcgccccgcccgcggcgcccc

SEQ ID NO: 359985 - RNA, 21 nt, Human
cugcagcucauggccugagaa

SEQ ID NO: 359986 - RNA, 24 nt, Human
gacucgccccgcccccggcgcccc

SEQ ID NO: 359987 - RNA, 22 nt, Human
gccccacuaaaggagaccaaca

SEQ ID NO: 359988 - RNA, 24 nt, Human
ggagacuaaauguauuucaugcug

SEQ ID NO: 359989 - RNA, 27 nt, Human
ggguggcccugacuguaaacacagccc

SEQ ID NO: 359990 - RNA, 20 nt, Human
gucacagucagaagaaagcu

SEQ ID NO: 359991 - RNA, 21 nt, Human
uaaaaauagccccacuaaagg

SEQ ID NO: 359992 - RNA, 23 nt, Human
uagccccacuaaaggagaccaac

SEQ ID NO: 359993 - RNA, 20 nt, Human
ucacugcagcucauggccug

SEQ ID NO: 359994 - RNA, 19 nt, Human
uccggacucgccccgcccc

SEQ ID NO: 359995 - RNA, 20 nt, Human
ucgccccgcccccggcgccc

SEQ ID NO: 359996 - RNA, 20 nt, Human
ugagaagacauuccaguggc

SEQ ID NO: 359997 - RNA, 22 nt, Human
ugaggagacuaaauguauuuca

SEQ ID NO: 359998 - RNA, 22 nt, Human
ugcccaagcugucuucaggcau

SEQ ID NO: 359999 - RNA, 20 nt, Human
uggaaagaacagauuuucuc

SEQ ID NO: 360000 - RNA, 23 nt, Human
uggaaagaacagauuuucucuca

SEQ ID NO: 360001 - RNA, 18 nt, Human
ugggauguggaugucucc

SEQ ID NO: 360002 - RNA, 28 nt, Human
uggucugauucaguucaagaggggaaag

SEQ ID NO: 360003 - RNA, 26 nt, Human
uguauuucaugcuggaaagaacagau

SEQ ID NO: 360004 - RNA, 23 nt, Human
uucugguuucaccugcccaagcu

SEQ ID NO: 360005 - RNA, 23 nt, Human
uuuuuuuuuuuuuuuuucccuuu

SEQ ID NO: 360006 - RNA, 26 nt, Human
uuuuuuuuuuuuuuuuuucccuuuga

SEQ ID NO: 360007 - RNA, 26 nt, Human
cccuacucuguugaaugggaacugga

SEQ ID NO: 360008 - RNA, 18 nt, Human
uaauuaagaauauccaca

SEQ ID NO: 360009 - RNA, 24 nt, Human
uccacacauuaagauaccuagaac

SEQ ID NO: 360010 - RNA, 20 nt, Human
uggaaucugucauuugagaa

SEQ ID NO: 360011 - RNA, 23 nt, Human
uggaaucugucauuugagaaggc

SEQ ID NO: 360012 - RNA, 23 nt, Human
uugaaugggaacuggaaucuguc

SEQ ID NO: 360013 - RNA, 20 nt, Human
aagaugguugucuccacggc

SEQ ID NO: 360014 - RNA, 22 nt, Human
acccauaagaccauuucuccuc

SEQ ID NO: 360015 - RNA, 23 nt, Human
accucacguuucaguucaaacca

SEQ ID NO: 360016 - RNA, 20 nt, Human
acuucuaaacccccaucacu

SEQ ID NO: 360017 - RNA, 20 nt, Human
agaaaauuauuuucuucuuc

SEQ ID NO: 360018 - RNA, 24 nt, Human
agaggcuauuuuuagauuguucag

SEQ ID NO: 360019 - RNA, 28 nt, Human
caaccauacacaucaaagauaccuccuu

SEQ ID NO: 360020 - RNA, 19 nt, Human
cccgcacaugcugccggcc

SEQ ID NO: 360021 - RNA, 21 nt, Human
cccgcacaugcugccggcccg

SEQ ID NO: 360022 - RNA, 21 nt, Human
ccucugcguguggccuaguuc

SEQ ID NO: 360023 - RNA, 20 nt, Human
cgccuuccaggcuuucuccu

SEQ ID NO: 360024 - RNA, 22 nt, Human
cuaagagcucuggguacccccg

SEQ ID NO: 360025 - RNA, 21 nt, Human
cucaccacccauaagaccauu

SEQ ID NO: 360026 - RNA, 24 nt, Human
cuuccaggcuuucuccuagaggcg

SEQ ID NO: 360027 - RNA, 28 nt, Human
cuuuccaguucugugacuuuugaaugug

SEQ ID NO: 360028 - RNA, 21 nt, Human
ggcgcugugucccgaccgcgc

SEQ ID NO: 360029 - RNA, 20 nt, Human
uaaccaaccauacacaucaa

SEQ ID NO: 360030 - RNA, 21 nt, Human
uaauuuacaaaauuuuucccu

SEQ ID NO: 360031 - RNA, 18 nt, Human
uaggguuuuuaccccuug

SEQ ID NO: 360032 - RNA, 20 nt, Human
uaguaggguuuuuaccccuu

SEQ ID NO: 360033 - RNA, 25 nt, Human
uauuuucuucuucuguagguuuuua

SEQ ID NO: 360034 - RNA, 21 nt, Human
ucaguacucagcucaccaccc

SEQ ID NO: 360035 - RNA, 23 nt, Human
uccaguucugugacuuuugaaug

SEQ ID NO: 360036 - RNA, 19 nt, Human
ucuuugcuacuucuaaacc

SEQ ID NO: 360037 - RNA, 18 nt, Human
ugcccagauaacaaaaau

SEQ ID NO: 360038 - RNA, 19 nt, Human
uuauuuuccacuaaaacuu

SEQ ID NO: 360039 - RNA, 23 nt, Human
uuauuuucuucuucuguagguuu

SEQ ID NO: 360040 - RNA, 23 nt, Human
uucugugacuuuugaaugugggu

SEQ ID NO: 360041 - RNA, 24 nt, Human
uuuuuuuuuuuuuuuuuacuguag

SEQ ID NO: 360042 - RNA, 23 nt, Human
aaaaagccccacccuccccaagc

SEQ ID NO: 360043 - RNA, 24 nt, Human
aaaagccccacccuccccaagcac

SEQ ID NO: 360044 - RNA, 18 nt, Human
aaagccccacccucccca

SEQ ID NO: 360045 - RNA, 20 nt, Human
aaccccuggccuggagcaca

SEQ ID NO: 360046 - RNA, 23 nt, Human
aagccccacccuccccaagcacc

SEQ ID NO: 360047 - RNA, 21 nt, Human
accacggagggcagguguaac

SEQ ID NO: 360048 - RNA, 18 nt, Human
acccuccccaagcacccu

SEQ ID NO: 360049 - RNA, 19 nt, Human
agcacagcucucagagccc

SEQ ID NO: 360050 - RNA, 21 nt, Human
agggagggaccacggagggca

SEQ ID NO: 360051 - RNA, 18 nt, Human
agggcccagccucaccuc

SEQ ID NO: 360052 - RNA, 26 nt, Human
aguaacaaagugagaccacgagagaa

SEQ ID NO: 360053 - RNA, 20 nt, Human
cacaguuucuacaaaaagcc

SEQ ID NO: 360054 - RNA, 20 nt, Human
cacgucucccuccagcccca

SEQ ID NO: 360055 - RNA, 22 nt, Human
cacgucucccuccagccccaaa

SEQ ID NO: 360056 - RNA, 22 nt, Human
cacuccuguuuaagcuggagac

SEQ ID NO: 360057 - RNA, 27 nt, Human
cagagcccugaggcucccggggacaga

SEQ ID NO: 360058 - RNA, 21 nt, Human
cagggagggcccagccucacc

SEQ ID NO: 360059 - RNA, 23 nt, Human
ccccacccuccccaagcacccug

SEQ ID NO: 360060 - RNA, 18 nt, Human
ccccuggagcccagggag

SEQ ID NO: 360061 - RNA, 18 nt, Human
cccugaggcucccgggga

SEQ ID NO: 360062 - RNA, 21 nt, Human
ccugcagggcccauggaggag

SEQ ID NO: 360063 - RNA, 23 nt, Human
cucagagcccugaggcucccggg

SEQ ID NO: 360064 - RNA, 22 nt, Human
cugguggacccacgucucccuc

SEQ ID NO: 360065 - RNA, 23 nt, Human
gacccacgucucccuccagcccc

SEQ ID NO: 360066 - RNA, 19 nt, Human
gacuuuuccagaagccugg

SEQ ID NO: 360067 - RNA, 22 nt, Human
gcaagccucuacugauccccca

SEQ ID NO: 360068 - RNA, 23 nt, Human
gcaccagaggccccuggagccca

SEQ ID NO: 360069 - RNA, 20 nt, Human
gcccugaggcucccggggac

SEQ ID NO: 360070 - RNA, 23 nt, Human
gcccugaggcucccggggacaga

SEQ ID NO: 360071 - RNA, 25 nt, Human
ggcccagaagggaggcccuggggac

SEQ ID NO: 360072 - RNA, 24 nt, Human
ggccuggagcacagcucucagagc

SEQ ID NO: 360073 - RNA, 19 nt, Human
gggguagggugggcuguag

SEQ ID NO: 360074 - RNA, 23 nt, Human
ggguagggugggcuguagggggc

SEQ ID NO: 360075 - RNA, 20 nt, Human
uacaaaaagccccacccucc

SEQ ID NO: 360076 - RNA, 21 nt, Human
uacaaaaagccccacccuccc

SEQ ID NO: 360077 - RNA, 19 nt, Human
uccugcagggcccauggag

SEQ ID NO: 360078 - RNA, 23 nt, Human
ucuacaaaaagccccacccuccc

SEQ ID NO: 360079 - RNA, 18 nt, Human
ucuccccuccugcagggc

SEQ ID NO: 360080 - RNA, 23 nt, Human
uggggacagagggaguucacucc

SEQ ID NO: 360081 - RNA, 21 nt, Human
ugggguguggcuucuucccgg

SEQ ID NO: 360082 - RNA, 24 nt, Human
uguugaggccgcuuccgccggaag

SEQ ID NO: 360083 - RNA, 18 nt, Human
uucacuccuguuuaagcu

SEQ ID NO: 360084 - RNA, 23 nt, Human
uuugcaagaaagaaauuguuuuu

SEQ ID NO: 360085 - RNA, 19 nt, Human
uuuuuauugcauugaggac

SEQ ID NO: 360086 - RNA, 20 nt, Human
uuuuuauugcauugaggacu

SEQ ID NO: 360087 - RNA, 21 nt, Human
aacccagccuucaccgugaca

SEQ ID NO: 360088 - RNA, 25 nt, Human
acucugcaggccggggcugaaauaa

SEQ ID NO: 360089 - RNA, 23 nt, Human
caggccguaucaggguacaaccg

SEQ ID NO: 360090 - RNA, 23 nt, Human
caucugcaaagugccaacuguuc

SEQ ID NO: 360091 - RNA, 21 nt, Human
ccaggccguaucaggguacaa

SEQ ID NO: 360092 - RNA, 22 nt, Human
ccccaaagaguucguucucccu

SEQ ID NO: 360093 - RNA, 23 nt, Human
ccccaaagaguucguucucccua

SEQ ID NO: 360094 - RNA, 22 nt, Human
ccccuggagaccugcucuuccg

SEQ ID NO: 360095 - RNA, 24 nt, Human
ccccuggagaccugcucuuccgcu

SEQ ID NO: 360096 - RNA, 19 nt, Human
cccuggagaccugcucuuc

SEQ ID NO: 360097 - RNA, 19 nt, Human
cggaugggcagguguccuc

SEQ ID NO: 360098 - RNA, 23 nt, Human
cggcugccaccucuugacacaga

SEQ ID NO: 360099 - RNA, 22 nt, Human
cuagacccgugggggcaaccca

SEQ ID NO: 360100 - RNA, 18 nt, Human
cuggccaucugcaaagug

SEQ ID NO: 360101 - RNA, 18 nt, Human
gaccugcucuuccgcuuc

SEQ ID NO: 360102 - RNA, 19 nt, Human
gacuggccuggugagcgag

SEQ ID NO: 360103 - RNA, 19 nt, Human
gaggaaaggccgcugggcg

SEQ ID NO: 360104 - RNA, 22 nt, Human
gcccugagacuggccuggugag

SEQ ID NO: 360105 - RNA, 22 nt, Human
ggccuggugagcgaggaaaggc

SEQ ID NO: 360106 - RNA, 22 nt, Human
uccccuggagaccugcucuucc

SEQ ID NO: 360107 - RNA, 24 nt, Human
uccucgauggccaggagugcguca

SEQ ID NO: 360108 - RNA, 21 nt, Human
ucucccuagacccgugggggc

SEQ ID NO: 360109 - RNA, 18 nt, Human
ugaaaaugucauccccaa

SEQ ID NO: 360110 - RNA, 22 nt, Human
ugacacuggccaucugcaaagu

SEQ ID NO: 360111 - RNA, 18 nt, Human
uguccucgauggccaggc

SEQ ID NO: 360112 - RNA, 18 nt, Human
uugacacagaggccggau

SEQ ID NO: 360113 - RNA, 23 nt, Human
aagugagaaccugggaguuuggg

SEQ ID NO: 360114 - RNA, 21 nt, Human
aaguuccagguccacuccagu

SEQ ID NO: 360115 - RNA, 19 nt, Human
accccucccccaccgccca

SEQ ID NO: 360116 - RNA, 18 nt, Human
acgccccgcugugccagg

SEQ ID NO: 360117 - RNA, 18 nt, Human
acugucuuugccuccucc

SEQ ID NO: 360118 - RNA, 20 nt, Human
agaaauaaggagggggcuac

SEQ ID NO: 360119 - RNA, 22 nt, Human
aggaaguccgggguagaucaca

SEQ ID NO: 360120 - RNA, 22 nt, Human
auaaggagggggcuacugucuu

SEQ ID NO: 360121 - RNA, 24 nt, Human
cacuucuuacucccaucccuccuc

SEQ ID NO: 360122 - RNA, 21 nt, Human
cagaagaaggaagugagaacc

SEQ ID NO: 360123 - RNA, 25 nt, Human
ccccaccgcccacuuccugugccug

SEQ ID NO: 360124 - RNA, 18 nt, Human
ccgcagcucagcaucccc

SEQ ID NO: 360125 - RNA, 19 nt, Human
ccgcagcucagcaucccca

SEQ ID NO: 360126 - RNA, 19 nt, Human
ccgcccacuuccugugccu

SEQ ID NO: 360127 - RNA, 25 nt, Human
ccugugccugaggagacacugaggc

SEQ ID NO: 360128 - RNA, 21 nt, Human
ccuuaccccucccccaccgcc

SEQ ID NO: 360129 - RNA, 20 nt, Human
gagcggggguggggaggauc

SEQ ID NO: 360130 - RNA, 22 nt, Human
gcagugcacgccccgcugugcc

SEQ ID NO: 360131 - RNA, 18 nt, Human
gcccuuaccccuccccca

SEQ ID NO: 360132 - RNA, 19 nt, Human
gcuacugucuuugccuccu

SEQ ID NO: 360133 - RNA, 19 nt, Human
ggagacuguauucuccugc

SEQ ID NO: 360134 - RNA, 18 nt, Human
gggguggggaggaucugg

SEQ ID NO: 360135 - RNA, 20 nt, Human
ucgggucccucccgucucua

SEQ ID NO: 360136 - RNA, 23 nt, Human
ugagaaccugggaguuugggggc

SEQ ID NO: 360137 - RNA, 20 nt, Human
ugcccugagaugucucccuu

SEQ ID NO: 360138 - RNA, 21 nt, Human
uggagacuguauucuccugcu

SEQ ID NO: 360139 - RNA, 21 nt, Human
ugggaguuugggggcuaagag

SEQ ID NO: 360140 - RNA, 22 nt, Human
uuggcaauggcagcccgucuuu

SEQ ID NO: 360141 - RNA, 19 nt, Human
aaacaacuccagaaacaag

SEQ ID NO: 360142 - RNA, 28 nt, Human
aaacaacuccagaaacaagcugcaaaaa

SEQ ID NO: 360143 - RNA, 23 nt, Human
aaacaagcugcaaaaauguuccu

SEQ ID NO: 360144 - RNA, 22 nt, Human
aagagaaggcggaggaguaggg

SEQ ID NO: 360145 - RNA, 24 nt, Human
aaugcaaaaguggaaagaguugga

SEQ ID NO: 360146 - RNA, 22 nt, Human
acggcccaggcgcacgcggcag

SEQ ID NO: 360147 - RNA, 18 nt, Human
agaggcagggggcggcgg

SEQ ID NO: 360148 - RNA, 25 nt, Human
agaggcagggggcggcggccgcagg

SEQ ID NO: 360149 - RNA, 21 nt, Human
agcagagccgagaggcagggg

SEQ ID NO: 360150 - RNA, 19 nt, Human
aggaguaggggagguucug

SEQ ID NO: 360151 - RNA, 21 nt, Human
aggcgaaaaccggagucggaa

SEQ ID NO: 360152 - RNA, 18 nt, Human
agggggcggcggccgcag

SEQ ID NO: 360153 - RNA, 18 nt, Human
caaacaacuccagaaaca

SEQ ID NO: 360154 - RNA, 20 nt, Human
caagcugcaaaaauguuccu

SEQ ID NO: 360155 - RNA, 22 nt, Human
caagcugcaaaaauguuccuga

SEQ ID NO: 360156 - RNA, 20 nt, Human
cagugguugcugcuccagga

SEQ ID NO: 360157 - RNA, 18 nt, Human
ccuccuccuuaggcuuug

SEQ ID NO: 360158 - RNA, 24 nt, Human
ccuccuuaggcuuugcaaaggcga

SEQ ID NO: 360159 - RNA, 20 nt, Human
cgcugcagugguugcugcuc

SEQ ID NO: 360160 - RNA, 22 nt, Human
cggcagggagcagagccgagag

SEQ ID NO: 360161 - RNA, 18 nt, Human
cggccgcagggagggggg

SEQ ID NO: 360162 - RNA, 22 nt, Human
cuccagaaacaagcugcaaaaa

SEQ ID NO: 360163 - RNA, 18 nt, Human
cugcagugguugcugcuc

SEQ ID NO: 360164 - RNA, 20 nt, Human
cuuuaugcgcaaacaacucc

SEQ ID NO: 360165 - RNA, 20 nt, Human
gaagagaaggcggaggagua

SEQ ID NO: 360166 - RNA, 19 nt, Human
gcacggcccaggcgcacgc

SEQ ID NO: 360167 - RNA, 22 nt, Human
gcagggggcggcggccgcaggg

SEQ ID NO: 360168 - RNA, 21 nt, Human
gccgagaggcagggggcggcg

SEQ ID NO: 360169 - RNA, 21 nt, Human
gcugcaaaaauguuccugauu

SEQ ID NO: 360170 - RNA, 18 nt, Human
ggcagggagcagagccga

SEQ ID NO: 360171 - RNA, 22 nt, Human
ggccgcagggaggggggcgcgg

SEQ ID NO: 360172 - RNA, 23 nt, Human
gggcggccaaggaagagaaggcg

SEQ ID NO: 360173 - RNA, 19 nt, Human
gggcggcggccgcagggag

SEQ ID NO: 360174 - RNA, 18 nt, Human
uccaggaaucccuucgag

SEQ ID NO: 360175 - RNA, 18 nt, Human
uccuccuuaggcuuugca

SEQ ID NO: 360176 - RNA, 24 nt, Human
uccuuuaugcgcaaacaacuccag

SEQ ID NO: 360177 - RNA, 18 nt, Human
ugaaaguccaccauuccu

SEQ ID NO: 360178 - RNA, 23 nt, Human
ugcaaaggcgaaaaccggagucg

SEQ ID NO: 360179 - RNA, 23 nt, Human
ugcgcaaacaacuccagaaacaa

SEQ ID NO: 360180 - RNA, 23 nt, Human
aaaaggcaagacaagagagggua

SEQ ID NO: 360181 - RNA, 23 nt, Human
aaacaagaaccaacauagacagc

SEQ ID NO: 360182 - RNA, 18 nt, Human
aaaggaagaggaaagggg

SEQ ID NO: 360183 - RNA, 24 nt, Human
aaauaaaucccaaacaagaaccaa

SEQ ID NO: 360184 - RNA, 18 nt, Human
aagaaccaacauagacag

SEQ ID NO: 360185 - RNA, 18 nt, Human
aagacagggguacauacg

SEQ ID NO: 360186 - RNA, 18 nt, Human
aagcagaaaaaagaaaag

SEQ ID NO: 360187 - RNA, 22 nt, Human
aagcugacaccugcagcuccca

SEQ ID NO: 360188 - RNA, 19 nt, Human
aaggaagggaaaggaagag

SEQ ID NO: 360189 - RNA, 19 nt, Human
aaggagagaaugaacggug

SEQ ID NO: 360190 - RNA, 21 nt, Human
acacagaguacaagagacugg

SEQ ID NO: 360191 - RNA, 21 nt, Human
acaccgccacuccacgucccc

SEQ ID NO: 360192 - RNA, 23 nt, Human
agaaaaaagaaaagagaaggaag

SEQ ID NO: 360193 - RNA, 19 nt, Human
agacagaaagcagaaaaaa

SEQ ID NO: 360194 - RNA, 24 nt, Human
agacagaaagcagaaaaaagaaaa

SEQ ID NO: 360195 - RNA, 28 nt, Human
agacagaaagcagaaaaaaggggacccc

SEQ ID NO: 360196 - RNA, 19 nt, Human
agagagaaggaggaggggc

SEQ ID NO: 360197 - RNA, 23 nt, Human
agaggaaagggggaaaaggcaag

SEQ ID NO: 360198 - RNA, 23 nt, Human
agcaauacaaggagagggagaaa

SEQ ID NO: 360199 - RNA, 20 nt, Human
aggaagagcgcgguguggcg

SEQ ID NO: 360200 - RNA, 19 nt, Human
aggaagggaaaggaagagg

SEQ ID NO: 360201 - RNA, 24 nt, Human
aguacaagagacuggcaggagaga

SEQ ID NO: 360202 - RNA, 19 nt, Human
agucacagucccgggagga

SEQ ID NO: 360203 - RNA, 25 nt, Human
agucggcggcucggggggcgcgcuc

SEQ ID NO: 360204 - RNA, 21 nt, Human
cacgaagcuccgaaccccaac

SEQ ID NO: 360205 - RNA, 19 nt, Human
caggacacagaguacaaga

SEQ ID NO: 360206 - RNA, 23 nt, Human
ccaaacaagaaccaacauagaca

SEQ ID NO: 360207 - RNA, 18 nt, Human
cccaaacaagaaccaaca

SEQ ID NO: 360208 - RNA, 18 nt, Human
ccccaacggcccgcgcgc

SEQ ID NO: 360209 - RNA, 25 nt, Human
cccccuacuccgguaaagcgagggc

SEQ ID NO: 360210 - RNA, 21 nt, Human
ccccuggacaccgccacucca

SEQ ID NO: 360211 - RNA, 20 nt, Human
cccgcgcgcgcccucaccgg

SEQ ID NO: 360212 - RNA, 24 nt, Human
cccgcgcgcgcccucaccgggccg

SEQ ID NO: 360213 - RNA, 26 nt, Human
cccgcgcgcgcccucaccgggccgcg

SEQ ID NO: 360214 - RNA, 25 nt, Human
cccgggggccgcccggggcgccgcu

SEQ ID NO: 360215 - RNA, 24 nt, Human
cccuacccggcuguucuacccgcu

SEQ ID NO: 360216 - RNA, 22 nt, Human
cccucaccgggccgcgcggucc

SEQ ID NO: 360217 - RNA, 19 nt, Human
ccgcgggucccacgaagcu

SEQ ID NO: 360218 - RNA, 20 nt, Human
ccgcgggucccacgaagcuc

SEQ ID NO: 360219 - RNA, 25 nt, Human
ccuggacaccgccacuccacguccc

SEQ ID NO: 360220 - RNA, 19 nt, Human
ccugucuuuucucuccucu

SEQ ID NO: 360221 - RNA, 21 nt, Human
cggcucggggggcgcgcucag

SEQ ID NO: 360222 - RNA, 22 nt, Human
cgggagcgcuguagucacaguc

SEQ ID NO: 360223 - RNA, 19 nt, Human
cgggaggaagagcgcggug

SEQ ID NO: 360224 - RNA, 23 nt, Human
cgggaggaagagcgcgguguggc

SEQ ID NO: 360225 - RNA, 19 nt, Human
cgggccgagacgcgggcgg

SEQ ID NO: 360226 - RNA, 21 nt, Human
cgggggccgcccggggcgccg

SEQ ID NO: 360227 - RNA, 22 nt, Human
cguccgggccgagacgcgggcg

SEQ ID NO: 360228 - RNA, 20 nt, Human
cuaucugcccuacccggcug

SEQ ID NO: 360229 - RNA, 19 nt, Human
cuccgaaccccaacggccc

SEQ ID NO: 360230 - RNA, 20 nt, Human
cugcagcucccacugaccca

SEQ ID NO: 360231 - RNA, 20 nt, Human
cugcagcucccacugaccca

SEQ ID NO: 360232 - RNA, 20 nt, Human
gaaaaggcaagacaagagag

SEQ ID NO: 360233 - RNA, 23 nt, Human
gaaccccaacggcccgcgcgccu

SEQ ID NO: 360234 - RNA, 22 nt, Human
gaagaacauucacaugagggca

SEQ ID NO: 360235 - RNA, 21 nt, Human
gaagaggaaagggggaaaagg

SEQ ID NO: 360236 - RNA, 23 nt, Human
gacaccugcagcucccacugacc

SEQ ID NO: 360237 - RNA, 24 nt, Human
gagaaagacagaaagcagaaaaaa

SEQ ID NO: 360238 - RNA, 25 nt, Human
gagaaagacagggguacauacggag

SEQ ID NO: 360239 - RNA, 20 nt, Human
gcacuggcccccggugagcc

SEQ ID NO: 360240 - RNA, 22 nt, Human
gcccaagcccucgcccaagccc

SEQ ID NO: 360241 - RNA, 21 nt, Human
gcgcucagccgggagcgcugu

SEQ ID NO: 360242 - RNA, 23 nt, Human
gcgcugcccuuucucucucacuu

SEQ ID NO: 360243 - RNA, 25 nt, Human
ggaagggaaaggaagaggaaagggg

SEQ ID NO: 360244 - RNA, 25 nt, Human
ggaccaggacacagaguacaagaga

SEQ ID NO: 360245 - RNA, 18 nt, Human
ggagagagagaaugacag

SEQ ID NO: 360246 - RNA, 20 nt, Human
ggcaagucggcggcucgggg

SEQ ID NO: 360247 - RNA, 22 nt, Human
ggcagauagaccaccagucagg

SEQ ID NO: 360248 - RNA, 24 nt, Human
gggccguccgggccgagacgcggg

SEQ ID NO: 360249 - RNA, 19 nt, Human
ggggccgcaggggcggggc

SEQ ID NO: 360250 - RNA, 19 nt, Human
ggggccgcaggggcggggc

SEQ ID NO: 360251 - RNA, 23 nt, Human
uaaaauaaaagcagaaauauuuc

SEQ ID NO: 360252 - RNA, 18 nt, Human
uaaaucccaaacaagaag

SEQ ID NO: 360253 - RNA, 21 nt, Human
uaacuuguugaaaauaaaucc

SEQ ID NO: 360254 - RNA, 23 nt, Human
uacaaggagagggagaaagacag

SEQ ID NO: 360255 - RNA, 19 nt, Human
uaccugguggggccgcagg

SEQ ID NO: 360256 - RNA, 23 nt, Human
uaccugguggggccgcaggggcg

SEQ ID NO: 360257 - RNA, 22 nt, Human
uacuagacgaaaagcugacacc

SEQ ID NO: 360258 - RNA, 18 nt, Human
uagacgaaaagcugacac

SEQ ID NO: 360259 - RNA, 19 nt, Human
ucacugccguacguccccg

SEQ ID NO: 360260 - RNA, 20 nt, Human
ucaggaggagaaagacaggg

SEQ ID NO: 360261 - RNA, 23 nt, Human
ucaguaccugguggggccgcagg

SEQ ID NO: 360262 - RNA, 24 nt, Human
ucaguaccugguggggccgcaggg

SEQ ID NO: 360263 - RNA, 19 nt, Human
ucagucuccagccccaaaa

SEQ ID NO: 360264 - RNA, 25 nt, Human
uccccgcgccggccgcgggucccac

SEQ ID NO: 360265 - RNA, 24 nt, Human
uccgggccgagacgcgggcggggc

SEQ ID NO: 360266 - RNA, 23 nt, Human
ucucccacccccuacuccgguaa

SEQ ID NO: 360267 - RNA, 18 nt, Human
ucuccucuucccucuccc

SEQ ID NO: 360268 - RNA, 18 nt, Human
ucucuccucuucccucuc

SEQ ID NO: 360269 - RNA, 24 nt, Human
ugaaaauaaaucccaaacaagaac

SEQ ID NO: 360270 - RNA, 18 nt, Human
ugccggcugcguccccgc

SEQ ID NO: 360271 - RNA, 18 nt, Human
uggcccccggugagcccc

SEQ ID NO: 360272 - RNA, 20 nt, Human
uggcccccuggcccggcacu

SEQ ID NO: 360273 - RNA, 23 nt, Human
uggcccggcacuggcccccgguc

SEQ ID NO: 360274 - RNA, 19 nt, Human
ugggagcuuccucgccggg

SEQ ID NO: 360275 - RNA, 19 nt, Human
ugggcgagggaaaaggccu

SEQ ID NO: 360276 - RNA, 18 nt, Human
ugguggggccgcaggggc

SEQ ID NO: 360277 - RNA, 26 nt, Human
uuucucuccucuucccucucccaccc

SEQ ID NO: 360278 - RNA, 21 nt, Human
uuuuuuuuuuuuuuuuuauuu

SEQ ID NO: 360279 - RNA, 20 nt, Human
aagagagaggggaggaagag

SEQ ID NO: 360280 - RNA, 24 nt, Human
aaggaggggggagcaggaggagga

SEQ ID NO: 360281 - RNA, 19 nt, Human
acaacagccucauaauauc

SEQ ID NO: 360282 - RNA, 19 nt, Human
acacacacacacccgcgca

SEQ ID NO: 360283 - RNA, 19 nt, Human
acacauccacacacacaca

SEQ ID NO: 360284 - RNA, 20 nt, Human
agaaggaaaggaggggggag

SEQ ID NO: 360285 - RNA, 23 nt, Human
agaaggaaaggaggggggagcag

SEQ ID NO: 360286 - RNA, 25 nt, Human
agaaggaaaggaggggggagcagga

SEQ ID NO: 360287 - RNA, 22 nt, Human
agaaggaagaggaggaagagga

SEQ ID NO: 360288 - RNA, 19 nt, Human
agagagggagguaggagag

SEQ ID NO: 360289 - RNA, 20 nt, Human
agagagggagguaggagagc

SEQ ID NO: 360290 - RNA, 18 nt, Human
agagaggggaggaagagg

SEQ ID NO: 360291 - RNA, 19 nt, Human
agagaggggaggaagagga

SEQ ID NO: 360292 - RNA, 18 nt, Human
agaggaggaagaggagga

SEQ ID NO: 360293 - RNA, 22 nt, Human
agaggaggaagaggaggagggc

SEQ ID NO: 360294 - RNA, 22 nt, Human
agaggaggagggcuaggaggcg

SEQ ID NO: 360295 - RNA, 25 nt, Human
agagggagagaggagagggagagcc

SEQ ID NO: 360296 - RNA, 18 nt, Human
agagggaggagggcggcc

SEQ ID NO: 360297 - RNA, 20 nt, Human
agaggggggaggaggagaag

SEQ ID NO: 360298 - RNA, 19 nt, Human
aggaaaggaggggggagca

SEQ ID NO: 360299 - RNA, 21 nt, Human
aggaagagagaggggaggaag

SEQ ID NO: 360300 - RNA, 18 nt, Human
aggaagaggaggaagagg

SEQ ID NO: 360301 - RNA, 19 nt, Human
aggaagaggaggaagagga

SEQ ID NO: 360302 - RNA, 24 nt, Human
aggaggaagaggaggagggcuagg

SEQ ID NO: 360303 - RNA, 22 nt, Human
aggaggagaaggaaaggagggg

SEQ ID NO: 360304 - RNA, 19 nt, Human
aggaggagaaggaagagga

SEQ ID NO: 360305 - RNA, 18 nt, Human
aggaggaggagggagagg

SEQ ID NO: 360306 - RNA, 19 nt, Human
aggaggagggagaggagga

SEQ ID NO: 360307 - RNA, 22 nt, Human
aggagggagaggagagggggga

SEQ ID NO: 360308 - RNA, 22 nt, Human
aggcggaggggaaggagugggg

SEQ ID NO: 360309 - RNA, 24 nt, Human
agggagaggaggaagggcguaagg

SEQ ID NO: 360310 - RNA, 20 nt, Human
aggggggagcaggaggagga

SEQ ID NO: 360311 - RNA, 24 nt, Human
auccacacacacacacacccgcgc

SEQ ID NO: 360312 - RNA, 19 nt, Human
aucuuuguauagucgacuc

SEQ ID NO: 360313 - RNA, 20 nt, Human
augcagguggggugccgggu

SEQ ID NO: 360314 - RNA, 26 nt, Human
cacacacacacacacccgcgcagcca

SEQ ID NO: 360315 - RNA, 25 nt, Human
cacacacacacacccgcgcagccac

SEQ ID NO: 360316 - RNA, 19 nt, Human
cacccacaccccacacaca

SEQ ID NO: 360317 - RNA, 23 nt, Human
cacccacaccccacacacaucca

SEQ ID NO: 360318 - RNA, 20 nt, Human
caccccacacacauccacac

SEQ ID NO: 360319 - RNA, 26 nt, Human
caccgcaaucgcccuaaugacaacag

SEQ ID NO: 360320 - RNA, 29 nt, Human
cagggagaggaagagagaggggaggaagg

SEQ ID NO: 360321 - RNA, 20 nt, Human
cauccacacacacacacacc

SEQ ID NO: 360322 - RNA, 21 nt, Human
cauugcccucuuguccucgug

SEQ ID NO: 360323 - RNA, 21 nt, Human
ccacacacauccacacacaca

SEQ ID NO: 360324 - RNA, 28 nt, Human
ccacacacauccacacacacacacaccc

SEQ ID NO: 360325 - RNA, 27 nt, Human
ccacaccccacacacauccacacacac

SEQ ID NO: 360326 - RNA, 24 nt, Human
cccacacacauccacacacacaca

SEQ ID NO: 360327 - RNA, 26 nt, Human
cccacacacauccacacacacacaca

SEQ ID NO: 360328 - RNA, 22 nt, Human
cccagauacaaauaaaucguca

SEQ ID NO: 360329 - RNA, 23 nt, Human
ccuagaaaguauacaauugucac

SEQ ID NO: 360330 - RNA, 21 nt, Human
ccuuugggguggccguagugg

SEQ ID NO: 360331 - RNA, 18 nt, Human
cggaacggagacggcgac

SEQ ID NO: 360332 - RNA, 21 nt, Human
cggcccggugcgcgcgcgcag

SEQ ID NO: 360333 - RNA, 18 nt, Human
gagaaggaagaggaggaa

SEQ ID NO: 360334 - RNA, 20 nt, Human
gagagggagagaggagaggg

SEQ ID NO: 360335 - RNA, 19 nt, Human
gagagggaggagggcggcc

SEQ ID NO: 360336 - RNA, 19 nt, Human
gaggaagaggaggagggcu

SEQ ID NO: 360337 - RNA, 18 nt, Human
gaggagggagaggagagg

SEQ ID NO: 360338 - RNA, 21 nt, Human
gaggagggagaggaggaaggg

SEQ ID NO: 360339 - RNA, 18 nt, Human
gaggaggggaaggagagg

SEQ ID NO: 360340 - RNA, 19 nt, Human
gagggagaggaggaagggc

SEQ ID NO: 360341 - RNA, 18 nt, Human
gaggggaaggagagggag

SEQ ID NO: 360342 - RNA, 18 nt, Human
gagguaggagagcggccc

SEQ ID NO: 360343 - RNA, 20 nt, Human
gcagagagagaacccgagac

SEQ ID NO: 360344 - RNA, 19 nt, Human
ggaaaggaggggggagcag

SEQ ID NO: 360345 - RNA, 23 nt, Human
ggaaaggaggggggagcaggagg

SEQ ID NO: 360346 - RNA, 18 nt, Human
ggaaggagagggaggagg

SEQ ID NO: 360347 - RNA, 20 nt, Human
ggagaaaauucagggagagg

SEQ ID NO: 360348 - RNA, 18 nt, Human
ggagaaggaaaggagggg

SEQ ID NO: 360349 - RNA, 18 nt, Human
ggagaaggaagaggagga

SEQ ID NO: 360350 - RNA, 21 nt, Human
ggagagccaaccaccgccgag

SEQ ID NO: 360351 - RNA, 24 nt, Human
ggagaggaagagagaggggaggaa

SEQ ID NO: 360352 - RNA, 24 nt, Human
ggagaggaagagagaggggaggaa

SEQ ID NO: 360353 - RNA, 22 nt, Human
ggagaggagaggggggaggaga

SEQ ID NO: 360354 - RNA, 24 nt, Human
ggagaggagaggggggaggaggaa

SEQ ID NO: 360355 - RNA, 21 nt, Human
ggagagggagagaggagaggg

SEQ ID NO: 360356 - RNA, 23 nt, Human
ggagagggaggagggcggccuug

SEQ ID NO: 360357 - RNA, 25 nt, Human
ggagaggggggaggaggagaaggaa

SEQ ID NO: 360358 - RNA, 21 nt, Human
ggaggaggagggagaggagga

SEQ ID NO: 360359 - RNA, 20 nt, Human
ggaggagggagaggagaggg

SEQ ID NO: 360360 - RNA, 30 nt, Human
ggaggggaaggagugggggaggaggggaaa

SEQ ID NO: 360361 - RNA, 21 nt, Human
ggaggggggagcaggaggagg

SEQ ID NO: 360362 - RNA, 24 nt, Human
ggcgaugaggaccaggaggaggga

SEQ ID NO: 360363 - RNA, 20 nt, Human
gggaaggagagggaggaggg

SEQ ID NO: 360364 - RNA, 20 nt, Human
gggagaggagaggggggagg

SEQ ID NO: 360365 - RNA, 20 nt, Human
gggaggaggggaaggagagg

SEQ ID NO: 360366 - RNA, 20 nt, Human
ggggaaggagagggaggagg

SEQ ID NO: 360367 - RNA, 23 nt, Human
ggggaggaggagaaggaaaggag

SEQ ID NO: 360368 - RNA, 18 nt, Human
ggggaggaggggaaggag

SEQ ID NO: 360369 - RNA, 22 nt, Human
ggggaggaggggaaggagaggg

SEQ ID NO: 360370 - RNA, 23 nt, Human
gggggagcaggaggaggagggag

SEQ ID NO: 360371 - RNA, 28 nt, Human
gggggaggaggagaaggaaaggaggggg

SEQ ID NO: 360372 - RNA, 23 nt, Human
gggggaggaggggaaggagaggg

SEQ ID NO: 360373 - RNA, 24 nt, Human
gucaugcagguggggugccggguc

SEQ ID NO: 360374 - RNA, 19 nt, Human
gugguggugauugaucuuu

SEQ ID NO: 360375 - RNA, 20 nt, Human
guguguguggacuuguaugu

SEQ ID NO: 360376 - RNA, 19 nt, Human
guuuuuuauauauuuuugg

SEQ ID NO: 360377 - RNA, 24 nt, Human
uaacuagagagaauauuuucccag

SEQ ID NO: 360378 - RNA, 27 nt, Human
uaagggacacccacaccccacacacau

SEQ ID NO: 360379 - RNA, 19 nt, Human
uaaugacaacagccucaua

SEQ ID NO: 360380 - RNA, 19 nt, Human
uccacacacacacacaccc

SEQ ID NO: 360381 - RNA, 30 nt, Human
uccacacacacacacacccgcgcagccaca

SEQ ID NO: 360382 - RNA, 20 nt, Human
ucuguucaugcucauugccc

SEQ ID NO: 360383 - RNA, 22 nt, Human
ugauaguuugcgguuaauuugu

SEQ ID NO: 360384 - RNA, 23 nt, Human
ugauuucgguuuguucugggggg

SEQ ID NO: 360385 - RNA, 24 nt, Human
ugcucauugcccucuuguccucgu

SEQ ID NO: 360386 - RNA, 19 nt, Human
uggcuggggugggagugug

SEQ ID NO: 360387 - RNA, 21 nt, Human
ugggaguguguguggacuugu

SEQ ID NO: 360388 - RNA, 21 nt, Human
uggggauggaggaggagaagg

SEQ ID NO: 360389 - RNA, 19 nt, Human
ugggggaggaggggaagga

SEQ ID NO: 360390 - RNA, 19 nt, Human
ugguagauggugguugggg

SEQ ID NO: 360391 - RNA, 22 nt, Human
uggugguuggggguuguugaua

SEQ ID NO: 360392 - RNA, 20 nt, Human
uguguggacuuguaugugug

SEQ ID NO: 360393 - RNA, 24 nt, Human
uucccagauacaaauaaaucguca

SEQ ID NO: 360394 - RNA, 23 nt, Human
uuggcuggggugggagugugugu

SEQ ID NO: 360395 - RNA, 24 nt, Human
uuuuuggcuggggugggagugugu

SEQ ID NO: 360396 - RNA, 20 nt, Human
aaacggcaacccgagcccgc

SEQ ID NO: 360397 - RNA, 20 nt, Human
aacccgagcccgcggguccc

SEQ ID NO: 360398 - RNA, 23 nt, Human
aagcaagaagaacguggugcugg

SEQ ID NO: 360399 - RNA, 19 nt, Human
acagaacccaucaccacca

SEQ ID NO: 360400 - RNA, 25 nt, Human
agcccggagcgggacacgcagcagg

SEQ ID NO: 360401 - RNA, 20 nt, Human
aggaaaaagcaaagcaagaa

SEQ ID NO: 360402 - RNA, 22 nt, Human
aggaaaaagcaaagcaagaaga

SEQ ID NO: 360403 - RNA, 23 nt, Human
cacacagaacccaucaccaccag

SEQ ID NO: 360404 - RNA, 20 nt, Human
cacagaacccaucaccacca

SEQ ID NO: 360405 - RNA, 29 nt, Human
caucuucuuccccucuuucauuuuguuuu

SEQ ID NO: 360406 - RNA, 21 nt, Human
ccaaagggcgccagugaagcc

SEQ ID NO: 360407 - RNA, 24 nt, Human
cccaagcuacagagaaaccuacca

SEQ ID NO: 360408 - RNA, 22 nt, Human
cccguggucgcggccaaagggc

SEQ ID NO: 360409 - RNA, 25 nt, Human
ccgagcccgcgggucccuggucacc

SEQ ID NO: 360410 - RNA, 21 nt, Human
ccguggucgcggccaaagggc

SEQ ID NO: 360411 - RNA, 22 nt, Human
cgagggcacugagcccggagcg

SEQ ID NO: 360412 - RNA, 22 nt, Human
cgccagugaagccaggccggcc

SEQ ID NO: 360413 - RNA, 18 nt, Human
cuccacacagaacccauc

SEQ ID NO: 360414 - RNA, 21 nt, Human
cuccacacagaacccaucacc

SEQ ID NO: 360415 - RNA, 24 nt, Human
cucucaucuucuuccccucuuuca

SEQ ID NO: 360416 - RNA, 20 nt, Human
cuuccccucuuucauuuugu

SEQ ID NO: 360417 - RNA, 19 nt, Human
gggucccuggucaccuggc

SEQ ID NO: 360418 - RNA, 21 nt, Human
gugccggcggcggcgagggca

SEQ ID NO: 360419 - RNA, 20 nt, Human
uaauuaagaagguugcccac

SEQ ID NO: 360420 - RNA, 18 nt, Human
ucaccuggcuucucuggc

SEQ ID NO: 360421 - RNA, 22 nt, Human
uccccaagcuacagagaaaccu

SEQ ID NO: 360422 - RNA, 21 nt, Human
ucucaucuucuuccccucuuu

SEQ ID NO: 360423 - RNA, 25 nt, Human
ucucaucuucuuccccucuuucauu

SEQ ID NO: 360424 - RNA, 25 nt, Human
ucucucaucuucuuccccucuuuca

SEQ ID NO: 360425 - RNA, 23 nt, Human
ugcugggucaggccucaccgcug

SEQ ID NO: 360426 - RNA, 18 nt, Human
uucauuuuguuuuucucg

SEQ ID NO: 360427 - RNA, 20 nt, Human
aagacagauaucuugggggu

SEQ ID NO: 360428 - RNA, 18 nt, Human
aagcagaggaccagcagg

SEQ ID NO: 360429 - RNA, 18 nt, Human
agaaaaaccccugcuguc

SEQ ID NO: 360430 - RNA, 19 nt, Human
agaauguuccagcaagcag

SEQ ID NO: 360431 - RNA, 21 nt, Human
agaccuggguccuugucgcug

SEQ ID NO: 360432 - RNA, 23 nt, Human
agaugcuggaaggcacagaacga

SEQ ID NO: 360433 - RNA, 24 nt, Human
agcugcaccgcccagccgcgcccc

SEQ ID NO: 360434 - RNA, 22 nt, Human
aggcggcacgugugcccggagg

SEQ ID NO: 360435 - RNA, 22 nt, Human
augaacgaacaaaaaaaaagaa

SEQ ID NO: 360436 - RNA, 22 nt, Human
augcugcagccucagucccaaa

SEQ ID NO: 360437 - RNA, 23 nt, Human
cacccccacuccguugcgggucu

SEQ ID NO: 360438 - RNA, 21 nt, Human
caccgcccagccgcgcccccc

SEQ ID NO: 360439 - RNA, 22 nt, Human
cacugucccugcucucccuggc

SEQ ID NO: 360440 - RNA, 19 nt, Human
cagcagcaggaagaccugg

SEQ ID NO: 360441 - RNA, 24 nt, Human
cagucccaaaaugaagggagcgac

SEQ ID NO: 360442 - RNA, 23 nt, Human
ccagccgcgccccccugcacccg

SEQ ID NO: 360443 - RNA, 24 nt, Human
cccccccggcccccgccgccgccc

SEQ ID NO: 360444 - RNA, 19 nt, Human
cccccccggcccccgccuc

SEQ ID NO: 360445 - RNA, 22 nt, Human
cccccggcccccgccgccgccc

SEQ ID NO: 360446 - RNA, 21 nt, Human
ccccggcccccgccgccgccc

SEQ ID NO: 360447 - RNA, 24 nt, Human
ccccugcuguccucacgcagccgc

SEQ ID NO: 360448 - RNA, 25 nt, Human
cccggucaggcggcacgugugcccg

SEQ ID NO: 360449 - RNA, 22 nt, Human
cccugcuguccucacgcagccg

SEQ ID NO: 360450 - RNA, 23 nt, Human
ccgccagccacggucaccacccg

SEQ ID NO: 360451 - RNA, 19 nt, Human
ccgcgcgcccgggcccccc

SEQ ID NO: 360452 - RNA, 22 nt, Human
cgaacaaaaaaaaagaaagaaa

SEQ ID NO: 360453 - RNA, 18 nt, Human
cgcccgggcccccccggc

SEQ ID NO: 360454 - RNA, 19 nt, Human
cggcggcgcugcggcggca

SEQ ID NO: 360455 - RNA, 23 nt, Human
cggcuuacucacuugaacuuggc

SEQ ID NO: 360456 - RNA, 19 nt, Human
cucagucccaaaaugaagg

SEQ ID NO: 360457 - RNA, 20 nt, Human
cucagucccaaaaugaaggg

SEQ ID NO: 360458 - RNA, 24 nt, Human
cuggaaggcacagaacgacccccg

SEQ ID NO: 360459 - RNA, 18 nt, Human
gcccgggcccccccggcc

SEQ ID NO: 360460 - RNA, 19 nt, Human
gcccgggcccccccggccc

SEQ ID NO: 360461 - RNA, 21 nt, Human
gcggcaguaaggcgggcagug

SEQ ID NO: 360462 - RNA, 21 nt, Human
gcgggcgggguaggcggcagu

SEQ ID NO: 360463 - RNA, 23 nt, Human
gcugagggcgugaccgccagcca

SEQ ID NO: 360464 - RNA, 19 nt, Human
gcuggcaucgacggcggcg

SEQ ID NO: 360465 - RNA, 20 nt, Human
ggaccagcaggccgccgagc

SEQ ID NO: 360466 - RNA, 25 nt, Human
ggcaguguucgagcucauggcagcc

SEQ ID NO: 360467 - RNA, 18 nt, Human
ggggaauagaaagagaag

SEQ ID NO: 360468 - RNA, 18 nt, Human
ggggcggagccgggcgga

SEQ ID NO: 360469 - RNA, 25 nt, Human
ggguaggcggcaguaaggcgggcaa

SEQ ID NO: 360470 - RNA, 23 nt, Human
guggcgggcgggguaggcggcag

SEQ ID NO: 360471 - RNA, 23 nt, Human
uaaaaaccucaguucacugggga

SEQ ID NO: 360472 - RNA, 25 nt, Human
uaaaaaccucaguucacuggggaau

SEQ ID NO: 360473 - RNA, 20 nt, Human
uaaggcgggcaguguucgag

SEQ ID NO: 360474 - RNA, 21 nt, Human
uacaagaugcuggaaggcaca

SEQ ID NO: 360475 - RNA, 21 nt, Human
uagaaaauuuugcaguggguu

SEQ ID NO: 360476 - RNA, 27 nt, Human
uaggcggcaguaaggcgggcaguguuc

SEQ ID NO: 360477 - RNA, 18 nt, Human
ucagucccaaaaugaagg

SEQ ID NO: 360478 - RNA, 19 nt, Human
ucagucccaaaaugaaggg

SEQ ID NO: 360479 - RNA, 18 nt, Human
ucccaaaaugaagggagc

SEQ ID NO: 360480 - RNA, 22 nt, Human
uccccggguggggagggugggg

SEQ ID NO: 360481 - RNA, 23 nt, Human
uccccucagcuccggggcagcuc

SEQ ID NO: 360482 - RNA, 25 nt, Human
uccccucagcuccggggcagcuccc

SEQ ID NO: 360483 - RNA, 22 nt, Human
ucccgcgcgcccgggccccccc

SEQ ID NO: 360484 - RNA, 19 nt, Human
ucgugguggaggagcgugg

SEQ ID NO: 360485 - RNA, 19 nt, Human
ucuuggggguaaaaagaca

SEQ ID NO: 360486 - RNA, 26 nt, Human
ucuuuuguuccaaugcugcagccuca

SEQ ID NO: 360487 - RNA, 21 nt, Human
ugaaaagggucgcccggucag

SEQ ID NO: 360488 - RNA, 21 nt, Human
ugaagacagauaucuuggggg

SEQ ID NO: 360489 - RNA, 20 nt, Human
ugagcugugauggcuucccc

SEQ ID NO: 360490 - RNA, 20 nt, Human
ugcagaggagccgaagaccg

SEQ ID NO: 360491 - RNA, 18 nt, Human
ugcccggagggcugaggg

SEQ ID NO: 360492 - RNA, 19 nt, Human
ugcggcggcaggcacggaa

SEQ ID NO: 360493 - RNA, 21 nt, Human
uggcagcagcaggaagaccug

SEQ ID NO: 360494 - RNA, 18 nt, Human
ugggggacgcggcuuacu

SEQ ID NO: 360495 - RNA, 28 nt, Human
ugucgcugaaaaaauagacucugaagaa

SEQ ID NO: 360496 - RNA, 19 nt, Human
ugugcugugugggcugcag

SEQ ID NO: 360497 - RNA, 18 nt, Human
ugugugggcugcaggggc

SEQ ID NO: 360498 - RNA, 26 nt, Human
uguguugauuuucugaauuucaaguc

SEQ ID NO: 360499 - RNA, 22 nt, Human
accuggaccgguggaaggccgg

SEQ ID NO: 360500 - RNA, 24 nt, Human
agccacagcagcugccuggcagcc

SEQ ID NO: 360501 - RNA, 19 nt, Human
caacuuccgguacagcccc

SEQ ID NO: 360502 - RNA, 19 nt, Human
cagcccggaagugcggcaa

SEQ ID NO: 360503 - RNA, 22 nt, Human
ccccggaacgggcggaaguaga

SEQ ID NO: 360504 - RNA, 20 nt, Human
cccucggguaaggcccucug

SEQ ID NO: 360505 - RNA, 20 nt, Human
cccucugcuucucacucuuc

SEQ ID NO: 360506 - RNA, 21 nt, Human
cggccggagaccguggggccc

SEQ ID NO: 360507 - RNA, 23 nt, Human
gccgcccccucggguaaggcccu

SEQ ID NO: 360508 - RNA, 19 nt, Human
gccguuucucuguucuucc

SEQ ID NO: 360509 - RNA, 20 nt, Human
gccuggggccgccuugguua

SEQ ID NO: 360510 - RNA, 21 nt, Human
gcgcggccggagaccgugggg

SEQ ID NO: 360511 - RNA, 18 nt, Human
gcgcgggcgcggccggag

SEQ ID NO: 360512 - RNA, 18 nt, Human
gcggccagcgcgggcgcg

SEQ ID NO: 360513 - RNA, 22 nt, Human
gcugcggaggggcagaccugga

SEQ ID NO: 360514 - RNA, 19 nt, Human
ggcggaaguagaggcaacu

SEQ ID NO: 360515 - RNA, 21 nt, Human
gggcagaccuggaccggugga

SEQ ID NO: 360516 - RNA, 18 nt, Human
ggggcccccgguugccgc

SEQ ID NO: 360517 - RNA, 21 nt, Human
guagaggcaacuuccgguaca

SEQ ID NO: 360518 - RNA, 20 nt, Human
gucaucguugugagcccgcu

SEQ ID NO: 360519 - RNA, 25 nt, Human
gugagcccgcuaucagcggccagcg

SEQ ID NO: 360520 - RNA, 18 nt, Human
ucuuugcguugcucugcg

SEQ ID NO: 360521 - RNA, 18 nt, Human
ugagcccgcuaucagcgg

SEQ ID NO: 360522 - RNA, 18 nt, Human
uggagccacagcagcugc

SEQ ID NO: 360523 - RNA, 24 nt, Human
uuucucauagccguuucucuguuc

SEQ ID NO: 360524 - RNA, 21 nt, Human
uuuuuuuuuuugugcuuugcu

SEQ ID NO: 360525 - RNA, 18 nt, Human
uuuuuuuuuuuuuuuuug

SEQ ID NO: 360526 - RNA, 23 nt, Human
uuuuuuuuuuuuuuuuugugcuu

SEQ ID NO: 360527 - RNA, 25 nt, Human
agaauaaaacuagcuaaguacucca

SEQ ID NO: 360528 - RNA, 19 nt, Human
agccagacccgcuaagccu

SEQ ID NO: 360529 - RNA, 19 nt, Human
agccagacccgcuaagccu

SEQ ID NO: 360530 - RNA, 19 nt, Human
aggcaaagggaaaaccaag

SEQ ID NO: 360531 - RNA, 18 nt, Human
cagccagacccgcuaagc

SEQ ID NO: 360532 - RNA, 18 nt, Human
cagccagacccgcuaagc

SEQ ID NO: 360533 - RNA, 19 nt, Human
cccccagcagccagacccg

SEQ ID NO: 360534 - RNA, 19 nt, Human
cccccagcagccagacccg

SEQ ID NO: 360535 - RNA, 18 nt, Human
cgcaaggcucuacagccc

SEQ ID NO: 360536 - RNA, 20 nt, Human
cuaaagaagagacaccaucc

SEQ ID NO: 360537 - RNA, 21 nt, Human
cucgggcccccagcagccaga

SEQ ID NO: 360538 - RNA, 21 nt, Human
cucgggcccccagcagccaga

SEQ ID NO: 360539 - RNA, 19 nt, Human
gcagagcugcucgccuccc

SEQ ID NO: 360540 - RNA, 21 nt, Human
gcgcaaggcucuacagcccgg

SEQ ID NO: 360541 - RNA, 22 nt, Human
ggcgcgcggcggcuccgagcgu

SEQ ID NO: 360542 - RNA, 22 nt, Human
ggcgcgcggcggcuccgagcgu

SEQ ID NO: 360543 - RNA, 20 nt, Human
ggcuuccugccuauuuuccc

SEQ ID NO: 360544 - RNA, 22 nt, Human
gggcuuccugccuauuuucccu

SEQ ID NO: 360545 - RNA, 24 nt, Human
uaacugcagagcugcucgccuccc

SEQ ID NO: 360546 - RNA, 21 nt, Human
ugcagaaugaaggcaaaggga

SEQ ID NO: 360547 - RNA, 21 nt, Human
uuuuuaguuuaagcacucauu

SEQ ID NO: 360548 - RNA, 21 nt, Human
aaaaaucccucugggugcucc

SEQ ID NO: 360549 - RNA, 22 nt, Human
aaaaucccucugggugcucccc

SEQ ID NO: 360550 - RNA, 20 nt, Human
aaacccagaccuucugccag

SEQ ID NO: 360551 - RNA, 21 nt, Human
aaauacaugauuuagcaaagu

SEQ ID NO: 360552 - RNA, 21 nt, Human
aagccauggcugcagacauca

SEQ ID NO: 360553 - RNA, 22 nt, Human
acaacggaaaacaacacauaag

SEQ ID NO: 360554 - RNA, 19 nt, Human
acacauaccaguagcacga

SEQ ID NO: 360555 - RNA, 23 nt, Human
acucugaagagcagcuggaaaau

SEQ ID NO: 360556 - RNA, 23 nt, Human
agacagggagagauacugcaagc

SEQ ID NO: 360557 - RNA, 23 nt, Human
agagaggaaagcauaccagaagu

SEQ ID NO: 360558 - RNA, 22 nt, Human
agagcaguccuggugcccuuuc

SEQ ID NO: 360559 - RNA, 21 nt, Human
agcagcuggaaaaugagcucc

SEQ ID NO: 360560 - RNA, 21 nt, Human
agccauggcugcagacaucag

SEQ ID NO: 360561 - RNA, 22 nt, Human
auacugcaagcauguuccccuc

SEQ ID NO: 360562 - RNA, 20 nt, Human
aucuuuuuuuuuuuuuugga

SEQ ID NO: 360563 - RNA, 19 nt, Human
augcugggcuuuuccaagc

SEQ ID NO: 360564 - RNA, 24 nt, Human
auggcugcagacaucagggaagcu

SEQ ID NO: 360565 - RNA, 22 nt, Human
augugugcauacauacaugcug

SEQ ID NO: 360566 - RNA, 19 nt, Human
cagaggacuuaaugcaaug

SEQ ID NO: 360567 - RNA, 21 nt, Human
caggaucccuuugaaacaggg

SEQ ID NO: 360568 - RNA, 22 nt, Human
cagggcacccaucugcaaaccc

SEQ ID NO: 360569 - RNA, 20 nt, Human
caugacaucauuaauccacu

SEQ ID NO: 360570 - RNA, 24 nt, Human
cauucagggcacccaucugcaaac

SEQ ID NO: 360571 - RNA, 21 nt, Human
cccaaauguuccaaucacauu

SEQ ID NO: 360572 - RNA, 25 nt, Human
cccacacacacaaugugugcauaca

SEQ ID NO: 360573 - RNA, 21 nt, Human
ccccuccuuccccaggauccc

SEQ ID NO: 360574 - RNA, 18 nt, Human
cccucugcagaaccaggg

SEQ ID NO: 360575 - RNA, 20 nt, Human
cccucugcagaaccagggag

SEQ ID NO: 360576 - RNA, 19 nt, Human
ccucugcagaaccagggag

SEQ ID NO: 360577 - RNA, 25 nt, Human
cgcugcaaagccauggcugcagaca

SEQ ID NO: 360578 - RNA, 23 nt, Human
cgguuggggaaaccacagauguc

SEQ ID NO: 360579 - RNA, 22 nt, Human
cuauacauuguguuuucucccu

SEQ ID NO: 360580 - RNA, 20 nt, Human
cucauucuucuggcccucug

SEQ ID NO: 360581 - RNA, 18 nt, Human
cuggacagguccaguucc

SEQ ID NO: 360582 - RNA, 21 nt, Human
cuggacagguccaguuccuug

SEQ ID NO: 360583 - RNA, 21 nt, Human
gaaguucucuccaaugaccuu

SEQ ID NO: 360584 - RNA, 26 nt, Human
gagaagaugcgaauuugagucuccau

SEQ ID NO: 360585 - RNA, 19 nt, Human
gagagcaguccuggugccc

SEQ ID NO: 360586 - RNA, 22 nt, Human
gagaggaaagcauaccagaagu

SEQ ID NO: 360587 - RNA, 18 nt, Human
gcaguucuagucucgccu

SEQ ID NO: 360588 - RNA, 20 nt, Human
gcgggaagucaauguccaca

SEQ ID NO: 360589 - RNA, 21 nt, Human
ggaaagcauaccagaaguccc

SEQ ID NO: 360590 - RNA, 22 nt, Human
gggcugguuccuuugaaauagc

SEQ ID NO: 360591 - RNA, 19 nt, Human
ggguuaggacuuagcaucu

SEQ ID NO: 360592 - RNA, 18 nt, Human
guuuccucucccucucag

SEQ ID NO: 360593 - RNA, 24 nt, Human
uaccagaagucccuauggauuagu

SEQ ID NO: 360594 - RNA, 21 nt, Human
uagcaucuuuuuuuuuuuuuu

SEQ ID NO: 360595 - RNA, 23 nt, Human
uaggacuuagcaucuuuuuuuuu

SEQ ID NO: 360596 - RNA, 19 nt, Human
ucacaacggaaaacaacac

SEQ ID NO: 360597 - RNA, 23 nt, Human
ucagggcacccaucugcaaaccc

SEQ ID NO: 360598 - RNA, 20 nt, Human
uccauguggcuucucuuggc

SEQ ID NO: 360599 - RNA, 18 nt, Human
ucccagagaaguucuguu

SEQ ID NO: 360600 - RNA, 25 nt, Human
ucccaggcaauaguuggaacuucug

SEQ ID NO: 360601 - RNA, 19 nt, Human
ucccagggaucagggaacc

SEQ ID NO: 360602 - RNA, 21 nt, Human
ucccucugggugcuccccaaa

SEQ ID NO: 360603 - RNA, 20 nt, Human
uccucauauggaugccagac

SEQ ID NO: 360604 - RNA, 24 nt, Human
ucuccauguggcuucucuuggcuu

SEQ ID NO: 360605 - RNA, 23 nt, Human
ucugcaaacccagaccuucugcc

SEQ ID NO: 360606 - RNA, 19 nt, Human
ucugcagaaccagggaggc

SEQ ID NO: 360607 - RNA, 19 nt, Human
ucuuaaaauuaugcaugac

SEQ ID NO: 360608 - RNA, 22 nt, Human
ugaaacagggaaacaugaguca

SEQ ID NO: 360609 - RNA, 18 nt, Human
ugacaucauuaauccacu

SEQ ID NO: 360610 - RNA, 20 nt, Human
ugaggcucccagggaucagg

SEQ ID NO: 360611 - RNA, 23 nt, Human
ugagugucccucaccugucucua

SEQ ID NO: 360612 - RNA, 23 nt, Human
ugauccaauguuuugugaugcca

SEQ ID NO: 360613 - RNA, 25 nt, Human
ugcacauacacauaccaguagcacg

SEQ ID NO: 360614 - RNA, 19 nt, Human
ugcagaaccagggaggcca

SEQ ID NO: 360615 - RNA, 19 nt, Human
ugccaggacacagcuuuug

SEQ ID NO: 360616 - RNA, 19 nt, Human
uggagcugagcauuuuucc

SEQ ID NO: 360617 - RNA, 21 nt, Human
uggaguguaacugucuggaca

SEQ ID NO: 360618 - RNA, 18 nt, Human
ugucuccuuguauaaaca

SEQ ID NO: 360619 - RNA, 20 nt, Human
uguguaacugcacauacaca

SEQ ID NO: 360620 - RNA, 19 nt, Human
ugugugcauacauacaugc

SEQ ID NO: 360621 - RNA, 27 nt, Human
ugugugcauacauacaugcugggcuuu

SEQ ID NO: 360622 - RNA, 22 nt, Human
uuagcaaaguguaaugcuuccc

SEQ ID NO: 360623 - RNA, 23 nt, Human
uuccuggagcugagcauuuuucc

SEQ ID NO: 360624 - RNA, 18 nt, Human
uucuaaaaaauccagcua

SEQ ID NO: 360625 - RNA, 18 nt, Human
uugaaggcuaagaagucc

SEQ ID NO: 360626 - RNA, 19 nt, Human
uuuguuuccucucccucuc

SEQ ID NO: 360627 - RNA, 18 nt, Human
aaagccuuucccacccca

SEQ ID NO: 360628 - RNA, 21 nt, Human
aaagccuuucccaccccaccu

SEQ ID NO: 360629 - RNA, 21 nt, Human
aacagggcaagacuccgucuc

SEQ ID NO: 360630 - RNA, 24 nt, Human
aacagggcaagacuccgucucaaa

SEQ ID NO: 360631 - RNA, 21 nt, Human
aaccccaaacucaagaacuaa

SEQ ID NO: 360632 - RNA, 18 nt, Human
aauuagccaggcauggug

SEQ ID NO: 360633 - RNA, 24 nt, Human
aauuguuugaauccaggagaugga

SEQ ID NO: 360634 - RNA, 24 nt, Human
acagggcaagacuccgucucaaaa

SEQ ID NO: 360635 - RNA, 21 nt, Human
accccaaacucaagaacuaac

SEQ ID NO: 360636 - RNA, 19 nt, Human
accuuguggguggggccug

SEQ ID NO: 360637 - RNA, 25 nt, Human
agaggaaagagcaaggguacaggug

SEQ ID NO: 360638 - RNA, 24 nt, Human
agauggagguugcagugagcugag

SEQ ID NO: 360639 - RNA, 24 nt, Human
agcacuuugggaggccaagguggg

SEQ ID NO: 360640 - RNA, 23 nt, Human
agccaggcauggugguguacgcc

SEQ ID NO: 360641 - RNA, 19 nt, Human
agccuggccaaugugguga

SEQ ID NO: 360642 - RNA, 22 nt, Human
agccuggccaauguggugaaac

SEQ ID NO: 360643 - RNA, 24 nt, Human
agccuggccaauguggugaaaccc

SEQ ID NO: 360644 - RNA, 23 nt, Human
aggagauggagguugcagugagc

SEQ ID NO: 360645 - RNA, 22 nt, Human
aggaggcuuauucucuuuuugg

SEQ ID NO: 360646 - RNA, 18 nt, Human
aggcagcagggaaaucaa

SEQ ID NO: 360647 - RNA, 23 nt, Human
aggcaggagaauuguuugaaucc

SEQ ID NO: 360648 - RNA, 24 nt, Human
aggcaggagaauuguuugaaucca

SEQ ID NO: 360649 - RNA, 24 nt, Human
aggcauggugguguacgccuguaa

SEQ ID NO: 360650 - RNA, 21 nt, Human
aggccaagguggguggaucac

SEQ ID NO: 360651 - RNA, 21 nt, Human
aggcugaggcaggagaauugu

SEQ ID NO: 360652 - RNA, 24 nt, Human
aggcugaggcaggagaauuguuug

SEQ ID NO: 360653 - RNA, 21 nt, Human
aucaccugaggucaggaguuc

SEQ ID NO: 360654 - RNA, 24 nt, Human
aucauggcacuggaaggaaguagg

SEQ ID NO: 360655 - RNA, 24 nt, Human
auccaggagauggagguugcagug

SEQ ID NO: 360656 - RNA, 22 nt, Human
aucccagcacuuugggaggcca

SEQ ID NO: 360657 - RNA, 23 nt, Human
aucccucuuucuuccucucccug

SEQ ID NO: 360658 - RNA, 24 nt, Human
aucgugccauugcacuccagcaug

SEQ ID NO: 360659 - RNA, 22 nt, Human
auugggguucuaggugugcagc

SEQ ID NO: 360660 - RNA, 19 nt, Human
caacaggcagggcauccag

SEQ ID NO: 360661 - RNA, 21 nt, Human
caagacuccgucucaaaaaaa

SEQ ID NO: 360662 - RNA, 24 nt, Human
caagguggguggaucaccugaggu

SEQ ID NO: 360663 - RNA, 26 nt, Human
caagguggguggaucaccugagguca

SEQ ID NO: 360664 - RNA, 24 nt, Human
cacaccuguaaucccagcacuuug

SEQ ID NO: 360665 - RNA, 22 nt, Human
caccccaucccucuuucuuccu

SEQ ID NO: 360666 - RNA, 18 nt, Human
cacccucccucccugagu

SEQ ID NO: 360667 - RNA, 19 nt, Human
caccuguaaucccagcacu

SEQ ID NO: 360668 - RNA, 24 nt, Human
caccuguaaucccagcacuuuggg

SEQ ID NO: 360669 - RNA, 23 nt, Human
cacuccagcaugggcaacagggc

SEQ ID NO: 360670 - RNA, 24 nt, Human
cagcacuuugggaggccaaggugg

SEQ ID NO: 360671 - RNA, 21 nt, Human
cagcauggcuguaugugcgug

SEQ ID NO: 360672 - RNA, 18 nt, Human
cagcaugggcaacagggc

SEQ ID NO: 360673 - RNA, 18 nt, Human
cagggaaaucaagggcug

SEQ ID NO: 360674 - RNA, 18 nt, Human
cauugcacuccagcaugg

SEQ ID NO: 360675 - RNA, 19 nt, Human
cauugcacuccagcauggg

SEQ ID NO: 360676 - RNA, 21 nt, Human
cauugcacuccagcaugggca

SEQ ID NO: 360677 - RNA, 23 nt, Human
cauugcacuccagcaugggcaac

SEQ ID NO: 360678 - RNA, 24 nt, Human
cauugcacuccagcaugggcaaca

SEQ ID NO: 360679 - RNA, 22 nt, Human
cauuugaggaccuagacugucc

SEQ ID NO: 360680 - RNA, 23 nt, Human
ccaccccaucccucuuucuuccu

SEQ ID NO: 360681 - RNA, 19 nt, Human
ccaggaggcuuauucucuu

SEQ ID NO: 360682 - RNA, 24 nt, Human
ccaggcauggugguguacgccugu

SEQ ID NO: 360683 - RNA, 18 nt, Human
ccauugcacuccagcaug

SEQ ID NO: 360684 - RNA, 20 nt, Human
ccauugcacuccagcauggg

SEQ ID NO: 360685 - RNA, 21 nt, Human
ccauugcacuccagcaugggc

SEQ ID NO: 360686 - RNA, 24 nt, Human
ccauugcacuccagcaugggcaac

SEQ ID NO: 360687 - RNA, 19 nt, Human
cccucuuucuuccucuccc

SEQ ID NO: 360688 - RNA, 20 nt, Human
ccucacugcagugugcuaga

SEQ ID NO: 360689 - RNA, 22 nt, Human
ccucccaccccaucccucuuuc

SEQ ID NO: 360690 - RNA, 19 nt, Human
ccucuggauucagaugaaa

SEQ ID NO: 360691 - RNA, 22 nt, Human
ccucuggauucagaugaaacau

SEQ ID NO: 360692 - RNA, 23 nt, Human
ccuggccaauguggugaaacccc

SEQ ID NO: 360693 - RNA, 24 nt, Human
ccuggccaauguggugaaacccca

SEQ ID NO: 360694 - RNA, 23 nt, Human
ccuggcccuggucccaccuucuc

SEQ ID NO: 360695 - RNA, 19 nt, Human
ccuguaaucccagcuauuc

SEQ ID NO: 360696 - RNA, 22 nt, Human
ccuguaaucccagcuauucugg

SEQ ID NO: 360697 - RNA, 22 nt, Human
ccuugccucuggggugcccagg

SEQ ID NO: 360698 - RNA, 19 nt, Human
ccuuguggguggggccugg

SEQ ID NO: 360699 - RNA, 24 nt, Human
cgacaccagccuggccaauguggu

SEQ ID NO: 360700 - RNA, 24 nt, Human
cgccuguaaucccagcuauucugg

SEQ ID NO: 360701 - RNA, 22 nt, Human
cucaacaggcagggcauccaga

SEQ ID NO: 360702 - RNA, 22 nt, Human
cucacaccuguaaucccagcac

SEQ ID NO: 360703 - RNA, 24 nt, Human
cucacaccuguaaucccagcacuu

SEQ ID NO: 360704 - RNA, 22 nt, Human
cucugcacucgcacuagagguc

SEQ ID NO: 360705 - RNA, 18 nt, Human
cucugugucccacccucc

SEQ ID NO: 360706 - RNA, 21 nt, Human
cuggggcuguuguccucaaug

SEQ ID NO: 360707 - RNA, 20 nt, Human
gaccucuuucuguuuaugga

SEQ ID NO: 360708 - RNA, 23 nt, Human
gagaauuguuugaauccaggaga

SEQ ID NO: 360709 - RNA, 23 nt, Human
gagaucgugccauugcacuccag

SEQ ID NO: 360710 - RNA, 23 nt, Human
gagguugcagugagcugagaucg

SEQ ID NO: 360711 - RNA, 24 nt, Human
gaucaccugaggucaggaguucga

SEQ ID NO: 360712 - RNA, 23 nt, Human
gcagcagggaaaucaagggcugg

SEQ ID NO: 360713 - RNA, 18 nt, Human
gccaauguggugaaaccc

SEQ ID NO: 360714 - RNA, 18 nt, Human
gccacaagauggcaaggc

SEQ ID NO: 360715 - RNA, 24 nt, Human
gccauugcacuccagcaugggcaa

SEQ ID NO: 360716 - RNA, 21 nt, Human
gccugguuaaugguggggaug

SEQ ID NO: 360717 - RNA, 20 nt, Human
ggagguugcagugagcugag

SEQ ID NO: 360718 - RNA, 22 nt, Human
ggagguugcagugagcugagau

SEQ ID NO: 360719 - RNA, 23 nt, Human
ggagguugcagugagcugagauc

SEQ ID NO: 360720 - RNA, 24 nt, Human
ggagguugcagugagcugagaucg

SEQ ID NO: 360721 - RNA, 22 nt, Human
ggaucaccugaggucaggaguu

SEQ ID NO: 360722 - RNA, 18 nt, Human
ggauuugguguaggcugu

SEQ ID NO: 360723 - RNA, 21 nt, Human
ggcucacaccuguaaucccag

SEQ ID NO: 360724 - RNA, 24 nt, Human
gggugccguggcucacaccuguaa

SEQ ID NO: 360725 - RNA, 20 nt, Human
gguacuggaaaccccaaacu

SEQ ID NO: 360726 - RNA, 21 nt, Human
gguggaucaccugaggucagg

SEQ ID NO: 360727 - RNA, 24 nt, Human
ggugguguacgccuguaaucccag

SEQ ID NO: 360728 - RNA, 19 nt, Human
gucuuucucuuugcucugg

SEQ ID NO: 360729 - RNA, 23 nt, Human
gugguguacgccuguaaucccag

SEQ ID NO: 360730 - RNA, 24 nt, Human
guugcagugagcugagaucgugcc

SEQ ID NO: 360731 - RNA, 18 nt, Human
uaccuuguggguggggcc

SEQ ID NO: 360732 - RNA, 22 nt, Human
uaccuuguggguggggccuggu

SEQ ID NO: 360733 - RNA, 19 nt, Human
uacgccuguaaucccagcu

SEQ ID NO: 360734 - RNA, 21 nt, Human
uacuggaaaccccaaacucaa

SEQ ID NO: 360735 - RNA, 21 nt, Human
uagaauggggcucaacaggca

SEQ ID NO: 360736 - RNA, 24 nt, Human
uagcaccuucugaugccccugccc

SEQ ID NO: 360737 - RNA, 21 nt, Human
uaggagcacuggagggggugc

SEQ ID NO: 360738 - RNA, 22 nt, Human
ucaauggcauuucaagucuucu

SEQ ID NO: 360739 - RNA, 19 nt, Human
ucagaccccccaggaggcu

SEQ ID NO: 360740 - RNA, 20 nt, Human
uccagcaugggcaacagggc

SEQ ID NO: 360741 - RNA, 21 nt, Human
uccaggagauggagguugcag

SEQ ID NO: 360742 - RNA, 21 nt, Human
uccauagcacaguacaugcag

SEQ ID NO: 360743 - RNA, 25 nt, Human
ucccaccccaccuguagcuugggaa

SEQ ID NO: 360744 - RNA, 18 nt, Human
ucccugagugcacagccu

SEQ ID NO: 360745 - RNA, 23 nt, Human
ucccuuagcggauccagcagacc

SEQ ID NO: 360746 - RNA, 20 nt, Human
ucccuucuaggccacagucc

SEQ ID NO: 360747 - RNA, 22 nt, Human
uccgucucaaaaaaaagaaaaa

SEQ ID NO: 360748 - RNA, 22 nt, Human
uccgucucaaaaaaaagaaaaa

SEQ ID NO: 360749 - RNA, 20 nt, Human
ucuacuaaaaauacaaaaaa

SEQ ID NO: 360750 - RNA, 18 nt, Human
ucuccaucggguguagag

SEQ ID NO: 360751 - RNA, 22 nt, Human
ucuccaucggguguagaguuuu

SEQ ID NO: 360752 - RNA, 24 nt, Human
ugaggcaggagaauuguuugaauc

SEQ ID NO: 360753 - RNA, 25 nt, Human
ugaggcaggagaauuguuugaaucc

SEQ ID NO: 360754 - RNA, 21 nt, Human
ugaggugccuggccucacugc

SEQ ID NO: 360755 - RNA, 22 nt, Human
ugcacuccagcaugggcaacag

SEQ ID NO: 360756 - RNA, 20 nt, Human
ugcccaggaggcugaauugg

SEQ ID NO: 360757 - RNA, 18 nt, Human
ugccucccaccccauccc

SEQ ID NO: 360758 - RNA, 18 nt, Human
ugccuggccucacugcag

SEQ ID NO: 360759 - RNA, 21 nt, Human
ugcucuggaggucacauagag

SEQ ID NO: 360760 - RNA, 24 nt, Human
uggaacccuggcccuggucccacc

SEQ ID NO: 360761 - RNA, 24 nt, Human
uggaucaccugaggucaggaguuc

SEQ ID NO: 360762 - RNA, 25 nt, Human
uggaucaccugaggucaggaguucg

SEQ ID NO: 360763 - RNA, 24 nt, Human
uggcaaggccagugugcuagggaa

SEQ ID NO: 360764 - RNA, 25 nt, Human
uggccaauguggugaaaccccaugu

SEQ ID NO: 360765 - RNA, 21 nt, Human
uggcucacaccuguaauccca

SEQ ID NO: 360766 - RNA, 22 nt, Human
uggcucacaccuguaaucccag

SEQ ID NO: 360767 - RNA, 24 nt, Human
uggcucacaccuguaaucccagca

SEQ ID NO: 360768 - RNA, 23 nt, Human
ugggaggccaagguggguggauc

SEQ ID NO: 360769 - RNA, 24 nt, Human
ugggaggccaagguggguggauca

SEQ ID NO: 360770 - RNA, 25 nt, Human
uggggccugguuaaugguggggaug

SEQ ID NO: 360771 - RNA, 24 nt, Human
uggguggaucaccugaggucagga

SEQ ID NO: 360772 - RNA, 19 nt, Human
uggugaaaccccaugucua

SEQ ID NO: 360773 - RNA, 24 nt, Human
uggugguguacgccuguaauccca

SEQ ID NO: 360774 - RNA, 21 nt, Human
ugguguacgccuguaauccca

SEQ ID NO: 360775 - RNA, 22 nt, Human
ugguguacgccuguaaucccag

SEQ ID NO: 360776 - RNA, 23 nt, Human
ugucccacccucccucccugagu

SEQ ID NO: 360777 - RNA, 18 nt, Human
uguggguggggccugguu

SEQ ID NO: 360778 - RNA, 18 nt, Human
uugacucuagggguuguu

SEQ ID NO: 360779 - RNA, 21 nt, Human
uugcagugagcugagaucgug

SEQ ID NO: 360780 - RNA, 22 nt, Human
uugcagugagcugagaucgugc

SEQ ID NO: 360781 - RNA, 24 nt, Human
uuggccucuccuuugggaggacgc

SEQ ID NO: 360782 - RNA, 24 nt, Human
uuguuugaauccaggagauggagg

SEQ ID NO: 360783 - RNA, 18 nt, Human
uuugccaaguggagcugu

SEQ ID NO: 360784 - RNA, 26 nt, Human
uuuggccucuccuuugggaggacggc

SEQ ID NO: 360785 - RNA, 19 nt, Human
uuuuuuuuuuuuuugccaa

SEQ ID NO: 360786 - RNA, 18 nt, Human
uuuuuuuuuuuuuuuuug

SEQ ID NO: 360787 - RNA, 22 nt, Human
uuuuuuuuuuuuuuuuugccaa

SEQ ID NO: 360788 - RNA, 23 nt, Human
uuuuuuuuuuuuuuuuugccaag

SEQ ID NO: 360789 - RNA, 19 nt, Human
aaaaauaauucagcaugag

SEQ ID NO: 360790 - RNA, 24 nt, Human
aaguacuuucuuggacuuagcucc

SEQ ID NO: 360791 - RNA, 22 nt, Human
acucugcugcccuaacucuugg

SEQ ID NO: 360792 - RNA, 19 nt, Human
agagcagggcagggccuga

SEQ ID NO: 360793 - RNA, 18 nt, Human
agcucaauuuaacaaugu

SEQ ID NO: 360794 - RNA, 21 nt, Human
aggcugaggcggcggcggcgc

SEQ ID NO: 360795 - RNA, 21 nt, Human
agugcacacacaugcuuggug

SEQ ID NO: 360796 - RNA, 18 nt, Human
auacaaaagcaauagaaa

SEQ ID NO: 360797 - RNA, 19 nt, Human
auacucacuauacauaaaa

SEQ ID NO: 360798 - RNA, 21 nt, Human
auccaaaacaguccaccugac

SEQ ID NO: 360799 - RNA, 19 nt, Human
caauaacugaagaugccug

SEQ ID NO: 360800 - RNA, 21 nt, Human
cagcuuacccuggaggacaac

SEQ ID NO: 360801 - RNA, 22 nt, Human
cagguacaagugcacacacaug

SEQ ID NO: 360802 - RNA, 20 nt, Human
cauacaaaagcaauagaaac

SEQ ID NO: 360803 - RNA, 23 nt, Human
ccauauaacuuacauaaaacuca

SEQ ID NO: 360804 - RNA, 22 nt, Human
cccauacaaaagcaauagaaac

SEQ ID NO: 360805 - RNA, 23 nt, Human
ccuuuuuauuuuugcaauauccc

SEQ ID NO: 360806 - RNA, 21 nt, Human
cgggcgcgcagcgcagggccg

SEQ ID NO: 360807 - RNA, 19 nt, Human
cuccacucugcugcccuaa

SEQ ID NO: 360808 - RNA, 19 nt, Human
cuguggaaaaccaguuaug

SEQ ID NO: 360809 - RNA, 22 nt, Human
gagcagggcagggccugaggca

SEQ ID NO: 360810 - RNA, 21 nt, Human
gaggcugaggcggcggcggcg

SEQ ID NO: 360811 - RNA, 21 nt, Human
gcggcggcgcgggcagagagc

SEQ ID NO: 360812 - RNA, 19 nt, Human
ggccaaaaauuaaguuucc

SEQ ID NO: 360813 - RNA, 23 nt, Human
ggccgggcgcgcagcgcagggcc

SEQ ID NO: 360814 - RNA, 18 nt, Human
guagagcagggcagggcc

SEQ ID NO: 360815 - RNA, 24 nt, Human
uaaaacaugcaaaauauacucacu

SEQ ID NO: 360816 - RNA, 19 nt, Human
uaaaaggccaaaaauuaag

SEQ ID NO: 360817 - RNA, 25 nt, Human
uaaauccaaaacaguccaccugaca

SEQ ID NO: 360818 - RNA, 22 nt, Human
uaacagagaaaccaccagguac

SEQ ID NO: 360819 - RNA, 24 nt, Human
uaaggcaaaaauaauucagcauga

SEQ ID NO: 360820 - RNA, 22 nt, Human
uacaaguaccaaauuaagacca

SEQ ID NO: 360821 - RNA, 19 nt, Human
ucccauggauuacaugguu

SEQ ID NO: 360822 - RNA, 21 nt, Human
ucuaacuagugcuauuuacaa

SEQ ID NO: 360823 - RNA, 20 nt, Human
ugacaagcaauaacugaaga

SEQ ID NO: 360824 - RNA, 21 nt, Human
ugaugccuauaaaaguagcug

SEQ ID NO: 360825 - RNA, 21 nt, Human
uuacaauuuaaaacaugcaaa

SEQ ID NO: 360826 - RNA, 18 nt, Human
uuuuuuuuuuuuugaggg

SEQ ID NO: 360827 - RNA, 23 nt, Human
uuuuuuuuuuuuuuuuuugaggg

SEQ ID NO: 360828 - RNA, 20 nt, Human
agacucaggcaagacuggug

SEQ ID NO: 360829 - RNA, 18 nt, Human
agauguacuggaaaugcu

SEQ ID NO: 360830 - RNA, 19 nt, Human
agcaagaggcagauucggu

SEQ ID NO: 360831 - RNA, 22 nt, Human
aggcuucuuggguagacacccu

SEQ ID NO: 360832 - RNA, 24 nt, Human
cacuugugagcauuuauuucucuu

SEQ ID NO: 360833 - RNA, 21 nt, Human
cagaauccaggccaccagggg

SEQ ID NO: 360834 - RNA, 22 nt, Human
ccuccugugaggcaguggaaga

SEQ ID NO: 360835 - RNA, 18 nt, Human
ccuuguucuccggcugac

SEQ ID NO: 360836 - RNA, 20 nt, Human
cuggaaaugcuggagaaaga

SEQ ID NO: 360837 - RNA, 20 nt, Human
cuugugcaguucuugcugga

SEQ ID NO: 360838 - RNA, 27 nt, Human
gacuccguuucuugugcaguucuugcu

SEQ ID NO: 360839 - RNA, 26 nt, Human
ggaccagaauccaggccaccagggga

SEQ ID NO: 360840 - RNA, 18 nt, Human
ggcugacuccguuucuug

SEQ ID NO: 360841 - RNA, 23 nt, Human
gggaccagaauccaggccaccag

SEQ ID NO: 360842 - RNA, 21 nt, Human
uaaguagcaaauucuaaguug

SEQ ID NO: 360843 - RNA, 25 nt, Human
uagaacuucugaaguuuaauucuac

SEQ ID NO: 360844 - RNA, 23 nt, Human
uccugugaggcaguggaagacca

SEQ ID NO: 360845 - RNA, 23 nt, Human
ucuaaguuggggauaggugaggc

SEQ ID NO: 360846 - RNA, 20 nt, Human
ucugauagauguacuggaaa

SEQ ID NO: 360847 - RNA, 23 nt, Human
ucuguguucccggccaagacuug

SEQ ID NO: 360848 - RNA, 19 nt, Human
ucuugugcaguucuugcug

SEQ ID NO: 360849 - RNA, 18 nt, Human
ucuuuugggucacaaaac

SEQ ID NO: 360850 - RNA, 22 nt, Human
uggaaaugcuggagaaagacuc

SEQ ID NO: 360851 - RNA, 22 nt, Human
ugggaccagaauccaggccacc

SEQ ID NO: 360852 - RNA, 18 nt, Human
uuaaaauaaguagcaaau

SEQ ID NO: 360853 - RNA, 28 nt, Human
uuuuagagaucccagcaagaggcagauu

SEQ ID NO: 360854 - RNA, 25 nt, Human
aaaauacccaaugcaaaauggaaca

SEQ ID NO: 360855 - RNA, 19 nt, Human
aaaauuauuuaguccauuu

SEQ ID NO: 360856 - RNA, 23 nt, Human
aaagcccuuucagccaaacacuu

SEQ ID NO: 360857 - RNA, 20 nt, Human
aaauauauagguugcaaagc

SEQ ID NO: 360858 - RNA, 23 nt, Human
aaaucaacucugaacuaguacag

SEQ ID NO: 360859 - RNA, 20 nt, Human
aacguaauuuggaacucguc

SEQ ID NO: 360860 - RNA, 25 nt, Human
aaugcaaaaagcccuuucagccaaa

SEQ ID NO: 360861 - RNA, 25 nt, Human
acacaggaaaaccuugaggaagucc

SEQ ID NO: 360862 - RNA, 22 nt, Human
accaugccauauaaaaagagcc

SEQ ID NO: 360863 - RNA, 22 nt, Human
accaugccauauaaaaagagcu

SEQ ID NO: 360864 - RNA, 18 nt, Human
acucugaauaguacagaa

SEQ ID NO: 360865 - RNA, 19 nt, Human
acuucugucuuugcaccuc

SEQ ID NO: 360866 - RNA, 19 nt, Human
agccauaggaaccaugcca

SEQ ID NO: 360867 - RNA, 21 nt, Human
aucauuuuagaaagcucagcu

SEQ ID NO: 360868 - RNA, 22 nt, Human
aucccucaccccucuacuggaa

SEQ ID NO: 360869 - RNA, 25 nt, Human
auggaacaaaaccacuaaggaccga

SEQ ID NO: 360870 - RNA, 19 nt, Human
auuaaagaauugggccacc

SEQ ID NO: 360871 - RNA, 20 nt, Human
caaacacuugaaauagacuc

SEQ ID NO: 360872 - RNA, 20 nt, Human
caaauacacaccguuugaaa

SEQ ID NO: 360873 - RNA, 19 nt, Human
cacaaaaguccagcaaaau

SEQ ID NO: 360874 - RNA, 27 nt, Human
cacugcacacaggaaaaccuugaggaa

SEQ ID NO: 360875 - RNA, 24 nt, Human
cagaaucccucaccccucuacugg

SEQ ID NO: 360876 - RNA, 19 nt, Human
cauaaaaagaucaauguua

SEQ ID NO: 360877 - RNA, 20 nt, Human
caugcaaaugcaaaaagccc

SEQ ID NO: 360878 - RNA, 20 nt, Human
cauuuuagaaagcucagcua

SEQ ID NO: 360879 - RNA, 21 nt, Human
ccaaacacuugaaauagacuc

SEQ ID NO: 360880 - RNA, 19 nt, Human
ccacugcacacaggaaaac

SEQ ID NO: 360881 - RNA, 22 nt, Human
ccagcagaaucugaacucagaa

SEQ ID NO: 360882 - RNA, 21 nt, Human
cccauaaugcuugggugcacc

SEQ ID NO: 360883 - RNA, 25 nt, Human
ccccaucaaacuuuuaaaccccucc

SEQ ID NO: 360884 - RNA, 23 nt, Human
ccccuggcagccguaaaccccug

SEQ ID NO: 360885 - RNA, 18 nt, Human
cccugggcccuggcucug

SEQ ID NO: 360886 - RNA, 21 nt, Human
ccuccugccaccucccugacc

SEQ ID NO: 360887 - RNA, 25 nt, Human
ccugggcccuggcucugcugcuggu

SEQ ID NO: 360888 - RNA, 18 nt, Human
cucaagucacaaguuacc

SEQ ID NO: 360889 - RNA, 23 nt, Human
cucaauacuucugucuuugcacc

SEQ ID NO: 360890 - RNA, 27 nt, Human
cucagaacaugcaaaugcaaaaagccc

SEQ ID NO: 360891 - RNA, 23 nt, Human
cuccacuagagucuugguguuuc

SEQ ID NO: 360892 - RNA, 20 nt, Human
cucccagauuugaagagcuc

SEQ ID NO: 360893 - RNA, 22 nt, Human
cugacacucucuaagaaggaag

SEQ ID NO: 360894 - RNA, 22 nt, Human
cugcugaguuaagagccugcau

SEQ ID NO: 360895 - RNA, 21 nt, Human
gaaaagcagaaucccucaccc

SEQ ID NO: 360896 - RNA, 22 nt, Human
gagaauauuuugggggaauauu

SEQ ID NO: 360897 - RNA, 19 nt, Human
gauguuuucauucucggug

SEQ ID NO: 360898 - RNA, 18 nt, Human
gccauaggaaccaugcca

SEQ ID NO: 360899 - RNA, 19 nt, Human
gcccuggcucugcugcugg

SEQ ID NO: 360900 - RNA, 21 nt, Human
gcccuugauuuuggguguguu

SEQ ID NO: 360901 - RNA, 21 nt, Human
gcgcuggucccugggcccugg

SEQ ID NO: 360902 - RNA, 19 nt, Human
gcugguggggcccuucuga

SEQ ID NO: 360903 - RNA, 23 nt, Human
gguguguugaaauuacaagagga

SEQ ID NO: 360904 - RNA, 19 nt, Human
guccuaccaaaacaaauaa

SEQ ID NO: 360905 - RNA, 23 nt, Human
uaaaaaacaauaaagcuaggaug

SEQ ID NO: 360906 - RNA, 20 nt, Human
uaaaaagagccacguuaaug

SEQ ID NO: 360907 - RNA, 19 nt, Human
uaaaaagagcuguguuaau

SEQ ID NO: 360908 - RNA, 20 nt, Human
uaaaaagagcuguguuaaug

SEQ ID NO: 360909 - RNA, 18 nt, Human
uacccccugcugccucca

SEQ ID NO: 360910 - RNA, 19 nt, Human
uacccccugcugccuccac

SEQ ID NO: 360911 - RNA, 20 nt, Human
uagcauuacaacacagagca

SEQ ID NO: 360912 - RNA, 22 nt, Human
uaggaaacaauauuugucccau

SEQ ID NO: 360913 - RNA, 25 nt, Human
uauaaaaagagccacguuaauguuu

SEQ ID NO: 360914 - RNA, 19 nt, Human
uauaguuacgguuuaagaa

SEQ ID NO: 360915 - RNA, 23 nt, Human
uauauaaaacauauacauauaua

SEQ ID NO: 360916 - RNA, 22 nt, Human
uauaugaguauacauacauaua

SEQ ID NO: 360917 - RNA, 19 nt, Human
uaucacuggaccccugagg

SEQ ID NO: 360918 - RNA, 21 nt, Human
uaugucacuuggugucucuuu

SEQ ID NO: 360919 - RNA, 18 nt, Human
uauuuuauacuaucuccc

SEQ ID NO: 360920 - RNA, 20 nt, Human
uccaacacuugaugaguuau

SEQ ID NO: 360921 - RNA, 18 nt, Human
uccacagaagcgcugguc

SEQ ID NO: 360922 - RNA, 22 nt, Human
uccaggcccuugauuuugggug

SEQ ID NO: 360923 - RNA, 20 nt, Human
ucccugcugaguuaagagcc

SEQ ID NO: 360924 - RNA, 18 nt, Human
uccucgaggguuuguugg

SEQ ID NO: 360925 - RNA, 22 nt, Human
ucgaggguuuguuggauaauuu

SEQ ID NO: 360926 - RNA, 22 nt, Human
ucugauugcugcagaaugaggg

SEQ ID NO: 360927 - RNA, 18 nt, Human
ucuguacccccugcugcc

SEQ ID NO: 360928 - RNA, 27 nt, Human
ugaaaagcagaaucccucaccccucua

SEQ ID NO: 360929 - RNA, 20 nt, Human
ugaaaauacccaaugcaaaa

SEQ ID NO: 360930 - RNA, 18 nt, Human
ugaagguuuguuggauaa

SEQ ID NO: 360931 - RNA, 19 nt, Human
ugaagucagauauuugccc

SEQ ID NO: 360932 - RNA, 22 nt, Human
ugaaucacaaaaguccagcaaa

SEQ ID NO: 360933 - RNA, 25 nt, Human
ugaauuccaaugaaauuccaauuuu

SEQ ID NO: 360934 - RNA, 24 nt, Human
ugaccauggugcuuacugugggug

SEQ ID NO: 360935 - RNA, 22 nt, Human
ugcaccuccugccaccucccug

SEQ ID NO: 360936 - RNA, 19 nt, Human
ugccucaccugucuugcuc

SEQ ID NO: 360937 - RNA, 22 nt, Human
ugccucaccugucuugcucaac

SEQ ID NO: 360938 - RNA, 21 nt, Human
uggaacaaaaccacuaaggac

SEQ ID NO: 360939 - RNA, 18 nt, Human
uggacugccacuggagaa

SEQ ID NO: 360940 - RNA, 20 nt, Human
ugggaaauguguaggaggua

SEQ ID NO: 360941 - RNA, 25 nt, Human
uggguggucccugucaacugacuag

SEQ ID NO: 360942 - RNA, 25 nt, Human
ugguguuucucucaauacuucuguc

SEQ ID NO: 360943 - RNA, 20 nt, Human
ugucuugcucaacagggagg

SEQ ID NO: 360944 - RNA, 21 nt, Human
ugugaaucacaaaaguccagc

SEQ ID NO: 360945 - RNA, 21 nt, Human
uguucucccauuucccuuuca

SEQ ID NO: 360946 - RNA, 23 nt, Human
uuaagagccugcauccaauaugg

SEQ ID NO: 360947 - RNA, 25 nt, Human
uuauucaacuguaaauggaaauccu

SEQ ID NO: 360948 - RNA, 21 nt, Human
uuccaauuuucacuuuaacuc

SEQ ID NO: 360949 - RNA, 23 nt, Human
uucccauaaugcuugggugcacc

SEQ ID NO: 360950 - RNA, 19 nt, Human
uuccuggcugguggggccc

SEQ ID NO: 360951 - RNA, 23 nt, Human
uucuuauacuacuuacuccugca

SEQ ID NO: 360952 - RNA, 24 nt, Human
uuucugauugaugggaaaugugua

SEQ ID NO: 360953 - RNA, 18 nt, Human
uuuuagaaagcucagcua

SEQ ID NO: 360954 - RNA, 18 nt, Human
aaaagaaaaggggcccag

SEQ ID NO: 360955 - RNA, 21 nt, Human
aaacaaaaccuucacaagugu

SEQ ID NO: 360956 - RNA, 21 nt, Human
aaauuagcuagucuugaacaa

SEQ ID NO: 360957 - RNA, 19 nt, Human
aacacuguagcugaaguug

SEQ ID NO: 360958 - RNA, 22 nt, Human
aagaacaaaagaaaaggggccg

SEQ ID NO: 360959 - RNA, 26 nt, Human
aauacaaaggugcucuuuaagcuaaa

SEQ ID NO: 360960 - RNA, 24 nt, Human
acacccucauguucuacaacacag

SEQ ID NO: 360961 - RNA, 20 nt, Human
acaggagugcaaggaacugg

SEQ ID NO: 360962 - RNA, 18 nt, Human
accaugcugugaagugcu

SEQ ID NO: 360963 - RNA, 25 nt, Human
acgugacuaaccacucuuuuacgua

SEQ ID NO: 360964 - RNA, 18 nt, Human
agggauuuucuuuuuucc

SEQ ID NO: 360965 - RNA, 20 nt, Human
aguacagauaagaaucuguc

SEQ ID NO: 360966 - RNA, 20 nt, Human
caaaauaagcacaugugcuc

SEQ ID NO: 360967 - RNA, 21 nt, Human
cauagcaaaucauuaugucau

SEQ ID NO: 360968 - RNA, 23 nt, Human
ccugcagcuuacaugauaaccau

SEQ ID NO: 360969 - RNA, 23 nt, Human
cgacgacuuuggcaaagaacaaa

SEQ ID NO: 360970 - RNA, 26 nt, Human
cgagccuagcggacgcccugagccag

SEQ ID NO: 360971 - RNA, 19 nt, Human
cuaacacuguagcugaagu

SEQ ID NO: 360972 - RNA, 22 nt, Human
cucaaggcacagcugugguaaa

SEQ ID NO: 360973 - RNA, 21 nt, Human
cucaugagaaauaggggaauu

SEQ ID NO: 360974 - RNA, 24 nt, Human
cucuauauaaucuaguaacaggau

SEQ ID NO: 360975 - RNA, 21 nt, Human
cugcaguacaaaauaagcaca

SEQ ID NO: 360976 - RNA, 24 nt, Human
cugcggcugcuaucgcugcugcug

SEQ ID NO: 360977 - RNA, 18 nt, Human
cugcugcucucgcugagg

SEQ ID NO: 360978 - RNA, 22 nt, Human
cuguagcugaaguuggaaaggc

SEQ ID NO: 360979 - RNA, 24 nt, Human
cuuacacccucauguucuacaacc

SEQ ID NO: 360980 - RNA, 20 nt, Human
cuuagguuuccuaaacagcu

SEQ ID NO: 360981 - RNA, 21 nt, Human
cuucuaccugcagcuuacaug

SEQ ID NO: 360982 - RNA, 19 nt, Human
cuucuguguggcuuuuggc

SEQ ID NO: 360983 - RNA, 24 nt, Human
gaacaagagugaguuuugcagaaa

SEQ ID NO: 360984 - RNA, 18 nt, Human
gggaauucaguguuauca

SEQ ID NO: 360985 - RNA, 23 nt, Human
guuaauuucugcugacuuagguu

SEQ ID NO: 360986 - RNA, 22 nt, Human
uaaaaacacaacagccuugggc

SEQ ID NO: 360987 - RNA, 22 nt, Human
uaaagaaagugcucauagcaac

SEQ ID NO: 360988 - RNA, 25 nt, Human
uaacaugaguuaaauugggauucuu

SEQ ID NO: 360989 - RNA, 21 nt, Human
uaagcacaugugcucuauaua

SEQ ID NO: 360990 - RNA, 21 nt, Human
uaagcuaaaccauaaaccuua

SEQ ID NO: 360991 - RNA, 22 nt, Human
uacaacauagcaaaucauuaug

SEQ ID NO: 360992 - RNA, 22 nt, Human
uagcugaaguuggaaaggcaaa

SEQ ID NO: 360993 - RNA, 18 nt, Human
uagguuuccuaaacagcu

SEQ ID NO: 360994 - RNA, 20 nt, Human
uauuagagaauucuaguuaa

SEQ ID NO: 360995 - RNA, 22 nt, Human
ucacuaaugaugauaacaugag

SEQ ID NO: 360996 - RNA, 19 nt, Human
uccaugaaagugcauauaa

SEQ ID NO: 360997 - RNA, 21 nt, Human
uccaugccucaacauaaggga

SEQ ID NO: 360998 - RNA, 18 nt, Human
ucgcugcugcugcucucg

SEQ ID NO: 360999 - RNA, 19 nt, Human
ucgcugcugcugcucucgc

SEQ ID NO: 361000 - RNA, 21 nt, Human
ucuacauguaacuugccaggc

SEQ ID NO: 361001 - RNA, 18 nt, Human
ucuucugcggcugcuauc

SEQ ID NO: 361002 - RNA, 24 nt, Human
ucuuuaagcuaaaccauaaaccuu

SEQ ID NO: 361003 - RNA, 19 nt, Human
ugaagcaaaggauuaaacu

SEQ ID NO: 361004 - RNA, 21 nt, Human
ugauuuguaaaacaaaaccuu

SEQ ID NO: 361005 - RNA, 21 nt, Human
ugcaaggaacuggagauagca

SEQ ID NO: 361006 - RNA, 18 nt, Human
ugcagucuccaugaaagu

SEQ ID NO: 361007 - RNA, 19 nt, Human
ugcccuucuguguggcuuu

SEQ ID NO: 361008 - RNA, 18 nt, Human
ugcuaucgcugcugcugc

SEQ ID NO: 361009 - RNA, 19 nt, Human
uggcaaagaacaaaagaaa

SEQ ID NO: 361010 - RNA, 27 nt, Human
uggcaaagaacaaaagaaaaggggccc

SEQ ID NO: 361011 - RNA, 21 nt, Human
uggcuucuagguucuaugacc

SEQ ID NO: 361012 - RNA, 18 nt, Human
ugggaggcucagcagguc

SEQ ID NO: 361013 - RNA, 19 nt, Human
ugggcuuucuacauguaac

SEQ ID NO: 361014 - RNA, 20 nt, Human
uguaucuacucaugagaaau

SEQ ID NO: 361015 - RNA, 20 nt, Human
ugucauacuguagaaagaug

SEQ ID NO: 361016 - RNA, 23 nt, Human
ugugaagugcuacauaugcuuca

SEQ ID NO: 361017 - RNA, 18 nt, Human
ugugguaaaaacagagca

SEQ ID NO: 361018 - RNA, 22 nt, Human
uguguuaaaucaagugauuugu

SEQ ID NO: 361019 - RNA, 21 nt, Human
uuagcuaacacuguagcugaa

SEQ ID NO: 361020 - RNA, 25 nt, Human
uuccacauacauguaaauaccuuaa

SEQ ID NO: 361021 - RNA, 24 nt, Human
uucugcggcugcuaucgcugcugc

SEQ ID NO: 361022 - RNA, 18 nt, Human
uugguacagacauguugc

SEQ ID NO: 361023 - RNA, 22 nt, Human
uuucugcugacuuagguuuccu

SEQ ID NO: 361024 - RNA, 21 nt, Human
uuucuuuuuuccuucuuucca

SEQ ID NO: 361025 - RNA, 21 nt, Human
uuugcagaaaacugacauauc

SEQ ID NO: 361026 - RNA, 21 nt, Human
uuuggcaaagaacaaaagaaa

SEQ ID NO: 361027 - RNA, 20 nt, Human
uuuuuuuuuuuuuuuuuaag

SEQ ID NO: 361028 - RNA, 18 nt, Human
aaacuacucucacaaacu

SEQ ID NO: 361029 - RNA, 22 nt, Human
acuucaguucaacagagaagaa

SEQ ID NO: 361030 - RNA, 21 nt, Human
agcaagcuuuccugugugcuu

SEQ ID NO: 361031 - RNA, 19 nt, Human
agcacgcccuccacacccc

SEQ ID NO: 361032 - RNA, 25 nt, Human
auuucagguuacuacacuaggcacu

SEQ ID NO: 361033 - RNA, 20 nt, Human
caaaggaaaacuacucucac

SEQ ID NO: 361034 - RNA, 18 nt, Human
cacgcccuccacaccccu

SEQ ID NO: 361035 - RNA, 18 nt, Human
cagccgcaagaccaggug

SEQ ID NO: 361036 - RNA, 20 nt, Human
ccauugugauguuaaugugu

SEQ ID NO: 361037 - RNA, 21 nt, Human
ccgccgccugcgggccgccgc

SEQ ID NO: 361038 - RNA, 19 nt, Human
ccggcgguggccacagccg

SEQ ID NO: 361039 - RNA, 21 nt, Human
ccggcgguggccacagccgca

SEQ ID NO: 361040 - RNA, 26 nt, Human
cuggccggcgguggccacagccgcaa

SEQ ID NO: 361041 - RNA, 23 nt, Human
gcagagcccggcggacgucuccg

SEQ ID NO: 361042 - RNA, 19 nt, Human
ggccggcgguggccacagc

SEQ ID NO: 361043 - RNA, 20 nt, Human
uaaaaccgaagucuccauac

SEQ ID NO: 361044 - RNA, 19 nt, Human
ucuggagggcuguccacug

SEQ ID NO: 361045 - RNA, 20 nt, Human
ugcccgacccccggcggaac

SEQ ID NO: 361046 - RNA, 20 nt, Human
ugucauugaagauuucaggu

SEQ ID NO: 361047 - RNA, 21 nt, Human
uuacuacacuaggcacugaag

SEQ ID NO: 361048 - RNA, 22 nt, Human
uucaacagagaagaaucaccau

SEQ ID NO: 361049 - RNA, 22 nt, Human
uugacuaaaaccgaagucucca

SEQ ID NO: 361050 - RNA, 22 nt, Human
uuucuccccgccgccugcgggg

SEQ ID NO: 361051 - RNA, 22 nt, Human
aaggagaccuagcaaagcuggg

SEQ ID NO: 361052 - RNA, 24 nt, Human
aaggagaccuagcaaagcuggguc

SEQ ID NO: 361053 - RNA, 18 nt, Human
acuccaggccacaagaug

SEQ ID NO: 361054 - RNA, 20 nt, Human
agaccugggauccaucucca

SEQ ID NO: 361055 - RNA, 20 nt, Human
aggacagggccaggcaagca

SEQ ID NO: 361056 - RNA, 21 nt, Human
aggugggugcugggaagaggc

SEQ ID NO: 361057 - RNA, 21 nt, Human
aguaaaguccccaaacauccc

SEQ ID NO: 361058 - RNA, 24 nt, Human
caaagcuggguccaggacagggcc

SEQ ID NO: 361059 - RNA, 23 nt, Human
caagaccucgacuccaggccaca

SEQ ID NO: 361060 - RNA, 24 nt, Human
caauaaauaugcaauaaauagcgc

SEQ ID NO: 361061 - RNA, 24 nt, Human
cacccgccgucccagccgcccgcc

SEQ ID NO: 361062 - RNA, 20 nt, Human
cagccgcccgccgcuguccc

SEQ ID NO: 361063 - RNA, 22 nt, Human
cagccgcccgccgcuguccccg

SEQ ID NO: 361064 - RNA, 22 nt, Human
caggccacaagaugacacuggg

SEQ ID NO: 361065 - RNA, 23 nt, Human
cauccaaacaauaaauaugcaau

SEQ ID NO: 361066 - RNA, 25 nt, Human
cauccaaacaauaaauaugcaauaa

SEQ ID NO: 361067 - RNA, 22 nt, Human
caucuccauuuugaggcccagg

SEQ ID NO: 361068 - RNA, 22 nt, Human
cccacaagaccugggauccauc

SEQ ID NO: 361069 - RNA, 20 nt, Human
ccccgccgcacccgccgucc

SEQ ID NO: 361070 - RNA, 18 nt, Human
cccgccgcuguccccgcc

SEQ ID NO: 361071 - RNA, 20 nt, Human
cccgccgucccagccgcccg

SEQ ID NO: 361072 - RNA, 20 nt, Human
ccgcacccgccgucccagcc

SEQ ID NO: 361073 - RNA, 19 nt, Human
ccgccgcuguccccgcccc

SEQ ID NO: 361074 - RNA, 21 nt, Human
ccgccgcuguccccgccccuc

SEQ ID NO: 361075 - RNA, 21 nt, Human
ccgccgcuguccccgccgcug

SEQ ID NO: 361076 - RNA, 24 nt, Human
ccgccgcuguccccgccgcugucc

SEQ ID NO: 361077 - RNA, 25 nt, Human
ccgccgcuguccccgccgcuguccc

SEQ ID NO: 361078 - RNA, 18 nt, Human
ccgccgucccagccgccc

SEQ ID NO: 361079 - RNA, 18 nt, Human
ccgucccagccgcccgcc

SEQ ID NO: 361080 - RNA, 25 nt, Human
ccgucccagccgcccgccgcugucc

SEQ ID NO: 361081 - RNA, 22 nt, Human
ccucccuggcuacccuucccuu

SEQ ID NO: 361082 - RNA, 19 nt, Human
ccugcaggcagcugggcug

SEQ ID NO: 361083 - RNA, 21 nt, Human
ccugcaggcagcugggcugga

SEQ ID NO: 361084 - RNA, 21 nt, Human
ccuggccaagaccucgacucc

SEQ ID NO: 361085 - RNA, 18 nt, Human
ccugggcugggccgggcc

SEQ ID NO: 361086 - RNA, 22 nt, Human
cggcugccuucaaaccccacuc

SEQ ID NO: 361087 - RNA, 21 nt, Human
cugggauccaucuccauuuug

SEQ ID NO: 361088 - RNA, 18 nt, Human
cuguccccgccgcugucc

SEQ ID NO: 361089 - RNA, 19 nt, Human
cuguccccgccgcuguccc

SEQ ID NO: 361090 - RNA, 20 nt, Human
cuucaaaccccacucggccc

SEQ ID NO: 361091 - RNA, 21 nt, Human
gcagggcuggcaggugggugc

SEQ ID NO: 361092 - RNA, 20 nt, Human
gccgcacccgccgucccagc

SEQ ID NO: 361093 - RNA, 31 nt, Human
gccgcccgccgcuguccccgccgcugucccc

SEQ ID NO: 361094 - RNA, 19 nt, Human
gcucagcuugguggggggc

SEQ ID NO: 361095 - RNA, 19 nt, Human
ggcaggugggugcugggaa

SEQ ID NO: 361096 - RNA, 18 nt, Human
ggcuggcaggugggugcu

SEQ ID NO: 361097 - RNA, 21 nt, Human
gucccacaagaccugggaucc

SEQ ID NO: 361098 - RNA, 19 nt, Human
uaaauagcgcuccugggcu

SEQ ID NO: 361099 - RNA, 27 nt, Human
uacacaauguuuuauugaaaaagucag

SEQ ID NO: 361100 - RNA, 18 nt, Human
uaccagucuucucuggcc

SEQ ID NO: 361101 - RNA, 19 nt, Human
uaccccagaccacagcuug

SEQ ID NO: 361102 - RNA, 24 nt, Human
uacccuucccuucgucucugaugg

SEQ ID NO: 361103 - RNA, 24 nt, Human
uaguagacugagccagaucuuccu

SEQ ID NO: 361104 - RNA, 22 nt, Human
uccaaacaauaaauaugcaaua

SEQ ID NO: 361105 - RNA, 20 nt, Human
ucccagggucccacaagacc

SEQ ID NO: 361106 - RNA, 24 nt, Human
uccccaaacaucccagggucccac

SEQ ID NO: 361107 - RNA, 18 nt, Human
uccccgccgcuguccccc

SEQ ID NO: 361108 - RNA, 25 nt, Human
ucucuggccaggacaggccgggguc

SEQ ID NO: 361109 - RNA, 23 nt, Human
ugaggcccaggccugguuuccaa

SEQ ID NO: 361110 - RNA, 23 nt, Human
ugccuucaaaccccacucggccc

SEQ ID NO: 361111 - RNA, 26 nt, Human
uggcaggugggugcugggaagaggcu

SEQ ID NO: 361112 - RNA, 22 nt, Human
uggggugcuagauaguaaaguc

SEQ ID NO: 361113 - RNA, 24 nt, Human
uggggugcuagauaguaaaguccc

SEQ ID NO: 361114 - RNA, 21 nt, Human
uggguccaggacagggccagg

SEQ ID NO: 361115 - RNA, 22 nt, Human
uugaggcccaggccugguuucc

SEQ ID NO: 361116 - RNA, 23 nt, Human
uuuuuuuuuuuuuuuuugcccag

SEQ ID NO: 361117 - RNA, 27 nt, Human
uuuuuuuuuuuuuuuuuuuuuuugggg

SEQ ID NO: 361118 - RNA, 21 nt, Human
aaugacugcagaucagauggg

SEQ ID NO: 361119 - RNA, 18 nt, Human
agacguggcuugaaagac

SEQ ID NO: 361120 - RNA, 22 nt, Human
agaugggagcucuuuuacacag

SEQ ID NO: 361121 - RNA, 21 nt, Human
aguaaugagcuggcacuucca

SEQ ID NO: 361122 - RNA, 22 nt, Human
auuguucugauguugagggaau

SEQ ID NO: 361123 - RNA, 23 nt, Human
ggagcucuuuuacacagguacuu

SEQ ID NO: 361124 - RNA, 20 nt, Human
uacagaacacaggcuucuag

SEQ ID NO: 361125 - RNA, 22 nt, Human
uacuuugcucuuucuguauuua

SEQ ID NO: 361126 - RNA, 22 nt, Human
ugacugcagaucagaugggagc

SEQ ID NO: 361127 - RNA, 22 nt, Human
uguacagaacacaggcuucuag

SEQ ID NO: 361128 - RNA, 21 nt, Human
uguacagaacacaggcuucuc

SEQ ID NO: 361129 - RNA, 23 nt, Human
aaaagaacuuccagaaaccaagg

SEQ ID NO: 361130 - RNA, 21 nt, Human
aacacaaagacagucaaggaa

SEQ ID NO: 361131 - RNA, 21 nt, Human
aacaggagagcccuaggugac

SEQ ID NO: 361132 - RNA, 21 nt, Human
aaccacuggguaaauccagcc

SEQ ID NO: 361133 - RNA, 18 nt, Human
aagcagaaacucacagcc

SEQ ID NO: 361134 - RNA, 24 nt, Human
aagccccaugggcagcuugggugg

SEQ ID NO: 361135 - RNA, 20 nt, Human
aaggaacagagugacucgga

SEQ ID NO: 361136 - RNA, 19 nt, Human
aaggaugccuggugcuugc

SEQ ID NO: 361137 - RNA, 19 nt, Human
aagguggauggagacucgg

SEQ ID NO: 361138 - RNA, 20 nt, Human
acaaagcagaaacucacagc

SEQ ID NO: 361139 - RNA, 21 nt, Human
acacagacagacagggaaacc

SEQ ID NO: 361140 - RNA, 22 nt, Human
acagaaacacaaagacagucag

SEQ ID NO: 361141 - RNA, 22 nt, Human
accaugcaagccagacguagcc

SEQ ID NO: 361142 - RNA, 18 nt, Human
agaaaccaaggcaagggc

SEQ ID NO: 361143 - RNA, 23 nt, Human
agacagacagggaaaccuacaaa

SEQ ID NO: 361144 - RNA, 18 nt, Human
agaggcugcagcccaggg

SEQ ID NO: 361145 - RNA, 21 nt, Human
agaggcugcagcccagggcgg

SEQ ID NO: 361146 - RNA, 22 nt, Human
agcagcgucugcccucagaugc

SEQ ID NO: 361147 - RNA, 23 nt, Human
agccaaggaaaagaacuuccaga

SEQ ID NO: 361148 - RNA, 21 nt, Human
agccaccaaccaacguucaga

SEQ ID NO: 361149 - RNA, 22 nt, Human
agccagacagaccugacaccag

SEQ ID NO: 361150 - RNA, 23 nt, Human
agccagacagaccugacaccagg

SEQ ID NO: 361151 - RNA, 23 nt, Human
agccagacguagcccaaggccug

SEQ ID NO: 361152 - RNA, 18 nt, Human
agccagcaccauguggcc

SEQ ID NO: 361153 - RNA, 22 nt, Human
agccgaagugcaaaguguuggg

SEQ ID NO: 361154 - RNA, 20 nt, Human
agccugcaaaugugaccaca

SEQ ID NO: 361155 - RNA, 21 nt, Human
aggcaagggcucacuggcuuc

SEQ ID NO: 361156 - RNA, 24 nt, Human
aggcagaggcugugggaacugcug

SEQ ID NO: 361157 - RNA, 19 nt, Human
auagaagcaaccucuuuau

SEQ ID NO: 361158 - RNA, 21 nt, Human
auaugccacauagaaagggag

SEQ ID NO: 361159 - RNA, 21 nt, Human
caaaguguugggcccuugaaa

SEQ ID NO: 361160 - RNA, 20 nt, Human
caaccaacguucagagccag

SEQ ID NO: 361161 - RNA, 25 nt, Human
caaccuaaccacuggguaaauccag

SEQ ID NO: 361162 - RNA, 24 nt, Human
caaccucuuuauggacaaccuugu

SEQ ID NO: 361163 - RNA, 23 nt, Human
cacaggaccugccggccccaucc

SEQ ID NO: 361164 - RNA, 24 nt, Human
cacaggccauggcaggggacgccc

SEQ ID NO: 361165 - RNA, 20 nt, Human
caccacacacccgacagaug

SEQ ID NO: 361166 - RNA, 21 nt, Human
caccaggcgccacugcugccu

SEQ ID NO: 361167 - RNA, 20 nt, Human
caccauguggccgcugugcc

SEQ ID NO: 361168 - RNA, 21 nt, Human
cacggaguugacaacacaaag

SEQ ID NO: 361169 - RNA, 19 nt, Human
cacgggcauggacagaguc

SEQ ID NO: 361170 - RNA, 18 nt, Human
cacucugcgcgcgugugc

SEQ ID NO: 361171 - RNA, 21 nt, Human
cacuggcuucuugugaccugc

SEQ ID NO: 361172 - RNA, 18 nt, Human
cacuggguaaauccagcc

SEQ ID NO: 361173 - RNA, 21 nt, Human
cagacagggaaaccuacaaaa

SEQ ID NO: 361174 - RNA, 21 nt, Human
cagaccugacaccaggcgcca

SEQ ID NO: 361175 - RNA, 19 nt, Human
cagcccagggcgggggcag

SEQ ID NO: 361176 - RNA, 18 nt, Human
cagccgaagugcaaagug

SEQ ID NO: 361177 - RNA, 19 nt, Human
cagccugcaaaugugacca

SEQ ID NO: 361178 - RNA, 21 nt, Human
cagcuucagcuccgggugcuc

SEQ ID NO: 361179 - RNA, 19 nt, Human
caucagggacagcuucagc

SEQ ID NO: 361180 - RNA, 21 nt, Human
caugaaauguggaccugccga

SEQ ID NO: 361181 - RNA, 18 nt, Human
caugcaagccagacguag

SEQ ID NO: 361182 - RNA, 22 nt, Human
caugcaaggcacaggccauggc

SEQ ID NO: 361183 - RNA, 20 nt, Human
ccagacagaccugacaccag

SEQ ID NO: 361184 - RNA, 19 nt, Human
ccaggcccaggcugcccac

SEQ ID NO: 361185 - RNA, 21 nt, Human
ccaggcccaggcugcccacgc

SEQ ID NO: 361186 - RNA, 21 nt, Human
ccagggcgggggcagagcuga

SEQ ID NO: 361187 - RNA, 25 nt, Human
ccaugcaagccagacguagcccaag

SEQ ID NO: 361188 - RNA, 19 nt, Human
ccaugggcagcuugggugg

SEQ ID NO: 361189 - RNA, 24 nt, Human
cccgcagccugcaaaugugaccac

SEQ ID NO: 361190 - RNA, 19 nt, Human
cccugagcggagccauggc

SEQ ID NO: 361191 - RNA, 18 nt, Human
cccugggccaagcccagg

SEQ ID NO: 361192 - RNA, 21 nt, Human
cccugggccaagcccaggccc

SEQ ID NO: 361193 - RNA, 24 nt, Human
cccuggguuucagugcauuugccu

SEQ ID NO: 361194 - RNA, 19 nt, Human
ccguaggaagccccauggg

SEQ ID NO: 361195 - RNA, 20 nt, Human
ccuacaaaaggaaacggagu

SEQ ID NO: 361196 - RNA, 18 nt, Human
ccucagaagcagggcugu

SEQ ID NO: 361197 - RNA, 26 nt, Human
ccuccuucccuggagcaccggggugg

SEQ ID NO: 361198 - RNA, 19 nt, Human
ccuguggcugugggcuggg

SEQ ID NO: 361199 - RNA, 18 nt, Human
cgagaagaucuggccacg

SEQ ID NO: 361200 - RNA, 19 nt, Human
cgcugugccucuagccugc

SEQ ID NO: 361201 - RNA, 21 nt, Human
cggggcccugagcggagccau

SEQ ID NO: 361202 - RNA, 19 nt, Human
cgggggcagagcugagccc

SEQ ID NO: 361203 - RNA, 22 nt, Human
cgggguggggauggcacgugug

SEQ ID NO: 361204 - RNA, 20 nt, Human
cgggugcucuuccaagaaug

SEQ ID NO: 361205 - RNA, 19 nt, Human
cggugccacugcccgcagc

SEQ ID NO: 361206 - RNA, 19 nt, Human
cguucuggaaaagccgagg

SEQ ID NO: 361207 - RNA, 20 nt, Human
cuaaagguggauggagacuc

SEQ ID NO: 361208 - RNA, 19 nt, Human
cucuacagcaaugccagcc

SEQ ID NO: 361209 - RNA, 19 nt, Human
cuggagcaccggggugggg

SEQ ID NO: 361210 - RNA, 21 nt, Human
cuggggugggguggggugggg

SEQ ID NO: 361211 - RNA, 22 nt, Human
cugugccucuagccugcucucc

SEQ ID NO: 361212 - RNA, 21 nt, Human
cuucagcuccgggugcucuuc

SEQ ID NO: 361213 - RNA, 22 nt, Human
cuuuauggacaaccuuguuacc

SEQ ID NO: 361214 - RNA, 18 nt, Human
gaaagggaggcccaaguc

SEQ ID NO: 361215 - RNA, 20 nt, Human
gaaaugcaaccuaaccacug

SEQ ID NO: 361216 - RNA, 18 nt, Human
gagaagaucuggccacgu

SEQ ID NO: 361217 - RNA, 19 nt, Human
gcacaggccauggcagggg

SEQ ID NO: 361218 - RNA, 20 nt, Human
gcagagcugagcccucagga

SEQ ID NO: 361219 - RNA, 21 nt, Human
gcagccgucacucuacagcaa

SEQ ID NO: 361220 - RNA, 24 nt, Human
gcucaugaaauguggaccugccga

SEQ ID NO: 361221 - RNA, 18 nt, Human
gcugaacugugugccgug

SEQ ID NO: 361222 - RNA, 21 nt, Human
ggaaacggagucaauuguaaa

SEQ ID NO: 361223 - RNA, 19 nt, Human
ggacacaggaccugccggc

SEQ ID NO: 361224 - RNA, 21 nt, Human
ggacagcugcaaacacagccc

SEQ ID NO: 361225 - RNA, 19 nt, Human
gggauggcacgugugagcc

SEQ ID NO: 361226 - RNA, 18 nt, Human
gggcagagcugagcccuc

SEQ ID NO: 361227 - RNA, 19 nt, Human
gguacagaaacacaaagac

SEQ ID NO: 361228 - RNA, 24 nt, Human
gugucugccgucugguucccuggg

SEQ ID NO: 361229 - RNA, 19 nt, Human
uacaaaaggaaacggaguc

SEQ ID NO: 361230 - RNA, 19 nt, Human
uacaaagcagaaacucaca

SEQ ID NO: 361231 - RNA, 20 nt, Human
uagaaaugcaaccuaaccac

SEQ ID NO: 361232 - RNA, 24 nt, Human
uaggugacgggccuagaaacuucc

SEQ ID NO: 361233 - RNA, 20 nt, Human
uaugccacauagaaagggag

SEQ ID NO: 361234 - RNA, 19 nt, Human
ucacagccagccgaagugc

SEQ ID NO: 361235 - RNA, 21 nt, Human
ucacagccagccgaagugcaa

SEQ ID NO: 361236 - RNA, 18 nt, Human
ucacugggggacaggugu

SEQ ID NO: 361237 - RNA, 19 nt, Human
ucagaaacaucugggggca

SEQ ID NO: 361238 - RNA, 19 nt, Human
ucagaaacaucugggggca

SEQ ID NO: 361239 - RNA, 26 nt, Human
ucagcucaugaaauguggaccugccc

SEQ ID NO: 361240 - RNA, 18 nt, Human
ucagugccuugagguaca

SEQ ID NO: 361241 - RNA, 20 nt, Human
uccagcuucagugccuugag

SEQ ID NO: 361242 - RNA, 21 nt, Human
ucccuggagcaccgggguggg

SEQ ID NO: 361243 - RNA, 19 nt, Human
uccuggggugggguggggu

SEQ ID NO: 361244 - RNA, 21 nt, Human
uccuggggugggguggggugg

SEQ ID NO: 361245 - RNA, 18 nt, Human
ucggugccacugcccgca

SEQ ID NO: 361246 - RNA, 23 nt, Human
ucucuucagugccaccgccgccu

SEQ ID NO: 361247 - RNA, 22 nt, Human
ucuucagugccaccgccgccuc

SEQ ID NO: 361248 - RNA, 18 nt, Human
ugaacaggagagcccuag

SEQ ID NO: 361249 - RNA, 21 nt, Human
ugacaccaggcgccacugcug

SEQ ID NO: 361250 - RNA, 19 nt, Human
ugaccggggcccugagcgg

SEQ ID NO: 361251 - RNA, 19 nt, Human
ugagccagcucagaggcug

SEQ ID NO: 361252 - RNA, 18 nt, Human
ugagcggagccauggcca

SEQ ID NO: 361253 - RNA, 20 nt, Human
ugcaagccagacguagccca

SEQ ID NO: 361254 - RNA, 22 nt, Human
ugcagaggcugcagcccagggc

SEQ ID NO: 361255 - RNA, 20 nt, Human
ugccugucccagagugccgu

SEQ ID NO: 361256 - RNA, 20 nt, Human
ugcgugaggcacugaucgca

SEQ ID NO: 361257 - RNA, 18 nt, Human
ugcgugcagaggcugcag

SEQ ID NO: 361258 - RNA, 21 nt, Human
ugcuccugggguggggugggg

SEQ ID NO: 361259 - RNA, 19 nt, Human
uggcagagccacagcuggg

SEQ ID NO: 361260 - RNA, 22 nt, Human
uggcagagccacagcugggggc

SEQ ID NO: 361261 - RNA, 20 nt, Human
uggcaggggacgcccgggac

SEQ ID NO: 361262 - RNA, 18 nt, Human
uggcaucacugggggaca

SEQ ID NO: 361263 - RNA, 21 nt, Human
uggcugugggcugggcccugu

SEQ ID NO: 361264 - RNA, 21 nt, Human
ugggaacugcugagccccgcu

SEQ ID NO: 361265 - RNA, 24 nt, Human
ugggaacugcugagccccgcugug

SEQ ID NO: 361266 - RNA, 18 nt, Human
ugggcugggcccugucag

SEQ ID NO: 361267 - RNA, 20 nt, Human
ugggguggggagggcagucc

SEQ ID NO: 361268 - RNA, 22 nt, Human
uggggugggguggggagggcag

SEQ ID NO: 361269 - RNA, 19 nt, Human
uggguaaauccagccaagg

SEQ ID NO: 361270 - RNA, 23 nt, Human
ugucugccgucugguucccuggg

SEQ ID NO: 361271 - RNA, 21 nt, Human
ugucugggacacgcucugggc

SEQ ID NO: 361272 - RNA, 24 nt, Human
uguggaccugccgagcccagaggc

SEQ ID NO: 361273 - RNA, 18 nt, Human
ugugugccgugcuccugg

SEQ ID NO: 361274 - RNA, 21 nt, Human
ugugugccgugcuccuggggu

SEQ ID NO: 361275 - RNA, 22 nt, Human
uguuaccacguaacucccuggg

SEQ ID NO: 361276 - RNA, 21 nt, Human
uguucacucugcgcgcgugug

SEQ ID NO: 361277 - RNA, 30 nt, Human
uucaccacacacccgacagaugauccaccc

SEQ ID NO: 361278 - RNA, 21 nt, Human
uucaccuucaucaucagggac

SEQ ID NO: 361279 - RNA, 22 nt, Human
uucaccuucaucaucagggaca

SEQ ID NO: 361280 - RNA, 20 nt, Human
uuuccagauggcccuggccc

SEQ ID NO: 361281 - RNA, 18 nt, Human
agcagcaagggcugcuac

SEQ ID NO: 361282 - RNA, 22 nt, Human
gagcuugggguguccccuccgg

SEQ ID NO: 361283 - RNA, 24 nt, Human
ggaauggggugggucuuccugggc

SEQ ID NO: 361284 - RNA, 19 nt, Human
gggcugcuacagccacugc

SEQ ID NO: 361285 - RNA, 20 nt, Human
gguaacagaaggaccaaaga

SEQ ID NO: 361286 - RNA, 24 nt, Human
guggagcagcaagggcugcuacag

SEQ ID NO: 361287 - RNA, 21 nt, Human
uguggagcagcaagggcuggu

SEQ ID NO: 361288 - RNA, 24 nt, Human
aagcgcuccuaggggaaucuccac

SEQ ID NO: 361289 - RNA, 19 nt, Human
aaggagcuuauuucucagg

SEQ ID NO: 361290 - RNA, 21 nt, Human
aaugauaaaacagcuaacuga

SEQ ID NO: 361291 - RNA, 23 nt, Human
acacugguugugaacagcuggaa

SEQ ID NO: 361292 - RNA, 26 nt, Human
agcaacugaccgccuugcagccacag

SEQ ID NO: 361293 - RNA, 24 nt, Human
aggcagacaccacuuccagccucg

SEQ ID NO: 361294 - RNA, 20 nt, Human
aucacacacugguugugaac

SEQ ID NO: 361295 - RNA, 19 nt, Human
aucagaagucuuagaaauc

SEQ ID NO: 361296 - RNA, 18 nt, Human
auggagagaucaaggcca

SEQ ID NO: 361297 - RNA, 18 nt, Human
caccccaugggagggcag

SEQ ID NO: 361298 - RNA, 19 nt, Human
cagaaugggcaccaacuaa

SEQ ID NO: 361299 - RNA, 19 nt, Human
cagccccaguggguuguaa

SEQ ID NO: 361300 - RNA, 18 nt, Human
caggacccaggccuggcc

SEQ ID NO: 361301 - RNA, 19 nt, Human
caugagucaccccauggga

SEQ ID NO: 361302 - RNA, 19 nt, Human
cauggagagaucaaggcca

SEQ ID NO: 361303 - RNA, 22 nt, Human
cccaggaaagugaucuuuaaag

SEQ ID NO: 361304 - RNA, 18 nt, Human
cccaguggguuguaacug

SEQ ID NO: 361305 - RNA, 21 nt, Human
ccccaguggguuguaacugug

SEQ ID NO: 361306 - RNA, 24 nt, Human
ccuccuaucccaacuguacgagac

SEQ ID NO: 361307 - RNA, 20 nt, Human
ccugcugggacaagcagcaa

SEQ ID NO: 361308 - RNA, 25 nt, Human
ccuggccugaccccagaauuauggc

SEQ ID NO: 361309 - RNA, 25 nt, Human
cgagacaaacaccaugccagauuug

SEQ ID NO: 361310 - RNA, 25 nt, Human
cuaaugcugggccauuccauucagc

SEQ ID NO: 361311 - RNA, 20 nt, Human
cuccaaggauuaaaaaagaa

SEQ ID NO: 361312 - RNA, 21 nt, Human
cugaccgccuugcagccacag

SEQ ID NO: 361313 - RNA, 23 nt, Human
cugcugggacaagcagcaacuga

SEQ ID NO: 361314 - RNA, 25 nt, Human
cuuccagucccauacaacgcaucuc

SEQ ID NO: 361315 - RNA, 18 nt, Human
cuuccugagggccugagc

SEQ ID NO: 361316 - RNA, 21 nt, Human
cuuugaaugaaccucuugcuu

SEQ ID NO: 361317 - RNA, 21 nt, Human
gacaagcagcaacugaccgcc

SEQ ID NO: 361318 - RNA, 23 nt, Human
gagaaacagcaaagaggcuuugc

SEQ ID NO: 361319 - RNA, 22 nt, Human
gagggcaggacccaggccuggc

SEQ ID NO: 361320 - RNA, 21 nt, Human
gaugaaacaggagaauccuaa

SEQ ID NO: 361321 - RNA, 21 nt, Human
gcaggacccaggccuggccug

SEQ ID NO: 361322 - RNA, 22 nt, Human
gcucacuuggaaaggaggugga

SEQ ID NO: 361323 - RNA, 22 nt, Human
ggccaaacugacccagaugaaa

SEQ ID NO: 361324 - RNA, 19 nt, Human
gggccccugggcugguguc

SEQ ID NO: 361325 - RNA, 21 nt, Human
gggcgcugccuucccagcugg

SEQ ID NO: 361326 - RNA, 23 nt, Human
ggugauggugacagcccuuugag

SEQ ID NO: 361327 - RNA, 24 nt, Human
ggugauggugacagcccuuugaga

SEQ ID NO: 361328 - RNA, 24 nt, Human
uaaaacaacuggugcagaaugggc

SEQ ID NO: 361329 - RNA, 22 nt, Human
uaaaacagcuaacugauaaagg

SEQ ID NO: 361330 - RNA, 25 nt, Human
uaaaacagcuaacugauaaaggagc

SEQ ID NO: 361331 - RNA, 20 nt, Human
uaggaaagggaagugugacg

SEQ ID NO: 361332 - RNA, 24 nt, Human
uaggagaguccuggcuggaggggu

SEQ ID NO: 361333 - RNA, 18 nt, Human
uaucccaacuguacgaga

SEQ ID NO: 361334 - RNA, 18 nt, Human
uauccuagauaauggcuc

SEQ ID NO: 361335 - RNA, 18 nt, Human
ucauguccuuggaaagcu

SEQ ID NO: 361336 - RNA, 18 nt, Human
ucccaccagccccagugg

SEQ ID NO: 361337 - RNA, 19 nt, Human
ucccagcuggccaagcgcu

SEQ ID NO: 361338 - RNA, 18 nt, Human
ugaaacaggagaauccua

SEQ ID NO: 361339 - RNA, 22 nt, Human
ugaaacaggagaauccuaaauc

SEQ ID NO: 361340 - RNA, 18 nt, Human
ugaaccucuugcuuccag

SEQ ID NO: 361341 - RNA, 20 nt, Human
ugaaggcagacaccacuucc

SEQ ID NO: 361342 - RNA, 18 nt, Human
ugaauggccuccuauccc

SEQ ID NO: 361343 - RNA, 23 nt, Human
ugagagauaccugggcuuugaac

SEQ ID NO: 361344 - RNA, 21 nt, Human
ugagggccugagcucuucacu

SEQ ID NO: 361345 - RNA, 19 nt, Human
ugcacagucucauguccuu

SEQ ID NO: 361346 - RNA, 18 nt, Human
ugcagaaggggacaaucu

SEQ ID NO: 361347 - RNA, 21 nt, Human
ugcagaaugggcaccaacuaa

SEQ ID NO: 361348 - RNA, 23 nt, Human
ugcagccacagaggccuaugggg

SEQ ID NO: 361349 - RNA, 21 nt, Human
uggagcucaacuuccaacuca

SEQ ID NO: 361350 - RNA, 23 nt, Human
uggccuuuuacaaggccccaauu

SEQ ID NO: 361351 - RNA, 21 nt, Human
uggcuggaggggucaugaguc

SEQ ID NO: 361352 - RNA, 19 nt, Human
ugggaaugaauggccuccu

SEQ ID NO: 361353 - RNA, 24 nt, Human
ugggacaagcagcaacugaccgcc

SEQ ID NO: 361354 - RNA, 23 nt, Human
ugggagggcaggacccaggccug

SEQ ID NO: 361355 - RNA, 21 nt, Human
ugggcaccaacuaagcaaaau

SEQ ID NO: 361356 - RNA, 23 nt, Human
ugguuacaaaucccaugaguuuc

SEQ ID NO: 361357 - RNA, 20 nt, Human
ugguuaucggcagggguaaa

SEQ ID NO: 361358 - RNA, 25 nt, Human
uuacccauaugcagaaggggacaau

SEQ ID NO: 361359 - RNA, 20 nt, Human
uucacaguauuuuugaucag

SEQ ID NO: 361360 - RNA, 24 nt, Human
uugaugacacugggcugucuugua

SEQ ID NO: 361361 - RNA, 21 nt, Human
uuugcacagucucauguccuu

SEQ ID NO: 361362 - RNA, 23 nt, Human
uuugcacagucucauguccuugg

SEQ ID NO: 361363 - RNA, 20 nt, Human
acaagcaccugagcuuguca

SEQ ID NO: 361364 - RNA, 21 nt, Human
acauuaaaaacgcucagagca

SEQ ID NO: 361365 - RNA, 20 nt, Human
agaguccuccuucgucuugg

SEQ ID NO: 361366 - RNA, 23 nt, Human
agcaaaaaggaacugggaaagga

SEQ ID NO: 361367 - RNA, 24 nt, Human
aggaagaagacacuaacagcgaaa

SEQ ID NO: 361368 - RNA, 25 nt, Human
aggaagaagacacuaacagcgaaag

SEQ ID NO: 361369 - RNA, 19 nt, Human
aggaugauaaacgggggca

SEQ ID NO: 361370 - RNA, 25 nt, Human
auuuaauuuuuauuuucuuuuucuu

SEQ ID NO: 361371 - RNA, 23 nt, Human
caccuuugcugcugcugcucggc

SEQ ID NO: 361372 - RNA, 18 nt, Human
cacuaacagcgaacgaug

SEQ ID NO: 361373 - RNA, 20 nt, Human
cagagcacauugugcucucc

SEQ ID NO: 361374 - RNA, 23 nt, Human
cagcagaaacccccuuaauccuu

SEQ ID NO: 361375 - RNA, 25 nt, Human
caguucacuugagguggcggaaucu

SEQ ID NO: 361376 - RNA, 21 nt, Human
ccuuaaaacaagcaccugagc

SEQ ID NO: 361377 - RNA, 19 nt, Human
ccuucgucuugggggcaga

SEQ ID NO: 361378 - RNA, 18 nt, Human
ccuuugcugcugcugcuc

SEQ ID NO: 361379 - RNA, 21 nt, Human
ccuuugcugcugcugcucggc

SEQ ID NO: 361380 - RNA, 21 nt, Human
cgccucuguccucuccagcuc

SEQ ID NO: 361381 - RNA, 21 nt, Human
cgcucagagcacauugugcuc

SEQ ID NO: 361382 - RNA, 19 nt, Human
cuccuggugguccuagugg

SEQ ID NO: 361383 - RNA, 18 nt, Human
cuggccuccugcuuuagg

SEQ ID NO: 361384 - RNA, 22 nt, Human
cuggugguccuagugguuuucu

SEQ ID NO: 361385 - RNA, 24 nt, Human
cuggugguccuagugguuuucuuu

SEQ ID NO: 361386 - RNA, 24 nt, Human
cuuaaaaacauuaaaaacgcucag

SEQ ID NO: 361387 - RNA, 23 nt, Human
cuuuaagccacaccuuugcugcu

SEQ ID NO: 361388 - RNA, 26 nt, Human
cuuuccuuaaaacaagcaccugagaa

SEQ ID NO: 361389 - RNA, 19 nt, Human
gaaaggaugauaaacgggg

SEQ ID NO: 361390 - RNA, 24 nt, Human
gaagaaaucauuuaaaagcuuaaa

SEQ ID NO: 361391 - RNA, 20 nt, Human
gacuucagguggggcugcug

SEQ ID NO: 361392 - RNA, 21 nt, Human
gagaguccuccuucgucuugg

SEQ ID NO: 361393 - RNA, 23 nt, Human
gccacaccuuugcugcugcugcc

SEQ ID NO: 361394 - RNA, 21 nt, Human
gggcaggaagaagacacuaac

SEQ ID NO: 361395 - RNA, 18 nt, Human
uaaaacaagcaccugagc

SEQ ID NO: 361396 - RNA, 21 nt, Human
uaaaacaagcaccugagcuug

SEQ ID NO: 361397 - RNA, 23 nt, Human
uagugguuuucuuugccuguggu

SEQ ID NO: 361398 - RNA, 20 nt, Human
ucagguggggcugcuggucg

SEQ ID NO: 361399 - RNA, 26 nt, Human
ucccaggacgugguaccuuaacucuu

SEQ ID NO: 361400 - RNA, 19 nt, Human
uccugcaguucacuugagg

SEQ ID NO: 361401 - RNA, 23 nt, Human
ucugggguugugugcuccuggug

SEQ ID NO: 361402 - RNA, 21 nt, Human
ucuuaaaccuuucuuggcuuc

SEQ ID NO: 361403 - RNA, 28 nt, Human
ucuugggggcagaacgggagggcaguua

SEQ ID NO: 361404 - RNA, 19 nt, Human
ugaagaaaucauuuaaaag

SEQ ID NO: 361405 - RNA, 23 nt, Human
ugaagaaaucauuuaaaagcuua

SEQ ID NO: 361406 - RNA, 21 nt, Human
ugaccagcaaaaaggaacugg

SEQ ID NO: 361407 - RNA, 23 nt, Human
ugcucggccuugaagaaaucauu

SEQ ID NO: 361408 - RNA, 19 nt, Human
ugcugcugcugcucggccu

SEQ ID NO: 361409 - RNA, 20 nt, Human
uggcuuccgagaguccuccu

SEQ ID NO: 361410 - RNA, 21 nt, Human
ugggaaaggaugauaaacggg

SEQ ID NO: 361411 - RNA, 22 nt, Human
uggggcugcuggucgcucccag

SEQ ID NO: 361412 - RNA, 23 nt, Human
uggggcugcuggucgcucccagg

SEQ ID NO: 361413 - RNA, 21 nt, Human
ugguugggccaguuuguacac

SEQ ID NO: 361414 - RNA, 21 nt, Human
uucagguggggcugcuggucg

SEQ ID NO: 361415 - RNA, 26 nt, Human
uuccuuaaaacaagcaccugagcucc

SEQ ID NO: 361416 - RNA, 19 nt, Human
uugagguggcggaaucuuc

SEQ ID NO: 361417 - RNA, 24 nt, Human
uugauuaguaauagaguaacuuca

SEQ ID NO: 361418 - RNA, 18 nt, Human
uugcugcugcugcucggc

SEQ ID NO: 361419 - RNA, 18 nt, Human
uuucuugagcuguggugc

SEQ ID NO: 361420 - RNA, 24 nt, Human
uuuuaauuuaauuuuuauuuucuu

SEQ ID NO: 361421 - RNA, 22 nt, Human
uuuuuuuuuuuuucuuugucuu

SEQ ID NO: 361422 - RNA, 24 nt, Human
uuuuuuuuuuuuuuuuucuuuggg

SEQ ID NO: 361423 - RNA, 24 nt, Human
aaagugcugggauuacaggcguga

SEQ ID NO: 361424 - RNA, 24 nt, Human
aaaugacucgugaccauggcugca

SEQ ID NO: 361425 - RNA, 20 nt, Human
aacuucgauuuugugacugu

SEQ ID NO: 361426 - RNA, 21 nt, Human
aagcaaucugcccgccugggc

SEQ ID NO: 361427 - RNA, 25 nt, Human
aaguagcuggaacuacaggcaccca

SEQ ID NO: 361428 - RNA, 19 nt, Human
aagugcugggauuacaggc

SEQ ID NO: 361429 - RNA, 19 nt, Human
aagugcugggauuacaggc

SEQ ID NO: 361430 - RNA, 22 nt, Human
acaacuuauaaaaauaacaccc

SEQ ID NO: 361431 - RNA, 21 nt, Human
acaggcacccaccaccaugcc

SEQ ID NO: 361432 - RNA, 21 nt, Human
acaggcacccaccaccaugcc

SEQ ID NO: 361433 - RNA, 18 nt, Human
acaggcgugagcaccaca

SEQ ID NO: 361434 - RNA, 19 nt, Human
acaggguuucaccaugcug

SEQ ID NO: 361435 - RNA, 24 nt, Human
acaggguuucaccaugcugcccag

SEQ ID NO: 361436 - RNA, 18 nt, Human
accaagaauaucaauaaa

SEQ ID NO: 361437 - RNA, 24 nt, Human
accaugcugcccaggcuggucuug

SEQ ID NO: 361438 - RNA, 25 nt, Human
accaugcugcccaggcuggucuuga

SEQ ID NO: 361439 - RNA, 23 nt, Human
acccagguuggagugcaguggug

SEQ ID NO: 361440 - RNA, 24 nt, Human
acucuugucacccagguuggagug

SEQ ID NO: 361441 - RNA, 19 nt, Human
agaaaugacucgugaccau

SEQ ID NO: 361442 - RNA, 21 nt, Human
agcagaaggcaguggcugaua

SEQ ID NO: 361443 - RNA, 21 nt, Human
agcucacugcagccuccuccu

SEQ ID NO: 361444 - RNA, 18 nt, Human
aggaaguggggacugagc

SEQ ID NO: 361445 - RNA, 25 nt, Human
aggaauucaacaacuuauaaaaaua

SEQ ID NO: 361446 - RNA, 21 nt, Human
aggcagaaaugacucgugacc

SEQ ID NO: 361447 - RNA, 20 nt, Human
agggauagggugcaggccau

SEQ ID NO: 361448 - RNA, 25 nt, Human
agguuggagugcaguggugcaaucu

SEQ ID NO: 361449 - RNA, 21 nt, Human
agugcaguggugcaaucuuag

SEQ ID NO: 361450 - RNA, 18 nt, Human
agugcugggauuacaggc

SEQ ID NO: 361451 - RNA, 22 nt, Human
auuuucccaccucagccuccca

SEQ ID NO: 361452 - RNA, 19 nt, Human
caaaaugagcauaagaaca

SEQ ID NO: 361453 - RNA, 24 nt, Human
caaagugcugggauuacaggcgug

SEQ ID NO: 361454 - RNA, 24 nt, Human
caccaugccuggcuaauuuuugua

SEQ ID NO: 361455 - RNA, 24 nt, Human
caccaugcugcccaggcuggucuu

SEQ ID NO: 361456 - RNA, 27 nt, Human
caccaugcugcccaggcuggucuugaa

SEQ ID NO: 361457 - RNA, 18 nt, Human
cacccaccaccaugccug

SEQ ID NO: 361458 - RNA, 24 nt, Human
cacccagguuggagugcaguggug

SEQ ID NO: 361459 - RNA, 21 nt, Human
cacccguaagcauucugaccu

SEQ ID NO: 361460 - RNA, 24 nt, Human
caccucagccucccaaguagcugg

SEQ ID NO: 361461 - RNA, 24 nt, Human
cacucuugucacccagguuggagu

SEQ ID NO: 361462 - RNA, 21 nt, Human
cacugcagccuccuccuccug

SEQ ID NO: 361463 - RNA, 21 nt, Human
cagcagaaggcaguggcugau

SEQ ID NO: 361464 - RNA, 23 nt, Human
cagccuccuccuccugggcucaa

SEQ ID NO: 361465 - RNA, 24 nt, Human
caggguuucaccaugcugcccagg

SEQ ID NO: 361466 - RNA, 24 nt, Human
caugcugcccaggcuggucuugaa

SEQ ID NO: 361467 - RNA, 20 nt, Human
ccaaagugcugggauuacag

SEQ ID NO: 361468 - RNA, 22 nt, Human
ccaaagugcugggauuacaggc

SEQ ID NO: 361469 - RNA, 22 nt, Human
ccaaagugcugggauuacaggc

SEQ ID NO: 361470 - RNA, 24 nt, Human
ccaaagugcugggauuacaggcgu

SEQ ID NO: 361471 - RNA, 24 nt, Human
ccagagcacaucaccuggauguga

SEQ ID NO: 361472 - RNA, 24 nt, Human
ccaggcuggucuugaacuccuggg

SEQ ID NO: 361473 - RNA, 18 nt, Human
ccauaggcuuagguuggg

SEQ ID NO: 361474 - RNA, 23 nt, Human
cccaacauugucccaugagagaa

SEQ ID NO: 361475 - RNA, 23 nt, Human
cccaccucagccucccaaguagc

SEQ ID NO: 361476 - RNA, 20 nt, Human
cccaccuccacgacaaggga

SEQ ID NO: 361477 - RNA, 24 nt, Human
ccccaaagugcugggauuacaggc

SEQ ID NO: 361478 - RNA, 24 nt, Human
cccguaagcauucugaccuuugcc

SEQ ID NO: 361479 - RNA, 23 nt, Human
cccuuuauuucuuuuuggugguu

SEQ ID NO: 361480 - RNA, 22 nt, Human
ccguaagcauucugaccuuugc

SEQ ID NO: 361481 - RNA, 28 nt, Human
ccuccacgacaagggagagugcuuuucg

SEQ ID NO: 361482 - RNA, 18 nt, Human
ccuccuccugggcucaag

SEQ ID NO: 361483 - RNA, 18 nt, Human
ccuggguucaagcaaucu

SEQ ID NO: 361484 - RNA, 22 nt, Human
ccuggguucaagcaaucugccc

SEQ ID NO: 361485 - RNA, 21 nt, Human
ccuuucucccucuugcagucc

SEQ ID NO: 361486 - RNA, 21 nt, Human
ccuuucucccucuugcagucc

SEQ ID NO: 361487 - RNA, 20 nt, Human
cgacaagggagagugcuuac

SEQ ID NO: 361488 - RNA, 24 nt, Human
cucaagucauuuucccaccucagc

SEQ ID NO: 361489 - RNA, 21 nt, Human
cucacugcagccuccuccucc

SEQ ID NO: 361490 - RNA, 23 nt, Human
cucacugcagccuccuccuccug

SEQ ID NO: 361491 - RNA, 24 nt, Human
cucacugcagccuccuccuccugg

SEQ ID NO: 361492 - RNA, 20 nt, Human
cuccuggguucaagcaaucu

SEQ ID NO: 361493 - RNA, 23 nt, Human
cugcagccuccuccuccugggcu

SEQ ID NO: 361494 - RNA, 21 nt, Human
cugggcuccccaaagugcugg

SEQ ID NO: 361495 - RNA, 19 nt, Human
cuggucuugaacuccuggg

SEQ ID NO: 361496 - RNA, 18 nt, Human
cuuagguuggguuuaugg

SEQ ID NO: 361497 - RNA, 24 nt, Human
cuugucacccagguuggagugcag

SEQ ID NO: 361498 - RNA, 19 nt, Human
gaaaaaccccaacauuguc

SEQ ID NO: 361499 - RNA, 20 nt, Human
gaacagauuacagacgcguc

SEQ ID NO: 361500 - RNA, 20 nt, Human
gaacagguuaagccaggaac

SEQ ID NO: 361501 - RNA, 21 nt, Human
gauuacaggcgugagcaccac

SEQ ID NO: 361502 - RNA, 22 nt, Human
gcucacugcagccuccuccucc

SEQ ID NO: 361503 - RNA, 20 nt, Human
gcuggaacuacaggcaccca

SEQ ID NO: 361504 - RNA, 18 nt, Human
ggaguugaaaggaaaaua

SEQ ID NO: 361505 - RNA, 18 nt, Human
ggcuggucuugaacuccu

SEQ ID NO: 361506 - RNA, 21 nt, Human
guagauacaggguuucaccau

SEQ ID NO: 361507 - RNA, 22 nt, Human
guagauacaggguuucaccaug

SEQ ID NO: 361508 - RNA, 18 nt, Human
gucauuuucccaccucag

SEQ ID NO: 361509 - RNA, 25 nt, Human
guugcaauacagaauaauuuugauu

SEQ ID NO: 361510 - RNA, 23 nt, Human
uaaaaaaaaagccaagcugcuua

SEQ ID NO: 361511 - RNA, 28 nt, Human
uaaaaaaaaagccaagcugcuuaucacu

SEQ ID NO: 361512 - RNA, 21 nt, Human
uaacuucgauuuugugacugu

SEQ ID NO: 361513 - RNA, 22 nt, Human
uaauuuuuguauuuuuuguaga

SEQ ID NO: 361514 - RNA, 23 nt, Human
uacaggcgugagcaccacacuca

SEQ ID NO: 361515 - RNA, 20 nt, Human
uacaggguuucaccaugcug

SEQ ID NO: 361516 - RNA, 18 nt, Human
uaccagagcacaucaccu

SEQ ID NO: 361517 - RNA, 21 nt, Human
uaccagagcacaucaccugga

SEQ ID NO: 361518 - RNA, 19 nt, Human
uacucgugaaaaacagcag

SEQ ID NO: 361519 - RNA, 21 nt, Human
uagauacaggguuucaccaug

SEQ ID NO: 361520 - RNA, 23 nt, Human
uagcucacugcagccuccuccuc

SEQ ID NO: 361521 - RNA, 26 nt, Human
uaggcuuagguuggguuuaugggggu

SEQ ID NO: 361522 - RNA, 20 nt, Human
uagggugcaggccauuguuu

SEQ ID NO: 361523 - RNA, 23 nt, Human
uaucaauaaauacuaauaguuug

SEQ ID NO: 361524 - RNA, 19 nt, Human
uauuuuuuguagauacagg

SEQ ID NO: 361525 - RNA, 22 nt, Human
ucacacacacaagggauagggu

SEQ ID NO: 361526 - RNA, 22 nt, Human
ucacccagguuggagugcagug

SEQ ID NO: 361527 - RNA, 23 nt, Human
ucacucuugucacccagguugga

SEQ ID NO: 361528 - RNA, 24 nt, Human
ucacugcagccuccuccuccuggg

SEQ ID NO: 361529 - RNA, 20 nt, Human
ucagccucccaaguagcugg

SEQ ID NO: 361530 - RNA, 25 nt, Human
uccauaccagagcacaucaccugga

SEQ ID NO: 361531 - RNA, 24 nt, Human
ucccaaguagcuggaacuacaggc

SEQ ID NO: 361532 - RNA, 20 nt, Human
uccccaaagugcugggauua

SEQ ID NO: 361533 - RNA, 24 nt, Human
uccccaaagugcugggauuacagg

SEQ ID NO: 361534 - RNA, 20 nt, Human
uccucaaaugaauaaaaaaa

SEQ ID NO: 361535 - RNA, 23 nt, Human
uccucaaaugaauaaaaaaauau

SEQ ID NO: 361536 - RNA, 21 nt, Human
uccugggcucaagucauuuuc

SEQ ID NO: 361537 - RNA, 22 nt, Human
uccugggcucaagucauuuucc

SEQ ID NO: 361538 - RNA, 24 nt, Human
uccugggcucaagucauuuuccca

SEQ ID NO: 361539 - RNA, 18 nt, Human
uccuggguucaagcaauc

SEQ ID NO: 361540 - RNA, 18 nt, Human
uccuggguucaagcaauc

SEQ ID NO: 361541 - RNA, 20 nt, Human
uccuggguucaagcaaucug

SEQ ID NO: 361542 - RNA, 22 nt, Human
uccuucuguuggagcacuuuga

SEQ ID NO: 361543 - RNA, 26 nt, Human
ucgugaccauggcugcaaauggggcu

SEQ ID NO: 361544 - RNA, 23 nt, Human
ucuaaauuaaggaauucaacaac

SEQ ID NO: 361545 - RNA, 23 nt, Human
ucuugaacuccuggguucaagca

SEQ ID NO: 361546 - RNA, 21 nt, Human
ugaaaaaccccaacauugucc

SEQ ID NO: 361547 - RNA, 30 nt, Human
ugaaaaaccccaacauugucccaugagagg

SEQ ID NO: 361548 - RNA, 24 nt, Human
ugaacuccuggguucaagcaaucu

SEQ ID NO: 361549 - RNA, 20 nt, Human
ugacuguggauuccauaggc

SEQ ID NO: 361550 - RNA, 21 nt, Human
ugagagagaauauugugagug

SEQ ID NO: 361551 - RNA, 22 nt, Human
ugcaguggugcaaucuuagcuc

SEQ ID NO: 361552 - RNA, 26 nt, Human
ugcccaccuccacgacaagggagagu

SEQ ID NO: 361553 - RNA, 24 nt, Human
ugcccaggcuggucuugaacuccu

SEQ ID NO: 361554 - RNA, 25 nt, Human
ugcccaggcuggucuugaacuccug

SEQ ID NO: 361555 - RNA, 22 nt, Human
ugcugcccaggcuggucuugaa

SEQ ID NO: 361556 - RNA, 23 nt, Human
ugcugggauuacaggcgugagca

SEQ ID NO: 361557 - RNA, 21 nt, Human
uggaacuacaggcacccacca

SEQ ID NO: 361558 - RNA, 24 nt, Human
uggaacuacaggcacccaccacca

SEQ ID NO: 361559 - RNA, 18 nt, Human
uggagugcaguggugcaa

SEQ ID NO: 361560 - RNA, 23 nt, Human
uggagugcaguggugcaaucuua

SEQ ID NO: 361561 - RNA, 24 nt, Human
uggagugcaguggugcaaucuuag

SEQ ID NO: 361562 - RNA, 21 nt, Human
uggcagcagaaggcaguggcu

SEQ ID NO: 361563 - RNA, 18 nt, Human
ugggauuacaggcgugag

SEQ ID NO: 361564 - RNA, 19 nt, Human
ugggauuacaggcgugagc

SEQ ID NO: 361565 - RNA, 23 nt, Human
ugggauuacaggcgugagcacca

SEQ ID NO: 361566 - RNA, 24 nt, Human
ugggcucaagucauuuucccaccu

SEQ ID NO: 361567 - RNA, 21 nt, Human
uggguucaagcaaucugcccg

SEQ ID NO: 361568 - RNA, 24 nt, Human
uggugcaaucuuagcucacugcag

SEQ ID NO: 361569 - RNA, 19 nt, Human
uuacaggcgugagcaccac

SEQ ID NO: 361570 - RNA, 23 nt, Human
uuagugccaaggccccauugggg

SEQ ID NO: 361571 - RNA, 24 nt, Human
uucacucuugucacccagguugga

SEQ ID NO: 361572 - RNA, 23 nt, Human
uucccaccucagccucccaagua

SEQ ID NO: 361573 - RNA, 20 nt, Human
uuccucuggcucuauaaucu

SEQ ID NO: 361574 - RNA, 22 nt, Human
uugcaggaaguggggacugagc

SEQ ID NO: 361575 - RNA, 18 nt, Human
uugcccaccuccacgacu

SEQ ID NO: 361576 - RNA, 19 nt, Human
uugcugagacccuggaagu

SEQ ID NO: 361577 - RNA, 24 nt, Human
uuguagauacaggguuucaccaug

SEQ ID NO: 361578 - RNA, 24 nt, Human
uuucacucuugucacccagguugg

SEQ ID NO: 361579 - RNA, 23 nt, Human
uuucccaccucagccucccaagu

SEQ ID NO: 361580 - RNA, 24 nt, Human
uuuguagauacaggguuucaccau

SEQ ID NO: 361581 - RNA, 18 nt, Human
uuuuuguauuuuuuguag

SEQ ID NO: 361582 - RNA, 21 nt, Human
uuuuuguauuuuuuguagaua

SEQ ID NO: 361583 - RNA, 24 nt, Human
uuuuuuguagauacaggguuucac

SEQ ID NO: 361584 - RNA, 24 nt, Human
aaagugcugggauuacaggcguga

SEQ ID NO: 361585 - RNA, 23 nt, Human
aagcaaacuuggaccuucucaau

SEQ ID NO: 361586 - RNA, 19 nt, Human
aaguagcugggaauacagg

SEQ ID NO: 361587 - RNA, 19 nt, Human
aagugcugggauuacaggc

SEQ ID NO: 361588 - RNA, 19 nt, Human
aagugcugggauuacaggc

SEQ ID NO: 361589 - RNA, 26 nt, Human
aagugcugggauuacaggcgugagcc

SEQ ID NO: 361590 - RNA, 25 nt, Human
aauccguugcccaggcuggagugca

SEQ ID NO: 361591 - RNA, 24 nt, Human
aaucucuugaaccugggaggugga

SEQ ID NO: 361592 - RNA, 24 nt, Human
aauggccgggugcggcggcccacg

SEQ ID NO: 361593 - RNA, 21 nt, Human
aauguggugaaaccccgucuc

SEQ ID NO: 361594 - RNA, 21 nt, Human
acagaccaaagggaaggcuaa

SEQ ID NO: 361595 - RNA, 23 nt, Human
acagagcaaacugugucucaaaa

SEQ ID NO: 361596 - RNA, 24 nt, Human
accccgucucuacuaaaaauacaa

SEQ ID NO: 361597 - RNA, 25 nt, Human
acccgccucggccucccaaagugcu

SEQ ID NO: 361598 - RNA, 25 nt, Human
accucccggguucacgccauuuucc

SEQ ID NO: 361599 - RNA, 21 nt, Human
acugggauuacaauuugagau

SEQ ID NO: 361600 - RNA, 19 nt, Human
agaacagaccaaagggaag

SEQ ID NO: 361601 - RNA, 24 nt, Human
agaagagggcaaguuccccacaaa

SEQ ID NO: 361602 - RNA, 24 nt, Human
agacagaagaaucucuugaaccug

SEQ ID NO: 361603 - RNA, 23 nt, Human
agcagggugugguggcacacacu

SEQ ID NO: 361604 - RNA, 19 nt, Human
agccuggccaaugugguga

SEQ ID NO: 361605 - RNA, 22 nt, Human
agccuggccaauguggugaaac

SEQ ID NO: 361606 - RNA, 24 nt, Human
agccuggccaauguggugaaaccc

SEQ ID NO: 361607 - RNA, 21 nt, Human
aggccgagucggguggaucac

SEQ ID NO: 361608 - RNA, 23 nt, Human
aggcgugagccaccgugcccggc

SEQ ID NO: 361609 - RNA, 25 nt, Human
aggcuggagugcaguggcgugaucu

SEQ ID NO: 361610 - RNA, 25 nt, Human
aggggaagcaaacuuggaccuucuc

SEQ ID NO: 361611 - RNA, 24 nt, Human
agguggagguugcagugagccaag

SEQ ID NO: 361612 - RNA, 18 nt, Human
agguguggacacagagcc

SEQ ID NO: 361613 - RNA, 21 nt, Human
aguagagaugggucucaccau

SEQ ID NO: 361614 - RNA, 23 nt, Human
agugcaguggcgugaucuuggcu

SEQ ID NO: 361615 - RNA, 24 nt, Human
agugcaguggcgugaucuuggcuc

SEQ ID NO: 361616 - RNA, 24 nt, Human
aguguacuccagccugggugacag

SEQ ID NO: 361617 - RNA, 28 nt, Human
auacauuucaaaacaaaauugugccccg

SEQ ID NO: 361618 - RNA, 24 nt, Human
auagugccaguguacuccagccug

SEQ ID NO: 361619 - RNA, 21 nt, Human
aucauucugccccuggccccu

SEQ ID NO: 361620 - RNA, 20 nt, Human
aucuggacggcgugcugaag

SEQ ID NO: 361621 - RNA, 18 nt, Human
auguucgccaggaugguc

SEQ ID NO: 361622 - RNA, 22 nt, Human
auucugccccuggccccuccca

SEQ ID NO: 361623 - RNA, 21 nt, Human
auuuuccugccucagccuccc

SEQ ID NO: 361624 - RNA, 24 nt, Human
auuuuuaguagagaugggucucac

SEQ ID NO: 361625 - RNA, 23 nt, Human
caaaccauaucauucugccccug

SEQ ID NO: 361626 - RNA, 24 nt, Human
caaagugcugggauuacaggcgug

SEQ ID NO: 361627 - RNA, 22 nt, Human
caagauagugccaguguacucc

SEQ ID NO: 361628 - RNA, 23 nt, Human
caagucccuuccaccuaugagcc

SEQ ID NO: 361629 - RNA, 24 nt, Human
caauccguugcccaggcuggagug

SEQ ID NO: 361630 - RNA, 18 nt, Human
caccauguucgccaggau

SEQ ID NO: 361631 - RNA, 24 nt, Human
caccauguucgccaggauggucuc

SEQ ID NO: 361632 - RNA, 23 nt, Human
cacccgccucggccucccaaagu

SEQ ID NO: 361633 - RNA, 19 nt, Human
caccucccggguucacgcc

SEQ ID NO: 361634 - RNA, 22 nt, Human
cacgccauuuuccugccucagc

SEQ ID NO: 361635 - RNA, 24 nt, Human
cacgccuguaaucccagcacuuug

SEQ ID NO: 361636 - RNA, 18 nt, Human
cagaagagagagauggug

SEQ ID NO: 361637 - RNA, 20 nt, Human
cagcacuuugagaggccgag

SEQ ID NO: 361638 - RNA, 24 nt, Human
cagcacuuugagaggccgagucgg

SEQ ID NO: 361639 - RNA, 20 nt, Human
cagcaugggggaaaccgcuc

SEQ ID NO: 361640 - RNA, 19 nt, Human
caggugcccgccaccaugc

SEQ ID NO: 361641 - RNA, 22 nt, Human
caguguacuccagccuggguga

SEQ ID NO: 361642 - RNA, 23 nt, Human
caguguacuccagccugggugac

SEQ ID NO: 361643 - RNA, 25 nt, Human
caguguacuccagccugggugacag

SEQ ID NO: 361644 - RNA, 20 nt, Human
cauacacgcuucuuuguguu

SEQ ID NO: 361645 - RNA, 21 nt, Human
cauugcuggggaggccucagg

SEQ ID NO: 361646 - RNA, 21 nt, Human
ccaaaccauaucauucugccc

SEQ ID NO: 361647 - RNA, 22 nt, Human
ccaaagugcugggauuacaggc

SEQ ID NO: 361648 - RNA, 22 nt, Human
ccaaagugcugggauuacaggc

SEQ ID NO: 361649 - RNA, 24 nt, Human
ccaaagugcugggauuacaggcgu

SEQ ID NO: 361650 - RNA, 23 nt, Human
ccaccuaugagccaguaaaauca

SEQ ID NO: 361651 - RNA, 19 nt, Human
ccacgccuguaaucccagc

SEQ ID NO: 361652 - RNA, 20 nt, Human
ccaguaaaaucaaaagcaaa

SEQ ID NO: 361653 - RNA, 22 nt, Human
ccagucaccuugcccugggucc

SEQ ID NO: 361654 - RNA, 21 nt, Human
ccaguguacuccagccugggu

SEQ ID NO: 361655 - RNA, 21 nt, Human
ccaguguacuccagccugggu

SEQ ID NO: 361656 - RNA, 22 nt, Human
ccaguguacuccagccugggug

SEQ ID NO: 361657 - RNA, 24 nt, Human
ccaguguacuccagccugggugac

SEQ ID NO: 361658 - RNA, 23 nt, Human
cccaaguagcugggaauacaggu

SEQ ID NO: 361659 - RNA, 22 nt, Human
cccacgccuguaaucccagcac

SEQ ID NO: 361660 - RNA, 24 nt, Human
cccacgccuguaaucccagcacuu

SEQ ID NO: 361661 - RNA, 23 nt, Human
cccggguucacgccauuuuccug

SEQ ID NO: 361662 - RNA, 20 nt, Human
ccuagcuacugggaggcuga

SEQ ID NO: 361663 - RNA, 20 nt, Human
ccugaccucgugauccaccc

SEQ ID NO: 361664 - RNA, 23 nt, Human
ccuggccaauguggugaaacccc

SEQ ID NO: 361665 - RNA, 24 nt, Human
ccuggccaauguggugaaaccccg

SEQ ID NO: 361666 - RNA, 21 nt, Human
ccugggagguggagguugcag

SEQ ID NO: 361667 - RNA, 18 nt, Human
ccugggugacagagcaaa

SEQ ID NO: 361668 - RNA, 24 nt, Human
cgagaccagccuggccaauguggu

SEQ ID NO: 361669 - RNA, 24 nt, Human
cgccucggccucccaaagugcugg

SEQ ID NO: 361670 - RNA, 18 nt, Human
cgccuguaaucccagcac

SEQ ID NO: 361671 - RNA, 22 nt, Human
cggcccacgccuguaaucccag

SEQ ID NO: 361672 - RNA, 24 nt, Human
cggcccacgccuguaaucccagca

SEQ ID NO: 361673 - RNA, 24 nt, Human
cggguggaucacuugacgucagaa

SEQ ID NO: 361674 - RNA, 21 nt, Human
cguugcccaggcuggagugca

SEQ ID NO: 361675 - RNA, 24 nt, Human
cucacugcaagcuccaccucccgg

SEQ ID NO: 361676 - RNA, 24 nt, Human
cuccugaccucgugauccacccgc

SEQ ID NO: 361677 - RNA, 24 nt, Human
cugcaagcuccaccucccggguuc

SEQ ID NO: 361678 - RNA, 23 nt, Human
cugccucagccucccaaguagcu

SEQ ID NO: 361679 - RNA, 24 nt, Human
cugugucucaaaaaaaaaaaaaaa

SEQ ID NO: 361680 - RNA, 21 nt, Human
cuugaaccugggagguggagg

SEQ ID NO: 361681 - RNA, 22 nt, Human
gaaagcuaaggguauaaagucu

SEQ ID NO: 361682 - RNA, 24 nt, Human
gaauacaggugcccgccaccaugc

SEQ ID NO: 361683 - RNA, 22 nt, Human
gaccucgugauccacccgccuc

SEQ ID NO: 361684 - RNA, 22 nt, Human
gaccucgugauccacccgccuc

SEQ ID NO: 361685 - RNA, 28 nt, Human
gagaacagcaugggggaaaccgguaccc

SEQ ID NO: 361686 - RNA, 18 nt, Human
gagguugcagugagccaa

SEQ ID NO: 361687 - RNA, 21 nt, Human
gagguugcagugagccaagau

SEQ ID NO: 361688 - RNA, 25 nt, Human
gagucggguggaucacuugacguca

SEQ ID NO: 361689 - RNA, 24 nt, Human
gaucacuugacgucagaaguucga

SEQ ID NO: 361690 - RNA, 20 nt, Human
gauccagucaccuugcccug

SEQ ID NO: 361691 - RNA, 18 nt, Human
gauuacaggcgugagcca

SEQ ID NO: 361692 - RNA, 20 nt, Human
gauuacaggcgugagccacc

SEQ ID NO: 361693 - RNA, 21 nt, Human
gauuacaggcgugagccaccg

SEQ ID NO: 361694 - RNA, 24 nt, Human
gccaauguggugaaaccccgucuc

SEQ ID NO: 361695 - RNA, 19 nt, Human
gccaguguacuccagccug

SEQ ID NO: 361696 - RNA, 24 nt, Human
gccaguguacuccagccuggguga

SEQ ID NO: 361697 - RNA, 20 nt, Human
gcccaggcuggagugcagug

SEQ ID NO: 361698 - RNA, 24 nt, Human
gcccaggcuggagugcaguggcgu

SEQ ID NO: 361699 - RNA, 20 nt, Human
gccucagccucccaaguagc

SEQ ID NO: 361700 - RNA, 23 nt, Human
gccuggcuaauuuuuuguauuuu

SEQ ID NO: 361701 - RNA, 23 nt, Human
gcggcccacgccuguaaucccag

SEQ ID NO: 361702 - RNA, 20 nt, Human
ggaaagcuaaggguauaaag

SEQ ID NO: 361703 - RNA, 20 nt, Human
ggaagcaaacuuggaccuuc

SEQ ID NO: 361704 - RNA, 18 nt, Human
ggagguugcagugagcca

SEQ ID NO: 361705 - RNA, 20 nt, Human
ggagguugcagugagccaag

SEQ ID NO: 361706 - RNA, 24 nt, Human
ggauggucucgaucuccugaccuc

SEQ ID NO: 361707 - RNA, 24 nt, Human
ggcggcccacgccuguaaucccag

SEQ ID NO: 361708 - RNA, 22 nt, Human
ggcuggagugcaguggcgugau

SEQ ID NO: 361709 - RNA, 24 nt, Human
gggugcggcggcccacgccuguaa

SEQ ID NO: 361710 - RNA, 24 nt, Human
guacuccagccugggugacagagc

SEQ ID NO: 361711 - RNA, 18 nt, Human
gucacagccacucuucua

SEQ ID NO: 361712 - RNA, 24 nt, Human
gugauccacccgccucggccuccc

SEQ ID NO: 361713 - RNA, 21 nt, Human
guguacuccagccugggugac

SEQ ID NO: 361714 - RNA, 21 nt, Human
uaaaaucaaaagcaaauggcc

SEQ ID NO: 361715 - RNA, 26 nt, Human
uaaaaucaaaagcaaauggccgggug

SEQ ID NO: 361716 - RNA, 24 nt, Human
uaauuuuuuguauuuuuaguagag

SEQ ID NO: 361717 - RNA, 25 nt, Human
uaauuuuuuguauuuuuaguagaga

SEQ ID NO: 361718 - RNA, 23 nt, Human
uacaggcgugagccaccgugccc

SEQ ID NO: 361719 - RNA, 22 nt, Human
uacuccagccugggugacagag

SEQ ID NO: 361720 - RNA, 21 nt, Human
uagagaugggucucaccaugu

SEQ ID NO: 361721 - RNA, 23 nt, Human
uagcaacagucccccaaagucuu

SEQ ID NO: 361722 - RNA, 19 nt, Human
uagcagggugugguggcac

SEQ ID NO: 361723 - RNA, 23 nt, Human
uaguagagaugggucucaccaug

SEQ ID NO: 361724 - RNA, 21 nt, Human
uaucacgagaacagcaugggg

SEQ ID NO: 361725 - RNA, 22 nt, Human
uaugagccaguaaaaucaaaag

SEQ ID NO: 361726 - RNA, 24 nt, Human
ucaauccguugcccaggcuggagu

SEQ ID NO: 361727 - RNA, 22 nt, Human
ucacagaacagaccaaagggaa

SEQ ID NO: 361728 - RNA, 23 nt, Human
ucaccuugcccuggguccugccc

SEQ ID NO: 361729 - RNA, 24 nt, Human
ucacugcaagcuccaccucccggg

SEQ ID NO: 361730 - RNA, 20 nt, Human
ucagccucccaaguagcugg

SEQ ID NO: 361731 - RNA, 18 nt, Human
uccagccugggugacaga

SEQ ID NO: 361732 - RNA, 24 nt, Human
ucccaaagugcugggauuacaggc

SEQ ID NO: 361733 - RNA, 24 nt, Human
ucccaaguagcugggaauacaggu

SEQ ID NO: 361734 - RNA, 24 nt, Human
ucccggguucacgccauuuuccug

SEQ ID NO: 361735 - RNA, 18 nt, Human
ucggccucccaaagugcu

SEQ ID NO: 361736 - RNA, 23 nt, Human
ucuaaacuaaacauaucuuugau

SEQ ID NO: 361737 - RNA, 19 nt, Human
ucucaaaaaaaaaaaaaaa

SEQ ID NO: 361738 - RNA, 24 nt, Human
ucucaauccguugcccaggcugga

SEQ ID NO: 361739 - RNA, 21 nt, Human
ucucuacuaaaaauacaaaaa

SEQ ID NO: 361740 - RNA, 22 nt, Human
ucucuugaaccugggaggugga

SEQ ID NO: 361741 - RNA, 24 nt, Human
ucucuugaaccugggagguggagg

SEQ ID NO: 361742 - RNA, 24 nt, Human
ucugccccuggccccucccagaua

SEQ ID NO: 361743 - RNA, 21 nt, Human
ucuuauccuggggaucuggac

SEQ ID NO: 361744 - RNA, 24 nt, Human
ugaaccugggagguggagguugca

SEQ ID NO: 361745 - RNA, 24 nt, Human
ugagacagaagaaucucuugaacc

SEQ ID NO: 361746 - RNA, 19 nt, Human
ugagacagagucucaaucc

SEQ ID NO: 361747 - RNA, 24 nt, Human
ugagaggccgagucggguggauca

SEQ ID NO: 361748 - RNA, 22 nt, Human
ugagccaguaaaaucaaaagca

SEQ ID NO: 361749 - RNA, 22 nt, Human
ugcaguggcgugaucuuggcuc

SEQ ID NO: 361750 - RNA, 18 nt, Human
ugcccaggcuggagugca

SEQ ID NO: 361751 - RNA, 21 nt, Human
ugcccaggcuggagugcagug

SEQ ID NO: 361752 - RNA, 22 nt, Human
ugcccaggcuggagugcagugg

SEQ ID NO: 361753 - RNA, 24 nt, Human
ugcccaggcuggagugcaguggcg

SEQ ID NO: 361754 - RNA, 18 nt, Human
ugcccuggguccugcccu

SEQ ID NO: 361755 - RNA, 22 nt, Human
ugcccuggguccugcccucaac

SEQ ID NO: 361756 - RNA, 24 nt, Human
ugccucagccucccaaguagcugg

SEQ ID NO: 361757 - RNA, 23 nt, Human
ugccuuagcaacagucccccaaa

SEQ ID NO: 361758 - RNA, 18 nt, Human
ugcugaagccugaauuua

SEQ ID NO: 361759 - RNA, 24 nt, Human
ugcugggauuacaggcgugagcca

SEQ ID NO: 361760 - RNA, 21 nt, Human
uggaaggcgaaggggaagcaa

SEQ ID NO: 361761 - RNA, 18 nt, Human
uggacacagagccaaacc

SEQ ID NO: 361762 - RNA, 19 nt, Human
uggagugcaguggcgugau

SEQ ID NO: 361763 - RNA, 23 nt, Human
uggagugcaguggcgugaucuug

SEQ ID NO: 361764 - RNA, 24 nt, Human
uggagugcaguggcgugaucuugg

SEQ ID NO: 361765 - RNA, 24 nt, Human
uggaucacuugacgucagaaguuc

SEQ ID NO: 361766 - RNA, 24 nt, Human
uggccaauguggugaaaccccguc

SEQ ID NO: 361767 - RNA, 23 nt, Human
uggccgggugcggcggcccacgg

SEQ ID NO: 361768 - RNA, 19 nt, Human
uggcucacugcaagcucca

SEQ ID NO: 361769 - RNA, 21 nt, Human
ugggaauacaggugcccgcca

SEQ ID NO: 361770 - RNA, 22 nt, Human
ugggaauacaggugcccgccac

SEQ ID NO: 361771 - RNA, 24 nt, Human
ugggaauacaggugcccgccacca

SEQ ID NO: 361772 - RNA, 27 nt, Human
ugggaggcugagacagaagaaucucuu

SEQ ID NO: 361773 - RNA, 18 nt, Human
ugggagguggagguugca

SEQ ID NO: 361774 - RNA, 29 nt, Human
ugggagguggagguugcagugacaacggu

SEQ ID NO: 361775 - RNA, 24 nt, Human
ugggagguggagguugcagugagc

SEQ ID NO: 361776 - RNA, 18 nt, Human
ugggauuacaggcgugag

SEQ ID NO: 361777 - RNA, 21 nt, Human
ugggauuacaggcgugagcca

SEQ ID NO: 361778 - RNA, 22 nt, Human
ugggauuacaggcgugagccac

SEQ ID NO: 361779 - RNA, 23 nt, Human
ugggauuacaggcgugagccacc

SEQ ID NO: 361780 - RNA, 23 nt, Human
ugggauuacaggcgugagccacc

SEQ ID NO: 361781 - RNA, 24 nt, Human
ugggauuacaggcgugagccaccg

SEQ ID NO: 361782 - RNA, 20 nt, Human
ugggugacagagcaaacugu

SEQ ID NO: 361783 - RNA, 19 nt, Human
uggugaaaccccgucucua

SEQ ID NO: 361784 - RNA, 22 nt, Human
ugguguggagcaggaaccugcc

SEQ ID NO: 361785 - RNA, 18 nt, Human
uguggacacagagccaaa

SEQ ID NO: 361786 - RNA, 24 nt, Human
uguggagcaggaaccugccaaaca

SEQ ID NO: 361787 - RNA, 18 nt, Human
uuagcagggugugguggc

SEQ ID NO: 361788 - RNA, 19 nt, Human
uuagcagggugugguggca

SEQ ID NO: 361789 - RNA, 23 nt, Human
uuaguagagaugggucucaccau

SEQ ID NO: 361790 - RNA, 24 nt, Human
uuaguagagaugggucucaccaug

SEQ ID NO: 361791 - RNA, 24 nt, Human
uugaaccugggagguggagguugc

SEQ ID NO: 361792 - RNA, 23 nt, Human
uugagacagagucucaauccguu

SEQ ID NO: 361793 - RNA, 22 nt, Human
uugcagugagccaagauagugc

SEQ ID NO: 361794 - RNA, 24 nt, Human
uuuaguagagaugggucucaccau

SEQ ID NO: 361795 - RNA, 21 nt, Human
uuuuuguauuuuuaguagaga

SEQ ID NO: 361796 - RNA, 24 nt, Human
uuuuuuguauuuuuaguagagaug

SEQ ID NO: 361797 - RNA, 20 nt, Human
uuuuuuuuuuugagacagag

SEQ ID NO: 361798 - RNA, 26 nt, Human
uuuuuuuuuuuugagacagagucuca

SEQ ID NO: 361799 - RNA, 26 nt, Human
aaaaaaaaaaaaaaaaaagaaaagaa

SEQ ID NO: 361800 - RNA, 24 nt, Human
aaaaaaaaaaaagaaaagaaaaag

SEQ ID NO: 361801 - RNA, 21 nt, Human
aaaaaaaagaaaagaaaaaga

SEQ ID NO: 361802 - RNA, 21 nt, Human
aaaaaaagaaaagaaaaagaa

SEQ ID NO: 361803 - RNA, 21 nt, Human
aaaaaucauuacucggccuuc

SEQ ID NO: 361804 - RNA, 23 nt, Human
aaaauaacaaaaacccaaaggua

SEQ ID NO: 361805 - RNA, 20 nt, Human
aaacaaaauaacaaaaaccc

SEQ ID NO: 361806 - RNA, 21 nt, Human
aaacaaaauaacaaaaaccca

SEQ ID NO: 361807 - RNA, 28 nt, Human
aaacaaaauaacaaaaacccaaagguaa

SEQ ID NO: 361808 - RNA, 19 nt, Human
aacauggugaaaccccauc

SEQ ID NO: 361809 - RNA, 20 nt, Human
aacauggugaaaccccaucu

SEQ ID NO: 361810 - RNA, 21 nt, Human
aacauggugaaaccccaucuc

SEQ ID NO: 361811 - RNA, 21 nt, Human
aacauggugaaaccccaucuc

SEQ ID NO: 361812 - RNA, 19 nt, Human
aagaaaaagaaaaaagaaa

SEQ ID NO: 361813 - RNA, 23 nt, Human
aagagcaaaacucugucucaaaa

SEQ ID NO: 361814 - RNA, 22 nt, Human
aagccuuucaaacagaagacuu

SEQ ID NO: 361815 - RNA, 24 nt, Human
aauaacaaaaacccaaagguaaag

SEQ ID NO: 361816 - RNA, 24 nt, Human
aauuacuugaaccugggaggcgga

SEQ ID NO: 361817 - RNA, 21 nt, Human
accagcuggcccuuaucacag

SEQ ID NO: 361818 - RNA, 24 nt, Human
accccaucucuacuaaaaauacaa

SEQ ID NO: 361819 - RNA, 28 nt, Human
acucugucucaaaaaaaaaaaaaaaaaa

SEQ ID NO: 361820 - RNA, 20 nt, Human
acuugaaccugggaggcgga

SEQ ID NO: 361821 - RNA, 21 nt, Human
agaaaagaaaaagaaaaaaga

SEQ ID NO: 361822 - RNA, 22 nt, Human
agaugaccaauguggggugggc

SEQ ID NO: 361823 - RNA, 24 nt, Human
agcacuuuggcaggccgagguggg

SEQ ID NO: 361824 - RNA, 23 nt, Human
agccuguaaucccagcacuuugg

SEQ ID NO: 361825 - RNA, 21 nt, Human
agcucaagccuguaaucccag

SEQ ID NO: 361826 - RNA, 20 nt, Human
agcugggcgugguggugcau

SEQ ID NO: 361827 - RNA, 23 nt, Human
agcugggcgugguggugcaugcc

SEQ ID NO: 361828 - RNA, 22 nt, Human
aggcaggagaauuacuugaacc

SEQ ID NO: 361829 - RNA, 24 nt, Human
aggcaggagaauuacuugaaccug

SEQ ID NO: 361830 - RNA, 21 nt, Human
aggccgaggugggcagaucac

SEQ ID NO: 361831 - RNA, 20 nt, Human
aggcggagguugcagugagc

SEQ ID NO: 361832 - RNA, 24 nt, Human
aggcggagguugcagugagcugag

SEQ ID NO: 361833 - RNA, 21 nt, Human
aggcugaggcaggagaauuac

SEQ ID NO: 361834 - RNA, 24 nt, Human
aggcugaggcaggagaauuacuug

SEQ ID NO: 361835 - RNA, 20 nt, Human
aggggccauccaauggagug

SEQ ID NO: 361836 - RNA, 20 nt, Human
auagcugggcgugguggugc

SEQ ID NO: 361837 - RNA, 24 nt, Human
aucgugccauugcacuccagccug

SEQ ID NO: 361838 - RNA, 23 nt, Human
augccgcuaaucccagccacucg

SEQ ID NO: 361839 - RNA, 18 nt, Human
auugcacuccagccugga

SEQ ID NO: 361840 - RNA, 25 nt, Human
auugcacuccagccuggacaacaag

SEQ ID NO: 361841 - RNA, 21 nt, Human
caaaaauagcugggcguggug

SEQ ID NO: 361842 - RNA, 23 nt, Human
caaacagaagacuucuuccagaa

SEQ ID NO: 361843 - RNA, 24 nt, Human
caagccuguaaucccagcacuuug

SEQ ID NO: 361844 - RNA, 19 nt, Human
cacagccauuuuaaaccug

SEQ ID NO: 361845 - RNA, 20 nt, Human
cacuccagccuggacaacaa

SEQ ID NO: 361846 - RNA, 24 nt, Human
cacuccagccuggacaacaagagc

SEQ ID NO: 361847 - RNA, 24 nt, Human
cacuuuuggccuuggcuccugccu

SEQ ID NO: 361848 - RNA, 21 nt, Human
cagcacuuuggcaggccgagg

SEQ ID NO: 361849 - RNA, 24 nt, Human
cagcacuuuggcaggccgaggugg

SEQ ID NO: 361850 - RNA, 24 nt, Human
cagccacucgggaggcugaggcag

SEQ ID NO: 361851 - RNA, 21 nt, Human
cagcuggcccuuaucacagcc

SEQ ID NO: 361852 - RNA, 21 nt, Human
cagggcuccugcgacugccgg

SEQ ID NO: 361853 - RNA, 18 nt, Human
caggggccauccaaugga

SEQ ID NO: 361854 - RNA, 18 nt, Human
cauugcacuccagccugg

SEQ ID NO: 361855 - RNA, 19 nt, Human
cauugcacuccagccugga

SEQ ID NO: 361856 - RNA, 20 nt, Human
cauugcacuccagccuggac

SEQ ID NO: 361857 - RNA, 21 nt, Human
cauugcacuccagccuggaca

SEQ ID NO: 361858 - RNA, 24 nt, Human
cauugcacuccagccuggacaaca

SEQ ID NO: 361859 - RNA, 23 nt, Human
ccagcuggcccuuaucacagcca

SEQ ID NO: 361860 - RNA, 22 nt, Human
ccaguccauccuccacuugccu

SEQ ID NO: 361861 - RNA, 19 nt, Human
ccauugcacuccagccugg

SEQ ID NO: 361862 - RNA, 20 nt, Human
ccauugcacuccagccugga

SEQ ID NO: 361863 - RNA, 21 nt, Human
ccauugcacuccagccuggac

SEQ ID NO: 361864 - RNA, 22 nt, Human
ccauugcacuccagccuggaca

SEQ ID NO: 361865 - RNA, 24 nt, Human
ccugcuaccugggggcagagguug

SEQ ID NO: 361866 - RNA, 22 nt, Human
ccugguuaacauggugaaaccc

SEQ ID NO: 361867 - RNA, 23 nt, Human
ccugguuaacauggugaaacccc

SEQ ID NO: 361868 - RNA, 24 nt, Human
ccugguuaacauggugaaacccca

SEQ ID NO: 361869 - RNA, 24 nt, Human
cgagaccauccugguuaacauggu

SEQ ID NO: 361870 - RNA, 24 nt, Human
cgaggugggcagaucaccagguca

SEQ ID NO: 361871 - RNA, 22 nt, Human
cuagaaaaacaaaauaacaaaa

SEQ ID NO: 361872 - RNA, 18 nt, Human
cucaaaaaaaaaaaaaaa

SEQ ID NO: 361873 - RNA, 23 nt, Human
cucaaaaaaaaaaaaaaaaaaaa

SEQ ID NO: 361874 - RNA, 24 nt, Human
cucaagccuguaaucccagcacuu

SEQ ID NO: 361875 - RNA, 19 nt, Human
cucugucucaaaaaaaaaa

SEQ ID NO: 361876 - RNA, 23 nt, Human
cugguuaacauggugaaacccca

SEQ ID NO: 361877 - RNA, 19 nt, Human
cuuagaaaauagcguucac

SEQ ID NO: 361878 - RNA, 20 nt, Human
cuucaccugagccugucuuu

SEQ ID NO: 361879 - RNA, 23 nt, Human
cuuuggcaggccgaggugggcag

SEQ ID NO: 361880 - RNA, 23 nt, Human
gagaauuacuugaaccugggagg

SEQ ID NO: 361881 - RNA, 23 nt, Human
gagaucgugccauugcacuccag

SEQ ID NO: 361882 - RNA, 20 nt, Human
gaggucagggcaucugcggc

SEQ ID NO: 361883 - RNA, 23 nt, Human
gagguugcagugagcugagaucg

SEQ ID NO: 361884 - RNA, 24 nt, Human
gaucaccaggucaagagaucgaga

SEQ ID NO: 361885 - RNA, 21 nt, Human
gccggcgggacgugcuccugg

SEQ ID NO: 361886 - RNA, 22 nt, Human
ggagguugcagugagcugagau

SEQ ID NO: 361887 - RNA, 23 nt, Human
ggagguugcagugagcugagauc

SEQ ID NO: 361888 - RNA, 24 nt, Human
ggagguugcagugagcugagaucg

SEQ ID NO: 361889 - RNA, 18 nt, Human
ggcagaucaccaggucaa

SEQ ID NO: 361890 - RNA, 22 nt, Human
gggcccaguccauccuccacuu

SEQ ID NO: 361891 - RNA, 24 nt, Human
gggcgcgguagcucaagccuguaa

SEQ ID NO: 361892 - RNA, 24 nt, Human
gguagcucaagccuguaaucccag

SEQ ID NO: 361893 - RNA, 24 nt, Human
gguggugcaugccgcuaaucccag

SEQ ID NO: 361894 - RNA, 23 nt, Human
guagcucaagccuguaaucccag

SEQ ID NO: 361895 - RNA, 21 nt, Human
guagggacuagaaaaacaaaa

SEQ ID NO: 361896 - RNA, 21 nt, Human
guggugcaugccgcuaauccc

SEQ ID NO: 361897 - RNA, 24 nt, Human
guugcagugagcugagaucgugcc

SEQ ID NO: 361898 - RNA, 19 nt, Human
uaaacacagguagggacua

SEQ ID NO: 361899 - RNA, 22 nt, Human
uaacauggugaaaccccaucuc

SEQ ID NO: 361900 - RNA, 24 nt, Human
uaacauggugaaaccccaucucua

SEQ ID NO: 361901 - RNA, 21 nt, Human
uaccugggggcagaggucagg

SEQ ID NO: 361902 - RNA, 24 nt, Human
uagcucaagccuguaaucccagca

SEQ ID NO: 361903 - RNA, 23 nt, Human
uagcugggcgugguggugcaugc

SEQ ID NO: 361904 - RNA, 22 nt, Human
uaucacagccauuuuaaaccug

SEQ ID NO: 361905 - RNA, 25 nt, Human
ucaaaaaaaaaaaaaaaaaaaagaa

SEQ ID NO: 361906 - RNA, 24 nt, Human
ucaccaggucaagagaucgagacc

SEQ ID NO: 361907 - RNA, 26 nt, Human
uccauaauuuaaacacagguagggac

SEQ ID NO: 361908 - RNA, 23 nt, Human
ucgggaggcugaggcaggagaau

SEQ ID NO: 361909 - RNA, 23 nt, Human
ucgugccauugcacuccagccug

SEQ ID NO: 361910 - RNA, 25 nt, Human
ucucuacuaaaaauacaaaaauagc

SEQ ID NO: 361911 - RNA, 23 nt, Human
ucugucucaaaaaaaaaaaaaaa

SEQ ID NO: 361912 - RNA, 22 nt, Human
ucuuccagaguuuuagauucac

SEQ ID NO: 361913 - RNA, 19 nt, Human
ugaaaccccaucucuacua

SEQ ID NO: 361914 - RNA, 24 nt, Human
ugaaccugggaggcggagguugca

SEQ ID NO: 361915 - RNA, 20 nt, Human
ugaggcaggagaauuacuug

SEQ ID NO: 361916 - RNA, 24 nt, Human
ugaggcaggagaauuacuugaacc

SEQ ID NO: 361917 - RNA, 25 nt, Human
ugaggcaggagaauuacuugaaccu

SEQ ID NO: 361918 - RNA, 25 nt, Human
ugcacuccagccuggacaacaagag

SEQ ID NO: 361919 - RNA, 23 nt, Human
uggaguguccugcuaccuggggg

SEQ ID NO: 361920 - RNA, 20 nt, Human
uggcaggccgaggugggcag

SEQ ID NO: 361921 - RNA, 24 nt, Human
uggcaggccgaggugggcagauca

SEQ ID NO: 361922 - RNA, 29 nt, Human
ugggaggcggagguugcagugacaacggu

SEQ ID NO: 361923 - RNA, 24 nt, Human
ugggaggcggagguugcagugagc

SEQ ID NO: 361924 - RNA, 24 nt, Human
ugggcgugguggugcaugccgcua

SEQ ID NO: 361925 - RNA, 22 nt, Human
uggugcaugccgcuaaucccag

SEQ ID NO: 361926 - RNA, 24 nt, Human
ugguggugcaugccgcuaauccca

SEQ ID NO: 361927 - RNA, 20 nt, Human
ugugugauagggaagaugac

SEQ ID NO: 361928 - RNA, 22 nt, Human
ugugugauagggaagaugacca

SEQ ID NO: 361929 - RNA, 24 nt, Human
uuacuugaaccugggaggcggagg

SEQ ID NO: 361930 - RNA, 26 nt, Human
uucccaauucugaagucuuccucauc

SEQ ID NO: 361931 - RNA, 24 nt, Human
uugaaccugggaggcggagguugc

SEQ ID NO: 361932 - RNA, 18 nt, Human
uugcagugagcugagauc

SEQ ID NO: 361933 - RNA, 22 nt, Human
uugcagugagcugagaucgugc

SEQ ID NO: 361934 - RNA, 23 nt, Human
aaaaaaaaacaaaaaaacaaaaa

SEQ ID NO: 361935 - RNA, 19 nt, Human
aaaaaaacaaaaacaccaa

SEQ ID NO: 361936 - RNA, 20 nt, Human
aaaaaaacaaaaacaccaaa

SEQ ID NO: 361937 - RNA, 26 nt, Human
aaaaacaaaaaaacaaaaacaccaaa

SEQ ID NO: 361938 - RNA, 18 nt, Human
aaaaacaaaaacaccaaa

SEQ ID NO: 361939 - RNA, 22 nt, Human
aaaacaaaaaaacaaaaacacc

SEQ ID NO: 361940 - RNA, 24 nt, Human
aaacaaaaaaacaaaaacaccaaa

SEQ ID NO: 361941 - RNA, 29 nt, Human
aaacaaaaaucccaucaaugaacaaccga

SEQ ID NO: 361942 - RNA, 26 nt, Human
aaaccuuaaaaaaaaaaaaacaaaaa

SEQ ID NO: 361943 - RNA, 23 nt, Human
aacaaaaaaacaaaaacaccaaa

SEQ ID NO: 361944 - RNA, 25 nt, Human
aagaaaauagacauuugggagaaga

SEQ ID NO: 361945 - RNA, 22 nt, Human
aagcagauauaaaugggaccac

SEQ ID NO: 361946 - RNA, 21 nt, Human
aagcaucccaagaaaagguac

SEQ ID NO: 361947 - RNA, 22 nt, Human
aaggggaaaaauuccaggaaaa

SEQ ID NO: 361948 - RNA, 23 nt, Human
aauuacuuauuaaaacuaagcac

SEQ ID NO: 361949 - RNA, 20 nt, Human
aauucuaagcacaacaauuu

SEQ ID NO: 361950 - RNA, 22 nt, Human
acaaaaaucccaucaaugaaca

SEQ ID NO: 361951 - RNA, 21 nt, Human
acaaaacaaaacagaaccuac

SEQ ID NO: 361952 - RNA, 21 nt, Human
acacugugucuagaacagcca

SEQ ID NO: 361953 - RNA, 25 nt, Human
accaaucauucccuccucaaauuca

SEQ ID NO: 361954 - RNA, 28 nt, Human
accuuaaaaaaaaaaaaacaaaaaaaca

SEQ ID NO: 361955 - RNA, 21 nt, Human
agacauuugggagaagaaaug

SEQ ID NO: 361956 - RNA, 21 nt, Human
agauaaauuccaaaaugcaac

SEQ ID NO: 361957 - RNA, 23 nt, Human
agauuaaaacaaaacaaaacaga

SEQ ID NO: 361958 - RNA, 21 nt, Human
agcuaagauuaaaacaaaaca

SEQ ID NO: 361959 - RNA, 19 nt, Human
aggguccggcucccguccu

SEQ ID NO: 361960 - RNA, 20 nt, Human
augcaucuuugaacagggga

SEQ ID NO: 361961 - RNA, 18 nt, Human
auucugguccaccuuccc

SEQ ID NO: 361962 - RNA, 18 nt, Human
auuuuucuggcccuuuuu

SEQ ID NO: 361963 - RNA, 21 nt, Human
caaaaaaacaaaaacaccaaa

SEQ ID NO: 361964 - RNA, 22 nt, Human
caaaaaugguuuaagaaguuaa

SEQ ID NO: 361965 - RNA, 22 nt, Human
caaaacagaaccuacuucuuuc

SEQ ID NO: 361966 - RNA, 25 nt, Human
caacugguaugauuuccacacaaau

SEQ ID NO: 361967 - RNA, 22 nt, Human
caaggcccaaaaugaaaccugg

SEQ ID NO: 361968 - RNA, 22 nt, Human
caauucuaagcacaacaauuuu

SEQ ID NO: 361969 - RNA, 21 nt, Human
cacacacauaucucacacaua

SEQ ID NO: 361970 - RNA, 22 nt, Human
cacacauagcacuaagcuagaa

SEQ ID NO: 361971 - RNA, 24 nt, Human
cacacauaucucacacauagcacu

SEQ ID NO: 361972 - RNA, 23 nt, Human
caccaaacacacacauaucucac

SEQ ID NO: 361973 - RNA, 18 nt, Human
cagaaacauaugccagaa

SEQ ID NO: 361974 - RNA, 23 nt, Human
cauagcacuaagcuagaagcaga

SEQ ID NO: 361975 - RNA, 20 nt, Human
cauccagcaauucuaagcac

SEQ ID NO: 361976 - RNA, 19 nt, Human
cauuucucuacuuuucagg

SEQ ID NO: 361977 - RNA, 22 nt, Human
ccaguacccacgcagcuagcca

SEQ ID NO: 361978 - RNA, 21 nt, Human
cccaaaaugaaaccugguaau

SEQ ID NO: 361979 - RNA, 19 nt, Human
ccuggugccaaauuuuucu

SEQ ID NO: 361980 - RNA, 22 nt, Human
ccuuaagcacuuuacuuggcuu

SEQ ID NO: 361981 - RNA, 20 nt, Human
ccuuauacugaauccauuuc

SEQ ID NO: 361982 - RNA, 19 nt, Human
ccuuauccuuauacugaau

SEQ ID NO: 361983 - RNA, 22 nt, Human
cgcagcgccgagcgugugcgug

SEQ ID NO: 361984 - RNA, 19 nt, Human
cggcucccguccuucgcuc

SEQ ID NO: 361985 - RNA, 25 nt, Human
cuuaaaaaaaaaaaaacaaaaaaaa

SEQ ID NO: 361986 - RNA, 26 nt, Human
cuuaaaaaaaaaaaaacaaaaaaaca

SEQ ID NO: 361987 - RNA, 23 nt, Human
cuucuuucccaauccuaucuuua

SEQ ID NO: 361988 - RNA, 22 nt, Human
gaaacauaugccagaaaucuac

SEQ ID NO: 361989 - RNA, 19 nt, Human
gaaauagaugaauucagca

SEQ ID NO: 361990 - RNA, 19 nt, Human
gcaacuucuuucccaaucc

SEQ ID NO: 361991 - RNA, 21 nt, Human
gcaauauuuuccucaagaaaa

SEQ ID NO: 361992 - RNA, 22 nt, Human
gcccaggguccggcucccgucc

SEQ ID NO: 361993 - RNA, 20 nt, Human
ggcagugaucuauaaacacu

SEQ ID NO: 361994 - RNA, 18 nt, Human
gggagaagaaauguuuuc

SEQ ID NO: 361995 - RNA, 19 nt, Human
ggguugacaaguacacugu

SEQ ID NO: 361996 - RNA, 18 nt, Human
guagaauauuuucagaua

SEQ ID NO: 361997 - RNA, 22 nt, Human
uaaaacaaaacaaaacagaacc

SEQ ID NO: 361998 - RNA, 22 nt, Human
uaaagacuaaaacuuaaggcac

SEQ ID NO: 361999 - RNA, 18 nt, Human
uaaggcacauauuauaau

SEQ ID NO: 362000 - RNA, 23 nt, Human
uaaugaaaacaaaccuuaagcac

SEQ ID NO: 362001 - RNA, 23 nt, Human
uacacugugucuagaacagccaa

SEQ ID NO: 362002 - RNA, 22 nt, Human
uacauguaacaaugaagcaaga

SEQ ID NO: 362003 - RNA, 18 nt, Human
uagauguguuguauuuac

SEQ ID NO: 362004 - RNA, 19 nt, Human
uagcagaaacauaugccag

SEQ ID NO: 362005 - RNA, 18 nt, Human
uauacugaauccauuucu

SEQ ID NO: 362006 - RNA, 21 nt, Human
uaucuauacuuuuacucuguc

SEQ ID NO: 362007 - RNA, 22 nt, Human
uaucucacacauagcacuaagc

SEQ ID NO: 362008 - RNA, 20 nt, Human
uaucuuuauucguuugccug

SEQ ID NO: 362009 - RNA, 25 nt, Human
uauuuuugucagcauuuuguaaaau

SEQ ID NO: 362010 - RNA, 21 nt, Human
ucagguaagugaaagggguca

SEQ ID NO: 362011 - RNA, 22 nt, Human
uccaaaaugcaggucaaaucca

SEQ ID NO: 362012 - RNA, 20 nt, Human
ucccaucaaugaacaacugg

SEQ ID NO: 362013 - RNA, 22 nt, Human
ucccguccuucgcucgcugccu

SEQ ID NO: 362014 - RNA, 20 nt, Human
uccugggucaugaacugcuc

SEQ ID NO: 362015 - RNA, 25 nt, Human
ucuaagcacaacaauuuucuguaag

SEQ ID NO: 362016 - RNA, 20 nt, Human
ucucacacauagcacuaagc

SEQ ID NO: 362017 - RNA, 18 nt, Human
ucuuuuuuuuuuuuuuuu

SEQ ID NO: 362018 - RNA, 21 nt, Human
ugaaauaucugucuacauuua

SEQ ID NO: 362019 - RNA, 23 nt, Human
ugacaaguacacugugucuagaa

SEQ ID NO: 362020 - RNA, 19 nt, Human
ugagagggguugacaagua

SEQ ID NO: 362021 - RNA, 24 nt, Human
ugcucaauuuacccuucagcccca

SEQ ID NO: 362022 - RNA, 21 nt, Human
uggcuucuaauaagcaucccu

SEQ ID NO: 362023 - RNA, 22 nt, Human
ugguaugauuuccacacaaaug

SEQ ID NO: 362024 - RNA, 26 nt, Human
uggugccaaauuuuucuggcccuuuu

SEQ ID NO: 362025 - RNA, 18 nt, Human
ugguggcgcaggcuggag

SEQ ID NO: 362026 - RNA, 19 nt, Human
uguagauuuuaauacuaac

SEQ ID NO: 362027 - RNA, 21 nt, Human
uuaccaaggaggcacaaauau

SEQ ID NO: 362028 - RNA, 18 nt, Human
uucccuccucaaauucag

SEQ ID NO: 362029 - RNA, 20 nt, Human
uucuguucauaaaucuucca

SEQ ID NO: 362030 - RNA, 21 nt, Human
uugaaauaucugucuacauuu

SEQ ID NO: 362031 - RNA, 23 nt, Human
uugcaaaccuuaaaaaaaaaaaa

SEQ ID NO: 362032 - RNA, 21 nt, Human
uuggcuucuaauaagcauccc

SEQ ID NO: 362033 - RNA, 24 nt, Human
uuuaacacaacacucgaaauagau

SEQ ID NO: 362034 - RNA, 21 nt, Human
uuuccacacaaaugucuacua

SEQ ID NO: 362035 - RNA, 18 nt, Human
uuugaaauaucugucuac

SEQ ID NO: 362036 - RNA, 25 nt, Human
uuuucuguaaggccuucucugaaaa

SEQ ID NO: 362037 - RNA, 25 nt, Human
uuuuuuuuuuuuuuuuuuuucaagg

SEQ ID NO: 362038 - RNA, 22 nt, Human
aaaaaaagaaggaagggaagag

SEQ ID NO: 362039 - RNA, 18 nt, Human
aaaaaagaaggaagggaa

SEQ ID NO: 362040 - RNA, 18 nt, Human
aaacagagauuugggccu

SEQ ID NO: 362041 - RNA, 21 nt, Human
aaagaggcagagugaggagag

SEQ ID NO: 362042 - RNA, 19 nt, Human
aaccucauccuccuggccc

SEQ ID NO: 362043 - RNA, 18 nt, Human
aacuacugccccuccucc

SEQ ID NO: 362044 - RNA, 19 nt, Human
aagaaggaagggaagaggg

SEQ ID NO: 362045 - RNA, 20 nt, Human
aagaaggaagggaagagggg

SEQ ID NO: 362046 - RNA, 25 nt, Human
aagagguccuacagaaccacccucu

SEQ ID NO: 362047 - RNA, 22 nt, Human
aagcucacaugugcacaaccac

SEQ ID NO: 362048 - RNA, 18 nt, Human
aagguggcaaguuacugu

SEQ ID NO: 362049 - RNA, 18 nt, Human
aaguuccgggucccuccc

SEQ ID NO: 362050 - RNA, 22 nt, Human
aaugcccucuaagcaaaguggc

SEQ ID NO: 362051 - RNA, 23 nt, Human
aauggggugcugggagggccuug

SEQ ID NO: 362052 - RNA, 18 nt, Human
acaagaauggggugcugg

SEQ ID NO: 362053 - RNA, 23 nt, Human
acaugugcacaaccacaugugug

SEQ ID NO: 362054 - RNA, 20 nt, Human
accacauguguggaagaagu

SEQ ID NO: 362055 - RNA, 20 nt, Human
accaugccccagcugccugu

SEQ ID NO: 362056 - RNA, 20 nt, Human
acccaguggcucccaaauau

SEQ ID NO: 362057 - RNA, 18 nt, Human
acuacugccccuccuccc

SEQ ID NO: 362058 - RNA, 18 nt, Human
acuccagccgccacugcc

SEQ ID NO: 362059 - RNA, 20 nt, Human
agaaaaagagacacaaagaa

SEQ ID NO: 362060 - RNA, 25 nt, Human
agaaaaagagacacaaagaggcaga

SEQ ID NO: 362061 - RNA, 23 nt, Human
agaggaaaaaaagaaggaaggga

SEQ ID NO: 362062 - RNA, 22 nt, Human
agaggggaaagaguauggagag

SEQ ID NO: 362063 - RNA, 23 nt, Human
agagugagguggggagaaaugga

SEQ ID NO: 362064 - RNA, 21 nt, Human
aggaacugauuuuuuuuuucu

SEQ ID NO: 362065 - RNA, 22 nt, Human
aggagaaaaagagacacaaaga

SEQ ID NO: 362066 - RNA, 23 nt, Human
aggagaaaaagagacacaaagag

SEQ ID NO: 362067 - RNA, 23 nt, Human
aggaguuucuucacauuuugcca

SEQ ID NO: 362068 - RNA, 18 nt, Human
aggcagagugaggagaga

SEQ ID NO: 362069 - RNA, 22 nt, Human
aggcagagugaggagagaggcc

SEQ ID NO: 362070 - RNA, 26 nt, Human
aggcagccgcuacagccucgcucuuc

SEQ ID NO: 362071 - RNA, 19 nt, Human
agggugggaugaaggggaa

SEQ ID NO: 362072 - RNA, 18 nt, Human
agguagaaauauagaccu

SEQ ID NO: 362073 - RNA, 21 nt, Human
auccugggaggagaaaggccc

SEQ ID NO: 362074 - RNA, 19 nt, Human
aucucucucuccucccccu

SEQ ID NO: 362075 - RNA, 25 nt, Human
augcugagcagggugggaugaaggg

SEQ ID NO: 362076 - RNA, 22 nt, Human
auuuugccucccugccccucca

SEQ ID NO: 362077 - RNA, 22 nt, Human
caaaaagaugaugaaagggugg

SEQ ID NO: 362078 - RNA, 21 nt, Human
caacauucucuccaaaagcac

SEQ ID NO: 362079 - RNA, 21 nt, Human
caaccucauccuccuggcccg

SEQ ID NO: 362080 - RNA, 19 nt, Human
caagaauggggugcuggga

SEQ ID NO: 362081 - RNA, 19 nt, Human
caagugacagccaggaaug

SEQ ID NO: 362082 - RNA, 21 nt, Human
cacaauagacaaaggcucaga

SEQ ID NO: 362083 - RNA, 21 nt, Human
cacacaagcucacaugugcac

SEQ ID NO: 362084 - RNA, 21 nt, Human
cacagccuggcagugcccucu

SEQ ID NO: 362085 - RNA, 18 nt, Human
cacauguguggaagaagu

SEQ ID NO: 362086 - RNA, 24 nt, Human
caccauaucaauaacuacugcccc

SEQ ID NO: 362087 - RNA, 22 nt, Human
cagcaaacagagauuugggccu

SEQ ID NO: 362088 - RNA, 23 nt, Human
cagcaacucuaagacuaaccaag

SEQ ID NO: 362089 - RNA, 20 nt, Human
cagcaugggagacacauugg

SEQ ID NO: 362090 - RNA, 21 nt, Human
cagcccuuccuccuccuuuua

SEQ ID NO: 362091 - RNA, 20 nt, Human
cagccgccacugccuccccc

SEQ ID NO: 362092 - RNA, 19 nt, Human
cagcucccuucccaaacua

SEQ ID NO: 362093 - RNA, 20 nt, Human
caguggucucuccugggagu

SEQ ID NO: 362094 - RNA, 21 nt, Human
caugaaaacugagagaugggg

SEQ ID NO: 362095 - RNA, 21 nt, Human
cauuuugccucccugccccuc

SEQ ID NO: 362096 - RNA, 19 nt, Human
ccaaaagcacacaagcuca

SEQ ID NO: 362097 - RNA, 25 nt, Human
ccacaccccccaccucuuccucccu

SEQ ID NO: 362098 - RNA, 21 nt, Human
ccaccucuuccucccucaaca

SEQ ID NO: 362099 - RNA, 20 nt, Human
ccacugccucccccagcucc

SEQ ID NO: 362100 - RNA, 25 nt, Human
ccagauccugggaggagaaaggaag

SEQ ID NO: 362101 - RNA, 23 nt, Human
cccaaaagaaauuuuccaacccu

SEQ ID NO: 362102 - RNA, 19 nt, Human
cccagcccuuccuccuccc

SEQ ID NO: 362103 - RNA, 20 nt, Human
ccccaccucuuccucccuca

SEQ ID NO: 362104 - RNA, 23 nt, Human
ccccccaccucuuccucccucaa

SEQ ID NO: 362105 - RNA, 23 nt, Human
ccccucaggacaaccucauccuc

SEQ ID NO: 362106 - RNA, 19 nt, Human
cccuccacccaguggcucc

SEQ ID NO: 362107 - RNA, 24 nt, Human
cccuccacccaguggcucccaaau

SEQ ID NO: 362108 - RNA, 25 nt, Human
cccuuccuacccacagagcuaagaa

SEQ ID NO: 362109 - RNA, 20 nt, Human
cccuuccuccuccuuuuacu

SEQ ID NO: 362110 - RNA, 25 nt, Human
cccuuccuccuccuuuuacucgccu

SEQ ID NO: 362111 - RNA, 20 nt, Human
ccuacccuauuaggcuccug

SEQ ID NO: 362112 - RNA, 19 nt, Human
ccuagggcccagauucucc

SEQ ID NO: 362113 - RNA, 19 nt, Human
ccucccccagcucccuucc

SEQ ID NO: 362114 - RNA, 24 nt, Human
ccucccccagcucccuucccaaac

SEQ ID NO: 362115 - RNA, 19 nt, Human
ccuggcagugcccucugcc

SEQ ID NO: 362116 - RNA, 18 nt, Human
ccuuggacuguaagauuu

SEQ ID NO: 362117 - RNA, 20 nt, Human
cuaaauauuaauacugugcu

SEQ ID NO: 362118 - RNA, 23 nt, Human
cuacccacagagcuaagaaccag

SEQ ID NO: 362119 - RNA, 21 nt, Human
cuccacccaguggcucccaaa

SEQ ID NO: 362120 - RNA, 26 nt, Human
cucccccuccuccacaccccccaccu

SEQ ID NO: 362121 - RNA, 20 nt, Human
cuccuguuccacuacuguuc

SEQ ID NO: 362122 - RNA, 19 nt, Human
cucuccucccccuccucca

SEQ ID NO: 362123 - RNA, 23 nt, Human
cucucucuccucccccuccucca

SEQ ID NO: 362124 - RNA, 21 nt, Human
cugcugccuguaccuuuuugg

SEQ ID NO: 362125 - RNA, 19 nt, Human
cugcuuuugccaaucaaca

SEQ ID NO: 362126 - RNA, 24 nt, Human
cugggaggagaaaggcccuggaaa

SEQ ID NO: 362127 - RNA, 20 nt, Human
gaccuaugaaugucuucccu

SEQ ID NO: 362128 - RNA, 23 nt, Human
gagagguuccaaaggccaggggu

SEQ ID NO: 362129 - RNA, 24 nt, Human
gaggagaaaaagagacacaaagag

SEQ ID NO: 362130 - RNA, 18 nt, Human
gaggagaaaggcccugga

SEQ ID NO: 362131 - RNA, 21 nt, Human
gaggcugauuggcccaaguuc

SEQ ID NO: 362132 - RNA, 22 nt, Human
gaggucccauccuccuccuccc

SEQ ID NO: 362133 - RNA, 23 nt, Human
gcacacaagcucacaugugcaca

SEQ ID NO: 362134 - RNA, 21 nt, Human
gccaucugcaucuuaagcaac

SEQ ID NO: 362135 - RNA, 22 nt, Human
gcccuuccuccuccuuuuacuc

SEQ ID NO: 362136 - RNA, 22 nt, Human
gcccuuucuagggccccuuccu

SEQ ID NO: 362137 - RNA, 19 nt, Human
gccuaccuacuccagccgc

SEQ ID NO: 362138 - RNA, 23 nt, Human
gccucgcucuucuccccagcccu

SEQ ID NO: 362139 - RNA, 18 nt, Human
gccuguaccuuuuuggga

SEQ ID NO: 362140 - RNA, 19 nt, Human
gcuacagccucgcucuucu

SEQ ID NO: 362141 - RNA, 18 nt, Human
gcucagccugagaugagu

SEQ ID NO: 362142 - RNA, 22 nt, Human
gcugugcuaacugaacacagcc

SEQ ID NO: 362143 - RNA, 21 nt, Human
ggaauguucuucaguaagacu

SEQ ID NO: 362144 - RNA, 19 nt, Human
ggagaauuuaguuaaugag

SEQ ID NO: 362145 - RNA, 19 nt, Human
ggaguugauaagagcugga

SEQ ID NO: 362146 - RNA, 19 nt, Human
ggcacugcuuguacccagu

SEQ ID NO: 362147 - RNA, 21 nt, Human
gggaccagcggagggggcuca

SEQ ID NO: 362148 - RNA, 20 nt, Human
gggcauaaggaggcaucagu

SEQ ID NO: 362149 - RNA, 22 nt, Human
guacccaguucuugggaagcca

SEQ ID NO: 362150 - RNA, 22 nt, Human
gucccauccuccuccuccccca

SEQ ID NO: 362151 - RNA, 23 nt, Human
gugguucccaagcuuucccagaa

SEQ ID NO: 362152 - RNA, 22 nt, Human
guuacagggcuccuagggccca

SEQ ID NO: 362153 - RNA, 18 nt, Human
uaacuaggcccuuucuag

SEQ ID NO: 362154 - RNA, 20 nt, Human
uacccacagagcuaagaacc

SEQ ID NO: 362155 - RNA, 22 nt, Human
uagaggaaaaaaagaaggaagg

SEQ ID NO: 362156 - RNA, 20 nt, Human
uagauuuaacuguggugcau

SEQ ID NO: 362157 - RNA, 18 nt, Human
uagggcccagauucuccu

SEQ ID NO: 362158 - RNA, 19 nt, Human
uagggccccuuccuaccca

SEQ ID NO: 362159 - RNA, 19 nt, Human
uagugggugacuaacaagc

SEQ ID NO: 362160 - RNA, 18 nt, Human
uauggagagaagucagua

SEQ ID NO: 362161 - RNA, 25 nt, Human
ucaccauaucaauaacuacugcccc

SEQ ID NO: 362162 - RNA, 21 nt, Human
ucaguagaggaaaaaaagaag

SEQ ID NO: 362163 - RNA, 23 nt, Human
ucaguagaggaaaaaaagaagga

SEQ ID NO: 362164 - RNA, 21 nt, Human
ucaguccuccucuaccugcug

SEQ ID NO: 362165 - RNA, 18 nt, Human
uccacaccccccaccucu

SEQ ID NO: 362166 - RNA, 24 nt, Human
ucccagauccugggaggagaaagg

SEQ ID NO: 362167 - RNA, 22 nt, Human
ucccauccuccuccucccccag

SEQ ID NO: 362168 - RNA, 21 nt, Human
ucccccagagcuuagaaagua

SEQ ID NO: 362169 - RNA, 21 nt, Human
ucccccagcucccuucccaaa

SEQ ID NO: 362170 - RNA, 19 nt, Human
ucccccuccuccacacccc

SEQ ID NO: 362171 - RNA, 19 nt, Human
ucccugccccuccacccag

SEQ ID NO: 362172 - RNA, 19 nt, Human
uccuagggcccagauucuc

SEQ ID NO: 362173 - RNA, 18 nt, Human
uccuccacaccccccacc

SEQ ID NO: 362174 - RNA, 25 nt, Human
uccuccacaccccccaccucuuccu

SEQ ID NO: 362175 - RNA, 21 nt, Human
ucgccuaccuacuccagccgc

SEQ ID NO: 362176 - RNA, 23 nt, Human
ucucauuuugccucccugccccu

SEQ ID NO: 362177 - RNA, 24 nt, Human
ucucauuuugccucccugccccuc

SEQ ID NO: 362178 - RNA, 23 nt, Human
ucuccaaaagcacacaagcucac

SEQ ID NO: 362179 - RNA, 20 nt, Human
ucuucacauuuugccaugug

SEQ ID NO: 362180 - RNA, 20 nt, Human
ugaaaggaguuucuucacau

SEQ ID NO: 362181 - RNA, 21 nt, Human
ugaaugggcagauuugggacc

SEQ ID NO: 362182 - RNA, 20 nt, Human
ugaaugucuucccuucaucu

SEQ ID NO: 362183 - RNA, 22 nt, Human
ugacaggaacacaauagacaaa

SEQ ID NO: 362184 - RNA, 21 nt, Human
ugacaggauaguaacuaggcc

SEQ ID NO: 362185 - RNA, 21 nt, Human
ugaggagagaggcugagcucc

SEQ ID NO: 362186 - RNA, 21 nt, Human
ugaggagagaggcugagcuuc

SEQ ID NO: 362187 - RNA, 24 nt, Human
ugagugggaacuauugucuucuuu

SEQ ID NO: 362188 - RNA, 20 nt, Human
ugcaacugcugccuguaccu

SEQ ID NO: 362189 - RNA, 19 nt, Human
ugccccagcugccuguuug

SEQ ID NO: 362190 - RNA, 18 nt, Human
ugcccucugccccuagcc

SEQ ID NO: 362191 - RNA, 25 nt, Human
uggaagaaguaaauugauaucccac

SEQ ID NO: 362192 - RNA, 20 nt, Human
uggagagguuccaaaggcca

SEQ ID NO: 362193 - RNA, 21 nt, Human
uggagcuuugacuccaaggag

SEQ ID NO: 362194 - RNA, 19 nt, Human
uggaggccaaccaugcccc

SEQ ID NO: 362195 - RNA, 18 nt, Human
uggcaaugaccuccucag

SEQ ID NO: 362196 - RNA, 19 nt, Human
uggcaccuuuaaugcccuc

SEQ ID NO: 362197 - RNA, 21 nt, Human
uggccuaggaugcccagcaug

SEQ ID NO: 362198 - RNA, 21 nt, Human
ugggaaagggcacacaauggc

SEQ ID NO: 362199 - RNA, 24 nt, Human
ugggaccagcggagggggcucagg

SEQ ID NO: 362200 - RNA, 19 nt, Human
ugggauggcuuccccuucc

SEQ ID NO: 362201 - RNA, 21 nt, Human
uggggaguugauaagagcugg

SEQ ID NO: 362202 - RNA, 21 nt, Human
uggggugcugggagggccuug

SEQ ID NO: 362203 - RNA, 18 nt, Human
uggugcauaagaggcugc

SEQ ID NO: 362204 - RNA, 20 nt, Human
ugguucagagucuaccuuuc

SEQ ID NO: 362205 - RNA, 24 nt, Human
ugucaugaaaacugagagaugggg

SEQ ID NO: 362206 - RNA, 22 nt, Human
ugugugcgcaggucugggaaca

SEQ ID NO: 362207 - RNA, 19 nt, Human
uguugccagagccugggca

SEQ ID NO: 362208 - RNA, 20 nt, Human
uuaggcuccuggggacacag

SEQ ID NO: 362209 - RNA, 24 nt, Human
uucauggcaccuuuaaugcccucu

SEQ ID NO: 362210 - RNA, 21 nt, Human
uuccgggucccuccuuucuuc

SEQ ID NO: 362211 - RNA, 23 nt, Human
uuugccaaucaacauucucucca

SEQ ID NO: 362212 - RNA, 19 nt, Human
uuugccucccugccccucc

SEQ ID NO: 362213 - RNA, 21 nt, Human
uuuguaaaaaucagugacugg

SEQ ID NO: 362214 - RNA, 23 nt, Human
aaaaaacaaaaugaaaaacaaac

SEQ ID NO: 362215 - RNA, 20 nt, Human
aaauaaaccuauagcaugga

SEQ ID NO: 362216 - RNA, 19 nt, Human
agggguuugggauucagaa

SEQ ID NO: 362217 - RNA, 18 nt, Human
caccacacccagagucag

SEQ ID NO: 362218 - RNA, 21 nt, Human
cacccagagucagguauggaa

SEQ ID NO: 362219 - RNA, 22 nt, Human
cagcuaaaaccuuuucuaauac

SEQ ID NO: 362220 - RNA, 18 nt, Human
ccacacccagagucaggu

SEQ ID NO: 362221 - RNA, 19 nt, Human
ccaccacacccagagucag

SEQ ID NO: 362222 - RNA, 21 nt, Human
ccgaaagucacuggaagacuu

SEQ ID NO: 362223 - RNA, 24 nt, Human
cuccauauaaccaagaccgaaagu

SEQ ID NO: 362224 - RNA, 18 nt, Human
cuccuagauaaagucaua

SEQ ID NO: 362225 - RNA, 25 nt, Human
cuccucuccccaccugaggcagaag

SEQ ID NO: 362226 - RNA, 23 nt, Human
cuucuaccuacuuaaaccagggg

SEQ ID NO: 362227 - RNA, 26 nt, Human
guguaagaggggauaauuaauugucu

SEQ ID NO: 362228 - RNA, 21 nt, Human
uaaccaccacacccagaguca

SEQ ID NO: 362229 - RNA, 23 nt, Human
uauaaccaagaccgaaagucacu

SEQ ID NO: 362230 - RNA, 23 nt, Human
uauggaaauaaaccuauagcaug

SEQ ID NO: 362231 - RNA, 21 nt, Human
uauuuuaaccaccacacccag

SEQ ID NO: 362232 - RNA, 20 nt, Human
ucacuggaagacuuuaaaau

SEQ ID NO: 362233 - RNA, 22 nt, Human
uccccaccugaggcagaaguug

SEQ ID NO: 362234 - RNA, 20 nt, Human
ucuauggacuccucucccca

SEQ ID NO: 362235 - RNA, 23 nt, Human
ucuauggacuccucuccccaccu

SEQ ID NO: 362236 - RNA, 22 nt, Human
ugaaaaacaaacuccuagauaa

SEQ ID NO: 362237 - RNA, 22 nt, Human
ugaucuauggacuccucucccc

SEQ ID NO: 362238 - RNA, 22 nt, Human
uguaagaggggauaauuaauug

SEQ ID NO: 362239 - RNA, 21 nt, Human
uguauaaagggucacuuugua

SEQ ID NO: 362240 - RNA, 24 nt, Human
uguauaaagggucacuuuguagga

SEQ ID NO: 362241 - RNA, 23 nt, Human
uguguacauguggguaaguaugu

SEQ ID NO: 362242 - RNA, 28 nt, Human
uguguacauguggguaaguaugugggag

SEQ ID NO: 362243 - RNA, 30 nt, Human
uuaaaaaaacaaaaugaaaaacaaacuccc

SEQ ID NO: 362244 - RNA, 22 nt, Human
uuaaccaccacacccagaguca

SEQ ID NO: 362245 - RNA, 19 nt, Human
accaccuucuuccuggugc

SEQ ID NO: 362246 - RNA, 20 nt, Human
accaccuucuuccuggugcu

SEQ ID NO: 362247 - RNA, 19 nt, Human
ccccuaggacuccuccuac

SEQ ID NO: 362248 - RNA, 23 nt, Human
ccccuaggacuccuccuaccacc

SEQ ID NO: 362249 - RNA, 24 nt, Human
ccccuaggacuccuccuaccaccu

SEQ ID NO: 362250 - RNA, 21 nt, Human
cuccuccuaccaccuucuucc

SEQ ID NO: 362251 - RNA, 22 nt, Human
cuggugcuggugacugccccuc

SEQ ID NO: 362252 - RNA, 23 nt, Human
gccucagccucaugugcuggucc

SEQ ID NO: 362253 - RNA, 19 nt, Human
uccuggugcuggugacugc

SEQ ID NO: 362254 - RNA, 25 nt, Human
ugucccaggcucugcaagugcucug

SEQ ID NO: 362255 - RNA, 19 nt, Human
aaaacuguucccuccccuu

SEQ ID NO: 362256 - RNA, 24 nt, Human
aauaaccugccccaccaugaagau

SEQ ID NO: 362257 - RNA, 23 nt, Human
agaaguaaaaaauguuuaaaaag

SEQ ID NO: 362258 - RNA, 20 nt, Human
agcagaucuucucugcaucc

SEQ ID NO: 362259 - RNA, 22 nt, Human
caaaaagaagaaaagcacuuac

SEQ ID NO: 362260 - RNA, 21 nt, Human
caguggcuucucaagccuugc

SEQ ID NO: 362261 - RNA, 20 nt, Human
cauccaauaaccugccccac

SEQ ID NO: 362262 - RNA, 20 nt, Human
ccagaguuaagaacugcuga

SEQ ID NO: 362263 - RNA, 19 nt, Human
cccaaaaagaagaaaagca

SEQ ID NO: 362264 - RNA, 19 nt, Human
ccuagacuauaaggcuaac

SEQ ID NO: 362265 - RNA, 18 nt, Human
ccugccccaccaugaaga

SEQ ID NO: 362266 - RNA, 21 nt, Human
ccuuauguugcuguuaauguc

SEQ ID NO: 362267 - RNA, 21 nt, Human
cgagcagaucuucucugcauc

SEQ ID NO: 362268 - RNA, 23 nt, Human
cgagcagaucuucucugcaucca

SEQ ID NO: 362269 - RNA, 19 nt, Human
cucuaaggaguaucuaaaa

SEQ ID NO: 362270 - RNA, 20 nt, Human
cucuaaggaguaucuaaaaa

SEQ ID NO: 362271 - RNA, 24 nt, Human
cugaaucucuuuuacuacgacagu

SEQ ID NO: 362272 - RNA, 22 nt, Human
cuuaauggaccuuugguaaguu

SEQ ID NO: 362273 - RNA, 25 nt, Human
cuuauaaaggcuccccagggaagac

SEQ ID NO: 362274 - RNA, 18 nt, Human
cuuuucaaguuuguccag

SEQ ID NO: 362275 - RNA, 22 nt, Human
gguggaguuucccugugcccug

SEQ ID NO: 362276 - RNA, 20 nt, Human
gucccaaguaucagugucuu

SEQ ID NO: 362277 - RNA, 24 nt, Human
uaaaggcuccccagggaagacuaa

SEQ ID NO: 362278 - RNA, 22 nt, Human
uaacacacagccagaguuaaga

SEQ ID NO: 362279 - RNA, 23 nt, Human
uaagcccuagacuauaaggcuaa

SEQ ID NO: 362280 - RNA, 21 nt, Human
uaguaucuggguuccacccca

SEQ ID NO: 362281 - RNA, 18 nt, Human
uauggucaggaauaugga

SEQ ID NO: 362282 - RNA, 19 nt, Human
uauggucaggaauauggag

SEQ ID NO: 362283 - RNA, 23 nt, Human
ucaaccccgggcgcaugcuagaa

SEQ ID NO: 362284 - RNA, 22 nt, Human
ucaguuaucuuuuucagagagu

SEQ ID NO: 362285 - RNA, 19 nt, Human
uccacaguguccauuggua

SEQ ID NO: 362286 - RNA, 23 nt, Human
uccacaguguccauugguaccag

SEQ ID NO: 362287 - RNA, 19 nt, Human
ucccugugcccugaaucuc

SEQ ID NO: 362288 - RNA, 20 nt, Human
ucuacccaaaaagaagaaaa

SEQ ID NO: 362289 - RNA, 22 nt, Human
ucugcauccaauaaccugcccc

SEQ ID NO: 362290 - RNA, 24 nt, Human
ucuggguuccaccccagaccaauu

SEQ ID NO: 362291 - RNA, 20 nt, Human
uggagugggucccaaguauc

SEQ ID NO: 362292 - RNA, 21 nt, Human
uggcuucucaagccuugcccu

SEQ ID NO: 362293 - RNA, 18 nt, Human
ugguaccaguggcuucuc

SEQ ID NO: 362294 - RNA, 19 nt, Human
ugucuuauaaaggcucccc

SEQ ID NO: 362295 - RNA, 20 nt, Human
uguucccuccccuuaaugga

SEQ ID NO: 362296 - RNA, 22 nt, Human
uguuuaaaaaguucaugcucag

SEQ ID NO: 362297 - RNA, 24 nt, Human
uuaaugucuuuucucugacuucuc

SEQ ID NO: 362298 - RNA, 22 nt, Human
aaagaucugcacaaagccaaaa

SEQ ID NO: 362299 - RNA, 25 nt, Human
aagcagauguggggcagaagucaag

SEQ ID NO: 362300 - RNA, 18 nt, Human
acaaugaugaacuaagca

SEQ ID NO: 362301 - RNA, 25 nt, Human
acauguuaaagaucugcacaaagcc

SEQ ID NO: 362302 - RNA, 19 nt, Human
agaaagaagguaacugucc

SEQ ID NO: 362303 - RNA, 23 nt, Human
agaaagaagguaacuguccaaaa

SEQ ID NO: 362304 - RNA, 21 nt, Human
agaggcggcucugauuccaaa

SEQ ID NO: 362305 - RNA, 19 nt, Human
agauggccagaaagaaggu

SEQ ID NO: 362306 - RNA, 20 nt, Human
agccaaaaagcagauguggg

SEQ ID NO: 362307 - RNA, 23 nt, Human
caaaaagcagauguggggcagaa

SEQ ID NO: 362308 - RNA, 22 nt, Human
caacucccuugugauucucagu

SEQ ID NO: 362309 - RNA, 30 nt, Human
cacaaagccaaaaagcagauguggggcagg

SEQ ID NO: 362310 - RNA, 21 nt, Human
cagacacguucauuccucuua

SEQ ID NO: 362311 - RNA, 27 nt, Human
ccaaaagcuaacucuggaagcacaggu

SEQ ID NO: 362312 - RNA, 22 nt, Human
cuaagcaccaggaucuagcacu

SEQ ID NO: 362313 - RNA, 24 nt, Human
cuacacacauuucuccagacauuu

SEQ ID NO: 362314 - RNA, 22 nt, Human
cuuuccuccuugacauuuuuca

SEQ ID NO: 362315 - RNA, 21 nt, Human
gaaaacaaugaugaacuaagc

SEQ ID NO: 362316 - RNA, 23 nt, Human
gaaaacacuaugcuuucuguugu

SEQ ID NO: 362317 - RNA, 22 nt, Human
gaaagagaaaugucugugaggg

SEQ ID NO: 362318 - RNA, 19 nt, Human
gacacguucauuccucuua

SEQ ID NO: 362319 - RNA, 22 nt, Human
gcaaacgaaggcagauaucaug

SEQ ID NO: 362320 - RNA, 18 nt, Human
gccaaaaagcagaugugg

SEQ ID NO: 362321 - RNA, 23 nt, Human
ggaggggcuagaagagacacugg

SEQ ID NO: 362322 - RNA, 21 nt, Human
gggauuccaacagucagaggg

SEQ ID NO: 362323 - RNA, 24 nt, Human
gggcagaagucaagauggccagaa

SEQ ID NO: 362324 - RNA, 18 nt, Human
ggucacuguccaaaagca

SEQ ID NO: 362325 - RNA, 21 nt, Human
gucuguucacuaacauguuaa

SEQ ID NO: 362326 - RNA, 21 nt, Human
gugauucucaguucucggucc

SEQ ID NO: 362327 - RNA, 19 nt, Human
guuguuuggggcuuucuuu

SEQ ID NO: 362328 - RNA, 19 nt, Human
uaaagaucugcacaaagcc

SEQ ID NO: 362329 - RNA, 22 nt, Human
uaucuugcucccauuaguugca

SEQ ID NO: 362330 - RNA, 23 nt, Human
ucauuauuguucuuuccuccuug

SEQ ID NO: 362331 - RNA, 19 nt, Human
uccaaaagcuaacucugga

SEQ ID NO: 362332 - RNA, 22 nt, Human
ucuuaugauccuccaugcugcc

SEQ ID NO: 362333 - RNA, 18 nt, Human
ugaaaugguuuugcuauc

SEQ ID NO: 362334 - RNA, 24 nt, Human
ugaagaacuguuggaggggcuaga

SEQ ID NO: 362335 - RNA, 19 nt, Human
ugcuuucuguuguuugggg

SEQ ID NO: 362336 - RNA, 19 nt, Human
uggaagcacagguauucca

SEQ ID NO: 362337 - RNA, 19 nt, Human
uggcuuaucagucaagcag

SEQ ID NO: 362338 - RNA, 18 nt, Human
uuccuagggacuggcauu

SEQ ID NO: 362339 - RNA, 19 nt, Human
uugaauugaauccuacuga

SEQ ID NO: 362340 - RNA, 24 nt, Human
uugaggacagcucagaggauucau

SEQ ID NO: 362341 - RNA, 19 nt, Human
uuuuacuaggauaacagug

SEQ ID NO: 362342 - RNA, 24 nt, Human
aaaaaauucucguguagcuuaaaa

SEQ ID NO: 362343 - RNA, 18 nt, Human
aaaaagacauagaaugcu

SEQ ID NO: 362344 - RNA, 22 nt, Human
aaaauucucguguagcuuaaaa

SEQ ID NO: 362345 - RNA, 24 nt, Human
aaacauugccauagcaauuuaaag

SEQ ID NO: 362346 - RNA, 24 nt, Human
aaagugcugggacuacaggcauga

SEQ ID NO: 362347 - RNA, 20 nt, Human
aacacagcacauagaaauuu

SEQ ID NO: 362348 - RNA, 23 nt, Human
aacacagcacauagaaauuuaua

SEQ ID NO: 362349 - RNA, 25 nt, Human
aaccacagccacuggaggauggucc

SEQ ID NO: 362350 - RNA, 23 nt, Human
aaccagaaguaaagaugauuacc

SEQ ID NO: 362351 - RNA, 19 nt, Human
aagugcugggacuacaggc

SEQ ID NO: 362352 - RNA, 26 nt, Human
aagugcugggacuacaggcaugagcc

SEQ ID NO: 362353 - RNA, 20 nt, Human
acaaaacgagaccccaucuc

SEQ ID NO: 362354 - RNA, 18 nt, Human
acacaauacagaaggcac

SEQ ID NO: 362355 - RNA, 23 nt, Human
acagaaggcacuuugagguuaca

SEQ ID NO: 362356 - RNA, 24 nt, Human
acaggcugggcacaguggcucaug

SEQ ID NO: 362357 - RNA, 23 nt, Human
accacagccacuggaggaugguc

SEQ ID NO: 362358 - RNA, 24 nt, Human
accaugcuggccaggcuggucucg

SEQ ID NO: 362359 - RNA, 18 nt, Human
acccugaagccagggagg

SEQ ID NO: 362360 - RNA, 23 nt, Human
accucagccccccaaagugcugg

SEQ ID NO: 362361 - RNA, 21 nt, Human
acugggcaucgcacuuuucuu

SEQ ID NO: 362362 - RNA, 24 nt, Human
agacagacugaacaaaccggaccc

SEQ ID NO: 362363 - RNA, 18 nt, Human
agacaggaggaucgcuug

SEQ ID NO: 362364 - RNA, 18 nt, Human
agaugaagacagacugaa

SEQ ID NO: 362365 - RNA, 21 nt, Human
agccaggaguucaaaaccagc

SEQ ID NO: 362366 - RNA, 24 nt, Human
agccugggcgacaaaacgagaccc

SEQ ID NO: 362367 - RNA, 23 nt, Human
aggaguucaaaaccagccugggc

SEQ ID NO: 362368 - RNA, 24 nt, Human
aggaucgcuugaagccaggaguuc

SEQ ID NO: 362369 - RNA, 18 nt, Human
aggcagguaugugaaccu

SEQ ID NO: 362370 - RNA, 21 nt, Human
aggcaugagccaccgugcccg

SEQ ID NO: 362371 - RNA, 23 nt, Human
aggcaugagccaccgugcccggc

SEQ ID NO: 362372 - RNA, 24 nt, Human
aggccgagacaggaggaucgcuug

SEQ ID NO: 362373 - RNA, 25 nt, Human
aggcuggagugcaguggcgugaucu

SEQ ID NO: 362374 - RNA, 21 nt, Human
agguucaagugauucuccuac

SEQ ID NO: 362375 - RNA, 22 nt, Human
agguucaagugauucuccuacc

SEQ ID NO: 362376 - RNA, 18 nt, Human
aguaucugggauuacagg

SEQ ID NO: 362377 - RNA, 23 nt, Human
agugcaguggcgugaucuugguu

SEQ ID NO: 362378 - RNA, 24 nt, Human
agugcaguggcgugaucuugguuc

SEQ ID NO: 362379 - RNA, 18 nt, Human
aguggcucaugccuguag

SEQ ID NO: 362380 - RNA, 23 nt, Human
aguggcucaugccuguagucuca

SEQ ID NO: 362381 - RNA, 22 nt, Human
augaagacagacugaacaaaca

SEQ ID NO: 362382 - RNA, 19 nt, Human
augccuguagucucaacac

SEQ ID NO: 362383 - RNA, 21 nt, Human
augcucaacaaccacagccac

SEQ ID NO: 362384 - RNA, 19 nt, Human
augggguuucaccaugcug

SEQ ID NO: 362385 - RNA, 24 nt, Human
augggguuucaccaugcuggccag

SEQ ID NO: 362386 - RNA, 19 nt, Human
auuaaaaaaaaaauucucg

SEQ ID NO: 362387 - RNA, 21 nt, Human
auuaaaaaaagacauagaaug

SEQ ID NO: 362388 - RNA, 24 nt, Human
caaaacacagcacauagaaauuua

SEQ ID NO: 362389 - RNA, 22 nt, Human
caaaacauaaacuaaguuuuaa

SEQ ID NO: 362390 - RNA, 22 nt, Human
caaaacgagaccccaucucuac

SEQ ID NO: 362391 - RNA, 25 nt, Human
caaaauacaaacgaacaaaacacag

SEQ ID NO: 362392 - RNA, 24 nt, Human
caaagugcugggacuacaggcaug

SEQ ID NO: 362393 - RNA, 23 nt, Human
caacacuuugugaggccgagaca

SEQ ID NO: 362394 - RNA, 23 nt, Human
caacuuccaucucccagguucaa

SEQ ID NO: 362395 - RNA, 20 nt, Human
caagugauucuccuaccuca

SEQ ID NO: 362396 - RNA, 22 nt, Human
caagugauucuccuaccucagc

SEQ ID NO: 362397 - RNA, 19 nt, Human
caccagccgaagagucgac

SEQ ID NO: 362398 - RNA, 21 nt, Human
caccaugcuggccaggcuggu

SEQ ID NO: 362399 - RNA, 24 nt, Human
caccaugcuggccaggcuggucuc

SEQ ID NO: 362400 - RNA, 27 nt, Human
caccaugcuggccaggcuggucucgaa

SEQ ID NO: 362401 - RNA, 23 nt, Human
cacucugacccugaagccaggga

SEQ ID NO: 362402 - RNA, 20 nt, Human
cagccuccugaguaucuggg

SEQ ID NO: 362403 - RNA, 21 nt, Human
caggcgcccgucaccacgccc

SEQ ID NO: 362404 - RNA, 19 nt, Human
cagggagggagugcuuggc

SEQ ID NO: 362405 - RNA, 19 nt, Human
cagguugcaugccagccaa

SEQ ID NO: 362406 - RNA, 20 nt, Human
caugccuguagucucaacac

SEQ ID NO: 362407 - RNA, 24 nt, Human
caugccuguagucucaacacuuug

SEQ ID NO: 362408 - RNA, 24 nt, Human
caugcuggccaggcuggucucgaa

SEQ ID NO: 362409 - RNA, 19 nt, Human
ccaaagugcugggacuaca

SEQ ID NO: 362410 - RNA, 24 nt, Human
ccaaagugcugggacuacaggcau

SEQ ID NO: 362411 - RNA, 19 nt, Human
ccacuggaaaaauaugauu

SEQ ID NO: 362412 - RNA, 24 nt, Human
cccaaagugcugggacuacaggca

SEQ ID NO: 362413 - RNA, 23 nt, Human
cccagguucaagugauucuccuc

SEQ ID NO: 362414 - RNA, 24 nt, Human
ccccaaagugcugggacuacaggc

SEQ ID NO: 362415 - RNA, 20 nt, Human
ccuaaaaaaucaacagaacu

SEQ ID NO: 362416 - RNA, 19 nt, Human
ccugaguaucugggauuac

SEQ ID NO: 362417 - RNA, 23 nt, Human
ccugaguaucugggauuacaggc

SEQ ID NO: 362418 - RNA, 24 nt, Human
ccugggcgacaaaacgagacccca

SEQ ID NO: 362419 - RNA, 22 nt, Human
cgaacaaaacacagcacauaga

SEQ ID NO: 362420 - RNA, 18 nt, Human
cgacagcccgaagccccc

SEQ ID NO: 362421 - RNA, 26 nt, Human
cgagacaggaggaucgcuugaagcca

SEQ ID NO: 362422 - RNA, 24 nt, Human
cgcccaggcuggagugcaguggcg

SEQ ID NO: 362423 - RNA, 18 nt, Human
cggcccgacagcccgaag

SEQ ID NO: 362424 - RNA, 20 nt, Human
cgugggucgacccacgcguc

SEQ ID NO: 362425 - RNA, 20 nt, Human
cgugggucgacccacgcguc

SEQ ID NO: 362426 - RNA, 20 nt, Human
cgugggucgacccacgcguu

SEQ ID NO: 362427 - RNA, 18 nt, Human
cuacacauugauagcccc

SEQ ID NO: 362428 - RNA, 21 nt, Human
cucagccccccaaagugcugg

SEQ ID NO: 362429 - RNA, 24 nt, Human
cucaugccuguagucucaacacuu

SEQ ID NO: 362430 - RNA, 20 nt, Human
cuccaucgcccaggcuggag

SEQ ID NO: 362431 - RNA, 18 nt, Human
cucccagguucaagugau

SEQ ID NO: 362432 - RNA, 20 nt, Human
cuccugaucucaugauucgc

SEQ ID NO: 362433 - RNA, 22 nt, Human
cugaguaucugggauuacaggc

SEQ ID NO: 362434 - RNA, 24 nt, Human
cugcaacuuccaucucccagguuc

SEQ ID NO: 362435 - RNA, 22 nt, Human
cuuuuuuuuuuuuugaguugga

SEQ ID NO: 362436 - RNA, 23 nt, Human
gaaagcaugcucaacaaccacag

SEQ ID NO: 362437 - RNA, 20 nt, Human
gacuacaggcaugagccacc

SEQ ID NO: 362438 - RNA, 21 nt, Human
gacuacaggcaugagccaccg

SEQ ID NO: 362439 - RNA, 19 nt, Human
gacugggcaucgcacuuuu

SEQ ID NO: 362440 - RNA, 22 nt, Human
gacugggcaucgcacuuuucuu

SEQ ID NO: 362441 - RNA, 18 nt, Human
gagaugggguuucaccau

SEQ ID NO: 362442 - RNA, 24 nt, Human
gagaugggguuucaccaugcuggc

SEQ ID NO: 362443 - RNA, 24 nt, Human
gaucgcuugaagccaggaguucaa

SEQ ID NO: 362444 - RNA, 21 nt, Human
gaucucacugcucuugccuac

SEQ ID NO: 362445 - RNA, 22 nt, Human
gaucucaugauucgcccaccuc

SEQ ID NO: 362446 - RNA, 21 nt, Human
gauucuccuaccucagccucc

SEQ ID NO: 362447 - RNA, 23 nt, Human
gcccagcuaauuuuuuguauuuu

SEQ ID NO: 362448 - RNA, 20 nt, Human
gcccaggcuggagugcagug

SEQ ID NO: 362449 - RNA, 24 nt, Human
gcccaggcuggagugcaguggcgu

SEQ ID NO: 362450 - RNA, 25 nt, Human
gcuccaucgcccaggcuggagugca

SEQ ID NO: 362451 - RNA, 19 nt, Human
gcuggagugcaguggcgug

SEQ ID NO: 362452 - RNA, 21 nt, Human
ggacuacaggcaugagccacc

SEQ ID NO: 362453 - RNA, 24 nt, Human
ggacuacaggcaugagccaccgug

SEQ ID NO: 362454 - RNA, 23 nt, Human
ggagucucgcuccaucgcccagg

SEQ ID NO: 362455 - RNA, 22 nt, Human
ggaguucaaaaccagccugggc

SEQ ID NO: 362456 - RNA, 23 nt, Human
ggaucgcuugaagccaggaguuc

SEQ ID NO: 362457 - RNA, 22 nt, Human
ggcacaguggcucaugccugua

SEQ ID NO: 362458 - RNA, 22 nt, Human
ggcgacaaaacgagaccccauc

SEQ ID NO: 362459 - RNA, 22 nt, Human
ggcuggagugcaguggcgugau

SEQ ID NO: 362460 - RNA, 23 nt, Human
ggcugggcacaguggcucaugcc

SEQ ID NO: 362461 - RNA, 24 nt, Human
ggcuggucucgaacuccugaucuc

SEQ ID NO: 362462 - RNA, 18 nt, Human
gggcacaguggcucaugc

SEQ ID NO: 362463 - RNA, 18 nt, Human
gggguuucaccaugcugg

SEQ ID NO: 362464 - RNA, 22 nt, Human
gggguuucaccaugcuggccag

SEQ ID NO: 362465 - RNA, 23 nt, Human
gggguuucaccaugcuggccagg

SEQ ID NO: 362466 - RNA, 19 nt, Human
gggucgacccacgcguccg

SEQ ID NO: 362467 - RNA, 23 nt, Human
gugauucuccuaccucagccucc

SEQ ID NO: 362468 - RNA, 19 nt, Human
guggccuuuaaaagucacu

SEQ ID NO: 362469 - RNA, 21 nt, Human
gugggucgacccacgcguccg

SEQ ID NO: 362470 - RNA, 22 nt, Human
gugggucgacccacgcguccgc

SEQ ID NO: 362471 - RNA, 23 nt, Human
gugggucgacccacgcguccgcg

SEQ ID NO: 362472 - RNA, 22 nt, Human
uaaaaauacauuaauagaggca

SEQ ID NO: 362473 - RNA, 23 nt, Human
uaaaagucacuuuaacuuuaaac

SEQ ID NO: 362474 - RNA, 24 nt, Human
uaauuuuuuguauuuuuaguagag

SEQ ID NO: 362475 - RNA, 23 nt, Human
uacaaacgaacaaaacacagcac

SEQ ID NO: 362476 - RNA, 23 nt, Human
uacaggcaugagccaccgugccc

SEQ ID NO: 362477 - RNA, 24 nt, Human
uaccucagccuccugaguaucugg

SEQ ID NO: 362478 - RNA, 21 nt, Human
uagaacaggcugggcacagug

SEQ ID NO: 362479 - RNA, 24 nt, Human
uaguagagaugggguuucaccaug

SEQ ID NO: 362480 - RNA, 26 nt, Human
uaguagagaugggguuucaccaugcu

SEQ ID NO: 362481 - RNA, 19 nt, Human
uauacaguggauggcagcu

SEQ ID NO: 362482 - RNA, 23 nt, Human
uauggcccuaaaaaaucaacaga

SEQ ID NO: 362483 - RNA, 24 nt, Human
ucacugcaacuuccaucucccagg

SEQ ID NO: 362484 - RNA, 21 nt, Human
ucagaggaaaggcaccagccg

SEQ ID NO: 362485 - RNA, 20 nt, Human
ucagccccccaaagugcugg

SEQ ID NO: 362486 - RNA, 24 nt, Human
uccaucgcccaggcuggagugcag

SEQ ID NO: 362487 - RNA, 21 nt, Human
ucccagguucaagugauucuc

SEQ ID NO: 362488 - RNA, 23 nt, Human
ucccagguucaagugauucuccu

SEQ ID NO: 362489 - RNA, 24 nt, Human
uccugaguaucugggauuacaggc

SEQ ID NO: 362490 - RNA, 18 nt, Human
ucgcauuuuucuuuugca

SEQ ID NO: 362491 - RNA, 22 nt, Human
ucgcccaggcuggagugcagug

SEQ ID NO: 362492 - RNA, 24 nt, Human
ucgcuccaucgcccaggcuggagu

SEQ ID NO: 362493 - RNA, 20 nt, Human
ucuacaaaauacaaacgaac

SEQ ID NO: 362494 - RNA, 19 nt, Human
ucucccagguucaagugau

SEQ ID NO: 362495 - RNA, 24 nt, Human
ucucccagguucaagugauucucc

SEQ ID NO: 362496 - RNA, 18 nt, Human
ucuccuaccucagccucc

SEQ ID NO: 362497 - RNA, 19 nt, Human
ucucgaacuccugaucuca

SEQ ID NO: 362498 - RNA, 22 nt, Human
ucucgcuccaucgcccaggcug

SEQ ID NO: 362499 - RNA, 23 nt, Human
ucucgcuccaucgcccaggcugg

SEQ ID NO: 362500 - RNA, 24 nt, Human
ucucgcuccaucgcccaggcugga

SEQ ID NO: 362501 - RNA, 26 nt, Human
ucucgcuccaucgcccaggcuggagu

SEQ ID NO: 362502 - RNA, 27 nt, Human
ucucgcuccaucgcccaggcuggagug

SEQ ID NO: 362503 - RNA, 18 nt, Human
ucugacccugaagccagg

SEQ ID NO: 362504 - RNA, 21 nt, Human
ucugugcugggaagggaaagu

SEQ ID NO: 362505 - RNA, 26 nt, Human
ugaaagcaugcucaacaaccacagcc

SEQ ID NO: 362506 - RNA, 24 nt, Human
ugacccugaagccagggagggagu

SEQ ID NO: 362507 - RNA, 20 nt, Human
ugagaauuaucaucuaguuu

SEQ ID NO: 362508 - RNA, 25 nt, Human
ugaggaaagugaacaacaacaggug

SEQ ID NO: 362509 - RNA, 24 nt, Human
ugauucgcccaccucagcccccca

SEQ ID NO: 362510 - RNA, 20 nt, Human
ugauucuccuaccucagccu

SEQ ID NO: 362511 - RNA, 23 nt, Human
ugcaacuuccaucucccagguuc

SEQ ID NO: 362512 - RNA, 18 nt, Human
ugccugggcacacucccc

SEQ ID NO: 362513 - RNA, 20 nt, Human
ugccugggcacacuccccuc

SEQ ID NO: 362514 - RNA, 22 nt, Human
ugccugggcacacuccccucag

SEQ ID NO: 362515 - RNA, 18 nt, Human
ugcuggccaggcuggucu

SEQ ID NO: 362516 - RNA, 19 nt, Human
uggagugcaguggcgugau

SEQ ID NO: 362517 - RNA, 23 nt, Human
uggagugcaguggcgugaucuug

SEQ ID NO: 362518 - RNA, 24 nt, Human
uggagugcaguggcgugaucuugg

SEQ ID NO: 362519 - RNA, 21 nt, Human
uggaugcugccucugauaaac

SEQ ID NO: 362520 - RNA, 24 nt, Human
uggccaggcuggucucgaacuccu

SEQ ID NO: 362521 - RNA, 21 nt, Human
uggcucaugccuguagucuca

SEQ ID NO: 362522 - RNA, 21 nt, Human
ugggaagggaaaguuugagga

SEQ ID NO: 362523 - RNA, 18 nt, Human
ugggacuacaggcaugag

SEQ ID NO: 362524 - RNA, 21 nt, Human
ugggacuacaggcaugagcca

SEQ ID NO: 362525 - RNA, 22 nt, Human
ugggacuacaggcaugagccac

SEQ ID NO: 362526 - RNA, 23 nt, Human
ugggacuacaggcaugagccacc

SEQ ID NO: 362527 - RNA, 24 nt, Human
ugggacuacaggcaugagccaccg

SEQ ID NO: 362528 - RNA, 21 nt, Human
ugggauuacaggcgcccguca

SEQ ID NO: 362529 - RNA, 22 nt, Human
ugggauuacaggcgcccgucac

SEQ ID NO: 362530 - RNA, 24 nt, Human
ugggauuacaggcgcccgucacca

SEQ ID NO: 362531 - RNA, 21 nt, Human
ugggcacacuccccucagucc

SEQ ID NO: 362532 - RNA, 23 nt, Human
ugggcuuggaugcugccucugau

SEQ ID NO: 362533 - RNA, 24 nt, Human
ugggguuucaccaugcuggccagg

SEQ ID NO: 362534 - RNA, 21 nt, Human
uguauuuuuaguagagauggg

SEQ ID NO: 362535 - RNA, 23 nt, Human
uuacacaauacagaaggcacuuu

SEQ ID NO: 362536 - RNA, 18 nt, Human
uuaguagagaugggguuu

SEQ ID NO: 362537 - RNA, 22 nt, Human
uuaguagagaugggguuucacc

SEQ ID NO: 362538 - RNA, 24 nt, Human
uuaguagagaugggguuucaccau

SEQ ID NO: 362539 - RNA, 23 nt, Human
uucaagugauucuccuaccucag

SEQ ID NO: 362540 - RNA, 24 nt, Human
uucaagugauucuccuaccucagc

SEQ ID NO: 362541 - RNA, 18 nt, Human
uucgcccaccucagcccc

SEQ ID NO: 362542 - RNA, 21 nt, Human
uucgcccaccucagcccccca

SEQ ID NO: 362543 - RNA, 23 nt, Human
uucuuuuuuuuuuuuugaguugg

SEQ ID NO: 362544 - RNA, 24 nt, Human
uucuuuuuuuuuuuuugaguugga

SEQ ID NO: 362545 - RNA, 23 nt, Human
uuguauuuuuaguagagaugggg

SEQ ID NO: 362546 - RNA, 25 nt, Human
uuuaaacugcaacacaaacuuagau

SEQ ID NO: 362547 - RNA, 21 nt, Human
uuucaccaugcuggccaggcu

SEQ ID NO: 362548 - RNA, 24 nt, Human
uuuuuaguagagaugggguuucac

SEQ ID NO: 362549 - RNA, 21 nt, Human
uuuuuguauuuuuaguagaga

SEQ ID NO: 362550 - RNA, 24 nt, Human
uuuuuuguauuuuuaguagagaug

SEQ ID NO: 362551 - RNA, 25 nt, Human
uuuuuuuuuuuugaguuggagucuc

SEQ ID NO: 362552 - RNA, 24 nt, Human
aaacugucagucugcagcuucacu

SEQ ID NO: 362553 - RNA, 18 nt, Human
aaaggagaugggagcuga

SEQ ID NO: 362554 - RNA, 23 nt, Human
aaggagagauuugaaaccacuga

SEQ ID NO: 362555 - RNA, 19 nt, Human
agagggucuugagaaauuu

SEQ ID NO: 362556 - RNA, 18 nt, Human
aggacagagaggagcagg

SEQ ID NO: 362557 - RNA, 21 nt, Human
agggaaccuuuaggggaauuu

SEQ ID NO: 362558 - RNA, 20 nt, Human
aggggaauuuggguauccuu

SEQ ID NO: 362559 - RNA, 18 nt, Human
aggggagaugugaagugg

SEQ ID NO: 362560 - RNA, 18 nt, Human
cacugggaacaagggaga

SEQ ID NO: 362561 - RNA, 27 nt, Human
cagcuucacuaccccugagaggcaauu

SEQ ID NO: 362562 - RNA, 27 nt, Human
caggccagagaugaguggaauggaggu

SEQ ID NO: 362563 - RNA, 18 nt, Human
ccacugaggcagaacggg

SEQ ID NO: 362564 - RNA, 20 nt, Human
ccccugagaggcaauuggga

SEQ ID NO: 362565 - RNA, 23 nt, Human
cccugagaggcaauugggaagga

SEQ ID NO: 362566 - RNA, 21 nt, Human
cuggaaacugccauucagugg

SEQ ID NO: 362567 - RNA, 20 nt, Human
gaaaccgccauuuuccauca

SEQ ID NO: 362568 - RNA, 20 nt, Human
gagagggaaccuuuagggga

SEQ ID NO: 362569 - RNA, 21 nt, Human
gaguggaauggagguccugga

SEQ ID NO: 362570 - RNA, 19 nt, Human
gauuugaaacuucuagagg

SEQ ID NO: 362571 - RNA, 24 nt, Human
gcugguaggggagaugugaagugg

SEQ ID NO: 362572 - RNA, 25 nt, Human
gggaacaagggagagugccgguacc

SEQ ID NO: 362573 - RNA, 19 nt, Human
gggaauuuggguauccuug

SEQ ID NO: 362574 - RNA, 25 nt, Human
gggucuugagaaauuuggugcuuuc

SEQ ID NO: 362575 - RNA, 22 nt, Human
gguggagagggaaccuuuaggg

SEQ ID NO: 362576 - RNA, 23 nt, Human
ucaggccagagaugaguggaaug

SEQ ID NO: 362577 - RNA, 20 nt, Human
ugaaaccacugaggcagaac

SEQ ID NO: 362578 - RNA, 20 nt, Human
ugaaacuucuagaggaggac

SEQ ID NO: 362579 - RNA, 23 nt, Human
ugaaaggagagauuugaaaccac

SEQ ID NO: 362580 - RNA, 21 nt, Human
ugacagcacugggaacaaggg

SEQ ID NO: 362581 - RNA, 24 nt, Human
ugaguggaauggagguccuggaaa

SEQ ID NO: 362582 - RNA, 18 nt, Human
uggaauggcggggacgag

SEQ ID NO: 362583 - RNA, 20 nt, Human
uggcggggacgaguaauugg

SEQ ID NO: 362584 - RNA, 20 nt, Human
uucgcagaaucugcugguag

SEQ ID NO: 362585 - RNA, 23 nt, Human
uucuagaggaggaccuugaauuu

SEQ ID NO: 362586 - RNA, 21 nt, Human
uugaaaccacugaggcagaac

SEQ ID NO: 362587 - RNA, 18 nt, Human
uugaaaccgccauuuucc

SEQ ID NO: 362588 - RNA, 19 nt, Human
uugaaaccgccauuuucca

SEQ ID NO: 362589 - RNA, 20 nt, Human
uugaaaccgccauuuuccau

SEQ ID NO: 362590 - RNA, 19 nt, Human
uugaauuuuucugaaagga

SEQ ID NO: 362591 - RNA, 22 nt, Human
aaaaacaaaacaaaacucuuca

SEQ ID NO: 362592 - RNA, 18 nt, Human
aaacucuucaagcuggca

SEQ ID NO: 362593 - RNA, 18 nt, Human
aaagagguggucacugag

SEQ ID NO: 362594 - RNA, 21 nt, Human
acaaaacaaaacucuucaagc

SEQ ID NO: 362595 - RNA, 22 nt, Human
acagcagcgggaaggugcauca

SEQ ID NO: 362596 - RNA, 19 nt, Human
acauuacaccccuccuauu

SEQ ID NO: 362597 - RNA, 20 nt, Human
acauuuucucaacucggcug

SEQ ID NO: 362598 - RNA, 18 nt, Human
acccgggaaagaacacgu

SEQ ID NO: 362599 - RNA, 19 nt, Human
agcaagacaaugcugagaa

SEQ ID NO: 362600 - RNA, 22 nt, Human
agcgggaaggugcaucacucug

SEQ ID NO: 362601 - RNA, 23 nt, Human
agguaugugaagcccacugagcc

SEQ ID NO: 362602 - RNA, 18 nt, Human
aucacucugucuucccau

SEQ ID NO: 362603 - RNA, 20 nt, Human
caaaacaaaacucuucaagc

SEQ ID NO: 362604 - RNA, 23 nt, Human
cacagcucaaguuuaaucaaccu

SEQ ID NO: 362605 - RNA, 21 nt, Human
cagggacaguguccaugggag

SEQ ID NO: 362606 - RNA, 24 nt, Human
caucaugaauucaaggagcaccuu

SEQ ID NO: 362607 - RNA, 23 nt, Human
cauuuucucaacucggcugggaa

SEQ ID NO: 362608 - RNA, 19 nt, Human
ccagagaaaaucaggcaac

SEQ ID NO: 362609 - RNA, 20 nt, Human
ccagcagaagagaaaugggc

SEQ ID NO: 362610 - RNA, 22 nt, Human
ccauggugaucuggucccaggg

SEQ ID NO: 362611 - RNA, 26 nt, Human
cccaggcagagguaugugaagcccac

SEQ ID NO: 362612 - RNA, 22 nt, Human
ccggacuggggcagucuuuccc

SEQ ID NO: 362613 - RNA, 28 nt, Human
ccucacagcagcgggaaggugcaucacu

SEQ ID NO: 362614 - RNA, 21 nt, Human
ccucuaugcaaugagucaccc

SEQ ID NO: 362615 - RNA, 21 nt, Human
ccugcagccuuuauggaagag

SEQ ID NO: 362616 - RNA, 23 nt, Human
cugcgggcucuuagggaaggucc

SEQ ID NO: 362617 - RNA, 19 nt, Human
gaagacacuuuucacugag

SEQ ID NO: 362618 - RNA, 19 nt, Human
gacacuguucucugaacgu

SEQ ID NO: 362619 - RNA, 26 nt, Human
gaggaaagaagauucccaggcagagg

SEQ ID NO: 362620 - RNA, 21 nt, Human
gcacauuacucacuaccaccu

SEQ ID NO: 362621 - RNA, 23 nt, Human
gcagaacccgucacagcucaagu

SEQ ID NO: 362622 - RNA, 18 nt, Human
gcagcaagacaaugcuga

SEQ ID NO: 362623 - RNA, 23 nt, Human
gccauggugaucuggucccaggg

SEQ ID NO: 362624 - RNA, 24 nt, Human
gccuuuauggaagaggggagggag

SEQ ID NO: 362625 - RNA, 22 nt, Human
ggaaagaagauucccaggcaga

SEQ ID NO: 362626 - RNA, 18 nt, Human
ggacuaugccagagaaaa

SEQ ID NO: 362627 - RNA, 21 nt, Human
ggauucuguguaugugugugu

SEQ ID NO: 362628 - RNA, 23 nt, Human
gggacuaugccagagaaaaucag

SEQ ID NO: 362629 - RNA, 24 nt, Human
gguaaagcccuuuuagcagcucua

SEQ ID NO: 362630 - RNA, 24 nt, Human
uaaauggaaaaaaaacaaaacaaa

SEQ ID NO: 362631 - RNA, 21 nt, Human
uagaagacacuuuucacugag

SEQ ID NO: 362632 - RNA, 22 nt, Human
ucacucugucuucccauaaaag

SEQ ID NO: 362633 - RNA, 23 nt, Human
ucacuuuauuaaaaaaaaaaaau

SEQ ID NO: 362634 - RNA, 18 nt, Human
ucagaaaagguaggaaca

SEQ ID NO: 362635 - RNA, 19 nt, Human
ucuaagagguucagaaaag

SEQ ID NO: 362636 - RNA, 23 nt, Human
ucuacaaucaggagggauuucaa

SEQ ID NO: 362637 - RNA, 19 nt, Human
ucugaacguggaugugcug

SEQ ID NO: 362638 - RNA, 25 nt, Human
ucuucuacuuuuauuucuaagaguc

SEQ ID NO: 362639 - RNA, 18 nt, Human
ucuuucccugcgggcucu

SEQ ID NO: 362640 - RNA, 22 nt, Human
ucuuucuucuacuuuuauuucu

SEQ ID NO: 362641 - RNA, 19 nt, Human
ugaaagauaaugaaaauag

SEQ ID NO: 362642 - RNA, 21 nt, Human
ugaaagauaaugaaaauagaa

SEQ ID NO: 362643 - RNA, 23 nt, Human
ugaacaaugucacauuacacccc

SEQ ID NO: 362644 - RNA, 21 nt, Human
ugagaacauuuucucaacucg

SEQ ID NO: 362645 - RNA, 19 nt, Human
ugaggcaucaugaauucaa

SEQ ID NO: 362646 - RNA, 23 nt, Human
uggaaaaaaaacaaaacaaaacu

SEQ ID NO: 362647 - RNA, 21 nt, Human
uggaagaggggagggagucug

SEQ ID NO: 362648 - RNA, 23 nt, Human
uggagcccauguuggugugaggc

SEQ ID NO: 362649 - RNA, 23 nt, Human
uggcagcaagacaaugcugagaa

SEQ ID NO: 362650 - RNA, 21 nt, Human
ugggaggggaggaaagaagau

SEQ ID NO: 362651 - RNA, 25 nt, Human
ugggaggggaggaaagaagauuccc

SEQ ID NO: 362652 - RNA, 18 nt, Human
uguguaugugugugugug

SEQ ID NO: 362653 - RNA, 24 nt, Human
uuggugugaggcacucagugaggu

SEQ ID NO: 362654 - RNA, 21 nt, Human
acuuugaugauuuuugaggau

SEQ ID NO: 362655 - RNA, 19 nt, Human
cuuugaugauuuuugagga

SEQ ID NO: 362656 - RNA, 18 nt, Human
gcucggggucgcuugcga

SEQ ID NO: 362657 - RNA, 21 nt, Human
aagagagaaagggauauggaa

SEQ ID NO: 362658 - RNA, 24 nt, Human
agccccgccgcugcgcuccccucc

SEQ ID NO: 362659 - RNA, 24 nt, Human
aggcgagggcagcgggacuucggg

SEQ ID NO: 362660 - RNA, 24 nt, Human
cagagcagcccccgccgcgcuaaa

SEQ ID NO: 362661 - RNA, 21 nt, Human
cagcgucccgggaaaggaaag

SEQ ID NO: 362662 - RNA, 21 nt, Human
caggcucuacacaggggagcc

SEQ ID NO: 362663 - RNA, 19 nt, Human
ccaagccccauuggacaag

SEQ ID NO: 362664 - RNA, 22 nt, Human
ccaaguuuggcacugggagcaa

SEQ ID NO: 362665 - RNA, 23 nt, Human
ccccaccccgaugcucuuccgaa

SEQ ID NO: 362666 - RNA, 20 nt, Human
cccccaccccgaugcucuuc

SEQ ID NO: 362667 - RNA, 18 nt, Human
ccccugugccucaggugg

SEQ ID NO: 362668 - RNA, 22 nt, Human
cccgcagugcagaggcgagggc

SEQ ID NO: 362669 - RNA, 20 nt, Human
cccgccgcgcuaagaggccg

SEQ ID NO: 362670 - RNA, 21 nt, Human
ccgcccgcccgcuugcccgcc

SEQ ID NO: 362671 - RNA, 22 nt, Human
ccgccgcgcuaagaggccgccc

SEQ ID NO: 362672 - RNA, 21 nt, Human
ccgcggagcucauggcccagc

SEQ ID NO: 362673 - RNA, 21 nt, Human
ccgcggcugcugggcucaggg

SEQ ID NO: 362674 - RNA, 20 nt, Human
ccgcugcgcuccccuccccu

SEQ ID NO: 362675 - RNA, 24 nt, Human
cgaagacgccuccgccagggccga

SEQ ID NO: 362676 - RNA, 20 nt, Human
cgagggacaugcuguugccg

SEQ ID NO: 362677 - RNA, 23 nt, Human
cgcacuucgcccggggcgcgccc

SEQ ID NO: 362678 - RNA, 18 nt, Human
cgcgcccagagcagcccc

SEQ ID NO: 362679 - RNA, 25 nt, Human
cgucccgcagugcagaggcgagggc

SEQ ID NO: 362680 - RNA, 19 nt, Human
cugcugggcucaggggcgg

SEQ ID NO: 362681 - RNA, 20 nt, Human
cugcugggcucaggggcggc

SEQ ID NO: 362682 - RNA, 18 nt, Human
gcuugcccgcccguuagc

SEQ ID NO: 362683 - RNA, 20 nt, Human
ggaaaggacuccguccggcg

SEQ ID NO: 362684 - RNA, 23 nt, Human
ggcacugggagcaauggaaggaa

SEQ ID NO: 362685 - RNA, 19 nt, Human
ggcgcacuucgcccggggc

SEQ ID NO: 362686 - RNA, 18 nt, Human
ggcggaggcgccgcggug

SEQ ID NO: 362687 - RNA, 21 nt, Human
ggcuucgcuggccucggugcu

SEQ ID NO: 362688 - RNA, 18 nt, Human
gggccggggccggagacu

SEQ ID NO: 362689 - RNA, 19 nt, Human
ggggagccgcaggugggga

SEQ ID NO: 362690 - RNA, 23 nt, Human
gguugggugggcuggaggaggag

SEQ ID NO: 362691 - RNA, 22 nt, Human
gucccgggaaaggaaaggacuc

SEQ ID NO: 362692 - RNA, 19 nt, Human
ucaggguccucuucaccuc

SEQ ID NO: 362693 - RNA, 18 nt, Human
ucgcuggccucggugcuc

SEQ ID NO: 362694 - RNA, 18 nt, Human
ucuuagccgaucccggga

SEQ ID NO: 362695 - RNA, 21 nt, Human
uggaacgggucacagggaggg

SEQ ID NO: 362696 - RNA, 21 nt, Human
uggaggaggugggcccugagc

SEQ ID NO: 362697 - RNA, 19 nt, Human
uggcugggguacucgcugg

SEQ ID NO: 362698 - RNA, 22 nt, Human
uggcugggguacucgcuggagg

SEQ ID NO: 362699 - RNA, 22 nt, Human
ugggcagaagucaagguugagg

SEQ ID NO: 362700 - RNA, 18 nt, Human
ugggcuugcagagcagcc

SEQ ID NO: 362701 - RNA, 19 nt, Human
ugggugggcuggaggagga

SEQ ID NO: 362702 - RNA, 21 nt, Human
uucggggaggcuguccuggcc

SEQ ID NO: 362703 - RNA, 18 nt, Human
uugggcagaagucaaggu

SEQ ID NO: 362704 - RNA, 26 nt, Human
aaaaaaaaaaagcaucuuucaaaaaa

SEQ ID NO: 362705 - RNA, 22 nt, Human
aaaaaaaaagcaucuuucaaaa

SEQ ID NO: 362706 - RNA, 23 nt, Human
aaaagcaucuuucaaaaaagcaa

SEQ ID NO: 362707 - RNA, 21 nt, Human
aaaccucggcccgcgccccgc

SEQ ID NO: 362708 - RNA, 24 nt, Human
aaggcagcccccccaaggcugccc

SEQ ID NO: 362709 - RNA, 24 nt, Human
acaaaggcagcccccccaaggcug

SEQ ID NO: 362710 - RNA, 19 nt, Human
acacuucagaaggacagac

SEQ ID NO: 362711 - RNA, 21 nt, Human
acagacaggaccauggagggc

SEQ ID NO: 362712 - RNA, 22 nt, Human
accagcaaugucacagcucagc

SEQ ID NO: 362713 - RNA, 22 nt, Human
acccaccggcuggcccgucccg

SEQ ID NO: 362714 - RNA, 19 nt, Human
accccgcagcccccgacac

SEQ ID NO: 362715 - RNA, 22 nt, Human
acguacuuccccagcgcccacc

SEQ ID NO: 362716 - RNA, 20 nt, Human
acgugccugggcgcgcucac

SEQ ID NO: 362717 - RNA, 18 nt, Human
acugugccuucccucugg

SEQ ID NO: 362718 - RNA, 25 nt, Human
agaaggacagacaggaccauggagg

SEQ ID NO: 362719 - RNA, 20 nt, Human
agacagagaagccacaugca

SEQ ID NO: 362720 - RNA, 19 nt, Human
agacaggaccauggagggc

SEQ ID NO: 362721 - RNA, 18 nt, Human
agcccccgacacugcgac

SEQ ID NO: 362722 - RNA, 24 nt, Human
agcccuggggggcagaaaggauuu

SEQ ID NO: 362723 - RNA, 21 nt, Human
agcgcccaccacaaaggcagc

SEQ ID NO: 362724 - RNA, 21 nt, Human
aggcaggcagacuccccagga

SEQ ID NO: 362725 - RNA, 21 nt, Human
aggcaggggucguggggaugc

SEQ ID NO: 362726 - RNA, 19 nt, Human
agggccccgagacaccccg

SEQ ID NO: 362727 - RNA, 21 nt, Human
agggggaauccuagggggccu

SEQ ID NO: 362728 - RNA, 20 nt, Human
agugugggagcagcugagga

SEQ ID NO: 362729 - RNA, 22 nt, Human
augcaguucuucauucuacguc

SEQ ID NO: 362730 - RNA, 19 nt, Human
caaaggcagcccccccaag

SEQ ID NO: 362731 - RNA, 20 nt, Human
caagagcaccaaggaugacc

SEQ ID NO: 362732 - RNA, 28 nt, Human
caagagcaccaaggaugacuggagaccc

SEQ ID NO: 362733 - RNA, 26 nt, Human
caagccccccaaggggcaugagccag

SEQ ID NO: 362734 - RNA, 25 nt, Human
caagccuggcacauaccaaggccag

SEQ ID NO: 362735 - RNA, 18 nt, Human
caaggggcaugagccagu

SEQ ID NO: 362736 - RNA, 18 nt, Human
caccaaggaugaccagca

SEQ ID NO: 362737 - RNA, 23 nt, Human
caccaaggaugaccagcaauguc

SEQ ID NO: 362738 - RNA, 22 nt, Human
caccacccaccucuuccagcaa

SEQ ID NO: 362739 - RNA, 21 nt, Human
caccccgcagcccccgacacu

SEQ ID NO: 362740 - RNA, 19 nt, Human
cacgcguggcuggcagggu

SEQ ID NO: 362741 - RNA, 21 nt, Human
cacuucagaaggacagacagg

SEQ ID NO: 362742 - RNA, 27 nt, Human
cagcgcccaccacaaaggcagcccccc

SEQ ID NO: 362743 - RNA, 19 nt, Human
cagcugcuccaaggggaag

SEQ ID NO: 362744 - RNA, 24 nt, Human
caucacaucagauggucccgcacc

SEQ ID NO: 362745 - RNA, 22 nt, Human
cauggagggcugcccuuagggu

SEQ ID NO: 362746 - RNA, 19 nt, Human
ccacaaaggcagccccccc

SEQ ID NO: 362747 - RNA, 22 nt, Human
ccacagagacagagaagccaca

SEQ ID NO: 362748 - RNA, 21 nt, Human
ccacccaccucuuccagcaac

SEQ ID NO: 362749 - RNA, 24 nt, Human
ccagcggcuguccaggcucucucu

SEQ ID NO: 362750 - RNA, 18 nt, Human
ccagcuuaguuggccugu

SEQ ID NO: 362751 - RNA, 21 nt, Human
cccagcccaggcaagccuggc

SEQ ID NO: 362752 - RNA, 21 nt, Human
cccauugcuaaggcaggcggc

SEQ ID NO: 362753 - RNA, 24 nt, Human
ccccaaggcugcccagcccaggca

SEQ ID NO: 362754 - RNA, 21 nt, Human
ccccagggccccgagacaccc

SEQ ID NO: 362755 - RNA, 22 nt, Human
cccccaaggcugcccagcccag

SEQ ID NO: 362756 - RNA, 21 nt, Human
ccccccaaggcugcccagccc

SEQ ID NO: 362757 - RNA, 20 nt, Human
cccgcagcccccgacacugc

SEQ ID NO: 362758 - RNA, 23 nt, Human
cccgcagcccccgacacugcgac

SEQ ID NO: 362759 - RNA, 18 nt, Human
cccgucccgaagcaacac

SEQ ID NO: 362760 - RNA, 24 nt, Human
cccuagggggauggcuuuccugcu

SEQ ID NO: 362761 - RNA, 19 nt, Human
cccucuggaugcauucugg

SEQ ID NO: 362762 - RNA, 29 nt, Human
ccgccugcaaaguuaccacaggggcuggg

SEQ ID NO: 362763 - RNA, 21 nt, Human
ccgcugggacguacuucccca

SEQ ID NO: 362764 - RNA, 19 nt, Human
ccugagcugguauccaaga

SEQ ID NO: 362765 - RNA, 19 nt, Human
ccugcaaaccucggcccgc

SEQ ID NO: 362766 - RNA, 20 nt, Human
ccugugggcaaggcacuagc

SEQ ID NO: 362767 - RNA, 22 nt, Human
ccuguguccugaggccaggcag

SEQ ID NO: 362768 - RNA, 19 nt, Human
cgagacaccccgcagcccc

SEQ ID NO: 362769 - RNA, 22 nt, Human
cuacaaagcuucuggcacagga

SEQ ID NO: 362770 - RNA, 22 nt, Human
cuccccaggacaggaguuuccg

SEQ ID NO: 362771 - RNA, 21 nt, Human
gaaaggcuccagcggcugucc

SEQ ID NO: 362772 - RNA, 18 nt, Human
gaaccagcuccgaggacc

SEQ ID NO: 362773 - RNA, 18 nt, Human
gacaggaguuuccgaugg

SEQ ID NO: 362774 - RNA, 25 nt, Human
gagacaccccgcagcccccgacacu

SEQ ID NO: 362775 - RNA, 21 nt, Human
gcagcccccccaaggcugccc

SEQ ID NO: 362776 - RNA, 21 nt, Human
gccaguguccccugagcuggu

SEQ ID NO: 362777 - RNA, 24 nt, Human
gcccugcaaaccucggcccgcgcc

SEQ ID NO: 362778 - RNA, 22 nt, Human
gcccuggggggcagaaaggauu

SEQ ID NO: 362779 - RNA, 19 nt, Human
gcggggcggcugcccuggg

SEQ ID NO: 362780 - RNA, 19 nt, Human
ggagaugugccaggggccc

SEQ ID NO: 362781 - RNA, 19 nt, Human
ggcacauaccaaggccagc

SEQ ID NO: 362782 - RNA, 20 nt, Human
gggcacagugcagggacagc

SEQ ID NO: 362783 - RNA, 18 nt, Human
gggcaugagccagugagg

SEQ ID NO: 362784 - RNA, 24 nt, Human
gggccagcuuaguuggccuguguc

SEQ ID NO: 362785 - RNA, 18 nt, Human
gggcggcugcccuggggc

SEQ ID NO: 362786 - RNA, 23 nt, Human
gucaguuaaaaaaaaaaaaagca

SEQ ID NO: 362787 - RNA, 24 nt, Human
guggacgcagaagcccaccaccca

SEQ ID NO: 362788 - RNA, 20 nt, Human
uaagcggaggcccccauugc

SEQ ID NO: 362789 - RNA, 22 nt, Human
uagcgcuccuuagacccugagg

SEQ ID NO: 362790 - RNA, 23 nt, Human
ucaaaaaagcaagagcaccaagg

SEQ ID NO: 362791 - RNA, 24 nt, Human
ucaagccccccaaggggcaugagc

SEQ ID NO: 362792 - RNA, 23 nt, Human
ucagauggucccgcaccuguggg

SEQ ID NO: 362793 - RNA, 19 nt, Human
ucaggccacgugcagcucc

SEQ ID NO: 362794 - RNA, 20 nt, Human
ucaguuaaaaaaaaaaaaag

SEQ ID NO: 362795 - RNA, 19 nt, Human
uccacagagacagagaagc

SEQ ID NO: 362796 - RNA, 22 nt, Human
uccccagcgcccaccacaaagg

SEQ ID NO: 362797 - RNA, 19 nt, Human
uccccuccgggcuggcaca

SEQ ID NO: 362798 - RNA, 18 nt, Human
ucccgaagcaacacgugc

SEQ ID NO: 362799 - RNA, 21 nt, Human
ucccgaagcaacacgugccug

SEQ ID NO: 362800 - RNA, 20 nt, Human
ucccggcucccacccugccc

SEQ ID NO: 362801 - RNA, 19 nt, Human
ucccucuggaugcauucug

SEQ ID NO: 362802 - RNA, 25 nt, Human
uccgcacccacagcugcuccaaggg

SEQ ID NO: 362803 - RNA, 23 nt, Human
uccgcggugaccgggaccggggc

SEQ ID NO: 362804 - RNA, 19 nt, Human
uccgcuggauccgcaccca

SEQ ID NO: 362805 - RNA, 22 nt, Human
ucgccagcacgcuguggccacc

SEQ ID NO: 362806 - RNA, 23 nt, Human
ucuggcacaggagacaauggucu

SEQ ID NO: 362807 - RNA, 25 nt, Human
ucuggcacaggagacaauggucugg

SEQ ID NO: 362808 - RNA, 19 nt, Human
ugcccuggggcucccggac

SEQ ID NO: 362809 - RNA, 22 nt, Human
ugccgccaaccugagauggcuu

SEQ ID NO: 362810 - RNA, 19 nt, Human
ugccugggcgcgcucacag

SEQ ID NO: 362811 - RNA, 18 nt, Human
ugcuaaggcaggcggccc

SEQ ID NO: 362812 - RNA, 23 nt, Human
uggacgcagaagcccaccaccca

SEQ ID NO: 362813 - RNA, 19 nt, Human
uggaugcauucuggauuuc

SEQ ID NO: 362814 - RNA, 24 nt, Human
uggcaggguucacccaccggcugg

SEQ ID NO: 362815 - RNA, 18 nt, Human
uggccuguguccugaggc

SEQ ID NO: 362816 - RNA, 21 nt, Human
ugggagcagcugaggacccgc

SEQ ID NO: 362817 - RNA, 19 nt, Human
uggggaugcacugagggcc

SEQ ID NO: 362818 - RNA, 20 nt, Human
uguccccugagcugguaucc

SEQ ID NO: 362819 - RNA, 22 nt, Human
ugucucaagccccccaaggggc

SEQ ID NO: 362820 - RNA, 19 nt, Human
uuagacccugaggccgcug

SEQ ID NO: 362821 - RNA, 19 nt, Human
aaaaaaagaaaaacagaca

SEQ ID NO: 362822 - RNA, 22 nt, Human
aaaaaaagaaaaacagacagaa

SEQ ID NO: 362823 - RNA, 21 nt, Human
aaaaaagaaaaacagacagaa

SEQ ID NO: 362824 - RNA, 20 nt, Human
aaaaaaucaaacacauccag

SEQ ID NO: 362825 - RNA, 21 nt, Human
aaaaagggggaaaacaucuga

SEQ ID NO: 362826 - RNA, 18 nt, Human
aaaacaaagcaaaaaaag

SEQ ID NO: 362827 - RNA, 18 nt, Human
aaacaaaacaaagcaaaa

SEQ ID NO: 362828 - RNA, 19 nt, Human
aaacaaaacaaagcaaaaa

SEQ ID NO: 362829 - RNA, 19 nt, Human
aaauauggccacauaccaa

SEQ ID NO: 362830 - RNA, 25 nt, Human
aacaaagcaaaaaaagaaaaacaga

SEQ ID NO: 362831 - RNA, 24 nt, Human
aacggggugccaaaaaaaaggggg

SEQ ID NO: 362832 - RNA, 18 nt, Human
aacuauguagaaagacca

SEQ ID NO: 362833 - RNA, 22 nt, Human
aacuuuacuucuggcuccucug

SEQ ID NO: 362834 - RNA, 26 nt, Human
aagcaaaaaaagaaaaacagacagaa

SEQ ID NO: 362835 - RNA, 23 nt, Human
aaguggcugcugugaagucaaga

SEQ ID NO: 362836 - RNA, 23 nt, Human
acaaagcaaaaaaagaaaaacag

SEQ ID NO: 362837 - RNA, 24 nt, Human
acaaauacaaauggccuaguuaca

SEQ ID NO: 362838 - RNA, 25 nt, Human
acauuuuguggccucuguggagccc

SEQ ID NO: 362839 - RNA, 20 nt, Human
accagaacaaauauugccag

SEQ ID NO: 362840 - RNA, 22 nt, Human
accaugugcugcuuugauugcu

SEQ ID NO: 362841 - RNA, 18 nt, Human
acugcacugcagccuggg

SEQ ID NO: 362842 - RNA, 24 nt, Human
acugcacugcagccugggcaacag

SEQ ID NO: 362843 - RNA, 22 nt, Human
agaaaaacagacagaauguaaa

SEQ ID NO: 362844 - RNA, 21 nt, Human
agacagaauguaaaaugaagg

SEQ ID NO: 362845 - RNA, 22 nt, Human
agcaauggaauaauuaaaaaga

SEQ ID NO: 362846 - RNA, 21 nt, Human
agcagccccuugguagacuga

SEQ ID NO: 362847 - RNA, 19 nt, Human
aggcaguugcugugcagag

SEQ ID NO: 362848 - RNA, 23 nt, Human
aggcaguugcugugcagaguucu

SEQ ID NO: 362849 - RNA, 24 nt, Human
aggcucaguuuaugaaaaaggccu

SEQ ID NO: 362850 - RNA, 23 nt, Human
agggggaagagucaaagguaaaa

SEQ ID NO: 362851 - RNA, 18 nt, Human
aguaacacagaaauaaga

SEQ ID NO: 362852 - RNA, 19 nt, Human
auaaauauggccacauacc

SEQ ID NO: 362853 - RNA, 23 nt, Human
auccaggcaguugcugugcagag

SEQ ID NO: 362854 - RNA, 24 nt, Human
caaacaaaacaaagcaaaaaaaga

SEQ ID NO: 362855 - RNA, 24 nt, Human
caacagugcaagacugucucaaaa

SEQ ID NO: 362856 - RNA, 22 nt, Human
caagauaaggcaacaaagucag

SEQ ID NO: 362857 - RNA, 21 nt, Human
cacaaacaaaacaaagcaaaa

SEQ ID NO: 362858 - RNA, 25 nt, Human
caccuuaaaauacagaacacuaaac

SEQ ID NO: 362859 - RNA, 20 nt, Human
cacugcacugcagccugggc

SEQ ID NO: 362860 - RNA, 23 nt, Human
cacugcacugcagccugggcaac

SEQ ID NO: 362861 - RNA, 24 nt, Human
cacugcacugcagccugggcaaca

SEQ ID NO: 362862 - RNA, 20 nt, Human
cacuuguaaccgcgagugac

SEQ ID NO: 362863 - RNA, 20 nt, Human
cagaacccccagcuuuaccc

SEQ ID NO: 362864 - RNA, 24 nt, Human
cauaugugaccuauaaaacaccaa

SEQ ID NO: 362865 - RNA, 22 nt, Human
caucuauccuaguuccuguccc

SEQ ID NO: 362866 - RNA, 24 nt, Human
cauuugcuucuaggauuccugcuu

SEQ ID NO: 362867 - RNA, 21 nt, Human
ccaaaaaaaagggggaaaaca

SEQ ID NO: 362868 - RNA, 20 nt, Human
ccacugcacugcagccuggg

SEQ ID NO: 362869 - RNA, 20 nt, Human
ccacugcacugcagccuggg

SEQ ID NO: 362870 - RNA, 21 nt, Human
ccacugcacugcagccugggc

SEQ ID NO: 362871 - RNA, 24 nt, Human
ccacugcacugcagccugggcaac

SEQ ID NO: 362872 - RNA, 20 nt, Human
ccccuuccuucuccuccucc

SEQ ID NO: 362873 - RNA, 22 nt, Human
cccggccccuuccuucuccucc

SEQ ID NO: 362874 - RNA, 22 nt, Human
cccuggucccaccaggccaagc

SEQ ID NO: 362875 - RNA, 21 nt, Human
ccuacugaaauagaagauaaa

SEQ ID NO: 362876 - RNA, 19 nt, Human
ccuccggcuacagaacccc

SEQ ID NO: 362877 - RNA, 26 nt, Human
ccucuagggucgcugccugaucgccc

SEQ ID NO: 362878 - RNA, 18 nt, Human
ccucugaauaguaucaug

SEQ ID NO: 362879 - RNA, 27 nt, Human
cgcuuuaaaaaaucaaacacauccagg

SEQ ID NO: 362880 - RNA, 19 nt, Human
cuccggcuacagaaccccc

SEQ ID NO: 362881 - RNA, 23 nt, Human
cugcauacaguacaacuugcaca

SEQ ID NO: 362882 - RNA, 18 nt, Human
gaacccccagcuuuaccc

SEQ ID NO: 362883 - RNA, 22 nt, Human
gccacauaccaagaugugaaca

SEQ ID NO: 362884 - RNA, 24 nt, Human
gccacugcacugcagccugggcaa

SEQ ID NO: 362885 - RNA, 26 nt, Human
gccuccggcuacagaacccccagcuu

SEQ ID NO: 362886 - RNA, 22 nt, Human
gcuaugaaguuucagaacaagg

SEQ ID NO: 362887 - RNA, 22 nt, Human
ggcaagaagauuccucccuggg

SEQ ID NO: 362888 - RNA, 23 nt, Human
gucaagaaaugcacauucauaaa

SEQ ID NO: 362889 - RNA, 23 nt, Human
gugcaacggggugccaaaaaaaa

SEQ ID NO: 362890 - RNA, 18 nt, Human
guuucugggauauaaugg

SEQ ID NO: 362891 - RNA, 25 nt, Human
uaaaaagagauaagagcagugccaa

SEQ ID NO: 362892 - RNA, 20 nt, Human
uaaaaucccucaaacagcac

SEQ ID NO: 362893 - RNA, 25 nt, Human
uaaaaucccucaaacagcacuuuuc

SEQ ID NO: 362894 - RNA, 19 nt, Human
uaagaagaagcccuucagc

SEQ ID NO: 362895 - RNA, 21 nt, Human
uaaggaagaaugcuuuaaaaa

SEQ ID NO: 362896 - RNA, 23 nt, Human
uacaacaccaugugcugcuuuga

SEQ ID NO: 362897 - RNA, 18 nt, Human
uacaacuugcacauugag

SEQ ID NO: 362898 - RNA, 22 nt, Human
uacacaauucccaaauuagcac

SEQ ID NO: 362899 - RNA, 23 nt, Human
uacagaacacuaaaccagaacaa

SEQ ID NO: 362900 - RNA, 24 nt, Human
uacagaacacuaaaccagaacaaa

SEQ ID NO: 362901 - RNA, 22 nt, Human
uacagaacccccagcuuuaccc

SEQ ID NO: 362902 - RNA, 25 nt, Human
uacagaacccccagcuuuacccuac

SEQ ID NO: 362903 - RNA, 21 nt, Human
uagauacagacauaugugacc

SEQ ID NO: 362904 - RNA, 19 nt, Human
uagcacaaacaaaacaaag

SEQ ID NO: 362905 - RNA, 22 nt, Human
uagcagccccuugguagacuga

SEQ ID NO: 362906 - RNA, 18 nt, Human
ucacaaagcaauggaaua

SEQ ID NO: 362907 - RNA, 19 nt, Human
uccauccaucaugacuugc

SEQ ID NO: 362908 - RNA, 21 nt, Human
uccgccaacuggagugagggu

SEQ ID NO: 362909 - RNA, 24 nt, Human
ucgcccaguuuaagggagacccgu

SEQ ID NO: 362910 - RNA, 22 nt, Human
ucgccgccgccuccggcuacag

SEQ ID NO: 362911 - RNA, 18 nt, Human
ucuaaagcuccuacugaa

SEQ ID NO: 362912 - RNA, 19 nt, Human
ucuguggagcccugguccc

SEQ ID NO: 362913 - RNA, 24 nt, Human
ugaaaagaggcucaguuuaugaaa

SEQ ID NO: 362914 - RNA, 24 nt, Human
ugaaauagaagauaaauuuaaaac

SEQ ID NO: 362915 - RNA, 24 nt, Human
ugacuugcaacauuuuguggccuc

SEQ ID NO: 362916 - RNA, 28 nt, Human
ugacuugcaacauuuuguggccucugug

SEQ ID NO: 362917 - RNA, 18 nt, Human
ugaguaacacagaaauaa

SEQ ID NO: 362918 - RNA, 24 nt, Human
ugcaaaaacguacuucuaaacaaa

SEQ ID NO: 362919 - RNA, 22 nt, Human
ugcaacauuuuguggccucugu

SEQ ID NO: 362920 - RNA, 22 nt, Human
ugcauacaguacaacuugcaca

SEQ ID NO: 362921 - RNA, 18 nt, Human
ugcaugaaaaauuuccag

SEQ ID NO: 362922 - RNA, 18 nt, Human
uggagcccuggucccacc

SEQ ID NO: 362923 - RNA, 23 nt, Human
uggagcccuggucccaccaggcc

SEQ ID NO: 362924 - RNA, 21 nt, Human
uggcugcugugaagucaagaa

SEQ ID NO: 362925 - RNA, 20 nt, Human
uguagaaagaccaauguaca

SEQ ID NO: 362926 - RNA, 21 nt, Human
ugugucauucuaaaaaaguua

SEQ ID NO: 362927 - RNA, 22 nt, Human
uucccaaauuagcacaaacaaa

SEQ ID NO: 362928 - RNA, 25 nt, Human
uuguggccucuguggagcccugguc

SEQ ID NO: 362929 - RNA, 22 nt, Human
uuugaaaugguauauuaaaaaa

SEQ ID NO: 362930 - RNA, 23 nt, Human
aagaauccuucucccuuucuucc

SEQ ID NO: 362931 - RNA, 21 nt, Human
aaucccaaaacccagagcgca

SEQ ID NO: 362932 - RNA, 21 nt, Human
aaugacaagcagaggauguaa

SEQ ID NO: 362933 - RNA, 20 nt, Human
acacccaaaucccaaaaccc

SEQ ID NO: 362934 - RNA, 20 nt, Human
acauuuuggcacauuaacug

SEQ ID NO: 362935 - RNA, 18 nt, Human
accauaauacaucucugc

SEQ ID NO: 362936 - RNA, 25 nt, Human
acccaaaucccaaaacccagagcgc

SEQ ID NO: 362937 - RNA, 21 nt, Human
accccacacccaaaucccaaa

SEQ ID NO: 362938 - RNA, 23 nt, Human
acccuaugcccaucuuaaaacug

SEQ ID NO: 362939 - RNA, 23 nt, Human
agaacuuuccuuuaaauugauuu

SEQ ID NO: 362940 - RNA, 23 nt, Human
agaggugagagccggccgcugca

SEQ ID NO: 362941 - RNA, 21 nt, Human
agcacuuaucuacucuucugc

SEQ ID NO: 362942 - RNA, 19 nt, Human
auaaauauauacauauaua

SEQ ID NO: 362943 - RNA, 21 nt, Human
auagaauuucuaaaacccaga

SEQ ID NO: 362944 - RNA, 21 nt, Human
auauauacauauauauauaua

SEQ ID NO: 362945 - RNA, 21 nt, Human
auauauacauauauauauaua

SEQ ID NO: 362946 - RNA, 23 nt, Human
caaaucccaaaacccagagcgca

SEQ ID NO: 362947 - RNA, 25 nt, Human
caccaccgccguugccgccgccacc

SEQ ID NO: 362948 - RNA, 21 nt, Human
cacccaaaucccaaaacccag

SEQ ID NO: 362949 - RNA, 22 nt, Human
cacccaaaucccaaaacccaga

SEQ ID NO: 362950 - RNA, 18 nt, Human
cagaauacugcagaaaca

SEQ ID NO: 362951 - RNA, 21 nt, Human
cagaaugacaagcagaggaug

SEQ ID NO: 362952 - RNA, 18 nt, Human
cagcucaaaucuggaagu

SEQ ID NO: 362953 - RNA, 25 nt, Human
cauagaauggaacuauuucccccga

SEQ ID NO: 362954 - RNA, 24 nt, Human
caucucugcuuuagagcugauaua

SEQ ID NO: 362955 - RNA, 25 nt, Human
ccaaaucccaaaacccagagcgcaa

SEQ ID NO: 362956 - RNA, 19 nt, Human
ccaccgccguugccgccgc

SEQ ID NO: 362957 - RNA, 18 nt, Human
cccaaaacccagagcgca

SEQ ID NO: 362958 - RNA, 21 nt, Human
cccacacccaaaucccaaaac

SEQ ID NO: 362959 - RNA, 22 nt, Human
cccacacccaaaucccaaaacc

SEQ ID NO: 362960 - RNA, 28 nt, Human
cccacacccaaaucccaaaacccagagc

SEQ ID NO: 362961 - RNA, 24 nt, Human
cccagagcgcaaaggcugugaauc

SEQ ID NO: 362962 - RNA, 26 nt, Human
cccagagcgcaaaggcugugaaucca

SEQ ID NO: 362963 - RNA, 18 nt, Human
cccagguuaggggaagcc

SEQ ID NO: 362964 - RNA, 25 nt, Human
cccccgaaccagugauaccagcuuu

SEQ ID NO: 362965 - RNA, 20 nt, Human
ccgccguugccgccgccacc

SEQ ID NO: 362966 - RNA, 24 nt, Human
ccuuaagcaguguuugagaugacu

SEQ ID NO: 362967 - RNA, 23 nt, Human
ccuucaacuuaccccacacccaa

SEQ ID NO: 362968 - RNA, 21 nt, Human
cuuccaaacccuaugcccauc

SEQ ID NO: 362969 - RNA, 22 nt, Human
cuuggaagaauaaagccuucca

SEQ ID NO: 362970 - RNA, 24 nt, Human
gaaccagugauaccagcuuauguc

SEQ ID NO: 362971 - RNA, 18 nt, Human
gaagaauaaagccuucca

SEQ ID NO: 362972 - RNA, 24 nt, Human
gagaacucuuuauuucacauugac

SEQ ID NO: 362973 - RNA, 24 nt, Human
gagaggugagagccggccgcugca

SEQ ID NO: 362974 - RNA, 23 nt, Human
gauuucccuucaacuuaccccac

SEQ ID NO: 362975 - RNA, 18 nt, Human
gccgugcgcgcgugggcu

SEQ ID NO: 362976 - RNA, 18 nt, Human
gcgcugggcucggccgug

SEQ ID NO: 362977 - RNA, 21 nt, Human
gcuacagaauacugcagaaac

SEQ ID NO: 362978 - RNA, 22 nt, Human
gcuccuuagaaaggaguucuga

SEQ ID NO: 362979 - RNA, 23 nt, Human
gggcugggcgacccggggacugc

SEQ ID NO: 362980 - RNA, 19 nt, Human
guacauugaaaaaagaauc

SEQ ID NO: 362981 - RNA, 19 nt, Human
gucaucugcagccaggggc

SEQ ID NO: 362982 - RNA, 22 nt, Human
guuuacauaacaauucaguauc

SEQ ID NO: 362983 - RNA, 22 nt, Human
uaaauuagcagaaugacaagca

SEQ ID NO: 362984 - RNA, 24 nt, Human
uaagccccaaagcagaccuggguu

SEQ ID NO: 362985 - RNA, 20 nt, Human
uaaguuggcuacagaauacu

SEQ ID NO: 362986 - RNA, 20 nt, Human
uacugcagaaacaugacuau

SEQ ID NO: 362987 - RNA, 21 nt, Human
uagaauuucuaaaacccagau

SEQ ID NO: 362988 - RNA, 18 nt, Human
uagauuucagauguaggu

SEQ ID NO: 362989 - RNA, 19 nt, Human
uauacauauauauauauau

SEQ ID NO: 362990 - RNA, 20 nt, Human
uauauacauauauauauaua

SEQ ID NO: 362991 - RNA, 20 nt, Human
uauauacauauauauauaua

SEQ ID NO: 362992 - RNA, 23 nt, Human
uauauacauauauauauauauau

SEQ ID NO: 362993 - RNA, 24 nt, Human
uauauacauauauauauauauaua

SEQ ID NO: 362994 - RNA, 23 nt, Human
uauggauucccuccaggcagcuc

SEQ ID NO: 362995 - RNA, 19 nt, Human
ucaaauguacacuuggcca

SEQ ID NO: 362996 - RNA, 32 nt, Human
ucgccgccgucaccaccgccguugccgccggc

SEQ ID NO: 362997 - RNA, 23 nt, Human
ucuaaaacccagauaauagaacu

SEQ ID NO: 362998 - RNA, 19 nt, Human
ucuaugcugaacacugggu

SEQ ID NO: 362999 - RNA, 25 nt, Human
ugaaaaaagaauccuucucccuuuc

SEQ ID NO: 363000 - RNA, 25 nt, Human
uggaaucgugguuauuauucaagua

SEQ ID NO: 363001 - RNA, 21 nt, Human
uggaggaggagacaagaguca

SEQ ID NO: 363002 - RNA, 23 nt, Human
ugggauuuacucugcaacaaccc

SEQ ID NO: 363003 - RNA, 21 nt, Human
ugggcgacccggggacugcug

SEQ ID NO: 363004 - RNA, 22 nt, Human
uuaggggaagcucuuuuucugc

SEQ ID NO: 363005 - RNA, 21 nt, Human
aagccucggcuaacagauuaa

SEQ ID NO: 363006 - RNA, 18 nt, Human
acaagagcuccucuaagc

SEQ ID NO: 363007 - RNA, 18 nt, Human
acacagcaccgugccugu

SEQ ID NO: 363008 - RNA, 22 nt, Human
agcggacgccggggugagcgcg

SEQ ID NO: 363009 - RNA, 20 nt, Human
agcgugcgugcgcgugugcg

SEQ ID NO: 363010 - RNA, 20 nt, Human
aggcgguggaggccgcugcg

SEQ ID NO: 363011 - RNA, 22 nt, Human
aggcgguggaggccgcugcgcu

SEQ ID NO: 363012 - RNA, 23 nt, Human
cagccgcugccaccugugcuuug

SEQ ID NO: 363013 - RNA, 23 nt, Human
caggagggcgcacgccggcgaug

SEQ ID NO: 363014 - RNA, 18 nt, Human
cauuucugcaucuuggga

SEQ ID NO: 363015 - RNA, 18 nt, Human
cccccuccucuucagcac

SEQ ID NO: 363016 - RNA, 21 nt, Human
ccccugcagccgcugccaccu

SEQ ID NO: 363017 - RNA, 18 nt, Human
cccuggaguguaccacac

SEQ ID NO: 363018 - RNA, 22 nt, Human
ccucuaagccucggcuaacaga

SEQ ID NO: 363019 - RNA, 22 nt, Human
ccucugcccgcccuuccacccg

SEQ ID NO: 363020 - RNA, 24 nt, Human
ccucugcccgcccuuccacccgcc

SEQ ID NO: 363021 - RNA, 21 nt, Human
ccugcagccgcugccaccugu

SEQ ID NO: 363022 - RNA, 33 nt, Human
cgcuaauccgcgucccggcucuccacggcgccg

SEQ ID NO: 363023 - RNA, 21 nt, Human
cggugagcgugcgugcgcgug

SEQ ID NO: 363024 - RNA, 22 nt, Human
cgugcgcgugugcgggugugug

SEQ ID NO: 363025 - RNA, 21 nt, Human
cgugcgugcgcgugugcgggu

SEQ ID NO: 363026 - RNA, 19 nt, Human
cugcagccgcugccaccug

SEQ ID NO: 363027 - RNA, 21 nt, Human
cugccaccugugcuuugcugc

SEQ ID NO: 363028 - RNA, 19 nt, Human
cugucaucacugacucaca

SEQ ID NO: 363029 - RNA, 18 nt, Human
gccggggugagcgcgaag

SEQ ID NO: 363030 - RNA, 18 nt, Human
gccucaacgggcgcagga

SEQ ID NO: 363031 - RNA, 19 nt, Human
gcgaagugcggccgggagc

SEQ ID NO: 363032 - RNA, 21 nt, Human
gcgacccgcgcuccccuccgc

SEQ ID NO: 363033 - RNA, 19 nt, Human
gggaaaagagcauccacau

SEQ ID NO: 363034 - RNA, 21 nt, Human
gggcgcggcgaguggcgggag

SEQ ID NO: 363035 - RNA, 22 nt, Human
ggggauggcgcuuggcggggag

SEQ ID NO: 363036 - RNA, 18 nt, Human
ggucuggggaacgccccc

SEQ ID NO: 363037 - RNA, 21 nt, Human
gugguggcagaggacggugag

SEQ ID NO: 363038 - RNA, 19 nt, Human
uauacgcauuuuuuuccuu

SEQ ID NO: 363039 - RNA, 19 nt, Human
uccaacugauuccuccagc

SEQ ID NO: 363040 - RNA, 29 nt, Human
uccuccagcagcauccauucaaauaauaa

SEQ ID NO: 363041 - RNA, 25 nt, Human
ucuccacggcgcgcgacccgcgcuc

SEQ ID NO: 363042 - RNA, 21 nt, Human
ucugcaucuugggagaaaagg

SEQ ID NO: 363043 - RNA, 21 nt, Human
ucuucaauuccaacugauucc

SEQ ID NO: 363044 - RNA, 18 nt, Human
ugcgugcgcgugugcggg

SEQ ID NO: 363045 - RNA, 23 nt, Human
uggcaagaacgugucuucaauuc

SEQ ID NO: 363046 - RNA, 19 nt, Human
uggcagaggacggugagcg

SEQ ID NO: 363047 - RNA, 22 nt, Human
uggcagaggacggugagcgugc

SEQ ID NO: 363048 - RNA, 21 nt, Human
uggcuuccccgagagagcgau

SEQ ID NO: 363049 - RNA, 24 nt, Human
ugggagaaaagggaagcuggcaag

SEQ ID NO: 363050 - RNA, 18 nt, Human
uguaccacacugcuuuac

SEQ ID NO: 363051 - RNA, 24 nt, Human
ugugugcgcgccuggggaggcggu

SEQ ID NO: 363052 - RNA, 20 nt, Human
uucagcacuauccggcagcu

SEQ ID NO: 363053 - RNA, 20 nt, Human
uuuggcaaagacacagcacc

SEQ ID NO: 363054 - RNA, 25 nt, Human
aaaaaaagccagaaaaaugaaccuc

SEQ ID NO: 363055 - RNA, 21 nt, Human
aaacaaaacaaaagcaaaccc

SEQ ID NO: 363056 - RNA, 23 nt, Human
aaacaaaacaaaagcaaacccca

SEQ ID NO: 363057 - RNA, 24 nt, Human
aaacaaaacaaaagcaaaccccac

SEQ ID NO: 363058 - RNA, 21 nt, Human
aaacaaaagcaaaccccacuc

SEQ ID NO: 363059 - RNA, 26 nt, Human
aaacuaaugccccugcuguuuuuuuc

SEQ ID NO: 363060 - RNA, 22 nt, Human
aaagaaaaacacuuucaaauaa

SEQ ID NO: 363061 - RNA, 25 nt, Human
aagaagaccuguacucuugguguuu

SEQ ID NO: 363062 - RNA, 22 nt, Human
aauacccacucaacucauggac

SEQ ID NO: 363063 - RNA, 23 nt, Human
acaaaagcaaaccccacuccagc

SEQ ID NO: 363064 - RNA, 25 nt, Human
acaaacaaaacaaaagcaaacccca

SEQ ID NO: 363065 - RNA, 20 nt, Human
acacagcugcuacugccuga

SEQ ID NO: 363066 - RNA, 21 nt, Human
acaggaugucugggcuggaag

SEQ ID NO: 363067 - RNA, 22 nt, Human
accaccacacacagccauccug

SEQ ID NO: 363068 - RNA, 25 nt, Human
agagaccaugaagacuucuagggaa

SEQ ID NO: 363069 - RNA, 21 nt, Human
auacaucuacaaaguaaugcu

SEQ ID NO: 363070 - RNA, 20 nt, Human
auacugauucaucuucuacc

SEQ ID NO: 363071 - RNA, 18 nt, Human
augauuaagucuuugcuc

SEQ ID NO: 363072 - RNA, 21 nt, Human
augguacaggguguucugagg

SEQ ID NO: 363073 - RNA, 22 nt, Human
auguuaacuuuuaugcacagaa

SEQ ID NO: 363074 - RNA, 19 nt, Human
caaaacaaaagcaaacccc

SEQ ID NO: 363075 - RNA, 21 nt, Human
caaaacaaaagcaaaccccac

SEQ ID NO: 363076 - RNA, 18 nt, Human
caaaagcaaaccccacuc

SEQ ID NO: 363077 - RNA, 24 nt, Human
caaacaaaacaaaagcaaacccca

SEQ ID NO: 363078 - RNA, 25 nt, Human
caaacaaaacaaaagcaaaccccac

SEQ ID NO: 363079 - RNA, 21 nt, Human
cacaaacaaaacaaaagcaaa

SEQ ID NO: 363080 - RNA, 26 nt, Human
cagccagaaacucaaacacagcugcu

SEQ ID NO: 363081 - RNA, 22 nt, Human
caggugaaaaaaaaagccagaa

SEQ ID NO: 363082 - RNA, 26 nt, Human
caucacaggaugucugggcuggaaga

SEQ ID NO: 363083 - RNA, 21 nt, Human
cauuuauaggaauugugugcc

SEQ ID NO: 363084 - RNA, 18 nt, Human
ccacccaaaauccucccu

SEQ ID NO: 363085 - RNA, 27 nt, Human
ccagucagaagagaaagggauaaaauc

SEQ ID NO: 363086 - RNA, 26 nt, Human
cccacagaaagccaaaccuccucuuu

SEQ ID NO: 363087 - RNA, 22 nt, Human
ccccacaggaccuuuccauaag

SEQ ID NO: 363088 - RNA, 18 nt, Human
cgaggugaauuccccagc

SEQ ID NO: 363089 - RNA, 18 nt, Human
cuacaagcacccuugcua

SEQ ID NO: 363090 - RNA, 24 nt, Human
cuacugccugacagcucccacuca

SEQ ID NO: 363091 - RNA, 24 nt, Human
cuauauaaaaauaucucuaauugu

SEQ ID NO: 363092 - RNA, 22 nt, Human
cucacaggaccuggugaccacc

SEQ ID NO: 363093 - RNA, 25 nt, Human
cucauugacagugucuucauacuga

SEQ ID NO: 363094 - RNA, 26 nt, Human
cuccccacaggaccuuuccauaagaa

SEQ ID NO: 363095 - RNA, 21 nt, Human
cucccuuguguuuuggaggac

SEQ ID NO: 363096 - RNA, 22 nt, Human
cugaaggccucgugcuccaugg

SEQ ID NO: 363097 - RNA, 24 nt, Human
gaaagaagggaauacuucccccau

SEQ ID NO: 363098 - RNA, 19 nt, Human
gaagggaauacuuccccca

SEQ ID NO: 363099 - RNA, 20 nt, Human
gaaucacccacagaaagcca

SEQ ID NO: 363100 - RNA, 22 nt, Human
gagcgaaugagcuguaaugaga

SEQ ID NO: 363101 - RNA, 23 nt, Human
gccuagaggugagaugggacuug

SEQ ID NO: 363102 - RNA, 23 nt, Human
ggacacaaacaaaacaaaagcaa

SEQ ID NO: 363103 - RNA, 23 nt, Human
ggcaggagacauucuucccagag

SEQ ID NO: 363104 - RNA, 21 nt, Human
gggaagaugacgggcuugcug

SEQ ID NO: 363105 - RNA, 19 nt, Human
uaaaaauuaaucucuaaac

SEQ ID NO: 363106 - RNA, 23 nt, Human
uaacaugaaaugauuuaaaaauu

SEQ ID NO: 363107 - RNA, 22 nt, Human
uaagaaauacccacucaacuca

SEQ ID NO: 363108 - RNA, 20 nt, Human
uaagacuaacaugaaaugau

SEQ ID NO: 363109 - RNA, 22 nt, Human
uaagcagacuucacggggggaa

SEQ ID NO: 363110 - RNA, 19 nt, Human
uagccuacuauuugucucu

SEQ ID NO: 363111 - RNA, 27 nt, Human
uagcugcuagucuucucaacccuccgg

SEQ ID NO: 363112 - RNA, 20 nt, Human
uaggaaagaagggaauacuu

SEQ ID NO: 363113 - RNA, 18 nt, Human
uauaccagucagaagaga

SEQ ID NO: 363114 - RNA, 22 nt, Human
uauuagagagcucauucauuug

SEQ ID NO: 363115 - RNA, 19 nt, Human
ucaacucuuuccuagcucu

SEQ ID NO: 363116 - RNA, 18 nt, Human
ucauacugauucaucuuc

SEQ ID NO: 363117 - RNA, 23 nt, Human
uccacacugagugcauguguaug

SEQ ID NO: 363118 - RNA, 27 nt, Human
uccauucuucaccauuuucagccagaa

SEQ ID NO: 363119 - RNA, 21 nt, Human
ucucauaaccucauugacagu

SEQ ID NO: 363120 - RNA, 18 nt, Human
ucuuuaguguuccacagu

SEQ ID NO: 363121 - RNA, 19 nt, Human
ugaaauagguauaccaguc

SEQ ID NO: 363122 - RNA, 24 nt, Human
ugaggacacugaggccuagaggug

SEQ ID NO: 363123 - RNA, 18 nt, Human
ugagugcauguguaugca

SEQ ID NO: 363124 - RNA, 23 nt, Human
ugauuuuguaagggguggaagau

SEQ ID NO: 363125 - RNA, 22 nt, Human
ugcuucccaguccacacugagu

SEQ ID NO: 363126 - RNA, 19 nt, Human
uggaagagaccaugaagac

SEQ ID NO: 363127 - RNA, 22 nt, Human
uggacacaaacaaaacaaaagc

SEQ ID NO: 363128 - RNA, 18 nt, Human
uggcaggagacauucuuc

SEQ ID NO: 363129 - RNA, 20 nt, Human
uggccacccaaaauccuccc

SEQ ID NO: 363130 - RNA, 19 nt, Human
ugggaugaacugggcaaag

SEQ ID NO: 363131 - RNA, 25 nt, Human
uguaugcagagccugugauggccga

SEQ ID NO: 363132 - RNA, 20 nt, Human
ugugcaccuagcuacuaaug

SEQ ID NO: 363133 - RNA, 24 nt, Human
uguuuuggaggacuauuuuccagu

SEQ ID NO: 363134 - RNA, 19 nt, Human
uuccagucuuaucagaagg

SEQ ID NO: 363135 - RNA, 18 nt, Human
uucuaaggacuuuugauu

SEQ ID NO: 363136 - RNA, 19 nt, Human
uucuagggaagucccucau

SEQ ID NO: 363137 - RNA, 19 nt, Human
uucugaggggaaacagagg

SEQ ID NO: 363138 - RNA, 19 nt, Human
uuuaaaaauuucaauugug

SEQ ID NO: 363139 - RNA, 22 nt, Human
uuuaaaaauuucaauuguggga

SEQ ID NO: 363140 - RNA, 24 nt, Human
uuuauagaugaggacacugaggcc

SEQ ID NO: 363141 - RNA, 20 nt, Human
uuucuaggagggucucuucu

SEQ ID NO: 363142 - RNA, 21 nt, Human
aaaaaagaagaacauacuggg

SEQ ID NO: 363143 - RNA, 24 nt, Human
aaaaaagauuuacugaagccugaa

SEQ ID NO: 363144 - RNA, 20 nt, Human
aaaaagccaaaguguuauca

SEQ ID NO: 363145 - RNA, 22 nt, Human
aaacagcacgcucucagaucuu

SEQ ID NO: 363146 - RNA, 19 nt, Human
aaacuuggauguacuggca

SEQ ID NO: 363147 - RNA, 25 nt, Human
aaagccaaaguguuaucagaggccc

SEQ ID NO: 363148 - RNA, 18 nt, Human
aacaccugagucccagcu

SEQ ID NO: 363149 - RNA, 20 nt, Human
aacucgaggcaaugcgacag

SEQ ID NO: 363150 - RNA, 20 nt, Human
aagauaccacagacauacaa

SEQ ID NO: 363151 - RNA, 23 nt, Human
aagcacccuucuccagacccaga

SEQ ID NO: 363152 - RNA, 21 nt, Human
aagcagaaaagugccccaggg

SEQ ID NO: 363153 - RNA, 23 nt, Human
acacacacgcacacacacacaca

SEQ ID NO: 363154 - RNA, 26 nt, Human
acagagcaguccuuucuccaaaggaa

SEQ ID NO: 363155 - RNA, 22 nt, Human
acauuaggaagaggcggcauuu

SEQ ID NO: 363156 - RNA, 20 nt, Human
acccaccuggaguauuucua

SEQ ID NO: 363157 - RNA, 19 nt, Human
acccugugaguccaugauu

SEQ ID NO: 363158 - RNA, 19 nt, Human
accugagucccagcucagc

SEQ ID NO: 363159 - RNA, 20 nt, Human
agaaagagaacagcagggga

SEQ ID NO: 363160 - RNA, 22 nt, Human
agaaaggacucugcuccacaga

SEQ ID NO: 363161 - RNA, 22 nt, Human
agaacccucugccccgcuucuc

SEQ ID NO: 363162 - RNA, 20 nt, Human
agcaaaaucaggcgcccaga

SEQ ID NO: 363163 - RNA, 22 nt, Human
agcacccuucuccagacccaga

SEQ ID NO: 363164 - RNA, 24 nt, Human
agccaaaguguuaucagaggccca

SEQ ID NO: 363165 - RNA, 24 nt, Human
agccaggggaccugggaaccugug

SEQ ID NO: 363166 - RNA, 18 nt, Human
agcuagagguggcagggg

SEQ ID NO: 363167 - RNA, 23 nt, Human
aggaagaaaaaaagauuuacuga

SEQ ID NO: 363168 - RNA, 20 nt, Human
aggaagaggcggcauuugaa

SEQ ID NO: 363169 - RNA, 18 nt, Human
aggaagcagaaaagugcc

SEQ ID NO: 363170 - RNA, 18 nt, Human
aggaagcagaaaagugcc

SEQ ID NO: 363171 - RNA, 20 nt, Human
aggaagcagaaaagugcccc

SEQ ID NO: 363172 - RNA, 18 nt, Human
aggcaauugucacaugua

SEQ ID NO: 363173 - RNA, 20 nt, Human
aggcugcauucccucuccuu

SEQ ID NO: 363174 - RNA, 18 nt, Human
agugcagcauuuuacaga

SEQ ID NO: 363175 - RNA, 20 nt, Human
aguuguuuaccuaaggcugu

SEQ ID NO: 363176 - RNA, 18 nt, Human
auauacauaugugugugu

SEQ ID NO: 363177 - RNA, 21 nt, Human
caaaaucaggcgcccagaacc

SEQ ID NO: 363178 - RNA, 25 nt, Human
caaacagaucccugguguacacaca

SEQ ID NO: 363179 - RNA, 23 nt, Human
caacagccacaaacagcacgcuc

SEQ ID NO: 363180 - RNA, 19 nt, Human
cacaaacucuuuaaacacc

SEQ ID NO: 363181 - RNA, 21 nt, Human
cacacagaacaagggcaugau

SEQ ID NO: 363182 - RNA, 23 nt, Human
cacagcaaaaucaggcgcccaga

SEQ ID NO: 363183 - RNA, 19 nt, Human
caccacagugcuaacaccc

SEQ ID NO: 363184 - RNA, 21 nt, Human
caccacagugcuaacacccac

SEQ ID NO: 363185 - RNA, 21 nt, Human
caccugcacacucucggaagc

SEQ ID NO: 363186 - RNA, 20 nt, Human
cacgguuccuggucccuuuu

SEQ ID NO: 363187 - RNA, 19 nt, Human
cacugcuggcaggcaagcc

SEQ ID NO: 363188 - RNA, 18 nt, Human
cagaaaggacucugcucc

SEQ ID NO: 363189 - RNA, 20 nt, Human
cagaucccugguguacacac

SEQ ID NO: 363190 - RNA, 21 nt, Human
cagcaaaaucaggcgcccaga

SEQ ID NO: 363191 - RNA, 20 nt, Human
cagcaaaggccagccauggc

SEQ ID NO: 363192 - RNA, 21 nt, Human
caguccuuucuccaaagcugu

SEQ ID NO: 363193 - RNA, 18 nt, Human
cauauacacaacacacau

SEQ ID NO: 363194 - RNA, 21 nt, Human
cauauacacaacacacaugug

SEQ ID NO: 363195 - RNA, 25 nt, Human
cauauguguguguguguuguguaua

SEQ ID NO: 363196 - RNA, 21 nt, Human
caucaacagccacaaacagca

SEQ ID NO: 363197 - RNA, 18 nt, Human
ccaggaccuguuacauca

SEQ ID NO: 363198 - RNA, 22 nt, Human
ccaguuuccuuugcacgguucc

SEQ ID NO: 363199 - RNA, 24 nt, Human
ccauaagcgugugccccugucugu

SEQ ID NO: 363200 - RNA, 19 nt, Human
cccagaacccagggaucag

SEQ ID NO: 363201 - RNA, 26 nt, Human
cccagggcugggaugcgaacugggac

SEQ ID NO: 363202 - RNA, 20 nt, Human
ccccauuuuacaaauggggu

SEQ ID NO: 363203 - RNA, 21 nt, Human
cccuggucuaccgacucugug

SEQ ID NO: 363204 - RNA, 22 nt, Human
cccugguguacacacaguugca

SEQ ID NO: 363205 - RNA, 23 nt, Human
ccucaggccagcgacugggccaa

SEQ ID NO: 363206 - RNA, 24 nt, Human
ccugcacacucucggaagcacccu

SEQ ID NO: 363207 - RNA, 21 nt, Human
ccuggcugggucaacucugug

SEQ ID NO: 363208 - RNA, 24 nt, Human
cgaauaugcaucaacagccacaaa

SEQ ID NO: 363209 - RNA, 21 nt, Human
cgacagaugacuauaaacccc

SEQ ID NO: 363210 - RNA, 21 nt, Human
cgacugggccaaagcauugcu

SEQ ID NO: 363211 - RNA, 21 nt, Human
cgagaaaggcgaggagaggcg

SEQ ID NO: 363212 - RNA, 23 nt, Human
cggaagcacccuucuccagaccc

SEQ ID NO: 363213 - RNA, 21 nt, Human
cggcugggugaacaggguggg

SEQ ID NO: 363214 - RNA, 20 nt, Human
cguuccaucuacccauucuc

SEQ ID NO: 363215 - RNA, 21 nt, Human
cuaaugcacauagagaacaaa

SEQ ID NO: 363216 - RNA, 20 nt, Human
cuagagguggcaggggacgu

SEQ ID NO: 363217 - RNA, 21 nt, Human
cuauaaacccccuugguuugc

SEQ ID NO: 363218 - RNA, 26 nt, Human
cucccagaacccagggaucagaagcu

SEQ ID NO: 363219 - RNA, 21 nt, Human
cucuccuuuuuucuuugaccu

SEQ ID NO: 363220 - RNA, 21 nt, Human
cucugccccgcuucuccccca

SEQ ID NO: 363221 - RNA, 19 nt, Human
cugaacagauuuaccacaa

SEQ ID NO: 363222 - RNA, 19 nt, Human
cugcaacucgaggcaaugc

SEQ ID NO: 363223 - RNA, 23 nt, Human
cugccccgcuucucccccacaag

SEQ ID NO: 363224 - RNA, 21 nt, Human
cugggucaacucuguguccca

SEQ ID NO: 363225 - RNA, 21 nt, Human
cuugagccuggcagcucaagg

SEQ ID NO: 363226 - RNA, 20 nt, Human
gacagaugacuauaaacccc

SEQ ID NO: 363227 - RNA, 18 nt, Human
gaggcugaacacugggga

SEQ ID NO: 363228 - RNA, 22 nt, Human
gcaccugcagucucccagaacc

SEQ ID NO: 363229 - RNA, 18 nt, Human
gcagaaacaguggcuggg

SEQ ID NO: 363230 - RNA, 21 nt, Human
gcauucccucuccuuuuuucu

SEQ ID NO: 363231 - RNA, 20 nt, Human
gccccgcuucucccccacaa

SEQ ID NO: 363232 - RNA, 20 nt, Human
gcucucagaucuuccccuuc

SEQ ID NO: 363233 - RNA, 24 nt, Human
gcugcauucccucuccuuuuuucu

SEQ ID NO: 363234 - RNA, 24 nt, Human
gcugggucaacucugugucgugca

SEQ ID NO: 363235 - RNA, 19 nt, Human
gcuucaccaaaucccucug

SEQ ID NO: 363236 - RNA, 23 nt, Human
ggcgcaggagcaggugcgagaaa

SEQ ID NO: 363237 - RNA, 22 nt, Human
ggcggcugggugaacagggugg

SEQ ID NO: 363238 - RNA, 25 nt, Human
gggaccugggaaccugugaaugggg

SEQ ID NO: 363239 - RNA, 21 nt, Human
gggagcccaaugccagugccg

SEQ ID NO: 363240 - RNA, 21 nt, Human
gggaggguaaaaguuggcaag

SEQ ID NO: 363241 - RNA, 21 nt, Human
gggccaggccaggacacagga

SEQ ID NO: 363242 - RNA, 25 nt, Human
guaaagugaggccccaggaccuguu

SEQ ID NO: 363243 - RNA, 19 nt, Human
guacaugguuuucucuggg

SEQ ID NO: 363244 - RNA, 21 nt, Human
guccuuguccuugguaaccag

SEQ ID NO: 363245 - RNA, 21 nt, Human
gugaaggaggcugaacacugg

SEQ ID NO: 363246 - RNA, 18 nt, Human
guggaccagagaccacca

SEQ ID NO: 363247 - RNA, 20 nt, Human
guguauagauauacauaugu

SEQ ID NO: 363248 - RNA, 27 nt, Human
guguguguguguuguguauauauauua

SEQ ID NO: 363249 - RNA, 25 nt, Human
guuccaucuacccauucucaucuca

SEQ ID NO: 363250 - RNA, 19 nt, Human
guuguguauauauauauga

SEQ ID NO: 363251 - RNA, 21 nt, Human
uaaacaccugagucccagcuc

SEQ ID NO: 363252 - RNA, 18 nt, Human
uaacuacaucacaccucc

SEQ ID NO: 363253 - RNA, 19 nt, Human
uacacacacgcacacacac

SEQ ID NO: 363254 - RNA, 22 nt, Human
uacacacagaacaagggcauga

SEQ ID NO: 363255 - RNA, 22 nt, Human
uacauaaaaaagaagaacauac

SEQ ID NO: 363256 - RNA, 24 nt, Human
uaccuaaggcuguggaccagagac

SEQ ID NO: 363257 - RNA, 18 nt, Human
uagugaguguucauuuac

SEQ ID NO: 363258 - RNA, 18 nt, Human
uaguucaugaaaacuuga

SEQ ID NO: 363259 - RNA, 19 nt, Human
uauccaaacacaaacuugc

SEQ ID NO: 363260 - RNA, 25 nt, Human
uauccacaccuagcuauagcacaaa

SEQ ID NO: 363261 - RNA, 25 nt, Human
uauguguguguguguuguguauaua

SEQ ID NO: 363262 - RNA, 28 nt, Human
ucaaguaacuacacacagaacaagggcc

SEQ ID NO: 363263 - RNA, 22 nt, Human
ucauuuaccauuuggaaucaaa

SEQ ID NO: 363264 - RNA, 24 nt, Human
uccaaacacaaacuugcuuggcuu

SEQ ID NO: 363265 - RNA, 19 nt, Human
uccaagaagugaaaugguc

SEQ ID NO: 363266 - RNA, 21 nt, Human
uccaagauguaaccacacagg

SEQ ID NO: 363267 - RNA, 19 nt, Human
uccaaggggaagggccacc

SEQ ID NO: 363268 - RNA, 20 nt, Human
uccaugacuggcggcugggu

SEQ ID NO: 363269 - RNA, 19 nt, Human
uccccagucacguaacccc

SEQ ID NO: 363270 - RNA, 21 nt, Human
uccccagucacguaaccccug

SEQ ID NO: 363271 - RNA, 25 nt, Human
ucggccaguugugcuccgcagguuc

SEQ ID NO: 363272 - RNA, 21 nt, Human
ucuaaguuguuuaccuaaggc

SEQ ID NO: 363273 - RNA, 24 nt, Human
ucuccagacccagacacgcuucuu

SEQ ID NO: 363274 - RNA, 24 nt, Human
ucuuugaccucagaaucuaaguug

SEQ ID NO: 363275 - RNA, 19 nt, Human
ugaaaacagaagaguauca

SEQ ID NO: 363276 - RNA, 20 nt, Human
ugaaaacagaagaguaucag

SEQ ID NO: 363277 - RNA, 20 nt, Human
ugaaauacaucugcauuuuu

SEQ ID NO: 363278 - RNA, 22 nt, Human
ugaaaucagccaaagccagggg

SEQ ID NO: 363279 - RNA, 25 nt, Human
ugcaccuggacauggaucaagccga

SEQ ID NO: 363280 - RNA, 20 nt, Human
ugcauauacacaacacacau

SEQ ID NO: 363281 - RNA, 24 nt, Human
ugcauucccucuccuuuuuucuuu

SEQ ID NO: 363282 - RNA, 21 nt, Human
ugcgacagaugacuauaaacc

SEQ ID NO: 363283 - RNA, 19 nt, Human
ugcucagaaaacaccugau

SEQ ID NO: 363284 - RNA, 21 nt, Human
ugcucagaaaacaccugaugc

SEQ ID NO: 363285 - RNA, 25 nt, Human
uggaguauuucuaacuugacaaugu

SEQ ID NO: 363286 - RNA, 20 nt, Human
uggcaaaagacgggguuccc

SEQ ID NO: 363287 - RNA, 22 nt, Human
uggcaagaaagggcucuauauu

SEQ ID NO: 363288 - RNA, 20 nt, Human
uggcaagggcagugcccugu

SEQ ID NO: 363289 - RNA, 22 nt, Human
uggcaagggcagugcccugugu

SEQ ID NO: 363290 - RNA, 20 nt, Human
uggcagaaacaguggcuggg

SEQ ID NO: 363291 - RNA, 21 nt, Human
uggcaggcaagcccaaagccc

SEQ ID NO: 363292 - RNA, 23 nt, Human
uggcaggggacgugggcucuggc

SEQ ID NO: 363293 - RNA, 18 nt, Human
ugggaggguaaaaguugg

SEQ ID NO: 363294 - RNA, 22 nt, Human
ugguggaaggugggguugcuag

SEQ ID NO: 363295 - RNA, 19 nt, Human
ugguuuaaagagagcuggg

SEQ ID NO: 363296 - RNA, 19 nt, Human
uguauagauauacauaugu

SEQ ID NO: 363297 - RNA, 29 nt, Human
uguauagauauacauaugugugugugugu

SEQ ID NO: 363298 - RNA, 22 nt, Human
ugucagaguguccuuguccuug

SEQ ID NO: 363299 - RNA, 19 nt, Human
uguguauagauauacauau

SEQ ID NO: 363300 - RNA, 23 nt, Human
uguguauagauauacauaugugu

SEQ ID NO: 363301 - RNA, 27 nt, Human
uguguauagauauacauaugugugugu

SEQ ID NO: 363302 - RNA, 18 nt, Human
uguguguauagauauaca

SEQ ID NO: 363303 - RNA, 18 nt, Human
uguguguguguguugugu

SEQ ID NO: 363304 - RNA, 23 nt, Human
uguguguguguguuguguauaua

SEQ ID NO: 363305 - RNA, 24 nt, Human
uguguguguuguguauauauauau

SEQ ID NO: 363306 - RNA, 21 nt, Human
uguuacaggguggcagaaaca

SEQ ID NO: 363307 - RNA, 22 nt, Human
uucacccuuucugcucaggcuc

SEQ ID NO: 363308 - RNA, 20 nt, Human
uucugggaagccgccccggg

SEQ ID NO: 363309 - RNA, 21 nt, Human
uuuacaaaugggguaaaguga

SEQ ID NO: 363310 - RNA, 18 nt, Human
uuuccaguuuccuuugca

SEQ ID NO: 363311 - RNA, 19 nt, Human
uuucucuggggugguggug

SEQ ID NO: 363312 - RNA, 18 nt, Human
aacauuauuucuccaucu

SEQ ID NO: 363313 - RNA, 28 nt, Human
aagcggaccuccggaaacaggggaccca

SEQ ID NO: 363314 - RNA, 23 nt, Human
acacacacacacacacacacaca

SEQ ID NO: 363315 - RNA, 23 nt, Human
acacacacacacacacacacaca

SEQ ID NO: 363316 - RNA, 23 nt, Human
acacacacacacacacacacaca

SEQ ID NO: 363317 - RNA, 23 nt, Human
acacacacacacacacacacaca

SEQ ID NO: 363318 - RNA, 23 nt, Human
acacacacacacacacacacaca

SEQ ID NO: 363319 - RNA, 24 nt, Human
acacacacacacacacacacacag

SEQ ID NO: 363320 - RNA, 23 nt, Human
acacacacacacacacacacacg

SEQ ID NO: 363321 - RNA, 22 nt, Human
acacacacacacacacacacag

SEQ ID NO: 363322 - RNA, 23 nt, Human
acacacacacacacacacgugca

SEQ ID NO: 363323 - RNA, 23 nt, Human
acacacacacacacacacgugca

SEQ ID NO: 363324 - RNA, 28 nt, Human
acacacacacacacacgugcacacacaa

SEQ ID NO: 363325 - RNA, 23 nt, Human
acacacacacacacgugcacaca

SEQ ID NO: 363326 - RNA, 25 nt, Human
acacacacacacgugcacacacaca

SEQ ID NO: 363327 - RNA, 18 nt, Human
acacacacauccccccac

SEQ ID NO: 363328 - RNA, 21 nt, Human
acacacauccccccacaacua

SEQ ID NO: 363329 - RNA, 24 nt, Human
acacauguacuccagcagccaggc

SEQ ID NO: 363330 - RNA, 31 nt, Human
acagaacacacacacacacacacacacacag

SEQ ID NO: 363331 - RNA, 21 nt, Human
acauguacuccagcagccagg

SEQ ID NO: 363332 - RNA, 24 nt, Human
acccuugugaacacauguacucca

SEQ ID NO: 363333 - RNA, 18 nt, Human
agacaggggaggccaggc

SEQ ID NO: 363334 - RNA, 20 nt, Human
agagugugcaggcagacccc

SEQ ID NO: 363335 - RNA, 21 nt, Human
agcgccuggaagcuggcuggg

SEQ ID NO: 363336 - RNA, 21 nt, Human
agcgccuggaagcuggcuggg

SEQ ID NO: 363337 - RNA, 27 nt, Human
agcggaccuccggaaacaggggaccca

SEQ ID NO: 363338 - RNA, 18 nt, Human
aggcaggucacggugggg

SEQ ID NO: 363339 - RNA, 19 nt, Human
aggcaggucacggugggga

SEQ ID NO: 363340 - RNA, 20 nt, Human
aggcgguggucugguguccg

SEQ ID NO: 363341 - RNA, 20 nt, Human
aggcgguggucugguguccg

SEQ ID NO: 363342 - RNA, 19 nt, Human
aggggaucuggggacaggg

SEQ ID NO: 363343 - RNA, 19 nt, Human
aggggaucuggggacaggg

SEQ ID NO: 363344 - RNA, 20 nt, Human
agguauuuguccucagccuc

SEQ ID NO: 363345 - RNA, 20 nt, Human
agguauuuguccucagccuc

SEQ ID NO: 363346 - RNA, 24 nt, Human
auaauccaguguccaaagagcacc

SEQ ID NO: 363347 - RNA, 19 nt, Human
auccgggaggcggggaccc

SEQ ID NO: 363348 - RNA, 19 nt, Human
auccgggaggcggggaccc

SEQ ID NO: 363349 - RNA, 22 nt, Human
caaaauaaccagcaugguguug

SEQ ID NO: 363350 - RNA, 22 nt, Human
caaagagcacccccagcagggc

SEQ ID NO: 363351 - RNA, 19 nt, Human
cacaacuacagccgccaaa

SEQ ID NO: 363352 - RNA, 20 nt, Human
cacacacacacacacacaca

SEQ ID NO: 363353 - RNA, 20 nt, Human
cacacacacacacacacaca

SEQ ID NO: 363354 - RNA, 20 nt, Human
cacacacacacacacacaca

SEQ ID NO: 363355 - RNA, 20 nt, Human
cacacacacacacacacaca

SEQ ID NO: 363356 - RNA, 20 nt, Human
cacacacacacacacacaca

SEQ ID NO: 363357 - RNA, 20 nt, Human
cacacacacacacacacaca

SEQ ID NO: 363358 - RNA, 20 nt, Human
cacacacacacacacacaca

SEQ ID NO: 363359 - RNA, 20 nt, Human
cacacacacacacacacaca

SEQ ID NO: 363360 - RNA, 20 nt, Human
cacacacacacacacacaca

SEQ ID NO: 363361 - RNA, 22 nt, Human
cacacacacacacacacacaca

SEQ ID NO: 363362 - RNA, 22 nt, Human
cacacacacacacacacacaca

SEQ ID NO: 363363 - RNA, 22 nt, Human
cacacacacacacacacacaca

SEQ ID NO: 363364 - RNA, 22 nt, Human
cacacacacacacacacacaca

SEQ ID NO: 363365 - RNA, 22 nt, Human
cacacacacacacacacacaca

SEQ ID NO: 363366 - RNA, 22 nt, Human
cacacacacacacacacacaca

SEQ ID NO: 363367 - RNA, 22 nt, Human
cacacacacacacacacacaca

SEQ ID NO: 363368 - RNA, 26 nt, Human
cacacacacacacacacacacacaca

SEQ ID NO: 363369 - RNA, 26 nt, Human
cacacacacacacacacacacacaca

SEQ ID NO: 363370 - RNA, 26 nt, Human
cacacacacacacacacacacacaca

SEQ ID NO: 363371 - RNA, 26 nt, Human
cacacacacacacacacacacacaca

SEQ ID NO: 363372 - RNA, 26 nt, Human
cacacacacacacacacacacacaca

SEQ ID NO: 363373 - RNA, 26 nt, Human
cacacacacacacacacacacacacg

SEQ ID NO: 363374 - RNA, 26 nt, Human
cacacacacacacacacacacacgug

SEQ ID NO: 363375 - RNA, 26 nt, Human
cacacacacacacacacacacgugca

SEQ ID NO: 363376 - RNA, 25 nt, Human
cacacacacacacacacacgugcac

SEQ ID NO: 363377 - RNA, 26 nt, Human
cacacacacacacacacgugcacaca

SEQ ID NO: 363378 - RNA, 26 nt, Human
cacacacacacacacgugcacacaca

SEQ ID NO: 363379 - RNA, 30 nt, Human
cacacacacacacgugcacacacacauccu

SEQ ID NO: 363380 - RNA, 24 nt, Human
cacacacacacgugcacacacaca

SEQ ID NO: 363381 - RNA, 22 nt, Human
cacacacacgugcacacacaca

SEQ ID NO: 363382 - RNA, 23 nt, Human
cacauccccccacaacuacagcc

SEQ ID NO: 363383 - RNA, 24 nt, Human
cacgugcacacacacaucccccca

SEQ ID NO: 363384 - RNA, 23 nt, Human
cagcagggcagggaaggucccuc

SEQ ID NO: 363385 - RNA, 20 nt, Human
caguguccaaagagcacccc

SEQ ID NO: 363386 - RNA, 25 nt, Human
cauaauccaguguccaaagagcacc

SEQ ID NO: 363387 - RNA, 22 nt, Human
cauccccccacaacuacagccg

SEQ ID NO: 363388 - RNA, 18 nt, Human
cauccccccacaacuacg

SEQ ID NO: 363389 - RNA, 19 nt, Human
cauguacuccagcagccag

SEQ ID NO: 363390 - RNA, 21 nt, Human
cauguacuccagcagccaggc

SEQ ID NO: 363391 - RNA, 25 nt, Human
ccacaacuacagccgccaaaauaac

SEQ ID NO: 363392 - RNA, 22 nt, Human
ccagagugugcaggcagacccc

SEQ ID NO: 363393 - RNA, 20 nt, Human
ccagcagccaggcaucccag

SEQ ID NO: 363394 - RNA, 18 nt, Human
ccagcagggcagggaagg

SEQ ID NO: 363395 - RNA, 22 nt, Human
ccaggcucuuagguccgggagg

SEQ ID NO: 363396 - RNA, 22 nt, Human
ccaggcucuuagguccgggagg

SEQ ID NO: 363397 - RNA, 24 nt, Human
ccaggcugggcgcugagcuucucu

SEQ ID NO: 363398 - RNA, 23 nt, Human
cccauggugaccugugaccugcu

SEQ ID NO: 363399 - RNA, 18 nt, Human
ccccagagcccuagcuca

SEQ ID NO: 363400 - RNA, 23 nt, Human
cccccacaacuacagccgccaaa

SEQ ID NO: 363401 - RNA, 24 nt, Human
cccccagagcccuagcucauccau

SEQ ID NO: 363402 - RNA, 22 nt, Human
cccccagauggcggaggucugc

SEQ ID NO: 363403 - RNA, 21 nt, Human
ccccgugugccagauguccga

SEQ ID NO: 363404 - RNA, 21 nt, Human
ccccgugugccagauguccga

SEQ ID NO: 363405 - RNA, 19 nt, Human
ccgggaguagcgguuacca

SEQ ID NO: 363406 - RNA, 22 nt, Human
ccuccggaaacaggggacccag

SEQ ID NO: 363407 - RNA, 22 nt, Human
ccuccggaaacaggggacccag

SEQ ID NO: 363408 - RNA, 21 nt, Human
ccucuccccagagucccuggg

SEQ ID NO: 363409 - RNA, 21 nt, Human
ccucuccccagagucccuggg

SEQ ID NO: 363410 - RNA, 19 nt, Human
ccucuggagugacagcagg

SEQ ID NO: 363411 - RNA, 22 nt, Human
ccuggagggugcuggggccccu

SEQ ID NO: 363412 - RNA, 20 nt, Human
ccuggcuccccagagugugc

SEQ ID NO: 363413 - RNA, 20 nt, Human
ccugggucuuggacacugag

SEQ ID NO: 363414 - RNA, 20 nt, Human
ccugggucuuggacacugag

SEQ ID NO: 363415 - RNA, 22 nt, Human
ccugugaccugcucccugagac

SEQ ID NO: 363416 - RNA, 26 nt, Human
cgcccggguuccuuggcccuaggagc

SEQ ID NO: 363417 - RNA, 26 nt, Human
cgcccggguuccuuggcccuaggagc

SEQ ID NO: 363418 - RNA, 23 nt, Human
cgguuaccagccagagaaagccu

SEQ ID NO: 363419 - RNA, 19 nt, Human
cguaccauggggacaggag

SEQ ID NO: 363420 - RNA, 19 nt, Human
cguaccauggggacaggag

SEQ ID NO: 363421 - RNA, 22 nt, Human
cgugcacacacacaucccccca

SEQ ID NO: 363422 - RNA, 20 nt, Human
cuccaucuugcuguuuucua

SEQ ID NO: 363423 - RNA, 20 nt, Human
cucugggugggacguggggc

SEQ ID NO: 363424 - RNA, 20 nt, Human
cucugggugggacguggggc

SEQ ID NO: 363425 - RNA, 22 nt, Human
cugaggcuucucugcucugccc

SEQ ID NO: 363426 - RNA, 23 nt, Human
cugggagcgcuugggcuccuucc

SEQ ID NO: 363427 - RNA, 20 nt, Human
cuuagcgccuggaagcuggc

SEQ ID NO: 363428 - RNA, 20 nt, Human
cuuagcgccuggaagcuggc

SEQ ID NO: 363429 - RNA, 20 nt, Human
cuuggcuccaggagguugag

SEQ ID NO: 363430 - RNA, 24 nt, Human
gaacacauguacuccagcagccag

SEQ ID NO: 363431 - RNA, 21 nt, Human
gacaugagugagaacuggggg

SEQ ID NO: 363432 - RNA, 20 nt, Human
gaggucugcaggaggcuagg

SEQ ID NO: 363433 - RNA, 20 nt, Human
gaggucugcaggaggcuagg

SEQ ID NO: 363434 - RNA, 19 nt, Human
gaucuccuguccuggaggg

SEQ ID NO: 363435 - RNA, 23 nt, Human
gcccccagauggcggaggucugc

SEQ ID NO: 363436 - RNA, 19 nt, Human
gccuggaagcuggcuggga

SEQ ID NO: 363437 - RNA, 19 nt, Human
gccuggaagcuggcuggga

SEQ ID NO: 363438 - RNA, 21 nt, Human
gccuggaagcuggcugggagc

SEQ ID NO: 363439 - RNA, 21 nt, Human
gccuggaagcuggcugggagc

SEQ ID NO: 363440 - RNA, 24 nt, Human
gccuugaguuggggacaugaguga

SEQ ID NO: 363441 - RNA, 25 nt, Human
gcgcugagcuucucugcuuggaccc

SEQ ID NO: 363442 - RNA, 24 nt, Human
gcgcuugggcuccuucccaggacc

SEQ ID NO: 363443 - RNA, 24 nt, Human
gcgcuugggcuccuucccaggacc

SEQ ID NO: 363444 - RNA, 18 nt, Human
gcuagaauuccccauggu

SEQ ID NO: 363445 - RNA, 18 nt, Human
ggaggccaggcaggucac

SEQ ID NO: 363446 - RNA, 19 nt, Human
ggagggaauaggggaucug

SEQ ID NO: 363447 - RNA, 19 nt, Human
ggagggaauaggggaucug

SEQ ID NO: 363448 - RNA, 23 nt, Human
ggagguugagugcccccagaugg

SEQ ID NO: 363449 - RNA, 23 nt, Human
ggagguugagugcccccagaugg

SEQ ID NO: 363450 - RNA, 19 nt, Human
ggcuagaauuccccauggu

SEQ ID NO: 363451 - RNA, 24 nt, Human
gggaauaggggaucuggggacagg

SEQ ID NO: 363452 - RNA, 24 nt, Human
gggaauaggggaucuggggacagg

SEQ ID NO: 363453 - RNA, 18 nt, Human
gggccccuggcuccccag

SEQ ID NO: 363454 - RNA, 20 nt, Human
ggggaggccaggcaggucac

SEQ ID NO: 363455 - RNA, 31 nt, Human
ggucacagaacacacacacacacacacacag

SEQ ID NO: 363456 - RNA, 19 nt, Human
ggucuuggacacugagggc

SEQ ID NO: 363457 - RNA, 33 nt, Human
gucacagaacacacacacacacacacacacagu

SEQ ID NO: 363458 - RNA, 33 nt, Human; identical to SEQ ID NO: 363457

SEQ ID NO: 363459 - RNA, 18 nt, Human
gucuuggacacugagggc

SEQ ID NO: 363460 - RNA, 20 nt, Human
uagaauuccccauggugacc

SEQ ID NO: 363461 - RNA, 18 nt, Human
ucacagaacacacacaca

SEQ ID NO: 363462 - RNA, 18 nt, Human
ucacagaacacacacaca

SEQ ID NO: 363463 - RNA, 19 nt, Human
uccaguguccaaagagcac

SEQ ID NO: 363464 - RNA, 28 nt, Human
uccccagagucccugggaguguuucugu

SEQ ID NO: 363465 - RNA, 28 nt, Human
uccccagagucccugggaguguuucugu

SEQ ID NO: 363466 - RNA, 18 nt, Human
ucccugggaguguuucug

SEQ ID NO: 363467 - RNA, 18 nt, Human
ucccugggaguguuucug

SEQ ID NO: 363468 - RNA, 18 nt, Human
ucccugggaguguuucug

SEQ ID NO: 363469 - RNA, 18 nt, Human
ucccugggaguguuucug

SEQ ID NO: 363470 - RNA, 24 nt, Human
uccucagccucuccccagaguccc

SEQ ID NO: 363471 - RNA, 21 nt, Human
uccucuggagugacagcaggu

SEQ ID NO: 363472 - RNA, 18 nt, Human
ucugggugggacgugggg

SEQ ID NO: 363473 - RNA, 18 nt, Human
ucugggugggacgugggg

SEQ ID NO: 363474 - RNA, 20 nt, Human
ugaccugcucccugagacag

SEQ ID NO: 363475 - RNA, 20 nt, Human
ugaccugugaccugcucccu

SEQ ID NO: 363476 - RNA, 20 nt, Human
ugagugcccccagauggcgg

SEQ ID NO: 363477 - RNA, 20 nt, Human
ugagugcccccagauggcgg

SEQ ID NO: 363478 - RNA, 22 nt, Human
ugaguucacagcacugaaguuc

SEQ ID NO: 363479 - RNA, 22 nt, Human
ugaguucacagcacugaaguuc

SEQ ID NO: 363480 - RNA, 19 nt, Human
ugaguugaguaacagcacc

SEQ ID NO: 363481 - RNA, 19 nt, Human
ugaguugaguaacagcacc

SEQ ID NO: 363482 - RNA, 23 nt, Human
ugcaggcagacccccagagcccu

SEQ ID NO: 363483 - RNA, 21 nt, Human
ugccugggucuuggacacuga

SEQ ID NO: 363484 - RNA, 21 nt, Human
ugccugggucuuggacacuga

SEQ ID NO: 363485 - RNA, 18 nt, Human
ugcuguuuucuagccuug

SEQ ID NO: 363486 - RNA, 23 nt, Human
ugcuguuuucuagccuugaguug

SEQ ID NO: 363487 - RNA, 24 nt, Human
ugcuguuuucuagccuugaguugg

SEQ ID NO: 363488 - RNA, 25 nt, Human
uggaagcuggcugggagcgcuuggg

SEQ ID NO: 363489 - RNA, 25 nt, Human
uggaagcuggcugggagcgcuuggg

SEQ ID NO: 363490 - RNA, 20 nt, Human
uggagggaauaggggaucug

SEQ ID NO: 363491 - RNA, 20 nt, Human
uggagggaauaggggaucug

SEQ ID NO: 363492 - RNA, 18 nt, Human
uggcccuaggagcuggga

SEQ ID NO: 363493 - RNA, 18 nt, Human
uggcccuaggagcuggga

SEQ ID NO: 363494 - RNA, 18 nt, Human
uggcuccaggagguugag

SEQ ID NO: 363495 - RNA, 19 nt, Human
ugggaugcgggccccugug

SEQ ID NO: 363496 - RNA, 19 nt, Human
ugggaugcgggccccugug

SEQ ID NO: 363497 - RNA, 24 nt, Human
ugggcuccuucccaggacccgacg

SEQ ID NO: 363498 - RNA, 24 nt, Human
ugggcuccuucccaggacccgacg

SEQ ID NO: 363499 - RNA, 22 nt, Human
uggggcccuuggcuccaggagg

SEQ ID NO: 363500 - RNA, 22 nt, Human
uggggcccuuggcuccaggagg

SEQ ID NO: 363501 - RNA, 18 nt, Human
ugugaguucacagcacug

SEQ ID NO: 363502 - RNA, 18 nt, Human
ugugaguucacagcacug

SEQ ID NO: 363503 - RNA, 21 nt, Human
uguggagggaauaggggaucu

SEQ ID NO: 363504 - RNA, 21 nt, Human
uguggagggaauaggggaucu

SEQ ID NO: 363505 - RNA, 24 nt, Human
uguuguaacauccccccagugggg

SEQ ID NO: 363506 - RNA, 23 nt, Human
uuagcgccuggaagcuggcuggg

SEQ ID NO: 363507 - RNA, 23 nt, Human
uuagcgccuggaagcuggcuggg

SEQ ID NO: 363508 - RNA, 21 nt, Human
uucuccaucuugcuguuuucu

SEQ ID NO: 363509 - RNA, 24 nt, Human
uugcuguuuucuagccuugaguug

SEQ ID NO: 363510 - RNA, 24 nt, Human
aaaaaaagaaaaaaaaaucacaag

SEQ ID NO: 363511 - RNA, 22 nt, Human
aaauaaccaagauugccaacag

SEQ ID NO: 363512 - RNA, 18 nt, Human
aaauacuguaaacuacgg

SEQ ID NO: 363513 - RNA, 21 nt, Human
aagaagcucccgaauaugcca

SEQ ID NO: 363514 - RNA, 20 nt, Human
aagucaucuucagagacaac

SEQ ID NO: 363515 - RNA, 22 nt, Human
agaaauaaccaagauugccaac

SEQ ID NO: 363516 - RNA, 18 nt, Human
agccugauacaaaaagua

SEQ ID NO: 363517 - RNA, 19 nt, Human
agcgccuuucaagaugugu

SEQ ID NO: 363518 - RNA, 21 nt, Human
agggaaaagggagggcggagc

SEQ ID NO: 363519 - RNA, 19 nt, Human
auggcggagaagagaaagg

SEQ ID NO: 363520 - RNA, 24 nt, Human
caacaggcuuuuucuuucuuacuu

SEQ ID NO: 363521 - RNA, 24 nt, Human
cacacggcccgggucggcggcacc

SEQ ID NO: 363522 - RNA, 23 nt, Human
cacagaaaccgagccgucagaga

SEQ ID NO: 363523 - RNA, 25 nt, Human
cacugccagaaaucuuaaagaaaua

SEQ ID NO: 363524 - RNA, 23 nt, Human
caggagggcuaaaagcacggagc

SEQ ID NO: 363525 - RNA, 23 nt, Human
cagggaaaagggagggcggagcg

SEQ ID NO: 363526 - RNA, 21 nt, Human
ccaaaguucacauuccacuuc

SEQ ID NO: 363527 - RNA, 19 nt, Human
cccacuuaacuugcccaaa

SEQ ID NO: 363528 - RNA, 19 nt, Human
cccagaaggaaaggggacc

SEQ ID NO: 363529 - RNA, 19 nt, Human
cggcggcaccggggacagc

SEQ ID NO: 363530 - RNA, 19 nt, Human
cucccaaauaaaaagacuc

SEQ ID NO: 363531 - RNA, 21 nt, Human
cuucuuagcaauaacagucaa

SEQ ID NO: 363532 - RNA, 21 nt, Human
gagaacuacugagcgccuuuc

SEQ ID NO: 363533 - RNA, 19 nt, Human
ggaaguuguaguuauauuu

SEQ ID NO: 363534 - RNA, 19 nt, Human
ggcuauuuuacacagcuaa

SEQ ID NO: 363535 - RNA, 22 nt, Human
ggcucaggagggcuaaaagcac

SEQ ID NO: 363536 - RNA, 25 nt, Human
guuuaaaaaaaagaaaaaaaaaucc

SEQ ID NO: 363537 - RNA, 22 nt, Human
uaaacuacggcacagaaaccga

SEQ ID NO: 363538 - RNA, 23 nt, Human
uaacacuucccuccucuggcucc

SEQ ID NO: 363539 - RNA, 23 nt, Human
uaacagucaauaaacugcuugca

SEQ ID NO: 363540 - RNA, 24 nt, Human
uaagaagcucccgaauaugccaaa

SEQ ID NO: 363541 - RNA, 25 nt, Human
uaagaagcucccgaauaugccaaua

SEQ ID NO: 363542 - RNA, 21 nt, Human
uaagauggucccaaacauuga

SEQ ID NO: 363543 - RNA, 22 nt, Human
uagcacaaguaacacuucccuc

SEQ ID NO: 363544 - RNA, 20 nt, Human
ucaaaaaugcuauaauaaau

SEQ ID NO: 363545 - RNA, 26 nt, Human
ucaugguuuaaaaaaaagaaaaaaaa

SEQ ID NO: 363546 - RNA, 20 nt, Human
uccaucccacacugccagaa

SEQ ID NO: 363547 - RNA, 23 nt, Human
uccauggcggagaagagaaagga

SEQ ID NO: 363548 - RNA, 25 nt, Human
ucccugugcaugugagggcagaagc

SEQ ID NO: 363549 - RNA, 21 nt, Human
ucgaggcgacagcggcuggag

SEQ ID NO: 363550 - RNA, 23 nt, Human
ucgaggcgacagcggcuggagcc

SEQ ID NO: 363551 - RNA, 23 nt, Human
ugaagccugauacaaaaaguaga

SEQ ID NO: 363552 - RNA, 19 nt, Human
ugacaggagggcagaguac

SEQ ID NO: 363553 - RNA, 23 nt, Human
ugagggcagaagcuggugaaacc

SEQ ID NO: 363554 - RNA, 21 nt, Human
ugccaacaggcuuuuucuuuc

SEQ ID NO: 363555 - RNA, 22 nt, Human
ugcuauacgcugcguaugggca

SEQ ID NO: 363556 - RNA, 24 nt, Human
uggaaggcugucccacuuaacuug

SEQ ID NO: 363557 - RNA, 18 nt, Human
uggcggagaagagaaagg

SEQ ID NO: 363558 - RNA, 20 nt, Human
uggcucaggagggcuaaaag

SEQ ID NO: 363559 - RNA, 22 nt, Human
uggcucccaaauaaaaagacuc

SEQ ID NO: 363560 - RNA, 22 nt, Human
ugugcaugugagggcagaagcu

SEQ ID NO: 363561 - RNA, 20 nt, Human
uguguaaacagaauaugagg

SEQ ID NO: 363562 - RNA, 22 nt, Human
uuccacuucauucauccauccc

SEQ ID NO: 363563 - RNA, 18 nt, Human
uugaagccugauacaaaa

SEQ ID NO: 363564 - RNA, 23 nt, Human
uuuaaaaaaaagaaaaaaaaauc

SEQ ID NO: 363565 - RNA, 19 nt, Human
aaaacaucauuuggaaaaa

SEQ ID NO: 363566 - RNA, 18 nt, Human
aacagugugggauggagc

SEQ ID NO: 363567 - RNA, 22 nt, Human
aaggaaaggccacugcaaggug

SEQ ID NO: 363568 - RNA, 22 nt, Human
aauguuagaggcuggacaaacu

SEQ ID NO: 363569 - RNA, 20 nt, Human
acaaggaaaggccacugcaa

SEQ ID NO: 363570 - RNA, 20 nt, Human
acaaugugaaaacguaacac

SEQ ID NO: 363571 - RNA, 21 nt, Human
acauuauaucaccacgauacc

SEQ ID NO: 363572 - RNA, 19 nt, Human
accgccacacacugcucug

SEQ ID NO: 363573 - RNA, 23 nt, Human
acucugaugacaaggaaaggcca

SEQ ID NO: 363574 - RNA, 21 nt, Human
acugcaccacauuauaucacc

SEQ ID NO: 363575 - RNA, 18 nt, Human
acuuuccuuuuagaaggc

SEQ ID NO: 363576 - RNA, 21 nt, Human
agaaauacuccauccagcauc

SEQ ID NO: 363577 - RNA, 19 nt, Human
agagccuggggguguccag

SEQ ID NO: 363578 - RNA, 23 nt, Human
agccacacgcccucaccaacacc

SEQ ID NO: 363579 - RNA, 22 nt, Human
agccacacgcccucaccaacag

SEQ ID NO: 363580 - RNA, 20 nt, Human
agccacggcguggcgcaugc

SEQ ID NO: 363581 - RNA, 21 nt, Human
agccuggggguguccagcuuu

SEQ ID NO: 363582 - RNA, 22 nt, Human
agucgcccgcuuccggaagccc

SEQ ID NO: 363583 - RNA, 19 nt, Human
auauaaguaacugcaccac

SEQ ID NO: 363584 - RNA, 24 nt, Human
auccaggauucucccucccucuca

SEQ ID NO: 363585 - RNA, 23 nt, Human
augauuccccugcuucuuuggua

SEQ ID NO: 363586 - RNA, 22 nt, Human
caaggugggugggaucuggggu

SEQ ID NO: 363587 - RNA, 21 nt, Human
caauacacaguauaugaacaa

SEQ ID NO: 363588 - RNA, 20 nt, Human
cacacgcccucaccaacacc

SEQ ID NO: 363589 - RNA, 19 nt, Human
cacaugucucccacacgcc

SEQ ID NO: 363590 - RNA, 23 nt, Human
cacaugucucccacacgccaaca

SEQ ID NO: 363591 - RNA, 23 nt, Human
cacauuauaucaccacgauaccu

SEQ ID NO: 363592 - RNA, 22 nt, Human
ccaacaccagaccaucccuuua

SEQ ID NO: 363593 - RNA, 24 nt, Human
ccaacaccagaccaucccuuuagc

SEQ ID NO: 363594 - RNA, 21 nt, Human
ccaacaccugugcauucucua

SEQ ID NO: 363595 - RNA, 18 nt, Human
ccaagaaaauguuuguca

SEQ ID NO: 363596 - RNA, 22 nt, Human
ccauauuuuuccucccgaucug

SEQ ID NO: 363597 - RNA, 22 nt, Human
cccacacgccaacaccagacca

SEQ ID NO: 363598 - RNA, 24 nt, Human
ccucagagaaauacuccauccagc

SEQ ID NO: 363599 - RNA, 18 nt, Human
ccuccuggaagggaggca

SEQ ID NO: 363600 - RNA, 21 nt, Human
cucaucccugaagugcuagaa

SEQ ID NO: 363601 - RNA, 21 nt, Human
cucccaacuugaauauguuug

SEQ ID NO: 363602 - RNA, 18 nt, Human
cucccacacgccaacacc

SEQ ID NO: 363603 - RNA, 18 nt, Human
cucccucccucucauccc

SEQ ID NO: 363604 - RNA, 22 nt, Human
cucccucccucucaucccugaa

SEQ ID NO: 363605 - RNA, 22 nt, Human
cugcagggucagguugccuguu

SEQ ID NO: 363606 - RNA, 23 nt, Human
cugcccucggucccgugcggucc

SEQ ID NO: 363607 - RNA, 20 nt, Human
cuugugagcucccgucccgc

SEQ ID NO: 363608 - RNA, 20 nt, Human
gacaaugaaguaccaagaaa

SEQ ID NO: 363609 - RNA, 21 nt, Human
gagacaaggauccguucuuca

SEQ ID NO: 363610 - RNA, 26 nt, Human
gagcacacaugucucccacacgccaa

SEQ ID NO: 363611 - RNA, 24 nt, Human
gagcuggucaugagagagccgugc

SEQ ID NO: 363612 - RNA, 19 nt, Human
gcccggucccggcgcggag

SEQ ID NO: 363613 - RNA, 21 nt, Human
gggugugguggcgguggcacu

SEQ ID NO: 363614 - RNA, 25 nt, Human
guggagcugcgagucgcccgcuucc

SEQ ID NO: 363615 - RNA, 26 nt, Human
guggcacgagcacacaugucucccac

SEQ ID NO: 363616 - RNA, 24 nt, Human
guggcgguggcacugcugguggga

SEQ ID NO: 363617 - RNA, 24 nt, Human
uaaacuucguaaggccaagaguuc

SEQ ID NO: 363618 - RNA, 22 nt, Human
uaacauuugccaucgaaauagu

SEQ ID NO: 363619 - RNA, 21 nt, Human
uacaguauauuagaaggcaaa

SEQ ID NO: 363620 - RNA, 19 nt, Human
uagaaggcaaaaacaucaa

SEQ ID NO: 363621 - RNA, 21 nt, Human
uagaaugucaaagcacagaaa

SEQ ID NO: 363622 - RNA, 18 nt, Human
uagcagcauuuccauagu

SEQ ID NO: 363623 - RNA, 19 nt, Human
uaucaaaaaaagaagagac

SEQ ID NO: 363624 - RNA, 20 nt, Human
uaucaaaaaaagaagagacu

SEQ ID NO: 363625 - RNA, 22 nt, Human
uaucaaaaaaagaagagacucc

SEQ ID NO: 363626 - RNA, 26 nt, Human
uaucaaaaaaagaagagacuccaaug

SEQ ID NO: 363627 - RNA, 22 nt, Human
ucagagaaauacuccauccagc

SEQ ID NO: 363628 - RNA, 21 nt, Human
ucagcgguaaaacacauucca

SEQ ID NO: 363629 - RNA, 18 nt, Human
uccccgaaacuccgagca

SEQ ID NO: 363630 - RNA, 21 nt, Human
uccgcagccugggugaacagu

SEQ ID NO: 363631 - RNA, 22 nt, Human
uccuggaagggaggcagagagc

SEQ ID NO: 363632 - RNA, 23 nt, Human
uccuggaagggaggcagagagcu

SEQ ID NO: 363633 - RNA, 22 nt, Human
ucgcccgcuuccggaagcccgc

SEQ ID NO: 363634 - RNA, 20 nt, Human
ucucccacacgccaacacca

SEQ ID NO: 363635 - RNA, 21 nt, Human
ucuccgcagccugggugaaca

SEQ ID NO: 363636 - RNA, 23 nt, Human
ucuccgcagccugggugaacagu

SEQ ID NO: 363637 - RNA, 18 nt, Human
ucuuugguacuuuccaaa

SEQ ID NO: 363638 - RNA, 19 nt, Human
ugaacagugugggauggag

SEQ ID NO: 363639 - RNA, 21 nt, Human
ugcagggucagguugccuguu

SEQ ID NO: 363640 - RNA, 22 nt, Human
ugcccucggucccgugcggucc

SEQ ID NO: 363641 - RNA, 18 nt, Human
ugcuggacaauguuagag

SEQ ID NO: 363642 - RNA, 21 nt, Human
uggcacugcuggugggagcca

SEQ ID NO: 363643 - RNA, 24 nt, Human
ugggagacagacaaugugaaaacg

SEQ ID NO: 363644 - RNA, 18 nt, Human
ugggauagaaacugacuc

SEQ ID NO: 363645 - RNA, 21 nt, Human
ugggauggaguagagccuggg

SEQ ID NO: 363646 - RNA, 24 nt, Human
uguauguguggcacgagcacacau

SEQ ID NO: 363647 - RNA, 20 nt, Human
ugucaaagcacagaaaaagc

SEQ ID NO: 363648 - RNA, 22 nt, Human
ugucaaagcacagaaaaagccu

SEQ ID NO: 363649 - RNA, 20 nt, Human
ugucaggacaguucauuugg

SEQ ID NO: 363650 - RNA, 21 nt, Human
ugucuccuccugcccucgguc

SEQ ID NO: 363651 - RNA, 19 nt, Human
ugugguggcgguggcacug

SEQ ID NO: 363652 - RNA, 21 nt, Human
uguguggcacgagcacacaug

SEQ ID NO: 363653 - RNA, 22 nt, Human
uguuagaggcuggacaaacugc

SEQ ID NO: 363654 - RNA, 19 nt, Human
uguucugaagcucauuacc

SEQ ID NO: 363655 - RNA, 19 nt, Human
uuccccugcuucuuuggua

SEQ ID NO: 363656 - RNA, 18 nt, Human
uucuuguaaacagugagu

SEQ ID NO: 363657 - RNA, 20 nt, Human
uuuggaaagugggugccggg

SEQ ID NO: 363658 - RNA, 18 nt, Human
uuugguuguguucaguca

SEQ ID NO: 363659 - RNA, 19 nt, Human
uuuuuuuucugaggggcau

SEQ ID NO: 363660 - RNA, 21 nt, Human
uuuuuuuuuucugaggggcau

SEQ ID NO: 363661 - RNA, 20 nt, Human
uuuuuuuuuuucugaggggc

SEQ ID NO: 363662 - RNA, 22 nt, Human
uuuuuuuuuuuuuuucugaggg

SEQ ID NO: 363663 - RNA, 21 nt, Human
aacucccacacccccaguccc

SEQ ID NO: 363664 - RNA, 20 nt, Human
aacuguggggaggacucugg

SEQ ID NO: 363665 - RNA, 18 nt, Human
aauacaaaaaggaaauga

SEQ ID NO: 363666 - RNA, 20 nt, Human
acaaagucggucuccaauaa

SEQ ID NO: 363667 - RNA, 18 nt, Human
accaacucccacaccccc

SEQ ID NO: 363668 - RNA, 19 nt, Human
accaacucccacaccccca

SEQ ID NO: 363669 - RNA, 25 nt, Human
accaacucccacacccccaguccca

SEQ ID NO: 363670 - RNA, 21 nt, Human
accucaucugcugccagggag

SEQ ID NO: 363671 - RNA, 18 nt, Human
acguagcagcugugucuc

SEQ ID NO: 363672 - RNA, 24 nt, Human
acucugcuucaucacuugcuuugc

SEQ ID NO: 363673 - RNA, 25 nt, Human
acucugcuucaucacuugcuuugcu

SEQ ID NO: 363674 - RNA, 25 nt, Human
acuggcuguuuugugggccgcagcu

SEQ ID NO: 363675 - RNA, 26 nt, Human
acuggcuguuuugugggccgcagcuu

SEQ ID NO: 363676 - RNA, 25 nt, Human
agaaagacagggauaacaugugagg

SEQ ID NO: 363677 - RNA, 20 nt, Human
agaauaaagguuugggagug

SEQ ID NO: 363678 - RNA, 19 nt, Human
agacagggaagugcaugug

SEQ ID NO: 363679 - RNA, 18 nt, Human
agacagggauaacaugug

SEQ ID NO: 363680 - RNA, 20 nt, Human
aggaacuguggggaggacuc

SEQ ID NO: 363681 - RNA, 19 nt, Human
aggacucugggaggaagag

SEQ ID NO: 363682 - RNA, 18 nt, Human
aggcuuuuccagaggugg

SEQ ID NO: 363683 - RNA, 22 nt, Human
augggaaugguaugagcauguc

SEQ ID NO: 363684 - RNA, 21 nt, Human
auuacucugagaugagggggu

SEQ ID NO: 363685 - RNA, 21 nt, Human
caacccaggcauccaccucuc

SEQ ID NO: 363686 - RNA, 22 nt, Human
caacucccacacccccaguccc

SEQ ID NO: 363687 - RNA, 25 nt, Human
caacucccacacccccagucccaca

SEQ ID NO: 363688 - RNA, 25 nt, Human
caagcagaaccauuucaaaugcuaa

SEQ ID NO: 363689 - RNA, 21 nt, Human
cacacagcccggguacacagu

SEQ ID NO: 363690 - RNA, 21 nt, Human
cacacccccagucccacacug

SEQ ID NO: 363691 - RNA, 19 nt, Human
caccgagcacacccuggga

SEQ ID NO: 363692 - RNA, 20 nt, Human
cagccccccaguucuggccc

SEQ ID NO: 363693 - RNA, 23 nt, Human
cagcuguuccagaggacaugggg

SEQ ID NO: 363694 - RNA, 19 nt, Human
cagcuugccauccagcuug

SEQ ID NO: 363695 - RNA, 23 nt, Human
caggauccuucaugccaaucugu

SEQ ID NO: 363696 - RNA, 22 nt, Human
caggcauccaccucucuggagg

SEQ ID NO: 363697 - RNA, 21 nt, Human
cagggaagugcaugugaagcc

SEQ ID NO: 363698 - RNA, 20 nt, Human
cauccagaauggccucuagg

SEQ ID NO: 363699 - RNA, 24 nt, Human
cauccagcuuggugacaguggaca

SEQ ID NO: 363700 - RNA, 24 nt, Human
caugacccaugcccagcuguucca

SEQ ID NO: 363701 - RNA, 23 nt, Human
caugcccagcuguuccagaggac

SEQ ID NO: 363702 - RNA, 18 nt, Human
cauuuuccaagcagaacc

SEQ ID NO: 363703 - RNA, 20 nt, Human
ccaacauggcagcauccaga

SEQ ID NO: 363704 - RNA, 22 nt, Human
ccagcuuggugacaguggacau

SEQ ID NO: 363705 - RNA, 22 nt, Human
ccaguucuggcccacacagccc

SEQ ID NO: 363706 - RNA, 19 nt, Human
cccacacagcccggguaca

SEQ ID NO: 363707 - RNA, 19 nt, Human
cccagcuguuccagaggac

SEQ ID NO: 363708 - RNA, 23 nt, Human
cccaugcccagcuguuccagagg

SEQ ID NO: 363709 - RNA, 18 nt, Human
ccccagggcuggugaggg

SEQ ID NO: 363710 - RNA, 22 nt, Human
ccccagucucccaguggcucug

SEQ ID NO: 363711 - RNA, 26 nt, Human
ccccccagggcuggugaggggccccu

SEQ ID NO: 363712 - RNA, 18 nt, Human
ccccugccacucugcagg

SEQ ID NO: 363713 - RNA, 19 nt, Human
ccucaucugcugccaggga

SEQ ID NO: 363714 - RNA, 18 nt, Human
ccuggcugccucaguggg

SEQ ID NO: 363715 - RNA, 23 nt, Human
cgcggaguggcgcggggucgggg

SEQ ID NO: 363716 - RNA, 19 nt, Human
cggcuggccgggcgcggag

SEQ ID NO: 363717 - RNA, 18 nt, Human
cguagucugugcugaugc

SEQ ID NO: 363718 - RNA, 18 nt, Human
cucccacacccccagucc

SEQ ID NO: 363719 - RNA, 21 nt, Human
cugaaaccaggaaagccaacc

SEQ ID NO: 363720 - RNA, 22 nt, Human
cugaaaccaggaaagccaaccc

SEQ ID NO: 363721 - RNA, 20 nt, Human
cugagguuacauugagccuc

SEQ ID NO: 363722 - RNA, 18 nt, Human
cugaugccaaacccaggu

SEQ ID NO: 363723 - RNA, 21 nt, Human
cuuccaguaugcuucuggagg

SEQ ID NO: 363724 - RNA, 23 nt, Human
cuugccauccagcuuggugacag

SEQ ID NO: 363725 - RNA, 21 nt, Human
cuuugcacaaagucggucucc

SEQ ID NO: 363726 - RNA, 25 nt, Human
gaaccauuucaaaugcuaaaacugg

SEQ ID NO: 363727 - RNA, 19 nt, Human
gagaacccugauuagcauu

SEQ ID NO: 363728 - RNA, 18 nt, Human
gagggaagcuccauggag

SEQ ID NO: 363729 - RNA, 21 nt, Human
gagguggcuuuggaaauaagc

SEQ ID NO: 363730 - RNA, 19 nt, Human
gcaaccaaucuucuagaac

SEQ ID NO: 363731 - RNA, 20 nt, Human
gcaagaagggcagauacccu

SEQ ID NO: 363732 - RNA, 18 nt, Human
gcagagacuguacuuccc

SEQ ID NO: 363733 - RNA, 23 nt, Human
gccaugggaaagaccaggguuag

SEQ ID NO: 363734 - RNA, 21 nt, Human
gccgcagcuugccauccagcu

SEQ ID NO: 363735 - RNA, 20 nt, Human
gcggcuggccgggcgcggag

SEQ ID NO: 363736 - RNA, 20 nt, Human
gcucuggcuauuaauaacuc

SEQ ID NO: 363737 - RNA, 24 nt, Human
gcuuggugacaguggacauccacc

SEQ ID NO: 363738 - RNA, 19 nt, Human
ggacagcacuuagaugacc

SEQ ID NO: 363739 - RNA, 24 nt, Human
ggaggaagagguagggaaggcaaa

SEQ ID NO: 363740 - RNA, 21 nt, Human
ggagggaggugagguaagagc

SEQ ID NO: 363741 - RNA, 18 nt, Human
ggcgcggaguggcgcggg

SEQ ID NO: 363742 - RNA, 19 nt, Human
gggccaggugcagagucag

SEQ ID NO: 363743 - RNA, 20 nt, Human
gggcgcggaguggcgcgggg

SEQ ID NO: 363744 - RNA, 23 nt, Human
gggucugagggggagggagccag

SEQ ID NO: 363745 - RNA, 19 nt, Human
gguuucucagucccugcuc

SEQ ID NO: 363746 - RNA, 22 nt, Human
guggcuucuugcuguccccacc

SEQ ID NO: 363747 - RNA, 18 nt, Human
guggggaggacucuggga

SEQ ID NO: 363748 - RNA, 20 nt, Human
uaaauggagggaggugaggu

SEQ ID NO: 363749 - RNA, 18 nt, Human
uacaaaaaggaaaugacg

SEQ ID NO: 363750 - RNA, 24 nt, Human
ucaauggaggacucaacacugaag

SEQ ID NO: 363751 - RNA, 19 nt, Human
ucaccaacucccacacccc

SEQ ID NO: 363752 - RNA, 19 nt, Human
ucagcugaaggcagugccu

SEQ ID NO: 363753 - RNA, 20 nt, Human
ucagucccugcucuggugcc

SEQ ID NO: 363754 - RNA, 21 nt, Human
ucagucccugcucuggugccu

SEQ ID NO: 363755 - RNA, 21 nt, Human
ucagucccugcucuggugccu

SEQ ID NO: 363756 - RNA, 24 nt, Human
ucauuuuccaagcagaaccauuuc

SEQ ID NO: 363757 - RNA, 20 nt, Human
uccagcuuggugacagugga

SEQ ID NO: 363758 - RNA, 21 nt, Human
uccccaccucuccuccugcuc

SEQ ID NO: 363759 - RNA, 22 nt, Human
uccucaguuugaaacguacccc

SEQ ID NO: 363760 - RNA, 20 nt, Human
ucuagguacaggaagugaga

SEQ ID NO: 363761 - RNA, 19 nt, Human
ucucauggcauuggacuuu

SEQ ID NO: 363762 - RNA, 25 nt, Human
ucuucugccucucuacuccucggaa

SEQ ID NO: 363763 - RNA, 18 nt, Human
ugaaacguaccccagaaa

SEQ ID NO: 363764 - RNA, 18 nt, Human
ugacuggcuguuuugugg

SEQ ID NO: 363765 - RNA, 21 nt, Human
ugagcaugucugaaaccagga

SEQ ID NO: 363766 - RNA, 22 nt, Human
ugagggggagggagccagcccc

SEQ ID NO: 363767 - RNA, 18 nt, Human
ugccagggagauguggga

SEQ ID NO: 363768 - RNA, 22 nt, Human
ugccuggcaagaagggcagaua

SEQ ID NO: 363769 - RNA, 22 nt, Human
ugcuuugcacaaagucggucuc

SEQ ID NO: 363770 - RNA, 27 nt, Human
uggaagagucaagguccacucucugga

SEQ ID NO: 363771 - RNA, 21 nt, Human
uggaggcagagaagaggcuga

SEQ ID NO: 363772 - RNA, 19 nt, Human
uggcaaagggccaggugca

SEQ ID NO: 363773 - RNA, 19 nt, Human
uggcagcauccagaauggc

SEQ ID NO: 363774 - RNA, 22 nt, Human
ugggaggaagagguagggaagg

SEQ ID NO: 363775 - RNA, 18 nt, Human
uguuccagaggacauggg

SEQ ID NO: 363776 - RNA, 19 nt, Human
uucugccucucuacuccuc

SEQ ID NO: 363777 - RNA, 18 nt, Human
uuggacauugacauaaau

SEQ ID NO: 363778 - RNA, 21 nt, Human
aaagcagggugaggcauugcc

SEQ ID NO: 363779 - RNA, 21 nt, Human
aaauccauugcauuacaaaaa

SEQ ID NO: 363780 - RNA, 21 nt, Human
aacccuugagcucagcaaucc

SEQ ID NO: 363781 - RNA, 19 nt, Human
aaccugcacguugugcaca

SEQ ID NO: 363782 - RNA, 24 nt, Human
aagaacgauuccuaaauagaauaa

SEQ ID NO: 363783 - RNA, 19 nt, Human
aagaagauguaggcuucuc

SEQ ID NO: 363784 - RNA, 18 nt, Human
aagcaaacaaaaaaauau

SEQ ID NO: 363785 - RNA, 28 nt, Human
acacaccagggccuguuguggggugggg

SEQ ID NO: 363786 - RNA, 22 nt, Human
acaccaacauggcacauguaua

SEQ ID NO: 363787 - RNA, 23 nt, Human
agaacaaucugaguuauguccuc

SEQ ID NO: 363788 - RNA, 18 nt, Human
agaagacgggugauuucu

SEQ ID NO: 363789 - RNA, 21 nt, Human
agaaggagauguaggaaguac

SEQ ID NO: 363790 - RNA, 20 nt, Human
agacaagaaaaaguuaucua

SEQ ID NO: 363791 - RNA, 22 nt, Human
agacaagaaaaaguuaucuauu

SEQ ID NO: 363792 - RNA, 24 nt, Human
agcaaugagggaaauauccagaaa

SEQ ID NO: 363793 - RNA, 22 nt, Human
aguaagugcugaaaaugaacaa

SEQ ID NO: 363794 - RNA, 22 nt, Human
auaggaacagcuccggugcaca

SEQ ID NO: 363795 - RNA, 20 nt, Human
auaugucuuacuucuacccu

SEQ ID NO: 363796 - RNA, 21 nt, Human
aucuucuuuagggggcuguua

SEQ ID NO: 363797 - RNA, 25 nt, Human
cacccuuacuucgaugaauuaaggg

SEQ ID NO: 363798 - RNA, 26 nt, Human
caccgugcgcaagccaaagcaggguu

SEQ ID NO: 363799 - RNA, 21 nt, Human
cagaagacgggugauuucugc

SEQ ID NO: 363800 - RNA, 20 nt, Human
caggaacaaggggagaggag

SEQ ID NO: 363801 - RNA, 26 nt, Human
caggcuuaaaaaacggcgcgccacaa

SEQ ID NO: 363802 - RNA, 22 nt, Human
cagggaguucccuuucugaguc

SEQ ID NO: 363803 - RNA, 25 nt, Human
cauagcaggcacuucacaaagcacc

SEQ ID NO: 363804 - RNA, 22 nt, Human
cauaguaggaugcucugcaacc

SEQ ID NO: 363805 - RNA, 19 nt, Human
cccuccuaggaaaacucaa

SEQ ID NO: 363806 - RNA, 21 nt, Human
ccgugcgcaagccaaagcagg

SEQ ID NO: 363807 - RNA, 20 nt, Human
ccugcacguugugcacaugu

SEQ ID NO: 363808 - RNA, 18 nt, Human
cggugcacagcucccagc

SEQ ID NO: 363809 - RNA, 22 nt, Human
cuacccuuucaagcaaacaaaa

SEQ ID NO: 363810 - RNA, 18 nt, Human
cuacgcccauggagucuc

SEQ ID NO: 363811 - RNA, 19 nt, Human
cucagcaaucccaguugug

SEQ ID NO: 363812 - RNA, 25 nt, Human
cucagcaaugagggaaauauccaga

SEQ ID NO: 363813 - RNA, 19 nt, Human
cucccacccgaauacugcg

SEQ ID NO: 363814 - RNA, 22 nt, Human
cugcaacccuugagcucagcaa

SEQ ID NO: 363815 - RNA, 18 nt, Human
cuucaaacaaagaauagu

SEQ ID NO: 363816 - RNA, 18 nt, Human
cuugucaggaagaugaug

SEQ ID NO: 363817 - RNA, 24 nt, Human
gaaagguaaauuugcucauaaaaa

SEQ ID NO: 363818 - RNA, 21 nt, Human
gaacaacauaauugaaaucca

SEQ ID NO: 363819 - RNA, 19 nt, Human
gaacuuggagagaaaggua

SEQ ID NO: 363820 - RNA, 22 nt, Human
gcaggcacuucacaaagcaccg

SEQ ID NO: 363821 - RNA, 23 nt, Human
gcgcaccgugcgcaagccaaagc

SEQ ID NO: 363822 - RNA, 19 nt, Human
ggacagaguauuuucaggg

SEQ ID NO: 363823 - RNA, 25 nt, Human
gggagaacuuggagagaaagguaaa

SEQ ID NO: 363824 - RNA, 18 nt, Human
gggagggauagcauuagg

SEQ ID NO: 363825 - RNA, 24 nt, Human
ggggaacaucacacaccagggccu

SEQ ID NO: 363826 - RNA, 19 nt, Human
gggggaaggggggagggau

SEQ ID NO: 363827 - RNA, 20 nt, Human
ggggugggggaaggggggag

SEQ ID NO: 363828 - RNA, 23 nt, Human
ggggugggggaaggggggaggga

SEQ ID NO: 363829 - RNA, 18 nt, Human
ggugcgcgcaccgugcgc

SEQ ID NO: 363830 - RNA, 18 nt, Human
gugcagcacaccaacaug

SEQ ID NO: 363831 - RNA, 18 nt, Human
guuucucaggguuuccaa

SEQ ID NO: 363832 - RNA, 22 nt, Human
uaaaaaacggcgcgccacaaga

SEQ ID NO: 363833 - RNA, 21 nt, Human
uaaaaauaaagcuggcucuaa

SEQ ID NO: 363834 - RNA, 22 nt, Human
uaaagaacgauuccuaaauaga

SEQ ID NO: 363835 - RNA, 23 nt, Human
uaaagaacgauuccuaaauagaa

SEQ ID NO: 363836 - RNA, 25 nt, Human
uaaagcaucauucuuuugaaguaag

SEQ ID NO: 363837 - RNA, 19 nt, Human
uaacauagcaggcacuuca

SEQ ID NO: 363838 - RNA, 21 nt, Human
uaaggcauauaagcccaggac

SEQ ID NO: 363839 - RNA, 23 nt, Human
uaagugcugaaaaugaacaacau

SEQ ID NO: 363840 - RNA, 20 nt, Human
uacagauuagaaaaucaugg

SEQ ID NO: 363841 - RNA, 22 nt, Human
uacccuuuguaaagagugugca

SEQ ID NO: 363842 - RNA, 24 nt, Human
uacugcgcucuuccaacaggcuua

SEQ ID NO: 363843 - RNA, 18 nt, Human
uagaaggagauguaggaa

SEQ ID NO: 363844 - RNA, 19 nt, Human
uagaaugaauaagaagagu

SEQ ID NO: 363845 - RNA, 23 nt, Human
uagcaggcacuucacaaagcacc

SEQ ID NO: 363846 - RNA, 21 nt, Human
uagucccauuaaaaucaggaa

SEQ ID NO: 363847 - RNA, 18 nt, Human
ucaaagaaaggggugacu

SEQ ID NO: 363848 - RNA, 27 nt, Human
ucgagguaguuuuucuuggaagcccau

SEQ ID NO: 363849 - RNA, 22 nt, Human
ucugcauucucagcaaugaggg

SEQ ID NO: 363850 - RNA, 23 nt, Human
ucuucacauaacagaaugagaau

SEQ ID NO: 363851 - RNA, 27 nt, Human
ugaaaaugaacaacauaauugaaaucc

SEQ ID NO: 363852 - RNA, 19 nt, Human
ugaugaguuaaugggugca

SEQ ID NO: 363853 - RNA, 24 nt, Human
ugaugauaguaacauagcaggcac

SEQ ID NO: 363854 - RNA, 21 nt, Human
ugcaaagauuucuacagcacc

SEQ ID NO: 363855 - RNA, 25 nt, Human
ugcgcaagccaaagcagggugaggc

SEQ ID NO: 363856 - RNA, 20 nt, Human
uggaagcccauagcaauaug

SEQ ID NO: 363857 - RNA, 21 nt, Human
uggaagcgauaaacuugaaua

SEQ ID NO: 363858 - RNA, 19 nt, Human
uggcacauguauacauaug

SEQ ID NO: 363859 - RNA, 18 nt, Human
ugggaagcccaagggguc

SEQ ID NO: 363860 - RNA, 21 nt, Human
ugggggaaggggggagggaua

SEQ ID NO: 363861 - RNA, 19 nt, Human
uggggugggggaagggggg

SEQ ID NO: 363862 - RNA, 21 nt, Human
uggggugggggaaggggggag

SEQ ID NO: 363863 - RNA, 22 nt, Human
uggggugggggaaggggggagg

SEQ ID NO: 363864 - RNA, 27 nt, Human
uguauacauauguaacaaaccugcacg

SEQ ID NO: 363865 - RNA, 21 nt, Human
ugucuuacuucuacccuuuca

SEQ ID NO: 363866 - RNA, 20 nt, Human
uguggggugggggaaggggg

SEQ ID NO: 363867 - RNA, 18 nt, Human
uguuguggggugggggaa

SEQ ID NO: 363868 - RNA, 21 nt, Human
uuaaaaaacggcgcgccacaa

SEQ ID NO: 363869 - RNA, 22 nt, Human
uuagaaauaucauuagugaaca

SEQ ID NO: 363870 - RNA, 19 nt, Human
uucaagcaaacaaaaaaau

SEQ ID NO: 363871 - RNA, 24 nt, Human
aaaaacagugucacagaacuaaac

SEQ ID NO: 363872 - RNA, 18 nt, Human
aaacaaaacaagggcuga

SEQ ID NO: 363873 - RNA, 20 nt, Human
aaacauuauccacacugccc

SEQ ID NO: 363874 - RNA, 21 nt, Human
aaacauuauccacacugcccc

SEQ ID NO: 363875 - RNA, 27 nt, Human
aacaacucuuugguucagacuagcaag

SEQ ID NO: 363876 - RNA, 21 nt, Human
aacacagcaaaugcccaaaca

SEQ ID NO: 363877 - RNA, 21 nt, Human
aacuucuguaccucccuuuuc

SEQ ID NO: 363878 - RNA, 19 nt, Human
aaggaaauaaccaggccag

SEQ ID NO: 363879 - RNA, 18 nt, Human
aaggacucagaggaggua

SEQ ID NO: 363880 - RNA, 18 nt, Human
aaguguuugucucccugg

SEQ ID NO: 363881 - RNA, 19 nt, Human
acaaaacaagggcugaugu

SEQ ID NO: 363882 - RNA, 19 nt, Human
acacagacccaggcaccca

SEQ ID NO: 363883 - RNA, 24 nt, Human
acccccagcacagggccaggaagc

SEQ ID NO: 363884 - RNA, 20 nt, Human
acugcuguggcugcuacucu

SEQ ID NO: 363885 - RNA, 19 nt, Human
agaaauggccaacacagca

SEQ ID NO: 363886 - RNA, 24 nt, Human
agacacggggucaguucuucuugg

SEQ ID NO: 363887 - RNA, 19 nt, Human
agacagcagcaggugagcc

SEQ ID NO: 363888 - RNA, 23 nt, Human
agcugaguguacccugaccgcac

SEQ ID NO: 363889 - RNA, 19 nt, Human
aggacucagaggagguacu

SEQ ID NO: 363890 - RNA, 18 nt, Human
aggcaagggccacaugug

SEQ ID NO: 363891 - RNA, 22 nt, Human
aggcaucggagaaccaggugcc

SEQ ID NO: 363892 - RNA, 22 nt, Human
aggugacacagacccaggcacc

SEQ ID NO: 363893 - RNA, 25 nt, Human
aggugccacccccaaaaaacagugu

SEQ ID NO: 363894 - RNA, 18 nt, Human
agguggggugguaauagg

SEQ ID NO: 363895 - RNA, 18 nt, Human
agguggggugguaauagg

SEQ ID NO: 363896 - RNA, 23 nt, Human
agucuugcucaaacucagcccca

SEQ ID NO: 363897 - RNA, 23 nt, Human
agugcagaccugggcuggggccc

SEQ ID NO: 363898 - RNA, 22 nt, Human
auaaacauccuaaaagccucau

SEQ ID NO: 363899 - RNA, 22 nt, Human
auggagggcagccuggcccacu

SEQ ID NO: 363900 - RNA, 24 nt, Human
caaaaaacagugucacagaacuaa

SEQ ID NO: 363901 - RNA, 21 nt, Human
caaacccucuccuccccgcaa

SEQ ID NO: 363902 - RNA, 18 nt, Human
caaacucagccccaagua

SEQ ID NO: 363903 - RNA, 23 nt, Human
caaacucagccccaaguaucucc

SEQ ID NO: 363904 - RNA, 23 nt, Human
cacagaacuaaacauuauccacc

SEQ ID NO: 363905 - RNA, 19 nt, Human
cacuuugcuauccuagggc

SEQ ID NO: 363906 - RNA, 20 nt, Human
cagcauggagggcagccugg

SEQ ID NO: 363907 - RNA, 23 nt, Human
cagcuccguccucccugugggag

SEQ ID NO: 363908 - RNA, 21 nt, Human
caggguccagcucagugcucu

SEQ ID NO: 363909 - RNA, 19 nt, Human
caguaggucccagcgaggu

SEQ ID NO: 363910 - RNA, 18 nt, Human
cagugcucugccuccagg

SEQ ID NO: 363911 - RNA, 21 nt, Human
ccaaccagcaaaauaaaaagg

SEQ ID NO: 363912 - RNA, 25 nt, Human
ccagaauggaacacagggcucuuga

SEQ ID NO: 363913 - RNA, 20 nt, Human
ccaggacagcuggcuggcug

SEQ ID NO: 363914 - RNA, 24 nt, Human
ccaggccagauaagacuagccaua

SEQ ID NO: 363915 - RNA, 18 nt, Human
ccagggcccagacuugcc

SEQ ID NO: 363916 - RNA, 21 nt, Human
cccacccccagcacagggcca

SEQ ID NO: 363917 - RNA, 20 nt, Human
cccaggagaaaauagagaaa

SEQ ID NO: 363918 - RNA, 20 nt, Human
cccagggcccagacuugccc

SEQ ID NO: 363919 - RNA, 18 nt, Human
ccccagcuuccccccacc

SEQ ID NO: 363920 - RNA, 19 nt, Human
ccccagcuuccccccaccc

SEQ ID NO: 363921 - RNA, 19 nt, Human
ccccagggcccagacuugc

SEQ ID NO: 363922 - RNA, 21 nt, Human
ccccagggcccagacuugccc

SEQ ID NO: 363923 - RNA, 19 nt, Human
cccgcaaggaaauaaccag

SEQ ID NO: 363924 - RNA, 23 nt, Human
cccuaaggcagguguugggccuc

SEQ ID NO: 363925 - RNA, 22 nt, Human
cccugucugcugccucccgagc

SEQ ID NO: 363926 - RNA, 23 nt, Human
ccgcaaggaaauaaccaggccag

SEQ ID NO: 363927 - RNA, 23 nt, Human
ccucccuaccccagggcccagac

SEQ ID NO: 363928 - RNA, 18 nt, Human
ccucccuuuucuuuuauc

SEQ ID NO: 363929 - RNA, 19 nt, Human
ccugaggccagcuccgucc

SEQ ID NO: 363930 - RNA, 22 nt, Human
ccugagucucccucccuacccc

SEQ ID NO: 363931 - RNA, 19 nt, Human
ccugggccugacaccagcc

SEQ ID NO: 363932 - RNA, 24 nt, Human
ccuggucacaugugugaaaucuug

SEQ ID NO: 363933 - RNA, 19 nt, Human
cggggucaguucuucuugg

SEQ ID NO: 363934 - RNA, 21 nt, Human
cucauuacacagagcugagcu

SEQ ID NO: 363935 - RNA, 18 nt, Human
cugcugccucccgagcag

SEQ ID NO: 363936 - RNA, 26 nt, Human
cuguaccucccuuuucuuuuaucaug

SEQ ID NO: 363937 - RNA, 22 nt, Human
gaacacagggcucuugacaccc

SEQ ID NO: 363938 - RNA, 24 nt, Human
gaaccaggugccacccccaaaaaa

SEQ ID NO: 363939 - RNA, 25 nt, Human
gagcaguaggucccagcgagguggg

SEQ ID NO: 363940 - RNA, 18 nt, Human
gagguacugcuguggcug

SEQ ID NO: 363941 - RNA, 19 nt, Human
gcccccagcuuccccccac

SEQ ID NO: 363942 - RNA, 22 nt, Human
gcccccagcuuccccccacccc

SEQ ID NO: 363943 - RNA, 24 nt, Human
gcugcuggaguuggggaggagagc

SEQ ID NO: 363944 - RNA, 28 nt, Human
gcuggagugcagugagcuccagccccua

SEQ ID NO: 363945 - RNA, 19 nt, Human
gcuggggcccagcauggag

SEQ ID NO: 363946 - RNA, 22 nt, Human
ggaccuggagcuuagcagggga

SEQ ID NO: 363947 - RNA, 19 nt, Human
ggagauggcuaaggcucaa

SEQ ID NO: 363948 - RNA, 19 nt, Human
ggagguacugcuguggcug

SEQ ID NO: 363949 - RNA, 21 nt, Human
ggagucuacccaggguccagc

SEQ ID NO: 363950 - RNA, 24 nt, Human
ggccagauaagacuagccauaaaa

SEQ ID NO: 363951 - RNA, 19 nt, Human
gggagucuugcucaaacuc

SEQ ID NO: 363952 - RNA, 19 nt, Human
gggcugggagcagauuagc

SEQ ID NO: 363953 - RNA, 20 nt, Human
gucucaaagcccuggcacug

SEQ ID NO: 363954 - RNA, 22 nt, Human
gugcagaccugggcuggggccc

SEQ ID NO: 363955 - RNA, 26 nt, Human
guggccccuggucacaugugugaaau

SEQ ID NO: 363956 - RNA, 22 nt, Human
guggcucccugagggcaagggc

SEQ ID NO: 363957 - RNA, 19 nt, Human
uaaaacaaaacaagggcug

SEQ ID NO: 363958 - RNA, 23 nt, Human
uaaacauuuacagauaccaacca

SEQ ID NO: 363959 - RNA, 21 nt, Human
uaagacacgagcaagccauag

SEQ ID NO: 363960 - RNA, 19 nt, Human
uacacagagcugagcuuua

SEQ ID NO: 363961 - RNA, 18 nt, Human
uacagauaccaaccagca

SEQ ID NO: 363962 - RNA, 18 nt, Human
uagcaggggagaggaggc

SEQ ID NO: 363963 - RNA, 22 nt, Human
uauaaacauccuaaaagccuca

SEQ ID NO: 363964 - RNA, 22 nt, Human
uauccacacugccccaggugac

SEQ ID NO: 363965 - RNA, 19 nt, Human
ucagaggagguacugcugu

SEQ ID NO: 363966 - RNA, 21 nt, Human
ucaggaccuggagcuuagcaa

SEQ ID NO: 363967 - RNA, 19 nt, Human
ucagugcucugccuccagg

SEQ ID NO: 363968 - RNA, 23 nt, Human
ucccagcacuacaguccugggcc

SEQ ID NO: 363969 - RNA, 19 nt, Human
uccccccacccccagcaca

SEQ ID NO: 363970 - RNA, 21 nt, Human
ucccuaccccagggcccagau

SEQ ID NO: 363971 - RNA, 20 nt, Human
ucccugcaaaaccugggaaa

SEQ ID NO: 363972 - RNA, 21 nt, Human
ucccugcaaaaccugggaaac

SEQ ID NO: 363973 - RNA, 21 nt, Human
uccugggccugacaccagccc

SEQ ID NO: 363974 - RNA, 23 nt, Human
ucuccaaguguuugucucccugg

SEQ ID NO: 363975 - RNA, 25 nt, Human
ucuuggccagguggggccccaagac

SEQ ID NO: 363976 - RNA, 21 nt, Human
ugaaauucuuggcguugauag

SEQ ID NO: 363977 - RNA, 19 nt, Human
ugaaggcccugccaagucu

SEQ ID NO: 363978 - RNA, 22 nt, Human
ugaaggcccugccaagucuggg

SEQ ID NO: 363979 - RNA, 24 nt, Human
ugaaggcccugccaagucugggug

SEQ ID NO: 363980 - RNA, 20 nt, Human
ugacacagacccaggcaccc

SEQ ID NO: 363981 - RNA, 19 nt, Human
ugaggccagcuccguccuc

SEQ ID NO: 363982 - RNA, 27 nt, Human
ugcaauaacggugggagcuccagacac

SEQ ID NO: 363983 - RNA, 22 nt, Human
ugccuccagggggcgccaaagg

SEQ ID NO: 363984 - RNA, 22 nt, Human
ugccucccgagcaguagguccc

SEQ ID NO: 363985 - RNA, 21 nt, Human
ugcugguggcucccugucugc

SEQ ID NO: 363986 - RNA, 19 nt, Human
uggagugcagugagcucca

SEQ ID NO: 363987 - RNA, 21 nt, Human
uggccaacacagcaaaugccc

SEQ ID NO: 363988 - RNA, 18 nt, Human
uggccccaggacagcugg

SEQ ID NO: 363989 - RNA, 18 nt, Human
ugggaaagucucaaagcc

SEQ ID NO: 363990 - RNA, 21 nt, Human
ugggagcagauuagcaaaccc

SEQ ID NO: 363991 - RNA, 21 nt, Human
ugggcaaaggacucagaggag

SEQ ID NO: 363992 - RNA, 20 nt, Human
ugggcugggagcagauuagc

SEQ ID NO: 363993 - RNA, 24 nt, Human
uggggaggagagcugaguguaccc

SEQ ID NO: 363994 - RNA, 22 nt, Human
uggggcccccacacaggccucu

SEQ ID NO: 363995 - RNA, 18 nt, Human
ugucacagaacuaaacau

SEQ ID NO: 363996 - RNA, 23 nt, Human
ugucacagaacuaaacauuaucc

SEQ ID NO: 363997 - RNA, 20 nt, Human
uguccagacacagguuaggg

SEQ ID NO: 363998 - RNA, 23 nt, Human
ugugggagucuacccagggucca

SEQ ID NO: 363999 - RNA, 22 nt, Human
ugugugaaaucuuggcaauguu

SEQ ID NO: 364000 - RNA, 21 nt, Human
uguuugucucccugggucacu

SEQ ID NO: 364001 - RNA, 24 nt, Human
uuaaacauuuacagauaccaacca

SEQ ID NO: 364002 - RNA, 22 nt, Human
uuccagacuuuuuuucccugca

SEQ ID NO: 364003 - RNA, 27 nt, Human
uucccugcaaaaccugggaaacaagag

SEQ ID NO: 364004 - RNA, 22 nt, Human
uugaaggcccugccaagucugg

SEQ ID NO: 364005 - RNA, 24 nt, Human
uuucccugcaaaaccugggaaaca

SEQ ID NO: 364006 - RNA, 23 nt, Human
uuugaaauucuuggcguugauag

SEQ ID NO: 364007 - RNA, 22 nt, Human
aagaauacagagaagugaaggc

SEQ ID NO: 364008 - RNA, 26 nt, Human
acacgacaucgccgcaaaacaucucu

SEQ ID NO: 364009 - RNA, 21 nt, Human
acuccaucuucaucccuccaa

SEQ ID NO: 364010 - RNA, 25 nt, Human
cagaggauaacuccaucuucauccc

SEQ ID NO: 364011 - RNA, 18 nt, Human
caucgccgcaaaacaucu

SEQ ID NO: 364012 - RNA, 22 nt, Human
caucuucaucccuccaacacga

SEQ ID NO: 364013 - RNA, 22 nt, Human
ccagaccuguuuuggggugcag

SEQ ID NO: 364014 - RNA, 21 nt, Human
ccuccaacacgacaucgccgc

SEQ ID NO: 364015 - RNA, 24 nt, Human
cucauggccguggccagaccuguu

SEQ ID NO: 364016 - RNA, 21 nt, Human
uaauuuggggguaggcaagua

SEQ ID NO: 364017 - RNA, 21 nt, Human
ucugcagaggauaacuccauc

SEQ ID NO: 364018 - RNA, 22 nt, Human
uuuuuuuuuuuuuuuuuucuuu

SEQ ID NO: 364019 - RNA, 25 nt, Human
uuuuuuuuuuuuuuuuuucuuuagg

SEQ ID NO: 364020 - RNA, 19 nt, Human
aacucgccuccacgcucug

SEQ ID NO: 364021 - RNA, 20 nt, Human
acaggcuccuguagggcccg

SEQ ID NO: 364022 - RNA, 24 nt, Human
aggagucuuugacuaaaggggcuc

SEQ ID NO: 364023 - RNA, 19 nt, Human
aggcaacuccuuuccagga

SEQ ID NO: 364024 - RNA, 20 nt, Human
aggcccuugaagucgcccaa

SEQ ID NO: 364025 - RNA, 23 nt, Human
agggcagggagaagaggagugag

SEQ ID NO: 364026 - RNA, 26 nt, Human
cacgcucugauuggagaagaggcaac

SEQ ID NO: 364027 - RNA, 23 nt, Human
cauucucauuucacagaugaggg

SEQ ID NO: 364028 - RNA, 18 nt, Human
cauuuauuuggccggugc

SEQ ID NO: 364029 - RNA, 20 nt, Human
ccaggcccuugaagucgccc

SEQ ID NO: 364030 - RNA, 25 nt, Human
cccggguaagguggggaaucugauc

SEQ ID NO: 364031 - RNA, 20 nt, Human
cccuugaagucgcccaacuc

SEQ ID NO: 364032 - RNA, 18 nt, Human
gagauuggaacccagucu

SEQ ID NO: 364033 - RNA, 20 nt, Human
gcagggagaagaggagugag

SEQ ID NO: 364034 - RNA, 26 nt, Human
gccacgcuguccacucggccacggcu

SEQ ID NO: 364035 - RNA, 20 nt, Human
gcccuggggggugggucacg

SEQ ID NO: 364036 - RNA, 19 nt, Human
ggcguggcugagugaaggu

SEQ ID NO: 364037 - RNA, 21 nt, Human
ggcugagcggacugcugaccu

SEQ ID NO: 364038 - RNA, 23 nt, Human
gggcauggccaucugcacaggcu

SEQ ID NO: 364039 - RNA, 19 nt, Human
uaagguggggaaucugauc

SEQ ID NO: 364040 - RNA, 20 nt, Human
ucagggcagggagaagagga

SEQ ID NO: 364041 - RNA, 22 nt, Human
uccaggagucuuugacuaaagg

SEQ ID NO: 364042 - RNA, 21 nt, Human
ucucauuucacagaugagggc

SEQ ID NO: 364043 - RNA, 22 nt, Human
ugagccuggcagggaaagggag

SEQ ID NO: 364044 - RNA, 23 nt, Human
ugaucagggcagggagaagagga

SEQ ID NO: 364045 - RNA, 24 nt, Human
uggcagggaaagggaggggaaccg

SEQ ID NO: 364046 - RNA, 18 nt, Human
uggcguggcugagugaag

SEQ ID NO: 364047 - RNA, 23 nt, Human
uuggagaagaggcaacuccuuuc

SEQ ID NO: 364048 - RNA, 25 nt, Human
uuuuuuuuuuuuuuuuuuuaucugg

SEQ ID NO: 364049 - RNA, 22 nt, Human
aaagaggccagggcaacgggcc

SEQ ID NO: 364050 - RNA, 18 nt, Human
aagagaaggugggccagg

SEQ ID NO: 364051 - RNA, 19 nt, Human
aaggggacagcaggcagag

SEQ ID NO: 364052 - RNA, 23 nt, Human
aaguggcagugcggagucaagca

SEQ ID NO: 364053 - RNA, 27 nt, Human
aaugccucucuggcccagcgcugugug

SEQ ID NO: 364054 - RNA, 21 nt, Human
acaaaggcuggcccagggcaa

SEQ ID NO: 364055 - RNA, 21 nt, Human
acagaagaagucucuuccucu

SEQ ID NO: 364056 - RNA, 19 nt, Human
acucauaggcuggcagggu

SEQ ID NO: 364057 - RNA, 21 nt, Human
agaaggugggccaggggaucc

SEQ ID NO: 364058 - RNA, 21 nt, Human
agaccuccagcaucuccccag

SEQ ID NO: 364059 - RNA, 23 nt, Human
agagaacagaagaagucucuucc

SEQ ID NO: 364060 - RNA, 22 nt, Human
agcaucuccccagagaggcagc

SEQ ID NO: 364061 - RNA, 25 nt, Human
agccacgagggcagggcagggugau

SEQ ID NO: 364062 - RNA, 19 nt, Human
aggcuguguggccuggccc

SEQ ID NO: 364063 - RNA, 19 nt, Human
agguggcugaggccuggag

SEQ ID NO: 364064 - RNA, 19 nt, Human
aguagggaauguggagacu

SEQ ID NO: 364065 - RNA, 18 nt, Human
agugugaccggugacacu

SEQ ID NO: 364066 - RNA, 23 nt, Human
aucucaggcuggcccuggacccc

SEQ ID NO: 364067 - RNA, 20 nt, Human
caacccucugggaacucaua

SEQ ID NO: 364068 - RNA, 24 nt, Human
caaggccagcucguuccccugggc

SEQ ID NO: 364069 - RNA, 25 nt, Human
caaggccagcucguuccccugggcc

SEQ ID NO: 364070 - RNA, 21 nt, Human
cacccguggcuccugccucca

SEQ ID NO: 364071 - RNA, 23 nt, Human
caccuggaggggcagcccugggg

SEQ ID NO: 364072 - RNA, 20 nt, Human
cagagggcagccucugggcc

SEQ ID NO: 364073 - RNA, 23 nt, Human
cagagggcagccucugggccucu

SEQ ID NO: 364074 - RNA, 25 nt, Human
cagcugcuccagaccucccgggaaa

SEQ ID NO: 364075 - RNA, 19 nt, Human
cauggggaggggccagggg

SEQ ID NO: 364076 - RNA, 20 nt, Human
ccacuucacaaaggcuggcc

SEQ ID NO: 364077 - RNA, 23 nt, Human
ccagagaggcagcugcuccagac

SEQ ID NO: 364078 - RNA, 20 nt, Human
ccagcggcuaggcuucacag

SEQ ID NO: 364079 - RNA, 23 nt, Human
ccccacccguggcuccugccucc

SEQ ID NO: 364080 - RNA, 19 nt, Human
ccccugcgccucccaggcu

SEQ ID NO: 364081 - RNA, 23 nt, Human
ccccugugugcccaccucccaga

SEQ ID NO: 364082 - RNA, 23 nt, Human
cccgcguugaggcaggcgcagac

SEQ ID NO: 364083 - RNA, 18 nt, Human
cccucugcucuccgaagc

SEQ ID NO: 364084 - RNA, 18 nt, Human
cccugaggccgcgugagg

SEQ ID NO: 364085 - RNA, 23 nt, Human
cccuggaccccuggaaggggggc

SEQ ID NO: 364086 - RNA, 18 nt, Human
cccugggggagagugggg

SEQ ID NO: 364087 - RNA, 21 nt, Human
cccugugugcccaccucccag

SEQ ID NO: 364088 - RNA, 18 nt, Human
cccuucggugccccugug

SEQ ID NO: 364089 - RNA, 23 nt, Human
ccguggcuccugccuccacucac

SEQ ID NO: 364090 - RNA, 22 nt, Human
ccuaaguuuuucuccuggcggc

SEQ ID NO: 364091 - RNA, 18 nt, Human
ccuccacucaccugcugu

SEQ ID NO: 364092 - RNA, 19 nt, Human
ccucccaggcuguguggcc

SEQ ID NO: 364093 - RNA, 24 nt, Human
ccucccaggcuguguggccuggcc

SEQ ID NO: 364094 - RNA, 21 nt, Human
ccucugggaacucauaggcug

SEQ ID NO: 364095 - RNA, 22 nt, Human
ccucugggccucuggaaaugga

SEQ ID NO: 364096 - RNA, 19 nt, Human
ccugaccccucugcucucc

SEQ ID NO: 364097 - RNA, 18 nt, Human
ccugcucugugccagguc

SEQ ID NO: 364098 - RNA, 21 nt, Human
ccugcuggugucacuuggggu

SEQ ID NO: 364099 - RNA, 18 nt, Human
ccuggccccacccguggc

SEQ ID NO: 364100 - RNA, 23 nt, Human
ccuggccccacccguggcuccug

SEQ ID NO: 364101 - RNA, 19 nt, Human
cggcuaggcuucacagacu

SEQ ID NO: 364102 - RNA, 22 nt, Human
cgggaaagcugaauuuggaaag

SEQ ID NO: 364103 - RNA, 20 nt, Human
cguggcuccugccuccacuc

SEQ ID NO: 364104 - RNA, 22 nt, Human
cucaaggggcccagaagagggg

SEQ ID NO: 364105 - RNA, 22 nt, Human
cuccaacugggcccugaggccc

SEQ ID NO: 364106 - RNA, 28 nt, Human
cuccagaccucccgggaaagcugaauuu

SEQ ID NO: 364107 - RNA, 21 nt, Human
cuccagcccagcggcuaggcu

SEQ ID NO: 364108 - RNA, 23 nt, Human
cucuccgaagccacgagggcagg

SEQ ID NO: 364109 - RNA, 20 nt, Human
cugaagacuuuaauuuuaga

SEQ ID NO: 364110 - RNA, 18 nt, Human
cugcuccagaccucccgg

SEQ ID NO: 364111 - RNA, 21 nt, Human
cugcuggugucacuuggggug

SEQ ID NO: 364112 - RNA, 19 nt, Human
cugcuugggggccagggcc

SEQ ID NO: 364113 - RNA, 23 nt, Human
cuggaaggggggcuggguuuggg

SEQ ID NO: 364114 - RNA, 22 nt, Human
cugggccucuggaaauggaggu

SEQ ID NO: 364115 - RNA, 20 nt, Human
cugggccugaccccucugcu

SEQ ID NO: 364116 - RNA, 21 nt, Human
cuggguuuggggguuaagugg

SEQ ID NO: 364117 - RNA, 22 nt, Human
cugugugcccaccucccagagu

SEQ ID NO: 364118 - RNA, 18 nt, Human
cuuggacugugagagggg

SEQ ID NO: 364119 - RNA, 21 nt, Human
cuugggucacuggcagcugcc

SEQ ID NO: 364120 - RNA, 19 nt, Human
gacaaguggcagugcggag

SEQ ID NO: 364121 - RNA, 21 nt, Human
gaggccuggagggacaugggg

SEQ ID NO: 364122 - RNA, 19 nt, Human
gcaaggccagcucguuccc

SEQ ID NO: 364123 - RNA, 21 nt, Human
gcagacgcgagggaggugcag

SEQ ID NO: 364124 - RNA, 22 nt, Human
gcccagcggcuaggcuucacag

SEQ ID NO: 364125 - RNA, 19 nt, Human
gcccagggcaaagaggcca

SEQ ID NO: 364126 - RNA, 18 nt, Human
gccccugcgccucccagg

SEQ ID NO: 364127 - RNA, 20 nt, Human
gccuccucugcuugggggcc

SEQ ID NO: 364128 - RNA, 18 nt, Human
gccuggagggacaugggg

SEQ ID NO: 364129 - RNA, 21 nt, Human
gccuggagggacauggggagg

SEQ ID NO: 364130 - RNA, 19 nt, Human
gcucugugccaggucuugg

SEQ ID NO: 364131 - RNA, 19 nt, Human
gcuggcccuggaccccugg

SEQ ID NO: 364132 - RNA, 23 nt, Human
ggacauggggaggggccaggggc

SEQ ID NO: 364133 - RNA, 21 nt, Human
ggauggugguuagcucugagc

SEQ ID NO: 364134 - RNA, 18 nt, Human
ggcaaagaggccagggca

SEQ ID NO: 364135 - RNA, 21 nt, Human
ggcagcugcccagccccugcg

SEQ ID NO: 364136 - RNA, 22 nt, Human
ggcagcugcuccagaccucccg

SEQ ID NO: 364137 - RNA, 20 nt, Human
ggcagggcucaccuggaggg

SEQ ID NO: 364138 - RNA, 21 nt, Human
ggcagguggcugaggccugga

SEQ ID NO: 364139 - RNA, 21 nt, Human
gggagaguggggaccucagag

SEQ ID NO: 364140 - RNA, 18 nt, Human
gggagcugggacaugggg

SEQ ID NO: 364141 - RNA, 19 nt, Human
gggcagggcucaccuggag

SEQ ID NO: 364142 - RNA, 21 nt, Human
gggccggaggcucaggcucuc

SEQ ID NO: 364143 - RNA, 20 nt, Human
ggggcagggcucaccuggag

SEQ ID NO: 364144 - RNA, 19 nt, Human
ggugauggugcacuggguc

SEQ ID NO: 364145 - RNA, 24 nt, Human
uacagggcuucuggguaaagcugu

SEQ ID NO: 364146 - RNA, 20 nt, Human
uccagagaacagaagaaguc

SEQ ID NO: 364147 - RNA, 22 nt, Human
ucccucgcaccaaugccucucu

SEQ ID NO: 364148 - RNA, 22 nt, Human
ucuggguaaagcuguggagcug

SEQ ID NO: 364149 - RNA, 25 nt, Human
ugacacuuauggaaucgaguuuagc

SEQ ID NO: 364150 - RNA, 20 nt, Human
ugcacugggucaccuccugc

SEQ ID NO: 364151 - RNA, 20 nt, Human
ugccagggcugccugcuccc

SEQ ID NO: 364152 - RNA, 23 nt, Human
ugccagggcugccugcucccuuc

SEQ ID NO: 364153 - RNA, 26 nt, Human
ugcccagccccugcgccucccaggcu

SEQ ID NO: 364154 - RNA, 19 nt, Human
ugccccaacccucugggaa

SEQ ID NO: 364155 - RNA, 21 nt, Human
ugcuuguguggagcuaggagg

SEQ ID NO: 364156 - RNA, 20 nt, Human
uggaaaguagggaaugugga

SEQ ID NO: 364157 - RNA, 24 nt, Human
uggaaggggggcuggguuuggggg

SEQ ID NO: 364158 - RNA, 18 nt, Human
uggaauuaaagugugacc

SEQ ID NO: 364159 - RNA, 22 nt, Human
uggaggucuuugcuuuccuccu

SEQ ID NO: 364160 - RNA, 18 nt, Human
uggcagcugcccagcccc

SEQ ID NO: 364161 - RNA, 19 nt, Human
uggcccagcgcuguguggg

SEQ ID NO: 364162 - RNA, 22 nt, Human
uggcccagggcaaagaggccag

SEQ ID NO: 364163 - RNA, 21 nt, Human
uggcggcugugggaugccagg

SEQ ID NO: 364164 - RNA, 19 nt, Human
uggcgggcagguggcugag

SEQ ID NO: 364165 - RNA, 23 nt, Human
uggcuccaacugggcccugaggc

SEQ ID NO: 364166 - RNA, 21 nt, Human
uggcuccugccuccacucacc

SEQ ID NO: 364167 - RNA, 19 nt, Human
ugggaacucauaggcuggc

SEQ ID NO: 364168 - RNA, 21 nt, Human
ugggaaggggacagcaggccg

SEQ ID NO: 364169 - RNA, 18 nt, Human
ugggaggaggcaggcuug

SEQ ID NO: 364170 - RNA, 21 nt, Human
ugggcuugggucacuggcagc

SEQ ID NO: 364171 - RNA, 20 nt, Human
uggggaccucagagggcagg

SEQ ID NO: 364172 - RNA, 20 nt, Human
uggggagcugggacaugggg

SEQ ID NO: 364173 - RNA, 21 nt, Human
ugggguggcuccaacugggcc

SEQ ID NO: 364174 - RNA, 21 nt, Human
ugguuagcucugagcucuggg

SEQ ID NO: 364175 - RNA, 24 nt, Human
uguggcgggcagguggcugaggcc

SEQ ID NO: 364176 - RNA, 19 nt, Human
uucacaaaggcuggcccag

SEQ ID NO: 364177 - RNA, 19 nt, Human
uuccccugggccugacccc

SEQ ID NO: 364178 - RNA, 21 nt, Human
uuugcuuuccuccugccuucu

SEQ ID NO: 364179 - RNA, 20 nt, Human
uuuuuuuuuuuuuuuugcca

SEQ ID NO: 364180 - RNA, 18 nt, Human
uuuuuuuuuuuuuuuuug

SEQ ID NO: 364181 - RNA, 23 nt, Human
uuuuuuuuuuuuuuuuugccauu

SEQ ID NO: 364182 - RNA, 21 nt, Human
aaaguccaguugauccgggca

SEQ ID NO: 364183 - RNA, 24 nt, Human
aagcaggaggcuggcggagcaggg

SEQ ID NO: 364184 - RNA, 20 nt, Human
aggaguuuauugccagucug

SEQ ID NO: 364185 - RNA, 22 nt, Human
cacugggucccaggcagcaccc

SEQ ID NO: 364186 - RNA, 23 nt, Human
cccaggcagcacccgccuggccu

SEQ ID NO: 364187 - RNA, 23 nt, Human
cuggcggagcagggggcaaaagu

SEQ ID NO: 364188 - RNA, 20 nt, Human
cugggucccaggcagcaccc

SEQ ID NO: 364189 - RNA, 19 nt, Human
cuggugccgguggggugag

SEQ ID NO: 364190 - RNA, 19 nt, Human
cuuugcaggggcgggcuug

SEQ ID NO: 364191 - RNA, 22 nt, Human
gccugccuuugcaggggcgggc

SEQ ID NO: 364192 - RNA, 21 nt, Human
gcggagcagggggcaaaaguc

SEQ ID NO: 364193 - RNA, 18 nt, Human
uccaagcaggaggcuggc

SEQ ID NO: 364194 - RNA, 21 nt, Human
ugcaggggcgggcuugggcac

SEQ ID NO: 364195 - RNA, 27 nt, Human
ugccuuugcaggggcgggcuugggcac

SEQ ID NO: 364196 - RNA, 23 nt, Human
uuuuuuuuuuuuuuuuuuuucgg

SEQ ID NO: 364197 - RNA, 24 nt, Human
uuuuuuuuuuuuuuuuuuuuucgu

SEQ ID NO: 364198 - RNA, 20 nt, Human
aaaaagaaacaaaaggaaca

SEQ ID NO: 364199 - RNA, 21 nt, Human
aaagaaacaaaaggaacaaua

SEQ ID NO: 364200 - RNA, 27 nt, Human
accaguuggaggccgggcggggaaggg

SEQ ID NO: 364201 - RNA, 23 nt, Human
accccagccccugcagccccagc

SEQ ID NO: 364202 - RNA, 18 nt, Human
agagaguggggguggggg

SEQ ID NO: 364203 - RNA, 21 nt, Human
agcacauccugugcuccagcu

SEQ ID NO: 364204 - RNA, 19 nt, Human
agccccugcagccccagcc

SEQ ID NO: 364205 - RNA, 23 nt, Human
cacaccccagccccugcagcccc

SEQ ID NO: 364206 - RNA, 27 nt, Human
caccccagccccugcagccccagccag

SEQ ID NO: 364207 - RNA, 20 nt, Human
caccucggggcucaggugug

SEQ ID NO: 364208 - RNA, 18 nt, Human
cagcuucagugccagccc

SEQ ID NO: 364209 - RNA, 19 nt, Human
caugcaguucuccaucgug

SEQ ID NO: 364210 - RNA, 23 nt, Human
ccaguuggaggccgggcggggaa

SEQ ID NO: 364211 - RNA, 26 nt, Human
ccaguuggaggccgggcggggaaggg

SEQ ID NO: 364212 - RNA, 21 nt, Human
cccagccccugcagccccagc

SEQ ID NO: 364213 - RNA, 19 nt, Human
cccccgucagcacauccug

SEQ ID NO: 364214 - RNA, 21 nt, Human
ccgcuguuccuccugcccucc

SEQ ID NO: 364215 - RNA, 21 nt, Human
ccucugcagccgcaaaaucca

SEQ ID NO: 364216 - RNA, 21 nt, Human
ccugcagccccagccagggcu

SEQ ID NO: 364217 - RNA, 25 nt, Human
cgcuuaagcugaguaaguuaaggac

SEQ ID NO: 364218 - RNA, 22 nt, Human
cucaaccaguucccuggcuacc

SEQ ID NO: 364219 - RNA, 22 nt, Human
cuccagcuucagugccagcccc

SEQ ID NO: 364220 - RNA, 21 nt, Human
cugcagccccagccagggcug

SEQ ID NO: 364221 - RNA, 23 nt, Human
gacaaaaaaaaaggucucuccga

SEQ ID NO: 364222 - RNA, 20 nt, Human
gacagcacuccgcugccucu

SEQ ID NO: 364223 - RNA, 21 nt, Human
gccccgggagaagccaugggg

SEQ ID NO: 364224 - RNA, 25 nt, Human
gcuucagugccagccccgggagaag

SEQ ID NO: 364225 - RNA, 21 nt, Human
ggaaggguggggacagacagc

SEQ ID NO: 364226 - RNA, 18 nt, Human
gggaaaaaagaaacaaaa

SEQ ID NO: 364227 - RNA, 19 nt, Human
gggagaagccauggggagc

SEQ ID NO: 364228 - RNA, 23 nt, Human
ggggaaggguggggacagacagc

SEQ ID NO: 364229 - RNA, 21 nt, Human
gugcagucagcuguuaaugug

SEQ ID NO: 364230 - RNA, 20 nt, Human
uaacacaccccagccccugc

SEQ ID NO: 364231 - RNA, 20 nt, Human
ucaugacaaaaaaaaagguc

SEQ ID NO: 364232 - RNA, 19 nt, Human
uccaaagggaaaaaagaaa

SEQ ID NO: 364233 - RNA, 24 nt, Human
uccaaagggaaaaaagaaacaaaa

SEQ ID NO: 364234 - RNA, 23 nt, Human
ucgcagagagugggggugggggu

SEQ ID NO: 364235 - RNA, 21 nt, Human
ucggggcucaggugugcaguc

SEQ ID NO: 364236 - RNA, 20 nt, Human
ucugcagccgcaaaauccag

SEQ ID NO: 364237 - RNA, 21 nt, Human
ucugcagccgcaaaauccagu

SEQ ID NO: 364238 - RNA, 18 nt, Human
ugacaaaaaaaaaggucu

SEQ ID NO: 364239 - RNA, 23 nt, Human
ugcuccagcuucagugccagccc

SEQ ID NO: 364240 - RNA, 18 nt, Human
uggacccccgucagcaca

SEQ ID NO: 364241 - RNA, 23 nt, Human
uggcuaccugaggcccugcuuca

SEQ ID NO: 364242 - RNA, 21 nt, Human
uucccuggcuaccugaggccc

SEQ ID NO: 364243 - RNA, 22 nt, Human
uuucaugcugccagggccccuc

SEQ ID NO: 364244 - RNA, 24 nt, Human
aaaaaaacccuccagaaaaccaag

SEQ ID NO: 364245 - RNA, 21 nt, Human
aaaaaacccuccagaaaacca

SEQ ID NO: 364246 - RNA, 24 nt, Human
aaaaaacccuccagaaaaccaaug

SEQ ID NO: 364247 - RNA, 21 nt, Human
aaaaacccuccagaaaaccaa

SEQ ID NO: 364248 - RNA, 22 nt, Human
aaacccuccagaaaaccaaugg

SEQ ID NO: 364249 - RNA, 21 nt, Human
aaauggccaugagaacuccag

SEQ ID NO: 364250 - RNA, 23 nt, Human
aagaagaagaaguugggcagaga

SEQ ID NO: 364251 - RNA, 23 nt, Human
aagaagaaguugggcagagaaac

SEQ ID NO: 364252 - RNA, 24 nt, Human
aagcuaggucaugacagcagcaac

SEQ ID NO: 364253 - RNA, 27 nt, Human
aauacaaagauggaaaaaaaacccucc

SEQ ID NO: 364254 - RNA, 21 nt, Human
aauagagcaagaagaagaagu

SEQ ID NO: 364255 - RNA, 19 nt, Human
acaaagauggaaaaaaaac

SEQ ID NO: 364256 - RNA, 19 nt, Human
accaauguccaauguccua

SEQ ID NO: 364257 - RNA, 21 nt, Human
accccagcuagcaccaggagc

SEQ ID NO: 364258 - RNA, 22 nt, Human
agaaaauagaugcuccucuccc

SEQ ID NO: 364259 - RNA, 22 nt, Human
agagaaacugugaacugcaacc

SEQ ID NO: 364260 - RNA, 18 nt, Human
agagcagagccaagagga

SEQ ID NO: 364261 - RNA, 22 nt, Human
agcgguggucaggggugaagcc

SEQ ID NO: 364262 - RNA, 21 nt, Human
aggaagugcguaagccacccc

SEQ ID NO: 364263 - RNA, 19 nt, Human
aggaaugcugagaauaaag

SEQ ID NO: 364264 - RNA, 25 nt, Human
aggggcccaguggcaggcggcuccu

SEQ ID NO: 364265 - RNA, 26 nt, Human
aggggugaagcccaggaagacgaugc

SEQ ID NO: 364266 - RNA, 22 nt, Human
aguaauagagcaagaagaagaa

SEQ ID NO: 364267 - RNA, 20 nt, Human
aguuguaugggcuuugugau

SEQ ID NO: 364268 - RNA, 21 nt, Human
auugcaaagaaaagaaucaaa

SEQ ID NO: 364269 - RNA, 24 nt, Human
caaacccuggccagaagucaaaga

SEQ ID NO: 364270 - RNA, 19 nt, Human
cagagaaacugugaacugc

SEQ ID NO: 364271 - RNA, 24 nt, Human
cagcacaaacccuggccagaaguc

SEQ ID NO: 364272 - RNA, 20 nt, Human
cagcagcaacggucucucuu

SEQ ID NO: 364273 - RNA, 18 nt, Human
cagcugcagcauuuauga

SEQ ID NO: 364274 - RNA, 18 nt, Human
caggaucuggucccaugg

SEQ ID NO: 364275 - RNA, 20 nt, Human
cagguccugggcccggcacc

SEQ ID NO: 364276 - RNA, 22 nt, Human
caugacagcagcaacggucucu

SEQ ID NO: 364277 - RNA, 24 nt, Human
ccagaaaaccaauguccaaugucc

SEQ ID NO: 364278 - RNA, 24 nt, Human
ccccacuguucuccgauaucuccg

SEQ ID NO: 364279 - RNA, 23 nt, Human
ccuagcccacaguuccccuaugu

SEQ ID NO: 364280 - RNA, 24 nt, Human
ccugcaggcaggagggcccgaggc

SEQ ID NO: 364281 - RNA, 24 nt, Human
cgaagguagccgagagcagagcca

SEQ ID NO: 364282 - RNA, 19 nt, Human
cgagccaggcgucucguac

SEQ ID NO: 364283 - RNA, 33 nt, Human
cuaggucaugacagcagcaacggucucucuuuu

SEQ ID NO: 364284 - RNA, 18 nt, Human
cuccgcccaacaaauucu

SEQ ID NO: 364285 - RNA, 28 nt, Human
cuccggggcuccggcagcggggcaaauc

SEQ ID NO: 364286 - RNA, 19 nt, Human
cugggagacucagguaugc

SEQ ID NO: 364287 - RNA, 20 nt, Human
cuguaguuaggaggcagagc

SEQ ID NO: 364288 - RNA, 22 nt, Human
cuuacggccaaaccugucugcu

SEQ ID NO: 364289 - RNA, 20 nt, Human
cuuuuggucuugcugccauc

SEQ ID NO: 364290 - RNA, 23 nt, Human
gaauagguccaacauccaggagu

SEQ ID NO: 364291 - RNA, 19 nt, Human
gagcuuacggccaaaccug

SEQ ID NO: 364292 - RNA, 25 nt, Human
gaggaaaaacauuugcuucuggaaa

SEQ ID NO: 364293 - RNA, 28 nt, Human
gauggaaaaaaaacccuccagaaaacca

SEQ ID NO: 364294 - RNA, 22 nt, Human
gcaggaucuggucccaugggua

SEQ ID NO: 364295 - RNA, 19 nt, Human
gcccacguagaugggcgcg

SEQ ID NO: 364296 - RNA, 27 nt, Human
ggcccaguggcaggcggcuccuguugg

SEQ ID NO: 364297 - RNA, 18 nt, Human
gggagaucagccaccugg

SEQ ID NO: 364298 - RNA, 20 nt, Human
ggucaggggugaagcccagg

SEQ ID NO: 364299 - RNA, 20 nt, Human
guagccgauacucauagagc

SEQ ID NO: 364300 - RNA, 22 nt, Human
guccacgguggugggcaugauc

SEQ ID NO: 364301 - RNA, 22 nt, Human
uaaaaaauccccacuguucucc

SEQ ID NO: 364302 - RNA, 22 nt, Human
uaagaaaauagaugcuccucuc

SEQ ID NO: 364303 - RNA, 22 nt, Human
uagccgagagcagagccaagag

SEQ ID NO: 364304 - RNA, 22 nt, Human
uaggcaacuugguaaaaaaucc

SEQ ID NO: 364305 - RNA, 19 nt, Human
uaggucaugacagcagcaa

SEQ ID NO: 364306 - RNA, 19 nt, Human
uauuuuguuugccuagccc

SEQ ID NO: 364307 - RNA, 22 nt, Human
uccagcugcagcauuuaugagg

SEQ ID NO: 364308 - RNA, 21 nt, Human
uccuguugguguccaggcugg

SEQ ID NO: 364309 - RNA, 18 nt, Human
ucgaaggugcucugguuc

SEQ ID NO: 364310 - RNA, 20 nt, Human
ugagcuggaagaauuuggca

SEQ ID NO: 364311 - RNA, 19 nt, Human
ugcaaagaaaagaaucaaa

SEQ ID NO: 364312 - RNA, 22 nt, Human
ugcuccucucccaacuuuacug

SEQ ID NO: 364313 - RNA, 19 nt, Human
ugcugaccaguccuuggau

SEQ ID NO: 364314 - RNA, 22 nt, Human
uggaaaaaaaacccuccagaaa

SEQ ID NO: 364315 - RNA, 18 nt, Human
uggaauagguccaacauc

SEQ ID NO: 364316 - RNA, 24 nt, Human
uggauuaagcgaaaaauuaacauc

SEQ ID NO: 364317 - RNA, 22 nt, Human
uguagccgauacucauagagcc

SEQ ID NO: 364318 - RNA, 21 nt, Human
uuaacauccacguauagguug

SEQ ID NO: 364319 - RNA, 26 nt, Human
uugccuagcccacaguuccccuaugu

SEQ ID NO: 364320 - RNA, 22 nt, Human
uuggggaggcuucgcccgcagg

SEQ ID NO: 364321 - RNA, 20 nt, Human
uuuggcaggaucugguccca

SEQ ID NO: 364322 - RNA, 18 nt, Human
uuugguugaguuguaugg

SEQ ID NO: 364323 - RNA, 22 nt, Human
aaaauacaauucaacaaugcaa

SEQ ID NO: 364324 - RNA, 22 nt, Human
aaaauauccacucaaaauacaa

SEQ ID NO: 364325 - RNA, 27 nt, Human
aaaauaucccuucacuuuuaaaauccu

SEQ ID NO: 364326 - RNA, 21 nt, Human
aaccaugccuggaaccccagc

SEQ ID NO: 364327 - RNA, 18 nt, Human
aagaagggaaucuguggc

SEQ ID NO: 364328 - RNA, 22 nt, Human
aagacccagaaaucagaaucca

SEQ ID NO: 364329 - RNA, 22 nt, Human
aauggagagaaaagcaaaacug

SEQ ID NO: 364330 - RNA, 18 nt, Human
acaagaaaaaaacccagg

SEQ ID NO: 364331 - RNA, 22 nt, Human
acaagaaaaaaacccaggaagg

SEQ ID NO: 364332 - RNA, 23 nt, Human
acaaguuccacauuucaaaagcc

SEQ ID NO: 364333 - RNA, 19 nt, Human
agaaaaaaacccaggaagg

SEQ ID NO: 364334 - RNA, 19 nt, Human
aggaucagcuccuggauag

SEQ ID NO: 364335 - RNA, 22 nt, Human
agggaacacaagaaaaaaaccc

SEQ ID NO: 364336 - RNA, 18 nt, Human
aucccuucacuuuuaaaa

SEQ ID NO: 364337 - RNA, 21 nt, Human
aucccuucacuuuuaaaaucc

SEQ ID NO: 364338 - RNA, 22 nt, Human
caaaaaaagaaagaucaauccc

SEQ ID NO: 364339 - RNA, 20 nt, Human
caaagugcuaagaaugaaua

SEQ ID NO: 364340 - RNA, 24 nt, Human
caaauauaagaaaaauaucccuuc

SEQ ID NO: 364341 - RNA, 26 nt, Human
caaauccuuggucggcacaucccaca

SEQ ID NO: 364342 - RNA, 19 nt, Human
caacuuucucaaauccuug

SEQ ID NO: 364343 - RNA, 18 nt, Human
cacagggaacacaagaaa

SEQ ID NO: 364344 - RNA, 19 nt, Human
cagcuccuggauagcuccu

SEQ ID NO: 364345 - RNA, 24 nt, Human
cagcuucuuuguuaaacuggcuac

SEQ ID NO: 364346 - RNA, 23 nt, Human
cauaaaauauagacugcaucuga

SEQ ID NO: 364347 - RNA, 20 nt, Human
cauauuauguguucccagaa

SEQ ID NO: 364348 - RNA, 24 nt, Human
ccaggaagggcugugcaccugaca

SEQ ID NO: 364349 - RNA, 18 nt, Human
ccaugccuggaaccccag

SEQ ID NO: 364350 - RNA, 21 nt, Human
cccaaauaaucucagaaccac

SEQ ID NO: 364351 - RNA, 19 nt, Human
ccgccgcccgccgcccgca

SEQ ID NO: 364352 - RNA, 24 nt, Human
ccuaaaccaugccuggaaccccag

SEQ ID NO: 364353 - RNA, 19 nt, Human
ccuaagacccagaaaucag

SEQ ID NO: 364354 - RNA, 23 nt, Human
ccuggaaccccagcuguuacaga

SEQ ID NO: 364355 - RNA, 19 nt, Human
ccuucuuucugucuuuguc

SEQ ID NO: 364356 - RNA, 20 nt, Human
ccuucuuucugucuuugucg

SEQ ID NO: 364357 - RNA, 22 nt, Human
cggcacaucccacauucuugau

SEQ ID NO: 364358 - RNA, 22 nt, Human
cgggagggacuccugaccuguu

SEQ ID NO: 364359 - RNA, 19 nt, Human
cucacaaauauaagaaaaa

SEQ ID NO: 364360 - RNA, 21 nt, Human
cucauuaacaggauucccaga

SEQ ID NO: 364361 - RNA, 19 nt, Human
cuuucugucuuugucgggg

SEQ ID NO: 364362 - RNA, 22 nt, Human
cuuuuaaaauccuaagacccag

SEQ ID NO: 364363 - RNA, 21 nt, Human
gaaaccaaggugagcagagaa

SEQ ID NO: 364364 - RNA, 19 nt, Human
gaacagggccuaaaccaug

SEQ ID NO: 364365 - RNA, 22 nt, Human
gaaccccagcuguuacagagga

SEQ ID NO: 364366 - RNA, 21 nt, Human
gaaggugugcggaaaccaagg

SEQ ID NO: 364367 - RNA, 20 nt, Human
gacgggagggacuccugacc

SEQ ID NO: 364368 - RNA, 25 nt, Human
ggagguggacgggagggacuccuga

SEQ ID NO: 364369 - RNA, 30 nt, Human
guaaagcuuuuccccaagacaugucaaagg

SEQ ID NO: 364370 - RNA, 19 nt, Human
uaaagaagggaaucugugg

SEQ ID NO: 364371 - RNA, 20 nt, Human
uacagcagagaaauggagag

SEQ ID NO: 364372 - RNA, 24 nt, Human
uagccuaaugggucagagaccaca

SEQ ID NO: 364373 - RNA, 23 nt, Human
uauaacauauaaagcagaacaca

SEQ ID NO: 364374 - RNA, 24 nt, Human
ucaaaauacaauucaacaaugcaa

SEQ ID NO: 364375 - RNA, 22 nt, Human
ucacacccuuuggcccaggugc

SEQ ID NO: 364376 - RNA, 22 nt, Human
ucagagaccacagggaacacaa

SEQ ID NO: 364377 - RNA, 18 nt, Human
uccacucaaaauacaauu

SEQ ID NO: 364378 - RNA, 18 nt, Human
uccaugcaaucuucagaa

SEQ ID NO: 364379 - RNA, 18 nt, Human
uccuaagacccagaaauc

SEQ ID NO: 364380 - RNA, 19 nt, Human
uccuccaugcaaucuucag

SEQ ID NO: 364381 - RNA, 20 nt, Human
uccuucuuucugucuuuguc

SEQ ID NO: 364382 - RNA, 23 nt, Human
uccuucuuucugucuuugucggg

SEQ ID NO: 364383 - RNA, 23 nt, Human
ucgauaacaaaaaaagaaagauc

SEQ ID NO: 364384 - RNA, 22 nt, Human
ugaaaagauauugaauauaaca

SEQ ID NO: 364385 - RNA, 21 nt, Human
ugaaaugcacacgugcaucuc

SEQ ID NO: 364386 - RNA, 22 nt, Human
ugaaaugcacacgugcaucucu

SEQ ID NO: 364387 - RNA, 19 nt, Human
ugaacacauuucuguacaa

SEQ ID NO: 364388 - RNA, 24 nt, Human
ugaacucacaaauauaagaaaaau

SEQ ID NO: 364389 - RNA, 22 nt, Human
ugccugugauucagccuucuca

SEQ ID NO: 364390 - RNA, 23 nt, Human
uggaacagggccuaaaccaugcc

SEQ ID NO: 364391 - RNA, 23 nt, Human
ugggggcuucucuugucucucuu

SEQ ID NO: 364392 - RNA, 24 nt, Human
uguagcugaaaugcacacgugcag

SEQ ID NO: 364393 - RNA, 21 nt, Human
uuaaaauuuuaauuguuacca

SEQ ID NO: 364394 - RNA, 23 nt, Human
uuacagcagagaaauggagagaa

SEQ ID NO: 364395 - RNA, 26 nt, Human
uuuggcccaggugccugugauucagc

SEQ ID NO: 364396 - RNA, 24 nt, Human
uuuuacgauuacgcgacauguguu

SEQ ID NO: 364397 - RNA, 23 nt, Human
aaaaaaaaaaaaaaagacacaaa

SEQ ID NO: 364398 - RNA, 25 nt, Human
aaaaaaaaaagacacaaaccaggag

SEQ ID NO: 364399 - RNA, 22 nt, Human
aaaaaaaaagacacaaaccagg

SEQ ID NO: 364400 - RNA, 23 nt, Human
aaaaaaaaagacacaaaccagga

SEQ ID NO: 364401 - RNA, 28 nt, Human
aaaaaaaaagacacaaaccaggaggcua

SEQ ID NO: 364402 - RNA, 22 nt, Human
aaaaaaaagacacaaaccagga

SEQ ID NO: 364403 - RNA, 21 nt, Human
aaacaaaacccacauuacagc

SEQ ID NO: 364404 - RNA, 18 nt, Human
aaaggccuuugucacugg

SEQ ID NO: 364405 - RNA, 24 nt, Human
aagugcauucugaagggcaaauaa

SEQ ID NO: 364406 - RNA, 20 nt, Human
aagugcuagaggcuagggcu

SEQ ID NO: 364407 - RNA, 26 nt, Human
acacugaacacaaaauaucacccaau

SEQ ID NO: 364408 - RNA, 21 nt, Human
agaaaaggauacaacaacaaa

SEQ ID NO: 364409 - RNA, 19 nt, Human
agaggggaguggggaaagg

SEQ ID NO: 364410 - RNA, 20 nt, Human
agaggggaguggggaaaggg

SEQ ID NO: 364411 - RNA, 23 nt, Human
aggcucgcgagcugacaccgccg

SEQ ID NO: 364412 - RNA, 18 nt, Human
aggggaguggggaaaggg

SEQ ID NO: 364413 - RNA, 24 nt, Human
aggggaguggggaaaggggugggg

SEQ ID NO: 364414 - RNA, 25 nt, Human
auaaauuuccuuuaaaccauacaua

SEQ ID NO: 364415 - RNA, 19 nt, Human
auaaucagcaaagagaaga

SEQ ID NO: 364416 - RNA, 24 nt, Human
auagggcgcacgaccagggaaggu

SEQ ID NO: 364417 - RNA, 27 nt, Human
auucugcuccaucuucauuaccuuuca

SEQ ID NO: 364418 - RNA, 24 nt, Human
caaaccaggaggcuaaggaaccag

SEQ ID NO: 364419 - RNA, 24 nt, Human
caaauaaacaguaaaacaaaaccc

SEQ ID NO: 364420 - RNA, 21 nt, Human
caagaaaggaacacacacaau

SEQ ID NO: 364421 - RNA, 19 nt, Human
caagaggacaaacagcaaa

SEQ ID NO: 364422 - RNA, 22 nt, Human
caagccaggcagcaggcgaccc

SEQ ID NO: 364423 - RNA, 23 nt, Human
cacaaaccaggaggcuaaggaac

SEQ ID NO: 364424 - RNA, 19 nt, Human
cacagagcgcggccugggg

SEQ ID NO: 364425 - RNA, 18 nt, Human
cacauuccuccagaucuc

SEQ ID NO: 364426 - RNA, 20 nt, Human
cacgaccagggaagguuccg

SEQ ID NO: 364427 - RNA, 19 nt, Human
cagcaaaggccuuugucac

SEQ ID NO: 364428 - RNA, 19 nt, Human
cagcaggcgacccaagacc

SEQ ID NO: 364429 - RNA, 23 nt, Human
cagcaggcgacccaagaccgucc

SEQ ID NO: 364430 - RNA, 22 nt, Human
cagcuuugagagaaaagacaac

SEQ ID NO: 364431 - RNA, 22 nt, Human
cagggaagguuccgggccuggg

SEQ ID NO: 364432 - RNA, 23 nt, Human
caggucaagaggacaaacagcaa

SEQ ID NO: 364433 - RNA, 19 nt, Human
cagucuuuccucuucaguu

SEQ ID NO: 364434 - RNA, 21 nt, Human
ccacagcaguggaaaacaaga

SEQ ID NO: 364435 - RNA, 21 nt, Human
ccacuagaggggaguggggaa

SEQ ID NO: 364436 - RNA, 19 nt, Human
cccuagcucugcgcucucc

SEQ ID NO: 364437 - RNA, 22 nt, Human
ccugauaaauuuccuuuaaacc

SEQ ID NO: 364438 - RNA, 25 nt, Human
ccuugguccugccgcggcuggccuu

SEQ ID NO: 364439 - RNA, 19 nt, Human
cucacacaucagugcacuu

SEQ ID NO: 364440 - RNA, 20 nt, Human
cuccagaucucacugguucu

SEQ ID NO: 364441 - RNA, 24 nt, Human
cugaaagacuaugaacacaauuua

SEQ ID NO: 364442 - RNA, 19 nt, Human
cugcgcucuccugcccugg

SEQ ID NO: 364443 - RNA, 21 nt, Human
cuguguuuaaaaaaaaaaaaa

SEQ ID NO: 364444 - RNA, 18 nt, Human
gacacuguuuuuggcacu

SEQ ID NO: 364445 - RNA, 24 nt, Human
gaccucuagccuuauuaggggccu

SEQ ID NO: 364446 - RNA, 20 nt, Human
gacucggagucugcacaagc

SEQ ID NO: 364447 - RNA, 18 nt, Human
gagaagacaauuacacug

SEQ ID NO: 364448 - RNA, 20 nt, Human
gagaagugcuagaggcuagg

SEQ ID NO: 364449 - RNA, 26 nt, Human
gagcugacaccgccgccuugguccug

SEQ ID NO: 364450 - RNA, 24 nt, Human
gcaaugauccaguuaauguccucu

SEQ ID NO: 364451 - RNA, 21 nt, Human
gcauaugcuucucacauuccu

SEQ ID NO: 364452 - RNA, 23 nt, Human
gcccagugcuuugaucagaugua

SEQ ID NO: 364453 - RNA, 24 nt, Human
gccccagugucccuagaggaaggu

SEQ ID NO: 364454 - RNA, 23 nt, Human
gccuggggucggggaacgcggcg

SEQ ID NO: 364455 - RNA, 23 nt, Human
gcggcgggcuuugcgcgugcgcg

SEQ ID NO: 364456 - RNA, 22 nt, Human
ggaggugcugaguccaucauug

SEQ ID NO: 364457 - RNA, 20 nt, Human
gggaguggggaaaggggugg

SEQ ID NO: 364458 - RNA, 18 nt, Human
ggggaguggggaaagggg

SEQ ID NO: 364459 - RNA, 26 nt, Human
guaaaacaaaacccacauuacagcuu

SEQ ID NO: 364460 - RNA, 25 nt, Human
guaucaagaaaggaacacacacaau

SEQ ID NO: 364461 - RNA, 19 nt, Human
uaaaacaaaacccacauua

SEQ ID NO: 364462 - RNA, 23 nt, Human
uaaaacaaaacccacauuacagc

SEQ ID NO: 364463 - RNA, 22 nt, Human
uaaaacuuucucauuucccaag

SEQ ID NO: 364464 - RNA, 23 nt, Human
uaaaguuacaggacuaaagugag

SEQ ID NO: 364465 - RNA, 21 nt, Human
uaacauaaucagcaaagagaa

SEQ ID NO: 364466 - RNA, 25 nt, Human
uaacauaaucagcaaagagaagaca

SEQ ID NO: 364467 - RNA, 18 nt, Human
uagcucugcgcucuccug

SEQ ID NO: 364468 - RNA, 18 nt, Human
uagugaaaaauuaacugc

SEQ ID NO: 364469 - RNA, 18 nt, Human
uaucaagaaaggaacaca

SEQ ID NO: 364470 - RNA, 25 nt, Human
uaucaagaaaggaacacacacaaug

SEQ ID NO: 364471 - RNA, 23 nt, Human
uccuccagaucucacugguucua

SEQ ID NO: 364472 - RNA, 18 nt, Human
ucugcacaagcuggccau

SEQ ID NO: 364473 - RNA, 24 nt, Human
ucuguguuuaaaaaaaaaaaaaaa

SEQ ID NO: 364474 - RNA, 26 nt, Human
ucuguguuuaaaaaaaaaaaaaaaaa

SEQ ID NO: 364475 - RNA, 22 nt, Human
ugacuaaguaucaagaaaggaa

SEQ ID NO: 364476 - RNA, 20 nt, Human
ugagaaaagguaagaaucaa

SEQ ID NO: 364477 - RNA, 21 nt, Human
ugagagaaaagacaacguugc

SEQ ID NO: 364478 - RNA, 18 nt, Human
ugcccuggggaagcaaug

SEQ ID NO: 364479 - RNA, 19 nt, Human
ugcugaguggucuuaagag

SEQ ID NO: 364480 - RNA, 20 nt, Human
uggggucggggaacgcggcg

SEQ ID NO: 364481 - RNA, 23 nt, Human
ugguaacauaaucagcaaagaga

SEQ ID NO: 364482 - RNA, 23 nt, Human
ugguccugccgcggcuggccuua

SEQ ID NO: 364483 - RNA, 21 nt, Human
ugucacugaaggacucggagu

SEQ ID NO: 364484 - RNA, 22 nt, Human
uguuuguucuuuuuuaaccagg

SEQ ID NO: 364485 - RNA, 23 nt, Human
uuaggggccuuuucaaguagucu

SEQ ID NO: 364486 - RNA, 20 nt, Human
uucaaguagucuaaaauuaa

SEQ ID NO: 364487 - RNA, 20 nt, Human
uucccuagcucugcgcucuc

SEQ ID NO: 364488 - RNA, 26 nt, Human
uuccucuucaguuucucccuuacugg

SEQ ID NO: 364489 - RNA, 24 nt, Human
uucucacauuccuccagaucucac

SEQ ID NO: 364490 - RNA, 25 nt, Human
uuuaaaaaaaaaaaaaaaaagacac

SEQ ID NO: 364491 - RNA, 23 nt, Human
acagaauccuccccaaccgugag

SEQ ID NO: 364492 - RNA, 21 nt, Human
accaaaugcuucaggugcagc

SEQ ID NO: 364493 - RNA, 22 nt, Human
agccccugcugcagagcuucuc

SEQ ID NO: 364494 - RNA, 25 nt, Human
agcggguacuggcagcaacuccggc

SEQ ID NO: 364495 - RNA, 22 nt, Human
aggggcaccuuuauuuacagaa

SEQ ID NO: 364496 - RNA, 18 nt, Human
auuuacagaauccucccc

SEQ ID NO: 364497 - RNA, 26 nt, Human
caacuccggcccuaggcagaggguuc

SEQ ID NO: 364498 - RNA, 22 nt, Human
caccacugccccaacccaaggg

SEQ ID NO: 364499 - RNA, 21 nt, Human
cagaauccuccccaaccguga

SEQ ID NO: 364500 - RNA, 21 nt, Human
cagagcccagggcagacucag

SEQ ID NO: 364501 - RNA, 18 nt, Human
cagaggguucgauacucc

SEQ ID NO: 364502 - RNA, 23 nt, Human
cagccccugcugcagagcuucug

SEQ ID NO: 364503 - RNA, 20 nt, Human
ccaaccgugagaggggugcc

SEQ ID NO: 364504 - RNA, 22 nt, Human
ccagccagcucaaacugcccac

SEQ ID NO: 364505 - RNA, 19 nt, Human
ccagggcucuucccacagc

SEQ ID NO: 364506 - RNA, 21 nt, Human
cccacugcauucugggaaguc

SEQ ID NO: 364507 - RNA, 18 nt, Human
cccagccugaguugcagg

SEQ ID NO: 364508 - RNA, 18 nt, Human
cuauccagggcucuuccc

SEQ ID NO: 364509 - RNA, 24 nt, Human
cuauccagggcucuucccacagcu

SEQ ID NO: 364510 - RNA, 24 nt, Human
cucaaacugcccaccacauagacc

SEQ ID NO: 364511 - RNA, 22 nt, Human
cucacccaccaaaugcuucagg

SEQ ID NO: 364512 - RNA, 23 nt, Human
cugccccaacccaaggggcaccu

SEQ ID NO: 364513 - RNA, 18 nt, Human
cuucaggugcagccuccc

SEQ ID NO: 364514 - RNA, 23 nt, Human
gagcagagggagcggguacuggc

SEQ ID NO: 364515 - RNA, 19 nt, Human
gagcccagggcagacucag

SEQ ID NO: 364516 - RNA, 18 nt, Human
gcccagcagcccacugca

SEQ ID NO: 364517 - RNA, 27 nt, Human
gcucaaacugcccaccacauagacccu

SEQ ID NO: 364518 - RNA, 18 nt, Human
gggccugccuccacuccc

SEQ ID NO: 364519 - RNA, 24 nt, Human
ggugaaguuuuaucagagcccagg

SEQ ID NO: 364520 - RNA, 19 nt, Human
guugcagggccugcccuuc

SEQ ID NO: 364521 - RNA, 22 nt, Human
uagaagccaaauaaucaaggau

SEQ ID NO: 364522 - RNA, 24 nt, Human
ucccacagcucgucaccacugccc

SEQ ID NO: 364523 - RNA, 22 nt, Human
ucccagccugaguugaagggcc

SEQ ID NO: 364524 - RNA, 22 nt, Human
ugaguugaagggccugcccuuc

SEQ ID NO: 364525 - RNA, 23 nt, Human
ugaguugaagggccugcccuucu

SEQ ID NO: 364526 - RNA, 26 nt, Human
ugaguugaagggccugcccuucugcu

SEQ ID NO: 364527 - RNA, 22 nt, Human
ugaguugcagggccugcccuuc

SEQ ID NO: 364528 - RNA, 23 nt, Human
ugaguugcagggccugcccuucu

SEQ ID NO: 364529 - RNA, 23 nt, Human
ugcccuucugcucucccagcccc

SEQ ID NO: 364530 - RNA, 22 nt, Human
ugcucacccaccaaaugcuuca

SEQ ID NO: 364531 - RNA, 21 nt, Human
ugcugcagagcuucuguggag

SEQ ID NO: 364532 - RNA, 24 nt, Human
uggaugagcagagggagcggguac

SEQ ID NO: 364533 - RNA, 18 nt, Human
uguggagggccugccucc

SEQ ID NO: 364534 - RNA, 20 nt, Human
uugcagggccugcccuucug

SEQ ID NO: 364535 - RNA, 18 nt, Human
uuuacagaauccucccca

SEQ ID NO: 364536 - RNA, 22 nt, Human
uuuuuuuuuuuuuuuuuaaugg

SEQ ID NO: 364537 - RNA, 24 nt, Human
aagcagagaugaggccugcaaacg

SEQ ID NO: 364538 - RNA, 19 nt, Human
agauacaugccucacugcg

SEQ ID NO: 364539 - RNA, 22 nt, Human
auacaugccucacugcggccag

SEQ ID NO: 364540 - RNA, 19 nt, Human
cagcaaggaacuacagaua

SEQ ID NO: 364541 - RNA, 21 nt, Human
cagccggcucuucuagugccu

SEQ ID NO: 364542 - RNA, 19 nt, Human
cauuacaauucgcugaguu

SEQ ID NO: 364543 - RNA, 22 nt, Human
ccuggagcccccgauucucaag

SEQ ID NO: 364544 - RNA, 21 nt, Human
cucacugcggccaggccacag

SEQ ID NO: 364545 - RNA, 20 nt, Human
cugcggccaggccacagggc

SEQ ID NO: 364546 - RNA, 19 nt, Human
gaagugaaggcuuauucaa

SEQ ID NO: 364547 - RNA, 20 nt, Human
gaagugaaggcuuauucaag

SEQ ID NO: 364548 - RNA, 20 nt, Human
gccuggagcccccgauucuc

SEQ ID NO: 364549 - RNA, 25 nt, Human
ggaacuacagauacaugccucacug

SEQ ID NO: 364550 - RNA, 22 nt, Human
uaggagcccaggaucagccgga

SEQ ID NO: 364551 - RNA, 24 nt, Human
ucgcugaguuacauuugcuuaugc

SEQ ID NO: 364552 - RNA, 19 nt, Human
ugcuuaugcaccaaggucc

SEQ ID NO: 364553 - RNA, 23 nt, Human
uggaagugaaggcuuauucaagc

SEQ ID NO: 364554 - RNA, 19 nt, Human
uuuuacuucuuguuacuca

SEQ ID NO: 364555 - RNA, 21 nt, Human
aaaaauagcauuguccacugg

SEQ ID NO: 364556 - RNA, 19 nt, Human
aaacuagaaaauacuggua

SEQ ID NO: 364557 - RNA, 22 nt, Human
aaccuuugcccccaguuaucuc

SEQ ID NO: 364558 - RNA, 23 nt, Human
aagagccaaacucugucucaaaa

SEQ ID NO: 364559 - RNA, 24 nt, Human
aagagccaaacucugucucaaaaa

SEQ ID NO: 364560 - RNA, 21 nt, Human
accccauucuccugcccccag

SEQ ID NO: 364561 - RNA, 20 nt, Human
acugauggagacaacacgaa

SEQ ID NO: 364562 - RNA, 24 nt, Human
acuuuauaaaccagauguggcgcu

SEQ ID NO: 364563 - RNA, 23 nt, Human
agaaccucacaauuugaacagaa

SEQ ID NO: 364564 - RNA, 18 nt, Human
agacaaaauugcagcgug

SEQ ID NO: 364565 - RNA, 26 nt, Human
agcaagcagugguauuuaauauacaa

SEQ ID NO: 364566 - RNA, 24 nt, Human
agcacuuugggaggccgaggcggg

SEQ ID NO: 364567 - RNA, 18 nt, Human
agccauauuuaccaucau

SEQ ID NO: 364568 - RNA, 25 nt, Human
agccugggcaacaagagccaaacuc

SEQ ID NO: 364569 - RNA, 18 nt, Human
agcuggacagcagggaac

SEQ ID NO: 364570 - RNA, 22 nt, Human
aggcaggagaauugcuugaacc

SEQ ID NO: 364571 - RNA, 23 nt, Human
aggcaggagaauugcuugaaccg

SEQ ID NO: 364572 - RNA, 22 nt, Human
aggccaggcgcgguggcugacg

SEQ ID NO: 364573 - RNA, 23 nt, Human
aggccgaggcgggcagaucacga

SEQ ID NO: 364574 - RNA, 24 nt, Human
aggcgcgguggcugacgccuguaa

SEQ ID NO: 364575 - RNA, 24 nt, Human
aggcgggcagaucacgacuucagg

SEQ ID NO: 364576 - RNA, 21 nt, Human
aggcugaggcaggagaauugc

SEQ ID NO: 364577 - RNA, 24 nt, Human
aggcugaggcaggagaauugcuug

SEQ ID NO: 364578 - RNA, 22 nt, Human
aggcugggucgggugugaaggg

SEQ ID NO: 364579 - RNA, 19 nt, Human
agggaacaccccauucucc

SEQ ID NO: 364580 - RNA, 21 nt, Human
aggugaagguuguggugugcc

SEQ ID NO: 364581 - RNA, 24 nt, Human
aggugaagguuguggugugccgag

SEQ ID NO: 364582 - RNA, 21 nt, Human
aguaguacugcacuuuucuca

SEQ ID NO: 364583 - RNA, 26 nt, Human
auacuuggaacaccuuagccaucauu

SEQ ID NO: 364584 - RNA, 24 nt, Human
aucacgccauugcacaccagccug

SEQ ID NO: 364585 - RNA, 18 nt, Human
auucuuggaauuucccuu

SEQ ID NO: 364586 - RNA, 19 nt, Human
caagagauacaguaacuuc

SEQ ID NO: 364587 - RNA, 24 nt, Human
cacaccagccugggcaacaagagc

SEQ ID NO: 364588 - RNA, 18 nt, Human
caccccauucuccugccc

SEQ ID NO: 364589 - RNA, 21 nt, Human
caccccauucuccugccccca

SEQ ID NO: 364590 - RNA, 22 nt, Human
cacgacuucaggcugaggcagg

SEQ ID NO: 364591 - RNA, 21 nt, Human
cagaucacgacuucaggcuga

SEQ ID NO: 364592 - RNA, 24 nt, Human
cagcacuuugggaggccgaggcgg

SEQ ID NO: 364593 - RNA, 18 nt, Human
cagcagggaacaccccau

SEQ ID NO: 364594 - RNA, 18 nt, Human
cauaaaccacagaagaaa

SEQ ID NO: 364595 - RNA, 24 nt, Human
cauuagaaugucuaaucccucaag

SEQ ID NO: 364596 - RNA, 19 nt, Human
cauugcacaccagccuggg

SEQ ID NO: 364597 - RNA, 22 nt, Human
cauugcacaccagccugggcaa

SEQ ID NO: 364598 - RNA, 24 nt, Human
cauugcacaccagccugggcaaca

SEQ ID NO: 364599 - RNA, 26 nt, Human
cauuuagaaaacccucuggcuccagg

SEQ ID NO: 364600 - RNA, 25 nt, Human
ccaaggacaaacuuuagucucagau

SEQ ID NO: 364601 - RNA, 22 nt, Human
ccacaacccuucagaccuugac

SEQ ID NO: 364602 - RNA, 21 nt, Human
ccagccaggggguauccacaa

SEQ ID NO: 364603 - RNA, 23 nt, Human
ccagccugggcaacaagagccaa

SEQ ID NO: 364604 - RNA, 23 nt, Human
ccagggguccuucuacugccucc

SEQ ID NO: 364605 - RNA, 26 nt, Human
ccauucuccugcccccagcucuccua

SEQ ID NO: 364606 - RNA, 21 nt, Human
ccauugcacaccagccugggc

SEQ ID NO: 364607 - RNA, 22 nt, Human
ccauugcacaccagccugggca

SEQ ID NO: 364608 - RNA, 23 nt, Human
ccauugcacaccagccugggcaa

SEQ ID NO: 364609 - RNA, 24 nt, Human
ccauugcacaccagccugggcaac

SEQ ID NO: 364610 - RNA, 22 nt, Human
ccccagcucuccuauggaaucc

SEQ ID NO: 364611 - RNA, 21 nt, Human
ccccauucuccugcccccagc

SEQ ID NO: 364612 - RNA, 19 nt, Human
cccuucccacuccacucaa

SEQ ID NO: 364613 - RNA, 18 nt, Human
ccucuggcuccagggguc

SEQ ID NO: 364614 - RNA, 22 nt, Human
ccuguaaucccagcacuuuggg

SEQ ID NO: 364615 - RNA, 19 nt, Human
ccuuagacucaccaauaac

SEQ ID NO: 364616 - RNA, 24 nt, Human
cgaggcgggcagaucacgacuuca

SEQ ID NO: 364617 - RNA, 23 nt, Human
cgccuguaaucccagcacuuugg

SEQ ID NO: 364618 - RNA, 18 nt, Human
cucaaaaaaaaaaaaaag

SEQ ID NO: 364619 - RNA, 23 nt, Human
cucaaaaaaaaaaaaaagaaaaa

SEQ ID NO: 364620 - RNA, 21 nt, Human
cuccaugaagcccagccaggg

SEQ ID NO: 364621 - RNA, 22 nt, Human
cuccauguaauagaugucugca

SEQ ID NO: 364622 - RNA, 19 nt, Human
cuccugcccccagcucucc

SEQ ID NO: 364623 - RNA, 19 nt, Human
cucugucucaaaaaaaaaa

SEQ ID NO: 364624 - RNA, 26 nt, Human
cugaagcuacagugauuacaaaccug

SEQ ID NO: 364625 - RNA, 24 nt, Human
cugacgccuguaaucccagcacuu

SEQ ID NO: 364626 - RNA, 18 nt, Human
cugguuacagaaggccuc

SEQ ID NO: 364627 - RNA, 18 nt, Human
gaagcuggacagcaggga

SEQ ID NO: 364628 - RNA, 24 nt, Human
gaagguuguggugugccgagauca

SEQ ID NO: 364629 - RNA, 24 nt, Human
gacgccuguaaucccagcacuuug

SEQ ID NO: 364630 - RNA, 23 nt, Human
gagaauugcuugaaccggggagg

SEQ ID NO: 364631 - RNA, 23 nt, Human
gagaucacgccauugcacaccag

SEQ ID NO: 364632 - RNA, 22 nt, Human
gccauugcacaccagccugggc

SEQ ID NO: 364633 - RNA, 19 nt, Human
gcgcgguggcugacgccug

SEQ ID NO: 364634 - RNA, 19 nt, Human
ggaacaccuuagccaucau

SEQ ID NO: 364635 - RNA, 19 nt, Human
ggaacagugagcguaggag

SEQ ID NO: 364636 - RNA, 22 nt, Human
gggaacaccccauucuccugcc

SEQ ID NO: 364637 - RNA, 19 nt, Human
ggugaucagagaagauuuc

SEQ ID NO: 364638 - RNA, 23 nt, Human
gguggcugacgccuguaauccca

SEQ ID NO: 364639 - RNA, 24 nt, Human
gguggcugacgccuguaaucccag

SEQ ID NO: 364640 - RNA, 20 nt, Human
gucucaaaaaaaaaaaaaag

SEQ ID NO: 364641 - RNA, 23 nt, Human
guggcugacgccuguaaucccag

SEQ ID NO: 364642 - RNA, 19 nt, Human
uaaaccagauguggcgcua

SEQ ID NO: 364643 - RNA, 25 nt, Human
uaaauggccucuagaguaguuuucc

SEQ ID NO: 364644 - RNA, 19 nt, Human
uaagaucauucauaaacca

SEQ ID NO: 364645 - RNA, 22 nt, Human
uacaguaacuucugcauggucu

SEQ ID NO: 364646 - RNA, 25 nt, Human
uaggccaggcgcgguggcugacgcc

SEQ ID NO: 364647 - RNA, 23 nt, Human
uauacaaacucaucaaauuccac

SEQ ID NO: 364648 - RNA, 26 nt, Human
uaucugguuacagaaggccucucauu

SEQ ID NO: 364649 - RNA, 23 nt, Human
ucaaaaaaaaaaaaaagaaaaau

SEQ ID NO: 364650 - RNA, 23 nt, Human
ucacgccauugcacaccagccug

SEQ ID NO: 364651 - RNA, 21 nt, Human
uccaaagaaugagaauccugg

SEQ ID NO: 364652 - RNA, 19 nt, Human
ucccaaccuuugcccccag

SEQ ID NO: 364653 - RNA, 19 nt, Human
uccuaggucacccaguucc

SEQ ID NO: 364654 - RNA, 23 nt, Human
uccuauggaauccuaauucaagg

SEQ ID NO: 364655 - RNA, 19 nt, Human
ucgugcgccuaucccaacc

SEQ ID NO: 364656 - RNA, 21 nt, Human
ucugcagucacccgagcucau

SEQ ID NO: 364657 - RNA, 18 nt, Human
ucugcaucuuuugggcca

SEQ ID NO: 364658 - RNA, 22 nt, Human
ucugucucaaaaaaaaaaaaaa

SEQ ID NO: 364659 - RNA, 27 nt, Human
ucugucucaaaaaaaaaaaaaagaaaa

SEQ ID NO: 364660 - RNA, 24 nt, Human
ucugucucaaaaaaaaaaaaaagg

SEQ ID NO: 364661 - RNA, 18 nt, Human
ucuuuugggccagcagcc

SEQ ID NO: 364662 - RNA, 19 nt, Human
ugaaccggggaggugaagg

SEQ ID NO: 364663 - RNA, 21 nt, Human
ugagcugcagguguuuccaag

SEQ ID NO: 364664 - RNA, 24 nt, Human
ugaggcaggagaauugcuugaacc

SEQ ID NO: 364665 - RNA, 18 nt, Human
ugagucagggguagaaac

SEQ ID NO: 364666 - RNA, 24 nt, Human
ugauccaugcccauugugagcaag

SEQ ID NO: 364667 - RNA, 19 nt, Human
ugcacaccagccugggcaa

SEQ ID NO: 364668 - RNA, 22 nt, Human
uggccucuagaguaguuuuccu

SEQ ID NO: 364669 - RNA, 18 nt, Human
uggcuccagggguccuuc

SEQ ID NO: 364670 - RNA, 22 nt, Human
uggcugacgccuguaaucccag

SEQ ID NO: 364671 - RNA, 24 nt, Human
uggcugacgccuguaaucccagca

SEQ ID NO: 364672 - RNA, 19 nt, Human
ugggaggccgaggcgggca

SEQ ID NO: 364673 - RNA, 20 nt, Human
ugggaggccgaggcgggcag

SEQ ID NO: 364674 - RNA, 24 nt, Human
ugggaggccgaggcgggcagauca

SEQ ID NO: 364675 - RNA, 22 nt, Human
ugggauucacaguuuauugaaa

SEQ ID NO: 364676 - RNA, 19 nt, Human
ugggugagaacaugcugga

SEQ ID NO: 364677 - RNA, 18 nt, Human
uuaccuuaagaucauuca

SEQ ID NO: 364678 - RNA, 18 nt, Human
uugcuugaaccggggagg

SEQ ID NO: 364679 - RNA, 25 nt, Human
uugggaggccgaggcgggcagauca

SEQ ID NO: 364680 - RNA, 20 nt, Human
uuguggugugccgagaucac

SEQ ID NO: 364681 - RNA, 20 nt, Human
uuucaggcugcuuuuuaaau

SEQ ID NO: 364682 - RNA, 22 nt, Human
acacagaccacaggggggacac

SEQ ID NO: 364683 - RNA, 24 nt, Human
agaccaggcuacagagcucgaggg

SEQ ID NO: 364684 - RNA, 23 nt, Human
agaguggugggugccacccuguc

SEQ ID NO: 364685 - RNA, 18 nt, Human
augugagacaaagguagg

SEQ ID NO: 364686 - RNA, 19 nt, Human
cacagaacaugaaacacag

SEQ ID NO: 364687 - RNA, 19 nt, Human
cacagaccaggcuacagag

SEQ ID NO: 364688 - RNA, 22 nt, Human
cacgugacacagaacaugaaac

SEQ ID NO: 364689 - RNA, 21 nt, Human
cauccagccauggcugggcca

SEQ ID NO: 364690 - RNA, 22 nt, Human
cauccagccauggcugggccag

SEQ ID NO: 364691 - RNA, 18 nt, Human
ccagccauggcugggcca

SEQ ID NO: 364692 - RNA, 26 nt, Human
cccaggccacacgggcaccccgggag

SEQ ID NO: 364693 - RNA, 21 nt, Human
cccuguggcggcuucgggucc

SEQ ID NO: 364694 - RNA, 19 nt, Human
ccgguuuauucugccuugg

SEQ ID NO: 364695 - RNA, 18 nt, Human
cgggaggcggggcacagg

SEQ ID NO: 364696 - RNA, 20 nt, Human
cucgagggacgugggaaggg

SEQ ID NO: 364697 - RNA, 23 nt, Human
cucgguccgcgguggcggcggcg

SEQ ID NO: 364698 - RNA, 21 nt, Human
gaagcagggggcugcagcccc

SEQ ID NO: 364699 - RNA, 24 nt, Human
gccagggcaggguggaaggcaccg

SEQ ID NO: 364700 - RNA, 20 nt, Human
gccgaggcccggaggcagcu

SEQ ID NO: 364701 - RNA, 19 nt, Human
gcgguggcggcggcggccg

SEQ ID NO: 364702 - RNA, 20 nt, Human
ggagaagcagggggcugcag

SEQ ID NO: 364703 - RNA, 21 nt, Human
ggccacacgggcaccccggga

SEQ ID NO: 364704 - RNA, 18 nt, Human
gggcacagggucauaggc

SEQ ID NO: 364705 - RNA, 18 nt, Human
gggugguccugagagugg

SEQ ID NO: 364706 - RNA, 24 nt, Human
ggucauaggccagaugcacaucca

SEQ ID NO: 364707 - RNA, 21 nt, Human
gguccgcgguggcggcggcgg

SEQ ID NO: 364708 - RNA, 24 nt, Human
ggugaagccaggccgaggcccgga

SEQ ID NO: 364709 - RNA, 23 nt, Human
gugacacagaacaugaaacacag

SEQ ID NO: 364710 - RNA, 20 nt, Human
guggcggcggcggccgguua

SEQ ID NO: 364711 - RNA, 19 nt, Human
gugguccugagaguggugg

SEQ ID NO: 364712 - RNA, 23 nt, Human
uccgcgguggcggcggcggccuu

SEQ ID NO: 364713 - RNA, 21 nt, Human
uccggggcggagagagggccc

SEQ ID NO: 364714 - RNA, 19 nt, Human
ugcacagaccaggcuacag

SEQ ID NO: 364715 - RNA, 21 nt, Human
ugcggugaagccaggccgagg

SEQ ID NO: 364716 - RNA, 18 nt, Human
uggaaugcggugaagcca

SEQ ID NO: 364717 - RNA, 21 nt, Human
uggcgggagaagcagggggcu

SEQ ID NO: 364718 - RNA, 20 nt, Human
ugggaaggggccuuuuggca

SEQ ID NO: 364719 - RNA, 22 nt, Human
uggggcgguccccuugcggccu

SEQ ID NO: 364720 - RNA, 24 nt, Human
aaacuaaaacccagggggaggcca

SEQ ID NO: 364721 - RNA, 25 nt, Human
agaccaaguccuuuaccgcagagga

SEQ ID NO: 364722 - RNA, 23 nt, Human
agggaaauaaauagaggggucca

SEQ ID NO: 364723 - RNA, 18 nt, Human
agggccacaucucccucu

SEQ ID NO: 364724 - RNA, 20 nt, Human
aggggguagaacagaccaag

SEQ ID NO: 364725 - RNA, 20 nt, Human
aguccucaaugagggggagg

SEQ ID NO: 364726 - RNA, 22 nt, Human
caaggacagagaaaucacagga

SEQ ID NO: 364727 - RNA, 20 nt, Human
caccgcgcgcgcaacagagc

SEQ ID NO: 364728 - RNA, 23 nt, Human
cccuuugaccaucuugauggcuu

SEQ ID NO: 364729 - RNA, 24 nt, Human
ccugcaagaauagccaaggacaga

SEQ ID NO: 364730 - RNA, 20 nt, Human
cgcgcggccccgcucgcgcc

SEQ ID NO: 364731 - RNA, 21 nt, Human
cgcggccccgcucgcgcccaa

SEQ ID NO: 364732 - RNA, 20 nt, Human
cuccagcucucccucgugcc

SEQ ID NO: 364733 - RNA, 20 nt, Human
cucgcgcccaaggugacacc

SEQ ID NO: 364734 - RNA, 21 nt, Human
cugcuccucccuguccccuca

SEQ ID NO: 364735 - RNA, 24 nt, Human
cuucugcuccucccuguccccuca

SEQ ID NO: 364736 - RNA, 18 nt, Human
gcaagaauagccaaggac

SEQ ID NO: 364737 - RNA, 22 nt, Human
gcagcagagcccaggcccccag

SEQ ID NO: 364738 - RNA, 27 nt, Human
gcgcgcgcacgccccuccagcucuccc

SEQ ID NO: 364739 - RNA, 24 nt, Human
gcuccgggucccgugcgcgcgcgg

SEQ ID NO: 364740 - RNA, 19 nt, Human
ggaagaaaccacacugugg

SEQ ID NO: 364741 - RNA, 22 nt, Human
gggaggccagaaauccucagga

SEQ ID NO: 364742 - RNA, 21 nt, Human
uaaaacccagggggaggccag

SEQ ID NO: 364743 - RNA, 22 nt, Human
uaccgcagaggaagaaaccaca

SEQ ID NO: 364744 - RNA, 23 nt, Human
ucagcucugccuugguuucccca

SEQ ID NO: 364745 - RNA, 23 nt, Human
uccccucagcucugccuugguuu

SEQ ID NO: 364746 - RNA, 18 nt, Human
ucuucugcuguccugugu

SEQ ID NO: 364747 - RNA, 18 nt, Human
ugagggggaggaagggcc

SEQ ID NO: 364748 - RNA, 22 nt, Human
ugcccugaaacuaaaacccagg

SEQ ID NO: 364749 - RNA, 22 nt, Human
ugcuguccugugugcccugaaa

SEQ ID NO: 364750 - RNA, 19 nt, Human
uggugucaucaauccaauu

SEQ ID NO: 364751 - RNA, 26 nt, Human
uuuuuugcuggugucaucaauccaau

SEQ ID NO: 364752 - RNA, 20 nt, Human
uuuuuuuuuuuuuuuuugcu

SEQ ID NO: 364753 - RNA, 22 nt, Human
uuuuuuuuuuuuuuuuugcugg

SEQ ID NO: 364754 - RNA, 23 nt, Human
uuuuuuuuuuuuuuuuuugcugg

SEQ ID NO: 364755 - RNA, 27 nt, Human
uuuuuuuuuuuuuuuuuuuuuuugggg

SEQ ID NO: 364756 - RNA, 20 nt, Human
aaggaaagcaaaacuaagcc

SEQ ID NO: 364757 - RNA, 21 nt, Human
acagggcugcucuccuaggcc

SEQ ID NO: 364758 - RNA, 23 nt, Human
aguaucacuuauucagugguagc

SEQ ID NO: 364759 - RNA, 24 nt, Human
aguauccuuuacucuuuugaaagc

SEQ ID NO: 364760 - RNA, 25 nt, Human
caagucauuagccugguccucuggc

SEQ ID NO: 364761 - RNA, 19 nt, Human
caaucacuguaagugcaag

SEQ ID NO: 364762 - RNA, 20 nt, Human
cacucagaaccgcauuacau

SEQ ID NO: 364763 - RNA, 21 nt, Human
cagaaagaagaguuugacucc

SEQ ID NO: 364764 - RNA, 23 nt, Human
cauacagaaagaagaguuugacu

SEQ ID NO: 364765 - RNA, 21 nt, Human
caucagcacacacaagucauu

SEQ ID NO: 364766 - RNA, 19 nt, Human
cauuacagggcugcucucc

SEQ ID NO: 364767 - RNA, 22 nt, Human
ccuuuuuauuccagaauggaaa

SEQ ID NO: 364768 - RNA, 21 nt, Human
cguugugguuuuuucccuggg

SEQ ID NO: 364769 - RNA, 18 nt, Human
gacuaaagcuugaaacag

SEQ ID NO: 364770 - RNA, 18 nt, Human
gaggagggucuacacaca

SEQ ID NO: 364771 - RNA, 18 nt, Human
gcuuggccuuugccuuac

SEQ ID NO: 364772 - RNA, 22 nt, Human
guauauguauaugucauacaga

SEQ ID NO: 364773 - RNA, 23 nt, Human
uacacacauuaaauacaaaugga

SEQ ID NO: 364774 - RNA, 19 nt, Human
uauauguauaugucauaca

SEQ ID NO: 364775 - RNA, 18 nt, Human
uaucacuuauucaguggu

SEQ ID NO: 364776 - RNA, 25 nt, Human
uauuuccauaagucaccaauaagag

SEQ ID NO: 364777 - RNA, 23 nt, Human
ucaaaacauucuguacauuucaa

SEQ ID NO: 364778 - RNA, 23 nt, Human
uccacuggcaugcaucuuuccaa

SEQ ID NO: 364779 - RNA, 24 nt, Human
uccagaauggaaaacaaacuagga

SEQ ID NO: 364780 - RNA, 18 nt, Human
ucccugggcaaaugauua

SEQ ID NO: 364781 - RNA, 18 nt, Human
uccucuggcauccacugg

SEQ ID NO: 364782 - RNA, 20 nt, Human
ugccaagaugucucuguaca

SEQ ID NO: 364783 - RNA, 24 nt, Human
ugccaaggcuuacaaaaacauuuc

SEQ ID NO: 364784 - RNA, 18 nt, Human
uggauacauuacagggcu

SEQ ID NO: 364785 - RNA, 21 nt, Human
uggugugcauuuuauuuuuga

SEQ ID NO: 364786 - RNA, 21 nt, Human
ugucaaaggaaagcaaaacua

SEQ ID NO: 364787 - RNA, 19 nt, Human
uuccagaauggaaaacaaa

SEQ ID NO: 364788 - RNA, 19 nt, Human
uugacuggaaucauaucca

SEQ ID NO: 364789 - RNA, 20 nt, Human
uugauugaugaacagaggag

SEQ ID NO: 364790 - RNA, 24 nt, Human
uuuuuuuuuuuuuuuacauuuugg

SEQ ID NO: 364791 - RNA, 18 nt, Human
aaaaaagccuggacuuga

SEQ ID NO: 364792 - RNA, 20 nt, Human
aaaaagacagcacuauccca

SEQ ID NO: 364793 - RNA, 21 nt, Human
aaaaagacagcacuaucccag

SEQ ID NO: 364794 - RNA, 25 nt, Human
aaacaaagguuucugggcagagggc

SEQ ID NO: 364795 - RNA, 29 nt, Human
aaacaagagauggacguaaaagggacccc

SEQ ID NO: 364796 - RNA, 18 nt, Human
aaacacccagaaaaugaa

SEQ ID NO: 364797 - RNA, 25 nt, Human
aaagccuggacuugaauuuaaacaa

SEQ ID NO: 364798 - RNA, 20 nt, Human
aaagguuucugggcagaggg

SEQ ID NO: 364799 - RNA, 22 nt, Human
aaaguacuucccuaaaguacaa

SEQ ID NO: 364800 - RNA, 21 nt, Human
aacauguuucacauaaaagcu

SEQ ID NO: 364801 - RNA, 20 nt, Human
acaaaaagacagcacuaucc

SEQ ID NO: 364802 - RNA, 18 nt, Human
agacagaauuugugcaug

SEQ ID NO: 364803 - RNA, 22 nt, Human
agagauggacguaaaagggaug

SEQ ID NO: 364804 - RNA, 20 nt, Human
agggauguucuuuacugcag

SEQ ID NO: 364805 - RNA, 24 nt, Human
aucauguuaguguugaccaaaucc

SEQ ID NO: 364806 - RNA, 21 nt, Human
augaagcauugcuucauuccc

SEQ ID NO: 364807 - RNA, 19 nt, Human
caaggcaacaugaauuaaa

SEQ ID NO: 364808 - RNA, 25 nt, Human
ccuaaaguacaaaggcauuucccua

SEQ ID NO: 364809 - RNA, 22 nt, Human
cgaaacacugcucugagcacca

SEQ ID NO: 364810 - RNA, 22 nt, Human
cggcggcggcgucggugggggc

SEQ ID NO: 364811 - RNA, 18 nt, Human
cggcucacuucuaguccc

SEQ ID NO: 364812 - RNA, 21 nt, Human
cggcucacuucuagucccggc

SEQ ID NO: 364813 - RNA, 19 nt, Human
cugagcaccaugauugccu

SEQ ID NO: 364814 - RNA, 23 nt, Human
cuggcuggcguuugggacccggg

SEQ ID NO: 364815 - RNA, 20 nt, Human
gcaaggcaacaugaauuaaa

SEQ ID NO: 364816 - RNA, 19 nt, Human
gcggcucacuucuaguccc

SEQ ID NO: 364817 - RNA, 22 nt, Human
ggcguuugggacccgggcggcu

SEQ ID NO: 364818 - RNA, 20 nt, Human
ggcucacuucuagucccggc

SEQ ID NO: 364819 - RNA, 21 nt, Human
guucaaggaggggaguacuaa

SEQ ID NO: 364820 - RNA, 22 nt, Human
uaaaaugccaaaaguacuuccc

SEQ ID NO: 364821 - RNA, 19 nt, Human
uaaauaugcaccuaguuuc

SEQ ID NO: 364822 - RNA, 24 nt, Human
uaauccagagacagaauuugugca

SEQ ID NO: 364823 - RNA, 25 nt, Human
uacccacaaaaagacagcacuaucc

SEQ ID NO: 364824 - RNA, 25 nt, Human
uccccaaaucauguuaguguugacc

SEQ ID NO: 364825 - RNA, 24 nt, Human
ucugguuaagaaaacacccagaaa

SEQ ID NO: 364826 - RNA, 22 nt, Human
ucuuuacugcaguacccacaaa

SEQ ID NO: 364827 - RNA, 23 nt, Human
ugaagcauugcuucauucccagg

SEQ ID NO: 364828 - RNA, 18 nt, Human
ugacuggcuggcuggcgu

SEQ ID NO: 364829 - RNA, 24 nt, Human
ugaucugguuaagaaaacacccag

SEQ ID NO: 364830 - RNA, 19 nt, Human
uggcuggcuggcguuuggg

SEQ ID NO: 364831 - RNA, 21 nt, Human
ugggacuacaauccuaguuca

SEQ ID NO: 364832 - RNA, 23 nt, Human
ugggggcggcgauacggccaggc

SEQ ID NO: 364833 - RNA, 21 nt, Human
ugguuaagaaaacacccagaa

SEQ ID NO: 364834 - RNA, 24 nt, Human
ugugcaugcuuacaauuugaagcc

SEQ ID NO: 364835 - RNA, 23 nt, Human
uuaaaacacacacgaaacacugc

SEQ ID NO: 364836 - RNA, 22 nt, Human
uucacaugauaaaaaagccugg

SEQ ID NO: 364837 - RNA, 19 nt, Human
uuuuuuuuuuuuucacuuu

SEQ ID NO: 364838 - RNA, 23 nt, Human
uuuuuuuuuuuuuuucacuuuaa

SEQ ID NO: 364839 - RNA, 26 nt, Human
aacacaaacauagaaauaacuuugaa

SEQ ID NO: 364840 - RNA, 22 nt, Human
aaccaccccacuguucuuccau

SEQ ID NO: 364841 - RNA, 19 nt, Human
aacuuugaaccaccccacu

SEQ ID NO: 364842 - RNA, 23 nt, Human
acauugucaaaauacauuagaac

SEQ ID NO: 364843 - RNA, 18 nt, Human
accccacuguucuuccau

SEQ ID NO: 364844 - RNA, 19 nt, Human
accccacuguucuuccauc

SEQ ID NO: 364845 - RNA, 19 nt, Human
agaaaggcuggcagggcug

SEQ ID NO: 364846 - RNA, 22 nt, Human
agaaaggcuggcagggcugggc

SEQ ID NO: 364847 - RNA, 21 nt, Human
aggcggccucccagggggguc

SEQ ID NO: 364848 - RNA, 19 nt, Human
ccacuguucuuccaucagg

SEQ ID NO: 364849 - RNA, 19 nt, Human
ccagaagagugaaagacag

SEQ ID NO: 364850 - RNA, 26 nt, Human
ccagagucucaauguuaacacuuucu

SEQ ID NO: 364851 - RNA, 21 nt, Human
cggggaaaaguuaacauggua

SEQ ID NO: 364852 - RNA, 19 nt, Human
cuggggccagagucucaau

SEQ ID NO: 364853 - RNA, 21 nt, Human
cuugccaguuccucagcuguc

SEQ ID NO: 364854 - RNA, 23 nt, Human
gaagauaccaaucuggggccaga

SEQ ID NO: 364855 - RNA, 22 nt, Human
gccuucugcucuagcccaaguc

SEQ ID NO: 364856 - RNA, 18 nt, Human
ggaguagaaaggcuggca

SEQ ID NO: 364857 - RNA, 24 nt, Human
uaacacauauagcaauaaccaccc

SEQ ID NO: 364858 - RNA, 21 nt, Human
uagaagauaccaaucuggggc

SEQ ID NO: 364859 - RNA, 18 nt, Human
uagcaauaaccacccugg

SEQ ID NO: 364860 - RNA, 21 nt, Human
ucaaaauacauuagaacacgg

SEQ ID NO: 364861 - RNA, 20 nt, Human
ucacccaucaguauccaucu

SEQ ID NO: 364862 - RNA, 20 nt, Human
ugaaccaccccacuguucuu

SEQ ID NO: 364863 - RNA, 24 nt, Human
ugccuucugcucuagcccaagucu

SEQ ID NO: 364864 - RNA, 19 nt, Human
uggagagaagggaggcgcc

SEQ ID NO: 364865 - RNA, 24 nt, Human
uggcagggcugggcucacauauaa

SEQ ID NO: 364866 - RNA, 24 nt, Human
uggcagggcugggcucacauauag

SEQ ID NO: 364867 - RNA, 21 nt, Human
ugucagagcgagcucguggag

SEQ ID NO: 364868 - RNA, 28 nt, Human
uuaacaugguaacacaaacauagaaaua

SEQ ID NO: 364869 - RNA, 19 nt, Human
uuagaacacgggaaaaggg

SEQ ID NO: 364870 - RNA, 19 nt, Human
uugccaguuccucagcugu

SEQ ID NO: 364871 - RNA, 20 nt, Human
uugccaguuccucagcuguc

SEQ ID NO: 364872 - RNA, 25 nt, Human
uuuucaaugucacccaucaguaucc

SEQ ID NO: 364873 - RNA, 25 nt, Human
aaaaagcaaauggaagaccagccau

SEQ ID NO: 364874 - RNA, 21 nt, Human
aaaaagcuuaaggaaccugga

SEQ ID NO: 364875 - RNA, 24 nt, Human
aaaaugaugaggcuaacuuaagua

SEQ ID NO: 364876 - RNA, 22 nt, Human
aaagcaccacucaguagcuacu

SEQ ID NO: 364877 - RNA, 27 nt, Human
aaauaaacaagguaccaaacuguauuu

SEQ ID NO: 364878 - RNA, 22 nt, Human
aagaaaucagaauaacuucaca

SEQ ID NO: 364879 - RNA, 25 nt, Human
aagacaaaaagcaaaauucccaaga

SEQ ID NO: 364880 - RNA, 18 nt, Human
aagcaaacagaaugaaua

SEQ ID NO: 364881 - RNA, 18 nt, Human
aagcaaccauuuauaagc

SEQ ID NO: 364882 - RNA, 21 nt, Human
aauagcuccauggcacaagag

SEQ ID NO: 364883 - RNA, 18 nt, Human
accauauggccaaagaac

SEQ ID NO: 364884 - RNA, 18 nt, Human
agaaaagcaaaguagaaa

SEQ ID NO: 364885 - RNA, 19 nt, Human
agacaaaaagcaaaauucc

SEQ ID NO: 364886 - RNA, 24 nt, Human
agcgauucuccugccucagccucc

SEQ ID NO: 364887 - RNA, 20 nt, Human
agggaagacaaaaagcaaaa

SEQ ID NO: 364888 - RNA, 23 nt, Human
aguagcugggacuacaggcacgu

SEQ ID NO: 364889 - RNA, 21 nt, Human
agugcaguggcacaauuucag

SEQ ID NO: 364890 - RNA, 21 nt, Human
augacagggaucuccucccca

SEQ ID NO: 364891 - RNA, 24 nt, Human
augguuuucacuuaaagaaaaagc

SEQ ID NO: 364892 - RNA, 23 nt, Human
caaaaagcaaaauucccaagaaa

SEQ ID NO: 364893 - RNA, 18 nt, Human
caaaauagagguucuucc

SEQ ID NO: 364894 - RNA, 23 nt, Human
caaauggaagaccagccauaaua

SEQ ID NO: 364895 - RNA, 20 nt, Human
caagcgauucuccugccuca

SEQ ID NO: 364896 - RNA, 22 nt, Human
caagcgauucuccugccucagc

SEQ ID NO: 364897 - RNA, 18 nt, Human
cacaaaaugaugaggcua

SEQ ID NO: 364898 - RNA, 20 nt, Human
cacugagcaggggacugugg

SEQ ID NO: 364899 - RNA, 21 nt, Human
cacugcaacuucugccucccg

SEQ ID NO: 364900 - RNA, 23 nt, Human
cacugcaacuucugccucccggg

SEQ ID NO: 364901 - RNA, 24 nt, Human
cacuggucuuguacuccaagaaac

SEQ ID NO: 364902 - RNA, 19 nt, Human
cagaaacacauacauggua

SEQ ID NO: 364903 - RNA, 19 nt, Human
cagaacuauauuccaccuu

SEQ ID NO: 364904 - RNA, 19 nt, Human
cagcaaaaagcuuaaggaa

SEQ ID NO: 364905 - RNA, 22 nt, Human
cagcaaaaagcuuaaggaaccu

SEQ ID NO: 364906 - RNA, 20 nt, Human
cagccuccugaguagcuggg

SEQ ID NO: 364907 - RNA, 20 nt, Human
cagcucaggcuccgccgccc

SEQ ID NO: 364908 - RNA, 20 nt, Human
caucuucaugagaaaugauc

SEQ ID NO: 364909 - RNA, 22 nt, Human
ccacugaaauuucuuuagacac

SEQ ID NO: 364910 - RNA, 20 nt, Human
ccagucccauuucuauuuua

SEQ ID NO: 364911 - RNA, 27 nt, Human
cccaagaaaucagaauaacuucacacu

SEQ ID NO: 364912 - RNA, 23 nt, Human
cccagucuggagugcaguggcac

SEQ ID NO: 364913 - RNA, 21 nt, Human
cccgccgcgccggcguggccg

SEQ ID NO: 364914 - RNA, 23 nt, Human
cccgccgcgccggcguggccgcg

SEQ ID NO: 364915 - RNA, 20 nt, Human
cccggguucaagcgauucuc

SEQ ID NO: 364916 - RNA, 23 nt, Human
cccggguucaagcgauucuccug

SEQ ID NO: 364917 - RNA, 20 nt, Human
cccucuggcuucuggcucug

SEQ ID NO: 364918 - RNA, 19 nt, Human
ccgcccgcucucggcuccg

SEQ ID NO: 364919 - RNA, 23 nt, Human
ccgccgcccgcucucggcuccgg

SEQ ID NO: 364920 - RNA, 23 nt, Human
ccucaaacaccugugcuuggcuc

SEQ ID NO: 364921 - RNA, 24 nt, Human
ccucccggguucaagcgauucucc

SEQ ID NO: 364922 - RNA, 23 nt, Human
ccugaguagcugggacuacaggc

SEQ ID NO: 364923 - RNA, 24 nt, Human
ccugaguagcugggacuacaggca

SEQ ID NO: 364924 - RNA, 23 nt, Human
ccugccucagccuccugaguagc

SEQ ID NO: 364925 - RNA, 18 nt, Human
cgggucgccggcuguggc

SEQ ID NO: 364926 - RNA, 24 nt, Human
cucagccuccugaguagcugggac

SEQ ID NO: 364927 - RNA, 20 nt, Human
cucauaucccuggcccucug

SEQ ID NO: 364928 - RNA, 23 nt, Human
cugcaacuucugccucccggguu

SEQ ID NO: 364929 - RNA, 24 nt, Human
cugcaacuucugccucccggguuc

SEQ ID NO: 364930 - RNA, 23 nt, Human
cugccucagccuccugaguagcu

SEQ ID NO: 364931 - RNA, 23 nt, Human
cugcuggucuuguggaaggcagc

SEQ ID NO: 364932 - RNA, 26 nt, Human
cuggcccucuggcuucuggcucugug

SEQ ID NO: 364933 - RNA, 22 nt, Human
cuucacacuggucuuguacucc

SEQ ID NO: 364934 - RNA, 25 nt, Human
cuuuuuuuuuuugagaugaagucuc

SEQ ID NO: 364935 - RNA, 23 nt, Human
gaaaucagaauaacuucacacug

SEQ ID NO: 364936 - RNA, 20 nt, Human
gaguagcugggacuacaggc

SEQ ID NO: 364937 - RNA, 25 nt, Human
gaguagcugggacuacaggcacgug

SEQ ID NO: 364938 - RNA, 19 nt, Human
gaugcaaaauagagguucu

SEQ ID NO: 364939 - RNA, 21 nt, Human
gccaccacuuagaaaaguaca

SEQ ID NO: 364940 - RNA, 22 nt, Human
gcccucuggcuucuggcucugu

SEQ ID NO: 364941 - RNA, 24 nt, Human
gcgauucuccugccucagccuccu

SEQ ID NO: 364942 - RNA, 24 nt, Human
ggcccucuggcuucuggcucugug

SEQ ID NO: 364943 - RNA, 18 nt, Human
ggcguggccgcguccagc

SEQ ID NO: 364944 - RNA, 21 nt, Human
ggcguggccgcguccagcuca

SEQ ID NO: 364945 - RNA, 18 nt, Human
gggaagacaaaaagcaaa

SEQ ID NO: 364946 - RNA, 21 nt, Human
gggggaucagaugaagugugg

SEQ ID NO: 364947 - RNA, 19 nt, Human
gguagaagggaagacaaaa

SEQ ID NO: 364948 - RNA, 24 nt, Human
gucuuguacuccaagaaacccuga

SEQ ID NO: 364949 - RNA, 23 nt, Human
guugguuggucagugaauuuuug

SEQ ID NO: 364950 - RNA, 20 nt, Human
guuuacguaaaagcccugac

SEQ ID NO: 364951 - RNA, 20 nt, Human
uaagcaaccauuuauaagca

SEQ ID NO: 364952 - RNA, 21 nt, Human
uaagcagacccuacaucuaga

SEQ ID NO: 364953 - RNA, 19 nt, Human
uauaccauauggccaaaga

SEQ ID NO: 364954 - RNA, 22 nt, Human
ucaaacaccugugcuuggcuca

SEQ ID NO: 364955 - RNA, 23 nt, Human
ucacugcaacuucugccucccgg

SEQ ID NO: 364956 - RNA, 24 nt, Human
ucacugcaacuucugccucccggg

SEQ ID NO: 364957 - RNA, 25 nt, Human
ucacugcaacuucugccucccgggu

SEQ ID NO: 364958 - RNA, 23 nt, Human
ucagccuccugaguagcugggac

SEQ ID NO: 364959 - RNA, 22 nt, Human
ucccaaccuaaguuuccguucc

SEQ ID NO: 364960 - RNA, 22 nt, Human
ucccgccgcgccggcguggccg

SEQ ID NO: 364961 - RNA, 21 nt, Human
ucccggguucaagcgauucuc

SEQ ID NO: 364962 - RNA, 24 nt, Human
ucccggguucaagcgauucuccug

SEQ ID NO: 364963 - RNA, 23 nt, Human
ucccucaacacauaacuguccaa

SEQ ID NO: 364964 - RNA, 21 nt, Human
ucccuggcccucuggcuucug

SEQ ID NO: 364965 - RNA, 24 nt, Human
uccugaguagcugggacuacaggc

SEQ ID NO: 364966 - RNA, 20 nt, Human
ucucccaaccuaaguuuccg

SEQ ID NO: 364967 - RNA, 24 nt, Human
ucuccugccucagccuccugagua

SEQ ID NO: 364968 - RNA, 24 nt, Human
ucucgcugugucacccagucugga

SEQ ID NO: 364969 - RNA, 21 nt, Human
ucugaagcaguuuacuuccug

SEQ ID NO: 364970 - RNA, 23 nt, Human
ucuucaugagaaaugaucaccuc

SEQ ID NO: 364971 - RNA, 24 nt, Human
ugaaauaaacaagguaccaaacug

SEQ ID NO: 364972 - RNA, 22 nt, Human
ugaaauagcacaaacuguacuc

SEQ ID NO: 364973 - RNA, 19 nt, Human
ugacaggcaccacauaucc

SEQ ID NO: 364974 - RNA, 19 nt, Human
ugaccauuuaaguauggag

SEQ ID NO: 364975 - RNA, 18 nt, Human
ugacuucuuuccggacac

SEQ ID NO: 364976 - RNA, 22 nt, Human
ugagaaaugaucaccucugggu

SEQ ID NO: 364977 - RNA, 26 nt, Human
ugagaugaacuguaguccucaaacac

SEQ ID NO: 364978 - RNA, 22 nt, Human
ugcaguggcacaauuucaguuc

SEQ ID NO: 364979 - RNA, 20 nt, Human
ugccacagaggauucaugga

SEQ ID NO: 364980 - RNA, 24 nt, Human
ugccucagccuccugaguagcugg

SEQ ID NO: 364981 - RNA, 22 nt, Human
ugccuggaguacagauaugaaa

SEQ ID NO: 364982 - RNA, 21 nt, Human
uggaaggcagcucucuggagc

SEQ ID NO: 364983 - RNA, 20 nt, Human
uggacagaaaugauaugaug

SEQ ID NO: 364984 - RNA, 22 nt, Human
uggacagcaaaaagcuuaagga

SEQ ID NO: 364985 - RNA, 18 nt, Human
uggagugcaguggcacaa

SEQ ID NO: 364986 - RNA, 23 nt, Human
uggagugcaguggcacaauuuca

SEQ ID NO: 364987 - RNA, 24 nt, Human
uggagugcaguggcacaauuucag

SEQ ID NO: 364988 - RNA, 20 nt, Human
uggcacaauuucaguucacu

SEQ ID NO: 364989 - RNA, 24 nt, Human
uggcacaauuucaguucacugcaa

SEQ ID NO: 364990 - RNA, 22 nt, Human
uggcccucuggcuucuggcucu

SEQ ID NO: 364991 - RNA, 21 nt, Human
ugggacuacaggcacgugcca

SEQ ID NO: 364992 - RNA, 22 nt, Human
ugggacuacaggcacgugccac

SEQ ID NO: 364993 - RNA, 24 nt, Human
ugggacuacaggcacgugccacca

SEQ ID NO: 364994 - RNA, 22 nt, Human
ugguauggacuauuauuaaaau

SEQ ID NO: 364995 - RNA, 20 nt, Human
ugugcuuggcucaggcccac

SEQ ID NO: 364996 - RNA, 24 nt, Human
ugugucacccagucuggagugcag

SEQ ID NO: 364997 - RNA, 21 nt, Human
uucaagcgauucuccugccuc

SEQ ID NO: 364998 - RNA, 23 nt, Human
uucaagcgauucuccugccucag

SEQ ID NO: 364999 - RNA, 24 nt, Human
uucaagcgauucuccugccucagc

SEQ ID NO: 365000 - RNA, 19 nt, Human
uugaauuaggugcauaagg

SEQ ID NO: 365001 - RNA, 20 nt, Human
uuggucagugaauuuuuggu

SEQ ID NO: 365002 - RNA, 26 nt, Human
uuuuaccaagagcaagagcggucacu

SEQ ID NO: 365003 - RNA, 24 nt, Human
aaaacaccaacacugagacauaca

SEQ ID NO: 365004 - RNA, 18 nt, Human
acaaaaauaaagucaugc

SEQ ID NO: 365005 - RNA, 23 nt, Human
acccagccacacuuuucccacag

SEQ ID NO: 365006 - RNA, 24 nt, Human
accccaaaauccaaccagccagca

SEQ ID NO: 365007 - RNA, 20 nt, Human
agcaaaauaguccauuucuc

SEQ ID NO: 365008 - RNA, 22 nt, Human
agccacacuuuucccacagaug

SEQ ID NO: 365009 - RNA, 24 nt, Human
aggaaaggagcaccggagcucagg

SEQ ID NO: 365010 - RNA, 21 nt, Human
agggcuuguaagaauggacac

SEQ ID NO: 365011 - RNA, 22 nt, Human
caaaauccaaccagccagcaug

SEQ ID NO: 365012 - RNA, 24 nt, Human
caaacacuaaugaauaagugacau

SEQ ID NO: 365013 - RNA, 21 nt, Human
caccccaaaauccaaccagcc

SEQ ID NO: 365014 - RNA, 20 nt, Human
caccucuccuuaagcaggga

SEQ ID NO: 365015 - RNA, 22 nt, Human
cauuaguccaacugccacccca

SEQ ID NO: 365016 - RNA, 21 nt, Human
ccaaaauccaaccagccagca

SEQ ID NO: 365017 - RNA, 21 nt, Human
ccaaccagccagcaugacaau

SEQ ID NO: 365018 - RNA, 20 nt, Human
cccacagaugccgcagccag

SEQ ID NO: 365019 - RNA, 18 nt, Human
cccagccacacuuuuccc

SEQ ID NO: 365020 - RNA, 22 nt, Human
cccagccacacuuuucccacag

SEQ ID NO: 365021 - RNA, 21 nt, Human
cucauauccaaaaaagacacc

SEQ ID NO: 365022 - RNA, 19 nt, Human
gacugaccagggcuuguaa

SEQ ID NO: 365023 - RNA, 19 nt, Human
gagccagagucaagggaga

SEQ ID NO: 365024 - RNA, 20 nt, Human
gaugcuuuucaagccaauga

SEQ ID NO: 365025 - RNA, 22 nt, Human
gggaaaaaaaagcccaacaaaa

SEQ ID NO: 365026 - RNA, 23 nt, Human
uagaaaacauuacacaugagagc

SEQ ID NO: 365027 - RNA, 20 nt, Human
uccaaaaaagacaccucucc

SEQ ID NO: 365028 - RNA, 19 nt, Human
uccaaccagccagcaugac

SEQ ID NO: 365029 - RNA, 20 nt, Human
ucccacagaugccgcagcca

SEQ ID NO: 365030 - RNA, 21 nt, Human
ucccugugcacccuuggaugc

SEQ ID NO: 365031 - RNA, 25 nt, Human
ucuccuuaagcagggaaaaaaaagc

SEQ ID NO: 365032 - RNA, 26 nt, Human
ucucuuaagaaaaccaauaaacacuc

SEQ ID NO: 365033 - RNA, 19 nt, Human
ugccaccccaaaauccaac

SEQ ID NO: 365034 - RNA, 18 nt, Human
ugcccguggacaagcccu

SEQ ID NO: 365035 - RNA, 21 nt, Human
uggacaagcccuaauguuagu

SEQ ID NO: 365036 - RNA, 27 nt, Human
uggaugcuuuucaagccaaugagggua

SEQ ID NO: 365037 - RNA, 20 nt, Human
uggugcaggagccagaguca

SEQ ID NO: 365038 - RNA, 19 nt, Human
uucacauuaguccaacugc

SEQ ID NO: 365039 - RNA, 18 nt, Human
uuugggugaacaauuuuc

SEQ ID NO: 365040 - RNA, 19 nt, Human
uuuuuuuuuuuuuuuuugu

SEQ ID NO: 365041 - RNA, 27 nt, Human
uuuuuuuuuuuuuuuuuuuuuuugggg

SEQ ID NO: 365042 - RNA, 19 nt, Human
aaaaagcaucccuuccagg

SEQ ID NO: 365043 - RNA, 18 nt, Human
aacuuccugcuccuucuc

SEQ ID NO: 365044 - RNA, 22 nt, Human
aaucuuccuuccuucaggaggc

SEQ ID NO: 365045 - RNA, 18 nt, Human
accacguccugcauuccc

SEQ ID NO: 365046 - RNA, 19 nt, Human
agauguacuuuuuuucacg

SEQ ID NO: 365047 - RNA, 20 nt, Human
agccccauccagaccaggaa

SEQ ID NO: 365048 - RNA, 23 nt, Human
agcuaaaaagcaucccuuccagg

SEQ ID NO: 365049 - RNA, 18 nt, Human
aggcagggcugauaggug

SEQ ID NO: 365050 - RNA, 23 nt, Human
cacacaauguccaucaguaucaa

SEQ ID NO: 365051 - RNA, 21 nt, Human
cagcagccccauccagaccag

SEQ ID NO: 365052 - RNA, 19 nt, Human
cagcuaaaaagcaucccuu

SEQ ID NO: 365053 - RNA, 21 nt, Human
cagggaagaccugggguccuu

SEQ ID NO: 365054 - RNA, 24 nt, Human
ccucuggcccacacaauguccauc

SEQ ID NO: 365055 - RNA, 23 nt, Human
ccugccucuggcccacacaaugu

SEQ ID NO: 365056 - RNA, 18 nt, Human
ccuuugcagugugggcug

SEQ ID NO: 365057 - RNA, 23 nt, Human
cucugcacucaagcagcagcccc

SEQ ID NO: 365058 - RNA, 18 nt, Human
cuggguggguucaaggcu

SEQ ID NO: 365059 - RNA, 21 nt, Human
cuggucagaggagaaacagca

SEQ ID NO: 365060 - RNA, 20 nt, Human
cuuccugcuccuucucacug

SEQ ID NO: 365061 - RNA, 23 nt, Human
cuucucacugugucguuggcuca

SEQ ID NO: 365062 - RNA, 25 nt, Human
gcccuggaccuucuggugguguccc

SEQ ID NO: 365063 - RNA, 22 nt, Human
ggaaaaacaggccaaguguagg

SEQ ID NO: 365064 - RNA, 20 nt, Human
guguucuguucuccuggcaa

SEQ ID NO: 365065 - RNA, 22 nt, Human
uaaaaagcaucccuuccaggaa

SEQ ID NO: 365066 - RNA, 18 nt, Human
ucagcuaaaaagcauccc

SEQ ID NO: 365067 - RNA, 23 nt, Human
ucaguggagacugaaucuuccuu

SEQ ID NO: 365068 - RNA, 22 nt, Human
uccaggagauguacuuuuuuuc

SEQ ID NO: 365069 - RNA, 21 nt, Human
uccagggaagaccuggggucc

SEQ ID NO: 365070 - RNA, 26 nt, Human
ucuccuggcaggcagggcugauaggu

SEQ ID NO: 365071 - RNA, 24 nt, Human
ucucucauggggagagcccuggac

SEQ ID NO: 365072 - RNA, 18 nt, Human
uggaaaaacaggccaagu

SEQ ID NO: 365073 - RNA, 21 nt, Human
uggaaaaacaggccaagugua

SEQ ID NO: 365074 - RNA, 24 nt, Human
uggagacugaaucuuccuuccuuc

SEQ ID NO: 365075 - RNA, 21 nt, Human
uggccugcagggaagggccag

SEQ ID NO: 365076 - RNA, 22 nt, Human
uguucuguucuccuggcaggca

SEQ ID NO: 365077 - RNA, 18 nt, Human
uucugguggugucccagc

SEQ ID NO: 365078 - RNA, 18 nt, Human
uuuuuuuuuuuguguguu

SEQ ID NO: 365079 - RNA, 18 nt, Human
uuuuuuuuuuuuuuuuug

SEQ ID NO: 365080 - RNA, 19 nt, Human
uuuuuuuuuuuuuuuuugu

SEQ ID NO: 365081 - RNA, 21 nt, Human
aacucuugccuuaagcaagag

SEQ ID NO: 365082 - RNA, 20 nt, Human
acucuugccuuaagcaagag

SEQ ID NO: 365083 - RNA, 23 nt, Human
acucuugccuuaagcaagaguug

SEQ ID NO: 365084 - RNA, 20 nt, Human
caacaagcagauucagucca

SEQ ID NO: 365085 - RNA, 20 nt, Human
caagaguacuacaguaauua

SEQ ID NO: 365086 - RNA, 21 nt, Human
caagaguacuacaguaauuau

SEQ ID NO: 365087 - RNA, 19 nt, Human
cacacaaccacucccuugg

SEQ ID NO: 365088 - RNA, 20 nt, Human
cucuugccuuaagcaagagu

SEQ ID NO: 365089 - RNA, 20 nt, Human
uacacugucaaauauauaaa

SEQ ID NO: 365090 - RNA, 19 nt, Human
uaucaggaauagacaauuu

SEQ ID NO: 365091 - RNA, 18 nt, Human
ucaguccacauuugcuuu

SEQ ID NO: 365092 - RNA, 21 nt, Human
ugaucaacaagcagauucagu

SEQ ID NO: 365093 - RNA, 22 nt, Human
ugccuuaagcaagaguacuaca

SEQ ID NO: 365094 - RNA, 22 nt, Human
aaccacacaauggaucugugaa

SEQ ID NO: 365095 - RNA, 23 nt, Human
aagcaucucuucugagguauucc

SEQ ID NO: 365096 - RNA, 25 nt, Human
aagcaucucuucugagguauuccuu

SEQ ID NO: 365097 - RNA, 21 nt, Human
augaacacucaaugaagcauc

SEQ ID NO: 365098 - RNA, 19 nt, Human
ccgcaggcagcccguucgu

SEQ ID NO: 365099 - RNA, 19 nt, Human
cucucagcccgcaggcagc

SEQ ID NO: 365100 - RNA, 20 nt, Human
cucucgcccacgcccggccu

SEQ ID NO: 365101 - RNA, 19 nt, Human
cugagguauuccuuucagu

SEQ ID NO: 365102 - RNA, 25 nt, Human
cuuucagucugguuuuaucccagaa

SEQ ID NO: 365103 - RNA, 23 nt, Human
ugaacacucaaugaagcaucucu

SEQ ID NO: 365104 - RNA, 21 nt, Human
uucgugcucucgcccacgccc

SEQ ID NO: 365105 - RNA, 25 nt, Human
aaagaggaggcagacugcugcagga

SEQ ID NO: 365106 - RNA, 21 nt, Human
aagaggaggcagacugcugca

SEQ ID NO: 365107 - RNA, 22 nt, Human
agaggaggcagacugcugcagg

SEQ ID NO: 365108 - RNA, 22 nt, Human
cagggggaaaaauccuaggaaa

SEQ ID NO: 365109 - RNA, 19 nt, Human
caucaucaucaucauggaa

SEQ ID NO: 365110 - RNA, 21 nt, Human
cgggaaccguuugacuccggc

SEQ ID NO: 365111 - RNA, 20 nt, Human
cgggacugggccgggaaccg

SEQ ID NO: 365112 - RNA, 23 nt, Human
uaaaguaguugccacugagaaac

SEQ ID NO: 365113 - RNA, 24 nt, Human
uggaaauggcuuuagaggaaaacu

SEQ ID NO: 365114 - RNA, 19 nt, Human
uguguuauagaauacaaca

SEQ ID NO: 365115 - RNA, 22 nt, Human
uuagauauuuuuauuucuccaa

SEQ ID NO: 365116 - RNA, 19 nt, Human
aaaggacggagcagccacc

SEQ ID NO: 365117 - RNA, 21 nt, Human
aaauaaauacuuagaacacga

SEQ ID NO: 365118 - RNA, 19 nt, Human
accccgugaucaagacacg

SEQ ID NO: 365119 - RNA, 18 nt, Human
agaacacgacuuggcucc

SEQ ID NO: 365120 - RNA, 19 nt, Human
aggauucuacgugguucuc

SEQ ID NO: 365121 - RNA, 26 nt, Human
caacauagaacauacucgccaguacu

SEQ ID NO: 365122 - RNA, 24 nt, Human
caaugcgccccuuuucuagagccu

SEQ ID NO: 365123 - RNA, 21 nt, Human
cccaugggccccacgcaggga

SEQ ID NO: 365124 - RNA, 25 nt, Human
cccgugaucaagacacggaaucggc

SEQ ID NO: 365125 - RNA, 22 nt, Human
ccgaaaggacggagcagccacc

SEQ ID NO: 365126 - RNA, 23 nt, Human
ccugccgccgccuggaccgaaag

SEQ ID NO: 365127 - RNA, 19 nt, Human
cgacuuggcuccuacaagc

SEQ ID NO: 365128 - RNA, 23 nt, Human
cgccuggaccgaaaggacggagc

SEQ ID NO: 365129 - RNA, 23 nt, Human
cucugcguccucuguuuauuguu

SEQ ID NO: 365130 - RNA, 23 nt, Human
cuggcucagcccugccgccgccu

SEQ ID NO: 365131 - RNA, 18 nt, Human
gaaaggacggagcagcca

SEQ ID NO: 365132 - RNA, 19 nt, Human
gaacacgacuuggcuccua

SEQ ID NO: 365133 - RNA, 20 nt, Human
gccggagaacgggcgcggag

SEQ ID NO: 365134 - RNA, 21 nt, Human
gccuggaccgaaaggacggag

SEQ ID NO: 365135 - RNA, 19 nt, Human
gcgccccuuuucuagagcc

SEQ ID NO: 365136 - RNA, 19 nt, Human
gcucagcccugccgccgcc

SEQ ID NO: 365137 - RNA, 18 nt, Human
ggagaacgggcgcggaga

SEQ ID NO: 365138 - RNA, 22 nt, Human
ggccccacgcagggacgccacg

SEQ ID NO: 365139 - RNA, 20 nt, Human
gggcgucgcuggcucagccc

SEQ ID NO: 365140 - RNA, 20 nt, Human
uacucgccaguacucggcug

SEQ ID NO: 365141 - RNA, 22 nt, Human
uccgcacgguugaggauucuac

SEQ ID NO: 365142 - RNA, 18 nt, Human
ucgcuggcucagcccugc

SEQ ID NO: 365143 - RNA, 23 nt, Human
ugcaaaacaggggcuagcgcuga

SEQ ID NO: 365144 - RNA, 21 nt, Human
ugcggcugggaaaaagacaac

SEQ ID NO: 365145 - RNA, 18 nt, Human
ugggaaaaagacaacugg

SEQ ID NO: 365146 - RNA, 27 nt, Human
ugggaaaaagacaacuggaauuucucg

SEQ ID NO: 365147 - RNA, 19 nt, Human
uggugugugugugugugug

SEQ ID NO: 365148 - RNA, 18 nt, Human
ugugcaaaacaggggcua

SEQ ID NO: 365149 - RNA, 18 nt, Human
uuagaacacgacuuggcu

SEQ ID NO: 365150 - RNA, 20 nt, Human
aaagaagucuacagcacuuc

SEQ ID NO: 365151 - RNA, 19 nt, Human
aaaugccauuagcuucaaa

SEQ ID NO: 365152 - RNA, 21 nt, Human
aaccguauuuucuucuuuuug

SEQ ID NO: 365153 - RNA, 18 nt, Human
aagccucuugaccuaugg

SEQ ID NO: 365154 - RNA, 22 nt, Human
aaggacaggaauggcacuuucc

SEQ ID NO: 365155 - RNA, 23 nt, Human
acuacaagaacaaaccugucuag

SEQ ID NO: 365156 - RNA, 24 nt, Human
acuuccaauguaaaucccaacuuc

SEQ ID NO: 365157 - RNA, 20 nt, Human
acuuugugauccagaagccu

SEQ ID NO: 365158 - RNA, 21 nt, Human
auaaccccuaaaacaggagag

SEQ ID NO: 365159 - RNA, 24 nt, Human
aucccaacuucaccgcuucaucuc

SEQ ID NO: 365160 - RNA, 22 nt, Human
augcacaguccaaauguauaac

SEQ ID NO: 365161 - RNA, 20 nt, Human
caagaaagccugaaaccgua

SEQ ID NO: 365162 - RNA, 19 nt, Human
ccacuguggaacugggaaa

SEQ ID NO: 365163 - RNA, 21 nt, Human
ccagcuacaagcucugcugca

SEQ ID NO: 365164 - RNA, 27 nt, Human
cuacagcacuuccaauguaaaucccaa

SEQ ID NO: 365165 - RNA, 21 nt, Human
gagacugugccuuaaggacag

SEQ ID NO: 365166 - RNA, 18 nt, Human
ggacaggaauggcacuuu

SEQ ID NO: 365167 - RNA, 20 nt, Human
ggacaggaauggcacuuucc

SEQ ID NO: 365168 - RNA, 18 nt, Human
ggagcaaagacuggggau

SEQ ID NO: 365169 - RNA, 20 nt, Human
uagaaaacuacaagaacaaa

SEQ ID NO: 365170 - RNA, 21 nt, Human
uauaaccccuaaaacaggaga

SEQ ID NO: 365171 - RNA, 22 nt, Human
uccaauguaaaucccaacuuca

SEQ ID NO: 365172 - RNA, 24 nt, Human
ucuucuuuuugacucuguccagcu

SEQ ID NO: 365173 - RNA, 23 nt, Human
ugcugcaguguguauauacaaau

SEQ ID NO: 365174 - RNA, 24 nt, Human
uguccagcuacaagcucugcugca

SEQ ID NO: 365175 - RNA, 22 nt, Human
uuggacacuugaaauuuuaacc

SEQ ID NO: 365176 - RNA, 19 nt, Human
uuggcuagacauucuucua

SEQ ID NO: 365177 - RNA, 26 nt, Human
uuucuucuuuuugacucuguccagcu

SEQ ID NO: 365178 - RNA, 21 nt, Human
aaaugccugacacauacucug

SEQ ID NO: 365179 - RNA, 22 nt, Human
cuauguggugaacacuucuucu

SEQ ID NO: 365180 - RNA, 22 nt, Human
uaauggaaauauauuaauauga

SEQ ID NO: 365181 - RNA, 21 nt, Human
uacuuauauaauuucauacua

SEQ ID NO: 365182 - RNA, 22 nt, Human
uaugugaaaaauaugccaugcu

SEQ ID NO: 365183 - RNA, 19 nt, Human
uauucugucaaaaauacuc

SEQ ID NO: 365184 - RNA, 20 nt, Human
ucuuguuccaaaguuugaaa

SEQ ID NO: 365185 - RNA, 20 nt, Human
ucuuuuuuuuuuucacugua

SEQ ID NO: 365186 - RNA, 19 nt, Human
ugaagaccuuugcaacuau

SEQ ID NO: 365187 - RNA, 19 nt, Human
ugagauucaaaacaguggc

SEQ ID NO: 365188 - RNA, 22 nt, Human
ugaggagcuucugcaacagugg

SEQ ID NO: 365189 - RNA, 23 nt, Human
uguggugaacacuucuucuugcc

SEQ ID NO: 365190 - RNA, 20 nt, Human
uucuucuugccuuuagcagg

SEQ ID NO: 365191 - RNA, 21 nt, Human
uugaagaccuuugcaacuaug

SEQ ID NO: 365192 - RNA, 20 nt, Human
uuguuccaaaguuugaaaca

SEQ ID NO: 365193 - RNA, 25 nt, Human
aaaaaagauuuuuauaaaccaugaa

SEQ ID NO: 365194 - RNA, 22 nt, Human
aaagugagcagugcauauuucc

SEQ ID NO: 365195 - RNA, 24 nt, Human
aaagugcugggauuacaggcauga

SEQ ID NO: 365196 - RNA, 25 nt, Human
aaauagcugggacuacaggcgcccg

SEQ ID NO: 365197 - RNA, 22 nt, Human
aaauccuaccccuccugcauuc

SEQ ID NO: 365198 - RNA, 18 nt, Human
aagaaaaacagagaagcc

SEQ ID NO: 365199 - RNA, 19 nt, Human
aagaaaaacagagaagcca

SEQ ID NO: 365200 - RNA, 22 nt, Human
aagaaugaguguuuugagucug

SEQ ID NO: 365201 - RNA, 25 nt, Human
aagacauucucaauuggggaccugg

SEQ ID NO: 365202 - RNA, 19 nt, Human
aagugcugggauuacaggc

SEQ ID NO: 365203 - RNA, 21 nt, Human
aagugcugggauuacaggcau

SEQ ID NO: 365204 - RNA, 26 nt, Human
aagugcugggauuacaggcaugagcc

SEQ ID NO: 365205 - RNA, 21 nt, Human
aaucauucgugacucgcuuga

SEQ ID NO: 365206 - RNA, 23 nt, Human
accagaauucaggauuaacccag

SEQ ID NO: 365207 - RNA, 23 nt, Human
accaugguuauguaagcacauca

SEQ ID NO: 365208 - RNA, 23 nt, Human
accauguuagccaggauggucuc

SEQ ID NO: 365209 - RNA, 22 nt, Human
accccuccugcauucuuccccu

SEQ ID NO: 365210 - RNA, 25 nt, Human
acccgccucggccucccaaagugcu

SEQ ID NO: 365211 - RNA, 21 nt, Human
accuuacauggugaucagugc

SEQ ID NO: 365212 - RNA, 18 nt, Human
acgggguuuuaccauguu

SEQ ID NO: 365213 - RNA, 19 nt, Human
acgggguuuuaccauguua

SEQ ID NO: 365214 - RNA, 20 nt, Human
acgggguuuuaccauguuag

SEQ ID NO: 365215 - RNA, 24 nt, Human
acgggguuuuaccauguuagccag

SEQ ID NO: 365216 - RNA, 19 nt, Human
acuacaggcgcccgccagg

SEQ ID NO: 365217 - RNA, 20 nt, Human
acugcaagcuccgccucccg

SEQ ID NO: 365218 - RNA, 23 nt, Human
agagaagccauucuaucuuuagg

SEQ ID NO: 365219 - RNA, 20 nt, Human
agagaccucccgaacccacu

SEQ ID NO: 365220 - RNA, 26 nt, Human
agauuuacaaccagaauucaggauua

SEQ ID NO: 365221 - RNA, 20 nt, Human
aggcuaauuucuuuuuuucu

SEQ ID NO: 365222 - RNA, 19 nt, Human
aggcuggagugcaguggca

SEQ ID NO: 365223 - RNA, 23 nt, Human
agugcaguggcacgaccucggcu

SEQ ID NO: 365224 - RNA, 24 nt, Human
agugcaguggcacgaccucggcuc

SEQ ID NO: 365225 - RNA, 18 nt, Human
agugcugggauuacaggc

SEQ ID NO: 365226 - RNA, 21 nt, Human
augaaguacaacuucauucac

SEQ ID NO: 365227 - RNA, 23 nt, Human
augucaucacaaaugaacccaga

SEQ ID NO: 365228 - RNA, 18 nt, Human
caaaauauauuggccugg

SEQ ID NO: 365229 - RNA, 24 nt, Human
caaagugcugggauuacaggcaug

SEQ ID NO: 365230 - RNA, 22 nt, Human
caagcaagacauucucaauugg

SEQ ID NO: 365231 - RNA, 23 nt, Human
cacccgccucggccucccaaagu

SEQ ID NO: 365232 - RNA, 22 nt, Human
cacgccauucuccugccuuagc

SEQ ID NO: 365233 - RNA, 23 nt, Human
cagaagaaaaacagagaagccau

SEQ ID NO: 365234 - RNA, 23 nt, Human
cagcauuauaauccuaguuaugc

SEQ ID NO: 365235 - RNA, 21 nt, Human
cagcauuuacuaaaugugacc

SEQ ID NO: 365236 - RNA, 20 nt, Human
caguggcacgaccucggcca

SEQ ID NO: 365237 - RNA, 21 nt, Human
caguggcacgaccucggcuca

SEQ ID NO: 365238 - RNA, 18 nt, Human
cauucacuccagugugaa

SEQ ID NO: 365239 - RNA, 25 nt, Human
cauucacuccagugugaaacagugg

SEQ ID NO: 365240 - RNA, 26 nt, Human
cauuuuuaaaacuccaauuuauuauc

SEQ ID NO: 365241 - RNA, 23 nt, Human
ccaaagugcugggauuacaggca

SEQ ID NO: 365242 - RNA, 24 nt, Human
ccaaagugcugggauuacaggcau

SEQ ID NO: 365243 - RNA, 24 nt, Human
cccaaagugcugggauuacaggca

SEQ ID NO: 365244 - RNA, 23 nt, Human
cccaaauagcugggacuacaggc

SEQ ID NO: 365245 - RNA, 18 nt, Human
ccccuuucccgaaccggg

SEQ ID NO: 365246 - RNA, 21 nt, Human
ccuccaugcaaugaucauuuc

SEQ ID NO: 365247 - RNA, 20 nt, Human
ccugaccucgugauccaccc

SEQ ID NO: 365248 - RNA, 23 nt, Human
ccugccuuagccucccaaauagc

SEQ ID NO: 365249 - RNA, 24 nt, Human
ccugccuuagccucccaaauagcu

SEQ ID NO: 365250 - RNA, 18 nt, Human
ccugucucugcucgcgcc

SEQ ID NO: 365251 - RNA, 21 nt, Human
ccugucucugcucgcgccccg

SEQ ID NO: 365252 - RNA, 19 nt, Human
ccuuggucgaagggaaaga

SEQ ID NO: 365253 - RNA, 26 nt, Human
cgcccggaaugccccgcggacuaccc

SEQ ID NO: 365254 - RNA, 19 nt, Human
cgccucccggguucacgcc

SEQ ID NO: 365255 - RNA, 24 nt, Human
cgccucggccucccaaagugcugg

SEQ ID NO: 365256 - RNA, 23 nt, Human
cggaaugccccgcggacuacccu

SEQ ID NO: 365257 - RNA, 26 nt, Human
cggagcaacagacaccuuggucgaag

SEQ ID NO: 365258 - RNA, 24 nt, Human
cggagucuugcucugucgcccagg

SEQ ID NO: 365259 - RNA, 22 nt, Human
cucauagagaccucccgaaccc

SEQ ID NO: 365260 - RNA, 20 nt, Human
cuccagugugaaauauaugg

SEQ ID NO: 365261 - RNA, 24 nt, Human
cucccaaauagcugggacuacagg

SEQ ID NO: 365262 - RNA, 21 nt, Human
cucccggguucacgccauucu

SEQ ID NO: 365263 - RNA, 24 nt, Human
cuccugaccucgugauccacccgc

SEQ ID NO: 365264 - RNA, 20 nt, Human
cucugucgcccaggcuggag

SEQ ID NO: 365265 - RNA, 21 nt, Human
cugcauucuuccccuuucccg

SEQ ID NO: 365266 - RNA, 24 nt, Human
cuuagccucccaaauagcugggac

SEQ ID NO: 365267 - RNA, 23 nt, Human
cuugcucauagagaccucccgaa

SEQ ID NO: 365268 - RNA, 22 nt, Human
gaccucgugauccacccgccuc

SEQ ID NO: 365269 - RNA, 22 nt, Human
gaccucgugauccacccgccuc

SEQ ID NO: 365270 - RNA, 24 nt, Human
gaccucgugauccacccgccucgg

SEQ ID NO: 365271 - RNA, 24 nt, Human
gagacgggguuuuaccauguuagc

SEQ ID NO: 365272 - RNA, 24 nt, Human
gagccaccgcgccuggccuacauu

SEQ ID NO: 365273 - RNA, 18 nt, Human
gauuacaggcaugagcca

SEQ ID NO: 365274 - RNA, 22 nt, Human
gauuacaggcaugagccaccgc

SEQ ID NO: 365275 - RNA, 22 nt, Human
gauuacaggcaugagccaccgc

SEQ ID NO: 365276 - RNA, 19 nt, Human
gcccaggcuggagugcagu

SEQ ID NO: 365277 - RNA, 23 nt, Human
gcccaggcuggagugcaguggca

SEQ ID NO: 365278 - RNA, 19 nt, Human
gccccgcggacuacccuuc

SEQ ID NO: 365279 - RNA, 25 nt, Human
gccucccggguucacgccauucucc

SEQ ID NO: 365280 - RNA, 25 nt, Human
gcucugucgcccaggcuggagugca

SEQ ID NO: 365281 - RNA, 19 nt, Human
gcuggagugcaguggcacg

SEQ ID NO: 365282 - RNA, 19 nt, Human
gcuuacccuggacgcugcc

SEQ ID NO: 365283 - RNA, 20 nt, Human
gcuuuuagguaaaccauuuc

SEQ ID NO: 365284 - RNA, 23 nt, Human
ggagucuugcucugucgcccagg

SEQ ID NO: 365285 - RNA, 22 nt, Human
ggauuacaggcaugagccaccg

SEQ ID NO: 365286 - RNA, 23 nt, Human
gggguuuuaccauguuagccagg

SEQ ID NO: 365287 - RNA, 22 nt, Human
ggguuuuaccauguuagccagg

SEQ ID NO: 365288 - RNA, 20 nt, Human
ggucucgaucuccugaccuc

SEQ ID NO: 365289 - RNA, 23 nt, Human
guagagacgggguuuuaccaugu

SEQ ID NO: 365290 - RNA, 20 nt, Human
gucuuagugcuucucuuuca

SEQ ID NO: 365291 - RNA, 19 nt, Human
gucuuucccaaccgauccu

SEQ ID NO: 365292 - RNA, 24 nt, Human
gugauccacccgccucggccuccc

SEQ ID NO: 365293 - RNA, 20 nt, Human
guuguauuucagaagaaaaa

SEQ ID NO: 365294 - RNA, 21 nt, Human
guuuauuuuauaaauaaagcc

SEQ ID NO: 365295 - RNA, 21 nt, Human
uaaaagacaacuuuacauuua

SEQ ID NO: 365296 - RNA, 21 nt, Human
uaaacucauuuuaaucaccau

SEQ ID NO: 365297 - RNA, 24 nt, Human
uaaagauuacuuacuuuacacacu

SEQ ID NO: 365298 - RNA, 21 nt, Human
uaaccagauuuacaaccagaa

SEQ ID NO: 365299 - RNA, 31 nt, Human
uaauuucuuuuuuucuauuuuuaguagagaa

SEQ ID NO: 365300 - RNA, 22 nt, Human
uacaggcaugagccaccgcgcc

SEQ ID NO: 365301 - RNA, 19 nt, Human
uaccauguuagccaggaug

SEQ ID NO: 365302 - RNA, 22 nt, Human
uaccauguuagccaggaugguc

SEQ ID NO: 365303 - RNA, 24 nt, Human
uaccauguuagccaggauggucuc

SEQ ID NO: 365304 - RNA, 19 nt, Human
uacuuuacacacugcuaaa

SEQ ID NO: 365305 - RNA, 22 nt, Human
uagaagagacaguauucccgca

SEQ ID NO: 365306 - RNA, 21 nt, Human
uagaagcagucuuagugcuuc

SEQ ID NO: 365307 - RNA, 22 nt, Human
uagagacgggguuuuaccaugu

SEQ ID NO: 365308 - RNA, 24 nt, Human
uaguagagacgggguuuuaccaug

SEQ ID NO: 365309 - RNA, 24 nt, Human
uauaacaccagcuuacccuggacg

SEQ ID NO: 365310 - RNA, 18 nt, Human
uauacaugccuccaugca

SEQ ID NO: 365311 - RNA, 18 nt, Human
uaucaggaaagaaauccu

SEQ ID NO: 365312 - RNA, 22 nt, Human
ucaaaaaaaccuguauuuuuca

SEQ ID NO: 365313 - RNA, 23 nt, Human
ucaagcaagacauucucaauugg

SEQ ID NO: 365314 - RNA, 18 nt, Human
ucacugcaagcuccgccu

SEQ ID NO: 365315 - RNA, 19 nt, Human
ucacugcaagcuccgccuc

SEQ ID NO: 365316 - RNA, 24 nt, Human
ucacugcaagcuccgccucccggg

SEQ ID NO: 365317 - RNA, 19 nt, Human
ucaggaaagaaauccuacc

SEQ ID NO: 365318 - RNA, 23 nt, Human
ucauucacuccagugugaaauau

SEQ ID NO: 365319 - RNA, 23 nt, Human
ucauuugucugcaucaauauuuc

SEQ ID NO: 365320 - RNA, 28 nt, Human
uccaaaguauuuucaaaggcuuuuauug

SEQ ID NO: 365321 - RNA, 24 nt, Human
ucccaaagugcugggauuacaggc

SEQ ID NO: 365322 - RNA, 24 nt, Human
ucccaaauagcugggacuacaggc

SEQ ID NO: 365323 - RNA, 19 nt, Human
uccccaagaucaaagccug

SEQ ID NO: 365324 - RNA, 21 nt, Human
ucccggguucacgccauucuc

SEQ ID NO: 365325 - RNA, 24 nt, Human
ucccggguucacgccauucuccug

SEQ ID NO: 365326 - RNA, 23 nt, Human
uccuaccccuccugcauucuucc

SEQ ID NO: 365327 - RNA, 22 nt, Human
uccugcauucuuccccuuuccc

SEQ ID NO: 365328 - RNA, 21 nt, Human
uccuugcucauagagaccucc

SEQ ID NO: 365329 - RNA, 22 nt, Human
ucgcccaggcuggagugcagug

SEQ ID NO: 365330 - RNA, 18 nt, Human
ucggccucccaaagugcu

SEQ ID NO: 365331 - RNA, 22 nt, Human
ucgucugaauaauucuagccau

SEQ ID NO: 365332 - RNA, 23 nt, Human
ucuagaaaauuguuggcacuuag

SEQ ID NO: 365333 - RNA, 26 nt, Human
ucuccugccuuagccucccaaauagc

SEQ ID NO: 365334 - RNA, 20 nt, Human
ucugcaucaauauuucaaaa

SEQ ID NO: 365335 - RNA, 24 nt, Human
ucugucgcccaggcuggagugcag

SEQ ID NO: 365336 - RNA, 18 nt, Human
ucuuccccuuucccgaac

SEQ ID NO: 365337 - RNA, 22 nt, Human
ucuugcucugucgcccaggcug

SEQ ID NO: 365338 - RNA, 23 nt, Human
ucuugcucugucgcccaggcugg

SEQ ID NO: 365339 - RNA, 24 nt, Human
ucuugcucugucgcccaggcugga

SEQ ID NO: 365340 - RNA, 20 nt, Human
ugaagaaauagucaaugcau

SEQ ID NO: 365341 - RNA, 19 nt, Human
ugagaaaaaauauaaacuc

SEQ ID NO: 365342 - RNA, 21 nt, Human
ugagaaaaaauauaaacucau

SEQ ID NO: 365343 - RNA, 22 nt, Human
ugagacggagucuugcucuguc

SEQ ID NO: 365344 - RNA, 23 nt, Human
ugagcagugcauauuuccuuuau

SEQ ID NO: 365345 - RNA, 23 nt, Human
ugcaggacuugagugugcacaaa

SEQ ID NO: 365346 - RNA, 20 nt, Human
ugcaguggcacgaccucggc

SEQ ID NO: 365347 - RNA, 19 nt, Human
ugccccgcggacuacccuu

SEQ ID NO: 365348 - RNA, 18 nt, Human
ugccuccaugcaaugauc

SEQ ID NO: 365349 - RNA, 24 nt, Human
ugccuuagccucccaaauagcugg

SEQ ID NO: 365350 - RNA, 23 nt, Human
uggagugcaguggcacgaccucg

SEQ ID NO: 365351 - RNA, 24 nt, Human
uggagugcaguggcacgaccucgg

SEQ ID NO: 365352 - RNA, 18 nt, Human
uggccugguucuguagcu

SEQ ID NO: 365353 - RNA, 19 nt, Human
ugggacuacaggcgcccgc

SEQ ID NO: 365354 - RNA, 21 nt, Human
ugggacuacaggcgcccgcca

SEQ ID NO: 365355 - RNA, 25 nt, Human
ugggacuacaggcgcccgccagcca

SEQ ID NO: 365356 - RNA, 28 nt, Human
ugggacuacaggcgcccgccagccacca

SEQ ID NO: 365357 - RNA, 18 nt, Human
ugggauuacaggcaugag

SEQ ID NO: 365358 - RNA, 19 nt, Human
ugggauuacaggcaugagc

SEQ ID NO: 365359 - RNA, 21 nt, Human
ugggauuacaggcaugagcca

SEQ ID NO: 365360 - RNA, 22 nt, Human
ugggauuacaggcaugagccac

SEQ ID NO: 365361 - RNA, 23 nt, Human
ugggauuacaggcaugagccacc

SEQ ID NO: 365362 - RNA, 24 nt, Human
ugggauuacaggcaugagccaccg

SEQ ID NO: 365363 - RNA, 24 nt, Human
ugggauuacaggcaugagccaccg

SEQ ID NO: 365364 - RNA, 23 nt, Human
uguagaucagcagcguauuauaa

SEQ ID NO: 365365 - RNA, 24 nt, Human
uuaccauguuagccaggauggucu

SEQ ID NO: 365366 - RNA, 21 nt, Human
uuagcaaaucugugauguaga

SEQ ID NO: 365367 - RNA, 18 nt, Human
uuaguagagacgggguuu

SEQ ID NO: 365368 - RNA, 22 nt, Human
uuaguagagacgggguuuuacc

SEQ ID NO: 365369 - RNA, 24 nt, Human
uuaguagagacgggguuuuaccau

SEQ ID NO: 365370 - RNA, 21 nt, Human
uucaaauguacaugauuugau

SEQ ID NO: 365371 - RNA, 18 nt, Human
uucacaaaauacauagaa

SEQ ID NO: 365372 - RNA, 23 nt, Human
uucacaaaauacauagaagagac

SEQ ID NO: 365373 - RNA, 24 nt, Human
uugcucugucgcccaggcuggagu

SEQ ID NO: 365374 - RNA, 21 nt, Human
uuggucaaaaaaaccuguauu

SEQ ID NO: 365375 - RNA, 22 nt, Human
uuugcugacuuaugucaucaca

SEQ ID NO: 365376 - RNA, 24 nt, Human
uuuuuaguagagacgggguuuuac

SEQ ID NO: 365377 - RNA, 22 nt, Human
uuuuucuauuuuuaguagagaa

SEQ ID NO: 365378 - RNA, 24 nt, Human
uuuuuucuauuuuuaguagagacg

SEQ ID NO: 365379 - RNA, 22 nt, Human
uuuuuucuauuuuuaguagagg

SEQ ID NO: 365380 - RNA, 27 nt, Human
uuuuuuuuuuuuuuuuuuuuuuugggg

SEQ ID NO: 365381 - RNA, 23 nt, Human
agaugguucccgggggagaacag

SEQ ID NO: 365382 - RNA, 23 nt, Human
agggaagguggggacagaugguu

SEQ ID NO: 365383 - RNA, 25 nt, Human
aguccuguggcuucccugaagaggg

SEQ ID NO: 365384 - RNA, 19 nt, Human
ccucagaagcgcagaagca

SEQ ID NO: 365385 - RNA, 20 nt, Human
ccuguggcuucccugaagag

SEQ ID NO: 365386 - RNA, 23 nt, Human
ggaagguggggacagaugguucc

SEQ ID NO: 365387 - RNA, 20 nt, Human
gggaagguggggacagaugg

SEQ ID NO: 365388 - RNA, 22 nt, Human
gguucccgggggagaacagccc

SEQ ID NO: 365389 - RNA, 22 nt, Human
uaaguccuguggcuucccugaa

SEQ ID NO: 365390 - RNA, 23 nt, Human
uaaguccuguggcuucccugaag

SEQ ID NO: 365391 - RNA, 18 nt, Human
ucccugaagagggcucug

SEQ ID NO: 365392 - RNA, 19 nt, Human
aaacaucuuggugagugag

SEQ ID NO: 365393 - RNA, 19 nt, Human
aaagcgcugggauuacagg

SEQ ID NO: 365394 - RNA, 24 nt, Human
aaagcgcugggauuacaggcguga

SEQ ID NO: 365395 - RNA, 19 nt, Human
aagcgcugggauuacaggc

SEQ ID NO: 365396 - RNA, 26 nt, Human
aagcgcugggauuacaggcgugagcc

SEQ ID NO: 365397 - RNA, 23 nt, Human
acccagcuuggggaauugauucc

SEQ ID NO: 365398 - RNA, 18 nt, Human
acgggguuucaccguguu

SEQ ID NO: 365399 - RNA, 19 nt, Human
acgggguuucaccguguua

SEQ ID NO: 365400 - RNA, 20 nt, Human
acgggguuucaccguguuag

SEQ ID NO: 365401 - RNA, 24 nt, Human
acgggguuucaccguguuagccag

SEQ ID NO: 365402 - RNA, 19 nt, Human
agagacgggguuucaccgu

SEQ ID NO: 365403 - RNA, 18 nt, Human
agcgcugggauuacaggc

SEQ ID NO: 365404 - RNA, 18 nt, Human
aggcgugagccacugagc

SEQ ID NO: 365405 - RNA, 20 nt, Human
aguacaguggcgcgaucccg

SEQ ID NO: 365406 - RNA, 21 nt, Human
aguagagacgggguuucaccg

SEQ ID NO: 365407 - RNA, 21 nt, Human
aguagcugggacuacagucgc

SEQ ID NO: 365408 - RNA, 24 nt, Human
caaagcgcugggauuacaggcgug

SEQ ID NO: 365409 - RNA, 24 nt, Human
caauuuuuuguaccuuuaguagag

SEQ ID NO: 365410 - RNA, 18 nt, Human
caccguguuagccaggau

SEQ ID NO: 365411 - RNA, 24 nt, Human
caccguguuagccaggauggucuc

SEQ ID NO: 365412 - RNA, 21 nt, Human
cacgccauucuccugccucag

SEQ ID NO: 365413 - RNA, 18 nt, Human
cagucgcccgacaccacu

SEQ ID NO: 365414 - RNA, 22 nt, Human
ccaaagcgcugggauuacaggc

SEQ ID NO: 365415 - RNA, 23 nt, Human
ccaaagcgcugggauuacaggcg

SEQ ID NO: 365416 - RNA, 24 nt, Human
ccaaagcgcugggauuacaggcgu

SEQ ID NO: 365417 - RNA, 21 nt, Human
cccgccucggccucccaaagc

SEQ ID NO: 365418 - RNA, 21 nt, Human
cccggcucgcugcaagcuccg

SEQ ID NO: 365419 - RNA, 24 nt, Human
ccucccggauucacgccauucucc

SEQ ID NO: 365420 - RNA, 20 nt, Human
ccugacccugcgauccgccc

SEQ ID NO: 365421 - RNA, 19 nt, Human
cgccucccggauucacgcc

SEQ ID NO: 365422 - RNA, 24 nt, Human
cgccucggccucccaaagcgcugg

SEQ ID NO: 365423 - RNA, 22 nt, Human
cgcucugucacccaggcuggag

SEQ ID NO: 365424 - RNA, 24 nt, Human
cgggguuucaccguguuagccagg

SEQ ID NO: 365425 - RNA, 24 nt, Human
cucagucucgcgaguagcugggac

SEQ ID NO: 365426 - RNA, 24 nt, Human
cuccugacccugcgauccgcccgc

SEQ ID NO: 365427 - RNA, 24 nt, Human
cucgcucugucacccaggcuggag

SEQ ID NO: 365428 - RNA, 23 nt, Human
cucugucacccaggcuggaguac

SEQ ID NO: 365429 - RNA, 23 nt, Human
cugccucagucucgcgaguagcu

SEQ ID NO: 365430 - RNA, 19 nt, Human
cugucacccaggcuggagu

SEQ ID NO: 365431 - RNA, 24 nt, Human
gagacgggguuucaccguguuagc

SEQ ID NO: 365432 - RNA, 18 nt, Human
gauuacaggcgugagcca

SEQ ID NO: 365433 - RNA, 21 nt, Human
gauuacaggcgugagccacug

SEQ ID NO: 365434 - RNA, 24 nt, Human
gauuacaggcgugagccacugagc

SEQ ID NO: 365435 - RNA, 24 nt, Human
gcgauccgcccgccucggccuccc

SEQ ID NO: 365436 - RNA, 24 nt, Human
gcuggaguacaguggcgcgauccc

SEQ ID NO: 365437 - RNA, 23 nt, Human
gcugggauuacaggcgugagcca

SEQ ID NO: 365438 - RNA, 23 nt, Human
gggguuucaccguguuagccagg

SEQ ID NO: 365439 - RNA, 23 nt, Human
guagagacgggguuucaccgugu

SEQ ID NO: 365440 - RNA, 19 nt, Human
gugagccacugagcccggc

SEQ ID NO: 365441 - RNA, 18 nt, Human
uacaggcgugagccacug

SEQ ID NO: 365442 - RNA, 19 nt, Human
uacaggcgugagccacuga

SEQ ID NO: 365443 - RNA, 23 nt, Human
uacaggcgugagccacugagccc

SEQ ID NO: 365444 - RNA, 21 nt, Human
uaguagagacgggguuucacc

SEQ ID NO: 365445 - RNA, 24 nt, Human
uaguagagacgggguuucaccgug

SEQ ID NO: 365446 - RNA, 26 nt, Human
uaguagagacgggguuucaccguguu

SEQ ID NO: 365447 - RNA, 24 nt, Human
ucaccguguuagccaggauggucu

SEQ ID NO: 365448 - RNA, 24 nt, Human
ucccaaagcgcugggauuacaggc

SEQ ID NO: 365449 - RNA, 20 nt, Human
ucccggauucacgccauucu

SEQ ID NO: 365450 - RNA, 24 nt, Human
ucccggauucacgccauucuccug

SEQ ID NO: 365451 - RNA, 18 nt, Human
ucgcccgacaccacuccc

SEQ ID NO: 365452 - RNA, 23 nt, Human
ucgcgaguagcugggacuacagu

SEQ ID NO: 365453 - RNA, 18 nt, Human
ucgcugcaagcuccgccu

SEQ ID NO: 365454 - RNA, 19 nt, Human
ucgcugcaagcuccgccuc

SEQ ID NO: 365455 - RNA, 23 nt, Human
ucgcugcaagcuccgccucccgg

SEQ ID NO: 365456 - RNA, 24 nt, Human
ucgcugcaagcuccgccucccgga

SEQ ID NO: 365457 - RNA, 19 nt, Human
ucuccucaacccagcuugg

SEQ ID NO: 365458 - RNA, 19 nt, Human
ucucgcucugucacccagg

SEQ ID NO: 365459 - RNA, 23 nt, Human
ucucgcucugucacccaggcugg

SEQ ID NO: 365460 - RNA, 24 nt, Human
ucucgcucugucacccaggcugga

SEQ ID NO: 365461 - RNA, 25 nt, Human
ucucgcucugucacccaggcuggag

SEQ ID NO: 365462 - RNA, 26 nt, Human
ucucgcucugucacccaggcuggagu

SEQ ID NO: 365463 - RNA, 18 nt, Human
ucugucacccaggcugga

SEQ ID NO: 365464 - RNA, 24 nt, Human
ucugucacccaggcuggaguacag

SEQ ID NO: 365465 - RNA, 18 nt, Human
ugagacagagucucgcuc

SEQ ID NO: 365466 - RNA, 22 nt, Human
ugagacagagucucgcucuguc

SEQ ID NO: 365467 - RNA, 24 nt, Human
ugccucagucucgcgaguagcugg

SEQ ID NO: 365468 - RNA, 24 nt, Human
uggaguacaguggcgcgaucccgg

SEQ ID NO: 365469 - RNA, 18 nt, Human
ugggauuacaggcgugag

SEQ ID NO: 365470 - RNA, 19 nt, Human
ugggauuacaggcgugagc

SEQ ID NO: 365471 - RNA, 21 nt, Human
ugggauuacaggcgugagcca

SEQ ID NO: 365472 - RNA, 22 nt, Human
ugggauuacaggcgugagccac

SEQ ID NO: 365473 - RNA, 22 nt, Human
ugggauuacaggcgugagccac

SEQ ID NO: 365474 - RNA, 24 nt, Human
ugggauuacaggcgugagccacug

SEQ ID NO: 365475 - RNA, 26 nt, Human
ugggauuacaggcgugagccacugag

SEQ ID NO: 365476 - RNA, 20 nt, Human
uguucuccucaacccagcuu

SEQ ID NO: 365477 - RNA, 18 nt, Human
uuaguagagacgggguuu

SEQ ID NO: 365478 - RNA, 22 nt, Human
uuaguagagacgggguuucacc

SEQ ID NO: 365479 - RNA, 24 nt, Human
uuaguagagacgggguuucaccgu

SEQ ID NO: 365480 - RNA, 21 nt, Human
uugcaaucacaaagcuuuuaa

SEQ ID NO: 365481 - RNA, 19 nt, Human
uuggggaauugauucccuc

SEQ ID NO: 365482 - RNA, 19 nt, Human
uuucaccguguuagccagg

SEQ ID NO: 365483 - RNA, 21 nt, Human
uuuuuguaccuuuaguagaga

SEQ ID NO: 365484 - RNA, 24 nt, Human
uuuuuuguaccuuuaguagagacg

SEQ ID NO: 365485 - RNA, 18 nt, Human
aaaugccgaggcuacacc

SEQ ID NO: 365486 - RNA, 23 nt, Human
aagcagggaucagucagagccaa

SEQ ID NO: 365487 - RNA, 25 nt, Human
acacauacacagagacacacguggg

SEQ ID NO: 365488 - RNA, 19 nt, Human
accccaggacaggcagaca

SEQ ID NO: 365489 - RNA, 18 nt, Human
agacacacagacacauac

SEQ ID NO: 365490 - RNA, 19 nt, Human
agaggaggaggcgcagggg

SEQ ID NO: 365491 - RNA, 21 nt, Human
agggggacauggaaaaaacac

SEQ ID NO: 365492 - RNA, 23 nt, Human
caagaaagguuuauuuaaaucag

SEQ ID NO: 365493 - RNA, 19 nt, Human
caagagccuccacuggccu

SEQ ID NO: 365494 - RNA, 21 nt, Human
caagcagggaucagucagagc

SEQ ID NO: 365495 - RNA, 21 nt, Human
caagcccaagagccuccacug

SEQ ID NO: 365496 - RNA, 20 nt, Human
cacacguguucuccaagccc

SEQ ID NO: 365497 - RNA, 19 nt, Human
cagacagggagggaggcag

SEQ ID NO: 365498 - RNA, 23 nt, Human
cagacagggagggaggcaggcag

SEQ ID NO: 365499 - RNA, 18 nt, Human
cagacagucugacagaca

SEQ ID NO: 365500 - RNA, 23 nt, Human
cagaggcucccuccccagggccu

SEQ ID NO: 365501 - RNA, 21 nt, Human
cagcucccucccucaggggcc

SEQ ID NO: 365502 - RNA, 19 nt, Human
cagcuggacagcgcagccc

SEQ ID NO: 365503 - RNA, 18 nt, Human
cagggccuggagauccgg

SEQ ID NO: 365504 - RNA, 18 nt, Human
caggggccugcugagacu

SEQ ID NO: 365505 - RNA, 24 nt, Human
caugauggguaaaaacugggcaug

SEQ ID NO: 365506 - RNA, 20 nt, Human
ccaaacccacaaugucccca

SEQ ID NO: 365507 - RNA, 22 nt, Human
ccaaacccacaauguccccacu

SEQ ID NO: 365508 - RNA, 23 nt, Human
ccaagcccaagagccuccacugg

SEQ ID NO: 365509 - RNA, 21 nt, Human
ccagaccacucaggaucaccc

SEQ ID NO: 365510 - RNA, 26 nt, Human
ccagaggcucccuccccagggccugg

SEQ ID NO: 365511 - RNA, 21 nt, Human
ccagcacacgccguggaaagc

SEQ ID NO: 365512 - RNA, 20 nt, Human
cccacaauguccccacuguc

SEQ ID NO: 365513 - RNA, 23 nt, Human
cccacaauguccccacuguccgu

SEQ ID NO: 365514 - RNA, 24 nt, Human
ccuccacuggccugcacaagcagg

SEQ ID NO: 365515 - RNA, 20 nt, Human
ccucccucaggggccugcug

SEQ ID NO: 365516 - RNA, 22 nt, Human
ccugcugagacuuuggagugag

SEQ ID NO: 365517 - RNA, 19 nt, Human
ccuggcugacagcucccuc

SEQ ID NO: 365518 - RNA, 20 nt, Human
cgacucugagccccaaaccc

SEQ ID NO: 365519 - RNA, 21 nt, Human
cggacgcagacacacagacac

SEQ ID NO: 365520 - RNA, 22 nt, Human
cguccagaggcucccuccccag

SEQ ID NO: 365521 - RNA, 21 nt, Human
cucccucccucaggggccugc

SEQ ID NO: 365522 - RNA, 20 nt, Human
cucggggcuggggccauagc

SEQ ID NO: 365523 - RNA, 19 nt, Human
cugagccccaaacccacaa

SEQ ID NO: 365524 - RNA, 24 nt, Human
gaaaaaaccgccagaccacucagg

SEQ ID NO: 365525 - RNA, 23 nt, Human
gaauggaguauaucaggucaaac

SEQ ID NO: 365526 - RNA, 22 nt, Human
gagaaacucaagcaaaugccga

SEQ ID NO: 365527 - RNA, 24 nt, Human
gaugguguucucgguuuucccugg

SEQ ID NO: 365528 - RNA, 23 nt, Human
gcagacacacagacacauacaca

SEQ ID NO: 365529 - RNA, 19 nt, Human
gcaguccuucuguccaucc

SEQ ID NO: 365530 - RNA, 18 nt, Human
gccauagccacagcugga

SEQ ID NO: 365531 - RNA, 23 nt, Human
ggaaaaaacacagaggaggaggc

SEQ ID NO: 365532 - RNA, 18 nt, Human
ggacgcagacacacagac

SEQ ID NO: 365533 - RNA, 22 nt, Human
ggcaggaggcagacagggaggg

SEQ ID NO: 365534 - RNA, 18 nt, Human
gggcaggaggcagacagg

SEQ ID NO: 365535 - RNA, 24 nt, Human
gugaugguguucucgguuuucccu

SEQ ID NO: 365536 - RNA, 24 nt, Human
guggaaagcagaagucaguuagaa

SEQ ID NO: 365537 - RNA, 22 nt, Human
uaaaaaaggcaguaacguggca

SEQ ID NO: 365538 - RNA, 25 nt, Human
uagaagaaaaaaccgccagaccacu

SEQ ID NO: 365539 - RNA, 19 nt, Human
uagccacagcuggacagcg

SEQ ID NO: 365540 - RNA, 21 nt, Human
ucagacccagcuccuagccac

SEQ ID NO: 365541 - RNA, 22 nt, Human
ucagagagccucugaaggcacc

SEQ ID NO: 365542 - RNA, 22 nt, Human
ucaggaucaccccuggcagaag

SEQ ID NO: 365543 - RNA, 22 nt, Human
ucaguuagaagaaaaaacccua

SEQ ID NO: 365544 - RNA, 23 nt, Human
uccguccagaggcucccucccca

SEQ ID NO: 365545 - RNA, 19 nt, Human
uccuagccaccccaggaca

SEQ ID NO: 365546 - RNA, 20 nt, Human
ucgacucugagccccaaacc

SEQ ID NO: 365547 - RNA, 22 nt, Human
ucuccaagcccaagagccucca

SEQ ID NO: 365548 - RNA, 24 nt, Human
ugagccccaaacccacaauguccc

SEQ ID NO: 365549 - RNA, 18 nt, Human
ugauggguaaaaacuggg

SEQ ID NO: 365550 - RNA, 22 nt, Human
ugauggguaaaaacugggcaug

SEQ ID NO: 365551 - RNA, 24 nt, Human
ugauggguaaaaacugggcauggg

SEQ ID NO: 365552 - RNA, 19 nt, Human
uggaaaaaacacagaggag

SEQ ID NO: 365553 - RNA, 21 nt, Human
uggaaaaaacacagaggagga

SEQ ID NO: 365554 - RNA, 18 nt, Human
uggagugagcauccggac

SEQ ID NO: 365555 - RNA, 23 nt, Human
uggcugacagcucccucccucag

SEQ ID NO: 365556 - RNA, 18 nt, Human
uggggaguugggaggggg

SEQ ID NO: 365557 - RNA, 19 nt, Human
uuagaagaaaaaaccgcca

SEQ ID NO: 365558 - RNA, 22 nt, Human
uucccaggccugcgggccccua

SEQ ID NO: 365559 - RNA, 19 nt, Human
uucccuggcugacagcucc

SEQ ID NO: 365560 - RNA, 18 nt, Human
accgguggugauuucuuc

SEQ ID NO: 365561 - RNA, 19 nt, Human
acuccaaguggaugaagag

SEQ ID NO: 365562 - RNA, 21 nt, Human
agaggcugccaaagagccugg

SEQ ID NO: 365563 - RNA, 21 nt, Human
augaagagcagcuccugcccg

SEQ ID NO: 365564 - RNA, 22 nt, Human
augaccgguggugauuucuucc

SEQ ID NO: 365565 - RNA, 23 nt, Human
augaccgguggugauuucuuccc

SEQ ID NO: 365566 - RNA, 18 nt, Human
caaagagccuggaggggc

SEQ ID NO: 365567 - RNA, 24 nt, Human
ccaagcucgccauucgcccugggc

SEQ ID NO: 365568 - RNA, 22 nt, Human
cccgcagaggccugagccaagg

SEQ ID NO: 365569 - RNA, 20 nt, Human
ccgcagaggccugagccaag

SEQ ID NO: 365570 - RNA, 18 nt, Human
ccucaggcccaggggccu

SEQ ID NO: 365571 - RNA, 24 nt, Human
cucaggcccaggggccuccacccc

SEQ ID NO: 365572 - RNA, 25 nt, Human
cuccugcccgcugcuggcagccuca

SEQ ID NO: 365573 - RNA, 23 nt, Human
uccaaguggaugaagagcagcuc

SEQ ID NO: 365574 - RNA, 19 nt, Human
uccccgcagcacuccaagu

SEQ ID NO: 365575 - RNA, 21 nt, Human
ucgagaagaggcugccaaaga

SEQ ID NO: 365576 - RNA, 22 nt, Human
ugauuucuuccccgcagcacuc

SEQ ID NO: 365577 - RNA, 18 nt, Human
ugccaaagagccuggagg

SEQ ID NO: 365578 - RNA, 19 nt, Human
uggaugaagagcagcuccu

SEQ ID NO: 365579 - RNA, 19 nt, Human
ugggcuggaucucagcucc

SEQ ID NO: 365580 - RNA, 23 nt, Human
aaauccuaauggagccugacccc

SEQ ID NO: 365581 - RNA, 18 nt, Human
aacccggcagcccagacu

SEQ ID NO: 365582 - RNA, 18 nt, Human
aaccuccuacccucaauc

SEQ ID NO: 365583 - RNA, 22 nt, Human
aaugcgauuucaagccugagca

SEQ ID NO: 365584 - RNA, 20 nt, Human
acacaacagggcaggagucu

SEQ ID NO: 365585 - RNA, 21 nt, Human
acagucuugcuuuuguuaaaa

SEQ ID NO: 365586 - RNA, 18 nt, Human
accaaaaauauauauaaa

SEQ ID NO: 365587 - RNA, 21 nt, Human
accaacuaucaaauaugugau

SEQ ID NO: 365588 - RNA, 18 nt, Human
acuggcccuuccccucuc

SEQ ID NO: 365589 - RNA, 22 nt, Human
acuggcccuuccccucuccucc

SEQ ID NO: 365590 - RNA, 19 nt, Human
agaaaggagccccaggccc

SEQ ID NO: 365591 - RNA, 18 nt, Human
agacuagaacccggcagc

SEQ ID NO: 365592 - RNA, 20 nt, Human
agccccaggcccggcucggc

SEQ ID NO: 365593 - RNA, 24 nt, Human
agccguugcagugguugcaacccc

SEQ ID NO: 365594 - RNA, 23 nt, Human
caagaggacacugaugagaggua

SEQ ID NO: 365595 - RNA, 22 nt, Human
caagccugagcaucacggcugg

SEQ ID NO: 365596 - RNA, 19 nt, Human
cagcagaacggguggccau

SEQ ID NO: 365597 - RNA, 19 nt, Human
caucuauacacaacagggc

SEQ ID NO: 365598 - RNA, 25 nt, Human
ccaacuggucucagguaaagaaaga

SEQ ID NO: 365599 - RNA, 22 nt, Human
ccagacuggcccuuccccucuc

SEQ ID NO: 365600 - RNA, 19 nt, Human
ccauccaaaccuccuaccc

SEQ ID NO: 365601 - RNA, 18 nt, Human
ccccaggcccggcucggc

SEQ ID NO: 365602 - RNA, 18 nt, Human
cccuuccccucuccuccc

SEQ ID NO: 365603 - RNA, 22 nt, Human
ccugaccccuagaguggggaga

SEQ ID NO: 365604 - RNA, 19 nt, Human
cgcugcgcugguggcucug

SEQ ID NO: 365605 - RNA, 23 nt, Human
cggguggccauagccaccuccug

SEQ ID NO: 365606 - RNA, 23 nt, Human
cuaguguuuuuuugaacaccaac

SEQ ID NO: 365607 - RNA, 20 nt, Human
cugacaucugucagguuugg

SEQ ID NO: 365608 - RNA, 24 nt, Human
gacaaccaaaaauauauauaaaua

SEQ ID NO: 365609 - RNA, 18 nt, Human
gcaggcucccacaggccc

SEQ ID NO: 365610 - RNA, 18 nt, Human
gcaggcucccacaggccc

SEQ ID NO: 365611 - RNA, 21 nt, Human
gcugggagcaggccgggcugg

SEQ ID NO: 365612 - RNA, 20 nt, Human
ggcucggcugacaucuguca

SEQ ID NO: 365613 - RNA, 20 nt, Human
ggcuuagucuccacccucag

SEQ ID NO: 365614 - RNA, 22 nt, Human
uaaaaauaacaaaaucaguaau

SEQ ID NO: 365615 - RNA, 23 nt, Human
uaacaaaaucaguaauaaaaaaa

SEQ ID NO: 365616 - RNA, 20 nt, Human
uaucuugcaucuauacacaa

SEQ ID NO: 365617 - RNA, 23 nt, Human
ucaaaauaaugcgauuucaagcc

SEQ ID NO: 365618 - RNA, 21 nt, Human
ucaggcucgugcuccgguccg

SEQ ID NO: 365619 - RNA, 22 nt, Human
ucaggcugauauaaaaauaaca

SEQ ID NO: 365620 - RNA, 23 nt, Human
ucaggcugauauaaaaauaacaa

SEQ ID NO: 365621 - RNA, 20 nt, Human
uccaaaccuccuacccucaa

SEQ ID NO: 365622 - RNA, 22 nt, Human
uccaaaccuccuacccucaauc

SEQ ID NO: 365623 - RNA, 21 nt, Human
uccacccucaggcauggaacc

SEQ ID NO: 365624 - RNA, 21 nt, Human
ucccauccaaaccuccuaccc

SEQ ID NO: 365625 - RNA, 18 nt, Human
uccccucuccucccugca

SEQ ID NO: 365626 - RNA, 21 nt, Human
ugagcaacagucuugcuuuug

SEQ ID NO: 365627 - RNA, 18 nt, Human
ugagcagugaguuugcag

SEQ ID NO: 365628 - RNA, 19 nt, Human
ugcaaccccacuuacuucu

SEQ ID NO: 365629 - RNA, 19 nt, Human
uggcccuuccccucuccuc

SEQ ID NO: 365630 - RNA, 22 nt, Human
uggcuggagaaaggagccccag

SEQ ID NO: 365631 - RNA, 22 nt, Human
ugggaaggggcaaauccuaaug

SEQ ID NO: 365632 - RNA, 21 nt, Human
ugggauagaagcuuuguaguu

SEQ ID NO: 365633 - RNA, 22 nt, Human
ugggcacaggagacucaggcug

SEQ ID NO: 365634 - RNA, 20 nt, Human
uggguaggaagagaugggaa

SEQ ID NO: 365635 - RNA, 24 nt, Human
ugguugcaaccccacuuacuucug

SEQ ID NO: 365636 - RNA, 19 nt, Human
uuacuucugucucacuccc

SEQ ID NO: 365637 - RNA, 21 nt, Human
uuauaaaaccuguugcuuguc

SEQ ID NO: 365638 - RNA, 18 nt, Human
uuggaagucucauccagc

SEQ ID NO: 365639 - RNA, 20 nt, Human
uuuggaagucucauccagcu

SEQ ID NO: 365640 - RNA, 25 nt, Human
aaaauuuuaagcaaaauacaaauuc

SEQ ID NO: 365641 - RNA, 19 nt, Human
aaauauuagaaccaccugc

SEQ ID NO: 365642 - RNA, 19 nt, Human
aaauauuuguugcauccuc

SEQ ID NO: 365643 - RNA, 19 nt, Human
aaccaggcuguccucaauu

SEQ ID NO: 365644 - RNA, 24 nt, Human
aacuuauuaggaauuugagguaau

SEQ ID NO: 365645 - RNA, 19 nt, Human
aagaaccuuguuauaaaga

SEQ ID NO: 365646 - RNA, 23 nt, Human
aagaaccuuguuauaaagaacag

SEQ ID NO: 365647 - RNA, 19 nt, Human
aagaaggaaaugucaaagg

SEQ ID NO: 365648 - RNA, 20 nt, Human
aagcccacacucaggaaucc

SEQ ID NO: 365649 - RNA, 23 nt, Human
aauggaagaguugucuauuuuaa

SEQ ID NO: 365650 - RNA, 19 nt, Human
acagaacaaaaguaaaauu

SEQ ID NO: 365651 - RNA, 22 nt, Human
acagagcuaaaaauauuagaac

SEQ ID NO: 365652 - RNA, 22 nt, Human
accaaaaaugaaaguuuuucuc

SEQ ID NO: 365653 - RNA, 21 nt, Human
agaaaaaagcugagugcaaua

SEQ ID NO: 365654 - RNA, 20 nt, Human
agaaaacagccuagagauac

SEQ ID NO: 365655 - RNA, 21 nt, Human
agagggaggaguugggcuacc

SEQ ID NO: 365656 - RNA, 23 nt, Human
agcacccugcuaagcuuuuggga

SEQ ID NO: 365657 - RNA, 19 nt, Human
agcuaagacaaagaaggaa

SEQ ID NO: 365658 - RNA, 18 nt, Human
aggaaaugucaaaggaga

SEQ ID NO: 365659 - RNA, 19 nt, Human
aggaaaugucaaaggagac

SEQ ID NO: 365660 - RNA, 18 nt, Human
aggagagggaggaguugg

SEQ ID NO: 365661 - RNA, 20 nt, Human
augaaguuucagaagcccac

SEQ ID NO: 365662 - RNA, 22 nt, Human
cacccugcuaagcuuuugggac

SEQ ID NO: 365663 - RNA, 24 nt, Human
cacccugcuaagcuuuugggaccu

SEQ ID NO: 365664 - RNA, 22 nt, Human
caccugacuagcuccugccugu

SEQ ID NO: 365665 - RNA, 30 nt, Human
cacuaggaaagaaaaugggagcaggucccc

SEQ ID NO: 365666 - RNA, 18 nt, Human
cacucaggaauccucaaa

SEQ ID NO: 365667 - RNA, 24 nt, Human
cauggaacuuauugccacuagcca

SEQ ID NO: 365668 - RNA, 24 nt, Human
ccaccugcccuuuaguguaacaaa

SEQ ID NO: 365669 - RNA, 22 nt, Human
ccauuuggccauuaaauaaagg

SEQ ID NO: 365670 - RNA, 20 nt, Human
cccacacucaggaauccuca

SEQ ID NO: 365671 - RNA, 19 nt, Human
ccucaauuaaaaagcaaag

SEQ ID NO: 365672 - RNA, 20 nt, Human
ccucagcaaccuguggcuuc

SEQ ID NO: 365673 - RNA, 22 nt, Human
cucaaacccuaccuuuucaacu

SEQ ID NO: 365674 - RNA, 18 nt, Human
gaaagaaaaugggagcag

SEQ ID NO: 365675 - RNA, 18 nt, Human
gagaaaacagccuagaga

SEQ ID NO: 365676 - RNA, 20 nt, Human
gaggaguugggcuacccaga

SEQ ID NO: 365677 - RNA, 24 nt, Human
gcuguccucaauuaaaaagcaaag

SEQ ID NO: 365678 - RNA, 19 nt, Human
ggaacuaaaaugguuuucu

SEQ ID NO: 365679 - RNA, 19 nt, Human
ggaauccucaaacccuacc

SEQ ID NO: 365680 - RNA, 19 nt, Human
ggagaaaacagccuagaga

SEQ ID NO: 365681 - RNA, 24 nt, Human
ggagaaaacagccuagagauacgu

SEQ ID NO: 365682 - RNA, 21 nt, Human
ggaggaggagcaaggagaggg

SEQ ID NO: 365683 - RNA, 23 nt, Human
ggauuuugauaaaagucugaagc

SEQ ID NO: 365684 - RNA, 22 nt, Human
ggcuagaaucuguauacagcua

SEQ ID NO: 365685 - RNA, 23 nt, Human
guguaacaaaauaaacuagccuu

SEQ ID NO: 365686 - RNA, 21 nt, Human
guuuaaucaucuguguauuuc

SEQ ID NO: 365687 - RNA, 19 nt, Human
guuuauucgcagcucugcc

SEQ ID NO: 365688 - RNA, 26 nt, Human
uaaaaagcaaagcaaacuauaacuca

SEQ ID NO: 365689 - RNA, 22 nt, Human
uaagugcuuugccucagcaacc

SEQ ID NO: 365690 - RNA, 23 nt, Human
uaagugcuuugccucagcaaccu

SEQ ID NO: 365691 - RNA, 23 nt, Human
uaccagaagggaaucaacauggu

SEQ ID NO: 365692 - RNA, 20 nt, Human
uagaaaacaaagcaaauguu

SEQ ID NO: 365693 - RNA, 20 nt, Human
uaggaacacaccauaaaaca

SEQ ID NO: 365694 - RNA, 21 nt, Human
uauaaagaacagagcuaaaaa

SEQ ID NO: 365695 - RNA, 18 nt, Human
uauaauagauguuaaugu

SEQ ID NO: 365696 - RNA, 25 nt, Human
uauguuaggaacacaccauaaaaca

SEQ ID NO: 365697 - RNA, 25 nt, Human
ucaucuguguauuuccaauuugccu

SEQ ID NO: 365698 - RNA, 23 nt, Human
ugacauuucugaugagagcacau

SEQ ID NO: 365699 - RNA, 23 nt, Human
ugagagcacauaaaaauaaaaca

SEQ ID NO: 365700 - RNA, 19 nt, Human
ugaguguggcacaugcacc

SEQ ID NO: 365701 - RNA, 20 nt, Human
ugcaccugacuagcuccugc

SEQ ID NO: 365702 - RNA, 23 nt, Human
ugcaccugacuagcuccugccug

SEQ ID NO: 365703 - RNA, 19 nt, Human
ugccucagcaaccuguggc

SEQ ID NO: 365704 - RNA, 19 nt, Human
uuaaaaagcaaagcaaacu

SEQ ID NO: 365705 - RNA, 23 nt, Human
uuaaagcaaacauaagaaggauu

SEQ ID NO: 365706 - RNA, 18 nt, Human
uuauaaagaacagagcua

SEQ ID NO: 365707 - RNA, 22 nt, Human
uugacuguaagcuaaagucugu

SEQ ID NO: 365708 - RNA, 25 nt, Human
uugaucagugcuccaguugguggag

SEQ ID NO: 365709 - RNA, 24 nt, Human
uuugguaauauuugaugacauuuc

SEQ ID NO: 365710 - RNA, 24 nt, Human
uuuugggacccaucagaacuauau

SEQ ID NO: 365711 - RNA, 24 nt, Human
aaaaaaauccucucccagagcuga

SEQ ID NO: 365712 - RNA, 21 nt, Human
aaaacucaaguuaauuugcca

SEQ ID NO: 365713 - RNA, 21 nt, Human
aaaauaagucaacaauaacgu

SEQ ID NO: 365714 - RNA, 19 nt, Human
aaagaaaaaagcuccaagg

SEQ ID NO: 365715 - RNA, 20 nt, Human
aaagaacaaaguggaaaaau

SEQ ID NO: 365716 - RNA, 24 nt, Human
aaagugcugggauuacaggcguga

SEQ ID NO: 365717 - RNA, 24 nt, Human
aacaauaacguacuuccacccaga

SEQ ID NO: 365718 - RNA, 18 nt, Human
aacaccucccucuaaucu

SEQ ID NO: 365719 - RNA, 19 nt, Human
aaccugcacauucggcaca

SEQ ID NO: 365720 - RNA, 19 nt, Human
aagauccaacaaaccgcag

SEQ ID NO: 365721 - RNA, 18 nt, Human
aagcagaagaggaugucc

SEQ ID NO: 365722 - RNA, 18 nt, Human
aagcagaagaggaugucc

SEQ ID NO: 365723 - RNA, 22 nt, Human
aagcagaagaggauguccagga

SEQ ID NO: 365724 - RNA, 21 nt, Human
aagcccccagccccaccccac

SEQ ID NO: 365725 - RNA, 22 nt, Human
aagcccccagccccaccccacc

SEQ ID NO: 365726 - RNA, 22 nt, Human
aagcgugccgugagccuaaagc

SEQ ID NO: 365727 - RNA, 19 nt, Human
aaguagcugggauuacagg

SEQ ID NO: 365728 - RNA, 25 nt, Human
aaguagcugggauuacaggcgcccg

SEQ ID NO: 365729 - RNA, 19 nt, Human
aagugcugggauuacaggc

SEQ ID NO: 365730 - RNA, 19 nt, Human
aagugcugggauuacaggc

SEQ ID NO: 365731 - RNA, 26 nt, Human
aagugcugggauuacaggcgugagcc

SEQ ID NO: 365732 - RNA, 20 nt, Human
aaguuaauuugccacguaga

SEQ ID NO: 365733 - RNA, 23 nt, Human
aauaucagaacccaagggaggaa

SEQ ID NO: 365734 - RNA, 23 nt, Human
acaacagaaaaucaacaccuaaa

SEQ ID NO: 365735 - RNA, 21 nt, Human
acaauagaaaauccauaugga

SEQ ID NO: 365736 - RNA, 23 nt, Human
acaccucccucuaaucucaauuu

SEQ ID NO: 365737 - RNA, 23 nt, Human
acaggcgcccgccaccacgcccg

SEQ ID NO: 365738 - RNA, 24 nt, Human
acaggguuucacgauguuggccag

SEQ ID NO: 365739 - RNA, 21 nt, Human
acccuccaauaaugaacaaca

SEQ ID NO: 365740 - RNA, 24 nt, Human
acgauguuggccagacuggucucg

SEQ ID NO: 365741 - RNA, 26 nt, Human
agaaacagcuuuuucagccaacaaaa

SEQ ID NO: 365742 - RNA, 18 nt, Human
agacaggguuucacgaug

SEQ ID NO: 365743 - RNA, 20 nt, Human
agccaccgcauccggccuca

SEQ ID NO: 365744 - RNA, 23 nt, Human
agccauugaagauccaacaaacc

SEQ ID NO: 365745 - RNA, 19 nt, Human
aggaccacagugacauggu

SEQ ID NO: 365746 - RNA, 19 nt, Human
aggagcagagggaacagug

SEQ ID NO: 365747 - RNA, 22 nt, Human
agguggcuuucccaugccggga

SEQ ID NO: 365748 - RNA, 19 nt, Human
aguaacaauagaaaaucca

SEQ ID NO: 365749 - RNA, 25 nt, Human
aguaaugagacuacuacaagaagga

SEQ ID NO: 365750 - RNA, 20 nt, Human
auccucucccagagcugagg

SEQ ID NO: 365751 - RNA, 24 nt, Human
augauucucccgccucagcuuccc

SEQ ID NO: 365752 - RNA, 27 nt, Human
augguaacagacauacgcaagcgugcc

SEQ ID NO: 365753 - RNA, 18 nt, Human
auguguaagcaccaagaa

SEQ ID NO: 365754 - RNA, 20 nt, Human
auuucauccagugaggggaa

SEQ ID NO: 365755 - RNA, 22 nt, Human
auuucauccagugaggggaaca

SEQ ID NO: 365756 - RNA, 23 nt, Human
auuucauccagugaggggaacag

SEQ ID NO: 365757 - RNA, 24 nt, Human
auuuuugcauuuuuaguagagaca

SEQ ID NO: 365758 - RNA, 24 nt, Human
caaagugcugggauuacaggcgug

SEQ ID NO: 365759 - RNA, 20 nt, Human
caaaucuucuacucuauaac

SEQ ID NO: 365760 - RNA, 25 nt, Human
caagcccccagccccaccccacccc

SEQ ID NO: 365761 - RNA, 22 nt, Human
caccaagaagggaaagggagac

SEQ ID NO: 365762 - RNA, 25 nt, Human
caccaagaagggaaagggagacuga

SEQ ID NO: 365763 - RNA, 19 nt, Human
caccuuaaccucuccagca

SEQ ID NO: 365764 - RNA, 24 nt, Human
caccuuaaccucuccagcaucaaa

SEQ ID NO: 365765 - RNA, 24 nt, Human
cacgauguuggccagacuggucuc

SEQ ID NO: 365766 - RNA, 21 nt, Human
cacugcaaccccugcgucccg

SEQ ID NO: 365767 - RNA, 20 nt, Human
cagaaaaaaauccucuccca

SEQ ID NO: 365768 - RNA, 21 nt, Human
cagaaaaaaauccucucccag

SEQ ID NO: 365769 - RNA, 24 nt, Human
cagaaaaucaacaccuaaaaucuc

SEQ ID NO: 365770 - RNA, 21 nt, Human
cagaguaacaauagaaaaucc

SEQ ID NO: 365771 - RNA, 19 nt, Human
cagcauucagaagcguccu

SEQ ID NO: 365772 - RNA, 21 nt, Human
cagccaacaaaaccuucaaaa

SEQ ID NO: 365773 - RNA, 21 nt, Human
caggaaggauccaaagucuca

SEQ ID NO: 365774 - RNA, 23 nt, Human
caggaaggauccaaagucucacc

SEQ ID NO: 365775 - RNA, 25 nt, Human
caggcaccacaucauuuacccucca

SEQ ID NO: 365776 - RNA, 21 nt, Human
caggcgcccgccaccacgccc

SEQ ID NO: 365777 - RNA, 19 nt, Human
caggguuucacgauguugg

SEQ ID NO: 365778 - RNA, 24 nt, Human
caugauucucccgccucagcuucc

SEQ ID NO: 365779 - RNA, 24 nt, Human
cauucagaagcguccuggguucau

SEQ ID NO: 365780 - RNA, 22 nt, Human
cauucagaauuuuuauuuuaaa

SEQ ID NO: 365781 - RNA, 24 nt, Human
ccaaagucucaccauuacaggcau

SEQ ID NO: 365782 - RNA, 20 nt, Human
ccaaagugcugggauuacag

SEQ ID NO: 365783 - RNA, 22 nt, Human
ccaaagugcugggauuacaggc

SEQ ID NO: 365784 - RNA, 22 nt, Human
ccaaagugcugggauuacaggc

SEQ ID NO: 365785 - RNA, 24 nt, Human
ccaaagugcugggauuacaggcgu

SEQ ID NO: 365786 - RNA, 22 nt, Human
ccaaguagcugggauuacaggc

SEQ ID NO: 365787 - RNA, 21 nt, Human
ccacccagagcaaagugacag

SEQ ID NO: 365788 - RNA, 19 nt, Human
ccagaaaguugacaugaag

SEQ ID NO: 365789 - RNA, 18 nt, Human
ccauauggaaauauucac

SEQ ID NO: 365790 - RNA, 22 nt, Human
ccaucugaaggacagaaauugu

SEQ ID NO: 365791 - RNA, 21 nt, Human
cccaagggaggaaaagcuggc

SEQ ID NO: 365792 - RNA, 23 nt, Human
cccaaguagcugggauuacaggc

SEQ ID NO: 365793 - RNA, 24 nt, Human
cccaaguagcugggauuacaggcg

SEQ ID NO: 365794 - RNA, 20 nt, Human
cccagccccaccccaccccc

SEQ ID NO: 365795 - RNA, 18 nt, Human
ccccagccccaccccacc

SEQ ID NO: 365796 - RNA, 19 nt, Human
ccccagccccaccccaccc

SEQ ID NO: 365797 - RNA, 18 nt, Human
cccccagccccaccccac

SEQ ID NO: 365798 - RNA, 20 nt, Human
cccccagccccaccccaccc

SEQ ID NO: 365799 - RNA, 22 nt, Human
cccccagccccaccccacccca

SEQ ID NO: 365800 - RNA, 24 nt, Human
ccccugaccgcccgccuaggccuc

SEQ ID NO: 365801 - RNA, 20 nt, Human
ccuaaagaacaaaguggaaa

SEQ ID NO: 365802 - RNA, 21 nt, Human
ccuagugcggcaauaucagaa

SEQ ID NO: 365803 - RNA, 23 nt, Human
ccucaggaaggauccaaagucuc

SEQ ID NO: 365804 - RNA, 24 nt, Human
ccuguggcccaggcuagagugcaa

SEQ ID NO: 365805 - RNA, 24 nt, Human
cgcccuguggcccaggcuagagug

SEQ ID NO: 365806 - RNA, 24 nt, Human
cgucccggguucacaugauucucc

SEQ ID NO: 365807 - RNA, 19 nt, Human
cuaaaaucuccuaaagaac

SEQ ID NO: 365808 - RNA, 21 nt, Human
cuacuguuugaggagccagaa

SEQ ID NO: 365809 - RNA, 21 nt, Human
cuaggccucccaaagugcugg

SEQ ID NO: 365810 - RNA, 20 nt, Human
cuagugcggcaauaucagaa

SEQ ID NO: 365811 - RNA, 24 nt, Human
cucacugcaaccccugcgucccgg

SEQ ID NO: 365812 - RNA, 24 nt, Human
cucagcuucccaaguagcugggau

SEQ ID NO: 365813 - RNA, 18 nt, Human
cuccaauaaugaacaagg

SEQ ID NO: 365814 - RNA, 22 nt, Human
cucgauagcuaugugcauuuuu

SEQ ID NO: 365815 - RNA, 19 nt, Human
cucuccagcaucaaaucuu

SEQ ID NO: 365816 - RNA, 23 nt, Human
cugcaaccccugcgucccggguu

SEQ ID NO: 365817 - RNA, 24 nt, Human
cugcaaccccugcgucccggguuc

SEQ ID NO: 365818 - RNA, 21 nt, Human
cuuccacacucauauguaucu

SEQ ID NO: 365819 - RNA, 20 nt, Human
gaaauauucacaaucuucuc

SEQ ID NO: 365820 - RNA, 18 nt, Human
gaaccccugaccgcccgc

SEQ ID NO: 365821 - RNA, 20 nt, Human
gaccucaggcaccacaucau

SEQ ID NO: 365822 - RNA, 22 nt, Human
gagcaaagugacagugcacaua

SEQ ID NO: 365823 - RNA, 22 nt, Human
gauaauaaucgcucagaaaaaa

SEQ ID NO: 365824 - RNA, 23 nt, Human
gaucaugacuauuuauaaucucc

SEQ ID NO: 365825 - RNA, 22 nt, Human
gaucuccgcucacugcaacccc

SEQ ID NO: 365826 - RNA, 18 nt, Human
gauuacaggcgcccgcca

SEQ ID NO: 365827 - RNA, 18 nt, Human
gauuacaggcgugagcca

SEQ ID NO: 365828 - RNA, 20 nt, Human
gauuacaggcgugagccacc

SEQ ID NO: 365829 - RNA, 23 nt, Human
gauuacaggcgugagccaccgca

SEQ ID NO: 365830 - RNA, 18 nt, Human
gcccccagccccacccca

SEQ ID NO: 365831 - RNA, 20 nt, Human
gcccccagccccaccccacc

SEQ ID NO: 365832 - RNA, 23 nt, Human
gccucagcuucccaaguagcugg

SEQ ID NO: 365833 - RNA, 24 nt, Human
gccucagcuucccaaguagcuggg

SEQ ID NO: 365834 - RNA, 20 nt, Human
ggaacaaacacagagaaaau

SEQ ID NO: 365835 - RNA, 19 nt, Human
ggagggagguggaaggagg

SEQ ID NO: 365836 - RNA, 23 nt, Human
ggguucacaugauucucccgccu

SEQ ID NO: 365837 - RNA, 24 nt, Human
uaaagaaaaaagcuccaaggaaau

SEQ ID NO: 365838 - RNA, 18 nt, Human
uaaccucucuuuaaacac

SEQ ID NO: 365839 - RNA, 21 nt, Human
uaaccucucuuuaaacaccuc

SEQ ID NO: 365840 - RNA, 24 nt, Human
uaauuuuugcauuuuuaguagaga

SEQ ID NO: 365841 - RNA, 23 nt, Human
uacaggcgcccgccaccacgccc

SEQ ID NO: 365842 - RNA, 23 nt, Human
uacaggcgugagccaccgcaucc

SEQ ID NO: 365843 - RNA, 19 nt, Human
uacccuccaauaaugaaca

SEQ ID NO: 365844 - RNA, 23 nt, Human
uacuacaagaaggaguuauuuca

SEQ ID NO: 365845 - RNA, 22 nt, Human
uagagacaggguuucacgaugu

SEQ ID NO: 365846 - RNA, 24 nt, Human
uaguagagacaggguuucacgaug

SEQ ID NO: 365847 - RNA, 22 nt, Human
uauaaccucucuuuaaacaccu

SEQ ID NO: 365848 - RNA, 22 nt, Human
uaugaguuaaaauacaacagaa

SEQ ID NO: 365849 - RNA, 21 nt, Human
uauucaaaggcuccaggagca

SEQ ID NO: 365850 - RNA, 18 nt, Human
uauuuuagguuucuuauu

SEQ ID NO: 365851 - RNA, 19 nt, Human
ucaacaccuaaaaucuccu

SEQ ID NO: 365852 - RNA, 19 nt, Human
ucacaugauucucccgccu

SEQ ID NO: 365853 - RNA, 24 nt, Human
ucacugcaaccccugcgucccggg

SEQ ID NO: 365854 - RNA, 21 nt, Human
ucaggcaccacaucauuuacc

SEQ ID NO: 365855 - RNA, 25 nt, Human
ucagugagaaaugggacccugccuu

SEQ ID NO: 365856 - RNA, 24 nt, Human
ucccaaagugcugggauuacaggc

SEQ ID NO: 365857 - RNA, 24 nt, Human
ucccaaguagcugggauuacaggc

SEQ ID NO: 365858 - RNA, 21 nt, Human
ucccggguucacaugauucuc

SEQ ID NO: 365859 - RNA, 26 nt, Human
ucccuaaauucuuauugcaccuucua

SEQ ID NO: 365860 - RNA, 20 nt, Human
ucccucuaaucucaauuucc

SEQ ID NO: 365861 - RNA, 23 nt, Human
uccugaaacuuaaaguaaaaaaa

SEQ ID NO: 365862 - RNA, 24 nt, Human
ucuagaaaucacuuucucuucccu

SEQ ID NO: 365863 - RNA, 24 nt, Human
ucucgcccuguggcccaggcuaga

SEQ ID NO: 365864 - RNA, 18 nt, Human
ucuuuaaacaccucccuc

SEQ ID NO: 365865 - RNA, 21 nt, Human
ugaaagggcgacaagccccca

SEQ ID NO: 365866 - RNA, 21 nt, Human
ugaacaacauuucucccuaaa

SEQ ID NO: 365867 - RNA, 24 nt, Human
ugacaugaaguugcaaggucaccu

SEQ ID NO: 365868 - RNA, 18 nt, Human
ugagaaaggaauuaagua

SEQ ID NO: 365869 - RNA, 22 nt, Human
ugagaacuaagaaccaaaauac

SEQ ID NO: 365870 - RNA, 18 nt, Human
ugagccuaaagcaacaac

SEQ ID NO: 365871 - RNA, 22 nt, Human
ugagggagagguggcuuuccca

SEQ ID NO: 365872 - RNA, 24 nt, Human
ugagggagagguggcuuucccaug

SEQ ID NO: 365873 - RNA, 20 nt, Human
ugauucucccgccucagcuu

SEQ ID NO: 365874 - RNA, 20 nt, Human
ugccgugagccuaaagcaac

SEQ ID NO: 365875 - RNA, 21 nt, Human
ugcuauaaacauucuuugggg

SEQ ID NO: 365876 - RNA, 24 nt, Human
ugcugggauuacaggcgugagcca

SEQ ID NO: 365877 - RNA, 25 nt, Human
uggaaaaauaaugaaucucuaccaa

SEQ ID NO: 365878 - RNA, 18 nt, Human
uggcaaaguugucaugug

SEQ ID NO: 365879 - RNA, 24 nt, Human
uggccagacuggucucgaaccccu

SEQ ID NO: 365880 - RNA, 25 nt, Human
uggccagacuggucucgaaccccug

SEQ ID NO: 365881 - RNA, 19 nt, Human
uggcccaggcuagagugca

SEQ ID NO: 365882 - RNA, 21 nt, Human
ugggauuacaggcgcccgcca

SEQ ID NO: 365883 - RNA, 22 nt, Human
ugggauuacaggcgcccgccac

SEQ ID NO: 365884 - RNA, 24 nt, Human
ugggauuacaggcgcccgccacca

SEQ ID NO: 365885 - RNA, 18 nt, Human
ugggauuacaggcgugag

SEQ ID NO: 365886 - RNA, 19 nt, Human
ugggauuacaggcgugagc

SEQ ID NO: 365887 - RNA, 21 nt, Human
ugggauuacaggcgugagcca

SEQ ID NO: 365888 - RNA, 22 nt, Human
ugggauuacaggcgugagccac

SEQ ID NO: 365889 - RNA, 23 nt, Human
ugggauuacaggcgugagccacc

SEQ ID NO: 365890 - RNA, 24 nt, Human
ugggauuacaggcgugagccaccg

SEQ ID NO: 365891 - RNA, 21 nt, Human
uggucucgaaccccugaccgc

SEQ ID NO: 365892 - RNA, 19 nt, Human
uguaggaacaaacacagag

SEQ ID NO: 365893 - RNA, 21 nt, Human
uguggcccaggcuagagugca

SEQ ID NO: 365894 - RNA, 25 nt, Human
uguggcccaggcuagagugcaauga

SEQ ID NO: 365895 - RNA, 24 nt, Human
uuacaaauuccaaguuugcuauaa

SEQ ID NO: 365896 - RNA, 18 nt, Human
uuaguagagacaggguuu

SEQ ID NO: 365897 - RNA, 21 nt, Human
uucaaaauguccuucucagca

SEQ ID NO: 365898 - RNA, 22 nt, Human
uucaaguccccugagggcauuc

SEQ ID NO: 365899 - RNA, 18 nt, Human
uucacaugauucucccgc

SEQ ID NO: 365900 - RNA, 24 nt, Human
uuccaaguuugcuauaaacauucu

SEQ ID NO: 365901 - RNA, 23 nt, Human
uuccacacucauauguaucugcu

SEQ ID NO: 365902 - RNA, 27 nt, Human
uuccagaaacagcuuuuuuccuggugg

SEQ ID NO: 365903 - RNA, 19 nt, Human
uuggauggcucucccacga

SEQ ID NO: 365904 - RNA, 26 nt, Human
uugucaugugccaagcggccaauccc

SEQ ID NO: 365905 - RNA, 21 nt, Human
uuucacgauguuggccagacu

SEQ ID NO: 365906 - RNA, 19 nt, Human
uuucccaugccgggaggga

SEQ ID NO: 365907 - RNA, 24 nt, Human
uuuuuaguagagacaggguuucac

SEQ ID NO: 365908 - RNA, 20 nt, Human
uuuuugcauuuuuaguagag

SEQ ID NO: 365909 - RNA, 25 nt, Human
uuuuuuuuuuuugagacggagucuc

SEQ ID NO: 365910 - RNA, 27 nt, Human
aacacauaaauaauccaaccugaacgg

SEQ ID NO: 365911 - RNA, 19 nt, Human
aagguggugggaaacugga

SEQ ID NO: 365912 - RNA, 18 nt, Human
accgauccuggagucucu

SEQ ID NO: 365913 - RNA, 18 nt, Human
agagaggguuaaagugcu

SEQ ID NO: 365914 - RNA, 19 nt, Human
agagggaggggagaguggc

SEQ ID NO: 365915 - RNA, 27 nt, Human
aggaagagggaggggagaguggcccaa

SEQ ID NO: 365916 - RNA, 22 nt, Human
aggggaugggggaaggaagagg

SEQ ID NO: 365917 - RNA, 23 nt, Human
auucuggagcugagucuggggaa

SEQ ID NO: 365918 - RNA, 21 nt, Human
cacccuucccccagcuuccca

SEQ ID NO: 365919 - RNA, 18 nt, Human
cagaaccugcggaggccg

SEQ ID NO: 365920 - RNA, 18 nt, Human
cagcuucccaauucuacc

SEQ ID NO: 365921 - RNA, 19 nt, Human
cagggauucuuuuccaccc

SEQ ID NO: 365922 - RNA, 21 nt, Human
ccacaacacauaaauaaucca

SEQ ID NO: 365923 - RNA, 20 nt, Human
ccugcucucugcucugguuu

SEQ ID NO: 365924 - RNA, 23 nt, Human
cgaagaagguauucuggagcuga

SEQ ID NO: 365925 - RNA, 20 nt, Human
cucccaccccugccuggccc

SEQ ID NO: 365926 - RNA, 22 nt, Human
gaagaagguauucuggagcuga

SEQ ID NO: 365927 - RNA, 19 nt, Human
gaagagaggguuaaagugc

SEQ ID NO: 365928 - RNA, 21 nt, Human
gaaggaagagggaggggagag

SEQ ID NO: 365929 - RNA, 22 nt, Human
gaaggaagagggaggggagagu

SEQ ID NO: 365930 - RNA, 22 nt, Human
gaccugucuucccuccaauccc

SEQ ID NO: 365931 - RNA, 23 nt, Human
gaccugucuucccuccaaucccc

SEQ ID NO: 365932 - RNA, 22 nt, Human
gcagcgaagaagguauucugga

SEQ ID NO: 365933 - RNA, 22 nt, Human
ggaaaggggaugggggaaggaa

SEQ ID NO: 365934 - RNA, 21 nt, Human
ggccuggagcgcagaaccugc

SEQ ID NO: 365935 - RNA, 18 nt, Human
ggcucucccaccccugcc

SEQ ID NO: 365936 - RNA, 23 nt, Human
gggaagagaggguuaaagugcug

SEQ ID NO: 365937 - RNA, 18 nt, Human
gggaaggaagagggaggg

SEQ ID NO: 365938 - RNA, 21 nt, Human
gggaagguggggaggaaaggg

SEQ ID NO: 365939 - RNA, 21 nt, Human
gggaagguggggaggaaaggg

SEQ ID NO: 365940 - RNA, 22 nt, Human
gggaugggggaaggaagaggga

SEQ ID NO: 365941 - RNA, 19 nt, Human
guccugcucucugcucugg

SEQ ID NO: 365942 - RNA, 22 nt, Human
gucuagaccugucuucccucca

SEQ ID NO: 365943 - RNA, 22 nt, Human
uccaagguggugggaaacugga

SEQ ID NO: 365944 - RNA, 18 nt, Human
uccaaucccccuucucua

SEQ ID NO: 365945 - RNA, 19 nt, Human
uccaaucccccuucucuag

SEQ ID NO: 365946 - RNA, 19 nt, Human
ucccccagcuucccaauuc

SEQ ID NO: 365947 - RNA, 25 nt, Human
ucccccagcuucccaauucuaccag

SEQ ID NO: 365948 - RNA, 21 nt, Human
ucucugacuccggccuggagc

SEQ ID NO: 365949 - RNA, 22 nt, Human
ugagucuggggaagguggggag

SEQ ID NO: 365950 - RNA, 24 nt, Human
ugagucuggggaagguggggagga

SEQ ID NO: 365951 - RNA, 21 nt, Human
ugggaggaguccaagguggug

SEQ ID NO: 365952 - RNA, 25 nt, Human
uggggaagguggggaggaaaggggg

SEQ ID NO: 365953 - RNA, 22 nt, Human
uggggaggaaaggggauggggg

SEQ ID NO: 365954 - RNA, 22 nt, Human
ugggggaaggaagagggagggg

SEQ ID NO: 365955 - RNA, 24 nt, Human
aagaacagcaaggcagcccuuugc

SEQ ID NO: 365956 - RNA, 26 nt, Human
aagaacagcaaggcagcccuuugcac

SEQ ID NO: 365957 - RNA, 18 nt, Human
aagaggaugaauuuggcu

SEQ ID NO: 365958 - RNA, 18 nt, Human
aagccccuggcagaccag

SEQ ID NO: 365959 - RNA, 21 nt, Human
aagccccuggcagaccagcuc

SEQ ID NO: 365960 - RNA, 23 nt, Human
acagcaaggcagcccuuugcaca

SEQ ID NO: 365961 - RNA, 20 nt, Human
caagaacagcaaggcagccc

SEQ ID NO: 365962 - RNA, 23 nt, Human
cacaguucccacuggggugggga

SEQ ID NO: 365963 - RNA, 23 nt, Human
cagcccagcuucaagaacagcaa

SEQ ID NO: 365964 - RNA, 22 nt, Human
cauuguuucugacaucacaccu

SEQ ID NO: 365965 - RNA, 23 nt, Human
ccaccgaguuaguuucucuggca

SEQ ID NO: 365966 - RNA, 21 nt, Human
ccacugggguggggaggcugg

SEQ ID NO: 365967 - RNA, 23 nt, Human
cccauggccccggaagaccuguu

SEQ ID NO: 365968 - RNA, 20 nt, Human
ccccggaagaccuguugggg

SEQ ID NO: 365969 - RNA, 22 nt, Human
ccgcucaccuccuuuuagccaa

SEQ ID NO: 365970 - RNA, 20 nt, Human
ccuagacagguauuucugga

SEQ ID NO: 365971 - RNA, 20 nt, Human
cuccacuggcuuccucucca

SEQ ID NO: 365972 - RNA, 24 nt, Human
cugcauuccacaucagaguuguuu

SEQ ID NO: 365973 - RNA, 18 nt, Human
cuggaaaaggaucuggua

SEQ ID NO: 365974 - RNA, 24 nt, Human
gaauuuggcucuaaacaaaugccc

SEQ ID NO: 365975 - RNA, 18 nt, Human
gccaaagugggaagcccc

SEQ ID NO: 365976 - RNA, 23 nt, Human
gccacacgaaggcugaaccagca

SEQ ID NO: 365977 - RNA, 23 nt, Human
gcccagcuucaagaacagcaagg

SEQ ID NO: 365978 - RNA, 18 nt, Human
gcugaaccagcaaagugg

SEQ ID NO: 365979 - RNA, 21 nt, Human
ggcagagugccgcucaccucc

SEQ ID NO: 365980 - RNA, 19 nt, Human
ggccccggaagaccuguug

SEQ ID NO: 365981 - RNA, 19 nt, Human
uaagaggaugaauuuggcu

SEQ ID NO: 365982 - RNA, 23 nt, Human
uaagccaaagugggaagccccug

SEQ ID NO: 365983 - RNA, 25 nt, Human
uaccaggagccacacaaagguugac

SEQ ID NO: 365984 - RNA, 25 nt, Human
uaccaggagccacacgaaggcugaa

SEQ ID NO: 365985 - RNA, 23 nt, Human
ucagaaaaauaagccaaaguggg

SEQ ID NO: 365986 - RNA, 21 nt, Human
ucagcuuucuggaugucauug

SEQ ID NO: 365987 - RNA, 19 nt, Human
uccacuggcuuccucucca

SEQ ID NO: 365988 - RNA, 19 nt, Human
ugaaccagcaaaguggagg

SEQ ID NO: 365989 - RNA, 21 nt, Human
ugacuacacagaagcaauucc

SEQ ID NO: 365990 - RNA, 22 nt, Human
ugacuacacagaagcaauucca

SEQ ID NO: 365991 - RNA, 22 nt, Human
ugcccauggccccggaagaccu

SEQ ID NO: 365992 - RNA, 22 nt, Human
uucaagaacagcaaggcagccc

SEQ ID NO: 365993 - RNA, 20 nt, Human
uuccuagacagguauuucug

SEQ ID NO: 365994 - RNA, 24 nt, Human
uuucuggaugucauuguuucugac

SEQ ID NO: 365995 - RNA, 28 nt, Human
uuugcacaguucccacugggguggggag

SEQ ID NO: 365996 - RNA, 18 nt, Human
uuuuauugacuacacaga

SEQ ID NO: 365997 - RNA, 24 nt, Human
aaagugcugggauuacaggcguga

SEQ ID NO: 365998 - RNA, 21 nt, Human
aacacaguuugcagauaggag

SEQ ID NO: 365999 - RNA, 24 nt, Human
aaguagcuggaacuacgggugugu

SEQ ID NO: 366000 - RNA, 19 nt, Human
aagugcugggauuacaggc

SEQ ID NO: 366001 - RNA, 19 nt, Human
aagugcugggauuacaggc

SEQ ID NO: 366002 - RNA, 26 nt, Human
aagugcugggauuacaggcgugagcc

SEQ ID NO: 366003 - RNA, 22 nt, Human
accauguuggccaggcuggucu

SEQ ID NO: 366004 - RNA, 18 nt, Human
acgggguuucaccauguu

SEQ ID NO: 366005 - RNA, 23 nt, Human
acgggguuucaccauguuggcca

SEQ ID NO: 366006 - RNA, 24 nt, Human
acgggguuucaccauguuggccag

SEQ ID NO: 366007 - RNA, 20 nt, Human
acucucguugcccaggcugg

SEQ ID NO: 366008 - RNA, 21 nt, Human
acucucguugcccaggcugga

SEQ ID NO: 366009 - RNA, 23 nt, Human
acucucguugcccaggcuggagu

SEQ ID NO: 366010 - RNA, 24 nt, Human
acucucguugcccaggcuggagug

SEQ ID NO: 366011 - RNA, 21 nt, Human
agcaaugcugccucagccucc

SEQ ID NO: 366012 - RNA, 23 nt, Human
agcugccuguucccagagguugg

SEQ ID NO: 366013 - RNA, 18 nt, Human
agugcugggauuacaggc

SEQ ID NO: 366014 - RNA, 18 nt, Human
augccaccagaucagagc

SEQ ID NO: 366015 - RNA, 24 nt, Human
caaagugcugggauuacaggcgug

SEQ ID NO: 366016 - RNA, 23 nt, Human
caaugcugccucagccucccaag

SEQ ID NO: 366017 - RNA, 19 nt, Human
cacaguuugcagauaggag

SEQ ID NO: 366018 - RNA, 21 nt, Human
caccauguuggccaggcuggu

SEQ ID NO: 366019 - RNA, 23 nt, Human
caccauguuggccaggcuggucu

SEQ ID NO: 366020 - RNA, 24 nt, Human
caccauguuggccaggcuggucuu

SEQ ID NO: 366021 - RNA, 27 nt, Human
caccauguuggccaggcuggucuugaa

SEQ ID NO: 366022 - RNA, 24 nt, Human
caccugcuuuggccucccaaagug

SEQ ID NO: 366023 - RNA, 19 nt, Human
cacugugggcugccugggc

SEQ ID NO: 366024 - RNA, 21 nt, Human
cagaugccaccagaucagagc

SEQ ID NO: 366025 - RNA, 21 nt, Human
cagcagugcuaccugucccga

SEQ ID NO: 366026 - RNA, 23 nt, Human
cagccuccaccucccggguucaa

SEQ ID NO: 366027 - RNA, 24 nt, Human
caggcgugagccacugugcccggc

SEQ ID NO: 366028 - RNA, 24 nt, Human
cauguuggccaggcuggucuugaa

SEQ ID NO: 366029 - RNA, 22 nt, Human
ccaaagugcugggauuacaggc

SEQ ID NO: 366030 - RNA, 22 nt, Human
ccaaagugcugggauuacaggc

SEQ ID NO: 366031 - RNA, 24 nt, Human
ccaaagugcugggauuacaggcgu

SEQ ID NO: 366032 - RNA, 19 nt, Human
ccacgccagguccuuugcc

SEQ ID NO: 366033 - RNA, 19 nt, Human
ccagagguugggcuggggc

SEQ ID NO: 366034 - RNA, 20 nt, Human
ccagguccuuugcccuggcu

SEQ ID NO: 366035 - RNA, 21 nt, Human
cccaucacacugcucuuccug

SEQ ID NO: 366036 - RNA, 21 nt, Human
ccccaucacacugcucuuccu

SEQ ID NO: 366037 - RNA, 18 nt, Human
cccccuccaggcggggac

SEQ ID NO: 366038 - RNA, 33 nt, Human
ccucccggguucaagcaaugcugccucagcccc

SEQ ID NO: 366039 - RNA, 24 nt, Human
ccugcuuuggccucccaaagugcu

SEQ ID NO: 366040 - RNA, 21 nt, Human
ccuggccuuggguaauccacc

SEQ ID NO: 366041 - RNA, 22 nt, Human
ccuguucccagagguugggcug

SEQ ID NO: 366042 - RNA, 19 nt, Human
cgcaagggaaagggacuag

SEQ ID NO: 366043 - RNA, 24 nt, Human
cgggguuucaccauguuggccagg

SEQ ID NO: 366044 - RNA, 20 nt, Human
cguugcccaggcuggagugc

SEQ ID NO: 366045 - RNA, 22 nt, Human
cguugcccaggcuggagugcaa

SEQ ID NO: 366046 - RNA, 24 nt, Human
cucauugcagccuccaccucccgg

SEQ ID NO: 366047 - RNA, 23 nt, Human
cuccuggccuuggguaauccacc

SEQ ID NO: 366048 - RNA, 19 nt, Human
cucucguugcccaggcugg

SEQ ID NO: 366049 - RNA, 23 nt, Human
cugccucagccucccaaguagcu

SEQ ID NO: 366050 - RNA, 24 nt, Human
cugcugccucuuggucccagggug

SEQ ID NO: 366051 - RNA, 24 nt, Human
cuggagugcaauggcaugaucuca

SEQ ID NO: 366052 - RNA, 23 nt, Human
cuuccugugcucuggcugguggc

SEQ ID NO: 366053 - RNA, 24 nt, Human
cuuggguaauccaccugcuuuggc

SEQ ID NO: 366054 - RNA, 24 nt, Human
gagacgggguuucaccauguuggc

SEQ ID NO: 366055 - RNA, 19 nt, Human
gagcugccuguucccagag

SEQ ID NO: 366056 - RNA, 19 nt, Human
gaggcccagccacuggggg

SEQ ID NO: 366057 - RNA, 22 nt, Human
gaggcccagccacuggggguuu

SEQ ID NO: 366058 - RNA, 18 nt, Human
gauuacaggcgugagcca

SEQ ID NO: 366059 - RNA, 19 nt, Human
gauuacaggcgugagccac

SEQ ID NO: 366060 - RNA, 21 nt, Human
gauuacaggcgugagccacug

SEQ ID NO: 366061 - RNA, 24 nt, Human
gcccaggcuggagugcaauggcau

SEQ ID NO: 366062 - RNA, 19 nt, Human
gcccauggcuacgugcagc

SEQ ID NO: 366063 - RNA, 23 nt, Human
gcccauggcuacgugcagcacug

SEQ ID NO: 366064 - RNA, 24 nt, Human
gccuguucccagagguugggcugg

SEQ ID NO: 366065 - RNA, 19 nt, Human
gcugccuccagcccugucc

SEQ ID NO: 366066 - RNA, 19 nt, Human
gcugccugggcuggggcug

SEQ ID NO: 366067 - RNA, 22 nt, Human
gcuuuggccucccaaagugcug

SEQ ID NO: 366068 - RNA, 23 nt, Human
gcuuuuuuuuuuuuuuuuuuggc

SEQ ID NO: 366069 - RNA, 21 nt, Human
ggaaguggccacgccaggucc

SEQ ID NO: 366070 - RNA, 18 nt, Human
ggcaaagccgggucuucc

SEQ ID NO: 366071 - RNA, 21 nt, Human
ggcuggggcaggaggaagugg

SEQ ID NO: 366072 - RNA, 23 nt, Human
ggcuggucuugaacuccuggccu

SEQ ID NO: 366073 - RNA, 21 nt, Human
gggcuggggcaggaggaagug

SEQ ID NO: 366074 - RNA, 18 nt, Human
gggcuggggcuguggcug

SEQ ID NO: 366075 - RNA, 23 nt, Human
gggguuucaccauguuggccagg

SEQ ID NO: 366076 - RNA, 23 nt, Human
gguaauccaccugcuuuggccuc

SEQ ID NO: 366077 - RNA, 24 nt, Human
guaauccaccugcuuuggccuccc

SEQ ID NO: 366078 - RNA, 23 nt, Human
guagagacgggguuucaccaugu

SEQ ID NO: 366079 - RNA, 18 nt, Human
guccaggauguucccugu

SEQ ID NO: 366080 - RNA, 18 nt, Human
gugcccggccugcccugg

SEQ ID NO: 366081 - RNA, 22 nt, Human
gugcuaccugucccgagccagg

SEQ ID NO: 366082 - RNA, 19 nt, Human
guggugcccauaagacuug

SEQ ID NO: 366083 - RNA, 23 nt, Human
uacaggcgugagccacugugccc

SEQ ID NO: 366084 - RNA, 23 nt, Human
uacaggcgugagccacugugccc

SEQ ID NO: 366085 - RNA, 24 nt, Human
uacgggugugugccaccacaccca

SEQ ID NO: 366086 - RNA, 22 nt, Human
uagagacgggguuucaccaugu

SEQ ID NO: 366087 - RNA, 24 nt, Human
uaguagagacgggguuucaccaug

SEQ ID NO: 366088 - RNA, 26 nt, Human
uaguagagacgggguuucaccauguu

SEQ ID NO: 366089 - RNA, 19 nt, Human
ucacacugcucuuccugug

SEQ ID NO: 366090 - RNA, 22 nt, Human
ucacccagcagggccguguccc

SEQ ID NO: 366091 - RNA, 23 nt, Human
ucacucucguugcccaggcugga

SEQ ID NO: 366092 - RNA, 20 nt, Human
ucagccucccaaguagcugg

SEQ ID NO: 366093 - RNA, 19 nt, Human
ucaguccuccccguagccu

SEQ ID NO: 366094 - RNA, 24 nt, Human
ucauugcagccuccaccucccggg

SEQ ID NO: 366095 - RNA, 25 nt, Human
ucauugcagccuccaccucccgggu

SEQ ID NO: 366096 - RNA, 24 nt, Human
ucccaaagugcugggauuacaggc

SEQ ID NO: 366097 - RNA, 24 nt, Human
ucccaaguagcuggaacuacgggu

SEQ ID NO: 366098 - RNA, 21 nt, Human
ucccagagguugggcuggggc

SEQ ID NO: 366099 - RNA, 18 nt, Human
uccccguagccuucugug

SEQ ID NO: 366100 - RNA, 20 nt, Human
ucuugaacuccuggccuugg

SEQ ID NO: 366101 - RNA, 20 nt, Human
ugcagauaggagcugccugu

SEQ ID NO: 366102 - RNA, 20 nt, Human
ugcagauaggagcugccugu

SEQ ID NO: 366103 - RNA, 20 nt, Human
ugcagccuccaccucccggg

SEQ ID NO: 366104 - RNA, 23 nt, Human
ugccaccacacccagcuuuuuug

SEQ ID NO: 366105 - RNA, 18 nt, Human
ugcccaggcuggagugca

SEQ ID NO: 366106 - RNA, 21 nt, Human
ugcccaggcuggagugcaaug

SEQ ID NO: 366107 - RNA, 24 nt, Human
ugcccaggcuggagugcaauggca

SEQ ID NO: 366108 - RNA, 18 nt, Human
ugcccggccugcccuggc

SEQ ID NO: 366109 - RNA, 19 nt, Human
ugcccuggcuuuuuaaguc

SEQ ID NO: 366110 - RNA, 24 nt, Human
ugccucagccucccaaguagcugg

SEQ ID NO: 366111 - RNA, 26 nt, Human
ugccuccagcccuguccucucagucc

SEQ ID NO: 366112 - RNA, 19 nt, Human
ugccugggcuggggcugug

SEQ ID NO: 366113 - RNA, 21 nt, Human
ugccugggcuggggcuguggc

SEQ ID NO: 366114 - RNA, 24 nt, Human
ugccugggcuggggcuguggccuc

SEQ ID NO: 366115 - RNA, 24 nt, Human
ugcugggauuacaggcgugagcca

SEQ ID NO: 366116 - RNA, 24 nt, Human
uggaacuacgggugugugccacca

SEQ ID NO: 366117 - RNA, 19 nt, Human
uggagugcaauggcaugau

SEQ ID NO: 366118 - RNA, 24 nt, Human
uggagugcaauggcaugaucucag

SEQ ID NO: 366119 - RNA, 24 nt, Human
uggcaugaucucagcucauugcag

SEQ ID NO: 366120 - RNA, 24 nt, Human
uggccaggcuggucuugaacuccu

SEQ ID NO: 366121 - RNA, 24 nt, Human
uggccuuggguaauccaccugcuu

SEQ ID NO: 366122 - RNA, 22 nt, Human
uggcuuuuuuuuuuuuuuuuuu

SEQ ID NO: 366123 - RNA, 18 nt, Human
ugggauuacaggcgugag

SEQ ID NO: 366124 - RNA, 21 nt, Human
ugggauuacaggcgugagcca

SEQ ID NO: 366125 - RNA, 22 nt, Human
ugggauuacaggcgugagccac

SEQ ID NO: 366126 - RNA, 22 nt, Human
ugggauuacaggcgugagccac

SEQ ID NO: 366127 - RNA, 22 nt, Human
ugggauuacaggcgugagccac

SEQ ID NO: 366128 - RNA, 24 nt, Human
ugggauuacaggcgugagccacug

SEQ ID NO: 366129 - RNA, 26 nt, Human
ugggauuacaggcgugagccacugug

SEQ ID NO: 366130 - RNA, 18 nt, Human
ugugagggcaaagccggg

SEQ ID NO: 366131 - RNA, 20 nt, Human
ugugugccaccacacccagc

SEQ ID NO: 366132 - RNA, 18 nt, Human
uuaguagagacgggguuu

SEQ ID NO: 366133 - RNA, 22 nt, Human
uuaguagagacgggguuucacc

SEQ ID NO: 366134 - RNA, 24 nt, Human
uuaguagagacgggguuucaccau

SEQ ID NO: 366135 - RNA, 24 nt, Human
uucacucucguugcccaggcugga

SEQ ID NO: 366136 - RNA, 20 nt, Human
uugcagccuccaccucccgg

SEQ ID NO: 366137 - RNA, 23 nt, Human
uugcagccuccaccucccggguu

SEQ ID NO: 366138 - RNA, 24 nt, Human
uugcagccuccaccucccggguuc

SEQ ID NO: 366139 - RNA, 18 nt, Human
uugcccaggcuggagugc

SEQ ID NO: 366140 - RNA, 24 nt, Human
uuucaccauguuggccaggcuggu

SEQ ID NO: 366141 - RNA, 24 nt, Human
uuucacucucguugcccaggcugg

SEQ ID NO: 366142 - RNA, 19 nt, Human
uuuggccucccaaagugcu

SEQ ID NO: 366143 - RNA, 24 nt, Human
uuuuuaguagagacgggguuucac

SEQ ID NO: 366144 - RNA, 23 nt, Human
uuuuuuaguagagacgggguuuc

SEQ ID NO: 366145 - RNA, 25 nt, Human
uuuuuuguauuuuuuaguagagacg

SEQ ID NO: 366146 - RNA, 23 nt, Human
uuuuuuuuuuuggcagggggugg

SEQ ID NO: 366147 - RNA, 20 nt, Human
uuuuuuuuuuuuggcagggg

SEQ ID NO: 366148 - RNA, 25 nt, Human
uuuuuuuuuuuuuuuuuggcagggg

SEQ ID NO: 366149 - RNA, 18 nt, Human
aaccuccaaaagcaccuc

SEQ ID NO: 366150 - RNA, 22 nt, Human
aacugagcuugcacaaagccca

SEQ ID NO: 366151 - RNA, 19 nt, Human
aagacaaagauccuagagg

SEQ ID NO: 366152 - RNA, 24 nt, Human
aagcaccuccagccagaagacaaa

SEQ ID NO: 366153 - RNA, 22 nt, Human
aaggcuccaaggggcuggauuc

SEQ ID NO: 366154 - RNA, 20 nt, Human
acccaaccuccaaaagcacc

SEQ ID NO: 366155 - RNA, 21 nt, Human
acccaaccuccaaaagcaccu

SEQ ID NO: 366156 - RNA, 25 nt, Human
caaaagcaccuccagccagaagaca

SEQ ID NO: 366157 - RNA, 21 nt, Human
caaacaaauuuccuucccgau

SEQ ID NO: 366158 - RNA, 20 nt, Human
caaagauccuagaggcccac

SEQ ID NO: 366159 - RNA, 22 nt, Human
caaauuuccuucccgauaaggc

SEQ ID NO: 366160 - RNA, 22 nt, Human
caaccuccaaaagcaccuccag

SEQ ID NO: 366161 - RNA, 24 nt, Human
caaccuccaaaagcaccuccagcc

SEQ ID NO: 366162 - RNA, 19 nt, Human
cacaaagcccagagacacu

SEQ ID NO: 366163 - RNA, 25 nt, Human
cacaaagcccagagacagcggaccg

SEQ ID NO: 366164 - RNA, 21 nt, Human
cacaggcuugcuccauccccu

SEQ ID NO: 366165 - RNA, 20 nt, Human
cacccaaccuccaaaagcac

SEQ ID NO: 366166 - RNA, 25 nt, Human
caccuccucuuccgcugcuuuaguc

SEQ ID NO: 366167 - RNA, 18 nt, Human
cagcacccaaccuccaaa

SEQ ID NO: 366168 - RNA, 22 nt, Human
cagcacccaaccuccaaaagca

SEQ ID NO: 366169 - RNA, 18 nt, Human
cagugagccuccuagccc

SEQ ID NO: 366170 - RNA, 21 nt, Human
cccagcacccaaccuccaaaa

SEQ ID NO: 366171 - RNA, 23 nt, Human
cccagcacccaaccuccaaaagc

SEQ ID NO: 366172 - RNA, 22 nt, Human
ccuccagccagaagacaaagau

SEQ ID NO: 366173 - RNA, 18 nt, Human
cgaucggccagcucuggc

SEQ ID NO: 366174 - RNA, 21 nt, Human
cucugggcuugggcccagcuu

SEQ ID NO: 366175 - RNA, 20 nt, Human
gacccagggaacugagccca

SEQ ID NO: 366176 - RNA, 21 nt, Human
gagcagcagcaggagcuggaa

SEQ ID NO: 366177 - RNA, 23 nt, Human
gauaaggcagccgcgugagagga

SEQ ID NO: 366178 - RNA, 19 nt, Human
gcacccaaccuccaaaagc

SEQ ID NO: 366179 - RNA, 22 nt, Human
gcagcagcaggagcuggaacag

SEQ ID NO: 366180 - RNA, 20 nt, Human
gcaggcaggggcucugggcu

SEQ ID NO: 366181 - RNA, 18 nt, Human
gcccagagacacugaccu

SEQ ID NO: 366182 - RNA, 21 nt, Human
gcccagagacacugaccugau

SEQ ID NO: 366183 - RNA, 20 nt, Human
gccugaaccgccccucgugc

SEQ ID NO: 366184 - RNA, 23 nt, Human
gcuugcacaaagcccagagacac

SEQ ID NO: 366185 - RNA, 19 nt, Human
ggaaggagggacccugcag

SEQ ID NO: 366186 - RNA, 20 nt, Human
ggcaggggcucugggcuugg

SEQ ID NO: 366187 - RNA, 21 nt, Human
ggcagugagccuccuagcccc

SEQ ID NO: 366188 - RNA, 22 nt, Human
ggggcaggcaggggcucugggc

SEQ ID NO: 366189 - RNA, 23 nt, Human
uaaggcagccgcgugagaggagc

SEQ ID NO: 366190 - RNA, 21 nt, Human
uagccagaaaugacuucucag

SEQ ID NO: 366191 - RNA, 22 nt, Human
ucacaggcuugcuccauccccu

SEQ ID NO: 366192 - RNA, 22 nt, Human
ucagagcagcagcaggagcugg

SEQ ID NO: 366193 - RNA, 21 nt, Human
uccaaaagcaccuccagccag

SEQ ID NO: 366194 - RNA, 22 nt, Human
uccaaaagcaccuccagccaga

SEQ ID NO: 366195 - RNA, 21 nt, Human
uccccuggggcaggcaggggc

SEQ ID NO: 366196 - RNA, 21 nt, Human
uccccuggggcaggcaggggc

SEQ ID NO: 366197 - RNA, 19 nt, Human
ucugcaaagcucgaaggug

SEQ ID NO: 366198 - RNA, 19 nt, Human
ugaaugcccagcacccaac

SEQ ID NO: 366199 - RNA, 27 nt, Human
ugacaggaaggagggacccugcagacc

SEQ ID NO: 366200 - RNA, 22 nt, Human
ugcccagcacccaaccuccaaa

SEQ ID NO: 366201 - RNA, 19 nt, Human
uggcgccugaaccgccccu

SEQ ID NO: 366202 - RNA, 22 nt, Human
ugggaauaaacccuuuucaaac

SEQ ID NO: 366203 - RNA, 18 nt, Human
ugugucagucuuuauuug

SEQ ID NO: 366204 - RNA, 21 nt, Human
uugcgcauggagggcugaccg

SEQ ID NO: 366205 - RNA, 21 nt, Human
uuuucugugucagucuuuauu

SEQ ID NO: 366206 - RNA, 18 nt, Human
uuuuuuuuuuuuuuuuug

SEQ ID NO: 366207 - RNA, 28 nt, Human
uuuuuuuuuuuuuuuuugguuuguuuuu

SEQ ID NO: 366208 - RNA, 23 nt, Human
uuuuuuuuuuuuuuuuuugguuu

SEQ ID NO: 366209 - RNA, 21 nt, Human
aagggcacagcaccaacagag

SEQ ID NO: 366210 - RNA, 23 nt, Human
acacacacacacacacacacaca

SEQ ID NO: 366211 - RNA, 23 nt, Human
acacacacacacacacacacaca

SEQ ID NO: 366212 - RNA, 23 nt, Human
acacacacacacacacacacaca

SEQ ID NO: 366213 - RNA, 23 nt, Human
acacacacacacacacacacaca

SEQ ID NO: 366214 - RNA, 23 nt, Human
acacacacacacacacacacaca

SEQ ID NO: 366215 - RNA, 23 nt, Human
acacacacacacacacacacaca

SEQ ID NO: 366216 - RNA, 23 nt, Human
acacacacacacacacacacaca

SEQ ID NO: 366217 - RNA, 22 nt, Human
acacacacacacacagacaaaa

SEQ ID NO: 366218 - RNA, 27 nt, Human
acacacagacaaaaccacagggcuaag

SEQ ID NO: 366219 - RNA, 27 nt, Human
acacggacaaagugcgggcuuuggggc

SEQ ID NO: 366220 - RNA, 19 nt, Human
acacugaggccugggaguc

SEQ ID NO: 366221 - RNA, 22 nt, Human
acaggccuucaacacacccugc

SEQ ID NO: 366222 - RNA, 21 nt, Human
accaacagagggauggagaga

SEQ ID NO: 366223 - RNA, 31 nt, Human
accaagaacacacacacacacacacacacag

SEQ ID NO: 366224 - RNA, 23 nt, Human
agacaaaaccacagggcuaagac

SEQ ID NO: 366225 - RNA, 21 nt, Human
agacagagcgagggccaugug

SEQ ID NO: 366226 - RNA, 24 nt, Human
agagaggaagggguauggaccugg

SEQ ID NO: 366227 - RNA, 26 nt, Human
agaugcugagagucuggggcugagcc

SEQ ID NO: 366228 - RNA, 18 nt, Human
agccacauaggcacagag

SEQ ID NO: 366229 - RNA, 18 nt, Human
aggagggagagaggaagg

SEQ ID NO: 366230 - RNA, 18 nt, Human
aggcacagagacacacag

SEQ ID NO: 366231 - RNA, 21 nt, Human
auagcacagccacauaggcac

SEQ ID NO: 366232 - RNA, 18 nt, Human
auggagagauagaccccc

SEQ ID NO: 366233 - RNA, 21 nt, Human
caaaaccacagggcuaagaca

SEQ ID NO: 366234 - RNA, 23 nt, Human
caaacagacacauggauggagca

SEQ ID NO: 366235 - RNA, 20 nt, Human
caacacacccugccacacug

SEQ ID NO: 366236 - RNA, 21 nt, Human
caagaacacacacacacacac

SEQ ID NO: 366237 - RNA, 31 nt, Human
caagaacacacacacacacacacacacacag

SEQ ID NO: 366238 - RNA, 20 nt, Human
cacacacacacacacacaca

SEQ ID NO: 366239 - RNA, 20 nt, Human
cacacacacacacacacaca

SEQ ID NO: 366240 - RNA, 20 nt, Human
cacacacacacacacacaca

SEQ ID NO: 366241 - RNA, 20 nt, Human
cacacacacacacacacaca

SEQ ID NO: 366242 - RNA, 20 nt, Human
cacacacacacacacacaca

SEQ ID NO: 366243 - RNA, 20 nt, Human
cacacacacacacacacaca

SEQ ID NO: 366244 - RNA, 20 nt, Human
cacacacacacacacacaca

SEQ ID NO: 366245 - RNA, 20 nt, Human
cacacacacacacacacaca

SEQ ID NO: 366246 - RNA, 20 nt, Human
cacacacacacacacacaca

SEQ ID NO: 366247 - RNA, 20 nt, Human
cacacacacacacacacaca

SEQ ID NO: 366248 - RNA, 20 nt, Human
cacacacacacacacacaca

SEQ ID NO: 366249 - RNA, 22 nt, Human
cacacacacacacacacacaca

SEQ ID NO: 366250 - RNA, 22 nt, Human
cacacacacacacacacacaca

SEQ ID NO: 366251 - RNA, 22 nt, Human
cacacacacacacacacacaca

SEQ ID NO: 366252 - RNA, 26 nt, Human
cacacacacacacacacacacacaca

SEQ ID NO: 366253 - RNA, 26 nt, Human
cacacacacacacacacacacacaca

SEQ ID NO: 366254 - RNA, 26 nt, Human
cacacacacacacacacacacacaca

SEQ ID NO: 366255 - RNA, 26 nt, Human
cacacacacacacacacacacacaca

SEQ ID NO: 366256 - RNA, 26 nt, Human
cacacacacacacacacacacacaca

SEQ ID NO: 366257 - RNA, 26 nt, Human
cacacacacacacacacacacacaca

SEQ ID NO: 366258 - RNA, 26 nt, Human
cacacacacacacacacacacacaca

SEQ ID NO: 366259 - RNA, 28 nt, Human
cacacacacacacacacacacacagaca

SEQ ID NO: 366260 - RNA, 24 nt, Human
cacacacacacacacagacaaaac

SEQ ID NO: 366261 - RNA, 21 nt, Human
cacacacacacacagacaaaa

SEQ ID NO: 366262 - RNA, 23 nt, Human
cacacacacacagacaaaaccac

SEQ ID NO: 366263 - RNA, 23 nt, Human
cacagcaccaacagagggaugga

SEQ ID NO: 366264 - RNA, 22 nt, Human
cacagccacauaggcacagaga

SEQ ID NO: 366265 - RNA, 24 nt, Human
caccacaggccuucaacacacccu

SEQ ID NO: 366266 - RNA, 24 nt, Human
caccacaggccuucaacacacccu

SEQ ID NO: 366267 - RNA, 20 nt, Human
caccccacuccccgccacac

SEQ ID NO: 366268 - RNA, 20 nt, Human
cacuggggcuggggcugggg

SEQ ID NO: 366269 - RNA, 20 nt, Human
cacuuuggucuugcccacug

SEQ ID NO: 366270 - RNA, 21 nt, Human
cagcggaguccucccucuuuc

SEQ ID NO: 366271 - RNA, 23 nt, Human
cauagaaaccauagcacagccac

SEQ ID NO: 366272 - RNA, 21 nt, Human
ccacacagacaaauggacugc

SEQ ID NO: 366273 - RNA, 23 nt, Human
ccacagcaccaagaacacacaca

SEQ ID NO: 366274 - RNA, 22 nt, Human
cccaccccacuccccgccacac

SEQ ID NO: 366275 - RNA, 19 nt, Human
cccccgggauccccgcagg

SEQ ID NO: 366276 - RNA, 18 nt, Human
ccccgaccgucuaggccc

SEQ ID NO: 366277 - RNA, 25 nt, Human
ccccgcgccaaguccgagcagcccc

SEQ ID NO: 366278 - RNA, 19 nt, Human
ccccgggauccccgcaggg

SEQ ID NO: 366279 - RNA, 20 nt, Human
ccccgggauccccgcagggc

SEQ ID NO: 366280 - RNA, 23 nt, Human
cccugacucccaccccacucccc

SEQ ID NO: 366281 - RNA, 23 nt, Human
ccugccacacugaggccugggag

SEQ ID NO: 366282 - RNA, 19 nt, Human
cgccgacccccgggauccc

SEQ ID NO: 366283 - RNA, 20 nt, Human
cggccccgcgccaaguccga

SEQ ID NO: 366284 - RNA, 21 nt, Human
cggccuggcaguggggugagg

SEQ ID NO: 366285 - RNA, 23 nt, Human
cucccaccccacuccccgccaca

SEQ ID NO: 366286 - RNA, 24 nt, Human
cucccucuuucagggauagccaag

SEQ ID NO: 366287 - RNA, 20 nt, Human
cugacucccaccccacuccc

SEQ ID NO: 366288 - RNA, 23 nt, Human
cugacucccaccccacuccccgc

SEQ ID NO: 366289 - RNA, 20 nt, Human
cuggggcugagccucggccu

SEQ ID NO: 366290 - RNA, 20 nt, Human
cuggggcuggggcugaggcu

SEQ ID NO: 366291 - RNA, 21 nt, Human
gaagggguauggaccuggcuc

SEQ ID NO: 366292 - RNA, 27 nt, Human
gacacacaggccacagcaccaagaaca

SEQ ID NO: 366293 - RNA, 18 nt, Human
gagauggcaccacaggcc

SEQ ID NO: 366294 - RNA, 20 nt, Human
gagcugcagcggaguccucc

SEQ ID NO: 366295 - RNA, 22 nt, Human
gaggcuggggaaacuggcaggu

SEQ ID NO: 366296 - RNA, 31 nt, Human
gcaccaagaacacacacacacacacacacag

SEQ ID NO: 366297 - RNA, 21 nt, Human
gccacagcaccaagaacacac

SEQ ID NO: 366298 - RNA, 22 nt, Human
gccuggcaguggggugagggca

SEQ ID NO: 366299 - RNA, 22 nt, Human
gcgacuguggcgcgcggagucc

SEQ ID NO: 366300 - RNA, 22 nt, Human
ggaagggguauggaccuggcuc

SEQ ID NO: 366301 - RNA, 21 nt, Human
ggcacagagacacacaggcca

SEQ ID NO: 366302 - RNA, 19 nt, Human
gggcuggggcugaggcugg

SEQ ID NO: 366303 - RNA, 18 nt, Human
ggggcugaggcuggggaa

SEQ ID NO: 366304 - RNA, 22 nt, Human
ggugguaggagggagagaggaa

SEQ ID NO: 366305 - RNA, 23 nt, Human
guaggagggagagaggaaggggu

SEQ ID NO: 366306 - RNA, 28 nt, Human
uagacaggcagaugcccccagccagcca

SEQ ID NO: 366307 - RNA, 18 nt, Human
uagacccccaaacagaca

SEQ ID NO: 366308 - RNA, 21 nt, Human
uagacccccaaacagacacau

SEQ ID NO: 366309 - RNA, 24 nt, Human
uagacccccaaacagacacaugga

SEQ ID NO: 366310 - RNA, 22 nt, Human
ucaacacacccugccacacuga

SEQ ID NO: 366311 - RNA, 23 nt, Human
ucugugaucagggcagcagaugc

SEQ ID NO: 366312 - RNA, 22 nt, Human
ucuuucagggauagccaagggc

SEQ ID NO: 366313 - RNA, 25 nt, Human
ugaccucccccaggcauaggcacac

SEQ ID NO: 366314 - RNA, 19 nt, Human
ugacucccaccccacuccc

SEQ ID NO: 366315 - RNA, 23 nt, Human
ugagagucuggggcugagccucg

SEQ ID NO: 366316 - RNA, 18 nt, Human
ugagccucggccuggcag

SEQ ID NO: 366317 - RNA, 19 nt, Human
ugcccccagccagccagcc

SEQ ID NO: 366318 - RNA, 18 nt, Human
uggagagauagaccccca

SEQ ID NO: 366319 - RNA, 22 nt, Human
uggagcugcagcggaguccucc

SEQ ID NO: 366320 - RNA, 18 nt, Human
uggcaggugguaggaggg

SEQ ID NO: 366321 - RNA, 21 nt, Human
uggggaaacuggcagguggua

SEQ ID NO: 366322 - RNA, 23 nt, Human
uggggagggggccccuacugacc

SEQ ID NO: 366323 - RNA, 22 nt, Human
uggggcuggggcugaggcuggg

SEQ ID NO: 366324 - RNA, 22 nt, Human
uggggugagggcagggccaugg

SEQ ID NO: 366325 - RNA, 21 nt, Human
uuucagggauagccaagggca

SEQ ID NO: 366326 - RNA, 21 nt, Human
uuuuuuuuuuuuuuuugcagu

SEQ ID NO: 366327 - RNA, 20 nt, Human
aacucaucuccccgcccccg

SEQ ID NO: 366328 - RNA, 24 nt, Human
cagccaccgccucuccccgcccug

SEQ ID NO: 366329 - RNA, 24 nt, Human
caggauaaauaaggcaggaguucc

SEQ ID NO: 366330 - RNA, 25 nt, Human
cauccuggggcgcugccgcggggcc

SEQ ID NO: 366331 - RNA, 21 nt, Human
ccaccgccucuccccgcccug

SEQ ID NO: 366332 - RNA, 22 nt, Human
cccacagccaccgccucucccc

SEQ ID NO: 366333 - RNA, 25 nt, Human
cccacagccaccgccucuccccgcc

SEQ ID NO: 366334 - RNA, 21 nt, Human
cccgcccccggccggcucagc

SEQ ID NO: 366335 - RNA, 24 nt, Human
ccgccgcgcccgcugcuggaggcc

SEQ ID NO: 366336 - RNA, 19 nt, Human
ccggacgcccacagccacc

SEQ ID NO: 366337 - RNA, 21 nt, Human
cgcgcccgccgcgcccgcugc

SEQ ID NO: 366338 - RNA, 23 nt, Human
cggacgcccacagccaccgccuc

SEQ ID NO: 366339 - RNA, 24 nt, Human
cggggccggacgcccacagccacc

SEQ ID NO: 366340 - RNA, 25 nt, Human
cggugcggaacggcuugggggaggc

SEQ ID NO: 366341 - RNA, 21 nt, Human
gcccgcugcuggaggccggcu

SEQ ID NO: 366342 - RNA, 18 nt, Human
gcugcuccacccgcggcc

SEQ ID NO: 366343 - RNA, 18 nt, Human
ggagaguggggucgugcu

SEQ ID NO: 366344 - RNA, 20 nt, Human
gggcucgcgcugcuccaccc

SEQ ID NO: 366345 - RNA, 19 nt, Human
uccacccgcggccgcagga

SEQ ID NO: 366346 - RNA, 25 nt, Human
ucugugacugcaggauaaauaaggc

SEQ ID NO: 366347 - RNA, 18 nt, Human
ucuuuuuuuuuuuuuuuu

SEQ ID NO: 366348 - RNA, 25 nt, Human
ucuuuuuuuuuuuuuuuuucucauu

SEQ ID NO: 366349 - RNA, 18 nt, Human
ugacugcaggauaaauaa

SEQ ID NO: 366350 - RNA, 20 nt, Human
uggggcgcugccgcggggcc

SEQ ID NO: 366351 - RNA, 21 nt, Human
ugugacugcaggauaaauaag

SEQ ID NO: 366352 - RNA, 18 nt, Human
uucccaaaauacauaaaa

SEQ ID NO: 366353 - RNA, 22 nt, Human
uuuuuuuuuuuuuuucucauuu

SEQ ID NO: 366354 - RNA, 22 nt, Human
uuuuuuuuuuuuuuuucuuuuu

SEQ ID NO: 366355 - RNA, 18 nt, Human
aaacuaaaccucuguuga

SEQ ID NO: 366356 - RNA, 23 nt, Human
aaagugcugggauuacaggcaug

SEQ ID NO: 366357 - RNA, 24 nt, Human
aaagugcugggauuacaggcaugg

SEQ ID NO: 366358 - RNA, 25 nt, Human
aaagugcugggauuacaggcauggg

SEQ ID NO: 366359 - RNA, 24 nt, Human
aacccgucacccccucacgacucu

SEQ ID NO: 366360 - RNA, 19 nt, Human
aagugcugggauuacaggc

SEQ ID NO: 366361 - RNA, 21 nt, Human
aagugcugggauuacaggcau

SEQ ID NO: 366362 - RNA, 23 nt, Human
acaggcgcccaccaccaugcccg

SEQ ID NO: 366363 - RNA, 18 nt, Human
acgggguuuccccauguu

SEQ ID NO: 366364 - RNA, 20 nt, Human
acgggguuuccccauguugg

SEQ ID NO: 366365 - RNA, 24 nt, Human
acgggguuuccccauguuggccag

SEQ ID NO: 366366 - RNA, 24 nt, Human
acucuugucacccaggcuggagug

SEQ ID NO: 366367 - RNA, 20 nt, Human
agaaggaaaagacaucucau

SEQ ID NO: 366368 - RNA, 19 nt, Human
aggaaucacgucuucaagu

SEQ ID NO: 366369 - RNA, 21 nt, Human
agguucaagugauucuccugc

SEQ ID NO: 366370 - RNA, 18 nt, Human
aguagcugggauuacagg

SEQ ID NO: 366371 - RNA, 19 nt, Human
aguagcugggauuacaggc

SEQ ID NO: 366372 - RNA, 24 nt, Human
agugauucuccugccucagccuuc

SEQ ID NO: 366373 - RNA, 24 nt, Human
agugcaauggcgccaucuuggcuc

SEQ ID NO: 366374 - RNA, 22 nt, Human
aucaagucauugaacaaaaagc

SEQ ID NO: 366375 - RNA, 24 nt, Human
aucucagcuuauuagaaaaaacaa

SEQ ID NO: 366376 - RNA, 24 nt, Human
auuuuuguauuuuuaguagagacg

SEQ ID NO: 366377 - RNA, 24 nt, Human
caaagugcugggauuacaggcaug

SEQ ID NO: 366378 - RNA, 18 nt, Human
caaaguguuaagugggaa

SEQ ID NO: 366379 - RNA, 21 nt, Human
caagaagggaugauuggagca

SEQ ID NO: 366380 - RNA, 20 nt, Human
caagugauucuccugccuca

SEQ ID NO: 366381 - RNA, 22 nt, Human
caagugauucuccugccucagc

SEQ ID NO: 366382 - RNA, 23 nt, Human
caaguucauggcuaaucaaagug

SEQ ID NO: 366383 - RNA, 24 nt, Human
caccaugcccggcuaauuuuugua

SEQ ID NO: 366384 - RNA, 20 nt, Human
caccucucucuccgaaucuu

SEQ ID NO: 366385 - RNA, 18 nt, Human
cacgucuucaagucuuca

SEQ ID NO: 366386 - RNA, 24 nt, Human
cacuagcaccucucucuccgaauc

SEQ ID NO: 366387 - RNA, 24 nt, Human
cacucuugucacccaggcuggagu

SEQ ID NO: 366388 - RNA, 21 nt, Human
cacugacccaggggaaaaaac

SEQ ID NO: 366389 - RNA, 21 nt, Human
cacugcaaccuccgccuccua

SEQ ID NO: 366390 - RNA, 22 nt, Human
cagaagauucuuuccaggucaa

SEQ ID NO: 366391 - RNA, 19 nt, Human
caggaaaaguugagaguca

SEQ ID NO: 366392 - RNA, 22 nt, Human
caggaaaaguugagagucagca

SEQ ID NO: 366393 - RNA, 21 nt, Human
caggcgcccaccaccaugccc

SEQ ID NO: 366394 - RNA, 25 nt, Human
caggucaaguccagccacuagcacc

SEQ ID NO: 366395 - RNA, 18 nt, Human
caugggccacuguguccg

SEQ ID NO: 366396 - RNA, 19 nt, Human
caugggccacuguguccgg

SEQ ID NO: 366397 - RNA, 24 nt, Human
cauguuggccagacuggucucgaa

SEQ ID NO: 366398 - RNA, 23 nt, Human
ccaaagugcugggauuacaggca

SEQ ID NO: 366399 - RNA, 24 nt, Human
ccaaagugcugggauuacaggcau

SEQ ID NO: 366400 - RNA, 18 nt, Human
ccaggggaaaaaaccacc

SEQ ID NO: 366401 - RNA, 21 nt, Human
ccaggggaaaaaaccaccaaa

SEQ ID NO: 366402 - RNA, 20 nt, Human
ccauccaagaauacacacuc

SEQ ID NO: 366403 - RNA, 25 nt, Human
ccauccaagaauacacacucugcaa

SEQ ID NO: 366404 - RNA, 22 nt, Human
ccauguuggccagacuggucuc

SEQ ID NO: 366405 - RNA, 24 nt, Human
cccaaagugcugggauuacaggca

SEQ ID NO: 366406 - RNA, 18 nt, Human
cccaggcuggagugcaau

SEQ ID NO: 366407 - RNA, 19 nt, Human
cccaggggaaaaaaccacc

SEQ ID NO: 366408 - RNA, 24 nt, Human
cccauguuggccagacuggucucg

SEQ ID NO: 366409 - RNA, 24 nt, Human
ccccaaagugcugggauuacaggc

SEQ ID NO: 366410 - RNA, 24 nt, Human
ccgccuccuagguucaagugauuc

SEQ ID NO: 366411 - RNA, 23 nt, Human
ccuagguucaagugauucuccuc

SEQ ID NO: 366412 - RNA, 23 nt, Human
ccuagguucaagugauucuccug

SEQ ID NO: 366413 - RNA, 22 nt, Human
ccucaggugauccagccugccu

SEQ ID NO: 366414 - RNA, 24 nt, Human
ccuccuagguucaagugauucucc

SEQ ID NO: 366415 - RNA, 18 nt, Human
ccucuguugagcaggggu

SEQ ID NO: 366416 - RNA, 25 nt, Human
ccuguccucaggugauccagccugc

SEQ ID NO: 366417 - RNA, 18 nt, Human
ccuuuccaucacugaccc

SEQ ID NO: 366418 - RNA, 19 nt, Human
cgggguuuccccauguugg

SEQ ID NO: 366419 - RNA, 23 nt, Human
cucagccuucugaguagcuggga

SEQ ID NO: 366420 - RNA, 19 nt, Human
cuccuagguucaagugauu

SEQ ID NO: 366421 - RNA, 22 nt, Human
cugaguagcugggauuacaggc

SEQ ID NO: 366422 - RNA, 23 nt, Human
cugcaaccuccgccuccuagguu

SEQ ID NO: 366423 - RNA, 24 nt, Human
cugcaaccuccgccuccuagguuc

SEQ ID NO: 366424 - RNA, 23 nt, Human
cugccucagccuucugaguagcu

SEQ ID NO: 366425 - RNA, 18 nt, Human
cuuaacccgucacccccu

SEQ ID NO: 366426 - RNA, 21 nt, Human
cuuggccccccaaagugcugg

SEQ ID NO: 366427 - RNA, 24 nt, Human
cuugucacccaggcuggagugcaa

SEQ ID NO: 366428 - RNA, 24 nt, Human
gagacgggguuuccccauguuggc

SEQ ID NO: 366429 - RNA, 25 nt, Human
gaguagcugggauuacaggcgccca

SEQ ID NO: 366430 - RNA, 20 nt, Human
gaugauggagaaggaaaaga

SEQ ID NO: 366431 - RNA, 18 nt, Human
gauuacaggcaugggcca

SEQ ID NO: 366432 - RNA, 21 nt, Human
gauuacaggcaugggccacug

SEQ ID NO: 366433 - RNA, 24 nt, Human
gauuacaggcaugggccacugugu

SEQ ID NO: 366434 - RNA, 22 nt, Human
gauuacaggcgcccaccaccau

SEQ ID NO: 366435 - RNA, 22 nt, Human
gcaaccuccgccuccuagguuc

SEQ ID NO: 366436 - RNA, 22 nt, Human
gcccggcuaauuuuuguauuuu

SEQ ID NO: 366437 - RNA, 18 nt, Human
gcgccaucuuggcucacu

SEQ ID NO: 366438 - RNA, 20 nt, Human
gcuggagugcaauggcgcca

SEQ ID NO: 366439 - RNA, 23 nt, Human
ggaguuucacucuugucacccag

SEQ ID NO: 366440 - RNA, 24 nt, Human
ggauuacaggcaugggccacugug

SEQ ID NO: 366441 - RNA, 21 nt, Human
ggugugugugugugugugugu

SEQ ID NO: 366442 - RNA, 23 nt, Human
guagagacgggguuuccccaugu

SEQ ID NO: 366443 - RNA, 18 nt, Human
guagcugggauuacaggc

SEQ ID NO: 366444 - RNA, 25 nt, Human
guccucaggugauccagccugccuu

SEQ ID NO: 366445 - RNA, 22 nt, Human
gugauccagccugccuuggccc

SEQ ID NO: 366446 - RNA, 24 nt, Human
gugauucuccugccucagccuucu

SEQ ID NO: 366447 - RNA, 21 nt, Human
guguguguguguguguacgug

SEQ ID NO: 366448 - RNA, 20 nt, Human
gugugugugugugugugugu

SEQ ID NO: 366449 - RNA, 21 nt, Human
gugugugugugugugugugug

SEQ ID NO: 366450 - RNA, 19 nt, Human
uaacuuggcucuaagauga

SEQ ID NO: 366451 - RNA, 24 nt, Human
uaauuuuuguauuuuuaguagaga

SEQ ID NO: 366452 - RNA, 23 nt, Human
uacaggcaugggccacugugucc

SEQ ID NO: 366453 - RNA, 23 nt, Human
uacgugcacaaagaggagcaaga

SEQ ID NO: 366454 - RNA, 21 nt, Human
uagaaaaaacaauuugggagg

SEQ ID NO: 366455 - RNA, 23 nt, Human
uagguucaagugauucuccugcc

SEQ ID NO: 366456 - RNA, 24 nt, Human
uaguagagacgggguuuccccaug

SEQ ID NO: 366457 - RNA, 18 nt, Human
uauuucuauuuucucaaa

SEQ ID NO: 366458 - RNA, 19 nt, Human
ucaagugauucuccugccu

SEQ ID NO: 366459 - RNA, 18 nt, Human
ucacccaggcuggagugc

SEQ ID NO: 366460 - RNA, 22 nt, Human
ucacucuugucacccaggcugg

SEQ ID NO: 366461 - RNA, 23 nt, Human
ucacucuugucacccaggcugga

SEQ ID NO: 366462 - RNA, 24 nt, Human
ucacugacccaggggaaaaaacca

SEQ ID NO: 366463 - RNA, 19 nt, Human
ucacugcaaccuccgccuc

SEQ ID NO: 366464 - RNA, 24 nt, Human
ucacugcaaccuccgccuccuagg

SEQ ID NO: 366465 - RNA, 25 nt, Human
ucacugcaaccuccgccuccuaggu

SEQ ID NO: 366466 - RNA, 26 nt, Human
ucacugcaaccuccgccuccuagguu

SEQ ID NO: 366467 - RNA, 20 nt, Human
ucagccuucugaguagcugg

SEQ ID NO: 366468 - RNA, 18 nt, Human
uccaucacugacccaggg

SEQ ID NO: 366469 - RNA, 20 nt, Human
ucccacucauugaauccaaa

SEQ ID NO: 366470 - RNA, 21 nt, Human
uccuagguucaagugauucuc

SEQ ID NO: 366471 - RNA, 24 nt, Human
uccuagguucaagugauucuccug

SEQ ID NO: 366472 - RNA, 24 nt, Human
ucgaugcaucagccauccaagaau

SEQ ID NO: 366473 - RNA, 24 nt, Human
ucuccgaaucuuaacccgucaccc

SEQ ID NO: 366474 - RNA, 24 nt, Human
ucuccugccucagccuucugagua

SEQ ID NO: 366475 - RNA, 21 nt, Human
ucuccuuaagagaaaugggaa

SEQ ID NO: 366476 - RNA, 22 nt, Human
ucuccuuaagagaaaugggaau

SEQ ID NO: 366477 - RNA, 23 nt, Human
ucugaguagcugggauuacaggc

SEQ ID NO: 366478 - RNA, 24 nt, Human
ucugaguagcugggauuacaggcg

SEQ ID NO: 366479 - RNA, 18 nt, Human
ucuugucacccaggcugg

SEQ ID NO: 366480 - RNA, 23 nt, Human
ucuuuucuuuuuuuuugagaugg

SEQ ID NO: 366481 - RNA, 22 nt, Human
ucuuuuuuuuugagauggaguu

SEQ ID NO: 366482 - RNA, 20 nt, Human
ugaacaaaaagcuacaugga

SEQ ID NO: 366483 - RNA, 20 nt, Human
ugauucuccugccucagccu

SEQ ID NO: 366484 - RNA, 22 nt, Human
ugccaucaauccuggcugaagu

SEQ ID NO: 366485 - RNA, 24 nt, Human
ugcccggcuaauuuuuguauuuuu

SEQ ID NO: 366486 - RNA, 24 nt, Human
ugccucagccuucugaguagcugg

SEQ ID NO: 366487 - RNA, 21 nt, Human
ugccuuggccccccaaagugc

SEQ ID NO: 366488 - RNA, 19 nt, Human
uggaccuuauuuucuaaug

SEQ ID NO: 366489 - RNA, 23 nt, Human
uggagugcaauggcgccaucuug

SEQ ID NO: 366490 - RNA, 24 nt, Human
uggagugcaauggcgccaucuugg

SEQ ID NO: 366491 - RNA, 24 nt, Human
uggccagacuggucucgaacuccu

SEQ ID NO: 366492 - RNA, 20 nt, Human
ugggagguuacuacuuuagu

SEQ ID NO: 366493 - RNA, 21 nt, Human
ugggauuacaggcaugggcca

SEQ ID NO: 366494 - RNA, 22 nt, Human
ugggauuacaggcaugggccac

SEQ ID NO: 366495 - RNA, 22 nt, Human
ugggauuacaggcaugggccac

SEQ ID NO: 366496 - RNA, 22 nt, Human
ugggauuacaggcaugggccac

SEQ ID NO: 366497 - RNA, 24 nt, Human
ugggauuacaggcaugggccacug

SEQ ID NO: 366498 - RNA, 26 nt, Human
ugggauuacaggcaugggccacugug

SEQ ID NO: 366499 - RNA, 21 nt, Human
ugggauuacaggcgcccacca

SEQ ID NO: 366500 - RNA, 24 nt, Human
ugggauuacaggcgcccaccacca

SEQ ID NO: 366501 - RNA, 25 nt, Human
ugggauuacaggcgcccaccaccau

SEQ ID NO: 366502 - RNA, 23 nt, Human
uggucucgaacuccuguccucag

SEQ ID NO: 366503 - RNA, 21 nt, Human
uguauuuuuaguagagacggg

SEQ ID NO: 366504 - RNA, 20 nt, Human
ugucacccaggcuggagugc

SEQ ID NO: 366505 - RNA, 25 nt, Human
uguccucaggugauccagccugccu

SEQ ID NO: 366506 - RNA, 21 nt, Human
uguguguguguguguacgugc

SEQ ID NO: 366507 - RNA, 21 nt, Human
uguguguguguguguguacgu

SEQ ID NO: 366508 - RNA, 18 nt, Human
ugugugugugugugugug

SEQ ID NO: 366509 - RNA, 18 nt, Human
ugugugugugugugugug

SEQ ID NO: 366510 - RNA, 18 nt, Human
ugugugugugugugugug

SEQ ID NO: 366511 - RNA, 18 nt, Human
ugugugugugugugugug

SEQ ID NO: 366512 - RNA, 18 nt, Human
ugugugugugugugugug

SEQ ID NO: 366513 - RNA, 18 nt, Human
ugugugugugugugugug

SEQ ID NO: 366514 - RNA, 18 nt, Human
ugugugugugugugugug

SEQ ID NO: 366515 - RNA, 18 nt, Human
ugugugugugugugugug

SEQ ID NO: 366516 - RNA, 18 nt, Human
ugugugugugugugugug

SEQ ID NO: 366517 - RNA, 20 nt, Human
ugugugugugugugugugua

SEQ ID NO: 366518 - RNA, 21 nt, Human
ugugugugugugugugugugu

SEQ ID NO: 366519 - RNA, 21 nt, Human
ugugugugugugugugugugu

SEQ ID NO: 366520 - RNA, 21 nt, Human
ugugugugugugugugugugu

SEQ ID NO: 366521 - RNA, 21 nt, Human
ugugugugugugugugugugu

SEQ ID NO: 366522 - RNA, 21 nt, Human
ugugugugugugugugugugu

SEQ ID NO: 366523 - RNA, 21 nt, Human
ugugugugugugugugugugu

SEQ ID NO: 366524 - RNA, 21 nt, Human
ugugugugugugugugugugu

SEQ ID NO: 366525 - RNA, 21 nt, Human
ugugugugugugugugugugu

SEQ ID NO: 366526 - RNA, 21 nt, Human
ugugugugugugugugugugu

SEQ ID NO: 366527 - RNA, 21 nt, Human
ugugugugugugugugugugu

SEQ ID NO: 366528 - RNA, 21 nt, Human
ugugugugugugugugugugu

SEQ ID NO: 366529 - RNA, 21 nt, Human
ugugugugugugugugugugu

SEQ ID NO: 366530 - RNA, 21 nt, Human
ugugugugugugugugugugu

SEQ ID NO: 366531 - RNA, 21 nt, Human
ugugugugugugugugugugu

SEQ ID NO: 366532 - RNA, 21 nt, Human
ugugugugugugugugugugu

SEQ ID NO: 366533 - RNA, 22 nt, Human
ugugugugugugugugugugua

SEQ ID NO: 366534 - RNA, 22 nt, Human
ugugugugugugugugugugug

SEQ ID NO: 366535 - RNA, 22 nt, Human
ugugugugugugugugugugug

SEQ ID NO: 366536 - RNA, 22 nt, Human
ugugugugugugugugugugug

SEQ ID NO: 366537 - RNA, 22 nt, Human
ugugugugugugugugugugug

SEQ ID NO: 366538 - RNA, 22 nt, Human
ugugugugugugugugugugug

SEQ ID NO: 366539 - RNA, 22 nt, Human
ugugugugugugugugugugug

SEQ ID NO: 366540 - RNA, 25 nt, Human
uguuaagugggaaugcaagucgaug

SEQ ID NO: 366541 - RNA, 19 nt, Human
uuaagugggaaugcaaguc

SEQ ID NO: 366542 - RNA, 18 nt, Human
uuaguagagacgggguuu

SEQ ID NO: 366543 - RNA, 24 nt, Human
uuaguagagacgggguuuccccau

SEQ ID NO: 366544 - RNA, 21 nt, Human
uucaagugauucuccugccuc

SEQ ID NO: 366545 - RNA, 23 nt, Human
uucaagugauucuccugccucag

SEQ ID NO: 366546 - RNA, 24 nt, Human
uucaagugauucuccugccucagc

SEQ ID NO: 366547 - RNA, 24 nt, Human
uucacucuugucacccaggcugga

SEQ ID NO: 366548 - RNA, 20 nt, Human
uuccaggucaaguccagcca

SEQ ID NO: 366549 - RNA, 24 nt, Human
uucugaguagcugggauuacaggc

SEQ ID NO: 366550 - RNA, 26 nt, Human
uucuuuuuuuuugagauggaguuuca

SEQ ID NO: 366551 - RNA, 33 nt, Human
uugagcagggguguguguguguguguguguggu

SEQ ID NO: 366552 - RNA, 23 nt, Human
uuguauuuuuaguagagacgggg

SEQ ID NO: 366553 - RNA, 21 nt, Human
uuuccccauguuggccagacu

SEQ ID NO: 366554 - RNA, 21 nt, Human
uuucuuuuuuuuugagaugga

SEQ ID NO: 366555 - RNA, 22 nt, Human
uuuuuaguagagacgggguuuc

SEQ ID NO: 366556 - RNA, 20 nt, Human
uuuuuguauuuuuaguagag

SEQ ID NO: 366557 - RNA, 23 nt, Human
acaagagaacaguuaguacagaa

SEQ ID NO: 366558 - RNA, 20 nt, Human
agaaaacacugaaauuucac

SEQ ID NO: 366559 - RNA, 23 nt, Human
agaaauguguaucaucuaacagc

SEQ ID NO: 366560 - RNA, 21 nt, Human
caccacccagaaauuguccga

SEQ ID NO: 366561 - RNA, 24 nt, Human
ccucuuguaagaaaagagcuaggu

SEQ ID NO: 366562 - RNA, 19 nt, Human
cuaccuucugagauugacu

SEQ ID NO: 366563 - RNA, 23 nt, Human
gcacuaaagggguacucacuaaa

SEQ ID NO: 366564 - RNA, 20 nt, Human
gccucaccaugauuuuuuuu

SEQ ID NO: 366565 - RNA, 19 nt, Human
gggucauccuucuccccgg

SEQ ID NO: 366566 - RNA, 22 nt, Human
uaaaacaauaguagaccccaaa

SEQ ID NO: 366567 - RNA, 23 nt, Human
uaaaacaauaguagaccccaaac

SEQ ID NO: 366568 - RNA, 20 nt, Human
uaacccuuagacauuguccc

SEQ ID NO: 366569 - RNA, 22 nt, Human
uaaguuucuguauuagcaguuc

SEQ ID NO: 366570 - RNA, 18 nt, Human
uacaaaagugacauuaga

SEQ ID NO: 366571 - RNA, 19 nt, Human
uacaaauuauauauacaca

SEQ ID NO: 366572 - RNA, 21 nt, Human
uagaaaacacugaaauuucac

SEQ ID NO: 366573 - RNA, 23 nt, Human
uauagaaaacacugaaauuucac

SEQ ID NO: 366574 - RNA, 18 nt, Human
uauagcacuaaaggggua

SEQ ID NO: 366575 - RNA, 19 nt, Human
ucuaaaacaauaguagacc

SEQ ID NO: 366576 - RNA, 24 nt, Human
ucuaacagcaaagaaauaugaacc

SEQ ID NO: 366577 - RNA, 22 nt, Human
ucuguauuagcaguucacucag

SEQ ID NO: 366578 - RNA, 20 nt, Human
ugaauggcacaaauauagca

SEQ ID NO: 366579 - RNA, 26 nt, Human
ugaauggcacaaauauagcacuaaag

SEQ ID NO: 366580 - RNA, 19 nt, Human
ugcaaauaaaguuuauugc

SEQ ID NO: 366581 - RNA, 18 nt, Human
ugcuaccuucugagauug

SEQ ID NO: 366582 - RNA, 22 nt, Human
ugcugaauuuccccauuaacau

SEQ ID NO: 366583 - RNA, 19 nt, Human
ugucuuguuucugccucuu

SEQ ID NO: 366584 - RNA, 20 nt, Human
uguuucugccucuuguaaga

SEQ ID NO: 366585 - RNA, 23 nt, Human
uucugccucuuguaagaaaagag

SEQ ID NO: 366586 - RNA, 21 nt, Human
uuuuuuuuuuuuuugcaaaua

SEQ ID NO: 366587 - RNA, 21 nt, Human
uuuuuuuuuuuuuuuuugcaa

SEQ ID NO: 366588 - RNA, 23 nt, Human
uuuuuuuuuuuuuuuuugcaaau

SEQ ID NO: 366589 - RNA, 27 nt, Human
uuuuuuuuuuuuuuuuuuuuuuugggg

SEQ ID NO: 366590 - RNA, 18 nt, Human
aagagagaacgaggccag

SEQ ID NO: 366591 - RNA, 18 nt, Human
accucacucuaccccuaa

SEQ ID NO: 366592 - RNA, 19 nt, Human
agcuggcaggggcuggggg

SEQ ID NO: 366593 - RNA, 20 nt, Human
aggggugguggggacaggga

SEQ ID NO: 366594 - RNA, 22 nt, Human
aggggugguggggacagggagu

SEQ ID NO: 366595 - RNA, 19 nt, Human
gcaggggugguggggacag

SEQ ID NO: 366596 - RNA, 19 nt, Human
gcccuggguggggcagggg

SEQ ID NO: 366597 - RNA, 21 nt, Human
gcccuggguggggcaggggug

SEQ ID NO: 366598 - RNA, 19 nt, Human
ggagcuggcaggggcuggg

SEQ ID NO: 366599 - RNA, 22 nt, Human
ggcuggggggcugagcugaggu

SEQ ID NO: 366600 - RNA, 21 nt, Human
gggcaggggugguggggacag

SEQ ID NO: 366601 - RNA, 20 nt, Human
ggggggcugagcugaggugg

SEQ ID NO: 366602 - RNA, 21 nt, Human
ggggggcugagcugagguggg

SEQ ID NO: 366603 - RNA, 20 nt, Human
ggggugguggggacagggag

SEQ ID NO: 366604 - RNA, 22 nt, Human
ggguggggcagggguggugggg

SEQ ID NO: 366605 - RNA, 19 nt, Human
guggagcuggcaggggcug

SEQ ID NO: 366606 - RNA, 19 nt, Human
uacacaacacauuuuauuu

SEQ ID NO: 366607 - RNA, 18 nt, Human
uaguguggagcuggcagg

SEQ ID NO: 366608 - RNA, 25 nt, Human
uccagugucuaccucacucuacccc

SEQ ID NO: 366609 - RNA, 20 nt, Human
uggagcuggcaggggcuggg

SEQ ID NO: 366610 - RNA, 21 nt, Human
uggggggcugagcugaggugg

SEQ ID NO: 366611 - RNA, 22 nt, Human
uguggagcuggcaggggcuggu

SEQ ID NO: 366612 - RNA, 21 nt, Human
agagauuaagggcuaaccucc

SEQ ID NO: 366613 - RNA, 22 nt, Human
agcaauccuucauuuaguaauc

SEQ ID NO: 366614 - RNA, 18 nt, Human
agcacaggagcaacugga

SEQ ID NO: 366615 - RNA, 25 nt, Human
caaaauucuccaaauguagauauua

SEQ ID NO: 366616 - RNA, 24 nt, Human
caacuggauugcuuucagcagucu

SEQ ID NO: 366617 - RNA, 22 nt, Human
cccgcagcgccgccggcucccg

SEQ ID NO: 366618 - RNA, 24 nt, Human
cccgcagcgccgccggcucccguc

SEQ ID NO: 366619 - RNA, 18 nt, Human
ccgccggcucccgucgcc

SEQ ID NO: 366620 - RNA, 19 nt, Human
ccgccggcucccgucgccg

SEQ ID NO: 366621 - RNA, 18 nt, Human
cgcgaccgcugacccgca

SEQ ID NO: 366622 - RNA, 25 nt, Human
cuagugccccaucgugaaaaaccag

SEQ ID NO: 366623 - RNA, 26 nt, Human
cuuucuaacuguauacaguauaugcu

SEQ ID NO: 366624 - RNA, 23 nt, Human
gcacuaaaauaucuuaaaauuca

SEQ ID NO: 366625 - RNA, 23 nt, Human
ggcugagcccaccaccgggggcc

SEQ ID NO: 366626 - RNA, 20 nt, Human
gggcgccccaggcugccgag

SEQ ID NO: 366627 - RNA, 26 nt, Human
guaaaaucuuuuuaaacucagauuuc

SEQ ID NO: 366628 - RNA, 25 nt, Human
ucccuggaaauacuuucaaguuuug

SEQ ID NO: 366629 - RNA, 21 nt, Human
ucgaccggcugagcccaccac

SEQ ID NO: 366630 - RNA, 22 nt, Human
ucuugaagcacuaaaauaucuu

SEQ ID NO: 366631 - RNA, 18 nt, Human
ucuuuuguauaaauauaa

SEQ ID NO: 366632 - RNA, 18 nt, Human
ugcagcaaucaaaaaggu

SEQ ID NO: 366633 - RNA, 24 nt, Human
ugcagcaaucaaaaagguaaaauc

SEQ ID NO: 366634 - RNA, 20 nt, Human
ugccccaucgugaaaaacca

SEQ ID NO: 366635 - RNA, 19 nt, Human
uggauugcuuucagcaguc

SEQ ID NO: 366636 - RNA, 23 nt, Human
uguugugugcucuugcaaagagu

SEQ ID NO: 366637 - RNA, 20 nt, Human
uuaaacucagauuucaaguu

SEQ ID NO: 366638 - RNA, 24 nt, Human
uucaaauuauacuucuauuuuuca

SEQ ID NO: 366639 - RNA, 19 nt, Human
uucucuggcuaccaucuag

SEQ ID NO: 366640 - RNA, 23 nt, Human
aaaacaaaacaaaacaaaaaagu

SEQ ID NO: 366641 - RNA, 25 nt, Human
aaaacaaaacaaaacaaaaaaguuc

SEQ ID NO: 366642 - RNA, 19 nt, Human
aaaagucuguagaaacaac

SEQ ID NO: 366643 - RNA, 26 nt, Human
aaacaaaaaauuuccccaaauccaac

SEQ ID NO: 366644 - RNA, 19 nt, Human
aaacaaaacaaaacaaaaa

SEQ ID NO: 366645 - RNA, 22 nt, Human
aaacaaacaaaaaauuucccca

SEQ ID NO: 366646 - RNA, 22 nt, Human
aaacaggacaaaaauggaccaa

SEQ ID NO: 366647 - RNA, 25 nt, Human
aaacaugaacacaacuaagccauac

SEQ ID NO: 366648 - RNA, 19 nt, Human
aaaguaauuauuuucauuu

SEQ ID NO: 366649 - RNA, 23 nt, Human
aacaaaaaccaugucuccacauu

SEQ ID NO: 366650 - RNA, 22 nt, Human
aacccaagacccaaaccugaca

SEQ ID NO: 366651 - RNA, 19 nt, Human
aacugcuucugaauaaagu

SEQ ID NO: 366652 - RNA, 21 nt, Human
aagaaccagcgaggaaucugc

SEQ ID NO: 366653 - RNA, 20 nt, Human
aagcacugggaggaaucggg

SEQ ID NO: 366654 - RNA, 18 nt, Human
aaugacuacuaacacuca

SEQ ID NO: 366655 - RNA, 28 nt, Human
acaaaaaaaaaaaaaaagucuguagaaa

SEQ ID NO: 366656 - RNA, 23 nt, Human
acaaaacaaaacaaaaaaguuca

SEQ ID NO: 366657 - RNA, 20 nt, Human
acacuggagacagaugcaac

SEQ ID NO: 366658 - RNA, 20 nt, Human
accaaaaugacuacuaacac

SEQ ID NO: 366659 - RNA, 20 nt, Human
acccaagacccaaaccugac

SEQ ID NO: 366660 - RNA, 22 nt, Human
acugaauaaacccuguuuuacc

SEQ ID NO: 366661 - RNA, 24 nt, Human
agaagaaccagcgaggaaucugca

SEQ ID NO: 366662 - RNA, 19 nt, Human
agacaagauagcucccaga

SEQ ID NO: 366663 - RNA, 19 nt, Human
aguaguugaguuuacucaa

SEQ ID NO: 366664 - RNA, 19 nt, Human
aguuauuuuauuucccaca

SEQ ID NO: 366665 - RNA, 22 nt, Human
auacaaaaaaaaaaaaaaaguc

SEQ ID NO: 366666 - RNA, 24 nt, Human
auacacuugaacccaagacccaaa

SEQ ID NO: 366667 - RNA, 19 nt, Human
auccauuggaauuuucccu

SEQ ID NO: 366668 - RNA, 21 nt, Human
augaacacaacuaagccauac

SEQ ID NO: 366669 - RNA, 24 nt, Human
augacacagccaagcauguggcuu

SEQ ID NO: 366670 - RNA, 24 nt, Human
auggaauuauguauauuagauuuu

SEQ ID NO: 366671 - RNA, 18 nt, Human
auggagugccuaaagccc

SEQ ID NO: 366672 - RNA, 24 nt, Human
auuaugccuacaaaaaggcaaacc

SEQ ID NO: 366673 - RNA, 21 nt, Human
auuuuuuuuccauuccuuccu

SEQ ID NO: 366674 - RNA, 22 nt, Human
caaaaaaagacccagagcuguc

SEQ ID NO: 366675 - RNA, 22 nt, Human
caaaacaaaacaaaaaaguuca

SEQ ID NO: 366676 - RNA, 21 nt, Human
caaaaugacuacuaacacuca

SEQ ID NO: 366677 - RNA, 22 nt, Human
caaaaugcaguuaagaaacuua

SEQ ID NO: 366678 - RNA, 21 nt, Human
caaaucauaaaaaacaaacaa

SEQ ID NO: 366679 - RNA, 22 nt, Human
caacuaagccauacauugucaa

SEQ ID NO: 366680 - RNA, 18 nt, Human
caacugaauaaacccugu

SEQ ID NO: 366681 - RNA, 21 nt, Human
caagggcaaaccuuacagcca

SEQ ID NO: 366682 - RNA, 21 nt, Human
caagguagacaagauagcucc

SEQ ID NO: 366683 - RNA, 28 nt, Human
caauauauguacauagauuaucauaaua

SEQ ID NO: 366684 - RNA, 23 nt, Human
cacaguaucuucucccauacaaa

SEQ ID NO: 366685 - RNA, 21 nt, Human
caccauacacugugacguacg

SEQ ID NO: 366686 - RNA, 20 nt, Human
cacuauauacacaaaguuaa

SEQ ID NO: 366687 - RNA, 19 nt, Human
cacucagaagaaccagcga

SEQ ID NO: 366688 - RNA, 18 nt, Human
cacuugauuuugaaccuu

SEQ ID NO: 366689 - RNA, 18 nt, Human
cagaguucaucugauuug

SEQ ID NO: 366690 - RNA, 20 nt, Human
cagcggcccgcgagucggcc

SEQ ID NO: 366691 - RNA, 23 nt, Human
cauacaaaaaaaaaaaaaaaguc

SEQ ID NO: 366692 - RNA, 21 nt, Human
cauauaauacaagaaugcgua

SEQ ID NO: 366693 - RNA, 20 nt, Human
caucaaaugcccauuuucca

SEQ ID NO: 366694 - RNA, 23 nt, Human
caugagaaacccaguggccuacg

SEQ ID NO: 366695 - RNA, 19 nt, Human
cauuacacuagaucacauu

SEQ ID NO: 366696 - RNA, 19 nt, Human
cauuacacuagaucacauu

SEQ ID NO: 366697 - RNA, 23 nt, Human
ccaaaaugacuacuaacacucag

SEQ ID NO: 366698 - RNA, 21 nt, Human
ccaucaaaugcccauuuucca

SEQ ID NO: 366699 - RNA, 22 nt, Human
ccccaaacaacauuuuuaguuc

SEQ ID NO: 366700 - RNA, 25 nt, Human
cccuaggcacuugauuuugaaccuu

SEQ ID NO: 366701 - RNA, 22 nt, Human
cgagacucgugguuuuguuguu

SEQ ID NO: 366702 - RNA, 24 nt, Human
cgauaaaugugcucuuaaagccaa

SEQ ID NO: 366703 - RNA, 21 nt, Human
cgcaaagagaacuuauaucau

SEQ ID NO: 366704 - RNA, 25 nt, Human
cgggugcagcuaguagcgcugggcu

SEQ ID NO: 366705 - RNA, 21 nt, Human
cuaggcacuugauuuugaacc

SEQ ID NO: 366706 - RNA, 22 nt, Human
cuaguagcgcugggcuccuuuu

SEQ ID NO: 366707 - RNA, 23 nt, Human
cucaacacuggcaucagauggac

SEQ ID NO: 366708 - RNA, 24 nt, Human
cucaacacuggcaucagauggacu

SEQ ID NO: 366709 - RNA, 22 nt, Human
cucaagguagacaagauagcuc

SEQ ID NO: 366710 - RNA, 24 nt, Human
cucuugguauucccuggcaggucu

SEQ ID NO: 366711 - RNA, 21 nt, Human
gaaaaaguguacucucuggac

SEQ ID NO: 366712 - RNA, 22 nt, Human
gaaaagacaaauugccgcccca

SEQ ID NO: 366713 - RNA, 18 nt, Human
gaaacgguguagcacucu

SEQ ID NO: 366714 - RNA, 19 nt, Human
gaauggagugccuaaagcc

SEQ ID NO: 366715 - RNA, 21 nt, Human
gacaaaacaugaacacaacua

SEQ ID NO: 366716 - RNA, 20 nt, Human
gacacagccaagcauguggc

SEQ ID NO: 366717 - RNA, 24 nt, Human
gacugcucauuaaugggaauucau

SEQ ID NO: 366718 - RNA, 23 nt, Human
gauaaaugugcucuuaaagccaa

SEQ ID NO: 366719 - RNA, 19 nt, Human
gcaaagagaacuuauauca

SEQ ID NO: 366720 - RNA, 18 nt, Human
ggaauuuucccuaggcac

SEQ ID NO: 366721 - RNA, 20 nt, Human
guagacaaaacaugaacaca

SEQ ID NO: 366722 - RNA, 19 nt, Human
gucaaaaaagggcuggccc

SEQ ID NO: 366723 - RNA, 25 nt, Human
gucuuuaauuacacauguaucuugu

SEQ ID NO: 366724 - RNA, 22 nt, Human
uaaaaaaacaaaacaaaacaaa

SEQ ID NO: 366725 - RNA, 21 nt, Human
uaacauuacaguuguaacuga

SEQ ID NO: 366726 - RNA, 20 nt, Human
uaaccuguggauuagaccuc

SEQ ID NO: 366727 - RNA, 19 nt, Human
uaaguugaagacacaaaca

SEQ ID NO: 366728 - RNA, 18 nt, Human
uacaacacuggagacaga

SEQ ID NO: 366729 - RNA, 24 nt, Human
uacgauaaaugugcucuuaaagcc

SEQ ID NO: 366730 - RNA, 22 nt, Human
uagcacuacaagacgucuucca

SEQ ID NO: 366731 - RNA, 25 nt, Human
uaggcacauucaaguaaaaucauaa

SEQ ID NO: 366732 - RNA, 23 nt, Human
uaguaguugaguuuacucaacac

SEQ ID NO: 366733 - RNA, 22 nt, Human
uauacaaccuauuuacaaauac

SEQ ID NO: 366734 - RNA, 23 nt, Human
uauauacacuugaacccaagacc

SEQ ID NO: 366735 - RNA, 22 nt, Human
uaugccuacaaaaaggcaaacc

SEQ ID NO: 366736 - RNA, 21 nt, Human
uauggacagacaauauaugua

SEQ ID NO: 366737 - RNA, 25 nt, Human
ucaagggcaaaccuuacagccagau

SEQ ID NO: 366738 - RNA, 22 nt, Human
ucagaagaaccagcgaggaauc

SEQ ID NO: 366739 - RNA, 23 nt, Human
uccaacaacaggcaggaaaaaua

SEQ ID NO: 366740 - RNA, 18 nt, Human
ucucacgcagacgucuuc

SEQ ID NO: 366741 - RNA, 25 nt, Human
ucucccauacaaaaaaaaaaaaaaa

SEQ ID NO: 366742 - RNA, 22 nt, Human
ugaagacacaaacauuucaguc

SEQ ID NO: 366743 - RNA, 19 nt, Human
ugacguuuaaauggaaaaa

SEQ ID NO: 366744 - RNA, 27 nt, Human
ugccacaguaucuucucccauacaaaa

SEQ ID NO: 366745 - RNA, 23 nt, Human
uggcggugggugcagcggcccgc

SEQ ID NO: 366746 - RNA, 18 nt, Human
uggggacagagaagaaaa

SEQ ID NO: 366747 - RNA, 24 nt, Human
uguagagaaaagaauuuuuuuucc

SEQ ID NO: 366748 - RNA, 22 nt, Human
uuaucuucauagaaacaggaca

SEQ ID NO: 366749 - RNA, 24 nt, Human
uuauuugcuuccuucaaccacuua

SEQ ID NO: 366750 - RNA, 21 nt, Human
uucaguggguuucucucaguc

SEQ ID NO: 366751 - RNA, 22 nt, Human
uucucacaucaaaugguuccau

SEQ ID NO: 366752 - RNA, 23 nt, Human
uucugcacucagaagaaccagcg

SEQ ID NO: 366753 - RNA, 23 nt, Human
uuucauaguaguugaguuuacuc

SEQ ID NO: 366754 - RNA, 22 nt, Human
uuucucacaucaaaugguucca

SEQ ID NO: 366755 - RNA, 19 nt, Human
uuugcuguaaauuaaaaag

SEQ ID NO: 366756 - RNA, 24 nt, Human
uuuuauaaagcuuacugcaugaga

SEQ ID NO: 366757 - RNA, 19 nt, Human
uuuuccauuccuuccuggu

SEQ ID NO: 366758 - RNA, 31 nt, Human
uuuugauuacugcauuuugaaaauguauucc

SEQ ID NO: 366759 - RNA, 23 nt, Human
aaggagggaaugaggggcuuggg

SEQ ID NO: 366760 - RNA, 19 nt, Human
acuggggucuuuggcuccc

SEQ ID NO: 366761 - RNA, 21 nt, Human
agcuccagagccuagcagggu

SEQ ID NO: 366762 - RNA, 21 nt, Human
agggcccaggagucugaaaag

SEQ ID NO: 366763 - RNA, 24 nt, Human
aggggggaaaacaagugggcuggg

SEQ ID NO: 366764 - RNA, 18 nt, Human
aguggcccaagggccuug

SEQ ID NO: 366765 - RNA, 22 nt, Human
auccugugaagggagaugggag

SEQ ID NO: 366766 - RNA, 20 nt, Human
caacagucagaugucuggcc

SEQ ID NO: 366767 - RNA, 23 nt, Human
cagcagggucgggggauggcugc

SEQ ID NO: 366768 - RNA, 19 nt, Human
cagcccuacccugcuccca

SEQ ID NO: 366769 - RNA, 19 nt, Human
caggggucucuuggggguc

SEQ ID NO: 366770 - RNA, 21 nt, Human
caggguaguggcccaagggcc

SEQ ID NO: 366771 - RNA, 19 nt, Human
ccacagagaggacaugggg

SEQ ID NO: 366772 - RNA, 19 nt, Human
cccaagggccuugguccug

SEQ ID NO: 366773 - RNA, 24 nt, Human
cccacccuaucccaguguggccac

SEQ ID NO: 366774 - RNA, 27 nt, Human
cccuacaccagccccacccucagcaga

SEQ ID NO: 366775 - RNA, 24 nt, Human
ccuacccugcucccaguucaggaa

SEQ ID NO: 366776 - RNA, 22 nt, Human
cuagggaauaaaaggggggaaa

SEQ ID NO: 366777 - RNA, 21 nt, Human
cugcaggcugaucccagcugu

SEQ ID NO: 366778 - RNA, 23 nt, Human
cugcaggcugaucccagcugugu

SEQ ID NO: 366779 - RNA, 20 nt, Human
cuuuggcucccgggggcagg

SEQ ID NO: 366780 - RNA, 22 nt, Human
gacaggggucucuugggggucc

SEQ ID NO: 366781 - RNA, 21 nt, Human
gagggaaugaggggcuugggc

SEQ ID NO: 366782 - RNA, 21 nt, Human
gaugggagaagaguauccaag

SEQ ID NO: 366783 - RNA, 19 nt, Human
gcaggcugaucccagcugu

SEQ ID NO: 366784 - RNA, 21 nt, Human
gccagccuccccacccuaucc

SEQ ID NO: 366785 - RNA, 18 nt, Human
gcugccagccuccccacc

SEQ ID NO: 366786 - RNA, 25 nt, Human
ggaauaaaaggggggaaaacaagug

SEQ ID NO: 366787 - RNA, 20 nt, Human
ggagcacuggucucacacca

SEQ ID NO: 366788 - RNA, 21 nt, Human
ggagggaaugaggggcuuggg

SEQ ID NO: 366789 - RNA, 23 nt, Human
ggccuguuucuucucccagcagu

SEQ ID NO: 366790 - RNA, 20 nt, Human
ggcuugggcgggaucuaagg

SEQ ID NO: 366791 - RNA, 18 nt, Human
gggaaaacaagugggcug

SEQ ID NO: 366792 - RNA, 22 nt, Human
gggaaugaggggcuugggcggg

SEQ ID NO: 366793 - RNA, 22 nt, Human
gggcagggcugcuagggugagu

SEQ ID NO: 366794 - RNA, 23 nt, Human
ggggaaaacaagugggcuggggg

SEQ ID NO: 366795 - RNA, 19 nt, Human
ggggagaugaggccccagg

SEQ ID NO: 366796 - RNA, 21 nt, Human
gggggagaugaggccccaggg

SEQ ID NO: 366797 - RNA, 23 nt, Human
uaaggcgacagcccuacccugcu

SEQ ID NO: 366798 - RNA, 22 nt, Human
uccacagagaggacauggggcc

SEQ ID NO: 366799 - RNA, 21 nt, Human
uccccaggacuggugaaggga

SEQ ID NO: 366800 - RNA, 23 nt, Human
ucccuacaccagccccacccuca

SEQ ID NO: 366801 - RNA, 22 nt, Human
ucgcucugcucccggccucgug

SEQ ID NO: 366802 - RNA, 21 nt, Human
ucgggccggugcgguucgcuc

SEQ ID NO: 366803 - RNA, 26 nt, Human
ugaacaaaaaccuuccacagagagga

SEQ ID NO: 366804 - RNA, 20 nt, Human
ugaagagucugggcagggcu

SEQ ID NO: 366805 - RNA, 20 nt, Human
ugaagggacaggacaggggu

SEQ ID NO: 366806 - RNA, 24 nt, Human
ugaagggagaugggagaagaguaa

SEQ ID NO: 366807 - RNA, 21 nt, Human
ugcaaggagggaaugaggggc

SEQ ID NO: 366808 - RNA, 19 nt, Human
uggcccaggcuuguggcag

SEQ ID NO: 366809 - RNA, 22 nt, Human
ugggagcaggggcugaagaguc

SEQ ID NO: 366810 - RNA, 20 nt, Human
ugggcugggggagaugaggc

SEQ ID NO: 366811 - RNA, 18 nt, Human
ugggggagaugaggcccc

SEQ ID NO: 366812 - RNA, 21 nt, Human
ugugcaaggagggaaugaggg

SEQ ID NO: 366813 - RNA, 22 nt, Human
uguuucuucucccagcagugga

SEQ ID NO: 366814 - RNA, 22 nt, Human
uuaaucgcgucuuucuccuccc

SEQ ID NO: 366815 - RNA, 20 nt, Human
uugguccuggcucuugaaca

SEQ ID NO: 366816 - RNA, 20 nt, Human
aaaaaaaaaagaaagaacug

SEQ ID NO: 366817 - RNA, 23 nt, Human
aaaaaaaaaagaaagaacugcgg

SEQ ID NO: 366818 - RNA, 22 nt, Human
aaaauaaagagcaagcaggccc

SEQ ID NO: 366819 - RNA, 21 nt, Human
aaaauagaggaguaagcagga

SEQ ID NO: 366820 - RNA, 22 nt, Human
aaaauauuucugccccacccca

SEQ ID NO: 366821 - RNA, 19 nt, Human
aacaaccuuccuccuaccc

SEQ ID NO: 366822 - RNA, 22 nt, Human
aagaagaguaggagggguccac

SEQ ID NO: 366823 - RNA, 25 nt, Human
aagugucuuccccaauccuaauguc

SEQ ID NO: 366824 - RNA, 25 nt, Human
acagagcgagacccugucuccaaaa

SEQ ID NO: 366825 - RNA, 19 nt, Human
acagcagcaguagauggcu

SEQ ID NO: 366826 - RNA, 19 nt, Human
acagcagcaguagauggcu

SEQ ID NO: 366827 - RNA, 18 nt, Human
acccguuccacagcagcu

SEQ ID NO: 366828 - RNA, 23 nt, Human
acccugucuccaaaaauaagaau

SEQ ID NO: 366829 - RNA, 24 nt, Human
accgcacuccagccugggcaacag

SEQ ID NO: 366830 - RNA, 24 nt, Human
accgcacuccagccugggcaacag

SEQ ID NO: 366831 - RNA, 21 nt, Human
agagaucgggagcgggagcgg

SEQ ID NO: 366832 - RNA, 22 nt, Human
agaugggaggagggagauaggu

SEQ ID NO: 366833 - RNA, 20 nt, Human
aggaaggggauuuguuuggc

SEQ ID NO: 366834 - RNA, 21 nt, Human
aggagggagauagguaugagg

SEQ ID NO: 366835 - RNA, 18 nt, Human
aggcgggagaaucaccug

SEQ ID NO: 366836 - RNA, 24 nt, Human
aggcgggagaaucaccugagcccg

SEQ ID NO: 366837 - RNA, 19 nt, Human
agggagagaccauuuggcg

SEQ ID NO: 366838 - RNA, 24 nt, Human
aguggcucgcgccugugguccuag

SEQ ID NO: 366839 - RNA, 26 nt, Human
auaccaaaauuggcagggagagacca

SEQ ID NO: 366840 - RNA, 24 nt, Human
aucgcaccaccgcacuccagccug

SEQ ID NO: 366841 - RNA, 28 nt, Human
aucgcaccaccgcacuccagccugggca

SEQ ID NO: 366842 - RNA, 19 nt, Human
auuucccuuccccuuuccu

SEQ ID NO: 366843 - RNA, 22 nt, Human
caacagagcgagacccugucuc

SEQ ID NO: 366844 - RNA, 19 nt, Human
caagugucuuccccaaucc

SEQ ID NO: 366845 - RNA, 22 nt, Human
cacagcccucccuccccaaaaa

SEQ ID NO: 366846 - RNA, 22 nt, Human
cacgaccgacugccaauggcag

SEQ ID NO: 366847 - RNA, 26 nt, Human
cacgaccgacugccaauggcagcacc

SEQ ID NO: 366848 - RNA, 18 nt, Human
cacuccaaguggcagggu

SEQ ID NO: 366849 - RNA, 18 nt, Human
cacuccaaguggcagggu

SEQ ID NO: 366850 - RNA, 23 nt, Human
cacuccagccugggcaacagagc

SEQ ID NO: 366851 - RNA, 24 nt, Human
cacuccagccugggcaacagagcg

SEQ ID NO: 366852 - RNA, 22 nt, Human
cagcaccgagugggcggggaca

SEQ ID NO: 366853 - RNA, 24 nt, Human
cagcagcuggguacccaccuccag

SEQ ID NO: 366854 - RNA, 23 nt, Human
cagcccucccuccccaaaaauaa

SEQ ID NO: 366855 - RNA, 26 nt, Human
caggucccaaaacaggucaguuaaua

SEQ ID NO: 366856 - RNA, 21 nt, Human
caucaaucuccccugccccuc

SEQ ID NO: 366857 - RNA, 23 nt, Human
cauguccauguccccauauuccu

SEQ ID NO: 366858 - RNA, 23 nt, Human
ccaaccucugauucuagcaguca

SEQ ID NO: 366859 - RNA, 20 nt, Human
ccaccgcacuccagccuggg

SEQ ID NO: 366860 - RNA, 21 nt, Human
ccaccgcacuccagccugggc

SEQ ID NO: 366861 - RNA, 24 nt, Human
ccaccgcacuccagccugggcaac

SEQ ID NO: 366862 - RNA, 23 nt, Human
ccagcccagaaaauauuucugcc

SEQ ID NO: 366863 - RNA, 25 nt, Human
ccagcccagaaaauauuucugcccc

SEQ ID NO: 366864 - RNA, 24 nt, Human
ccauguccauguccccauauuccu

SEQ ID NO: 366865 - RNA, 22 nt, Human
cccaauccuaauguccccugau

SEQ ID NO: 366866 - RNA, 18 nt, Human
cccagaaaauauuucugc

SEQ ID NO: 366867 - RNA, 23 nt, Human
cccagaaaauauuucugccccac

SEQ ID NO: 366868 - RNA, 18 nt, Human
ccccaaaaauaacgcugg

SEQ ID NO: 366869 - RNA, 19 nt, Human
ccccaaaggcucuaucuuu

SEQ ID NO: 366870 - RNA, 19 nt, Human
ccccuuuccuuccuauucc

SEQ ID NO: 366871 - RNA, 22 nt, Human
ccccuuuccuuccuauucccca

SEQ ID NO: 366872 - RNA, 18 nt, Human
cccuaugcacagcccucc

SEQ ID NO: 366873 - RNA, 19 nt, Human
cccugucuccaaaaauaag

SEQ ID NO: 366874 - RNA, 19 nt, Human
cccuucccccuugggcucc

SEQ ID NO: 366875 - RNA, 21 nt, Human
cccuucccccuugggcuccuc

SEQ ID NO: 366876 - RNA, 19 nt, Human
ccucuugucugcccacuuc

SEQ ID NO: 366877 - RNA, 25 nt, Human
ccuuccuauuccccacaacuggggg

SEQ ID NO: 366878 - RNA, 21 nt, Human
cgcaccaccgcacuccagccu

SEQ ID NO: 366879 - RNA, 22 nt, Human
cggagcaggcgaccuggcugcu

SEQ ID NO: 366880 - RNA, 24 nt, Human
cggccggacgcaguggcucgcgcc

SEQ ID NO: 366881 - RNA, 23 nt, Human
cgggaccaaaauaaagagcaagc

SEQ ID NO: 366882 - RNA, 18 nt, Human
cgggagcgggcggagcag

SEQ ID NO: 366883 - RNA, 24 nt, Human
cuaagaagaguaggagggguccac

SEQ ID NO: 366884 - RNA, 20 nt, Human
cucaguguuuaucaucuggg

SEQ ID NO: 366885 - RNA, 24 nt, Human
cuccaaaaauaagaauaaagaaaa

SEQ ID NO: 366886 - RNA, 21 nt, Human
cuccagccucccaugugagcc

SEQ ID NO: 366887 - RNA, 21 nt, Human
cuccagugacucucagaccca

SEQ ID NO: 366888 - RNA, 22 nt, Human
cuccagugacucucagacccac

SEQ ID NO: 366889 - RNA, 24 nt, Human
cuccagugacucucagacccacga

SEQ ID NO: 366890 - RNA, 22 nt, Human
cucccaugugagccuguccuua

SEQ ID NO: 366891 - RNA, 28 nt, Human
cuccccaaaaauaacgcuggggguaggg

SEQ ID NO: 366892 - RNA, 23 nt, Human
cucgcgccugugguccuagcugc

SEQ ID NO: 366893 - RNA, 18 nt, Human
cugcaacaaccuuccucc

SEQ ID NO: 366894 - RNA, 20 nt, Human
cugccccucucuugaagccc

SEQ ID NO: 366895 - RNA, 21 nt, Human
cugccccucucuugaagcccc

SEQ ID NO: 366896 - RNA, 21 nt, Human
cuggagaggccagagaagaua

SEQ ID NO: 366897 - RNA, 23 nt, Human
cuucccggcgauucauauucugg

SEQ ID NO: 366898 - RNA, 18 nt, Human
cuuccuccuaccccagcc

SEQ ID NO: 366899 - RNA, 19 nt, Human
gagcgggagcgggcggagc

SEQ ID NO: 366900 - RNA, 21 nt, Human
gauccgggaccaaaauaaaga

SEQ ID NO: 366901 - RNA, 22 nt, Human
gcacagcccucccuccccaaaa

SEQ ID NO: 366902 - RNA, 20 nt, Human
gcaccaccgcacuccagccu

SEQ ID NO: 366903 - RNA, 24 nt, Human
gcacuccagccugggcaacagagc

SEQ ID NO: 366904 - RNA, 24 nt, Human
ggacgcaguggcucgcgccugugg

SEQ ID NO: 366905 - RNA, 20 nt, Human
ggagcaggcgaccuggcugc

SEQ ID NO: 366906 - RNA, 22 nt, Human
ggagggaagggagaacaggggc

SEQ ID NO: 366907 - RNA, 19 nt, Human
gggggagggaagggagaac

SEQ ID NO: 366908 - RNA, 21 nt, Human
gucaagugucuuccccaaucc

SEQ ID NO: 366909 - RNA, 20 nt, Human
uaacaggucccaaaacaggu

SEQ ID NO: 366910 - RNA, 24 nt, Human
uaacgcuggggguaggcauugccc

SEQ ID NO: 366911 - RNA, 25 nt, Human
uaggagggguccacuccaaguggca

SEQ ID NO: 366912 - RNA, 25 nt, Human
uauuccccacaacugggggagggaa

SEQ ID NO: 366913 - RNA, 20 nt, Human
ucaccugagcccgggagguc

SEQ ID NO: 366914 - RNA, 23 nt, Human
ucacugaggugcuggguagggcu

SEQ ID NO: 366915 - RNA, 20 nt, Human
ucagacccacgaccgacugc

SEQ ID NO: 366916 - RNA, 23 nt, Human
ucagacccacgaccgacugccaa

SEQ ID NO: 366917 - RNA, 23 nt, Human
uccagccugggcaacagagcgag

SEQ ID NO: 366918 - RNA, 24 nt, Human
uccagccugggcaacagagcgaga

SEQ ID NO: 366919 - RNA, 24 nt, Human
uccauacccguuccacagcagcug

SEQ ID NO: 366920 - RNA, 20 nt, Human
uccccugccccucucuugaa

SEQ ID NO: 366921 - RNA, 20 nt, Human
uccccuuuccuuccuauucc

SEQ ID NO: 366922 - RNA, 24 nt, Human
uccgggaccaaaauaaagagcaag

SEQ ID NO: 366923 - RNA, 21 nt, Human
uccuugggacuggggccagcc

SEQ ID NO: 366924 - RNA, 31 nt, Human
ucgcaccaccgcacuccagccugggcaacaa

SEQ ID NO: 366925 - RNA, 24 nt, Human
ucuugucugcccacuucccucuca

SEQ ID NO: 366926 - RNA, 23 nt, Human
ugaaaugggcuaggaccaacagg

SEQ ID NO: 366927 - RNA, 20 nt, Human
ugacucuagguuuaugaccu

SEQ ID NO: 366928 - RNA, 20 nt, Human
ugagcccgggaggucggggg

SEQ ID NO: 366929 - RNA, 25 nt, Human
ugagcccgggaggucgggggcugca

SEQ ID NO: 366930 - RNA, 20 nt, Human
ugaggcgggagaaucaccug

SEQ ID NO: 366931 - RNA, 24 nt, Human
ugaggcgggagaaucaccugagcc

SEQ ID NO: 366932 - RNA, 21 nt, Human
uggcagcucaguguuuaucau

SEQ ID NO: 366933 - RNA, 23 nt, Human
uggcagggagagaccauuuggcg

SEQ ID NO: 366934 - RNA, 19 nt, Human
uggccugacucuccuccuc

SEQ ID NO: 366935 - RNA, 23 nt, Human
ugggaggagggagauagguauga

SEQ ID NO: 366936 - RNA, 24 nt, Human
ugggcaacagagcgagacccuguc

SEQ ID NO: 366937 - RNA, 21 nt, Human
ugggcaugggacaccaugucc

SEQ ID NO: 366938 - RNA, 19 nt, Human
uggggccagccucuugucu

SEQ ID NO: 366939 - RNA, 21 nt, Human
uggguacccaccuccagccuc

SEQ ID NO: 366940 - RNA, 22 nt, Human
uggguacccaccuccagccucc

SEQ ID NO: 366941 - RNA, 25 nt, Human
uuaaaaaaauguuuuggcagcucag

SEQ ID NO: 366942 - RNA, 20 nt, Human
uuagcucccagagaacuuuu

SEQ ID NO: 366943 - RNA, 23 nt, Human
uugcccuucccccuugggcuccu

SEQ ID NO: 366944 - RNA, 20 nt, Human
uuggcacuuuaaaaauagag

SEQ ID NO: 366945 - RNA, 24 nt, Human
uuuaaaaaaauguuuuggcagcuc

SEQ ID NO: 366946 - RNA, 20 nt, Human
uuuccuuccuauuccccaca

SEQ ID NO: 366947 - RNA, 22 nt, Human
uuuuuuuuuucuagaaacaucu

SEQ ID NO: 366948 - RNA, 19 nt, Human
acaguggucccccaucccc

SEQ ID NO: 366949 - RNA, 23 nt, Human
aggccccuguccugcuuccccaa

SEQ ID NO: 366950 - RNA, 19 nt, Human
agggggaguuggcccuggg

SEQ ID NO: 366951 - RNA, 27 nt, Human
caaccccuggcgcccuuccgucucccu

SEQ ID NO: 366952 - RNA, 21 nt, Human
caggccccuguccugcuuccc

SEQ ID NO: 366953 - RNA, 18 nt, Human
cccagugcuucugggcug

SEQ ID NO: 366954 - RNA, 23 nt, Human
cccuuccgucuccccaggccccu

SEQ ID NO: 366955 - RNA, 21 nt, Human
ccucaugagcaggaggguggg

SEQ ID NO: 366956 - RNA, 23 nt, Human
ccuccuccgccuccuggaguuuu

SEQ ID NO: 366957 - RNA, 20 nt, Human
ccuggcgcccuuccgucucc

SEQ ID NO: 366958 - RNA, 20 nt, Human
ccuggggagaagagggacug

SEQ ID NO: 366959 - RNA, 20 nt, Human
ccugucugcccucaugagca

SEQ ID NO: 366960 - RNA, 26 nt, Human
cggcagggggaguuggcccugggguc

SEQ ID NO: 366961 - RNA, 20 nt, Human
cucaaccccuggcgcccuuc

SEQ ID NO: 366962 - RNA, 19 nt, Human
cucaugagcaggagggugg

SEQ ID NO: 366963 - RNA, 19 nt, Human
cugagggcggcuuugcugg

SEQ ID NO: 366964 - RNA, 22 nt, Human
cuuugcugggguuguccagggc

SEQ ID NO: 366965 - RNA, 20 nt, Human
gcccagugcuucugggcugg

SEQ ID NO: 366966 - RNA, 20 nt, Human
ggguccuggggagaagaggg

SEQ ID NO: 366967 - RNA, 22 nt, Human
uacuggaguugggacuggggcc

SEQ ID NO: 366968 - RNA, 22 nt, Human
ucaaaggugggggacuagggca

SEQ ID NO: 366969 - RNA, 19 nt, Human
ucagcucccagcgugcuca

SEQ ID NO: 366970 - RNA, 19 nt, Human
uccaagggacaagaguguc

SEQ ID NO: 366971 - RNA, 18 nt, Human
uccccaggccccuguccu

SEQ ID NO: 366972 - RNA, 19 nt, Human
uccccaggccccuguccug

SEQ ID NO: 366973 - RNA, 25 nt, Human
ugcccucaugagcaggagggugggc

SEQ ID NO: 366974 - RNA, 19 nt, Human
ugcugggguuguccagggc

SEQ ID NO: 366975 - RNA, 24 nt, Human
uggcagagggccggcagggggagu

SEQ ID NO: 366976 - RNA, 20 nt, Human
uggccuguggggagggucag

SEQ ID NO: 366977 - RNA, 24 nt, Human
uggcugagggcggcuuugcugggg

SEQ ID NO: 366978 - RNA, 20 nt, Human
ugggaucuuaagucaaaggu

SEQ ID NO: 366979 - RNA, 20 nt, Human
ugggaucuuaagucaaaggu

SEQ ID NO: 366980 - RNA, 22 nt, Human
uggggagaagagggacuguguc

SEQ ID NO: 366981 - RNA, 21 nt, Human
uuacuggaguugggacugggg

SEQ ID NO: 366982 - RNA, 21 nt, Human
uuacuggaguugggacugggg

SEQ ID NO: 366983 - RNA, 24 nt, Human
uuacuggaguugggacuggggccc

SEQ ID NO: 366984 - RNA, 19 nt, Human
uucugggcuggcugagggc

SEQ ID NO: 366985 - RNA, 25 nt, Human
uuuuuuuuuuuuuuuuuuuccaagg

SEQ ID NO: 366986 - RNA, 26 nt, Human
uuuuuuuuuuuuuuuuuuuccaaggg

SEQ ID NO: 366987 - RNA, 23 nt, Human
uuuuuuuuuuuuuuuuuuuucca

SEQ ID NO: 366988 - RNA, 24 nt, Human
uuuuuuuuuuuuuuuuuuuuuccu

SEQ ID NO: 366989 - RNA, 22 nt, Human
cuuacaaucccacugaaaugcc

SEQ ID NO: 366990 - RNA, 21 nt, Human
uacaaucccacugaaaugcca

SEQ ID NO: 366991 - RNA, 19 nt, Human
uacaugaagcuauuacaaa

SEQ ID NO: 366992 - RNA, 23 nt, Human
uauuacaaaugcuuacaauccca

SEQ ID NO: 366993 - RNA, 19 nt, Human
uuuuuucaaaacauuugag

SEQ ID NO: 366994 - RNA, 20 nt, Human
aacacagucagaccccgucu

SEQ ID NO: 366995 - RNA, 21 nt, Human
aacacagucagaccccgucuc

SEQ ID NO: 366996 - RNA, 19 nt, Human
aacacagugagaccccaac

SEQ ID NO: 366997 - RNA, 20 nt, Human
aacacagugagaccccaacu

SEQ ID NO: 366998 - RNA, 21 nt, Human
aacacagugagaccccaacuc

SEQ ID NO: 366999 - RNA, 21 nt, Human
aacacagugagaccccaacuc

SEQ ID NO: 367000 - RNA, 23 nt, Human
aagaggaucaccugaggccaaga

SEQ ID NO: 367001 - RNA, 20 nt, Human
aaggggcagcucagaacagg

SEQ ID NO: 367002 - RNA, 20 nt, Human
acacagugagaccccaacuc

SEQ ID NO: 367003 - RNA, 19 nt, Human
accagucugggcaacacag

SEQ ID NO: 367004 - RNA, 20 nt, Human
acccuggacaccagccuccg

SEQ ID NO: 367005 - RNA, 22 nt, Human
agaguugaagaccagccugggu

SEQ ID NO: 367006 - RNA, 18 nt, Human
agccuggguaacacaguc

SEQ ID NO: 367007 - RNA, 24 nt, Human
agccuggguaacacagucagaccc

SEQ ID NO: 367008 - RNA, 24 nt, Human
aggaucaccugaggccaagaguuc

SEQ ID NO: 367009 - RNA, 27 nt, Human
aggaucacuugaggccaagaguugaag

SEQ ID NO: 367010 - RNA, 18 nt, Human
aggcaggaggaucacuug

SEQ ID NO: 367011 - RNA, 18 nt, Human
aggcggauccugcacaca

SEQ ID NO: 367012 - RNA, 22 nt, Human
agucugggcaacacagugagac

SEQ ID NO: 367013 - RNA, 24 nt, Human
agucugggcaacacagugagaccc

SEQ ID NO: 367014 - RNA, 19 nt, Human
caacucugagucguccccc

SEQ ID NO: 367015 - RNA, 18 nt, Human
cacacagguuuggggugu

SEQ ID NO: 367016 - RNA, 19 nt, Human
caccgcuccugccacaugc

SEQ ID NO: 367017 - RNA, 24 nt, Human
caccugaggccaagaguucgagac

SEQ ID NO: 367018 - RNA, 23 nt, Human
cacuugaggccaagaguugaaga

SEQ ID NO: 367019 - RNA, 20 nt, Human
ccaagccgcaaugcggucgg

SEQ ID NO: 367020 - RNA, 19 nt, Human
cccgcgcugagacccugga

SEQ ID NO: 367021 - RNA, 21 nt, Human
cccuggacaccagccuccgaa

SEQ ID NO: 367022 - RNA, 23 nt, Human
ccuggguaacacagucagacccc

SEQ ID NO: 367023 - RNA, 20 nt, Human
cgcgcugagacccuggacac

SEQ ID NO: 367024 - RNA, 24 nt, Human
cgcgcugagacccuggacaccagc

SEQ ID NO: 367025 - RNA, 24 nt, Human
cugagacccuggacaccagccucc

SEQ ID NO: 367026 - RNA, 23 nt, Human
cugggcaacacagugagacccca

SEQ ID NO: 367027 - RNA, 19 nt, Human
gaaggaaaggagaagggua

SEQ ID NO: 367028 - RNA, 22 nt, Human
gacacgacggcgaucgaggcuu

SEQ ID NO: 367029 - RNA, 24 nt, Human
gaucaccugaggccaagaguucga

SEQ ID NO: 367030 - RNA, 23 nt, Human
gaucacuugaggccaagaguuga

SEQ ID NO: 367031 - RNA, 26 nt, Human
gaucucaccgcuccugccacaugcac

SEQ ID NO: 367032 - RNA, 18 nt, Human
gcacugggugagaaaacc

SEQ ID NO: 367033 - RNA, 23 nt, Human
gcagcucagaacaggguuagagg

SEQ ID NO: 367034 - RNA, 18 nt, Human
gcggauccugcacacagg

SEQ ID NO: 367035 - RNA, 19 nt, Human
ggaaaggagaaggguagug

SEQ ID NO: 367036 - RNA, 23 nt, Human
ggaucaccugaggccaagaguuc

SEQ ID NO: 367037 - RNA, 19 nt, Human
ggaucacuugaggccaaga

SEQ ID NO: 367038 - RNA, 19 nt, Human
ggccaagaguugaagacca

SEQ ID NO: 367039 - RNA, 23 nt, Human
gggcaacacagugagaccccaac

SEQ ID NO: 367040 - RNA, 20 nt, Human
gggugugugggcaaggggca

SEQ ID NO: 367041 - RNA, 24 nt, Human
uaacacagucagaccccgucucua

SEQ ID NO: 367042 - RNA, 20 nt, Human
uaaggcaggaggaucacuug

SEQ ID NO: 367043 - RNA, 23 nt, Human
uaaggcaggaggaucacuugagg

SEQ ID NO: 367044 - RNA, 25 nt, Human
uaaggcaggaggaucacuugaggcc

SEQ ID NO: 367045 - RNA, 26 nt, Human
uaaggcaggaggaucacuugaggcca

SEQ ID NO: 367046 - RNA, 18 nt, Human
ucagcauucuuggaagcu

SEQ ID NO: 367047 - RNA, 19 nt, Human
ucccccgcgcugagacccu

SEQ ID NO: 367048 - RNA, 27 nt, Human
ucgacacgacggcgaucgaggcuucuu

SEQ ID NO: 367049 - RNA, 19 nt, Human
ugagaaaaccaagccgcaa

SEQ ID NO: 367050 - RNA, 20 nt, Human
ugagggaagaggaucaccug

SEQ ID NO: 367051 - RNA, 23 nt, Human
ugagggaagaggaucaccugagg

SEQ ID NO: 367052 - RNA, 24 nt, Human
ugggaagcugagggaagaggauca

SEQ ID NO: 367053 - RNA, 22 nt, Human
ugggcaacacagugagacccca

SEQ ID NO: 367054 - RNA, 18 nt, Human
ugugugggcaaggggcag

SEQ ID NO: 367055 - RNA, 24 nt, Human
uucaggaggcuguagcuccaugga

SEQ ID NO: 367056 - RNA, 24 nt, Human
uuggaagcuaaggcaggaggauca

SEQ ID NO: 367057 - RNA, 21 nt, Human
uuuuuuuuuuuuuuuuugcaa

SEQ ID NO: 367058 - RNA, 21 nt, Human
uuuuuuuuuuuuuuuuuuugg

SEQ ID NO: 367059 - RNA, 24 nt, Human
aagcaccccacccgcucacccacc

SEQ ID NO: 367060 - RNA, 22 nt, Human
acauguaucuuugguccucagu

SEQ ID NO: 367061 - RNA, 22 nt, Human
accccacccgcucacccaccuc

SEQ ID NO: 367062 - RNA, 22 nt, Human
acccgcucacccaccuccugcc

SEQ ID NO: 367063 - RNA, 21 nt, Human
acuucugcuuuuccuuggaag

SEQ ID NO: 367064 - RNA, 23 nt, Human
agaagaggaaauauaggccugga

SEQ ID NO: 367065 - RNA, 18 nt, Human
agcagaguggggaaggga

SEQ ID NO: 367066 - RNA, 18 nt, Human
aggagggacugugcaaca

SEQ ID NO: 367067 - RNA, 21 nt, Human
aggcuacccuuuguggaaggu

SEQ ID NO: 367068 - RNA, 21 nt, Human
agggacuuacccaaggucaca

SEQ ID NO: 367069 - RNA, 24 nt, Human
agugaaaguguggcaacaggaggg

SEQ ID NO: 367070 - RNA, 18 nt, Human
caacaggagggacugugc

SEQ ID NO: 367071 - RNA, 22 nt, Human
caagcaccccacccgcucaccc

SEQ ID NO: 367072 - RNA, 18 nt, Human
caagggacuuacccaagg

SEQ ID NO: 367073 - RNA, 28 nt, Human
caagggacuuacccaaggucacacagca

SEQ ID NO: 367074 - RNA, 21 nt, Human
cacacagcaagcaccccaccc

SEQ ID NO: 367075 - RNA, 20 nt, Human
cacccaccuccugccuuugc

SEQ ID NO: 367076 - RNA, 21 nt, Human
caccccacccgcucacccacc

SEQ ID NO: 367077 - RNA, 23 nt, Human
caccccacccgcucacccaccuc

SEQ ID NO: 367078 - RNA, 21 nt, Human
cacgccuuccuuccccaccca

SEQ ID NO: 367079 - RNA, 19 nt, Human
caugaacuucugcuuuucc

SEQ ID NO: 367080 - RNA, 21 nt, Human
ccaaggucacacagcaagcac

SEQ ID NO: 367081 - RNA, 21 nt, Human
ccacagcccuggggccucagc

SEQ ID NO: 367082 - RNA, 24 nt, Human
cccagccagaaaagccaggcuacc

SEQ ID NO: 367083 - RNA, 22 nt, Human
cccccagcauaacccgcaccgc

SEQ ID NO: 367084 - RNA, 18 nt, Human
cccgcaccgcgggucccu

SEQ ID NO: 367085 - RNA, 23 nt, Human
cccgcucacccaccuccugccuu

SEQ ID NO: 367086 - RNA, 19 nt, Human
cccuggggccucagcugcu

SEQ ID NO: 367087 - RNA, 19 nt, Human
ccgcaccgcgggucccugc

SEQ ID NO: 367088 - RNA, 23 nt, Human
ccugccuguaccuuccuucaccc

SEQ ID NO: 367089 - RNA, 23 nt, Human
ccugguucaaaucccagcugcac

SEQ ID NO: 367090 - RNA, 24 nt, Human
ccuguaccuuccuucacccaggac

SEQ ID NO: 367091 - RNA, 22 nt, Human
ccugugcugggaagagggaggg

SEQ ID NO: 367092 - RNA, 23 nt, Human
cgcucacccaccuccugccuuug

SEQ ID NO: 367093 - RNA, 18 nt, Human
cggaccuugaaaucagaa

SEQ ID NO: 367094 - RNA, 22 nt, Human
cgugguccugaguguccaguug

SEQ ID NO: 367095 - RNA, 22 nt, Human
cuaccccugccugugcugggaa

SEQ ID NO: 367096 - RNA, 19 nt, Human
cugggaagagggagggcuc

SEQ ID NO: 367097 - RNA, 21 nt, Human
cuggggccucagcugcugcuc

SEQ ID NO: 367098 - RNA, 21 nt, Human
cugguucaaaucccagcugcc

SEQ ID NO: 367099 - RNA, 19 nt, Human
gcccagagaagagggucuc

SEQ ID NO: 367100 - RNA, 19 nt, Human
ggacacgccuuccuucccc

SEQ ID NO: 367101 - RNA, 21 nt, Human
ggagucacaggggaagggaaa

SEQ ID NO: 367102 - RNA, 18 nt, Human
ggauguggaauggugggg

SEQ ID NO: 367103 - RNA, 18 nt, Human
gggaaaguggacgcauga

SEQ ID NO: 367104 - RNA, 21 nt, Human
gggaagagggagggcucagau

SEQ ID NO: 367105 - RNA, 22 nt, Human
gggagggucuagggccugggcc

SEQ ID NO: 367106 - RNA, 22 nt, Human
gggggagggucuagggccuggg

SEQ ID NO: 367107 - RNA, 19 nt, Human
gucaagggacuuacccaag

SEQ ID NO: 367108 - RNA, 18 nt, Human
gucacaggggaagggaaa

SEQ ID NO: 367109 - RNA, 23 nt, Human
uacauguaucuuugguccucagu

SEQ ID NO: 367110 - RNA, 26 nt, Human
uagaacagucccuguggaguuuacaa

SEQ ID NO: 367111 - RNA, 20 nt, Human
uaucuuugguccucaguaac

SEQ ID NO: 367112 - RNA, 19 nt, Human
ucaaaucccagcuauguga

SEQ ID NO: 367113 - RNA, 25 nt, Human
ucaagguaggggcugggagcagagu

SEQ ID NO: 367114 - RNA, 23 nt, Human
ucaauauacccauuuuacagaag

SEQ ID NO: 367115 - RNA, 22 nt, Human
ucaguucaaaucccagcuaugu

SEQ ID NO: 367116 - RNA, 20 nt, Human
uccagcacgggauccccagu

SEQ ID NO: 367117 - RNA, 21 nt, Human
ucuagggccugggcccgcccc

SEQ ID NO: 367118 - RNA, 21 nt, Human
ucucaagguaggggcugggag

SEQ ID NO: 367119 - RNA, 24 nt, Human
ugccuuugcuucuaccccugccug

SEQ ID NO: 367120 - RNA, 21 nt, Human
ugcugggaagagggagggcuc

SEQ ID NO: 367121 - RNA, 24 nt, Human
uggaagguggggauguggaauggu

SEQ ID NO: 367122 - RNA, 18 nt, Human
uggggaagggaggaguca

SEQ ID NO: 367123 - RNA, 23 nt, Human
uggggaagggaggagucacaggg

SEQ ID NO: 367124 - RNA, 24 nt, Human
uggggauguggaauggugggggag

SEQ ID NO: 367125 - RNA, 22 nt, Human
uggugggggagggucuagggcc

SEQ ID NO: 367126 - RNA, 18 nt, Human
ugguucaaaucccagcug

SEQ ID NO: 367127 - RNA, 21 nt, Human
ugugcugggaagagggagggc

SEQ ID NO: 367128 - RNA, 22 nt, Human
ugugcugggaagagggagggcu

SEQ ID NO: 367129 - RNA, 20 nt, Human
uuacagaagaggaaauauag

SEQ ID NO: 367130 - RNA, 19 nt, Human
aaacuaaaaagaaguuuga

SEQ ID NO: 367131 - RNA, 20 nt, Human
aaagaaguuugacuaccuuu

SEQ ID NO: 367132 - RNA, 24 nt, Human
aacaguuuuuuaugauccaaguau

SEQ ID NO: 367133 - RNA, 19 nt, Human
acucgcucugcuuagccgg

SEQ ID NO: 367134 - RNA, 21 nt, Human
aggcgucuucaggucucuaaa

SEQ ID NO: 367135 - RNA, 23 nt, Human
caacuaucccugagucagcuuuc

SEQ ID NO: 367136 - RNA, 19 nt, Human
cagugucuucagugucuua

SEQ ID NO: 367137 - RNA, 18 nt, Human
ccucuggaauaagcaccu

SEQ ID NO: 367138 - RNA, 23 nt, Human
cucauauauauguaaaaaauaaa

SEQ ID NO: 367139 - RNA, 18 nt, Human
cucgcucugcuuagccgg

SEQ ID NO: 367140 - RNA, 20 nt, Human
cugagucagcuuucuucucu

SEQ ID NO: 367141 - RNA, 22 nt, Human
cuuucuucucuuuucggcuuuc

SEQ ID NO: 367142 - RNA, 26 nt, Human
gacuaccuuucaaaaauucuccugaa

SEQ ID NO: 367143 - RNA, 21 nt, Human
gagucauagacaagucucccu

SEQ ID NO: 367144 - RNA, 21 nt, Human
uaaauaagaaaaaugaaacag

SEQ ID NO: 367145 - RNA, 19 nt, Human
uacacucagcccggcacuc

SEQ ID NO: 367146 - RNA, 24 nt, Human
uacaguagccaaaugcauaaauac

SEQ ID NO: 367147 - RNA, 23 nt, Human
uagguguauaugacuuaucucuu

SEQ ID NO: 367148 - RNA, 18 nt, Human
ucagaauccaguuuacaa

SEQ ID NO: 367149 - RNA, 18 nt, Human
ucccugagucagcuuucu

SEQ ID NO: 367150 - RNA, 23 nt, Human
ucccugagucagcuuucuucucu

SEQ ID NO: 367151 - RNA, 24 nt, Human
ucuucagugucuuacacucagccc

SEQ ID NO: 367152 - RNA, 23 nt, Human
ugcuccgaaauuuuaacaccgaa

SEQ ID NO: 367153 - RNA, 25 nt, Human
uggagcaaaacuuacaguagccaaa

SEQ ID NO: 367154 - RNA, 23 nt, Human
uguaacgccucuggaauaagcac

SEQ ID NO: 367155 - RNA, 22 nt, Human
aacauaugguucccuuuuuaca

SEQ ID NO: 367156 - RNA, 22 nt, Human
aagaacacagaacgaaaagcca

SEQ ID NO: 367157 - RNA, 23 nt, Human
aagccagucaccagaucuuacaa

SEQ ID NO: 367158 - RNA, 21 nt, Human
agacagccgcccagcccgcuc

SEQ ID NO: 367159 - RNA, 19 nt, Human
auaauaugagaaaaacaaa

SEQ ID NO: 367160 - RNA, 21 nt, Human
caagaacacagaacgaaaagc

SEQ ID NO: 367161 - RNA, 23 nt, Human
caagaacacagaacgaaaagcca

SEQ ID NO: 367162 - RNA, 21 nt, Human
caauuugauacauuaucccaa

SEQ ID NO: 367163 - RNA, 22 nt, Human
cacagaacgaaaagccagucac

SEQ ID NO: 367164 - RNA, 23 nt, Human
cagauaaauuuaggaagccaaga

SEQ ID NO: 367165 - RNA, 18 nt, Human
cagcagugaauagugugg

SEQ ID NO: 367166 - RNA, 21 nt, Human
caugguccacaagguuuucuu

SEQ ID NO: 367167 - RNA, 23 nt, Human
ccacaagguuuucuuuugggauu

SEQ ID NO: 367168 - RNA, 23 nt, Human
cccgcucugcgacgcagcaguga

SEQ ID NO: 367169 - RNA, 19 nt, Human
cgcccagcccgcucugcga

SEQ ID NO: 367170 - RNA, 18 nt, Human
gaaaagccagucaccaga

SEQ ID NO: 367171 - RNA, 18 nt, Human
gaaaagccagucaccaga

SEQ ID NO: 367172 - RNA, 22 nt, Human
gcagcagugaauagugugguac

SEQ ID NO: 367173 - RNA, 25 nt, Human
gggcagauaaauuuaggaagccaag

SEQ ID NO: 367174 - RNA, 23 nt, Human
guuacaacgggaucguaaugacu

SEQ ID NO: 367175 - RNA, 20 nt, Human
uagcuugauugagaagaagc

SEQ ID NO: 367176 - RNA, 20 nt, Human
uaggaagccaagaacacaga

SEQ ID NO: 367177 - RNA, 22 nt, Human
ucaucuaaacuucucuggccau

SEQ ID NO: 367178 - RNA, 23 nt, Human
ucucacuuuacaaauucucaaaa

SEQ ID NO: 367179 - RNA, 19 nt, Human
ugagaaaaacaaaacgguu

SEQ ID NO: 367180 - RNA, 20 nt, Human
ugagaaaaacaaaacgguua

SEQ ID NO: 367181 - RNA, 19 nt, Human
ugagaagaagcgcuuccgg

SEQ ID NO: 367182 - RNA, 21 nt, Human
ugagaagaagcgcuuccggcg

SEQ ID NO: 367183 - RNA, 21 nt, Human
ugggcagauaaauuuaggaag

SEQ ID NO: 367184 - RNA, 24 nt, Human
ugggcagauaaauuuaggaagcca

SEQ ID NO: 367185 - RNA, 25 nt, Human
uuaucgggaugcugugcagaacggg

SEQ ID NO: 367186 - RNA, 19 nt, Human
aaucuuagcccuuuucgcu

SEQ ID NO: 367187 - RNA, 21 nt, Human
aggagggaggggcaugggagg

SEQ ID NO: 367188 - RNA, 22 nt, Human
aggagggaggggcaugggaggg

SEQ ID NO: 367189 - RNA, 25 nt, Human
caucccaccagccuguccccucguc

SEQ ID NO: 367190 - RNA, 23 nt, Human
ccaucggucccucggcugucccu

SEQ ID NO: 367191 - RNA, 18 nt, Human
cccgugcccaccccgggg

SEQ ID NO: 367192 - RNA, 21 nt, Human
ccuuuucgcugucgcugcggc

SEQ ID NO: 367193 - RNA, 20 nt, Human
cgacugccccgugcccaccc

SEQ ID NO: 367194 - RNA, 22 nt, Human
cgaggcggaggcauaacccgcu

SEQ ID NO: 367195 - RNA, 18 nt, Human
gagggaggggcaugggag

SEQ ID NO: 367196 - RNA, 18 nt, Human
ggagggaggggcauggga

SEQ ID NO: 367197 - RNA, 24 nt, Human
ggaggggcaugggagggggaaccc

SEQ ID NO: 367198 - RNA, 24 nt, Human
ucacuuaaauaaaaaggagggagg

SEQ ID NO: 367199 - RNA, 19 nt, Human
ucagggcaacgaggcggag

SEQ ID NO: 367200 - RNA, 21 nt, Human
uccaucggucccucggcuguc

SEQ ID NO: 367201 - RNA, 24 nt, Human
ucccucggcugucccucgguggcg

SEQ ID NO: 367202 - RNA, 23 nt, Human
ucgcugucgcugcggcuuucaac

SEQ ID NO: 367203 - RNA, 23 nt, Human
ucguccaucggucccucggcugu

SEQ ID NO: 367204 - RNA, 20 nt, Human
uuaaauaaaaaggagggagg

SEQ ID NO: 367205 - RNA, 22 nt, Human
uuacugcaggggcaguggggga

SEQ ID NO: 367206 - RNA, 27 nt, Human
uucacuuaaauaaaaaggagggagggg

SEQ ID NO: 367207 - RNA, 19 nt, Human
uuuuuugggggccaaagca

SEQ ID NO: 367208 - RNA, 20 nt, Human
uuuuuuuuuuuuugggggcc

SEQ ID NO: 367209 - RNA, 20 nt, Human
uuuuuuuuuuuuuuuggggg

SEQ ID NO: 367210 - RNA, 22 nt, Human
uuuuuuuuuuuuuuuuuggggg

SEQ ID NO: 367211 - RNA, 24 nt, Human
aaacaaaaacaaaugacauuaaca

SEQ ID NO: 367212 - RNA, 23 nt, Human
aaacaaacagccaaacaaaaaca

SEQ ID NO: 367213 - RNA, 24 nt, Human
aaacaaacagccaaacaaaaacaa

SEQ ID NO: 367214 - RNA, 21 nt, Human
aaacaacaaaaucuaggaaga

SEQ ID NO: 367215 - RNA, 18 nt, Human
aaacagaauucuugcuuu

SEQ ID NO: 367216 - RNA, 19 nt, Human
aaacagccaaacaaaaaca

SEQ ID NO: 367217 - RNA, 18 nt, Human
aaaccaccaccaaauccg

SEQ ID NO: 367218 - RNA, 24 nt, Human
aaaccaccaccaaauccgguucau

SEQ ID NO: 367219 - RNA, 18 nt, Human
aaagaaaucaaagcccuu

SEQ ID NO: 367220 - RNA, 24 nt, Human
aaaguuaauaaagacuuaagagaa

SEQ ID NO: 367221 - RNA, 20 nt, Human
aacaaaaacaaaugacauua

SEQ ID NO: 367222 - RNA, 19 nt, Human
aacaaaaguaccuuuaacu

SEQ ID NO: 367223 - RNA, 22 nt, Human
aaccaaaaaacucggaagacaa

SEQ ID NO: 367224 - RNA, 19 nt, Human
aauacaaaugugaagccag

SEQ ID NO: 367225 - RNA, 18 nt, Human
aauauguaauguaucaua

SEQ ID NO: 367226 - RNA, 22 nt, Human
acaaaaccagaggcauuuuugc

SEQ ID NO: 367227 - RNA, 18 nt, Human
acaaacagguuacaaugu

SEQ ID NO: 367228 - RNA, 25 nt, Human
acagccaaacaaaaacaaaugacau

SEQ ID NO: 367229 - RNA, 18 nt, Human
acauuccagcacuugcua

SEQ ID NO: 367230 - RNA, 24 nt, Human
accucuacucagaggcugaaauga

SEQ ID NO: 367231 - RNA, 18 nt, Human
acuccacagauaaguuca

SEQ ID NO: 367232 - RNA, 20 nt, Human
acuccacagauaaguucauu

SEQ ID NO: 367233 - RNA, 24 nt, Human
agaaacaaaaccaccaccaaaucc

SEQ ID NO: 367234 - RNA, 20 nt, Human
agacacuugacuuagucauc

SEQ ID NO: 367235 - RNA, 20 nt, Human
agcacauacacaaacacaca

SEQ ID NO: 367236 - RNA, 20 nt, Human
aggcauuuuugcucuuuuga

SEQ ID NO: 367237 - RNA, 21 nt, Human
auaaagaaaaaaggaaagucu

SEQ ID NO: 367238 - RNA, 22 nt, Human
auagaaacaaaaccaccaccaa

SEQ ID NO: 367239 - RNA, 23 nt, Human
auagagcacaaugaaaugagcca

SEQ ID NO: 367240 - RNA, 21 nt, Human
aucaaagcccuucucuauucc

SEQ ID NO: 367241 - RNA, 23 nt, Human
augacauuuuuaaaaacuucccu

SEQ ID NO: 367242 - RNA, 22 nt, Human
augagcauaaaauacacgcaaa

SEQ ID NO: 367243 - RNA, 23 nt, Human
caaaaugagaaaaugucuaacaa

SEQ ID NO: 367244 - RNA, 24 nt, Human
caaauccccaaucuaaagccaaaa

SEQ ID NO: 367245 - RNA, 25 nt, Human
caaauccccaaucuaaagccaaaaa

SEQ ID NO: 367246 - RNA, 21 nt, Human
caaauguaagguacuauucug

SEQ ID NO: 367247 - RNA, 20 nt, Human
caaggaaaacagugcguccc

SEQ ID NO: 367248 - RNA, 26 nt, Human
caagugagguuuuaacacaauaacau

SEQ ID NO: 367249 - RNA, 22 nt, Human
cacuggaugacuuuagcccuga

SEQ ID NO: 367250 - RNA, 18 nt, Human
cagacaaagacaagccag

SEQ ID NO: 367251 - RNA, 24 nt, Human
caguaagcacagcuccaaagcuaa

SEQ ID NO: 367252 - RNA, 19 nt, Human
cauaucuaaaucucuggcc

SEQ ID NO: 367253 - RNA, 20 nt, Human
caugaaaccacagauacuuu

SEQ ID NO: 367254 - RNA, 21 nt, Human
caugagcauaaaauacacgca

SEQ ID NO: 367255 - RNA, 22 nt, Human
cauuguaggacugggacaaagu

SEQ ID NO: 367256 - RNA, 19 nt, Human
cauuuucauaaaagguguu

SEQ ID NO: 367257 - RNA, 25 nt, Human
ccagacaaagacaagccaguaagcc

SEQ ID NO: 367258 - RNA, 21 nt, Human
ccccagccccacuccucaacc

SEQ ID NO: 367259 - RNA, 18 nt, Human
ccccuggcacacaaaaca

SEQ ID NO: 367260 - RNA, 20 nt, Human
ccugcuaagccucccaaauc

SEQ ID NO: 367261 - RNA, 24 nt, Human
ccugcuaagccucccaaaucccca

SEQ ID NO: 367262 - RNA, 22 nt, Human
ccuuugguucugaacuguaucu

SEQ ID NO: 367263 - RNA, 25 nt, Human
cuaaagccaaaaagaaaucaaagcc

SEQ ID NO: 367264 - RNA, 22 nt, Human
cuccccagccccacuccucaac

SEQ ID NO: 367265 - RNA, 27 nt, Human
cucuccccagccccacuccucaaccuu

SEQ ID NO: 367266 - RNA, 22 nt, Human
cugaaagugcguauugauucug

SEQ ID NO: 367267 - RNA, 27 nt, Human
cugaucuugccuucuggcuuacccuag

SEQ ID NO: 367268 - RNA, 23 nt, Human
cugcuucuaguauaccccucaac

SEQ ID NO: 367269 - RNA, 21 nt, Human
cuggcuuacccuagagauugu

SEQ ID NO: 367270 - RNA, 19 nt, Human
gaauauguaccagccauga

SEQ ID NO: 367271 - RNA, 19 nt, Human
gagaagcagagagagcgcu

SEQ ID NO: 367272 - RNA, 22 nt, Human
gagcacauacacaaacacacaa

SEQ ID NO: 367273 - RNA, 21 nt, Human
gaggagagagguuuuuguuuu

SEQ ID NO: 367274 - RNA, 23 nt, Human
gaucacggguuaagcugaauuua

SEQ ID NO: 367275 - RNA, 21 nt, Human
gaugcaucauuucucucucca

SEQ ID NO: 367276 - RNA, 20 nt, Human
gugucugugucuugagugac

SEQ ID NO: 367277 - RNA, 26 nt, Human
uaaaaaauaaacaaacagccaaacaa

SEQ ID NO: 367278 - RNA, 18 nt, Human
uaaaaagaggcaacuauu

SEQ ID NO: 367279 - RNA, 18 nt, Human
uaaaacuguaaaauacua

SEQ ID NO: 367280 - RNA, 21 nt, Human
uaaaauagcagcacuuuuucc

SEQ ID NO: 367281 - RNA, 23 nt, Human
uaaacaaacagccaaacaaaaac

SEQ ID NO: 367282 - RNA, 18 nt, Human
uaacacaauaacauauaa

SEQ ID NO: 367283 - RNA, 18 nt, Human
uaacauaacaaugagugg

SEQ ID NO: 367284 - RNA, 20 nt, Human
uaacauauaauucaccacua

SEQ ID NO: 367285 - RNA, 27 nt, Human
uaacauugcacauauauacaccagcca

SEQ ID NO: 367286 - RNA, 23 nt, Human
uaacuacuucuguuccuuugaaa

SEQ ID NO: 367287 - RNA, 23 nt, Human
uaagaaagacaaacagguuacaa

SEQ ID NO: 367288 - RNA, 18 nt, Human
uaagaagaucacggguaa

SEQ ID NO: 367289 - RNA, 20 nt, Human
uaaguccucuccccagcccc

SEQ ID NO: 367290 - RNA, 24 nt, Human
uaaguccucuccccagccccacuc

SEQ ID NO: 367291 - RNA, 22 nt, Human
uacaaaauccuuaauacuucca

SEQ ID NO: 367292 - RNA, 24 nt, Human
uacacaaauauaucuaaauguccc

SEQ ID NO: 367293 - RNA, 19 nt, Human
uacacgcaaacugaauuac

SEQ ID NO: 367294 - RNA, 22 nt, Human
uacacuguacucugcagcucug

SEQ ID NO: 367295 - RNA, 25 nt, Human
uacuauguuauaggaauuuuaggau

SEQ ID NO: 367296 - RNA, 19 nt, Human
uagaaacaaaaccaccacc

SEQ ID NO: 367297 - RNA, 25 nt, Human
uagaaagcuagauaauauagacuca

SEQ ID NO: 367298 - RNA, 22 nt, Human
uauaaaaaaauuuacuguugua

SEQ ID NO: 367299 - RNA, 24 nt, Human
uauacaccagccauggcacagagc

SEQ ID NO: 367300 - RNA, 19 nt, Human
uaugaaaaggauugaagaa

SEQ ID NO: 367301 - RNA, 24 nt, Human
uauuuguguguguauguaugugua

SEQ ID NO: 367302 - RNA, 25 nt, Human
ucaaaggacacaucugaaaguuuaa

SEQ ID NO: 367303 - RNA, 20 nt, Human
ucacuggaugacuuuagccc

SEQ ID NO: 367304 - RNA, 20 nt, Human
ucacuggaugacuuuagccc

SEQ ID NO: 367305 - RNA, 23 nt, Human
ucacuggaugacuuuagcccuga

SEQ ID NO: 367306 - RNA, 26 nt, Human
ucccaaauccccaaucuaaagccaaa

SEQ ID NO: 367307 - RNA, 18 nt, Human
ucccugaacaaugucaac

SEQ ID NO: 367308 - RNA, 19 nt, Human
ucgguuauucucaugacau

SEQ ID NO: 367309 - RNA, 24 nt, Human
ucuaaaucucuggccaaaacacaa

SEQ ID NO: 367310 - RNA, 20 nt, Human
ucuccccagccccacuccuu

SEQ ID NO: 367311 - RNA, 23 nt, Human
ucuguaauacaacucaaauuauu

SEQ ID NO: 367312 - RNA, 18 nt, Human
ucugucuggaggucaagg

SEQ ID NO: 367313 - RNA, 22 nt, Human
ugaaaaaaauugcaugagagua

SEQ ID NO: 367314 - RNA, 23 nt, Human
ugaaaaggauugaagaaggcuuu

SEQ ID NO: 367315 - RNA, 19 nt, Human
ugaaauguuuucuguucuu

SEQ ID NO: 367316 - RNA, 21 nt, Human
ugacauaggaguuugucucuu

SEQ ID NO: 367317 - RNA, 23 nt, Human
ugacuuagucaucucuuuucuuc

SEQ ID NO: 367318 - RNA, 26 nt, Human
ugacuuagucaucucuuuucuuccaa

SEQ ID NO: 367319 - RNA, 21 nt, Human
ugagaaaaugucuaacaauac

SEQ ID NO: 367320 - RNA, 23 nt, Human
ugcauagaaacaaaaccaccacc

SEQ ID NO: 367321 - RNA, 20 nt, Human
ugcauaggacauugacgugg

SEQ ID NO: 367322 - RNA, 23 nt, Human
ugccuaccaucacucuuuugccu

SEQ ID NO: 367323 - RNA, 22 nt, Human
uggaaggcugaggagagagguu

SEQ ID NO: 367324 - RNA, 20 nt, Human
uggccaaaacacaacuugac

SEQ ID NO: 367325 - RNA, 21 nt, Human
uggccugugaccaaaaacuga

SEQ ID NO: 367326 - RNA, 20 nt, Human
ugggagaagaggcagggaca

SEQ ID NO: 367327 - RNA, 22 nt, Human
uguaaaaaucacauuauauaca

SEQ ID NO: 367328 - RNA, 23 nt, Human
uguaaaaguaacagcuaacucag

SEQ ID NO: 367329 - RNA, 22 nt, Human
ugucucuucucccucaaucucc

SEQ ID NO: 367330 - RNA, 20 nt, Human
ugucuugagugacagaauuu

SEQ ID NO: 367331 - RNA, 19 nt, Human
uguguauuuguguguguau

SEQ ID NO: 367332 - RNA, 21 nt, Human
uucaaugacuuugcccucugc

SEQ ID NO: 367333 - RNA, 22 nt, Human
uuccugcuaagccucccaaauc

SEQ ID NO: 367334 - RNA, 19 nt, Human
uucucccaaacacaaaacc

SEQ ID NO: 367335 - RNA, 19 nt, Human
uucuucaauguacuccaca

SEQ ID NO: 367336 - RNA, 22 nt, Human
uugguucuccaccacucuccag

SEQ ID NO: 367337 - RNA, 24 nt, Human
uuguaaucaaaauuacaaggagac

SEQ ID NO: 367338 - RNA, 19 nt, Human
uuuacagaaagccuggcag

SEQ ID NO: 367339 - RNA, 21 nt, Human
uuuauauugcauguuagagcu

SEQ ID NO: 367340 - RNA, 22 nt, Human
uuuauauugcauguuagagcua

SEQ ID NO: 367341 - RNA, 21 nt, Human
uuuguguguguauguaugugu

SEQ ID NO: 367342 - RNA, 22 nt, Human
uuuuacagaaagccuggcagcu

SEQ ID NO: 367343 - RNA, 19 nt, Human
aaacauccaucagcucaug

SEQ ID NO: 367344 - RNA, 24 nt, Human
aaaccaggauccaaaucccaggga

SEQ ID NO: 367345 - RNA, 24 nt, Human
aaaccaggauccaaaucccaggga

SEQ ID NO: 367346 - RNA, 25 nt, Human
aaaccaggauccaaaucccagggag

SEQ ID NO: 367347 - RNA, 19 nt, Human
aaggaagaaucagagugag

SEQ ID NO: 367348 - RNA, 21 nt, Human
agguuaucuuacacucccacc

SEQ ID NO: 367349 - RNA, 19 nt, Human
caaaucccagggaggccag

SEQ ID NO: 367350 - RNA, 24 nt, Human
caagcuuuggcaggugguacaaua

SEQ ID NO: 367351 - RNA, 26 nt, Human
caggauccaaaucccagggaggccag

SEQ ID NO: 367352 - RNA, 18 nt, Human
ccccuuuuuuucucuucc

SEQ ID NO: 367353 - RNA, 23 nt, Human
cuccuuuuuuuccuucucuggga

SEQ ID NO: 367354 - RNA, 18 nt, Human
cucuuccucuucuugucu

SEQ ID NO: 367355 - RNA, 23 nt, Human
cuggaaaccaggauccaaauccc

SEQ ID NO: 367356 - RNA, 19 nt, Human
cuuagcucuggaaaccagg

SEQ ID NO: 367357 - RNA, 19 nt, Human
cuuccagauuguuugugcc

SEQ ID NO: 367358 - RNA, 19 nt, Human
ggaggagggaacuggggcu

SEQ ID NO: 367359 - RNA, 20 nt, Human
ggauccaaaucccagggagg

SEQ ID NO: 367360 - RNA, 27 nt, Human
guccaggguugagaagggaacauacug

SEQ ID NO: 367361 - RNA, 19 nt, Human
ucccagggaggccagaacc

SEQ ID NO: 367362 - RNA, 21 nt, Human
ucuguuccacaguaugugcaa

SEQ ID NO: 367363 - RNA, 21 nt, Human
ucuuccucuucuugucuguug

SEQ ID NO: 367364 - RNA, 19 nt, Human
ugagaagggaacauacugu

SEQ ID NO: 367365 - RNA, 19 nt, Human
ugauggugucagcacucuu

SEQ ID NO: 367366 - RNA, 19 nt, Human
uggaaacauccaucagcuc

SEQ ID NO: 367367 - RNA, 18 nt, Human
uggcaggugguacaauau

SEQ ID NO: 367368 - RNA, 20 nt, Human
uggguggucuucaggguacu

SEQ ID NO: 367369 - RNA, 24 nt, Human
uuguuugugccaagcuuuggcagg

SEQ ID NO: 367370 - RNA, 19 nt, Human
uuuucuggcaaugcagugg

SEQ ID NO: 367371 - RNA, 25 nt, Human
aaaaaaaauuuaaacauaaaaguua

SEQ ID NO: 367372 - RNA, 18 nt, Human
aaaaugucauuaaucuga

SEQ ID NO: 367373 - RNA, 19 nt, Human
aaacaggauucacauguua

SEQ ID NO: 367374 - RNA, 22 nt, Human
aaauguucaauaugugcuaauu

SEQ ID NO: 367375 - RNA, 19 nt, Human
aacaaaacaaaacuggggu

SEQ ID NO: 367376 - RNA, 21 nt, Human
aaccuugaauaauaaagcaac

SEQ ID NO: 367377 - RNA, 23 nt, Human
aagcaacaaaagccacaacacaa

SEQ ID NO: 367378 - RNA, 20 nt, Human
aagcauuguaaaaacauuuu

SEQ ID NO: 367379 - RNA, 21 nt, Human
aagccacaacacaaaaacuaa

SEQ ID NO: 367380 - RNA, 30 nt, Human
aauaaagcaacaaaagccacaacacaaaag

SEQ ID NO: 367381 - RNA, 23 nt, Human
aaucacuuaaaacaagcaguuaa

SEQ ID NO: 367382 - RNA, 19 nt, Human
aaucugguuuacaaauaca

SEQ ID NO: 367383 - RNA, 23 nt, Human
acaagcaguuaauuacuuaaaca

SEQ ID NO: 367384 - RNA, 24 nt, Human
acaauggauaccuagauaugaagg

SEQ ID NO: 367385 - RNA, 22 nt, Human
acacaauuaaauaaaaucacag

SEQ ID NO: 367386 - RNA, 22 nt, Human
acuaagcuccauucuggaaauc

SEQ ID NO: 367387 - RNA, 18 nt, Human
acuacugcuuacauacac

SEQ ID NO: 367388 - RNA, 19 nt, Human
acuauguuuuccuauaauu

SEQ ID NO: 367389 - RNA, 19 nt, Human
agaaaagcaaaaacuaagg

SEQ ID NO: 367390 - RNA, 23 nt, Human
agacaaucucccccauggggaaa

SEQ ID NO: 367391 - RNA, 18 nt, Human
agagugggaaucauuggc

SEQ ID NO: 367392 - RNA, 24 nt, Human
agguaaaucaguacauagcaacua

SEQ ID NO: 367393 - RNA, 19 nt, Human
agguggcucuguggccagg

SEQ ID NO: 367394 - RNA, 24 nt, Human
aguuucagaaagcauuuuucuuuc

SEQ ID NO: 367395 - RNA, 18 nt, Human
auaaagcacuaacaaaag

SEQ ID NO: 367396 - RNA, 21 nt, Human
auaaauaaauaaacuagggug

SEQ ID NO: 367397 - RNA, 24 nt, Human
auacugauaaaaaugaugugaucu

SEQ ID NO: 367398 - RNA, 18 nt, Human
auauaucuauauguauaa

SEQ ID NO: 367399 - RNA, 20 nt, Human
aucaauggcuuacacaguug

SEQ ID NO: 367400 - RNA, 18 nt, Human
aucuauauguauaaugcc

SEQ ID NO: 367401 - RNA, 18 nt, Human
augccuuguuucugauga

SEQ ID NO: 367402 - RNA, 21 nt, Human
auuguuggaauaaaccaaaag

SEQ ID NO: 367403 - RNA, 19 nt, Human
caaggcagagaacagagug

SEQ ID NO: 367404 - RNA, 24 nt, Human
cacaaggaaaugaugugaggaaau

SEQ ID NO: 367405 - RNA, 23 nt, Human
cacaauuaaauaaaaucacagaa

SEQ ID NO: 367406 - RNA, 19 nt, Human
cauaaagagaaaaugaaag

SEQ ID NO: 367407 - RNA, 19 nt, Human
cauuauuaaaguuucuauu

SEQ ID NO: 367408 - RNA, 19 nt, Human
ccacaacacaaaaacuaau

SEQ ID NO: 367409 - RNA, 23 nt, Human
cgaauugccacugaugaacagag

SEQ ID NO: 367410 - RNA, 22 nt, Human
cguuauaucaauggcuuacaca

SEQ ID NO: 367411 - RNA, 22 nt, Human
cuacagaaaugaaacacaaaua

SEQ ID NO: 367412 - RNA, 27 nt, Human
cugaugauguaaugcaguaacucccuu

SEQ ID NO: 367413 - RNA, 23 nt, Human
cuuaaagucuuuaaacuuacuuu

SEQ ID NO: 367414 - RNA, 18 nt, Human
gaaaauuucaggaaacac

SEQ ID NO: 367415 - RNA, 23 nt, Human
gaaacaccuaaaaauuauaaaca

SEQ ID NO: 367416 - RNA, 20 nt, Human
gaaaccaguaacauuuagaa

SEQ ID NO: 367417 - RNA, 24 nt, Human
gauaauaaacauaaaugaaaguaa

SEQ ID NO: 367418 - RNA, 22 nt, Human
gcaacaaaagccacaacacaaa

SEQ ID NO: 367419 - RNA, 22 nt, Human
gccacaacacaaaaacuaauca

SEQ ID NO: 367420 - RNA, 18 nt, Human
ggaguuuuaaaaauagca

SEQ ID NO: 367421 - RNA, 19 nt, Human
gguuaaagggagcauugga

SEQ ID NO: 367422 - RNA, 21 nt, Human
guuaccccugauguccagaca

SEQ ID NO: 367423 - RNA, 22 nt, Human
uaaaaaaacaaaacaaaacugg

SEQ ID NO: 367424 - RNA, 18 nt, Human
uaaaacaggauucacaug

SEQ ID NO: 367425 - RNA, 19 nt, Human
uaaaagccauaaaaauugg

SEQ ID NO: 367426 - RNA, 18 nt, Human
uaaaaucacagaaacacu

SEQ ID NO: 367427 - RNA, 20 nt, Human
uaaaaucacagguaacaagc

SEQ ID NO: 367428 - RNA, 23 nt, Human
uaaaaucuaucaauugcuuuaag

SEQ ID NO: 367429 - RNA, 21 nt, Human
uaaacagcaugacauacaaua

SEQ ID NO: 367430 - RNA, 22 nt, Human
uaaagcaacaaaagccacaaca

SEQ ID NO: 367431 - RNA, 19 nt, Human
uaacagauauaagaucagu

SEQ ID NO: 367432 - RNA, 25 nt, Human
uaauaaacauaaaugaaaguaagca

SEQ ID NO: 367433 - RNA, 21 nt, Human
uagucaagaacuugaaccuga

SEQ ID NO: 367434 - RNA, 18 nt, Human
uauaaacaaaguaucacu

SEQ ID NO: 367435 - RNA, 24 nt, Human
uauaucaauggcuuacacaguuga

SEQ ID NO: 367436 - RNA, 24 nt, Human
uaugaaacaaauuugaaaggcagg

SEQ ID NO: 367437 - RNA, 19 nt, Human
uauguauauaucuauaugu

SEQ ID NO: 367438 - RNA, 23 nt, Human
ucaggaaacaccuaaaaauuaua

SEQ ID NO: 367439 - RNA, 21 nt, Human
ucauuauuaaaguuucuauug

SEQ ID NO: 367440 - RNA, 24 nt, Human
uccagacacuacuuuuaaaaaccc

SEQ ID NO: 367441 - RNA, 22 nt, Human
ucuccaaaaaaauaguuuucau

SEQ ID NO: 367442 - RNA, 21 nt, Human
ucuccacauccuucuauugca

SEQ ID NO: 367443 - RNA, 22 nt, Human
ucugguuuacaaauacaugcau

SEQ ID NO: 367444 - RNA, 23 nt, Human
ucugucacugucucucaaugaau

SEQ ID NO: 367445 - RNA, 22 nt, Human
ucuuugauuauuuuucaaaaac

SEQ ID NO: 367446 - RNA, 22 nt, Human
ugaaacacaaauagagaagccc

SEQ ID NO: 367447 - RNA, 18 nt, Human
ugaaacagcauucagaaa

SEQ ID NO: 367448 - RNA, 24 nt, Human
ugaaaggcaggaugauucacaaua

SEQ ID NO: 367449 - RNA, 18 nt, Human
ugaauaguuaagaaccau

SEQ ID NO: 367450 - RNA, 23 nt, Human
ugacaugauacgcacacauuaca

SEQ ID NO: 367451 - RNA, 20 nt, Human
ugcaaaguauuuugcaagug

SEQ ID NO: 367452 - RNA, 20 nt, Human
ugccacagcuuuuuaaaaca

SEQ ID NO: 367453 - RNA, 21 nt, Human
ugcucaaucaacuucaguaac

SEQ ID NO: 367454 - RNA, 22 nt, Human
uggaauuucauaaaauuuucau

SEQ ID NO: 367455 - RNA, 18 nt, Human
uggggaaagaaaaaaaaa

SEQ ID NO: 367456 - RNA, 18 nt, Human
ugugcuaauuaaauuuca

SEQ ID NO: 367457 - RNA, 21 nt, Human
uuaaaacaccagacuugcuaa

SEQ ID NO: 367458 - RNA, 18 nt, Human
uuaaacauuggaagacaa

SEQ ID NO: 367459 - RNA, 21 nt, Human
uuaaaguuucuauuguucuac

SEQ ID NO: 367460 - RNA, 19 nt, Human
uuaauuaucaaaucaccug

SEQ ID NO: 367461 - RNA, 20 nt, Human
uuacaaacuccagacacuac

SEQ ID NO: 367462 - RNA, 20 nt, Human
uucaaaaacaguggaagaaa

SEQ ID NO: 367463 - RNA, 20 nt, Human
uucacacaaacauacacaca

SEQ ID NO: 367464 - RNA, 21 nt, Human
uucacacaaacauacacacac

SEQ ID NO: 367465 - RNA, 21 nt, Human
uucuaaagaaaagcagcuaca

SEQ ID NO: 367466 - RNA, 19 nt, Human
uugaaccugauggaaacua

SEQ ID NO: 367467 - RNA, 18 nt, Human
uuuacaaauacaugcauu

SEQ ID NO: 367468 - RNA, 23 nt, Human
uuuacaucauuguuuucucaaaa

SEQ ID NO: 367469 - RNA, 21 nt, Human
uuuccaacuauguuuuccuau

SEQ ID NO: 367470 - RNA, 23 nt, Human
aaacuucuggccucaaguaaucc

SEQ ID NO: 367471 - RNA, 22 nt, Human
aaugaaaaaagacagaaagucc

SEQ ID NO: 367472 - RNA, 18 nt, Human
acacauucuuucuuugca

SEQ ID NO: 367473 - RNA, 23 nt, Human
acuauuuuaggcacuaacuguau

SEQ ID NO: 367474 - RNA, 19 nt, Human
agacagaagcaagaauccc

SEQ ID NO: 367475 - RNA, 23 nt, Human
agacagaagcaagaaucccuaau

SEQ ID NO: 367476 - RNA, 24 nt, Human
agacagaagcaagaaucccuaauc

SEQ ID NO: 367477 - RNA, 18 nt, Human
agcuccuaaauauaaccc

SEQ ID NO: 367478 - RNA, 20 nt, Human
agcugagaacaucuuugggg

SEQ ID NO: 367479 - RNA, 24 nt, Human
aggcacuaacuguauuuggaaaca

SEQ ID NO: 367480 - RNA, 21 nt, Human
aggguccauuguguagaugac

SEQ ID NO: 367481 - RNA, 19 nt, Human
agguaugagccuggugagu

SEQ ID NO: 367482 - RNA, 22 nt, Human
agugcugagggaaaugaaaaaa

SEQ ID NO: 367483 - RNA, 22 nt, Human
caaaggacacuauuuuaggcac

SEQ ID NO: 367484 - RNA, 21 nt, Human
caaccacagcaccauuugcaa

SEQ ID NO: 367485 - RNA, 20 nt, Human
cagcuccuaaauauaacccu

SEQ ID NO: 367486 - RNA, 24 nt, Human
cagggucucaucauauugcccagg

SEQ ID NO: 367487 - RNA, 24 nt, Human
cauauugcccaggcuagucucaaa

SEQ ID NO: 367488 - RNA, 24 nt, Human
caucauauugcccaggcuagucuc

SEQ ID NO: 367489 - RNA, 21 nt, Human
cauucuaggaaauaauggggg

SEQ ID NO: 367490 - RNA, 20 nt, Human
cauuguguagaugacaagau

SEQ ID NO: 367491 - RNA, 22 nt, Human
ccaaccacagcaccauuugcaa

SEQ ID NO: 367492 - RNA, 22 nt, Human
ccacagcaccauuugcaauuag

SEQ ID NO: 367493 - RNA, 26 nt, Human
ccagacaugcugacuuuucacaugac

SEQ ID NO: 367494 - RNA, 21 nt, Human
cuuuugaaagaaugugagcca

SEQ ID NO: 367495 - RNA, 21 nt, Human
gaaaaaagacagaaaguccua

SEQ ID NO: 367496 - RNA, 18 nt, Human
uaagugguugucaaaccc

SEQ ID NO: 367497 - RNA, 18 nt, Human
uaagugguugucaaaccc

SEQ ID NO: 367498 - RNA, 18 nt, Human
uacuguauguucacauug

SEQ ID NO: 367499 - RNA, 24 nt, Human
uagcugagaacaucuuugggggua

SEQ ID NO: 367500 - RNA, 25 nt, Human
ucacauuguagguaugagccuggug

SEQ ID NO: 367501 - RNA, 23 nt, Human
ucccaaaagcccuggaauuacag

SEQ ID NO: 367502 - RNA, 18 nt, Human
uccuccagcuucaacucc

SEQ ID NO: 367503 - RNA, 19 nt, Human
ugacaagaugccaagugcu

SEQ ID NO: 367504 - RNA, 21 nt, Human
ugacaagaugccaagugcuga

SEQ ID NO: 367505 - RNA, 24 nt, Human
ugccaagugcugagggaaaugaaa

SEQ ID NO: 367506 - RNA, 22 nt, Human
ugcccaggcuagucucaaacuu

SEQ ID NO: 367507 - RNA, 22 nt, Human
ugcuacacauucuuucuuugca

SEQ ID NO: 367508 - RNA, 21 nt, Human
uggaauuacagggauaaccca

SEQ ID NO: 367509 - RNA, 24 nt, Human
uggaauuacagggauaacccacua

SEQ ID NO: 367510 - RNA, 21 nt, Human
uggccuaaaaaaaagucuuuu

SEQ ID NO: 367511 - RNA, 18 nt, Human
uggccucaaguaauccuc

SEQ ID NO: 367512 - RNA, 25 nt, Human
uggccucaaguaauccuccagcuuc

SEQ ID NO: 367513 - RNA, 20 nt, Human
uucuuucuuugcacauauag

SEQ ID NO: 367514 - RNA, 24 nt, Human
uuguagagacagggucucaucaua

SEQ ID NO: 367515 - RNA, 18 nt, Human
uuuguagagacagggucu

SEQ ID NO: 367516 - RNA, 21 nt, Human
uuuguagagacagggucucau

SEQ ID NO: 367517 - RNA, 23 nt, Human
aaaccacacugacacccggaauc

SEQ ID NO: 367518 - RNA, 20 nt, Human
cacauuuauccaccugggca

SEQ ID NO: 367519 - RNA, 20 nt, Human
cacugacacccggaaucuac

SEQ ID NO: 367520 - RNA, 21 nt, Human
cauggcuucugauucuuaguc

SEQ ID NO: 367521 - RNA, 21 nt, Human
ccagggagaccaaaguuucua

SEQ ID NO: 367522 - RNA, 18 nt, Human
cggacaggaaaaguggca

SEQ ID NO: 367523 - RNA, 25 nt, Human
cgucagacaucaaucacauggcuuc

SEQ ID NO: 367524 - RNA, 20 nt, Human
gaccaaaguuucuaaaacaa

SEQ ID NO: 367525 - RNA, 20 nt, Human
ggcaggaaccagggagacca

SEQ ID NO: 367526 - RNA, 19 nt, Human
uaaaccacacugacacccg

SEQ ID NO: 367527 - RNA, 20 nt, Human
uaaaccacacugacacccgg

SEQ ID NO: 367528 - RNA, 24 nt, Human
uaaugguuuucuuccagcuagccu

SEQ ID NO: 367529 - RNA, 20 nt, Human
uauaaaccacacugacaccc

SEQ ID NO: 367530 - RNA, 20 nt, Human
ugaguaagaguccagccaug

SEQ ID NO: 367531 - RNA, 25 nt, Human
ugaguaagaguccagccaugguaaa

SEQ ID NO: 367532 - RNA, 24 nt, Human
ugaguggacucccuucugcggcuc

SEQ ID NO: 367533 - RNA, 23 nt, Human
uggcaggaaccagggagaccaaa

SEQ ID NO: 367534 - RNA, 24 nt, Human
uggcaggaaccagggagaccaaag

SEQ ID NO: 367535 - RNA, 18 nt, Human
uggggaggaggacggaca

SEQ ID NO: 367536 - RNA, 18 nt, Human
ugguaaaucuacagcaaa

SEQ ID NO: 367537 - RNA, 20 nt, Human
ugguaaaucuacagcaaaag

SEQ ID NO: 367538 - RNA, 22 nt, Human
ugguaaaucuacagcaaaaggu

SEQ ID NO: 367539 - RNA, 20 nt, Human
uguacacauuuauccaccuu

SEQ ID NO: 367540 - RNA, 26 nt, Human
uuaacagcaaacuaaugguuuucuuc

SEQ ID NO: 367541 - RNA, 19 nt, Human
uucaacaccacaggacgag

SEQ ID NO: 367542 - RNA, 19 nt, Human
aggcagcuuuauuuuuccu

SEQ ID NO: 367543 - RNA, 18 nt, Human
aggcuccucacccccacu

SEQ ID NO: 367544 - RNA, 21 nt, Human
cacuuccugugaggcuguggc

SEQ ID NO: 367545 - RNA, 25 nt, Human
cagcuuuauuuuuccuuagggcaac

SEQ ID NO: 367546 - RNA, 22 nt, Human
ccugugaggcuguggcuuaugg

SEQ ID NO: 367547 - RNA, 19 nt, Human
cugccccuuccccuuuucu

SEQ ID NO: 367548 - RNA, 19 nt, Human
ggccgggagaaggggagcc

SEQ ID NO: 367549 - RNA, 19 nt, Human
gugggccaggcccucaugg

SEQ ID NO: 367550 - RNA, 24 nt, Human
ucucaccccacugccccuuccccu

SEQ ID NO: 367551 - RNA, 21 nt, Human
ugacugccaaucagaugcagu

SEQ ID NO: 367552 - RNA, 22 nt, Human
ugaggcuguggcuuaugguguc

SEQ ID NO: 367553 - RNA, 21 nt, Human
ugcagcgggugggccaggccc

SEQ ID NO: 367554 - RNA, 21 nt, Human
ugccccuuccccuuuucuggg

SEQ ID NO: 367555 - RNA, 23 nt, Human
aaaugaccucccggaggcagggc

SEQ ID NO: 367556 - RNA, 20 nt, Human
aggacggggagggcgggugg

SEQ ID NO: 367557 - RNA, 24 nt, Human
aggcaggacggggagggcgggugg

SEQ ID NO: 367558 - RNA, 23 nt, Human
caauccagccaaucagagcccaa

SEQ ID NO: 367559 - RNA, 18 nt, Human
caccuccccucucacucu

SEQ ID NO: 367560 - RNA, 21 nt, Human
cagagcccaaggccaugggcc

SEQ ID NO: 367561 - RNA, 20 nt, Human
cagccggcugucugucccuc

SEQ ID NO: 367562 - RNA, 24 nt, Human
ccccgcugucugucucugcguccg

SEQ ID NO: 367563 - RNA, 19 nt, Human
cgggggaagcuggcagggg

SEQ ID NO: 367564 - RNA, 20 nt, Human
cucccggaggcagggccucc

SEQ ID NO: 367565 - RNA, 21 nt, Human
cucccuguccccgcugucugu

SEQ ID NO: 367566 - RNA, 22 nt, Human
cuggggacgguugaagcaaggg

SEQ ID NO: 367567 - RNA, 19 nt, Human
cugucucugcguccgcccc

SEQ ID NO: 367568 - RNA, 19 nt, Human
gaagcggcgagaggggccg

SEQ ID NO: 367569 - RNA, 21 nt, Human
gaggggccggggcucccuggg

SEQ ID NO: 367570 - RNA, 23 nt, Human
gaggggccggggcucccuggguu

SEQ ID NO: 367571 - RNA, 23 nt, Human
gcguccgccccugcugucugucu

SEQ ID NO: 367572 - RNA, 22 nt, Human
gcucaagcgggggaagcuggca

SEQ ID NO: 367573 - RNA, 23 nt, Human
gcucaagcgggggaagcuggcag

SEQ ID NO: 367574 - RNA, 24 nt, Human
ggacggggagggcgggugggagga

SEQ ID NO: 367575 - RNA, 23 nt, Human
ggggagggcgggugggaggaugc

SEQ ID NO: 367576 - RNA, 25 nt, Human
guccugccaccuccccucucacucu

SEQ ID NO: 367577 - RNA, 18 nt, Human
ucccagggugucaguccc

SEQ ID NO: 367578 - RNA, 23 nt, Human
ucccagggugucagucccgccgu

SEQ ID NO: 367579 - RNA, 29 nt, Human
ucccuggguuaggaaucuaugggcugucg

SEQ ID NO: 367580 - RNA, 25 nt, Human
ucuggggugggaagcggcgagaggg

SEQ ID NO: 367581 - RNA, 20 nt, Human
ucugucucugcguccgcccc

SEQ ID NO: 367582 - RNA, 21 nt, Human
ucugucuguccugccaccucc

SEQ ID NO: 367583 - RNA, 21 nt, Human
ugaccucccggaggcagggcc

SEQ ID NO: 367584 - RNA, 20 nt, Human
ugcagccggcugucuguccc

SEQ ID NO: 367585 - RNA, 18 nt, Human
uggcaggggccgaggagg

SEQ ID NO: 367586 - RNA, 20 nt, Human
uggcaggggccgaggaggca

SEQ ID NO: 367587 - RNA, 19 nt, Human
uguccgugucggccucccu

SEQ ID NO: 367588 - RNA, 18 nt, Human
uguccugccaccuccccu

SEQ ID NO: 367589 - RNA, 22 nt, Human
uguccugccaccuccccucuca

SEQ ID NO: 367590 - RNA, 25 nt, Human
ugucugucccucucccugggcgcug

SEQ ID NO: 367591 - RNA, 18 nt, Human
ugugcucagcgcugacag

SEQ ID NO: 367592 - RNA, 25 nt, Human
uugucuggguuuggcccauccugag

SEQ ID NO: 367593 - RNA, 22 nt, Human
accagcccgccaggugccagaa

SEQ ID NO: 367594 - RNA, 21 nt, Human
aggugccagaagccaccgggu

SEQ ID NO: 367595 - RNA, 23 nt, Human
cagaaggccuccuucugccaccc

SEQ ID NO: 367596 - RNA, 21 nt, Human
ccagcccgccaggugccagaa

SEQ ID NO: 367597 - RNA, 21 nt, Human
ccaggggucuaacuguccucc

SEQ ID NO: 367598 - RNA, 26 nt, Human
ccaggucggggggugagagugucggg

SEQ ID NO: 367599 - RNA, 23 nt, Human
cccacggcagggcccacccaggg

SEQ ID NO: 367600 - RNA, 23 nt, Human
cccaggggucuaacuguccuccc

SEQ ID NO: 367601 - RNA, 27 nt, Human
ccuccuucugccacccugggugagauc

SEQ ID NO: 367602 - RNA, 23 nt, Human
ccuggauuaaaaaggucaccagc

SEQ ID NO: 367603 - RNA, 21 nt, Human
cguggugauggugucuggacu

SEQ ID NO: 367604 - RNA, 22 nt, Human
cuaacuguccucccaccucccc

SEQ ID NO: 367605 - RNA, 20 nt, Human
cugcguggugauggugucuu

SEQ ID NO: 367606 - RNA, 21 nt, Human
gguaacaggcacagaaagaga

SEQ ID NO: 367607 - RNA, 18 nt, Human
uaacaggcacagaaagag

SEQ ID NO: 367608 - RNA, 21 nt, Human
uaacaggcacagaaagagagu

SEQ ID NO: 367609 - RNA, 22 nt, Human
ugcggcucaagggcacccuagg

SEQ ID NO: 367610 - RNA, 20 nt, Human
ugcguggugauggugucugg

SEQ ID NO: 367611 - RNA, 19 nt, Human
uggguaacaggcacagaaa

SEQ ID NO: 367612 - RNA, 21 nt, Human
aaacacugcaagaacagugcg

SEQ ID NO: 367613 - RNA, 18 nt, Human
aaacgauggugccuucca

SEQ ID NO: 367614 - RNA, 19 nt, Human
aaacuccagacugacggca

SEQ ID NO: 367615 - RNA, 25 nt, Human
aagaacagugcggaacuagggccgg

SEQ ID NO: 367616 - RNA, 18 nt, Human
aagccccuuccauuccaa

SEQ ID NO: 367617 - RNA, 22 nt, Human
aaucaucucccaagccccuucc

SEQ ID NO: 367618 - RNA, 19 nt, Human
agaggaacggacagugcag

SEQ ID NO: 367619 - RNA, 21 nt, Human
agcaagacaaugagucgugga

SEQ ID NO: 367620 - RNA, 22 nt, Human
agccgccucgcucuggccacac

SEQ ID NO: 367621 - RNA, 22 nt, Human
aggcagaggcuguccgcugagg

SEQ ID NO: 367622 - RNA, 20 nt, Human
aggccuuggcagaugaagug

SEQ ID NO: 367623 - RNA, 20 nt, Human
agggcaggagcuggagaugc

SEQ ID NO: 367624 - RNA, 30 nt, Human
auggaggguggcccugaccuagguucccgg

SEQ ID NO: 367625 - RNA, 20 nt, Human
caaaaagaccccccuuuaua

SEQ ID NO: 367626 - RNA, 20 nt, Human
caaaaccuggcucucucugu

SEQ ID NO: 367627 - RNA, 21 nt, Human
caaaugcaguacgcucuaaca

SEQ ID NO: 367628 - RNA, 24 nt, Human
caagaaggggguccccaugugaac

SEQ ID NO: 367629 - RNA, 21 nt, Human
caagacaaugagucguggagc

SEQ ID NO: 367630 - RNA, 19 nt, Human
caagaggcauccccacagu

SEQ ID NO: 367631 - RNA, 25 nt, Human
caagccccuuccauuccaaugcucc

SEQ ID NO: 367632 - RNA, 19 nt, Human
caauaucggccuugggcag

SEQ ID NO: 367633 - RNA, 24 nt, Human
cacaagagaggagucuggccucca

SEQ ID NO: 367634 - RNA, 22 nt, Human
cacacccccucucugaacucua

SEQ ID NO: 367635 - RNA, 22 nt, Human
cacaguggaauccucauaacuc

SEQ ID NO: 367636 - RNA, 19 nt, Human
caccaaaaccuggcucucu

SEQ ID NO: 367637 - RNA, 24 nt, Human
cacccaagaccacucaggagugga

SEQ ID NO: 367638 - RNA, 25 nt, Human
cacccccucucugaaccaccacugg

SEQ ID NO: 367639 - RNA, 21 nt, Human
cacucaggaguggaaccguga

SEQ ID NO: 367640 - RNA, 27 nt, Human
cagcaagacaaugagucguggagcugg

SEQ ID NO: 367641 - RNA, 22 nt, Human
cagcucagaguaaacaggggag

SEQ ID NO: 367642 - RNA, 18 nt, Human
caggagacagaggcagag

SEQ ID NO: 367643 - RNA, 23 nt, Human
caggaguugaugaaacacugcaa

SEQ ID NO: 367644 - RNA, 18 nt, Human
caguggugguguuaucag

SEQ ID NO: 367645 - RNA, 23 nt, Human
caguguguucaguugucacuucc

SEQ ID NO: 367646 - RNA, 18 nt, Human
ccaaaaagaccccccuuu

SEQ ID NO: 367647 - RNA, 19 nt, Human
ccaguggugguguuaucag

SEQ ID NO: 367648 - RNA, 20 nt, Human
cccaagaaggggguccccau

SEQ ID NO: 367649 - RNA, 19 nt, Human
ccccaagaagggggucccc

SEQ ID NO: 367650 - RNA, 25 nt, Human
cccuuccauuccaaugcuccaggag

SEQ ID NO: 367651 - RNA, 21 nt, Human
ccggcccaucugcccaggucc

SEQ ID NO: 367652 - RNA, 21 nt, Human
ccuaacggaaccuccgaucca

SEQ ID NO: 367653 - RNA, 25 nt, Human
ccuccgauccaacacaguguguuca

SEQ ID NO: 367654 - RNA, 21 nt, Human
ccuggagcacauucggaggau

SEQ ID NO: 367655 - RNA, 21 nt, Human
ccuuccauuccaaugcuccag

SEQ ID NO: 367656 - RNA, 24 nt, Human
cggcccaucugcccagguccuuga

SEQ ID NO: 367657 - RNA, 19 nt, Human
cuaacaagaggcaucccca

SEQ ID NO: 367658 - RNA, 18 nt, Human
cucagccuagccucuggc

SEQ ID NO: 367659 - RNA, 22 nt, Human
cucagccuagccucuggccucc

SEQ ID NO: 367660 - RNA, 22 nt, Human
cugacggcaugcaaaggcuugc

SEQ ID NO: 367661 - RNA, 18 nt, Human
cuggagcacauucggagg

SEQ ID NO: 367662 - RNA, 20 nt, Human
cuuaggagccgccucgcucu

SEQ ID NO: 367663 - RNA, 20 nt, Human
gaaccuccgauccaacacag

SEQ ID NO: 367664 - RNA, 21 nt, Human
gacaaugagucguggagcugg

SEQ ID NO: 367665 - RNA, 20 nt, Human
gauugugaggugggaaagaa

SEQ ID NO: 367666 - RNA, 18 nt, Human
gcccugaccuagguuccc

SEQ ID NO: 367667 - RNA, 19 nt, Human
gccuggagcacauucggag

SEQ ID NO: 367668 - RNA, 18 nt, Human
ggaaggauccccuaacgg

SEQ ID NO: 367669 - RNA, 20 nt, Human
ggagacagaggcagaggcug

SEQ ID NO: 367670 - RNA, 23 nt, Human
ggagaugccaugagagacucgga

SEQ ID NO: 367671 - RNA, 20 nt, Human
ggcaggagacagaggcagag

SEQ ID NO: 367672 - RNA, 18 nt, Human
ggccuccaaaaagacccc

SEQ ID NO: 367673 - RNA, 18 nt, Human
gggaaggagcugcuccag

SEQ ID NO: 367674 - RNA, 21 nt, Human
ggucaggcaaaucacaccccc

SEQ ID NO: 367675 - RNA, 23 nt, Human
gucaggcaaaucacacccccucu

SEQ ID NO: 367676 - RNA, 18 nt, Human
gucccuuugucucuuugg

SEQ ID NO: 367677 - RNA, 18 nt, Human
gugaacuugaaaaagucc

SEQ ID NO: 367678 - RNA, 19 nt, Human
guucaguugucacuuccaa

SEQ ID NO: 367679 - RNA, 22 nt, Human
uacacacuuguuaacuaaggca

SEQ ID NO: 367680 - RNA, 24 nt, Human
uacacacuuguuaacuaaggcagg

SEQ ID NO: 367681 - RNA, 19 nt, Human
uagccucuggccuccaggu

SEQ ID NO: 367682 - RNA, 21 nt, Human
uagggcaggagcuggagaugc

SEQ ID NO: 367683 - RNA, 23 nt, Human
uaguuuucugaguuugcagauga

SEQ ID NO: 367684 - RNA, 24 nt, Human
uauagcuccucuccccguguacaa

SEQ ID NO: 367685 - RNA, 24 nt, Human
uccagacugacggcaugcaaaggc

SEQ ID NO: 367686 - RNA, 22 nt, Human
ucccaagccccuuccauuccaa

SEQ ID NO: 367687 - RNA, 18 nt, Human
uccccuaacggaaccucc

SEQ ID NO: 367688 - RNA, 27 nt, Human
ucgccuggagcacauucggaggauugu

SEQ ID NO: 367689 - RNA, 18 nt, Human
ucuccagguuccucaucc

SEQ ID NO: 367690 - RNA, 19 nt, Human
ucucuggcccccaagaagg

SEQ ID NO: 367691 - RNA, 20 nt, Human
ucucuuuggucuccagguuc

SEQ ID NO: 367692 - RNA, 18 nt, Human
ucugaacucuaaguuucc

SEQ ID NO: 367693 - RNA, 26 nt, Human
ucugcugagugaccucagccuagccu

SEQ ID NO: 367694 - RNA, 24 nt, Human
ucuuuggucuccagguuccucauc

SEQ ID NO: 367695 - RNA, 22 nt, Human
ugaagugauucacccaagacca

SEQ ID NO: 367696 - RNA, 22 nt, Human
ugagaauggaggguggcccuga

SEQ ID NO: 367697 - RNA, 21 nt, Human
uggagaugccaugagagacuc

SEQ ID NO: 367698 - RNA, 27 nt, Human
uggcaccaaaaccuggcucucucugua

SEQ ID NO: 367699 - RNA, 26 nt, Human
uggcccccaagaagggggucccuccu

SEQ ID NO: 367700 - RNA, 24 nt, Human
uggcccccaagaagggggucccuu

SEQ ID NO: 367701 - RNA, 22 nt, Human
ugggaagccccgcugggugggc

SEQ ID NO: 367702 - RNA, 20 nt, Human
ugggcagaggaacggacagu

SEQ ID NO: 367703 - RNA, 20 nt, Human
ugggcaggaugacgagggcc

SEQ ID NO: 367704 - RNA, 21 nt, Human
ugggugggcaggaugacgagg

SEQ ID NO: 367705 - RNA, 21 nt, Human
ugguguuaucagcaaagggga

SEQ ID NO: 367706 - RNA, 18 nt, Human
ugucccaucaggcucucc

SEQ ID NO: 367707 - RNA, 21 nt, Human
ugucccuuuuuaucuguacag

SEQ ID NO: 367708 - RNA, 21 nt, Human
uguucaguugucacuuccaac

SEQ ID NO: 367709 - RNA, 18 nt, Human
aagaagagaggaucagaa

SEQ ID NO: 367710 - RNA, 25 nt, Human
aaggacaacuuccaggggaggaauc

SEQ ID NO: 367711 - RNA, 19 nt, Human
acauuggcauggggguucc

SEQ ID NO: 367712 - RNA, 20 nt, Human
agaaggugaacaaaaacuac

SEQ ID NO: 367713 - RNA, 23 nt, Human
caaaaacuacagucacgaaauca

SEQ ID NO: 367714 - RNA, 27 nt, Human
ccaggccagaugcacagaaggugguac

SEQ ID NO: 367715 - RNA, 19 nt, Human
ccuggacauuggcaugggg

SEQ ID NO: 367716 - RNA, 21 nt, Human
cuccucugagcuaacagcccc

SEQ ID NO: 367717 - RNA, 23 nt, Human
gcagcggaugccugugaccugga

SEQ ID NO: 367718 - RNA, 20 nt, Human
ggacaacuuccaggggagga

SEQ ID NO: 367719 - RNA, 21 nt, Human
uccaggggaggaaucccaaga

SEQ ID NO: 367720 - RNA, 22 nt, Human
uccucugagcuaacagccccca

SEQ ID NO: 367721 - RNA, 23 nt, Human
ugaacaaaaacuacagucacgaa

SEQ ID NO: 367722 - RNA, 24 nt, Human
ugaacaaaaacuacagucacgaaa

SEQ ID NO: 367723 - RNA, 20 nt, Human
ugcuccucuccucugagcua

SEQ ID NO: 367724 - RNA, 21 nt, Human
uuccaggggaggaaucccaag

SEQ ID NO: 367725 - RNA, 19 nt, Human
uuggcauggggguuccucc

SEQ ID NO: 367726 - RNA, 23 nt, Human
uuuguaaaugggaaaagaagaga

SEQ ID NO: 367727 - RNA, 22 nt, Human
aagcagcuuuuggccaacaucc

SEQ ID NO: 367728 - RNA, 25 nt, Human
aagcagcuuuuggccaacauccuuc

SEQ ID NO: 367729 - RNA, 21 nt, Human
accaggacccccauccuccaa

SEQ ID NO: 367730 - RNA, 24 nt, Human
acugcagcggccagaaggcgaugg

SEQ ID NO: 367731 - RNA, 26 nt, Human
agagauuggucaacagacacggacaa

SEQ ID NO: 367732 - RNA, 20 nt, Human
agcaggugcgucuacaagga

SEQ ID NO: 367733 - RNA, 24 nt, Human
aggacccccauccuccaaugccgu

SEQ ID NO: 367734 - RNA, 21 nt, Human
auggaaagcagcuuuuggcca

SEQ ID NO: 367735 - RNA, 24 nt, Human
auggaaagcagcuuuuggccaaca

SEQ ID NO: 367736 - RNA, 22 nt, Human
caaaguaaauggucuaggaagc

SEQ ID NO: 367737 - RNA, 18 nt, Human
caccgagcauuacacucc

SEQ ID NO: 367738 - RNA, 18 nt, Human
cacggcgaggugcgcucc

SEQ ID NO: 367739 - RNA, 22 nt, Human
cacuuuccugucaguggcagag

SEQ ID NO: 367740 - RNA, 18 nt, Human
cagagccgggagcaggga

SEQ ID NO: 367741 - RNA, 20 nt, Human
caggaugacuuccugggguc

SEQ ID NO: 367742 - RNA, 21 nt, Human
caggcagaguguuggucugca

SEQ ID NO: 367743 - RNA, 22 nt, Human
cauaccaggacccccauccucc

SEQ ID NO: 367744 - RNA, 23 nt, Human
cauaccaggacccccauccucca

SEQ ID NO: 367745 - RNA, 18 nt, Human
caugacuggcccugcacg

SEQ ID NO: 367746 - RNA, 21 nt, Human
cauuacacuccagucccugga

SEQ ID NO: 367747 - RNA, 21 nt, Human
cauuacacuccagucccugga

SEQ ID NO: 367748 - RNA, 19 nt, Human
ccaggcagaguguuggucu

SEQ ID NO: 367749 - RNA, 19 nt, Human
ccccagaaggcaaugggga

SEQ ID NO: 367750 - RNA, 19 nt, Human
ccccagaaggcaaugggga

SEQ ID NO: 367751 - RNA, 19 nt, Human
cccuacaccacaaggaccc

SEQ ID NO: 367752 - RNA, 25 nt, Human
ccuccaaugccucugaacagacugu

SEQ ID NO: 367753 - RNA, 21 nt, Human
ccucucaggccguucccuacc

SEQ ID NO: 367754 - RNA, 18 nt, Human
ccugcccucgggcagcac

SEQ ID NO: 367755 - RNA, 22 nt, Human
ccuggggucuucgucucugcuc

SEQ ID NO: 367756 - RNA, 24 nt, Human
cgcccgggccugggcuuugcacgc

SEQ ID NO: 367757 - RNA, 22 nt, Human
cggcacggaaagguguaaacag

SEQ ID NO: 367758 - RNA, 18 nt, Human
cggcucaaggccaggcag

SEQ ID NO: 367759 - RNA, 21 nt, Human
cucgcugcacagaucuacguc

SEQ ID NO: 367760 - RNA, 19 nt, Human
cugagaacacagugccccu

SEQ ID NO: 367761 - RNA, 19 nt, Human
cuggagcccacguccacuu

SEQ ID NO: 367762 - RNA, 25 nt, Human
cuggagcccacguccacuugcaggg

SEQ ID NO: 367763 - RNA, 18 nt, Human
cuuguaaacaaaaacugc

SEQ ID NO: 367764 - RNA, 19 nt, Human
gaagagaggagucuucugc

SEQ ID NO: 367765 - RNA, 20 nt, Human
gaauuccuuuuuuuuuuucc

SEQ ID NO: 367766 - RNA, 22 nt, Human
gaauuugugguuuccuccauuu

SEQ ID NO: 367767 - RNA, 22 nt, Human
gacacgcuccucucaggccguu

SEQ ID NO: 367768 - RNA, 21 nt, Human
gacguuuuucugcccugcagg

SEQ ID NO: 367769 - RNA, 19 nt, Human
gacugugugugcaaugugu

SEQ ID NO: 367770 - RNA, 23 nt, Human
gagccgggagcagggagcaggga

SEQ ID NO: 367771 - RNA, 20 nt, Human
gcauccacuuuccugucagu

SEQ ID NO: 367772 - RNA, 19 nt, Human
gcguucugggguaguacac

SEQ ID NO: 367773 - RNA, 21 nt, Human
gcucaaggccaggcagagugu

SEQ ID NO: 367774 - RNA, 19 nt, Human
ggagcagggagcagggagg

SEQ ID NO: 367775 - RNA, 20 nt, Human
ggagcagggagggagggagc

SEQ ID NO: 367776 - RNA, 19 nt, Human
ggggauucucagcaggugc

SEQ ID NO: 367777 - RNA, 21 nt, Human
gguguaaacagucagaagaga

SEQ ID NO: 367778 - RNA, 18 nt, Human
uacacuccagucccugga

SEQ ID NO: 367779 - RNA, 18 nt, Human
uagacguuuuucugcccu

SEQ ID NO: 367780 - RNA, 21 nt, Human
uaguacacgcuccuguggggg

SEQ ID NO: 367781 - RNA, 21 nt, Human
uaguacacgcuccuguggggg

SEQ ID NO: 367782 - RNA, 21 nt, Human
uaguacacgcuccuguggggg

SEQ ID NO: 367783 - RNA, 21 nt, Human
uaguacacgcuccuguggggg

SEQ ID NO: 367784 - RNA, 21 nt, Human
uaguacacgcuccuguggggg

SEQ ID NO: 367785 - RNA, 21 nt, Human
uauugugcuuagggacccaca

SEQ ID NO: 367786 - RNA, 21 nt, Human
ucagagccgggagcagggagc

SEQ ID NO: 367787 - RNA, 21 nt, Human
uccaaugccucugaacagacu

SEQ ID NO: 367788 - RNA, 20 nt, Human
uccacuuuccugucaguggc

SEQ ID NO: 367789 - RNA, 22 nt, Human
uccauuguggaugucuuuuauu

SEQ ID NO: 367790 - RNA, 18 nt, Human
ucccggcacggaaaggug

SEQ ID NO: 367791 - RNA, 20 nt, Human
uccgcgaagccuccccuccc

SEQ ID NO: 367792 - RNA, 19 nt, Human
uccucugugucccucccca

SEQ ID NO: 367793 - RNA, 19 nt, Human
uccucugugucccucccca

SEQ ID NO: 367794 - RNA, 19 nt, Human
uccuucacucaguauugcu

SEQ ID NO: 367795 - RNA, 22 nt, Human
ugagagaaauaaaauuccagug

SEQ ID NO: 367796 - RNA, 25 nt, Human
ugcaagaacauaaacagaauuuccu

SEQ ID NO: 367797 - RNA, 19 nt, Human
ugcaauaucagcaagcagg

SEQ ID NO: 367798 - RNA, 19 nt, Human
ugccugaguggcaguagcc

SEQ ID NO: 367799 - RNA, 21 nt, Human
ugcguucugggguaguacacg

SEQ ID NO: 367800 - RNA, 20 nt, Human
uggcaguagccugagcuggu

SEQ ID NO: 367801 - RNA, 20 nt, Human
uggcaguagccugagcuggu

SEQ ID NO: 367802 - RNA, 23 nt, Human
uggcaguagccugagcugguuuc

SEQ ID NO: 367803 - RNA, 25 nt, Human
uggcgccgagagcguuccgcgaagc

SEQ ID NO: 367804 - RNA, 18 nt, Human
uggucuggccgcccgggc

SEQ ID NO: 367805 - RNA, 25 nt, Human
uggucuggccgcccgggccugggcu

SEQ ID NO: 367806 - RNA, 22 nt, Human
ugguuuguucgugucucuccca

SEQ ID NO: 367807 - RNA, 23 nt, Human
ugugccauggaaagcagcuuuug

SEQ ID NO: 367808 - RNA, 22 nt, Human
uucacaggcugacggcucccac

SEQ ID NO: 367809 - RNA, 22 nt, Human
uuccauuguggaugucuuuuau

SEQ ID NO: 367810 - RNA, 22 nt, Human
uucgcaaacauaaaaacuguug

SEQ ID NO: 367811 - RNA, 19 nt, Human
uugaagaguagaaguugcc

SEQ ID NO: 367812 - RNA, 24 nt, Human
uugcuacacggagccccuccccag

SEQ ID NO: 367813 - RNA, 24 nt, Human
uuggucaacagacacggacaacac

SEQ ID NO: 367814 - RNA, 20 nt, Human
uuugugguuuccuccauuuc

SEQ ID NO: 367815 - RNA, 22 nt, Human
aacagauaucagauaccaauga

SEQ ID NO: 367816 - RNA, 19 nt, Human
aggagguuguggagaagcc

SEQ ID NO: 367817 - RNA, 22 nt, Human
aggagguuguggagaagccuuu

SEQ ID NO: 367818 - RNA, 20 nt, Human
aggcuuagcuggaaacucau

SEQ ID NO: 367819 - RNA, 22 nt, Human
cauaccaagaaaugauacagga

SEQ ID NO: 367820 - RNA, 23 nt, Human
cauccacauccucacacguccaa

SEQ ID NO: 367821 - RNA, 22 nt, Human
ccacauccucacacguccaaaa

SEQ ID NO: 367822 - RNA, 18 nt, Human
ccugaugccacagcagca

SEQ ID NO: 367823 - RNA, 26 nt, Human
cugaugauagggugguuuucaucacc

SEQ ID NO: 367824 - RNA, 22 nt, Human
gaaaccuuuagaagcaaacaga

SEQ ID NO: 367825 - RNA, 22 nt, Human
gaggaggagguuguggagaagc

SEQ ID NO: 367826 - RNA, 19 nt, Human
ggauuagaagguucuagua

SEQ ID NO: 367827 - RNA, 20 nt, Human
uaaguggcuggaggccuuga

SEQ ID NO: 367828 - RNA, 23 nt, Human
uaccaugggaauauguccagggg

SEQ ID NO: 367829 - RNA, 24 nt, Human
uaguagauuccagcaauaaaauuc

SEQ ID NO: 367830 - RNA, 18 nt, Human
ucacagucuaccauggga

SEQ ID NO: 367831 - RNA, 25 nt, Human
ucacuuggaggggagaaggcaggcg

SEQ ID NO: 367832 - RNA, 21 nt, Human
ucagauaccaaugaucauacc

SEQ ID NO: 367833 - RNA, 26 nt, Human
ucaucaccuccauccacauccucaca

SEQ ID NO: 367834 - RNA, 20 nt, Human
uggaggccuugagucugggc

SEQ ID NO: 367835 - RNA, 22 nt, Human
uguggagaagccuuuuuccucu

SEQ ID NO: 367836 - RNA, 20 nt, Human
uuagcuggaaacucauucaa

SEQ ID NO: 367837 - RNA, 18 nt, Human
aaggugcccuugguuuga

SEQ ID NO: 367838 - RNA, 19 nt, Human
aaggugcccuugguuugac

SEQ ID NO: 367839 - RNA, 19 nt, Human
agugcaaagcaaggugccc

SEQ ID NO: 367840 - RNA, 20 nt, Human
agugcaaagcaaggugcccu

SEQ ID NO: 367841 - RNA, 22 nt, Human
aucauuacccccuuggauucaa

SEQ ID NO: 367842 - RNA, 21 nt, Human
ccggggcagagaggaaaaaca

SEQ ID NO: 367843 - RNA, 21 nt, Human
cuccagcgggagggggcugcg

SEQ ID NO: 367844 - RNA, 21 nt, Human
gucuggaccaucccacaccac

SEQ ID NO: 367845 - RNA, 19 nt, Human
guguuugaccugcccgggc

SEQ ID NO: 367846 - RNA, 20 nt, Human
uccagcgggagggggcugcg

SEQ ID NO: 367847 - RNA, 19 nt, Human
ucugacacaggcaacagac

SEQ ID NO: 367848 - RNA, 20 nt, Human
ugggaaaggccggguuugcg

SEQ ID NO: 367849 - RNA, 22 nt, Human
ugucgcuccagcgggagggggc

SEQ ID NO: 367850 - RNA, 26 nt, Human
aaaaaaaaaauacaaagaaaaauuua

SEQ ID NO: 367851 - RNA, 27 nt, Human
aaaaaaaaaauacaaagaaaaauuuac

SEQ ID NO: 367852 - RNA, 21 nt, Human
aaaaacaggaacaagauagaa

SEQ ID NO: 367853 - RNA, 19 nt, Human
aaaacucuccuaggccuuc

SEQ ID NO: 367854 - RNA, 26 nt, Human
aaacagcaggaaagccgccggccccg

SEQ ID NO: 367855 - RNA, 18 nt, Human
aaacaggaacaagauaga

SEQ ID NO: 367856 - RNA, 24 nt, Human
aaacaguaaaaucaaaucagacac

SEQ ID NO: 367857 - RNA, 18 nt, Human
aaauaucccccaaaucaa

SEQ ID NO: 367858 - RNA, 23 nt, Human
aacacacacacacgauacacaca

SEQ ID NO: 367859 - RNA, 25 nt, Human
aacacacacacacgauacacacaca

SEQ ID NO: 367860 - RNA, 22 nt, Human
aaccuucuagaaaacucuccua

SEQ ID NO: 367861 - RNA, 23 nt, Human
aagacaaaggaaaacaggucaca

SEQ ID NO: 367862 - RNA, 21 nt, Human
aagcaccccuccccgacaccg

SEQ ID NO: 367863 - RNA, 23 nt, Human
aagcaccccuccccgacaccggg

SEQ ID NO: 367864 - RNA, 20 nt, Human
aagccaguucuggggggccg

SEQ ID NO: 367865 - RNA, 19 nt, Human
acaaaauaucccccaaauc

SEQ ID NO: 367866 - RNA, 21 nt, Human
acaaagaaaaauuuaccaaau

SEQ ID NO: 367867 - RNA, 25 nt, Human
acaaagaaaaauuuaccaaauuccc

SEQ ID NO: 367868 - RNA, 21 nt, Human
acacacacacacacacacaca

SEQ ID NO: 367869 - RNA, 28 nt, Human
acacacacacgcacgcacacauacccac

SEQ ID NO: 367870 - RNA, 19 nt, Human
acagcaggaaagccgccgg

SEQ ID NO: 367871 - RNA, 21 nt, Human
accagaaccugcuaugacccc

SEQ ID NO: 367872 - RNA, 23 nt, Human
acgauacacacacacacacacac

SEQ ID NO: 367873 - RNA, 23 nt, Human
acgcacacauacccacaauuaca

SEQ ID NO: 367874 - RNA, 20 nt, Human
acuaaaguuauauaagacaa

SEQ ID NO: 367875 - RNA, 20 nt, Human
acucaccuccccaccacucc

SEQ ID NO: 367876 - RNA, 23 nt, Human
acucaccuccccaccacuccccu

SEQ ID NO: 367877 - RNA, 25 nt, Human
agaguggggaguggggagaugagga

SEQ ID NO: 367878 - RNA, 19 nt, Human
agcaccccuccccgacacc

SEQ ID NO: 367879 - RNA, 19 nt, Human
agccuucuuggaucucuag

SEQ ID NO: 367880 - RNA, 22 nt, Human
aggcaacuuuaagagaugcuga

SEQ ID NO: 367881 - RNA, 18 nt, Human
agggaaaaaacaguaaaa

SEQ ID NO: 367882 - RNA, 20 nt, Human
aggggcugggugggggugug

SEQ ID NO: 367883 - RNA, 22 nt, Human
aguggggaguggggagaugagg

SEQ ID NO: 367884 - RNA, 22 nt, Human
aguguauauauacuuauaugua

SEQ ID NO: 367885 - RNA, 24 nt, Human
auacacacacacacacacacacag

SEQ ID NO: 367886 - RNA, 22 nt, Human
auacacacacacacacacacag

SEQ ID NO: 367887 - RNA, 25 nt, Human
auagaaaaacaggaacaagauagaa

SEQ ID NO: 367888 - RNA, 23 nt, Human
auagaaucguugagaguuuggaa

SEQ ID NO: 367889 - RNA, 24 nt, Human
auaucccccaaaucaaaacaaaac

SEQ ID NO: 367890 - RNA, 21 nt, Human
aucccccaaaucaaaacaaaa

SEQ ID NO: 367891 - RNA, 21 nt, Human
auccuuugguccacucaccuc

SEQ ID NO: 367892 - RNA, 22 nt, Human
auccuuugguccacucaccucc

SEQ ID NO: 367893 - RNA, 19 nt, Human
auuacaaaaaaaaaaaaau

SEQ ID NO: 367894 - RNA, 18 nt, Human
caaaacacacacacacga

SEQ ID NO: 367895 - RNA, 21 nt, Human
caaaucaaaacaaaacacaca

SEQ ID NO: 367896 - RNA, 23 nt, Human
caaccucugcuccacauaaggcc

SEQ ID NO: 367897 - RNA, 20 nt, Human
cacacacacacacacacaca

SEQ ID NO: 367898 - RNA, 26 nt, Human
cacacacacacacacacacacgcacg

SEQ ID NO: 367899 - RNA, 25 nt, Human
cacacacacacacacacacgcacgc

SEQ ID NO: 367900 - RNA, 26 nt, Human
cacacacacacacacacgcacgcaca

SEQ ID NO: 367901 - RNA, 25 nt, Human
cacacacacacacacgcacgcacac

SEQ ID NO: 367902 - RNA, 26 nt, Human
cacacacacacacgcacgcacacaua

SEQ ID NO: 367903 - RNA, 23 nt, Human
cacacacacgauacacacacaca

SEQ ID NO: 367904 - RNA, 27 nt, Human
cacaguuuagguccaaauaggggcuuc

SEQ ID NO: 367905 - RNA, 21 nt, Human
cacauaaggcccuugaucaag

SEQ ID NO: 367906 - RNA, 25 nt, Human
caccuccccaccacuccccuagucc

SEQ ID NO: 367907 - RNA, 18 nt, Human
cacgcacgcacacauacc

SEQ ID NO: 367908 - RNA, 21 nt, Human
cacucaccuccccaccacucc

SEQ ID NO: 367909 - RNA, 25 nt, Human
cacucaccuccccaccacuccccua

SEQ ID NO: 367910 - RNA, 22 nt, Human
caguaugaaagcucugccucuc

SEQ ID NO: 367911 - RNA, 21 nt, Human
cagugacugccuuugugcgug

SEQ ID NO: 367912 - RNA, 26 nt, Human
ccaaaggcauacuccuccucccaaau

SEQ ID NO: 367913 - RNA, 18 nt, Human
ccaggugguaaaugucug

SEQ ID NO: 367914 - RNA, 24 nt, Human
cccaccacuccccuagucccucaa

SEQ ID NO: 367915 - RNA, 19 nt, Human
ccccaaaucaaaacaaaac

SEQ ID NO: 367916 - RNA, 22 nt, Human
ccccaggaaggacuguggccuc

SEQ ID NO: 367917 - RNA, 22 nt, Human
cccccaaaucaaaacaaaacaa

SEQ ID NO: 367918 - RNA, 22 nt, Human
ccccuagucccucaacagguau

SEQ ID NO: 367919 - RNA, 23 nt, Human
cccuugggagggggacaccaaag

SEQ ID NO: 367920 - RNA, 21 nt, Human
ccggccccgucgacccgagag

SEQ ID NO: 367921 - RNA, 21 nt, Human
ccuccucccaaauuuaagaag

SEQ ID NO: 367922 - RNA, 22 nt, Human
ccucugcuccuucucuggggcc

SEQ ID NO: 367923 - RNA, 22 nt, Human
ccuucucugccuggaaugcccc

SEQ ID NO: 367924 - RNA, 18 nt, Human
cuaggugccagggcagcc

SEQ ID NO: 367925 - RNA, 18 nt, Human
cuccccaccacuccccua

SEQ ID NO: 367926 - RNA, 21 nt, Human
cuccucacagcccuccuuucu

SEQ ID NO: 367927 - RNA, 21 nt, Human
cucucuggccagugguucuga

SEQ ID NO: 367928 - RNA, 22 nt, Human
cucugcuccuucucugccugga

SEQ ID NO: 367929 - RNA, 19 nt, Human
cugagcccugagaccccag

SEQ ID NO: 367930 - RNA, 21 nt, Human
cugccaaagaugggguucaga

SEQ ID NO: 367931 - RNA, 20 nt, Human
cugcccuggggauuugaaag

SEQ ID NO: 367932 - RNA, 21 nt, Human
cugcuaugaccccauucaaau

SEQ ID NO: 367933 - RNA, 19 nt, Human
gaaauauguaugccugcca

SEQ ID NO: 367934 - RNA, 19 nt, Human
gaacugggagcacuucccc

SEQ ID NO: 367935 - RNA, 20 nt, Human
gcacaguuuagguccaaauu

SEQ ID NO: 367936 - RNA, 22 nt, Human
gcccucuuccccacgugccacc

SEQ ID NO: 367937 - RNA, 23 nt, Human
gccucuccacggacaucuucccg

SEQ ID NO: 367938 - RNA, 21 nt, Human
ggaaaaaacaguaaaaucaaa

SEQ ID NO: 367939 - RNA, 22 nt, Human
ggacccugacaaucccaaccuu

SEQ ID NO: 367940 - RNA, 19 nt, Human
ggauuugaaagguauagua

SEQ ID NO: 367941 - RNA, 21 nt, Human
ggggcuggguggggguguguc

SEQ ID NO: 367942 - RNA, 22 nt, Human
ggguccucucuccugcuauuuc

SEQ ID NO: 367943 - RNA, 22 nt, Human
ggguuuccagaguuccaagagc

SEQ ID NO: 367944 - RNA, 25 nt, Human
guaaaaucaaaucagacacaaacgg

SEQ ID NO: 367945 - RNA, 19 nt, Human
gugguaaaaguauaugaca

SEQ ID NO: 367946 - RNA, 18 nt, Human
guguauauauacuuauau

SEQ ID NO: 367947 - RNA, 18 nt, Human
guguauauauacuuauau

SEQ ID NO: 367948 - RNA, 21 nt, Human
guucauuccuuuggcaucucu

SEQ ID NO: 367949 - RNA, 22 nt, Human
guuuucuuuuuguacaaaauau

SEQ ID NO: 367950 - RNA, 20 nt, Human
uaaaaguauaugacaaucuc

SEQ ID NO: 367951 - RNA, 22 nt, Human
uaagacaaaggaaaacagguca

SEQ ID NO: 367952 - RNA, 18 nt, Human
uacaaaauaucccccaaa

SEQ ID NO: 367953 - RNA, 18 nt, Human
uacaaguuucuacugcuc

SEQ ID NO: 367954 - RNA, 20 nt, Human
uacacacacacacacacaca

SEQ ID NO: 367955 - RNA, 25 nt, Human
uacacacacacacacacacacacgc

SEQ ID NO: 367956 - RNA, 25 nt, Human
uacacacacacacacacacacacgg

SEQ ID NO: 367957 - RNA, 19 nt, Human
uacauagaaaaacaggaac

SEQ ID NO: 367958 - RNA, 19 nt, Human
uacugacuauccacucacc

SEQ ID NO: 367959 - RNA, 19 nt, Human
uagcagcucccucucuggc

SEQ ID NO: 367960 - RNA, 19 nt, Human
uagggccuccucauucagc

SEQ ID NO: 367961 - RNA, 19 nt, Human
uauaccaccuuaagauggg

SEQ ID NO: 367962 - RNA, 21 nt, Human
uauagggccuccucauucagc

SEQ ID NO: 367963 - RNA, 24 nt, Human
uaucccccaaaucaaaacaaaaca

SEQ ID NO: 367964 - RNA, 19 nt, Human
ucaccuccccaccacuccc

SEQ ID NO: 367965 - RNA, 22 nt, Human
ucagcaccacgggcugcccuug

SEQ ID NO: 367966 - RNA, 21 nt, Human
ucagggaaaaaacaguaaaau

SEQ ID NO: 367967 - RNA, 19 nt, Human
uccaaauaggggcugggug

SEQ ID NO: 367968 - RNA, 19 nt, Human
uccaaauaggggcugggug

SEQ ID NO: 367969 - RNA, 19 nt, Human
uccacggacaucuucccgu

SEQ ID NO: 367970 - RNA, 20 nt, Human
uccacucaccuccccaccaa

SEQ ID NO: 367971 - RNA, 21 nt, Human
uccauaaaaucagggaaaaaa

SEQ ID NO: 367972 - RNA, 21 nt, Human
ucccaaccuucuagaaaacuc

SEQ ID NO: 367973 - RNA, 22 nt, Human
uccccaccacuccccuaguccc

SEQ ID NO: 367974 - RNA, 24 nt, Human
uccccaccacuccccuagucccuc

SEQ ID NO: 367975 - RNA, 18 nt, Human
uccccgacaccgggccca

SEQ ID NO: 367976 - RNA, 24 nt, Human
uccuaggucagcaccacgggcugc

SEQ ID NO: 367977 - RNA, 19 nt, Human
uccucucuccugcuauuuc

SEQ ID NO: 367978 - RNA, 18 nt, Human
ucucuggccagugguucu

SEQ ID NO: 367979 - RNA, 23 nt, Human
ucugagcccugagaccccagcuc

SEQ ID NO: 367980 - RNA, 18 nt, Human
ucugccuggaaugcccca

SEQ ID NO: 367981 - RNA, 20 nt, Human
ucuguaaacccagcuauugc

SEQ ID NO: 367982 - RNA, 20 nt, Human
ucuucccguggguuuucuuu

SEQ ID NO: 367983 - RNA, 18 nt, Human
ugacaaucccaaccuucu

SEQ ID NO: 367984 - RNA, 19 nt, Human
ugaggaaagaaagcacccc

SEQ ID NO: 367985 - RNA, 20 nt, Human
ugccagggcagcccagggug

SEQ ID NO: 367986 - RNA, 20 nt, Human
ugcccuuguucugaacuggg

SEQ ID NO: 367987 - RNA, 18 nt, Human
ugccgggagagccucugc

SEQ ID NO: 367988 - RNA, 19 nt, Human
ugccuggaaugccccagga

SEQ ID NO: 367989 - RNA, 21 nt, Human
ugcggucugcaccccucgagc

SEQ ID NO: 367990 - RNA, 21 nt, Human
uggggaaugaccagaaccugc

SEQ ID NO: 367991 - RNA, 20 nt, Human
uggggagaugaggaaagaaa

SEQ ID NO: 367992 - RNA, 22 nt, Human
ugggggugugucugcccugggg

SEQ ID NO: 367993 - RNA, 18 nt, Human
uggguccccaggugguaa

SEQ ID NO: 367994 - RNA, 23 nt, Human
uggguccucucuccugcuauuuc

SEQ ID NO: 367995 - RNA, 19 nt, Human
ugggugggggugugucugc

SEQ ID NO: 367996 - RNA, 19 nt, Human
uggguguuguuuggcagag

SEQ ID NO: 367997 - RNA, 20 nt, Human
uguaaacccagcuauugcag

SEQ ID NO: 367998 - RNA, 25 nt, Human
uguacaaaauaucccccaaaucaaa

SEQ ID NO: 367999 - RNA, 21 nt, Human
ugucuguaaacccagcuauug

SEQ ID NO: 368000 - RNA, 20 nt, Human
uuccagaguuccaagagccc

SEQ ID NO: 368001 - RNA, 18 nt, Human
uucugcggucugcacccc

SEQ ID NO: 368002 - RNA, 22 nt, Human
uuuguacaaaauaucccccaaa

SEQ ID NO: 368003 - RNA, 23 nt, Human
uuuguacaaaauaucccccaaau

SEQ ID NO: 368004 - RNA, 21 nt, Human
aagcaguccacgaagcacuug

SEQ ID NO: 368005 - RNA, 23 nt, Human
accacacacgcacauccacacaa

SEQ ID NO: 368006 - RNA, 25 nt, Human
acccagccccagcccugcagccucu

SEQ ID NO: 368007 - RNA, 18 nt, Human
acccucacccagccccag

SEQ ID NO: 368008 - RNA, 24 nt, Human
acugcugcuucuggggugaggggu

SEQ ID NO: 368009 - RNA, 22 nt, Human
agacucacacacgcaacagcuc

SEQ ID NO: 368010 - RNA, 23 nt, Human
agagcagagccuggagagguggg

SEQ ID NO: 368011 - RNA, 19 nt, Human
agcguggggacagccccga

SEQ ID NO: 368012 - RNA, 21 nt, Human
agcuucuauaacagggauggg

SEQ ID NO: 368013 - RNA, 30 nt, Human
aggugggcagggggugggcguggcaggggg

SEQ ID NO: 368014 - RNA, 22 nt, Human
auccacacaacagacucacacc

SEQ ID NO: 368015 - RNA, 20 nt, Human
aucucauucucucaaguuuu

SEQ ID NO: 368016 - RNA, 19 nt, Human
auggggagagggguauagc

SEQ ID NO: 368017 - RNA, 21 nt, Human
caaagggacagcguggggaca

SEQ ID NO: 368018 - RNA, 25 nt, Human
caaagggacagcguggggacagccc

SEQ ID NO: 368019 - RNA, 18 nt, Human
cacacgcacauccacaca

SEQ ID NO: 368020 - RNA, 22 nt, Human
cacacgcacauccacacaacag

SEQ ID NO: 368021 - RNA, 19 nt, Human
caccggcggcaccggggag

SEQ ID NO: 368022 - RNA, 22 nt, Human
caccggggagggccccgagggc

SEQ ID NO: 368023 - RNA, 19 nt, Human
cacuugaaagugagccuga

SEQ ID NO: 368024 - RNA, 24 nt, Human
cagaccccaaaagugucagggaaa

SEQ ID NO: 368025 - RNA, 18 nt, Human
cagagccuggagaggugg

SEQ ID NO: 368026 - RNA, 24 nt, Human
cagccucugucugggugucgggga

SEQ ID NO: 368027 - RNA, 19 nt, Human
cagcgacucgccaccucgg

SEQ ID NO: 368028 - RNA, 24 nt, Human
caggacggaauauugcagccucuu

SEQ ID NO: 368029 - RNA, 18 nt, Human
ccagcccugcagccucug

SEQ ID NO: 368030 - RNA, 19 nt, Human
ccagcccugcagccucuga

SEQ ID NO: 368031 - RNA, 23 nt, Human
cccacagacuuguggcaaaggga

SEQ ID NO: 368032 - RNA, 22 nt, Human
cccagacacccaggacggaaua

SEQ ID NO: 368033 - RNA, 21 nt, Human
cccagccccagcccugcagcc

SEQ ID NO: 368034 - RNA, 28 nt, Human
cccagccccagcccugcagccgguuccg

SEQ ID NO: 368035 - RNA, 25 nt, Human
cccaggcagaccccaaaaggaguuc

SEQ ID NO: 368036 - RNA, 19 nt, Human
ccccccgccccggccgggg

SEQ ID NO: 368037 - RNA, 21 nt, Human
ccccccgccccggccggggcc

SEQ ID NO: 368038 - RNA, 23 nt, Human
ccccggccggggcccgcggaggc

SEQ ID NO: 368039 - RNA, 18 nt, Human
ccccugccucccuucucc

SEQ ID NO: 368040 - RNA, 18 nt, Human
ccccugccucccuucucc

SEQ ID NO: 368041 - RNA, 21 nt, Human
cccgccacccucacccagccc

SEQ ID NO: 368042 - RNA, 18 nt, Human
cccgcgccccccgccccg

SEQ ID NO: 368043 - RNA, 21 nt, Human
cccgcgccccccgccccggcc

SEQ ID NO: 368044 - RNA, 23 nt, Human
ccgccacccucacccagccccag

SEQ ID NO: 368045 - RNA, 18 nt, Human
ccgcgccccccgccccgg

SEQ ID NO: 368046 - RNA, 18 nt, Human
ccgggccggggucgcggc

SEQ ID NO: 368047 - RNA, 21 nt, Human
ccgggccggggucgcggcgcc

SEQ ID NO: 368048 - RNA, 19 nt, Human
ccgucucgggacuggacgu

SEQ ID NO: 368049 - RNA, 19 nt, Human
ccgucucucccuccuuccc

SEQ ID NO: 368050 - RNA, 24 nt, Human
ccucacccagccccagcccugcag

SEQ ID NO: 368051 - RNA, 25 nt, Human
ccucccccaggcagaccccaaaagu

SEQ ID NO: 368052 - RNA, 18 nt, Human
ccucccgucucucccucc

SEQ ID NO: 368053 - RNA, 18 nt, Human
ccucccuucuccucucuc

SEQ ID NO: 368054 - RNA, 18 nt, Human
ccucgcccucuccuuccc

SEQ ID NO: 368055 - RNA, 19 nt, Human
ccucucucuccucccuccc

SEQ ID NO: 368056 - RNA, 20 nt, Human
ccuugguucugcugccccuc

SEQ ID NO: 368057 - RNA, 22 nt, Human
cgaagcacuugaaagugagccu

SEQ ID NO: 368058 - RNA, 25 nt, Human
cgacuccgguggcggugguggcggc

SEQ ID NO: 368059 - RNA, 20 nt, Human
cgcacggccgggccgggguc

SEQ ID NO: 368060 - RNA, 21 nt, Human
cggcaccggggagggccccga

SEQ ID NO: 368061 - RNA, 20 nt, Human
cggcggcaccggggagggcc

SEQ ID NO: 368062 - RNA, 21 nt, Human
cggcucccgaggcuccugccc

SEQ ID NO: 368063 - RNA, 23 nt, Human
cggcucccgaggcuccugcccgc

SEQ ID NO: 368064 - RNA, 19 nt, Human
cggcugcggcggcuccucg

SEQ ID NO: 368065 - RNA, 21 nt, Human
cggcuggcccgcgacuccggu

SEQ ID NO: 368066 - RNA, 20 nt, Human
cgggcggcgucggggcccgg

SEQ ID NO: 368067 - RNA, 19 nt, Human
cggggagggccccgagggc

SEQ ID NO: 368068 - RNA, 19 nt, Human
cggggcgcgggcggcgcag

SEQ ID NO: 368069 - RNA, 22 nt, Human
cggggcgcgggcggcgcaguca

SEQ ID NO: 368070 - RNA, 22 nt, Human
cgguggggcugaagcaggggcu

SEQ ID NO: 368071 - RNA, 18 nt, Human
cgucucgggacuggacgu

SEQ ID NO: 368072 - RNA, 26 nt, Human
cgugcacucgcacccaagcucacaca

SEQ ID NO: 368073 - RNA, 20 nt, Human
cuccccugccucccuucucc

SEQ ID NO: 368074 - RNA, 19 nt, Human
cucccuucuccucucucuc

SEQ ID NO: 368075 - RNA, 19 nt, Human
cuucuauaacagggauggg

SEQ ID NO: 368076 - RNA, 19 nt, Human
cuucuccucucucuccucc

SEQ ID NO: 368077 - RNA, 23 nt, Human
gaaaaaguuguuuuagugagcac

SEQ ID NO: 368078 - RNA, 22 nt, Human
gacucgccaccucgcuccgacu

SEQ ID NO: 368079 - RNA, 22 nt, Human
gagaggugggcagggggugggc

SEQ ID NO: 368080 - RNA, 21 nt, Human
gagcuggugaugugagcugag

SEQ ID NO: 368081 - RNA, 19 nt, Human
gaggggucacccacgggug

SEQ ID NO: 368082 - RNA, 22 nt, Human
gaucuauaaauucacacuccuu

SEQ ID NO: 368083 - RNA, 23 nt, Human
gcagaccccaaaagugucaggga

SEQ ID NO: 368084 - RNA, 20 nt, Human
gccacugcugcuucuggggu

SEQ ID NO: 368085 - RNA, 22 nt, Human
gcccccuggaggggugcgguga

SEQ ID NO: 368086 - RNA, 23 nt, Human
gccccgaggcccccaccaugcac

SEQ ID NO: 368087 - RNA, 23 nt, Human
gcccgcggaggcugcccggcugg

SEQ ID NO: 368088 - RNA, 18 nt, Human
gccuggagaggugggcag

SEQ ID NO: 368089 - RNA, 24 nt, Human
gcgacuccgguggcggugguggcg

SEQ ID NO: 368090 - RNA, 19 nt, Human
gcggcaccggggagggccc

SEQ ID NO: 368091 - RNA, 24 nt, Human
gcggcaccggggagggccccgagg

SEQ ID NO: 368092 - RNA, 20 nt, Human
gcggcggcggcggcggcggc

SEQ ID NO: 368093 - RNA, 23 nt, Human
gcggcggcggcggcggcggcggc

SEQ ID NO: 368094 - RNA, 20 nt, Human
gcggcggcggcggcggcucc

SEQ ID NO: 368095 - RNA, 24 nt, Human
gcggcggcggcggcggcucgggcg

SEQ ID NO: 368096 - RNA, 23 nt, Human
gcggcggcggcgguggcggcggc

SEQ ID NO: 368097 - RNA, 24 nt, Human
gcggcggcgguggcggcggcggcg

SEQ ID NO: 368098 - RNA, 19 nt, Human
gcggcggcucccgaggcuc

SEQ ID NO: 368099 - RNA, 23 nt, Human
gcggcgguggcggcggcggcggc

SEQ ID NO: 368100 - RNA, 19 nt, Human
gcggggugcggggcgcggg

SEQ ID NO: 368101 - RNA, 21 nt, Human
gcucgggcgcgccucgcccuc

SEQ ID NO: 368102 - RNA, 19 nt, Human
gcugaaauauuugccuugg

SEQ ID NO: 368103 - RNA, 21 nt, Human
ggcaaagggacagcgugggga

SEQ ID NO: 368104 - RNA, 18 nt, Human
ggcagggggugggcgugg

SEQ ID NO: 368105 - RNA, 23 nt, Human
ggcagggggugggcguggcaggg

SEQ ID NO: 368106 - RNA, 18 nt, Human
ggccgggccggggucgcg

SEQ ID NO: 368107 - RNA, 25 nt, Human
ggccgggcggcggcggcggcggcgg

SEQ ID NO: 368108 - RNA, 21 nt, Human
ggcgccucacggggggcggcg

SEQ ID NO: 368109 - RNA, 21 nt, Human
ggcggcggcggcggcggcucg

SEQ ID NO: 368110 - RNA, 23 nt, Human
ggcggcggcggcgguggcggcgg

SEQ ID NO: 368111 - RNA, 21 nt, Human
ggcggcggcggcucccgaggc

SEQ ID NO: 368112 - RNA, 18 nt, Human
ggcggcggcggcugcggc

SEQ ID NO: 368113 - RNA, 23 nt, Human
ggcggcggcgguggcggcggcgg

SEQ ID NO: 368114 - RNA, 23 nt, Human
ggcggcgguggcggcggcggcgg

SEQ ID NO: 368115 - RNA, 18 nt, Human
ggcggcgucggggcccgg

SEQ ID NO: 368116 - RNA, 23 nt, Human
ggcggcgucggggcccggccggg

SEQ ID NO: 368117 - RNA, 20 nt, Human
ggcggucaggcggggggcac

SEQ ID NO: 368118 - RNA, 21 nt, Human
ggcggucaggcggggggcacc

SEQ ID NO: 368119 - RNA, 23 nt, Human
ggcgguggcggcggcggcggcgg

SEQ ID NO: 368120 - RNA, 23 nt, Human
ggcggugguggcggcggcggcgg

SEQ ID NO: 368121 - RNA, 24 nt, Human
gggcggcggcggcggcggcggcgg

SEQ ID NO: 368122 - RNA, 21 nt, Human
gggcggcggcggcugcggcgg

SEQ ID NO: 368123 - RNA, 22 nt, Human
gggcggcggucaggcggggggc

SEQ ID NO: 368124 - RNA, 18 nt, Human
ggggcgcgggcggcgcag

SEQ ID NO: 368125 - RNA, 22 nt, Human
gggggcggccgggccgggggac

SEQ ID NO: 368126 - RNA, 20 nt, Human
ggggggcggcggucaggcgg

SEQ ID NO: 368127 - RNA, 20 nt, Human
ggggugggcguggcaggggc

SEQ ID NO: 368128 - RNA, 23 nt, Human
gguggcggcggcggcgguggcgg

SEQ ID NO: 368129 - RNA, 20 nt, Human
gguggcggugguggcggcgg

SEQ ID NO: 368130 - RNA, 23 nt, Human
gguggcggugguggcggcggcgg

SEQ ID NO: 368131 - RNA, 23 nt, Human
ggugguggcggcggcggcggugg

SEQ ID NO: 368132 - RNA, 22 nt, Human
ggugugccccgcacaggguggg

SEQ ID NO: 368133 - RNA, 22 nt, Human
guaaggagaggaugguuugggc

SEQ ID NO: 368134 - RNA, 23 nt, Human
guacucacgcacgcgugcacucg

SEQ ID NO: 368135 - RNA, 25 nt, Human
gugcacucgcacccaagcucacaca

SEQ ID NO: 368136 - RNA, 19 nt, Human
gugccccgcacaggguggg

SEQ ID NO: 368137 - RNA, 20 nt, Human
guggcggcggcggcggcggc

SEQ ID NO: 368138 - RNA, 20 nt, Human
guggcggcggcggcgguggc

SEQ ID NO: 368139 - RNA, 23 nt, Human
guggcggcggcggcgguggcggc

SEQ ID NO: 368140 - RNA, 23 nt, Human
guggcggugguggcggcggcggc

SEQ ID NO: 368141 - RNA, 19 nt, Human
gugguggcggcggcggcgg

SEQ ID NO: 368142 - RNA, 22 nt, Human
uaacagggauggggagaggggu

SEQ ID NO: 368143 - RNA, 20 nt, Human
uagaauguccccgcaggccc

SEQ ID NO: 368144 - RNA, 22 nt, Human
uagagaucuauauauacucucc

SEQ ID NO: 368145 - RNA, 20 nt, Human
uaggggcagagggguaaggu

SEQ ID NO: 368146 - RNA, 21 nt, Human
uaggggcagagggguaaggua

SEQ ID NO: 368147 - RNA, 20 nt, Human
uauaacagggauggggagag

SEQ ID NO: 368148 - RNA, 23 nt, Human
ucacacacgcaacagcucgaagc

SEQ ID NO: 368149 - RNA, 24 nt, Human
ucaccuuugcuaagagauagagau

SEQ ID NO: 368150 - RNA, 18 nt, Human
ucaggcggggggcaccgg

SEQ ID NO: 368151 - RNA, 21 nt, Human
uccacacaacagacucacaca

SEQ ID NO: 368152 - RNA, 22 nt, Human
uccacacaacagacucacacac

SEQ ID NO: 368153 - RNA, 21 nt, Human
uccaccuuaagccuggacgug

SEQ ID NO: 368154 - RNA, 23 nt, Human
uccacgaagcacuugaaagugag

SEQ ID NO: 368155 - RNA, 20 nt, Human
ucccaagcugccacugcugc

SEQ ID NO: 368156 - RNA, 20 nt, Human
uccccgcaggcccgccaccc

SEQ ID NO: 368157 - RNA, 18 nt, Human
uccccugccucccuucuc

SEQ ID NO: 368158 - RNA, 29 nt, Human
uccccugccucccuucuccucucucuccc

SEQ ID NO: 368159 - RNA, 20 nt, Human
ucccgucucucccuccuucc

SEQ ID NO: 368160 - RNA, 20 nt, Human
ucccucccgucucucccucc

SEQ ID NO: 368161 - RNA, 20 nt, Human
ucccuuccucacauuuccca

SEQ ID NO: 368162 - RNA, 23 nt, Human
ucccuucuccucucucuccuccc

SEQ ID NO: 368163 - RNA, 22 nt, Human
uccguacucacgcacgcgugca

SEQ ID NO: 368164 - RNA, 22 nt, Human
uccuuugcccagaggcgccauu

SEQ ID NO: 368165 - RNA, 21 nt, Human
ucgggacuggacgugacagac

SEQ ID NO: 368166 - RNA, 19 nt, Human
ucgggcggcggcggcugcg

SEQ ID NO: 368167 - RNA, 18 nt, Human
ucuccuucccggcggcgg

SEQ ID NO: 368168 - RNA, 18 nt, Human
ucucuaagcuucuauaac

SEQ ID NO: 368169 - RNA, 21 nt, Human
ucugcaaacgacggccggagc

SEQ ID NO: 368170 - RNA, 18 nt, Human
ucuggggugaggggucac

SEQ ID NO: 368171 - RNA, 21 nt, Human
ugacauguuuuuauugcuaug

SEQ ID NO: 368172 - RNA, 21 nt, Human
ugcaaacgacggccggagcag

SEQ ID NO: 368173 - RNA, 20 nt, Human
ugccacugcugcuucugggg

SEQ ID NO: 368174 - RNA, 21 nt, Human
ugccacugcugcuucuggggu

SEQ ID NO: 368175 - RNA, 22 nt, Human
ugcuuucuccccuccuccccca

SEQ ID NO: 368176 - RNA, 20 nt, Human
uggaaaaaguuguuuuagug

SEQ ID NO: 368177 - RNA, 21 nt, Human
uggagggggagaggcaucuau

SEQ ID NO: 368178 - RNA, 20 nt, Human
uggcaaagggacagcguggg

SEQ ID NO: 368179 - RNA, 18 nt, Human
uggcggcggcggcggcgg

SEQ ID NO: 368180 - RNA, 18 nt, Human
uggcggugguggcggcgg

SEQ ID NO: 368181 - RNA, 21 nt, Human
ugggaagccugagcaggccag

SEQ ID NO: 368182 - RNA, 19 nt, Human
uggggcacuaggcggggcc

SEQ ID NO: 368183 - RNA, 22 nt, Human
uggggucacucagccgucucgg

SEQ ID NO: 368184 - RNA, 19 nt, Human
uggguggggguggggcacu

SEQ ID NO: 368185 - RNA, 21 nt, Human
ugggugucggggaagccuuuc

SEQ ID NO: 368186 - RNA, 20 nt, Human
ugguggcggcggcggcggug

SEQ ID NO: 368187 - RNA, 25 nt, Human
ugguggcggcggcggcgguggcggc

SEQ ID NO: 368188 - RNA, 23 nt, Human
ugguggguugugauauuuuuggc

SEQ ID NO: 368189 - RNA, 24 nt, Human
ugguuugggcuccuuccucuuuuu

SEQ ID NO: 368190 - RNA, 18 nt, Human
ugucagggaaaggcaggc

SEQ ID NO: 368191 - RNA, 21 nt, Human
ugucagggaaaggcaggcccc

SEQ ID NO: 368192 - RNA, 24 nt, Human
ugucagggaaaggcaggcccccug

SEQ ID NO: 368193 - RNA, 21 nt, Human
uguggcaaagggacagcgugg

SEQ ID NO: 368194 - RNA, 21 nt, Human
uguggguggggguggggcacu

SEQ ID NO: 368195 - RNA, 19 nt, Human
ugugugucgggggcccggg

SEQ ID NO: 368196 - RNA, 21 nt, Human
uuccauugcuggcuggcucuc

SEQ ID NO: 368197 - RNA, 18 nt, Human
uuccugggggugugcccc

SEQ ID NO: 368198 - RNA, 18 nt, Human
uugggcuccuuccucuuu

SEQ ID NO: 368199 - RNA, 25 nt, Human
uugguggguugugauauuuuuggcg

SEQ ID NO: 368200 - RNA, 22 nt, Human
uuucccaagcugccacugcugc

SEQ ID NO: 368201 - RNA, 19 nt, Human
acacugacgcauccccugc

SEQ ID NO: 368202 - RNA, 19 nt, Human
auccccugccucucccacu

SEQ ID NO: 368203 - RNA, 24 nt, Human
cagcgcgacacugacgcauccccu

SEQ ID NO: 368204 - RNA, 20 nt, Human
ccaugcagcccagcacgggu

SEQ ID NO: 368205 - RNA, 18 nt, Human
cccacugccgggcugggc

SEQ ID NO: 368206 - RNA, 21 nt, Human
cccgcgugucuccgccgcuca

SEQ ID NO: 368207 - RNA, 19 nt, Human
ccgcuccccuggcccugcc

SEQ ID NO: 368208 - RNA, 25 nt, Human
ccucccgaagcucugccuacccgcu

SEQ ID NO: 368209 - RNA, 20 nt, Human
ccuggcccugccccuccggc

SEQ ID NO: 368210 - RNA, 19 nt, Human
cgcgacacugacgcauccc

SEQ ID NO: 368211 - RNA, 19 nt, Human
gaagcucugccuacccgcu

SEQ ID NO: 368212 - RNA, 21 nt, Human
gcagcccagcacgggugcucc

SEQ ID NO: 368213 - RNA, 20 nt, Human
gcucugccuacccgcucccc

SEQ ID NO: 368214 - RNA, 18 nt, Human
ggaguggggugugugggc

SEQ ID NO: 368215 - RNA, 21 nt, Human
ggcgagcgaucgcagccccgc

SEQ ID NO: 368216 - RNA, 24 nt, Human
ucaccucaucuccucccgaagcuc

SEQ ID NO: 368217 - RNA, 20 nt, Human
ucaucuccucccgaagcucu

SEQ ID NO: 368218 - RNA, 22 nt, Human
uccccuggcccugccccuccgg

SEQ ID NO: 368219 - RNA, 27 nt, Human
uggcccugccccuccggccagucccca

SEQ ID NO: 368220 - RNA, 20 nt, Human
ugggguggcacuccccuggc

SEQ ID NO: 368221 - RNA, 22 nt, Human
ugucuccgccgcucaucaccuc

SEQ ID NO: 368222 - RNA, 22 nt, Human
agcaaagaugucucaggaggga

SEQ ID NO: 368223 - RNA, 22 nt, Human
agccucgaucuugcagcaaaga

SEQ ID NO: 368224 - RNA, 22 nt, Human
caccagaggacagccucgaucu

SEQ ID NO: 368225 - RNA, 19 nt, Human
cacugguggggaggguggg

SEQ ID NO: 368226 - RNA, 20 nt, Human
cagaggacagccucgaucuu

SEQ ID NO: 368227 - RNA, 23 nt, Human
cagccucgaucuugcagcaaaga

SEQ ID NO: 368228 - RNA, 21 nt, Human
caggagggauacaaggaaggu

SEQ ID NO: 368229 - RNA, 20 nt, Human
ccaccuucucaccagaggac

SEQ ID NO: 368230 - RNA, 22 nt, Human
ccucggggcugcugccaccucc

SEQ ID NO: 368231 - RNA, 18 nt, Human
cggcggcggcggggcucc

SEQ ID NO: 368232 - RNA, 19 nt, Human
cggggcugcugccaccucc

SEQ ID NO: 368233 - RNA, 18 nt, Human
cucaggagggauacaagg

SEQ ID NO: 368234 - RNA, 20 nt, Human
cuggaauaugacgggaagcc

SEQ ID NO: 368235 - RNA, 20 nt, Human
gcacugguggggaggguggg

SEQ ID NO: 368236 - RNA, 23 nt, Human
gccaccuccggggggcggggcug

SEQ ID NO: 368237 - RNA, 19 nt, Human
gcugcugccaccuccgggg

SEQ ID NO: 368238 - RNA, 21 nt, Human
guggggugccucccgguccuc

SEQ ID NO: 368239 - RNA, 22 nt, Human
ucccucggggcugcugccaccu

SEQ ID NO: 368240 - RNA, 25 nt, Human
ugcacugguggggaggguggggugc

SEQ ID NO: 368241 - RNA, 24 nt, Human
uguugcacugguggggaggguggg

SEQ ID NO: 368242 - RNA, 21 nt, Human
aacccaggcugcccacaacag

SEQ ID NO: 368243 - RNA, 18 nt, Human
aagacccgaagcccagcc

SEQ ID NO: 368244 - RNA, 23 nt, Human
aagcaggugugggagggcggggc

SEQ ID NO: 368245 - RNA, 24 nt, Human
aagguccuaagguccugaggacuc

SEQ ID NO: 368246 - RNA, 25 nt, Human
accccaccacaacugcccagguagc

SEQ ID NO: 368247 - RNA, 21 nt, Human
agaaggcucugggcagagucc

SEQ ID NO: 368248 - RNA, 23 nt, Human
agcaggugugggagggcggggcc

SEQ ID NO: 368249 - RNA, 24 nt, Human
agguggccgagaagagcaccgagc

SEQ ID NO: 368250 - RNA, 19 nt, Human
aggugugggagggcggggc

SEQ ID NO: 368251 - RNA, 19 nt, Human
aguccauggcaccagcacc

SEQ ID NO: 368252 - RNA, 19 nt, Human
caccagcaccagccaaggc

SEQ ID NO: 368253 - RNA, 22 nt, Human
caccagcaccagccaaggccca

SEQ ID NO: 368254 - RNA, 25 nt, Human
cagcaggccacauggcuggccaagc

SEQ ID NO: 368255 - RNA, 23 nt, Human
cagccaaggcccacuccugaaga

SEQ ID NO: 368256 - RNA, 21 nt, Human
cagccccuggaugaagguccu

SEQ ID NO: 368257 - RNA, 22 nt, Human
cauaaacaagaaggcucugggc

SEQ ID NO: 368258 - RNA, 23 nt, Human
cauccaccccaccacaacugccc

SEQ ID NO: 368259 - RNA, 22 nt, Human
ccaccccaccacaacugcccag

SEQ ID NO: 368260 - RNA, 22 nt, Human
ccagcaccagccaaggcccacu

SEQ ID NO: 368261 - RNA, 19 nt, Human
cccaccacaacugcccagg

SEQ ID NO: 368262 - RNA, 22 nt, Human
cccaggcugcccacaacagaag

SEQ ID NO: 368263 - RNA, 23 nt, Human
cccuugggcugugggccuuccca

SEQ ID NO: 368264 - RNA, 18 nt, Human
ccugcaaacccaggcugc

SEQ ID NO: 368265 - RNA, 22 nt, Human
cuccugaagacccgaagcccag

SEQ ID NO: 368266 - RNA, 23 nt, Human
cucucggcuugucuggccucucc

SEQ ID NO: 368267 - RNA, 21 nt, Human
cugggcagaguccauggcacc

SEQ ID NO: 368268 - RNA, 19 nt, Human
cugugggccuucccauccu

SEQ ID NO: 368269 - RNA, 25 nt, Human
gcccacaacagaaggggcucucggc

SEQ ID NO: 368270 - RNA, 23 nt, Human
gccugcaaacccaggcugcccac

SEQ ID NO: 368271 - RNA, 21 nt, Human
gcuugucuggccucucuggcc

SEQ ID NO: 368272 - RNA, 22 nt, Human
uagcuggagcugaucauaaaca

SEQ ID NO: 368273 - RNA, 19 nt, Human
uccaccccaccacaacugc

SEQ ID NO: 368274 - RNA, 22 nt, Human
uccaccccaccacaacugccca

SEQ ID NO: 368275 - RNA, 18 nt, Human
ucccaagcagguguggga

SEQ ID NO: 368276 - RNA, 22 nt, Human
uccccagccugugcaggccugc

SEQ ID NO: 368277 - RNA, 20 nt, Human
uccuaagguccugaggacuc

SEQ ID NO: 368278 - RNA, 21 nt, Human
ucuggccucccaagcaggugu

SEQ ID NO: 368279 - RNA, 22 nt, Human
ugaagacccgaagcccagcccc

SEQ ID NO: 368280 - RNA, 24 nt, Human
ugaagguccuaagguccugaggac

SEQ ID NO: 368281 - RNA, 19 nt, Human
ugaggacuccccagccugu

SEQ ID NO: 368282 - RNA, 22 nt, Human
uggcaccagcaccagccaaggc

SEQ ID NO: 368283 - RNA, 19 nt, Human
uggccgagaagagcaccga

SEQ ID NO: 368284 - RNA, 18 nt, Human
ugggcagaguccauggca

SEQ ID NO: 368285 - RNA, 21 nt, Human
ugggcugugggccuucccauc

SEQ ID NO: 368286 - RNA, 18 nt, Human
aaaaaagcacaacgacug

SEQ ID NO: 368287 - RNA, 26 nt, Human
aaaaaagcacaacgacugaaaaugca

SEQ ID NO: 368288 - RNA, 24 nt, Human
aaaaagcacaacgacugaaaaugc

SEQ ID NO: 368289 - RNA, 20 nt, Human
aaaacaccugaagcccacaa

SEQ ID NO: 368290 - RNA, 21 nt, Human
aaaaccccacaaaaaagccag

SEQ ID NO: 368291 - RNA, 26 nt, Human
aaaagccagaacacccuacccaaccc

SEQ ID NO: 368292 - RNA, 18 nt, Human
aaaccccacaaaaaagcc

SEQ ID NO: 368293 - RNA, 22 nt, Human
aaaccccacaaaaaagccagaa

SEQ ID NO: 368294 - RNA, 23 nt, Human
aaauaaaaaccccacaaaaaagc

SEQ ID NO: 368295 - RNA, 18 nt, Human
aacacagucaguccaccu

SEQ ID NO: 368296 - RNA, 23 nt, Human
aagcaagagagacggacaucugg

SEQ ID NO: 368297 - RNA, 18 nt, Human
aagcacaacgacugaaaa

SEQ ID NO: 368298 - RNA, 25 nt, Human
aagcaccuccugggaggaaucaccc

SEQ ID NO: 368299 - RNA, 21 nt, Human
aagccagaacacccuacccaa

SEQ ID NO: 368300 - RNA, 24 nt, Human
acagaauaaagaaggucccagcca

SEQ ID NO: 368301 - RNA, 23 nt, Human
acagacgcuggcagcccccaugc

SEQ ID NO: 368302 - RNA, 22 nt, Human
acccaccuugcccagauccccc

SEQ ID NO: 368303 - RNA, 21 nt, Human
accccacaaaaaagccagaac

SEQ ID NO: 368304 - RNA, 20 nt, Human
acggcaucccgaggaccccu

SEQ ID NO: 368305 - RNA, 20 nt, Human
acgggaacaacagaaacaag

SEQ ID NO: 368306 - RNA, 24 nt, Human
acucagccuccaaaacuggaacag

SEQ ID NO: 368307 - RNA, 18 nt, Human
acuggccucugcgcaugc

SEQ ID NO: 368308 - RNA, 24 nt, Human
agaacacccuacccaacccagccc

SEQ ID NO: 368309 - RNA, 26 nt, Human
agacgcuggcagcccccaugcucgcc

SEQ ID NO: 368310 - RNA, 18 nt, Human
agagccccccgagcucag

SEQ ID NO: 368311 - RNA, 18 nt, Human
agagggaagaggucuugc

SEQ ID NO: 368312 - RNA, 22 nt, Human
agcacuggagugacgcuggacc

SEQ ID NO: 368313 - RNA, 19 nt, Human
agcccaggggccuccaaac

SEQ ID NO: 368314 - RNA, 18 nt, Human
agcggccccagccauuuc

SEQ ID NO: 368315 - RNA, 18 nt, Human
aggcauggcaccugcgcc

SEQ ID NO: 368316 - RNA, 21 nt, Human
aggccaggccuggugagcuag

SEQ ID NO: 368317 - RNA, 21 nt, Human
aggcggcagagacgugagcag

SEQ ID NO: 368318 - RNA, 22 nt, Human
agggaaaaagggcccaaggaga

SEQ ID NO: 368319 - RNA, 18 nt, Human
agggagcaggcauggcac

SEQ ID NO: 368320 - RNA, 19 nt, Human
agggggagggggaagcagg

SEQ ID NO: 368321 - RNA, 21 nt, Human
agggggagggggaagcaggcc

SEQ ID NO: 368322 - RNA, 24 nt, Human
aggugaucuacuuuaacuggccuc

SEQ ID NO: 368323 - RNA, 23 nt, Human
aguguuucuuuaaaaauaaaaac

SEQ ID NO: 368324 - RNA, 23 nt, Human
augaaccagaacucagccuccaa

SEQ ID NO: 368325 - RNA, 18 nt, Human
augucacaagcccaugug

SEQ ID NO: 368326 - RNA, 19 nt, Human
auucacacagcaaugcacc

SEQ ID NO: 368327 - RNA, 23 nt, Human
caaaaaagcacaacgacugaaaa

SEQ ID NO: 368328 - RNA, 24 nt, Human
caaacccuaaggcagagacauaag

SEQ ID NO: 368329 - RNA, 19 nt, Human
caaggggugcccuaguucc

SEQ ID NO: 368330 - RNA, 28 nt, Human
cacaaaacaaaaaagcacaacgacugaa

SEQ ID NO: 368331 - RNA, 21 nt, Human
cacagccgcagcagccaacag

SEQ ID NO: 368332 - RNA, 22 nt, Human
caccuugcccagaucccccacc

SEQ ID NO: 368333 - RNA, 20 nt, Human
cacucagggcugugccacag

SEQ ID NO: 368334 - RNA, 20 nt, Human
cacucugcaaacccuaaggc

SEQ ID NO: 368335 - RNA, 24 nt, Human
cacucugcaaacccuaaggcagag

SEQ ID NO: 368336 - RNA, 23 nt, Human
cagaacggcaucccgaggacccc

SEQ ID NO: 368337 - RNA, 20 nt, Human
cagaacucagccuccaaaac

SEQ ID NO: 368338 - RNA, 24 nt, Human
cagaacucagccuccaaaacugga

SEQ ID NO: 368339 - RNA, 21 nt, Human
cagaggguguccagccugguc

SEQ ID NO: 368340 - RNA, 18 nt, Human
cagcccccaugcucgccc

SEQ ID NO: 368341 - RNA, 22 nt, Human
cagcugagcacuggagugacgc

SEQ ID NO: 368342 - RNA, 28 nt, Human
cagcugcuguccuuauuugcagccaaga

SEQ ID NO: 368343 - RNA, 23 nt, Human
caggaccaggacaggacaugagc

SEQ ID NO: 368344 - RNA, 19 nt, Human
cagggcugugccacaggcc

SEQ ID NO: 368345 - RNA, 18 nt, Human
caguccaccugccugcug

SEQ ID NO: 368346 - RNA, 23 nt, Human
caugaaccagaacucagccucca

SEQ ID NO: 368347 - RNA, 21 nt, Human
cauuggaggcugaggguagcu

SEQ ID NO: 368348 - RNA, 20 nt, Human
cauuucacuagcagcuacuu

SEQ ID NO: 368349 - RNA, 20 nt, Human
ccacaaguggaaaccgcugg

SEQ ID NO: 368350 - RNA, 21 nt, Human
ccacagccgcagcagccaacc

SEQ ID NO: 368351 - RNA, 23 nt, Human
ccacagcugagcacuggagugac

SEQ ID NO: 368352 - RNA, 22 nt, Human
ccacaggguugguuuucacgaa

SEQ ID NO: 368353 - RNA, 22 nt, Human
ccagaacacccuacccaaccca

SEQ ID NO: 368354 - RNA, 19 nt, Human
ccagaucccccacccccuc

SEQ ID NO: 368355 - RNA, 18 nt, Human
ccaggacaggacaugagc

SEQ ID NO: 368356 - RNA, 21 nt, Human
cccaacccagcccaguguaac

SEQ ID NO: 368357 - RNA, 25 nt, Human
cccacagccgcagcagccaacaggc

SEQ ID NO: 368358 - RNA, 26 nt, Human
cccaccccagcucagacgcccagaag

SEQ ID NO: 368359 - RNA, 18 nt, Human
cccagaucccccaccccc

SEQ ID NO: 368360 - RNA, 21 nt, Human
cccagcucagacgcccagaag

SEQ ID NO: 368361 - RNA, 20 nt, Human
cccauagcgaaaaaaauuca

SEQ ID NO: 368362 - RNA, 20 nt, Human
cccaugcucgcccacagccg

SEQ ID NO: 368363 - RNA, 22 nt, Human
cccaugcucgcccacagccgca

SEQ ID NO: 368364 - RNA, 18 nt, Human
ccccaccaaccuucugcg

SEQ ID NO: 368365 - RNA, 21 nt, Human
ccccccgagcucaggagggau

SEQ ID NO: 368366 - RNA, 23 nt, Human
cccggggccugagaaggcagagc

SEQ ID NO: 368367 - RNA, 22 nt, Human
ccgcggugugucugccuuucuu

SEQ ID NO: 368368 - RNA, 18 nt, Human
ccuaggccgggaguggga

SEQ ID NO: 368369 - RNA, 18 nt, Human
ccuccagccacagcugag

SEQ ID NO: 368370 - RNA, 19 nt, Human
ccucccagugccacccuac

SEQ ID NO: 368371 - RNA, 19 nt, Human
ccuccggcagccacucggc

SEQ ID NO: 368372 - RNA, 21 nt, Human
ccuccggcagccacucggccu

SEQ ID NO: 368373 - RNA, 22 nt, Human
ccugcgggggggucuucuuguu

SEQ ID NO: 368374 - RNA, 20 nt, Human
ccugcuggugguccucggcc

SEQ ID NO: 368375 - RNA, 19 nt, Human
ccuggccgcggugugucug

SEQ ID NO: 368376 - RNA, 20 nt, Human
ccuuggacgaguggaauucg

SEQ ID NO: 368377 - RNA, 21 nt, Human
cgacagcaucuuuaaauuagu

SEQ ID NO: 368378 - RNA, 24 nt, Human
cgcccacagccgcagcagccaaca

SEQ ID NO: 368379 - RNA, 18 nt, Human
cggaaaaaucaagucuuc

SEQ ID NO: 368380 - RNA, 18 nt, Human
cgguggcccuggucccug

SEQ ID NO: 368381 - RNA, 27 nt, Human
cuacccaacccagcccaguguaacagg

SEQ ID NO: 368382 - RNA, 18 nt, Human
cuccagggagcacuucuc

SEQ ID NO: 368383 - RNA, 18 nt, Human
cuccugccuucccccagc

SEQ ID NO: 368384 - RNA, 20 nt, Human
cucgcccacagccgcagcag

SEQ ID NO: 368385 - RNA, 25 nt, Human
cucugcgcaugcuccuccggcagcc

SEQ ID NO: 368386 - RNA, 20 nt, Human
cugcgcaccggccgggccug

SEQ ID NO: 368387 - RNA, 18 nt, Human
cuguguggagcccagggu

SEQ ID NO: 368388 - RNA, 22 nt, Human
cuguucaucagguuucuccggg

SEQ ID NO: 368389 - RNA, 21 nt, Human
cuucguuggcucccggcuugg

SEQ ID NO: 368390 - RNA, 22 nt, Human
cuuucuugucucuguuucuaga

SEQ ID NO: 368391 - RNA, 20 nt, Human
gaaaaaaauucacgggaaca

SEQ ID NO: 368392 - RNA, 19 nt, Human
gacagggcuuugucugcau

SEQ ID NO: 368393 - RNA, 18 nt, Human
gacgaguggaauucgucc

SEQ ID NO: 368394 - RNA, 19 nt, Human
gagagacggacaucugguc

SEQ ID NO: 368395 - RNA, 24 nt, Human
gauggugucucggggcuaggauua

SEQ ID NO: 368396 - RNA, 21 nt, Human
gcacaaaacaaaaaagcacaa

SEQ ID NO: 368397 - RNA, 22 nt, Human
gcacaggcacaccugggucccu

SEQ ID NO: 368398 - RNA, 21 nt, Human
gcaggagcacaggcacaccug

SEQ ID NO: 368399 - RNA, 20 nt, Human
gcaggcauggcaccugcgcc

SEQ ID NO: 368400 - RNA, 22 nt, Human
gcauuggaggcugaggguagcu

SEQ ID NO: 368401 - RNA, 23 nt, Human
gccagaacacccuacccaaccca

SEQ ID NO: 368402 - RNA, 21 nt, Human
gcccaacacagucaguccacc

SEQ ID NO: 368403 - RNA, 20 nt, Human
gcccagaggccaggccuggu

SEQ ID NO: 368404 - RNA, 23 nt, Human
gccgggccugggacacccgggag

SEQ ID NO: 368405 - RNA, 22 nt, Human
gccucagucagcaccgcgggac

SEQ ID NO: 368406 - RNA, 21 nt, Human
gcggggaaccggaguggguuc

SEQ ID NO: 368407 - RNA, 20 nt, Human
gcuguggguugcggggaacc

SEQ ID NO: 368408 - RNA, 18 nt, Human
ggaauuccagcacagcag

SEQ ID NO: 368409 - RNA, 23 nt, Human
ggacacugcuguguggagcccag

SEQ ID NO: 368410 - RNA, 19 nt, Human
ggacagggcuuugucugca

SEQ ID NO: 368411 - RNA, 24 nt, Human
ggacaucugguccugaguccccaa

SEQ ID NO: 368412 - RNA, 25 nt, Human
ggagaagggaagcccggggccugag

SEQ ID NO: 368413 - RNA, 25 nt, Human
ggagaugccggcaccccccaacccu

SEQ ID NO: 368414 - RNA, 22 nt, Human
ggaguccaucggggccucaagc

SEQ ID NO: 368415 - RNA, 21 nt, Human
ggccacacugcccagaggccc

SEQ ID NO: 368416 - RNA, 23 nt, Human
ggccugggacacccgggagccgc

SEQ ID NO: 368417 - RNA, 18 nt, Human
ggcuguucccuggcucag

SEQ ID NO: 368418 - RNA, 22 nt, Human
gggaacccagcaccggccagaa

SEQ ID NO: 368419 - RNA, 23 nt, Human
gggagagcggggaggugccuagg

SEQ ID NO: 368420 - RNA, 18 nt, Human
gggcgcccacaugggugc

SEQ ID NO: 368421 - RNA, 20 nt, Human
gggcugugccacaggccagc

SEQ ID NO: 368422 - RNA, 19 nt, Human
ggggaggugccuaggccgg

SEQ ID NO: 368423 - RNA, 21 nt, Human
ggugccuaggccgggaguggg

SEQ ID NO: 368424 - RNA, 20 nt, Human
ggugucaaguugacccaaaa

SEQ ID NO: 368425 - RNA, 18 nt, Human
gucccuguggaauuccag

SEQ ID NO: 368426 - RNA, 20 nt, Human
gugcuuggcucugucuccua

SEQ ID NO: 368427 - RNA, 25 nt, Human
guggcugggacacagaccggggucc

SEQ ID NO: 368428 - RNA, 20 nt, Human
gugggcugucccuuggacga

SEQ ID NO: 368429 - RNA, 23 nt, Human
uaaaaaccccacaaaaaagccag

SEQ ID NO: 368430 - RNA, 20 nt, Human
uaaacaaaggagggaaggga

SEQ ID NO: 368431 - RNA, 23 nt, Human
uaacacagaauaaagaagguccc

SEQ ID NO: 368432 - RNA, 23 nt, Human
uaaguaaacaaaggagggaaggg

SEQ ID NO: 368433 - RNA, 21 nt, Human
uaccagaguuuucacagcagc

SEQ ID NO: 368434 - RNA, 23 nt, Human
uaccuucugaaguggggucccca

SEQ ID NO: 368435 - RNA, 20 nt, Human
uagcugcgaccucuggggca

SEQ ID NO: 368436 - RNA, 21 nt, Human
uagcugcgaccucuggggcag

SEQ ID NO: 368437 - RNA, 22 nt, Human
uaguucccucucugcaggcggg

SEQ ID NO: 368438 - RNA, 23 nt, Human
uauggucaggaguccaucggggc

SEQ ID NO: 368439 - RNA, 22 nt, Human
ucacaguggauggcccugcgug

SEQ ID NO: 368440 - RNA, 23 nt, Human
uccaaaacuggaacagaaauagc

SEQ ID NO: 368441 - RNA, 23 nt, Human
uccacaacagacgcuggcagccc

SEQ ID NO: 368442 - RNA, 23 nt, Human
uccaucggggccucaagcaccuc

SEQ ID NO: 368443 - RNA, 21 nt, Human
uccccaaacuguucaucaggu

SEQ ID NO: 368444 - RNA, 20 nt, Human
uccccaggcuggaguggggc

SEQ ID NO: 368445 - RNA, 18 nt, Human
ucccccacccccucccag

SEQ ID NO: 368446 - RNA, 25 nt, Human
uccccugcgguggcccuggucccug

SEQ ID NO: 368447 - RNA, 23 nt, Human
ucccuggcucaggauggugucuc

SEQ ID NO: 368448 - RNA, 21 nt, Human
uccucggccuccagaccgugg

SEQ ID NO: 368449 - RNA, 23 nt, Human
uccugaguccccaaacuguucau

SEQ ID NO: 368450 - RNA, 23 nt, Human
uccugcgggggggucuucuuguu

SEQ ID NO: 368451 - RNA, 21 nt, Human
ucggcugccucccauagcgaa

SEQ ID NO: 368452 - RNA, 22 nt, Human
ucguuggcucccggcuugggac

SEQ ID NO: 368453 - RNA, 20 nt, Human
ucugggcagcuguccggcuu

SEQ ID NO: 368454 - RNA, 22 nt, Human
ucuuguucuggggguccuuggc

SEQ ID NO: 368455 - RNA, 21 nt, Human
ugaaaacaccugaagcccaca

SEQ ID NO: 368456 - RNA, 23 nt, Human
ugaagacggaccccagcggcccc

SEQ ID NO: 368457 - RNA, 20 nt, Human
ugacagggagagcggggagg

SEQ ID NO: 368458 - RNA, 18 nt, Human
ugacgcuggaccacuugg

SEQ ID NO: 368459 - RNA, 22 nt, Human
ugagcagugcuuggcucugucu

SEQ ID NO: 368460 - RNA, 21 nt, Human
ugaggcauguccaccucccag

SEQ ID NO: 368461 - RNA, 19 nt, Human
ugcaaacccuaaggcagag

SEQ ID NO: 368462 - RNA, 24 nt, Human
ugcauuggaggcugaggguagcug

SEQ ID NO: 368463 - RNA, 20 nt, Human
ugccacccuacggcugaguu

SEQ ID NO: 368464 - RNA, 24 nt, Human
ugcccaggugggggcggcaggcuc

SEQ ID NO: 368465 - RNA, 22 nt, Human
ugccuaggccgggagugggaac

SEQ ID NO: 368466 - RNA, 21 nt, Human
ugcgcaccggccgggccuggg

SEQ ID NO: 368467 - RNA, 21 nt, Human
ugcggaggagcucccacccca

SEQ ID NO: 368468 - RNA, 19 nt, Human
ugcuuguugugguggguug

SEQ ID NO: 368469 - RNA, 22 nt, Human
ugcuuguugugguggguugugc

SEQ ID NO: 368470 - RNA, 21 nt, Human
uggaaauaaauaaacauggug

SEQ ID NO: 368471 - RNA, 21 nt, Human
uggaacagaacggcaucccga

SEQ ID NO: 368472 - RNA, 23 nt, Human
uggaggcagcgacagcucaggaa

SEQ ID NO: 368473 - RNA, 21 nt, Human
uggaguggggcacacagcacc

SEQ ID NO: 368474 - RNA, 23 nt, Human
uggaguggggcacacagcaccaa

SEQ ID NO: 368475 - RNA, 22 nt, Human
uggcagcccccaugcucgccca

SEQ ID NO: 368476 - RNA, 20 nt, Human
uggccucugcgcaugcuccu

SEQ ID NO: 368477 - RNA, 23 nt, Human
uggcugggacacagacagggagc

SEQ ID NO: 368478 - RNA, 21 nt, Human
ugggaugggcagcugagcugu

SEQ ID NO: 368479 - RNA, 24 nt, Human
ugggaugggcagcugagcuguggg

SEQ ID NO: 368480 - RNA, 27 nt, Human
ugggcagcugagcugugggacagagag

SEQ ID NO: 368481 - RNA, 23 nt, Human
uggggagaagggaagcccggggc

SEQ ID NO: 368482 - RNA, 24 nt, Human
uggggagaagggaagcccggggcc

SEQ ID NO: 368483 - RNA, 21 nt, Human
uggggcacacagcaccaagga

SEQ ID NO: 368484 - RNA, 19 nt, Human
uggggcaggggacacugcu

SEQ ID NO: 368485 - RNA, 18 nt, Human
ugggguccccaggcugga

SEQ ID NO: 368486 - RNA, 24 nt, Human
ugggucccuggcccucaguugagg

SEQ ID NO: 368487 - RNA, 20 nt, Human
ugucacaagcccaugugucu

SEQ ID NO: 368488 - RNA, 22 nt, Human
ugucacaagcccaugugucugg

SEQ ID NO: 368489 - RNA, 20 nt, Human
ugucaguggaguguggagaa

SEQ ID NO: 368490 - RNA, 22 nt, Human
ugucucuguuucuagaagacug

SEQ ID NO: 368491 - RNA, 20 nt, Human
uguucuggggguccuuggcu

SEQ ID NO: 368492 - RNA, 22 nt, Human
uguuucuuuaaaaauaaaaacc

SEQ ID NO: 368493 - RNA, 22 nt, Human
uucacagcagccuccacugccc

SEQ ID NO: 368494 - RNA, 22 nt, Human
uucacgaaugucacaagcccau

SEQ ID NO: 368495 - RNA, 24 nt, Human
uucacuagcagcuacuuuccacaa

SEQ ID NO: 368496 - RNA, 24 nt, Human
uuccaagucucaguagcucuguuu

SEQ ID NO: 368497 - RNA, 21 nt, Human
uugcccagaucccccaccccc

SEQ ID NO: 368498 - RNA, 25 nt, Human
uugcccagaucccccacccccuccc

SEQ ID NO: 368499 - RNA, 18 nt, Human
uuggaggcugaggguagc

SEQ ID NO: 368500 - RNA, 22 nt, Human
uuggccaggccucggcugccuc

SEQ ID NO: 368501 - RNA, 21 nt, Human
uuugcccagggucugggcccu

SEQ ID NO: 368502 - RNA, 21 nt, Human
aaacaacacagaacauucagc

SEQ ID NO: 368503 - RNA, 21 nt, Human
aaacagcaauauuaacagacu

SEQ ID NO: 368504 - RNA, 23 nt, Human
aaacagcaauauuaacagacuuc

SEQ ID NO: 368505 - RNA, 21 nt, Human
aaagggguaccaguggguccc

SEQ ID NO: 368506 - RNA, 23 nt, Human
aaagguauaauucaccguuauaa

SEQ ID NO: 368507 - RNA, 18 nt, Human
aacaacacagaacauuca

SEQ ID NO: 368508 - RNA, 23 nt, Human
aaccuagcauucccucuucccca

SEQ ID NO: 368509 - RNA, 23 nt, Human
aagccaccagcccuaucaaccua

SEQ ID NO: 368510 - RNA, 20 nt, Human
aagcuggggucagggaucuu

SEQ ID NO: 368511 - RNA, 23 nt, Human
aaggaaacaacacagaacauuca

SEQ ID NO: 368512 - RNA, 20 nt, Human
aaguuuccccaauauuaaag

SEQ ID NO: 368513 - RNA, 27 nt, Human
acaaagagcuggcagaaauuaauucca

SEQ ID NO: 368514 - RNA, 21 nt, Human
acaaagccuggugccagggac

SEQ ID NO: 368515 - RNA, 21 nt, Human
acaacaaaaaauccuauacgg

SEQ ID NO: 368516 - RNA, 19 nt, Human
acaacucuuacaacaacaa

SEQ ID NO: 368517 - RNA, 22 nt, Human
acagacauuucugagcccaaag

SEQ ID NO: 368518 - RNA, 26 nt, Human
acaucacacuuucauaagccaccucc

SEQ ID NO: 368519 - RNA, 22 nt, Human
accacagacauuucugagccca

SEQ ID NO: 368520 - RNA, 22 nt, Human
acccagagauuuacugucagcu

SEQ ID NO: 368521 - RNA, 21 nt, Human
accuagcauucccucuucccc

SEQ ID NO: 368522 - RNA, 24 nt, Human
acucuucacagcacccaccacaaa

SEQ ID NO: 368523 - RNA, 22 nt, Human
acuuggguggagagcccagccu

SEQ ID NO: 368524 - RNA, 22 nt, Human
acuuguaucucuucuaagcaga

SEQ ID NO: 368525 - RNA, 21 nt, Human
agaaacccagagauuuacugu

SEQ ID NO: 368526 - RNA, 23 nt, Human
agaaaugguagcauuucaggccu

SEQ ID NO: 368527 - RNA, 20 nt, Human
agaagccaccagcccuauca

SEQ ID NO: 368528 - RNA, 18 nt, Human
agacagaagucauguucu

SEQ ID NO: 368529 - RNA, 21 nt, Human
agcacuggcccugagccccac

SEQ ID NO: 368530 - RNA, 19 nt, Human
agccaccuccucauaaaug

SEQ ID NO: 368531 - RNA, 20 nt, Human
agcuuuagcuucuuggccca

SEQ ID NO: 368532 - RNA, 21 nt, Human
aggaaaaggauuuaaggagac

SEQ ID NO: 368533 - RNA, 19 nt, Human
aggaggaaagaggcagcag

SEQ ID NO: 368534 - RNA, 22 nt, Human
aggcaggagaaucgcuugaacc

SEQ ID NO: 368535 - RNA, 24 nt, Human
aggcaggagaaucgcuugaaccag

SEQ ID NO: 368536 - RNA, 20 nt, Human
aggcugaggcaggagaaucg

SEQ ID NO: 368537 - RNA, 24 nt, Human
aggcugaggcaggagaaucgcuug

SEQ ID NO: 368538 - RNA, 22 nt, Human
agggagaaaacagaagucccca

SEQ ID NO: 368539 - RNA, 24 nt, Human
agggagucggagguugcagugagc

SEQ ID NO: 368540 - RNA, 24 nt, Human
agucggagguugcagugagccaag

SEQ ID NO: 368541 - RNA, 23 nt, Human
auuaaguuuccccaauauuaaag

SEQ ID NO: 368542 - RNA, 18 nt, Human
auuaugcucugaacccag

SEQ ID NO: 368543 - RNA, 26 nt, Human
auuucaggccuuuaaagucagguguu

SEQ ID NO: 368544 - RNA, 19 nt, Human
caaacgguuccugcacacc

SEQ ID NO: 368545 - RNA, 22 nt, Human
caaaguaccuucugaacuuagc

SEQ ID NO: 368546 - RNA, 24 nt, Human
cacagcacccaccacaaaaacaaa

SEQ ID NO: 368547 - RNA, 19 nt, Human
caccacaaaaacaaacuac

SEQ ID NO: 368548 - RNA, 19 nt, Human
cacucaggaggcugaggca

SEQ ID NO: 368549 - RNA, 20 nt, Human
cacugguggggggcagcaaa

SEQ ID NO: 368550 - RNA, 21 nt, Human
cagacauuucugagcccaaag

SEQ ID NO: 368551 - RNA, 18 nt, Human
cagccugcugaagagccg

SEQ ID NO: 368552 - RNA, 22 nt, Human
cagcuuagcucagacagaaguc

SEQ ID NO: 368553 - RNA, 19 nt, Human
cagguugggauugcuuggg

SEQ ID NO: 368554 - RNA, 20 nt, Human
caugagguucugccacaugc

SEQ ID NO: 368555 - RNA, 22 nt, Human
cauggcucacuaagcaaguacu

SEQ ID NO: 368556 - RNA, 23 nt, Human
ccacaccaagguggcuccaagug

SEQ ID NO: 368557 - RNA, 23 nt, Human
ccacagacauuucugagcccaaa

SEQ ID NO: 368558 - RNA, 18 nt, Human
ccacugcacuuuaccaag

SEQ ID NO: 368559 - RNA, 18 nt, Human
ccacugcacuuuaccaag

SEQ ID NO: 368560 - RNA, 19 nt, Human
ccacugcacuuuaccaagu

SEQ ID NO: 368561 - RNA, 19 nt, Human
ccaugcuucacauaugcau

SEQ ID NO: 368562 - RNA, 19 nt, Human
cccacaaguaccaagcucu

SEQ ID NO: 368563 - RNA, 19 nt, Human
ccccaaucuuccccccacc

SEQ ID NO: 368564 - RNA, 20 nt, Human
ccccaaucuuccccccaccc

SEQ ID NO: 368565 - RNA, 21 nt, Human
ccccacaaguaccaagcucuu

SEQ ID NO: 368566 - RNA, 22 nt, Human
ccccugcagcaaggccuaauuc

SEQ ID NO: 368567 - RNA, 27 nt, Human
ccccugcagcaaggccuaauuccacuu

SEQ ID NO: 368568 - RNA, 23 nt, Human
cccucugaagcccccaccuugag

SEQ ID NO: 368569 - RNA, 20 nt, Human
ccucacuguugaccaauucc

SEQ ID NO: 368570 - RNA, 23 nt, Human
ccucggccacauaaacucuccca

SEQ ID NO: 368571 - RNA, 21 nt, Human
ccugcacaccuguguuugcug

SEQ ID NO: 368572 - RNA, 22 nt, Human
ccuucauccuaccugccaucau

SEQ ID NO: 368573 - RNA, 21 nt, Human
cgucgggcaggaauuugccgu

SEQ ID NO: 368574 - RNA, 21 nt, Human
cguuccccaaucuucccccca

SEQ ID NO: 368575 - RNA, 19 nt, Human
cuaaaccuuugccuacacu

SEQ ID NO: 368576 - RNA, 21 nt, Human
cuagcaccagguugggauugc

SEQ ID NO: 368577 - RNA, 22 nt, Human
cucuaggaaaacccuguuccuu

SEQ ID NO: 368578 - RNA, 18 nt, Human
cugugacuggguggagaa

SEQ ID NO: 368579 - RNA, 21 nt, Human
cuucacagcacccaccacaaa

SEQ ID NO: 368580 - RNA, 20 nt, Human
cuucgcucccaaagagagga

SEQ ID NO: 368581 - RNA, 18 nt, Human
cuugcuggaccugagcca

SEQ ID NO: 368582 - RNA, 22 nt, Human
cuuuauguccauuuucuaaacc

SEQ ID NO: 368583 - RNA, 25 nt, Human
gaaagaaaaaaaaacguugaaaaaa

SEQ ID NO: 368584 - RNA, 22 nt, Human
gagaaucgcuugaaccagggag

SEQ ID NO: 368585 - RNA, 24 nt, Human
gagacugcagccaccacaccucgg

SEQ ID NO: 368586 - RNA, 22 nt, Human
gaggauccugggagaagucugu

SEQ ID NO: 368587 - RNA, 22 nt, Human
gagguugcagugagccaagauc

SEQ ID NO: 368588 - RNA, 21 nt, Human
gcaaccgggugaaaaaaacaa

SEQ ID NO: 368589 - RNA, 23 nt, Human
gccaccuccucauaaaugggucc

SEQ ID NO: 368590 - RNA, 20 nt, Human
ggagguugcagugagccaag

SEQ ID NO: 368591 - RNA, 24 nt, Human
ggagguugcagugagccaagauca

SEQ ID NO: 368592 - RNA, 18 nt, Human
ggccauuagggcagaaag

SEQ ID NO: 368593 - RNA, 23 nt, Human
gggaggcuggcaggagaggagua

SEQ ID NO: 368594 - RNA, 19 nt, Human
ggggaaggggaggcuggca

SEQ ID NO: 368595 - RNA, 19 nt, Human
gguaccagugggucccuug

SEQ ID NO: 368596 - RNA, 24 nt, Human
guaaaauaaaggauuguccuucaa

SEQ ID NO: 368597 - RNA, 18 nt, Human
guaacauuguccaguaga

SEQ ID NO: 368598 - RNA, 21 nt, Human
guaccuggucagagaaaaacu

SEQ ID NO: 368599 - RNA, 22 nt, Human
gugaaaugaccuagcaccaggu

SEQ ID NO: 368600 - RNA, 22 nt, Human
gugauccaccugaauaucagaa

SEQ ID NO: 368601 - RNA, 19 nt, Human
guucaucuguccuugcugg

SEQ ID NO: 368602 - RNA, 20 nt, Human
uaaaacaacaaacauccuag

SEQ ID NO: 368603 - RNA, 23 nt, Human
uaaagcagccccucuauagggac

SEQ ID NO: 368604 - RNA, 21 nt, Human
uaaagucagguguuguaccug

SEQ ID NO: 368605 - RNA, 22 nt, Human
uaagcaaguacuagggcaccug

SEQ ID NO: 368606 - RNA, 23 nt, Human
uacaacucuuacaacaacaaaaa

SEQ ID NO: 368607 - RNA, 23 nt, Human
uaccaagcucuuccugagacugc

SEQ ID NO: 368608 - RNA, 19 nt, Human
uaccaaggacuuaaggcaa

SEQ ID NO: 368609 - RNA, 23 nt, Human
uaccacagacauuucugagccca

SEQ ID NO: 368610 - RNA, 20 nt, Human
uacgcgaacaucacacuuuc

SEQ ID NO: 368611 - RNA, 19 nt, Human
uacuccacggaggggagaa

SEQ ID NO: 368612 - RNA, 19 nt, Human
uagcuucuuggcccaggaa

SEQ ID NO: 368613 - RNA, 18 nt, Human
ucaaaagugacccuacag

SEQ ID NO: 368614 - RNA, 21 nt, Human
uccaggccucagaaagccacc

SEQ ID NO: 368615 - RNA, 19 nt, Human
ucccaaagagaggauccug

SEQ ID NO: 368616 - RNA, 21 nt, Human
ucccaaagagaggauccuggg

SEQ ID NO: 368617 - RNA, 24 nt, Human
ucccagucuucacugaucuccaca

SEQ ID NO: 368618 - RNA, 22 nt, Human
uccccccacccucugaagcccc

SEQ ID NO: 368619 - RNA, 19 nt, Human
uccugagucuccuauagcu

SEQ ID NO: 368620 - RNA, 22 nt, Human
ugaaaaaaggaagguuucuuua

SEQ ID NO: 368621 - RNA, 21 nt, Human
ugaaauagaagguucagcauu

SEQ ID NO: 368622 - RNA, 21 nt, Human
ugaagcagcuuuccucccagu

SEQ ID NO: 368623 - RNA, 23 nt, Human
ugaaugugauacauguguuuagu

SEQ ID NO: 368624 - RNA, 23 nt, Human
ugacaacuuaauaaacuguacuc

SEQ ID NO: 368625 - RNA, 20 nt, Human
ugacagcccccacgaccugg

SEQ ID NO: 368626 - RNA, 22 nt, Human
ugacaguaggaaugucacccca

SEQ ID NO: 368627 - RNA, 21 nt, Human
ugaccauuccccccguucccc

SEQ ID NO: 368628 - RNA, 20 nt, Human
ugagaaggaaaugaaguccc

SEQ ID NO: 368629 - RNA, 23 nt, Human
ugaggaggaaagaggcagcagca

SEQ ID NO: 368630 - RNA, 20 nt, Human
ugaggcaggagaaucgcuug

SEQ ID NO: 368631 - RNA, 24 nt, Human
ugaggcaggagaaucgcuugaacc

SEQ ID NO: 368632 - RNA, 23 nt, Human
ugagguccuugcuuucccuagaa

SEQ ID NO: 368633 - RNA, 25 nt, Human
ugauccaccugaauaucagaaguuu

SEQ ID NO: 368634 - RNA, 21 nt, Human
ugauugggucaaaaggcuccu

SEQ ID NO: 368635 - RNA, 20 nt, Human
ugcacagcagucccucacac

SEQ ID NO: 368636 - RNA, 23 nt, Human
ugccauaccaccaggcugccugc

SEQ ID NO: 368637 - RNA, 22 nt, Human
ugccucacuguugaccaauucc

SEQ ID NO: 368638 - RNA, 25 nt, Human
ugccucggccacauaaacucuccca

SEQ ID NO: 368639 - RNA, 23 nt, Human
ugcuaaacagcauaaaaucugug

SEQ ID NO: 368640 - RNA, 20 nt, Human
ugcucugaacccagggcaac

SEQ ID NO: 368641 - RNA, 20 nt, Human
uggagaaagcuaaagcuggg

SEQ ID NO: 368642 - RNA, 21 nt, Human
uggagaaagcuaaagcugggg

SEQ ID NO: 368643 - RNA, 22 nt, Human
uggagagcccagccugagcacc

SEQ ID NO: 368644 - RNA, 19 nt, Human
ugggagaagucuguaucca

SEQ ID NO: 368645 - RNA, 24 nt, Human
ugguggggggcagcaaauuccugg

SEQ ID NO: 368646 - RNA, 24 nt, Human
uguaguaguagacacggguggcug

SEQ ID NO: 368647 - RNA, 21 nt, Human
uguccuugcuggaccugagcc

SEQ ID NO: 368648 - RNA, 19 nt, Human
ugugcagccugcugaagag

SEQ ID NO: 368649 - RNA, 22 nt, Human
uguugaccaauuccaaaaccua

SEQ ID NO: 368650 - RNA, 22 nt, Human
uuaaaaggcaagcacauuuugc

SEQ ID NO: 368651 - RNA, 21 nt, Human
uuacaaaucccaaacccauga

SEQ ID NO: 368652 - RNA, 23 nt, Human
uuagcuucuuggcccaggaauuu

SEQ ID NO: 368653 - RNA, 21 nt, Human
uucacagcacccaccacaaaa

SEQ ID NO: 368654 - RNA, 18 nt, Human
uucaggagaguugggccc

SEQ ID NO: 368655 - RNA, 18 nt, Human
uucugugucugcacugug

SEQ ID NO: 368656 - RNA, 20 nt, Human
uucugugucugcacugugua

SEQ ID NO: 368657 - RNA, 18 nt, Human
uugagcaaggauuuugca

SEQ ID NO: 368658 - RNA, 19 nt, Human
uugagcaaggauuuugcau

SEQ ID NO: 368659 - RNA, 20 nt, Human
uugcagugagccaagaucac

SEQ ID NO: 368660 - RNA, 24 nt, Human
uugcuuccacuugugcagccugcu

SEQ ID NO: 368661 - RNA, 19 nt, Human
uuggcaguggggccaagaa

SEQ ID NO: 368662 - RNA, 21 nt, Human
uuguaccuggucagagaaaaa

SEQ ID NO: 368663 - RNA, 21 nt, Human
uuucauuuuaauguaauuagc

SEQ ID NO: 368664 - RNA, 21 nt, Human
uuugaugacuugggcccauga

SEQ ID NO: 368665 - RNA, 22 nt, Human
uuugcugguuggccugccuucc

SEQ ID NO: 368666 - RNA, 19 nt, Human
uuuugcuuaaaggauuagc

SEQ ID NO: 368667 - RNA, 19 nt, Human
aaaagaaaagaggaguagg

SEQ ID NO: 368668 - RNA, 24 nt, Human
aaacaaccaagcccaaaccugaca

SEQ ID NO: 368669 - RNA, 20 nt, Human
aacaguauguagcaaaacaa

SEQ ID NO: 368670 - RNA, 18 nt, Human
aagcugccuaggccaggc

SEQ ID NO: 368671 - RNA, 19 nt, Human
aagcugccuaggccaggcu

SEQ ID NO: 368672 - RNA, 29 nt, Human
acacagcacucucucucucuguguccucc

SEQ ID NO: 368673 - RNA, 21 nt, Human
acaggacaguagcggggaagg

SEQ ID NO: 368674 - RNA, 21 nt, Human
acccaggugcuucuaaaacaa

SEQ ID NO: 368675 - RNA, 24 nt, Human
acucucucucucuguguccuccau

SEQ ID NO: 368676 - RNA, 26 nt, Human
agaccagaaaccccugcuuuccacau

SEQ ID NO: 368677 - RNA, 21 nt, Human
agcuuccuggcauugccuccu

SEQ ID NO: 368678 - RNA, 18 nt, Human
aggaaggagugagggagg

SEQ ID NO: 368679 - RNA, 22 nt, Human
aggacaggacaguagcggggaa

SEQ ID NO: 368680 - RNA, 18 nt, Human
aggcuucuggacaggugc

SEQ ID NO: 368681 - RNA, 22 nt, Human
agggagagaagugccuuccagg

SEQ ID NO: 368682 - RNA, 19 nt, Human
agugagggagggggaaagg

SEQ ID NO: 368683 - RNA, 21 nt, Human
agugagggagggggaaaggag

SEQ ID NO: 368684 - RNA, 20 nt, Human
augucucucuaaaggagaca

SEQ ID NO: 368685 - RNA, 18 nt, Human
caaccaagcccaaaccug

SEQ ID NO: 368686 - RNA, 22 nt, Human
caagaaggguggaggaggugag

SEQ ID NO: 368687 - RNA, 19 nt, Human
caagguucacuggcccuuc

SEQ ID NO: 368688 - RNA, 23 nt, Human
cagcucugcucugggaccagggg

SEQ ID NO: 368689 - RNA, 22 nt, Human
caggaaauuggagcauuguggg

SEQ ID NO: 368690 - RNA, 18 nt, Human
caggaaucuccuuuguca

SEQ ID NO: 368691 - RNA, 21 nt, Human
ccagagcaaguuagcugagga

SEQ ID NO: 368692 - RNA, 24 nt, Human
ccaggugcuucuaaaacaaccaag

SEQ ID NO: 368693 - RNA, 19 nt, Human
cccagccagcaguaaaagg

SEQ ID NO: 368694 - RNA, 19 nt, Human
ccugacaugcuccucccca

SEQ ID NO: 368695 - RNA, 19 nt, Human
ccuggauauaagcagguuc

SEQ ID NO: 368696 - RNA, 24 nt, Human
ccuucauuguccccuuuaaaaguc

SEQ ID NO: 368697 - RNA, 19 nt, Human
cucugggaccaggggccca

SEQ ID NO: 368698 - RNA, 24 nt, Human
cuucacaucugcaaaaggggcagc

SEQ ID NO: 368699 - RNA, 20 nt, Human
cuuggcucagcacuuucugu

SEQ ID NO: 368700 - RNA, 19 nt, Human
gaagcugccuaggccaggc

SEQ ID NO: 368701 - RNA, 21 nt, Human
gaaggagugagggagggggaa

SEQ ID NO: 368702 - RNA, 18 nt, Human
gacaggacaguagcgggg

SEQ ID NO: 368703 - RNA, 24 nt, Human
gagaggaaacccuucaccagcuuc

SEQ ID NO: 368704 - RNA, 21 nt, Human
gcaguaaaagggaaggccaga

SEQ ID NO: 368705 - RNA, 24 nt, Human
gcuuuccuuuucaacuuccuuagc

SEQ ID NO: 368706 - RNA, 18 nt, Human
ggacaggugccuccaaag

SEQ ID NO: 368707 - RNA, 23 nt, Human
ggcagucagggagagaagugccu

SEQ ID NO: 368708 - RNA, 21 nt, Human
ggcuucuggacaggugccucc

SEQ ID NO: 368709 - RNA, 18 nt, Human
gggagggggaaaggagua

SEQ ID NO: 368710 - RNA, 24 nt, Human
ggggaaggaauacacagccgaccu

SEQ ID NO: 368711 - RNA, 28 nt, Human
uaaaacaaccaagcccaaaccugacaug

SEQ ID NO: 368712 - RNA, 23 nt, Human
uacacagcacucucucucucugu

SEQ ID NO: 368713 - RNA, 20 nt, Human
uagaccagaaaccccugcuu

SEQ ID NO: 368714 - RNA, 25 nt, Human
uagccaguagaccagaaaccccuuc

SEQ ID NO: 368715 - RNA, 25 nt, Human
uauuaagcaaccaucuggguccaag

SEQ ID NO: 368716 - RNA, 21 nt, Human
ucaaaaaguaaguucaaaggu

SEQ ID NO: 368717 - RNA, 18 nt, Human
ucagcucugcucugggac

SEQ ID NO: 368718 - RNA, 23 nt, Human
uccagcaccugugauaguuucau

SEQ ID NO: 368719 - RNA, 18 nt, Human
ucccagagcaaguuagcu

SEQ ID NO: 368720 - RNA, 25 nt, Human
uccuggcauugccuccuugguccug

SEQ ID NO: 368721 - RNA, 20 nt, Human
ucucucaggaaucuccuuug

SEQ ID NO: 368722 - RNA, 18 nt, Human
ucuuggcucagcacuuuc

SEQ ID NO: 368723 - RNA, 21 nt, Human
ucuuggcucagcacuuucugu

SEQ ID NO: 368724 - RNA, 23 nt, Human
ugacaugcuccuccccacaguca

SEQ ID NO: 368725 - RNA, 20 nt, Human
ugagggagggggaaaggagu

SEQ ID NO: 368726 - RNA, 22 nt, Human
ugccuaggccaggcuucuggac

SEQ ID NO: 368727 - RNA, 22 nt, Human
uggaacaguauguagcaaaaca

SEQ ID NO: 368728 - RNA, 21 nt, Human
uggacaggugccuccaaagaa

SEQ ID NO: 368729 - RNA, 21 nt, Human
uuaaaagucuggaacaguaug

SEQ ID NO: 368730 - RNA, 19 nt, Human
uucaaagguugaagcugcc

SEQ ID NO: 368731 - RNA, 23 nt, Human
uugaagcugccuaggccaggcuu

SEQ ID NO: 368732 - RNA, 25 nt, Human
aaaaaaaaaaaaaaaaggccagggg

SEQ ID NO: 368733 - RNA, 18 nt, Human
aaaaaaaaaaaaaaaggc

SEQ ID NO: 368734 - RNA, 26 nt, Human
aaaaaaaaaaaaaaaggccaggggag

SEQ ID NO: 368735 - RNA, 19 nt, Human
aaaaaaggcaagcagauaa

SEQ ID NO: 368736 - RNA, 19 nt, Human
aaaagaaauagaaauacca

SEQ ID NO: 368737 - RNA, 21 nt, Human
aaaagagaacacgaaaaauau

SEQ ID NO: 368738 - RNA, 18 nt, Human
aaaaggcaagcagauaaa

SEQ ID NO: 368739 - RNA, 20 nt, Human
aaaaggccaggggagacagu

SEQ ID NO: 368740 - RNA, 24 nt, Human
aaagagaacacgaaaaauauuccu

SEQ ID NO: 368741 - RNA, 20 nt, Human
aaagggggaggaaggagaga

SEQ ID NO: 368742 - RNA, 22 nt, Human
aaccuuacauuaaaaaaaaucc

SEQ ID NO: 368743 - RNA, 19 nt, Human
aacuuuacaaaaaaauaau

SEQ ID NO: 368744 - RNA, 21 nt, Human
aagacagcaugacacugagac

SEQ ID NO: 368745 - RNA, 25 nt, Human
aagcauccccuuggauuuugggucc

SEQ ID NO: 368746 - RNA, 22 nt, Human
aagccaaggcccagagaggaga

SEQ ID NO: 368747 - RNA, 20 nt, Human
aagcugggcggggaagcugg

SEQ ID NO: 368748 - RNA, 19 nt, Human
aagcuuuggcaccauguug

SEQ ID NO: 368749 - RNA, 21 nt, Human
aaggaggggaggaaguuggag

SEQ ID NO: 368750 - RNA, 20 nt, Human
aaggucagaggcugccagcc

SEQ ID NO: 368751 - RNA, 24 nt, Human
acaaaucucuaaaaccuacaccaa

SEQ ID NO: 368752 - RNA, 22 nt, Human
acaagaaaaguguugcuaaaaa

SEQ ID NO: 368753 - RNA, 26 nt, Human
acaccaaaguccuaccacugccugac

SEQ ID NO: 368754 - RNA, 23 nt, Human
acacuuucuggucacucgcguuu

SEQ ID NO: 368755 - RNA, 18 nt, Human
acaucaaaagaaaaaaac

SEQ ID NO: 368756 - RNA, 30 nt, Human
agaaauagaaauaccagcuucaaaaauauu

SEQ ID NO: 368757 - RNA, 21 nt, Human
agacaccauccaggccaggaa

SEQ ID NO: 368758 - RNA, 20 nt, Human
agacagaauucggggugggg

SEQ ID NO: 368759 - RNA, 21 nt, Human
agaggcuguucuucuccuugg

SEQ ID NO: 368760 - RNA, 18 nt, Human
aggauaaaagggggagga

SEQ ID NO: 368761 - RNA, 21 nt, Human
aggauaaaagggggaggaagg

SEQ ID NO: 368762 - RNA, 23 nt, Human
aggcaagcagauaaaagagaaca

SEQ ID NO: 368763 - RNA, 28 nt, Human
aggcaagcagauaaaagagaagggaccc

SEQ ID NO: 368764 - RNA, 18 nt, Human
aggcaggggcagggcugg

SEQ ID NO: 368765 - RNA, 19 nt, Human
aggcaggggcagggcuggg

SEQ ID NO: 368766 - RNA, 20 nt, Human
aggcaggggcagggcugggu

SEQ ID NO: 368767 - RNA, 23 nt, Human
aggcugccagccacagaggaggg

SEQ ID NO: 368768 - RNA, 21 nt, Human
agggaagcauccccuuggauu

SEQ ID NO: 368769 - RNA, 19 nt, Human
agggaugugucuucagaaa

SEQ ID NO: 368770 - RNA, 19 nt, Human
aggggccaaccccagccug

SEQ ID NO: 368771 - RNA, 19 nt, Human
agggggaggaaggagagag

SEQ ID NO: 368772 - RNA, 21 nt, Human
agugcagcaggaguggcuggg

SEQ ID NO: 368773 - RNA, 21 nt, Human
aguggcugcagggauagcagg

SEQ ID NO: 368774 - RNA, 23 nt, Human
aguggcugcagggauagcagggg

SEQ ID NO: 368775 - RNA, 27 nt, Human
aguguugcuaaaaaaaaaaaaaaaaaa

SEQ ID NO: 368776 - RNA, 22 nt, Human
aguuggaggaaugagaaaagag

SEQ ID NO: 368777 - RNA, 19 nt, Human
auaaaacaggagacugccu

SEQ ID NO: 368778 - RNA, 23 nt, Human
augauggggaggggcaggaaaga

SEQ ID NO: 368779 - RNA, 26 nt, Human
augcaggaggcaggggcagggcuggg

SEQ ID NO: 368780 - RNA, 24 nt, Human
auggggacagaauugcuugagccu

SEQ ID NO: 368781 - RNA, 19 nt, Human
auugggagagagcuuugaa

SEQ ID NO: 368782 - RNA, 23 nt, Human
caaaacaaccuuacauuaaaaaa

SEQ ID NO: 368783 - RNA, 21 nt, Human
caaaagaaaaaaaccucucca

SEQ ID NO: 368784 - RNA, 23 nt, Human
caaaagcugccucccuuucuaaa

SEQ ID NO: 368785 - RNA, 20 nt, Human
caaaucucuaaaaccuacac

SEQ ID NO: 368786 - RNA, 19 nt, Human
caacucagaccaaacuugg

SEQ ID NO: 368787 - RNA, 21 nt, Human
caacucagaccaaacuuggca

SEQ ID NO: 368788 - RNA, 22 nt, Human
caagcagauaaaagagaacaac

SEQ ID NO: 368789 - RNA, 21 nt, Human
caagcugggcggggaagcugg

SEQ ID NO: 368790 - RNA, 24 nt, Human
caaugcucuccucagucucccagg

SEQ ID NO: 368791 - RNA, 21 nt, Human
caauuucucaccacccacacc

SEQ ID NO: 368792 - RNA, 26 nt, Human
cacaacucagaccaaacuuggcaucu

SEQ ID NO: 368793 - RNA, 20 nt, Human
cacagccggccccaucccuc

SEQ ID NO: 368794 - RNA, 19 nt, Human
caccacccacaccaaaguc

SEQ ID NO: 368795 - RNA, 23 nt, Human
cacccacaccaaaguccuaccac

SEQ ID NO: 368796 - RNA, 21 nt, Human
cagagugggcgcccugcugcc

SEQ ID NO: 368797 - RNA, 18 nt, Human
cagcuccuggccucuccu

SEQ ID NO: 368798 - RNA, 22 nt, Human
caggaggcaggggcagggcugg

SEQ ID NO: 368799 - RNA, 20 nt, Human
caggggcagggcuggguuuc

SEQ ID NO: 368800 - RNA, 23 nt, Human
caggggccaaccccagccugccg

SEQ ID NO: 368801 - RNA, 21 nt, Human
ccaaaaaguaaggcaucaacu

SEQ ID NO: 368802 - RNA, 23 nt, Human
ccaaaguccuaccacugccugac

SEQ ID NO: 368803 - RNA, 23 nt, Human
ccacaaaacaaaucucuaaaacc

SEQ ID NO: 368804 - RNA, 24 nt, Human
ccacagcaaacuccauagccuucc

SEQ ID NO: 368805 - RNA, 22 nt, Human
ccagccugccgggcaucuacuc

SEQ ID NO: 368806 - RNA, 18 nt, Human
ccaggccaggaagggcuc

SEQ ID NO: 368807 - RNA, 20 nt, Human
ccaggccaggaagggcuccu

SEQ ID NO: 368808 - RNA, 19 nt, Human
ccaguuuaagcagacagaa

SEQ ID NO: 368809 - RNA, 20 nt, Human
ccaucccccaaaacaaccuu

SEQ ID NO: 368810 - RNA, 19 nt, Human
cccaagccaaggcccagag

SEQ ID NO: 368811 - RNA, 19 nt, Human
cccacagcaaacuccauag

SEQ ID NO: 368812 - RNA, 25 nt, Human
cccacagcaaacuccauagggcccc

SEQ ID NO: 368813 - RNA, 19 nt, Human
ccccaagacagcaugacac

SEQ ID NO: 368814 - RNA, 23 nt, Human
ccccacaaugcagcuccuggccu

SEQ ID NO: 368815 - RNA, 19 nt, Human
ccccccacaaugcagcucc

SEQ ID NO: 368816 - RNA, 22 nt, Human
ccccuuggauuuugggucccug

SEQ ID NO: 368817 - RNA, 21 nt, Human
cccuccaggggccaaccccag

SEQ ID NO: 368818 - RNA, 18 nt, Human
cccuggcuggggugggug

SEQ ID NO: 368819 - RNA, 18 nt, Human
cccuggggugagaggcug

SEQ ID NO: 368820 - RNA, 23 nt, Human
ccgaauucuggacagggagcccu

SEQ ID NO: 368821 - RNA, 23 nt, Human
ccuccaggggccaaccccagccu

SEQ ID NO: 368822 - RNA, 22 nt, Human
ccugccgggcaucuacucugaa

SEQ ID NO: 368823 - RNA, 23 nt, Human
ccugcugccacuacccuuucacc

SEQ ID NO: 368824 - RNA, 24 nt, Human
ccuuguuuuccucuuuucgauccc

SEQ ID NO: 368825 - RNA, 19 nt, Human
cgggaccaaggcagggagg

SEQ ID NO: 368826 - RNA, 19 nt, Human
cuacccuuucacccugccc

SEQ ID NO: 368827 - RNA, 20 nt, Human
cuacccuuucacccugcccc

SEQ ID NO: 368828 - RNA, 19 nt, Human
cuaccuuaaaaaucagaag

SEQ ID NO: 368829 - RNA, 20 nt, Human
cuauggguuucuuuucccuu

SEQ ID NO: 368830 - RNA, 21 nt, Human
cucaaaagcugccucccuuuc

SEQ ID NO: 368831 - RNA, 20 nt, Human
cuccccucuccuccagcagc

SEQ ID NO: 368832 - RNA, 19 nt, Human
cucccugggagggaaggca

SEQ ID NO: 368833 - RNA, 21 nt, Human
cucuaaaaaaggcaagcagau

SEQ ID NO: 368834 - RNA, 27 nt, Human
cucuaaaaccuacaccaaacgaaagaa

SEQ ID NO: 368835 - RNA, 23 nt, Human
cucugaucucaggccugaagggc

SEQ ID NO: 368836 - RNA, 21 nt, Human
cucuucuuucucgcuggucuu

SEQ ID NO: 368837 - RNA, 24 nt, Human
cugccugacaaaagcagagagagg

SEQ ID NO: 368838 - RNA, 18 nt, Human
cugcuccuuccugcggcg

SEQ ID NO: 368839 - RNA, 18 nt, Human
cugcuccuuccugcggcg

SEQ ID NO: 368840 - RNA, 18 nt, Human
cuggcuuggggguggaga

SEQ ID NO: 368841 - RNA, 24 nt, Human
cuuagugcagcaggaguggcuggg

SEQ ID NO: 368842 - RNA, 22 nt, Human
cuucagaaaccaggaugguucu

SEQ ID NO: 368843 - RNA, 23 nt, Human
cuucucaguaggauugcaaccuc

SEQ ID NO: 368844 - RNA, 22 nt, Human
cuuggcaucuccccucuccucc

SEQ ID NO: 368845 - RNA, 21 nt, Human
cuuggggguggagaggcuguu

SEQ ID NO: 368846 - RNA, 18 nt, Human
cuuuaccuccccuuaguu

SEQ ID NO: 368847 - RNA, 21 nt, Human
gaaaaacaaacugugaaccug

SEQ ID NO: 368848 - RNA, 19 nt, Human
gaaaggucagaggcugcca

SEQ ID NO: 368849 - RNA, 18 nt, Human
gacugccuuuaccucccc

SEQ ID NO: 368850 - RNA, 20 nt, Human
gagcagcuucgucauuagga

SEQ ID NO: 368851 - RNA, 22 nt, Human
gcagcugaggguguggcccgga

SEQ ID NO: 368852 - RNA, 24 nt, Human
gcagggcaccuuggcaucuccccu

SEQ ID NO: 368853 - RNA, 25 nt, Human
gcagggcaccuuggcaucuccccuc

SEQ ID NO: 368854 - RNA, 20 nt, Human
gcccacagcaaacuccauag

SEQ ID NO: 368855 - RNA, 21 nt, Human
gcuccuggccucuccucucug

SEQ ID NO: 368856 - RNA, 20 nt, Human
gcugugugcgggugugcugg

SEQ ID NO: 368857 - RNA, 19 nt, Human
ggaaagcacccuuccuccc

SEQ ID NO: 368858 - RNA, 19 nt, Human
ggaggaaguuggaggaaug

SEQ ID NO: 368859 - RNA, 24 nt, Human
ggaugugucuucagaaaccaggau

SEQ ID NO: 368860 - RNA, 19 nt, Human
ggauuucccuucaccucuc

SEQ ID NO: 368861 - RNA, 21 nt, Human
ggcaagcugggcggggaagcu

SEQ ID NO: 368862 - RNA, 23 nt, Human
ggcccacagcaaacuccauagcc

SEQ ID NO: 368863 - RNA, 19 nt, Human
ggcccggagggagguccug

SEQ ID NO: 368864 - RNA, 21 nt, Human
gggaggaaguuggaggaauga

SEQ ID NO: 368865 - RNA, 20 nt, Human
gggaggggcaggaaagaggg

SEQ ID NO: 368866 - RNA, 21 nt, Human
gggcgguggugcuggcugugu

SEQ ID NO: 368867 - RNA, 21 nt, Human
gggugagaggcugguucuuug

SEQ ID NO: 368868 - RNA, 19 nt, Human
ggucuugggucucuccagc

SEQ ID NO: 368869 - RNA, 22 nt, Human
gguguggcccggagggaggucc

SEQ ID NO: 368870 - RNA, 22 nt, Human
guaaggcaucaacuuuacaaaa

SEQ ID NO: 368871 - RNA, 22 nt, Human
guacuuucuucucuucuagaaa

SEQ ID NO: 368872 - RNA, 18 nt, Human
guccucuucuuucucgcu

SEQ ID NO: 368873 - RNA, 21 nt, Human
guccuuagcucugggaguugg

SEQ ID NO: 368874 - RNA, 21 nt, Human
guucuaacuccaucccccaaa

SEQ ID NO: 368875 - RNA, 23 nt, Human
uaaaaaaaauccaaaagaaauag

SEQ ID NO: 368876 - RNA, 27 nt, Human
uaaaagggggaggaaggagagaguagc

SEQ ID NO: 368877 - RNA, 23 nt, Human
uaaggcaucaacuuuacaaaaaa

SEQ ID NO: 368878 - RNA, 21 nt, Human
uaccacugccugacaaaagca

SEQ ID NO: 368879 - RNA, 20 nt, Human
uaccuggucccaagccaagg

SEQ ID NO: 368880 - RNA, 19 nt, Human
uacucugaaggggucacaa

SEQ ID NO: 368881 - RNA, 25 nt, Human
uaggaaaaaagagcaauccucaggu

SEQ ID NO: 368882 - RNA, 27 nt, Human
uaggauugcaaccucaaaagcugccuc

SEQ ID NO: 368883 - RNA, 20 nt, Human
uagggagggggaaagcaccc

SEQ ID NO: 368884 - RNA, 21 nt, Human
uauauugggagagagcuuuga

SEQ ID NO: 368885 - RNA, 18 nt, Human
ucaaaaauauuuauccaa

SEQ ID NO: 368886 - RNA, 24 nt, Human
ucaaaagaaaaaaaccucuccaca

SEQ ID NO: 368887 - RNA, 22 nt, Human
ucagaccaaacuuggcaucuca

SEQ ID NO: 368888 - RNA, 18 nt, Human
ucagccaaugcucuccuc

SEQ ID NO: 368889 - RNA, 21 nt, Human
uccaaaagaaauagaaauacc

SEQ ID NO: 368890 - RNA, 24 nt, Human
uccacaaaacaaaucucuaaaacc

SEQ ID NO: 368891 - RNA, 19 nt, Human
uccaggccaggaagggcuc

SEQ ID NO: 368892 - RNA, 20 nt, Human
uccccccacaaugcagcucc

SEQ ID NO: 368893 - RNA, 21 nt, Human
uccgccuuucccagguguccu

SEQ ID NO: 368894 - RNA, 19 nt, Human
uccucagucucccagggua

SEQ ID NO: 368895 - RNA, 25 nt, Human
uccuccagcagcugggagugugggc

SEQ ID NO: 368896 - RNA, 23 nt, Human
uccuugguccuuagcucugggag

SEQ ID NO: 368897 - RNA, 24 nt, Human
uccuuugaagcccagggaaagguc

SEQ ID NO: 368898 - RNA, 23 nt, Human
ucucaggccugaagggcuugggg

SEQ ID NO: 368899 - RNA, 23 nt, Human
ucuuuuaugaugaagacaaaagu

SEQ ID NO: 368900 - RNA, 23 nt, Human
ucuuuucccuuccccgucuucug

SEQ ID NO: 368901 - RNA, 23 nt, Human
ugaaggaggggaggaaguuggag

SEQ ID NO: 368902 - RNA, 24 nt, Human
ugaaggaggggaggaaguuggagg

SEQ ID NO: 368903 - RNA, 26 nt, Human
ugaaggaggggaggaaguuggaggaa

SEQ ID NO: 368904 - RNA, 18 nt, Human
ugaaggggccucccuggg

SEQ ID NO: 368905 - RNA, 24 nt, Human
ugacuuaaggcugaucuggcucug

SEQ ID NO: 368906 - RNA, 23 nt, Human
ugaggagaaccgaauucuggaca

SEQ ID NO: 368907 - RNA, 19 nt, Human
ugcacagccggccccaucc

SEQ ID NO: 368908 - RNA, 19 nt, Human
ugcaggaggcaggggcagg

SEQ ID NO: 368909 - RNA, 23 nt, Human
ugcaggaggcaggggcagggcug

SEQ ID NO: 368910 - RNA, 22 nt, Human
ugccuuuaccuccccuuaguuu

SEQ ID NO: 368911 - RNA, 18 nt, Human
uggaggaaugagaaaaga

SEQ ID NO: 368912 - RNA, 22 nt, Human
uggaguggggccugggacaugg

SEQ ID NO: 368913 - RNA, 23 nt, Human
uggcccggagggagguccugcag

SEQ ID NO: 368914 - RNA, 19 nt, Human
uggcugcagggauagcagg

SEQ ID NO: 368915 - RNA, 24 nt, Human
uggcugggaagguugcagggccca

SEQ ID NO: 368916 - RNA, 18 nt, Human
ugggaagguugcagggcc

SEQ ID NO: 368917 - RNA, 22 nt, Human
uggggaggggcaggaaagaggg

SEQ ID NO: 368918 - RNA, 21 nt, Human
ugggggagagaaucccgauuu

SEQ ID NO: 368919 - RNA, 20 nt, Human
uggggugggcaagcugggcg

SEQ ID NO: 368920 - RNA, 22 nt, Human
ugggugcagguaugauggggag

SEQ ID NO: 368921 - RNA, 24 nt, Human
ugggugcagguaugauggggaggg

SEQ ID NO: 368922 - RNA, 19 nt, Human
uggguuucuuuucccuucc

SEQ ID NO: 368923 - RNA, 19 nt, Human
ugguccccugacccuccag

SEQ ID NO: 368924 - RNA, 23 nt, Human
uggugcuggcugugugcgggugu

SEQ ID NO: 368925 - RNA, 21 nt, Human
ugugcugggaguggcugcagg

SEQ ID NO: 368926 - RNA, 23 nt, Human
uguguuggcgggaccaaggcagg

SEQ ID NO: 368927 - RNA, 23 nt, Human
uguugcuaaaaaaaaaaaaaaaa

SEQ ID NO: 368928 - RNA, 29 nt, Human
uuccugaagaggcagcugaggguguggcc

SEQ ID NO: 368929 - RNA, 18 nt, Human
uugaaggaggggaggaag

SEQ ID NO: 368930 - RNA, 19 nt, Human
uugcaaccucaaaagcugc

SEQ ID NO: 368931 - RNA, 21 nt, Human
uugcagggcccacagcaaacu

SEQ ID NO: 368932 - RNA, 21 nt, Human
uuggaggaaugagaaaagagg

SEQ ID NO: 368933 - RNA, 19 nt, Human
uugguccuuagcucuggga

SEQ ID NO: 368934 - RNA, 21 nt, Human
uuuacaauuucucaccaccca

SEQ ID NO: 368935 - RNA, 21 nt, Human
uuucccagguguccucuucuu

SEQ ID NO: 368936 - RNA, 22 nt, Human
uuuuccucuuuucgauccccgu

SEQ ID NO: 368937 - RNA, 25 nt, Human
aaaaaaaggaagaaauaaccacaaa

SEQ ID NO: 368938 - RNA, 24 nt, Human
aaaaggaagaaauaaccacaaaua

SEQ ID NO: 368939 - RNA, 18 nt, Human
aagaaaaaaaggaagaaa

SEQ ID NO: 368940 - RNA, 21 nt, Human
acccugcagagccggaggagc

SEQ ID NO: 368941 - RNA, 19 nt, Human
aggagggcgcacagcuaaa

SEQ ID NO: 368942 - RNA, 18 nt, Human
caagacgcaagugcaagc

SEQ ID NO: 368943 - RNA, 24 nt, Human
cagcagcagcagacaagacgcaag

SEQ ID NO: 368944 - RNA, 22 nt, Human
cggccuggacuaggggagcugg

SEQ ID NO: 368945 - RNA, 24 nt, Human
gagccggaggagcugcggcccagc

SEQ ID NO: 368946 - RNA, 21 nt, Human
gcccagcugaccgcccgugcc

SEQ ID NO: 368947 - RNA, 18 nt, Human
ucagcagcagcagacaag

SEQ ID NO: 368948 - RNA, 24 nt, Human
ucagcagcagcagacaagacgcaa

SEQ ID NO: 368949 - RNA, 19 nt, Human
ugacccugcagagccggag

SEQ ID NO: 368950 - RNA, 21 nt, Human
ugacuuggcuacaagagacgg

SEQ ID NO: 368951 - RNA, 24 nt, Human
uggcuuacuuaccuuccuccguga

SEQ ID NO: 368952 - RNA, 20 nt, Human
uucagcagcagcagacaaga

SEQ ID NO: 368953 - RNA, 18 nt, Human
aaagauggcccugccucc

SEQ ID NO: 368954 - RNA, 23 nt, Human
caugacaaaugucaguuuccucu

SEQ ID NO: 368955 - RNA, 24 nt, Human
cauuauacauaauuuuuauguaua

SEQ ID NO: 368956 - RNA, 25 nt, Human
ccuccaugccuuguugaacaugaug

SEQ ID NO: 368957 - RNA, 22 nt, Human
cucuccacaaguguccucaaaa

SEQ ID NO: 368958 - RNA, 20 nt, Human
gggaggugaugguuuuuuac

SEQ ID NO: 368959 - RNA, 24 nt, Human
guaagugaacaugacaaaugucag

SEQ ID NO: 368960 - RNA, 24 nt, Human
uacauaauuuuuauguauauauau

SEQ ID NO: 368961 - RNA, 18 nt, Human
uauauauauguauauaua

SEQ ID NO: 368962 - RNA, 18 nt, Human
uauauauguauauauaua

SEQ ID NO: 368963 - RNA, 19 nt, Human
uauauguauauauauaaau

SEQ ID NO: 368964 - RNA, 20 nt, Human
uauguauauauauguauaua

SEQ ID NO: 368965 - RNA, 22 nt, Human
uauguauauauauguauauaua

SEQ ID NO: 368966 - RNA, 18 nt, Human
uguauauauauguauaua

SEQ ID NO: 368967 - RNA, 19 nt, Human
uguauauauauguauauau

SEQ ID NO: 368968 - RNA, 22 nt, Human
uguauauauauguauauauaua

SEQ ID NO: 368969 - RNA, 24 nt, Human
aaagagacagcgacugaugaugag

SEQ ID NO: 368970 - RNA, 20 nt, Human
aaaguuauggggguaguugg

SEQ ID NO: 368971 - RNA, 24 nt, Human
aacaggacgauagaaugcugaaaa

SEQ ID NO: 368972 - RNA, 24 nt, Human
aagacaugcacccucccgcguccc

SEQ ID NO: 368973 - RNA, 19 nt, Human
aagggcugggagcugagac

SEQ ID NO: 368974 - RNA, 25 nt, Human
acaacaggacgauagaaugcugaaa

SEQ ID NO: 368975 - RNA, 22 nt, Human
acccacccgcuccuccccgccg

SEQ ID NO: 368976 - RNA, 24 nt, Human
accugugggaagcagaaaguuaug

SEQ ID NO: 368977 - RNA, 19 nt, Human
agaaaagagacagcgacug

SEQ ID NO: 368978 - RNA, 23 nt, Human
agaaaucacagaaaagagacagc

SEQ ID NO: 368979 - RNA, 20 nt, Human
agaacaggggcaaucaaagc

SEQ ID NO: 368980 - RNA, 22 nt, Human
agacaugcacccucccgcgucc

SEQ ID NO: 368981 - RNA, 24 nt, Human
agaccaggguccaagagcaggugc

SEQ ID NO: 368982 - RNA, 21 nt, Human
agaggaagagggaaggcugag

SEQ ID NO: 368983 - RNA, 21 nt, Human
agagggaaggcugagcuacug

SEQ ID NO: 368984 - RNA, 18 nt, Human
agaucccuuggcccaguc

SEQ ID NO: 368985 - RNA, 18 nt, Human
agccaggggagggggcgg

SEQ ID NO: 368986 - RNA, 21 nt, Human
aggaagagggaaggcugagcu

SEQ ID NO: 368987 - RNA, 22 nt, Human
aggagaccaggguccaagagca

SEQ ID NO: 368988 - RNA, 21 nt, Human
aggccuccaaaguuaaaaaug

SEQ ID NO: 368989 - RNA, 24 nt, Human
agggaaggcugagcuacuggggac

SEQ ID NO: 368990 - RNA, 22 nt, Human
aggggcaaucaaagccagggga

SEQ ID NO: 368991 - RNA, 25 nt, Human
agucccauccccccacccaucccca

SEQ ID NO: 368992 - RNA, 22 nt, Human
augagcugggggagagaagggu

SEQ ID NO: 368993 - RNA, 21 nt, Human
caaacuucuccccucgucucc

SEQ ID NO: 368994 - RNA, 21 nt, Human
cacaagccccucccuccaagg

SEQ ID NO: 368995 - RNA, 20 nt, Human
cacuauauacacacacaagc

SEQ ID NO: 368996 - RNA, 21 nt, Human
cacuauauacacacacaagcc

SEQ ID NO: 368997 - RNA, 21 nt, Human
cacugcccaaauguguccuuu

SEQ ID NO: 368998 - RNA, 18 nt, Human
cagaaaagagacagcgac

SEQ ID NO: 368999 - RNA, 22 nt, Human
cagcauuugcuggcuuguagca

SEQ ID NO: 369000 - RNA, 24 nt, Human
cagcauuugcuggcuuguagcauu

SEQ ID NO: 369001 - RNA, 22 nt, Human
caggacgauagaaugcugaaaa

SEQ ID NO: 369002 - RNA, 20 nt, Human
caggggagaucaacuggacu

SEQ ID NO: 369003 - RNA, 20 nt, Human
caugcacccucccgcguccc

SEQ ID NO: 369004 - RNA, 20 nt, Human
ccaaaguuaaaaaugcccac

SEQ ID NO: 369005 - RNA, 21 nt, Human
cccacccagaucccuuggccc

SEQ ID NO: 369006 - RNA, 19 nt, Human
cccacccgcuccuccccgc

SEQ ID NO: 369007 - RNA, 23 nt, Human
cccacccgcuccuccccgccggg

SEQ ID NO: 369008 - RNA, 19 nt, Human
cccagucccauccccccac

SEQ ID NO: 369009 - RNA, 22 nt, Human
cccauccccccacccaucccca

SEQ ID NO: 369010 - RNA, 21 nt, Human
ccccacccauccccacccccc

SEQ ID NO: 369011 - RNA, 22 nt, Human
ccccacccauccccacccccca

SEQ ID NO: 369012 - RNA, 18 nt, Human
ccccccacccauccccac

SEQ ID NO: 369013 - RNA, 20 nt, Human
ccccccacccauccccaccc

SEQ ID NO: 369014 - RNA, 19 nt, Human
ccccccaucaggcagagau

SEQ ID NO: 369015 - RNA, 24 nt, Human
ccccccaucaggcagagauguggc

SEQ ID NO: 369016 - RNA, 23 nt, Human
cccccucccccaaacacacuaua

SEQ ID NO: 369017 - RNA, 19 nt, Human
ccccucgucuccgagccug

SEQ ID NO: 369018 - RNA, 24 nt, Human
cccgcguccccccucccccaaaca

SEQ ID NO: 369019 - RNA, 22 nt, Human
cccucgucuccgagccuggaga

SEQ ID NO: 369020 - RNA, 20 nt, Human
cccuggggaggggacugggg

SEQ ID NO: 369021 - RNA, 23 nt, Human
ccucccgcguccccccuccccca

SEQ ID NO: 369022 - RNA, 24 nt, Human
ccucccgcguccccccucccccaa

SEQ ID NO: 369023 - RNA, 18 nt, Human
ccucugggacccucgguc

SEQ ID NO: 369024 - RNA, 19 nt, Human
ccucuucgaggguccugcc

SEQ ID NO: 369025 - RNA, 23 nt, Human
ccugcggcuacagccuggagcag

SEQ ID NO: 369026 - RNA, 28 nt, Human
ccuugcgcgcacacccacccgcuccucc

SEQ ID NO: 369027 - RNA, 23 nt, Human
cgagucccaggagaggaggccga

SEQ ID NO: 369028 - RNA, 18 nt, Human
cgccggggcugagcggag

SEQ ID NO: 369029 - RNA, 20 nt, Human
cgccggggcugagcggagcu

SEQ ID NO: 369030 - RNA, 23 nt, Human
cggagaagggaggccgaguccca

SEQ ID NO: 369031 - RNA, 20 nt, Human
cucaaaaguugucugucacc

SEQ ID NO: 369032 - RNA, 19 nt, Human
cuccccaaagcugguucuc

SEQ ID NO: 369033 - RNA, 24 nt, Human
cugaaaccccaaacuucuccccuc

SEQ ID NO: 369034 - RNA, 18 nt, Human
cugcugcccucucaaaag

SEQ ID NO: 369035 - RNA, 20 nt, Human
cuggagcagguccccccagc

SEQ ID NO: 369036 - RNA, 24 nt, Human
cuggagcagguccccccagcgcug

SEQ ID NO: 369037 - RNA, 22 nt, Human
cuggcacugagggcaaaaggaa

SEQ ID NO: 369038 - RNA, 23 nt, Human
cuggcaguggugggcgacuccgc

SEQ ID NO: 369039 - RNA, 18 nt, Human
cuuguagcauugguccuc

SEQ ID NO: 369040 - RNA, 23 nt, Human
gaccaggguccaagagcaggugc

SEQ ID NO: 369041 - RNA, 22 nt, Human
gagaagggaggccgagucccag

SEQ ID NO: 369042 - RNA, 23 nt, Human
gagggucccccagggaggguggg

SEQ ID NO: 369043 - RNA, 22 nt, Human
gaggguccugcccggauuggcu

SEQ ID NO: 369044 - RNA, 20 nt, Human
gaguguccucccaagaaccc

SEQ ID NO: 369045 - RNA, 20 nt, Human
gaguuggggucaccgcaggg

SEQ ID NO: 369046 - RNA, 20 nt, Human
gaguuggggucaccgcaggg

SEQ ID NO: 369047 - RNA, 18 nt, Human
gccggggcugagcggagc

SEQ ID NO: 369048 - RNA, 18 nt, Human
gcuacagccuggagcagg

SEQ ID NO: 369049 - RNA, 23 nt, Human
ggacugggguggaaauuucccca

SEQ ID NO: 369050 - RNA, 18 nt, Human
ggauuggaaggaacggug

SEQ ID NO: 369051 - RNA, 20 nt, Human
ggcacugagggcaaaaggaa

SEQ ID NO: 369052 - RNA, 23 nt, Human
ggcuaagcccugggacugaaacc

SEQ ID NO: 369053 - RNA, 21 nt, Human
gggaagcagaaaguuaugggg

SEQ ID NO: 369054 - RNA, 20 nt, Human
gggaggcucccgagaggaag

SEQ ID NO: 369055 - RNA, 18 nt, Human
ggggaagggagacuuugg

SEQ ID NO: 369056 - RNA, 19 nt, Human
ggggaggggacuggggugg

SEQ ID NO: 369057 - RNA, 20 nt, Human
ggggucaccgcaggggagga

SEQ ID NO: 369058 - RNA, 20 nt, Human
ggggugaagugggggggggg

SEQ ID NO: 369059 - RNA, 21 nt, Human
ggggugguucccuggggaggg

SEQ ID NO: 369060 - RNA, 19 nt, Human
gggugaagugggggggggg

SEQ ID NO: 369061 - RNA, 20 nt, Human
ggguggugggguccugcggc

SEQ ID NO: 369062 - RNA, 20 nt, Human
gguccugcccggauuggcug

SEQ ID NO: 369063 - RNA, 24 nt, Human
gguucugaggcucugggggagagc

SEQ ID NO: 369064 - RNA, 22 nt, Human
gucccauccccccacccauccc

SEQ ID NO: 369065 - RNA, 19 nt, Human
gucccccagggaggguggg

SEQ ID NO: 369066 - RNA, 23 nt, Human
uacacacacaagccccucccucc

SEQ ID NO: 369067 - RNA, 22 nt, Human
uacagccuggagcagguccccc

SEQ ID NO: 369068 - RNA, 19 nt, Human
uagaaugcugaaaaccugu

SEQ ID NO: 369069 - RNA, 25 nt, Human
uauggggguaguugggucauccuag

SEQ ID NO: 369070 - RNA, 19 nt, Human
ucauggcugagggagucug

SEQ ID NO: 369071 - RNA, 19 nt, Human
uccaaaguuaaaaaugccc

SEQ ID NO: 369072 - RNA, 21 nt, Human
ucccauccccccacccauccc

SEQ ID NO: 369073 - RNA, 25 nt, Human
uccccaggauauagacggucaccaa

SEQ ID NO: 369074 - RNA, 23 nt, Human
uccccccucccccaaacacacua

SEQ ID NO: 369075 - RNA, 19 nt, Human
ucccugagggcugggggga

SEQ ID NO: 369076 - RNA, 20 nt, Human
ucccuggggaggggacuggg

SEQ ID NO: 369077 - RNA, 19 nt, Human
uccuccggcuaagcccugg

SEQ ID NO: 369078 - RNA, 26 nt, Human
ucucauggcugagggagucugcugcc

SEQ ID NO: 369079 - RNA, 18 nt, Human
ucuggggggaaaaggaga

SEQ ID NO: 369080 - RNA, 23 nt, Human
ugagacggccucugacagccucc

SEQ ID NO: 369081 - RNA, 24 nt, Human
ugagggcuggggggaagggcuggg

SEQ ID NO: 369082 - RNA, 20 nt, Human
ugauucccggccuccucccc

SEQ ID NO: 369083 - RNA, 20 nt, Human
ugcagccgagucccuagccc

SEQ ID NO: 369084 - RNA, 19 nt, Human
uggaaggaacggugugcgg

SEQ ID NO: 369085 - RNA, 24 nt, Human
uggagggauuggaaggaacggugu

SEQ ID NO: 369086 - RNA, 18 nt, Human
uggcuggcacugagggca

SEQ ID NO: 369087 - RNA, 18 nt, Human
ugggggagagaaggguag

SEQ ID NO: 369088 - RNA, 21 nt, Human
ugggggcaaagccaggcuggg

SEQ ID NO: 369089 - RNA, 21 nt, Human
uggggggggggucacuagggg

SEQ ID NO: 369090 - RNA, 18 nt, Human
ugggggugguucccuggg

SEQ ID NO: 369091 - RNA, 22 nt, Human
uggggugaaguggggggggggu

SEQ ID NO: 369092 - RNA, 19 nt, Human
ugucugaaguugcagguuc

SEQ ID NO: 369093 - RNA, 18 nt, Human
uucccggccuccucccca

SEQ ID NO: 369094 - RNA, 24 nt, Human
uugcgcgcacacccacccgcuccu

SEQ ID NO: 369095 - RNA, 21 nt, Human
uuggcuggcacugagggcaaa

SEQ ID NO: 369096 - RNA, 19 nt, Human
uuucccaagacaugcaccc

SEQ ID NO: 369097 - RNA, 18 nt, Human
aaacuuaaaaaggcagca

SEQ ID NO: 369098 - RNA, 21 nt, Human
aaaggcagcacauucuggagc

SEQ ID NO: 369099 - RNA, 22 nt, Human
aaaguggggaaagggggcaagg

SEQ ID NO: 369100 - RNA, 18 nt, Human
aaccaccccugcuccagg

SEQ ID NO: 369101 - RNA, 20 nt, Human
aaggacccaggaacgaccac

SEQ ID NO: 369102 - RNA, 25 nt, Human
aaggacccaggaacgaccacgaaag

SEQ ID NO: 369103 - RNA, 22 nt, Human
acaaacaaaacuuaaaaaggca

SEQ ID NO: 369104 - RNA, 23 nt, Human
acaauccugggggagugccccag

SEQ ID NO: 369105 - RNA, 26 nt, Human
accuuacccaaaugagaguaaaaccg

SEQ ID NO: 369106 - RNA, 23 nt, Human
acuauugcacaauccugggggag

SEQ ID NO: 369107 - RNA, 21 nt, Human
acuccaaaguggggaaagggg

SEQ ID NO: 369108 - RNA, 22 nt, Human
acucuugauuaggagugggagu

SEQ ID NO: 369109 - RNA, 19 nt, Human
acugagcccuagggauaga

SEQ ID NO: 369110 - RNA, 22 nt, Human
agagaggggcagggguccaggc

SEQ ID NO: 369111 - RNA, 21 nt, Human
agagcuggcaggaggagugug

SEQ ID NO: 369112 - RNA, 20 nt, Human
agaggaaggggcaggauagg

SEQ ID NO: 369113 - RNA, 22 nt, Human
agaggaggauggacagaugggc

SEQ ID NO: 369114 - RNA, 19 nt, Human
agcagcugcgguggcuugg

SEQ ID NO: 369115 - RNA, 19 nt, Human
agccaugugccugguaccc

SEQ ID NO: 369116 - RNA, 23 nt, Human
agccugagcuaaaggaaggggac

SEQ ID NO: 369117 - RNA, 25 nt, Human
agcugugcuggggugggggcugugg

SEQ ID NO: 369118 - RNA, 18 nt, Human
aggaaggcugggaccuuu

SEQ ID NO: 369119 - RNA, 22 nt, Human
aggagaccaaaaggucuggaac

SEQ ID NO: 369120 - RNA, 21 nt, Human
aggagagagggggcugggagc

SEQ ID NO: 369121 - RNA, 25 nt, Human
aggagcugugcuggggugggggcug

SEQ ID NO: 369122 - RNA, 21 nt, Human
aggaggaggaugaggcagagg

SEQ ID NO: 369123 - RNA, 18 nt, Human
aggaggauggacagaugg

SEQ ID NO: 369124 - RNA, 23 nt, Human
aggagugugugugggcaaagguc

SEQ ID NO: 369125 - RNA, 21 nt, Human
aggcagagacacucagagaug

SEQ ID NO: 369126 - RNA, 19 nt, Human
aggcagagagacguggggg

SEQ ID NO: 369127 - RNA, 21 nt, Human
aggcagcagaguggcagcagc

SEQ ID NO: 369128 - RNA, 18 nt, Human
aggcagcucuggugggga

SEQ ID NO: 369129 - RNA, 21 nt, Human
aggcagggugugguacacaca

SEQ ID NO: 369130 - RNA, 18 nt, Human
aggccagcaggacuggag

SEQ ID NO: 369131 - RNA, 24 nt, Human
aggccagcaggacuggaggucagg

SEQ ID NO: 369132 - RNA, 19 nt, Human
aggcccaagagcuaggcag

SEQ ID NO: 369133 - RNA, 20 nt, Human
aggcgcugccugcuggcccu

SEQ ID NO: 369134 - RNA, 20 nt, Human
aguccuuccccuagcagcuu

SEQ ID NO: 369135 - RNA, 19 nt, Human
agugcaaaggaaaggaaga

SEQ ID NO: 369136 - RNA, 23 nt, Human
aguuucuucuguacaggcagcag

SEQ ID NO: 369137 - RNA, 18 nt, Human
caaacagcacuugcaugg

SEQ ID NO: 369138 - RNA, 22 nt, Human
caauccaccagccccaggggac

SEQ ID NO: 369139 - RNA, 21 nt, Human
caauuuucuggggguggaggg

SEQ ID NO: 369140 - RNA, 18 nt, Human
cacagcugagccagagac

SEQ ID NO: 369141 - RNA, 21 nt, Human
caccccugcuccaggcagaga

SEQ ID NO: 369142 - RNA, 22 nt, Human
cagagagacgugggggaggggu

SEQ ID NO: 369143 - RNA, 26 nt, Human
cagaguggcagcagcugcgguggcuu

SEQ ID NO: 369144 - RNA, 20 nt, Human
cagcagcugcgguggcuugg

SEQ ID NO: 369145 - RNA, 21 nt, Human
caggaagggcaaggggagccc

SEQ ID NO: 369146 - RNA, 18 nt, Human
caggcacagaugaggaag

SEQ ID NO: 369147 - RNA, 23 nt, Human
caggcccaagagcuaggcaggug

SEQ ID NO: 369148 - RNA, 19 nt, Human
cauggcccaguccccugca

SEQ ID NO: 369149 - RNA, 19 nt, Human
ccacaaugggcuccacagc

SEQ ID NO: 369150 - RNA, 18 nt, Human
ccacccagagaggggcag

SEQ ID NO: 369151 - RNA, 19 nt, Human
ccagccccagcaguucugc

SEQ ID NO: 369152 - RNA, 20 nt, Human
ccagccccagcaguucugcc

SEQ ID NO: 369153 - RNA, 23 nt, Human
cccaggcugagaaggagugaaac

SEQ ID NO: 369154 - RNA, 22 nt, Human
cccagugguccccgugggagca

SEQ ID NO: 369155 - RNA, 26 nt, Human
ccccaccgccuccacaaugggcucca

SEQ ID NO: 369156 - RNA, 18 nt, Human
ccccagcagccccugcuc

SEQ ID NO: 369157 - RNA, 19 nt, Human
ccccagcagccccugcucu

SEQ ID NO: 369158 - RNA, 19 nt, Human
ccccugaggggcccagugg

SEQ ID NO: 369159 - RNA, 19 nt, Human
ccccugaggggcccagugg

SEQ ID NO: 369160 - RNA, 22 nt, Human
ccccugaggggcccaguggucc

SEQ ID NO: 369161 - RNA, 18 nt, Human
ccccugcuccaggcagag

SEQ ID NO: 369162 - RNA, 21 nt, Human
cccuagcagcuuccccugagg

SEQ ID NO: 369163 - RNA, 21 nt, Human
cccuagggauagaggaagggg

SEQ ID NO: 369164 - RNA, 20 nt, Human
ccggccucaccagccccagc

SEQ ID NO: 369165 - RNA, 20 nt, Human
ccuagcagcuuccccugagg

SEQ ID NO: 369166 - RNA, 21 nt, Human
ccugagcuaaaggaaggggac

SEQ ID NO: 369167 - RNA, 22 nt, Human
ccugggggagugccccagggac

SEQ ID NO: 369168 - RNA, 23 nt, Human
cgaggacccauggcccagucccc

SEQ ID NO: 369169 - RNA, 20 nt, Human
cgaugucacccuugcauggg

SEQ ID NO: 369170 - RNA, 26 nt, Human
cucccccagccaugugccugguaccc

SEQ ID NO: 369171 - RNA, 18 nt, Human
cucccccccaccgccucc

SEQ ID NO: 369172 - RNA, 20 nt, Human
cuccgaggcccuaguccagg

SEQ ID NO: 369173 - RNA, 27 nt, Human
cuggagccacggccaguccuuccccua

SEQ ID NO: 369174 - RNA, 18 nt, Human
cuggggugggggcugugg

SEQ ID NO: 369175 - RNA, 22 nt, Human
cuuccugggugggaccacagcu

SEQ ID NO: 369176 - RNA, 19 nt, Human
gaaagggggcaaggaccca

SEQ ID NO: 369177 - RNA, 23 nt, Human
gagaggggcagggguccaggcgc

SEQ ID NO: 369178 - RNA, 25 nt, Human
gagccacggccaguccuuccccuag

SEQ ID NO: 369179 - RNA, 21 nt, Human
gagccagccucgaccuuaccc

SEQ ID NO: 369180 - RNA, 25 nt, Human
gaggagcugggacucugggcugugg

SEQ ID NO: 369181 - RNA, 23 nt, Human
gaggagcugugcugggguggggg

SEQ ID NO: 369182 - RNA, 19 nt, Human
gaggaggauggacagaugg

SEQ ID NO: 369183 - RNA, 23 nt, Human
gaggagggaguuagaggcagagc

SEQ ID NO: 369184 - RNA, 19 nt, Human
gagggguuggacagacagg

SEQ ID NO: 369185 - RNA, 23 nt, Human
gaguggcagcagcugcgguggga

SEQ ID NO: 369186 - RNA, 20 nt, Human
gagugugaggagggaguuag

SEQ ID NO: 369187 - RNA, 23 nt, Human
gcaaaaagggacacucugacuau

SEQ ID NO: 369188 - RNA, 20 nt, Human
gcagagcacuguucagccag

SEQ ID NO: 369189 - RNA, 20 nt, Human
gccaugcgguagggggaggg

SEQ ID NO: 369190 - RNA, 21 nt, Human
gccaugugccugguaccccug

SEQ ID NO: 369191 - RNA, 23 nt, Human
gcccaaacagcacuugcauggag

SEQ ID NO: 369192 - RNA, 19 nt, Human
gcccaggcugagaaggagu

SEQ ID NO: 369193 - RNA, 20 nt, Human
gcuggggugggggcuguggg

SEQ ID NO: 369194 - RNA, 19 nt, Human
gcuucuccacccagagagg

SEQ ID NO: 369195 - RNA, 18 nt, Human
ggaaguaagagcaggcca

SEQ ID NO: 369196 - RNA, 22 nt, Human
ggacagacaggcacagaugagg

SEQ ID NO: 369197 - RNA, 21 nt, Human
ggacuggaggucaggcccaag

SEQ ID NO: 369198 - RNA, 18 nt, Human
ggagagagggggcuggga

SEQ ID NO: 369199 - RNA, 23 nt, Human
ggagcccccagcagccccugcuc

SEQ ID NO: 369200 - RNA, 21 nt, Human
ggaggaggaugaggcagaggg

SEQ ID NO: 369201 - RNA, 18 nt, Human
ggcaggauagggauagug

SEQ ID NO: 369202 - RNA, 20 nt, Human
ggcugagaaggagugaaacc

SEQ ID NO: 369203 - RNA, 26 nt, Human
gggacacucugacuauugcacaaucc

SEQ ID NO: 369204 - RNA, 19 nt, Human
gggacaggggauccucagg

SEQ ID NO: 369205 - RNA, 23 nt, Human
gggacaggggauccucagggaag

SEQ ID NO: 369206 - RNA, 25 nt, Human
gggagccugagcuaaaggaagggga

SEQ ID NO: 369207 - RNA, 24 nt, Human
gggaggggcagggccaauccgggu

SEQ ID NO: 369208 - RNA, 23 nt, Human
gggcaaggggagcccccagcagc

SEQ ID NO: 369209 - RNA, 22 nt, Human
gggccaaacccaggguggggga

SEQ ID NO: 369210 - RNA, 19 nt, Human
ggggcagggccaauccggg

SEQ ID NO: 369211 - RNA, 18 nt, Human
ggggcccaggauucugcc

SEQ ID NO: 369212 - RNA, 21 nt, Human
ggucugaaugaggaggaggau

SEQ ID NO: 369213 - RNA, 20 nt, Human
ggugccaagaggccagcauc

SEQ ID NO: 369214 - RNA, 21 nt, Human
gucacccuugcauggugacuc

SEQ ID NO: 369215 - RNA, 21 nt, Human
guggagggaggcuggguuugc

SEQ ID NO: 369216 - RNA, 23 nt, Human
guggagggaggcuggguuugcaa

SEQ ID NO: 369217 - RNA, 21 nt, Human
gugugggcaaaggucucuggg

SEQ ID NO: 369218 - RNA, 18 nt, Human
uaaaggaaggggaccgaa

SEQ ID NO: 369219 - RNA, 22 nt, Human
uaaaggaaggggaccgaagggg

SEQ ID NO: 369220 - RNA, 23 nt, Human
uaaaggaagggguagggagccug

SEQ ID NO: 369221 - RNA, 20 nt, Human
uaagagcccagcaggcagag

SEQ ID NO: 369222 - RNA, 18 nt, Human
uaaggacagguugggugg

SEQ ID NO: 369223 - RNA, 19 nt, Human
uaauucuggagugugagga

SEQ ID NO: 369224 - RNA, 19 nt, Human
uagaaaccaccccugcucc

SEQ ID NO: 369225 - RNA, 23 nt, Human
uagcagcuuccccugaggggccc

SEQ ID NO: 369226 - RNA, 22 nt, Human
uaggagugugaacaaacaaaac

SEQ ID NO: 369227 - RNA, 24 nt, Human
ucagcaagugggaagagagacugg

SEQ ID NO: 369228 - RNA, 26 nt, Human
uccaaaguggggaaagggggcaagga

SEQ ID NO: 369229 - RNA, 23 nt, Human
uccacccagagaggggcaggggu

SEQ ID NO: 369230 - RNA, 22 nt, Human
uccaggcagagacacucagaga

SEQ ID NO: 369231 - RNA, 20 nt, Human
ucccccagccaugugccugg

SEQ ID NO: 369232 - RNA, 21 nt, Human
ucccccccaccgccuccacaa

SEQ ID NO: 369233 - RNA, 19 nt, Human
ucucugggggcccaggauu

SEQ ID NO: 369234 - RNA, 21 nt, Human
ucuugauuaggagugggaguu

SEQ ID NO: 369235 - RNA, 18 nt, Human
ugacugaggagcugggac

SEQ ID NO: 369236 - RNA, 22 nt, Human
ugagcuaaaggaaggggaccga

SEQ ID NO: 369237 - RNA, 21 nt, Human
ugaggaaagugacugaggagc

SEQ ID NO: 369238 - RNA, 19 nt, Human
ugaggagcugggacucugg

SEQ ID NO: 369239 - RNA, 23 nt, Human
ugaggagcugggacucugggcug

SEQ ID NO: 369240 - RNA, 20 nt, Human
ugaggcagagggaggagccu

SEQ ID NO: 369241 - RNA, 25 nt, Human
ugcaaaggaaaggaagaaggaaggg

SEQ ID NO: 369242 - RNA, 18 nt, Human
ugcccaaacagcacuugc

SEQ ID NO: 369243 - RNA, 24 nt, Human
ugccugguaccccugguuuguccc

SEQ ID NO: 369244 - RNA, 18 nt, Human
ugcucugguggaagaguc

SEQ ID NO: 369245 - RNA, 19 nt, Human
uggagaggaggauggacag

SEQ ID NO: 369246 - RNA, 24 nt, Human
ugggaaacugagcccuagggauag

SEQ ID NO: 369247 - RNA, 21 nt, Human
ugggagcacaguucgaaaagc

SEQ ID NO: 369248 - RNA, 25 nt, Human
ugggagcccaggcugagaaggagug

SEQ ID NO: 369249 - RNA, 22 nt, Human
ugggggaaguaagagcaggcca

SEQ ID NO: 369250 - RNA, 22 nt, Human
ugggggcccaggauucugccca

SEQ ID NO: 369251 - RNA, 18 nt, Human
uggucugaaugaggagga

SEQ ID NO: 369252 - RNA, 22 nt, Human
ugucacagucuucgagcaacag

SEQ ID NO: 369253 - RNA, 20 nt, Human
ugugcaaacaaucauauaua

SEQ ID NO: 369254 - RNA, 19 nt, Human
ugugcuggggugggggcug

SEQ ID NO: 369255 - RNA, 19 nt, Human
ugugggcuaaaggaagggg

SEQ ID NO: 369256 - RNA, 24 nt, Human
uucugcccaauccaccagccccag

SEQ ID NO: 369257 - RNA, 19 nt, Human
caaggggaccggcgguugg

SEQ ID NO: 369258 - RNA, 20 nt, Human
cacagagaguuuuacaugga

SEQ ID NO: 369259 - RNA, 23 nt, Human
uccguggcaugaaucugucgccc

SEQ ID NO: 369260 - RNA, 22 nt, Human
ugcaucagguuucagagugaca

SEQ ID NO: 369261 - RNA, 21 nt, Human
uuuauccguggcaugaaucug

SEQ ID NO: 369262 - RNA, 24 nt, Human
uuuuuuuuuuuuuucuucggauuu

SEQ ID NO: 369263 - RNA, 22 nt, Human
uuuuuuuuuuuuuuuucuucgg

SEQ ID NO: 369264 - RNA, 20 nt, Human
gcggcggcggcggugggcga

SEQ ID NO: 369265 - RNA, 25 nt, Human
aaaaaucauuugucaagaaagggga

SEQ ID NO: 369266 - RNA, 20 nt, Human
aaaggugggguggaaugcug

SEQ ID NO: 369267 - RNA, 19 nt, Human
acgggucagcggcgcgacu

SEQ ID NO: 369268 - RNA, 18 nt, Human
agaaggaaaaaggugggg

SEQ ID NO: 369269 - RNA, 21 nt, Human
agccaaacccuccccgugcug

SEQ ID NO: 369270 - RNA, 18 nt, Human
aggaaaaagguggggugg

SEQ ID NO: 369271 - RNA, 18 nt, Human
aggaaccagcugaauuuc

SEQ ID NO: 369272 - RNA, 18 nt, Human
aggaggagggaggcagag

SEQ ID NO: 369273 - RNA, 18 nt, Human
aggcagagucuccuuucu

SEQ ID NO: 369274 - RNA, 20 nt, Human
aggugggguggaaugcuggc

SEQ ID NO: 369275 - RNA, 22 nt, Human
aggugggguggaaugcuggcuc

SEQ ID NO: 369276 - RNA, 22 nt, Human
aguaauuggggagaaggaaaaa

SEQ ID NO: 369277 - RNA, 20 nt, Human
caaaaaucaaaugaaaacaa

SEQ ID NO: 369278 - RNA, 23 nt, Human
caaaaauuccucuagacucugca

SEQ ID NO: 369279 - RNA, 26 nt, Human
caaagggacacccgguaggaugaggc

SEQ ID NO: 369280 - RNA, 20 nt, Human
caagcaggugucccaggaac

SEQ ID NO: 369281 - RNA, 19 nt, Human
cacuggguggcagcagggc

SEQ ID NO: 369282 - RNA, 20 nt, Human
cccagcccuucuucccgucc

SEQ ID NO: 369283 - RNA, 27 nt, Human
ccuaaagucagggaagaaccggggucc

SEQ ID NO: 369284 - RNA, 18 nt, Human
ccuggcucagggaugggc

SEQ ID NO: 369285 - RNA, 23 nt, Human
cgaaccgggagcgcagcagagaa

SEQ ID NO: 369286 - RNA, 19 nt, Human
cugccacaggucucagggu

SEQ ID NO: 369287 - RNA, 18 nt, Human
cuuaacaaaaaucaaaug

SEQ ID NO: 369288 - RNA, 23 nt, Human
cuucccguccagcgaaccgggag

SEQ ID NO: 369289 - RNA, 18 nt, Human
gagagaggaccacagacc

SEQ ID NO: 369290 - RNA, 19 nt, Human
gcacucagugaggaggagg

SEQ ID NO: 369291 - RNA, 20 nt, Human
gcaggguggcaaagggacac

SEQ ID NO: 369292 - RNA, 18 nt, Human
gcgggaggacgggaacac

SEQ ID NO: 369293 - RNA, 22 nt, Human
gcugaggccacugccaugcccu

SEQ ID NO: 369294 - RNA, 24 nt, Human
ggagggaggcagagucuccuuucu

SEQ ID NO: 369295 - RNA, 24 nt, Human
ggggaugugggugcugauuuguac

SEQ ID NO: 369296 - RNA, 18 nt, Human
gguagccaaacccucccc

SEQ ID NO: 369297 - RNA, 21 nt, Human
guggaaugcuggcucggcccu

SEQ ID NO: 369298 - RNA, 21 nt, Human
uagacucugcaauacugcacu

SEQ ID NO: 369299 - RNA, 19 nt, Human
uagccaaacccuccccgug

SEQ ID NO: 369300 - RNA, 21 nt, Human
uagccaaacccuccccgugcu

SEQ ID NO: 369301 - RNA, 24 nt, Human
uagccaaacccuccccgugcugcc

SEQ ID NO: 369302 - RNA, 24 nt, Human
ucaagaaaggggaugugggugcug

SEQ ID NO: 369303 - RNA, 22 nt, Human
ucacaugggggaggaagggagg

SEQ ID NO: 369304 - RNA, 23 nt, Human
ucacaugggggaggaagggaggg

SEQ ID NO: 369305 - RNA, 24 nt, Human
ucagcggcgcgacuugggguuccu

SEQ ID NO: 369306 - RNA, 23 nt, Human
ucagggaugggcagggguagcca

SEQ ID NO: 369307 - RNA, 22 nt, Human
ucccaggcaggguggcaaaggg

SEQ ID NO: 369308 - RNA, 27 nt, Human
ucccaugauccuggcauggugcagguu

SEQ ID NO: 369309 - RNA, 18 nt, Human
uccccgugcugcccaguu

SEQ ID NO: 369310 - RNA, 21 nt, Human
ucugaaaguguuuccuuacaa

SEQ ID NO: 369311 - RNA, 23 nt, Human
ugccaugcccuggauguaacaac

SEQ ID NO: 369312 - RNA, 20 nt, Human
uggaaugcuggcucggcccu

SEQ ID NO: 369313 - RNA, 24 nt, Human
uggaaugcuggcucggcccugcca

SEQ ID NO: 369314 - RNA, 18 nt, Human
uggcucagggaugggcag

SEQ ID NO: 369315 - RNA, 21 nt, Human
ugggcagggguagccaaaccc

SEQ ID NO: 369316 - RNA, 19 nt, Human
uggggagaaggaaaaaggu

SEQ ID NO: 369317 - RNA, 21 nt, Human
uggggagaaggaaaaaggugg

SEQ ID NO: 369318 - RNA, 22 nt, Human
ugggguggaaugcuggcucggc

SEQ ID NO: 369319 - RNA, 20 nt, Human
uuaaggcugaggccacugcc

SEQ ID NO: 369320 - RNA, 23 nt, Human
uugucaagaaaggggaugugggu

SEQ ID NO: 369321 - RNA, 23 nt, Human
aaaaacacaaauuccuuucaguc

SEQ ID NO: 369322 - RNA, 23 nt, Human
aaagcaaaaacacaaauuccuuu

SEQ ID NO: 369323 - RNA, 22 nt, Human
aaaggcccucgccccgcggcug

SEQ ID NO: 369324 - RNA, 22 nt, Human
agcaggccccggcagagcagca

SEQ ID NO: 369325 - RNA, 19 nt, Human
agcucgggggcggcggcgg

SEQ ID NO: 369326 - RNA, 18 nt, Human
aggggaaggggggggguc

SEQ ID NO: 369327 - RNA, 31 nt, Human
aggggcaggaugggggcucaccggggcuggg

SEQ ID NO: 369328 - RNA, 24 nt, Human
aggggcgcgggggagcucgggggc

SEQ ID NO: 369329 - RNA, 22 nt, Human
cacccuccaguccacugaggcu

SEQ ID NO: 369330 - RNA, 20 nt, Human
cagcaaaggcccucgccccg

SEQ ID NO: 369331 - RNA, 21 nt, Human
ccagggucccgagacaggcag

SEQ ID NO: 369332 - RNA, 18 nt, Human
ccaguaccuggugggcag

SEQ ID NO: 369333 - RNA, 21 nt, Human
ccaguccacugaggcuggggg

SEQ ID NO: 369334 - RNA, 29 nt, Human
cccccaguaccuggugggcaggggcuggg

SEQ ID NO: 369335 - RNA, 27 nt, Human
ccgcccgcgggcaggggcgcgggggag

SEQ ID NO: 369336 - RNA, 23 nt, Human
ccggcagagcagcaaaggcccuc

SEQ ID NO: 369337 - RNA, 25 nt, Human
ccggggcuggggcugauuucugggc

SEQ ID NO: 369338 - RNA, 22 nt, Human
cgcgggcaggggcgcgggggag

SEQ ID NO: 369339 - RNA, 23 nt, Human
cgcugcccaccggccgcccgcgg

SEQ ID NO: 369340 - RNA, 22 nt, Human
cgggggcggcggcggcgcuggg

SEQ ID NO: 369341 - RNA, 25 nt, Human
cucucucucugucucugucucugac

SEQ ID NO: 369342 - RNA, 19 nt, Human
cugggcacccggcgguggc

SEQ ID NO: 369343 - RNA, 21 nt, Human
cugucucugucucugacucuc

SEQ ID NO: 369344 - RNA, 21 nt, Human
gaaaaaaagcaaaaacacaaa

SEQ ID NO: 369345 - RNA, 20 nt, Human
gcagagcagcaaaggcccuc

SEQ ID NO: 369346 - RNA, 21 nt, Human
gcagagcagcaaaggcccucg

SEQ ID NO: 369347 - RNA, 18 nt, Human
gcaggaugggggcucacc

SEQ ID NO: 369348 - RNA, 23 nt, Human
gcgcugggcacccggcgguggcu

SEQ ID NO: 369349 - RNA, 18 nt, Human
gcugccacaggcccccag

SEQ ID NO: 369350 - RNA, 20 nt, Human
gcugggggagcucggggcag

SEQ ID NO: 369351 - RNA, 18 nt, Human
ggaggggaaggggggggg

SEQ ID NO: 369352 - RNA, 21 nt, Human
ggcaggaugggggcucaccgg

SEQ ID NO: 369353 - RNA, 18 nt, Human
ggcaggggcaggaugggg

SEQ ID NO: 369354 - RNA, 21 nt, Human
ggcgcgggggagcucgggggc

SEQ ID NO: 369355 - RNA, 21 nt, Human
ggcggcggcggcgcugggcac

SEQ ID NO: 369356 - RNA, 21 nt, Human
ggcugggggagcucggggcag

SEQ ID NO: 369357 - RNA, 21 nt, Human
gggcaggggcaggaugggggc

SEQ ID NO: 369358 - RNA, 22 nt, Human
gggcuggggcugauuucugggc

SEQ ID NO: 369359 - RNA, 22 nt, Human
ggggaggggaaggggggggguc

SEQ ID NO: 369360 - RNA, 22 nt, Human
ggggcggcggcggcgcugggca

SEQ ID NO: 369361 - RNA, 21 nt, Human
ggggcuggggcugauuucugg

SEQ ID NO: 369362 - RNA, 20 nt, Human
gggggcggcggcggcgcugg

SEQ ID NO: 369363 - RNA, 21 nt, Human
gggggcggcggcggcgcuggg

SEQ ID NO: 369364 - RNA, 22 nt, Human
gggggcucaccggggcuggggc

SEQ ID NO: 369365 - RNA, 18 nt, Human
guggagcuggagaucuuu

SEQ ID NO: 369366 - RNA, 19 nt, Human
uaccuggugggcaggggca

SEQ ID NO: 369367 - RNA, 21 nt, Human
uagagcgcgucccaaggggga

SEQ ID NO: 369368 - RNA, 24 nt, Human
ucagcaggccccggcagagcagca

SEQ ID NO: 369369 - RNA, 22 nt, Human
uccacugaggcugggggagcuc

SEQ ID NO: 369370 - RNA, 21 nt, Human
ucgcucgcucucucucugucu

SEQ ID NO: 369371 - RNA, 23 nt, Human
ucgcucgcucucucucugucucu

SEQ ID NO: 369372 - RNA, 20 nt, Human
ucgggggcggcggcggcgcu

SEQ ID NO: 369373 - RNA, 18 nt, Human
ucucucucugugucucuu

SEQ ID NO: 369374 - RNA, 20 nt, Human
ucucugguauuaaguggaac

SEQ ID NO: 369375 - RNA, 23 nt, Human
ucucugucucucucugugucucu

SEQ ID NO: 369376 - RNA, 20 nt, Human
ucugucucucucugugucuc

SEQ ID NO: 369377 - RNA, 20 nt, Human
ucugucucugacucucucuc

SEQ ID NO: 369378 - RNA, 22 nt, Human
ucugucucugucucugacucuc

SEQ ID NO: 369379 - RNA, 19 nt, Human
ugacucucucucacaucuc

SEQ ID NO: 369380 - RNA, 19 nt, Human
ugccacaggcccccaguac

SEQ ID NO: 369381 - RNA, 19 nt, Human
ugcgggaggggucccaggg

SEQ ID NO: 369382 - RNA, 18 nt, Human
ugcugccacaggccccca

SEQ ID NO: 369383 - RNA, 20 nt, Human
uggaaaaaaagcaaaaacac

SEQ ID NO: 369384 - RNA, 26 nt, Human
uggaaaaaaagcaaaaacacaaauuc

SEQ ID NO: 369385 - RNA, 18 nt, Human
ugggcaggggcaggaugg

SEQ ID NO: 369386 - RNA, 24 nt, Human
ugggcaggggcaggaugggggcuc

SEQ ID NO: 369387 - RNA, 21 nt, Human
ugggggcucaccggggcuggg

SEQ ID NO: 369388 - RNA, 25 nt, Human
ugucucugucucugacucucucuca

SEQ ID NO: 369389 - RNA, 23 nt, Human
uguuuuauugcaauuauuuagag

SEQ ID NO: 369390 - RNA, 19 nt, Human
uugcugccacaggccccca

SEQ ID NO: 369391 - RNA, 19 nt, Human
uuuuuggaaaaaaagcaaa

SEQ ID NO: 369392 - RNA, 23 nt, Human
aaacccagacccaaggaucagaa

SEQ ID NO: 369393 - RNA, 23 nt, Human
aaacccagacccaaggaucagaa

SEQ ID NO: 369394 - RNA, 24 nt, Human
aacccaggcccuucuggccccaug

SEQ ID NO: 369395 - RNA, 21 nt, Human
aagcaggaaguggaggcagag

SEQ ID NO: 369396 - RNA, 21 nt, Human
aagcaggaaguggaggcagag

SEQ ID NO: 369397 - RNA, 20 nt, Human
aagcuggcauccacugaaga

SEQ ID NO: 369398 - RNA, 20 nt, Human
aaggccccugugaggaccag

SEQ ID NO: 369399 - RNA, 22 nt, Human
acagggcagcaaagcccaaggg

SEQ ID NO: 369400 - RNA, 22 nt, Human
acagggcagcaaagcccaaggg

SEQ ID NO: 369401 - RNA, 22 nt, Human
acccaacagggcagcaaagccc

SEQ ID NO: 369402 - RNA, 22 nt, Human
acccaacagggcagcaaagccc

SEQ ID NO: 369403 - RNA, 21 nt, Human
acccaagucucugggccuagc

SEQ ID NO: 369404 - RNA, 20 nt, Human
accugccacccugucagccc

SEQ ID NO: 369405 - RNA, 20 nt, Human
accugccacccugucagccc

SEQ ID NO: 369406 - RNA, 21 nt, Human
agaugcuggguuccuucucug

SEQ ID NO: 369407 - RNA, 21 nt, Human
caaaaaacccagacccaagga

SEQ ID NO: 369408 - RNA, 21 nt, Human
caaaaaacccagacccaagga

SEQ ID NO: 369409 - RNA, 22 nt, Human
caaaaaacccagacccaaggau

SEQ ID NO: 369410 - RNA, 22 nt, Human
caaaaaacccagacccaaggau

SEQ ID NO: 369411 - RNA, 19 nt, Human
caaaacacagggcaggugc

SEQ ID NO: 369412 - RNA, 19 nt, Human
caaaacacagggcaggugc

SEQ ID NO: 369413 - RNA, 22 nt, Human
caacaggccugaacugaagccu

SEQ ID NO: 369414 - RNA, 22 nt, Human
caacaggccugaacugaagccu

SEQ ID NO: 369415 - RNA, 20 nt, Human
caacccaagucucugggccu

SEQ ID NO: 369416 - RNA, 23 nt, Human
caagucucugggccuagcccgua

SEQ ID NO: 369417 - RNA, 22 nt, Human
caauuacuacuucaacccaggc

SEQ ID NO: 369418 - RNA, 21 nt, Human
cacagggcaggugcugauccc

SEQ ID NO: 369419 - RNA, 21 nt, Human
cacagggcaggugcugauccc

SEQ ID NO: 369420 - RNA, 19 nt, Human
cacagguuggggagggggg

SEQ ID NO: 369421 - RNA, 25 nt, Human
caccuccugcuccuccccgaggccu

SEQ ID NO: 369422 - RNA, 21 nt, Human
caccugccacccugucagccc

SEQ ID NO: 369423 - RNA, 21 nt, Human
cacugccaggucccccugccc

SEQ ID NO: 369424 - RNA, 23 nt, Human
cacugccaggucccccugcccac

SEQ ID NO: 369425 - RNA, 27 nt, Human
cagagcagcagaucccagggugacccc

SEQ ID NO: 369426 - RNA, 27 nt, Human
cagagcagcagaucccagggugacccc

SEQ ID NO: 369427 - RNA, 19 nt, Human
cagaucccagggugacccc

SEQ ID NO: 369428 - RNA, 19 nt, Human
cagaucccagggugacccc

SEQ ID NO: 369429 - RNA, 24 nt, Human
cagcaaagcccaagggugaggccu

SEQ ID NO: 369430 - RNA, 24 nt, Human
cagcaaagcccaagggugaggccu

SEQ ID NO: 369431 - RNA, 23 nt, Human
cagcaacccaagucucugggccu

SEQ ID NO: 369432 - RNA, 19 nt, Human
cagccccugcuuagccagg

SEQ ID NO: 369433 - RNA, 21 nt, Human
cagccccugcuuagccaggaa

SEQ ID NO: 369434 - RNA, 18 nt, Human
caggaaguggaggcagag

SEQ ID NO: 369435 - RNA, 18 nt, Human
caggaaguggaggcagag

SEQ ID NO: 369436 - RNA, 22 nt, Human
caggucccccugcccacucuuc

SEQ ID NO: 369437 - RNA, 21 nt, Human
cagugcuggggagggaguugg

SEQ ID NO: 369438 - RNA, 18 nt, Human
caguuaagcaacaggccu

SEQ ID NO: 369439 - RNA, 18 nt, Human
ccaaggaucagaaagguc

SEQ ID NO: 369440 - RNA, 23 nt, Human
ccaauaccuggcagcaaagggaa

SEQ ID NO: 369441 - RNA, 23 nt, Human
ccaauaccuggcagcaaagggaa

SEQ ID NO: 369442 - RNA, 19 nt, Human
ccacagggauuccaccucc

SEQ ID NO: 369443 - RNA, 23 nt, Human
ccaccucccaccccaguuccucu

SEQ ID NO: 369444 - RNA, 23 nt, Human
ccacuucccaccccaguuccucu

SEQ ID NO: 369445 - RNA, 19 nt, Human
cccaaggaucagaaagguc

SEQ ID NO: 369446 - RNA, 23 nt, Human
cccacugcccuaaaaaaauggac

SEQ ID NO: 369447 - RNA, 23 nt, Human
cccacugcccuaaaaaaauggac

SEQ ID NO: 369448 - RNA, 20 nt, Human
cccagaggccacuauguccc

SEQ ID NO: 369449 - RNA, 24 nt, Human
cccagaggccacuauguccccucc

SEQ ID NO: 369450 - RNA, 20 nt, Human
cccaguuccucuaagggcca

SEQ ID NO: 369451 - RNA, 20 nt, Human
cccaguuccucuaagggcca

SEQ ID NO: 369452 - RNA, 22 nt, Human
ccccagagcaauggagcagugg

SEQ ID NO: 369453 - RNA, 22 nt, Human
ccccagagcaauggagcagugg

SEQ ID NO: 369454 - RNA, 21 nt, Human
ccccaguuaagcaacaggccu

SEQ ID NO: 369455 - RNA, 20 nt, Human
ccccaguuccucuaagggcc

SEQ ID NO: 369456 - RNA, 20 nt, Human
ccccaguuccucuaagggcc

SEQ ID NO: 369457 - RNA, 19 nt, Human
cccggcaccgcagcggccg

SEQ ID NO: 369458 - RNA, 20 nt, Human
cccuaaaaaaauggacuaug

SEQ ID NO: 369459 - RNA, 20 nt, Human
cccuaaaaaaauggacuaug

SEQ ID NO: 369460 - RNA, 22 nt, Human
cccuccucaaaaaacccagacc

SEQ ID NO: 369461 - RNA, 19 nt, Human
cccugagaugauggguucu

SEQ ID NO: 369462 - RNA, 20 nt, Human
cccuuccucaaaaaacccaa

SEQ ID NO: 369463 - RNA, 18 nt, Human
ccgccugcccagccgccc

SEQ ID NO: 369464 - RNA, 22 nt, Human
ccgccugcccagccgcccuccc

SEQ ID NO: 369465 - RNA, 21 nt, Human
ccucaaaaaacccagacccaa

SEQ ID NO: 369466 - RNA, 21 nt, Human
ccucaaaaaacccagacccaa

SEQ ID NO: 369467 - RNA, 24 nt, Human
ccucacggagccucacugccagga

SEQ ID NO: 369468 - RNA, 20 nt, Human
ccugcuuagccaggcauccc

SEQ ID NO: 369469 - RNA, 24 nt, Human
ccuggcccagccucuuggccuugg

SEQ ID NO: 369470 - RNA, 24 nt, Human
ccuggcccagccucuuggccuugg

SEQ ID NO: 369471 - RNA, 25 nt, Human
ccuggcccagccucuuggccuuggu

SEQ ID NO: 369472 - RNA, 25 nt, Human
ccuggcccagccucuuggccuuggu

SEQ ID NO: 369473 - RNA, 20 nt, Human
ccuuccucaaaaaacccaga

SEQ ID NO: 369474 - RNA, 20 nt, Human
cgaggacacguacacugcca

SEQ ID NO: 369475 - RNA, 18 nt, Human
cucaaaaaacccagaccc

SEQ ID NO: 369476 - RNA, 18 nt, Human
cucaaaaaacccagaccc

SEQ ID NO: 369477 - RNA, 20 nt, Human
cucacugccaggacaccacu

SEQ ID NO: 369478 - RNA, 21 nt, Human
cuccucaaaaaacccagaccc

SEQ ID NO: 369479 - RNA, 24 nt, Human
cuccucaaaaaacccagacccaag

SEQ ID NO: 369480 - RNA, 18 nt, Human
cucuaagggccagccccc

SEQ ID NO: 369481 - RNA, 21 nt, Human
cugccaggacaccacugaccc

SEQ ID NO: 369482 - RNA, 20 nt, Human
cuuagccaggcaucccagcc

SEQ ID NO: 369483 - RNA, 21 nt, Human
cuuggccuuggucuuggaaaa

SEQ ID NO: 369484 - RNA, 21 nt, Human
cuuggccuuggucuuggaaaa

SEQ ID NO: 369485 - RNA, 22 nt, Human
gaaggcuggcauccacugaaga

SEQ ID NO: 369486 - RNA, 18 nt, Human
gacauggcagcccagagg

SEQ ID NO: 369487 - RNA, 20 nt, Human
gacuauggguagcugaccca

SEQ ID NO: 369488 - RNA, 20 nt, Human
gacuauggguagcugaccca

SEQ ID NO: 369489 - RNA, 18 nt, Human
gaguuggggcagggaagg

SEQ ID NO: 369490 - RNA, 18 nt, Human
gcagcccagaggccacua

SEQ ID NO: 369491 - RNA, 18 nt, Human
gcagcccagaggccacua

SEQ ID NO: 369492 - RNA, 24 nt, Human
gccggcccgcguccgcccguccgc

SEQ ID NO: 369493 - RNA, 24 nt, Human
gcuggguuccuucucuguuugggg

SEQ ID NO: 369494 - RNA, 24 nt, Human
ggagccucacugccaggacaccac

SEQ ID NO: 369495 - RNA, 24 nt, Human
ggagcuucacugccaggacaccac

SEQ ID NO: 369496 - RNA, 23 nt, Human
ggagggaguuggggcagggaagg

SEQ ID NO: 369497 - RNA, 20 nt, Human
ggccugaacugaagccuggc

SEQ ID NO: 369498 - RNA, 20 nt, Human
ggccugaacugaagccuggc

SEQ ID NO: 369499 - RNA, 22 nt, Human
gggaaggggcuaaagcaggaag

SEQ ID NO: 369500 - RNA, 22 nt, Human
gggaaggggcuaaagcaggaag

SEQ ID NO: 369501 - RNA, 18 nt, Human
gggagcacuucccacagg

SEQ ID NO: 369502 - RNA, 18 nt, Human
ggggaccagcaacccaag

SEQ ID NO: 369503 - RNA, 24 nt, Human
gguagcugacccaacagggcagca

SEQ ID NO: 369504 - RNA, 22 nt, Human
ggucuuggaaaaggaggaaaua

SEQ ID NO: 369505 - RNA, 22 nt, Human
ggucuuggaaaaggaggaaaua

SEQ ID NO: 369506 - RNA, 22 nt, Human
gguuaggagcagggagguggug

SEQ ID NO: 369507 - RNA, 21 nt, Human
guggcagggguuaggagcagg

SEQ ID NO: 369508 - RNA, 18 nt, Human
uagaaagucaccugccac

SEQ ID NO: 369509 - RNA, 18 nt, Human
uagaaagucaccugccac

SEQ ID NO: 369510 - RNA, 19 nt, Human
uagcugacccaacagggca

SEQ ID NO: 369511 - RNA, 19 nt, Human
uagcugacccaacagggca

SEQ ID NO: 369512 - RNA, 23 nt, Human
uagguucaagguacaaaacacag

SEQ ID NO: 369513 - RNA, 23 nt, Human
uagguucaagguacaaaacacag

SEQ ID NO: 369514 - RNA, 19 nt, Human
ucaaaaaacccagacccaa

SEQ ID NO: 369515 - RNA, 19 nt, Human
ucaaaaaacccagacccaa

SEQ ID NO: 369516 - RNA, 22 nt, Human
ucacggagcuucacugccagga

SEQ ID NO: 369517 - RNA, 19 nt, Human
ucagccccugcuuagccag

SEQ ID NO: 369518 - RNA, 19 nt, Human
ucagccccugcuuagccag

SEQ ID NO: 369519 - RNA, 22 nt, Human
ucagccccugcuuagccaggca

SEQ ID NO: 369520 - RNA, 21 nt, Human
ucccacugcccuaaaaaaaug

SEQ ID NO: 369521 - RNA, 21 nt, Human
ucccacugcccuaaaaaaaug

SEQ ID NO: 369522 - RNA, 24 nt, Human
ucccuagaaagucaccugccaccc

SEQ ID NO: 369523 - RNA, 24 nt, Human
ucccuagaaagucaccugccaccc

SEQ ID NO: 369524 - RNA, 19 nt, Human
uccugagccagaguagagg

SEQ ID NO: 369525 - RNA, 19 nt, Human
ucuagacuuagacccagag

SEQ ID NO: 369526 - RNA, 21 nt, Human
ugaaacagaaaguggcagggg

SEQ ID NO: 369527 - RNA, 19 nt, Human
ugacauggcagcccagagg

SEQ ID NO: 369528 - RNA, 18 nt, Human
ugacccaacagggcagca

SEQ ID NO: 369529 - RNA, 18 nt, Human
ugacccaacagggcagca

SEQ ID NO: 369530 - RNA, 19 nt, Human
ugacccaacagggcagcaa

SEQ ID NO: 369531 - RNA, 19 nt, Human
ugacccaacagggcagcaa

SEQ ID NO: 369532 - RNA, 22 nt, Human
ugacccagugcuggggagggag

SEQ ID NO: 369533 - RNA, 20 nt, Human
ugaccccaguuaagcaacag

SEQ ID NO: 369534 - RNA, 20 nt, Human
ugaccccaguuaagcaacag

SEQ ID NO: 369535 - RNA, 21 nt, Human
ugagaaaggccccugugagga

SEQ ID NO: 369536 - RNA, 19 nt, Human
ugaggccugccccaccucc

SEQ ID NO: 369537 - RNA, 19 nt, Human
ugaggccugccccacuucc

SEQ ID NO: 369538 - RNA, 22 nt, Human
ugccaggacaccacgaacauga

SEQ ID NO: 369539 - RNA, 23 nt, Human
ugccaggucccccugcccacucu

SEQ ID NO: 369540 - RNA, 20 nt, Human
ugccccaccucccaccccag

SEQ ID NO: 369541 - RNA, 20 nt, Human
ugccccacuucccaccccag

SEQ ID NO: 369542 - RNA, 21 nt, Human
ugcuggggaggauuggggcag

SEQ ID NO: 369543 - RNA, 23 nt, Human
ugcuggggagggaguuggggcag

SEQ ID NO: 369544 - RNA, 19 nt, Human
uggaaaaggaggaaauauu

SEQ ID NO: 369545 - RNA, 21 nt, Human
uggaaaaggaggaaauauuac

SEQ ID NO: 369546 - RNA, 21 nt, Human
uggaaaaggaggaaauauuac

SEQ ID NO: 369547 - RNA, 23 nt, Human
uggaaaaggaggaaauauuaccc

SEQ ID NO: 369548 - RNA, 23 nt, Human
uggaaaaggaggaaauauuaccc

SEQ ID NO: 369549 - RNA, 21 nt, Human
uggagcaguggcccugagaug

SEQ ID NO: 369550 - RNA, 21 nt, Human
uggagcaguggcccugagaug

SEQ ID NO: 369551 - RNA, 20 nt, Human
uggcccagccucuuggccuu

SEQ ID NO: 369552 - RNA, 20 nt, Human
uggcccagccucuuggccuu

SEQ ID NO: 369553 - RNA, 23 nt, Human
uggcccugagaugcuggguuccc

SEQ ID NO: 369554 - RNA, 19 nt, Human
uggggagggaguuggggca

SEQ ID NO: 369555 - RNA, 19 nt, Human
uggggcagggaagcuggca

SEQ ID NO: 369556 - RNA, 25 nt, Human
uucaacccaggcccuucuggcccca

SEQ ID NO: 369557 - RNA, 21 nt, Human
uuccucaaaaaacccagaccc

SEQ ID NO: 369558 - RNA, 20 nt, Human
uuccucuaagggccagcccc

SEQ ID NO: 369559 - RNA, 20 nt, Human
uuccucuaagggccagcccc

SEQ ID NO: 369560 - RNA, 21 nt, Human
uugcgggcaggagcagcugcc

SEQ ID NO: 369561 - RNA, 24 nt, Human
uuggggcagggaagcuggcaucca

SEQ ID NO: 369562 - RNA, 20 nt, Human
uuuuuuuuuuuuuuuuccau

SEQ ID NO: 369563 - RNA, 21 nt, Human
uuuuuuuuuuuuuuuuuucca

SEQ ID NO: 369564 - RNA, 19 nt, Human
aaaaacuucugacgacaaa

SEQ ID NO: 369565 - RNA, 21 nt, Human
aaaacagauccagucuacaga

SEQ ID NO: 369566 - RNA, 20 nt, Human
aaaaguuucccaacaaagga

SEQ ID NO: 369567 - RNA, 21 nt, Human
aaacaacaggaaaacaagucc

SEQ ID NO: 369568 - RNA, 18 nt, Human
aaacaaguccaagagcaa

SEQ ID NO: 369569 - RNA, 20 nt, Human
aaaggagccacccugcugca

SEQ ID NO: 369570 - RNA, 25 nt, Human
aaaggcagcagcuaucaacaaaagu

SEQ ID NO: 369571 - RNA, 25 nt, Human
aaauaacacucccuccucacucucc

SEQ ID NO: 369572 - RNA, 23 nt, Human
aaaucaauguucuaacuggauaa

SEQ ID NO: 369573 - RNA, 21 nt, Human
aacaacaggaaaacaagucca

SEQ ID NO: 369574 - RNA, 24 nt, Human
aaccacuauaacaucuguccaagu

SEQ ID NO: 369575 - RNA, 19 nt, Human
aacucagacuguacuucau

SEQ ID NO: 369576 - RNA, 20 nt, Human
aacuguugacauuaacuaca

SEQ ID NO: 369577 - RNA, 21 nt, Human
aagaaagagaaaauccgucac

SEQ ID NO: 369578 - RNA, 22 nt, Human
aagcauucuuccaagcauucaa

SEQ ID NO: 369579 - RNA, 22 nt, Human
aagcugccacgaaaggguacaa

SEQ ID NO: 369580 - RNA, 18 nt, Human
aaguaacuuccuaaaaca

SEQ ID NO: 369581 - RNA, 24 nt, Human
aagucucagaagucauuugcagcc

SEQ ID NO: 369582 - RNA, 18 nt, Human
aauccaaaaaaguuuguu

SEQ ID NO: 369583 - RNA, 19 nt, Human
acaaacaacaggaaaacaa

SEQ ID NO: 369584 - RNA, 23 nt, Human
acaaaggcagcagcuaucaacaa

SEQ ID NO: 369585 - RNA, 25 nt, Human
acaaaggcagcagcuaucaacaaaa

SEQ ID NO: 369586 - RNA, 21 nt, Human
acaacaucacugugaaaguaa

SEQ ID NO: 369587 - RNA, 24 nt, Human
acauaacaaauggcuaugccaaca

SEQ ID NO: 369588 - RNA, 22 nt, Human
accauucucuuuacucgccucu

SEQ ID NO: 369589 - RNA, 22 nt, Human
accccagccccuccaaaucuaa

SEQ ID NO: 369590 - RNA, 24 nt, Human
acuccagagaaaacaaaaaauaca

SEQ ID NO: 369591 - RNA, 23 nt, Human
acugagacauaaaacuaacagaa

SEQ ID NO: 369592 - RNA, 23 nt, Human
agaaaagacauaaagucucagaa

SEQ ID NO: 369593 - RNA, 23 nt, Human
agacuacuacaccugcugcacac

SEQ ID NO: 369594 - RNA, 23 nt, Human
agacuguacuucaucaaaguuca

SEQ ID NO: 369595 - RNA, 20 nt, Human
agagugcaaccaggaaaacu

SEQ ID NO: 369596 - RNA, 26 nt, Human
agcuaucaacaaaaguuucccaacaa

SEQ ID NO: 369597 - RNA, 20 nt, Human
auaggcgucugagcagaguu

SEQ ID NO: 369598 - RNA, 24 nt, Human
aucaaaaagcauucuuccaagcau

SEQ ID NO: 369599 - RNA, 18 nt, Human
aucagcucguugcaccac

SEQ ID NO: 369600 - RNA, 21 nt, Human
caaaaagcauucuuccaagca

SEQ ID NO: 369601 - RNA, 19 nt, Human
caaaauagaaucuacuuuc

SEQ ID NO: 369602 - RNA, 20 nt, Human
caaaggaaccucuccucccu

SEQ ID NO: 369603 - RNA, 24 nt, Human
caaaggcagcagcuaucaacaaaa

SEQ ID NO: 369604 - RNA, 18 nt, Human
caacaaaggaaccucucc

SEQ ID NO: 369605 - RNA, 22 nt, Human
caagagcaguucuacuugugca

SEQ ID NO: 369606 - RNA, 23 nt, Human
cacacaacaucacugugaaagua

SEQ ID NO: 369607 - RNA, 22 nt, Human
caccccagccccuccaaaucua

SEQ ID NO: 369608 - RNA, 22 nt, Human
cacuacauaacaaauggcuaug

SEQ ID NO: 369609 - RNA, 21 nt, Human
cagcaagcgggggaaaagggu

SEQ ID NO: 369610 - RNA, 23 nt, Human
cagcacauugccaaacacggaca

SEQ ID NO: 369611 - RNA, 24 nt, Human
caggucaaaaucaacaucaaaaag

SEQ ID NO: 369612 - RNA, 20 nt, Human
ccacaaacaacaggaaaaca

SEQ ID NO: 369613 - RNA, 24 nt, Human
ccacacuucacuccccaaccugaa

SEQ ID NO: 369614 - RNA, 21 nt, Human
ccaccccagccccuccaaauc

SEQ ID NO: 369615 - RNA, 25 nt, Human
ccauucaaacgcguagguuccacaa

SEQ ID NO: 369616 - RNA, 21 nt, Human
cccaaggaaauaacacucccu

SEQ ID NO: 369617 - RNA, 20 nt, Human
cccacacuucacuccccaac

SEQ ID NO: 369618 - RNA, 22 nt, Human
cccccgccucccgccccuaccc

SEQ ID NO: 369619 - RNA, 20 nt, Human
ccucccgccccuaccucacc

SEQ ID NO: 369620 - RNA, 23 nt, Human
ccucccgccccuaccucaccggc

SEQ ID NO: 369621 - RNA, 18 nt, Human
ccugcauagcaggaaagu

SEQ ID NO: 369622 - RNA, 22 nt, Human
ccugcauagcaggaaagucgcu

SEQ ID NO: 369623 - RNA, 21 nt, Human
cgaucaggacaaaggcagcag

SEQ ID NO: 369624 - RNA, 23 nt, Human
cgcguagguuccacaaacaacag

SEQ ID NO: 369625 - RNA, 18 nt, Human
cucagaccugagggaaaa

SEQ ID NO: 369626 - RNA, 21 nt, Human
cuccccccgccucccgcccuc

SEQ ID NO: 369627 - RNA, 20 nt, Human
cuccucccuagguucccaag

SEQ ID NO: 369628 - RNA, 21 nt, Human
cuccuguuuggcugcuaaaga

SEQ ID NO: 369629 - RNA, 20 nt, Human
cucuccucccuagguuccca

SEQ ID NO: 369630 - RNA, 23 nt, Human
cucugcccaccccagccccucca

SEQ ID NO: 369631 - RNA, 20 nt, Human
cugaaucaugaacaggucaa

SEQ ID NO: 369632 - RNA, 21 nt, Human
cugcccaccccagccccucca

SEQ ID NO: 369633 - RNA, 18 nt, Human
gaacacacaacaucacug

SEQ ID NO: 369634 - RNA, 22 nt, Human
gacacaguaaguucaaaaauuu

SEQ ID NO: 369635 - RNA, 23 nt, Human
gagaaaacaaaaaauacauaaag

SEQ ID NO: 369636 - RNA, 19 nt, Human
gccucuugcucucugccca

SEQ ID NO: 369637 - RNA, 19 nt, Human
ggaaaacaaguccaagagc

SEQ ID NO: 369638 - RNA, 25 nt, Human
ggaagaaaagacauaaagucucaga

SEQ ID NO: 369639 - RNA, 20 nt, Human
guagguuccacaaacaacag

SEQ ID NO: 369640 - RNA, 22 nt, Human
gucaaaaucaacaucaaaaagc

SEQ ID NO: 369641 - RNA, 19 nt, Human
uaaagugaggucaguaacc

SEQ ID NO: 369642 - RNA, 19 nt, Human
uaaaucaagugcccugaac

SEQ ID NO: 369643 - RNA, 20 nt, Human
uaacagcacauugccaaacu

SEQ ID NO: 369644 - RNA, 19 nt, Human
uaacuacagacuaacaaau

SEQ ID NO: 369645 - RNA, 19 nt, Human
uaacucagacuguacuuca

SEQ ID NO: 369646 - RNA, 23 nt, Human
uaacucagacuguacuucaucaa

SEQ ID NO: 369647 - RNA, 19 nt, Human
uaagaaagagaaaauccgu

SEQ ID NO: 369648 - RNA, 20 nt, Human
uacauaaagauuaaaagucu

SEQ ID NO: 369649 - RNA, 23 nt, Human
uacuccagagaaaacaaaaaaua

SEQ ID NO: 369650 - RNA, 19 nt, Human
uagcacagauagaugccuu

SEQ ID NO: 369651 - RNA, 24 nt, Human
uaggauaaaugccaagaaaccuua

SEQ ID NO: 369652 - RNA, 20 nt, Human
uaguuuguucacaaucugcc

SEQ ID NO: 369653 - RNA, 19 nt, Human
uauaacuuuuuuaaugaca

SEQ ID NO: 369654 - RNA, 20 nt, Human
uauaacuuuuuuaaugacag

SEQ ID NO: 369655 - RNA, 21 nt, Human
uauacagauaaaguacauaau

SEQ ID NO: 369656 - RNA, 20 nt, Human
uauaguuuguucacaaucug

SEQ ID NO: 369657 - RNA, 21 nt, Human
ucaaugcaucuuuagguauua

SEQ ID NO: 369658 - RNA, 23 nt, Human
ucagaagucauuugcagccuucu

SEQ ID NO: 369659 - RNA, 21 nt, Human
ucagguaaguuuaagaaagag

SEQ ID NO: 369660 - RNA, 20 nt, Human
ucaguaacccgacagaauag

SEQ ID NO: 369661 - RNA, 18 nt, Human
ucaugggagggauuccug

SEQ ID NO: 369662 - RNA, 26 nt, Human
uccacaaacaacaggaaaacaagucc

SEQ ID NO: 369663 - RNA, 19 nt, Human
uccccccgccucccgcccc

SEQ ID NO: 369664 - RNA, 22 nt, Human
uccuaaaacagauccagucuac

SEQ ID NO: 369665 - RNA, 19 nt, Human
uccucacucucccuccccu

SEQ ID NO: 369666 - RNA, 21 nt, Human
ucuccccccgccucccgcccc

SEQ ID NO: 369667 - RNA, 21 nt, Human
ucuccucccuagguucccaag

SEQ ID NO: 369668 - RNA, 24 nt, Human
ucucuuaugacugacuuuggugca

SEQ ID NO: 369669 - RNA, 22 nt, Human
ucugcccaccccagccccucca

SEQ ID NO: 369670 - RNA, 18 nt, Human
ucuuggucuggaagaaaa

SEQ ID NO: 369671 - RNA, 23 nt, Human
ugaauaacuuuguggguaaguga

SEQ ID NO: 369672 - RNA, 24 nt, Human
ugaaucaugaacaggucaaaauca

SEQ ID NO: 369673 - RNA, 23 nt, Human
ugaggucaguaacccgacagaau

SEQ ID NO: 369674 - RNA, 18 nt, Human
ugccacgaaaggguacaa

SEQ ID NO: 369675 - RNA, 22 nt, Human
uggaaaaucugaacaucauguu

SEQ ID NO: 369676 - RNA, 20 nt, Human
uggaagaaaagacauaaagu

SEQ ID NO: 369677 - RNA, 20 nt, Human
uggcugcuaaagagcagcaa

SEQ ID NO: 369678 - RNA, 24 nt, Human
uguacuguagucaaugaaucugug

SEQ ID NO: 369679 - RNA, 23 nt, Human
ugugaaaguaacuuccuaaaaca

SEQ ID NO: 369680 - RNA, 20 nt, Human
uuaaaagaugcaacguucaa

SEQ ID NO: 369681 - RNA, 22 nt, Human
uucacaaucacaugugcaaauu

SEQ ID NO: 369682 - RNA, 21 nt, Human
uucccuagugaaaagucuuau

SEQ ID NO: 369683 - RNA, 25 nt, Human
uugcaccacaacaggccaccagaga

SEQ ID NO: 369684 - RNA, 22 nt, Human
uuguucugugcucuuccuugag

SEQ ID NO: 369685 - RNA, 21 nt, Human
uuuuucacuggaaaaucugaa

SEQ ID NO: 369686 - RNA, 21 nt, Human
aaaauaauauggaacaaggca

SEQ ID NO: 369687 - RNA, 22 nt, Human
aaguauacaaccuuuuccaaag

SEQ ID NO: 369688 - RNA, 24 nt, Human
auacaaccuuuuccaaagacagag

SEQ ID NO: 369689 - RNA, 22 nt, Human
cacacgccucccaccgcccucu

SEQ ID NO: 369690 - RNA, 21 nt, Human
cacgccucccaccgcccucuc

SEQ ID NO: 369691 - RNA, 24 nt, Human
cagaaaaaaagucuuuauucucau

SEQ ID NO: 369692 - RNA, 21 nt, Human
cagagugccagggaaaaugug

SEQ ID NO: 369693 - RNA, 22 nt, Human
cagugucugaggcccagugccc

SEQ ID NO: 369694 - RNA, 22 nt, Human
cccaccgcccucuccacccugc

SEQ ID NO: 369695 - RNA, 20 nt, Human
ccccgccgccuccuuccucg

SEQ ID NO: 369696 - RNA, 21 nt, Human
ccccgccgccuccuuccucgc

SEQ ID NO: 369697 - RNA, 19 nt, Human
cccucuccacccugcucug

SEQ ID NO: 369698 - RNA, 18 nt, Human
ccucccaccgcccucucc

SEQ ID NO: 369699 - RNA, 21 nt, Human
cgcccucuccacccugcucug

SEQ ID NO: 369700 - RNA, 20 nt, Human
cggcacugggggcuuucuuu

SEQ ID NO: 369701 - RNA, 24 nt, Human
gccgccuccuuccucgccggcacu

SEQ ID NO: 369702 - RNA, 21 nt, Human
gccucccaccgcccucuccac

SEQ ID NO: 369703 - RNA, 23 nt, Human
ggcaguagagcccacucaggcac

SEQ ID NO: 369704 - RNA, 25 nt, Human
ucaggcacacgccucccaccgcccu

SEQ ID NO: 369705 - RNA, 22 nt, Human
ucccaccgcccucuccacccug

SEQ ID NO: 369706 - RNA, 21 nt, Human
uccccgccgccuccuuccucg

SEQ ID NO: 369707 - RNA, 19 nt, Human
uccucgccggcacuggggg

SEQ ID NO: 369708 - RNA, 20 nt, Human
ugaagcauucauuaguccca

SEQ ID NO: 369709 - RNA, 22 nt, Human
ugcacaaaauaauauggaacaa

SEQ ID NO: 369710 - RNA, 22 nt, Human
ugcugcuccgagggaaccgcgc

SEQ ID NO: 369711 - RNA, 24 nt, Human
ugucugaggcccagugcccggcgg

SEQ ID NO: 369712 - RNA, 20 nt, Human
accuuccucuccagcuucau

SEQ ID NO: 369713 - RNA, 22 nt, Human
acgcguggagcccgaggaggcg

SEQ ID NO: 369714 - RNA, 22 nt, Human
aggaggggcgagcucggugcuc

SEQ ID NO: 369715 - RNA, 19 nt, Human
agguggcaggcaggcgggc

SEQ ID NO: 369716 - RNA, 24 nt, Human
agguggcaggcaggcgggcagggg

SEQ ID NO: 369717 - RNA, 22 nt, Human
ccagcuucauuuccuucaugcu

SEQ ID NO: 369718 - RNA, 23 nt, Human
cccgcugcgcaucgcugggagug

SEQ ID NO: 369719 - RNA, 18 nt, Human
ccggcgcugccccgcugc

SEQ ID NO: 369720 - RNA, 21 nt, Human
ccgggcggcggcggcggcagc

SEQ ID NO: 369721 - RNA, 22 nt, Human
cgcggaggaggggcgagcucgg

SEQ ID NO: 369722 - RNA, 23 nt, Human
cggcggcagcaacagcagcucca

SEQ ID NO: 369723 - RNA, 19 nt, Human
cggcggggccggcgcugcc

SEQ ID NO: 369724 - RNA, 21 nt, Human
gagcggggcgcuccgggcggc

SEQ ID NO: 369725 - RNA, 21 nt, Human
gagguggcaggcaggcgggca

SEQ ID NO: 369726 - RNA, 24 nt, Human
gcccgaggaggcgcgcggggagcg

SEQ ID NO: 369727 - RNA, 19 nt, Human
gcggaggaggggcgagcuc

SEQ ID NO: 369728 - RNA, 20 nt, Human
gcggcggaguuagcgcggag

SEQ ID NO: 369729 - RNA, 23 nt, Human
gcuucauuuccuucaugcugaau

SEQ ID NO: 369730 - RNA, 20 nt, Human
ggaggggcgagcucggugcu

SEQ ID NO: 369731 - RNA, 19 nt, Human
ggcgcgcggggagcgcggg

SEQ ID NO: 369732 - RNA, 23 nt, Human
ggcgcgcggggagcgcgggcggc

SEQ ID NO: 369733 - RNA, 22 nt, Human
ggcgcuccgggcggcggcggcg

SEQ ID NO: 369734 - RNA, 25 nt, Human
ggggcgcuccgggcggcggcggcgg

SEQ ID NO: 369735 - RNA, 31 nt, Human
ggggcgcuccgggcggcggcggcggcagcaa

SEQ ID NO: 369736 - RNA, 23 nt, Human
guggcaggcaggcgggcaggggc

SEQ ID NO: 369737 - RNA, 23 nt, Human
uccagcuucauuuccuucaugcu

SEQ ID NO: 369738 - RNA, 19 nt, Human
ucccacauggcugucccaa

SEQ ID NO: 369739 - RNA, 22 nt, Human
uccuggaggaggcugccucugc

SEQ ID NO: 369740 - RNA, 27 nt, Human
ucuccagcuucauuuccuugggccgcc

SEQ ID NO: 369741 - RNA, 23 nt, Human
ucucuucuucuuuaccuuccucu

SEQ ID NO: 369742 - RNA, 22 nt, Human
ugucccaacuccaucaagcugg

SEQ ID NO: 369743 - RNA, 22 nt, Human
acagcaguggggucucagggca

SEQ ID NO: 369744 - RNA, 19 nt, Human
acauaaucaauccuagcac

SEQ ID NO: 369745 - RNA, 23 nt, Human
cauuuucaguuaagaguugggga

SEQ ID NO: 369746 - RNA, 18 nt, Human
ccucuggcuuguccucac

SEQ ID NO: 369747 - RNA, 18 nt, Human
cggcuuggugagaacugc

SEQ ID NO: 369748 - RNA, 24 nt, Human
cucaccuccugaagaggaucaaag

SEQ ID NO: 369749 - RNA, 22 nt, Human
cuggcuauggcagguuucuccu

SEQ ID NO: 369750 - RNA, 22 nt, Human
gaagaggaucaaagacacaccc

SEQ ID NO: 369751 - RNA, 24 nt, Human
gaccucuggcuuguccucaccucc

SEQ ID NO: 369752 - RNA, 21 nt, Human
gcagguuucuccucgcugucu

SEQ ID NO: 369753 - RNA, 19 nt, Human
gcaguggggucucagggca

SEQ ID NO: 369754 - RNA, 26 nt, Human
ggaauaaaucuaccguucccuggcaa

SEQ ID NO: 369755 - RNA, 22 nt, Human
guuucuccucgcugucuccaac

SEQ ID NO: 369756 - RNA, 18 nt, Human
uagcacuacagcauagca

SEQ ID NO: 369757 - RNA, 24 nt, Human
ucacaggugcccucggauggagaa

SEQ ID NO: 369758 - RNA, 20 nt, Human
uccucuaacauuccuucugg

SEQ ID NO: 369759 - RNA, 18 nt, Human
ugaagaggaucaaagaca

SEQ ID NO: 369760 - RNA, 20 nt, Human
uggcaaacacuuggcagccc

SEQ ID NO: 369761 - RNA, 21 nt, Human
uggcagcccuugggagcagca

SEQ ID NO: 369762 - RNA, 19 nt, Human
uguggugagacagaucagg

SEQ ID NO: 369763 - RNA, 19 nt, Human
uucccuggcaaacacuugg

SEQ ID NO: 369764 - RNA, 27 nt, Human
uuccuucuggcagguuggucgaacucg

SEQ ID NO: 369765 - RNA, 18 nt, Human
uugcagaccguguggguu

SEQ ID NO: 369766 - RNA, 18 nt, Human
uugggagcagcaucuuug

SEQ ID NO: 369767 - RNA, 20 nt, Human
uuugguugcagaccgugugg

SEQ ID NO: 369768 - RNA, 22 nt, Human
agucacaaguacacaagaagaa

SEQ ID NO: 369769 - RNA, 22 nt, Human
gcucuuuuuaggagcgugggug

SEQ ID NO: 369770 - RNA, 20 nt, Human
ugcuaagagucacaaguaca

SEQ ID NO: 369771 - RNA, 23 nt, Human
ugggugccucgcgaacccugccg

SEQ ID NO: 369772 - RNA, 24 nt, Human
uuuccagggauuaaagcuuugcac

SEQ ID NO: 369773 - RNA, 23 nt, Human
uuuuacaguuagcauauuaagcu

SEQ ID NO: 369774 - RNA, 26 nt, Human
uuuuuuuuuuuuuuuuuuacaguuag

SEQ ID NO: 369775 - RNA, 24 nt, Human
uuuuuuuuuuuuuuuuuuuuacag

SEQ ID NO: 369776 - RNA, 20 nt, Human
aaaacacaaaaauuagcccg

SEQ ID NO: 369777 - RNA, 23 nt, Human
aaaaggaagccgggcuugaccca

SEQ ID NO: 369778 - RNA, 20 nt, Human
aaaauguugccucaggcagg

SEQ ID NO: 369779 - RNA, 23 nt, Human
aaacucgagccaagcaggaaccu

SEQ ID NO: 369780 - RNA, 24 nt, Human
aaauuuucaacauacaccaaguuu

SEQ ID NO: 369781 - RNA, 22 nt, Human
aacaaaacaaaaagaaaaaaaa

SEQ ID NO: 369782 - RNA, 18 nt, Human
aacagagcgagacugagu

SEQ ID NO: 369783 - RNA, 19 nt, Human
aacauggugaaaccccauc

SEQ ID NO: 369784 - RNA, 20 nt, Human
aacauggugaaaccccaucu

SEQ ID NO: 369785 - RNA, 20 nt, Human
aacauggugaaaccccaucu

SEQ ID NO: 369786 - RNA, 21 nt, Human
aacauggugaaaccccaucuc

SEQ ID NO: 369787 - RNA, 22 nt, Human
aagggcaugacaaaaaggacuc

SEQ ID NO: 369788 - RNA, 24 nt, Human
aauaaaauaaaauguugccuuuaa

SEQ ID NO: 369789 - RNA, 18 nt, Human
aaucgcuugaaccuggga

SEQ ID NO: 369790 - RNA, 24 nt, Human
aaucgcuugaaccugggaggcaga

SEQ ID NO: 369791 - RNA, 18 nt, Human
acaaaacaaaaagaaaaa

SEQ ID NO: 369792 - RNA, 20 nt, Human
acacucugcaccccuucucu

SEQ ID NO: 369793 - RNA, 24 nt, Human
acagaggcagaucuugucucaaaa

SEQ ID NO: 369794 - RNA, 24 nt, Human
accaacauggugaaaccccaucuc

SEQ ID NO: 369795 - RNA, 19 nt, Human
acggucccgcuacaaucgc

SEQ ID NO: 369796 - RNA, 24 nt, Human
acugcacuccagccugggcgacag

SEQ ID NO: 369797 - RNA, 26 nt, Human
acugcacuccagccugggcgacagag

SEQ ID NO: 369798 - RNA, 24 nt, Human
acugcacuucagccugggcaacag

SEQ ID NO: 369799 - RNA, 24 nt, Human
acugcacuucagccugggcaacag

SEQ ID NO: 369800 - RNA, 20 nt, Human
agaaaaaaaaaaauuagccg

SEQ ID NO: 369801 - RNA, 22 nt, Human
agaaucgcuugaaccugggagg

SEQ ID NO: 369802 - RNA, 21 nt, Human
agagaaacggaaagaaaggaa

SEQ ID NO: 369803 - RNA, 24 nt, Human
agagaaacggaaagaaaggaaggg

SEQ ID NO: 369804 - RNA, 20 nt, Human
agagacgcauuuucucuuuc

SEQ ID NO: 369805 - RNA, 18 nt, Human
agagguugcagugagccg

SEQ ID NO: 369806 - RNA, 21 nt, Human
agagguugcagugagccgaga

SEQ ID NO: 369807 - RNA, 24 nt, Human
agcaccagguaaacacucugcacc

SEQ ID NO: 369808 - RNA, 25 nt, Human
agccaagcaggaaccuaaaugagga

SEQ ID NO: 369809 - RNA, 21 nt, Human
agccugggcaacauggcuggc

SEQ ID NO: 369810 - RNA, 24 nt, Human
agccugggcgacagaggcagaucu

SEQ ID NO: 369811 - RNA, 24 nt, Human
agcgccccacugcacuucagccug

SEQ ID NO: 369812 - RNA, 19 nt, Human
aggaaggaacaagaggccu

SEQ ID NO: 369813 - RNA, 23 nt, Human
aggaauucgaaaucugccugacc

SEQ ID NO: 369814 - RNA, 18 nt, Human
aggacagugggggcagau

SEQ ID NO: 369815 - RNA, 24 nt, Human
aggaucacuugagcccaggaguuc

SEQ ID NO: 369816 - RNA, 20 nt, Human
aggcacagguugcagugagc

SEQ ID NO: 369817 - RNA, 24 nt, Human
aggcacagguugcagugagcugag

SEQ ID NO: 369818 - RNA, 21 nt, Human
aggcagagguugcagugagcc

SEQ ID NO: 369819 - RNA, 24 nt, Human
aggcagagguugcagugagccgag

SEQ ID NO: 369820 - RNA, 22 nt, Human
aggcaggagaaucgcuugaacc

SEQ ID NO: 369821 - RNA, 24 nt, Human
aggcaggagaaucgcuugaaccug

SEQ ID NO: 369822 - RNA, 21 nt, Human
aggcaggguguugguggcuca

SEQ ID NO: 369823 - RNA, 23 nt, Human
aggccaagggcaaggcgggagga

SEQ ID NO: 369824 - RNA, 19 nt, Human
aggccgaggcggguggauc

SEQ ID NO: 369825 - RNA, 21 nt, Human
aggccgaggcggguggaucac

SEQ ID NO: 369826 - RNA, 18 nt, Human
aggcgggaggaucacuug

SEQ ID NO: 369827 - RNA, 23 nt, Human
aggcgggaggaucacuugagccc

SEQ ID NO: 369828 - RNA, 21 nt, Human
aggcggguggaucacuugagg

SEQ ID NO: 369829 - RNA, 26 nt, Human
aggcggguggaucacuugaggucagg

SEQ ID NO: 369830 - RNA, 20 nt, Human
aggcugaggcaggagaaucg

SEQ ID NO: 369831 - RNA, 24 nt, Human
aggcugaggcaggagaaucgcuug

SEQ ID NO: 369832 - RNA, 23 nt, Human
aggcugaggcugagaaucgcuug

SEQ ID NO: 369833 - RNA, 21 nt, Human
agggggcggaggcggggcugu

SEQ ID NO: 369834 - RNA, 18 nt, Human
agguuccccucccccugc

SEQ ID NO: 369835 - RNA, 21 nt, Human
agguugcagugagcugagauc

SEQ ID NO: 369836 - RNA, 18 nt, Human
agguuuuucacuccuugg

SEQ ID NO: 369837 - RNA, 19 nt, Human
aguaauagguuuuucacuc

SEQ ID NO: 369838 - RNA, 21 nt, Human
aucacuugaggucaggaauuc

SEQ ID NO: 369839 - RNA, 21 nt, Human
auccuagcacuuggaaggcca

SEQ ID NO: 369840 - RNA, 24 nt, Human
aucucgccacugcacuccagccug

SEQ ID NO: 369841 - RNA, 19 nt, Human
aucugccccugcuuucccc

SEQ ID NO: 369842 - RNA, 18 nt, Human
caaacucgagccaagcag

SEQ ID NO: 369843 - RNA, 24 nt, Human
caacauggugaaaccccaucucua

SEQ ID NO: 369844 - RNA, 23 nt, Human
caagaaggcagcccggggucucg

SEQ ID NO: 369845 - RNA, 23 nt, Human
caagaaggcagcccggggucucu

SEQ ID NO: 369846 - RNA, 21 nt, Human
caaggcgggaggaucacuuga

SEQ ID NO: 369847 - RNA, 25 nt, Human
caauagagaaacggaaagaaaggaa

SEQ ID NO: 369848 - RNA, 18 nt, Human
cacagguugcagugagcu

SEQ ID NO: 369849 - RNA, 23 nt, Human
caccccuucucuuaguaguaaua

SEQ ID NO: 369850 - RNA, 23 nt, Human
cacgccuguaauccuagcacuug

SEQ ID NO: 369851 - RNA, 25 nt, Human
cacucugcaccccuucucuuaguag

SEQ ID NO: 369852 - RNA, 19 nt, Human
cacugcacuccagccuggg

SEQ ID NO: 369853 - RNA, 20 nt, Human
cacugcacuccagccugggc

SEQ ID NO: 369854 - RNA, 22 nt, Human
cacugcacuccagccugggcga

SEQ ID NO: 369855 - RNA, 23 nt, Human
cacugcacuccagccugggcgac

SEQ ID NO: 369856 - RNA, 24 nt, Human
cacugcacuccagccugggcgaca

SEQ ID NO: 369857 - RNA, 18 nt, Human
cacugcacuucagccugg

SEQ ID NO: 369858 - RNA, 19 nt, Human
cacugcacuucagccuggg

SEQ ID NO: 369859 - RNA, 21 nt, Human
cacugcacuucagccugggca

SEQ ID NO: 369860 - RNA, 23 nt, Human
cacugcacuucagccugggcaac

SEQ ID NO: 369861 - RNA, 24 nt, Human
cacugcacuucagccugggcaaca

SEQ ID NO: 369862 - RNA, 23 nt, Human
cacuucagccugggcaacagagc

SEQ ID NO: 369863 - RNA, 24 nt, Human
cacuucagccugggcaacagagcg

SEQ ID NO: 369864 - RNA, 20 nt, Human
cacuugaggucaggaauucg

SEQ ID NO: 369865 - RNA, 21 nt, Human
cagccugggcaacagagcgag

SEQ ID NO: 369866 - RNA, 21 nt, Human
cagcgcaagccugagaccaca

SEQ ID NO: 369867 - RNA, 24 nt, Human
cagcuacucgggaggcugaggcag

SEQ ID NO: 369868 - RNA, 26 nt, Human
caggagccugcagcgcuagguagagg

SEQ ID NO: 369869 - RNA, 23 nt, Human
cagggcaggaucugccgccucuu

SEQ ID NO: 369870 - RNA, 22 nt, Human
caggguggcaucugccccugcu

SEQ ID NO: 369871 - RNA, 20 nt, Human
caggguguugguggcucacg

SEQ ID NO: 369872 - RNA, 25 nt, Human
cagguaaacacucugcaccccuucu

SEQ ID NO: 369873 - RNA, 19 nt, Human
cagugcccaagggcuaaga

SEQ ID NO: 369874 - RNA, 20 nt, Human
cagugcccaagggcuaagaa

SEQ ID NO: 369875 - RNA, 23 nt, Human
caguugugugugacggucccgcu

SEQ ID NO: 369876 - RNA, 21 nt, Human
caugccgugucccuccuccuc

SEQ ID NO: 369877 - RNA, 20 nt, Human
ccacugcacuccagccuggg

SEQ ID NO: 369878 - RNA, 21 nt, Human
ccacugcacuccagccugggc

SEQ ID NO: 369879 - RNA, 21 nt, Human
ccacugcacuccagccugggc

SEQ ID NO: 369880 - RNA, 24 nt, Human
ccacugcacuccagccugggcgac

SEQ ID NO: 369881 - RNA, 20 nt, Human
ccacugcacuucagccuggg

SEQ ID NO: 369882 - RNA, 21 nt, Human
ccacugcacuucagccugggc

SEQ ID NO: 369883 - RNA, 23 nt, Human
ccacugcacuucagccugggcaa

SEQ ID NO: 369884 - RNA, 24 nt, Human
ccacugcacuucagccugggcaac

SEQ ID NO: 369885 - RNA, 23 nt, Human
ccagcgcaagccugagaccacag

SEQ ID NO: 369886 - RNA, 21 nt, Human
ccaugccgugucccuccuccu

SEQ ID NO: 369887 - RNA, 20 nt, Human
ccccacugcacuucagccug

SEQ ID NO: 369888 - RNA, 24 nt, Human
ccccacugcacuucagccugggca

SEQ ID NO: 369889 - RNA, 21 nt, Human
ccccaugccgugucccuccuc

SEQ ID NO: 369890 - RNA, 25 nt, Human
cccccaugccgugucccuccuccuc

SEQ ID NO: 369891 - RNA, 21 nt, Human
cccccugccacaacuggcauc

SEQ ID NO: 369892 - RNA, 19 nt, Human
cccuccuccucuccacguc

SEQ ID NO: 369893 - RNA, 21 nt, Human
cccugccacaacuggcauccc

SEQ ID NO: 369894 - RNA, 22 nt, Human
ccgaggcggguggaucacuuga

SEQ ID NO: 369895 - RNA, 19 nt, Human
ccucccccugccacaacug

SEQ ID NO: 369896 - RNA, 24 nt, Human
ccugaccaacauggugaaacccca

SEQ ID NO: 369897 - RNA, 21 nt, Human
ccugcaaucccagcuacucgg

SEQ ID NO: 369898 - RNA, 22 nt, Human
ccugcaaucccagcuacucggg

SEQ ID NO: 369899 - RNA, 25 nt, Human
ccugggaggcagagguugcagugag

SEQ ID NO: 369900 - RNA, 20 nt, Human
ccugggugccaguugugugu

SEQ ID NO: 369901 - RNA, 21 nt, Human
ccuguaaucccagcuacucgg

SEQ ID NO: 369902 - RNA, 20 nt, Human
ccuguaauccuagcacuugg

SEQ ID NO: 369903 - RNA, 22 nt, Human
cgagccaagcaggaaccuaaau

SEQ ID NO: 369904 - RNA, 24 nt, Human
cgaggcggguggaucacuugaggu

SEQ ID NO: 369905 - RNA, 26 nt, Human
cgaggcggguggaucacuugagguca

SEQ ID NO: 369906 - RNA, 26 nt, Human
cgccacugcacuccagccugggcgac

SEQ ID NO: 369907 - RNA, 23 nt, Human
cgccugcaaucccagcuacucgg

SEQ ID NO: 369908 - RNA, 24 nt, Human
cgccugcaaucccagcuacucggg

SEQ ID NO: 369909 - RNA, 18 nt, Human
cgccuguaauccuagcac

SEQ ID NO: 369910 - RNA, 22 nt, Human
cgccuguaauccuagcacuugg

SEQ ID NO: 369911 - RNA, 23 nt, Human
cgcuccugcaggcagaauuuagc

SEQ ID NO: 369912 - RNA, 24 nt, Human
cgcuugaagccgggaggcacaggg

SEQ ID NO: 369913 - RNA, 24 nt, Human
cgggaggcacagguugcagugagc

SEQ ID NO: 369914 - RNA, 22 nt, Human
cgggaggcugaggcugagaauc

SEQ ID NO: 369915 - RNA, 24 nt, Human
cggguggaucacuugaggucagga

SEQ ID NO: 369916 - RNA, 18 nt, Human
cucaaacucgagccaagc

SEQ ID NO: 369917 - RNA, 24 nt, Human
cucacgccuguaauccuagcacuu

SEQ ID NO: 369918 - RNA, 21 nt, Human
cucccccggccccuucugccc

SEQ ID NO: 369919 - RNA, 23 nt, Human
cuccuccucuccacgucuccuca

SEQ ID NO: 369920 - RNA, 23 nt, Human
cuccuguaaucccagcuacucgg

SEQ ID NO: 369921 - RNA, 24 nt, Human
cuccuguaaucccagcuacucggg

SEQ ID NO: 369922 - RNA, 24 nt, Human
cuggaccccuggccugggugccag

SEQ ID NO: 369923 - RNA, 21 nt, Human
cugggcaggguggcaucugcc

SEQ ID NO: 369924 - RNA, 21 nt, Human
cuguccucacaggacaguggg

SEQ ID NO: 369925 - RNA, 22 nt, Human
cuuaaaacacaaaaauuagccc

SEQ ID NO: 369926 - RNA, 22 nt, Human
cuuaagggcaugacaaaaagga

SEQ ID NO: 369927 - RNA, 21 nt, Human
gaaacggaaagaaaggaaggg

SEQ ID NO: 369928 - RNA, 22 nt, Human
gacagugggggcagaucagaga

SEQ ID NO: 369929 - RNA, 18 nt, Human
gacgucuucagacgcucg

SEQ ID NO: 369930 - RNA, 18 nt, Human
gagacugagucucaaaca

SEQ ID NO: 369931 - RNA, 23 nt, Human
gagagcgccccacugcacuucag

SEQ ID NO: 369932 - RNA, 23 nt, Human
gagaucucgccacugcacuccag

SEQ ID NO: 369933 - RNA, 21 nt, Human
gagcagccccaagaaggcaac

SEQ ID NO: 369934 - RNA, 23 nt, Human
gagcagccccaagaaggcagccc

SEQ ID NO: 369935 - RNA, 21 nt, Human
gagcccugcgccagcuccccc

SEQ ID NO: 369936 - RNA, 24 nt, Human
gaguggggagacagggcagugugc

SEQ ID NO: 369937 - RNA, 18 nt, Human
gaucacuugaggucagga

SEQ ID NO: 369938 - RNA, 24 nt, Human
gaucacuugaggucaggaauucga

SEQ ID NO: 369939 - RNA, 18 nt, Human
gaucugccgccucuucuc

SEQ ID NO: 369940 - RNA, 24 nt, Human
gcacuucagccugggcaacagagc

SEQ ID NO: 369941 - RNA, 18 nt, Human
gcaggguguugguggcuc

SEQ ID NO: 369942 - RNA, 20 nt, Human
gcagugagccgagagcgccc

SEQ ID NO: 369943 - RNA, 22 nt, Human
gcaugacaaaaaggacuccucu

SEQ ID NO: 369944 - RNA, 22 nt, Human
gccacugcacuccagccugggc

SEQ ID NO: 369945 - RNA, 24 nt, Human
gccacugcacuccagccugggcga

SEQ ID NO: 369946 - RNA, 22 nt, Human
gcccaggaguucacgaccagcc

SEQ ID NO: 369947 - RNA, 21 nt, Human
gcccggggucucggggacucg

SEQ ID NO: 369948 - RNA, 23 nt, Human
gccugaccaacauggugaaaccc

SEQ ID NO: 369949 - RNA, 18 nt, Human
gccugggcaacauggcug

SEQ ID NO: 369950 - RNA, 21 nt, Human
gcuacucgggaggcugaggcu

SEQ ID NO: 369951 - RNA, 21 nt, Human
gcuggcaacaugaccccgugu

SEQ ID NO: 369952 - RNA, 22 nt, Human
gcuguccucacaggacaguggg

SEQ ID NO: 369953 - RNA, 23 nt, Human
ggacuccccccaugccguguccc

SEQ ID NO: 369954 - RNA, 19 nt, Human
ggagacagggcagugugcu

SEQ ID NO: 369955 - RNA, 23 nt, Human
ggaucacuugagcccaggaguuc

SEQ ID NO: 369956 - RNA, 19 nt, Human
ggcaggguguugguggcuc

SEQ ID NO: 369957 - RNA, 21 nt, Human
ggcgugguggcgggcgccugc

SEQ ID NO: 369958 - RNA, 19 nt, Human
gggcaggguggcaucugcc

SEQ ID NO: 369959 - RNA, 23 nt, Human
gggcgugguggcgggcgccugca

SEQ ID NO: 369960 - RNA, 23 nt, Human
gggcuggucaggaggcggagcag

SEQ ID NO: 369961 - RNA, 19 nt, Human
ggggagacagggcagugug

SEQ ID NO: 369962 - RNA, 18 nt, Human
ggggcggaggcggggcug

SEQ ID NO: 369963 - RNA, 18 nt, Human
gggggcggaggcggggcu

SEQ ID NO: 369964 - RNA, 21 nt, Human
gguggaucacuugaggucagg

SEQ ID NO: 369965 - RNA, 24 nt, Human
gguggcacgcuccuguaaucccag

SEQ ID NO: 369966 - RNA, 24 nt, Human
gguggcucacgccuguaauccuag

SEQ ID NO: 369967 - RNA, 24 nt, Human
gguguugguggcucacgccuguaa

SEQ ID NO: 369968 - RNA, 21 nt, Human
guaaacacucugcaccccuuc

SEQ ID NO: 369969 - RNA, 19 nt, Human
guacuaaaucauuuuugac

SEQ ID NO: 369970 - RNA, 22 nt, Human
guugcagugagccgagagcgcc

SEQ ID NO: 369971 - RNA, 23 nt, Human
uaaacacucugcaccccuucucu

SEQ ID NO: 369972 - RNA, 21 nt, Human
uaagagcagcuguacagagug

SEQ ID NO: 369973 - RNA, 24 nt, Human
uaaguaaauaaaggccgaggcggg

SEQ ID NO: 369974 - RNA, 25 nt, Human
uaauagguuuuucacuccuuggccu

SEQ ID NO: 369975 - RNA, 22 nt, Human
uacaauagagaaacggaaagaa

SEQ ID NO: 369976 - RNA, 18 nt, Human
uagagaaacggaaagaaa

SEQ ID NO: 369977 - RNA, 19 nt, Human
uagcacuuggaaggccaag

SEQ ID NO: 369978 - RNA, 20 nt, Human
uagcucuggaccccuggccu

SEQ ID NO: 369979 - RNA, 22 nt, Human
uagguagagagcccugcgccag

SEQ ID NO: 369980 - RNA, 28 nt, Human
ucaaacaaaacaaaaagaaaaaaaaaaa

SEQ ID NO: 369981 - RNA, 21 nt, Human
ucacgaccagccugggcaaca

SEQ ID NO: 369982 - RNA, 20 nt, Human
uccagccugggcgacagagg

SEQ ID NO: 369983 - RNA, 21 nt, Human
ucccuccuccucuccacgucu

SEQ ID NO: 369984 - RNA, 23 nt, Human
uccuguaaucccagcuacucggg

SEQ ID NO: 369985 - RNA, 19 nt, Human
uccuguugauguuaagucc

SEQ ID NO: 369986 - RNA, 21 nt, Human
ucgagccaagcaggaaccuaa

SEQ ID NO: 369987 - RNA, 18 nt, Human
ucgcuugaaccugggagg

SEQ ID NO: 369988 - RNA, 24 nt, Human
ucgggaggcugaggcaggagaauc

SEQ ID NO: 369989 - RNA, 23 nt, Human
ucgggaggcugaggcugagaauc

SEQ ID NO: 369990 - RNA, 29 nt, Human
ucucaaacaaaacaaaaagaaaaaaaaaa

SEQ ID NO: 369991 - RNA, 19 nt, Human
ucuccucagggacuucgag

SEQ ID NO: 369992 - RNA, 19 nt, Human
ugaaaacagguuaaacagu

SEQ ID NO: 369993 - RNA, 20 nt, Human
ugaaaacagguuaaacaguu

SEQ ID NO: 369994 - RNA, 24 nt, Human
ugaaccugggaggcagagguugca

SEQ ID NO: 369995 - RNA, 24 nt, Human
ugaccaacauggugaaaccccauc

SEQ ID NO: 369996 - RNA, 21 nt, Human
ugacccagggggcggaggcgg

SEQ ID NO: 369997 - RNA, 21 nt, Human
ugacgagggcuggucaggagg

SEQ ID NO: 369998 - RNA, 19 nt, Human
ugagagcaccagguaaaca

SEQ ID NO: 369999 - RNA, 25 nt, Human
ugagagcaccagguaaacacucugc

SEQ ID NO: 370000 - RNA, 26 nt, Human
ugagagcaccagguaaacuggagacc

SEQ ID NO: 370001 - RNA, 23 nt, Human
ugagcccaggaguucacgaccag

SEQ ID NO: 370002 - RNA, 22 nt, Human
ugagcugagaucucgccacugc

SEQ ID NO: 370003 - RNA, 24 nt, Human
ugaggcaggagaaucgcuugaacc

SEQ ID NO: 370004 - RNA, 24 nt, Human
ugaggcaggagaaucgcuugaacc

SEQ ID NO: 370005 - RNA, 22 nt, Human
ugagggguuuugaaauuuucaa

SEQ ID NO: 370006 - RNA, 21 nt, Human
ugagucucaaacaaaacaaaa

SEQ ID NO: 370007 - RNA, 23 nt, Human
uggaccccuggccugggugccag

SEQ ID NO: 370008 - RNA, 24 nt, Human
uggaucacuugaggucaggaauuc

SEQ ID NO: 370009 - RNA, 26 nt, Human
uggaucacuugaggucaggaauucga

SEQ ID NO: 370010 - RNA, 22 nt, Human
uggcacgcuccuguaaucccag

SEQ ID NO: 370011 - RNA, 21 nt, Human
uggcaucugccccugcuuucc

SEQ ID NO: 370012 - RNA, 19 nt, Human
uggcucacgccuguaaucc

SEQ ID NO: 370013 - RNA, 24 nt, Human
uggcucacgccuguaauccuagca

SEQ ID NO: 370014 - RNA, 24 nt, Human
ugggaggcagagguugcagugagc

SEQ ID NO: 370015 - RNA, 22 nt, Human
uggguaagagcagcuguacaga

SEQ ID NO: 370016 - RNA, 22 nt, Human
ugggugccaguugugugugacg

SEQ ID NO: 370017 - RNA, 24 nt, Human
ugguggcacgcuccuguaauccca

SEQ ID NO: 370018 - RNA, 22 nt, Human
ugguggcucacgccuguaaucc

SEQ ID NO: 370019 - RNA, 24 nt, Human
ugugagguaaaaaaaauggguaag

SEQ ID NO: 370020 - RNA, 18 nt, Human
ugugcagcgcgcggacgc

SEQ ID NO: 370021 - RNA, 19 nt, Human
uguugauguuaaguccugu

SEQ ID NO: 370022 - RNA, 22 nt, Human
uuagcccggagugguggcacgc

SEQ ID NO: 370023 - RNA, 18 nt, Human
uuagccgggcgugguggc

SEQ ID NO: 370024 - RNA, 22 nt, Human
uuagccgggcgugguggcgggc

SEQ ID NO: 370025 - RNA, 24 nt, Human
uuagccgggcgugguggcgggcgc

SEQ ID NO: 370026 - RNA, 24 nt, Human
uucagccugggcaacagagcgaga

SEQ ID NO: 370027 - RNA, 24 nt, Human
uugaaccugggaggcagagguugc

SEQ ID NO: 370028 - RNA, 20 nt, Human
uugagagcaccagguaaaca

SEQ ID NO: 370029 - RNA, 20 nt, Human
uugcagugagccgagagcgc

SEQ ID NO: 370030 - RNA, 21 nt, Human
uugcagugagcugagaucucc

SEQ ID NO: 370031 - RNA, 21 nt, Human
uugcagugagcugagaucucg

SEQ ID NO: 370032 - RNA, 22 nt, Human
uugcagugagcugagaucucgc

SEQ ID NO: 370033 - RNA, 21 nt, Human
uuuaaaauguugccucaggca

SEQ ID NO: 370034 - RNA, 19 nt, Human
agaagaugcuaaacauagc

SEQ ID NO: 370035 - RNA, 22 nt, Human
agacaauacaaacuagcuacga

SEQ ID NO: 370036 - RNA, 19 nt, Human
caagacaauacaaacuagc

SEQ ID NO: 370037 - RNA, 20 nt, Human
caagacaauacaaacuagcu

SEQ ID NO: 370038 - RNA, 24 nt, Human
cagguaccuccucuucuguaacuu

SEQ ID NO: 370039 - RNA, 18 nt, Human
cauggcucuguggggcca

SEQ ID NO: 370040 - RNA, 19 nt, Human
cccaugguuucugcccuaa

SEQ ID NO: 370041 - RNA, 18 nt, Human
cccgcaagcccaagcucu

SEQ ID NO: 370042 - RNA, 21 nt, Human
cgucgccaucuuggccccgaa

SEQ ID NO: 370043 - RNA, 26 nt, Human
cucuggaacugggcccgcaagcccaa

SEQ ID NO: 370044 - RNA, 19 nt, Human
cuguaacuuccaccucugg

SEQ ID NO: 370045 - RNA, 23 nt, Human
gauggaccauggcucuguggggc

SEQ ID NO: 370046 - RNA, 20 nt, Human
ggaccauggcucuguggggc

SEQ ID NO: 370047 - RNA, 21 nt, Human
ggccccgaagucuccaacccu

SEQ ID NO: 370048 - RNA, 18 nt, Human
ggggccagugcuuagcag

SEQ ID NO: 370049 - RNA, 24 nt, Human
uaaaacaggcaauugugcuacucc

SEQ ID NO: 370050 - RNA, 21 nt, Human
ucacuggugguuguuuuuuuu

SEQ ID NO: 370051 - RNA, 19 nt, Human
ucggcucaaagaggguaac

SEQ ID NO: 370052 - RNA, 22 nt, Human
ucucucggauggaccauggcuc

SEQ ID NO: 370053 - RNA, 21 nt, Human
ugacaagacaauacaaacuag

SEQ ID NO: 370054 - RNA, 21 nt, Human
uggaacugggcccgcaagccc

SEQ ID NO: 370055 - RNA, 22 nt, Human
uggccccgaagucuccaacccu

SEQ ID NO: 370056 - RNA, 21 nt, Human
uucuguaacuuccaccucugg

SEQ ID NO: 370057 - RNA, 26 nt, Human
uuuuuuuuuuuuuuuuuuuaguuuuu

SEQ ID NO: 370058 - RNA, 19 nt, Human
aaaaauacuagaaugccau

SEQ ID NO: 370059 - RNA, 22 nt, Human
aaauauaaagcuacacauuuca

SEQ ID NO: 370060 - RNA, 21 nt, Human
aagcccagacucaauagaaaa

SEQ ID NO: 370061 - RNA, 21 nt, Human
acaaaaauacuagaaugccau

SEQ ID NO: 370062 - RNA, 21 nt, Human
acacaaacaagcccagacuca

SEQ ID NO: 370063 - RNA, 21 nt, Human
agaaaagaaagcaacaaagaa

SEQ ID NO: 370064 - RNA, 19 nt, Human
agaaugccauaaaauauaa

SEQ ID NO: 370065 - RNA, 24 nt, Human
agcaacaaagaagugaaaaagucu

SEQ ID NO: 370066 - RNA, 21 nt, Human
agcuaaaaccucagcacaagc

SEQ ID NO: 370067 - RNA, 21 nt, Human
aguagggggacaaggcagggg

SEQ ID NO: 370068 - RNA, 18 nt, Human
auagaaucuagguucucu

SEQ ID NO: 370069 - RNA, 21 nt, Human
augcaagaaaucaaaaccaaa

SEQ ID NO: 370070 - RNA, 21 nt, Human
caaaaauacuagaaugccagu

SEQ ID NO: 370071 - RNA, 21 nt, Human
caaaaauacuagaaugccaua

SEQ ID NO: 370072 - RNA, 22 nt, Human
caaaauacaguacacaaaaaua

SEQ ID NO: 370073 - RNA, 18 nt, Human
caacaaagaagugaaaaa

SEQ ID NO: 370074 - RNA, 22 nt, Human
cagcacaagcuucaaaagaaca

SEQ ID NO: 370075 - RNA, 23 nt, Human
caguaugcaguaacacaaacaag

SEQ ID NO: 370076 - RNA, 21 nt, Human
ccagagcucucaguagcugac

SEQ ID NO: 370077 - RNA, 23 nt, Human
cccagacucaauagaaaagaaag

SEQ ID NO: 370078 - RNA, 24 nt, Human
cccagacucaauagaaaagaaagc

SEQ ID NO: 370079 - RNA, 24 nt, Human
ccuucuuuccagagcucucaguag

SEQ ID NO: 370080 - RNA, 19 nt, Human
cggcaguggcugcacugga

SEQ ID NO: 370081 - RNA, 21 nt, Human
cggcaguggcugcacuggaaa

SEQ ID NO: 370082 - RNA, 23 nt, Human
cggcggcaguggcugcacuggaa

SEQ ID NO: 370083 - RNA, 23 nt, Human
cuaaucacaguaugcaguaacac

SEQ ID NO: 370084 - RNA, 20 nt, Human
cuagguucucuuucaaagca

SEQ ID NO: 370085 - RNA, 18 nt, Human
gaauacacuggaacuggc

SEQ ID NO: 370086 - RNA, 19 nt, Human
gagggcuccugggcggcgg

SEQ ID NO: 370087 - RNA, 22 nt, Human
gaguagggggacaaggcagggg

SEQ ID NO: 370088 - RNA, 23 nt, Human
gcaagcacaguaucaaauauuag

SEQ ID NO: 370089 - RNA, 24 nt, Human
gcacaagcuucaaaagaacaagga

SEQ ID NO: 370090 - RNA, 19 nt, Human
gcccagacucaauagaaaa

SEQ ID NO: 370091 - RNA, 20 nt, Human
gcggcaguggcugcacugga

SEQ ID NO: 370092 - RNA, 25 nt, Human
gcggcaguggcugcacuggaaagag

SEQ ID NO: 370093 - RNA, 24 nt, Human
gcuaaucacaguaugcaguaacac

SEQ ID NO: 370094 - RNA, 19 nt, Human
ggacgagggcuccugggcg

SEQ ID NO: 370095 - RNA, 21 nt, Human
ggcggcaguggcugcacugga

SEQ ID NO: 370096 - RNA, 22 nt, Human
ggcggcaguggcugcacuggaa

SEQ ID NO: 370097 - RNA, 23 nt, Human
gggaacgaguagggggacaaggc

SEQ ID NO: 370098 - RNA, 22 nt, Human
gggagcgggaacgaguaggggg

SEQ ID NO: 370099 - RNA, 21 nt, Human
guuuuuccacagccauauaaa

SEQ ID NO: 370100 - RNA, 23 nt, Human
uaaaacauagaaaagcuaaaacc

SEQ ID NO: 370101 - RNA, 20 nt, Human
uaaaauggaaacagauuuaa

SEQ ID NO: 370102 - RNA, 22 nt, Human
uagaaaagcuaaaaccucagca

SEQ ID NO: 370103 - RNA, 20 nt, Human
uaggaaaaaaauauuuagau

SEQ ID NO: 370104 - RNA, 18 nt, Human
uaggauuucaccuucuug

SEQ ID NO: 370105 - RNA, 19 nt, Human
uagguucucuuucaaagca

SEQ ID NO: 370106 - RNA, 24 nt, Human
uauaaaacauagaaaagcuaaaac

SEQ ID NO: 370107 - RNA, 22 nt, Human
uaugcaagaaaucaaaaccaaa

SEQ ID NO: 370108 - RNA, 21 nt, Human
uaugcuaaucacaguaugcag

SEQ ID NO: 370109 - RNA, 22 nt, Human
uaugcuaaucacaguaugcagu

SEQ ID NO: 370110 - RNA, 23 nt, Human
ucguuuuuccacagccauauaaa

SEQ ID NO: 370111 - RNA, 19 nt, Human
ugaaaugcacaaaauacag

SEQ ID NO: 370112 - RNA, 26 nt, Human
ugaccucaaagaaacaauuauuaugc

SEQ ID NO: 370113 - RNA, 23 nt, Human
ugaugaagacaugaaaugcacaa

SEQ ID NO: 370114 - RNA, 21 nt, Human
uggaaagagcuagauggagca

SEQ ID NO: 370115 - RNA, 24 nt, Human
ugggagcgggaacgaguaggggga

SEQ ID NO: 370116 - RNA, 21 nt, Human
uuaggaaaaaaauauuuagau

SEQ ID NO: 370117 - RNA, 24 nt, Human
uuuccacagccauauaaauuuaaa

SEQ ID NO: 370118 - RNA, 22 nt, Human
aaaaaccucgaaaauugccuga

SEQ ID NO: 370119 - RNA, 22 nt, Human
aaacuuuuuuuuaaaucaagaa

SEQ ID NO: 370120 - RNA, 22 nt, Human
aaagaagccauccaauacacua

SEQ ID NO: 370121 - RNA, 21 nt, Human
aaauuagacccacccauagaa

SEQ ID NO: 370122 - RNA, 26 nt, Human
aagacaaaaaucuucucaucugaacc

SEQ ID NO: 370123 - RNA, 25 nt, Human
aaucaagagcaaaaaaauuaagcaa

SEQ ID NO: 370124 - RNA, 20 nt, Human
acccacauauuuuccaucaa

SEQ ID NO: 370125 - RNA, 21 nt, Human
acccagugccuauaugacaaa

SEQ ID NO: 370126 - RNA, 25 nt, Human
accucgaaaauugccugaugaaaaa

SEQ ID NO: 370127 - RNA, 22 nt, Human
acuuuagggagaaggagacgau

SEQ ID NO: 370128 - RNA, 19 nt, Human
agaaauauacuauccaccc

SEQ ID NO: 370129 - RNA, 20 nt, Human
agagcauaaaauggaaaaau

SEQ ID NO: 370130 - RNA, 18 nt, Human
agggagaaggagacgaua

SEQ ID NO: 370131 - RNA, 24 nt, Human
auagaaauauacuauccacccaca

SEQ ID NO: 370132 - RNA, 21 nt, Human
auauuuguguauguguguguu

SEQ ID NO: 370133 - RNA, 19 nt, Human
aucugaacaggugauaaaa

SEQ ID NO: 370134 - RNA, 24 nt, Human
augauauagaaacaacccagugcc

SEQ ID NO: 370135 - RNA, 18 nt, Human
caguagaguaaugcuugc

SEQ ID NO: 370136 - RNA, 21 nt, Human
cagugcuacaaaagacaaaaa

SEQ ID NO: 370137 - RNA, 22 nt, Human
cagugcuacaaaagacaaaaau

SEQ ID NO: 370138 - RNA, 26 nt, Human
caguucuaccaaggaaaaagguccau

SEQ ID NO: 370139 - RNA, 20 nt, Human
caucugaacaggugauaaaa

SEQ ID NO: 370140 - RNA, 22 nt, Human
ccaguggcuuuuaauggcuucu

SEQ ID NO: 370141 - RNA, 23 nt, Human
ccgaacaaauaaaaaccucgaaa

SEQ ID NO: 370142 - RNA, 19 nt, Human
gaacaggugauaaaaccag

SEQ ID NO: 370143 - RNA, 24 nt, Human
gacgaugaugauauagaaacaacc

SEQ ID NO: 370144 - RNA, 18 nt, Human
gagucacccagaguacag

SEQ ID NO: 370145 - RNA, 18 nt, Human
gcuuuuaauggcuucucc

SEQ ID NO: 370146 - RNA, 19 nt, Human
gugauaaaaccaggcacaa

SEQ ID NO: 370147 - RNA, 21 nt, Human
uaaaaccaggcacaaucaaac

SEQ ID NO: 370148 - RNA, 20 nt, Human
uaaccaguggcuuuuaaugg

SEQ ID NO: 370149 - RNA, 20 nt, Human
uacaccaugauaucauaugu

SEQ ID NO: 370150 - RNA, 21 nt, Human
uaccaaauuagacccacccau

SEQ ID NO: 370151 - RNA, 19 nt, Human
uaccaaggaaaaaggucca

SEQ ID NO: 370152 - RNA, 21 nt, Human
uaccacaguguaaaaaaacaa

SEQ ID NO: 370153 - RNA, 27 nt, Human
uaccacaguguaaaaaaacaauaccga

SEQ ID NO: 370154 - RNA, 21 nt, Human
uaggaaagcaccaacaccaca

SEQ ID NO: 370155 - RNA, 23 nt, Human
uaucagugcuacaaaagacaaaa

SEQ ID NO: 370156 - RNA, 21 nt, Human
uauuaggaaagcaccaacacc

SEQ ID NO: 370157 - RNA, 24 nt, Human
ucacuggguagaaaugagacaggg

SEQ ID NO: 370158 - RNA, 25 nt, Human
ucacuggguagaaaugagacagggg

SEQ ID NO: 370159 - RNA, 18 nt, Human
ucccucucugagucaccc

SEQ ID NO: 370160 - RNA, 24 nt, Human
ucugagucacccagaguacagaaa

SEQ ID NO: 370161 - RNA, 20 nt, Human
ugugcaaagaaagcaaagau

SEQ ID NO: 370162 - RNA, 22 nt, Human
uuaccaaauuagacccacccau

SEQ ID NO: 370163 - RNA, 23 nt, Human
uucuucgaaauuacuggaauuuu

SEQ ID NO: 370164 - RNA, 24 nt, Human
uuuuuuuuuuuuuuuuuuuucaag

SEQ ID NO: 370165 - RNA, 23 nt, Human
aaacugaccuuacuaaaauccca

SEQ ID NO: 370166 - RNA, 21 nt, Human
aacacauaacaauuguuuaca

SEQ ID NO: 370167 - RNA, 28 nt, Human
aagaaaacggcacagggagaaaaggacc

SEQ ID NO: 370168 - RNA, 28 nt, Human
aagaaaacggcacagggagaaaaggacc

SEQ ID NO: 370169 - RNA, 21 nt, Human
aagcagaaagaguagacugug

SEQ ID NO: 370170 - RNA, 21 nt, Human
aagcagaaagaguagacugug

SEQ ID NO: 370171 - RNA, 21 nt, Human
aaugcaaauaugguuuuugaa

SEQ ID NO: 370172 - RNA, 21 nt, Human
acacaacauugucuccgaucu

SEQ ID NO: 370173 - RNA, 21 nt, Human
acacaacauugucuccgaucu

SEQ ID NO: 370174 - RNA, 20 nt, Human
acacauaacaauuguuuaca

SEQ ID NO: 370175 - RNA, 22 nt, Human
accagguaacuucccaacugcu

SEQ ID NO: 370176 - RNA, 22 nt, Human
accagguaacuucccaacugcu

SEQ ID NO: 370177 - RNA, 22 nt, Human
agaaaagaaaaaagaugacuaa

SEQ ID NO: 370178 - RNA, 22 nt, Human
agaaaagaaaaaagaugacuaa

SEQ ID NO: 370179 - RNA, 19 nt, Human
agaaaaggacuuaucuggu

SEQ ID NO: 370180 - RNA, 19 nt, Human
agaaaaggacuuaucuggu

SEQ ID NO: 370181 - RNA, 20 nt, Human
agaaaaggacuuaucuggug

SEQ ID NO: 370182 - RNA, 18 nt, Human
agaacuguacaaaacaaa

SEQ ID NO: 370183 - RNA, 25 nt, Human
agcaagaaaacggcacagggagaaa

SEQ ID NO: 370184 - RNA, 25 nt, Human
agcaagaaaacggcacagggagaaa

SEQ ID NO: 370185 - RNA, 25 nt, Human
aggaaaaauaaaaaccugugcuaac

SEQ ID NO: 370186 - RNA, 22 nt, Human
agggagaaaaggacuuaucugg

SEQ ID NO: 370187 - RNA, 22 nt, Human
agggagaaaaggacuuaucugg

SEQ ID NO: 370188 - RNA, 23 nt, Human
auaaaguuacuuccaaaaaaagc

SEQ ID NO: 370189 - RNA, 21 nt, Human
auauaacaacaucuaacagaa

SEQ ID NO: 370190 - RNA, 21 nt, Human
auauaacaacaucuaacagaa

SEQ ID NO: 370191 - RNA, 19 nt, Human
auguagcuguaggaaaaau

SEQ ID NO: 370192 - RNA, 21 nt, Human
caacagcauagcauauaggaa

SEQ ID NO: 370193 - RNA, 21 nt, Human
caacagcauagcauauaggaa

SEQ ID NO: 370194 - RNA, 19 nt, Human
caagaaaacggcacaggga

SEQ ID NO: 370195 - RNA, 19 nt, Human
caagaaaacggcacaggga

SEQ ID NO: 370196 - RNA, 22 nt, Human
cacagcaaguuacauuuaaaca

SEQ ID NO: 370197 - RNA, 18 nt, Human
cacaguauauaacggaac

SEQ ID NO: 370198 - RNA, 19 nt, Human
cacgccucucacauauagu

SEQ ID NO: 370199 - RNA, 19 nt, Human
cacgccucucacauauagu

SEQ ID NO: 370200 - RNA, 18 nt, Human
caggccccgcagcccuga

SEQ ID NO: 370201 - RNA, 22 nt, Human
caggccccgcagcccugaagcc

SEQ ID NO: 370202 - RNA, 27 nt, Human
caggccccgcagcccugaagccgggga

SEQ ID NO: 370203 - RNA, 21 nt, Human
caucuaacagaacuguacaaa

SEQ ID NO: 370204 - RNA, 21 nt, Human
caucuaacagaacuguacaaa

SEQ ID NO: 370205 - RNA, 31 nt, Human
ccaacuuccauccagauaucacgccucucaa

SEQ ID NO: 370206 - RNA, 22 nt, Human
ccaaucaaacugaccuuacuaa

SEQ ID NO: 370207 - RNA, 22 nt, Human
ccagcccaacuuccauccagau

SEQ ID NO: 370208 - RNA, 22 nt, Human
ccagcccaacuuccauccagau

SEQ ID NO: 370209 - RNA, 23 nt, Human
ccagcccaacuuccauccagaua

SEQ ID NO: 370210 - RNA, 23 nt, Human
ccagcccaacuuccauccagaua

SEQ ID NO: 370211 - RNA, 21 nt, Human
cccacagacuauauuuauacc

SEQ ID NO: 370212 - RNA, 19 nt, Human
cccugaagccggggacaaa

SEQ ID NO: 370213 - RNA, 20 nt, Human
ccuccuuccaggccccgcag

SEQ ID NO: 370214 - RNA, 24 nt, Human
cgcagcccugaagccggggacaaa

SEQ ID NO: 370215 - RNA, 21 nt, Human
cgccucggcuccccuggaucg

SEQ ID NO: 370216 - RNA, 19 nt, Human
cggcacagggagaaaagga

SEQ ID NO: 370217 - RNA, 19 nt, Human
cggcacagggagaaaagga

SEQ ID NO: 370218 - RNA, 19 nt, Human
cgugaaaauacucagcaua

SEQ ID NO: 370219 - RNA, 24 nt, Human
cucccacagacuauauuuauaccu

SEQ ID NO: 370220 - RNA, 20 nt, Human
cugaaguauugcuauaugga

SEQ ID NO: 370221 - RNA, 20 nt, Human
cugaaguauugcuauaugga

SEQ ID NO: 370222 - RNA, 18 nt, Human
cuuccaaaaaaagcuaca

SEQ ID NO: 370223 - RNA, 27 nt, Human
cuucuuuguuuuaaauaugcucaggag

SEQ ID NO: 370224 - RNA, 19 nt, Human
cuuuggagaucauccagcc

SEQ ID NO: 370225 - RNA, 19 nt, Human
cuuuggagaucauccagcc

SEQ ID NO: 370226 - RNA, 22 nt, Human
gaagacguguucucuagaucuc

SEQ ID NO: 370227 - RNA, 23 nt, Human
gaucaggagcgcacgacugaaag

SEQ ID NO: 370228 - RNA, 24 nt, Human
uaacaaaaaaguaaaaaaaaaaga

SEQ ID NO: 370229 - RNA, 21 nt, Human
uaacacaacauugucuccgau

SEQ ID NO: 370230 - RNA, 23 nt, Human
uaacagaacuguacaaaacaaag

SEQ ID NO: 370231 - RNA, 23 nt, Human
uaagaugucuuuaagaguugaaa

SEQ ID NO: 370232 - RNA, 23 nt, Human
uaagaugucuuuaagaguugaaa

SEQ ID NO: 370233 - RNA, 27 nt, Human
uacaaggacuacaaacacugcaucaca

SEQ ID NO: 370234 - RNA, 21 nt, Human
uagcgggcuaaucccacauua

SEQ ID NO: 370235 - RNA, 21 nt, Human
uagcgggcuaaucccacauua

SEQ ID NO: 370236 - RNA, 19 nt, Human
uagcuggcuaauucacugu

SEQ ID NO: 370237 - RNA, 19 nt, Human
uagcuggcuaauucacugu

SEQ ID NO: 370238 - RNA, 21 nt, Human
uaggaaaaauaaaaaccugug

SEQ ID NO: 370239 - RNA, 23 nt, Human
uauaacacaacauugucuccgau

SEQ ID NO: 370240 - RNA, 19 nt, Human
uaucaaaugacuuccaaca

SEQ ID NO: 370241 - RNA, 26 nt, Human
uaucaaaugacuuccaacacucuuaa

SEQ ID NO: 370242 - RNA, 26 nt, Human
uaucaaaugacuuccaacacucuuaa

SEQ ID NO: 370243 - RNA, 20 nt, Human
uaucacgccucucacauaua

SEQ ID NO: 370244 - RNA, 20 nt, Human
uaucacgccucucacauaua

SEQ ID NO: 370245 - RNA, 21 nt, Human
ucaacccaaauucugcagcaa

SEQ ID NO: 370246 - RNA, 21 nt, Human
ucaacccaaauucugcagcaa

SEQ ID NO: 370247 - RNA, 19 nt, Human
uccaacauagaaaauaacu

SEQ ID NO: 370248 - RNA, 19 nt, Human
ucccuuugagcaagaaaac

SEQ ID NO: 370249 - RNA, 22 nt, Human
ucccuuugagcaagaaaacggc

SEQ ID NO: 370250 - RNA, 22 nt, Human
ucccuuugagcaagaaaacggc

SEQ ID NO: 370251 - RNA, 19 nt, Human
ucucaaauuauuucaggcc

SEQ ID NO: 370252 - RNA, 20 nt, Human
ucuuuguaagcagaaagagu

SEQ ID NO: 370253 - RNA, 19 nt, Human
ugaaauaaaaccaccuacc

SEQ ID NO: 370254 - RNA, 19 nt, Human
ugaaauaaaaccaccuacc

SEQ ID NO: 370255 - RNA, 22 nt, Human
ugaaauaaaaccaccuaccuaa

SEQ ID NO: 370256 - RNA, 23 nt, Human
ugagugggaugacaagaggagcg

SEQ ID NO: 370257 - RNA, 20 nt, Human
ugcagcaaauaaguuugcuu

SEQ ID NO: 370258 - RNA, 20 nt, Human
ugcagcaaauaaguuugcuu

SEQ ID NO: 370259 - RNA, 20 nt, Human
ugccucaaaaagggaccagg

SEQ ID NO: 370260 - RNA, 20 nt, Human
ugccucaaaaagggaccagg

SEQ ID NO: 370261 - RNA, 20 nt, Human
uggcuuuuuuauauauuuau

SEQ ID NO: 370262 - RNA, 20 nt, Human
uggcuuuuuuauauauuuau

SEQ ID NO: 370263 - RNA, 20 nt, Human
ugguaauacaaugucuucaa

SEQ ID NO: 370264 - RNA, 20 nt, Human
ugguaauacaaugucuucaa

SEQ ID NO: 370265 - RNA, 19 nt, Human
uguagcuguaggaaaaaua

SEQ ID NO: 370266 - RNA, 25 nt, Human
ugucaguaauaccucuucacuaaua

SEQ ID NO: 370267 - RNA, 20 nt, Human
uuagaagacguguucucuag

SEQ ID NO: 370268 - RNA, 22 nt, Human
uuccaaaaaaagcuacauaaau

SEQ ID NO: 370269 - RNA, 18 nt, Human
uuccaggccccgcagccc

SEQ ID NO: 370270 - RNA, 19 nt, Human
uucccuuugagcaagaaaa

SEQ ID NO: 370271 - RNA, 19 nt, Human
uucccuuugagcaagaaaa

SEQ ID NO: 370272 - RNA, 20 nt, Human
uugccaaaaacuguuuauac

SEQ ID NO: 370273 - RNA, 20 nt, Human
uuggagaucauccagcccaa

SEQ ID NO: 370274 - RNA, 20 nt, Human
uuggagaucauccagcccaa

SEQ ID NO: 370275 - RNA, 24 nt, Human
uugguucuggaaugcaaauauggu

SEQ ID NO: 370276 - RNA, 21 nt, Human
uuuaaauaugcucaggaguca

SEQ ID NO: 370277 - RNA, 21 nt, Human
uuuaaauaugcucaggaguca

SEQ ID NO: 370278 - RNA, 22 nt, Human
uuuaaauaugcucaggagucaa

SEQ ID NO: 370279 - RNA, 22 nt, Human
uuuaaauaugcucaggagucaa

SEQ ID NO: 370280 - RNA, 24 nt, Human
uuugaaauaaaaccaccuaccuaa

SEQ ID NO: 370281 - RNA, 21 nt, Human
aaaaaaauuucagcacagcug

SEQ ID NO: 370282 - RNA, 21 nt, Human
aaaaggaaaacgaaagagaga

SEQ ID NO: 370283 - RNA, 22 nt, Human
aaaaggaaaacgaaagagagac

SEQ ID NO: 370284 - RNA, 27 nt, Human
aaaaggaaaacgaaagagagacugagg

SEQ ID NO: 370285 - RNA, 18 nt, Human
aaacgaaagagagacuga

SEQ ID NO: 370286 - RNA, 21 nt, Human
agcgcuccccugcgccgcgcc

SEQ ID NO: 370287 - RNA, 21 nt, Human
cacccgagcgcuccccugcgc

SEQ ID NO: 370288 - RNA, 23 nt, Human
ccgggcccaggagcugcacacuc

SEQ ID NO: 370289 - RNA, 23 nt, Human
cgccgccuccuccucuuccucug

SEQ ID NO: 370290 - RNA, 22 nt, Human
cgccgcgccuccgcgacgggcc

SEQ ID NO: 370291 - RNA, 25 nt, Human
cgccuccuccucuuccucuggaaga

SEQ ID NO: 370292 - RNA, 21 nt, Human
cggaggguugggggaagggaa

SEQ ID NO: 370293 - RNA, 25 nt, Human
cguucugcucuuccgcggggcucua

SEQ ID NO: 370294 - RNA, 20 nt, Human
cuccgcgacgggccugagcc

SEQ ID NO: 370295 - RNA, 21 nt, Human
gacucccacccgagcgcuccc

SEQ ID NO: 370296 - RNA, 25 nt, Human
gaugucuuuaaaugacauaacaauu

SEQ ID NO: 370297 - RNA, 21 nt, Human
gcgacgggccugagccgggcc

SEQ ID NO: 370298 - RNA, 24 nt, Human
gcgccgcgccuccgcgacgggccu

SEQ ID NO: 370299 - RNA, 22 nt, Human
ggccugagccgggcccaggagc

SEQ ID NO: 370300 - RNA, 21 nt, Human
gggccugagccgggcccagga

SEQ ID NO: 370301 - RNA, 23 nt, Human
gggcggggccagacgggucacug

SEQ ID NO: 370302 - RNA, 22 nt, Human
guucugcucuuccgcggggcuc

SEQ ID NO: 370303 - RNA, 23 nt, Human
uaaugauaaaaaaauuucagcac

SEQ ID NO: 370304 - RNA, 18 nt, Human
ucacugaggucaaggaag

SEQ ID NO: 370305 - RNA, 21 nt, Human
ucaguaaacagaugaaccuga

SEQ ID NO: 370306 - RNA, 21 nt, Human
uccaggacgacgaccuacgcc

SEQ ID NO: 370307 - RNA, 23 nt, Human
ucgcaauaaacugguggaggagc

SEQ ID NO: 370308 - RNA, 19 nt, Human
ucugcucuuccgcggggcu

SEQ ID NO: 370309 - RNA, 18 nt, Human
ugacauaacaauugagca

SEQ ID NO: 370310 - RNA, 22 nt, Human
ugauaaaaaaauuucagcacag

SEQ ID NO: 370311 - RNA, 20 nt, Human
uuagagaagggcggaggguu

SEQ ID NO: 370312 - RNA, 18 nt, Human
uuccaccggcgcuuaccu

SEQ ID NO: 370313 - RNA, 19 nt, Human
uggaaaguuggcaaaagca

SEQ ID NO: 370314 - RNA, 19 nt, Human
uggaaaguuggcaaaagca

SEQ ID NO: 370315 - RNA, 19 nt, Human
uuuuuuucuuuuugccccu

SEQ ID NO: 370316 - RNA, 19 nt, Human
aaaccgaagccggaaggcg

SEQ ID NO: 370317 - RNA, 26 nt, Human
aaaccgaagccggaaggcgaaaugcg

SEQ ID NO: 370318 - RNA, 25 nt, Human
acacaaccuaaaauaagggggaacc

SEQ ID NO: 370319 - RNA, 18 nt, Human
acccgauccucaggaugg

SEQ ID NO: 370320 - RNA, 21 nt, Human
acccgauccucaggauggcgc

SEQ ID NO: 370321 - RNA, 22 nt, Human
agggaucaggagggcuggggcg

SEQ ID NO: 370322 - RNA, 20 nt, Human
agggguagggaggguggggu

SEQ ID NO: 370323 - RNA, 24 nt, Human
auacaaaaacaaaacacaaccuaa

SEQ ID NO: 370324 - RNA, 21 nt, Human
caaaacacaaccuaaaauaag

SEQ ID NO: 370325 - RNA, 24 nt, Human
caccuggaagcccccacuccaccc

SEQ ID NO: 370326 - RNA, 19 nt, Human
cagaggcgggcggccggag

SEQ ID NO: 370327 - RNA, 26 nt, Human
ccaccuggaagcccccacuccacccc

SEQ ID NO: 370328 - RNA, 21 nt, Human
ccccacuccacccccacccga

SEQ ID NO: 370329 - RNA, 21 nt, Human
ccccagagacuggggaggggu

SEQ ID NO: 370330 - RNA, 25 nt, Human
cccccacuccacccccacccgaucc

SEQ ID NO: 370331 - RNA, 19 nt, Human
ccgauccucaggauggcgc

SEQ ID NO: 370332 - RNA, 22 nt, Human
ccgccgccgccgccgcagacga

SEQ ID NO: 370333 - RNA, 21 nt, Human
ccucagccgccgccgccgccg

SEQ ID NO: 370334 - RNA, 18 nt, Human
cgccgccgccgccgcaga

SEQ ID NO: 370335 - RNA, 19 nt, Human
cgugggagccgugugcuga

SEQ ID NO: 370336 - RNA, 22 nt, Human
cucaacaaauggaaugugugcc

SEQ ID NO: 370337 - RNA, 18 nt, Human
cugaccccagagacuggg

SEQ ID NO: 370338 - RNA, 20 nt, Human
cuguccccucgccucugucc

SEQ ID NO: 370339 - RNA, 24 nt, Human
gaagauggaggagaggcggcccaa

SEQ ID NO: 370340 - RNA, 24 nt, Human
gaagcccccacuccacccccaccc

SEQ ID NO: 370341 - RNA, 19 nt, Human
gaagccggaaggcgaaaug

SEQ ID NO: 370342 - RNA, 19 nt, Human
gacgacgaccaggccgccc

SEQ ID NO: 370343 - RNA, 25 nt, Human
gagggugggguggggggcaggacug

SEQ ID NO: 370344 - RNA, 18 nt, Human
gcccccacuccaccccca

SEQ ID NO: 370345 - RNA, 21 nt, Human
gccgagggaaaccgaagccgg

SEQ ID NO: 370346 - RNA, 25 nt, Human
gcggccggagccgggcugcgaggga

SEQ ID NO: 370347 - RNA, 18 nt, Human
ggcggggccggggcgugc

SEQ ID NO: 370348 - RNA, 21 nt, Human
gggaagggccaccuggaagcc

SEQ ID NO: 370349 - RNA, 22 nt, Human
gggagggugggguggggggcag

SEQ ID NO: 370350 - RNA, 18 nt, Human
gggcggggccggggcgug

SEQ ID NO: 370351 - RNA, 23 nt, Human
gggcuggggcggggccggggcgu

SEQ ID NO: 370352 - RNA, 25 nt, Human
ggggcaggacuggggcucaacaaau

SEQ ID NO: 370353 - RNA, 18 nt, Human
gggguagggagggugggg

SEQ ID NO: 370354 - RNA, 22 nt, Human
gugggguggggggcaggacugg

SEQ ID NO: 370355 - RNA, 19 nt, Human
uaagguuucuuccugaccc

SEQ ID NO: 370356 - RNA, 20 nt, Human
uacaaaaacaaaacacaacc

SEQ ID NO: 370357 - RNA, 20 nt, Human
uagcccugccuggggcuccu

SEQ ID NO: 370358 - RNA, 22 nt, Human
uauacaaaaacaaaacacaacc

SEQ ID NO: 370359 - RNA, 21 nt, Human
ucagccgggcuccucagccgc

SEQ ID NO: 370360 - RNA, 25 nt, Human
uccucagccgccgccgccgccgcag

SEQ ID NO: 370361 - RNA, 18 nt, Human
ucuuccugaccccagaga

SEQ ID NO: 370362 - RNA, 18 nt, Human
ugccuggggcuccuauac

SEQ ID NO: 370363 - RNA, 22 nt, Human
ugccuggggcuccuauacaaaa

SEQ ID NO: 370364 - RNA, 18 nt, Human
uggggagggguagggagg

SEQ ID NO: 370365 - RNA, 24 nt, Human
uggggcucaacaaauggaaugugu

SEQ ID NO: 370366 - RNA, 25 nt, Human
ugggguggggggcaggacuggggcu

SEQ ID NO: 370367 - RNA, 24 nt, Human
uguugccuuuuauuuaaaaacugu

SEQ ID NO: 370368 - RNA, 21 nt, Human
uuccugaccccagagacuggg

SEQ ID NO: 370369 - RNA, 18 nt, Human
uugaacaugaccuguugc

SEQ ID NO: 370370 - RNA, 19 nt, Human
aaaacacccuuuccccaca

SEQ ID NO: 370371 - RNA, 22 nt, Human
aaaacacucacccccaauccaa

SEQ ID NO: 370372 - RNA, 23 nt, Human
aaaacccugugauagauggaaug

SEQ ID NO: 370373 - RNA, 21 nt, Human
aaacaaaacacucacccccaa

SEQ ID NO: 370374 - RNA, 23 nt, Human
aaacacucacccccaauccaaug

SEQ ID NO: 370375 - RNA, 24 nt, Human
aaaccaagcucuaccaaaaacacc

SEQ ID NO: 370376 - RNA, 25 nt, Human
aaaccagagccagcaggccuaggga

SEQ ID NO: 370377 - RNA, 22 nt, Human
aaagacaugaaaagaaaaagcc

SEQ ID NO: 370378 - RNA, 21 nt, Human
aaagaccugagguuacaaggg

SEQ ID NO: 370379 - RNA, 22 nt, Human
aaagccaccacuuauacugaaa

SEQ ID NO: 370380 - RNA, 21 nt, Human
aaagcucacacugcccccaga

SEQ ID NO: 370381 - RNA, 20 nt, Human
aaccaagcucuaccaaaaac

SEQ ID NO: 370382 - RNA, 18 nt, Human
aaccagagccagcaggcc

SEQ ID NO: 370383 - RNA, 18 nt, Human
aaccagagccagcaggcc

SEQ ID NO: 370384 - RNA, 24 nt, Human
aacccucaaagcucacacugcccc

SEQ ID NO: 370385 - RNA, 22 nt, Human
aagagagcaaaaaugguaaaga

SEQ ID NO: 370386 - RNA, 25 nt, Human
aagagggagaaaaaaaugcacacaa

SEQ ID NO: 370387 - RNA, 20 nt, Human
aagaguccagaacaaaaaca

SEQ ID NO: 370388 - RNA, 21 nt, Human
aagaguccagaacaaaaacaa

SEQ ID NO: 370389 - RNA, 23 nt, Human
aagcaaaaaacugcaagagagca

SEQ ID NO: 370390 - RNA, 22 nt, Human
aagcagaaauaaggucacuuau

SEQ ID NO: 370391 - RNA, 24 nt, Human
aagccaggcgcuuuggaaaccaag

SEQ ID NO: 370392 - RNA, 18 nt, Human
aaggacagaagggaggga

SEQ ID NO: 370393 - RNA, 20 nt, Human
aauaacagaaagauaaaaag

SEQ ID NO: 370394 - RNA, 18 nt, Human
acaaagcaaaaaacugca

SEQ ID NO: 370395 - RNA, 22 nt, Human
acaaagcaaaaaacugcaagag

SEQ ID NO: 370396 - RNA, 23 nt, Human
acaaagcaaaaaacugcaagaga

SEQ ID NO: 370397 - RNA, 20 nt, Human
accaaaaacacccuuucccc

SEQ ID NO: 370398 - RNA, 23 nt, Human
accaagcucuaccaaaaacaccc

SEQ ID NO: 370399 - RNA, 18 nt, Human
acccaagaaaguugagga

SEQ ID NO: 370400 - RNA, 19 nt, Human
acccucagcaucucuuuga

SEQ ID NO: 370401 - RNA, 20 nt, Human
agaaaaagauauccaaaaga

SEQ ID NO: 370402 - RNA, 18 nt, Human
agaaaagcagaaauaagg

SEQ ID NO: 370403 - RNA, 18 nt, Human
agacaugaaaagaaaaag

SEQ ID NO: 370404 - RNA, 23 nt, Human
agagaggggugguaagaggagug

SEQ ID NO: 370405 - RNA, 24 nt, Human
agagccagcaggccuagggaagga

SEQ ID NO: 370406 - RNA, 21 nt, Human
agaggaguggggaggcacggg

SEQ ID NO: 370407 - RNA, 20 nt, Human
agcaggccuagggaaggagc

SEQ ID NO: 370408 - RNA, 22 nt, Human
aggaaaaaaccgggaacucuca

SEQ ID NO: 370409 - RNA, 18 nt, Human
aggaaaaaaguucucaag

SEQ ID NO: 370410 - RNA, 18 nt, Human
aggacaagaggaaaaaac

SEQ ID NO: 370411 - RNA, 24 nt, Human
aggcacuggggucuuucuggagcc

SEQ ID NO: 370412 - RNA, 20 nt, Human
agggagggaaggacaagagg

SEQ ID NO: 370413 - RNA, 21 nt, Human
aggggugguaagaggaguggg

SEQ ID NO: 370414 - RNA, 22 nt, Human
aguaaaaauauuuccaccugga

SEQ ID NO: 370415 - RNA, 22 nt, Human
auaaacucauucucauuuccac

SEQ ID NO: 370416 - RNA, 18 nt, Human
auccaaaagauguccacc

SEQ ID NO: 370417 - RNA, 20 nt, Human
auccccacuccagcucaugg

SEQ ID NO: 370418 - RNA, 20 nt, Human
caacacaaaaagugucagaa

SEQ ID NO: 370419 - RNA, 23 nt, Human
cacacugagaaacauguuuguac

SEQ ID NO: 370420 - RNA, 18 nt, Human
cacagccuggcccacccc

SEQ ID NO: 370421 - RNA, 23 nt, Human
cacagccuggcccaccccggccc

SEQ ID NO: 370422 - RNA, 18 nt, Human
cacaguaugaaccagaau

SEQ ID NO: 370423 - RNA, 20 nt, Human
caccccaaaccucaaagcau

SEQ ID NO: 370424 - RNA, 21 nt, Human
cacugcccccagaaaaacaaa

SEQ ID NO: 370425 - RNA, 20 nt, Human
cagaacaaaaacaaaaggac

SEQ ID NO: 370426 - RNA, 18 nt, Human
cagagccagcaggccuag

SEQ ID NO: 370427 - RNA, 24 nt, Human
cauucuaaauaaugaaacugccac

SEQ ID NO: 370428 - RNA, 22 nt, Human
ccaaugaaucaucugcauagaa

SEQ ID NO: 370429 - RNA, 18 nt, Human
ccacugccgcuucccggc

SEQ ID NO: 370430 - RNA, 23 nt, Human
ccacugccgcuucccggccccgc

SEQ ID NO: 370431 - RNA, 23 nt, Human
ccagaacaaaaacaaaaggacca

SEQ ID NO: 370432 - RNA, 19 nt, Human
cccaagaaaguugaggaac

SEQ ID NO: 370433 - RNA, 21 nt, Human
ccccaaaccucaaagcaugau

SEQ ID NO: 370434 - RNA, 26 nt, Human
ccccaauccaaugaaucaucugcaua

SEQ ID NO: 370435 - RNA, 18 nt, Human
ccccagaaaaacaaaaca

SEQ ID NO: 370436 - RNA, 19 nt, Human
ccccagaaaaacaaaacac

SEQ ID NO: 370437 - RNA, 23 nt, Human
cccccaauccaaugaaucaucug

SEQ ID NO: 370438 - RNA, 18 nt, Human
cccccagaaaaacaaaac

SEQ ID NO: 370439 - RNA, 19 nt, Human
cccccagaaaaacaaaaca

SEQ ID NO: 370440 - RNA, 24 nt, Human
cccccagaaaaacaaaacacucac

SEQ ID NO: 370441 - RNA, 19 nt, Human
cccccccuucugcccauca

SEQ ID NO: 370442 - RNA, 21 nt, Human
cccgcgcgcacccccgcgcgc

SEQ ID NO: 370443 - RNA, 22 nt, Human
cccgcgcgcacccccgcgcgcg

SEQ ID NO: 370444 - RNA, 29 nt, Human
cccgcgcgcacccccgcgcgcguagccgg

SEQ ID NO: 370445 - RNA, 19 nt, Human
cccgcgcgcguagccgcca

SEQ ID NO: 370446 - RNA, 25 nt, Human
cccgcgcgcguagccgccacugccg

SEQ ID NO: 370447 - RNA, 24 nt, Human
cccgucccauccuaaccuuaaaag

SEQ ID NO: 370448 - RNA, 23 nt, Human
cccucagcaucucuuugaaaacc

SEQ ID NO: 370449 - RNA, 18 nt, Human
ccucaaagcucacacugc

SEQ ID NO: 370450 - RNA, 18 nt, Human
ccucccagccugagcacc

SEQ ID NO: 370451 - RNA, 19 nt, Human
ccucccagccugagcaccc

SEQ ID NO: 370452 - RNA, 24 nt, Human
ccucccagccugagcaccccaaac

SEQ ID NO: 370453 - RNA, 24 nt, Human
ccuggcccaccccggcccucgcgg

SEQ ID NO: 370454 - RNA, 22 nt, Human
cgcgcgcacccccgcgcgcgua

SEQ ID NO: 370455 - RNA, 23 nt, Human
cggacuccaggggaaaaaagaag

SEQ ID NO: 370456 - RNA, 18 nt, Human
cucagaaauggaagggag

SEQ ID NO: 370457 - RNA, 27 nt, Human
cucccaauauuccaacccucaaagcuu

SEQ ID NO: 370458 - RNA, 18 nt, Human
cucccagccugagcaccc

SEQ ID NO: 370459 - RNA, 23 nt, Human
cucccuccccucauuuuuuccaa

SEQ ID NO: 370460 - RNA, 24 nt, Human
cuccucuagcacauacuaguucag

SEQ ID NO: 370461 - RNA, 21 nt, Human
cucucauauguaaagcuuuag

SEQ ID NO: 370462 - RNA, 20 nt, Human
cugaaauauaacaguguuaa

SEQ ID NO: 370463 - RNA, 23 nt, Human
cugccaggcaguguggaggcccu

SEQ ID NO: 370464 - RNA, 19 nt, Human
cugcccccagaaaaacaaa

SEQ ID NO: 370465 - RNA, 18 nt, Human
gaaaagaaaaagccacca

SEQ ID NO: 370466 - RNA, 21 nt, Human
gaacaaaaacaaaaggaccaa

SEQ ID NO: 370467 - RNA, 20 nt, Human
gacaaagcaaaaaacugcaa

SEQ ID NO: 370468 - RNA, 18 nt, Human
gacaagaggaaaaaaccg

SEQ ID NO: 370469 - RNA, 22 nt, Human
gagaagaaaaauccugaaagaa

SEQ ID NO: 370470 - RNA, 22 nt, Human
gagccaaaugcauuggaacuaa

SEQ ID NO: 370471 - RNA, 20 nt, Human
gcaggaaguagguaaaaccc

SEQ ID NO: 370472 - RNA, 18 nt, Human
gccacugccgcuucccgg

SEQ ID NO: 370473 - RNA, 20 nt, Human
gcccuccucuagcacauacu

SEQ ID NO: 370474 - RNA, 18 nt, Human
gccgccacugccgcuucc

SEQ ID NO: 370475 - RNA, 21 nt, Human
gcuaaaguugacaggaccugc

SEQ ID NO: 370476 - RNA, 18 nt, Human
gcucugacugccaaguga

SEQ ID NO: 370477 - RNA, 19 nt, Human
gcuucccggccccgcccag

SEQ ID NO: 370478 - RNA, 23 nt, Human
ggaaaaaaccgggaacucucaag

SEQ ID NO: 370479 - RNA, 24 nt, Human
ggacaggggagaugcagguuauuu

SEQ ID NO: 370480 - RNA, 22 nt, Human
ggacuuguacccccagccaucc

SEQ ID NO: 370481 - RNA, 18 nt, Human
ggcuagacucauuggggg

SEQ ID NO: 370482 - RNA, 27 nt, Human
uaaaacaauaauaacagaaagauaaaa

SEQ ID NO: 370483 - RNA, 19 nt, Human
uaaagaccugagguuacaa

SEQ ID NO: 370484 - RNA, 18 nt, Human
uaacaagagguaguuugg

SEQ ID NO: 370485 - RNA, 22 nt, Human
uaaccaaguuucaugagcuaaa

SEQ ID NO: 370486 - RNA, 20 nt, Human
uaacuuaggaugcucuccuu

SEQ ID NO: 370487 - RNA, 18 nt, Human
uaagacaaagcaaaaaac

SEQ ID NO: 370488 - RNA, 23 nt, Human
uaagacaaagcaaaaaacugcaa

SEQ ID NO: 370489 - RNA, 23 nt, Human
uacaagggaccacaguaugaacc

SEQ ID NO: 370490 - RNA, 22 nt, Human
uaccaucagcaccauucuuagc

SEQ ID NO: 370491 - RNA, 23 nt, Human
uagcacauacuaguucaguggua

SEQ ID NO: 370492 - RNA, 21 nt, Human
uauaacaguguuaagaauuca

SEQ ID NO: 370493 - RNA, 23 nt, Human
uaugaaccagaauuccauuuucc

SEQ ID NO: 370494 - RNA, 22 nt, Human
uauuccaacccucaaagcucac

SEQ ID NO: 370495 - RNA, 25 nt, Human
uccaacccucaaagcucacacugcc

SEQ ID NO: 370496 - RNA, 23 nt, Human
ucccagccugagcaccccaaacc

SEQ ID NO: 370497 - RNA, 24 nt, Human
ugaccagggcacacugucgcggac

SEQ ID NO: 370498 - RNA, 23 nt, Human
ugaccagggcacacugucgcggc

SEQ ID NO: 370499 - RNA, 18 nt, Human
ugacgaaauuccacuccc

SEQ ID NO: 370500 - RNA, 26 nt, Human
ugagaaacauguuuguacaaaaacca

SEQ ID NO: 370501 - RNA, 21 nt, Human
ugagaagaaaaauccugaaag

SEQ ID NO: 370502 - RNA, 21 nt, Human
ugccaggcaguguggaggccc

SEQ ID NO: 370503 - RNA, 22 nt, Human
ugcccuccucuagcacauacua

SEQ ID NO: 370504 - RNA, 22 nt, Human
ugccucccaauauuccaacccu

SEQ ID NO: 370505 - RNA, 20 nt, Human
ugcuucacuuuucccguccc

SEQ ID NO: 370506 - RNA, 23 nt, Human
uggaagggagaagguauaaggag

SEQ ID NO: 370507 - RNA, 22 nt, Human
uggaaugaguuuccuuuggggg

SEQ ID NO: 370508 - RNA, 22 nt, Human
uggaggcccucagaggccucac

SEQ ID NO: 370509 - RNA, 23 nt, Human
uggcuauucccccccuucugccc

SEQ ID NO: 370510 - RNA, 20 nt, Human
ugggaaagacuggcaggaag

SEQ ID NO: 370511 - RNA, 21 nt, Human
ugggggguaauuacccuagac

SEQ ID NO: 370512 - RNA, 21 nt, Human
ugguaagaggaguggggaggc

SEQ ID NO: 370513 - RNA, 22 nt, Human
ugguuagaggcaaaccugaggg

SEQ ID NO: 370514 - RNA, 21 nt, Human
uguagaauuauuacuauagua

SEQ ID NO: 370515 - RNA, 20 nt, Human
ugugauagauggaaugugag

SEQ ID NO: 370516 - RNA, 23 nt, Human
uguuaagaauucagguauuuugu

SEQ ID NO: 370517 - RNA, 24 nt, Human
uguuuuauaaacaccucccuauac

SEQ ID NO: 370518 - RNA, 25 nt, Human
uuagcacuaucuacuuuuuuuuuuc

SEQ ID NO: 370519 - RNA, 25 nt, Human
uucucaaguguuuuauaaacaccuc

SEQ ID NO: 370520 - RNA, 19 nt, Human
uugacgaaauuccacuccc

SEQ ID NO: 370521 - RNA, 18 nt, Human
uuggaaugaguuuccuuu

SEQ ID NO: 370522 - RNA, 28 nt, Human
uuuaaaacaauaauaacagaaagauaaa

SEQ ID NO: 370523 - RNA, 21 nt, Human
uuuaaagagggagaaaaaaau

SEQ ID NO: 370524 - RNA, 23 nt, Human
uuuauaaacaccucccuauaccc

SEQ ID NO: 370525 - RNA, 24 nt, Human
uuuguguguggcaaaagucucaaa

SEQ ID NO: 370526 - RNA, 24 nt, Human
uuuuaaaggguuuuuuaaagaggg

SEQ ID NO: 370527 - RNA, 19 nt, Human
aaacaccuuucaccagccc

SEQ ID NO: 370528 - RNA, 22 nt, Human
aaacagaaguccuugaauaauc

SEQ ID NO: 370529 - RNA, 18 nt, Human
aguggugggggaagggcu

SEQ ID NO: 370530 - RNA, 18 nt, Human
ccacagggggugaggggg

SEQ ID NO: 370531 - RNA, 23 nt, Human
ccauccuauccucucucccagac

SEQ ID NO: 370532 - RNA, 23 nt, Human
cccauccuauccucucucccaga

SEQ ID NO: 370533 - RNA, 24 nt, Human
ccggcucgggccccgccgccgccc

SEQ ID NO: 370534 - RNA, 27 nt, Human
gcggaaggagcuuuccuuacguagugg

SEQ ID NO: 370535 - RNA, 25 nt, Human
ggaaggagcuuuccuuacguagugg

SEQ ID NO: 370536 - RNA, 23 nt, Human
ggcuuuggaggggcggaaggagc

SEQ ID NO: 370537 - RNA, 25 nt, Human
gggcuuuggaggggcggaaggagcu

SEQ ID NO: 370538 - RNA, 23 nt, Human
uaauagaaccuuguauaaacacc

SEQ ID NO: 370539 - RNA, 20 nt, Human
uagaaccuuguauaaacacc

SEQ ID NO: 370540 - RNA, 22 nt, Human
ucccauccuauccucucuccca

SEQ ID NO: 370541 - RNA, 25 nt, Human
ucccauccuauccucucucccagac

SEQ ID NO: 370542 - RNA, 19 nt, Human
ucuccaggcuggggagggu

SEQ ID NO: 370543 - RNA, 25 nt, Human
uuaaacagaaguccuugaauaaucu

SEQ ID NO: 370544 - RNA, 21 nt, Human
uuacguagugaugaacucucc

SEQ ID NO: 370545 - RNA, 18 nt, Human
uuagaagugguuaauaga

SEQ ID NO: 370546 - RNA, 21 nt, Human
uuuggaggggcggaaggagcu

SEQ ID NO: 370547 - RNA, 25 nt, Human
aaaaaacaauucaguuaauaaaaac

SEQ ID NO: 370548 - RNA, 23 nt, Human
aaaccaucucagauccaaggggc

SEQ ID NO: 370549 - RNA, 21 nt, Human
aaccggaaccggaacuccccc

SEQ ID NO: 370550 - RNA, 20 nt, Human
aacgccccaagcaagaccaa

SEQ ID NO: 370551 - RNA, 20 nt, Human
aagaccaaggcagauacuau

SEQ ID NO: 370552 - RNA, 24 nt, Human
aagcucccaacuccugggucucug

SEQ ID NO: 370553 - RNA, 21 nt, Human
aaggggccaagaucacaaggu

SEQ ID NO: 370554 - RNA, 18 nt, Human
aaguacugagcuuccuuc

SEQ ID NO: 370555 - RNA, 24 nt, Human
aauaaggggacaguacaaaaaaaa

SEQ ID NO: 370556 - RNA, 25 nt, Human
acaaaaaaaaguuugguccaugaaa

SEQ ID NO: 370557 - RNA, 22 nt, Human
acagggcaacaagugaagggag

SEQ ID NO: 370558 - RNA, 21 nt, Human
accaacagcauccccuggaac

SEQ ID NO: 370559 - RNA, 22 nt, Human
accuggccugaggcccaaucca

SEQ ID NO: 370560 - RNA, 20 nt, Human
acucauuaccacuacauguu

SEQ ID NO: 370561 - RNA, 27 nt, Human
acuccccccgccccccgagcgcccccc

SEQ ID NO: 370562 - RNA, 18 nt, Human
agaaggagcgaaagcucc

SEQ ID NO: 370563 - RNA, 22 nt, Human
agacaagggacaggaagacagg

SEQ ID NO: 370564 - RNA, 23 nt, Human
agacaagggacaggaagacaggg

SEQ ID NO: 370565 - RNA, 20 nt, Human
agagugcccacaggccugag

SEQ ID NO: 370566 - RNA, 25 nt, Human
agcacagggcccaaaucaagaauuu

SEQ ID NO: 370567 - RNA, 19 nt, Human
agccacagacuggaaaccc

SEQ ID NO: 370568 - RNA, 22 nt, Human
agcccuaggcgcuuucacuccu

SEQ ID NO: 370569 - RNA, 20 nt, Human
aggaagacagggauggccca

SEQ ID NO: 370570 - RNA, 21 nt, Human
aggaagacagggauggcccag

SEQ ID NO: 370571 - RNA, 20 nt, Human
aggaaggggaagacggggag

SEQ ID NO: 370572 - RNA, 20 nt, Human
aggaggccccggaguuccgc

SEQ ID NO: 370573 - RNA, 18 nt, Human
aggcagggagagggaaga

SEQ ID NO: 370574 - RNA, 19 nt, Human
aggcgcuuucacuccucag

SEQ ID NO: 370575 - RNA, 21 nt, Human
agggaaggaaggaaauuggau

SEQ ID NO: 370576 - RNA, 23 nt, Human
agggaaggaaggaaauuggauuc

SEQ ID NO: 370577 - RNA, 22 nt, Human
agggagcaauaaagaacaaaac

SEQ ID NO: 370578 - RNA, 24 nt, Human
agggauggcccagggcuuuuuacc

SEQ ID NO: 370579 - RNA, 19 nt, Human
agggauuuggggguggggg

SEQ ID NO: 370580 - RNA, 20 nt, Human
aguuuguuccaaaccugugg

SEQ ID NO: 370581 - RNA, 18 nt, Human
aucugagggaaucacaaa

SEQ ID NO: 370582 - RNA, 23 nt, Human
augaggcaggcagcacagggccc

SEQ ID NO: 370583 - RNA, 20 nt, Human
caaagaaccggaaccggaac

SEQ ID NO: 370584 - RNA, 21 nt, Human
caacucagcgcuauucuccag

SEQ ID NO: 370585 - RNA, 21 nt, Human
caagaccaaggcagauacuau

SEQ ID NO: 370586 - RNA, 22 nt, Human
caaggcagcagccgcgcccgcc

SEQ ID NO: 370587 - RNA, 19 nt, Human
caauccauuccaagcacuc

SEQ ID NO: 370588 - RNA, 18 nt, Human
cacugacagcaggccaac

SEQ ID NO: 370589 - RNA, 22 nt, Human
cagcacagggcccaaaucaaga

SEQ ID NO: 370590 - RNA, 27 nt, Human
cagcacagggcccaaaucaagaauuuu

SEQ ID NO: 370591 - RNA, 21 nt, Human
cagcagccgcgcccgccccuc

SEQ ID NO: 370592 - RNA, 18 nt, Human
cagcaggaaggaacagcc

SEQ ID NO: 370593 - RNA, 23 nt, Human
cagcccuaggcgcuuucacuccu

SEQ ID NO: 370594 - RNA, 24 nt, Human
cagccgcgcccgccccuccugagg

SEQ ID NO: 370595 - RNA, 20 nt, Human
cagcugccccaagguugucc

SEQ ID NO: 370596 - RNA, 18 nt, Human
caggaaggaacagccucu

SEQ ID NO: 370597 - RNA, 20 nt, Human
cagugucaaccuuucaaggg

SEQ ID NO: 370598 - RNA, 20 nt, Human
caucaauaaggggacaguac

SEQ ID NO: 370599 - RNA, 22 nt, Human
ccaagaucaacuagcuuauaga

SEQ ID NO: 370600 - RNA, 23 nt, Human
ccaaggcagauacuaugaggcag

SEQ ID NO: 370601 - RNA, 20 nt, Human
cccacccaaaugcccgggau

SEQ ID NO: 370602 - RNA, 28 nt, Human
ccccccgccccccgagcgccccccgagc

SEQ ID NO: 370603 - RNA, 19 nt, Human
ccccggaguuccgcccggg

SEQ ID NO: 370604 - RNA, 21 nt, Human
ccccggaguuccgcccgggcc

SEQ ID NO: 370605 - RNA, 22 nt, Human
ccccuugaagaccaccuggccu

SEQ ID NO: 370606 - RNA, 18 nt, Human
cccgccccccgagcgccc

SEQ ID NO: 370607 - RNA, 20 nt, Human
cccgccccuccugaggcucc

SEQ ID NO: 370608 - RNA, 18 nt, Human
ccgccccccgagcgcccc

SEQ ID NO: 370609 - RNA, 20 nt, Human
ccgccccccgagcgcccccc

SEQ ID NO: 370610 - RNA, 20 nt, Human
ccgcccgggccgccaucuuc

SEQ ID NO: 370611 - RNA, 18 nt, Human
ccgcgcccgccccuccug

SEQ ID NO: 370612 - RNA, 24 nt, Human
ccgcgcccgccccuccugaggcuc

SEQ ID NO: 370613 - RNA, 20 nt, Human
ccggaaccggaacucccccc

SEQ ID NO: 370614 - RNA, 21 nt, Human
ccugugaggcagggagaggga

SEQ ID NO: 370615 - RNA, 18 nt, Human
cgccccccgagcgccccc

SEQ ID NO: 370616 - RNA, 18 nt, Human
cgcccgggcccaaggcag

SEQ ID NO: 370617 - RNA, 21 nt, Human
cgcccgggcccaaggcagcag

SEQ ID NO: 370618 - RNA, 22 nt, Human
cgcccgggcccaaggcagcagc

SEQ ID NO: 370619 - RNA, 24 nt, Human
cggaaccggaacuccccccgcccc

SEQ ID NO: 370620 - RNA, 25 nt, Human
cggaaccggaacuccccccgccccc

SEQ ID NO: 370621 - RNA, 23 nt, Human
cuacagggcaacaagugaaggga

SEQ ID NO: 370622 - RNA, 21 nt, Human
cuagagguccuauguagaccg

SEQ ID NO: 370623 - RNA, 22 nt, Human
cucagcugccccaagguugucc

SEQ ID NO: 370624 - RNA, 21 nt, Human
cucccaacuccugggucucug

SEQ ID NO: 370625 - RNA, 20 nt, Human
cuccuggaaagaugcaaaaa

SEQ ID NO: 370626 - RNA, 20 nt, Human
cuggccugaggcccaaucca

SEQ ID NO: 370627 - RNA, 18 nt, Human
cuugugagacccucuuca

SEQ ID NO: 370628 - RNA, 20 nt, Human
cuuugugcccagcugucucc

SEQ ID NO: 370629 - RNA, 23 nt, Human
cuuugugcccagcugucucccac

SEQ ID NO: 370630 - RNA, 19 nt, Human
gaaccaacagcauccccug

SEQ ID NO: 370631 - RNA, 21 nt, Human
gaaccggaaccggaacucccc

SEQ ID NO: 370632 - RNA, 26 nt, Human
gagacccucuucauucuggggcacuc

SEQ ID NO: 370633 - RNA, 19 nt, Human
gaggggguggggaagcagg

SEQ ID NO: 370634 - RNA, 20 nt, Human
gaugcagaggcaggguggag

SEQ ID NO: 370635 - RNA, 18 nt, Human
gauuugggggugggggug

SEQ ID NO: 370636 - RNA, 23 nt, Human
gccaagaucaacuagcuuauaga

SEQ ID NO: 370637 - RNA, 18 nt, Human
gccccccgagcgcccccc

SEQ ID NO: 370638 - RNA, 20 nt, Human
gccugaggcccaauccauuc

SEQ ID NO: 370639 - RNA, 23 nt, Human
ggaaccggaacuccccccgcccc

SEQ ID NO: 370640 - RNA, 25 nt, Human
ggaacuccccccgccccccgagcgc

SEQ ID NO: 370641 - RNA, 21 nt, Human
ggaagacggggagaaaauucu

SEQ ID NO: 370642 - RNA, 18 nt, Human
ggaaguacugagcuuccu

SEQ ID NO: 370643 - RNA, 18 nt, Human
ggagaaggagcgaaagcu

SEQ ID NO: 370644 - RNA, 21 nt, Human
ggagggaaggaaggaaauugg

SEQ ID NO: 370645 - RNA, 23 nt, Human
ggagggauuugggggugggggug

SEQ ID NO: 370646 - RNA, 23 nt, Human
ggcaggaaggggaagacggggag

SEQ ID NO: 370647 - RNA, 18 nt, Human
ggcuuugucaguucugug

SEQ ID NO: 370648 - RNA, 23 nt, Human
gggaaaauggcaggaaggggaag

SEQ ID NO: 370649 - RNA, 27 nt, Human
gggaaucacaaagggcagccgguaccc

SEQ ID NO: 370650 - RNA, 18 nt, Human
gggcaaagggaagcuggg

SEQ ID NO: 370651 - RNA, 22 nt, Human
gggcaaagggaagcugggggug

SEQ ID NO: 370652 - RNA, 18 nt, Human
gggcaacaagugaaggga

SEQ ID NO: 370653 - RNA, 19 nt, Human
gggcuggggagucacaauc

SEQ ID NO: 370654 - RNA, 18 nt, Human
ggggugggaagagauagg

SEQ ID NO: 370655 - RNA, 21 nt, Human
gggguggggaagcaggggcuu

SEQ ID NO: 370656 - RNA, 25 nt, Human
ggggugggggugugcucgcaggagc

SEQ ID NO: 370657 - RNA, 20 nt, Human
ggguggagugagugaaugaa

SEQ ID NO: 370658 - RNA, 20 nt, Human
gggugugcucgcaggagccu

SEQ ID NO: 370659 - RNA, 20 nt, Human
ggugauacaaccuggaagaa

SEQ ID NO: 370660 - RNA, 23 nt, Human
gugaaagaagaggauaacaggug

SEQ ID NO: 370661 - RNA, 18 nt, Human
guuugguuuuaggcccgu

SEQ ID NO: 370662 - RNA, 24 nt, Human
uaaggggacaguacaaaaaaaagu

SEQ ID NO: 370663 - RNA, 24 nt, Human
uaaggggacaguacaaaaaaaagu

SEQ ID NO: 370664 - RNA, 23 nt, Human
uaccugaggggucugaagcuuug

SEQ ID NO: 370665 - RNA, 25 nt, Human
uaggcgcuuucacuccucagugccc

SEQ ID NO: 370666 - RNA, 21 nt, Human
uaugcuaacucgggggugaua

SEQ ID NO: 370667 - RNA, 24 nt, Human
ucaacugggcagacaagggacagg

SEQ ID NO: 370668 - RNA, 21 nt, Human
ucaagggagggaaaauggcag

SEQ ID NO: 370669 - RNA, 19 nt, Human
ucagauccaaggggccaag

SEQ ID NO: 370670 - RNA, 23 nt, Human
ucagcugccccaagguuguccag

SEQ ID NO: 370671 - RNA, 18 nt, Human
uccaauacugauguggac

SEQ ID NO: 370672 - RNA, 23 nt, Human
uccagugucaaccuuucaaggga

SEQ ID NO: 370673 - RNA, 19 nt, Human
uccaugaaaaaaacaauuc

SEQ ID NO: 370674 - RNA, 20 nt, Human
ucccaacuccugggucucug

SEQ ID NO: 370675 - RNA, 21 nt, Human
uccccaguguagaacagggag

SEQ ID NO: 370676 - RNA, 23 nt, Human
ucccccacccaaaugcccgggau

SEQ ID NO: 370677 - RNA, 18 nt, Human
ucucccacccuugcugug

SEQ ID NO: 370678 - RNA, 24 nt, Human
ucugcuggcaaugacaguucccca

SEQ ID NO: 370679 - RNA, 23 nt, Human
ugaaaaaaacaauucaguuaaua

SEQ ID NO: 370680 - RNA, 26 nt, Human
ugaaaaaaacaauucaguuaauaaaa

SEQ ID NO: 370681 - RNA, 18 nt, Human
ugaccuggggcucagugg

SEQ ID NO: 370682 - RNA, 22 nt, Human
ugaggcaggcagcacagggccc

SEQ ID NO: 370683 - RNA, 19 nt, Human
ugaggcagggagagggaag

SEQ ID NO: 370684 - RNA, 23 nt, Human
ugaggcagggagagggaagaguc

SEQ ID NO: 370685 - RNA, 19 nt, Human
ugaggcccaauccauucca

SEQ ID NO: 370686 - RNA, 24 nt, Human
ugccccaagguuguccagugucaa

SEQ ID NO: 370687 - RNA, 18 nt, Human
ugcccgggauuagggcag

SEQ ID NO: 370688 - RNA, 18 nt, Human
uggaaagaugcaaaaacc

SEQ ID NO: 370689 - RNA, 21 nt, Human
uggaacgccccaagcaagacc

SEQ ID NO: 370690 - RNA, 18 nt, Human
uggaagaagaaugugagg

SEQ ID NO: 370691 - RNA, 21 nt, Human
uggaagaagaaugugaggcuc

SEQ ID NO: 370692 - RNA, 19 nt, Human
uggagggaaggaaggaaau

SEQ ID NO: 370693 - RNA, 24 nt, Human
uggagugagugaaugaaugaguca

SEQ ID NO: 370694 - RNA, 18 nt, Human
uggcaggaaggggaagac

SEQ ID NO: 370695 - RNA, 20 nt, Human
uggcaggaaggggaagacga

SEQ ID NO: 370696 - RNA, 21 nt, Human
uggcaggaaggggaagacggg

SEQ ID NO: 370697 - RNA, 25 nt, Human
uggcaggaaggggaagacggggaga

SEQ ID NO: 370698 - RNA, 21 nt, Human
ugggaagagauagggugaaag

SEQ ID NO: 370699 - RNA, 19 nt, Human
uggggcaaagggaagcugg

SEQ ID NO: 370700 - RNA, 19 nt, Human
ugggggugggaagagauag

SEQ ID NO: 370701 - RNA, 21 nt, Human
ugggggugggaagagauaggg

SEQ ID NO: 370702 - RNA, 20 nt, Human
ugggucucugaagggcagga

SEQ ID NO: 370703 - RNA, 18 nt, Human
uguccuugaaccaacagc

SEQ ID NO: 370704 - RNA, 21 nt, Human
ugucugggagggagcaauaaa

SEQ ID NO: 370705 - RNA, 23 nt, Human
uuaggcccguuucuccauuaagg

SEQ ID NO: 370706 - RNA, 20 nt, Human
uucaagggagggaaaauggc

SEQ ID NO: 370707 - RNA, 19 nt, Human
uugaaccaacagcaucccc

SEQ ID NO: 370708 - RNA, 18 nt, Human
uugagucugcgagccugg

SEQ ID NO: 370709 - RNA, 18 nt, Human
uuucaagggagggaaaau

SEQ ID NO: 370710 - RNA, 22 nt, Human
uuuuuuuuuuucagaagauucu

SEQ ID NO: 370711 - RNA, 21 nt, Human
uuuuuuuuuuuuuuuuuucag

SEQ ID NO: 370712 - RNA, 25 nt, Human
aaacccagcagccuuugguucggaa

SEQ ID NO: 370713 - RNA, 19 nt, Human
aaacccccaacuuaccccu

SEQ ID NO: 370714 - RNA, 18 nt, Human
aagaaaagaaggaggcac

SEQ ID NO: 370715 - RNA, 23 nt, Human
aaugcaaaaaguauaaggcuuug

SEQ ID NO: 370716 - RNA, 19 nt, Human
acaccaguccucccagccu

SEQ ID NO: 370717 - RNA, 23 nt, Human
accccauaccucaggccaugcua

SEQ ID NO: 370718 - RNA, 21 nt, Human
acccgguucgggacagauucc

SEQ ID NO: 370719 - RNA, 19 nt, Human
accuccucuuccuagccca

SEQ ID NO: 370720 - RNA, 18 nt, Human
acuccgugcucugugcuc

SEQ ID NO: 370721 - RNA, 18 nt, Human
agcccucuggcaucccag

SEQ ID NO: 370722 - RNA, 21 nt, Human
agccgcuggagaggcagcccu

SEQ ID NO: 370723 - RNA, 21 nt, Human
agcgggggcagcgggaacccg

SEQ ID NO: 370724 - RNA, 21 nt, Human
aggcucccugaaaacccccaa

SEQ ID NO: 370725 - RNA, 23 nt, Human
caaaggaaaggaaaaaaccagca

SEQ ID NO: 370726 - RNA, 23 nt, Human
caaagggcaacaccaguccuccc

SEQ ID NO: 370727 - RNA, 21 nt, Human
caagcccuaggcccacccucc

SEQ ID NO: 370728 - RNA, 22 nt, Human
caagcccuaggcccacccuccu

SEQ ID NO: 370729 - RNA, 22 nt, Human
cacagacccgguucgggacaga

SEQ ID NO: 370730 - RNA, 18 nt, Human
cacagccuccagcagucc

SEQ ID NO: 370731 - RNA, 19 nt, Human
caccaagcuccaaagggca

SEQ ID NO: 370732 - RNA, 21 nt, Human
cacccuccucaccaagcucca

SEQ ID NO: 370733 - RNA, 22 nt, Human
cacccuccucaccaagcuccaa

SEQ ID NO: 370734 - RNA, 23 nt, Human
caccuaacaggcucccugaaaac

SEQ ID NO: 370735 - RNA, 20 nt, Human
caccuccucuuccuagccca

SEQ ID NO: 370736 - RNA, 18 nt, Human
cacuccucaccccagccu

SEQ ID NO: 370737 - RNA, 18 nt, Human
cagagccagcucugaccc

SEQ ID NO: 370738 - RNA, 21 nt, Human
cagcagacacuccucacccca

SEQ ID NO: 370739 - RNA, 26 nt, Human
cagcagacacuccucaccccagccua

SEQ ID NO: 370740 - RNA, 23 nt, Human
cagcagcaaggcugggcuuguag

SEQ ID NO: 370741 - RNA, 20 nt, Human
cagccuccccauucaccuua

SEQ ID NO: 370742 - RNA, 20 nt, Human
cagcucugacccucgcccca

SEQ ID NO: 370743 - RNA, 19 nt, Human
caggaucugcugcgggccc

SEQ ID NO: 370744 - RNA, 20 nt, Human
caggcuccagggcugggaag

SEQ ID NO: 370745 - RNA, 19 nt, Human
caguccucccagccucccc

SEQ ID NO: 370746 - RNA, 22 nt, Human
caguccucccagccuccccauu

SEQ ID NO: 370747 - RNA, 18 nt, Human
cauagaaaacuugcuccc

SEQ ID NO: 370748 - RNA, 27 nt, Human
cauucaccuuacccuggccuccacaug

SEQ ID NO: 370749 - RNA, 24 nt, Human
cauuuauaaaacuaaagcuggaga

SEQ ID NO: 370750 - RNA, 23 nt, Human
ccaagcccuaggcccacccuccc

SEQ ID NO: 370751 - RNA, 23 nt, Human
ccacaugcacauaccccauaccu

SEQ ID NO: 370752 - RNA, 22 nt, Human
ccaggcuccagggcugggaaga

SEQ ID NO: 370753 - RNA, 27 nt, Human
cccagccuacgugucugcggccccagc

SEQ ID NO: 370754 - RNA, 19 nt, Human
cccgcccgcgccucggccc

SEQ ID NO: 370755 - RNA, 18 nt, Human
ccgcccgcgccucggccc

SEQ ID NO: 370756 - RNA, 24 nt, Human
ccuccaggcuccagggcugggaag

SEQ ID NO: 370757 - RNA, 18 nt, Human
ccuccggagguuuggccg

SEQ ID NO: 370758 - RNA, 24 nt, Human
ccuuccguccccggccuccggagg

SEQ ID NO: 370759 - RNA, 18 nt, Human
cgaguccacuccgugcuc

SEQ ID NO: 370760 - RNA, 21 nt, Human
cgcagccacggcgccgccgcc

SEQ ID NO: 370761 - RNA, 25 nt, Human
cgcccgagucgaguuacccagaggc

SEQ ID NO: 370762 - RNA, 18 nt, Human
cgggauuuccuaauccaa

SEQ ID NO: 370763 - RNA, 21 nt, Human
cgggggcagcgggaacccgcc

SEQ ID NO: 370764 - RNA, 24 nt, Human
cuccagcaguccuacuugggccug

SEQ ID NO: 370765 - RNA, 25 nt, Human
cucccaaaauagugcaaauacccaa

SEQ ID NO: 370766 - RNA, 21 nt, Human
cucccagccuccccauucacc

SEQ ID NO: 370767 - RNA, 24 nt, Human
cuugcucccaaaauagugcaaaua

SEQ ID NO: 370768 - RNA, 24 nt, Human
cuuuggggaccaagcaacaaggaa

SEQ ID NO: 370769 - RNA, 20 nt, Human
gaacucccugccccgcccaa

SEQ ID NO: 370770 - RNA, 22 nt, Human
gaacuggaguguccccuccccg

SEQ ID NO: 370771 - RNA, 19 nt, Human
gacagauuccgcuccugcc

SEQ ID NO: 370772 - RNA, 18 nt, Human
gagauuccggauccagga

SEQ ID NO: 370773 - RNA, 23 nt, Human
gagccagcucugacccucgcccc

SEQ ID NO: 370774 - RNA, 19 nt, Human
gccccagggggagucugua

SEQ ID NO: 370775 - RNA, 22 nt, Human
ggaacccgcccgcgccucggcc

SEQ ID NO: 370776 - RNA, 19 nt, Human
ggggaggcggcgcucccag

SEQ ID NO: 370777 - RNA, 21 nt, Human
ggucccgcggggggaggcggc

SEQ ID NO: 370778 - RNA, 18 nt, Human
uaacaggcucccugaaaa

SEQ ID NO: 370779 - RNA, 21 nt, Human
uacaaaaaaaguggcucccac

SEQ ID NO: 370780 - RNA, 24 nt, Human
uacgugucugcggccccagcaagg

SEQ ID NO: 370781 - RNA, 26 nt, Human
uacuugggccugccugcagggggaag

SEQ ID NO: 370782 - RNA, 19 nt, Human
uagagggugacagcagaca

SEQ ID NO: 370783 - RNA, 22 nt, Human
uagcccagcuccccagagccag

SEQ ID NO: 370784 - RNA, 20 nt, Human
uaggaagagucugggcugca

SEQ ID NO: 370785 - RNA, 22 nt, Human
uauuuggaaauuuccaaaccug

SEQ ID NO: 370786 - RNA, 18 nt, Human
ucccagggccgcagccac

SEQ ID NO: 370787 - RNA, 20 nt, Human
ucccugaaaacccccaacuu

SEQ ID NO: 370788 - RNA, 25 nt, Human
ucccugaaaacccccaacuuacccc

SEQ ID NO: 370789 - RNA, 18 nt, Human
uccuaauccaaguucgcg

SEQ ID NO: 370790 - RNA, 19 nt, Human
ucgccaagcccuaggccca

SEQ ID NO: 370791 - RNA, 18 nt, Human
ucuguaaacaugcaaacc

SEQ ID NO: 370792 - RNA, 18 nt, Human
ugaggaaagaaaagaagg

SEQ ID NO: 370793 - RNA, 22 nt, Human
ugcaccuccucuuccuagccca

SEQ ID NO: 370794 - RNA, 21 nt, Human
ugcggccccagcaaggaccca

SEQ ID NO: 370795 - RNA, 22 nt, Human
uggaguguccccuccccggccc

SEQ ID NO: 370796 - RNA, 18 nt, Human
ugucaaagcacagccucc

SEQ ID NO: 370797 - RNA, 19 nt, Human
aaaaugcuggggcccggga

SEQ ID NO: 370798 - RNA, 21 nt, Human
accccaagguggcagaggagu

SEQ ID NO: 370799 - RNA, 21 nt, Human
augaaugacuuuuaauccagc

SEQ ID NO: 370800 - RNA, 21 nt, Human
caaaaugcuggggcccgggac

SEQ ID NO: 370801 - RNA, 23 nt, Human
cccacaccccaagguggcagagg

SEQ ID NO: 370802 - RNA, 19 nt, Human
ccccacaccccaagguggc

SEQ ID NO: 370803 - RNA, 21 nt, Human
ccccacaccccaagguggcag

SEQ ID NO: 370804 - RNA, 21 nt, Human
cccccgggaccccggcccgga

SEQ ID NO: 370805 - RNA, 22 nt, Human
cccccgggaccccggcccggag

SEQ ID NO: 370806 - RNA, 20 nt, Human
ccccgggaccccggcccgga

SEQ ID NO: 370807 - RNA, 22 nt, Human
cggccgcccgcucccugcucgg

SEQ ID NO: 370808 - RNA, 24 nt, Human
cuggagcccggggcaaaaugcugg

SEQ ID NO: 370809 - RNA, 18 nt, Human
gaugcuggagcccggggc

SEQ ID NO: 370810 - RNA, 21 nt, Human
gccccacaccccaagguggca

SEQ ID NO: 370811 - RNA, 20 nt, Human
gccgcccgcucccugcucgg

SEQ ID NO: 370812 - RNA, 20 nt, Human
ggagagucauccagugcccc

SEQ ID NO: 370813 - RNA, 21 nt, Human
ggagugaugcuggagcccggg

SEQ ID NO: 370814 - RNA, 19 nt, Human
ggcccggagcgcggccgcc

SEQ ID NO: 370815 - RNA, 19 nt, Human
uaauccagccccacacccc

SEQ ID NO: 370816 - RNA, 22 nt, Human
ugcuggggcccgggacacggcu

SEQ ID NO: 370817 - RNA, 23 nt, Human
uggagcccggggcaaaaugcugg

SEQ ID NO: 370818 - RNA, 25 nt, Human
uggagcccggggcaaaaugcugggg

SEQ ID NO: 370819 - RNA, 21 nt, Human
uggcagaggagugaugcugga

SEQ ID NO: 370820 - RNA, 18 nt, Human
aaaagaggggaggagagu

SEQ ID NO: 370821 - RNA, 21 nt, Human
aaaagcuuucuucagaucaca

SEQ ID NO: 370822 - RNA, 18 nt, Human
aaagcuuucuucagauca

SEQ ID NO: 370823 - RNA, 19 nt, Human
aacaugaacccaggaggag

SEQ ID NO: 370824 - RNA, 19 nt, Human
accacaguuaccucccaaa

SEQ ID NO: 370825 - RNA, 22 nt, Human
agaggggaggagagugggggcc

SEQ ID NO: 370826 - RNA, 22 nt, Human
agagugggggcagggguuagug

SEQ ID NO: 370827 - RNA, 22 nt, Human
agcagggauggccacccccccu

SEQ ID NO: 370828 - RNA, 24 nt, Human
agcccauccaucuaucugccucag

SEQ ID NO: 370829 - RNA, 18 nt, Human
agccuucgccaccacagu

SEQ ID NO: 370830 - RNA, 21 nt, Human
aggaaggaaaagaggggagga

SEQ ID NO: 370831 - RNA, 21 nt, Human
aggagacaggggaggacaggg

SEQ ID NO: 370832 - RNA, 24 nt, Human
aggcuaccagggagggaagacucc

SEQ ID NO: 370833 - RNA, 19 nt, Human
agggagggaagacuccagg

SEQ ID NO: 370834 - RNA, 25 nt, Human
agggagggaggacugaggugguugu

SEQ ID NO: 370835 - RNA, 24 nt, Human
aggggaagggagagggagaagggg

SEQ ID NO: 370836 - RNA, 18 nt, Human
aggggaggagaguggggg

SEQ ID NO: 370837 - RNA, 24 nt, Human
augaacccaggaggaggaaaggag

SEQ ID NO: 370838 - RNA, 22 nt, Human
caccaagcccuaggaaaccuuc

SEQ ID NO: 370839 - RNA, 18 nt, Human
caccacaguuaccuccca

SEQ ID NO: 370840 - RNA, 23 nt, Human
cacccccccuacccgcccacccc

SEQ ID NO: 370841 - RNA, 18 nt, Human
caccccccugcccaccag

SEQ ID NO: 370842 - RNA, 21 nt, Human
caccccccugcccaccagccc

SEQ ID NO: 370843 - RNA, 26 nt, Human
caccccggacugagagaaaauaguuc

SEQ ID NO: 370844 - RNA, 20 nt, Human
cagaauacaaaagucaaggg

SEQ ID NO: 370845 - RNA, 22 nt, Human
cagccccagccaccccccugcc

SEQ ID NO: 370846 - RNA, 21 nt, Human
cagcuccccagccaaauuccu

SEQ ID NO: 370847 - RNA, 21 nt, Human
cagcuccccagccaaauuccu

SEQ ID NO: 370848 - RNA, 21 nt, Human
cauggccuggccaggaccaga

SEQ ID NO: 370849 - RNA, 25 nt, Human
ccaaaagcuuucuucagaucacagg

SEQ ID NO: 370850 - RNA, 20 nt, Human
ccacaacaaaccggauccuu

SEQ ID NO: 370851 - RNA, 21 nt, Human
ccaccacaguuaccucccaaa

SEQ ID NO: 370852 - RNA, 18 nt, Human
ccaccccccaagaagcag

SEQ ID NO: 370853 - RNA, 20 nt, Human
ccacccccccuacccgccca

SEQ ID NO: 370854 - RNA, 23 nt, Human
ccagcccauccaucuaucugccu

SEQ ID NO: 370855 - RNA, 20 nt, Human
ccagccccagccaccccccu

SEQ ID NO: 370856 - RNA, 22 nt, Human
ccaggaggaggaaaggagacaa

SEQ ID NO: 370857 - RNA, 19 nt, Human
cccaaacgccgcggccuuc

SEQ ID NO: 370858 - RNA, 24 nt, Human
cccacaccacaacaaaccggaucc

SEQ ID NO: 370859 - RNA, 24 nt, Human
cccacuaccgcagccuucgccacc

SEQ ID NO: 370860 - RNA, 21 nt, Human
cccagccaaauuccuuuaaaa

SEQ ID NO: 370861 - RNA, 20 nt, Human
cccagccccagccacccccc

SEQ ID NO: 370862 - RNA, 22 nt, Human
cccauccaucuaucugccucag

SEQ ID NO: 370863 - RNA, 18 nt, Human
ccccacaccacaacaaac

SEQ ID NO: 370864 - RNA, 22 nt, Human
ccccacaccacaacaaaccgga

SEQ ID NO: 370865 - RNA, 19 nt, Human
ccccacuaccgcagccuuc

SEQ ID NO: 370866 - RNA, 19 nt, Human
cccccccuacccgcccacc

SEQ ID NO: 370867 - RNA, 23 nt, Human
cccccccuacccgcccacccccc

SEQ ID NO: 370868 - RNA, 22 nt, Human
ccccccuacccgcccacccccc

SEQ ID NO: 370869 - RNA, 19 nt, Human
ccccccugcccaccagccc

SEQ ID NO: 370870 - RNA, 23 nt, Human
cccccuacccgcccaccccccaa

SEQ ID NO: 370871 - RNA, 18 nt, Human
ccccuacccgcccacccc

SEQ ID NO: 370872 - RNA, 18 nt, Human
ccgcuguuugaagccgag

SEQ ID NO: 370873 - RNA, 21 nt, Human
ccggauccuuccgcggggugu

SEQ ID NO: 370874 - RNA, 23 nt, Human
ccuacccgcccaccccccaagaa

SEQ ID NO: 370875 - RNA, 19 nt, Human
ccuaggaaaccuucauaua

SEQ ID NO: 370876 - RNA, 23 nt, Human
ccuuccgagccucguauacguug

SEQ ID NO: 370877 - RNA, 23 nt, Human
cgccaccacaguuaccucccaaa

SEQ ID NO: 370878 - RNA, 23 nt, Human
cgucccgcuccguuucuuccaaa

SEQ ID NO: 370879 - RNA, 20 nt, Human
cuacccgcccaccccccaag

SEQ ID NO: 370880 - RNA, 27 nt, Human
cuacccgcccaccccccaagaagcagg

SEQ ID NO: 370881 - RNA, 25 nt, Human
cuccccacuaccgcagccuucgcca

SEQ ID NO: 370882 - RNA, 18 nt, Human
cucuggaauggugauggc

SEQ ID NO: 370883 - RNA, 20 nt, Human
cugacucuacugcuaccgcu

SEQ ID NO: 370884 - RNA, 21 nt, Human
cugggccagggaucgggaggc

SEQ ID NO: 370885 - RNA, 18 nt, Human
gaaaggagacaggggagg

SEQ ID NO: 370886 - RNA, 22 nt, Human
gagcacggcuaugugaaguuuc

SEQ ID NO: 370887 - RNA, 19 nt, Human
gaggacaagcaccaaaagc

SEQ ID NO: 370888 - RNA, 20 nt, Human
gaggagagugggggcagggg

SEQ ID NO: 370889 - RNA, 22 nt, Human
gaggugguugugaggacaagca

SEQ ID NO: 370890 - RNA, 19 nt, Human
gcaaugcucggaggcuagg

SEQ ID NO: 370891 - RNA, 24 nt, Human
gccacccccccuacccgcccaccc

SEQ ID NO: 370892 - RNA, 21 nt, Human
gcugaggucugaacaauaccu

SEQ ID NO: 370893 - RNA, 19 nt, Human
ggaaaggagacaggggagg

SEQ ID NO: 370894 - RNA, 21 nt, Human
ggaaaggagacaggggaggac

SEQ ID NO: 370895 - RNA, 23 nt, Human
ggacaagcaccaaaagcuuucuu

SEQ ID NO: 370896 - RNA, 19 nt, Human
ggaccagaacuggggagag

SEQ ID NO: 370897 - RNA, 18 nt, Human
ggagcccuguucagcucc

SEQ ID NO: 370898 - RNA, 22 nt, Human
ggaggacugaggugguugugag

SEQ ID NO: 370899 - RNA, 20 nt, Human
ggaggagagugggggcaggg

SEQ ID NO: 370900 - RNA, 19 nt, Human
gggacucaggggugggcgg

SEQ ID NO: 370901 - RNA, 20 nt, Human
gggaggagagugggggcagg

SEQ ID NO: 370902 - RNA, 18 nt, Human
gggcccgaggucugggcc

SEQ ID NO: 370903 - RNA, 18 nt, Human
gggcggguagcagggaug

SEQ ID NO: 370904 - RNA, 20 nt, Human
gggcggguagcagggauggc

SEQ ID NO: 370905 - RNA, 22 nt, Human
ggggaggacagggagggaggac

SEQ ID NO: 370906 - RNA, 19 nt, Human
ggggaggagagugggggca

SEQ ID NO: 370907 - RNA, 19 nt, Human
gggguguccuuccgagccu

SEQ ID NO: 370908 - RNA, 20 nt, Human
gggugggcggguagcaggga

SEQ ID NO: 370909 - RNA, 21 nt, Human
ggugggcccgaggucugggcc

SEQ ID NO: 370910 - RNA, 22 nt, Human
gguguccuuccgagccucguau

SEQ ID NO: 370911 - RNA, 21 nt, Human
gucaggggaagggagagggag

SEQ ID NO: 370912 - RNA, 20 nt, Human
gucccgcuccguuucuucca

SEQ ID NO: 370913 - RNA, 20 nt, Human
gucuccccuccccacaccac

SEQ ID NO: 370914 - RNA, 20 nt, Human
gucugaacaauaccuuggag

SEQ ID NO: 370915 - RNA, 22 nt, Human
gugggcccgaggucugggccag

SEQ ID NO: 370916 - RNA, 22 nt, Human
guuaccucccaaacgccgcggc

SEQ ID NO: 370917 - RNA, 19 nt, Human
uaccagggagggaagacuc

SEQ ID NO: 370918 - RNA, 19 nt, Human
uagcagggauggccacccc

SEQ ID NO: 370919 - RNA, 21 nt, Human
uagcagggauggccacccccc

SEQ ID NO: 370920 - RNA, 20 nt, Human
uaggaaaccuucauauagug

SEQ ID NO: 370921 - RNA, 27 nt, Human
uaggaaggaaggaaaagaggggaggag

SEQ ID NO: 370922 - RNA, 20 nt, Human
ucagggucugugcuaggcuc

SEQ ID NO: 370923 - RNA, 20 nt, Human
uccccacaccacaacaaacc

SEQ ID NO: 370924 - RNA, 21 nt, Human
ucccgcuccguuucuuccaaa

SEQ ID NO: 370925 - RNA, 22 nt, Human
ucccgcuccguuucuuccaaaa

SEQ ID NO: 370926 - RNA, 26 nt, Human
ucucuggaauggugauggcccagccc

SEQ ID NO: 370927 - RNA, 22 nt, Human
ucugggccagggaucgggaggc

SEQ ID NO: 370928 - RNA, 23 nt, Human
ugaacaauaccuuggagucagaa

SEQ ID NO: 370929 - RNA, 18 nt, Human
ugagagucucaggcugac

SEQ ID NO: 370930 - RNA, 24 nt, Human
ugaggugguugugaggacaagcac

SEQ ID NO: 370931 - RNA, 20 nt, Human
ugcaacggcggaggaacaag

SEQ ID NO: 370932 - RNA, 23 nt, Human
ugcauauacacuggccuugucuc

SEQ ID NO: 370933 - RNA, 22 nt, Human
uggccaggaccagaacugggga

SEQ ID NO: 370934 - RNA, 22 nt, Human
uggcgccgccgcuguuugaagc

SEQ ID NO: 370935 - RNA, 25 nt, Human
uggguggaacagucaggggaaggga

SEQ ID NO: 370936 - RNA, 21 nt, Human
ugguuugucagcgucuccccu

SEQ ID NO: 370937 - RNA, 20 nt, Human
uuacacaccaacaaucuucu

SEQ ID NO: 370938 - RNA, 24 nt, Human
uuccaaacugugugguugccuccc

SEQ ID NO: 370939 - RNA, 22 nt, Human
uuugucagcgucuccccucccc

SEQ ID NO: 370940 - RNA, 24 nt, Human
aaaaaaacaaaaaacaaacaaaaa

SEQ ID NO: 370941 - RNA, 23 nt, Human
aaaaagcaagauaaaaauaguau

SEQ ID NO: 370942 - RNA, 21 nt, Human
aaaacaaaaaacaaacaaaaa

SEQ ID NO: 370943 - RNA, 19 nt, Human
aaacaaacaaaaacaaccc

SEQ ID NO: 370944 - RNA, 27 nt, Human
aaacaaacaaacaaaaacaaccacaaa

SEQ ID NO: 370945 - RNA, 18 nt, Human
aacaaaaacaaccacaaa

SEQ ID NO: 370946 - RNA, 24 nt, Human
aacaaacaaaaacaaccacaaaug

SEQ ID NO: 370947 - RNA, 20 nt, Human
aacaaacaaacaaaaacaac

SEQ ID NO: 370948 - RNA, 18 nt, Human
aagcaagauaaaaauagu

SEQ ID NO: 370949 - RNA, 18 nt, Human
aagcuccuucugaggucc

SEQ ID NO: 370950 - RNA, 20 nt, Human
aaggggagaaaagaaaagga

SEQ ID NO: 370951 - RNA, 25 nt, Human
acaaaaaaacaaaaaacaaacaaaa

SEQ ID NO: 370952 - RNA, 19 nt, Human
acaaacaaaaacaaccaca

SEQ ID NO: 370953 - RNA, 22 nt, Human
acgaaaaagcaagauaaaaaua

SEQ ID NO: 370954 - RNA, 20 nt, Human
agauaggcaaaaagcuccuu

SEQ ID NO: 370955 - RNA, 21 nt, Human
agggacaaaaaaacaaaaaac

SEQ ID NO: 370956 - RNA, 23 nt, Human
aguacagaaagaggguggugggg

SEQ ID NO: 370957 - RNA, 23 nt, Human
caaaaaaacaaaaaacaaacaaa

SEQ ID NO: 370958 - RNA, 24 nt, Human
caaaaaaacaaaaaacaaacaaaa

SEQ ID NO: 370959 - RNA, 22 nt, Human
caaaaagcuccuucugaggucc

SEQ ID NO: 370960 - RNA, 18 nt, Human
cacagguagagucaugaa

SEQ ID NO: 370961 - RNA, 23 nt, Human
caccugagauaaacgcugaggac

SEQ ID NO: 370962 - RNA, 23 nt, Human
cacuccuguaugcuagcaggaau

SEQ ID NO: 370963 - RNA, 25 nt, Human
cagaacgaaaaagcaagauaaaaau

SEQ ID NO: 370964 - RNA, 23 nt, Human
cagacuagaaugaaacugguuua

SEQ ID NO: 370965 - RNA, 19 nt, Human
ccaaggggagaaaagaaaa

SEQ ID NO: 370966 - RNA, 20 nt, Human
ccgggcccugcagugugguc

SEQ ID NO: 370967 - RNA, 18 nt, Human
ccuccgggcccugcagug

SEQ ID NO: 370968 - RNA, 20 nt, Human
ccuuuuaacaguaacucuag

SEQ ID NO: 370969 - RNA, 23 nt, Human
cuagcaggaauguugcuggcaag

SEQ ID NO: 370970 - RNA, 18 nt, Human
cugagauaaacgcugagg

SEQ ID NO: 370971 - RNA, 21 nt, Human
gaaacaaacaaacaaaaacaa

SEQ ID NO: 370972 - RNA, 18 nt, Human
uaacaaaagaaaugaaau

SEQ ID NO: 370973 - RNA, 23 nt, Human
uaagaaacaaacaaacaaaaaca

SEQ ID NO: 370974 - RNA, 21 nt, Human
uaccagaggaaaacagucaac

SEQ ID NO: 370975 - RNA, 22 nt, Human
uagcaggaauguugcuggcaag

SEQ ID NO: 370976 - RNA, 19 nt, Human
uauagauaggcaaaaagcu

SEQ ID NO: 370977 - RNA, 20 nt, Human
uauucagacuagaaugaaac

SEQ ID NO: 370978 - RNA, 22 nt, Human
ucuugaccuccgggcccugcag

SEQ ID NO: 370979 - RNA, 25 nt, Human
ucuugaccuccgggcccugcagugu

SEQ ID NO: 370980 - RNA, 19 nt, Human
ugaaauuaaagauagacca

SEQ ID NO: 370981 - RNA, 20 nt, Human
ugaaguacagaaagagggug

SEQ ID NO: 370982 - RNA, 19 nt, Human
ugacagggacaaaaaaaca

SEQ ID NO: 370983 - RNA, 20 nt, Human
ugacagggacaaaaaaacaa

SEQ ID NO: 370984 - RNA, 24 nt, Human
ugaggacgcaagagcgauuuuacc

SEQ ID NO: 370985 - RNA, 20 nt, Human
uggcaagacacuucugagcc

SEQ ID NO: 370986 - RNA, 23 nt, Human
uguuugucccuauucagacuaga

SEQ ID NO: 370987 - RNA, 20 nt, Human
uuaaugcuaagcaaucguca

SEQ ID NO: 370988 - RNA, 31 nt, Human
uugguaauuacaacguacauugucuucuuuu

SEQ ID NO: 370989 - RNA, 22 nt, Human
aaaaaaauuucagucuaccucc

SEQ ID NO: 370990 - RNA, 19 nt, Human
aaagacgggguuucaccgu

SEQ ID NO: 370991 - RNA, 24 nt, Human
aaagugcugggauuacaggcguga

SEQ ID NO: 370992 - RNA, 21 nt, Human
aacccuauucuagucuggguu

SEQ ID NO: 370993 - RNA, 22 nt, Human
aaccucaugauccgcccgccuc

SEQ ID NO: 370994 - RNA, 18 nt, Human
aacggguaaguggugggg

SEQ ID NO: 370995 - RNA, 18 nt, Human
aagauggcuaaucuacua

SEQ ID NO: 370996 - RNA, 19 nt, Human
aagugcugggauuacaggc

SEQ ID NO: 370997 - RNA, 19 nt, Human
aagugcugggauuacaggc

SEQ ID NO: 370998 - RNA, 26 nt, Human
aagugcugggauuacaggcgugagcc

SEQ ID NO: 370999 - RNA, 20 nt, Human
aaucugaaugcaucaaaucu

SEQ ID NO: 371000 - RNA, 22 nt, Human
acaccccgcuccggcccggggc

SEQ ID NO: 371001 - RNA, 23 nt, Human
acaggcgcccgccaccacgcccg

SEQ ID NO: 371002 - RNA, 19 nt, Human
accccgcuccggcccgggg

SEQ ID NO: 371003 - RNA, 21 nt, Human
acccuugacccugggguugca

SEQ ID NO: 371004 - RNA, 23 nt, Human
acgacgcuggggccccggaggac

SEQ ID NO: 371005 - RNA, 18 nt, Human
acgggguuucaccguguu

SEQ ID NO: 371006 - RNA, 19 nt, Human
acgggguuucaccguguua

SEQ ID NO: 371007 - RNA, 20 nt, Human
acgggguuucaccguguuag

SEQ ID NO: 371008 - RNA, 24 nt, Human
acgggguuucaccguguuagccag

SEQ ID NO: 371009 - RNA, 18 nt, Human
acugcaagcuccgccucc

SEQ ID NO: 371010 - RNA, 18 nt, Human
agcuccgccuccuggguu

SEQ ID NO: 371011 - RNA, 24 nt, Human
agcucuguugcccaggcuggagug

SEQ ID NO: 371012 - RNA, 21 nt, Human
aggacgaggagcaggcggugg

SEQ ID NO: 371013 - RNA, 25 nt, Human
aggcuggagugcaguggcacaaucu

SEQ ID NO: 371014 - RNA, 20 nt, Human
aguaaagacgggguuucacc

SEQ ID NO: 371015 - RNA, 18 nt, Human
aguagcugggacuacagg

SEQ ID NO: 371016 - RNA, 19 nt, Human
aguagcugggacuacaggc

SEQ ID NO: 371017 - RNA, 21 nt, Human
agugaauuugaaagauggcua

SEQ ID NO: 371018 - RNA, 20 nt, Human
agugcaguggcacaaucucg

SEQ ID NO: 371019 - RNA, 24 nt, Human
agugcaguggcacaaucucggcuc

SEQ ID NO: 371020 - RNA, 18 nt, Human
agugcugggauuacaggc

SEQ ID NO: 371021 - RNA, 19 nt, Human
agugguggggaggaguagg

SEQ ID NO: 371022 - RNA, 19 nt, Human
aucuguuacauagcucucc

SEQ ID NO: 371023 - RNA, 24 nt, Human
augauccgcccgccucggccuccc

SEQ ID NO: 371024 - RNA, 22 nt, Human
augcaucaaaucuuccuuggcu

SEQ ID NO: 371025 - RNA, 19 nt, Human
auggccaagcgccgccgcc

SEQ ID NO: 371026 - RNA, 21 nt, Human
auucuccugccucagccuccc

SEQ ID NO: 371027 - RNA, 24 nt, Human
caaagugcugggauuacaggcgug

SEQ ID NO: 371028 - RNA, 22 nt, Human
caagcgccgccgcccgaaccgg

SEQ ID NO: 371029 - RNA, 18 nt, Human
caccguguuagccaggau

SEQ ID NO: 371030 - RNA, 24 nt, Human
caccguguuagccaggauggucuc

SEQ ID NO: 371031 - RNA, 22 nt, Human
cacgccauucuccugccucagc

SEQ ID NO: 371032 - RNA, 20 nt, Human
cacuggauuagcuacuuucu

SEQ ID NO: 371033 - RNA, 23 nt, Human
cacuucacagacuaauaacugaa

SEQ ID NO: 371034 - RNA, 24 nt, Human
cagagucuagcucuguugcccagg

SEQ ID NO: 371035 - RNA, 22 nt, Human
cagccaacaauuaagauuuuaa

SEQ ID NO: 371036 - RNA, 21 nt, Human
caggcgcccgccaccacgccc

SEQ ID NO: 371037 - RNA, 26 nt, Human
caggcgguggcggcagcuccucacgc

SEQ ID NO: 371038 - RNA, 19 nt, Human
caucaaaucuuccuuggcu

SEQ ID NO: 371039 - RNA, 21 nt, Human
cauggccaagcgccgccgccc

SEQ ID NO: 371040 - RNA, 20 nt, Human
ccaaagugcugggauuacag

SEQ ID NO: 371041 - RNA, 22 nt, Human
ccaaagugcugggauuacaggc

SEQ ID NO: 371042 - RNA, 22 nt, Human
ccaaagugcugggauuacaggc

SEQ ID NO: 371043 - RNA, 24 nt, Human
ccaaagugcugggauuacaggcgu

SEQ ID NO: 371044 - RNA, 23 nt, Human
ccacugugcccagccaacaauua

SEQ ID NO: 371045 - RNA, 23 nt, Human
ccccggaggacgaggaggacgag

SEQ ID NO: 371046 - RNA, 23 nt, Human
cccgaguagcugggacuacaggc

SEQ ID NO: 371047 - RNA, 24 nt, Human
cccgaguagcugggacuacaggcg

SEQ ID NO: 371048 - RNA, 20 nt, Human
ccgcagggcaggacgaggga

SEQ ID NO: 371049 - RNA, 23 nt, Human
ccgccgacaccccgcuccggccc

SEQ ID NO: 371050 - RNA, 21 nt, Human
ccgccgccgacaccccgcucc

SEQ ID NO: 371051 - RNA, 24 nt, Human
ccuccaaaaaaaaugcacacuaua

SEQ ID NO: 371052 - RNA, 23 nt, Human
ccugccucagccucccgaguagc

SEQ ID NO: 371053 - RNA, 24 nt, Human
ccugccucagccucccgaguagcu

SEQ ID NO: 371054 - RNA, 22 nt, Human
cgaaccggccgccgccgacacc

SEQ ID NO: 371055 - RNA, 21 nt, Human
cgaggagcaggcgguggcggc

SEQ ID NO: 371056 - RNA, 24 nt, Human
cgaggaggacgaggagcaggcggu

SEQ ID NO: 371057 - RNA, 19 nt, Human
cgcccgaaccggccgccgc

SEQ ID NO: 371058 - RNA, 19 nt, Human
cgccuccuggguucacgcc

SEQ ID NO: 371059 - RNA, 24 nt, Human
cgccucggccucccaaagugcugg

SEQ ID NO: 371060 - RNA, 24 nt, Human
cucagccucccgaguagcugggac

SEQ ID NO: 371061 - RNA, 24 nt, Human
cuccuaaccucaugauccgcccgc

SEQ ID NO: 371062 - RNA, 21 nt, Human
cuccuggguucacgccauucu

SEQ ID NO: 371063 - RNA, 22 nt, Human
gacgaggaggacgaggagcagg

SEQ ID NO: 371064 - RNA, 18 nt, Human
gaggaggaggaggcggcg

SEQ ID NO: 371065 - RNA, 20 nt, Human
gaggaggaggaggcggcggc

SEQ ID NO: 371066 - RNA, 20 nt, Human
gaggcggcggcggagggcgg

SEQ ID NO: 371067 - RNA, 25 nt, Human
gaguagcugggacuacaggcgcccg

SEQ ID NO: 371068 - RNA, 18 nt, Human
gauuacaggcgugagcca

SEQ ID NO: 371069 - RNA, 19 nt, Human
gauuacaggcgugagccac

SEQ ID NO: 371070 - RNA, 21 nt, Human
gauuacaggcgugagccacug

SEQ ID NO: 371071 - RNA, 25 nt, Human
gcccggcuaauuuuuuuuguauuuu

SEQ ID NO: 371072 - RNA, 20 nt, Human
gccgacaccccgcuccggcc

SEQ ID NO: 371073 - RNA, 25 nt, Human
gccuccuggguucacgccauucucc

SEQ ID NO: 371074 - RNA, 18 nt, Human
gcggcggcggagggcggg

SEQ ID NO: 371075 - RNA, 25 nt, Human
gcucuguugcccaggcuggagugca

SEQ ID NO: 371076 - RNA, 19 nt, Human
gcuggagugcaguggcaca

SEQ ID NO: 371077 - RNA, 20 nt, Human
ggaggaagccgagaaggagg

SEQ ID NO: 371078 - RNA, 19 nt, Human
ggaggacgaggaggacgag

SEQ ID NO: 371079 - RNA, 21 nt, Human
ggaggaguagggaacgauggg

SEQ ID NO: 371080 - RNA, 23 nt, Human
ggccaugguguugggcguauccc

SEQ ID NO: 371081 - RNA, 23 nt, Human
gggguuucaccguguuagccagg

SEQ ID NO: 371082 - RNA, 22 nt, Human
ggguuucaccguguuagccagg

SEQ ID NO: 371083 - RNA, 18 nt, Human
gucaacccaaccaguacu

SEQ ID NO: 371084 - RNA, 21 nt, Human
gugagcuugcuuuccuucacc

SEQ ID NO: 371085 - RNA, 26 nt, Human
gugguggggaggaguagggaacgaug

SEQ ID NO: 371086 - RNA, 19 nt, Human
guugcaucaccaccgacug

SEQ ID NO: 371087 - RNA, 24 nt, Human
guuuuuauuuuggaucagcaauuu

SEQ ID NO: 371088 - RNA, 21 nt, Human
uaaccggaauuacauuuugug

SEQ ID NO: 371089 - RNA, 21 nt, Human
uaaggaaaccuugaucaugaa

SEQ ID NO: 371090 - RNA, 23 nt, Human
uacaggcgcccgccaccacgccc

SEQ ID NO: 371091 - RNA, 23 nt, Human
uacaggcgugagccacugugccc

SEQ ID NO: 371092 - RNA, 24 nt, Human
uacaggcgugagccacugugccca

SEQ ID NO: 371093 - RNA, 20 nt, Human
uaccuccaccagaacaucac

SEQ ID NO: 371094 - RNA, 24 nt, Human
uagaaucacagaaaugacuuaaau

SEQ ID NO: 371095 - RNA, 24 nt, Human
uagcucuguugcccaggcuggagu

SEQ ID NO: 371096 - RNA, 21 nt, Human
uaguaaagacgggguuucacc

SEQ ID NO: 371097 - RNA, 24 nt, Human
uaguaaagacgggguuucaccgug

SEQ ID NO: 371098 - RNA, 26 nt, Human
uaguaaagacgggguuucaccguguu

SEQ ID NO: 371099 - RNA, 19 nt, Human
uaucaaaugaaaaacauga

SEQ ID NO: 371100 - RNA, 23 nt, Human
uauuaaaauugugcaaaaaguaa

SEQ ID NO: 371101 - RNA, 24 nt, Human
ucaccguguuagccaggauggucu

SEQ ID NO: 371102 - RNA, 22 nt, Human
ucacuauaauguauuacugaau

SEQ ID NO: 371103 - RNA, 18 nt, Human
ucacugcaagcuccgccu

SEQ ID NO: 371104 - RNA, 23 nt, Human
ucacugcaagcuccgccuccugg

SEQ ID NO: 371105 - RNA, 24 nt, Human
ucacugcaagcuccgccuccuggg

SEQ ID NO: 371106 - RNA, 23 nt, Human
ucagccucccgaguagcugggac

SEQ ID NO: 371107 - RNA, 24 nt, Human
ucccaaagugcugggauuacaggc

SEQ ID NO: 371108 - RNA, 20 nt, Human
uccccgacacgacauggcca

SEQ ID NO: 371109 - RNA, 24 nt, Human
ucccgaguagcugggacuacaggc

SEQ ID NO: 371110 - RNA, 20 nt, Human
uccucacgcucacacggcca

SEQ ID NO: 371111 - RNA, 24 nt, Human
uccuggguucacgccauucuccug

SEQ ID NO: 371112 - RNA, 18 nt, Human
ucggccucccaaagugcu

SEQ ID NO: 371113 - RNA, 22 nt, Human
ucuaccuccaccagaacaucac

SEQ ID NO: 371114 - RNA, 23 nt, Human
ucuagcucuguugcccaggcugg

SEQ ID NO: 371115 - RNA, 24 nt, Human
ucuagcucuguugcccaggcugga

SEQ ID NO: 371116 - RNA, 24 nt, Human
ucuccugccucagccucccgagua

SEQ ID NO: 371117 - RNA, 24 nt, Human
ucuguugcccaggcuggagugcag

SEQ ID NO: 371118 - RNA, 21 nt, Human
ugaaagaaacuacagcuauca

SEQ ID NO: 371119 - RNA, 19 nt, Human
ugagagaggcggaugaagg

SEQ ID NO: 371120 - RNA, 21 nt, Human
ugagagaggcggaugaaggcg

SEQ ID NO: 371121 - RNA, 23 nt, Human
ugaggaggaagccgagaaggagg

SEQ ID NO: 371122 - RNA, 22 nt, Human
ugcaucaccaccgacuguggug

SEQ ID NO: 371123 - RNA, 20 nt, Human
ugccaagcaacaaguguuac

SEQ ID NO: 371124 - RNA, 18 nt, Human
ugcccaggcuggagugca

SEQ ID NO: 371125 - RNA, 21 nt, Human
ugcccaggcuggagugcagug

SEQ ID NO: 371126 - RNA, 22 nt, Human
ugcccaggcuggagugcagugg

SEQ ID NO: 371127 - RNA, 24 nt, Human
ugcccaggcuggagugcaguggca

SEQ ID NO: 371128 - RNA, 24 nt, Human
ugccucagccucccgaguagcugg

SEQ ID NO: 371129 - RNA, 24 nt, Human
ugcugggauuacaggcgugagcca

SEQ ID NO: 371130 - RNA, 22 nt, Human
uggaauggaguuccaaaucacu

SEQ ID NO: 371131 - RNA, 23 nt, Human
uggagugcaguggcacaaucucg

SEQ ID NO: 371132 - RNA, 24 nt, Human
uggagugcaguggcacaaucucgg

SEQ ID NO: 371133 - RNA, 24 nt, Human
uggcacaaucucggcucacugcaa

SEQ ID NO: 371134 - RNA, 21 nt, Human
ugggacuacaggcgcccgcca

SEQ ID NO: 371135 - RNA, 22 nt, Human
ugggacuacaggcgcccgccac

SEQ ID NO: 371136 - RNA, 24 nt, Human
ugggacuacaggcgcccgccacca

SEQ ID NO: 371137 - RNA, 18 nt, Human
ugggauuacaggcgugag

SEQ ID NO: 371138 - RNA, 21 nt, Human
ugggauuacaggcgugagcca

SEQ ID NO: 371139 - RNA, 22 nt, Human
ugggauuacaggcgugagccac

SEQ ID NO: 371140 - RNA, 22 nt, Human
ugggauuacaggcgugagccac

SEQ ID NO: 371141 - RNA, 22 nt, Human
ugggauuacaggcgugagccac

SEQ ID NO: 371142 - RNA, 24 nt, Human
ugggauuacaggcgugagccacug

SEQ ID NO: 371143 - RNA, 26 nt, Human
ugggauuacaggcgugagccacugug

SEQ ID NO: 371144 - RNA, 24 nt, Human
uggggaggaguagggaacgauggg

SEQ ID NO: 371145 - RNA, 24 nt, Human
ugggguugcaggccaugguguugg

SEQ ID NO: 371146 - RNA, 20 nt, Human
uggguucacgccauucuccu

SEQ ID NO: 371147 - RNA, 19 nt, Human
ugguuuuuuucccuucauu

SEQ ID NO: 371148 - RNA, 22 nt, Human
uuaguaaagacgggguuucacc

SEQ ID NO: 371149 - RNA, 24 nt, Human
uuaguaaagacgggguuucaccgu

SEQ ID NO: 371150 - RNA, 23 nt, Human
uuccaaaucacucugugcuccgc

SEQ ID NO: 371151 - RNA, 24 nt, Human
uugcccaggcuggagugcaguggc

SEQ ID NO: 371152 - RNA, 18 nt, Human
uuggaucagcaauuuagc

SEQ ID NO: 371153 - RNA, 19 nt, Human
uuucaccguguuagccagg

SEQ ID NO: 371154 - RNA, 19 nt, Human
aacacccuucucacaggcc

SEQ ID NO: 371155 - RNA, 21 nt, Human
aacaguacgguggccgggagg

SEQ ID NO: 371156 - RNA, 18 nt, Human
acucuaacacuucauucc

SEQ ID NO: 371157 - RNA, 20 nt, Human
agaaaaaaacaguacaauga

SEQ ID NO: 371158 - RNA, 21 nt, Human
caaaaucuaauccacauucaa

SEQ ID NO: 371159 - RNA, 20 nt, Human
cacauuccagaucugucuga

SEQ ID NO: 371160 - RNA, 18 nt, Human
caccaccgugcuggccuc

SEQ ID NO: 371161 - RNA, 19 nt, Human
cacucuaacacuucauucc

SEQ ID NO: 371162 - RNA, 21 nt, Human
cagcguggggccccgucccuu

SEQ ID NO: 371163 - RNA, 23 nt, Human
cagucuuuuacagaugguuuuuc

SEQ ID NO: 371164 - RNA, 21 nt, Human
cauuccagaucugucugaucg

SEQ ID NO: 371165 - RNA, 22 nt, Human
ccacuuccuuuuuucuuuccca

SEQ ID NO: 371166 - RNA, 20 nt, Human
ccagucuuuuacagaugguu

SEQ ID NO: 371167 - RNA, 19 nt, Human
ccgccgcccggggcuucug

SEQ ID NO: 371168 - RNA, 21 nt, Human
cgagugguuaucgcccuccca

SEQ ID NO: 371169 - RNA, 20 nt, Human
cgggaggaccgcuuguagua

SEQ ID NO: 371170 - RNA, 18 nt, Human
cuaaaugcuuaaguaugc

SEQ ID NO: 371171 - RNA, 24 nt, Human
cuaauccacauucaaauuuucuca

SEQ ID NO: 371172 - RNA, 22 nt, Human
gaacaguacgguggccgggagg

SEQ ID NO: 371173 - RNA, 21 nt, Human
gacuuccgccgcccggggcuu

SEQ ID NO: 371174 - RNA, 20 nt, Human
gagugguuaucgcccuccca

SEQ ID NO: 371175 - RNA, 22 nt, Human
gcagcguggggccccgucccuu

SEQ ID NO: 371176 - RNA, 19 nt, Human
gcccggggcuucugggagc

SEQ ID NO: 371177 - RNA, 21 nt, Human
uaaacuacaacacccuucuca

SEQ ID NO: 371178 - RNA, 24 nt, Human
uagaaaaaaacaguacaaugaaca

SEQ ID NO: 371179 - RNA, 19 nt, Human
uauagaagauagaaaaaaa

SEQ ID NO: 371180 - RNA, 28 nt, Human
uaucauucaaaaucuaauccacauucaa

SEQ ID NO: 371181 - RNA, 20 nt, Human
ucuacgagugguuaucgccc

SEQ ID NO: 371182 - RNA, 21 nt, Human
ugcauuugguuauuacauaac

SEQ ID NO: 371183 - RNA, 23 nt, Human
ugcuggccucccacccccacccc

SEQ ID NO: 371184 - RNA, 18 nt, Human
uuaagacacucuaacacu

SEQ ID NO: 371185 - RNA, 24 nt, Human
uuacagaugguuuuucaaaagagu

SEQ ID NO: 371186 - RNA, 23 nt, Human
uuauaaacuacaacacccuucuc

SEQ ID NO: 371187 - RNA, 24 nt, Human
uuccuuuuuucuuucccaacacuu

SEQ ID NO: 371188 - RNA, 19 nt, Human
uucuacgagugguuaucgc

SEQ ID NO: 371189 - RNA, 19 nt, Human
uuuaagacacucuaacacu

SEQ ID NO: 371190 - RNA, 22 nt, Human
uuuaagacacucuaacacuuca

SEQ ID NO: 371191 - RNA, 19 nt, Human
uuuaaucaagaagaguuac

SEQ ID NO: 371192 - RNA, 20 nt, Human
uuucacauugcauuugguua

SEQ ID NO: 371193 - RNA, 18 nt, Human
uuuuuucuuucccaacac

SEQ ID NO: 371194 - RNA, 18 nt, Human
aaaaaggaaacgcaaaga

SEQ ID NO: 371195 - RNA, 18 nt, Human
aaaaaggaaacgcaaaga

SEQ ID NO: 371196 - RNA, 23 nt, Human
aacaaaagauggguuugggguag

SEQ ID NO: 371197 - RNA, 20 nt, Human
aaccccgccaacucagcaag

SEQ ID NO: 371198 - RNA, 23 nt, Human
aacccggggcccauguugggcug

SEQ ID NO: 371199 - RNA, 20 nt, Human
aaccuggaacccagccagca

SEQ ID NO: 371200 - RNA, 20 nt, Human
aagcccuagccucgcaaucc

SEQ ID NO: 371201 - RNA, 24 nt, Human
acaagcucugcauacccccugccc

SEQ ID NO: 371202 - RNA, 18 nt, Human
acccugagcuccagggcc

SEQ ID NO: 371203 - RNA, 19 nt, Human
acccugagcuccagggccc

SEQ ID NO: 371204 - RNA, 20 nt, Human
accucggcggccgcggaggc

SEQ ID NO: 371205 - RNA, 20 nt, Human
accugugcgcccagagaauc

SEQ ID NO: 371206 - RNA, 19 nt, Human
acuguauuucuucucccca

SEQ ID NO: 371207 - RNA, 19 nt, Human
agaaaacggcagccagccc

SEQ ID NO: 371208 - RNA, 19 nt, Human
agaacaaaagauggguuug

SEQ ID NO: 371209 - RNA, 21 nt, Human
agccagacauccagaacucuc

SEQ ID NO: 371210 - RNA, 21 nt, Human
agccccggcgcccccgccugc

SEQ ID NO: 371211 - RNA, 19 nt, Human
aggaauacggugcccuggc

SEQ ID NO: 371212 - RNA, 28 nt, Human
aggagaaggaggauauaggagaacaaaa

SEQ ID NO: 371213 - RNA, 18 nt, Human
augcucggugaggaagaa

SEQ ID NO: 371214 - RNA, 19 nt, Human
caaaagccccggcgccccc

SEQ ID NO: 371215 - RNA, 22 nt, Human
caaagcccacucugggaacugu

SEQ ID NO: 371216 - RNA, 27 nt, Human
caacaaaaaggaaacgcaaagagguug

SEQ ID NO: 371217 - RNA, 18 nt, Human
caagcucugcauaccccc

SEQ ID NO: 371218 - RNA, 22 nt, Human
caauccaaguugucuucagccc

SEQ ID NO: 371219 - RNA, 25 nt, Human
caccacaagcucugcauacccccug

SEQ ID NO: 371220 - RNA, 26 nt, Human
caccgcugaaacugaacugaaaugga

SEQ ID NO: 371221 - RNA, 19 nt, Human
caccucugccuccaccguu

SEQ ID NO: 371222 - RNA, 24 nt, Human
cacucacugcuccuaucccacucc

SEQ ID NO: 371223 - RNA, 23 nt, Human
cagaaaacggcagccagcccuca

SEQ ID NO: 371224 - RNA, 25 nt, Human
cagaaacaaggacccugagcuccag

SEQ ID NO: 371225 - RNA, 20 nt, Human
cagcaucuauggcuuccugc

SEQ ID NO: 371226 - RNA, 21 nt, Human
cagcuucccaggguagccccu

SEQ ID NO: 371227 - RNA, 21 nt, Human
cauggccccugugggagcagg

SEQ ID NO: 371228 - RNA, 21 nt, Human
ccagccagcaucuauggcuuc

SEQ ID NO: 371229 - RNA, 23 nt, Human
ccagccccacaaacaccugggag

SEQ ID NO: 371230 - RNA, 25 nt, Human
cccacaaacaccugggagaggaaua

SEQ ID NO: 371231 - RNA, 24 nt, Human
cccacaguccugcugcuuugagcc

SEQ ID NO: 371232 - RNA, 26 nt, Human
cccagaaaacggcagccagcccucau

SEQ ID NO: 371233 - RNA, 19 nt, Human
cccagagaauccgggcccg

SEQ ID NO: 371234 - RNA, 18 nt, Human
ccccggcgcccccgccug

SEQ ID NO: 371235 - RNA, 18 nt, Human
ccccucggcgcccaacuu

SEQ ID NO: 371236 - RNA, 24 nt, Human
cccggccacacgcacgaccucggc

SEQ ID NO: 371237 - RNA, 18 nt, Human
cccggggcccauguuggg

SEQ ID NO: 371238 - RNA, 19 nt, Human
cccucaagucuagaggacc

SEQ ID NO: 371239 - RNA, 20 nt, Human
cccucaagucuagaggaccc

SEQ ID NO: 371240 - RNA, 20 nt, Human
ccgccugcuccucggagccc

SEQ ID NO: 371241 - RNA, 24 nt, Human
ccgcugaaacugaacugaaaugga

SEQ ID NO: 371242 - RNA, 27 nt, Human
ccguuccugccccaccacaagcucugc

SEQ ID NO: 371243 - RNA, 23 nt, Human
ccugccccaccacaagcucugca

SEQ ID NO: 371244 - RNA, 20 nt, Human
cgccccggccccucggcgcc

SEQ ID NO: 371245 - RNA, 22 nt, Human
cgccccggccccucggcgccca

SEQ ID NO: 371246 - RNA, 19 nt, Human
cgccugcuccucggagccc

SEQ ID NO: 371247 - RNA, 20 nt, Human
cggagggcagucagcccaca

SEQ ID NO: 371248 - RNA, 24 nt, Human
cuccaccguuccugccccaccaca

SEQ ID NO: 371249 - RNA, 21 nt, Human
cuccagggcccugucccuggg

SEQ ID NO: 371250 - RNA, 19 nt, Human
cuccgcgcgccccggcccc

SEQ ID NO: 371251 - RNA, 21 nt, Human
cuccgcgcgccccggccccuc

SEQ ID NO: 371252 - RNA, 21 nt, Human
cugaagcuacggcagcuuccc

SEQ ID NO: 371253 - RNA, 25 nt, Human
cugagcuccagggcccugucccugg

SEQ ID NO: 371254 - RNA, 18 nt, Human
cuggccaccaaagcccac

SEQ ID NO: 371255 - RNA, 23 nt, Human
cuuuccugucccagguccugcuc

SEQ ID NO: 371256 - RNA, 20 nt, Human
gaaaacggcagccagcccuc

SEQ ID NO: 371257 - RNA, 22 nt, Human
gaaacugaacugaaauggaaca

SEQ ID NO: 371258 - RNA, 20 nt, Human
gaacugucaccucugccucc

SEQ ID NO: 371259 - RNA, 19 nt, Human
gaauccgggcccgggcccc

SEQ ID NO: 371260 - RNA, 21 nt, Human
gaaucuccucacccaccggcu

SEQ ID NO: 371261 - RNA, 23 nt, Human
gacugccaggaaagggcacccau

SEQ ID NO: 371262 - RNA, 18 nt, Human
gcuccagggcccuguccc

SEQ ID NO: 371263 - RNA, 19 nt, Human
ggaaacgcaaagagguugg

SEQ ID NO: 371264 - RNA, 18 nt, Human
ggaacugucaccucugcc

SEQ ID NO: 371265 - RNA, 18 nt, Human
ggagccccccggccacac

SEQ ID NO: 371266 - RNA, 21 nt, Human
ggccacacgcacgaccucggc

SEQ ID NO: 371267 - RNA, 23 nt, Human
ggcccuagagccgaaccagucuc

SEQ ID NO: 371268 - RNA, 23 nt, Human
ggggugaggccuccccauggaga

SEQ ID NO: 371269 - RNA, 19 nt, Human
ggugaggaagaagagccuu

SEQ ID NO: 371270 - RNA, 19 nt, Human
gugcagcagcucugggucc

SEQ ID NO: 371271 - RNA, 25 nt, Human
uaaaugggugugaggaagagaugau

SEQ ID NO: 371272 - RNA, 21 nt, Human
ucagcccagaaaacggcagcc

SEQ ID NO: 371273 - RNA, 27 nt, Human
ucagcccagaaaacggcagccagcccu

SEQ ID NO: 371274 - RNA, 19 nt, Human
ucccuggccaccaaagccc

SEQ ID NO: 371275 - RNA, 21 nt, Human
ucccuggggugaggccucccc

SEQ ID NO: 371276 - RNA, 19 nt, Human
uccucucuuuccuguccca

SEQ ID NO: 371277 - RNA, 18 nt, Human
ucuccuguggagaugggg

SEQ ID NO: 371278 - RNA, 18 nt, Human
ucugcauacccccugccc

SEQ ID NO: 371279 - RNA, 23 nt, Human
ugaagcuacggcagcuucccagg

SEQ ID NO: 371280 - RNA, 21 nt, Human
ugaaggaagcuuucuugccug

SEQ ID NO: 371281 - RNA, 19 nt, Human
ugagccagacauccagaac

SEQ ID NO: 371282 - RNA, 23 nt, Human
ugaggaagaagagccuugaaggg

SEQ ID NO: 371283 - RNA, 22 nt, Human
ugaggaagagaugaugcaucuu

SEQ ID NO: 371284 - RNA, 20 nt, Human
ugaggcccuagagccgaacc

SEQ ID NO: 371285 - RNA, 18 nt, Human
ugagugugugcagcagcu

SEQ ID NO: 371286 - RNA, 24 nt, Human
ugagugugugcagcagcucugggu

SEQ ID NO: 371287 - RNA, 20 nt, Human
ugccuggcugaagcuacggc

SEQ ID NO: 371288 - RNA, 18 nt, Human
uggaacaggagaaggagg

SEQ ID NO: 371289 - RNA, 19 nt, Human
uggaaggugggaaucuccu

SEQ ID NO: 371290 - RNA, 20 nt, Human
uggcagggcagaaacaagga

SEQ ID NO: 371291 - RNA, 23 nt, Human
uggcuuccugcugucugauucuu

SEQ ID NO: 371292 - RNA, 28 nt, Human
uggggccuugggaacauguuuggaggcu

SEQ ID NO: 371293 - RNA, 18 nt, Human
ugggguagugccaccuau

SEQ ID NO: 371294 - RNA, 20 nt, Human
ugguuccucucuuuccuguc

SEQ ID NO: 371295 - RNA, 21 nt, Human
ugguuccucucuuuccugucc

SEQ ID NO: 371296 - RNA, 18 nt, Human
ugugugcagcagcucugg

SEQ ID NO: 371297 - RNA, 22 nt, Human
uucuccccauaaccuggaaccc

SEQ ID NO: 371298 - RNA, 18 nt, Human
uugaaaguggggccuugg

SEQ ID NO: 371299 - RNA, 22 nt, Human
uuuuauugacuguauuucuucu

SEQ ID NO: 371300 - RNA, 22 nt, Human
uuuuuuuuuuuuauacaaaaac

SEQ ID NO: 371301 - RNA, 25 nt, Human
aaaaaaacaaacaaacccaugcagg

SEQ ID NO: 371302 - RNA, 22 nt, Human
aaaacaaaacggccacagccuc

SEQ ID NO: 371303 - RNA, 22 nt, Human
aaaacaggaaaauuacaaauca

SEQ ID NO: 371304 - RNA, 21 nt, Human
aaacaaacaaacccaugcagg

SEQ ID NO: 371305 - RNA, 22 nt, Human
aaaugcaacauggaacccaguu

SEQ ID NO: 371306 - RNA, 18 nt, Human
aacccaguuuauuaucag

SEQ ID NO: 371307 - RNA, 23 nt, Human
aaccucuaagaucuucuccaguu

SEQ ID NO: 371308 - RNA, 21 nt, Human
aagaaaacaaaacggccacag

SEQ ID NO: 371309 - RNA, 22 nt, Human
aagaaaacaaaacggccacagc

SEQ ID NO: 371310 - RNA, 25 nt, Human
aagaaaacaaaacggccacagccuc

SEQ ID NO: 371311 - RNA, 19 nt, Human
aagacauuucaaacugugg

SEQ ID NO: 371312 - RNA, 19 nt, Human
aagagaaggugggcuucaa

SEQ ID NO: 371313 - RNA, 19 nt, Human
aagagaccacauuugaaua

SEQ ID NO: 371314 - RNA, 18 nt, Human
aagaggaagagacaacaa

SEQ ID NO: 371315 - RNA, 26 nt, Human
acaagaguucugaagaggaagagaca

SEQ ID NO: 371316 - RNA, 21 nt, Human
acucuugucuacaucagcaaa

SEQ ID NO: 371317 - RNA, 20 nt, Human
agagguggggagccuggggg

SEQ ID NO: 371318 - RNA, 19 nt, Human
agaguucccaguagcuaau

SEQ ID NO: 371319 - RNA, 19 nt, Human
agcacuuucauugugguuu

SEQ ID NO: 371320 - RNA, 21 nt, Human
agccuggggggacaagaguuc

SEQ ID NO: 371321 - RNA, 23 nt, Human
agguugugcucaguuguagggug

SEQ ID NO: 371322 - RNA, 20 nt, Human
aguacacagaugaaaugcaa

SEQ ID NO: 371323 - RNA, 18 nt, Human
auaauacaaaacaggaaa

SEQ ID NO: 371324 - RNA, 19 nt, Human
aucaugcuuuucucccagc

SEQ ID NO: 371325 - RNA, 21 nt, Human
augaaaugcaacauggaaccc

SEQ ID NO: 371326 - RNA, 23 nt, Human
caaaacggccacagccuccagac

SEQ ID NO: 371327 - RNA, 22 nt, Human
caagaaaacaaaacggccacag

SEQ ID NO: 371328 - RNA, 24 nt, Human
caagaaaacaaaacggccacagcc

SEQ ID NO: 371329 - RNA, 21 nt, Human
cagcaguaccauccacccggc

SEQ ID NO: 371330 - RNA, 21 nt, Human
caguaaaaaaacaaacaaacc

SEQ ID NO: 371331 - RNA, 22 nt, Human
caucagcaaagcagauaauaca

SEQ ID NO: 371332 - RNA, 23 nt, Human
ccacacauuuaaaucacccagca

SEQ ID NO: 371333 - RNA, 24 nt, Human
ccacacauuuaaaucacccagcaa

SEQ ID NO: 371334 - RNA, 19 nt, Human
ccacucaccccuugggaga

SEQ ID NO: 371335 - RNA, 18 nt, Human
cccagcaaauauuccgaa

SEQ ID NO: 371336 - RNA, 22 nt, Human
cccaguuuauuaucagaacaac

SEQ ID NO: 371337 - RNA, 19 nt, Human
ccgccucacucccccgauu

SEQ ID NO: 371338 - RNA, 18 nt, Human
ccugguggcuggaccaug

SEQ ID NO: 371339 - RNA, 19 nt, Human
cggccacagccuccagaca

SEQ ID NO: 371340 - RNA, 25 nt, Human
cuacucaguuaacucuugucuacau

SEQ ID NO: 371341 - RNA, 22 nt, Human
cucacucccccgauuuuagcca

SEQ ID NO: 371342 - RNA, 22 nt, Human
cuggagugucaagucucugccc

SEQ ID NO: 371343 - RNA, 21 nt, Human
cuugggagacccucaaaagcc

SEQ ID NO: 371344 - RNA, 23 nt, Human
gacauuucaaacugugguccuga

SEQ ID NO: 371345 - RNA, 21 nt, Human
gaccgugcuggucuauuaggc

SEQ ID NO: 371346 - RNA, 19 nt, Human
gagcccggugucgcgccgc

SEQ ID NO: 371347 - RNA, 21 nt, Human
gagguggggagccugggggga

SEQ ID NO: 371348 - RNA, 25 nt, Human
gcacugccugaggauuaaaaaacua

SEQ ID NO: 371349 - RNA, 18 nt, Human
gcaguaaaaaaacaaaca

SEQ ID NO: 371350 - RNA, 19 nt, Human
gcaguaccauccacccggc

SEQ ID NO: 371351 - RNA, 18 nt, Human
gcccuuuuuuccuuuccc

SEQ ID NO: 371352 - RNA, 22 nt, Human
gccucacucccccgauuuuagc

SEQ ID NO: 371353 - RNA, 19 nt, Human
gcuuuucucccagcaguuu

SEQ ID NO: 371354 - RNA, 19 nt, Human
ggauuaaaaaacuaguucu

SEQ ID NO: 371355 - RNA, 22 nt, Human
gggaaucaugcuuuucucccag

SEQ ID NO: 371356 - RNA, 23 nt, Human
gggacaagaguucugaagaggaa

SEQ ID NO: 371357 - RNA, 20 nt, Human
guggagugacugugcauccc

SEQ ID NO: 371358 - RNA, 24 nt, Human
uaaaaaaacaaacaaacccaugca

SEQ ID NO: 371359 - RNA, 25 nt, Human
uaaguuaaucaagugcauaccacaa

SEQ ID NO: 371360 - RNA, 21 nt, Human
uacaaaacaggaaaauuacaa

SEQ ID NO: 371361 - RNA, 18 nt, Human
uaccaugauaaaauuuga

SEQ ID NO: 371362 - RNA, 21 nt, Human
uaggguggggggaugcacugc

SEQ ID NO: 371363 - RNA, 21 nt, Human
uaugaaagacauuucaaacug

SEQ ID NO: 371364 - RNA, 18 nt, Human
uaugacaaauacuuacau

SEQ ID NO: 371365 - RNA, 23 nt, Human
uaugacaaauacuuacauugaca

SEQ ID NO: 371366 - RNA, 24 nt, Human
uaugacaaauacuuacauugacaa

SEQ ID NO: 371367 - RNA, 23 nt, Human
uaugugaaaagagaaggugggcu

SEQ ID NO: 371368 - RNA, 22 nt, Human
ucaaacugugguccugaagagu

SEQ ID NO: 371369 - RNA, 24 nt, Human
ucaagucucugcccuuuuuuccuu

SEQ ID NO: 371370 - RNA, 24 nt, Human
ucaaugguggauguggagugacug

SEQ ID NO: 371371 - RNA, 31 nt, Human
ucacccagcaaauauuccgaaggcuaauugu

SEQ ID NO: 371372 - RNA, 20 nt, Human
uccaacacguccacucaccc

SEQ ID NO: 371373 - RNA, 21 nt, Human
ucccauggaagggacacaggg

SEQ ID NO: 371374 - RNA, 25 nt, Human
ugagcaguaaaaaaacaaacaaacc

SEQ ID NO: 371375 - RNA, 20 nt, Human
ugaggaagaauuuugaccac

SEQ ID NO: 371376 - RNA, 23 nt, Human
ugaggaagaauuuugaccacgga

SEQ ID NO: 371377 - RNA, 21 nt, Human
ugcccuuggaaugagaggcac

SEQ ID NO: 371378 - RNA, 24 nt, Human
uggaaaugagacccacacauuuaa

SEQ ID NO: 371379 - RNA, 18 nt, Human
uggcuggaccauggugcu

SEQ ID NO: 371380 - RNA, 20 nt, Human
uggcuggaccauggugcuuc

SEQ ID NO: 371381 - RNA, 21 nt, Human
ugggagacccucaaaagccag

SEQ ID NO: 371382 - RNA, 19 nt, Human
uggggagccuggggggaca

SEQ ID NO: 371383 - RNA, 23 nt, Human
ugguuguuguuuagguguucucg

SEQ ID NO: 371384 - RNA, 18 nt, Human
uguagaaaaaacaucagg

SEQ ID NO: 371385 - RNA, 19 nt, Human
uguaggguggggggaugca

SEQ ID NO: 371386 - RNA, 23 nt, Human
ugucaagucucugcccuuuuuuc

SEQ ID NO: 371387 - RNA, 19 nt, Human
ugugguuuuggaccucaga

SEQ ID NO: 371388 - RNA, 21 nt, Human
uuacaaaucacugauacuuag

SEQ ID NO: 371389 - RNA, 21 nt, Human
uuaguccuugugggaaucaug

SEQ ID NO: 371390 - RNA, 20 nt, Human
uucaaccucuaagaucuucu

SEQ ID NO: 371391 - RNA, 23 nt, Human
uucauugugguuuuggaccucag

SEQ ID NO: 371392 - RNA, 18 nt, Human
uucccaguagcuaauguu

SEQ ID NO: 371393 - RNA, 18 nt, Human
uuccggagcccggugucg

SEQ ID NO: 371394 - RNA, 18 nt, Human
uugcacuguggggaaaga

SEQ ID NO: 371395 - RNA, 22 nt, Human
uuuaaaauaaauguuuaguuuc

SEQ ID NO: 371396 - RNA, 25 nt, Human
aaguaagaaauacagccaacuagaa

SEQ ID NO: 371397 - RNA, 18 nt, Human
aaguagcuugggaaacuu

SEQ ID NO: 371398 - RNA, 24 nt, Human
aaucauaucccuccucaaaaccac

SEQ ID NO: 371399 - RNA, 20 nt, Human
acugccuaagggaaguccca

SEQ ID NO: 371400 - RNA, 23 nt, Human
agcuugggaaacuuuucaucaaa

SEQ ID NO: 371401 - RNA, 21 nt, Human
caaacaggccauuucugcuag

SEQ ID NO: 371402 - RNA, 19 nt, Human
caggagguucacaaucauc

SEQ ID NO: 371403 - RNA, 24 nt, Human
cauaaaaucauaucccuccucaaa

SEQ ID NO: 371404 - RNA, 21 nt, Human
ccagaugcaagaauacaaagc

SEQ ID NO: 371405 - RNA, 25 nt, Human
ccauaucauucuccauaaaaucaua

SEQ ID NO: 371406 - RNA, 19 nt, Human
ccucaaaaccacacccucc

SEQ ID NO: 371407 - RNA, 23 nt, Human
ccucugagcugcgaucucaauuc

SEQ ID NO: 371408 - RNA, 22 nt, Human
cucaggcauucaggagguucac

SEQ ID NO: 371409 - RNA, 20 nt, Human
cugugaggugccaaaaauga

SEQ ID NO: 371410 - RNA, 18 nt, Human
cuuggaagguggaagggg

SEQ ID NO: 371411 - RNA, 18 nt, Human
gaaggggcgcccgguguc

SEQ ID NO: 371412 - RNA, 19 nt, Human
ggugaagaacuaaaacgca

SEQ ID NO: 371413 - RNA, 20 nt, Human
uaaaguaagaaauacagcca

SEQ ID NO: 371414 - RNA, 20 nt, Human
uaaaguaagaaauacagccc

SEQ ID NO: 371415 - RNA, 23 nt, Human
uaagaaauacagccaacuagaag

SEQ ID NO: 371416 - RNA, 22 nt, Human
uauugaauccaucuucugccuc

SEQ ID NO: 371417 - RNA, 19 nt, Human
ucauaucccuccucaaaac

SEQ ID NO: 371418 - RNA, 19 nt, Human
ugcaagaauacaaagcucc

SEQ ID NO: 371419 - RNA, 23 nt, Human
ugcuagagucucaggcauucagg

SEQ ID NO: 371420 - RNA, 24 nt, Human
ugcuuuauguauuuguuuacugcc

SEQ ID NO: 371421 - RNA, 18 nt, Human
uggaaggggcgcccggug

SEQ ID NO: 371422 - RNA, 22 nt, Human
uuagucaaauauuuauuugaac

SEQ ID NO: 371423 - RNA, 23 nt, Human
uuagugacauaauuuaaaaggug

SEQ ID NO: 371424 - RNA, 18 nt, Human
uuugaacucauacaaagu

SEQ ID NO: 371425 - RNA, 19 nt, Human
aaaaaaaaaacacccuaag

SEQ ID NO: 371426 - RNA, 19 nt, Human
aaaaaaacacccuaagcuc

SEQ ID NO: 371427 - RNA, 22 nt, Human
aaaaaaacacccuaagcucauc

SEQ ID NO: 371428 - RNA, 25 nt, Human
aaaaacaaaaacaaaagcccacaga

SEQ ID NO: 371429 - RNA, 22 nt, Human
aaaaacaaaagcccacagagaa

SEQ ID NO: 371430 - RNA, 23 nt, Human
aaaaacaaaagcccacagagaaa

SEQ ID NO: 371431 - RNA, 19 nt, Human
aaaaacacccuaagcucau

SEQ ID NO: 371432 - RNA, 28 nt, Human
aaaacaaaaacaaaaacaaaagcccaca

SEQ ID NO: 371433 - RNA, 25 nt, Human
aaacaaaaacaaaaacaaaagccca

SEQ ID NO: 371434 - RNA, 21 nt, Human
aaacaccaucaagaucuuccc

SEQ ID NO: 371435 - RNA, 22 nt, Human
aacaaaaacaaaagcccacaga

SEQ ID NO: 371436 - RNA, 22 nt, Human
aacacccuaagcucaucaaaaa

SEQ ID NO: 371437 - RNA, 30 nt, Human
aagaucuaccaaaacaaaaacaaaaacaaa

SEQ ID NO: 371438 - RNA, 22 nt, Human
acaaaaacaaaaacaaaagccc

SEQ ID NO: 371439 - RNA, 23 nt, Human
acaaaaacaaaagcccacagaga

SEQ ID NO: 371440 - RNA, 21 nt, Human
accaucaagaucuucccucca

SEQ ID NO: 371441 - RNA, 18 nt, Human
agagaaauaaaaaggaac

SEQ ID NO: 371442 - RNA, 21 nt, Human
aggaacaaaaaucacauucua

SEQ ID NO: 371443 - RNA, 19 nt, Human
auccaaauugaagaucuac

SEQ ID NO: 371444 - RNA, 23 nt, Human
caaaaacaaaaacaaaagcccac

SEQ ID NO: 371445 - RNA, 21 nt, Human
caaaaacaaaagcccacagag

SEQ ID NO: 371446 - RNA, 20 nt, Human
caggaaggcuauuugcagca

SEQ ID NO: 371447 - RNA, 31 nt, Human
ccaaaacaaaaacaaaaacaaaagcccacaa

SEQ ID NO: 371448 - RNA, 28 nt, Human
ccaaaacaaaaacaaaaacaaaagcccc

SEQ ID NO: 371449 - RNA, 19 nt, Human
ccacagagaaauaaaaagg

SEQ ID NO: 371450 - RNA, 24 nt, Human
ccauccuucagcugacuuucaaaa

SEQ ID NO: 371451 - RNA, 22 nt, Human
cccugugccaugccugggggag

SEQ ID NO: 371452 - RNA, 22 nt, Human
cgaggcccugugccaugccugg

SEQ ID NO: 371453 - RNA, 18 nt, Human
cgggagacuggggggccg

SEQ ID NO: 371454 - RNA, 22 nt, Human
cuccaaauauccaaauugaaga

SEQ ID NO: 371455 - RNA, 24 nt, Human
gcaaaacaacgauguucacuccuc

SEQ ID NO: 371456 - RNA, 21 nt, Human
gcccugugccaugccuggggg

SEQ ID NO: 371457 - RNA, 18 nt, Human
uacagcauauggagguca

SEQ ID NO: 371458 - RNA, 22 nt, Human
uaccaaaacaaaaacaaaaaca

SEQ ID NO: 371459 - RNA, 20 nt, Human
uauggaggucaggaaggcua

SEQ ID NO: 371460 - RNA, 24 nt, Human
uauuuuuuuuuaacucucucuuau

SEQ ID NO: 371461 - RNA, 22 nt, Human
ugacuuucaaaaaaaaaacacc

SEQ ID NO: 371462 - RNA, 24 nt, Human
ugacuuucaaaaaaaaaacacccu

SEQ ID NO: 371463 - RNA, 19 nt, Human
ugucuaaccauccuucagc

SEQ ID NO: 371464 - RNA, 23 nt, Human
uuuuaauugaagcaauccuauuu

SEQ ID NO: 371465 - RNA, 18 nt, Human
uuuuuuuuuuuuuuuuug

SEQ ID NO: 371466 - RNA, 24 nt, Human
uuuuuuuuuuuuuuuuugucucuu

SEQ ID NO: 371467 - RNA, 24 nt, Human
aaaaaggcagagaauggccaccaa

SEQ ID NO: 371468 - RNA, 24 nt, Human
aaacaggaaaugagaacauuucag

SEQ ID NO: 371469 - RNA, 18 nt, Human
aaauuggugaauaaacac

SEQ ID NO: 371470 - RNA, 18 nt, Human
aagcagcacggcacaaac

SEQ ID NO: 371471 - RNA, 20 nt, Human
acacaacagagccaacaaac

SEQ ID NO: 371472 - RNA, 21 nt, Human
acacaacagagccaacaaaca

SEQ ID NO: 371473 - RNA, 22 nt, Human
acagagccaacaaacaucccac

SEQ ID NO: 371474 - RNA, 22 nt, Human
accaaccuugcccccaauaccu

SEQ ID NO: 371475 - RNA, 22 nt, Human
agaagaaaucugaggccacaac

SEQ ID NO: 371476 - RNA, 22 nt, Human
agagaggaaaaucaucguggug

SEQ ID NO: 371477 - RNA, 22 nt, Human
agauauaguuuugaguugcacu

SEQ ID NO: 371478 - RNA, 23 nt, Human
agcaauggagccucagggaagga

SEQ ID NO: 371479 - RNA, 23 nt, Human
auauacugacaaagcuuaaauuu

SEQ ID NO: 371480 - RNA, 27 nt, Human
aucagaagcaaauacuagaagaaaucu

SEQ ID NO: 371481 - RNA, 18 nt, Human
auggccaccaagcagcaa

SEQ ID NO: 371482 - RNA, 18 nt, Human
auggucacgugcucacca

SEQ ID NO: 371483 - RNA, 21 nt, Human
caacagcaaugcgaggaugga

SEQ ID NO: 371484 - RNA, 22 nt, Human
caacauaacugcaaauucagca

SEQ ID NO: 371485 - RNA, 24 nt, Human
caacauaacugcaaauucagcaau

SEQ ID NO: 371486 - RNA, 22 nt, Human
cacaacaccauuaccaaaugag

SEQ ID NO: 371487 - RNA, 20 nt, Human
cagaacugaaaucaccagac

SEQ ID NO: 371488 - RNA, 22 nt, Human
cagagccaacaaacaucccacc

SEQ ID NO: 371489 - RNA, 22 nt, Human
cagcaagauuucaagcaagcaa

SEQ ID NO: 371490 - RNA, 19 nt, Human
cagcacggcacaaacccac

SEQ ID NO: 371491 - RNA, 23 nt, Human
cauacagcaaacaggaaaugaga

SEQ ID NO: 371492 - RNA, 22 nt, Human
caugaagucaucauuccauggg

SEQ ID NO: 371493 - RNA, 22 nt, Human
cauggucacgugcucaccauuc

SEQ ID NO: 371494 - RNA, 21 nt, Human
ccacaauaucuugcaacucau

SEQ ID NO: 371495 - RNA, 21 nt, Human
cccaauaccuguccaacagcu

SEQ ID NO: 371496 - RNA, 23 nt, Human
cccacaauaucuugcaacucauu

SEQ ID NO: 371497 - RNA, 21 nt, Human
ccccacugcgggaaacaccaa

SEQ ID NO: 371498 - RNA, 22 nt, Human
cccuggccagacuaaaagcgaa

SEQ ID NO: 371499 - RNA, 20 nt, Human
ccugugccuguaacagcaag

SEQ ID NO: 371500 - RNA, 19 nt, Human
cgagaagaacaugaaguca

SEQ ID NO: 371501 - RNA, 18 nt, Human
cgcgagcggcgcggggag

SEQ ID NO: 371502 - RNA, 18 nt, Human
cggccccgccgcucuccc

SEQ ID NO: 371503 - RNA, 24 nt, Human
cgggggaagcagcgcggagcgggc

SEQ ID NO: 371504 - RNA, 21 nt, Human
cuguccucccuaccaaccuug

SEQ ID NO: 371505 - RNA, 20 nt, Human
cuugaaguacaucaaagaga

SEQ ID NO: 371506 - RNA, 25 nt, Human
cuugcccccaauaccuguccaacag

SEQ ID NO: 371507 - RNA, 22 nt, Human
gaaguagcucuuauacacgaca

SEQ ID NO: 371508 - RNA, 25 nt, Human
gaauaaacacaacagagccaacaaa

SEQ ID NO: 371509 - RNA, 18 nt, Human
gagggguggcaggggggu

SEQ ID NO: 371510 - RNA, 20 nt, Human
gcccgggcuggggacgggcc

SEQ ID NO: 371511 - RNA, 22 nt, Human
gcccgggcuggggacgggcccu

SEQ ID NO: 371512 - RNA, 21 nt, Human
gcgcggggaggcggcgcgggg

SEQ ID NO: 371513 - RNA, 22 nt, Human
ggagggggggaaaacacaaaug

SEQ ID NO: 371514 - RNA, 19 nt, Human
gggaagcagcgcggagcgg

SEQ ID NO: 371515 - RNA, 19 nt, Human
gggaguggggugggagggg

SEQ ID NO: 371516 - RNA, 22 nt, Human
gggugggagggguggcaggggg

SEQ ID NO: 371517 - RNA, 21 nt, Human
ggugggagggguggcaggggg

SEQ ID NO: 371518 - RNA, 20 nt, Human
guacugagcagggagugggg

SEQ ID NO: 371519 - RNA, 19 nt, Human
guucauuuguaaccacacu

SEQ ID NO: 371520 - RNA, 21 nt, Human
uaccaaccuugcccccaauac

SEQ ID NO: 371521 - RNA, 23 nt, Human
uacccacaauaucuugcaacuca

SEQ ID NO: 371522 - RNA, 22 nt, Human
uaccugaacaaagauaacaauu

SEQ ID NO: 371523 - RNA, 27 nt, Human
uaccugaacaaagauaaccggggguuc

SEQ ID NO: 371524 - RNA, 20 nt, Human
uaccuguccaacagcugcau

SEQ ID NO: 371525 - RNA, 27 nt, Human
uaguaaaggacaacaaauaauguacaa

SEQ ID NO: 371526 - RNA, 24 nt, Human
ucaagcaagcaagagaugaugggu

SEQ ID NO: 371527 - RNA, 21 nt, Human
uccaguauuuucccuucaacu

SEQ ID NO: 371528 - RNA, 23 nt, Human
ucccuaccaaccuugcccccaau

SEQ ID NO: 371529 - RNA, 21 nt, Human
uccucccuaccaaccuugccc

SEQ ID NO: 371530 - RNA, 21 nt, Human
ugaaaucaccagacuaaugca

SEQ ID NO: 371531 - RNA, 21 nt, Human
ugaauaaacacaacagagcca

SEQ ID NO: 371532 - RNA, 23 nt, Human
ugaauaaacacaacagagccaac

SEQ ID NO: 371533 - RNA, 26 nt, Human
ugaauaaacacaacagagccaacaaa

SEQ ID NO: 371534 - RNA, 21 nt, Human
ugacuggagugagcaggggag

SEQ ID NO: 371535 - RNA, 21 nt, Human
ugcauaaauucaauaccuauu

SEQ ID NO: 371536 - RNA, 24 nt, Human
ugcccccaauaccuguccaacagc

SEQ ID NO: 371537 - RNA, 18 nt, Human
ugcgcgagcggcgcgggg

SEQ ID NO: 371538 - RNA, 19 nt, Human
uggaaagcagcacggcaca

SEQ ID NO: 371539 - RNA, 18 nt, Human
uggacggcccgggcuggg

SEQ ID NO: 371540 - RNA, 24 nt, Human
ugggaauuucuucaauauuaagag

SEQ ID NO: 371541 - RNA, 18 nt, Human
ugggagggguggcagggg

SEQ ID NO: 371542 - RNA, 20 nt, Human
uggggugggagggguggcaa

SEQ ID NO: 371543 - RNA, 23 nt, Human
uggggugggagggguggcagggg

SEQ ID NO: 371544 - RNA, 24 nt, Human
uggggugggagggguggcaggggg

SEQ ID NO: 371545 - RNA, 22 nt, Human
uggguccugggccucagacccc

SEQ ID NO: 371546 - RNA, 24 nt, Human
uguaggagggggggaaaacacaaa

SEQ ID NO: 371547 - RNA, 19 nt, Human
ugugccaauccuugccugu

SEQ ID NO: 371548 - RNA, 20 nt, Human
uucacagaacugaaaucacc

SEQ ID NO: 371549 - RNA, 22 nt, Human
uuuugggguuaaaaaaauguug

SEQ ID NO: 371550 - RNA, 25 nt, Human
agaauucucucaguccagcccaccc

SEQ ID NO: 371551 - RNA, 24 nt, Human
agagaauucucucaguccagccca

SEQ ID NO: 371552 - RNA, 18 nt, Human
aggugguuguagagcgac

SEQ ID NO: 371553 - RNA, 19 nt, Human
caacagacagggcaguggu

SEQ ID NO: 371554 - RNA, 22 nt, Human
cagacagggcagcggugggcgg

SEQ ID NO: 371555 - RNA, 22 nt, Human
cagacagggcagcggugggcgg

SEQ ID NO: 371556 - RNA, 22 nt, Human
cagacagggcaguggugggcgg

SEQ ID NO: 371557 - RNA, 22 nt, Human
cagugccuguggcaccugucac

SEQ ID NO: 371558 - RNA, 21 nt, Human
caucaugucguccaccuccac

SEQ ID NO: 371559 - RNA, 28 nt, Human
ccaggcccgcucagcaaccguccccugg

SEQ ID NO: 371560 - RNA, 19 nt, Human
ccccagugccuguggcacc

SEQ ID NO: 371561 - RNA, 22 nt, Human
ccccagugccuguggcaccuga

SEQ ID NO: 371562 - RNA, 18 nt, Human
cccggagagugggggcgg

SEQ ID NO: 371563 - RNA, 18 nt, Human
cccggagagugggggcgg

SEQ ID NO: 371564 - RNA, 18 nt, Human
cgcucagcaaccgucccc

SEQ ID NO: 371565 - RNA, 18 nt, Human
gacacacuuggggucagg

SEQ ID NO: 371566 - RNA, 21 nt, Human
gcccggagagugggggcggca

SEQ ID NO: 371567 - RNA, 21 nt, Human
gcccggagagugggggcggca

SEQ ID NO: 371568 - RNA, 19 nt, Human
gcgcaggccggaggugccg

SEQ ID NO: 371569 - RNA, 21 nt, Human
gcuggccaugcgggcgggcag

SEQ ID NO: 371570 - RNA, 20 nt, Human
ggacgcacaggcaggagacg

SEQ ID NO: 371571 - RNA, 20 nt, Human
ggacgcacaggcaggagacg

SEQ ID NO: 371572 - RNA, 24 nt, Human
ggcaguggugggcggacgcacagg

SEQ ID NO: 371573 - RNA, 21 nt, Human
gggcgggcaggcuagacauuc

SEQ ID NO: 371574 - RNA, 23 nt, Human
uccccagugccuguggcaccugu

SEQ ID NO: 371575 - RNA, 22 nt, Human
uggccccuagcuccgucgguuc

SEQ ID NO: 371576 - RNA, 24 nt, Human
uggccccuagcuccgucgguuccu

SEQ ID NO: 371577 - RNA, 24 nt, Human
uggggucaggcuucuugcccauga

SEQ ID NO: 371578 - RNA, 22 nt, Human
uggugggcggacgcacaggcag

SEQ ID NO: 371579 - RNA, 19 nt, Human
ugucccaggcccgcucagc

SEQ ID NO: 371580 - RNA, 22 nt, Human
ugucccaggcccgcucagcaac

SEQ ID NO: 371581 - RNA, 22 nt, Human
uguguaugugggggggagggug

SEQ ID NO: 371582 - RNA, 22 nt, Human
uguguaugugggggggagggug

SEQ ID NO: 371583 - RNA, 23 nt, Human
uguguaugugggggggagggugu

SEQ ID NO: 371584 - RNA, 23 nt, Human
uguguaugugggggggagggugu

SEQ ID NO: 371585 - RNA, 22 nt, Human
uuccuuucuggugagaucccca

SEQ ID NO: 371586 - RNA, 24 nt, Human
uucuugcccaugaucaucaugucg

SEQ ID NO: 371587 - RNA, 23 nt, Human
aaaacaacaacaaagaaaccaca

SEQ ID NO: 371588 - RNA, 18 nt, Human
aaacaaaaacaacaacaa

SEQ ID NO: 371589 - RNA, 22 nt, Human
aaacaaaaacaacaacaaagaa

SEQ ID NO: 371590 - RNA, 23 nt, Human
aaacaaaaacaacaacaaagaaa

SEQ ID NO: 371591 - RNA, 24 nt, Human
aaacaaaaacaacaacaaagaaac

SEQ ID NO: 371592 - RNA, 24 nt, Human
aaacaacaacaaagaaaccacaua

SEQ ID NO: 371593 - RNA, 22 nt, Human
aaacccucaaucagccacgccc

SEQ ID NO: 371594 - RNA, 21 nt, Human
aaacuggaaauggugucagaa

SEQ ID NO: 371595 - RNA, 21 nt, Human
aaagaaauauccugggccucc

SEQ ID NO: 371596 - RNA, 21 nt, Human
aaagagcucagggcugugagc

SEQ ID NO: 371597 - RNA, 18 nt, Human
aaagcagagacggaggcc

SEQ ID NO: 371598 - RNA, 22 nt, Human
aaagcagagacggaggccagga

SEQ ID NO: 371599 - RNA, 19 nt, Human
aaagucccccaucccccuc

SEQ ID NO: 371600 - RNA, 24 nt, Human
aaagucccccaucccccuccccca

SEQ ID NO: 371601 - RNA, 22 nt, Human
aacaaaaauaaacacauuuuua

SEQ ID NO: 371602 - RNA, 20 nt, Human
aacauuggccugcuguuuuc

SEQ ID NO: 371603 - RNA, 23 nt, Human
aaccucauuuggcagcccuucua

SEQ ID NO: 371604 - RNA, 18 nt, Human
aagagugaaccggagcuc

SEQ ID NO: 371605 - RNA, 19 nt, Human
aagcagagacggaggccag

SEQ ID NO: 371606 - RNA, 21 nt, Human
aagcagagacggaggccagga

SEQ ID NO: 371607 - RNA, 26 nt, Human
acaaaaauaaacacauuuuuaaaauc

SEQ ID NO: 371608 - RNA, 22 nt, Human
acaacaaagaaaccacauagga

SEQ ID NO: 371609 - RNA, 24 nt, Human
acaacaacaaagaaaccacauagg

SEQ ID NO: 371610 - RNA, 22 nt, Human
acagauaaaaccauuguccaca

SEQ ID NO: 371611 - RNA, 23 nt, Human
accaaagccaaaggcuaaaccug

SEQ ID NO: 371612 - RNA, 22 nt, Human
accccaaacaaaaacaacaaca

SEQ ID NO: 371613 - RNA, 22 nt, Human
acuccgcggcccaggcguccgg

SEQ ID NO: 371614 - RNA, 22 nt, Human
acugaaaaaaaagucaaacugg

SEQ ID NO: 371615 - RNA, 21 nt, Human
agacaacccuuuccccucagg

SEQ ID NO: 371616 - RNA, 21 nt, Human
agacggaggccaggaugggaa

SEQ ID NO: 371617 - RNA, 19 nt, Human
agccaccaacaaaaguccc

SEQ ID NO: 371618 - RNA, 24 nt, Human
agccaccaguuccaaacccucaau

SEQ ID NO: 371619 - RNA, 24 nt, Human
agccggacgcccgccgcccucgcc

SEQ ID NO: 371620 - RNA, 19 nt, Human
aggcguccgggcggcaggc

SEQ ID NO: 371621 - RNA, 20 nt, Human
aguggaaaagcagagacgga

SEQ ID NO: 371622 - RNA, 24 nt, Human
aucgccugggaccaccgagagggg

SEQ ID NO: 371623 - RNA, 18 nt, Human
aucggcgcuugcugcggc

SEQ ID NO: 371624 - RNA, 22 nt, Human
augagacacaggaugugcccac

SEQ ID NO: 371625 - RNA, 24 nt, Human
auguaacaaaaugaaccugaccuc

SEQ ID NO: 371626 - RNA, 24 nt, Human
caaacaaaaacaacaacaaagaaa

SEQ ID NO: 371627 - RNA, 23 nt, Human
caaacuggacagauaaugcagca

SEQ ID NO: 371628 - RNA, 20 nt, Human
caaagaaaccacauaggaac

SEQ ID NO: 371629 - RNA, 21 nt, Human
caaagccaaaggcuaaaccug

SEQ ID NO: 371630 - RNA, 22 nt, Human
caaaugcaacauuccugcuuca

SEQ ID NO: 371631 - RNA, 22 nt, Human
caacaaaagucccccauccccc

SEQ ID NO: 371632 - RNA, 24 nt, Human
caacaaaagucccccaucccccuc

SEQ ID NO: 371633 - RNA, 24 nt, Human
caacaaagaaaccacauaggaaca

SEQ ID NO: 371634 - RNA, 18 nt, Human
caacaacaaagaaaccac

SEQ ID NO: 371635 - RNA, 23 nt, Human
caacagaaaggagagagacaacc

SEQ ID NO: 371636 - RNA, 26 nt, Human
caagauacccagaaaagaagggaguc

SEQ ID NO: 371637 - RNA, 20 nt, Human
cacacaaccgaugacaaggc

SEQ ID NO: 371638 - RNA, 22 nt, Human
cacaggaugugcccaccugugg

SEQ ID NO: 371639 - RNA, 22 nt, Human
cacauuaaauagaacuaguauu

SEQ ID NO: 371640 - RNA, 19 nt, Human
caccgccccccagcccggc

SEQ ID NO: 371641 - RNA, 19 nt, Human
cagaauauccugugugacu

SEQ ID NO: 371642 - RNA, 27 nt, Human
cagagccggacgcccgccgcccucgcc

SEQ ID NO: 371643 - RNA, 19 nt, Human
cagcauggggauggcggug

SEQ ID NO: 371644 - RNA, 19 nt, Human
cagcccucuggcucugggc

SEQ ID NO: 371645 - RNA, 20 nt, Human
cagcgccaccgccccccagc

SEQ ID NO: 371646 - RNA, 19 nt, Human
cagggccucugccagcuuu

SEQ ID NO: 371647 - RNA, 19 nt, Human
cagguggggccucugaccu

SEQ ID NO: 371648 - RNA, 22 nt, Human
caguggcacagaggucacagcu

SEQ ID NO: 371649 - RNA, 24 nt, Human
caucugggcagaggggcagggggc

SEQ ID NO: 371650 - RNA, 19 nt, Human
cauuguccacaagguccuu

SEQ ID NO: 371651 - RNA, 31 nt, Human
ccaaacaaaaacaacaacaaagaaaccacaa

SEQ ID NO: 371652 - RNA, 22 nt, Human
ccaaacccucaaucagccacgc

SEQ ID NO: 371653 - RNA, 21 nt, Human
ccaacaaaagucccccauccc

SEQ ID NO: 371654 - RNA, 19 nt, Human
ccaacagaaaggagagaga

SEQ ID NO: 371655 - RNA, 18 nt, Human
ccaccccaaacaaaaaca

SEQ ID NO: 371656 - RNA, 22 nt, Human
ccaccccaaacaaaaacaacaa

SEQ ID NO: 371657 - RNA, 19 nt, Human
ccacuggggaacgggcuuc

SEQ ID NO: 371658 - RNA, 22 nt, Human
ccacuggggaacgggcuucuag

SEQ ID NO: 371659 - RNA, 22 nt, Human
ccagcccucuggcucugggcug

SEQ ID NO: 371660 - RNA, 24 nt, Human
ccagcugguuccauaaccacauua

SEQ ID NO: 371661 - RNA, 21 nt, Human
ccaguccccuaacugugaguu

SEQ ID NO: 371662 - RNA, 22 nt, Human
ccagucccgagccgccgccgcc

SEQ ID NO: 371663 - RNA, 23 nt, Human
ccagucccgagccgccgccgccu

SEQ ID NO: 371664 - RNA, 18 nt, Human
ccauaaccacauuaaaua

SEQ ID NO: 371665 - RNA, 19 nt, Human
cccaaacaaaaacaacaac

SEQ ID NO: 371666 - RNA, 24 nt, Human
cccaaacaaaaacaacaacaaaga

SEQ ID NO: 371667 - RNA, 18 nt, Human
cccacacgcagguagaag

SEQ ID NO: 371668 - RNA, 22 nt, Human
ccccaccccaaacaaaaacaac

SEQ ID NO: 371669 - RNA, 20 nt, Human
cccccaccccaaacaaaaac

SEQ ID NO: 371670 - RNA, 20 nt, Human
cccccagcccggcccggccc

SEQ ID NO: 371671 - RNA, 18 nt, Human
cccccaucccccuccccc

SEQ ID NO: 371672 - RNA, 20 nt, Human
cccccaucccccucccccaa

SEQ ID NO: 371673 - RNA, 22 nt, Human
ccccccagcccggcccggcccg

SEQ ID NO: 371674 - RNA, 19 nt, Human
cccccgacuccucccaaca

SEQ ID NO: 371675 - RNA, 19 nt, Human
cccggcccggccccgccgc

SEQ ID NO: 371676 - RNA, 19 nt, Human
cccggcccggcccggcccc

SEQ ID NO: 371677 - RNA, 21 nt, Human
cccucaaucagccacgcccag

SEQ ID NO: 371678 - RNA, 24 nt, Human
cccucaaucagccacgcccagucc

SEQ ID NO: 371679 - RNA, 23 nt, Human
ccgaacaagcucaggggucgaaa

SEQ ID NO: 371680 - RNA, 20 nt, Human
ccgcccucgccgcuuccgcc

SEQ ID NO: 371681 - RNA, 19 nt, Human
ccgcccucgccgcuuccgg

SEQ ID NO: 371682 - RNA, 18 nt, Human
ccgccgcccucgccgcuu

SEQ ID NO: 371683 - RNA, 18 nt, Human
ccgccgccgccgccucaa

SEQ ID NO: 371684 - RNA, 20 nt, Human
ccgccgccgccuccgccgcc

SEQ ID NO: 371685 - RNA, 20 nt, Human
ccgccgccgccuccgccgcc

SEQ ID NO: 371686 - RNA, 21 nt, Human
ccgccgccgccuccgccgccg

SEQ ID NO: 371687 - RNA, 23 nt, Human
ccgccgccgccuccgccgccgcc

SEQ ID NO: 371688 - RNA, 22 nt, Human
ccgccgccgccuccgccgccuc

SEQ ID NO: 371689 - RNA, 24 nt, Human
ccgccgccgccuccgccgccucca

SEQ ID NO: 371690 - RNA, 21 nt, Human
ccgccgccuccaccaccucag

SEQ ID NO: 371691 - RNA, 23 nt, Human
ccgccucaagguuacggcuccgg

SEQ ID NO: 371692 - RNA, 20 nt, Human
ccgccuccgccgccgccucc

SEQ ID NO: 371693 - RNA, 21 nt, Human
ccgccuccgccgccgccuccg

SEQ ID NO: 371694 - RNA, 20 nt, Human
ccgccuccgccgccuccacc

SEQ ID NO: 371695 - RNA, 26 nt, Human
ccgcggauccagcgccaccgcccccc

SEQ ID NO: 371696 - RNA, 22 nt, Human
ccggagcucuggaaaggucugc

SEQ ID NO: 371697 - RNA, 20 nt, Human
ccggccccgccgccgccgcc

SEQ ID NO: 371698 - RNA, 24 nt, Human
ccgggccucccaggcagccucagc

SEQ ID NO: 371699 - RNA, 21 nt, Human
ccuccaccaccucagagccgg

SEQ ID NO: 371700 - RNA, 19 nt, Human
ccucccaggcagccucagc

SEQ ID NO: 371701 - RNA, 18 nt, Human
ccuccgccgccgccuccg

SEQ ID NO: 371702 - RNA, 19 nt, Human
ccuccgccgccgccuccgc

SEQ ID NO: 371703 - RNA, 24 nt, Human
ccuccgccgccgccuccgccgccu

SEQ ID NO: 371704 - RNA, 21 nt, Human
ccucgccgcuuccgccgcugc

SEQ ID NO: 371705 - RNA, 26 nt, Human
ccuggcugcagauggcgggugggggg

SEQ ID NO: 371706 - RNA, 21 nt, Human
ccuguggaggacccgggaccc

SEQ ID NO: 371707 - RNA, 19 nt, Human
ccugugggggcaaggcaga

SEQ ID NO: 371708 - RNA, 24 nt, Human
cgagaggcagggcagcaccaacca

SEQ ID NO: 371709 - RNA, 18 nt, Human
cgccaacgaucgggcagc

SEQ ID NO: 371710 - RNA, 18 nt, Human
cgccccccagcccggccc

SEQ ID NO: 371711 - RNA, 19 nt, Human
cgccgccuccgccgccucc

SEQ ID NO: 371712 - RNA, 23 nt, Human
cggcacgagaggcagggcagcac

SEQ ID NO: 371713 - RNA, 20 nt, Human
cgggccccugaagcaucugg

SEQ ID NO: 371714 - RNA, 18 nt, Human
cgggcuucuagaacaccc

SEQ ID NO: 371715 - RNA, 18 nt, Human
cuagaaccucagcagccc

SEQ ID NO: 371716 - RNA, 24 nt, Human
cuagaaccucagcagcccagaaau

SEQ ID NO: 371717 - RNA, 23 nt, Human
cucgcccccgacuccucccaaca

SEQ ID NO: 371718 - RNA, 21 nt, Human
cucuagggcugauuuuggucu

SEQ ID NO: 371719 - RNA, 23 nt, Human
cuggcucugggcugaagcaacac

SEQ ID NO: 371720 - RNA, 22 nt, Human
cugugugaccaaagccaaaggc

SEQ ID NO: 371721 - RNA, 19 nt, Human
gaaagcacuggcggagugg

SEQ ID NO: 371722 - RNA, 23 nt, Human
gaagguucuaggagugcaguggu

SEQ ID NO: 371723 - RNA, 22 nt, Human
gaccaaacaaaccaucguagaa

SEQ ID NO: 371724 - RNA, 22 nt, Human
gacucuguugccuuugguugcu

SEQ ID NO: 371725 - RNA, 22 nt, Human
gagcccagucccgagccgccgc

SEQ ID NO: 371726 - RNA, 19 nt, Human
gagcucagggcugugagcc

SEQ ID NO: 371727 - RNA, 20 nt, Human
gagguuauccuuucaccauu

SEQ ID NO: 371728 - RNA, 26 nt, Human
gauagcagcaauacuucaaaacaaga

SEQ ID NO: 371729 - RNA, 18 nt, Human
gauaucuagcagcugcuc

SEQ ID NO: 371730 - RNA, 22 nt, Human
gauggcggugcagcugcuaagg

SEQ ID NO: 371731 - RNA, 21 nt, Human
gcaaacccacacgcagguaga

SEQ ID NO: 371732 - RNA, 24 nt, Human
gcagaauauccugugugaccaaag

SEQ ID NO: 371733 - RNA, 18 nt, Human
gccaccgccccccagccc

SEQ ID NO: 371734 - RNA, 26 nt, Human
gccaucucagacccacagcgggaucc

SEQ ID NO: 371735 - RNA, 18 nt, Human
gccccgggccucccaggc

SEQ ID NO: 371736 - RNA, 21 nt, Human
gccccgggccucccaggcagc

SEQ ID NO: 371737 - RNA, 23 nt, Human
gcccgccgcccucgccgcuuccg

SEQ ID NO: 371738 - RNA, 25 nt, Human
gccgccgccgccuccgccgccgccu

SEQ ID NO: 371739 - RNA, 20 nt, Human
gccuccaggaaaagcugcuc

SEQ ID NO: 371740 - RNA, 19 nt, Human
gccucugaccucaucccgg

SEQ ID NO: 371741 - RNA, 20 nt, Human
gcgcuugcugcggcgcucug

SEQ ID NO: 371742 - RNA, 20 nt, Human
gcggcccaggcguccgggcg

SEQ ID NO: 371743 - RNA, 23 nt, Human
ggaaaagcagagacggaggccag

SEQ ID NO: 371744 - RNA, 19 nt, Human
ggacaacaguggcacagag

SEQ ID NO: 371745 - RNA, 18 nt, Human
ggacccaaaguagaacag

SEQ ID NO: 371746 - RNA, 25 nt, Human
ggagagagacaacccuuuccccuca

SEQ ID NO: 371747 - RNA, 24 nt, Human
ggauggcggugcagcugccgcccc

SEQ ID NO: 371748 - RNA, 23 nt, Human
gggccuccaggaaaagcugcucc

SEQ ID NO: 371749 - RNA, 18 nt, Human
gggcuucuagaacacccu

SEQ ID NO: 371750 - RNA, 23 nt, Human
ggggcagggggcauggcuggauc

SEQ ID NO: 371751 - RNA, 19 nt, Human
gucacagcuuugggacuga

SEQ ID NO: 371752 - RNA, 18 nt, Human
gucucuuccgccucccgc

SEQ ID NO: 371753 - RNA, 21 nt, Human
gucugcgacacucacacaacc

SEQ ID NO: 371754 - RNA, 24 nt, Human
guuuuguguuuccagcugguucca

SEQ ID NO: 371755 - RNA, 22 nt, Human
uaaaacaaaauuuucagccaag

SEQ ID NO: 371756 - RNA, 19 nt, Human
uaaaaccauuguccacaag

SEQ ID NO: 371757 - RNA, 21 nt, Human
uaacaaggauagcagcaauac

SEQ ID NO: 371758 - RNA, 28 nt, Human
uacccagaaaagaaauauccugggccuc

SEQ ID NO: 371759 - RNA, 23 nt, Human
uacccagaaccggcugcugggau

SEQ ID NO: 371760 - RNA, 19 nt, Human
uacccuguacuugccccca

SEQ ID NO: 371761 - RNA, 19 nt, Human
uagcagcaauacuucaaaa

SEQ ID NO: 371762 - RNA, 22 nt, Human
uagcaguugcugcaucaugguu

SEQ ID NO: 371763 - RNA, 23 nt, Human
uauaaagugguugagaaacaaaa

SEQ ID NO: 371764 - RNA, 22 nt, Human
ucaaaacaagacauuacaaaau

SEQ ID NO: 371765 - RNA, 18 nt, Human
ucaaaaggaccaaacaaa

SEQ ID NO: 371766 - RNA, 21 nt, Human
ucagagccggacgcccgccgc

SEQ ID NO: 371767 - RNA, 18 nt, Human
ucagugauaaaaacagug

SEQ ID NO: 371768 - RNA, 28 nt, Human
uccaccaccucagagccggacgcccgcc

SEQ ID NO: 371769 - RNA, 23 nt, Human
uccaccggggucaccuguggagg

SEQ ID NO: 371770 - RNA, 21 nt, Human
ucccaggccaucucagacccc

SEQ ID NO: 371771 - RNA, 20 nt, Human
ucccccaucccccuccccca

SEQ ID NO: 371772 - RNA, 21 nt, Human
ucccccaucccccucccccaa

SEQ ID NO: 371773 - RNA, 27 nt, Human
ucccccaucccccucccccaacagaaa

SEQ ID NO: 371774 - RNA, 19 nt, Human
ucccgagccgccgccgccu

SEQ ID NO: 371775 - RNA, 21 nt, Human
ucccggaggccgcuucaguuc

SEQ ID NO: 371776 - RNA, 21 nt, Human
uccugcagcaaaccucauuug

SEQ ID NO: 371777 - RNA, 18 nt, Human
uccugggccuccaggaaa

SEQ ID NO: 371778 - RNA, 26 nt, Human
uccugggccuccaggaaaagcugcuc

SEQ ID NO: 371779 - RNA, 22 nt, Human
ucgaaauucgaucugguggcag

SEQ ID NO: 371780 - RNA, 18 nt, Human
ucgcccccgacuccuccc

SEQ ID NO: 371781 - RNA, 21 nt, Human
ucgcccccgacuccucccaac

SEQ ID NO: 371782 - RNA, 21 nt, Human
ucgccccgggccucccaggca

SEQ ID NO: 371783 - RNA, 24 nt, Human
ucgccugggaccaccgagaggggc

SEQ ID NO: 371784 - RNA, 19 nt, Human
ucgcugcuuccagccgagc

SEQ ID NO: 371785 - RNA, 21 nt, Human
ucuauggacaacaguggcaca

SEQ ID NO: 371786 - RNA, 19 nt, Human
ucugcgacacucacacaac

SEQ ID NO: 371787 - RNA, 18 nt, Human
ucugcuacccagaaccgg

SEQ ID NO: 371788 - RNA, 21 nt, Human
ucuggcucugggcugaagcaa

SEQ ID NO: 371789 - RNA, 23 nt, Human
ucugggcugaagcaacacccggc

SEQ ID NO: 371790 - RNA, 18 nt, Human
ucuguaguuuucacuucc

SEQ ID NO: 371791 - RNA, 20 nt, Human
ucuugcucaugaauuacccu

SEQ ID NO: 371792 - RNA, 23 nt, Human
ugaaaaaaaagucaaacuggaca

SEQ ID NO: 371793 - RNA, 26 nt, Human
ugaaagcacuggcggaguuggagacc

SEQ ID NO: 371794 - RNA, 22 nt, Human
ugaaaugucuugcucaugaauu

SEQ ID NO: 371795 - RNA, 21 nt, Human
ugaagguucuaggagugcagu

SEQ ID NO: 371796 - RNA, 19 nt, Human
ugaagucgucccccucugc

SEQ ID NO: 371797 - RNA, 22 nt, Human
ugaauuacccuguacuugcccc

SEQ ID NO: 371798 - RNA, 20 nt, Human
ugaccuccugggcccagccu

SEQ ID NO: 371799 - RNA, 26 nt, Human
ugcaacacagcagaauauccugugug

SEQ ID NO: 371800 - RNA, 18 nt, Human
ugcacagaagcuggaugc

SEQ ID NO: 371801 - RNA, 22 nt, Human
uggaaaagcagagacggaggcc

SEQ ID NO: 371802 - RNA, 28 nt, Human
uggaaagagugaaccggagcucuggaaa

SEQ ID NO: 371803 - RNA, 19 nt, Human
uggauaccaccaccaggaa

SEQ ID NO: 371804 - RNA, 22 nt, Human
uggauaccaccaccaggaaaau

SEQ ID NO: 371805 - RNA, 18 nt, Human
uggaugcuuuuggucugg

SEQ ID NO: 371806 - RNA, 24 nt, Human
uggaugggugauggaagugggugg

SEQ ID NO: 371807 - RNA, 21 nt, Human
uggcagcccuucuauucuaga

SEQ ID NO: 371808 - RNA, 22 nt, Human
uggcugcagauggcgggugggg

SEQ ID NO: 371809 - RNA, 18 nt, Human
uggcugcauuuuauugga

SEQ ID NO: 371810 - RNA, 21 nt, Human
ugggaacgcguguguccaccg

SEQ ID NO: 371811 - RNA, 23 nt, Human
ugggaguacuaugguaaaggagg

SEQ ID NO: 371812 - RNA, 20 nt, Human
ugggcagaggggcagggggc

SEQ ID NO: 371813 - RNA, 22 nt, Human
ugggggauuaaacuuuccuccu

SEQ ID NO: 371814 - RNA, 24 nt, Human
ugguugagaaacaaaaauaaacac

SEQ ID NO: 371815 - RNA, 19 nt, Human
ugugaccaaagccaaaggc

SEQ ID NO: 371816 - RNA, 25 nt, Human
uguuuggaaagagugaaccggagcu

SEQ ID NO: 371817 - RNA, 21 nt, Human
uuaaaauccauacuauguuuc

SEQ ID NO: 371818 - RNA, 22 nt, Human
uuacuaauauuuuaagugacac

SEQ ID NO: 371819 - RNA, 19 nt, Human
uucacaaaauaaaucagug

SEQ ID NO: 371820 - RNA, 19 nt, Human
uucagaacuugagagagcc

SEQ ID NO: 371821 - RNA, 19 nt, Human
uugcuuugccauguugagu

SEQ ID NO: 371822 - RNA, 21 nt, Human
uuggaaagagugaaccggagc

SEQ ID NO: 371823 - RNA, 22 nt, Human
uuucacuuccucaccuucaaga

SEQ ID NO: 371824 - RNA, 24 nt, Human
uuuuaccauuugcuuugccauguu

SEQ ID NO: 371825 - RNA, 20 nt, Human
uuuucacuuccucaccuuca

SEQ ID NO: 371826 - RNA, 20 nt, Human
aaaaacccacgcagacaggc

SEQ ID NO: 371827 - RNA, 20 nt, Human
aaaauguaaacaucuuccuc

SEQ ID NO: 371828 - RNA, 25 nt, Human
aaacaggaggcugaaauaggggacc

SEQ ID NO: 371829 - RNA, 21 nt, Human
accccaccaaacaggaggcug

SEQ ID NO: 371830 - RNA, 22 nt, Human
accugucgggcccccagaauag

SEQ ID NO: 371831 - RNA, 21 nt, Human
agaggaagagggagccucgag

SEQ ID NO: 371832 - RNA, 22 nt, Human
aggcagaggacacagaaccaga

SEQ ID NO: 371833 - RNA, 25 nt, Human
auggcagugagaaggaugugggguc

SEQ ID NO: 371834 - RNA, 23 nt, Human
caaagcagcuguauccaaacagc

SEQ ID NO: 371835 - RNA, 23 nt, Human
caccaaacaggaggcugaaauag

SEQ ID NO: 371836 - RNA, 28 nt, Human
caccccaccaaacaggaggcugaaauag

SEQ ID NO: 371837 - RNA, 21 nt, Human
caccugucgggcccccagaau

SEQ ID NO: 371838 - RNA, 18 nt, Human
cagaauaguucugggaga

SEQ ID NO: 371839 - RNA, 21 nt, Human
cagagcaccccacuugggccc

SEQ ID NO: 371840 - RNA, 20 nt, Human
caggagggaauuccauggca

SEQ ID NO: 371841 - RNA, 19 nt, Human
caggcagaggacacagaac

SEQ ID NO: 371842 - RNA, 24 nt, Human
ccaccccaccaaacaggaggcuga

SEQ ID NO: 371843 - RNA, 23 nt, Human
ccagaaaauggucuucaucaaag

SEQ ID NO: 371844 - RNA, 22 nt, Human
ccagagcaccccacuugggccc

SEQ ID NO: 371845 - RNA, 24 nt, Human
ccagagcccaggcagaggacacag

SEQ ID NO: 371846 - RNA, 22 nt, Human
cccaccaaacaggaggcugaaa

SEQ ID NO: 371847 - RNA, 24 nt, Human
cccccagaauaguucugggagaca

SEQ ID NO: 371848 - RNA, 24 nt, Human
cccuggggcugcaccugggggugg

SEQ ID NO: 371849 - RNA, 24 nt, Human
cccuggggcugcaccugggggugg

SEQ ID NO: 371850 - RNA, 18 nt, Human
ccugaggguuccuugugg

SEQ ID NO: 371851 - RNA, 21 nt, Human
ccuuccugcuggagcugggga

SEQ ID NO: 371852 - RNA, 27 nt, Human
cgcagaagaaccacucgcuaggccggu

SEQ ID NO: 371853 - RNA, 18 nt, Human
cucccaggcccaccuguc

SEQ ID NO: 371854 - RNA, 20 nt, Human
cucuuccagagcccaggcag

SEQ ID NO: 371855 - RNA, 21 nt, Human
cuggggcugcaccugggggug

SEQ ID NO: 371856 - RNA, 22 nt, Human
cuucccagugagucugucagcc

SEQ ID NO: 371857 - RNA, 25 nt, Human
gaccagagcaccccacuugggcccc

SEQ ID NO: 371858 - RNA, 18 nt, Human
gagaaggauguggggucc

SEQ ID NO: 371859 - RNA, 22 nt, Human
gagaggaagagggagccucgag

SEQ ID NO: 371860 - RNA, 19 nt, Human
gccagcugcccucccucca

SEQ ID NO: 371861 - RNA, 19 nt, Human
gccaugggaaggccucuuc

SEQ ID NO: 371862 - RNA, 19 nt, Human
gcccccagaauaguucugg

SEQ ID NO: 371863 - RNA, 20 nt, Human
ggcagguauggagaggaaga

SEQ ID NO: 371864 - RNA, 20 nt, Human
ggggagugggguccccugag

SEQ ID NO: 371865 - RNA, 19 nt, Human
gguauggagaggaagaggg

SEQ ID NO: 371866 - RNA, 24 nt, Human
gugggguccccugagugggguggg

SEQ ID NO: 371867 - RNA, 24 nt, Human
ucacaccucguggaggguggccug

SEQ ID NO: 371868 - RNA, 22 nt, Human
ucccaggcccaccugucgggcc

SEQ ID NO: 371869 - RNA, 24 nt, Human
ucccaggcccaccugucgggcccc

SEQ ID NO: 371870 - RNA, 21 nt, Human
uccccugaguggggugggagc

SEQ ID NO: 371871 - RNA, 22 nt, Human
ucggucagaccagagcacccca

SEQ ID NO: 371872 - RNA, 19 nt, Human
ucugucagccuuuguccug

SEQ ID NO: 371873 - RNA, 20 nt, Human
ugagaaggaugugggguccu

SEQ ID NO: 371874 - RNA, 18 nt, Human
ugaguggggugggagcuu

SEQ ID NO: 371875 - RNA, 21 nt, Human
ugauguggccagaaguggggc

SEQ ID NO: 371876 - RNA, 22 nt, Human
uggagaggaagagggagccucg

SEQ ID NO: 371877 - RNA, 24 nt, Human
uggauacaaaaacccacgcagaca

SEQ ID NO: 371878 - RNA, 20 nt, Human
uggcagugagaaggaugugg

SEQ ID NO: 371879 - RNA, 18 nt, Human
uggccagaaguggggcac

SEQ ID NO: 371880 - RNA, 21 nt, Human
uggccagaaguggggcacuca

SEQ ID NO: 371881 - RNA, 19 nt, Human
uggggcugauguggccaga

SEQ ID NO: 371882 - RNA, 19 nt, Human
uguccuguagcucaaagca

SEQ ID NO: 371883 - RNA, 21 nt, Human
ugugugugaggggaguggggu

SEQ ID NO: 371884 - RNA, 18 nt, Human
uuccagagcccaggcaga

SEQ ID NO: 371885 - RNA, 24 nt, Human
uuguuaaauugcccgggaaacagg

SEQ ID NO: 371886 - RNA, 24 nt, Human
aaaaacaaaacaaaacaaaaaaga

SEQ ID NO: 371887 - RNA, 23 nt, Human
aaaacaaaacaaaacaaaaauac

SEQ ID NO: 371888 - RNA, 19 nt, Human
aaacaaaacaaaacaaaaa

SEQ ID NO: 371889 - RNA, 23 nt, Human
aaacacaugaauuccaugcucuu

SEQ ID NO: 371890 - RNA, 27 nt, Human
aacaaaacaaaacaaaaauacuuuuaa

SEQ ID NO: 371891 - RNA, 19 nt, Human
acaaaacaaaacaaaaaua

SEQ ID NO: 371892 - RNA, 22 nt, Human
agaaacauugauuucacaaguc

SEQ ID NO: 371893 - RNA, 19 nt, Human
agacaaccgacauguaaug

SEQ ID NO: 371894 - RNA, 18 nt, Human
agguaaucaaaaaaaggc

SEQ ID NO: 371895 - RNA, 18 nt, Human
auaugugugugugucuau

SEQ ID NO: 371896 - RNA, 25 nt, Human
aucucaguuucauacagaacucauu

SEQ ID NO: 371897 - RNA, 18 nt, Human
augccuuuggacuuuauu

SEQ ID NO: 371898 - RNA, 22 nt, Human
auggaaaggauuaucuuuaaac

SEQ ID NO: 371899 - RNA, 25 nt, Human
caaaaacaaaacaaaacaaaaauac

SEQ ID NO: 371900 - RNA, 23 nt, Human
caaaacaaaacaaaaauacuuuu

SEQ ID NO: 371901 - RNA, 19 nt, Human
caaucuagccaucagcaaa

SEQ ID NO: 371902 - RNA, 21 nt, Human
caauuuaaaaaggcacuugga

SEQ ID NO: 371903 - RNA, 21 nt, Human
cagacucuauuacaaagcaau

SEQ ID NO: 371904 - RNA, 21 nt, Human
cagcacaggagaaaaugccuu

SEQ ID NO: 371905 - RNA, 19 nt, Human
ccagacaaccgacauguaa

SEQ ID NO: 371906 - RNA, 18 nt, Human
cucucucucugugggugu

SEQ ID NO: 371907 - RNA, 19 nt, Human
gagugaagaaaugcauucu

SEQ ID NO: 371908 - RNA, 27 nt, Human
ggaaaggauuaucuuuaaacacaugaa

SEQ ID NO: 371909 - RNA, 21 nt, Human
ggaguaaacuuggaauacuuu

SEQ ID NO: 371910 - RNA, 21 nt, Human
ggcgggccaggcucgggcagg

SEQ ID NO: 371911 - RNA, 23 nt, Human
gggcaggggccgugcucaggugc

SEQ ID NO: 371912 - RNA, 21 nt, Human
gugugugcauaugugugugug

SEQ ID NO: 371913 - RNA, 19 nt, Human
gugugugugugugugugug

SEQ ID NO: 371914 - RNA, 23 nt, Human
uaaaaaggcacuuggaaggggua

SEQ ID NO: 371915 - RNA, 23 nt, Human
uaagacaauggagcaugcgccag

SEQ ID NO: 371916 - RNA, 18 nt, Human
uaaggcaccugaguucgc

SEQ ID NO: 371917 - RNA, 20 nt, Human
uacuuuuuaaggcaccugag

SEQ ID NO: 371918 - RNA, 18 nt, Human
ucccuccucccccaaggc

SEQ ID NO: 371919 - RNA, 18 nt, Human
ugcgccaggaauguucaa

SEQ ID NO: 371920 - RNA, 25 nt, Human
ugcggcagacggacgggccggcgcc

SEQ ID NO: 371921 - RNA, 22 nt, Human
uggcaaaaacaaaacaaaacaa

SEQ ID NO: 371922 - RNA, 23 nt, Human
uggcaaaaacaaaacaaaacaaa

SEQ ID NO: 371923 - RNA, 25 nt, Human
uggcagaucucuuccuaugggaaau

SEQ ID NO: 371924 - RNA, 20 nt, Human
ugggugugugugugugugug

SEQ ID NO: 371925 - RNA, 19 nt, Human
ugugugcauaugugugugu

SEQ ID NO: 371926 - RNA, 19 nt, Human
ugugugcauaugugugugu

SEQ ID NO: 371927 - RNA, 20 nt, Human
ugugugugcauaugugugug

SEQ ID NO: 371928 - RNA, 21 nt, Human
ugugugugcauaugugugugu

SEQ ID NO: 371929 - RNA, 21 nt, Human
ugugugugcauaugugugugu

SEQ ID NO: 371930 - RNA, 23 nt, Human
ugugugugcauaugugugugugu

SEQ ID NO: 371931 - RNA, 21 nt, Human
ugugugugugcauaugugugu

SEQ ID NO: 371932 - RNA, 22 nt, Human
ugugugugugugcauaugugug

SEQ ID NO: 371933 - RNA, 23 nt, Human
ugugugugugugcauaugugugu

SEQ ID NO: 371934 - RNA, 19 nt, Human
ugugugugugugugcauau

SEQ ID NO: 371935 - RNA, 19 nt, Human
ugugugugugugugcauau

SEQ ID NO: 371936 - RNA, 21 nt, Human
ugugugugugugugugcauau

SEQ ID NO: 371937 - RNA, 23 nt, Human
ugugugugugugugugcauaugu

SEQ ID NO: 371938 - RNA, 23 nt, Human
ugugugugugugugugugcauau

SEQ ID NO: 371939 - RNA, 23 nt, Human
uuaaaaaggcacuuggaaggggu

SEQ ID NO: 371940 - RNA, 21 nt, Human
uuaggaagaaaagaugcaaug

SEQ ID NO: 371941 - RNA, 20 nt, Human
uucaaaaauuauuaaaaugu

SEQ ID NO: 371942 - RNA, 24 nt, Human
uuggcaaaaacaaaacaaaacaaa

SEQ ID NO: 371943 - RNA, 19 nt, Human
uuuauuugucauuuggcuu

SEQ ID NO: 371944 - RNA, 19 nt, Human
aaaaaagaaagaaaacuca

SEQ ID NO: 371945 - RNA, 19 nt, Human
aaaccaagcauuagccuaa

SEQ ID NO: 371946 - RNA, 22 nt, Human
aaacuauauccaacuagaucuu

SEQ ID NO: 371947 - RNA, 22 nt, Human
aaaucuugaaagcaaaagaacc

SEQ ID NO: 371948 - RNA, 20 nt, Human
aacaacaacaaaaaacaccu

SEQ ID NO: 371949 - RNA, 22 nt, Human
aacagaaaacaaaaaagaagga

SEQ ID NO: 371950 - RNA, 23 nt, Human
aaccacaaaagcaaaaauaaaca

SEQ ID NO: 371951 - RNA, 21 nt, Human
aacuauauccaacuagaucuu

SEQ ID NO: 371952 - RNA, 20 nt, Human
aacucagccaggcacagugg

SEQ ID NO: 371953 - RNA, 20 nt, Human
aagcaaaaauaaacaacaac

SEQ ID NO: 371954 - RNA, 22 nt, Human
aaggaaggcagagcagcagucg

SEQ ID NO: 371955 - RNA, 20 nt, Human
aaggaggagcuacggaagug

SEQ ID NO: 371956 - RNA, 22 nt, Human
aaggagggcuguaacugcucug

SEQ ID NO: 371957 - RNA, 23 nt, Human
aaggcaggagaauugcuugaacc

SEQ ID NO: 371958 - RNA, 23 nt, Human
aaggcggguggaucacgacguca

SEQ ID NO: 371959 - RNA, 19 nt, Human
aauaaaugauaaagaagaa

SEQ ID NO: 371960 - RNA, 18 nt, Human
aauaauuaaaccagaggc

SEQ ID NO: 371961 - RNA, 24 nt, Human
aauugcuugaaccagggaggcgga

SEQ ID NO: 371962 - RNA, 18 nt, Human
acaacaacaaaaaacacc

SEQ ID NO: 371963 - RNA, 18 nt, Human
acauggugaaacccuguc

SEQ ID NO: 371964 - RNA, 19 nt, Human
acauggugaaacccugucu

SEQ ID NO: 371965 - RNA, 20 nt, Human
acauggugaaacccugucuc

SEQ ID NO: 371966 - RNA, 22 nt, Human
acauggugaaacccugucucua

SEQ ID NO: 371967 - RNA, 23 nt, Human
accagcuugacauggugaaaccc

SEQ ID NO: 371968 - RNA, 24 nt, Human
acccugucucuacuaaaaauacaa

SEQ ID NO: 371969 - RNA, 19 nt, Human
agaaaacaaaaaagaagga

SEQ ID NO: 371970 - RNA, 20 nt, Human
agaaaacaaaaaagaaggag

SEQ ID NO: 371971 - RNA, 19 nt, Human
agaaagaaaauacuagaag

SEQ ID NO: 371972 - RNA, 19 nt, Human
agaaagaaaauacuagaag

SEQ ID NO: 371973 - RNA, 25 nt, Human
agagagcgagacucugacuccaaaa

SEQ ID NO: 371974 - RNA, 22 nt, Human
agaucgcgcuauugcacuccag

SEQ ID NO: 371975 - RNA, 19 nt, Human
agcaaaagaaccugcugaa

SEQ ID NO: 371976 - RNA, 23 nt, Human
agcguggugacacacgccuguaa

SEQ ID NO: 371977 - RNA, 21 nt, Human
agcuacggaagugaauaaaug

SEQ ID NO: 371978 - RNA, 18 nt, Human
aggaaggcagagcagcag

SEQ ID NO: 371979 - RNA, 19 nt, Human
aggaggagcuacggaagug

SEQ ID NO: 371980 - RNA, 24 nt, Human
aggcacaguggcucacgccuguaa

SEQ ID NO: 371981 - RNA, 22 nt, Human
aggcaggagaauugcuugaacc

SEQ ID NO: 371982 - RNA, 24 nt, Human
aggcaggagaauugcuugaaccag

SEQ ID NO: 371983 - RNA, 21 nt, Human
aggccaaggcggguggaucac

SEQ ID NO: 371984 - RNA, 19 nt, Human
aggcggagguugcagugag

SEQ ID NO: 371985 - RNA, 24 nt, Human
aggcggagguugcagugagcccag

SEQ ID NO: 371986 - RNA, 24 nt, Human
aggcggguggaucacgacgucagg

SEQ ID NO: 371987 - RNA, 24 nt, Human
agggaggcggagguugcagugagc

SEQ ID NO: 371988 - RNA, 24 nt, Human
agguuuuuacugagguaacaaccu

SEQ ID NO: 371989 - RNA, 24 nt, Human
aguggcucacgccuguaaucccag

SEQ ID NO: 371990 - RNA, 18 nt, Human
aguguuccugaauggugc

SEQ ID NO: 371991 - RNA, 22 nt, Human
auaacugcaacuuaaaucaaaa

SEQ ID NO: 371992 - RNA, 24 nt, Human
aucgcgcuauugcacuccagccug

SEQ ID NO: 371993 - RNA, 21 nt, Human
augaaaacacuaaacaugaca

SEQ ID NO: 371994 - RNA, 18 nt, Human
auugcacuccagccugga

SEQ ID NO: 371995 - RNA, 19 nt, Human
auugcacuccagccuggac

SEQ ID NO: 371996 - RNA, 22 nt, Human
auugcacuccagccuggacaag

SEQ ID NO: 371997 - RNA, 22 nt, Human
auugcacuccagccuggacaag

SEQ ID NO: 371998 - RNA, 26 nt, Human
caaaaaacaccucuacagcuuccuuc

SEQ ID NO: 371999 - RNA, 22 nt, Human
caaaaauaaacaacaacaaaaa

SEQ ID NO: 372000 - RNA, 22 nt, Human
caacaacaaaaaacaccucuac

SEQ ID NO: 372001 - RNA, 23 nt, Human
caacagaaaacaaaaaagaagga

SEQ ID NO: 372002 - RNA, 22 nt, Human
caagcagugguuauuggugaaa

SEQ ID NO: 372003 - RNA, 24 nt, Human
caaggcggguggaucacgacguca

SEQ ID NO: 372004 - RNA, 19 nt, Human
caauaauuaaaccagaggc

SEQ ID NO: 372005 - RNA, 23 nt, Human
caccggaccuggcgcugcacccu

SEQ ID NO: 372006 - RNA, 25 nt, Human
caccggaccuggcgcugcacccuag

SEQ ID NO: 372007 - RNA, 18 nt, Human
cacgccuguaaucccagc

SEQ ID NO: 372008 - RNA, 19 nt, Human
cacgccuguaaucccagcu

SEQ ID NO: 372009 - RNA, 24 nt, Human
cacgccuguaaucccaguacuuug

SEQ ID NO: 372010 - RNA, 23 nt, Human
cacuccagccuggacaagagagc

SEQ ID NO: 372011 - RNA, 24 nt, Human
cacuccagccuggacaagagagcg

SEQ ID NO: 372012 - RNA, 23 nt, Human
cacuuuaagaaaacucagccagg

SEQ ID NO: 372013 - RNA, 21 nt, Human
cagauguucauaacacuuuuc

SEQ ID NO: 372014 - RNA, 24 nt, Human
caguacuuugggaggccaaggcgg

SEQ ID NO: 372015 - RNA, 23 nt, Human
cauuagccuaaauuggcuauaac

SEQ ID NO: 372016 - RNA, 24 nt, Human
ccaaaaccaagcauuagccuaaau

SEQ ID NO: 372017 - RNA, 25 nt, Human
ccaauacacacugacagcuuugaag

SEQ ID NO: 372018 - RNA, 22 nt, Human
ccagcuugacauggugaaaccc

SEQ ID NO: 372019 - RNA, 22 nt, Human
ccuggacaagagagcgagacuc

SEQ ID NO: 372020 - RNA, 19 nt, Human
ccuguaaucccagcuacuc

SEQ ID NO: 372021 - RNA, 21 nt, Human
ccuguaaucccagcuacucag

SEQ ID NO: 372022 - RNA, 22 nt, Human
ccuguaaucccaguacuuuggg

SEQ ID NO: 372023 - RNA, 24 nt, Human
cgccuguaaucccagcuacucagg

SEQ ID NO: 372024 - RNA, 23 nt, Human
cgccuguaaucccaguacuuugg

SEQ ID NO: 372025 - RNA, 24 nt, Human
cgcuauugcacuccagccuggaca

SEQ ID NO: 372026 - RNA, 22 nt, Human
cggguggaucacgacgucagga

SEQ ID NO: 372027 - RNA, 19 nt, Human
cuauugcacuccagccugg

SEQ ID NO: 372028 - RNA, 21 nt, Human
cuauugcacuccagccuggac

SEQ ID NO: 372029 - RNA, 24 nt, Human
cucaaccacaaaagcaaaaauaaa

SEQ ID NO: 372030 - RNA, 22 nt, Human
cucacgccuguaaucccaguac

SEQ ID NO: 372031 - RNA, 24 nt, Human
cucacgccuguaaucccaguacuu

SEQ ID NO: 372032 - RNA, 24 nt, Human
cuccaaaaccaagcauuagccuaa

SEQ ID NO: 372033 - RNA, 24 nt, Human
cucugacuccaaaaaaaaaaaaaa

SEQ ID NO: 372034 - RNA, 23 nt, Human
cuuuuugcuuuguggccugaagg

SEQ ID NO: 372035 - RNA, 28 nt, Human
gaaaauacuagaaggaaggccgguaccc

SEQ ID NO: 372036 - RNA, 20 nt, Human
gacauggugaaacccugucu

SEQ ID NO: 372037 - RNA, 23 nt, Human
gacgucaggaguccaagaccagc

SEQ ID NO: 372038 - RNA, 22 nt, Human
gagaaagaaaauacuagaagga

SEQ ID NO: 372039 - RNA, 22 nt, Human
gagaauugcuugaaccagggag

SEQ ID NO: 372040 - RNA, 24 nt, Human
gagcguggugacacacgccuguaa

SEQ ID NO: 372041 - RNA, 19 nt, Human
gagguugcagugagcccag

SEQ ID NO: 372042 - RNA, 23 nt, Human
gagguugcagugagcccagaucg

SEQ ID NO: 372043 - RNA, 25 nt, Human
gcaaggcaggagaauugcuugaacc

SEQ ID NO: 372044 - RNA, 24 nt, Human
gcauuagccuaaauuggcuauaac

SEQ ID NO: 372045 - RNA, 23 nt, Human
gccuggacaagagagcgagacuc

SEQ ID NO: 372046 - RNA, 20 nt, Human
ggacaccccaacaccggacc

SEQ ID NO: 372047 - RNA, 23 nt, Human
ggagguugcagugagcccagauc

SEQ ID NO: 372048 - RNA, 24 nt, Human
ggagguugcagugagcccagaucg

SEQ ID NO: 372049 - RNA, 22 nt, Human
ggguggaucacgacgucaggag

SEQ ID NO: 372050 - RNA, 21 nt, Human
gguaugcuuugucaaacuuuu

SEQ ID NO: 372051 - RNA, 24 nt, Human
ggugacacacgccuguaaucccag

SEQ ID NO: 372052 - RNA, 23 nt, Human
gucggcccucaacagaaaacaaa

SEQ ID NO: 372053 - RNA, 20 nt, Human
gucuuuggcaaugcuuccaa

SEQ ID NO: 372054 - RNA, 21 nt, Human
gugaaacccugucucuacuaa

SEQ ID NO: 372055 - RNA, 23 nt, Human
gugacacacgccuguaaucccag

SEQ ID NO: 372056 - RNA, 23 nt, Human
guggaucacgacgucaggagucc

SEQ ID NO: 372057 - RNA, 19 nt, Human
uaaaagcuccaaaaccaag

SEQ ID NO: 372058 - RNA, 22 nt, Human
uaaacaacaacaaaaaacaccu

SEQ ID NO: 372059 - RNA, 20 nt, Human
uaacuaaacauaauucuuag

SEQ ID NO: 372060 - RNA, 18 nt, Human
uaccugaggucaaaauga

SEQ ID NO: 372061 - RNA, 23 nt, Human
uaugaauugagaaagaaaauacu

SEQ ID NO: 372062 - RNA, 21 nt, Human
uauugcacuccagccuggaca

SEQ ID NO: 372063 - RNA, 24 nt, Human
uauugcacuccagccuggacaaga

SEQ ID NO: 372064 - RNA, 19 nt, Human
ucaaagacuaaugacaaug

SEQ ID NO: 372065 - RNA, 22 nt, Human
ucaauacacaaggguaagagaa

SEQ ID NO: 372066 - RNA, 24 nt, Human
ucacgacgucaggaguccaagacc

SEQ ID NO: 372067 - RNA, 22 nt, Human
ucacgccuguaaucccaguacu

SEQ ID NO: 372068 - RNA, 23 nt, Human
ucagccaggcacaguggcucacg

SEQ ID NO: 372069 - RNA, 22 nt, Human
uccaaaaaaaaaaaaaagaaag

SEQ ID NO: 372070 - RNA, 22 nt, Human
uccaaaaaauuuuaagcccugc

SEQ ID NO: 372071 - RNA, 23 nt, Human
uccagccuggacaagagagcgag

SEQ ID NO: 372072 - RNA, 24 nt, Human
uccagccuggacaagagagcgaga

SEQ ID NO: 372073 - RNA, 23 nt, Human
ucccaauuagaagagcguggaac

SEQ ID NO: 372074 - RNA, 24 nt, Human
ucccucaaccacaaaagcaaaaau

SEQ ID NO: 372075 - RNA, 22 nt, Human
ucggcccucaacagaaaacaaa

SEQ ID NO: 372076 - RNA, 23 nt, Human
ucggcccucaacagaaaacaaaa

SEQ ID NO: 372077 - RNA, 21 nt, Human
ucucauguuacacauauauau

SEQ ID NO: 372078 - RNA, 21 nt, Human
ucucccaauuagaagagcgug

SEQ ID NO: 372079 - RNA, 24 nt, Human
ucuccggcggcaacucggacaccc

SEQ ID NO: 372080 - RNA, 21 nt, Human
ucucuacuaaaaauacaaaaa

SEQ ID NO: 372081 - RNA, 23 nt, Human
ucucuacuaaaaauacaaaaauu

SEQ ID NO: 372082 - RNA, 23 nt, Human
ucucuuguccuucccucaaccac

SEQ ID NO: 372083 - RNA, 24 nt, Human
ucucuuguccuucccucaaccaca

SEQ ID NO: 372084 - RNA, 18 nt, Human
ucucuuuggagcagaggu

SEQ ID NO: 372085 - RNA, 24 nt, Human
ucugacuccaaaaaaaaaaaaaag

SEQ ID NO: 372086 - RNA, 20 nt, Human
ugaaaacacuaaacaugaca

SEQ ID NO: 372087 - RNA, 18 nt, Human
ugaaagcaaaagaaccug

SEQ ID NO: 372088 - RNA, 23 nt, Human
ugaaagcaaaagaaccugcugaa

SEQ ID NO: 372089 - RNA, 25 nt, Human
ugaaucacuaagaguucagaaauua

SEQ ID NO: 372090 - RNA, 22 nt, Human
ugacacacgccuguaaucccag

SEQ ID NO: 372091 - RNA, 22 nt, Human
ugacauggugaaacccugucuc

SEQ ID NO: 372092 - RNA, 24 nt, Human
ugacauggugaaacccugucucua

SEQ ID NO: 372093 - RNA, 18 nt, Human
ugagaaagaaaauacuag

SEQ ID NO: 372094 - RNA, 23 nt, Human
ugagaaagaaaauacuagaaggg

SEQ ID NO: 372095 - RNA, 22 nt, Human
ugagcccagaucgcgcuauugc

SEQ ID NO: 372096 - RNA, 18 nt, Human
ugcacuccagccuggaca

SEQ ID NO: 372097 - RNA, 19 nt, Human
ugcacuccagccuggacaa

SEQ ID NO: 372098 - RNA, 20 nt, Human
ugcacuccagccuggacaag

SEQ ID NO: 372099 - RNA, 22 nt, Human
ugcacuccagccuggacaagag

SEQ ID NO: 372100 - RNA, 20 nt, Human
uggaaccgaaaacuuaaacu

SEQ ID NO: 372101 - RNA, 22 nt, Human
uggaucacgacgucaggagucc

SEQ ID NO: 372102 - RNA, 22 nt, Human
uggcucacgccuguaaucccag

SEQ ID NO: 372103 - RNA, 24 nt, Human
uggcucacgccuguaaucccagua

SEQ ID NO: 372104 - RNA, 24 nt, Human
ugggaggccaaggcggguggauca

SEQ ID NO: 372105 - RNA, 24 nt, Human
uggugacacacgccuguaauccca

SEQ ID NO: 372106 - RNA, 18 nt, Human
uguacauauaugaaucac

SEQ ID NO: 372107 - RNA, 24 nt, Human
uuaaaauaaaugugacaaauacca

SEQ ID NO: 372108 - RNA, 20 nt, Human
uuagagagaaauucucaugu

SEQ ID NO: 372109 - RNA, 24 nt, Human
uuccaaaucuugaaagcaaaagaa

SEQ ID NO: 372110 - RNA, 24 nt, Human
uugaaccagggaggcggagguugc

SEQ ID NO: 372111 - RNA, 20 nt, Human
uugacauggugaaacccugu

SEQ ID NO: 372112 - RNA, 22 nt, Human
uugcagugagcccagaucgcgc

SEQ ID NO: 372113 - RNA, 24 nt, Human
uugcuugaaccagggaggcggagg

SEQ ID NO: 372114 - RNA, 23 nt, Human
uuggagcagagguugcaaaacug

SEQ ID NO: 372115 - RNA, 18 nt, Human
uuuaagaaaacucagcca

SEQ ID NO: 372116 - RNA, 18 nt, Human
uuucaaggaggagcuacg

SEQ ID NO: 372117 - RNA, 24 nt, Human
uuuuuucuucaaagacuaaugaca

SEQ ID NO: 372118 - RNA, 23 nt, Human
aaacauauauuuugcuggaaaug

SEQ ID NO: 372119 - RNA, 24 nt, Human
aacugacagaggagacaggaggaa

SEQ ID NO: 372120 - RNA, 21 nt, Human
aagaaagagaccaagagagaa

SEQ ID NO: 372121 - RNA, 19 nt, Human
aagagaccaagagagaaca

SEQ ID NO: 372122 - RNA, 19 nt, Human
aagagaccaagagagaaca

SEQ ID NO: 372123 - RNA, 25 nt, Human
aagagagaacaaaagacacaaagua

SEQ ID NO: 372124 - RNA, 18 nt, Human
aagcaacaaagaauugua

SEQ ID NO: 372125 - RNA, 23 nt, Human
aauuguacugauaacaaaccaca

SEQ ID NO: 372126 - RNA, 22 nt, Human
acccuauauuacauccauuuga

SEQ ID NO: 372127 - RNA, 24 nt, Human
acggguuuggcucuggaccugggc

SEQ ID NO: 372128 - RNA, 22 nt, Human
acuagauaauaccaugagaaaa

SEQ ID NO: 372129 - RNA, 25 nt, Human
agaaagagaccaagagagaacaaaa

SEQ ID NO: 372130 - RNA, 22 nt, Human
agccaucaaaagcagcaaacaa

SEQ ID NO: 372131 - RNA, 21 nt, Human
aguaagagucagccuuauaaa

SEQ ID NO: 372132 - RNA, 19 nt, Human
auaaagacagauaacagcc

SEQ ID NO: 372133 - RNA, 24 nt, Human
auaauuuuaaacuagcuacaaaau

SEQ ID NO: 372134 - RNA, 21 nt, Human
auccaucuuuuuuaaaauucu

SEQ ID NO: 372135 - RNA, 26 nt, Human
auuaagcaacaaagaauuguacugau

SEQ ID NO: 372136 - RNA, 22 nt, Human
caaaagcagcaaacaaacccua

SEQ ID NO: 372137 - RNA, 22 nt, Human
caaacugacagaggagacagga

SEQ ID NO: 372138 - RNA, 19 nt, Human
cacuguuucacagcaagau

SEQ ID NO: 372139 - RNA, 20 nt, Human
cacuuuuagugcaaugccug

SEQ ID NO: 372140 - RNA, 20 nt, Human
cagagccugacacucaaagg

SEQ ID NO: 372141 - RNA, 22 nt, Human
cagcaaacaaacccuauauuac

SEQ ID NO: 372142 - RNA, 24 nt, Human
cagcgccugaccuccccgagguuu

SEQ ID NO: 372143 - RNA, 24 nt, Human
caucaaaagcagcaaacaaacccu

SEQ ID NO: 372144 - RNA, 23 nt, Human
caugaaaucauaaagacagauaa

SEQ ID NO: 372145 - RNA, 18 nt, Human
ccacacuguuucacagca

SEQ ID NO: 372146 - RNA, 25 nt, Human
ccaccaaaugaccacuauguacaac

SEQ ID NO: 372147 - RNA, 18 nt, Human
ccgagcagggagggaagg

SEQ ID NO: 372148 - RNA, 22 nt, Human
cgccugggcuggggggucagug

SEQ ID NO: 372149 - RNA, 23 nt, Human
cggguuuggcucuggaccugggc

SEQ ID NO: 372150 - RNA, 18 nt, Human
cucuguggaaugucacag

SEQ ID NO: 372151 - RNA, 23 nt, Human
cugcagguugcaacuguggugga

SEQ ID NO: 372152 - RNA, 20 nt, Human
gacugauguguguuaugugu

SEQ ID NO: 372153 - RNA, 22 nt, Human
gaggagaacacgggugggcaca

SEQ ID NO: 372154 - RNA, 20 nt, Human
gcaugaaggagcuaucuugc

SEQ ID NO: 372155 - RNA, 22 nt, Human
gccaugaggaaccaaagacggc

SEQ ID NO: 372156 - RNA, 21 nt, Human
ggaaaaaagugacacuacugc

SEQ ID NO: 372157 - RNA, 22 nt, Human
gggggucagugacggguuuggc

SEQ ID NO: 372158 - RNA, 18 nt, Human
gucagugacggguuuggc

SEQ ID NO: 372159 - RNA, 18 nt, Human
uaaaaaaggaugauuaug

SEQ ID NO: 372160 - RNA, 20 nt, Human
uaacucuguggaaugucaca

SEQ ID NO: 372161 - RNA, 23 nt, Human
uaagcaacaaagaauuguacuga

SEQ ID NO: 372162 - RNA, 23 nt, Human
uagauaauaccaugagaaaagca

SEQ ID NO: 372163 - RNA, 19 nt, Human
uagccaucaaaagcagcaa

SEQ ID NO: 372164 - RNA, 23 nt, Human
uauugacaggaaaaaagugacac

SEQ ID NO: 372165 - RNA, 19 nt, Human
uccacacuguuucacagca

SEQ ID NO: 372166 - RNA, 19 nt, Human
uccaucuuuuuuaaaauuc

SEQ ID NO: 372167 - RNA, 23 nt, Human
ucugcagguugcaacuguggugg

SEQ ID NO: 372168 - RNA, 19 nt, Human
ucuugcccgacagcauuug

SEQ ID NO: 372169 - RNA, 21 nt, Human
ucuugcccgacagcauuugga

SEQ ID NO: 372170 - RNA, 20 nt, Human
ugacagaggagacaggagga

SEQ ID NO: 372171 - RNA, 21 nt, Human
ugacagaggagacaggaggaa

SEQ ID NO: 372172 - RNA, 23 nt, Human
ugacagaugacacaggacaacau

SEQ ID NO: 372173 - RNA, 19 nt, Human
ugcauaaaugcauaaauca

SEQ ID NO: 372174 - RNA, 24 nt, Human
ugccuguuauguaauuccacauug

SEQ ID NO: 372175 - RNA, 24 nt, Human
uggaaugucacaguuuuacaagaa

SEQ ID NO: 372176 - RNA, 18 nt, Human
uggcugggcgccugggcu

SEQ ID NO: 372177 - RNA, 18 nt, Human
uggcugggcgccugggcu

SEQ ID NO: 372178 - RNA, 23 nt, Human
uggcugggcgccugggcuggggg

SEQ ID NO: 372179 - RNA, 24 nt, Human
ugggcuucucgggaggguuguguu

SEQ ID NO: 372180 - RNA, 25 nt, Human
uguacaaccuuuggaaagaaagaga

SEQ ID NO: 372181 - RNA, 23 nt, Human
ugucucaauacugagcaugcuuu

SEQ ID NO: 372182 - RNA, 18 nt, Human
uguguguguguguguugu

SEQ ID NO: 372183 - RNA, 21 nt, Human
uguguguguguguguugucuc

SEQ ID NO: 372184 - RNA, 21 nt, Human
uguugcuguuguuuugugugu

SEQ ID NO: 372185 - RNA, 19 nt, Human
uguuuugugugugugugug

SEQ ID NO: 372186 - RNA, 25 nt, Human
uuaaguaggaaucuaaaaaucuauu

SEQ ID NO: 372187 - RNA, 19 nt, Human
uuaauauuacaugcuauaa

SEQ ID NO: 372188 - RNA, 18 nt, Human
uuggcucuggaccugggc

SEQ ID NO: 372189 - RNA, 22 nt, Human
uuguguguguguguguugucuc

SEQ ID NO: 372190 - RNA, 20 nt, Human
uuguguucuccgggccucug

SEQ ID NO: 372191 - RNA, 21 nt, Human
uuguuuugugugugugugugu

SEQ ID NO: 372192 - RNA, 20 nt, Human
uuuagaagucucuauauauu

SEQ ID NO: 372193 - RNA, 21 nt, Human
aaaaaaaguagaggccucagc

SEQ ID NO: 372194 - RNA, 22 nt, Human
aaaaguggguggacagagguca

SEQ ID NO: 372195 - RNA, 18 nt, Human
acugcuacuguauucaag

SEQ ID NO: 372196 - RNA, 21 nt, Human
agaggccucagcucauuugug

SEQ ID NO: 372197 - RNA, 20 nt, Human
caagccagugcaauaaaaaa

SEQ ID NO: 372198 - RNA, 21 nt, Human
cagcuuaaaaaaaaaaaagua

SEQ ID NO: 372199 - RNA, 18 nt, Human
ccaggcccauguaaccag

SEQ ID NO: 372200 - RNA, 19 nt, Human
ccccaguguaaacaggaaa

SEQ ID NO: 372201 - RNA, 23 nt, Human
ccuccaaauccccaguguaaaca

SEQ ID NO: 372202 - RNA, 23 nt, Human
ccuccaaauccccaguguaaaca

SEQ ID NO: 372203 - RNA, 25 nt, Human
cuguguguagguuuccuggggcccc

SEQ ID NO: 372204 - RNA, 18 nt, Human
cuuugccugcccccucca

SEQ ID NO: 372205 - RNA, 19 nt, Human
gcagcuuaaaaaaaaaaaa

SEQ ID NO: 372206 - RNA, 20 nt, Human
gggacugucuccuaggaucu

SEQ ID NO: 372207 - RNA, 21 nt, Human
guccugaagcccccucgugcc

SEQ ID NO: 372208 - RNA, 20 nt, Human
guggguggacagaggucauu

SEQ ID NO: 372209 - RNA, 20 nt, Human
uaagacgaagugcuucaaac

SEQ ID NO: 372210 - RNA, 19 nt, Human
uaagccucaaguaugcagc

SEQ ID NO: 372211 - RNA, 22 nt, Human
ucaagccagugcaauaaaaaag

SEQ ID NO: 372212 - RNA, 22 nt, Human
uccuuugggaaccucauucugg

SEQ ID NO: 372213 - RNA, 21 nt, Human
ugacuuugccugcccccucca

SEQ ID NO: 372214 - RNA, 21 nt, Human
ugggaaccucauucuggcugu

SEQ ID NO: 372215 - RNA, 21 nt, Human
uggggaacaguacuugugcua

SEQ ID NO: 372216 - RNA, 26 nt, Human
uguaaacaggaaaaugagaagucaca

SEQ ID NO: 372217 - RNA, 19 nt, Human
ugucugaaggucuaugggg

SEQ ID NO: 372218 - RNA, 19 nt, Human
ugugaaaggaagcaagagc

SEQ ID NO: 372219 - RNA, 21 nt, Human
ugugaaaggaagcaagagcca

SEQ ID NO: 372220 - RNA, 24 nt, Human
uuuuuuuuucauuuuaaguauuua

SEQ ID NO: 372221 - RNA, 23 nt, Human
uuuuuuuuuuuuuuuuucauuuu

SEQ ID NO: 372222 - RNA, 24 nt, Human
aaaaaauagugaggauuuagaaau

SEQ ID NO: 372223 - RNA, 21 nt, Human
aaaaggcucaauuaaaaaugu

SEQ ID NO: 372224 - RNA, 18 nt, Human
aacaaauuucacaauacg

SEQ ID NO: 372225 - RNA, 20 nt, Human
aacaaauuucacaauacguc

SEQ ID NO: 372226 - RNA, 23 nt, Human
aacaacuucugaacaacagcaac

SEQ ID NO: 372227 - RNA, 19 nt, Human
aauuaaucacagccacuua

SEQ ID NO: 372228 - RNA, 20 nt, Human
acaccaauaucagacaaaau

SEQ ID NO: 372229 - RNA, 21 nt, Human
acuucagugaaagggaagcac

SEQ ID NO: 372230 - RNA, 22 nt, Human
acuucgagauacacuguaaaaa

SEQ ID NO: 372231 - RNA, 19 nt, Human
acuuugagaaaugucauga

SEQ ID NO: 372232 - RNA, 24 nt, Human
acuuugagaaaugucaugacuggg

SEQ ID NO: 372233 - RNA, 23 nt, Human
agaaacugggagcaaagauauuu

SEQ ID NO: 372234 - RNA, 20 nt, Human
agcacacaaagacccugcua

SEQ ID NO: 372235 - RNA, 26 nt, Human
agccacaaaauccacagcacacaaag

SEQ ID NO: 372236 - RNA, 20 nt, Human
auaugauagcaaaucacuaa

SEQ ID NO: 372237 - RNA, 19 nt, Human
aucauuaaaagacaccuaa

SEQ ID NO: 372238 - RNA, 20 nt, Human
augacugggcacauuggaac

SEQ ID NO: 372239 - RNA, 21 nt, Human
auuaaaagacaccuaaaaauc

SEQ ID NO: 372240 - RNA, 24 nt, Human
caaacaacaguuccccaaaauaca

SEQ ID NO: 372241 - RNA, 22 nt, Human
caacuucugaacaacagcaaca

SEQ ID NO: 372242 - RNA, 22 nt, Human
cacaaaauccacagcacacaaa

SEQ ID NO: 372243 - RNA, 18 nt, Human
cacaagugaauaaaacac

SEQ ID NO: 372244 - RNA, 22 nt, Human
cacaagugaauaaaacacaucg

SEQ ID NO: 372245 - RNA, 21 nt, Human
cacacaaagacccugcuacca

SEQ ID NO: 372246 - RNA, 22 nt, Human
cacuaacaacuucugaacaaca

SEQ ID NO: 372247 - RNA, 21 nt, Human
cagugaaagggaagcaccgaa

SEQ ID NO: 372248 - RNA, 23 nt, Human
cagugcauaccaaaacacacuuc

SEQ ID NO: 372249 - RNA, 24 nt, Human
caucaaacaacaguuccccaaaau

SEQ ID NO: 372250 - RNA, 20 nt, Human
caucguagauugaagccaca

SEQ ID NO: 372251 - RNA, 23 nt, Human
ccacaaaauccacagcacacaaa

SEQ ID NO: 372252 - RNA, 19 nt, Human
cguagauugaagccacaaa

SEQ ID NO: 372253 - RNA, 20 nt, Human
cuucaacaccccacuuucaa

SEQ ID NO: 372254 - RNA, 24 nt, Human
gauaacguuuuauuuuaauucuca

SEQ ID NO: 372255 - RNA, 25 nt, Human
gccacaaaauccacagcacacaaag

SEQ ID NO: 372256 - RNA, 24 nt, Human
uaacaacuucugaacaacagcaac

SEQ ID NO: 372257 - RNA, 25 nt, Human
uaacuaaaaaauuauuucgagacaa

SEQ ID NO: 372258 - RNA, 23 nt, Human
uacaaacacaagugaauaaaaca

SEQ ID NO: 372259 - RNA, 22 nt, Human
uagacaguaucauuaaaagaca

SEQ ID NO: 372260 - RNA, 22 nt, Human
uaguaguuggggucuucaacac

SEQ ID NO: 372261 - RNA, 23 nt, Human
ucauuaaaagacaccuaaaaauc

SEQ ID NO: 372262 - RNA, 20 nt, Human
uccccaaaauacauaaagca

SEQ ID NO: 372263 - RNA, 19 nt, Human
ugaauuccuuuacaccaca

SEQ ID NO: 372264 - RNA, 19 nt, Human
ugacugggcacauuggaac

SEQ ID NO: 372265 - RNA, 24 nt, Human
ugauagcaaaucacuaacaacuuc

SEQ ID NO: 372266 - RNA, 21 nt, Human
ugguagucacuuagguguuuu

SEQ ID NO: 372267 - RNA, 22 nt, Human
ugugucaguucuuaauucaugu

SEQ ID NO: 372268 - RNA, 25 nt, Human
uuaaaagacaccuaaaaaucuuaua

SEQ ID NO: 372269 - RNA, 23 nt, Human
uucacaccaauaucagacaaaau

SEQ ID NO: 372270 - RNA, 25 nt, Human
uuucauauuuaguauuuauaggugc

SEQ ID NO: 372271 - RNA, 25 nt, Human
aaacaauaccacugaccugaucuca

SEQ ID NO: 372272 - RNA, 20 nt, Human
aaacauacauuuucccaauc

SEQ ID NO: 372273 - RNA, 18 nt, Human
acagaaacaauaccacug

SEQ ID NO: 372274 - RNA, 26 nt, Human
agguggcuguuaacauuguuuuauuu

SEQ ID NO: 372275 - RNA, 24 nt, Human
auacaaaaaguagaaaugacagaa

SEQ ID NO: 372276 - RNA, 19 nt, Human
auuccagcuagagcuagaa

SEQ ID NO: 372277 - RNA, 18 nt, Human
caagcuccugaggcuggg

SEQ ID NO: 372278 - RNA, 23 nt, Human
cacccagcgaugugcugggcuca

SEQ ID NO: 372279 - RNA, 24 nt, Human
cagaaaaaacacucuugacagaaa

SEQ ID NO: 372280 - RNA, 27 nt, Human
cagaaaaaacacucuugacagaaacaa

SEQ ID NO: 372281 - RNA, 19 nt, Human
ccgcccacuccaucuccag

SEQ ID NO: 372282 - RNA, 26 nt, Human
cucacccccuuucugguacucaacca

SEQ ID NO: 372283 - RNA, 22 nt, Human
cuccugaggcugggggcccagg

SEQ ID NO: 372284 - RNA, 21 nt, Human
cuuuuggucaucacuuucauu

SEQ ID NO: 372285 - RNA, 24 nt, Human
gaaaaaacacucuugacagaaaca

SEQ ID NO: 372286 - RNA, 24 nt, Human
ggcaucuuuuaaaaaaacaaguua

SEQ ID NO: 372287 - RNA, 18 nt, Human
ggguagggugaaucaauc

SEQ ID NO: 372288 - RNA, 22 nt, Human
gugccccaagcuuauagguggc

SEQ ID NO: 372289 - RNA, 23 nt, Human
uacagauaucaccccaaaaugaa

SEQ ID NO: 372290 - RNA, 18 nt, Human
uacucaaccacuuucugg

SEQ ID NO: 372291 - RNA, 23 nt, Human
uauauacagauaucaccccaaaa

SEQ ID NO: 372292 - RNA, 21 nt, Human
uauggggaaagggagguucaa

SEQ ID NO: 372293 - RNA, 20 nt, Human
ucacccagcgaugugcuggg

SEQ ID NO: 372294 - RNA, 24 nt, Human
ucacccagcgaugugcugggcuca

SEQ ID NO: 372295 - RNA, 23 nt, Human
ucacugggcggaacuuacuguac

SEQ ID NO: 372296 - RNA, 22 nt, Human
uccagggccaagcuccugaggc

SEQ ID NO: 372297 - RNA, 22 nt, Human
uccuuuauacaaaaaguagaaa

SEQ ID NO: 372298 - RNA, 23 nt, Human
uccuuuauacaaaaaguagaaau

SEQ ID NO: 372299 - RNA, 22 nt, Human
ucucaugaaggagcugagccaa

SEQ ID NO: 372300 - RNA, 23 nt, Human
uucauuguucuccagagucucug

SEQ ID NO: 372301 - RNA, 26 nt, Human
uuuuggucaucacuuucauuguucuu

SEQ ID NO: 372302 - RNA, 22 nt, Human
aaaacacauagaacaugcuaca

SEQ ID NO: 372303 - RNA, 19 nt, Human
aauugugcugcuggugggg

SEQ ID NO: 372304 - RNA, 21 nt, Human
acaugcuacauccgcgcagac

SEQ ID NO: 372305 - RNA, 20 nt, Human
agaaggagucuaaggacagc

SEQ ID NO: 372306 - RNA, 18 nt, Human
agacagauggacagacac

SEQ ID NO: 372307 - RNA, 19 nt, Human
agacagauggacagacacu

SEQ ID NO: 372308 - RNA, 23 nt, Human
agauggacagacacuaacacagg

SEQ ID NO: 372309 - RNA, 23 nt, Human
caacccuggcccuguccaugccc

SEQ ID NO: 372310 - RNA, 23 nt, Human
ccagccgcgaccgcaacccuggc

SEQ ID NO: 372311 - RNA, 24 nt, Human
cccagccgcgaccgcaacccuggc

SEQ ID NO: 372312 - RNA, 19 nt, Human
ccccgggguuggacgcggg

SEQ ID NO: 372313 - RNA, 21 nt, Human
ccgcaacccuggcccugucca

SEQ ID NO: 372314 - RNA, 19 nt, Human
ccuggcucuggggggcggg

SEQ ID NO: 372315 - RNA, 20 nt, Human
cgcagacgcuggaugggagg

SEQ ID NO: 372316 - RNA, 18 nt, Human
cucagagcggaaggaaga

SEQ ID NO: 372317 - RNA, 21 nt, Human
cuggcucuggggggcggggca

SEQ ID NO: 372318 - RNA, 18 nt, Human
gcggcugcgcggcagacg

SEQ ID NO: 372319 - RNA, 20 nt, Human
ggagagccacugucggggau

SEQ ID NO: 372320 - RNA, 21 nt, Human
ggaggaggcaacacuggaggg

SEQ ID NO: 372321 - RNA, 21 nt, Human
ggaugggaggaggcaacacug

SEQ ID NO: 372322 - RNA, 18 nt, Human
gggagaaggagucuaagg

SEQ ID NO: 372323 - RNA, 19 nt, Human
ggguuggacgcgggcgggu

SEQ ID NO: 372324 - RNA, 18 nt, Human
gguuggacgcgggcgggu

SEQ ID NO: 372325 - RNA, 25 nt, Human
ugauuggggagaaggagucuaagga

SEQ ID NO: 372326 - RNA, 18 nt, Human
ugcgcggcagacgcgggg

SEQ ID NO: 372327 - RNA, 18 nt, Human
uggacagacacuaacaca

SEQ ID NO: 372328 - RNA, 21 nt, Human
uggcggccuggaugcggggcc

SEQ ID NO: 372329 - RNA, 18 nt, Human
ugggaggaggcaacacug

SEQ ID NO: 372330 - RNA, 20 nt, Human
ugggaggaggcaacacugga

SEQ ID NO: 372331 - RNA, 22 nt, Human
ugggaggaggcaacacuggagg

SEQ ID NO: 372332 - RNA, 24 nt, Human
agaaggaccagagggugggugggg

SEQ ID NO: 372333 - RNA, 22 nt, Human
agggagggcagugagguuggug

SEQ ID NO: 372334 - RNA, 24 nt, Human
aggguugugcugcugcaggcagga

SEQ ID NO: 372335 - RNA, 22 nt, Human
cuccuugugcuaggaggggaug

SEQ ID NO: 372336 - RNA, 19 nt, Human
guggguggggccgagggag

SEQ ID NO: 372337 - RNA, 21 nt, Human
uggggucagaaggaccagagg

SEQ ID NO: 372338 - RNA, 21 nt, Human
uggguggggccgagggagggc

SEQ ID NO: 372339 - RNA, 25 nt, Human
uggguggggccgagggagggcagug

SEQ ID NO: 372340 - RNA, 26 nt, Human
uguccaaggcagaggagcgcucuuca

SEQ ID NO: 372341 - RNA, 18 nt, Human
uuuuuuuuuuuaggagug

SEQ ID NO: 372342 - RNA, 18 nt, Human
uuuuuuuuuuuuaggagu

SEQ ID NO: 372343 - RNA, 19 nt, Human
aagaacuguaugccuuagc

SEQ ID NO: 372344 - RNA, 26 nt, Human
acaccacgucacgccuaugccccgcc

SEQ ID NO: 372345 - RNA, 20 nt, Human
acggggaggcgggaaggggg

SEQ ID NO: 372346 - RNA, 20 nt, Human
acucuuuauugccaacgguu

SEQ ID NO: 372347 - RNA, 25 nt, Human
augcaccuuucugcaaaauugucug

SEQ ID NO: 372348 - RNA, 26 nt, Human
cagccaaaagcugcuccaauuacagc

SEQ ID NO: 372349 - RNA, 24 nt, Human
ccaaaagcugcuccaauuacagcc

SEQ ID NO: 372350 - RNA, 19 nt, Human
ccacccaguccagcaggcc

SEQ ID NO: 372351 - RNA, 24 nt, Human
ccacccaguccagcaggccacagg

SEQ ID NO: 372352 - RNA, 18 nt, Human
ccacggccggccgagcgc

SEQ ID NO: 372353 - RNA, 18 nt, Human
cccuucucccuccccuuc

SEQ ID NO: 372354 - RNA, 19 nt, Human
ccgccacccgggucaugcu

SEQ ID NO: 372355 - RNA, 19 nt, Human
ccgcugccacccccuaggc

SEQ ID NO: 372356 - RNA, 21 nt, Human
ccgcugccacccccuaggcgc

SEQ ID NO: 372357 - RNA, 19 nt, Human
ccuugccgccccgcacugc

SEQ ID NO: 372358 - RNA, 23 nt, Human
cgacuagcacccaacaccccggu

SEQ ID NO: 372359 - RNA, 23 nt, Human
cgccccgcacugcccgcugccac

SEQ ID NO: 372360 - RNA, 18 nt, Human
cgccuaugccccgccccc

SEQ ID NO: 372361 - RNA, 21 nt, Human
cucccuucucccuccccuuca

SEQ ID NO: 372362 - RNA, 21 nt, Human
cucuuugggcuguaauaaaua

SEQ ID NO: 372363 - RNA, 23 nt, Human
cuuucugcaaaauugucugaaaa

SEQ ID NO: 372364 - RNA, 18 nt, Human
ggaaaagaggagucccau

SEQ ID NO: 372365 - RNA, 24 nt, Human
ggaauuguuuucguaccaccacau

SEQ ID NO: 372366 - RNA, 23 nt, Human
ggagcuuccucccuucucccucc

SEQ ID NO: 372367 - RNA, 21 nt, Human
ggccgugguccucgcacccuu

SEQ ID NO: 372368 - RNA, 22 nt, Human
ggccgugguccucgcacccuug

SEQ ID NO: 372369 - RNA, 19 nt, Human
gguucuggguuccacccag

SEQ ID NO: 372370 - RNA, 18 nt, Human
gucccgccacccggguca

SEQ ID NO: 372371 - RNA, 23 nt, Human
guuccacccaguccagcaggcca

SEQ ID NO: 372372 - RNA, 20 nt, Human
uaaaacagguaucucaagga

SEQ ID NO: 372373 - RNA, 25 nt, Human
uaauaaauacugcucuuugggcugu

SEQ ID NO: 372374 - RNA, 19 nt, Human
uaggcgcggucacacgucc

SEQ ID NO: 372375 - RNA, 21 nt, Human
uaggguccauucgaaaagucu

SEQ ID NO: 372376 - RNA, 22 nt, Human
ucacaguggaaaagaggagucc

SEQ ID NO: 372377 - RNA, 19 nt, Human
uccaaaguccucuggcuga

SEQ ID NO: 372378 - RNA, 18 nt, Human
uccacuugugcgagugag

SEQ ID NO: 372379 - RNA, 21 nt, Human
uccacuugugcgagugagagu

SEQ ID NO: 372380 - RNA, 23 nt, Human
uccagccacaaguaucuucaaaa

SEQ ID NO: 372381 - RNA, 24 nt, Human
uccucuggcugaaaugcucucaac

SEQ ID NO: 372382 - RNA, 18 nt, Human
ucuggguuccacccaguc

SEQ ID NO: 372383 - RNA, 23 nt, Human
ugaaaugcucucaacagagagaa

SEQ ID NO: 372384 - RNA, 20 nt, Human
uggccgggaagcaagucuug

SEQ ID NO: 372385 - RNA, 21 nt, Human
ugguucuggguuccacccagu

SEQ ID NO: 372386 - RNA, 25 nt, Human
uuaaaacagguaucucaaggaaaac

SEQ ID NO: 372387 - RNA, 21 nt, Human
uuacgcagccaaaagcugcuc

SEQ ID NO: 372388 - RNA, 24 nt, Human
aaaaaauaaaagaccaagacaccc

SEQ ID NO: 372389 - RNA, 20 nt, Human
aaaagaccaagacacccaga

SEQ ID NO: 372390 - RNA, 23 nt, Human
aaaagaccaagacacccagagug

SEQ ID NO: 372391 - RNA, 21 nt, Human
aaagauuccaguuacacuaca

SEQ ID NO: 372392 - RNA, 22 nt, Human
aaccgucccuuagccgcuucca

SEQ ID NO: 372393 - RNA, 18 nt, Human
aagaccaagacacccaga

SEQ ID NO: 372394 - RNA, 20 nt, Human
acccgcccgccaccaccacc

SEQ ID NO: 372395 - RNA, 21 nt, Human
acgccccccgccagaucacuc

SEQ ID NO: 372396 - RNA, 25 nt, Human
agacccuguggccgucacgcccugc

SEQ ID NO: 372397 - RNA, 23 nt, Human
agcaggggcucuggcccaggugu

SEQ ID NO: 372398 - RNA, 24 nt, Human
aggcuggcagcaggggggccccgg

SEQ ID NO: 372399 - RNA, 20 nt, Human
agggaggguuggcaggagcc

SEQ ID NO: 372400 - RNA, 21 nt, Human
agggggcgacgccuggcuuca

SEQ ID NO: 372401 - RNA, 22 nt, Human
cacagcaggggcucuggcccag

SEQ ID NO: 372402 - RNA, 26 nt, Human
caccacccaaaaaaacaccacaaggg

SEQ ID NO: 372403 - RNA, 28 nt, Human
cacccagagugagaugcauguuggggac

SEQ ID NO: 372404 - RNA, 18 nt, Human
caccccuacccgcccgcc

SEQ ID NO: 372405 - RNA, 23 nt, Human
cagagaaauaaggcucagagccg

SEQ ID NO: 372406 - RNA, 21 nt, Human
cagagccgucugaggucagaa

SEQ ID NO: 372407 - RNA, 19 nt, Human
cagcccccaaccgucccuu

SEQ ID NO: 372408 - RNA, 23 nt, Human
caggagccgccaugugggcaggg

SEQ ID NO: 372409 - RNA, 19 nt, Human
caggaggaagacggccccc

SEQ ID NO: 372410 - RNA, 19 nt, Human
cagggccaggccgcagccg

SEQ ID NO: 372411 - RNA, 23 nt, Human
ccaaccgucccuuagccgcuucc

SEQ ID NO: 372412 - RNA, 25 nt, Human
ccacaccccuacccgcccgccacca

SEQ ID NO: 372413 - RNA, 23 nt, Human
ccaccacccaaaaaaacaccaca

SEQ ID NO: 372414 - RNA, 18 nt, Human
ccacccaaaaaaacacca

SEQ ID NO: 372415 - RNA, 20 nt, Human
ccacccaaaaaaacaccaca

SEQ ID NO: 372416 - RNA, 19 nt, Human
ccaggcccagggcuggggc

SEQ ID NO: 372417 - RNA, 22 nt, Human
cccaaaaaaacaccacaagggu

SEQ ID NO: 372418 - RNA, 24 nt, Human
cccagcccccaaccgucccuuagc

SEQ ID NO: 372419 - RNA, 21 nt, Human
cccagggccaggccgcagccg

SEQ ID NO: 372420 - RNA, 18 nt, Human
cccagggcuggggcugga

SEQ ID NO: 372421 - RNA, 23 nt, Human
ccccacaccccuacccgcccgcc

SEQ ID NO: 372422 - RNA, 19 nt, Human
cccccacaccccuacccgc

SEQ ID NO: 372423 - RNA, 21 nt, Human
cccccacaccccuacccgccc

SEQ ID NO: 372424 - RNA, 23 nt, Human
cccccacaccccuacccgcccgc

SEQ ID NO: 372425 - RNA, 20 nt, Human
ccccccgccagaucacucgc

SEQ ID NO: 372426 - RNA, 20 nt, Human
ccccggcggcucaccccagg

SEQ ID NO: 372427 - RNA, 21 nt, Human
ccccggcggcucaccccaggg

SEQ ID NO: 372428 - RNA, 19 nt, Human
ccccgggagguggguggcg

SEQ ID NO: 372429 - RNA, 20 nt, Human
ccccugcuccuuuguucggc

SEQ ID NO: 372430 - RNA, 18 nt, Human
cccuggagcccaccuggc

SEQ ID NO: 372431 - RNA, 22 nt, Human
ccgcagccgcugacccgagggg

SEQ ID NO: 372432 - RNA, 23 nt, Human
ccucccagggccaggccgcagcc

SEQ ID NO: 372433 - RNA, 26 nt, Human
ccucccgacagcuucccuucccaagc

SEQ ID NO: 372434 - RNA, 18 nt, Human
ccucccgcccuggagccc

SEQ ID NO: 372435 - RNA, 20 nt, Human
ccucccgcccuggagcccac

SEQ ID NO: 372436 - RNA, 22 nt, Human
ccuggcuucauccacccgggag

SEQ ID NO: 372437 - RNA, 18 nt, Human
cgacagcuucccuuccca

SEQ ID NO: 372438 - RNA, 30 nt, Human
cgcccagggcucccagcccccaaccguccc

SEQ ID NO: 372439 - RNA, 18 nt, Human
cgcccgccaccaccaccu

SEQ ID NO: 372440 - RNA, 27 nt, Human
cgcccgccaccaccaccuuggcagaac

SEQ ID NO: 372441 - RNA, 20 nt, Human
cggcccccacaccccuaccc

SEQ ID NO: 372442 - RNA, 23 nt, Human
cuacagccaggcuugccugggac

SEQ ID NO: 372443 - RNA, 21 nt, Human
cugaaaucccucccagggcca

SEQ ID NO: 372444 - RNA, 19 nt, Human
cugcgcggccccgggaggu

SEQ ID NO: 372445 - RNA, 19 nt, Human
cugcuuccagucaggcuag

SEQ ID NO: 372446 - RNA, 19 nt, Human
cuugccucccgcccuggag

SEQ ID NO: 372447 - RNA, 22 nt, Human
gcacccccuggggagggugcug

SEQ ID NO: 372448 - RNA, 19 nt, Human
gcccccaaccgucccuuag

SEQ ID NO: 372449 - RNA, 26 nt, Human
gcccgccaccaccaccuuggcagaac

SEQ ID NO: 372450 - RNA, 18 nt, Human
gcugggagaggcaaaaga

SEQ ID NO: 372451 - RNA, 25 nt, Human
ggagggccacugacaggcuugggac

SEQ ID NO: 372452 - RNA, 20 nt, Human
ggcagcaggggggccccggc

SEQ ID NO: 372453 - RNA, 25 nt, Human
ggcucaccccagggcucccggaggg

SEQ ID NO: 372454 - RNA, 21 nt, Human
ggcugggagaggcaaaagauu

SEQ ID NO: 372455 - RNA, 20 nt, Human
ggcugggaggagguggcugg

SEQ ID NO: 372456 - RNA, 20 nt, Human
gggaggcuggcagcaggggg

SEQ ID NO: 372457 - RNA, 24 nt, Human
gggggcugggaggagguggcuggg

SEQ ID NO: 372458 - RNA, 25 nt, Human
ggugaaaggaaagagacaggaggaa

SEQ ID NO: 372459 - RNA, 24 nt, Human
gguggcugggagaggcaaaagauu

SEQ ID NO: 372460 - RNA, 20 nt, Human
uaaaagaccaagacacccag

SEQ ID NO: 372461 - RNA, 25 nt, Human
uacagccaggcuugccugggacgcc

SEQ ID NO: 372462 - RNA, 21 nt, Human
uaggggcgacaggugggggca

SEQ ID NO: 372463 - RNA, 20 nt, Human
ucacucgcuacuacagccag

SEQ ID NO: 372464 - RNA, 21 nt, Human
uccagagaaauaaggcucaga

SEQ ID NO: 372465 - RNA, 20 nt, Human
ucccugcggcggcgccccug

SEQ ID NO: 372466 - RNA, 23 nt, Human
ucccugcggcggcgccccugcuc

SEQ ID NO: 372467 - RNA, 20 nt, Human
ucccuucccaagcagggguu

SEQ ID NO: 372468 - RNA, 20 nt, Human
uccuggggggcugggaggag

SEQ ID NO: 372469 - RNA, 21 nt, Human
uccuggggggcugggaggagg

SEQ ID NO: 372470 - RNA, 23 nt, Human
uccuggggggcugggaggaggug

SEQ ID NO: 372471 - RNA, 21 nt, Human
ucggcagcccaggcccagggc

SEQ ID NO: 372472 - RNA, 23 nt, Human
ugaaaggaaagagacaggaggaa

SEQ ID NO: 372473 - RNA, 23 nt, Human
ugaguuauuuuauuucgcuauuu

SEQ ID NO: 372474 - RNA, 29 nt, Human
ugcccagcucuccuggggggcuggggcca

SEQ ID NO: 372475 - RNA, 24 nt, Human
ugccucccgcccuggagcccaccu

SEQ ID NO: 372476 - RNA, 23 nt, Human
uggcaguagacgagaggccgcug

SEQ ID NO: 372477 - RNA, 18 nt, Human
uggcccaggugucggcag

SEQ ID NO: 372478 - RNA, 21 nt, Human
ugggagaggggcuguuuccag

SEQ ID NO: 372479 - RNA, 21 nt, Human
ugggaggagguggcugggaga

SEQ ID NO: 372480 - RNA, 22 nt, Human
ugggaggagguggcugggagag

SEQ ID NO: 372481 - RNA, 25 nt, Human
ugggaggagguggcugggagaggcc

SEQ ID NO: 372482 - RNA, 21 nt, Human
uggggcuggacgggaaggacg

SEQ ID NO: 372483 - RNA, 22 nt, Human
uggggggcugggaggagguggc

SEQ ID NO: 372484 - RNA, 23 nt, Human
uuacaaaaaauaaaagaccaaga

SEQ ID NO: 372485 - RNA, 19 nt, Human
uucauuaaaaaaaauacug

SEQ ID NO: 372486 - RNA, 23 nt, Human
uuuucucugggguuuccaguuug

SEQ ID NO: 372487 - RNA, 23 nt, Human
aaacacagcagauggagaggacg

SEQ ID NO: 372488 - RNA, 20 nt, Human
aacaaaugagacaccuaccc

SEQ ID NO: 372489 - RNA, 21 nt, Human
aacaacaacuccugcuucggc

SEQ ID NO: 372490 - RNA, 19 nt, Human
aagucgcguagcgcccucc

SEQ ID NO: 372491 - RNA, 18 nt, Human
acaaacucaaguggccaa

SEQ ID NO: 372492 - RNA, 20 nt, Human
acagcagauggagaggacga

SEQ ID NO: 372493 - RNA, 22 nt, Human
agccccucagcaacaacaacuc

SEQ ID NO: 372494 - RNA, 21 nt, Human
aucccuccgccguccucacug

SEQ ID NO: 372495 - RNA, 22 nt, Human
caaacacagcagauggagagga

SEQ ID NO: 372496 - RNA, 27 nt, Human
caacaacaacccacacacuaggacccg

SEQ ID NO: 372497 - RNA, 22 nt, Human
caacaacaacuccugcuucggc

SEQ ID NO: 372498 - RNA, 20 nt, Human
cagaacaaaugagacaccua

SEQ ID NO: 372499 - RNA, 18 nt, Human
cagcaaggggcugggcag

SEQ ID NO: 372500 - RNA, 24 nt, Human
cagccccucagcaacaacaacucc

SEQ ID NO: 372501 - RNA, 23 nt, Human
ccccucagcaacaacaacuccug

SEQ ID NO: 372502 - RNA, 19 nt, Human
ccgcgggcacagcgcacgc

SEQ ID NO: 372503 - RNA, 20 nt, Human
ccgcggggggcuggcuucug

SEQ ID NO: 372504 - RNA, 24 nt, Human
ccucagcaacaacaacuccugcuu

SEQ ID NO: 372505 - RNA, 21 nt, Human
cgcacgcgccgugcggugcca

SEQ ID NO: 372506 - RNA, 23 nt, Human
cgcgggcacagcgcacgcgcggu

SEQ ID NO: 372507 - RNA, 22 nt, Human
cggaggcucgcggcggcugcgg

SEQ ID NO: 372508 - RNA, 20 nt, Human
gcguagcgcccuccucgcuc

SEQ ID NO: 372509 - RNA, 24 nt, Human
ggcugcggcagccccucagcaaca

SEQ ID NO: 372510 - RNA, 21 nt, Human
guccaaacacagcagauggag

SEQ ID NO: 372511 - RNA, 18 nt, Human
uaggacccggcgcugccg

SEQ ID NO: 372512 - RNA, 20 nt, Human
uccaaacacagcagauggag

SEQ ID NO: 372513 - RNA, 18 nt, Human
ucccggccgcaaaucccu

SEQ ID NO: 372514 - RNA, 21 nt, Human
ucggcuuccacuccgggggcg

SEQ ID NO: 372515 - RNA, 24 nt, Human
ucuggcgucuguccggaggcucgc

SEQ ID NO: 372516 - RNA, 18 nt, Human
ugagacaccuacccuugg

SEQ ID NO: 372517 - RNA, 18 nt, Human
ugaguaccucagccgcgg

SEQ ID NO: 372518 - RNA, 26 nt, Human
ugaguaccucagccgcggggggcugg

SEQ ID NO: 372519 - RNA, 19 nt, Human
aaaaccaaaccucaaaaag

SEQ ID NO: 372520 - RNA, 21 nt, Human
acacacggcuccaagaaggcc

SEQ ID NO: 372521 - RNA, 27 nt, Human
acacggcuccaagaaggcccccaaggg

SEQ ID NO: 372522 - RNA, 19 nt, Human
accaaaccucaaaaagcca

SEQ ID NO: 372523 - RNA, 23 nt, Human
acggcuccaagaaggcccccaag

SEQ ID NO: 372524 - RNA, 22 nt, Human
agggggcugagccaagggggaa

SEQ ID NO: 372525 - RNA, 22 nt, Human
caagaaggcccccaagggggga

SEQ ID NO: 372526 - RNA, 21 nt, Human
cacacacggcuccaagaaggc

SEQ ID NO: 372527 - RNA, 24 nt, Human
ccacucacucacacacggcuccaa

SEQ ID NO: 372528 - RNA, 20 nt, Human
ccuuuuuuuugugaaaaacc

SEQ ID NO: 372529 - RNA, 21 nt, Human
cugagccaagggggaaagggg

SEQ ID NO: 372530 - RNA, 20 nt, Human
gcccccaaggggggacuuac

SEQ ID NO: 372531 - RNA, 19 nt, Human
gcccuggguuucuccaaau

SEQ ID NO: 372532 - RNA, 20 nt, Human
ggaaggggcaggcauggggg

SEQ ID NO: 372533 - RNA, 21 nt, Human
ggggaaagggguggccccaga

SEQ ID NO: 372534 - RNA, 22 nt, Human
ggggaaggggcaggcauggggg

SEQ ID NO: 372535 - RNA, 25 nt, Human
ggggaaggggcaggcauggggggaa

SEQ ID NO: 372536 - RNA, 20 nt, Human
uaagucuuaaaggaggaaaa

SEQ ID NO: 372537 - RNA, 21 nt, Human
ucuggguacaaugcugugugg

SEQ ID NO: 372538 - RNA, 18 nt, Human
ugaaaaaccaaaccucaa

SEQ ID NO: 372539 - RNA, 20 nt, Human
uggguacaaugcuguguggc

SEQ ID NO: 372540 - RNA, 22 nt, Human
auaccauguucgaaaagcaaga

SEQ ID NO: 372541 - RNA, 20 nt, Human
ccccgcgcuguggaaagccc

SEQ ID NO: 372542 - RNA, 18 nt, Human
cugcagccucccguuccc

SEQ ID NO: 372543 - RNA, 23 nt, Human
gaaaagcaagacuuguuccaaga

SEQ ID NO: 372544 - RNA, 21 nt, Human
gaauuccuuuuuuuuuuuuuu

SEQ ID NO: 372545 - RNA, 27 nt, Human
uaacacaaacaaggcuauuauaccaug

SEQ ID NO: 372546 - RNA, 22 nt, Human
uauaccauguucgaaaagcaag

SEQ ID NO: 372547 - RNA, 18 nt, Human
uauuuuuauaauuuguag

SEQ ID NO: 372548 - RNA, 21 nt, Human
ucaacaaugcugauagauucc

SEQ ID NO: 372549 - RNA, 24 nt, Human
ucccccgcgcuguggaaagcccgu

SEQ ID NO: 372550 - RNA, 27 nt, Human
uccuuuuuuuuuuuuuuagcauagaga

SEQ ID NO: 372551 - RNA, 26 nt, Human
uuccuuuuuuuuuuuuuuagcauaga

SEQ ID NO: 372552 - RNA, 18 nt, Human
uuuguagaaaauugacau

SEQ ID NO: 372553 - RNA, 24 nt, Human
aacagguaauauaaaaccgauaca

SEQ ID NO: 372554 - RNA, 20 nt, Human
aucacagcagcaugaucucc

SEQ ID NO: 372555 - RNA, 22 nt, Human
caauaaggccuccccucuaucc

SEQ ID NO: 372556 - RNA, 19 nt, Human
ccaauacaaaggaaaacug

SEQ ID NO: 372557 - RNA, 24 nt, Human
gagcaagucuuccuuaugcuguuu

SEQ ID NO: 372558 - RNA, 24 nt, Human
uaaaaccgauacaauaaggccucc

SEQ ID NO: 372559 - RNA, 24 nt, Human
uacaaaggaaaacugcaucuuuuu

SEQ ID NO: 372560 - RNA, 23 nt, Human
uacaauaaggccuccccucuauc

SEQ ID NO: 372561 - RNA, 18 nt, Human
ucuccuggugaagcagaa

SEQ ID NO: 372562 - RNA, 23 nt, Human
uggugaagcagaacagguaauau

SEQ ID NO: 372563 - RNA, 22 nt, Human
ugucccacuucuccccuccaaa

SEQ ID NO: 372564 - RNA, 23 nt, Human
uuccuuuuuuuuuuuaacugaaa

SEQ ID NO: 372565 - RNA, 21 nt, Human
uucucuuucauaggacagggg

SEQ ID NO: 372566 - RNA, 23 nt, Human
uugacaauuuuauuuucacauuu

SEQ ID NO: 372567 - RNA, 24 nt, Human
uugacaauuuuauuuucacauuuc

SEQ ID NO: 372568 - RNA, 19 nt, Human
uuugucccacuucuccccu

SEQ ID NO: 372569 - RNA, 23 nt, Human
uuuugucccacuucuccccucca

SEQ ID NO: 372570 - RNA, 23 nt, Human
auaaauguucacauuggacaaag

SEQ ID NO: 372571 - RNA, 28 nt, Human
caaagagcacacccgcacgccggggccc

SEQ ID NO: 372572 - RNA, 22 nt, Human
caaaggacaucuaaaaacaaag

SEQ ID NO: 372573 - RNA, 21 nt, Human
cucaacaauuucucacuucau

SEQ ID NO: 372574 - RNA, 24 nt, Human
gacaucuaaaaacaaacuguaucc

SEQ ID NO: 372575 - RNA, 19 nt, Human
gagcacacccgcacgcugc

SEQ ID NO: 372576 - RNA, 24 nt, Human
uaaaaacaaacuguauccuucuca

SEQ ID NO: 372577 - RNA, 25 nt, Human
uaaaaacaaacuguauccuucucaa

SEQ ID NO: 372578 - RNA, 21 nt, Human
uaacacgaggguaaucaaaac

SEQ ID NO: 372579 - RNA, 22 nt, Human
uggaauuucacaaagagcacac

SEQ ID NO: 372580 - RNA, 20 nt, Human
uucacaaagagcacacccgc

SEQ ID NO: 372581 - RNA, 22 nt, Human
aaaaagcaauaugaaauguuac

SEQ ID NO: 372582 - RNA, 21 nt, Human
aaauagccccagagagagggc

SEQ ID NO: 372583 - RNA, 23 nt, Human
aaauagccccagagagagggcag

SEQ ID NO: 372584 - RNA, 24 nt, Human
aaggggcagcaaaaaucuguagag

SEQ ID NO: 372585 - RNA, 24 nt, Human
aaggggcagcaaaaaucuguagag

SEQ ID NO: 372586 - RNA, 24 nt, Human
aaggggcagcaaaaaucuguagag

SEQ ID NO: 372587 - RNA, 19 nt, Human
aagugccccacguggcugc

SEQ ID NO: 372588 - RNA, 19 nt, Human
aagugccccacguggcugc

SEQ ID NO: 372589 - RNA, 19 nt, Human
aagugccccacguggcugc

SEQ ID NO: 372590 - RNA, 19 nt, Human
aagugccccacguggcugc

SEQ ID NO: 372591 - RNA, 19 nt, Human
aaugccugccucaguucag

SEQ ID NO: 372592 - RNA, 19 nt, Human
aaugccugccucaguucag

SEQ ID NO: 372593 - RNA, 19 nt, Human
aaugccugccucaguucag

SEQ ID NO: 372594 - RNA, 19 nt, Human
aaugccugccucaguucag

SEQ ID NO: 372595 - RNA, 26 nt, Human
acugcagaccccacagaaggcucuga

SEQ ID NO: 372596 - RNA, 22 nt, Human
acuugcugcugcugagaacgcc

SEQ ID NO: 372597 - RNA, 22 nt, Human
acuugcugcugcugagaacgcc

SEQ ID NO: 372598 - RNA, 22 nt, Human
acuugcugcugcugagaacgcc

SEQ ID NO: 372599 - RNA, 22 nt, Human
acuugcugcugcugagaacgcc

SEQ ID NO: 372600 - RNA, 22 nt, Human
agagggcagggggcagcugacc

SEQ ID NO: 372601 - RNA, 21 nt, Human
aggagaaaguagauucagcca

SEQ ID NO: 372602 - RNA, 21 nt, Human
aggagaaaguagauucagcca

SEQ ID NO: 372603 - RNA, 21 nt, Human
aggagaaaguagauucagcca

SEQ ID NO: 372604 - RNA, 21 nt, Human
aggagaaaguagauucagcca

SEQ ID NO: 372605 - RNA, 21 nt, Human
aggccgcauuccucaaauagc

SEQ ID NO: 372606 - RNA, 18 nt, Human
agggaagacagggggcgg

SEQ ID NO: 372607 - RNA, 18 nt, Human
aucccacuuacaucucca

SEQ ID NO: 372608 - RNA, 24 nt, Human
caaauagccccagagagagggcag

SEQ ID NO: 372609 - RNA, 20 nt, Human
cagaaggcucugagcucagc

SEQ ID NO: 372610 - RNA, 20 nt, Human
cagaaggcucugagcucagc

SEQ ID NO: 372611 - RNA, 21 nt, Human
cagauuccucgcuacuccaaa

SEQ ID NO: 372612 - RNA, 21 nt, Human
cagauuccucgcuacuccaaa

SEQ ID NO: 372613 - RNA, 21 nt, Human
cagauuccucgcuacuccaaa

SEQ ID NO: 372614 - RNA, 21 nt, Human
cagauuccucgcuacuccaaa

SEQ ID NO: 372615 - RNA, 19 nt, Human
cagcuacaguggcugcggc

SEQ ID NO: 372616 - RNA, 23 nt, Human
cagcuccagagggaagacagggg

SEQ ID NO: 372617 - RNA, 23 nt, Human
cagcugaccuugcccccgcaaac

SEQ ID NO: 372618 - RNA, 18 nt, Human
cagggggcagcugaccuu

SEQ ID NO: 372619 - RNA, 18 nt, Human
cauuccucaaauagcccc

SEQ ID NO: 372620 - RNA, 24 nt, Human
cauugaucagcgaccacaguuacu

SEQ ID NO: 372621 - RNA, 27 nt, Human
ccaaauccaauguccacaguuaaaacu

SEQ ID NO: 372622 - RNA, 27 nt, Human
ccaaauccaauguccacaguuaaaacu

SEQ ID NO: 372623 - RNA, 27 nt, Human
ccaaauccaauguccacaguuaaaacu

SEQ ID NO: 372624 - RNA, 27 nt, Human
ccaaauccaauguccacaguuaaaacu

SEQ ID NO: 372625 - RNA, 18 nt, Human
ccaccaaauccaaugucc

SEQ ID NO: 372626 - RNA, 18 nt, Human
ccaccaaauccaaugucc

SEQ ID NO: 372627 - RNA, 18 nt, Human
ccaccaaauccaaugucc

SEQ ID NO: 372628 - RNA, 18 nt, Human
ccaccaaauccaaugucc

SEQ ID NO: 372629 - RNA, 21 nt, Human
ccagagagagggcagggggca

SEQ ID NO: 372630 - RNA, 18 nt, Human
ccagagggaagacagggg

SEQ ID NO: 372631 - RNA, 23 nt, Human
ccuugccacugcagaccccacag

SEQ ID NO: 372632 - RNA, 24 nt, Human
cgaccacaguuacuguagagaaaa

SEQ ID NO: 372633 - RNA, 19 nt, Human
cggcuggccuugccacugc

SEQ ID NO: 372634 - RNA, 19 nt, Human
cuacaguggcugcggccag

SEQ ID NO: 372635 - RNA, 20 nt, Human
cucagcuacaguggcugcgg

SEQ ID NO: 372636 - RNA, 23 nt, Human
cugagcucagcuacaguggcugc

SEQ ID NO: 372637 - RNA, 21 nt, Human
cugaguuccacuuacauaugc

SEQ ID NO: 372638 - RNA, 21 nt, Human
cugaguuccacuuacauaugc

SEQ ID NO: 372639 - RNA, 21 nt, Human
cugaguuccacuuacauaugc

SEQ ID NO: 372640 - RNA, 21 nt, Human
cugaguuccacuuacauaugc

SEQ ID NO: 372641 - RNA, 23 nt, Human
cugcguuugacuuggacuuccac

SEQ ID NO: 372642 - RNA, 23 nt, Human
cugcguuugacuuggacuuccac

SEQ ID NO: 372643 - RNA, 23 nt, Human
cugcguuugacuuggacuuccac

SEQ ID NO: 372644 - RNA, 23 nt, Human
cugcguuugacuuggacuuccac

SEQ ID NO: 372645 - RNA, 19 nt, Human
cugugaauuuucagaucca

SEQ ID NO: 372646 - RNA, 23 nt, Human
gacacucuugguugcucagugag

SEQ ID NO: 372647 - RNA, 23 nt, Human
gacacucuugguugcucagugag

SEQ ID NO: 372648 - RNA, 23 nt, Human
gacacucuugguugcucagugag

SEQ ID NO: 372649 - RNA, 23 nt, Human
gacacucuugguugcucagugag

SEQ ID NO: 372650 - RNA, 21 nt, Human
gaccuugcccccgcaaaccac

SEQ ID NO: 372651 - RNA, 25 nt, Human
gacgcggguucuccuagaaacaaug

SEQ ID NO: 372652 - RNA, 25 nt, Human
gacgcggguucuccuagaaacaaug

SEQ ID NO: 372653 - RNA, 25 nt, Human
gacgcggguucuccuagaaacaaug

SEQ ID NO: 372654 - RNA, 25 nt, Human
gacgcggguucuccuagaaacaaug

SEQ ID NO: 372655 - RNA, 18 nt, Human
gagcucagcuacaguggc

SEQ ID NO: 372656 - RNA, 21 nt, Human
gagcucagcuacaguggcugc

SEQ ID NO: 372657 - RNA, 24 nt, Human
ggaacaaaaagcucacaaacacuc

SEQ ID NO: 372658 - RNA, 22 nt, Human
ggggcagcaaaaaucuguagag

SEQ ID NO: 372659 - RNA, 20 nt, Human
gguaaaaggggcagcaaaaa

SEQ ID NO: 372660 - RNA, 20 nt, Human
gguaaaaggggcagcaaaaa

SEQ ID NO: 372661 - RNA, 20 nt, Human
gguaaaaggggcagcaaaaa

SEQ ID NO: 372662 - RNA, 20 nt, Human
gguaaaaggggcagcaaaaa

SEQ ID NO: 372663 - RNA, 20 nt, Human
guagagaaaagccuuucuua

SEQ ID NO: 372664 - RNA, 18 nt, Human
gucucagcuaagaaugcc

SEQ ID NO: 372665 - RNA, 18 nt, Human
gucucagcuaagaaugcc

SEQ ID NO: 372666 - RNA, 18 nt, Human
gucucagcuaagaaugcc

SEQ ID NO: 372667 - RNA, 18 nt, Human
gucucagcuaagaaugcc

SEQ ID NO: 372668 - RNA, 20 nt, Human
guggcugcggccagcccuug

SEQ ID NO: 372669 - RNA, 18 nt, Human
uaaaacuugaugcuucug

SEQ ID NO: 372670 - RNA, 22 nt, Human
uacaacugacacucuugguugc

SEQ ID NO: 372671 - RNA, 22 nt, Human
uacaacugacacucuugguugc

SEQ ID NO: 372672 - RNA, 22 nt, Human
uacaacugacacucuugguugc

SEQ ID NO: 372673 - RNA, 22 nt, Human
uacaacugacacucuugguugc

SEQ ID NO: 372674 - RNA, 22 nt, Human
uacuugcugcugcugagaacgc

SEQ ID NO: 372675 - RNA, 22 nt, Human
uacuugcugcugcugagaacgc

SEQ ID NO: 372676 - RNA, 24 nt, Human
uagauggagccugguuuuugcuug

SEQ ID NO: 372677 - RNA, 24 nt, Human
uagauggagccugguuuuugcuug

SEQ ID NO: 372678 - RNA, 24 nt, Human
uagauggagccugguuuuugcuug

SEQ ID NO: 372679 - RNA, 24 nt, Human
uagauggagccugguuuuugcuug

SEQ ID NO: 372680 - RNA, 18 nt, Human
uaucucauuugcaguuug

SEQ ID NO: 372681 - RNA, 20 nt, Human
ucagcuacaguggcugcggc

SEQ ID NO: 372682 - RNA, 23 nt, Human
ucaucaggugguggugagcuggc

SEQ ID NO: 372683 - RNA, 18 nt, Human
ucucagguguaagcgauc

SEQ ID NO: 372684 - RNA, 18 nt, Human
ucucagguguaagcgauc

SEQ ID NO: 372685 - RNA, 18 nt, Human
ucucagguguaagcgauc

SEQ ID NO: 372686 - RNA, 18 nt, Human
ucucagguguaagcgauc

SEQ ID NO: 372687 - RNA, 20 nt, Human
ucuccuagaaacaaugcaag

SEQ ID NO: 372688 - RNA, 21 nt, Human
ucuccuagaaacaaugcaagc

SEQ ID NO: 372689 - RNA, 21 nt, Human
ucuccuagaaacaaugcaagc

SEQ ID NO: 372690 - RNA, 21 nt, Human
ucuccuagaaacaaugcaagc

SEQ ID NO: 372691 - RNA, 23 nt, Human
ucuccuagaaacaaugcaagcuc

SEQ ID NO: 372692 - RNA, 23 nt, Human
ucuccuagaaacaaugcaagcuc

SEQ ID NO: 372693 - RNA, 23 nt, Human
ucuccuagaaacaaugcaagcuc

SEQ ID NO: 372694 - RNA, 23 nt, Human
ucuccuagaaacaaugcaagcuc

SEQ ID NO: 372695 - RNA, 24 nt, Human
ugacuggagagaaaagccuuucuu

SEQ ID NO: 372696 - RNA, 20 nt, Human
ugcaaaagaacugcauuccu

SEQ ID NO: 372697 - RNA, 21 nt, Human
ugcaagcugggcagaagcuuc

SEQ ID NO: 372698 - RNA, 21 nt, Human
ugcaagcugggcagaagcuuc

SEQ ID NO: 372699 - RNA, 21 nt, Human
ugcaagcugggcagaagcuuc

SEQ ID NO: 372700 - RNA, 21 nt, Human
ugcaagcugggcagaagcuuc

SEQ ID NO: 372701 - RNA, 19 nt, Human
ugcaggggaaaaagugacu

SEQ ID NO: 372702 - RNA, 19 nt, Human
ugccuucugaguuccacuu

SEQ ID NO: 372703 - RNA, 19 nt, Human
ugccuucugaguuccacuu

SEQ ID NO: 372704 - RNA, 19 nt, Human
ugccuucugaguuccacuu

SEQ ID NO: 372705 - RNA, 19 nt, Human
ugccuucugaguuccacuu

SEQ ID NO: 372706 - RNA, 18 nt, Human
ugcugcugcugagaacgc

SEQ ID NO: 372707 - RNA, 18 nt, Human
ugcugcugcugagaacgc

SEQ ID NO: 372708 - RNA, 21 nt, Human
uggaagaguauguucagggaa

SEQ ID NO: 372709 - RNA, 21 nt, Human
uggaagaguauguucagggaa

SEQ ID NO: 372710 - RNA, 24 nt, Human
ugguggaagaguauguucagggaa

SEQ ID NO: 372711 - RNA, 24 nt, Human
ugguggaagaguauguucagggaa

SEQ ID NO: 372712 - RNA, 19 nt, Human
uguagagaaaagccuuucu

SEQ ID NO: 372713 - RNA, 23 nt, Human
uguuaggaugcucucacccugug

SEQ ID NO: 372714 - RNA, 19 nt, Human
uuaaaacuugaugcuucug

SEQ ID NO: 372715 - RNA, 19 nt, Human
uuaaaacuugaugcuucug

SEQ ID NO: 372716 - RNA, 19 nt, Human
uuaaaacuugaugcuucug

SEQ ID NO: 372717 - RNA, 20 nt, Human
uucaaagaguagauggagcc

SEQ ID NO: 372718 - RNA, 20 nt, Human
uucaaagaguagauggagcc

SEQ ID NO: 372719 - RNA, 20 nt, Human
uucaaagaguagauggagcc

SEQ ID NO: 372720 - RNA, 20 nt, Human
uucaaagaguagauggagcc

SEQ ID NO: 372721 - RNA, 20 nt, Human
aaaauacccauaauucacuc

SEQ ID NO: 372722 - RNA, 18 nt, Human
aaucacaauaagaaaagg

SEQ ID NO: 372723 - RNA, 21 nt, Human
agacagcagaccuugguguga

SEQ ID NO: 372724 - RNA, 20 nt, Human
aggaaauaaaucacaauaag

SEQ ID NO: 372725 - RNA, 18 nt, Human
aggcaaaaacaaggguca

SEQ ID NO: 372726 - RNA, 19 nt, Human
aggcaaaaacaagggucag

SEQ ID NO: 372727 - RNA, 20 nt, Human
aggcaaaaacaagggucagg

SEQ ID NO: 372728 - RNA, 18 nt, Human
auacaagcacaggcaaaa

SEQ ID NO: 372729 - RNA, 22 nt, Human
auggggauaauuaguuaacucc

SEQ ID NO: 372730 - RNA, 20 nt, Human
caagcacaggcaaaaacaag

SEQ ID NO: 372731 - RNA, 24 nt, Human
cacgcuacaucuggugcgacaggg

SEQ ID NO: 372732 - RNA, 19 nt, Human
cauucuacaccauugaaag

SEQ ID NO: 372733 - RNA, 20 nt, Human
cgacucuugagagcuaaagc

SEQ ID NO: 372734 - RNA, 23 nt, Human
cuaaagcugacuguagcacgcua

SEQ ID NO: 372735 - RNA, 21 nt, Human
cucugguggcauugcagcccu

SEQ ID NO: 372736 - RNA, 22 nt, Human
cugaaaaaauacccauaauuca

SEQ ID NO: 372737 - RNA, 19 nt, Human
cugguggcauugcagcccu

SEQ ID NO: 372738 - RNA, 19 nt, Human
cugguggcauugcagcccu

SEQ ID NO: 372739 - RNA, 18 nt, Human
gaaaaguggggaagggug

SEQ ID NO: 372740 - RNA, 20 nt, Human
gccucggugcccucacucgg

SEQ ID NO: 372741 - RNA, 21 nt, Human
ggaaaaggggggaaaaguggg

SEQ ID NO: 372742 - RNA, 22 nt, Human
gggaaaaguggggaaggguggc

SEQ ID NO: 372743 - RNA, 25 nt, Human
gggaaaaguggggaaggguggccgg

SEQ ID NO: 372744 - RNA, 18 nt, Human
ggggauagggggcuagga

SEQ ID NO: 372745 - RNA, 19 nt, Human
ggggggaaaaguggggaag

SEQ ID NO: 372746 - RNA, 25 nt, Human
uaaguugccacugaaaaccaugaaa

SEQ ID NO: 372747 - RNA, 20 nt, Human
uaccuggugaacaaguugcc

SEQ ID NO: 372748 - RNA, 19 nt, Human
uagggggcuaggaggagua

SEQ ID NO: 372749 - RNA, 24 nt, Human
uauccagaauuaaaugaggcugcu

SEQ ID NO: 372750 - RNA, 20 nt, Human
ucagaucaguaucugaugcu

SEQ ID NO: 372751 - RNA, 18 nt, Human
uccagaauuaaaugaggc

SEQ ID NO: 372752 - RNA, 20 nt, Human
ucccagaauuaaucauccuu

SEQ ID NO: 372753 - RNA, 24 nt, Human
uccuugguugucauuauuucaaag

SEQ ID NO: 372754 - RNA, 18 nt, Human
ucucaaaggcaagucacc

SEQ ID NO: 372755 - RNA, 22 nt, Human
ucucugguggcauugcagcccu

SEQ ID NO: 372756 - RNA, 26 nt, Human
ugauuggaaaaggggggaaaagucgu

SEQ ID NO: 372757 - RNA, 23 nt, Human
ugcauacaacucuuuagcaaagc

SEQ ID NO: 372758 - RNA, 24 nt, Human
ugcauacaagcacaggcaaaaaca

SEQ ID NO: 372759 - RNA, 19 nt, Human
ugcaugcauacaagcacag

SEQ ID NO: 372760 - RNA, 18 nt, Human
uggaaucauucuacacca

SEQ ID NO: 372761 - RNA, 22 nt, Human
uggcagcugcacucaggcuggu

SEQ ID NO: 372762 - RNA, 21 nt, Human
uggugucugacaucacguucu

SEQ ID NO: 372763 - RNA, 18 nt, Human
uguguauaucagaugaca

SEQ ID NO: 372764 - RNA, 25 nt, Human
uuaagaucugcacaugcuguucuaa

SEQ ID NO: 372765 - RNA, 22 nt, Human
uuaauuccugcucaguauaugc

SEQ ID NO: 372766 - RNA, 21 nt, Human
uucauacuuaaauaaaaggug

SEQ ID NO: 372767 - RNA, 18 nt, Human
uucccgucaccucaccuc

SEQ ID NO: 372768 - RNA, 24 nt, Human
uuuaaaaaguaacagcugcuucau

SEQ ID NO: 372769 - RNA, 22 nt, Human
uuucucaaaggcaagucacccc

SEQ ID NO: 372770 - RNA, 24 nt, Human
agauggugaacccauuuucauagu

SEQ ID NO: 372771 - RNA, 21 nt, Human
auccaagggagggggaucgac

SEQ ID NO: 372772 - RNA, 20 nt, Human
caccaaaauccaaguauaga

SEQ ID NO: 372773 - RNA, 22 nt, Human
cacccugaagagaugcaucuca

SEQ ID NO: 372774 - RNA, 19 nt, Human
cagcagcauggcaacccug

SEQ ID NO: 372775 - RNA, 22 nt, Human
cagcucagcagcagcauggcaa

SEQ ID NO: 372776 - RNA, 22 nt, Human
cauccggagccagaaugaacca

SEQ ID NO: 372777 - RNA, 18 nt, Human
ccaaccugguggcaacaa

SEQ ID NO: 372778 - RNA, 24 nt, Human
ccagaaugaaccaaccugguggca

SEQ ID NO: 372779 - RNA, 23 nt, Human
cccucgggaccaccaaaauccaa

SEQ ID NO: 372780 - RNA, 22 nt, Human
cccugaacaaguauccuggucc

SEQ ID NO: 372781 - RNA, 20 nt, Human
cgcccaggcaucucuugucc

SEQ ID NO: 372782 - RNA, 18 nt, Human
cucauacaagcaguccca

SEQ ID NO: 372783 - RNA, 22 nt, Human
cucgggaccaccaaaauccaag

SEQ ID NO: 372784 - RNA, 26 nt, Human
cugguggcaacaaguggguagcugug

SEQ ID NO: 372785 - RNA, 24 nt, Human
cuugugacagucaaggcucuuuuc

SEQ ID NO: 372786 - RNA, 19 nt, Human
ggacaagagugcaggucca

SEQ ID NO: 372787 - RNA, 18 nt, Human
uacaauaugcugcuggag

SEQ ID NO: 372788 - RNA, 18 nt, Human
uagcaaauguaaggucag

SEQ ID NO: 372789 - RNA, 24 nt, Human
uagcgguacaauaugcugcuggag

SEQ ID NO: 372790 - RNA, 23 nt, Human
uaguaagccucaccucuuggcca

SEQ ID NO: 372791 - RNA, 23 nt, Human
ucccucgggaccaccaaaaucca

SEQ ID NO: 372792 - RNA, 18 nt, Human
uccggagccagaaugaac

SEQ ID NO: 372793 - RNA, 18 nt, Human
uccugguccaggaugaca

SEQ ID NO: 372794 - RNA, 19 nt, Human
ugaacaaguauccuggucc

SEQ ID NO: 372795 - RNA, 22 nt, Human
ugagauggugaacccauuuuca

SEQ ID NO: 372796 - RNA, 18 nt, Human
ugaucagcucagcagcag

SEQ ID NO: 372797 - RNA, 26 nt, Human
uucccuugagauggugaacccauuuu

SEQ ID NO: 372798 - RNA, 21 nt, Human
uuccuugaucagcucagcagc

SEQ ID NO: 372799 - RNA, 22 nt, Human
aaaaggcagcgucacacaggug

SEQ ID NO: 372800 - RNA, 22 nt, Human
agggaggaagggguuaagucca

SEQ ID NO: 372801 - RNA, 24 nt, Human
cagccuaggcaggaugcaucacua

SEQ ID NO: 372802 - RNA, 26 nt, Human
cagccuaggcaggaugcaucacuagg

SEQ ID NO: 372803 - RNA, 20 nt, Human
caguuccuaaaccacauccu

SEQ ID NO: 372804 - RNA, 22 nt, Human
cccauaauuccaccaccuauug

SEQ ID NO: 372805 - RNA, 21 nt, Human
gcuuaaagcaggaaacuauuc

SEQ ID NO: 372806 - RNA, 18 nt, Human
gggacaguuggucguggg

SEQ ID NO: 372807 - RNA, 18 nt, Human
guaggucuuuugcuuaaa

SEQ ID NO: 372808 - RNA, 24 nt, Human
gucguggggacagggaggaagggg

SEQ ID NO: 372809 - RNA, 20 nt, Human
uaaguccagccuaggcagga

SEQ ID NO: 372810 - RNA, 20 nt, Human
uagguaagaaaauauauaug

SEQ ID NO: 372811 - RNA, 26 nt, Human
ucacacaggugggcucugggguccuu

SEQ ID NO: 372812 - RNA, 18 nt, Human
ucacuagggguccaucaa

SEQ ID NO: 372813 - RNA, 24 nt, Human
ucacuagggguccaucaagguggg

SEQ ID NO: 372814 - RNA, 26 nt, Human
uccaccccaucccauaauuccaccac

SEQ ID NO: 372815 - RNA, 19 nt, Human
ugggcucugggguccuugg

SEQ ID NO: 372816 - RNA, 24 nt, Human
aacugcuccuucagucuucucccg

SEQ ID NO: 372817 - RNA, 18 nt, Human
aaucauuuaagacacaga

SEQ ID NO: 372818 - RNA, 30 nt, Human
acacaacaguauuugaguuaagccccagaa

SEQ ID NO: 372819 - RNA, 19 nt, Human
acucggcuucgcuggccuc

SEQ ID NO: 372820 - RNA, 23 nt, Human
acucggcuucgcuggccuccccu

SEQ ID NO: 372821 - RNA, 23 nt, Human
auaccauuaguccuggacaaaau

SEQ ID NO: 372822 - RNA, 19 nt, Human
caccccggggaagugaggu

SEQ ID NO: 372823 - RNA, 21 nt, Human
cagaagaucuguccauaccau

SEQ ID NO: 372824 - RNA, 21 nt, Human
cauucuugcuugagauggggg

SEQ ID NO: 372825 - RNA, 23 nt, Human
ccaacggcggcaacugcuccuuc

SEQ ID NO: 372826 - RNA, 27 nt, Human
ccaacggcggcaacugcuccuucaguc

SEQ ID NO: 372827 - RNA, 22 nt, Human
ccccagaagaucuguccauacc

SEQ ID NO: 372828 - RNA, 20 nt, Human
ccgggcggcgguuuuacucg

SEQ ID NO: 372829 - RNA, 20 nt, Human
ccuagccucgccucauggcc

SEQ ID NO: 372830 - RNA, 19 nt, Human
ccuggacaaaaugaacacc

SEQ ID NO: 372831 - RNA, 21 nt, Human
cgccaacggcggcaacugcuc

SEQ ID NO: 372832 - RNA, 21 nt, Human
cggcccggucgcucgcgacgg

SEQ ID NO: 372833 - RNA, 20 nt, Human
cggcuucgcuggccuccccu

SEQ ID NO: 372834 - RNA, 20 nt, Human
cgggccgccgccaacggcgg

SEQ ID NO: 372835 - RNA, 19 nt, Human
cucccgggcggcgguuuua

SEQ ID NO: 372836 - RNA, 18 nt, Human
cucggcccggucgcucgc

SEQ ID NO: 372837 - RNA, 19 nt, Human
cucggcccggucgcucgcg

SEQ ID NO: 372838 - RNA, 23 nt, Human
cucggcccggucgcucgcgacgg

SEQ ID NO: 372839 - RNA, 28 nt, Human
gaagaaaccaacgccauucuugcuugag

SEQ ID NO: 372840 - RNA, 18 nt, Human
gacacuaaaagacuggug

SEQ ID NO: 372841 - RNA, 24 nt, Human
ggugcagacacaacaguauuugag

SEQ ID NO: 372842 - RNA, 18 nt, Human
uagcagcagcgaaaacug

SEQ ID NO: 372843 - RNA, 26 nt, Human
uccauaccauuaguccuggacaaaau

SEQ ID NO: 372844 - RNA, 26 nt, Human
ucccgggcggcgguuuuacucggcuu

SEQ ID NO: 372845 - RNA, 19 nt, Human
ugaaauggaagaaaccaac

SEQ ID NO: 372846 - RNA, 23 nt, Human
ugagaagaaccacagacuuaugg

SEQ ID NO: 372847 - RNA, 18 nt, Human
ugcuugagaugggggcag

SEQ ID NO: 372848 - RNA, 21 nt, Human
uggaagaaaccaacgccauuc

SEQ ID NO: 372849 - RNA, 24 nt, Human
uggaagaaaccaacgccauucuug

SEQ ID NO: 372850 - RNA, 26 nt, Human
uggcaacagccguagcagcagcgaaa

SEQ ID NO: 372851 - RNA, 23 nt, Human
uguaauucagguauaagguuauu

SEQ ID NO: 372852 - RNA, 19 nt, Human
uucuugcuugagauggggg

SEQ ID NO: 372853 - RNA, 23 nt, Human
uugagaugggggcaguuuucucu

SEQ ID NO: 372854 - RNA, 20 nt, Human
uuuacucggcuucgcuggcc

SEQ ID NO: 372855 - RNA, 18 nt, Human
uuuuuuuuuuuuuuuuug

SEQ ID NO: 372856 - RNA, 23 nt, Human
uuuuuuuuuuuuuuuuugauugg

SEQ ID NO: 372857 - RNA, 23 nt, Human
aaaaaaaccccaaaaagacaggc

SEQ ID NO: 372858 - RNA, 21 nt, Human
aaaaaaccccaaaaagacagg

SEQ ID NO: 372859 - RNA, 19 nt, Human
aaaaaccccaaaaagacag

SEQ ID NO: 372860 - RNA, 21 nt, Human
aaaaagacaggcagggucaga

SEQ ID NO: 372861 - RNA, 25 nt, Human
aaaaagacaggcagggucagaagug

SEQ ID NO: 372862 - RNA, 27 nt, Human
aaaaaguaaaaaccacucucacagccc

SEQ ID NO: 372863 - RNA, 22 nt, Human
aaaaccacucucacagcccuua

SEQ ID NO: 372864 - RNA, 21 nt, Human
aaaagacaggcagggucagaa

SEQ ID NO: 372865 - RNA, 18 nt, Human
aacaugguguaaccccgu

SEQ ID NO: 372866 - RNA, 19 nt, Human
aacaugguguaaccccguc

SEQ ID NO: 372867 - RNA, 20 nt, Human
aacaugguguaaccccgucc

SEQ ID NO: 372868 - RNA, 21 nt, Human
aaccccaaaaagacaggcagg

SEQ ID NO: 372869 - RNA, 19 nt, Human
aacucaaaaaaaccccaaa

SEQ ID NO: 372870 - RNA, 24 nt, Human
aacugcuugaaccugggaggugga

SEQ ID NO: 372871 - RNA, 20 nt, Human
aagacagacagacaugggcc

SEQ ID NO: 372872 - RNA, 20 nt, Human
acacagcgagacuccaacuc

SEQ ID NO: 372873 - RNA, 24 nt, Human
acacagcgagacuccaacucaaaa

SEQ ID NO: 372874 - RNA, 20 nt, Human
acacaucaagacagacagac

SEQ ID NO: 372875 - RNA, 20 nt, Human
acagacagacaugggccggg

SEQ ID NO: 372876 - RNA, 23 nt, Human
accacagcugcugcucacacauc

SEQ ID NO: 372877 - RNA, 22 nt, Human
accacugcacuccagucugggc

SEQ ID NO: 372878 - RNA, 24 nt, Human
accccgucccuacugaaaauacaa

SEQ ID NO: 372879 - RNA, 22 nt, Human
acucaaaaaaaccccaaaaaga

SEQ ID NO: 372880 - RNA, 24 nt, Human
acucaaaaaaaccccaaaaagaca

SEQ ID NO: 372881 - RNA, 18 nt, Human
acugcacuccagucuggg

SEQ ID NO: 372882 - RNA, 23 nt, Human
acugcacuccagucugggcgaca

SEQ ID NO: 372883 - RNA, 24 nt, Human
acuugaggucaggaguucgagacc

SEQ ID NO: 372884 - RNA, 21 nt, Human
agacagacagacaugggccgg

SEQ ID NO: 372885 - RNA, 22 nt, Human
agacaggagaacugcuugaacc

SEQ ID NO: 372886 - RNA, 24 nt, Human
agacaggagaacugcuugaaccug

SEQ ID NO: 372887 - RNA, 21 nt, Human
agacugaggcggguggaucac

SEQ ID NO: 372888 - RNA, 24 nt, Human
agcacuuugggagacugaggcggg

SEQ ID NO: 372889 - RNA, 24 nt, Human
agccuggccaacaugguguaaccc

SEQ ID NO: 372890 - RNA, 23 nt, Human
agcugggcgugguggcaugugcc

SEQ ID NO: 372891 - RNA, 23 nt, Human
aggcggguggaucacuugagguc

SEQ ID NO: 372892 - RNA, 26 nt, Human
aggcggguggaucacuugaggucagg

SEQ ID NO: 372893 - RNA, 24 nt, Human
aggcugagacaggagaacugcuug

SEQ ID NO: 372894 - RNA, 18 nt, Human
agggccaggcccugggga

SEQ ID NO: 372895 - RNA, 21 nt, Human
agguggagguugcagugagcc

SEQ ID NO: 372896 - RNA, 22 nt, Human
agguggagguugcagugagccg

SEQ ID NO: 372897 - RNA, 24 nt, Human
agucugggcgacacagcgagacuc

SEQ ID NO: 372898 - RNA, 24 nt, Human
agugacucaugccuguaaucucag

SEQ ID NO: 372899 - RNA, 21 nt, Human
aucacuugaggucaggaguuc

SEQ ID NO: 372900 - RNA, 24 nt, Human
aucccaccacugcacuccagucug

SEQ ID NO: 372901 - RNA, 19 nt, Human
augccuguaaucucagcac

SEQ ID NO: 372902 - RNA, 20 nt, Human
caaaaaaaccccaaaaagac

SEQ ID NO: 372903 - RNA, 23 nt, Human
caacucaaaaaaaccccaaaaag

SEQ ID NO: 372904 - RNA, 22 nt, Human
caagacagacagacaugggccg

SEQ ID NO: 372905 - RNA, 21 nt, Human
cacaucaagacagacagacau

SEQ ID NO: 372906 - RNA, 24 nt, Human
caccuccucgccguccccaccccu

SEQ ID NO: 372907 - RNA, 19 nt, Human
cacugcacuccagucuggg

SEQ ID NO: 372908 - RNA, 21 nt, Human
cacugcacuccagucugggcg

SEQ ID NO: 372909 - RNA, 22 nt, Human
cacugcacuccagucugggcga

SEQ ID NO: 372910 - RNA, 23 nt, Human
cacugcacuccagucugggcgac

SEQ ID NO: 372911 - RNA, 24 nt, Human
cacugcacuccagucugggcgaca

SEQ ID NO: 372912 - RNA, 23 nt, Human
cacuugaggucaggaguucgaga

SEQ ID NO: 372913 - RNA, 22 nt, Human
cagcacuuugggagacugaggc

SEQ ID NO: 372914 - RNA, 24 nt, Human
cagcacuuugggagacugaggcgg

SEQ ID NO: 372915 - RNA, 24 nt, Human
cagcgagacuccaacucaaaaaaa

SEQ ID NO: 372916 - RNA, 31 nt, Human
cagcgagacuccaacucaaaaaaaccccaaa

SEQ ID NO: 372917 - RNA, 24 nt, Human
caggagcgagagucccagggaaug

SEQ ID NO: 372918 - RNA, 24 nt, Human
caugccuguaaucucagcacuuug

SEQ ID NO: 372919 - RNA, 20 nt, Human
ccacugcacuccagucuggg

SEQ ID NO: 372920 - RNA, 20 nt, Human
ccacugcacuccagucuggg

SEQ ID NO: 372921 - RNA, 21 nt, Human
ccacugcacuccagucugggc

SEQ ID NO: 372922 - RNA, 21 nt, Human
ccacugcacuccagucugggc

SEQ ID NO: 372923 - RNA, 23 nt, Human
ccacugcacuccagucugggcga

SEQ ID NO: 372924 - RNA, 24 nt, Human
ccacugcacuccagucugggcgac

SEQ ID NO: 372925 - RNA, 23 nt, Human
ccagccuccgcccgccgccgccu

SEQ ID NO: 372926 - RNA, 18 nt, Human
ccccaccccuccggccca

SEQ ID NO: 372927 - RNA, 18 nt, Human
ccgccucgccaggccugc

SEQ ID NO: 372928 - RNA, 21 nt, Human
ccucgccguccccaccccucc

SEQ ID NO: 372929 - RNA, 22 nt, Human
ccucgccguccccaccccuccg

SEQ ID NO: 372930 - RNA, 18 nt, Human
ccugcaaucucagcuacu

SEQ ID NO: 372931 - RNA, 21 nt, Human
ccugcaaucucagcuacuggg

SEQ ID NO: 372932 - RNA, 22 nt, Human
ccugcaaucucagcuacugggg

SEQ ID NO: 372933 - RNA, 18 nt, Human
ccuggccaacauggugua

SEQ ID NO: 372934 - RNA, 23 nt, Human
ccuggccaacaugguguaacccc

SEQ ID NO: 372935 - RNA, 24 nt, Human
ccuggccaacaugguguaaccccg

SEQ ID NO: 372936 - RNA, 21 nt, Human
ccugggagguggagguugcag

SEQ ID NO: 372937 - RNA, 20 nt, Human
ccuguaauuacaagaccagg

SEQ ID NO: 372938 - RNA, 24 nt, Human
cgagaccagccuggccaacauggu

SEQ ID NO: 372939 - RNA, 21 nt, Human
cgagacuccaacucaaaaaaa

SEQ ID NO: 372940 - RNA, 24 nt, Human
cggagcggagcgccggccuccacc

SEQ ID NO: 372941 - RNA, 24 nt, Human
cggguggaucacuugaggucagga

SEQ ID NO: 372942 - RNA, 24 nt, Human
cucaugccuguaaucucagcacuu

SEQ ID NO: 372943 - RNA, 20 nt, Human
cuccgcccgccgccgccucg

SEQ ID NO: 372944 - RNA, 22 nt, Human
cuccggcccagccuccgcccgc

SEQ ID NO: 372945 - RNA, 22 nt, Human
cuccucgccguccccaccccuc

SEQ ID NO: 372946 - RNA, 23 nt, Human
cuccucgccguccccaccccucc

SEQ ID NO: 372947 - RNA, 24 nt, Human
cugcuugaaccugggagguggagg

SEQ ID NO: 372948 - RNA, 23 nt, Human
cugggcgacacagcgagacucca

SEQ ID NO: 372949 - RNA, 19 nt, Human
cuugaaccugggaggugga

SEQ ID NO: 372950 - RNA, 24 nt, Human
gacuccaacucaaaaaaaccccaa

SEQ ID NO: 372951 - RNA, 23 nt, Human
gagacuccaacucaaaaaaaccc

SEQ ID NO: 372952 - RNA, 19 nt, Human
gagguagggccaggccccc

SEQ ID NO: 372953 - RNA, 24 nt, Human
gaucacuugaggucaggaguucga

SEQ ID NO: 372954 - RNA, 22 nt, Human
gccaacaugguguaaccccguc

SEQ ID NO: 372955 - RNA, 22 nt, Human
gccgggcguagugacucaugcc

SEQ ID NO: 372956 - RNA, 19 nt, Human
ggagaaggggcuggcagug

SEQ ID NO: 372957 - RNA, 23 nt, Human
ggagguagggccaggcccugggg

SEQ ID NO: 372958 - RNA, 18 nt, Human
ggagguugcagugagccg

SEQ ID NO: 372959 - RNA, 22 nt, Human
ggaucacuugaggucaggaguu

SEQ ID NO: 372960 - RNA, 22 nt, Human
ggccgggcguagugacucaugg

SEQ ID NO: 372961 - RNA, 24 nt, Human
gggcguagugacucaugccuguaa

SEQ ID NO: 372962 - RNA, 24 nt, Human
gggcgugguggcaugugccugcaa

SEQ ID NO: 372963 - RNA, 22 nt, Human
uagcugggcgugguggcaugug

SEQ ID NO: 372964 - RNA, 24 nt, Human
uagugacucaugccuguaaucuca

SEQ ID NO: 372965 - RNA, 20 nt, Human
ucaaaaaaaccccaaaaaga

SEQ ID NO: 372966 - RNA, 22 nt, Human
ucaaaaaaaccccaaaaagaca

SEQ ID NO: 372967 - RNA, 21 nt, Human
ucacacaucaagacagacaga

SEQ ID NO: 372968 - RNA, 20 nt, Human
ucacuugaggucaggaguuc

SEQ ID NO: 372969 - RNA, 20 nt, Human
ucagaagugugaguccugga

SEQ ID NO: 372970 - RNA, 22 nt, Human
uccaacaaauuuuauuuaugga

SEQ ID NO: 372971 - RNA, 21 nt, Human
uccaccuccucgccgucccca

SEQ ID NO: 372972 - RNA, 22 nt, Human
uccaccuccucgccguccccac

SEQ ID NO: 372973 - RNA, 19 nt, Human
uccuggauuccaagguggc

SEQ ID NO: 372974 - RNA, 21 nt, Human
ucgccguccccaccccuccgg

SEQ ID NO: 372975 - RNA, 22 nt, Human
ugaaaauacaaaauauuagcug

SEQ ID NO: 372976 - RNA, 24 nt, Human
ugaaccugggagguggagguugca

SEQ ID NO: 372977 - RNA, 21 nt, Human
ugacucaugccuguaaucuca

SEQ ID NO: 372978 - RNA, 22 nt, Human
ugacucaugccuguaaucucag

SEQ ID NO: 372979 - RNA, 24 nt, Human
ugacucaugccuguaaucucagca

SEQ ID NO: 372980 - RNA, 24 nt, Human
ugagacaggagaacugcuugaacc

SEQ ID NO: 372981 - RNA, 22 nt, Human
ugaggcggguggaucacuugag

SEQ ID NO: 372982 - RNA, 24 nt, Human
ugaggcggguggaucacuugaggu

SEQ ID NO: 372983 - RNA, 26 nt, Human
ugaggcggguggaucacuugagguca

SEQ ID NO: 372984 - RNA, 19 nt, Human
ugaguccuggauuccaagg

SEQ ID NO: 372985 - RNA, 22 nt, Human
ugcagugagccgcgaucccacc

SEQ ID NO: 372986 - RNA, 23 nt, Human
ugccuguaaucucagcacuuugg

SEQ ID NO: 372987 - RNA, 23 nt, Human
ugccuguaaucucagcacuuugg

SEQ ID NO: 372988 - RNA, 24 nt, Human
ugccuguaaucucagcacuuuggg

SEQ ID NO: 372989 - RNA, 26 nt, Human
ugcucacacaucaagacagacagaca

SEQ ID NO: 372990 - RNA, 24 nt, Human
uggaucacuugaggucaggaguuc

SEQ ID NO: 372991 - RNA, 27 nt, Human
uggaucacuugaggucaggaguucgag

SEQ ID NO: 372992 - RNA, 22 nt, Human
uggcaugugccugcaaucucag

SEQ ID NO: 372993 - RNA, 24 nt, Human
uggcaugugccugcaaucucagcu

SEQ ID NO: 372994 - RNA, 21 nt, Human
uggccaacaugguguaacccc

SEQ ID NO: 372995 - RNA, 24 nt, Human
ugggagacugaggcggguggauca

SEQ ID NO: 372996 - RNA, 18 nt, Human
ugggagguggagguugca

SEQ ID NO: 372997 - RNA, 29 nt, Human
ugggagguggagguugcagugacaacggu

SEQ ID NO: 372998 - RNA, 24 nt, Human
ugggagguggagguugcagugagc

SEQ ID NO: 372999 - RNA, 24 nt, Human
ugguggcaugugccugcaaucuca

SEQ ID NO: 373000 - RNA, 20 nt, Human
ugucacauauaaauuucacc

SEQ ID NO: 373001 - RNA, 20 nt, Human
ugugaguccuggauuccaag

SEQ ID NO: 373002 - RNA, 23 nt, Human
ugugccugcaaucucagcuacug

SEQ ID NO: 373003 - RNA, 19 nt, Human
uuagcugggcgugguggca

SEQ ID NO: 373004 - RNA, 20 nt, Human
uuagcugggcgugguggcau

SEQ ID NO: 373005 - RNA, 24 nt, Human
uuagcugggcgugguggcaugugc

SEQ ID NO: 373006 - RNA, 24 nt, Human
uugaaccugggagguggagguugc

SEQ ID NO: 373007 - RNA, 22 nt, Human
uugcagugagccgcgaucccac

SEQ ID NO: 373008 - RNA, 25 nt, Human
uugggagacugaggcggguggauca

SEQ ID NO: 373009 - RNA, 18 nt, Human
uugguccaguuaccuaca

SEQ ID NO: 373010 - RNA, 18 nt, Human
uuucucauucuuggucca

SEQ ID NO: 373011 - RNA, 24 nt, Human
aggucuucuuaacggcaacaaucu

SEQ ID NO: 373012 - RNA, 19 nt, Human
caaagagggucaggacaug

SEQ ID NO: 373013 - RNA, 20 nt, Human
cacccgaacgacugcgcgag

SEQ ID NO: 373014 - RNA, 21 nt, Human
ccacaguccacuuaauucaaa

SEQ ID NO: 373015 - RNA, 20 nt, Human
ccacauguaauucauaaaau

SEQ ID NO: 373016 - RNA, 24 nt, Human
gagugugugugugugugugugugg

SEQ ID NO: 373017 - RNA, 20 nt, Human
gugugugugugugugugugu

SEQ ID NO: 373018 - RNA, 21 nt, Human
gugugugugugugugugugug

SEQ ID NO: 373019 - RNA, 21 nt, Human
gugugugugugugugugugug

SEQ ID NO: 373020 - RNA, 19 nt, Human
uaacuggaacaacauccaa

SEQ ID NO: 373021 - RNA, 19 nt, Human
ugucaugccacaguccacu

SEQ ID NO: 373022 - RNA, 19 nt, Human
uguguauauaaaaccacau

SEQ ID NO: 373023 - RNA, 22 nt, Human
uguguauauaaaaccacaugua

SEQ ID NO: 373024 - RNA, 25 nt, Human
uguguguauauaaaaccacauguaa

SEQ ID NO: 373025 - RNA, 23 nt, Human
uguguguguauauaaaaccacau

SEQ ID NO: 373026 - RNA, 23 nt, Human
uguguguguauauaaaaccacau

SEQ ID NO: 373027 - RNA, 28 nt, Human
uguguguguauauaaaaccacauguaau

SEQ ID NO: 373028 - RNA, 25 nt, Human
uguguguguguauauaaaaccacau

SEQ ID NO: 373029 - RNA, 18 nt, Human
uguguguguguguguaua

SEQ ID NO: 373030 - RNA, 20 nt, Human
uguguguguguguguauaua

SEQ ID NO: 373031 - RNA, 18 nt, Human
ugugugugugugugugug

SEQ ID NO: 373032 - RNA, 18 nt, Human
ugugugugugugugugug

SEQ ID NO: 373033 - RNA, 18 nt, Human
ugugugugugugugugug

SEQ ID NO: 373034 - RNA, 18 nt, Human
ugugugugugugugugug

SEQ ID NO: 373035 - RNA, 18 nt, Human
ugugugugugugugugug

SEQ ID NO: 373036 - RNA, 18 nt, Human
ugugugugugugugugug

SEQ ID NO: 373037 - RNA, 18 nt, Human
ugugugugugugugugug

SEQ ID NO: 373038 - RNA, 18 nt, Human
ugugugugugugugugug

SEQ ID NO: 373039 - RNA, 18 nt, Human
ugugugugugugugugug

SEQ ID NO: 373040 - RNA, 24 nt, Human
uguguguguguguguguguauaua

SEQ ID NO: 373041 - RNA, 21 nt, Human
ugugugugugugugugugugu

SEQ ID NO: 373042 - RNA, 21 nt, Human
ugugugugugugugugugugu

SEQ ID NO: 373043 - RNA, 21 nt, Human
ugugugugugugugugugugu

SEQ ID NO: 373044 - RNA, 21 nt, Human
ugugugugugugugugugugu

SEQ ID NO: 373045 - RNA, 21 nt, Human
ugugugugugugugugugugu

SEQ ID NO: 373046 - RNA, 21 nt, Human
ugugugugugugugugugugu

SEQ ID NO: 373047 - RNA, 21 nt, Human
ugugugugugugugugugugu

SEQ ID NO: 373048 - RNA, 21 nt, Human
ugugugugugugugugugugu

SEQ ID NO: 373049 - RNA, 21 nt, Human
ugugugugugugugugugugu

SEQ ID NO: 373050 - RNA, 21 nt, Human
ugugugugugugugugugugu

SEQ ID NO: 373051 - RNA, 21 nt, Human
ugugugugugugugugugugu

SEQ ID NO: 373052 - RNA, 21 nt, Human
ugugugugugugugugugugu

SEQ ID NO: 373053 - RNA, 21 nt, Human
ugugugugugugugugugugu

SEQ ID NO: 373054 - RNA, 21 nt, Human
ugugugugugugugugugugu

SEQ ID NO: 373055 - RNA, 21 nt, Human
ugugugugugugugugugugu

SEQ ID NO: 373056 - RNA, 22 nt, Human
ugugugugugugugugugugua

SEQ ID NO: 373057 - RNA, 22 nt, Human
ugugugugugugugugugugug

SEQ ID NO: 373058 - RNA, 22 nt, Human
ugugugugugugugugugugug

SEQ ID NO: 373059 - RNA, 22 nt, Human
ugugugugugugugugugugug

SEQ ID NO: 373060 - RNA, 22 nt, Human
ugugugugugugugugugugug

SEQ ID NO: 373061 - RNA, 22 nt, Human
ugugugugugugugugugugug

SEQ ID NO: 373062 - RNA, 21 nt, Human
uucaaagagggucaggacaug

SEQ ID NO: 373063 - RNA, 19 nt, Human
aaacaagacgcaaaaacug

SEQ ID NO: 373064 - RNA, 24 nt, Human
aaacaagacgcaaaaacugugcaa

SEQ ID NO: 373065 - RNA, 19 nt, Human
aaagagcuauuuauauaga

SEQ ID NO: 373066 - RNA, 21 nt, Human
acaagacgcaaaaacugugca

SEQ ID NO: 373067 - RNA, 22 nt, Human
acaagacgcaaaaacugugcaa

SEQ ID NO: 373068 - RNA, 26 nt, Human
agaagcaaacaagacgcaaaaaccag

SEQ ID NO: 373069 - RNA, 25 nt, Human
augcauuuuaauuuuuauuugaaaa

SEQ ID NO: 373070 - RNA, 19 nt, Human
caagaaagagcuauuuaua

SEQ ID NO: 373071 - RNA, 21 nt, Human
caagaagcaaacaagacgcaa

SEQ ID NO: 373072 - RNA, 21 nt, Human
caagacgcaaaaacugugcaa

SEQ ID NO: 373073 - RNA, 22 nt, Human
cagcaugcuaaaaguuagaacu

SEQ ID NO: 373074 - RNA, 22 nt, Human
ccaaaacaaaacaaaacugagc

SEQ ID NO: 373075 - RNA, 25 nt, Human
ccaaaacaaaacaaaacugagcaua

SEQ ID NO: 373076 - RNA, 20 nt, Human
ccgccgcgggcucccuccuc

SEQ ID NO: 373077 - RNA, 18 nt, Human
uaaaacagcaagaaagag

SEQ ID NO: 373078 - RNA, 24 nt, Human
uaagaccaagccaguaacuuuagu

SEQ ID NO: 373079 - RNA, 18 nt, Human
uauuacaagccuggagga

SEQ ID NO: 373080 - RNA, 21 nt, Human
ucaacugccaaaacaaaacaa

SEQ ID NO: 373081 - RNA, 22 nt, Human
ucaacugccaaaacaaaacaaa

SEQ ID NO: 373082 - RNA, 24 nt, Human
uccuacacauaaauggggucaagu

SEQ ID NO: 373083 - RNA, 24 nt, Human
ucgcuguagcugcugccgccgccg

SEQ ID NO: 373084 - RNA, 21 nt, Human
ugaaggguauuacaagccugg

SEQ ID NO: 373085 - RNA, 20 nt, Human
ugagggauuuuuacuaaagc

SEQ ID NO: 373086 - RNA, 22 nt, Human
ugccaaaacaaaacaaaacuga

SEQ ID NO: 373087 - RNA, 22 nt, Human
ugcugccgccgccgcgggcucc

SEQ ID NO: 373088 - RNA, 22 nt, Human
uuaaaacagcaagaaagagcua

SEQ ID NO: 373089 - RNA, 24 nt, Human
uugcuuuuguuuuuauacagaaua

SEQ ID NO: 373090 - RNA, 21 nt, Human
uuugcauaucagaaaugcauu

SEQ ID NO: 373091 - RNA, 19 nt, Human
uuuuuuuuuuuuuuuugca

SEQ ID NO: 373092 - RNA, 18 nt, Human
uuuuuuuuuuuuuuuuug

SEQ ID NO: 373093 - RNA, 19 nt, Human
uuuuuuuuuuuuuuuuugc

SEQ ID NO: 373094 - RNA, 23 nt, Human
accacaauuaaguuaaagaaagg

SEQ ID NO: 373095 - RNA, 20 nt, Human
acuagguagugacuuaaauu

SEQ ID NO: 373096 - RNA, 24 nt, Human
caauuaaguuaaagaaaggcugaa

SEQ ID NO: 373097 - RNA, 25 nt, Human
cuagguagugacuuaaauuucuuuu

SEQ ID NO: 373098 - RNA, 22 nt, Human
guauauguuuauguauacuagg

SEQ ID NO: 373099 - RNA, 19 nt, Human
uaaguuaaagaaaggcuga

SEQ ID NO: 373100 - RNA, 23 nt, Human
ugacuuaaauuucuuuuauuuac

SEQ ID NO: 373101 - RNA, 21 nt, Human
uugaagagaaauucaauucac

SEQ ID NO: 373102 - RNA, 18 nt, Human
aaaaaaacaaacacccaa

SEQ ID NO: 373103 - RNA, 28 nt, Human
aaaaaaacaaacacccaaagacauacaa

SEQ ID NO: 373104 - RNA, 21 nt, Human
aaaaaaaggaggugcaaagag

SEQ ID NO: 373105 - RNA, 22 nt, Human
aaaacaaacacccaaagacaua

SEQ ID NO: 373106 - RNA, 23 nt, Human
aaacaaaaacacaaaccccaccu

SEQ ID NO: 373107 - RNA, 24 nt, Human
aaacaaaaacacaaaccccaccuu

SEQ ID NO: 373108 - RNA, 23 nt, Human
acaaacacccaaagacauacaac

SEQ ID NO: 373109 - RNA, 20 nt, Human
acaaaccccaccuucaguga

SEQ ID NO: 373110 - RNA, 18 nt, Human
acaccgcccucacccccc

SEQ ID NO: 373111 - RNA, 22 nt, Human
acagggcaaaacaaaaacacaa

SEQ ID NO: 373112 - RNA, 21 nt, Human
accgaccucaaguagcugaau

SEQ ID NO: 373113 - RNA, 22 nt, Human
accuguagauauuucucucccc

SEQ ID NO: 373114 - RNA, 20 nt, Human
agggcaaaacaaaaacacaa

SEQ ID NO: 373115 - RNA, 23 nt, Human
auacaacacaccgcccucacccc

SEQ ID NO: 373116 - RNA, 24 nt, Human
auaguacaaacaccagaugacuac

SEQ ID NO: 373117 - RNA, 19 nt, Human
caaaaacacaaaccccacc

SEQ ID NO: 373118 - RNA, 18 nt, Human
caaaacaaaaacacaaac

SEQ ID NO: 373119 - RNA, 24 nt, Human
caaaacaaaaacacaaaccccacc

SEQ ID NO: 373120 - RNA, 22 nt, Human
caacacaccgcccucacccccc

SEQ ID NO: 373121 - RNA, 19 nt, Human
caaguagcaagcaauaaua

SEQ ID NO: 373122 - RNA, 22 nt, Human
cacccaaagacauacaacacac

SEQ ID NO: 373123 - RNA, 20 nt, Human
caucuuauaaagcagaccac

SEQ ID NO: 373124 - RNA, 21 nt, Human
ccagaugacuaccaguggagu

SEQ ID NO: 373125 - RNA, 18 nt, Human
cccaaagacauacaacac

SEQ ID NO: 373126 - RNA, 23 nt, Human
ccccagcggccauuagggagggg

SEQ ID NO: 373127 - RNA, 20 nt, Human
ccgccgccgccgccgccugg

SEQ ID NO: 373128 - RNA, 19 nt, Human
ccgccgccgccgccugggc

SEQ ID NO: 373129 - RNA, 18 nt, Human
ccgccgccgccugggcgc

SEQ ID NO: 373130 - RNA, 20 nt, Human
gaccacauuauuuguuucca

SEQ ID NO: 373131 - RNA, 22 nt, Human
gcaaaacaaaaacacaaacccc

SEQ ID NO: 373132 - RNA, 22 nt, Human
gcccucaccccccagcggccau

SEQ ID NO: 373133 - RNA, 20 nt, Human
gcgggacucgagcaggggcc

SEQ ID NO: 373134 - RNA, 22 nt, Human
ggcaaaacaaaaacacaaaccc

SEQ ID NO: 373135 - RNA, 22 nt, Human
gugcgaggaaagaagaagcugg

SEQ ID NO: 373136 - RNA, 19 nt, Human
uaaaaaaacaaacacccaa

SEQ ID NO: 373137 - RNA, 19 nt, Human
uaaaaaaacaaacacccaa

SEQ ID NO: 373138 - RNA, 20 nt, Human
uaaaaaaacaaacacccaaa

SEQ ID NO: 373139 - RNA, 21 nt, Human
uaaaaaaacaaacacccaaag

SEQ ID NO: 373140 - RNA, 23 nt, Human
uaaaaaaacaaacacccaaagac

SEQ ID NO: 373141 - RNA, 24 nt, Human
uaaaaaaacaaacacccaaagaca

SEQ ID NO: 373142 - RNA, 19 nt, Human
uaacagggcaaaacaaaaa

SEQ ID NO: 373143 - RNA, 24 nt, Human
uagcaagcaauaauauuuuuaaac

SEQ ID NO: 373144 - RNA, 25 nt, Human
uagcugaaucaccugcuguaacugg

SEQ ID NO: 373145 - RNA, 19 nt, Human
uagggacaugggccaggug

SEQ ID NO: 373146 - RNA, 18 nt, Human
uccuacacccuuucuuag

SEQ ID NO: 373147 - RNA, 24 nt, Human
ucucgacuaaaaaaaggaggugca

SEQ ID NO: 373148 - RNA, 19 nt, Human
ugagauuuucuugcuguug

SEQ ID NO: 373149 - RNA, 25 nt, Human
ugcuuggcuuucuuucacauucauu

SEQ ID NO: 373150 - RNA, 20 nt, Human
uguccuacacccuuucuuag

SEQ ID NO: 373151 - RNA, 27 nt, Human
uuuucuugcuguuguuauaguacaaac

SEQ ID NO: 373152 - RNA, 18 nt, Human
aaaaaagaaaaacuaaga

SEQ ID NO: 373153 - RNA, 24 nt, Human
aaaaagaaaaacuaagaccugcac

SEQ ID NO: 373154 - RNA, 23 nt, Human
aaaagauaguggaaaaauccaac

SEQ ID NO: 373155 - RNA, 25 nt, Human
aaacaaaaauaaaauuugaaggaag

SEQ ID NO: 373156 - RNA, 22 nt, Human
aaagagacgaaacgcugaccag

SEQ ID NO: 373157 - RNA, 19 nt, Human
aaagcauaauacaggagua

SEQ ID NO: 373158 - RNA, 19 nt, Human
aaccugccucuguccgauu

SEQ ID NO: 373159 - RNA, 22 nt, Human
aaccugccucuguccgauucca

SEQ ID NO: 373160 - RNA, 19 nt, Human
aagagacgaaacgcugacc

SEQ ID NO: 373161 - RNA, 21 nt, Human
aauguccaccugcagagcagc

SEQ ID NO: 373162 - RNA, 20 nt, Human
acaaaggaaucaugaagcca

SEQ ID NO: 373163 - RNA, 19 nt, Human
acagcacuggggaacaugu

SEQ ID NO: 373164 - RNA, 20 nt, Human
acauaccaaucuauccacuc

SEQ ID NO: 373165 - RNA, 27 nt, Human
accacaacagacuguacucugcuccug

SEQ ID NO: 373166 - RNA, 19 nt, Human
acccuucuccuucaccaag

SEQ ID NO: 373167 - RNA, 19 nt, Human
acccuucuccuucaccaag

SEQ ID NO: 373168 - RNA, 20 nt, Human
acuaaugcauuugcuuuucu

SEQ ID NO: 373169 - RNA, 23 nt, Human
agaccaagaacgggcgcucagga

SEQ ID NO: 373170 - RNA, 18 nt, Human
agagugauacaaugacca

SEQ ID NO: 373171 - RNA, 20 nt, Human
aggaaaauguaaacaaacua

SEQ ID NO: 373172 - RNA, 23 nt, Human
aggcagcccuuuuuaacaggaag

SEQ ID NO: 373173 - RNA, 18 nt, Human
aguggcagccauaaggaa

SEQ ID NO: 373174 - RNA, 19 nt, Human
aucacuuugaagaucuaca

SEQ ID NO: 373175 - RNA, 24 nt, Human
auuucaaaagaaaugagaaaaaag

SEQ ID NO: 373176 - RNA, 25 nt, Human
caaaaucaggucuugguggugcugg

SEQ ID NO: 373177 - RNA, 19 nt, Human
caagcaaaccugcccuggg

SEQ ID NO: 373178 - RNA, 22 nt, Human
cacaacaccccugugagguagg

SEQ ID NO: 373179 - RNA, 18 nt, Human
cacacagacuggcaucgc

SEQ ID NO: 373180 - RNA, 19 nt, Human
cagaaauguccaccugcag

SEQ ID NO: 373181 - RNA, 19 nt, Human
cagacuguacucugcuccu

SEQ ID NO: 373182 - RNA, 24 nt, Human
cauacuuauaaagauuacauaaaa

SEQ ID NO: 373183 - RNA, 19 nt, Human
cauguugccgaacaacuga

SEQ ID NO: 373184 - RNA, 21 nt, Human
ccaaccacgcaaccuuaacuu

SEQ ID NO: 373185 - RNA, 18 nt, Human
ccaccgcgcucccgggac

SEQ ID NO: 373186 - RNA, 20 nt, Human
ccaccgcgcucccgggacuc

SEQ ID NO: 373187 - RNA, 21 nt, Human
ccagagugauacaaugaccau

SEQ ID NO: 373188 - RNA, 22 nt, Human
ccccgcgcccgccccgcgcccg

SEQ ID NO: 373189 - RNA, 24 nt, Human
cccgcugcccccaccgcgcucccg

SEQ ID NO: 373190 - RNA, 20 nt, Human
cccugggccacagagcagca

SEQ ID NO: 373191 - RNA, 18 nt, Human
ccgccccgcgcccgcugc

SEQ ID NO: 373192 - RNA, 19 nt, Human
ccgccccgcgcccgcugcc

SEQ ID NO: 373193 - RNA, 20 nt, Human
ccgccccgcgcccgcugccc

SEQ ID NO: 373194 - RNA, 28 nt, Human
ccgcgcccgcugcccccaccgcgcuccc

SEQ ID NO: 373195 - RNA, 21 nt, Human
ccgcgcucccgggacucggcg

SEQ ID NO: 373196 - RNA, 18 nt, Human
ccgcugcccccaccgcgc

SEQ ID NO: 373197 - RNA, 18 nt, Human
ccgcugcccccaccgcgc

SEQ ID NO: 373198 - RNA, 19 nt, Human
ccgcugcccccaccgcgcu

SEQ ID NO: 373199 - RNA, 21 nt, Human
ccgcugcccccaccgcgcucc

SEQ ID NO: 373200 - RNA, 19 nt, Human
cgcacucagccagcaacgg

SEQ ID NO: 373201 - RNA, 19 nt, Human
cggcugaggaaguguggaa

SEQ ID NO: 373202 - RNA, 22 nt, Human
cucgcauaacuacuaaguggcu

SEQ ID NO: 373203 - RNA, 24 nt, Human
cucucgguccagcauucauccacu

SEQ ID NO: 373204 - RNA, 20 nt, Human
cuggcaucgccugggcgugc

SEQ ID NO: 373205 - RNA, 19 nt, Human
cuuuaaguccgcgguccuc

SEQ ID NO: 373206 - RNA, 21 nt, Human
gaaauguccaccugcagagca

SEQ ID NO: 373207 - RNA, 22 nt, Human
gaacacagugcggcaucacggc

SEQ ID NO: 373208 - RNA, 22 nt, Human
gacaggcuggcgcgguccggac

SEQ ID NO: 373209 - RNA, 23 nt, Human
gacaggcuggcgcgguccggacc

SEQ ID NO: 373210 - RNA, 19 nt, Human
gagaugggggagacacaaa

SEQ ID NO: 373211 - RNA, 24 nt, Human
gcagaugaagggccuagaccugga

SEQ ID NO: 373212 - RNA, 27 nt, Human
gcaucagaaauguccaccugcagagca

SEQ ID NO: 373213 - RNA, 23 nt, Human
gccccgcgcccgcugcccccacc

SEQ ID NO: 373214 - RNA, 24 nt, Human
gcgguccccgcgcccgccccgcgc

SEQ ID NO: 373215 - RNA, 21 nt, Human
ggaaggcagcccuuuuuaaca

SEQ ID NO: 373216 - RNA, 23 nt, Human
ggacaaaacgcacucagccagca

SEQ ID NO: 373217 - RNA, 23 nt, Human
uaaacuaggaaugacaauaaugu

SEQ ID NO: 373218 - RNA, 22 nt, Human
uagaccuggauccagaagcuag

SEQ ID NO: 373219 - RNA, 22 nt, Human
uagagucgagaacugaggcaga

SEQ ID NO: 373220 - RNA, 22 nt, Human
uaggcgcggaauccgggaaacc

SEQ ID NO: 373221 - RNA, 21 nt, Human
uauguccuuuagagucgagaa

SEQ ID NO: 373222 - RNA, 23 nt, Human
uauucugcuuuucuuuccccaca

SEQ ID NO: 373223 - RNA, 21 nt, Human
ucaggaaaauguaaacaaacu

SEQ ID NO: 373224 - RNA, 21 nt, Human
ucaggaauaacugucacuaac

SEQ ID NO: 373225 - RNA, 18 nt, Human
ucaggucuugguggugcu

SEQ ID NO: 373226 - RNA, 19 nt, Human
uccagugagcauaaaugcu

SEQ ID NO: 373227 - RNA, 26 nt, Human
uccauguuucucagaaaaagaggagu

SEQ ID NO: 373228 - RNA, 30 nt, Human
uccccgcgcccgccccgcgcccgcugcccu

SEQ ID NO: 373229 - RNA, 22 nt, Human
uccgggccgucguccaggccuu

SEQ ID NO: 373230 - RNA, 19 nt, Human
ucuacauaccaaucuaucc

SEQ ID NO: 373231 - RNA, 22 nt, Human
ucucaugcuuaauuggcugagc

SEQ ID NO: 373232 - RNA, 23 nt, Human
ugaaaagguuaaauuucagaaau

SEQ ID NO: 373233 - RNA, 19 nt, Human
ugaaggaaggcagcccuuu

SEQ ID NO: 373234 - RNA, 25 nt, Human
ugacaggcuggcgcgguccggaccc

SEQ ID NO: 373235 - RNA, 18 nt, Human
ugaccagcucaugaauga

SEQ ID NO: 373236 - RNA, 20 nt, Human
ugagaaaaaagaaaaacuaa

SEQ ID NO: 373237 - RNA, 21 nt, Human
ugaggcaagacaacaugcggc

SEQ ID NO: 373238 - RNA, 23 nt, Human
ugaggcagaggucaagcaaaccu

SEQ ID NO: 373239 - RNA, 26 nt, Human
ugaggcagaggucaagcaaaccugcc

SEQ ID NO: 373240 - RNA, 21 nt, Human
ugagguaggucaguauguccc

SEQ ID NO: 373241 - RNA, 23 nt, Human
ugcccccaccgcgcucccgggac

SEQ ID NO: 373242 - RNA, 21 nt, Human
ugcccugggccacagagcagc

SEQ ID NO: 373243 - RNA, 18 nt, Human
uggaaaaauccaaccacg

SEQ ID NO: 373244 - RNA, 24 nt, Human
uggcaucgccugggcgugcgcugc

SEQ ID NO: 373245 - RNA, 24 nt, Human
uggggaacacagugcggcaucacg

SEQ ID NO: 373246 - RNA, 22 nt, Human
ugucccaaaacgucuaagaaau

SEQ ID NO: 373247 - RNA, 22 nt, Human
uuaaagagacgaaacgcugacc

SEQ ID NO: 373248 - RNA, 22 nt, Human
uucauccacugguggacaucac

SEQ ID NO: 373249 - RNA, 24 nt, Human
uucgagaugccauuucaaaagaaa

SEQ ID NO: 373250 - RNA, 21 nt, Human
uucuaugaaguacacacagag

SEQ ID NO: 373251 - RNA, 19 nt, Human
uugguggacuuuguucgag

SEQ ID NO: 373252 - RNA, 19 nt, Human
uuucaacaaugcauucuga

SEQ ID NO: 373253 - RNA, 23 nt, Human
uuucaggaauaacugucacuaac

SEQ ID NO: 373254 - RNA, 24 nt, Human
uuuuuuuuuuuuuuuuuuccaaag

SEQ ID NO: 373255 - RNA, 23 nt, Human
aaaaaugaaagcagcgggaggga

SEQ ID NO: 373256 - RNA, 22 nt, Human
aaaaguacuuaacaacaacaac

SEQ ID NO: 373257 - RNA, 18 nt, Human
aaacauuaacaaaaaccc

SEQ ID NO: 373258 - RNA, 22 nt, Human
aaagcagcgggagggaacgcgg

SEQ ID NO: 373259 - RNA, 22 nt, Human
aagaaaaaucaaguggggagaa

SEQ ID NO: 373260 - RNA, 24 nt, Human
aagcagcgggagggaacgcgguaa

SEQ ID NO: 373261 - RNA, 22 nt, Human
aagcgcuggaagugcuggugcu

SEQ ID NO: 373262 - RNA, 27 nt, Human
aauaauaggggaaaaaaagggagggcc

SEQ ID NO: 373263 - RNA, 24 nt, Human
aaucauuaaaaaucaaaacaucaa

SEQ ID NO: 373264 - RNA, 24 nt, Human
aaugaacaaaagaccaucccuaaa

SEQ ID NO: 373265 - RNA, 20 nt, Human
acaacaaaaaucacacacaa

SEQ ID NO: 373266 - RNA, 22 nt, Human
acaacaacaacaaaaaucacac

SEQ ID NO: 373267 - RNA, 28 nt, Human
acaacaacaacaaaaaucacacacaaag

SEQ ID NO: 373268 - RNA, 22 nt, Human
agaaauaggauuuggggaagaa

SEQ ID NO: 373269 - RNA, 22 nt, Human
agaagaaaaaucaaguggggag

SEQ ID NO: 373270 - RNA, 18 nt, Human
agagcgccggggacucug

SEQ ID NO: 373271 - RNA, 22 nt, Human
agccacaaaauucucuacaaag

SEQ ID NO: 373272 - RNA, 25 nt, Human
agccacaaaauucucuacaaagucc

SEQ ID NO: 373273 - RNA, 18 nt, Human
aggaaggaagugcaaaga

SEQ ID NO: 373274 - RNA, 19 nt, Human
aguacuuaacaacaacaac

SEQ ID NO: 373275 - RNA, 18 nt, Human
agucaggaagggcgcugg

SEQ ID NO: 373276 - RNA, 22 nt, Human
augaaacauuaacaaaaacccg

SEQ ID NO: 373277 - RNA, 19 nt, Human
auggcauaaaacaugccuu

SEQ ID NO: 373278 - RNA, 21 nt, Human
auugccccaagucaggagaaa

SEQ ID NO: 373279 - RNA, 24 nt, Human
caaaaaguguuuugaaaaagugau

SEQ ID NO: 373280 - RNA, 24 nt, Human
caaacauagauauuuuuuauucug

SEQ ID NO: 373281 - RNA, 19 nt, Human
caaagucccucaauucuuc

SEQ ID NO: 373282 - RNA, 24 nt, Human
caagccaagcagugugccguggcc

SEQ ID NO: 373283 - RNA, 21 nt, Human
cacacacccacgauggcacua

SEQ ID NO: 373284 - RNA, 19 nt, Human
cacccacgauggcacuagu

SEQ ID NO: 373285 - RNA, 19 nt, Human
cacugcugaggcugcagcc

SEQ ID NO: 373286 - RNA, 25 nt, Human
cagaaacacccugugugaaguuucg

SEQ ID NO: 373287 - RNA, 18 nt, Human
cagaagaaauaggauuug

SEQ ID NO: 373288 - RNA, 23 nt, Human
caggcugugggguccccuggagg

SEQ ID NO: 373289 - RNA, 21 nt, Human
ccaggcaucaaaucccgugga

SEQ ID NO: 373290 - RNA, 24 nt, Human
ccaggcugugggguccccuggagg

SEQ ID NO: 373291 - RNA, 22 nt, Human
ccaggggcccccagcguccucc

SEQ ID NO: 373292 - RNA, 22 nt, Human
ccagucaaauccaaauauccga

SEQ ID NO: 373293 - RNA, 19 nt, Human
cccaccugcccacacaccc

SEQ ID NO: 373294 - RNA, 26 nt, Human
ccccaggggcccccagcguccucccu

SEQ ID NO: 373295 - RNA, 19 nt, Human
cccccaggcccucccgaac

SEQ ID NO: 373296 - RNA, 32 nt, Human
cccccaggcccucccgaacacaggccuccggu

SEQ ID NO: 373297 - RNA, 22 nt, Human
cccgugauauugaagaacaaga

SEQ ID NO: 373298 - RNA, 18 nt, Human
cccgugccaucuccauuu

SEQ ID NO: 373299 - RNA, 18 nt, Human
cccucccgaacacaggcc

SEQ ID NO: 373300 - RNA, 23 nt, Human
ccgcgcaggcaaaggcaagggcu

SEQ ID NO: 373301 - RNA, 19 nt, Human
ccgcuccuccgccucggcc

SEQ ID NO: 373302 - RNA, 22 nt, Human
ccggcgcggcggccgcuccucc

SEQ ID NO: 373303 - RNA, 19 nt, Human
ccggggacucuguacacug

SEQ ID NO: 373304 - RNA, 20 nt, Human
ccuccgcacagccacucacc

SEQ ID NO: 373305 - RNA, 21 nt, Human
ccuccgcacagccacucaccc

SEQ ID NO: 373306 - RNA, 26 nt, Human
ccuccuucccccaggcccucccgaac

SEQ ID NO: 373307 - RNA, 19 nt, Human
cuccgcacagccacucacc

SEQ ID NO: 373308 - RNA, 18 nt, Human
cucugaggagcccgugcc

SEQ ID NO: 373309 - RNA, 20 nt, Human
cugcagcccuucucaguccc

SEQ ID NO: 373310 - RNA, 22 nt, Human
cugccaggcugugggguccccu

SEQ ID NO: 373311 - RNA, 22 nt, Human
cuuucucuccaaccucagagcg

SEQ ID NO: 373312 - RNA, 18 nt, Human
gaacaaaagaccaucccu

SEQ ID NO: 373313 - RNA, 23 nt, Human
gacaccaacuggccaugaacccc

SEQ ID NO: 373314 - RNA, 19 nt, Human
gaccaucccuaaauaacug

SEQ ID NO: 373315 - RNA, 21 nt, Human
gagacgguggcugccaguguu

SEQ ID NO: 373316 - RNA, 18 nt, Human
gagcagcacaucagaaau

SEQ ID NO: 373317 - RNA, 19 nt, Human
gcaaaggcaagggcgaggg

SEQ ID NO: 373318 - RNA, 19 nt, Human
gccagagacgccggggugc

SEQ ID NO: 373319 - RNA, 19 nt, Human
gcccaccugcccacacacc

SEQ ID NO: 373320 - RNA, 20 nt, Human
gccccagaggacugaaagga

SEQ ID NO: 373321 - RNA, 27 nt, Human
gcccuccuucccccaggcccucccgaa

SEQ ID NO: 373322 - RNA, 20 nt, Human
gccguggccacagcagcgcu

SEQ ID NO: 373323 - RNA, 19 nt, Human
ggaaaaaaguuuugaauug

SEQ ID NO: 373324 - RNA, 21 nt, Human
ggagggacaugggauggccca

SEQ ID NO: 373325 - RNA, 22 nt, Human
ggccagagacgccggggugcug

SEQ ID NO: 373326 - RNA, 22 nt, Human
ggccagagacgccggggugcug

SEQ ID NO: 373327 - RNA, 18 nt, Human
ggcgggucccccggcccg

SEQ ID NO: 373328 - RNA, 19 nt, Human
gggcccccagcguccuccc

SEQ ID NO: 373329 - RNA, 18 nt, Human
gguaagaacuggaagauu

SEQ ID NO: 373330 - RNA, 23 nt, Human
guacuuaacaacaacaacaaaaa

SEQ ID NO: 373331 - RNA, 19 nt, Human
gugcaugugacuccccgga

SEQ ID NO: 373332 - RNA, 21 nt, Human
uaaaauaucaguggggagaaa

SEQ ID NO: 373333 - RNA, 22 nt, Human
uaaaugcaguuuuuugcaacuc

SEQ ID NO: 373334 - RNA, 31 nt, Human
uaacaacaacaacaaaaaucacacacaaagg

SEQ ID NO: 373335 - RNA, 21 nt, Human
uaagagcagcacaucagaaau

SEQ ID NO: 373336 - RNA, 21 nt, Human
uaauggggagcuaaccugugc

SEQ ID NO: 373337 - RNA, 22 nt, Human
uaccuggaccauuuucagcagc

SEQ ID NO: 373338 - RNA, 23 nt, Human
ucacacacaaaguccaaaaagug

SEQ ID NO: 373339 - RNA, 21 nt, Human
ucaguggggagaaaccccuca

SEQ ID NO: 373340 - RNA, 23 nt, Human
ucccggaccgcaacacuugaccu

SEQ ID NO: 373341 - RNA, 23 nt, Human
ucccucaaugacaggagccccag

SEQ ID NO: 373342 - RNA, 20 nt, Human
uccgcacagccacucacccg

SEQ ID NO: 373343 - RNA, 20 nt, Human
ucuguucuuucucuccaacc

SEQ ID NO: 373344 - RNA, 18 nt, Human
ugaaaaagugauuugaga

SEQ ID NO: 373345 - RNA, 21 nt, Human
ugaaaugaugaauucauguca

SEQ ID NO: 373346 - RNA, 19 nt, Human
ugacggugugccaaggucc

SEQ ID NO: 373347 - RNA, 24 nt, Human
ugacggugugccaagguccuguuu

SEQ ID NO: 373348 - RNA, 18 nt, Human
ugaggacauggguggcca

SEQ ID NO: 373349 - RNA, 25 nt, Human
ugauuugagaauuuacuguacaguu

SEQ ID NO: 373350 - RNA, 19 nt, Human
ugccauguugccacuugaa

SEQ ID NO: 373351 - RNA, 24 nt, Human
ugccucacaccagucaaauccaaa

SEQ ID NO: 373352 - RNA, 22 nt, Human
ugcggaaaugaacaaaagacca

SEQ ID NO: 373353 - RNA, 20 nt, Human
uggaagauugugggagacuu

SEQ ID NO: 373354 - RNA, 23 nt, Human
uggaagugcuggugcucagaaac

SEQ ID NO: 373355 - RNA, 19 nt, Human
uggaauaaaaaguacuuaa

SEQ ID NO: 373356 - RNA, 21 nt, Human
ugggagacgggagcgcuccuc

SEQ ID NO: 373357 - RNA, 26 nt, Human
ugggugcccuccuucccccaggcccu

SEQ ID NO: 373358 - RNA, 18 nt, Human
ugucagaagaaauaggau

SEQ ID NO: 373359 - RNA, 19 nt, Human
ugucagaagaaauaggauu

SEQ ID NO: 373360 - RNA, 23 nt, Human
uguggcagugaaaggcguaacga

SEQ ID NO: 373361 - RNA, 19 nt, Human
ugugugaaguuucggaugu

SEQ ID NO: 373362 - RNA, 24 nt, Human
uuaacaaaaacccgugauauugaa

SEQ ID NO: 373363 - RNA, 21 nt, Human
uuaugauacgcuucccggacc

SEQ ID NO: 373364 - RNA, 22 nt, Human
uucauggcauaaaacaugccuu

SEQ ID NO: 373365 - RNA, 19 nt, Human
uucauuggcaacuucccag

SEQ ID NO: 373366 - RNA, 25 nt, Human
uucucagucccuacacuuuuccauc

SEQ ID NO: 373367 - RNA, 20 nt, Human
uucucuacaaagucccucaa

SEQ ID NO: 373368 - RNA, 24 nt, Human
uugaagaacaagauguucucauau

SEQ ID NO: 373369 - RNA, 20 nt, Human
uuggcaacuucccagguggu

SEQ ID NO: 373370 - RNA, 20 nt, Human
uugguuuuguuuccuuuuuu

SEQ ID NO: 373371 - RNA, 18 nt, Human
uuucacauucccucugcu

SEQ ID NO: 373372 - RNA, 19 nt, Human
uuuuuuauucuggcauagu

SEQ ID NO: 373373 - RNA, 25 nt, Human
aaaaauccaaaguggcauaguggga

SEQ ID NO: 373374 - RNA, 26 nt, Human
aaaagaaaaauaaaauauuaaaagaa

SEQ ID NO: 373375 - RNA, 25 nt, Human
aaccauuugucaucuaccuugucuu

SEQ ID NO: 373376 - RNA, 22 nt, Human
aaccccacaauuacuuuagcac

SEQ ID NO: 373377 - RNA, 20 nt, Human
aagaaaacaaaaaaaaguca

SEQ ID NO: 373378 - RNA, 20 nt, Human
acaagagggaaaagcacagu

SEQ ID NO: 373379 - RNA, 24 nt, Human
accaaauuucaaaugugccuggau

SEQ ID NO: 373380 - RNA, 24 nt, Human
agcuaauacagaaaaaccccacaa

SEQ ID NO: 373381 - RNA, 20 nt, Human
auuguggaauuuccccaaag

SEQ ID NO: 373382 - RNA, 23 nt, Human
auuuagggcagagauuuuauuuu

SEQ ID NO: 373383 - RNA, 25 nt, Human
cagaaaaaccccacaauuacuuuag

SEQ ID NO: 373384 - RNA, 19 nt, Human
cagcaggaaguuucuucug

SEQ ID NO: 373385 - RNA, 24 nt, Human
cagcaggaaguuucuucugggccg

SEQ ID NO: 373386 - RNA, 24 nt, Human
cagcuuuacugaagaauaucaaac

SEQ ID NO: 373387 - RNA, 21 nt, Human
caggaaguuucuucugggcac

SEQ ID NO: 373388 - RNA, 18 nt, Human
cauauuaagcuucuauua

SEQ ID NO: 373389 - RNA, 20 nt, Human
ccaaacaccugguuaaaaau

SEQ ID NO: 373390 - RNA, 20 nt, Human
ccagcaggaaguuucuucug

SEQ ID NO: 373391 - RNA, 19 nt, Human
ccccaaaguaacagcucag

SEQ ID NO: 373392 - RNA, 18 nt, Human
ccugaauacugagcucca

SEQ ID NO: 373393 - RNA, 18 nt, Human
cuaaagaaaacaaaaaaa

SEQ ID NO: 373394 - RNA, 22 nt, Human
cuaaguuaauucugaagauagg

SEQ ID NO: 373395 - RNA, 21 nt, Human
cuuccaaugagaaaggaacaa

SEQ ID NO: 373396 - RNA, 24 nt, Human
gaaaaauccaaaguggcauaaaaa

SEQ ID NO: 373397 - RNA, 23 nt, Human
gaauuuccccaaaguaacagcuc

SEQ ID NO: 373398 - RNA, 21 nt, Human
guaaaaacaaaaaccaaacac

SEQ ID NO: 373399 - RNA, 18 nt, Human
guauaaauuaaggaaaga

SEQ ID NO: 373400 - RNA, 20 nt, Human
uaaaagggcuaaguagaagc

SEQ ID NO: 373401 - RNA, 21 nt, Human
uaaaagggcuaaguagaagca

SEQ ID NO: 373402 - RNA, 24 nt, Human
uaaaauaaaaauacaccaaguuug

SEQ ID NO: 373403 - RNA, 23 nt, Human
uaaagaaaacaaaaaaaagucaa

SEQ ID NO: 373404 - RNA, 24 nt, Human
uaacaaaauauuuuacauguagga

SEQ ID NO: 373405 - RNA, 18 nt, Human
uaaccauuugucaucuac

SEQ ID NO: 373406 - RNA, 21 nt, Human
uaagcuaauacagaaaaaccc

SEQ ID NO: 373407 - RNA, 21 nt, Human
uaaguagaagcaacaguucaa

SEQ ID NO: 373408 - RNA, 20 nt, Human
uaaguuacaaaagucaauaa

SEQ ID NO: 373409 - RNA, 20 nt, Human
uagaaaaauccaaaguggca

SEQ ID NO: 373410 - RNA, 18 nt, Human
uagacacaagagggaaaa

SEQ ID NO: 373411 - RNA, 23 nt, Human
uaguacaugaaaaagagauguug

SEQ ID NO: 373412 - RNA, 18 nt, Human
uauaauacuacuaauggc

SEQ ID NO: 373413 - RNA, 18 nt, Human
uauuucuggaaucuuuau

SEQ ID NO: 373414 - RNA, 23 nt, Human
ucauguagcugucaaaaggcuuu

SEQ ID NO: 373415 - RNA, 19 nt, Human
ucuucugggcacuuucugg

SEQ ID NO: 373416 - RNA, 19 nt, Human
ugaaaaacuacuuagguac

SEQ ID NO: 373417 - RNA, 23 nt, Human
ugaaaaacuacuuagguacucuu

SEQ ID NO: 373418 - RNA, 19 nt, Human
ugaaaaagagauguuggaa

SEQ ID NO: 373419 - RNA, 21 nt, Human
ugaaaaagagauguuggaagg

SEQ ID NO: 373420 - RNA, 22 nt, Human
ugaagaauaucaaacucaauga

SEQ ID NO: 373421 - RNA, 24 nt, Human
ugaagaauaucaaacucaaugaaa

SEQ ID NO: 373422 - RNA, 19 nt, Human
ugaagaugguuuagcucuu

SEQ ID NO: 373423 - RNA, 21 nt, Human
ugagaaaggaacaagauuuau

SEQ ID NO: 373424 - RNA, 21 nt, Human
uggacaccacugccuuuguag

SEQ ID NO: 373425 - RNA, 26 nt, Human
uggacaccacugccuuuguagaaaaa

SEQ ID NO: 373426 - RNA, 26 nt, Human
uggaucauguauaaauuaguuaaaga

SEQ ID NO: 373427 - RNA, 26 nt, Human
uggaucuuguagaucaaaaacaguau

SEQ ID NO: 373428 - RNA, 21 nt, Human
uguagcugucaaaaggcuuuc

SEQ ID NO: 373429 - RNA, 27 nt, Human
ugucaucuaccuugucuaguuuacaua

SEQ ID NO: 373430 - RNA, 19 nt, Human
uuaguacaugaaaaagaga

SEQ ID NO: 373431 - RNA, 19 nt, Human
uucaggaaugacaaaugau

SEQ ID NO: 373432 - RNA, 23 nt, Human
uuugcaaugccuaccaaauuuca

SEQ ID NO: 373433 - RNA, 21 nt, Human
uuuguggcugcuaauacauug

SEQ ID NO: 373434 - RNA, 21 nt, Human
aaaaaaaaaucacacacaaga

SEQ ID NO: 373435 - RNA, 23 nt, Human
aaaaaaaaaucacacacaagacu

SEQ ID NO: 373436 - RNA, 19 nt, Human
aaaaaaagcagccauaaca

SEQ ID NO: 373437 - RNA, 20 nt, Human
aaaagcagccauaacaaggc

SEQ ID NO: 373438 - RNA, 24 nt, Human
aaaagggacaagucuuugguuaaa

SEQ ID NO: 373439 - RNA, 20 nt, Human
aaacacuagaacuugauaua

SEQ ID NO: 373440 - RNA, 18 nt, Human
aaagggacaagucuuugg

SEQ ID NO: 373441 - RNA, 24 nt, Human
aaauucaguucaguuacuaagaag

SEQ ID NO: 373442 - RNA, 22 nt, Human
aacauacuuuauuagcacaaaa

SEQ ID NO: 373443 - RNA, 19 nt, Human
aagcucaagaaaaaagacc

SEQ ID NO: 373444 - RNA, 20 nt, Human
aagugaacugcacuaugccc

SEQ ID NO: 373445 - RNA, 19 nt, Human
aaguuuccucucuaaaaca

SEQ ID NO: 373446 - RNA, 21 nt, Human
acaaaaucauccugggcauag

SEQ ID NO: 373447 - RNA, 19 nt, Human
acaaggagaacaccaaaca

SEQ ID NO: 373448 - RNA, 18 nt, Human
acagagcacauuaacgaa

SEQ ID NO: 373449 - RNA, 22 nt, Human
acagcaagcagaaacauacauu

SEQ ID NO: 373450 - RNA, 21 nt, Human
acauaaacucaaacacauuua

SEQ ID NO: 373451 - RNA, 25 nt, Human
agaaaaaagacccaacaauuaggca

SEQ ID NO: 373452 - RNA, 24 nt, Human
agaaaaggacacagugaauauaga

SEQ ID NO: 373453 - RNA, 20 nt, Human
agaacuugauauaacuucca

SEQ ID NO: 373454 - RNA, 22 nt, Human
agaauucuucauaacaaaugcc

SEQ ID NO: 373455 - RNA, 23 nt, Human
agaauucuucauaacaaaugccc

SEQ ID NO: 373456 - RNA, 21 nt, Human
agacaaaaauuuaaaccaaaa

SEQ ID NO: 373457 - RNA, 23 nt, Human
agacaaaaauuuaaaccaaaaau

SEQ ID NO: 373458 - RNA, 21 nt, Human
agacugcacaucaacuuaaaa

SEQ ID NO: 373459 - RNA, 21 nt, Human
aggugcaaguucaugcuggug

SEQ ID NO: 373460 - RNA, 23 nt, Human
aguaguaguacauauuauucuaa

SEQ ID NO: 373461 - RNA, 20 nt, Human
aguuacuaagaagcaaacac

SEQ ID NO: 373462 - RNA, 24 nt, Human
aguuaugagaguuuacaaaaaaga

SEQ ID NO: 373463 - RNA, 24 nt, Human
auaaaacagcagauauacaaggag

SEQ ID NO: 373464 - RNA, 22 nt, Human
auaccacagccauuaaaaacca

SEQ ID NO: 373465 - RNA, 23 nt, Human
auaccacagccauuaaaaaccaa

SEQ ID NO: 373466 - RNA, 24 nt, Human
auuacaaauucacaagacuucauu

SEQ ID NO: 373467 - RNA, 22 nt, Human
auugcagcagcuauuccaaacg

SEQ ID NO: 373468 - RNA, 20 nt, Human
caaaaugucuaggacagaac

SEQ ID NO: 373469 - RNA, 25 nt, Human
caacaauaaucucaacaucagcaac

SEQ ID NO: 373470 - RNA, 22 nt, Human
caagucuuugguuaaaguucua

SEQ ID NO: 373471 - RNA, 21 nt, Human
caaguuuccucucuaaaacac

SEQ ID NO: 373472 - RNA, 21 nt, Human
cacaaaaaaagcagccauaac

SEQ ID NO: 373473 - RNA, 21 nt, Human
cacaagacuacauugcagcag

SEQ ID NO: 373474 - RNA, 18 nt, Human
cacagcaagcagaaacau

SEQ ID NO: 373475 - RNA, 19 nt, Human
cagauacuaacacuaagcu

SEQ ID NO: 373476 - RNA, 24 nt, Human
cauuuaaaacaauuuccauuuaac

SEQ ID NO: 373477 - RNA, 22 nt, Human
cgggggcggcccgggagucggg

SEQ ID NO: 373478 - RNA, 19 nt, Human
cuaaaacacaaucuugcuc

SEQ ID NO: 373479 - RNA, 20 nt, Human
cuagaacuugauauaacuuc

SEQ ID NO: 373480 - RNA, 20 nt, Human
cuaggacagaacuguaaauu

SEQ ID NO: 373481 - RNA, 19 nt, Human
cuguucauuaacucugcau

SEQ ID NO: 373482 - RNA, 18 nt, Human
gaaggagggaggcagggc

SEQ ID NO: 373483 - RNA, 19 nt, Human
gaaggagggaggcagggcg

SEQ ID NO: 373484 - RNA, 19 nt, Human
gaguuuacaaaaaagagau

SEQ ID NO: 373485 - RNA, 21 nt, Human
gcagggcgcgagacgggggcg

SEQ ID NO: 373486 - RNA, 22 nt, Human
gcauaggaacagauccaacuuu

SEQ ID NO: 373487 - RNA, 27 nt, Human
gcgcgagacgggggcggcccgggaguc

SEQ ID NO: 373488 - RNA, 20 nt, Human
ggauuccuagcggccaaucc

SEQ ID NO: 373489 - RNA, 18 nt, Human
ggcacagcaagcagaaac

SEQ ID NO: 373490 - RNA, 20 nt, Human
gguaggugaaggccgaagga

SEQ ID NO: 373491 - RNA, 20 nt, Human
gucugauuauaaacuacauc

SEQ ID NO: 373492 - RNA, 24 nt, Human
uaaaaaaaaaucacacacaagacu

SEQ ID NO: 373493 - RNA, 21 nt, Human
uaaaaaccccaaaccauucca

SEQ ID NO: 373494 - RNA, 21 nt, Human
uaaaaaccccaaaccauucca

SEQ ID NO: 373495 - RNA, 25 nt, Human
uaaaacagcagauauacaaggagaa

SEQ ID NO: 373496 - RNA, 23 nt, Human
uaaaauaacauucuguagcagca

SEQ ID NO: 373497 - RNA, 23 nt, Human
uaaaugguacugaucuauuacaa

SEQ ID NO: 373498 - RNA, 18 nt, Human
uaacaaggcacagcaagc

SEQ ID NO: 373499 - RNA, 23 nt, Human
uaacaaggcacagcaagcagaaa

SEQ ID NO: 373500 - RNA, 20 nt, Human
uaacuuccaaaagcgcucac

SEQ ID NO: 373501 - RNA, 23 nt, Human
uaagaugguccccaaaccaauaa

SEQ ID NO: 373502 - RNA, 21 nt, Human
uacacaaacugaaacauguga

SEQ ID NO: 373503 - RNA, 19 nt, Human
uacagauacucauuuacua

SEQ ID NO: 373504 - RNA, 22 nt, Human
uacauuagcagucaaaagguua

SEQ ID NO: 373505 - RNA, 19 nt, Human
uaccacagccauuaaaaac

SEQ ID NO: 373506 - RNA, 24 nt, Human
uaccacagccauuaaaaaccaaac

SEQ ID NO: 373507 - RNA, 21 nt, Human
uagaacaucaauuugcuacaa

SEQ ID NO: 373508 - RNA, 21 nt, Human
uagcacaguguauacaugcuu

SEQ ID NO: 373509 - RNA, 24 nt, Human
uaguucaacaauaaucucaacauc

SEQ ID NO: 373510 - RNA, 26 nt, Human
uauaaaacagcagauauacaaggaga

SEQ ID NO: 373511 - RNA, 22 nt, Human
uauacacaaacugaaacaugug

SEQ ID NO: 373512 - RNA, 25 nt, Human
uaugucauaacaacuuaauugcaca

SEQ ID NO: 373513 - RNA, 24 nt, Human
ucaaauaccacagccauuaaaaac

SEQ ID NO: 373514 - RNA, 22 nt, Human
ucauuggauaguuucaaucuuu

SEQ ID NO: 373515 - RNA, 23 nt, Human
uccaacuuuuaugaaacaacaau

SEQ ID NO: 373516 - RNA, 23 nt, Human
ucuaaaacacaaucuugcucaca

SEQ ID NO: 373517 - RNA, 21 nt, Human
ucugacagauacuaacacuaa

SEQ ID NO: 373518 - RNA, 19 nt, Human
ugaaaaagccuaacacugc

SEQ ID NO: 373519 - RNA, 19 nt, Human
ugauauaacuuccaaaagc

SEQ ID NO: 373520 - RNA, 19 nt, Human
ugccccagaguugccucac

SEQ ID NO: 373521 - RNA, 22 nt, Human
ugccucacucaaauaccacagc

SEQ ID NO: 373522 - RNA, 18 nt, Human
uggaagguuauagaaaaa

SEQ ID NO: 373523 - RNA, 23 nt, Human
uguauacaugcuuacauaaacuc

SEQ ID NO: 373524 - RNA, 23 nt, Human
ugucauaacaacuuaauugcaca

SEQ ID NO: 373525 - RNA, 19 nt, Human
ugugcuugcuauaggugua

SEQ ID NO: 373526 - RNA, 23 nt, Human
uuaaaaaccccaaaccauuccau

SEQ ID NO: 373527 - RNA, 19 nt, Human
uuuguagucuuacugaaca

SEQ ID NO: 373528 - RNA, 20 nt, Human
uuuuucuaaaaggaaggcag

SEQ ID NO: 373529 - RNA, 22 nt, Human
aaacagucauaaagagcuuaac

SEQ ID NO: 373530 - RNA, 26 nt, Human
aaaggcaucccuacaaguccccaaag

SEQ ID NO: 373531 - RNA, 24 nt, Human
acaucaagaaaugcuacaauagag

SEQ ID NO: 373532 - RNA, 25 nt, Human
acuaagcaacaucaagaaaugcuac

SEQ ID NO: 373533 - RNA, 18 nt, Human
aggcaucccuacaagucc

SEQ ID NO: 373534 - RNA, 22 nt, Human
caauagagcagcuuacuguauu

SEQ ID NO: 373535 - RNA, 23 nt, Human
cacaaagcauuuacuauuuucaa

SEQ ID NO: 373536 - RNA, 20 nt, Human
cagcuuacuguauucugcag

SEQ ID NO: 373537 - RNA, 20 nt, Human
caucaagaaaugcuacaaua

SEQ ID NO: 373538 - RNA, 18 nt, Human
ggacuagaaaggcauccc

SEQ ID NO: 373539 - RNA, 19 nt, Human
uaacaaaauguuuaguaag

SEQ ID NO: 373540 - RNA, 18 nt, Human
uaacauacucagcauaac

SEQ ID NO: 373541 - RNA, 19 nt, Human
uaagaaauuauucagaaca

SEQ ID NO: 373542 - RNA, 21 nt, Human
uagaauaggacuagaaaggca

SEQ ID NO: 373543 - RNA, 22 nt, Human
uagcucucugaagaaaaugucc

SEQ ID NO: 373544 - RNA, 22 nt, Human
uaugaaauaagugacuaagcaa

SEQ ID NO: 373545 - RNA, 24 nt, Human
ucuauaacugcaauagaauaggac

SEQ ID NO: 373546 - RNA, 19 nt, Human
ucuauaccacuacaaaaac

SEQ ID NO: 373547 - RNA, 19 nt, Human
ucugcaguacucuauacca

SEQ ID NO: 373548 - RNA, 21 nt, Human
ugacuaagcaacaucaagaaa

SEQ ID NO: 373549 - RNA, 21 nt, Human
aaaaauagaagcucuucuuuc

SEQ ID NO: 373550 - RNA, 24 nt, Human
aaagcccaugugggaaaaaccagg

SEQ ID NO: 373551 - RNA, 24 nt, Human
aacgucaguaaaugcauccaguac

SEQ ID NO: 373552 - RNA, 24 nt, Human
aaggcagaggggggccucgggggu

SEQ ID NO: 373553 - RNA, 26 nt, Human
aagguaccucagggagccuaggaggc

SEQ ID NO: 373554 - RNA, 23 nt, Human
acaacaacgucaguaaaugcauc

SEQ ID NO: 373555 - RNA, 22 nt, Human
acccacagcugcaugagucacc

SEQ ID NO: 373556 - RNA, 20 nt, Human
accugaaggcgggaaggggg

SEQ ID NO: 373557 - RNA, 25 nt, Human
acgcaggcugucccuggagccccgc

SEQ ID NO: 373558 - RNA, 21 nt, Human
agaggggggccucgggggucc

SEQ ID NO: 373559 - RNA, 20 nt, Human
aggcagaggggggccucggg

SEQ ID NO: 373560 - RNA, 21 nt, Human
aggcagaggggggccucgggg

SEQ ID NO: 373561 - RNA, 21 nt, Human
aggcagaggggggccucgggg

SEQ ID NO: 373562 - RNA, 21 nt, Human
aucuguaacacaaagguugcc

SEQ ID NO: 373563 - RNA, 22 nt, Human
augagaucauuacucgcccagu

SEQ ID NO: 373564 - RNA, 26 nt, Human
caaaaauagaagcucuucuuucccag

SEQ ID NO: 373565 - RNA, 19 nt, Human
cacagcugcaugagucacc

SEQ ID NO: 373566 - RNA, 19 nt, Human
caugugggaaaaaccaggc

SEQ ID NO: 373567 - RNA, 23 nt, Human
ccagagcggccucugagcgccua

SEQ ID NO: 373568 - RNA, 24 nt, Human
ccagcccaggaacgcaggcugucc

SEQ ID NO: 373569 - RNA, 19 nt, Human
ccucagggagccuaggagg

SEQ ID NO: 373570 - RNA, 22 nt, Human
ccuccugcauuccugcaacaaa

SEQ ID NO: 373571 - RNA, 19 nt, Human
ccucgggggucccuggccc

SEQ ID NO: 373572 - RNA, 19 nt, Human
ccuggagccccgcacgccc

SEQ ID NO: 373573 - RNA, 20 nt, Human
ccuggccgccgccggguggg

SEQ ID NO: 373574 - RNA, 19 nt, Human
ccuucagaccuacugagug

SEQ ID NO: 373575 - RNA, 19 nt, Human
cgcggggcaguuggccugg

SEQ ID NO: 373576 - RNA, 24 nt, Human
cgcggggcaguuggccuggcuucc

SEQ ID NO: 373577 - RNA, 21 nt, Human
cgggagcgguggugggugggg

SEQ ID NO: 373578 - RNA, 24 nt, Human
cgguauagggagaccucugggugg

SEQ ID NO: 373579 - RNA, 21 nt, Human
cugcaugagucaccuuggggg

SEQ ID NO: 373580 - RNA, 19 nt, Human
gagaucauuacucgcccag

SEQ ID NO: 373581 - RNA, 18 nt, Human
gaguguuucccucccgac

SEQ ID NO: 373582 - RNA, 18 nt, Human
gcagaggagaagcucaaa

SEQ ID NO: 373583 - RNA, 18 nt, Human
gcaguuggccuggcuucc

SEQ ID NO: 373584 - RNA, 19 nt, Human
gccaugaacuuuucucaau

SEQ ID NO: 373585 - RNA, 21 nt, Human
gcccuuuccaaaaauagaagc

SEQ ID NO: 373586 - RNA, 22 nt, Human
gcugcacccagccagcccagga

SEQ ID NO: 373587 - RNA, 22 nt, Human
ggaaagcuuauaaaaaaucuaa

SEQ ID NO: 373588 - RNA, 23 nt, Human
ggagaccucuggguggagagggc

SEQ ID NO: 373589 - RNA, 18 nt, Human
ggagcgcagcgacgaaga

SEQ ID NO: 373590 - RNA, 19 nt, Human
ggaggaaccugaaggcggg

SEQ ID NO: 373591 - RNA, 20 nt, Human
gggagcgguggugggugggg

SEQ ID NO: 373592 - RNA, 18 nt, Human
gggcaccuuuccagcucc

SEQ ID NO: 373593 - RNA, 18 nt, Human
ggggaaggagggucuggg

SEQ ID NO: 373594 - RNA, 21 nt, Human
gggggccucgggggucccugg

SEQ ID NO: 373595 - RNA, 18 nt, Human
ggggucccuggccgccgc

SEQ ID NO: 373596 - RNA, 21 nt, Human
ggguggggaggggugggggga

SEQ ID NO: 373597 - RNA, 21 nt, Human
gguggggaaggagggucuggg

SEQ ID NO: 373598 - RNA, 21 nt, Human
gucucagggcuuauggggugg

SEQ ID NO: 373599 - RNA, 19 nt, Human
guggagagggcugcgggga

SEQ ID NO: 373600 - RNA, 19 nt, Human
guggggaaggagggucugg

SEQ ID NO: 373601 - RNA, 21 nt, Human
uaaaaaaucuaaaucucugga

SEQ ID NO: 373602 - RNA, 20 nt, Human
uaacacaaagguugccaaac

SEQ ID NO: 373603 - RNA, 19 nt, Human
uaggaggaaccugaaggcg

SEQ ID NO: 373604 - RNA, 20 nt, Human
ucaguaaaugcauccaguac

SEQ ID NO: 373605 - RNA, 26 nt, Human
ucccuggccgccgccgggugggggcc

SEQ ID NO: 373606 - RNA, 21 nt, Human
ucuucuuucccagaaaagccc

SEQ ID NO: 373607 - RNA, 22 nt, Human
ugaaaagagagcugcacccagc

SEQ ID NO: 373608 - RNA, 26 nt, Human
ugaacuuuucucaaucauagcagccc

SEQ ID NO: 373609 - RNA, 21 nt, Human
ugagaucauuacucgcccagu

SEQ ID NO: 373610 - RNA, 24 nt, Human
ugaguggggggcuccgaggguugg

SEQ ID NO: 373611 - RNA, 23 nt, Human
ugcuguaugccgggcacccacag

SEQ ID NO: 373612 - RNA, 20 nt, Human
uggagccccgcacgcccacc

SEQ ID NO: 373613 - RNA, 21 nt, Human
uggcaggaaagcuuauaaaaa

SEQ ID NO: 373614 - RNA, 18 nt, Human
ugggagaacuaggagugu

SEQ ID NO: 373615 - RNA, 24 nt, Human
uggggagggguggggggacucgag

SEQ ID NO: 373616 - RNA, 23 nt, Human
uggggggcuccgaggguuggggc

SEQ ID NO: 373617 - RNA, 18 nt, Human
ugguggguggggaggggu

SEQ ID NO: 373618 - RNA, 18 nt, Human
ugguggguggggaggggu

SEQ ID NO: 373619 - RNA, 21 nt, Human
ugguggguggggagggguggg

SEQ ID NO: 373620 - RNA, 24 nt, Human
uguaugccgggcacccacagcugc

SEQ ID NO: 373621 - RNA, 23 nt, Human
uguuucccucccgacgucugucc

SEQ ID NO: 373622 - RNA, 20 nt, Human
uuucgguacaaauggaggcc

SEQ ID NO: 373623 - RNA, 29 nt, Human
uuuuuugcugccaugaacuuuucucaauu

SEQ ID NO: 373624 - RNA, 18 nt, Human
aagcucccaggcccucuc

SEQ ID NO: 373625 - RNA, 21 nt, Human
acaccagggcuccagggaccc

SEQ ID NO: 373626 - RNA, 19 nt, Human
acccagugcaguggccccg

SEQ ID NO: 373627 - RNA, 20 nt, Human
acccugagcccacagggagg

SEQ ID NO: 373628 - RNA, 20 nt, Human
accucagggccugggcacac

SEQ ID NO: 373629 - RNA, 19 nt, Human
agacaggcaccgccccggg

SEQ ID NO: 373630 - RNA, 21 nt, Human
aggaggggggcggggggccca

SEQ ID NO: 373631 - RNA, 25 nt, Human
aggggaaggaggggggcggggggcc

SEQ ID NO: 373632 - RNA, 25 nt, Human
aggggaaggaggggggcggggggcc

SEQ ID NO: 373633 - RNA, 23 nt, Human
aggggggcggggggcccauggga

SEQ ID NO: 373634 - RNA, 19 nt, Human
cacagcccggcggcgccgc

SEQ ID NO: 373635 - RNA, 21 nt, Human
cacagcccggcggcgccgccu

SEQ ID NO: 373636 - RNA, 21 nt, Human
cagcucccugggcgggguccu

SEQ ID NO: 373637 - RNA, 22 nt, Human
caguccgugguucccauccugg

SEQ ID NO: 373638 - RNA, 18 nt, Human
ccauccuggcucccuguc

SEQ ID NO: 373639 - RNA, 21 nt, Human
ccccggcccccgggcccgcuc

SEQ ID NO: 373640 - RNA, 18 nt, Human
ccccgggcccgcucgccc

SEQ ID NO: 373641 - RNA, 23 nt, Human
cccgcaggagacccugagcccac

SEQ ID NO: 373642 - RNA, 20 nt, Human
cccgcucgcccccgccggcc

SEQ ID NO: 373643 - RNA, 18 nt, Human
cccgggcccgcucgcccc

SEQ ID NO: 373644 - RNA, 28 nt, Human
ccggagagcggcggggccccucucgccc

SEQ ID NO: 373645 - RNA, 20 nt, Human
ccggcccaccucagggccug

SEQ ID NO: 373646 - RNA, 18 nt, Human
ccgggcccgcucgccccc

SEQ ID NO: 373647 - RNA, 18 nt, Human
ccgggcccgcucgccccc

SEQ ID NO: 373648 - RNA, 24 nt, Human
ccuccacagcccggcggcgccgcc

SEQ ID NO: 373649 - RNA, 26 nt, Human
ccuggccucggcccccguccgguucc

SEQ ID NO: 373650 - RNA, 18 nt, Human
cgccgccggccgcgcugc

SEQ ID NO: 373651 - RNA, 24 nt, Human
cgccucguccucgcggcccgggca

SEQ ID NO: 373652 - RNA, 19 nt, Human
cgcggccccggcccccggg

SEQ ID NO: 373653 - RNA, 20 nt, Human
cgcggccccggcccccgggc

SEQ ID NO: 373654 - RNA, 23 nt, Human
cggcccccgggcccgcucgcccc

SEQ ID NO: 373655 - RNA, 22 nt, Human
cgggcccgcucgcccccgccgg

SEQ ID NO: 373656 - RNA, 19 nt, Human
cggguguuggggcuggcag

SEQ ID NO: 373657 - RNA, 22 nt, Human
cuccagggaccccgccugcccu

SEQ ID NO: 373658 - RNA, 20 nt, Human
cucccaggcccucucugugc

SEQ ID NO: 373659 - RNA, 21 nt, Human
cucccaggcccucucugugcc

SEQ ID NO: 373660 - RNA, 20 nt, Human
cucgccgccggccgcgcugc

SEQ ID NO: 373661 - RNA, 20 nt, Human
cucugucggggucucccuca

SEQ ID NO: 373662 - RNA, 21 nt, Human
cugaagcugcagcaagcuccc

SEQ ID NO: 373663 - RNA, 21 nt, Human
cugcagcaagcucccaggccc

SEQ ID NO: 373664 - RNA, 23 nt, Human
cugcagcaagcucccaggcccuc

SEQ ID NO: 373665 - RNA, 24 nt, Human
cugcagcaagcucccaggcccucu

SEQ ID NO: 373666 - RNA, 20 nt, Human
cugugccgcgucugggcugc

SEQ ID NO: 373667 - RNA, 19 nt, Human
gacugugggguucagggag

SEQ ID NO: 373668 - RNA, 20 nt, Human
gacugugggguucagggagg

SEQ ID NO: 373669 - RNA, 18 nt, Human
gagggguggucccugauc

SEQ ID NO: 373670 - RNA, 24 nt, Human
gccccgggacucgccgcuccacac

SEQ ID NO: 373671 - RNA, 21 nt, Human
gcccggacggccucccgcucc

SEQ ID NO: 373672 - RNA, 20 nt, Human
gccgcgcugcccggacggcc

SEQ ID NO: 373673 - RNA, 18 nt, Human
gcggggggcccaugggaa

SEQ ID NO: 373674 - RNA, 18 nt, Human
gcugccacucccaggucc

SEQ ID NO: 373675 - RNA, 21 nt, Human
gcugguucacagcccgccugg

SEQ ID NO: 373676 - RNA, 19 nt, Human
ggccaggcggacugugggg

SEQ ID NO: 373677 - RNA, 19 nt, Human
ggccucggcccccgucggg

SEQ ID NO: 373678 - RNA, 21 nt, Human
ggcgccgccucguccucgcgg

SEQ ID NO: 373679 - RNA, 26 nt, Human
gggcagcgcggccccggcccccgggc

SEQ ID NO: 373680 - RNA, 23 nt, Human
gggcgggguccugagauucuggc

SEQ ID NO: 373681 - RNA, 21 nt, Human
ggggggcggggggcccauggg

SEQ ID NO: 373682 - RNA, 22 nt, Human
guccgucugugcacagccccug

SEQ ID NO: 373683 - RNA, 21 nt, Human
gucggguguuggggcuggcag

SEQ ID NO: 373684 - RNA, 22 nt, Human
gucggguguuggggcuggcagg

SEQ ID NO: 373685 - RNA, 20 nt, Human
guucagggaggggaaggagg

SEQ ID NO: 373686 - RNA, 21 nt, Human
uccacaccagggcuccaggga

SEQ ID NO: 373687 - RNA, 22 nt, Human
uccacaccagggcuccagggac

SEQ ID NO: 373688 - RNA, 20 nt, Human
ucccagguccggcccaccuc

SEQ ID NO: 373689 - RNA, 25 nt, Human
ucccucauaaagugcgugugggggu

SEQ ID NO: 373690 - RNA, 20 nt, Human
ucccugggcgggguccugag

SEQ ID NO: 373691 - RNA, 20 nt, Human
uccggcccaccucagggccu

SEQ ID NO: 373692 - RNA, 23 nt, Human
ucucccucauaaagugcgugugg

SEQ ID NO: 373693 - RNA, 21 nt, Human
ucuucugagacaggcaccgcc

SEQ ID NO: 373694 - RNA, 26 nt, Human
ugacacccagauuugguuuugcggac

SEQ ID NO: 373695 - RNA, 23 nt, Human
ugagacaggcaccgccccgggac

SEQ ID NO: 373696 - RNA, 25 nt, Human
ugagacaggcaccgccccgggacuc

SEQ ID NO: 373697 - RNA, 21 nt, Human
ugagcccugggcuggcagcuc

SEQ ID NO: 373698 - RNA, 23 nt, Human
ugagcccugggcuggcagcuccc

SEQ ID NO: 373699 - RNA, 19 nt, Human
uggccaggcggacuguggg

SEQ ID NO: 373700 - RNA, 26 nt, Human
uggcggccaggaggucuggccaggcg

SEQ ID NO: 373701 - RNA, 22 nt, Human
uggcugccacucccagguccgg

SEQ ID NO: 373702 - RNA, 21 nt, Human
ugggaagcugagcccugggcu

SEQ ID NO: 373703 - RNA, 26 nt, Human
ugggaagcugagcccugggcuggcag

SEQ ID NO: 373704 - RNA, 27 nt, Human
ugggguucagggaggggaaggaggggg

SEQ ID NO: 373705 - RNA, 20 nt, Human
ugguucccauccuggcuccc

SEQ ID NO: 373706 - RNA, 21 nt, Human
ugguuuugcggacagagcucc

SEQ ID NO: 373707 - RNA, 19 nt, Human
uguuggggcuggcagguga

SEQ ID NO: 373708 - RNA, 24 nt, Human
uuggccucugacacccagauuugg

SEQ ID NO: 373709 - RNA, 20 nt, Human
aaacaaauacaucacuaagg

SEQ ID NO: 373710 - RNA, 20 nt, Human
aaacaaauacaucacuaagg

SEQ ID NO: 373711 - RNA, 20 nt, Human
aaacaaauacaucacuaagg

SEQ ID NO: 373712 - RNA, 18 nt, Human
aaacaacccagagaaaca

SEQ ID NO: 373713 - RNA, 20 nt, Human
aaacaauauaaacauaccaa

SEQ ID NO: 373714 - RNA, 20 nt, Human
aaacaauauaaacauaccaa

SEQ ID NO: 373715 - RNA, 20 nt, Human
aaacaauauaaacauaccaa

SEQ ID NO: 373716 - RNA, 23 nt, Human
aaacaauauaaacauaccaaaac

SEQ ID NO: 373717 - RNA, 23 nt, Human
aaacaauauaaacauaccaaaac

SEQ ID NO: 373718 - RNA, 23 nt, Human
aaacaauauaaacauaccaaaac

SEQ ID NO: 373719 - RNA, 21 nt, Human
aaagguacagauacagagaua

SEQ ID NO: 373720 - RNA, 22 nt, Human
aacaccuccuccauucaaacga

SEQ ID NO: 373721 - RNA, 21 nt, Human
aacaugcucauggcuucaaga

SEQ ID NO: 373722 - RNA, 23 nt, Human
aacuccuccucgcuaguccucca

SEQ ID NO: 373723 - RNA, 20 nt, Human
aagagaaaauguuugcgaug

SEQ ID NO: 373724 - RNA, 23 nt, Human
aagaugcucacaucaaccuacaa

SEQ ID NO: 373725 - RNA, 25 nt, Human
aagaugcucacaucaaccuacaaug

SEQ ID NO: 373726 - RNA, 22 nt, Human
aaggcuaucugacaaacaaccc

SEQ ID NO: 373727 - RNA, 20 nt, Human
aagggaauggaguaccaagg

SEQ ID NO: 373728 - RNA, 18 nt, Human
aaguggcauuagccauga

SEQ ID NO: 373729 - RNA, 18 nt, Human
aaguggcauuagccauga

SEQ ID NO: 373730 - RNA, 18 nt, Human
aaguggcauuagccauga

SEQ ID NO: 373731 - RNA, 20 nt, Human
aauauaaacauaccaaaacc

SEQ ID NO: 373732 - RNA, 20 nt, Human
aauauaaacauaccaaaacc

SEQ ID NO: 373733 - RNA, 20 nt, Human
aauauaaacauaccaaaacc

SEQ ID NO: 373734 - RNA, 25 nt, Human
acaaagauacagauauauauauaua

SEQ ID NO: 373735 - RNA, 21 nt, Human
acaacauuaaagaggaaauac

SEQ ID NO: 373736 - RNA, 21 nt, Human
acaacauuaaagaggaaauac

SEQ ID NO: 373737 - RNA, 18 nt, Human
acacaggauguuugccug

SEQ ID NO: 373738 - RNA, 18 nt, Human
acacaggauguuugccug

SEQ ID NO: 373739 - RNA, 19 nt, Human
acagagauacauacaaaga

SEQ ID NO: 373740 - RNA, 20 nt, Human
acagcaaagguacagauaca

SEQ ID NO: 373741 - RNA, 18 nt, Human
acaguaagaaaccaucau

SEQ ID NO: 373742 - RNA, 20 nt, Human
acccuaaaaauuaacauaaa

SEQ ID NO: 373743 - RNA, 21 nt, Human
acccuaaaaauuaacauaaac

SEQ ID NO: 373744 - RNA, 21 nt, Human
acccuaaaaauuaacauaaac

SEQ ID NO: 373745 - RNA, 25 nt, Human
accuacaaugaccuuuuccaaucca

SEQ ID NO: 373746 - RNA, 19 nt, Human
accucaauaacacuggccc

SEQ ID NO: 373747 - RNA, 19 nt, Human
accucaauaacacuggccc

SEQ ID NO: 373748 - RNA, 19 nt, Human
accucaauaacacuggccc

SEQ ID NO: 373749 - RNA, 23 nt, Human
accucaauaacacuggcccauua

SEQ ID NO: 373750 - RNA, 23 nt, Human
accucaauaacacuggcccauua

SEQ ID NO: 373751 - RNA, 23 nt, Human
accucaauaacacuggcccauua

SEQ ID NO: 373752 - RNA, 20 nt, Human
acuaagguaaacaauauaaa

SEQ ID NO: 373753 - RNA, 19 nt, Human
acucaacaccuccuccauu

SEQ ID NO: 373754 - RNA, 20 nt, Human
agaaacaguaagaaaccauc

SEQ ID NO: 373755 - RNA, 20 nt, Human
agagaaguucccagaccucu

SEQ ID NO: 373756 - RNA, 20 nt, Human
agagaaguucccagaccucu

SEQ ID NO: 373757 - RNA, 20 nt, Human
agagauguccacaggcucug

SEQ ID NO: 373758 - RNA, 23 nt, Human
agaggggaaggagaagggaaugg

SEQ ID NO: 373759 - RNA, 22 nt, Human
agcucuauuuaacaugcucaug

SEQ ID NO: 373760 - RNA, 19 nt, Human
aggaaugcaggacuuagug

SEQ ID NO: 373761 - RNA, 19 nt, Human
aggaaugcaggacuuagug

SEQ ID NO: 373762 - RNA, 19 nt, Human
agggaauucuuuuguuaau

SEQ ID NO: 373763 - RNA, 21 nt, Human
auacuaaauguacuggccucu

SEQ ID NO: 373764 - RNA, 21 nt, Human
auacuaaauguacuggccucu

SEQ ID NO: 373765 - RNA, 21 nt, Human
auacuaaauguacuggccucu

SEQ ID NO: 373766 - RNA, 21 nt, Human
augaaauauucuaucagaccc

SEQ ID NO: 373767 - RNA, 21 nt, Human
augaaauauucuaucagaccc

SEQ ID NO: 373768 - RNA, 21 nt, Human
augaaauauucuaucagaccc

SEQ ID NO: 373769 - RNA, 18 nt, Human
auuagggcuggcaaagcu

SEQ ID NO: 373770 - RNA, 21 nt, Human
auuagggcuggcaaagcuggg

SEQ ID NO: 373771 - RNA, 21 nt, Human
auuagggcuggcaaagcuggg

SEQ ID NO: 373772 - RNA, 21 nt, Human
auuagggcuggcaaagcuggg

SEQ ID NO: 373773 - RNA, 21 nt, Human
caaauacaucacuaagguaaa

SEQ ID NO: 373774 - RNA, 21 nt, Human
caaauacaucacuaagguaaa

SEQ ID NO: 373775 - RNA, 21 nt, Human
caaauacaucacuaagguaaa

SEQ ID NO: 373776 - RNA, 20 nt, Human
caacauuaaagaggaaauac

SEQ ID NO: 373777 - RNA, 20 nt, Human
caacauuaaagaggaaauac

SEQ ID NO: 373778 - RNA, 20 nt, Human
caacauuaaagaggaaauac

SEQ ID NO: 373779 - RNA, 22 nt, Human
caaccuacaaugaccuuuucca

SEQ ID NO: 373780 - RNA, 22 nt, Human
caacuauagccccguggaaauu

SEQ ID NO: 373781 - RNA, 20 nt, Human
caagugcccguucacucauu

SEQ ID NO: 373782 - RNA, 22 nt, Human
caauauaaacauaccaaaaccc

SEQ ID NO: 373783 - RNA, 22 nt, Human
caauauaaacauaccaaaaccc

SEQ ID NO: 373784 - RNA, 22 nt, Human
caauauaaacauaccaaaaccc

SEQ ID NO: 373785 - RNA, 21 nt, Human
caaugggcuauguacccaaga

SEQ ID NO: 373786 - RNA, 22 nt, Human
caccaguauuggccaacuguuc

SEQ ID NO: 373787 - RNA, 18 nt, Human
caggugguugccaccuuc

SEQ ID NO: 373788 - RNA, 22 nt, Human
caggugguugccaccuucuuuu

SEQ ID NO: 373789 - RNA, 22 nt, Human
caggugguugccaccuucuuuu

SEQ ID NO: 373790 - RNA, 24 nt, Human
caucacuaagguaaacaauauaaa

SEQ ID NO: 373791 - RNA, 24 nt, Human
caucacuaagguaaacaauauaaa

SEQ ID NO: 373792 - RNA, 19 nt, Human
cauuagcccuguggaacag

SEQ ID NO: 373793 - RNA, 19 nt, Human
cauuagcccuguggaacag

SEQ ID NO: 373794 - RNA, 20 nt, Human
cauuaucuguccagcagaac

SEQ ID NO: 373795 - RNA, 20 nt, Human
cauuaucuguccagcagaac

SEQ ID NO: 373796 - RNA, 20 nt, Human
cauuaucuguccagcagaac

SEQ ID NO: 373797 - RNA, 19 nt, Human
cauugcuguagagaugucc

SEQ ID NO: 373798 - RNA, 22 nt, Human
cauuuuaaugggguuguuuuga

SEQ ID NO: 373799 - RNA, 20 nt, Human
ccacaggaacccauucucca

SEQ ID NO: 373800 - RNA, 21 nt, Human
ccacuguaauacacaugaaau

SEQ ID NO: 373801 - RNA, 21 nt, Human
ccacuguaauacacaugaaau

SEQ ID NO: 373802 - RNA, 21 nt, Human
ccacuguaauacacaugaaau

SEQ ID NO: 373803 - RNA, 18 nt, Human
ccauucuccauaaacacu

SEQ ID NO: 373804 - RNA, 18 nt, Human
cccagaaaauaaaacacc

SEQ ID NO: 373805 - RNA, 18 nt, Human
cccagaaaauaaaacacc

SEQ ID NO: 373806 - RNA, 18 nt, Human
cccagaaaauaaaacacc

SEQ ID NO: 373807 - RNA, 20 nt, Human
cccagaaaauaaaacaccac

SEQ ID NO: 373808 - RNA, 20 nt, Human
cccagaaaauaaaacaccac

SEQ ID NO: 373809 - RNA, 20 nt, Human
cccagaaaauaaaacaccac

SEQ ID NO: 373810 - RNA, 24 nt, Human
cccauuccuccaguuaccggggcu

SEQ ID NO: 373811 - RNA, 24 nt, Human
cccauuccuccaguuaccggggcu

SEQ ID NO: 373812 - RNA, 20 nt, Human
ccucaaucuaucuacgugag

SEQ ID NO: 373813 - RNA, 20 nt, Human
ccucaaucuaucuacgugag

SEQ ID NO: 373814 - RNA, 20 nt, Human
ccucaaucuaucuacgugag

SEQ ID NO: 373815 - RNA, 21 nt, Human
ccuucuccuucucuccagccc

SEQ ID NO: 373816 - RNA, 19 nt, Human
cuccgaucaaucccuccac

SEQ ID NO: 373817 - RNA, 18 nt, Human
cuccucagucaguuuggc

SEQ ID NO: 373818 - RNA, 22 nt, Human
cuccucgcuaguccuccaggcu

SEQ ID NO: 373819 - RNA, 20 nt, Human
cuuuuugguggaguugguuu

SEQ ID NO: 373820 - RNA, 19 nt, Human
gaaggagaagggaauggag

SEQ ID NO: 373821 - RNA, 21 nt, Human
gaaggggaguuacaucauagu

SEQ ID NO: 373822 - RNA, 21 nt, Human
gaaggggaguuacaucauagu

SEQ ID NO: 373823 - RNA, 21 nt, Human
gaaggggaguuacaucauagu

SEQ ID NO: 373824 - RNA, 22 nt, Human
gacacuuggcauuauuaagaua

SEQ ID NO: 373825 - RNA, 19 nt, Human
gcaaagaggggaaggagaa

SEQ ID NO: 373826 - RNA, 20 nt, Human
gcaaagaggggaaggagaag

SEQ ID NO: 373827 - RNA, 28 nt, Human
gccaccuucuuuuauuacagaucuccau

SEQ ID NO: 373828 - RNA, 28 nt, Human
gccaccuucuuuuauuacagaucuccau

SEQ ID NO: 373829 - RNA, 22 nt, Human
gcccucuccgaucaaucccucc

SEQ ID NO: 373830 - RNA, 18 nt, Human
gcggcauuuuaauggggu

SEQ ID NO: 373831 - RNA, 18 nt, Human
ggaaugcaggacuuagug

SEQ ID NO: 373832 - RNA, 18 nt, Human
ggaaugcaggacuuagug

SEQ ID NO: 373833 - RNA, 18 nt, Human
ggaaugcaggacuuagug

SEQ ID NO: 373834 - RNA, 18 nt, Human
gggaauggaguaccaagg

SEQ ID NO: 373835 - RNA, 20 nt, Human
gggaauucuuuuguuaaugu

SEQ ID NO: 373836 - RNA, 22 nt, Human
gggccuuaagcuuuugaaaaua

SEQ ID NO: 373837 - RNA, 22 nt, Human
gggccuuaagcuuuugaaaaua

SEQ ID NO: 373838 - RNA, 22 nt, Human
gggccuuaagcuuuugaaaaua

SEQ ID NO: 373839 - RNA, 23 nt, Human
guaaacaauauaaacauaccaaa

SEQ ID NO: 373840 - RNA, 23 nt, Human
guaaacaauauaaacauaccaaa

SEQ ID NO: 373841 - RNA, 23 nt, Human
guaaacaauauaaacauaccaaa

SEQ ID NO: 373842 - RNA, 18 nt, Human
gugcacagcccuucacug

SEQ ID NO: 373843 - RNA, 18 nt, Human
gugcacagcccuucacug

SEQ ID NO: 373844 - RNA, 18 nt, Human
gugcacagcccuucacug

SEQ ID NO: 373845 - RNA, 26 nt, Human
guguugcucacucaacaccuccucca

SEQ ID NO: 373846 - RNA, 25 nt, Human
uaacaggaaugcaggacuuagugcu

SEQ ID NO: 373847 - RNA, 25 nt, Human
uaacaggaaugcaggacuuagugcu

SEQ ID NO: 373848 - RNA, 25 nt, Human
uaacaggaaugcaggacuuagugcu

SEQ ID NO: 373849 - RNA, 24 nt, Human
uaagaaaccaucauuaagggcaau

SEQ ID NO: 373850 - RNA, 25 nt, Human
uaagaaaccaucauuaagggcaaug

SEQ ID NO: 373851 - RNA, 24 nt, Human
uaagcgcuuccauuuaucaauacc

SEQ ID NO: 373852 - RNA, 23 nt, Human
uacacaaugucuuaaauugccaa

SEQ ID NO: 373853 - RNA, 23 nt, Human
uacacaaugucuuaaauugccaa

SEQ ID NO: 373854 - RNA, 23 nt, Human
uacacaaugucuuaaauugccaa

SEQ ID NO: 373855 - RNA, 18 nt, Human
uacagcaaagguacagau

SEQ ID NO: 373856 - RNA, 26 nt, Human
uaccacuuucuuuuuagaaccucuac

SEQ ID NO: 373857 - RNA, 26 nt, Human
uaccacuuucuuuuuagaaccucuac

SEQ ID NO: 373858 - RNA, 26 nt, Human
uaccacuuucuuuuuagaaccucuac

SEQ ID NO: 373859 - RNA, 22 nt, Human
uaccggggcugcucuuaagaac

SEQ ID NO: 373860 - RNA, 19 nt, Human
uagcaaagaggggaaggag

SEQ ID NO: 373861 - RNA, 22 nt, Human
uagccuagccauaaggaagggg

SEQ ID NO: 373862 - RNA, 22 nt, Human
uagccuagccauaaggaagggg

SEQ ID NO: 373863 - RNA, 22 nt, Human
uagccuagccauaaggaagggg

SEQ ID NO: 373864 - RNA, 26 nt, Human
uauauauauauauuuacauauauaua

SEQ ID NO: 373865 - RNA, 23 nt, Human
uauauauauuuacauauauauac

SEQ ID NO: 373866 - RNA, 22 nt, Human
uauauauuuacauauauauaca

SEQ ID NO: 373867 - RNA, 22 nt, Human
uauauauuuacauauauauaca

SEQ ID NO: 373868 - RNA, 24 nt, Human
uauaucacaacucaaugccauacu

SEQ ID NO: 373869 - RNA, 24 nt, Human
uauaucacaacucaaugccauacu

SEQ ID NO: 373870 - RNA, 24 nt, Human
uauaucacaacucaaugccauacu

SEQ ID NO: 373871 - RNA, 23 nt, Human
uaucacaacucaaugccauacua

SEQ ID NO: 373872 - RNA, 23 nt, Human
uaucacaacucaaugccauacua

SEQ ID NO: 373873 - RNA, 23 nt, Human
uaucacaacucaaugccauacua

SEQ ID NO: 373874 - RNA, 19 nt, Human
uauuagggcuggcaaagcu

SEQ ID NO: 373875 - RNA, 19 nt, Human
uauuagggcuggcaaagcu

SEQ ID NO: 373876 - RNA, 19 nt, Human
ucaaacgaaccgucccacu

SEQ ID NO: 373877 - RNA, 25 nt, Human
ucaaagcagacacaggauguuugcc

SEQ ID NO: 373878 - RNA, 25 nt, Human
ucaaagcagacacaggauguuugcc

SEQ ID NO: 373879 - RNA, 20 nt, Human
ucauccgaaacaugagguuu

SEQ ID NO: 373880 - RNA, 19 nt, Human
ucauuaagggcaaugggcu

SEQ ID NO: 373881 - RNA, 22 nt, Human
uccuucuccuucucuccagccc

SEQ ID NO: 373882 - RNA, 20 nt, Human
ucuagucagacuucauuuuu

SEQ ID NO: 373883 - RNA, 20 nt, Human
ucuagucagacuucauuuuu

SEQ ID NO: 373884 - RNA, 20 nt, Human
ucuagucagacuucauuuuu

SEQ ID NO: 373885 - RNA, 21 nt, Human
ugaaauauucuaucagacccu

SEQ ID NO: 373886 - RNA, 21 nt, Human
ugaaauauucuaucagacccu

SEQ ID NO: 373887 - RNA, 21 nt, Human
ugaaauauucuaucagacccu

SEQ ID NO: 373888 - RNA, 21 nt, Human
ugaagcaaguggcauuagcca

SEQ ID NO: 373889 - RNA, 21 nt, Human
ugaagcaaguggcauuagcca

SEQ ID NO: 373890 - RNA, 21 nt, Human
ugaagcaaguggcauuagcca

SEQ ID NO: 373891 - RNA, 21 nt, Human
ugacaaacaacccagagaaac

SEQ ID NO: 373892 - RNA, 22 nt, Human
ugacaaacaacccagagaaaca

SEQ ID NO: 373893 - RNA, 21 nt, Human
ugacccaaguggcuuuaacag

SEQ ID NO: 373894 - RNA, 21 nt, Human
ugacccaaguggcuuuaacag

SEQ ID NO: 373895 - RNA, 21 nt, Human
ugacccaaguggcuuuaacag

SEQ ID NO: 373896 - RNA, 22 nt, Human
ugagauccagaugauacaggga

SEQ ID NO: 373897 - RNA, 24 nt, Human
ugaucaccucaauaacacuggccc

SEQ ID NO: 373898 - RNA, 24 nt, Human
ugaucaccucaauaacacuggccc

SEQ ID NO: 373899 - RNA, 24 nt, Human
ugaucaccucaauaacacuggccc

SEQ ID NO: 373900 - RNA, 23 nt, Human
ugaugcagaguaaaauucugaaa

SEQ ID NO: 373901 - RNA, 23 nt, Human
ugaugcagaguaaaauucugaaa

SEQ ID NO: 373902 - RNA, 23 nt, Human
ugaugcagaguaaaauucugaaa

SEQ ID NO: 373903 - RNA, 20 nt, Human
ugauuacaggcaaguguuaa

SEQ ID NO: 373904 - RNA, 20 nt, Human
ugauuacaggcaaguguuaa

SEQ ID NO: 373905 - RNA, 20 nt, Human
ugauuacaggcaaguguuaa

SEQ ID NO: 373906 - RNA, 19 nt, Human
uggaguugguuuugcugca

SEQ ID NO: 373907 - RNA, 24 nt, Human
ugggcaccaguauuggccaacugu

SEQ ID NO: 373908 - RNA, 19 nt, Human
uggguuccuuauugccuuc

SEQ ID NO: 373909 - RNA, 19 nt, Human
uggguuccuuauugccuuc

SEQ ID NO: 373910 - RNA, 22 nt, Human
uguaugguuaaauacaauuucc

SEQ ID NO: 373911 - RNA, 22 nt, Human
uguaugguuaaauacaauuucc

SEQ ID NO: 373912 - RNA, 22 nt, Human
uguaugguuaaauacaauuucc

SEQ ID NO: 373913 - RNA, 21 nt, Human
uguccagcagaacccauugug

SEQ ID NO: 373914 - RNA, 21 nt, Human
uguccagcagaacccauugug

SEQ ID NO: 373915 - RNA, 21 nt, Human
uguccagcagaacccauugug

SEQ ID NO: 373916 - RNA, 26 nt, Human
uguggaacagaucuugaucaccucaa

SEQ ID NO: 373917 - RNA, 26 nt, Human
uguggaacagaucuugaucaccucaa

SEQ ID NO: 373918 - RNA, 26 nt, Human
uguggaacagaucuugaucaccucaa

SEQ ID NO: 373919 - RNA, 24 nt, Human
uguuacaguagccuagccauaagg

SEQ ID NO: 373920 - RNA, 24 nt, Human
uguuacaguagccuagccauaagg

SEQ ID NO: 373921 - RNA, 24 nt, Human
uguuacaguagccuagccauaagg

SEQ ID NO: 373922 - RNA, 24 nt, Human
uguugcucacucaacaccuccucc

SEQ ID NO: 373923 - RNA, 20 nt, Human
uuaaaagggccaagguagca

SEQ ID NO: 373924 - RNA, 22 nt, Human
uuaauccaggcuugggcaccag

SEQ ID NO: 373925 - RNA, 24 nt, Human
uucaugugcacuauauuuagcagc

SEQ ID NO: 373926 - RNA, 22 nt, Human
uuccaugguacaaaaaucaaag

SEQ ID NO: 373927 - RNA, 22 nt, Human
uuccaugguacaaaaaucaaag

SEQ ID NO: 373928 - RNA, 22 nt, Human
uuccaugguacaaaaaucaaag

SEQ ID NO: 373929 - RNA, 22 nt, Human
uugcucacucaacaccuccucc

SEQ ID NO: 373930 - RNA, 18 nt, Human
uuuaacuuucucauaguc

SEQ ID NO: 373931 - RNA, 20 nt, Human
uuuaacuuucucauagucaa

SEQ ID NO: 373932 - RNA, 20 nt, Human
uuuaacuuucucauagucaa

SEQ ID NO: 373933 - RNA, 19 nt, Human
uuucuucaccauuuuucuc

SEQ ID NO: 373934 - RNA, 20 nt, Human
uuuuacacaaugucuuaaau

SEQ ID NO: 373935 - RNA, 20 nt, Human
uuuuacacaaugucuuaaau

SEQ ID NO: 373936 - RNA, 20 nt, Human
uuuuacacaaugucuuaaau

SEQ ID NO: 373937 - RNA, 21 nt, Human
aaagaccaggaaacacauuag

SEQ ID NO: 373938 - RNA, 22 nt, Human
aaagacgggcaaauuggugagg

SEQ ID NO: 373939 - RNA, 26 nt, Human
aaaucuguaggugaguuauuuggaau

SEQ ID NO: 373940 - RNA, 22 nt, Human
aacacaacacuucucugucccu

SEQ ID NO: 373941 - RNA, 23 nt, Human
aaccuguauaaacauuucagcau

SEQ ID NO: 373942 - RNA, 20 nt, Human
aagcucacccccuccaguuc

SEQ ID NO: 373943 - RNA, 20 nt, Human
aaggaguuuggggcuugccu

SEQ ID NO: 373944 - RNA, 20 nt, Human
acaacaacaacaacaaaaaa

SEQ ID NO: 373945 - RNA, 19 nt, Human
acaauggcuauuuuugugc

SEQ ID NO: 373946 - RNA, 21 nt, Human
acaggggccucucucuucuga

SEQ ID NO: 373947 - RNA, 19 nt, Human
acccaaaauaaugaaauua

SEQ ID NO: 373948 - RNA, 21 nt, Human
acccugguuacuaccguuugu

SEQ ID NO: 373949 - RNA, 23 nt, Human
acugcagauaaauaggacugcaa

SEQ ID NO: 373950 - RNA, 23 nt, Human
agaaaacagacauaaccuaucug

SEQ ID NO: 373951 - RNA, 27 nt, Human
agaaaacagacauaaccuaucugcuug

SEQ ID NO: 373952 - RNA, 21 nt, Human
agacaaaagagcaauuggaaa

SEQ ID NO: 373953 - RNA, 21 nt, Human
agaccguaaaacaacaacaac

SEQ ID NO: 373954 - RNA, 19 nt, Human
aggcacaggcauugaaaac

SEQ ID NO: 373955 - RNA, 19 nt, Human
agugugaaugaauuagugg

SEQ ID NO: 373956 - RNA, 27 nt, Human
auaggacugcaaaaaccaaaaacccaa

SEQ ID NO: 373957 - RNA, 21 nt, Human
aucaggugccucaguuuugcc

SEQ ID NO: 373958 - RNA, 21 nt, Human
augaacuacccucagacaaag

SEQ ID NO: 373959 - RNA, 25 nt, Human
auuucuggcuaacucugcuccugga

SEQ ID NO: 373960 - RNA, 19 nt, Human
caaaaaccaaaaacccaaa

SEQ ID NO: 373961 - RNA, 19 nt, Human
caacaaaaaaaaaaaaaca

SEQ ID NO: 373962 - RNA, 24 nt, Human
caagccagaaaagaaaacuuagca

SEQ ID NO: 373963 - RNA, 20 nt, Human
cagcagcugaggcacaggcc

SEQ ID NO: 373964 - RNA, 22 nt, Human
cagcaggcugaaugcaucaggu

SEQ ID NO: 373965 - RNA, 18 nt, Human
caggaaacacauuagcca

SEQ ID NO: 373966 - RNA, 18 nt, Human
caggggagcugagaaaug

SEQ ID NO: 373967 - RNA, 23 nt, Human
caggucagauuacccaagaagug

SEQ ID NO: 373968 - RNA, 20 nt, Human
cauuucuaaaagccaaggau

SEQ ID NO: 373969 - RNA, 21 nt, Human
ccagaaaaacacaagccagaa

SEQ ID NO: 373970 - RNA, 22 nt, Human
ccagaaaaacacaagccagaaa

SEQ ID NO: 373971 - RNA, 19 nt, Human
cccacaaagaacagacguc

SEQ ID NO: 373972 - RNA, 20 nt, Human
cccacaaagaacagacgucc

SEQ ID NO: 373973 - RNA, 22 nt, Human
ccccacaaagaacagacguccu

SEQ ID NO: 373974 - RNA, 21 nt, Human
cccccacaaagaacagacguc

SEQ ID NO: 373975 - RNA, 24 nt, Human
ccccuuccauucaaauuuuuaaaa

SEQ ID NO: 373976 - RNA, 22 nt, Human
ccgccaguuaguugcacuugcu

SEQ ID NO: 373977 - RNA, 21 nt, Human
ccuaccaccuagaauugcuac

SEQ ID NO: 373978 - RNA, 19 nt, Human
ccuuuacccccuuccauuc

SEQ ID NO: 373979 - RNA, 24 nt, Human
cguaaaacaacaacaacaacaaaa

SEQ ID NO: 373980 - RNA, 20 nt, Human
cguacacaacccuaccaccu

SEQ ID NO: 373981 - RNA, 23 nt, Human
cuaacucugcuccuggacuaugc

SEQ ID NO: 373982 - RNA, 20 nt, Human
cuaagauggguauuugugac

SEQ ID NO: 373983 - RNA, 24 nt, Human
cuccaauaaaaauaaucuccaugg

SEQ ID NO: 373984 - RNA, 21 nt, Human
cucccagaagcggcuaaguaa

SEQ ID NO: 373985 - RNA, 21 nt, Human
cucuguuuccccauccacacc

SEQ ID NO: 373986 - RNA, 21 nt, Human
cugaccuccagcagcguuaca

SEQ ID NO: 373987 - RNA, 19 nt, Human
cugcagauaaauaggacug

SEQ ID NO: 373988 - RNA, 19 nt, Human
cugcugguaguggcagaau

SEQ ID NO: 373989 - RNA, 25 nt, Human
cuggaaaauauuccaaguauuucca

SEQ ID NO: 373990 - RNA, 21 nt, Human
cuggagccacggcaaacccug

SEQ ID NO: 373991 - RNA, 19 nt, Human
cuggggcucugaacugcuc

SEQ ID NO: 373992 - RNA, 20 nt, Human
cuguauuugucucacucagg

SEQ ID NO: 373993 - RNA, 23 nt, Human
cuugaagccuucaggcucaauga

SEQ ID NO: 373994 - RNA, 25 nt, Human
gagaccguaaaacaacaacaacaac

SEQ ID NO: 373995 - RNA, 19 nt, Human
gagcuuggauguguaucug

SEQ ID NO: 373996 - RNA, 21 nt, Human
gaucagcuggcuccaggggag

SEQ ID NO: 373997 - RNA, 23 nt, Human
gaugcaaauuuuaacacaagauu

SEQ ID NO: 373998 - RNA, 19 nt, Human
gcaaaaaccaaaaacccaa

SEQ ID NO: 373999 - RNA, 19 nt, Human
gccacagggcuuccugacu

SEQ ID NO: 374000 - RNA, 19 nt, Human
gccacggcaaacccugggc

SEQ ID NO: 374001 - RNA, 21 nt, Human
gccagaguacauugguguaug

SEQ ID NO: 374002 - RNA, 23 nt, Human
gccucuguuuccccauccacacc

SEQ ID NO: 374003 - RNA, 19 nt, Human
ggacagaguugugaccaag

SEQ ID NO: 374004 - RNA, 18 nt, Human
ggaggggaggggaaaggc

SEQ ID NO: 374005 - RNA, 20 nt, Human
gggagaaagugaggguacug

SEQ ID NO: 374006 - RNA, 18 nt, Human
ggggaugggaagcugaug

SEQ ID NO: 374007 - RNA, 18 nt, Human
gguacuguggcugucugg

SEQ ID NO: 374008 - RNA, 23 nt, Human
guuaccuuuccuccccaauagaa

SEQ ID NO: 374009 - RNA, 22 nt, Human
uaaaacaacaacaacaacaaaa

SEQ ID NO: 374010 - RNA, 24 nt, Human
uaaaacaacaacaacaacaaaaaa

SEQ ID NO: 374011 - RNA, 18 nt, Human
uaaaugaaucacugaaca

SEQ ID NO: 374012 - RNA, 23 nt, Human
uaaauuuuaacacuuuacaaugg

SEQ ID NO: 374013 - RNA, 21 nt, Human
uaaguaaauacaauuugcuuc

SEQ ID NO: 374014 - RNA, 25 nt, Human
uacaauggcuauuuuugugcuaaaa

SEQ ID NO: 374015 - RNA, 19 nt, Human
uacagggaguagaucugga

SEQ ID NO: 374016 - RNA, 19 nt, Human
uacccccuuccauucaaag

SEQ ID NO: 374017 - RNA, 26 nt, Human
uaccuguaaagacucuagacuuuggg

SEQ ID NO: 374018 - RNA, 20 nt, Human
uacuuuaaauuaauugguua

SEQ ID NO: 374019 - RNA, 19 nt, Human
uagcaauaggacuuaauac

SEQ ID NO: 374020 - RNA, 21 nt, Human
uagcucagacugaccuccagc

SEQ ID NO: 374021 - RNA, 18 nt, Human
uaggaucccuccagggaa

SEQ ID NO: 374022 - RNA, 19 nt, Human
uaguggcaguuucuuuccu

SEQ ID NO: 374023 - RNA, 19 nt, Human
ucaaugauugagaugggag

SEQ ID NO: 374024 - RNA, 19 nt, Human
ucaauucuuuuugcucagc

SEQ ID NO: 374025 - RNA, 19 nt, Human
ucacaacccugguuacuac

SEQ ID NO: 374026 - RNA, 25 nt, Human
ucacaggggccucucucuucugauc

SEQ ID NO: 374027 - RNA, 20 nt, Human
ucagcagguugagugaggga

SEQ ID NO: 374028 - RNA, 18 nt, Human
ucccagaaaaacacaagc

SEQ ID NO: 374029 - RNA, 19 nt, Human
uccguacacaacccuacca

SEQ ID NO: 374030 - RNA, 21 nt, Human
ucgguucaugaaugaugcuuc

SEQ ID NO: 374031 - RNA, 24 nt, Human
ucuaaggcuggggcagcaggaggc

SEQ ID NO: 374032 - RNA, 21 nt, Human
ucuacccagaaagcucacccc

SEQ ID NO: 374033 - RNA, 20 nt, Human
ucugcaacuggggcucugaa

SEQ ID NO: 374034 - RNA, 19 nt, Human
ugaaugaugcuuccuccuc

SEQ ID NO: 374035 - RNA, 21 nt, Human
ugaaugcaucaggugccucag

SEQ ID NO: 374036 - RNA, 23 nt, Human
ugaauuggacagaguugugacca

SEQ ID NO: 374037 - RNA, 19 nt, Human
ugaccaagcagcccgggcg

SEQ ID NO: 374038 - RNA, 20 nt, Human
ugaccaagcagcccgggcgu

SEQ ID NO: 374039 - RNA, 24 nt, Human
ugagaacaggauuugaaagaacaa

SEQ ID NO: 374040 - RNA, 19 nt, Human
ugaggcacaggcauugaaa

SEQ ID NO: 374041 - RNA, 22 nt, Human
ugaggcacaggcauugaaaaca

SEQ ID NO: 374042 - RNA, 21 nt, Human
ugaggguacuguggcugucug

SEQ ID NO: 374043 - RNA, 23 nt, Human
ugcaaaaaaacuucaugacuucc

SEQ ID NO: 374044 - RNA, 22 nt, Human
ugccaacuccuugcuggucgcc

SEQ ID NO: 374045 - RNA, 19 nt, Human
ugccaggguguacucagau

SEQ ID NO: 374046 - RNA, 19 nt, Human
ugcuuaugguugucccccc

SEQ ID NO: 374047 - RNA, 22 nt, Human
ugcuuggccaucugcuccccaa

SEQ ID NO: 374048 - RNA, 21 nt, Human
uggaggggaggggaaaggcug

SEQ ID NO: 374049 - RNA, 22 nt, Human
uggccaucugcuccccaauucu

SEQ ID NO: 374050 - RNA, 20 nt, Human
uggugggcagggaauggguc

SEQ ID NO: 374051 - RNA, 27 nt, Human
uggugggggaugggaagcugaugggau

SEQ ID NO: 374052 - RNA, 22 nt, Human
ugucugaagacaaaagagcaaa

SEQ ID NO: 374053 - RNA, 22 nt, Human
ugugugcguuucucucugaaca

SEQ ID NO: 374054 - RNA, 22 nt, Human
uuaugguuguccccccagcagc

SEQ ID NO: 374055 - RNA, 18 nt, Human
uuauuuggaauuccuuca

SEQ ID NO: 374056 - RNA, 22 nt, Human
uucaacacaucuauuuaucaaa

SEQ ID NO: 374057 - RNA, 22 nt, Human
uucaggucagauuacccaagaa

SEQ ID NO: 374058 - RNA, 18 nt, Human
uuccccauccacaccuca

SEQ ID NO: 374059 - RNA, 23 nt, Human
uugcuucuuacuuuauccacugu

SEQ ID NO: 374060 - RNA, 20 nt, Human
uuggucuugggcaguguggg

SEQ ID NO: 374061 - RNA, 18 nt, Human
uugguguauguuaaauga

SEQ ID NO: 374062 - RNA, 18 nt, Human
uuuccccauccacaccuc

SEQ ID NO: 374063 - RNA, 21 nt, Human
uuucuagcuguauuuaaagag

SEQ ID NO: 374064 - RNA, 21 nt, Human
uuucuggagauauacaaaugc

SEQ ID NO: 374065 - RNA, 23 nt, Human
uuucuggugggcagggaaugggu

SEQ ID NO: 374066 - RNA, 20 nt, Human
uuugugacagcagcugaggc

SEQ ID NO: 374067 - RNA, 22 nt, Human
uuuuaacacuuuacaauggcua

SEQ ID NO: 374068 - RNA, 21 nt, Human
uuuuuugccacgcaauucuga

SEQ ID NO: 374069 - RNA, 19 nt, Human
aaacagccaaaaaccucaa

SEQ ID NO: 374070 - RNA, 19 nt, Human
aaagagagagaagaagaaa

SEQ ID NO: 374071 - RNA, 18 nt, Human
aacaacuggccaaggucc

SEQ ID NO: 374072 - RNA, 19 nt, Human
aaccauaaacaucucugcc

SEQ ID NO: 374073 - RNA, 19 nt, Human
aagacaaagauacaugaaa

SEQ ID NO: 374074 - RNA, 24 nt, Human
aagacaaagauacaugaaacugaa

SEQ ID NO: 374075 - RNA, 22 nt, Human
aagaggugaacaggaaaccaag

SEQ ID NO: 374076 - RNA, 20 nt, Human
aaggggaggcaaucauggug

SEQ ID NO: 374077 - RNA, 22 nt, Human
aaguggaacagagaaacagcuc

SEQ ID NO: 374078 - RNA, 22 nt, Human
aaucaaaguaauuuaauaaaca

SEQ ID NO: 374079 - RNA, 18 nt, Human
aaucuuaccuuccacaua

SEQ ID NO: 374080 - RNA, 26 nt, Human
acacuccucugaccuuaagcccacca

SEQ ID NO: 374081 - RNA, 21 nt, Human
acagccaaaaaccucaagccu

SEQ ID NO: 374082 - RNA, 23 nt, Human
acaggcuuuuguuucccucuuuc

SEQ ID NO: 374083 - RNA, 19 nt, Human
acauagcaaagaaggaggc

SEQ ID NO: 374084 - RNA, 21 nt, Human
accccacugcucucaaaguug

SEQ ID NO: 374085 - RNA, 23 nt, Human
acccugggaaaaaugggguuucc

SEQ ID NO: 374086 - RNA, 19 nt, Human
acucgcaucuuuguuccug

SEQ ID NO: 374087 - RNA, 19 nt, Human
acuuuagagacauuaucug

SEQ ID NO: 374088 - RNA, 23 nt, Human
agaaagagggagaggggaguguu

SEQ ID NO: 374089 - RNA, 23 nt, Human
agaaagcagccuuguggccacug

SEQ ID NO: 374090 - RNA, 18 nt, Human
agaagaagaaagagggag

SEQ ID NO: 374091 - RNA, 19 nt, Human
agaagaagaaagagggaga

SEQ ID NO: 374092 - RNA, 18 nt, Human
agacaagacccccauuua

SEQ ID NO: 374093 - RNA, 19 nt, Human
agagagaagaagaaagagg

SEQ ID NO: 374094 - RNA, 19 nt, Human
agagagaagaagaaagagg

SEQ ID NO: 374095 - RNA, 21 nt, Human
agagagaagaagaaagagggg

SEQ ID NO: 374096 - RNA, 19 nt, Human
aggaaacgucaggguuaau

SEQ ID NO: 374097 - RNA, 20 nt, Human
aggacacccucauuaucacc

SEQ ID NO: 374098 - RNA, 21 nt, Human
aggaguagggaaagcugcaag

SEQ ID NO: 374099 - RNA, 20 nt, Human
aggcaaagacuuuagagaca

SEQ ID NO: 374100 - RNA, 18 nt, Human
agguaacagcaaccguca

SEQ ID NO: 374101 - RNA, 19 nt, Human
aguaaaaaacagccaaaaa

SEQ ID NO: 374102 - RNA, 20 nt, Human
aucagccuuuaaugcuaaaa

SEQ ID NO: 374103 - RNA, 24 nt, Human
aucaguuuuauuucacaaacauuu

SEQ ID NO: 374104 - RNA, 21 nt, Human
caaaaugccagguaucucaug

SEQ ID NO: 374105 - RNA, 18 nt, Human
caaacucucacccuaaug

SEQ ID NO: 374106 - RNA, 18 nt, Human
caaaguccauuaaccugu

SEQ ID NO: 374107 - RNA, 20 nt, Human
caacacuuugucuuccacau

SEQ ID NO: 374108 - RNA, 18 nt, Human
caaggcacugugcuagaa

SEQ ID NO: 374109 - RNA, 19 nt, Human
cacacauggaugacaaaca

SEQ ID NO: 374110 - RNA, 23 nt, Human
cacaggccaggccaguauuuagg

SEQ ID NO: 374111 - RNA, 23 nt, Human
cacaggcuuaaagcuaaaaaccc

SEQ ID NO: 374112 - RNA, 24 nt, Human
caccagggccuguguuauacccug

SEQ ID NO: 374113 - RNA, 19 nt, Human
cacugcugaccaacagagc

SEQ ID NO: 374114 - RNA, 22 nt, Human
cagaacagcugccaagcacccc

SEQ ID NO: 374115 - RNA, 20 nt, Human
cagcaagguccaugggcaca

SEQ ID NO: 374116 - RNA, 20 nt, Human
cagcugccaagcaccccacu

SEQ ID NO: 374117 - RNA, 23 nt, Human
cagggauauuugaaaaaggcagg

SEQ ID NO: 374118 - RNA, 19 nt, Human
caucccucccuacacacuc

SEQ ID NO: 374119 - RNA, 21 nt, Human
ccaggugggaaaaggcaggga

SEQ ID NO: 374120 - RNA, 24 nt, Human
ccaguuaaaaucaguuuuauuuca

SEQ ID NO: 374121 - RNA, 22 nt, Human
ccaucuuuggucacuucccaaa

SEQ ID NO: 374122 - RNA, 21 nt, Human
cccugugcugguuugagugag

SEQ ID NO: 374123 - RNA, 22 nt, Human
ccuaguacaaugguucucaaac

SEQ ID NO: 374124 - RNA, 20 nt, Human
ccucccuuccuuccuuauuc

SEQ ID NO: 374125 - RNA, 21 nt, Human
ccucccuuccuuccuuauucu

SEQ ID NO: 374126 - RNA, 23 nt, Human
ccugacaaacuucugacagcagc

SEQ ID NO: 374127 - RNA, 18 nt, Human
ccuguagccuuugggggu

SEQ ID NO: 374128 - RNA, 22 nt, Human
ccuuaagcccaccaaacuccuu

SEQ ID NO: 374129 - RNA, 18 nt, Human
cuaauccacccaucagcc

SEQ ID NO: 374130 - RNA, 28 nt, Human
cucacccuaauguaagacaagaccccca

SEQ ID NO: 374131 - RNA, 19 nt, Human
cuccucugaccuuaagccc

SEQ ID NO: 374132 - RNA, 21 nt, Human
cuccucugaccuuaagcccac

SEQ ID NO: 374133 - RNA, 23 nt, Human
cugcugaacaggcuuuuguuucc

SEQ ID NO: 374134 - RNA, 22 nt, Human
cuuccuuauucuaccggcacaa

SEQ ID NO: 374135 - RNA, 24 nt, Human
gaaaagacaaagauacaugaaagg

SEQ ID NO: 374136 - RNA, 19 nt, Human
gaaagagggagaggggagu

SEQ ID NO: 374137 - RNA, 21 nt, Human
gaagccuggcagguuggggau

SEQ ID NO: 374138 - RNA, 23 nt, Human
gaaugaacaccaaggguuuagga

SEQ ID NO: 374139 - RNA, 18 nt, Human
gagagaagaagaaagagg

SEQ ID NO: 374140 - RNA, 20 nt, Human
gagcaccuguacacugcccc

SEQ ID NO: 374141 - RNA, 22 nt, Human
gauuuacagcccauucuucccu

SEQ ID NO: 374142 - RNA, 24 nt, Human
gcagguucuagaggaaaagacaaa

SEQ ID NO: 374143 - RNA, 25 nt, Human
gccaagcaccccacugcucucaaag

SEQ ID NO: 374144 - RNA, 24 nt, Human
ggaaaaaugggguuucuucaugcu

SEQ ID NO: 374145 - RNA, 23 nt, Human
ggaaaagacaaagauacaugaaa

SEQ ID NO: 374146 - RNA, 21 nt, Human
ggauuucuuuugugcuuugau

SEQ ID NO: 374147 - RNA, 24 nt, Human
gggcaggggcggcacaggccaggc

SEQ ID NO: 374148 - RNA, 20 nt, Human
gguuucuucaugcuuugugc

SEQ ID NO: 374149 - RNA, 28 nt, Human
uaaaaaacagccaaaaaccucaagccug

SEQ ID NO: 374150 - RNA, 21 nt, Human
uaaaaauaagucggcaaauga

SEQ ID NO: 374151 - RNA, 21 nt, Human
uaaaagcaauaaacaagagca

SEQ ID NO: 374152 - RNA, 24 nt, Human
uaaaauagcugauaaaucuagagc

SEQ ID NO: 374153 - RNA, 18 nt, Human
uaaaauagguggcugggc

SEQ ID NO: 374154 - RNA, 23 nt, Human
uaaacacaaaguccauuaaccug

SEQ ID NO: 374155 - RNA, 23 nt, Human
uacaguauauguuuccagguggg

SEQ ID NO: 374156 - RNA, 20 nt, Human
uacccugggaaaaauggggu

SEQ ID NO: 374157 - RNA, 20 nt, Human
uacucagaggucagagagca

SEQ ID NO: 374158 - RNA, 20 nt, Human
uagaacaugcacaguuugcc

SEQ ID NO: 374159 - RNA, 21 nt, Human
uaggauuaaaaaaaaaaauac

SEQ ID NO: 374160 - RNA, 19 nt, Human
uaggcacuuaggucccucc

SEQ ID NO: 374161 - RNA, 18 nt, Human
uaucggauuuuuagcuug

SEQ ID NO: 374162 - RNA, 21 nt, Human
uaugcuuucuuuuccaaagua

SEQ ID NO: 374163 - RNA, 22 nt, Human
uauggaaaguggaacagagaaa

SEQ ID NO: 374164 - RNA, 22 nt, Human
uauucuacugugagaguggaaa

SEQ ID NO: 374165 - RNA, 21 nt, Human
ucaaaaaagucauuuuaaaau

SEQ ID NO: 374166 - RNA, 19 nt, Human
ucacacauggaugacaaac

SEQ ID NO: 374167 - RNA, 20 nt, Human
ucagcaggucgccuguagcc

SEQ ID NO: 374168 - RNA, 26 nt, Human
ucagcaggucgccuguagccuuuggg

SEQ ID NO: 374169 - RNA, 19 nt, Human
ucagccuuuaaugcuaaaa

SEQ ID NO: 374170 - RNA, 22 nt, Human
ucaggguuucaaacuccugugc

SEQ ID NO: 374171 - RNA, 18 nt, Human
uccaaaguacauggccag

SEQ ID NO: 374172 - RNA, 18 nt, Human
uccaauuaaaaauaaggc

SEQ ID NO: 374173 - RNA, 22 nt, Human
uccacauacaucccucccuaca

SEQ ID NO: 374174 - RNA, 22 nt, Human
uccacaugcacaggcuuaaagc

SEQ ID NO: 374175 - RNA, 19 nt, Human
ucccucuuucucugagccu

SEQ ID NO: 374176 - RNA, 19 nt, Human
ucccugccucccuuccuuc

SEQ ID NO: 374177 - RNA, 23 nt, Human
uccuacugcaguuggggcaggag

SEQ ID NO: 374178 - RNA, 18 nt, Human
uccuguggccacagagag

SEQ ID NO: 374179 - RNA, 25 nt, Human
ucuaauucaguagguaugggguaug

SEQ ID NO: 374180 - RNA, 21 nt, Human
ucucugagcagcaccuugccu

SEQ ID NO: 374181 - RNA, 19 nt, Human
ucuuccacauuaaauuugg

SEQ ID NO: 374182 - RNA, 19 nt, Human
ucuuuugauuuuccaacac

SEQ ID NO: 374183 - RNA, 19 nt, Human
ugaaaaaaaagcaaagcaa

SEQ ID NO: 374184 - RNA, 24 nt, Human
ugaaaaaaaagcaaagcaaaccuc

SEQ ID NO: 374185 - RNA, 26 nt, Human
ugaaauccuauacaugcaacacuucu

SEQ ID NO: 374186 - RNA, 18 nt, Human
ugaaaugcagguagaauu

SEQ ID NO: 374187 - RNA, 19 nt, Human
ugaacaggaaaccaagguc

SEQ ID NO: 374188 - RNA, 19 nt, Human
ugaaucuuaccuuccacau

SEQ ID NO: 374189 - RNA, 20 nt, Human
ugaaucuuaccuuccacaua

SEQ ID NO: 374190 - RNA, 24 nt, Human
ugacaaacaaaugugaagacagga

SEQ ID NO: 374191 - RNA, 19 nt, Human
ugacaaagggcucagaaac

SEQ ID NO: 374192 - RNA, 19 nt, Human
ugacaugcuuugccucccu

SEQ ID NO: 374193 - RNA, 19 nt, Human
ugaccaacagagcuaccaa

SEQ ID NO: 374194 - RNA, 21 nt, Human
ugaggcaaagacuuuagagac

SEQ ID NO: 374195 - RNA, 18 nt, Human
ugaguagugggggcaggg

SEQ ID NO: 374196 - RNA, 20 nt, Human
ugcagauuuccuuggccuau

SEQ ID NO: 374197 - RNA, 21 nt, Human
ugcagcaagguccaugggcac

SEQ ID NO: 374198 - RNA, 21 nt, Human
ugccaagcaccccacugcucu

SEQ ID NO: 374199 - RNA, 25 nt, Human
ugccaagcaccccacugcucucaaa

SEQ ID NO: 374200 - RNA, 25 nt, Human
ugccagguaucucaugucgaccucu

SEQ ID NO: 374201 - RNA, 21 nt, Human
ugccuuguuaguaaaaaacag

SEQ ID NO: 374202 - RNA, 19 nt, Human
ugcuuugauucucagcaac

SEQ ID NO: 374203 - RNA, 25 nt, Human
uggaaaacguugcaguaucggauuu

SEQ ID NO: 374204 - RNA, 23 nt, Human
uggaacagagaaacagcucaggg

SEQ ID NO: 374205 - RNA, 24 nt, Human
uggcaaaauaggaaacagaacaac

SEQ ID NO: 374206 - RNA, 20 nt, Human
ugggguuuggagggaagaga

SEQ ID NO: 374207 - RNA, 19 nt, Human
ugguuugagugagccucuu

SEQ ID NO: 374208 - RNA, 23 nt, Human
uguaaaagcaauaaacaagagca

SEQ ID NO: 374209 - RNA, 18 nt, Human
ugugcaggaugcagcaag

SEQ ID NO: 374210 - RNA, 23 nt, Human
uguuuuguuuuguuuuuguuuuu

SEQ ID NO: 374211 - RNA, 25 nt, Human
uucaaaacauuucucacaagaaucu

SEQ ID NO: 374212 - RNA, 20 nt, Human
uucccucuuucucugagccu

SEQ ID NO: 374213 - RNA, 20 nt, Human
uuccuggaaaacacagaaca

SEQ ID NO: 374214 - RNA, 24 nt, Human
uugggagacuccaacugaagagga

SEQ ID NO: 374215 - RNA, 22 nt, Human
uuggggcaggaguagggaaagc

SEQ ID NO: 374216 - RNA, 23 nt, Human
uuuggagggaagagauucaaaga

SEQ ID NO: 374217 - RNA, 19 nt, Human
uuuucuacaaacacgaccg

SEQ ID NO: 374218 - RNA, 22 nt, Human
uuuuguuuuguuuuuguuuuug

SEQ ID NO: 374219 - RNA, 19 nt, Human
aaaaacccaacccaaacag

SEQ ID NO: 374220 - RNA, 21 nt, Human
aaaaaggaaaaauaagaagga

SEQ ID NO: 374221 - RNA, 23 nt, Human
aaaagacagaugcugggguggcc

SEQ ID NO: 374222 - RNA, 20 nt, Human
aaacccaacccaaacagcag

SEQ ID NO: 374223 - RNA, 22 nt, Human
aacccaacccaaacagcagaga

SEQ ID NO: 374224 - RNA, 24 nt, Human
aagaaggaaugcauugucucuuug

SEQ ID NO: 374225 - RNA, 20 nt, Human
aagcaaagucagggaggccc

SEQ ID NO: 374226 - RNA, 21 nt, Human
aagcaggggaaugggggcugu

SEQ ID NO: 374227 - RNA, 18 nt, Human
acacccccaccaccgcca

SEQ ID NO: 374228 - RNA, 22 nt, Human
acagguggaagggguggggaca

SEQ ID NO: 374229 - RNA, 23 nt, Human
acgcugauggcccuuccagcccu

SEQ ID NO: 374230 - RNA, 21 nt, Human
acugcagaaaacugguacauc

SEQ ID NO: 374231 - RNA, 20 nt, Human
acuggcgcgcagagggcugg

SEQ ID NO: 374232 - RNA, 22 nt, Human
agaagcaaagucagggaggccc

SEQ ID NO: 374233 - RNA, 26 nt, Human
agagagcuuugggucugggggacagg

SEQ ID NO: 374234 - RNA, 20 nt, Human
agagaggagggggaggaggg

SEQ ID NO: 374235 - RNA, 21 nt, Human
agagaggcauuuacagagcug

SEQ ID NO: 374236 - RNA, 24 nt, Human
agagcuuugggucugggggacagg

SEQ ID NO: 374237 - RNA, 19 nt, Human
agaggagggggaggaggga

SEQ ID NO: 374238 - RNA, 23 nt, Human
agaucccugccagagaggagggg

SEQ ID NO: 374239 - RNA, 18 nt, Human
agcagcagcaggagcggc

SEQ ID NO: 374240 - RNA, 23 nt, Human
agcaggacaagaaucccugcaaa

SEQ ID NO: 374241 - RNA, 21 nt, Human
agccagggcucuggcguucuc

SEQ ID NO: 374242 - RNA, 21 nt, Human
agccagggcucuggcguucuc

SEQ ID NO: 374243 - RNA, 22 nt, Human
agccaucaggugggagaagccu

SEQ ID NO: 374244 - RNA, 18 nt, Human
agccggagggcagggggg

SEQ ID NO: 374245 - RNA, 18 nt, Human
aggacgaccagccucagc

SEQ ID NO: 374246 - RNA, 20 nt, Human
aggacgaccagccucagccc

SEQ ID NO: 374247 - RNA, 22 nt, Human
aggagggggaggagggaggagg

SEQ ID NO: 374248 - RNA, 18 nt, Human
agggaggaggaggaaggg

SEQ ID NO: 374249 - RNA, 27 nt, Human
agggggaggagggaggaggaggaaggg

SEQ ID NO: 374250 - RNA, 21 nt, Human
agggggaggagggaggaggga

SEQ ID NO: 374251 - RNA, 21 nt, Human
agggggcacaggagccccagg

SEQ ID NO: 374252 - RNA, 19 nt, Human
aggggguggugccugucgc

SEQ ID NO: 374253 - RNA, 22 nt, Human
agugaagaagcaaagucaggga

SEQ ID NO: 374254 - RNA, 19 nt, Human
aguggcuaccgcaggcacu

SEQ ID NO: 374255 - RNA, 19 nt, Human
auaaaauacaggaaaccca

SEQ ID NO: 374256 - RNA, 20 nt, Human
augggggcuguggcaagguu

SEQ ID NO: 374257 - RNA, 22 nt, Human
caaaaggugacccccccacccc

SEQ ID NO: 374258 - RNA, 24 nt, Human
caaaaggugacccccccacccccc

SEQ ID NO: 374259 - RNA, 21 nt, Human
caacccaaacagcagagagaa

SEQ ID NO: 374260 - RNA, 22 nt, Human
caaggcaaaaggugaccccccc

SEQ ID NO: 374261 - RNA, 18 nt, Human
cacccgggucaguugggc

SEQ ID NO: 374262 - RNA, 18 nt, Human
cacuggcgcgcagagggc

SEQ ID NO: 374263 - RNA, 23 nt, Human
cagauaacuaaggggaaaaaccc

SEQ ID NO: 374264 - RNA, 24 nt, Human
cagcagcagcagcagcagcaggag

SEQ ID NO: 374265 - RNA, 23 nt, Human
cagcagcagcagcaggagcggcc

SEQ ID NO: 374266 - RNA, 19 nt, Human
cagcagcagcaggagcggc

SEQ ID NO: 374267 - RNA, 21 nt, Human
cagccggagggcaggggggcc

SEQ ID NO: 374268 - RNA, 18 nt, Human
caggacaagaaucccugc

SEQ ID NO: 374269 - RNA, 19 nt, Human
caggcggccugcuggccag

SEQ ID NO: 374270 - RNA, 19 nt, Human
cagggacaggugugggugg

SEQ ID NO: 374271 - RNA, 20 nt, Human
cauccagggcucuggcguuc

SEQ ID NO: 374272 - RNA, 20 nt, Human
ccaacccaaacagcagagag

SEQ ID NO: 374273 - RNA, 24 nt, Human
ccaacccaaacagcagagagaauu

SEQ ID NO: 374274 - RNA, 22 nt, Human
ccaccgggcacuguuuggggcg

SEQ ID NO: 374275 - RNA, 19 nt, Human
ccagccgccggcuuugcug

SEQ ID NO: 374276 - RNA, 24 nt, Human
ccagcggcgccgcccgcucccagg

SEQ ID NO: 374277 - RNA, 20 nt, Human
ccagggagaugagguuccag

SEQ ID NO: 374278 - RNA, 19 nt, Human
ccagggcucuggcguucuc

SEQ ID NO: 374279 - RNA, 18 nt, Human
cccaccuuucugggggca

SEQ ID NO: 374280 - RNA, 25 nt, Human
ccccaccaccgccagcagcuaccua

SEQ ID NO: 374281 - RNA, 18 nt, Human
ccccagccagcacaucac

SEQ ID NO: 374282 - RNA, 18 nt, Human
ccccagccagcgcaucac

SEQ ID NO: 374283 - RNA, 20 nt, Human
cccccaccaccgccagcagg

SEQ ID NO: 374284 - RNA, 19 nt, Human
cccccaccccccuauauuc

SEQ ID NO: 374285 - RNA, 22 nt, Human
cccccaccccccuauauuccuu

SEQ ID NO: 374286 - RNA, 22 nt, Human
cccccagccagcgcaucaccau

SEQ ID NO: 374287 - RNA, 23 nt, Human
ccccgccgccccgcaggcgccca

SEQ ID NO: 374288 - RNA, 21 nt, Human
ccccuauauuccuauagacuu

SEQ ID NO: 374289 - RNA, 20 nt, Human
ccccuucuugaaaaugaggg

SEQ ID NO: 374290 - RNA, 21 nt, Human
cccgagguacugggagggcuc

SEQ ID NO: 374291 - RNA, 27 nt, Human
cccucgaauuuacaaccagggacagac

SEQ ID NO: 374292 - RNA, 24 nt, Human
cccugccauccucagccucuccca

SEQ ID NO: 374293 - RNA, 21 nt, Human
cccuggggagaaccagggaga

SEQ ID NO: 374294 - RNA, 26 nt, Human
ccgugcugugaccuucaguuacucuc

SEQ ID NO: 374295 - RNA, 20 nt, Human
ccuccuucccaggugcuugg

SEQ ID NO: 374296 - RNA, 20 nt, Human
ccuggcacccgggcucccac

SEQ ID NO: 374297 - RNA, 22 nt, Human
cgccccgcaggcgcccagcagc

SEQ ID NO: 374298 - RNA, 18 nt, Human
cgccccgcgggagggcuc

SEQ ID NO: 374299 - RNA, 18 nt, Human
cgcccgggcucaggggag

SEQ ID NO: 374300 - RNA, 22 nt, Human
cgcucccagcgccgguagcccg

SEQ ID NO: 374301 - RNA, 18 nt, Human
cgggagggcuccgcggca

SEQ ID NO: 374302 - RNA, 20 nt, Human
cgguccucgccgccaccggg

SEQ ID NO: 374303 - RNA, 19 nt, Human
cgugggccugggcgggcuu

SEQ ID NO: 374304 - RNA, 20 nt, Human
cucagaugccaccuccuucc

SEQ ID NO: 374305 - RNA, 20 nt, Human
cucauugggauucaccccca

SEQ ID NO: 374306 - RNA, 20 nt, Human
cucauugggauucaccccca

SEQ ID NO: 374307 - RNA, 23 nt, Human
cuccaugggugguuuuacucaac

SEQ ID NO: 374308 - RNA, 21 nt, Human
cucccagcgccgguagcccgc

SEQ ID NO: 374309 - RNA, 20 nt, Human
cucccgaguacggaacucug

SEQ ID NO: 374310 - RNA, 19 nt, Human
cucugagagggacccucau

SEQ ID NO: 374311 - RNA, 19 nt, Human
cugcgcccgcgaagccacu

SEQ ID NO: 374312 - RNA, 22 nt, Human
cugggcacucagggaaaggggc

SEQ ID NO: 374313 - RNA, 22 nt, Human
cuggugccgucuccaccaccca

SEQ ID NO: 374314 - RNA, 24 nt, Human
cugguugugcgucgcgucccccuu

SEQ ID NO: 374315 - RNA, 22 nt, Human
cugugaccuucaguuacucucc

SEQ ID NO: 374316 - RNA, 22 nt, Human
cuugcagcccgagguacuggga

SEQ ID NO: 374317 - RNA, 18 nt, Human
cuuguaggguggccucug

SEQ ID NO: 374318 - RNA, 22 nt, Human
cuuugcuggugguucugugccc

SEQ ID NO: 374319 - RNA, 20 nt, Human
cuuugggucugggggacagg

SEQ ID NO: 374320 - RNA, 20 nt, Human
gaacaccccccgacccaggg

SEQ ID NO: 374321 - RNA, 22 nt, Human
gagcccgcaacgcagugucuga

SEQ ID NO: 374322 - RNA, 21 nt, Human
gaggaaccaugggcacugggu

SEQ ID NO: 374323 - RNA, 20 nt, Human
gaggacccaggcgcccgggc

SEQ ID NO: 374324 - RNA, 22 nt, Human
gaggacccaggcgcccgggcuc

SEQ ID NO: 374325 - RNA, 20 nt, Human
gaggagacacccugggcacu

SEQ ID NO: 374326 - RNA, 19 nt, Human
gagggcaggggggccugga

SEQ ID NO: 374327 - RNA, 24 nt, Human
gagggcaggggggccuggagggug

SEQ ID NO: 374328 - RNA, 23 nt, Human
gagugaagaagcaaagucaggga

SEQ ID NO: 374329 - RNA, 23 nt, Human
gcaauucccccaagcucagacau

SEQ ID NO: 374330 - RNA, 22 nt, Human
gcauugucucuuuguuaugugc

SEQ ID NO: 374331 - RNA, 23 nt, Human
gccccaggugggcagguagggug

SEQ ID NO: 374332 - RNA, 25 nt, Human
ggaaaaacccaacccaaacagcaga

SEQ ID NO: 374333 - RNA, 21 nt, Human
ggaccaggagcgggaccggga

SEQ ID NO: 374334 - RNA, 22 nt, Human
ggaggaggaggaaggggcuacu

SEQ ID NO: 374335 - RNA, 24 nt, Human
ggaggagggaggaggaggaagggg

SEQ ID NO: 374336 - RNA, 21 nt, Human
ggagggcaggggggccuggag

SEQ ID NO: 374337 - RNA, 19 nt, Human
ggagggggaggagggagga

SEQ ID NO: 374338 - RNA, 24 nt, Human
ggagggggaggagggaggaggagg

SEQ ID NO: 374339 - RNA, 20 nt, Human
ggcaaaaggugaccccccca

SEQ ID NO: 374340 - RNA, 22 nt, Human
ggcacuggguccugagcccgcc

SEQ ID NO: 374341 - RNA, 19 nt, Human
ggcaggggggccuggaggg

SEQ ID NO: 374342 - RNA, 24 nt, Human
ggcaggggggccuggaggguggug

SEQ ID NO: 374343 - RNA, 18 nt, Human
gggcacaggagccccagg

SEQ ID NO: 374344 - RNA, 21 nt, Human
ggggagagagcuuugggucug

SEQ ID NO: 374345 - RNA, 20 nt, Human
gggggcaucuggcuccuucc

SEQ ID NO: 374346 - RNA, 21 nt, Human
ggguccugagcccgcccuacc

SEQ ID NO: 374347 - RNA, 22 nt, Human
gucugcccuggggagaaccagg

SEQ ID NO: 374348 - RNA, 20 nt, Human
gugggccugggcgggcuugg

SEQ ID NO: 374349 - RNA, 20 nt, Human
guggggcggccguguguggg

SEQ ID NO: 374350 - RNA, 22 nt, Human
guggggucuggggggcagaacc

SEQ ID NO: 374351 - RNA, 18 nt, Human
guggugccugucgccugg

SEQ ID NO: 374352 - RNA, 21 nt, Human
gugguguugggagggccuggc

SEQ ID NO: 374353 - RNA, 24 nt, Human
uaacuaaggggaaaaacccaaccc

SEQ ID NO: 374354 - RNA, 18 nt, Human
uacaaccagggacagaca

SEQ ID NO: 374355 - RNA, 18 nt, Human
uacagagcugcaguuucc

SEQ ID NO: 374356 - RNA, 23 nt, Human
uacaggaaacccacagauaacua

SEQ ID NO: 374357 - RNA, 20 nt, Human
uaccgccggcuauaaagaca

SEQ ID NO: 374358 - RNA, 21 nt, Human
uaccgccggcuauaaagacag

SEQ ID NO: 374359 - RNA, 18 nt, Human
uaccuagagaggcauuua

SEQ ID NO: 374360 - RNA, 22 nt, Human
uacggaacucugacagagccac

SEQ ID NO: 374361 - RNA, 18 nt, Human
uagcccgcggcgggggcg

SEQ ID NO: 374362 - RNA, 20 nt, Human
ucaccccugggcuuuccccu

SEQ ID NO: 374363 - RNA, 23 nt, Human
ucagcccagagaagucaggccuc

SEQ ID NO: 374364 - RNA, 22 nt, Human
ucagggagggggcuuuccgcag

SEQ ID NO: 374365 - RNA, 21 nt, Human
uccacccgguucccuucgccu

SEQ ID NO: 374366 - RNA, 18 nt, Human
ucccagagagucauggcc

SEQ ID NO: 374367 - RNA, 21 nt, Human
ucccagagagucauggcccca

SEQ ID NO: 374368 - RNA, 21 nt, Human
ucccaucuccaggaugaccuu

SEQ ID NO: 374369 - RNA, 18 nt, Human
ucccugcaaagguguccu

SEQ ID NO: 374370 - RNA, 22 nt, Human
ucccugggccucaguuuccccu

SEQ ID NO: 374371 - RNA, 22 nt, Human
uccggggagucccggggggucc

SEQ ID NO: 374372 - RNA, 23 nt, Human
uccucagccucucccagcuuggu

SEQ ID NO: 374373 - RNA, 19 nt, Human
uccugagcccgcccuaccc

SEQ ID NO: 374374 - RNA, 21 nt, Human
ucucagaugccaccuccuucc

SEQ ID NO: 374375 - RNA, 23 nt, Human
ucucagaugccaccuccuuccca

SEQ ID NO: 374376 - RNA, 20 nt, Human
ucucugaggggcgccagucc

SEQ ID NO: 374377 - RNA, 18 nt, Human
ugaaaagacagaugcugg

SEQ ID NO: 374378 - RNA, 22 nt, Human
ugaaaagacagaugcuggggug

SEQ ID NO: 374379 - RNA, 25 nt, Human
ugacccccccaccccccuauauucc

SEQ ID NO: 374380 - RNA, 21 nt, Human
ugagcacgaacgacgugcuga

SEQ ID NO: 374381 - RNA, 19 nt, Human
ugaggacaacuuguagggu

SEQ ID NO: 374382 - RNA, 22 nt, Human
ugaggacaacuuguaggguggc

SEQ ID NO: 374383 - RNA, 24 nt, Human
ugaggacaacuuguaggguggccu

SEQ ID NO: 374384 - RNA, 23 nt, Human
ugcauggcagcugauggccucgu

SEQ ID NO: 374385 - RNA, 23 nt, Human
ugccagagaggagggggaggagg

SEQ ID NO: 374386 - RNA, 21 nt, Human
ugcuuggguccacaugcccaa

SEQ ID NO: 374387 - RNA, 19 nt, Human
uggaggguggugugguguu

SEQ ID NO: 374388 - RNA, 21 nt, Human
uggaguggggagggggcacag

SEQ ID NO: 374389 - RNA, 23 nt, Human
uggcgacgacucagggagggggc

SEQ ID NO: 374390 - RNA, 19 nt, Human
ugggccccgggccugcacu

SEQ ID NO: 374391 - RNA, 18 nt, Human
uggggagggggcacagga

SEQ ID NO: 374392 - RNA, 24 nt, Human
uggggagggggcacaggagcccca

SEQ ID NO: 374393 - RNA, 21 nt, Human
ugggggacagguggaaggggu

SEQ ID NO: 374394 - RNA, 23 nt, Human
ugggggacagguggaaggggugg

SEQ ID NO: 374395 - RNA, 19 nt, Human
uggguccugagcccgcccu

SEQ ID NO: 374396 - RNA, 19 nt, Human
ugggugcacagacgggaac

SEQ ID NO: 374397 - RNA, 24 nt, Human
ugguaggagugaggaaccaugggc

SEQ ID NO: 374398 - RNA, 23 nt, Human
uguaggguggccucuggaguggg

SEQ ID NO: 374399 - RNA, 22 nt, Human
ugugcauggcagcugauggccu

SEQ ID NO: 374400 - RNA, 21 nt, Human
uguggcccagggugcuccccu

SEQ ID NO: 374401 - RNA, 19 nt, Human
uuacucuccucccugggcc

SEQ ID NO: 374402 - RNA, 23 nt, Human
uuccccuucuugaaaaugagggu

SEQ ID NO: 374403 - RNA, 23 nt, Human
uucucccccucugagagggaggc

SEQ ID NO: 374404 - RNA, 21 nt, Human
uugcccgugggccccgggccu

SEQ ID NO: 374405 - RNA, 20 nt, Human
uugugcgucgcgucccccuu

SEQ ID NO: 374406 - RNA, 22 nt, Human
uuuccacccgguucccuucgcc

SEQ ID NO: 374407 - RNA, 18 nt, Human
aaacaaaaaagcaggauc

SEQ ID NO: 374408 - RNA, 20 nt, Human
aaagagccaacccaacuuca

SEQ ID NO: 374409 - RNA, 26 nt, Human
aaaugugugaaggggcugaggugcug

SEQ ID NO: 374410 - RNA, 23 nt, Human
aacaauaaaaccaagaacaguau

SEQ ID NO: 374411 - RNA, 22 nt, Human
aacaggagagcauccaaaccca

SEQ ID NO: 374412 - RNA, 20 nt, Human
aagccccuccccccaccccc

SEQ ID NO: 374413 - RNA, 21 nt, Human
aagccccuccccccacccccc

SEQ ID NO: 374414 - RNA, 22 nt, Human
aauaguaauaguaaucaucaaa

SEQ ID NO: 374415 - RNA, 23 nt, Human
acaaagaagaaugggaacaacug

SEQ ID NO: 374416 - RNA, 19 nt, Human
acaacaggagagcauccaa

SEQ ID NO: 374417 - RNA, 22 nt, Human
acaaggcagggccucuuucaca

SEQ ID NO: 374418 - RNA, 19 nt, Human
acucuucccuccuagcucc

SEQ ID NO: 374419 - RNA, 24 nt, Human
agaaaccagcuauggcauggacaa

SEQ ID NO: 374420 - RNA, 19 nt, Human
aggaagcuguuuuccccca

SEQ ID NO: 374421 - RNA, 21 nt, Human
aggaggcugugggaagaugca

SEQ ID NO: 374422 - RNA, 23 nt, Human
aggaggcugugggaagaugcaac

SEQ ID NO: 374423 - RNA, 24 nt, Human
aggcagggccucuuucacaaaguu

SEQ ID NO: 374424 - RNA, 21 nt, Human
aggcuagaccccuacuuggcc

SEQ ID NO: 374425 - RNA, 21 nt, Human
aggcuuugaaagccacucacc

SEQ ID NO: 374426 - RNA, 19 nt, Human
agggagaccacaaggaaaa

SEQ ID NO: 374427 - RNA, 18 nt, Human
aguggggagggggcggcc

SEQ ID NO: 374428 - RNA, 22 nt, Human
auaaaaacaaugcuuacagcau

SEQ ID NO: 374429 - RNA, 18 nt, Human
auccacugacugccuucu

SEQ ID NO: 374430 - RNA, 19 nt, Human
aucuaacugggaaaugauc

SEQ ID NO: 374431 - RNA, 19 nt, Human
augggaacaacaucccaca

SEQ ID NO: 374432 - RNA, 25 nt, Human
caaaaaagcaggaucuuuagaaaua

SEQ ID NO: 374433 - RNA, 23 nt, Human
caaauagcacagcuuugcuaaaa

SEQ ID NO: 374434 - RNA, 23 nt, Human
caaaugccucuucccuuccaacc

SEQ ID NO: 374435 - RNA, 22 nt, Human
caagcaaauagcacagcuuugc

SEQ ID NO: 374436 - RNA, 22 nt, Human
cacagcuuugcuaaaauugccu

SEQ ID NO: 374437 - RNA, 20 nt, Human
cacauucucucugucucaca

SEQ ID NO: 374438 - RNA, 23 nt, Human
cacucaccccagaggcaagaacu

SEQ ID NO: 374439 - RNA, 18 nt, Human
cagagaagccccuccccc

SEQ ID NO: 374440 - RNA, 24 nt, Human
cagagaagccccuccccccacccc

SEQ ID NO: 374441 - RNA, 22 nt, Human
cagcauggcuuaacgugacccu

SEQ ID NO: 374442 - RNA, 21 nt, Human
cagcuacauccacccccacca

SEQ ID NO: 374443 - RNA, 21 nt, Human
caucugacaagcaaauagcac

SEQ ID NO: 374444 - RNA, 19 nt, Human
ccacaaaugccucuucccu

SEQ ID NO: 374445 - RNA, 22 nt, Human
ccacucuucccuccuagcuccc

SEQ ID NO: 374446 - RNA, 19 nt, Human
cccagagaagccccucccc

SEQ ID NO: 374447 - RNA, 20 nt, Human
cccagagaagccccuccccc

SEQ ID NO: 374448 - RNA, 23 nt, Human
cccagagaagccccuccccccac

SEQ ID NO: 374449 - RNA, 18 nt, Human
ccccaccaaccuacuucc

SEQ ID NO: 374450 - RNA, 21 nt, Human
ccccagagaagccccuccccc

SEQ ID NO: 374451 - RNA, 25 nt, Human
ccccagagaagccccuccccccacc

SEQ ID NO: 374452 - RNA, 20 nt, Human
ccccagaggcaagaacuacc

SEQ ID NO: 374453 - RNA, 19 nt, Human
cccgcucgcccguucucuu

SEQ ID NO: 374454 - RNA, 19 nt, Human
cccguucucuuguccagag

SEQ ID NO: 374455 - RNA, 28 nt, Human
ccucgccgguccucuccacucuucccuc

SEQ ID NO: 374456 - RNA, 19 nt, Human
cuccccccaccccccuuua

SEQ ID NO: 374457 - RNA, 20 nt, Human
cucucugucucacaaagaag

SEQ ID NO: 374458 - RNA, 21 nt, Human
cugccauguucuaugauguca

SEQ ID NO: 374459 - RNA, 18 nt, Human
cuuggaacaaaaacgacu

SEQ ID NO: 374460 - RNA, 25 nt, Human
cuuuaacuccucccaugccaagaga

SEQ ID NO: 374461 - RNA, 22 nt, Human
cuuuaccuagugcccaggggac

SEQ ID NO: 374462 - RNA, 18 nt, Human
gaagccccuccccccacc

SEQ ID NO: 374463 - RNA, 18 nt, Human
gaggaggcugugggaaga

SEQ ID NO: 374464 - RNA, 20 nt, Human
gaguggggagggggcggccc

SEQ ID NO: 374465 - RNA, 20 nt, Human
gcaucuuucuuuuuucuguu

SEQ ID NO: 374466 - RNA, 21 nt, Human
gcuaagccugaaaauaaaaac

SEQ ID NO: 374467 - RNA, 21 nt, Human
gcuagaccccuacuuggccug

SEQ ID NO: 374468 - RNA, 21 nt, Human
ggaacaauaaaaccaagaaca

SEQ ID NO: 374469 - RNA, 23 nt, Human
ggaacaauaaaaccaagaacagu

SEQ ID NO: 374470 - RNA, 18 nt, Human
ggcuaccgcggcucgggc

SEQ ID NO: 374471 - RNA, 23 nt, Human
gggaaggagguggcuccggcugg

SEQ ID NO: 374472 - RNA, 19 nt, Human
gggaguggggagggggcgg

SEQ ID NO: 374473 - RNA, 23 nt, Human
gggaguggggagggggcggccgg

SEQ ID NO: 374474 - RNA, 20 nt, Human
guacauauacuguauauaua

SEQ ID NO: 374475 - RNA, 21 nt, Human
guccuuccuuuaucaauugcc

SEQ ID NO: 374476 - RNA, 20 nt, Human
uaaaaccaagaacaguauau

SEQ ID NO: 374477 - RNA, 19 nt, Human
uaacagguacaaaauguga

SEQ ID NO: 374478 - RNA, 19 nt, Human
uaagcuaccaauggcagag

SEQ ID NO: 374479 - RNA, 19 nt, Human
uacauauacuguauauaua

SEQ ID NO: 374480 - RNA, 23 nt, Human
uacugaucuacacuguagccagc

SEQ ID NO: 374481 - RNA, 20 nt, Human
uagggggaguggggaggggg

SEQ ID NO: 374482 - RNA, 27 nt, Human
uaguaauaguaaucaucaaaaauaaaa

SEQ ID NO: 374483 - RNA, 19 nt, Human
uaucauuaaaggcuagacc

SEQ ID NO: 374484 - RNA, 18 nt, Human
uauguacauauacuguau

SEQ ID NO: 374485 - RNA, 21 nt, Human
uauguacauauacuguauaua

SEQ ID NO: 374486 - RNA, 23 nt, Human
uauguacauauacuguauauaua

SEQ ID NO: 374487 - RNA, 24 nt, Human
ucaaguggaacaauaaaaccaaga

SEQ ID NO: 374488 - RNA, 18 nt, Human
ucacugggcuuuaccuag

SEQ ID NO: 374489 - RNA, 21 nt, Human
uccaaacccaaugcauugagc

SEQ ID NO: 374490 - RNA, 20 nt, Human
uccacccccaccaaccuacu

SEQ ID NO: 374491 - RNA, 22 nt, Human
uccacccccaccaaccuacuuc

SEQ ID NO: 374492 - RNA, 19 nt, Human
ucccauauauauacauuau

SEQ ID NO: 374493 - RNA, 21 nt, Human
ucccuccuagcucccgcucgc

SEQ ID NO: 374494 - RNA, 20 nt, Human
uccuuuaucaauugccccag

SEQ ID NO: 374495 - RNA, 20 nt, Human
ucucccaaagcuaggcauuu

SEQ ID NO: 374496 - RNA, 22 nt, Human
ucucuauaucacauucucucug

SEQ ID NO: 374497 - RNA, 22 nt, Human
ucugcagcuacauccaccccca

SEQ ID NO: 374498 - RNA, 19 nt, Human
ucuuggaacaaaaacgacu

SEQ ID NO: 374499 - RNA, 23 nt, Human
ugaaagccacucaccccagaggc

SEQ ID NO: 374500 - RNA, 22 nt, Human
ugaaggggcugaggugcuggaa

SEQ ID NO: 374501 - RNA, 20 nt, Human
ugacuaauaucauuaaaggc

SEQ ID NO: 374502 - RNA, 19 nt, Human
ugagcucagaauagccuga

SEQ ID NO: 374503 - RNA, 22 nt, Human
ugcccaggggacuuuucugagc

SEQ ID NO: 374504 - RNA, 21 nt, Human
ugccucuucccuuccaaccuc

SEQ ID NO: 374505 - RNA, 23 nt, Human
ugcguaagccaacacacgcaucu

SEQ ID NO: 374506 - RNA, 20 nt, Human
uggaacaauaaaaccaagaa

SEQ ID NO: 374507 - RNA, 18 nt, Human
uggcauggacaaggagau

SEQ ID NO: 374508 - RNA, 21 nt, Human
uggcauggacaaggagaugca

SEQ ID NO: 374509 - RNA, 22 nt, Human
ugggaacaacaucccacaaaaa

SEQ ID NO: 374510 - RNA, 26 nt, Human
uggggaugagagguucacaaagagcc

SEQ ID NO: 374511 - RNA, 22 nt, Human
uguagggggaguggggaggggg

SEQ ID NO: 374512 - RNA, 23 nt, Human
uguagggggaguggggagggggc

SEQ ID NO: 374513 - RNA, 23 nt, Human
ugugaaggggcugaggugcuggg

SEQ ID NO: 374514 - RNA, 18 nt, Human
ugugcaugcuuucugcag

SEQ ID NO: 374515 - RNA, 19 nt, Human
ugugcaugcuuucugcagc

SEQ ID NO: 374516 - RNA, 19 nt, Human
uguguuguaugugugugug

SEQ ID NO: 374517 - RNA, 23 nt, Human
uucauagaauccaauuuaaaaac

SEQ ID NO: 374518 - RNA, 19 nt, Human
uuccugcggaucuaacugg

SEQ ID NO: 374519 - RNA, 21 nt, Human
uucugcagcuacauccacccc

SEQ ID NO: 374520 - RNA, 21 nt, Human
uugcuaaaauugccuuugacu

SEQ ID NO: 374521 - RNA, 23 nt, Human
uuggugauucugcuguggggaug

SEQ ID NO: 374522 - RNA, 21 nt, Human
uugugcaugcuuucugcagcu

SEQ ID NO: 374523 - RNA, 21 nt, Human
uuuaagauccacugacugccu

SEQ ID NO: 374524 - RNA, 21 nt, Human
aaaaauuauccuggauccagg

SEQ ID NO: 374525 - RNA, 24 nt, Human
aaaacccaccauuaaaauaagaca

SEQ ID NO: 374526 - RNA, 22 nt, Human
aaaauaagacaaguucauagaa

SEQ ID NO: 374527 - RNA, 22 nt, Human
aaccaaacccuccuggucucug

SEQ ID NO: 374528 - RNA, 23 nt, Human
aacucagcccucauuccccucug

SEQ ID NO: 374529 - RNA, 22 nt, Human
aaugaaggcacuccaggaagaa

SEQ ID NO: 374530 - RNA, 18 nt, Human
acccuccacccauagcca

SEQ ID NO: 374531 - RNA, 25 nt, Human
agaaccucuucaaacucacccucca

SEQ ID NO: 374532 - RNA, 21 nt, Human
agagcccacccauguccagcc

SEQ ID NO: 374533 - RNA, 21 nt, Human
aggaagaaggggaguuccugg

SEQ ID NO: 374534 - RNA, 26 nt, Human
aggaauuaaaggcuauagcucaagcu

SEQ ID NO: 374535 - RNA, 20 nt, Human
agguccacaaguagcaguuu

SEQ ID NO: 374536 - RNA, 24 nt, Human
aucugaaagaaucgggcacaaggg

SEQ ID NO: 374537 - RNA, 26 nt, Human
caaacucacccuccacccauagccaa

SEQ ID NO: 374538 - RNA, 23 nt, Human
cacccauagccaaaguaaggaau

SEQ ID NO: 374539 - RNA, 21 nt, Human
cacccuccacccauagccaaa

SEQ ID NO: 374540 - RNA, 19 nt, Human
cagaaaaaaaacccaccau

SEQ ID NO: 374541 - RNA, 20 nt, Human
cagaagcuguagaagaggca

SEQ ID NO: 374542 - RNA, 18 nt, Human
caguagcaguggaaccag

SEQ ID NO: 374543 - RNA, 23 nt, Human
cauaacucagcccucauuccccu

SEQ ID NO: 374544 - RNA, 21 nt, Human
ccaugcuuaggggugggcugg

SEQ ID NO: 374545 - RNA, 19 nt, Human
cccacccauguccagccau

SEQ ID NO: 374546 - RNA, 23 nt, Human
cccagguuacaagaaaaucagaa

SEQ ID NO: 374547 - RNA, 24 nt, Human
cccucugggucaguagcaguggaa

SEQ ID NO: 374548 - RNA, 18 nt, Human
ccucuuacuuuuuccaca

SEQ ID NO: 374549 - RNA, 25 nt, Human
ccucuuacuuuuuccacauuagggg

SEQ ID NO: 374550 - RNA, 21 nt, Human
ccuggugacaagggaccaugc

SEQ ID NO: 374551 - RNA, 21 nt, Human
ccugugagcuaaccaaacccu

SEQ ID NO: 374552 - RNA, 22 nt, Human
cuaaccaaacccuccuggucuc

SEQ ID NO: 374553 - RNA, 22 nt, Human
cuccaggaagaaggggaguucc

SEQ ID NO: 374554 - RNA, 19 nt, Human
cuggcaccugccugccaaa

SEQ ID NO: 374555 - RNA, 22 nt, Human
cuuuuuuguuuguuuguuuuuu

SEQ ID NO: 374556 - RNA, 21 nt, Human
gagaucccaagacugugggga

SEQ ID NO: 374557 - RNA, 21 nt, Human
gaguaguccucuuacuuuuuc

SEQ ID NO: 374558 - RNA, 21 nt, Human
gcaaacugguuuaaccucaca

SEQ ID NO: 374559 - RNA, 19 nt, Human
ggcacaccaauuccucugc

SEQ ID NO: 374560 - RNA, 19 nt, Human
ggccuggaaggcgcgggac

SEQ ID NO: 374561 - RNA, 21 nt, Human
gggccagauuuccuuccucaa

SEQ ID NO: 374562 - RNA, 22 nt, Human
gggcuggggcauguuggggagg

SEQ ID NO: 374563 - RNA, 24 nt, Human
gggcuggggcauguuggggagggg

SEQ ID NO: 374564 - RNA, 20 nt, Human
gguaaugagaagaggaaaga

SEQ ID NO: 374565 - RNA, 21 nt, Human
ggucaguagcaguggaaccag

SEQ ID NO: 374566 - RNA, 19 nt, Human
guccucuuacuuuuuccac

SEQ ID NO: 374567 - RNA, 22 nt, Human
guccucuuacuuuuuccacauu

SEQ ID NO: 374568 - RNA, 25 nt, Human
guggcagauuuucaugaaaaucagc

SEQ ID NO: 374569 - RNA, 19 nt, Human
uaaccaaacccuccugguc

SEQ ID NO: 374570 - RNA, 24 nt, Human
uaaggcacaccaauuccucugcuu

SEQ ID NO: 374571 - RNA, 21 nt, Human
uaccagaaaaaaaacccacca

SEQ ID NO: 374572 - RNA, 20 nt, Human
uacccagccgaggguccagg

SEQ ID NO: 374573 - RNA, 22 nt, Human
uacccagccgaggguccagggc

SEQ ID NO: 374574 - RNA, 25 nt, Human
ucagagcccacccauguccagccau

SEQ ID NO: 374575 - RNA, 22 nt, Human
ucaguagcaguggaaccaggaa

SEQ ID NO: 374576 - RNA, 20 nt, Human
uccagggcacuggauggaag

SEQ ID NO: 374577 - RNA, 20 nt, Human
uccagggcacuggauggaag

SEQ ID NO: 374578 - RNA, 20 nt, Human
ucccagguuacaagaaaauc

SEQ ID NO: 374579 - RNA, 25 nt, Human
uccucauucuugaugaauagucuca

SEQ ID NO: 374580 - RNA, 23 nt, Human
ucuaaaucuuaccagaaaaaaaa

SEQ ID NO: 374581 - RNA, 23 nt, Human
ugaaagaaucgggcacaagguca

SEQ ID NO: 374582 - RNA, 24 nt, Human
ugacaagccuucaucccagacccu

SEQ ID NO: 374583 - RNA, 23 nt, Human
ugaguaguccucuuacuuuuucc

SEQ ID NO: 374584 - RNA, 24 nt, Human
ugaguaguccucuuacuuuuucca

SEQ ID NO: 374585 - RNA, 19 nt, Human
ugcugaacuuugcucagca

SEQ ID NO: 374586 - RNA, 21 nt, Human
uggaaccaggaaacccaaggg

SEQ ID NO: 374587 - RNA, 18 nt, Human
uggggugggggaaguccu

SEQ ID NO: 374588 - RNA, 24 nt, Human
uggggugggggaaguccugugagc

SEQ ID NO: 374589 - RNA, 18 nt, Human
uguuuguuuguuuuuuuc

SEQ ID NO: 374590 - RNA, 23 nt, Human
uucaaaagagaaaguucugcauc

SEQ ID NO: 374591 - RNA, 22 nt, Human
uucauaacucagcccucauucc

SEQ ID NO: 374592 - RNA, 18 nt, Human
uuguuuguuuguuuuuuu

SEQ ID NO: 374593 - RNA, 21 nt, Human
uuuaaaaauuauccuggaucc

SEQ ID NO: 374594 - RNA, 25 nt, Human
uuuaucaucaaaacaaacagccaau

SEQ ID NO: 374595 - RNA, 22 nt, Human
uuuucaugaaaaucagcuucug

SEQ ID NO: 374596 - RNA, 20 nt, Human
uuuuuguuuguuuguuuuuu

SEQ ID NO: 374597 - RNA, 22 nt, Human
uuuuuuuuuuuuuuuuuuucag

SEQ ID NO: 374598 - RNA, 19 nt, Human
auugcaacucaaagugcau

SEQ ID NO: 374599 - RNA, 18 nt, Human
ccgcgcgcgccgcucccg

SEQ ID NO: 374600 - RNA, 21 nt, Human
cucccggggcuccaggccgcc

SEQ ID NO: 374601 - RNA, 20 nt, Human
gccaggagagaaugugcagc

SEQ ID NO: 374602 - RNA, 19 nt, Human
gcuccaggccgcccgcgcc

SEQ ID NO: 374603 - RNA, 22 nt, Human
ggccaggagagccggcugggcc

SEQ ID NO: 374604 - RNA, 19 nt, Human
ggcgccgccgccaggagag

SEQ ID NO: 374605 - RNA, 20 nt, Human
gugcagcgcgaggccaggag

SEQ ID NO: 374606 - RNA, 21 nt, Human
ugugcagcgcgaggccaggag

SEQ ID NO: 374607 - RNA, 22 nt, Human
uuuguuuuuggcccauauaaaa

SEQ ID NO: 374608 - RNA, 24 nt, Human
uuuuuuuuuuuguuuuuuguuuuu

SEQ ID NO: 374609 - RNA, 19 nt, Human
aaaaagugcucaggguucc

SEQ ID NO: 374610 - RNA, 18 nt, Human
aagcagcagaaacagagc

SEQ ID NO: 374611 - RNA, 19 nt, Human
aagcagcagaaacagagcu

SEQ ID NO: 374612 - RNA, 22 nt, Human
acgccgacaccugccgcccggc

SEQ ID NO: 374613 - RNA, 18 nt, Human
aggguuccccacccccac

SEQ ID NO: 374614 - RNA, 22 nt, Human
augucucccuuuuucucagagc

SEQ ID NO: 374615 - RNA, 22 nt, Human
cagaaacagagcugggucccuc

SEQ ID NO: 374616 - RNA, 18 nt, Human
cagcagaaacagagcugg

SEQ ID NO: 374617 - RNA, 25 nt, Human
cagcagaaacagagcugggucccuc

SEQ ID NO: 374618 - RNA, 24 nt, Human
cauccaugcuggguccagcuccuc

SEQ ID NO: 374619 - RNA, 20 nt, Human
ccugccgcccggcgcgcccg

SEQ ID NO: 374620 - RNA, 22 nt, Human
ccugccgcccggcgcgcccgcc

SEQ ID NO: 374621 - RNA, 23 nt, Human
cgacgccgacaccugccgcccgg

SEQ ID NO: 374622 - RNA, 26 nt, Human
cgccgccgaaugccgccgacgccgac

SEQ ID NO: 374623 - RNA, 22 nt, Human
gaagcagcagaaacagagcugg

SEQ ID NO: 374624 - RNA, 24 nt, Human
gccgacaccugccgcccggcgcgg

SEQ ID NO: 374625 - RNA, 18 nt, Human
ggguuccccacccccacc

SEQ ID NO: 374626 - RNA, 22 nt, Human
uccaugcuggguccagcuccuc

SEQ ID NO: 374627 - RNA, 23 nt, Human
uccccacccccacccugcauuuc

SEQ ID NO: 374628 - RNA, 24 nt, Human
uggaagcagcagaaacagagcugg

SEQ ID NO: 374629 - RNA, 24 nt, Human
uuccccacccccacccugcauuuc

SEQ ID NO: 374630 - RNA, 24 nt, Human
aaaaaaaaacuuuacaaauaccau

SEQ ID NO: 374631 - RNA, 19 nt, Human
aaaaaacuuuacaaauacc

SEQ ID NO: 374632 - RNA, 18 nt, Human
aaaaauuucaguuaacac

SEQ ID NO: 374633 - RNA, 21 nt, Human
aaaaggccacaaaccaguaaa

SEQ ID NO: 374634 - RNA, 27 nt, Human
aaacuagaagauggucaaaggggaccc

SEQ ID NO: 374635 - RNA, 25 nt, Human
aaacuagaaguaaaaacuagaagau

SEQ ID NO: 374636 - RNA, 19 nt, Human
aaaguacuaaaauacuaug

SEQ ID NO: 374637 - RNA, 25 nt, Human
aaccaguaaauaaacaacguggcuu

SEQ ID NO: 374638 - RNA, 20 nt, Human
acaaaauaauaaacacuuac

SEQ ID NO: 374639 - RNA, 24 nt, Human
acaaaccaguaaauaaacaacgug

SEQ ID NO: 374640 - RNA, 24 nt, Human
acaaagcacaguaaaaggccacaa

SEQ ID NO: 374641 - RNA, 28 nt, Human
acaaagcacaguaaaaggccacaaacca

SEQ ID NO: 374642 - RNA, 24 nt, Human
acaguaaaaggccacaaaccagua

SEQ ID NO: 374643 - RNA, 24 nt, Human
acagugcaaauauaaauucuuuau

SEQ ID NO: 374644 - RNA, 21 nt, Human
agacgucauagucugcaaaaa

SEQ ID NO: 374645 - RNA, 23 nt, Human
auacaaagcacaguaaaaggcca

SEQ ID NO: 374646 - RNA, 22 nt, Human
auauacaauauaaacaaaacug

SEQ ID NO: 374647 - RNA, 20 nt, Human
caaaccaguaaauaaacaaa

SEQ ID NO: 374648 - RNA, 22 nt, Human
caaagcacaguaaaaggccaca

SEQ ID NO: 374649 - RNA, 22 nt, Human
cagcacugaggauccaagacaa

SEQ ID NO: 374650 - RNA, 19 nt, Human
cagugcaaucaugucacuu

SEQ ID NO: 374651 - RNA, 22 nt, Human
cauuuuugucuucagcagcaaa

SEQ ID NO: 374652 - RNA, 24 nt, Human
ccaaauggcaaauaaaagcuuuac

SEQ ID NO: 374653 - RNA, 20 nt, Human
ccuaugccauagaauuuuuu

SEQ ID NO: 374654 - RNA, 20 nt, Human
ccuuuuggcagcacugagga

SEQ ID NO: 374655 - RNA, 25 nt, Human
cugcaaaaacaaaaggcacaucuga

SEQ ID NO: 374656 - RNA, 19 nt, Human
gaaaaauuucacaaaagca

SEQ ID NO: 374657 - RNA, 20 nt, Human
gucuugaaggcaaggcaguu

SEQ ID NO: 374658 - RNA, 24 nt, Human
uaaaaggccacaaaccaguaaaua

SEQ ID NO: 374659 - RNA, 21 nt, Human
uaaaccauauuuuugcagagu

SEQ ID NO: 374660 - RNA, 19 nt, Human
uaaagacgucauagucugc

SEQ ID NO: 374661 - RNA, 22 nt, Human
uaaagacgucauagucugcaaa

SEQ ID NO: 374662 - RNA, 27 nt, Human
uacaaagcacaguaaaaggccacaaac

SEQ ID NO: 374663 - RNA, 24 nt, Human
uagcauuuuuguaagagcauuauu

SEQ ID NO: 374664 - RNA, 18 nt, Human
ucacaaaagcacuauccc

SEQ ID NO: 374665 - RNA, 22 nt, Human
ucagcaaaacacucuaucacuu

SEQ ID NO: 374666 - RNA, 23 nt, Human
ucugcaaaaacaaaaggcacauc

SEQ ID NO: 374667 - RNA, 22 nt, Human
ucuugaaggcaaggcaguuggu

SEQ ID NO: 374668 - RNA, 21 nt, Human
ugacaaaauaauaaacacuua

SEQ ID NO: 374669 - RNA, 24 nt, Human
uguuaagaacucugauacaaagca

SEQ ID NO: 374670 - RNA, 23 nt, Human
uuaaauauuaccaaucuaaaaaa

SEQ ID NO: 374671 - RNA, 19 nt, Human
uuauacuggccuuuuggca

SEQ ID NO: 374672 - RNA, 19 nt, Human
uuuacucacuuaucugauu

SEQ ID NO: 374673 - RNA, 23 nt, Human
aaaaaaacgaccaguccugcagg

SEQ ID NO: 374674 - RNA, 21 nt, Human
aaaaugcuuccauuucugccu

SEQ ID NO: 374675 - RNA, 22 nt, Human
aaacaaucaaaccacgcgcaga

SEQ ID NO: 374676 - RNA, 18 nt, Human
aaaguggaaauugagguc

SEQ ID NO: 374677 - RNA, 19 nt, Human
aacaaugucucuggacucu

SEQ ID NO: 374678 - RNA, 20 nt, Human
aagauuuuuggguggcagcu

SEQ ID NO: 374679 - RNA, 22 nt, Human
agcacuuguaguuuuuccccca

SEQ ID NO: 374680 - RNA, 18 nt, Human
aggcauuuacaaugaaau

SEQ ID NO: 374681 - RNA, 22 nt, Human
aguggugggcagaaggcggugu

SEQ ID NO: 374682 - RNA, 22 nt, Human
auaugccaucacauguaagagc

SEQ ID NO: 374683 - RNA, 24 nt, Human
aucccucccaccacccucggaccc

SEQ ID NO: 374684 - RNA, 22 nt, Human
auggagggguggagguagccaa

SEQ ID NO: 374685 - RNA, 21 nt, Human
auuccucagggccuggaaggu

SEQ ID NO: 374686 - RNA, 24 nt, Human
cacccucauuuuacaaaguggaaa

SEQ ID NO: 374687 - RNA, 21 nt, Human
cacugaaucaaugcaacugca

SEQ ID NO: 374688 - RNA, 18 nt, Human
cagcauagcuucuuccag

SEQ ID NO: 374689 - RNA, 24 nt, Human
cagucccuggacuuucccacuccc

SEQ ID NO: 374690 - RNA, 18 nt, Human
ccacaccgcucccuuaaa

SEQ ID NO: 374691 - RNA, 24 nt, Human
ccacucccacaccgcucccuuaaa

SEQ ID NO: 374692 - RNA, 22 nt, Human
cccacaccgcucccuuaaaacc

SEQ ID NO: 374693 - RNA, 20 nt, Human
cccucuccuuuucuacccca

SEQ ID NO: 374694 - RNA, 21 nt, Human
cccugccccgugggaccccuc

SEQ ID NO: 374695 - RNA, 25 nt, Human
ccugcaaggccaguguccuugaacc

SEQ ID NO: 374696 - RNA, 24 nt, Human
cgugggaccccucagcuggcgggc

SEQ ID NO: 374697 - RNA, 22 nt, Human
cuccccugccccgugggacccc

SEQ ID NO: 374698 - RNA, 23 nt, Human
cucucaauucccuccccugcccc

SEQ ID NO: 374699 - RNA, 24 nt, Human
cucucucucucucaccucugccca

SEQ ID NO: 374700 - RNA, 25 nt, Human
cuuuaaaaaccacuacuuucauucu

SEQ ID NO: 374701 - RNA, 19 nt, Human
cuuucggucaugauucauu

SEQ ID NO: 374702 - RNA, 21 nt, Human
gaaggucucagcccccugccc

SEQ ID NO: 374703 - RNA, 23 nt, Human
gacccucuccuuuucuaggaguc

SEQ ID NO: 374704 - RNA, 23 nt, Human
gagccaggacuagaaaccacauc

SEQ ID NO: 374705 - RNA, 23 nt, Human
gauaugccaucacauguaagagc

SEQ ID NO: 374706 - RNA, 19 nt, Human
gauccuauucccaccucca

SEQ ID NO: 374707 - RNA, 23 nt, Human
gcacugaaucaaugcaacugcau

SEQ ID NO: 374708 - RNA, 28 nt, Human
gcacuggaguccuuggaaucauaugcca

SEQ ID NO: 374709 - RNA, 22 nt, Human
gcagaggacagaaauguggggg

SEQ ID NO: 374710 - RNA, 20 nt, Human
gcgaggugcaagggggaauc

SEQ ID NO: 374711 - RNA, 20 nt, Human
gcggguucagggccggggcg

SEQ ID NO: 374712 - RNA, 21 nt, Human
gcucagugucugugacucuca

SEQ ID NO: 374713 - RNA, 21 nt, Human
ggacccucuccuuuucuaccc

SEQ ID NO: 374714 - RNA, 20 nt, Human
ggacuuucccacucccacac

SEQ ID NO: 374715 - RNA, 21 nt, Human
ggagggcacgccaccuuccag

SEQ ID NO: 374716 - RNA, 19 nt, Human
ggcuaugggucgggggagg

SEQ ID NO: 374717 - RNA, 21 nt, Human
gggaugcugcucuuugggaag

SEQ ID NO: 374718 - RNA, 19 nt, Human
gggcgcccgccggugggga

SEQ ID NO: 374719 - RNA, 22 nt, Human
uaccagccagaggagggcacgc

SEQ ID NO: 374720 - RNA, 27 nt, Human
uagaaaccacaucuacaguugccccca

SEQ ID NO: 374721 - RNA, 22 nt, Human
uagccaaacauccggggaagcc

SEQ ID NO: 374722 - RNA, 21 nt, Human
ucaaaccacgcgcagaggaca

SEQ ID NO: 374723 - RNA, 18 nt, Human
ucagaagagagcaucaca

SEQ ID NO: 374724 - RNA, 24 nt, Human
uccaacuuucuuaaccagucccug

SEQ ID NO: 374725 - RNA, 21 nt, Human
ucccuggacuuucccacuccc

SEQ ID NO: 374726 - RNA, 19 nt, Human
uccgugaguggugggcaga

SEQ ID NO: 374727 - RNA, 18 nt, Human
ucuaccccaauggaugau

SEQ ID NO: 374728 - RNA, 23 nt, Human
ucucucaccucugcccauucaaa

SEQ ID NO: 374729 - RNA, 22 nt, Human
ucugaagugggaccagcaaagg

SEQ ID NO: 374730 - RNA, 19 nt, Human
ucuuucucucucucucucc

SEQ ID NO: 374731 - RNA, 21 nt, Human
ucuuucucucucucucucuca

SEQ ID NO: 374732 - RNA, 25 nt, Human
ucuuugggaaguuggggcggaugug

SEQ ID NO: 374733 - RNA, 21 nt, Human
ugaaaaugcuuccauuucugc

SEQ ID NO: 374734 - RNA, 24 nt, Human
ugaagugggaccagcaaagguagg

SEQ ID NO: 374735 - RNA, 21 nt, Human
ugagauggagggguggaggua

SEQ ID NO: 374736 - RNA, 23 nt, Human
ugagauggagggguggagguagc

SEQ ID NO: 374737 - RNA, 24 nt, Human
ugauggcugcucccucgggccugc

SEQ ID NO: 374738 - RNA, 24 nt, Human
ugauuucuaucccucccaccaccc

SEQ ID NO: 374739 - RNA, 18 nt, Human
ugcauaaauaacuuaagu

SEQ ID NO: 374740 - RNA, 18 nt, Human
ugcucuuugggaaguugg

SEQ ID NO: 374741 - RNA, 23 nt, Human
uggcagagccaggacuagaaacc

SEQ ID NO: 374742 - RNA, 21 nt, Human
uggcugucagaagagagcauc

SEQ ID NO: 374743 - RNA, 22 nt, Human
ugggaagcagcauagcuucuuc

SEQ ID NO: 374744 - RNA, 20 nt, Human
ugggaaguuggggcggaugu

SEQ ID NO: 374745 - RNA, 22 nt, Human
uggggaggggcgcgggcgggcu

SEQ ID NO: 374746 - RNA, 22 nt, Human
uggggcgcggguucagggccgg

SEQ ID NO: 374747 - RNA, 20 nt, Human
uucaucuuuggcugucagaa

SEQ ID NO: 374748 - RNA, 18 nt, Human
uuccaguagcacaggcuc

SEQ ID NO: 374749 - RNA, 19 nt, Human
uucccacucccacaccgcu

SEQ ID NO: 374750 - RNA, 24 nt, Human
uucucuucggaaggugacuuuaaa

SEQ ID NO: 374751 - RNA, 24 nt, Human
uucuuugagauggagggguggagg

SEQ ID NO: 374752 - RNA, 23 nt, Human
uugcccccagucuugugcucugg

SEQ ID NO: 374753 - RNA, 20 nt, Human
uuuauuaacaaugucucugg

SEQ ID NO: 374754 - RNA, 23 nt, Human
uuuuuuuuuuuuuuuucuuucgg

SEQ ID NO: 374755 - RNA, 21 nt, Human
aaagggagggggcauugaagg

SEQ ID NO: 374756 - RNA, 24 nt, Human
aagaguccaacgcccaccuccucg

SEQ ID NO: 374757 - RNA, 23 nt, Human
aagggagggggcauugaagggau

SEQ ID NO: 374758 - RNA, 22 nt, Human
aagucccucgaaccccccacuc

SEQ ID NO: 374759 - RNA, 23 nt, Human
acagcaaccugggugcugggccc

SEQ ID NO: 374760 - RNA, 21 nt, Human
accaacccuggugcuuccccu

SEQ ID NO: 374761 - RNA, 21 nt, Human
accuccuucuccucuguccag

SEQ ID NO: 374762 - RNA, 22 nt, Human
accugucagccucuucagccuc

SEQ ID NO: 374763 - RNA, 23 nt, Human
agagagaaaacaggagucauagg

SEQ ID NO: 374764 - RNA, 20 nt, Human
agcaggcccuucucaggucc

SEQ ID NO: 374765 - RNA, 21 nt, Human
agccccugccucgucaccucc

SEQ ID NO: 374766 - RNA, 23 nt, Human
aggaaaauaggggcagauauagc

SEQ ID NO: 374767 - RNA, 22 nt, Human
aggcaagggcagaauguacagg

SEQ ID NO: 374768 - RNA, 22 nt, Human
aggcaagggguaagaggcaagg

SEQ ID NO: 374769 - RNA, 21 nt, Human
agggaguggggcugacugagc

SEQ ID NO: 374770 - RNA, 24 nt, Human
agucccucgaaccccccacucccc

SEQ ID NO: 374771 - RNA, 23 nt, Human
agucucuggguggccuagcccuu

SEQ ID NO: 374772 - RNA, 20 nt, Human
aguggaggaggacugggggc

SEQ ID NO: 374773 - RNA, 18 nt, Human
aguggcuaggagagggga

SEQ ID NO: 374774 - RNA, 21 nt, Human
caaauaccacugggaggcaag

SEQ ID NO: 374775 - RNA, 18 nt, Human
caaggugugcgguccagc

SEQ ID NO: 374776 - RNA, 22 nt, Human
cacacaggcugggggcaggggc

SEQ ID NO: 374777 - RNA, 18 nt, Human
caccaaccacccuggccg

SEQ ID NO: 374778 - RNA, 19 nt, Human
cacuaagucccucgaaccc

SEQ ID NO: 374779 - RNA, 19 nt, Human
cacugccaccaccaggccu

SEQ ID NO: 374780 - RNA, 18 nt, Human
cagacagaaagccccccg

SEQ ID NO: 374781 - RNA, 22 nt, Human
cagggcagugagccagacagaa

SEQ ID NO: 374782 - RNA, 19 nt, Human
ccacugccaccaccaggcc

SEQ ID NO: 374783 - RNA, 22 nt, Human
cccccacuccccaaugaggcuc

SEQ ID NO: 374784 - RNA, 20 nt, Human
ccccccgaccugucagccuc

SEQ ID NO: 374785 - RNA, 20 nt, Human
cccccggccgccgccgccgc

SEQ ID NO: 374786 - RNA, 19 nt, Human
cccccgggccagccgccgg

SEQ ID NO: 374787 - RNA, 21 nt, Human
ccccugagugggagacacggc

SEQ ID NO: 374788 - RNA, 21 nt, Human
cccucgaaccccccacucccc

SEQ ID NO: 374789 - RNA, 20 nt, Human
cccugagccucaggccacgg

SEQ ID NO: 374790 - RNA, 19 nt, Human
ccgccgccgccgccgccuc

SEQ ID NO: 374791 - RNA, 21 nt, Human
ccgccgccgccgccgccucgg

SEQ ID NO: 374792 - RNA, 18 nt, Human
ccgccgccgccgccucgg

SEQ ID NO: 374793 - RNA, 21 nt, Human
ccgccgccgccgccucggccg

SEQ ID NO: 374794 - RNA, 19 nt, Human
ccgccgccgccucggccgc

SEQ ID NO: 374795 - RNA, 20 nt, Human
ccgccgccgccucggccgcc

SEQ ID NO: 374796 - RNA, 22 nt, Human
ccggccgccgccgccgccgccu

SEQ ID NO: 374797 - RNA, 23 nt, Human
ccucaaagcuacucucagccccu

SEQ ID NO: 374798 - RNA, 22 nt, Human
ccucagccuccuccacugccac

SEQ ID NO: 374799 - RNA, 21 nt, Human
ccuccucagccuccuccacug

SEQ ID NO: 374800 - RNA, 20 nt, Human
ccugggugcugggcccugug

SEQ ID NO: 374801 - RNA, 23 nt, Human
cgccgccucggccgccucccccg

SEQ ID NO: 374802 - RNA, 23 nt, Human
cuguccagccuguucuccugggg

SEQ ID NO: 374803 - RNA, 19 nt, Human
cuuccugccuucagaaagg

SEQ ID NO: 374804 - RNA, 18 nt, Human
gaaccccccacuccccaa

SEQ ID NO: 374805 - RNA, 23 nt, Human
gaccugucagccucuucagccuc

SEQ ID NO: 374806 - RNA, 22 nt, Human
gagcagcugucacucucuggga

SEQ ID NO: 374807 - RNA, 22 nt, Human
gagcaggcccuucucagguccu

SEQ ID NO: 374808 - RNA, 24 nt, Human
gagccuaguaagggaagagggagc

SEQ ID NO: 374809 - RNA, 18 nt, Human
gcaggggcugggcggggg

SEQ ID NO: 374810 - RNA, 18 nt, Human
gcaggggcugggcggggg

SEQ ID NO: 374811 - RNA, 19 nt, Human
gccauagagccuaguaagg

SEQ ID NO: 374812 - RNA, 22 nt, Human
gccccugccucgucaccuccug

SEQ ID NO: 374813 - RNA, 18 nt, Human
gcccugugucuccuggag

SEQ ID NO: 374814 - RNA, 20 nt, Human
gccuccucagccuccuccac

SEQ ID NO: 374815 - RNA, 22 nt, Human
gcucugugaauugucucugauu

SEQ ID NO: 374816 - RNA, 20 nt, Human
ggagcccagggagggaggcu

SEQ ID NO: 374817 - RNA, 22 nt, Human
ggaggggcggggggcccugagc

SEQ ID NO: 374818 - RNA, 25 nt, Human
ggaguggggcugacugagcaggggc

SEQ ID NO: 374819 - RNA, 18 nt, Human
ggcaaggaacagggcaca

SEQ ID NO: 374820 - RNA, 21 nt, Human
ggcaaggagcccagggaggga

SEQ ID NO: 374821 - RNA, 25 nt, Human
ggcaggggcugggcgggggguggug

SEQ ID NO: 374822 - RNA, 20 nt, Human
ggccagcuccgggcacaguc

SEQ ID NO: 374823 - RNA, 22 nt, Human
ggcgggugggucaucagggcag

SEQ ID NO: 374824 - RNA, 24 nt, Human
ggcugggagggaggggcggggggc

SEQ ID NO: 374825 - RNA, 25 nt, Human
ggcugggagggaggggcggggggcc

SEQ ID NO: 374826 - RNA, 18 nt, Human
ggcugggaggugacgcug

SEQ ID NO: 374827 - RNA, 18 nt, Human
gggagggaggggcggggg

SEQ ID NO: 374828 - RNA, 20 nt, Human
gggcaggggcugggcggggg

SEQ ID NO: 374829 - RNA, 26 nt, Human
gggcaggggcugggcgggggguggug

SEQ ID NO: 374830 - RNA, 19 nt, Human
gggcgggugggucaucagg

SEQ ID NO: 374831 - RNA, 23 nt, Human
ggggcaggggcugggcggggggu

SEQ ID NO: 374832 - RNA, 22 nt, Human
ggggcgggugggucaucagggc

SEQ ID NO: 374833 - RNA, 22 nt, Human
gggggcaggggcugggcggggg

SEQ ID NO: 374834 - RNA, 25 nt, Human
gggugggucaucagggcagugagcc

SEQ ID NO: 374835 - RNA, 26 nt, Human
gugcugggcccugugucuccuggagc

SEQ ID NO: 374836 - RNA, 24 nt, Human
guggggcugacugagcaggggcca

SEQ ID NO: 374837 - RNA, 21 nt, Human
uaagaggcaagggcagaaugu

SEQ ID NO: 374838 - RNA, 18 nt, Human
uaagggaagagggagcug

SEQ ID NO: 374839 - RNA, 22 nt, Human
ucagccucuucagccuccucag

SEQ ID NO: 374840 - RNA, 19 nt, Human
ucagguccugggauagagg

SEQ ID NO: 374841 - RNA, 23 nt, Human
uccaacgcccaccuccucggacc

SEQ ID NO: 374842 - RNA, 25 nt, Human
uccacuaagucccucgaacccccca

SEQ ID NO: 374843 - RNA, 20 nt, Human
uccacugccaccaccaggcc

SEQ ID NO: 374844 - RNA, 24 nt, Human
uccagcucggggcugggaggugac

SEQ ID NO: 374845 - RNA, 23 nt, Human
uccucaaagcuacucucagcccc

SEQ ID NO: 374846 - RNA, 20 nt, Human
uccucagccuccuccacugc

SEQ ID NO: 374847 - RNA, 18 nt, Human
uccuggagccccugccuc

SEQ ID NO: 374848 - RNA, 20 nt, Human
uccugggauagagggucauu

SEQ ID NO: 374849 - RNA, 25 nt, Human
ucgcccccggccgccgccgccgccg

SEQ ID NO: 374850 - RNA, 24 nt, Human
ucuccuggagccaaggguuagggc

SEQ ID NO: 374851 - RNA, 22 nt, Human
ucuccuggggcuuugcugcugg

SEQ ID NO: 374852 - RNA, 21 nt, Human
ucucugggaagcccagggagu

SEQ ID NO: 374853 - RNA, 19 nt, Human
ucucuggguggccuagccc

SEQ ID NO: 374854 - RNA, 20 nt, Human
ucucuggguggccuagcccu

SEQ ID NO: 374855 - RNA, 20 nt, Human
ucuucagccuccucagccuc

SEQ ID NO: 374856 - RNA, 24 nt, Human
ugaagggaugagaacuccacuaag

SEQ ID NO: 374857 - RNA, 22 nt, Human
ugaauccuuaccaccaaccacc

SEQ ID NO: 374858 - RNA, 23 nt, Human
ugacgcuggugggcugggaggga

SEQ ID NO: 374859 - RNA, 22 nt, Human
ugagccagacagaaagcccccc

SEQ ID NO: 374860 - RNA, 18 nt, Human
ugagugggagacacggcc

SEQ ID NO: 374861 - RNA, 21 nt, Human
ugauuccuuuccuggagcccc

SEQ ID NO: 374862 - RNA, 22 nt, Human
ugccgacagcaaccugggugcu

SEQ ID NO: 374863 - RNA, 26 nt, Human
ugcgguccagcucggggcugggaggu

SEQ ID NO: 374864 - RNA, 22 nt, Human
uggcaugggcaugucagacccu

SEQ ID NO: 374865 - RNA, 18 nt, Human
uggccuagcccuuaggca

SEQ ID NO: 374866 - RNA, 24 nt, Human
ugggaagcccagggaguggggcug

SEQ ID NO: 374867 - RNA, 25 nt, Human
ugggagacacggccagcuccgggca

SEQ ID NO: 374868 - RNA, 26 nt, Human
ugggaugcgucucaaggucauggagg

SEQ ID NO: 374869 - RNA, 20 nt, Human
ugggcugggagggaggggcg

SEQ ID NO: 374870 - RNA, 25 nt, Human
ugggcugggagggaggggcgggggg

SEQ ID NO: 374871 - RNA, 18 nt, Human
ugggggcaggggcugggc

SEQ ID NO: 374872 - RNA, 18 nt, Human
ugggggcaggggcugggc

SEQ ID NO: 374873 - RNA, 19 nt, Human
ugggggcaggggcugggcg

SEQ ID NO: 374874 - RNA, 19 nt, Human
uggggggcugcagaacagg

SEQ ID NO: 374875 - RNA, 20 nt, Human
uuaccaccaaccacccuggc

SEQ ID NO: 374876 - RNA, 19 nt, Human
uuucucagacaaagaauga

SEQ ID NO: 374877 - RNA, 22 nt, Human
uuuuuuuuuuuuuuuaaccgga

SEQ ID NO: 374878 - RNA, 23 nt, Human
uuuuuuuuuuuuuuuuuaaccgg

SEQ ID NO: 374879 - RNA, 18 nt, Human
aaaaaaaaaaaaaaaagc

SEQ ID NO: 374880 - RNA, 21 nt, Human
aaaaaaaaaaaaaacaggcaa

SEQ ID NO: 374881 - RNA, 23 nt, Human
aaaaaaaaaaaaaacaggcaaug

SEQ ID NO: 374882 - RNA, 23 nt, Human
aaaaaaaaaaagccagcaguaag

SEQ ID NO: 374883 - RNA, 24 nt, Human
aaaaaaacaggcaaugaugucgag

SEQ ID NO: 374884 - RNA, 23 nt, Human
aaaaaagaaaucaaaagggaaga

SEQ ID NO: 374885 - RNA, 20 nt, Human
aaaaagaaacaucucugccc

SEQ ID NO: 374886 - RNA, 23 nt, Human
aaaaagaaaucaaaagggaagaa

SEQ ID NO: 374887 - RNA, 24 nt, Human
aaaaagccagcaguaaguaaaaug

SEQ ID NO: 374888 - RNA, 22 nt, Human
aaaaugccaucagagucuguga

SEQ ID NO: 374889 - RNA, 18 nt, Human
aaacagcaggauccccac

SEQ ID NO: 374890 - RNA, 20 nt, Human
aaacggcuguccccacccuu

SEQ ID NO: 374891 - RNA, 18 nt, Human
aaacgggguucagcgagc

SEQ ID NO: 374892 - RNA, 22 nt, Human
aaagcacaguuuaaguacacug

SEQ ID NO: 374893 - RNA, 20 nt, Human
aaaggguauuugaaacugac

SEQ ID NO: 374894 - RNA, 21 nt, Human
aacacugcauaccaagggggg

SEQ ID NO: 374895 - RNA, 22 nt, Human
aacagcaggauccccacuggcu

SEQ ID NO: 374896 - RNA, 19 nt, Human
aacagccucaccaccgaau

SEQ ID NO: 374897 - RNA, 24 nt, Human
aacaguugugcugccaaaaggguc

SEQ ID NO: 374898 - RNA, 20 nt, Human
aacauacuugcaugcuaaaa

SEQ ID NO: 374899 - RNA, 19 nt, Human
aaccaauaauaaaaauaag

SEQ ID NO: 374900 - RNA, 23 nt, Human
aaccaauaauaaaaauaagccaa

SEQ ID NO: 374901 - RNA, 20 nt, Human
aacccagcucugcacccucc

SEQ ID NO: 374902 - RNA, 24 nt, Human
aacuacuuauaauaaacagcagga

SEQ ID NO: 374903 - RNA, 20 nt, Human
aacuuccucccaaggaaccc

SEQ ID NO: 374904 - RNA, 22 nt, Human
aagaaaccuguccaucugcagc

SEQ ID NO: 374905 - RNA, 19 nt, Human
aagaccgacaagcuucaaa

SEQ ID NO: 374906 - RNA, 26 nt, Human
aagagccaggcacggggacccggagc

SEQ ID NO: 374907 - RNA, 19 nt, Human
aagaggcagggaguggagg

SEQ ID NO: 374908 - RNA, 19 nt, Human
aagaguaaaaguagacaaa

SEQ ID NO: 374909 - RNA, 18 nt, Human
aagcaagcgggaggggag

SEQ ID NO: 374910 - RNA, 20 nt, Human
aagcaagcgggaggggaggc

SEQ ID NO: 374911 - RNA, 21 nt, Human
aagcaagcgggaggggaggcg

SEQ ID NO: 374912 - RNA, 22 nt, Human
aagcagggaaccacacaguaaa

SEQ ID NO: 374913 - RNA, 19 nt, Human
aagccacagaaaagaaacc

SEQ ID NO: 374914 - RNA, 21 nt, Human
aagcuucaaacagcgccuucc

SEQ ID NO: 374915 - RNA, 22 nt, Human
aagcuugcuggcuucgcauccc

SEQ ID NO: 374916 - RNA, 21 nt, Human
aaggaaacagacaccgaccac

SEQ ID NO: 374917 - RNA, 24 nt, Human
aaggaaacagacaccgaccacuuc

SEQ ID NO: 374918 - RNA, 20 nt, Human
aaugguggggagcgaggggg

SEQ ID NO: 374919 - RNA, 19 nt, Human
aauuucaggaaaaagaaau

SEQ ID NO: 374920 - RNA, 24 nt, Human
acaaaaaaaggacaggaaaaaugu

SEQ ID NO: 374921 - RNA, 22 nt, Human
acaaaaaaauacauaguuuuca

SEQ ID NO: 374922 - RNA, 18 nt, Human
acaaaucucuacuauagc

SEQ ID NO: 374923 - RNA, 23 nt, Human
acacagcacccacccgccacccc

SEQ ID NO: 374924 - RNA, 20 nt, Human
acacugcauaccaagggggg

SEQ ID NO: 374925 - RNA, 22 nt, Human
acagaaaaaauucaaaucugga

SEQ ID NO: 374926 - RNA, 20 nt, Human
acagaaaauguccaagauuc

SEQ ID NO: 374927 - RNA, 20 nt, Human
acagcacccacccgccaccc

SEQ ID NO: 374928 - RNA, 22 nt, Human
acagccuuaaauauuguuaaaa

SEQ ID NO: 374929 - RNA, 22 nt, Human
acagugcauugagucugcuuug

SEQ ID NO: 374930 - RNA, 21 nt, Human
accaaaacugacaaaaaaauc

SEQ ID NO: 374931 - RNA, 22 nt, Human
accacacaguaaaagaguauaa

SEQ ID NO: 374932 - RNA, 22 nt, Human
accuccccucccccgccccgcc

SEQ ID NO: 374933 - RNA, 21 nt, Human
accuucguugcggcggccccg

SEQ ID NO: 374934 - RNA, 24 nt, Human
acucaucaaaacagccuuaaauau

SEQ ID NO: 374935 - RNA, 18 nt, Human
acugaaaaaacacagcaa

SEQ ID NO: 374936 - RNA, 21 nt, Human
agaaaguaagacaagcaucau

SEQ ID NO: 374937 - RNA, 24 nt, Human
agaacagaaaaaauucaaaucugg

SEQ ID NO: 374938 - RNA, 22 nt, Human
agaaggaaacagacaccgacca

SEQ ID NO: 374939 - RNA, 20 nt, Human
agaauucucuccugccaccu

SEQ ID NO: 374940 - RNA, 18 nt, Human
agacuucaaagaccgaca

SEQ ID NO: 374941 - RNA, 23 nt, Human
agagaccaacaaaaaaaaaucaa

SEQ ID NO: 374942 - RNA, 20 nt, Human
agagagcucaguuucauaaa

SEQ ID NO: 374943 - RNA, 24 nt, Human
agauagucuacgagaagacgaaac

SEQ ID NO: 374944 - RNA, 19 nt, Human
agcaagcgggaggggaggc

SEQ ID NO: 374945 - RNA, 19 nt, Human
agcaucuucuucucucccc

SEQ ID NO: 374946 - RNA, 19 nt, Human
agcauuaacacugcauacc

SEQ ID NO: 374947 - RNA, 24 nt, Human
agccagcgcuggugucuccgcgcg

SEQ ID NO: 374948 - RNA, 18 nt, Human
agccccgaggcuucccuc

SEQ ID NO: 374949 - RNA, 19 nt, Human
agcgcacugccucagguag

SEQ ID NO: 374950 - RNA, 19 nt, Human
agcggguccuaccuccccu

SEQ ID NO: 374951 - RNA, 21 nt, Human
agcugauuccggggcagcccc

SEQ ID NO: 374952 - RNA, 25 nt, Human
aggaaaaagaaauaguaauuacaaa

SEQ ID NO: 374953 - RNA, 22 nt, Human
aggaaaaagccacagaaaagaa

SEQ ID NO: 374954 - RNA, 20 nt, Human
aggaacccagcucugcaccc

SEQ ID NO: 374955 - RNA, 22 nt, Human
aggaggaggugagaaaggaaau

SEQ ID NO: 374956 - RNA, 29 nt, Human
aggcaaaagcaagcgggaggggaggcggg

SEQ ID NO: 374957 - RNA, 20 nt, Human
aggcagcuaauggauauagg

SEQ ID NO: 374958 - RNA, 19 nt, Human
aggcagggaguggaggaag

SEQ ID NO: 374959 - RNA, 26 nt, Human
aggcagggaguggaggaggagggacc

SEQ ID NO: 374960 - RNA, 23 nt, Human
aggcagggaguggaggaggaggu

SEQ ID NO: 374961 - RNA, 27 nt, Human
aggcagggaguggaggaggaggugaga

SEQ ID NO: 374962 - RNA, 25 nt, Human
aggcagggaguggaggagggggacc

SEQ ID NO: 374963 - RNA, 26 nt, Human
aggcagggaguggaggagggggaccc

SEQ ID NO: 374964 - RNA, 24 nt, Human
aggcauacuguuuuugaacaaaag

SEQ ID NO: 374965 - RNA, 21 nt, Human
aggcggcggaugcucggaagg

SEQ ID NO: 374966 - RNA, 22 nt, Human
aggcgggaagggcgccggggcc

SEQ ID NO: 374967 - RNA, 21 nt, Human
aggcuccacaggaaggggcaa

SEQ ID NO: 374968 - RNA, 20 nt, Human
agggaggaggcauacuguuu

SEQ ID NO: 374969 - RNA, 22 nt, Human
agggaggggggacaaaaaaagg

SEQ ID NO: 374970 - RNA, 23 nt, Human
aggggguguggacaggcaaacgg

SEQ ID NO: 374971 - RNA, 25 nt, Human
agguagcuuuaccuucucucuguuu

SEQ ID NO: 374972 - RNA, 19 nt, Human
aggugucacagaacaaaug

SEQ ID NO: 374973 - RNA, 22 nt, Human
agucugcauuuuuucaagcucc

SEQ ID NO: 374974 - RNA, 22 nt, Human
aguuggcaaguagaaaucacau

SEQ ID NO: 374975 - RNA, 23 nt, Human
auaaucacaacuccagacuaggu

SEQ ID NO: 374976 - RNA, 26 nt, Human
auccgcgcacacaacagccucaccac

SEQ ID NO: 374977 - RNA, 26 nt, Human
auggaacagauaaaacuaauuaggca

SEQ ID NO: 374978 - RNA, 21 nt, Human
auggaguauaacguuucuccc

SEQ ID NO: 374979 - RNA, 22 nt, Human
auggucccuuuuuuuguuaaaa

SEQ ID NO: 374980 - RNA, 23 nt, Human
augguuuaucgaaaggaaaaagc

SEQ ID NO: 374981 - RNA, 22 nt, Human
auuucuuaaagauggaaagcuu

SEQ ID NO: 374982 - RNA, 19 nt, Human
caaaaacacauuuuuuggg

SEQ ID NO: 374983 - RNA, 24 nt, Human
caaaauacauagaucagccuauca

SEQ ID NO: 374984 - RNA, 20 nt, Human
caaacagcgccuuccggagc

SEQ ID NO: 374985 - RNA, 22 nt, Human
caaaccuggaguggcuaagaaa

SEQ ID NO: 374986 - RNA, 21 nt, Human
caaagagcagaauuuuccaga

SEQ ID NO: 374987 - RNA, 23 nt, Human
caaaugcaaaagacucuuaaacc

SEQ ID NO: 374988 - RNA, 25 nt, Human
caacacacuacacucugcaugcuag

SEQ ID NO: 374989 - RNA, 25 nt, Human
caacauauguacaagaguaaaagua

SEQ ID NO: 374990 - RNA, 26 nt, Human
caagaauaccauguguauuauacuau

SEQ ID NO: 374991 - RNA, 22 nt, Human
caagauucaucuaugauuaaaa

SEQ ID NO: 374992 - RNA, 19 nt, Human
caauggguuuacguugcca

SEQ ID NO: 374993 - RNA, 21 nt, Human
cacacagcacccacccgccac

SEQ ID NO: 374994 - RNA, 27 nt, Human
cacagaacaaaugcaaaagacucuuaa

SEQ ID NO: 374995 - RNA, 23 nt, Human
cacauaaaaucaccagcacggag

SEQ ID NO: 374996 - RNA, 19 nt, Human
caccaauggcugcauuagu

SEQ ID NO: 374997 - RNA, 19 nt, Human
cacccccugcuccccacgc

SEQ ID NO: 374998 - RNA, 19 nt, Human
cacccuuccccugucuuuc

SEQ ID NO: 374999 - RNA, 19 nt, Human
cacuacaacuuccucccaa

SEQ ID NO: 375000 - RNA, 21 nt, Human
cacucagacuucuacacaaaa

SEQ ID NO: 375001 - RNA, 20 nt, Human
cagaaaagaaaccuguccau

SEQ ID NO: 375002 - RNA, 19 nt, Human
cagcacccacccgccaccc

SEQ ID NO: 375003 - RNA, 22 nt, Human
cagcagaaaaaaucaagucuac

SEQ ID NO: 375004 - RNA, 23 nt, Human
cagcagaaaagaggcggcggaug

SEQ ID NO: 375005 - RNA, 18 nt, Human
cagcaguaaguaaaaugg

SEQ ID NO: 375006 - RNA, 19 nt, Human
cagccgccugcuccccggg

SEQ ID NO: 375007 - RNA, 19 nt, Human
cagccuaacccccuaaaug

SEQ ID NO: 375008 - RNA, 23 nt, Human
cagcguuaaaaauaaagaacaga

SEQ ID NO: 375009 - RNA, 19 nt, Human
cagcucccgagccuccgcg

SEQ ID NO: 375010 - RNA, 25 nt, Human
caggaggcucccggagaacaaucaa

SEQ ID NO: 375011 - RNA, 21 nt, Human
caguaaaaauggaaggccaaa

SEQ ID NO: 375012 - RNA, 19 nt, Human
caucaacaccaccaucauc

SEQ ID NO: 375013 - RNA, 22 nt, Human
caucaucaccacuacaacuucc

SEQ ID NO: 375014 - RNA, 25 nt, Human
caucaucaucaccacuacaacuucc

SEQ ID NO: 375015 - RNA, 19 nt, Human
caucaucaucaucaccacu

SEQ ID NO: 375016 - RNA, 24 nt, Human
caugcaaacucuaaaaaagguccc

SEQ ID NO: 375017 - RNA, 22 nt, Human
caugcuaaaaaacagaggaaaa

SEQ ID NO: 375018 - RNA, 23 nt, Human
cauugagucugcuuugccaccau

SEQ ID NO: 375019 - RNA, 22 nt, Human
ccaaaaaaaaaaaaaaaaaaaa

SEQ ID NO: 375020 - RNA, 23 nt, Human
ccaaaaaaaaaaaaaaaaaaaaa

SEQ ID NO: 375021 - RNA, 23 nt, Human
ccaacauacuugcaugcuaaaaa

SEQ ID NO: 375022 - RNA, 18 nt, Human
ccaaggaacccagcucug

SEQ ID NO: 375023 - RNA, 24 nt, Human
ccacacaguaaaagaguauaaaga

SEQ ID NO: 375024 - RNA, 18 nt, Human
ccacagaaaagaaaccug

SEQ ID NO: 375025 - RNA, 22 nt, Human
ccacagaaaauguccaagauuc

SEQ ID NO: 375026 - RNA, 21 nt, Human
ccaccgaaugcucugcgacaa

SEQ ID NO: 375027 - RNA, 23 nt, Human
ccaccgccaccaucaacaccacc

SEQ ID NO: 375028 - RNA, 21 nt, Human
ccacuacaacuuccucccaag

SEQ ID NO: 375029 - RNA, 22 nt, Human
ccagacccagcagaaaagaggc

SEQ ID NO: 375030 - RNA, 23 nt, Human
ccagacccagcagaaaagaggcg

SEQ ID NO: 375031 - RNA, 23 nt, Human
ccagagcgggaggcuggggggcg

SEQ ID NO: 375032 - RNA, 22 nt, Human
ccaguucuauauugagaaccug

SEQ ID NO: 375033 - RNA, 18 nt, Human
ccccacaaaccacucaga

SEQ ID NO: 375034 - RNA, 18 nt, Human
ccccagcgagcaggaccc

SEQ ID NO: 375035 - RNA, 22 nt, Human
cccccacaaaccacucagacuu

SEQ ID NO: 375036 - RNA, 21 nt, Human
cccccgccccgcccccucugc

SEQ ID NO: 375037 - RNA, 21 nt, Human
ccccgagcggccucccagccu

SEQ ID NO: 375038 - RNA, 22 nt, Human
ccccgagcggccucccagccuc

SEQ ID NO: 375039 - RNA, 21 nt, Human
ccccgccccgcccccucugcc

SEQ ID NO: 375040 - RNA, 22 nt, Human
ccccgccccgcccccucugccu

SEQ ID NO: 375041 - RNA, 20 nt, Human
ccccgcgcccccugcggccc

SEQ ID NO: 375042 - RNA, 19 nt, Human
ccccggccagcucccgagc

SEQ ID NO: 375043 - RNA, 25 nt, Human
ccccggccagcucccgagccuccgc

SEQ ID NO: 375044 - RNA, 19 nt, Human
ccccggggagcugauuccg

SEQ ID NO: 375045 - RNA, 21 nt, Human
ccccucauccgcgcacacaac

SEQ ID NO: 375046 - RNA, 19 nt, Human
ccccugucuuucacaacua

SEQ ID NO: 375047 - RNA, 21 nt, Human
ccccuucccccuucaccgcua

SEQ ID NO: 375048 - RNA, 19 nt, Human
ccccuucuuuucccaaaug

SEQ ID NO: 375049 - RNA, 20 nt, Human
cccgacucccgccucccucc

SEQ ID NO: 375050 - RNA, 20 nt, Human
cccgccgcgccccgcgcccc

SEQ ID NO: 375051 - RNA, 20 nt, Human
cccgcgccgccgccggagcc

SEQ ID NO: 375052 - RNA, 21 nt, Human
cccgcgccgccgccggagccc

SEQ ID NO: 375053 - RNA, 24 nt, Human
cccgcggcggggcgcgcccaggag

SEQ ID NO: 375054 - RNA, 22 nt, Human
cccggagcgucagggcucugcc

SEQ ID NO: 375055 - RNA, 21 nt, Human
cccggcccgcgggcccgggaa

SEQ ID NO: 375056 - RNA, 22 nt, Human
cccuccaaaaaaaaaaaaaaaa

SEQ ID NO: 375057 - RNA, 24 nt, Human
cccuccaaaaaaaaaaaaaaaaaa

SEQ ID NO: 375058 - RNA, 20 nt, Human
cccucugccacccccugcuc

SEQ ID NO: 375059 - RNA, 23 nt, Human
cccucugccacccccugcucccc

SEQ ID NO: 375060 - RNA, 21 nt, Human
ccgacagcuccacggccccgg

SEQ ID NO: 375061 - RNA, 22 nt, Human
ccgcagagaacacacaagcccc

SEQ ID NO: 375062 - RNA, 21 nt, Human
ccgcagccccgaggcuucccu

SEQ ID NO: 375063 - RNA, 18 nt, Human
ccgccccgcccccucugc

SEQ ID NO: 375064 - RNA, 19 nt, Human
ccgccccgcccccucugcc

SEQ ID NO: 375065 - RNA, 19 nt, Human
ccgccccgcccccucugcc

SEQ ID NO: 375066 - RNA, 20 nt, Human
ccgccccgcccccucugccu

SEQ ID NO: 375067 - RNA, 21 nt, Human
ccgccccgcccccucugccuu

SEQ ID NO: 375068 - RNA, 19 nt, Human
ccgccccuccccggccagc

SEQ ID NO: 375069 - RNA, 22 nt, Human
ccgccccuccccggccagcucc

SEQ ID NO: 375070 - RNA, 19 nt, Human
ccgcgcacacaacagccuc

SEQ ID NO: 375071 - RNA, 18 nt, Human
ccgcgcccccugcggccc

SEQ ID NO: 375072 - RNA, 22 nt, Human
ccgcgccgccgccggagccccc

SEQ ID NO: 375073 - RNA, 19 nt, Human
ccgcggcggggcgcgccca

SEQ ID NO: 375074 - RNA, 19 nt, Human
ccgcugcgggcgccgcagc

SEQ ID NO: 375075 - RNA, 23 nt, Human
ccggagcgucagggcucugccuu

SEQ ID NO: 375076 - RNA, 20 nt, Human
ccuaccaccgccaccaucaa

SEQ ID NO: 375077 - RNA, 24 nt, Human
ccuaccuccccucccccgccccgc

SEQ ID NO: 375078 - RNA, 19 nt, Human
ccuaucaauggguuuacgu

SEQ ID NO: 375079 - RNA, 23 nt, Human
ccucaccaccgaaugcucugcga

SEQ ID NO: 375080 - RNA, 20 nt, Human
ccuccaaaaaaaaaaaaaaa

SEQ ID NO: 375081 - RNA, 19 nt, Human
ccuccauccgccccucccc

SEQ ID NO: 375082 - RNA, 20 nt, Human
ccucccaaggaacccagcuc

SEQ ID NO: 375083 - RNA, 24 nt, Human
ccucccagccucccuccucccaga

SEQ ID NO: 375084 - RNA, 25 nt, Human
ccucccagccucccuccucccagac

SEQ ID NO: 375085 - RNA, 22 nt, Human
ccucccaggcaccccggagacc

SEQ ID NO: 375086 - RNA, 20 nt, Human
ccucccgcucguagccuggg

SEQ ID NO: 375087 - RNA, 23 nt, Human
ccugcggccccgcaccguccucc

SEQ ID NO: 375088 - RNA, 19 nt, Human
ccuuuccucuuccccuucc

SEQ ID NO: 375089 - RNA, 21 nt, Human
cgagcggccucccagccuccc

SEQ ID NO: 375090 - RNA, 19 nt, Human
cgagggcucggggacacag

SEQ ID NO: 375091 - RNA, 23 nt, Human
cgccaacaaccaccucugagcac

SEQ ID NO: 375092 - RNA, 20 nt, Human
cgccaccaucaacaccacca

SEQ ID NO: 375093 - RNA, 23 nt, Human
cgcccgggugcccucugccaccc

SEQ ID NO: 375094 - RNA, 19 nt, Human
cgcccucaccagugguucg

SEQ ID NO: 375095 - RNA, 26 nt, Human
cgccggagcccccaggaggcucccgg

SEQ ID NO: 375096 - RNA, 20 nt, Human
cgcgccgccgccggagcccc

SEQ ID NO: 375097 - RNA, 21 nt, Human
cgcugggccccgagcggccuc

SEQ ID NO: 375098 - RNA, 21 nt, Human
cggagcggguccuaccucccc

SEQ ID NO: 375099 - RNA, 23 nt, Human
cggccccgggggacagaaggaaa

SEQ ID NO: 375100 - RNA, 21 nt, Human
cggccucccagccucccuccu

SEQ ID NO: 375101 - RNA, 24 nt, Human
cguuucaacacacuacacucugcu

SEQ ID NO: 375102 - RNA, 22 nt, Human
cuaaaaaaggucccccccacaa

SEQ ID NO: 375103 - RNA, 22 nt, Human
cuacacaaaaggguuuuucagc

SEQ ID NO: 375104 - RNA, 24 nt, Human
cuacauaaaagaaguuugaucaaa

SEQ ID NO: 375105 - RNA, 26 nt, Human
cucacaacgcacucaucaaaacagcc

SEQ ID NO: 375106 - RNA, 24 nt, Human
cuccacaggaaggggcaaaaacca

SEQ ID NO: 375107 - RNA, 18 nt, Human
cuccacauaugcacaucc

SEQ ID NO: 375108 - RNA, 20 nt, Human
cucccagacccagcagaaaa

SEQ ID NO: 375109 - RNA, 25 nt, Human
cucccagccucccuccucccagacc

SEQ ID NO: 375110 - RNA, 19 nt, Human
cuccccggccagcucccga

SEQ ID NO: 375111 - RNA, 19 nt, Human
cuccccggcccgcgggccc

SEQ ID NO: 375112 - RNA, 19 nt, Human
cucccucccgcucguagcc

SEQ ID NO: 375113 - RNA, 18 nt, Human
cucuccccuccacccuac

SEQ ID NO: 375114 - RNA, 24 nt, Human
cugagcacacgcgaagaugcagcg

SEQ ID NO: 375115 - RNA, 19 nt, Human
cugaucuuaagucaguuca

SEQ ID NO: 375116 - RNA, 21 nt, Human
cugcacccuccgagagaaaga

SEQ ID NO: 375117 - RNA, 18 nt, Human
cugcuccccacgcccuca

SEQ ID NO: 375118 - RNA, 19 nt, Human
cugggucccgccgcgcccc

SEQ ID NO: 375119 - RNA, 22 nt, Human
cuuuuagugguuuguuucucug

SEQ ID NO: 375120 - RNA, 21 nt, Human
cuuuucacuguacaaaaauac

SEQ ID NO: 375121 - RNA, 19 nt, Human
gaaaaaaaagaaaucaaaa

SEQ ID NO: 375122 - RNA, 19 nt, Human
gaaaaaaaagaaaucaaaa

SEQ ID NO: 375123 - RNA, 21 nt, Human
gaaauaaccaauaauaaaaau

SEQ ID NO: 375124 - RNA, 21 nt, Human
gaaauuaaugagaauggagua

SEQ ID NO: 375125 - RNA, 19 nt, Human
gaaauucucuuauaaacuc

SEQ ID NO: 375126 - RNA, 20 nt, Human
gaacaaaugcaaaagacucu

SEQ ID NO: 375127 - RNA, 21 nt, Human
gaacaaaugcaaaagacucuu

SEQ ID NO: 375128 - RNA, 23 nt, Human
gaacccagcucugcacccuccga

SEQ ID NO: 375129 - RNA, 21 nt, Human
gaacuggaaauuacuuccaca

SEQ ID NO: 375130 - RNA, 22 nt, Human
gaagcacaagcacaagccacug

SEQ ID NO: 375131 - RNA, 23 nt, Human
gaagcacaagcacaagccacugg

SEQ ID NO: 375132 - RNA, 23 nt, Human
gacccggagcgucagggcucugc

SEQ ID NO: 375133 - RNA, 18 nt, Human
gacucccgccucccuccc

SEQ ID NO: 375134 - RNA, 18 nt, Human
gagaaccugguuaacgcc

SEQ ID NO: 375135 - RNA, 20 nt, Human
gagcuugugucucccuuugu

SEQ ID NO: 375136 - RNA, 21 nt, Human
gaggcgggaagggcgccgggg

SEQ ID NO: 375137 - RNA, 23 nt, Human
gaggcucagcggggacgcggccc

SEQ ID NO: 375138 - RNA, 24 nt, Human
gaggggggacaaaaaaaggacagg

SEQ ID NO: 375139 - RNA, 20 nt, Human
gcaaaagacucuuaaaccca

SEQ ID NO: 375140 - RNA, 21 nt, Human
gcaaaagacucuuaaacccac

SEQ ID NO: 375141 - RNA, 18 nt, Human
gcagagaacacacaagcc

SEQ ID NO: 375142 - RNA, 20 nt, Human
gccugggucccgccgcgccc

SEQ ID NO: 375143 - RNA, 19 nt, Human
gcgaggcaagaagagccag

SEQ ID NO: 375144 - RNA, 18 nt, Human
gcgaucgccugcucgggc

SEQ ID NO: 375145 - RNA, 20 nt, Human
gcgccggggccccucuggcc

SEQ ID NO: 375146 - RNA, 25 nt, Human
gcgcgccucaagggcccgcggcggg

SEQ ID NO: 375147 - RNA, 24 nt, Human
gcggcagccgccugcuccccgggu

SEQ ID NO: 375148 - RNA, 21 nt, Human
gcgggagcccggggcgcgcgu

SEQ ID NO: 375149 - RNA, 19 nt, Human
gcgggcccgggaagccagc

SEQ ID NO: 375150 - RNA, 18 nt, Human
gcguuaaaaauaaagaac

SEQ ID NO: 375151 - RNA, 25 nt, Human
ggaaaaaaaaaaaaaaaaaagccag

SEQ ID NO: 375152 - RNA, 30 nt, Human
ggaaaaagaaauaguaauuacaaaaacacu

SEQ ID NO: 375153 - RNA, 18 nt, Human
ggaaaaagaaaucagccu

SEQ ID NO: 375154 - RNA, 20 nt, Human
ggaaaccacaucucaacucg

SEQ ID NO: 375155 - RNA, 21 nt, Human
ggaacaaguuacaaaaaaaaa

SEQ ID NO: 375156 - RNA, 19 nt, Human
ggaaucaaggaaaaaaaaa

SEQ ID NO: 375157 - RNA, 22 nt, Human
ggagcgaggggguguggacagg

SEQ ID NO: 375158 - RNA, 20 nt, Human
ggaggaggcucgcccagagc

SEQ ID NO: 375159 - RNA, 19 nt, Human
ggcccgcggcggggcgcgc

SEQ ID NO: 375160 - RNA, 22 nt, Human
ggcgggagcccggggcgcgcgu

SEQ ID NO: 375161 - RNA, 19 nt, Human
ggcguggugagggcccggg

SEQ ID NO: 375162 - RNA, 18 nt, Human
ggcucauucuuguuaucc

SEQ ID NO: 375163 - RNA, 21 nt, Human
ggcucgcccagagcgggaggc

SEQ ID NO: 375164 - RNA, 20 nt, Human
gggagggcguggugagggcc

SEQ ID NO: 375165 - RNA, 21 nt, Human
gggcgggugagaggcccgagu

SEQ ID NO: 375166 - RNA, 18 nt, Human
gggcguggugagggcccg

SEQ ID NO: 375167 - RNA, 21 nt, Human
gggcguggugagggcccgggg

SEQ ID NO: 375168 - RNA, 18 nt, Human
gggcuggggaggaggcuc

SEQ ID NO: 375169 - RNA, 22 nt, Human
ggggggugggucaagaagcugg

SEQ ID NO: 375170 - RNA, 18 nt, Human
ggggugggggcuggggag

SEQ ID NO: 375171 - RNA, 23 nt, Human
gggguguggacaggcaaacgggg

SEQ ID NO: 375172 - RNA, 18 nt, Human
ggugcccucggccggccu

SEQ ID NO: 375173 - RNA, 24 nt, Human
ggugcccucugccacccccugcuc

SEQ ID NO: 375174 - RNA, 20 nt, Human
guaaaaauggaaggccaaac

SEQ ID NO: 375175 - RNA, 24 nt, Human
guggggagcgaggggguguggaca

SEQ ID NO: 375176 - RNA, 24 nt, Human
uaaaaaaaaaucaccaguucuuua

SEQ ID NO: 375177 - RNA, 19 nt, Human
uaaaaacuacucauuucac

SEQ ID NO: 375178 - RNA, 25 nt, Human
uaaaaagaaacaucucugcccaaaa

SEQ ID NO: 375179 - RNA, 20 nt, Human
uaaaaauaagacuuacuuaa

SEQ ID NO: 375180 - RNA, 20 nt, Human
uaaaacagaaaagacaugcc

SEQ ID NO: 375181 - RNA, 23 nt, Human
uaaaacagaaaagacaugccaag

SEQ ID NO: 375182 - RNA, 19 nt, Human
uaaaauaaauguaccacca

SEQ ID NO: 375183 - RNA, 24 nt, Human
uaaaauaaauguaccaccaauggc

SEQ ID NO: 375184 - RNA, 25 nt, Human
uaaaauagagcaacuuauuugccuu

SEQ ID NO: 375185 - RNA, 20 nt, Human
uaaaaucaccagcacggagc

SEQ ID NO: 375186 - RNA, 21 nt, Human
uaaaaucaccagcacggagca

SEQ ID NO: 375187 - RNA, 26 nt, Human
uaaauuaacaaaaguugcaauggucc

SEQ ID NO: 375188 - RNA, 23 nt, Human
uaaauucaccaauugcucauugg

SEQ ID NO: 375189 - RNA, 19 nt, Human
uaacagugucaugcugaaa

SEQ ID NO: 375190 - RNA, 19 nt, Human
uaagaaaaaagcacaaaua

SEQ ID NO: 375191 - RNA, 24 nt, Human
uaagagaccaacaaaaaaaaauca

SEQ ID NO: 375192 - RNA, 19 nt, Human
uaagauaacagcucugagg

SEQ ID NO: 375193 - RNA, 24 nt, Human
uaagguaaacaacuccagaaaucc

SEQ ID NO: 375194 - RNA, 19 nt, Human
uacaaaaaaaaaguuggca

SEQ ID NO: 375195 - RNA, 26 nt, Human
uacaaaggguauuugaaacugacauu

SEQ ID NO: 375196 - RNA, 18 nt, Human
uacauaagaaaaaagcac

SEQ ID NO: 375197 - RNA, 18 nt, Human
uaccaagggggggugggu

SEQ ID NO: 375198 - RNA, 21 nt, Human
uaccaagggggggugggucaa

SEQ ID NO: 375199 - RNA, 22 nt, Human
uaccaccgccaccaucaacacc

SEQ ID NO: 375200 - RNA, 21 nt, Human
uacguugccaccaaguuucgg

SEQ ID NO: 375201 - RNA, 24 nt, Human
uagaauucucuccugccaccuccc

SEQ ID NO: 375202 - RNA, 21 nt, Human
uagacacucaauaaagaauuc

SEQ ID NO: 375203 - RNA, 18 nt, Human
uagaggucaaacacugcg

SEQ ID NO: 375204 - RNA, 20 nt, Human
uagaucgaagcacaagcaca

SEQ ID NO: 375205 - RNA, 20 nt, Human
uagauugccaaacaauuacu

SEQ ID NO: 375206 - RNA, 19 nt, Human
uaggauagguaaggcucau

SEQ ID NO: 375207 - RNA, 19 nt, Human
uaggucuccuuuaaaauuc

SEQ ID NO: 375208 - RNA, 19 nt, Human
uauaauaaacagcaggauc

SEQ ID NO: 375209 - RNA, 22 nt, Human
uauccaguggcaagaauaccau

SEQ ID NO: 375210 - RNA, 25 nt, Human
uaucuauuugaucaaaauucuuuau

SEQ ID NO: 375211 - RNA, 23 nt, Human
uaugcagauggucuguacuuuau

SEQ ID NO: 375212 - RNA, 21 nt, Human
uaugguaggaaucaaggaaaa

SEQ ID NO: 375213 - RNA, 20 nt, Human
ucaaacagugagacgggagc

SEQ ID NO: 375214 - RNA, 24 nt, Human
ucaaggaaaaaaaaaaaaaaaaaa

SEQ ID NO: 375215 - RNA, 20 nt, Human
ucaccaguucuuuaaguucu

SEQ ID NO: 375216 - RNA, 20 nt, Human
ucaccauuuucaauaaaucu

SEQ ID NO: 375217 - RNA, 18 nt, Human
ucagucggggggccgggg

SEQ ID NO: 375218 - RNA, 18 nt, Human
ucagucggggggccgggg

SEQ ID NO: 375219 - RNA, 21 nt, Human
ucagucggggggccgggggag

SEQ ID NO: 375220 - RNA, 23 nt, Human
uccaccucaccacagaaaauguc

SEQ ID NO: 375221 - RNA, 25 nt, Human
uccaccucaccacagaaaaugucca

SEQ ID NO: 375222 - RNA, 23 nt, Human
uccagcacaaaaaaaaaaaaaaa

SEQ ID NO: 375223 - RNA, 21 nt, Human
uccagcgcacugccucaggua

SEQ ID NO: 375224 - RNA, 20 nt, Human
uccagguugcuuaaauucac

SEQ ID NO: 375225 - RNA, 23 nt, Human
uccaguucuauauugagaaccug

SEQ ID NO: 375226 - RNA, 25 nt, Human
ucccaaaccggaaaaaauaggccuc

SEQ ID NO: 375227 - RNA, 19 nt, Human
ucccaaauguacuacugaa

SEQ ID NO: 375228 - RNA, 21 nt, Human
ucccccgacucccgccucccu

SEQ ID NO: 375229 - RNA, 18 nt, Human
ucccccgccccgcccccu

SEQ ID NO: 375230 - RNA, 23 nt, Human
uccccggccagcucccgagccuc

SEQ ID NO: 375231 - RNA, 21 nt, Human
ucccgagccuccgcgcagccc

SEQ ID NO: 375232 - RNA, 24 nt, Human
ucccuuuuuuuguuaaaaaaaaau

SEQ ID NO: 375233 - RNA, 18 nt, Human
uccgccaacaaccaccuc

SEQ ID NO: 375234 - RNA, 20 nt, Human
uccgccaacaaccaccucuu

SEQ ID NO: 375235 - RNA, 18 nt, Human
uccgcgcacacaacagcc

SEQ ID NO: 375236 - RNA, 19 nt, Human
uccgcgcacacaacagccu

SEQ ID NO: 375237 - RNA, 23 nt, Human
uccuaccuccccucccccgcccc

SEQ ID NO: 375238 - RNA, 18 nt, Human
uccucggggugcccucgg

SEQ ID NO: 375239 - RNA, 22 nt, Human
uccucuuccccuucccccuuca

SEQ ID NO: 375240 - RNA, 22 nt, Human
uccuuuccucuuccccuucccc

SEQ ID NO: 375241 - RNA, 19 nt, Human
ucgcacagaggccaugcca

SEQ ID NO: 375242 - RNA, 20 nt, Human
ucgcgcccgcgccgccgccg

SEQ ID NO: 375243 - RNA, 20 nt, Human
ucggaugcauagaagacauc

SEQ ID NO: 375244 - RNA, 23 nt, Human
ucuaugauuaaaacagaaaagac

SEQ ID NO: 375245 - RNA, 18 nt, Human
ucucaguaaaaauggaag

SEQ ID NO: 375246 - RNA, 24 nt, Human
ucucccuccaaaaaaaaaaaaaaa

SEQ ID NO: 375247 - RNA, 18 nt, Human
ucucuacuauagcuguac

SEQ ID NO: 375248 - RNA, 18 nt, Human
ucucuacuauagcuguac

SEQ ID NO: 375249 - RNA, 21 nt, Human
ucugaagccaaauuauuacuu

SEQ ID NO: 375250 - RNA, 20 nt, Human
ucugcauuuuuucaagcucc

SEQ ID NO: 375251 - RNA, 18 nt, Human
ucuguagucauucauaac

SEQ ID NO: 375252 - RNA, 21 nt, Human
ugaaaaaagcaacuaaaucac

SEQ ID NO: 375253 - RNA, 23 nt, Human
ugaaaaaagcaacuaaaucaccc

SEQ ID NO: 375254 - RNA, 30 nt, Human
ugaacaaaucucuacuauagcuguacaaaa

SEQ ID NO: 375255 - RNA, 21 nt, Human
ugacaaaaaaauccugaguug

SEQ ID NO: 375256 - RNA, 19 nt, Human
ugagaaccugguuaacgcc

SEQ ID NO: 375257 - RNA, 21 nt, Human
ugagaaccugguuaacgccau

SEQ ID NO: 375258 - RNA, 19 nt, Human
ugagccggcgcgcggggag

SEQ ID NO: 375259 - RNA, 19 nt, Human
ugagcuugugucucccuuu

SEQ ID NO: 375260 - RNA, 21 nt, Human
ugcauaccaaggggggguggg

SEQ ID NO: 375261 - RNA, 20 nt, Human
ugccaaaggcggcugucacc

SEQ ID NO: 375262 - RNA, 21 nt, Human
ugccaaaggcggcugucaccg

SEQ ID NO: 375263 - RNA, 22 nt, Human
ugccaaaggcggcugucaccgc

SEQ ID NO: 375264 - RNA, 22 nt, Human
ugcucggaaggggggcgggagc

SEQ ID NO: 375265 - RNA, 23 nt, Human
ugcucgggccugccgcgagggcu

SEQ ID NO: 375266 - RNA, 23 nt, Human
uggaaagggagggcagagagaaa

SEQ ID NO: 375267 - RNA, 21 nt, Human
uggaagagagcucaguuucau

SEQ ID NO: 375268 - RNA, 25 nt, Human
uggaaggccaaaccucggucaauca

SEQ ID NO: 375269 - RNA, 23 nt, Human
uggagacgguuacuuugggaacu

SEQ ID NO: 375270 - RNA, 22 nt, Human
uggaggaggaggugagaaagga

SEQ ID NO: 375271 - RNA, 20 nt, Human
ugggaugccauaaccacuag

SEQ ID NO: 375272 - RNA, 21 nt, Human
ugggaugccauaaccacuagg

SEQ ID NO: 375273 - RNA, 20 nt, Human
ugggccccgagcggccuccc

SEQ ID NO: 375274 - RNA, 19 nt, Human
uggguggggagaagaggca

SEQ ID NO: 375275 - RNA, 18 nt, Human
uggguuuacguugccacc

SEQ ID NO: 375276 - RNA, 22 nt, Human
uguaggcuccacaggaaggggc

SEQ ID NO: 375277 - RNA, 19 nt, Human
ugucauacaccguuucaac

SEQ ID NO: 375278 - RNA, 18 nt, Human
uuaaaaauaaagaacaga

SEQ ID NO: 375279 - RNA, 23 nt, Human
uuaaaacagucaauucaaaaaaa

SEQ ID NO: 375280 - RNA, 18 nt, Human
uuaacagugucaugcuga

SEQ ID NO: 375281 - RNA, 22 nt, Human
uuagacacucaauaaagaauuc

SEQ ID NO: 375282 - RNA, 19 nt, Human
uucaaaauacauagaucag

SEQ ID NO: 375283 - RNA, 23 nt, Human
uucaaagaccgacaagcuucaaa

SEQ ID NO: 375284 - RNA, 19 nt, Human
uucaacccugagcauuaac

SEQ ID NO: 375285 - RNA, 21 nt, Human
uucacuguacaaaaauacgcc

SEQ ID NO: 375286 - RNA, 23 nt, Human
uuccagaucauuaaauaaaaggg

SEQ ID NO: 375287 - RNA, 27 nt, Human
uuccagcacaaaaaaaaaaaaaaaaaa

SEQ ID NO: 375288 - RNA, 20 nt, Human
uucccccgacucccgccucc

SEQ ID NO: 375289 - RNA, 23 nt, Human
uuccggagcggguccuaccuccc

SEQ ID NO: 375290 - RNA, 19 nt, Human
uuccuugggcaaaagucac

SEQ ID NO: 375291 - RNA, 23 nt, Human
uucgcaucccaggggugggggcu

SEQ ID NO: 375292 - RNA, 18 nt, Human
uucucuccugccaccucc

SEQ ID NO: 375293 - RNA, 24 nt, Human
uugaacaaaagcuggaugaagaaa

SEQ ID NO: 375294 - RNA, 18 nt, Human
uugaacaaaucucuacua

SEQ ID NO: 375295 - RNA, 22 nt, Human
uugcaaucacgaauuucaggaa

SEQ ID NO: 375296 - RNA, 19 nt, Human
uuuaaacuaagauaacagc

SEQ ID NO: 375297 - RNA, 24 nt, Human
uuuaccuacaaauauugaacaaau

SEQ ID NO: 375298 - RNA, 20 nt, Human
uuucgcuggucuuccuacau

SEQ ID NO: 375299 - RNA, 26 nt, Human
uuuguaagcguuuguacagucugcau

SEQ ID NO: 375300 - RNA, 22 nt, Human
uuuguacagucugcauuuuuuc

SEQ ID NO: 375301 - RNA, 23 nt, Human
uuuguacugaggucuaggcugac

SEQ ID NO: 375302 - RNA, 22 nt, Human
uuuuuuguaagcguuuguacag

SEQ ID NO: 375303 - RNA, 27 nt, Human
aaaaaaaaaaaaaauagagcgcaagaa

SEQ ID NO: 375304 - RNA, 24 nt, Human
aaaccagauguuuaaaagcgagag

SEQ ID NO: 375305 - RNA, 18 nt, Human
aaaggagggggcgggucc

SEQ ID NO: 375306 - RNA, 26 nt, Human
aaaucacacggacuugaaucuggcaa

SEQ ID NO: 375307 - RNA, 19 nt, Human
aacccagagaaggcgggcc

SEQ ID NO: 375308 - RNA, 20 nt, Human
aacccuuccgagugcuccuc

SEQ ID NO: 375309 - RNA, 18 nt, Human
aagaagaggaagaagagg

SEQ ID NO: 375310 - RNA, 18 nt, Human
aagaccacagacagugac

SEQ ID NO: 375311 - RNA, 22 nt, Human
aagagcacagacaugcagaacc

SEQ ID NO: 375312 - RNA, 20 nt, Human
aagaggaagaagaggaagca

SEQ ID NO: 375313 - RNA, 18 nt, Human
aaggugccuugguuuuua

SEQ ID NO: 375314 - RNA, 23 nt, Human
aauagagcgcaagaaaggcccag

SEQ ID NO: 375315 - RNA, 25 nt, Human
aaugaccagguguuuauaccaugcc

SEQ ID NO: 375316 - RNA, 22 nt, Human
accaaucccaccacuccaggcc

SEQ ID NO: 375317 - RNA, 23 nt, Human
accaugccucacucagacaccag

SEQ ID NO: 375318 - RNA, 22 nt, Human
acccuuccgagugcuccuccca

SEQ ID NO: 375319 - RNA, 20 nt, Human
acugcagcuugaguacugag

SEQ ID NO: 375320 - RNA, 20 nt, Human
acuggcaggagguaggcccc

SEQ ID NO: 375321 - RNA, 20 nt, Human
agaagaggaagaagaggaag

SEQ ID NO: 375322 - RNA, 23 nt, Human
agaggaagaagaggaagcaggcc

SEQ ID NO: 375323 - RNA, 18 nt, Human
agagugugugagccaccc

SEQ ID NO: 375324 - RNA, 22 nt, Human
agauuccggagcaaaggagggg

SEQ ID NO: 375325 - RNA, 18 nt, Human
aggaagcagaaccaagcc

SEQ ID NO: 375326 - RNA, 18 nt, Human
aggaagcaggccugggca

SEQ ID NO: 375327 - RNA, 26 nt, Human
aggaggcagcggcgacggaggggcgg

SEQ ID NO: 375328 - RNA, 20 nt, Human
aggaggggguggggaaggug

SEQ ID NO: 375329 - RNA, 19 nt, Human
aggcagccacgcgaccgga

SEQ ID NO: 375330 - RNA, 18 nt, Human
aggcauggccaagccagc

SEQ ID NO: 375331 - RNA, 20 nt, Human
agggggaggggugucagagg

SEQ ID NO: 375332 - RNA, 24 nt, Human
agggggcuggcugcugguggcugu

SEQ ID NO: 375333 - RNA, 19 nt, Human
aggggggaggggugcaggu

SEQ ID NO: 375334 - RNA, 24 nt, Human
aggggguggggaaggugcagcagg

SEQ ID NO: 375335 - RNA, 19 nt, Human
agggguccggaggacucug

SEQ ID NO: 375336 - RNA, 21 nt, Human
auacugcagcuugaguacuga

SEQ ID NO: 375337 - RNA, 21 nt, Human
aucaaaggauuucccaggauc

SEQ ID NO: 375338 - RNA, 23 nt, Human
aucgcacccuccgggcccccgcc

SEQ ID NO: 375339 - RNA, 23 nt, Human
auggggugccagccucggccucc

SEQ ID NO: 375340 - RNA, 23 nt, Human
auuuccacacucagcccuggcuc

SEQ ID NO: 375341 - RNA, 21 nt, Human
caaauacacuuuauucagucc

SEQ ID NO: 375342 - RNA, 18 nt, Human
caacagggacagggcucc

SEQ ID NO: 375343 - RNA, 21 nt, Human
caagaccacagacagugacau

SEQ ID NO: 375344 - RNA, 19 nt, Human
cacacucagcccuggcucc

SEQ ID NO: 375345 - RNA, 26 nt, Human
cacagcaacagggacagggcucccga

SEQ ID NO: 375346 - RNA, 20 nt, Human
caccacuccaggcccucagc

SEQ ID NO: 375347 - RNA, 22 nt, Human
caccagauacaggcugccccag

SEQ ID NO: 375348 - RNA, 18 nt, Human
caccuucucaacucuacc

SEQ ID NO: 375349 - RNA, 24 nt, Human
cacuccaggcccucagcugggggc

SEQ ID NO: 375350 - RNA, 18 nt, Human
cagacagagggaccccac

SEQ ID NO: 375351 - RNA, 23 nt, Human
cagacagagggaccccaccccuc

SEQ ID NO: 375352 - RNA, 19 nt, Human
cagagaccugcagagaccc

SEQ ID NO: 375353 - RNA, 22 nt, Human
caucacaucugcucuccacgcc

SEQ ID NO: 375354 - RNA, 21 nt, Human
cauggccaagccagcccccuc

SEQ ID NO: 375355 - RNA, 18 nt, Human
ccaagccagcccccucgg

SEQ ID NO: 375356 - RNA, 24 nt, Human
ccaagcccugucucugacccuggc

SEQ ID NO: 375357 - RNA, 24 nt, Human
ccauguuggauugaaaugaccagg

SEQ ID NO: 375358 - RNA, 22 nt, Human
cccagagaaggcgggccgggcg

SEQ ID NO: 375359 - RNA, 21 nt, Human
ccccaggaagggcguggucuc

SEQ ID NO: 375360 - RNA, 20 nt, Human
ccccccagggaagggagggg

SEQ ID NO: 375361 - RNA, 18 nt, Human
cccccgcgaacuggggag

SEQ ID NO: 375362 - RNA, 22 nt, Human
cccccgcgaacuggggagcgag

SEQ ID NO: 375363 - RNA, 20 nt, Human
cccccgcgggcucuuccugc

SEQ ID NO: 375364 - RNA, 24 nt, Human
cccccuaacccagagaaggcgggc

SEQ ID NO: 375365 - RNA, 20 nt, Human
ccccgccgccuccggcaagu

SEQ ID NO: 375366 - RNA, 18 nt, Human
ccccgcgaacuggggagc

SEQ ID NO: 375367 - RNA, 22 nt, Human
cccgagggcacccugaacugga

SEQ ID NO: 375368 - RNA, 18 nt, Human
cccuccuccccagaagca

SEQ ID NO: 375369 - RNA, 21 nt, Human
cccuggcugcuugcaggcccu

SEQ ID NO: 375370 - RNA, 20 nt, Human
cccuggcuggccugggccug

SEQ ID NO: 375371 - RNA, 18 nt, Human
cccugggacacccagcuc

SEQ ID NO: 375372 - RNA, 22 nt, Human
ccgaagccaugcuucaccagga

SEQ ID NO: 375373 - RNA, 19 nt, Human
ccgagggcacccugaacug

SEQ ID NO: 375374 - RNA, 20 nt, Human
ccgagggcacccugaacugg

SEQ ID NO: 375375 - RNA, 27 nt, Human
ccuccgaggggccccaauaccugauuc

SEQ ID NO: 375376 - RNA, 18 nt, Human
ccugaacuggacacaacu

SEQ ID NO: 375377 - RNA, 20 nt, Human
ccugcagagacccugggcag

SEQ ID NO: 375378 - RNA, 20 nt, Human
ccugcagccucuggcuccgc

SEQ ID NO: 375379 - RNA, 19 nt, Human
ccugggacacccagcucgg

SEQ ID NO: 375380 - RNA, 19 nt, Human
ccuugaagggaguucuggg

SEQ ID NO: 375381 - RNA, 23 nt, Human
cgacgggaacgcguggggcagag

SEQ ID NO: 375382 - RNA, 22 nt, Human
cgagacuaguucuccaagacca

SEQ ID NO: 375383 - RNA, 23 nt, Human
cgccccgcggcucggcccggccc

SEQ ID NO: 375384 - RNA, 19 nt, Human
cgcggcuggggguggggga

SEQ ID NO: 375385 - RNA, 18 nt, Human
cggcgcgcccccgccgcc

SEQ ID NO: 375386 - RNA, 18 nt, Human
cggcgcgcccccgccgcc

SEQ ID NO: 375387 - RNA, 21 nt, Human
cggggccgcuagacgccgccg

SEQ ID NO: 375388 - RNA, 22 nt, Human
cggugagauacagguagugagg

SEQ ID NO: 375389 - RNA, 19 nt, Human
cucagaaacauccauccag

SEQ ID NO: 375390 - RNA, 24 nt, Human
cuccacgccucagucccaaaccuu

SEQ ID NO: 375391 - RNA, 24 nt, Human
cucccaaaccagauguuuaaaagc

SEQ ID NO: 375392 - RNA, 20 nt, Human
cuccgggcccccgcgggcuc

SEQ ID NO: 375393 - RNA, 21 nt, Human
cugacccuggcugcuugcagg

SEQ ID NO: 375394 - RNA, 23 nt, Human
cuggccacuguggacugcauucc

SEQ ID NO: 375395 - RNA, 19 nt, Human
cuggccugggccugcuggg

SEQ ID NO: 375396 - RNA, 24 nt, Human
cugggaccagcccccuccucccca

SEQ ID NO: 375397 - RNA, 25 nt, Human
cugggccugcugggaguacugucug

SEQ ID NO: 375398 - RNA, 19 nt, Human
cuguaauuuccacacucag

SEQ ID NO: 375399 - RNA, 24 nt, Human
cugugaaaagaagaggaagaagag

SEQ ID NO: 375400 - RNA, 19 nt, Human
cuuccacaccuucucaacu

SEQ ID NO: 375401 - RNA, 21 nt, Human
cuuccugcagccucuggcucc

SEQ ID NO: 375402 - RNA, 21 nt, Human
gaccagcccccuccuccccag

SEQ ID NO: 375403 - RNA, 21 nt, Human
gaccugggugacaggaagggc

SEQ ID NO: 375404 - RNA, 20 nt, Human
gacucugggaccguuuguuc

SEQ ID NO: 375405 - RNA, 20 nt, Human
gagcacagacaugcagaacc

SEQ ID NO: 375406 - RNA, 20 nt, Human
gagggcaagggggguguggg

SEQ ID NO: 375407 - RNA, 26 nt, Human
gaggggguggggaaggugcagcaggg

SEQ ID NO: 375408 - RNA, 26 nt, Human
gaucaaaggauuucccaggaucgcuc

SEQ ID NO: 375409 - RNA, 25 nt, Human
gcaccugugaaaagaagaggaagaa

SEQ ID NO: 375410 - RNA, 18 nt, Human
gcagagaccugcagagac

SEQ ID NO: 375411 - RNA, 21 nt, Human
gcagagaccugcagagacccu

SEQ ID NO: 375412 - RNA, 18 nt, Human
gccaagucgauggucucu

SEQ ID NO: 375413 - RNA, 20 nt, Human
gccccagcggaggggcgggc

SEQ ID NO: 375414 - RNA, 25 nt, Human
gcccuggcuggccugggccugcugg

SEQ ID NO: 375415 - RNA, 20 nt, Human
gccgcuagacgccgccgggg

SEQ ID NO: 375416 - RNA, 23 nt, Human
gccuccggcaaguugcguccugg

SEQ ID NO: 375417 - RNA, 29 nt, Human
gcgccccuccccccagggaagggaggggc

SEQ ID NO: 375418 - RNA, 20 nt, Human
gcgggcucuuccugcagccu

SEQ ID NO: 375419 - RNA, 23 nt, Human
gcugggaguacugucugucagug

SEQ ID NO: 375420 - RNA, 23 nt, Human
gcugucccuaucuuccacaccuu

SEQ ID NO: 375421 - RNA, 21 nt, Human
ggacacaacuuccuccuaaca

SEQ ID NO: 375422 - RNA, 22 nt, Human
ggagauggggugccagccucgg

SEQ ID NO: 375423 - RNA, 18 nt, Human
ggagcaccaagcuuaaag

SEQ ID NO: 375424 - RNA, 19 nt, Human
ggaggaggcagcggcgacg

SEQ ID NO: 375425 - RNA, 22 nt, Human
ggagggggcaggcugcgcggga

SEQ ID NO: 375426 - RNA, 18 nt, Human
ggagggggcuggcugcug

SEQ ID NO: 375427 - RNA, 19 nt, Human
ggaguaacacgaugggcac

SEQ ID NO: 375428 - RNA, 21 nt, Human
ggaucugacagaugagaauua

SEQ ID NO: 375429 - RNA, 20 nt, Human
ggccugggccugcugggagu

SEQ ID NO: 375430 - RNA, 22 nt, Human
ggcggggcagagagauggcggc

SEQ ID NO: 375431 - RNA, 18 nt, Human
ggcggggggagaagguca

SEQ ID NO: 375432 - RNA, 21 nt, Human
ggcugccccaggaagggcgug

SEQ ID NO: 375433 - RNA, 21 nt, Human
gggaggccggaggggcggggc

SEQ ID NO: 375434 - RNA, 20 nt, Human
gggaggggcgcaggaggcgc

SEQ ID NO: 375435 - RNA, 22 nt, Human
gggaggggcuugggugucgggg

SEQ ID NO: 375436 - RNA, 19 nt, Human
gggcaggcugcgcgggaga

SEQ ID NO: 375437 - RNA, 19 nt, Human
gggcagggguccggaggac

SEQ ID NO: 375438 - RNA, 19 nt, Human
gggcucccgagggcacccu

SEQ ID NO: 375439 - RNA, 20 nt, Human
ggggcagagaccugcagaga

SEQ ID NO: 375440 - RNA, 23 nt, Human
gggggaggaggcagcggcgacgg

SEQ ID NO: 375441 - RNA, 18 nt, Human
gggguggggaaggugcag

SEQ ID NO: 375442 - RNA, 20 nt, Human
ggggugugucugcgggggag

SEQ ID NO: 375443 - RNA, 25 nt, Human
ggguguggggaggccggaggggcgg

SEQ ID NO: 375444 - RNA, 20 nt, Human
gguguaucggagggggcugg

SEQ ID NO: 375445 - RNA, 21 nt, Human
guaaaacaccagucagaaccu

SEQ ID NO: 375446 - RNA, 19 nt, Human
gugaaaagaagaggaagaa

SEQ ID NO: 375447 - RNA, 21 nt, Human
gugaaaagaagaggaagaaga

SEQ ID NO: 375448 - RNA, 19 nt, Human
gugcgccccuccccccagg

SEQ ID NO: 375449 - RNA, 21 nt, Human
guggcugugcaggagggggcg

SEQ ID NO: 375450 - RNA, 21 nt, Human
guggggcagagaccugcagag

SEQ ID NO: 375451 - RNA, 18 nt, Human
guggucucaggugaagug

SEQ ID NO: 375452 - RNA, 20 nt, Human
gugugcaaaaggggggaggg

SEQ ID NO: 375453 - RNA, 27 nt, Human
guuuuucuuaaaaaaaaaaaaaaaaaa

SEQ ID NO: 375454 - RNA, 24 nt, Human
uaaaggcacagaaaggcauggcca

SEQ ID NO: 375455 - RNA, 24 nt, Human
uaaaggcacagaaaggcuggagac

SEQ ID NO: 375456 - RNA, 21 nt, Human
uacacuggaucugacagauga

SEQ ID NO: 375457 - RNA, 22 nt, Human
uacagggaugaguuugcuauuc

SEQ ID NO: 375458 - RNA, 19 nt, Human
uacagguagugagggcaag

SEQ ID NO: 375459 - RNA, 18 nt, Human
uagaggcagccacgcgac

SEQ ID NO: 375460 - RNA, 22 nt, Human
uauuauccccacguuauacaua

SEQ ID NO: 375461 - RNA, 20 nt, Human
ucaauucccaguugggggga

SEQ ID NO: 375462 - RNA, 23 nt, Human
ucacaacacacauuguuuugcgg

SEQ ID NO: 375463 - RNA, 21 nt, Human
ucacguggaaaaaccgaggug

SEQ ID NO: 375464 - RNA, 18 nt, Human
ucagaaacauccauccag

SEQ ID NO: 375465 - RNA, 20 nt, Human
uccacaccuucucaacucua

SEQ ID NO: 375466 - RNA, 22 nt, Human
uccacaccuucucaacucuacc

SEQ ID NO: 375467 - RNA, 21 nt, Human
uccuccgcggcuggggguggg

SEQ ID NO: 375468 - RNA, 21 nt, Human
ucggagggggcuggcugcugg

SEQ ID NO: 375469 - RNA, 21 nt, Human
ucggcgcgcccccgccgccuc

SEQ ID NO: 375470 - RNA, 23 nt, Human
ucucaggugaaguggcucucugc

SEQ ID NO: 375471 - RNA, 22 nt, Human
ucugacaauggaguaacacgau

SEQ ID NO: 375472 - RNA, 21 nt, Human
ucugcgggggaggggcauguc

SEQ ID NO: 375473 - RNA, 19 nt, Human
ucuggaucugaggggggau

SEQ ID NO: 375474 - RNA, 22 nt, Human
ugaaaagaagaggaagaagagg

SEQ ID NO: 375475 - RNA, 18 nt, Human
ugacaggaagggccggug

SEQ ID NO: 375476 - RNA, 21 nt, Human
ugacucagaaacauccaucca

SEQ ID NO: 375477 - RNA, 22 nt, Human
ugacucagaaacauccauccag

SEQ ID NO: 375478 - RNA, 23 nt, Human
ugacucagaaacauccauccagc

SEQ ID NO: 375479 - RNA, 19 nt, Human
ugagaagaagcagucacug

SEQ ID NO: 375480 - RNA, 24 nt, Human
ugagaagaagcagucacuguaauu

SEQ ID NO: 375481 - RNA, 19 nt, Human
ugagggcaaggggggugug

SEQ ID NO: 375482 - RNA, 21 nt, Human
ugagggcaagggggguguggg

SEQ ID NO: 375483 - RNA, 18 nt, Human
ugaguccagacagugugg

SEQ ID NO: 375484 - RNA, 21 nt, Human
ugaguccagacaguguggccc

SEQ ID NO: 375485 - RNA, 18 nt, Human
ugcccugggacacccagc

SEQ ID NO: 375486 - RNA, 22 nt, Human
ugcccugggacacccagcucgg

SEQ ID NO: 375487 - RNA, 24 nt, Human
ugccugaccccguuuccuccucug

SEQ ID NO: 375488 - RNA, 21 nt, Human
ugccuugguuuuuaguuuucu

SEQ ID NO: 375489 - RNA, 18 nt, Human
ugcgccccuccccccagg

SEQ ID NO: 375490 - RNA, 21 nt, Human
ugcguccuggcucacaacaca

SEQ ID NO: 375491 - RNA, 19 nt, Human
ugcucagugguggagcugg

SEQ ID NO: 375492 - RNA, 24 nt, Human
ugcugcaggccugacgaagcccug

SEQ ID NO: 375493 - RNA, 18 nt, Human
ugcuugcaggcccuccuu

SEQ ID NO: 375494 - RNA, 20 nt, Human
uggagaggaaaccuagggcu

SEQ ID NO: 375495 - RNA, 22 nt, Human
uggcaggagguaggccccuuga

SEQ ID NO: 375496 - RNA, 23 nt, Human
uggcaggagguaggccccuugaa

SEQ ID NO: 375497 - RNA, 18 nt, Human
uggccaagccagcccccu

SEQ ID NO: 375498 - RNA, 19 nt, Human
uggccaagccagcccccuc

SEQ ID NO: 375499 - RNA, 27 nt, Human
ugggaccaaucccaccacuccaggccc

SEQ ID NO: 375500 - RNA, 19 nt, Human
ugggaccagcccccuccuc

SEQ ID NO: 375501 - RNA, 22 nt, Human
ugggcagggguccggaggacuc

SEQ ID NO: 375502 - RNA, 18 nt, Human
ugggccugcugggaguac

SEQ ID NO: 375503 - RNA, 26 nt, Human
ugggcugccuuggggugugucugcgg

SEQ ID NO: 375504 - RNA, 18 nt, Human
uggggagcgaggagcugg

SEQ ID NO: 375505 - RNA, 19 nt, Human
uggggagcgaggagcuggg

SEQ ID NO: 375506 - RNA, 21 nt, Human
uggggaggccggaggggcggg

SEQ ID NO: 375507 - RNA, 22 nt, Human
ugggggugggggaggaggcagc

SEQ ID NO: 375508 - RNA, 22 nt, Human
uggggguugggcugccuugggg

SEQ ID NO: 375509 - RNA, 19 nt, Human
ugugcaaaaggggggaggg

SEQ ID NO: 375510 - RNA, 19 nt, Human
ugugcaaaaggggggaggg

SEQ ID NO: 375511 - RNA, 22 nt, Human
ugugcaggagggggcgacgugg

SEQ ID NO: 375512 - RNA, 19 nt, Human
ugugggugccagugcccca

SEQ ID NO: 375513 - RNA, 20 nt, Human
uuaaaaaaaaaaaaaaaaaa

SEQ ID NO: 375514 - RNA, 18 nt, Human
uuccugccaucacaucug

SEQ ID NO: 375515 - RNA, 23 nt, Human
uugcgggggccgaggaaucgcac

SEQ ID NO: 375516 - RNA, 25 nt, Human
uuugugugugugaaugagagugugu

SEQ ID NO: 375517 - RNA, 22 nt, Human
uuuuuaguuuucuugggugguc

SEQ ID NO: 375518 - RNA, 24 nt, Human
aaaaaagaaacagccuggagagaa

SEQ ID NO: 375519 - RNA, 23 nt, Human
aaaaagaaacagccuggagagaa

SEQ ID NO: 375520 - RNA, 23 nt, Human
aaacaaaaaaaucccccgagugu

SEQ ID NO: 375521 - RNA, 18 nt, Human
aaacagccuggagagaag

SEQ ID NO: 375522 - RNA, 21 nt, Human
aaacagccuggagagaagugg

SEQ ID NO: 375523 - RNA, 26 nt, Human
aaagaaacagccuggagagaaguggg

SEQ ID NO: 375524 - RNA, 22 nt, Human
aaagagaagcacagaaagaggc

SEQ ID NO: 375525 - RNA, 19 nt, Human
aacaaguccaaguaccaac

SEQ ID NO: 375526 - RNA, 30 nt, Human
aacagaugaaacacacacacgugcacgcgg

SEQ ID NO: 375527 - RNA, 19 nt, Human
aaccugagacacccagacu

SEQ ID NO: 375528 - RNA, 22 nt, Human
aagcacagaaagaggcccccag

SEQ ID NO: 375529 - RNA, 22 nt, Human
aagcccuaaaggcugaggugcu

SEQ ID NO: 375530 - RNA, 25 nt, Human
acaaacuuugugaaacugaucagag

SEQ ID NO: 375531 - RNA, 24 nt, Human
acaaagagaagcacagaaagaggc

SEQ ID NO: 375532 - RNA, 18 nt, Human
acaaaguacaaagcgauc

SEQ ID NO: 375533 - RNA, 26 nt, Human
acaagaauggaaacaaagcaugugac

SEQ ID NO: 375534 - RNA, 24 nt, Human
acaaggucuuccccagaggagaag

SEQ ID NO: 375535 - RNA, 20 nt, Human
acacaaggacacacagaacc

SEQ ID NO: 375536 - RNA, 20 nt, Human
acacacacacgugcacgcgc

SEQ ID NO: 375537 - RNA, 19 nt, Human
acacagaaccugagacacc

SEQ ID NO: 375538 - RNA, 22 nt, Human
acacagaaccugagacacccag

SEQ ID NO: 375539 - RNA, 21 nt, Human
acacccacaggaacucagcaa

SEQ ID NO: 375540 - RNA, 21 nt, Human
acacgugcacgcgcacacaua

SEQ ID NO: 375541 - RNA, 19 nt, Human
acagaaagaggcccccaga

SEQ ID NO: 375542 - RNA, 21 nt, Human
acagaaaugcacacaaggaca

SEQ ID NO: 375543 - RNA, 21 nt, Human
acagaaccugagacacccaga

SEQ ID NO: 375544 - RNA, 21 nt, Human
acauacagcagccagaggcac

SEQ ID NO: 375545 - RNA, 20 nt, Human
acauagacccagagaaucca

SEQ ID NO: 375546 - RNA, 20 nt, Human
acccacaggaacucagcaac

SEQ ID NO: 375547 - RNA, 20 nt, Human
agaaaacaaaaaaauccccc

SEQ ID NO: 375548 - RNA, 22 nt, Human
agaaagagagaaauagagggcc

SEQ ID NO: 375549 - RNA, 20 nt, Human
agaaagaggcccccagagaa

SEQ ID NO: 375550 - RNA, 21 nt, Human
agacacacccacaggaacuca

SEQ ID NO: 375551 - RNA, 21 nt, Human
agagaagcaggaguggcaucg

SEQ ID NO: 375552 - RNA, 18 nt, Human
agagacacacccacagga

SEQ ID NO: 375553 - RNA, 25 nt, Human
agagggcacagggggcaaaggacag

SEQ ID NO: 375554 - RNA, 23 nt, Human
agagugggggaggggagggcagg

SEQ ID NO: 375555 - RNA, 20 nt, Human
agaugccauaccccaggugg

SEQ ID NO: 375556 - RNA, 23 nt, Human
agcacagaaagaggcccccagag

SEQ ID NO: 375557 - RNA, 23 nt, Human
agccaggacaagaauggaaacaa

SEQ ID NO: 375558 - RNA, 23 nt, Human
aggaaggcugaugagcccagggc

SEQ ID NO: 375559 - RNA, 20 nt, Human
aggcaggugaggggcagggc

SEQ ID NO: 375560 - RNA, 21 nt, Human
aggcaggugaggggcagggcu

SEQ ID NO: 375561 - RNA, 23 nt, Human
aggcaggugaggggcagggcugg

SEQ ID NO: 375562 - RNA, 18 nt, Human
agguggauagacaccugc

SEQ ID NO: 375563 - RNA, 23 nt, Human
auaagcccuaaaggcugaggugc

SEQ ID NO: 375564 - RNA, 19 nt, Human
aucagaaaacaaaaaaauc

SEQ ID NO: 375565 - RNA, 19 nt, Human
aucgagagacacacccaca

SEQ ID NO: 375566 - RNA, 21 nt, Human
caacagcuccucaggaaggga

SEQ ID NO: 375567 - RNA, 21 nt, Human
caagaauggggacccccccga

SEQ ID NO: 375568 - RNA, 19 nt, Human
cacacaaggacacacagaa

SEQ ID NO: 375569 - RNA, 22 nt, Human
cacagaaccugagacacccaga

SEQ ID NO: 375570 - RNA, 19 nt, Human
cacagcuuugcccaucucu

SEQ ID NO: 375571 - RNA, 22 nt, Human
cacaucuggcccugugggauuu

SEQ ID NO: 375572 - RNA, 19 nt, Human
caccaagaaagagagaaau

SEQ ID NO: 375573 - RNA, 20 nt, Human
caccaagaaagagagaaaua

SEQ ID NO: 375574 - RNA, 18 nt, Human
caccaggacaaagccccu

SEQ ID NO: 375575 - RNA, 18 nt, Human
cacccacaggaacucagc

SEQ ID NO: 375576 - RNA, 22 nt, Human
cacgcgcacacauacagcagcc

SEQ ID NO: 375577 - RNA, 20 nt, Human
cagaaaugcacacaaggaca

SEQ ID NO: 375578 - RNA, 23 nt, Human
cagaggcacaauaggcuuggcag

SEQ ID NO: 375579 - RNA, 19 nt, Human
cagcuccucaggaagggag

SEQ ID NO: 375580 - RNA, 25 nt, Human
caggacaaagccccuuggaggccga

SEQ ID NO: 375581 - RNA, 18 nt, Human
caggcaggugaggggcag

SEQ ID NO: 375582 - RNA, 18 nt, Human
caggggcgggggcaccag

SEQ ID NO: 375583 - RNA, 20 nt, Human
caucagaaaacaaaaaaauc

SEQ ID NO: 375584 - RNA, 22 nt, Human
caucagaaaacaaaaaaauccc

SEQ ID NO: 375585 - RNA, 18 nt, Human
ccaagaaagagagaaaua

SEQ ID NO: 375586 - RNA, 19 nt, Human
ccacaggaacucagcaaca

SEQ ID NO: 375587 - RNA, 25 nt, Human
ccaggacaagaauggaaacaaagca

SEQ ID NO: 375588 - RNA, 24 nt, Human
ccaggagucuucucaaccucuucc

SEQ ID NO: 375589 - RNA, 18 nt, Human
ccaggcccacccagccgg

SEQ ID NO: 375590 - RNA, 21 nt, Human
cccacaggaacucagcaacag

SEQ ID NO: 375591 - RNA, 19 nt, Human
cccagagaauccagagggc

SEQ ID NO: 375592 - RNA, 26 nt, Human
cccauggccauacugcaguuccugcc

SEQ ID NO: 375593 - RNA, 21 nt, Human
ccccgaguguaaacaggagaa

SEQ ID NO: 375594 - RNA, 23 nt, Human
cccuggccauaagcccuaaaggc

SEQ ID NO: 375595 - RNA, 18 nt, Human
cccugugggauuuggggu

SEQ ID NO: 375596 - RNA, 19 nt, Human
ccgacuggcagagccaggg

SEQ ID NO: 375597 - RNA, 22 nt, Human
ccgaggcacauucccaugcuga

SEQ ID NO: 375598 - RNA, 25 nt, Human
ccucaggaagggagggcgccucucc

SEQ ID NO: 375599 - RNA, 20 nt, Human
ccuccugucccaacucccuc

SEQ ID NO: 375600 - RNA, 23 nt, Human
ccugagacacccagacugacaaa

SEQ ID NO: 375601 - RNA, 21 nt, Human
cgcgcacacauacagcagcca

SEQ ID NO: 375602 - RNA, 18 nt, Human
cgguagaugccauacccc

SEQ ID NO: 375603 - RNA, 24 nt, Human
cucaaccucuuccaagaaugggga

SEQ ID NO: 375604 - RNA, 19 nt, Human
cuggagagaagugggggcu

SEQ ID NO: 375605 - RNA, 20 nt, Human
cuuggcagagaugaaaacag

SEQ ID NO: 375606 - RNA, 27 nt, Human
gaaaacagcaagggacagccgguaccc

SEQ ID NO: 375607 - RNA, 19 nt, Human
gaaccgacuggcagagcca

SEQ ID NO: 375608 - RNA, 25 nt, Human
gaaccugagacacccagacugacag

SEQ ID NO: 375609 - RNA, 24 nt, Human
gaacucagcaacagugccuggcag

SEQ ID NO: 375610 - RNA, 24 nt, Human
gaagggagggcgccucuccccuca

SEQ ID NO: 375611 - RNA, 22 nt, Human
gacaaagagaagcacagaaaga

SEQ ID NO: 375612 - RNA, 23 nt, Human
gacaagaauggaaacaaagcaug

SEQ ID NO: 375613 - RNA, 21 nt, Human
gacuccacaucuggcccugug

SEQ ID NO: 375614 - RNA, 22 nt, Human
gagaagcaggaguggcaucgag

SEQ ID NO: 375615 - RNA, 21 nt, Human
gagcagucugggggagugugg

SEQ ID NO: 375616 - RNA, 18 nt, Human
gagcccagggcagaccag

SEQ ID NO: 375617 - RNA, 20 nt, Human
gagggguguuggucccacag

SEQ ID NO: 375618 - RNA, 19 nt, Human
gagugggggaggggagggc

SEQ ID NO: 375619 - RNA, 22 nt, Human
gcacaaaguacaaagcgauccu

SEQ ID NO: 375620 - RNA, 18 nt, Human
gcagaccaggggccuaca

SEQ ID NO: 375621 - RNA, 26 nt, Human
gcagaccaggggccuacauagaccca

SEQ ID NO: 375622 - RNA, 20 nt, Human
gcccccagagaagcaggagu

SEQ ID NO: 375623 - RNA, 24 nt, Human
ggagagaagugggggcuuugagga

SEQ ID NO: 375624 - RNA, 25 nt, Human
ggcaaaggacagacaccaagaaaga

SEQ ID NO: 375625 - RNA, 20 nt, Human
ggcccugugggauuuggggu

SEQ ID NO: 375626 - RNA, 19 nt, Human
gggagaggcugaagcccag

SEQ ID NO: 375627 - RNA, 19 nt, Human
gggagaggcugaagcccag

SEQ ID NO: 375628 - RNA, 26 nt, Human
gggagggcaggcaggugaggggcagg

SEQ ID NO: 375629 - RNA, 18 nt, Human
gggcacagggggcaaagg

SEQ ID NO: 375630 - RNA, 25 nt, Human
gggcaccaggacaaagccccuugga

SEQ ID NO: 375631 - RNA, 19 nt, Human
gggcagaccaggggccuac

SEQ ID NO: 375632 - RNA, 24 nt, Human
gggcagggcugggugggagaggcu

SEQ ID NO: 375633 - RNA, 20 nt, Human
ggggaggggagggcaggcag

SEQ ID NO: 375634 - RNA, 20 nt, Human
ggggcacgaacaaguccaag

SEQ ID NO: 375635 - RNA, 24 nt, Human
gggguucccauacugauccaaggg

SEQ ID NO: 375636 - RNA, 19 nt, Human
gggugggagaggcugaagc

SEQ ID NO: 375637 - RNA, 19 nt, Human
ggugaggggcagggcuggg

SEQ ID NO: 375638 - RNA, 18 nt, Human
gucugggggaguguggga

SEQ ID NO: 375639 - RNA, 24 nt, Human
gugcucagccugcucagcccaugg

SEQ ID NO: 375640 - RNA, 23 nt, Human
uagagugggggaggggagggcag

SEQ ID NO: 375641 - RNA, 19 nt, Human
ucagccugcucagcccaug

SEQ ID NO: 375642 - RNA, 18 nt, Human
uccacaucuggcccugug

SEQ ID NO: 375643 - RNA, 19 nt, Human
uccacaucuggcccugugg

SEQ ID NO: 375644 - RNA, 18 nt, Human
uccccuggccauaagccc

SEQ ID NO: 375645 - RNA, 21 nt, Human
uccccuggccauaagcccuaa

SEQ ID NO: 375646 - RNA, 23 nt, Human
uccucaggaagggagggcgccuc

SEQ ID NO: 375647 - RNA, 22 nt, Human
uccugcccacccaggccaacag

SEQ ID NO: 375648 - RNA, 19 nt, Human
ucgguagaugccauacccc

SEQ ID NO: 375649 - RNA, 23 nt, Human
ugaaaacagcaagggacagcccu

SEQ ID NO: 375650 - RNA, 20 nt, Human
ugaaacacacacacgugcac

SEQ ID NO: 375651 - RNA, 19 nt, Human
ugaaacugaucagaggcug

SEQ ID NO: 375652 - RNA, 32 nt, Human
ugaacagaugaaacacacacacgugcacggug

SEQ ID NO: 375653 - RNA, 22 nt, Human
ugacaaagagguagcaauuugg

SEQ ID NO: 375654 - RNA, 19 nt, Human
ugaccccagggagacaggu

SEQ ID NO: 375655 - RNA, 20 nt, Human
ugagacacccagacugacaa

SEQ ID NO: 375656 - RNA, 18 nt, Human
ugagcccagggcagacca

SEQ ID NO: 375657 - RNA, 21 nt, Human
ugcacaaaguacaaagcgauc

SEQ ID NO: 375658 - RNA, 23 nt, Human
ugccauaccccagguggauagac

SEQ ID NO: 375659 - RNA, 18 nt, Human
ugccauggacagccccuc

SEQ ID NO: 375660 - RNA, 23 nt, Human
uggaaacaaagcaugugacccca

SEQ ID NO: 375661 - RNA, 18 nt, Human
uggagagaagugggggcu

SEQ ID NO: 375662 - RNA, 24 nt, Human
uggcaggaaggggagcaccaucaa

SEQ ID NO: 375663 - RNA, 19 nt, Human
uggcuggcugugcccaucg

SEQ ID NO: 375664 - RNA, 24 nt, Human
ugggacaaggucuuccccagagga

SEQ ID NO: 375665 - RNA, 19 nt, Human
ugggagaggcugaagccca

SEQ ID NO: 375666 - RNA, 20 nt, Human
uggggacaaagagaagcaca

SEQ ID NO: 375667 - RNA, 24 nt, Human
ugggggagugugggagggguguug

SEQ ID NO: 375668 - RNA, 24 nt, Human
ugucaucagaaaacaaaaaaaucc

SEQ ID NO: 375669 - RNA, 27 nt, Human
ugucaucagaaaacaaaaaaauccccc

SEQ ID NO: 375670 - RNA, 21 nt, Human
uuccuuagggaacaaacuuug

SEQ ID NO: 375671 - RNA, 23 nt, Human
uuugcacaaaguacaaagcgauc

SEQ ID NO: 375672 - RNA, 22 nt, Human
uuugggguucccauacugaucc

SEQ ID NO: 375673 - RNA, 18 nt, Human
uuuuuuuuuuuuuuucug

SEQ ID NO: 375674 - RNA, 19 nt, Human
aaagacugacuccgccccu

SEQ ID NO: 375675 - RNA, 21 nt, Human
acugacuccgccccugucccu

SEQ ID NO: 375676 - RNA, 22 nt, Human
acuuuggggagagucgaaugca

SEQ ID NO: 375677 - RNA, 22 nt, Human
agcccagagcuuaaaccggagc

SEQ ID NO: 375678 - RNA, 18 nt, Human
agccugggguaggggaug

SEQ ID NO: 375679 - RNA, 19 nt, Human
aggcccgucccgugagguc

SEQ ID NO: 375680 - RNA, 20 nt, Human
aggcgcggauaggccagacc

SEQ ID NO: 375681 - RNA, 20 nt, Human
aucaugggaggacugcaggc

SEQ ID NO: 375682 - RNA, 20 nt, Human
cagcugccaggcgcggauag

SEQ ID NO: 375683 - RNA, 20 nt, Human
ccaccugggcucagcguuug

SEQ ID NO: 375684 - RNA, 22 nt, Human
cguugccgaggaacuugggucc

SEQ ID NO: 375685 - RNA, 21 nt, Human
cucccuggcuaucaugggagg

SEQ ID NO: 375686 - RNA, 20 nt, Human
gccccugucccucccauaag

SEQ ID NO: 375687 - RNA, 19 nt, Human
ggggaugcugcuggauuaa

SEQ ID NO: 375688 - RNA, 18 nt, Human
ggucuccggaguuccgac

SEQ ID NO: 375689 - RNA, 24 nt, Human
gugcggcucucccuggcuaucaug

SEQ ID NO: 375690 - RNA, 21 nt, Human
guggcaggcgggccagaccug

SEQ ID NO: 375691 - RNA, 23 nt, Human
uaaaccccuuuguggucuccgga

SEQ ID NO: 375692 - RNA, 23 nt, Human
uacaaaacuguuuaauacuacca

SEQ ID NO: 375693 - RNA, 23 nt, Human
uauguugugcggcucucccuggc

SEQ ID NO: 375694 - RNA, 22 nt, Human
ucccauaagacugcaccuccuu

SEQ ID NO: 375695 - RNA, 23 nt, Human
uccccaagcccagagcuuaaacc

SEQ ID NO: 375696 - RNA, 19 nt, Human
ucccgugaggucugcgucc

SEQ ID NO: 375697 - RNA, 26 nt, Human
ucccucccauaagacugcaccuccuu

SEQ ID NO: 375698 - RNA, 25 nt, Human
ucccuggcuaucaugggaggacugc

SEQ ID NO: 375699 - RNA, 23 nt, Human
ugaaaauggaaaggucuucccag

SEQ ID NO: 375700 - RNA, 19 nt, Human
ugaagcgucgauccugaaa

SEQ ID NO: 375701 - RNA, 19 nt, Human
ugaaugcccuccccucaac

SEQ ID NO: 375702 - RNA, 20 nt, Human
ugacuccgccccugucccuc

SEQ ID NO: 375703 - RNA, 23 nt, Human
ugacuccgccccugucccuccca

SEQ ID NO: 375704 - RNA, 21 nt, Human
ugcugcuggauuaaaaaagga

SEQ ID NO: 375705 - RNA, 24 nt, Human
ugggaacagcuuuuaaagacugac

SEQ ID NO: 375706 - RNA, 22 nt, Human
ugggcucagcguuuguggcagg

SEQ ID NO: 375707 - RNA, 19 nt, Human
uguuuaauacuaccaaaaa

SEQ ID NO: 375708 - RNA, 22 nt, Human
uuggguccuuaaaaaguguauu

SEQ ID NO: 375709 - RNA, 23 nt, Human
uuguauguugugcggcucucccu

SEQ ID NO: 375710 - RNA, 21 nt, Human
uuuguggcaggcgggccagac

SEQ ID NO: 375711 - RNA, 22 nt, Human
aagggcaggccaggccgggagg

SEQ ID NO: 375712 - RNA, 19 nt, Human
auggcgguggggacggcgg

SEQ ID NO: 375713 - RNA, 23 nt, Human
auggcgguggggacggcgguggu

SEQ ID NO: 375714 - RNA, 20 nt, Human
cuggggagccgggcgcaagg

SEQ ID NO: 375715 - RNA, 18 nt, Human
gagcgcggcgggcgggcg

SEQ ID NO: 375716 - RNA, 21 nt, Human
gccgggcgcaagggcaggcca

SEQ ID NO: 375717 - RNA, 22 nt, Human
gcgcggccugggcggaacggag

SEQ ID NO: 375718 - RNA, 22 nt, Human
gcggcgggcgggcggcgggcac

SEQ ID NO: 375719 - RNA, 22 nt, Human
gcgggcgggcggcgggcacugg

SEQ ID NO: 375720 - RNA, 19 nt, Human
gcugcagggacccgggcgg

SEQ ID NO: 375721 - RNA, 20 nt, Human
ggacccgggcggcgccggcg

SEQ ID NO: 375722 - RNA, 21 nt, Human
ggacccgggcggcgccggcgg

SEQ ID NO: 375723 - RNA, 21 nt, Human
ggagcgcggcgggcgggcggc

SEQ ID NO: 375724 - RNA, 18 nt, Human
ggcggauggcggugggga

SEQ ID NO: 375725 - RNA, 20 nt, Human
gggagggcggauggcggugg

SEQ ID NO: 375726 - RNA, 18 nt, Human
gggcaggccaggccggga

SEQ ID NO: 375727 - RNA, 24 nt, Human
uccagcugggcgcggccugggcgg

SEQ ID NO: 375728 - RNA, 19 nt, Human
caccccucccauuucccuc

SEQ ID NO: 375729 - RNA, 23 nt, Human
caugcuguuucuuacucuccucu

SEQ ID NO: 375730 - RNA, 23 nt, Human
cuccaugcuguuucuuacucucc

SEQ ID NO: 375731 - RNA, 19 nt, Human
cuguuucuuacucuccucu

SEQ ID NO: 375732 - RNA, 24 nt, Human
cuuugaaaauuucuccccccucca

SEQ ID NO: 375733 - RNA, 20 nt, Human
ggccgggacuuuggggggcc

SEQ ID NO: 375734 - RNA, 21 nt, Human
ggcgcugugcgcgggcccggc

SEQ ID NO: 375735 - RNA, 24 nt, Human
uaccggguuuucuccaugcuguuu

SEQ ID NO: 375736 - RNA, 21 nt, Human
uacucuccucuuuugcacccc

SEQ ID NO: 375737 - RNA, 19 nt, Human
ugaaaauuucuccccccuc

SEQ ID NO: 375738 - RNA, 27 nt, Human
uuugaaaauuucuccccccuccaguuc

SEQ ID NO: 375739 - RNA, 19 nt, Human
aaaaaaagggggggagggg

SEQ ID NO: 375740 - RNA, 22 nt, Human
aaaauaaaacaaaaccaaggug

SEQ ID NO: 375741 - RNA, 21 nt, Human
aacaacaaucacaggucgccc

SEQ ID NO: 375742 - RNA, 21 nt, Human
aacaacaucaauaacaacaau

SEQ ID NO: 375743 - RNA, 23 nt, Human
aagcaaaauaaaacaaaaccaag

SEQ ID NO: 375744 - RNA, 26 nt, Human
aagggggggaggggugcgcuggguuc

SEQ ID NO: 375745 - RNA, 24 nt, Human
aaguccccaaaagauuuggggaag

SEQ ID NO: 375746 - RNA, 25 nt, Human
accccccccggcccuucucccugcc

SEQ ID NO: 375747 - RNA, 24 nt, Human
acccucuuccuccuccgcgucccu

SEQ ID NO: 375748 - RNA, 19 nt, Human
acgccuccggggucuggga

SEQ ID NO: 375749 - RNA, 20 nt, Human
acgggaagacgcgcgcggcg

SEQ ID NO: 375750 - RNA, 19 nt, Human
agagagaaaaguccccaaa

SEQ ID NO: 375751 - RNA, 20 nt, Human
agcaaaauaaaacaaaacca

SEQ ID NO: 375752 - RNA, 19 nt, Human
aggaaaaaaaggccccaaa

SEQ ID NO: 375753 - RNA, 21 nt, Human
agggggggaggggugcgcugg

SEQ ID NO: 375754 - RNA, 23 nt, Human
agggggggaggggugcgcugggu

SEQ ID NO: 375755 - RNA, 25 nt, Human
agggggggaggggugcgcuggguuc

SEQ ID NO: 375756 - RNA, 22 nt, Human
agucuccucuccuccacgccuc

SEQ ID NO: 375757 - RNA, 22 nt, Human
aguggguccccggcccgggaag

SEQ ID NO: 375758 - RNA, 25 nt, Human
aucacgcguuuaaaaaaaggggggg

SEQ ID NO: 375759 - RNA, 21 nt, Human
caaaacgccgccgcgcuccuu

SEQ ID NO: 375760 - RNA, 20 nt, Human
caagaagcaaaauaaaacaa

SEQ ID NO: 375761 - RNA, 25 nt, Human
caauaacaacaaucacaggucgccc

SEQ ID NO: 375762 - RNA, 25 nt, Human
cagucuccucuccuccacgccuccu

SEQ ID NO: 375763 - RNA, 20 nt, Human
caucuccuccuccggcugca

SEQ ID NO: 375764 - RNA, 22 nt, Human
ccaaaacaucugccaucggcca

SEQ ID NO: 375765 - RNA, 23 nt, Human
ccaaaacaucugccaucggccaa

SEQ ID NO: 375766 - RNA, 19 nt, Human
ccacaucaaacagucuccu

SEQ ID NO: 375767 - RNA, 25 nt, Human
cccaaaacaucugccaucggccaaa

SEQ ID NO: 375768 - RNA, 19 nt, Human
cccacgcgcgcucacaccc

SEQ ID NO: 375769 - RNA, 21 nt, Human
cccacgcgcgcucacacccuc

SEQ ID NO: 375770 - RNA, 22 nt, Human
cccacgcgcgcucacacccucg

SEQ ID NO: 375771 - RNA, 22 nt, Human
ccccaaaagauuuggggaagga

SEQ ID NO: 375772 - RNA, 19 nt, Human
cccccaaaacaucugccau

SEQ ID NO: 375773 - RNA, 18 nt, Human
cccccgccccuagcuccc

SEQ ID NO: 375774 - RNA, 20 nt, Human
cccccgccccuagcucccgc

SEQ ID NO: 375775 - RNA, 20 nt, Human
cccccggcccuucucccugc

SEQ ID NO: 375776 - RNA, 20 nt, Human
ccccuccuuucuugaccaag

SEQ ID NO: 375777 - RNA, 18 nt, Human
cccggcccuucucccugc

SEQ ID NO: 375778 - RNA, 19 nt, Human
cccucaacaucuccuccuc

SEQ ID NO: 375779 - RNA, 19 nt, Human
cccucucucucgcucucuc

SEQ ID NO: 375780 - RNA, 22 nt, Human
cccucuuccuccuccgcguccc

SEQ ID NO: 375781 - RNA, 22 nt, Human
ccgaaaccacucgcccuccacu

SEQ ID NO: 375782 - RNA, 18 nt, Human
ccgccgccgccagcuccc

SEQ ID NO: 375783 - RNA, 22 nt, Human
ccgccgccgccagcuccccaac

SEQ ID NO: 375784 - RNA, 22 nt, Human
ccuccgcccccgccccuagcuc

SEQ ID NO: 375785 - RNA, 21 nt, Human
ccucgcaggggcggagguggg

SEQ ID NO: 375786 - RNA, 23 nt, Human
cgaaaccacucgcccuccacuga

SEQ ID NO: 375787 - RNA, 18 nt, Human
cggagccuucugucuuca

SEQ ID NO: 375788 - RNA, 18 nt, Human
cucaacaucuccuccucc

SEQ ID NO: 375789 - RNA, 22 nt, Human
cucaacaucuccuccuccggcu

SEQ ID NO: 375790 - RNA, 23 nt, Human
cucacacccucgcggcggccgcc

SEQ ID NO: 375791 - RNA, 23 nt, Human
cugcgcuuccaacgggguucucg

SEQ ID NO: 375792 - RNA, 22 nt, Human
cugcugcgcuuccaacgggguu

SEQ ID NO: 375793 - RNA, 26 nt, Human
cuggccuccuccccucaacaucuccu

SEQ ID NO: 375794 - RNA, 18 nt, Human
cuggcuggccuccucccc

SEQ ID NO: 375795 - RNA, 22 nt, Human
cuuucuugaccaagaagcaaaa

SEQ ID NO: 375796 - RNA, 19 nt, Human
gaaggaguucuccgccucu

SEQ ID NO: 375797 - RNA, 18 nt, Human
gaagggggagggggucuc

SEQ ID NO: 375798 - RNA, 21 nt, Human
gaccgugaacccccuuccagu

SEQ ID NO: 375799 - RNA, 18 nt, Human
gagaccgugcuaaaguag

SEQ ID NO: 375800 - RNA, 21 nt, Human
gagggggcaaggggaaaagag

SEQ ID NO: 375801 - RNA, 19 nt, Human
gaggggugcgcuggguucu

SEQ ID NO: 375802 - RNA, 22 nt, Human
gcaaaauaaaacaaaaccaagg

SEQ ID NO: 375803 - RNA, 24 nt, Human
gccagcuccccaacgugcaaaucc

SEQ ID NO: 375804 - RNA, 26 nt, Human
gcccgggaaggugggggaugggagcg

SEQ ID NO: 375805 - RNA, 20 nt, Human
gcggagguggguaaagagag

SEQ ID NO: 375806 - RNA, 23 nt, Human
gcucccgcugcugcgcuuccaac

SEQ ID NO: 375807 - RNA, 20 nt, Human
gcugcaguuugcugucucuc

SEQ ID NO: 375808 - RNA, 21 nt, Human
gcugcaguuugcugucucucg

SEQ ID NO: 375809 - RNA, 18 nt, Human
ggcaaggggaaaagaggg

SEQ ID NO: 375810 - RNA, 21 nt, Human
ggcggaggcccagcagccgcc

SEQ ID NO: 375811 - RNA, 21 nt, Human
gggcagaguggguccccggcc

SEQ ID NO: 375812 - RNA, 20 nt, Human
gggggggaggggugcgcugg

SEQ ID NO: 375813 - RNA, 23 nt, Human
guuuaaaaaaagggggggagggg

SEQ ID NO: 375814 - RNA, 21 nt, Human
uaaacucuucgucuguccuuu

SEQ ID NO: 375815 - RNA, 21 nt, Human
uaaaguagagaggaguuucuc

SEQ ID NO: 375816 - RNA, 24 nt, Human
uccccaaaagauuuggggaaggag

SEQ ID NO: 375817 - RNA, 20 nt, Human
uccccaacgugcaaauccau

SEQ ID NO: 375818 - RNA, 21 nt, Human
uccccgggccaagcacacgcc

SEQ ID NO: 375819 - RNA, 19 nt, Human
uccccucaacaucuccucc

SEQ ID NO: 375820 - RNA, 18 nt, Human
ucccuccggcugggcaga

SEQ ID NO: 375821 - RNA, 27 nt, Human
uccggaagcucguuggaagggggaggg

SEQ ID NO: 375822 - RNA, 21 nt, Human
uccuucaagucucuagaaaac

SEQ ID NO: 375823 - RNA, 20 nt, Human
ucucgggucauuuccuagcg

SEQ ID NO: 375824 - RNA, 20 nt, Human
ucucucagucccggcguucc

SEQ ID NO: 375825 - RNA, 20 nt, Human
ucucuucaagcaaaggggag

SEQ ID NO: 375826 - RNA, 18 nt, Human
ucuguccuuuucguuucu

SEQ ID NO: 375827 - RNA, 23 nt, Human
ugaacccccuuccaguucguguc

SEQ ID NO: 375828 - RNA, 20 nt, Human
ugaccaagaagcaaaauaaa

SEQ ID NO: 375829 - RNA, 24 nt, Human
ugaccaagaagcaaaauaaaacaa

SEQ ID NO: 375830 - RNA, 21 nt, Human
ugcagagggggcaaggggaaa

SEQ ID NO: 375831 - RNA, 19 nt, Human
ugcaggaagggggagacuc

SEQ ID NO: 375832 - RNA, 20 nt, Human
ugcaggaagggggagacucc

SEQ ID NO: 375833 - RNA, 26 nt, Human
ugccccuguaccacaucaaacagucu

SEQ ID NO: 375834 - RNA, 21 nt, Human
ugggagcgcggguccaaaacg

SEQ ID NO: 375835 - RNA, 22 nt, Human
uguaccacaucaaacagucucc

SEQ ID NO: 375836 - RNA, 21 nt, Human
uuaaaaaaagggggggagggg

SEQ ID NO: 375837 - RNA, 22 nt, Human
uucaagucucuagaaaacuaac

SEQ ID NO: 375838 - RNA, 21 nt, Human
uugcugggggugcagacaagu

SEQ ID NO: 375839 - RNA, 21 nt, Human
uuuuuucacuuuuuuuuucuc

SEQ ID NO: 375840 - RNA, 24 nt, Human
uuuuuuucuuuuuuuuuuuccggg

SEQ ID NO: 375841 - RNA, 18 nt, Human
acuucagugcuuggaugu

SEQ ID NO: 375842 - RNA, 24 nt, Human
agcagcugaauuacuggcauuauu

SEQ ID NO: 375843 - RNA, 22 nt, Human
aguuuauuuaaaaaaaaaaaaa

SEQ ID NO: 375844 - RNA, 19 nt, Human
augagaaaguuaaugugcu

SEQ ID NO: 375845 - RNA, 19 nt, Human
gcacaauuucccuuuguca

SEQ ID NO: 375846 - RNA, 23 nt, Human
guuuuuucuuuccaagccuuuug

SEQ ID NO: 375847 - RNA, 24 nt, Human
uaaaguaacagucaguguaugaga

SEQ ID NO: 375848 - RNA, 24 nt, Human
uaaguccuaaggucacaacaaucu

SEQ ID NO: 375849 - RNA, 19 nt, Human
uagcagcugaauuacuggc

SEQ ID NO: 375850 - RNA, 20 nt, Human
ucucuuguuguugauauugu

SEQ ID NO: 375851 - RNA, 19 nt, Human
uguuguauuuguuuuuucu

SEQ ID NO: 375852 - RNA, 19 nt, Human
uuaaaguaacagucagugu

SEQ ID NO: 375853 - RNA, 19 nt, Human
uuaaaguaacagucagugu

SEQ ID NO: 375854 - RNA, 20 nt, Human
uuuaaaaaaaaaaaaaaagu

SEQ ID NO: 375855 - RNA, 22 nt, Human
uuuguuuuuucuuuccaagccu

SEQ ID NO: 375856 - RNA, 19 nt, Human
uuuuuuuuuuuuuuuuugu

SEQ ID NO: 375857 - RNA, 27 nt, Human
uuuuuuuuuuuuuuuuuuuuuuugggg

SEQ ID NO: 375858 - RNA, 19 nt, Human
aaaaaaaaaaaaaaaaaga

SEQ ID NO: 375859 - RNA, 21 nt, Human
aaaaaaacaaaaaaacacaaa

SEQ ID NO: 375860 - RNA, 21 nt, Human
aaaaaaacacaaauguccaaa

SEQ ID NO: 375861 - RNA, 20 nt, Human
aaaaaacaaaaaaacacaaa

SEQ ID NO: 375862 - RNA, 31 nt, Human
aaaaacaaaaaaacacaaauguccaaagggg

SEQ ID NO: 375863 - RNA, 22 nt, Human
aaaaauauguauaaauccccuc

SEQ ID NO: 375864 - RNA, 19 nt, Human
aaaacaacaaagaaaaaag

SEQ ID NO: 375865 - RNA, 22 nt, Human
aaaacacgaacacaaaccaaag

SEQ ID NO: 375866 - RNA, 21 nt, Human
aaaauaugauuuaaaugccag

SEQ ID NO: 375867 - RNA, 21 nt, Human
aaacaaaaaaacacaaauguu

SEQ ID NO: 375868 - RNA, 24 nt, Human
aaacaaaacacgaacacaaaccaa

SEQ ID NO: 375869 - RNA, 26 nt, Human
aaacaaaacacgaacacaaaccaaag

SEQ ID NO: 375870 - RNA, 19 nt, Human
aaacaaacaaaacacgaac

SEQ ID NO: 375871 - RNA, 20 nt, Human
aaacaaacaaaacacgaaca

SEQ ID NO: 375872 - RNA, 27 nt, Human
aaacaaacaaaacacgaacacaaacca

SEQ ID NO: 375873 - RNA, 20 nt, Human
aaacaagugaaacaaacaaa

SEQ ID NO: 375874 - RNA, 21 nt, Human
aaaccaaagcuuuuaccuaaa

SEQ ID NO: 375875 - RNA, 19 nt, Human
aaagcaauccucaaacucu

SEQ ID NO: 375876 - RNA, 21 nt, Human
aaagcaauccucaaacucucu

SEQ ID NO: 375877 - RNA, 21 nt, Human
aacaagcaaaggcaggaggaa

SEQ ID NO: 375878 - RNA, 19 nt, Human
aacagaugaccauacccuu

SEQ ID NO: 375879 - RNA, 18 nt, Human
aagaaaaaagggauggac

SEQ ID NO: 375880 - RNA, 19 nt, Human
aagaaaaaagggauggaca

SEQ ID NO: 375881 - RNA, 22 nt, Human
aagaaaaaagggauggacaaaa

SEQ ID NO: 375882 - RNA, 19 nt, Human
aagaagaaaaaacaaaaca

SEQ ID NO: 375883 - RNA, 20 nt, Human
aagaagaagaagaaaaaaca

SEQ ID NO: 375884 - RNA, 23 nt, Human
aagaagaagaagaaaaaacaaaa

SEQ ID NO: 375885 - RNA, 22 nt, Human
aagaagaagaagaagaaaaaac

SEQ ID NO: 375886 - RNA, 24 nt, Human
aagagaaagcaaaucuguacaaaa

SEQ ID NO: 375887 - RNA, 19 nt, Human
aaggaagaagaagaagaag

SEQ ID NO: 375888 - RNA, 23 nt, Human
aauguccaaagggaauucugguu

SEQ ID NO: 375889 - RNA, 26 nt, Human
acaaaacaaaauaaaaaaacaaaaaa

SEQ ID NO: 375890 - RNA, 27 nt, Human
acaaaauaaaaaaacaaaaaaacacaa

SEQ ID NO: 375891 - RNA, 18 nt, Human
acaaacaaaacacgaaca

SEQ ID NO: 375892 - RNA, 27 nt, Human
acaaagaaaaaagggauggacaaaaag

SEQ ID NO: 375893 - RNA, 21 nt, Human
acaacagaugaccauacccuu

SEQ ID NO: 375894 - RNA, 25 nt, Human
acaagcaaaggcaggaggaaaugca

SEQ ID NO: 375895 - RNA, 25 nt, Human
acacacacacacccacacacacaca

SEQ ID NO: 375896 - RNA, 23 nt, Human
acacacacccacacacacacaca

SEQ ID NO: 375897 - RNA, 19 nt, Human
acacacccacacacacaca

SEQ ID NO: 375898 - RNA, 31 nt, Human
acaggauuuuuuuuuucuuuuuguaagagaa

SEQ ID NO: 375899 - RNA, 27 nt, Human
acccccaaaacugaucacauaacacaa

SEQ ID NO: 375900 - RNA, 22 nt, Human
accucuuucuuaagacugcagu

SEQ ID NO: 375901 - RNA, 25 nt, Human
agaaaaaacaaaacaaaauaaaaaa

SEQ ID NO: 375902 - RNA, 25 nt, Human
agaaagcaaaucuguacaaaaauac

SEQ ID NO: 375903 - RNA, 23 nt, Human
agaagaagaaaaaacaaaacaaa

SEQ ID NO: 375904 - RNA, 24 nt, Human
agaagaagaaaaaacaaaacaaaa

SEQ ID NO: 375905 - RNA, 26 nt, Human
agaagaagaagaaaaaacaaaacaaa

SEQ ID NO: 375906 - RNA, 22 nt, Human
agcaaaguuaacccccaaaacu

SEQ ID NO: 375907 - RNA, 18 nt, Human
aggaagaagaagaagaag

SEQ ID NO: 375908 - RNA, 27 nt, Human
auuggaaaaaaaaaaaaaaaaaagaau

SEQ ID NO: 375909 - RNA, 21 nt, Human
caaaaaaacacaaauguccaa

SEQ ID NO: 375910 - RNA, 24 nt, Human
caaaaaaacacaaauguccaaagg

SEQ ID NO: 375911 - RNA, 24 nt, Human
caaacaaaacacgaacacaaacca

SEQ ID NO: 375912 - RNA, 23 nt, Human
caaacaggcagagagauuuagca

SEQ ID NO: 375913 - RNA, 25 nt, Human
caaacaggcagagagauuuagcacu

SEQ ID NO: 375914 - RNA, 21 nt, Human
caaaguuaacccccaaaacug

SEQ ID NO: 375915 - RNA, 18 nt, Human
caaaugacucagugauac

SEQ ID NO: 375916 - RNA, 18 nt, Human
caacaaaaacaacaaaga

SEQ ID NO: 375917 - RNA, 28 nt, Human
caacaaaaacaacaaagaaaaaagggau

SEQ ID NO: 375918 - RNA, 22 nt, Human
caacaaccuauuuuaaagaagg

SEQ ID NO: 375919 - RNA, 25 nt, Human
caacaggauuuuuuuuuucuuuuug

SEQ ID NO: 375920 - RNA, 20 nt, Human
caagguguuuuucucuucuu

SEQ ID NO: 375921 - RNA, 21 nt, Human
caaguuuccaguuuguuuuca

SEQ ID NO: 375922 - RNA, 21 nt, Human
cacacacacacacaauauaag

SEQ ID NO: 375923 - RNA, 22 nt, Human
cacacacacacccacacacaca

SEQ ID NO: 375924 - RNA, 24 nt, Human
cacacacacacccacacacacaca

SEQ ID NO: 375925 - RNA, 26 nt, Human
cacacacacccacacacacacacaau

SEQ ID NO: 375926 - RNA, 25 nt, Human
cacacacccacacacacacacaaua

SEQ ID NO: 375927 - RNA, 27 nt, Human
cacacacccacacacacacacaauaua

SEQ ID NO: 375928 - RNA, 25 nt, Human
cacacugaucacacgauucuccauc

SEQ ID NO: 375929 - RNA, 29 nt, Human
caccccuucucuucuccuccugcaaagaa

SEQ ID NO: 375930 - RNA, 26 nt, Human
cagaaaacacugcaaaugacucagug

SEQ ID NO: 375931 - RNA, 19 nt, Human
cagaacagauuucaucucc

SEQ ID NO: 375932 - RNA, 21 nt, Human
cagagcgagcaggcaucugcc

SEQ ID NO: 375933 - RNA, 19 nt, Human
cagcugcccgcuccaagug

SEQ ID NO: 375934 - RNA, 20 nt, Human
caguaauuaagauuaagguc

SEQ ID NO: 375935 - RNA, 23 nt, Human
ccacaaguggguaaugcgcuugg

SEQ ID NO: 375936 - RNA, 24 nt, Human
ccacacacacacacaauauaaggc

SEQ ID NO: 375937 - RNA, 22 nt, Human
ccacagcaguaauuaagauuaa

SEQ ID NO: 375938 - RNA, 19 nt, Human
ccagucaguuucgagcucc

SEQ ID NO: 375939 - RNA, 30 nt, Human
cccacacacacacacaauauaaggcagccc

SEQ ID NO: 375940 - RNA, 21 nt, Human
cccauaauugcaaaauaaggc

SEQ ID NO: 375941 - RNA, 22 nt, Human
ccccuccagguagccucccuca

SEQ ID NO: 375942 - RNA, 23 nt, Human
ccuccagguagccucccucacuc

SEQ ID NO: 375943 - RNA, 27 nt, Human
ccuccugcaaagaaaaguuuccggggu

SEQ ID NO: 375944 - RNA, 24 nt, Human
cgaacacaaaccaaagcuuuuacc

SEQ ID NO: 375945 - RNA, 26 nt, Human
cgaauuggagaggaggaggaggggag

SEQ ID NO: 375946 - RNA, 22 nt, Human
cgccacugaaguuuccagucag

SEQ ID NO: 375947 - RNA, 21 nt, Human
cgcgggcccggggcagggggc

SEQ ID NO: 375948 - RNA, 19 nt, Human
cgcgggcuccucuccccuc

SEQ ID NO: 375949 - RNA, 19 nt, Human
cgcgucggccggcuaccgc

SEQ ID NO: 375950 - RNA, 19 nt, Human
cggcugcccggaugcggag

SEQ ID NO: 375951 - RNA, 23 nt, Human
cgggaaaggcgagaagccgcggc

SEQ ID NO: 375952 - RNA, 24 nt, Human
cgggaaaggcgagaagccgcggcg

SEQ ID NO: 375953 - RNA, 22 nt, Human
cgggcccggggcagggggcugg

SEQ ID NO: 375954 - RNA, 23 nt, Human
cuccuuaaaucgcaaagccugag

SEQ ID NO: 375955 - RNA, 22 nt, Human
gaaaaagagcaaaagugggggc

SEQ ID NO: 375956 - RNA, 18 nt, Human
gaacauaauuuaacaaca

SEQ ID NO: 375957 - RNA, 19 nt, Human
gaagaagaagaagaagaaa

SEQ ID NO: 375958 - RNA, 22 nt, Human
gaagaagaagaagaagaaaaaa

SEQ ID NO: 375959 - RNA, 18 nt, Human
gaaggcgcgggguggcca

SEQ ID NO: 375960 - RNA, 18 nt, Human
gagaagauguagagaaau

SEQ ID NO: 375961 - RNA, 18 nt, Human
gagaagccgcggcggcuc

SEQ ID NO: 375962 - RNA, 20 nt, Human
gagaggcacaggugacagag

SEQ ID NO: 375963 - RNA, 20 nt, Human
gagcaggcaucugccuucca

SEQ ID NO: 375964 - RNA, 19 nt, Human
gaggcgaauuggagaggag

SEQ ID NO: 375965 - RNA, 23 nt, Human
gcaaaguuaacccccaaaacuga

SEQ ID NO: 375966 - RNA, 21 nt, Human
gcaaguggaaugucuugaagg

SEQ ID NO: 375967 - RNA, 27 nt, Human
gcaccccuucucuucuccuccugcaaa

SEQ ID NO: 375968 - RNA, 20 nt, Human
gccgggaaaggcgagaagcc

SEQ ID NO: 375969 - RNA, 21 nt, Human
gcgggcuccucuccccucggc

SEQ ID NO: 375970 - RNA, 19 nt, Human
ggaagcuggcgcgucggcc

SEQ ID NO: 375971 - RNA, 21 nt, Human
ggaggaaaaagagcaaaagug

SEQ ID NO: 375972 - RNA, 22 nt, Human
ggaggaggggaggaaaaagagc

SEQ ID NO: 375973 - RNA, 24 nt, Human
ggaggcgaauuggagaggaggagg

SEQ ID NO: 375974 - RNA, 18 nt, Human
ggcagaaaacacugcaaa

SEQ ID NO: 375975 - RNA, 20 nt, Human
ggcccggggcagggggcugg

SEQ ID NO: 375976 - RNA, 20 nt, Human
ggcugggagggaaacaagug

SEQ ID NO: 375977 - RNA, 20 nt, Human
ggcugguggccgggaaaggc

SEQ ID NO: 375978 - RNA, 21 nt, Human
gggaggaaaaagagcaaaagu

SEQ ID NO: 375979 - RNA, 21 nt, Human
gggcugguggccgggaaaggc

SEQ ID NO: 375980 - RNA, 22 nt, Human
ggggcugggagggaaacaagug

SEQ ID NO: 375981 - RNA, 24 nt, Human
gggggaggcgaauuggagaggagg

SEQ ID NO: 375982 - RNA, 19 nt, Human
gggggcugguggccgggaa

SEQ ID NO: 375983 - RNA, 18 nt, Human
gugggcugauccccucca

SEQ ID NO: 375984 - RNA, 25 nt, Human
guuaacccccaaaacugaucacaua

SEQ ID NO: 375985 - RNA, 27 nt, Human
uaaaaaaacaaaaaaacacaaaugucc

SEQ ID NO: 375986 - RNA, 18 nt, Human
uaaaaagcaauccucaaa

SEQ ID NO: 375987 - RNA, 21 nt, Human
uaaaaagcaauccucaaacuc

SEQ ID NO: 375988 - RNA, 22 nt, Human
uaaagcuuaccaaaugcuucuc

SEQ ID NO: 375989 - RNA, 26 nt, Human
uaaagcuuaccaaaugcuucucuaga

SEQ ID NO: 375990 - RNA, 19 nt, Human
uaaaucgcaaagccugagg

SEQ ID NO: 375991 - RNA, 18 nt, Human
uaagcaaaguuaaccccc

SEQ ID NO: 375992 - RNA, 21 nt, Human
uaagcaaaguuaacccccaaa

SEQ ID NO: 375993 - RNA, 26 nt, Human
uacaaaaaaagaaacaaguuuccagu

SEQ ID NO: 375994 - RNA, 24 nt, Human
uacaaaguccaaacaggcagagag

SEQ ID NO: 375995 - RNA, 23 nt, Human
uacccuuugaggaaagcuccaac

SEQ ID NO: 375996 - RNA, 23 nt, Human
uaguuuagcuguuggaaaaauaa

SEQ ID NO: 375997 - RNA, 24 nt, Human
uauacaaaaaaagaaacaaguuuc

SEQ ID NO: 375998 - RNA, 18 nt, Human
uaucauaaagcuuaccaa

SEQ ID NO: 375999 - RNA, 18 nt, Human
ucaaaacacacacacacc

SEQ ID NO: 376000 - RNA, 21 nt, Human
ucaaaacacacacacacccac

SEQ ID NO: 376001 - RNA, 22 nt, Human
ucacagcugcccgcuccaagug

SEQ ID NO: 376002 - RNA, 24 nt, Human
uccaagagaagauguagagaaaua

SEQ ID NO: 376003 - RNA, 19 nt, Human
ucgaggcgcgggcuccucu

SEQ ID NO: 376004 - RNA, 24 nt, Human
ucgcaaagccugaggaauuaagca

SEQ ID NO: 376005 - RNA, 23 nt, Human
ucuagccacagcaguaauuaaga

SEQ ID NO: 376006 - RNA, 21 nt, Human
ucuguacaaaaauacucuggu

SEQ ID NO: 376007 - RNA, 22 nt, Human
ucuuaaguuacagaaguaucuu

SEQ ID NO: 376008 - RNA, 23 nt, Human
ucuuaaguuacagaaguaucuuu

SEQ ID NO: 376009 - RNA, 24 nt, Human
ugaaacaaacaaaacacgaacaca

SEQ ID NO: 376010 - RNA, 19 nt, Human
ugaagguuaacugcuggug

SEQ ID NO: 376011 - RNA, 20 nt, Human
ugaagguuaacugcuggugu

SEQ ID NO: 376012 - RNA, 19 nt, Human
ugacagagcgagcaggcau

SEQ ID NO: 376013 - RNA, 21 nt, Human
ugagaggcacaggugacagag

SEQ ID NO: 376014 - RNA, 24 nt, Human
ugauacacuacauuugcaaucucu

SEQ ID NO: 376015 - RNA, 21 nt, Human
ugcaaagaaaaguuuccgggg

SEQ ID NO: 376016 - RNA, 21 nt, Human
ugcuccauuuagccaagguug

SEQ ID NO: 376017 - RNA, 19 nt, Human
uggaaaaaaaaaaaaaaaa

SEQ ID NO: 376018 - RNA, 24 nt, Human
uggagaggaggaggaggggaggaa

SEQ ID NO: 376019 - RNA, 18 nt, Human
uggccaguucacagcugc

SEQ ID NO: 376020 - RNA, 27 nt, Human
uggcgagucuccgcgccacugaaguuu

SEQ ID NO: 376021 - RNA, 20 nt, Human
uggggcugggagggaaacaa

SEQ ID NO: 376022 - RNA, 23 nt, Human
uggggcugggagggaaacaagug

SEQ ID NO: 376023 - RNA, 21 nt, Human
ugguugcaagaaaagcuaggg

SEQ ID NO: 376024 - RNA, 21 nt, Human
ugucaaaacacacacacaccc

SEQ ID NO: 376025 - RNA, 23 nt, Human
ugugucaaaacacacacacagug

SEQ ID NO: 376026 - RNA, 31 nt, Human
uuaaaugucuuuaaggaagaagaagaagaaa

SEQ ID NO: 376027 - RNA, 19 nt, Human
uuaaauguuaauacaacag

SEQ ID NO: 376028 - RNA, 21 nt, Human
uuaacccccaaaacugaucac

SEQ ID NO: 376029 - RNA, 24 nt, Human
uuaacccccaaaacugaucacaua

SEQ ID NO: 376030 - RNA, 19 nt, Human
uuaaggaagaagaagaaga

SEQ ID NO: 376031 - RNA, 21 nt, Human
uuaaggaagaagaagaagaaa

SEQ ID NO: 376032 - RNA, 23 nt, Human
uuauacaaaaaaagaaacaaguu

SEQ ID NO: 376033 - RNA, 22 nt, Human
uucaacaaaaacaacaaagaaa

SEQ ID NO: 376034 - RNA, 20 nt, Human
uucgcugcuccauuuagcca

SEQ ID NO: 376035 - RNA, 23 nt, Human
uucgcugcuccauuuagccaagg

SEQ ID NO: 376036 - RNA, 20 nt, Human
uucuccaucauccuccacgc

SEQ ID NO: 376037 - RNA, 22 nt, Human
uucuccaucauccuccacgcuu

SEQ ID NO: 376038 - RNA, 20 nt, Human
uuguaaacaauaauauacaa

SEQ ID NO: 376039 - RNA, 18 nt, Human
uuuauacagaaauugaag

SEQ ID NO: 376040 - RNA, 18 nt, Human
auuucauccauggaguga

SEQ ID NO: 376041 - RNA, 21 nt, Human
cacuugggccccaguggcagc

SEQ ID NO: 376042 - RNA, 21 nt, Human
caguggcagcaaacugcagcu

SEQ ID NO: 376043 - RNA, 24 nt, Human
ccaacuccuuuuucaauuuucacc

SEQ ID NO: 376044 - RNA, 18 nt, Human
ccagaaccauccugcugc

SEQ ID NO: 376045 - RNA, 24 nt, Human
cugcugcacuugggccccaguggc

SEQ ID NO: 376046 - RNA, 19 nt, Human
ggccccaguggcagcaaac

SEQ ID NO: 376047 - RNA, 23 nt, Human
uaggcaucacuccagguaguccu

SEQ ID NO: 376048 - RNA, 22 nt, Human
ucaauuuucaccacagcuguca

SEQ ID NO: 376049 - RNA, 23 nt, Human
uccugcugcacuugggccccagu

SEQ ID NO: 376050 - RNA, 24 nt, Human
ugccaccaacuccuuuuucaauuu

SEQ ID NO: 376051 - RNA, 19 nt, Human
uggcagcaaacugcagcug

SEQ ID NO: 376052 - RNA, 24 nt, Human
ugucauuucauccauggagugauc

SEQ ID NO: 376053 - RNA, 22 nt, Human
aacauucuuaugacaaugguua

SEQ ID NO: 376054 - RNA, 27 nt, Human
aagaaccugcuuuaaauuuccaugcca

SEQ ID NO: 376055 - RNA, 18 nt, Human
aagcuacaucagagacaa

SEQ ID NO: 376056 - RNA, 22 nt, Human
acaagaaaaaaacugcacuaga

SEQ ID NO: 376057 - RNA, 19 nt, Human
acaguguacgguuuaaaaa

SEQ ID NO: 376058 - RNA, 20 nt, Human
acuguuuuuuuuuuuugcaa

SEQ ID NO: 376059 - RNA, 22 nt, Human
agacaagaaaaaaacugcacua

SEQ ID NO: 376060 - RNA, 23 nt, Human
agacaagaaaaaaacugcacuag

SEQ ID NO: 376061 - RNA, 21 nt, Human
aggacagggcuaucugaagac

SEQ ID NO: 376062 - RNA, 26 nt, Human
aucagagacaacugaaggugaaaaaa

SEQ ID NO: 376063 - RNA, 20 nt, Human
caaaaccaaaacaguuacuu

SEQ ID NO: 376064 - RNA, 21 nt, Human
caaaaccaaaacaguuacuuu

SEQ ID NO: 376065 - RNA, 19 nt, Human
caacaaaacagcugcaacu

SEQ ID NO: 376066 - RNA, 23 nt, Human
caagaaaaaaacugcacuagaag

SEQ ID NO: 376067 - RNA, 20 nt, Human
cacccuaggcccugcguggg

SEQ ID NO: 376068 - RNA, 22 nt, Human
ccaggacagggcuaucugaaga

SEQ ID NO: 376069 - RNA, 22 nt, Human
cccuaggcccugcgugggccuc

SEQ ID NO: 376070 - RNA, 21 nt, Human
ccuugucuacacaguucccuc

SEQ ID NO: 376071 - RNA, 21 nt, Human
gaaaaaaacugcacuagaagc

SEQ ID NO: 376072 - RNA, 26 nt, Human
gaaccugcuuuaaauuuccaugccaa

SEQ ID NO: 376073 - RNA, 18 nt, Human
gcacuaacaagaaccugc

SEQ ID NO: 376074 - RNA, 24 nt, Human
gcauaaguucaauaauaaucuguu

SEQ ID NO: 376075 - RNA, 23 nt, Human
gcauucagaaugucaacaaaaca

SEQ ID NO: 376076 - RNA, 18 nt, Human
gccaauuuacaaccccca

SEQ ID NO: 376077 - RNA, 22 nt, Human
gcugugcacuaacaagaaccug

SEQ ID NO: 376078 - RNA, 18 nt, Human
uaaaaggagugaguugug

SEQ ID NO: 376079 - RNA, 18 nt, Human
uaaauaccaccaggacag

SEQ ID NO: 376080 - RNA, 20 nt, Human
uaacaagaaccugcuuuaaa

SEQ ID NO: 376081 - RNA, 20 nt, Human
uaacagaacaacaaauguuu

SEQ ID NO: 376082 - RNA, 21 nt, Human
uaacaggacagauuggaaaca

SEQ ID NO: 376083 - RNA, 20 nt, Human
uaauagaacauggaagaaga

SEQ ID NO: 376084 - RNA, 24 nt, Human
uaauagaacauggaagaagacuga

SEQ ID NO: 376085 - RNA, 23 nt, Human
uacaaaaaaacacaguguacggu

SEQ ID NO: 376086 - RNA, 24 nt, Human
uaccuugucuacacaguucccuca

SEQ ID NO: 376087 - RNA, 22 nt, Human
uagaacauggaagaagacugac

SEQ ID NO: 376088 - RNA, 18 nt, Human
ugaaggugaaaaaacuac

SEQ ID NO: 376089 - RNA, 19 nt, Human
ugacaagauuguuuugagg

SEQ ID NO: 376090 - RNA, 21 nt, Human
ugaccugguaccuugucuaca

SEQ ID NO: 376091 - RNA, 20 nt, Human
uggaagaagacugaccuggu

SEQ ID NO: 376092 - RNA, 21 nt, Human
uggaagaagacugaccuggua

SEQ ID NO: 376093 - RNA, 21 nt, Human
uggaagaagacugaccuggua

SEQ ID NO: 376094 - RNA, 21 nt, Human
ugguuauuugcauaaguucaa

SEQ ID NO: 376095 - RNA, 21 nt, Human
uucauaaacauucuuaugaca

SEQ ID NO: 376096 - RNA, 22 nt, Human
uucauaaacauucuuaugacaa

SEQ ID NO: 376097 - RNA, 22 nt, Human
uucccacccuaggcccugcgug

SEQ ID NO: 376098 - RNA, 22 nt, Human
uuuuguuuucaaaagucaagaa

SEQ ID NO: 376099 - RNA, 20 nt, Human
uuuuuuuuuuuuuugaugga

SEQ ID NO: 376100 - RNA, 18 nt, Human
uuuuuuuuuuuuuuuuug

SEQ ID NO: 376101 - RNA, 22 nt, Human
uuuuuuuuuuuuuuuuugaugg

SEQ ID NO: 376102 - RNA, 23 nt, Human
acuuuuaaagguaaaaagaaaga

SEQ ID NO: 376103 - RNA, 18 nt, Human
agggucccaucagcugaa

SEQ ID NO: 376104 - RNA, 19 nt, Human
auggugacugagaggguag

SEQ ID NO: 376105 - RNA, 21 nt, Human
caucccagacucacuggcaau

SEQ ID NO: 376106 - RNA, 22 nt, Human
caucccagacucacuggcaauc

SEQ ID NO: 376107 - RNA, 24 nt, Human
cccuuuccaggggcugggacaggg

SEQ ID NO: 376108 - RNA, 19 nt, Human
ccugccccuuuccaggggc

SEQ ID NO: 376109 - RNA, 22 nt, Human
cguuccugccccuuuccagggg

SEQ ID NO: 376110 - RNA, 21 nt, Human
cuccagacagggaaagucugc

SEQ ID NO: 376111 - RNA, 19 nt, Human
cuuggaaacucagaagcuc

SEQ ID NO: 376112 - RNA, 25 nt, Human
gagccuccagacagggaaagucucc

SEQ ID NO: 376113 - RNA, 21 nt, Human
gccagggucccaucagcugaa

SEQ ID NO: 376114 - RNA, 19 nt, Human
gccaugcccaaauguggag

SEQ ID NO: 376115 - RNA, 20 nt, Human
gggaaagucugcaacauggu

SEQ ID NO: 376116 - RNA, 21 nt, Human
gggaaagucugcaacauggug

SEQ ID NO: 376117 - RNA, 23 nt, Human
ggguuuggguccugagggcagcc

SEQ ID NO: 376118 - RNA, 18 nt, Human
gugucuggguuugggucc

SEQ ID NO: 376119 - RNA, 19 nt, Human
gugucuggguuuggguccu

SEQ ID NO: 376120 - RNA, 24 nt, Human
ucauuugcuuccccaucccaaauu

SEQ ID NO: 376121 - RNA, 24 nt, Human
ucccagacucacuggcaaucaaca

SEQ ID NO: 376122 - RNA, 22 nt, Human
ucuggguuuggguccugagggc

SEQ ID NO: 376123 - RNA, 19 nt, Human
ugaagugucuggguuuggg

SEQ ID NO: 376124 - RNA, 24 nt, Human
ugagccuccagacagggaaagucu

SEQ ID NO: 376125 - RNA, 23 nt, Human
ugcccaaauguggaggugacuca

SEQ ID NO: 376126 - RNA, 21 nt, Human
uggagggugugauaauccuau

SEQ ID NO: 376127 - RNA, 24 nt, Human
ugucuggguuuggguccugagggc

SEQ ID NO: 376128 - RNA, 25 nt, Human
uuaauuuuuauuuuagagucauuug

SEQ ID NO: 376129 - RNA, 24 nt, Human
uuccugccccuuuccaggggcugg

SEQ ID NO: 376130 - RNA, 21 nt, Human
uuuaaagguaaaaagaaagaa

SEQ ID NO: 376131 - RNA, 26 nt, Human
uuuagagucauuugcuuccccauccc

SEQ ID NO: 376132 - RNA, 24 nt, Human
uuuuuuuuuuuuuuuugagcuuuu

SEQ ID NO: 376133 - RNA, 18 nt, Human
uuuuuuuuuuuuuuuuug

SEQ ID NO: 376134 - RNA, 24 nt, Human
aaaaaagacuuaaaaaaauaucau

SEQ ID NO: 376135 - RNA, 27 nt, Human
aaaaagaaaauacagcauaauaaaaaa

SEQ ID NO: 376136 - RNA, 19 nt, Human
aaaaauaaccacaaugaau

SEQ ID NO: 376137 - RNA, 26 nt, Human
aaacauacgcuucucaauuaaaugua

SEQ ID NO: 376138 - RNA, 21 nt, Human
aacauucucuuaccacccaaa

SEQ ID NO: 376139 - RNA, 22 nt, Human
aacuguauagcucuuacaagac

SEQ ID NO: 376140 - RNA, 22 nt, Human
aagaaaaaaaaauaguguuuua

SEQ ID NO: 376141 - RNA, 27 nt, Human
aagaaaagggauaauucacuauaacau

SEQ ID NO: 376142 - RNA, 22 nt, Human
aagaggcacauuagcaacuacu

SEQ ID NO: 376143 - RNA, 26 nt, Human
aagcaaaaaaggaaaaugagggaccc

SEQ ID NO: 376144 - RNA, 23 nt, Human
aagcaaaaaaggaaaaugauuga

SEQ ID NO: 376145 - RNA, 21 nt, Human
aaguaaagccuacacuaugua

SEQ ID NO: 376146 - RNA, 25 nt, Human
aauauaaacaauaauuaaaaaauaa

SEQ ID NO: 376147 - RNA, 22 nt, Human
acaaaacccaugcaauuuuacc

SEQ ID NO: 376148 - RNA, 25 nt, Human
acacucacacgcgcacaaaaaggcg

SEQ ID NO: 376149 - RNA, 21 nt, Human
acauugguuauauugcccaac

SEQ ID NO: 376150 - RNA, 24 nt, Human
acccaaaugccucaacuuauacau

SEQ ID NO: 376151 - RNA, 23 nt, Human
accuuauuuuuuugguccuccaa

SEQ ID NO: 376152 - RNA, 22 nt, Human
acgcuggggcccacacucacac

SEQ ID NO: 376153 - RNA, 18 nt, Human
agacaaaaaaaaaaaaga

SEQ ID NO: 376154 - RNA, 22 nt, Human
agacugacuaccuagacaaaaa

SEQ ID NO: 376155 - RNA, 21 nt, Human
agagagggagacagggggagg

SEQ ID NO: 376156 - RNA, 21 nt, Human
agagagggagacagggggagg

SEQ ID NO: 376157 - RNA, 22 nt, Human
agauaaauaccaacauguucuc

SEQ ID NO: 376158 - RNA, 18 nt, Human
agcagaagguguuccaga

SEQ ID NO: 376159 - RNA, 21 nt, Human
agcggccagcagagcgagcgg

SEQ ID NO: 376160 - RNA, 19 nt, Human
agggaagaagcaaaaaagg

SEQ ID NO: 376161 - RNA, 18 nt, Human
agggggaggggguggcgg

SEQ ID NO: 376162 - RNA, 20 nt, Human
agggggaggggguggcgguu

SEQ ID NO: 376163 - RNA, 21 nt, Human
aguaccuacaaaacccaugca

SEQ ID NO: 376164 - RNA, 18 nt, Human
auaaaaauaaccacaaug

SEQ ID NO: 376165 - RNA, 24 nt, Human
auaaacaauaauuaaaaaauaaaa

SEQ ID NO: 376166 - RNA, 22 nt, Human
auauacuauggaauaucauaca

SEQ ID NO: 376167 - RNA, 20 nt, Human
caaaagaaaaaaaaauagug

SEQ ID NO: 376168 - RNA, 18 nt, Human
caccccggcuccccgguc

SEQ ID NO: 376169 - RNA, 21 nt, Human
caccccggcuccccgguccgc

SEQ ID NO: 376170 - RNA, 23 nt, Human
caccccggcuccccgguccgcgg

SEQ ID NO: 376171 - RNA, 19 nt, Human
cagacugacuaccuagaca

SEQ ID NO: 376172 - RNA, 22 nt, Human
ccaaguuacugucaauccaaaa

SEQ ID NO: 376173 - RNA, 19 nt, Human
ccagcccgcgcucuccucc

SEQ ID NO: 376174 - RNA, 21 nt, Human
cccaaagaaucuagaucgaca

SEQ ID NO: 376175 - RNA, 22 nt, Human
cccacacucacacgcgcacaaa

SEQ ID NO: 376176 - RNA, 23 nt, Human
cccccauuaucugaagagccugu

SEQ ID NO: 376177 - RNA, 18 nt, Human
ccccgccgacugcgcccg

SEQ ID NO: 376178 - RNA, 26 nt, Human
ccccgcuccaagcaccccggcucccc

SEQ ID NO: 376179 - RNA, 19 nt, Human
cccgggcaagcgccagccc

SEQ ID NO: 376180 - RNA, 22 nt, Human
ccgccuuccgcccggaacccac

SEQ ID NO: 376181 - RNA, 21 nt, Human
ccuccuccuccuccugguccc

SEQ ID NO: 376182 - RNA, 21 nt, Human
cgccuuccgcccggaacccac

SEQ ID NO: 376183 - RNA, 18 nt, Human
cggcggcgggggccccgg

SEQ ID NO: 376184 - RNA, 22 nt, Human
cgggcaagcgccagcccgcgcu

SEQ ID NO: 376185 - RNA, 23 nt, Human
cuauaacauucucuuaccaccca

SEQ ID NO: 376186 - RNA, 23 nt, Human
cuccuccuccuccuccugguccc

SEQ ID NO: 376187 - RNA, 23 nt, Human
cugcgcgccgggccuccgccuuc

SEQ ID NO: 376188 - RNA, 20 nt, Human
cugcggcggccgccuccucc

SEQ ID NO: 376189 - RNA, 19 nt, Human
cugcugacuggaucugugg

SEQ ID NO: 376190 - RNA, 24 nt, Human
cuggggcccacacucacacgcgca

SEQ ID NO: 376191 - RNA, 19 nt, Human
cuuaggaacaauauucuuc

SEQ ID NO: 376192 - RNA, 19 nt, Human
cuucaaaaugacaaauuga

SEQ ID NO: 376193 - RNA, 23 nt, Human
gaaccaccaauugcaacucccug

SEQ ID NO: 376194 - RNA, 22 nt, Human
gaacccacccccgggagggcac

SEQ ID NO: 376195 - RNA, 18 nt, Human
gaauaucauacaaaguaa

SEQ ID NO: 376196 - RNA, 24 nt, Human
gacuggaucugugguaucacuuga

SEQ ID NO: 376197 - RNA, 23 nt, Human
gagagggagacagggggaggggg

SEQ ID NO: 376198 - RNA, 18 nt, Human
gcacaggaaguacgacuc

SEQ ID NO: 376199 - RNA, 26 nt, Human
gccagcccacgccuggcgucccccgc

SEQ ID NO: 376200 - RNA, 21 nt, Human
gcccacacucacacgcgcaca

SEQ ID NO: 376201 - RNA, 19 nt, Human
ggucccgccgccagcccac

SEQ ID NO: 376202 - RNA, 21 nt, Human
guaugagauucuggauguuag

SEQ ID NO: 376203 - RNA, 23 nt, Human
uaaaaaacauacgcuucucaaag

SEQ ID NO: 376204 - RNA, 23 nt, Human
uaaaaaauaaaaagaaaauacag

SEQ ID NO: 376205 - RNA, 27 nt, Human
uaaaaagaaaauacagcauaauaaaaa

SEQ ID NO: 376206 - RNA, 24 nt, Human
uacaugauggcuuuuaaggcccug

SEQ ID NO: 376207 - RNA, 20 nt, Human
uaccaacauguucucauuuu

SEQ ID NO: 376208 - RNA, 24 nt, Human
uaccuagacaaaaaaaaaaaagac

SEQ ID NO: 376209 - RNA, 22 nt, Human
uacuauggaauaucauacaaag

SEQ ID NO: 376210 - RNA, 22 nt, Human
uagcagaagguguuccagaggc

SEQ ID NO: 376211 - RNA, 24 nt, Human
uauaacauucucuuaccacccaaa

SEQ ID NO: 376212 - RNA, 20 nt, Human
uaucugaagagccugugaaa

SEQ ID NO: 376213 - RNA, 26 nt, Human
uaucugaagagccugugaaaccaauu

SEQ ID NO: 376214 - RNA, 21 nt, Human
ucacacgcgcacaaaaaggcg

SEQ ID NO: 376215 - RNA, 25 nt, Human
ucacuauaacauucucuuaccaccc

SEQ ID NO: 376216 - RNA, 22 nt, Human
ucauuucuucuagauuccaaaa

SEQ ID NO: 376217 - RNA, 20 nt, Human
uccaaaaguaccuacaaaac

SEQ ID NO: 376218 - RNA, 23 nt, Human
uccaaaaguaccuacaaaaccca

SEQ ID NO: 376219 - RNA, 18 nt, Human
uccagaggcaaguaaggu

SEQ ID NO: 376220 - RNA, 20 nt, Human
ucccccgcuccaagcacccc

SEQ ID NO: 376221 - RNA, 18 nt, Human
uccccgccgacugcgccc

SEQ ID NO: 376222 - RNA, 22 nt, Human
ucccgccgccagcccacgccug

SEQ ID NO: 376223 - RNA, 21 nt, Human
ucccugaaccuggacuugacc

SEQ ID NO: 376224 - RNA, 20 nt, Human
uccuccaauagucaagaaaa

SEQ ID NO: 376225 - RNA, 21 nt, Human
ucuuaagaauaacaaaugaac

SEQ ID NO: 376226 - RNA, 18 nt, Human
ugaagagccugugaaacc

SEQ ID NO: 376227 - RNA, 22 nt, Human
ugaauaaguauuuguguaauau

SEQ ID NO: 376228 - RNA, 22 nt, Human
ugaccaggaaaagaugaaccac

SEQ ID NO: 376229 - RNA, 22 nt, Human
ugggagacaugguuuuuggaaa

SEQ ID NO: 376230 - RNA, 26 nt, Human
ugguccuccaauagucaagacccguc

SEQ ID NO: 376231 - RNA, 23 nt, Human
uggugcaacggaaaauauuuguu

SEQ ID NO: 376232 - RNA, 21 nt, Human
uggugcuccuccuaacugugc

SEQ ID NO: 376233 - RNA, 21 nt, Human
uguauagcucuuacaagacca

SEQ ID NO: 376234 - RNA, 24 nt, Human
uguauagcucuuacaagaccagca

SEQ ID NO: 376235 - RNA, 19 nt, Human
ugugcagaagccaaaucac

SEQ ID NO: 376236 - RNA, 20 nt, Human
ugugcagaagccaaaucacc

SEQ ID NO: 376237 - RNA, 19 nt, Human
uguuacacuuuacugguaa

SEQ ID NO: 376238 - RNA, 22 nt, Human
uucacuauaacauucucuuacc

SEQ ID NO: 376239 - RNA, 19 nt, Human
uucaucuuuuauaguugua

SEQ ID NO: 376240 - RNA, 20 nt, Human
uucuugauuuauacccccau

SEQ ID NO: 376241 - RNA, 21 nt, Human
uugaacacuggacacuguacc

SEQ ID NO: 376242 - RNA, 21 nt, Human
uugaugcauuugguuagacua

SEQ ID NO: 376243 - RNA, 24 nt, Human
uuucgcacaggaaguacgacucgg

SEQ ID NO: 376244 - RNA, 25 nt, Human
uuugaccaggaaaagaugaaccacc

SEQ ID NO: 376245 - RNA, 26 nt, Human
aacuaucuguuuucugugcuauagag

SEQ ID NO: 376246 - RNA, 21 nt, Human
aagaagccaagaaugaaaaca

SEQ ID NO: 376247 - RNA, 22 nt, Human
acccuggaauacuuaaagaagc

SEQ ID NO: 376248 - RNA, 18 nt, Human
agaagccaagaaugaaaa

SEQ ID NO: 376249 - RNA, 22 nt, Human
agaagccaagaaugaaaacaua

SEQ ID NO: 376250 - RNA, 19 nt, Human
agccaagaaugaaaacaua

SEQ ID NO: 376251 - RNA, 21 nt, Human
cacaggcucugccucuuuuuc

SEQ ID NO: 376252 - RNA, 24 nt, Human
ccagccugcaaacuacuaagggga

SEQ ID NO: 376253 - RNA, 19 nt, Human
ccuggaauacuuaaagaag

SEQ ID NO: 376254 - RNA, 21 nt, Human
cgaggcgggaggagaggccgg

SEQ ID NO: 376255 - RNA, 23 nt, Human
cuggcacaggcucugccucuuuu

SEQ ID NO: 376256 - RNA, 24 nt, Human
cugggauagaggugggugggggug

SEQ ID NO: 376257 - RNA, 18 nt, Human
cugugcuauagagaaaaa

SEQ ID NO: 376258 - RNA, 18 nt, Human
gaauacuuaaagaagcca

SEQ ID NO: 376259 - RNA, 21 nt, Human
gaggugggugggggugggggc

SEQ ID NO: 376260 - RNA, 20 nt, Human
gauauuaagagaugggaaga

SEQ ID NO: 376261 - RNA, 23 nt, Human
gcuguagcuggcacaggcucugc

SEQ ID NO: 376262 - RNA, 24 nt, Human
ggaagauucuguauaaagguuaug

SEQ ID NO: 376263 - RNA, 18 nt, Human
ggggugggggcgaggcgg

SEQ ID NO: 376264 - RNA, 21 nt, Human
uaacaggacaaacccucagac

SEQ ID NO: 376265 - RNA, 23 nt, Human
uaagagaugggaagauucuguau

SEQ ID NO: 376266 - RNA, 19 nt, Human
uacaacuuauaguauggag

SEQ ID NO: 376267 - RNA, 21 nt, Human
uagcuggcacaggcucugccu

SEQ ID NO: 376268 - RNA, 24 nt, Human
uauaacaaaguacuuucaaagaaa

SEQ ID NO: 376269 - RNA, 23 nt, Human
uauauuuccaaacaacuacaacu

SEQ ID NO: 376270 - RNA, 19 nt, Human
uaucuguuuucugugcuau

SEQ ID NO: 376271 - RNA, 24 nt, Human
ucaguuaacuaucuguuuucugug

SEQ ID NO: 376272 - RNA, 23 nt, Human
ugcuuuuuguauuuuuuaaaauu

SEQ ID NO: 376273 - RNA, 22 nt, Human
uggaauacuuaaagaagccaag

SEQ ID NO: 376274 - RNA, 21 nt, Human
uggaggaaauacuuuucuguu

SEQ ID NO: 376275 - RNA, 19 nt, Human
uggcacaggcucugccucu

SEQ ID NO: 376276 - RNA, 18 nt, Human
ugggauagaggugggugg

SEQ ID NO: 376277 - RNA, 18 nt, Human
ugugcuauagagaaaaag

SEQ ID NO: 376278 - RNA, 22 nt, Human
uuaacuaucuguuuucugugcu

SEQ ID NO: 376279 - RNA, 22 nt, Human
uuuccagauuuucaaaggugug

SEQ ID NO: 376280 - RNA, 24 nt, Human
aaauauuuauugaacaccuacuau

SEQ ID NO: 376281 - RNA, 22 nt, Human
aagcacccagggugggugggca

SEQ ID NO: 376282 - RNA, 23 nt, Human
aauauuuauugaacaccuacuau

SEQ ID NO: 376283 - RNA, 23 nt, Human
aauauuuauugaacaccuacuau

SEQ ID NO: 376284 - RNA, 24 nt, Human
aauggcagaaaaaaagucugcaga

SEQ ID NO: 376285 - RNA, 25 nt, Human
accagaauggcagaaaaaaagucug

SEQ ID NO: 376286 - RNA, 22 nt, Human
acccugcggucacaacuccaga

SEQ ID NO: 376287 - RNA, 18 nt, Human
acccugggugaggcuccu

SEQ ID NO: 376288 - RNA, 21 nt, Human
agacaggaggcaggaagagga

SEQ ID NO: 376289 - RNA, 22 nt, Human
agacaggaggcaggaagaggaa

SEQ ID NO: 376290 - RNA, 23 nt, Human
agcugccuccuggccucugaagc

SEQ ID NO: 376291 - RNA, 19 nt, Human
agcugugcuccaggaugac

SEQ ID NO: 376292 - RNA, 19 nt, Human
aggcuccugcucuucggcu

SEQ ID NO: 376293 - RNA, 18 nt, Human
agugaggcugggugugug

SEQ ID NO: 376294 - RNA, 20 nt, Human
aucagcucuucaccuuuggu

SEQ ID NO: 376295 - RNA, 20 nt, Human
aucagcucuucaccuuuggu

SEQ ID NO: 376296 - RNA, 22 nt, Human
auggagugaggcugggugugug

SEQ ID NO: 376297 - RNA, 21 nt, Human
auggaucccugaggagccagu

SEQ ID NO: 376298 - RNA, 22 nt, Human
auggcagaaaaaaagucugcag

SEQ ID NO: 376299 - RNA, 21 nt, Human
caacuccagaagacaggaggc

SEQ ID NO: 376300 - RNA, 25 nt, Human
caccagaauggcagaaaaaaagucu

SEQ ID NO: 376301 - RNA, 18 nt, Human
cacccagggugggugggc

SEQ ID NO: 376302 - RNA, 19 nt, Human
cacccagggugggugggca

SEQ ID NO: 376303 - RNA, 20 nt, Human
cacccagggugggugggcag

SEQ ID NO: 376304 - RNA, 20 nt, Human
caccuuuggugcuaaauuca

SEQ ID NO: 376305 - RNA, 20 nt, Human
caccuuuggugcuaaauuca

SEQ ID NO: 376306 - RNA, 18 nt, Human
cacgcuuuuucucaccag

SEQ ID NO: 376307 - RNA, 21 nt, Human
cagacccugggugaggcuccu

SEQ ID NO: 376308 - RNA, 18 nt, Human
caggcuuagucagagcca

SEQ ID NO: 376309 - RNA, 21 nt, Human
caguccacggagcacagccga

SEQ ID NO: 376310 - RNA, 18 nt, Human
cauccaucucugguuucu

SEQ ID NO: 376311 - RNA, 20 nt, Human
ccaguccacggagcacagcc

SEQ ID NO: 376312 - RNA, 18 nt, Human
cccucccgugaaggagcc

SEQ ID NO: 376313 - RNA, 19 nt, Human
ccugcggucacaacuccag

SEQ ID NO: 376314 - RNA, 21 nt, Human
ccugcggucacaacuccagaa

SEQ ID NO: 376315 - RNA, 20 nt, Human
cgcaacaccuauuccaggga

SEQ ID NO: 376316 - RNA, 26 nt, Human
cuccuggccucugaagccgauccacc

SEQ ID NO: 376317 - RNA, 23 nt, Human
cucuucggcugcagagagcugcc

SEQ ID NO: 376318 - RNA, 24 nt, Human
gaagacaggaggcaggaagaggaa

SEQ ID NO: 376319 - RNA, 21 nt, Human
gacaggaggcaggaagaggaa

SEQ ID NO: 376320 - RNA, 24 nt, Human
gagcugccuccuggccucugaagc

SEQ ID NO: 376321 - RNA, 21 nt, Human
gagcugugcuccaggaugacu

SEQ ID NO: 376322 - RNA, 19 nt, Human
gcugcagagagcugccucc

SEQ ID NO: 376323 - RNA, 20 nt, Human
ggagcacagccgagaggcag

SEQ ID NO: 376324 - RNA, 20 nt, Human
ggagugaggcugggugugug

SEQ ID NO: 376325 - RNA, 21 nt, Human
ggcccggagcgugggaagagc

SEQ ID NO: 376326 - RNA, 27 nt, Human
ggcccggagcgugggaagagcugucgu

SEQ ID NO: 376327 - RNA, 23 nt, Human
gggugggcaggcagcggggcucc

SEQ ID NO: 376328 - RNA, 22 nt, Human
ggugggcaggcagcggggcucc

SEQ ID NO: 376329 - RNA, 22 nt, Human
ggugggugggcaggcagcgggg

SEQ ID NO: 376330 - RNA, 26 nt, Human
uaagcccuugggauacuucaacaucc

SEQ ID NO: 376331 - RNA, 26 nt, Human
uaagcccuugggauacuucaacaucc

SEQ ID NO: 376332 - RNA, 22 nt, Human
uacgcaacaccuauuccaggga

SEQ ID NO: 376333 - RNA, 20 nt, Human
uauuugauacgcaacaccua

SEQ ID NO: 376334 - RNA, 20 nt, Human
ucgcacugaggaucauacuc

SEQ ID NO: 376335 - RNA, 18 nt, Human
ugaaggagcacaaauaug

SEQ ID NO: 376336 - RNA, 25 nt, Human
ugauggagugaggcugggugugugg

SEQ ID NO: 376337 - RNA, 20 nt, Human
uggcagaaaaaaagucugca

SEQ ID NO: 376338 - RNA, 22 nt, Human
uggcagaaaaaaagucugcaga

SEQ ID NO: 376339 - RNA, 26 nt, Human
uggcagaaaaaaagucugcagauccc

SEQ ID NO: 376340 - RNA, 19 nt, Human
uggccucugaagccgaucc

SEQ ID NO: 376341 - RNA, 18 nt, Human
ugggcaggcagcggggcu

SEQ ID NO: 376342 - RNA, 24 nt, Human
uucucuuuuccuucuucaucugua

SEQ ID NO: 376343 - RNA, 18 nt, Human
uuuuaucagcucuucacc

SEQ ID NO: 376344 - RNA, 18 nt, Human
uuuuaucagcucuucacc

SEQ ID NO: 376345 - RNA, 26 nt, Human
ccgcggggaccccacggacccugcgu

SEQ ID NO: 376346 - RNA, 21 nt, Human
gcccuggggccuccuucagcc

SEQ ID NO: 376347 - RNA, 22 nt, Human
ggcccuggggccuccuucagcc

SEQ ID NO: 376348 - RNA, 18 nt, Human
uagucacugacgcuaaag

SEQ ID NO: 376349 - RNA, 21 nt, Human
aaccuaacagguuacccacag

SEQ ID NO: 376350 - RNA, 21 nt, Human
aagugacguuaggacaaggau

SEQ ID NO: 376351 - RNA, 23 nt, Human
accugaaaaugugacuuuugaaa

SEQ ID NO: 376352 - RNA, 24 nt, Human
aggaguauaacucucuauucugaa

SEQ ID NO: 376353 - RNA, 22 nt, Human
auuuuauugaaacccucuuuca

SEQ ID NO: 376354 - RNA, 23 nt, Human
caaaaugccuuaaggcccuuuaa

SEQ ID NO: 376355 - RNA, 24 nt, Human
caaggccagcuuuccuugccuaug

SEQ ID NO: 376356 - RNA, 23 nt, Human
cacccguuuaccacuuccuaagu

SEQ ID NO: 376357 - RNA, 21 nt, Human
ccccgccgccgucugcccucc

SEQ ID NO: 376358 - RNA, 22 nt, Human
ccccgccgccgucugcccuccu

SEQ ID NO: 376359 - RNA, 24 nt, Human
ccccgccgccgucugcccuccucg

SEQ ID NO: 376360 - RNA, 22 nt, Human
ccucgagcucugcggggaagcc

SEQ ID NO: 376361 - RNA, 22 nt, Human
cgucugcccuccucgagcucug

SEQ ID NO: 376362 - RNA, 25 nt, Human
cucaaaacuacucugcugugaauuu

SEQ ID NO: 376363 - RNA, 20 nt, Human
guaaaaccuaacagguuacc

SEQ ID NO: 376364 - RNA, 23 nt, Human
gugacuuuugaaacuugggaaag

SEQ ID NO: 376365 - RNA, 20 nt, Human
uacuauauaguuagcaaggc

SEQ ID NO: 376366 - RNA, 20 nt, Human
ucacauauucaagcuacgaa

SEQ ID NO: 376367 - RNA, 23 nt, Human
ucacccguuuaccacuuccuaag

SEQ ID NO: 376368 - RNA, 19 nt, Human
ucagagucuccuucaagug

SEQ ID NO: 376369 - RNA, 21 nt, Human
uccuuaaauaccugaaaaugu

SEQ ID NO: 376370 - RNA, 22 nt, Human
ucguggcgacgacucggccucc

SEQ ID NO: 376371 - RNA, 23 nt, Human
ucugcccuccucgagcucugcgg

SEQ ID NO: 376372 - RNA, 23 nt, Human
ucugucaucaguuuccuccuuca

SEQ ID NO: 376373 - RNA, 23 nt, Human
ugauaaagaggaguaaauuuuuc

SEQ ID NO: 376374 - RNA, 20 nt, Human
ugcauguacgagugugugug

SEQ ID NO: 376375 - RNA, 23 nt, Human
ugccuaugacaaauuggcuagaa

SEQ ID NO: 376376 - RNA, 18 nt, Human
ugcgaguccaccaagggg

SEQ ID NO: 376377 - RNA, 24 nt, Human
ugucugcauguacgagugugugug

SEQ ID NO: 376378 - RNA, 21 nt, Human
uuaaauaccugaaaaugugac

SEQ ID NO: 376379 - RNA, 20 nt, Human
uuuauugaaacccucuuuca

SEQ ID NO: 376380 - RNA, 23 nt, Human
uuuauugaaacccucuuucaccc

SEQ ID NO: 376381 - RNA, 24 nt, Human
uuuuuugcuguuuuuauuuaaaau

SEQ ID NO: 376382 - RNA, 20 nt, Human
uuuuuuuuuuuuuuuugcug

SEQ ID NO: 376383 - RNA, 24 nt, Human
uuuuuuuuuuuuuuuuugcuguuu

SEQ ID NO: 376384 - RNA, 27 nt, Human
uuuuuuuuuuuuuuuuuuuuuuugggg

SEQ ID NO: 376385 - RNA, 19 nt, Human
aacaaaacaacucugcccu

SEQ ID NO: 376386 - RNA, 19 nt, Human
aagccagaacaaaacaacu

SEQ ID NO: 376387 - RNA, 22 nt, Human
aagccagaacaaaacaacucug

SEQ ID NO: 376388 - RNA, 19 nt, Human
aaucaaaugccugcuuucc

SEQ ID NO: 376389 - RNA, 24 nt, Human
acaacucugcccuaccuuuccugc

SEQ ID NO: 376390 - RNA, 26 nt, Human
acagggaagggaagauauuucuccca

SEQ ID NO: 376391 - RNA, 20 nt, Human
accccacuucccuccucacc

SEQ ID NO: 376392 - RNA, 25 nt, Human
accccacuucccuccucaccccuca

SEQ ID NO: 376393 - RNA, 20 nt, Human
acucuccccaagccagaaca

SEQ ID NO: 376394 - RNA, 23 nt, Human
acucuccccaagccagaacaaaa

SEQ ID NO: 376395 - RNA, 19 nt, Human
acugaguauucaccaggug

SEQ ID NO: 376396 - RNA, 21 nt, Human
agaacccuuuauguaaagccu

SEQ ID NO: 376397 - RNA, 23 nt, Human
agacagcaaacaacuccuggagc

SEQ ID NO: 376398 - RNA, 20 nt, Human
agcggaaaggaccuccugga

SEQ ID NO: 376399 - RNA, 23 nt, Human
auaauaauaaaaguucugauguc

SEQ ID NO: 376400 - RNA, 21 nt, Human
aucccacucuccccaagccag

SEQ ID NO: 376401 - RNA, 22 nt, Human
aucccacucuccccaagccaga

SEQ ID NO: 376402 - RNA, 25 nt, Human
caaaaaaagcuaccuuauauggaag

SEQ ID NO: 376403 - RNA, 22 nt, Human
caaaaguuuccccagagacaag

SEQ ID NO: 376404 - RNA, 22 nt, Human
caaaaucaaaugccugcuuucc

SEQ ID NO: 376405 - RNA, 18 nt, Human
caagccagaacaaaacaa

SEQ ID NO: 376406 - RNA, 19 nt, Human
caccaugucugcacacacc

SEQ ID NO: 376407 - RNA, 20 nt, Human
caccaugucugcacacaccg

SEQ ID NO: 376408 - RNA, 18 nt, Human
cacucuccccaagccaga

SEQ ID NO: 376409 - RNA, 23 nt, Human
cacugggccugcuuuaccuccuc

SEQ ID NO: 376410 - RNA, 21 nt, Human
cagacagaaauagauuccaua

SEQ ID NO: 376411 - RNA, 18 nt, Human
cagguggcgguggaggca

SEQ ID NO: 376412 - RNA, 18 nt, Human
cauggaucccacucuccc

SEQ ID NO: 376413 - RNA, 25 nt, Human
cccaagccagaacaaaaccgggguc

SEQ ID NO: 376414 - RNA, 18 nt, Human
ccccagagacaaggguac

SEQ ID NO: 376415 - RNA, 19 nt, Human
ccccccuccaccacccagc

SEQ ID NO: 376416 - RNA, 19 nt, Human
ccccgcucugcccccaaca

SEQ ID NO: 376417 - RNA, 18 nt, Human
ccccuuccucccuacuuu

SEQ ID NO: 376418 - RNA, 19 nt, Human
ccccuuccucccuacuuuc

SEQ ID NO: 376419 - RNA, 21 nt, Human
cccuguacauauaccuguccc

SEQ ID NO: 376420 - RNA, 20 nt, Human
cccugucuggcuuggucccc

SEQ ID NO: 376421 - RNA, 19 nt, Human
ccucuguccucuugaguua

SEQ ID NO: 376422 - RNA, 22 nt, Human
ccucuucaaguacagugagaau

SEQ ID NO: 376423 - RNA, 19 nt, Human
ccugcugcagacagggugu

SEQ ID NO: 376424 - RNA, 19 nt, Human
cuacuuucuguaaauaucu

SEQ ID NO: 376425 - RNA, 22 nt, Human
cuccccccuccaccacccagcc

SEQ ID NO: 376426 - RNA, 18 nt, Human
cucuuccauagcuuuggc

SEQ ID NO: 376427 - RNA, 22 nt, Human
cucuuccauagcuuuggcacaa

SEQ ID NO: 376428 - RNA, 18 nt, Human
cugggcggacuugcaggu

SEQ ID NO: 376429 - RNA, 19 nt, Human
cuuccucccuacuuucugu

SEQ ID NO: 376430 - RNA, 18 nt, Human
cuuggggaugaaagagaa

SEQ ID NO: 376431 - RNA, 22 nt, Human
cuuuauguaaagccucuucaag

SEQ ID NO: 376432 - RNA, 21 nt, Human
gagaacccuuuauguaaagcc

SEQ ID NO: 376433 - RNA, 20 nt, Human
gaguauucaccaggugugga

SEQ ID NO: 376434 - RNA, 23 nt, Human
gauagucuucugcugcugguacc

SEQ ID NO: 376435 - RNA, 23 nt, Human
gcaaaaguuuccccagagacaag

SEQ ID NO: 376436 - RNA, 23 nt, Human
gcaauggaaaagagccacaaaaa

SEQ ID NO: 376437 - RNA, 24 nt, Human
gcccuguacauauaccugucccug

SEQ ID NO: 376438 - RNA, 19 nt, Human
gcggacuugcagguggcgg

SEQ ID NO: 376439 - RNA, 20 nt, Human
gcugcugguaccuggguggg

SEQ ID NO: 376440 - RNA, 27 nt, Human
ggaaaggaccuccuggacuccuguaaa

SEQ ID NO: 376441 - RNA, 23 nt, Human
gggauaggggcaaucccaaggaa

SEQ ID NO: 376442 - RNA, 20 nt, Human
guaaagccucuucaaguaca

SEQ ID NO: 376443 - RNA, 21 nt, Human
guaaagccucuucaaguacag

SEQ ID NO: 376444 - RNA, 20 nt, Human
uaaacccccauucuuuccaa

SEQ ID NO: 376445 - RNA, 25 nt, Human
uaccccacuucccuccucaccccuc

SEQ ID NO: 376446 - RNA, 20 nt, Human
uaccccacuucccuccucag

SEQ ID NO: 376447 - RNA, 19 nt, Human
uaccuuuccugccccgcuc

SEQ ID NO: 376448 - RNA, 18 nt, Human
uacuggguugacauagag

SEQ ID NO: 376449 - RNA, 20 nt, Human
uaggggcaaucccaaggaaa

SEQ ID NO: 376450 - RNA, 24 nt, Human
uaugcacacagugacucacagaau

SEQ ID NO: 376451 - RNA, 24 nt, Human
ucagacuccagcuacuggguugac

SEQ ID NO: 376452 - RNA, 27 nt, Human
uccauaccccacuucccuccucacccc

SEQ ID NO: 376453 - RNA, 21 nt, Human
ucccacucuccccaagccaga

SEQ ID NO: 376454 - RNA, 22 nt, Human
uccccaagccagaacaaaacaa

SEQ ID NO: 376455 - RNA, 24 nt, Human
uccccaagccagaacaaaacaacu

SEQ ID NO: 376456 - RNA, 23 nt, Human
uccccccuccaccacccagccuu

SEQ ID NO: 376457 - RNA, 20 nt, Human
uccccuuccucccuacuuuc

SEQ ID NO: 376458 - RNA, 25 nt, Human
uccccuuccucccuacuuucuguaa

SEQ ID NO: 376459 - RNA, 22 nt, Human
uccucaccagccucuguccucu

SEQ ID NO: 376460 - RNA, 23 nt, Human
uccucaccagccucuguccucuu

SEQ ID NO: 376461 - RNA, 23 nt, Human
uccuccucucugacaguuugggc

SEQ ID NO: 376462 - RNA, 20 nt, Human
uccuggacuccuguaaaccc

SEQ ID NO: 376463 - RNA, 21 nt, Human
uccuggacuccuguaaacccc

SEQ ID NO: 376464 - RNA, 18 nt, Human
ucucccaauugguagggg

SEQ ID NO: 376465 - RNA, 21 nt, Human
ucuguccucuugaguuaccgu

SEQ ID NO: 376466 - RNA, 22 nt, Human
ucuucugcugcugguaccuggg

SEQ ID NO: 376467 - RNA, 18 nt, Human
ugagaauuaacuuccucc

SEQ ID NO: 376468 - RNA, 21 nt, Human
ugccaggaugagcauggaucc

SEQ ID NO: 376469 - RNA, 19 nt, Human
ugcgcagaaguccagcugg

SEQ ID NO: 376470 - RNA, 20 nt, Human
ugcugcugguaccugggugg

SEQ ID NO: 376471 - RNA, 19 nt, Human
uggacuccuguaaaccccc

SEQ ID NO: 376472 - RNA, 19 nt, Human
uggcagagccuauuugucc

SEQ ID NO: 376473 - RNA, 24 nt, Human
ugguguugagaagcugcaguucuu

SEQ ID NO: 376474 - RNA, 23 nt, Human
ugucauagugugggauaggggca

SEQ ID NO: 376475 - RNA, 19 nt, Human
uguggcucuuaggagagcg

SEQ ID NO: 376476 - RNA, 24 nt, Human
uuccauagcuuuggcacaauuacc

SEQ ID NO: 376477 - RNA, 25 nt, Human
uuuccugccccgcucugcccccaac

SEQ ID NO: 376478 - RNA, 19 nt, Human
caagaauagguaucuuuua

SEQ ID NO: 376479 - RNA, 21 nt, Human
uaguggaaaucuuuugacugu

SEQ ID NO: 376480 - RNA, 23 nt, Human
ucuuuuaauccaccacagugaca

SEQ ID NO: 376481 - RNA, 23 nt, Human
uugagauuauuuugguuccuuuu

SEQ ID NO: 376482 - RNA, 22 nt, Human
aacacauuuuucccucaugacu

SEQ ID NO: 376483 - RNA, 25 nt, Human
aacuugccuucuccccacagcaucu

SEQ ID NO: 376484 - RNA, 20 nt, Human
aaguugcaucaccuauaacc

SEQ ID NO: 376485 - RNA, 21 nt, Human
aaugaauucacuuugauggau

SEQ ID NO: 376486 - RNA, 19 nt, Human
acuuugauggauaaagagg

SEQ ID NO: 376487 - RNA, 22 nt, Human
aguuggcuggucucaaugucuu

SEQ ID NO: 376488 - RNA, 21 nt, Human
auaaagagguauaaugauuaa

SEQ ID NO: 376489 - RNA, 19 nt, Human
augaauucacuuugaugga

SEQ ID NO: 376490 - RNA, 20 nt, Human
caaggcaagaaguuggcugg

SEQ ID NO: 376491 - RNA, 21 nt, Human
ccaauaucugaugcaaaguau

SEQ ID NO: 376492 - RNA, 20 nt, Human
cccaaggauguuggugauga

SEQ ID NO: 376493 - RNA, 22 nt, Human
cccuugcuaggaaggaccuuau

SEQ ID NO: 376494 - RNA, 22 nt, Human
ccugaaacacauuuuucccuca

SEQ ID NO: 376495 - RNA, 18 nt, Human
ccugaaauuauuuuucca

SEQ ID NO: 376496 - RNA, 22 nt, Human
cugcuuucaaaauccagccacc

SEQ ID NO: 376497 - RNA, 26 nt, Human
cuuauaaucuuauauaaauaucuucu

SEQ ID NO: 376498 - RNA, 22 nt, Human
cuuucaaaauccagccacccaa

SEQ ID NO: 376499 - RNA, 21 nt, Human
gaaggucuaucuuuguaacuu

SEQ ID NO: 376500 - RNA, 26 nt, Human
uaagccaagggaagaggccugaaaca

SEQ ID NO: 376501 - RNA, 22 nt, Human
uaaggauaauaccaugaaaauc

SEQ ID NO: 376502 - RNA, 21 nt, Human
uauaaccagaagucugcuuuc

SEQ ID NO: 376503 - RNA, 24 nt, Human
ucaguaguuaucaaggcaagaagu

SEQ ID NO: 376504 - RNA, 21 nt, Human
ucuaucuuuguaacuugccuu

SEQ ID NO: 376505 - RNA, 20 nt, Human
ugaaaacauuuauuucuucc

SEQ ID NO: 376506 - RNA, 30 nt, Human
ugauaggcuucaucagauucccaaagccuu

SEQ ID NO: 376507 - RNA, 24 nt, Human
ugcaucaccuauaaccagaagucu

SEQ ID NO: 376508 - RNA, 21 nt, Human
uggaaaaggcauaauucuuua

SEQ ID NO: 376509 - RNA, 20 nt, Human
uggauuucuuuugucuuccc

SEQ ID NO: 376510 - RNA, 23 nt, Human
uguaacuugccuucuccccacag

SEQ ID NO: 376511 - RNA, 18 nt, Human
uucaggauuguuuuucaa

SEQ ID NO: 376512 - RNA, 26 nt, Human
uuggugaugauagucaugguuuuuuc

SEQ ID NO: 376513 - RNA, 23 nt, Human
uuuccuguaagccaagggaagag

SEQ ID NO: 376514 - RNA, 22 nt, Human
cauugcccaagguugagagaug

SEQ ID NO: 376515 - RNA, 18 nt, Human
gcccaagguugagagaug

SEQ ID NO: 376516 - RNA, 24 nt, Human
uauauugguucuucaaugucagug

SEQ ID NO: 376517 - RNA, 20 nt, Human
ucaaugucaguggcaggcuu

SEQ ID NO: 376518 - RNA, 18 nt, Human
gcccaagguugagagaug

SEQ ID NO: 376519 - RNA, 23 nt, Human
uuuuuuuuuuuuuuuuucagcuu

SEQ ID NO: 376520 - RNA, 26 nt, Human
uuuuuuuuuuuuuuuuuuuucagcuu

SEQ ID NO: 376521 - RNA, 24 nt, Human
uuuuuuuuuuuuuuuuuuuuucag

SEQ ID NO: 376522 - RNA, 22 nt, Human
aaaaauucucaacaaaauauua

SEQ ID NO: 376523 - RNA, 21 nt, Human
aaaagaagauauuggagaaga

SEQ ID NO: 376524 - RNA, 24 nt, Human
aaaagaagauauuggagaagaaac

SEQ ID NO: 376525 - RNA, 21 nt, Human
aaaauucucaacaaaauauua

SEQ ID NO: 376526 - RNA, 21 nt, Human
aaacaaaugcugcaauaaagc

SEQ ID NO: 376527 - RNA, 27 nt, Human
aaacacacaaucucccaagauugaacc

SEQ ID NO: 376528 - RNA, 30 nt, Human
aaacuuaccaaccaacacaaaagcccuagg

SEQ ID NO: 376529 - RNA, 19 nt, Human
aaagaagaaaaucuggagg

SEQ ID NO: 376530 - RNA, 20 nt, Human
aaagagauguacucuugguc

SEQ ID NO: 376531 - RNA, 18 nt, Human
aaauuccuggaaacacac

SEQ ID NO: 376532 - RNA, 24 nt, Human
aacacaaaagcccuagaccagaug

SEQ ID NO: 376533 - RNA, 24 nt, Human
aaccaggaagagacagaaaccccc

SEQ ID NO: 376534 - RNA, 18 nt, Human
aagaagaaaaucuggagg

SEQ ID NO: 376535 - RNA, 20 nt, Human
aagaagauauuggagaagaa

SEQ ID NO: 376536 - RNA, 22 nt, Human
aagaagauauuggagaagaaac

SEQ ID NO: 376537 - RNA, 24 nt, Human
aagcaacaccagugaaaccaagga

SEQ ID NO: 376538 - RNA, 24 nt, Human
aagcaacaccagugaaaccaaggg

SEQ ID NO: 376539 - RNA, 28 nt, Human
aagcaacaccagugaaacccccaguagg

SEQ ID NO: 376540 - RNA, 24 nt, Human
aauuaguaauaaaaaacuuaccaa

SEQ ID NO: 376541 - RNA, 22 nt, Human
acagcaaagcaacaccagugaa

SEQ ID NO: 376542 - RNA, 19 nt, Human
agaaaccccuccuagacca

SEQ ID NO: 376543 - RNA, 24 nt, Human
agaaaccccuccuagaccaauauc

SEQ ID NO: 376544 - RNA, 21 nt, Human
agaagaaaaucuggaggaaac

SEQ ID NO: 376545 - RNA, 23 nt, Human
agcaaagcaacaccagugaaacc

SEQ ID NO: 376546 - RNA, 22 nt, Human
aggaaagaaagcagugcuucag

SEQ ID NO: 376547 - RNA, 24 nt, Human
aggaagagacagaaaccccuccua

SEQ ID NO: 376548 - RNA, 22 nt, Human
agguaaaagaagauauuggaga

SEQ ID NO: 376549 - RNA, 21 nt, Human
aguccuguucucaucacuuca

SEQ ID NO: 376550 - RNA, 19 nt, Human
auaaagaagaaaaucugga

SEQ ID NO: 376551 - RNA, 18 nt, Human
auaaagcaagucacacag

SEQ ID NO: 376552 - RNA, 22 nt, Human
aucacuucacaguagaugaagg

SEQ ID NO: 376553 - RNA, 22 nt, Human
auuguuuuccugugcccaucca

SEQ ID NO: 376554 - RNA, 22 nt, Human
auuguuuuccugugcccaucca

SEQ ID NO: 376555 - RNA, 20 nt, Human
caaacauucuggcagagaca

SEQ ID NO: 376556 - RNA, 19 nt, Human
caaagcaacaccagugaaa

SEQ ID NO: 376557 - RNA, 20 nt, Human
caaagcaacaccagugaaac

SEQ ID NO: 376558 - RNA, 23 nt, Human
caaagcaacaccagugaaaccaa

SEQ ID NO: 376559 - RNA, 22 nt, Human
caaaugcugcaauaaagcaagu

SEQ ID NO: 376560 - RNA, 19 nt, Human
caacacaaaagcccuagac

SEQ ID NO: 376561 - RNA, 20 nt, Human
caacacaaaagcccuagacc

SEQ ID NO: 376562 - RNA, 23 nt, Human
caacacaaaagcccuagaccaga

SEQ ID NO: 376563 - RNA, 24 nt, Human
caacaccagugaaaccaaggacac

SEQ ID NO: 376564 - RNA, 21 nt, Human
caagaugcagaaagaauaacu

SEQ ID NO: 376565 - RNA, 22 nt, Human
cacacaaucucccaagauugaa

SEQ ID NO: 376566 - RNA, 24 nt, Human
cacacagauuuuuugguuucccag

SEQ ID NO: 376567 - RNA, 22 nt, Human
caccagugaaaccaaggacacc

SEQ ID NO: 376568 - RNA, 23 nt, Human
caccuucccccucuucacacaca

SEQ ID NO: 376569 - RNA, 21 nt, Human
cagagguuuaagacuugggcc

SEQ ID NO: 376570 - RNA, 24 nt, Human
cagcaaagcaacaccagugaaacc

SEQ ID NO: 376571 - RNA, 25 nt, Human
cagcaaagcaacaccagugaaacca

SEQ ID NO: 376572 - RNA, 21 nt, Human
caggugauaagccucaagcau

SEQ ID NO: 376573 - RNA, 23 nt, Human
caguuagagauaauuuucucaac

SEQ ID NO: 376574 - RNA, 23 nt, Human
caguuagagauaauuuucucaac

SEQ ID NO: 376575 - RNA, 18 nt, Human
caguucugggugcugccu

SEQ ID NO: 376576 - RNA, 18 nt, Human
caguucugggugcugccu

SEQ ID NO: 376577 - RNA, 21 nt, Human
ccaaaauaaaacaaaugcugc

SEQ ID NO: 376578 - RNA, 22 nt, Human
ccaaacaguccccagagaacuc

SEQ ID NO: 376579 - RNA, 18 nt, Human
ccagacuaccaaaauaaa

SEQ ID NO: 376580 - RNA, 20 nt, Human
ccagcccucuucauauuucu

SEQ ID NO: 376581 - RNA, 25 nt, Human
ccccagagaacuccagcugucauga

SEQ ID NO: 376582 - RNA, 19 nt, Human
ccccagagguuuaagacuu

SEQ ID NO: 376583 - RNA, 18 nt, Human
cccuccuagaccaauauc

SEQ ID NO: 376584 - RNA, 22 nt, Human
ccuugcuguugaucuucccuuc

SEQ ID NO: 376585 - RNA, 22 nt, Human
cuagaccaauaucaagcgcuga

SEQ ID NO: 376586 - RNA, 23 nt, Human
cuaugccaaaaaaucaaggagga

SEQ ID NO: 376587 - RNA, 24 nt, Human
cuuaccaaccaacacaaaagcccu

SEQ ID NO: 376588 - RNA, 23 nt, Human
cuucacacacagcagacaucucc

SEQ ID NO: 376589 - RNA, 25 nt, Human
cuucuuauaaaugcuauauagggau

SEQ ID NO: 376590 - RNA, 27 nt, Human
cuuuggugauauugcagguucaguucc

SEQ ID NO: 376591 - RNA, 19 nt, Human
gaaaauuucaggccaauau

SEQ ID NO: 376592 - RNA, 20 nt, Human
gcacguucuggcuguggcag

SEQ ID NO: 376593 - RNA, 18 nt, Human
gcauuucuaaacauauau

SEQ ID NO: 376594 - RNA, 18 nt, Human
gcauuucuaaacauauau

SEQ ID NO: 376595 - RNA, 25 nt, Human
ggaaaagaaaauuucaggccaauau

SEQ ID NO: 376596 - RNA, 19 nt, Human
ggugauaagccucaagcau

SEQ ID NO: 376597 - RNA, 22 nt, Human
uaaaagaagauauuggagaaga

SEQ ID NO: 376598 - RNA, 27 nt, Human
uaaagaagaaaaucuggaggaaacggc

SEQ ID NO: 376599 - RNA, 18 nt, Human
uaaagcaagucacacaga

SEQ ID NO: 376600 - RNA, 24 nt, Human
uaaagcaagucacacagauuuuuu

SEQ ID NO: 376601 - RNA, 21 nt, Human
uaaaugcuauauagggauguu

SEQ ID NO: 376602 - RNA, 24 nt, Human
uaaauuccuggaaacacacaaucu

SEQ ID NO: 376603 - RNA, 26 nt, Human
uaccaaaauaaaacaaaugcugcaau

SEQ ID NO: 376604 - RNA, 27 nt, Human
uaccaaaauaaaacaaaugcugcaaua

SEQ ID NO: 376605 - RNA, 19 nt, Human
uacuaugucaaaaaucaca

SEQ ID NO: 376606 - RNA, 25 nt, Human
uagcagaaauaauuuauuugcacag

SEQ ID NO: 376607 - RNA, 23 nt, Human
uagguaaaagaagauauuggaga

SEQ ID NO: 376608 - RNA, 18 nt, Human
uaugaagccagcaucagc

SEQ ID NO: 376609 - RNA, 20 nt, Human
uaugccaaaaaaucaaggag

SEQ ID NO: 376610 - RNA, 21 nt, Human
uauugcaaauacucauauuua

SEQ ID NO: 376611 - RNA, 21 nt, Human
uccagacuaccaaaauaaaaa

SEQ ID NO: 376612 - RNA, 21 nt, Human
uccagcccucuucauauuucu

SEQ ID NO: 376613 - RNA, 24 nt, Human
ucccaaugaacauauuugcaaaaa

SEQ ID NO: 376614 - RNA, 21 nt, Human
uccccagagaacuccagcugu

SEQ ID NO: 376615 - RNA, 19 nt, Human
ucgaugcacauaaagaaga

SEQ ID NO: 376616 - RNA, 22 nt, Human
ucgaugcacauaaagaagaaaa

SEQ ID NO: 376617 - RNA, 19 nt, Human
ucuuauucauucuucccuc

SEQ ID NO: 376618 - RNA, 24 nt, Human
ucuuuuuuuucuuuuguauccuau

SEQ ID NO: 376619 - RNA, 24 nt, Human
ucuuuuuuuucuuuuguauccuau

SEQ ID NO: 376620 - RNA, 25 nt, Human
ugaaaagagauguacucuugguccu

SEQ ID NO: 376621 - RNA, 22 nt, Human
ugacaggaggugccuccugagg

SEQ ID NO: 376622 - RNA, 19 nt, Human
uggagaagaaacaucauca

SEQ ID NO: 376623 - RNA, 26 nt, Human
uggcagagacacaguggaaaagaaaa

SEQ ID NO: 376624 - RNA, 20 nt, Human
ugggugcugccugcagacaa

SEQ ID NO: 376625 - RNA, 20 nt, Human
ugggugcugccugcagacaa

SEQ ID NO: 376626 - RNA, 23 nt, Human
uuaagguagcagaaauaauuuau

SEQ ID NO: 376627 - RNA, 20 nt, Human
uuagagauaauuuucucaac

SEQ ID NO: 376628 - RNA, 20 nt, Human
uuagagauaauuuucucaac

SEQ ID NO: 376629 - RNA, 18 nt, Human
uuaggaaauaauuuuaag

SEQ ID NO: 376630 - RNA, 18 nt, Human
uuaggaaauaauuuuaag

SEQ ID NO: 376631 - RNA, 21 nt, Human
uuggagaagaaacaucaucag

SEQ ID NO: 376632 - RNA, 18 nt, Human
uuuuaagguagcagaaau

SEQ ID NO: 376633 - RNA, 21 nt, Human
uuuuuuuuuuuuuuuuuacag

SEQ ID NO: 376634 - RNA, 24 nt, Human
aaacagccuggcagucccuagagc

SEQ ID NO: 376635 - RNA, 21 nt, Human
aacaaaccauccaaacauuuu

SEQ ID NO: 376636 - RNA, 20 nt, Human
aacaacaaaccauccaaaca

SEQ ID NO: 376637 - RNA, 19 nt, Human
aacagaacacuaaagagaa

SEQ ID NO: 376638 - RNA, 23 nt, Human
aagaacaaccgauucaccaacuc

SEQ ID NO: 376639 - RNA, 22 nt, Human
agagagaauccgguacugugga

SEQ ID NO: 376640 - RNA, 21 nt, Human
agcuacaaauggcaagagaaa

SEQ ID NO: 376641 - RNA, 23 nt, Human
aggcagaacaacaaaccauccaa

SEQ ID NO: 376642 - RNA, 24 nt, Human
aggcagagcccagcagauccgugg

SEQ ID NO: 376643 - RNA, 20 nt, Human
aggcagccaagacccugaaa

SEQ ID NO: 376644 - RNA, 19 nt, Human
aggcaggcaggcggcaggc

SEQ ID NO: 376645 - RNA, 19 nt, Human
aggcaggcggcaggcagag

SEQ ID NO: 376646 - RNA, 20 nt, Human
aggcaggcggcaggcagagc

SEQ ID NO: 376647 - RNA, 24 nt, Human
agggaucucucccaccacugagcc

SEQ ID NO: 376648 - RNA, 19 nt, Human
auaagaagcagcuuuuuca

SEQ ID NO: 376649 - RNA, 20 nt, Human
augaacacaaagucugacuc

SEQ ID NO: 376650 - RNA, 24 nt, Human
caagacccugaaaugaaaugaaca

SEQ ID NO: 376651 - RNA, 24 nt, Human
cacaucauggugagaguuuguaug

SEQ ID NO: 376652 - RNA, 22 nt, Human
cacuaaagagaaaaguugaagc

SEQ ID NO: 376653 - RNA, 21 nt, Human
cacugagccucuagucccaaa

SEQ ID NO: 376654 - RNA, 24 nt, Human
cagccucaggcaaaccacguucug

SEQ ID NO: 376655 - RNA, 23 nt, Human
cagccugugagauccgaccaucc

SEQ ID NO: 376656 - RNA, 22 nt, Human
caggcaggcaggcggcaggcag

SEQ ID NO: 376657 - RNA, 22 nt, Human
cagucccuagagccccugagaa

SEQ ID NO: 376658 - RNA, 25 nt, Human
cauccaaaugugaggaaagaacaac

SEQ ID NO: 376659 - RNA, 20 nt, Human
ccaaaaguuugaaccaacag

SEQ ID NO: 376660 - RNA, 18 nt, Human
ccaggcagaacaacaaac

SEQ ID NO: 376661 - RNA, 19 nt, Human
cccaaaaguuugaaccaac

SEQ ID NO: 376662 - RNA, 20 nt, Human
cccacaggcagccaagaccc

SEQ ID NO: 376663 - RNA, 24 nt, Human
cccacaggcagccaagacccugaa

SEQ ID NO: 376664 - RNA, 26 nt, Human
cccaccacugagccucuagucccaaa

SEQ ID NO: 376665 - RNA, 23 nt, Human
ccucuagucccaaaaccauccuu

SEQ ID NO: 376666 - RNA, 25 nt, Human
cuccaggccaccuggggaagcccac

SEQ ID NO: 376667 - RNA, 21 nt, Human
cucucccaccacugagccucu

SEQ ID NO: 376668 - RNA, 20 nt, Human
cugugagauccgaccauccc

SEQ ID NO: 376669 - RNA, 19 nt, Human
gaacaacaaaccauccaaa

SEQ ID NO: 376670 - RNA, 24 nt, Human
gacccugaaaugaaaugaacacaa

SEQ ID NO: 376671 - RNA, 24 nt, Human
gagaagcccugcaggaugcgcuga

SEQ ID NO: 376672 - RNA, 23 nt, Human
gccccagaaucuuucucucaguu

SEQ ID NO: 376673 - RNA, 23 nt, Human
gcggcaggcagagcgcgcucucc

SEQ ID NO: 376674 - RNA, 22 nt, Human
ggaggaacaugcuaaaaaccuu

SEQ ID NO: 376675 - RNA, 19 nt, Human
ggagggugaagaaaaggag

SEQ ID NO: 376676 - RNA, 18 nt, Human
ggcaggcaggcaggcggc

SEQ ID NO: 376677 - RNA, 19 nt, Human
gggaacccucaguggcagg

SEQ ID NO: 376678 - RNA, 20 nt, Human
ggugaagaaaaggaggaaca

SEQ ID NO: 376679 - RNA, 20 nt, Human
gucaugucuuggguuagaau

SEQ ID NO: 376680 - RNA, 18 nt, Human
guccgugcucccaaaagu

SEQ ID NO: 376681 - RNA, 18 nt, Human
uaagacaaugggcaaagc

SEQ ID NO: 376682 - RNA, 27 nt, Human
uaaggcagagcccagcagauccguguc

SEQ ID NO: 376683 - RNA, 19 nt, Human
uaaguuacagcuaagaaug

SEQ ID NO: 376684 - RNA, 18 nt, Human
uaauaguuaaguuacagc

SEQ ID NO: 376685 - RNA, 24 nt, Human
uacagcuaagaaugucaugucuug

SEQ ID NO: 376686 - RNA, 20 nt, Human
uagcaccguuaauguauuca

SEQ ID NO: 376687 - RNA, 22 nt, Human
ucaaacagaacacuaaagagaa

SEQ ID NO: 376688 - RNA, 22 nt, Human
uccaaaugugaggaaagaacaa

SEQ ID NO: 376689 - RNA, 24 nt, Human
ucccaaaaguuugaaccaacagcc

SEQ ID NO: 376690 - RNA, 25 nt, Human
ucccagagaacugacaguccgugcu

SEQ ID NO: 376691 - RNA, 26 nt, Human
ucccuagagccccugagaagagcccu

SEQ ID NO: 376692 - RNA, 24 nt, Human
uccuggcugaaacagccuggcagu

SEQ ID NO: 376693 - RNA, 22 nt, Human
ucuccaggcagaacaacaaacc

SEQ ID NO: 376694 - RNA, 20 nt, Human
ucucucccaccacugagccu

SEQ ID NO: 376695 - RNA, 21 nt, Human
ugaaaagaaacugcacugaaa

SEQ ID NO: 376696 - RNA, 22 nt, Human
ugaaaagaaacugcacugaaag

SEQ ID NO: 376697 - RNA, 25 nt, Human
ugaaaagaaacugcacugaaaggua

SEQ ID NO: 376698 - RNA, 22 nt, Human
ugaaaugaaaugaacacaaagu

SEQ ID NO: 376699 - RNA, 19 nt, Human
ugaccacuucccagagaac

SEQ ID NO: 376700 - RNA, 19 nt, Human
ugcacugaaagguaaagga

SEQ ID NO: 376701 - RNA, 19 nt, Human
uggcaggcaggcaggcggc

SEQ ID NO: 376702 - RNA, 23 nt, Human
uuagcaccguuaauguauucacu

SEQ ID NO: 376703 - RNA, 23 nt, Human
uucaugaaaugcuuggaggugaa

SEQ ID NO: 376704 - RNA, 22 nt, Human
uugugaaacucuucacaucaug

SEQ ID NO: 376705 - RNA, 20 nt, Human
uuucaugaaaugcuuggagg

SEQ ID NO: 376706 - RNA, 19 nt, Human
uuugaaguuucucuugauu

SEQ ID NO: 376707 - RNA, 19 nt, Human
uuugcccaccuccaggcca

SEQ ID NO: 376708 - RNA, 23 nt, Human
uuuuuuuuuuuuuuuuucaguuu

SEQ ID NO: 376709 - RNA, 22 nt, Human
uuuuuuuuuuuuuuuuuuucag

SEQ ID NO: 376710 - RNA, 22 nt, Human
aaaaaacaaaaacaccuuagaa

SEQ ID NO: 376711 - RNA, 18 nt, Human
aaaaaacaggaaaaaagc

SEQ ID NO: 376712 - RNA, 26 nt, Human
aaaaaacaggaaaaaagcaaacauac

SEQ ID NO: 376713 - RNA, 27 nt, Human
aaaaacaaaaacaccuuagaaaaggga

SEQ ID NO: 376714 - RNA, 21 nt, Human
aaaaacacuuuauuuaauaaa

SEQ ID NO: 376715 - RNA, 27 nt, Human
aaaaagcaaacauacaaaaaacaaaaa

SEQ ID NO: 376716 - RNA, 27 nt, Human
aaaagcaaacauacaaaaaacaaaaac

SEQ ID NO: 376717 - RNA, 23 nt, Human
aaacaaaaaacaggaaaaaagca

SEQ ID NO: 376718 - RNA, 24 nt, Human
aaacaaaaaacaggaaaaaagcaa

SEQ ID NO: 376719 - RNA, 25 nt, Human
aaacaggaaaaaagcaaacauacaa

SEQ ID NO: 376720 - RNA, 19 nt, Human
aaacaucacacauccaaaa

SEQ ID NO: 376721 - RNA, 20 nt, Human
aaacaucacacauccaaaac

SEQ ID NO: 376722 - RNA, 25 nt, Human
aaagcaaacauacaaaaaacaaaaa

SEQ ID NO: 376723 - RNA, 21 nt, Human
aacaaaaaacaggaaaaaagc

SEQ ID NO: 376724 - RNA, 20 nt, Human
aacauacaaaaaacaaaaac

SEQ ID NO: 376725 - RNA, 20 nt, Human
aagcaaacauacaaaaaaca

SEQ ID NO: 376726 - RNA, 23 nt, Human
aaggaagaacucggucggcggcg

SEQ ID NO: 376727 - RNA, 21 nt, Human
acaaaaaacaggaaaaaagca

SEQ ID NO: 376728 - RNA, 23 nt, Human
aggaaaaaagcaaacauacaaaa

SEQ ID NO: 376729 - RNA, 24 nt, Human
agggggaagggaggaacgccgggc

SEQ ID NO: 376730 - RNA, 18 nt, Human
auacaaaaaacaaaaaca

SEQ ID NO: 376731 - RNA, 21 nt, Human
auacaaaaaacaaaaacaccu

SEQ ID NO: 376732 - RNA, 25 nt, Human
auacaaaaaacaaaaacaccuuaga

SEQ ID NO: 376733 - RNA, 21 nt, Human
aucagcuuuuuguucucccau

SEQ ID NO: 376734 - RNA, 18 nt, Human
auccaaaacaugguacca

SEQ ID NO: 376735 - RNA, 19 nt, Human
augaaacagcaucuacaaa

SEQ ID NO: 376736 - RNA, 18 nt, Human
caaaaaacaggaaaaaag

SEQ ID NO: 376737 - RNA, 21 nt, Human
caaaaaacaggaaaaaagcaa

SEQ ID NO: 376738 - RNA, 20 nt, Human
caaaaguugcuuuauucaac

SEQ ID NO: 376739 - RNA, 22 nt, Human
caacuuacaaaaaguacacacc

SEQ ID NO: 376740 - RNA, 19 nt, Human
caccaacaaaugcagacaa

SEQ ID NO: 376741 - RNA, 23 nt, Human
caccauagguuaaguaggcgccu

SEQ ID NO: 376742 - RNA, 20 nt, Human
caccgcgacgacagcaaggc

SEQ ID NO: 376743 - RNA, 28 nt, Human
caccuuagaaaagggagcucauccuaag

SEQ ID NO: 376744 - RNA, 24 nt, Human
cacugccguaaauggaaaaaacaa

SEQ ID NO: 376745 - RNA, 21 nt, Human
cagacaaccugaucuaauuaa

SEQ ID NO: 376746 - RNA, 18 nt, Human
cagcaaggcgacccgguc

SEQ ID NO: 376747 - RNA, 23 nt, Human
cagcagcaguagcaguagcagga

SEQ ID NO: 376748 - RNA, 21 nt, Human
cagcuaaguuuuaaagcugaa

SEQ ID NO: 376749 - RNA, 21 nt, Human
caggaaaaaagcaaacauaca

SEQ ID NO: 376750 - RNA, 19 nt, Human
caguagcaggaaaaucacc

SEQ ID NO: 376751 - RNA, 19 nt, Human
cauauaaacaucacacauc

SEQ ID NO: 376752 - RNA, 24 nt, Human
cccagugguaguggcgguggcuuu

SEQ ID NO: 376753 - RNA, 22 nt, Human
cccugcagagaugaaauccaac

SEQ ID NO: 376754 - RNA, 25 nt, Human
ccuaaaaauuaccuucuuccauuaa

SEQ ID NO: 376755 - RNA, 22 nt, Human
ccuuguguuuuuacaaaaauag

SEQ ID NO: 376756 - RNA, 20 nt, Human
cggggcggcgggaagggguc

SEQ ID NO: 376757 - RNA, 26 nt, Human
cguaaauggaaaaaacaaaaaacagg

SEQ ID NO: 376758 - RNA, 21 nt, Human
cguuucauucuacugaagcca

SEQ ID NO: 376759 - RNA, 20 nt, Human
cucccauauaaacaucacag

SEQ ID NO: 376760 - RNA, 19 nt, Human
cuuaaacucaacucaggau

SEQ ID NO: 376761 - RNA, 21 nt, Human
cuuguguuuuuacaaaaauag

SEQ ID NO: 376762 - RNA, 18 nt, Human
gagaugaaauccaacagu

SEQ ID NO: 376763 - RNA, 20 nt, Human
gcagcagcagcaguagcagu

SEQ ID NO: 376764 - RNA, 22 nt, Human
ggaaaaaacaaaaaacaggaaa

SEQ ID NO: 376765 - RNA, 19 nt, Human
ggcgagggggaagggagga

SEQ ID NO: 376766 - RNA, 19 nt, Human
ggcggcgggaaggggucgg

SEQ ID NO: 376767 - RNA, 22 nt, Human
ggcgguggcagcagcagcagua

SEQ ID NO: 376768 - RNA, 18 nt, Human
ggggcggggcggcgggaa

SEQ ID NO: 376769 - RNA, 19 nt, Human
ggggcugggggcggggcgg

SEQ ID NO: 376770 - RNA, 21 nt, Human
guggcgguggcagcagcagca

SEQ ID NO: 376771 - RNA, 21 nt, Human
gugguaguggcgguggcagca

SEQ ID NO: 376772 - RNA, 23 nt, Human
uaacaaauaauuuaccuuuagaa

SEQ ID NO: 376773 - RNA, 22 nt, Human
uacacaccauagguuaaguagg

SEQ ID NO: 376774 - RNA, 22 nt, Human
ucaaagcaucugaaaauuucaa

SEQ ID NO: 376775 - RNA, 19 nt, Human
uccauuaauaggaagaccc

SEQ ID NO: 376776 - RNA, 18 nt, Human
ucugaaaaggaagaacuc

SEQ ID NO: 376777 - RNA, 20 nt, Human
ugaaaaggaagaacucgguc

SEQ ID NO: 376778 - RNA, 21 nt, Human
ugaaacagcaucuacaaaagu

SEQ ID NO: 376779 - RNA, 24 nt, Human
ugaaauaauacacauccuaaaaau

SEQ ID NO: 376780 - RNA, 23 nt, Human
ugagaaaaguuaaaugaauagca

SEQ ID NO: 376781 - RNA, 23 nt, Human
uggaaaaaacaaaaaacaggaaa

SEQ ID NO: 376782 - RNA, 18 nt, Human
ugugaugauguucacuua

SEQ ID NO: 376783 - RNA, 21 nt, Human
ugugaugauguucacuuacac

SEQ ID NO: 376784 - RNA, 18 nt, Human
ugugucaaguucaaagca

SEQ ID NO: 376785 - RNA, 19 nt, Human
uguguggggcugggggcgg

SEQ ID NO: 376786 - RNA, 26 nt, Human
uucuucacguuucauucuacugaagc

SEQ ID NO: 376787 - RNA, 26 nt, Human
uuuagagauggccuaauaggccuggg

SEQ ID NO: 376788 - RNA, 23 nt, Human
aaccaugcauacauacaucugcu

SEQ ID NO: 376789 - RNA, 20 nt, Human
aacuaaggaacucuaaaaag

SEQ ID NO: 376790 - RNA, 21 nt, Human
aagcaauaucugguuuuugau

SEQ ID NO: 376791 - RNA, 21 nt, Human
acucuaaaaagugcuuaaaaa

SEQ ID NO: 376792 - RNA, 24 nt, Human
acucuaaaaagugcuuaaaaauaa

SEQ ID NO: 376793 - RNA, 21 nt, Human
acucugaggauguugcugugg

SEQ ID NO: 376794 - RNA, 23 nt, Human
acugaaguaaaagaacuaaucca

SEQ ID NO: 376795 - RNA, 23 nt, Human
agcacuuugaauguugcauggag

SEQ ID NO: 376796 - RNA, 20 nt, Human
aguaaauucaagcagaacac

SEQ ID NO: 376797 - RNA, 24 nt, Human
auauacaaagugauuuuuugugca

SEQ ID NO: 376798 - RNA, 20 nt, Human
auggugaaauaauuuaaaau

SEQ ID NO: 376799 - RNA, 21 nt, Human
auuaaaagaauaaaccuauga

SEQ ID NO: 376800 - RNA, 23 nt, Human
cauaaauagacaaauacuuuaua

SEQ ID NO: 376801 - RNA, 24 nt, Human
cauuuuugaagaaaaaaucaggaa

SEQ ID NO: 376802 - RNA, 23 nt, Human
ccaaacguggaauaucacaugau

SEQ ID NO: 376803 - RNA, 19 nt, Human
ccaugcauacauacaucug

SEQ ID NO: 376804 - RNA, 19 nt, Human
ccgcagguugcuggcggug

SEQ ID NO: 376805 - RNA, 18 nt, Human
gaagaaaaaaucaggaaa

SEQ ID NO: 376806 - RNA, 23 nt, Human
gaagaauacauucuuuguguacc

SEQ ID NO: 376807 - RNA, 25 nt, Human
gaagaauacauucuuuguguaccaa

SEQ ID NO: 376808 - RNA, 20 nt, Human
gagcugucacugcgcugccu

SEQ ID NO: 376809 - RNA, 20 nt, Human
gcugaguuaugaugcugugu

SEQ ID NO: 376810 - RNA, 21 nt, Human
gucaugcaccuguauuucuua

SEQ ID NO: 376811 - RNA, 20 nt, Human
guuaacaaaauaguauaacc

SEQ ID NO: 376812 - RNA, 25 nt, Human
uaaaagaacuaauccaguuugcagu

SEQ ID NO: 376813 - RNA, 22 nt, Human
uaaaagaauaaaccuaugaaga

SEQ ID NO: 376814 - RNA, 24 nt, Human
uaaacacugaaguaaaagaacuaa

SEQ ID NO: 376815 - RNA, 19 nt, Human
uaaaccuaugaagaauaca

SEQ ID NO: 376816 - RNA, 21 nt, Human
uaacagcauuuuugaagaaaa

SEQ ID NO: 376817 - RNA, 22 nt, Human
uaagaugauacagauuaaaucc

SEQ ID NO: 376818 - RNA, 24 nt, Human
uaguauaaccaugcauacauacag

SEQ ID NO: 376819 - RNA, 29 nt, Human
uauccaaacguggaauaucacaugauuuu

SEQ ID NO: 376820 - RNA, 20 nt, Human
ucugaggauguugcuguggc

SEQ ID NO: 376821 - RNA, 23 nt, Human
ucugauggaagcacuuugaaugu

SEQ ID NO: 376822 - RNA, 26 nt, Human
ugaagaauacauucuuuguguaccaa

SEQ ID NO: 376823 - RNA, 22 nt, Human
ugcccgcgcugggcgcaaguuc

SEQ ID NO: 376824 - RNA, 19 nt, Human
ugcgcugccugcuucuccg

SEQ ID NO: 376825 - RNA, 19 nt, Human
uggaauaucacaugauuua

SEQ ID NO: 376826 - RNA, 21 nt, Human
ugguccaggagcugguggcgg

SEQ ID NO: 376827 - RNA, 24 nt, Human
uugaagaaaaaaucaggaaauugu

SEQ ID NO: 376828 - RNA, 20 nt, Human
uuuaacaaauggcuaauggu

SEQ ID NO: 376829 - RNA, 20 nt, Human
aaaaaaauacugcaggucac

SEQ ID NO: 376830 - RNA, 21 nt, Human
aaaaaacaucagaagacaaac

SEQ ID NO: 376831 - RNA, 18 nt, Human
aaacuaagggcaaauauc

SEQ ID NO: 376832 - RNA, 20 nt, Human
aaagaaaauaaacuuaagag

SEQ ID NO: 376833 - RNA, 20 nt, Human
aaagcaagcagaaggaacua

SEQ ID NO: 376834 - RNA, 22 nt, Human
aaagcaagcagaaggaacuaga

SEQ ID NO: 376835 - RNA, 24 nt, Human
aaauacugcaggucacaugaagac

SEQ ID NO: 376836 - RNA, 20 nt, Human
aacccgccucccgcagaccg

SEQ ID NO: 376837 - RNA, 22 nt, Human
aagaaaaaacaucagaagacaa

SEQ ID NO: 376838 - RNA, 20 nt, Human
aagaacacaacaauuguuua

SEQ ID NO: 376839 - RNA, 26 nt, Human
aaggcagaucaacagacuagaacuag

SEQ ID NO: 376840 - RNA, 21 nt, Human
aaggccuuaaacaacaaaaaa

SEQ ID NO: 376841 - RNA, 24 nt, Human
acauuuugggagaacaaaaggcag

SEQ ID NO: 376842 - RNA, 20 nt, Human
agaaaaaacaucagaagaca

SEQ ID NO: 376843 - RNA, 23 nt, Human
agaaaaauaaaagguaaaaagaa

SEQ ID NO: 376844 - RNA, 21 nt, Human
agaacuagaacuuuugaguua

SEQ ID NO: 376845 - RNA, 22 nt, Human
agacaaacaaacaaauguucuu

SEQ ID NO: 376846 - RNA, 18 nt, Human
agauuucugacaaauaca

SEQ ID NO: 376847 - RNA, 23 nt, Human
agcgacggcggcagccacugcua

SEQ ID NO: 376848 - RNA, 20 nt, Human
aggagaaauuacuauuuuaa

SEQ ID NO: 376849 - RNA, 19 nt, Human
aggcaaggccuuaaacaac

SEQ ID NO: 376850 - RNA, 22 nt, Human
aggcagaucaacagacuagaac

SEQ ID NO: 376851 - RNA, 21 nt, Human
aggcauauuuauacaaacaaa

SEQ ID NO: 376852 - RNA, 24 nt, Human
aguuaauaaagcaagcagaaggaa

SEQ ID NO: 376853 - RNA, 23 nt, Human
auaaagcaagcagaaggaacuag

SEQ ID NO: 376854 - RNA, 24 nt, Human
auaaagcaagcagaaggaacuaga

SEQ ID NO: 376855 - RNA, 23 nt, Human
auaacccgccucccgcagaccga

SEQ ID NO: 376856 - RNA, 24 nt, Human
auuacaauauuuaaaaggccauga

SEQ ID NO: 376857 - RNA, 21 nt, Human
auuagaaaaaaaaauacugca

SEQ ID NO: 376858 - RNA, 22 nt, Human
cagaaaauaaauuccaucagga

SEQ ID NO: 376859 - RNA, 19 nt, Human
cagaaggaacuagaaaaau

SEQ ID NO: 376860 - RNA, 20 nt, Human
cagaaggaacuagaaaaaug

SEQ ID NO: 376861 - RNA, 21 nt, Human
caggaagaaguuaacagucua

SEQ ID NO: 376862 - RNA, 23 nt, Human
cauaacccgccucccgcagaccg

SEQ ID NO: 376863 - RNA, 24 nt, Human
caucaaggcaaggccuuaaacaac

SEQ ID NO: 376864 - RNA, 25 nt, Human
caucaaggcaaggccuuaaacaaca

SEQ ID NO: 376865 - RNA, 19 nt, Human
ccccgugugcccgccgguc

SEQ ID NO: 376866 - RNA, 21 nt, Human
ccgccgccgccauaacccgcc

SEQ ID NO: 376867 - RNA, 22 nt, Human
ccucccgcagaccgacgggaac

SEQ ID NO: 376868 - RNA, 23 nt, Human
cuacggcgggggccacagacccc

SEQ ID NO: 376869 - RNA, 24 nt, Human
cucuaaaaaguccuguaaacuuag

SEQ ID NO: 376870 - RNA, 21 nt, Human
cugcuacggcgggggccacag

SEQ ID NO: 376871 - RNA, 22 nt, Human
cuugcagaaaauaaauuccauc

SEQ ID NO: 376872 - RNA, 21 nt, Human
guaaacuaagggcaaauaucu

SEQ ID NO: 376873 - RNA, 19 nt, Human
uaaaagaugguaguuccac

SEQ ID NO: 376874 - RNA, 19 nt, Human
uaaauuccaucaggaagaa

SEQ ID NO: 376875 - RNA, 24 nt, Human
uaagaaaaaacaucagaagacaaa

SEQ ID NO: 376876 - RNA, 18 nt, Human
uaagacucuaaaaagucc

SEQ ID NO: 376877 - RNA, 18 nt, Human
uaaguaaaauguucugca

SEQ ID NO: 376878 - RNA, 18 nt, Human
uagcaagguaauagaaaa

SEQ ID NO: 376879 - RNA, 19 nt, Human
ucaacagacuagaacuaga

SEQ ID NO: 376880 - RNA, 25 nt, Human
ucacugccgccgccgccauaacccg

SEQ ID NO: 376881 - RNA, 19 nt, Human
ucuacucccuacaaugaca

SEQ ID NO: 376882 - RNA, 18 nt, Human
ucugcagguuuacaaagg

SEQ ID NO: 376883 - RNA, 23 nt, Human
ucuucaaguuuggugcacaaaua

SEQ ID NO: 376884 - RNA, 22 nt, Human
ugacaaauacauuagaaaaaaa

SEQ ID NO: 376885 - RNA, 19 nt, Human
ugcaacacaauauacaaau

SEQ ID NO: 376886 - RNA, 20 nt, Human
ugcccgccggucucaggagc

SEQ ID NO: 376887 - RNA, 20 nt, Human
uggaaacauuuucacagcag

SEQ ID NO: 376888 - RNA, 24 nt, Human
uggaaacauuuucacagcaguuaa

SEQ ID NO: 376889 - RNA, 22 nt, Human
uggcucucuuaaauaucagaau

SEQ ID NO: 376890 - RNA, 23 nt, Human
uucaucugcaacacaauauacaa

SEQ ID NO: 376891 - RNA, 21 nt, Human
uucaucuucaaguuuggugca

SEQ ID NO: 376892 - RNA, 19 nt, Human
uucuugugucuucuaccau

SEQ ID NO: 376893 - RNA, 24 nt, Human
uucuugugucuucuaccauucacu

SEQ ID NO: 376894 - RNA, 22 nt, Human
uugaagggauuaauaauuauua

SEQ ID NO: 376895 - RNA, 22 nt, Human
uuggcucucuuaaauaucagaa

SEQ ID NO: 376896 - RNA, 21 nt, Human
uuggugcacaaauauguaaga

SEQ ID NO: 376897 - RNA, 25 nt, Human
uuuauaaaacgaaaaaagaaaauaa

SEQ ID NO: 376898 - RNA, 21 nt, Human
uuugggagaacaaaaggcaga

SEQ ID NO: 376899 - RNA, 26 nt, Human
aaacgacucacaaacacaggacuccg

SEQ ID NO: 376900 - RNA, 23 nt, Human
acuacugagggccgcgagaggaa

SEQ ID NO: 376901 - RNA, 24 nt, Human
acugcaugcgugacuagaccagca

SEQ ID NO: 376902 - RNA, 25 nt, Human
caacacugcaugcgugacuagacca

SEQ ID NO: 376903 - RNA, 19 nt, Human
cagccacacugggaacgac

SEQ ID NO: 376904 - RNA, 21 nt, Human
cauccccaacacugcaugcgu

SEQ ID NO: 376905 - RNA, 22 nt, Human
cccaacacugcaugcgugacua

SEQ ID NO: 376906 - RNA, 23 nt, Human
ccccaacacugcaugcgugacua

SEQ ID NO: 376907 - RNA, 21 nt, Human
ccggagcccagugccugggcc

SEQ ID NO: 376908 - RNA, 22 nt, Human
ccucaacuugcaccaguccaca

SEQ ID NO: 376909 - RNA, 19 nt, Human
ccucuggguggccucagcc

SEQ ID NO: 376910 - RNA, 23 nt, Human
cgacugucuauaacccugggaac

SEQ ID NO: 376911 - RNA, 18 nt, Human
cucagagcaguaaaaacc

SEQ ID NO: 376912 - RNA, 20 nt, Human
cucagagcaguaaaaaccaa

SEQ ID NO: 376913 - RNA, 21 nt, Human
cuccggagcccagugccuggg

SEQ ID NO: 376914 - RNA, 20 nt, Human
gaaaagcaacucaggguggc

SEQ ID NO: 376915 - RNA, 21 nt, Human
gacuagaccagcaagaagucc

SEQ ID NO: 376916 - RNA, 27 nt, Human
gagcaguaaaaaccaaggcauccccaa

SEQ ID NO: 376917 - RNA, 20 nt, Human
gagccacaggaacuggggcg

SEQ ID NO: 376918 - RNA, 18 nt, Human
gauaaccuuccccauagg

SEQ ID NO: 376919 - RNA, 28 nt, Human
gcacugauaaccuuccccaaccggaggg

SEQ ID NO: 376920 - RNA, 19 nt, Human
gcagggacuacugagggcc

SEQ ID NO: 376921 - RNA, 22 nt, Human
gccacacugggaacgacugucu

SEQ ID NO: 376922 - RNA, 19 nt, Human
ggagcccagugccugggcc

SEQ ID NO: 376923 - RNA, 22 nt, Human
ggguccuuucauguccgauccc

SEQ ID NO: 376924 - RNA, 25 nt, Human
uaaaguaucucaacaauucucagag

SEQ ID NO: 376925 - RNA, 18 nt, Human
ucacaaacacaggacucc

SEQ ID NO: 376926 - RNA, 23 nt, Human
ucagcugaaaagcaacucagggu

SEQ ID NO: 376927 - RNA, 20 nt, Human
uccacauggcagcagggggc

SEQ ID NO: 376928 - RNA, 19 nt, Human
ucucagagcaguaaaaacc

SEQ ID NO: 376929 - RNA, 18 nt, Human
ucugaaugcucugcugcc

SEQ ID NO: 376930 - RNA, 21 nt, Human
ugaaaagcaacucaggguggc

SEQ ID NO: 376931 - RNA, 21 nt, Human
ugacuagaccagcaagaaguc

SEQ ID NO: 376932 - RNA, 20 nt, Human
ugagcuggaugacagggccg

SEQ ID NO: 376933 - RNA, 20 nt, Human
ugcagagaaacuuaaaauca

SEQ ID NO: 376934 - RNA, 18 nt, Human
ugcagggacuacugaggg

SEQ ID NO: 376935 - RNA, 21 nt, Human
ugcgugacuagaccagcaaga

SEQ ID NO: 376936 - RNA, 26 nt, Human
ugcucugcugccucuggguggccuca

SEQ ID NO: 376937 - RNA, 20 nt, Human
uggaugacagggccgcugga

SEQ ID NO: 376938 - RNA, 21 nt, Human
uggaugacagggccgcuggag

SEQ ID NO: 376939 - RNA, 20 nt, Human
uggcagcagggggcaguggu

SEQ ID NO: 376940 - RNA, 25 nt, Human
uggcagcagggggcaguggugaguc

SEQ ID NO: 376941 - RNA, 21 nt, Human
ugggaacgacugucuauaacc

SEQ ID NO: 376942 - RNA, 19 nt, Human
uggugaguccuccggagcc

SEQ ID NO: 376943 - RNA, 18 nt, Human
uguccgauccccuuagca

SEQ ID NO: 376944 - RNA, 21 nt, Human
uuuuccaacuacacaguuuau

SEQ ID NO: 376945 - RNA, 18 nt, Human
aaaauagacuccgcccuc

SEQ ID NO: 376946 - RNA, 18 nt, Human
aaauccuagcgccggccc

SEQ ID NO: 376947 - RNA, 19 nt, Human
acuccgcccucagccaucc

SEQ ID NO: 376948 - RNA, 20 nt, Human
cacaacucuagcagccaggc

SEQ ID NO: 376949 - RNA, 23 nt, Human
cacccccuagcucaggcuccgcc

SEQ ID NO: 376950 - RNA, 18 nt, Human
caccgcgcgacgcaucgu

SEQ ID NO: 376951 - RNA, 24 nt, Human
cacuguccuggccugaccuucagc

SEQ ID NO: 376952 - RNA, 24 nt, Human
caucgugcuagcuacacgcaucuc

SEQ ID NO: 376953 - RNA, 19 nt, Human
ccacacccccuagcucagg

SEQ ID NO: 376954 - RNA, 21 nt, Human
ccccugccaccacaacucuag

SEQ ID NO: 376955 - RNA, 23 nt, Human
cccgccggguccuccgggagcca

SEQ ID NO: 376956 - RNA, 20 nt, Human
ccggaaagcuaucgagaaca

SEQ ID NO: 376957 - RNA, 26 nt, Human
ccugccccuccugggcugauuggcca

SEQ ID NO: 376958 - RNA, 18 nt, Human
ccuggccugaccuucagc

SEQ ID NO: 376959 - RNA, 22 nt, Human
ccuuccagcaucacgucugguc

SEQ ID NO: 376960 - RNA, 25 nt, Human
cgacgugcuggcccuucccucuugg

SEQ ID NO: 376961 - RNA, 19 nt, Human
cgggacgagcccauuucuc

SEQ ID NO: 376962 - RNA, 22 nt, Human
cucgcucccagaucccuuucuu

SEQ ID NO: 376963 - RNA, 25 nt, Human
cucgcucccagaucccuuucuuccg

SEQ ID NO: 376964 - RNA, 24 nt, Human
cugggcccgccggguccuccggga

SEQ ID NO: 376965 - RNA, 19 nt, Human
gaauuuccccgcccccacc

SEQ ID NO: 376966 - RNA, 21 nt, Human
gccccggggaaccugccccuc

SEQ ID NO: 376967 - RNA, 18 nt, Human
gcccugggucuuaagccc

SEQ ID NO: 376968 - RNA, 26 nt, Human
gccggccccggggaaccugccccucc

SEQ ID NO: 376969 - RNA, 22 nt, Human
gcguaaaauagacuccgcccuc

SEQ ID NO: 376970 - RNA, 18 nt, Human
gcgucgggccagagcguc

SEQ ID NO: 376971 - RNA, 19 nt, Human
gcucuaugcucucugccgu

SEQ ID NO: 376972 - RNA, 23 nt, Human
gcucucugccguuaucgcccggc

SEQ ID NO: 376973 - RNA, 23 nt, Human
ggcccgccggguccuccgggagc

SEQ ID NO: 376974 - RNA, 18 nt, Human
guaaaauagacuccgccc

SEQ ID NO: 376975 - RNA, 18 nt, Human
guaggagcagguggcaag

SEQ ID NO: 376976 - RNA, 22 nt, Human
uagcagccaggccacacccccu

SEQ ID NO: 376977 - RNA, 18 nt, Human
uccccgcccccacccgcg

SEQ ID NO: 376978 - RNA, 19 nt, Human
ucuguuacaucaacgggac

SEQ ID NO: 376979 - RNA, 24 nt, Human
ugagacggggccagggccccugcc

SEQ ID NO: 376980 - RNA, 19 nt, Human
ugaggccuaccccagccag

SEQ ID NO: 376981 - RNA, 22 nt, Human
ugaggccuaccccagccaguac

SEQ ID NO: 376982 - RNA, 23 nt, Human
ugccaccacaacucuagcagcca

SEQ ID NO: 376983 - RNA, 21 nt, Human
uggaauguaggccccgccccc

SEQ ID NO: 376984 - RNA, 23 nt, Human
uggauggggcgaggcugcgggcc

SEQ ID NO: 376985 - RNA, 18 nt, Human
uggccggguaggagcagg

SEQ ID NO: 376986 - RNA, 21 nt, Human
uggccugaccuucagcucucc

SEQ ID NO: 376987 - RNA, 21 nt, Human
ugggucuuaagccauaguagg

SEQ ID NO: 376988 - RNA, 19 nt, Human
ugguaggagcaaggaguca

SEQ ID NO: 376989 - RNA, 22 nt, Human
ugguaggagcaaggagucaggu

SEQ ID NO: 376990 - RNA, 23 nt, Human
ugucauugggcgacgcguaaaau

SEQ ID NO: 376991 - RNA, 22 nt, Human
uguccuggccugaccuucagcc

SEQ ID NO: 376992 - RNA, 21 nt, Human
uuggggacggaggacgcgcau

SEQ ID NO: 376993 - RNA, 19 nt, Human
uuuccccgcccccacccgc

SEQ ID NO: 376994 - RNA, 21 nt, Human
uuuuuuuuuuuuuugagagga

SEQ ID NO: 376995 - RNA, 22 nt, Human
uuuuuuuuuuuuuuuugagagg

SEQ ID NO: 376996 - RNA, 18 nt, Human
uuuuuuuuuuuuuuuuug

SEQ ID NO: 376997 - RNA, 23 nt, Human
acaguccugccucugggccccgg

SEQ ID NO: 376998 - RNA, 23 nt, Human
agccgggguggaguccuggaggg

SEQ ID NO: 376999 - RNA, 24 nt, Human
agggaggcgaagcgggauguggag

SEQ ID NO: 377000 - RNA, 20 nt, Human
cacaguccugccucugggcc

SEQ ID NO: 377001 - RNA, 21 nt, Human
caggggcuggacggucguggg

SEQ ID NO: 377002 - RNA, 20 nt, Human
cccccugagcuacaggagcu

SEQ ID NO: 377003 - RNA, 19 nt, Human
ccccugagcuacaggagcc

SEQ ID NO: 377004 - RNA, 21 nt, Human
ccccugagcuacaggagcccu

SEQ ID NO: 377005 - RNA, 18 nt, Human
cccggcccgccacagucc

SEQ ID NO: 377006 - RNA, 24 nt, Human
ccggcccgccacaguccugccucu

SEQ ID NO: 377007 - RNA, 20 nt, Human
ccucaggauggggugcccgu

SEQ ID NO: 377008 - RNA, 18 nt, Human
ccucugcaagguugccgg

SEQ ID NO: 377009 - RNA, 20 nt, Human
ccuggaguggggggaggggc

SEQ ID NO: 377010 - RNA, 21 nt, Human
cgcccagcuggcgucgggagc

SEQ ID NO: 377011 - RNA, 24 nt, Human
cgcccagcuggcgucgggagccgg

SEQ ID NO: 377012 - RNA, 20 nt, Human
cggggaggccuggcggggcc

SEQ ID NO: 377013 - RNA, 23 nt, Human
cucugggccccgggagcguccuc

SEQ ID NO: 377014 - RNA, 28 nt, Human
cuugagacucccaaggcaguaccccggg

SEQ ID NO: 377015 - RNA, 21 nt, Human
gagguuaaugggugggagggg

SEQ ID NO: 377016 - RNA, 19 nt, Human
gaguggggggaggggcggg

SEQ ID NO: 377017 - RNA, 20 nt, Human
gcccagcuggcgucgggagc

SEQ ID NO: 377018 - RNA, 23 nt, Human
ggaguccuggagggaggcgaagc

SEQ ID NO: 377019 - RNA, 23 nt, Human
ggccuggaguggggggaggggcg

SEQ ID NO: 377020 - RNA, 18 nt, Human
ggcggggccggcgggggc

SEQ ID NO: 377021 - RNA, 20 nt, Human
ggcgucgggagccggggugg

SEQ ID NO: 377022 - RNA, 18 nt, Human
ggggaggccuggcggggc

SEQ ID NO: 377023 - RNA, 18 nt, Human
gugcccgucaggggcugg

SEQ ID NO: 377024 - RNA, 18 nt, Human
uaaugggugggaggggug

SEQ ID NO: 377025 - RNA, 22 nt, Human
uaccccgggucguccucugcaa

SEQ ID NO: 377026 - RNA, 23 nt, Human
ucaggggcuggacggucgugggg

SEQ ID NO: 377027 - RNA, 22 nt, Human
ugacauugcagggccagcacaa

SEQ ID NO: 377028 - RNA, 18 nt, Human
ugcagggcucaggccugc

SEQ ID NO: 377029 - RNA, 23 nt, Human
ugcagggcucaggccugcccccu

SEQ ID NO: 377030 - RNA, 24 nt, Human
ugccucugggccccgggagcgucc

SEQ ID NO: 377031 - RNA, 26 nt, Human
uggagggggccuggaguggggggagg

SEQ ID NO: 377032 - RNA, 20 nt, Human
uggaguggggggaggggcgg

SEQ ID NO: 377033 - RNA, 20 nt, Human
ugggaggagguuaaugggug

SEQ ID NO: 377034 - RNA, 21 nt, Human
ugggaggagguuaaugggugg

SEQ ID NO: 377035 - RNA, 19 nt, Human
uggggcgggugcagggcuc

SEQ ID NO: 377036 - RNA, 22 nt, Human
uggggugcccgucaggggcugg

SEQ ID NO: 377037 - RNA, 20 nt, Human
uugcagggccagcacaaguu

SEQ ID NO: 377038 - RNA, 24 nt, Human
uuuugggaggagguuaaugggugg

SEQ ID NO: 377039 - RNA, 20 nt, Human
aaggauucuuuuuuucuuua

SEQ ID NO: 377040 - RNA, 18 nt, Human
agaaaaaggggaaaugca

SEQ ID NO: 377041 - RNA, 24 nt, Human
aggaaaagagaaaaaggggaaaug

SEQ ID NO: 377042 - RNA, 18 nt, Human
aggagcaaaagccaagaa

SEQ ID NO: 377043 - RNA, 21 nt, Human
agugaagguggucucuccauc

SEQ ID NO: 377044 - RNA, 24 nt, Human
caaugcacaagucaccugggcagu

SEQ ID NO: 377045 - RNA, 26 nt, Human
ccaggagcaaaagccaagaaacaagg

SEQ ID NO: 377046 - RNA, 24 nt, Human
ccagugaagguggucucuccaucu

SEQ ID NO: 377047 - RNA, 18 nt, Human
ccccugcggucuguuacc

SEQ ID NO: 377048 - RNA, 21 nt, Human
ccgcgccggcugucuugcccc

SEQ ID NO: 377049 - RNA, 21 nt, Human
gagcaaaagccaagaaacaaa

SEQ ID NO: 377050 - RNA, 23 nt, Human
gagcaaaagccaagaaacaagga

SEQ ID NO: 377051 - RNA, 20 nt, Human
uaaagcaaugcacaagucac

SEQ ID NO: 377052 - RNA, 19 nt, Human
uauccaucacuacacaugg

SEQ ID NO: 377053 - RNA, 24 nt, Human
ucaccugggcaguaagcuuaacuc

SEQ ID NO: 377054 - RNA, 22 nt, Human
uccaggagcaaaagccaagaaa

SEQ ID NO: 377055 - RNA, 25 nt, Human
ucugccagugaagguggucucucca

SEQ ID NO: 377056 - RNA, 23 nt, Human
uggcugucuuccauaccugcucu

SEQ ID NO: 377057 - RNA, 23 nt, Human
ugucuugccccugcggucuguua

SEQ ID NO: 377058 - RNA, 20 nt, Human
uuaccugcgccacucgcagg

SEQ ID NO: 377059 - RNA, 21 nt, Human
uuccauaccugcucucagaaa

SEQ ID NO: 377060 - RNA, 24 nt, Human
agauggugaagguaggugauucag

SEQ ID NO: 377061 - RNA, 19 nt, Human
agcaaauaagacaagcucc

SEQ ID NO: 377062 - RNA, 20 nt, Human
aggaggaaagaaauggaaaa

SEQ ID NO: 377063 - RNA, 21 nt, Human
aggaggaaagaaauggaaaag

SEQ ID NO: 377064 - RNA, 21 nt, Human
auagcaaauaagacaagcucc

SEQ ID NO: 377065 - RNA, 23 nt, Human
auggaaaagacugaaaaucagug

SEQ ID NO: 377066 - RNA, 24 nt, Human
cccaaaagcucuguauuguuuucu

SEQ ID NO: 377067 - RNA, 18 nt, Human
cccucagaucacagauuc

SEQ ID NO: 377068 - RNA, 19 nt, Human
gaggaaagaaauggaaaag

SEQ ID NO: 377069 - RNA, 27 nt, Human
ggacauuuugagggcucaaacuuggug

SEQ ID NO: 377070 - RNA, 18 nt, Human
guuuauuuuuucccucau

SEQ ID NO: 377071 - RNA, 23 nt, Human
ucuaggaggaaagaaauggaaaa

SEQ ID NO: 377072 - RNA, 23 nt, Human
ucuauagcaaauaagaccggggc

SEQ ID NO: 377073 - RNA, 19 nt, Human
uggaaaagacugaaaauca

SEQ ID NO: 377074 - RNA, 19 nt, Human
uggaaaagacugaaaauca

SEQ ID NO: 377075 - RNA, 21 nt, Human
uggaaaugucuuuauacccuc

SEQ ID NO: 377076 - RNA, 23 nt, Human
uguaaucaggacauuuugagggc

SEQ ID NO: 377077 - RNA, 24 nt, Human
aaacccaucccugccagaccagga

SEQ ID NO: 377078 - RNA, 21 nt, Human
aaagcaaacccaucccugcca

SEQ ID NO: 377079 - RNA, 22 nt, Human
aagcaaagaaaacucuaccugg

SEQ ID NO: 377080 - RNA, 18 nt, Human
aagguggccgggcaggca

SEQ ID NO: 377081 - RNA, 24 nt, Human
aagguggccgggcaggcagggggc

SEQ ID NO: 377082 - RNA, 21 nt, Human
aagucgccuuuccggaccuuc

SEQ ID NO: 377083 - RNA, 22 nt, Human
acaaacaaaagaaacgauucca

SEQ ID NO: 377084 - RNA, 18 nt, Human
agcccccggaagucgccu

SEQ ID NO: 377085 - RNA, 24 nt, Human
agccgcgcuacaccucccaacgcg

SEQ ID NO: 377086 - RNA, 23 nt, Human
agccguuggggucucgcgaucag

SEQ ID NO: 377087 - RNA, 18 nt, Human
aggcaauggaauucaaca

SEQ ID NO: 377088 - RNA, 18 nt, Human
agguggccgggcaggcag

SEQ ID NO: 377089 - RNA, 19 nt, Human
agguggccgggcaggcagg

SEQ ID NO: 377090 - RNA, 24 nt, Human
aucacuucugugaugagaaaagag

SEQ ID NO: 377091 - RNA, 24 nt, Human
caaacaaaagaaacgauuccaaca

SEQ ID NO: 377092 - RNA, 23 nt, Human
caaagcaaacccaucccugccag

SEQ ID NO: 377093 - RNA, 24 nt, Human
caaagcccccggaagucgccuuuc

SEQ ID NO: 377094 - RNA, 18 nt, Human
cagagaaacagaccucaa

SEQ ID NO: 377095 - RNA, 20 nt, Human
cagccgagacgcgcaggcga

SEQ ID NO: 377096 - RNA, 23 nt, Human
cagccgagacgcgcaggcgacgc

SEQ ID NO: 377097 - RNA, 24 nt, Human
cauaaaucagacaaacaaaagaaa

SEQ ID NO: 377098 - RNA, 20 nt, Human
caucccugccagaccaggaa

SEQ ID NO: 377099 - RNA, 21 nt, Human
ccaaagcaaacccaucccugc

SEQ ID NO: 377100 - RNA, 21 nt, Human
ccaacaucacuucugugauga

SEQ ID NO: 377101 - RNA, 24 nt, Human
cccagagaaacagaccucagcccu

SEQ ID NO: 377102 - RNA, 22 nt, Human
cccaucccugccagaccaggaa

SEQ ID NO: 377103 - RNA, 18 nt, Human
ccccucccuuccccaguc

SEQ ID NO: 377104 - RNA, 19 nt, Human
cccucccuuccccaguccu

SEQ ID NO: 377105 - RNA, 25 nt, Human
ccucuauuuaaaaaaagcucacaca

SEQ ID NO: 377106 - RNA, 21 nt, Human
cgcccggccuucucggcgcgc

SEQ ID NO: 377107 - RNA, 22 nt, Human
cgccugcgacacucaacggccc

SEQ ID NO: 377108 - RNA, 18 nt, Human
cgcgcuacaccucccaac

SEQ ID NO: 377109 - RNA, 18 nt, Human
cggcucccgaagguggcc

SEQ ID NO: 377110 - RNA, 24 nt, Human
cuaccucccagagaaacagaccuc

SEQ ID NO: 377111 - RNA, 24 nt, Human
cucaaauccgagucaaucccucua

SEQ ID NO: 377112 - RNA, 19 nt, Human
cucccagagaaacagaccu

SEQ ID NO: 377113 - RNA, 20 nt, Human
cucccagagaaacagaccuc

SEQ ID NO: 377114 - RNA, 19 nt, Human
gaagccccucaacgcgcac

SEQ ID NO: 377115 - RNA, 18 nt, Human
gccaggugccaaagcccc

SEQ ID NO: 377116 - RNA, 24 nt, Human
gccgccugcgacacucaacggccc

SEQ ID NO: 377117 - RNA, 20 nt, Human
gccugcgacacucaacggcc

SEQ ID NO: 377118 - RNA, 20 nt, Human
gggcaggcagggggcggggc

SEQ ID NO: 377119 - RNA, 19 nt, Human
ggggaaggccccuuuuuau

SEQ ID NO: 377120 - RNA, 20 nt, Human
guguggggacgcccggccuu

SEQ ID NO: 377121 - RNA, 27 nt, Human
uaaaaaaaccauaaaucagacaaacaa

SEQ ID NO: 377122 - RNA, 24 nt, Human
uaauaaaaaacuuuuguuuauacu

SEQ ID NO: 377123 - RNA, 20 nt, Human
uagucuccccucccuucccc

SEQ ID NO: 377124 - RNA, 22 nt, Human
ucacucaaauccgagucaaucc

SEQ ID NO: 377125 - RNA, 22 nt, Human
ucagcccuaaugaucacucaaa

SEQ ID NO: 377126 - RNA, 19 nt, Human
ucagccgagacgcgcaggc

SEQ ID NO: 377127 - RNA, 22 nt, Human
uccaacaucacuucugugauga

SEQ ID NO: 377128 - RNA, 18 nt, Human
ucccagagaaacagaccu

SEQ ID NO: 377129 - RNA, 19 nt, Human
ucgccgccugcgacacuca

SEQ ID NO: 377130 - RNA, 18 nt, Human
ucgcgaucaggugcggga

SEQ ID NO: 377131 - RNA, 19 nt, Human
ucugugaugagaaaagagg

SEQ ID NO: 377132 - RNA, 19 nt, Human
uggccgggcaggcaggggg

SEQ ID NO: 377133 - RNA, 21 nt, Human
uuaaaaaaagcucacacauag

SEQ ID NO: 377134 - RNA, 18 nt, Human
uuccccaguccucuuggc

SEQ ID NO: 377135 - RNA, 22 nt, Human
acauucucgucccucaagaggg

SEQ ID NO: 377136 - RNA, 18 nt, Human
caaagcacccgcagguca

SEQ ID NO: 377137 - RNA, 20 nt, Human
caagccccgccccguccccc

SEQ ID NO: 377138 - RNA, 25 nt, Human
caccacccucucugagguggucaug

SEQ ID NO: 377139 - RNA, 22 nt, Human
cagccccgagucccugucccac

SEQ ID NO: 377140 - RNA, 27 nt, Human
cagccccgagucccugucccacccccu

SEQ ID NO: 377141 - RNA, 19 nt, Human
cagcgcagcucuggccucc

SEQ ID NO: 377142 - RNA, 21 nt, Human
caugccuccucgaugaagccg

SEQ ID NO: 377143 - RNA, 21 nt, Human
ccccagccccgagucccuguc

SEQ ID NO: 377144 - RNA, 20 nt, Human
cccccucagcagugccucuu

SEQ ID NO: 377145 - RNA, 21 nt, Human
cccccuuucccccucgagccc

SEQ ID NO: 377146 - RNA, 21 nt, Human
ccccgagucccugucccaccc

SEQ ID NO: 377147 - RNA, 24 nt, Human
ccccgccccgucccccagccccga

SEQ ID NO: 377148 - RNA, 18 nt, Human
ccccucagcagugccucu

SEQ ID NO: 377149 - RNA, 21 nt, Human
cccgccccgucccccagcccc

SEQ ID NO: 377150 - RNA, 21 nt, Human
cgccauggcugcugucagcgc

SEQ ID NO: 377151 - RNA, 18 nt, Human
cgccccgucccccagccc

SEQ ID NO: 377152 - RNA, 22 nt, Human
cgcgcccccucagcagugccuc

SEQ ID NO: 377153 - RNA, 18 nt, Human
ggaaugcgaugaucucau

SEQ ID NO: 377154 - RNA, 21 nt, Human
ucaagagcauguugagguuug

SEQ ID NO: 377155 - RNA, 19 nt, Human
ucaaugucucgcuugcaug

SEQ ID NO: 377156 - RNA, 24 nt, Human
ucaccacguucacauucucguccc

SEQ ID NO: 377157 - RNA, 19 nt, Human
ucccacccccuuucccccu

SEQ ID NO: 377158 - RNA, 21 nt, Human
ucccccagccccgagucccug

SEQ ID NO: 377159 - RNA, 18 nt, Human
uccccucgcgcccccuca

SEQ ID NO: 377160 - RNA, 21 nt, Human
uccccucgcgcccccucagca

SEQ ID NO: 377161 - RNA, 18 nt, Human
uggaaugcgaugaucuca

SEQ ID NO: 377162 - RNA, 19 nt, Human
uggaaugcgaugaucucau

SEQ ID NO: 377163 - RNA, 24 nt, Human
uguccaguagugugggucuuuguu

SEQ ID NO: 377164 - RNA, 22 nt, Human
ugucccacccccuuucccccuc

SEQ ID NO: 377165 - RNA, 20 nt, Human
ugucuccacugccgcucgcu

SEQ ID NO: 377166 - RNA, 19 nt, Human
uuugagcacugugaucuuu

SEQ ID NO: 377167 - RNA, 22 nt, Human
aaaaaggagauucgggugagga

SEQ ID NO: 377168 - RNA, 18 nt, Human
aaaagaaaaaaaaaaagg

SEQ ID NO: 377169 - RNA, 19 nt, Human
aacauggugaaaccccauc

SEQ ID NO: 377170 - RNA, 20 nt, Human
aacauggugaaaccccaucu

SEQ ID NO: 377171 - RNA, 21 nt, Human
aacauggugaaaccccaucuc

SEQ ID NO: 377172 - RNA, 21 nt, Human
aacauggugaaaccccaucuc

SEQ ID NO: 377173 - RNA, 21 nt, Human
aagaggugggugaggaggcaa

SEQ ID NO: 377174 - RNA, 21 nt, Human
aagcagcugggcaugguggug

SEQ ID NO: 377175 - RNA, 21 nt, Human
aaggugcuggaggcuggcuga

SEQ ID NO: 377176 - RNA, 24 nt, Human
aaucgccugaacuuaggaggcaga

SEQ ID NO: 377177 - RNA, 19 nt, Human
acaaagcgaaacucugucu

SEQ ID NO: 377178 - RNA, 20 nt, Human
acaaagcgaaacucugucuc

SEQ ID NO: 377179 - RNA, 24 nt, Human
acaaagcgaaacucugucucaaaa

SEQ ID NO: 377180 - RNA, 24 nt, Human
agagguugcagugaacugagaucg

SEQ ID NO: 377181 - RNA, 22 nt, Human
agaucaccugaggucaggaguu

SEQ ID NO: 377182 - RNA, 24 nt, Human
agcacuuugggaggcugaggcagg

SEQ ID NO: 377183 - RNA, 24 nt, Human
agccuagccaacauggugaaaccc

SEQ ID NO: 377184 - RNA, 22 nt, Human
agccugggcgacaaagcgaaac

SEQ ID NO: 377185 - RNA, 24 nt, Human
agccugggcgacaaagcgaaacuc

SEQ ID NO: 377186 - RNA, 18 nt, Human
agcgagggggcaguggga

SEQ ID NO: 377187 - RNA, 23 nt, Human
agcugggcaugguggugggugcc

SEQ ID NO: 377188 - RNA, 20 nt, Human
aggcagagguugcagugaac

SEQ ID NO: 377189 - RNA, 24 nt, Human
aggcagagguugcagugaacugag

SEQ ID NO: 377190 - RNA, 18 nt, Human
aggcaggagaaucgccug

SEQ ID NO: 377191 - RNA, 19 nt, Human
aggcaggagcaagagcugg

SEQ ID NO: 377192 - RNA, 22 nt, Human
aggcagguagaucaccugaggu

SEQ ID NO: 377193 - RNA, 26 nt, Human
aggcagguagaucaccugaggucagg

SEQ ID NO: 377194 - RNA, 22 nt, Human
aggcgcuaguugugggugcugg

SEQ ID NO: 377195 - RNA, 24 nt, Human
aggcucaugucuguaaucucagca

SEQ ID NO: 377196 - RNA, 21 nt, Human
aggcugaggcagguagaucac

SEQ ID NO: 377197 - RNA, 24 nt, Human
agggugccggguggaaacauggga

SEQ ID NO: 377198 - RNA, 19 nt, Human
aggucaggaguuugagacc

SEQ ID NO: 377199 - RNA, 19 nt, Human
aggugcuggaggcuggcuu

SEQ ID NO: 377200 - RNA, 20 nt, Human
aucaccugaggucaggaguu

SEQ ID NO: 377201 - RNA, 24 nt, Human
aucaccugaggucaggaguuugag

SEQ ID NO: 377202 - RNA, 19 nt, Human
augucuguaaucucagcac

SEQ ID NO: 377203 - RNA, 24 nt, Human
auugcacuccagccugggcgacaa

SEQ ID NO: 377204 - RNA, 19 nt, Human
caaaagaaaaaaaaaaagg

SEQ ID NO: 377205 - RNA, 24 nt, Human
caacauggugaaaccccaucucua

SEQ ID NO: 377206 - RNA, 23 nt, Human
caccugaggucaggaguuugaga

SEQ ID NO: 377207 - RNA, 24 nt, Human
cagcacuuugggaggcugaggcag

SEQ ID NO: 377208 - RNA, 24 nt, Human
cagcacuuugggaggcugaggcag

SEQ ID NO: 377209 - RNA, 18 nt, Human
caggagcaagagcuggga

SEQ ID NO: 377210 - RNA, 24 nt, Human
caggcaggagcaagagcugggacc

SEQ ID NO: 377211 - RNA, 24 nt, Human
cagguagaucaccugaggucagga

SEQ ID NO: 377212 - RNA, 22 nt, Human
caugguggugggugccuguaau

SEQ ID NO: 377213 - RNA, 24 nt, Human
caugucuguaaucucagcacuuug

SEQ ID NO: 377214 - RNA, 19 nt, Human
cauugcacuccagccuggg

SEQ ID NO: 377215 - RNA, 20 nt, Human
cauugcacuccagccugggc

SEQ ID NO: 377216 - RNA, 20 nt, Human
cauugcacuccagccugggc

SEQ ID NO: 377217 - RNA, 21 nt, Human
cauugcacuccagccugggcg

SEQ ID NO: 377218 - RNA, 22 nt, Human
cauugcacuccagccugggcga

SEQ ID NO: 377219 - RNA, 24 nt, Human
cauugcacuccagccugggcgaca

SEQ ID NO: 377220 - RNA, 24 nt, Human
ccuagccaacauggugaaacccca

SEQ ID NO: 377221 - RNA, 22 nt, Human
ccugaggucaggaguuugagac

SEQ ID NO: 377222 - RNA, 20 nt, Human
ccugggcgacaaagcgaaac

SEQ ID NO: 377223 - RNA, 23 nt, Human
cgaaacucugucucaaaagaaaa

SEQ ID NO: 377224 - RNA, 24 nt, Human
cgagggggcagugggauggugaga

SEQ ID NO: 377225 - RNA, 21 nt, Human
cgugcauugcacuccagccug

SEQ ID NO: 377226 - RNA, 22 nt, Human
cucaaaagaaaaaaaaaaagga

SEQ ID NO: 377227 - RNA, 23 nt, Human
cucaaaagaaaaaaaaaaaggag

SEQ ID NO: 377228 - RNA, 22 nt, Human
cucaugaggauucagagugaag

SEQ ID NO: 377229 - RNA, 24 nt, Human
cucaugucuguaaucucagcacuu

SEQ ID NO: 377230 - RNA, 20 nt, Human
cucuaccaaaaauacaaaaa

SEQ ID NO: 377231 - RNA, 22 nt, Human
cucuaccaaaaauacaaaaaag

SEQ ID NO: 377232 - RNA, 21 nt, Human
cugcccaggcgcuaguugugg

SEQ ID NO: 377233 - RNA, 22 nt, Human
cuggcugagauuccggccucca

SEQ ID NO: 377234 - RNA, 22 nt, Human
cugggugaggauggcagcagga

SEQ ID NO: 377235 - RNA, 21 nt, Human
cuguaaucucagcacuuuggg

SEQ ID NO: 377236 - RNA, 19 nt, Human
gacaaagcgaaacucuguc

SEQ ID NO: 377237 - RNA, 21 nt, Human
gacaaagcgaaacucugucuc

SEQ ID NO: 377238 - RNA, 23 nt, Human
gagaccagccuagccaacauggu

SEQ ID NO: 377239 - RNA, 24 nt, Human
gaucaccugaggucaggaguuuga

SEQ ID NO: 377240 - RNA, 20 nt, Human
gcacuggggccaggucacuc

SEQ ID NO: 377241 - RNA, 21 nt, Human
gcauugcacuccagccugggc

SEQ ID NO: 377242 - RNA, 24 nt, Human
gcauugcacuccagccugggcgac

SEQ ID NO: 377243 - RNA, 24 nt, Human
gccaacauggugaaaccccaucuc

SEQ ID NO: 377244 - RNA, 23 nt, Human
gcgacaaagcgaaacucugucuc

SEQ ID NO: 377245 - RNA, 18 nt, Human
ggaccggcucggcugaua

SEQ ID NO: 377246 - RNA, 23 nt, Human
ggaggcucaugucuguaaucuca

SEQ ID NO: 377247 - RNA, 24 nt, Human
ggaggcucaugucuguaaucucag

SEQ ID NO: 377248 - RNA, 19 nt, Human
ggcaggagcaagagcuggg

SEQ ID NO: 377249 - RNA, 22 nt, Human
ggcagugggauggugagaggga

SEQ ID NO: 377250 - RNA, 23 nt, Human
ggcaugguggugggugccuguaa

SEQ ID NO: 377251 - RNA, 20 nt, Human
ggcucaugucuguaaucuca

SEQ ID NO: 377252 - RNA, 21 nt, Human
ggcucaugucuguaaucucag

SEQ ID NO: 377253 - RNA, 23 nt, Human
gggcagugggauggugagaggga

SEQ ID NO: 377254 - RNA, 19 nt, Human
ggucaggaguuugagacca

SEQ ID NO: 377255 - RNA, 21 nt, Human
ggugccggguggaaacauggg

SEQ ID NO: 377256 - RNA, 24 nt, Human
gguggugggugccuguaaucucag

SEQ ID NO: 377257 - RNA, 21 nt, Human
uaccaaaaauacaaaaaagca

SEQ ID NO: 377258 - RNA, 22 nt, Human
uaccaaaaauacaaaaaagcag

SEQ ID NO: 377259 - RNA, 23 nt, Human
uagaucaccugaggucaggaguu

SEQ ID NO: 377260 - RNA, 24 nt, Human
uagaucaccugaggucaggaguuu

SEQ ID NO: 377261 - RNA, 27 nt, Human
uagaucaccugaggucaggaguuugag

SEQ ID NO: 377262 - RNA, 21 nt, Human
uaguugugggugcugggugag

SEQ ID NO: 377263 - RNA, 19 nt, Human
ucacuccaccaccucccga

SEQ ID NO: 377264 - RNA, 22 nt, Human
ucagggugccggguggaaacau

SEQ ID NO: 377265 - RNA, 22 nt, Human
ucaugaggauucagagugaaga

SEQ ID NO: 377266 - RNA, 19 nt, Human
ucauucaguccacagacgu

SEQ ID NO: 377267 - RNA, 22 nt, Human
uccagccugggcgacaaagcga

SEQ ID NO: 377268 - RNA, 26 nt, Human
uccagggcugagaagccucaugagga

SEQ ID NO: 377269 - RNA, 21 nt, Human
ucgugcauugcacuccagccu

SEQ ID NO: 377270 - RNA, 23 nt, Human
ucugucucaaaagaaaaaaaaaa

SEQ ID NO: 377271 - RNA, 24 nt, Human
ucugucucaaaagaaaaaaaaaaa

SEQ ID NO: 377272 - RNA, 19 nt, Human
ugaagaggugggugaggag

SEQ ID NO: 377273 - RNA, 23 nt, Human
ugagaccagccuagccaacaugg

SEQ ID NO: 377274 - RNA, 18 nt, Human
ugagaucgugcauugcac

SEQ ID NO: 377275 - RNA, 23 nt, Human
ugagaucgugcauugcacuccag

SEQ ID NO: 377276 - RNA, 25 nt, Human
ugagaucgugcauugcacuccagcc

SEQ ID NO: 377277 - RNA, 20 nt, Human
ugaggcaggagaaucgccug

SEQ ID NO: 377278 - RNA, 23 nt, Human
ugaggcaggagaaucgccugaac

SEQ ID NO: 377279 - RNA, 24 nt, Human
ugaggcaggagaaucgccugaacu

SEQ ID NO: 377280 - RNA, 25 nt, Human
ugaggcaggagaaucgccugaacuu

SEQ ID NO: 377281 - RNA, 20 nt, Human
ugaggcagguagaucaccug

SEQ ID NO: 377282 - RNA, 26 nt, Human
ugaggcagguagaucaccugagguca

SEQ ID NO: 377283 - RNA, 18 nt, Human
ugaggucaggaguuugag

SEQ ID NO: 377284 - RNA, 21 nt, Human
ugcacuccagccugggcgaca

SEQ ID NO: 377285 - RNA, 22 nt, Human
ugcauugcacuccagccugggc

SEQ ID NO: 377286 - RNA, 25 nt, Human
ugccagcccugcccugcccaggcgc

SEQ ID NO: 377287 - RNA, 20 nt, Human
ugcccaggcgcuaguugugg

SEQ ID NO: 377288 - RNA, 23 nt, Human
ugccuguaaucucaguuacucgg

SEQ ID NO: 377289 - RNA, 24 nt, Human
ugccuguaaucucaguuacucggg

SEQ ID NO: 377290 - RNA, 20 nt, Human
uggaggcuggcugagauucc

SEQ ID NO: 377291 - RNA, 22 nt, Human
uggcagcaggaaauccagggcu

SEQ ID NO: 377292 - RNA, 18 nt, Human
ugggagcgagggggcagu

SEQ ID NO: 377293 - RNA, 20 nt, Human
ugggaggcugaggcagguag

SEQ ID NO: 377294 - RNA, 24 nt, Human
ugggaggcugaggcagguagauca

SEQ ID NO: 377295 - RNA, 19 nt, Human
ugggugaggaggcaaggcg

SEQ ID NO: 377296 - RNA, 21 nt, Human
uggugagagggaaggugcugg

SEQ ID NO: 377297 - RNA, 22 nt, Human
uggugggugccuguaaucucag

SEQ ID NO: 377298 - RNA, 24 nt, Human
ugguggugggugccuguaaucuca

SEQ ID NO: 377299 - RNA, 23 nt, Human
ugucuguaaucucagcacuuugg

SEQ ID NO: 377300 - RNA, 25 nt, Human
uucagagugaagaggugggugagga

SEQ ID NO: 377301 - RNA, 28 nt, Human
uuccaggcaaacaggcaggagcaagagc

SEQ ID NO: 377302 - RNA, 21 nt, Human
uugcagugaacugagaucgug

SEQ ID NO: 377303 - RNA, 22 nt, Human
uugcagugaacugagaucgugc

SEQ ID NO: 377304 - RNA, 25 nt, Human
uugggaggcugaggcagguagauca

SEQ ID NO: 377305 - RNA, 23 nt, Human
aaaauuaaugaaaagccucuggc

SEQ ID NO: 377306 - RNA, 22 nt, Human
accccuaaaguauaaaggcaaa

SEQ ID NO: 377307 - RNA, 24 nt, Human
caccacaauucauuugcaacaucu

SEQ ID NO: 377308 - RNA, 26 nt, Human
caccacaauucauuugcaacaucuca

SEQ ID NO: 377309 - RNA, 24 nt, Human
cccuaaaguauaaaggcaaaggaa

SEQ ID NO: 377310 - RNA, 24 nt, Human
cuaaaguauaaaggcaaaggaaaa

SEQ ID NO: 377311 - RNA, 18 nt, Human
cuccagaagccccugucc

SEQ ID NO: 377312 - RNA, 25 nt, Human
gaaaauguaagaagaaaccgguacc

SEQ ID NO: 377313 - RNA, 24 nt, Human
uaagaccccuaaaguauaaaggcu

SEQ ID NO: 377314 - RNA, 23 nt, Human
ucugagcgggcggcgucgguguc

SEQ ID NO: 377315 - RNA, 19 nt, Human
ugccagaagcuccagaagc

SEQ ID NO: 377316 - RNA, 23 nt, Human
ugucucuauagaggcaagaauug

SEQ ID NO: 377317 - RNA, 23 nt, Human
uuaguuguaucguagaagguaaa

SEQ ID NO: 377318 - RNA, 21 nt, Human
uuuucaaaaauaauuuaaagg

SEQ ID NO: 377319 - RNA, 18 nt, Human
aaaaaauaaacaacaaca

SEQ ID NO: 377320 - RNA, 23 nt, Human
aaaaagaccaaaaccacccacug

SEQ ID NO: 377321 - RNA, 24 nt, Human
aaaagaccaaaaccacccacugua

SEQ ID NO: 377322 - RNA, 19 nt, Human
aacccaggguuugcuucca

SEQ ID NO: 377323 - RNA, 19 nt, Human
aagaaagcaaacauucuac

SEQ ID NO: 377324 - RNA, 23 nt, Human
aagagauagauaugugggccaga

SEQ ID NO: 377325 - RNA, 23 nt, Human
aagcaaacauucuacuucuaagg

SEQ ID NO: 377326 - RNA, 22 nt, Human
aagcagaaaugaaagaggggac

SEQ ID NO: 377327 - RNA, 24 nt, Human
aagcauggaacuccaauuugcacu

SEQ ID NO: 377328 - RNA, 20 nt, Human
aaggaaaugggggaacuuca

SEQ ID NO: 377329 - RNA, 21 nt, Human
aaguauccagacaccaauuuu

SEQ ID NO: 377330 - RNA, 24 nt, Human
acaacaaaaaaaaaacacaacacc

SEQ ID NO: 377331 - RNA, 21 nt, Human
acacccuuucucccauacaaa

SEQ ID NO: 377332 - RNA, 25 nt, Human
accaaaaccacccacuguagaaugg

SEQ ID NO: 377333 - RNA, 22 nt, Human
accuuggugccuuggagucuua

SEQ ID NO: 377334 - RNA, 19 nt, Human
acgaagccaaaggacuuug

SEQ ID NO: 377335 - RNA, 18 nt, Human
acuagguuuuugcuacau

SEQ ID NO: 377336 - RNA, 20 nt, Human
acugugccacgggacagggc

SEQ ID NO: 377337 - RNA, 23 nt, Human
acuucccuauccaaaaaauaaac

SEQ ID NO: 377338 - RNA, 20 nt, Human
agacuccaaugaguuuaguu

SEQ ID NO: 377339 - RNA, 24 nt, Human
agagagcaacaauggagaagagac

SEQ ID NO: 377340 - RNA, 21 nt, Human
agaggcuugcuuggguggcug

SEQ ID NO: 377341 - RNA, 21 nt, Human
agaggcuuucaguaacucugc

SEQ ID NO: 377342 - RNA, 20 nt, Human
agauagauaugugggccaga

SEQ ID NO: 377343 - RNA, 28 nt, Human
aggcaagagauagauaugugggccagag

SEQ ID NO: 377344 - RNA, 18 nt, Human
aguagaacaagcauggaa

SEQ ID NO: 377345 - RNA, 20 nt, Human
agugguucacccuguuccua

SEQ ID NO: 377346 - RNA, 21 nt, Human
aucacaugcuuguuggaaaaa

SEQ ID NO: 377347 - RNA, 18 nt, Human
augaugcuacuguauuca

SEQ ID NO: 377348 - RNA, 21 nt, Human
augcaccuacucaggacuaca

SEQ ID NO: 377349 - RNA, 20 nt, Human
auggagaagagaccuuggug

SEQ ID NO: 377350 - RNA, 23 nt, Human
augguggaacaaaauucugggau

SEQ ID NO: 377351 - RNA, 18 nt, Human
auuaguaucuugucacuu

SEQ ID NO: 377352 - RNA, 22 nt, Human
auuucaucuacaauagggacaa

SEQ ID NO: 377353 - RNA, 23 nt, Human
caaaaaauaaacaacaacaaaaa

SEQ ID NO: 377354 - RNA, 22 nt, Human
caaaaucagaauccucugggaa

SEQ ID NO: 377355 - RNA, 24 nt, Human
caacaaaaaaaaaacacaacaccc

SEQ ID NO: 377356 - RNA, 24 nt, Human
cacacacauacagucuuucuguac

SEQ ID NO: 377357 - RNA, 23 nt, Human
cacgggacagggcuugcacuuga

SEQ ID NO: 377358 - RNA, 24 nt, Human
cagccugcaggcuacaagagccaa

SEQ ID NO: 377359 - RNA, 24 nt, Human
caggguuauuuacgaagccaaagg

SEQ ID NO: 377360 - RNA, 23 nt, Human
caucacuauuucaucuacaauag

SEQ ID NO: 377361 - RNA, 19 nt, Human
caugguggaacaaaauucu

SEQ ID NO: 377362 - RNA, 27 nt, Human
ccaaaaaauaaacaacaacaaaaaaaa

SEQ ID NO: 377363 - RNA, 26 nt, Human
ccagagaggcuugcuuggguggcuga

SEQ ID NO: 377364 - RNA, 25 nt, Human
ccaguagaacaagcauggaacucca

SEQ ID NO: 377365 - RNA, 24 nt, Human
cccacuguagaaugggcucuugga

SEQ ID NO: 377366 - RNA, 24 nt, Human
ccuauccaaaaaauaaacaacaac

SEQ ID NO: 377367 - RNA, 22 nt, Human
ccuggggagcaggugcuugcgg

SEQ ID NO: 377368 - RNA, 23 nt, Human
cgaaugcugucaugucaaaguga

SEQ ID NO: 377369 - RNA, 22 nt, Human
cggguauagagagcaacaaugg

SEQ ID NO: 377370 - RNA, 24 nt, Human
cgugauuuuuaauauacuucauag

SEQ ID NO: 377371 - RNA, 19 nt, Human
cguggagagcuccaaacca

SEQ ID NO: 377372 - RNA, 25 nt, Human
cucguggagagcuccaaaccaaucc

SEQ ID NO: 377373 - RNA, 20 nt, Human
cucugggagacagggacagg

SEQ ID NO: 377374 - RNA, 18 nt, Human
cugaauuaaggccggggc

SEQ ID NO: 377375 - RNA, 22 nt, Human
cugugcaggcacuccuuucugc

SEQ ID NO: 377376 - RNA, 24 nt, Human
cugugcaggcacuccuuucugccu

SEQ ID NO: 377377 - RNA, 18 nt, Human
gaacuccaauuugcacuu

SEQ ID NO: 377378 - RNA, 24 nt, Human
gaagagacuuccucagccugcagg

SEQ ID NO: 377379 - RNA, 18 nt, Human
gaaguauccagacaccaa

SEQ ID NO: 377380 - RNA, 23 nt, Human
gaaguauccagacaccaauuuuu

SEQ ID NO: 377381 - RNA, 19 nt, Human
gaauguagagaugaugacc

SEQ ID NO: 377382 - RNA, 20 nt, Human
gacuacuguuugguacuugu

SEQ ID NO: 377383 - RNA, 22 nt, Human
gagggcugcauuuuaccuucag

SEQ ID NO: 377384 - RNA, 20 nt, Human
gcaguaacgggggcaggggg

SEQ ID NO: 377385 - RNA, 18 nt, Human
gcaucucauuaccuuacu

SEQ ID NO: 377386 - RNA, 21 nt, Human
gcugacacacagggcggucug

SEQ ID NO: 377387 - RNA, 27 nt, Human
gcuugcggcugacacacagggguuucc

SEQ ID NO: 377388 - RNA, 23 nt, Human
gcuugcuuggguggcugauucug

SEQ ID NO: 377389 - RNA, 23 nt, Human
ggagaaacagauacaaaaucucc

SEQ ID NO: 377390 - RNA, 20 nt, Human
ggagacagggacagggccca

SEQ ID NO: 377391 - RNA, 18 nt, Human
ggaugagcagggggacag

SEQ ID NO: 377392 - RNA, 24 nt, Human
ggccaucugagccgcagaccaugg

SEQ ID NO: 377393 - RNA, 18 nt, Human
gggaacaagcaguugucc

SEQ ID NO: 377394 - RNA, 22 nt, Human
gggggauuggucagcugccacu

SEQ ID NO: 377395 - RNA, 24 nt, Human
ggggguuccaaucugaggagggcu

SEQ ID NO: 377396 - RNA, 25 nt, Human
gguaacaagaagaaaaaaaugugag

SEQ ID NO: 377397 - RNA, 21 nt, Human
gguacuuguaucugggccagc

SEQ ID NO: 377398 - RNA, 21 nt, Human
gguggcucaggcucugggaga

SEQ ID NO: 377399 - RNA, 20 nt, Human
guacuuguaucugggccagc

SEQ ID NO: 377400 - RNA, 29 nt, Human
gugcuugcggcugacacacagggguuucc

SEQ ID NO: 377401 - RNA, 28 nt, Human
gugcuugcggcugacacacaggguuucc

SEQ ID NO: 377402 - RNA, 23 nt, Human
guuuauguggcuuuuguguggaa

SEQ ID NO: 377403 - RNA, 24 nt, Human
uaaaaagaccaaaaccacccacug

SEQ ID NO: 377404 - RNA, 23 nt, Human
uaaaacaaacacuauggugaaga

SEQ ID NO: 377405 - RNA, 25 nt, Human
uaaaacaaacacuauggugaagaac

SEQ ID NO: 377406 - RNA, 22 nt, Human
uaaccaugguggaacaaaauuc

SEQ ID NO: 377407 - RNA, 18 nt, Human
uaacgggggcagggggaa

SEQ ID NO: 377408 - RNA, 21 nt, Human
uaagauaauuaggcaaauuaa

SEQ ID NO: 377409 - RNA, 25 nt, Human
uacaguuaagcauuuacuauuaacc

SEQ ID NO: 377410 - RNA, 22 nt, Human
uacaugcaugcauauuuaugca

SEQ ID NO: 377411 - RNA, 22 nt, Human
uaccaaauuuggaacuagacuc

SEQ ID NO: 377412 - RNA, 22 nt, Human
uaccuguaucaaaugaggaagu

SEQ ID NO: 377413 - RNA, 23 nt, Human
uacuauuaaccaaagaguugugu

SEQ ID NO: 377414 - RNA, 22 nt, Human
uacuguacagcguggucaaggu

SEQ ID NO: 377415 - RNA, 18 nt, Human
uacuuggucacuauacaa

SEQ ID NO: 377416 - RNA, 18 nt, Human
uagaaugggcucuuggau

SEQ ID NO: 377417 - RNA, 23 nt, Human
uaggacacccugauaaaugaaaa

SEQ ID NO: 377418 - RNA, 21 nt, Human
uaguacucauggaaaguauua

SEQ ID NO: 377419 - RNA, 22 nt, Human
uaguucauuucuuaucuaagac

SEQ ID NO: 377420 - RNA, 19 nt, Human
uauaaaaagaccaaaacca

SEQ ID NO: 377421 - RNA, 21 nt, Human
uauaaaaagaccaaaaccacc

SEQ ID NO: 377422 - RNA, 22 nt, Human
uauaaaaagaccaaaaccaccc

SEQ ID NO: 377423 - RNA, 22 nt, Human
uauaaaaagaccaaaaccaccc

SEQ ID NO: 377424 - RNA, 23 nt, Human
uaucugggccagcuugauaggga

SEQ ID NO: 377425 - RNA, 21 nt, Human
ucaauuuuaauuuguucucuu

SEQ ID NO: 377426 - RNA, 20 nt, Human
ucagagaacaggagauaugu

SEQ ID NO: 377427 - RNA, 18 nt, Human
ucaggauuugaugggcuc

SEQ ID NO: 377428 - RNA, 21 nt, Human
ucaggguuauuuacgaagcca

SEQ ID NO: 377429 - RNA, 18 nt, Human
ucccaaaacagaguuugc

SEQ ID NO: 377430 - RNA, 22 nt, Human
ucuacaauagggacaacaaacu

SEQ ID NO: 377431 - RNA, 22 nt, Human
ucuuuaagugucaucuuaauuu

SEQ ID NO: 377432 - RNA, 25 nt, Human
ugaaggaaaugggggaacuucagag

SEQ ID NO: 377433 - RNA, 22 nt, Human
ugagaucccaaaacagaguuug

SEQ ID NO: 377434 - RNA, 21 nt, Human
ugagccgcagaccauggcuga

SEQ ID NO: 377435 - RNA, 24 nt, Human
ugauagggagagaaauccuaagga

SEQ ID NO: 377436 - RNA, 26 nt, Human
ugcaaaaaaggacuuuaauacaaauu

SEQ ID NO: 377437 - RNA, 22 nt, Human
ugcaugccuuagaaaaagcccu

SEQ ID NO: 377438 - RNA, 22 nt, Human
ugccuagaauauugguagaaac

SEQ ID NO: 377439 - RNA, 24 nt, Human
ugccuggggagcaggugcuugcgg

SEQ ID NO: 377440 - RNA, 19 nt, Human
ugcugcuguggguaggaaa

SEQ ID NO: 377441 - RNA, 20 nt, Human
ugcuugcggcugacacacag

SEQ ID NO: 377442 - RNA, 19 nt, Human
uggaaaaaucucacagaaa

SEQ ID NO: 377443 - RNA, 20 nt, Human
uggauggguccagggcuugg

SEQ ID NO: 377444 - RNA, 18 nt, Human
uggcaaauaacuaaccau

SEQ ID NO: 377445 - RNA, 20 nt, Human
uggcaucucauuaccuuacu
